United States Patent 7,691,997 (FUNCTIONAL AND HYPERFUNCTIONAL SIRNA) - sequence listing, part 12

SEQ ID NO: 458768 - RNA, 19 nt, Homo sapiens
gggcuagaauccgggaguu

SEQ ID NO: 458769 - RNA, 19 nt, Homo sapiens
gcuguggucauuuaggaaa

SEQ ID NO: 458770 - RNA, 19 nt, Homo sapiens
ucauuggccugcccuucaa

SEQ ID NO: 458771 - RNA, 19 nt, Homo sapiens
gacauuguggugagacuga

SEQ ID NO: 458772 - RNA, 19 nt, Homo sapiens
gaauugacgacuaugacau

SEQ ID NO: 458773 - RNA, 19 nt, Homo sapiens
caagacaaucugaucaaag

SEQ ID NO: 458774 - RNA, 19 nt, Homo sapiens
caagccagcacccauguuc

SEQ ID NO: 458775 - RNA, 19 nt, Homo sapiens
caaucaguguuugguguau

SEQ ID NO: 458776 - RNA, 19 nt, Homo sapiens
cguggaagcuacacuuacu

SEQ ID NO: 458777 - RNA, 19 nt, Homo sapiens
ucgcaggauuuggcuauga

SEQ ID NO: 458778 - RNA, 19 nt, Homo sapiens
ucaaaggucaagacaaucu

SEQ ID NO: 458779 - RNA, 19 nt, Homo sapiens
aagcucgcgucaucacuga

SEQ ID NO: 458780 - RNA, 19 nt, Homo sapiens
gauggcuucuggaaaucug

SEQ ID NO: 458781 - RNA, 19 nt, Homo sapiens
cgaauccucaacccauauu

SEQ ID NO: 458782 - RNA, 19 nt, Homo sapiens
agaaggacgugggcagcaa

SEQ ID NO: 458783 - RNA, 19 nt, Homo sapiens
aaucacuucuccaaucagu

SEQ ID NO: 458784 - RNA, 19 nt, Homo sapiens
gaccagcacucagccucau

SEQ ID NO: 458785 - RNA, 19 nt, Homo sapiens
gaauccucaacccauauuu

SEQ ID NO: 458786 - RNA, 19 nt, Homo sapiens
gcaguacgagcgcgauucu

SEQ ID NO: 458787 - RNA, 19 nt, Homo sapiens
cguaaaucaugugaagaug

SEQ ID NO: 458788 - RNA, 19 nt, Homo sapiens
ccagggcuauagcagaaag

SEQ ID NO: 458789 - RNA, 19 nt, Homo sapiens
ccucaacccauauuucauc

SEQ ID NO: 458790 - RNA, 19 nt, Homo sapiens
gagcaguacgagcgcgauu

SEQ ID NO: 458791 - RNA, 19 nt, Homo sapiens
cgaauugacgacuaugaca

SEQ ID NO: 458792 - RNA, 19 nt, Homo sapiens
uuaaauaagguuggagaug

SEQ ID NO: 458793 - RNA, 19 nt, Homo sapiens
aaacacuaggcucagagua

SEQ ID NO: 458794 - RNA, 19 nt, Homo sapiens
cugaauuagccaccaagua

SEQ ID NO: 458795 - RNA, 19 nt, Homo sapiens
gggaagugaggcccaagga

SEQ ID NO: 458796 - RNA, 19 nt, Homo sapiens
uucagugguucuuuccuuu

SEQ ID NO: 458797 - RNA, 19 nt, Homo sapiens
aaucaguguuugguguauu

SEQ ID NO: 458798 - RNA, 19 nt, Homo sapiens
uucgaauccucaacccaua

SEQ ID NO: 458799 - RNA, 19 nt, Homo sapiens
ggaucaaaggucaagacaa

SEQ ID NO: 458800 - RNA, 19 nt, Homo sapiens
gcuagcccucugccucuuu

SEQ ID NO: 458801 - RNA, 19 nt, Homo sapiens
cagcagccagcaccaccua

SEQ ID NO: 458802 - RNA, 19 nt, Homo sapiens
ggacgcagccuuugcauua

SEQ ID NO: 458803 - RNA, 19 nt, Homo sapiens
gaucaaaggucaagacaau

SEQ ID NO: 458804 - RNA, 19 nt, Homo sapiens
gcccaggccugcugaauua

SEQ ID NO: 458805 - RNA, 19 nt, Homo sapiens
ugaaauacaucgucuacaa

SEQ ID NO: 458806 - RNA, 19 nt, Homo sapiens
gaucaaagccaucuuguca

SEQ ID NO: 458807 - RNA, 19 nt, Homo sapiens
ggaaucacuucuccaauca

SEQ ID NO: 458808 - RNA, 19 nt, Homo sapiens
ggugaaagcucgcgucauc

SEQ ID NO: 458809 - RNA, 19 nt, Homo sapiens
ggagaagccuguugcagau

SEQ ID NO: 458810 - RNA, 19 nt, Homo sapiens
uaaauaagguuggagaugu

SEQ ID NO: 458811 - RNA, 19 nt, Homo sapiens
auaaagcucuucccugaaa

SEQ ID NO: 458812 - RNA, 19 nt, Homo sapiens
gguuggagaugucaaguug

SEQ ID NO: 458813 - RNA, 19 nt, Homo sapiens
ggauuuggcuaugacauga

SEQ ID NO: 458814 - RNA, 19 nt, Homo sapiens
cgagcgcgauucucucuuu

SEQ ID NO: 458815 - RNA, 19 nt, Homo sapiens
ugacuccgcuggacaaaca

SEQ ID NO: 458816 - RNA, 19 nt, Homo sapiens
ucaagacaaucugaucaaa

SEQ ID NO: 458817 - RNA, 19 nt, Homo sapiens
ggaggguagggauaauuua

SEQ ID NO: 458818 - RNA, 19 nt, Homo sapiens
cggaaucacuucuccaauc

SEQ ID NO: 458819 - RNA, 19 nt, Homo sapiens
ucaaagccaucuugucagu

SEQ ID NO: 458820 - RNA, 19 nt, Homo sapiens
gagcgaggacgcagccuuu

SEQ ID NO: 458821 - RNA, 19 nt, Homo sapiens
ggccugcccuucaacaaug

SEQ ID NO: 458822 - RNA, 19 nt, Homo sapiens
guuccuggaugacuccuuu

SEQ ID NO: 458823 - RNA, 19 nt, Homo sapiens
gaaaucguaaaucauguga

SEQ ID NO: 458824 - RNA, 19 nt, Homo sapiens
gugguuggguucugccuuu

SEQ ID NO: 458825 - RNA, 19 nt, Homo sapiens
ucuaagcaguggcaucuga

SEQ ID NO: 458826 - RNA, 19 nt, Homo sapiens
ucggauggcuucuggaaau

SEQ ID NO: 458827 - RNA, 19 nt, Homo sapiens
gaaauacaucgucuacaag

SEQ ID NO: 458828 - RNA, 19 nt, Homo sapiens
gacaaacacuaggcucaga

SEQ ID NO: 458829 - RNA, 19 nt, Homo sapiens
aaagccaucuugucaguca

SEQ ID NO: 458830 - RNA, 19 nt, Homo sapiens
guaaguauagucacucuag

SEQ ID NO: 458831 - RNA, 19 nt, Homo sapiens
gggaggguagggauaauuu

SEQ ID NO: 458832 - RNA, 19 nt, Homo sapiens
ugacgacuaugacauugug

SEQ ID NO: 458833 - RNA, 19 nt, Homo sapiens
ucuccgcuguggucauuua

SEQ ID NO: 458834 - RNA, 19 nt, Homo sapiens
gcaggaagaggcccacuag

SEQ ID NO: 458835 - RNA, 19 nt, Homo sapiens
gaugggacucuugguauuu

SEQ ID NO: 458836 - RNA, 19 nt, Homo sapiens
ugaauuagccaccaaguac

SEQ ID NO: 458837 - RNA, 19 nt, Homo sapiens
uaggaaaucguaaaucaug

SEQ ID NO: 458838 - RNA, 19 nt, Homo sapiens
aaucguaaaucaugugaag

SEQ ID NO: 458839 - RNA, 19 nt, Homo sapiens
acacuaggcucagaguaug

SEQ ID NO: 458840 - RNA, 19 nt, Homo sapiens
cagauucagugguucuuuc

SEQ ID NO: 458841 - RNA, 19 nt, Homo sapiens
ggccuugacugcauauugg

SEQ ID NO: 458842 - RNA, 19 nt, Homo sapiens
uccugaaucuggacucuaa

SEQ ID NO: 458843 - RNA, 19 nt, Homo sapiens
ggaaaucguaaaucaugug

SEQ ID NO: 458844 - RNA, 19 nt, Homo sapiens
gaugacuccuuucgcaagu

SEQ ID NO: 458845 - RNA, 19 nt, Homo sapiens
gagcgcgauucucucuuug

SEQ ID NO: 458846 - RNA, 19 nt, Homo sapiens
gaaggacgugggcagcaaa

SEQ ID NO: 458847 - RNA, 19 nt, Homo sapiens
gaggcguucuugccaacaa

SEQ ID NO: 458848 - RNA, 19 nt, Homo sapiens
gggaguucgugccgccuuu

SEQ ID NO: 458849 - RNA, 19 nt, Homo sapiens
caaggcugcugccggaauc

SEQ ID NO: 458850 - RNA, 19 nt, Homo sapiens
agaugggacucuugguauu

SEQ ID NO: 458851 - RNA, 19 nt, Homo sapiens
aaucuggacucuaaacucu

SEQ ID NO: 458852 - RNA, 19 nt, Homo sapiens
ucaccaacuugccacaugu

SEQ ID NO: 458853 - RNA, 19 nt, Homo sapiens
gaucuaagcaguggcaucu

SEQ ID NO: 458854 - RNA, 19 nt, Homo sapiens
caauauccagcgagagaaa

SEQ ID NO: 458855 - RNA, 19 nt, Homo sapiens
cacaauauccagcgagaga

SEQ ID NO: 458856 - RNA, 19 nt, Homo sapiens
cagugguucuuuccuuuga

SEQ ID NO: 458857 - RNA, 19 nt, Homo sapiens
gaagccuguugcagauuca

SEQ ID NO: 458858 - RNA, 19 nt, Homo sapiens
ggucaagacaaucugauca

SEQ ID NO: 458859 - RNA, 19 nt, Homo sapiens
cuacacaggagucuucaga

SEQ ID NO: 458860 - RNA, 19 nt, Homo sapiens
gaggacuccaguaaguaua

SEQ ID NO: 458861 - RNA, 19 nt, Homo sapiens
cuucaacaauggccucaug

SEQ ID NO: 458862 - RNA, 19 nt, Homo sapiens
gcgcgauucucucuuuguc

SEQ ID NO: 458863 - RNA, 19 nt, Homo sapiens
aucaguguuugguguauua

SEQ ID NO: 458864 - RNA, 19 nt, Homo sapiens
ccucuccgcuguggucauu

SEQ ID NO: 458865 - RNA, 19 nt, Homo sapiens
gcagauucagugguucuuu

SEQ ID NO: 458866 - RNA, 19 nt, Homo sapiens
aaauaagguuggagauguc

SEQ ID NO: 458867 - RNA, 19 nt, Homo sapiens
agaagccuguugcagauuc

SEQ ID NO: 458868 - RNA, 19 nt, Homo sapiens
gcaaggcugcugccggaau

SEQ ID NO: 458869 - RNA, 19 nt, Homo sapiens
ccagcgagagaaagaguuu

SEQ ID NO: 458870 - RNA, 19 nt, Homo sapiens
gguggcagucgcaggauuu

SEQ ID NO: 458871 - RNA, 19 nt, Homo sapiens
cgacacugcgcaucaccua

SEQ ID NO: 458872 - RNA, 19 nt, Homo sapiens
caucuugucagucaccaaa

SEQ ID NO: 458873 - RNA, 19 nt, Homo sapiens
aagacaaucugaucaaagc

SEQ ID NO: 458874 - RNA, 19 nt, Homo sapiens
gggcuagaauccgggaguu

SEQ ID NO: 458875 - RNA, 19 nt, Homo sapiens
ccgcuguggucauuuagga

SEQ ID NO: 458876 - RNA, 19 nt, Homo sapiens
gcuguggucauuuaggaaa

SEQ ID NO: 458877 - RNA, 19 nt, Homo sapiens
ucauuggccugcccuucaa

SEQ ID NO: 458878 - RNA, 19 nt, Homo sapiens
gacauuguggugagacuga

SEQ ID NO: 458879 - RNA, 19 nt, Homo sapiens
gaauugacgacuaugacau

SEQ ID NO: 458880 - RNA, 19 nt, Homo sapiens
caagacaaucugaucaaag

SEQ ID NO: 458881 - RNA, 19 nt, Homo sapiens
caagccagcacccauguuc

SEQ ID NO: 458882 - RNA, 19 nt, Homo sapiens
caaucaguguuugguguau

SEQ ID NO: 458883 - RNA, 19 nt, Homo sapiens
ucgcaggauuuggcuauga

SEQ ID NO: 458884 - RNA, 19 nt, Homo sapiens
ucaaaggucaagacaaucu

SEQ ID NO: 458885 - RNA, 19 nt, Homo sapiens
cguggaagcuacacuuacu

SEQ ID NO: 458886 - RNA, 19 nt, Homo sapiens
gaaucuggacucuaaacuc

SEQ ID NO: 458887 - RNA, 19 nt, Homo sapiens
ggacuccaguaaguauagu

SEQ ID NO: 458888 - RNA, 19 nt, Homo sapiens
aagcucgcgucaucacuga

SEQ ID NO: 458889 - RNA, 19 nt, Homo sapiens
gauggcuucuggaaaucug

SEQ ID NO: 458890 - RNA, 19 nt, Homo sapiens
cgaauccucaacccauauu

SEQ ID NO: 458891 - RNA, 19 nt, Homo sapiens
agaaggacgugggcagcaa

SEQ ID NO: 458892 - RNA, 19 nt, Homo sapiens
aaucacuucuccaaucagu

SEQ ID NO: 458893 - RNA, 19 nt, Homo sapiens
gaccagcacucagccucau

SEQ ID NO: 458894 - RNA, 19 nt, Homo sapiens
gaauccucaacccauauuu

SEQ ID NO: 458895 - RNA, 19 nt, Homo sapiens
gcaguacgagcgcgauucu

SEQ ID NO: 458896 - RNA, 19 nt, Homo sapiens
cguaaaucaugugaagaug

SEQ ID NO: 458897 - RNA, 19 nt, Homo sapiens
ucuggacucuaaacucuca

SEQ ID NO: 458898 - RNA, 19 nt, Homo sapiens
ccagggcuauagcagaaag

SEQ ID NO: 458899 - RNA, 19 nt, Homo sapiens
uguugcagauucagugguu

SEQ ID NO: 458900 - RNA, 19 nt, Homo sapiens
ccucaacccauauuucauc

SEQ ID NO: 458901 - RNA, 19 nt, Homo sapiens
gagcaguacgagcgcgauu

SEQ ID NO: 458902 - RNA, 19 nt, Homo sapiens
uaaacugccugcugaauua

SEQ ID NO: 458903 - RNA, 19 nt, Homo sapiens
gaucaaaggucaagacaau

SEQ ID NO: 458904 - RNA, 19 nt, Homo sapiens
ugaaauacaucgucuacaa

SEQ ID NO: 458905 - RNA, 19 nt, Homo sapiens
gaucaaagccaucuuguca

SEQ ID NO: 458906 - RNA, 19 nt, Homo sapiens
ggaaucacuucuccaauca

SEQ ID NO: 458907 - RNA, 19 nt, Homo sapiens
ggugaaagcucgcgucauc

SEQ ID NO: 458908 - RNA, 19 nt, Homo sapiens
ggagaagccuguugcagau

SEQ ID NO: 458909 - RNA, 19 nt, Homo sapiens
uaaauaagguuggagaugu

SEQ ID NO: 458910 - RNA, 19 nt, Homo sapiens
auaaagcucuucccugaaa

SEQ ID NO: 458911 - RNA, 19 nt, Homo sapiens
gguuggagaugucaaguug

SEQ ID NO: 458912 - RNA, 19 nt, Homo sapiens
ggauuuggcuaugacauga

SEQ ID NO: 458913 - RNA, 19 nt, Homo sapiens
cgagcgcgauucucucuuu

SEQ ID NO: 458914 - RNA, 19 nt, Homo sapiens
ugacuccgcuggacaaaca

SEQ ID NO: 458915 - RNA, 19 nt, Homo sapiens
ucaagacaaucugaucaaa

SEQ ID NO: 458916 - RNA, 19 nt, Homo sapiens
ggaggguagggauaauuua

SEQ ID NO: 458917 - RNA, 19 nt, Homo sapiens
cggaaucacuucuccaauc

SEQ ID NO: 458918 - RNA, 19 nt, Homo sapiens
ucaaagccaucuugucagu

SEQ ID NO: 458919 - RNA, 19 nt, Homo sapiens
ggccugcccuucaacaaug

SEQ ID NO: 458920 - RNA, 19 nt, Homo sapiens
gaaaucguaaaucauguga

SEQ ID NO: 458921 - RNA, 19 nt, Homo sapiens
guuccuggaugacuccuuu

SEQ ID NO: 458922 - RNA, 19 nt, Homo sapiens
gugguuggguucugccuuu

SEQ ID NO: 458923 - RNA, 19 nt, Homo sapiens
ucuaagcaguggcaucuga

SEQ ID NO: 458924 - RNA, 19 nt, Homo sapiens
ucggauggcuucuggaaau

SEQ ID NO: 458925 - RNA, 19 nt, Homo sapiens
gaaauacaucgucuacaag

SEQ ID NO: 458926 - RNA, 19 nt, Homo sapiens
gacaaacacuaggcucaga

SEQ ID NO: 458927 - RNA, 19 nt, Homo sapiens
aaagccaucuugucaguca

SEQ ID NO: 458928 - RNA, 19 nt, Homo sapiens
guaaguauagucacucuag

SEQ ID NO: 458929 - RNA, 19 nt, Homo sapiens
gggaggguagggauaauuu

SEQ ID NO: 458930 - RNA, 19 nt, Homo sapiens
ugacgacuaugacauugug

SEQ ID NO: 458931 - RNA, 19 nt, Homo sapiens
ucuccgcuguggucauuua

SEQ ID NO: 458932 - RNA, 19 nt, Homo sapiens
gaugggacucuugguauuu

SEQ ID NO: 458933 - RNA, 19 nt, Homo sapiens
gcaggaagaggcccacuag

SEQ ID NO: 458934 - RNA, 19 nt, Homo sapiens
ugaauuagccaccaaguac

SEQ ID NO: 458935 - RNA, 19 nt, Homo sapiens
aaucguaaaucaugugaag

SEQ ID NO: 458936 - RNA, 19 nt, Homo sapiens
uaggaaaucguaaaucaug

SEQ ID NO: 458937 - RNA, 19 nt, Homo sapiens
acacuaggcucagaguaug

SEQ ID NO: 458938 - RNA, 19 nt, Homo sapiens
cagauucagugguucuuuc

SEQ ID NO: 458939 - RNA, 19 nt, Homo sapiens
cuaaacugccugcugaauu

SEQ ID NO: 458940 - RNA, 19 nt, Homo sapiens
uccugaaucuggacucuaa

SEQ ID NO: 458941 - RNA, 19 nt, Homo sapiens
gaugacuccuuucgcaagu

SEQ ID NO: 458942 - RNA, 19 nt, Homo sapiens
ggaaaucguaaaucaugug

SEQ ID NO: 458943 - RNA, 19 nt, Homo sapiens
gagcgcgauucucucuuug

SEQ ID NO: 458944 - RNA, 19 nt, Homo sapiens
gaaggacgugggcagcaaa

SEQ ID NO: 458945 - RNA, 19 nt, Homo sapiens
gaggcguucuugccaacaa

SEQ ID NO: 458946 - RNA, 19 nt, Homo sapiens
gggaguucgugccgccuuu

SEQ ID NO: 458947 - RNA, 19 nt, Homo sapiens
caaggcugcugccggaauc

SEQ ID NO: 458948 - RNA, 19 nt, Homo sapiens
agaugggacucuugguauu

SEQ ID NO: 458949 - RNA, 19 nt, Homo sapiens
ucaccaacuugccacaugu

SEQ ID NO: 458950 - RNA, 19 nt, Homo sapiens
gaucuaagcaguggcaucu

SEQ ID NO: 458951 - RNA, 19 nt, Homo sapiens
caauauccagcgagagaaa

SEQ ID NO: 458952 - RNA, 19 nt, Homo sapiens
cacaauauccagcgagaga

SEQ ID NO: 458953 - RNA, 19 nt, Homo sapiens
gaaucuggacucuaaacug

SEQ ID NO: 458954 - RNA, 19 nt, Homo sapiens
cagugguucuuuccuuuga

SEQ ID NO: 458955 - RNA, 19 nt, Homo sapiens
gaagccuguugcagauuca

SEQ ID NO: 458956 - RNA, 19 nt, Homo sapiens
ggucaagacaaucugauca

SEQ ID NO: 458957 - RNA, 19 nt, Homo sapiens
cuacacaggagucuucaga

SEQ ID NO: 458958 - RNA, 19 nt, Homo sapiens
cuucaacaauggccucaug

SEQ ID NO: 458959 - RNA, 19 nt, Homo sapiens
gcgcgauucucucuuuguc

SEQ ID NO: 458960 - RNA, 19 nt, Homo sapiens
gaggacuccaguaaguaua

SEQ ID NO: 458961 - RNA, 19 nt, Homo sapiens
aucaguguuugguguauua

SEQ ID NO: 458962 - RNA, 19 nt, Homo sapiens
ccucuccgcuguggucauu

SEQ ID NO: 458963 - RNA, 19 nt, Homo sapiens
gcagauucagugguucuuu

SEQ ID NO: 458964 - RNA, 19 nt, Homo sapiens
aaauaagguuggagauguc

SEQ ID NO: 458965 - RNA, 19 nt, Homo sapiens
ccgcuguggucauuuagga

SEQ ID NO: 458966 - RNA, 19 nt, Homo sapiens
gcaaggcugcugccggaau

SEQ ID NO: 458967 - RNA, 19 nt, Homo sapiens
agaagccuguugcagauuc

SEQ ID NO: 458968 - RNA, 19 nt, Homo sapiens
ccagcgagagaaagaguuu

SEQ ID NO: 458969 - RNA, 19 nt, Homo sapiens
gguggcagucgcaggauuu

SEQ ID NO: 458970 - RNA, 19 nt, Homo sapiens
cgacacugcgcaucaccua

SEQ ID NO: 458971 - RNA, 19 nt, Homo sapiens
caucuugucagucaccaaa

SEQ ID NO: 458972 - RNA, 19 nt, Homo sapiens
aagacaaucugaucaaagc

SEQ ID NO: 458973 - RNA, 19 nt, Homo sapiens
gggcuagaauccgggaguu

SEQ ID NO: 458974 - RNA, 19 nt, Homo sapiens
gcuguggucauuuaggaaa

SEQ ID NO: 458975 - RNA, 19 nt, Homo sapiens
ucauuggccugcccuucaa

SEQ ID NO: 458976 - RNA, 19 nt, Homo sapiens
gacauuguggugagacuga

SEQ ID NO: 458977 - RNA, 19 nt, Homo sapiens
gaauugacgacuaugacau

SEQ ID NO: 458978 - RNA, 19 nt, Homo sapiens
caagacaaucugaucaaag

SEQ ID NO: 458979 - RNA, 19 nt, Homo sapiens
caagccagcacccauguuc

SEQ ID NO: 458980 - RNA, 19 nt, Homo sapiens
caaucaguguuugguguau

SEQ ID NO: 458981 - RNA, 19 nt, Homo sapiens
cguggaagcuacacuuacu

SEQ ID NO: 458982 - RNA, 19 nt, Homo sapiens
ucgcaggauuuggcuauga

SEQ ID NO: 458983 - RNA, 19 nt, Homo sapiens
ucaaaggucaagacaaucu

SEQ ID NO: 458984 - RNA, 19 nt, Homo sapiens
ggacuccaguaaguauagu

SEQ ID NO: 458985 - RNA, 19 nt, Homo sapiens
aagcucgcgucaucacuga

SEQ ID NO: 458986 - RNA, 19 nt, Homo sapiens
gauggcuucuggaaaucug

SEQ ID NO: 458987 - RNA, 19 nt, Homo sapiens
cgaauccucaacccauauu

SEQ ID NO: 458988 - RNA, 19 nt, Homo sapiens
agaaggacgugggcagcaa

SEQ ID NO: 458989 - RNA, 19 nt, Homo sapiens
aaucacuucuccaaucagu

SEQ ID NO: 458990 - RNA, 19 nt, Homo sapiens
gaccagcacucagccucau

SEQ ID NO: 458991 - RNA, 19 nt, Homo sapiens
cguaaaucaugugaagaug

SEQ ID NO: 458992 - RNA, 19 nt, Homo sapiens
gaauccucaacccauauuu

SEQ ID NO: 458993 - RNA, 19 nt, Homo sapiens
gcaguacgagcgcgauucu

SEQ ID NO: 458994 - RNA, 19 nt, Homo sapiens
ccagggcuauagcagaaag

SEQ ID NO: 458995 - RNA, 19 nt, Homo sapiens
gagaagccuguugcagauu

SEQ ID NO: 458996 - RNA, 19 nt, Homo sapiens
ccucaacccauauuucauc

SEQ ID NO: 458997 - RNA, 19 nt, Homo sapiens
gagcaguacgagcgcgauu

SEQ ID NO: 458998 - RNA, 19 nt, Homo sapiens
uguugcagauucagugguu

SEQ ID NO: 458999 - RNA, 19 nt, Homo sapiens
cgaauugacgacuaugaca

SEQ ID NO: 459000 - RNA, 19 nt, Homo sapiens
uuaaauaagguuggagaug

SEQ ID NO: 459001 - RNA, 19 nt, Homo sapiens
aaacacuaggcucagagua

SEQ ID NO: 459002 - RNA, 19 nt, Homo sapiens
uaaacugccugcugaauua

SEQ ID NO: 459003 - RNA, 19 nt, Homo sapiens
ggaaucacuucuccaauca

SEQ ID NO: 459004 - RNA, 19 nt, Homo sapiens
ggugaaagcucgcgucauc

SEQ ID NO: 459005 - RNA, 19 nt, Homo sapiens
ggagaagccuguugcagau

SEQ ID NO: 459006 - RNA, 19 nt, Homo sapiens
uaaauaagguuggagaugu

SEQ ID NO: 459007 - RNA, 19 nt, Homo sapiens
auaaagcucuucccugaaa

SEQ ID NO: 459008 - RNA, 19 nt, Homo sapiens
gguuggagaugucaaguug

SEQ ID NO: 459009 - RNA, 19 nt, Homo sapiens
ugacuccgcuggacaaaca

SEQ ID NO: 459010 - RNA, 19 nt, Homo sapiens
ggaggguagggauaauuua

SEQ ID NO: 459011 - RNA, 19 nt, Homo sapiens
cggaaucacuucuccaauc

SEQ ID NO: 459012 - RNA, 19 nt, Homo sapiens
guuccuggaugacuccuuu

SEQ ID NO: 459013 - RNA, 19 nt, Homo sapiens
gaaaucguaaaucauguga

SEQ ID NO: 459014 - RNA, 19 nt, Homo sapiens
gugguuggguucugccuuu

SEQ ID NO: 459015 - RNA, 19 nt, Homo sapiens
ucuaagcaguggcaucuga

SEQ ID NO: 459016 - RNA, 19 nt, Homo sapiens
gacaaacacuaggcucaga

SEQ ID NO: 459017 - RNA, 19 nt, Homo sapiens
guaaguauagucacucuag

SEQ ID NO: 459018 - RNA, 19 nt, Homo sapiens
gggaggguagggauaauuu

SEQ ID NO: 459019 - RNA, 19 nt, Homo sapiens
ucuccgcuguggucauuua

SEQ ID NO: 459020 - RNA, 19 nt, Homo sapiens
gcaggaagaggcccacuag

SEQ ID NO: 459021 - RNA, 19 nt, Homo sapiens
ugaauuagccaccaaguac

SEQ ID NO: 459022 - RNA, 19 nt, Homo sapiens
gaugggacucuugguauuu

SEQ ID NO: 459023 - RNA, 19 nt, Homo sapiens
uaggaaaucguaaaucaug

SEQ ID NO: 459024 - RNA, 19 nt, Homo sapiens
acacuaggcucagaguaug

SEQ ID NO: 459025 - RNA, 19 nt, Homo sapiens
aaucguaaaucaugugaag

SEQ ID NO: 459026 - RNA, 19 nt, Homo sapiens
cagauucagugguucuuuc

SEQ ID NO: 459027 - RNA, 19 nt, Homo sapiens
cuaaacugccugcugaauu

SEQ ID NO: 459028 - RNA, 19 nt, Homo sapiens
uccugaaucuggacucuaa

SEQ ID NO: 459029 - RNA, 19 nt, Homo sapiens
ggaaaucguaaaucaugug

SEQ ID NO: 459030 - RNA, 19 nt, Homo sapiens
gaugacuccuuucgcaagu

SEQ ID NO: 459031 - RNA, 19 nt, Homo sapiens
gggaguucgugccgccuuu

SEQ ID NO: 459032 - RNA, 19 nt, Homo sapiens
caaggcugcugccggaauc

SEQ ID NO: 459033 - RNA, 19 nt, Homo sapiens
agaugggacucuugguauu

SEQ ID NO: 459034 - RNA, 19 nt, Homo sapiens
ucaccaacuugccacaugu

SEQ ID NO: 459035 - RNA, 19 nt, Homo sapiens
gaucuaagcaguggcaucu

SEQ ID NO: 459036 - RNA, 19 nt, Homo sapiens
caauauccagcgagagaaa

SEQ ID NO: 459037 - RNA, 19 nt, Homo sapiens
cacaauauccagcgagaga

SEQ ID NO: 459038 - RNA, 19 nt, Homo sapiens
gaaucuggacucuaaacug

SEQ ID NO: 459039 - RNA, 19 nt, Homo sapiens
cagugguucuuuccuuuga

SEQ ID NO: 459040 - RNA, 19 nt, Homo sapiens
gaagccuguugcagauuca

SEQ ID NO: 459041 - RNA, 19 nt, Homo sapiens
cuacacaggagucuucaga

SEQ ID NO: 459042 - RNA, 19 nt, Homo sapiens
gaggacuccaguaaguaua

SEQ ID NO: 459043 - RNA, 19 nt, Homo sapiens
aucaguguuugguguauua

SEQ ID NO: 459044 - RNA, 19 nt, Homo sapiens
ccucuccgcuguggucauu

SEQ ID NO: 459045 - RNA, 19 nt, Homo sapiens
gcagauucagugguucuuu

SEQ ID NO: 459046 - RNA, 19 nt, Homo sapiens
aaauaagguuggagauguc

SEQ ID NO: 459047 - RNA, 19 nt, Homo sapiens
gcaaggcugcugccggaau

SEQ ID NO: 459048 - RNA, 19 nt, Homo sapiens
ccagcgagagaaagaguuu

SEQ ID NO: 459049 - RNA, 19 nt, Homo sapiens
gggcuagaauccgggaguu

SEQ ID NO: 459050 - RNA, 19 nt, Homo sapiens
ccgcuguggucauuuagga

SEQ ID NO: 459051 - RNA, 19 nt, Homo sapiens
agaagccuguugcagauuc

SEQ ID NO: 459052 - RNA, 19 nt, Homo sapiens
gcuguggucauuuaggaaa

SEQ ID NO: 459053 - RNA, 19 nt, Homo sapiens
caagccagcacccauguuc

SEQ ID NO: 459054 - RNA, 19 nt, Homo sapiens
caaucaguguuugguguau

SEQ ID NO: 459055 - RNA, 19 nt, Homo sapiens
cguggaagcuacacuuacu

SEQ ID NO: 459056 - RNA, 19 nt, Homo sapiens
ggacuccaguaaguauagu

SEQ ID NO: 459057 - RNA, 19 nt, Homo sapiens
aagcucgcgucaucacuga

SEQ ID NO: 459058 - RNA, 19 nt, Homo sapiens
cguaaaucaugugaagaug

SEQ ID NO: 459059 - RNA, 19 nt, Homo sapiens
aaucacuucuccaaucagu

SEQ ID NO: 459060 - RNA, 19 nt, Homo sapiens
gaccagcacucagccucau

SEQ ID NO: 459061 - RNA, 19 nt, Homo sapiens
ccagggcuauagcagaaag

SEQ ID NO: 459062 - RNA, 19 nt, Homo sapiens
uguugcagauucagugguu

SEQ ID NO: 459063 - RNA, 19 nt, Homo sapiens
gagaagccuguugcagauu

SEQ ID NO: 459064 - RNA, 19 nt, Homo sapiens
uuaaauaagguuggagaug

SEQ ID NO: 459065 - RNA, 19 nt, Homo sapiens
cugaauuagccaccaagua

SEQ ID NO: 459066 - RNA, 19 nt, Homo sapiens
aaacacuaggcucagagua

SEQ ID NO: 459067 - RNA, 19 nt, Homo sapiens
gggaagugaggcccaagga

SEQ ID NO: 459068 - RNA, 19 nt, Homo sapiens
aaucaguguuugguguauu

SEQ ID NO: 459069 - RNA, 19 nt, Homo sapiens
uucagugguucuuuccuuu

SEQ ID NO: 459070 - RNA, 19 nt, Homo sapiens
gcuagcccucugccucuuu

SEQ ID NO: 459071 - RNA, 19 nt, Homo sapiens
cagcagccagcaccaccua

SEQ ID NO: 459072 - RNA, 19 nt, Homo sapiens
cccagcacauggccauaga

SEQ ID NO: 459073 - RNA, 19 nt, Homo sapiens
uggaagcaauaaagcucuu

SEQ ID NO: 459074 - RNA, 19 nt, Homo sapiens
gcuauagcagaaagaacuu

SEQ ID NO: 459075 - RNA, 19 nt, Homo sapiens
gcagccagcaccaccuaca

SEQ ID NO: 459076 - RNA, 19 nt, Homo sapiens
gccuuuagccuggaccaaa

SEQ ID NO: 459077 - RNA, 19 nt, Homo sapiens
caguaaguauagucacucu

SEQ ID NO: 459078 - RNA, 19 nt, Homo sapiens
ugcggaagcuggugaaagc

SEQ ID NO: 459079 - RNA, 19 nt, Homo sapiens
uguauuauucugcguggaa

SEQ ID NO: 459080 - RNA, 19 nt, Homo sapiens
uaaacugccugcugaauua

SEQ ID NO: 459081 - RNA, 19 nt, Homo sapiens
gaucaaaggucaagacaau

SEQ ID NO: 459082 - RNA, 19 nt, Homo sapiens
ugaaauacaucgucuacaa

SEQ ID NO: 459083 - RNA, 19 nt, Homo sapiens
gaucaaagccaucuuguca

SEQ ID NO: 459084 - RNA, 19 nt, Homo sapiens
ggaaucacuucuccaauca

SEQ ID NO: 459085 - RNA, 19 nt, Homo sapiens
ggugaaagcucgcgucauc

SEQ ID NO: 459086 - RNA, 19 nt, Homo sapiens
uaaauaagguuggagaugu

SEQ ID NO: 459087 - RNA, 19 nt, Homo sapiens
auaaagcucuucccugaaa

SEQ ID NO: 459088 - RNA, 19 nt, Homo sapiens
gguuggagaugucaaguug

SEQ ID NO: 459089 - RNA, 19 nt, Homo sapiens
ggacuccaauucagugguu

SEQ ID NO: 459090 - RNA, 19 nt, Homo sapiens
cgagcgcgauucucucuuu

SEQ ID NO: 459091 - RNA, 19 nt, Homo sapiens
ugacuccgcuggacaaaca

SEQ ID NO: 459092 - RNA, 19 nt, Homo sapiens
ccaauucagugguucuuuc

SEQ ID NO: 459093 - RNA, 19 nt, Homo sapiens
ucaagacaaucugaucaaa

SEQ ID NO: 459094 - RNA, 19 nt, Homo sapiens
ggaggguagggauaauuua

SEQ ID NO: 459095 - RNA, 19 nt, Homo sapiens
cggaaucacuucuccaauc

SEQ ID NO: 459096 - RNA, 19 nt, Homo sapiens
ucaaagccaucuugucagu

SEQ ID NO: 459097 - RNA, 19 nt, Homo sapiens
gaaaucguaaaucauguga

SEQ ID NO: 459098 - RNA, 19 nt, Homo sapiens
guuccuggaugacuccuuu

SEQ ID NO: 459099 - RNA, 19 nt, Homo sapiens
gugguuggguucugccuuu

SEQ ID NO: 459100 - RNA, 19 nt, Homo sapiens
ucuaagcaguggcaucuga

SEQ ID NO: 459101 - RNA, 19 nt, Homo sapiens
gaaauacaucgucuacaag

SEQ ID NO: 459102 - RNA, 19 nt, Homo sapiens
gacaaacacuaggcucaga

SEQ ID NO: 459103 - RNA, 19 nt, Homo sapiens
aaagccaucuugucaguca

SEQ ID NO: 459104 - RNA, 19 nt, Homo sapiens
gggaggguagggauaauuu

SEQ ID NO: 459105 - RNA, 19 nt, Homo sapiens
ugacgacuaugacauugug

SEQ ID NO: 459106 - RNA, 19 nt, Homo sapiens
ucuccgcuguggucauuua

SEQ ID NO: 459107 - RNA, 19 nt, Homo sapiens
gcaggaagaggcccacuag

SEQ ID NO: 459108 - RNA, 19 nt, Homo sapiens
gaugggacucuugguauuu

SEQ ID NO: 459109 - RNA, 19 nt, Homo sapiens
ugaauuagccaccaaguac

SEQ ID NO: 459110 - RNA, 19 nt, Homo sapiens
aaucguaaaucaugugaag

SEQ ID NO: 459111 - RNA, 19 nt, Homo sapiens
uaggaaaucguaaaucaug

SEQ ID NO: 459112 - RNA, 19 nt, Homo sapiens
acacuaggcucagaguaug

SEQ ID NO: 459113 - RNA, 19 nt, Homo sapiens
cuaaacugccugcugaauu

SEQ ID NO: 459114 - RNA, 19 nt, Homo sapiens
uccugaaucuggacucuaa

SEQ ID NO: 459115 - RNA, 19 nt, Homo sapiens
gaugacuccuuucgcaagu

SEQ ID NO: 459116 - RNA, 19 nt, Homo sapiens
ggaaaucguaaaucaugug

SEQ ID NO: 459117 - RNA, 19 nt, Homo sapiens
gagcgcgauucucucuuug

SEQ ID NO: 459118 - RNA, 19 nt, Homo sapiens
gaaggacgugggcagcaaa

SEQ ID NO: 459119 - RNA, 19 nt, Homo sapiens
gaggcguucuugccaacaa

SEQ ID NO: 459120 - RNA, 19 nt, Homo sapiens
gggaguucgugccgccuuu

SEQ ID NO: 459121 - RNA, 19 nt, Homo sapiens
agaugggacucuugguauu

SEQ ID NO: 459122 - RNA, 19 nt, Homo sapiens
caaggcugcugccggaauc

SEQ ID NO: 459123 - RNA, 19 nt, Homo sapiens
ucaccaacuugccacaugu

SEQ ID NO: 459124 - RNA, 19 nt, Homo sapiens
gaucuaagcaguggcaucu

SEQ ID NO: 459125 - RNA, 19 nt, Homo sapiens
caauauccagcgagagaaa

SEQ ID NO: 459126 - RNA, 19 nt, Homo sapiens
cacaauauccagcgagaga

SEQ ID NO: 459127 - RNA, 19 nt, Homo sapiens
gaaucuggacucuaaacug

SEQ ID NO: 459128 - RNA, 19 nt, Homo sapiens
cagugguucuuuccuuuga

SEQ ID NO: 459129 - RNA, 19 nt, Homo sapiens
ggucaagacaaucugauca

SEQ ID NO: 459130 - RNA, 19 nt, Homo sapiens
cuacacaggagucuucaga

SEQ ID NO: 459131 - RNA, 19 nt, Homo sapiens
gcgcgauucucucuuuguc

SEQ ID NO: 459132 - RNA, 19 nt, Homo sapiens
aucaguguuugguguauua

SEQ ID NO: 459133 - RNA, 19 nt, Homo sapiens
ccucuccgcuguggucauu

SEQ ID NO: 459134 - RNA, 19 nt, Homo sapiens
ccgcuguggucauuuagga

SEQ ID NO: 459135 - RNA, 19 nt, Homo sapiens
aaauaagguuggagauguc

SEQ ID NO: 459136 - RNA, 19 nt, Homo sapiens
gcaaggcugcugccggaau

SEQ ID NO: 459137 - RNA, 19 nt, Homo sapiens
ccagcgagagaaagaguuu

SEQ ID NO: 459138 - RNA, 19 nt, Homo sapiens
cgacacugcgcaucaccua

SEQ ID NO: 459139 - RNA, 19 nt, Homo sapiens
caucuugucagucaccaaa

SEQ ID NO: 459140 - RNA, 19 nt, Homo sapiens
aagacaaucugaucaaagc

SEQ ID NO: 459141 - RNA, 19 nt, Homo sapiens
gggcuagaauccgggaguu

SEQ ID NO: 459142 - RNA, 19 nt, Homo sapiens
gcuguggucauuuaggaaa

SEQ ID NO: 459143 - RNA, 19 nt, Homo sapiens
gacauuguggugagacuga

SEQ ID NO: 459144 - RNA, 19 nt, Homo sapiens
gaauugacgacuaugacau

SEQ ID NO: 459145 - RNA, 19 nt, Homo sapiens
caagacaaucugaucaaag

SEQ ID NO: 459146 - RNA, 19 nt, Homo sapiens
caagccagcacccauguuc

SEQ ID NO: 459147 - RNA, 19 nt, Homo sapiens
caaucaguguuugguguau

SEQ ID NO: 459148 - RNA, 19 nt, Homo sapiens
cguggaagcuacacuuacu

SEQ ID NO: 459149 - RNA, 19 nt, Homo sapiens
ucaaaggucaagacaaucu

SEQ ID NO: 459150 - RNA, 19 nt, Homo sapiens
aagcucgcgucaucacuga

SEQ ID NO: 459151 - RNA, 19 nt, Homo sapiens
agaaggacgugggcagcaa

SEQ ID NO: 459152 - RNA, 19 nt, Homo sapiens
aaucacuucuccaaucagu

SEQ ID NO: 459153 - RNA, 19 nt, Homo sapiens
gaccagcacucagccucau

SEQ ID NO: 459154 - RNA, 19 nt, Homo sapiens
gcaguacgagcgcgauucu

SEQ ID NO: 459155 - RNA, 19 nt, Homo sapiens
cguaaaucaugugaagaug

SEQ ID NO: 459156 - RNA, 19 nt, Homo sapiens
ccagggcuauagcagaaag

SEQ ID NO: 459157 - RNA, 19 nt, Homo sapiens
gagcaguacgagcgcgauu

SEQ ID NO: 459158 - RNA, 19 nt, Homo sapiens
cgaauugacgacuaugaca

SEQ ID NO: 459159 - RNA, 19 nt, Homo sapiens
uuaaauaagguuggagaug

SEQ ID NO: 459160 - RNA, 19 nt, Homo sapiens
aaacacuaggcucagagua

SEQ ID NO: 459161 - RNA, 19 nt, Homo sapiens
cugaauuagccaccaagua

SEQ ID NO: 459162 - RNA, 19 nt, Homo sapiens
gggaagugaggcccaagga

SEQ ID NO: 459163 - RNA, 19 nt, Homo sapiens
aaucaguguuugguguauu

SEQ ID NO: 459164 - RNA, 19 nt, Homo sapiens
uucagugguucuuuccuuu

SEQ ID NO: 459165 - RNA, 19 nt, Homo sapiens
ggaucaaaggucaagacaa

SEQ ID NO: 459166 - RNA, 19 nt, Homo sapiens
gcuagcccucugccucuuu

SEQ ID NO: 459167 - RNA, 19 nt, Homo sapiens
cagcagccagcaccaccua

SEQ ID NO: 459168 - RNA, 19 nt, Homo sapiens
cccagcacauggccauaga

SEQ ID NO: 459169 - RNA, 19 nt, Homo sapiens
ugucagucaccaaagagua

SEQ ID NO: 459170 - RNA, 19 nt, Homo sapiens
uggaagcaauaaagcucuu

SEQ ID NO: 459171 - RNA, 19 nt, Homo sapiens
gcuauagcagaaagaacuu

SEQ ID NO: 459172 - RNA, 19 nt, Homo sapiens
gcagccagcaccaccuaca

SEQ ID NO: 459173 - RNA, 19 nt, Homo sapiens
gucaagacaaucugaucaa

SEQ ID NO: 459174 - RNA, 19 nt, Homo sapiens
gccuuuagccuggaccaaa

SEQ ID NO: 459175 - RNA, 19 nt, Homo sapiens
ugcggaagcuggugaaagc

SEQ ID NO: 459176 - RNA, 19 nt, Homo sapiens
aauugacgacuaugacauu

SEQ ID NO: 459177 - RNA, 19 nt, Homo sapiens
ucucuggggucacgaauug

SEQ ID NO: 459178 - RNA, 19 nt, Homo sapiens
ggcaauggaggcguucuug

SEQ ID NO: 459179 - RNA, 19 nt, Homo sapiens
aaaggucaagacaaucuga

SEQ ID NO: 459180 - RNA, 19 nt, Homo sapiens
uaaacugccugcugaauua

SEQ ID NO: 459181 - RNA, 19 nt, Homo sapiens
ggaaucacuucuccaauca

SEQ ID NO: 459182 - RNA, 19 nt, Homo sapiens
ggugaaagcucgcgucauc

SEQ ID NO: 459183 - RNA, 19 nt, Homo sapiens
uaaauaagguuggagaugu

SEQ ID NO: 459184 - RNA, 19 nt, Homo sapiens
auaaagcucuucccugaaa

SEQ ID NO: 459185 - RNA, 19 nt, Homo sapiens
gguuggagaugucaaguug

SEQ ID NO: 459186 - RNA, 19 nt, Homo sapiens
ggacuccaauucagugguu

SEQ ID NO: 459187 - RNA, 19 nt, Homo sapiens
ugacuccgcuggacaaaca

SEQ ID NO: 459188 - RNA, 19 nt, Homo sapiens
ccaauucagugguucuuuc

SEQ ID NO: 459189 - RNA, 19 nt, Homo sapiens
ggaggguagggauaauuua

SEQ ID NO: 459190 - RNA, 19 nt, Homo sapiens
cggaaucacuucuccaauc

SEQ ID NO: 459191 - RNA, 19 nt, Homo sapiens
guuccuggaugacuccuuu

SEQ ID NO: 459192 - RNA, 19 nt, Homo sapiens
gaaaucguaaaucauguga

SEQ ID NO: 459193 - RNA, 19 nt, Homo sapiens
gugguuggguucugccuuu

SEQ ID NO: 459194 - RNA, 19 nt, Homo sapiens
ucuaagcaguggcaucuga

SEQ ID NO: 459195 - RNA, 19 nt, Homo sapiens
gacaaacacuaggcucaga

SEQ ID NO: 459196 - RNA, 19 nt, Homo sapiens
gggaggguagggauaauuu

SEQ ID NO: 459197 - RNA, 19 nt, Homo sapiens
ucuccgcuguggucauuua

SEQ ID NO: 459198 - RNA, 19 nt, Homo sapiens
gcaggaagaggcccacuag

SEQ ID NO: 459199 - RNA, 19 nt, Homo sapiens
ugaauuagccaccaaguac

SEQ ID NO: 459200 - RNA, 19 nt, Homo sapiens
gaugggacucuugguauuu

SEQ ID NO: 459201 - RNA, 19 nt, Homo sapiens
uaggaaaucguaaaucaug

SEQ ID NO: 459202 - RNA, 19 nt, Homo sapiens
aaucguaaaucaugugaag

SEQ ID NO: 459203 - RNA, 19 nt, Homo sapiens
acacuaggcucagaguaug

SEQ ID NO: 459204 - RNA, 19 nt, Homo sapiens
cuaaacugccugcugaauu

SEQ ID NO: 459205 - RNA, 19 nt, Homo sapiens
uccugaaucuggacucuaa

SEQ ID NO: 459206 - RNA, 19 nt, Homo sapiens
ggaaaucguaaaucaugug

SEQ ID NO: 459207 - RNA, 19 nt, Homo sapiens
gaugacuccuuucgcaagu

SEQ ID NO: 459208 - RNA, 19 nt, Homo sapiens
gggaguucgugccgccuuu

SEQ ID NO: 459209 - RNA, 19 nt, Homo sapiens
caaggcugcugccggaauc

SEQ ID NO: 459210 - RNA, 19 nt, Homo sapiens
agaugggacucuugguauu

SEQ ID NO: 459211 - RNA, 19 nt, Homo sapiens
ucaccaacuugccacaugu

SEQ ID NO: 459212 - RNA, 19 nt, Homo sapiens
gaucuaagcaguggcaucu

SEQ ID NO: 459213 - RNA, 19 nt, Homo sapiens
caauauccagcgagagaaa

SEQ ID NO: 459214 - RNA, 19 nt, Homo sapiens
cacaauauccagcgagaga

SEQ ID NO: 459215 - RNA, 19 nt, Homo sapiens
gaaucuggacucuaaacug

SEQ ID NO: 459216 - RNA, 19 nt, Homo sapiens
cagugguucuuuccuuuga

SEQ ID NO: 459217 - RNA, 19 nt, Homo sapiens
cuacacaggagucuucaga

SEQ ID NO: 459218 - RNA, 19 nt, Homo sapiens
aucaguguuugguguauua

SEQ ID NO: 459219 - RNA, 19 nt, Homo sapiens
ccucuccgcuguggucauu

SEQ ID NO: 459220 - RNA, 19 nt, Homo sapiens
aaauaagguuggagauguc

SEQ ID NO: 459221 - RNA, 19 nt, Homo sapiens
gcaaggcugcugccggaau

SEQ ID NO: 459222 - RNA, 19 nt, Homo sapiens
ccagcgagagaaagaguuu

SEQ ID NO: 459223 - RNA, 19 nt, Homo sapiens
gggcuagaauccgggaguu

SEQ ID NO: 459224 - RNA, 19 nt, Homo sapiens
ccgcuguggucauuuagga

SEQ ID NO: 459225 - RNA, 19 nt, Homo sapiens
gcuguggucauuuaggaaa

SEQ ID NO: 459226 - RNA, 19 nt, Homo sapiens
caagccagcacccauguuc

SEQ ID NO: 459227 - RNA, 19 nt, Homo sapiens
caaucaguguuugguguau

SEQ ID NO: 459228 - RNA, 19 nt, Homo sapiens
cguggaagcuacacuuacu

SEQ ID NO: 459229 - RNA, 19 nt, Homo sapiens
aagcucgcgucaucacuga

SEQ ID NO: 459230 - RNA, 19 nt, Homo sapiens
cguaaaucaugugaagaug

SEQ ID NO: 459231 - RNA, 19 nt, Homo sapiens
aaucacuucuccaaucagu

SEQ ID NO: 459232 - RNA, 19 nt, Homo sapiens
gaccagcacucagccucau

SEQ ID NO: 459233 - RNA, 19 nt, Homo sapiens
ccagggcuauagcagaaag

SEQ ID NO: 459234 - RNA, 19 nt, Homo sapiens
uuaaauaagguuggagaug

SEQ ID NO: 459235 - RNA, 19 nt, Homo sapiens
cugaauuagccaccaagua

SEQ ID NO: 459236 - RNA, 19 nt, Homo sapiens
aaacacuaggcucagagua

SEQ ID NO: 459237 - RNA, 19 nt, Homo sapiens
gggaagugaggcccaagga

SEQ ID NO: 459238 - RNA, 19 nt, Homo sapiens
aaucaguguuugguguauu

SEQ ID NO: 459239 - RNA, 19 nt, Homo sapiens
uucagugguucuuuccuuu

SEQ ID NO: 459240 - RNA, 19 nt, Homo sapiens
cagcagccagcaccaccua

SEQ ID NO: 459241 - RNA, 19 nt, Homo sapiens
cccagcacauggccauaga

SEQ ID NO: 459242 - RNA, 19 nt, Homo sapiens
gcuagcccucugccucuuu

SEQ ID NO: 459243 - RNA, 19 nt, Homo sapiens
uggaagcaauaaagcucuu

SEQ ID NO: 459244 - RNA, 19 nt, Homo sapiens
gcuauagcagaaagaacuu

SEQ ID NO: 459245 - RNA, 19 nt, Homo sapiens
gcagccagcaccaccuaca

SEQ ID NO: 459246 - RNA, 19 nt, Homo sapiens
gccuuuagccuggaccaaa

SEQ ID NO: 459247 - RNA, 19 nt, Homo sapiens
uguauuauucugcguggaa

SEQ ID NO: 459248 - RNA, 19 nt, Homo sapiens
ugcggaagcuggugaaagc

SEQ ID NO: 459249 - RNA, 19 nt, Homo sapiens
ggacgcagccuuugcauua

SEQ ID NO: 459250 - RNA, 19 nt, Homo sapiens
gaucaaaggucaagacaau

SEQ ID NO: 459251 - RNA, 19 nt, Homo sapiens
gcccaggccugcugaauua

SEQ ID NO: 459252 - RNA, 19 nt, Homo sapiens
ugaaauacaucgucuacaa

SEQ ID NO: 459253 - RNA, 19 nt, Homo sapiens
gaucaaagccaucuuguca

SEQ ID NO: 459254 - RNA, 19 nt, Homo sapiens
ggaaucacuucuccaauca

SEQ ID NO: 459255 - RNA, 19 nt, Homo sapiens
ggugaaagcucgcgucauc

SEQ ID NO: 459256 - RNA, 19 nt, Homo sapiens
uaaauaagguuggagaugu

SEQ ID NO: 459257 - RNA, 19 nt, Homo sapiens
auaaagcucuucccugaaa

SEQ ID NO: 459258 - RNA, 19 nt, Homo sapiens
gguuggagaugucaaguug

SEQ ID NO: 459259 - RNA, 19 nt, Homo sapiens
ggacuccaauucagugguu

SEQ ID NO: 459260 - RNA, 19 nt, Homo sapiens
ggauuuggcuaugacauga

SEQ ID NO: 459261 - RNA, 19 nt, Homo sapiens
cgagcgcgauucucucuuu

SEQ ID NO: 459262 - RNA, 19 nt, Homo sapiens
ugacuccgcuggacaaaca

SEQ ID NO: 459263 - RNA, 19 nt, Homo sapiens
ccaauucagugguucuuuc

SEQ ID NO: 459264 - RNA, 19 nt, Homo sapiens
ucaagacaaucugaucaaa

SEQ ID NO: 459265 - RNA, 19 nt, Homo sapiens
ggaggguagggauaauuua

SEQ ID NO: 459266 - RNA, 19 nt, Homo sapiens
cggaaucacuucuccaauc

SEQ ID NO: 459267 - RNA, 19 nt, Homo sapiens
ucaaagccaucuugucagu

SEQ ID NO: 459268 - RNA, 19 nt, Homo sapiens
gagcgaggacgcagccuuu

SEQ ID NO: 459269 - RNA, 19 nt, Homo sapiens
ggccugcccuucaacaaug

SEQ ID NO: 459270 - RNA, 19 nt, Homo sapiens
guuccuggaugacuccuuu

SEQ ID NO: 459271 - RNA, 19 nt, Homo sapiens
gaaaucguaaaucauguga

SEQ ID NO: 459272 - RNA, 19 nt, Homo sapiens
gugguuggguucugccuuu

SEQ ID NO: 459273 - RNA, 19 nt, Homo sapiens
ucuaagcaguggcaucuga

SEQ ID NO: 459274 - RNA, 19 nt, Homo sapiens
ucggauggcuucuggaaau

SEQ ID NO: 459275 - RNA, 19 nt, Homo sapiens
gaaauacaucgucuacaag

SEQ ID NO: 459276 - RNA, 19 nt, Homo sapiens
gacaaacacuaggcucaga

SEQ ID NO: 459277 - RNA, 19 nt, Homo sapiens
aaagccaucuugucaguca

SEQ ID NO: 459278 - RNA, 19 nt, Homo sapiens
gggaggguagggauaauuu

SEQ ID NO: 459279 - RNA, 19 nt, Homo sapiens
ugacgacuaugacauugug

SEQ ID NO: 459280 - RNA, 19 nt, Homo sapiens
ucuccgcuguggucauuua

SEQ ID NO: 459281 - RNA, 19 nt, Homo sapiens
gcaggaagaggcccacuag

SEQ ID NO: 459282 - RNA, 19 nt, Homo sapiens
gaugggacucuugguauuu

SEQ ID NO: 459283 - RNA, 19 nt, Homo sapiens
ugaauuagccaccaaguac

SEQ ID NO: 459284 - RNA, 19 nt, Homo sapiens
acacuaggcucagaguaug

SEQ ID NO: 459285 - RNA, 19 nt, Homo sapiens
aaucguaaaucaugugaag

SEQ ID NO: 459286 - RNA, 19 nt, Homo sapiens
uaggaaaucguaaaucaug

SEQ ID NO: 459287 - RNA, 19 nt, Homo sapiens
ggccuugacugcauauugg

SEQ ID NO: 459288 - RNA, 19 nt, Homo sapiens
uccugaaucuggacucuaa

SEQ ID NO: 459289 - RNA, 19 nt, Homo sapiens
ggaaaucguaaaucaugug

SEQ ID NO: 459290 - RNA, 19 nt, Homo sapiens
gaugacuccuuucgcaagu

SEQ ID NO: 459291 - RNA, 19 nt, Homo sapiens
gagcgcgauucucucuuug

SEQ ID NO: 459292 - RNA, 19 nt, Homo sapiens
gaaggacgugggcagcaaa

SEQ ID NO: 459293 - RNA, 19 nt, Homo sapiens
gaggcguucuugccaacaa

SEQ ID NO: 459294 - RNA, 19 nt, Homo sapiens
gggaguucgugccgccuuu

SEQ ID NO: 459295 - RNA, 19 nt, Homo sapiens
caaggcugcugccggaauc

SEQ ID NO: 459296 - RNA, 19 nt, Homo sapiens
agaugggacucuugguauu

SEQ ID NO: 459297 - RNA, 19 nt, Homo sapiens
aaucuggacucuaaacucu

SEQ ID NO: 459298 - RNA, 19 nt, Homo sapiens
ucaccaacuugccacaugu

SEQ ID NO: 459299 - RNA, 19 nt, Homo sapiens
gaucuaagcaguggcaucu

SEQ ID NO: 459300 - RNA, 19 nt, Homo sapiens
caauauccagcgagagaaa

SEQ ID NO: 459301 - RNA, 19 nt, Homo sapiens
cacaauauccagcgagaga

SEQ ID NO: 459302 - RNA, 19 nt, Homo sapiens
cagugguucuuuccuuuga

SEQ ID NO: 459303 - RNA, 19 nt, Homo sapiens
ggucaagacaaucugauca

SEQ ID NO: 459304 - RNA, 19 nt, Homo sapiens
cuacacaggagucuucaga

SEQ ID NO: 459305 - RNA, 19 nt, Homo sapiens
cuucaacaauggccucaug

SEQ ID NO: 459306 - RNA, 19 nt, Homo sapiens
gcgcgauucucucuuuguc

SEQ ID NO: 459307 - RNA, 19 nt, Homo sapiens
aucaguguuugguguauua

SEQ ID NO: 459308 - RNA, 19 nt, Homo sapiens
ccucuccgcuguggucauu

SEQ ID NO: 459309 - RNA, 19 nt, Homo sapiens
aaauaagguuggagauguc

SEQ ID NO: 459310 - RNA, 19 nt, Homo sapiens
ccgcuguggucauuuagga

SEQ ID NO: 459311 - RNA, 19 nt, Homo sapiens
gcaaggcugcugccggaau

SEQ ID NO: 459312 - RNA, 19 nt, Homo sapiens
ccagcgagagaaagaguuu

SEQ ID NO: 459313 - RNA, 19 nt, Homo sapiens
gguggcagucgcaggauuu

SEQ ID NO: 459314 - RNA, 19 nt, Homo sapiens
cgacacugcgcaucaccua

SEQ ID NO: 459315 - RNA, 19 nt, Homo sapiens
caucuugucagucaccaaa

SEQ ID NO: 459316 - RNA, 19 nt, Homo sapiens
aagacaaucugaucaaagc

SEQ ID NO: 459317 - RNA, 19 nt, Homo sapiens
gggcuagaauccgggaguu

SEQ ID NO: 459318 - RNA, 19 nt, Homo sapiens
gcuguggucauuuaggaaa

SEQ ID NO: 459319 - RNA, 19 nt, Homo sapiens
ucauuggccugcccuucaa

SEQ ID NO: 459320 - RNA, 19 nt, Homo sapiens
gacauuguggugagacuga

SEQ ID NO: 459321 - RNA, 19 nt, Homo sapiens
gaauugacgacuaugacau

SEQ ID NO: 459322 - RNA, 19 nt, Homo sapiens
caagacaaucugaucaaag

SEQ ID NO: 459323 - RNA, 19 nt, Homo sapiens
caagccagcacccauguuc

SEQ ID NO: 459324 - RNA, 19 nt, Homo sapiens
caaucaguguuugguguau

SEQ ID NO: 459325 - RNA, 19 nt, Homo sapiens
cguggaagcuacacuuacu

SEQ ID NO: 459326 - RNA, 19 nt, Homo sapiens
ucgcaggauuuggcuauga

SEQ ID NO: 459327 - RNA, 19 nt, Homo sapiens
ucaaaggucaagacaaucu

SEQ ID NO: 459328 - RNA, 19 nt, Homo sapiens
gaaucuggacucuaaacuc

SEQ ID NO: 459329 - RNA, 19 nt, Homo sapiens
aagcucgcgucaucacuga

SEQ ID NO: 459330 - RNA, 19 nt, Homo sapiens
gauggcuucuggaaaucug

SEQ ID NO: 459331 - RNA, 19 nt, Homo sapiens
cgaauccucaacccauauu

SEQ ID NO: 459332 - RNA, 19 nt, Homo sapiens
agaaggacgugggcagcaa

SEQ ID NO: 459333 - RNA, 19 nt, Homo sapiens
aaucacuucuccaaucagu

SEQ ID NO: 459334 - RNA, 19 nt, Homo sapiens
cguaaaucaugugaagaug

SEQ ID NO: 459335 - RNA, 19 nt, Homo sapiens
gaccagcacucagccucau

SEQ ID NO: 459336 - RNA, 19 nt, Homo sapiens
gaauccucaacccauauuu

SEQ ID NO: 459337 - RNA, 19 nt, Homo sapiens
gcaguacgagcgcgauucu

SEQ ID NO: 459338 - RNA, 19 nt, Homo sapiens
ucuggacucuaaacucuca

SEQ ID NO: 459339 - RNA, 19 nt, Homo sapiens
ccagggcuauagcagaaag

SEQ ID NO: 459340 - RNA, 19 nt, Homo sapiens
ccucaacccauauuucauc

SEQ ID NO: 459341 - RNA, 19 nt, Homo sapiens
gagcaguacgagcgcgauu

SEQ ID NO: 459342 - RNA, 19 nt, Homo sapiens
cgaauugacgacuaugaca

SEQ ID NO: 459343 - RNA, 19 nt, Homo sapiens
uuaaauaagguuggagaug

SEQ ID NO: 459344 - RNA, 19 nt, Homo sapiens
aaacacuaggcucagagua

SEQ ID NO: 459345 - RNA, 19 nt, Homo sapiens
cugaauuagccaccaagua

SEQ ID NO: 459346 - RNA, 19 nt, Homo sapiens
gggaagugaggcccaagga

SEQ ID NO: 459347 - RNA, 19 nt, Homo sapiens
aaucaguguuugguguauu

SEQ ID NO: 459348 - RNA, 19 nt, Homo sapiens
uucgaauccucaacccaua

SEQ ID NO: 459349 - RNA, 19 nt, Homo sapiens
uaaacugccugcugaauua

SEQ ID NO: 459350 - RNA, 19 nt, Homo sapiens
gaucaaaggucaagacaau

SEQ ID NO: 459351 - RNA, 19 nt, Homo sapiens
ugaaauacaucgucuacaa

SEQ ID NO: 459352 - RNA, 19 nt, Homo sapiens
gaucaaagccaucuuguca

SEQ ID NO: 459353 - RNA, 19 nt, Homo sapiens
ggaaucacuucuccaauca

SEQ ID NO: 459354 - RNA, 19 nt, Homo sapiens
ggugaaagcucgcgucauc

SEQ ID NO: 459355 - RNA, 19 nt, Homo sapiens
uaaauaagguuggagaugu

SEQ ID NO: 459356 - RNA, 19 nt, Homo sapiens
auaaagcucuucccugaaa

SEQ ID NO: 459357 - RNA, 19 nt, Homo sapiens
gguuggagaugucaaguug

SEQ ID NO: 459358 - RNA, 19 nt, Homo sapiens
ggauuuggcuaugacauga

SEQ ID NO: 459359 - RNA, 19 nt, Homo sapiens
cgagcgcgauucucucuuu

SEQ ID NO: 459360 - RNA, 19 nt, Homo sapiens
ucaagacaaucugaucaaa

SEQ ID NO: 459361 - RNA, 19 nt, Homo sapiens
ggaggguagggauaauuua

SEQ ID NO: 459362 - RNA, 19 nt, Homo sapiens
cggaaucacuucuccaauc

SEQ ID NO: 459363 - RNA, 19 nt, Homo sapiens
ucaaagccaucuugucagu

SEQ ID NO: 459364 - RNA, 19 nt, Homo sapiens
gaaaucguaaaucauguga

SEQ ID NO: 459365 - RNA, 19 nt, Homo sapiens
ggccugcccuucaacaaug

SEQ ID NO: 459366 - RNA, 19 nt, Homo sapiens
guuccuggaugacuccuuu

SEQ ID NO: 459367 - RNA, 19 nt, Homo sapiens
gugguuggguucugccuuu

SEQ ID NO: 459368 - RNA, 19 nt, Homo sapiens
ucuaagcaguggcaucuga

SEQ ID NO: 459369 - RNA, 19 nt, Homo sapiens
ucggauggcuucuggaaau

SEQ ID NO: 459370 - RNA, 19 nt, Homo sapiens
gaaauacaucgucuacaag

SEQ ID NO: 459371 - RNA, 19 nt, Homo sapiens
aaagccaucuugucaguca

SEQ ID NO: 459372 - RNA, 19 nt, Homo sapiens
gggaggguagggauaauuu

SEQ ID NO: 459373 - RNA, 19 nt, Homo sapiens
ugacgacuaugacauugug

SEQ ID NO: 459374 - RNA, 19 nt, Homo sapiens
ucuccgcuguggucauuua

SEQ ID NO: 459375 - RNA, 19 nt, Homo sapiens
gcaggaagaggcccacuag

SEQ ID NO: 459376 - RNA, 19 nt, Homo sapiens
gaugggacucuugguauuu

SEQ ID NO: 459377 - RNA, 19 nt, Homo sapiens
ugaauuagccaccaaguac

SEQ ID NO: 459378 - RNA, 19 nt, Homo sapiens
uaggaaaucguaaaucaug

SEQ ID NO: 459379 - RNA, 19 nt, Homo sapiens
aaucguaaaucaugugaag

SEQ ID NO: 459380 - RNA, 19 nt, Homo sapiens
cuaaacugccugcugaauu

SEQ ID NO: 459381 - RNA, 19 nt, Homo sapiens
uccugaaucuggacucuaa

SEQ ID NO: 459382 - RNA, 19 nt, Homo sapiens
ggaaaucguaaaucaugug

SEQ ID NO: 459383 - RNA, 19 nt, Homo sapiens
gaugacuccuuucgcaagu

SEQ ID NO: 459384 - RNA, 19 nt, Homo sapiens
gagcgcgauucucucuuug

SEQ ID NO: 459385 - RNA, 19 nt, Homo sapiens
gaaggacgugggcagcaaa

SEQ ID NO: 459386 - RNA, 19 nt, Homo sapiens
gaggcguucuugccaacaa

SEQ ID NO: 459387 - RNA, 19 nt, Homo sapiens
gggaguucgugccgccuuu

SEQ ID NO: 459388 - RNA, 19 nt, Homo sapiens
caaggcugcugccggaauc

SEQ ID NO: 459389 - RNA, 19 nt, Homo sapiens
agaugggacucuugguauu

SEQ ID NO: 459390 - RNA, 19 nt, Homo sapiens
ucaccaacuugccacaugu

SEQ ID NO: 459391 - RNA, 19 nt, Homo sapiens
gaucuaagcaguggcaucu

SEQ ID NO: 459392 - RNA, 19 nt, Homo sapiens
caauauccagcgagagaaa

SEQ ID NO: 459393 - RNA, 19 nt, Homo sapiens
cacaauauccagcgagaga

SEQ ID NO: 459394 - RNA, 19 nt, Homo sapiens
gaaucuggacucuaaacug

SEQ ID NO: 459395 - RNA, 19 nt, Homo sapiens
ggucaagacaaucugauca

SEQ ID NO: 459396 - RNA, 19 nt, Homo sapiens
cuacacaggagucuucaga

SEQ ID NO: 459397 - RNA, 19 nt, Homo sapiens
cuucaacaauggccucaug

SEQ ID NO: 459398 - RNA, 19 nt, Homo sapiens
gcgcgauucucucuuuguc

SEQ ID NO: 459399 - RNA, 19 nt, Homo sapiens
aucaguguuugguguauua

SEQ ID NO: 459400 - RNA, 19 nt, Homo sapiens
ccucuccgcuguggucauu

SEQ ID NO: 459401 - RNA, 19 nt, Homo sapiens
ccgcuguggucauuuagga

SEQ ID NO: 459402 - RNA, 19 nt, Homo sapiens
aaauaagguuggagauguc

SEQ ID NO: 459403 - RNA, 19 nt, Homo sapiens
gcaaggcugcugccggaau

SEQ ID NO: 459404 - RNA, 19 nt, Homo sapiens
ccagcgagagaaagaguuu

SEQ ID NO: 459405 - RNA, 19 nt, Homo sapiens
gguggcagucgcaggauuu

SEQ ID NO: 459406 - RNA, 19 nt, Homo sapiens
cgacacugcgcaucaccua

SEQ ID NO: 459407 - RNA, 19 nt, Homo sapiens
caucuugucagucaccaaa

SEQ ID NO: 459408 - RNA, 19 nt, Homo sapiens
aagacaaucugaucaaagc

SEQ ID NO: 459409 - RNA, 19 nt, Homo sapiens
gggcuagaauccgggaguu

SEQ ID NO: 459410 - RNA, 19 nt, Homo sapiens
gcuguggucauuuaggaaa

SEQ ID NO: 459411 - RNA, 19 nt, Homo sapiens
ucauuggccugcccuucaa

SEQ ID NO: 459412 - RNA, 19 nt, Homo sapiens
gacauuguggugagacuga

SEQ ID NO: 459413 - RNA, 19 nt, Homo sapiens
gaauugacgacuaugacau

SEQ ID NO: 459414 - RNA, 19 nt, Homo sapiens
caagacaaucugaucaaag

SEQ ID NO: 459415 - RNA, 19 nt, Homo sapiens
caagccagcacccauguuc

SEQ ID NO: 459416 - RNA, 19 nt, Homo sapiens
caaucaguguuugguguau

SEQ ID NO: 459417 - RNA, 19 nt, Homo sapiens
ucgcaggauuuggcuauga

SEQ ID NO: 459418 - RNA, 19 nt, Homo sapiens
cguggaagcuacacuuacu

SEQ ID NO: 459419 - RNA, 19 nt, Homo sapiens
ucaaaggucaagacaaucu

SEQ ID NO: 459420 - RNA, 19 nt, Homo sapiens
aagcucgcgucaucacuga

SEQ ID NO: 459421 - RNA, 19 nt, Homo sapiens
gauggcuucuggaaaucug

SEQ ID NO: 459422 - RNA, 19 nt, Homo sapiens
cgaauccucaacccauauu

SEQ ID NO: 459423 - RNA, 19 nt, Homo sapiens
agaaggacgugggcagcaa

SEQ ID NO: 459424 - RNA, 19 nt, Homo sapiens
aaucacuucuccaaucagu

SEQ ID NO: 459425 - RNA, 19 nt, Homo sapiens
gaccagcacucagccucau

SEQ ID NO: 459426 - RNA, 19 nt, Homo sapiens
gaauccucaacccauauuu

SEQ ID NO: 459427 - RNA, 19 nt, Homo sapiens
gcaguacgagcgcgauucu

SEQ ID NO: 459428 - RNA, 19 nt, Homo sapiens
cguaaaucaugugaagaug

SEQ ID NO: 459429 - RNA, 19 nt, Homo sapiens
ccagggcuauagcagaaag

SEQ ID NO: 459430 - RNA, 19 nt, Homo sapiens
ccucaacccauauuucauc

SEQ ID NO: 459431 - RNA, 19 nt, Homo sapiens
gagcaguacgagcgcgauu

SEQ ID NO: 459432 - RNA, 19 nt, Homo sapiens
cgaauugacgacuaugaca

SEQ ID NO: 459433 - RNA, 19 nt, Homo sapiens
uuaaauaagguuggagaug

SEQ ID NO: 459434 - RNA, 19 nt, Homo sapiens
cugaauuagccaccaagua

SEQ ID NO: 459435 - RNA, 19 nt, Homo sapiens
gggaagugaggcccaagga

SEQ ID NO: 459436 - RNA, 19 nt, Homo sapiens
aaucaguguuugguguauu

SEQ ID NO: 459437 - RNA, 19 nt, Homo sapiens
uucgaauccucaacccaua

SEQ ID NO: 459438 - RNA, 19 nt, Homo sapiens
ggaucaaaggucaagacaa

SEQ ID NO: 459439 - RNA, 19 nt, Homo sapiens
cagcagccagcaccaccua

SEQ ID NO: 459440 - RNA, 19 nt, Homo sapiens
cccagcacauggccauaga

SEQ ID NO: 459441 - RNA, 19 nt, Homo sapiens
ugucagucaccaaagagua

SEQ ID NO: 459442 - RNA, 19 nt, Homo sapiens
gcuagcccucugccucuuu

SEQ ID NO: 459443 - RNA, 19 nt, Homo sapiens
uggaagcaauaaagcucuu

SEQ ID NO: 459444 - RNA, 19 nt, Homo sapiens
gcuauagcagaaagaacuu

SEQ ID NO: 459445 - RNA, 19 nt, Homo sapiens
gcagccagcaccaccuaca

SEQ ID NO: 459446 - RNA, 19 nt, Homo sapiens
gucaagacaaucugaucaa

SEQ ID NO: 459447 - RNA, 19 nt, Homo sapiens
gccuuuagccuggaccaaa

SEQ ID NO: 459448 - RNA, 19 nt, Homo sapiens
uguauuauucugcguggaa

SEQ ID NO: 459449 - RNA, 19 nt, Homo sapiens
uaaacugccugcugaauua

SEQ ID NO: 459450 - RNA, 19 nt, Homo sapiens
ggaaucacuucuccaauca

SEQ ID NO: 459451 - RNA, 19 nt, Homo sapiens
ggugaaagcucgcgucauc

SEQ ID NO: 459452 - RNA, 19 nt, Homo sapiens
uaaauaagguuggagaugu

SEQ ID NO: 459453 - RNA, 19 nt, Homo sapiens
auaaagcucuucccugaaa

SEQ ID NO: 459454 - RNA, 19 nt, Homo sapiens
gguuggagaugucaaguug

SEQ ID NO: 459455 - RNA, 19 nt, Homo sapiens
ggaggguagggauaauuua

SEQ ID NO: 459456 - RNA, 19 nt, Homo sapiens
cggaaucacuucuccaauc

SEQ ID NO: 459457 - RNA, 19 nt, Homo sapiens
guuccuggaugacuccuuu

SEQ ID NO: 459458 - RNA, 19 nt, Homo sapiens
gaaaucguaaaucauguga

SEQ ID NO: 459459 - RNA, 19 nt, Homo sapiens
gugguuggguucugccuuu

SEQ ID NO: 459460 - RNA, 19 nt, Homo sapiens
ucuaagcaguggcaucuga

SEQ ID NO: 459461 - RNA, 19 nt, Homo sapiens
gggaggguagggauaauuu

SEQ ID NO: 459462 - RNA, 19 nt, Homo sapiens
ucuccgcuguggucauuua

SEQ ID NO: 459463 - RNA, 19 nt, Homo sapiens
gcaggaagaggcccacuag

SEQ ID NO: 459464 - RNA, 19 nt, Homo sapiens
ugaauuagccaccaaguac

SEQ ID NO: 459465 - RNA, 19 nt, Homo sapiens
gaugggacucuugguauuu

SEQ ID NO: 459466 - RNA, 19 nt, Homo sapiens
uaggaaaucguaaaucaug

SEQ ID NO: 459467 - RNA, 19 nt, Homo sapiens
aaucguaaaucaugugaag

SEQ ID NO: 459468 - RNA, 19 nt, Homo sapiens
cuaaacugccugcugaauu

SEQ ID NO: 459469 - RNA, 19 nt, Homo sapiens
uccugaaucuggacucuaa

SEQ ID NO: 459470 - RNA, 19 nt, Homo sapiens
ggaaaucguaaaucaugug

SEQ ID NO: 459471 - RNA, 19 nt, Homo sapiens
gaugacuccuuucgcaagu

SEQ ID NO: 459472 - RNA, 19 nt, Homo sapiens
gggaguucgugccgccuuu

SEQ ID NO: 459473 - RNA, 19 nt, Homo sapiens
caaggcugcugccggaauc

SEQ ID NO: 459474 - RNA, 19 nt, Homo sapiens
agaugggacucuugguauu

SEQ ID NO: 459475 - RNA, 19 nt, Homo sapiens
ucaccaacuugccacaugu

SEQ ID NO: 459476 - RNA, 19 nt, Homo sapiens
gaucuaagcaguggcaucu

SEQ ID NO: 459477 - RNA, 19 nt, Homo sapiens
caauauccagcgagagaaa

SEQ ID NO: 459478 - RNA, 19 nt, Homo sapiens
cacaauauccagcgagaga

SEQ ID NO: 459479 - RNA, 19 nt, Homo sapiens
gaaucuggacucuaaacug

SEQ ID NO: 459480 - RNA, 19 nt, Homo sapiens
cuacacaggagucuucaga

SEQ ID NO: 459481 - RNA, 19 nt, Homo sapiens
aucaguguuugguguauua

SEQ ID NO: 459482 - RNA, 19 nt, Homo sapiens
ccucuccgcuguggucauu

SEQ ID NO: 459483 - RNA, 19 nt, Homo sapiens
aaauaagguuggagauguc

SEQ ID NO: 459484 - RNA, 19 nt, Homo sapiens
ccgcuguggucauuuagga

SEQ ID NO: 459485 - RNA, 19 nt, Homo sapiens
gcaaggcugcugccggaau

SEQ ID NO: 459486 - RNA, 19 nt, Homo sapiens
ccagcgagagaaagaguuu

SEQ ID NO: 459487 - RNA, 19 nt, Homo sapiens
gggcuagaauccgggaguu

SEQ ID NO: 459488 - RNA, 19 nt, Homo sapiens
gcuguggucauuuaggaaa

SEQ ID NO: 459489 - RNA, 19 nt, Homo sapiens
caagccagcacccauguuc

SEQ ID NO: 459490 - RNA, 19 nt, Homo sapiens
caaucaguguuugguguau

SEQ ID NO: 459491 - RNA, 19 nt, Homo sapiens
cguggaagcuacacuuacu

SEQ ID NO: 459492 - RNA, 19 nt, Homo sapiens
aagcucgcgucaucacuga

SEQ ID NO: 459493 - RNA, 19 nt, Homo sapiens
cguaaaucaugugaagaug

SEQ ID NO: 459494 - RNA, 19 nt, Homo sapiens
aaucacuucuccaaucagu

SEQ ID NO: 459495 - RNA, 19 nt, Homo sapiens
gaccagcacucagccucau

SEQ ID NO: 459496 - RNA, 19 nt, Homo sapiens
ccagggcuauagcagaaag

SEQ ID NO: 459497 - RNA, 19 nt, Homo sapiens
uuaaauaagguuggagaug

SEQ ID NO: 459498 - RNA, 19 nt, Homo sapiens
cugaauuagccaccaagua

SEQ ID NO: 459499 - RNA, 19 nt, Homo sapiens
gggaagugaggcccaagga

SEQ ID NO: 459500 - RNA, 19 nt, Homo sapiens
aaucaguguuugguguauu

SEQ ID NO: 459501 - RNA, 19 nt, Homo sapiens
cagcagccagcaccaccua

SEQ ID NO: 459502 - RNA, 19 nt, Homo sapiens
cccagcacauggccauaga

SEQ ID NO: 459503 - RNA, 19 nt, Homo sapiens
gcuagcccucugccucuuu

SEQ ID NO: 459504 - RNA, 19 nt, Homo sapiens
uggaagcaauaaagcucuu

SEQ ID NO: 459505 - RNA, 19 nt, Homo sapiens
gcuauagcagaaagaacuu

SEQ ID NO: 459506 - RNA, 19 nt, Homo sapiens
gcagccagcaccaccuaca

SEQ ID NO: 459507 - RNA, 19 nt, Homo sapiens
gccuuuagccuggaccaaa

SEQ ID NO: 459508 - RNA, 19 nt, Homo sapiens
ugcggaagcuggugaaagc

SEQ ID NO: 459509 - RNA, 19 nt, Homo sapiens
uguauuauucugcguggaa

SEQ ID NO: 459510 - RNA, 19 nt, Homo sapiens
ggacgcagccuuugcauua

SEQ ID NO: 459511 - RNA, 19 nt, Homo sapiens
gaucaaaggucaagacaau

SEQ ID NO: 459512 - RNA, 19 nt, Homo sapiens
gcccaggccugcugaauua

SEQ ID NO: 459513 - RNA, 19 nt, Homo sapiens
ugaaauacaucgucuacaa

SEQ ID NO: 459514 - RNA, 19 nt, Homo sapiens
gaucaaagccaucuuguca

SEQ ID NO: 459515 - RNA, 19 nt, Homo sapiens
ggaaucacuucuccaauca

SEQ ID NO: 459516 - RNA, 19 nt, Homo sapiens
ggugaaagcucgcgucauc

SEQ ID NO: 459517 - RNA, 19 nt, Homo sapiens
uaaauaagguuggagaugu

SEQ ID NO: 459518 - RNA, 19 nt, Homo sapiens
auaaagcucuucccugaaa

SEQ ID NO: 459519 - RNA, 19 nt, Homo sapiens
gguuggagaugucaaguug

SEQ ID NO: 459520 - RNA, 19 nt, Homo sapiens
ggauuuggcuaugacauga

SEQ ID NO: 459521 - RNA, 19 nt, Homo sapiens
cgagcgcgauucucucuuu

SEQ ID NO: 459522 - RNA, 19 nt, Homo sapiens
ucaagacaaucugaucaaa

SEQ ID NO: 459523 - RNA, 19 nt, Homo sapiens
ggaggguagggauaauuua

SEQ ID NO: 459524 - RNA, 19 nt, Homo sapiens
cggaaucacuucuccaauc

SEQ ID NO: 459525 - RNA, 19 nt, Homo sapiens
ucaaagccaucuugucagu

SEQ ID NO: 459526 - RNA, 19 nt, Homo sapiens
gagcgaggacgcagccuuu

SEQ ID NO: 459527 - RNA, 19 nt, Homo sapiens
gaaaucguaaaucauguga

SEQ ID NO: 459528 - RNA, 19 nt, Homo sapiens
ggccugcccuucaacaaug

SEQ ID NO: 459529 - RNA, 19 nt, Homo sapiens
guuccuggaugacuccuuu

SEQ ID NO: 459530 - RNA, 19 nt, Homo sapiens
gugguuggguucugccuuu

SEQ ID NO: 459531 - RNA, 19 nt, Homo sapiens
ucuaagcaguggcaucuga

SEQ ID NO: 459532 - RNA, 19 nt, Homo sapiens
ucggauggcuucuggaaau

SEQ ID NO: 459533 - RNA, 19 nt, Homo sapiens
gaaauacaucgucuacaag

SEQ ID NO: 459534 - RNA, 19 nt, Homo sapiens
aaagccaucuugucaguca

SEQ ID NO: 459535 - RNA, 19 nt, Homo sapiens
gggaggguagggauaauuu

SEQ ID NO: 459536 - RNA, 19 nt, Homo sapiens
ugacgacuaugacauugug

SEQ ID NO: 459537 - RNA, 19 nt, Homo sapiens
ucuccgcuguggucauuua

SEQ ID NO: 459538 - RNA, 19 nt, Homo sapiens
gaugggacucuugguauuu

SEQ ID NO: 459539 - RNA, 19 nt, Homo sapiens
gcaggaagaggcccacuag

SEQ ID NO: 459540 - RNA, 19 nt, Homo sapiens
ugaauuagccaccaaguac

SEQ ID NO: 459541 - RNA, 19 nt, Homo sapiens
aaucguaaaucaugugaag

SEQ ID NO: 459542 - RNA, 19 nt, Homo sapiens
uaggaaaucguaaaucaug

SEQ ID NO: 459543 - RNA, 19 nt, Homo sapiens
ggccuugacugcauauugg

SEQ ID NO: 459544 - RNA, 19 nt, Homo sapiens
uccugaaucuggacucuaa

SEQ ID NO: 459545 - RNA, 19 nt, Homo sapiens
ggaaaucguaaaucaugug

SEQ ID NO: 459546 - RNA, 19 nt, Homo sapiens
gaugacuccuuucgcaagu

SEQ ID NO: 459547 - RNA, 19 nt, Homo sapiens
gagcgcgauucucucuuug

SEQ ID NO: 459548 - RNA, 19 nt, Homo sapiens
gaaggacgugggcagcaaa

SEQ ID NO: 459549 - RNA, 19 nt, Homo sapiens
gaggcguucuugccaacaa

SEQ ID NO: 459550 - RNA, 19 nt, Homo sapiens
gggaguucgugccgccuuu

SEQ ID NO: 459551 - RNA, 19 nt, Homo sapiens
caaggcugcugccggaauc

SEQ ID NO: 459552 - RNA, 19 nt, Homo sapiens
agaugggacucuugguauu

SEQ ID NO: 459553 - RNA, 19 nt, Homo sapiens
aaucuggacucuaaacucu

SEQ ID NO: 459554 - RNA, 19 nt, Homo sapiens
ucaccaacuugccacaugu

SEQ ID NO: 459555 - RNA, 19 nt, Homo sapiens
gaucuaagcaguggcaucu

SEQ ID NO: 459556 - RNA, 19 nt, Homo sapiens
caauauccagcgagagaaa

SEQ ID NO: 459557 - RNA, 19 nt, Homo sapiens
cacaauauccagcgagaga

SEQ ID NO: 459558 - RNA, 19 nt, Homo sapiens
ggucaagacaaucugauca

SEQ ID NO: 459559 - RNA, 19 nt, Homo sapiens
cuacacaggagucuucaga

SEQ ID NO: 459560 - RNA, 19 nt, Homo sapiens
cuucaacaauggccucaug

SEQ ID NO: 459561 - RNA, 19 nt, Homo sapiens
gcgcgauucucucuuuguc

SEQ ID NO: 459562 - RNA, 19 nt, Homo sapiens
aucaguguuugguguauua

SEQ ID NO: 459563 - RNA, 19 nt, Homo sapiens
ccucuccgcuguggucauu

SEQ ID NO: 459564 - RNA, 19 nt, Homo sapiens
aaauaagguuggagauguc

SEQ ID NO: 459565 - RNA, 19 nt, Homo sapiens
ccgcuguggucauuuagga

SEQ ID NO: 459566 - RNA, 19 nt, Homo sapiens
gcaaggcugcugccggaau

SEQ ID NO: 459567 - RNA, 19 nt, Homo sapiens
ccagcgagagaaagaguuu

SEQ ID NO: 459568 - RNA, 19 nt, Homo sapiens
gguggcagucgcaggauuu

SEQ ID NO: 459569 - RNA, 19 nt, Homo sapiens
cgacacugcgcaucaccua

SEQ ID NO: 459570 - RNA, 19 nt, Homo sapiens
caucuugucagucaccaaa

SEQ ID NO: 459571 - RNA, 19 nt, Homo sapiens
aagacaaucugaucaaagc

SEQ ID NO: 459572 - RNA, 19 nt, Homo sapiens
gggcuagaauccgggaguu

SEQ ID NO: 459573 - RNA, 19 nt, Homo sapiens
gcuguggucauuuaggaaa

SEQ ID NO: 459574 - RNA, 19 nt, Homo sapiens
ucauuggccugcccuucaa

SEQ ID NO: 459575 - RNA, 19 nt, Homo sapiens
gacauuguggugagacuga

SEQ ID NO: 459576 - RNA, 19 nt, Homo sapiens
gaauugacgacuaugacau

SEQ ID NO: 459577 - RNA, 19 nt, Homo sapiens
caagacaaucugaucaaag

SEQ ID NO: 459578 - RNA, 19 nt, Homo sapiens
caagccagcacccauguuc

SEQ ID NO: 459579 - RNA, 19 nt, Homo sapiens
caaucaguguuugguguau

SEQ ID NO: 459580 - RNA, 19 nt, Homo sapiens
cguggaagcuacacuuacu

SEQ ID NO: 459581 - RNA, 19 nt, Homo sapiens
ucgcaggauuuggcuauga

SEQ ID NO: 459582 - RNA, 19 nt, Homo sapiens
gaaucuggacucuaaacuc

SEQ ID NO: 459583 - RNA, 19 nt, Homo sapiens
ucaaaggucaagacaaucu

SEQ ID NO: 459584 - RNA, 19 nt, Homo sapiens
aagcucgcgucaucacuga

SEQ ID NO: 459585 - RNA, 19 nt, Homo sapiens
gauggcuucuggaaaucug

SEQ ID NO: 459586 - RNA, 19 nt, Homo sapiens
cgaauccucaacccauauu

SEQ ID NO: 459587 - RNA, 19 nt, Homo sapiens
agaaggacgugggcagcaa

SEQ ID NO: 459588 - RNA, 19 nt, Homo sapiens
cguaaaucaugugaagaug

SEQ ID NO: 459589 - RNA, 19 nt, Homo sapiens
aaucacuucuccaaucagu

SEQ ID NO: 459590 - RNA, 19 nt, Homo sapiens
gaccagcacucagccucau

SEQ ID NO: 459591 - RNA, 19 nt, Homo sapiens
gaauccucaacccauauuu

SEQ ID NO: 459592 - RNA, 19 nt, Homo sapiens
gcaguacgagcgcgauucu

SEQ ID NO: 459593 - RNA, 19 nt, Homo sapiens
ucuggacucuaaacucuca

SEQ ID NO: 459594 - RNA, 19 nt, Homo sapiens
ccagggcuauagcagaaag

SEQ ID NO: 459595 - RNA, 19 nt, Homo sapiens
ccucaacccauauuucauc

SEQ ID NO: 459596 - RNA, 19 nt, Homo sapiens
gagcaguacgagcgcgauu

SEQ ID NO: 459597 - RNA, 19 nt, Homo sapiens
cgaauugacgacuaugaca

SEQ ID NO: 459598 - RNA, 19 nt, Homo sapiens
uuaaauaagguuggagaug

SEQ ID NO: 459599 - RNA, 19 nt, Homo sapiens
cugaauuagccaccaagua

SEQ ID NO: 459600 - RNA, 19 nt, Homo sapiens
gggaagugaggcccaagga

SEQ ID NO: 459601 - RNA, 19 nt, Homo sapiens
aaucaguguuugguguauu

SEQ ID NO: 459602 - RNA, 19 nt, Homo sapiens
uucgaauccucaacccaua

SEQ ID NO: 459603 - RNA, 19 nt, Homo sapiens
ggaucaaaggucaagacaa

SEQ ID NO: 459604 - RNA, 19 nt, Homo sapiens
gacgcagccuuugcauuag

SEQ ID NO: 459605 - RNA, 19 nt, Homo sapiens
cagcagccagcaccaccua

SEQ ID NO: 459606 - RNA, 19 nt, Homo sapiens
cccagcacauggccauaga

SEQ ID NO: 459607 - RNA, 19 nt, Homo sapiens
ugucagucaccaaagagua

SEQ ID NO: 459608 - RNA, 19 nt, Homo sapiens
gcuagcccucugccucuuu

SEQ ID NO: 459609 - RNA, 19 nt, Homo sapiens
uggaagcaauaaagcucuu

SEQ ID NO: 459610 - RNA, 19 nt, Homo sapiens
uaaacugccugcugaauua

SEQ ID NO: 459611 - RNA, 19 nt, Homo sapiens
gaucaaaggucaagacaau

SEQ ID NO: 459612 - RNA, 19 nt, Homo sapiens
ugaaauacaucgucuacaa

SEQ ID NO: 459613 - RNA, 19 nt, Homo sapiens
gaucaaagccaucuuguca

SEQ ID NO: 459614 - RNA, 19 nt, Homo sapiens
ggaaucacuucuccaauca

SEQ ID NO: 459615 - RNA, 19 nt, Homo sapiens
ggugaaagcucgcgucauc

SEQ ID NO: 459616 - RNA, 19 nt, Homo sapiens
uaaauaagguuggagaugu

SEQ ID NO: 459617 - RNA, 19 nt, Homo sapiens
auaaagcucuucccugaaa

SEQ ID NO: 459618 - RNA, 19 nt, Homo sapiens
gguuggagaugucaaguug

SEQ ID NO: 459619 - RNA, 19 nt, Homo sapiens
ggacuccaauucagugguu

SEQ ID NO: 459620 - RNA, 19 nt, Homo sapiens
ggauuuggcuaugacauga

SEQ ID NO: 459621 - RNA, 19 nt, Homo sapiens
cgagcgcgauucucucuuu

SEQ ID NO: 459622 - RNA, 19 nt, Homo sapiens
ugacuccgcuggacaaaca

SEQ ID NO: 459623 - RNA, 19 nt, Homo sapiens
ccaauucagugguucuuuc

SEQ ID NO: 459624 - RNA, 19 nt, Homo sapiens
ucaagacaaucugaucaaa

SEQ ID NO: 459625 - RNA, 19 nt, Homo sapiens
ggaggguagggauaauuua

SEQ ID NO: 459626 - RNA, 19 nt, Homo sapiens
cggaaucacuucuccaauc

SEQ ID NO: 459627 - RNA, 19 nt, Homo sapiens
ucaaagccaucuugucagu

SEQ ID NO: 459628 - RNA, 19 nt, Homo sapiens
ggccugcccuucaacaaug

SEQ ID NO: 459629 - RNA, 19 nt, Homo sapiens
guuccuggaugacuccuuu

SEQ ID NO: 459630 - RNA, 19 nt, Homo sapiens
gaaaucguaaaucauguga

SEQ ID NO: 459631 - RNA, 19 nt, Homo sapiens
gugguuggguucugccuuu

SEQ ID NO: 459632 - RNA, 19 nt, Homo sapiens
ucuaagcaguggcaucuga

SEQ ID NO: 459633 - RNA, 19 nt, Homo sapiens
ucggauggcuucuggaaau

SEQ ID NO: 459634 - RNA, 19 nt, Homo sapiens
gaaauacaucgucuacaag

SEQ ID NO: 459635 - RNA, 19 nt, Homo sapiens
gacaaacacuaggcucaga

SEQ ID NO: 459636 - RNA, 19 nt, Homo sapiens
aaagccaucuugucaguca

SEQ ID NO: 459637 - RNA, 19 nt, Homo sapiens
gggaggguagggauaauuu

SEQ ID NO: 459638 - RNA, 19 nt, Homo sapiens
ugacgacuaugacauugug

SEQ ID NO: 459639 - RNA, 19 nt, Homo sapiens
ucuccgcuguggucauuua

SEQ ID NO: 459640 - RNA, 19 nt, Homo sapiens
gcaggaagaggcccacuag

SEQ ID NO: 459641 - RNA, 19 nt, Homo sapiens
ugaauuagccaccaaguac

SEQ ID NO: 459642 - RNA, 19 nt, Homo sapiens
gaugggacucuugguauuu

SEQ ID NO: 459643 - RNA, 19 nt, Homo sapiens
uaggaaaucguaaaucaug

SEQ ID NO: 459644 - RNA, 19 nt, Homo sapiens
gagugggccugcucucugu

SEQ ID NO: 459645 - RNA, 19 nt, Homo sapiens
aaucguaaaucaugugaag

SEQ ID NO: 459646 - RNA, 19 nt, Homo sapiens
acacuaggcucagaguaug

SEQ ID NO: 459647 - RNA, 19 nt, Homo sapiens
cuaaacugccugcugaauu

SEQ ID NO: 459648 - RNA, 19 nt, Homo sapiens
uccugaaucuggacucuaa

SEQ ID NO: 459649 - RNA, 19 nt, Homo sapiens
gaugacuccuuucgcaagu

SEQ ID NO: 459650 - RNA, 19 nt, Homo sapiens
ggaaaucguaaaucaugug

SEQ ID NO: 459651 - RNA, 19 nt, Homo sapiens
gagcgcgauucucucuuug

SEQ ID NO: 459652 - RNA, 19 nt, Homo sapiens
gaaggacgugggcagcaaa

SEQ ID NO: 459653 - RNA, 19 nt, Homo sapiens
gaggcguucuugccaacaa

SEQ ID NO: 459654 - RNA, 19 nt, Homo sapiens
gggaguucgugccgccuuu

SEQ ID NO: 459655 - RNA, 19 nt, Homo sapiens
caaggcugcugccggaauc

SEQ ID NO: 459656 - RNA, 19 nt, Homo sapiens
agaugggacucuugguauu

SEQ ID NO: 459657 - RNA, 19 nt, Homo sapiens
ucaccaacuugccacaugu

SEQ ID NO: 459658 - RNA, 19 nt, Homo sapiens
gaucuaagcaguggcaucu

SEQ ID NO: 459659 - RNA, 19 nt, Homo sapiens
caauauccagcgagagaaa

SEQ ID NO: 459660 - RNA, 19 nt, Homo sapiens
cacaauauccagcgagaga

SEQ ID NO: 459661 - RNA, 19 nt, Homo sapiens
gaaucuggacucuaaacug

SEQ ID NO: 459662 - RNA, 19 nt, Homo sapiens
cagugguucuuuccuuuga

SEQ ID NO: 459663 - RNA, 19 nt, Homo sapiens
ccugcucucuguagacuga

SEQ ID NO: 459664 - RNA, 19 nt, Homo sapiens
ggucaagacaaucugauca

SEQ ID NO: 459665 - RNA, 19 nt, Homo sapiens
cuacacaggagucuucaga

SEQ ID NO: 459666 - RNA, 19 nt, Homo sapiens
cuucaacaauggccucaug

SEQ ID NO: 459667 - RNA, 19 nt, Homo sapiens
gcgcgauucucucuuuguc

SEQ ID NO: 459668 - RNA, 19 nt, Homo sapiens
aucaguguuugguguauua

SEQ ID NO: 459669 - RNA, 19 nt, Homo sapiens
ccucuccgcuguggucauu

SEQ ID NO: 459670 - RNA, 19 nt, Homo sapiens
ccgcuguggucauuuagga

SEQ ID NO: 459671 - RNA, 19 nt, Homo sapiens
aaauaagguuggagauguc

SEQ ID NO: 459672 - RNA, 19 nt, Homo sapiens
gcaaggcugcugccggaau

SEQ ID NO: 459673 - RNA, 19 nt, Homo sapiens
ccagcgagagaaagaguuu

SEQ ID NO: 459674 - RNA, 19 nt, Homo sapiens
gguggcagucgcaggauuu

SEQ ID NO: 459675 - RNA, 19 nt, Homo sapiens
cgacacugcgcaucaccua

SEQ ID NO: 459676 - RNA, 19 nt, Homo sapiens
caucuugucagucaccaaa

SEQ ID NO: 459677 - RNA, 19 nt, Homo sapiens
aagacaaucugaucaaagc

SEQ ID NO: 459678 - RNA, 19 nt, Homo sapiens
gggcuagaauccgggaguu

SEQ ID NO: 459679 - RNA, 19 nt, Homo sapiens
ucauuggccugcccuucaa

SEQ ID NO: 459680 - RNA, 19 nt, Homo sapiens
gaauugacgacuaugacau

SEQ ID NO: 459681 - RNA, 19 nt, Homo sapiens
caagacaaucugaucaaag

SEQ ID NO: 459682 - RNA, 19 nt, Homo sapiens
caagccagcacccauguuc

SEQ ID NO: 459683 - RNA, 19 nt, Homo sapiens
gcuguggucauuuaggaaa

SEQ ID NO: 459684 - RNA, 19 nt, Homo sapiens
caaucaguguuugguguau

SEQ ID NO: 459685 - RNA, 19 nt, Homo sapiens
cguggaagcuacacuuacu

SEQ ID NO: 459686 - RNA, 19 nt, Homo sapiens
ucgcaggauuuggcuauga

SEQ ID NO: 459687 - RNA, 19 nt, Homo sapiens
ucaaaggucaagacaaucu

SEQ ID NO: 459688 - RNA, 19 nt, Homo sapiens
aagcucgcgucaucacuga

SEQ ID NO: 459689 - RNA, 19 nt, Homo sapiens
gauggcuucuggaaaucug

SEQ ID NO: 459690 - RNA, 19 nt, Homo sapiens
cgaauccucaacccauauu

SEQ ID NO: 459691 - RNA, 19 nt, Homo sapiens
agaaggacgugggcagcaa

SEQ ID NO: 459692 - RNA, 19 nt, Homo sapiens
aaucacuucuccaaucagu

SEQ ID NO: 459693 - RNA, 19 nt, Homo sapiens
gaccagcacucagccucau

SEQ ID NO: 459694 - RNA, 19 nt, Homo sapiens
gaauccucaacccauauuu

SEQ ID NO: 459695 - RNA, 19 nt, Homo sapiens
gcaguacgagcgcgauucu

SEQ ID NO: 459696 - RNA, 19 nt, Homo sapiens
cguaaaucaugugaagaug

SEQ ID NO: 459697 - RNA, 19 nt, Homo sapiens
ccagggcuauagcagaaag

SEQ ID NO: 459698 - RNA, 19 nt, Homo sapiens
ccucaacccauauuucauc

SEQ ID NO: 459699 - RNA, 19 nt, Homo sapiens
gagcaguacgagcgcgauu

SEQ ID NO: 459700 - RNA, 19 nt, Homo sapiens
cgaauugacgacuaugaca

SEQ ID NO: 459701 - RNA, 19 nt, Homo sapiens
uuaaauaagguuggagaug

SEQ ID NO: 459702 - RNA, 19 nt, Homo sapiens
aaacacuaggcucagagua

SEQ ID NO: 459703 - RNA, 19 nt, Homo sapiens
cugaauuagccaccaagua

SEQ ID NO: 459704 - RNA, 19 nt, Homo sapiens
gggaagugaggcccaagga

SEQ ID NO: 459705 - RNA, 19 nt, Homo sapiens
aaucaguguuugguguauu

SEQ ID NO: 459706 - RNA, 19 nt, Homo sapiens
uucgaauccucaacccaua

SEQ ID NO: 459707 - RNA, 19 nt, Homo sapiens
uucagugguucuuuccuuu

SEQ ID NO: 459708 - RNA, 19 nt, Homo sapiens
ggaucaaaggucaagacaa

SEQ ID NO: 459709 - RNA, 19 nt, Homo sapiens
gcuagcccucugccucuuu

SEQ ID NO: 459710 - RNA, 19 nt, Homo sapiens
gaaaugaaacauccuauga

SEQ ID NO: 459711 - RNA, 19 nt, Homo sapiens
gcacaugguucaaaucuag

SEQ ID NO: 459712 - RNA, 19 nt, Homo sapiens
caaugaagauccaagcaaa

SEQ ID NO: 459713 - RNA, 19 nt, Homo sapiens
ggaaaguucuggaaaagua

SEQ ID NO: 459714 - RNA, 19 nt, Homo sapiens
gaacagagccaucuuugag

SEQ ID NO: 459715 - RNA, 19 nt, Homo sapiens
gaugcaaucucccuccuuu

SEQ ID NO: 459716 - RNA, 19 nt, Homo sapiens
ggaagagcaugugguauga

SEQ ID NO: 459717 - RNA, 19 nt, Homo sapiens
agaaagaaauccuuggaaa

SEQ ID NO: 459718 - RNA, 19 nt, Homo sapiens
ggaaguggguggguagauu

SEQ ID NO: 459719 - RNA, 19 nt, Homo sapiens
caaguuguuucaugaguuu

SEQ ID NO: 459720 - RNA, 19 nt, Homo sapiens
gugaagagguggccaucua

SEQ ID NO: 459721 - RNA, 19 nt, Homo sapiens
ggacugaaccaggguauuu

SEQ ID NO: 459722 - RNA, 19 nt, Homo sapiens
ggccauagaucgugacuuc

SEQ ID NO: 459723 - RNA, 19 nt, Homo sapiens
aacacaaacuggcuuaaua

SEQ ID NO: 459724 - RNA, 19 nt, Homo sapiens
gcacauggcagauuugcaa

SEQ ID NO: 459725 - RNA, 19 nt, Homo sapiens
gugaaaugcuguugguaaa

SEQ ID NO: 459726 - RNA, 19 nt, Homo sapiens
caacucugguaucuucaua

SEQ ID NO: 459727 - RNA, 19 nt, Homo sapiens
uaaagcacaugguucaaau

SEQ ID NO: 459728 - RNA, 19 nt, Homo sapiens
gcccaucucuuugcuauga

SEQ ID NO: 459729 - RNA, 19 nt, Homo sapiens
gaggacaaauaagaaauga

SEQ ID NO: 459730 - RNA, 19 nt, Homo sapiens
ggaaauggugggauucuga

SEQ ID NO: 459731 - RNA, 19 nt, Homo sapiens
guaaaaugcuggugaaaug

SEQ ID NO: 459732 - RNA, 19 nt, Homo sapiens
uauagcacauggcagauuu

SEQ ID NO: 459733 - RNA, 19 nt, Homo sapiens
gaaguggguggguagauuu

SEQ ID NO: 459734 - RNA, 19 nt, Homo sapiens
ggugaaaugcuguugguaa

SEQ ID NO: 459735 - RNA, 19 nt, Homo sapiens
caucuuugaggguuuauua

SEQ ID NO: 459736 - RNA, 19 nt, Homo sapiens
acacaaacuggcuuaauaa

SEQ ID NO: 459737 - RNA, 19 nt, Homo sapiens
gaaaggagcaaugaagauc

SEQ ID NO: 459738 - RNA, 19 nt, Homo sapiens
gcuaaucccagcauaauuc

SEQ ID NO: 459739 - RNA, 19 nt, Homo sapiens
gggaagagcaugugguaug

SEQ ID NO: 459740 - RNA, 19 nt, Homo sapiens
ggugggaaauggugggauu

SEQ ID NO: 459741 - RNA, 19 nt, Homo sapiens
guaaaaguguugcugauug

SEQ ID NO: 459742 - RNA, 19 nt, Homo sapiens
gaaaugcuguugguaaagc

SEQ ID NO: 459743 - RNA, 19 nt, Homo sapiens
guaaagcacaugguucaaa

SEQ ID NO: 459744 - RNA, 19 nt, Homo sapiens
gcagauuugcaacuaguaa

SEQ ID NO: 459745 - RNA, 19 nt, Homo sapiens
gcaaugaagauccaagcaa

SEQ ID NO: 459746 - RNA, 19 nt, Homo sapiens
uauuaagacuggcuuuaga

SEQ ID NO: 459747 - RNA, 19 nt, Homo sapiens
ucuagaagaugcaguucaa

SEQ ID NO: 459748 - RNA, 19 nt, Homo sapiens
gaaacauccuaugaaauac

SEQ ID NO: 459749 - RNA, 19 nt, Homo sapiens
ggaaaggagcaaugaagau

SEQ ID NO: 459750 - RNA, 19 nt, Homo sapiens
ggaacagagccaucuuuga

SEQ ID NO: 459751 - RNA, 19 nt, Homo sapiens
gaaauggugggauucugaa

SEQ ID NO: 459752 - RNA, 19 nt, Homo sapiens
ggccagagcguucaggaaa

SEQ ID NO: 459753 - RNA, 19 nt, Homo sapiens
uaaaaucggugcacugaga

SEQ ID NO: 459754 - RNA, 19 nt, Homo sapiens
ugacaacgucuuacccuuu

SEQ ID NO: 459755 - RNA, 19 nt, Homo sapiens
gaaagaaauccuuggaaaa

SEQ ID NO: 459756 - RNA, 19 nt, Homo sapiens
ggaggacaaauaagaaaug

SEQ ID NO: 459757 - RNA, 19 nt, Homo sapiens
agacagacucgaguuguua

SEQ ID NO: 459758 - RNA, 19 nt, Homo sapiens
cauggcagauuugcaacua

SEQ ID NO: 459759 - RNA, 19 nt, Homo sapiens
ucaaguuguuucaugaguu

SEQ ID NO: 459760 - RNA, 19 nt, Homo sapiens
uaggaacaauggaagaaga

SEQ ID NO: 459761 - RNA, 19 nt, Homo sapiens
caaucucccuccuuuguca

SEQ ID NO: 459762 - RNA, 19 nt, Homo sapiens
gcaaguaagagaaccaaag

SEQ ID NO: 459763 - RNA, 19 nt, Homo sapiens
cagcugccauugaagaaau

SEQ ID NO: 459764 - RNA, 19 nt, Homo sapiens
ugaauacacuaaggauguu

SEQ ID NO: 459765 - RNA, 19 nt, Homo sapiens
gugaauacacuaaggaugu

SEQ ID NO: 459766 - RNA, 19 nt, Homo sapiens
cuacuaugacaacgucuua

SEQ ID NO: 459767 - RNA, 19 nt, Homo sapiens
guggguggguagauuuaaa

SEQ ID NO: 459768 - RNA, 19 nt, Homo sapiens
aagagggaauggucaaguu

SEQ ID NO: 459769 - RNA, 19 nt, Homo sapiens
gaacaauggaagaagaaag

SEQ ID NO: 459770 - RNA, 19 nt, Homo sapiens
gugcgugcguuugcaagua

SEQ ID NO: 459771 - RNA, 19 nt, Homo sapiens
gaagagguggccaucuaug

SEQ ID NO: 459772 - RNA, 19 nt, Homo sapiens
caaucaagguagaacaaag

SEQ ID NO: 459773 - RNA, 19 nt, Homo sapiens
caacacaaacuggcuuaau

SEQ ID NO: 459774 - RNA, 19 nt, Homo sapiens
ggaauggucaaguuguuuc

SEQ ID NO: 459775 - RNA, 19 nt, Homo sapiens
acucugguaucuucauaaa

SEQ ID NO: 459776 - RNA, 19 nt, Homo sapiens
gacagcuaaucccagcaua

SEQ ID NO: 459777 - RNA, 19 nt, Homo sapiens
gacaacgucuuacccuuuu

SEQ ID NO: 459778 - RNA, 19 nt, Homo sapiens
gcccuucucugugaauaug

SEQ ID NO: 459779 - RNA, 19 nt, Homo sapiens
cgaccgugaugcugcagaa

SEQ ID NO: 459780 - RNA, 19 nt, Homo sapiens
ugaggaaccaaucaaggua

SEQ ID NO: 459781 - RNA, 19 nt, Homo sapiens
caucagccaccacuacuau

SEQ ID NO: 459782 - RNA, 19 nt, Homo sapiens
cauuccagcugccauugaa

SEQ ID NO: 459783 - RNA, 19 nt, Homo sapiens
ucuguuggcucuacaucuu

SEQ ID NO: 459784 - RNA, 19 nt, Homo sapiens
gaagaagaaaggacugaac

SEQ ID NO: 459785 - RNA, 19 nt, Homo sapiens
gagccaucuuugaggguuu

SEQ ID NO: 459786 - RNA, 19 nt, Homo sapiens
uaaaaugaauuccccuaug

SEQ ID NO: 459787 - RNA, 19 nt, Homo sapiens
ccagagcguucaggaaaca

SEQ ID NO: 459788 - RNA, 19 nt, Homo sapiens
aagacagacucgaguuguu

SEQ ID NO: 459789 - RNA, 19 nt, Homo sapiens
gcuuggaggacaaauaaga

SEQ ID NO: 459790 - RNA, 19 nt, Homo sapiens
uggcuuggaggacaaauaa

SEQ ID NO: 459791 - RNA, 19 nt, Homo sapiens
ccacuucgccuagcuuugu

SEQ ID NO: 459792 - RNA, 19 nt, Homo sapiens
cuccaacucugguaucuuc

SEQ ID NO: 459793 - RNA, 19 nt, Homo sapiens
gcauaauucggcaaagguu

SEQ ID NO: 459794 - RNA, 19 nt, Homo sapiens
uauacucauucaccauuga

SEQ ID NO: 459795 - RNA, 19 nt, Homo sapiens
ggaagaagaaaggacugaa

SEQ ID NO: 459796 - RNA, 19 nt, Homo sapiens
cgaggaauuucuccaacuc

SEQ ID NO: 459797 - RNA, 19 nt, Homo sapiens
gccacgggccacauguuua

SEQ ID NO: 459798 - RNA, 19 nt, Homo sapiens
aaacaggaaaggagcaaug

SEQ ID NO: 459799 - RNA, 19 nt, Homo sapiens
gggaauggucaaguuguuu

SEQ ID NO: 459800 - RNA, 19 nt, Homo sapiens
ggaagcgaccauggccaua

SEQ ID NO: 459801 - RNA, 19 nt, Homo sapiens
gcguagcauuggaaaguuc

SEQ ID NO: 459802 - RNA, 19 nt, Homo sapiens
caagguagaacaaagaaaa

SEQ ID NO: 459803 - RNA, 19 nt, Homo sapiens
ggaacaauggaagaagaaa

SEQ ID NO: 459804 - RNA, 19 nt, Homo sapiens
cagcuaaucccagcauaau

SEQ ID NO: 459805 - RNA, 19 nt, Homo sapiens
cgacccugcccaucucuuu

SEQ ID NO: 459806 - RNA, 19 nt, Homo sapiens
gaagcgaccauggccauag

SEQ ID NO: 459807 - RNA, 19 nt, Homo sapiens
gcagcuggacccaugugaa

SEQ ID NO: 459808 - RNA, 19 nt, Homo sapiens
caaguaagagaaccaaagg

SEQ ID NO: 459809 - RNA, 19 nt, Homo sapiens
auuauacacugucagaugu

SEQ ID NO: 459810 - RNA, 19 nt, Homo sapiens
gcaaaugccuccuucucua

SEQ ID NO: 459811 - RNA, 19 nt, Homo sapiens
gaagagaagcuuuguuuau

SEQ ID NO: 459812 - RNA, 19 nt, Homo sapiens
gcagagagcacagguauga

SEQ ID NO: 459813 - RNA, 19 nt, Homo sapiens
gccaaccacugaagucaua

SEQ ID NO: 459814 - RNA, 19 nt, Homo sapiens
gaacaagcacuuccugaga

SEQ ID NO: 459815 - RNA, 19 nt, Homo sapiens
uaucaugccuggucaagaa

SEQ ID NO: 459816 - RNA, 19 nt, Homo sapiens
ggaagugacugucuaccau

SEQ ID NO: 459817 - RNA, 19 nt, Homo sapiens
cagaagagaagcuuuguuu

SEQ ID NO: 459818 - RNA, 19 nt, Homo sapiens
gaugccagcucaaucaugu

SEQ ID NO: 459819 - RNA, 19 nt, Homo sapiens
aaccacagcugcacaggua

SEQ ID NO: 459820 - RNA, 19 nt, Homo sapiens
ccaagugccuacuacagaa

SEQ ID NO: 459821 - RNA, 19 nt, Homo sapiens
aagagaagcuuuguuuaug

SEQ ID NO: 459822 - RNA, 19 nt, Homo sapiens
ucaaucaugucuacggaaa

SEQ ID NO: 459823 - RNA, 19 nt, Homo sapiens
guaucgauaugguuccuuu

SEQ ID NO: 459824 - RNA, 19 nt, Homo sapiens
caccacagcuggccaagug

SEQ ID NO: 459825 - RNA, 19 nt, Homo sapiens
ggacuggcuuggugucuca

SEQ ID NO: 459826 - RNA, 19 nt, Homo sapiens
gcagacuuaugaagcaaga

SEQ ID NO: 459827 - RNA, 19 nt, Homo sapiens
auauauaggcgcagacuua

SEQ ID NO: 459828 - RNA, 19 nt, Homo sapiens
gagaagcuuuguuuauguc

SEQ ID NO: 459829 - RNA, 19 nt, Homo sapiens
uugcaucucugauauauag

SEQ ID NO: 459830 - RNA, 19 nt, Homo sapiens
uauaggcgcagacuuauga

SEQ ID NO: 459831 - RNA, 19 nt, Homo sapiens
guaccacacuggcagagau

SEQ ID NO: 459832 - RNA, 19 nt, Homo sapiens
gcacacacaccauggaagu

SEQ ID NO: 459833 - RNA, 19 nt, Homo sapiens
caacaauaccaucaucaau

SEQ ID NO: 459834 - RNA, 19 nt, Homo sapiens
ggucaacaauaccaucauc

SEQ ID NO: 459835 - RNA, 19 nt, Homo sapiens
caaggcaacucagaaccaa

SEQ ID NO: 459836 - RNA, 19 nt, Homo sapiens
aacaagcacuuccugagaa

SEQ ID NO: 459837 - RNA, 19 nt, Homo sapiens
agagaagcuuuguuuaugu

SEQ ID NO: 459838 - RNA, 19 nt, Homo sapiens
ccauggaagugacugucua

SEQ ID NO: 459839 - RNA, 19 nt, Homo sapiens
caaaagguauugccagaug

SEQ ID NO: 459840 - RNA, 19 nt, Homo sapiens
ggacagaagcccagagacu

SEQ ID NO: 459841 - RNA, 19 nt, Homo sapiens
ccacauagcagcagucacu

SEQ ID NO: 459842 - RNA, 19 nt, Homo sapiens
acaagcacuuccugagaaa

SEQ ID NO: 459843 - RNA, 19 nt, Homo sapiens
cagcucagccuucaccauu

SEQ ID NO: 459844 - RNA, 19 nt, Homo sapiens
gaugguacagccaccuuaa

SEQ ID NO: 459845 - RNA, 19 nt, Homo sapiens
cugcagagguaucaauugu

SEQ ID NO: 459846 - RNA, 19 nt, Homo sapiens
agaagagaagcuuuguuua

SEQ ID NO: 459847 - RNA, 19 nt, Homo sapiens
caaaugccuccuucucuau

SEQ ID NO: 459848 - RNA, 19 nt, Homo sapiens
ccagaugccagcucaauca

SEQ ID NO: 459849 - RNA, 19 nt, Homo sapiens
gguccuugcaucucugaua

SEQ ID NO: 459850 - RNA, 19 nt, Homo sapiens
gcaucuugcugguguugau

SEQ ID NO: 459851 - RNA, 19 nt, Homo sapiens
cuggagagguggucaagug

SEQ ID NO: 459852 - RNA, 19 nt, Homo sapiens
gggacauacugccucaaug

SEQ ID NO: 459853 - RNA, 19 nt, Homo sapiens
ggaugguacagccaccuua

SEQ ID NO: 459854 - RNA, 19 nt, Homo sapiens
cuucugcucuugucccauu

SEQ ID NO: 459855 - RNA, 19 nt, Homo sapiens
guccuugcaucucugauau

SEQ ID NO: 459856 - RNA, 19 nt, Homo sapiens
guugauggcugugguccuu

SEQ ID NO: 459857 - RNA, 19 nt, Homo sapiens
guggucagcacccagcuua

SEQ ID NO: 459858 - RNA, 19 nt, Homo sapiens
gccaagugccuacuacaga

SEQ ID NO: 459859 - RNA, 19 nt, Homo sapiens
uuacugaccaggugccuuu

SEQ ID NO: 459860 - RNA, 19 nt, Homo sapiens
gcucagccuucaccauuac

SEQ ID NO: 459861 - RNA, 19 nt, Homo sapiens
gggcaaugcugggcacaca

SEQ ID NO: 459862 - RNA, 19 nt, Homo sapiens
gacagaagcccagagacuu

SEQ ID NO: 459863 - RNA, 19 nt, Homo sapiens
ugaugggccuacacugauu

SEQ ID NO: 459864 - RNA, 19 nt, Homo sapiens
cagguuaucugggucaaca

SEQ ID NO: 459865 - RNA, 19 nt, Homo sapiens
cuacaaaaguacccagaaa

SEQ ID NO: 459866 - RNA, 19 nt, Homo sapiens
cugagaaggugccaguuuc

SEQ ID NO: 459867 - RNA, 19 nt, Homo sapiens
ccuuaaggcuggugaagag

SEQ ID NO: 459868 - RNA, 19 nt, Homo sapiens
gaagcugaccucuccuaca

SEQ ID NO: 459869 - RNA, 19 nt, Homo sapiens
gcacagguaacaacuacag

SEQ ID NO: 459870 - RNA, 19 nt, Homo sapiens
uaucaauuguggugcuuuc

SEQ ID NO: 459871 - RNA, 19 nt, Homo sapiens
gggaggacagccaguguau

SEQ ID NO: 459872 - RNA, 19 nt, Homo sapiens
aacaauaccaucaucaaug

SEQ ID NO: 459873 - RNA, 19 nt, Homo sapiens
gcgcagacuuaugaagcaa

SEQ ID NO: 459874 - RNA, 19 nt, Homo sapiens
ccuugcaucucugauauau

SEQ ID NO: 459875 - RNA, 19 nt, Homo sapiens
ucaacaauaccaucaucaa

SEQ ID NO: 459876 - RNA, 19 nt, Homo sapiens
gcauuugagcugacugugu

SEQ ID NO: 459877 - RNA, 19 nt, Homo sapiens
ccugagaaggugccaguuu

SEQ ID NO: 459878 - RNA, 19 nt, Homo sapiens
aaugaugggccuacacuga

SEQ ID NO: 459879 - RNA, 19 nt, Homo sapiens
aaucaugucuacggaaagu

SEQ ID NO: 459880 - RNA, 19 nt, Homo sapiens
ucauuuggcugugauaggu

SEQ ID NO: 459881 - RNA, 19 nt, Homo sapiens
gcaaugcugggcacacaca

SEQ ID NO: 459882 - RNA, 19 nt, Homo sapiens
cuacacugauuggugcaaa

SEQ ID NO: 459883 - RNA, 19 nt, Homo sapiens
acagaagcccagagacuug

SEQ ID NO: 459884 - RNA, 19 nt, Homo sapiens
uaaggcuggugaagagaca

SEQ ID NO: 459885 - RNA, 19 nt, Homo sapiens
ccagcucaaucaugucuac

SEQ ID NO: 459886 - RNA, 19 nt, Homo sapiens
acacacaccauggaaguga

SEQ ID NO: 459887 - RNA, 19 nt, Homo sapiens
gcugaucgugggcaucuug

SEQ ID NO: 459888 - RNA, 19 nt, Homo sapiens
uauugaaagugccgagauc

SEQ ID NO: 459889 - RNA, 19 nt, Homo sapiens
aagcugaccucuccuacac

SEQ ID NO: 459890 - RNA, 19 nt, Homo sapiens
gggcacacacaccauggaa

SEQ ID NO: 459891 - RNA, 19 nt, Homo sapiens
gaggacagccaguguaucc

SEQ ID NO: 459892 - RNA, 19 nt, Homo sapiens
caaugugucucuggcugau

SEQ ID NO: 459893 - RNA, 19 nt, Homo sapiens
gguaucaauuguggugcuu

SEQ ID NO: 459894 - RNA, 19 nt, Homo sapiens
gaaccaaagccuggaacag

SEQ ID NO: 459895 - RNA, 19 nt, Homo sapiens
ggcgcagacuuaugaagca

SEQ ID NO: 459896 - RNA, 19 nt, Homo sapiens
ggucagcacccagcuuauc

SEQ ID NO: 459897 - RNA, 19 nt, Homo sapiens
auuguguucuguaucgaua

SEQ ID NO: 459898 - RNA, 19 nt, Homo sapiens
guuaucugggucaacaaua

SEQ ID NO: 459899 - RNA, 19 nt, Homo sapiens
guaccccaguugccacaua

SEQ ID NO: 459900 - RNA, 19 nt, Homo sapiens
ccuggauuguguucuguau

SEQ ID NO: 459901 - RNA, 19 nt, Homo sapiens
cugcacagguaacaacuac

SEQ ID NO: 459902 - RNA, 19 nt, Homo sapiens
guaaugaugggccuacacu

SEQ ID NO: 459903 - RNA, 19 nt, Homo sapiens
gcaggugccaaccacugaa

SEQ ID NO: 459904 - RNA, 19 nt, Homo sapiens
agaaggugccaguuucaga

SEQ ID NO: 459905 - RNA, 19 nt, Homo sapiens
ggacuuuggagacaguagu

SEQ ID NO: 459906 - RNA, 19 nt, Homo sapiens
uggauuguguucuguaucg

SEQ ID NO: 459907 - RNA, 19 nt, Homo sapiens
agcucagccuucaccauua

SEQ ID NO: 459908 - RNA, 19 nt, Homo sapiens
cagaagcccagagacuuga

SEQ ID NO: 459909 - RNA, 19 nt, Homo sapiens
ccaaggaagccugcaugga

SEQ ID NO: 459910 - RNA, 19 nt, Homo sapiens
caacaucacugaaaccuuu

SEQ ID NO: 459911 - RNA, 19 nt, Homo sapiens
gaagagauauggacuccua

SEQ ID NO: 459912 - RNA, 19 nt, Homo sapiens
gcaguaaucugaauauuuc

SEQ ID NO: 459913 - RNA, 19 nt, Homo sapiens
caacagcucuggcaagaaa

SEQ ID NO: 459914 - RNA, 19 nt, Homo sapiens
gaugguaccuuuccacuuu

SEQ ID NO: 459915 - RNA, 19 nt, Homo sapiens
gaagcaagaugauaccaaa

SEQ ID NO: 459916 - RNA, 19 nt, Homo sapiens
ggacuaaguucucauuguu

SEQ ID NO: 459917 - RNA, 19 nt, Homo sapiens
gcagugaucucuggauuaa

SEQ ID NO: 459918 - RNA, 19 nt, Homo sapiens
gaaaucaaccgcuuccuaa

SEQ ID NO: 459919 - RNA, 19 nt, Homo sapiens
gaacaagacagacagcuaa

SEQ ID NO: 459920 - RNA, 19 nt, Homo sapiens
ugaagaagguguaacauug

SEQ ID NO: 459921 - RNA, 19 nt, Homo sapiens
ucaaguaaaccaccuauua

SEQ ID NO: 459922 - RNA, 19 nt, Homo sapiens
gaaacacaguccagaaguu

SEQ ID NO: 459923 - RNA, 19 nt, Homo sapiens
caacauugcuguggaagaa

SEQ ID NO: 459924 - RNA, 19 nt, Homo sapiens
gagccugacucucaaauga

SEQ ID NO: 459925 - RNA, 19 nt, Homo sapiens
caagagaaaugauaguuca

SEQ ID NO: 459926 - RNA, 19 nt, Homo sapiens
gaauuuggcugucuggaau

SEQ ID NO: 459927 - RNA, 19 nt, Homo sapiens
guaaagaaccuuaaaccaa

SEQ ID NO: 459928 - RNA, 19 nt, Homo sapiens
gaauuuaaccagccacuuu

SEQ ID NO: 459929 - RNA, 19 nt, Homo sapiens
gguagugcaucuucauuaa

SEQ ID NO: 459930 - RNA, 19 nt, Homo sapiens
ugacuucaguucagcuuua

SEQ ID NO: 459931 - RNA, 19 nt, Homo sapiens
caaguaaaccaccuauuaa

SEQ ID NO: 459932 - RNA, 19 nt, Homo sapiens
gguaugggcuugcuguuug

SEQ ID NO: 459933 - RNA, 19 nt, Homo sapiens
cgaagaguauccuauaaga

SEQ ID NO: 459934 - RNA, 19 nt, Homo sapiens
ccauaagucuggauacuga

SEQ ID NO: 459935 - RNA, 19 nt, Homo sapiens
gacaugagccauugacuuu

SEQ ID NO: 459936 - RNA, 19 nt, Homo sapiens
gcaagaccgccuucacaua

SEQ ID NO: 459937 - RNA, 19 nt, Homo sapiens
caauauaguccgcuaaauu

SEQ ID NO: 459938 - RNA, 19 nt, Homo sapiens
ggauggcaauuucauagaa

SEQ ID NO: 459939 - RNA, 19 nt, Homo sapiens
caguaacucuagcaaauaa

SEQ ID NO: 459940 - RNA, 19 nt, Homo sapiens
gagaagaccauccgacuug

SEQ ID NO: 459941 - RNA, 19 nt, Homo sapiens
gagaauaauuuggaucaga

SEQ ID NO: 459942 - RNA, 19 nt, Homo sapiens
gauauggacuccuacaaag

SEQ ID NO: 459943 - RNA, 19 nt, Homo sapiens
gaagacaaauggaguuggu

SEQ ID NO: 459944 - RNA, 19 nt, Homo sapiens
aaacacaguuggauccauu

SEQ ID NO: 459945 - RNA, 19 nt, Homo sapiens
acacgcaaauuguuacuuu

SEQ ID NO: 459946 - RNA, 19 nt, Homo sapiens
gcucuacagugccauauau

SEQ ID NO: 459947 - RNA, 19 nt, Homo sapiens
gaagaagguguaacauuga

SEQ ID NO: 459948 - RNA, 19 nt, Homo sapiens
cacaacgccuggcuaauuu

SEQ ID NO: 459949 - RNA, 19 nt, Homo sapiens
cuacaaagcagugacaaua

SEQ ID NO: 459950 - RNA, 19 nt, Homo sapiens
gagaaaagguguaagcauu

SEQ ID NO: 459951 - RNA, 19 nt, Homo sapiens
ggaguugguuucuguggaa

SEQ ID NO: 459952 - RNA, 19 nt, Homo sapiens
ccacaaggcuccugaucau

SEQ ID NO: 459953 - RNA, 19 nt, Homo sapiens
guaggcaccuucuuagaug

SEQ ID NO: 459954 - RNA, 19 nt, Homo sapiens
gcagaugaauagcaugaau

SEQ ID NO: 459955 - RNA, 19 nt, Homo sapiens
gcaaggagcaaacacaguu

SEQ ID NO: 459956 - RNA, 19 nt, Homo sapiens
guccagcccuguacuguaa

SEQ ID NO: 459957 - RNA, 19 nt, Homo sapiens
aaacgaagaguauccuaua

SEQ ID NO: 459958 - RNA, 19 nt, Homo sapiens
ggaugaaacacgcaaauug

SEQ ID NO: 459959 - RNA, 19 nt, Homo sapiens
gacaguagaucgcuuugau

SEQ ID NO: 459960 - RNA, 19 nt, Homo sapiens
cuacagaaauccaaagcuu

SEQ ID NO: 459961 - RNA, 19 nt, Homo sapiens
caagcaggaugguaccuuu

SEQ ID NO: 459962 - RNA, 19 nt, Homo sapiens
uaggaugcauguugauuaa

SEQ ID NO: 459963 - RNA, 19 nt, Homo sapiens
ccagugaggacaugaauuu

SEQ ID NO: 459964 - RNA, 19 nt, Homo sapiens
ggaagaugccaauacauga

SEQ ID NO: 459965 - RNA, 19 nt, Homo sapiens
ccacaacgccuggcuaauu

SEQ ID NO: 459966 - RNA, 19 nt, Homo sapiens
uaagaagccuuggaguaaa

SEQ ID NO: 459967 - RNA, 19 nt, Homo sapiens
ucacgacucugguguugaa

SEQ ID NO: 459968 - RNA, 19 nt, Homo sapiens
gaucacgacucugguguug

SEQ ID NO: 459969 - RNA, 19 nt, Homo sapiens
gcaguaacucuagcaaaua

SEQ ID NO: 459970 - RNA, 19 nt, Homo sapiens
guaccugaaugccuagaaa

SEQ ID NO: 459971 - RNA, 19 nt, Homo sapiens
cuaagaagccuuggaguaa

SEQ ID NO: 459972 - RNA, 19 nt, Homo sapiens
uggaaauggugaauaauga

SEQ ID NO: 459973 - RNA, 19 nt, Homo sapiens
ggaaauuucaucauaguuc

SEQ ID NO: 459974 - RNA, 19 nt, Homo sapiens
uaauuaggaugcauguuga

SEQ ID NO: 459975 - RNA, 19 nt, Homo sapiens
uaaagcagaugaauagcau

SEQ ID NO: 459976 - RNA, 19 nt, Homo sapiens
caagacugguggacaaaga

SEQ ID NO: 459977 - RNA, 19 nt, Homo sapiens
caagaccgccuucacauau

SEQ ID NO: 459978 - RNA, 19 nt, Homo sapiens
aaucugaucccaagguuua

SEQ ID NO: 459979 - RNA, 19 nt, Homo sapiens
ggaaucugaucccaagguu

SEQ ID NO: 459980 - RNA, 19 nt, Homo sapiens
caaaguucauacucaagaa

SEQ ID NO: 459981 - RNA, 19 nt, Homo sapiens
uuaagaagguccagcaugu

SEQ ID NO: 459982 - RNA, 19 nt, Homo sapiens
caacgcagauacgccagua

SEQ ID NO: 459983 - RNA, 19 nt, Homo sapiens
ugauguaccuguguucuuu

SEQ ID NO: 459984 - RNA, 19 nt, Homo sapiens
caguugauauucccaguuu

SEQ ID NO: 459985 - RNA, 19 nt, Homo sapiens
caaaugaagcaagaugaua

SEQ ID NO: 459986 - RNA, 19 nt, Homo sapiens
gaagauuucuaagauccaa

SEQ ID NO: 459987 - RNA, 19 nt, Homo sapiens
guaaggcuuccaagaauuu

SEQ ID NO: 459988 - RNA, 19 nt, Homo sapiens
gagcaguaaucugaauauu

SEQ ID NO: 459989 - RNA, 19 nt, Homo sapiens
gcaaaguucauacucaaga

SEQ ID NO: 459990 - RNA, 19 nt, Homo sapiens
ucacugaaaccuuuaagaa

SEQ ID NO: 459991 - RNA, 19 nt, Homo sapiens
ggauuaaacugcaugucau

SEQ ID NO: 459992 - RNA, 19 nt, Homo sapiens
caaagauuguguccuuaau

SEQ ID NO: 459993 - RNA, 19 nt, Homo sapiens
aaugauaguucacagugua

SEQ ID NO: 459994 - RNA, 19 nt, Homo sapiens
ccagaugaauaccagguuu

SEQ ID NO: 459995 - RNA, 19 nt, Homo sapiens
caguaaggcuuccaagaau

SEQ ID NO: 459996 - RNA, 19 nt, Homo sapiens
caagggacuuauaaauaug

SEQ ID NO: 459997 - RNA, 19 nt, Homo sapiens
gguguaacauugacaguag

SEQ ID NO: 459998 - RNA, 19 nt, Homo sapiens
agacgaagaugaagaaggu

SEQ ID NO: 459999 - RNA, 19 nt, Homo sapiens
ugacaauagugaagaugaa

SEQ ID NO: 460000 - RNA, 19 nt, Homo sapiens
caaaugcuauagcucugaa

SEQ ID NO: 460001 - RNA, 19 nt, Homo sapiens
gcagaaaguguaagcaugu

SEQ ID NO: 460002 - RNA, 19 nt, Homo sapiens
gcauucuguucuucaagua

SEQ ID NO: 460003 - RNA, 19 nt, Homo sapiens
gaugaaacacgcaaauugu

SEQ ID NO: 460004 - RNA, 19 nt, Homo sapiens
gaucaguuauuccuacaag

SEQ ID NO: 460005 - RNA, 19 nt, Homo sapiens
uaaugcaacucuuaagcaa

SEQ ID NO: 460006 - RNA, 19 nt, Homo sapiens
gagcagccgucuaccaaag

SEQ ID NO: 460007 - RNA, 19 nt, Homo sapiens
ggagauaugggcaguuguu

SEQ ID NO: 460008 - RNA, 19 nt, Homo sapiens
gaacaguauuaaaccaucu

SEQ ID NO: 460009 - RNA, 19 nt, Homo sapiens
ugauuaaacucgagauaca

SEQ ID NO: 460010 - RNA, 19 nt, Homo sapiens
gaacugaacuuauuaccua

SEQ ID NO: 460011 - RNA, 19 nt, Homo sapiens
ggaaguaguucuaugaaua

SEQ ID NO: 460012 - RNA, 19 nt, Homo sapiens
gagcagaacugaacuuauu

SEQ ID NO: 460013 - RNA, 19 nt, Homo sapiens
gcaguacucugaaggaaua

SEQ ID NO: 460014 - RNA, 19 nt, Homo sapiens
gaucaagugugcauauaua

SEQ ID NO: 460015 - RNA, 19 nt, Homo sapiens
gagaacagauuacagcuaa

SEQ ID NO: 460016 - RNA, 19 nt, Homo sapiens
gcacuagcauucaggguua

SEQ ID NO: 460017 - RNA, 19 nt, Homo sapiens
gaagagaggcauuuccaua

SEQ ID NO: 460018 - RNA, 19 nt, Homo sapiens
ggacaaagcauccauaauc

SEQ ID NO: 460019 - RNA, 19 nt, Homo sapiens
gauccuagcuaaagacuau

SEQ ID NO: 460020 - RNA, 19 nt, Homo sapiens
ugagaggacugaugaauga

SEQ ID NO: 460021 - RNA, 19 nt, Homo sapiens
uaagaacacugagauauug

SEQ ID NO: 460022 - RNA, 19 nt, Homo sapiens
ggaaacagcauuuaugaau

SEQ ID NO: 460023 - RNA, 19 nt, Homo sapiens
ggagagagucuaagauaaa

SEQ ID NO: 460024 - RNA, 19 nt, Homo sapiens
ggacaacguuggccgagaa

SEQ ID NO: 460025 - RNA, 19 nt, Homo sapiens
cuaauuaacucucugcuau

SEQ ID NO: 460026 - RNA, 19 nt, Homo sapiens
ccacaugacagcaguguua

SEQ ID NO: 460027 - RNA, 19 nt, Homo sapiens
caacaaacuuggucuuaca

SEQ ID NO: 460028 - RNA, 19 nt, Homo sapiens
gacaaagcauccauaauca

SEQ ID NO: 460029 - RNA, 19 nt, Homo sapiens
aaagggagcuaaauugaau

SEQ ID NO: 460030 - RNA, 19 nt, Homo sapiens
gcuaaagacuaucugcauu

SEQ ID NO: 460031 - RNA, 19 nt, Homo sapiens
acacuaaacuucuuaacga

SEQ ID NO: 460032 - RNA, 19 nt, Homo sapiens
gugcauauauacuacauga

SEQ ID NO: 460033 - RNA, 19 nt, Homo sapiens
aaacauagcacuagcauuc

SEQ ID NO: 460034 - RNA, 19 nt, Homo sapiens
gaacaagacacaaugaaag

SEQ ID NO: 460035 - RNA, 19 nt, Homo sapiens
guaagaacacugagauauu

SEQ ID NO: 460036 - RNA, 19 nt, Homo sapiens
caacuggcuuccauuaaug

SEQ ID NO: 460037 - RNA, 19 nt, Homo sapiens
ccaacuggcuuccauuaau

SEQ ID NO: 460038 - RNA, 19 nt, Homo sapiens
ugaaucaggugaccgauau

SEQ ID NO: 460039 - RNA, 19 nt, Homo sapiens
ggaacaagacacaaugaaa

SEQ ID NO: 460040 - RNA, 19 nt, Homo sapiens
gagcuuaaguugugagaag

SEQ ID NO: 460041 - RNA, 19 nt, Homo sapiens
ccagugaagugccacauga

SEQ ID NO: 460042 - RNA, 19 nt, Homo sapiens
gagcuaaauugaauacaca

SEQ ID NO: 460043 - RNA, 19 nt, Homo sapiens
gcgaaaccauuagaaacua

SEQ ID NO: 460044 - RNA, 19 nt, Homo sapiens
uuagaugcuuugugacuua

SEQ ID NO: 460045 - RNA, 19 nt, Homo sapiens
caccugguauccauuauaa

SEQ ID NO: 460046 - RNA, 19 nt, Homo sapiens
gcauauauacuacaugaga

SEQ ID NO: 460047 - RNA, 19 nt, Homo sapiens
ugccaaauaugaucucuaa

SEQ ID NO: 460048 - RNA, 19 nt, Homo sapiens
uguaauggcucacacuuug

SEQ ID NO: 460049 - RNA, 19 nt, Homo sapiens
gauaugcccuggagcacuu

SEQ ID NO: 460050 - RNA, 19 nt, Homo sapiens
ggcccuaccuguaacuuaa

SEQ ID NO: 460051 - RNA, 19 nt, Homo sapiens
ggauauaucuccucaucag

SEQ ID NO: 460052 - RNA, 19 nt, Homo sapiens
cuacacagcaauauguuua

SEQ ID NO: 460053 - RNA, 19 nt, Homo sapiens
gaccacaguuguaccauuc

SEQ ID NO: 460054 - RNA, 19 nt, Homo sapiens
gcugauagacaaguaguua

SEQ ID NO: 460055 - RNA, 19 nt, Homo sapiens
caggagagagucuaagaua

SEQ ID NO: 460056 - RNA, 19 nt, Homo sapiens
agaagaagagaacagauua

SEQ ID NO: 460057 - RNA, 19 nt, Homo sapiens
caaaguagcccacaugaac

SEQ ID NO: 460058 - RNA, 19 nt, Homo sapiens
gacaaguaguuaagagcua

SEQ ID NO: 460059 - RNA, 19 nt, Homo sapiens
ugacagcaguguuaagugu

SEQ ID NO: 460060 - RNA, 19 nt, Homo sapiens
ccacucagcaaaugauuaa

SEQ ID NO: 460061 - RNA, 19 nt, Homo sapiens
cuaguuuccugguuuguaa

SEQ ID NO: 460062 - RNA, 19 nt, Homo sapiens
aaggaucucugaaacauau

SEQ ID NO: 460063 - RNA, 19 nt, Homo sapiens
ccaguuugauccuagcuaa

SEQ ID NO: 460064 - RNA, 19 nt, Homo sapiens
gaccaacuggcuuccauua

SEQ ID NO: 460065 - RNA, 19 nt, Homo sapiens
caccaugacugacaacaga

SEQ ID NO: 460066 - RNA, 19 nt, Homo sapiens
guacacagaaguuuagaug

SEQ ID NO: 460067 - RNA, 19 nt, Homo sapiens
gcguucauguucugugaua

SEQ ID NO: 460068 - RNA, 19 nt, Homo sapiens
gagcaguacucugaaggaa

SEQ ID NO: 460069 - RNA, 19 nt, Homo sapiens
guaguucuaugaauaugga

SEQ ID NO: 460070 - RNA, 19 nt, Homo sapiens
caagugugcauauauacua

SEQ ID NO: 460071 - RNA, 19 nt, Homo sapiens
gcaaauacuucagccucuu

SEQ ID NO: 460072 - RNA, 19 nt, Homo sapiens
gcucucaccggcaguauuu

SEQ ID NO: 460073 - RNA, 19 nt, Homo sapiens
ucaacuauguccucacaga

SEQ ID NO: 460074 - RNA, 19 nt, Homo sapiens
ucacggagaucaagcuaca

SEQ ID NO: 460075 - RNA, 19 nt, Homo sapiens
caaagcauccauaaucaga

SEQ ID NO: 460076 - RNA, 19 nt, Homo sapiens
uuaggcagguuacaguuaa

SEQ ID NO: 460077 - RNA, 19 nt, Homo sapiens
cagcauaaguaaacaacau

SEQ ID NO: 460078 - RNA, 19 nt, Homo sapiens
uaagggcucagcauaagua

SEQ ID NO: 460079 - RNA, 19 nt, Homo sapiens
gaaaagggagcuaaauuga

SEQ ID NO: 460080 - RNA, 19 nt, Homo sapiens
uaugacagcgaaaccauua

SEQ ID NO: 460081 - RNA, 19 nt, Homo sapiens
caagacacaaugaaagaaa

SEQ ID NO: 460082 - RNA, 19 nt, Homo sapiens
aaguuuagaugcuuuguga

SEQ ID NO: 460083 - RNA, 19 nt, Homo sapiens
ucagccagcucauuugguu

SEQ ID NO: 460084 - RNA, 19 nt, Homo sapiens
gaagauaguguggucaguu

SEQ ID NO: 460085 - RNA, 19 nt, Homo sapiens
caagacugaucauucuguu

SEQ ID NO: 460086 - RNA, 19 nt, Homo sapiens
uagaucaagugugcauaua

SEQ ID NO: 460087 - RNA, 19 nt, Homo sapiens
ggaugaaucugcggagcuu

SEQ ID NO: 460088 - RNA, 19 nt, Homo sapiens
ggguaugggugcagagcua

SEQ ID NO: 460089 - RNA, 19 nt, Homo sapiens
gaaggaaaacagugaauuu

SEQ ID NO: 460090 - RNA, 19 nt, Homo sapiens
ucaauacacuguucuuggu

SEQ ID NO: 460091 - RNA, 19 nt, Homo sapiens
ggaauaggcaaaauguuua

SEQ ID NO: 460092 - RNA, 19 nt, Homo sapiens
caaaccaauucacccagaa

SEQ ID NO: 460093 - RNA, 19 nt, Homo sapiens
ggcauaaauuagagaaaug

SEQ ID NO: 460094 - RNA, 19 nt, Homo sapiens
uuugauacguguuccuaua

SEQ ID NO: 460095 - RNA, 19 nt, Homo sapiens
gaucucuggauucuaauuu

SEQ ID NO: 460096 - RNA, 19 nt, Homo sapiens
caaaauaacugagaaagag

SEQ ID NO: 460097 - RNA, 19 nt, Homo sapiens
caacauugcauugugacua

SEQ ID NO: 460098 - RNA, 19 nt, Homo sapiens
ggacuaggagggagaagga

SEQ ID NO: 460099 - RNA, 19 nt, Homo sapiens
ugaacuggcuaaauuacug

SEQ ID NO: 460100 - RNA, 19 nt, Homo sapiens
gcuaugaguugucaagacu

SEQ ID NO: 460101 - RNA, 19 nt, Homo sapiens
cugcggagcuuaaguugug

SEQ ID NO: 460102 - RNA, 19 nt, Homo sapiens
ucaccuugcuuuucaguua

SEQ ID NO: 460103 - RNA, 19 nt, Homo sapiens
cgaaaccauuagaaacuau

SEQ ID NO: 460104 - RNA, 19 nt, Homo sapiens
acaaguaguuaagagcuaa

SEQ ID NO: 460105 - RNA, 19 nt, Homo sapiens
caaacugcgguauacauuu

SEQ ID NO: 460106 - RNA, 19 nt, Homo sapiens
caauucggaucgcauuuca

SEQ ID NO: 460107 - RNA, 19 nt, Homo sapiens
caaacuuggucuuacaucu

SEQ ID NO: 460108 - RNA, 19 nt, Homo sapiens
aggagagagucuaagauaa

SEQ ID NO: 460109 - RNA, 19 nt, Homo sapiens
uaacugagaaagagagaga

SEQ ID NO: 460110 - RNA, 19 nt, Homo sapiens
agacaaagcugagaacaaa

SEQ ID NO: 460111 - RNA, 19 nt, Homo sapiens
caauacagcucguuccaaa

SEQ ID NO: 460112 - RNA, 19 nt, Homo sapiens
uaucaacacugcagcauuu

SEQ ID NO: 460113 - RNA, 19 nt, Homo sapiens
caacuccacugucuuuaaa

SEQ ID NO: 460114 - RNA, 19 nt, Homo sapiens
gcaaauauccuccacuuuc

SEQ ID NO: 460115 - RNA, 19 nt, Homo sapiens
agagacagcuguuugaauu

SEQ ID NO: 460116 - RNA, 19 nt, Homo sapiens
ucacggagauugaauacaa

SEQ ID NO: 460117 - RNA, 19 nt, Homo sapiens
gaaccgccguccuucaauu

SEQ ID NO: 460118 - RNA, 19 nt, Homo sapiens
guucaugagucuuguaauu

SEQ ID NO: 460119 - RNA, 19 nt, Homo sapiens
uuaaagaucucaacaugga

SEQ ID NO: 460120 - RNA, 19 nt, Homo sapiens
ugaccgaggugacggguua

SEQ ID NO: 460121 - RNA, 19 nt, Homo sapiens
gcuuaaagaucucaacaug

SEQ ID NO: 460122 - RNA, 19 nt, Homo sapiens
cugucaagcuucauuauua

SEQ ID NO: 460123 - RNA, 19 nt, Homo sapiens
uaucggagcaguucaauaa

SEQ ID NO: 460124 - RNA, 19 nt, Homo sapiens
ggaaauaagccgaggguau

SEQ ID NO: 460125 - RNA, 19 nt, Homo sapiens
caaauauccuccacuuuca

SEQ ID NO: 460126 - RNA, 19 nt, Homo sapiens
gaaggaaaauggcgaguuu

SEQ ID NO: 460127 - RNA, 19 nt, Homo sapiens
uaggugugcuucccaaaua

SEQ ID NO: 460128 - RNA, 19 nt, Homo sapiens
agaucaagcuguacaguaa

SEQ ID NO: 460129 - RNA, 19 nt, Homo sapiens
ccaaauacauuaacaagcu

SEQ ID NO: 460130 - RNA, 19 nt, Homo sapiens
cgaccuacauuaauuuaug

SEQ ID NO: 460131 - RNA, 19 nt, Homo sapiens
ggagauaccaccgacauuu

SEQ ID NO: 460132 - RNA, 19 nt, Homo sapiens
gaguagcaccuucagaaua

SEQ ID NO: 460133 - RNA, 19 nt, Homo sapiens
gcagaagugaugauuguaa

SEQ ID NO: 460134 - RNA, 19 nt, Homo sapiens
gaccgcuucuguccauuua

SEQ ID NO: 460135 - RNA, 19 nt, Homo sapiens
gaaauuagugaaacccaaa

SEQ ID NO: 460136 - RNA, 19 nt, Homo sapiens
ucaccgagaucaagcugua

SEQ ID NO: 460137 - RNA, 19 nt, Homo sapiens
gguguagguuugauuacua

SEQ ID NO: 460138 - RNA, 19 nt, Homo sapiens
gcucugaacugcacaaugc

SEQ ID NO: 460139 - RNA, 19 nt, Homo sapiens
gcacgaccuacauuaauuu

SEQ ID NO: 460140 - RNA, 19 nt, Homo sapiens
aaagguuacuguugagaaa

SEQ ID NO: 460141 - RNA, 19 nt, Homo sapiens
ccagacaguuuaugagaau

SEQ ID NO: 460142 - RNA, 19 nt, Homo sapiens
gugucuaccuuguuauuaa

SEQ ID NO: 460143 - RNA, 19 nt, Homo sapiens
gcacucagcuauaccucau

SEQ ID NO: 460144 - RNA, 19 nt, Homo sapiens
gcagugaccuucuguacac

SEQ ID NO: 460145 - RNA, 19 nt, Homo sapiens
auaccaagaugaagacaaa

SEQ ID NO: 460146 - RNA, 19 nt, Homo sapiens
gggcaacaguauuuaugaa

SEQ ID NO: 460147 - RNA, 19 nt, Homo sapiens
uaaagcaccagcaguguuu

SEQ ID NO: 460148 - RNA, 19 nt, Homo sapiens
gagaucaagcuguacagua

SEQ ID NO: 460149 - RNA, 19 nt, Homo sapiens
gauuguaagucccaugaau

SEQ ID NO: 460150 - RNA, 19 nt, Homo sapiens
gcuccaagaguaugagaua

SEQ ID NO: 460151 - RNA, 19 nt, Homo sapiens
caucgugagugucaauuau

SEQ ID NO: 460152 - RNA, 19 nt, Homo sapiens
gugaggaccugacacaauc

SEQ ID NO: 460153 - RNA, 19 nt, Homo sapiens
gaaagguguagguuugauu

SEQ ID NO: 460154 - RNA, 19 nt, Homo sapiens
aguagcaccuucagaauau

SEQ ID NO: 460155 - RNA, 19 nt, Homo sapiens
ucaauggacugcaccuugu

SEQ ID NO: 460156 - RNA, 19 nt, Homo sapiens
ugaaggagaaguccaagaa

SEQ ID NO: 460157 - RNA, 19 nt, Homo sapiens
gcaguucaauaacaaaggu

SEQ ID NO: 460158 - RNA, 19 nt, Homo sapiens
aaagguguagguuugauua

SEQ ID NO: 460159 - RNA, 19 nt, Homo sapiens
cuugaaagguguagguuug

SEQ ID NO: 460160 - RNA, 19 nt, Homo sapiens
ucacuaggcucguguuugc

SEQ ID NO: 460161 - RNA, 19 nt, Homo sapiens
gccaacaaaccaagacuaa

SEQ ID NO: 460162 - RNA, 19 nt, Homo sapiens
acacaacuccacugucuuu

SEQ ID NO: 460163 - RNA, 19 nt, Homo sapiens
ccgcaaauauccuccacuu

SEQ ID NO: 460164 - RNA, 19 nt, Homo sapiens
aagcugauauuccuggauu

SEQ ID NO: 460165 - RNA, 19 nt, Homo sapiens
gagaggucguucuuucuuc

SEQ ID NO: 460166 - RNA, 19 nt, Homo sapiens
caacaaaccaagacuaagg

SEQ ID NO: 460167 - RNA, 19 nt, Homo sapiens
ccaaauggacaaacuggaa

SEQ ID NO: 460168 - RNA, 19 nt, Homo sapiens
guaauuaaaccgugauucu

SEQ ID NO: 460169 - RNA, 19 nt, Homo sapiens
ucagugggccucaugguaa

SEQ ID NO: 460170 - RNA, 19 nt, Homo sapiens
gaacauguuacgugugcaa

SEQ ID NO: 460171 - RNA, 19 nt, Homo sapiens
gccagacaguuuaugagaa

SEQ ID NO: 460172 - RNA, 19 nt, Homo sapiens
ccuaugaacucuugauaac

SEQ ID NO: 460173 - RNA, 19 nt, Homo sapiens
gacuuuggauggauuuguu

SEQ ID NO: 460174 - RNA, 19 nt, Homo sapiens
gaaggcagaagugaugauu

SEQ ID NO: 460175 - RNA, 19 nt, Homo sapiens
gaggcgcgaugaaggagaa

SEQ ID NO: 460176 - RNA, 19 nt, Homo sapiens
ggagauugaauacaaggaa

SEQ ID NO: 460177 - RNA, 19 nt, Homo sapiens
auagagaggucguucuuuc

SEQ ID NO: 460178 - RNA, 19 nt, Homo sapiens
aaggagaaguccaagaaug

SEQ ID NO: 460179 - RNA, 19 nt, Homo sapiens
cgagaaaacuucguaagaa

SEQ ID NO: 460180 - RNA, 19 nt, Homo sapiens
gcaucgugagugucaauua

SEQ ID NO: 460181 - RNA, 19 nt, Homo sapiens
agaagacccuauaccauca

SEQ ID NO: 460182 - RNA, 19 nt, Homo sapiens
gugcuucccaaauacauua

SEQ ID NO: 460183 - RNA, 19 nt, Homo sapiens
cgcacgaccuacauuaauu

SEQ ID NO: 460184 - RNA, 19 nt, Homo sapiens
cgagaccgcuucuguccau

SEQ ID NO: 460185 - RNA, 19 nt, Homo sapiens
gaaggagaaguccaagaau

SEQ ID NO: 460186 - RNA, 19 nt, Homo sapiens
gcauuuugcugcuuuauca

SEQ ID NO: 460187 - RNA, 19 nt, Homo sapiens
gcauugaaccgccguccuu

SEQ ID NO: 460188 - RNA, 19 nt, Homo sapiens
auacacaacuccacugucu

SEQ ID NO: 460189 - RNA, 19 nt, Homo sapiens
aggcagaagugaugauugu

SEQ ID NO: 460190 - RNA, 19 nt, Homo sapiens
ggugaaggcagaagugaug

SEQ ID NO: 460191 - RNA, 19 nt, Homo sapiens
caagaaacuaggaaauuag

SEQ ID NO: 460192 - RNA, 19 nt, Homo sapiens
cacaagaaacuaggaaauu

SEQ ID NO: 460193 - RNA, 19 nt, Homo sapiens
cggagcaguucaauaacaa

SEQ ID NO: 460194 - RNA, 19 nt, Homo sapiens
caacugcucucaaaaugug

SEQ ID NO: 460195 - RNA, 19 nt, Homo sapiens
ugcaacagguaaacagaaa

SEQ ID NO: 460196 - RNA, 19 nt, Homo sapiens
gcaauacggaacacuguca

SEQ ID NO: 460197 - RNA, 19 nt, Homo sapiens
guagcaccuucagaauaua

SEQ ID NO: 460198 - RNA, 19 nt, Homo sapiens
gaauacacaacuccacugu

SEQ ID NO: 460199 - RNA, 19 nt, Homo sapiens
caaagguuacuguugagaa

SEQ ID NO: 460200 - RNA, 19 nt, Homo sapiens
uacaccaacugcucucaaa

SEQ ID NO: 460201 - RNA, 19 nt, Homo sapiens
gaauacauccauccuucug

SEQ ID NO: 460202 - RNA, 19 nt, Homo sapiens
cagaagugaugauuguaag

SEQ ID NO: 460203 - RNA, 19 nt, Homo sapiens
cgguuucacuccgcaaaua

SEQ ID NO: 460204 - RNA, 19 nt, Homo sapiens
gcagagacagcuguuugaa

SEQ ID NO: 460205 - RNA, 19 nt, Homo sapiens
gaagaucaggcaguauaug

SEQ ID NO: 460206 - RNA, 19 nt, Homo sapiens
caacagguaaacagaaauc

SEQ ID NO: 460207 - RNA, 19 nt, Homo sapiens
guagccagacaguuuauga

SEQ ID NO: 460208 - RNA, 19 nt, Homo sapiens
aagaguagcaccuucagaa

SEQ ID NO: 460209 - RNA, 19 nt, Homo sapiens
gagcucacgggcaacagua

SEQ ID NO: 460210 - RNA, 19 nt, Homo sapiens
gaaggugacaucaggauua

SEQ ID NO: 460211 - RNA, 19 nt, Homo sapiens
caauacagcucauuccaaa

SEQ ID NO: 460212 - RNA, 19 nt, Homo sapiens
agacaaagcugagaacaaa

SEQ ID NO: 460213 - RNA, 19 nt, Homo sapiens
ucacggagauugaauacaa

SEQ ID NO: 460214 - RNA, 19 nt, Homo sapiens
ggacacuagugacaguaua

SEQ ID NO: 460215 - RNA, 19 nt, Homo sapiens
ugaccgaggugacggguua

SEQ ID NO: 460216 - RNA, 19 nt, Homo sapiens
gaaggaaaauggcgaguuu

SEQ ID NO: 460217 - RNA, 19 nt, Homo sapiens
agaucaagcuguacaguaa

SEQ ID NO: 460218 - RNA, 19 nt, Homo sapiens
gagcuaagaucacaucacu

SEQ ID NO: 460219 - RNA, 19 nt, Homo sapiens
aaacuaugguggaaauuug

SEQ ID NO: 460220 - RNA, 19 nt, Homo sapiens
gaccgcuucuguccauuua

SEQ ID NO: 460221 - RNA, 19 nt, Homo sapiens
ggacauguauucccauugc

SEQ ID NO: 460222 - RNA, 19 nt, Homo sapiens
gaaauuagugaaacccaaa

SEQ ID NO: 460223 - RNA, 19 nt, Homo sapiens
ucaccgagaucaagcugua

SEQ ID NO: 460224 - RNA, 19 nt, Homo sapiens
cgacaagccugccaacaag

SEQ ID NO: 460225 - RNA, 19 nt, Homo sapiens
gacagaacccucacgcuuu

SEQ ID NO: 460226 - RNA, 19 nt, Homo sapiens
gcagugaccuucuguacac

SEQ ID NO: 460227 - RNA, 19 nt, Homo sapiens
auaccaagaugaagacaaa

SEQ ID NO: 460228 - RNA, 19 nt, Homo sapiens
gggcaacaguauuuaugaa

SEQ ID NO: 460229 - RNA, 19 nt, Homo sapiens
aaccagaagugaauauuug

SEQ ID NO: 460230 - RNA, 19 nt, Homo sapiens
gagaucaagcuguacagua

SEQ ID NO: 460231 - RNA, 19 nt, Homo sapiens
gauaggaggaucacuugaa

SEQ ID NO: 460232 - RNA, 19 nt, Homo sapiens
caaccagaagugaauauuu

SEQ ID NO: 460233 - RNA, 19 nt, Homo sapiens
gcuccaagaguaugagaua

SEQ ID NO: 460234 - RNA, 19 nt, Homo sapiens
gauguccucugcggagaua

SEQ ID NO: 460235 - RNA, 19 nt, Homo sapiens
caucgugagugucaauuau

SEQ ID NO: 460236 - RNA, 19 nt, Homo sapiens
uaucuggccuucacguaaa

SEQ ID NO: 460237 - RNA, 19 nt, Homo sapiens
caaacggccuauuggcuau

SEQ ID NO: 460238 - RNA, 19 nt, Homo sapiens
caugcuaguucaacagaaa

SEQ ID NO: 460239 - RNA, 19 nt, Homo sapiens
ggaaaacuaugguggaaau

SEQ ID NO: 460240 - RNA, 19 nt, Homo sapiens
cguaaauccuggccacauu

SEQ ID NO: 460241 - RNA, 19 nt, Homo sapiens
acagaacccucacgcuuug

SEQ ID NO: 460242 - RNA, 19 nt, Homo sapiens
gagauaggaggaucacuug

SEQ ID NO: 460243 - RNA, 19 nt, Homo sapiens
ugaaggagaaguccaagaa

SEQ ID NO: 460244 - RNA, 19 nt, Homo sapiens
guauaaagggcaaaggaaa

SEQ ID NO: 460245 - RNA, 19 nt, Homo sapiens
gguggcagauggagacaga

SEQ ID NO: 460246 - RNA, 19 nt, Homo sapiens
gcaauacagcucauuccaa

SEQ ID NO: 460247 - RNA, 19 nt, Homo sapiens
aagcugauauuccuggauu

SEQ ID NO: 460248 - RNA, 19 nt, Homo sapiens
gagaggucguucuuucuuc

SEQ ID NO: 460249 - RNA, 19 nt, Homo sapiens
gcgacaagccugccaacaa

SEQ ID NO: 460250 - RNA, 19 nt, Homo sapiens
ccaaauggacaaacuggaa

SEQ ID NO: 460251 - RNA, 19 nt, Homo sapiens
gaggcgcgaugaaggagaa

SEQ ID NO: 460252 - RNA, 19 nt, Homo sapiens
ggagauugaauacaaggaa

SEQ ID NO: 460253 - RNA, 19 nt, Homo sapiens
auagagaggucguucuuuc

SEQ ID NO: 460254 - RNA, 19 nt, Homo sapiens
gacuuuggauggauuuguu

SEQ ID NO: 460255 - RNA, 19 nt, Homo sapiens
aaggagaaguccaagaaug

SEQ ID NO: 460256 - RNA, 19 nt, Homo sapiens
gcaucgugagugucaauua

SEQ ID NO: 460257 - RNA, 19 nt, Homo sapiens
agaagacccuauaccauca

SEQ ID NO: 460258 - RNA, 19 nt, Homo sapiens
gguggaaggugggaacaga

SEQ ID NO: 460259 - RNA, 19 nt, Homo sapiens
gaagugaauauuugagaca

SEQ ID NO: 460260 - RNA, 19 nt, Homo sapiens
gaaaccccaucuccacuaa

SEQ ID NO: 460261 - RNA, 19 nt, Homo sapiens
ugagacaaacggccuauug

SEQ ID NO: 460262 - RNA, 19 nt, Homo sapiens
gaaggagaaguccaagaau

SEQ ID NO: 460263 - RNA, 19 nt, Homo sapiens
cgagaccgcuucuguccau

SEQ ID NO: 460264 - RNA, 19 nt, Homo sapiens
caagaaacuaggaaauuag

SEQ ID NO: 460265 - RNA, 19 nt, Homo sapiens
cacaagaaacuaggaaauu

SEQ ID NO: 460266 - RNA, 19 nt, Homo sapiens
guaucuggccuucacguaa

SEQ ID NO: 460267 - RNA, 19 nt, Homo sapiens
ucaguuucuucaccuguaa

SEQ ID NO: 460268 - RNA, 19 nt, Homo sapiens
gaacaccccagcugcauuu

SEQ ID NO: 460269 - RNA, 19 nt, Homo sapiens
gacacuagugacaguauaa

SEQ ID NO: 460270 - RNA, 19 nt, Homo sapiens
gaagaucaggcaguauaug

SEQ ID NO: 460271 - RNA, 19 nt, Homo sapiens
gaauacauccauccuucug

SEQ ID NO: 460272 - RNA, 19 nt, Homo sapiens
agaccgagauggugcagau

SEQ ID NO: 460273 - RNA, 19 nt, Homo sapiens
caggacauguauucccauu

SEQ ID NO: 460274 - RNA, 19 nt, Homo sapiens
gaaggugggaacagagguu

SEQ ID NO: 460275 - RNA, 19 nt, Homo sapiens
gaaagcagugaccuucugu

SEQ ID NO: 460276 - RNA, 19 nt, Homo sapiens
gggugugggugcagagcua

SEQ ID NO: 460277 - RNA, 19 nt, Homo sapiens
gggccagccuugaccugaa

SEQ ID NO: 460278 - RNA, 19 nt, Homo sapiens
gagcucacgggcaacagua

SEQ ID NO: 460279 - RNA, 19 nt, Homo sapiens
ggucaggaguuugcgacaa

SEQ ID NO: 460280 - RNA, 19 nt, Homo sapiens
gcuguacaguaacauguuc

SEQ ID NO: 460281 - RNA, 19 nt, Homo sapiens
gaaaugugucuuggcgaaa

SEQ ID NO: 460282 - RNA, 19 nt, Homo sapiens
gcccuucuccuaccauuau

SEQ ID NO: 460283 - RNA, 19 nt, Homo sapiens
uugaagaucaggcaguaua

SEQ ID NO: 460284 - RNA, 19 nt, Homo sapiens
ugagauaggaggaucacuu

SEQ ID NO: 460285 - RNA, 19 nt, Homo sapiens
gcagacugacuccuguuug

SEQ ID NO: 460286 - RNA, 19 nt, Homo sapiens
cgcacuugcugcagacuuu

SEQ ID NO: 460287 - RNA, 19 nt, Homo sapiens
ggcaguauaugcuggacau

SEQ ID NO: 460288 - RNA, 19 nt, Homo sapiens
gauagagaggucguucuuu

SEQ ID NO: 460289 - RNA, 19 nt, Homo sapiens
ccaagaguaugagauagag

SEQ ID NO: 460290 - RNA, 19 nt, Homo sapiens
ggagguugcagugagcuaa

SEQ ID NO: 460291 - RNA, 19 nt, Homo sapiens
gcaccuguaaucccagcua

SEQ ID NO: 460292 - RNA, 19 nt, Homo sapiens
ucuggacucucacuucuuc

SEQ ID NO: 460293 - RNA, 19 nt, Homo sapiens
ucacaagaaacuaggaaau

SEQ ID NO: 460294 - RNA, 19 nt, Homo sapiens
gaauggccuuucaccuucu

SEQ ID NO: 460295 - RNA, 19 nt, Homo sapiens
cagaagugaauauuugaga

SEQ ID NO: 460296 - RNA, 19 nt, Homo sapiens
caaauggacaaacuggaau

SEQ ID NO: 460297 - RNA, 19 nt, Homo sapiens
ucacgggcaacaguauuua

SEQ ID NO: 460298 - RNA, 19 nt, Homo sapiens
gaagacaaagcugagaaca

SEQ ID NO: 460299 - RNA, 19 nt, Homo sapiens
uaacugccgcucagagugu

SEQ ID NO: 460300 - RNA, 19 nt, Homo sapiens
ucacuucgcagcuggacaa

SEQ ID NO: 460301 - RNA, 19 nt, Homo sapiens
gagacaaacggccuauugg

SEQ ID NO: 460302 - RNA, 19 nt, Homo sapiens
guaaauccuggccacauuc

SEQ ID NO: 460303 - RNA, 19 nt, Homo sapiens
ccagugccaucaccgagau

SEQ ID NO: 460304 - RNA, 19 nt, Homo sapiens
ugcaguggcuacuugaaga

SEQ ID NO: 460305 - RNA, 19 nt, Homo sapiens
ccuguaaucccagcacuuu

SEQ ID NO: 460306 - RNA, 19 nt, Homo sapiens
cgagaagacccuauaccau

SEQ ID NO: 460307 - RNA, 19 nt, Homo sapiens
gaccugcccuguacaugcu

SEQ ID NO: 460308 - RNA, 19 nt, Homo sapiens
ccacagcaauacagcucau

SEQ ID NO: 460309 - RNA, 19 nt, Homo sapiens
cgacuccugcuaccagauu

SEQ ID NO: 460310 - RNA, 19 nt, Homo sapiens
gcaaagaacaucagaacuu

SEQ ID NO: 460311 - RNA, 19 nt, Homo sapiens
gcagcucucugucggauga

SEQ ID NO: 460312 - RNA, 19 nt, Homo sapiens
caaagaacaucagaacuuc

SEQ ID NO: 460313 - RNA, 19 nt, Homo sapiens
guccacagaugaccucuuu

SEQ ID NO: 460314 - RNA, 19 nt, Homo sapiens
gcagaggcgugucuuagca

SEQ ID NO: 460315 - RNA, 19 nt, Homo sapiens
gagauugccucuacuugca

SEQ ID NO: 460316 - RNA, 19 nt, Homo sapiens
ccacccggcucuucacuga

SEQ ID NO: 460317 - RNA, 19 nt, Homo sapiens
ggacagcccaucccagaga

SEQ ID NO: 460318 - RNA, 19 nt, Homo sapiens
gcaacgacauugugaccau

SEQ ID NO: 460319 - RNA, 19 nt, Homo sapiens
gcuugagccucgaugguuu

SEQ ID NO: 460320 - RNA, 19 nt, Homo sapiens
ccaacgaggugaccacuac

SEQ ID NO: 460321 - RNA, 19 nt, Homo sapiens
gcucggaggaggagaugua

SEQ ID NO: 460322 - RNA, 19 nt, Homo sapiens
aggaggagauguacaacaa

SEQ ID NO: 460323 - RNA, 19 nt, Homo sapiens
caaauacuucuauggcaaa

SEQ ID NO: 460324 - RNA, 19 nt, Homo sapiens
uguccacgaugcugccuua

SEQ ID NO: 460325 - RNA, 19 nt, Homo sapiens
gcacagcuaccgcgucauc

SEQ ID NO: 460326 - RNA, 19 nt, Homo sapiens
aggaggaccugcagaagga

SEQ ID NO: 460327 - RNA, 19 nt, Homo sapiens
uaagggaacuccaaaaucu

SEQ ID NO: 460328 - RNA, 19 nt, Homo sapiens
gcaaggugggcauccugua

SEQ ID NO: 460329 - RNA, 19 nt, Homo sapiens
gcuacuaccgcaaauacuu

SEQ ID NO: 460330 - RNA, 19 nt, Homo sapiens
ugcaagaccuggccaccaa

SEQ ID NO: 460331 - RNA, 19 nt, Homo sapiens
gcacuuccagcacguguuc

SEQ ID NO: 460332 - RNA, 19 nt, Homo sapiens
ccacauuggcaacgacauu

SEQ ID NO: 460333 - RNA, 19 nt, Homo sapiens
gggcccagcuagacaccaa

SEQ ID NO: 460334 - RNA, 19 nt, Homo sapiens
guggagcgcuucacauucg

SEQ ID NO: 460335 - RNA, 19 nt, Homo sapiens
gugcggagccugagacaca

SEQ ID NO: 460336 - RNA, 19 nt, Homo sapiens
gcacguggagcgcuucaca

SEQ ID NO: 460337 - RNA, 19 nt, Homo sapiens
gaccggccuucaugcaguu

SEQ ID NO: 460338 - RNA, 19 nt, Homo sapiens
gaugguuugcccacuauga

SEQ ID NO: 460339 - RNA, 19 nt, Homo sapiens
ggaacuccaucagcaggau

SEQ ID NO: 460340 - RNA, 19 nt, Homo sapiens
ccacgaugcugccuuacac

SEQ ID NO: 460341 - RNA, 19 nt, Homo sapiens
caccuggcuuuguguguga

SEQ ID NO: 460342 - RNA, 19 nt, Homo sapiens
aagaggacuucagggagua

SEQ ID NO: 460343 - RNA, 19 nt, Homo sapiens
ggaccacgagaucauguuc

SEQ ID NO: 460344 - RNA, 19 nt, Homo sapiens
gcgcagaggcgugucuuag

SEQ ID NO: 460345 - RNA, 19 nt, Homo sapiens
ucaugcaguuucucaccuu

SEQ ID NO: 460346 - RNA, 19 nt, Homo sapiens
ccacagaugaccucuuugc

SEQ ID NO: 460347 - RNA, 19 nt, Homo sapiens
cggaggaggagauguacaa

SEQ ID NO: 460348 - RNA, 19 nt, Homo sapiens
gugcuggccuggaccuucu

SEQ ID NO: 460349 - RNA, 19 nt, Homo sapiens
ucgaugguuugcccacuau

SEQ ID NO: 460350 - RNA, 19 nt, Homo sapiens
gaggaggagauguacaaca

SEQ ID NO: 460351 - RNA, 19 nt, Homo sapiens
gcaaguggugagcuuccaa

SEQ ID NO: 460352 - RNA, 19 nt, Homo sapiens
ggagagucaggcccacaga

SEQ ID NO: 460353 - RNA, 19 nt, Homo sapiens
ccgaggagaggacugaguu

SEQ ID NO: 460354 - RNA, 19 nt, Homo sapiens
ucaccuugcugggcgaugu

SEQ ID NO: 460355 - RNA, 19 nt, Homo sapiens
gccgcguaguguucaauug

SEQ ID NO: 460356 - RNA, 19 nt, Homo sapiens
ucaccacgcagcucucugu

SEQ ID NO: 460357 - RNA, 19 nt, Homo sapiens
ccacagccaagccaucagu

SEQ ID NO: 460358 - RNA, 19 nt, Homo sapiens
ggcacgcacucccucuaca

SEQ ID NO: 460359 - RNA, 19 nt, Homo sapiens
caaggugggcauccuguac

SEQ ID NO: 460360 - RNA, 19 nt, Homo sapiens
cacggacgcugcucacacu

SEQ ID NO: 460361 - RNA, 19 nt, Homo sapiens
gcaaagaacaucagaacuu

SEQ ID NO: 460362 - RNA, 19 nt, Homo sapiens
gcagcucucugucggauga

SEQ ID NO: 460363 - RNA, 19 nt, Homo sapiens
caaagaacaucagaacuuc

SEQ ID NO: 460364 - RNA, 19 nt, Homo sapiens
guccacagaugaccucuuu

SEQ ID NO: 460365 - RNA, 19 nt, Homo sapiens
gaacccauguguccuugug

SEQ ID NO: 460366 - RNA, 19 nt, Homo sapiens
gcagaggcgugucuuagca

SEQ ID NO: 460367 - RNA, 19 nt, Homo sapiens
gagauugccucuacuugca

SEQ ID NO: 460368 - RNA, 19 nt, Homo sapiens
ccacccggcucuucacuga

SEQ ID NO: 460369 - RNA, 19 nt, Homo sapiens
ggacagcccaucccagaga

SEQ ID NO: 460370 - RNA, 19 nt, Homo sapiens
gcaacgacauugugaccau

SEQ ID NO: 460371 - RNA, 19 nt, Homo sapiens
gcuugagccucgaugguuu

SEQ ID NO: 460372 - RNA, 19 nt, Homo sapiens
ccaacgaggugaccacuac

SEQ ID NO: 460373 - RNA, 19 nt, Homo sapiens
gcucggaggaggagaugua

SEQ ID NO: 460374 - RNA, 19 nt, Homo sapiens
aggaggagauguacaacaa

SEQ ID NO: 460375 - RNA, 19 nt, Homo sapiens
caaauacuucuauggcaaa

SEQ ID NO: 460376 - RNA, 19 nt, Homo sapiens
uguccacgaugcugccuua

SEQ ID NO: 460377 - RNA, 19 nt, Homo sapiens
gcacagcuaccgcgucauc

SEQ ID NO: 460378 - RNA, 19 nt, Homo sapiens
gaaguccucuugccauucc

SEQ ID NO: 460379 - RNA, 19 nt, Homo sapiens
aggaggaccugcagaagga

SEQ ID NO: 460380 - RNA, 19 nt, Homo sapiens
uaagggaacuccaaaaucu

SEQ ID NO: 460381 - RNA, 19 nt, Homo sapiens
gcaaggugggcauccugua

SEQ ID NO: 460382 - RNA, 19 nt, Homo sapiens
gcuacuaccgcaaauacuu

SEQ ID NO: 460383 - RNA, 19 nt, Homo sapiens
ugcaagaccuggccaccaa

SEQ ID NO: 460384 - RNA, 19 nt, Homo sapiens
gcacuuccagcacguguuc

SEQ ID NO: 460385 - RNA, 19 nt, Homo sapiens
ccacauuggcaacgacauu

SEQ ID NO: 460386 - RNA, 19 nt, Homo sapiens
gggcccagcuagacaccaa

SEQ ID NO: 460387 - RNA, 19 nt, Homo sapiens
guggagcgcuucacauucg

SEQ ID NO: 460388 - RNA, 19 nt, Homo sapiens
gugcggagccugagacaca

SEQ ID NO: 460389 - RNA, 19 nt, Homo sapiens
gcacguggagcgcuucaca

SEQ ID NO: 460390 - RNA, 19 nt, Homo sapiens
gaccggccuucaugcaguu

SEQ ID NO: 460391 - RNA, 19 nt, Homo sapiens
gaugguuugcccacuauga

SEQ ID NO: 460392 - RNA, 19 nt, Homo sapiens
ggaacuccaucagcaggau

SEQ ID NO: 460393 - RNA, 19 nt, Homo sapiens
ccacgaugcugccuuacac

SEQ ID NO: 460394 - RNA, 19 nt, Homo sapiens
caccuggcuuuguguguga

SEQ ID NO: 460395 - RNA, 19 nt, Homo sapiens
aagaggacuucagggagua

SEQ ID NO: 460396 - RNA, 19 nt, Homo sapiens
ggaccacgagaucauguuc

SEQ ID NO: 460397 - RNA, 19 nt, Homo sapiens
gcgcagaggcgugucuuag

SEQ ID NO: 460398 - RNA, 19 nt, Homo sapiens
ucaugcaguuucucaccuu

SEQ ID NO: 460399 - RNA, 19 nt, Homo sapiens
ggaaguccucuugccauuc

SEQ ID NO: 460400 - RNA, 19 nt, Homo sapiens
ccacagaugaccucuuugc

SEQ ID NO: 460401 - RNA, 19 nt, Homo sapiens
cggaggaggagauguacaa

SEQ ID NO: 460402 - RNA, 19 nt, Homo sapiens
gugcuggccuggaccuucu

SEQ ID NO: 460403 - RNA, 19 nt, Homo sapiens
gaggaggagauguacaaca

SEQ ID NO: 460404 - RNA, 19 nt, Homo sapiens
gcaaguggugagcuuccaa

SEQ ID NO: 460405 - RNA, 19 nt, Homo sapiens
ucgaugguuugcccacuau

SEQ ID NO: 460406 - RNA, 19 nt, Homo sapiens
ggagagucaggcccacaga

SEQ ID NO: 460407 - RNA, 19 nt, Homo sapiens
ccgaggagaggacugaguu

SEQ ID NO: 460408 - RNA, 19 nt, Homo sapiens
ucaccuugcugggcgaugu

SEQ ID NO: 460409 - RNA, 19 nt, Homo sapiens
gccgcguaguguucaauug

SEQ ID NO: 460410 - RNA, 19 nt, Homo sapiens
ucaccacgcagcucucugu

SEQ ID NO: 460411 - RNA, 19 nt, Homo sapiens
ccacagccaagccaucagu

SEQ ID NO: 460412 - RNA, 19 nt, Homo sapiens
ggcacgcacucccucuaca

SEQ ID NO: 460413 - RNA, 19 nt, Homo sapiens
caaggugggcauccuguac

SEQ ID NO: 460414 - RNA, 19 nt, Homo sapiens
cacggacgcugcucacacu

SEQ ID NO: 460415 - RNA, 19 nt, Homo sapiens
caacagcgaucucaagcuu

SEQ ID NO: 460416 - RNA, 19 nt, Homo sapiens
gccaggagcucaaacuauu

SEQ ID NO: 460417 - RNA, 19 nt, Homo sapiens
ggacacuuguaaauagaaa

SEQ ID NO: 460418 - RNA, 19 nt, Homo sapiens
acagcgaucucaagcuuaa

SEQ ID NO: 460419 - RNA, 19 nt, Homo sapiens
ccaacucucuccucuggaa

SEQ ID NO: 460420 - RNA, 19 nt, Homo sapiens
gcgaccaccugcacaagaa

SEQ ID NO: 460421 - RNA, 19 nt, Homo sapiens
gucagcaacugguuuaaga

SEQ ID NO: 460422 - RNA, 19 nt, Homo sapiens
cuccaacucuuuccacuuu

SEQ ID NO: 460423 - RNA, 19 nt, Homo sapiens
gguggacuuucacaaauau

SEQ ID NO: 460424 - RNA, 19 nt, Homo sapiens
uagggacacuuguaaauag

SEQ ID NO: 460425 - RNA, 19 nt, Homo sapiens
cgacuagggacacuuguaa

SEQ ID NO: 460426 - RNA, 19 nt, Homo sapiens
gagaccagcuacugcuuca

SEQ ID NO: 460427 - RNA, 19 nt, Homo sapiens
ggaguuguuugcgcauaaa

SEQ ID NO: 460428 - RNA, 19 nt, Homo sapiens
gaacgagagcguacucaag

SEQ ID NO: 460429 - RNA, 19 nt, Homo sapiens
ugguggacuuucacaaaua

SEQ ID NO: 460430 - RNA, 19 nt, Homo sapiens
cuagggacacuuguaaaua

SEQ ID NO: 460431 - RNA, 19 nt, Homo sapiens
gaaagggagaacaccgaaa

SEQ ID NO: 460432 - RNA, 19 nt, Homo sapiens
gcagcuuguuucuggaguu

SEQ ID NO: 460433 - RNA, 19 nt, Homo sapiens
gcucauguccagcucagaa

SEQ ID NO: 460434 - RNA, 19 nt, Homo sapiens
auaaaggaaugguggacuu

SEQ ID NO: 460435 - RNA, 19 nt, Homo sapiens
uccgugagcucuacaagau

SEQ ID NO: 460436 - RNA, 19 nt, Homo sapiens
caagcuuaaucuccucuuc

SEQ ID NO: 460437 - RNA, 19 nt, Homo sapiens
caggucagcaacugguuua

SEQ ID NO: 460438 - RNA, 19 nt, Homo sapiens
caacuuccgugagcucuac

SEQ ID NO: 460439 - RNA, 19 nt, Homo sapiens
uggaguuguuugcgcauaa

SEQ ID NO: 460440 - RNA, 19 nt, Homo sapiens
gcuuguuucuggaguuguu

SEQ ID NO: 460441 - RNA, 19 nt, Homo sapiens
gagaacaccgaaaacaaua

SEQ ID NO: 460442 - RNA, 19 nt, Homo sapiens
ccucuucucuccaacucuu

SEQ ID NO: 460443 - RNA, 19 nt, Homo sapiens
gcuacugcuucaaggagaa

SEQ ID NO: 460444 - RNA, 19 nt, Homo sapiens
uuuaagaaccggaggcaaa

SEQ ID NO: 460445 - RNA, 19 nt, Homo sapiens
ugucgaugcugccgucguu

SEQ ID NO: 460446 - RNA, 19 nt, Homo sapiens
caaguuccgacuccgguuu

SEQ ID NO: 460447 - RNA, 19 nt, Homo sapiens
gcgacuagggacacuugua

SEQ ID NO: 460448 - RNA, 19 nt, Homo sapiens
ggagaacaccgaaaacaau

SEQ ID NO: 460449 - RNA, 19 nt, Homo sapiens
aaucuccucuucucuccaa

SEQ ID NO: 460450 - RNA, 19 nt, Homo sapiens
ggacuuucacaaauaucuu

SEQ ID NO: 460451 - RNA, 19 nt, Homo sapiens
aaggaaugguggacuuuca

SEQ ID NO: 460452 - RNA, 19 nt, Homo sapiens
cagcuuguuucuggaguug

SEQ ID NO: 460453 - RNA, 19 nt, Homo sapiens
ccaacaagcagaaccaacu

SEQ ID NO: 460454 - RNA, 19 nt, Homo sapiens
uaacuccuccuccaacaag

SEQ ID NO: 460455 - RNA, 19 nt, Homo sapiens
caccaguucucgccucaca

SEQ ID NO: 460456 - RNA, 19 nt, Homo sapiens
aaugguggacuuucacaaa

SEQ ID NO: 460457 - RNA, 19 nt, Homo sapiens
gaaugguggacuuucacaa

SEQ ID NO: 460458 - RNA, 19 nt, Homo sapiens
gaccagcuacugcuucaag

SEQ ID NO: 460459 - RNA, 19 nt, Homo sapiens
gcaacuuccgugagcucua

SEQ ID NO: 460460 - RNA, 19 nt, Homo sapiens
ggaaugguggacuuucaca

SEQ ID NO: 460461 - RNA, 19 nt, Homo sapiens
aauaacuccuccuccaaca

SEQ ID NO: 460462 - RNA, 19 nt, Homo sapiens
ccacccaggucagcaacug

SEQ ID NO: 460463 - RNA, 19 nt, Homo sapiens
gacuagggacacuuguaaa

SEQ ID NO: 460464 - RNA, 19 nt, Homo sapiens
gcgaggagaccagcuacug

SEQ ID NO: 460465 - RNA, 19 nt, Homo sapiens
agggacacuuguaaauaga

SEQ ID NO: 460466 - RNA, 19 nt, Homo sapiens
acaauaacuccuccuccaa

SEQ ID NO: 460467 - RNA, 19 nt, Homo sapiens
guccagcucagaagaggaa

SEQ ID NO: 460468 - RNA, 19 nt, Homo sapiens
caacaagcagaaccaacuc

SEQ ID NO: 460469 - RNA, 19 nt, Homo sapiens
gggacacuuguaaauagaa

SEQ ID NO: 460470 - RNA, 19 nt, Homo sapiens
cagcgacuagggacacuug

SEQ ID NO: 460471 - RNA, 19 nt, Homo sapiens
ccaccagcaucagcuccaa

SEQ ID NO: 460472 - RNA, 19 nt, Homo sapiens
ggagugguacgcgcacaau

SEQ ID NO: 460473 - RNA, 19 nt, Homo sapiens
gcaugacgauuuauuugua

SEQ ID NO: 460474 - RNA, 19 nt, Homo sapiens
caaauuaaccgcaaacuau

SEQ ID NO: 460475 - RNA, 19 nt, Homo sapiens
gaacagacagaguaagaaa

SEQ ID NO: 460476 - RNA, 19 nt, Homo sapiens
guaggcaacugguuuaaga

SEQ ID NO: 460477 - RNA, 19 nt, Homo sapiens
ggaaugugauguaugauag

SEQ ID NO: 460478 - RNA, 19 nt, Homo sapiens
ccaccugcaugacgauuua

SEQ ID NO: 460479 - RNA, 19 nt, Homo sapiens
ggugacaauuguauacuuu

SEQ ID NO: 460480 - RNA, 19 nt, Homo sapiens
uggaaucgcugaaucuuga

SEQ ID NO: 460481 - RNA, 19 nt, Homo sapiens
uaaaagaggugacaauugu

SEQ ID NO: 460482 - RNA, 19 nt, Homo sapiens
caaccaccaucuaccacua

SEQ ID NO: 460483 - RNA, 19 nt, Homo sapiens
caaguaggcaacugguuua

SEQ ID NO: 460484 - RNA, 19 nt, Homo sapiens
cggaagaguuguccauguu

SEQ ID NO: 460485 - RNA, 19 nt, Homo sapiens
gcgaggccaucaacaaaca

SEQ ID NO: 460486 - RNA, 19 nt, Homo sapiens
caccaccgcuccauacuuc

SEQ ID NO: 460487 - RNA, 19 nt, Homo sapiens
gggaaaauauucucucuag

SEQ ID NO: 460488 - RNA, 19 nt, Homo sapiens
gcaugaacagacagaguaa

SEQ ID NO: 460489 - RNA, 19 nt, Homo sapiens
acaaguaggcaacugguuu

SEQ ID NO: 460490 - RNA, 19 nt, Homo sapiens
caaugagcaugaacagaca

SEQ ID NO: 460491 - RNA, 19 nt, Homo sapiens
cggaaugugauguaugaua

SEQ ID NO: 460492 - RNA, 19 nt, Homo sapiens
uaaagagucgacuauacaa

SEQ ID NO: 460493 - RNA, 19 nt, Homo sapiens
agagucgacuauacaaaga

SEQ ID NO: 460494 - RNA, 19 nt, Homo sapiens
gauauuaugaggcuguugu

SEQ ID NO: 460495 - RNA, 19 nt, Homo sapiens
acaaauuaaccgcaaacua

SEQ ID NO: 460496 - RNA, 19 nt, Homo sapiens
ucaggucaguccaugguau

SEQ ID NO: 460497 - RNA, 19 nt, Homo sapiens
uuaaagagucgacuauaca

SEQ ID NO: 460498 - RNA, 19 nt, Homo sapiens
gauuuaaagagucgacuau

SEQ ID NO: 460499 - RNA, 19 nt, Homo sapiens
cgacucggaaugugaugua

SEQ ID NO: 460500 - RNA, 19 nt, Homo sapiens
gugcgaggccaucaacaaa

SEQ ID NO: 460501 - RNA, 19 nt, Homo sapiens
cucggaaugugauguauga

SEQ ID NO: 460502 - RNA, 19 nt, Homo sapiens
cuaccucccucucuaugug

SEQ ID NO: 460503 - RNA, 19 nt, Homo sapiens
ucuccuaccucccucucua

SEQ ID NO: 460504 - RNA, 19 nt, Homo sapiens
aaagaggugacaauuguau

SEQ ID NO: 460505 - RNA, 19 nt, Homo sapiens
gcgagcagaagacgcauug

SEQ ID NO: 460506 - RNA, 19 nt, Homo sapiens
ggaagaguuguccauguuc

SEQ ID NO: 460507 - RNA, 19 nt, Homo sapiens
uuuaaagagucgacuauac

SEQ ID NO: 460508 - RNA, 19 nt, Homo sapiens
acccaaccauacacacaua

SEQ ID NO: 460509 - RNA, 19 nt, Homo sapiens
gcgguggaaucgcugaauc

SEQ ID NO: 460510 - RNA, 19 nt, Homo sapiens
ccggaagaguuguccaugu

SEQ ID NO: 460511 - RNA, 19 nt, Homo sapiens
caaccauacacacauacaa

SEQ ID NO: 460512 - RNA, 19 nt, Homo sapiens
gagcaugaacagacagagu

SEQ ID NO: 460513 - RNA, 19 nt, Homo sapiens
gaggacaagagggcaauga

SEQ ID NO: 460514 - RNA, 19 nt, Homo sapiens
ccacacaaguaggcaacug

SEQ ID NO: 460515 - RNA, 19 nt, Homo sapiens
acagacagaguaagaaaca

SEQ ID NO: 460516 - RNA, 19 nt, Homo sapiens
caggauacccaaccauaca

SEQ ID NO: 460517 - RNA, 19 nt, Homo sapiens
acaaaccgaaaucaggaua

SEQ ID NO: 460518 - RNA, 19 nt, Homo sapiens
caacuuccgcgaccucuac

SEQ ID NO: 460519 - RNA, 19 nt, Homo sapiens
acauacaaguccacacaca

SEQ ID NO: 460520 - RNA, 19 nt, Homo sapiens
acacauacaaguccacaca

SEQ ID NO: 460521 - RNA, 19 nt, Homo sapiens
aaagagucgacuauacaaa

SEQ ID NO: 460522 - RNA, 19 nt, Homo sapiens
ugccaaacuucgccgauuc

SEQ ID NO: 460523 - RNA, 19 nt, Homo sapiens
gggcagaaaacauaaaaga

SEQ ID NO: 460524 - RNA, 19 nt, Homo sapiens
uguauacuuucuaggacaa

SEQ ID NO: 460525 - RNA, 19 nt, Homo sapiens
gcaagcugcaggccaugug

SEQ ID NO: 460526 - RNA, 19 nt, Homo sapiens
ucuaccacauccuugagaa

SEQ ID NO: 460527 - RNA, 19 nt, Homo sapiens
ucaacaaacacgagucgau

SEQ ID NO: 460528 - RNA, 19 nt, Homo sapiens
cggccucacucccacacaa

SEQ ID NO: 460529 - RNA, 19 nt, Homo sapiens
gcaacuuccgcgaccucua

SEQ ID NO: 460530 - RNA, 19 nt, Homo sapiens
ccugcaugacgauuuauuu

SEQ ID NO: 460531 - RNA, 19 nt, Homo sapiens
agcaugaacagacagagua

SEQ ID NO: 460532 - RNA, 19 nt, Homo sapiens
aaauuaaccgcaaacuauc

SEQ ID NO: 460533 - RNA, 19 nt, Homo sapiens
ccagaacaaaccgaaauca

SEQ ID NO: 460534 - RNA, 19 nt, Homo sapiens
ccagcgacucggaauguga

SEQ ID NO: 460535 - RNA, 19 nt, Homo sapiens
caaacuucgccgauucuca

SEQ ID NO: 460536 - RNA, 19 nt, Homo sapiens
ugaacagacagaguaagaa

SEQ ID NO: 460537 - RNA, 19 nt, Homo sapiens
agagggcaaugagcaugaa

SEQ ID NO: 460538 - RNA, 19 nt, Homo sapiens
cugcaugacgauuuauuug

SEQ ID NO: 460539 - RNA, 19 nt, Homo sapiens
ggaaaauauucucucuagu

SEQ ID NO: 460540 - RNA, 19 nt, Homo sapiens
gacgauuuauuuguaucug

SEQ ID NO: 460541 - RNA, 19 nt, Homo sapiens
aagaggugacaauuguaua

SEQ ID NO: 460542 - RNA, 19 nt, Homo sapiens
gacagucaaacgcugaugu

SEQ ID NO: 460543 - RNA, 19 nt, Homo sapiens
uaacaaauuaaccgcaaac

SEQ ID NO: 460544 - RNA, 19 nt, Homo sapiens
ccucacucccacacaagua

SEQ ID NO: 460545 - RNA, 19 nt, Homo sapiens
aaacgucgcucccuucauu

SEQ ID NO: 460546 - RNA, 19 nt, Homo sapiens
gcgacgagcuccacaucua

SEQ ID NO: 460547 - RNA, 19 nt, Homo sapiens
ugaaggagcugcaggaaca

SEQ ID NO: 460548 - RNA, 19 nt, Homo sapiens
gcuggaacauucuaacauu

SEQ ID NO: 460549 - RNA, 19 nt, Homo sapiens
gaaagaggccaacgaguca

SEQ ID NO: 460550 - RNA, 19 nt, Homo sapiens
ggacugaggcugcagcauu

SEQ ID NO: 460551 - RNA, 19 nt, Homo sapiens
cgucuuaccgugccuauua

SEQ ID NO: 460552 - RNA, 19 nt, Homo sapiens
gaauucaccuccuccuugu

SEQ ID NO: 460553 - RNA, 19 nt, Homo sapiens
agaagacgcuggagcaguu

SEQ ID NO: 460554 - RNA, 19 nt, Homo sapiens
guaaggagacuugaaauuc

SEQ ID NO: 460555 - RNA, 19 nt, Homo sapiens
ccacggaggccaagcguaa

SEQ ID NO: 460556 - RNA, 19 nt, Homo sapiens
gacugaggcugcagcauug

SEQ ID NO: 460557 - RNA, 19 nt, Homo sapiens
ggaacccacugcaaaauuu

SEQ ID NO: 460558 - RNA, 19 nt, Homo sapiens
aagagaaguuccugcauga

SEQ ID NO: 460559 - RNA, 19 nt, Homo sapiens
gaaggagaaauucgacuau

SEQ ID NO: 460560 - RNA, 19 nt, Homo sapiens
aauccugacucgugucuuu

SEQ ID NO: 460561 - RNA, 19 nt, Homo sapiens
ccaguaaggagacuugaaa

SEQ ID NO: 460562 - RNA, 19 nt, Homo sapiens
ggaacauucuaacauuuac

SEQ ID NO: 460563 - RNA, 19 nt, Homo sapiens
uggagaagguggugaagga

SEQ ID NO: 460564 - RNA, 19 nt, Homo sapiens
ccaaggaagccaaagagaa

SEQ ID NO: 460565 - RNA, 19 nt, Homo sapiens
gcaggaggccuacaagaag

SEQ ID NO: 460566 - RNA, 19 nt, Homo sapiens
caaggaagccaaagagaag

SEQ ID NO: 460567 - RNA, 19 nt, Homo sapiens
gagacagcuucuacuccua

SEQ ID NO: 460568 - RNA, 19 nt, Homo sapiens
aaacagaugacaccucuuc

SEQ ID NO: 460569 - RNA, 19 nt, Homo sapiens
gccagcgccucucugcuuu

SEQ ID NO: 460570 - RNA, 19 nt, Homo sapiens
gaacaagggaaucacaaaa

SEQ ID NO: 460571 - RNA, 19 nt, Homo sapiens
ccgaagugcucgagugcuu

SEQ ID NO: 460572 - RNA, 19 nt, Homo sapiens
gaacgagaagaagaugaaa

SEQ ID NO: 460573 - RNA, 19 nt, Homo sapiens
ccacaaccuucccuucucu

SEQ ID NO: 460574 - RNA, 19 nt, Homo sapiens
cuggaacauucuaacauuu

SEQ ID NO: 460575 - RNA, 19 nt, Homo sapiens
ggacaccaaggaagccaaa

SEQ ID NO: 460576 - RNA, 19 nt, Homo sapiens
ugaaggagaaauucgacua

SEQ ID NO: 460577 - RNA, 19 nt, Homo sapiens
gcacaaggcccuggagaac

SEQ ID NO: 460578 - RNA, 19 nt, Homo sapiens
gugcucgagugcuuagaaa

SEQ ID NO: 460579 - RNA, 19 nt, Homo sapiens
gcaaacgucgcucccuuca

SEQ ID NO: 460580 - RNA, 19 nt, Homo sapiens
ccacacagcacaacgucuu

SEQ ID NO: 460581 - RNA, 19 nt, Homo sapiens
aggcggagguggaaguuga

SEQ ID NO: 460582 - RNA, 19 nt, Homo sapiens
agauaucugucuucaguag

SEQ ID NO: 460583 - RNA, 19 nt, Homo sapiens
gagcuggagccguagauuc

SEQ ID NO: 460584 - RNA, 19 nt, Homo sapiens
ugcaugagguggucaagau

SEQ ID NO: 460585 - RNA, 19 nt, Homo sapiens
gcgagaagcgccugugucu

SEQ ID NO: 460586 - RNA, 19 nt, Homo sapiens
gcgccgagaacgagaagaa

SEQ ID NO: 460587 - RNA, 19 nt, Homo sapiens
gaaagcagggaggaauuca

SEQ ID NO: 460588 - RNA, 19 nt, Homo sapiens
ugaacaagggaaucacaaa

SEQ ID NO: 460589 - RNA, 19 nt, Homo sapiens
ggagauccucaaagucaug

SEQ ID NO: 460590 - RNA, 19 nt, Homo sapiens
ggaagcggaagcugacugu

SEQ ID NO: 460591 - RNA, 19 nt, Homo sapiens
ggacugccgccucauguac

SEQ ID NO: 460592 - RNA, 19 nt, Homo sapiens
gaagugcucgagugcuuag

SEQ ID NO: 460593 - RNA, 19 nt, Homo sapiens
guacucggcccagaucgaa

SEQ ID NO: 460594 - RNA, 19 nt, Homo sapiens
gagaacgagaagaagauga

SEQ ID NO: 460595 - RNA, 19 nt, Homo sapiens
gcgugaagcaggaggagaa

SEQ ID NO: 460596 - RNA, 19 nt, Homo sapiens
auuuagaacugcacuuugu

SEQ ID NO: 460597 - RNA, 19 nt, Homo sapiens
agaaggagagcgccaagga

SEQ ID NO: 460598 - RNA, 19 nt, Homo sapiens
agaacgagaagaagaugaa

SEQ ID NO: 460599 - RNA, 19 nt, Homo sapiens
cgaagugcucgagugcuua

SEQ ID NO: 460600 - RNA, 19 nt, Homo sapiens
acacaugacgccaucugaa

SEQ ID NO: 460601 - RNA, 19 nt, Homo sapiens
gccaaguucaagugaguaa

SEQ ID NO: 460602 - RNA, 19 nt, Homo sapiens
cgcaggaggccuacaagaa

SEQ ID NO: 460603 - RNA, 19 nt, Homo sapiens
acgagaagaagaugaaaga

SEQ ID NO: 460604 - RNA, 19 nt, Homo sapiens
cuacaagagcuuugagaca

SEQ ID NO: 460605 - RNA, 19 nt, Homo sapiens
gagccuccggccuccauaa

SEQ ID NO: 460606 - RNA, 19 nt, Homo sapiens
uggacgacgugaaggagaa

SEQ ID NO: 460607 - RNA, 19 nt, Homo sapiens
gcugcagcauuggaacaaa

SEQ ID NO: 460608 - RNA, 19 nt, Homo sapiens
gggcgacccuuuucaguuc

SEQ ID NO: 460609 - RNA, 19 nt, Homo sapiens
cuggagauccucaaaguca

SEQ ID NO: 460610 - RNA, 19 nt, Homo sapiens
uaaaagccccaacacauga

SEQ ID NO: 460611 - RNA, 19 nt, Homo sapiens
ugucagcgagugagaaaga

SEQ ID NO: 460612 - RNA, 19 nt, Homo sapiens
aaggagaaauucgacuaug

SEQ ID NO: 460613 - RNA, 19 nt, Homo sapiens
caaccuucccuucucuuuc

SEQ ID NO: 460614 - RNA, 19 nt, Homo sapiens
caacacaugacgccaucug

SEQ ID NO: 460615 - RNA, 19 nt, Homo sapiens
caaguacucggcccagauc

SEQ ID NO: 460616 - RNA, 19 nt, Homo sapiens
gcgcaggaggccuacaaga

SEQ ID NO: 460617 - RNA, 19 nt, Homo sapiens
aguaaggagacuugaaauu

SEQ ID NO: 460618 - RNA, 19 nt, Homo sapiens
aggagaaauucgacuaugg

SEQ ID NO: 460619 - RNA, 19 nt, Homo sapiens
gccacucucagaauaaguu

SEQ ID NO: 460620 - RNA, 19 nt, Homo sapiens
gccgagaacgagaagaaga

SEQ ID NO: 460621 - RNA, 19 nt, Homo sapiens
cgugcgggcucaucaccaa

SEQ ID NO: 460622 - RNA, 19 nt, Homo sapiens
aaccuucccuucucuuucu

SEQ ID NO: 460623 - RNA, 19 nt, Homo sapiens
ggacgacgugaaggagaaa

SEQ ID NO: 460624 - RNA, 19 nt, Homo sapiens
ggagguggaaguugaaagc

SEQ ID NO: 460625 - RNA, 19 nt, Homo sapiens
ucgacuauggcaacaagua

SEQ ID NO: 460626 - RNA, 19 nt, Homo sapiens
cgacugaaucugccacucu

SEQ ID NO: 460627 - RNA, 19 nt, Homo sapiens
aaaccaguaaggagacuug

SEQ ID NO: 460628 - RNA, 19 nt, Homo sapiens
gcaugagguggucaagaug

SEQ ID NO: 460629 - RNA, 19 nt, Homo sapiens
caaagagaaguuccugcau

SEQ ID NO: 460630 - RNA, 19 nt, Homo sapiens
cagcaucuuguacagcaaa

SEQ ID NO: 460631 - RNA, 19 nt, Homo sapiens
ccaaguacucggcccagau

SEQ ID NO: 460632 - RNA, 19 nt, Homo sapiens
ugaaagcagggaggaauuc

SEQ ID NO: 460633 - RNA, 19 nt, Homo sapiens
cgacgugaaggagaaauuc

SEQ ID NO: 460634 - RNA, 19 nt, Homo sapiens
ucugcuugcuggaacauuc

SEQ ID NO: 460635 - RNA, 19 nt, Homo sapiens
uggccaaguucaagugagu

SEQ ID NO: 460636 - RNA, 19 nt, Homo sapiens
gaacccacugcaaaauuuu

SEQ ID NO: 460637 - RNA, 19 nt, Homo sapiens
cacacagcacaacgucuua

SEQ ID NO: 460638 - RNA, 19 nt, Homo sapiens
ggagcuggagccguagauu

SEQ ID NO: 460639 - RNA, 19 nt, Homo sapiens
acaccaaggaagccaaaga

SEQ ID NO: 460640 - RNA, 19 nt, Homo sapiens
gaagccaucacagcucauc

SEQ ID NO: 460641 - RNA, 19 nt, Homo sapiens
guugaaagcagggaggaau

SEQ ID NO: 460642 - RNA, 19 nt, Homo sapiens
gaagauaacugggcaauuu

SEQ ID NO: 460643 - RNA, 19 nt, Homo sapiens
gugaugaacuguacauaua

SEQ ID NO: 460644 - RNA, 19 nt, Homo sapiens
gcaaauaaauacagugugu

SEQ ID NO: 460645 - RNA, 19 nt, Homo sapiens
gaaugaacaugcucaaaga

SEQ ID NO: 460646 - RNA, 19 nt, Homo sapiens
ugaaagaugucauuuguga

SEQ ID NO: 460647 - RNA, 19 nt, Homo sapiens
gggaaucuauuucuuguuu

SEQ ID NO: 460648 - RNA, 19 nt, Homo sapiens
ggcaagaacuccaagauga

SEQ ID NO: 460649 - RNA, 19 nt, Homo sapiens
gcaaguaaguccauaucaa

SEQ ID NO: 460650 - RNA, 19 nt, Homo sapiens
gcaggaaggugaccauguu

SEQ ID NO: 460651 - RNA, 19 nt, Homo sapiens
gaaaugaaggagaaguuua

SEQ ID NO: 460652 - RNA, 19 nt, Homo sapiens
gaacuauaauccuugaaga

SEQ ID NO: 460653 - RNA, 19 nt, Homo sapiens
ggagcaaauucaaauguaa

SEQ ID NO: 460654 - RNA, 19 nt, Homo sapiens
gcacaauuccauuuaagua

SEQ ID NO: 460655 - RNA, 19 nt, Homo sapiens
ugaaggaacucacugaaga

SEQ ID NO: 460656 - RNA, 19 nt, Homo sapiens
caaagaggcugaauaugca

SEQ ID NO: 460657 - RNA, 19 nt, Homo sapiens
caaagacugcuaaagaaua

SEQ ID NO: 460658 - RNA, 19 nt, Homo sapiens
ggacaucuuuaauugagaa

SEQ ID NO: 460659 - RNA, 19 nt, Homo sapiens
agaauuauguagccguuua

SEQ ID NO: 460660 - RNA, 19 nt, Homo sapiens
cuaaagagcucacaaagac

SEQ ID NO: 460661 - RNA, 19 nt, Homo sapiens
ccaaaugugucacuuacuu

SEQ ID NO: 460662 - RNA, 19 nt, Homo sapiens
gaaagcaugucgccuacug

SEQ ID NO: 460663 - RNA, 19 nt, Homo sapiens
gcauuuaaaucccaguuug

SEQ ID NO: 460664 - RNA, 19 nt, Homo sapiens
caacuuagucagagacaua

SEQ ID NO: 460665 - RNA, 19 nt, Homo sapiens
gcauuuguauccauucauu

SEQ ID NO: 460666 - RNA, 19 nt, Homo sapiens
caucaaagacugcuaaaga

SEQ ID NO: 460667 - RNA, 19 nt, Homo sapiens
gaacagaaagacuuagaga

SEQ ID NO: 460668 - RNA, 19 nt, Homo sapiens
uagaagaaaugaaggagaa

SEQ ID NO: 460669 - RNA, 19 nt, Homo sapiens
ggaguguuguggaauguuu

SEQ ID NO: 460670 - RNA, 19 nt, Homo sapiens
gaaguuagagaugaugaua

SEQ ID NO: 460671 - RNA, 19 nt, Homo sapiens
gcuaaucucagacuuaauu

SEQ ID NO: 460672 - RNA, 19 nt, Homo sapiens
uuacacacgucuucaguuu

SEQ ID NO: 460673 - RNA, 19 nt, Homo sapiens
ucagauagcuccacagaac

SEQ ID NO: 460674 - RNA, 19 nt, Homo sapiens
agacagaaguuagagauga

SEQ ID NO: 460675 - RNA, 19 nt, Homo sapiens
gggcauacuuccauucaau

SEQ ID NO: 460676 - RNA, 19 nt, Homo sapiens
ccugaaacuuugcauuuaa

SEQ ID NO: 460677 - RNA, 19 nt, Homo sapiens
caugagaaguggaaagaga

SEQ ID NO: 460678 - RNA, 19 nt, Homo sapiens
ucacagaucaccugacaaa

SEQ ID NO: 460679 - RNA, 19 nt, Homo sapiens
uaaauacagugugugauga

SEQ ID NO: 460680 - RNA, 19 nt, Homo sapiens
acagaaagacuuagagaaa

SEQ ID NO: 460681 - RNA, 19 nt, Homo sapiens
gcaaaugucaggguuuauu

SEQ ID NO: 460682 - RNA, 19 nt, Homo sapiens
gaauuuacacuccagcaaa

SEQ ID NO: 460683 - RNA, 19 nt, Homo sapiens
uaaacaaggugccaacagu

SEQ ID NO: 460684 - RNA, 19 nt, Homo sapiens
agacaaagaggcugaauau

SEQ ID NO: 460685 - RNA, 19 nt, Homo sapiens
gagcagauaaugaagcaaa

SEQ ID NO: 460686 - RNA, 19 nt, Homo sapiens
gaauggaauuacagucaug

SEQ ID NO: 460687 - RNA, 19 nt, Homo sapiens
gaaaucaauccaagacaga

SEQ ID NO: 460688 - RNA, 19 nt, Homo sapiens
gcuaaagaauagaaacugu

SEQ ID NO: 460689 - RNA, 19 nt, Homo sapiens
ggaauuacagucaugguau

SEQ ID NO: 460690 - RNA, 19 nt, Homo sapiens
aaggagaaguuuagcauga

SEQ ID NO: 460691 - RNA, 19 nt, Homo sapiens
ggaagcaagacagaaguua

SEQ ID NO: 460692 - RNA, 19 nt, Homo sapiens
gcaagaacuccaagaugaa

SEQ ID NO: 460693 - RNA, 19 nt, Homo sapiens
gaacugaggcagagauugg

SEQ ID NO: 460694 - RNA, 19 nt, Homo sapiens
gaacagcagaauuuacaga

SEQ ID NO: 460695 - RNA, 19 nt, Homo sapiens
ggagaaguuuagcaugaga

SEQ ID NO: 460696 - RNA, 19 nt, Homo sapiens
ccugugggcugauuacauu

SEQ ID NO: 460697 - RNA, 19 nt, Homo sapiens
guucagggcucaacuaaaa

SEQ ID NO: 460698 - RNA, 19 nt, Homo sapiens
ggaacucacugaagaacag

SEQ ID NO: 460699 - RNA, 19 nt, Homo sapiens
ugugaaagaugucauuugu

SEQ ID NO: 460700 - RNA, 19 nt, Homo sapiens
caugguauccuguuauaaa

SEQ ID NO: 460701 - RNA, 19 nt, Homo sapiens
uagaaaugcuaaucucaga

SEQ ID NO: 460702 - RNA, 19 nt, Homo sapiens
gcacaaggaauggcauaaa

SEQ ID NO: 460703 - RNA, 19 nt, Homo sapiens
ucagagacauaaacaaagu

SEQ ID NO: 460704 - RNA, 19 nt, Homo sapiens
gucaugguauccuguuaua

SEQ ID NO: 460705 - RNA, 19 nt, Homo sapiens
gaaagagaaaucaauccaa

SEQ ID NO: 460706 - RNA, 19 nt, Homo sapiens
agaccagcuucauaucuua

SEQ ID NO: 460707 - RNA, 19 nt, Homo sapiens
uuacuggugugaggauuua

SEQ ID NO: 460708 - RNA, 19 nt, Homo sapiens
ugaacaugcucaaagaaug

SEQ ID NO: 460709 - RNA, 19 nt, Homo sapiens
cugaagaacagcagaauuu

SEQ ID NO: 460710 - RNA, 19 nt, Homo sapiens
gaaggaacucacugaagaa

SEQ ID NO: 460711 - RNA, 19 nt, Homo sapiens
caaagacagaggcaaguaa

SEQ ID NO: 460712 - RNA, 19 nt, Homo sapiens
gaauuacagucaugguauc

SEQ ID NO: 460713 - RNA, 19 nt, Homo sapiens
ggaauggaauuacagucau

SEQ ID NO: 460714 - RNA, 19 nt, Homo sapiens
uaacugaugcacaaagauu

SEQ ID NO: 460715 - RNA, 19 nt, Homo sapiens
uacauuaacugaugcacaa

SEQ ID NO: 460716 - RNA, 19 nt, Homo sapiens
gcaugucgccuacuguauu

SEQ ID NO: 460717 - RNA, 19 nt, Homo sapiens
aaacaaaggcauccucaga

SEQ ID NO: 460718 - RNA, 19 nt, Homo sapiens
gcaacaacuucagauggaa

SEQ ID NO: 460719 - RNA, 19 nt, Homo sapiens
ugaaugggaugggagauga

SEQ ID NO: 460720 - RNA, 19 nt, Homo sapiens
aaagacugcuaaagaauag

SEQ ID NO: 460721 - RNA, 19 nt, Homo sapiens
cagcagaauuuacagaaag

SEQ ID NO: 460722 - RNA, 19 nt, Homo sapiens
caucaggaauggaauuaca

SEQ ID NO: 460723 - RNA, 19 nt, Homo sapiens
cagaccagcuucauaucuu

SEQ ID NO: 460724 - RNA, 19 nt, Homo sapiens
caugucgccuacuguauuu

SEQ ID NO: 460725 - RNA, 19 nt, Homo sapiens
gaacgggaagcaagacaga

SEQ ID NO: 460726 - RNA, 19 nt, Homo sapiens
ugaagaacagcagaauuua

SEQ ID NO: 460727 - RNA, 19 nt, Homo sapiens
caucuccgcuucuugugaa

SEQ ID NO: 460728 - RNA, 19 nt, Homo sapiens
ucacaguagugguaaacuu

SEQ ID NO: 460729 - RNA, 19 nt, Homo sapiens
uggagcaaauucaaaugua

SEQ ID NO: 460730 - RNA, 19 nt, Homo sapiens
gaacaugcucaaagaaugg

SEQ ID NO: 460731 - RNA, 19 nt, Homo sapiens
auacaugugugauaaagug

SEQ ID NO: 460732 - RNA, 19 nt, Homo sapiens
gcacagaccagcagaccau

SEQ ID NO: 460733 - RNA, 19 nt, Homo sapiens
gcauugcuaucuucaugug

SEQ ID NO: 460734 - RNA, 19 nt, Homo sapiens
aggcaaaugucaggguuua

SEQ ID NO: 460735 - RNA, 19 nt, Homo sapiens
ggaaacugauggagagcau

SEQ ID NO: 460736 - RNA, 19 nt, Homo sapiens
acacuuggaugacuaugga

SEQ ID NO: 460737 - RNA, 19 nt, Homo sapiens
guaaguccauaucaagaca

SEQ ID NO: 460738 - RNA, 19 nt, Homo sapiens
gcucggcauucccaagaaa

SEQ ID NO: 460739 - RNA, 19 nt, Homo sapiens
guaccugugacucaaauuu

SEQ ID NO: 460740 - RNA, 19 nt, Homo sapiens
agaaggaacacuuggauga

SEQ ID NO: 460741 - RNA, 19 nt, Homo sapiens
gaaaaccuccagacaaauu

SEQ ID NO: 460742 - RNA, 19 nt, Homo sapiens
ucacugagcucauguuuga

SEQ ID NO: 460743 - RNA, 19 nt, Homo sapiens
ggagauagacuuugagaaa

SEQ ID NO: 460744 - RNA, 19 nt, Homo sapiens
gcaagaagcagaacaguug

SEQ ID NO: 460745 - RNA, 19 nt, Homo sapiens
cgucagaucuaugugauua

SEQ ID NO: 460746 - RNA, 19 nt, Homo sapiens
aaacaguuguggcugaaua

SEQ ID NO: 460747 - RNA, 19 nt, Homo sapiens
gagaaacggcuaugagaaa

SEQ ID NO: 460748 - RNA, 19 nt, Homo sapiens
ucaaagauaugucaguugu

SEQ ID NO: 460749 - RNA, 19 nt, Homo sapiens
gaaugcagauacagaagga

SEQ ID NO: 460750 - RNA, 19 nt, Homo sapiens
cagaugaccucgugggauu

SEQ ID NO: 460751 - RNA, 19 nt, Homo sapiens
ccaagaggcugggagcuuu

SEQ ID NO: 460752 - RNA, 19 nt, Homo sapiens
gcucaaagauaugucaguu

SEQ ID NO: 460753 - RNA, 19 nt, Homo sapiens
uacaguggcucagauguua

SEQ ID NO: 460754 - RNA, 19 nt, Homo sapiens
gaaggguggugguugugaa

SEQ ID NO: 460755 - RNA, 19 nt, Homo sapiens
gaggagccuuccauacaaa

SEQ ID NO: 460756 - RNA, 19 nt, Homo sapiens
gcaagaggcagcagccaaa

SEQ ID NO: 460757 - RNA, 19 nt, Homo sapiens
ugacaugacuggccaacug

SEQ ID NO: 460758 - RNA, 19 nt, Homo sapiens
ucaaggagaucguggagau

SEQ ID NO: 460759 - RNA, 19 nt, Homo sapiens
ucaaugaccugcagcucaa

SEQ ID NO: 460760 - RNA, 19 nt, Homo sapiens
uugaugagguucacuauau

SEQ ID NO: 460761 - RNA, 19 nt, Homo sapiens
cgaggagccuuccauacaa

SEQ ID NO: 460762 - RNA, 19 nt, Homo sapiens
aaacaugccugcucguaca

SEQ ID NO: 460763 - RNA, 19 nt, Homo sapiens
aaagauaugucaguuguag

SEQ ID NO: 460764 - RNA, 19 nt, Homo sapiens
uggaagaccuaguguugaa

SEQ ID NO: 460765 - RNA, 19 nt, Homo sapiens
gauacuggguuacaaagag

SEQ ID NO: 460766 - RNA, 19 nt, Homo sapiens
ugguugagguuguauauga

SEQ ID NO: 460767 - RNA, 19 nt, Homo sapiens
gaccacugcuguccaggaa

SEQ ID NO: 460768 - RNA, 19 nt, Homo sapiens
ugaguuugcugacuggauu

SEQ ID NO: 460769 - RNA, 19 nt, Homo sapiens
gggaggaggugcuuaucau

SEQ ID NO: 460770 - RNA, 19 nt, Homo sapiens
acaaaucucucggcuacaa

SEQ ID NO: 460771 - RNA, 19 nt, Homo sapiens
gagcucauguuugacaaug

SEQ ID NO: 460772 - RNA, 19 nt, Homo sapiens
ccaagcagcccacacauca

SEQ ID NO: 460773 - RNA, 19 nt, Homo sapiens
gcaugacucugucuuuguc

SEQ ID NO: 460774 - RNA, 19 nt, Homo sapiens
gacagcggcuaccuugcua

SEQ ID NO: 460775 - RNA, 19 nt, Homo sapiens
gaccugcagcucaaagaua

SEQ ID NO: 460776 - RNA, 19 nt, Homo sapiens
ggaggagccugacaugacu

SEQ ID NO: 460777 - RNA, 19 nt, Homo sapiens
caaagaggaagaacagaga

SEQ ID NO: 460778 - RNA, 19 nt, Homo sapiens
gaggugcccuauccagaug

SEQ ID NO: 460779 - RNA, 19 nt, Homo sapiens
ggaggugcuuaucaugcua

SEQ ID NO: 460780 - RNA, 19 nt, Homo sapiens
ucacacaucugcaggaaaa

SEQ ID NO: 460781 - RNA, 19 nt, Homo sapiens
gaacagagaaacggcuaug

SEQ ID NO: 460782 - RNA, 19 nt, Homo sapiens
gcaaacacgcccagaccuu

SEQ ID NO: 460783 - RNA, 19 nt, Homo sapiens
uggagugggucaucuuuga

SEQ ID NO: 460784 - RNA, 19 nt, Homo sapiens
cauaacagaucugaacaca

SEQ ID NO: 460785 - RNA, 19 nt, Homo sapiens
cggcugcgcuuccuacugu

SEQ ID NO: 460786 - RNA, 19 nt, Homo sapiens
caacccuggucuuguguga

SEQ ID NO: 460787 - RNA, 19 nt, Homo sapiens
cgaccugccugaauauuac

SEQ ID NO: 460788 - RNA, 19 nt, Homo sapiens
gaggagcuucucugaguuu

SEQ ID NO: 460789 - RNA, 19 nt, Homo sapiens
guaaacaugccugcucgua

SEQ ID NO: 460790 - RNA, 19 nt, Homo sapiens
caugcuaccugaccacguu

SEQ ID NO: 460791 - RNA, 19 nt, Homo sapiens
acggaucccuggucucuuu

SEQ ID NO: 460792 - RNA, 19 nt, Homo sapiens
acacuaugauccucaacuu

SEQ ID NO: 460793 - RNA, 19 nt, Homo sapiens
gaccugcaccgcaugauga

SEQ ID NO: 460794 - RNA, 19 nt, Homo sapiens
caaacacgcccagaccuuu

SEQ ID NO: 460795 - RNA, 19 nt, Homo sapiens
guacaguggcucagauguu

SEQ ID NO: 460796 - RNA, 19 nt, Homo sapiens
gcucacacaucugcaggaa

SEQ ID NO: 460797 - RNA, 19 nt, Homo sapiens
gaacccaccauaacagauc

SEQ ID NO: 460798 - RNA, 19 nt, Homo sapiens
ugaagaaucaggagcauca

SEQ ID NO: 460799 - RNA, 19 nt, Homo sapiens
ugaacgggcugaagucucu

SEQ ID NO: 460800 - RNA, 19 nt, Homo sapiens
gcugauagcgggcucacaa

SEQ ID NO: 460801 - RNA, 19 nt, Homo sapiens
aggaggagauagacuuuga

SEQ ID NO: 460802 - RNA, 19 nt, Homo sapiens
gagcgaaugcagauacaga

SEQ ID NO: 460803 - RNA, 19 nt, Homo sapiens
acccuggucuugugugaua

SEQ ID NO: 460804 - RNA, 19 nt, Homo sapiens
ugauuucuaucgccucauu

SEQ ID NO: 460805 - RNA, 19 nt, Homo sapiens
ccaggaugauggagacaga

SEQ ID NO: 460806 - RNA, 19 nt, Homo sapiens
ggaugaacccaccauaaca

SEQ ID NO: 460807 - RNA, 19 nt, Homo sapiens
acugggagcugcugaacuu

SEQ ID NO: 460808 - RNA, 19 nt, Homo sapiens
cuacaggucuccucgaacu

SEQ ID NO: 460809 - RNA, 19 nt, Homo sapiens
cagagaaacggcuaugaga

SEQ ID NO: 460810 - RNA, 19 nt, Homo sapiens
ccacguuucuaucauccuu

SEQ ID NO: 460811 - RNA, 19 nt, Homo sapiens
ggaagcguccacagcugua

SEQ ID NO: 460812 - RNA, 19 nt, Homo sapiens
gcucauguuugacaaugca

SEQ ID NO: 460813 - RNA, 19 nt, Homo sapiens
ggagacagagcgacuugug

SEQ ID NO: 460814 - RNA, 19 nt, Homo sapiens
acagagacccagcacauga

SEQ ID NO: 460815 - RNA, 19 nt, Homo sapiens
cggcaugacucugucuuug

SEQ ID NO: 460816 - RNA, 19 nt, Homo sapiens
caggaaggguggugguugu

SEQ ID NO: 460817 - RNA, 19 nt, Homo sapiens
uggcugaacugaccaagag

SEQ ID NO: 460818 - RNA, 19 nt, Homo sapiens
ugaguaccaucagcgagua

SEQ ID NO: 460819 - RNA, 19 nt, Homo sapiens
uggucgaccugccugaaua

SEQ ID NO: 460820 - RNA, 19 nt, Homo sapiens
gaguuucccucccgcaaag

SEQ ID NO: 460821 - RNA, 19 nt, Homo sapiens
gccaagaaggagagaauga

SEQ ID NO: 460822 - RNA, 19 nt, Homo sapiens
gaagcgucgucagaucuau

SEQ ID NO: 460823 - RNA, 19 nt, Homo sapiens
gaggagauagacuuugaga

SEQ ID NO: 460824 - RNA, 19 nt, Homo sapiens
gcgccuggcugagaugugu

SEQ ID NO: 460825 - RNA, 19 nt, Homo sapiens
ugacagagacccagcacau

SEQ ID NO: 460826 - RNA, 19 nt, Homo sapiens
agccagauguguuucagaa

SEQ ID NO: 460827 - RNA, 19 nt, Homo sapiens
gugacgaggaugagaauga

SEQ ID NO: 460828 - RNA, 19 nt, Homo sapiens
uguuggagccucuggauuu

SEQ ID NO: 460829 - RNA, 19 nt, Homo sapiens
ggguggugguugugaagaa

SEQ ID NO: 460830 - RNA, 19 nt, Homo sapiens
ugucgcagcucacacaucu

SEQ ID NO: 460831 - RNA, 19 nt, Homo sapiens
caaagauaugucaguugua

SEQ ID NO: 460832 - RNA, 19 nt, Homo sapiens
ccaaggugcuccgggugaa

SEQ ID NO: 460833 - RNA, 19 nt, Homo sapiens
ugaccacguuucuaucauc

SEQ ID NO: 460834 - RNA, 19 nt, Homo sapiens
gaaccagacgguggaggaa

SEQ ID NO: 460835 - RNA, 19 nt, Homo sapiens
caugccugcucguacagua

SEQ ID NO: 460836 - RNA, 19 nt, Homo sapiens
ccgaggagccuuccauaca

SEQ ID NO: 460837 - RNA, 19 nt, Homo sapiens
ccaacgcccuugaguuugc

SEQ ID NO: 460838 - RNA, 19 nt, Homo sapiens
gaugagguucacuauauca

SEQ ID NO: 460839 - RNA, 19 nt, Homo sapiens
guuggagccucuggauuug

SEQ ID NO: 460840 - RNA, 19 nt, Homo sapiens
ucgaccugccugaauauua

SEQ ID NO: 460841 - RNA, 19 nt, Homo sapiens
ggaggaggugcuuaucaug

SEQ ID NO: 460842 - RNA, 19 nt, Homo sapiens
gaaaggaaauccggaaaua

SEQ ID NO: 460843 - RNA, 19 nt, Homo sapiens
gaagagaagugaaauguug

SEQ ID NO: 460844 - RNA, 19 nt, Homo sapiens
gcacagaucccaaaccuua

SEQ ID NO: 460845 - RNA, 19 nt, Homo sapiens
gggaggaaaugaaagaaua

SEQ ID NO: 460846 - RNA, 19 nt, Homo sapiens
gcacugcucuguuuauaau

SEQ ID NO: 460847 - RNA, 19 nt, Homo sapiens
ggaaagacuacucaaguua

SEQ ID NO: 460848 - RNA, 19 nt, Homo sapiens
ggagagauauuugaaguug

SEQ ID NO: 460849 - RNA, 19 nt, Homo sapiens
gaaagacuacucaaguuaa

SEQ ID NO: 460850 - RNA, 19 nt, Homo sapiens
gggaauggaugaugaagga

SEQ ID NO: 460851 - RNA, 19 nt, Homo sapiens
ugacaugacuacagacuga

SEQ ID NO: 460852 - RNA, 19 nt, Homo sapiens
caaacaaucugugacuauu

SEQ ID NO: 460853 - RNA, 19 nt, Homo sapiens
ucaauuaaguugcagaguu

SEQ ID NO: 460854 - RNA, 19 nt, Homo sapiens
ucacacuacuugcauguaa

SEQ ID NO: 460855 - RNA, 19 nt, Homo sapiens
cagcaagucaauuguauua

SEQ ID NO: 460856 - RNA, 19 nt, Homo sapiens
guaaggauuguuccaaaua

SEQ ID NO: 460857 - RNA, 19 nt, Homo sapiens
cagaaagcauccaucauga

SEQ ID NO: 460858 - RNA, 19 nt, Homo sapiens
cgcaagaccuucaauauca

SEQ ID NO: 460859 - RNA, 19 nt, Homo sapiens
gaguaccacuguauugauu

SEQ ID NO: 460860 - RNA, 19 nt, Homo sapiens
gaaagcauccaucaugaau

SEQ ID NO: 460861 - RNA, 19 nt, Homo sapiens
ggccaaguuucuucuagua

SEQ ID NO: 460862 - RNA, 19 nt, Homo sapiens
gcagaauauuguccucauu

SEQ ID NO: 460863 - RNA, 19 nt, Homo sapiens
ggaccaagaauuccugaaa

SEQ ID NO: 460864 - RNA, 19 nt, Homo sapiens
caauuaaguugcagaguuc

SEQ ID NO: 460865 - RNA, 19 nt, Homo sapiens
gacaaacaguagacaaaug

SEQ ID NO: 460866 - RNA, 19 nt, Homo sapiens
gaaagaauagaucagaaug

SEQ ID NO: 460867 - RNA, 19 nt, Homo sapiens
gcaagaccuucaauaucaa

SEQ ID NO: 460868 - RNA, 19 nt, Homo sapiens
aaggaaauccggaaauaua

SEQ ID NO: 460869 - RNA, 19 nt, Homo sapiens
gcaaacuacuuagacauca

SEQ ID NO: 460870 - RNA, 19 nt, Homo sapiens
cagaugauaucccuguuug

SEQ ID NO: 460871 - RNA, 19 nt, Homo sapiens
aaaugugaaugcagcaaua

SEQ ID NO: 460872 - RNA, 19 nt, Homo sapiens
ccagaaagcauccaucaug

SEQ ID NO: 460873 - RNA, 19 nt, Homo sapiens
ugaaguaaauguucugagu

SEQ ID NO: 460874 - RNA, 19 nt, Homo sapiens
caaguuucuucuaguauga

SEQ ID NO: 460875 - RNA, 19 nt, Homo sapiens
caagaauuccugaaaguug

SEQ ID NO: 460876 - RNA, 19 nt, Homo sapiens
cuaguaugauggaaaguuu

SEQ ID NO: 460877 - RNA, 19 nt, Homo sapiens
ggcuaucgaugaaucagua

SEQ ID NO: 460878 - RNA, 19 nt, Homo sapiens
uuaagguacuucccuauau

SEQ ID NO: 460879 - RNA, 19 nt, Homo sapiens
ccaaguuucuucuaguaug

SEQ ID NO: 460880 - RNA, 19 nt, Homo sapiens
ucugaacacuuagaugaua

SEQ ID NO: 460881 - RNA, 19 nt, Homo sapiens
gcaagucaauuguauuagc

SEQ ID NO: 460882 - RNA, 19 nt, Homo sapiens
ggaaaugaaagaauagauc

SEQ ID NO: 460883 - RNA, 19 nt, Homo sapiens
ugaaguugauguggaaauu

SEQ ID NO: 460884 - RNA, 19 nt, Homo sapiens
gaaucaguagguaguauuu

SEQ ID NO: 460885 - RNA, 19 nt, Homo sapiens
uaaauugcccauugccuuu

SEQ ID NO: 460886 - RNA, 19 nt, Homo sapiens
ccuauaacaugccagcaaa

SEQ ID NO: 460887 - RNA, 19 nt, Homo sapiens
gaaaguugaccaaggaaca

SEQ ID NO: 460888 - RNA, 19 nt, Homo sapiens
gaccaagaauuccugaaag

SEQ ID NO: 460889 - RNA, 19 nt, Homo sapiens
caucaugaaugcaagauac

SEQ ID NO: 460890 - RNA, 19 nt, Homo sapiens
cuacuugcauguaaagaau

SEQ ID NO: 460891 - RNA, 19 nt, Homo sapiens
agcaaugucugccuaguuu

SEQ ID NO: 460892 - RNA, 19 nt, Homo sapiens
gagagauauuugaaguuga

SEQ ID NO: 460893 - RNA, 19 nt, Homo sapiens
caaaagaggugacuguauc

SEQ ID NO: 460894 - RNA, 19 nt, Homo sapiens
gaacaccaugccuucaauu

SEQ ID NO: 460895 - RNA, 19 nt, Homo sapiens
aagaauuccugaaaguuga

SEQ ID NO: 460896 - RNA, 19 nt, Homo sapiens
ugugaaugcagcaauauua

SEQ ID NO: 460897 - RNA, 19 nt, Homo sapiens
gaguucugauggagagaua

SEQ ID NO: 460898 - RNA, 19 nt, Homo sapiens
cuaguuuauuguccaguua

SEQ ID NO: 460899 - RNA, 19 nt, Homo sapiens
gagcacagaucccaaaccu

SEQ ID NO: 460900 - RNA, 19 nt, Homo sapiens
gaguaacaccuauaacaug

SEQ ID NO: 460901 - RNA, 19 nt, Homo sapiens
ggaguaacaccuauaacau

SEQ ID NO: 460902 - RNA, 19 nt, Homo sapiens
ccugaaaguugaccaagga

SEQ ID NO: 460903 - RNA, 19 nt, Homo sapiens
ccuagagacucaguuacua

SEQ ID NO: 460904 - RNA, 19 nt, Homo sapiens
caagucaauuguauuagca

SEQ ID NO: 460905 - RNA, 19 nt, Homo sapiens
uaguugcacugcucuguuu

SEQ ID NO: 460906 - RNA, 19 nt, Homo sapiens
uaagguacuucccuauauc

SEQ ID NO: 460907 - RNA, 19 nt, Homo sapiens
aauuugcucugucaacuuu

SEQ ID NO: 460908 - RNA, 19 nt, Homo sapiens
gaccauacauaucugacau

SEQ ID NO: 460909 - RNA, 19 nt, Homo sapiens
ugaagaugaugagaacaaa

SEQ ID NO: 460910 - RNA, 19 nt, Homo sapiens
caccaugccuucaauuaag

SEQ ID NO: 460911 - RNA, 19 nt, Homo sapiens
guuaagguacuucccuaua

SEQ ID NO: 460912 - RNA, 19 nt, Homo sapiens
caucuguucuucugacuca

SEQ ID NO: 460913 - RNA, 19 nt, Homo sapiens
gagcucuuguuaauguauu

SEQ ID NO: 460914 - RNA, 19 nt, Homo sapiens
gaggugacuguaucaagua

SEQ ID NO: 460915 - RNA, 19 nt, Homo sapiens
gggaguaacaccuauaaca

SEQ ID NO: 460916 - RNA, 19 nt, Homo sapiens
caaacuacuuagacaucaa

SEQ ID NO: 460917 - RNA, 19 nt, Homo sapiens
gaaaagcgaacagaugaua

SEQ ID NO: 460918 - RNA, 19 nt, Homo sapiens
aggaaagacuacucaaguu

SEQ ID NO: 460919 - RNA, 19 nt, Homo sapiens
gcacccaccacaaggauga

SEQ ID NO: 460920 - RNA, 19 nt, Homo sapiens
uauauugccuagagacuca

SEQ ID NO: 460921 - RNA, 19 nt, Homo sapiens
ggaaauauagucuuaaccu

SEQ ID NO: 460922 - RNA, 19 nt, Homo sapiens
uuaagaccauguuggaaga

SEQ ID NO: 460923 - RNA, 19 nt, Homo sapiens
uuacuguucugucuuuaug

SEQ ID NO: 460924 - RNA, 19 nt, Homo sapiens
gugaaugcagcaauauuaa

SEQ ID NO: 460925 - RNA, 19 nt, Homo sapiens
ccaaacaaucugugacuau

SEQ ID NO: 460926 - RNA, 19 nt, Homo sapiens
caagacuguugccaauaug

SEQ ID NO: 460927 - RNA, 19 nt, Homo sapiens
gccaaacaaucugugacua

SEQ ID NO: 460928 - RNA, 19 nt, Homo sapiens
gcaaugucugccuaguuua

SEQ ID NO: 460929 - RNA, 19 nt, Homo sapiens
cgaacaccaugccuucaau

SEQ ID NO: 460930 - RNA, 19 nt, Homo sapiens
guaccacuguauugauuag

SEQ ID NO: 460931 - RNA, 19 nt, Homo sapiens
uaaggauuguuccaaauac

SEQ ID NO: 460932 - RNA, 19 nt, Homo sapiens
guuggaagauuugggaaug

SEQ ID NO: 460933 - RNA, 19 nt, Homo sapiens
acaccaugccuucaauuaa

SEQ ID NO: 460934 - RNA, 19 nt, Homo sapiens
cauugcauguguaguuuga

SEQ ID NO: 460935 - RNA, 19 nt, Homo sapiens
cagaauauuguccucauug

SEQ ID NO: 460936 - RNA, 19 nt, Homo sapiens
acuacagacugaaauaaug

SEQ ID NO: 460937 - RNA, 19 nt, Homo sapiens
ggaggaagcccagguaggu

SEQ ID NO: 460938 - RNA, 19 nt, Homo sapiens
acuuagacaucaaagguuu

SEQ ID NO: 460939 - RNA, 19 nt, Homo sapiens
gcugcaaacuacuuagaca

SEQ ID NO: 460940 - RNA, 19 nt, Homo sapiens
gaaguugauguggaaauug

SEQ ID NO: 460941 - RNA, 19 nt, Homo sapiens
cagcagcaagucaauugua

SEQ ID NO: 460942 - RNA, 19 nt, Homo sapiens
gaagagaagugaaauguug

SEQ ID NO: 460943 - RNA, 19 nt, Homo sapiens
gcacagaucccaaaccuua

SEQ ID NO: 460944 - RNA, 19 nt, Homo sapiens
gcacugcucuguuuauaau

SEQ ID NO: 460945 - RNA, 19 nt, Homo sapiens
ggagagauauuugaaguug

SEQ ID NO: 460946 - RNA, 19 nt, Homo sapiens
gggaauggaugaugaagga

SEQ ID NO: 460947 - RNA, 19 nt, Homo sapiens
caaacaaucugugacuauu

SEQ ID NO: 460948 - RNA, 19 nt, Homo sapiens
ucaauuaaguugcagaguu

SEQ ID NO: 460949 - RNA, 19 nt, Homo sapiens
ucacacuacuugcauguaa

SEQ ID NO: 460950 - RNA, 19 nt, Homo sapiens
cagcaagucaauuguauua

SEQ ID NO: 460951 - RNA, 19 nt, Homo sapiens
guaaggauuguuccaaaua

SEQ ID NO: 460952 - RNA, 19 nt, Homo sapiens
cagaaagcauccaucauga

SEQ ID NO: 460953 - RNA, 19 nt, Homo sapiens
cgcaagaccuucaauauca

SEQ ID NO: 460954 - RNA, 19 nt, Homo sapiens
gaguaccacuguauugauu

SEQ ID NO: 460955 - RNA, 19 nt, Homo sapiens
gaaagcauccaucaugaau

SEQ ID NO: 460956 - RNA, 19 nt, Homo sapiens
ggccaaguuucuucuagua

SEQ ID NO: 460957 - RNA, 19 nt, Homo sapiens
gcagaauauuguccucauu

SEQ ID NO: 460958 - RNA, 19 nt, Homo sapiens
ggaccaagaauuccugaaa

SEQ ID NO: 460959 - RNA, 19 nt, Homo sapiens
caauuaaguugcagaguuc

SEQ ID NO: 460960 - RNA, 19 nt, Homo sapiens
gacaaacaguagacaaaug

SEQ ID NO: 460961 - RNA, 19 nt, Homo sapiens
gcaagaccuucaauaucaa

SEQ ID NO: 460962 - RNA, 19 nt, Homo sapiens
gcaaacuacuuagacauca

SEQ ID NO: 460963 - RNA, 19 nt, Homo sapiens
cagaugauaucccuguuug

SEQ ID NO: 460964 - RNA, 19 nt, Homo sapiens
aaaugugaaugcagcaaua

SEQ ID NO: 460965 - RNA, 19 nt, Homo sapiens
ccagaaagcauccaucaug

SEQ ID NO: 460966 - RNA, 19 nt, Homo sapiens
ugaaguaaauguucugagu

SEQ ID NO: 460967 - RNA, 19 nt, Homo sapiens
caaguuucuucuaguauga

SEQ ID NO: 460968 - RNA, 19 nt, Homo sapiens
caagaauuccugaaaguug

SEQ ID NO: 460969 - RNA, 19 nt, Homo sapiens
cuaguaugauggaaaguuu

SEQ ID NO: 460970 - RNA, 19 nt, Homo sapiens
ccaaguuucuucuaguaug

SEQ ID NO: 460971 - RNA, 19 nt, Homo sapiens
gcaagucaauuguauuagc

SEQ ID NO: 460972 - RNA, 19 nt, Homo sapiens
ugaaguugauguggaaauu

SEQ ID NO: 460973 - RNA, 19 nt, Homo sapiens
gaaaguugaccaaggaaca

SEQ ID NO: 460974 - RNA, 19 nt, Homo sapiens
gaccaagaauuccugaaag

SEQ ID NO: 460975 - RNA, 19 nt, Homo sapiens
caucaugaaugcaagauac

SEQ ID NO: 460976 - RNA, 19 nt, Homo sapiens
cuacuugcauguaaagaau

SEQ ID NO: 460977 - RNA, 19 nt, Homo sapiens
agcaaugucugccuaguuu

SEQ ID NO: 460978 - RNA, 19 nt, Homo sapiens
gaguucugauggagagaua

SEQ ID NO: 460979 - RNA, 19 nt, Homo sapiens
aagaauuccugaaaguuga

SEQ ID NO: 460980 - RNA, 19 nt, Homo sapiens
gaacaccaugccuucaauu

SEQ ID NO: 460981 - RNA, 19 nt, Homo sapiens
ugugaaugcagcaauauua

SEQ ID NO: 460982 - RNA, 19 nt, Homo sapiens
gagagauauuugaaguuga

SEQ ID NO: 460983 - RNA, 19 nt, Homo sapiens
cuaguuuauuguccaguua

SEQ ID NO: 460984 - RNA, 19 nt, Homo sapiens
gagcacagaucccaaaccu

SEQ ID NO: 460985 - RNA, 19 nt, Homo sapiens
ccugaaaguugaccaagga

SEQ ID NO: 460986 - RNA, 19 nt, Homo sapiens
ccuagagacucaguuacua

SEQ ID NO: 460987 - RNA, 19 nt, Homo sapiens
caagucaauuguauuagca

SEQ ID NO: 460988 - RNA, 19 nt, Homo sapiens
uaguugcacugcucuguuu

SEQ ID NO: 460989 - RNA, 19 nt, Homo sapiens
ugaagaugaugagaacaaa

SEQ ID NO: 460990 - RNA, 19 nt, Homo sapiens
caccaugccuucaauuaag

SEQ ID NO: 460991 - RNA, 19 nt, Homo sapiens
caaacuacuuagacaucaa

SEQ ID NO: 460992 - RNA, 19 nt, Homo sapiens
gaaaagcgaacagaugaua

SEQ ID NO: 460993 - RNA, 19 nt, Homo sapiens
gcacccaccacaaggauga

SEQ ID NO: 460994 - RNA, 19 nt, Homo sapiens
uauauugccuagagacuca

SEQ ID NO: 460995 - RNA, 19 nt, Homo sapiens
gugaaugcagcaauauuaa

SEQ ID NO: 460996 - RNA, 19 nt, Homo sapiens
uuaagaccauguuggaaga

SEQ ID NO: 460997 - RNA, 19 nt, Homo sapiens
ccaaacaaucugugacuau

SEQ ID NO: 460998 - RNA, 19 nt, Homo sapiens
caagacuguugccaauaug

SEQ ID NO: 460999 - RNA, 19 nt, Homo sapiens
gccaaacaaucugugacua

SEQ ID NO: 461000 - RNA, 19 nt, Homo sapiens
gcaaugucugccuaguuua

SEQ ID NO: 461001 - RNA, 19 nt, Homo sapiens
guaccacuguauugauuag

SEQ ID NO: 461002 - RNA, 19 nt, Homo sapiens
cgaacaccaugccuucaau

SEQ ID NO: 461003 - RNA, 19 nt, Homo sapiens
uaaggauuguuccaaauac

SEQ ID NO: 461004 - RNA, 19 nt, Homo sapiens
guuggaagauuugggaaug

SEQ ID NO: 461005 - RNA, 19 nt, Homo sapiens
cauugcauguguaguuuga

SEQ ID NO: 461006 - RNA, 19 nt, Homo sapiens
cagaauauuguccucauug

SEQ ID NO: 461007 - RNA, 19 nt, Homo sapiens
acaccaugccuucaauuaa

SEQ ID NO: 461008 - RNA, 19 nt, Homo sapiens
acuuagacaucaaagguuu

SEQ ID NO: 461009 - RNA, 19 nt, Homo sapiens
gcugcaaacuacuuagaca

SEQ ID NO: 461010 - RNA, 19 nt, Homo sapiens
cagcagcaagucaauugua

SEQ ID NO: 461011 - RNA, 19 nt, Homo sapiens
gaaguugauguggaaauug

SEQ ID NO: 461012 - RNA, 19 nt, Homo sapiens
agaccauguuggaagauuu

SEQ ID NO: 461013 - RNA, 19 nt, Homo sapiens
caaggaguaccacuguauu

SEQ ID NO: 461014 - RNA, 19 nt, Homo sapiens
gcagcaagucaauuguauu

SEQ ID NO: 461015 - RNA, 19 nt, Homo sapiens
gaugaugagaacaaagaaa

SEQ ID NO: 461016 - RNA, 19 nt, Homo sapiens
caugaaugcaagauacuuu

SEQ ID NO: 461017 - RNA, 19 nt, Homo sapiens
uaauuaguguucccaugug

SEQ ID NO: 461018 - RNA, 19 nt, Homo sapiens
uagacaaacaguagacaaa

SEQ ID NO: 461019 - RNA, 19 nt, Homo sapiens
ucaaggaguaccacuguau

SEQ ID NO: 461020 - RNA, 19 nt, Homo sapiens
ggugugaagagaagugaaa

SEQ ID NO: 461021 - RNA, 19 nt, Homo sapiens
ggaguaccacuguauugau

SEQ ID NO: 461022 - RNA, 19 nt, Homo sapiens
gugaagagaagugaaaugu

SEQ ID NO: 461023 - RNA, 19 nt, Homo sapiens
ccaagaauuccugaaaguu

SEQ ID NO: 461024 - RNA, 19 nt, Homo sapiens
gaaugcaagauacuuucaa

SEQ ID NO: 461025 - RNA, 19 nt, Homo sapiens
aaagacacuuaacccaugu

SEQ ID NO: 461026 - RNA, 19 nt, Homo sapiens
caaugucugccuaguuuau

SEQ ID NO: 461027 - RNA, 19 nt, Homo sapiens
ccucauugcauguguaguu

SEQ ID NO: 461028 - RNA, 19 nt, Homo sapiens
uguaaggauuguuccaaau

SEQ ID NO: 461029 - RNA, 19 nt, Homo sapiens
ccaguggugugaagagaag

SEQ ID NO: 461030 - RNA, 19 nt, Homo sapiens
gagauucgcaagaccuuca

SEQ ID NO: 461031 - RNA, 19 nt, Homo sapiens
uugauuagccuguauguag

SEQ ID NO: 461032 - RNA, 19 nt, Homo sapiens
gucaaggaguaccacugua

SEQ ID NO: 461033 - RNA, 19 nt, Homo sapiens
gagcuacuaggaugucuuc

SEQ ID NO: 461034 - RNA, 19 nt, Homo sapiens
caaaugcagcagcaaguca

SEQ ID NO: 461035 - RNA, 19 nt, Homo sapiens
uugcacugcucuguuuaua

SEQ ID NO: 461036 - RNA, 19 nt, Homo sapiens
cuguaacacuguaaggauu

SEQ ID NO: 461037 - RNA, 19 nt, Homo sapiens
cacacuacuugcauguaaa

SEQ ID NO: 461038 - RNA, 19 nt, Homo sapiens
cuguaaggauuguuccaaa

SEQ ID NO: 461039 - RNA, 19 nt, Homo sapiens
cauugcaucugaggacuug

SEQ ID NO: 461040 - RNA, 19 nt, Homo sapiens
ccuaguuuauuguccaguu

SEQ ID NO: 461041 - RNA, 19 nt, Homo sapiens
gauauuugaaguugaugug

SEQ ID NO: 461042 - RNA, 19 nt, Homo sapiens
gaaagaaucuccagaaauc

SEQ ID NO: 461043 - RNA, 19 nt, Homo sapiens
aaucagaucucucuacuuu

SEQ ID NO: 461044 - RNA, 19 nt, Homo sapiens
caucuagacuuaagugaua

SEQ ID NO: 461045 - RNA, 19 nt, Homo sapiens
ggaaacggcugaagagcaa

SEQ ID NO: 461046 - RNA, 19 nt, Homo sapiens
ggagaaauucccacacuaa

SEQ ID NO: 461047 - RNA, 19 nt, Homo sapiens
gaaaucagaucucucuacu

SEQ ID NO: 461048 - RNA, 19 nt, Homo sapiens
gcaaagggagugacaaaga

SEQ ID NO: 461049 - RNA, 19 nt, Homo sapiens
cagaaagaaucuccagaaa

SEQ ID NO: 461050 - RNA, 19 nt, Homo sapiens
cuaaaggucucugguguuu

SEQ ID NO: 461051 - RNA, 19 nt, Homo sapiens
gauggugucucuucuuuag

SEQ ID NO: 461052 - RNA, 19 nt, Homo sapiens
ucagaucucucuacuuuag

SEQ ID NO: 461053 - RNA, 19 nt, Homo sapiens
gcaguuaaugcacguauuu

SEQ ID NO: 461054 - RNA, 19 nt, Homo sapiens
gagcaaagggagugacaaa

SEQ ID NO: 461055 - RNA, 19 nt, Homo sapiens
cagcaagacuucugaacug

SEQ ID NO: 461056 - RNA, 19 nt, Homo sapiens
gauagugucaugcuaaaga

SEQ ID NO: 461057 - RNA, 19 nt, Homo sapiens
gagaaauucccacacuaaa

SEQ ID NO: 461058 - RNA, 19 nt, Homo sapiens
ucggugcuaugauauaaua

SEQ ID NO: 461059 - RNA, 19 nt, Homo sapiens
caaauuuagugcgacuuaa

SEQ ID NO: 461060 - RNA, 19 nt, Homo sapiens
cagauuaauugcucccauu

SEQ ID NO: 461061 - RNA, 19 nt, Homo sapiens
aaaggucucugguguuugu

SEQ ID NO: 461062 - RNA, 19 nt, Homo sapiens
cccaggaacugcucucaaa

SEQ ID NO: 461063 - RNA, 19 nt, Homo sapiens
gaugguacccuucaacugu

SEQ ID NO: 461064 - RNA, 19 nt, Homo sapiens
ugacugcuuucaggaauuu

SEQ ID NO: 461065 - RNA, 19 nt, Homo sapiens
ucaaauuuagugcgacuua

SEQ ID NO: 461066 - RNA, 19 nt, Homo sapiens
gaacuuuccagguguuuca

SEQ ID NO: 461067 - RNA, 19 nt, Homo sapiens
ucacccagcugaaucuuag

SEQ ID NO: 461068 - RNA, 19 nt, Homo sapiens
gugauagugucaugcuaaa

SEQ ID NO: 461069 - RNA, 19 nt, Homo sapiens
caaagggagugacaaagac

SEQ ID NO: 461070 - RNA, 19 nt, Homo sapiens
gaaugacugcuuucaggaa

SEQ ID NO: 461071 - RNA, 19 nt, Homo sapiens
gaauuugcccugcagacuu

SEQ ID NO: 461072 - RNA, 19 nt, Homo sapiens
gguaucgccuagcgucuga

SEQ ID NO: 461073 - RNA, 19 nt, Homo sapiens
aagaggagcccgacaguga

SEQ ID NO: 461074 - RNA, 19 nt, Homo sapiens
gaaagaggagcccgacagu

SEQ ID NO: 461075 - RNA, 19 nt, Homo sapiens
ccaguugucuaugaaguau

SEQ ID NO: 461076 - RNA, 19 nt, Homo sapiens
cccaauugcuggaguacuu

SEQ ID NO: 461077 - RNA, 19 nt, Homo sapiens
cucagucggugcuaugaua

SEQ ID NO: 461078 - RNA, 19 nt, Homo sapiens
ucuuguccaucuagacuua

SEQ ID NO: 461079 - RNA, 19 nt, Homo sapiens
ggauggugucucuucuuua

SEQ ID NO: 461080 - RNA, 19 nt, Homo sapiens
aauuugcccugcagacuuu

SEQ ID NO: 461081 - RNA, 19 nt, Homo sapiens
ggaugggauuccagcaaga

SEQ ID NO: 461082 - RNA, 19 nt, Homo sapiens
ccacggaaacggcugaaga

SEQ ID NO: 461083 - RNA, 19 nt, Homo sapiens
uggaguacuuagcuaguuu

SEQ ID NO: 461084 - RNA, 19 nt, Homo sapiens
aggauggugucucuucuuu

SEQ ID NO: 461085 - RNA, 19 nt, Homo sapiens
acagaaagaaucuccagaa

SEQ ID NO: 461086 - RNA, 19 nt, Homo sapiens
aaagcccaguugucuauga

SEQ ID NO: 461087 - RNA, 19 nt, Homo sapiens
gaaacuuuacuugaacuug

SEQ ID NO: 461088 - RNA, 19 nt, Homo sapiens
caacuaccuccaacaccua

SEQ ID NO: 461089 - RNA, 19 nt, Homo sapiens
ccagaaaucagaucucucu

SEQ ID NO: 461090 - RNA, 19 nt, Homo sapiens
uggagaaauucccacacua

SEQ ID NO: 461091 - RNA, 19 nt, Homo sapiens
guuccaaguugcagaaucu

SEQ ID NO: 461092 - RNA, 19 nt, Homo sapiens
gcaggauggugucucuucu

SEQ ID NO: 461093 - RNA, 19 nt, Homo sapiens
agaaagaaucuccagaaau

SEQ ID NO: 461094 - RNA, 19 nt, Homo sapiens
ucccugagcugcuaaaggu

SEQ ID NO: 461095 - RNA, 19 nt, Homo sapiens
uaagcuaaaucgagagaac

SEQ ID NO: 461096 - RNA, 19 nt, Homo sapiens
caucaaaugccgacugaca

SEQ ID NO: 461097 - RNA, 19 nt, Homo sapiens
auuaauugcucccauuuca

SEQ ID NO: 461098 - RNA, 19 nt, Homo sapiens
accauuggcugaacauuuc

SEQ ID NO: 461099 - RNA, 19 nt, Homo sapiens
ggaaucgugccagauggua

SEQ ID NO: 461100 - RNA, 19 nt, Homo sapiens
agucggugcuaugauauaa

SEQ ID NO: 461101 - RNA, 19 nt, Homo sapiens
gagauuccagaccugagua

SEQ ID NO: 461102 - RNA, 19 nt, Homo sapiens
gaucucucuacuuuaguua

SEQ ID NO: 461103 - RNA, 19 nt, Homo sapiens
gcuaaaggucucugguguu

SEQ ID NO: 461104 - RNA, 19 nt, Homo sapiens
guacagcacauggaccuau

SEQ ID NO: 461105 - RNA, 19 nt, Homo sapiens
ccaauugcuggaguacuua

SEQ ID NO: 461106 - RNA, 19 nt, Homo sapiens
uuagugcgacuuaaccuuu

SEQ ID NO: 461107 - RNA, 19 nt, Homo sapiens
ccgcaggccuaagcuaaau

SEQ ID NO: 461108 - RNA, 19 nt, Homo sapiens
caaaagcccaguugucuau

SEQ ID NO: 461109 - RNA, 19 nt, Homo sapiens
ggagauauggggcaucaaa

SEQ ID NO: 461110 - RNA, 19 nt, Homo sapiens
ccaaucuuguccaucuaga

SEQ ID NO: 461111 - RNA, 19 nt, Homo sapiens
agaucucucuacuuuaguu

SEQ ID NO: 461112 - RNA, 19 nt, Homo sapiens
uaccugaaacuuuacuuga

SEQ ID NO: 461113 - RNA, 19 nt, Homo sapiens
gaccaucacccagcugaau

SEQ ID NO: 461114 - RNA, 19 nt, Homo sapiens
gaacauuucagcccuuuuc

SEQ ID NO: 461115 - RNA, 19 nt, Homo sapiens
agagaacuuuccagguguu

SEQ ID NO: 461116 - RNA, 19 nt, Homo sapiens
gcccaguugucuaugaagu

SEQ ID NO: 461117 - RNA, 19 nt, Homo sapiens
ugguacccuucaacuguua

SEQ ID NO: 461118 - RNA, 19 nt, Homo sapiens
acuugaacuuggagaaauu

SEQ ID NO: 461119 - RNA, 19 nt, Homo sapiens
ggagauuccagaccugagu

SEQ ID NO: 461120 - RNA, 19 nt, Homo sapiens
gcaaaagcccaguugucua

SEQ ID NO: 461121 - RNA, 19 nt, Homo sapiens
ccugaaacuuuacuugaac

SEQ ID NO: 461122 - RNA, 19 nt, Homo sapiens
auagugucaugcuaaagaa

SEQ ID NO: 461123 - RNA, 19 nt, Homo sapiens
cuuaagugauagugucaug

SEQ ID NO: 461124 - RNA, 19 nt, Homo sapiens
cuacuuuaguuagaagaug

SEQ ID NO: 461125 - RNA, 19 nt, Homo sapiens
aaccauuggcugaacauuu

SEQ ID NO: 461126 - RNA, 19 nt, Homo sapiens
ccgcugcccacgaucauuu

SEQ ID NO: 461127 - RNA, 19 nt, Homo sapiens
gaggagcccgacagugaga

SEQ ID NO: 461128 - RNA, 19 nt, Homo sapiens
accugaaacuuuacuugaa

SEQ ID NO: 461129 - RNA, 19 nt, Homo sapiens
aaugacugcuuucaggaau

SEQ ID NO: 461130 - RNA, 19 nt, Homo sapiens
aagcccaguugucuaugaa

SEQ ID NO: 461131 - RNA, 19 nt, Homo sapiens
gcuaaaucgagagaacuuu

SEQ ID NO: 461132 - RNA, 19 nt, Homo sapiens
cugaaccucuccugguguu

SEQ ID NO: 461133 - RNA, 19 nt, Homo sapiens
cuggaaggccugcggcuuu

SEQ ID NO: 461134 - RNA, 19 nt, Homo sapiens
ccuucauucugcaaguaua

SEQ ID NO: 461135 - RNA, 19 nt, Homo sapiens
aagcccaauugcuggagua

SEQ ID NO: 461136 - RNA, 19 nt, Homo sapiens
gauuaauugcucccauuuc

SEQ ID NO: 461137 - RNA, 19 nt, Homo sapiens
guccgcaggccuaagcuaa

SEQ ID NO: 461138 - RNA, 19 nt, Homo sapiens
cuaaaucgagagaacuuuc

SEQ ID NO: 461139 - RNA, 19 nt, Homo sapiens
guuagaagaugccccaauc

SEQ ID NO: 461140 - RNA, 19 nt, Homo sapiens
ccuagcgucugaugagucu

SEQ ID NO: 461141 - RNA, 19 nt, Homo sapiens
gugccucccugagcugcua

SEQ ID NO: 461142 - RNA, 19 nt, Homo sapiens
gaaagaaucuccagaaauc

SEQ ID NO: 461143 - RNA, 19 nt, Homo sapiens
aaucagaucucucuacuuu

SEQ ID NO: 461144 - RNA, 19 nt, Homo sapiens
caucuagacuuaagugaua

SEQ ID NO: 461145 - RNA, 19 nt, Homo sapiens
ggaaacggcugaagagcaa

SEQ ID NO: 461146 - RNA, 19 nt, Homo sapiens
gaaaucagaucucucuacu

SEQ ID NO: 461147 - RNA, 19 nt, Homo sapiens
gcaaagggagugacaaaga

SEQ ID NO: 461148 - RNA, 19 nt, Homo sapiens
cagaaagaaucuccagaaa

SEQ ID NO: 461149 - RNA, 19 nt, Homo sapiens
cuaaaggucucugguguuu

SEQ ID NO: 461150 - RNA, 19 nt, Homo sapiens
aaacucaaguccagccaua

SEQ ID NO: 461151 - RNA, 19 nt, Homo sapiens
gcaguuaaugcacguauuu

SEQ ID NO: 461152 - RNA, 19 nt, Homo sapiens
ucagaucucucuacuuuag

SEQ ID NO: 461153 - RNA, 19 nt, Homo sapiens
gagcaaagggagugacaaa

SEQ ID NO: 461154 - RNA, 19 nt, Homo sapiens
cagcaagacuucugaacug

SEQ ID NO: 461155 - RNA, 19 nt, Homo sapiens
gauagugucaugcuaaaga

SEQ ID NO: 461156 - RNA, 19 nt, Homo sapiens
ucggugcuaugauauaaua

SEQ ID NO: 461157 - RNA, 19 nt, Homo sapiens
caaauuuagugcgacuuaa

SEQ ID NO: 461158 - RNA, 19 nt, Homo sapiens
auacagaacuuccaaacuc

SEQ ID NO: 461159 - RNA, 19 nt, Homo sapiens
aaaggucucugguguuugu

SEQ ID NO: 461160 - RNA, 19 nt, Homo sapiens
cccaggaacugcucucaaa

SEQ ID NO: 461161 - RNA, 19 nt, Homo sapiens
ccucaaacauacagaacuu

SEQ ID NO: 461162 - RNA, 19 nt, Homo sapiens
ugacugcuuucaggaauuu

SEQ ID NO: 461163 - RNA, 19 nt, Homo sapiens
ucaaauuuagugcgacuua

SEQ ID NO: 461164 - RNA, 19 nt, Homo sapiens
gaacuuuccagguguuuca

SEQ ID NO: 461165 - RNA, 19 nt, Homo sapiens
ucacccagcugaaucuuag

SEQ ID NO: 461166 - RNA, 19 nt, Homo sapiens
gugauagugucaugcuaaa

SEQ ID NO: 461167 - RNA, 19 nt, Homo sapiens
caaagggagugacaaagac

SEQ ID NO: 461168 - RNA, 19 nt, Homo sapiens
gaaugacugcuuucaggaa

SEQ ID NO: 461169 - RNA, 19 nt, Homo sapiens
gaauuugcccugcagacuu

SEQ ID NO: 461170 - RNA, 19 nt, Homo sapiens
gguaucgccuagcgucuga

SEQ ID NO: 461171 - RNA, 19 nt, Homo sapiens
aagaggagcccgacaguga

SEQ ID NO: 461172 - RNA, 19 nt, Homo sapiens
gaaagaggagcccgacagu

SEQ ID NO: 461173 - RNA, 19 nt, Homo sapiens
ccugaaacuuuacuauuag

SEQ ID NO: 461174 - RNA, 19 nt, Homo sapiens
cucagucggugcuaugaua

SEQ ID NO: 461175 - RNA, 19 nt, Homo sapiens
ucuuguccaucuagacuua

SEQ ID NO: 461176 - RNA, 19 nt, Homo sapiens
aauuugcccugcagacuuu

SEQ ID NO: 461177 - RNA, 19 nt, Homo sapiens
ggaugggauuccagcaaga

SEQ ID NO: 461178 - RNA, 19 nt, Homo sapiens
ccacggaaacggcugaaga

SEQ ID NO: 461179 - RNA, 19 nt, Homo sapiens
caacaugucagaguaaucu

SEQ ID NO: 461180 - RNA, 19 nt, Homo sapiens
acagaaagaaucuccagaa

SEQ ID NO: 461181 - RNA, 19 nt, Homo sapiens
ucggaugcccucaaacaua

SEQ ID NO: 461182 - RNA, 19 nt, Homo sapiens
caacuaccuccaacaccua

SEQ ID NO: 461183 - RNA, 19 nt, Homo sapiens
ccagaaaucagaucucucu

SEQ ID NO: 461184 - RNA, 19 nt, Homo sapiens
guuccaaguugcagaaucu

SEQ ID NO: 461185 - RNA, 19 nt, Homo sapiens
guccagccauaagcuauuu

SEQ ID NO: 461186 - RNA, 19 nt, Homo sapiens
agaaagaaucuccagaaau

SEQ ID NO: 461187 - RNA, 19 nt, Homo sapiens
ucccugagcugcuaaaggu

SEQ ID NO: 461188 - RNA, 19 nt, Homo sapiens
uaagcuaaaucgagagaac

SEQ ID NO: 461189 - RNA, 19 nt, Homo sapiens
accauuggcugaacauuuc

SEQ ID NO: 461190 - RNA, 19 nt, Homo sapiens
cggaugcccucaaacauac

SEQ ID NO: 461191 - RNA, 19 nt, Homo sapiens
uacagaacuuccaaacuca

SEQ ID NO: 461192 - RNA, 19 nt, Homo sapiens
aaacauacagaacuuccaa

SEQ ID NO: 461193 - RNA, 19 nt, Homo sapiens
ggauccgguuggacucuga

SEQ ID NO: 461194 - RNA, 19 nt, Homo sapiens
gagauuccagaccugagua

SEQ ID NO: 461195 - RNA, 19 nt, Homo sapiens
agucggugcuaugauauaa

SEQ ID NO: 461196 - RNA, 19 nt, Homo sapiens
gaucucucuacuuuaguua

SEQ ID NO: 461197 - RNA, 19 nt, Homo sapiens
gcuaaaggucucugguguu

SEQ ID NO: 461198 - RNA, 19 nt, Homo sapiens
uugccaacaugucagagua

SEQ ID NO: 461199 - RNA, 19 nt, Homo sapiens
guacagcacauggaccuau

SEQ ID NO: 461200 - RNA, 19 nt, Homo sapiens
uuagugcgacuuaaccuuu

SEQ ID NO: 461201 - RNA, 19 nt, Homo sapiens
ccgcaggccuaagcuaaau

SEQ ID NO: 461202 - RNA, 19 nt, Homo sapiens
caaguccagccauaagcua

SEQ ID NO: 461203 - RNA, 19 nt, Homo sapiens
ccaaucuuguccaucuaga

SEQ ID NO: 461204 - RNA, 19 nt, Homo sapiens
agaucucucuacuuuaguu

SEQ ID NO: 461205 - RNA, 19 nt, Homo sapiens
gaccaucacccagcugaau

SEQ ID NO: 461206 - RNA, 19 nt, Homo sapiens
gaacauuucagcccuuuuc

SEQ ID NO: 461207 - RNA, 19 nt, Homo sapiens
agagaacuuuccagguguu

SEQ ID NO: 461208 - RNA, 19 nt, Homo sapiens
gccaacaugucagaguaau

SEQ ID NO: 461209 - RNA, 19 nt, Homo sapiens
ggagauuccagaccugagu

SEQ ID NO: 461210 - RNA, 19 nt, Homo sapiens
auagugucaugcuaaagaa

SEQ ID NO: 461211 - RNA, 19 nt, Homo sapiens
cuuaagugauagugucaug

SEQ ID NO: 461212 - RNA, 19 nt, Homo sapiens
cuacuuuaguuagaagaug

SEQ ID NO: 461213 - RNA, 19 nt, Homo sapiens
aaccauuggcugaacauuu

SEQ ID NO: 461214 - RNA, 19 nt, Homo sapiens
ccgcugcccacgaucauuu

SEQ ID NO: 461215 - RNA, 19 nt, Homo sapiens
aaugacugcuuucaggaau

SEQ ID NO: 461216 - RNA, 19 nt, Homo sapiens
gaggagcccgacagugaga

SEQ ID NO: 461217 - RNA, 19 nt, Homo sapiens
cugaaccucuccugguguu

SEQ ID NO: 461218 - RNA, 19 nt, Homo sapiens
cuggaaggccugcggcuuu

SEQ ID NO: 461219 - RNA, 19 nt, Homo sapiens
gcuaaaucgagagaacuuu

SEQ ID NO: 461220 - RNA, 19 nt, Homo sapiens
guuagaagaugccccaauc

SEQ ID NO: 461221 - RNA, 19 nt, Homo sapiens
guccgcaggccuaagcuaa

SEQ ID NO: 461222 - RNA, 19 nt, Homo sapiens
ccuagcgucugaugagucu

SEQ ID NO: 461223 - RNA, 19 nt, Homo sapiens
gugccucccugagcugcua

SEQ ID NO: 461224 - RNA, 19 nt, Homo sapiens
cuaaaucgagagaacuuuc

SEQ ID NO: 461225 - RNA, 19 nt, Homo sapiens
agaccugaguagcaacguu

SEQ ID NO: 461226 - RNA, 19 nt, Homo sapiens
gggauuccagcaagacuuc

SEQ ID NO: 461227 - RNA, 19 nt, Homo sapiens
gaaccucuccugguguuuu

SEQ ID NO: 461228 - RNA, 19 nt, Homo sapiens
cggacgcuaugcacaggaa

SEQ ID NO: 461229 - RNA, 19 nt, Homo sapiens
ggucucugguguuuguaag

SEQ ID NO: 461230 - RNA, 19 nt, Homo sapiens
gacaagagcugggguuagg

SEQ ID NO: 461231 - RNA, 19 nt, Homo sapiens
agugauagugucaugcuaa

SEQ ID NO: 461232 - RNA, 19 nt, Homo sapiens
ccaaguugcagaaucuaag

SEQ ID NO: 461233 - RNA, 19 nt, Homo sapiens
acauggaccuaucgaacuc

SEQ ID NO: 461234 - RNA, 19 nt, Homo sapiens
ugucaauacucucgcaaaa

SEQ ID NO: 461235 - RNA, 19 nt, Homo sapiens
gagaacuuuccagguguuu

SEQ ID NO: 461236 - RNA, 19 nt, Homo sapiens
ucacucagucggugcuaug

SEQ ID NO: 461237 - RNA, 19 nt, Homo sapiens
gcccugcagacuuugcuaa

SEQ ID NO: 461238 - RNA, 19 nt, Homo sapiens
uggaaggccugcggcuuuc

SEQ ID NO: 461239 - RNA, 19 nt, Homo sapiens
gaacaugcuugcaguaucu

SEQ ID NO: 461240 - RNA, 19 nt, Homo sapiens
gacauugacuucccgcaua

SEQ ID NO: 461241 - RNA, 19 nt, Homo sapiens
agaaauggauacagucuaa

SEQ ID NO: 461242 - RNA, 19 nt, Homo sapiens
ggaaccagcccacguauga

SEQ ID NO: 461243 - RNA, 19 nt, Homo sapiens
ggaacuacuuuaacuaauc

SEQ ID NO: 461244 - RNA, 19 nt, Homo sapiens
gcagaugggugcccugaau

SEQ ID NO: 461245 - RNA, 19 nt, Homo sapiens
uaacucacccgguacuuua

SEQ ID NO: 461246 - RNA, 19 nt, Homo sapiens
ggacaaagccacucucaca

SEQ ID NO: 461247 - RNA, 19 nt, Homo sapiens
ccaaguggauuaaugaugu

SEQ ID NO: 461248 - RNA, 19 nt, Homo sapiens
gaauggaacuacuuuaacu

SEQ ID NO: 461249 - RNA, 19 nt, Homo sapiens
gaucagggcuguggcauca

SEQ ID NO: 461250 - RNA, 19 nt, Homo sapiens
gaaaagaaauggauacagu

SEQ ID NO: 461251 - RNA, 19 nt, Homo sapiens
caaagccacucucacaaga

SEQ ID NO: 461252 - RNA, 19 nt, Homo sapiens
gcacuggucgagagaguua

SEQ ID NO: 461253 - RNA, 19 nt, Homo sapiens
cauaaauccuaguguguuu

SEQ ID NO: 461254 - RNA, 19 nt, Homo sapiens
gaauaggcauugcauuaag

SEQ ID NO: 461255 - RNA, 19 nt, Homo sapiens
ccgaauaggcauugcauua

SEQ ID NO: 461256 - RNA, 19 nt, Homo sapiens
gacaacaccuccuuugauc

SEQ ID NO: 461257 - RNA, 19 nt, Homo sapiens
gcauuacacuuugcuaaau

SEQ ID NO: 461258 - RNA, 19 nt, Homo sapiens
ugcauuaaguccucuguua

SEQ ID NO: 461259 - RNA, 19 nt, Homo sapiens
gaaaugggaaacagcauga

SEQ ID NO: 461260 - RNA, 19 nt, Homo sapiens
acaggcagguaaagcauua

SEQ ID NO: 461261 - RNA, 19 nt, Homo sapiens
guaacacuguggacauuga

SEQ ID NO: 461262 - RNA, 19 nt, Homo sapiens
gguaugcuuuccucucuuu

SEQ ID NO: 461263 - RNA, 19 nt, Homo sapiens
ggacaacaccuccuuugau

SEQ ID NO: 461264 - RNA, 19 nt, Homo sapiens
gaaaugaauguaacacugu

SEQ ID NO: 461265 - RNA, 19 nt, Homo sapiens
caaauucgcaucuucucua

SEQ ID NO: 461266 - RNA, 19 nt, Homo sapiens
gaauauguguggccagagu

SEQ ID NO: 461267 - RNA, 19 nt, Homo sapiens
guauguguaugugcaguua

SEQ ID NO: 461268 - RNA, 19 nt, Homo sapiens
gagaagcucccauccaaau

SEQ ID NO: 461269 - RNA, 19 nt, Homo sapiens
ggauacagucuaaagaauu

SEQ ID NO: 461270 - RNA, 19 nt, Homo sapiens
gaagccacauggagacuca

SEQ ID NO: 461271 - RNA, 19 nt, Homo sapiens
gcagagggccagaagaaug

SEQ ID NO: 461272 - RNA, 19 nt, Homo sapiens
ggaacaugcuugcaguauc

SEQ ID NO: 461273 - RNA, 19 nt, Homo sapiens
gaucggguagguaagaaua

SEQ ID NO: 461274 - RNA, 19 nt, Homo sapiens
uaccauggcuggcuguuug

SEQ ID NO: 461275 - RNA, 19 nt, Homo sapiens
gagagugggcugcagauga

SEQ ID NO: 461276 - RNA, 19 nt, Homo sapiens
ggagaaaacacaauguaua

SEQ ID NO: 461277 - RNA, 19 nt, Homo sapiens
gguaagaauagcuggauuu

SEQ ID NO: 461278 - RNA, 19 nt, Homo sapiens
cgaauaggcauugcauuaa

SEQ ID NO: 461279 - RNA, 19 nt, Homo sapiens
gugggaagcauuacacuuu

SEQ ID NO: 461280 - RNA, 19 nt, Homo sapiens
agagugggcugcagaugaa

SEQ ID NO: 461281 - RNA, 19 nt, Homo sapiens
gagaaacugcgugugauuu

SEQ ID NO: 461282 - RNA, 19 nt, Homo sapiens
ggaacuucgugacacuaaa

SEQ ID NO: 461283 - RNA, 19 nt, Homo sapiens
ggaaacagcaugaaaucca

SEQ ID NO: 461284 - RNA, 19 nt, Homo sapiens
ggagaaacugcgugugauu

SEQ ID NO: 461285 - RNA, 19 nt, Homo sapiens
ccacauggagacucaaauu

SEQ ID NO: 461286 - RNA, 19 nt, Homo sapiens
gaacuacuuuaacuaaucc

SEQ ID NO: 461287 - RNA, 19 nt, Homo sapiens
cagaaguguucacagugua

SEQ ID NO: 461288 - RNA, 19 nt, Homo sapiens
acacuuugcuaaaucaugu

SEQ ID NO: 461289 - RNA, 19 nt, Homo sapiens
caucaccaccuuacuuuga

SEQ ID NO: 461290 - RNA, 19 nt, Homo sapiens
cgacuuccuugccgugcua

SEQ ID NO: 461291 - RNA, 19 nt, Homo sapiens
ugacucauguuucccuguu

SEQ ID NO: 461292 - RNA, 19 nt, Homo sapiens
aaaggaaccagcccacgua

SEQ ID NO: 461293 - RNA, 19 nt, Homo sapiens
aagccacucucacaagaaa

SEQ ID NO: 461294 - RNA, 19 nt, Homo sapiens
gccaagaacagacacaaug

SEQ ID NO: 461295 - RNA, 19 nt, Homo sapiens
caccuuacuuugaggacua

SEQ ID NO: 461296 - RNA, 19 nt, Homo sapiens
acauugacuucccgcauaa

SEQ ID NO: 461297 - RNA, 19 nt, Homo sapiens
acagaaguguucacagugu

SEQ ID NO: 461298 - RNA, 19 nt, Homo sapiens
gcaccagcuucccugaugu

SEQ ID NO: 461299 - RNA, 19 nt, Homo sapiens
gaagaaugagagagaggaa

SEQ ID NO: 461300 - RNA, 19 nt, Homo sapiens
ucaauugggagauaccuuu

SEQ ID NO: 461301 - RNA, 19 nt, Homo sapiens
caccaggacugcucuccaa

SEQ ID NO: 461302 - RNA, 19 nt, Homo sapiens
caucuucucuauccacauc

SEQ ID NO: 461303 - RNA, 19 nt, Homo sapiens
gcucaucgugcuacuggua

SEQ ID NO: 461304 - RNA, 19 nt, Homo sapiens
gaaucugugacucauguuu

SEQ ID NO: 461305 - RNA, 19 nt, Homo sapiens
aaagcgagguucccugauc

SEQ ID NO: 461306 - RNA, 19 nt, Homo sapiens
gcccacguaugagaaauga

SEQ ID NO: 461307 - RNA, 19 nt, Homo sapiens
caacaccuccuuugaucga

SEQ ID NO: 461308 - RNA, 19 nt, Homo sapiens
ccacguaugagaaaugaau

SEQ ID NO: 461309 - RNA, 19 nt, Homo sapiens
ccaaaaggcuauuucaaag

SEQ ID NO: 461310 - RNA, 19 nt, Homo sapiens
gggagaaacugcgugugau

SEQ ID NO: 461311 - RNA, 19 nt, Homo sapiens
cagagggccagaagaauga

SEQ ID NO: 461312 - RNA, 19 nt, Homo sapiens
ggucugcuccugcaccaaa

SEQ ID NO: 461313 - RNA, 19 nt, Homo sapiens
gagagggagaggaaacaaa

SEQ ID NO: 461314 - RNA, 19 nt, Homo sapiens
ccagacaguuacacuccaa

SEQ ID NO: 461315 - RNA, 19 nt, Homo sapiens
caagagaaagagcucauuc

SEQ ID NO: 461316 - RNA, 19 nt, Homo sapiens
gagagagugagaccaagaa

SEQ ID NO: 461317 - RNA, 19 nt, Homo sapiens
ggagacaucugugguuucc

SEQ ID NO: 461318 - RNA, 19 nt, Homo sapiens
aaggagacaucugugguuu

SEQ ID NO: 461319 - RNA, 19 nt, Homo sapiens
caaggagacaucugugguu

SEQ ID NO: 461320 - RNA, 19 nt, Homo sapiens
caggacugcucuccaagga

SEQ ID NO: 461321 - RNA, 19 nt, Homo sapiens
cacaauguauagccagaga

SEQ ID NO: 461322 - RNA, 19 nt, Homo sapiens
agaguuacaucccuggaau

SEQ ID NO: 461323 - RNA, 19 nt, Homo sapiens
cugaauggaacuacuuuaa

SEQ ID NO: 461324 - RNA, 19 nt, Homo sapiens
gcaagagaaagagcucauu

SEQ ID NO: 461325 - RNA, 19 nt, Homo sapiens
ggaggagaguguccagacu

SEQ ID NO: 461326 - RNA, 19 nt, Homo sapiens
gaaauggauacagucuaaa

SEQ ID NO: 461327 - RNA, 19 nt, Homo sapiens
ggcuuaggauggaauuaga

SEQ ID NO: 461328 - RNA, 19 nt, Homo sapiens
gcauuaaguccucuguuag

SEQ ID NO: 461329 - RNA, 19 nt, Homo sapiens
ucucugggaugcugggauu

SEQ ID NO: 461330 - RNA, 19 nt, Homo sapiens
ggacuucugguaugcuuuc

SEQ ID NO: 461331 - RNA, 19 nt, Homo sapiens
uggauacagucuaaagaau

SEQ ID NO: 461332 - RNA, 19 nt, Homo sapiens
agaaagaaaugggaaacag

SEQ ID NO: 461333 - RNA, 19 nt, Homo sapiens
gggacuggauagcgacuuc

SEQ ID NO: 461334 - RNA, 19 nt, Homo sapiens
ucaguuggccucccugguu

SEQ ID NO: 461335 - RNA, 19 nt, Homo sapiens
gacaaagccacucucacaa

SEQ ID NO: 461336 - RNA, 19 nt, Homo sapiens
ccugucaccuugcgucaga

SEQ ID NO: 461337 - RNA, 19 nt, Homo sapiens
cauuacacuuugcuaaauc

SEQ ID NO: 461338 - RNA, 19 nt, Homo sapiens
ucagagagagugagaccaa

SEQ ID NO: 461339 - RNA, 19 nt, Homo sapiens
gaugagggaugguaccuua

SEQ ID NO: 461340 - RNA, 19 nt, Homo sapiens
gaacagagcguuacuugau

SEQ ID NO: 461341 - RNA, 19 nt, Homo sapiens
gaaauggacaguaauguga

SEQ ID NO: 461342 - RNA, 19 nt, Homo sapiens
cagaugaaauggacaguaa

SEQ ID NO: 461343 - RNA, 19 nt, Homo sapiens
gcuuacagcuggagugaaa

SEQ ID NO: 461344 - RNA, 19 nt, Homo sapiens
uaacagcguuccaucuuug

SEQ ID NO: 461345 - RNA, 19 nt, Homo sapiens
caaauuccaucacagucua

SEQ ID NO: 461346 - RNA, 19 nt, Homo sapiens
ggucuccacuccagaaauu

SEQ ID NO: 461347 - RNA, 19 nt, Homo sapiens
agaagaaacuugacuccuu

SEQ ID NO: 461348 - RNA, 19 nt, Homo sapiens
gaaaugaacaaggaaguga

SEQ ID NO: 461349 - RNA, 19 nt, Homo sapiens
uaaugugaguucagacuuu

SEQ ID NO: 461350 - RNA, 19 nt, Homo sapiens
ggagaucgcuacaaguuuu

SEQ ID NO: 461351 - RNA, 19 nt, Homo sapiens
ggcuggaacugauaauaaa

SEQ ID NO: 461352 - RNA, 19 nt, Homo sapiens
gauaacagcguuccaucuu

SEQ ID NO: 461353 - RNA, 19 nt, Homo sapiens
ccugacauaugaaaggaua

SEQ ID NO: 461354 - RNA, 19 nt, Homo sapiens
gaagggugaauuucuuauu

SEQ ID NO: 461355 - RNA, 19 nt, Homo sapiens
gagggaugguaccuuauga

SEQ ID NO: 461356 - RNA, 19 nt, Homo sapiens
caguuucucucucaggaua

SEQ ID NO: 461357 - RNA, 19 nt, Homo sapiens
gcucuuggcuggaacugau

SEQ ID NO: 461358 - RNA, 19 nt, Homo sapiens
acagagcguuacuugauaa

SEQ ID NO: 461359 - RNA, 19 nt, Homo sapiens
acauacaucugugaaauga

SEQ ID NO: 461360 - RNA, 19 nt, Homo sapiens
gaagcaggcccuccacguu

SEQ ID NO: 461361 - RNA, 19 nt, Homo sapiens
gaacagugucgagaacaaa

SEQ ID NO: 461362 - RNA, 19 nt, Homo sapiens
gaaaccagguccucuucag

SEQ ID NO: 461363 - RNA, 19 nt, Homo sapiens
uaaacaagacccaggagaa

SEQ ID NO: 461364 - RNA, 19 nt, Homo sapiens
ggagaacagugucgagaac

SEQ ID NO: 461365 - RNA, 19 nt, Homo sapiens
gaugaacugcccaaagauu

SEQ ID NO: 461366 - RNA, 19 nt, Homo sapiens
gaacaaaagcauccacauu

SEQ ID NO: 461367 - RNA, 19 nt, Homo sapiens
ggauaaagagugaauagag

SEQ ID NO: 461368 - RNA, 19 nt, Homo sapiens
ucaacucccuggugauguu

SEQ ID NO: 461369 - RNA, 19 nt, Homo sapiens
caaagauucuccggcaguu

SEQ ID NO: 461370 - RNA, 19 nt, Homo sapiens
ggacaguaaugugaguuca

SEQ ID NO: 461371 - RNA, 19 nt, Homo sapiens
auacuacaguugagaagaa

SEQ ID NO: 461372 - RNA, 19 nt, Homo sapiens
guauaaaggaagcuaagaa

SEQ ID NO: 461373 - RNA, 19 nt, Homo sapiens
caggacaucugaguaccua

SEQ ID NO: 461374 - RNA, 19 nt, Homo sapiens
gaugaaauggacaguaaug

SEQ ID NO: 461375 - RNA, 19 nt, Homo sapiens
aacagagcguuacuugaua

SEQ ID NO: 461376 - RNA, 19 nt, Homo sapiens
aagcaggcccuccacguua

SEQ ID NO: 461377 - RNA, 19 nt, Homo sapiens
augaugaacugcccaaaga

SEQ ID NO: 461378 - RNA, 19 nt, Homo sapiens
gagguaaaacgaaccauua

SEQ ID NO: 461379 - RNA, 19 nt, Homo sapiens
gcagaugaaauggacagua

SEQ ID NO: 461380 - RNA, 19 nt, Homo sapiens
cagaacagagcguuacuug

SEQ ID NO: 461381 - RNA, 19 nt, Homo sapiens
caucauggugguaauacua

SEQ ID NO: 461382 - RNA, 19 nt, Homo sapiens
ucugggagcugaucaugau

SEQ ID NO: 461383 - RNA, 19 nt, Homo sapiens
aagugaggcuucccaagaa

SEQ ID NO: 461384 - RNA, 19 nt, Homo sapiens
uaggagaucgcuacaaguu

SEQ ID NO: 461385 - RNA, 19 nt, Homo sapiens
auaacagcguuccaucuuu

SEQ ID NO: 461386 - RNA, 19 nt, Homo sapiens
guaauacuacaguugagaa

SEQ ID NO: 461387 - RNA, 19 nt, Homo sapiens
ucugugaaaugaacaagga

SEQ ID NO: 461388 - RNA, 19 nt, Homo sapiens
aaacaaauuccaucacagu

SEQ ID NO: 461389 - RNA, 19 nt, Homo sapiens
gcaggucuccacuccagaa

SEQ ID NO: 461390 - RNA, 19 nt, Homo sapiens
ucuaggagaucgcuacaag

SEQ ID NO: 461391 - RNA, 19 nt, Homo sapiens
gaccaccagucacaaaguc

SEQ ID NO: 461392 - RNA, 19 nt, Homo sapiens
caaaaucacuggagaacag

SEQ ID NO: 461393 - RNA, 19 nt, Homo sapiens
uggcuggaacugauaauaa

SEQ ID NO: 461394 - RNA, 19 nt, Homo sapiens
acaguaaugugaguucaga

SEQ ID NO: 461395 - RNA, 19 nt, Homo sapiens
aaaccaaaaugaacacuga

SEQ ID NO: 461396 - RNA, 19 nt, Homo sapiens
ggauaaauaagagcaugaa

SEQ ID NO: 461397 - RNA, 19 nt, Homo sapiens
cacaaagucuggaaaaguu

SEQ ID NO: 461398 - RNA, 19 nt, Homo sapiens
ggacaucugaguaccuauc

SEQ ID NO: 461399 - RNA, 19 nt, Homo sapiens
gcaacccuaucagcaacaa

SEQ ID NO: 461400 - RNA, 19 nt, Homo sapiens
ugaaauggacaguaaugug

SEQ ID NO: 461401 - RNA, 19 nt, Homo sapiens
gcaacaauucccagaccuu

SEQ ID NO: 461402 - RNA, 19 nt, Homo sapiens
agaacagugucgagaacaa

SEQ ID NO: 461403 - RNA, 19 nt, Homo sapiens
gcaaaacccagaagcuaaa

SEQ ID NO: 461404 - RNA, 19 nt, Homo sapiens
aguguaugcugggcuguua

SEQ ID NO: 461405 - RNA, 19 nt, Homo sapiens
gcacgucuguacccuucuc

SEQ ID NO: 461406 - RNA, 19 nt, Homo sapiens
ggaacaggugggcgcauga

SEQ ID NO: 461407 - RNA, 19 nt, Homo sapiens
ugaggcuucccaagaauuu

SEQ ID NO: 461408 - RNA, 19 nt, Homo sapiens
caguugagaagaagaggua

SEQ ID NO: 461409 - RNA, 19 nt, Homo sapiens
auacaucugugaaaugaac

SEQ ID NO: 461410 - RNA, 19 nt, Homo sapiens
ccagaaaccagguccucuu

SEQ ID NO: 461411 - RNA, 19 nt, Homo sapiens
gugguaauacuacaguuga

SEQ ID NO: 461412 - RNA, 19 nt, Homo sapiens
gagcugaucaugauaaccu

SEQ ID NO: 461413 - RNA, 19 nt, Homo sapiens
gcaguugggaagcaaagug

SEQ ID NO: 461414 - RNA, 19 nt, Homo sapiens
caccagagaccaacaaagg

SEQ ID NO: 461415 - RNA, 19 nt, Homo sapiens
aacgggaccugcaccuuga

SEQ ID NO: 461416 - RNA, 19 nt, Homo sapiens
ccacugaacccagccaaca

SEQ ID NO: 461417 - RNA, 19 nt, Homo sapiens
guaaugugaguucagacuu

SEQ ID NO: 461418 - RNA, 19 nt, Homo sapiens
gaacaggugggcgcaugau

SEQ ID NO: 461419 - RNA, 19 nt, Homo sapiens
gaagaagagguaaaacgaa

SEQ ID NO: 461420 - RNA, 19 nt, Homo sapiens
caggauaaagagugaauag

SEQ ID NO: 461421 - RNA, 19 nt, Homo sapiens
gaccugaucaagccucugu

SEQ ID NO: 461422 - RNA, 19 nt, Homo sapiens
uuggcuaucuuuacuuugu

SEQ ID NO: 461423 - RNA, 19 nt, Homo sapiens
gcagaacagagcguuacuu

SEQ ID NO: 461424 - RNA, 19 nt, Homo sapiens
ggugguaauacuacaguug

SEQ ID NO: 461425 - RNA, 19 nt, Homo sapiens
ggacagaccccucagaaac

SEQ ID NO: 461426 - RNA, 19 nt, Homo sapiens
aauagugucucuugaucca

SEQ ID NO: 461427 - RNA, 19 nt, Homo sapiens
aaugugaguucagacuuug

SEQ ID NO: 461428 - RNA, 19 nt, Homo sapiens
uguuguagcagaugaaaug

SEQ ID NO: 461429 - RNA, 19 nt, Homo sapiens
guuccaucuuuguguugua

SEQ ID NO: 461430 - RNA, 19 nt, Homo sapiens
gguaauacuacaguugaga

SEQ ID NO: 461431 - RNA, 19 nt, Homo sapiens
ugagcaacccuaucagcaa

SEQ ID NO: 461432 - RNA, 19 nt, Homo sapiens
acaggugggcgcaugauga

SEQ ID NO: 461433 - RNA, 19 nt, Homo sapiens
guucagacuuugggcaucu

SEQ ID NO: 461434 - RNA, 19 nt, Homo sapiens
gaggcuucccaagaauuua

SEQ ID NO: 461435 - RNA, 19 nt, Homo sapiens
caggugggcgcaugaugaa

SEQ ID NO: 461436 - RNA, 19 nt, Homo sapiens
aaccagguccucuucagaa

SEQ ID NO: 461437 - RNA, 19 nt, Homo sapiens
cagaaaccagguccucuuc

SEQ ID NO: 461438 - RNA, 19 nt, Homo sapiens
guuucucucucaggauaaa

SEQ ID NO: 461439 - RNA, 19 nt, Homo sapiens
ggacuguucuaacuaguaa

SEQ ID NO: 461440 - RNA, 19 nt, Homo sapiens
guagauaagugcucaguau

SEQ ID NO: 461441 - RNA, 19 nt, Homo sapiens
caacugcaauuuccaagaa

SEQ ID NO: 461442 - RNA, 19 nt, Homo sapiens
gauaagugcucaguauuga

SEQ ID NO: 461443 - RNA, 19 nt, Homo sapiens
cagcauaguucugcaauaa

SEQ ID NO: 461444 - RNA, 19 nt, Homo sapiens
uaacuuaucuccagccaau

SEQ ID NO: 461445 - RNA, 19 nt, Homo sapiens
gaguaaaucccacgacaua

SEQ ID NO: 461446 - RNA, 19 nt, Homo sapiens
gcagaugacuggaaacaag

SEQ ID NO: 461447 - RNA, 19 nt, Homo sapiens
auaaagaguucuccuugua

SEQ ID NO: 461448 - RNA, 19 nt, Homo sapiens
agacagagaucagaauuga

SEQ ID NO: 461449 - RNA, 19 nt, Homo sapiens
auacagaccuccagauuau

SEQ ID NO: 461450 - RNA, 19 nt, Homo sapiens
gcacuagaaugagaaauca

SEQ ID NO: 461451 - RNA, 19 nt, Homo sapiens
gcugauauauuucauaguc

SEQ ID NO: 461452 - RNA, 19 nt, Homo sapiens
gcagaagaguagauaagug

SEQ ID NO: 461453 - RNA, 19 nt, Homo sapiens
cuaaagcagagauguauua

SEQ ID NO: 461454 - RNA, 19 nt, Homo sapiens
cuaaggagcacuagaauga

SEQ ID NO: 461455 - RNA, 19 nt, Homo sapiens
gaagaaagggagaaggauu

SEQ ID NO: 461456 - RNA, 19 nt, Homo sapiens
gcauaguucugcaauaaca

SEQ ID NO: 461457 - RNA, 19 nt, Homo sapiens
gaaauugugccaaagauag

SEQ ID NO: 461458 - RNA, 19 nt, Homo sapiens
aagcagagauguauuaugg

SEQ ID NO: 461459 - RNA, 19 nt, Homo sapiens
gaaauaaagaguucuccuu

SEQ ID NO: 461460 - RNA, 19 nt, Homo sapiens
gaaggacauuuccgugaga

SEQ ID NO: 461461 - RNA, 19 nt, Homo sapiens
gcgcugucguguauuauuu

SEQ ID NO: 461462 - RNA, 19 nt, Homo sapiens
ggaggacuguucuaacuag

SEQ ID NO: 461463 - RNA, 19 nt, Homo sapiens
uaucagcucugcauaagau

SEQ ID NO: 461464 - RNA, 19 nt, Homo sapiens
agaaggagcuggagcagau

SEQ ID NO: 461465 - RNA, 19 nt, Homo sapiens
gagaaauugugccaaagau

SEQ ID NO: 461466 - RNA, 19 nt, Homo sapiens
ucucauugcuguuauucua

SEQ ID NO: 461467 - RNA, 19 nt, Homo sapiens
guacuucaguucucaucuu

SEQ ID NO: 461468 - RNA, 19 nt, Homo sapiens
guggcaagcuaccaacuaa

SEQ ID NO: 461469 - RNA, 19 nt, Homo sapiens
gcauagccauucauuuaca

SEQ ID NO: 461470 - RNA, 19 nt, Homo sapiens
gaaccgucaaugugaaaua

SEQ ID NO: 461471 - RNA, 19 nt, Homo sapiens
uggcauggauuuccuuuga

SEQ ID NO: 461472 - RNA, 19 nt, Homo sapiens
caucugaagucaacauugu

SEQ ID NO: 461473 - RNA, 19 nt, Homo sapiens
guaauucucccgcugauau

SEQ ID NO: 461474 - RNA, 19 nt, Homo sapiens
gcauaggguuuggaagaaa

SEQ ID NO: 461475 - RNA, 19 nt, Homo sapiens
caauggaggcuuugcagua

SEQ ID NO: 461476 - RNA, 19 nt, Homo sapiens
ccacaauccuugacaacga

SEQ ID NO: 461477 - RNA, 19 nt, Homo sapiens
aaagauagcagaagaguag

SEQ ID NO: 461478 - RNA, 19 nt, Homo sapiens
gaacacagcaaccucucaa

SEQ ID NO: 461479 - RNA, 19 nt, Homo sapiens
ggaagaucauagaaguuga

SEQ ID NO: 461480 - RNA, 19 nt, Homo sapiens
aaacagaccagcauaguuc

SEQ ID NO: 461481 - RNA, 19 nt, Homo sapiens
gaaacaaggaaggacauuu

SEQ ID NO: 461482 - RNA, 19 nt, Homo sapiens
acaagaggaucacucgauu

SEQ ID NO: 461483 - RNA, 19 nt, Homo sapiens
guugaagacugggaaauau

SEQ ID NO: 461484 - RNA, 19 nt, Homo sapiens
cagaucaucauguguuaua

SEQ ID NO: 461485 - RNA, 19 nt, Homo sapiens
ccagaaagugggugaaauu

SEQ ID NO: 461486 - RNA, 19 nt, Homo sapiens
aaugagaaauugugccaaa

SEQ ID NO: 461487 - RNA, 19 nt, Homo sapiens
gaaaagagaaacacuaaug

SEQ ID NO: 461488 - RNA, 19 nt, Homo sapiens
gaucucaucaggaauaugu

SEQ ID NO: 461489 - RNA, 19 nt, Homo sapiens
gaugucacccugaucauug

SEQ ID NO: 461490 - RNA, 19 nt, Homo sapiens
caugaucucuuccaguuca

SEQ ID NO: 461491 - RNA, 19 nt, Homo sapiens
gauagcagaagaguagaua

SEQ ID NO: 461492 - RNA, 19 nt, Homo sapiens
aaauaacaguggcaagcua

SEQ ID NO: 461493 - RNA, 19 nt, Homo sapiens
gggcauaggguuuggaaga

SEQ ID NO: 461494 - RNA, 19 nt, Homo sapiens
uauacagaccuccagauua

SEQ ID NO: 461495 - RNA, 19 nt, Homo sapiens
gaagaucauagaaguugaa

SEQ ID NO: 461496 - RNA, 19 nt, Homo sapiens
cuucaguucucaucuugua

SEQ ID NO: 461497 - RNA, 19 nt, Homo sapiens
gagaaaucauguuguucga

SEQ ID NO: 461498 - RNA, 19 nt, Homo sapiens
gggcagaucaucaccauca

SEQ ID NO: 461499 - RNA, 19 nt, Homo sapiens
gggaagaucauagaaguug

SEQ ID NO: 461500 - RNA, 19 nt, Homo sapiens
ggacaaauucugguggauu

SEQ ID NO: 461501 - RNA, 19 nt, Homo sapiens
aaacuaagcgugaagaagu

SEQ ID NO: 461502 - RNA, 19 nt, Homo sapiens
uaucagggcccaaauaaca

SEQ ID NO: 461503 - RNA, 19 nt, Homo sapiens
ccaaguucauucauacuca

SEQ ID NO: 461504 - RNA, 19 nt, Homo sapiens
ccaaguguacauuugauuu

SEQ ID NO: 461505 - RNA, 19 nt, Homo sapiens
gaagucuuaugucaaugga

SEQ ID NO: 461506 - RNA, 19 nt, Homo sapiens
gaccuggacuugggcauug

SEQ ID NO: 461507 - RNA, 19 nt, Homo sapiens
gaucauagaaguugaagac

SEQ ID NO: 461508 - RNA, 19 nt, Homo sapiens
uguuagaucucaucaggaa

SEQ ID NO: 461509 - RNA, 19 nt, Homo sapiens
acaaagcugucacucacaa

SEQ ID NO: 461510 - RNA, 19 nt, Homo sapiens
ccugacagcucucaugauc

SEQ ID NO: 461511 - RNA, 19 nt, Homo sapiens
uaagaugggcauaggguuu

SEQ ID NO: 461512 - RNA, 19 nt, Homo sapiens
uuacucaggcuuucuauug

SEQ ID NO: 461513 - RNA, 19 nt, Homo sapiens
ggaugggacugcgcucuau

SEQ ID NO: 461514 - RNA, 19 nt, Homo sapiens
gugcaacaaucaacaugga

SEQ ID NO: 461515 - RNA, 19 nt, Homo sapiens
ugacagcucucaugaucuc

SEQ ID NO: 461516 - RNA, 19 nt, Homo sapiens
gagaugaacaugacagaag

SEQ ID NO: 461517 - RNA, 19 nt, Homo sapiens
uuagaucucaucaggaaua

SEQ ID NO: 461518 - RNA, 19 nt, Homo sapiens
aaucuuggcccuauucauu

SEQ ID NO: 461519 - RNA, 19 nt, Homo sapiens
caacuggaaggcuuuauuc

SEQ ID NO: 461520 - RNA, 19 nt, Homo sapiens
ccagcauaguucugcaaua

SEQ ID NO: 461521 - RNA, 19 nt, Homo sapiens
gaucacucgauucguguua

SEQ ID NO: 461522 - RNA, 19 nt, Homo sapiens
guauucagauggcauaaac

SEQ ID NO: 461523 - RNA, 19 nt, Homo sapiens
ggcauaggguuuggaagaa

SEQ ID NO: 461524 - RNA, 19 nt, Homo sapiens
aaacaaggaaggacauuuc

SEQ ID NO: 461525 - RNA, 19 nt, Homo sapiens
ggacgggcauuguggaaaa

SEQ ID NO: 461526 - RNA, 19 nt, Homo sapiens
gcucaguauugacgaccua

SEQ ID NO: 461527 - RNA, 19 nt, Homo sapiens
cuaguaaucuuggcccuau

SEQ ID NO: 461528 - RNA, 19 nt, Homo sapiens
caggaggacuguucuaacu

SEQ ID NO: 461529 - RNA, 19 nt, Homo sapiens
guucauucauacucaaaga

SEQ ID NO: 461530 - RNA, 19 nt, Homo sapiens
cauaucagcucugcauaag

SEQ ID NO: 461531 - RNA, 19 nt, Homo sapiens
ccauaucagcucugcauaa

SEQ ID NO: 461532 - RNA, 19 nt, Homo sapiens
gaagaauaacuggguguug

SEQ ID NO: 461533 - RNA, 19 nt, Homo sapiens
ugacugggcuugcaaucca

SEQ ID NO: 461534 - RNA, 19 nt, Homo sapiens
guaaaucccacgacauaag

SEQ ID NO: 461535 - RNA, 19 nt, Homo sapiens
cauccuugcacuucuguua

SEQ ID NO: 461536 - RNA, 19 nt, Homo sapiens
caaguucauucauacucaa

SEQ ID NO: 461537 - RNA, 19 nt, Homo sapiens
cagaucaucaccaucagua

SEQ ID NO: 461538 - RNA, 19 nt, Homo sapiens
gaauauguucccugagaau

SEQ ID NO: 461539 - RNA, 19 nt, Homo sapiens
gaaagcaacucuaaucaau

SEQ ID NO: 461540 - RNA, 19 nt, Homo sapiens
cgagagccaugguguauua

SEQ ID NO: 461541 - RNA, 19 nt, Homo sapiens
acacaacucugucauagua

SEQ ID NO: 461542 - RNA, 19 nt, Homo sapiens
cgaaaucucuucccugaaa

SEQ ID NO: 461543 - RNA, 19 nt, Homo sapiens
gaagaagaaugaugaagug

SEQ ID NO: 461544 - RNA, 19 nt, Homo sapiens
gaugagaacuucagucaau

SEQ ID NO: 461545 - RNA, 19 nt, Homo sapiens
gcaugaagauauugaaaug

SEQ ID NO: 461546 - RNA, 19 nt, Homo sapiens
gaacuucagucaauguugu

SEQ ID NO: 461547 - RNA, 19 nt, Homo sapiens
guagaugaaugcaagguaa

SEQ ID NO: 461548 - RNA, 19 nt, Homo sapiens
gcacacaacucugucauag

SEQ ID NO: 461549 - RNA, 19 nt, Homo sapiens
gaccaagacucaauccauu

SEQ ID NO: 461550 - RNA, 19 nt, Homo sapiens
gaaagaucauugcaaucaa

SEQ ID NO: 461551 - RNA, 19 nt, Homo sapiens
ggaaagaucauugcaauca

SEQ ID NO: 461552 - RNA, 19 nt, Homo sapiens
cuaaucaucuccagcuuaa

SEQ ID NO: 461553 - RNA, 19 nt, Homo sapiens
gaaauaaggauaugagucu

SEQ ID NO: 461554 - RNA, 19 nt, Homo sapiens
gaaaugaccaagacucaau

SEQ ID NO: 461555 - RNA, 19 nt, Homo sapiens
guaaugaaguuagugauca

SEQ ID NO: 461556 - RNA, 19 nt, Homo sapiens
agacuaagaugguuaucaa

SEQ ID NO: 461557 - RNA, 19 nt, Homo sapiens
guggauuucuucaacauuu

SEQ ID NO: 461558 - RNA, 19 nt, Homo sapiens
gaucauaggccucaucauc

SEQ ID NO: 461559 - RNA, 19 nt, Homo sapiens
gaacgucuuaggucugaua

SEQ ID NO: 461560 - RNA, 19 nt, Homo sapiens
ggaagaaccuuggaaacgu

SEQ ID NO: 461561 - RNA, 19 nt, Homo sapiens
gaacuuugccugucaccuu

SEQ ID NO: 461562 - RNA, 19 nt, Homo sapiens
gaccaucauugcugcagua

SEQ ID NO: 461563 - RNA, 19 nt, Homo sapiens
ggaaagcaacucuaaucaa

SEQ ID NO: 461564 - RNA, 19 nt, Homo sapiens
ccaagacucaauccauuua

SEQ ID NO: 461565 - RNA, 19 nt, Homo sapiens
cuaagaugguuaucaagaa

SEQ ID NO: 461566 - RNA, 19 nt, Homo sapiens
caacagauucaaacaguga

SEQ ID NO: 461567 - RNA, 19 nt, Homo sapiens
ggaagaagaaugaugaagu

SEQ ID NO: 461568 - RNA, 19 nt, Homo sapiens
guggaaagaucauugcaau

SEQ ID NO: 461569 - RNA, 19 nt, Homo sapiens
ggauguacaugguaacagu

SEQ ID NO: 461570 - RNA, 19 nt, Homo sapiens
ccaagcugaugguggauuu

SEQ ID NO: 461571 - RNA, 19 nt, Homo sapiens
caucauugcugcaguacug

SEQ ID NO: 461572 - RNA, 19 nt, Homo sapiens
ugucaggccuggaugcuaa

SEQ ID NO: 461573 - RNA, 19 nt, Homo sapiens
cgacugcaguguugaggaa

SEQ ID NO: 461574 - RNA, 19 nt, Homo sapiens
aagcaacucuaaucaaugu

SEQ ID NO: 461575 - RNA, 19 nt, Homo sapiens
ccaaaugaaugguguuguc

SEQ ID NO: 461576 - RNA, 19 nt, Homo sapiens
gaaugagauuguaaugaag

SEQ ID NO: 461577 - RNA, 19 nt, Homo sapiens
ggaggagacuaagaugguu

SEQ ID NO: 461578 - RNA, 19 nt, Homo sapiens
gcacgagagccauggugua

SEQ ID NO: 461579 - RNA, 19 nt, Homo sapiens
ggaaggugccaacaauaug

SEQ ID NO: 461580 - RNA, 19 nt, Homo sapiens
ccaacaauaugcccaagca

SEQ ID NO: 461581 - RNA, 19 nt, Homo sapiens
gaugguggauuucuucaac

SEQ ID NO: 461582 - RNA, 19 nt, Homo sapiens
ugaacgagacugugacuga

SEQ ID NO: 461583 - RNA, 19 nt, Homo sapiens
uaagaugguuaucaagaag

SEQ ID NO: 461584 - RNA, 19 nt, Homo sapiens
uuggaaacgugagaaauaa

SEQ ID NO: 461585 - RNA, 19 nt, Homo sapiens
gaggagacuaagaugguua

SEQ ID NO: 461586 - RNA, 19 nt, Homo sapiens
gggauauacucaugaggau

SEQ ID NO: 461587 - RNA, 19 nt, Homo sapiens
agaagggccuggaguucaa

SEQ ID NO: 461588 - RNA, 19 nt, Homo sapiens
gauauugaaaugaccaaga

SEQ ID NO: 461589 - RNA, 19 nt, Homo sapiens
cuuggaaacgugagaaaua

SEQ ID NO: 461590 - RNA, 19 nt, Homo sapiens
cucaauccauuuaugauga

SEQ ID NO: 461591 - RNA, 19 nt, Homo sapiens
ucgagugcaugaagauauu

SEQ ID NO: 461592 - RNA, 19 nt, Homo sapiens
gcuggaacuuugccuguca

SEQ ID NO: 461593 - RNA, 19 nt, Homo sapiens
gggaaagcaacucuaauca

SEQ ID NO: 461594 - RNA, 19 nt, Homo sapiens
gauggaggacagauuguga

SEQ ID NO: 461595 - RNA, 19 nt, Homo sapiens
gauaagcgugugacuagau

SEQ ID NO: 461596 - RNA, 19 nt, Homo sapiens
gaagugcgaaugccagaca

SEQ ID NO: 461597 - RNA, 19 nt, Homo sapiens
aaagaucauugcaaucaag

SEQ ID NO: 461598 - RNA, 19 nt, Homo sapiens
gaagaaaguccugguugca

SEQ ID NO: 461599 - RNA, 19 nt, Homo sapiens
caugguaacagugaucaua

SEQ ID NO: 461600 - RNA, 19 nt, Homo sapiens
gcaaucccaagcucaagaa

SEQ ID NO: 461601 - RNA, 19 nt, Homo sapiens
gaaugguguuguccuggau

SEQ ID NO: 461602 - RNA, 19 nt, Homo sapiens
aaacagugacgaagaaagu

SEQ ID NO: 461603 - RNA, 19 nt, Homo sapiens
agacucaauccauuuauga

SEQ ID NO: 461604 - RNA, 19 nt, Homo sapiens
agucugagcuggauaccau

SEQ ID NO: 461605 - RNA, 19 nt, Homo sapiens
ucaagaagggccuggaguu

SEQ ID NO: 461606 - RNA, 19 nt, Homo sapiens
ggucuuggcuauccaucca

SEQ ID NO: 461607 - RNA, 19 nt, Homo sapiens
gaaacgugagaaauaagga

SEQ ID NO: 461608 - RNA, 19 nt, Homo sapiens
ugaggaagaaccuuggaaa

SEQ ID NO: 461609 - RNA, 19 nt, Homo sapiens
cggaaggugccaacaauau

SEQ ID NO: 461610 - RNA, 19 nt, Homo sapiens
gcaacucuaaucaaugugu

SEQ ID NO: 461611 - RNA, 19 nt, Homo sapiens
uacggaaggugccaacaau

SEQ ID NO: 461612 - RNA, 19 nt, Homo sapiens
gguaucgccugccugaucu

SEQ ID NO: 461613 - RNA, 19 nt, Homo sapiens
acagggaaagcaacucuaa

SEQ ID NO: 461614 - RNA, 19 nt, Homo sapiens
ucuaucaccucuccaaguc

SEQ ID NO: 461615 - RNA, 19 nt, Homo sapiens
ucuaaucaucuccagcuua

SEQ ID NO: 461616 - RNA, 19 nt, Homo sapiens
gagaacuucagucaauguu

SEQ ID NO: 461617 - RNA, 19 nt, Homo sapiens
gaugguacagcccuuuaug

SEQ ID NO: 461618 - RNA, 19 nt, Homo sapiens
ugccugaucuguggaaaga

SEQ ID NO: 461619 - RNA, 19 nt, Homo sapiens
ugaaguuagugaucaugau

SEQ ID NO: 461620 - RNA, 19 nt, Homo sapiens
ggccugggaagaagaauga

SEQ ID NO: 461621 - RNA, 19 nt, Homo sapiens
ggaaacgugagaaauaagg

SEQ ID NO: 461622 - RNA, 19 nt, Homo sapiens
ucaccaugcuccucauucu

SEQ ID NO: 461623 - RNA, 19 nt, Homo sapiens
auaagcgugugacuagauu

SEQ ID NO: 461624 - RNA, 19 nt, Homo sapiens
gaaggugccaacaauaugc

SEQ ID NO: 461625 - RNA, 19 nt, Homo sapiens
caagaagggccuggaguuc

SEQ ID NO: 461626 - RNA, 19 nt, Homo sapiens
ucagccgacugcaguguug

SEQ ID NO: 461627 - RNA, 19 nt, Homo sapiens
acaacucugucauaguaga

SEQ ID NO: 461628 - RNA, 19 nt, Homo sapiens
cuuuauagcccaaaugaau

SEQ ID NO: 461629 - RNA, 19 nt, Homo sapiens
acagucaucuuggcucaga

SEQ ID NO: 461630 - RNA, 19 nt, Homo sapiens
gagauuguaaugaaguuag

SEQ ID NO: 461631 - RNA, 19 nt, Homo sapiens
aagacucaauccauuuaug

SEQ ID NO: 461632 - RNA, 19 nt, Homo sapiens
ggaugggaugaacgucuua

SEQ ID NO: 461633 - RNA, 19 nt, Homo sapiens
uucaaacagugacgaagaa

SEQ ID NO: 461634 - RNA, 19 nt, Homo sapiens
gaaaucucuucccugaaaa

SEQ ID NO: 461635 - RNA, 19 nt, Homo sapiens
ucauugcaaucaaggacuu

SEQ ID NO: 461636 - RNA, 19 nt, Homo sapiens
gagacuaagaugguuauca

SEQ ID NO: 461637 - RNA, 19 nt, Homo sapiens
gagaaauaaggauaugagu

SEQ ID NO: 461638 - RNA, 19 nt, Homo sapiens
cgugagaaauaaggauaug

SEQ ID NO: 461639 - RNA, 19 nt, Homo sapiens
guacguggcuguccucuua

SEQ ID NO: 461640 - RNA, 19 nt, Homo sapiens
gaacugaacuucggacaaa

SEQ ID NO: 461641 - RNA, 19 nt, Homo sapiens
gagcaaagacuuaaucaua

SEQ ID NO: 461642 - RNA, 19 nt, Homo sapiens
agacauagauccucugaua

SEQ ID NO: 461643 - RNA, 19 nt, Homo sapiens
gguagaagaugaaucagua

SEQ ID NO: 461644 - RNA, 19 nt, Homo sapiens
ugaaugagcucucuaauag

SEQ ID NO: 461645 - RNA, 19 nt, Homo sapiens
gaagagacccuccuagaaa

SEQ ID NO: 461646 - RNA, 19 nt, Homo sapiens
gaacauuucuaacuaagga

SEQ ID NO: 461647 - RNA, 19 nt, Homo sapiens
aaaccaagauguagacuaa

SEQ ID NO: 461648 - RNA, 19 nt, Homo sapiens
ggaaauacacuacaaaugu

SEQ ID NO: 461649 - RNA, 19 nt, Homo sapiens
gaaagcaccugcccucugu

SEQ ID NO: 461650 - RNA, 19 nt, Homo sapiens
gcacacaauuccuauaaau

SEQ ID NO: 461651 - RNA, 19 nt, Homo sapiens
gaguacaggucuucuuuaa

SEQ ID NO: 461652 - RNA, 19 nt, Homo sapiens
guaccaagaucacaaauag

SEQ ID NO: 461653 - RNA, 19 nt, Homo sapiens
caaggcagcucccagguuu

SEQ ID NO: 461654 - RNA, 19 nt, Homo sapiens
uaagagaaaugguagaaga

SEQ ID NO: 461655 - RNA, 19 nt, Homo sapiens
gaagagaagcuuuaaagug

SEQ ID NO: 461656 - RNA, 19 nt, Homo sapiens
uaaggaauauccagucaaa

SEQ ID NO: 461657 - RNA, 19 nt, Homo sapiens
gaagaugaaucaguaugaa

SEQ ID NO: 461658 - RNA, 19 nt, Homo sapiens
ggagugggauuauucauca

SEQ ID NO: 461659 - RNA, 19 nt, Homo sapiens
gaacuucggacaaauuauu

SEQ ID NO: 461660 - RNA, 19 nt, Homo sapiens
gguauucucuuccugauug

SEQ ID NO: 461661 - RNA, 19 nt, Homo sapiens
guacaggucuucuuuaagg

SEQ ID NO: 461662 - RNA, 19 nt, Homo sapiens
gagugaacauuucuaacua

SEQ ID NO: 461663 - RNA, 19 nt, Homo sapiens
gcaaagacuuaaucauauc

SEQ ID NO: 461664 - RNA, 19 nt, Homo sapiens
gaguggguauuucuuauuu

SEQ ID NO: 461665 - RNA, 19 nt, Homo sapiens
gaagaaaccauaucaacug

SEQ ID NO: 461666 - RNA, 19 nt, Homo sapiens
gagaaaugguagaagauga

SEQ ID NO: 461667 - RNA, 19 nt, Homo sapiens
gaaagaagucaaaugaaug

SEQ ID NO: 461668 - RNA, 19 nt, Homo sapiens
gcuguagucuauuauauga

SEQ ID NO: 461669 - RNA, 19 nt, Homo sapiens
gagcuguagucuauuauau

SEQ ID NO: 461670 - RNA, 19 nt, Homo sapiens
uaauagaaguccaugaguu

SEQ ID NO: 461671 - RNA, 19 nt, Homo sapiens
ucaguguccucaucuauaa

SEQ ID NO: 461672 - RNA, 19 nt, Homo sapiens
ugagagaguucuuugauuc

SEQ ID NO: 461673 - RNA, 19 nt, Homo sapiens
guuaacaacuuugaacuga

SEQ ID NO: 461674 - RNA, 19 nt, Homo sapiens
gcauuacuuuguagaugua

SEQ ID NO: 461675 - RNA, 19 nt, Homo sapiens
caaauaguguugaucagau

SEQ ID NO: 461676 - RNA, 19 nt, Homo sapiens
guuaucaguuggacaguaa

SEQ ID NO: 461677 - RNA, 19 nt, Homo sapiens
uaacgaagccaucaugaga

SEQ ID NO: 461678 - RNA, 19 nt, Homo sapiens
gagaagagaagcuuuaaag

SEQ ID NO: 461679 - RNA, 19 nt, Homo sapiens
gcacaggcaacauuacaaa

SEQ ID NO: 461680 - RNA, 19 nt, Homo sapiens
cgaauaagguaccaagauc

SEQ ID NO: 461681 - RNA, 19 nt, Homo sapiens
ggaugggacugcccucuau

SEQ ID NO: 461682 - RNA, 19 nt, Homo sapiens
ucaagugccuggaagagaa

SEQ ID NO: 461683 - RNA, 19 nt, Homo sapiens
acauagauccucugauaua

SEQ ID NO: 461684 - RNA, 19 nt, Homo sapiens
gaagaaagugcagaacauu

SEQ ID NO: 461685 - RNA, 19 nt, Homo sapiens
gcucccagguuuagagauu

SEQ ID NO: 461686 - RNA, 19 nt, Homo sapiens
gacaugaacugaagaacag

SEQ ID NO: 461687 - RNA, 19 nt, Homo sapiens
gcuugugggugcugugaua

SEQ ID NO: 461688 - RNA, 19 nt, Homo sapiens
guaacucagugauugaaga

SEQ ID NO: 461689 - RNA, 19 nt, Homo sapiens
uggccaaaguguacaauuu

SEQ ID NO: 461690 - RNA, 19 nt, Homo sapiens
ggacuuaauuaugcuaaca

SEQ ID NO: 461691 - RNA, 19 nt, Homo sapiens
ggcaguagcagcuguguuu

SEQ ID NO: 461692 - RNA, 19 nt, Homo sapiens
gcacagagaaggcaaaauu

SEQ ID NO: 461693 - RNA, 19 nt, Homo sapiens
ggugaagaauggacuuaau

SEQ ID NO: 461694 - RNA, 19 nt, Homo sapiens
gaacugaagaacagagaug

SEQ ID NO: 461695 - RNA, 19 nt, Homo sapiens
agaauggacuuaauuaugc

SEQ ID NO: 461696 - RNA, 19 nt, Homo sapiens
gaagagaaugaaaugaaga

SEQ ID NO: 461697 - RNA, 19 nt, Homo sapiens
ggaagauuguggagaugga

SEQ ID NO: 461698 - RNA, 19 nt, Homo sapiens
uuacaaaggaggauguuaa

SEQ ID NO: 461699 - RNA, 19 nt, Homo sapiens
cuaaagagcuaggaaagag

SEQ ID NO: 461700 - RNA, 19 nt, Homo sapiens
gaaaugaagaaaccauauc

SEQ ID NO: 461701 - RNA, 19 nt, Homo sapiens
gaaauggguaacucaguga

SEQ ID NO: 461702 - RNA, 19 nt, Homo sapiens
ggacugggaagcauuacuu

SEQ ID NO: 461703 - RNA, 19 nt, Homo sapiens
guggguauuucuuauuuga

SEQ ID NO: 461704 - RNA, 19 nt, Homo sapiens
gaaaccaagauguagacua

SEQ ID NO: 461705 - RNA, 19 nt, Homo sapiens
ggacaaugaaacugagaaa

SEQ ID NO: 461706 - RNA, 19 nt, Homo sapiens
gggaagggcacaaaggaaa

SEQ ID NO: 461707 - RNA, 19 nt, Homo sapiens
aaugcgagcuguagucuau

SEQ ID NO: 461708 - RNA, 19 nt, Homo sapiens
gaacuucugaugaggaugu

SEQ ID NO: 461709 - RNA, 19 nt, Homo sapiens
gauuuacccuccgaccaua

SEQ ID NO: 461710 - RNA, 19 nt, Homo sapiens
uagcagcuguguuugaguu

SEQ ID NO: 461711 - RNA, 19 nt, Homo sapiens
guggaacacuaaagagcua

SEQ ID NO: 461712 - RNA, 19 nt, Homo sapiens
ggaaaauaguccuccaaaa

SEQ ID NO: 461713 - RNA, 19 nt, Homo sapiens
caaagaagagacccuccua

SEQ ID NO: 461714 - RNA, 19 nt, Homo sapiens
uagauccucugauauacaa

SEQ ID NO: 461715 - RNA, 19 nt, Homo sapiens
ggagugaacauuucuaacu

SEQ ID NO: 461716 - RNA, 19 nt, Homo sapiens
agaaacccaucgacaguga

SEQ ID NO: 461717 - RNA, 19 nt, Homo sapiens
ucacaaauaguguugauca

SEQ ID NO: 461718 - RNA, 19 nt, Homo sapiens
aagaaaccauaucaacuga

SEQ ID NO: 461719 - RNA, 19 nt, Homo sapiens
ugaagagaaugaaaugaag

SEQ ID NO: 461720 - RNA, 19 nt, Homo sapiens
uaacaacuuugaacugaac

SEQ ID NO: 461721 - RNA, 19 nt, Homo sapiens
cuaguugucuucuccaugu

SEQ ID NO: 461722 - RNA, 19 nt, Homo sapiens
cuuaucaucuccagucuug

SEQ ID NO: 461723 - RNA, 19 nt, Homo sapiens
agaagaaagugcagaacau

SEQ ID NO: 461724 - RNA, 19 nt, Homo sapiens
ugggaagcauuacuuugua

SEQ ID NO: 461725 - RNA, 19 nt, Homo sapiens
ccucugauauacaauuaga

SEQ ID NO: 461726 - RNA, 19 nt, Homo sapiens
uaugagaagagaagcuuua

SEQ ID NO: 461727 - RNA, 19 nt, Homo sapiens
cauaaucauugucaucauc

SEQ ID NO: 461728 - RNA, 19 nt, Homo sapiens
uaaugucgaggcucuauuu

SEQ ID NO: 461729 - RNA, 19 nt, Homo sapiens
aguauucccuucuuuccua

SEQ ID NO: 461730 - RNA, 19 nt, Homo sapiens
gcacgaggccuucagaaaa

SEQ ID NO: 461731 - RNA, 19 nt, Homo sapiens
gaauaagguaccaagauca

SEQ ID NO: 461732 - RNA, 19 nt, Homo sapiens
ccaagcauucugugcauaa

SEQ ID NO: 461733 - RNA, 19 nt, Homo sapiens
gugaagaauggacuuaauu

SEQ ID NO: 461734 - RNA, 19 nt, Homo sapiens
ggcacacaauuccuauaaa

SEQ ID NO: 461735 - RNA, 19 nt, Homo sapiens
gaucuuacaaguuuaugug

SEQ ID NO: 461736 - RNA, 19 nt, Homo sapiens
gacugucauuguuggcuua

SEQ ID NO: 461737 - RNA, 19 nt, Homo sapiens
gaagacaugggugugauug

SEQ ID NO: 461738 - RNA, 19 nt, Homo sapiens
uagcaguaauaauguggua

SEQ ID NO: 461739 - RNA, 19 nt, Homo sapiens
gauaagcgcucgugguuca

SEQ ID NO: 461740 - RNA, 19 nt, Homo sapiens
ucagugaccucucccgaua

SEQ ID NO: 461741 - RNA, 19 nt, Homo sapiens
caaggacaguggcuucuuu

SEQ ID NO: 461742 - RNA, 19 nt, Homo sapiens
gaagaucccugaagaugcu

SEQ ID NO: 461743 - RNA, 19 nt, Homo sapiens
gcaggaagaagaagaagaa

SEQ ID NO: 461744 - RNA, 19 nt, Homo sapiens
gaaagaggaagaaggagaa

SEQ ID NO: 461745 - RNA, 19 nt, Homo sapiens
ggagaaagaggaagaagga

SEQ ID NO: 461746 - RNA, 19 nt, Homo sapiens
gcacagccaucccaacgau

SEQ ID NO: 461747 - RNA, 19 nt, Homo sapiens
ggaagaugcugaaccaaac

SEQ ID NO: 461748 - RNA, 19 nt, Homo sapiens
ccaucgagcuccagcauga

SEQ ID NO: 461749 - RNA, 19 nt, Homo sapiens
gcucgggaccuucuucaua

SEQ ID NO: 461750 - RNA, 19 nt, Homo sapiens
cugacaagcuguuucauga

SEQ ID NO: 461751 - RNA, 19 nt, Homo sapiens
gagaagaucccugaagaug

SEQ ID NO: 461752 - RNA, 19 nt, Homo sapiens
ggaggaggacgaugacuug

SEQ ID NO: 461753 - RNA, 19 nt, Homo sapiens
ucacgucccugucugguau

SEQ ID NO: 461754 - RNA, 19 nt, Homo sapiens
ugaugguccugguggauua

SEQ ID NO: 461755 - RNA, 19 nt, Homo sapiens
gcuuugagcucauuauaac

SEQ ID NO: 461756 - RNA, 19 nt, Homo sapiens
uuucucaucucacucauuu

SEQ ID NO: 461757 - RNA, 19 nt, Homo sapiens
ggaggaagaggaaggagaa

SEQ ID NO: 461758 - RNA, 19 nt, Homo sapiens
cuacguacccugcuacuga

SEQ ID NO: 461759 - RNA, 19 nt, Homo sapiens
uggagaagaucccugaaga

SEQ ID NO: 461760 - RNA, 19 nt, Homo sapiens
ggaagaggaggaagaggaa

SEQ ID NO: 461761 - RNA, 19 nt, Homo sapiens
gccugaagcugcuggagaa

SEQ ID NO: 461762 - RNA, 19 nt, Homo sapiens
gagcgggacuuugaguuuc

SEQ ID NO: 461763 - RNA, 19 nt, Homo sapiens
cccaagaccuuagggauug

SEQ ID NO: 461764 - RNA, 19 nt, Homo sapiens
gaaggcaaaguucuccauu

SEQ ID NO: 461765 - RNA, 19 nt, Homo sapiens
gaucuuugccuuucucauc

SEQ ID NO: 461766 - RNA, 19 nt, Homo sapiens
caggagaucuuugccuuuc

SEQ ID NO: 461767 - RNA, 19 nt, Homo sapiens
ccgcugugcucuucaucua

SEQ ID NO: 461768 - RNA, 19 nt, Homo sapiens
ggaagaggaaggagaaucu

SEQ ID NO: 461769 - RNA, 19 nt, Homo sapiens
acacagaucacggcgcuua

SEQ ID NO: 461770 - RNA, 19 nt, Homo sapiens
gaccucgccucaccuuuca

SEQ ID NO: 461771 - RNA, 19 nt, Homo sapiens
cccauuggcugugcucuuu

SEQ ID NO: 461772 - RNA, 19 nt, Homo sapiens
ucuacaagguguucacaga

SEQ ID NO: 461773 - RNA, 19 nt, Homo sapiens
ucuacaagcucuacaaggu

SEQ ID NO: 461774 - RNA, 19 nt, Homo sapiens
gcacaggcuuugagcucau

SEQ ID NO: 461775 - RNA, 19 nt, Homo sapiens
agcgagagcugcuuaggaa

SEQ ID NO: 461776 - RNA, 19 nt, Homo sapiens
ugaagcugcuggagaagau

SEQ ID NO: 461777 - RNA, 19 nt, Homo sapiens
ggccgcugcuuguguuuga

SEQ ID NO: 461778 - RNA, 19 nt, Homo sapiens
gcgcuggacucggaagaug

SEQ ID NO: 461779 - RNA, 19 nt, Homo sapiens
ccgaggaaccagcccaaua

SEQ ID NO: 461780 - RNA, 19 nt, Homo sapiens
gccaggaugaguacaauga

SEQ ID NO: 461781 - RNA, 19 nt, Homo sapiens
ggagaagaucccugaagau

SEQ ID NO: 461782 - RNA, 19 nt, Homo sapiens
cgagcgggacuuugaguuu

SEQ ID NO: 461783 - RNA, 19 nt, Homo sapiens
cggaagaugcugaaccaaa

SEQ ID NO: 461784 - RNA, 19 nt, Homo sapiens
guuccuggauggcagcauu

SEQ ID NO: 461785 - RNA, 19 nt, Homo sapiens
gagcugcacaugccagugu

SEQ ID NO: 461786 - RNA, 19 nt, Homo sapiens
gcucaagggcuccgguuuc

SEQ ID NO: 461787 - RNA, 19 nt, Homo sapiens
ccgauaagcgcucgugguu

SEQ ID NO: 461788 - RNA, 19 nt, Homo sapiens
uaagugccaucagcgaguu

SEQ ID NO: 461789 - RNA, 19 nt, Homo sapiens
gcccaucggccaguuauga

SEQ ID NO: 461790 - RNA, 19 nt, Homo sapiens
aaggcaaaguucuccauug

SEQ ID NO: 461791 - RNA, 19 nt, Homo sapiens
ggacucggaagaugcugaa

SEQ ID NO: 461792 - RNA, 19 nt, Homo sapiens
cugcuggucuggagccaaa

SEQ ID NO: 461793 - RNA, 19 nt, Homo sapiens
cugcagaccuggacgacau

SEQ ID NO: 461794 - RNA, 19 nt, Homo sapiens
aggcaaaguucuccauugg

SEQ ID NO: 461795 - RNA, 19 nt, Homo sapiens
ggcuuugagcucauuauaa

SEQ ID NO: 461796 - RNA, 19 nt, Homo sapiens
cggcaagaccuccuaagug

SEQ ID NO: 461797 - RNA, 19 nt, Homo sapiens
guggagaccaugauugugu

SEQ ID NO: 461798 - RNA, 19 nt, Homo sapiens
cgaugaggauggccaggau

SEQ ID NO: 461799 - RNA, 19 nt, Homo sapiens
cgaggaaccagcccaauac

SEQ ID NO: 461800 - RNA, 19 nt, Homo sapiens
cggacgggcucgguauuug

SEQ ID NO: 461801 - RNA, 19 nt, Homo sapiens
ccaagaccuuagggauuga

SEQ ID NO: 461802 - RNA, 19 nt, Homo sapiens
cggcacaccaggagaaaga

SEQ ID NO: 461803 - RNA, 19 nt, Homo sapiens
gcugugcucuucaucuacu

SEQ ID NO: 461804 - RNA, 19 nt, Homo sapiens
uggacgacaugaagaguca

SEQ ID NO: 461805 - RNA, 19 nt, Homo sapiens
ggagcccaucggccaguua

SEQ ID NO: 461806 - RNA, 19 nt, Homo sapiens
ucuuugggaucuuccugua

SEQ ID NO: 461807 - RNA, 19 nt, Homo sapiens
gcggacgggcucgguauuu

SEQ ID NO: 461808 - RNA, 19 nt, Homo sapiens
uugccacccuuaugucuga

SEQ ID NO: 461809 - RNA, 19 nt, Homo sapiens
acagcgagcgggacuuuga

SEQ ID NO: 461810 - RNA, 19 nt, Homo sapiens
ggagggcugcugucaccaa

SEQ ID NO: 461811 - RNA, 19 nt, Homo sapiens
caucgcgccuggugacaag

SEQ ID NO: 461812 - RNA, 19 nt, Homo sapiens
cuacagcgagcgggacuuu

SEQ ID NO: 461813 - RNA, 19 nt, Homo sapiens
cauuggaagugacgaggau

SEQ ID NO: 461814 - RNA, 19 nt, Homo sapiens
ugaccucgccucaccuuuc

SEQ ID NO: 461815 - RNA, 19 nt, Homo sapiens
gcugugcucuuugggaucu

SEQ ID NO: 461816 - RNA, 19 nt, Homo sapiens
cuacgagaccuucuacaag

SEQ ID NO: 461817 - RNA, 19 nt, Homo sapiens
ccaggagaucuuugccuuu

SEQ ID NO: 461818 - RNA, 19 nt, Homo sapiens
ugccuaccauggcugauga

SEQ ID NO: 461819 - RNA, 19 nt, Homo sapiens
uacguacccugcuacugaa

SEQ ID NO: 461820 - RNA, 19 nt, Homo sapiens
cguccuacguacccugcua

SEQ ID NO: 461821 - RNA, 19 nt, Homo sapiens
cagcaggugcccacagaug

SEQ ID NO: 461822 - RNA, 19 nt, Homo sapiens
ggaggaagaggaggaagag

SEQ ID NO: 461823 - RNA, 19 nt, Homo sapiens
ccacaccagcacugacuau

SEQ ID NO: 461824 - RNA, 19 nt, Homo sapiens
gagcccaucggccaguuau

SEQ ID NO: 461825 - RNA, 19 nt, Homo sapiens
ccagaccggcacaggcuuu

SEQ ID NO: 461826 - RNA, 19 nt, Homo sapiens
guacaaugagcugcacaug

SEQ ID NO: 461827 - RNA, 19 nt, Homo sapiens
cucgggaccuucuucauag

SEQ ID NO: 461828 - RNA, 19 nt, Homo sapiens
ucuacgagaccuucuacaa

SEQ ID NO: 461829 - RNA, 19 nt, Homo sapiens
cgcuacaucucgccuuuca

SEQ ID NO: 461830 - RNA, 19 nt, Homo sapiens
gaagaggaaggagaaucug

SEQ ID NO: 461831 - RNA, 19 nt, Homo sapiens
ggacgggcucgguauuugg

SEQ ID NO: 461832 - RNA, 19 nt, Homo sapiens
cuggauggcagcauuguga

SEQ ID NO: 461833 - RNA, 19 nt, Homo sapiens
uggaggaggaggacgauga

SEQ ID NO: 461834 - RNA, 19 nt, Homo sapiens
gaagaugcugaaccaaacu

SEQ ID NO: 461835 - RNA, 19 nt, Homo sapiens
caucagcgaguuccuggau

SEQ ID NO: 461836 - RNA, 19 nt, Homo sapiens
gaccuggacgacaugaaga

SEQ ID NO: 461837 - RNA, 19 nt, Homo sapiens
gugugacccugaagacagu

SEQ ID NO: 461838 - RNA, 19 nt, Homo sapiens
gaggauggccaggaugagu

SEQ ID NO: 461839 - RNA, 19 nt, Homo sapiens
gagaagaccucauccguuu

SEQ ID NO: 461840 - RNA, 19 nt, Homo sapiens
ggacucagguguuuaaaga

SEQ ID NO: 461841 - RNA, 19 nt, Homo sapiens
gaaauuagagcuggacuua

SEQ ID NO: 461842 - RNA, 19 nt, Homo sapiens
gaagcaaacuguuaaucuu

SEQ ID NO: 461843 - RNA, 19 nt, Homo sapiens
gaagcaagaucguggaaau

SEQ ID NO: 461844 - RNA, 19 nt, Homo sapiens
gcacaguccucagaaauga

SEQ ID NO: 461845 - RNA, 19 nt, Homo sapiens
gagagaaugugcugucuau

SEQ ID NO: 461846 - RNA, 19 nt, Homo sapiens
gcaaguuuguguuuggaua

SEQ ID NO: 461847 - RNA, 19 nt, Homo sapiens
gcacugcccuugccaacuu

SEQ ID NO: 461848 - RNA, 19 nt, Homo sapiens
cagcagcucuggaaaugua

SEQ ID NO: 461849 - RNA, 19 nt, Homo sapiens
gccaguacauccaaguuua

SEQ ID NO: 461850 - RNA, 19 nt, Homo sapiens
ggacagguuucacauacaa

SEQ ID NO: 461851 - RNA, 19 nt, Homo sapiens
gagcuggacuuaagacuca

SEQ ID NO: 461852 - RNA, 19 nt, Homo sapiens
ccagggaucuguuuggaaa

SEQ ID NO: 461853 - RNA, 19 nt, Homo sapiens
ggaauuguucugccacuua

SEQ ID NO: 461854 - RNA, 19 nt, Homo sapiens
ucaggacccuuguugauuu

SEQ ID NO: 461855 - RNA, 19 nt, Homo sapiens
guacguaugcaaccgauua

SEQ ID NO: 461856 - RNA, 19 nt, Homo sapiens
gaaacuaggcuccgaagga

SEQ ID NO: 461857 - RNA, 19 nt, Homo sapiens
ccauuucacuucuuggaua

SEQ ID NO: 461858 - RNA, 19 nt, Homo sapiens
gcagaaagggugaagaaga

SEQ ID NO: 461859 - RNA, 19 nt, Homo sapiens
ggacggagcagccaucuuc

SEQ ID NO: 461860 - RNA, 19 nt, Homo sapiens
ggaaauguaacccaugaaa

SEQ ID NO: 461861 - RNA, 19 nt, Homo sapiens
gaacagcagcucuggaaau

SEQ ID NO: 461862 - RNA, 19 nt, Homo sapiens
agaaaugaauaccguguuu

SEQ ID NO: 461863 - RNA, 19 nt, Homo sapiens
cauaaagcgugaaauuaga

SEQ ID NO: 461864 - RNA, 19 nt, Homo sapiens
gaauucaacuggacacucu

SEQ ID NO: 461865 - RNA, 19 nt, Homo sapiens
gugcugguguccuggauua

SEQ ID NO: 461866 - RNA, 19 nt, Homo sapiens
ggaacuugcugaggugaaa

SEQ ID NO: 461867 - RNA, 19 nt, Homo sapiens
gaauuguucugccacuuau

SEQ ID NO: 461868 - RNA, 19 nt, Homo sapiens
gcaagaucguggaaaugaa

SEQ ID NO: 461869 - RNA, 19 nt, Homo sapiens
gacaugagccugagcagaa

SEQ ID NO: 461870 - RNA, 19 nt, Homo sapiens
gagcagggcuuuguucucu

SEQ ID NO: 461871 - RNA, 19 nt, Homo sapiens
guaaacaacuuagauucug

SEQ ID NO: 461872 - RNA, 19 nt, Homo sapiens
gaacaaugguguggacaag

SEQ ID NO: 461873 - RNA, 19 nt, Homo sapiens
gagcagaaagggugaagaa

SEQ ID NO: 461874 - RNA, 19 nt, Homo sapiens
gugcguguguguauaguuu

SEQ ID NO: 461875 - RNA, 19 nt, Homo sapiens
uaaugucaccugccucuua

SEQ ID NO: 461876 - RNA, 19 nt, Homo sapiens
ugacacgguucuaagcuaa

SEQ ID NO: 461877 - RNA, 19 nt, Homo sapiens
ccuaauguccuucaaguuu

SEQ ID NO: 461878 - RNA, 19 nt, Homo sapiens
gcagggcuuuguucucuau

SEQ ID NO: 461879 - RNA, 19 nt, Homo sapiens
caucuucgcaucuauauug

SEQ ID NO: 461880 - RNA, 19 nt, Homo sapiens
ggaguggccuuaaagaaac

SEQ ID NO: 461881 - RNA, 19 nt, Homo sapiens
gccauaaagcgugaaauua

SEQ ID NO: 461882 - RNA, 19 nt, Homo sapiens
gauuccaaaugguaaauga

SEQ ID NO: 461883 - RNA, 19 nt, Homo sapiens
gcucaacgcaggacagauu

SEQ ID NO: 461884 - RNA, 19 nt, Homo sapiens
ugaagugcauugaagagaa

SEQ ID NO: 461885 - RNA, 19 nt, Homo sapiens
cagcgacccuucccucuau

SEQ ID NO: 461886 - RNA, 19 nt, Homo sapiens
cagaaagggugaagaagag

SEQ ID NO: 461887 - RNA, 19 nt, Homo sapiens
gcauauucgugauguaaca

SEQ ID NO: 461888 - RNA, 19 nt, Homo sapiens
caggacccuuguugauuua

SEQ ID NO: 461889 - RNA, 19 nt, Homo sapiens
caaggacacucugacauuc

SEQ ID NO: 461890 - RNA, 19 nt, Homo sapiens
ggacagauuuucaccauuc

SEQ ID NO: 461891 - RNA, 19 nt, Homo sapiens
cauaggcacugagauagaa

SEQ ID NO: 461892 - RNA, 19 nt, Homo sapiens
guaugucugugguaucuug

SEQ ID NO: 461893 - RNA, 19 nt, Homo sapiens
aagcccagcucucuuuaaa

SEQ ID NO: 461894 - RNA, 19 nt, Homo sapiens
ccauaaagcgugaaauuag

SEQ ID NO: 461895 - RNA, 19 nt, Homo sapiens
guaaaugaacacucacuau

SEQ ID NO: 461896 - RNA, 19 nt, Homo sapiens
ggacaggacagguuucaca

SEQ ID NO: 461897 - RNA, 19 nt, Homo sapiens
ccauugggcugccuacuca

SEQ ID NO: 461898 - RNA, 19 nt, Homo sapiens
uuucuaacauguuguggua

SEQ ID NO: 461899 - RNA, 19 nt, Homo sapiens
gcauguugcugauacucuu

SEQ ID NO: 461900 - RNA, 19 nt, Homo sapiens
caacuggacacucuguaaa

SEQ ID NO: 461901 - RNA, 19 nt, Homo sapiens
aaauacaucuucgcaucua

SEQ ID NO: 461902 - RNA, 19 nt, Homo sapiens
caagaucguggaaaugaaa

SEQ ID NO: 461903 - RNA, 19 nt, Homo sapiens
ggcaucauguuccuuguug

SEQ ID NO: 461904 - RNA, 19 nt, Homo sapiens
agaaugugcugucuaucuu

SEQ ID NO: 461905 - RNA, 19 nt, Homo sapiens
caagcaaguuuguguuugg

SEQ ID NO: 461906 - RNA, 19 nt, Homo sapiens
caagggaaacaaucacauu

SEQ ID NO: 461907 - RNA, 19 nt, Homo sapiens
guaugcaaccgauuauaaa

SEQ ID NO: 461908 - RNA, 19 nt, Homo sapiens
ucuaacauguugugguaaa

SEQ ID NO: 461909 - RNA, 19 nt, Homo sapiens
aauuagagcuggacuuaag

SEQ ID NO: 461910 - RNA, 19 nt, Homo sapiens
ucacauuguuugauuccaa

SEQ ID NO: 461911 - RNA, 19 nt, Homo sapiens
ggacaaggacacucugaca

SEQ ID NO: 461912 - RNA, 19 nt, Homo sapiens
gaagugcauugaagagaac

SEQ ID NO: 461913 - RNA, 19 nt, Homo sapiens
ccuguuugcucugguguua

SEQ ID NO: 461914 - RNA, 19 nt, Homo sapiens
gagaaugugcugucuaucu

SEQ ID NO: 461915 - RNA, 19 nt, Homo sapiens
ggcacacgcuuauggaugu

SEQ ID NO: 461916 - RNA, 19 nt, Homo sapiens
uagaagggaugaacauuuu

SEQ ID NO: 461917 - RNA, 19 nt, Homo sapiens
caaaggaaacuggaaacuu

SEQ ID NO: 461918 - RNA, 19 nt, Homo sapiens
uaaaccagcuaagccauuc

SEQ ID NO: 461919 - RNA, 19 nt, Homo sapiens
caaaugccgccucuuccua

SEQ ID NO: 461920 - RNA, 19 nt, Homo sapiens
uaaagaguuugugcuauag

SEQ ID NO: 461921 - RNA, 19 nt, Homo sapiens
aagaggaucagcagguuua

SEQ ID NO: 461922 - RNA, 19 nt, Homo sapiens
ccaagcaaguuuguguuug

SEQ ID NO: 461923 - RNA, 19 nt, Homo sapiens
caacacacacacacauaug

SEQ ID NO: 461924 - RNA, 19 nt, Homo sapiens
gaggugugauguaguuauc

SEQ ID NO: 461925 - RNA, 19 nt, Homo sapiens
cguaugcaaccgauuauaa

SEQ ID NO: 461926 - RNA, 19 nt, Homo sapiens
caggacagguuucacauac

SEQ ID NO: 461927 - RNA, 19 nt, Homo sapiens
auagucaucugucgcauug

SEQ ID NO: 461928 - RNA, 19 nt, Homo sapiens
caaggagucgguucuguga

SEQ ID NO: 461929 - RNA, 19 nt, Homo sapiens
gaaauacaucuucgcaucu

SEQ ID NO: 461930 - RNA, 19 nt, Homo sapiens
ccucauccguuucuucaau

SEQ ID NO: 461931 - RNA, 19 nt, Homo sapiens
gaacacucacuauucuuca

SEQ ID NO: 461932 - RNA, 19 nt, Homo sapiens
caggaaccgugcaaaggaa

SEQ ID NO: 461933 - RNA, 19 nt, Homo sapiens
ucagguguuuaaagaguuu

SEQ ID NO: 461934 - RNA, 19 nt, Homo sapiens
guacaccagggaucuguuu

SEQ ID NO: 461935 - RNA, 19 nt, Homo sapiens
ucagaaggcaacaaagaaa

SEQ ID NO: 461936 - RNA, 19 nt, Homo sapiens
uguccuggauuauguggua

SEQ ID NO: 461937 - RNA, 19 nt, Homo sapiens
gaauuucacaaagccauaa

SEQ ID NO: 461938 - RNA, 19 nt, Homo sapiens
aaugguaaaugaacacuca

SEQ ID NO: 461939 - RNA, 19 nt, Homo sapiens
gaaggaaucagucauguaa

SEQ ID NO: 461940 - RNA, 19 nt, Homo sapiens
gcaaggaggugcucgauuc

SEQ ID NO: 461941 - RNA, 19 nt, Homo sapiens
ggauguggguuuacucuuu

SEQ ID NO: 461942 - RNA, 19 nt, Homo sapiens
gcacagagccugaguugau

SEQ ID NO: 461943 - RNA, 19 nt, Homo sapiens
acagcaagauggagaaaua

SEQ ID NO: 461944 - RNA, 19 nt, Homo sapiens
gauggaggauguggguuua

SEQ ID NO: 461945 - RNA, 19 nt, Homo sapiens
gcuccgaacucccagcuuu

SEQ ID NO: 461946 - RNA, 19 nt, Homo sapiens
gggagaggcugaggacaaa

SEQ ID NO: 461947 - RNA, 19 nt, Homo sapiens
gaacauccugggcuuggua

SEQ ID NO: 461948 - RNA, 19 nt, Homo sapiens
gaaauaucuucccuuccaa

SEQ ID NO: 461949 - RNA, 19 nt, Homo sapiens
acaaauaccugcugucacu

SEQ ID NO: 461950 - RNA, 19 nt, Homo sapiens
gagaggcugaggacaaaua

SEQ ID NO: 461951 - RNA, 19 nt, Homo sapiens
gauguggguuuacucuuug

SEQ ID NO: 461952 - RNA, 19 nt, Homo sapiens
agaaauaucuucccuucca

SEQ ID NO: 461953 - RNA, 19 nt, Homo sapiens
gagaaggaaucagucaugu

SEQ ID NO: 461954 - RNA, 19 nt, Homo sapiens
gaacucacaacucuaagga

SEQ ID NO: 461955 - RNA, 19 nt, Homo sapiens
uaugaggaauggauaaaug

SEQ ID NO: 461956 - RNA, 19 nt, Homo sapiens
gacacuggauuaugaggaa

SEQ ID NO: 461957 - RNA, 19 nt, Homo sapiens
ugauacaagugaagaguga

SEQ ID NO: 461958 - RNA, 19 nt, Homo sapiens
gcaagauggagaaauaaug

SEQ ID NO: 461959 - RNA, 19 nt, Homo sapiens
cacagagccugaguugaua

SEQ ID NO: 461960 - RNA, 19 nt, Homo sapiens
gcacaucagccguuucauc

SEQ ID NO: 461961 - RNA, 19 nt, Homo sapiens
gcaagaucguggagaugga

SEQ ID NO: 461962 - RNA, 19 nt, Homo sapiens
guucuggucuccuggauca

SEQ ID NO: 461963 - RNA, 19 nt, Homo sapiens
caagauggagaaauaaugu

SEQ ID NO: 461964 - RNA, 19 nt, Homo sapiens
ugaagugcguggaggagaa

SEQ ID NO: 461965 - RNA, 19 nt, Homo sapiens
gcucauacucuaccaccua

SEQ ID NO: 461966 - RNA, 19 nt, Homo sapiens
ccaagcacaucagccguuu

SEQ ID NO: 461967 - RNA, 19 nt, Homo sapiens
cagcagccuuucgcucaua

SEQ ID NO: 461968 - RNA, 19 nt, Homo sapiens
uuuggacacuggauuauga

SEQ ID NO: 461969 - RNA, 19 nt, Homo sapiens
guaccguccucaauguaga

SEQ ID NO: 461970 - RNA, 19 nt, Homo sapiens
gccuuucgcucauacucua

SEQ ID NO: 461971 - RNA, 19 nt, Homo sapiens
gagccugaguugauacaag

SEQ ID NO: 461972 - RNA, 19 nt, Homo sapiens
ucuccuggaucauguggua

SEQ ID NO: 461973 - RNA, 19 nt, Homo sapiens
ggauuaugaggaauggaua

SEQ ID NO: 461974 - RNA, 19 nt, Homo sapiens
ggaauggauaaauggauga

SEQ ID NO: 461975 - RNA, 19 nt, Homo sapiens
ggucgccucugagaaggaa

SEQ ID NO: 461976 - RNA, 19 nt, Homo sapiens
gagccuggguccccuguuu

SEQ ID NO: 461977 - RNA, 19 nt, Homo sapiens
ccugguggcuggcaagauc

SEQ ID NO: 461978 - RNA, 19 nt, Homo sapiens
caaugaggccaccaugguu

SEQ ID NO: 461979 - RNA, 19 nt, Homo sapiens
ugagaaggaaucagucaug

SEQ ID NO: 461980 - RNA, 19 nt, Homo sapiens
uuugggaccucuuccaguu

SEQ ID NO: 461981 - RNA, 19 nt, Homo sapiens
gaucuugcgagaaauaucu

SEQ ID NO: 461982 - RNA, 19 nt, Homo sapiens
guguguguguguucuguga

SEQ ID NO: 461983 - RNA, 19 nt, Homo sapiens
agaaggaaucagucaugua

SEQ ID NO: 461984 - RNA, 19 nt, Homo sapiens
ccacgucccacccagagaa

SEQ ID NO: 461985 - RNA, 19 nt, Homo sapiens
uccuggaucuugcgagaaa

SEQ ID NO: 461986 - RNA, 19 nt, Homo sapiens
cagcaagauggagaaauaa

SEQ ID NO: 461987 - RNA, 19 nt, Homo sapiens
gaagcacagagccugaguu

SEQ ID NO: 461988 - RNA, 19 nt, Homo sapiens
ccuguaccguccucaaugu

SEQ ID NO: 461989 - RNA, 19 nt, Homo sapiens
aggaggugcucgauucguu

SEQ ID NO: 461990 - RNA, 19 nt, Homo sapiens
augccuggcugcuggagua

SEQ ID NO: 461991 - RNA, 19 nt, Homo sapiens
ucguaaagaucaucaccau

SEQ ID NO: 461992 - RNA, 19 nt, Homo sapiens
ucaaugaggccaccauggu

SEQ ID NO: 461993 - RNA, 19 nt, Homo sapiens
caagagccaaggaacuuca

SEQ ID NO: 461994 - RNA, 19 nt, Homo sapiens
aggaaucagucauguaaac

SEQ ID NO: 461995 - RNA, 19 nt, Homo sapiens
gcgccaccgucaacaugga

SEQ ID NO: 461996 - RNA, 19 nt, Homo sapiens
aagcacagagccugaguug

SEQ ID NO: 461997 - RNA, 19 nt, Homo sapiens
ccucaucuacuuccucuuc

SEQ ID NO: 461998 - RNA, 19 nt, Homo sapiens
gaggaauggauaaauggau

SEQ ID NO: 461999 - RNA, 19 nt, Homo sapiens
gaccaccgccuuccguaca

SEQ ID NO: 462000 - RNA, 19 nt, Homo sapiens
uaaacacuccagcuuccaa

SEQ ID NO: 462001 - RNA, 19 nt, Homo sapiens
ucguggagauggaggaugu

SEQ ID NO: 462002 - RNA, 19 nt, Homo sapiens
uaugaagagaggaauauca

SEQ ID NO: 462003 - RNA, 19 nt, Homo sapiens
gcaggucacaggucaccau

SEQ ID NO: 462004 - RNA, 19 nt, Homo sapiens
gaagugcguggaggagaau

SEQ ID NO: 462005 - RNA, 19 nt, Homo sapiens
agauggaggauguggguuu

SEQ ID NO: 462006 - RNA, 19 nt, Homo sapiens
gcucuuuggacacuggauu

SEQ ID NO: 462007 - RNA, 19 nt, Homo sapiens
aagcacaucagccguuuca

SEQ ID NO: 462008 - RNA, 19 nt, Homo sapiens
gaggauguggguuuacucu

SEQ ID NO: 462009 - RNA, 19 nt, Homo sapiens
cuugagcgccuucgucuuc

SEQ ID NO: 462010 - RNA, 19 nt, Homo sapiens
aaacagcaagauggagaaa

SEQ ID NO: 462011 - RNA, 19 nt, Homo sapiens
cacaaggguuacuccucaa

SEQ ID NO: 462012 - RNA, 19 nt, Homo sapiens
cuuauccgcuucuucaacu

SEQ ID NO: 462013 - RNA, 19 nt, Homo sapiens
cugcuuauccgcuucuuca

SEQ ID NO: 462014 - RNA, 19 nt, Homo sapiens
ccuaugaagagaggaauau

SEQ ID NO: 462015 - RNA, 19 nt, Homo sapiens
cugcagaccuccgccaucu

SEQ ID NO: 462016 - RNA, 19 nt, Homo sapiens
ccuuggacuucguaaagau

SEQ ID NO: 462017 - RNA, 19 nt, Homo sapiens
gcguggaggagaauaaugg

SEQ ID NO: 462018 - RNA, 19 nt, Homo sapiens
guuacucaacucaguccua

SEQ ID NO: 462019 - RNA, 19 nt, Homo sapiens
caacgagagugcuauguga

SEQ ID NO: 462020 - RNA, 19 nt, Homo sapiens
ggaagauucuggagaugga

SEQ ID NO: 462021 - RNA, 19 nt, Homo sapiens
ucauggaccugaucagaaa

SEQ ID NO: 462022 - RNA, 19 nt, Homo sapiens
gaagacaucacgcucauca

SEQ ID NO: 462023 - RNA, 19 nt, Homo sapiens
ggucuucucuguggccuuu

SEQ ID NO: 462024 - RNA, 19 nt, Homo sapiens
ggucagaucacaaccauca

SEQ ID NO: 462025 - RNA, 19 nt, Homo sapiens
gaccugaucagaaauaugu

SEQ ID NO: 462026 - RNA, 19 nt, Homo sapiens
gguguuaccucucauuguc

SEQ ID NO: 462027 - RNA, 19 nt, Homo sapiens
caucuucauugcucaaguu

SEQ ID NO: 462028 - RNA, 19 nt, Homo sapiens
uggcaucccuggacaacaa

SEQ ID NO: 462029 - RNA, 19 nt, Homo sapiens
ggucagcgccguggucauu

SEQ ID NO: 462030 - RNA, 19 nt, Homo sapiens
gcccauaucagcucaccua

SEQ ID NO: 462031 - RNA, 19 nt, Homo sapiens
gcaacgagagugcuaugug

SEQ ID NO: 462032 - RNA, 19 nt, Homo sapiens
gggcaucauuaucugguau

SEQ ID NO: 462033 - RNA, 19 nt, Homo sapiens
gagagcuucugaugaggau

SEQ ID NO: 462034 - RNA, 19 nt, Homo sapiens
ggaccauggugaggacaga

SEQ ID NO: 462035 - RNA, 19 nt, Homo sapiens
caaccugggucagaucaca

SEQ ID NO: 462036 - RNA, 19 nt, Homo sapiens
ccugauugcugggaagauu

SEQ ID NO: 462037 - RNA, 19 nt, Homo sapiens
ucaaugaggcuauuaugag

SEQ ID NO: 462038 - RNA, 19 nt, Homo sapiens
gcgccacggucaacaugga

SEQ ID NO: 462039 - RNA, 19 nt, Homo sapiens
ggcauccuguuccugauug

SEQ ID NO: 462040 - RNA, 19 nt, Homo sapiens
caucaucgcggucuucauc

SEQ ID NO: 462041 - RNA, 19 nt, Homo sapiens
cuggagagcuucugaugag

SEQ ID NO: 462042 - RNA, 19 nt, Homo sapiens
ggaggcaacgagagugcua

SEQ ID NO: 462043 - RNA, 19 nt, Homo sapiens
gaucaaguacuucucuuuu

SEQ ID NO: 462044 - RNA, 19 nt, Homo sapiens
gcgccgaaacgccuucauu

SEQ ID NO: 462045 - RNA, 19 nt, Homo sapiens
gagcucaaccugggucaga

SEQ ID NO: 462046 - RNA, 19 nt, Homo sapiens
caggagaugcugagcuuug

SEQ ID NO: 462047 - RNA, 19 nt, Homo sapiens
guacagcacgaggguggua

SEQ ID NO: 462048 - RNA, 19 nt, Homo sapiens
gcgggcagcuguguacuac

SEQ ID NO: 462049 - RNA, 19 nt, Homo sapiens
gcacaaugaccaacguacu

SEQ ID NO: 462050 - RNA, 19 nt, Homo sapiens
gaccggcuucgcacaauga

SEQ ID NO: 462051 - RNA, 19 nt, Homo sapiens
cuucauugcucaaguuaac

SEQ ID NO: 462052 - RNA, 19 nt, Homo sapiens
ccgaaacgccuucauucug

SEQ ID NO: 462053 - RNA, 19 nt, Homo sapiens
caacgcugcccaucaccuu

SEQ ID NO: 462054 - RNA, 19 nt, Homo sapiens
ugcaggagaugcugagcuu

SEQ ID NO: 462055 - RNA, 19 nt, Homo sapiens
cuccaugccuccuccauuc

SEQ ID NO: 462056 - RNA, 19 nt, Homo sapiens
guggaggccugcuucaaac

SEQ ID NO: 462057 - RNA, 19 nt, Homo sapiens
ugaugaggaugcugcagau

SEQ ID NO: 462058 - RNA, 19 nt, Homo sapiens
cggaagacaucacgcucau

SEQ ID NO: 462059 - RNA, 19 nt, Homo sapiens
cagaucaaguacuucucuu

SEQ ID NO: 462060 - RNA, 19 nt, Homo sapiens
cugggaagauucuggagau

SEQ ID NO: 462061 - RNA, 19 nt, Homo sapiens
gggcauccuguuccugauu

SEQ ID NO: 462062 - RNA, 19 nt, Homo sapiens
gaggccugcuucaaacagu

SEQ ID NO: 462063 - RNA, 19 nt, Homo sapiens
uguggaggccugcuucaaa

SEQ ID NO: 462064 - RNA, 19 nt, Homo sapiens
cagcugaugccuucaugga

SEQ ID NO: 462065 - RNA, 19 nt, Homo sapiens
ggccacagcagccaguguu

SEQ ID NO: 462066 - RNA, 19 nt, Homo sapiens
aggagaugcugagcuuuga

SEQ ID NO: 462067 - RNA, 19 nt, Homo sapiens
ggaccugaucagaaauaug

SEQ ID NO: 462068 - RNA, 19 nt, Homo sapiens
ugaccggcuucgcacaaug

SEQ ID NO: 462069 - RNA, 19 nt, Homo sapiens
ccuuugggcuggucauugg

SEQ ID NO: 462070 - RNA, 19 nt, Homo sapiens
ucaccuaccgccagaucaa

SEQ ID NO: 462071 - RNA, 19 nt, Homo sapiens
ucaucgagcacuugucuca

SEQ ID NO: 462072 - RNA, 19 nt, Homo sapiens
ggggucagcugggcaugua

SEQ ID NO: 462073 - RNA, 19 nt, Homo sapiens
ccugaucagaaauauguuu

SEQ ID NO: 462074 - RNA, 19 nt, Homo sapiens
gaagauucuggagauggaa

SEQ ID NO: 462075 - RNA, 19 nt, Homo sapiens
gagcuuugaggagacugua

SEQ ID NO: 462076 - RNA, 19 nt, Homo sapiens
ccagaucaaguacuucucu

SEQ ID NO: 462077 - RNA, 19 nt, Homo sapiens
ugaggaugcugcagaugcu

SEQ ID NO: 462078 - RNA, 19 nt, Homo sapiens
cacagcugaugccuucaug

SEQ ID NO: 462079 - RNA, 19 nt, Homo sapiens
gacacuaacucaaaucuuu

SEQ ID NO: 462080 - RNA, 19 nt, Homo sapiens
cagaauggcugugugaaga

SEQ ID NO: 462081 - RNA, 19 nt, Homo sapiens
ggacacaggcaccgagaaa

SEQ ID NO: 462082 - RNA, 19 nt, Homo sapiens
gcaaauucaguguuaacua

SEQ ID NO: 462083 - RNA, 19 nt, Homo sapiens
uguccaaggucucacguua

SEQ ID NO: 462084 - RNA, 19 nt, Homo sapiens
ugacaucacccucaucauu

SEQ ID NO: 462085 - RNA, 19 nt, Homo sapiens
ucaagugccugcuggagaa

SEQ ID NO: 462086 - RNA, 19 nt, Homo sapiens
guuugcaaauucaguguua

SEQ ID NO: 462087 - RNA, 19 nt, Homo sapiens
ucaagacacuaacucaaau

SEQ ID NO: 462088 - RNA, 19 nt, Homo sapiens
gaagccacauucaaacagu

SEQ ID NO: 462089 - RNA, 19 nt, Homo sapiens
guaagauccuggagaugga

SEQ ID NO: 462090 - RNA, 19 nt, Homo sapiens
ggagucagguuuucuauuc

SEQ ID NO: 462091 - RNA, 19 nt, Homo sapiens
acagaugucuuuacuagag

SEQ ID NO: 462092 - RNA, 19 nt, Homo sapiens
gacaucacccucaucauug

SEQ ID NO: 462093 - RNA, 19 nt, Homo sapiens
ggcauuguguuccucauug

SEQ ID NO: 462094 - RNA, 19 nt, Homo sapiens
gccaaccucccauggaaua

SEQ ID NO: 462095 - RNA, 19 nt, Homo sapiens
gcaaagcuccuuggaugug

SEQ ID NO: 462096 - RNA, 19 nt, Homo sapiens
cgaggucguuuacaaguca

SEQ ID NO: 462097 - RNA, 19 nt, Homo sapiens
gggccaggaucacacauuc

SEQ ID NO: 462098 - RNA, 19 nt, Homo sapiens
caccagcgauggcaugaau

SEQ ID NO: 462099 - RNA, 19 nt, Homo sapiens
ggaauggacuccucauccu

SEQ ID NO: 462100 - RNA, 19 nt, Homo sapiens
caacuacgagcuggacuuu

SEQ ID NO: 462101 - RNA, 19 nt, Homo sapiens
caccacaggaaauuaguua

SEQ ID NO: 462102 - RNA, 19 nt, Homo sapiens
ucuauuccuuucuguguuu

SEQ ID NO: 462103 - RNA, 19 nt, Homo sapiens
gucaagacacuaacucaaa

SEQ ID NO: 462104 - RNA, 19 nt, Homo sapiens
guuaaggucaagacacuaa

SEQ ID NO: 462105 - RNA, 19 nt, Homo sapiens
cagaucaucaccaucagua

SEQ ID NO: 462106 - RNA, 19 nt, Homo sapiens
ugaggaugcugaagaugau

SEQ ID NO: 462107 - RNA, 19 nt, Homo sapiens
ggucucacguuaaggucaa

SEQ ID NO: 462108 - RNA, 19 nt, Homo sapiens
gaucaucaccaucaguauc

SEQ ID NO: 462109 - RNA, 19 nt, Homo sapiens
ggccagaucaucaccauca

SEQ ID NO: 462110 - RNA, 19 nt, Homo sapiens
aaacaguaccgcaccaaga

SEQ ID NO: 462111 - RNA, 19 nt, Homo sapiens
cacaggaaauuaguuacuu

SEQ ID NO: 462112 - RNA, 19 nt, Homo sapiens
gcucccaugugcagaacuu

SEQ ID NO: 462113 - RNA, 19 nt, Homo sapiens
aguagaagccacauucaaa

SEQ ID NO: 462114 - RNA, 19 nt, Homo sapiens
ugaugaggaugcugaagau

SEQ ID NO: 462115 - RNA, 19 nt, Homo sapiens
gaauggcugugugaagagu

SEQ ID NO: 462116 - RNA, 19 nt, Homo sapiens
ucgcccaggucaacaacua

SEQ ID NO: 462117 - RNA, 19 nt, Homo sapiens
guucccagccaaccuagua

SEQ ID NO: 462118 - RNA, 19 nt, Homo sapiens
gaccucauccggaacaugu

SEQ ID NO: 462119 - RNA, 19 nt, Homo sapiens
gcagaauggcugugugaag

SEQ ID NO: 462120 - RNA, 19 nt, Homo sapiens
cggguaagauccuggagau

SEQ ID NO: 462121 - RNA, 19 nt, Homo sapiens
ccauauaugucggaaggau

SEQ ID NO: 462122 - RNA, 19 nt, Homo sapiens
acaggaaauuaguuacuuc

SEQ ID NO: 462123 - RNA, 19 nt, Homo sapiens
ggucaagacacuaacucaa

SEQ ID NO: 462124 - RNA, 19 nt, Homo sapiens
gaccguuuccgcaccauga

SEQ ID NO: 462125 - RNA, 19 nt, Homo sapiens
acuacgagcuggacuuugg

SEQ ID NO: 462126 - RNA, 19 nt, Homo sapiens
aggccaaccucccauggaa

SEQ ID NO: 462127 - RNA, 19 nt, Homo sapiens
cgcccgaggucguuuacaa

SEQ ID NO: 462128 - RNA, 19 nt, Homo sapiens
aagccacauucaaacagua

SEQ ID NO: 462129 - RNA, 19 nt, Homo sapiens
ccacacugcccaucaccuu

SEQ ID NO: 462130 - RNA, 19 nt, Homo sapiens
caaggucucacguuaaggu

SEQ ID NO: 462131 - RNA, 19 nt, Homo sapiens
uccaaggucucacguuaag

SEQ ID NO: 462132 - RNA, 19 nt, Homo sapiens
cuugagaggcuggaauuaa

SEQ ID NO: 462133 - RNA, 19 nt, Homo sapiens
acugggcucuggaccguuu

SEQ ID NO: 462134 - RNA, 19 nt, Homo sapiens
ggcgguggcugugugguau

SEQ ID NO: 462135 - RNA, 19 nt, Homo sapiens
guagaagccacauucaaac

SEQ ID NO: 462136 - RNA, 19 nt, Homo sapiens
ccuaguagaagccacauuc

SEQ ID NO: 462137 - RNA, 19 nt, Homo sapiens
ccuuggauguggagacaga

SEQ ID NO: 462138 - RNA, 19 nt, Homo sapiens
guccaaggucucacguuaa

SEQ ID NO: 462139 - RNA, 19 nt, Homo sapiens
ggaucacacauucuucuca

SEQ ID NO: 462140 - RNA, 19 nt, Homo sapiens
gccaggaucacacauucuu

SEQ ID NO: 462141 - RNA, 19 nt, Homo sapiens
auauaugucggaaggauuu

SEQ ID NO: 462142 - RNA, 19 nt, Homo sapiens
gugcuccacgggcucuuua

SEQ ID NO: 462143 - RNA, 19 nt, Homo sapiens
gggcaucgucuucuucucu

SEQ ID NO: 462144 - RNA, 19 nt, Homo sapiens
cgaggcugguguuuagcaa

SEQ ID NO: 462145 - RNA, 19 nt, Homo sapiens
cguuuccgcaccaugauua

SEQ ID NO: 462146 - RNA, 19 nt, Homo sapiens
ggccucagccacacaguuc

SEQ ID NO: 462147 - RNA, 19 nt, Homo sapiens
uaaccccgcuugacggaaa

SEQ ID NO: 462148 - RNA, 19 nt, Homo sapiens
uugagaggcuggaauuaac

SEQ ID NO: 462149 - RNA, 19 nt, Homo sapiens
cuccucggcuucuucuuga

SEQ ID NO: 462150 - RNA, 19 nt, Homo sapiens
ccacugcaccauccagauc

SEQ ID NO: 462151 - RNA, 19 nt, Homo sapiens
ggacuuuggccagaucauc

SEQ ID NO: 462152 - RNA, 19 nt, Homo sapiens
gcauuguguuccucauugc

SEQ ID NO: 462153 - RNA, 19 nt, Homo sapiens
uuucuguguuugcaaauuc

SEQ ID NO: 462154 - RNA, 19 nt, Homo sapiens
ggacugcccaccgaugaca

SEQ ID NO: 462155 - RNA, 19 nt, Homo sapiens
gacuuuggccagaucauca

SEQ ID NO: 462156 - RNA, 19 nt, Homo sapiens
ccaagaagaaucccaucgu

SEQ ID NO: 462157 - RNA, 19 nt, Homo sapiens
ggugccgcaugccaucuug

SEQ ID NO: 462158 - RNA, 19 nt, Homo sapiens
caucgugggcaucuucaug

SEQ ID NO: 462159 - RNA, 19 nt, Homo sapiens
ccacaggaaauuaguuacu

SEQ ID NO: 462160 - RNA, 19 nt, Homo sapiens
caagacacuaacucaaauc

SEQ ID NO: 462161 - RNA, 19 nt, Homo sapiens
cgguggcugugugguauuu

SEQ ID NO: 462162 - RNA, 19 nt, Homo sapiens
uagaagccacauucaaaca

SEQ ID NO: 462163 - RNA, 19 nt, Homo sapiens
cauguucccagccaaccua

SEQ ID NO: 462164 - RNA, 19 nt, Homo sapiens
cauauaugucggaaggauu

SEQ ID NO: 462165 - RNA, 19 nt, Homo sapiens
gguggucuccagcuugaug

SEQ ID NO: 462166 - RNA, 19 nt, Homo sapiens
ccagcgauggcaugaaugu

SEQ ID NO: 462167 - RNA, 19 nt, Homo sapiens
ugucuuuacuagagcugaa

SEQ ID NO: 462168 - RNA, 19 nt, Homo sapiens
gcaaugauguccagaagaa

SEQ ID NO: 462169 - RNA, 19 nt, Homo sapiens
caucaacgcugucuucuau

SEQ ID NO: 462170 - RNA, 19 nt, Homo sapiens
gaagaauauucaggacuua

SEQ ID NO: 462171 - RNA, 19 nt, Homo sapiens
caaacucacugcucaagaa

SEQ ID NO: 462172 - RNA, 19 nt, Homo sapiens
ucaacgcugucuucuauua

SEQ ID NO: 462173 - RNA, 19 nt, Homo sapiens
gaagagagucggcagauga

SEQ ID NO: 462174 - RNA, 19 nt, Homo sapiens
gcucaaaucuauucagaca

SEQ ID NO: 462175 - RNA, 19 nt, Homo sapiens
ccaagagugugcuaaagaa

SEQ ID NO: 462176 - RNA, 19 nt, Homo sapiens
ggaauucaaugcugaugau

SEQ ID NO: 462177 - RNA, 19 nt, Homo sapiens
guguauagaugcaagauau

SEQ ID NO: 462178 - RNA, 19 nt, Homo sapiens
caucguggcugaacucuuc

SEQ ID NO: 462179 - RNA, 19 nt, Homo sapiens
agauauaaauggcugguuu

SEQ ID NO: 462180 - RNA, 19 nt, Homo sapiens
cuuaacggcuccaggauuu

SEQ ID NO: 462181 - RNA, 19 nt, Homo sapiens
ggagccagccaaagugaua

SEQ ID NO: 462182 - RNA, 19 nt, Homo sapiens
caacuggaccucaaauuuc

SEQ ID NO: 462183 - RNA, 19 nt, Homo sapiens
ccaacuggaccucaaauuu

SEQ ID NO: 462184 - RNA, 19 nt, Homo sapiens
cagcugacgugacccauga

SEQ ID NO: 462185 - RNA, 19 nt, Homo sapiens
ucaaaguuccugagacuaa

SEQ ID NO: 462186 - RNA, 19 nt, Homo sapiens
cuacaacacuggagucauc

SEQ ID NO: 462187 - RNA, 19 nt, Homo sapiens
ucaaaucuauucagacaag

SEQ ID NO: 462188 - RNA, 19 nt, Homo sapiens
agaagaauauucaggacuu

SEQ ID NO: 462189 - RNA, 19 nt, Homo sapiens
caaaguuccugagacuaaa

SEQ ID NO: 462190 - RNA, 19 nt, Homo sapiens
acacguaccucucaucagu

SEQ ID NO: 462191 - RNA, 19 nt, Homo sapiens
ccacgagcaucuucgagaa

SEQ ID NO: 462192 - RNA, 19 nt, Homo sapiens
gagcaucguggccaucuuu

SEQ ID NO: 462193 - RNA, 19 nt, Homo sapiens
caucuucaccuacuucaaa

SEQ ID NO: 462194 - RNA, 19 nt, Homo sapiens
ggaagagagucggcagaug

SEQ ID NO: 462195 - RNA, 19 nt, Homo sapiens
gacuguugcucaaaucuau

SEQ ID NO: 462196 - RNA, 19 nt, Homo sapiens
gaccucaaauuucauugug

SEQ ID NO: 462197 - RNA, 19 nt, Homo sapiens
guaugugggugaaguguca

SEQ ID NO: 462198 - RNA, 19 nt, Homo sapiens
gggcaaguccuuugagaug

SEQ ID NO: 462199 - RNA, 19 nt, Homo sapiens
uugaaaugcuuguggauug

SEQ ID NO: 462200 - RNA, 19 nt, Homo sapiens
gcucaugggcuucucgaaa

SEQ ID NO: 462201 - RNA, 19 nt, Homo sapiens
uacccaaccacucaaauua

SEQ ID NO: 462202 - RNA, 19 nt, Homo sapiens
ugaaaugcuuguggauuga

SEQ ID NO: 462203 - RNA, 19 nt, Homo sapiens
gcaugugcuuccaguaugu

SEQ ID NO: 462204 - RNA, 19 nt, Homo sapiens
ggcuugaaaucgcauuauu

SEQ ID NO: 462205 - RNA, 19 nt, Homo sapiens
ucucaucaguguccucuug

SEQ ID NO: 462206 - RNA, 19 nt, Homo sapiens
ucacccagcuaaucuguag

SEQ ID NO: 462207 - RNA, 19 nt, Homo sapiens
ggacacacuaaucgaacua

SEQ ID NO: 462208 - RNA, 19 nt, Homo sapiens
cgagacacuugccuucuuc

SEQ ID NO: 462209 - RNA, 19 nt, Homo sapiens
caagacuguugcucaaauc

SEQ ID NO: 462210 - RNA, 19 nt, Homo sapiens
guaaauacaccaccucacu

SEQ ID NO: 462211 - RNA, 19 nt, Homo sapiens
gaacuacaaagcuucuauc

SEQ ID NO: 462212 - RNA, 19 nt, Homo sapiens
gccugaggguggagacuaa

SEQ ID NO: 462213 - RNA, 19 nt, Homo sapiens
ggccggaccuucgaugaga

SEQ ID NO: 462214 - RNA, 19 nt, Homo sapiens
gggcaugugcuuccaguau

SEQ ID NO: 462215 - RNA, 19 nt, Homo sapiens
gaaacugggcaaguccuuu

SEQ ID NO: 462216 - RNA, 19 nt, Homo sapiens
aaugauguccagaagaaua

SEQ ID NO: 462217 - RNA, 19 nt, Homo sapiens
cagcaaugauguccagaag

SEQ ID NO: 462218 - RNA, 19 nt, Homo sapiens
cagccaaagugauaagaca

SEQ ID NO: 462219 - RNA, 19 nt, Homo sapiens
ggcaugugcuuccaguaug

SEQ ID NO: 462220 - RNA, 19 nt, Homo sapiens
gagcagcuacccuggaugu

SEQ ID NO: 462221 - RNA, 19 nt, Homo sapiens
gcagcugucuggcaucaac

SEQ ID NO: 462222 - RNA, 19 nt, Homo sapiens
ugcaggagaugaaggaaga

SEQ ID NO: 462223 - RNA, 19 nt, Homo sapiens
gccaagagugugcuaaaga

SEQ ID NO: 462224 - RNA, 19 nt, Homo sapiens
caaccacugcaacggcuua

SEQ ID NO: 462225 - RNA, 19 nt, Homo sapiens
gggucaggcuccauuagga

SEQ ID NO: 462226 - RNA, 19 nt, Homo sapiens
agaaggugaucgaggaguu

SEQ ID NO: 462227 - RNA, 19 nt, Homo sapiens
gcaaacucacugcucaaga

SEQ ID NO: 462228 - RNA, 19 nt, Homo sapiens
uaaggacacacuaaucgaa

SEQ ID NO: 462229 - RNA, 19 nt, Homo sapiens
uuccaaaccugacagaugu

SEQ ID NO: 462230 - RNA, 19 nt, Homo sapiens
guucuguucuucaucuuca

SEQ ID NO: 462231 - RNA, 19 nt, Homo sapiens
ucaaggcauuucuaucaca

SEQ ID NO: 462232 - RNA, 19 nt, Homo sapiens
caccaccucacuccuguua

SEQ ID NO: 462233 - RNA, 19 nt, Homo sapiens
gugggagccugcaaacuca

SEQ ID NO: 462234 - RNA, 19 nt, Homo sapiens
cccaaccacucaaauuaau

SEQ ID NO: 462235 - RNA, 19 nt, Homo sapiens
acuaugaacuacaaagcuu

SEQ ID NO: 462236 - RNA, 19 nt, Homo sapiens
ggaugagacuuccaaaccu

SEQ ID NO: 462237 - RNA, 19 nt, Homo sapiens
ggaugggagugagacagaa

SEQ ID NO: 462238 - RNA, 19 nt, Homo sapiens
gaacuaugaacuacaaagc

SEQ ID NO: 462239 - RNA, 19 nt, Homo sapiens
gcaucaacgcugucuucua

SEQ ID NO: 462240 - RNA, 19 nt, Homo sapiens
caaggcauuucuaucacau

SEQ ID NO: 462241 - RNA, 19 nt, Homo sapiens
ggagugagacagaaguaag

SEQ ID NO: 462242 - RNA, 19 nt, Homo sapiens
acacuaaucgaacuaugaa

SEQ ID NO: 462243 - RNA, 19 nt, Homo sapiens
gcaaguccuuugagaugcu

SEQ ID NO: 462244 - RNA, 19 nt, Homo sapiens
gauugaggguaggagguuu

SEQ ID NO: 462245 - RNA, 19 nt, Homo sapiens
cuaaucgaacuaugaacua

SEQ ID NO: 462246 - RNA, 19 nt, Homo sapiens
gcuccaggauuuuaacaaa

SEQ ID NO: 462247 - RNA, 19 nt, Homo sapiens
ccagggagcaggagaccaa

SEQ ID NO: 462248 - RNA, 19 nt, Homo sapiens
ucacugugcuccugguucu

SEQ ID NO: 462249 - RNA, 19 nt, Homo sapiens
ggaccucaaauuucauugu

SEQ ID NO: 462250 - RNA, 19 nt, Homo sapiens
aggcauuucuaucacauau

SEQ ID NO: 462251 - RNA, 19 nt, Homo sapiens
ccuguuacccagagaauau

SEQ ID NO: 462252 - RNA, 19 nt, Homo sapiens
cggcuuagacuucgacuca

SEQ ID NO: 462253 - RNA, 19 nt, Homo sapiens
ccaccucacuccuguuacu

SEQ ID NO: 462254 - RNA, 19 nt, Homo sapiens
ucgagacacuugccuucuu

SEQ ID NO: 462255 - RNA, 19 nt, Homo sapiens
ggagaugaaggaagagagu

SEQ ID NO: 462256 - RNA, 19 nt, Homo sapiens
gacauucaaggcauuucua

SEQ ID NO: 462257 - RNA, 19 nt, Homo sapiens
cccagagaauauauacauu

SEQ ID NO: 462258 - RNA, 19 nt, Homo sapiens
cccaugaccugcaggagau

SEQ ID NO: 462259 - RNA, 19 nt, Homo sapiens
acacuggagucaucaaugc

SEQ ID NO: 462260 - RNA, 19 nt, Homo sapiens
aaacugggcaaguccuuug

SEQ ID NO: 462261 - RNA, 19 nt, Homo sapiens
gugaugcucaggcuugaaa

SEQ ID NO: 462262 - RNA, 19 nt, Homo sapiens
cuacccaaccacucaaauu

SEQ ID NO: 462263 - RNA, 19 nt, Homo sapiens
gggccaagagugugcuaaa

SEQ ID NO: 462264 - RNA, 19 nt, Homo sapiens
gaggguaggagguuuggau

SEQ ID NO: 462265 - RNA, 19 nt, Homo sapiens
gcccuguuguguauagaug

SEQ ID NO: 462266 - RNA, 19 nt, Homo sapiens
ucagacaagcaacagguuu

SEQ ID NO: 462267 - RNA, 19 nt, Homo sapiens
uugcucaaaucuauucaga

SEQ ID NO: 462268 - RNA, 19 nt, Homo sapiens
gcaaagcacuuauugauua

SEQ ID NO: 462269 - RNA, 19 nt, Homo sapiens
gcaauaaguuccauguuaa

SEQ ID NO: 462270 - RNA, 19 nt, Homo sapiens
ggaaauacacagaugauua

SEQ ID NO: 462271 - RNA, 19 nt, Homo sapiens
ggcaauaaguuccauguua

SEQ ID NO: 462272 - RNA, 19 nt, Homo sapiens
gcaggugguucuaauauuu

SEQ ID NO: 462273 - RNA, 19 nt, Homo sapiens
gcagaaagucucuauaauu

SEQ ID NO: 462274 - RNA, 19 nt, Homo sapiens
gaagagauuucaacauauc

SEQ ID NO: 462275 - RNA, 19 nt, Homo sapiens
caucagaaaugucaucaaa

SEQ ID NO: 462276 - RNA, 19 nt, Homo sapiens
cagaaagucucuauaauuc

SEQ ID NO: 462277 - RNA, 19 nt, Homo sapiens
gaugauuccuugagcauuu

SEQ ID NO: 462278 - RNA, 19 nt, Homo sapiens
gcauguggcucagcaauuu

SEQ ID NO: 462279 - RNA, 19 nt, Homo sapiens
gagcagaaagucucuauaa

SEQ ID NO: 462280 - RNA, 19 nt, Homo sapiens
gaucaauccuucuuauguu

SEQ ID NO: 462281 - RNA, 19 nt, Homo sapiens
ccagauaccuuuacaucaa

SEQ ID NO: 462282 - RNA, 19 nt, Homo sapiens
gaaaagcuaucaacaacua

SEQ ID NO: 462283 - RNA, 19 nt, Homo sapiens
gguacaauccuuugaguua

SEQ ID NO: 462284 - RNA, 19 nt, Homo sapiens
uagcguggguuaucaguua

SEQ ID NO: 462285 - RNA, 19 nt, Homo sapiens
gaucauauagcguggguua

SEQ ID NO: 462286 - RNA, 19 nt, Homo sapiens
agacaacucuuccauuuau

SEQ ID NO: 462287 - RNA, 19 nt, Homo sapiens
uagcaaacauucugucauu

SEQ ID NO: 462288 - RNA, 19 nt, Homo sapiens
gacaugaacagaaacaaua

SEQ ID NO: 462289 - RNA, 19 nt, Homo sapiens
ggacuugugcugcugaaua

SEQ ID NO: 462290 - RNA, 19 nt, Homo sapiens
gguuucaccugaucauaua

SEQ ID NO: 462291 - RNA, 19 nt, Homo sapiens
uggaauggauuauagagua

SEQ ID NO: 462292 - RNA, 19 nt, Homo sapiens
ggacuucuguggaccuuau

SEQ ID NO: 462293 - RNA, 19 nt, Homo sapiens
gaugaugucaccaaagaua

SEQ ID NO: 462294 - RNA, 19 nt, Homo sapiens
uaacacgcauuguacacua

SEQ ID NO: 462295 - RNA, 19 nt, Homo sapiens
auagacaacucuuccauuu

SEQ ID NO: 462296 - RNA, 19 nt, Homo sapiens
gaaagucucuauaauucag

SEQ ID NO: 462297 - RNA, 19 nt, Homo sapiens
ggaauggauuauagaguau

SEQ ID NO: 462298 - RNA, 19 nt, Homo sapiens
gacuugugcugcugaauaa

SEQ ID NO: 462299 - RNA, 19 nt, Homo sapiens
ggacacacuuggaagaauc

SEQ ID NO: 462300 - RNA, 19 nt, Homo sapiens
cagaugaacugcccacaau

SEQ ID NO: 462301 - RNA, 19 nt, Homo sapiens
ggauugaucacuuuguuaa

SEQ ID NO: 462302 - RNA, 19 nt, Homo sapiens
guuuguaacuuaugccuaa

SEQ ID NO: 462303 - RNA, 19 nt, Homo sapiens
ugacaggacucccaacuag

SEQ ID NO: 462304 - RNA, 19 nt, Homo sapiens
gaggaugcaacaaauauuu

SEQ ID NO: 462305 - RNA, 19 nt, Homo sapiens
gaugguaagacuguaauua

SEQ ID NO: 462306 - RNA, 19 nt, Homo sapiens
gauuagauucccaucaaua

SEQ ID NO: 462307 - RNA, 19 nt, Homo sapiens
uaauucagcucuucaccaa

SEQ ID NO: 462308 - RNA, 19 nt, Homo sapiens
guacaaugacagaagauaa

SEQ ID NO: 462309 - RNA, 19 nt, Homo sapiens
guacaauccuuugaguuau

SEQ ID NO: 462310 - RNA, 19 nt, Homo sapiens
gccaaaagcugcuguagaa

SEQ ID NO: 462311 - RNA, 19 nt, Homo sapiens
ugaauaaguucucuuggau

SEQ ID NO: 462312 - RNA, 19 nt, Homo sapiens
gagaagaagcaucgaguga

SEQ ID NO: 462313 - RNA, 19 nt, Homo sapiens
uaauuuagcaguccaaaga

SEQ ID NO: 462314 - RNA, 19 nt, Homo sapiens
aauaaguucucuuggauga

SEQ ID NO: 462315 - RNA, 19 nt, Homo sapiens
caaguuagaugaggaaguc

SEQ ID NO: 462316 - RNA, 19 nt, Homo sapiens
gggaccaucucauauacuu

SEQ ID NO: 462317 - RNA, 19 nt, Homo sapiens
uaugugcucucaucagaaa

SEQ ID NO: 462318 - RNA, 19 nt, Homo sapiens
caaacaaucaugagucaga

SEQ ID NO: 462319 - RNA, 19 nt, Homo sapiens
gauuagacuuggacucuca

SEQ ID NO: 462320 - RNA, 19 nt, Homo sapiens
ggaaugagugggauguuug

SEQ ID NO: 462321 - RNA, 19 nt, Homo sapiens
aaucaaagccauguuagua

SEQ ID NO: 462322 - RNA, 19 nt, Homo sapiens
ucacauacacucaaacaau

SEQ ID NO: 462323 - RNA, 19 nt, Homo sapiens
ugagugggauguuuguuug

SEQ ID NO: 462324 - RNA, 19 nt, Homo sapiens
gcaaacauucugucauuag

SEQ ID NO: 462325 - RNA, 19 nt, Homo sapiens
guccaaagaacaagaaauu

SEQ ID NO: 462326 - RNA, 19 nt, Homo sapiens
ccacugaacauuugcuuug

SEQ ID NO: 462327 - RNA, 19 nt, Homo sapiens
gcagggugcuaacguaucu

SEQ ID NO: 462328 - RNA, 19 nt, Homo sapiens
ggaauuuucuuacccauau

SEQ ID NO: 462329 - RNA, 19 nt, Homo sapiens
ucacugcugucucuguauu

SEQ ID NO: 462330 - RNA, 19 nt, Homo sapiens
gaugucaccaaagauauua

SEQ ID NO: 462331 - RNA, 19 nt, Homo sapiens
aaacaaagcuugaaaagac

SEQ ID NO: 462332 - RNA, 19 nt, Homo sapiens
caaacauucugucauuagu

SEQ ID NO: 462333 - RNA, 19 nt, Homo sapiens
cuacauaggcaaauuggaa

SEQ ID NO: 462334 - RNA, 19 nt, Homo sapiens
caaagcacuuauugauuag

SEQ ID NO: 462335 - RNA, 19 nt, Homo sapiens
ucauaaauguucagcuuca

SEQ ID NO: 462336 - RNA, 19 nt, Homo sapiens
uguggcagcugcucaacua

SEQ ID NO: 462337 - RNA, 19 nt, Homo sapiens
gcacugaucaauccuucuu

SEQ ID NO: 462338 - RNA, 19 nt, Homo sapiens
aaucaugagucagacauuu

SEQ ID NO: 462339 - RNA, 19 nt, Homo sapiens
gacguucucucuuucuaau

SEQ ID NO: 462340 - RNA, 19 nt, Homo sapiens
ggcaggugguucuaauauu

SEQ ID NO: 462341 - RNA, 19 nt, Homo sapiens
uuugucagcuucuuugaaa

SEQ ID NO: 462342 - RNA, 19 nt, Homo sapiens
ucacgggcauucuuauuag

SEQ ID NO: 462343 - RNA, 19 nt, Homo sapiens
cuucauaaauguucagcuu

SEQ ID NO: 462344 - RNA, 19 nt, Homo sapiens
agucagacauuugguauau

SEQ ID NO: 462345 - RNA, 19 nt, Homo sapiens
cauguggaauggauuauag

SEQ ID NO: 462346 - RNA, 19 nt, Homo sapiens
gucacgggcauucuuauua

SEQ ID NO: 462347 - RNA, 19 nt, Homo sapiens
ggacuauauugugggcuaa

SEQ ID NO: 462348 - RNA, 19 nt, Homo sapiens
gaccaucucauauacuuau

SEQ ID NO: 462349 - RNA, 19 nt, Homo sapiens
aaacagacuuuagcuuaca

SEQ ID NO: 462350 - RNA, 19 nt, Homo sapiens
gauucuagccaaacuauuc

SEQ ID NO: 462351 - RNA, 19 nt, Homo sapiens
cuggaaagacugauuguuu

SEQ ID NO: 462352 - RNA, 19 nt, Homo sapiens
cacauacacucaaacaauc

SEQ ID NO: 462353 - RNA, 19 nt, Homo sapiens
ugaggaaauugcugcagaa

SEQ ID NO: 462354 - RNA, 19 nt, Homo sapiens
cuguggaccuuauguguuu

SEQ ID NO: 462355 - RNA, 19 nt, Homo sapiens
guacauugcggacuucugu

SEQ ID NO: 462356 - RNA, 19 nt, Homo sapiens
aaauugggaccaucucaua

SEQ ID NO: 462357 - RNA, 19 nt, Homo sapiens
aagaaucaaagccauguua

SEQ ID NO: 462358 - RNA, 19 nt, Homo sapiens
uaucaacaguacagaugaa

SEQ ID NO: 462359 - RNA, 19 nt, Homo sapiens
gauaugacauuggugugau

SEQ ID NO: 462360 - RNA, 19 nt, Homo sapiens
caaauuggaaauacacaga

SEQ ID NO: 462361 - RNA, 19 nt, Homo sapiens
aaauaaucgucuccuuuga

SEQ ID NO: 462362 - RNA, 19 nt, Homo sapiens
ggaaagacugauuguuuua

SEQ ID NO: 462363 - RNA, 19 nt, Homo sapiens
gcugagaagauuagacuug

SEQ ID NO: 462364 - RNA, 19 nt, Homo sapiens
cugaauaaguucucuugga

SEQ ID NO: 462365 - RNA, 19 nt, Homo sapiens
gcgacguucucucuuucua

SEQ ID NO: 462366 - RNA, 19 nt, Homo sapiens
auucagcucuucaccaauu

SEQ ID NO: 462367 - RNA, 19 nt, Homo sapiens
cagaggauaugaugauguc

SEQ ID NO: 462368 - RNA, 19 nt, Homo sapiens
gcacauagcuaucgagugu

SEQ ID NO: 462369 - RNA, 19 nt, Homo sapiens
gcaaggaugucacaagaaa

SEQ ID NO: 462370 - RNA, 19 nt, Homo sapiens
aaagagagguuauagagua

SEQ ID NO: 462371 - RNA, 19 nt, Homo sapiens
ggaaguacguuauuguuga

SEQ ID NO: 462372 - RNA, 19 nt, Homo sapiens
ucaaugcuguguucuauua

SEQ ID NO: 462373 - RNA, 19 nt, Homo sapiens
gagcggagaucgcaucauu

SEQ ID NO: 462374 - RNA, 19 nt, Homo sapiens
gauggaaacucuuuaacuu

SEQ ID NO: 462375 - RNA, 19 nt, Homo sapiens
gaaauaacuccuucuugua

SEQ ID NO: 462376 - RNA, 19 nt, Homo sapiens
ggagagaccucaucaggau

SEQ ID NO: 462377 - RNA, 19 nt, Homo sapiens
ugaaauaacuccuucuugu

SEQ ID NO: 462378 - RNA, 19 nt, Homo sapiens
gaaacccugucucuacuaa

SEQ ID NO: 462379 - RNA, 19 nt, Homo sapiens
caacaggaaucuucaagga

SEQ ID NO: 462380 - RNA, 19 nt, Homo sapiens
gcucaugacuguuucuuug

SEQ ID NO: 462381 - RNA, 19 nt, Homo sapiens
gaagaaggacucugcauau

SEQ ID NO: 462382 - RNA, 19 nt, Homo sapiens
gaaguaaucccgccaccua

SEQ ID NO: 462383 - RNA, 19 nt, Homo sapiens
gaaggacucugcauaugau

SEQ ID NO: 462384 - RNA, 19 nt, Homo sapiens
gaauguaugugcacuguca

SEQ ID NO: 462385 - RNA, 19 nt, Homo sapiens
gggaugagcuuugucugua

SEQ ID NO: 462386 - RNA, 19 nt, Homo sapiens
ggaagaaggacucugcaua

SEQ ID NO: 462387 - RNA, 19 nt, Homo sapiens
guacguuauuguugacuua

SEQ ID NO: 462388 - RNA, 19 nt, Homo sapiens
gaucaaugcuguguucuau

SEQ ID NO: 462389 - RNA, 19 nt, Homo sapiens
guauauauaugccaugaug

SEQ ID NO: 462390 - RNA, 19 nt, Homo sapiens
gaaccuaccuucauuucag

SEQ ID NO: 462391 - RNA, 19 nt, Homo sapiens
ggacauccucuucugcuua

SEQ ID NO: 462392 - RNA, 19 nt, Homo sapiens
aaucggcucuuuccaauuu

SEQ ID NO: 462393 - RNA, 19 nt, Homo sapiens
gcaacuucaugucaacuuu

SEQ ID NO: 462394 - RNA, 19 nt, Homo sapiens
gccaaacccuugucaguga

SEQ ID NO: 462395 - RNA, 19 nt, Homo sapiens
ggacuugaaucuuuccaau

SEQ ID NO: 462396 - RNA, 19 nt, Homo sapiens
gaaggaaauugagauuaga

SEQ ID NO: 462397 - RNA, 19 nt, Homo sapiens
gggcaucguuguuggaauu

SEQ ID NO: 462398 - RNA, 19 nt, Homo sapiens
cugagaagauugugaauau

SEQ ID NO: 462399 - RNA, 19 nt, Homo sapiens
agagggagguguuuaaaga

SEQ ID NO: 462400 - RNA, 19 nt, Homo sapiens
cgaaugugcagguuuguua

SEQ ID NO: 462401 - RNA, 19 nt, Homo sapiens
ggaggguguuuauguaaga

SEQ ID NO: 462402 - RNA, 19 nt, Homo sapiens
gagaagaucauaaaggaau

SEQ ID NO: 462403 - RNA, 19 nt, Homo sapiens
ggagagccauccaaauaag

SEQ ID NO: 462404 - RNA, 19 nt, Homo sapiens
cgacagcccaucaucauuu

SEQ ID NO: 462405 - RNA, 19 nt, Homo sapiens
gugcaaggaugucacaaga

SEQ ID NO: 462406 - RNA, 19 nt, Homo sapiens
uaacuaauaugggcauugu

SEQ ID NO: 462407 - RNA, 19 nt, Homo sapiens
agaaggaaauugagauuag

SEQ ID NO: 462408 - RNA, 19 nt, Homo sapiens
ugacaacuuugccagcuuu

SEQ ID NO: 462409 - RNA, 19 nt, Homo sapiens
cgagugugcuuuagcuuga

SEQ ID NO: 462410 - RNA, 19 nt, Homo sapiens
gaugagcuuugucuguauu

SEQ ID NO: 462411 - RNA, 19 nt, Homo sapiens
caugacuguuucuuuguua

SEQ ID NO: 462412 - RNA, 19 nt, Homo sapiens
gggagagccauccaaauaa

SEQ ID NO: 462413 - RNA, 19 nt, Homo sapiens
ggaagcagauacauaugag

SEQ ID NO: 462414 - RNA, 19 nt, Homo sapiens
ccaggaagcagauacauau

SEQ ID NO: 462415 - RNA, 19 nt, Homo sapiens
cacuguaguuucucuauuu

SEQ ID NO: 462416 - RNA, 19 nt, Homo sapiens
ugggagagccauccaaaua

SEQ ID NO: 462417 - RNA, 19 nt, Homo sapiens
acacaucucagacccuuua

SEQ ID NO: 462418 - RNA, 19 nt, Homo sapiens
gagcgauuauuaucuaaag

SEQ ID NO: 462419 - RNA, 19 nt, Homo sapiens
cuacuuaauuccuuucuca

SEQ ID NO: 462420 - RNA, 19 nt, Homo sapiens
gauccugggucgcuugguu

SEQ ID NO: 462421 - RNA, 19 nt, Homo sapiens
gaugguugauggguucuaa

SEQ ID NO: 462422 - RNA, 19 nt, Homo sapiens
gaucuuuggucuggaauuc

SEQ ID NO: 462423 - RNA, 19 nt, Homo sapiens
cugagaagaucauaaagga

SEQ ID NO: 462424 - RNA, 19 nt, Homo sapiens
ucugagcgauuauuaucua

SEQ ID NO: 462425 - RNA, 19 nt, Homo sapiens
gagagguuauagaguagaa

SEQ ID NO: 462426 - RNA, 19 nt, Homo sapiens
ucugaaugcugcuacuuaa

SEQ ID NO: 462427 - RNA, 19 nt, Homo sapiens
ccaggacgcuucugaaugc

SEQ ID NO: 462428 - RNA, 19 nt, Homo sapiens
gaacccaggacgcuucuga

SEQ ID NO: 462429 - RNA, 19 nt, Homo sapiens
cccauucccugguuuauug

SEQ ID NO: 462430 - RNA, 19 nt, Homo sapiens
caucaaugcuccugagaag

SEQ ID NO: 462431 - RNA, 19 nt, Homo sapiens
uugcggagauuauaaauag

SEQ ID NO: 462432 - RNA, 19 nt, Homo sapiens
guucuuaguucucacuguu

SEQ ID NO: 462433 - RNA, 19 nt, Homo sapiens
uaucuaaaguguguuguug

SEQ ID NO: 462434 - RNA, 19 nt, Homo sapiens
gucuguacguuaccucuua

SEQ ID NO: 462435 - RNA, 19 nt, Homo sapiens
gccggaggguguuuaugua

SEQ ID NO: 462436 - RNA, 19 nt, Homo sapiens
ugaaugcugcuacuuaauu

SEQ ID NO: 462437 - RNA, 19 nt, Homo sapiens
uccaggagaugaaagauga

SEQ ID NO: 462438 - RNA, 19 nt, Homo sapiens
ggaugagcuuugucuguau

SEQ ID NO: 462439 - RNA, 19 nt, Homo sapiens
gaaagggcaggaagaagga

SEQ ID NO: 462440 - RNA, 19 nt, Homo sapiens
aauacuaucuucacuguag

SEQ ID NO: 462441 - RNA, 19 nt, Homo sapiens
caucacaguugcuacaauc

SEQ ID NO: 462442 - RNA, 19 nt, Homo sapiens
gcaucgagccugcuaagga

SEQ ID NO: 462443 - RNA, 19 nt, Homo sapiens
ggaugcagguguucaagag

SEQ ID NO: 462444 - RNA, 19 nt, Homo sapiens
uaaagcuacugauuuccuu

SEQ ID NO: 462445 - RNA, 19 nt, Homo sapiens
guagcuaagucgguugaaa

SEQ ID NO: 462446 - RNA, 19 nt, Homo sapiens
uuacucugguucuuuguuu

SEQ ID NO: 462447 - RNA, 19 nt, Homo sapiens
ccauauggauuuucuauug

SEQ ID NO: 462448 - RNA, 19 nt, Homo sapiens
cuugaagacuugaauuaga

SEQ ID NO: 462449 - RNA, 19 nt, Homo sapiens
gagauuagagggagguguu

SEQ ID NO: 462450 - RNA, 19 nt, Homo sapiens
guuccacgcucaugacugu

SEQ ID NO: 462451 - RNA, 19 nt, Homo sapiens
uaucuucacuguaguuucu

SEQ ID NO: 462452 - RNA, 19 nt, Homo sapiens
aagaagaggagaaugcuaa

SEQ ID NO: 462453 - RNA, 19 nt, Homo sapiens
acaaucggcucuuuccaau

SEQ ID NO: 462454 - RNA, 19 nt, Homo sapiens
gauauuugccaucacaguu

SEQ ID NO: 462455 - RNA, 19 nt, Homo sapiens
aacaguagguuggcaguaa

SEQ ID NO: 462456 - RNA, 19 nt, Homo sapiens
uaugugcacugucacuuug

SEQ ID NO: 462457 - RNA, 19 nt, Homo sapiens
cagaaggaaauugagauua

SEQ ID NO: 462458 - RNA, 19 nt, Homo sapiens
ccucugguuuaauuacaua

SEQ ID NO: 462459 - RNA, 19 nt, Homo sapiens
gaccaccaccaaugucuaa

SEQ ID NO: 462460 - RNA, 19 nt, Homo sapiens
ucacuguaguuucucuauu

SEQ ID NO: 462461 - RNA, 19 nt, Homo sapiens
gaugaaauaacuccuucuu

SEQ ID NO: 462462 - RNA, 19 nt, Homo sapiens
aauaugggcauuguaguua

SEQ ID NO: 462463 - RNA, 19 nt, Homo sapiens
gcagguuuguuacauaggu

SEQ ID NO: 462464 - RNA, 19 nt, Homo sapiens
cagcagcucucugggauca

SEQ ID NO: 462465 - RNA, 19 nt, Homo sapiens
caucaucauuuccauugug

SEQ ID NO: 462466 - RNA, 19 nt, Homo sapiens
guaaggcagggucccauuu

SEQ ID NO: 462467 - RNA, 19 nt, Homo sapiens
gaaguacguuauuguugac

SEQ ID NO: 462468 - RNA, 19 nt, Homo sapiens
gcacagaacuugaguauuu

SEQ ID NO: 462469 - RNA, 19 nt, Homo sapiens
gaacagagcuacaaugaga

SEQ ID NO: 462470 - RNA, 19 nt, Homo sapiens
uggcugagcugaaggauga

SEQ ID NO: 462471 - RNA, 19 nt, Homo sapiens
gaucgguucuuucaucuuc

SEQ ID NO: 462472 - RNA, 19 nt, Homo sapiens
gugugacucucuuggauua

SEQ ID NO: 462473 - RNA, 19 nt, Homo sapiens
agacucagcuccagaauac

SEQ ID NO: 462474 - RNA, 19 nt, Homo sapiens
aacccucucuucccuauua

SEQ ID NO: 462475 - RNA, 19 nt, Homo sapiens
gcagcucucuggcaucaau

SEQ ID NO: 462476 - RNA, 19 nt, Homo sapiens
ggacaaaccagagcagaga

SEQ ID NO: 462477 - RNA, 19 nt, Homo sapiens
cacagaacuugaguauuua

SEQ ID NO: 462478 - RNA, 19 nt, Homo sapiens
gagacaagaaauccaguuu

SEQ ID NO: 462479 - RNA, 19 nt, Homo sapiens
uggcauggguuuccaguau

SEQ ID NO: 462480 - RNA, 19 nt, Homo sapiens
ggacaggagacaagaaauc

SEQ ID NO: 462481 - RNA, 19 nt, Homo sapiens
gcugcugccuccuaugaaa

SEQ ID NO: 462482 - RNA, 19 nt, Homo sapiens
gcucauccuuggacgauuc

SEQ ID NO: 462483 - RNA, 19 nt, Homo sapiens
cagauaggcuccgaagaug

SEQ ID NO: 462484 - RNA, 19 nt, Homo sapiens
caggaucgguucuuucauc

SEQ ID NO: 462485 - RNA, 19 nt, Homo sapiens
gcauggguuuccaguaugu

SEQ ID NO: 462486 - RNA, 19 nt, Homo sapiens
ugacucucuuggauuauuu

SEQ ID NO: 462487 - RNA, 19 nt, Homo sapiens
acgagcaacuucaucauug

SEQ ID NO: 462488 - RNA, 19 nt, Homo sapiens
ucaaccaacuggccauugu

SEQ ID NO: 462489 - RNA, 19 nt, Homo sapiens
gggccaugcuggucaacaa

SEQ ID NO: 462490 - RNA, 19 nt, Homo sapiens
caucaaugcuguuuucuau

SEQ ID NO: 462491 - RNA, 19 nt, Homo sapiens
cagcagcucucuggcauca

SEQ ID NO: 462492 - RNA, 19 nt, Homo sapiens
ggugaaacccagcacagaa

SEQ ID NO: 462493 - RNA, 19 nt, Homo sapiens
cuacgucuuccuucuauuu

SEQ ID NO: 462494 - RNA, 19 nt, Homo sapiens
gcaguuuggguacaacauu

SEQ ID NO: 462495 - RNA, 19 nt, Homo sapiens
cagcacagaacuugaguau

SEQ ID NO: 462496 - RNA, 19 nt, Homo sapiens
gacgagcaacuucaucauu

SEQ ID NO: 462497 - RNA, 19 nt, Homo sapiens
gugacucucuuggauuauu

SEQ ID NO: 462498 - RNA, 19 nt, Homo sapiens
gcacuuuaacccucucuuc

SEQ ID NO: 462499 - RNA, 19 nt, Homo sapiens
acagauaggcuccgaagau

SEQ ID NO: 462500 - RNA, 19 nt, Homo sapiens
ccauggcuguggcugguuu

SEQ ID NO: 462501 - RNA, 19 nt, Homo sapiens
ugagcuacgucuccauugu

SEQ ID NO: 462502 - RNA, 19 nt, Homo sapiens
caguuuggguacaacauug

SEQ ID NO: 462503 - RNA, 19 nt, Homo sapiens
ggagacaagaaauccaguu

SEQ ID NO: 462504 - RNA, 19 nt, Homo sapiens
gagcaggacaggagacaag

SEQ ID NO: 462505 - RNA, 19 nt, Homo sapiens
ucauugguaucaucucuca

SEQ ID NO: 462506 - RNA, 19 nt, Homo sapiens
caacuggacgagcaacuuc

SEQ ID NO: 462507 - RNA, 19 nt, Homo sapiens
ucaacacagucuucaccuu

SEQ ID NO: 462508 - RNA, 19 nt, Homo sapiens
cuuggacgauuccucauug

SEQ ID NO: 462509 - RNA, 19 nt, Homo sapiens
caggacaggagacaagaaa

SEQ ID NO: 462510 - RNA, 19 nt, Homo sapiens
cagacucagcuccagaaua

SEQ ID NO: 462511 - RNA, 19 nt, Homo sapiens
ccugcagccugguagaauu

SEQ ID NO: 462512 - RNA, 19 nt, Homo sapiens
caccggacacccucucuuu

SEQ ID NO: 462513 - RNA, 19 nt, Homo sapiens
gcgcguccagcucuucuaa

SEQ ID NO: 462514 - RNA, 19 nt, Homo sapiens
gauuuccuccuuccucauu

SEQ ID NO: 462515 - RNA, 19 nt, Homo sapiens
ggacuccucccacaaucug

SEQ ID NO: 462516 - RNA, 19 nt, Homo sapiens
ccucucuucccuauuauuu

SEQ ID NO: 462517 - RNA, 19 nt, Homo sapiens
ggcauggguuuccaguaug

SEQ ID NO: 462518 - RNA, 19 nt, Homo sapiens
ucaguggcuuggaaggaaa

SEQ ID NO: 462519 - RNA, 19 nt, Homo sapiens
cugcugggcuucuucaucu

SEQ ID NO: 462520 - RNA, 19 nt, Homo sapiens
gagcuacgucuccauugug

SEQ ID NO: 462521 - RNA, 19 nt, Homo sapiens
aaccaacuggccauuguua

SEQ ID NO: 462522 - RNA, 19 nt, Homo sapiens
cucagaaggugauugaaca

SEQ ID NO: 462523 - RNA, 19 nt, Homo sapiens
gcaggacaggagacaagaa

SEQ ID NO: 462524 - RNA, 19 nt, Homo sapiens
uugaacagagcuacaauga

SEQ ID NO: 462525 - RNA, 19 nt, Homo sapiens
uuaacccucucuucccuau

SEQ ID NO: 462526 - RNA, 19 nt, Homo sapiens
gaaacccagcacagaacuu

SEQ ID NO: 462527 - RNA, 19 nt, Homo sapiens
cgagcaacuucaucauugg

SEQ ID NO: 462528 - RNA, 19 nt, Homo sapiens
ggccauuguuaucggcauu

SEQ ID NO: 462529 - RNA, 19 nt, Homo sapiens
ccaacuggccauuguuauc

SEQ ID NO: 462530 - RNA, 19 nt, Homo sapiens
ccaugcuggucaacaaugu

SEQ ID NO: 462531 - RNA, 19 nt, Homo sapiens
cuucaucuucaccuucuua

SEQ ID NO: 462532 - RNA, 19 nt, Homo sapiens
caugagcuacgucuccauu

SEQ ID NO: 462533 - RNA, 19 nt, Homo sapiens
caaccaacuggccauuguu

SEQ ID NO: 462534 - RNA, 19 nt, Homo sapiens
aaagggccaugcuggucaa

SEQ ID NO: 462535 - RNA, 19 nt, Homo sapiens
aaacccagcacagaacuug

SEQ ID NO: 462536 - RNA, 19 nt, Homo sapiens
ggacgagcaacuucaucau

SEQ ID NO: 462537 - RNA, 19 nt, Homo sapiens
gcccuacgucuuccuucua

SEQ ID NO: 462538 - RNA, 19 nt, Homo sapiens
caucguggccgagcucuuc

SEQ ID NO: 462539 - RNA, 19 nt, Homo sapiens
ccucauugguaucaucucu

SEQ ID NO: 462540 - RNA, 19 nt, Homo sapiens
ccuccuuccucauugguau

SEQ ID NO: 462541 - RNA, 19 nt, Homo sapiens
acuccaggaucgguucuuu

SEQ ID NO: 462542 - RNA, 19 nt, Homo sapiens
ccgucgggcuuccaacaga

SEQ ID NO: 462543 - RNA, 19 nt, Homo sapiens
cccuacgucuuccuucuau

SEQ ID NO: 462544 - RNA, 19 nt, Homo sapiens
gcggcaugauuuccuccuu

SEQ ID NO: 462545 - RNA, 19 nt, Homo sapiens
gguccuugcuguguucucu

SEQ ID NO: 462546 - RNA, 19 nt, Homo sapiens
gagcgaguuccagccauga

SEQ ID NO: 462547 - RNA, 19 nt, Homo sapiens
caacuggccauuguuaucg

SEQ ID NO: 462548 - RNA, 19 nt, Homo sapiens
cucaguggcuuggaaggaa

SEQ ID NO: 462549 - RNA, 19 nt, Homo sapiens
gcuuggcucccugcaguuu

SEQ ID NO: 462550 - RNA, 19 nt, Homo sapiens
ccggacacccucucuuuua

SEQ ID NO: 462551 - RNA, 19 nt, Homo sapiens
gaccagcaucuucgagaca

SEQ ID NO: 462552 - RNA, 19 nt, Homo sapiens
agaaauaccugucuaggaa

SEQ ID NO: 462553 - RNA, 19 nt, Homo sapiens
aaacaacucugauguggaa

SEQ ID NO: 462554 - RNA, 19 nt, Homo sapiens
aaaugaaccugaucacuuu

SEQ ID NO: 462555 - RNA, 19 nt, Homo sapiens
gggaauaugugcaggugua

SEQ ID NO: 462556 - RNA, 19 nt, Homo sapiens
caacaacaguuacuauagu

SEQ ID NO: 462557 - RNA, 19 nt, Homo sapiens
ugaauaaggugucugaagu

SEQ ID NO: 462558 - RNA, 19 nt, Homo sapiens
gauggaaggaaucaaauuu

SEQ ID NO: 462559 - RNA, 19 nt, Homo sapiens
gccaagacguucauagaga

SEQ ID NO: 462560 - RNA, 19 nt, Homo sapiens
caacguggcugcugucaac

SEQ ID NO: 462561 - RNA, 19 nt, Homo sapiens
ucagaauucuucauccaaa

SEQ ID NO: 462562 - RNA, 19 nt, Homo sapiens
gaaacaaugacauccagaa

SEQ ID NO: 462563 - RNA, 19 nt, Homo sapiens
gagcaagcauggagcaaca

SEQ ID NO: 462564 - RNA, 19 nt, Homo sapiens
ccacaucauuugagcuuau

SEQ ID NO: 462565 - RNA, 19 nt, Homo sapiens
gaaucuccuugcaaacgua

SEQ ID NO: 462566 - RNA, 19 nt, Homo sapiens
gugaauaaauuuggcagaa

SEQ ID NO: 462567 - RNA, 19 nt, Homo sapiens
ucaacgcuaucuacuacua

SEQ ID NO: 462568 - RNA, 19 nt, Homo sapiens
gcccagaucuuuggucuuc

SEQ ID NO: 462569 - RNA, 19 nt, Homo sapiens
ucaccaagaugaauaaggu

SEQ ID NO: 462570 - RNA, 19 nt, Homo sapiens
ucauagagaucaaccagau

SEQ ID NO: 462571 - RNA, 19 nt, Homo sapiens
gaaggugugaugucagaaa

SEQ ID NO: 462572 - RNA, 19 nt, Homo sapiens
uaaggugucugaaguguac

SEQ ID NO: 462573 - RNA, 19 nt, Homo sapiens
ccagaaagcugaggaacag

SEQ ID NO: 462574 - RNA, 19 nt, Homo sapiens
cugugaauauccagaaaua

SEQ ID NO: 462575 - RNA, 19 nt, Homo sapiens
ugucaucuccuacgucaua

SEQ ID NO: 462576 - RNA, 19 nt, Homo sapiens
gaucuuuggucuucggaau

SEQ ID NO: 462577 - RNA, 19 nt, Homo sapiens
cagagucgccacaucauuu

SEQ ID NO: 462578 - RNA, 19 nt, Homo sapiens
gcacugcucaugcaacaau

SEQ ID NO: 462579 - RNA, 19 nt, Homo sapiens
ccaagacguucauagagau

SEQ ID NO: 462580 - RNA, 19 nt, Homo sapiens
ggccaugggcauuuguuua

SEQ ID NO: 462581 - RNA, 19 nt, Homo sapiens
uggaauugcuucuguguag

SEQ ID NO: 462582 - RNA, 19 nt, Homo sapiens
ggaaugcaguccucaucuc

SEQ ID NO: 462583 - RNA, 19 nt, Homo sapiens
cgucaacgcuaucuacuac

SEQ ID NO: 462584 - RNA, 19 nt, Homo sapiens
caaugagacuuacuauggu

SEQ ID NO: 462585 - RNA, 19 nt, Homo sapiens
acaaugagacuuacuaugg

SEQ ID NO: 462586 - RNA, 19 nt, Homo sapiens
ggucauccuuccaguaugg

SEQ ID NO: 462587 - RNA, 19 nt, Homo sapiens
gaauaaggugucugaagug

SEQ ID NO: 462588 - RNA, 19 nt, Homo sapiens
ggugugaugucagaaacaa

SEQ ID NO: 462589 - RNA, 19 nt, Homo sapiens
aaugagacuuacuauggua

SEQ ID NO: 462590 - RNA, 19 nt, Homo sapiens
aaacaaugacauccagaaa

SEQ ID NO: 462591 - RNA, 19 nt, Homo sapiens
ugagauggaaggaaucaaa

SEQ ID NO: 462592 - RNA, 19 nt, Homo sapiens
guggugagauggaaggaau

SEQ ID NO: 462593 - RNA, 19 nt, Homo sapiens
ggaaucuccuugcaaacgu

SEQ ID NO: 462594 - RNA, 19 nt, Homo sapiens
gcagagucgccacaucauu

SEQ ID NO: 462595 - RNA, 19 nt, Homo sapiens
caacaggaucagagcauga

SEQ ID NO: 462596 - RNA, 19 nt, Homo sapiens
cggaggagcacgugcagua

SEQ ID NO: 462597 - RNA, 19 nt, Homo sapiens
gcuucuguguagucaauaa

SEQ ID NO: 462598 - RNA, 19 nt, Homo sapiens
cuaggaaggugugauguca

SEQ ID NO: 462599 - RNA, 19 nt, Homo sapiens
gagccaaauucauccucuu

SEQ ID NO: 462600 - RNA, 19 nt, Homo sapiens
ggaaaaggaggaacugaaa

SEQ ID NO: 462601 - RNA, 19 nt, Homo sapiens
gcauggagcaacaggauca

SEQ ID NO: 462602 - RNA, 19 nt, Homo sapiens
gagcuuaucauuauuucca

SEQ ID NO: 462603 - RNA, 19 nt, Homo sapiens
gaaagcugaggaacagguu

SEQ ID NO: 462604 - RNA, 19 nt, Homo sapiens
acaaugacauccagaaagc

SEQ ID NO: 462605 - RNA, 19 nt, Homo sapiens
cagaauucuucauccaaau

SEQ ID NO: 462606 - RNA, 19 nt, Homo sapiens
cagaaauaccugucuagga

SEQ ID NO: 462607 - RNA, 19 nt, Homo sapiens
ucagugcacgcguuacuuu

SEQ ID NO: 462608 - RNA, 19 nt, Homo sapiens
cagcagagucgccacauca

SEQ ID NO: 462609 - RNA, 19 nt, Homo sapiens
uaggaccggugaauucaug

SEQ ID NO: 462610 - RNA, 19 nt, Homo sapiens
gccaggggcuucccacuuu

SEQ ID NO: 462611 - RNA, 19 nt, Homo sapiens
auagagaucaaccagauuu

SEQ ID NO: 462612 - RNA, 19 nt, Homo sapiens
gcacuggcucuccaacuuc

SEQ ID NO: 462613 - RNA, 19 nt, Homo sapiens
gcagcagagucgccacauc

SEQ ID NO: 462614 - RNA, 19 nt, Homo sapiens
ugacguugcuguggucugu

SEQ ID NO: 462615 - RNA, 19 nt, Homo sapiens
gugaauucauggaagacuu

SEQ ID NO: 462616 - RNA, 19 nt, Homo sapiens
gagauggaaggaaucaaau

SEQ ID NO: 462617 - RNA, 19 nt, Homo sapiens
ccguacagcuucauugucu

SEQ ID NO: 462618 - RNA, 19 nt, Homo sapiens
caccagacccgagucaauu

SEQ ID NO: 462619 - RNA, 19 nt, Homo sapiens
ggcuugaucuucccguuca

SEQ ID NO: 462620 - RNA, 19 nt, Homo sapiens
ccgcgcugcucaucacuga

SEQ ID NO: 462621 - RNA, 19 nt, Homo sapiens
acagggagguggccgagau

SEQ ID NO: 462622 - RNA, 19 nt, Homo sapiens
ggaauugcuucuguguagu

SEQ ID NO: 462623 - RNA, 19 nt, Homo sapiens
aggaaggugugaugucaga

SEQ ID NO: 462624 - RNA, 19 nt, Homo sapiens
caagaugaauaaggugucu

SEQ ID NO: 462625 - RNA, 19 nt, Homo sapiens
ucaccaccaucuacaucuu

SEQ ID NO: 462626 - RNA, 19 nt, Homo sapiens
gugcagguguaucuuccaa

SEQ ID NO: 462627 - RNA, 19 nt, Homo sapiens
gaagcugggcugucucucu

SEQ ID NO: 462628 - RNA, 19 nt, Homo sapiens
caucuacaucuucuugauu

SEQ ID NO: 462629 - RNA, 19 nt, Homo sapiens
ccaucuacaucuucuugau

SEQ ID NO: 462630 - RNA, 19 nt, Homo sapiens
guacagcuucauugucuuc

SEQ ID NO: 462631 - RNA, 19 nt, Homo sapiens
guaaccguguccauguuuc

SEQ ID NO: 462632 - RNA, 19 nt, Homo sapiens
guuuagagccaaauucauc

SEQ ID NO: 462633 - RNA, 19 nt, Homo sapiens
uuacuauaguggugagaug

SEQ ID NO: 462634 - RNA, 19 nt, Homo sapiens
cagcugguccuccacuuug

SEQ ID NO: 462635 - RNA, 19 nt, Homo sapiens
ggcugucucucuccauguu

SEQ ID NO: 462636 - RNA, 19 nt, Homo sapiens
gccaagaaagcccuacaga

SEQ ID NO: 462637 - RNA, 19 nt, Homo sapiens
ccggugaauucauggaaga

SEQ ID NO: 462638 - RNA, 19 nt, Homo sapiens
gccaugggcauuuguuuag

SEQ ID NO: 462639 - RNA, 19 nt, Homo sapiens
ccagacccgagucaauuaa

SEQ ID NO: 462640 - RNA, 19 nt, Homo sapiens
gagacuuacuaugguagga

SEQ ID NO: 462641 - RNA, 19 nt, Homo sapiens
aacaacaguuacuauagug

SEQ ID NO: 462642 - RNA, 19 nt, Homo sapiens
gggcugccuugcuguucuu

SEQ ID NO: 462643 - RNA, 19 nt, Homo sapiens
aauaaggugucugaagugu

SEQ ID NO: 462644 - RNA, 19 nt, Homo sapiens
agaccaaggccaagacguu

SEQ ID NO: 462645 - RNA, 19 nt, Homo sapiens
gaauugcuucuguguaguc

SEQ ID NO: 462646 - RNA, 19 nt, Homo sapiens
ccugguaacauaacaacaa

SEQ ID NO: 462647 - RNA, 19 nt, Homo sapiens
uguggcuccugguaacaua

SEQ ID NO: 462648 - RNA, 19 nt, Homo sapiens
gcaguccucucggccaucu

SEQ ID NO: 462649 - RNA, 19 nt, Homo sapiens
cugcugggcuucuccaucu

SEQ ID NO: 462650 - RNA, 19 nt, Homo sapiens
aagggaggcugacgcuugu

SEQ ID NO: 462651 - RNA, 19 nt, Homo sapiens
acaacaacaguuacuauag

SEQ ID NO: 462652 - RNA, 19 nt, Homo sapiens
gaaagguucucaaauguuu

SEQ ID NO: 462653 - RNA, 19 nt, Homo sapiens
gagaugagauccaaguaaa

SEQ ID NO: 462654 - RNA, 19 nt, Homo sapiens
agagauagaugcuuuguuu

SEQ ID NO: 462655 - RNA, 19 nt, Homo sapiens
gauaugguguugaagauuu

SEQ ID NO: 462656 - RNA, 19 nt, Homo sapiens
agacauggcugaagauaaa

SEQ ID NO: 462657 - RNA, 19 nt, Homo sapiens
gaaagagcaaccugauuua

SEQ ID NO: 462658 - RNA, 19 nt, Homo sapiens
gagagggacucaucuuuga

SEQ ID NO: 462659 - RNA, 19 nt, Homo sapiens
gaaauuggaaugggaaaua

SEQ ID NO: 462660 - RNA, 19 nt, Homo sapiens
gaacuccuauaacuuacua

SEQ ID NO: 462661 - RNA, 19 nt, Homo sapiens
ccaaacagcuuucagagau

SEQ ID NO: 462662 - RNA, 19 nt, Homo sapiens
gaucggcuuugaaguuaua

SEQ ID NO: 462663 - RNA, 19 nt, Homo sapiens
caaaggguguugaugguuu

SEQ ID NO: 462664 - RNA, 19 nt, Homo sapiens
gaacggagaucugaaaggu

SEQ ID NO: 462665 - RNA, 19 nt, Homo sapiens
gaugagauccaaguaaaua

SEQ ID NO: 462666 - RNA, 19 nt, Homo sapiens
gcaguaaaguugauacaag

SEQ ID NO: 462667 - RNA, 19 nt, Homo sapiens
cagaucggcuuugaaguua

SEQ ID NO: 462668 - RNA, 19 nt, Homo sapiens
caaagcaccugagagauga

SEQ ID NO: 462669 - RNA, 19 nt, Homo sapiens
ggugaacaaucauuaauuc

SEQ ID NO: 462670 - RNA, 19 nt, Homo sapiens
caaacagcuuucagagaua

SEQ ID NO: 462671 - RNA, 19 nt, Homo sapiens
gcaaagcaccugagagaug

SEQ ID NO: 462672 - RNA, 19 nt, Homo sapiens
ugaaagagcaaccugauuu

SEQ ID NO: 462673 - RNA, 19 nt, Homo sapiens
gaacacaacacgaagaauc

SEQ ID NO: 462674 - RNA, 19 nt, Homo sapiens
gaaauauuguagccgcaaa

SEQ ID NO: 462675 - RNA, 19 nt, Homo sapiens
ggacucaucuuugaacaca

SEQ ID NO: 462676 - RNA, 19 nt, Homo sapiens
cgacaaaggcaguaaaguu

SEQ ID NO: 462677 - RNA, 19 nt, Homo sapiens
gaaucugguugcagccaua

SEQ ID NO: 462678 - RNA, 19 nt, Homo sapiens
gacaaaggcaguaaaguug

SEQ ID NO: 462679 - RNA, 19 nt, Homo sapiens
ggugagacauggcugaaga

SEQ ID NO: 462680 - RNA, 19 nt, Homo sapiens
ccgcaaaucucaaugaaag

SEQ ID NO: 462681 - RNA, 19 nt, Homo sapiens
gaacagcguguaugagguu

SEQ ID NO: 462682 - RNA, 19 nt, Homo sapiens
acucggagcuguaccauga

SEQ ID NO: 462683 - RNA, 19 nt, Homo sapiens
ccaaugcagugggacaaua

SEQ ID NO: 462684 - RNA, 19 nt, Homo sapiens
ggagagggacucaucuuug

SEQ ID NO: 462685 - RNA, 19 nt, Homo sapiens
ggaaugacagccacuaugu

SEQ ID NO: 462686 - RNA, 19 nt, Homo sapiens
ggcagaccauggaccaaua

SEQ ID NO: 462687 - RNA, 19 nt, Homo sapiens
agagcaaccugauuuaaau

SEQ ID NO: 462688 - RNA, 19 nt, Homo sapiens
agaauaagguuaaguacca

SEQ ID NO: 462689 - RNA, 19 nt, Homo sapiens
gcaaccugauuuaaauuuc

SEQ ID NO: 462690 - RNA, 19 nt, Homo sapiens
gugaugaacaugcuucuuu

SEQ ID NO: 462691 - RNA, 19 nt, Homo sapiens
ggaaggcacuccgaagaca

SEQ ID NO: 462692 - RNA, 19 nt, Homo sapiens
ccaaaccacacgagugaua

SEQ ID NO: 462693 - RNA, 19 nt, Homo sapiens
ccaggcagcucaacagaca

SEQ ID NO: 462694 - RNA, 19 nt, Homo sapiens
uuucagagauagaugcuuu

SEQ ID NO: 462695 - RNA, 19 nt, Homo sapiens
ggacuacaucacagcuuua

SEQ ID NO: 462696 - RNA, 19 nt, Homo sapiens
caacggguuuguccauaau

SEQ ID NO: 462697 - RNA, 19 nt, Homo sapiens
cgauauuucuguagcuuga

SEQ ID NO: 462698 - RNA, 19 nt, Homo sapiens
gcauuucagugggauugua

SEQ ID NO: 462699 - RNA, 19 nt, Homo sapiens
gcaccuuuaugaagagaug

SEQ ID NO: 462700 - RNA, 19 nt, Homo sapiens
ccagaucggcuuugaaguu

SEQ ID NO: 462701 - RNA, 19 nt, Homo sapiens
ggaccgugauguacuaugg

SEQ ID NO: 462702 - RNA, 19 nt, Homo sapiens
aagauaaacuggacuacau

SEQ ID NO: 462703 - RNA, 19 nt, Homo sapiens
gaaaauggccuaacuggau

SEQ ID NO: 462704 - RNA, 19 nt, Homo sapiens
cggacacggucacacaaua

SEQ ID NO: 462705 - RNA, 19 nt, Homo sapiens
gguuaaguguguauggaaa

SEQ ID NO: 462706 - RNA, 19 nt, Homo sapiens
caaaggcaguaaaguugau

SEQ ID NO: 462707 - RNA, 19 nt, Homo sapiens
cuggaacuccuauaacuua

SEQ ID NO: 462708 - RNA, 19 nt, Homo sapiens
uggccuaacuggaugauug

SEQ ID NO: 462709 - RNA, 19 nt, Homo sapiens
uguaugagguuaucacauc

SEQ ID NO: 462710 - RNA, 19 nt, Homo sapiens
uuaggcaccuuuaugaaga

SEQ ID NO: 462711 - RNA, 19 nt, Homo sapiens
gaauaagguuaaguaccaa

SEQ ID NO: 462712 - RNA, 19 nt, Homo sapiens
uuaauacccuucgcucaaa

SEQ ID NO: 462713 - RNA, 19 nt, Homo sapiens
uuggaacgauggaagauuu

SEQ ID NO: 462714 - RNA, 19 nt, Homo sapiens
ggacaauaguucaaaugcu

SEQ ID NO: 462715 - RNA, 19 nt, Homo sapiens
cccaacaacugguuaagug

SEQ ID NO: 462716 - RNA, 19 nt, Homo sapiens
gauggaagauuuugagaau

SEQ ID NO: 462717 - RNA, 19 nt, Homo sapiens
cuacaucacagcuuuaaau

SEQ ID NO: 462718 - RNA, 19 nt, Homo sapiens
ccaaggaggugcuguucca

SEQ ID NO: 462719 - RNA, 19 nt, Homo sapiens
gaugaagacacuggcauuu

SEQ ID NO: 462720 - RNA, 19 nt, Homo sapiens
caacagacaaccugaagca

SEQ ID NO: 462721 - RNA, 19 nt, Homo sapiens
gagacauggcugaagauaa

SEQ ID NO: 462722 - RNA, 19 nt, Homo sapiens
uaccaauucugccgacaaa

SEQ ID NO: 462723 - RNA, 19 nt, Homo sapiens
gaacaugcuucuuuucaca

SEQ ID NO: 462724 - RNA, 19 nt, Homo sapiens
ccacacgagugauaaacau

SEQ ID NO: 462725 - RNA, 19 nt, Homo sapiens
acggagaucugaaagguau

SEQ ID NO: 462726 - RNA, 19 nt, Homo sapiens
uucuguagcuugaauguaa

SEQ ID NO: 462727 - RNA, 19 nt, Homo sapiens
caguaaaguugauacaagu

SEQ ID NO: 462728 - RNA, 19 nt, Homo sapiens
ggaaugggaaauauuguag

SEQ ID NO: 462729 - RNA, 19 nt, Homo sapiens
acaggaccgugauguacua

SEQ ID NO: 462730 - RNA, 19 nt, Homo sapiens
uaguuuggaugcuguuaaa

SEQ ID NO: 462731 - RNA, 19 nt, Homo sapiens
gugcgaaaccaauguuauu

SEQ ID NO: 462732 - RNA, 19 nt, Homo sapiens
cagauaugguguugaagau

SEQ ID NO: 462733 - RNA, 19 nt, Homo sapiens
gggagagggacucaucuuu

SEQ ID NO: 462734 - RNA, 19 nt, Homo sapiens
gaaugacagccacuauguu

SEQ ID NO: 462735 - RNA, 19 nt, Homo sapiens
aagcaaagcaccugagaga

SEQ ID NO: 462736 - RNA, 19 nt, Homo sapiens
gagcaaccugauuuaaauu

SEQ ID NO: 462737 - RNA, 19 nt, Homo sapiens
gaagugcgaaaccaauguu

SEQ ID NO: 462738 - RNA, 19 nt, Homo sapiens
uaaaucgucccuuaaagau

SEQ ID NO: 462739 - RNA, 19 nt, Homo sapiens
ucauugcccucucuccaaa

SEQ ID NO: 462740 - RNA, 19 nt, Homo sapiens
caauucagauuaccacacu

SEQ ID NO: 462741 - RNA, 19 nt, Homo sapiens
guaagcauuuguaauagcu

SEQ ID NO: 462742 - RNA, 19 nt, Homo sapiens
gggauuguaagcauuugua

SEQ ID NO: 462743 - RNA, 19 nt, Homo sapiens
cagaaucuuuaucgugguu

SEQ ID NO: 462744 - RNA, 19 nt, Homo sapiens
gaaggaaaauggccuaacu

SEQ ID NO: 462745 - RNA, 19 nt, Homo sapiens
gagagaugagauccaagua

SEQ ID NO: 462746 - RNA, 19 nt, Homo sapiens
gauuucagauaugguguug

SEQ ID NO: 462747 - RNA, 19 nt, Homo sapiens
uggacuacaucacagcuuu

SEQ ID NO: 462748 - RNA, 19 nt, Homo sapiens
guaauagcuucauguacag

SEQ ID NO: 462749 - RNA, 19 nt, Homo sapiens
gagauccaaguaaauaaga

SEQ ID NO: 462750 - RNA, 19 nt, Homo sapiens
aagagcaaccugauuuaaa

SEQ ID NO: 462751 - RNA, 19 nt, Homo sapiens
aaagagcaaccugauuuaa

SEQ ID NO: 462752 - RNA, 19 nt, Homo sapiens
gcucauaccugucugauuc

SEQ ID NO: 462753 - RNA, 19 nt, Homo sapiens
gaaggaugcucuggaguuu

SEQ ID NO: 462754 - RNA, 19 nt, Homo sapiens
gacccuggcucccuccuuu

SEQ ID NO: 462755 - RNA, 19 nt, Homo sapiens
ccacucagguugacacugu

SEQ ID NO: 462756 - RNA, 19 nt, Homo sapiens
ugaaggagguggagcugaa

SEQ ID NO: 462757 - RNA, 19 nt, Homo sapiens
gcuccugacuuccuucuug

SEQ ID NO: 462758 - RNA, 19 nt, Homo sapiens
ggacauagagaaucugaag

SEQ ID NO: 462759 - RNA, 19 nt, Homo sapiens
agaauggucuggugaagau

SEQ ID NO: 462760 - RNA, 19 nt, Homo sapiens
ggccuggacucuucuccua

SEQ ID NO: 462761 - RNA, 19 nt, Homo sapiens
gagcauccgugucauucug

SEQ ID NO: 462762 - RNA, 19 nt, Homo sapiens
ucacgggccuguccaagga

SEQ ID NO: 462763 - RNA, 19 nt, Homo sapiens
gaagaauggucuggugaag

SEQ ID NO: 462764 - RNA, 19 nt, Homo sapiens
caagaaugcugagguuaca

SEQ ID NO: 462765 - RNA, 19 nt, Homo sapiens
ccuggacucuucuccuaua

SEQ ID NO: 462766 - RNA, 19 nt, Homo sapiens
ugccuuagcuuccaagaau

SEQ ID NO: 462767 - RNA, 19 nt, Homo sapiens
gaaacuggagccucacgaa

SEQ ID NO: 462768 - RNA, 19 nt, Homo sapiens
ccagaaugccgagaugaua

SEQ ID NO: 462769 - RNA, 19 nt, Homo sapiens
aggcaaggcuccugacuuc

SEQ ID NO: 462770 - RNA, 19 nt, Homo sapiens
ggaccuuacucccaacuac

SEQ ID NO: 462771 - RNA, 19 nt, Homo sapiens
acaagaaccagaaggauga

SEQ ID NO: 462772 - RNA, 19 nt, Homo sapiens
gcugcaagcuggcguggau

SEQ ID NO: 462773 - RNA, 19 nt, Homo sapiens
gaaugagcguuuucuggua

SEQ ID NO: 462774 - RNA, 19 nt, Homo sapiens
gcagaucgaccccaauuuu

SEQ ID NO: 462775 - RNA, 19 nt, Homo sapiens
ggacucuucuccuauaucc

SEQ ID NO: 462776 - RNA, 19 nt, Homo sapiens
caaggaagauuuugacagu

SEQ ID NO: 462777 - RNA, 19 nt, Homo sapiens
gagguuacaggcaccauga

SEQ ID NO: 462778 - RNA, 19 nt, Homo sapiens
ugaaggaugcucuggaguu

SEQ ID NO: 462779 - RNA, 19 nt, Homo sapiens
gaguccagcuucccugaca

SEQ ID NO: 462780 - RNA, 19 nt, Homo sapiens
aggaggagcugcugaaggu

SEQ ID NO: 462781 - RNA, 19 nt, Homo sapiens
caaaaucccuagucacaca

SEQ ID NO: 462782 - RNA, 19 nt, Homo sapiens
agguggagcugaaugaguu

SEQ ID NO: 462783 - RNA, 19 nt, Homo sapiens
gugccaacaugacugugaa

SEQ ID NO: 462784 - RNA, 19 nt, Homo sapiens
gcuguaagugccaacauga

SEQ ID NO: 462785 - RNA, 19 nt, Homo sapiens
gcuguugacuagcucauac

SEQ ID NO: 462786 - RNA, 19 nt, Homo sapiens
ugagcucucugaaggugaa

SEQ ID NO: 462787 - RNA, 19 nt, Homo sapiens
gggcacugcugcugcucuu

SEQ ID NO: 462788 - RNA, 19 nt, Homo sapiens
ccaaggaggagcugcugaa

SEQ ID NO: 462789 - RNA, 19 nt, Homo sapiens
agacugacuugcugcagau

SEQ ID NO: 462790 - RNA, 19 nt, Homo sapiens
ccgagaagcagccgaugaa

SEQ ID NO: 462791 - RNA, 19 nt, Homo sapiens
ucccucagcuucccagaau

SEQ ID NO: 462792 - RNA, 19 nt, Homo sapiens
ccuccgaccuucagcagau

SEQ ID NO: 462793 - RNA, 19 nt, Homo sapiens
ugaaggggcgucucgauua

SEQ ID NO: 462794 - RNA, 19 nt, Homo sapiens
ggcuguaagugccaacaug

SEQ ID NO: 462795 - RNA, 19 nt, Homo sapiens
guuccagguucgggacaua

SEQ ID NO: 462796 - RNA, 19 nt, Homo sapiens
aaagagcauccgugucauu

SEQ ID NO: 462797 - RNA, 19 nt, Homo sapiens
agaucaagguggcggaaga

SEQ ID NO: 462798 - RNA, 19 nt, Homo sapiens
aagugauccuccugccuua

SEQ ID NO: 462799 - RNA, 19 nt, Homo sapiens
ggccucaggugauccucuu

SEQ ID NO: 462800 - RNA, 19 nt, Homo sapiens
ugagugaccagcggaguaa

SEQ ID NO: 462801 - RNA, 19 nt, Homo sapiens
ggaugcagcugcccuuccu

SEQ ID NO: 462802 - RNA, 19 nt, Homo sapiens
ggaugagauuggccuggau

SEQ ID NO: 462803 - RNA, 19 nt, Homo sapiens
gcagcuggaguuugucuca

SEQ ID NO: 462804 - RNA, 19 nt, Homo sapiens
aagacuugcuguugacuag

SEQ ID NO: 462805 - RNA, 19 nt, Homo sapiens
acaaagacuugcuguugac

SEQ ID NO: 462806 - RNA, 19 nt, Homo sapiens
acauagagaaucugaagga

SEQ ID NO: 462807 - RNA, 19 nt, Homo sapiens
gauccugagccuacucgaa

SEQ ID NO: 462808 - RNA, 19 nt, Homo sapiens
ccaagaaugcugagguuac

SEQ ID NO: 462809 - RNA, 19 nt, Homo sapiens
ggagcugaaugaguuagag

SEQ ID NO: 462810 - RNA, 19 nt, Homo sapiens
gggaccagaaugagcguuu

SEQ ID NO: 462811 - RNA, 19 nt, Homo sapiens
gcucccuccuuuccuuguu

SEQ ID NO: 462812 - RNA, 19 nt, Homo sapiens
cuacucgaauccaacaaag

SEQ ID NO: 462813 - RNA, 19 nt, Homo sapiens
cauagagaaucugaaggau

SEQ ID NO: 462814 - RNA, 19 nt, Homo sapiens
gaaccagaaggaugauguc

SEQ ID NO: 462815 - RNA, 19 nt, Homo sapiens
caaccuggcgggucugaag

SEQ ID NO: 462816 - RNA, 19 nt, Homo sapiens
ucuaccagcugaugcucuu

SEQ ID NO: 462817 - RNA, 19 nt, Homo sapiens
cgaauccaacaaagacuug

SEQ ID NO: 462818 - RNA, 19 nt, Homo sapiens
gcacugcugcugcucuucu

SEQ ID NO: 462819 - RNA, 19 nt, Homo sapiens
acgacugccuacccucuaa

SEQ ID NO: 462820 - RNA, 19 nt, Homo sapiens
uggugcagcuggaguuugu

SEQ ID NO: 462821 - RNA, 19 nt, Homo sapiens
ucgauuaccugagcucucu

SEQ ID NO: 462822 - RNA, 19 nt, Homo sapiens
gagcuacagccuccugaag

SEQ ID NO: 462823 - RNA, 19 nt, Homo sapiens
ucugguagugcuuaacuuu

SEQ ID NO: 462824 - RNA, 19 nt, Homo sapiens
cagaaugccgagaugauag

SEQ ID NO: 462825 - RNA, 19 nt, Homo sapiens
gugaagggccagagugaag

SEQ ID NO: 462826 - RNA, 19 nt, Homo sapiens
ucacacaguauuugaaugc

SEQ ID NO: 462827 - RNA, 19 nt, Homo sapiens
caauucacaagaaccagaa

SEQ ID NO: 462828 - RNA, 19 nt, Homo sapiens
gcaaggcuccugacuuccu

SEQ ID NO: 462829 - RNA, 19 nt, Homo sapiens
gaaggggcgucucgauuac

SEQ ID NO: 462830 - RNA, 19 nt, Homo sapiens
ggaccagaaugagcguuuu

SEQ ID NO: 462831 - RNA, 19 nt, Homo sapiens
gacuaacuccuccgaccuu

SEQ ID NO: 462832 - RNA, 19 nt, Homo sapiens
uggguccaauucacaagaa

SEQ ID NO: 462833 - RNA, 19 nt, Homo sapiens
gcuggugccguggucauaa

SEQ ID NO: 462834 - RNA, 19 nt, Homo sapiens
agaagaauggucuggugaa

SEQ ID NO: 462835 - RNA, 19 nt, Homo sapiens
gguggagcugaaugaguua

SEQ ID NO: 462836 - RNA, 19 nt, Homo sapiens
gaaggagguggagcugaau

SEQ ID NO: 462837 - RNA, 19 nt, Homo sapiens
ugguagugcuuaacuuugg

SEQ ID NO: 462838 - RNA, 19 nt, Homo sapiens
ggaccccuguuuucagcua

SEQ ID NO: 462839 - RNA, 19 nt, Homo sapiens
ggcaggagcggugagauca

SEQ ID NO: 462840 - RNA, 19 nt, Homo sapiens
aggcuggucuucaacucuu

SEQ ID NO: 462841 - RNA, 19 nt, Homo sapiens
uaagugccaacaugacugu

SEQ ID NO: 462842 - RNA, 19 nt, Homo sapiens
cuagucacacaguauuuga

SEQ ID NO: 462843 - RNA, 19 nt, Homo sapiens
cauacaaaaucccuaguca

SEQ ID NO: 462844 - RNA, 19 nt, Homo sapiens
gauuaccugagcucucuga

SEQ ID NO: 462845 - RNA, 19 nt, Homo sapiens
uuccaagaaugcugagguu

SEQ ID NO: 462846 - RNA, 19 nt, Homo sapiens
gagguggagcugaaugagu

SEQ ID NO: 462847 - RNA, 19 nt, Homo sapiens
aaagacuugcuguugacua

SEQ ID NO: 462848 - RNA, 19 nt, Homo sapiens
ugaguuagagcccgagaag

SEQ ID NO: 462849 - RNA, 19 nt, Homo sapiens
gaaccaggccuucugauuu

SEQ ID NO: 462850 - RNA, 19 nt, Homo sapiens
ucacauagcugggauuuga

SEQ ID NO: 462851 - RNA, 19 nt, Homo sapiens
gaccaaagauacauguaaa

SEQ ID NO: 462852 - RNA, 19 nt, Homo sapiens
guagacaacuggacacuca

SEQ ID NO: 462853 - RNA, 19 nt, Homo sapiens
cuacaagggccuagacuua

SEQ ID NO: 462854 - RNA, 19 nt, Homo sapiens
gcagucaucauuugucuuu

SEQ ID NO: 462855 - RNA, 19 nt, Homo sapiens
ggaccaaagauacauguaa

SEQ ID NO: 462856 - RNA, 19 nt, Homo sapiens
uggaggagcugcaggauga

SEQ ID NO: 462857 - RNA, 19 nt, Homo sapiens
ggaggaaggucgggaugaa

SEQ ID NO: 462858 - RNA, 19 nt, Homo sapiens
gaucuucuccuuccucauu

SEQ ID NO: 462859 - RNA, 19 nt, Homo sapiens
gaagggcacucaccaucug

SEQ ID NO: 462860 - RNA, 19 nt, Homo sapiens
gggcuugcguuccgaguuu

SEQ ID NO: 462861 - RNA, 19 nt, Homo sapiens
gcacucaccaucuggaauu

SEQ ID NO: 462862 - RNA, 19 nt, Homo sapiens
cuagacagguuuaucuuug

SEQ ID NO: 462863 - RNA, 19 nt, Homo sapiens
gaagguacaggcaggauga

SEQ ID NO: 462864 - RNA, 19 nt, Homo sapiens
caaggguacuguucuccua

SEQ ID NO: 462865 - RNA, 19 nt, Homo sapiens
ccuauacgcuuccucuuug

SEQ ID NO: 462866 - RNA, 19 nt, Homo sapiens
ucaagaacagcuccuauuu

SEQ ID NO: 462867 - RNA, 19 nt, Homo sapiens
ccacauuacaggaugguua

SEQ ID NO: 462868 - RNA, 19 nt, Homo sapiens
gaccgcaucuugcuucugu

SEQ ID NO: 462869 - RNA, 19 nt, Homo sapiens
gaacguggagcuucagugu

SEQ ID NO: 462870 - RNA, 19 nt, Homo sapiens
caggagaccuuccacaaag

SEQ ID NO: 462871 - RNA, 19 nt, Homo sapiens
gccgguaccuucuucuuug

SEQ ID NO: 462872 - RNA, 19 nt, Homo sapiens
acagaagacuuauaacuac

SEQ ID NO: 462873 - RNA, 19 nt, Homo sapiens
acaagggccuagacuuaaa

SEQ ID NO: 462874 - RNA, 19 nt, Homo sapiens
uuacugaggaccaaagaua

SEQ ID NO: 462875 - RNA, 19 nt, Homo sapiens
gaucugagcccucccucuu

SEQ ID NO: 462876 - RNA, 19 nt, Homo sapiens
gagaggguguuccgcauag

SEQ ID NO: 462877 - RNA, 19 nt, Homo sapiens
gggcucagaucaccguaga

SEQ ID NO: 462878 - RNA, 19 nt, Homo sapiens
ucuccaagcugaucaagau

SEQ ID NO: 462879 - RNA, 19 nt, Homo sapiens
ucauuugucuuugaacgua

SEQ ID NO: 462880 - RNA, 19 nt, Homo sapiens
ccugguggauuucuucauu

SEQ ID NO: 462881 - RNA, 19 nt, Homo sapiens
cuauagcagucaucauuug

SEQ ID NO: 462882 - RNA, 19 nt, Homo sapiens
ggaugauuaugaagacaug

SEQ ID NO: 462883 - RNA, 19 nt, Homo sapiens
gcaucuugcuucuguucaa

SEQ ID NO: 462884 - RNA, 19 nt, Homo sapiens
gcugcaggaugauuaugaa

SEQ ID NO: 462885 - RNA, 19 nt, Homo sapiens
caagaacagcuccuauuuc

SEQ ID NO: 462886 - RNA, 19 nt, Homo sapiens
caacugcuagacagguuua

SEQ ID NO: 462887 - RNA, 19 nt, Homo sapiens
gaacguacccaaggucaca

SEQ ID NO: 462888 - RNA, 19 nt, Homo sapiens
ccaaguaucacccagaugu

SEQ ID NO: 462889 - RNA, 19 nt, Homo sapiens
gcaggaugauuaugaagac

SEQ ID NO: 462890 - RNA, 19 nt, Homo sapiens
uagcugggauuugaacuga

SEQ ID NO: 462891 - RNA, 19 nt, Homo sapiens
gaaguggccaugccugugu

SEQ ID NO: 462892 - RNA, 19 nt, Homo sapiens
uagacagguuuaucuuuga

SEQ ID NO: 462893 - RNA, 19 nt, Homo sapiens
gcuagacagguuuaucuuu

SEQ ID NO: 462894 - RNA, 19 nt, Homo sapiens
ccaggagaccuuccacaaa

SEQ ID NO: 462895 - RNA, 19 nt, Homo sapiens
ggaugaauacgacgaagug

SEQ ID NO: 462896 - RNA, 19 nt, Homo sapiens
aaauagggcuuuguaaacu

SEQ ID NO: 462897 - RNA, 19 nt, Homo sapiens
ucaugguccugguggauuu

SEQ ID NO: 462898 - RNA, 19 nt, Homo sapiens
aaccaggccuucugauuuc

SEQ ID NO: 462899 - RNA, 19 nt, Homo sapiens
agacagguuuaucuuugaa

SEQ ID NO: 462900 - RNA, 19 nt, Homo sapiens
gggugcaacuggaggagaa

SEQ ID NO: 462901 - RNA, 19 nt, Homo sapiens
agucaucauuugucuuuga

SEQ ID NO: 462902 - RNA, 19 nt, Homo sapiens
ucaggaacguggagcuuca

SEQ ID NO: 462903 - RNA, 19 nt, Homo sapiens
ucauauuccuggagucuca

SEQ ID NO: 462904 - RNA, 19 nt, Homo sapiens
ccacuacagaagacuuaua

SEQ ID NO: 462905 - RNA, 19 nt, Homo sapiens
gaagacuuauaacuacaac

SEQ ID NO: 462906 - RNA, 19 nt, Homo sapiens
cagaagacuuauaacuaca

SEQ ID NO: 462907 - RNA, 19 nt, Homo sapiens
ugcaggagcuggugaugga

SEQ ID NO: 462908 - RNA, 19 nt, Homo sapiens
aagaacagcuccuauuucc

SEQ ID NO: 462909 - RNA, 19 nt, Homo sapiens
gcagacaggccagcucuuc

SEQ ID NO: 462910 - RNA, 19 nt, Homo sapiens
gccuauacgcuuccucuuu

SEQ ID NO: 462911 - RNA, 19 nt, Homo sapiens
ucaagccacccaaguauca

SEQ ID NO: 462912 - RNA, 19 nt, Homo sapiens
guucaagccacccaaguau

SEQ ID NO: 462913 - RNA, 19 nt, Homo sapiens
cacuacagaagacuuauaa

SEQ ID NO: 462914 - RNA, 19 nt, Homo sapiens
ccaacggucuagaguacau

SEQ ID NO: 462915 - RNA, 19 nt, Homo sapiens
ucagucaugcguccacuuu

SEQ ID NO: 462916 - RNA, 19 nt, Homo sapiens
ugaaccaggccuucugauu

SEQ ID NO: 462917 - RNA, 19 nt, Homo sapiens
cuggaagacuuagaucuga

SEQ ID NO: 462918 - RNA, 19 nt, Homo sapiens
gcucuuugaccgcaucuug

SEQ ID NO: 462919 - RNA, 19 nt, Homo sapiens
ggagcaggaggaauaugaa

SEQ ID NO: 462920 - RNA, 19 nt, Homo sapiens
aggaaggucgggaugaaua

SEQ ID NO: 462921 - RNA, 19 nt, Homo sapiens
ggucuucauccucauauuc

SEQ ID NO: 462922 - RNA, 19 nt, Homo sapiens
uacaagggccuagacuuaa

SEQ ID NO: 462923 - RNA, 19 nt, Homo sapiens
gcagagggagcuacuucga

SEQ ID NO: 462924 - RNA, 19 nt, Homo sapiens
ggucacauagcugggauuu

SEQ ID NO: 462925 - RNA, 19 nt, Homo sapiens
ggccgguaccuucuucuuu

SEQ ID NO: 462926 - RNA, 19 nt, Homo sapiens
gggcccugcugcuuaaaca

SEQ ID NO: 462927 - RNA, 19 nt, Homo sapiens
gucaucauuugucuuugaa

SEQ ID NO: 462928 - RNA, 19 nt, Homo sapiens
cgagcucuguccucuguca

SEQ ID NO: 462929 - RNA, 19 nt, Homo sapiens
gaccuuuccaggccuauau

SEQ ID NO: 462930 - RNA, 19 nt, Homo sapiens
gcuggaagacuuagaucug

SEQ ID NO: 462931 - RNA, 19 nt, Homo sapiens
cuacagaagacuuauaacu

SEQ ID NO: 462932 - RNA, 19 nt, Homo sapiens
ccuauuaccugagugacau

SEQ ID NO: 462933 - RNA, 19 nt, Homo sapiens
cagggacuguucuauagca

SEQ ID NO: 462934 - RNA, 19 nt, Homo sapiens
ucauuucccucaucuucau

SEQ ID NO: 462935 - RNA, 19 nt, Homo sapiens
uagcagucaucauuugucu

SEQ ID NO: 462936 - RNA, 19 nt, Homo sapiens
ggauaccuacacccagaaa

SEQ ID NO: 462937 - RNA, 19 nt, Homo sapiens
gcucagaucaccguagaca

SEQ ID NO: 462938 - RNA, 19 nt, Homo sapiens
caucuggaauucuggaaaa

SEQ ID NO: 462939 - RNA, 19 nt, Homo sapiens
cuauauuuccucuucugua

SEQ ID NO: 462940 - RNA, 19 nt, Homo sapiens
aggccuauauuuccucuuc

SEQ ID NO: 462941 - RNA, 19 nt, Homo sapiens
ucacgggcauccagaucau

SEQ ID NO: 462942 - RNA, 19 nt, Homo sapiens
gaccacccacuacagaaga

SEQ ID NO: 462943 - RNA, 19 nt, Homo sapiens
ggaccacccacuacagaag

SEQ ID NO: 462944 - RNA, 19 nt, Homo sapiens
ucccucaucuucaucuaug

SEQ ID NO: 462945 - RNA, 19 nt, Homo sapiens
gcuauacccaggagaucuu

SEQ ID NO: 462946 - RNA, 19 nt, Homo sapiens
cgcuucaucucccgcuaua

SEQ ID NO: 462947 - RNA, 19 nt, Homo sapiens
ggagcugcaggaugauuau

SEQ ID NO: 462948 - RNA, 19 nt, Homo sapiens
ccgugcagcugggauuuga

SEQ ID NO: 462949 - RNA, 19 nt, Homo sapiens
ugaaaugucuggaugcuaa

SEQ ID NO: 462950 - RNA, 19 nt, Homo sapiens
ucauggugcuuguggauua

SEQ ID NO: 462951 - RNA, 19 nt, Homo sapiens
ucacucaucuucaucuaug

SEQ ID NO: 462952 - RNA, 19 nt, Homo sapiens
ggacggcggugagaacaug

SEQ ID NO: 462953 - RNA, 19 nt, Homo sapiens
gugggccucuccauaguua

SEQ ID NO: 462954 - RNA, 19 nt, Homo sapiens
gggaggguguggacgagua

SEQ ID NO: 462955 - RNA, 19 nt, Homo sapiens
ggaguuggacgcaguguug

SEQ ID NO: 462956 - RNA, 19 nt, Homo sapiens
uggagaagauuccugagaa

SEQ ID NO: 462957 - RNA, 19 nt, Homo sapiens
ugaaacugcuggagaagau

SEQ ID NO: 462958 - RNA, 19 nt, Homo sapiens
caugaagagucaccgguuu

SEQ ID NO: 462959 - RNA, 19 nt, Homo sapiens
ggaggaagacuuugaguac

SEQ ID NO: 462960 - RNA, 19 nt, Homo sapiens
ucacuuacgucaagaaggu

SEQ ID NO: 462961 - RNA, 19 nt, Homo sapiens
gccgugcucuuuggaauuu

SEQ ID NO: 462962 - RNA, 19 nt, Homo sapiens
gcagcaaccaccuggagua

SEQ ID NO: 462963 - RNA, 19 nt, Homo sapiens
gcagucaucuucaucuacu

SEQ ID NO: 462964 - RNA, 19 nt, Homo sapiens
cagagccgguguuugauga

SEQ ID NO: 462965 - RNA, 19 nt, Homo sapiens
ucuacaagcuggugaagau

SEQ ID NO: 462966 - RNA, 19 nt, Homo sapiens
gggacaagcccaagauuca

SEQ ID NO: 462967 - RNA, 19 nt, Homo sapiens
gcuuguggauuacaguauu

SEQ ID NO: 462968 - RNA, 19 nt, Homo sapiens
gccaaagguuccacacaga

SEQ ID NO: 462969 - RNA, 19 nt, Homo sapiens
ggaggaagaugaggaugag

SEQ ID NO: 462970 - RNA, 19 nt, Homo sapiens
ggucuucauucucaucuuc

SEQ ID NO: 462971 - RNA, 19 nt, Homo sapiens
ggagaucuucgccuucuug

SEQ ID NO: 462972 - RNA, 19 nt, Homo sapiens
ugucggagcugauuauguc

SEQ ID NO: 462973 - RNA, 19 nt, Homo sapiens
aaacacagccacccaagug

SEQ ID NO: 462974 - RNA, 19 nt, Homo sapiens
ggacaccuauacccagaag

SEQ ID NO: 462975 - RNA, 19 nt, Homo sapiens
gagcuuggcugggcagucu

SEQ ID NO: 462976 - RNA, 19 nt, Homo sapiens
gggaggaagacuuugagua

SEQ ID NO: 462977 - RNA, 19 nt, Homo sapiens
aggcagagccgguguuuga

SEQ ID NO: 462978 - RNA, 19 nt, Homo sapiens
gaccuagaccucaugaaga

SEQ ID NO: 462979 - RNA, 19 nt, Homo sapiens
ggagaaaccccgaccauug

SEQ ID NO: 462980 - RNA, 19 nt, Homo sapiens
uuaacgggauccaguucua

SEQ ID NO: 462981 - RNA, 19 nt, Homo sapiens
gggcugugcucuuggaucu

SEQ ID NO: 462982 - RNA, 19 nt, Homo sapiens
ggacgaguacaaugagaug

SEQ ID NO: 462983 - RNA, 19 nt, Homo sapiens
guccagagcgagcggguua

SEQ ID NO: 462984 - RNA, 19 nt, Homo sapiens
ccaaacaccacccagaugu

SEQ ID NO: 462985 - RNA, 19 nt, Homo sapiens
gcaaccaccuggaguaccu

SEQ ID NO: 462986 - RNA, 19 nt, Homo sapiens
gcggaagaaugccaaaggu

SEQ ID NO: 462987 - RNA, 19 nt, Homo sapiens
gggaggaagaugaggauga

SEQ ID NO: 462988 - RNA, 19 nt, Homo sapiens
gcaggaggaagacgaacuu

SEQ ID NO: 462989 - RNA, 19 nt, Homo sapiens
auaaggcgcuccugcagau

SEQ ID NO: 462990 - RNA, 19 nt, Homo sapiens
gcagagccgguguuugaug

SEQ ID NO: 462991 - RNA, 19 nt, Homo sapiens
caagggcgcagauucuuuc

SEQ ID NO: 462992 - RNA, 19 nt, Homo sapiens
gggaggcuguggaguugga

SEQ ID NO: 462993 - RNA, 19 nt, Homo sapiens
ucuaugagaccuucuacaa

SEQ ID NO: 462994 - RNA, 19 nt, Homo sapiens
ccaagggcgcagauucuuu

SEQ ID NO: 462995 - RNA, 19 nt, Homo sapiens
ccgcagucaucuucaucua

SEQ ID NO: 462996 - RNA, 19 nt, Homo sapiens
gaaacacagccacccaagu

SEQ ID NO: 462997 - RNA, 19 nt, Homo sapiens
ccaacgcgcucacugucau

SEQ ID NO: 462998 - RNA, 19 nt, Homo sapiens
gagaugcccaugccugugu

SEQ ID NO: 462999 - RNA, 19 nt, Homo sapiens
ccacccagaugucacuuac

SEQ ID NO: 463000 - RNA, 19 nt, Homo sapiens
ucaccacgcucaucaucuc

SEQ ID NO: 463001 - RNA, 19 nt, Homo sapiens
cugagugacuuccgagaug

SEQ ID NO: 463002 - RNA, 19 nt, Homo sapiens
uuguggagcugaaugaguu

SEQ ID NO: 463003 - RNA, 19 nt, Homo sapiens
gaugaaaugucuggaugcu

SEQ ID NO: 463004 - RNA, 19 nt, Homo sapiens
gaucaccacgcucaucauc

SEQ ID NO: 463005 - RNA, 19 nt, Homo sapiens
ccacccaagugaugagaag

SEQ ID NO: 463006 - RNA, 19 nt, Homo sapiens
gaucaaggccgaggauagg

SEQ ID NO: 463007 - RNA, 19 nt, Homo sapiens
cgaccuagaccucaugaag

SEQ ID NO: 463008 - RNA, 19 nt, Homo sapiens
caggagaucuucgccuucu

SEQ ID NO: 463009 - RNA, 19 nt, Homo sapiens
gcuugugggccucuccaua

SEQ ID NO: 463010 - RNA, 19 nt, Homo sapiens
ucuccacccucaugucaga

SEQ ID NO: 463011 - RNA, 19 nt, Homo sapiens
agaugucacuuacgucaag

SEQ ID NO: 463012 - RNA, 19 nt, Homo sapiens
gcaccgcagcuacaaccuu

SEQ ID NO: 463013 - RNA, 19 nt, Homo sapiens
gaaacugcuggagaagauu

SEQ ID NO: 463014 - RNA, 19 nt, Homo sapiens
aaacaccacccagauguca

SEQ ID NO: 463015 - RNA, 19 nt, Homo sapiens
gcccaaacaccacccagau

SEQ ID NO: 463016 - RNA, 19 nt, Homo sapiens
gcccaucgccauccucauc

SEQ ID NO: 463017 - RNA, 19 nt, Homo sapiens
ucucacucaucuucaucua

SEQ ID NO: 463018 - RNA, 19 nt, Homo sapiens
ccgccucguugcccugaaa

SEQ ID NO: 463019 - RNA, 19 nt, Homo sapiens
accgagagaugaaaugucu

SEQ ID NO: 463020 - RNA, 19 nt, Homo sapiens
ccacgcucaucaucuccaa

SEQ ID NO: 463021 - RNA, 19 nt, Homo sapiens
cagaucaccacgcucauca

SEQ ID NO: 463022 - RNA, 19 nt, Homo sapiens
gagcguucccaguggauuc

SEQ ID NO: 463023 - RNA, 19 nt, Homo sapiens
acaagcuggugaagaucuu

SEQ ID NO: 463024 - RNA, 19 nt, Homo sapiens
ugaagagucaccgguuuga

SEQ ID NO: 463025 - RNA, 19 nt, Homo sapiens
gaugucacuuacgucaaga

SEQ ID NO: 463026 - RNA, 19 nt, Homo sapiens
gagaucuucgccuucuuga

SEQ ID NO: 463027 - RNA, 19 nt, Homo sapiens
caucuccacccucauguca

SEQ ID NO: 463028 - RNA, 19 nt, Homo sapiens
gugccaacauggacuacca

SEQ ID NO: 463029 - RNA, 19 nt, Homo sapiens
caaagguuccacacagagu

SEQ ID NO: 463030 - RNA, 19 nt, Homo sapiens
guggacgaguacaaugaga

SEQ ID NO: 463031 - RNA, 19 nt, Homo sapiens
ccuccucggugcaguucuu

SEQ ID NO: 463032 - RNA, 19 nt, Homo sapiens
gcucaucaucuccaagaag

SEQ ID NO: 463033 - RNA, 19 nt, Homo sapiens
gcgaaaagggcuaagauuc

SEQ ID NO: 463034 - RNA, 19 nt, Homo sapiens
gcuaagauucggccaugag

SEQ ID NO: 463035 - RNA, 19 nt, Homo sapiens
cugcgcaaauucaagaaca

SEQ ID NO: 463036 - RNA, 19 nt, Homo sapiens
uaacgggauccaguucuau

SEQ ID NO: 463037 - RNA, 19 nt, Homo sapiens
cgccagagccagagagcuu

SEQ ID NO: 463038 - RNA, 19 nt, Homo sapiens
cacacagaguggccgagaa

SEQ ID NO: 463039 - RNA, 19 nt, Homo sapiens
guguggacgaguacaauga

SEQ ID NO: 463040 - RNA, 19 nt, Homo sapiens
cgaggcagagccgguguuu

SEQ ID NO: 463041 - RNA, 19 nt, Homo sapiens
ucaccgaccgagagaugaa

SEQ ID NO: 463042 - RNA, 19 nt, Homo sapiens
ggacaagcccaagauucag

SEQ ID NO: 463043 - RNA, 19 nt, Homo sapiens
ugaucucacucaucuucau

SEQ ID NO: 463044 - RNA, 19 nt, Homo sapiens
ccacuuccagcgccagaug

SEQ ID NO: 463045 - RNA, 19 nt, Homo sapiens
cgaguagugccaacaugga

SEQ ID NO: 463046 - RNA, 19 nt, Homo sapiens
cggaagaaugccaaagguu

SEQ ID NO: 463047 - RNA, 19 nt, Homo sapiens
uaccauggcuggacucuua

SEQ ID NO: 463048 - RNA, 19 nt, Homo sapiens
gaaaucagccaguuguaaa

SEQ ID NO: 463049 - RNA, 19 nt, Homo sapiens
caagagagcaucugagaaa

SEQ ID NO: 463050 - RNA, 19 nt, Homo sapiens
gaaagccauuccaaccaua

SEQ ID NO: 463051 - RNA, 19 nt, Homo sapiens
gagagccuaugaccuauuu

SEQ ID NO: 463052 - RNA, 19 nt, Homo sapiens
gaauaugucucacgugaag

SEQ ID NO: 463053 - RNA, 19 nt, Homo sapiens
gaacgucaauggcaucauc

SEQ ID NO: 463054 - RNA, 19 nt, Homo sapiens
gugggcaacucuucgauua

SEQ ID NO: 463055 - RNA, 19 nt, Homo sapiens
gcacagaucaggucauugu

SEQ ID NO: 463056 - RNA, 19 nt, Homo sapiens
gaagggaaaucagccaguu

SEQ ID NO: 463057 - RNA, 19 nt, Homo sapiens
agaaagagcucaugauugc

SEQ ID NO: 463058 - RNA, 19 nt, Homo sapiens
aaacacaaguuccugagaa

SEQ ID NO: 463059 - RNA, 19 nt, Homo sapiens
ggagaccauugaaauagaa

SEQ ID NO: 463060 - RNA, 19 nt, Homo sapiens
ggaaaucagccaguuguaa

SEQ ID NO: 463061 - RNA, 19 nt, Homo sapiens
gagaaagccaugaagauga

SEQ ID NO: 463062 - RNA, 19 nt, Homo sapiens
uaaggagaccauugaaaua

SEQ ID NO: 463063 - RNA, 19 nt, Homo sapiens
gcaaagaggagcguauuga

SEQ ID NO: 463064 - RNA, 19 nt, Homo sapiens
gaagccaugugauugaugu

SEQ ID NO: 463065 - RNA, 19 nt, Homo sapiens
gaaauagaaacacaaguuc

SEQ ID NO: 463066 - RNA, 19 nt, Homo sapiens
gagaaagagcucaugauug

SEQ ID NO: 463067 - RNA, 19 nt, Homo sapiens
ucacugcccuuuacacaau

SEQ ID NO: 463068 - RNA, 19 nt, Homo sapiens
ggagaaagccaugaagaug

SEQ ID NO: 463069 - RNA, 19 nt, Homo sapiens
caggagagccuaugaccua

SEQ ID NO: 463070 - RNA, 19 nt, Homo sapiens
agaaagccaugaagaugaa

SEQ ID NO: 463071 - RNA, 19 nt, Homo sapiens
ggacugauccuaggacuuc

SEQ ID NO: 463072 - RNA, 19 nt, Homo sapiens
gcaacugucccacgauuau

SEQ ID NO: 463073 - RNA, 19 nt, Homo sapiens
caacaccaccuuucaggaa

SEQ ID NO: 463074 - RNA, 19 nt, Homo sapiens
ccagguggauaaaugugua

SEQ ID NO: 463075 - RNA, 19 nt, Homo sapiens
caucgccuauccaaccuua

SEQ ID NO: 463076 - RNA, 19 nt, Homo sapiens
gugcugggcuggcuguuug

SEQ ID NO: 463077 - RNA, 19 nt, Homo sapiens
gggauuucacguaugauua

SEQ ID NO: 463078 - RNA, 19 nt, Homo sapiens
caagaugacugaggaagag

SEQ ID NO: 463079 - RNA, 19 nt, Homo sapiens
cagcaacugucccacgauu

SEQ ID NO: 463080 - RNA, 19 nt, Homo sapiens
uuacugaguuugcuuaugg

SEQ ID NO: 463081 - RNA, 19 nt, Homo sapiens
gauccuaggacuucugauu

SEQ ID NO: 463082 - RNA, 19 nt, Homo sapiens
gugcacagaucaggucauu

SEQ ID NO: 463083 - RNA, 19 nt, Homo sapiens
caucaucguuaucuacuuc

SEQ ID NO: 463084 - RNA, 19 nt, Homo sapiens
gggcaacucuucgauuaca

SEQ ID NO: 463085 - RNA, 19 nt, Homo sapiens
ugaauggaaugcccugguu

SEQ ID NO: 463086 - RNA, 19 nt, Homo sapiens
ccaaacccauuccggaugu

SEQ ID NO: 463087 - RNA, 19 nt, Homo sapiens
gagagcaucugagaaagag

SEQ ID NO: 463088 - RNA, 19 nt, Homo sapiens
cagaaugugagaaauauug

SEQ ID NO: 463089 - RNA, 19 nt, Homo sapiens
ccucuuugcuaguaacauu

SEQ ID NO: 463090 - RNA, 19 nt, Homo sapiens
cuaaggagaccauugaaau

SEQ ID NO: 463091 - RNA, 19 nt, Homo sapiens
gcacaaagugggcaacucu

SEQ ID NO: 463092 - RNA, 19 nt, Homo sapiens
gaaacacaaguuccugaga

SEQ ID NO: 463093 - RNA, 19 nt, Homo sapiens
gauaucuccaucaucguua

SEQ ID NO: 463094 - RNA, 19 nt, Homo sapiens
uaaagcugaugcccauguu

SEQ ID NO: 463095 - RNA, 19 nt, Homo sapiens
gaggagaaagccaugaaga

SEQ ID NO: 463096 - RNA, 19 nt, Homo sapiens
gugcaucucuaccgucugu

SEQ ID NO: 463097 - RNA, 19 nt, Homo sapiens
ggacuucugauugggauuu

SEQ ID NO: 463098 - RNA, 19 nt, Homo sapiens
uccaguccaucaccaguua

SEQ ID NO: 463099 - RNA, 19 nt, Homo sapiens
ugucgucccuucagaaugu

SEQ ID NO: 463100 - RNA, 19 nt, Homo sapiens
aaaggcagacuaagaauca

SEQ ID NO: 463101 - RNA, 19 nt, Homo sapiens
uuacucaccuuccuuuagu

SEQ ID NO: 463102 - RNA, 19 nt, Homo sapiens
gaggagaacauccaagaag

SEQ ID NO: 463103 - RNA, 19 nt, Homo sapiens
ggaggacaguguugaacgu

SEQ ID NO: 463104 - RNA, 19 nt, Homo sapiens
ugauugggauuucacguau

SEQ ID NO: 463105 - RNA, 19 nt, Homo sapiens
gcaagagagcaucugagaa

SEQ ID NO: 463106 - RNA, 19 nt, Homo sapiens
ugaaagccauuccaaccau

SEQ ID NO: 463107 - RNA, 19 nt, Homo sapiens
ccuuaggccugaaucugua

SEQ ID NO: 463108 - RNA, 19 nt, Homo sapiens
ucagaagccaugugauuga

SEQ ID NO: 463109 - RNA, 19 nt, Homo sapiens
gugcacuacuuguacuuug

SEQ ID NO: 463110 - RNA, 19 nt, Homo sapiens
gaauggaaugcccugguuu

SEQ ID NO: 463111 - RNA, 19 nt, Homo sapiens
accauuaguuugcuguuaa

SEQ ID NO: 463112 - RNA, 19 nt, Homo sapiens
acaaguuccugagaagaaa

SEQ ID NO: 463113 - RNA, 19 nt, Homo sapiens
cuucagaaugugagaaaua

SEQ ID NO: 463114 - RNA, 19 nt, Homo sapiens
gugucagugugguuuauaa

SEQ ID NO: 463115 - RNA, 19 nt, Homo sapiens
ccaugugauugaugucuga

SEQ ID NO: 463116 - RNA, 19 nt, Homo sapiens
gaucucggcagacaucuuc

SEQ ID NO: 463117 - RNA, 19 nt, Homo sapiens
ccauugaaauagaaacaca

SEQ ID NO: 463118 - RNA, 19 nt, Homo sapiens
aaccauuaguuugcuguua

SEQ ID NO: 463119 - RNA, 19 nt, Homo sapiens
ugacggacaccucugagaa

SEQ ID NO: 463120 - RNA, 19 nt, Homo sapiens
gcccuaaggagaccauuga

SEQ ID NO: 463121 - RNA, 19 nt, Homo sapiens
guaccaacaucgccuaucc

SEQ ID NO: 463122 - RNA, 19 nt, Homo sapiens
caagaucucggcagacauc

SEQ ID NO: 463123 - RNA, 19 nt, Homo sapiens
ggaagaggagaacauccaa

SEQ ID NO: 463124 - RNA, 19 nt, Homo sapiens
ccaugaagaugaagaugac

SEQ ID NO: 463125 - RNA, 19 nt, Homo sapiens
gccaugaagaugaagauga

SEQ ID NO: 463126 - RNA, 19 nt, Homo sapiens
uuagccaucuuucucuuau

SEQ ID NO: 463127 - RNA, 19 nt, Homo sapiens
agaaucagaagccauguga

SEQ ID NO: 463128 - RNA, 19 nt, Homo sapiens
gaagaggagaaagccauga

SEQ ID NO: 463129 - RNA, 19 nt, Homo sapiens
ccaagaugacugaggaaga

SEQ ID NO: 463130 - RNA, 19 nt, Homo sapiens
uuucacguaugauuacuga

SEQ ID NO: 463131 - RNA, 19 nt, Homo sapiens
gauuacauccaguccauca

SEQ ID NO: 463132 - RNA, 19 nt, Homo sapiens
gcuaguaacauuggaagug

SEQ ID NO: 463133 - RNA, 19 nt, Homo sapiens
gcauuugaagccaguguga

SEQ ID NO: 463134 - RNA, 19 nt, Homo sapiens
cacaaguuccugagaagaa

SEQ ID NO: 463135 - RNA, 19 nt, Homo sapiens
gcauggagcccagcaacug

SEQ ID NO: 463136 - RNA, 19 nt, Homo sapiens
ggagagccuaugaccuauu

SEQ ID NO: 463137 - RNA, 19 nt, Homo sapiens
caaugagccaggagccuuu

SEQ ID NO: 463138 - RNA, 19 nt, Homo sapiens
agccaucuuucucuuauug

SEQ ID NO: 463139 - RNA, 19 nt, Homo sapiens
cagaagccaugugauugau

SEQ ID NO: 463140 - RNA, 19 nt, Homo sapiens
ggaaugcccugguuuuggu

SEQ ID NO: 463141 - RNA, 19 nt, Homo sapiens
gggaaaucagccaguugua

SEQ ID NO: 463142 - RNA, 19 nt, Homo sapiens
cuacuuguacuuugccauu

SEQ ID NO: 463143 - RNA, 19 nt, Homo sapiens
ggauuucacguaugauuac

SEQ ID NO: 463144 - RNA, 19 nt, Homo sapiens
gccggaagguuguuuaucc

SEQ ID NO: 463145 - RNA, 19 nt, Homo sapiens
auucaucaaucuggccuua

SEQ ID NO: 463146 - RNA, 19 nt, Homo sapiens
caucgccauuggaggcuuu

SEQ ID NO: 463147 - RNA, 19 nt, Homo sapiens
gcgggcagcucuucgauua

SEQ ID NO: 463148 - RNA, 19 nt, Homo sapiens
guacagaccuucgucauuc

SEQ ID NO: 463149 - RNA, 19 nt, Homo sapiens
ggaaacaucuccagcuucu

SEQ ID NO: 463150 - RNA, 19 nt, Homo sapiens
ggaagagccugacccacau

SEQ ID NO: 463151 - RNA, 19 nt, Homo sapiens
cuacugggcuggcuguuug

SEQ ID NO: 463152 - RNA, 19 nt, Homo sapiens
gaggugggcugcuccaaca

SEQ ID NO: 463153 - RNA, 19 nt, Homo sapiens
gaagcugacgcccauguuu

SEQ ID NO: 463154 - RNA, 19 nt, Homo sapiens
gcucugggcuggaacaucu

SEQ ID NO: 463155 - RNA, 19 nt, Homo sapiens
gcagcacgcucuucaccau

SEQ ID NO: 463156 - RNA, 19 nt, Homo sapiens
gaauggaggagcacacaga

SEQ ID NO: 463157 - RNA, 19 nt, Homo sapiens
ucaaugcccugcucaugau

SEQ ID NO: 463158 - RNA, 19 nt, Homo sapiens
ugacaauccugcugacauc

SEQ ID NO: 463159 - RNA, 19 nt, Homo sapiens
agaaggcccugauugacaa

SEQ ID NO: 463160 - RNA, 19 nt, Homo sapiens
ggaccuggaugcugaugag

SEQ ID NO: 463161 - RNA, 19 nt, Homo sapiens
gggcagcucuucgauuaca

SEQ ID NO: 463162 - RNA, 19 nt, Homo sapiens
agucauugcugcauauuuc

SEQ ID NO: 463163 - RNA, 19 nt, Homo sapiens
gguacagaccuucgucauu

SEQ ID NO: 463164 - RNA, 19 nt, Homo sapiens
caauccugcugacauccua

SEQ ID NO: 463165 - RNA, 19 nt, Homo sapiens
cuccggagcuguauucauc

SEQ ID NO: 463166 - RNA, 19 nt, Homo sapiens
agagugccauggagaugaa

SEQ ID NO: 463167 - RNA, 19 nt, Homo sapiens
gagagugccauggagauga

SEQ ID NO: 463168 - RNA, 19 nt, Homo sapiens
cagaaggcccugauugaca

SEQ ID NO: 463169 - RNA, 19 nt, Homo sapiens
ccuagucauugcugcauau

SEQ ID NO: 463170 - RNA, 19 nt, Homo sapiens
ugggaaacaucuccagcuu

SEQ ID NO: 463171 - RNA, 19 nt, Homo sapiens
ccugcauccucauggguua

SEQ ID NO: 463172 - RNA, 19 nt, Homo sapiens
gaucucaguggacauguuc

SEQ ID NO: 463173 - RNA, 19 nt, Homo sapiens
gggcuucuaugccuaagac

SEQ ID NO: 463174 - RNA, 19 nt, Homo sapiens
gcuccucacucccuguaca

SEQ ID NO: 463175 - RNA, 19 nt, Homo sapiens
caagaucucaguggacaug

SEQ ID NO: 463176 - RNA, 19 nt, Homo sapiens
gcaguugcccuaaggaaaa

SEQ ID NO: 463177 - RNA, 19 nt, Homo sapiens
ccauugugcuguucuucug

SEQ ID NO: 463178 - RNA, 19 nt, Homo sapiens
gcccagaaggcccugauug

SEQ ID NO: 463179 - RNA, 19 nt, Homo sapiens
gcuuggcuguugcuggauu

SEQ ID NO: 463180 - RNA, 19 nt, Homo sapiens
ggcagucacuucccaugag

SEQ ID NO: 463181 - RNA, 19 nt, Homo sapiens
cauguucuccggagcugua

SEQ ID NO: 463182 - RNA, 19 nt, Homo sapiens
ggcaugaucagccgcauuc

SEQ ID NO: 463183 - RNA, 19 nt, Homo sapiens
cccagaaggcccugauuga

SEQ ID NO: 463184 - RNA, 19 nt, Homo sapiens
gcccagagagugccaugga

SEQ ID NO: 463185 - RNA, 19 nt, Homo sapiens
gcacgcucuucaccaugga

SEQ ID NO: 463186 - RNA, 19 nt, Homo sapiens
ucgcuggccuccaucuuca

SEQ ID NO: 463187 - RNA, 19 nt, Homo sapiens
cgaguggaaugcgcucuuc

SEQ ID NO: 463188 - RNA, 19 nt, Homo sapiens
gaucagccgcauucuguac

SEQ ID NO: 463189 - RNA, 19 nt, Homo sapiens
gagccugacccacaucaag

SEQ ID NO: 463190 - RNA, 19 nt, Homo sapiens
gagaauggaggagcacaca

SEQ ID NO: 463191 - RNA, 19 nt, Homo sapiens
gcuacugggcuggcuguuu

SEQ ID NO: 463192 - RNA, 19 nt, Homo sapiens
caucuaugccuccgucauc

SEQ ID NO: 463193 - RNA, 19 nt, Homo sapiens
ggaacgggaggaccuggau

SEQ ID NO: 463194 - RNA, 19 nt, Homo sapiens
cuucugggcaucaccauga

SEQ ID NO: 463195 - RNA, 19 nt, Homo sapiens
cauauuuccugcuggucau

SEQ ID NO: 463196 - RNA, 19 nt, Homo sapiens
cucaaugcccugcucauga

SEQ ID NO: 463197 - RNA, 19 nt, Homo sapiens
uccaggcagucucuagcua

SEQ ID NO: 463198 - RNA, 19 nt, Homo sapiens
cgggucucuucgacaaaua

SEQ ID NO: 463199 - RNA, 19 nt, Homo sapiens
gaagagccugacccacauc

SEQ ID NO: 463200 - RNA, 19 nt, Homo sapiens
ggaauugacugcacuguug

SEQ ID NO: 463201 - RNA, 19 nt, Homo sapiens
gcgaagcgcuggugaguau

SEQ ID NO: 463202 - RNA, 19 nt, Homo sapiens
gcaaggccaugauugagaa

SEQ ID NO: 463203 - RNA, 19 nt, Homo sapiens
cagcggaccuuccucauuc

SEQ ID NO: 463204 - RNA, 19 nt, Homo sapiens
ccaagugugucuucaccua

SEQ ID NO: 463205 - RNA, 19 nt, Homo sapiens
cugaggagcugaugacuau

SEQ ID NO: 463206 - RNA, 19 nt, Homo sapiens
cgaggaggcugcagcauca

SEQ ID NO: 463207 - RNA, 19 nt, Homo sapiens
ugaacgauguggaggaauu

SEQ ID NO: 463208 - RNA, 19 nt, Homo sapiens
gaucagagcacggacuuug

SEQ ID NO: 463209 - RNA, 19 nt, Homo sapiens
gggcuggacugagagaauu

SEQ ID NO: 463210 - RNA, 19 nt, Homo sapiens
gcaccaugaugcaaaccaa

SEQ ID NO: 463211 - RNA, 19 nt, Homo sapiens
gcugauggcucugcuguca

SEQ ID NO: 463212 - RNA, 19 nt, Homo sapiens
uugagaagcuggagaagga

SEQ ID NO: 463213 - RNA, 19 nt, Homo sapiens
gaagaaagagcugaugaag

SEQ ID NO: 463214 - RNA, 19 nt, Homo sapiens
gaacagcaggcagagguuu

SEQ ID NO: 463215 - RNA, 19 nt, Homo sapiens
agaacuggcugcacucuca

SEQ ID NO: 463216 - RNA, 19 nt, Homo sapiens
gcacuguuaccaagacuga

SEQ ID NO: 463217 - RNA, 19 nt, Homo sapiens
ggagguggacgacaugaug

SEQ ID NO: 463218 - RNA, 19 nt, Homo sapiens
gcugaugacuauugaggau

SEQ ID NO: 463219 - RNA, 19 nt, Homo sapiens
gaggagcugaugacuauug

SEQ ID NO: 463220 - RNA, 19 nt, Homo sapiens
gggaucguguccacaaguu

SEQ ID NO: 463221 - RNA, 19 nt, Homo sapiens
ugaugacuauugaggauga

SEQ ID NO: 463222 - RNA, 19 nt, Homo sapiens
gaagcgcuggugaguauga

SEQ ID NO: 463223 - RNA, 19 nt, Homo sapiens
gagguggccuucucaucug

SEQ ID NO: 463224 - RNA, 19 nt, Homo sapiens
gagcagacccgagugaaca

SEQ ID NO: 463225 - RNA, 19 nt, Homo sapiens
ucacucaugucaccagcuu

SEQ ID NO: 463226 - RNA, 19 nt, Homo sapiens
caugaacgauguggaggaa

SEQ ID NO: 463227 - RNA, 19 nt, Homo sapiens
gcagcguuuugauaaauua

SEQ ID NO: 463228 - RNA, 19 nt, Homo sapiens
ccaagaagaugggcagcau

SEQ ID NO: 463229 - RNA, 19 nt, Homo sapiens
gaaccgacgccagaacuuc

SEQ ID NO: 463230 - RNA, 19 nt, Homo sapiens
gaagaagaaagagcugaug

SEQ ID NO: 463231 - RNA, 19 nt, Homo sapiens
ggccuuagcugggcuggau

SEQ ID NO: 463232 - RNA, 19 nt, Homo sapiens
gugaggcgcucggagaaug

SEQ ID NO: 463233 - RNA, 19 nt, Homo sapiens
uggacaagaugcuggauca

SEQ ID NO: 463234 - RNA, 19 nt, Homo sapiens
gcacacaggcuggaacagu

SEQ ID NO: 463235 - RNA, 19 nt, Homo sapiens
gaacgauguggaggaauug

SEQ ID NO: 463236 - RNA, 19 nt, Homo sapiens
gacaagaugcuggaucaga

SEQ ID NO: 463237 - RNA, 19 nt, Homo sapiens
ccaacagcaucaagcagau

SEQ ID NO: 463238 - RNA, 19 nt, Homo sapiens
gagaccagcgggacaagga

SEQ ID NO: 463239 - RNA, 19 nt, Homo sapiens
caaggagcaacgaggagua

SEQ ID NO: 463240 - RNA, 19 nt, Homo sapiens
gcugaggagcugaugacua

SEQ ID NO: 463241 - RNA, 19 nt, Homo sapiens
gaucguguccacaaguuca

SEQ ID NO: 463242 - RNA, 19 nt, Homo sapiens
ggcaguggcagcaccauga

SEQ ID NO: 463243 - RNA, 19 nt, Homo sapiens
ccagagggcagaacugaca

SEQ ID NO: 463244 - RNA, 19 nt, Homo sapiens
gcagcaccaugaugcaaac

SEQ ID NO: 463245 - RNA, 19 nt, Homo sapiens
ucagagcacggacuuugaa

SEQ ID NO: 463246 - RNA, 19 nt, Homo sapiens
gagguggacgacaugauga

SEQ ID NO: 463247 - RNA, 19 nt, Homo sapiens
ucacaucugauucuccuau

SEQ ID NO: 463248 - RNA, 19 nt, Homo sapiens
caaguucacaucugauucu

SEQ ID NO: 463249 - RNA, 19 nt, Homo sapiens
uccacaaguucacaucuga

SEQ ID NO: 463250 - RNA, 19 nt, Homo sapiens
gcaggcagagguuucaaag

SEQ ID NO: 463251 - RNA, 19 nt, Homo sapiens
cgagguggccuucucaucu

SEQ ID NO: 463252 - RNA, 19 nt, Homo sapiens
gugaugggauggccuucug

SEQ ID NO: 463253 - RNA, 19 nt, Homo sapiens
agaagaaagagcugaugaa

SEQ ID NO: 463254 - RNA, 19 nt, Homo sapiens
ccagcggaccuuccucauu

SEQ ID NO: 463255 - RNA, 19 nt, Homo sapiens
uguacgggcucaggagauu

SEQ ID NO: 463256 - RNA, 19 nt, Homo sapiens
gagcuccgacaaaggaaga

SEQ ID NO: 463257 - RNA, 19 nt, Homo sapiens
gauggcggacgaggccuua

SEQ ID NO: 463258 - RNA, 19 nt, Homo sapiens
gcacgucgacauccagaac

SEQ ID NO: 463259 - RNA, 19 nt, Homo sapiens
aagaagaaagagcugauga

SEQ ID NO: 463260 - RNA, 19 nt, Homo sapiens
ggaggcugcagcaucaaga

SEQ ID NO: 463261 - RNA, 19 nt, Homo sapiens
ggaacagcaggcagagguu

SEQ ID NO: 463262 - RNA, 19 nt, Homo sapiens
cacaaguucacaucugauu

SEQ ID NO: 463263 - RNA, 19 nt, Homo sapiens
ucccaacaguggcucaaga

SEQ ID NO: 463264 - RNA, 19 nt, Homo sapiens
ugauugagaagcuggagaa

SEQ ID NO: 463265 - RNA, 19 nt, Homo sapiens
ggccugcgcgugucuaauc

SEQ ID NO: 463266 - RNA, 19 nt, Homo sapiens
ggaggucacagcagaucug

SEQ ID NO: 463267 - RNA, 19 nt, Homo sapiens
gauaccuccucccgguuca

SEQ ID NO: 463268 - RNA, 19 nt, Homo sapiens
guccacaaguucacaucug

SEQ ID NO: 463269 - RNA, 19 nt, Homo sapiens
ggaucucaccagaaaggaa

SEQ ID NO: 463270 - RNA, 19 nt, Homo sapiens
caagugugucuucaccuau

SEQ ID NO: 463271 - RNA, 19 nt, Homo sapiens
cgugagcuccgacaaagga

SEQ ID NO: 463272 - RNA, 19 nt, Homo sapiens
gcgcgcaaggccaugauug

SEQ ID NO: 463273 - RNA, 19 nt, Homo sapiens
ggcagcaccaugaugcaaa

SEQ ID NO: 463274 - RNA, 19 nt, Homo sapiens
gcugagcagacccgaguga

SEQ ID NO: 463275 - RNA, 19 nt, Homo sapiens
gcucaagagaggacagcaa

SEQ ID NO: 463276 - RNA, 19 nt, Homo sapiens
ugcagucgcucuacaacca

SEQ ID NO: 463277 - RNA, 19 nt, Homo sapiens
cauccgggcugcacuucgu

SEQ ID NO: 463278 - RNA, 19 nt, Homo sapiens
gcagacccgagugaacaaa

SEQ ID NO: 463279 - RNA, 19 nt, Homo sapiens
ccacauucaccaucgagau

SEQ ID NO: 463280 - RNA, 19 nt, Homo sapiens
ggcaggacaacaaggagaa

SEQ ID NO: 463281 - RNA, 19 nt, Homo sapiens
aagugugucuucaccuaug

SEQ ID NO: 463282 - RNA, 19 nt, Homo sapiens
ccugaggccuucgacuaug

SEQ ID NO: 463283 - RNA, 19 nt, Homo sapiens
gcuacgagcacgucgacau

SEQ ID NO: 463284 - RNA, 19 nt, Homo sapiens
gaugacuauugaggaugaa

SEQ ID NO: 463285 - RNA, 19 nt, Homo sapiens
aggagcugaugacuauuga

SEQ ID NO: 463286 - RNA, 19 nt, Homo sapiens
ggucaacaagcuucugucu

SEQ ID NO: 463287 - RNA, 19 nt, Homo sapiens
aggaggcccuggcauccaa

SEQ ID NO: 463288 - RNA, 19 nt, Homo sapiens
gcucguccacuccaaugau

SEQ ID NO: 463289 - RNA, 19 nt, Homo sapiens
ggaauugacugcacuguug

SEQ ID NO: 463290 - RNA, 19 nt, Homo sapiens
gcgaagcgcuggugaguau

SEQ ID NO: 463291 - RNA, 19 nt, Homo sapiens
gcaaggccaugauugagaa

SEQ ID NO: 463292 - RNA, 19 nt, Homo sapiens
acacguacauccaggaauu

SEQ ID NO: 463293 - RNA, 19 nt, Homo sapiens
cagcggaccuuccucauuc

SEQ ID NO: 463294 - RNA, 19 nt, Homo sapiens
ccaagugugucuucaccua

SEQ ID NO: 463295 - RNA, 19 nt, Homo sapiens
cugaggagcugaugacuau

SEQ ID NO: 463296 - RNA, 19 nt, Homo sapiens
cgaggaggcugcagcauca

SEQ ID NO: 463297 - RNA, 19 nt, Homo sapiens
ugaacgauguggaggaauu

SEQ ID NO: 463298 - RNA, 19 nt, Homo sapiens
gaucagagcacggacuuug

SEQ ID NO: 463299 - RNA, 19 nt, Homo sapiens
gggcuggacugagagaauu

SEQ ID NO: 463300 - RNA, 19 nt, Homo sapiens
gcaccaugaugcaaaccaa

SEQ ID NO: 463301 - RNA, 19 nt, Homo sapiens
gcugauggcucugcuguca

SEQ ID NO: 463302 - RNA, 19 nt, Homo sapiens
uugagaagcuggagaagga

SEQ ID NO: 463303 - RNA, 19 nt, Homo sapiens
gaagaaagagcugaugaag

SEQ ID NO: 463304 - RNA, 19 nt, Homo sapiens
gaacagcaggcagagguuu

SEQ ID NO: 463305 - RNA, 19 nt, Homo sapiens
agaacuggcugcacucuca

SEQ ID NO: 463306 - RNA, 19 nt, Homo sapiens
gcacuguuaccaagacuga

SEQ ID NO: 463307 - RNA, 19 nt, Homo sapiens
ggagguggacgacaugaug

SEQ ID NO: 463308 - RNA, 19 nt, Homo sapiens
gcugaugacuauugaggau

SEQ ID NO: 463309 - RNA, 19 nt, Homo sapiens
gaggagcugaugacuauug

SEQ ID NO: 463310 - RNA, 19 nt, Homo sapiens
gggaucguguccacaaguu

SEQ ID NO: 463311 - RNA, 19 nt, Homo sapiens
ugaugacuauugaggauga

SEQ ID NO: 463312 - RNA, 19 nt, Homo sapiens
gaagcgcuggugaguauga

SEQ ID NO: 463313 - RNA, 19 nt, Homo sapiens
gagguggccuucucaucug

SEQ ID NO: 463314 - RNA, 19 nt, Homo sapiens
gagcagacccgagugaaca

SEQ ID NO: 463315 - RNA, 19 nt, Homo sapiens
ucacucaugucaccagcuu

SEQ ID NO: 463316 - RNA, 19 nt, Homo sapiens
caugaacgauguggaggaa

SEQ ID NO: 463317 - RNA, 19 nt, Homo sapiens
gcagcguuuugauaaauua

SEQ ID NO: 463318 - RNA, 19 nt, Homo sapiens
ccaagaagaugggcagcau

SEQ ID NO: 463319 - RNA, 19 nt, Homo sapiens
gaaccgacgccagaacuuc

SEQ ID NO: 463320 - RNA, 19 nt, Homo sapiens
gaagaagaaagagcugaug

SEQ ID NO: 463321 - RNA, 19 nt, Homo sapiens
ggccuuagcugggcuggau

SEQ ID NO: 463322 - RNA, 19 nt, Homo sapiens
gugaggcgcucggagaaug

SEQ ID NO: 463323 - RNA, 19 nt, Homo sapiens
uggacaagaugcuggauca

SEQ ID NO: 463324 - RNA, 19 nt, Homo sapiens
gcacacaggcuggaacagu

SEQ ID NO: 463325 - RNA, 19 nt, Homo sapiens
gaacgauguggaggaauug

SEQ ID NO: 463326 - RNA, 19 nt, Homo sapiens
gacaagaugcuggaucaga

SEQ ID NO: 463327 - RNA, 19 nt, Homo sapiens
ccaacagcaucaagcagau

SEQ ID NO: 463328 - RNA, 19 nt, Homo sapiens
gagaccagcgggacaagga

SEQ ID NO: 463329 - RNA, 19 nt, Homo sapiens
caaggagcaacgaggagua

SEQ ID NO: 463330 - RNA, 19 nt, Homo sapiens
gcugaggagcugaugacua

SEQ ID NO: 463331 - RNA, 19 nt, Homo sapiens
gaucguguccacaaguuca

SEQ ID NO: 463332 - RNA, 19 nt, Homo sapiens
guacauccaggaauucuac

SEQ ID NO: 463333 - RNA, 19 nt, Homo sapiens
ggcaguggcagcaccauga

SEQ ID NO: 463334 - RNA, 19 nt, Homo sapiens
ccagagggcagaacugaca

SEQ ID NO: 463335 - RNA, 19 nt, Homo sapiens
gcagcaccaugaugcaaac

SEQ ID NO: 463336 - RNA, 19 nt, Homo sapiens
ucagagcacggacuuugaa

SEQ ID NO: 463337 - RNA, 19 nt, Homo sapiens
gagguggacgacaugauga

SEQ ID NO: 463338 - RNA, 19 nt, Homo sapiens
ucacaucugauucuccuau

SEQ ID NO: 463339 - RNA, 19 nt, Homo sapiens
caaguucacaucugauucu

SEQ ID NO: 463340 - RNA, 19 nt, Homo sapiens
uccacaaguucacaucuga

SEQ ID NO: 463341 - RNA, 19 nt, Homo sapiens
gcaggcagagguuucaaag

SEQ ID NO: 463342 - RNA, 19 nt, Homo sapiens
ggaugcugguggacugugu

SEQ ID NO: 463343 - RNA, 19 nt, Homo sapiens
cgagguggccuucucaucu

SEQ ID NO: 463344 - RNA, 19 nt, Homo sapiens
gugaugggauggccuucug

SEQ ID NO: 463345 - RNA, 19 nt, Homo sapiens
agaagaaagagcugaugaa

SEQ ID NO: 463346 - RNA, 19 nt, Homo sapiens
ccagcggaccuuccucauu

SEQ ID NO: 463347 - RNA, 19 nt, Homo sapiens
uguacgggcucaggagauu

SEQ ID NO: 463348 - RNA, 19 nt, Homo sapiens
gagcuccgacaaaggaaga

SEQ ID NO: 463349 - RNA, 19 nt, Homo sapiens
gcacgucgacauccagaac

SEQ ID NO: 463350 - RNA, 19 nt, Homo sapiens
aagaagaaagagcugauga

SEQ ID NO: 463351 - RNA, 19 nt, Homo sapiens
ggaggcugcagcaucaaga

SEQ ID NO: 463352 - RNA, 19 nt, Homo sapiens
ggaacagcaggcagagguu

SEQ ID NO: 463353 - RNA, 19 nt, Homo sapiens
gauggcggacgaggccuua

SEQ ID NO: 463354 - RNA, 19 nt, Homo sapiens
cacaaguucacaucugauu

SEQ ID NO: 463355 - RNA, 19 nt, Homo sapiens
ucccaacaguggcucaaga

SEQ ID NO: 463356 - RNA, 19 nt, Homo sapiens
ugauugagaagcuggagaa

SEQ ID NO: 463357 - RNA, 19 nt, Homo sapiens
ggccugcgcgugucuaauc

SEQ ID NO: 463358 - RNA, 19 nt, Homo sapiens
ggaggucacagcagaucug

SEQ ID NO: 463359 - RNA, 19 nt, Homo sapiens
ggaucucaccagaaaggaa

SEQ ID NO: 463360 - RNA, 19 nt, Homo sapiens
gauaccuccucccgguuca

SEQ ID NO: 463361 - RNA, 19 nt, Homo sapiens
guccacaaguucacaucug

SEQ ID NO: 463362 - RNA, 19 nt, Homo sapiens
caagugugucuucaccuau

SEQ ID NO: 463363 - RNA, 19 nt, Homo sapiens
cgugagcuccgacaaagga

SEQ ID NO: 463364 - RNA, 19 nt, Homo sapiens
gcgcgcaaggccaugauug

SEQ ID NO: 463365 - RNA, 19 nt, Homo sapiens
ggcagcaccaugaugcaaa

SEQ ID NO: 463366 - RNA, 19 nt, Homo sapiens
gcugagcagacccgaguga

SEQ ID NO: 463367 - RNA, 19 nt, Homo sapiens
gcucaagagaggacagcaa

SEQ ID NO: 463368 - RNA, 19 nt, Homo sapiens
ugcagucgcucuacaacca

SEQ ID NO: 463369 - RNA, 19 nt, Homo sapiens
cauccgggcugcacuucgu

SEQ ID NO: 463370 - RNA, 19 nt, Homo sapiens
ggcaggacaacaaggagaa

SEQ ID NO: 463371 - RNA, 19 nt, Homo sapiens
gcagacccgagugaacaaa

SEQ ID NO: 463372 - RNA, 19 nt, Homo sapiens
ccacauucaccaucgagau

SEQ ID NO: 463373 - RNA, 19 nt, Homo sapiens
aagugugucuucaccuaug

SEQ ID NO: 463374 - RNA, 19 nt, Homo sapiens
ccugaggccuucgacuaug

SEQ ID NO: 463375 - RNA, 19 nt, Homo sapiens
gcuacgagcacgucgacau

SEQ ID NO: 463376 - RNA, 19 nt, Homo sapiens
gaugacuauugaggaugaa

SEQ ID NO: 463377 - RNA, 19 nt, Homo sapiens
aggagcugaugacuauuga

SEQ ID NO: 463378 - RNA, 19 nt, Homo sapiens
ggucaacaagcuucugucu

SEQ ID NO: 463379 - RNA, 19 nt, Homo sapiens
aggaggcccuggcauccaa

SEQ ID NO: 463380 - RNA, 19 nt, Homo sapiens
gcucguccacuccaaugau

SEQ ID NO: 463381 - RNA, 19 nt, Homo sapiens
ggaauugacugcacuguug

SEQ ID NO: 463382 - RNA, 19 nt, Homo sapiens
gcgaagcgcuggugaguau

SEQ ID NO: 463383 - RNA, 19 nt, Homo sapiens
gcaaggccaugauugagaa

SEQ ID NO: 463384 - RNA, 19 nt, Homo sapiens
cagcggaccuuccucauuc

SEQ ID NO: 463385 - RNA, 19 nt, Homo sapiens
ccaagugugucuucaccua

SEQ ID NO: 463386 - RNA, 19 nt, Homo sapiens
cugaggagcugaugacuau

SEQ ID NO: 463387 - RNA, 19 nt, Homo sapiens
cgaggaggcugcagcauca

SEQ ID NO: 463388 - RNA, 19 nt, Homo sapiens
ugaacgauguggaggaauu

SEQ ID NO: 463389 - RNA, 19 nt, Homo sapiens
gaucagagcacggacuuug

SEQ ID NO: 463390 - RNA, 19 nt, Homo sapiens
gggcuggacugagagaauu

SEQ ID NO: 463391 - RNA, 19 nt, Homo sapiens
gcaccaugaugcaaaccaa

SEQ ID NO: 463392 - RNA, 19 nt, Homo sapiens
gcugauggcucugcuguca

SEQ ID NO: 463393 - RNA, 19 nt, Homo sapiens
uugagaagcuggagaagga

SEQ ID NO: 463394 - RNA, 19 nt, Homo sapiens
gaagaaagagcugaugaag

SEQ ID NO: 463395 - RNA, 19 nt, Homo sapiens
gaacagcaggcagagguuu

SEQ ID NO: 463396 - RNA, 19 nt, Homo sapiens
agaacuggcugcacucuca

SEQ ID NO: 463397 - RNA, 19 nt, Homo sapiens
gcacuguuaccaagacuga

SEQ ID NO: 463398 - RNA, 19 nt, Homo sapiens
ggagguggacgacaugaug

SEQ ID NO: 463399 - RNA, 19 nt, Homo sapiens
gcugaugacuauugaggau

SEQ ID NO: 463400 - RNA, 19 nt, Homo sapiens
gaggagcugaugacuauug

SEQ ID NO: 463401 - RNA, 19 nt, Homo sapiens
gggaucguguccacaaguu

SEQ ID NO: 463402 - RNA, 19 nt, Homo sapiens
ugaugacuauugaggauga

SEQ ID NO: 463403 - RNA, 19 nt, Homo sapiens
gaagcgcuggugaguauga

SEQ ID NO: 463404 - RNA, 19 nt, Homo sapiens
gagguggccuucucaucug

SEQ ID NO: 463405 - RNA, 19 nt, Homo sapiens
gagcagacccgagugaaca

SEQ ID NO: 463406 - RNA, 19 nt, Homo sapiens
ucacucaugucaccagcuu

SEQ ID NO: 463407 - RNA, 19 nt, Homo sapiens
caugaacgauguggaggaa

SEQ ID NO: 463408 - RNA, 19 nt, Homo sapiens
gcagcguuuugauaaauua

SEQ ID NO: 463409 - RNA, 19 nt, Homo sapiens
ccaagaagaugggcagcau

SEQ ID NO: 463410 - RNA, 19 nt, Homo sapiens
gaaccgacgccagaacuuc

SEQ ID NO: 463411 - RNA, 19 nt, Homo sapiens
gaagaagaaagagcugaug

SEQ ID NO: 463412 - RNA, 19 nt, Homo sapiens
ggccuuagcugggcuggau

SEQ ID NO: 463413 - RNA, 19 nt, Homo sapiens
gugaggcgcucggagaaug

SEQ ID NO: 463414 - RNA, 19 nt, Homo sapiens
uggacaagaugcuggauca

SEQ ID NO: 463415 - RNA, 19 nt, Homo sapiens
gcacacaggcuggaacagu

SEQ ID NO: 463416 - RNA, 19 nt, Homo sapiens
gaacgauguggaggaauug

SEQ ID NO: 463417 - RNA, 19 nt, Homo sapiens
gacaagaugcuggaucaga

SEQ ID NO: 463418 - RNA, 19 nt, Homo sapiens
ccaacagcaucaagcagau

SEQ ID NO: 463419 - RNA, 19 nt, Homo sapiens
gagaccagcgggacaagga

SEQ ID NO: 463420 - RNA, 19 nt, Homo sapiens
caaggagcaacgaggagua

SEQ ID NO: 463421 - RNA, 19 nt, Homo sapiens
gcugaggagcugaugacua

SEQ ID NO: 463422 - RNA, 19 nt, Homo sapiens
gaucguguccacaaguuca

SEQ ID NO: 463423 - RNA, 19 nt, Homo sapiens
ggcaguggcagcaccauga

SEQ ID NO: 463424 - RNA, 19 nt, Homo sapiens
ccagagggcagaacugaca

SEQ ID NO: 463425 - RNA, 19 nt, Homo sapiens
gcagcaccaugaugcaaac

SEQ ID NO: 463426 - RNA, 19 nt, Homo sapiens
ucagagcacggacuuugaa

SEQ ID NO: 463427 - RNA, 19 nt, Homo sapiens
gagguggacgacaugauga

SEQ ID NO: 463428 - RNA, 19 nt, Homo sapiens
ucacaucugauucuccuau

SEQ ID NO: 463429 - RNA, 19 nt, Homo sapiens
caaguucacaucugauucu

SEQ ID NO: 463430 - RNA, 19 nt, Homo sapiens
uccacaaguucacaucuga

SEQ ID NO: 463431 - RNA, 19 nt, Homo sapiens
gcaggcagagguuucaaag

SEQ ID NO: 463432 - RNA, 19 nt, Homo sapiens
cgagguggccuucucaucu

SEQ ID NO: 463433 - RNA, 19 nt, Homo sapiens
gugaugggauggccuucug

SEQ ID NO: 463434 - RNA, 19 nt, Homo sapiens
agaagaaagagcugaugaa

SEQ ID NO: 463435 - RNA, 19 nt, Homo sapiens
ccagcggaccuuccucauu

SEQ ID NO: 463436 - RNA, 19 nt, Homo sapiens
uguacgggcucaggagauu

SEQ ID NO: 463437 - RNA, 19 nt, Homo sapiens
gagcuccgacaaaggaaga

SEQ ID NO: 463438 - RNA, 19 nt, Homo sapiens
gauggcggacgaggccuua

SEQ ID NO: 463439 - RNA, 19 nt, Homo sapiens
gcacgucgacauccagaac

SEQ ID NO: 463440 - RNA, 19 nt, Homo sapiens
aagaagaaagagcugauga

SEQ ID NO: 463441 - RNA, 19 nt, Homo sapiens
ggaggcugcagcaucaaga

SEQ ID NO: 463442 - RNA, 19 nt, Homo sapiens
ggaacagcaggcagagguu

SEQ ID NO: 463443 - RNA, 19 nt, Homo sapiens
cacaaguucacaucugauu

SEQ ID NO: 463444 - RNA, 19 nt, Homo sapiens
ucccaacaguggcucaaga

SEQ ID NO: 463445 - RNA, 19 nt, Homo sapiens
ugauugagaagcuggagaa

SEQ ID NO: 463446 - RNA, 19 nt, Homo sapiens
ggccugcgcgugucuaauc

SEQ ID NO: 463447 - RNA, 19 nt, Homo sapiens
ggaggucacagcagaucug

SEQ ID NO: 463448 - RNA, 19 nt, Homo sapiens
gauaccuccucccgguuca

SEQ ID NO: 463449 - RNA, 19 nt, Homo sapiens
guccacaaguucacaucug

SEQ ID NO: 463450 - RNA, 19 nt, Homo sapiens
ggaucucaccagaaaggaa

SEQ ID NO: 463451 - RNA, 19 nt, Homo sapiens
caagugugucuucaccuau

SEQ ID NO: 463452 - RNA, 19 nt, Homo sapiens
cgugagcuccgacaaagga

SEQ ID NO: 463453 - RNA, 19 nt, Homo sapiens
gcgcgcaaggccaugauug

SEQ ID NO: 463454 - RNA, 19 nt, Homo sapiens
ggcagcaccaugaugcaaa

SEQ ID NO: 463455 - RNA, 19 nt, Homo sapiens
gcugagcagacccgaguga

SEQ ID NO: 463456 - RNA, 19 nt, Homo sapiens
gcucaagagaggacagcaa

SEQ ID NO: 463457 - RNA, 19 nt, Homo sapiens
ugcagucgcucuacaacca

SEQ ID NO: 463458 - RNA, 19 nt, Homo sapiens
gaagaugcugguggacugu

SEQ ID NO: 463459 - RNA, 19 nt, Homo sapiens
cauccgggcugcacuucgu

SEQ ID NO: 463460 - RNA, 19 nt, Homo sapiens
gcagacccgagugaacaaa

SEQ ID NO: 463461 - RNA, 19 nt, Homo sapiens
ccacauucaccaucgagau

SEQ ID NO: 463462 - RNA, 19 nt, Homo sapiens
ggcaggacaacaaggagaa

SEQ ID NO: 463463 - RNA, 19 nt, Homo sapiens
aagugugucuucaccuaug

SEQ ID NO: 463464 - RNA, 19 nt, Homo sapiens
ccugaggccuucgacuaug

SEQ ID NO: 463465 - RNA, 19 nt, Homo sapiens
gcuacgagcacgucgacau

SEQ ID NO: 463466 - RNA, 19 nt, Homo sapiens
gaugacuauugaggaugaa

SEQ ID NO: 463467 - RNA, 19 nt, Homo sapiens
aggagcugaugacuauuga

SEQ ID NO: 463468 - RNA, 19 nt, Homo sapiens
ggucaacaagcuucugucu

SEQ ID NO: 463469 - RNA, 19 nt, Homo sapiens
aggaggcccuggcauccaa

SEQ ID NO: 463470 - RNA, 19 nt, Homo sapiens
gcucguccacuccaaugau

SEQ ID NO: 463471 - RNA, 19 nt, Homo sapiens
gccaaaggcucuacucuua

SEQ ID NO: 463472 - RNA, 19 nt, Homo sapiens
gcacuuacacuuaugauua

SEQ ID NO: 463473 - RNA, 19 nt, Homo sapiens
gaagagacucggcaaguua

SEQ ID NO: 463474 - RNA, 19 nt, Homo sapiens
agaggaggcuguuuguuua

SEQ ID NO: 463475 - RNA, 19 nt, Homo sapiens
aaacauugcucaugccaaa

SEQ ID NO: 463476 - RNA, 19 nt, Homo sapiens
gaaagaaacggaugaugga

SEQ ID NO: 463477 - RNA, 19 nt, Homo sapiens
aaacaccaguugacgcuua

SEQ ID NO: 463478 - RNA, 19 nt, Homo sapiens
gaggccagauguaccuuua

SEQ ID NO: 463479 - RNA, 19 nt, Homo sapiens
ucuuauggcuggcuucuua

SEQ ID NO: 463480 - RNA, 19 nt, Homo sapiens
gaggauauuuguggcauuu

SEQ ID NO: 463481 - RNA, 19 nt, Homo sapiens
caaaggcucuacucuuaug

SEQ ID NO: 463482 - RNA, 19 nt, Homo sapiens
ggaauucaaugccuuacug

SEQ ID NO: 463483 - RNA, 19 nt, Homo sapiens
gcugguugcuccaauauug

SEQ ID NO: 463484 - RNA, 19 nt, Homo sapiens
gcagugaucuacacagaca

SEQ ID NO: 463485 - RNA, 19 nt, Homo sapiens
gaaagaaagaaacggauga

SEQ ID NO: 463486 - RNA, 19 nt, Homo sapiens
uauauaccaugccugaaua

SEQ ID NO: 463487 - RNA, 19 nt, Homo sapiens
gaaugugaccaaccugaua

SEQ ID NO: 463488 - RNA, 19 nt, Homo sapiens
uaagaaagaagcccugaaa

SEQ ID NO: 463489 - RNA, 19 nt, Homo sapiens
ggauauuuguggcauuuau

SEQ ID NO: 463490 - RNA, 19 nt, Homo sapiens
agaagaaccugguggugaa

SEQ ID NO: 463491 - RNA, 19 nt, Homo sapiens
uggaauggcuggcuuuguu

SEQ ID NO: 463492 - RNA, 19 nt, Homo sapiens
uaacagugccaguaccaua

SEQ ID NO: 463493 - RNA, 19 nt, Homo sapiens
ccaggauacuguuuacuga

SEQ ID NO: 463494 - RNA, 19 nt, Homo sapiens
uaccaugccugaauacuug

SEQ ID NO: 463495 - RNA, 19 nt, Homo sapiens
ucacgggacucauuacugu

SEQ ID NO: 463496 - RNA, 19 nt, Homo sapiens
gaaaagagcauucugagau

SEQ ID NO: 463497 - RNA, 19 nt, Homo sapiens
caucaaagacauccauuau

SEQ ID NO: 463498 - RNA, 19 nt, Homo sapiens
gaaagaagcccugaaaaug

SEQ ID NO: 463499 - RNA, 19 nt, Homo sapiens
gaagcaccgugaguggaua

SEQ ID NO: 463500 - RNA, 19 nt, Homo sapiens
ggauacuguuuacugauga

SEQ ID NO: 463501 - RNA, 19 nt, Homo sapiens
cagcagacauugccauagu

SEQ ID NO: 463502 - RNA, 19 nt, Homo sapiens
uaagagaagguacauguug

SEQ ID NO: 463503 - RNA, 19 nt, Homo sapiens
ggaaguucauagacugguu

SEQ ID NO: 463504 - RNA, 19 nt, Homo sapiens
gauguuaaucuguugguaa

SEQ ID NO: 463505 - RNA, 19 nt, Homo sapiens
aagaggaggcuguuuguuu

SEQ ID NO: 463506 - RNA, 19 nt, Homo sapiens
agaaagagagaaagaaaga

SEQ ID NO: 463507 - RNA, 19 nt, Homo sapiens
gaccaucaaccacaucauu

SEQ ID NO: 463508 - RNA, 19 nt, Homo sapiens
gccauaggauucaggucua

SEQ ID NO: 463509 - RNA, 19 nt, Homo sapiens
guuuacagaugcuagaaga

SEQ ID NO: 463510 - RNA, 19 nt, Homo sapiens
gagaugcagugagaauaau

SEQ ID NO: 463511 - RNA, 19 nt, Homo sapiens
ugagaugcagugagaauaa

SEQ ID NO: 463512 - RNA, 19 nt, Homo sapiens
uaaagcuccugccaauguu

SEQ ID NO: 463513 - RNA, 19 nt, Homo sapiens
gaaguucauagacugguuu

SEQ ID NO: 463514 - RNA, 19 nt, Homo sapiens
ugagaaagagagaaagaaa

SEQ ID NO: 463515 - RNA, 19 nt, Homo sapiens
uugcagcucugaugaguga

SEQ ID NO: 463516 - RNA, 19 nt, Homo sapiens
gccaauguuuaucauaguu

SEQ ID NO: 463517 - RNA, 19 nt, Homo sapiens
agaagagacucggcaaguu

SEQ ID NO: 463518 - RNA, 19 nt, Homo sapiens
ggaagaggaggcuguuugu

SEQ ID NO: 463519 - RNA, 19 nt, Homo sapiens
ggaggucgguacuggaagu

SEQ ID NO: 463520 - RNA, 19 nt, Homo sapiens
ugaccaaccugauaauagg

SEQ ID NO: 463521 - RNA, 19 nt, Homo sapiens
uucaggagguagcagauua

SEQ ID NO: 463522 - RNA, 19 nt, Homo sapiens
ucggcaaguuaaaguaaua

SEQ ID NO: 463523 - RNA, 19 nt, Homo sapiens
aguaagagccucagcaaga

SEQ ID NO: 463524 - RNA, 19 nt, Homo sapiens
ggaggauauuuguggcauu

SEQ ID NO: 463525 - RNA, 19 nt, Homo sapiens
guauauaccaugccugaau

SEQ ID NO: 463526 - RNA, 19 nt, Homo sapiens
guaagagccucagcaagag

SEQ ID NO: 463527 - RNA, 19 nt, Homo sapiens
gaaaucugaagacagcauu

SEQ ID NO: 463528 - RNA, 19 nt, Homo sapiens
caaagacauccauuauaug

SEQ ID NO: 463529 - RNA, 19 nt, Homo sapiens
uuaaagcuccugccaaugu

SEQ ID NO: 463530 - RNA, 19 nt, Homo sapiens
ucuuaaagcuccugccaau

SEQ ID NO: 463531 - RNA, 19 nt, Homo sapiens
guuaagagaagguacaugu

SEQ ID NO: 463532 - RNA, 19 nt, Homo sapiens
gaaguuaagagaagguaca

SEQ ID NO: 463533 - RNA, 19 nt, Homo sapiens
caacuucugggauggguuu

SEQ ID NO: 463534 - RNA, 19 nt, Homo sapiens
gaaagagagaaagaaagaa

SEQ ID NO: 463535 - RNA, 19 nt, Homo sapiens
ucacaccaccucccacaaa

SEQ ID NO: 463536 - RNA, 19 nt, Homo sapiens
ccauaguggcccuguauuu

SEQ ID NO: 463537 - RNA, 19 nt, Homo sapiens
gcucugcucaugaucauug

SEQ ID NO: 463538 - RNA, 19 nt, Homo sapiens
caacccaguggcauccuua

SEQ ID NO: 463539 - RNA, 19 nt, Homo sapiens
uucaaugccuuacugcuuu

SEQ ID NO: 463540 - RNA, 19 nt, Homo sapiens
ggucgguacuggaaguuca

SEQ ID NO: 463541 - RNA, 19 nt, Homo sapiens
ucuaugaccuggguaacaa

SEQ ID NO: 463542 - RNA, 19 nt, Homo sapiens
gcaaggaggccagauguac

SEQ ID NO: 463543 - RNA, 19 nt, Homo sapiens
gaugauugcagcucugaug

SEQ ID NO: 463544 - RNA, 19 nt, Homo sapiens
uggaagcgcugcaaugaac

SEQ ID NO: 463545 - RNA, 19 nt, Homo sapiens
gauugcagcucugaugagu

SEQ ID NO: 463546 - RNA, 19 nt, Homo sapiens
gaggguccuugcagccaaa

SEQ ID NO: 463547 - RNA, 19 nt, Homo sapiens
ugacauacaaccuuuccaa

SEQ ID NO: 463548 - RNA, 19 nt, Homo sapiens
gcaacccaguggcauccuu

SEQ ID NO: 463549 - RNA, 19 nt, Homo sapiens
gagaauaaugagaccauca

SEQ ID NO: 463550 - RNA, 19 nt, Homo sapiens
ugagcaauauugggaguga

SEQ ID NO: 463551 - RNA, 19 nt, Homo sapiens
uagcaugggugccaaucau

SEQ ID NO: 463552 - RNA, 19 nt, Homo sapiens
gaagaggaggcuguuuguu

SEQ ID NO: 463553 - RNA, 19 nt, Homo sapiens
gagaaagagagaaagaaag

SEQ ID NO: 463554 - RNA, 19 nt, Homo sapiens
auucugagaugcagugaga

SEQ ID NO: 463555 - RNA, 19 nt, Homo sapiens
gcagugggcgcaugggaau

SEQ ID NO: 463556 - RNA, 19 nt, Homo sapiens
cucgauguguacaaacuua

SEQ ID NO: 463557 - RNA, 19 nt, Homo sapiens
uggccuggauucauucuug

SEQ ID NO: 463558 - RNA, 19 nt, Homo sapiens
ugacugcuuugcugacugu

SEQ ID NO: 463559 - RNA, 19 nt, Homo sapiens
ggugagaaagagagaaaga

SEQ ID NO: 463560 - RNA, 19 nt, Homo sapiens
ucaucaaagacauccauua

SEQ ID NO: 463561 - RNA, 19 nt, Homo sapiens
gaauccaacagaugaagau

SEQ ID NO: 463562 - RNA, 19 nt, Homo sapiens
ggaauccaacagaugaaga

SEQ ID NO: 463563 - RNA, 19 nt, Homo sapiens
cauacaaccuuuccaacac

SEQ ID NO: 463564 - RNA, 19 nt, Homo sapiens
ugucucugauucucuauau

SEQ ID NO: 463565 - RNA, 19 nt, Homo sapiens
gaugcagugagaauaauga

SEQ ID NO: 463566 - RNA, 19 nt, Homo sapiens
ccaaaggcucuacucuuau

SEQ ID NO: 463567 - RNA, 19 nt, Homo sapiens
gcuguguguucacuuggaa

SEQ ID NO: 463568 - RNA, 19 nt, Homo sapiens
caccgugaguggauacuuc

SEQ ID NO: 463569 - RNA, 19 nt, Homo sapiens
aaaguaagagccucagcaa

SEQ ID NO: 463570 - RNA, 19 nt, Homo sapiens
gauucgaaccaccaccuuu

SEQ ID NO: 463571 - RNA, 19 nt, Homo sapiens
gaauuucccucuuaacaaa

SEQ ID NO: 463572 - RNA, 19 nt, Homo sapiens
gaauggacuuccucaguaa

SEQ ID NO: 463573 - RNA, 19 nt, Homo sapiens
uaacagaguuugcuuaugg

SEQ ID NO: 463574 - RNA, 19 nt, Homo sapiens
gaaggccgcuugcauuaug

SEQ ID NO: 463575 - RNA, 19 nt, Homo sapiens
ggacaugucucacgugaag

SEQ ID NO: 463576 - RNA, 19 nt, Homo sapiens
ccugauagcuggacggaua

SEQ ID NO: 463577 - RNA, 19 nt, Homo sapiens
guuaauuucugcagacaua

SEQ ID NO: 463578 - RNA, 19 nt, Homo sapiens
ugaauggacuuccucagua

SEQ ID NO: 463579 - RNA, 19 nt, Homo sapiens
ggacggauauuuguucuuc

SEQ ID NO: 463580 - RNA, 19 nt, Homo sapiens
cauauuugcuggagccaua

SEQ ID NO: 463581 - RNA, 19 nt, Homo sapiens
gaagaagauuauccugaga

SEQ ID NO: 463582 - RNA, 19 nt, Homo sapiens
uaucugagccauuagaaua

SEQ ID NO: 463583 - RNA, 19 nt, Homo sapiens
ggacaauagugaacaucaa

SEQ ID NO: 463584 - RNA, 19 nt, Homo sapiens
ggaauuauauuuggaaugc

SEQ ID NO: 463585 - RNA, 19 nt, Homo sapiens
caaccgagguacuauagga

SEQ ID NO: 463586 - RNA, 19 nt, Homo sapiens
gaaagcuuaugacuuguuc

SEQ ID NO: 463587 - RNA, 19 nt, Homo sapiens
gacccaagcuaaccaagga

SEQ ID NO: 463588 - RNA, 19 nt, Homo sapiens
cgauauagaugcagaagag

SEQ ID NO: 463589 - RNA, 19 nt, Homo sapiens
guucuucuauuaacuguug

SEQ ID NO: 463590 - RNA, 19 nt, Homo sapiens
gaaacacuguggcguugau

SEQ ID NO: 463591 - RNA, 19 nt, Homo sapiens
agaaagagcuccugauagc

SEQ ID NO: 463592 - RNA, 19 nt, Homo sapiens
gaaguuggagguuaugaga

SEQ ID NO: 463593 - RNA, 19 nt, Homo sapiens
ucacguggaugccucaaga

SEQ ID NO: 463594 - RNA, 19 nt, Homo sapiens
gugaaggccgcuugcauua

SEQ ID NO: 463595 - RNA, 19 nt, Homo sapiens
gaagcaagcgucggagaaa

SEQ ID NO: 463596 - RNA, 19 nt, Homo sapiens
ccauugaccucuacaccaa

SEQ ID NO: 463597 - RNA, 19 nt, Homo sapiens
gcagaagggacccaagcua

SEQ ID NO: 463598 - RNA, 19 nt, Homo sapiens
ggaagaaacagaugauggu

SEQ ID NO: 463599 - RNA, 19 nt, Homo sapiens
guaacugucccaagauuau

SEQ ID NO: 463600 - RNA, 19 nt, Homo sapiens
cagaagggacccaagcuaa

SEQ ID NO: 463601 - RNA, 19 nt, Homo sapiens
gggcgaugcugaagaccaa

SEQ ID NO: 463602 - RNA, 19 nt, Homo sapiens
gcgaaucgauauagaugca

SEQ ID NO: 463603 - RNA, 19 nt, Homo sapiens
gagcgaaucgauauagaug

SEQ ID NO: 463604 - RNA, 19 nt, Homo sapiens
guacacagauaugguagca

SEQ ID NO: 463605 - RNA, 19 nt, Homo sapiens
ugaugaccaugccggaaua

SEQ ID NO: 463606 - RNA, 19 nt, Homo sapiens
agaagauuauccugagaaa

SEQ ID NO: 463607 - RNA, 19 nt, Homo sapiens
gagaaagagcuccugauag

SEQ ID NO: 463608 - RNA, 19 nt, Homo sapiens
ggaagcaagcgucggagaa

SEQ ID NO: 463609 - RNA, 19 nt, Homo sapiens
uaugguagcauguguggua

SEQ ID NO: 463610 - RNA, 19 nt, Homo sapiens
ggaggacaauagugaacau

SEQ ID NO: 463611 - RNA, 19 nt, Homo sapiens
gugcacaaaucaggucauu

SEQ ID NO: 463612 - RNA, 19 nt, Homo sapiens
guacaaguuucucaaaaug

SEQ ID NO: 463613 - RNA, 19 nt, Homo sapiens
ccgaaaugcugcugacauc

SEQ ID NO: 463614 - RNA, 19 nt, Homo sapiens
ggccaggaauuauauuugg

SEQ ID NO: 463615 - RNA, 19 nt, Homo sapiens
ugaagcugcugcccauguu

SEQ ID NO: 463616 - RNA, 19 nt, Homo sapiens
ucaagaaagcuuaugacuu

SEQ ID NO: 463617 - RNA, 19 nt, Homo sapiens
cagaggagcgaaucgauau

SEQ ID NO: 463618 - RNA, 19 nt, Homo sapiens
guaauguugcugauucuug

SEQ ID NO: 463619 - RNA, 19 nt, Homo sapiens
agaguuugcuuauggaaca

SEQ ID NO: 463620 - RNA, 19 nt, Homo sapiens
gaccaaccgagguacuaua

SEQ ID NO: 463621 - RNA, 19 nt, Homo sapiens
uacuaugccugaacucuau

SEQ ID NO: 463622 - RNA, 19 nt, Homo sapiens
gaaaugcugcugacaucuc

SEQ ID NO: 463623 - RNA, 19 nt, Homo sapiens
guaaaagagucaaugaaca

SEQ ID NO: 463624 - RNA, 19 nt, Homo sapiens
ggggacaacuugacaauca

SEQ ID NO: 463625 - RNA, 19 nt, Homo sapiens
ccugagaaaucacguggau

SEQ ID NO: 463626 - RNA, 19 nt, Homo sapiens
gccauggccaguacgguua

SEQ ID NO: 463627 - RNA, 19 nt, Homo sapiens
ggagugcacuaucuguacu

SEQ ID NO: 463628 - RNA, 19 nt, Homo sapiens
ugauaacagaguuugcuua

SEQ ID NO: 463629 - RNA, 19 nt, Homo sapiens
acggauauuuguucuucua

SEQ ID NO: 463630 - RNA, 19 nt, Homo sapiens
gggcuuggccucggugauu

SEQ ID NO: 463631 - RNA, 19 nt, Homo sapiens
ggaucuuugucccuaucua

SEQ ID NO: 463632 - RNA, 19 nt, Homo sapiens
ucucagucauugucaucua

SEQ ID NO: 463633 - RNA, 19 nt, Homo sapiens
ccauuacacagaaucaauu

SEQ ID NO: 463634 - RNA, 19 nt, Homo sapiens
ccucggugauuuacacaga

SEQ ID NO: 463635 - RNA, 19 nt, Homo sapiens
agaugaugguguugaagaa

SEQ ID NO: 463636 - RNA, 19 nt, Homo sapiens
uauagaugcagaagagaaa

SEQ ID NO: 463637 - RNA, 19 nt, Homo sapiens
acagaggagcgaaucgaua

SEQ ID NO: 463638 - RNA, 19 nt, Homo sapiens
gccggaauaucucaagaag

SEQ ID NO: 463639 - RNA, 19 nt, Homo sapiens
ggacuuccucaguaauguu

SEQ ID NO: 463640 - RNA, 19 nt, Homo sapiens
ccaguaacaucggcagcaa

SEQ ID NO: 463641 - RNA, 19 nt, Homo sapiens
cuacuaugccugaacucua

SEQ ID NO: 463642 - RNA, 19 nt, Homo sapiens
ggagcgaaucgauauagau

SEQ ID NO: 463643 - RNA, 19 nt, Homo sapiens
gguacaaguuucucaaaau

SEQ ID NO: 463644 - RNA, 19 nt, Homo sapiens
gcacccucuucaccauuga

SEQ ID NO: 463645 - RNA, 19 nt, Homo sapiens
ugugguaccuucugaaugc

SEQ ID NO: 463646 - RNA, 19 nt, Homo sapiens
gccaggaauuauauuugga

SEQ ID NO: 463647 - RNA, 19 nt, Homo sapiens
cagucauugucaucuauuu

SEQ ID NO: 463648 - RNA, 19 nt, Homo sapiens
guggaugccucaagaaagc

SEQ ID NO: 463649 - RNA, 19 nt, Homo sapiens
cagaugaugguguugaaga

SEQ ID NO: 463650 - RNA, 19 nt, Homo sapiens
aaaugcugcugacaucuca

SEQ ID NO: 463651 - RNA, 19 nt, Homo sapiens
uaacuguugugagcauugu

SEQ ID NO: 463652 - RNA, 19 nt, Homo sapiens
caugugugguaccuucuga

SEQ ID NO: 463653 - RNA, 19 nt, Homo sapiens
cagauaugguagcaugugu

SEQ ID NO: 463654 - RNA, 19 nt, Homo sapiens
cgugaaggccgcuugcauu

SEQ ID NO: 463655 - RNA, 19 nt, Homo sapiens
ccauuacagcuuuguggua

SEQ ID NO: 463656 - RNA, 19 nt, Homo sapiens
ggacuccuuccauaucuuc

SEQ ID NO: 463657 - RNA, 19 nt, Homo sapiens
gcggacuccuuccauaucu

SEQ ID NO: 463658 - RNA, 19 nt, Homo sapiens
ggcuaugacugcuguuuac

SEQ ID NO: 463659 - RNA, 19 nt, Homo sapiens
aacucuaucugagccauua

SEQ ID NO: 463660 - RNA, 19 nt, Homo sapiens
gaacucuaucugagccauu

SEQ ID NO: 463661 - RNA, 19 nt, Homo sapiens
caaaacccauuccugaugu

SEQ ID NO: 463662 - RNA, 19 nt, Homo sapiens
uaugugugcuuaccugaag

SEQ ID NO: 463663 - RNA, 19 nt, Homo sapiens
gggcggacuccuuccauau

SEQ ID NO: 463664 - RNA, 19 nt, Homo sapiens
gaggagcgaaucgauauag

SEQ ID NO: 463665 - RNA, 19 nt, Homo sapiens
aauugcagcugucuuugug

SEQ ID NO: 463666 - RNA, 19 nt, Homo sapiens
ucccugaccuccaucuuca

SEQ ID NO: 463667 - RNA, 19 nt, Homo sapiens
ccaggaauuauauuuggaa

SEQ ID NO: 463668 - RNA, 19 nt, Homo sapiens
uggcugugguggucuuuau

SEQ ID NO: 463669 - RNA, 19 nt, Homo sapiens
gaagauuauccugagaaau

SEQ ID NO: 463670 - RNA, 19 nt, Homo sapiens
augcuggccucucucauga

SEQ ID NO: 463671 - RNA, 19 nt, Homo sapiens
gcaaaugaguucaggacua

SEQ ID NO: 463672 - RNA, 19 nt, Homo sapiens
ggaauuaucugcaccuucu

SEQ ID NO: 463673 - RNA, 19 nt, Homo sapiens
ggucaaggguccugaagaa

SEQ ID NO: 463674 - RNA, 19 nt, Homo sapiens
ccaggaaacucgugauuau

SEQ ID NO: 463675 - RNA, 19 nt, Homo sapiens
caaugaggaucgucuguuu

SEQ ID NO: 463676 - RNA, 19 nt, Homo sapiens
ggucuggacugauguguuc

SEQ ID NO: 463677 - RNA, 19 nt, Homo sapiens
gcugggagccuucaucuug

SEQ ID NO: 463678 - RNA, 19 nt, Homo sapiens
ggaucaaccucauggacuu

SEQ ID NO: 463679 - RNA, 19 nt, Homo sapiens
caaaugaguucaggacuac

SEQ ID NO: 463680 - RNA, 19 nt, Homo sapiens
gcuguggucuggacugaug

SEQ ID NO: 463681 - RNA, 19 nt, Homo sapiens
ggacuuugcaguacauugu

SEQ ID NO: 463682 - RNA, 19 nt, Homo sapiens
ggacaucgacagcccauag

SEQ ID NO: 463683 - RNA, 19 nt, Homo sapiens
gcuauacauucuggacuuu

SEQ ID NO: 463684 - RNA, 19 nt, Homo sapiens
cagaaccacucccggauca

SEQ ID NO: 463685 - RNA, 19 nt, Homo sapiens
gagaccagcaggagacaaa

SEQ ID NO: 463686 - RNA, 19 nt, Homo sapiens
uagaagaccucaucaaacc

SEQ ID NO: 463687 - RNA, 19 nt, Homo sapiens
uguagaagaccucaucaaa

SEQ ID NO: 463688 - RNA, 19 nt, Homo sapiens
gcuguacaccggcaucgua

SEQ ID NO: 463689 - RNA, 19 nt, Homo sapiens
acaauacccuacccuaugg

SEQ ID NO: 463690 - RNA, 19 nt, Homo sapiens
gcaggagacaaaccucuga

SEQ ID NO: 463691 - RNA, 19 nt, Homo sapiens
gcuguggcaucgucauguu

SEQ ID NO: 463692 - RNA, 19 nt, Homo sapiens
ugguguggcucuccaugua

SEQ ID NO: 463693 - RNA, 19 nt, Homo sapiens
gaagaacuccccacuggaa

SEQ ID NO: 463694 - RNA, 19 nt, Homo sapiens
ggaaacucgugauuaucuc

SEQ ID NO: 463695 - RNA, 19 nt, Homo sapiens
gaggagccgcuauacauuc

SEQ ID NO: 463696 - RNA, 19 nt, Homo sapiens
ggagguggcaggacagaca

SEQ ID NO: 463697 - RNA, 19 nt, Homo sapiens
caaggguccugaagaacuc

SEQ ID NO: 463698 - RNA, 19 nt, Homo sapiens
guagaagaccucaucaaac

SEQ ID NO: 463699 - RNA, 19 nt, Homo sapiens
ucaaccucauggacuuuaa

SEQ ID NO: 463700 - RNA, 19 nt, Homo sapiens
ugaccgggcuggacaucug

SEQ ID NO: 463701 - RNA, 19 nt, Homo sapiens
acaccggcaucguaaucua

SEQ ID NO: 463702 - RNA, 19 nt, Homo sapiens
uacaauacccuacccuaug

SEQ ID NO: 463703 - RNA, 19 nt, Homo sapiens
cgaggagccgcuauacauu

SEQ ID NO: 463704 - RNA, 19 nt, Homo sapiens
gacagcccauagauuccua

SEQ ID NO: 463705 - RNA, 19 nt, Homo sapiens
guacaccggcaucguaauc

SEQ ID NO: 463706 - RNA, 19 nt, Homo sapiens
cuacaauacccuacccuau

SEQ ID NO: 463707 - RNA, 19 nt, Homo sapiens
gacccgaggagccgcuaua

SEQ ID NO: 463708 - RNA, 19 nt, Homo sapiens
gaucaaccucauggacuuu

SEQ ID NO: 463709 - RNA, 19 nt, Homo sapiens
caucgacagcccauagauu

SEQ ID NO: 463710 - RNA, 19 nt, Homo sapiens
ccgaggagccgcuauacau

SEQ ID NO: 463711 - RNA, 19 nt, Homo sapiens
gcucugauuggcuggauug

SEQ ID NO: 463712 - RNA, 19 nt, Homo sapiens
caucuccuaucucuauuac

SEQ ID NO: 463713 - RNA, 19 nt, Homo sapiens
ggacagcggaacccagagu

SEQ ID NO: 463714 - RNA, 19 nt, Homo sapiens
gagccuucaucuugggaau

SEQ ID NO: 463715 - RNA, 19 nt, Homo sapiens
cccaggaaacucgugauua

SEQ ID NO: 463716 - RNA, 19 nt, Homo sapiens
ucuaugccaucuccuaucu

SEQ ID NO: 463717 - RNA, 19 nt, Homo sapiens
gcacagcauccaccagcau

SEQ ID NO: 463718 - RNA, 19 nt, Homo sapiens
gcuauggccucaaguuccu

SEQ ID NO: 463719 - RNA, 19 nt, Homo sapiens
ucaccagcaccuacgagua

SEQ ID NO: 463720 - RNA, 19 nt, Homo sapiens
ugaguucaggacuacaaua

SEQ ID NO: 463721 - RNA, 19 nt, Homo sapiens
ucaaguuccucuggaugug

SEQ ID NO: 463722 - RNA, 19 nt, Homo sapiens
ccaucuccuaucucuauua

SEQ ID NO: 463723 - RNA, 19 nt, Homo sapiens
ugccaucuccuaucucuau

SEQ ID NO: 463724 - RNA, 19 nt, Homo sapiens
gcguggcucucucagucaa

SEQ ID NO: 463725 - RNA, 19 nt, Homo sapiens
gcaucgucauguuuguguu

SEQ ID NO: 463726 - RNA, 19 nt, Homo sapiens
ccaaugaggaucgucuguu

SEQ ID NO: 463727 - RNA, 19 nt, Homo sapiens
cggcucuccucccugcuaa

SEQ ID NO: 463728 - RNA, 19 nt, Homo sapiens
ucaccgcccugcucuucau

SEQ ID NO: 463729 - RNA, 19 nt, Homo sapiens
ggcacgcggugucaugcuu

SEQ ID NO: 463730 - RNA, 19 nt, Homo sapiens
uggcuggauugccuuguau

SEQ ID NO: 463731 - RNA, 19 nt, Homo sapiens
gccuucaucuugggaaugu

SEQ ID NO: 463732 - RNA, 19 nt, Homo sapiens
guguggcucuccauguaug

SEQ ID NO: 463733 - RNA, 19 nt, Homo sapiens
gcuccuguccaccggaauu

SEQ ID NO: 463734 - RNA, 19 nt, Homo sapiens
gccaucuccuaucucuauu

SEQ ID NO: 463735 - RNA, 19 nt, Homo sapiens
cgcuauacauucuggacuu

SEQ ID NO: 463736 - RNA, 19 nt, Homo sapiens
gaaccacucccggaucaac

SEQ ID NO: 463737 - RNA, 19 nt, Homo sapiens
gaguucaggacuacaauac

SEQ ID NO: 463738 - RNA, 19 nt, Homo sapiens
ccagggagagggacagaca

SEQ ID NO: 463739 - RNA, 19 nt, Homo sapiens
uaugccaucuccuaucucu

SEQ ID NO: 463740 - RNA, 19 nt, Homo sapiens
gcauccaccagcaucaaug

SEQ ID NO: 463741 - RNA, 19 nt, Homo sapiens
cagagaagcaggccaagcu

SEQ ID NO: 463742 - RNA, 19 nt, Homo sapiens
ucaaggguccugaagaacu

SEQ ID NO: 463743 - RNA, 19 nt, Homo sapiens
uggcagcccuguccucacu

SEQ ID NO: 463744 - RNA, 19 nt, Homo sapiens
gcgggacuuugcaguacau

SEQ ID NO: 463745 - RNA, 19 nt, Homo sapiens
gaauuaucugcaccuucua

SEQ ID NO: 463746 - RNA, 19 nt, Homo sapiens
uuggcuggauugccuugua

SEQ ID NO: 463747 - RNA, 19 nt, Homo sapiens
gacaucgacagcccauaga

SEQ ID NO: 463748 - RNA, 19 nt, Homo sapiens
ugggcacgcugaccacugu

SEQ ID NO: 463749 - RNA, 19 nt, Homo sapiens
caccagcaccuacgaguac

SEQ ID NO: 463750 - RNA, 19 nt, Homo sapiens
gcuucuaugccaucuccua

SEQ ID NO: 463751 - RNA, 19 nt, Homo sapiens
gaggauaccuuccaucuca

SEQ ID NO: 463752 - RNA, 19 nt, Homo sapiens
gaagcuggcuccuauguuc

SEQ ID NO: 463753 - RNA, 19 nt, Homo sapiens
gcaaggaggccuacaucua

SEQ ID NO: 463754 - RNA, 19 nt, Homo sapiens
ucacagcccugguggauga

SEQ ID NO: 463755 - RNA, 19 nt, Homo sapiens
ggaggugggaggacaguua

SEQ ID NO: 463756 - RNA, 19 nt, Homo sapiens
ggucaacacuaccaacaug

SEQ ID NO: 463757 - RNA, 19 nt, Homo sapiens
gguguuggcuggacuggaa

SEQ ID NO: 463758 - RNA, 19 nt, Homo sapiens
uauggaagcuggcuccuau

SEQ ID NO: 463759 - RNA, 19 nt, Homo sapiens
ccaagguccuacucucuuu

SEQ ID NO: 463760 - RNA, 19 nt, Homo sapiens
caaggaggccuacaucuag

SEQ ID NO: 463761 - RNA, 19 nt, Homo sapiens
ccuggauccuuguguauuu

SEQ ID NO: 463762 - RNA, 19 nt, Homo sapiens
cuacaacucuuuccacaac

SEQ ID NO: 463763 - RNA, 19 nt, Homo sapiens
ggguauuuaugucuucaaa

SEQ ID NO: 463764 - RNA, 19 nt, Homo sapiens
gaaugugucucuauuuccu

SEQ ID NO: 463765 - RNA, 19 nt, Homo sapiens
cuggaaagguggucuacuu

SEQ ID NO: 463766 - RNA, 19 nt, Homo sapiens
cauucuggcugaacaucua

SEQ ID NO: 463767 - RNA, 19 nt, Homo sapiens
ggcauccucuucuacauca

SEQ ID NO: 463768 - RNA, 19 nt, Homo sapiens
caacccagaucuucuucuc

SEQ ID NO: 463769 - RNA, 19 nt, Homo sapiens
gagcgcaacaugcaucaga

SEQ ID NO: 463770 - RNA, 19 nt, Homo sapiens
cggcugcugugcuaucauu

SEQ ID NO: 463771 - RNA, 19 nt, Homo sapiens
ugacggacgggcuggauaa

SEQ ID NO: 463772 - RNA, 19 nt, Homo sapiens
aaacucugcuggucuuucu

SEQ ID NO: 463773 - RNA, 19 nt, Homo sapiens
caaccgauucuaugacaau

SEQ ID NO: 463774 - RNA, 19 nt, Homo sapiens
ggacuggaaagguggucua

SEQ ID NO: 463775 - RNA, 19 nt, Homo sapiens
uaccuuccaucucaaccua

SEQ ID NO: 463776 - RNA, 19 nt, Homo sapiens
uggaaacucugcuggucuu

SEQ ID NO: 463777 - RNA, 19 nt, Homo sapiens
ccgauucuaugacaauauc

SEQ ID NO: 463778 - RNA, 19 nt, Homo sapiens
uugaaugugucucuauuuc

SEQ ID NO: 463779 - RNA, 19 nt, Homo sapiens
cuacaucacacccaacuuc

SEQ ID NO: 463780 - RNA, 19 nt, Homo sapiens
ggaagcuggcuccuauguu

SEQ ID NO: 463781 - RNA, 19 nt, Homo sapiens
ggauaagccaggucagauc

SEQ ID NO: 463782 - RNA, 19 nt, Homo sapiens
ugacaucgcacguccaucu

SEQ ID NO: 463783 - RNA, 19 nt, Homo sapiens
cuacagggacuccaucauc

SEQ ID NO: 463784 - RNA, 19 nt, Homo sapiens
ugacccagcugccuaucuc

SEQ ID NO: 463785 - RNA, 19 nt, Homo sapiens
agagguccauugcugaugu

SEQ ID NO: 463786 - RNA, 19 nt, Homo sapiens
gcugcugucugcaucaucu

SEQ ID NO: 463787 - RNA, 19 nt, Homo sapiens
ucgccuggauccuugugua

SEQ ID NO: 463788 - RNA, 19 nt, Homo sapiens
cugcuggucuuucuucaca

SEQ ID NO: 463789 - RNA, 19 nt, Homo sapiens
ggugucaaccgauucuaug

SEQ ID NO: 463790 - RNA, 19 nt, Homo sapiens
acaacucuuuccacaacaa

SEQ ID NO: 463791 - RNA, 19 nt, Homo sapiens
aagcagcgcauccaaguca

SEQ ID NO: 463792 - RNA, 19 nt, Homo sapiens
ugaagcagcgcauccaagu

SEQ ID NO: 463793 - RNA, 19 nt, Homo sapiens
caagagguccauugcugau

SEQ ID NO: 463794 - RNA, 19 nt, Homo sapiens
ccagcgcugugguggaguu

SEQ ID NO: 463795 - RNA, 19 nt, Homo sapiens
caucaucuccugggccauu

SEQ ID NO: 463796 - RNA, 19 nt, Homo sapiens
uggucaaggugcagaagaa

SEQ ID NO: 463797 - RNA, 19 nt, Homo sapiens
cacuugaugucugaggaua

SEQ ID NO: 463798 - RNA, 19 nt, Homo sapiens
cagcccugguggaugagua

SEQ ID NO: 463799 - RNA, 19 nt, Homo sapiens
cuuugaaugugucucuauu

SEQ ID NO: 463800 - RNA, 19 nt, Homo sapiens
ggcuggcguuccuggcaua

SEQ ID NO: 463801 - RNA, 19 nt, Homo sapiens
cccagaucuucuucucaua

SEQ ID NO: 463802 - RNA, 19 nt, Homo sapiens
gcgcugugguggaguucug

SEQ ID NO: 463803 - RNA, 19 nt, Homo sapiens
ggcugaacaucuacuacau

SEQ ID NO: 463804 - RNA, 19 nt, Homo sapiens
gugcagaugacgccacuca

SEQ ID NO: 463805 - RNA, 19 nt, Homo sapiens
ggucuuucuucacaccaau

SEQ ID NO: 463806 - RNA, 19 nt, Homo sapiens
gcaugagccugcuguuccu

SEQ ID NO: 463807 - RNA, 19 nt, Homo sapiens
caucacagcccugguggau

SEQ ID NO: 463808 - RNA, 19 nt, Homo sapiens
ccuugcggcugcugugcua

SEQ ID NO: 463809 - RNA, 19 nt, Homo sapiens
aaccgauucuaugacaaua

SEQ ID NO: 463810 - RNA, 19 nt, Homo sapiens
ugaucggucucucuaacau

SEQ ID NO: 463811 - RNA, 19 nt, Homo sapiens
gagguccauugcugaugug

SEQ ID NO: 463812 - RNA, 19 nt, Homo sapiens
gaccgcugcuucuccaacu

SEQ ID NO: 463813 - RNA, 19 nt, Homo sapiens
cagcaaggaggccuacauc

SEQ ID NO: 463814 - RNA, 19 nt, Homo sapiens
ccggguacauggccuacau

SEQ ID NO: 463815 - RNA, 19 nt, Homo sapiens
ugacaauauccaagagaug

SEQ ID NO: 463816 - RNA, 19 nt, Homo sapiens
ucuaugacaauauccaaga

SEQ ID NO: 463817 - RNA, 19 nt, Homo sapiens
gggcauugacagccaguuc

SEQ ID NO: 463818 - RNA, 19 nt, Homo sapiens
cagcauguucgcaggauuc

SEQ ID NO: 463819 - RNA, 19 nt, Homo sapiens
ccagcauguucgcaggauu

SEQ ID NO: 463820 - RNA, 19 nt, Homo sapiens
caucgucugcugcaucaau

SEQ ID NO: 463821 - RNA, 19 nt, Homo sapiens
acccagaucuucuucucau

SEQ ID NO: 463822 - RNA, 19 nt, Homo sapiens
gggcauccucuucuacauc

SEQ ID NO: 463823 - RNA, 19 nt, Homo sapiens
uuuacuaccuguacaacuc

SEQ ID NO: 463824 - RNA, 19 nt, Homo sapiens
uuucagugcugugcagaug

SEQ ID NO: 463825 - RNA, 19 nt, Homo sapiens
ucgcaggauucgucaucuu

SEQ ID NO: 463826 - RNA, 19 nt, Homo sapiens
gcuacaacucuuuccacaa

SEQ ID NO: 463827 - RNA, 19 nt, Homo sapiens
guccaaauuccgagacaug

SEQ ID NO: 463828 - RNA, 19 nt, Homo sapiens
ggccaucgccuggauccuu

SEQ ID NO: 463829 - RNA, 19 nt, Homo sapiens
gguccuacucucuuucugu

SEQ ID NO: 463830 - RNA, 19 nt, Homo sapiens
ccgcuucgacuuccucaug

SEQ ID NO: 463831 - RNA, 19 nt, Homo sapiens
ccagaucuucuucucauac

SEQ ID NO: 463832 - RNA, 19 nt, Homo sapiens
cgacacugccguggaaaca

SEQ ID NO: 463833 - RNA, 19 nt, Homo sapiens
ucuccugggccauuuacua

SEQ ID NO: 463834 - RNA, 19 nt, Homo sapiens
gcugaacaucuacuacauc

SEQ ID NO: 463835 - RNA, 19 nt, Homo sapiens
ggaaacucugcuggucuuu

SEQ ID NO: 463836 - RNA, 19 nt, Homo sapiens
ucaaccgauucuaugacaa

SEQ ID NO: 463837 - RNA, 19 nt, Homo sapiens
guauggaagcuggcuccua

SEQ ID NO: 463838 - RNA, 19 nt, Homo sapiens
ccugaucggucucucuaac

SEQ ID NO: 463839 - RNA, 19 nt, Homo sapiens
uaccugaucggucucucua

SEQ ID NO: 463840 - RNA, 19 nt, Homo sapiens
gccauuuacuaccuguaca

SEQ ID NO: 463841 - RNA, 19 nt, Homo sapiens
gaacacaaggucaacauug

SEQ ID NO: 463842 - RNA, 19 nt, Homo sapiens
agaaggagcuggccuagug

SEQ ID NO: 463843 - RNA, 19 nt, Homo sapiens
cggaaacucuucacauuug

SEQ ID NO: 463844 - RNA, 19 nt, Homo sapiens
caacaaauuugacaacaac

SEQ ID NO: 463845 - RNA, 19 nt, Homo sapiens
ccaucuacgucaucuauaa

SEQ ID NO: 463846 - RNA, 19 nt, Homo sapiens
caucggaguuuccugguuu

SEQ ID NO: 463847 - RNA, 19 nt, Homo sapiens
gaaguuguccuuucugauc

SEQ ID NO: 463848 - RNA, 19 nt, Homo sapiens
ucacgggccuggcagauga

SEQ ID NO: 463849 - RNA, 19 nt, Homo sapiens
gcaacgacauccagcagau

SEQ ID NO: 463850 - RNA, 19 nt, Homo sapiens
gagaggagcaaacaggaaa

SEQ ID NO: 463851 - RNA, 19 nt, Homo sapiens
gagccugccuggaggagaa

SEQ ID NO: 463852 - RNA, 19 nt, Homo sapiens
uaaccaaggguggaauuua

SEQ ID NO: 463853 - RNA, 19 nt, Homo sapiens
gggagagacuggccuaugg

SEQ ID NO: 463854 - RNA, 19 nt, Homo sapiens
ugauugcauuugccaguua

SEQ ID NO: 463855 - RNA, 19 nt, Homo sapiens
caggaaaggugguguggau

SEQ ID NO: 463856 - RNA, 19 nt, Homo sapiens
auucugggcuguuguguuu

SEQ ID NO: 463857 - RNA, 19 nt, Homo sapiens
ggauuuggaguauugauug

SEQ ID NO: 463858 - RNA, 19 nt, Homo sapiens
ggaaaggugguguggauca

SEQ ID NO: 463859 - RNA, 19 nt, Homo sapiens
ggaaaggggugaagacauc

SEQ ID NO: 463860 - RNA, 19 nt, Homo sapiens
gagagcagcgggauucaug

SEQ ID NO: 463861 - RNA, 19 nt, Homo sapiens
gaaagaggccacgguaugg

SEQ ID NO: 463862 - RNA, 19 nt, Homo sapiens
ugaaagaggccacgguaug

SEQ ID NO: 463863 - RNA, 19 nt, Homo sapiens
ccaguuacaacaaauuuga

SEQ ID NO: 463864 - RNA, 19 nt, Homo sapiens
caucagacaguuccaguug

SEQ ID NO: 463865 - RNA, 19 nt, Homo sapiens
gcacgcagggcucucuuug

SEQ ID NO: 463866 - RNA, 19 nt, Homo sapiens
cgacuucuaccgcuugaaa

SEQ ID NO: 463867 - RNA, 19 nt, Homo sapiens
ggguggaauuuacgucuug

SEQ ID NO: 463868 - RNA, 19 nt, Homo sapiens
gcagcgggauucaugacau

SEQ ID NO: 463869 - RNA, 19 nt, Homo sapiens
ucaagccacucaccuacga

SEQ ID NO: 463870 - RNA, 19 nt, Homo sapiens
ggaaacucuucacauuugg

SEQ ID NO: 463871 - RNA, 19 nt, Homo sapiens
gagcuggccuaguguucau

SEQ ID NO: 463872 - RNA, 19 nt, Homo sapiens
ccagcagcaucaacuguau

SEQ ID NO: 463873 - RNA, 19 nt, Homo sapiens
gaaaaucugcccauucuuc

SEQ ID NO: 463874 - RNA, 19 nt, Homo sapiens
ggagaggagcaaacaggaa

SEQ ID NO: 463875 - RNA, 19 nt, Homo sapiens
ugccgcaacucagauauuu

SEQ ID NO: 463876 - RNA, 19 nt, Homo sapiens
ggauugaugccgcaacuca

SEQ ID NO: 463877 - RNA, 19 nt, Homo sapiens
ggcuggauuuggaguauug

SEQ ID NO: 463878 - RNA, 19 nt, Homo sapiens
uggaaguuguccuuucuga

SEQ ID NO: 463879 - RNA, 19 nt, Homo sapiens
caaauuugacaacaacugu

SEQ ID NO: 463880 - RNA, 19 nt, Homo sapiens
accggaaacucuucacauu

SEQ ID NO: 463881 - RNA, 19 nt, Homo sapiens
gaguauugauugcauuugc

SEQ ID NO: 463882 - RNA, 19 nt, Homo sapiens
ccggaaacucuucacauuu

SEQ ID NO: 463883 - RNA, 19 nt, Homo sapiens
gugaagacaucaggaaagg

SEQ ID NO: 463884 - RNA, 19 nt, Homo sapiens
gcuaugcugucauccugau

SEQ ID NO: 463885 - RNA, 19 nt, Homo sapiens
gcccaucuacgucaucuau

SEQ ID NO: 463886 - RNA, 19 nt, Homo sapiens
ucaacuguaucaccagcuu

SEQ ID NO: 463887 - RNA, 19 nt, Homo sapiens
caaaggcguuggcuaugcu

SEQ ID NO: 463888 - RNA, 19 nt, Homo sapiens
ucagacaguuccaguugca

SEQ ID NO: 463889 - RNA, 19 nt, Homo sapiens
ggaguuuccugguuuuaug

SEQ ID NO: 463890 - RNA, 19 nt, Homo sapiens
ggagcaaacaggaaaauga

SEQ ID NO: 463891 - RNA, 19 nt, Homo sapiens
aaccaaggguggaauuuac

SEQ ID NO: 463892 - RNA, 19 nt, Homo sapiens
cuucaaaggcguuggcuau

SEQ ID NO: 463893 - RNA, 19 nt, Homo sapiens
agagggacaucagacaguu

SEQ ID NO: 463894 - RNA, 19 nt, Homo sapiens
gcauuugccaguuacaaca

SEQ ID NO: 463895 - RNA, 19 nt, Homo sapiens
gccacgguauggauugaug

SEQ ID NO: 463896 - RNA, 19 nt, Homo sapiens
ucaaaggcguuggcuaugc

SEQ ID NO: 463897 - RNA, 19 nt, Homo sapiens
aaucugcccauucuucaaa

SEQ ID NO: 463898 - RNA, 19 nt, Homo sapiens
gggcuggauuuggaguauu

SEQ ID NO: 463899 - RNA, 19 nt, Homo sapiens
uacguuggcuucuacuaca

SEQ ID NO: 463900 - RNA, 19 nt, Homo sapiens
gcaucgcccuguccuccau

SEQ ID NO: 463901 - RNA, 19 nt, Homo sapiens
gaaaggugguguggaucac

SEQ ID NO: 463902 - RNA, 19 nt, Homo sapiens
guacguuggcuucuacuac

SEQ ID NO: 463903 - RNA, 19 nt, Homo sapiens
ccuggaaguuguccuuucu

SEQ ID NO: 463904 - RNA, 19 nt, Homo sapiens
cagcgggauucaugacauc

SEQ ID NO: 463905 - RNA, 19 nt, Homo sapiens
ggaaguuguccuuucugau

SEQ ID NO: 463906 - RNA, 19 nt, Homo sapiens
agacuggccuauggcauca

SEQ ID NO: 463907 - RNA, 19 nt, Homo sapiens
gguggaauuuacgucuuga

SEQ ID NO: 463908 - RNA, 19 nt, Homo sapiens
cauaaccaaggguggaauu

SEQ ID NO: 463909 - RNA, 19 nt, Homo sapiens
gggccuggcagaugacuuc

SEQ ID NO: 463910 - RNA, 19 nt, Homo sapiens
ggagcuggccuaguguuca

SEQ ID NO: 463911 - RNA, 19 nt, Homo sapiens
gaaggagcuggccuagugu

SEQ ID NO: 463912 - RNA, 19 nt, Homo sapiens
gggcugccaccguuuggaa

SEQ ID NO: 463913 - RNA, 19 nt, Homo sapiens
ggugaagacaucaggaaag

SEQ ID NO: 463914 - RNA, 19 nt, Homo sapiens
gggugaagacaucaggaaa

SEQ ID NO: 463915 - RNA, 19 nt, Homo sapiens
cggacaccaucuugggauu

SEQ ID NO: 463916 - RNA, 19 nt, Homo sapiens
ccaucggaguuuccugguu

SEQ ID NO: 463917 - RNA, 19 nt, Homo sapiens
cuucagcacuuuccuucuc

SEQ ID NO: 463918 - RNA, 19 nt, Homo sapiens
ggccauuucuacccugucu

SEQ ID NO: 463919 - RNA, 19 nt, Homo sapiens
gccuaguguucauccugua

SEQ ID NO: 463920 - RNA, 19 nt, Homo sapiens
gcaaccacaccaaguacuc

SEQ ID NO: 463921 - RNA, 19 nt, Homo sapiens
ucucuucuuuucccauuua

SEQ ID NO: 463922 - RNA, 19 nt, Homo sapiens
ggacaccaucuugggauuc

SEQ ID NO: 463923 - RNA, 19 nt, Homo sapiens
ucuacgucaucuauaaguu

SEQ ID NO: 463924 - RNA, 19 nt, Homo sapiens
gcccuguucugcauaacca

SEQ ID NO: 463925 - RNA, 19 nt, Homo sapiens
ugaacacaaggucaacauu

SEQ ID NO: 463926 - RNA, 19 nt, Homo sapiens
ucuucuccauccuugguua

SEQ ID NO: 463927 - RNA, 19 nt, Homo sapiens
gaccagcagcaucaacugu

SEQ ID NO: 463928 - RNA, 19 nt, Homo sapiens
ggcguuggcuaugcuguca

SEQ ID NO: 463929 - RNA, 19 nt, Homo sapiens
cuacgucaucuauaaguuc

SEQ ID NO: 463930 - RNA, 19 nt, Homo sapiens
ggucagcaucaucaacuuc

SEQ ID NO: 463931 - RNA, 19 nt, Homo sapiens
uuuauggaguggacagguu

SEQ ID NO: 463932 - RNA, 19 nt, Homo sapiens
caguggaccuggccaacgu

SEQ ID NO: 463933 - RNA, 19 nt, Homo sapiens
cuacuacaacgucaucauc

SEQ ID NO: 463934 - RNA, 19 nt, Homo sapiens
gcaucacgccagagaacga

SEQ ID NO: 463935 - RNA, 19 nt, Homo sapiens
gauuuggaguauugauugc

SEQ ID NO: 463936 - RNA, 19 nt, Homo sapiens
gcucuugcucugucugaug

SEQ ID NO: 463937 - RNA, 19 nt, Homo sapiens
cggagcugcugguggugaa

SEQ ID NO: 463938 - RNA, 19 nt, Homo sapiens
ggaguauugauugcauuug

SEQ ID NO: 463939 - RNA, 19 nt, Homo sapiens
uuucugauccucucuucuu

SEQ ID NO: 463940 - RNA, 19 nt, Homo sapiens
ucucuggguucgccaucuu

SEQ ID NO: 463941 - RNA, 19 nt, Homo sapiens
gaaaguggaugccauaguu

SEQ ID NO: 463942 - RNA, 19 nt, Homo sapiens
gaaaggagggcaacuucua

SEQ ID NO: 463943 - RNA, 19 nt, Homo sapiens
gagcauaccugagcguuga

SEQ ID NO: 463944 - RNA, 19 nt, Homo sapiens
gcacagaauuccucaacuc

SEQ ID NO: 463945 - RNA, 19 nt, Homo sapiens
cagcagaggccguaaauug

SEQ ID NO: 463946 - RNA, 19 nt, Homo sapiens
ggaguggccugguucuaug

SEQ ID NO: 463947 - RNA, 19 nt, Homo sapiens
ggaggaaaccacaaauuca

SEQ ID NO: 463948 - RNA, 19 nt, Homo sapiens
gaacaaaccaaggaaaucu

SEQ ID NO: 463949 - RNA, 19 nt, Homo sapiens
ggaccccacuggaauuuua

SEQ ID NO: 463950 - RNA, 19 nt, Homo sapiens
gcacguccauccucuuugg

SEQ ID NO: 463951 - RNA, 19 nt, Homo sapiens
cuacggagccuacaucuuc

SEQ ID NO: 463952 - RNA, 19 nt, Homo sapiens
uaaauugagcguucaguug

SEQ ID NO: 463953 - RNA, 19 nt, Homo sapiens
ccacaucaauaacaacagu

SEQ ID NO: 463954 - RNA, 19 nt, Homo sapiens
gagggcaacuucuacucuu

SEQ ID NO: 463955 - RNA, 19 nt, Homo sapiens
acaacaaguucaccaacaa

SEQ ID NO: 463956 - RNA, 19 nt, Homo sapiens
uaaaagacauccacaaugg

SEQ ID NO: 463957 - RNA, 19 nt, Homo sapiens
gggaagaagcacagaauuc

SEQ ID NO: 463958 - RNA, 19 nt, Homo sapiens
ccauuuacuuugcccauau

SEQ ID NO: 463959 - RNA, 19 nt, Homo sapiens
gagaaaggagggcaacuuc

SEQ ID NO: 463960 - RNA, 19 nt, Homo sapiens
ucacgcuccuggaccauuu

SEQ ID NO: 463961 - RNA, 19 nt, Homo sapiens
ccagugugcccaugaguaa

SEQ ID NO: 463962 - RNA, 19 nt, Homo sapiens
gagccugcuugcugauauu

SEQ ID NO: 463963 - RNA, 19 nt, Homo sapiens
guagcuuccuagaccauuu

SEQ ID NO: 463964 - RNA, 19 nt, Homo sapiens
agacgcaccugcugagaau

SEQ ID NO: 463965 - RNA, 19 nt, Homo sapiens
ccucucuucugacuguuua

SEQ ID NO: 463966 - RNA, 19 nt, Homo sapiens
ggccagggcugaucuucau

SEQ ID NO: 463967 - RNA, 19 nt, Homo sapiens
gaaaccagcucaggcuacu

SEQ ID NO: 463968 - RNA, 19 nt, Homo sapiens
cgaggcgucuguuuggauu

SEQ ID NO: 463969 - RNA, 19 nt, Homo sapiens
ucacagccaccaugccaua

SEQ ID NO: 463970 - RNA, 19 nt, Homo sapiens
gugcgugccacaucaauaa

SEQ ID NO: 463971 - RNA, 19 nt, Homo sapiens
cgaaggagguggagcucau

SEQ ID NO: 463972 - RNA, 19 nt, Homo sapiens
guaaauugagcguucaguu

SEQ ID NO: 463973 - RNA, 19 nt, Homo sapiens
cagggaaggugguauggau

SEQ ID NO: 463974 - RNA, 19 nt, Homo sapiens
aaauugagcguucaguuga

SEQ ID NO: 463975 - RNA, 19 nt, Homo sapiens
aaaucuaaguuucgagaga

SEQ ID NO: 463976 - RNA, 19 nt, Homo sapiens
gcguucaguugacacauug

SEQ ID NO: 463977 - RNA, 19 nt, Homo sapiens
gaggaaaccacaaauucau

SEQ ID NO: 463978 - RNA, 19 nt, Homo sapiens
gccguggucuucuucauca

SEQ ID NO: 463979 - RNA, 19 nt, Homo sapiens
aaccacaaauucaugcaaa

SEQ ID NO: 463980 - RNA, 19 nt, Homo sapiens
gcaaugggagagacacgaa

SEQ ID NO: 463981 - RNA, 19 nt, Homo sapiens
gcuggugucuggaagaucu

SEQ ID NO: 463982 - RNA, 19 nt, Homo sapiens
gccauaguuugaauucaug

SEQ ID NO: 463983 - RNA, 19 nt, Homo sapiens
caggaaaguggaugccaua

SEQ ID NO: 463984 - RNA, 19 nt, Homo sapiens
cauauuuaccugugaauca

SEQ ID NO: 463985 - RNA, 19 nt, Homo sapiens
ggaaauucuguuuauguuc

SEQ ID NO: 463986 - RNA, 19 nt, Homo sapiens
caggaaauucuguuuaugu

SEQ ID NO: 463987 - RNA, 19 nt, Homo sapiens
ccaggaaauucuguuuaug

SEQ ID NO: 463988 - RNA, 19 nt, Homo sapiens
gagggaagaagcacagaau

SEQ ID NO: 463989 - RNA, 19 nt, Homo sapiens
ucaacucccugacgagcuu

SEQ ID NO: 463990 - RNA, 19 nt, Homo sapiens
gagagcggcuuccccauug

SEQ ID NO: 463991 - RNA, 19 nt, Homo sapiens
caccaggaaauucuguuua

SEQ ID NO: 463992 - RNA, 19 nt, Homo sapiens
gaaauggaggaaaccacaa

SEQ ID NO: 463993 - RNA, 19 nt, Homo sapiens
aaucuaaguuucgagagaa

SEQ ID NO: 463994 - RNA, 19 nt, Homo sapiens
gguauggagucagugauca

SEQ ID NO: 463995 - RNA, 19 nt, Homo sapiens
ggaaaguggaugccauagu

SEQ ID NO: 463996 - RNA, 19 nt, Homo sapiens
gggcaagaagaucgacuuu

SEQ ID NO: 463997 - RNA, 19 nt, Homo sapiens
acaaaccaaggaaaucuaa

SEQ ID NO: 463998 - RNA, 19 nt, Homo sapiens
gcgacgacauccagcagau

SEQ ID NO: 463999 - RNA, 19 nt, Homo sapiens
ccacaccugcugccgagua

SEQ ID NO: 464000 - RNA, 19 nt, Homo sapiens
guugaccaaucucuauuca

SEQ ID NO: 464001 - RNA, 19 nt, Homo sapiens
cgagccugcuugcugauau

SEQ ID NO: 464002 - RNA, 19 nt, Homo sapiens
accaggaaauucuguuuau

SEQ ID NO: 464003 - RNA, 19 nt, Homo sapiens
guaauaacgacguagaucu

SEQ ID NO: 464004 - RNA, 19 nt, Homo sapiens
ccaggcagcugcaguuagc

SEQ ID NO: 464005 - RNA, 19 nt, Homo sapiens
gcagaggccguaaauugag

SEQ ID NO: 464006 - RNA, 19 nt, Homo sapiens
uacaacaaguucaccaaca

SEQ ID NO: 464007 - RNA, 19 nt, Homo sapiens
ccugggcgcugcacuaucu

SEQ ID NO: 464008 - RNA, 19 nt, Homo sapiens
guccgugucuguugaccaa

SEQ ID NO: 464009 - RNA, 19 nt, Homo sapiens
ucaggugcgugccacauca

SEQ ID NO: 464010 - RNA, 19 nt, Homo sapiens
gaaggugaaauggaggaaa

SEQ ID NO: 464011 - RNA, 19 nt, Homo sapiens
cauuuacuuugcccauauu

SEQ ID NO: 464012 - RNA, 19 nt, Homo sapiens
caaacaacaaagcagaaga

SEQ ID NO: 464013 - RNA, 19 nt, Homo sapiens
ggagagacacgaacaaacc

SEQ ID NO: 464014 - RNA, 19 nt, Homo sapiens
ggagguggagcucauccuu

SEQ ID NO: 464015 - RNA, 19 nt, Homo sapiens
ugcaacaacuccuggaaca

SEQ ID NO: 464016 - RNA, 19 nt, Homo sapiens
gcgcugcacuaucucuucu

SEQ ID NO: 464017 - RNA, 19 nt, Homo sapiens
uggaggaaaccacaaauuc

SEQ ID NO: 464018 - RNA, 19 nt, Homo sapiens
uagcuuccuagaccauuua

SEQ ID NO: 464019 - RNA, 19 nt, Homo sapiens
gucuuguguugcuguaaua

SEQ ID NO: 464020 - RNA, 19 nt, Homo sapiens
aaacacaaacaacaaagca

SEQ ID NO: 464021 - RNA, 19 nt, Homo sapiens
cagccugccuggguccuuu

SEQ ID NO: 464022 - RNA, 19 nt, Homo sapiens
gcaguucagcgacgacauc

SEQ ID NO: 464023 - RNA, 19 nt, Homo sapiens
cagcugcaguuagcacaga

SEQ ID NO: 464024 - RNA, 19 nt, Homo sapiens
ugccauaguuugaauucau

SEQ ID NO: 464025 - RNA, 19 nt, Homo sapiens
aauuagcaauacugaguga

SEQ ID NO: 464026 - RNA, 19 nt, Homo sapiens
gggaaggugguauggauca

SEQ ID NO: 464027 - RNA, 19 nt, Homo sapiens
ucaccaggaaauucuguuu

SEQ ID NO: 464028 - RNA, 19 nt, Homo sapiens
uaauaacgacguagaucug

SEQ ID NO: 464029 - RNA, 19 nt, Homo sapiens
gcaccucgccgugucuugu

SEQ ID NO: 464030 - RNA, 19 nt, Homo sapiens
ggagggcaacuucuacucu

SEQ ID NO: 464031 - RNA, 19 nt, Homo sapiens
uaugucggcuucuucuaca

SEQ ID NO: 464032 - RNA, 19 nt, Homo sapiens
gaugccauaguuugaauuc

SEQ ID NO: 464033 - RNA, 19 nt, Homo sapiens
ggugcgugccacaucaaua

SEQ ID NO: 464034 - RNA, 19 nt, Homo sapiens
gcccaugaguaagagcaaa

SEQ ID NO: 464035 - RNA, 19 nt, Homo sapiens
ucaucgugcugcucuacuu

SEQ ID NO: 464036 - RNA, 19 nt, Homo sapiens
gaagggaccccacuggaau

SEQ ID NO: 464037 - RNA, 19 nt, Homo sapiens
aaauggaggaaaccacaaa

SEQ ID NO: 464038 - RNA, 19 nt, Homo sapiens
gugcagaaggugaaaugga

SEQ ID NO: 464039 - RNA, 19 nt, Homo sapiens
aaaccaaggaaaucuaagu

SEQ ID NO: 464040 - RNA, 19 nt, Homo sapiens
ucuaugcggccuacaaguu

SEQ ID NO: 464041 - RNA, 19 nt, Homo sapiens
gaaagucuccuguaucauu

SEQ ID NO: 464042 - RNA, 19 nt, Homo sapiens
ugaaugaguuuccagcuaa

SEQ ID NO: 464043 - RNA, 19 nt, Homo sapiens
ggaguaucaucuuggguua

SEQ ID NO: 464044 - RNA, 19 nt, Homo sapiens
gugaaagucuccuguauca

SEQ ID NO: 464045 - RNA, 19 nt, Homo sapiens
caucuuggguuacugcaua

SEQ ID NO: 464046 - RNA, 19 nt, Homo sapiens
gaucuucacuguuaucuac

SEQ ID NO: 464047 - RNA, 19 nt, Homo sapiens
cuacauauguuaccagaau

SEQ ID NO: 464048 - RNA, 19 nt, Homo sapiens
gcagggacgugaaggaaau

SEQ ID NO: 464049 - RNA, 19 nt, Homo sapiens
ggucaucaccugcuucuuu

SEQ ID NO: 464050 - RNA, 19 nt, Homo sapiens
ggagaagauugucaggaaa

SEQ ID NO: 464051 - RNA, 19 nt, Homo sapiens
gccaucaucuucuuucuga

SEQ ID NO: 464052 - RNA, 19 nt, Homo sapiens
augcugaucuucacuguua

SEQ ID NO: 464053 - RNA, 19 nt, Homo sapiens
ggaaugaagaugugucuga

SEQ ID NO: 464054 - RNA, 19 nt, Homo sapiens
ccacuuauuuccauggauu

SEQ ID NO: 464055 - RNA, 19 nt, Homo sapiens
gauaucuguuugcuucuaa

SEQ ID NO: 464056 - RNA, 19 nt, Homo sapiens
gagcuucguuucgggauuu

SEQ ID NO: 464057 - RNA, 19 nt, Homo sapiens
gguguucucuucuacuuga

SEQ ID NO: 464058 - RNA, 19 nt, Homo sapiens
ucaguuaggauuagguuua

SEQ ID NO: 464059 - RNA, 19 nt, Homo sapiens
ccacauauauagcuuaucg

SEQ ID NO: 464060 - RNA, 19 nt, Homo sapiens
ggaaccucaucuuucauuu

SEQ ID NO: 464061 - RNA, 19 nt, Homo sapiens
gcauaggaaccucaucuuu

SEQ ID NO: 464062 - RNA, 19 nt, Homo sapiens
gaaaggaagauguaagaag

SEQ ID NO: 464063 - RNA, 19 nt, Homo sapiens
gugaaugaguuuccagcua

SEQ ID NO: 464064 - RNA, 19 nt, Homo sapiens
ccagaaacaccaacagaaa

SEQ ID NO: 464065 - RNA, 19 nt, Homo sapiens
gaugaggaaugaagaugug

SEQ ID NO: 464066 - RNA, 19 nt, Homo sapiens
gcaagaagguggauuuccu

SEQ ID NO: 464067 - RNA, 19 nt, Homo sapiens
ugaagcugcuggaggagua

SEQ ID NO: 464068 - RNA, 19 nt, Homo sapiens
gaaacccaauuggcagaaa

SEQ ID NO: 464069 - RNA, 19 nt, Homo sapiens
aaagucuccuguaucauuu

SEQ ID NO: 464070 - RNA, 19 nt, Homo sapiens
ugucugagguggccaaaga

SEQ ID NO: 464071 - RNA, 19 nt, Homo sapiens
uggagaagauugucaggaa

SEQ ID NO: 464072 - RNA, 19 nt, Homo sapiens
gaaccucaucuuucauuug

SEQ ID NO: 464073 - RNA, 19 nt, Homo sapiens
ugacagccaccuucccuua

SEQ ID NO: 464074 - RNA, 19 nt, Homo sapiens
ccgcuugaaugcuguguaa

SEQ ID NO: 464075 - RNA, 19 nt, Homo sapiens
caacaacugcuaccaagau

SEQ ID NO: 464076 - RNA, 19 nt, Homo sapiens
acaacaaguucaacaacaa

SEQ ID NO: 464077 - RNA, 19 nt, Homo sapiens
acagccaccuucccuuaua

SEQ ID NO: 464078 - RNA, 19 nt, Homo sapiens
ggacaguaccaccgaaaug

SEQ ID NO: 464079 - RNA, 19 nt, Homo sapiens
ggagagaacagggaugcua

SEQ ID NO: 464080 - RNA, 19 nt, Homo sapiens
ucacggcugugcuggauga

SEQ ID NO: 464081 - RNA, 19 nt, Homo sapiens
uggcugagaugaggaauga

SEQ ID NO: 464082 - RNA, 19 nt, Homo sapiens
caacaacaacugcuaccaa

SEQ ID NO: 464083 - RNA, 19 nt, Homo sapiens
uuacauugcuuccuacuac

SEQ ID NO: 464084 - RNA, 19 nt, Homo sapiens
auaggaaccucaucuuuca

SEQ ID NO: 464085 - RNA, 19 nt, Homo sapiens
gaucacggcugugcuggau

SEQ ID NO: 464086 - RNA, 19 nt, Homo sapiens
caacugcaccaauuacuuc

SEQ ID NO: 464087 - RNA, 19 nt, Homo sapiens
uaugaucauugguaucuga

SEQ ID NO: 464088 - RNA, 19 nt, Homo sapiens
agacgacgcccuugaauuc

SEQ ID NO: 464089 - RNA, 19 nt, Homo sapiens
cuaucucgcuagccauaua

SEQ ID NO: 464090 - RNA, 19 nt, Homo sapiens
caaggccuccagccacuua

SEQ ID NO: 464091 - RNA, 19 nt, Homo sapiens
ucuaaagguuucacuguuc

SEQ ID NO: 464092 - RNA, 19 nt, Homo sapiens
gagacgacgcccuugaauu

SEQ ID NO: 464093 - RNA, 19 nt, Homo sapiens
agaaacaccaacagaaauu

SEQ ID NO: 464094 - RNA, 19 nt, Homo sapiens
cagaucuucuucucucuug

SEQ ID NO: 464095 - RNA, 19 nt, Homo sapiens
ucaaagggauugguuaugc

SEQ ID NO: 464096 - RNA, 19 nt, Homo sapiens
gaaucaagucugugaaagu

SEQ ID NO: 464097 - RNA, 19 nt, Homo sapiens
cauaggaaccucaucuuuc

SEQ ID NO: 464098 - RNA, 19 nt, Homo sapiens
gcaacugcaccaauuacuu

SEQ ID NO: 464099 - RNA, 19 nt, Homo sapiens
ggaugcauuucaauaugga

SEQ ID NO: 464100 - RNA, 19 nt, Homo sapiens
gucaucaccugcuucuuug

SEQ ID NO: 464101 - RNA, 19 nt, Homo sapiens
caccuucccuuauaucauc

SEQ ID NO: 464102 - RNA, 19 nt, Homo sapiens
cuaaagguuucacuguuca

SEQ ID NO: 464103 - RNA, 19 nt, Homo sapiens
ggauguggauggaggugau

SEQ ID NO: 464104 - RNA, 19 nt, Homo sapiens
gcuaucagcgugugaagau

SEQ ID NO: 464105 - RNA, 19 nt, Homo sapiens
gugugaagauggagaagau

SEQ ID NO: 464106 - RNA, 19 nt, Homo sapiens
cagaagcgauagccaacau

SEQ ID NO: 464107 - RNA, 19 nt, Homo sapiens
guacucagcaguuccaagu

SEQ ID NO: 464108 - RNA, 19 nt, Homo sapiens
ggaaaggaagauguaagaa

SEQ ID NO: 464109 - RNA, 19 nt, Homo sapiens
gagagaacagggaugcuau

SEQ ID NO: 464110 - RNA, 19 nt, Homo sapiens
gaaaaccacccuaucauca

SEQ ID NO: 464111 - RNA, 19 nt, Homo sapiens
cggcugugcuggaugaguu

SEQ ID NO: 464112 - RNA, 19 nt, Homo sapiens
ucacagugcucgguuacau

SEQ ID NO: 464113 - RNA, 19 nt, Homo sapiens
gaaacaccaacagaaauuc

SEQ ID NO: 464114 - RNA, 19 nt, Homo sapiens
ggccaucagcccucuguuu

SEQ ID NO: 464115 - RNA, 19 nt, Homo sapiens
gguuuagaaucaagucugu

SEQ ID NO: 464116 - RNA, 19 nt, Homo sapiens
uaucaucaguuaggauuag

SEQ ID NO: 464117 - RNA, 19 nt, Homo sapiens
gaaugaguuuccagcuaag

SEQ ID NO: 464118 - RNA, 19 nt, Homo sapiens
cagaaacaccaacagaaau

SEQ ID NO: 464119 - RNA, 19 nt, Homo sapiens
uacaacaaguucaacaaca

SEQ ID NO: 464120 - RNA, 19 nt, Homo sapiens
ugauaucuguuugcuucua

SEQ ID NO: 464121 - RNA, 19 nt, Homo sapiens
aaucaagucugugaaaguc

SEQ ID NO: 464122 - RNA, 19 nt, Homo sapiens
gaugacacacggcacucua

SEQ ID NO: 464123 - RNA, 19 nt, Homo sapiens
uagaaucaagucugugaaa

SEQ ID NO: 464124 - RNA, 19 nt, Homo sapiens
caucagugucauuuacuaa

SEQ ID NO: 464125 - RNA, 19 nt, Homo sapiens
cagccaccuucccuuauau

SEQ ID NO: 464126 - RNA, 19 nt, Homo sapiens
gcauuucaauauggaggaa

SEQ ID NO: 464127 - RNA, 19 nt, Homo sapiens
ggaagauguaagaagcuaa

SEQ ID NO: 464128 - RNA, 19 nt, Homo sapiens
ggagacgacgcccuugaau

SEQ ID NO: 464129 - RNA, 19 nt, Homo sapiens
ccuguaucauuucuuggua

SEQ ID NO: 464130 - RNA, 19 nt, Homo sapiens
aaaccacccuaucaucagu

SEQ ID NO: 464131 - RNA, 19 nt, Homo sapiens
ucuccuguaucauuucuug

SEQ ID NO: 464132 - RNA, 19 nt, Homo sapiens
ucuauggcaucacucaguu

SEQ ID NO: 464133 - RNA, 19 nt, Homo sapiens
gggcuuggacagcacguuu

SEQ ID NO: 464134 - RNA, 19 nt, Homo sapiens
acaucagugucauuuacua

SEQ ID NO: 464135 - RNA, 19 nt, Homo sapiens
acuggcaacugcaccaauu

SEQ ID NO: 464136 - RNA, 19 nt, Homo sapiens
cgacgcccuugaauucuca

SEQ ID NO: 464137 - RNA, 19 nt, Homo sapiens
gugaagauggagaagauug

SEQ ID NO: 464138 - RNA, 19 nt, Homo sapiens
ggagggguguucucuucua

SEQ ID NO: 464139 - RNA, 19 nt, Homo sapiens
gaaaacggaguucuacaga

SEQ ID NO: 464140 - RNA, 19 nt, Homo sapiens
gguaugaucauugguaucu

SEQ ID NO: 464141 - RNA, 19 nt, Homo sapiens
uaacaaagcucuucacuuc

SEQ ID NO: 464142 - RNA, 19 nt, Homo sapiens
gaacggcgcucucgugaaa

SEQ ID NO: 464143 - RNA, 19 nt, Homo sapiens
gaagagagaugccaaagga

SEQ ID NO: 464144 - RNA, 19 nt, Homo sapiens
gaaccaacccuucacauaa

SEQ ID NO: 464145 - RNA, 19 nt, Homo sapiens
ggagauaccucauuaaacu

SEQ ID NO: 464146 - RNA, 19 nt, Homo sapiens
gcaaggagauggccaccaa

SEQ ID NO: 464147 - RNA, 19 nt, Homo sapiens
gaccuaaacugugccauuu

SEQ ID NO: 464148 - RNA, 19 nt, Homo sapiens
caagaaggcuggcaggaau

SEQ ID NO: 464149 - RNA, 19 nt, Homo sapiens
gccaagcccucauuaaaga

SEQ ID NO: 464150 - RNA, 19 nt, Homo sapiens
guagaaacuuguaccagaa

SEQ ID NO: 464151 - RNA, 19 nt, Homo sapiens
gaaaagaucugccccuugu

SEQ ID NO: 464152 - RNA, 19 nt, Homo sapiens
gagaaguggucuagcaaga

SEQ ID NO: 464153 - RNA, 19 nt, Homo sapiens
gaaguggucuagcaagauc

SEQ ID NO: 464154 - RNA, 19 nt, Homo sapiens
aaacuuggcuuagugaaga

SEQ ID NO: 464155 - RNA, 19 nt, Homo sapiens
gcauacauauuucacuguu

SEQ ID NO: 464156 - RNA, 19 nt, Homo sapiens
gcaucaaguucuaucugua

SEQ ID NO: 464157 - RNA, 19 nt, Homo sapiens
gugcugaccuaggauauaa

SEQ ID NO: 464158 - RNA, 19 nt, Homo sapiens
gaacagcuuuugagucgua

SEQ ID NO: 464159 - RNA, 19 nt, Homo sapiens
gagacuggcugaagcugaa

SEQ ID NO: 464160 - RNA, 19 nt, Homo sapiens
ucucaacgauucuaucuug

SEQ ID NO: 464161 - RNA, 19 nt, Homo sapiens
acaaagcucuucacuucaa

SEQ ID NO: 464162 - RNA, 19 nt, Homo sapiens
gaagaaaggagggcuguga

SEQ ID NO: 464163 - RNA, 19 nt, Homo sapiens
uaagagcaguagaaacuug

SEQ ID NO: 464164 - RNA, 19 nt, Homo sapiens
ggagggcugugaggagaua

SEQ ID NO: 464165 - RNA, 19 nt, Homo sapiens
caacgauucuaucuuguuc

SEQ ID NO: 464166 - RNA, 19 nt, Homo sapiens
caggagagaggacccauua

SEQ ID NO: 464167 - RNA, 19 nt, Homo sapiens
guuauugccuggauauaug

SEQ ID NO: 464168 - RNA, 19 nt, Homo sapiens
gaaaccgacccacaucauu

SEQ ID NO: 464169 - RNA, 19 nt, Homo sapiens
uaucuacucugccaaacaa

SEQ ID NO: 464170 - RNA, 19 nt, Homo sapiens
ccuaaacugugccauuuga

SEQ ID NO: 464171 - RNA, 19 nt, Homo sapiens
ggacucuacacccaucuua

SEQ ID NO: 464172 - RNA, 19 nt, Homo sapiens
aggcagagcuuucauacug

SEQ ID NO: 464173 - RNA, 19 nt, Homo sapiens
cauccuugguugaucuuua

SEQ ID NO: 464174 - RNA, 19 nt, Homo sapiens
agaugagucuguugcauuu

SEQ ID NO: 464175 - RNA, 19 nt, Homo sapiens
gaagaagagagaugccaaa

SEQ ID NO: 464176 - RNA, 19 nt, Homo sapiens
aaaguugccugcaggaaug

SEQ ID NO: 464177 - RNA, 19 nt, Homo sapiens
aaccaacccuucacauaaa

SEQ ID NO: 464178 - RNA, 19 nt, Homo sapiens
gagaaggccuaggagaguu

SEQ ID NO: 464179 - RNA, 19 nt, Homo sapiens
gaacagugguaccaguuuu

SEQ ID NO: 464180 - RNA, 19 nt, Homo sapiens
cagauauucuucucuuaug

SEQ ID NO: 464181 - RNA, 19 nt, Homo sapiens
caagcucagucuaaaugaa

SEQ ID NO: 464182 - RNA, 19 nt, Homo sapiens
ggaccuaaacugugccauu

SEQ ID NO: 464183 - RNA, 19 nt, Homo sapiens
agagggagcugcuagagau

SEQ ID NO: 464184 - RNA, 19 nt, Homo sapiens
gauggugaguggauaguca

SEQ ID NO: 464185 - RNA, 19 nt, Homo sapiens
gaagaaauagcaggagaga

SEQ ID NO: 464186 - RNA, 19 nt, Homo sapiens
ggacucagauauucuucuc

SEQ ID NO: 464187 - RNA, 19 nt, Homo sapiens
ugcagugucugaaagauuu

SEQ ID NO: 464188 - RNA, 19 nt, Homo sapiens
acacuuagagauugucaua

SEQ ID NO: 464189 - RNA, 19 nt, Homo sapiens
guuugugucugauuugauu

SEQ ID NO: 464190 - RNA, 19 nt, Homo sapiens
caggagagaagguacuaua

SEQ ID NO: 464191 - RNA, 19 nt, Homo sapiens
caucucagcaucucuuaaa

SEQ ID NO: 464192 - RNA, 19 nt, Homo sapiens
cagaaccacuggccagaga

SEQ ID NO: 464193 - RNA, 19 nt, Homo sapiens
ugaaugaggaggcccuaua

SEQ ID NO: 464194 - RNA, 19 nt, Homo sapiens
gagaggcagagcuuucaua

SEQ ID NO: 464195 - RNA, 19 nt, Homo sapiens
ggaggugcguuucucauac

SEQ ID NO: 464196 - RNA, 19 nt, Homo sapiens
caaacaacacccaguccua

SEQ ID NO: 464197 - RNA, 19 nt, Homo sapiens
ggaggaggaguaugccuuu

SEQ ID NO: 464198 - RNA, 19 nt, Homo sapiens
gacggaggguggcauguau

SEQ ID NO: 464199 - RNA, 19 nt, Homo sapiens
ggcaucaccugcugggaaa

SEQ ID NO: 464200 - RNA, 19 nt, Homo sapiens
ggacgaggcugagggaaaa

SEQ ID NO: 464201 - RNA, 19 nt, Homo sapiens
guacuauaccuuucaaauc

SEQ ID NO: 464202 - RNA, 19 nt, Homo sapiens
gcuacaacaaguacaagua

SEQ ID NO: 464203 - RNA, 19 nt, Homo sapiens
gaagugcucccaguucaga

SEQ ID NO: 464204 - RNA, 19 nt, Homo sapiens
ggaggugaguggaccaaag

SEQ ID NO: 464205 - RNA, 19 nt, Homo sapiens
guagcauugugaccuguuu

SEQ ID NO: 464206 - RNA, 19 nt, Homo sapiens
caaagcucuucacuucaaa

SEQ ID NO: 464207 - RNA, 19 nt, Homo sapiens
gaccuaggauauaacaaag

SEQ ID NO: 464208 - RNA, 19 nt, Homo sapiens
ugaccuaggauauaacaaa

SEQ ID NO: 464209 - RNA, 19 nt, Homo sapiens
uagcaaggcacaccaagaa

SEQ ID NO: 464210 - RNA, 19 nt, Homo sapiens
gaaguugaaggacagauca

SEQ ID NO: 464211 - RNA, 19 nt, Homo sapiens
gagaagcugcagugucuga

SEQ ID NO: 464212 - RNA, 19 nt, Homo sapiens
cuagcaagaucgacuuugu

SEQ ID NO: 464213 - RNA, 19 nt, Homo sapiens
uaaacuaaccacugucaau

SEQ ID NO: 464214 - RNA, 19 nt, Homo sapiens
caacaucucagcaucucuu

SEQ ID NO: 464215 - RNA, 19 nt, Homo sapiens
uccaaacucucaacgauuc

SEQ ID NO: 464216 - RNA, 19 nt, Homo sapiens
ggaggaguaugccuuuggu

SEQ ID NO: 464217 - RNA, 19 nt, Homo sapiens
ggugcagaccgcagaauuu

SEQ ID NO: 464218 - RNA, 19 nt, Homo sapiens
gcaaggcacaccaagaaca

SEQ ID NO: 464219 - RNA, 19 nt, Homo sapiens
gugaguggaccaaaggaua

SEQ ID NO: 464220 - RNA, 19 nt, Homo sapiens
cugcaggaaugaagcauga

SEQ ID NO: 464221 - RNA, 19 nt, Homo sapiens
gaaugaggaggcccuauag

SEQ ID NO: 464222 - RNA, 19 nt, Homo sapiens
cauuaaacuuggcuuagug

SEQ ID NO: 464223 - RNA, 19 nt, Homo sapiens
ccacuugaauugaucuucu

SEQ ID NO: 464224 - RNA, 19 nt, Homo sapiens
gcgagggagccacaccuua

SEQ ID NO: 464225 - RNA, 19 nt, Homo sapiens
uguuucagcucuuugacua

SEQ ID NO: 464226 - RNA, 19 nt, Homo sapiens
ggcaucaaguucuaucugu

SEQ ID NO: 464227 - RNA, 19 nt, Homo sapiens
gccgaggcaucaaguucua

SEQ ID NO: 464228 - RNA, 19 nt, Homo sapiens
ggcagagcuuucauacuga

SEQ ID NO: 464229 - RNA, 19 nt, Homo sapiens
ccaguuuguugaaguugaa

SEQ ID NO: 464230 - RNA, 19 nt, Homo sapiens
gaagcugcagugucugaaa

SEQ ID NO: 464231 - RNA, 19 nt, Homo sapiens
ugaugccgcugcccacauu

SEQ ID NO: 464232 - RNA, 19 nt, Homo sapiens
ggcuaugccuccguuguaa

SEQ ID NO: 464233 - RNA, 19 nt, Homo sapiens
aggagaagcugcagugucu

SEQ ID NO: 464234 - RNA, 19 nt, Homo sapiens
cucagcaucucuuaaaguu

SEQ ID NO: 464235 - RNA, 19 nt, Homo sapiens
gagagaugccaaaggaaug

SEQ ID NO: 464236 - RNA, 19 nt, Homo sapiens
guaaacgcaggauggaauu

SEQ ID NO: 464237 - RNA, 19 nt, Homo sapiens
aaaccgacccacaucauug

SEQ ID NO: 464238 - RNA, 19 nt, Homo sapiens
ucuucucgcucgucaagua

SEQ ID NO: 464239 - RNA, 19 nt, Homo sapiens
ggugaucacuccaguucuc

SEQ ID NO: 464240 - RNA, 19 nt, Homo sapiens
ggauauauggaggugauaa

SEQ ID NO: 464241 - RNA, 19 nt, Homo sapiens
gaccaucgcuggaggagaa

SEQ ID NO: 464242 - RNA, 19 nt, Homo sapiens
ggaagggcauccaguucua

SEQ ID NO: 464243 - RNA, 19 nt, Homo sapiens
cagaugaguucccauacua

SEQ ID NO: 464244 - RNA, 19 nt, Homo sapiens
aaucagcccucucuucaaa

SEQ ID NO: 464245 - RNA, 19 nt, Homo sapiens
gaggaggagucgaugaugu

SEQ ID NO: 464246 - RNA, 19 nt, Homo sapiens
cgggcaaggugguguauuu

SEQ ID NO: 464247 - RNA, 19 nt, Homo sapiens
uguauagcaucgucaagua

SEQ ID NO: 464248 - RNA, 19 nt, Homo sapiens
ugacagaugaguucccaua

SEQ ID NO: 464249 - RNA, 19 nt, Homo sapiens
cagaacaucuauagagaca

SEQ ID NO: 464250 - RNA, 19 nt, Homo sapiens
cgaccuggauguggacuuu

SEQ ID NO: 464251 - RNA, 19 nt, Homo sapiens
gaaccggacgggcauguau

SEQ ID NO: 464252 - RNA, 19 nt, Homo sapiens
cggccuagauagccaguuu

SEQ ID NO: 464253 - RNA, 19 nt, Homo sapiens
gccgagacauccacaugau

SEQ ID NO: 464254 - RNA, 19 nt, Homo sapiens
aagcugcucuucagaucuu

SEQ ID NO: 464255 - RNA, 19 nt, Homo sapiens
cgagguggaccgugagauu

SEQ ID NO: 464256 - RNA, 19 nt, Homo sapiens
gcaacgccaucaccagcau

SEQ ID NO: 464257 - RNA, 19 nt, Homo sapiens
gaaaaucagcccucucuuc

SEQ ID NO: 464258 - RNA, 19 nt, Homo sapiens
ggacaggcaagcuggacuu

SEQ ID NO: 464259 - RNA, 19 nt, Homo sapiens
acaacacguuucaccagaa

SEQ ID NO: 464260 - RNA, 19 nt, Homo sapiens
gcaaggugguguauuucac

SEQ ID NO: 464261 - RNA, 19 nt, Homo sapiens
caacacguuucaccagaac

SEQ ID NO: 464262 - RNA, 19 nt, Homo sapiens
uguauggcauucagagguu

SEQ ID NO: 464263 - RNA, 19 nt, Homo sapiens
gggcugaugguggugguua

SEQ ID NO: 464264 - RNA, 19 nt, Homo sapiens
ccaguuccaccacuuguug

SEQ ID NO: 464265 - RNA, 19 nt, Homo sapiens
gccaucuacuacaacauga

SEQ ID NO: 464266 - RNA, 19 nt, Homo sapiens
gagguggaccgugagauug

SEQ ID NO: 464267 - RNA, 19 nt, Homo sapiens
ggaccaaguagccaaagca

SEQ ID NO: 464268 - RNA, 19 nt, Homo sapiens
accagaacaucuauagaga

SEQ ID NO: 464269 - RNA, 19 nt, Homo sapiens
ggcauccaguucuaucuca

SEQ ID NO: 464270 - RNA, 19 nt, Homo sapiens
gaagggcauccaguucuau

SEQ ID NO: 464271 - RNA, 19 nt, Homo sapiens
gcaacugguggaacacaga

SEQ ID NO: 464272 - RNA, 19 nt, Homo sapiens
ggccaucuacuacaacaug

SEQ ID NO: 464273 - RNA, 19 nt, Homo sapiens
ucgccuacgugcucuucua

SEQ ID NO: 464274 - RNA, 19 nt, Homo sapiens
gauagccaguuugccuuuc

SEQ ID NO: 464275 - RNA, 19 nt, Homo sapiens
caccagaacaucuauagag

SEQ ID NO: 464276 - RNA, 19 nt, Homo sapiens
gcucuucagaucuucuauu

SEQ ID NO: 464277 - RNA, 19 nt, Homo sapiens
gcugguggcugugcuucga

SEQ ID NO: 464278 - RNA, 19 nt, Homo sapiens
uaucgagcguacaccaaug

SEQ ID NO: 464279 - RNA, 19 nt, Homo sapiens
ggaggagucgaugauguga

SEQ ID NO: 464280 - RNA, 19 nt, Homo sapiens
cugcuguccugccucauga

SEQ ID NO: 464281 - RNA, 19 nt, Homo sapiens
ucaucugcguggccaugua

SEQ ID NO: 464282 - RNA, 19 nt, Homo sapiens
ggucaucguguuccucugu

SEQ ID NO: 464283 - RNA, 19 nt, Homo sapiens
caacugguggaacacagaa

SEQ ID NO: 464284 - RNA, 19 nt, Homo sapiens
ccucggaguauggcaguua

SEQ ID NO: 464285 - RNA, 19 nt, Homo sapiens
gaggaggaggagucgauga

SEQ ID NO: 464286 - RNA, 19 nt, Homo sapiens
ggcugguccuucuggauga

SEQ ID NO: 464287 - RNA, 19 nt, Homo sapiens
ggcugauccucaccacuga

SEQ ID NO: 464288 - RNA, 19 nt, Homo sapiens
acagaugaguucccauacu

SEQ ID NO: 464289 - RNA, 19 nt, Homo sapiens
ccucaagggugugaagucu

SEQ ID NO: 464290 - RNA, 19 nt, Homo sapiens
gucaucguguuccucugua

SEQ ID NO: 464291 - RNA, 19 nt, Homo sapiens
ggaggaggagucgaugaug

SEQ ID NO: 464292 - RNA, 19 nt, Homo sapiens
guaccagcccucggaguau

SEQ ID NO: 464293 - RNA, 19 nt, Homo sapiens
uguggcaacugguggaaca

SEQ ID NO: 464294 - RNA, 19 nt, Homo sapiens
ucuuggcccuccuggugua

SEQ ID NO: 464295 - RNA, 19 nt, Homo sapiens
ggcaaggugguguauuuca

SEQ ID NO: 464296 - RNA, 19 nt, Homo sapiens
cagaggaggaggagucgau

SEQ ID NO: 464297 - RNA, 19 nt, Homo sapiens
uaccagcccucggaguaug

SEQ ID NO: 464298 - RNA, 19 nt, Homo sapiens
aguaccagcccucggagua

SEQ ID NO: 464299 - RNA, 19 nt, Homo sapiens
gagguucugccgagacauc

SEQ ID NO: 464300 - RNA, 19 nt, Homo sapiens
cuauagagacaccuucauc

SEQ ID NO: 464301 - RNA, 19 nt, Homo sapiens
cucuucagaucuucuauuc

SEQ ID NO: 464302 - RNA, 19 nt, Homo sapiens
gcuugguggccaucuacua

SEQ ID NO: 464303 - RNA, 19 nt, Homo sapiens
gcaagaggcugcaauauuc

SEQ ID NO: 464304 - RNA, 19 nt, Homo sapiens
caaggagugugaauuuaua

SEQ ID NO: 464305 - RNA, 19 nt, Homo sapiens
gcaaaggaggcuuguauuu

SEQ ID NO: 464306 - RNA, 19 nt, Homo sapiens
guacuucacugcuacauuc

SEQ ID NO: 464307 - RNA, 19 nt, Homo sapiens
ggagguguguuccuuauuc

SEQ ID NO: 464308 - RNA, 19 nt, Homo sapiens
ggaaagaucguguacuuca

SEQ ID NO: 464309 - RNA, 19 nt, Homo sapiens
gccaaggagugugaauuua

SEQ ID NO: 464310 - RNA, 19 nt, Homo sapiens
guacggagaguauauauag

SEQ ID NO: 464311 - RNA, 19 nt, Homo sapiens
ggcaagaggcugcaauauu

SEQ ID NO: 464312 - RNA, 19 nt, Homo sapiens
cgggaaagaucguguacuu

SEQ ID NO: 464313 - RNA, 19 nt, Homo sapiens
gggcaaaggaggcuuguau

SEQ ID NO: 464314 - RNA, 19 nt, Homo sapiens
ggacgacauugccuguaug

SEQ ID NO: 464315 - RNA, 19 nt, Homo sapiens
gguggagagugucauguga

SEQ ID NO: 464316 - RNA, 19 nt, Homo sapiens
ucuauuaccuggucaaguc

SEQ ID NO: 464317 - RNA, 19 nt, Homo sapiens
cugcagacauagcaauaaa

SEQ ID NO: 464318 - RNA, 19 nt, Homo sapiens
ccaaggagugugaauuuau

SEQ ID NO: 464319 - RNA, 19 nt, Homo sapiens
ccaccaguaucaauugugu

SEQ ID NO: 464320 - RNA, 19 nt, Homo sapiens
cgacauugccuguaugauc

SEQ ID NO: 464321 - RNA, 19 nt, Homo sapiens
caacaacaacugcuacaag

SEQ ID NO: 464322 - RNA, 19 nt, Homo sapiens
gcugggugcuggucuacuu

SEQ ID NO: 464323 - RNA, 19 nt, Homo sapiens
caacaccuacuacaucaug

SEQ ID NO: 464324 - RNA, 19 nt, Homo sapiens
gcggagguguguuccuuau

SEQ ID NO: 464325 - RNA, 19 nt, Homo sapiens
gagugugaauuuauagauc

SEQ ID NO: 464326 - RNA, 19 nt, Homo sapiens
aaaggaggcuuguauuuug

SEQ ID NO: 464327 - RNA, 19 nt, Homo sapiens
gcaugggcaucuucaucuu

SEQ ID NO: 464328 - RNA, 19 nt, Homo sapiens
cgacacacaugagauucuu

SEQ ID NO: 464329 - RNA, 19 nt, Homo sapiens
ccaaaccauccucuccuua

SEQ ID NO: 464330 - RNA, 19 nt, Homo sapiens
aaaggugaaugccagaugu

SEQ ID NO: 464331 - RNA, 19 nt, Homo sapiens
gagcugaccgcuucaugga

SEQ ID NO: 464332 - RNA, 19 nt, Homo sapiens
ccucagguguggauagaug

SEQ ID NO: 464333 - RNA, 19 nt, Homo sapiens
cgaagaagagcgccgagaa

SEQ ID NO: 464334 - RNA, 19 nt, Homo sapiens
caugaagacugugccaaug

SEQ ID NO: 464335 - RNA, 19 nt, Homo sapiens
uacaaccgcuucaacaaca

SEQ ID NO: 464336 - RNA, 19 nt, Homo sapiens
ggacccagauuuucuuuuc

SEQ ID NO: 464337 - RNA, 19 nt, Homo sapiens
gugaaugccagauguaaau

SEQ ID NO: 464338 - RNA, 19 nt, Homo sapiens
gagcagggcgugcacaucu

SEQ ID NO: 464339 - RNA, 19 nt, Homo sapiens
ggagaucuuccgccaugaa

SEQ ID NO: 464340 - RNA, 19 nt, Homo sapiens
gaaagaucguguacuucac

SEQ ID NO: 464341 - RNA, 19 nt, Homo sapiens
gacauucuacugugcuaaa

SEQ ID NO: 464342 - RNA, 19 nt, Homo sapiens
caaaggaggcuuguauuuu

SEQ ID NO: 464343 - RNA, 19 nt, Homo sapiens
ccauggugaucgucuucua

SEQ ID NO: 464344 - RNA, 19 nt, Homo sapiens
ggagugugaauuuauagau

SEQ ID NO: 464345 - RNA, 19 nt, Homo sapiens
gcuacaaccgcuucaacaa

SEQ ID NO: 464346 - RNA, 19 nt, Homo sapiens
gaagaagagcgccgagaac

SEQ ID NO: 464347 - RNA, 19 nt, Homo sapiens
gggacauucuacugugcua

SEQ ID NO: 464348 - RNA, 19 nt, Homo sapiens
cauccuggcucucaucaac

SEQ ID NO: 464349 - RNA, 19 nt, Homo sapiens
ggugaaugccagauguaaa

SEQ ID NO: 464350 - RNA, 19 nt, Homo sapiens
cuacuuccguuuccaaagg

SEQ ID NO: 464351 - RNA, 19 nt, Homo sapiens
uggacgacauugccuguau

SEQ ID NO: 464352 - RNA, 19 nt, Homo sapiens
caaaggugaaugccagaug

SEQ ID NO: 464353 - RNA, 19 nt, Homo sapiens
ugacaacucagcucacauc

SEQ ID NO: 464354 - RNA, 19 nt, Homo sapiens
gagcucaggacgcagaugu

SEQ ID NO: 464355 - RNA, 19 nt, Homo sapiens
cuacaaggacgccaucauc

SEQ ID NO: 464356 - RNA, 19 nt, Homo sapiens
gugagucuguuguguggau

SEQ ID NO: 464357 - RNA, 19 nt, Homo sapiens
ggcaaaggaggcuuguauu

SEQ ID NO: 464358 - RNA, 19 nt, Homo sapiens
ugcaacaccuacuacauca

SEQ ID NO: 464359 - RNA, 19 nt, Homo sapiens
gcaguggcagcuugggaaa

SEQ ID NO: 464360 - RNA, 19 nt, Homo sapiens
guacgucuuccagcuguuu

SEQ ID NO: 464361 - RNA, 19 nt, Homo sapiens
caaauccacgggaaagauc

SEQ ID NO: 464362 - RNA, 19 nt, Homo sapiens
ugaguacggagaguauaua

SEQ ID NO: 464363 - RNA, 19 nt, Homo sapiens
uuagagagccagccagcaa

SEQ ID NO: 464364 - RNA, 19 nt, Homo sapiens
gggaggagagagaggagaa

SEQ ID NO: 464365 - RNA, 19 nt, Homo sapiens
ucuuccagcuguuugacua

SEQ ID NO: 464366 - RNA, 19 nt, Homo sapiens
acugggaggugacccuuug

SEQ ID NO: 464367 - RNA, 19 nt, Homo sapiens
caaaccauccucuccuuac

SEQ ID NO: 464368 - RNA, 19 nt, Homo sapiens
gagccagccagcaauggaa

SEQ ID NO: 464369 - RNA, 19 nt, Homo sapiens
acgagccgcuggucuacaa

SEQ ID NO: 464370 - RNA, 19 nt, Homo sapiens
ucuucaacguuguguacua

SEQ ID NO: 464371 - RNA, 19 nt, Homo sapiens
gacgacauugccuguauga

SEQ ID NO: 464372 - RNA, 19 nt, Homo sapiens
ggcaucauuuacuaucuca

SEQ ID NO: 464373 - RNA, 19 nt, Homo sapiens
ggacgcgccagauggacuu

SEQ ID NO: 464374 - RNA, 19 nt, Homo sapiens
gcuuguauuuugcacauuu

SEQ ID NO: 464375 - RNA, 19 nt, Homo sapiens
gaguacggagaguauauau

SEQ ID NO: 464376 - RNA, 19 nt, Homo sapiens
ccgcuggucuacaacaaca

SEQ ID NO: 464377 - RNA, 19 nt, Homo sapiens
ccaugaagacugugccaau

SEQ ID NO: 464378 - RNA, 19 nt, Homo sapiens
ggacauucuacugugcuaa

SEQ ID NO: 464379 - RNA, 19 nt, Homo sapiens
cggcggagguguguuccuu

SEQ ID NO: 464380 - RNA, 19 nt, Homo sapiens
agccaaggagugugaauuu

SEQ ID NO: 464381 - RNA, 19 nt, Homo sapiens
cggagaguauauauagauc

SEQ ID NO: 464382 - RNA, 19 nt, Homo sapiens
gugaguacggagaguauau

SEQ ID NO: 464383 - RNA, 19 nt, Homo sapiens
gggcaagaggcugcaauau

SEQ ID NO: 464384 - RNA, 19 nt, Homo sapiens
cccaaaccauccucuccuu

SEQ ID NO: 464385 - RNA, 19 nt, Homo sapiens
uauuucagcugggcuauac

SEQ ID NO: 464386 - RNA, 19 nt, Homo sapiens
aguggcagcuugggaaaug

SEQ ID NO: 464387 - RNA, 19 nt, Homo sapiens
ggucaaauccacgggaaag

SEQ ID NO: 464388 - RNA, 19 nt, Homo sapiens
gaagggaaggagggagaga

SEQ ID NO: 464389 - RNA, 19 nt, Homo sapiens
ugacugauggcgggaugua

SEQ ID NO: 464390 - RNA, 19 nt, Homo sapiens
ucaucgaucucuccauggu

SEQ ID NO: 464391 - RNA, 19 nt, Homo sapiens
ccccaucccuguuauagaa

SEQ ID NO: 464392 - RNA, 19 nt, Homo sapiens
gcucaggacgcagauguca

SEQ ID NO: 464393 - RNA, 19 nt, Homo sapiens
ucaacguuguguacuacga

SEQ ID NO: 464394 - RNA, 19 nt, Homo sapiens
caucuucaucuucaacguu

SEQ ID NO: 464395 - RNA, 19 nt, Homo sapiens
guugugcccucugcuuugu

SEQ ID NO: 464396 - RNA, 19 nt, Homo sapiens
cgacagccaguuuguaggu

SEQ ID NO: 464397 - RNA, 19 nt, Homo sapiens
gaaugccagauguaaaugg

SEQ ID NO: 464398 - RNA, 19 nt, Homo sapiens
ucccuguuauagaagcuua

SEQ ID NO: 464399 - RNA, 19 nt, Homo sapiens
ucaaauccacgggaaagau

SEQ ID NO: 464400 - RNA, 19 nt, Homo sapiens
gaggaaggagcccaaacca

SEQ ID NO: 464401 - RNA, 19 nt, Homo sapiens
aaacuugagagaaugagau

SEQ ID NO: 464402 - RNA, 19 nt, Homo sapiens
ggaggaauccccauuuucu

SEQ ID NO: 464403 - RNA, 19 nt, Homo sapiens
gagaugaggugaaaguaau

SEQ ID NO: 464404 - RNA, 19 nt, Homo sapiens
ggucaagucuucagggaaa

SEQ ID NO: 464405 - RNA, 19 nt, Homo sapiens
acaacaaguuccacaauaa

SEQ ID NO: 464406 - RNA, 19 nt, Homo sapiens
ggagugggcuaugguauga

SEQ ID NO: 464407 - RNA, 19 nt, Homo sapiens
gccaucaucuucuuuauuc

SEQ ID NO: 464408 - RNA, 19 nt, Homo sapiens
gcaaccagaucgaguuugu

SEQ ID NO: 464409 - RNA, 19 nt, Homo sapiens
uacaacaaguuccacaaua

SEQ ID NO: 464410 - RNA, 19 nt, Homo sapiens
gggaggagaugaggugaaa

SEQ ID NO: 464411 - RNA, 19 nt, Homo sapiens
ggagaugaggugaaaguaa

SEQ ID NO: 464412 - RNA, 19 nt, Homo sapiens
ggucaucuccugcaucaug

SEQ ID NO: 464413 - RNA, 19 nt, Homo sapiens
ccacaaagccaagcagaga

SEQ ID NO: 464414 - RNA, 19 nt, Homo sapiens
gggaggcgccuucauguuc

SEQ ID NO: 464415 - RNA, 19 nt, Homo sapiens
caccauggcuuccuacaac

SEQ ID NO: 464416 - RNA, 19 nt, Homo sapiens
ggcaucauguacuaccuaa

SEQ ID NO: 464417 - RNA, 19 nt, Homo sapiens
cagaugacauugggaacuu

SEQ ID NO: 464418 - RNA, 19 nt, Homo sapiens
ggucucugcucuucuucuu

SEQ ID NO: 464419 - RNA, 19 nt, Homo sapiens
ccaccuacaucggcaucua

SEQ ID NO: 464420 - RNA, 19 nt, Homo sapiens
guggucaucuccugcauca

SEQ ID NO: 464421 - RNA, 19 nt, Homo sapiens
ccuccaaccucaccaaugg

SEQ ID NO: 464422 - RNA, 19 nt, Homo sapiens
gaggagaugaggugaaagu

SEQ ID NO: 464423 - RNA, 19 nt, Homo sapiens
ucucugcucuucuucuuca

SEQ ID NO: 464424 - RNA, 19 nt, Homo sapiens
ucaaaggagugggcuaugg

SEQ ID NO: 464425 - RNA, 19 nt, Homo sapiens
gcuguggucucugcucuuc

SEQ ID NO: 464426 - RNA, 19 nt, Homo sapiens
gaugcugccucccagaucu

SEQ ID NO: 464427 - RNA, 19 nt, Homo sapiens
gugcugaccauucuguuug

SEQ ID NO: 464428 - RNA, 19 nt, Homo sapiens
ucuauuggcugcugcugau

SEQ ID NO: 464429 - RNA, 19 nt, Homo sapiens
gggcaaccagaucgaguuu

SEQ ID NO: 464430 - RNA, 19 nt, Homo sapiens
cuccaggacucccggauau

SEQ ID NO: 464431 - RNA, 19 nt, Homo sapiens
cagaucgaguuuguacuga

SEQ ID NO: 464432 - RNA, 19 nt, Homo sapiens
ccaccaagagggaccagaa

SEQ ID NO: 464433 - RNA, 19 nt, Homo sapiens
ccuacaaccacuaccagua

SEQ ID NO: 464434 - RNA, 19 nt, Homo sapiens
caacaaguuccacaauaac

SEQ ID NO: 464435 - RNA, 19 nt, Homo sapiens
ccagaucgaguuuguacug

SEQ ID NO: 464436 - RNA, 19 nt, Homo sapiens
gaacuacuuccaggacauc

SEQ ID NO: 464437 - RNA, 19 nt, Homo sapiens
ggugcugaccauucuguuu

SEQ ID NO: 464438 - RNA, 19 nt, Homo sapiens
cuacaacaaguuccacaau

SEQ ID NO: 464439 - RNA, 19 nt, Homo sapiens
gaugaggugaaaguaauug

SEQ ID NO: 464440 - RNA, 19 nt, Homo sapiens
gaugacauugggaacuuug

SEQ ID NO: 464441 - RNA, 19 nt, Homo sapiens
cuacuacaauguggucauc

SEQ ID NO: 464442 - RNA, 19 nt, Homo sapiens
aaaggagugggcuauggua

SEQ ID NO: 464443 - RNA, 19 nt, Homo sapiens
caaaggagugggcuauggu

SEQ ID NO: 464444 - RNA, 19 nt, Homo sapiens
uguggucucugcucuucuu

SEQ ID NO: 464445 - RNA, 19 nt, Homo sapiens
cagccaggcaggcaucuau

SEQ ID NO: 464446 - RNA, 19 nt, Homo sapiens
ucacacuacuucccaucuc

SEQ ID NO: 464447 - RNA, 19 nt, Homo sapiens
gccuggccuucguggcuua

SEQ ID NO: 464448 - RNA, 19 nt, Homo sapiens
ucaucaccauggcuuccua

SEQ ID NO: 464449 - RNA, 19 nt, Homo sapiens
caaccagaucgaguuugua

SEQ ID NO: 464450 - RNA, 19 nt, Homo sapiens
cuacaaccacuaccaguac

SEQ ID NO: 464451 - RNA, 19 nt, Homo sapiens
augaguggauccugcagaa

SEQ ID NO: 464452 - RNA, 19 nt, Homo sapiens
guucaaaggagugggcuau

SEQ ID NO: 464453 - RNA, 19 nt, Homo sapiens
ccaggacucccggauauag

SEQ ID NO: 464454 - RNA, 19 nt, Homo sapiens
acacccuccuccagcguuu

SEQ ID NO: 464455 - RNA, 19 nt, Homo sapiens
gccaggcaggcaucuauug

SEQ ID NO: 464456 - RNA, 19 nt, Homo sapiens
uugacggcaucauguacua

SEQ ID NO: 464457 - RNA, 19 nt, Homo sapiens
cuacaucggcaucuacuac

SEQ ID NO: 464458 - RNA, 19 nt, Homo sapiens
ggagcuggcagaggugaug

SEQ ID NO: 464459 - RNA, 19 nt, Homo sapiens
gaguggauccugcagaaaa

SEQ ID NO: 464460 - RNA, 19 nt, Homo sapiens
cccugggccuacugcaaua

SEQ ID NO: 464461 - RNA, 19 nt, Homo sapiens
gcucuccuucggccaguuu

SEQ ID NO: 464462 - RNA, 19 nt, Homo sapiens
ccgccaucaucuucuuuau

SEQ ID NO: 464463 - RNA, 19 nt, Homo sapiens
ucccauaccucugcuaucg

SEQ ID NO: 464464 - RNA, 19 nt, Homo sapiens
gcucuucuucuucaugcuu

SEQ ID NO: 464465 - RNA, 19 nt, Homo sapiens
agaugacauugggaacuuu

SEQ ID NO: 464466 - RNA, 19 nt, Homo sapiens
gagcuucgggaggagauga

SEQ ID NO: 464467 - RNA, 19 nt, Homo sapiens
ccuccaggacucccggaua

SEQ ID NO: 464468 - RNA, 19 nt, Homo sapiens
gaucaccuacaaccacuac

SEQ ID NO: 464469 - RNA, 19 nt, Homo sapiens
ccucccagaucuucuacuc

SEQ ID NO: 464470 - RNA, 19 nt, Homo sapiens
cggcaucuacuacaaugug

SEQ ID NO: 464471 - RNA, 19 nt, Homo sapiens
gaagcaaccgguucuauga

SEQ ID NO: 464472 - RNA, 19 nt, Homo sapiens
gcaaccgguucuaugauaa

SEQ ID NO: 464473 - RNA, 19 nt, Homo sapiens
ccacggauggugacaguua

SEQ ID NO: 464474 - RNA, 19 nt, Homo sapiens
gcaacugcuucacuacuga

SEQ ID NO: 464475 - RNA, 19 nt, Homo sapiens
gaccaucuguuacuucugu

SEQ ID NO: 464476 - RNA, 19 nt, Homo sapiens
ugaccgcucugggaaguua

SEQ ID NO: 464477 - RNA, 19 nt, Homo sapiens
gaagguggcauuacguguu

SEQ ID NO: 464478 - RNA, 19 nt, Homo sapiens
gagcuggccuugugucucu

SEQ ID NO: 464479 - RNA, 19 nt, Homo sapiens
acaacaacaucuacaccua

SEQ ID NO: 464480 - RNA, 19 nt, Homo sapiens
caccgucgcucauuaagug

SEQ ID NO: 464481 - RNA, 19 nt, Homo sapiens
ggaagcaaccgguucuaug

SEQ ID NO: 464482 - RNA, 19 nt, Homo sapiens
uaacagaggguggcaugua

SEQ ID NO: 464483 - RNA, 19 nt, Homo sapiens
ggaccaagucuacaggaaa

SEQ ID NO: 464484 - RNA, 19 nt, Homo sapiens
caggaaagguuguauacgu

SEQ ID NO: 464485 - RNA, 19 nt, Homo sapiens
gaccaagucuacaggaaag

SEQ ID NO: 464486 - RNA, 19 nt, Homo sapiens
cagagggcaucaaguucua

SEQ ID NO: 464487 - RNA, 19 nt, Homo sapiens
ccaaggcggucaccaugau

SEQ ID NO: 464488 - RNA, 19 nt, Homo sapiens
acaagccacucaaguacaa

SEQ ID NO: 464489 - RNA, 19 nt, Homo sapiens
ugucuguuaucuccuauuu

SEQ ID NO: 464490 - RNA, 19 nt, Homo sapiens
cagccuggaccaucuguua

SEQ ID NO: 464491 - RNA, 19 nt, Homo sapiens
uaaugacugugaugccaaa

SEQ ID NO: 464492 - RNA, 19 nt, Homo sapiens
gaucuucaucuucuucuug

SEQ ID NO: 464493 - RNA, 19 nt, Homo sapiens
ggacagccaguuugugugu

SEQ ID NO: 464494 - RNA, 19 nt, Homo sapiens
ucaaguacaacaacaucua

SEQ ID NO: 464495 - RNA, 19 nt, Homo sapiens
cggccaccgucgcucauua

SEQ ID NO: 464496 - RNA, 19 nt, Homo sapiens
ggaacaacaagguggaguu

SEQ ID NO: 464497 - RNA, 19 nt, Homo sapiens
ccgguucuaugauaacauu

SEQ ID NO: 464498 - RNA, 19 nt, Homo sapiens
agcaaccgguucuaugaua

SEQ ID NO: 464499 - RNA, 19 nt, Homo sapiens
guacaucuuccagcucuuu

SEQ ID NO: 464500 - RNA, 19 nt, Homo sapiens
auccuagccuugucuguua

SEQ ID NO: 464501 - RNA, 19 nt, Homo sapiens
ccacucaaguacaacaaca

SEQ ID NO: 464502 - RNA, 19 nt, Homo sapiens
gggaccaagucuacaggaa

SEQ ID NO: 464503 - RNA, 19 nt, Homo sapiens
cuacagggacugcaucaug

SEQ ID NO: 464504 - RNA, 19 nt, Homo sapiens
gauugaggcccaucugaau

SEQ ID NO: 464505 - RNA, 19 nt, Homo sapiens
ggacacugcccgagaaacu

SEQ ID NO: 464506 - RNA, 19 nt, Homo sapiens
ugauaacauugaagacaug

SEQ ID NO: 464507 - RNA, 19 nt, Homo sapiens
ggauggugacaguuaauga

SEQ ID NO: 464508 - RNA, 19 nt, Homo sapiens
ucugggaaguuauaacaau

SEQ ID NO: 464509 - RNA, 19 nt, Homo sapiens
ucgcagccaucacagagaa

SEQ ID NO: 464510 - RNA, 19 nt, Homo sapiens
gaccaucgcagccaucaca

SEQ ID NO: 464511 - RNA, 19 nt, Homo sapiens
ggaugugccuucucuucgu

SEQ ID NO: 464512 - RNA, 19 nt, Homo sapiens
aguacaagccacucaagua

SEQ ID NO: 464513 - RNA, 19 nt, Homo sapiens
gcucugggaaguuauaaca

SEQ ID NO: 464514 - RNA, 19 nt, Homo sapiens
gggcucuucuuccuuucuu

SEQ ID NO: 464515 - RNA, 19 nt, Homo sapiens
cugggaaguuauaacaauu

SEQ ID NO: 464516 - RNA, 19 nt, Homo sapiens
caacuacagccaugugucu

SEQ ID NO: 464517 - RNA, 19 nt, Homo sapiens
ugacugugaugccaaacuc

SEQ ID NO: 464518 - RNA, 19 nt, Homo sapiens
cacggauggugacaguuaa

SEQ ID NO: 464519 - RNA, 19 nt, Homo sapiens
aagguggcauuacguguug

SEQ ID NO: 464520 - RNA, 19 nt, Homo sapiens
cugcuucacuacugagcua

SEQ ID NO: 464521 - RNA, 19 nt, Homo sapiens
gcccacggauggugacagu

SEQ ID NO: 464522 - RNA, 19 nt, Homo sapiens
ccaugugucucugcagaau

SEQ ID NO: 464523 - RNA, 19 nt, Homo sapiens
gaguggaacacagagaauu

SEQ ID NO: 464524 - RNA, 19 nt, Homo sapiens
auuaaguggugcuggauga

SEQ ID NO: 464525 - RNA, 19 nt, Homo sapiens
gaggguggcauguacaucu

SEQ ID NO: 464526 - RNA, 19 nt, Homo sapiens
gagcaacuacagccaugug

SEQ ID NO: 464527 - RNA, 19 nt, Homo sapiens
aggcccaucugaaugugua

SEQ ID NO: 464528 - RNA, 19 nt, Homo sapiens
acaagugaagguggcauua

SEQ ID NO: 464529 - RNA, 19 nt, Homo sapiens
uuuauuugcuguggaauuc

SEQ ID NO: 464530 - RNA, 19 nt, Homo sapiens
ggaucuucaucuucuucuu

SEQ ID NO: 464531 - RNA, 19 nt, Homo sapiens
ggccaccgucgcucauuaa

SEQ ID NO: 464532 - RNA, 19 nt, Homo sapiens
auacgugacugcgacauuc

SEQ ID NO: 464533 - RNA, 19 nt, Homo sapiens
cagcacagaucugaaaaug

SEQ ID NO: 464534 - RNA, 19 nt, Homo sapiens
acaacaagguggaguucgu

SEQ ID NO: 464535 - RNA, 19 nt, Homo sapiens
cagagaaggagacgcacuu

SEQ ID NO: 464536 - RNA, 19 nt, Homo sapiens
ggaggggcauuccugauuc

SEQ ID NO: 464537 - RNA, 19 nt, Homo sapiens
ccuugucuguuaucuccua

SEQ ID NO: 464538 - RNA, 19 nt, Homo sapiens
ggacauguaccccaagguu

SEQ ID NO: 464539 - RNA, 19 nt, Homo sapiens
aguuugcccuuuauuugaa

SEQ ID NO: 464540 - RNA, 19 nt, Homo sapiens
gauaacauugaagacauga

SEQ ID NO: 464541 - RNA, 19 nt, Homo sapiens
ccagcucuuugacuccuau

SEQ ID NO: 464542 - RNA, 19 nt, Homo sapiens
cauccuagccuugucuguu

SEQ ID NO: 464543 - RNA, 19 nt, Homo sapiens
ccgccgugguggacaugua

SEQ ID NO: 464544 - RNA, 19 nt, Homo sapiens
ccaccuuguucuucaugau

SEQ ID NO: 464545 - RNA, 19 nt, Homo sapiens
gguuugccaucuucucagu

SEQ ID NO: 464546 - RNA, 19 nt, Homo sapiens
ugauugaggcccaucugaa

SEQ ID NO: 464547 - RNA, 19 nt, Homo sapiens
gcuguggaauuccuguuuu

SEQ ID NO: 464548 - RNA, 19 nt, Homo sapiens
ggcaugaguggaacacaga

SEQ ID NO: 464549 - RNA, 19 nt, Homo sapiens
caaguacaacaacaucuac

SEQ ID NO: 464550 - RNA, 19 nt, Homo sapiens
gguucuaugauaacauuga

SEQ ID NO: 464551 - RNA, 19 nt, Homo sapiens
aaguuugcccuuuauuuga

SEQ ID NO: 464552 - RNA, 19 nt, Homo sapiens
uuccagaaacugaauguga

SEQ ID NO: 464553 - RNA, 19 nt, Homo sapiens
gagcuacccugggcuaccu

SEQ ID NO: 464554 - RNA, 19 nt, Homo sapiens
cagagaauuguguggaguu

SEQ ID NO: 464555 - RNA, 19 nt, Homo sapiens
aaguggugcuggaugauca

SEQ ID NO: 464556 - RNA, 19 nt, Homo sapiens
ucuguuaucuccuauuuuc

SEQ ID NO: 464557 - RNA, 19 nt, Homo sapiens
acagccaguuugugugugu

SEQ ID NO: 464558 - RNA, 19 nt, Homo sapiens
ucagagggcaucaaguucu

SEQ ID NO: 464559 - RNA, 19 nt, Homo sapiens
ucaaguacaagccacucaa

SEQ ID NO: 464560 - RNA, 19 nt, Homo sapiens
gcugcugauccuccugaua

SEQ ID NO: 464561 - RNA, 19 nt, Homo sapiens
gugauugaggcccaucuga

SEQ ID NO: 464562 - RNA, 19 nt, Homo sapiens
caagucuacaggaaagguu

SEQ ID NO: 464563 - RNA, 19 nt, Homo sapiens
agagaauuguguggaguuc

SEQ ID NO: 464564 - RNA, 19 nt, Homo sapiens
gagaggagcuauaauugga

SEQ ID NO: 464565 - RNA, 19 nt, Homo sapiens
uaacaaguguguauggauu

SEQ ID NO: 464566 - RNA, 19 nt, Homo sapiens
gaacagugccaccagcuuu

SEQ ID NO: 464567 - RNA, 19 nt, Homo sapiens
caggcaaggugguuuauuu

SEQ ID NO: 464568 - RNA, 19 nt, Homo sapiens
guggcgagcuguacagaua

SEQ ID NO: 464569 - RNA, 19 nt, Homo sapiens
gccagugucuucccauuaa

SEQ ID NO: 464570 - RNA, 19 nt, Homo sapiens
gaaguggucugcauaagcu

SEQ ID NO: 464571 - RNA, 19 nt, Homo sapiens
caacaaguaucacaacaac

SEQ ID NO: 464572 - RNA, 19 nt, Homo sapiens
gaaggagacccauuuguag

SEQ ID NO: 464573 - RNA, 19 nt, Homo sapiens
ggagaugauuccuagacuu

SEQ ID NO: 464574 - RNA, 19 nt, Homo sapiens
gcauuggucuggcaucugu

SEQ ID NO: 464575 - RNA, 19 nt, Homo sapiens
agaaggagacccauuugua

SEQ ID NO: 464576 - RNA, 19 nt, Homo sapiens
gguccugccuguucuuuau

SEQ ID NO: 464577 - RNA, 19 nt, Homo sapiens
gcacacugccguccaaugu

SEQ ID NO: 464578 - RNA, 19 nt, Homo sapiens
gggcggaccguuucuauga

SEQ ID NO: 464579 - RNA, 19 nt, Homo sapiens
gggagaaggagacccauuu

SEQ ID NO: 464580 - RNA, 19 nt, Homo sapiens
gacuuugccuggccacuuu

SEQ ID NO: 464581 - RNA, 19 nt, Homo sapiens
caacauugaggacaugauu

SEQ ID NO: 464582 - RNA, 19 nt, Homo sapiens
caaggugguuuauuucaca

SEQ ID NO: 464583 - RNA, 19 nt, Homo sapiens
gcacggacuuucugaacca

SEQ ID NO: 464584 - RNA, 19 nt, Homo sapiens
ugaggaaccuggagaccaa

SEQ ID NO: 464585 - RNA, 19 nt, Homo sapiens
acaacaacgucuaugugua

SEQ ID NO: 464586 - RNA, 19 nt, Homo sapiens
ggucaucgagucauauuug

SEQ ID NO: 464587 - RNA, 19 nt, Homo sapiens
ggcaaugucuggagguuuc

SEQ ID NO: 464588 - RNA, 19 nt, Homo sapiens
gcuaacugaucacagauuc

SEQ ID NO: 464589 - RNA, 19 nt, Homo sapiens
gcacacagggaaacuuaga

SEQ ID NO: 464590 - RNA, 19 nt, Homo sapiens
ucaaggaccugggcagaug

SEQ ID NO: 464591 - RNA, 19 nt, Homo sapiens
ggccagagauaugacuaaa

SEQ ID NO: 464592 - RNA, 19 nt, Homo sapiens
cgauauugcuaacugauca

SEQ ID NO: 464593 - RNA, 19 nt, Homo sapiens
gggagaggagcuauaauug

SEQ ID NO: 464594 - RNA, 19 nt, Homo sapiens
guuagagcguacugcauuu

SEQ ID NO: 464595 - RNA, 19 nt, Homo sapiens
agacuccucucuugugcua

SEQ ID NO: 464596 - RNA, 19 nt, Homo sapiens
ccacuuuccucuucuccuu

SEQ ID NO: 464597 - RNA, 19 nt, Homo sapiens
ggcaucaucuacuacuuga

SEQ ID NO: 464598 - RNA, 19 nt, Homo sapiens
gcaaaccccugacuucaug

SEQ ID NO: 464599 - RNA, 19 nt, Homo sapiens
acaauacccuguuggaagu

SEQ ID NO: 464600 - RNA, 19 nt, Homo sapiens
gagaugauuccuagacuuc

SEQ ID NO: 464601 - RNA, 19 nt, Homo sapiens
gauccuuccuuaggcuuaa

SEQ ID NO: 464602 - RNA, 19 nt, Homo sapiens
ggacaauacccuguuggaa

SEQ ID NO: 464603 - RNA, 19 nt, Homo sapiens
ggagaaggagacccauuug

SEQ ID NO: 464604 - RNA, 19 nt, Homo sapiens
caacaacgucuauguguac

SEQ ID NO: 464605 - RNA, 19 nt, Homo sapiens
gaccucacacagcaaguua

SEQ ID NO: 464606 - RNA, 19 nt, Homo sapiens
gcacccagaucuucuucuc

SEQ ID NO: 464607 - RNA, 19 nt, Homo sapiens
guacaacaacgucuaugug

SEQ ID NO: 464608 - RNA, 19 nt, Homo sapiens
ccaaggcugugacuaugau

SEQ ID NO: 464609 - RNA, 19 nt, Homo sapiens
ggagagaaccaugcaguca

SEQ ID NO: 464610 - RNA, 19 nt, Homo sapiens
gggccacccuccauucuca

SEQ ID NO: 464611 - RNA, 19 nt, Homo sapiens
cgucaugugcuaccugaua

SEQ ID NO: 464612 - RNA, 19 nt, Homo sapiens
ucacacagcaaguuagaga

SEQ ID NO: 464613 - RNA, 19 nt, Homo sapiens
gcagcuacaacaaguauca

SEQ ID NO: 464614 - RNA, 19 nt, Homo sapiens
ccggaaggcuacagagaga

SEQ ID NO: 464615 - RNA, 19 nt, Homo sapiens
ggaccaacaagauggaguu

SEQ ID NO: 464616 - RNA, 19 nt, Homo sapiens
ggagaggagcuauaauugg

SEQ ID NO: 464617 - RNA, 19 nt, Homo sapiens
guacaucuuccagcuguuu

SEQ ID NO: 464618 - RNA, 19 nt, Homo sapiens
ccucaccugucauggaauu

SEQ ID NO: 464619 - RNA, 19 nt, Homo sapiens
ggccagugucuucccauua

SEQ ID NO: 464620 - RNA, 19 nt, Homo sapiens
ugacuaugaugcccuuauc

SEQ ID NO: 464621 - RNA, 19 nt, Homo sapiens
uaccucaccugucauggaa

SEQ ID NO: 464622 - RNA, 19 nt, Homo sapiens
gggcaucaucuacuacuug

SEQ ID NO: 464623 - RNA, 19 nt, Homo sapiens
gcaaggugguuuauuucac

SEQ ID NO: 464624 - RNA, 19 nt, Homo sapiens
guuaggggauccuuccuua

SEQ ID NO: 464625 - RNA, 19 nt, Homo sapiens
ugcaacaccucgaguuaug

SEQ ID NO: 464626 - RNA, 19 nt, Homo sapiens
cuacuucaucuucuucuuu

SEQ ID NO: 464627 - RNA, 19 nt, Homo sapiens
ggcgagcuguacagauaaa

SEQ ID NO: 464628 - RNA, 19 nt, Homo sapiens
ggaaggggcuugggagaug

SEQ ID NO: 464629 - RNA, 19 nt, Homo sapiens
guggaaggcaccaucguuu

SEQ ID NO: 464630 - RNA, 19 nt, Homo sapiens
cagaucuucuucuccuuug

SEQ ID NO: 464631 - RNA, 19 nt, Homo sapiens
ccagaucuucuucuccuuu

SEQ ID NO: 464632 - RNA, 19 nt, Homo sapiens
ccaauggaccaacaagaug

SEQ ID NO: 464633 - RNA, 19 nt, Homo sapiens
uaacugaucacagauucuu

SEQ ID NO: 464634 - RNA, 19 nt, Homo sapiens
agagcguacugcauuugua

SEQ ID NO: 464635 - RNA, 19 nt, Homo sapiens
gagaaggagacccauuugu

SEQ ID NO: 464636 - RNA, 19 nt, Homo sapiens
gauacuccauuggcugguu

SEQ ID NO: 464637 - RNA, 19 nt, Homo sapiens
ugacaacauugaggacaug

SEQ ID NO: 464638 - RNA, 19 nt, Homo sapiens
gccaauggaccaacaagau

SEQ ID NO: 464639 - RNA, 19 nt, Homo sapiens
guuaacaaguguguaugga

SEQ ID NO: 464640 - RNA, 19 nt, Homo sapiens
ccaaggccgauauugcuaa

SEQ ID NO: 464641 - RNA, 19 nt, Homo sapiens
caaguacaacaacgucuau

SEQ ID NO: 464642 - RNA, 19 nt, Homo sapiens
gcauaugccugcuguuccu

SEQ ID NO: 464643 - RNA, 19 nt, Homo sapiens
ccagcuguuugacuacuau

SEQ ID NO: 464644 - RNA, 19 nt, Homo sapiens
acaaguaucacaacaacug

SEQ ID NO: 464645 - RNA, 19 nt, Homo sapiens
gggcagcuacaacaaguau

SEQ ID NO: 464646 - RNA, 19 nt, Homo sapiens
gucaucgagucauauuuga

SEQ ID NO: 464647 - RNA, 19 nt, Homo sapiens
ugauuugccugaccucaca

SEQ ID NO: 464648 - RNA, 19 nt, Homo sapiens
gaagugacaacugaacaca

SEQ ID NO: 464649 - RNA, 19 nt, Homo sapiens
ucaaguacaacaacgucua

SEQ ID NO: 464650 - RNA, 19 nt, Homo sapiens
caucgagucauauuugaau

SEQ ID NO: 464651 - RNA, 19 nt, Homo sapiens
ggaagguggcagugcaaga

SEQ ID NO: 464652 - RNA, 19 nt, Homo sapiens
ugaguggucuugggugaau

SEQ ID NO: 464653 - RNA, 19 nt, Homo sapiens
gcuccaggcgacaccauuu

SEQ ID NO: 464654 - RNA, 19 nt, Homo sapiens
guuaugaggauuccacugu

SEQ ID NO: 464655 - RNA, 19 nt, Homo sapiens
gcaacaccucgaguuauga

SEQ ID NO: 464656 - RNA, 19 nt, Homo sapiens
ggacuuugccuggccacuu

SEQ ID NO: 464657 - RNA, 19 nt, Homo sapiens
gaagguggcagugcaagag

SEQ ID NO: 464658 - RNA, 19 nt, Homo sapiens
cuacagagagagccagguu

SEQ ID NO: 464659 - RNA, 19 nt, Homo sapiens
aacaagggaaggacugaua

SEQ ID NO: 464660 - RNA, 19 nt, Homo sapiens
aaagggacaugaaaaugaa

SEQ ID NO: 464661 - RNA, 19 nt, Homo sapiens
ccguuucuaugacaacauu

SEQ ID NO: 464662 - RNA, 19 nt, Homo sapiens
gcggaccguuucuaugaca

SEQ ID NO: 464663 - RNA, 19 nt, Homo sapiens
gugacagccuccauagaca

SEQ ID NO: 464664 - RNA, 19 nt, Homo sapiens
ucacagagcuagagucuca

SEQ ID NO: 464665 - RNA, 19 nt, Homo sapiens
cauggccucuuaucaaaua

SEQ ID NO: 464666 - RNA, 19 nt, Homo sapiens
caacaucgaagacaugauu

SEQ ID NO: 464667 - RNA, 19 nt, Homo sapiens
gcacuaggccaguacacua

SEQ ID NO: 464668 - RNA, 19 nt, Homo sapiens
gccauggccucuuaucaaa

SEQ ID NO: 464669 - RNA, 19 nt, Homo sapiens
guacuucacggccacauuu

SEQ ID NO: 464670 - RNA, 19 nt, Homo sapiens
caacgucuacuacaucauu

SEQ ID NO: 464671 - RNA, 19 nt, Homo sapiens
gaacaacaagauggaguuu

SEQ ID NO: 464672 - RNA, 19 nt, Homo sapiens
ugacagcgcugguggacau

SEQ ID NO: 464673 - RNA, 19 nt, Homo sapiens
caaauacuguuggcucuuc

SEQ ID NO: 464674 - RNA, 19 nt, Homo sapiens
caacagcggcaccagcuuu

SEQ ID NO: 464675 - RNA, 19 nt, Homo sapiens
gagaauccgucagcucaug

SEQ ID NO: 464676 - RNA, 19 nt, Homo sapiens
acacuccgcugaccuacaa

SEQ ID NO: 464677 - RNA, 19 nt, Homo sapiens
uaccucgucuuccucuuua

SEQ ID NO: 464678 - RNA, 19 nt, Homo sapiens
ggaccucacugcucagacu

SEQ ID NO: 464679 - RNA, 19 nt, Homo sapiens
ccgcugaccuacaacaaga

SEQ ID NO: 464680 - RNA, 19 nt, Homo sapiens
ggcagcagcuucacuaagg

SEQ ID NO: 464681 - RNA, 19 nt, Homo sapiens
cauguacccucacguguuc

SEQ ID NO: 464682 - RNA, 19 nt, Homo sapiens
ggcuaugccucccagauga

SEQ ID NO: 464683 - RNA, 19 nt, Homo sapiens
agacagcacuaggccagua

SEQ ID NO: 464684 - RNA, 19 nt, Homo sapiens
ggaacaacaagauggaguu

SEQ ID NO: 464685 - RNA, 19 nt, Homo sapiens
ucacuaaggugggauggau

SEQ ID NO: 464686 - RNA, 19 nt, Homo sapiens
ugaccuacaacaagaagua

SEQ ID NO: 464687 - RNA, 19 nt, Homo sapiens
gaguaucugucgucuccuu

SEQ ID NO: 464688 - RNA, 19 nt, Homo sapiens
ggaugcaggcacccagaua

SEQ ID NO: 464689 - RNA, 19 nt, Homo sapiens
gaauucaguuuuaccugua

SEQ ID NO: 464690 - RNA, 19 nt, Homo sapiens
gcacagccaccuuucucuu

SEQ ID NO: 464691 - RNA, 19 nt, Homo sapiens
caggcaaggugguguacuu

SEQ ID NO: 464692 - RNA, 19 nt, Homo sapiens
gagccaagcgcuucuacga

SEQ ID NO: 464693 - RNA, 19 nt, Homo sapiens
ucacagagggcggaaugua

SEQ ID NO: 464694 - RNA, 19 nt, Homo sapiens
gcacuggaacaacaagaug

SEQ ID NO: 464695 - RNA, 19 nt, Homo sapiens
acaacaagaaguacacgua

SEQ ID NO: 464696 - RNA, 19 nt, Homo sapiens
ggccugcuguuucuucuuc

SEQ ID NO: 464697 - RNA, 19 nt, Homo sapiens
gaaugguaccucugagaau

SEQ ID NO: 464698 - RNA, 19 nt, Homo sapiens
cauccuucauuccauuaaa

SEQ ID NO: 464699 - RNA, 19 nt, Homo sapiens
caacaaguaccacaacaac

SEQ ID NO: 464700 - RNA, 19 nt, Homo sapiens
gcacccagauauucuucuc

SEQ ID NO: 464701 - RNA, 19 nt, Homo sapiens
gaccaacggcucccugaau

SEQ ID NO: 464702 - RNA, 19 nt, Homo sapiens
ggcaacgucuggagguuuc

SEQ ID NO: 464703 - RNA, 19 nt, Homo sapiens
cacauuuccuuaccucaug

SEQ ID NO: 464704 - RNA, 19 nt, Homo sapiens
ucacggccacauuuccuua

SEQ ID NO: 464705 - RNA, 19 nt, Homo sapiens
cauuaaauccacauucuuc

SEQ ID NO: 464706 - RNA, 19 nt, Homo sapiens
ucuucucccugauaaagua

SEQ ID NO: 464707 - RNA, 19 nt, Homo sapiens
cagcgcugguggacaugua

SEQ ID NO: 464708 - RNA, 19 nt, Homo sapiens
ucucauccuucauuccauu

SEQ ID NO: 464709 - RNA, 19 nt, Homo sapiens
gaaaggccagugccaagag

SEQ ID NO: 464710 - RNA, 19 nt, Homo sapiens
cgacaacaucgaagacaug

SEQ ID NO: 464711 - RNA, 19 nt, Homo sapiens
ccagcucuuugacuacuau

SEQ ID NO: 464712 - RNA, 19 nt, Homo sapiens
gaugcaggcacccagauau

SEQ ID NO: 464713 - RNA, 19 nt, Homo sapiens
cccaaggaauucaguuuua

SEQ ID NO: 464714 - RNA, 19 nt, Homo sapiens
aaugguaccucugagaaug

SEQ ID NO: 464715 - RNA, 19 nt, Homo sapiens
gcaugugccuccuguucgu

SEQ ID NO: 464716 - RNA, 19 nt, Homo sapiens
gcucacagagggcggaaug

SEQ ID NO: 464717 - RNA, 19 nt, Homo sapiens
gcaaggugguguacuucac

SEQ ID NO: 464718 - RNA, 19 nt, Homo sapiens
ugaaugguaccucugagaa

SEQ ID NO: 464719 - RNA, 19 nt, Homo sapiens
aaaccaguguauccaguca

SEQ ID NO: 464720 - RNA, 19 nt, Homo sapiens
ucuacuacaucauuguguu

SEQ ID NO: 464721 - RNA, 19 nt, Homo sapiens
acaaguaccacaacaacug

SEQ ID NO: 464722 - RNA, 19 nt, Homo sapiens
gaccuggaguggauaagac

SEQ ID NO: 464723 - RNA, 19 nt, Homo sapiens
gcagcagcuucacuaaggu

SEQ ID NO: 464724 - RNA, 19 nt, Homo sapiens
guacguguuccagcucuuu

SEQ ID NO: 464725 - RNA, 19 nt, Homo sapiens
ccaguaauggagagacaaa

SEQ ID NO: 464726 - RNA, 19 nt, Homo sapiens
ccucauccuuggaguaucu

SEQ ID NO: 464727 - RNA, 19 nt, Homo sapiens
ccucacguguuccgcaaga

SEQ ID NO: 464728 - RNA, 19 nt, Homo sapiens
ggauagccaguuugugugu

SEQ ID NO: 464729 - RNA, 19 nt, Homo sapiens
gccuggcuuucaucgcuua

SEQ ID NO: 464730 - RNA, 19 nt, Homo sapiens
uggcauuccugucuuccuu

SEQ ID NO: 464731 - RNA, 19 nt, Homo sapiens
gacaacaucgaagacauga

SEQ ID NO: 464732 - RNA, 19 nt, Homo sapiens
uguuccagcucuuugacua

SEQ ID NO: 464733 - RNA, 19 nt, Homo sapiens
uuucucuucucccugauaa

SEQ ID NO: 464734 - RNA, 19 nt, Homo sapiens
gcaggcacccagauauucu

SEQ ID NO: 464735 - RNA, 19 nt, Homo sapiens
gauggaguuugugcuguca

SEQ ID NO: 464736 - RNA, 19 nt, Homo sapiens
cuaccucgucuuccucuuu

SEQ ID NO: 464737 - RNA, 19 nt, Homo sapiens
gggaggugccuucuucauc

SEQ ID NO: 464738 - RNA, 19 nt, Homo sapiens
ccaagcgcuucuacgacaa

SEQ ID NO: 464739 - RNA, 19 nt, Homo sapiens
ccaaaccucacgcgucugu

SEQ ID NO: 464740 - RNA, 19 nt, Homo sapiens
uggccugggucaucugcua

SEQ ID NO: 464741 - RNA, 19 nt, Homo sapiens
gucacagccuggaggaaga

SEQ ID NO: 464742 - RNA, 19 nt, Homo sapiens
uccauuaaauccacauucu

SEQ ID NO: 464743 - RNA, 19 nt, Homo sapiens
caguuuguguguguagaaa

SEQ ID NO: 464744 - RNA, 19 nt, Homo sapiens
gcccuggccuggcuuucau

SEQ ID NO: 464745 - RNA, 19 nt, Homo sapiens
gcccucugcuuccucaaca

SEQ ID NO: 464746 - RNA, 19 nt, Homo sapiens
accaacggcucccugaaug

SEQ ID NO: 464747 - RNA, 19 nt, Homo sapiens
gcugcuaccaugaguggaa

SEQ ID NO: 464748 - RNA, 19 nt, Homo sapiens
gaagacaugauuggguaca

SEQ ID NO: 464749 - RNA, 19 nt, Homo sapiens
uacaacaaguaccacaaca

SEQ ID NO: 464750 - RNA, 19 nt, Homo sapiens
ccucuccugucaucgaguu

SEQ ID NO: 464751 - RNA, 19 nt, Homo sapiens
ugaaaggccagugccaaga

SEQ ID NO: 464752 - RNA, 19 nt, Homo sapiens
ucucaggcacaaccaguaa

SEQ ID NO: 464753 - RNA, 19 nt, Homo sapiens
gcgcuucuacgacaacauc

SEQ ID NO: 464754 - RNA, 19 nt, Homo sapiens
ggaaguccucauccuugga

SEQ ID NO: 464755 - RNA, 19 nt, Homo sapiens
gcuggugguccuguuaauu

SEQ ID NO: 464756 - RNA, 19 nt, Homo sapiens
gcauuccugucuuccuucu

SEQ ID NO: 464757 - RNA, 19 nt, Homo sapiens
ccucuuaucaaauacuguu

SEQ ID NO: 464758 - RNA, 19 nt, Homo sapiens
ccacauuuccuuaccucau

SEQ ID NO: 464759 - RNA, 19 nt, Homo sapiens
caucuucgagucccucugu

SEQ ID NO: 464760 - RNA, 19 nt, Homo sapiens
gcuacaacaaguaccacaa

SEQ ID NO: 464761 - RNA, 19 nt, Homo sapiens
caugcuggugguccuguua

SEQ ID NO: 464762 - RNA, 19 nt, Homo sapiens
aaugccaccucuccuguca

SEQ ID NO: 464763 - RNA, 19 nt, Homo sapiens
ccauuaaauccacauucuu

SEQ ID NO: 464764 - RNA, 19 nt, Homo sapiens
gaucauaauucucaucuug

SEQ ID NO: 464765 - RNA, 19 nt, Homo sapiens
gaacgucuaucucaugaug

SEQ ID NO: 464766 - RNA, 19 nt, Homo sapiens
agaccaagcucucauuuaa

SEQ ID NO: 464767 - RNA, 19 nt, Homo sapiens
gaggauggacugcuauuua

SEQ ID NO: 464768 - RNA, 19 nt, Homo sapiens
ggacacacaugacucugaa

SEQ ID NO: 464769 - RNA, 19 nt, Homo sapiens
ggacugcuauuuaaauucu

SEQ ID NO: 464770 - RNA, 19 nt, Homo sapiens
gcaaaguccugcucaacau

SEQ ID NO: 464771 - RNA, 19 nt, Homo sapiens
gcagugaucauaauucuca

SEQ ID NO: 464772 - RNA, 19 nt, Homo sapiens
ucugaaaccuuccuuguau

SEQ ID NO: 464773 - RNA, 19 nt, Homo sapiens
gaagggaggcucucaccaa

SEQ ID NO: 464774 - RNA, 19 nt, Homo sapiens
ggaaggugguggacuguag

SEQ ID NO: 464775 - RNA, 19 nt, Homo sapiens
caaaaucucugggcuaauu

SEQ ID NO: 464776 - RNA, 19 nt, Homo sapiens
gggcucagcuuaccucuac

SEQ ID NO: 464777 - RNA, 19 nt, Homo sapiens
ggaacuuaauccucuccua

SEQ ID NO: 464778 - RNA, 19 nt, Homo sapiens
aggauggacugcuauuuaa

SEQ ID NO: 464779 - RNA, 19 nt, Homo sapiens
ggugaggcuucccgucaua

SEQ ID NO: 464780 - RNA, 19 nt, Homo sapiens
ccuuauagcuguucucauc

SEQ ID NO: 464781 - RNA, 19 nt, Homo sapiens
gugaacgucuaucucauga

SEQ ID NO: 464782 - RNA, 19 nt, Homo sapiens
gaucguggcgucccucuug

SEQ ID NO: 464783 - RNA, 19 nt, Homo sapiens
ggagagcucugggccuuca

SEQ ID NO: 464784 - RNA, 19 nt, Homo sapiens
gugauggccuuccucuuug

SEQ ID NO: 464785 - RNA, 19 nt, Homo sapiens
ccaagacgggcucagcuua

SEQ ID NO: 464786 - RNA, 19 nt, Homo sapiens
gcaagaccaagcucucauu

SEQ ID NO: 464787 - RNA, 19 nt, Homo sapiens
caucaucaccuucugcauu

SEQ ID NO: 464788 - RNA, 19 nt, Homo sapiens
caucaggccgucucuguuu

SEQ ID NO: 464789 - RNA, 19 nt, Homo sapiens
cauauucgcagugaucaua

SEQ ID NO: 464790 - RNA, 19 nt, Homo sapiens
gggcuaauugugaacauuu

SEQ ID NO: 464791 - RNA, 19 nt, Homo sapiens
gaagggaagcccgguguug

SEQ ID NO: 464792 - RNA, 19 nt, Homo sapiens
cauaauggugucaggauuu

SEQ ID NO: 464793 - RNA, 19 nt, Homo sapiens
guccugggcuucauaaugg

SEQ ID NO: 464794 - RNA, 19 nt, Homo sapiens
gggaggcucucaccaaagg

SEQ ID NO: 464795 - RNA, 19 nt, Homo sapiens
ugugauggccuuccucuuu

SEQ ID NO: 464796 - RNA, 19 nt, Homo sapiens
gauggacugcuauuuaaau

SEQ ID NO: 464797 - RNA, 19 nt, Homo sapiens
gcagcgacuugcuucuaug

SEQ ID NO: 464798 - RNA, 19 nt, Homo sapiens
ggcagcgacuugcuucuau

SEQ ID NO: 464799 - RNA, 19 nt, Homo sapiens
uuaauccucuccuacauca

SEQ ID NO: 464800 - RNA, 19 nt, Homo sapiens
caagaccaagcucucauuu

SEQ ID NO: 464801 - RNA, 19 nt, Homo sapiens
aagggaggcucucaccaaa

SEQ ID NO: 464802 - RNA, 19 nt, Homo sapiens
ucauaauggugucaggauu

SEQ ID NO: 464803 - RNA, 19 nt, Homo sapiens
caccaauaaucgccacauu

SEQ ID NO: 464804 - RNA, 19 nt, Homo sapiens
ucuucuagguuccauguuu

SEQ ID NO: 464805 - RNA, 19 nt, Homo sapiens
gaacaaugacacaaaagaa

SEQ ID NO: 464806 - RNA, 19 nt, Homo sapiens
caucaccggcuggaacuua

SEQ ID NO: 464807 - RNA, 19 nt, Homo sapiens
gcacucuccuggcuuacuc

SEQ ID NO: 464808 - RNA, 19 nt, Homo sapiens
ccugugcuauggcgaguuu

SEQ ID NO: 464809 - RNA, 19 nt, Homo sapiens
uagccaacgucaaugauag

SEQ ID NO: 464810 - RNA, 19 nt, Homo sapiens
ggauggacugcuauuuaaa

SEQ ID NO: 464811 - RNA, 19 nt, Homo sapiens
gcugggaaggugccaagua

SEQ ID NO: 464812 - RNA, 19 nt, Homo sapiens
cgacauauucgcagugauc

SEQ ID NO: 464813 - RNA, 19 nt, Homo sapiens
caucaucuacuuuggcuau

SEQ ID NO: 464814 - RNA, 19 nt, Homo sapiens
ucucugggcuaauugugaa

SEQ ID NO: 464815 - RNA, 19 nt, Homo sapiens
ggacuugguggaccucaug

SEQ ID NO: 464816 - RNA, 19 nt, Homo sapiens
caaaguccugcucaacauu

SEQ ID NO: 464817 - RNA, 19 nt, Homo sapiens
ggugucaggauuugugaaa

SEQ ID NO: 464818 - RNA, 19 nt, Homo sapiens
gguccugggcuucauaaug

SEQ ID NO: 464819 - RNA, 19 nt, Homo sapiens
caagcucucauuuaagguu

SEQ ID NO: 464820 - RNA, 19 nt, Homo sapiens
agagcagccuaaccuggua

SEQ ID NO: 464821 - RNA, 19 nt, Homo sapiens
gggcagcgacuugcuucua

SEQ ID NO: 464822 - RNA, 19 nt, Homo sapiens
gugaaaggaucgguuaaaa

SEQ ID NO: 464823 - RNA, 19 nt, Homo sapiens
aagaccaagcucucauuua

SEQ ID NO: 464824 - RNA, 19 nt, Homo sapiens
cauuucaaccagccuuaua

SEQ ID NO: 464825 - RNA, 19 nt, Homo sapiens
guacuuccgacgaguuaga

SEQ ID NO: 464826 - RNA, 19 nt, Homo sapiens
ggcugaggauggacugcua

SEQ ID NO: 464827 - RNA, 19 nt, Homo sapiens
ugacaggacuuuuaacucu

SEQ ID NO: 464828 - RNA, 19 nt, Homo sapiens
acuucugccuggacaauaa

SEQ ID NO: 464829 - RNA, 19 nt, Homo sapiens
caguacuuccgacgaguua

SEQ ID NO: 464830 - RNA, 19 nt, Homo sapiens
ucuuugaccugaaggacuu

SEQ ID NO: 464831 - RNA, 19 nt, Homo sapiens
gcuguccucuggugagaag

SEQ ID NO: 464832 - RNA, 19 nt, Homo sapiens
auaauggugucaggauuug

SEQ ID NO: 464833 - RNA, 19 nt, Homo sapiens
ugauggccuuccucuuuga

SEQ ID NO: 464834 - RNA, 19 nt, Homo sapiens
ggugcaaaguccugcucaa

SEQ ID NO: 464835 - RNA, 19 nt, Homo sapiens
ucgcagugaucauaauucu

SEQ ID NO: 464836 - RNA, 19 nt, Homo sapiens
gcaucuucgugaacgucua

SEQ ID NO: 464837 - RNA, 19 nt, Homo sapiens
uauaccagauggccaguac

SEQ ID NO: 464838 - RNA, 19 nt, Homo sapiens
uuggcacucuccuggcuua

SEQ ID NO: 464839 - RNA, 19 nt, Homo sapiens
ugaaagagucggccauggu

SEQ ID NO: 464840 - RNA, 19 nt, Homo sapiens
caucuugacaggacuuuua

SEQ ID NO: 464841 - RNA, 19 nt, Homo sapiens
ugaaaaccccgacauauuc

SEQ ID NO: 464842 - RNA, 19 nt, Homo sapiens
accaagcucucauuuaagg

SEQ ID NO: 464843 - RNA, 19 nt, Homo sapiens
gaccaaaacaccaauaauc

SEQ ID NO: 464844 - RNA, 19 nt, Homo sapiens
uuagccaacgucaaugaua

SEQ ID NO: 464845 - RNA, 19 nt, Homo sapiens
caggugaagaggugaagaa

SEQ ID NO: 464846 - RNA, 19 nt, Homo sapiens
gcuuaccucuacagcuaug

SEQ ID NO: 464847 - RNA, 19 nt, Homo sapiens
gaggcuucccgucauauuc

SEQ ID NO: 464848 - RNA, 19 nt, Homo sapiens
ggcuaauugugaacauuuc

SEQ ID NO: 464849 - RNA, 19 nt, Homo sapiens
uaccagaggcagagauguu

SEQ ID NO: 464850 - RNA, 19 nt, Homo sapiens
caaaaugaauuggcaagca

SEQ ID NO: 464851 - RNA, 19 nt, Homo sapiens
caccuucgacgagcugaua

SEQ ID NO: 464852 - RNA, 19 nt, Homo sapiens
caacauugggcagcagaug

SEQ ID NO: 464853 - RNA, 19 nt, Homo sapiens
aucaucaccuucugcauug

SEQ ID NO: 464854 - RNA, 19 nt, Homo sapiens
aaaguccugcucaacauug

SEQ ID NO: 464855 - RNA, 19 nt, Homo sapiens
ugucaucuccuuccugauc

SEQ ID NO: 464856 - RNA, 19 nt, Homo sapiens
gaccaagcucucauuuaag

SEQ ID NO: 464857 - RNA, 19 nt, Homo sapiens
ugccguugcugcugugaug

SEQ ID NO: 464858 - RNA, 19 nt, Homo sapiens
cgucaaugauaggaccaaa

SEQ ID NO: 464859 - RNA, 19 nt, Homo sapiens
cuucuagguuccauguuuc

SEQ ID NO: 464860 - RNA, 19 nt, Homo sapiens
gaggugaagaacccacaga

SEQ ID NO: 464861 - RNA, 19 nt, Homo sapiens
gucaggauuugugaaagga

SEQ ID NO: 464862 - RNA, 19 nt, Homo sapiens
ugucaggauuugugaaagg

SEQ ID NO: 464863 - RNA, 19 nt, Homo sapiens
uuccagcucugaacagcaa

SEQ ID NO: 464864 - RNA, 19 nt, Homo sapiens
gcaauuggcuuccugauuu

SEQ ID NO: 464865 - RNA, 19 nt, Homo sapiens
gaagauuagugaagaguuu

SEQ ID NO: 464866 - RNA, 19 nt, Homo sapiens
ccagaaagcuauucccauu

SEQ ID NO: 464867 - RNA, 19 nt, Homo sapiens
gcaaacagauuggucaguu

SEQ ID NO: 464868 - RNA, 19 nt, Homo sapiens
caaauuaugccgcugcuua

SEQ ID NO: 464869 - RNA, 19 nt, Homo sapiens
gaaucaagauagaaccuuu

SEQ ID NO: 464870 - RNA, 19 nt, Homo sapiens
cgggauggcuuacuguuua

SEQ ID NO: 464871 - RNA, 19 nt, Homo sapiens
acacuggucuugcagaaua

SEQ ID NO: 464872 - RNA, 19 nt, Homo sapiens
gauagaaccuuuagauguc

SEQ ID NO: 464873 - RNA, 19 nt, Homo sapiens
guggcaaacuggaagauua

SEQ ID NO: 464874 - RNA, 19 nt, Homo sapiens
caacuggaaugaagauaga

SEQ ID NO: 464875 - RNA, 19 nt, Homo sapiens
gcaucuuggugaacauuua

SEQ ID NO: 464876 - RNA, 19 nt, Homo sapiens
cuucacagcuguuaauauu

SEQ ID NO: 464877 - RNA, 19 nt, Homo sapiens
gaaugaagauagaaacaag

SEQ ID NO: 464878 - RNA, 19 nt, Homo sapiens
caauuggcuuccugauuua

SEQ ID NO: 464879 - RNA, 19 nt, Homo sapiens
gaaacuagcaacuggaaug

SEQ ID NO: 464880 - RNA, 19 nt, Homo sapiens
ggucauuucugcuuugaug

SEQ ID NO: 464881 - RNA, 19 nt, Homo sapiens
gaaaggaaauguggcaaac

SEQ ID NO: 464882 - RNA, 19 nt, Homo sapiens
caagauagaaccuuuagau

SEQ ID NO: 464883 - RNA, 19 nt, Homo sapiens
gaauuacacuggucuugca

SEQ ID NO: 464884 - RNA, 19 nt, Homo sapiens
ucuagaagacaccaaauua

SEQ ID NO: 464885 - RNA, 19 nt, Homo sapiens
ccucugcuaugccgaauuu

SEQ ID NO: 464886 - RNA, 19 nt, Homo sapiens
gaagaugcuuauccagaca

SEQ ID NO: 464887 - RNA, 19 nt, Homo sapiens
cguacuaccuccucgauga

SEQ ID NO: 464888 - RNA, 19 nt, Homo sapiens
ucacagcuguuaauauucu

SEQ ID NO: 464889 - RNA, 19 nt, Homo sapiens
uuagaugucucaccacgaa

SEQ ID NO: 464890 - RNA, 19 nt, Homo sapiens
ugaagaagaugcuuaucca

SEQ ID NO: 464891 - RNA, 19 nt, Homo sapiens
gcauuuggauggcaauugg

SEQ ID NO: 464892 - RNA, 19 nt, Homo sapiens
caguucaccuuucauauuc

SEQ ID NO: 464893 - RNA, 19 nt, Homo sapiens
gaaauguggcaaacuggaa

SEQ ID NO: 464894 - RNA, 19 nt, Homo sapiens
gaccaucacccaagaaauc

SEQ ID NO: 464895 - RNA, 19 nt, Homo sapiens
ggugaacauuuacuugaug

SEQ ID NO: 464896 - RNA, 19 nt, Homo sapiens
ugcaacaacuggugaagaa

SEQ ID NO: 464897 - RNA, 19 nt, Homo sapiens
ugaaggcgcuuguggacau

SEQ ID NO: 464898 - RNA, 19 nt, Homo sapiens
caaacuggaagauuaguga

SEQ ID NO: 464899 - RNA, 19 nt, Homo sapiens
gaacuucuuagcaaacaga

SEQ ID NO: 464900 - RNA, 19 nt, Homo sapiens
ggaguggcaccuuugauga

SEQ ID NO: 464901 - RNA, 19 nt, Homo sapiens
gauagaaacaagugguuau

SEQ ID NO: 464902 - RNA, 19 nt, Homo sapiens
ugggucagauucagcauuu

SEQ ID NO: 464903 - RNA, 19 nt, Homo sapiens
gaaacaagugguuauaacu

SEQ ID NO: 464904 - RNA, 19 nt, Homo sapiens
ggaaugaagauagaaacaa

SEQ ID NO: 464905 - RNA, 19 nt, Homo sapiens
ucaguucaccuuucauauu

SEQ ID NO: 464906 - RNA, 19 nt, Homo sapiens
uagcaggucuuuugucuuu

SEQ ID NO: 464907 - RNA, 19 nt, Homo sapiens
auagguacaucaaguguug

SEQ ID NO: 464908 - RNA, 19 nt, Homo sapiens
aaacggaacaaguaucuau

SEQ ID NO: 464909 - RNA, 19 nt, Homo sapiens
cugcauauuuguacaccua

SEQ ID NO: 464910 - RNA, 19 nt, Homo sapiens
uagaagacaccaaauuaug

SEQ ID NO: 464911 - RNA, 19 nt, Homo sapiens
gaaagcuauucccauugga

SEQ ID NO: 464912 - RNA, 19 nt, Homo sapiens
gaggacauacuucagaaug

SEQ ID NO: 464913 - RNA, 19 nt, Homo sapiens
agaaagcuauucccauugg

SEQ ID NO: 464914 - RNA, 19 nt, Homo sapiens
uugaugaacuucuuagcaa

SEQ ID NO: 464915 - RNA, 19 nt, Homo sapiens
ugucgaggguuuauuggaa

SEQ ID NO: 464916 - RNA, 19 nt, Homo sapiens
gaaaucucaguucaccuuu

SEQ ID NO: 464917 - RNA, 19 nt, Homo sapiens
ugacgucuuugcuuguuug

SEQ ID NO: 464918 - RNA, 19 nt, Homo sapiens
caaugaagaagaugcuuau

SEQ ID NO: 464919 - RNA, 19 nt, Homo sapiens
acaaugaagaagaugcuua

SEQ ID NO: 464920 - RNA, 19 nt, Homo sapiens
cgucuuugcuuguuugcuu

SEQ ID NO: 464921 - RNA, 19 nt, Homo sapiens
agaaacaagugguuauaac

SEQ ID NO: 464922 - RNA, 19 nt, Homo sapiens
gcaacuggaaugaagauag

SEQ ID NO: 464923 - RNA, 19 nt, Homo sapiens
ugaugaacuucuuagcaaa

SEQ ID NO: 464924 - RNA, 19 nt, Homo sapiens
cccaagaaaucucaguuca

SEQ ID NO: 464925 - RNA, 19 nt, Homo sapiens
agauagaaccuuuagaugu

SEQ ID NO: 464926 - RNA, 19 nt, Homo sapiens
cuuuaugccuuauggcuuu

SEQ ID NO: 464927 - RNA, 19 nt, Homo sapiens
aaucugccauucaagcaaa

SEQ ID NO: 464928 - RNA, 19 nt, Homo sapiens
uuugauggccuuucuguuu

SEQ ID NO: 464929 - RNA, 19 nt, Homo sapiens
cuucugggcucuauguuuc

SEQ ID NO: 464930 - RNA, 19 nt, Homo sapiens
ggagagcugugggccuuca

SEQ ID NO: 464931 - RNA, 19 nt, Homo sapiens
gguuauaacucagacaaac

SEQ ID NO: 464932 - RNA, 19 nt, Homo sapiens
aaggaaauguggcaaacug

SEQ ID NO: 464933 - RNA, 19 nt, Homo sapiens
ggaaucucauuuuaucgua

SEQ ID NO: 464934 - RNA, 19 nt, Homo sapiens
cuagaagacaccaaauuau

SEQ ID NO: 464935 - RNA, 19 nt, Homo sapiens
aaaaguagccuucaugguu

SEQ ID NO: 464936 - RNA, 19 nt, Homo sapiens
caacaacuggugaagaagu

SEQ ID NO: 464937 - RNA, 19 nt, Homo sapiens
ggaagauuagugaagaguu

SEQ ID NO: 464938 - RNA, 19 nt, Homo sapiens
ugugaugguugcuggguuu

SEQ ID NO: 464939 - RNA, 19 nt, Homo sapiens
aaucucaguucaccuuuca

SEQ ID NO: 464940 - RNA, 19 nt, Homo sapiens
aaaugaccaucacccaaga

SEQ ID NO: 464941 - RNA, 19 nt, Homo sapiens
gcacacucauggccuacuc

SEQ ID NO: 464942 - RNA, 19 nt, Homo sapiens
aagaggcagucaccaguug

SEQ ID NO: 464943 - RNA, 19 nt, Homo sapiens
gaugguugcuggguuugug

SEQ ID NO: 464944 - RNA, 19 nt, Homo sapiens
ugccuuauauuacuucuag

SEQ ID NO: 464945 - RNA, 19 nt, Homo sapiens
uuacacuggucuugcagaa

SEQ ID NO: 464946 - RNA, 19 nt, Homo sapiens
gugguguccuuccucauug

SEQ ID NO: 464947 - RNA, 19 nt, Homo sapiens
aacaagugguuauaacuca

SEQ ID NO: 464948 - RNA, 19 nt, Homo sapiens
ucaccaugcugcagagaca

SEQ ID NO: 464949 - RNA, 19 nt, Homo sapiens
ugaaaggaaauguggcaaa

SEQ ID NO: 464950 - RNA, 19 nt, Homo sapiens
uacaucaaguguugcaaga

SEQ ID NO: 464951 - RNA, 19 nt, Homo sapiens
cuucaucacuggcuggaau

SEQ ID NO: 464952 - RNA, 19 nt, Homo sapiens
ggcaauuggcuuccugauu

SEQ ID NO: 464953 - RNA, 19 nt, Homo sapiens
gcagacacuugggucagau

SEQ ID NO: 464954 - RNA, 19 nt, Homo sapiens
gcucucaaauuuucuauag

SEQ ID NO: 464955 - RNA, 19 nt, Homo sapiens
gaugggguccugccaaaua

SEQ ID NO: 464956 - RNA, 19 nt, Homo sapiens
cugcuugggugaauaaagu

SEQ ID NO: 464957 - RNA, 19 nt, Homo sapiens
gaguggcaccuuugaugaa

SEQ ID NO: 464958 - RNA, 19 nt, Homo sapiens
ccuggagggucaucugaga

SEQ ID NO: 464959 - RNA, 19 nt, Homo sapiens
uugauggccuuucuguuug

SEQ ID NO: 464960 - RNA, 19 nt, Homo sapiens
caagucuucugggcucuau

SEQ ID NO: 464961 - RNA, 19 nt, Homo sapiens
ucugcagcuuuaacacuua

SEQ ID NO: 464962 - RNA, 19 nt, Homo sapiens
aggacauacuucagaauga

SEQ ID NO: 464963 - RNA, 19 nt, Homo sapiens
acuaauuugucgaggguuu

SEQ ID NO: 464964 - RNA, 19 nt, Homo sapiens
ggaauguucuccucgaaua

SEQ ID NO: 464965 - RNA, 19 nt, Homo sapiens
caagggauccauaauaaua

SEQ ID NO: 464966 - RNA, 19 nt, Homo sapiens
gcccagagccuucuuguuu

SEQ ID NO: 464967 - RNA, 19 nt, Homo sapiens
cccaagggauccauaauaa

SEQ ID NO: 464968 - RNA, 19 nt, Homo sapiens
gcucaccagugucauguuu

SEQ ID NO: 464969 - RNA, 19 nt, Homo sapiens
ccuaugcuaugcagaauuu

SEQ ID NO: 464970 - RNA, 19 nt, Homo sapiens
gcagagagaguuccaguag

SEQ ID NO: 464971 - RNA, 19 nt, Homo sapiens
gaugggacuugcaguguau

SEQ ID NO: 464972 - RNA, 19 nt, Homo sapiens
cccagagccuucuuguuua

SEQ ID NO: 464973 - RNA, 19 nt, Homo sapiens
gcccaagggauccauaaua

SEQ ID NO: 464974 - RNA, 19 nt, Homo sapiens
cgggaagacuuauuucaga

SEQ ID NO: 464975 - RNA, 19 nt, Homo sapiens
ccagagccuucuuguuuau

SEQ ID NO: 464976 - RNA, 19 nt, Homo sapiens
gggcugaacuccacacacu

SEQ ID NO: 464977 - RNA, 19 nt, Homo sapiens
gggaagacuuauuucagau

SEQ ID NO: 464978 - RNA, 19 nt, Homo sapiens
uggagucgcugguucaguu

SEQ ID NO: 464979 - RNA, 19 nt, Homo sapiens
gucauucucuucauuguca

SEQ ID NO: 464980 - RNA, 19 nt, Homo sapiens
ugaugggacuugcagugua

SEQ ID NO: 464981 - RNA, 19 nt, Homo sapiens
guggcuaccuggacucuau

SEQ ID NO: 464982 - RNA, 19 nt, Homo sapiens
caggugggcuggcuucauc

SEQ ID NO: 464983 - RNA, 19 nt, Homo sapiens
gggcucaccagcaacagua

SEQ ID NO: 464984 - RNA, 19 nt, Homo sapiens
gagcaucguccucaacauc

SEQ ID NO: 464985 - RNA, 19 nt, Homo sapiens
caacuggagcgcugacgaa

SEQ ID NO: 464986 - RNA, 19 nt, Homo sapiens
ggccucagccaucaccaua

SEQ ID NO: 464987 - RNA, 19 nt, Homo sapiens
cugccuaccuguucaccua

SEQ ID NO: 464988 - RNA, 19 nt, Homo sapiens
cauauggaguagcugauca

SEQ ID NO: 464989 - RNA, 19 nt, Homo sapiens
guaucgggaagacuuauuu

SEQ ID NO: 464990 - RNA, 19 nt, Homo sapiens
gcuugucauucucuucauu

SEQ ID NO: 464991 - RNA, 19 nt, Homo sapiens
gccaucagccugcuuguca

SEQ ID NO: 464992 - RNA, 19 nt, Homo sapiens
gcacacuccuggccuacac

SEQ ID NO: 464993 - RNA, 19 nt, Homo sapiens
uaccuggacucuauguuca

SEQ ID NO: 464994 - RNA, 19 nt, Homo sapiens
agagagaguuccaguagcu

SEQ ID NO: 464995 - RNA, 19 nt, Homo sapiens
agagccuucuuguuuauga

SEQ ID NO: 464996 - RNA, 19 nt, Homo sapiens
gcugaaacuuagcuaucug

SEQ ID NO: 464997 - RNA, 19 nt, Homo sapiens
ggaagacuuauuucagauc

SEQ ID NO: 464998 - RNA, 19 nt, Homo sapiens
cgacucagcgcuugcagau

SEQ ID NO: 464999 - RNA, 19 nt, Homo sapiens
caccauaggcugcgugcuu

SEQ ID NO: 465000 - RNA, 19 nt, Homo sapiens
gcuugcagaugccuucuac

SEQ ID NO: 465001 - RNA, 19 nt, Homo sapiens
ccagugaggaggcccagaa

SEQ ID NO: 465002 - RNA, 19 nt, Homo sapiens
ccgaugggcucuucuucca

SEQ ID NO: 465003 - RNA, 19 nt, Homo sapiens
ccacagcauccgcaacuuc

SEQ ID NO: 465004 - RNA, 19 nt, Homo sapiens
gcugugggccuuccucauc

SEQ ID NO: 465005 - RNA, 19 nt, Homo sapiens
ccaagggauccauaauaau

SEQ ID NO: 465006 - RNA, 19 nt, Homo sapiens
ugccucaugcugaaacuua

SEQ ID NO: 465007 - RNA, 19 nt, Homo sapiens
ucaccagugucauguuucu

SEQ ID NO: 465008 - RNA, 19 nt, Homo sapiens
cuggagcaguggugacuug

SEQ ID NO: 465009 - RNA, 19 nt, Homo sapiens
ugacgaaggcggcuuugca

SEQ ID NO: 465010 - RNA, 19 nt, Homo sapiens
gcaacaguaucgggaagac

SEQ ID NO: 465011 - RNA, 19 nt, Homo sapiens
gcugcgugcuugucuuugg

SEQ ID NO: 465012 - RNA, 19 nt, Homo sapiens
gcagcagagcuccuucuca

SEQ ID NO: 465013 - RNA, 19 nt, Homo sapiens
gaagcugaaccgccugaag

SEQ ID NO: 465014 - RNA, 19 nt, Homo sapiens
ccagguguuugcccaugug

SEQ ID NO: 465015 - RNA, 19 nt, Homo sapiens
ccuccugcuucuaugcuuu

SEQ ID NO: 465016 - RNA, 19 nt, Homo sapiens
gcacugccuccugcuucua

SEQ ID NO: 465017 - RNA, 19 nt, Homo sapiens
gagccuucuuguuuaugau

SEQ ID NO: 465018 - RNA, 19 nt, Homo sapiens
ggacuugcaguguauuucg

SEQ ID NO: 465019 - RNA, 19 nt, Homo sapiens
ugggugcgcuucuccaucu

SEQ ID NO: 465020 - RNA, 19 nt, Homo sapiens
gcaucguccucaacaucug

SEQ ID NO: 465021 - RNA, 19 nt, Homo sapiens
ccaucucgcuugccauugc

SEQ ID NO: 465022 - RNA, 19 nt, Homo sapiens
cugcugugcucuuguccuu

SEQ ID NO: 465023 - RNA, 19 nt, Homo sapiens
cuaccuggacucuauguuc

SEQ ID NO: 465024 - RNA, 19 nt, Homo sapiens
cucaucggcuggaauguuc

SEQ ID NO: 465025 - RNA, 19 nt, Homo sapiens
gcucuucuuccagguguuu

SEQ ID NO: 465026 - RNA, 19 nt, Homo sapiens
caucagccugcuugucauu

SEQ ID NO: 465027 - RNA, 19 nt, Homo sapiens
ggcagagagaguuccagua

SEQ ID NO: 465028 - RNA, 19 nt, Homo sapiens
acaguaucgggaagacuua

SEQ ID NO: 465029 - RNA, 19 nt, Homo sapiens
ccucagccaucaccauagg

SEQ ID NO: 465030 - RNA, 19 nt, Homo sapiens
gcccuaugcuaugcagaau

SEQ ID NO: 465031 - RNA, 19 nt, Homo sapiens
gggcucugccuaccuguuc

SEQ ID NO: 465032 - RNA, 19 nt, Homo sapiens
gcugaacuccacacacuac

SEQ ID NO: 465033 - RNA, 19 nt, Homo sapiens
gcaguguauuucggcuaug

SEQ ID NO: 465034 - RNA, 19 nt, Homo sapiens
ugcaguguauuucggcuau

SEQ ID NO: 465035 - RNA, 19 nt, Homo sapiens
ccaagcagcagagcuccuu

SEQ ID NO: 465036 - RNA, 19 nt, Homo sapiens
ggccaccaguaucauugug

SEQ ID NO: 465037 - RNA, 19 nt, Homo sapiens
cagcccaagggauccauaa

SEQ ID NO: 465038 - RNA, 19 nt, Homo sapiens
acaucugccucaugcugaa

SEQ ID NO: 465039 - RNA, 19 nt, Homo sapiens
gugcuugucuuugggaacu

SEQ ID NO: 465040 - RNA, 19 nt, Homo sapiens
gcccugcugugcucuuguc

SEQ ID NO: 465041 - RNA, 19 nt, Homo sapiens
ggaccuggagucgcugguu

SEQ ID NO: 465042 - RNA, 19 nt, Homo sapiens
gaauguucuccucgaauac

SEQ ID NO: 465043 - RNA, 19 nt, Homo sapiens
caaggaagauuaagcauuu

SEQ ID NO: 465044 - RNA, 19 nt, Homo sapiens
gaagaaagcccuguuauug

SEQ ID NO: 465045 - RNA, 19 nt, Homo sapiens
ggaccaagaugaugaagaa

SEQ ID NO: 465046 - RNA, 19 nt, Homo sapiens
gaaauguuaucguuccaua

SEQ ID NO: 465047 - RNA, 19 nt, Homo sapiens
gcagaagcauccagauaaa

SEQ ID NO: 465048 - RNA, 19 nt, Homo sapiens
ggagagacaaggaagauua

SEQ ID NO: 465049 - RNA, 19 nt, Homo sapiens
ggaaaguggucaauucuca

SEQ ID NO: 465050 - RNA, 19 nt, Homo sapiens
gcagacgccuccauaggua

SEQ ID NO: 465051 - RNA, 19 nt, Homo sapiens
ugaaggaacuuaagcagaa

SEQ ID NO: 465052 - RNA, 19 nt, Homo sapiens
gcauccagauaaagaaaua

SEQ ID NO: 465053 - RNA, 19 nt, Homo sapiens
gugaggaucuggaaugaaa

SEQ ID NO: 465054 - RNA, 19 nt, Homo sapiens
ugaaggaacugugguguuu

SEQ ID NO: 465055 - RNA, 19 nt, Homo sapiens
gcauuugcgugucuucuuu

SEQ ID NO: 465056 - RNA, 19 nt, Homo sapiens
agaaagcccuguuauugaa

SEQ ID NO: 465057 - RNA, 19 nt, Homo sapiens
gggaagguuugcuuacuuu

SEQ ID NO: 465058 - RNA, 19 nt, Homo sapiens
ggagaugagugagaagaaa

SEQ ID NO: 465059 - RNA, 19 nt, Homo sapiens
gaucuggaaugaaacaguu

SEQ ID NO: 465060 - RNA, 19 nt, Homo sapiens
ccgauucucucuacuguaa

SEQ ID NO: 465061 - RNA, 19 nt, Homo sapiens
gacuggagcuggcaacauu

SEQ ID NO: 465062 - RNA, 19 nt, Homo sapiens
agaauuagcuaacuaccaa

SEQ ID NO: 465063 - RNA, 19 nt, Homo sapiens
aaaugaaacuggugaaugu

SEQ ID NO: 465064 - RNA, 19 nt, Homo sapiens
ccgcagagguggugauuug

SEQ ID NO: 465065 - RNA, 19 nt, Homo sapiens
gggaagugcugcauucaau

SEQ ID NO: 465066 - RNA, 19 nt, Homo sapiens
ggaaggagaaggaaaugaa

SEQ ID NO: 465067 - RNA, 19 nt, Homo sapiens
ucacuuaccugcugaugga

SEQ ID NO: 465068 - RNA, 19 nt, Homo sapiens
caaaugcugggucugauua

SEQ ID NO: 465069 - RNA, 19 nt, Homo sapiens
agaccuggcuucccacuuu

SEQ ID NO: 465070 - RNA, 19 nt, Homo sapiens
gaagguucaugcuagagaa

SEQ ID NO: 465071 - RNA, 19 nt, Homo sapiens
cuugguggcuucacaauaa

SEQ ID NO: 465072 - RNA, 19 nt, Homo sapiens
ucucagcaaugucaaagua

SEQ ID NO: 465073 - RNA, 19 nt, Homo sapiens
gaaaugaaacuggugaaug

SEQ ID NO: 465074 - RNA, 19 nt, Homo sapiens
ccagaaugaugaaauuguu

SEQ ID NO: 465075 - RNA, 19 nt, Homo sapiens
gaacaagggacauaucagu

SEQ ID NO: 465076 - RNA, 19 nt, Homo sapiens
ggagacaggccaucuucua

SEQ ID NO: 465077 - RNA, 19 nt, Homo sapiens
acaccuggcuuuacauuau

SEQ ID NO: 465078 - RNA, 19 nt, Homo sapiens
ucaaugggauuucaucugu

SEQ ID NO: 465079 - RNA, 19 nt, Homo sapiens
ugaauguacuggaucauau

SEQ ID NO: 465080 - RNA, 19 nt, Homo sapiens
caagaguacuguggacaaa

SEQ ID NO: 465081 - RNA, 19 nt, Homo sapiens
gaacauccgauucucucua

SEQ ID NO: 465082 - RNA, 19 nt, Homo sapiens
ggagcucgaggaaauguua

SEQ ID NO: 465083 - RNA, 19 nt, Homo sapiens
gcaugcagcugaccaagca

SEQ ID NO: 465084 - RNA, 19 nt, Homo sapiens
aaugggauuucaucuguua

SEQ ID NO: 465085 - RNA, 19 nt, Homo sapiens
agaggaaacugacauuugu

SEQ ID NO: 465086 - RNA, 19 nt, Homo sapiens
ggaagaugaugacgacgau

SEQ ID NO: 465087 - RNA, 19 nt, Homo sapiens
uggacaaacucauuaagaa

SEQ ID NO: 465088 - RNA, 19 nt, Homo sapiens
gaaaaugacccuguuagua

SEQ ID NO: 465089 - RNA, 19 nt, Homo sapiens
ggaugauuauugaacauga

SEQ ID NO: 465090 - RNA, 19 nt, Homo sapiens
ggauuucaucuguuaguua

SEQ ID NO: 465091 - RNA, 19 nt, Homo sapiens
cuauggcucuuguacauuu

SEQ ID NO: 465092 - RNA, 19 nt, Homo sapiens
gaagugcugcauucaauau

SEQ ID NO: 465093 - RNA, 19 nt, Homo sapiens
gaaggagaaggaaaugaaa

SEQ ID NO: 465094 - RNA, 19 nt, Homo sapiens
ugaagaagcuaggcgagaa

SEQ ID NO: 465095 - RNA, 19 nt, Homo sapiens
agacugaaauugaaaugga

SEQ ID NO: 465096 - RNA, 19 nt, Homo sapiens
gagacaggccaucuucuaa

SEQ ID NO: 465097 - RNA, 19 nt, Homo sapiens
ugucauaucuccugguguu

SEQ ID NO: 465098 - RNA, 19 nt, Homo sapiens
gaagugaucauugaagaau

SEQ ID NO: 465099 - RNA, 19 nt, Homo sapiens
ucauggaggugaaaguauu

SEQ ID NO: 465100 - RNA, 19 nt, Homo sapiens
gaaaucagaguggguauca

SEQ ID NO: 465101 - RNA, 19 nt, Homo sapiens
ggaagugcugcauucaaua

SEQ ID NO: 465102 - RNA, 19 nt, Homo sapiens
ggagagaccaccaagacaa

SEQ ID NO: 465103 - RNA, 19 nt, Homo sapiens
guucauguccucuauagaa

SEQ ID NO: 465104 - RNA, 19 nt, Homo sapiens
gcaacgcggugaaugucuu

SEQ ID NO: 465105 - RNA, 19 nt, Homo sapiens
gaaauggcuaggauucuga

SEQ ID NO: 465106 - RNA, 19 nt, Homo sapiens
gagagacaaggaagauuaa

SEQ ID NO: 465107 - RNA, 19 nt, Homo sapiens
gacaaacucauuaagaaga

SEQ ID NO: 465108 - RNA, 19 nt, Homo sapiens
gaagaggagaggcgcauug

SEQ ID NO: 465109 - RNA, 19 nt, Homo sapiens
caauaucagucaagguaau

SEQ ID NO: 465110 - RNA, 19 nt, Homo sapiens
aaggaacugugguguuuaa

SEQ ID NO: 465111 - RNA, 19 nt, Homo sapiens
gagaagaaagcccuguuau

SEQ ID NO: 465112 - RNA, 19 nt, Homo sapiens
ggaagccaaucauguuucu

SEQ ID NO: 465113 - RNA, 19 nt, Homo sapiens
gaaggaacugugguguuua

SEQ ID NO: 465114 - RNA, 19 nt, Homo sapiens
cuagagcuacuguguauuu

SEQ ID NO: 465115 - RNA, 19 nt, Homo sapiens
cauuugucauguucacuua

SEQ ID NO: 465116 - RNA, 19 nt, Homo sapiens
gucacucucuucaccauuu

SEQ ID NO: 465117 - RNA, 19 nt, Homo sapiens
ccauuggccugaaagauuc

SEQ ID NO: 465118 - RNA, 19 nt, Homo sapiens
agacgaauaugaugacaag

SEQ ID NO: 465119 - RNA, 19 nt, Homo sapiens
gaaccugugacucauguga

SEQ ID NO: 465120 - RNA, 19 nt, Homo sapiens
gcaaaugcugggucugauu

SEQ ID NO: 465121 - RNA, 19 nt, Homo sapiens
gaagaagcuaggcgagaaa

SEQ ID NO: 465122 - RNA, 19 nt, Homo sapiens
ggaagugucauguacaaca

SEQ ID NO: 465123 - RNA, 19 nt, Homo sapiens
acaaguaugucuacaagag

SEQ ID NO: 465124 - RNA, 19 nt, Homo sapiens
ggauaggagacuucuguuu

SEQ ID NO: 465125 - RNA, 19 nt, Homo sapiens
gaauguacuggaucauauu

SEQ ID NO: 465126 - RNA, 19 nt, Homo sapiens
ccucacauccugccucuuu

SEQ ID NO: 465127 - RNA, 19 nt, Homo sapiens
ugagaagaaagcccuguua

SEQ ID NO: 465128 - RNA, 19 nt, Homo sapiens
gugaaaguauugagaacau

SEQ ID NO: 465129 - RNA, 19 nt, Homo sapiens
aaucauguuucuacacuug

SEQ ID NO: 465130 - RNA, 19 nt, Homo sapiens
ggacaaacucauuaagaag

SEQ ID NO: 465131 - RNA, 19 nt, Homo sapiens
ucgaggaaauguuaucguu

SEQ ID NO: 465132 - RNA, 19 nt, Homo sapiens
aaucagaguggguaucaua

SEQ ID NO: 465133 - RNA, 19 nt, Homo sapiens
gaagucaucacaucucaag

SEQ ID NO: 465134 - RNA, 19 nt, Homo sapiens
cagaggaaacugacauuug

SEQ ID NO: 465135 - RNA, 19 nt, Homo sapiens
ggaagugaucauugaagaa

SEQ ID NO: 465136 - RNA, 19 nt, Homo sapiens
aagaaagcccuguuauuga

SEQ ID NO: 465137 - RNA, 19 nt, Homo sapiens
caagguaauugaugaugag

SEQ ID NO: 465138 - RNA, 19 nt, Homo sapiens
ggugauacccagaaggaaa

SEQ ID NO: 465139 - RNA, 19 nt, Homo sapiens
gauuucaucuguuaguuac

SEQ ID NO: 465140 - RNA, 19 nt, Homo sapiens
aaaaugacccuguuaguaa

SEQ ID NO: 465141 - RNA, 19 nt, Homo sapiens
ggaggccuacugccacaua

SEQ ID NO: 465142 - RNA, 19 nt, Homo sapiens
agaagaaagcccuguuauu

SEQ ID NO: 465143 - RNA, 19 nt, Homo sapiens
gaugaacacuucuuuguaa

SEQ ID NO: 465144 - RNA, 19 nt, Homo sapiens
gaagaaacaugcagcagaa

SEQ ID NO: 465145 - RNA, 19 nt, Homo sapiens
gcacagggcagaacaauga

SEQ ID NO: 465146 - RNA, 19 nt, Homo sapiens
ucagaaagcgcuccuguua

SEQ ID NO: 465147 - RNA, 19 nt, Homo sapiens
gcaauauccugaagaaaca

SEQ ID NO: 465148 - RNA, 19 nt, Homo sapiens
gacaaacaccgaggaauua

SEQ ID NO: 465149 - RNA, 19 nt, Homo sapiens
agagggaggugacaauuaa

SEQ ID NO: 465150 - RNA, 19 nt, Homo sapiens
ggagauggccaauuacuau

SEQ ID NO: 465151 - RNA, 19 nt, Homo sapiens
cauaauugaugacgacauu

SEQ ID NO: 465152 - RNA, 19 nt, Homo sapiens
cgacugcucuucuacaaau

SEQ ID NO: 465153 - RNA, 19 nt, Homo sapiens
gaaaccagcacaaccacua

SEQ ID NO: 465154 - RNA, 19 nt, Homo sapiens
gagagggaggugacaauua

SEQ ID NO: 465155 - RNA, 19 nt, Homo sapiens
agaaagcgcuccuguuauc

SEQ ID NO: 465156 - RNA, 19 nt, Homo sapiens
gacaacuggugcugcaaua

SEQ ID NO: 465157 - RNA, 19 nt, Homo sapiens
ugguggagauggccaauua

SEQ ID NO: 465158 - RNA, 19 nt, Homo sapiens
caaacuagaagucaucauu

SEQ ID NO: 465159 - RNA, 19 nt, Homo sapiens
ggaugaacacuucuuugua

SEQ ID NO: 465160 - RNA, 19 nt, Homo sapiens
gaaacggucucuggccuau

SEQ ID NO: 465161 - RNA, 19 nt, Homo sapiens
acaggaagcugacuaugga

SEQ ID NO: 465162 - RNA, 19 nt, Homo sapiens
ggaaugaaacugucuccaa

SEQ ID NO: 465163 - RNA, 19 nt, Homo sapiens
gaagcugacuauggaagaa

SEQ ID NO: 465164 - RNA, 19 nt, Homo sapiens
gaacacuucuuuguaaggu

SEQ ID NO: 465165 - RNA, 19 nt, Homo sapiens
cuacgagucuucuucauca

SEQ ID NO: 465166 - RNA, 19 nt, Homo sapiens
ccagggucauugucuauuu

SEQ ID NO: 465167 - RNA, 19 nt, Homo sapiens
aagaaggccuccagcauga

SEQ ID NO: 465168 - RNA, 19 nt, Homo sapiens
ucucaaagauucagucaca

SEQ ID NO: 465169 - RNA, 19 nt, Homo sapiens
uaagaaacccaauggagaa

SEQ ID NO: 465170 - RNA, 19 nt, Homo sapiens
gcacuucggcugcaccauu

SEQ ID NO: 465171 - RNA, 19 nt, Homo sapiens
uggacaaacugaucaagaa

SEQ ID NO: 465172 - RNA, 19 nt, Homo sapiens
auacuccucucuuuaauug

SEQ ID NO: 465173 - RNA, 19 nt, Homo sapiens
ccaagccacucguaugaug

SEQ ID NO: 465174 - RNA, 19 nt, Homo sapiens
gccuacaucuggcucuaua

SEQ ID NO: 465175 - RNA, 19 nt, Homo sapiens
guugagcaauguccgcaua

SEQ ID NO: 465176 - RNA, 19 nt, Homo sapiens
ucaaggaucugaagcaaaa

SEQ ID NO: 465177 - RNA, 19 nt, Homo sapiens
ccauuggucucaaagauuc

SEQ ID NO: 465178 - RNA, 19 nt, Homo sapiens
agacaaaccuggccuuggu

SEQ ID NO: 465179 - RNA, 19 nt, Homo sapiens
gaaacaugcagcagaacaa

SEQ ID NO: 465180 - RNA, 19 nt, Homo sapiens
agacaaacaccgaggaauu

SEQ ID NO: 465181 - RNA, 19 nt, Homo sapiens
gggaaggccuccucacucu

SEQ ID NO: 465182 - RNA, 19 nt, Homo sapiens
gcaucagcgugcucuugua

SEQ ID NO: 465183 - RNA, 19 nt, Homo sapiens
gcaggcaucuucacuuuug

SEQ ID NO: 465184 - RNA, 19 nt, Homo sapiens
ugaggaggaugaacacuuc

SEQ ID NO: 465185 - RNA, 19 nt, Homo sapiens
auaaacgacugcucuucua

SEQ ID NO: 465186 - RNA, 19 nt, Homo sapiens
gggaugaggaugaggauga

SEQ ID NO: 465187 - RNA, 19 nt, Homo sapiens
gaagaguccuaugaguuca

SEQ ID NO: 465188 - RNA, 19 nt, Homo sapiens
gaugggaaagccaguauug

SEQ ID NO: 465189 - RNA, 19 nt, Homo sapiens
ggacuuugaagacacauau

SEQ ID NO: 465190 - RNA, 19 nt, Homo sapiens
uagaucagcugguggagau

SEQ ID NO: 465191 - RNA, 19 nt, Homo sapiens
gaauuaucauagagacaga

SEQ ID NO: 465192 - RNA, 19 nt, Homo sapiens
ggagagacucgcaagauca

SEQ ID NO: 465193 - RNA, 19 nt, Homo sapiens
caacauguucaucaucauu

SEQ ID NO: 465194 - RNA, 19 nt, Homo sapiens
ggaggugacaauuaagaaa

SEQ ID NO: 465195 - RNA, 19 nt, Homo sapiens
ggaugaggaugaggaugaa

SEQ ID NO: 465196 - RNA, 19 nt, Homo sapiens
ggaggaugaacacuucuuu

SEQ ID NO: 465197 - RNA, 19 nt, Homo sapiens
ugucaaagaccauguaugu

SEQ ID NO: 465198 - RNA, 19 nt, Homo sapiens
caagguaauugaugaugag

SEQ ID NO: 465199 - RNA, 19 nt, Homo sapiens
ggagaaaccagcacaacca

SEQ ID NO: 465200 - RNA, 19 nt, Homo sapiens
uagaagucaucauugaaga

SEQ ID NO: 465201 - RNA, 19 nt, Homo sapiens
ccaagaggauagcagagau

SEQ ID NO: 465202 - RNA, 19 nt, Homo sapiens
ggccacaguuaccaucuug

SEQ ID NO: 465203 - RNA, 19 nt, Homo sapiens
ggggaugccuccagcaaua

SEQ ID NO: 465204 - RNA, 19 nt, Homo sapiens
cgaugagccugaggacuuu

SEQ ID NO: 465205 - RNA, 19 nt, Homo sapiens
gccaauuacuaugcucuuu

SEQ ID NO: 465206 - RNA, 19 nt, Homo sapiens
caucaucauuggcaucugu

SEQ ID NO: 465207 - RNA, 19 nt, Homo sapiens
caacuggugcugcaauaga

SEQ ID NO: 465208 - RNA, 19 nt, Homo sapiens
gcaacgccgucaaugucuu

SEQ ID NO: 465209 - RNA, 19 nt, Homo sapiens
ggagggaccaguucaugga

SEQ ID NO: 465210 - RNA, 19 nt, Homo sapiens
ugaagaguccuaugaguuc

SEQ ID NO: 465211 - RNA, 19 nt, Homo sapiens
caauucacaucaagguaau

SEQ ID NO: 465212 - RNA, 19 nt, Homo sapiens
gaggaugguucugccaaug

SEQ ID NO: 465213 - RNA, 19 nt, Homo sapiens
cagcagaacaagccaagaa

SEQ ID NO: 465214 - RNA, 19 nt, Homo sapiens
ucugggaccuucuaccauu

SEQ ID NO: 465215 - RNA, 19 nt, Homo sapiens
guucauugcuggugaucug

SEQ ID NO: 465216 - RNA, 19 nt, Homo sapiens
gauacuccucucuuuaauu

SEQ ID NO: 465217 - RNA, 19 nt, Homo sapiens
gaagucaucaccucucaag

SEQ ID NO: 465218 - RNA, 19 nt, Homo sapiens
acaauucacaucaagguaa

SEQ ID NO: 465219 - RNA, 19 nt, Homo sapiens
gauaaacgacugcucuucu

SEQ ID NO: 465220 - RNA, 19 nt, Homo sapiens
ggugaggacuuugaagaca

SEQ ID NO: 465221 - RNA, 19 nt, Homo sapiens
uuuccaaggucuucuuuga

SEQ ID NO: 465222 - RNA, 19 nt, Homo sapiens
aaacaccgaggaauuauca

SEQ ID NO: 465223 - RNA, 19 nt, Homo sapiens
gcagcaacgccgucaaugu

SEQ ID NO: 465224 - RNA, 19 nt, Homo sapiens
ccuaugaguucaagacuac

SEQ ID NO: 465225 - RNA, 19 nt, Homo sapiens
uaauugaugaugaggcaua

SEQ ID NO: 465226 - RNA, 19 nt, Homo sapiens
gagagacccagaaggaguu

SEQ ID NO: 465227 - RNA, 19 nt, Homo sapiens
caggagagacccagaagga

SEQ ID NO: 465228 - RNA, 19 nt, Homo sapiens
gagugcagccuucaacaug

SEQ ID NO: 465229 - RNA, 19 nt, Homo sapiens
aaacuagaagucaucauug

SEQ ID NO: 465230 - RNA, 19 nt, Homo sapiens
ggaagcugacuauggaaga

SEQ ID NO: 465231 - RNA, 19 nt, Homo sapiens
gugcagccuucaacauguu

SEQ ID NO: 465232 - RNA, 19 nt, Homo sapiens
gcugcaagcucgccacaac

SEQ ID NO: 465233 - RNA, 19 nt, Homo sapiens
agacuacgguggacaaacu

SEQ ID NO: 465234 - RNA, 19 nt, Homo sapiens
aacuagaagucaucauuga

SEQ ID NO: 465235 - RNA, 19 nt, Homo sapiens
ccucugccuuccuccauuu

SEQ ID NO: 465236 - RNA, 19 nt, Homo sapiens
ggcaauauccugaagaaac

SEQ ID NO: 465237 - RNA, 19 nt, Homo sapiens
cagagaaggacuuagauca

SEQ ID NO: 465238 - RNA, 19 nt, Homo sapiens
cuaagggcauugagaugga

SEQ ID NO: 465239 - RNA, 19 nt, Homo sapiens
ggacaacuggugcugcaau

SEQ ID NO: 465240 - RNA, 19 nt, Homo sapiens
gacaaacugaucaagaaga

SEQ ID NO: 465241 - RNA, 19 nt, Homo sapiens
gcaugguggauaugaguuu

SEQ ID NO: 465242 - RNA, 19 nt, Homo sapiens
gaugaugaggcauaugaga

SEQ ID NO: 465243 - RNA, 19 nt, Homo sapiens
gaugaacacuucuuuguaa

SEQ ID NO: 465244 - RNA, 19 nt, Homo sapiens
gaagaaacaugcagcagaa

SEQ ID NO: 465245 - RNA, 19 nt, Homo sapiens
gcacagggcagaacaauga

SEQ ID NO: 465246 - RNA, 19 nt, Homo sapiens
gcaauauccugaagaaaca

SEQ ID NO: 465247 - RNA, 19 nt, Homo sapiens
gauggaacguggaauauca

SEQ ID NO: 465248 - RNA, 19 nt, Homo sapiens
gacaaacaccgaggaauua

SEQ ID NO: 465249 - RNA, 19 nt, Homo sapiens
agagggaggugacaauuaa

SEQ ID NO: 465250 - RNA, 19 nt, Homo sapiens
ggagauggccaauuacuau

SEQ ID NO: 465251 - RNA, 19 nt, Homo sapiens
cauaauugaugacgacauu

SEQ ID NO: 465252 - RNA, 19 nt, Homo sapiens
cgacugcucuucuacaaau

SEQ ID NO: 465253 - RNA, 19 nt, Homo sapiens
gaaaccagcacaaccacua

SEQ ID NO: 465254 - RNA, 19 nt, Homo sapiens
gagagggaggugacaauua

SEQ ID NO: 465255 - RNA, 19 nt, Homo sapiens
gacaacuggugcugcaaua

SEQ ID NO: 465256 - RNA, 19 nt, Homo sapiens
ugguggagauggccaauua

SEQ ID NO: 465257 - RNA, 19 nt, Homo sapiens
caaacuagaagucaucauu

SEQ ID NO: 465258 - RNA, 19 nt, Homo sapiens
ggaugaacacuucuuugua

SEQ ID NO: 465259 - RNA, 19 nt, Homo sapiens
gaaacggucucuggccuau

SEQ ID NO: 465260 - RNA, 19 nt, Homo sapiens
acaggaagcugacuaugga

SEQ ID NO: 465261 - RNA, 19 nt, Homo sapiens
uaucagcgcuccuguuauc

SEQ ID NO: 465262 - RNA, 19 nt, Homo sapiens
ggaaugaaacugucuccaa

SEQ ID NO: 465263 - RNA, 19 nt, Homo sapiens
gaagcugacuauggaagaa

SEQ ID NO: 465264 - RNA, 19 nt, Homo sapiens
gaacacuucuuuguaaggu

SEQ ID NO: 465265 - RNA, 19 nt, Homo sapiens
cuacgagucuucuucauca

SEQ ID NO: 465266 - RNA, 19 nt, Homo sapiens
ccagggucauugucuauuu

SEQ ID NO: 465267 - RNA, 19 nt, Homo sapiens
aagaaggccuccagcauga

SEQ ID NO: 465268 - RNA, 19 nt, Homo sapiens
ucucaaagauucagucaca

SEQ ID NO: 465269 - RNA, 19 nt, Homo sapiens
uaagaaacccaauggagaa

SEQ ID NO: 465270 - RNA, 19 nt, Homo sapiens
gcacuucggcugcaccauu

SEQ ID NO: 465271 - RNA, 19 nt, Homo sapiens
uggacaaacugaucaagaa

SEQ ID NO: 465272 - RNA, 19 nt, Homo sapiens
auacuccucucuuuaauug

SEQ ID NO: 465273 - RNA, 19 nt, Homo sapiens
ccaagccacucguaugaug

SEQ ID NO: 465274 - RNA, 19 nt, Homo sapiens
gccuacaucuggcucuaua

SEQ ID NO: 465275 - RNA, 19 nt, Homo sapiens
aauaucagcgcuccuguua

SEQ ID NO: 465276 - RNA, 19 nt, Homo sapiens
guugagcaauguccgcaua

SEQ ID NO: 465277 - RNA, 19 nt, Homo sapiens
ucaaggaucugaagcaaaa

SEQ ID NO: 465278 - RNA, 19 nt, Homo sapiens
ccauuggucucaaagauuc

SEQ ID NO: 465279 - RNA, 19 nt, Homo sapiens
agacaaaccuggccuuggu

SEQ ID NO: 465280 - RNA, 19 nt, Homo sapiens
gaaacaugcagcagaacaa

SEQ ID NO: 465281 - RNA, 19 nt, Homo sapiens
agacaaacaccgaggaauu

SEQ ID NO: 465282 - RNA, 19 nt, Homo sapiens
gggaaggccuccucacucu

SEQ ID NO: 465283 - RNA, 19 nt, Homo sapiens
gcaucagcgugcucuugua

SEQ ID NO: 465284 - RNA, 19 nt, Homo sapiens
gcaggcaucuucacuuuug

SEQ ID NO: 465285 - RNA, 19 nt, Homo sapiens
ugaggaggaugaacacuuc

SEQ ID NO: 465286 - RNA, 19 nt, Homo sapiens
auaaacgacugcucuucua

SEQ ID NO: 465287 - RNA, 19 nt, Homo sapiens
gggaugaggaugaggauga

SEQ ID NO: 465288 - RNA, 19 nt, Homo sapiens
gaagaguccuaugaguuca

SEQ ID NO: 465289 - RNA, 19 nt, Homo sapiens
gaugggaaagccaguauug

SEQ ID NO: 465290 - RNA, 19 nt, Homo sapiens
ggacuuugaagacacauau

SEQ ID NO: 465291 - RNA, 19 nt, Homo sapiens
uagaucagcugguggagau

SEQ ID NO: 465292 - RNA, 19 nt, Homo sapiens
gaauuaucauagagacaga

SEQ ID NO: 465293 - RNA, 19 nt, Homo sapiens
ggagagacucgcaagauca

SEQ ID NO: 465294 - RNA, 19 nt, Homo sapiens
caacauguucaucaucauu

SEQ ID NO: 465295 - RNA, 19 nt, Homo sapiens
ggaggugacaauuaagaaa

SEQ ID NO: 465296 - RNA, 19 nt, Homo sapiens
ggaugaggaugaggaugaa

SEQ ID NO: 465297 - RNA, 19 nt, Homo sapiens
ggaggaugaacacuucuuu

SEQ ID NO: 465298 - RNA, 19 nt, Homo sapiens
ugucaaagaccauguaugu

SEQ ID NO: 465299 - RNA, 19 nt, Homo sapiens
ggagaaaccagcacaacca

SEQ ID NO: 465300 - RNA, 19 nt, Homo sapiens
uagaagucaucauugaaga

SEQ ID NO: 465301 - RNA, 19 nt, Homo sapiens
ccaagaggauagcagagau

SEQ ID NO: 465302 - RNA, 19 nt, Homo sapiens
aauaguagaugaggaggaa

SEQ ID NO: 465303 - RNA, 19 nt, Homo sapiens
ggccacaguuaccaucuug

SEQ ID NO: 465304 - RNA, 19 nt, Homo sapiens
ggggaugccuccagcaaua

SEQ ID NO: 465305 - RNA, 19 nt, Homo sapiens
cgaugagccugaggacuuu

SEQ ID NO: 465306 - RNA, 19 nt, Homo sapiens
gccaauuacuaugcucuuu

SEQ ID NO: 465307 - RNA, 19 nt, Homo sapiens
caacuggugcugcaauaga

SEQ ID NO: 465308 - RNA, 19 nt, Homo sapiens
caucaucauuggcaucugu

SEQ ID NO: 465309 - RNA, 19 nt, Homo sapiens
gcaacgccgucaaugucuu

SEQ ID NO: 465310 - RNA, 19 nt, Homo sapiens
ggagggaccaguucaugga

SEQ ID NO: 465311 - RNA, 19 nt, Homo sapiens
ugaagaguccuaugaguuc

SEQ ID NO: 465312 - RNA, 19 nt, Homo sapiens
gaggaugguucugccaaug

SEQ ID NO: 465313 - RNA, 19 nt, Homo sapiens
cagcagaacaagccaagaa

SEQ ID NO: 465314 - RNA, 19 nt, Homo sapiens
ucugggaccuucuaccauu

SEQ ID NO: 465315 - RNA, 19 nt, Homo sapiens
guucauugcuggugaucug

SEQ ID NO: 465316 - RNA, 19 nt, Homo sapiens
gauacuccucucuuuaauu

SEQ ID NO: 465317 - RNA, 19 nt, Homo sapiens
gaagucaucaccucucaag

SEQ ID NO: 465318 - RNA, 19 nt, Homo sapiens
gaauaucagcgcuccuguu

SEQ ID NO: 465319 - RNA, 19 nt, Homo sapiens
gauaaacgacugcucuucu

SEQ ID NO: 465320 - RNA, 19 nt, Homo sapiens
ggugaggacuuugaagaca

SEQ ID NO: 465321 - RNA, 19 nt, Homo sapiens
uuuccaaggucuucuuuga

SEQ ID NO: 465322 - RNA, 19 nt, Homo sapiens
aaacaccgaggaauuauca

SEQ ID NO: 465323 - RNA, 19 nt, Homo sapiens
gcagcaacgccgucaaugu

SEQ ID NO: 465324 - RNA, 19 nt, Homo sapiens
ccuaugaguucaagacuac

SEQ ID NO: 465325 - RNA, 19 nt, Homo sapiens
gagagacccagaaggaguu

SEQ ID NO: 465326 - RNA, 19 nt, Homo sapiens
caggagagacccagaagga

SEQ ID NO: 465327 - RNA, 19 nt, Homo sapiens
gagugcagccuucaacaug

SEQ ID NO: 465328 - RNA, 19 nt, Homo sapiens
aaacuagaagucaucauug

SEQ ID NO: 465329 - RNA, 19 nt, Homo sapiens
ggaagcugacuauggaaga

SEQ ID NO: 465330 - RNA, 19 nt, Homo sapiens
acgaaaggcaagagaauuu

SEQ ID NO: 465331 - RNA, 19 nt, Homo sapiens
gugcagccuucaacauguu

SEQ ID NO: 465332 - RNA, 19 nt, Homo sapiens
gcugcaagcucgccacaac

SEQ ID NO: 465333 - RNA, 19 nt, Homo sapiens
agacuacgguggacaaacu

SEQ ID NO: 465334 - RNA, 19 nt, Homo sapiens
aacuagaagucaucauuga

SEQ ID NO: 465335 - RNA, 19 nt, Homo sapiens
ccucugccuuccuccauuu

SEQ ID NO: 465336 - RNA, 19 nt, Homo sapiens
ggcaauauccugaagaaac

SEQ ID NO: 465337 - RNA, 19 nt, Homo sapiens
cagagaaggacuuagauca

SEQ ID NO: 465338 - RNA, 19 nt, Homo sapiens
cuaagggcauugagaugga

SEQ ID NO: 465339 - RNA, 19 nt, Homo sapiens
ggacaacuggugcugcaau

SEQ ID NO: 465340 - RNA, 19 nt, Homo sapiens
gacaaacugaucaagaaga

SEQ ID NO: 465341 - RNA, 19 nt, Homo sapiens
gcaauauucaacagucuuc

SEQ ID NO: 465342 - RNA, 19 nt, Homo sapiens
uggccuggguggcagauaa

SEQ ID NO: 465343 - RNA, 19 nt, Homo sapiens
gaagauagguuuccaugug

SEQ ID NO: 465344 - RNA, 19 nt, Homo sapiens
gaacagugcucugccucua

SEQ ID NO: 465345 - RNA, 19 nt, Homo sapiens
agaaauaugugaagaagug

SEQ ID NO: 465346 - RNA, 19 nt, Homo sapiens
caucaucacugucaucuuc

SEQ ID NO: 465347 - RNA, 19 nt, Homo sapiens
gaauuacccuuccucaucu

SEQ ID NO: 465348 - RNA, 19 nt, Homo sapiens
ucaaugagcugcugcacau

SEQ ID NO: 465349 - RNA, 19 nt, Homo sapiens
gaagagauccacacacagu

SEQ ID NO: 465350 - RNA, 19 nt, Homo sapiens
gaacuggaccuucgucauc

SEQ ID NO: 465351 - RNA, 19 nt, Homo sapiens
gcugggcucuuaacuguug

SEQ ID NO: 465352 - RNA, 19 nt, Homo sapiens
gugaagaagugucugauag

SEQ ID NO: 465353 - RNA, 19 nt, Homo sapiens
gaucuucccuuccuuacuc

SEQ ID NO: 465354 - RNA, 19 nt, Homo sapiens
gaaguaacucccacuccua

SEQ ID NO: 465355 - RNA, 19 nt, Homo sapiens
cgaagacugugacaucaga

SEQ ID NO: 465356 - RNA, 19 nt, Homo sapiens
ggccguggcuccagaaugu

SEQ ID NO: 465357 - RNA, 19 nt, Homo sapiens
gcugaagggcaaagucuua

SEQ ID NO: 465358 - RNA, 19 nt, Homo sapiens
ggccugaccugguucauca

SEQ ID NO: 465359 - RNA, 19 nt, Homo sapiens
gccuucaccucccgauuua

SEQ ID NO: 465360 - RNA, 19 nt, Homo sapiens
gguccuguaucaccucuuu

SEQ ID NO: 465361 - RNA, 19 nt, Homo sapiens
gggaguccuugcucaauga

SEQ ID NO: 465362 - RNA, 19 nt, Homo sapiens
aagcucaaccgguuuaaua

SEQ ID NO: 465363 - RNA, 19 nt, Homo sapiens
ugacgugacucagagcuuu

SEQ ID NO: 465364 - RNA, 19 nt, Homo sapiens
gagcugaggccucccuuga

SEQ ID NO: 465365 - RNA, 19 nt, Homo sapiens
cuacauggccuacuuguca

SEQ ID NO: 465366 - RNA, 19 nt, Homo sapiens
agaccaaucuuaguuucua

SEQ ID NO: 465367 - RNA, 19 nt, Homo sapiens
ggaaaugccucucuaaaac

SEQ ID NO: 465368 - RNA, 19 nt, Homo sapiens
caaccgguuuaauaagaaa

SEQ ID NO: 465369 - RNA, 19 nt, Homo sapiens
ucacugugguccuguauca

SEQ ID NO: 465370 - RNA, 19 nt, Homo sapiens
agcagaagaucaacaacua

SEQ ID NO: 465371 - RNA, 19 nt, Homo sapiens
ggcaaagucuuaggguuga

SEQ ID NO: 465372 - RNA, 19 nt, Homo sapiens
gaagaagugucugauagcu

SEQ ID NO: 465373 - RNA, 19 nt, Homo sapiens
gacaagcucaaccgguuua

SEQ ID NO: 465374 - RNA, 19 nt, Homo sapiens
gccaacaucucccacaagu

SEQ ID NO: 465375 - RNA, 19 nt, Homo sapiens
cuaccuaugugcccgguuu

SEQ ID NO: 465376 - RNA, 19 nt, Homo sapiens
ugacaucgacaaccacgua

SEQ ID NO: 465377 - RNA, 19 nt, Homo sapiens
aggaacaacuugcagaaga

SEQ ID NO: 465378 - RNA, 19 nt, Homo sapiens
gaaaaccccuggcugaaca

SEQ ID NO: 465379 - RNA, 19 nt, Homo sapiens
ugaggaaauucacaucaau

SEQ ID NO: 465380 - RNA, 19 nt, Homo sapiens
aagauagguuuccauguga

SEQ ID NO: 465381 - RNA, 19 nt, Homo sapiens
gaaccuuucccuugugugu

SEQ ID NO: 465382 - RNA, 19 nt, Homo sapiens
ucacugccaucaucacugu

SEQ ID NO: 465383 - RNA, 19 nt, Homo sapiens
cacagaugcuggccucuug

SEQ ID NO: 465384 - RNA, 19 nt, Homo sapiens
gcugaggccucccuugagu

SEQ ID NO: 465385 - RNA, 19 nt, Homo sapiens
cagacccacuggccuauga

SEQ ID NO: 465386 - RNA, 19 nt, Homo sapiens
ggaacaacuugcagaagac

SEQ ID NO: 465387 - RNA, 19 nt, Homo sapiens
ucaaccgguuuaauaagaa

SEQ ID NO: 465388 - RNA, 19 nt, Homo sapiens
ggacaagcucaaccgguuu

SEQ ID NO: 465389 - RNA, 19 nt, Homo sapiens
ccauggaaaugccucucua

SEQ ID NO: 465390 - RNA, 19 nt, Homo sapiens
gggcugagggcaucucuga

SEQ ID NO: 465391 - RNA, 19 nt, Homo sapiens
acgaagagauccacacaca

SEQ ID NO: 465392 - RNA, 19 nt, Homo sapiens
gcggugagcagaucaacaa

SEQ ID NO: 465393 - RNA, 19 nt, Homo sapiens
gcucgaagacugugacauc

SEQ ID NO: 465394 - RNA, 19 nt, Homo sapiens
ccuguuggcugugaagaaa

SEQ ID NO: 465395 - RNA, 19 nt, Homo sapiens
gcgagacccucaucuucau

SEQ ID NO: 465396 - RNA, 19 nt, Homo sapiens
gugagcagaucaacaacau

SEQ ID NO: 465397 - RNA, 19 nt, Homo sapiens
cagccuuccuucuuccuuu

SEQ ID NO: 465398 - RNA, 19 nt, Homo sapiens
ugaccugguucaucaacaa

SEQ ID NO: 465399 - RNA, 19 nt, Homo sapiens
cugcugggcucuuaacugu

SEQ ID NO: 465400 - RNA, 19 nt, Homo sapiens
agaauuacccuuccucauc

SEQ ID NO: 465401 - RNA, 19 nt, Homo sapiens
aguaggcccugcuuuauca

SEQ ID NO: 465402 - RNA, 19 nt, Homo sapiens
gagccgggauccugcaaag

SEQ ID NO: 465403 - RNA, 19 nt, Homo sapiens
cuguggaccuggugaauga

SEQ ID NO: 465404 - RNA, 19 nt, Homo sapiens
gaagcgcuccaucaacgaa

SEQ ID NO: 465405 - RNA, 19 nt, Homo sapiens
guagaccuguuggcuguga

SEQ ID NO: 465406 - RNA, 19 nt, Homo sapiens
ugacaggcaucgaagacau

SEQ ID NO: 465407 - RNA, 19 nt, Homo sapiens
gcaccauccugaucuuugc

SEQ ID NO: 465408 - RNA, 19 nt, Homo sapiens
cuucuggccugccucauga

SEQ ID NO: 465409 - RNA, 19 nt, Homo sapiens
gggcucaguuucccacauc

SEQ ID NO: 465410 - RNA, 19 nt, Homo sapiens
guacagaagaaacugaauc

SEQ ID NO: 465411 - RNA, 19 nt, Homo sapiens
acacuccuauauaugauug

SEQ ID NO: 465412 - RNA, 19 nt, Homo sapiens
gaggaaauucacaucaaug

SEQ ID NO: 465413 - RNA, 19 nt, Homo sapiens
uccagaaugugcugccuuu

SEQ ID NO: 465414 - RNA, 19 nt, Homo sapiens
ucagaccaaucuuaguuuc

SEQ ID NO: 465415 - RNA, 19 nt, Homo sapiens
agacaucuguggccacuac

SEQ ID NO: 465416 - RNA, 19 nt, Homo sapiens
caacgaagagauccacaca

SEQ ID NO: 465417 - RNA, 19 nt, Homo sapiens
acaccaccaucaaauacuu

SEQ ID NO: 465418 - RNA, 19 nt, Homo sapiens
uccucacacuccagaauua

SEQ ID NO: 465419 - RNA, 19 nt, Homo sapiens
gcccggaguuccagaccuu

SEQ ID NO: 465420 - RNA, 19 nt, Homo sapiens
uugaguaggcccugcuuua

SEQ ID NO: 465421 - RNA, 19 nt, Homo sapiens
cucaaccgguuuaauaaga

SEQ ID NO: 465422 - RNA, 19 nt, Homo sapiens
gcaguccgacgucuucuuc

SEQ ID NO: 465423 - RNA, 19 nt, Homo sapiens
uaacucccacuccuaauca

SEQ ID NO: 465424 - RNA, 19 nt, Homo sapiens
gacugugacaucagaagua

SEQ ID NO: 465425 - RNA, 19 nt, Homo sapiens
agacgaagcgcuccaucaa

SEQ ID NO: 465426 - RNA, 19 nt, Homo sapiens
gugcagggcaugaccauuc

SEQ ID NO: 465427 - RNA, 19 nt, Homo sapiens
gcuaccuccuggacaagaa

SEQ ID NO: 465428 - RNA, 19 nt, Homo sapiens
caaguuccguaucgugaag

SEQ ID NO: 465429 - RNA, 19 nt, Homo sapiens
gcugguggauugggcagaa

SEQ ID NO: 465430 - RNA, 19 nt, Homo sapiens
ggacucacccaccaugucu

SEQ ID NO: 465431 - RNA, 19 nt, Homo sapiens
gagcagaagaucaacaacu

SEQ ID NO: 465432 - RNA, 19 nt, Homo sapiens
ugccagcacuguccaagga

SEQ ID NO: 465433 - RNA, 19 nt, Homo sapiens
gagacgaagcgcuccauca

SEQ ID NO: 465434 - RNA, 19 nt, Homo sapiens
gcugacccuuugcuaccua

SEQ ID NO: 465435 - RNA, 19 nt, Homo sapiens
gcaagggugacaucgacaa

SEQ ID NO: 465436 - RNA, 19 nt, Homo sapiens
ucacacuccuauauaugau

SEQ ID NO: 465437 - RNA, 19 nt, Homo sapiens
ggacaaggaggaggagauc

SEQ ID NO: 465438 - RNA, 19 nt, Homo sapiens
acagcuacauggccuacuu

SEQ ID NO: 465439 - RNA, 19 nt, Homo sapiens
ccacucugcugccuguaca

SEQ ID NO: 465440 - RNA, 19 nt, Homo sapiens
acugugacaucagaaguaa

SEQ ID NO: 465441 - RNA, 19 nt, Homo sapiens
gacagugacgugacucaga

SEQ ID NO: 465442 - RNA, 19 nt, Homo sapiens
guuccucacugccaucauc

SEQ ID NO: 465443 - RNA, 19 nt, Homo sapiens
caucacagcugaaauguuu

SEQ ID NO: 465444 - RNA, 19 nt, Homo sapiens
ccugagagcugccuucuua

SEQ ID NO: 465445 - RNA, 19 nt, Homo sapiens
caaccaaagucaaguauug

SEQ ID NO: 465446 - RNA, 19 nt, Homo sapiens
gagagucccugcugaauga

SEQ ID NO: 465447 - RNA, 19 nt, Homo sapiens
ggaccaccgugcucaauuu

SEQ ID NO: 465448 - RNA, 19 nt, Homo sapiens
gagacaaguuuaagaaguu

SEQ ID NO: 465449 - RNA, 19 nt, Homo sapiens
cgacacaguuugcgagaaa

SEQ ID NO: 465450 - RNA, 19 nt, Homo sapiens
gucaagagguccaauaaga

SEQ ID NO: 465451 - RNA, 19 nt, Homo sapiens
gaggaggacuauuucuauu

SEQ ID NO: 465452 - RNA, 19 nt, Homo sapiens
ggagagacaaguuuaagaa

SEQ ID NO: 465453 - RNA, 19 nt, Homo sapiens
gaauaaguacguagaagaa

SEQ ID NO: 465454 - RNA, 19 nt, Homo sapiens
gagagcugccuucuuauaa

SEQ ID NO: 465455 - RNA, 19 nt, Homo sapiens
ggagugagaagccuuaaga

SEQ ID NO: 465456 - RNA, 19 nt, Homo sapiens
uaaguacugucccuacauu

SEQ ID NO: 465457 - RNA, 19 nt, Homo sapiens
gagcugccuucuuauaaug

SEQ ID NO: 465458 - RNA, 19 nt, Homo sapiens
acacagggcuuccacuuca

SEQ ID NO: 465459 - RNA, 19 nt, Homo sapiens
acaacaagcugucagugaa

SEQ ID NO: 465460 - RNA, 19 nt, Homo sapiens
agaaugagguagauguuga

SEQ ID NO: 465461 - RNA, 19 nt, Homo sapiens
gaacacagggcuuccacuu

SEQ ID NO: 465462 - RNA, 19 nt, Homo sapiens
gagaaagcauuaggaagga

SEQ ID NO: 465463 - RNA, 19 nt, Homo sapiens
gcagagacugggaugauaa

SEQ ID NO: 465464 - RNA, 19 nt, Homo sapiens
caagagguccaauaagaaa

SEQ ID NO: 465465 - RNA, 19 nt, Homo sapiens
uauaaugguuggacuucua

SEQ ID NO: 465466 - RNA, 19 nt, Homo sapiens
caaaagaggaggacuauuu

SEQ ID NO: 465467 - RNA, 19 nt, Homo sapiens
gugagaagccuuaagagaa

SEQ ID NO: 465468 - RNA, 19 nt, Homo sapiens
gugcaaugacuaugaauaa

SEQ ID NO: 465469 - RNA, 19 nt, Homo sapiens
ccaaggagauucugauucg

SEQ ID NO: 465470 - RNA, 19 nt, Homo sapiens
gaaauucgagaacucuuau

SEQ ID NO: 465471 - RNA, 19 nt, Homo sapiens
gauaaguacugucccuaca

SEQ ID NO: 465472 - RNA, 19 nt, Homo sapiens
gaagaaugagguagauguu

SEQ ID NO: 465473 - RNA, 19 nt, Homo sapiens
ggcagagacugggaugaua

SEQ ID NO: 465474 - RNA, 19 nt, Homo sapiens
caaugaagacugauguauu

SEQ ID NO: 465475 - RNA, 19 nt, Homo sapiens
ugagaagccuuaagagaag

SEQ ID NO: 465476 - RNA, 19 nt, Homo sapiens
ugagguagauguugauucu

SEQ ID NO: 465477 - RNA, 19 nt, Homo sapiens
ggaagaaugagguagaugu

SEQ ID NO: 465478 - RNA, 19 nt, Homo sapiens
gagacugggaugauaagua

SEQ ID NO: 465479 - RNA, 19 nt, Homo sapiens
guagggacacuuuggaauu

SEQ ID NO: 465480 - RNA, 19 nt, Homo sapiens
gcugaaugaugcaguaaca

SEQ ID NO: 465481 - RNA, 19 nt, Homo sapiens
ugaaauucgagaacucuua

SEQ ID NO: 465482 - RNA, 19 nt, Homo sapiens
ggaggacuauuucuauugc

SEQ ID NO: 465483 - RNA, 19 nt, Homo sapiens
gcaaugacuaugaauaagu

SEQ ID NO: 465484 - RNA, 19 nt, Homo sapiens
ugagaccauugauguguuu

SEQ ID NO: 465485 - RNA, 19 nt, Homo sapiens
gagaacauuggcacgauuu

SEQ ID NO: 465486 - RNA, 19 nt, Homo sapiens
ugagagcugccuucuuaua

SEQ ID NO: 465487 - RNA, 19 nt, Homo sapiens
ggaauggaagaaugaggua

SEQ ID NO: 465488 - RNA, 19 nt, Homo sapiens
ugugaagacuggaauugaa

SEQ ID NO: 465489 - RNA, 19 nt, Homo sapiens
gcaaugaagacugauguau

SEQ ID NO: 465490 - RNA, 19 nt, Homo sapiens
ucugaaaccugaugcaaca

SEQ ID NO: 465491 - RNA, 19 nt, Homo sapiens
ggaauuccauuggcauugg

SEQ ID NO: 465492 - RNA, 19 nt, Homo sapiens
agacuggaauugaagaugu

SEQ ID NO: 465493 - RNA, 19 nt, Homo sapiens
caggacagcugugguuugu

SEQ ID NO: 465494 - RNA, 19 nt, Homo sapiens
auacgaagcuuccagaaaa

SEQ ID NO: 465495 - RNA, 19 nt, Homo sapiens
ccacuucaaccucccgaua

SEQ ID NO: 465496 - RNA, 19 nt, Homo sapiens
uugcaucucuaaaugauug

SEQ ID NO: 465497 - RNA, 19 nt, Homo sapiens
agacugggaugauaaguac

SEQ ID NO: 465498 - RNA, 19 nt, Homo sapiens
gaugucaagagguccaaua

SEQ ID NO: 465499 - RNA, 19 nt, Homo sapiens
acacgaccaucaaguacuu

SEQ ID NO: 465500 - RNA, 19 nt, Homo sapiens
cuacaucacagcugaaaug

SEQ ID NO: 465501 - RNA, 19 nt, Homo sapiens
ggagagucccugcugaaug

SEQ ID NO: 465502 - RNA, 19 nt, Homo sapiens
gagacaagccaaggagauu

SEQ ID NO: 465503 - RNA, 19 nt, Homo sapiens
cgacacaagugagagacaa

SEQ ID NO: 465504 - RNA, 19 nt, Homo sapiens
uaucacaaguugcccacaa

SEQ ID NO: 465505 - RNA, 19 nt, Homo sapiens
gaaaucuauugucgguugu

SEQ ID NO: 465506 - RNA, 19 nt, Homo sapiens
gaaacaacaagcugucagu

SEQ ID NO: 465507 - RNA, 19 nt, Homo sapiens
ucaagagguccaauaagaa

SEQ ID NO: 465508 - RNA, 19 nt, Homo sapiens
cuacucgauucacccauaa

SEQ ID NO: 465509 - RNA, 19 nt, Homo sapiens
ugagaacauuggcacgauu

SEQ ID NO: 465510 - RNA, 19 nt, Homo sapiens
cuacuaggugggauuauuu

SEQ ID NO: 465511 - RNA, 19 nt, Homo sapiens
gcaauagcagcgacucaga

SEQ ID NO: 465512 - RNA, 19 nt, Homo sapiens
agaaaucucuaucaaaucc

SEQ ID NO: 465513 - RNA, 19 nt, Homo sapiens
agagacaaguuuaagaagu

SEQ ID NO: 465514 - RNA, 19 nt, Homo sapiens
aaucacugcuugugcaaug

SEQ ID NO: 465515 - RNA, 19 nt, Homo sapiens
ugagaacauucacgucaau

SEQ ID NO: 465516 - RNA, 19 nt, Homo sapiens
uauuacggcugccauuguu

SEQ ID NO: 465517 - RNA, 19 nt, Homo sapiens
ugaauaaguacguagaaga

SEQ ID NO: 465518 - RNA, 19 nt, Homo sapiens
ucacaaguugcccacaaua

SEQ ID NO: 465519 - RNA, 19 nt, Homo sapiens
cagaaaagcuacaaaagag

SEQ ID NO: 465520 - RNA, 19 nt, Homo sapiens
ugaaacugaugaaauucga

SEQ ID NO: 465521 - RNA, 19 nt, Homo sapiens
cuaaaugauugucgugaag

SEQ ID NO: 465522 - RNA, 19 nt, Homo sapiens
guacguagaagaaaaugua

SEQ ID NO: 465523 - RNA, 19 nt, Homo sapiens
aggaaucgccaacuucuuu

SEQ ID NO: 465524 - RNA, 19 nt, Homo sapiens
ucuaaaugauugucgugaa

SEQ ID NO: 465525 - RNA, 19 nt, Homo sapiens
gacuggaauugaagauguu

SEQ ID NO: 465526 - RNA, 19 nt, Homo sapiens
aaaccuugaucuucaucuu

SEQ ID NO: 465527 - RNA, 19 nt, Homo sapiens
gaaggacagcagcuugaau

SEQ ID NO: 465528 - RNA, 19 nt, Homo sapiens
caaguugcccacaauagug

SEQ ID NO: 465529 - RNA, 19 nt, Homo sapiens
guucaucauugccuaugga

SEQ ID NO: 465530 - RNA, 19 nt, Homo sapiens
acuacucgauucacccaua

SEQ ID NO: 465531 - RNA, 19 nt, Homo sapiens
ccauugagaccauugaugu

SEQ ID NO: 465532 - RNA, 19 nt, Homo sapiens
ccaucuguaucacaaguug

SEQ ID NO: 465533 - RNA, 19 nt, Homo sapiens
ugaggcaaauccgaagaaa

SEQ ID NO: 465534 - RNA, 19 nt, Homo sapiens
ggagggcgacagauucaug

SEQ ID NO: 465535 - RNA, 19 nt, Homo sapiens
agagcugccuucuuauaau

SEQ ID NO: 465536 - RNA, 19 nt, Homo sapiens
ggaaggacagcagcuugaa

SEQ ID NO: 465537 - RNA, 19 nt, Homo sapiens
ucuacuaggugggauuauu

SEQ ID NO: 465538 - RNA, 19 nt, Homo sapiens
aaaugauugucgugaagaa

SEQ ID NO: 465539 - RNA, 19 nt, Homo sapiens
gcgaaaccuugaucuucau

SEQ ID NO: 465540 - RNA, 19 nt, Homo sapiens
gacuaugaauaaguacgua

SEQ ID NO: 465541 - RNA, 19 nt, Homo sapiens
uagggacacuuuggaauuc

SEQ ID NO: 465542 - RNA, 19 nt, Homo sapiens
ccagacgucaggcuuacua

SEQ ID NO: 465543 - RNA, 19 nt, Homo sapiens
ggacagaucgggcacaauu

SEQ ID NO: 465544 - RNA, 19 nt, Homo sapiens
ggacauauccggacagauc

SEQ ID NO: 465545 - RNA, 19 nt, Homo sapiens
gagacaaggucaaggagaa

SEQ ID NO: 465546 - RNA, 19 nt, Homo sapiens
gcgcagaauuucaccauca

SEQ ID NO: 465547 - RNA, 19 nt, Homo sapiens
gcacgcagauucccuacuc

SEQ ID NO: 465548 - RNA, 19 nt, Homo sapiens
ggagaaagacuuggaacuu

SEQ ID NO: 465549 - RNA, 19 nt, Homo sapiens
gggagucgcugcugaacga

SEQ ID NO: 465550 - RNA, 19 nt, Homo sapiens
ggaagcgccuggaguccuu

SEQ ID NO: 465551 - RNA, 19 nt, Homo sapiens
ggagagcccugcgcagaau

SEQ ID NO: 465552 - RNA, 19 nt, Homo sapiens
caacuaugaugaggagaug

SEQ ID NO: 465553 - RNA, 19 nt, Homo sapiens
gagaccggauccugaaugu

SEQ ID NO: 465554 - RNA, 19 nt, Homo sapiens
gaggacauauccggacaga

SEQ ID NO: 465555 - RNA, 19 nt, Homo sapiens
ccacaucgcguccuucaca

SEQ ID NO: 465556 - RNA, 19 nt, Homo sapiens
gacagaucgggcacaauua

SEQ ID NO: 465557 - RNA, 19 nt, Homo sapiens
ggaauugacaacccugugu

SEQ ID NO: 465558 - RNA, 19 nt, Homo sapiens
gaaacaggaccgggaaauc

SEQ ID NO: 465559 - RNA, 19 nt, Homo sapiens
gcaccaccaucaucguagu

SEQ ID NO: 465560 - RNA, 19 nt, Homo sapiens
gggcauaguguccuucuuc

SEQ ID NO: 465561 - RNA, 19 nt, Homo sapiens
ucaacgagguccuguucau

SEQ ID NO: 465562 - RNA, 19 nt, Homo sapiens
gaauugacaacccuguguu

SEQ ID NO: 465563 - RNA, 19 nt, Homo sapiens
ccacggaggacgagaaaca

SEQ ID NO: 465564 - RNA, 19 nt, Homo sapiens
caauguguuugaaucuuuc

SEQ ID NO: 465565 - RNA, 19 nt, Homo sapiens
gaccggauccugaaugucu

SEQ ID NO: 465566 - RNA, 19 nt, Homo sapiens
ucaccaagcaugugcguau

SEQ ID NO: 465567 - RNA, 19 nt, Homo sapiens
ucaaggagaagaaccuguu

SEQ ID NO: 465568 - RNA, 19 nt, Homo sapiens
ucaccgugguucuguacaa

SEQ ID NO: 465569 - RNA, 19 nt, Homo sapiens
agauugggcugcuggacuu

SEQ ID NO: 465570 - RNA, 19 nt, Homo sapiens
gcccagaagcggagaaaca

SEQ ID NO: 465571 - RNA, 19 nt, Homo sapiens
guucuucaccgucaucuuc

SEQ ID NO: 465572 - RNA, 19 nt, Homo sapiens
cagcaccaccaucaucgua

SEQ ID NO: 465573 - RNA, 19 nt, Homo sapiens
gaccaucaucuucauguuc

SEQ ID NO: 465574 - RNA, 19 nt, Homo sapiens
gagaccaucaucuucaugu

SEQ ID NO: 465575 - RNA, 19 nt, Homo sapiens
gggcucaaccagaacaaga

SEQ ID NO: 465576 - RNA, 19 nt, Homo sapiens
uguacaauguguuugaauc

SEQ ID NO: 465577 - RNA, 19 nt, Homo sapiens
uccacgagcugaaccugaa

SEQ ID NO: 465578 - RNA, 19 nt, Homo sapiens
ugcaguggcugaaggugaa

SEQ ID NO: 465579 - RNA, 19 nt, Homo sapiens
guacaauguguuugaaucu

SEQ ID NO: 465580 - RNA, 19 nt, Homo sapiens
aaacaggaccgggaaaucu

SEQ ID NO: 465581 - RNA, 19 nt, Homo sapiens
gagaaacaggaccgggaaa

SEQ ID NO: 465582 - RNA, 19 nt, Homo sapiens
cagcaggguccucaugaga

SEQ ID NO: 465583 - RNA, 19 nt, Homo sapiens
acagaucgggcacaauuau

SEQ ID NO: 465584 - RNA, 19 nt, Homo sapiens
gcaggaucccuacgucauc

SEQ ID NO: 465585 - RNA, 19 nt, Homo sapiens
uggcuagugucaccaagga

SEQ ID NO: 465586 - RNA, 19 nt, Homo sapiens
gaccacaucgcguccuuca

SEQ ID NO: 465587 - RNA, 19 nt, Homo sapiens
ggucccacuucgacaggaa

SEQ ID NO: 465588 - RNA, 19 nt, Homo sapiens
gcgccgagaccaucaucuu

SEQ ID NO: 465589 - RNA, 19 nt, Homo sapiens
ccaccgucuucuucuucua

SEQ ID NO: 465590 - RNA, 19 nt, Homo sapiens
cgacuccccugcaggaauu

SEQ ID NO: 465591 - RNA, 19 nt, Homo sapiens
ccaccaucaucguaguguu

SEQ ID NO: 465592 - RNA, 19 nt, Homo sapiens
gcuggacuuccuccuguuu

SEQ ID NO: 465593 - RNA, 19 nt, Homo sapiens
agaccaucaucuucauguu

SEQ ID NO: 465594 - RNA, 19 nt, Homo sapiens
cgcagaauuucaccaucaa

SEQ ID NO: 465595 - RNA, 19 nt, Homo sapiens
gccgagaccaucaucuuca

SEQ ID NO: 465596 - RNA, 19 nt, Homo sapiens
ggacugcgugaagggcaua

SEQ ID NO: 465597 - RNA, 19 nt, Homo sapiens
ucgaguuccuggcuagugu

SEQ ID NO: 465598 - RNA, 19 nt, Homo sapiens
gcaccgacaacguggucaa

SEQ ID NO: 465599 - RNA, 19 nt, Homo sapiens
ccaagcaugugcguaucau

SEQ ID NO: 465600 - RNA, 19 nt, Homo sapiens
gugguucuguacaaugugu

SEQ ID NO: 465601 - RNA, 19 nt, Homo sapiens
gcagucaccgugguucugu

SEQ ID NO: 465602 - RNA, 19 nt, Homo sapiens
gguuccaccugucccacaa

SEQ ID NO: 465603 - RNA, 19 nt, Homo sapiens
accacacgcuacagcagua

SEQ ID NO: 465604 - RNA, 19 nt, Homo sapiens
gcugucagaaguaugugaa

SEQ ID NO: 465605 - RNA, 19 nt, Homo sapiens
gcccaaccgccucuucuuc

SEQ ID NO: 465606 - RNA, 19 nt, Homo sapiens
ccgugguucuguacaaugu

SEQ ID NO: 465607 - RNA, 19 nt, Homo sapiens
ccaacuaugaugaggagau

SEQ ID NO: 465608 - RNA, 19 nt, Homo sapiens
gcccacggaggacgagaaa

SEQ ID NO: 465609 - RNA, 19 nt, Homo sapiens
cgagaccggauccugaaug

SEQ ID NO: 465610 - RNA, 19 nt, Homo sapiens
caacgagguccuguucauc

SEQ ID NO: 465611 - RNA, 19 nt, Homo sapiens
cgggcacaauuaucucaga

SEQ ID NO: 465612 - RNA, 19 nt, Homo sapiens
gcuucuggauggagacaag

SEQ ID NO: 465613 - RNA, 19 nt, Homo sapiens
gggaaccucggcucaacga

SEQ ID NO: 465614 - RNA, 19 nt, Homo sapiens
ccgagaccaucaucuucau

SEQ ID NO: 465615 - RNA, 19 nt, Homo sapiens
gcacaacugucaaauauac

SEQ ID NO: 465616 - RNA, 19 nt, Homo sapiens
guagagcccucgaaacuug

SEQ ID NO: 465617 - RNA, 19 nt, Homo sapiens
ucaaauggcugaaggugaa

SEQ ID NO: 465618 - RNA, 19 nt, Homo sapiens
gcaagagcaucauuccuau

SEQ ID NO: 465619 - RNA, 19 nt, Homo sapiens
ggacaagauugaccaagug

SEQ ID NO: 465620 - RNA, 19 nt, Homo sapiens
guucaggccuguugcuuaa

SEQ ID NO: 465621 - RNA, 19 nt, Homo sapiens
caacaucucccauaaguca

SEQ ID NO: 465622 - RNA, 19 nt, Homo sapiens
ccagugagguucuccaaga

SEQ ID NO: 465623 - RNA, 19 nt, Homo sapiens
gcaggugauugacacagua

SEQ ID NO: 465624 - RNA, 19 nt, Homo sapiens
gugcagggcuugaccauca

SEQ ID NO: 465625 - RNA, 19 nt, Homo sapiens
gccacuuucuguuucauua

SEQ ID NO: 465626 - RNA, 19 nt, Homo sapiens
gagaugggcucugccaaug

SEQ ID NO: 465627 - RNA, 19 nt, Homo sapiens
ggacucaggcuauuucaug

SEQ ID NO: 465628 - RNA, 19 nt, Homo sapiens
gggagcaguuugacaagaa

SEQ ID NO: 465629 - RNA, 19 nt, Homo sapiens
acgcacaacugucaaauau

SEQ ID NO: 465630 - RNA, 19 nt, Homo sapiens
gagcaucauuccuauucuu

SEQ ID NO: 465631 - RNA, 19 nt, Homo sapiens
gccaacaucucccauaagu

SEQ ID NO: 465632 - RNA, 19 nt, Homo sapiens
ggucuaagucuaaaccuuu

SEQ ID NO: 465633 - RNA, 19 nt, Homo sapiens
ggccuggguugaaguagua

SEQ ID NO: 465634 - RNA, 19 nt, Homo sapiens
ucaagccacuggucaaaug

SEQ ID NO: 465635 - RNA, 19 nt, Homo sapiens
gguggcaggugacuuucua

SEQ ID NO: 465636 - RNA, 19 nt, Homo sapiens
ggagcaguuugacaagaaa

SEQ ID NO: 465637 - RNA, 19 nt, Homo sapiens
cuagcaggcuguucuuuga

SEQ ID NO: 465638 - RNA, 19 nt, Homo sapiens
ucaccugucucggaaagua

SEQ ID NO: 465639 - RNA, 19 nt, Homo sapiens
cuaccucacugcugaaaug

SEQ ID NO: 465640 - RNA, 19 nt, Homo sapiens
gcaaagcaagagcaucauu

SEQ ID NO: 465641 - RNA, 19 nt, Homo sapiens
gaugggcucugccaaugug

SEQ ID NO: 465642 - RNA, 19 nt, Homo sapiens
gagagcugccugcugauuu

SEQ ID NO: 465643 - RNA, 19 nt, Homo sapiens
gagcgacaguucagagaca

SEQ ID NO: 465644 - RNA, 19 nt, Homo sapiens
aaaaggagcuccccuggaa

SEQ ID NO: 465645 - RNA, 19 nt, Homo sapiens
ccgaagagcccacccagaa

SEQ ID NO: 465646 - RNA, 19 nt, Homo sapiens
gcgagucccugcucaacga

SEQ ID NO: 465647 - RNA, 19 nt, Homo sapiens
ccucugggcugccauguca

SEQ ID NO: 465648 - RNA, 19 nt, Homo sapiens
gcucugggucuaagucuaa

SEQ ID NO: 465649 - RNA, 19 nt, Homo sapiens
gguaauauuuccuccuuuu

SEQ ID NO: 465650 - RNA, 19 nt, Homo sapiens
ggccugggcuguaagaagu

SEQ ID NO: 465651 - RNA, 19 nt, Homo sapiens
gaucugggauguguacuac

SEQ ID NO: 465652 - RNA, 19 nt, Homo sapiens
gcuguucuuugacaacuug

SEQ ID NO: 465653 - RNA, 19 nt, Homo sapiens
ggacaggugggagcaguuu

SEQ ID NO: 465654 - RNA, 19 nt, Homo sapiens
ggagaugggcucugccaau

SEQ ID NO: 465655 - RNA, 19 nt, Homo sapiens
gaaccucugccuccacuuc

SEQ ID NO: 465656 - RNA, 19 nt, Homo sapiens
guaauugggcuuccuugga

SEQ ID NO: 465657 - RNA, 19 nt, Homo sapiens
agaccugggugcugaauca

SEQ ID NO: 465658 - RNA, 19 nt, Homo sapiens
guaccuugaaccuaagaua

SEQ ID NO: 465659 - RNA, 19 nt, Homo sapiens
cagagaaggaggacgauga

SEQ ID NO: 465660 - RNA, 19 nt, Homo sapiens
guucagagacagagaagga

SEQ ID NO: 465661 - RNA, 19 nt, Homo sapiens
gaaggaugguguggcgaau

SEQ ID NO: 465662 - RNA, 19 nt, Homo sapiens
ccucaccuaugccguggua

SEQ ID NO: 465663 - RNA, 19 nt, Homo sapiens
uauuaaccguggagucuga

SEQ ID NO: 465664 - RNA, 19 nt, Homo sapiens
gauauuaaccguggagucu

SEQ ID NO: 465665 - RNA, 19 nt, Homo sapiens
caaagcaagagcaucauuc

SEQ ID NO: 465666 - RNA, 19 nt, Homo sapiens
gccguggacucuucuaagu

SEQ ID NO: 465667 - RNA, 19 nt, Homo sapiens
aggccaacaucucccauaa

SEQ ID NO: 465668 - RNA, 19 nt, Homo sapiens
ggugcaggcuggcuuacug

SEQ ID NO: 465669 - RNA, 19 nt, Homo sapiens
ggugggagcaguuugacaa

SEQ ID NO: 465670 - RNA, 19 nt, Homo sapiens
ggccuuugcucucgucauc

SEQ ID NO: 465671 - RNA, 19 nt, Homo sapiens
ccaaugugcaggccacuga

SEQ ID NO: 465672 - RNA, 19 nt, Homo sapiens
caggguggcaggugacuuu

SEQ ID NO: 465673 - RNA, 19 nt, Homo sapiens
cagggccacugcuccauug

SEQ ID NO: 465674 - RNA, 19 nt, Homo sapiens
gauugugccuguggacaug

SEQ ID NO: 465675 - RNA, 19 nt, Homo sapiens
cagcugcagucgccacuuc

SEQ ID NO: 465676 - RNA, 19 nt, Homo sapiens
gaggccacgucuugucuuc

SEQ ID NO: 465677 - RNA, 19 nt, Homo sapiens
gcugagaccgugaucuuca

SEQ ID NO: 465678 - RNA, 19 nt, Homo sapiens
ccuugaaccuaagauauau

SEQ ID NO: 465679 - RNA, 19 nt, Homo sapiens
ggguaauauuuccuccuuu

SEQ ID NO: 465680 - RNA, 19 nt, Homo sapiens
gcaggcuguucuuugacaa

SEQ ID NO: 465681 - RNA, 19 nt, Homo sapiens
cagaagggccuggguugaa

SEQ ID NO: 465682 - RNA, 19 nt, Homo sapiens
ggguagagcccucgaaacu

SEQ ID NO: 465683 - RNA, 19 nt, Homo sapiens
cgaaugcugaggcuacaaa

SEQ ID NO: 465684 - RNA, 19 nt, Homo sapiens
gccgugggcuuagucuuug

SEQ ID NO: 465685 - RNA, 19 nt, Homo sapiens
gaggugcacgucaaugaga

SEQ ID NO: 465686 - RNA, 19 nt, Homo sapiens
ccgcaaagcaagagcauca

SEQ ID NO: 465687 - RNA, 19 nt, Homo sapiens
accaggagcugcaugaaca

SEQ ID NO: 465688 - RNA, 19 nt, Homo sapiens
gaaccaggagcugcaugaa

SEQ ID NO: 465689 - RNA, 19 nt, Homo sapiens
gaggccaacaucucccaua

SEQ ID NO: 465690 - RNA, 19 nt, Homo sapiens
ggaaccagagcaucucauc

SEQ ID NO: 465691 - RNA, 19 nt, Homo sapiens
uggacaagauugaccaagu

SEQ ID NO: 465692 - RNA, 19 nt, Homo sapiens
ucucagccguggacucuuc

SEQ ID NO: 465693 - RNA, 19 nt, Homo sapiens
ucccauaagucacgcacaa

SEQ ID NO: 465694 - RNA, 19 nt, Homo sapiens
uggaaugccuucacaacag

SEQ ID NO: 465695 - RNA, 19 nt, Homo sapiens
cagcaccugcccuguguuu

SEQ ID NO: 465696 - RNA, 19 nt, Homo sapiens
agcaagagcaucauuccua

SEQ ID NO: 465697 - RNA, 19 nt, Homo sapiens
gagagcgacaguucagaga

SEQ ID NO: 465698 - RNA, 19 nt, Homo sapiens
ugccaaggacuacuuugua

SEQ ID NO: 465699 - RNA, 19 nt, Homo sapiens
ccaagaaagcugaguacca

SEQ ID NO: 465700 - RNA, 19 nt, Homo sapiens
gggucuaagucuaaaccuu

SEQ ID NO: 465701 - RNA, 19 nt, Homo sapiens
caagagcaucauuccuauu

SEQ ID NO: 465702 - RNA, 19 nt, Homo sapiens
ucggaaaccaccaagauug

SEQ ID NO: 465703 - RNA, 19 nt, Homo sapiens
ccaccaagcacaacaucug

SEQ ID NO: 465704 - RNA, 19 nt, Homo sapiens
cggcuggaguccuuuaagu

SEQ ID NO: 465705 - RNA, 19 nt, Homo sapiens
ggagcugcaugaacacacu

SEQ ID NO: 465706 - RNA, 19 nt, Homo sapiens
gugcugagaccgugaucuu

SEQ ID NO: 465707 - RNA, 19 nt, Homo sapiens
gucaccaccugcaacauuc

SEQ ID NO: 465708 - RNA, 19 nt, Homo sapiens
gggccaggcuucaguucag

SEQ ID NO: 465709 - RNA, 19 nt, Homo sapiens
ccacuuucuguuucauuaa

SEQ ID NO: 465710 - RNA, 19 nt, Homo sapiens
guaggcacacucuggaaug

SEQ ID NO: 465711 - RNA, 19 nt, Homo sapiens
ggaaaccaccaagauugug

SEQ ID NO: 465712 - RNA, 19 nt, Homo sapiens
ggaggagagcgacaguuca

SEQ ID NO: 465713 - RNA, 19 nt, Homo sapiens
ugaagaggagugagcauca

SEQ ID NO: 465714 - RNA, 19 nt, Homo sapiens
caucaagccacuggucaaa

SEQ ID NO: 465715 - RNA, 19 nt, Homo sapiens
cacaagugcuguagaauua

SEQ ID NO: 465716 - RNA, 19 nt, Homo sapiens
gaucaaggcucacuuaugg

SEQ ID NO: 465717 - RNA, 19 nt, Homo sapiens
gagggaaccuguccaaugu

SEQ ID NO: 465718 - RNA, 19 nt, Homo sapiens
caaaucccauuccaaguuu

SEQ ID NO: 465719 - RNA, 19 nt, Homo sapiens
gcucacaagugcuguagaa

SEQ ID NO: 465720 - RNA, 19 nt, Homo sapiens
uuaaagacuuguucaguga

SEQ ID NO: 465721 - RNA, 19 nt, Homo sapiens
caagaucaaggcucacuua

SEQ ID NO: 465722 - RNA, 19 nt, Homo sapiens
gggaagagcaucauguuug

SEQ ID NO: 465723 - RNA, 19 nt, Homo sapiens
caagugcuguagaauuaaa

SEQ ID NO: 465724 - RNA, 19 nt, Homo sapiens
ggaaauggcaccuacaaag

SEQ ID NO: 465725 - RNA, 19 nt, Homo sapiens
agaaauaaaugcucacaag

SEQ ID NO: 465726 - RNA, 19 nt, Homo sapiens
gacaugaaccucagcauug

SEQ ID NO: 465727 - RNA, 19 nt, Homo sapiens
ggacaugaaccucagcauu

SEQ ID NO: 465728 - RNA, 19 nt, Homo sapiens
ggagggaaccuguccaaug

SEQ ID NO: 465729 - RNA, 19 nt, Homo sapiens
ucaagacucccaaggauaa

SEQ ID NO: 465730 - RNA, 19 nt, Homo sapiens
ggacaaggugcccuauaaa

SEQ ID NO: 465731 - RNA, 19 nt, Homo sapiens
ggagucagccggagaacaa

SEQ ID NO: 465732 - RNA, 19 nt, Homo sapiens
ccaaaucccauuccaaguu

SEQ ID NO: 465733 - RNA, 19 nt, Homo sapiens
ucacucaauuccugaacua

SEQ ID NO: 465734 - RNA, 19 nt, Homo sapiens
gcaagaacugcacaagaaa

SEQ ID NO: 465735 - RNA, 19 nt, Homo sapiens
ggaagagcaucauguuugc

SEQ ID NO: 465736 - RNA, 19 nt, Homo sapiens
agcaagaacugcacaagaa

SEQ ID NO: 465737 - RNA, 19 nt, Homo sapiens
aggacaaggugcccuauaa

SEQ ID NO: 465738 - RNA, 19 nt, Homo sapiens
caagaagccucaccuaucc

SEQ ID NO: 465739 - RNA, 19 nt, Homo sapiens
gaaauaaaugcucacaagu

SEQ ID NO: 465740 - RNA, 19 nt, Homo sapiens
ucucauuccuugcaccaua

SEQ ID NO: 465741 - RNA, 19 nt, Homo sapiens
cuacacagcugccacaacu

SEQ ID NO: 465742 - RNA, 19 nt, Homo sapiens
gaaccuguccaaugucuuc

SEQ ID NO: 465743 - RNA, 19 nt, Homo sapiens
ucacaagugcuguagaauu

SEQ ID NO: 465744 - RNA, 19 nt, Homo sapiens
ccaagaagccucaccuauc

SEQ ID NO: 465745 - RNA, 19 nt, Homo sapiens
ccaaagcaauucugaaagc

SEQ ID NO: 465746 - RNA, 19 nt, Homo sapiens
gaaauggcaccuacaaagg

SEQ ID NO: 465747 - RNA, 19 nt, Homo sapiens
gagucuuucuccagcauuu

SEQ ID NO: 465748 - RNA, 19 nt, Homo sapiens
cuauaaaggcaucgugaua

SEQ ID NO: 465749 - RNA, 19 nt, Homo sapiens
gcuguagaauuaaacuuca

SEQ ID NO: 465750 - RNA, 19 nt, Homo sapiens
guacaucuaucagaaucau

SEQ ID NO: 465751 - RNA, 19 nt, Homo sapiens
gaaagccagugugguaaac

SEQ ID NO: 465752 - RNA, 19 nt, Homo sapiens
caaauacccaaaucccauu

SEQ ID NO: 465753 - RNA, 19 nt, Homo sapiens
ucugaaagccaguguggua

SEQ ID NO: 465754 - RNA, 19 nt, Homo sapiens
aaauaaaugcucacaagug

SEQ ID NO: 465755 - RNA, 19 nt, Homo sapiens
ugccacaacugaagaaaca

SEQ ID NO: 465756 - RNA, 19 nt, Homo sapiens
ugacaccacucuugauugc

SEQ ID NO: 465757 - RNA, 19 nt, Homo sapiens
gacuguaaacucuaugaaa

SEQ ID NO: 465758 - RNA, 19 nt, Homo sapiens
ccuccucccugaugccuuu

SEQ ID NO: 465759 - RNA, 19 nt, Homo sapiens
gaaccucagcauugugaug

SEQ ID NO: 465760 - RNA, 19 nt, Homo sapiens
gcucucuucugccucaaug

SEQ ID NO: 465761 - RNA, 19 nt, Homo sapiens
ccauagggaucguccucaa

SEQ ID NO: 465762 - RNA, 19 nt, Homo sapiens
caacuuagaauuugcuacu

SEQ ID NO: 465763 - RNA, 19 nt, Homo sapiens
uccaguacaucuaucagaa

SEQ ID NO: 465764 - RNA, 19 nt, Homo sapiens
caugacaccacucuugauu

SEQ ID NO: 465765 - RNA, 19 nt, Homo sapiens
auaaaggcaucgugauauc

SEQ ID NO: 465766 - RNA, 19 nt, Homo sapiens
gaaaccagaaaccgaaucu

SEQ ID NO: 465767 - RNA, 19 nt, Homo sapiens
acacagcugccacaacuga

SEQ ID NO: 465768 - RNA, 19 nt, Homo sapiens
ucuccucauugccauauuu

SEQ ID NO: 465769 - RNA, 19 nt, Homo sapiens
caaacggccacaauacaug

SEQ ID NO: 465770 - RNA, 19 nt, Homo sapiens
aauccaaacggccacaaua

SEQ ID NO: 465771 - RNA, 19 nt, Homo sapiens
uauaaaggcaucgugauau

SEQ ID NO: 465772 - RNA, 19 nt, Homo sapiens
uuacucaaauacccaaauc

SEQ ID NO: 465773 - RNA, 19 nt, Homo sapiens
gcugggaucucuaaaagug

SEQ ID NO: 465774 - RNA, 19 nt, Homo sapiens
caguacaucuaucagaauc

SEQ ID NO: 465775 - RNA, 19 nt, Homo sapiens
aagccagugugguaaacua

SEQ ID NO: 465776 - RNA, 19 nt, Homo sapiens
gggaaauggcaccuacaaa

SEQ ID NO: 465777 - RNA, 19 nt, Homo sapiens
gagacuggaugccaaaaug

SEQ ID NO: 465778 - RNA, 19 nt, Homo sapiens
gacaaggugcccuauaaag

SEQ ID NO: 465779 - RNA, 19 nt, Homo sapiens
gggaaccuguccaaugucu

SEQ ID NO: 465780 - RNA, 19 nt, Homo sapiens
ucaaggcucacuuauggaa

SEQ ID NO: 465781 - RNA, 19 nt, Homo sapiens
cagcaagaacugcacaaga

SEQ ID NO: 465782 - RNA, 19 nt, Homo sapiens
gcauuuccaguacaucuau

SEQ ID NO: 465783 - RNA, 19 nt, Homo sapiens
guuccaccauccucaaugu

SEQ ID NO: 465784 - RNA, 19 nt, Homo sapiens
caucuuaaagucacucaau

SEQ ID NO: 465785 - RNA, 19 nt, Homo sapiens
ucccaaagcaauucugaaa

SEQ ID NO: 465786 - RNA, 19 nt, Homo sapiens
caggagcucugggaaaugg

SEQ ID NO: 465787 - RNA, 19 nt, Homo sapiens
ccaaacggccacaauacau

SEQ ID NO: 465788 - RNA, 19 nt, Homo sapiens
ugaaagccagugugguaaa

SEQ ID NO: 465789 - RNA, 19 nt, Homo sapiens
ugaugccucuccuccugua

SEQ ID NO: 465790 - RNA, 19 nt, Homo sapiens
gaaggcauccagcaagaac

SEQ ID NO: 465791 - RNA, 19 nt, Homo sapiens
gagaaauaaaugcucacaa

SEQ ID NO: 465792 - RNA, 19 nt, Homo sapiens
gccaugacaccacucuuga

SEQ ID NO: 465793 - RNA, 19 nt, Homo sapiens
guuuaacccauuacucaaa

SEQ ID NO: 465794 - RNA, 19 nt, Homo sapiens
gaaaccgaaucugccucuu

SEQ ID NO: 465795 - RNA, 19 nt, Homo sapiens
acaccagucuugccugagu

SEQ ID NO: 465796 - RNA, 19 nt, Homo sapiens
acaguucucucugccauca

SEQ ID NO: 465797 - RNA, 19 nt, Homo sapiens
acaugaaccucagcauugu

SEQ ID NO: 465798 - RNA, 19 nt, Homo sapiens
ccauggaguucagcaagau

SEQ ID NO: 465799 - RNA, 19 nt, Homo sapiens
aaaccgaaucugccucuug

SEQ ID NO: 465800 - RNA, 19 nt, Homo sapiens
acuguaaacucuaugaaac

SEQ ID NO: 465801 - RNA, 19 nt, Homo sapiens
ggcacaguauggcaucaug

SEQ ID NO: 465802 - RNA, 19 nt, Homo sapiens
cucaauuccugaacuaauc

SEQ ID NO: 465803 - RNA, 19 nt, Homo sapiens
ggauucuggucccaaagca

SEQ ID NO: 465804 - RNA, 19 nt, Homo sapiens
cauccucaauguggccuuu

SEQ ID NO: 465805 - RNA, 19 nt, Homo sapiens
ccacaacugaagaaacaau

SEQ ID NO: 465806 - RNA, 19 nt, Homo sapiens
ccacaauacaugcgcuaug

SEQ ID NO: 465807 - RNA, 19 nt, Homo sapiens
ccuggauucuggucccaaa

SEQ ID NO: 465808 - RNA, 19 nt, Homo sapiens
gaucguccucaaauccaaa

SEQ ID NO: 465809 - RNA, 19 nt, Homo sapiens
auucaagacucccaaggau

SEQ ID NO: 465810 - RNA, 19 nt, Homo sapiens
caacgcgucugccccauuc

SEQ ID NO: 465811 - RNA, 19 nt, Homo sapiens
uaaaggcaucgugauauca

SEQ ID NO: 465812 - RNA, 19 nt, Homo sapiens
ccagugugguaaacuagag

SEQ ID NO: 465813 - RNA, 19 nt, Homo sapiens
cauagggaucguccucaaa

SEQ ID NO: 465814 - RNA, 19 nt, Homo sapiens
gauaucacugguccugguu

SEQ ID NO: 465815 - RNA, 19 nt, Homo sapiens
caacuuagcucuuccagua

SEQ ID NO: 465816 - RNA, 19 nt, Homo sapiens
cauccuagcuuuauuguuu

SEQ ID NO: 465817 - RNA, 19 nt, Homo sapiens
gaaaauaacucaucaagug

SEQ ID NO: 465818 - RNA, 19 nt, Homo sapiens
gaacuccucuuguaauuuc

SEQ ID NO: 465819 - RNA, 19 nt, Homo sapiens
ggacuuggcuuucuuacau

SEQ ID NO: 465820 - RNA, 19 nt, Homo sapiens
gguacagacuuccuucuua

SEQ ID NO: 465821 - RNA, 19 nt, Homo sapiens
gaucaggaaaugaguauua

SEQ ID NO: 465822 - RNA, 19 nt, Homo sapiens
ggaggaauauuguaccaaa

SEQ ID NO: 465823 - RNA, 19 nt, Homo sapiens
gaacucaacuuagcucuuc

SEQ ID NO: 465824 - RNA, 19 nt, Homo sapiens
gagaacuccucuuguaauu

SEQ ID NO: 465825 - RNA, 19 nt, Homo sapiens
ccuauaagauucuguacua

SEQ ID NO: 465826 - RNA, 19 nt, Homo sapiens
ccuauaagauucuguacua

SEQ ID NO: 465827 - RNA, 19 nt, Homo sapiens
ggaaaugggagaacaauau

SEQ ID NO: 465828 - RNA, 19 nt, Homo sapiens
aaacugacauccuagcuuu

SEQ ID NO: 465829 - RNA, 19 nt, Homo sapiens
ucgaggacauuaaacauua

SEQ ID NO: 465830 - RNA, 19 nt, Homo sapiens
uauauggcaugguucauua

SEQ ID NO: 465831 - RNA, 19 nt, Homo sapiens
gaucauugcucccaaacug

SEQ ID NO: 465832 - RNA, 19 nt, Homo sapiens
ccugagaacuccucuugua

SEQ ID NO: 465833 - RNA, 19 nt, Homo sapiens
ggaacaggaacucaacuua

SEQ ID NO: 465834 - RNA, 19 nt, Homo sapiens
acagacgaguuccaaauua

SEQ ID NO: 465835 - RNA, 19 nt, Homo sapiens
caaagcgccuggaucauug

SEQ ID NO: 465836 - RNA, 19 nt, Homo sapiens
gaacagcuguguggacaau

SEQ ID NO: 465837 - RNA, 19 nt, Homo sapiens
caccaaaacugaauucuua

SEQ ID NO: 465838 - RNA, 19 nt, Homo sapiens
gcucauagcugugguugga

SEQ ID NO: 465839 - RNA, 19 nt, Homo sapiens
gaacaucuuucacugacau

SEQ ID NO: 465840 - RNA, 19 nt, Homo sapiens
gaacggagccagagucauc

SEQ ID NO: 465841 - RNA, 19 nt, Homo sapiens
ggaacugccuccaauaucu

SEQ ID NO: 465842 - RNA, 19 nt, Homo sapiens
gacaccaagugacauauuu

SEQ ID NO: 465843 - RNA, 19 nt, Homo sapiens
ucaauaacauccuaagugu

SEQ ID NO: 465844 - RNA, 19 nt, Homo sapiens
guacagacuuccuucuuag

SEQ ID NO: 465845 - RNA, 19 nt, Homo sapiens
gaugcaggcucuuaacuca

SEQ ID NO: 465846 - RNA, 19 nt, Homo sapiens
gaacaggaacucaacuuag

SEQ ID NO: 465847 - RNA, 19 nt, Homo sapiens
ggaaaugaguauuaaacag

SEQ ID NO: 465848 - RNA, 19 nt, Homo sapiens
ggaguaaguaguauaagaa

SEQ ID NO: 465849 - RNA, 19 nt, Homo sapiens
gcaggaguaaguaguauaa

SEQ ID NO: 465850 - RNA, 19 nt, Homo sapiens
gcagggauaucguacaucu

SEQ ID NO: 465851 - RNA, 19 nt, Homo sapiens
caagaaaugucauggaaaa

SEQ ID NO: 465852 - RNA, 19 nt, Homo sapiens
aaaggaagauuuacagucu

SEQ ID NO: 465853 - RNA, 19 nt, Homo sapiens
acagaaguauugagagaaa

SEQ ID NO: 465854 - RNA, 19 nt, Homo sapiens
aaacaucguuaacaccaaa

SEQ ID NO: 465855 - RNA, 19 nt, Homo sapiens
ggagcucaaugucguauuc

SEQ ID NO: 465856 - RNA, 19 nt, Homo sapiens
gagagcaauuucaauaaca

SEQ ID NO: 465857 - RNA, 19 nt, Homo sapiens
agacagaaguauugagaga

SEQ ID NO: 465858 - RNA, 19 nt, Homo sapiens
gccaauaaaugauuaaucg

SEQ ID NO: 465859 - RNA, 19 nt, Homo sapiens
gauaggacuuggcuuucuu

SEQ ID NO: 465860 - RNA, 19 nt, Homo sapiens
caagacaggugaggcaaga

SEQ ID NO: 465861 - RNA, 19 nt, Homo sapiens
gagaauaugcucccaaugg

SEQ ID NO: 465862 - RNA, 19 nt, Homo sapiens
gcagaaaugagaggaaauu

SEQ ID NO: 465863 - RNA, 19 nt, Homo sapiens
caaauuacguucuuaaacc

SEQ ID NO: 465864 - RNA, 19 nt, Homo sapiens
uacaagaaaugucauggaa

SEQ ID NO: 465865 - RNA, 19 nt, Homo sapiens
gagucuauuucaaguguuu

SEQ ID NO: 465866 - RNA, 19 nt, Homo sapiens
gaaaugggagaacaauaug

SEQ ID NO: 465867 - RNA, 19 nt, Homo sapiens
gaaauuauccaacaaaccu

SEQ ID NO: 465868 - RNA, 19 nt, Homo sapiens
ccaaagcgccuggaucauu

SEQ ID NO: 465869 - RNA, 19 nt, Homo sapiens
guaauucccuaugauaaca

SEQ ID NO: 465870 - RNA, 19 nt, Homo sapiens
guaaugcuaccucuugaaa

SEQ ID NO: 465871 - RNA, 19 nt, Homo sapiens
gaauucauguauugguuuc

SEQ ID NO: 465872 - RNA, 19 nt, Homo sapiens
ccugagagcaauuucaaua

SEQ ID NO: 465873 - RNA, 19 nt, Homo sapiens
cuaaguaccuccuacacau

SEQ ID NO: 465874 - RNA, 19 nt, Homo sapiens
ggauaucguacaucuauug

SEQ ID NO: 465875 - RNA, 19 nt, Homo sapiens
gggcaaauaucugacuuca

SEQ ID NO: 465876 - RNA, 19 nt, Homo sapiens
ccgcucaucuacagcauuu

SEQ ID NO: 465877 - RNA, 19 nt, Homo sapiens
gcaaucagaauacacaauc

SEQ ID NO: 465878 - RNA, 19 nt, Homo sapiens
gcaaagacagaaguauuga

SEQ ID NO: 465879 - RNA, 19 nt, Homo sapiens
ggaauucauguauugguuu

SEQ ID NO: 465880 - RNA, 19 nt, Homo sapiens
gaaucaaguccgagaguga

SEQ ID NO: 465881 - RNA, 19 nt, Homo sapiens
aauuagaugugcaggagua

SEQ ID NO: 465882 - RNA, 19 nt, Homo sapiens
ucaaugggagauaguauaa

SEQ ID NO: 465883 - RNA, 19 nt, Homo sapiens
caaccugaguuucuguaug

SEQ ID NO: 465884 - RNA, 19 nt, Homo sapiens
gcucagucccuauaagauu

SEQ ID NO: 465885 - RNA, 19 nt, Homo sapiens
agaaguaaacguugcuuaa

SEQ ID NO: 465886 - RNA, 19 nt, Homo sapiens
cagagaauaugcucccaau

SEQ ID NO: 465887 - RNA, 19 nt, Homo sapiens
gaugcaacguggaaaucaa

SEQ ID NO: 465888 - RNA, 19 nt, Homo sapiens
uagagagugucagagaaua

SEQ ID NO: 465889 - RNA, 19 nt, Homo sapiens
ggcaggaggugcaaagaca

SEQ ID NO: 465890 - RNA, 19 nt, Homo sapiens
ggauccacauagcuaauau

SEQ ID NO: 465891 - RNA, 19 nt, Homo sapiens
gcucccaaacuguggauua

SEQ ID NO: 465892 - RNA, 19 nt, Homo sapiens
gcaucguaauucccuauga

SEQ ID NO: 465893 - RNA, 19 nt, Homo sapiens
caacguggaaaucaagaaa

SEQ ID NO: 465894 - RNA, 19 nt, Homo sapiens
gaaacugacauccuagcuu

SEQ ID NO: 465895 - RNA, 19 nt, Homo sapiens
gcucuguguuguaaugcua

SEQ ID NO: 465896 - RNA, 19 nt, Homo sapiens
aaauagacagguacacuaa

SEQ ID NO: 465897 - RNA, 19 nt, Homo sapiens
gaccugagaacuccucuug

SEQ ID NO: 465898 - RNA, 19 nt, Homo sapiens
cuacacauuucccaucaau

SEQ ID NO: 465899 - RNA, 19 nt, Homo sapiens
gcauuugcauguucugagu

SEQ ID NO: 465900 - RNA, 19 nt, Homo sapiens
guguuggacuuucaauuau

SEQ ID NO: 465901 - RNA, 19 nt, Homo sapiens
aguguuggacuuucaauua

SEQ ID NO: 465902 - RNA, 19 nt, Homo sapiens
gaacugccuccaauaucuu

SEQ ID NO: 465903 - RNA, 19 nt, Homo sapiens
aaucguaacucucugucuu

SEQ ID NO: 465904 - RNA, 19 nt, Homo sapiens
uaauuuccuuucccucauu

SEQ ID NO: 465905 - RNA, 19 nt, Homo sapiens
cgagagugaucaggaaaug

SEQ ID NO: 465906 - RNA, 19 nt, Homo sapiens
gugcaaagacagaaguauu

SEQ ID NO: 465907 - RNA, 19 nt, Homo sapiens
guaggacaguuggcagaaa

SEQ ID NO: 465908 - RNA, 19 nt, Homo sapiens
guucuuaaaccguaacuau

SEQ ID NO: 465909 - RNA, 19 nt, Homo sapiens
aagcagaaaugagaggaaa

SEQ ID NO: 465910 - RNA, 19 nt, Homo sapiens
ucuugaaacugacauccua

SEQ ID NO: 465911 - RNA, 19 nt, Homo sapiens
gaugacaaccugaguuucu

SEQ ID NO: 465912 - RNA, 19 nt, Homo sapiens
aaacagacgaguuccaaau

SEQ ID NO: 465913 - RNA, 19 nt, Homo sapiens
cagcagacccagcaaugaa

SEQ ID NO: 465914 - RNA, 19 nt, Homo sapiens
caaaagagacaccaaguga

SEQ ID NO: 465915 - RNA, 19 nt, Homo sapiens
gggcagagcuccaccauga

SEQ ID NO: 465916 - RNA, 19 nt, Homo sapiens
caacauguacuuccugauu

SEQ ID NO: 465917 - RNA, 19 nt, Homo sapiens
ccaauggccugcugaacaa

SEQ ID NO: 465918 - RNA, 19 nt, Homo sapiens
gggccuggcuuccucauga

SEQ ID NO: 465919 - RNA, 19 nt, Homo sapiens
gcacggccauugcauucaa

SEQ ID NO: 465920 - RNA, 19 nt, Homo sapiens
gcuaagaucuuccccauga

SEQ ID NO: 465921 - RNA, 19 nt, Homo sapiens
gcucucagcuggacgaauc

SEQ ID NO: 465922 - RNA, 19 nt, Homo sapiens
caggaaacaucgagucaga

SEQ ID NO: 465923 - RNA, 19 nt, Homo sapiens
ucaaugaucugcucaacgu

SEQ ID NO: 465924 - RNA, 19 nt, Homo sapiens
ggacuccuuauaaccauua

SEQ ID NO: 465925 - RNA, 19 nt, Homo sapiens
ucagagaagccaacaugua

SEQ ID NO: 465926 - RNA, 19 nt, Homo sapiens
uguaugggcuccuugaaga

SEQ ID NO: 465927 - RNA, 19 nt, Homo sapiens
cgacuacgcuaagaucuuc

SEQ ID NO: 465928 - RNA, 19 nt, Homo sapiens
ggaaacaucgagucagauc

SEQ ID NO: 465929 - RNA, 19 nt, Homo sapiens
ggacuugucgggccucaau

SEQ ID NO: 465930 - RNA, 19 nt, Homo sapiens
caucagagaagccaacaug

SEQ ID NO: 465931 - RNA, 19 nt, Homo sapiens
cgucaccucuuccaucaug

SEQ ID NO: 465932 - RNA, 19 nt, Homo sapiens
gagaagccaacauguacuu

SEQ ID NO: 465933 - RNA, 19 nt, Homo sapiens
gagcagggagcgcuucuuc

SEQ ID NO: 465934 - RNA, 19 nt, Homo sapiens
ccaucgagcuagccauugu

SEQ ID NO: 465935 - RNA, 19 nt, Homo sapiens
agaccuaccugagugagaa

SEQ ID NO: 465936 - RNA, 19 nt, Homo sapiens
ggucugccaucucuacuac

SEQ ID NO: 465937 - RNA, 19 nt, Homo sapiens
acauguacuuccugauuga

SEQ ID NO: 465938 - RNA, 19 nt, Homo sapiens
aaacaucgagucagaucuu

SEQ ID NO: 465939 - RNA, 19 nt, Homo sapiens
gaccaucgagcuagccauu

SEQ ID NO: 465940 - RNA, 19 nt, Homo sapiens
ccguggccguggacauuua

SEQ ID NO: 465941 - RNA, 19 nt, Homo sapiens
cagagaagccaacauguac

SEQ ID NO: 465942 - RNA, 19 nt, Homo sapiens
gcuccgacaugcaggaagu

SEQ ID NO: 465943 - RNA, 19 nt, Homo sapiens
caccaccacuuccuguaug

SEQ ID NO: 465944 - RNA, 19 nt, Homo sapiens
aacauguacuuccugauug

SEQ ID NO: 465945 - RNA, 19 nt, Homo sapiens
gaccuuuggcuaugaguau

SEQ ID NO: 465946 - RNA, 19 nt, Homo sapiens
ccacggagccaccuuucug

SEQ ID NO: 465947 - RNA, 19 nt, Homo sapiens
acagcagccuccacgacua

SEQ ID NO: 465948 - RNA, 19 nt, Homo sapiens
gcuaagcggguccagcuau

SEQ ID NO: 465949 - RNA, 19 nt, Homo sapiens
cauuauggccuugaccuuu

SEQ ID NO: 465950 - RNA, 19 nt, Homo sapiens
ggcgaggucugccaucucu

SEQ ID NO: 465951 - RNA, 19 nt, Homo sapiens
gauccugggcugccuguuc

SEQ ID NO: 465952 - RNA, 19 nt, Homo sapiens
gucgucaccucuuccauca

SEQ ID NO: 465953 - RNA, 19 nt, Homo sapiens
cuaagcggguccagcuaug

SEQ ID NO: 465954 - RNA, 19 nt, Homo sapiens
guggcgggauucaaacuuc

SEQ ID NO: 465955 - RNA, 19 nt, Homo sapiens
gcaccuacgcgggacaguu

SEQ ID NO: 465956 - RNA, 19 nt, Homo sapiens
caucaaccucuuugucaug

SEQ ID NO: 465957 - RNA, 19 nt, Homo sapiens
gagagaccuaccugaguga

SEQ ID NO: 465958 - RNA, 19 nt, Homo sapiens
ggccuugaccuuuggcuau

SEQ ID NO: 465959 - RNA, 19 nt, Homo sapiens
auuauggccuugaccuuug

SEQ ID NO: 465960 - RNA, 19 nt, Homo sapiens
ccaccaccacuuccuguau

SEQ ID NO: 465961 - RNA, 19 nt, Homo sapiens
ugucgggccucaaugaucu

SEQ ID NO: 465962 - RNA, 19 nt, Homo sapiens
ccacgacuacgcuaagauc

SEQ ID NO: 465963 - RNA, 19 nt, Homo sapiens
cgacaugcaggaagucauc

SEQ ID NO: 465964 - RNA, 19 nt, Homo sapiens
cgggacaguucgugaugga

SEQ ID NO: 465965 - RNA, 19 nt, Homo sapiens
gcccuguccgucuccuuua

SEQ ID NO: 465966 - RNA, 19 nt, Homo sapiens
ccaucaaccucuacuucgu

SEQ ID NO: 465967 - RNA, 19 nt, Homo sapiens
caccaucaaccucuacuuc

SEQ ID NO: 465968 - RNA, 19 nt, Homo sapiens
ugcaggaguuugccaaugg

SEQ ID NO: 465969 - RNA, 19 nt, Homo sapiens
cagagagaccuaccugagu

SEQ ID NO: 465970 - RNA, 19 nt, Homo sapiens
ucaucaaccucuuugucau

SEQ ID NO: 465971 - RNA, 19 nt, Homo sapiens
caucguggacaccuucuuc

SEQ ID NO: 465972 - RNA, 19 nt, Homo sapiens
gccuugaccuuuggcuaug

SEQ ID NO: 465973 - RNA, 19 nt, Homo sapiens
gcaccaucaaccucuacuu

SEQ ID NO: 465974 - RNA, 19 nt, Homo sapiens
ugacaaggguccccaaagg

SEQ ID NO: 465975 - RNA, 19 nt, Homo sapiens
gaaacaucgagucagaucu

SEQ ID NO: 465976 - RNA, 19 nt, Homo sapiens
caccuacgcgggacaguuc

SEQ ID NO: 465977 - RNA, 19 nt, Homo sapiens
caccguggccguggacauu

SEQ ID NO: 465978 - RNA, 19 nt, Homo sapiens
cauuugggcaggccuucua

SEQ ID NO: 465979 - RNA, 19 nt, Homo sapiens
uaucaucaaccucuuuguc

SEQ ID NO: 465980 - RNA, 19 nt, Homo sapiens
acucggcccuggucaaguc

SEQ ID NO: 465981 - RNA, 19 nt, Homo sapiens
gaacaacucuuccaaugua

SEQ ID NO: 465982 - RNA, 19 nt, Homo sapiens
ggacauaacucacgccuuu

SEQ ID NO: 465983 - RNA, 19 nt, Homo sapiens
aaacaggccuggcuuauaa

SEQ ID NO: 465984 - RNA, 19 nt, Homo sapiens
gaggauauauucucacuuu

SEQ ID NO: 465985 - RNA, 19 nt, Homo sapiens
ugacagagauugagaacua

SEQ ID NO: 465986 - RNA, 19 nt, Homo sapiens
caugaaagcugcaaagauu

SEQ ID NO: 465987 - RNA, 19 nt, Homo sapiens
ccagagguuucuuuaauua

SEQ ID NO: 465988 - RNA, 19 nt, Homo sapiens
ccaccugucuuacuaguua

SEQ ID NO: 465989 - RNA, 19 nt, Homo sapiens
agacaaugcucuggaauua

SEQ ID NO: 465990 - RNA, 19 nt, Homo sapiens
gaggaaagcucccuugaca

SEQ ID NO: 465991 - RNA, 19 nt, Homo sapiens
gaagccagcacucaauuua

SEQ ID NO: 465992 - RNA, 19 nt, Homo sapiens
gggauucgcugaaacugua

SEQ ID NO: 465993 - RNA, 19 nt, Homo sapiens
gaaacuccguggaaaauua

SEQ ID NO: 465994 - RNA, 19 nt, Homo sapiens
gcaaacuucuucauuggaa

SEQ ID NO: 465995 - RNA, 19 nt, Homo sapiens
gggaugaacugcaaugguu

SEQ ID NO: 465996 - RNA, 19 nt, Homo sapiens
gaaccucccaccugucuua

SEQ ID NO: 465997 - RNA, 19 nt, Homo sapiens
gccauggcauuuauucuua

SEQ ID NO: 465998 - RNA, 19 nt, Homo sapiens
accaaucgcuuucaaguua

SEQ ID NO: 465999 - RNA, 19 nt, Homo sapiens
aaagagagcuggaaagucu

SEQ ID NO: 466000 - RNA, 19 nt, Homo sapiens
gcuggcaaguugaacauua

SEQ ID NO: 466001 - RNA, 19 nt, Homo sapiens
gaacuacgugggaaucaua

SEQ ID NO: 466002 - RNA, 19 nt, Homo sapiens
ggaauuagagagauuagaa

SEQ ID NO: 466003 - RNA, 19 nt, Homo sapiens
ggaaagcucccuugacaga

SEQ ID NO: 466004 - RNA, 19 nt, Homo sapiens
uaacaacugcugagaaauu

SEQ ID NO: 466005 - RNA, 19 nt, Homo sapiens
gcaauggcuucccuucuga

SEQ ID NO: 466006 - RNA, 19 nt, Homo sapiens
ggugaaaggugugcuggua

SEQ ID NO: 466007 - RNA, 19 nt, Homo sapiens
ggaauuggucuuggaguua

SEQ ID NO: 466008 - RNA, 19 nt, Homo sapiens
ggagugcuaugacaauuuc

SEQ ID NO: 466009 - RNA, 19 nt, Homo sapiens
ucaccuaugucauugaauu

SEQ ID NO: 466010 - RNA, 19 nt, Homo sapiens
gaacugucauuccauccaa

SEQ ID NO: 466011 - RNA, 19 nt, Homo sapiens
gcaaguugaacauuacuaa

SEQ ID NO: 466012 - RNA, 19 nt, Homo sapiens
cuacaaagcccugcaguuu

SEQ ID NO: 466013 - RNA, 19 nt, Homo sapiens
gauggaggguuaacacuuc

SEQ ID NO: 466014 - RNA, 19 nt, Homo sapiens
caucugcugugaagucuuu

SEQ ID NO: 466015 - RNA, 19 nt, Homo sapiens
ggaagcgacuaucaaagau

SEQ ID NO: 466016 - RNA, 19 nt, Homo sapiens
guauauggcuugguuggaa

SEQ ID NO: 466017 - RNA, 19 nt, Homo sapiens
gcaagaaagggauccauau

SEQ ID NO: 466018 - RNA, 19 nt, Homo sapiens
ugaaagcugcaaagauuua

SEQ ID NO: 466019 - RNA, 19 nt, Homo sapiens
guccagagguuucuuuaau

SEQ ID NO: 466020 - RNA, 19 nt, Homo sapiens
uaacgacaaucacagguau

SEQ ID NO: 466021 - RNA, 19 nt, Homo sapiens
gaauuggucuuggaguuau

SEQ ID NO: 466022 - RNA, 19 nt, Homo sapiens
gggcagcugucaucaccua

SEQ ID NO: 466023 - RNA, 19 nt, Homo sapiens
gaaccaugcuggccauuuu

SEQ ID NO: 466024 - RNA, 19 nt, Homo sapiens
guaagaagccagaugugaa

SEQ ID NO: 466025 - RNA, 19 nt, Homo sapiens
gcuaugacuucucaagaug

SEQ ID NO: 466026 - RNA, 19 nt, Homo sapiens
ccaaugacauccggauuau

SEQ ID NO: 466027 - RNA, 19 nt, Homo sapiens
cgaguucggugggucaaua

SEQ ID NO: 466028 - RNA, 19 nt, Homo sapiens
ggaugccguucccaagaua

SEQ ID NO: 466029 - RNA, 19 nt, Homo sapiens
ucaaagauaaugaguguga

SEQ ID NO: 466030 - RNA, 19 nt, Homo sapiens
gcaagaggaauuagagaga

SEQ ID NO: 466031 - RNA, 19 nt, Homo sapiens
gcaaggacaacaucuacaa

SEQ ID NO: 466032 - RNA, 19 nt, Homo sapiens
gguuggaaauccucacaaa

SEQ ID NO: 466033 - RNA, 19 nt, Homo sapiens
uuuaacaacugcugagaaa

SEQ ID NO: 466034 - RNA, 19 nt, Homo sapiens
caaccgcauugaagaagaa

SEQ ID NO: 466035 - RNA, 19 nt, Homo sapiens
caaacacucuggugauugg

SEQ ID NO: 466036 - RNA, 19 nt, Homo sapiens
ccacacaggcucuuuccua

SEQ ID NO: 466037 - RNA, 19 nt, Homo sapiens
gcaucaauauuugcagaaa

SEQ ID NO: 466038 - RNA, 19 nt, Homo sapiens
ggcaaaggcccaagucauu

SEQ ID NO: 466039 - RNA, 19 nt, Homo sapiens
uaaggaagaugaucaagcu

SEQ ID NO: 466040 - RNA, 19 nt, Homo sapiens
aacaacugcugagaaauua

SEQ ID NO: 466041 - RNA, 19 nt, Homo sapiens
caaguuagugucauaaaug

SEQ ID NO: 466042 - RNA, 19 nt, Homo sapiens
ggagagugauucgaugaug

SEQ ID NO: 466043 - RNA, 19 nt, Homo sapiens
gauguuuggugguuguuug

SEQ ID NO: 466044 - RNA, 19 nt, Homo sapiens
ucaauaggccugaucuuug

SEQ ID NO: 466045 - RNA, 19 nt, Homo sapiens
gagcaacucgcaaagaaug

SEQ ID NO: 466046 - RNA, 19 nt, Homo sapiens
caacucuuccaauguauuu

SEQ ID NO: 466047 - RNA, 19 nt, Homo sapiens
guauggaauuuacaacaug

SEQ ID NO: 466048 - RNA, 19 nt, Homo sapiens
uaccaagcaucaauauuug

SEQ ID NO: 466049 - RNA, 19 nt, Homo sapiens
uaagaugcaugcugaacau

SEQ ID NO: 466050 - RNA, 19 nt, Homo sapiens
ugggauaccuggagaugaa

SEQ ID NO: 466051 - RNA, 19 nt, Homo sapiens
ggaaucaggagugcuauga

SEQ ID NO: 466052 - RNA, 19 nt, Homo sapiens
caugaaagauuggaauaca

SEQ ID NO: 466053 - RNA, 19 nt, Homo sapiens
uggaaauccucacaaagaa

SEQ ID NO: 466054 - RNA, 19 nt, Homo sapiens
ucgacugaaugaacucuua

SEQ ID NO: 466055 - RNA, 19 nt, Homo sapiens
caacugcugagaaauuaaa

SEQ ID NO: 466056 - RNA, 19 nt, Homo sapiens
ggaaagacuguaaauuaag

SEQ ID NO: 466057 - RNA, 19 nt, Homo sapiens
ggaagccagcacucaauuu

SEQ ID NO: 466058 - RNA, 19 nt, Homo sapiens
auacugacccaccacauua

SEQ ID NO: 466059 - RNA, 19 nt, Homo sapiens
gcagucauguuugucauca

SEQ ID NO: 466060 - RNA, 19 nt, Homo sapiens
ggccucauaugcacuuauu

SEQ ID NO: 466061 - RNA, 19 nt, Homo sapiens
aagagaugauugaaccaua

SEQ ID NO: 466062 - RNA, 19 nt, Homo sapiens
cugagcaaauuuaggauaa

SEQ ID NO: 466063 - RNA, 19 nt, Homo sapiens
ggaggguuaacacuucuua

SEQ ID NO: 466064 - RNA, 19 nt, Homo sapiens
caucaccuaugucauugaa

SEQ ID NO: 466065 - RNA, 19 nt, Homo sapiens
ugacaucucucagguucuu

SEQ ID NO: 466066 - RNA, 19 nt, Homo sapiens
uaggaagaaugaaaccaaa

SEQ ID NO: 466067 - RNA, 19 nt, Homo sapiens
ccucauaugcacuuauuaa

SEQ ID NO: 466068 - RNA, 19 nt, Homo sapiens
ggaugaagcucagaaaaga

SEQ ID NO: 466069 - RNA, 19 nt, Homo sapiens
cugaacaacucuuccaaug

SEQ ID NO: 466070 - RNA, 19 nt, Homo sapiens
aaacaaagagagcuggaaa

SEQ ID NO: 466071 - RNA, 19 nt, Homo sapiens
gggaagaucaaccgcauug

SEQ ID NO: 466072 - RNA, 19 nt, Homo sapiens
caauugauguuuggugguu

SEQ ID NO: 466073 - RNA, 19 nt, Homo sapiens
ccaaggauuugacaucucu

SEQ ID NO: 466074 - RNA, 19 nt, Homo sapiens
gucauugaauucuuccuuu

SEQ ID NO: 466075 - RNA, 19 nt, Homo sapiens
caauaggccugaucuuugc

SEQ ID NO: 466076 - RNA, 19 nt, Homo sapiens
gaaagcugcaaagauuuaa

SEQ ID NO: 466077 - RNA, 19 nt, Homo sapiens
aaagauggcagcauuaaca

SEQ ID NO: 466078 - RNA, 19 nt, Homo sapiens
gaaugaaaccaaacacucu

SEQ ID NO: 466079 - RNA, 19 nt, Homo sapiens
ggaagaaugaaaccaaaca

SEQ ID NO: 466080 - RNA, 19 nt, Homo sapiens
agacucagaaucagcuuua

SEQ ID NO: 466081 - RNA, 19 nt, Homo sapiens
gaucaaggguguauuagua

SEQ ID NO: 466082 - RNA, 19 nt, Homo sapiens
gcacuuggauucaucuuaa

SEQ ID NO: 466083 - RNA, 19 nt, Homo sapiens
uaucagcgauggcuuauua

SEQ ID NO: 466084 - RNA, 19 nt, Homo sapiens
ggagagcgauggcuacuuu

SEQ ID NO: 466085 - RNA, 19 nt, Homo sapiens
gaugaaccauggcgaauaa

SEQ ID NO: 466086 - RNA, 19 nt, Homo sapiens
ggauauaucucaucuucaa

SEQ ID NO: 466087 - RNA, 19 nt, Homo sapiens
uaacagagcuaacaaacug

SEQ ID NO: 466088 - RNA, 19 nt, Homo sapiens
gcaaauaucucaggugauc

SEQ ID NO: 466089 - RNA, 19 nt, Homo sapiens
guaguaaccugaaaucuuc

SEQ ID NO: 466090 - RNA, 19 nt, Homo sapiens
ggacagcccuccagaaugg

SEQ ID NO: 466091 - RNA, 19 nt, Homo sapiens
guaaaggagucgugaaguu

SEQ ID NO: 466092 - RNA, 19 nt, Homo sapiens
caggaaagcuugcuccauu

SEQ ID NO: 466093 - RNA, 19 nt, Homo sapiens
ggaggagcauauuauuuaa

SEQ ID NO: 466094 - RNA, 19 nt, Homo sapiens
gaggauggcuuugcaaaug

SEQ ID NO: 466095 - RNA, 19 nt, Homo sapiens
gcagaugacuugagagaag

SEQ ID NO: 466096 - RNA, 19 nt, Homo sapiens
ggauuuacaccacuaauuu

SEQ ID NO: 466097 - RNA, 19 nt, Homo sapiens
gaugaucuguggccaugua

SEQ ID NO: 466098 - RNA, 19 nt, Homo sapiens
aaacucacguccagcuuua

SEQ ID NO: 466099 - RNA, 19 nt, Homo sapiens
ucaaggacaagaagaauua

SEQ ID NO: 466100 - RNA, 19 nt, Homo sapiens
gaagacaagccaugaaaga

SEQ ID NO: 466101 - RNA, 19 nt, Homo sapiens
gagaugcuguggucacgua

SEQ ID NO: 466102 - RNA, 19 nt, Homo sapiens
ccaauuaucucaaacuucu

SEQ ID NO: 466103 - RNA, 19 nt, Homo sapiens
uaagaaagauugguugcaa

SEQ ID NO: 466104 - RNA, 19 nt, Homo sapiens
aaagcuugcuccauugaua

SEQ ID NO: 466105 - RNA, 19 nt, Homo sapiens
gguaguaaguguggaauau

SEQ ID NO: 466106 - RNA, 19 nt, Homo sapiens
ugagggauguggauaugua

SEQ ID NO: 466107 - RNA, 19 nt, Homo sapiens
ggaaagauaaacagaauag

SEQ ID NO: 466108 - RNA, 19 nt, Homo sapiens
ugacaacuaucacaggauu

SEQ ID NO: 466109 - RNA, 19 nt, Homo sapiens
gaaagacuguaagaucaga

SEQ ID NO: 466110 - RNA, 19 nt, Homo sapiens
ucaagcacagcuaauauua

SEQ ID NO: 466111 - RNA, 19 nt, Homo sapiens
gggcugcauugcuaacaua

SEQ ID NO: 466112 - RNA, 19 nt, Homo sapiens
gcauuagcaucccuaguga

SEQ ID NO: 466113 - RNA, 19 nt, Homo sapiens
uaacguguauggagacuuc

SEQ ID NO: 466114 - RNA, 19 nt, Homo sapiens
gaugauaaagagcaagaua

SEQ ID NO: 466115 - RNA, 19 nt, Homo sapiens
ggucuaaucuucgccuuug

SEQ ID NO: 466116 - RNA, 19 nt, Homo sapiens
cagcacuacuauuaugaua

SEQ ID NO: 466117 - RNA, 19 nt, Homo sapiens
aggaggagcauauuauuua

SEQ ID NO: 466118 - RNA, 19 nt, Homo sapiens
gagcuugaacuuuauaaga

SEQ ID NO: 466119 - RNA, 19 nt, Homo sapiens
gauaaugagcuugaacuuu

SEQ ID NO: 466120 - RNA, 19 nt, Homo sapiens
ggaagaggauggcaagacu

SEQ ID NO: 466121 - RNA, 19 nt, Homo sapiens
cuacacaagcccugacuua

SEQ ID NO: 466122 - RNA, 19 nt, Homo sapiens
gcaacuaauggauuuguaa

SEQ ID NO: 466123 - RNA, 19 nt, Homo sapiens
guacuucagugccuagugu

SEQ ID NO: 466124 - RNA, 19 nt, Homo sapiens
uaacagauaaugagcuuga

SEQ ID NO: 466125 - RNA, 19 nt, Homo sapiens
cgauuuagauacuuccaaa

SEQ ID NO: 466126 - RNA, 19 nt, Homo sapiens
ccacuaauuucugcaggua

SEQ ID NO: 466127 - RNA, 19 nt, Homo sapiens
gauccuacuucuugcuauu

SEQ ID NO: 466128 - RNA, 19 nt, Homo sapiens
gaggaggagcauauuauuu

SEQ ID NO: 466129 - RNA, 19 nt, Homo sapiens
guggaaagauaaacagaau

SEQ ID NO: 466130 - RNA, 19 nt, Homo sapiens
gauguuugcuaaagguuau

SEQ ID NO: 466131 - RNA, 19 nt, Homo sapiens
gaucagguuaaaugaguua

SEQ ID NO: 466132 - RNA, 19 nt, Homo sapiens
uggaaagacuguaagauca

SEQ ID NO: 466133 - RNA, 19 nt, Homo sapiens
gacaggugcuccaaacuca

SEQ ID NO: 466134 - RNA, 19 nt, Homo sapiens
gaacauucaagcacagcua

SEQ ID NO: 466135 - RNA, 19 nt, Homo sapiens
uaaacagaauagaccauga

SEQ ID NO: 466136 - RNA, 19 nt, Homo sapiens
gaacaacuuccagguaaug

SEQ ID NO: 466137 - RNA, 19 nt, Homo sapiens
gaggaggaggagcauauua

SEQ ID NO: 466138 - RNA, 19 nt, Homo sapiens
gacaacaucuacccagcuu

SEQ ID NO: 466139 - RNA, 19 nt, Homo sapiens
ggaggaggagcauauuauu

SEQ ID NO: 466140 - RNA, 19 nt, Homo sapiens
uaaaggagucgugaaguuu

SEQ ID NO: 466141 - RNA, 19 nt, Homo sapiens
uaggagauaucaauaccaa

SEQ ID NO: 466142 - RNA, 19 nt, Homo sapiens
gguuugaccuuauugauac

SEQ ID NO: 466143 - RNA, 19 nt, Homo sapiens
gacaagccaugaaagagau

SEQ ID NO: 466144 - RNA, 19 nt, Homo sapiens
uccuugggcuguauauuua

SEQ ID NO: 466145 - RNA, 19 nt, Homo sapiens
cuacccagcuuuccagaug

SEQ ID NO: 466146 - RNA, 19 nt, Homo sapiens
ggaacacuccuagccauuu

SEQ ID NO: 466147 - RNA, 19 nt, Homo sapiens
cagaucagguuaaaugagu

SEQ ID NO: 466148 - RNA, 19 nt, Homo sapiens
aaaagaaggucuggauaua

SEQ ID NO: 466149 - RNA, 19 nt, Homo sapiens
acuaauuucugcagguaua

SEQ ID NO: 466150 - RNA, 19 nt, Homo sapiens
gaacacuccuagccauuuu

SEQ ID NO: 466151 - RNA, 19 nt, Homo sapiens
cagaaaccgugguggaguu

SEQ ID NO: 466152 - RNA, 19 nt, Homo sapiens
ucacaggauugucuacuuc

SEQ ID NO: 466153 - RNA, 19 nt, Homo sapiens
ggaaagcuugcuccauuga

SEQ ID NO: 466154 - RNA, 19 nt, Homo sapiens
ccaauuacacacaaaguug

SEQ ID NO: 466155 - RNA, 19 nt, Homo sapiens
aagaaggucuggauauauc

SEQ ID NO: 466156 - RNA, 19 nt, Homo sapiens
guuaaugacacuaucguaa

SEQ ID NO: 466157 - RNA, 19 nt, Homo sapiens
ggaaaucauugagccauac

SEQ ID NO: 466158 - RNA, 19 nt, Homo sapiens
guaaguguggaauauagua

SEQ ID NO: 466159 - RNA, 19 nt, Homo sapiens
ccaaggaugugguaguaag

SEQ ID NO: 466160 - RNA, 19 nt, Homo sapiens
gaagaaaguacuccaacca

SEQ ID NO: 466161 - RNA, 19 nt, Homo sapiens
gauaaagagcaagauauug

SEQ ID NO: 466162 - RNA, 19 nt, Homo sapiens
gcacugcagcauucaauuc

SEQ ID NO: 466163 - RNA, 19 nt, Homo sapiens
cuuaauugcugaacugaau

SEQ ID NO: 466164 - RNA, 19 nt, Homo sapiens
cuaacaaacuguacuucug

SEQ ID NO: 466165 - RNA, 19 nt, Homo sapiens
ggaauggagugggaagcaa

SEQ ID NO: 466166 - RNA, 19 nt, Homo sapiens
cuucguggcuacaucuuaa

SEQ ID NO: 466167 - RNA, 19 nt, Homo sapiens
augaacaacuuccagguaa

SEQ ID NO: 466168 - RNA, 19 nt, Homo sapiens
uaaugacacuaucguaaca

SEQ ID NO: 466169 - RNA, 19 nt, Homo sapiens
caccagcacuacuauuaug

SEQ ID NO: 466170 - RNA, 19 nt, Homo sapiens
uaauaaugauggccacugu

SEQ ID NO: 466171 - RNA, 19 nt, Homo sapiens
cuaaggaccuaccaccaau

SEQ ID NO: 466172 - RNA, 19 nt, Homo sapiens
guaguaaguguggaauaua

SEQ ID NO: 466173 - RNA, 19 nt, Homo sapiens
caauauggaguagugguua

SEQ ID NO: 466174 - RNA, 19 nt, Homo sapiens
aaauaucagcgauggcuua

SEQ ID NO: 466175 - RNA, 19 nt, Homo sapiens
gcuaacauaugugauaguc

SEQ ID NO: 466176 - RNA, 19 nt, Homo sapiens
uugcugaacugaauguuau

SEQ ID NO: 466177 - RNA, 19 nt, Homo sapiens
caucuuaauugcugaacug

SEQ ID NO: 466178 - RNA, 19 nt, Homo sapiens
guggcuacaucuuaacauu

SEQ ID NO: 466179 - RNA, 19 nt, Homo sapiens
caacaucuacccagcuuuc

SEQ ID NO: 466180 - RNA, 19 nt, Homo sapiens
cgaauuauuggagccauua

SEQ ID NO: 466181 - RNA, 19 nt, Homo sapiens
gaucacggcuggcaucuuc

SEQ ID NO: 466182 - RNA, 19 nt, Homo sapiens
gccaguaacuccaggcuuu

SEQ ID NO: 466183 - RNA, 19 nt, Homo sapiens
ccaaguggcugaacaagag

SEQ ID NO: 466184 - RNA, 19 nt, Homo sapiens
caagauccguguguucgua

SEQ ID NO: 466185 - RNA, 19 nt, Homo sapiens
gaacugcccacaacagaga

SEQ ID NO: 466186 - RNA, 19 nt, Homo sapiens
gagagaaaggcgaucauuu

SEQ ID NO: 466187 - RNA, 19 nt, Homo sapiens
ccaaggcccuggugaagga

SEQ ID NO: 466188 - RNA, 19 nt, Homo sapiens
gaccuucauuccaauacua

SEQ ID NO: 466189 - RNA, 19 nt, Homo sapiens
gcaagaagaccauagacau

SEQ ID NO: 466190 - RNA, 19 nt, Homo sapiens
ccucagaccuccagucauc

SEQ ID NO: 466191 - RNA, 19 nt, Homo sapiens
cgucaucacuuugcccaua

SEQ ID NO: 466192 - RNA, 19 nt, Homo sapiens
ggaauguucuccaucuucu

SEQ ID NO: 466193 - RNA, 19 nt, Homo sapiens
cgacugggauuccaugaag

SEQ ID NO: 466194 - RNA, 19 nt, Homo sapiens
gcuguggccuucaucauca

SEQ ID NO: 466195 - RNA, 19 nt, Homo sapiens
gaccagcuguacccacuga

SEQ ID NO: 466196 - RNA, 19 nt, Homo sapiens
ggauggaccaggagagaaa

SEQ ID NO: 466197 - RNA, 19 nt, Homo sapiens
guccugaccuggaucauca

SEQ ID NO: 466198 - RNA, 19 nt, Homo sapiens
aagaggagguggagcaaau

SEQ ID NO: 466199 - RNA, 19 nt, Homo sapiens
ccuaugcccucaucaacuu

SEQ ID NO: 466200 - RNA, 19 nt, Homo sapiens
ccaagggcuucuucagcua

SEQ ID NO: 466201 - RNA, 19 nt, Homo sapiens
guucaacuauggcgugugu

SEQ ID NO: 466202 - RNA, 19 nt, Homo sapiens
acaagaagccagagguaaa

SEQ ID NO: 466203 - RNA, 19 nt, Homo sapiens
caaaggcuauggcaagaac

SEQ ID NO: 466204 - RNA, 19 nt, Homo sapiens
augaggagauuacgaagaa

SEQ ID NO: 466205 - RNA, 19 nt, Homo sapiens
ggagagaaaggcgaucauu

SEQ ID NO: 466206 - RNA, 19 nt, Homo sapiens
ggcaaaggcuauggcaaga

SEQ ID NO: 466207 - RNA, 19 nt, Homo sapiens
gugguuggguucaagaaga

SEQ ID NO: 466208 - RNA, 19 nt, Homo sapiens
ggagaccuucauuccaaua

SEQ ID NO: 466209 - RNA, 19 nt, Homo sapiens
ccucaaggacccugcuaua

SEQ ID NO: 466210 - RNA, 19 nt, Homo sapiens
caagaagaccauagacauc

SEQ ID NO: 466211 - RNA, 19 nt, Homo sapiens
uggaagaccacaucaagaa

SEQ ID NO: 466212 - RNA, 19 nt, Homo sapiens
ggacgaccauuuccuaccu

SEQ ID NO: 466213 - RNA, 19 nt, Homo sapiens
cagaugaggagauuacgaa

SEQ ID NO: 466214 - RNA, 19 nt, Homo sapiens
caagagguuugaggacaug

SEQ ID NO: 466215 - RNA, 19 nt, Homo sapiens
ucgcugagcucaacaccau

SEQ ID NO: 466216 - RNA, 19 nt, Homo sapiens
ucacaggccucuccaucuc

SEQ ID NO: 466217 - RNA, 19 nt, Homo sapiens
gacaucuacuggcucuuug

SEQ ID NO: 466218 - RNA, 19 nt, Homo sapiens
caucaucgcugagcucaac

SEQ ID NO: 466219 - RNA, 19 nt, Homo sapiens
gcccacauaugagcacuau

SEQ ID NO: 466220 - RNA, 19 nt, Homo sapiens
gugcuguucuuccuuguca

SEQ ID NO: 466221 - RNA, 19 nt, Homo sapiens
ccaagagguuugaggacau

SEQ ID NO: 466222 - RNA, 19 nt, Homo sapiens
gagcacaccaagagguuug

SEQ ID NO: 466223 - RNA, 19 nt, Homo sapiens
aagaccacaucaagaacua

SEQ ID NO: 466224 - RNA, 19 nt, Homo sapiens
uggcugaccugcacuccuu

SEQ ID NO: 466225 - RNA, 19 nt, Homo sapiens
ucagccaucuccaccaaug

SEQ ID NO: 466226 - RNA, 19 nt, Homo sapiens
caugaugccuuugaguuca

SEQ ID NO: 466227 - RNA, 19 nt, Homo sapiens
caagaagccagagguaaau

SEQ ID NO: 466228 - RNA, 19 nt, Homo sapiens
uaacgacauccgcaucauu

SEQ ID NO: 466229 - RNA, 19 nt, Homo sapiens
gcaccuacuuccucaucuc

SEQ ID NO: 466230 - RNA, 19 nt, Homo sapiens
gaugaggagauuacgaaga

SEQ ID NO: 466231 - RNA, 19 nt, Homo sapiens
cuacaagaagccagaggua

SEQ ID NO: 466232 - RNA, 19 nt, Homo sapiens
ggucuccuuugccaacuau

SEQ ID NO: 466233 - RNA, 19 nt, Homo sapiens
caggugaggcugaaugaga

SEQ ID NO: 466234 - RNA, 19 nt, Homo sapiens
gggcugagcacaccaagag

SEQ ID NO: 466235 - RNA, 19 nt, Homo sapiens
ggagguggagcaaaugcaa

SEQ ID NO: 466236 - RNA, 19 nt, Homo sapiens
gaagaccacaucaagaacu

SEQ ID NO: 466237 - RNA, 19 nt, Homo sapiens
acuacggccucaucaacua

SEQ ID NO: 466238 - RNA, 19 nt, Homo sapiens
guucuuccuugucaucaug

SEQ ID NO: 466239 - RNA, 19 nt, Homo sapiens
ucuaugucaucuacaagaa

SEQ ID NO: 466240 - RNA, 19 nt, Homo sapiens
gcaaaggcuauggcaagaa

SEQ ID NO: 466241 - RNA, 19 nt, Homo sapiens
gcaccagcagcgagaagaa

SEQ ID NO: 466242 - RNA, 19 nt, Homo sapiens
gaccucagaccuccaguca

SEQ ID NO: 466243 - RNA, 19 nt, Homo sapiens
agacaucuacuggcucuuu

SEQ ID NO: 466244 - RNA, 19 nt, Homo sapiens
ugaugcaggcgcacauuaa

SEQ ID NO: 466245 - RNA, 19 nt, Homo sapiens
acauuggcauccuccauga

SEQ ID NO: 466246 - RNA, 19 nt, Homo sapiens
gaagccagagguaaauugg

SEQ ID NO: 466247 - RNA, 19 nt, Homo sapiens
ugcaugcccuggccuuuga

SEQ ID NO: 466248 - RNA, 19 nt, Homo sapiens
augagauugugcuggauua

SEQ ID NO: 466249 - RNA, 19 nt, Homo sapiens
gaaugauggcuucaaggau

SEQ ID NO: 466250 - RNA, 19 nt, Homo sapiens
gagguuugaggacaugauu

SEQ ID NO: 466251 - RNA, 19 nt, Homo sapiens
ucccugacaucaaccagaa

SEQ ID NO: 466252 - RNA, 19 nt, Homo sapiens
caacguguccaagaugaug

SEQ ID NO: 466253 - RNA, 19 nt, Homo sapiens
gaaugagauugugcuggau

SEQ ID NO: 466254 - RNA, 19 nt, Homo sapiens
gagcaggccaccaccaucu

SEQ ID NO: 466255 - RNA, 19 nt, Homo sapiens
gcacauuaaccccguguuu

SEQ ID NO: 466256 - RNA, 19 nt, Homo sapiens
gcuacaacacgaucgaugu

SEQ ID NO: 466257 - RNA, 19 nt, Homo sapiens
gaucggcuucuucggcaaa

SEQ ID NO: 466258 - RNA, 19 nt, Homo sapiens
cagaacugcccacaacaga

SEQ ID NO: 466259 - RNA, 19 nt, Homo sapiens
gauccgaggaaaccaggaa

SEQ ID NO: 466260 - RNA, 19 nt, Homo sapiens
gcucucaucgucaucacuu

SEQ ID NO: 466261 - RNA, 19 nt, Homo sapiens
gcaaguuccgacugggauu

SEQ ID NO: 466262 - RNA, 19 nt, Homo sapiens
ugaacaagaggaagaucaa

SEQ ID NO: 466263 - RNA, 19 nt, Homo sapiens
caucauuuccaacuucuuc

SEQ ID NO: 466264 - RNA, 19 nt, Homo sapiens
ucucagccaucuccaccaa

SEQ ID NO: 466265 - RNA, 19 nt, Homo sapiens
ggaaaacgugcucaccuuu

SEQ ID NO: 466266 - RNA, 19 nt, Homo sapiens
gaggagauuacgaagaaca

SEQ ID NO: 466267 - RNA, 19 nt, Homo sapiens
gacucaacguguccaagau

SEQ ID NO: 466268 - RNA, 19 nt, Homo sapiens
ggagaaugaagcccaacau

SEQ ID NO: 466269 - RNA, 19 nt, Homo sapiens
gcagaggcguccagauccu

SEQ ID NO: 466270 - RNA, 19 nt, Homo sapiens
gaacaagaggaagaucaag

SEQ ID NO: 466271 - RNA, 19 nt, Homo sapiens
ccaacgggcacaccaagug

SEQ ID NO: 466272 - RNA, 19 nt, Homo sapiens
ccuugucucugcugccaaa

SEQ ID NO: 466273 - RNA, 19 nt, Homo sapiens
ggccaucucagccaccauu

SEQ ID NO: 466274 - RNA, 19 nt, Homo sapiens
cauccucccugacaucaac

SEQ ID NO: 466275 - RNA, 19 nt, Homo sapiens
gcaagaggagguggagcaa

SEQ ID NO: 466276 - RNA, 19 nt, Homo sapiens
ccaugaugccuuugaguuc

SEQ ID NO: 466277 - RNA, 19 nt, Homo sapiens
ggccucacccuccucauuc

SEQ ID NO: 466278 - RNA, 19 nt, Homo sapiens
gcaggccaccaccaucuuc

SEQ ID NO: 466279 - RNA, 19 nt, Homo sapiens
gcaucguccugaccuggau

SEQ ID NO: 466280 - RNA, 19 nt, Homo sapiens
cacaguggaagacuacauu

SEQ ID NO: 466281 - RNA, 19 nt, Homo sapiens
caacuucccucguguacuu

SEQ ID NO: 466282 - RNA, 19 nt, Homo sapiens
gcaagggccugaccauugu

SEQ ID NO: 466283 - RNA, 19 nt, Homo sapiens
gggcauaaagucuauauuu

SEQ ID NO: 466284 - RNA, 19 nt, Homo sapiens
ggaauugacuacuaugaca

SEQ ID NO: 466285 - RNA, 19 nt, Homo sapiens
ccagaggaauugacuacua

SEQ ID NO: 466286 - RNA, 19 nt, Homo sapiens
ggcauaaagucuauauuug

SEQ ID NO: 466287 - RNA, 19 nt, Homo sapiens
ggacauccgcccaaaggua

SEQ ID NO: 466288 - RNA, 19 nt, Homo sapiens
ucaagaacaugauggaaau

SEQ ID NO: 466289 - RNA, 19 nt, Homo sapiens
ccaaagguaucgucucuuc

SEQ ID NO: 466290 - RNA, 19 nt, Homo sapiens
ggaccuggcugucuuucug

SEQ ID NO: 466291 - RNA, 19 nt, Homo sapiens
ggucaaguaugugaacaaa

SEQ ID NO: 466292 - RNA, 19 nt, Homo sapiens
acagugacaucucugcaua

SEQ ID NO: 466293 - RNA, 19 nt, Homo sapiens
ggacaaguauggcgauggu

SEQ ID NO: 466294 - RNA, 19 nt, Homo sapiens
gugcuuaucugcugcuguu

SEQ ID NO: 466295 - RNA, 19 nt, Homo sapiens
cagaggaauugacuacuau

SEQ ID NO: 466296 - RNA, 19 nt, Homo sapiens
cauaaggucuggaggaagu

SEQ ID NO: 466297 - RNA, 19 nt, Homo sapiens
cagaauaucuuugggguua

SEQ ID NO: 466298 - RNA, 19 nt, Homo sapiens
gagcagaccaucaagaaca

SEQ ID NO: 466299 - RNA, 19 nt, Homo sapiens
caucauggcuggcucaaac

SEQ ID NO: 466300 - RNA, 19 nt, Homo sapiens
uaucgucucuucugggaaa

SEQ ID NO: 466301 - RNA, 19 nt, Homo sapiens
gcauaacagugacaucucu

SEQ ID NO: 466302 - RNA, 19 nt, Homo sapiens
acaaauacaucgaguacca

SEQ ID NO: 466303 - RNA, 19 nt, Homo sapiens
ccacccagcuauggaguuu

SEQ ID NO: 466304 - RNA, 19 nt, Homo sapiens
ggacccagcuuugcuaggu

SEQ ID NO: 466305 - RNA, 19 nt, Homo sapiens
ggcaugaucuacaaauaca

SEQ ID NO: 466306 - RNA, 19 nt, Homo sapiens
gggagcuggugcacauuaa

SEQ ID NO: 466307 - RNA, 19 nt, Homo sapiens
ggcaagggccugaccauug

SEQ ID NO: 466308 - RNA, 19 nt, Homo sapiens
gaaugccacuuugaacaau

SEQ ID NO: 466309 - RNA, 19 nt, Homo sapiens
gaagaucuggcucagucua

SEQ ID NO: 466310 - RNA, 19 nt, Homo sapiens
ugacaucugugccaagaca

SEQ ID NO: 466311 - RNA, 19 nt, Homo sapiens
ggaccaguuugacaucugu

SEQ ID NO: 466312 - RNA, 19 nt, Homo sapiens
cagcuguaguggacaauga

SEQ ID NO: 466313 - RNA, 19 nt, Homo sapiens
gaacaauaugcguguguau

SEQ ID NO: 466314 - RNA, 19 nt, Homo sapiens
gagcgcuauuuauugcaua

SEQ ID NO: 466315 - RNA, 19 nt, Homo sapiens
cagaugagacugaccaaga

SEQ ID NO: 466316 - RNA, 19 nt, Homo sapiens
agaaggaccuggcugucuu

SEQ ID NO: 466317 - RNA, 19 nt, Homo sapiens
gcagugugguucucuuugg

SEQ ID NO: 466318 - RNA, 19 nt, Homo sapiens
ccaccaagcugagccgaau

SEQ ID NO: 466319 - RNA, 19 nt, Homo sapiens
agaacaugauggaaauuga

SEQ ID NO: 466320 - RNA, 19 nt, Homo sapiens
caucuuauccauguucuuu

SEQ ID NO: 466321 - RNA, 19 nt, Homo sapiens
cgucaucggcuccuucuuu

SEQ ID NO: 466322 - RNA, 19 nt, Homo sapiens
gaaggaccuggcugucuuu

SEQ ID NO: 466323 - RNA, 19 nt, Homo sapiens
gagagcagcccuuuucuuu

SEQ ID NO: 466324 - RNA, 19 nt, Homo sapiens
ugaacaauaugcgugugua

SEQ ID NO: 466325 - RNA, 19 nt, Homo sapiens
gcccaaagguaucgucucu

SEQ ID NO: 466326 - RNA, 19 nt, Homo sapiens
ccggcaugaucuacaaaua

SEQ ID NO: 466327 - RNA, 19 nt, Homo sapiens
ccaggagcgcuauuuauug

SEQ ID NO: 466328 - RNA, 19 nt, Homo sapiens
ucaacaaugugaccgagau

SEQ ID NO: 466329 - RNA, 19 nt, Homo sapiens
gaggaauugacuacuauga

SEQ ID NO: 466330 - RNA, 19 nt, Homo sapiens
ggucuuggccaggacauaa

SEQ ID NO: 466331 - RNA, 19 nt, Homo sapiens
gcucaugacacgucgaaug

SEQ ID NO: 466332 - RNA, 19 nt, Homo sapiens
gaacaugauggaaauugag

SEQ ID NO: 466333 - RNA, 19 nt, Homo sapiens
cgaaugccacuuugaacaa

SEQ ID NO: 466334 - RNA, 19 nt, Homo sapiens
ggagcgcuauuuauugcau

SEQ ID NO: 466335 - RNA, 19 nt, Homo sapiens
caggagcgcuauuuauugc

SEQ ID NO: 466336 - RNA, 19 nt, Homo sapiens
ggaccauucuggccaucau

SEQ ID NO: 466337 - RNA, 19 nt, Homo sapiens
cuucuucccuucuguaaca

SEQ ID NO: 466338 - RNA, 19 nt, Homo sapiens
caaauuugccucgcucuuc

SEQ ID NO: 466339 - RNA, 19 nt, Homo sapiens
gugggacccugggauguuu

SEQ ID NO: 466340 - RNA, 19 nt, Homo sapiens
aagcccagcuggucaagga

SEQ ID NO: 466341 - RNA, 19 nt, Homo sapiens
cuuaucugcugcuguugua

SEQ ID NO: 466342 - RNA, 19 nt, Homo sapiens
ggacgaggaagaugagucu

SEQ ID NO: 466343 - RNA, 19 nt, Homo sapiens
ugauggaaauugagaaggu

SEQ ID NO: 466344 - RNA, 19 nt, Homo sapiens
gacaguggccacccagcua

SEQ ID NO: 466345 - RNA, 19 nt, Homo sapiens
acacgucgaaugccacuuu

SEQ ID NO: 466346 - RNA, 19 nt, Homo sapiens
gacauccgcccaaagguau

SEQ ID NO: 466347 - RNA, 19 nt, Homo sapiens
cccaggagcgcuauuuauu

SEQ ID NO: 466348 - RNA, 19 nt, Homo sapiens
gggcuccuauuucaugauc

SEQ ID NO: 466349 - RNA, 19 nt, Homo sapiens
agacagcuguaguggacaa

SEQ ID NO: 466350 - RNA, 19 nt, Homo sapiens
gacaaguacaugacugaga

SEQ ID NO: 466351 - RNA, 19 nt, Homo sapiens
gcgauggugucagcaggaa

SEQ ID NO: 466352 - RNA, 19 nt, Homo sapiens
gaucuggcucagucuacua

SEQ ID NO: 466353 - RNA, 19 nt, Homo sapiens
gggacaaguacaugacuga

SEQ ID NO: 466354 - RNA, 19 nt, Homo sapiens
gcugacaagauccagauga

SEQ ID NO: 466355 - RNA, 19 nt, Homo sapiens
gagaagcccagcuggucaa

SEQ ID NO: 466356 - RNA, 19 nt, Homo sapiens
cugugaagcucaaugaagu

SEQ ID NO: 466357 - RNA, 19 nt, Homo sapiens
ccgagcagaccaucaagaa

SEQ ID NO: 466358 - RNA, 19 nt, Homo sapiens
ucaugacccuggugguguu

SEQ ID NO: 466359 - RNA, 19 nt, Homo sapiens
aaugccacuuugaacaaua

SEQ ID NO: 466360 - RNA, 19 nt, Homo sapiens
gcccaggagcgcuauuuau

SEQ ID NO: 466361 - RNA, 19 nt, Homo sapiens
gaagucaucaccaucuacu

SEQ ID NO: 466362 - RNA, 19 nt, Homo sapiens
guacuucagcagugugguu

SEQ ID NO: 466363 - RNA, 19 nt, Homo sapiens
acacugcugugaagcucaa

SEQ ID NO: 466364 - RNA, 19 nt, Homo sapiens
cuacaaauacaucgaguac

SEQ ID NO: 466365 - RNA, 19 nt, Homo sapiens
acauuaagccggaccaauc

SEQ ID NO: 466366 - RNA, 19 nt, Homo sapiens
cgggagcuggugcacauua

SEQ ID NO: 466367 - RNA, 19 nt, Homo sapiens
gccuggcccuuauguuugu

SEQ ID NO: 466368 - RNA, 19 nt, Homo sapiens
cgucgaaugccacuuugaa

SEQ ID NO: 466369 - RNA, 19 nt, Homo sapiens
ugagugccaucgccaccaa

SEQ ID NO: 466370 - RNA, 19 nt, Homo sapiens
gcuacaggcccuccucauc

SEQ ID NO: 466371 - RNA, 19 nt, Homo sapiens
ggaccagggacaaguacau

SEQ ID NO: 466372 - RNA, 19 nt, Homo sapiens
cuaccuggagggccacaua

SEQ ID NO: 466373 - RNA, 19 nt, Homo sapiens
cugccuggcccuuauguuu

SEQ ID NO: 466374 - RNA, 19 nt, Homo sapiens
ugugcuaccuguucgugaa

SEQ ID NO: 466375 - RNA, 19 nt, Homo sapiens
ucucuuuggugccugcauu

SEQ ID NO: 466376 - RNA, 19 nt, Homo sapiens
cagcagugugguucucuuu

SEQ ID NO: 466377 - RNA, 19 nt, Homo sapiens
ucgcugacaucgccacauc

SEQ ID NO: 466378 - RNA, 19 nt, Homo sapiens
guacguggucgcugacauc

SEQ ID NO: 466379 - RNA, 19 nt, Homo sapiens
gaaccuggcacuguuugag

SEQ ID NO: 466380 - RNA, 19 nt, Homo sapiens
uuauccauguucuuucuga

SEQ ID NO: 466381 - RNA, 19 nt, Homo sapiens
gcuaugauuugcacuauua

SEQ ID NO: 466382 - RNA, 19 nt, Homo sapiens
aaaguaaggugcacaguua

SEQ ID NO: 466383 - RNA, 19 nt, Homo sapiens
gaaaacugcugacguauua

SEQ ID NO: 466384 - RNA, 19 nt, Homo sapiens
gagcauuuguuucaucuua

SEQ ID NO: 466385 - RNA, 19 nt, Homo sapiens
ggaguuaucuguuuagcaa

SEQ ID NO: 466386 - RNA, 19 nt, Homo sapiens
ccaauaagguaucaagaaa

SEQ ID NO: 466387 - RNA, 19 nt, Homo sapiens
gggcugcuauucuuucuua

SEQ ID NO: 466388 - RNA, 19 nt, Homo sapiens
ucaguuacauucugguuua

SEQ ID NO: 466389 - RNA, 19 nt, Homo sapiens
gagauuagagcauuuguuu

SEQ ID NO: 466390 - RNA, 19 nt, Homo sapiens
gaaaagaacucaggcauga

SEQ ID NO: 466391 - RNA, 19 nt, Homo sapiens
guaaugagaccaugccaua

SEQ ID NO: 466392 - RNA, 19 nt, Homo sapiens
ggauaaggcuugcuaugau

SEQ ID NO: 466393 - RNA, 19 nt, Homo sapiens
aaggaaagcugaacacuau

SEQ ID NO: 466394 - RNA, 19 nt, Homo sapiens
gauaaggcuugcuaugauu

SEQ ID NO: 466395 - RNA, 19 nt, Homo sapiens
uuaaggagauguucaaaug

SEQ ID NO: 466396 - RNA, 19 nt, Homo sapiens
ucaaagagauuagagcauu

SEQ ID NO: 466397 - RNA, 19 nt, Homo sapiens
caggagaaauuguugcuuu

SEQ ID NO: 466398 - RNA, 19 nt, Homo sapiens
gaugaugguugguguaaau

SEQ ID NO: 466399 - RNA, 19 nt, Homo sapiens
ggaagacauuaaugauuga

SEQ ID NO: 466400 - RNA, 19 nt, Homo sapiens
ggaaagcugaacacuauaa

SEQ ID NO: 466401 - RNA, 19 nt, Homo sapiens
caaagagauuagagcauuu

SEQ ID NO: 466402 - RNA, 19 nt, Homo sapiens
ggauauagccauucuuguu

SEQ ID NO: 466403 - RNA, 19 nt, Homo sapiens
ccacucagaugacuuacuu

SEQ ID NO: 466404 - RNA, 19 nt, Homo sapiens
uggaagacauuaaugauug

SEQ ID NO: 466405 - RNA, 19 nt, Homo sapiens
uguuugaccucuacacuua

SEQ ID NO: 466406 - RNA, 19 nt, Homo sapiens
gcaaauccacccaaugcua

SEQ ID NO: 466407 - RNA, 19 nt, Homo sapiens
ccaaauaucgaacaaagaa

SEQ ID NO: 466408 - RNA, 19 nt, Homo sapiens
gaucaucaaugcagaagca

SEQ ID NO: 466409 - RNA, 19 nt, Homo sapiens
gauguuauaucacagcaau

SEQ ID NO: 466410 - RNA, 19 nt, Homo sapiens
gcacaaaauuucugacuau

SEQ ID NO: 466411 - RNA, 19 nt, Homo sapiens
caugugaacccucuuuaua

SEQ ID NO: 466412 - RNA, 19 nt, Homo sapiens
ccagagaauuugcugagaa

SEQ ID NO: 466413 - RNA, 19 nt, Homo sapiens
ucugauaucuucuuugaug

SEQ ID NO: 466414 - RNA, 19 nt, Homo sapiens
ggacaugaaauaaaugaga

SEQ ID NO: 466415 - RNA, 19 nt, Homo sapiens
cagagaauuugcugagaaa

SEQ ID NO: 466416 - RNA, 19 nt, Homo sapiens
gauuagagcauuuguuuca

SEQ ID NO: 466417 - RNA, 19 nt, Homo sapiens
uaacugagguagccagcaa

SEQ ID NO: 466418 - RNA, 19 nt, Homo sapiens
cagcuuugcuaccuaguuu

SEQ ID NO: 466419 - RNA, 19 nt, Homo sapiens
cuaaguggauaggaaauaa

SEQ ID NO: 466420 - RNA, 19 nt, Homo sapiens
uaaaugagaggaaagagaa

SEQ ID NO: 466421 - RNA, 19 nt, Homo sapiens
gaagguggcaucugcuuau

SEQ ID NO: 466422 - RNA, 19 nt, Homo sapiens
guagacagguagcaaaaua

SEQ ID NO: 466423 - RNA, 19 nt, Homo sapiens
gauauuggcacacugagaa

SEQ ID NO: 466424 - RNA, 19 nt, Homo sapiens
uuaauucgguacuuggaua

SEQ ID NO: 466425 - RNA, 19 nt, Homo sapiens
gaaaccugcugguauaacu

SEQ ID NO: 466426 - RNA, 19 nt, Homo sapiens
cagcauggcuaauaauucu

SEQ ID NO: 466427 - RNA, 19 nt, Homo sapiens
gauauagccauucuuguug

SEQ ID NO: 466428 - RNA, 19 nt, Homo sapiens
aaucauuucugcauuguug

SEQ ID NO: 466429 - RNA, 19 nt, Homo sapiens
cccgaaaccugcugguaua

SEQ ID NO: 466430 - RNA, 19 nt, Homo sapiens
gguuaaagcuggacuuggu

SEQ ID NO: 466431 - RNA, 19 nt, Homo sapiens
ugugaacccucuuuauauu

SEQ ID NO: 466432 - RNA, 19 nt, Homo sapiens
caagcaagguggaguugga

SEQ ID NO: 466433 - RNA, 19 nt, Homo sapiens
gguggcaucugcuuauuuc

SEQ ID NO: 466434 - RNA, 19 nt, Homo sapiens
uuaccagcauggcuaauaa

SEQ ID NO: 466435 - RNA, 19 nt, Homo sapiens
ugauuacucuccacugauu

SEQ ID NO: 466436 - RNA, 19 nt, Homo sapiens
gcuaccuaguuuaauguua

SEQ ID NO: 466437 - RNA, 19 nt, Homo sapiens
gaaagcugaacacuauaaa

SEQ ID NO: 466438 - RNA, 19 nt, Homo sapiens
ucagaguccauauuuguua

SEQ ID NO: 466439 - RNA, 19 nt, Homo sapiens
cagcuaagacacugacuaa

SEQ ID NO: 466440 - RNA, 19 nt, Homo sapiens
uaauggcucugcuaugguu

SEQ ID NO: 466441 - RNA, 19 nt, Homo sapiens
uauaauggcucugcuaugg

SEQ ID NO: 466442 - RNA, 19 nt, Homo sapiens
ggaauuugcacaagagaau

SEQ ID NO: 466443 - RNA, 19 nt, Homo sapiens
caauuacccugaugugaca

SEQ ID NO: 466444 - RNA, 19 nt, Homo sapiens
ccuuaucauucuacucuua

SEQ ID NO: 466445 - RNA, 19 nt, Homo sapiens
agaaugaguuuccaauuac

SEQ ID NO: 466446 - RNA, 19 nt, Homo sapiens
ggacuuggugucaacauug

SEQ ID NO: 466447 - RNA, 19 nt, Homo sapiens
caauaaugauacagggaaa

SEQ ID NO: 466448 - RNA, 19 nt, Homo sapiens
caaaguaaggugcacaguu

SEQ ID NO: 466449 - RNA, 19 nt, Homo sapiens
ugaguaacaacuuugcuua

SEQ ID NO: 466450 - RNA, 19 nt, Homo sapiens
caacuugcuucaucauaag

SEQ ID NO: 466451 - RNA, 19 nt, Homo sapiens
cauauguacuuggauugua

SEQ ID NO: 466452 - RNA, 19 nt, Homo sapiens
gacuagaaauugaugaaag

SEQ ID NO: 466453 - RNA, 19 nt, Homo sapiens
caaccacggacuagaaauu

SEQ ID NO: 466454 - RNA, 19 nt, Homo sapiens
cugcuuauuucaaggauuu

SEQ ID NO: 466455 - RNA, 19 nt, Homo sapiens
ugguguagcugcugcaauu

SEQ ID NO: 466456 - RNA, 19 nt, Homo sapiens
gguaauuucuggaagacau

SEQ ID NO: 466457 - RNA, 19 nt, Homo sapiens
ugaggagucuggauuaucu

SEQ ID NO: 466458 - RNA, 19 nt, Homo sapiens
agaugcagauguuauauca

SEQ ID NO: 466459 - RNA, 19 nt, Homo sapiens
gaagugaggaugcguaaaa

SEQ ID NO: 466460 - RNA, 19 nt, Homo sapiens
gaguaacaacuuugcuuaa

SEQ ID NO: 466461 - RNA, 19 nt, Homo sapiens
ccaaaauuauggcugaaua

SEQ ID NO: 466462 - RNA, 19 nt, Homo sapiens
caguuggaguucaauguaa

SEQ ID NO: 466463 - RNA, 19 nt, Homo sapiens
guaacagcuuugcuaccua

SEQ ID NO: 466464 - RNA, 19 nt, Homo sapiens
gagcaucuaugugccuuca

SEQ ID NO: 466465 - RNA, 19 nt, Homo sapiens
gccaauaagguaucaagaa

SEQ ID NO: 466466 - RNA, 19 nt, Homo sapiens
ccaaaacaguccaacaaaa

SEQ ID NO: 466467 - RNA, 19 nt, Homo sapiens
caguauaguuagaaaggaa

SEQ ID NO: 466468 - RNA, 19 nt, Homo sapiens
gagauugaagcacuaauuc

SEQ ID NO: 466469 - RNA, 19 nt, Homo sapiens
gcaucuaugugccuucauc

SEQ ID NO: 466470 - RNA, 19 nt, Homo sapiens
caaauccacccaaugcuau

SEQ ID NO: 466471 - RNA, 19 nt, Homo sapiens
gcucugcuaugguuuaguc

SEQ ID NO: 466472 - RNA, 19 nt, Homo sapiens
caacuuuggaucaugguuu

SEQ ID NO: 466473 - RNA, 19 nt, Homo sapiens
caaaaccaguuccaggaua

SEQ ID NO: 466474 - RNA, 19 nt, Homo sapiens
uuagcaacauccauagaaa

SEQ ID NO: 466475 - RNA, 19 nt, Homo sapiens
gugcauuuccucauuuaaa

SEQ ID NO: 466476 - RNA, 19 nt, Homo sapiens
gcauuguuguuccagagaa

SEQ ID NO: 466477 - RNA, 19 nt, Homo sapiens
caacuaaagagcaucuaug

SEQ ID NO: 466478 - RNA, 19 nt, Homo sapiens
uggcauauguacuuggauu

SEQ ID NO: 466479 - RNA, 19 nt, Homo sapiens
cgauuucucuucgugguuu

SEQ ID NO: 466480 - RNA, 19 nt, Homo sapiens
ggacuagaaauugaugaaa

SEQ ID NO: 466481 - RNA, 19 nt, Homo sapiens
gcaaaggucagaaugcuua

SEQ ID NO: 466482 - RNA, 19 nt, Homo sapiens
gggcaucuccugcuacuua

SEQ ID NO: 466483 - RNA, 19 nt, Homo sapiens
gcacuaagacuggaaugua

SEQ ID NO: 466484 - RNA, 19 nt, Homo sapiens
gaacuugccaaccagcuua

SEQ ID NO: 466485 - RNA, 19 nt, Homo sapiens
ucaaagugcuccaacagaa

SEQ ID NO: 466486 - RNA, 19 nt, Homo sapiens
uauaaagacugaaggcaaa

SEQ ID NO: 466487 - RNA, 19 nt, Homo sapiens
ugaaagaacuugccaacca

SEQ ID NO: 466488 - RNA, 19 nt, Homo sapiens
gaugugcucugguauggaa

SEQ ID NO: 466489 - RNA, 19 nt, Homo sapiens
ccacaaaugcauagaauug

SEQ ID NO: 466490 - RNA, 19 nt, Homo sapiens
gcucugguauggaauuuga

SEQ ID NO: 466491 - RNA, 19 nt, Homo sapiens
ggucauaccuauaacuaca

SEQ ID NO: 466492 - RNA, 19 nt, Homo sapiens
aaacuggucauaccuauaa

SEQ ID NO: 466493 - RNA, 19 nt, Homo sapiens
ccaaccagcuuaaagacaa

SEQ ID NO: 466494 - RNA, 19 nt, Homo sapiens
gaaauaaagggcugagugu

SEQ ID NO: 466495 - RNA, 19 nt, Homo sapiens
cagcuagaguggucuuuaa

SEQ ID NO: 466496 - RNA, 19 nt, Homo sapiens
guaccuggcccuucuguuu

SEQ ID NO: 466497 - RNA, 19 nt, Homo sapiens
caggacaggucauuaauag

SEQ ID NO: 466498 - RNA, 19 nt, Homo sapiens
ggaggugggcaaaucuuua

SEQ ID NO: 466499 - RNA, 19 nt, Homo sapiens
ggacaagggagacuauuuc

SEQ ID NO: 466500 - RNA, 19 nt, Homo sapiens
ugacaagagugaaacugaa

SEQ ID NO: 466501 - RNA, 19 nt, Homo sapiens
auacucagcuuaggcauuu

SEQ ID NO: 466502 - RNA, 19 nt, Homo sapiens
guccaugacuugcccaauu

SEQ ID NO: 466503 - RNA, 19 nt, Homo sapiens
ggacaggucauuaauagca

SEQ ID NO: 466504 - RNA, 19 nt, Homo sapiens
caggugaugugcucuggua

SEQ ID NO: 466505 - RNA, 19 nt, Homo sapiens
uaacuacagcuccaaauau

SEQ ID NO: 466506 - RNA, 19 nt, Homo sapiens
gcagugagcuaagauugca

SEQ ID NO: 466507 - RNA, 19 nt, Homo sapiens
ucgaugauguuaacaguau

SEQ ID NO: 466508 - RNA, 19 nt, Homo sapiens
ucacgaguaucaacuuuca

SEQ ID NO: 466509 - RNA, 19 nt, Homo sapiens
ucuguaaucuguucuuaug

SEQ ID NO: 466510 - RNA, 19 nt, Homo sapiens
gagguuggauugccagcuu

SEQ ID NO: 466511 - RNA, 19 nt, Homo sapiens
cuuaaccuguucuuacaua

SEQ ID NO: 466512 - RNA, 19 nt, Homo sapiens
ccuuucaacuccaggaaua

SEQ ID NO: 466513 - RNA, 19 nt, Homo sapiens
ccaaacuggucauaccuau

SEQ ID NO: 466514 - RNA, 19 nt, Homo sapiens
caaccugggugacaagagu

SEQ ID NO: 466515 - RNA, 19 nt, Homo sapiens
acaauggccugcacccuau

SEQ ID NO: 466516 - RNA, 19 nt, Homo sapiens
ucagugcccuggaguuguu

SEQ ID NO: 466517 - RNA, 19 nt, Homo sapiens
caaccagcuuaaagacaaa

SEQ ID NO: 466518 - RNA, 19 nt, Homo sapiens
ugacgcgucuguaaucugu

SEQ ID NO: 466519 - RNA, 19 nt, Homo sapiens
gauuauagagccagaggaa

SEQ ID NO: 466520 - RNA, 19 nt, Homo sapiens
ccaggacaggucauuaaua

SEQ ID NO: 466521 - RNA, 19 nt, Homo sapiens
cacuaagacuggaauguau

SEQ ID NO: 466522 - RNA, 19 nt, Homo sapiens
ggugaaacccuguaucuac

SEQ ID NO: 466523 - RNA, 19 nt, Homo sapiens
guuccuggcuuaaccuguu

SEQ ID NO: 466524 - RNA, 19 nt, Homo sapiens
caagagggagaaaggaauu

SEQ ID NO: 466525 - RNA, 19 nt, Homo sapiens
gcaaugggaggaauguuca

SEQ ID NO: 466526 - RNA, 19 nt, Homo sapiens
gaaggcaaaggucagaaug

SEQ ID NO: 466527 - RNA, 19 nt, Homo sapiens
cauuugaggaugucuuaua

SEQ ID NO: 466528 - RNA, 19 nt, Homo sapiens
uccaugacuugcccaauuu

SEQ ID NO: 466529 - RNA, 19 nt, Homo sapiens
gcucgaugauguuaacagu

SEQ ID NO: 466530 - RNA, 19 nt, Homo sapiens
gcaagagggagaaaggaau

SEQ ID NO: 466531 - RNA, 19 nt, Homo sapiens
cgucuguaaucuguucuua

SEQ ID NO: 466532 - RNA, 19 nt, Homo sapiens
gcaaguacaccauuauagc

SEQ ID NO: 466533 - RNA, 19 nt, Homo sapiens
caaacuggucauaccuaua

SEQ ID NO: 466534 - RNA, 19 nt, Homo sapiens
ggcuuaaccuguucuuaca

SEQ ID NO: 466535 - RNA, 19 nt, Homo sapiens
aaucgaaguuaacccagaa

SEQ ID NO: 466536 - RNA, 19 nt, Homo sapiens
gaggugggcaaaucuuuau

SEQ ID NO: 466537 - RNA, 19 nt, Homo sapiens
gaucuauggcugugauaau

SEQ ID NO: 466538 - RNA, 19 nt, Homo sapiens
caacagaaggaggaaguga

SEQ ID NO: 466539 - RNA, 19 nt, Homo sapiens
ggcaucuccugcuacuuaa

SEQ ID NO: 466540 - RNA, 19 nt, Homo sapiens
gggaguuggucagaucuau

SEQ ID NO: 466541 - RNA, 19 nt, Homo sapiens
gcccuggaguuguugaaau

SEQ ID NO: 466542 - RNA, 19 nt, Homo sapiens
gaaaggaauuuugucaauc

SEQ ID NO: 466543 - RNA, 19 nt, Homo sapiens
caaccuaagccuauggaau

SEQ ID NO: 466544 - RNA, 19 nt, Homo sapiens
uuagcuggcucgaugaugu

SEQ ID NO: 466545 - RNA, 19 nt, Homo sapiens
gugccugcaugcugccaua

SEQ ID NO: 466546 - RNA, 19 nt, Homo sapiens
auaacuacagcuccaaaua

SEQ ID NO: 466547 - RNA, 19 nt, Homo sapiens
aggaagagauagccaugga

SEQ ID NO: 466548 - RNA, 19 nt, Homo sapiens
ggagaaguuccuggcuuaa

SEQ ID NO: 466549 - RNA, 19 nt, Homo sapiens
ugugugacauucucucaug

SEQ ID NO: 466550 - RNA, 19 nt, Homo sapiens
gaucauugcugggcauagc

SEQ ID NO: 466551 - RNA, 19 nt, Homo sapiens
ggaguuguugaaaucuaua

SEQ ID NO: 466552 - RNA, 19 nt, Homo sapiens
caagugcauugaauuccau

SEQ ID NO: 466553 - RNA, 19 nt, Homo sapiens
gugacaagagugaaacuga

SEQ ID NO: 466554 - RNA, 19 nt, Homo sapiens
uugaggaugucuuauaaag

SEQ ID NO: 466555 - RNA, 19 nt, Homo sapiens
acagaaggaggaagugaaa

SEQ ID NO: 466556 - RNA, 19 nt, Homo sapiens
ucagaucuauggcugugau

SEQ ID NO: 466557 - RNA, 19 nt, Homo sapiens
gacaagagugaaacugaau

SEQ ID NO: 466558 - RNA, 19 nt, Homo sapiens
cauacugacgcgucuguaa

SEQ ID NO: 466559 - RNA, 19 nt, Homo sapiens
acgaguaucaacuuucaua

SEQ ID NO: 466560 - RNA, 19 nt, Homo sapiens
cacccucccuuucaacaug

SEQ ID NO: 466561 - RNA, 19 nt, Homo sapiens
ccagcuagaguggucuuua

SEQ ID NO: 466562 - RNA, 19 nt, Homo sapiens
cacaauauucucucucaga

SEQ ID NO: 466563 - RNA, 19 nt, Homo sapiens
aaacccaaccuaagccuau

SEQ ID NO: 466564 - RNA, 19 nt, Homo sapiens
uuauagagccagaggaaga

SEQ ID NO: 466565 - RNA, 19 nt, Homo sapiens
acauuacaauccguucuuu

SEQ ID NO: 466566 - RNA, 19 nt, Homo sapiens
ccaggaagccagcuagagu

SEQ ID NO: 466567 - RNA, 19 nt, Homo sapiens
guucacggccuaucuugga

SEQ ID NO: 466568 - RNA, 19 nt, Homo sapiens
gcgggcagauugcuugaac

SEQ ID NO: 466569 - RNA, 19 nt, Homo sapiens
ccuguaaucccagcacuuu

SEQ ID NO: 466570 - RNA, 19 nt, Homo sapiens
ugccacaaaugcauagaau

SEQ ID NO: 466571 - RNA, 19 nt, Homo sapiens
gcuuguaccuggcccuucu

SEQ ID NO: 466572 - RNA, 19 nt, Homo sapiens
uggaguuguugaaaucuau

SEQ ID NO: 466573 - RNA, 19 nt, Homo sapiens
aacuacagcuccaaauauc

SEQ ID NO: 466574 - RNA, 19 nt, Homo sapiens
gacauuacaauccguucuu

SEQ ID NO: 466575 - RNA, 19 nt, Homo sapiens
aaccuaagccuauggaauc

SEQ ID NO: 466576 - RNA, 19 nt, Homo sapiens
gugaugugcucugguaugg

SEQ ID NO: 466577 - RNA, 19 nt, Homo sapiens
uuucacgaguaucaacuuu

SEQ ID NO: 466578 - RNA, 19 nt, Homo sapiens
ugacugcuccagcuaacuu

SEQ ID NO: 466579 - RNA, 19 nt, Homo sapiens
gcuguuacucccuguaugu

SEQ ID NO: 466580 - RNA, 19 nt, Homo sapiens
gguaggacuucuuguucag

SEQ ID NO: 466581 - RNA, 19 nt, Homo sapiens
gaaacgaaguccaaauuaa

SEQ ID NO: 466582 - RNA, 19 nt, Homo sapiens
ggacugggcuaaagagaaa

SEQ ID NO: 466583 - RNA, 19 nt, Homo sapiens
ucaguaagcuccauuaaug

SEQ ID NO: 466584 - RNA, 19 nt, Homo sapiens
aaucggagcucuugaaauu

SEQ ID NO: 466585 - RNA, 19 nt, Homo sapiens
gaaguuugcuuuccacaau

SEQ ID NO: 466586 - RNA, 19 nt, Homo sapiens
acaauaagcucaacagaga

SEQ ID NO: 466587 - RNA, 19 nt, Homo sapiens
cggcucaucucccaaauua

SEQ ID NO: 466588 - RNA, 19 nt, Homo sapiens
gcagugggauguacaagaa

SEQ ID NO: 466589 - RNA, 19 nt, Homo sapiens
ggaaacgaaguccaaauua

SEQ ID NO: 466590 - RNA, 19 nt, Homo sapiens
gcucagaguucaacaaugu

SEQ ID NO: 466591 - RNA, 19 nt, Homo sapiens
gaagguguuugaagauauu

SEQ ID NO: 466592 - RNA, 19 nt, Homo sapiens
guaacaaaguuuccuauuc

SEQ ID NO: 466593 - RNA, 19 nt, Homo sapiens
ggagaucgaagcucaauuu

SEQ ID NO: 466594 - RNA, 19 nt, Homo sapiens
uaacauggcucugcaaauc

SEQ ID NO: 466595 - RNA, 19 nt, Homo sapiens
cagcugguauuaacugaua

SEQ ID NO: 466596 - RNA, 19 nt, Homo sapiens
ggaaacaauaccaugaaua

SEQ ID NO: 466597 - RNA, 19 nt, Homo sapiens
ggauuggaauucucauauu

SEQ ID NO: 466598 - RNA, 19 nt, Homo sapiens
uaaacaaacugacaaggau

SEQ ID NO: 466599 - RNA, 19 nt, Homo sapiens
caaaguuuccuauuccaua

SEQ ID NO: 466600 - RNA, 19 nt, Homo sapiens
gaagauauuucagccaaca

SEQ ID NO: 466601 - RNA, 19 nt, Homo sapiens
ugacaaggauaaacauuuc

SEQ ID NO: 466602 - RNA, 19 nt, Homo sapiens
ucacacaguuucuuugguu

SEQ ID NO: 466603 - RNA, 19 nt, Homo sapiens
caucauggcucgguucuau

SEQ ID NO: 466604 - RNA, 19 nt, Homo sapiens
gaaggccgaguaaugauuu

SEQ ID NO: 466605 - RNA, 19 nt, Homo sapiens
gugaagguguuugaagaua

SEQ ID NO: 466606 - RNA, 19 nt, Homo sapiens
uaacaaaguuuccuauucc

SEQ ID NO: 466607 - RNA, 19 nt, Homo sapiens
ggagagauggugacacuug

SEQ ID NO: 466608 - RNA, 19 nt, Homo sapiens
ucacagaccacaaccauga

SEQ ID NO: 466609 - RNA, 19 nt, Homo sapiens
caaaucacacaguuucuuu

SEQ ID NO: 466610 - RNA, 19 nt, Homo sapiens
gcaaacagugggccgagua

SEQ ID NO: 466611 - RNA, 19 nt, Homo sapiens
guaaacaaacugacaagga

SEQ ID NO: 466612 - RNA, 19 nt, Homo sapiens
acugauaacuuuaccuuug

SEQ ID NO: 466613 - RNA, 19 nt, Homo sapiens
uaacccauauuucauguca

SEQ ID NO: 466614 - RNA, 19 nt, Homo sapiens
gguaaaggauggucuuaac

SEQ ID NO: 466615 - RNA, 19 nt, Homo sapiens
gauaagggccagcugguau

SEQ ID NO: 466616 - RNA, 19 nt, Homo sapiens
uaacuuuaccuuuggguuu

SEQ ID NO: 466617 - RNA, 19 nt, Homo sapiens
guacacacacugucuuaga

SEQ ID NO: 466618 - RNA, 19 nt, Homo sapiens
caaaggaaacgaaguccaa

SEQ ID NO: 466619 - RNA, 19 nt, Homo sapiens
ggugaaggccgaguaauga

SEQ ID NO: 466620 - RNA, 19 nt, Homo sapiens
gugggaaaguuuaugcaaa

SEQ ID NO: 466621 - RNA, 19 nt, Homo sapiens
cuaaagagaaauacgauga

SEQ ID NO: 466622 - RNA, 19 nt, Homo sapiens
aaagugaacguacagguuu

SEQ ID NO: 466623 - RNA, 19 nt, Homo sapiens
cauaaaaggcuucacaaua

SEQ ID NO: 466624 - RNA, 19 nt, Homo sapiens
ggaauucacaguaaacaag

SEQ ID NO: 466625 - RNA, 19 nt, Homo sapiens
ggagaaacaaagaaacaga

SEQ ID NO: 466626 - RNA, 19 nt, Homo sapiens
ggaaaguucaagaccauug

SEQ ID NO: 466627 - RNA, 19 nt, Homo sapiens
ccaauucucggagcucuua

SEQ ID NO: 466628 - RNA, 19 nt, Homo sapiens
ccaaagugcugggauuaca

SEQ ID NO: 466629 - RNA, 19 nt, Homo sapiens
ugaagguguuugaagauau

SEQ ID NO: 466630 - RNA, 19 nt, Homo sapiens
cccaaugucucaaacaaau

SEQ ID NO: 466631 - RNA, 19 nt, Homo sapiens
ggaaucaaacccugugugu

SEQ ID NO: 466632 - RNA, 19 nt, Homo sapiens
ggaaaagaguaacccauau

SEQ ID NO: 466633 - RNA, 19 nt, Homo sapiens
uggcucgguucuauacuua

SEQ ID NO: 466634 - RNA, 19 nt, Homo sapiens
guucaacaauguggaauuc

SEQ ID NO: 466635 - RNA, 19 nt, Homo sapiens
ccauacuguucauuucuaa

SEQ ID NO: 466636 - RNA, 19 nt, Homo sapiens
gaagugaagguguuugaag

SEQ ID NO: 466637 - RNA, 19 nt, Homo sapiens
gcaaacaucagcagcuaca

SEQ ID NO: 466638 - RNA, 19 nt, Homo sapiens
gaaauucagcccgaucaga

SEQ ID NO: 466639 - RNA, 19 nt, Homo sapiens
ccaccacgcccagcuauuu

SEQ ID NO: 466640 - RNA, 19 nt, Homo sapiens
cgagggugauguuccugua

SEQ ID NO: 466641 - RNA, 19 nt, Homo sapiens
uauuaaugcuggaaguuug

SEQ ID NO: 466642 - RNA, 19 nt, Homo sapiens
gacaagcagucaccucagu

SEQ ID NO: 466643 - RNA, 19 nt, Homo sapiens
ggaacuaaaccaugaaugc

SEQ ID NO: 466644 - RNA, 19 nt, Homo sapiens
caacaucauugugcucauc

SEQ ID NO: 466645 - RNA, 19 nt, Homo sapiens
cacaaugucaaccuaauuu

SEQ ID NO: 466646 - RNA, 19 nt, Homo sapiens
acaaugagugggaaaguuu

SEQ ID NO: 466647 - RNA, 19 nt, Homo sapiens
gcucaucucccaaauuaag

SEQ ID NO: 466648 - RNA, 19 nt, Homo sapiens
cgaaaacuauucuaaagga

SEQ ID NO: 466649 - RNA, 19 nt, Homo sapiens
gaauuugguagugcuuaua

SEQ ID NO: 466650 - RNA, 19 nt, Homo sapiens
uuaacgagcucaucaccau

SEQ ID NO: 466651 - RNA, 19 nt, Homo sapiens
gaacguacagguuuaaaau

SEQ ID NO: 466652 - RNA, 19 nt, Homo sapiens
gaaaagaguaacccauauu

SEQ ID NO: 466653 - RNA, 19 nt, Homo sapiens
gggauuggaauucucauau

SEQ ID NO: 466654 - RNA, 19 nt, Homo sapiens
gcccugaagugaagguguu

SEQ ID NO: 466655 - RNA, 19 nt, Homo sapiens
gcucaucaccaucacaaug

SEQ ID NO: 466656 - RNA, 19 nt, Homo sapiens
aaacaaacugacaaggaua

SEQ ID NO: 466657 - RNA, 19 nt, Homo sapiens
ggcccaaugucucaaacaa

SEQ ID NO: 466658 - RNA, 19 nt, Homo sapiens
ggaaaucgauaaaacucuu

SEQ ID NO: 466659 - RNA, 19 nt, Homo sapiens
gcagguggaaaucgauaaa

SEQ ID NO: 466660 - RNA, 19 nt, Homo sapiens
caagcagucaccucaguaa

SEQ ID NO: 466661 - RNA, 19 nt, Homo sapiens
gguaacaaaguuuccuauu

SEQ ID NO: 466662 - RNA, 19 nt, Homo sapiens
cuucagaauugggaacuaa

SEQ ID NO: 466663 - RNA, 19 nt, Homo sapiens
aagaguaacccauauuuca

SEQ ID NO: 466664 - RNA, 19 nt, Homo sapiens
caaugagugggaaaguuua

SEQ ID NO: 466665 - RNA, 19 nt, Homo sapiens
cacacaguuucuuugguua

SEQ ID NO: 466666 - RNA, 19 nt, Homo sapiens
aagugaagguguuugaaga

SEQ ID NO: 466667 - RNA, 19 nt, Homo sapiens
cagcugcccugaagugaag

SEQ ID NO: 466668 - RNA, 19 nt, Homo sapiens
ugaauuugguagugcuuau

SEQ ID NO: 466669 - RNA, 19 nt, Homo sapiens
ccacaaugucaaccuaauu

SEQ ID NO: 466670 - RNA, 19 nt, Homo sapiens
gaaaaucggagcucuugaa

SEQ ID NO: 466671 - RNA, 19 nt, Homo sapiens
guaaggcauuucccaagag

SEQ ID NO: 466672 - RNA, 19 nt, Homo sapiens
gaaaguucaagaccauugu

SEQ ID NO: 466673 - RNA, 19 nt, Homo sapiens
cacacacugucuuagagua

SEQ ID NO: 466674 - RNA, 19 nt, Homo sapiens
gaguaacccauauuucaug

SEQ ID NO: 466675 - RNA, 19 nt, Homo sapiens
aaugacagcugcccugaag

SEQ ID NO: 466676 - RNA, 19 nt, Homo sapiens
aaacugacaaggauaaaca

SEQ ID NO: 466677 - RNA, 19 nt, Homo sapiens
agggugauguuccuguaua

SEQ ID NO: 466678 - RNA, 19 nt, Homo sapiens
gagaaacaaagaaacagau

SEQ ID NO: 466679 - RNA, 19 nt, Homo sapiens
acuaaaccaugaaugcuau

SEQ ID NO: 466680 - RNA, 19 nt, Homo sapiens
cacaaugagugggaaaguu

SEQ ID NO: 466681 - RNA, 19 nt, Homo sapiens
gcagggagcuugauuucua

SEQ ID NO: 466682 - RNA, 19 nt, Homo sapiens
caagagagauagcagcaua

SEQ ID NO: 466683 - RNA, 19 nt, Homo sapiens
gaggagaugugcaauguuu

SEQ ID NO: 466684 - RNA, 19 nt, Homo sapiens
caaagcagcucauuaugga

SEQ ID NO: 466685 - RNA, 19 nt, Homo sapiens
cagcauaucuguuuguuau

SEQ ID NO: 466686 - RNA, 19 nt, Homo sapiens
ggaauuccuuuauagguaa

SEQ ID NO: 466687 - RNA, 19 nt, Homo sapiens
gggaauuccuuuauaggua

SEQ ID NO: 466688 - RNA, 19 nt, Homo sapiens
gaacagaagauaagaacuu

SEQ ID NO: 466689 - RNA, 19 nt, Homo sapiens
gagcuugauuucuacauuu

SEQ ID NO: 466690 - RNA, 19 nt, Homo sapiens
ggacugauggcccuaauuu

SEQ ID NO: 466691 - RNA, 19 nt, Homo sapiens
gaaaauggcuguugguaug

SEQ ID NO: 466692 - RNA, 19 nt, Homo sapiens
gagaggagaugugcaaugu

SEQ ID NO: 466693 - RNA, 19 nt, Homo sapiens
acagauaccucucucaaug

SEQ ID NO: 466694 - RNA, 19 nt, Homo sapiens
ggaauuaacuucucaucac

SEQ ID NO: 466695 - RNA, 19 nt, Homo sapiens
aaauguaucugguuugcua

SEQ ID NO: 466696 - RNA, 19 nt, Homo sapiens
ggagaagacugcuaugcau

SEQ ID NO: 466697 - RNA, 19 nt, Homo sapiens
ugucacaggucuugaguuu

SEQ ID NO: 466698 - RNA, 19 nt, Homo sapiens
gaaagcagaacaaccaaug

SEQ ID NO: 466699 - RNA, 19 nt, Homo sapiens
acaauucucuguugauaga

SEQ ID NO: 466700 - RNA, 19 nt, Homo sapiens
gucaacaucucccugagua

SEQ ID NO: 466701 - RNA, 19 nt, Homo sapiens
ggagcuugauuucuacauu

SEQ ID NO: 466702 - RNA, 19 nt, Homo sapiens
ggaacggacuagauacuuc

SEQ ID NO: 466703 - RNA, 19 nt, Homo sapiens
ccaggcagcuuggcuauug

SEQ ID NO: 466704 - RNA, 19 nt, Homo sapiens
ggaacaugaucaaacuaga

SEQ ID NO: 466705 - RNA, 19 nt, Homo sapiens
guaaggagccagccaugaa

SEQ ID NO: 466706 - RNA, 19 nt, Homo sapiens
ccaccuagcccuccaaaga

SEQ ID NO: 466707 - RNA, 19 nt, Homo sapiens
ccaggguacuauuccuuua

SEQ ID NO: 466708 - RNA, 19 nt, Homo sapiens
cagaggaacggacuagaua

SEQ ID NO: 466709 - RNA, 19 nt, Homo sapiens
ggagaccaguuugaagaaa

SEQ ID NO: 466710 - RNA, 19 nt, Homo sapiens
cuacuacuauguuccugua

SEQ ID NO: 466711 - RNA, 19 nt, Homo sapiens
aacaguaucuccagcauga

SEQ ID NO: 466712 - RNA, 19 nt, Homo sapiens
ugacaguggugggaaauga

SEQ ID NO: 466713 - RNA, 19 nt, Homo sapiens
aaacauaguggcucaaguu

SEQ ID NO: 466714 - RNA, 19 nt, Homo sapiens
ggacugcucaugguaauug

SEQ ID NO: 466715 - RNA, 19 nt, Homo sapiens
ggaauaucaucgugcuugu

SEQ ID NO: 466716 - RNA, 19 nt, Homo sapiens
gaggucauguucucuguca

SEQ ID NO: 466717 - RNA, 19 nt, Homo sapiens
caauguuggugaagacuau

SEQ ID NO: 466718 - RNA, 19 nt, Homo sapiens
gaauuaacuucucaucacu

SEQ ID NO: 466719 - RNA, 19 nt, Homo sapiens
uaauugcacuuguuguguu

SEQ ID NO: 466720 - RNA, 19 nt, Homo sapiens
ucaagacaaucaucuaucu

SEQ ID NO: 466721 - RNA, 19 nt, Homo sapiens
ucugaugacucccuagauu

SEQ ID NO: 466722 - RNA, 19 nt, Homo sapiens
uuauagaacugugcaaaga

SEQ ID NO: 466723 - RNA, 19 nt, Homo sapiens
ugagguuuguuaacacuuu

SEQ ID NO: 466724 - RNA, 19 nt, Homo sapiens
caccugaaauaucacaauu

SEQ ID NO: 466725 - RNA, 19 nt, Homo sapiens
gagcauugccuucauugug

SEQ ID NO: 466726 - RNA, 19 nt, Homo sapiens
caucaugggcuacuacuau

SEQ ID NO: 466727 - RNA, 19 nt, Homo sapiens
gcacugaccaggguacuau

SEQ ID NO: 466728 - RNA, 19 nt, Homo sapiens
gaaacauaguggcucaagu

SEQ ID NO: 466729 - RNA, 19 nt, Homo sapiens
ucagcagccucuguuauuu

SEQ ID NO: 466730 - RNA, 19 nt, Homo sapiens
guccaucagugaacucauu

SEQ ID NO: 466731 - RNA, 19 nt, Homo sapiens
gcugaucuccuccaccuuu

SEQ ID NO: 466732 - RNA, 19 nt, Homo sapiens
ggauuagacaagagagaua

SEQ ID NO: 466733 - RNA, 19 nt, Homo sapiens
gaacuuuucucugaauuug

SEQ ID NO: 466734 - RNA, 19 nt, Homo sapiens
guacagauaccucucucaa

SEQ ID NO: 466735 - RNA, 19 nt, Homo sapiens
gaagccaucuccgacaauc

SEQ ID NO: 466736 - RNA, 19 nt, Homo sapiens
auagguaacugccauuuag

SEQ ID NO: 466737 - RNA, 19 nt, Homo sapiens
gauaagcacauuccucaca

SEQ ID NO: 466738 - RNA, 19 nt, Homo sapiens
caauugcaguugggaauau

SEQ ID NO: 466739 - RNA, 19 nt, Homo sapiens
caguacaucuuuaaacaag

SEQ ID NO: 466740 - RNA, 19 nt, Homo sapiens
agacuuuggugcagcauau

SEQ ID NO: 466741 - RNA, 19 nt, Homo sapiens
acuauggugugucugcuua

SEQ ID NO: 466742 - RNA, 19 nt, Homo sapiens
gguaaaggauacagaaagc

SEQ ID NO: 466743 - RNA, 19 nt, Homo sapiens
gagaagacugcuaugcauu

SEQ ID NO: 466744 - RNA, 19 nt, Homo sapiens
gcagaauaacaaagaaaug

SEQ ID NO: 466745 - RNA, 19 nt, Homo sapiens
gaacaugaucaaacuagag

SEQ ID NO: 466746 - RNA, 19 nt, Homo sapiens
gcagaggaacggacuagau

SEQ ID NO: 466747 - RNA, 19 nt, Homo sapiens
aagcugugcugauccugua

SEQ ID NO: 466748 - RNA, 19 nt, Homo sapiens
aaugaaagcugugcugauc

SEQ ID NO: 466749 - RNA, 19 nt, Homo sapiens
uaugggaauuccuuuauag

SEQ ID NO: 466750 - RNA, 19 nt, Homo sapiens
ggaacaguaucuccagcau

SEQ ID NO: 466751 - RNA, 19 nt, Homo sapiens
caauuugucucucuacacu

SEQ ID NO: 466752 - RNA, 19 nt, Homo sapiens
ccaugaauccuuuccagaa

SEQ ID NO: 466753 - RNA, 19 nt, Homo sapiens
caugguaauugcacuuguu

SEQ ID NO: 466754 - RNA, 19 nt, Homo sapiens
ggccuggugucuccaaaug

SEQ ID NO: 466755 - RNA, 19 nt, Homo sapiens
acaguucaguggccuggua

SEQ ID NO: 466756 - RNA, 19 nt, Homo sapiens
gcagcauaucuguuuguua

SEQ ID NO: 466757 - RNA, 19 nt, Homo sapiens
gaugguaaaggauacagaa

SEQ ID NO: 466758 - RNA, 19 nt, Homo sapiens
gaagacugcuaugcauugg

SEQ ID NO: 466759 - RNA, 19 nt, Homo sapiens
acagugggccgaauucauu

SEQ ID NO: 466760 - RNA, 19 nt, Homo sapiens
cagcaggguucacgaugga

SEQ ID NO: 466761 - RNA, 19 nt, Homo sapiens
aggguacuauuccuuuaua

SEQ ID NO: 466762 - RNA, 19 nt, Homo sapiens
ccaaagcagcucauuaugg

SEQ ID NO: 466763 - RNA, 19 nt, Homo sapiens
acacacaguccuaucauug

SEQ ID NO: 466764 - RNA, 19 nt, Homo sapiens
ggcccugucuugaagcauu

SEQ ID NO: 466765 - RNA, 19 nt, Homo sapiens
caggcucccucuagcauga

SEQ ID NO: 466766 - RNA, 19 nt, Homo sapiens
gcucaaguuuucaaaugua

SEQ ID NO: 466767 - RNA, 19 nt, Homo sapiens
uauagguaacugccauuua

SEQ ID NO: 466768 - RNA, 19 nt, Homo sapiens
ggagagagagagaguaagg

SEQ ID NO: 466769 - RNA, 19 nt, Homo sapiens
ucacaggucuugaguuuuc

SEQ ID NO: 466770 - RNA, 19 nt, Homo sapiens
gaccagaugcagguucuaa

SEQ ID NO: 466771 - RNA, 19 nt, Homo sapiens
uauccaaagcagcucauua

SEQ ID NO: 466772 - RNA, 19 nt, Homo sapiens
cgacacgacuggcuagacu

SEQ ID NO: 466773 - RNA, 19 nt, Homo sapiens
ucaccugucuccauugaag

SEQ ID NO: 466774 - RNA, 19 nt, Homo sapiens
uauggugugucugcuuaua

SEQ ID NO: 466775 - RNA, 19 nt, Homo sapiens
agauaccucucucaauguu

SEQ ID NO: 466776 - RNA, 19 nt, Homo sapiens
gugaagaugggaacaguau

SEQ ID NO: 466777 - RNA, 19 nt, Homo sapiens
gcugagaaauauccaaagc

SEQ ID NO: 466778 - RNA, 19 nt, Homo sapiens
caucagugaacucauuaaa

SEQ ID NO: 466779 - RNA, 19 nt, Homo sapiens
uccaguacaucuuuaaaca

SEQ ID NO: 466780 - RNA, 19 nt, Homo sapiens
gaaugaaagcugugcugau

SEQ ID NO: 466781 - RNA, 19 nt, Homo sapiens
gaaaucaccugguauuauu

SEQ ID NO: 466782 - RNA, 19 nt, Homo sapiens
gaacagaaauauugguuga

SEQ ID NO: 466783 - RNA, 19 nt, Homo sapiens
gcagaaagauauagacauu

SEQ ID NO: 466784 - RNA, 19 nt, Homo sapiens
gaaagaaguugcuaagugu

SEQ ID NO: 466785 - RNA, 19 nt, Homo sapiens
ggaaagaaguugcuaagug

SEQ ID NO: 466786 - RNA, 19 nt, Homo sapiens
gcaguauccuggugaauaa

SEQ ID NO: 466787 - RNA, 19 nt, Homo sapiens
guaaagugcuuaagguuug

SEQ ID NO: 466788 - RNA, 19 nt, Homo sapiens
gcaaauggagugugucaua

SEQ ID NO: 466789 - RNA, 19 nt, Homo sapiens
cuacagaacuacauauuug

SEQ ID NO: 466790 - RNA, 19 nt, Homo sapiens
ggaggaaaguccagucuga

SEQ ID NO: 466791 - RNA, 19 nt, Homo sapiens
agaggaagcuuucuaauuc

SEQ ID NO: 466792 - RNA, 19 nt, Homo sapiens
cuacuaaacugcuguguug

SEQ ID NO: 466793 - RNA, 19 nt, Homo sapiens
gaagagaccaguauagaug

SEQ ID NO: 466794 - RNA, 19 nt, Homo sapiens
gaagacacccuaaacaaga

SEQ ID NO: 466795 - RNA, 19 nt, Homo sapiens
caaagagauugaagguaua

SEQ ID NO: 466796 - RNA, 19 nt, Homo sapiens
gagaggaagcuuucuaauu

SEQ ID NO: 466797 - RNA, 19 nt, Homo sapiens
aaacauuucuucucccaaa

SEQ ID NO: 466798 - RNA, 19 nt, Homo sapiens
guagauuucuggcauaugu

SEQ ID NO: 466799 - RNA, 19 nt, Homo sapiens
gcaaguauuucuacaagag

SEQ ID NO: 466800 - RNA, 19 nt, Homo sapiens
gagggaagguggaccagaa

SEQ ID NO: 466801 - RNA, 19 nt, Homo sapiens
guagagaaauggauucagu

SEQ ID NO: 466802 - RNA, 19 nt, Homo sapiens
gcucagcuccguauuguuu

SEQ ID NO: 466803 - RNA, 19 nt, Homo sapiens
gaccucgaauucaguauuu

SEQ ID NO: 466804 - RNA, 19 nt, Homo sapiens
ccaauaagaccucgaauuc

SEQ ID NO: 466805 - RNA, 19 nt, Homo sapiens
cggcuucucuuaugcauuu

SEQ ID NO: 466806 - RNA, 19 nt, Homo sapiens
uauaucugcuucuagcuua

SEQ ID NO: 466807 - RNA, 19 nt, Homo sapiens
guaauuggagcuuucauuu

SEQ ID NO: 466808 - RNA, 19 nt, Homo sapiens
gcaccaggcaaacgaauaa

SEQ ID NO: 466809 - RNA, 19 nt, Homo sapiens
caaaugaaguuaccaaagc

SEQ ID NO: 466810 - RNA, 19 nt, Homo sapiens
ggaagagucagcauuauuc

SEQ ID NO: 466811 - RNA, 19 nt, Homo sapiens
gauugcagcuucuuucugu

SEQ ID NO: 466812 - RNA, 19 nt, Homo sapiens
caaguaaagugcuuaaggu

SEQ ID NO: 466813 - RNA, 19 nt, Homo sapiens
uaaagcaucccuugagaaa

SEQ ID NO: 466814 - RNA, 19 nt, Homo sapiens
uagaauugcuggaugcauu

SEQ ID NO: 466815 - RNA, 19 nt, Homo sapiens
gagaaggccuuacagaaaa

SEQ ID NO: 466816 - RNA, 19 nt, Homo sapiens
ucacaguggucccauuuau

SEQ ID NO: 466817 - RNA, 19 nt, Homo sapiens
caaauggagugugucauau

SEQ ID NO: 466818 - RNA, 19 nt, Homo sapiens
gaaacgaucagucuuccaa

SEQ ID NO: 466819 - RNA, 19 nt, Homo sapiens
ccaaaucaauuacugucuu

SEQ ID NO: 466820 - RNA, 19 nt, Homo sapiens
guuaaacugugaagcuauu

SEQ ID NO: 466821 - RNA, 19 nt, Homo sapiens
caacacaaagccaauaaga

SEQ ID NO: 466822 - RNA, 19 nt, Homo sapiens
gagaaauggauucaguaua

SEQ ID NO: 466823 - RNA, 19 nt, Homo sapiens
gggcaucaauuaucgacuu

SEQ ID NO: 466824 - RNA, 19 nt, Homo sapiens
gggaaugauugguagcaaa

SEQ ID NO: 466825 - RNA, 19 nt, Homo sapiens
gaaagcaaacgagcagaaa

SEQ ID NO: 466826 - RNA, 19 nt, Homo sapiens
gaccaugauuggcaaguau

SEQ ID NO: 466827 - RNA, 19 nt, Homo sapiens
cgaauucaguauuucuuug

SEQ ID NO: 466828 - RNA, 19 nt, Homo sapiens
gaaauggauucaguauaag

SEQ ID NO: 466829 - RNA, 19 nt, Homo sapiens
agagaaggccuuacagaaa

SEQ ID NO: 466830 - RNA, 19 nt, Homo sapiens
agagagccuuaacuucuua

SEQ ID NO: 466831 - RNA, 19 nt, Homo sapiens
ccaaacaauuaaucaguuc

SEQ ID NO: 466832 - RNA, 19 nt, Homo sapiens
aauguuggcugucauguau

SEQ ID NO: 466833 - RNA, 19 nt, Homo sapiens
caaaucaauuacugucuuc

SEQ ID NO: 466834 - RNA, 19 nt, Homo sapiens
gguugaaaguuagagauuu

SEQ ID NO: 466835 - RNA, 19 nt, Homo sapiens
gaggagggaaugauuggua

SEQ ID NO: 466836 - RNA, 19 nt, Homo sapiens
ccaauagccugaauuugag

SEQ ID NO: 466837 - RNA, 19 nt, Homo sapiens
aaaggaaaguaaagaggaa

SEQ ID NO: 466838 - RNA, 19 nt, Homo sapiens
ggaagacacccuaaacaag

SEQ ID NO: 466839 - RNA, 19 nt, Homo sapiens
ucaaacaucagcugaauuc

SEQ ID NO: 466840 - RNA, 19 nt, Homo sapiens
gaaaucauaccaguuguuc

SEQ ID NO: 466841 - RNA, 19 nt, Homo sapiens
ggaagagaccaguauagau

SEQ ID NO: 466842 - RNA, 19 nt, Homo sapiens
aaacauugauggaccuugu

SEQ ID NO: 466843 - RNA, 19 nt, Homo sapiens
ggaagguggaccagaauga

SEQ ID NO: 466844 - RNA, 19 nt, Homo sapiens
ugagauauguguguguuug

SEQ ID NO: 466845 - RNA, 19 nt, Homo sapiens
guagacagauauuucaaac

SEQ ID NO: 466846 - RNA, 19 nt, Homo sapiens
guauccuggugaauaaaua

SEQ ID NO: 466847 - RNA, 19 nt, Homo sapiens
gggccuugcuaaauugauu

SEQ ID NO: 466848 - RNA, 19 nt, Homo sapiens
ucagguaucuaucucuuca

SEQ ID NO: 466849 - RNA, 19 nt, Homo sapiens
ugacauguauggagacuac

SEQ ID NO: 466850 - RNA, 19 nt, Homo sapiens
gggaagagucagcauuauu

SEQ ID NO: 466851 - RNA, 19 nt, Homo sapiens
gaucagucuuccaaacaau

SEQ ID NO: 466852 - RNA, 19 nt, Homo sapiens
ggaaagauaagucuaaagc

SEQ ID NO: 466853 - RNA, 19 nt, Homo sapiens
cagcugaauucacuuaagu

SEQ ID NO: 466854 - RNA, 19 nt, Homo sapiens
caucuuggcuguucuagac

SEQ ID NO: 466855 - RNA, 19 nt, Homo sapiens
ucaguagauuucuggcaua

SEQ ID NO: 466856 - RNA, 19 nt, Homo sapiens
cauaccaguuguucauuga

SEQ ID NO: 466857 - RNA, 19 nt, Homo sapiens
guaucuaucucuucauugg

SEQ ID NO: 466858 - RNA, 19 nt, Homo sapiens
gagacuacaaauacacaua

SEQ ID NO: 466859 - RNA, 19 nt, Homo sapiens
ugagaaagcuggaaaaucu

SEQ ID NO: 466860 - RNA, 19 nt, Homo sapiens
ggauucaguauaaggauaa

SEQ ID NO: 466861 - RNA, 19 nt, Homo sapiens
gcaaacgaauaaagauagg

SEQ ID NO: 466862 - RNA, 19 nt, Homo sapiens
uagagagccuuaacuucuu

SEQ ID NO: 466863 - RNA, 19 nt, Homo sapiens
caauuacugucuucuucaa

SEQ ID NO: 466864 - RNA, 19 nt, Homo sapiens
gaagguggaccagaaugaa

SEQ ID NO: 466865 - RNA, 19 nt, Homo sapiens
cagagaaggccuuacagaa

SEQ ID NO: 466866 - RNA, 19 nt, Homo sapiens
accaauagccugaauuuga

SEQ ID NO: 466867 - RNA, 19 nt, Homo sapiens
ggaaaucauaccaguuguu

SEQ ID NO: 466868 - RNA, 19 nt, Homo sapiens
ccagaaagacacagaagga

SEQ ID NO: 466869 - RNA, 19 nt, Homo sapiens
ccauuuauaucugcuucua

SEQ ID NO: 466870 - RNA, 19 nt, Homo sapiens
gcugaauucacuuaaguuu

SEQ ID NO: 466871 - RNA, 19 nt, Homo sapiens
caucagcugaauucacuua

SEQ ID NO: 466872 - RNA, 19 nt, Homo sapiens
ugaaaucaccugguauuau

SEQ ID NO: 466873 - RNA, 19 nt, Homo sapiens
cuacuggccuguaaucuac

SEQ ID NO: 466874 - RNA, 19 nt, Homo sapiens
gauauccuccauaauguug

SEQ ID NO: 466875 - RNA, 19 nt, Homo sapiens
caagagaaacgaucagucu

SEQ ID NO: 466876 - RNA, 19 nt, Homo sapiens
gaagucguauagucaugau

SEQ ID NO: 466877 - RNA, 19 nt, Homo sapiens
guggaaaucauaccaguug

SEQ ID NO: 466878 - RNA, 19 nt, Homo sapiens
uaaauugagcaguucauga

SEQ ID NO: 466879 - RNA, 19 nt, Homo sapiens
gaaaguaaagaggaagaga

SEQ ID NO: 466880 - RNA, 19 nt, Homo sapiens
caaaagaacagaaagcaaa

SEQ ID NO: 466881 - RNA, 19 nt, Homo sapiens
ggaaagagacuauuuaaga

SEQ ID NO: 466882 - RNA, 19 nt, Homo sapiens
gaaccaaucuaaugccuuu

SEQ ID NO: 466883 - RNA, 19 nt, Homo sapiens
gcagauggcucuuaagaau

SEQ ID NO: 466884 - RNA, 19 nt, Homo sapiens
ggacccagcuuguuaguca

SEQ ID NO: 466885 - RNA, 19 nt, Homo sapiens
uagcacagcucaccucauu

SEQ ID NO: 466886 - RNA, 19 nt, Homo sapiens
gguaugaucuucuucuguu

SEQ ID NO: 466887 - RNA, 19 nt, Homo sapiens
guuccaaacucauuaacua

SEQ ID NO: 466888 - RNA, 19 nt, Homo sapiens
ugacaggucuauauuucua

SEQ ID NO: 466889 - RNA, 19 nt, Homo sapiens
gaaccucuccauauacuuu

SEQ ID NO: 466890 - RNA, 19 nt, Homo sapiens
caaaggauguucaagaaag

SEQ ID NO: 466891 - RNA, 19 nt, Homo sapiens
cauuaaaggugccaugaaa

SEQ ID NO: 466892 - RNA, 19 nt, Homo sapiens
ccacuucucuccagaugaa

SEQ ID NO: 466893 - RNA, 19 nt, Homo sapiens
gcagugcccuuauuguaug

SEQ ID NO: 466894 - RNA, 19 nt, Homo sapiens
caugaaagguagacucuga

SEQ ID NO: 466895 - RNA, 19 nt, Homo sapiens
gccaggcuguguucaguua

SEQ ID NO: 466896 - RNA, 19 nt, Homo sapiens
uuucagagcucaagacaug

SEQ ID NO: 466897 - RNA, 19 nt, Homo sapiens
gcaccacaguuaaaucuag

SEQ ID NO: 466898 - RNA, 19 nt, Homo sapiens
caugugagcuugugugcuu

SEQ ID NO: 466899 - RNA, 19 nt, Homo sapiens
acacaugggugcuugaaga

SEQ ID NO: 466900 - RNA, 19 nt, Homo sapiens
caugacaggucuauauuuc

SEQ ID NO: 466901 - RNA, 19 nt, Homo sapiens
ggaagaguagaauaucaua

SEQ ID NO: 466902 - RNA, 19 nt, Homo sapiens
cuacugacuucucuccaua

SEQ ID NO: 466903 - RNA, 19 nt, Homo sapiens
ccaggaaagagacuauuua

SEQ ID NO: 466904 - RNA, 19 nt, Homo sapiens
gggcaguaguuauugauau

SEQ ID NO: 466905 - RNA, 19 nt, Homo sapiens
ggccugauguccaugauga

SEQ ID NO: 466906 - RNA, 19 nt, Homo sapiens
gcagcacaguauuaauauu

SEQ ID NO: 466907 - RNA, 19 nt, Homo sapiens
acaguaacuugccaccuua

SEQ ID NO: 466908 - RNA, 19 nt, Homo sapiens
gguagacucugaaccacuu

SEQ ID NO: 466909 - RNA, 19 nt, Homo sapiens
gacuguggcuucccaagaa

SEQ ID NO: 466910 - RNA, 19 nt, Homo sapiens
caagacaugggacauuuaa

SEQ ID NO: 466911 - RNA, 19 nt, Homo sapiens
aagcagcacaguauuaaua

SEQ ID NO: 466912 - RNA, 19 nt, Homo sapiens
agucaaagcuccagguguu

SEQ ID NO: 466913 - RNA, 19 nt, Homo sapiens
uauauucacugaccguuug

SEQ ID NO: 466914 - RNA, 19 nt, Homo sapiens
gcacagcucaccucauuag

SEQ ID NO: 466915 - RNA, 19 nt, Homo sapiens
ggugacugaugccuccuua

SEQ ID NO: 466916 - RNA, 19 nt, Homo sapiens
cuuauuguaugguugguua

SEQ ID NO: 466917 - RNA, 19 nt, Homo sapiens
gaagggaagacauucauag

SEQ ID NO: 466918 - RNA, 19 nt, Homo sapiens
gaagccaucccagccuuua

SEQ ID NO: 466919 - RNA, 19 nt, Homo sapiens
ccaaagaagacaauaguuc

SEQ ID NO: 466920 - RNA, 19 nt, Homo sapiens
ccauguggccuucuacuuu

SEQ ID NO: 466921 - RNA, 19 nt, Homo sapiens
ugacuucucuccauacucu

SEQ ID NO: 466922 - RNA, 19 nt, Homo sapiens
gagauuccagcaaggauaa

SEQ ID NO: 466923 - RNA, 19 nt, Homo sapiens
uuaagaagaucuacuugca

SEQ ID NO: 466924 - RNA, 19 nt, Homo sapiens
uggcucagcucaggaagua

SEQ ID NO: 466925 - RNA, 19 nt, Homo sapiens
cugaguaccuucauguuug

SEQ ID NO: 466926 - RNA, 19 nt, Homo sapiens
caggaaagagacuauuuaa

SEQ ID NO: 466927 - RNA, 19 nt, Homo sapiens
gcccuuggcuacuuuguuc

SEQ ID NO: 466928 - RNA, 19 nt, Homo sapiens
caucugggccuucggaauu

SEQ ID NO: 466929 - RNA, 19 nt, Homo sapiens
caaaagcagcacaguauua

SEQ ID NO: 466930 - RNA, 19 nt, Homo sapiens
caagcuauauaauccuaga

SEQ ID NO: 466931 - RNA, 19 nt, Homo sapiens
cagcaaggauaagauguug

SEQ ID NO: 466932 - RNA, 19 nt, Homo sapiens
cauguggccuucuacuuug

SEQ ID NO: 466933 - RNA, 19 nt, Homo sapiens
cuacuuuguucccuaugua

SEQ ID NO: 466934 - RNA, 19 nt, Homo sapiens
gcugaguaccuucauguuu

SEQ ID NO: 466935 - RNA, 19 nt, Homo sapiens
acaguuaaaucuagaacga

SEQ ID NO: 466936 - RNA, 19 nt, Homo sapiens
ucccaaaucugcccauuca

SEQ ID NO: 466937 - RNA, 19 nt, Homo sapiens
gacaauaguucccacucau

SEQ ID NO: 466938 - RNA, 19 nt, Homo sapiens
ucucugagccuuugucuau

SEQ ID NO: 466939 - RNA, 19 nt, Homo sapiens
ggcaguaguuauugauaug

SEQ ID NO: 466940 - RNA, 19 nt, Homo sapiens
ggucauugccauccauauu

SEQ ID NO: 466941 - RNA, 19 nt, Homo sapiens
agauggcucuuaagaauca

SEQ ID NO: 466942 - RNA, 19 nt, Homo sapiens
ccacuuugaucccucugaa

SEQ ID NO: 466943 - RNA, 19 nt, Homo sapiens
uagaguugcugaugacugu

SEQ ID NO: 466944 - RNA, 19 nt, Homo sapiens
gcaggaggcagaccaggaa

SEQ ID NO: 466945 - RNA, 19 nt, Homo sapiens
aaaggauguucaagaaaga

SEQ ID NO: 466946 - RNA, 19 nt, Homo sapiens
gguacaagcagugcccuua

SEQ ID NO: 466947 - RNA, 19 nt, Homo sapiens
ggaguagguaggcgaguaa

SEQ ID NO: 466948 - RNA, 19 nt, Homo sapiens
caauaguucccacucauga

SEQ ID NO: 466949 - RNA, 19 nt, Homo sapiens
uacaagcagugcccuuauu

SEQ ID NO: 466950 - RNA, 19 nt, Homo sapiens
agaugcagauggcucuuaa

SEQ ID NO: 466951 - RNA, 19 nt, Homo sapiens
ccaaucagccucaccuugu

SEQ ID NO: 466952 - RNA, 19 nt, Homo sapiens
agacaugggacauuuaaau

SEQ ID NO: 466953 - RNA, 19 nt, Homo sapiens
ggaccucuuuuguugcuua

SEQ ID NO: 466954 - RNA, 19 nt, Homo sapiens
gcagguagaggaggacuga

SEQ ID NO: 466955 - RNA, 19 nt, Homo sapiens
aagcagugcccuuauugua

SEQ ID NO: 466956 - RNA, 19 nt, Homo sapiens
ucauugccauccauauuug

SEQ ID NO: 466957 - RNA, 19 nt, Homo sapiens
gggauucucuuugguugug

SEQ ID NO: 466958 - RNA, 19 nt, Homo sapiens
ucaagacaugggacauuua

SEQ ID NO: 466959 - RNA, 19 nt, Homo sapiens
agaaagagcagagagauuc

SEQ ID NO: 466960 - RNA, 19 nt, Homo sapiens
ggugggauaucaauuuacu

SEQ ID NO: 466961 - RNA, 19 nt, Homo sapiens
auucauaggucccaaaucu

SEQ ID NO: 466962 - RNA, 19 nt, Homo sapiens
agacaauaguucccacuca

SEQ ID NO: 466963 - RNA, 19 nt, Homo sapiens
uauggugggauaucaauuu

SEQ ID NO: 466964 - RNA, 19 nt, Homo sapiens
aacaguaacuugccaccuu

SEQ ID NO: 466965 - RNA, 19 nt, Homo sapiens
aaaggugccaugaaaggua

SEQ ID NO: 466966 - RNA, 19 nt, Homo sapiens
gguagaggaggacugauga

SEQ ID NO: 466967 - RNA, 19 nt, Homo sapiens
gucauugccauccauauuu

SEQ ID NO: 466968 - RNA, 19 nt, Homo sapiens
gagaagagcgaggcuguag

SEQ ID NO: 466969 - RNA, 19 nt, Homo sapiens
gagccuuugucuauugugu

SEQ ID NO: 466970 - RNA, 19 nt, Homo sapiens
ugacugaugccuccuuaug

SEQ ID NO: 466971 - RNA, 19 nt, Homo sapiens
gcauuaaaggugccaugaa

SEQ ID NO: 466972 - RNA, 19 nt, Homo sapiens
auaaucaacugccaaaggu

SEQ ID NO: 466973 - RNA, 19 nt, Homo sapiens
cguuugggcugccgaauca

SEQ ID NO: 466974 - RNA, 19 nt, Homo sapiens
cagaugaagggaagacauu

SEQ ID NO: 466975 - RNA, 19 nt, Homo sapiens
ucugagccuuugucuauug

SEQ ID NO: 466976 - RNA, 19 nt, Homo sapiens
gccaggaaagagacuauuu

SEQ ID NO: 466977 - RNA, 19 nt, Homo sapiens
auguacaccugaugaagua

SEQ ID NO: 466978 - RNA, 19 nt, Homo sapiens
guucucccauugugaguau

SEQ ID NO: 466979 - RNA, 19 nt, Homo sapiens
cucaagacaugggacauuu

SEQ ID NO: 466980 - RNA, 19 nt, Homo sapiens
auggugggauaucaauuua

SEQ ID NO: 466981 - RNA, 19 nt, Homo sapiens
caaagaagcuccuggauaa

SEQ ID NO: 466982 - RNA, 19 nt, Homo sapiens
gcacagauccacaugguuu

SEQ ID NO: 466983 - RNA, 19 nt, Homo sapiens
gaacgaggccgacuuacuu

SEQ ID NO: 466984 - RNA, 19 nt, Homo sapiens
gcacuguuguaauguuaua

SEQ ID NO: 466985 - RNA, 19 nt, Homo sapiens
gggacaaccuccuuauuga

SEQ ID NO: 466986 - RNA, 19 nt, Homo sapiens
uaaugugacuggccuaauu

SEQ ID NO: 466987 - RNA, 19 nt, Homo sapiens
auaaauggcuuggauauug

SEQ ID NO: 466988 - RNA, 19 nt, Homo sapiens
gacaaucucugccuaucaa

SEQ ID NO: 466989 - RNA, 19 nt, Homo sapiens
ugucuucccuucccuauuu

SEQ ID NO: 466990 - RNA, 19 nt, Homo sapiens
cccauggucuucuauauuu

SEQ ID NO: 466991 - RNA, 19 nt, Homo sapiens
ccaaagaccacccauguau

SEQ ID NO: 466992 - RNA, 19 nt, Homo sapiens
ugacuggaguuaucuguga

SEQ ID NO: 466993 - RNA, 19 nt, Homo sapiens
aaagaccacccauguauaa

SEQ ID NO: 466994 - RNA, 19 nt, Homo sapiens
acuauacacuccaauguuu

SEQ ID NO: 466995 - RNA, 19 nt, Homo sapiens
caaagaccacccauguaua

SEQ ID NO: 466996 - RNA, 19 nt, Homo sapiens
cagcccaguuugaaauaua

SEQ ID NO: 466997 - RNA, 19 nt, Homo sapiens
gugcacuguuguaauguua

SEQ ID NO: 466998 - RNA, 19 nt, Homo sapiens
ggaaugauaggaggacuaa

SEQ ID NO: 466999 - RNA, 19 nt, Homo sapiens
gguggaguguuuauaaaug

SEQ ID NO: 467000 - RNA, 19 nt, Homo sapiens
gcaggucaguucaaguaga

SEQ ID NO: 467001 - RNA, 19 nt, Homo sapiens
acaaagaagcuccuggaua

SEQ ID NO: 467002 - RNA, 19 nt, Homo sapiens
cguaauugcuguccggaaa

SEQ ID NO: 467003 - RNA, 19 nt, Homo sapiens
uaucaaggcuauacuuaag

SEQ ID NO: 467004 - RNA, 19 nt, Homo sapiens
ggacaaccuccuuauugaa

SEQ ID NO: 467005 - RNA, 19 nt, Homo sapiens
ggaauccgccugguuuaaa

SEQ ID NO: 467006 - RNA, 19 nt, Homo sapiens
cagcaggucaguucaagua

SEQ ID NO: 467007 - RNA, 19 nt, Homo sapiens
caacagcccaguuugaaau

SEQ ID NO: 467008 - RNA, 19 nt, Homo sapiens
ccacaugguuugcccaaca

SEQ ID NO: 467009 - RNA, 19 nt, Homo sapiens
ggaguuaucugugaaucuc

SEQ ID NO: 467010 - RNA, 19 nt, Homo sapiens
ggaauauucucagcguaau

SEQ ID NO: 467011 - RNA, 19 nt, Homo sapiens
ggauacuucucuggaauau

SEQ ID NO: 467012 - RNA, 19 nt, Homo sapiens
cccaacaccuccacaaaga

SEQ ID NO: 467013 - RNA, 19 nt, Homo sapiens
gcaacagcccaguuugaaa

SEQ ID NO: 467014 - RNA, 19 nt, Homo sapiens
gaagagggaccagcacaug

SEQ ID NO: 467015 - RNA, 19 nt, Homo sapiens
cuaauugcuuccacuuuga

SEQ ID NO: 467016 - RNA, 19 nt, Homo sapiens
cauaacaucaugacacuau

SEQ ID NO: 467017 - RNA, 19 nt, Homo sapiens
uguauaagcaucagugaaa

SEQ ID NO: 467018 - RNA, 19 nt, Homo sapiens
gcccagauauccagggaau

SEQ ID NO: 467019 - RNA, 19 nt, Homo sapiens
aagaagcuccuggauaaua

SEQ ID NO: 467020 - RNA, 19 nt, Homo sapiens
caacacacacgucucugaa

SEQ ID NO: 467021 - RNA, 19 nt, Homo sapiens
acuaauugcuuccacuuug

SEQ ID NO: 467022 - RNA, 19 nt, Homo sapiens
gaggccgacuuacuucuau

SEQ ID NO: 467023 - RNA, 19 nt, Homo sapiens
gaagcuccuggauaauaua

SEQ ID NO: 467024 - RNA, 19 nt, Homo sapiens
agaagcuccuggauaauau

SEQ ID NO: 467025 - RNA, 19 nt, Homo sapiens
aaugauaggaggacuaauu

SEQ ID NO: 467026 - RNA, 19 nt, Homo sapiens
agaacccuauguauaauug

SEQ ID NO: 467027 - RNA, 19 nt, Homo sapiens
gcaggucaguuaucagacu

SEQ ID NO: 467028 - RNA, 19 nt, Homo sapiens
uggaguagcuugggucguu

SEQ ID NO: 467029 - RNA, 19 nt, Homo sapiens
gcuccuggauaauauaaag

SEQ ID NO: 467030 - RNA, 19 nt, Homo sapiens
uugcuuggguggaguguuu

SEQ ID NO: 467031 - RNA, 19 nt, Homo sapiens
acacacacgucucugaagu

SEQ ID NO: 467032 - RNA, 19 nt, Homo sapiens
ggacuaauugcuuccacuu

SEQ ID NO: 467033 - RNA, 19 nt, Homo sapiens
guuuauaaauggcuuggau

SEQ ID NO: 467034 - RNA, 19 nt, Homo sapiens
ccuaucaaggcuauacuua

SEQ ID NO: 467035 - RNA, 19 nt, Homo sapiens
gaccacccauguauaagca

SEQ ID NO: 467036 - RNA, 19 nt, Homo sapiens
uagcuugggucguuguaug

SEQ ID NO: 467037 - RNA, 19 nt, Homo sapiens
cuucacagcagcaggauuu

SEQ ID NO: 467038 - RNA, 19 nt, Homo sapiens
gaauauucucagcguaauu

SEQ ID NO: 467039 - RNA, 19 nt, Homo sapiens
ucaguuaucagacuucuuc

SEQ ID NO: 467040 - RNA, 19 nt, Homo sapiens
ccagguuucuguuccuuuc

SEQ ID NO: 467041 - RNA, 19 nt, Homo sapiens
gaucugugguaaccuagca

SEQ ID NO: 467042 - RNA, 19 nt, Homo sapiens
gcccauggucuucuauauu

SEQ ID NO: 467043 - RNA, 19 nt, Homo sapiens
ggauuucuccuuccugcaa

SEQ ID NO: 467044 - RNA, 19 nt, Homo sapiens
gaaaaggaauacaucacau

SEQ ID NO: 467045 - RNA, 19 nt, Homo sapiens
ccguaugucuucucugguu

SEQ ID NO: 467046 - RNA, 19 nt, Homo sapiens
ggcccauggucuucuauau

SEQ ID NO: 467047 - RNA, 19 nt, Homo sapiens
gaaaaugauuggcuuugca

SEQ ID NO: 467048 - RNA, 19 nt, Homo sapiens
ccagauauccagggaauca

SEQ ID NO: 467049 - RNA, 19 nt, Homo sapiens
uauaauuggagcccagaua

SEQ ID NO: 467050 - RNA, 19 nt, Homo sapiens
cuugugcacuguuguaaug

SEQ ID NO: 467051 - RNA, 19 nt, Homo sapiens
uagcacagauccacauggu

SEQ ID NO: 467052 - RNA, 19 nt, Homo sapiens
ggccuaauuuucuaccuua

SEQ ID NO: 467053 - RNA, 19 nt, Homo sapiens
gaauccgccugguuuaaaa

SEQ ID NO: 467054 - RNA, 19 nt, Homo sapiens
ccuagcaggucaguuauca

SEQ ID NO: 467055 - RNA, 19 nt, Homo sapiens
uggauugucuuuccuugug

SEQ ID NO: 467056 - RNA, 19 nt, Homo sapiens
agucugggcuauuuccauu

SEQ ID NO: 467057 - RNA, 19 nt, Homo sapiens
gaauagcacagauccacau

SEQ ID NO: 467058 - RNA, 19 nt, Homo sapiens
ucaaggcuauacuuaaguc

SEQ ID NO: 467059 - RNA, 19 nt, Homo sapiens
uaaauggcuuggauauugc

SEQ ID NO: 467060 - RNA, 19 nt, Homo sapiens
guuggauacuucucuggaa

SEQ ID NO: 467061 - RNA, 19 nt, Homo sapiens
ugggacaaccuccuuauug

SEQ ID NO: 467062 - RNA, 19 nt, Homo sapiens
ucuccuuccugcaaucuuu

SEQ ID NO: 467063 - RNA, 19 nt, Homo sapiens
uggguggaguguuuauaaa

SEQ ID NO: 467064 - RNA, 19 nt, Homo sapiens
acacuccaauguuuaucaa

SEQ ID NO: 467065 - RNA, 19 nt, Homo sapiens
cuauuuccauugguaguuu

SEQ ID NO: 467066 - RNA, 19 nt, Homo sapiens
ggaacgaggccgacuuacu

SEQ ID NO: 467067 - RNA, 19 nt, Homo sapiens
gacaaccuccuuauugaag

SEQ ID NO: 467068 - RNA, 19 nt, Homo sapiens
uagcaggucaguuaucaga

SEQ ID NO: 467069 - RNA, 19 nt, Homo sapiens
ugccucagcucuguguuaa

SEQ ID NO: 467070 - RNA, 19 nt, Homo sapiens
cagggaaucaucuugaguu

SEQ ID NO: 467071 - RNA, 19 nt, Homo sapiens
caacaccuccacaaagaag

SEQ ID NO: 467072 - RNA, 19 nt, Homo sapiens
aaacaacacacacgucucu

SEQ ID NO: 467073 - RNA, 19 nt, Homo sapiens
guggaguguuuauaaaugg

SEQ ID NO: 467074 - RNA, 19 nt, Homo sapiens
cuauacacuccaauguuua

SEQ ID NO: 467075 - RNA, 19 nt, Homo sapiens
cacauaacaucaugacacu

SEQ ID NO: 467076 - RNA, 19 nt, Homo sapiens
cuaucaaggcuauacuuaa

SEQ ID NO: 467077 - RNA, 19 nt, Homo sapiens
guagacaaucucugccuau

SEQ ID NO: 467078 - RNA, 19 nt, Homo sapiens
gcuuguggcugugccguau

SEQ ID NO: 467079 - RNA, 19 nt, Homo sapiens
gcuggcccauggucuucua

SEQ ID NO: 467080 - RNA, 19 nt, Homo sapiens
ucccagauauuuuggauuu

SEQ ID NO: 467081 - RNA, 19 nt, Homo sapiens
gaaaugcaaccacaucuuu

SEQ ID NO: 467082 - RNA, 19 nt, Homo sapiens
ggugacaucuucaaggaua

SEQ ID NO: 467083 - RNA, 19 nt, Homo sapiens
gaagguggcuggugacauc

SEQ ID NO: 467084 - RNA, 19 nt, Homo sapiens
gcucugggcuugugugaga

SEQ ID NO: 467085 - RNA, 19 nt, Homo sapiens
uguagaagcuuguauuugu

SEQ ID NO: 467086 - RNA, 19 nt, Homo sapiens
ucacagagcccuucacgaa

SEQ ID NO: 467087 - RNA, 19 nt, Homo sapiens
gggaaggccugguguggaa

SEQ ID NO: 467088 - RNA, 19 nt, Homo sapiens
guccagcgcuuuccagauu

SEQ ID NO: 467089 - RNA, 19 nt, Homo sapiens
ggaaacgcacggccaagua

SEQ ID NO: 467090 - RNA, 19 nt, Homo sapiens
gaaaugccaccauggagaa

SEQ ID NO: 467091 - RNA, 19 nt, Homo sapiens
ucacgaagcucaucaucca

SEQ ID NO: 467092 - RNA, 19 nt, Homo sapiens
gccagucucuccuucugua

SEQ ID NO: 467093 - RNA, 19 nt, Homo sapiens
ggauaucuggguaugauuu

SEQ ID NO: 467094 - RNA, 19 nt, Homo sapiens
gagcagaagcugaaacaca

SEQ ID NO: 467095 - RNA, 19 nt, Homo sapiens
gcaccugucauguguagaa

SEQ ID NO: 467096 - RNA, 19 nt, Homo sapiens
gugcaugacugcuuuaacu

SEQ ID NO: 467097 - RNA, 19 nt, Homo sapiens
guagaagcuuguauuugug

SEQ ID NO: 467098 - RNA, 19 nt, Homo sapiens
caacaucucggguauccuu

SEQ ID NO: 467099 - RNA, 19 nt, Homo sapiens
gcacguguacacaugacua

SEQ ID NO: 467100 - RNA, 19 nt, Homo sapiens
ccaagugguuacagacaug

SEQ ID NO: 467101 - RNA, 19 nt, Homo sapiens
caggauaucuggguaugau

SEQ ID NO: 467102 - RNA, 19 nt, Homo sapiens
ccaugcagguguacacaga

SEQ ID NO: 467103 - RNA, 19 nt, Homo sapiens
gaagcugaaacacagaauu

SEQ ID NO: 467104 - RNA, 19 nt, Homo sapiens
ggagaaaugcaaccacauc

SEQ ID NO: 467105 - RNA, 19 nt, Homo sapiens
gggaggguguguguaggua

SEQ ID NO: 467106 - RNA, 19 nt, Homo sapiens
gaggguguguguagguaug

SEQ ID NO: 467107 - RNA, 19 nt, Homo sapiens
ggagggaggguguguguag

SEQ ID NO: 467108 - RNA, 19 nt, Homo sapiens
gcugaaacacagaauucua

SEQ ID NO: 467109 - RNA, 19 nt, Homo sapiens
gauguuggugccugcguua

SEQ ID NO: 467110 - RNA, 19 nt, Homo sapiens
cugaaacacagaauucuaa

SEQ ID NO: 467111 - RNA, 19 nt, Homo sapiens
gcaccugcccaagugguua

SEQ ID NO: 467112 - RNA, 19 nt, Homo sapiens
gcuggacgagucugugaua

SEQ ID NO: 467113 - RNA, 19 nt, Homo sapiens
uaccaucuccucauccuaa

SEQ ID NO: 467114 - RNA, 19 nt, Homo sapiens
guacacaugacuaggauag

SEQ ID NO: 467115 - RNA, 19 nt, Homo sapiens
ggugugaucagcauugaga

SEQ ID NO: 467116 - RNA, 19 nt, Homo sapiens
uccagaaggucaucaauac

SEQ ID NO: 467117 - RNA, 19 nt, Homo sapiens
ggacgagucugugauaacc

SEQ ID NO: 467118 - RNA, 19 nt, Homo sapiens
gugccugcguuacugaauu

SEQ ID NO: 467119 - RNA, 19 nt, Homo sapiens
uggccaaggucauccagaa

SEQ ID NO: 467120 - RNA, 19 nt, Homo sapiens
ucccaacacuugccugaug

SEQ ID NO: 467121 - RNA, 19 nt, Homo sapiens
cagguccucugcacgugua

SEQ ID NO: 467122 - RNA, 19 nt, Homo sapiens
gaaacgcacggccaaguac

SEQ ID NO: 467123 - RNA, 19 nt, Homo sapiens
cggguauccuucuguggua

SEQ ID NO: 467124 - RNA, 19 nt, Homo sapiens
ggucaucaauacggacuuc

SEQ ID NO: 467125 - RNA, 19 nt, Homo sapiens
ggacggccuuugccuacgu

SEQ ID NO: 467126 - RNA, 19 nt, Homo sapiens
gugcaccugucauguguag

SEQ ID NO: 467127 - RNA, 19 nt, Homo sapiens
caucaugggcuccaacauc

SEQ ID NO: 467128 - RNA, 19 nt, Homo sapiens
ugccugcguuacugaauuu

SEQ ID NO: 467129 - RNA, 19 nt, Homo sapiens
ggccaaguaccgcugguuu

SEQ ID NO: 467130 - RNA, 19 nt, Homo sapiens
cccaacacuugccugauga

SEQ ID NO: 467131 - RNA, 19 nt, Homo sapiens
gcgccaugcugcucaaggu

SEQ ID NO: 467132 - RNA, 19 nt, Homo sapiens
cacggugcaugacugcuuu

SEQ ID NO: 467133 - RNA, 19 nt, Homo sapiens
gccaccaccacaauuaauu

SEQ ID NO: 467134 - RNA, 19 nt, Homo sapiens
ccaaggucauccagaaggu

SEQ ID NO: 467135 - RNA, 19 nt, Homo sapiens
gugaugagucccugaggaa

SEQ ID NO: 467136 - RNA, 19 nt, Homo sapiens
cuccugaccugcucaagau

SEQ ID NO: 467137 - RNA, 19 nt, Homo sapiens
gugguggccuccuucaaca

SEQ ID NO: 467138 - RNA, 19 nt, Homo sapiens
caccacaucacucgacuug

SEQ ID NO: 467139 - RNA, 19 nt, Homo sapiens
gcaccucugucaccaacac

SEQ ID NO: 467140 - RNA, 19 nt, Homo sapiens
gugacaucuucaaggauaa

SEQ ID NO: 467141 - RNA, 19 nt, Homo sapiens
gcagcuguuugugcauaga

SEQ ID NO: 467142 - RNA, 19 nt, Homo sapiens
gagaaaugcaaccacaucu

SEQ ID NO: 467143 - RNA, 19 nt, Homo sapiens
gcuccugaccugcucaaga

SEQ ID NO: 467144 - RNA, 19 nt, Homo sapiens
cuggugacaucuucaagga

SEQ ID NO: 467145 - RNA, 19 nt, Homo sapiens
gauaccaucuccucauccu

SEQ ID NO: 467146 - RNA, 19 nt, Homo sapiens
uuaauucccuucccaacac

SEQ ID NO: 467147 - RNA, 19 nt, Homo sapiens
gccagcccaugcaggugua

SEQ ID NO: 467148 - RNA, 19 nt, Homo sapiens
gcucaaggugccacugaug

SEQ ID NO: 467149 - RNA, 19 nt, Homo sapiens
caacacuugccugaugaaa

SEQ ID NO: 467150 - RNA, 19 nt, Homo sapiens
aagggugggucuggguaua

SEQ ID NO: 467151 - RNA, 19 nt, Homo sapiens
gugccacccagacuccuua

SEQ ID NO: 467152 - RNA, 19 nt, Homo sapiens
ccaccaccacaauuaauuc

SEQ ID NO: 467153 - RNA, 19 nt, Homo sapiens
gauaucuggguaugauuuc

SEQ ID NO: 467154 - RNA, 19 nt, Homo sapiens
gcagaagcugaaacacaga

SEQ ID NO: 467155 - RNA, 19 nt, Homo sapiens
gguuugccguccucuaucu

SEQ ID NO: 467156 - RNA, 19 nt, Homo sapiens
aagcugaaacacagaauuc

SEQ ID NO: 467157 - RNA, 19 nt, Homo sapiens
ugucacuucuucuucaaca

SEQ ID NO: 467158 - RNA, 19 nt, Homo sapiens
gguggcuggugacaucuuc

SEQ ID NO: 467159 - RNA, 19 nt, Homo sapiens
caccuuccuuccuccaaga

SEQ ID NO: 467160 - RNA, 19 nt, Homo sapiens
ugaauuugcacaccuccuu

SEQ ID NO: 467161 - RNA, 19 nt, Homo sapiens
ugacugugcagcuguuugu

SEQ ID NO: 467162 - RNA, 19 nt, Homo sapiens
gggugggucuggguauaug

SEQ ID NO: 467163 - RNA, 19 nt, Homo sapiens
guguacacaugacuaggau

SEQ ID NO: 467164 - RNA, 19 nt, Homo sapiens
gccaaguaccgcugguuug

SEQ ID NO: 467165 - RNA, 19 nt, Homo sapiens
cacacuggguuccaacauc

SEQ ID NO: 467166 - RNA, 19 nt, Homo sapiens
gcauugccacuggugauga

SEQ ID NO: 467167 - RNA, 19 nt, Homo sapiens
ucaccuuccucuaccucuu

SEQ ID NO: 467168 - RNA, 19 nt, Homo sapiens
agaagcuuguauuugugua

SEQ ID NO: 467169 - RNA, 19 nt, Homo sapiens
uguguagaagcuuguauuu

SEQ ID NO: 467170 - RNA, 19 nt, Homo sapiens
ucguggugcucaucaaugu

SEQ ID NO: 467171 - RNA, 19 nt, Homo sapiens
gccagacccuuggaaaugc

SEQ ID NO: 467172 - RNA, 19 nt, Homo sapiens
ucggccaccaccacaauua

SEQ ID NO: 467173 - RNA, 19 nt, Homo sapiens
gcaggauaucuggguauga

SEQ ID NO: 467174 - RNA, 19 nt, Homo sapiens
gugccagucucuccuucug

SEQ ID NO: 467175 - RNA, 19 nt, Homo sapiens
ucacugguguuuggcaucu

SEQ ID NO: 467176 - RNA, 19 nt, Homo sapiens
gcucaacucccugcucaag

SEQ ID NO: 467177 - RNA, 19 nt, Homo sapiens
ccagccagacccuuggaaa

SEQ ID NO: 467178 - RNA, 19 nt, Homo sapiens
gaccugcucaagaucauca

SEQ ID NO: 467179 - RNA, 19 nt, Homo sapiens
ccacggugcaugacugcuu

SEQ ID NO: 467180 - RNA, 19 nt, Homo sapiens
ggucuggguauaugacugu

SEQ ID NO: 467181 - RNA, 19 nt, Homo sapiens
gaagaaagcguaccuagug

SEQ ID NO: 467182 - RNA, 19 nt, Homo sapiens
gaagccaucucagcucaua

SEQ ID NO: 467183 - RNA, 19 nt, Homo sapiens
ggaauagcauggaugaaug

SEQ ID NO: 467184 - RNA, 19 nt, Homo sapiens
gaccuauacucuacucuuu

SEQ ID NO: 467185 - RNA, 19 nt, Homo sapiens
ugacaagccucuuuaaucu

SEQ ID NO: 467186 - RNA, 19 nt, Homo sapiens
caacaugggcuccaaguga

SEQ ID NO: 467187 - RNA, 19 nt, Homo sapiens
gaagagaagcuugcuauuc

SEQ ID NO: 467188 - RNA, 19 nt, Homo sapiens
gaaguguaauguacgaguu

SEQ ID NO: 467189 - RNA, 19 nt, Homo sapiens
ccacaguuauguuugcuuu

SEQ ID NO: 467190 - RNA, 19 nt, Homo sapiens
aagcguaccuaguggaaua

SEQ ID NO: 467191 - RNA, 19 nt, Homo sapiens
caacagaucggaagagugu

SEQ ID NO: 467192 - RNA, 19 nt, Homo sapiens
gauaacaggaggcaauaaa

SEQ ID NO: 467193 - RNA, 19 nt, Homo sapiens
cacaggaccuucccuaaga

SEQ ID NO: 467194 - RNA, 19 nt, Homo sapiens
caccguggcuguugaagaa

SEQ ID NO: 467195 - RNA, 19 nt, Homo sapiens
aaaagaaacugccuugaaa

SEQ ID NO: 467196 - RNA, 19 nt, Homo sapiens
gcacauccacguucagaga

SEQ ID NO: 467197 - RNA, 19 nt, Homo sapiens
gggaagaaguuaaaagaaa

SEQ ID NO: 467198 - RNA, 19 nt, Homo sapiens
gcugugagguugauuaaac

SEQ ID NO: 467199 - RNA, 19 nt, Homo sapiens
acacagaauccucagauaa

SEQ ID NO: 467200 - RNA, 19 nt, Homo sapiens
gaauagcauggaugaauga

SEQ ID NO: 467201 - RNA, 19 nt, Homo sapiens
gauuaaacuugagcuguga

SEQ ID NO: 467202 - RNA, 19 nt, Homo sapiens
gaagcuugcuauucugagu

SEQ ID NO: 467203 - RNA, 19 nt, Homo sapiens
ugacauggaguucaaagaa

SEQ ID NO: 467204 - RNA, 19 nt, Homo sapiens
ccucuuagacucuuagaaa

SEQ ID NO: 467205 - RNA, 19 nt, Homo sapiens
ugacugacaagccucuuua

SEQ ID NO: 467206 - RNA, 19 nt, Homo sapiens
caacaggauuggauaucau

SEQ ID NO: 467207 - RNA, 19 nt, Homo sapiens
gaaagcguaccuaguggaa

SEQ ID NO: 467208 - RNA, 19 nt, Homo sapiens
uauaugacauggaguucaa

SEQ ID NO: 467209 - RNA, 19 nt, Homo sapiens
ccaaaugccagcuugaaga

SEQ ID NO: 467210 - RNA, 19 nt, Homo sapiens
ugagguugauuaaacuuga

SEQ ID NO: 467211 - RNA, 19 nt, Homo sapiens
cauguuugcuggcuuuguu

SEQ ID NO: 467212 - RNA, 19 nt, Homo sapiens
acaagccucuuuaaucugu

SEQ ID NO: 467213 - RNA, 19 nt, Homo sapiens
gguggauucuucuaugaug

SEQ ID NO: 467214 - RNA, 19 nt, Homo sapiens
cugauuagacccaagauuu

SEQ ID NO: 467215 - RNA, 19 nt, Homo sapiens
ggaagagaagcuugcuauu

SEQ ID NO: 467216 - RNA, 19 nt, Homo sapiens
gcucagugggcuucacaua

SEQ ID NO: 467217 - RNA, 19 nt, Homo sapiens
caaaggcugugaugcaacu

SEQ ID NO: 467218 - RNA, 19 nt, Homo sapiens
gcuaacagcugccaauacc

SEQ ID NO: 467219 - RNA, 19 nt, Homo sapiens
ggagcucccuuuggaagug

SEQ ID NO: 467220 - RNA, 19 nt, Homo sapiens
gacauggaguucaaagaag

SEQ ID NO: 467221 - RNA, 19 nt, Homo sapiens
uagaggugguagugaguaa

SEQ ID NO: 467222 - RNA, 19 nt, Homo sapiens
uaacaggaggcaauaaauc

SEQ ID NO: 467223 - RNA, 19 nt, Homo sapiens
caugguggauucuucuaug

SEQ ID NO: 467224 - RNA, 19 nt, Homo sapiens
acacacacauacacagaau

SEQ ID NO: 467225 - RNA, 19 nt, Homo sapiens
uacacagaauccucagaua

SEQ ID NO: 467226 - RNA, 19 nt, Homo sapiens
acagaucggaagaguguua

SEQ ID NO: 467227 - RNA, 19 nt, Homo sapiens
ccuauacucuacucuuugu

SEQ ID NO: 467228 - RNA, 19 nt, Homo sapiens
ggaccuauacucuacucuu

SEQ ID NO: 467229 - RNA, 19 nt, Homo sapiens
cagugucccugcugucuug

SEQ ID NO: 467230 - RNA, 19 nt, Homo sapiens
ggcauuggaucuucauuuu

SEQ ID NO: 467231 - RNA, 19 nt, Homo sapiens
gugcccaccuuccuauaug

SEQ ID NO: 467232 - RNA, 19 nt, Homo sapiens
aaugccagcuugaagaguu

SEQ ID NO: 467233 - RNA, 19 nt, Homo sapiens
ggucaucaacaucgucuau

SEQ ID NO: 467234 - RNA, 19 nt, Homo sapiens
uaacugauuagacccaaga

SEQ ID NO: 467235 - RNA, 19 nt, Homo sapiens
acuuguagcucuuccucua

SEQ ID NO: 467236 - RNA, 19 nt, Homo sapiens
caucugcuuugccaacaug

SEQ ID NO: 467237 - RNA, 19 nt, Homo sapiens
auguuucucuccacaguua

SEQ ID NO: 467238 - RNA, 19 nt, Homo sapiens
ccucgccucuccugccuuu

SEQ ID NO: 467239 - RNA, 19 nt, Homo sapiens
uaaaagaaacugccuugaa

SEQ ID NO: 467240 - RNA, 19 nt, Homo sapiens
ggauguaugcaacccagaa

SEQ ID NO: 467241 - RNA, 19 nt, Homo sapiens
guaccagcuugcucugugu

SEQ ID NO: 467242 - RNA, 19 nt, Homo sapiens
ucucaaagacccuuacauc

SEQ ID NO: 467243 - RNA, 19 nt, Homo sapiens
guaauguacgaguuuguug

SEQ ID NO: 467244 - RNA, 19 nt, Homo sapiens
ucaaggcauuggaucuuca

SEQ ID NO: 467245 - RNA, 19 nt, Homo sapiens
cagauaacaggaggcaaua

SEQ ID NO: 467246 - RNA, 19 nt, Homo sapiens
guucaaagaagucaacucu

SEQ ID NO: 467247 - RNA, 19 nt, Homo sapiens
ucagauaacaggaggcaau

SEQ ID NO: 467248 - RNA, 19 nt, Homo sapiens
caagauuucaugggaagaa

SEQ ID NO: 467249 - RNA, 19 nt, Homo sapiens
ggcuuuacccucagugaaa

SEQ ID NO: 467250 - RNA, 19 nt, Homo sapiens
ccucagugaccaccucuuu

SEQ ID NO: 467251 - RNA, 19 nt, Homo sapiens
gugacauuguucauacuug

SEQ ID NO: 467252 - RNA, 19 nt, Homo sapiens
ggaagaaguuaaaagaaac

SEQ ID NO: 467253 - RNA, 19 nt, Homo sapiens
gauuagacccaagauuuca

SEQ ID NO: 467254 - RNA, 19 nt, Homo sapiens
gcauugucuugcugccaaa

SEQ ID NO: 467255 - RNA, 19 nt, Homo sapiens
ccaagugaguuuccuucgu

SEQ ID NO: 467256 - RNA, 19 nt, Homo sapiens
cuaagagcccgcagggaaa

SEQ ID NO: 467257 - RNA, 19 nt, Homo sapiens
acagaauccucagauaaca

SEQ ID NO: 467258 - RNA, 19 nt, Homo sapiens
gaggugguagugaguaaug

SEQ ID NO: 467259 - RNA, 19 nt, Homo sapiens
cuacagccuuccaaagucu

SEQ ID NO: 467260 - RNA, 19 nt, Homo sapiens
ugaugcaacuucuggucaa

SEQ ID NO: 467261 - RNA, 19 nt, Homo sapiens
gcugcugugagguugauua

SEQ ID NO: 467262 - RNA, 19 nt, Homo sapiens
cccagaagcccacgaagga

SEQ ID NO: 467263 - RNA, 19 nt, Homo sapiens
uugcaugggcuuugcuaua

SEQ ID NO: 467264 - RNA, 19 nt, Homo sapiens
uggcuuuguuaucauguuu

SEQ ID NO: 467265 - RNA, 19 nt, Homo sapiens
acauggaguucaaagaagu

SEQ ID NO: 467266 - RNA, 19 nt, Homo sapiens
aaagaaacugccuugaaau

SEQ ID NO: 467267 - RNA, 19 nt, Homo sapiens
cagaaacaggagcccauuu

SEQ ID NO: 467268 - RNA, 19 nt, Homo sapiens
cuaaaucuagagcugcuaa

SEQ ID NO: 467269 - RNA, 19 nt, Homo sapiens
cugacaagccucuuuaauc

SEQ ID NO: 467270 - RNA, 19 nt, Homo sapiens
augaggagccugaccauga

SEQ ID NO: 467271 - RNA, 19 nt, Homo sapiens
gaagcccacgaaggaauuu

SEQ ID NO: 467272 - RNA, 19 nt, Homo sapiens
caacccagaagcccacgaa

SEQ ID NO: 467273 - RNA, 19 nt, Homo sapiens
ugcaugggcuuugcuauag

SEQ ID NO: 467274 - RNA, 19 nt, Homo sapiens
ucgcuuugcuccuggacaa

SEQ ID NO: 467275 - RNA, 19 nt, Homo sapiens
ucacaggaccuucccuaag

SEQ ID NO: 467276 - RNA, 19 nt, Homo sapiens
ucaccuguguaacuuguag

SEQ ID NO: 467277 - RNA, 19 nt, Homo sapiens
ugaggagccugaccaugag

SEQ ID NO: 467278 - RNA, 19 nt, Homo sapiens
ucaaagacccuuacauccu

SEQ ID NO: 467279 - RNA, 19 nt, Homo sapiens
ccuacagccuuccaaaguc

SEQ ID NO: 467280 - RNA, 19 nt, Homo sapiens
uggaauagcauggaugaau

SEQ ID NO: 467281 - RNA, 19 nt, Homo sapiens
gaucacaacugcccuauua

SEQ ID NO: 467282 - RNA, 19 nt, Homo sapiens
acaaagaccuccugaauga

SEQ ID NO: 467283 - RNA, 19 nt, Homo sapiens
gaagaaugcuacagaaauc

SEQ ID NO: 467284 - RNA, 19 nt, Homo sapiens
gaaagugacugagaugaga

SEQ ID NO: 467285 - RNA, 19 nt, Homo sapiens
gcuaguaucucuuaucuca

SEQ ID NO: 467286 - RNA, 19 nt, Homo sapiens
ugacacaacucauccagaa

SEQ ID NO: 467287 - RNA, 19 nt, Homo sapiens
ggagugugcucuaugaguu

SEQ ID NO: 467288 - RNA, 19 nt, Homo sapiens
gcaaguuggucuguuguuu

SEQ ID NO: 467289 - RNA, 19 nt, Homo sapiens
gcauuaagcaugagaagaa

SEQ ID NO: 467290 - RNA, 19 nt, Homo sapiens
ccagagaccugacacuuca

SEQ ID NO: 467291 - RNA, 19 nt, Homo sapiens
caaguuaucuguacagcau

SEQ ID NO: 467292 - RNA, 19 nt, Homo sapiens
acucauagcuccgaacuuu

SEQ ID NO: 467293 - RNA, 19 nt, Homo sapiens
uaaccacgcugcugaagga

SEQ ID NO: 467294 - RNA, 19 nt, Homo sapiens
cagagcaucuucuccuauu

SEQ ID NO: 467295 - RNA, 19 nt, Homo sapiens
gaaguccaccugccaaaga

SEQ ID NO: 467296 - RNA, 19 nt, Homo sapiens
caccaacccuuucauagga

SEQ ID NO: 467297 - RNA, 19 nt, Homo sapiens
gagaagaaugcuacagaaa

SEQ ID NO: 467298 - RNA, 19 nt, Homo sapiens
ugagaagaaugcuacagaa

SEQ ID NO: 467299 - RNA, 19 nt, Homo sapiens
cuacacagaugaugaagag

SEQ ID NO: 467300 - RNA, 19 nt, Homo sapiens
gcuauccaauucccauauu

SEQ ID NO: 467301 - RNA, 19 nt, Homo sapiens
caacagaauuggcuaucca

SEQ ID NO: 467302 - RNA, 19 nt, Homo sapiens
gaugaagaaucugaaagug

SEQ ID NO: 467303 - RNA, 19 nt, Homo sapiens
gacaaagaccuccugaaug

SEQ ID NO: 467304 - RNA, 19 nt, Homo sapiens
gcacacugccuccaucuca

SEQ ID NO: 467305 - RNA, 19 nt, Homo sapiens
ucacaacugcccuauuaaa

SEQ ID NO: 467306 - RNA, 19 nt, Homo sapiens
agacaaagaccuccugaau

SEQ ID NO: 467307 - RNA, 19 nt, Homo sapiens
gagcaucuucuccuauuau

SEQ ID NO: 467308 - RNA, 19 nt, Homo sapiens
uaucaugggcuaccucgua

SEQ ID NO: 467309 - RNA, 19 nt, Homo sapiens
cagcuaguaucucuuaucu

SEQ ID NO: 467310 - RNA, 19 nt, Homo sapiens
gaccauguguucccgaaag

SEQ ID NO: 467311 - RNA, 19 nt, Homo sapiens
aaagaccuccugaaugaaa

SEQ ID NO: 467312 - RNA, 19 nt, Homo sapiens
caucaccaacccuuucaua

SEQ ID NO: 467313 - RNA, 19 nt, Homo sapiens
cuacugaccaacagaauug

SEQ ID NO: 467314 - RNA, 19 nt, Homo sapiens
ggacuacugaccaacagaa

SEQ ID NO: 467315 - RNA, 19 nt, Homo sapiens
gauaggugaagaugaagaa

SEQ ID NO: 467316 - RNA, 19 nt, Homo sapiens
uccgauaggugaagaugaa

SEQ ID NO: 467317 - RNA, 19 nt, Homo sapiens
gcucuucugggaaugauaa

SEQ ID NO: 467318 - RNA, 19 nt, Homo sapiens
gcugggcguugccuucuug

SEQ ID NO: 467319 - RNA, 19 nt, Homo sapiens
ugggauacuugcacacaaa

SEQ ID NO: 467320 - RNA, 19 nt, Homo sapiens
gcaauuggaaugguggauu

SEQ ID NO: 467321 - RNA, 19 nt, Homo sapiens
ggagucagcauuuuaugua

SEQ ID NO: 467322 - RNA, 19 nt, Homo sapiens
caucugcuuugcaaacaug

SEQ ID NO: 467323 - RNA, 19 nt, Homo sapiens
gaggcaacgucaugggaau

SEQ ID NO: 467324 - RNA, 19 nt, Homo sapiens
gggauucugcaucauguuu

SEQ ID NO: 467325 - RNA, 19 nt, Homo sapiens
caaguuggucuguuguuug

SEQ ID NO: 467326 - RNA, 19 nt, Homo sapiens
agagcaucuucuccuauua

SEQ ID NO: 467327 - RNA, 19 nt, Homo sapiens
caacugcccuauuaaaaca

SEQ ID NO: 467328 - RNA, 19 nt, Homo sapiens
gcaaaggcaauuggauuuc

SEQ ID NO: 467329 - RNA, 19 nt, Homo sapiens
agaagaaugcuacagaaau

SEQ ID NO: 467330 - RNA, 19 nt, Homo sapiens
aguuaucuguacagcauua

SEQ ID NO: 467331 - RNA, 19 nt, Homo sapiens
acaacaugcugcucacugu

SEQ ID NO: 467332 - RNA, 19 nt, Homo sapiens
gcgggauucugcaucaugu

SEQ ID NO: 467333 - RNA, 19 nt, Homo sapiens
cgcggaagcucauccuguu

SEQ ID NO: 467334 - RNA, 19 nt, Homo sapiens
cacagaugaugaagagaga

SEQ ID NO: 467335 - RNA, 19 nt, Homo sapiens
ucauaggacuacugaccaa

SEQ ID NO: 467336 - RNA, 19 nt, Homo sapiens
cagaacugucuuagucaua

SEQ ID NO: 467337 - RNA, 19 nt, Homo sapiens
acucuuggauggagcuauu

SEQ ID NO: 467338 - RNA, 19 nt, Homo sapiens
cuauccaauucccauauuu

SEQ ID NO: 467339 - RNA, 19 nt, Homo sapiens
gaccaacgcguccgcuguu

SEQ ID NO: 467340 - RNA, 19 nt, Homo sapiens
caucuucuccuauuaugau

SEQ ID NO: 467341 - RNA, 19 nt, Homo sapiens
ccagaacugucuuagucau

SEQ ID NO: 467342 - RNA, 19 nt, Homo sapiens
ucagaauaauauccaguca

SEQ ID NO: 467343 - RNA, 19 nt, Homo sapiens
ggaguugguuuugcaauug

SEQ ID NO: 467344 - RNA, 19 nt, Homo sapiens
uguacagcauuaagcauga

SEQ ID NO: 467345 - RNA, 19 nt, Homo sapiens
gauucugcaucauguuugu

SEQ ID NO: 467346 - RNA, 19 nt, Homo sapiens
caucccuggugaaagagua

SEQ ID NO: 467347 - RNA, 19 nt, Homo sapiens
ucgggagugugcucuauga

SEQ ID NO: 467348 - RNA, 19 nt, Homo sapiens
cgugcaaguuggucuguug

SEQ ID NO: 467349 - RNA, 19 nt, Homo sapiens
aaauggcuauucucaugga

SEQ ID NO: 467350 - RNA, 19 nt, Homo sapiens
gcucaucaccaacccuuuc

SEQ ID NO: 467351 - RNA, 19 nt, Homo sapiens
uggcuauucucauggauca

SEQ ID NO: 467352 - RNA, 19 nt, Homo sapiens
gagugugcucuaugaguuu

SEQ ID NO: 467353 - RNA, 19 nt, Homo sapiens
ggaagcucauccuguucau

SEQ ID NO: 467354 - RNA, 19 nt, Homo sapiens
auccaucccuggugaaaga

SEQ ID NO: 467355 - RNA, 19 nt, Homo sapiens
ugcaaaggcaauuggauuu

SEQ ID NO: 467356 - RNA, 19 nt, Homo sapiens
gggaguguguacgccauug

SEQ ID NO: 467357 - RNA, 19 nt, Homo sapiens
agagagaggcaacgucaug

SEQ ID NO: 467358 - RNA, 19 nt, Homo sapiens
auccagaacugucuuaguc

SEQ ID NO: 467359 - RNA, 19 nt, Homo sapiens
ugccagcuaguaucucuua

SEQ ID NO: 467360 - RNA, 19 nt, Homo sapiens
acaauuauguuugccuucu

SEQ ID NO: 467361 - RNA, 19 nt, Homo sapiens
caucccaaguuaucuguac

SEQ ID NO: 467362 - RNA, 19 nt, Homo sapiens
caaaggcaauuggauuucc

SEQ ID NO: 467363 - RNA, 19 nt, Homo sapiens
cuucugggaaugauaauug

SEQ ID NO: 467364 - RNA, 19 nt, Homo sapiens
cauuaagcaugagaagaau

SEQ ID NO: 467365 - RNA, 19 nt, Homo sapiens
gagguggcuuugugcucuu

SEQ ID NO: 467366 - RNA, 19 nt, Homo sapiens
agaacugucuuagucauac

SEQ ID NO: 467367 - RNA, 19 nt, Homo sapiens
cauugcggauguggcauuu

SEQ ID NO: 467368 - RNA, 19 nt, Homo sapiens
ggauucugcaucauguuug

SEQ ID NO: 467369 - RNA, 19 nt, Homo sapiens
uauccaauucccauauuug

SEQ ID NO: 467370 - RNA, 19 nt, Homo sapiens
ccagagcaucuucuccuau

SEQ ID NO: 467371 - RNA, 19 nt, Homo sapiens
ggacccguacauccucauu

SEQ ID NO: 467372 - RNA, 19 nt, Homo sapiens
uccagagcaucuucuccua

SEQ ID NO: 467373 - RNA, 19 nt, Homo sapiens
caaagaccuccugaaugaa

SEQ ID NO: 467374 - RNA, 19 nt, Homo sapiens
gcuaugccuuccugcugau

SEQ ID NO: 467375 - RNA, 19 nt, Homo sapiens
ucaccaacccuuucauagg

SEQ ID NO: 467376 - RNA, 19 nt, Homo sapiens
aaucugaaagugacugaga

SEQ ID NO: 467377 - RNA, 19 nt, Homo sapiens
ggaucacaacugcccuauu

SEQ ID NO: 467378 - RNA, 19 nt, Homo sapiens
aaguccaccugccaaagaa

SEQ ID NO: 467379 - RNA, 19 nt, Homo sapiens
gauguggcauuuuguaugg

SEQ ID NO: 467380 - RNA, 19 nt, Homo sapiens
aaugguggauucgucaaug

SEQ ID NO: 467381 - RNA, 19 nt, Homo sapiens
gcgaugugcugcuugauga

SEQ ID NO: 467382 - RNA, 19 nt, Homo sapiens
gcucuaugcucccgucuug

SEQ ID NO: 467383 - RNA, 19 nt, Homo sapiens
ccaaaucaauaaacugugu

SEQ ID NO: 467384 - RNA, 19 nt, Homo sapiens
ccacguggaugaagcauac

SEQ ID NO: 467385 - RNA, 19 nt, Homo sapiens
gcucaccaccuguaacauu

SEQ ID NO: 467386 - RNA, 19 nt, Homo sapiens
ccauaucccuuucucucuu

SEQ ID NO: 467387 - RNA, 19 nt, Homo sapiens
gcaagcgcgugcccuucuu

SEQ ID NO: 467388 - RNA, 19 nt, Homo sapiens
gcgaggacgacuacaacua

SEQ ID NO: 467389 - RNA, 19 nt, Homo sapiens
ggacgugcgccaugucuca

SEQ ID NO: 467390 - RNA, 19 nt, Homo sapiens
gcgcuggccuucauuagcu

SEQ ID NO: 467391 - RNA, 19 nt, Homo sapiens
ggacuacgccacgcuguuc

SEQ ID NO: 467392 - RNA, 19 nt, Homo sapiens
gcccaaaucaauaaacugu

SEQ ID NO: 467393 - RNA, 19 nt, Homo sapiens
guguagagccugcaucugu

SEQ ID NO: 467394 - RNA, 19 nt, Homo sapiens
cauaucccuuucucucuug

SEQ ID NO: 467395 - RNA, 19 nt, Homo sapiens
gagcgaagacgugaagauc

SEQ ID NO: 467396 - RNA, 19 nt, Homo sapiens
ggagagcgaagacgugaag

SEQ ID NO: 467397 - RNA, 19 nt, Homo sapiens
ucgccgacaucuccuauuc

SEQ ID NO: 467398 - RNA, 19 nt, Homo sapiens
gacuacaacuacuacuaca

SEQ ID NO: 467399 - RNA, 19 nt, Homo sapiens
ccugugacccguuccauau

SEQ ID NO: 467400 - RNA, 19 nt, Homo sapiens
ggacgacuacaacuacuac

SEQ ID NO: 467401 - RNA, 19 nt, Homo sapiens
cgacuacaacuacuacuac

SEQ ID NO: 467402 - RNA, 19 nt, Homo sapiens
gggcauccucuaugaguuc

SEQ ID NO: 467403 - RNA, 19 nt, Homo sapiens
gcaugggacuggccaaccu

SEQ ID NO: 467404 - RNA, 19 nt, Homo sapiens
ccaaauccccucccuguga

SEQ ID NO: 467405 - RNA, 19 nt, Homo sapiens
gcgcucaccaccuguaaca

SEQ ID NO: 467406 - RNA, 19 nt, Homo sapiens
ggucaucgugcccauagug

SEQ ID NO: 467407 - RNA, 19 nt, Homo sapiens
gaagaucggggugcuguuu

SEQ ID NO: 467408 - RNA, 19 nt, Homo sapiens
gaggacgacuacaacuacu

SEQ ID NO: 467409 - RNA, 19 nt, Homo sapiens
uggccaaccugcucuaugc

SEQ ID NO: 467410 - RNA, 19 nt, Homo sapiens
gacggaguccuuuccuuuc

SEQ ID NO: 467411 - RNA, 19 nt, Homo sapiens
cgaggacgacuacaacuac

SEQ ID NO: 467412 - RNA, 19 nt, Homo sapiens
uggacaacaugcuguacau

SEQ ID NO: 467413 - RNA, 19 nt, Homo sapiens
cgccaugucucagucuaug

SEQ ID NO: 467414 - RNA, 19 nt, Homo sapiens
cgacuacaucgcccacaug

SEQ ID NO: 467415 - RNA, 19 nt, Homo sapiens
ccuccgcccaaaucaauaa

SEQ ID NO: 467416 - RNA, 19 nt, Homo sapiens
ucacuaugcggccucuguu

SEQ ID NO: 467417 - RNA, 19 nt, Homo sapiens
gcaagcaguuccaguuaua

SEQ ID NO: 467418 - RNA, 19 nt, Homo sapiens
ugaauacucuucccacaua

SEQ ID NO: 467419 - RNA, 19 nt, Homo sapiens
gaaguggccucuuggauac

SEQ ID NO: 467420 - RNA, 19 nt, Homo sapiens
ucaagaccaucaucacuuu

SEQ ID NO: 467421 - RNA, 19 nt, Homo sapiens
gcacaucuccagaccauug

SEQ ID NO: 467422 - RNA, 19 nt, Homo sapiens
ugaaguggccucuuggaua

SEQ ID NO: 467423 - RNA, 19 nt, Homo sapiens
gcauguggcuucucugucu

SEQ ID NO: 467424 - RNA, 19 nt, Homo sapiens
gcuacuaccugguggucua

SEQ ID NO: 467425 - RNA, 19 nt, Homo sapiens
gaugugaugugaauacucu

SEQ ID NO: 467426 - RNA, 19 nt, Homo sapiens
caucaucacuuucauuguc

SEQ ID NO: 467427 - RNA, 19 nt, Homo sapiens
uaacugacguagaaugaag

SEQ ID NO: 467428 - RNA, 19 nt, Homo sapiens
cuagugaaguggccucuug

SEQ ID NO: 467429 - RNA, 19 nt, Homo sapiens
ucacgccggugcugucgua

SEQ ID NO: 467430 - RNA, 19 nt, Homo sapiens
gggagcaggucacgaacga

SEQ ID NO: 467431 - RNA, 19 nt, Homo sapiens
ggacacaggccaacuaagc

SEQ ID NO: 467432 - RNA, 19 nt, Homo sapiens
gauugcaucuucucugucu

SEQ ID NO: 467433 - RNA, 19 nt, Homo sapiens
ucauggagcucuucuacag

SEQ ID NO: 467434 - RNA, 19 nt, Homo sapiens
gcgacgguguucagaaugu

SEQ ID NO: 467435 - RNA, 19 nt, Homo sapiens
gcccugaggcugcagauga

SEQ ID NO: 467436 - RNA, 19 nt, Homo sapiens
ccgcaagcaguuccaguua

SEQ ID NO: 467437 - RNA, 19 nt, Homo sapiens
gacguagaaugaagaacug

SEQ ID NO: 467438 - RNA, 19 nt, Homo sapiens
gggcuuuguugcuggaaga

SEQ ID NO: 467439 - RNA, 19 nt, Homo sapiens
acucuucccacauacauua

SEQ ID NO: 467440 - RNA, 19 nt, Homo sapiens
aagcgacgguguucagaau

SEQ ID NO: 467441 - RNA, 19 nt, Homo sapiens
ggacgugcuggccuuggua

SEQ ID NO: 467442 - RNA, 19 nt, Homo sapiens
ggucauccuuggugcucuu

SEQ ID NO: 467443 - RNA, 19 nt, Homo sapiens
caagcuggguuugcagugu

SEQ ID NO: 467444 - RNA, 19 nt, Homo sapiens
gguccugucuguccuucug

SEQ ID NO: 467445 - RNA, 19 nt, Homo sapiens
gaaugaagaacugcaugug

SEQ ID NO: 467446 - RNA, 19 nt, Homo sapiens
caucgccaccuuucagauu

SEQ ID NO: 467447 - RNA, 19 nt, Homo sapiens
agagacagagcgacccaua

SEQ ID NO: 467448 - RNA, 19 nt, Homo sapiens
gaccaucaucacuuucauu

SEQ ID NO: 467449 - RNA, 19 nt, Homo sapiens
ggaaaagccaucucagguu

SEQ ID NO: 467450 - RNA, 19 nt, Homo sapiens
cgcaagcaguuccaguuau

SEQ ID NO: 467451 - RNA, 19 nt, Homo sapiens
gaauacucuucccacauac

SEQ ID NO: 467452 - RNA, 19 nt, Homo sapiens
ucaggacacaggccaacua

SEQ ID NO: 467453 - RNA, 19 nt, Homo sapiens
uggcacaucuccagaccau

SEQ ID NO: 467454 - RNA, 19 nt, Homo sapiens
ucuccacgcucaacuacau

SEQ ID NO: 467455 - RNA, 19 nt, Homo sapiens
caggacacaggccaacuaa

SEQ ID NO: 467456 - RNA, 19 nt, Homo sapiens
gguuugcagugucuuccaa

SEQ ID NO: 467457 - RNA, 19 nt, Homo sapiens
ccaguuauacuccguguac

SEQ ID NO: 467458 - RNA, 19 nt, Homo sapiens
gucaagaccaucaucacuu

SEQ ID NO: 467459 - RNA, 19 nt, Homo sapiens
gagcuggagcgcaugaauc

SEQ ID NO: 467460 - RNA, 19 nt, Homo sapiens
gaauuccugagcccaguga

SEQ ID NO: 467461 - RNA, 19 nt, Homo sapiens
ugacguagaaugaagaacu

SEQ ID NO: 467462 - RNA, 19 nt, Homo sapiens
caagcgacgguguucagaa

SEQ ID NO: 467463 - RNA, 19 nt, Homo sapiens
gugcuggccuugguaugug

SEQ ID NO: 467464 - RNA, 19 nt, Homo sapiens
ggaguugugagcccucuag

SEQ ID NO: 467465 - RNA, 19 nt, Homo sapiens
ccuccuacaucuucucucu

SEQ ID NO: 467466 - RNA, 19 nt, Homo sapiens
ugugcuaccuuugcuucua

SEQ ID NO: 467467 - RNA, 19 nt, Homo sapiens
gaagcaggugcccguggaa

SEQ ID NO: 467468 - RNA, 19 nt, Homo sapiens
ggcuugagacaaauccuuu

SEQ ID NO: 467469 - RNA, 19 nt, Homo sapiens
ggagcuggagcgcaugaau

SEQ ID NO: 467470 - RNA, 19 nt, Homo sapiens
ggucuaaggagcgcuagug

SEQ ID NO: 467471 - RNA, 19 nt, Homo sapiens
gcugagcugugacauugcu

SEQ ID NO: 467472 - RNA, 19 nt, Homo sapiens
gcaggucacgaacgagauc

SEQ ID NO: 467473 - RNA, 19 nt, Homo sapiens
gauccuguccaucaucuac

SEQ ID NO: 467474 - RNA, 19 nt, Homo sapiens
guuauacuccguguacuuc

SEQ ID NO: 467475 - RNA, 19 nt, Homo sapiens
aagcgcagccucuucuuca

SEQ ID NO: 467476 - RNA, 19 nt, Homo sapiens
gugcuaccuuugcuucuac

SEQ ID NO: 467477 - RNA, 19 nt, Homo sapiens
guccaucaucuacuucuug

SEQ ID NO: 467478 - RNA, 19 nt, Homo sapiens
caagcgcagccucuucuuc

SEQ ID NO: 467479 - RNA, 19 nt, Homo sapiens
cgacgguguucagaaugug

SEQ ID NO: 467480 - RNA, 19 nt, Homo sapiens
uugcaucuucucugucuaa

SEQ ID NO: 467481 - RNA, 19 nt, Homo sapiens
gccuauuccuccuacaucu

SEQ ID NO: 467482 - RNA, 19 nt, Homo sapiens
gaaagaagaccaugaagaa

SEQ ID NO: 467483 - RNA, 19 nt, Homo sapiens
acaaagagcuacuccauaa

SEQ ID NO: 467484 - RNA, 19 nt, Homo sapiens
gaaauaaaguguaguccuu

SEQ ID NO: 467485 - RNA, 19 nt, Homo sapiens
caaguggucugaacugaua

SEQ ID NO: 467486 - RNA, 19 nt, Homo sapiens
gcacagggauuuaacaaca

SEQ ID NO: 467487 - RNA, 19 nt, Homo sapiens
gaaaggcgcucaguaguuc

SEQ ID NO: 467488 - RNA, 19 nt, Homo sapiens
gaagaugacuugugauuuu

SEQ ID NO: 467489 - RNA, 19 nt, Homo sapiens
gaauucgaauggacaguua

SEQ ID NO: 467490 - RNA, 19 nt, Homo sapiens
gaagaaugauuacaguguu

SEQ ID NO: 467491 - RNA, 19 nt, Homo sapiens
caauauggcuucuacucua

SEQ ID NO: 467492 - RNA, 19 nt, Homo sapiens
caaagaaggugaacagaag

SEQ ID NO: 467493 - RNA, 19 nt, Homo sapiens
gaggaaaccagcauagaua

SEQ ID NO: 467494 - RNA, 19 nt, Homo sapiens
ugaaugaaguggaauguga

SEQ ID NO: 467495 - RNA, 19 nt, Homo sapiens
gaagcaagccugcauccua

SEQ ID NO: 467496 - RNA, 19 nt, Homo sapiens
cauccuagcuagcaucuuu

SEQ ID NO: 467497 - RNA, 19 nt, Homo sapiens
aagaauagcuugaaagaag

SEQ ID NO: 467498 - RNA, 19 nt, Homo sapiens
caggagauguuucuucaaa

SEQ ID NO: 467499 - RNA, 19 nt, Homo sapiens
ccaaugauguagcaaauuc

SEQ ID NO: 467500 - RNA, 19 nt, Homo sapiens
gaacuugcguccuuucucu

SEQ ID NO: 467501 - RNA, 19 nt, Homo sapiens
ucuaguggcuucaguauug

SEQ ID NO: 467502 - RNA, 19 nt, Homo sapiens
gugaagcuguuugagauua

SEQ ID NO: 467503 - RNA, 19 nt, Homo sapiens
gcagugcaguugccuaaug

SEQ ID NO: 467504 - RNA, 19 nt, Homo sapiens
ccacugcuuucuggaauua

SEQ ID NO: 467505 - RNA, 19 nt, Homo sapiens
ggcaggaucuauuggcaua

SEQ ID NO: 467506 - RNA, 19 nt, Homo sapiens
gcagaggagggaaguguua

SEQ ID NO: 467507 - RNA, 19 nt, Homo sapiens
gaaagaggaaaccagcaua

SEQ ID NO: 467508 - RNA, 19 nt, Homo sapiens
gaacgagaaauaaagugua

SEQ ID NO: 467509 - RNA, 19 nt, Homo sapiens
gugaauuccuguacauauu

SEQ ID NO: 467510 - RNA, 19 nt, Homo sapiens
uaauggcucucuagaagaa

SEQ ID NO: 467511 - RNA, 19 nt, Homo sapiens
gaacagaagggcgaagaaa

SEQ ID NO: 467512 - RNA, 19 nt, Homo sapiens
gcaauaauagcuauacuuc

SEQ ID NO: 467513 - RNA, 19 nt, Homo sapiens
ggauaagccugaagucucu

SEQ ID NO: 467514 - RNA, 19 nt, Homo sapiens
gcaugccucuggauucauu

SEQ ID NO: 467515 - RNA, 19 nt, Homo sapiens
ggacagccuuccauguuca

SEQ ID NO: 467516 - RNA, 19 nt, Homo sapiens
uaucagugcugccaucaug

SEQ ID NO: 467517 - RNA, 19 nt, Homo sapiens
gugcauucauccuccauaa

SEQ ID NO: 467518 - RNA, 19 nt, Homo sapiens
gaaagccccuuaauggaaa

SEQ ID NO: 467519 - RNA, 19 nt, Homo sapiens
ugauugacguggagaugua

SEQ ID NO: 467520 - RNA, 19 nt, Homo sapiens
ugacuguuauugcuaagaa

SEQ ID NO: 467521 - RNA, 19 nt, Homo sapiens
gaagcuguuugagauuaaa

SEQ ID NO: 467522 - RNA, 19 nt, Homo sapiens
gaagaguuauccagaccau

SEQ ID NO: 467523 - RNA, 19 nt, Homo sapiens
gggcuucauuauugcauuu

SEQ ID NO: 467524 - RNA, 19 nt, Homo sapiens
gcgaagaaauggagaagcu

SEQ ID NO: 467525 - RNA, 19 nt, Homo sapiens
gaauucugcuccgugcuuu

SEQ ID NO: 467526 - RNA, 19 nt, Homo sapiens
gaauaaaccucuuuuccau

SEQ ID NO: 467527 - RNA, 19 nt, Homo sapiens
ggaacccauuguauuguug

SEQ ID NO: 467528 - RNA, 19 nt, Homo sapiens
gauaugucauccucagaau

SEQ ID NO: 467529 - RNA, 19 nt, Homo sapiens
gaaguaauggcucucuaga

SEQ ID NO: 467530 - RNA, 19 nt, Homo sapiens
ccaaagaaggugaacagaa

SEQ ID NO: 467531 - RNA, 19 nt, Homo sapiens
cuccauaaauuacaucuug

SEQ ID NO: 467532 - RNA, 19 nt, Homo sapiens
cacaggagauguuucuuca

SEQ ID NO: 467533 - RNA, 19 nt, Homo sapiens
gcagauccaguuccuaaug

SEQ ID NO: 467534 - RNA, 19 nt, Homo sapiens
gcuaagaagaaguaagaaa

SEQ ID NO: 467535 - RNA, 19 nt, Homo sapiens
gaauuccuguacauauuuc

SEQ ID NO: 467536 - RNA, 19 nt, Homo sapiens
ugaagcuguuugagauuaa

SEQ ID NO: 467537 - RNA, 19 nt, Homo sapiens
aagcugacauggccuaaug

SEQ ID NO: 467538 - RNA, 19 nt, Homo sapiens
gcgcucaguaguucucuua

SEQ ID NO: 467539 - RNA, 19 nt, Homo sapiens
ucauuugucuaccucuuaa

SEQ ID NO: 467540 - RNA, 19 nt, Homo sapiens
gggacagccuuccauguuc

SEQ ID NO: 467541 - RNA, 19 nt, Homo sapiens
cauauucuguuuacacauc

SEQ ID NO: 467542 - RNA, 19 nt, Homo sapiens
acagaagacugacaagagu

SEQ ID NO: 467543 - RNA, 19 nt, Homo sapiens
ggaugaacuugcguccuuu

SEQ ID NO: 467544 - RNA, 19 nt, Homo sapiens
gcaaugacguaagcaaugc

SEQ ID NO: 467545 - RNA, 19 nt, Homo sapiens
cauucaaacuuggagauuu

SEQ ID NO: 467546 - RNA, 19 nt, Homo sapiens
agaagaccaugaagaaaca

SEQ ID NO: 467547 - RNA, 19 nt, Homo sapiens
gggaccaucuuagguauuc

SEQ ID NO: 467548 - RNA, 19 nt, Homo sapiens
aaagugggcucuguugugu

SEQ ID NO: 467549 - RNA, 19 nt, Homo sapiens
ucugguugcuuuauauuug

SEQ ID NO: 467550 - RNA, 19 nt, Homo sapiens
ggccucugguugcuuuaua

SEQ ID NO: 467551 - RNA, 19 nt, Homo sapiens
aguaauggcucucuagaag

SEQ ID NO: 467552 - RNA, 19 nt, Homo sapiens
agagcuacuccauaaauua

SEQ ID NO: 467553 - RNA, 19 nt, Homo sapiens
guacaaagagcuacuccau

SEQ ID NO: 467554 - RNA, 19 nt, Homo sapiens
acaagcauccuguuucuga

SEQ ID NO: 467555 - RNA, 19 nt, Homo sapiens
ugaaagaagaccaugaaga

SEQ ID NO: 467556 - RNA, 19 nt, Homo sapiens
cauauucgggagcuucuua

SEQ ID NO: 467557 - RNA, 19 nt, Homo sapiens
uggaugaacuugcguccuu

SEQ ID NO: 467558 - RNA, 19 nt, Homo sapiens
gaaugaaguggaaugugaa

SEQ ID NO: 467559 - RNA, 19 nt, Homo sapiens
agaauagcuugaaagaaga

SEQ ID NO: 467560 - RNA, 19 nt, Homo sapiens
uaaaguguaguccuucuga

SEQ ID NO: 467561 - RNA, 19 nt, Homo sapiens
gcaacgcugauuaccagua

SEQ ID NO: 467562 - RNA, 19 nt, Homo sapiens
ugaaaggcgcucaguaguu

SEQ ID NO: 467563 - RNA, 19 nt, Homo sapiens
caggaucuauuggcauauu

SEQ ID NO: 467564 - RNA, 19 nt, Homo sapiens
gcucugcguuguugguuuc

SEQ ID NO: 467565 - RNA, 19 nt, Homo sapiens
aagagcuacuccauaaauu

SEQ ID NO: 467566 - RNA, 19 nt, Homo sapiens
aaagagcuacuccauaaau

SEQ ID NO: 467567 - RNA, 19 nt, Homo sapiens
aaaguugucuguuggugau

SEQ ID NO: 467568 - RNA, 19 nt, Homo sapiens
gagaauggcaacgcugauu

SEQ ID NO: 467569 - RNA, 19 nt, Homo sapiens
acagggauuuaacaacaaa

SEQ ID NO: 467570 - RNA, 19 nt, Homo sapiens
ggaauucugcuccgugcuu

SEQ ID NO: 467571 - RNA, 19 nt, Homo sapiens
ggaaguaauggcucucuag

SEQ ID NO: 467572 - RNA, 19 nt, Homo sapiens
ccaagaagcgaauucgaau

SEQ ID NO: 467573 - RNA, 19 nt, Homo sapiens
gaaaccagcauagauagca

SEQ ID NO: 467574 - RNA, 19 nt, Homo sapiens
cuagcuagcaucuuugaaa

SEQ ID NO: 467575 - RNA, 19 nt, Homo sapiens
agaauggcaacgcugauua

SEQ ID NO: 467576 - RNA, 19 nt, Homo sapiens
auaaguagaguccuuggua

SEQ ID NO: 467577 - RNA, 19 nt, Homo sapiens
ugauuacaguguuaacaga

SEQ ID NO: 467578 - RNA, 19 nt, Homo sapiens
gccguaguuuacaguauuu

SEQ ID NO: 467579 - RNA, 19 nt, Homo sapiens
gauaccucauauucuguuu

SEQ ID NO: 467580 - RNA, 19 nt, Homo sapiens
caacgcugauuaccaguac

SEQ ID NO: 467581 - RNA, 19 nt, Homo sapiens
ucacaugcacagggauuua

SEQ ID NO: 467582 - RNA, 19 nt, Homo sapiens
caucauagcuuucaucuug

SEQ ID NO: 467583 - RNA, 19 nt, Homo sapiens
gaggagacaucacagcuuu

SEQ ID NO: 467584 - RNA, 19 nt, Homo sapiens
gauauaauguggugcaguu

SEQ ID NO: 467585 - RNA, 19 nt, Homo sapiens
guaaugagcuucagaacag

SEQ ID NO: 467586 - RNA, 19 nt, Homo sapiens
gaugcuggauggaguauuu

SEQ ID NO: 467587 - RNA, 19 nt, Homo sapiens
acaaagaucugcugcacaa

SEQ ID NO: 467588 - RNA, 19 nt, Homo sapiens
guuuauaucuccacuguug

SEQ ID NO: 467589 - RNA, 19 nt, Homo sapiens
ccucaagcuuuguuuauuu

SEQ ID NO: 467590 - RNA, 19 nt, Homo sapiens
gauuguugcuucuugguuu

SEQ ID NO: 467591 - RNA, 19 nt, Homo sapiens
caucacagcuuucccagau

SEQ ID NO: 467592 - RNA, 19 nt, Homo sapiens
ggaaguacgacuaauguug

SEQ ID NO: 467593 - RNA, 19 nt, Homo sapiens
gaagagcacuguccaugac

SEQ ID NO: 467594 - RNA, 19 nt, Homo sapiens
gugcacggcucucucauga

SEQ ID NO: 467595 - RNA, 19 nt, Homo sapiens
caaaguaggagaaaccauu

SEQ ID NO: 467596 - RNA, 19 nt, Homo sapiens
cauagaauaggcagcauua

SEQ ID NO: 467597 - RNA, 19 nt, Homo sapiens
gaagagugauccagaccau

SEQ ID NO: 467598 - RNA, 19 nt, Homo sapiens
ggaaguuagugccaugguu

SEQ ID NO: 467599 - RNA, 19 nt, Homo sapiens
gcaaugacgugaguaaugc

SEQ ID NO: 467600 - RNA, 19 nt, Homo sapiens
ggaagagcacuguccauga

SEQ ID NO: 467601 - RNA, 19 nt, Homo sapiens
gaacacaaccaaaugaacu

SEQ ID NO: 467602 - RNA, 19 nt, Homo sapiens
gagcuaacuuaacuacugu

SEQ ID NO: 467603 - RNA, 19 nt, Homo sapiens
cgagcuaacuuaacuacug

SEQ ID NO: 467604 - RNA, 19 nt, Homo sapiens
gaaaccauucgcaaaggua

SEQ ID NO: 467605 - RNA, 19 nt, Homo sapiens
ccauuggagucucuucuuu

SEQ ID NO: 467606 - RNA, 19 nt, Homo sapiens
gcaguggccuuuccuuguc

SEQ ID NO: 467607 - RNA, 19 nt, Homo sapiens
gaaggacgcacccgagguu

SEQ ID NO: 467608 - RNA, 19 nt, Homo sapiens
gagcgacggucauguguac

SEQ ID NO: 467609 - RNA, 19 nt, Homo sapiens
ggagaaaccauucgcaaag

SEQ ID NO: 467610 - RNA, 19 nt, Homo sapiens
cauuguggguucuacuaua

SEQ ID NO: 467611 - RNA, 19 nt, Homo sapiens
ugaaaucgcccaucuccaa

SEQ ID NO: 467612 - RNA, 19 nt, Homo sapiens
ggccauggaugaguauuug

SEQ ID NO: 467613 - RNA, 19 nt, Homo sapiens
ggaggaaguacgacuaaug

SEQ ID NO: 467614 - RNA, 19 nt, Homo sapiens
ccaaaggugugcaguggau

SEQ ID NO: 467615 - RNA, 19 nt, Homo sapiens
ccauagcccucauuuccuu

SEQ ID NO: 467616 - RNA, 19 nt, Homo sapiens
uuuauaaccucaagcuuug

SEQ ID NO: 467617 - RNA, 19 nt, Homo sapiens
guuuauaaccucaagcuuu

SEQ ID NO: 467618 - RNA, 19 nt, Homo sapiens
aaaggaaaguguagauugg

SEQ ID NO: 467619 - RNA, 19 nt, Homo sapiens
guggugcaguuacuuauau

SEQ ID NO: 467620 - RNA, 19 nt, Homo sapiens
gacgaaagccucaguaagg

SEQ ID NO: 467621 - RNA, 19 nt, Homo sapiens
gaggaaguacgacuaaugu

SEQ ID NO: 467622 - RNA, 19 nt, Homo sapiens
gaagaacggauccuugucu

SEQ ID NO: 467623 - RNA, 19 nt, Homo sapiens
ucauugacgugaaccugua

SEQ ID NO: 467624 - RNA, 19 nt, Homo sapiens
caaauguuaagccuucuaa

SEQ ID NO: 467625 - RNA, 19 nt, Homo sapiens
gccuagaagucaauauuca

SEQ ID NO: 467626 - RNA, 19 nt, Homo sapiens
aaauggccauggaugagua

SEQ ID NO: 467627 - RNA, 19 nt, Homo sapiens
ggauggaguauuucucuga

SEQ ID NO: 467628 - RNA, 19 nt, Homo sapiens
gggaaucauuggccagugu

SEQ ID NO: 467629 - RNA, 19 nt, Homo sapiens
ggaaaguguagauuggaaa

SEQ ID NO: 467630 - RNA, 19 nt, Homo sapiens
ggagaagccagcccaggaa

SEQ ID NO: 467631 - RNA, 19 nt, Homo sapiens
uaaccucaagcuuuguuua

SEQ ID NO: 467632 - RNA, 19 nt, Homo sapiens
gagaaaccauucgcaaagg

SEQ ID NO: 467633 - RNA, 19 nt, Homo sapiens
ugacugaacacaaccaaau

SEQ ID NO: 467634 - RNA, 19 nt, Homo sapiens
ggaaaguaccaaagaagca

SEQ ID NO: 467635 - RNA, 19 nt, Homo sapiens
cuauggaaaugcugcuaaa

SEQ ID NO: 467636 - RNA, 19 nt, Homo sapiens
ggacgggagcucacaagug

SEQ ID NO: 467637 - RNA, 19 nt, Homo sapiens
guguauugauuguugugua

SEQ ID NO: 467638 - RNA, 19 nt, Homo sapiens
gcugagcacuacaugucaa

SEQ ID NO: 467639 - RNA, 19 nt, Homo sapiens
gcaaauguuaagccuucua

SEQ ID NO: 467640 - RNA, 19 nt, Homo sapiens
ggugaucgccuccaacauc

SEQ ID NO: 467641 - RNA, 19 nt, Homo sapiens
ggcaaugacgugaguaaug

SEQ ID NO: 467642 - RNA, 19 nt, Homo sapiens
ggccuuacgaaguuuauaa

SEQ ID NO: 467643 - RNA, 19 nt, Homo sapiens
gacaaacauuuucuuggua

SEQ ID NO: 467644 - RNA, 19 nt, Homo sapiens
gaucagagaauuuuggaaa

SEQ ID NO: 467645 - RNA, 19 nt, Homo sapiens
ccauaugugugauuugucu

SEQ ID NO: 467646 - RNA, 19 nt, Homo sapiens
gugccaaggcuaaugauga

SEQ ID NO: 467647 - RNA, 19 nt, Homo sapiens
gcucugguguggugaccuu

SEQ ID NO: 467648 - RNA, 19 nt, Homo sapiens
gcucuacuccaucccauug

SEQ ID NO: 467649 - RNA, 19 nt, Homo sapiens
uaacauuguccagcacuuu

SEQ ID NO: 467650 - RNA, 19 nt, Homo sapiens
gaaucauuggccaguguua

SEQ ID NO: 467651 - RNA, 19 nt, Homo sapiens
uguccagccucuaacauug

SEQ ID NO: 467652 - RNA, 19 nt, Homo sapiens
gcagcauuauuucaaacau

SEQ ID NO: 467653 - RNA, 19 nt, Homo sapiens
gcuacucgagcuacuguaa

SEQ ID NO: 467654 - RNA, 19 nt, Homo sapiens
ucacgaguaucugacgaaa

SEQ ID NO: 467655 - RNA, 19 nt, Homo sapiens
uggaaaugcugcuaaaauu

SEQ ID NO: 467656 - RNA, 19 nt, Homo sapiens
guuggagccugaaacuaug

SEQ ID NO: 467657 - RNA, 19 nt, Homo sapiens
ccauagcaaucaaugucuu

SEQ ID NO: 467658 - RNA, 19 nt, Homo sapiens
caugucaaguccagaguca

SEQ ID NO: 467659 - RNA, 19 nt, Homo sapiens
gguaaugagcuucagaaca

SEQ ID NO: 467660 - RNA, 19 nt, Homo sapiens
uaggcagcauuauuucaaa

SEQ ID NO: 467661 - RNA, 19 nt, Homo sapiens
aaacugguaucguggugau

SEQ ID NO: 467662 - RNA, 19 nt, Homo sapiens
agaagaggcugcgcuacga

SEQ ID NO: 467663 - RNA, 19 nt, Homo sapiens
gagaagccagcccaggaaa

SEQ ID NO: 467664 - RNA, 19 nt, Homo sapiens
ggaggagacaucacagcuu

SEQ ID NO: 467665 - RNA, 19 nt, Homo sapiens
gagggaggaaguacgacua

SEQ ID NO: 467666 - RNA, 19 nt, Homo sapiens
ucucugaggcccacacaaa

SEQ ID NO: 467667 - RNA, 19 nt, Homo sapiens
gugcuucccuuauacuuuu

SEQ ID NO: 467668 - RNA, 19 nt, Homo sapiens
ugucuggccugcuguuugu

SEQ ID NO: 467669 - RNA, 19 nt, Homo sapiens
ggagcgacggucaugugua

SEQ ID NO: 467670 - RNA, 19 nt, Homo sapiens
gauucucacuggucgcaau

SEQ ID NO: 467671 - RNA, 19 nt, Homo sapiens
gucaguuucuaucccaauu

SEQ ID NO: 467672 - RNA, 19 nt, Homo sapiens
auggugugcuucccuuaua

SEQ ID NO: 467673 - RNA, 19 nt, Homo sapiens
gauccuuccauauguguga

SEQ ID NO: 467674 - RNA, 19 nt, Homo sapiens
cauuuuggguuucaucaua

SEQ ID NO: 467675 - RNA, 19 nt, Homo sapiens
guucaccuccuguuccauu

SEQ ID NO: 467676 - RNA, 19 nt, Homo sapiens
guaccacaccgugcacaaa

SEQ ID NO: 467677 - RNA, 19 nt, Homo sapiens
gccugaaacuauggaaaug

SEQ ID NO: 467678 - RNA, 19 nt, Homo sapiens
gaacucuuggccuuacgaa

SEQ ID NO: 467679 - RNA, 19 nt, Homo sapiens
gaagcagaguccccaguau

SEQ ID NO: 467680 - RNA, 19 nt, Homo sapiens
acuguugucugguuucaug

SEQ ID NO: 467681 - RNA, 19 nt, Homo sapiens
uguuggagccugaaacuau

SEQ ID NO: 467682 - RNA, 19 nt, Homo sapiens
gcucaaggcauucuacaaa

SEQ ID NO: 467683 - RNA, 19 nt, Homo sapiens
gaauaaaccggauccuguu

SEQ ID NO: 467684 - RNA, 19 nt, Homo sapiens
gaaacacuccucuggaugu

SEQ ID NO: 467685 - RNA, 19 nt, Homo sapiens
ggauguggccauaguguuu

SEQ ID NO: 467686 - RNA, 19 nt, Homo sapiens
gcuugcagauccugaagaa

SEQ ID NO: 467687 - RNA, 19 nt, Homo sapiens
ugaagcugcucaacaaagu

SEQ ID NO: 467688 - RNA, 19 nt, Homo sapiens
uggugaagcugcucaacaa

SEQ ID NO: 467689 - RNA, 19 nt, Homo sapiens
ccauaguguuugucaucua

SEQ ID NO: 467690 - RNA, 19 nt, Homo sapiens
ccacuuguccaugugcuua

SEQ ID NO: 467691 - RNA, 19 nt, Homo sapiens
agaguguccugcuaccuuu

SEQ ID NO: 467692 - RNA, 19 nt, Homo sapiens
gcgcacaaauaccggaaca

SEQ ID NO: 467693 - RNA, 19 nt, Homo sapiens
uggaaacacuccucuggau

SEQ ID NO: 467694 - RNA, 19 nt, Homo sapiens
gccagugucuuuggaaaca

SEQ ID NO: 467695 - RNA, 19 nt, Homo sapiens
gguuuggaauguucgaguu

SEQ ID NO: 467696 - RNA, 19 nt, Homo sapiens
cagccagugucuuuggaaa

SEQ ID NO: 467697 - RNA, 19 nt, Homo sapiens
cgucagguuuggaauguuc

SEQ ID NO: 467698 - RNA, 19 nt, Homo sapiens
ccagugcaguagugccaaa

SEQ ID NO: 467699 - RNA, 19 nt, Homo sapiens
cuaccuuugucucacauga

SEQ ID NO: 467700 - RNA, 19 nt, Homo sapiens
ucaaggcauucuacaaagg

SEQ ID NO: 467701 - RNA, 19 nt, Homo sapiens
caaguacagaggauucuuc

SEQ ID NO: 467702 - RNA, 19 nt, Homo sapiens
gcauuguggcugucaaauc

SEQ ID NO: 467703 - RNA, 19 nt, Homo sapiens
gccgucagguuuggaaugu

SEQ ID NO: 467704 - RNA, 19 nt, Homo sapiens
guccaugugcuuacuguga

SEQ ID NO: 467705 - RNA, 19 nt, Homo sapiens
cauuguggcugucaaaucc

SEQ ID NO: 467706 - RNA, 19 nt, Homo sapiens
cagaguguccugcuaccuu

SEQ ID NO: 467707 - RNA, 19 nt, Homo sapiens
gcgcggaguucuggagucu

SEQ ID NO: 467708 - RNA, 19 nt, Homo sapiens
ggccauaguguuugucauc

SEQ ID NO: 467709 - RNA, 19 nt, Homo sapiens
acacuccucuggaugugau

SEQ ID NO: 467710 - RNA, 19 nt, Homo sapiens
aaacacuccucuggaugug

SEQ ID NO: 467711 - RNA, 19 nt, Homo sapiens
uccaugugcuuacugugaa

SEQ ID NO: 467712 - RNA, 19 nt, Homo sapiens
cccaugaacccucugauca

SEQ ID NO: 467713 - RNA, 19 nt, Homo sapiens
ggccuggcuucaccgcauu

SEQ ID NO: 467714 - RNA, 19 nt, Homo sapiens
uggagaccaucaaggugaa

SEQ ID NO: 467715 - RNA, 19 nt, Homo sapiens
ggugaagcugcucaacaaa

SEQ ID NO: 467716 - RNA, 19 nt, Homo sapiens
gcagccagugucuuuggaa

SEQ ID NO: 467717 - RNA, 19 nt, Homo sapiens
caugaacccucugaucacu

SEQ ID NO: 467718 - RNA, 19 nt, Homo sapiens
ccgccagaguguccugcua

SEQ ID NO: 467719 - RNA, 19 nt, Homo sapiens
gaagcugcucaacaaagug

SEQ ID NO: 467720 - RNA, 19 nt, Homo sapiens
aggcgcagccagugucuuu

SEQ ID NO: 467721 - RNA, 19 nt, Homo sapiens
gauguggccauaguguuug

SEQ ID NO: 467722 - RNA, 19 nt, Homo sapiens
cagccacuguccugaagca

SEQ ID NO: 467723 - RNA, 19 nt, Homo sapiens
augugcaucuggccuauga

SEQ ID NO: 467724 - RNA, 19 nt, Homo sapiens
ugauuccagugcaguagug

SEQ ID NO: 467725 - RNA, 19 nt, Homo sapiens
ucaacaaaguguggaagac

SEQ ID NO: 467726 - RNA, 19 nt, Homo sapiens
gugaagcugcucaacaaag

SEQ ID NO: 467727 - RNA, 19 nt, Homo sapiens
accuuugucucacaugauu

SEQ ID NO: 467728 - RNA, 19 nt, Homo sapiens
gccauaguguuugucaucu

SEQ ID NO: 467729 - RNA, 19 nt, Homo sapiens
ugaccucccugcgcaacug

SEQ ID NO: 467730 - RNA, 19 nt, Homo sapiens
ggaaguggcugaguuauua

SEQ ID NO: 467731 - RNA, 19 nt, Homo sapiens
ccaagcaacugaucuauuu

SEQ ID NO: 467732 - RNA, 19 nt, Homo sapiens
gaagggaggcucaauguaa

SEQ ID NO: 467733 - RNA, 19 nt, Homo sapiens
gcucauuucuucagcuuua

SEQ ID NO: 467734 - RNA, 19 nt, Homo sapiens
ggucauucaucaacaaaua

SEQ ID NO: 467735 - RNA, 19 nt, Homo sapiens
gaaggaaguggcugaguua

SEQ ID NO: 467736 - RNA, 19 nt, Homo sapiens
guacaucuccaucuuauuu

SEQ ID NO: 467737 - RNA, 19 nt, Homo sapiens
cagaagagaugucagcaaa

SEQ ID NO: 467738 - RNA, 19 nt, Homo sapiens
ggaagaaccucccacaucu

SEQ ID NO: 467739 - RNA, 19 nt, Homo sapiens
caacacagcugcaguuaac

SEQ ID NO: 467740 - RNA, 19 nt, Homo sapiens
gcucauaccauucccauuu

SEQ ID NO: 467741 - RNA, 19 nt, Homo sapiens
cagacaagcuuauuuccaa

SEQ ID NO: 467742 - RNA, 19 nt, Homo sapiens
caacugaucuauuugaacu

SEQ ID NO: 467743 - RNA, 19 nt, Homo sapiens
ucccaaaccuuuauucuau

SEQ ID NO: 467744 - RNA, 19 nt, Homo sapiens
cagcugaguuuaugaacaa

SEQ ID NO: 467745 - RNA, 19 nt, Homo sapiens
gcaacuaacccuggucuuu

SEQ ID NO: 467746 - RNA, 19 nt, Homo sapiens
cgugauagauguugagaga

SEQ ID NO: 467747 - RNA, 19 nt, Homo sapiens
gaggcucccugguggauuu

SEQ ID NO: 467748 - RNA, 19 nt, Homo sapiens
gcaagaagccacagauugg

SEQ ID NO: 467749 - RNA, 19 nt, Homo sapiens
caaagcaagugaugaagca

SEQ ID NO: 467750 - RNA, 19 nt, Homo sapiens
gaagagaugucagcaaagc

SEQ ID NO: 467751 - RNA, 19 nt, Homo sapiens
gcuggagggugaagaagaa

SEQ ID NO: 467752 - RNA, 19 nt, Homo sapiens
ggaggucauucaucaacaa

SEQ ID NO: 467753 - RNA, 19 nt, Homo sapiens
ugaagaagaacaaggagua

SEQ ID NO: 467754 - RNA, 19 nt, Homo sapiens
guacagcgccuacuucaag

SEQ ID NO: 467755 - RNA, 19 nt, Homo sapiens
cuuagauccucacauguua

SEQ ID NO: 467756 - RNA, 19 nt, Homo sapiens
gaaaugguucugcuuggaa

SEQ ID NO: 467757 - RNA, 19 nt, Homo sapiens
caaggaaggccuaugaaau

SEQ ID NO: 467758 - RNA, 19 nt, Homo sapiens
uaagugcuguccauaugaa

SEQ ID NO: 467759 - RNA, 19 nt, Homo sapiens
cagaugagguggcuucaca

SEQ ID NO: 467760 - RNA, 19 nt, Homo sapiens
ccuauacucacuaauguua

SEQ ID NO: 467761 - RNA, 19 nt, Homo sapiens
gcagaucuuuguggacuau

SEQ ID NO: 467762 - RNA, 19 nt, Homo sapiens
agaaggaaguggcugaguu

SEQ ID NO: 467763 - RNA, 19 nt, Homo sapiens
ucaacaaguuccuggagaa

SEQ ID NO: 467764 - RNA, 19 nt, Homo sapiens
gcaaugccauccucaucau

SEQ ID NO: 467765 - RNA, 19 nt, Homo sapiens
guacagucucugcccauua

SEQ ID NO: 467766 - RNA, 19 nt, Homo sapiens
ggaagggaggcucaaugua

SEQ ID NO: 467767 - RNA, 19 nt, Homo sapiens
guccuuagauccucacaug

SEQ ID NO: 467768 - RNA, 19 nt, Homo sapiens
ccaccuuccucaacaaguu

SEQ ID NO: 467769 - RNA, 19 nt, Homo sapiens
ccugguggauuucauuaaa

SEQ ID NO: 467770 - RNA, 19 nt, Homo sapiens
cauaugaacccuggacuuu

SEQ ID NO: 467771 - RNA, 19 nt, Homo sapiens
acacagcugcuacgugaua

SEQ ID NO: 467772 - RNA, 19 nt, Homo sapiens
cagcaaagcaagugaugaa

SEQ ID NO: 467773 - RNA, 19 nt, Homo sapiens
ucuaagugcuguccauaug

SEQ ID NO: 467774 - RNA, 19 nt, Homo sapiens
guuaacacgucauuuccuu

SEQ ID NO: 467775 - RNA, 19 nt, Homo sapiens
gcacaucaaguucuauaca

SEQ ID NO: 467776 - RNA, 19 nt, Homo sapiens
gcuuugggcucuccaguuc

SEQ ID NO: 467777 - RNA, 19 nt, Homo sapiens
gaaggauccugaccugacu

SEQ ID NO: 467778 - RNA, 19 nt, Homo sapiens
ccucaccucccuccauuua

SEQ ID NO: 467779 - RNA, 19 nt, Homo sapiens
ugauagauguugagagaca

SEQ ID NO: 467780 - RNA, 19 nt, Homo sapiens
cagacaugcucauaccauu

SEQ ID NO: 467781 - RNA, 19 nt, Homo sapiens
gggauccgcuucagcaaag

SEQ ID NO: 467782 - RNA, 19 nt, Homo sapiens
ugaaugagaucagcaaugc

SEQ ID NO: 467783 - RNA, 19 nt, Homo sapiens
ggccauucaugacccuuaa

SEQ ID NO: 467784 - RNA, 19 nt, Homo sapiens
ccaaggaaggccuaugaaa

SEQ ID NO: 467785 - RNA, 19 nt, Homo sapiens
gcagcaacaucaacaugag

SEQ ID NO: 467786 - RNA, 19 nt, Homo sapiens
ggaccugccucccaguaag

SEQ ID NO: 467787 - RNA, 19 nt, Homo sapiens
caacuaacccuggucuuuc

SEQ ID NO: 467788 - RNA, 19 nt, Homo sapiens
ggucucauuuccagcuuga

SEQ ID NO: 467789 - RNA, 19 nt, Homo sapiens
gaaguggcugaguuauuaa

SEQ ID NO: 467790 - RNA, 19 nt, Homo sapiens
ccuagcacaucaaguucua

SEQ ID NO: 467791 - RNA, 19 nt, Homo sapiens
ugagguggcuucacaugca

SEQ ID NO: 467792 - RNA, 19 nt, Homo sapiens
aaggaaggccuaugaaaug

SEQ ID NO: 467793 - RNA, 19 nt, Homo sapiens
cauuugggaucuccuaugu

SEQ ID NO: 467794 - RNA, 19 nt, Homo sapiens
aaugaugcccugcaacuaa

SEQ ID NO: 467795 - RNA, 19 nt, Homo sapiens
agacaagcuuauuuccaaa

SEQ ID NO: 467796 - RNA, 19 nt, Homo sapiens
ggagaccgacuuugugcaa

SEQ ID NO: 467797 - RNA, 19 nt, Homo sapiens
gcugcuacgugauagaugu

SEQ ID NO: 467798 - RNA, 19 nt, Homo sapiens
cauugaggaugcccacuga

SEQ ID NO: 467799 - RNA, 19 nt, Homo sapiens
gauccuuuguguuccuuug

SEQ ID NO: 467800 - RNA, 19 nt, Homo sapiens
uaugccaacuuccucauug

SEQ ID NO: 467801 - RNA, 19 nt, Homo sapiens
uggcuaggccugcucauuu

SEQ ID NO: 467802 - RNA, 19 nt, Homo sapiens
caauuuaaccacauuugga

SEQ ID NO: 467803 - RNA, 19 nt, Homo sapiens
aaagccaccucauuuccaa

SEQ ID NO: 467804 - RNA, 19 nt, Homo sapiens
ucaccucccuccauuuaca

SEQ ID NO: 467805 - RNA, 19 nt, Homo sapiens
gcaugcugcugcuuugcuu

SEQ ID NO: 467806 - RNA, 19 nt, Homo sapiens
ggucaacacagcugcaguu

SEQ ID NO: 467807 - RNA, 19 nt, Homo sapiens
caucuuauuugccaucucu

SEQ ID NO: 467808 - RNA, 19 nt, Homo sapiens
ggaaaaugaugcccugcaa

SEQ ID NO: 467809 - RNA, 19 nt, Homo sapiens
ugaaaugguucugcuugga

SEQ ID NO: 467810 - RNA, 19 nt, Homo sapiens
guagagaggcagaagagau

SEQ ID NO: 467811 - RNA, 19 nt, Homo sapiens
gaagcuacaacacagugaa

SEQ ID NO: 467812 - RNA, 19 nt, Homo sapiens
uaugaacccuggacuuucu

SEQ ID NO: 467813 - RNA, 19 nt, Homo sapiens
aaaugguucugcuuggaaa

SEQ ID NO: 467814 - RNA, 19 nt, Homo sapiens
uagcacaucaaguucuaua

SEQ ID NO: 467815 - RNA, 19 nt, Homo sapiens
uauugguucucaccucuuu

SEQ ID NO: 467816 - RNA, 19 nt, Homo sapiens
cugaguuuaugaacaauga

SEQ ID NO: 467817 - RNA, 19 nt, Homo sapiens
gagacaauggaaucgagua

SEQ ID NO: 467818 - RNA, 19 nt, Homo sapiens
cuauguggaugacuucuca

SEQ ID NO: 467819 - RNA, 19 nt, Homo sapiens
aaaguccaaugccaugaga

SEQ ID NO: 467820 - RNA, 19 nt, Homo sapiens
uaccucaccucccuccauu

SEQ ID NO: 467821 - RNA, 19 nt, Homo sapiens
gcagaagagaugucagcaa

SEQ ID NO: 467822 - RNA, 19 nt, Homo sapiens
gggaugcuguuuggaggaa

SEQ ID NO: 467823 - RNA, 19 nt, Homo sapiens
ggcuaggccugcucauuuc

SEQ ID NO: 467824 - RNA, 19 nt, Homo sapiens
ugccaucucuguauuugga

SEQ ID NO: 467825 - RNA, 19 nt, Homo sapiens
ucuccgagcccuaccagua

SEQ ID NO: 467826 - RNA, 19 nt, Homo sapiens
gcaauuuaaccacauuugg

SEQ ID NO: 467827 - RNA, 19 nt, Homo sapiens
uuacagacaagcuuauuuc

SEQ ID NO: 467828 - RNA, 19 nt, Homo sapiens
ccaaugccaugagacugaa

SEQ ID NO: 467829 - RNA, 19 nt, Homo sapiens
gaaaaccccaguccucauu

SEQ ID NO: 467830 - RNA, 19 nt, Homo sapiens
caaacaagcugcccacaua

SEQ ID NO: 467831 - RNA, 19 nt, Homo sapiens
ggacauaacucagauuguu

SEQ ID NO: 467832 - RNA, 19 nt, Homo sapiens
uaacuuaccuccaauaugu

SEQ ID NO: 467833 - RNA, 19 nt, Homo sapiens
gcacaagaguauuugguaa

SEQ ID NO: 467834 - RNA, 19 nt, Homo sapiens
cccauuaacucaucauuua

SEQ ID NO: 467835 - RNA, 19 nt, Homo sapiens
gcaauaacaugugcauuug

SEQ ID NO: 467836 - RNA, 19 nt, Homo sapiens
gcaaaugucccuucuguau

SEQ ID NO: 467837 - RNA, 19 nt, Homo sapiens
gggcuuaggcuguuucuua

SEQ ID NO: 467838 - RNA, 19 nt, Homo sapiens
caagauuacugucaaacaa

SEQ ID NO: 467839 - RNA, 19 nt, Homo sapiens
ggaccugacuguuccuuga

SEQ ID NO: 467840 - RNA, 19 nt, Homo sapiens
gugcaaauguuuauguuga

SEQ ID NO: 467841 - RNA, 19 nt, Homo sapiens
gaaacaggagcuauuauug

SEQ ID NO: 467842 - RNA, 19 nt, Homo sapiens
gaugcaaucuuucuaaugg

SEQ ID NO: 467843 - RNA, 19 nt, Homo sapiens
gaaggaauuccacaagauu

SEQ ID NO: 467844 - RNA, 19 nt, Homo sapiens
guagaaacaggagcuauua

SEQ ID NO: 467845 - RNA, 19 nt, Homo sapiens
aagaagaggucaagaagga

SEQ ID NO: 467846 - RNA, 19 nt, Homo sapiens
ggcaauaacaugugcauuu

SEQ ID NO: 467847 - RNA, 19 nt, Homo sapiens
cuaguuggauucauuaaug

SEQ ID NO: 467848 - RNA, 19 nt, Homo sapiens
gcagguuuguuacauaugu

SEQ ID NO: 467849 - RNA, 19 nt, Homo sapiens
gauugcaacuguccaucua

SEQ ID NO: 467850 - RNA, 19 nt, Homo sapiens
gaaaagcagucuagcaaau

SEQ ID NO: 467851 - RNA, 19 nt, Homo sapiens
uaugaaaucugaagagaag

SEQ ID NO: 467852 - RNA, 19 nt, Homo sapiens
ccaacacacuuccaaagga

SEQ ID NO: 467853 - RNA, 19 nt, Homo sapiens
gaccuuaauuacacuauuc

SEQ ID NO: 467854 - RNA, 19 nt, Homo sapiens
uagcaaaugucccuucugu

SEQ ID NO: 467855 - RNA, 19 nt, Homo sapiens
guacaaaggaaguuaaauc

SEQ ID NO: 467856 - RNA, 19 nt, Homo sapiens
ggaaauucaucugcaguuc

SEQ ID NO: 467857 - RNA, 19 nt, Homo sapiens
gaagaggucaagaaggaaa

SEQ ID NO: 467858 - RNA, 19 nt, Homo sapiens
gaaucuacaguuucaguuu

SEQ ID NO: 467859 - RNA, 19 nt, Homo sapiens
ggcauuggaugugugguua

SEQ ID NO: 467860 - RNA, 19 nt, Homo sapiens
ugagguguaugaaaucuga

SEQ ID NO: 467861 - RNA, 19 nt, Homo sapiens
gaacgggaauaaacauggu

SEQ ID NO: 467862 - RNA, 19 nt, Homo sapiens
ggcuuaggcuguuucuuaa

SEQ ID NO: 467863 - RNA, 19 nt, Homo sapiens
aauggaagcuuugagauug

SEQ ID NO: 467864 - RNA, 19 nt, Homo sapiens
aaaugucccuucuguaugu

SEQ ID NO: 467865 - RNA, 19 nt, Homo sapiens
uccaaguucucccaaauuu

SEQ ID NO: 467866 - RNA, 19 nt, Homo sapiens
ugaaggaauuccacaagau

SEQ ID NO: 467867 - RNA, 19 nt, Homo sapiens
aaauaccucuuaugaagga

SEQ ID NO: 467868 - RNA, 19 nt, Homo sapiens
ugguuuggcuuucugauuu

SEQ ID NO: 467869 - RNA, 19 nt, Homo sapiens
ggauauaugguucucuuga

SEQ ID NO: 467870 - RNA, 19 nt, Homo sapiens
aauugcagcuguauucaaa

SEQ ID NO: 467871 - RNA, 19 nt, Homo sapiens
aggaaggacuagagacuaa

SEQ ID NO: 467872 - RNA, 19 nt, Homo sapiens
gugcagguuuguuacauau

SEQ ID NO: 467873 - RNA, 19 nt, Homo sapiens
cgacaaaggaccugacugu

SEQ ID NO: 467874 - RNA, 19 nt, Homo sapiens
gcagcuguauucaaacauc

SEQ ID NO: 467875 - RNA, 19 nt, Homo sapiens
caacuuguccucaaacagu

SEQ ID NO: 467876 - RNA, 19 nt, Homo sapiens
ugauacaguucaaugcauu

SEQ ID NO: 467877 - RNA, 19 nt, Homo sapiens
gagcuauuauugguccuuu

SEQ ID NO: 467878 - RNA, 19 nt, Homo sapiens
aaacucccauccugccuuu

SEQ ID NO: 467879 - RNA, 19 nt, Homo sapiens
acaaauagagagacaauuc

SEQ ID NO: 467880 - RNA, 19 nt, Homo sapiens
cauccuaucagaacaauau

SEQ ID NO: 467881 - RNA, 19 nt, Homo sapiens
gauauaugguucucuugag

SEQ ID NO: 467882 - RNA, 19 nt, Homo sapiens
ugucagcgaugagcaguuu

SEQ ID NO: 467883 - RNA, 19 nt, Homo sapiens
ucaaacaucaggaaauuca

SEQ ID NO: 467884 - RNA, 19 nt, Homo sapiens
guucaagauuacugucaaa

SEQ ID NO: 467885 - RNA, 19 nt, Homo sapiens
gcaaauguuuauguugaca

SEQ ID NO: 467886 - RNA, 19 nt, Homo sapiens
gcacacaaagagauagaga

SEQ ID NO: 467887 - RNA, 19 nt, Homo sapiens
ggugugggauuacauacau

SEQ ID NO: 467888 - RNA, 19 nt, Homo sapiens
gggcuuauaugccuuagac

SEQ ID NO: 467889 - RNA, 19 nt, Homo sapiens
cuucaugccuaaauaccua

SEQ ID NO: 467890 - RNA, 19 nt, Homo sapiens
agaaacaggagcuauuauu

SEQ ID NO: 467891 - RNA, 19 nt, Homo sapiens
gugaaucuccuaaugcuau

SEQ ID NO: 467892 - RNA, 19 nt, Homo sapiens
aaauucaucugcaguucuu

SEQ ID NO: 467893 - RNA, 19 nt, Homo sapiens
aaugacaucuuugcugauu

SEQ ID NO: 467894 - RNA, 19 nt, Homo sapiens
gagcaaauuuaccuuucuc

SEQ ID NO: 467895 - RNA, 19 nt, Homo sapiens
uaauggaagcuuugagauu

SEQ ID NO: 467896 - RNA, 19 nt, Homo sapiens
caacaucccaacaucucua

SEQ ID NO: 467897 - RNA, 19 nt, Homo sapiens
ucacacaaauagagagaca

SEQ ID NO: 467898 - RNA, 19 nt, Homo sapiens
gcaauccaauuuauaugcu

SEQ ID NO: 467899 - RNA, 19 nt, Homo sapiens
ugaauuccaugcucacaca

SEQ ID NO: 467900 - RNA, 19 nt, Homo sapiens
gaaugcagcacacaaagag

SEQ ID NO: 467901 - RNA, 19 nt, Homo sapiens
aaagcagucuagcaaaugu

SEQ ID NO: 467902 - RNA, 19 nt, Homo sapiens
acaaaggaccugacuguuc

SEQ ID NO: 467903 - RNA, 19 nt, Homo sapiens
gaaggacuagagacuaaug

SEQ ID NO: 467904 - RNA, 19 nt, Homo sapiens
gaggacauaacucagauug

SEQ ID NO: 467905 - RNA, 19 nt, Homo sapiens
caacgcaggauccaucaga

SEQ ID NO: 467906 - RNA, 19 nt, Homo sapiens
caaauagagagacaauuca

SEQ ID NO: 467907 - RNA, 19 nt, Homo sapiens
gaagaaugaggacauaacu

SEQ ID NO: 467908 - RNA, 19 nt, Homo sapiens
aauaugggauccugugugu

SEQ ID NO: 467909 - RNA, 19 nt, Homo sapiens
acaguucaaugcauucguu

SEQ ID NO: 467910 - RNA, 19 nt, Homo sapiens
gguauuuccuauauagaag

SEQ ID NO: 467911 - RNA, 19 nt, Homo sapiens
caucagaguguacaaagga

SEQ ID NO: 467912 - RNA, 19 nt, Homo sapiens
guuaugggcuuaggcuguu

SEQ ID NO: 467913 - RNA, 19 nt, Homo sapiens
caaaugucccuucuguaug

SEQ ID NO: 467914 - RNA, 19 nt, Homo sapiens
cgugcagguuuguuacaua

SEQ ID NO: 467915 - RNA, 19 nt, Homo sapiens
guuccuugaugcuccagua

SEQ ID NO: 467916 - RNA, 19 nt, Homo sapiens
gcuauuauugguccuuuga

SEQ ID NO: 467917 - RNA, 19 nt, Homo sapiens
gucuggaucuuauaugaau

SEQ ID NO: 467918 - RNA, 19 nt, Homo sapiens
cggccaagauguuucuguu

SEQ ID NO: 467919 - RNA, 19 nt, Homo sapiens
ggagucggccaagauguuu

SEQ ID NO: 467920 - RNA, 19 nt, Homo sapiens
ugagaaugcagcacacaaa

SEQ ID NO: 467921 - RNA, 19 nt, Homo sapiens
uuaccuuucucuccaaguu

SEQ ID NO: 467922 - RNA, 19 nt, Homo sapiens
caugugcagaacaauauua

SEQ ID NO: 467923 - RNA, 19 nt, Homo sapiens
ggaauuccacaagauuuau

SEQ ID NO: 467924 - RNA, 19 nt, Homo sapiens
ggguauuuccuauauagaa

SEQ ID NO: 467925 - RNA, 19 nt, Homo sapiens
ucaggcaacuuguccucaa

SEQ ID NO: 467926 - RNA, 19 nt, Homo sapiens
acacaaagagauagagaau

SEQ ID NO: 467927 - RNA, 19 nt, Homo sapiens
ggaagaaugaggacauaac

SEQ ID NO: 467928 - RNA, 19 nt, Homo sapiens
gaaauucaucugcaguucu

SEQ ID NO: 467929 - RNA, 19 nt, Homo sapiens
gaaaauucuucaguuguug

SEQ ID NO: 467930 - RNA, 19 nt, Homo sapiens
caaacaagcugcccacaua

SEQ ID NO: 467931 - RNA, 19 nt, Homo sapiens
uaacuuaccuccaauaugu

SEQ ID NO: 467932 - RNA, 19 nt, Homo sapiens
gaaaaugagugcaaagaua

SEQ ID NO: 467933 - RNA, 19 nt, Homo sapiens
gaacaugcuguacaacuua

SEQ ID NO: 467934 - RNA, 19 nt, Homo sapiens
gcaauaacaugugcauuug

SEQ ID NO: 467935 - RNA, 19 nt, Homo sapiens
gcaugacuccuauauaaua

SEQ ID NO: 467936 - RNA, 19 nt, Homo sapiens
gggcuuaggcuguuucuua

SEQ ID NO: 467937 - RNA, 19 nt, Homo sapiens
aaacagcaauuucccuuaa

SEQ ID NO: 467938 - RNA, 19 nt, Homo sapiens
gaaaaugccucuucaggaa

SEQ ID NO: 467939 - RNA, 19 nt, Homo sapiens
caagauuacugucaaacaa

SEQ ID NO: 467940 - RNA, 19 nt, Homo sapiens
gaaguaagacauaucaaga

SEQ ID NO: 467941 - RNA, 19 nt, Homo sapiens
aggcaugacuccuauauaa

SEQ ID NO: 467942 - RNA, 19 nt, Homo sapiens
ggaccugacuguuccuuga

SEQ ID NO: 467943 - RNA, 19 nt, Homo sapiens
gugcaaauguuuauguuga

SEQ ID NO: 467944 - RNA, 19 nt, Homo sapiens
gaaacaggagcuauuauug

SEQ ID NO: 467945 - RNA, 19 nt, Homo sapiens
gcaauggauuucaauuaug

SEQ ID NO: 467946 - RNA, 19 nt, Homo sapiens
gaugcaaucuuucuaaugg

SEQ ID NO: 467947 - RNA, 19 nt, Homo sapiens
ccacuaaauuuguucuuug

SEQ ID NO: 467948 - RNA, 19 nt, Homo sapiens
aaauauacccuccuacuuu

SEQ ID NO: 467949 - RNA, 19 nt, Homo sapiens
cuacaucuccuucuacuaa

SEQ ID NO: 467950 - RNA, 19 nt, Homo sapiens
gaaggaauuccacaagauu

SEQ ID NO: 467951 - RNA, 19 nt, Homo sapiens
guagaaacaggagcuauua

SEQ ID NO: 467952 - RNA, 19 nt, Homo sapiens
aagaagaggucaagaagga

SEQ ID NO: 467953 - RNA, 19 nt, Homo sapiens
guuuaucgcuuccauguga

SEQ ID NO: 467954 - RNA, 19 nt, Homo sapiens
ggcaauaacaugugcauuu

SEQ ID NO: 467955 - RNA, 19 nt, Homo sapiens
ggaacacccugaagagcaa

SEQ ID NO: 467956 - RNA, 19 nt, Homo sapiens
guaaugcaauggauuucaa

SEQ ID NO: 467957 - RNA, 19 nt, Homo sapiens
gugcaaagauauauaccaa

SEQ ID NO: 467958 - RNA, 19 nt, Homo sapiens
cuaguuggauucauuaaug

SEQ ID NO: 467959 - RNA, 19 nt, Homo sapiens
gauugcaacuguccaucua

SEQ ID NO: 467960 - RNA, 19 nt, Homo sapiens
uaugaaaucugaagagaag

SEQ ID NO: 467961 - RNA, 19 nt, Homo sapiens
ccaacacacuuccaaagga

SEQ ID NO: 467962 - RNA, 19 nt, Homo sapiens
cuaagaggaucaagcuuug

SEQ ID NO: 467963 - RNA, 19 nt, Homo sapiens
guacaaaggaaguuaaauc

SEQ ID NO: 467964 - RNA, 19 nt, Homo sapiens
gaauugaaacccauagaau

SEQ ID NO: 467965 - RNA, 19 nt, Homo sapiens
ggagggacaucaauaacag

SEQ ID NO: 467966 - RNA, 19 nt, Homo sapiens
ggaaauucaucugcaguuc

SEQ ID NO: 467967 - RNA, 19 nt, Homo sapiens
gaagaggucaagaaggaaa

SEQ ID NO: 467968 - RNA, 19 nt, Homo sapiens
gaaucuacaguuucaguuu

SEQ ID NO: 467969 - RNA, 19 nt, Homo sapiens
ggcauuggaugugugguua

SEQ ID NO: 467970 - RNA, 19 nt, Homo sapiens
ucagaugccuaaauucuca

SEQ ID NO: 467971 - RNA, 19 nt, Homo sapiens
uagagaacaugcuguacaa

SEQ ID NO: 467972 - RNA, 19 nt, Homo sapiens
ugagguguaugaaaucuga

SEQ ID NO: 467973 - RNA, 19 nt, Homo sapiens
gaacgggaauaaacauggu

SEQ ID NO: 467974 - RNA, 19 nt, Homo sapiens
uuucagcacuuacuucaaa

SEQ ID NO: 467975 - RNA, 19 nt, Homo sapiens
ggcuuaggcuguuucuuaa

SEQ ID NO: 467976 - RNA, 19 nt, Homo sapiens
aauggaagcuuugagauug

SEQ ID NO: 467977 - RNA, 19 nt, Homo sapiens
ugaaacccauagaauaaga

SEQ ID NO: 467978 - RNA, 19 nt, Homo sapiens
ucauaaauauacccuccua

SEQ ID NO: 467979 - RNA, 19 nt, Homo sapiens
ugaaggaauuccacaagau

SEQ ID NO: 467980 - RNA, 19 nt, Homo sapiens
aaauaccucuuaugaagga

SEQ ID NO: 467981 - RNA, 19 nt, Homo sapiens
ugguuuggcuuucugauuu

SEQ ID NO: 467982 - RNA, 19 nt, Homo sapiens
cagaauacugacaaacuua

SEQ ID NO: 467983 - RNA, 19 nt, Homo sapiens
ggauauaugguucucuuga

SEQ ID NO: 467984 - RNA, 19 nt, Homo sapiens
aauugcagcuguauucaaa

SEQ ID NO: 467985 - RNA, 19 nt, Homo sapiens
aggaaggacuagagacuaa

SEQ ID NO: 467986 - RNA, 19 nt, Homo sapiens
acagaauacugacaaacuu

SEQ ID NO: 467987 - RNA, 19 nt, Homo sapiens
cgacaaaggaccugacugu

SEQ ID NO: 467988 - RNA, 19 nt, Homo sapiens
gcagcuguauucaaacauc

SEQ ID NO: 467989 - RNA, 19 nt, Homo sapiens
caacuuguccucaaacagu

SEQ ID NO: 467990 - RNA, 19 nt, Homo sapiens
gggcaugcaggauauauga

SEQ ID NO: 467991 - RNA, 19 nt, Homo sapiens
uggcauuccugcaccuaua

SEQ ID NO: 467992 - RNA, 19 nt, Homo sapiens
ugauacaguucaaugcauu

SEQ ID NO: 467993 - RNA, 19 nt, Homo sapiens
gagcuauuauugguccuuu

SEQ ID NO: 467994 - RNA, 19 nt, Homo sapiens
aaacucccauccugccuuu

SEQ ID NO: 467995 - RNA, 19 nt, Homo sapiens
acaaauagagagacaauuc

SEQ ID NO: 467996 - RNA, 19 nt, Homo sapiens
aagccuacaucuucuuauu

SEQ ID NO: 467997 - RNA, 19 nt, Homo sapiens
ccuaaauucucauucuguu

SEQ ID NO: 467998 - RNA, 19 nt, Homo sapiens
gauauaugguucucuugag

SEQ ID NO: 467999 - RNA, 19 nt, Homo sapiens
ugucagcgaugagcaguuu

SEQ ID NO: 468000 - RNA, 19 nt, Homo sapiens
ucaaacaucaggaaauuca

SEQ ID NO: 468001 - RNA, 19 nt, Homo sapiens
guucaagauuacugucaaa

SEQ ID NO: 468002 - RNA, 19 nt, Homo sapiens
gcaaauguuuauguugaca

SEQ ID NO: 468003 - RNA, 19 nt, Homo sapiens
gcacuuacuucaaaagaau

SEQ ID NO: 468004 - RNA, 19 nt, Homo sapiens
guagaaguaagacauauca

SEQ ID NO: 468005 - RNA, 19 nt, Homo sapiens
agaacaugcuguacaacuu

SEQ ID NO: 468006 - RNA, 19 nt, Homo sapiens
ggaacagagcuuauagaga

SEQ ID NO: 468007 - RNA, 19 nt, Homo sapiens
gcaugcaggauauaugauu

SEQ ID NO: 468008 - RNA, 19 nt, Homo sapiens
ggugugggauuacauacau

SEQ ID NO: 468009 - RNA, 19 nt, Homo sapiens
cuucaugccuaaauaccua

SEQ ID NO: 468010 - RNA, 19 nt, Homo sapiens
agaaacaggagcuauuauu

SEQ ID NO: 468011 - RNA, 19 nt, Homo sapiens
uaaauauacccuccuacuu

SEQ ID NO: 468012 - RNA, 19 nt, Homo sapiens
gaaucguucuuuaacucuu

SEQ ID NO: 468013 - RNA, 19 nt, Homo sapiens
aaauucaucugcaguucuu

SEQ ID NO: 468014 - RNA, 19 nt, Homo sapiens
aaugacaucuuugcugauu

SEQ ID NO: 468015 - RNA, 19 nt, Homo sapiens
uaauggaagcuuugagauu

SEQ ID NO: 468016 - RNA, 19 nt, Homo sapiens
caacaucccaacaucucua

SEQ ID NO: 468017 - RNA, 19 nt, Homo sapiens
ucacacaaauagagagaca

SEQ ID NO: 468018 - RNA, 19 nt, Homo sapiens
gaaggaaaaugagugcaaa

SEQ ID NO: 468019 - RNA, 19 nt, Homo sapiens
gcacuaagaggaucaagcu

SEQ ID NO: 468020 - RNA, 19 nt, Homo sapiens
gcaauccaauuuauaugcu

SEQ ID NO: 468021 - RNA, 19 nt, Homo sapiens
ugaauuccaugcucacaca

SEQ ID NO: 468022 - RNA, 19 nt, Homo sapiens
aauauacccuccuacuuuc

SEQ ID NO: 468023 - RNA, 19 nt, Homo sapiens
acaaaggaccugacuguuc

SEQ ID NO: 468024 - RNA, 19 nt, Homo sapiens
gaaggacuagagacuaaug

SEQ ID NO: 468025 - RNA, 19 nt, Homo sapiens
caacgcaggauccaucaga

SEQ ID NO: 468026 - RNA, 19 nt, Homo sapiens
caaauagagagacaauuca

SEQ ID NO: 468027 - RNA, 19 nt, Homo sapiens
aagcuuuguuccagccuua

SEQ ID NO: 468028 - RNA, 19 nt, Homo sapiens
aauaugggauccugugugu

SEQ ID NO: 468029 - RNA, 19 nt, Homo sapiens
ugaaaggguagaaguaaga

SEQ ID NO: 468030 - RNA, 19 nt, Homo sapiens
caaacaagcugcccacaua

SEQ ID NO: 468031 - RNA, 19 nt, Homo sapiens
uaacuuaccuccaauaugu

SEQ ID NO: 468032 - RNA, 19 nt, Homo sapiens
ugaagugccugcuauguua

SEQ ID NO: 468033 - RNA, 19 nt, Homo sapiens
gaaaaugagugcaaagaua

SEQ ID NO: 468034 - RNA, 19 nt, Homo sapiens
gaacaugcuguacaacuua

SEQ ID NO: 468035 - RNA, 19 nt, Homo sapiens
gcuaugggcuuccaagaaa

SEQ ID NO: 468036 - RNA, 19 nt, Homo sapiens
gcaauaacaugugcauuug

SEQ ID NO: 468037 - RNA, 19 nt, Homo sapiens
gcaugacuccuauauaaua

SEQ ID NO: 468038 - RNA, 19 nt, Homo sapiens
gggcuuaggcuguuucuua

SEQ ID NO: 468039 - RNA, 19 nt, Homo sapiens
aaacagcaauuucccuuaa

SEQ ID NO: 468040 - RNA, 19 nt, Homo sapiens
gaaaaugccucuucaggaa

SEQ ID NO: 468041 - RNA, 19 nt, Homo sapiens
caagauuacugucaaacaa

SEQ ID NO: 468042 - RNA, 19 nt, Homo sapiens
gggacuaccuugguuauuu

SEQ ID NO: 468043 - RNA, 19 nt, Homo sapiens
gaaguaagacauaucaaga

SEQ ID NO: 468044 - RNA, 19 nt, Homo sapiens
aggcaugacuccuauauaa

SEQ ID NO: 468045 - RNA, 19 nt, Homo sapiens
ggaccugacuguuccuuga

SEQ ID NO: 468046 - RNA, 19 nt, Homo sapiens
gugcaaauguuuauguuga

SEQ ID NO: 468047 - RNA, 19 nt, Homo sapiens
gaaacaggagcuauuauug

SEQ ID NO: 468048 - RNA, 19 nt, Homo sapiens
gaugcaaucuuucuaaugg

SEQ ID NO: 468049 - RNA, 19 nt, Homo sapiens
ccacuaaauuuguucuuug

SEQ ID NO: 468050 - RNA, 19 nt, Homo sapiens
aaauauacccuccuacuuu

SEQ ID NO: 468051 - RNA, 19 nt, Homo sapiens
cuacaucuccuucuacuaa

SEQ ID NO: 468052 - RNA, 19 nt, Homo sapiens
gaaggaauuccacaagauu

SEQ ID NO: 468053 - RNA, 19 nt, Homo sapiens
guagaaacaggagcuauua

SEQ ID NO: 468054 - RNA, 19 nt, Homo sapiens
aagaagaggucaagaagga

SEQ ID NO: 468055 - RNA, 19 nt, Homo sapiens
ggacuaccuugguuauuuc

SEQ ID NO: 468056 - RNA, 19 nt, Homo sapiens
guuuaucgcuuccauguga

SEQ ID NO: 468057 - RNA, 19 nt, Homo sapiens
ggcaauaacaugugcauuu

SEQ ID NO: 468058 - RNA, 19 nt, Homo sapiens
ggaacacccugaagagcaa

SEQ ID NO: 468059 - RNA, 19 nt, Homo sapiens
gugcaaagauauauaccaa

SEQ ID NO: 468060 - RNA, 19 nt, Homo sapiens
caccggagcuguuccuauu

SEQ ID NO: 468061 - RNA, 19 nt, Homo sapiens
cuaguuggauucauuaaug

SEQ ID NO: 468062 - RNA, 19 nt, Homo sapiens
gcagaaaucacccgucuuc

SEQ ID NO: 468063 - RNA, 19 nt, Homo sapiens
gauugcaacuguccaucua

SEQ ID NO: 468064 - RNA, 19 nt, Homo sapiens
uaugaaaucugaagagaag

SEQ ID NO: 468065 - RNA, 19 nt, Homo sapiens
ccaacacacuuccaaagga

SEQ ID NO: 468066 - RNA, 19 nt, Homo sapiens
cuaagaggaucaagcuuug

SEQ ID NO: 468067 - RNA, 19 nt, Homo sapiens
guacaaaggaaguuaaauc

SEQ ID NO: 468068 - RNA, 19 nt, Homo sapiens
gaauugaaacccauagaau

SEQ ID NO: 468069 - RNA, 19 nt, Homo sapiens
ggagggacaucaauaacag

SEQ ID NO: 468070 - RNA, 19 nt, Homo sapiens
ggaaauucaucugcaguuc

SEQ ID NO: 468071 - RNA, 19 nt, Homo sapiens
gaagaggucaagaaggaaa

SEQ ID NO: 468072 - RNA, 19 nt, Homo sapiens
gaaucuacaguuucaguuu

SEQ ID NO: 468073 - RNA, 19 nt, Homo sapiens
ggcauuggaugugugguua

SEQ ID NO: 468074 - RNA, 19 nt, Homo sapiens
ucagaugccuaaauucuca

SEQ ID NO: 468075 - RNA, 19 nt, Homo sapiens
uagagaacaugcuguacaa

SEQ ID NO: 468076 - RNA, 19 nt, Homo sapiens
ugagguguaugaaaucuga

SEQ ID NO: 468077 - RNA, 19 nt, Homo sapiens
gaacgggaauaaacauggu

SEQ ID NO: 468078 - RNA, 19 nt, Homo sapiens
ggcuuaggcuguuucuuaa

SEQ ID NO: 468079 - RNA, 19 nt, Homo sapiens
aauggaagcuuugagauug

SEQ ID NO: 468080 - RNA, 19 nt, Homo sapiens
ccacugaccugcgcccauu

SEQ ID NO: 468081 - RNA, 19 nt, Homo sapiens
ugaaacccauagaauaaga

SEQ ID NO: 468082 - RNA, 19 nt, Homo sapiens
ucauaaauauacccuccua

SEQ ID NO: 468083 - RNA, 19 nt, Homo sapiens
ugaaggaauuccacaagau

SEQ ID NO: 468084 - RNA, 19 nt, Homo sapiens
aaauaccucuuaugaagga

SEQ ID NO: 468085 - RNA, 19 nt, Homo sapiens
ugguuuggcuuucugauuu

SEQ ID NO: 468086 - RNA, 19 nt, Homo sapiens
caugcacacucuuuacaaa

SEQ ID NO: 468087 - RNA, 19 nt, Homo sapiens
cagaauacugacaaacuua

SEQ ID NO: 468088 - RNA, 19 nt, Homo sapiens
ggauauaugguucucuuga

SEQ ID NO: 468089 - RNA, 19 nt, Homo sapiens
aauugcagcuguauucaaa

SEQ ID NO: 468090 - RNA, 19 nt, Homo sapiens
aggaaggacuagagacuaa

SEQ ID NO: 468091 - RNA, 19 nt, Homo sapiens
acagaauacugacaaacuu

SEQ ID NO: 468092 - RNA, 19 nt, Homo sapiens
acaagauggugcuguagaa

SEQ ID NO: 468093 - RNA, 19 nt, Homo sapiens
cgacaaaggaccugacugu

SEQ ID NO: 468094 - RNA, 19 nt, Homo sapiens
gcagcuguauucaaacauc

SEQ ID NO: 468095 - RNA, 19 nt, Homo sapiens
caacuuguccucaaacagu

SEQ ID NO: 468096 - RNA, 19 nt, Homo sapiens
gggcaugcaggauauauga

SEQ ID NO: 468097 - RNA, 19 nt, Homo sapiens
uggcauuccugcaccuaua

SEQ ID NO: 468098 - RNA, 19 nt, Homo sapiens
ugauacaguucaaugcauu

SEQ ID NO: 468099 - RNA, 19 nt, Homo sapiens
gagcuauuauugguccuuu

SEQ ID NO: 468100 - RNA, 19 nt, Homo sapiens
aaacucccauccugccuuu

SEQ ID NO: 468101 - RNA, 19 nt, Homo sapiens
acaaauagagagacaauuc

SEQ ID NO: 468102 - RNA, 19 nt, Homo sapiens
aagccuacaucuucuuauu

SEQ ID NO: 468103 - RNA, 19 nt, Homo sapiens
ccuaaauucucauucuguu

SEQ ID NO: 468104 - RNA, 19 nt, Homo sapiens
gauauaugguucucuugag

SEQ ID NO: 468105 - RNA, 19 nt, Homo sapiens
ugucagcgaugagcaguuu

SEQ ID NO: 468106 - RNA, 19 nt, Homo sapiens
ucaaacaucaggaaauuca

SEQ ID NO: 468107 - RNA, 19 nt, Homo sapiens
guucaagauuacugucaaa

SEQ ID NO: 468108 - RNA, 19 nt, Homo sapiens
gcaaauguuuauguugaca

SEQ ID NO: 468109 - RNA, 19 nt, Homo sapiens
cuguagaaaucuuugcaua

SEQ ID NO: 468110 - RNA, 19 nt, Homo sapiens
agaacaugcuguacaacuu

SEQ ID NO: 468111 - RNA, 19 nt, Homo sapiens
ggaacagagcuuauagaga

SEQ ID NO: 468112 - RNA, 19 nt, Homo sapiens
gcaugcaggauauaugauu

SEQ ID NO: 468113 - RNA, 19 nt, Homo sapiens
ggugugggauuacauacau

SEQ ID NO: 468114 - RNA, 19 nt, Homo sapiens
cuucaugccuaaauaccua

SEQ ID NO: 468115 - RNA, 19 nt, Homo sapiens
agaaacaggagcuauuauu

SEQ ID NO: 468116 - RNA, 19 nt, Homo sapiens
guagaaguaagacauauca

SEQ ID NO: 468117 - RNA, 19 nt, Homo sapiens
uaaauauacccuccuacuu

SEQ ID NO: 468118 - RNA, 19 nt, Homo sapiens
gaaucguucuuuaacucuu

SEQ ID NO: 468119 - RNA, 19 nt, Homo sapiens
aaauucaucugcaguucuu

SEQ ID NO: 468120 - RNA, 19 nt, Homo sapiens
aaugacaucuuugcugauu

SEQ ID NO: 468121 - RNA, 19 nt, Homo sapiens
uaauggaagcuuugagauu

SEQ ID NO: 468122 - RNA, 19 nt, Homo sapiens
caacaucccaacaucucua

SEQ ID NO: 468123 - RNA, 19 nt, Homo sapiens
ucacacaaauagagagaca

SEQ ID NO: 468124 - RNA, 19 nt, Homo sapiens
gaaggaaaaugagugcaaa

SEQ ID NO: 468125 - RNA, 19 nt, Homo sapiens
gcacuaagaggaucaagcu

SEQ ID NO: 468126 - RNA, 19 nt, Homo sapiens
gcaauccaauuuauaugcu

SEQ ID NO: 468127 - RNA, 19 nt, Homo sapiens
ugaauuccaugcucacaca

SEQ ID NO: 468128 - RNA, 19 nt, Homo sapiens
aauauacccuccuacuuuc

SEQ ID NO: 468129 - RNA, 19 nt, Homo sapiens
acaaaggaccugacuguuc

SEQ ID NO: 468130 - RNA, 19 nt, Homo sapiens
aagaaacacugaagcaaua

SEQ ID NO: 468131 - RNA, 19 nt, Homo sapiens
ggaugaagauggaguuauc

SEQ ID NO: 468132 - RNA, 19 nt, Homo sapiens
gaagaacgguggcgaucau

SEQ ID NO: 468133 - RNA, 19 nt, Homo sapiens
ucacuucucuguauucuuc

SEQ ID NO: 468134 - RNA, 19 nt, Homo sapiens
ggaguuauccucugcagaa

SEQ ID NO: 468135 - RNA, 19 nt, Homo sapiens
ugacauaggugggauaauc

SEQ ID NO: 468136 - RNA, 19 nt, Homo sapiens
gaacgguggcgaucaugua

SEQ ID NO: 468137 - RNA, 19 nt, Homo sapiens
gcuaugaaguggacuggaa

SEQ ID NO: 468138 - RNA, 19 nt, Homo sapiens
gggaaucaccauugcaaua

SEQ ID NO: 468139 - RNA, 19 nt, Homo sapiens
gaaguugccuccugcugau

SEQ ID NO: 468140 - RNA, 19 nt, Homo sapiens
guuauccucugcagaaauu

SEQ ID NO: 468141 - RNA, 19 nt, Homo sapiens
cggaggagcugaacuauac

SEQ ID NO: 468142 - RNA, 19 nt, Homo sapiens
gaccugcacugguuaaaca

SEQ ID NO: 468143 - RNA, 19 nt, Homo sapiens
gcucuuccaucgucacuga

SEQ ID NO: 468144 - RNA, 19 nt, Homo sapiens
gcaagccuuccucaucuua

SEQ ID NO: 468145 - RNA, 19 nt, Homo sapiens
gaaaacacgauuuaccuua

SEQ ID NO: 468146 - RNA, 19 nt, Homo sapiens
gaaugcgggcuucuuguuu

SEQ ID NO: 468147 - RNA, 19 nt, Homo sapiens
ccacaucgcucaaaagaau

SEQ ID NO: 468148 - RNA, 19 nt, Homo sapiens
ggagugacgcuacuucuuc

SEQ ID NO: 468149 - RNA, 19 nt, Homo sapiens
caccugaccugcacugguu

SEQ ID NO: 468150 - RNA, 19 nt, Homo sapiens
aagcugagcccuucauuug

SEQ ID NO: 468151 - RNA, 19 nt, Homo sapiens
ccgagaaccuugggagaaa

SEQ ID NO: 468152 - RNA, 19 nt, Homo sapiens
gggaaccucuaccuggauu

SEQ ID NO: 468153 - RNA, 19 nt, Homo sapiens
ccaaagaaaacacgauuua

SEQ ID NO: 468154 - RNA, 19 nt, Homo sapiens
gaaucaccauugcaauaca

SEQ ID NO: 468155 - RNA, 19 nt, Homo sapiens
gcacugguuaaacaucaua

SEQ ID NO: 468156 - RNA, 19 nt, Homo sapiens
gcugagcccuucauuugca

SEQ ID NO: 468157 - RNA, 19 nt, Homo sapiens
gaaacacugaagcaauaaa

SEQ ID NO: 468158 - RNA, 19 nt, Homo sapiens
gcuacacccuaaucacaga

SEQ ID NO: 468159 - RNA, 19 nt, Homo sapiens
gaagaggaugucaccgaaa

SEQ ID NO: 468160 - RNA, 19 nt, Homo sapiens
cgccuucacuucucuguau

SEQ ID NO: 468161 - RNA, 19 nt, Homo sapiens
aaagaaacacugaagcaau

SEQ ID NO: 468162 - RNA, 19 nt, Homo sapiens
gcggaggagcugaacuaua

SEQ ID NO: 468163 - RNA, 19 nt, Homo sapiens
aagcaagccuuccucaucu

SEQ ID NO: 468164 - RNA, 19 nt, Homo sapiens
ccuggaagcuggaccucuu

SEQ ID NO: 468165 - RNA, 19 nt, Homo sapiens
gaaaagcaaagcccaaaga

SEQ ID NO: 468166 - RNA, 19 nt, Homo sapiens
ggaaucaccauugcaauac

SEQ ID NO: 468167 - RNA, 19 nt, Homo sapiens
gaagcaauaaagauaaugg

SEQ ID NO: 468168 - RNA, 19 nt, Homo sapiens
caggauggcuggguguaug

SEQ ID NO: 468169 - RNA, 19 nt, Homo sapiens
gaguuauccucugcagaaa

SEQ ID NO: 468170 - RNA, 19 nt, Homo sapiens
aaacacgauuuaccuuaag

SEQ ID NO: 468171 - RNA, 19 nt, Homo sapiens
aaagcaaagcccaaagaaa

SEQ ID NO: 468172 - RNA, 19 nt, Homo sapiens
uaaagauaauggaccacau

SEQ ID NO: 468173 - RNA, 19 nt, Homo sapiens
gauuucaaaccacuccuuu

SEQ ID NO: 468174 - RNA, 19 nt, Homo sapiens
ccuaaucacagaauuuguu

SEQ ID NO: 468175 - RNA, 19 nt, Homo sapiens
cuaccuggauuuccuuuac

SEQ ID NO: 468176 - RNA, 19 nt, Homo sapiens
guugccuccugcugauuua

SEQ ID NO: 468177 - RNA, 19 nt, Homo sapiens
cacugaagcaauaaagaua

SEQ ID NO: 468178 - RNA, 19 nt, Homo sapiens
aagcaaagcccaaagaaaa

SEQ ID NO: 468179 - RNA, 19 nt, Homo sapiens
gaaccucuaccuggauuuc

SEQ ID NO: 468180 - RNA, 19 nt, Homo sapiens
cuacuuugcagacagguuu

SEQ ID NO: 468181 - RNA, 19 nt, Homo sapiens
aaugcgggcuucuuguuug

SEQ ID NO: 468182 - RNA, 19 nt, Homo sapiens
ggugaaugcugagcuguac

SEQ ID NO: 468183 - RNA, 19 nt, Homo sapiens
ggccaugucaaauuuguug

SEQ ID NO: 468184 - RNA, 19 nt, Homo sapiens
ucauagcccucaucaccau

SEQ ID NO: 468185 - RNA, 19 nt, Homo sapiens
ggcucgggcuccagaagaa

SEQ ID NO: 468186 - RNA, 19 nt, Homo sapiens
gcaccugagagagauguuu

SEQ ID NO: 468187 - RNA, 19 nt, Homo sapiens
gacauaggugggauaauca

SEQ ID NO: 468188 - RNA, 19 nt, Homo sapiens
uuacuccgcucuggucgaa

SEQ ID NO: 468189 - RNA, 19 nt, Homo sapiens
ucucgguguuggcuacuuu

SEQ ID NO: 468190 - RNA, 19 nt, Homo sapiens
aaucaccauugcaauacaa

SEQ ID NO: 468191 - RNA, 19 nt, Homo sapiens
cagccugccucgucaugau

SEQ ID NO: 468192 - RNA, 19 nt, Homo sapiens
cggacucugugcucuauca

SEQ ID NO: 468193 - RNA, 19 nt, Homo sapiens
aaagcugagcccuucauuu

SEQ ID NO: 468194 - RNA, 19 nt, Homo sapiens
ugaaugcgggcuucuuguu

SEQ ID NO: 468195 - RNA, 19 nt, Homo sapiens
acacugaagcaauaaagau

SEQ ID NO: 468196 - RNA, 19 nt, Homo sapiens
ucaggaaccucggagugau

SEQ ID NO: 468197 - RNA, 19 nt, Homo sapiens
caccguggaugacauucug

SEQ ID NO: 468198 - RNA, 19 nt, Homo sapiens
ucaaaccacuccuuuucaa

SEQ ID NO: 468199 - RNA, 19 nt, Homo sapiens
ugccagagaccaugaagga

SEQ ID NO: 468200 - RNA, 19 nt, Homo sapiens
cgguggcuguuaucacaaa

SEQ ID NO: 468201 - RNA, 19 nt, Homo sapiens
cagacagguuuggccguaa

SEQ ID NO: 468202 - RNA, 19 nt, Homo sapiens
gccgagaaccuugggagaa

SEQ ID NO: 468203 - RNA, 19 nt, Homo sapiens
gggagugacgcuacuucuu

SEQ ID NO: 468204 - RNA, 19 nt, Homo sapiens
ucaaaagaaugggaaguug

SEQ ID NO: 468205 - RNA, 19 nt, Homo sapiens
caucgucacugaguucaac

SEQ ID NO: 468206 - RNA, 19 nt, Homo sapiens
ggaagcuggaccucuuuca

SEQ ID NO: 468207 - RNA, 19 nt, Homo sapiens
ucggagugaugguguguuc

SEQ ID NO: 468208 - RNA, 19 nt, Homo sapiens
cacggacucugugcucuau

SEQ ID NO: 468209 - RNA, 19 nt, Homo sapiens
ucacggacucugugcucua

SEQ ID NO: 468210 - RNA, 19 nt, Homo sapiens
gugcaggcgcuaugaagug

SEQ ID NO: 468211 - RNA, 19 nt, Homo sapiens
guuuggcucucucgguguu

SEQ ID NO: 468212 - RNA, 19 nt, Homo sapiens
ccaugaaggacgccgagaa

SEQ ID NO: 468213 - RNA, 19 nt, Homo sapiens
aagccuuccucaucuuaug

SEQ ID NO: 468214 - RNA, 19 nt, Homo sapiens
cugcacugguuaaacauca

SEQ ID NO: 468215 - RNA, 19 nt, Homo sapiens
gaagcuggaccucuuucag

SEQ ID NO: 468216 - RNA, 19 nt, Homo sapiens
aaagauaauggaccacauc

SEQ ID NO: 468217 - RNA, 19 nt, Homo sapiens
cuaaucacagaauuuguug

SEQ ID NO: 468218 - RNA, 19 nt, Homo sapiens
uuggagggaugaagaugga

SEQ ID NO: 468219 - RNA, 19 nt, Homo sapiens
cauguguguuggccgaaug

SEQ ID NO: 468220 - RNA, 19 nt, Homo sapiens
aagaggaugucaccgaaaa

SEQ ID NO: 468221 - RNA, 19 nt, Homo sapiens
aaacacugaagcaauaaag

SEQ ID NO: 468222 - RNA, 19 nt, Homo sapiens
cacccuaaucacagaauuu

SEQ ID NO: 468223 - RNA, 19 nt, Homo sapiens
acacccuaaucacagaauu

SEQ ID NO: 468224 - RNA, 19 nt, Homo sapiens
cuagacgccuucacuucuc

SEQ ID NO: 468225 - RNA, 19 nt, Homo sapiens
gagggaugaagauggaguu

SEQ ID NO: 468226 - RNA, 19 nt, Homo sapiens
gucaggaaccucggaguga

SEQ ID NO: 468227 - RNA, 19 nt, Homo sapiens
cugcggaggagcugaacua

SEQ ID NO: 468228 - RNA, 19 nt, Homo sapiens
agacagguuuggccguaag

SEQ ID NO: 468229 - RNA, 19 nt, Homo sapiens
gagaaaagcaaagcccaaa

SEQ ID NO: 468230 - RNA, 19 nt, Homo sapiens
aagaaacacugaagcaaua

SEQ ID NO: 468231 - RNA, 19 nt, Homo sapiens
ggaugaagauggaguuauc

SEQ ID NO: 468232 - RNA, 19 nt, Homo sapiens
gaagaacgguggcgaucau

SEQ ID NO: 468233 - RNA, 19 nt, Homo sapiens
ucacuucucuguauucuuc

SEQ ID NO: 468234 - RNA, 19 nt, Homo sapiens
ggaguuauccucugcagaa

SEQ ID NO: 468235 - RNA, 19 nt, Homo sapiens
gaacgguggcgaucaugua

SEQ ID NO: 468236 - RNA, 19 nt, Homo sapiens
gcuaugaaguggacuggaa

SEQ ID NO: 468237 - RNA, 19 nt, Homo sapiens
gggaaucaccauugcaaua

SEQ ID NO: 468238 - RNA, 19 nt, Homo sapiens
gaaguugccuccugcugau

SEQ ID NO: 468239 - RNA, 19 nt, Homo sapiens
guuauccucugcagaaauu

SEQ ID NO: 468240 - RNA, 19 nt, Homo sapiens
cggaggagcugaacuauac

SEQ ID NO: 468241 - RNA, 19 nt, Homo sapiens
gaccugcacugguuaaaca

SEQ ID NO: 468242 - RNA, 19 nt, Homo sapiens
gcucuuccaucgucacuga

SEQ ID NO: 468243 - RNA, 19 nt, Homo sapiens
gcaagccuuccucaucuua

SEQ ID NO: 468244 - RNA, 19 nt, Homo sapiens
gaaaacacgauuuaccuua

SEQ ID NO: 468245 - RNA, 19 nt, Homo sapiens
gaaugcgggcuucuuguuu

SEQ ID NO: 468246 - RNA, 19 nt, Homo sapiens
ccacaucgcucaaaagaau

SEQ ID NO: 468247 - RNA, 19 nt, Homo sapiens
ggagugacgcuacuucuuc

SEQ ID NO: 468248 - RNA, 19 nt, Homo sapiens
caccugaccugcacugguu

SEQ ID NO: 468249 - RNA, 19 nt, Homo sapiens
aagcugagcccuucauuug

SEQ ID NO: 468250 - RNA, 19 nt, Homo sapiens
ccgagaaccuugggagaaa

SEQ ID NO: 468251 - RNA, 19 nt, Homo sapiens
gggaaccucuaccuggauu

SEQ ID NO: 468252 - RNA, 19 nt, Homo sapiens
ccaaagaaaacacgauuua

SEQ ID NO: 468253 - RNA, 19 nt, Homo sapiens
gaaucaccauugcaauaca

SEQ ID NO: 468254 - RNA, 19 nt, Homo sapiens
gcacugguuaaacaucaua

SEQ ID NO: 468255 - RNA, 19 nt, Homo sapiens
gcugagcccuucauuugca

SEQ ID NO: 468256 - RNA, 19 nt, Homo sapiens
gaaacacugaagcaauaaa

SEQ ID NO: 468257 - RNA, 19 nt, Homo sapiens
gcuacacccuaaucacaga

SEQ ID NO: 468258 - RNA, 19 nt, Homo sapiens
gaagaggaugucaccgaaa

SEQ ID NO: 468259 - RNA, 19 nt, Homo sapiens
cgccuucacuucucuguau

SEQ ID NO: 468260 - RNA, 19 nt, Homo sapiens
aaagaaacacugaagcaau

SEQ ID NO: 468261 - RNA, 19 nt, Homo sapiens
gcggaggagcugaacuaua

SEQ ID NO: 468262 - RNA, 19 nt, Homo sapiens
aagcaagccuuccucaucu

SEQ ID NO: 468263 - RNA, 19 nt, Homo sapiens
ccuggaagcuggaccucuu

SEQ ID NO: 468264 - RNA, 19 nt, Homo sapiens
gaaaagcaaagcccaaaga

SEQ ID NO: 468265 - RNA, 19 nt, Homo sapiens
ggaaucaccauugcaauac

SEQ ID NO: 468266 - RNA, 19 nt, Homo sapiens
gaagcaauaaagauaaugg

SEQ ID NO: 468267 - RNA, 19 nt, Homo sapiens
caggauggcuggguguaug

SEQ ID NO: 468268 - RNA, 19 nt, Homo sapiens
gaguuauccucugcagaaa

SEQ ID NO: 468269 - RNA, 19 nt, Homo sapiens
aaacacgauuuaccuuaag

SEQ ID NO: 468270 - RNA, 19 nt, Homo sapiens
aaagcaaagcccaaagaaa

SEQ ID NO: 468271 - RNA, 19 nt, Homo sapiens
uaaagauaauggaccacau

SEQ ID NO: 468272 - RNA, 19 nt, Homo sapiens
gauuucaaaccacuccuuu

SEQ ID NO: 468273 - RNA, 19 nt, Homo sapiens
ccuaaucacagaauuuguu

SEQ ID NO: 468274 - RNA, 19 nt, Homo sapiens
cuaccuggauuuccuuuac

SEQ ID NO: 468275 - RNA, 19 nt, Homo sapiens
guugccuccugcugauuua

SEQ ID NO: 468276 - RNA, 19 nt, Homo sapiens
cacugaagcaauaaagaua

SEQ ID NO: 468277 - RNA, 19 nt, Homo sapiens
aagcaaagcccaaagaaaa

SEQ ID NO: 468278 - RNA, 19 nt, Homo sapiens
gaaccucuaccuggauuuc

SEQ ID NO: 468279 - RNA, 19 nt, Homo sapiens
cuacuuugcagacagguuu

SEQ ID NO: 468280 - RNA, 19 nt, Homo sapiens
aaugcgggcuucuuguuug

SEQ ID NO: 468281 - RNA, 19 nt, Homo sapiens
ggugaaugcugagcuguac

SEQ ID NO: 468282 - RNA, 19 nt, Homo sapiens
ggccaugucaaauuuguug

SEQ ID NO: 468283 - RNA, 19 nt, Homo sapiens
ucauagcccucaucaccau

SEQ ID NO: 468284 - RNA, 19 nt, Homo sapiens
ggcucgggcuccagaagaa

SEQ ID NO: 468285 - RNA, 19 nt, Homo sapiens
gcaccugagagagauguuu

SEQ ID NO: 468286 - RNA, 19 nt, Homo sapiens
uuacuccgcucuggucgaa

SEQ ID NO: 468287 - RNA, 19 nt, Homo sapiens
ucucgguguuggcuacuuu

SEQ ID NO: 468288 - RNA, 19 nt, Homo sapiens
aaucaccauugcaauacaa

SEQ ID NO: 468289 - RNA, 19 nt, Homo sapiens
cagccugccucgucaugau

SEQ ID NO: 468290 - RNA, 19 nt, Homo sapiens
cggacucugugcucuauca

SEQ ID NO: 468291 - RNA, 19 nt, Homo sapiens
aaagcugagcccuucauuu

SEQ ID NO: 468292 - RNA, 19 nt, Homo sapiens
ugaaugcgggcuucuuguu

SEQ ID NO: 468293 - RNA, 19 nt, Homo sapiens
acacugaagcaauaaagau

SEQ ID NO: 468294 - RNA, 19 nt, Homo sapiens
caccguggaugacauucug

SEQ ID NO: 468295 - RNA, 19 nt, Homo sapiens
ucaaaccacuccuuuucaa

SEQ ID NO: 468296 - RNA, 19 nt, Homo sapiens
ugccagagaccaugaagga

SEQ ID NO: 468297 - RNA, 19 nt, Homo sapiens
cgguggcuguuaucacaaa

SEQ ID NO: 468298 - RNA, 19 nt, Homo sapiens
cagacagguuuggccguaa

SEQ ID NO: 468299 - RNA, 19 nt, Homo sapiens
caucgucacugaguucaac

SEQ ID NO: 468300 - RNA, 19 nt, Homo sapiens
gccgagaaccuugggagaa

SEQ ID NO: 468301 - RNA, 19 nt, Homo sapiens
gggagugacgcuacuucuu

SEQ ID NO: 468302 - RNA, 19 nt, Homo sapiens
ucaaaagaaugggaaguug

SEQ ID NO: 468303 - RNA, 19 nt, Homo sapiens
cacggacucugugcucuau

SEQ ID NO: 468304 - RNA, 19 nt, Homo sapiens
ggaagcuggaccucuuuca

SEQ ID NO: 468305 - RNA, 19 nt, Homo sapiens
ucacggacucugugcucua

SEQ ID NO: 468306 - RNA, 19 nt, Homo sapiens
gugcaggcgcuaugaagug

SEQ ID NO: 468307 - RNA, 19 nt, Homo sapiens
guuuggcucucucgguguu

SEQ ID NO: 468308 - RNA, 19 nt, Homo sapiens
ccaugaaggacgccgagaa

SEQ ID NO: 468309 - RNA, 19 nt, Homo sapiens
cugcacugguuaaacauca

SEQ ID NO: 468310 - RNA, 19 nt, Homo sapiens
aagccuuccucaucuuaug

SEQ ID NO: 468311 - RNA, 19 nt, Homo sapiens
gaagcuggaccucuuucag

SEQ ID NO: 468312 - RNA, 19 nt, Homo sapiens
aaagauaauggaccacauc

SEQ ID NO: 468313 - RNA, 19 nt, Homo sapiens
cuaaucacagaauuuguug

SEQ ID NO: 468314 - RNA, 19 nt, Homo sapiens
uuggagggaugaagaugga

SEQ ID NO: 468315 - RNA, 19 nt, Homo sapiens
cauguguguuggccgaaug

SEQ ID NO: 468316 - RNA, 19 nt, Homo sapiens
aagaggaugucaccgaaaa

SEQ ID NO: 468317 - RNA, 19 nt, Homo sapiens
aaacacugaagcaauaaag

SEQ ID NO: 468318 - RNA, 19 nt, Homo sapiens
cacccuaaucacagaauuu

SEQ ID NO: 468319 - RNA, 19 nt, Homo sapiens
acacccuaaucacagaauu

SEQ ID NO: 468320 - RNA, 19 nt, Homo sapiens
cuagacgccuucacuucuc

SEQ ID NO: 468321 - RNA, 19 nt, Homo sapiens
gagggaugaagauggaguu

SEQ ID NO: 468322 - RNA, 19 nt, Homo sapiens
cugcggaggagcugaacua

SEQ ID NO: 468323 - RNA, 19 nt, Homo sapiens
agacagguuuggccguaag

SEQ ID NO: 468324 - RNA, 19 nt, Homo sapiens
gagaaaagcaaagcccaaa

SEQ ID NO: 468325 - RNA, 19 nt, Homo sapiens
ugagcaugcugagccauca

SEQ ID NO: 468326 - RNA, 19 nt, Homo sapiens
gggaugaagauggaguuau

SEQ ID NO: 468327 - RNA, 19 nt, Homo sapiens
gaccacaucgcucaaaaga

SEQ ID NO: 468328 - RNA, 19 nt, Homo sapiens
agaaacacugaagcaauaa

SEQ ID NO: 468329 - RNA, 19 nt, Homo sapiens
gaaaggagauaaagcauua

SEQ ID NO: 468330 - RNA, 19 nt, Homo sapiens
ggaaauaccucucaucaaa

SEQ ID NO: 468331 - RNA, 19 nt, Homo sapiens
gagaacaggugacaauaua

SEQ ID NO: 468332 - RNA, 19 nt, Homo sapiens
gaaccaaucugcuguacaa

SEQ ID NO: 468333 - RNA, 19 nt, Homo sapiens
gcacagagcucaguggauu

SEQ ID NO: 468334 - RNA, 19 nt, Homo sapiens
ggacagaucuaggcaguuu

SEQ ID NO: 468335 - RNA, 19 nt, Homo sapiens
gcuacaaucuucauaacua

SEQ ID NO: 468336 - RNA, 19 nt, Homo sapiens
uaagaugacuguugcauug

SEQ ID NO: 468337 - RNA, 19 nt, Homo sapiens
ggacguggaugacuugcua

SEQ ID NO: 468338 - RNA, 19 nt, Homo sapiens
gggcaucacuguaaaguau

SEQ ID NO: 468339 - RNA, 19 nt, Homo sapiens
gggagugacugcuuaauug

SEQ ID NO: 468340 - RNA, 19 nt, Homo sapiens
ccaacaacauuacgaaauu

SEQ ID NO: 468341 - RNA, 19 nt, Homo sapiens
gcaccaaacuucccugugu

SEQ ID NO: 468342 - RNA, 19 nt, Homo sapiens
gaaaugcaauugcuauucu

SEQ ID NO: 468343 - RNA, 19 nt, Homo sapiens
gaaauguguucaucaaauc

SEQ ID NO: 468344 - RNA, 19 nt, Homo sapiens
ugagaaaguuguacagaaa

SEQ ID NO: 468345 - RNA, 19 nt, Homo sapiens
gcauuucucugcuguaaga

SEQ ID NO: 468346 - RNA, 19 nt, Homo sapiens
gcaggagcuuuauaaauga

SEQ ID NO: 468347 - RNA, 19 nt, Homo sapiens
guaaagagagucugagaaa

SEQ ID NO: 468348 - RNA, 19 nt, Homo sapiens
gacaaauccuucuagaauu

SEQ ID NO: 468349 - RNA, 19 nt, Homo sapiens
guaaaugcauggacaacuu

SEQ ID NO: 468350 - RNA, 19 nt, Homo sapiens
cagauucccuucuuuacua

SEQ ID NO: 468351 - RNA, 19 nt, Homo sapiens
gagacuacauucacccuuu

SEQ ID NO: 468352 - RNA, 19 nt, Homo sapiens
gagauuauuugggacauuu

SEQ ID NO: 468353 - RNA, 19 nt, Homo sapiens
gacaguggaugauguagaa

SEQ ID NO: 468354 - RNA, 19 nt, Homo sapiens
gaaauuggaaaggaacuua

SEQ ID NO: 468355 - RNA, 19 nt, Homo sapiens
ggaauccuguuaaugagaa

SEQ ID NO: 468356 - RNA, 19 nt, Homo sapiens
gcuccuagcugaccauuca

SEQ ID NO: 468357 - RNA, 19 nt, Homo sapiens
ggauaaccauggccuuuga

SEQ ID NO: 468358 - RNA, 19 nt, Homo sapiens
gaagaaaggagauaaagca

SEQ ID NO: 468359 - RNA, 19 nt, Homo sapiens
caugacagcuccaucaaga

SEQ ID NO: 468360 - RNA, 19 nt, Homo sapiens
gcacaagacuaacuuuggu

SEQ ID NO: 468361 - RNA, 19 nt, Homo sapiens
caucugcagugcuuaagua

SEQ ID NO: 468362 - RNA, 19 nt, Homo sapiens
ccacagauucccuucuuua

SEQ ID NO: 468363 - RNA, 19 nt, Homo sapiens
aaagguaccuguguuuaaa

SEQ ID NO: 468364 - RNA, 19 nt, Homo sapiens
ggucuaacguugacaaauc

SEQ ID NO: 468365 - RNA, 19 nt, Homo sapiens
caucagaauugaauacgaa

SEQ ID NO: 468366 - RNA, 19 nt, Homo sapiens
ggacaauuccuauucauuc

SEQ ID NO: 468367 - RNA, 19 nt, Homo sapiens
gcacacuuauucuuauguu

SEQ ID NO: 468368 - RNA, 19 nt, Homo sapiens
ugacaaauccuucuagaau

SEQ ID NO: 468369 - RNA, 19 nt, Homo sapiens
caaagguaccuguguuuaa

SEQ ID NO: 468370 - RNA, 19 nt, Homo sapiens
cagauuucauucccaauaa

SEQ ID NO: 468371 - RNA, 19 nt, Homo sapiens
guaccaaagggaaacauua

SEQ ID NO: 468372 - RNA, 19 nt, Homo sapiens
guacagaaauguguucauc

SEQ ID NO: 468373 - RNA, 19 nt, Homo sapiens
guucaggucugugugauuu

SEQ ID NO: 468374 - RNA, 19 nt, Homo sapiens
gaaaugcacacuuauucuu

SEQ ID NO: 468375 - RNA, 19 nt, Homo sapiens
guauaaagaccucaaucua

SEQ ID NO: 468376 - RNA, 19 nt, Homo sapiens
gguauugccuugccagaga

SEQ ID NO: 468377 - RNA, 19 nt, Homo sapiens
gaucgucauuuacuugcua

SEQ ID NO: 468378 - RNA, 19 nt, Homo sapiens
ggagauaaagcauuacaga

SEQ ID NO: 468379 - RNA, 19 nt, Homo sapiens
agaagugacuccuuguaaa

SEQ ID NO: 468380 - RNA, 19 nt, Homo sapiens
gaacaaagagcaugaaaau

SEQ ID NO: 468381 - RNA, 19 nt, Homo sapiens
gccaggagcucucuugauc

SEQ ID NO: 468382 - RNA, 19 nt, Homo sapiens
gaucuaggcaguuucuaaa

SEQ ID NO: 468383 - RNA, 19 nt, Homo sapiens
gaaaccacaccacuuaguu

SEQ ID NO: 468384 - RNA, 19 nt, Homo sapiens
guaaugcuguugaaguuuc

SEQ ID NO: 468385 - RNA, 19 nt, Homo sapiens
gaaggaauagcaugguuga

SEQ ID NO: 468386 - RNA, 19 nt, Homo sapiens
agacuacauucacccuuua

SEQ ID NO: 468387 - RNA, 19 nt, Homo sapiens
agcaggagcuuuauaaaug

SEQ ID NO: 468388 - RNA, 19 nt, Homo sapiens
uaaaguaugugcaguuggu

SEQ ID NO: 468389 - RNA, 19 nt, Homo sapiens
aaacauucaucucagaguu

SEQ ID NO: 468390 - RNA, 19 nt, Homo sapiens
ccauacauguugcagcuuu

SEQ ID NO: 468391 - RNA, 19 nt, Homo sapiens
gaacaggugacaauauaca

SEQ ID NO: 468392 - RNA, 19 nt, Homo sapiens
ggagaacaggugacaauau

SEQ ID NO: 468393 - RNA, 19 nt, Homo sapiens
caaucuauccagaguauuu

SEQ ID NO: 468394 - RNA, 19 nt, Homo sapiens
auaaagaccucaaucuauc

SEQ ID NO: 468395 - RNA, 19 nt, Homo sapiens
gaaauaccucucaucaaau

SEQ ID NO: 468396 - RNA, 19 nt, Homo sapiens
acagaaauguguucaucaa

SEQ ID NO: 468397 - RNA, 19 nt, Homo sapiens
ccaaggauuugagaaaguu

SEQ ID NO: 468398 - RNA, 19 nt, Homo sapiens
guagccaguuuaacaaaga

SEQ ID NO: 468399 - RNA, 19 nt, Homo sapiens
aaagagagucugagaaaug

SEQ ID NO: 468400 - RNA, 19 nt, Homo sapiens
cuaaaucccuacccacguu

SEQ ID NO: 468401 - RNA, 19 nt, Homo sapiens
acacaacucuuugaggauu

SEQ ID NO: 468402 - RNA, 19 nt, Homo sapiens
gagcugauccuccuugcaa

SEQ ID NO: 468403 - RNA, 19 nt, Homo sapiens
augaggaaaugcacacuua

SEQ ID NO: 468404 - RNA, 19 nt, Homo sapiens
gaaagaaaugguugcugaa

SEQ ID NO: 468405 - RNA, 19 nt, Homo sapiens
gacuggagcauucaccuua

SEQ ID NO: 468406 - RNA, 19 nt, Homo sapiens
caucuauuguccauaugua

SEQ ID NO: 468407 - RNA, 19 nt, Homo sapiens
gcaggaucgucauuuacuu

SEQ ID NO: 468408 - RNA, 19 nt, Homo sapiens
guaaauguggcaggaauaa

SEQ ID NO: 468409 - RNA, 19 nt, Homo sapiens
gaggaaaugcacacuuauu

SEQ ID NO: 468410 - RNA, 19 nt, Homo sapiens
cauauaugauucuguguuc

SEQ ID NO: 468411 - RNA, 19 nt, Homo sapiens
caaaaucuauucagcgaaa

SEQ ID NO: 468412 - RNA, 19 nt, Homo sapiens
cuaaauagagguagggaaa

SEQ ID NO: 468413 - RNA, 19 nt, Homo sapiens
aaacuuggcaguccacauu

SEQ ID NO: 468414 - RNA, 19 nt, Homo sapiens
gauugugacagaaauagua

SEQ ID NO: 468415 - RNA, 19 nt, Homo sapiens
ccaaagguaccuguguuua

SEQ ID NO: 468416 - RNA, 19 nt, Homo sapiens
gcauauuacuggagcaucu

SEQ ID NO: 468417 - RNA, 19 nt, Homo sapiens
gcaauuagcaaugggaaau

SEQ ID NO: 468418 - RNA, 19 nt, Homo sapiens
gaucagcaggagcuuuaua

SEQ ID NO: 468419 - RNA, 19 nt, Homo sapiens
ccaaucugcuguacaaucu

SEQ ID NO: 468420 - RNA, 19 nt, Homo sapiens
ggauuugauucuuccauuc

SEQ ID NO: 468421 - RNA, 19 nt, Homo sapiens
cucguuagcugaugaggua

SEQ ID NO: 468422 - RNA, 19 nt, Homo sapiens
ucagaugcagucuauauuu

SEQ ID NO: 468423 - RNA, 19 nt, Homo sapiens
gcaguccacauuccuguaa

SEQ ID NO: 468424 - RNA, 19 nt, Homo sapiens
aaccauggccuuugaaauu

SEQ ID NO: 468425 - RNA, 19 nt, Homo sapiens
ucaaauuacucagagauca

SEQ ID NO: 468426 - RNA, 19 nt, Homo sapiens
cuacuuacaucauaaugca

SEQ ID NO: 468427 - RNA, 19 nt, Homo sapiens
uaugucaccuuacuacaga

SEQ ID NO: 468428 - RNA, 19 nt, Homo sapiens
agggaaacauuaaccauga

SEQ ID NO: 468429 - RNA, 19 nt, Homo sapiens
ggucagaacuccucagaua

SEQ ID NO: 468430 - RNA, 19 nt, Homo sapiens
gaauacaacuuaagugauc

SEQ ID NO: 468431 - RNA, 19 nt, Homo sapiens
gacaauaucuaccuggauu

SEQ ID NO: 468432 - RNA, 19 nt, Homo sapiens
gaccagauccugccaaauu

SEQ ID NO: 468433 - RNA, 19 nt, Homo sapiens
gaaacuagacauuccauug

SEQ ID NO: 468434 - RNA, 19 nt, Homo sapiens
uaacuacaguccucauaaa

SEQ ID NO: 468435 - RNA, 19 nt, Homo sapiens
gaaaggcccugcccugaag

SEQ ID NO: 468436 - RNA, 19 nt, Homo sapiens
uggcugaucucccagaaua

SEQ ID NO: 468437 - RNA, 19 nt, Homo sapiens
caaguugccuauacaguug

SEQ ID NO: 468438 - RNA, 19 nt, Homo sapiens
agaggaaacuggcaagaaa

SEQ ID NO: 468439 - RNA, 19 nt, Homo sapiens
caaagcaggcugguuaaua

SEQ ID NO: 468440 - RNA, 19 nt, Homo sapiens
gaaucaggaauacaacuua

SEQ ID NO: 468441 - RNA, 19 nt, Homo sapiens
cacaauggccuaugagaua

SEQ ID NO: 468442 - RNA, 19 nt, Homo sapiens
cuacauagcagacagguuu

SEQ ID NO: 468443 - RNA, 19 nt, Homo sapiens
ccacaucuguuccucaaug

SEQ ID NO: 468444 - RNA, 19 nt, Homo sapiens
gaaacuggcaagaaauuga

SEQ ID NO: 468445 - RNA, 19 nt, Homo sapiens
caacuuaagugaucaugag

SEQ ID NO: 468446 - RNA, 19 nt, Homo sapiens
cguaagcucugccuccuaa

SEQ ID NO: 468447 - RNA, 19 nt, Homo sapiens
ugagguccuuccauauuua

SEQ ID NO: 468448 - RNA, 19 nt, Homo sapiens
uagauaggccuuucaguaa

SEQ ID NO: 468449 - RNA, 19 nt, Homo sapiens
uuuauuggcucuaugagua

SEQ ID NO: 468450 - RNA, 19 nt, Homo sapiens
cagaauguaugucaagaau

SEQ ID NO: 468451 - RNA, 19 nt, Homo sapiens
aaagcaggcugguuaauag

SEQ ID NO: 468452 - RNA, 19 nt, Homo sapiens
ccugaaggcuggucacuug

SEQ ID NO: 468453 - RNA, 19 nt, Homo sapiens
ggacauuggacauugguuu

SEQ ID NO: 468454 - RNA, 19 nt, Homo sapiens
ggaucacaauggccuauga

SEQ ID NO: 468455 - RNA, 19 nt, Homo sapiens
gggcggagauaucggagaa

SEQ ID NO: 468456 - RNA, 19 nt, Homo sapiens
gcuacgagguggacuggaa

SEQ ID NO: 468457 - RNA, 19 nt, Homo sapiens
caaaagaccuugagaagag

SEQ ID NO: 468458 - RNA, 19 nt, Homo sapiens
ggaaaggcccugcccugaa

SEQ ID NO: 468459 - RNA, 19 nt, Homo sapiens
uuagauaggccuuucagua

SEQ ID NO: 468460 - RNA, 19 nt, Homo sapiens
agaaaucccugcacucauc

SEQ ID NO: 468461 - RNA, 19 nt, Homo sapiens
gauaggccuuucaguaaca

SEQ ID NO: 468462 - RNA, 19 nt, Homo sapiens
gaccguugcugcugucaug

SEQ ID NO: 468463 - RNA, 19 nt, Homo sapiens
ucacaaagcccauacaacu

SEQ ID NO: 468464 - RNA, 19 nt, Homo sapiens
ccagcucacuuuauucuca

SEQ ID NO: 468465 - RNA, 19 nt, Homo sapiens
gaaacuaaagggaaagcuu

SEQ ID NO: 468466 - RNA, 19 nt, Homo sapiens
ccucagauaaggaaacaua

SEQ ID NO: 468467 - RNA, 19 nt, Homo sapiens
uuaagcacaucgcaaagaa

SEQ ID NO: 468468 - RNA, 19 nt, Homo sapiens
ggguaagcaugaaugugua

SEQ ID NO: 468469 - RNA, 19 nt, Homo sapiens
aaacuagacauuccauuga

SEQ ID NO: 468470 - RNA, 19 nt, Homo sapiens
ugauuuaccuccaaguuca

SEQ ID NO: 468471 - RNA, 19 nt, Homo sapiens
gggaaagcuuugccugaga

SEQ ID NO: 468472 - RNA, 19 nt, Homo sapiens
ucacuaacaucuggcuuga

SEQ ID NO: 468473 - RNA, 19 nt, Homo sapiens
ccaaguugccuauacaguu

SEQ ID NO: 468474 - RNA, 19 nt, Homo sapiens
gaacugugggcuaggcaaa

SEQ ID NO: 468475 - RNA, 19 nt, Homo sapiens
gggaccagauccugccaaa

SEQ ID NO: 468476 - RNA, 19 nt, Homo sapiens
guagaaaucccugcacuca

SEQ ID NO: 468477 - RNA, 19 nt, Homo sapiens
ugacauugguggcaucauc

SEQ ID NO: 468478 - RNA, 19 nt, Homo sapiens
caugagguccuuccauauu

SEQ ID NO: 468479 - RNA, 19 nt, Homo sapiens
cagauaaggaaacauacua

SEQ ID NO: 468480 - RNA, 19 nt, Homo sapiens
gcuacauccugauuacaga

SEQ ID NO: 468481 - RNA, 19 nt, Homo sapiens
aaagaugauuuaccuccaa

SEQ ID NO: 468482 - RNA, 19 nt, Homo sapiens
ccagcugccuucaugauca

SEQ ID NO: 468483 - RNA, 19 nt, Homo sapiens
cauccugauuacagaauuu

SEQ ID NO: 468484 - RNA, 19 nt, Homo sapiens
ggaguucucauggccauuu

SEQ ID NO: 468485 - RNA, 19 nt, Homo sapiens
cuacaguccucauaaaugc

SEQ ID NO: 468486 - RNA, 19 nt, Homo sapiens
ggaauacaacuuaagugau

SEQ ID NO: 468487 - RNA, 19 nt, Homo sapiens
ccauacaacucaaccaaac

SEQ ID NO: 468488 - RNA, 19 nt, Homo sapiens
cagaggaacugaacuacac

SEQ ID NO: 468489 - RNA, 19 nt, Homo sapiens
ccauugaacuaagaagaga

SEQ ID NO: 468490 - RNA, 19 nt, Homo sapiens
gaugauuuaccuccaaguu

SEQ ID NO: 468491 - RNA, 19 nt, Homo sapiens
ggucaaugcugagcuguac

SEQ ID NO: 468492 - RNA, 19 nt, Homo sapiens
acucugcccugguugaauu

SEQ ID NO: 468493 - RNA, 19 nt, Homo sapiens
ccuaggacauuggacauug

SEQ ID NO: 468494 - RNA, 19 nt, Homo sapiens
gaaaauaugcaaagaccaa

SEQ ID NO: 468495 - RNA, 19 nt, Homo sapiens
gcugaagccaugagaauca

SEQ ID NO: 468496 - RNA, 19 nt, Homo sapiens
ggagauaucggagaacagu

SEQ ID NO: 468497 - RNA, 19 nt, Homo sapiens
auaaaguuguccagaaugu

SEQ ID NO: 468498 - RNA, 19 nt, Homo sapiens
ccugagcccuaucaaccua

SEQ ID NO: 468499 - RNA, 19 nt, Homo sapiens
gacauuccauugaacuaag

SEQ ID NO: 468500 - RNA, 19 nt, Homo sapiens
ccugagacuugaagaggaa

SEQ ID NO: 468501 - RNA, 19 nt, Homo sapiens
ucauuaagcacaucgcaaa

SEQ ID NO: 468502 - RNA, 19 nt, Homo sapiens
ggaggggaguuucacuuuu

SEQ ID NO: 468503 - RNA, 19 nt, Homo sapiens
ucccugcacucaucacaaa

SEQ ID NO: 468504 - RNA, 19 nt, Homo sapiens
uccagaaacuaaagggaaa

SEQ ID NO: 468505 - RNA, 19 nt, Homo sapiens
ggaaacuggcaagaaauug

SEQ ID NO: 468506 - RNA, 19 nt, Homo sapiens
ggagaacaguggggauuuu

SEQ ID NO: 468507 - RNA, 19 nt, Homo sapiens
augagguccuuccauauuu

SEQ ID NO: 468508 - RNA, 19 nt, Homo sapiens
ccaguggagucuauuguac

SEQ ID NO: 468509 - RNA, 19 nt, Homo sapiens
guccacaucuguuccucaa

SEQ ID NO: 468510 - RNA, 19 nt, Homo sapiens
ugauauugauguacaacug

SEQ ID NO: 468511 - RNA, 19 nt, Homo sapiens
gaagaggaaacuggcaaga

SEQ ID NO: 468512 - RNA, 19 nt, Homo sapiens
gcggagauaucggagaaca

SEQ ID NO: 468513 - RNA, 19 nt, Homo sapiens
cuaacuacaguccucauaa

SEQ ID NO: 468514 - RNA, 19 nt, Homo sapiens
guccuuccauauuuagauu

SEQ ID NO: 468515 - RNA, 19 nt, Homo sapiens
aucaugagguccuuccaua

SEQ ID NO: 468516 - RNA, 19 nt, Homo sapiens
aaaguuguccagaauguau

SEQ ID NO: 468517 - RNA, 19 nt, Homo sapiens
ucacuuuauucucagcauu

SEQ ID NO: 468518 - RNA, 19 nt, Homo sapiens
cuaccuggauuucuucuac

SEQ ID NO: 468519 - RNA, 19 nt, Homo sapiens
gcagaggaacugaacuaca

SEQ ID NO: 468520 - RNA, 19 nt, Homo sapiens
cagcauuccuaggacauug

SEQ ID NO: 468521 - RNA, 19 nt, Homo sapiens
acaaagcccauacaacuca

SEQ ID NO: 468522 - RNA, 19 nt, Homo sapiens
gccaguggagucuauugua

SEQ ID NO: 468523 - RNA, 19 nt, Homo sapiens
gucaugaccuagcuuugau

SEQ ID NO: 468524 - RNA, 19 nt, Homo sapiens
ggugaucuacaauggcuaa

SEQ ID NO: 468525 - RNA, 19 nt, Homo sapiens
cuucuacucugcccugguu

SEQ ID NO: 468526 - RNA, 19 nt, Homo sapiens
gagaaucauuaagcacauc

SEQ ID NO: 468527 - RNA, 19 nt, Homo sapiens
uuaccaaguugccuauaca

SEQ ID NO: 468528 - RNA, 19 nt, Homo sapiens
ucuuccagcucacuuuauu

SEQ ID NO: 468529 - RNA, 19 nt, Homo sapiens
ggucagaacuccucagaua

SEQ ID NO: 468530 - RNA, 19 nt, Homo sapiens
gcagugaaauuauuccaua

SEQ ID NO: 468531 - RNA, 19 nt, Homo sapiens
gcaucaaccugcagaauaa

SEQ ID NO: 468532 - RNA, 19 nt, Homo sapiens
gaauacaacuuaagugauc

SEQ ID NO: 468533 - RNA, 19 nt, Homo sapiens
gacaauaucuaccuggauu

SEQ ID NO: 468534 - RNA, 19 nt, Homo sapiens
gaauuagcauugugucuga

SEQ ID NO: 468535 - RNA, 19 nt, Homo sapiens
gaccagauccugccaaauu

SEQ ID NO: 468536 - RNA, 19 nt, Homo sapiens
gaaacuagacauuccauug

SEQ ID NO: 468537 - RNA, 19 nt, Homo sapiens
gugagaaucugcugacauu

SEQ ID NO: 468538 - RNA, 19 nt, Homo sapiens
gaacaaacgugagaaucug

SEQ ID NO: 468539 - RNA, 19 nt, Homo sapiens
uaacuacaguccucauaaa

SEQ ID NO: 468540 - RNA, 19 nt, Homo sapiens
gaaaggcccugcccugaag

SEQ ID NO: 468541 - RNA, 19 nt, Homo sapiens
gagaaucugcugacauuaa

SEQ ID NO: 468542 - RNA, 19 nt, Homo sapiens
uggcugaucucccagaaua

SEQ ID NO: 468543 - RNA, 19 nt, Homo sapiens
acaaauaccuggauaagag

SEQ ID NO: 468544 - RNA, 19 nt, Homo sapiens
caaguugccuauacaguug

SEQ ID NO: 468545 - RNA, 19 nt, Homo sapiens
agaggaaacuggcaagaaa

SEQ ID NO: 468546 - RNA, 19 nt, Homo sapiens
caaagcaggcugguuaaua

SEQ ID NO: 468547 - RNA, 19 nt, Homo sapiens
gaaucaggaauacaacuua

SEQ ID NO: 468548 - RNA, 19 nt, Homo sapiens
cacaauggccuaugagaua

SEQ ID NO: 468549 - RNA, 19 nt, Homo sapiens
gggaacaaauaccuggaua

SEQ ID NO: 468550 - RNA, 19 nt, Homo sapiens
cuacauagcagacagguuu

SEQ ID NO: 468551 - RNA, 19 nt, Homo sapiens
ccacaucuguuccucaaug

SEQ ID NO: 468552 - RNA, 19 nt, Homo sapiens
gaaacuggcaagaaauuga

SEQ ID NO: 468553 - RNA, 19 nt, Homo sapiens
caacuuaagugaucaugag

SEQ ID NO: 468554 - RNA, 19 nt, Homo sapiens
gaagguucaucaaguaaca

SEQ ID NO: 468555 - RNA, 19 nt, Homo sapiens
guaaaugccauccauaaau

SEQ ID NO: 468556 - RNA, 19 nt, Homo sapiens
cguaagcucugccuccuaa

SEQ ID NO: 468557 - RNA, 19 nt, Homo sapiens
ugagguccuuccauauuua

SEQ ID NO: 468558 - RNA, 19 nt, Homo sapiens
gagcaugggccuuggguaa

SEQ ID NO: 468559 - RNA, 19 nt, Homo sapiens
uagauaggccuuucaguaa

SEQ ID NO: 468560 - RNA, 19 nt, Homo sapiens
gaugugauguaacaagaga

SEQ ID NO: 468561 - RNA, 19 nt, Homo sapiens
uuuauuggcucuaugagua

SEQ ID NO: 468562 - RNA, 19 nt, Homo sapiens
cagaauguaugucaagaau

SEQ ID NO: 468563 - RNA, 19 nt, Homo sapiens
gaacaaauaccuggauaag

SEQ ID NO: 468564 - RNA, 19 nt, Homo sapiens
guaaguaaaugccauccau

SEQ ID NO: 468565 - RNA, 19 nt, Homo sapiens
aaagcaggcugguuaauag

SEQ ID NO: 468566 - RNA, 19 nt, Homo sapiens
ccugaaggcuggucacuug

SEQ ID NO: 468567 - RNA, 19 nt, Homo sapiens
ggacauuggacauugguuu

SEQ ID NO: 468568 - RNA, 19 nt, Homo sapiens
aaucaucuguguacggaua

SEQ ID NO: 468569 - RNA, 19 nt, Homo sapiens
aaagagagaauuagcauug

SEQ ID NO: 468570 - RNA, 19 nt, Homo sapiens
ggauacaggucauuaugca

SEQ ID NO: 468571 - RNA, 19 nt, Homo sapiens
ggaucacaauggccuauga

SEQ ID NO: 468572 - RNA, 19 nt, Homo sapiens
ccucuuagaucuacaaugg

SEQ ID NO: 468573 - RNA, 19 nt, Homo sapiens
gagcuucguuugaauccuu

SEQ ID NO: 468574 - RNA, 19 nt, Homo sapiens
gggcggagauaucggagaa

SEQ ID NO: 468575 - RNA, 19 nt, Homo sapiens
gcuacgagguggacuggaa

SEQ ID NO: 468576 - RNA, 19 nt, Homo sapiens
caaaagaccuugagaagag

SEQ ID NO: 468577 - RNA, 19 nt, Homo sapiens
ggaaaggcccugcccugaa

SEQ ID NO: 468578 - RNA, 19 nt, Homo sapiens
ugucugagguuaagaugaa

SEQ ID NO: 468579 - RNA, 19 nt, Homo sapiens
guuuaaaugugcccauauu

SEQ ID NO: 468580 - RNA, 19 nt, Homo sapiens
gagaauccuuuuagcaaua

SEQ ID NO: 468581 - RNA, 19 nt, Homo sapiens
uuagauaggccuuucagua

SEQ ID NO: 468582 - RNA, 19 nt, Homo sapiens
agaaaucccugcacucauc

SEQ ID NO: 468583 - RNA, 19 nt, Homo sapiens
guauaacuccguugucauu

SEQ ID NO: 468584 - RNA, 19 nt, Homo sapiens
ggaacaaauaccuggauaa

SEQ ID NO: 468585 - RNA, 19 nt, Homo sapiens
ggaaaaccauguaauuugu

SEQ ID NO: 468586 - RNA, 19 nt, Homo sapiens
gauaggccuuucaguaaca

SEQ ID NO: 468587 - RNA, 19 nt, Homo sapiens
gaccguugcugcugucaug

SEQ ID NO: 468588 - RNA, 19 nt, Homo sapiens
ucacaaagcccauacaacu

SEQ ID NO: 468589 - RNA, 19 nt, Homo sapiens
caccaagagugaacccuaa

SEQ ID NO: 468590 - RNA, 19 nt, Homo sapiens
ggucuaaaguuaagagaac

SEQ ID NO: 468591 - RNA, 19 nt, Homo sapiens
caacgaaggggaacaaaua

SEQ ID NO: 468592 - RNA, 19 nt, Homo sapiens
ccagcucacuuuauucuca

SEQ ID NO: 468593 - RNA, 19 nt, Homo sapiens
gaaacuaaagggaaagcuu

SEQ ID NO: 468594 - RNA, 19 nt, Homo sapiens
ccaagacccuggagaaagg

SEQ ID NO: 468595 - RNA, 19 nt, Homo sapiens
ccucagauaaggaaacaua

SEQ ID NO: 468596 - RNA, 19 nt, Homo sapiens
uuaagcacaucgcaaagaa

SEQ ID NO: 468597 - RNA, 19 nt, Homo sapiens
ggguaagcaugaaugugua

SEQ ID NO: 468598 - RNA, 19 nt, Homo sapiens
aaacuagacauuccauuga

SEQ ID NO: 468599 - RNA, 19 nt, Homo sapiens
ugauuuaccuccaaguuca

SEQ ID NO: 468600 - RNA, 19 nt, Homo sapiens
gggaaagcuuugccugaga

SEQ ID NO: 468601 - RNA, 19 nt, Homo sapiens
gcaauauggagcuucguuu

SEQ ID NO: 468602 - RNA, 19 nt, Homo sapiens
ucacuaacaucuggcuuga

SEQ ID NO: 468603 - RNA, 19 nt, Homo sapiens
gauuaucguugccacugaa

SEQ ID NO: 468604 - RNA, 19 nt, Homo sapiens
ggacccuucugagcaaauu

SEQ ID NO: 468605 - RNA, 19 nt, Homo sapiens
ccaaguugccuauacaguu

SEQ ID NO: 468606 - RNA, 19 nt, Homo sapiens
gaacugugggcuaggcaaa

SEQ ID NO: 468607 - RNA, 19 nt, Homo sapiens
gggaccagauccugccaaa

SEQ ID NO: 468608 - RNA, 19 nt, Homo sapiens
guagaaaucccugcacuca

SEQ ID NO: 468609 - RNA, 19 nt, Homo sapiens
ugacauugguggcaucauc

SEQ ID NO: 468610 - RNA, 19 nt, Homo sapiens
gacauuaacaugagccuau

SEQ ID NO: 468611 - RNA, 19 nt, Homo sapiens
caugagguccuuccauauu

SEQ ID NO: 468612 - RNA, 19 nt, Homo sapiens
gauaaguacuguucuuuuc

SEQ ID NO: 468613 - RNA, 19 nt, Homo sapiens
gagguuaugugggaaaucu

SEQ ID NO: 468614 - RNA, 19 nt, Homo sapiens
cagauaaggaaacauacua

SEQ ID NO: 468615 - RNA, 19 nt, Homo sapiens
gcuacauccugauuacaga

SEQ ID NO: 468616 - RNA, 19 nt, Homo sapiens
aaagaugauuuaccuccaa

SEQ ID NO: 468617 - RNA, 19 nt, Homo sapiens
ccagcugccuucaugauca

SEQ ID NO: 468618 - RNA, 19 nt, Homo sapiens
cauccugauuacagaauuu

SEQ ID NO: 468619 - RNA, 19 nt, Homo sapiens
ggaguucucauggccauuu

SEQ ID NO: 468620 - RNA, 19 nt, Homo sapiens
cuacaguccucauaaaugc

SEQ ID NO: 468621 - RNA, 19 nt, Homo sapiens
ggaauacaacuuaagugau

SEQ ID NO: 468622 - RNA, 19 nt, Homo sapiens
gaacccuaaugccagcuau

SEQ ID NO: 468623 - RNA, 19 nt, Homo sapiens
uuagggcagugaaauuauu

SEQ ID NO: 468624 - RNA, 19 nt, Homo sapiens
auaacuccguugucauuaa

SEQ ID NO: 468625 - RNA, 19 nt, Homo sapiens
ugacuucuauagacuaaag

SEQ ID NO: 468626 - RNA, 19 nt, Homo sapiens
aggugaaguuggagucuua

SEQ ID NO: 468627 - RNA, 19 nt, Homo sapiens
ccauacaacucaaccaaac

SEQ ID NO: 468628 - RNA, 19 nt, Homo sapiens
uaaguaaaugccauccaua

SEQ ID NO: 468629 - RNA, 19 nt, Homo sapiens
gaaauuccagcuuacauua

SEQ ID NO: 468630 - RNA, 19 nt, Homo sapiens
caagucaguucguauuaua

SEQ ID NO: 468631 - RNA, 19 nt, Homo sapiens
gauguucacuguguuauuu

SEQ ID NO: 468632 - RNA, 19 nt, Homo sapiens
ucuaauaacugcauucuga

SEQ ID NO: 468633 - RNA, 19 nt, Homo sapiens
gaaauggauugguaagaug

SEQ ID NO: 468634 - RNA, 19 nt, Homo sapiens
uaucauagcugcaguacug

SEQ ID NO: 468635 - RNA, 19 nt, Homo sapiens
ggaugauucuuccagauaa

SEQ ID NO: 468636 - RNA, 19 nt, Homo sapiens
cagauaauguccuugcuuu

SEQ ID NO: 468637 - RNA, 19 nt, Homo sapiens
gaaauggacugacuguaac

SEQ ID NO: 468638 - RNA, 19 nt, Homo sapiens
gcccaggcguuauaucaua

SEQ ID NO: 468639 - RNA, 19 nt, Homo sapiens
ugauugaaauuccagcuua

SEQ ID NO: 468640 - RNA, 19 nt, Homo sapiens
ugaaauggacugacuguaa

SEQ ID NO: 468641 - RNA, 19 nt, Homo sapiens
cccaauggcuucaauggua

SEQ ID NO: 468642 - RNA, 19 nt, Homo sapiens
gauuaacacucauuuccaa

SEQ ID NO: 468643 - RNA, 19 nt, Homo sapiens
gcaagucaguucguauuau

SEQ ID NO: 468644 - RNA, 19 nt, Homo sapiens
ggccagaucuccaacuaug

SEQ ID NO: 468645 - RNA, 19 nt, Homo sapiens
acacucauuuccaaucaua

SEQ ID NO: 468646 - RNA, 19 nt, Homo sapiens
ucuggaugcuccuaauuua

SEQ ID NO: 468647 - RNA, 19 nt, Homo sapiens
ggagauguucacuguguua

SEQ ID NO: 468648 - RNA, 19 nt, Homo sapiens
gagcagaugcagaaaguga

SEQ ID NO: 468649 - RNA, 19 nt, Homo sapiens
gaaugacucuuccagaaac

SEQ ID NO: 468650 - RNA, 19 nt, Homo sapiens
gcugggagauguucacugu

SEQ ID NO: 468651 - RNA, 19 nt, Homo sapiens
uaacacucauuuccaauca

SEQ ID NO: 468652 - RNA, 19 nt, Homo sapiens
ugaaauggauugguaagau

SEQ ID NO: 468653 - RNA, 19 nt, Homo sapiens
gaaaugcucgucauacagu

SEQ ID NO: 468654 - RNA, 19 nt, Homo sapiens
aaaugaaccuugcuaucaa

SEQ ID NO: 468655 - RNA, 19 nt, Homo sapiens
guucaggacucggaauauu

SEQ ID NO: 468656 - RNA, 19 nt, Homo sapiens
uagagaggcugaagauauc

SEQ ID NO: 468657 - RNA, 19 nt, Homo sapiens
ggacugacuguaacgauug

SEQ ID NO: 468658 - RNA, 19 nt, Homo sapiens
gagacucaauggagacaga

SEQ ID NO: 468659 - RNA, 19 nt, Homo sapiens
ccugaaaguuugggaauga

SEQ ID NO: 468660 - RNA, 19 nt, Homo sapiens
gcagugauauuugauucug

SEQ ID NO: 468661 - RNA, 19 nt, Homo sapiens
gucaaggacugguaaaaua

SEQ ID NO: 468662 - RNA, 19 nt, Homo sapiens
aguaaacucuggaugauuc

SEQ ID NO: 468663 - RNA, 19 nt, Homo sapiens
ggagaugccuaccugaacu

SEQ ID NO: 468664 - RNA, 19 nt, Homo sapiens
uaccagcagugauauuuga

SEQ ID NO: 468665 - RNA, 19 nt, Homo sapiens
ccacugaaauggacugacu

SEQ ID NO: 468666 - RNA, 19 nt, Homo sapiens
aauaagacccuguggagaa

SEQ ID NO: 468667 - RNA, 19 nt, Homo sapiens
uagagcagaugcagaaagu

SEQ ID NO: 468668 - RNA, 19 nt, Homo sapiens
ugguaccuguggauuauua

SEQ ID NO: 468669 - RNA, 19 nt, Homo sapiens
cagcagugauauuugauuc

SEQ ID NO: 468670 - RNA, 19 nt, Homo sapiens
uuagagaggcugaagauau

SEQ ID NO: 468671 - RNA, 19 nt, Homo sapiens
ugugguagccuucauacua

SEQ ID NO: 468672 - RNA, 19 nt, Homo sapiens
ccaauggcuucaaugguau

SEQ ID NO: 468673 - RNA, 19 nt, Homo sapiens
aagaaaugcucgucauaca

SEQ ID NO: 468674 - RNA, 19 nt, Homo sapiens
ucaagaaaugcucgucaua

SEQ ID NO: 468675 - RNA, 19 nt, Homo sapiens
ggaacguucuaacauccuu

SEQ ID NO: 468676 - RNA, 19 nt, Homo sapiens
gaucuccaacuauguggua

SEQ ID NO: 468677 - RNA, 19 nt, Homo sapiens
aguggaaucugguguguga

SEQ ID NO: 468678 - RNA, 19 nt, Homo sapiens
ggcaagucaguucguauua

SEQ ID NO: 468679 - RNA, 19 nt, Homo sapiens
gaugauucuuccagauaau

SEQ ID NO: 468680 - RNA, 19 nt, Homo sapiens
gcagaugcagaaagugaaa

SEQ ID NO: 468681 - RNA, 19 nt, Homo sapiens
ccucggugcuuacaacaga

SEQ ID NO: 468682 - RNA, 19 nt, Homo sapiens
gaggaggugugcuucucuu

SEQ ID NO: 468683 - RNA, 19 nt, Homo sapiens
gaggugugcuucucuucau

SEQ ID NO: 468684 - RNA, 19 nt, Homo sapiens
ugaaauuccagcuuacauu

SEQ ID NO: 468685 - RNA, 19 nt, Homo sapiens
cauuaugucuuugcugcua

SEQ ID NO: 468686 - RNA, 19 nt, Homo sapiens
gauaauguccuugcuuuac

SEQ ID NO: 468687 - RNA, 19 nt, Homo sapiens
gcugauaucccagagaaga

SEQ ID NO: 468688 - RNA, 19 nt, Homo sapiens
uggcugauaucccagagaa

SEQ ID NO: 468689 - RNA, 19 nt, Homo sapiens
gugguagccuucauacuag

SEQ ID NO: 468690 - RNA, 19 nt, Homo sapiens
gcaaauauuaggugacaac

SEQ ID NO: 468691 - RNA, 19 nt, Homo sapiens
guggagaaauucguuguuc

SEQ ID NO: 468692 - RNA, 19 nt, Homo sapiens
ugacuguccugauuggaau

SEQ ID NO: 468693 - RNA, 19 nt, Homo sapiens
augccuaccugaacuguuu

SEQ ID NO: 468694 - RNA, 19 nt, Homo sapiens
acagaaugcugcccuacau

SEQ ID NO: 468695 - RNA, 19 nt, Homo sapiens
cggaauauugccauaauga

SEQ ID NO: 468696 - RNA, 19 nt, Homo sapiens
uaauguccuugcuuuacaa

SEQ ID NO: 468697 - RNA, 19 nt, Homo sapiens
auaagacccuguggagaaa

SEQ ID NO: 468698 - RNA, 19 nt, Homo sapiens
ucucuucauucaacuggua

SEQ ID NO: 468699 - RNA, 19 nt, Homo sapiens
gugcuucucuucauucaac

SEQ ID NO: 468700 - RNA, 19 nt, Homo sapiens
aaccaaccauuucuagaga

SEQ ID NO: 468701 - RNA, 19 nt, Homo sapiens
gaacaacauagcuguacca

SEQ ID NO: 468702 - RNA, 19 nt, Homo sapiens
cauacuaggaacagaaauu

SEQ ID NO: 468703 - RNA, 19 nt, Homo sapiens
ugggagauguucacugugu

SEQ ID NO: 468704 - RNA, 19 nt, Homo sapiens
acaguaaacucuggaugau

SEQ ID NO: 468705 - RNA, 19 nt, Homo sapiens
ugcagaaagugaaaugguu

SEQ ID NO: 468706 - RNA, 19 nt, Homo sapiens
gaccucaguggguuacuuu

SEQ ID NO: 468707 - RNA, 19 nt, Homo sapiens
caaaccaaccauuucuaga

SEQ ID NO: 468708 - RNA, 19 nt, Homo sapiens
gaaaaucccaagguucuaa

SEQ ID NO: 468709 - RNA, 19 nt, Homo sapiens
gcucagcgccagcaucauc

SEQ ID NO: 468710 - RNA, 19 nt, Homo sapiens
ucuccuuacucauuaauuc

SEQ ID NO: 468711 - RNA, 19 nt, Homo sapiens
uggacugacuguaacgauu

SEQ ID NO: 468712 - RNA, 19 nt, Homo sapiens
cccauuuggugaagugaaa

SEQ ID NO: 468713 - RNA, 19 nt, Homo sapiens
uacaguaaacucuggauga

SEQ ID NO: 468714 - RNA, 19 nt, Homo sapiens
caagaaaugcucgucauac

SEQ ID NO: 468715 - RNA, 19 nt, Homo sapiens
gggaucaccucugcuuucu

SEQ ID NO: 468716 - RNA, 19 nt, Homo sapiens
ggacuacgacgaggugauc

SEQ ID NO: 468717 - RNA, 19 nt, Homo sapiens
gggagauguucacuguguu

SEQ ID NO: 468718 - RNA, 19 nt, Homo sapiens
uggcuucaaugguauguca

SEQ ID NO: 468719 - RNA, 19 nt, Homo sapiens
gacugacuguaacgauuga

SEQ ID NO: 468720 - RNA, 19 nt, Homo sapiens
ggaggugugcuucucuuca

SEQ ID NO: 468721 - RNA, 19 nt, Homo sapiens
gauugaaauuccagcuuac

SEQ ID NO: 468722 - RNA, 19 nt, Homo sapiens
gauaucccagagaagauuu

SEQ ID NO: 468723 - RNA, 19 nt, Homo sapiens
ugucuuugcugcuauggau

SEQ ID NO: 468724 - RNA, 19 nt, Homo sapiens
guaccagcagugauauuug

SEQ ID NO: 468725 - RNA, 19 nt, Homo sapiens
aaccauggcuguacagacu

SEQ ID NO: 468726 - RNA, 19 nt, Homo sapiens
auaauguccuugcuuuaca

SEQ ID NO: 468727 - RNA, 19 nt, Homo sapiens
gcugucaucacccguaguu

SEQ ID NO: 468728 - RNA, 19 nt, Homo sapiens
aaacaagagacucaaugga

SEQ ID NO: 468729 - RNA, 19 nt, Homo sapiens
caagucaguucguauaaua

SEQ ID NO: 468730 - RNA, 19 nt, Homo sapiens
acaaggaguuugauucuua

SEQ ID NO: 468731 - RNA, 19 nt, Homo sapiens
gacauuaacuggaucauug

SEQ ID NO: 468732 - RNA, 19 nt, Homo sapiens
ggaaguaauugcacaagga

SEQ ID NO: 468733 - RNA, 19 nt, Homo sapiens
gggagaaacugaagaggaa

SEQ ID NO: 468734 - RNA, 19 nt, Homo sapiens
uaacaucgcuuccaguaag

SEQ ID NO: 468735 - RNA, 19 nt, Homo sapiens
gcauaugccucaccugguu

SEQ ID NO: 468736 - RNA, 19 nt, Homo sapiens
cagaguagcucacuuuagu

SEQ ID NO: 468737 - RNA, 19 nt, Homo sapiens
gaaagguaaugaagaugga

SEQ ID NO: 468738 - RNA, 19 nt, Homo sapiens
aaagugcacugauguguga

SEQ ID NO: 468739 - RNA, 19 nt, Homo sapiens
uaaugaagauggagcagaa

SEQ ID NO: 468740 - RNA, 19 nt, Homo sapiens
guuccuuucuugauacuua

SEQ ID NO: 468741 - RNA, 19 nt, Homo sapiens
gaaaccuccuugcuacuau

SEQ ID NO: 468742 - RNA, 19 nt, Homo sapiens
gaagugccuugggaaauga

SEQ ID NO: 468743 - RNA, 19 nt, Homo sapiens
ggccagaucuccaacuaug

SEQ ID NO: 468744 - RNA, 19 nt, Homo sapiens
gaaucacucuggcaauugu

SEQ ID NO: 468745 - RNA, 19 nt, Homo sapiens
guaauugucuucucuuugc

SEQ ID NO: 468746 - RNA, 19 nt, Homo sapiens
ggaaauuuaucaggugaga

SEQ ID NO: 468747 - RNA, 19 nt, Homo sapiens
gaaagugaaagguaaugaa

SEQ ID NO: 468748 - RNA, 19 nt, Homo sapiens
ggaguuugauucuuaccuu

SEQ ID NO: 468749 - RNA, 19 nt, Homo sapiens
guggugaacuuuagaggaa

SEQ ID NO: 468750 - RNA, 19 nt, Homo sapiens
gaugagcaacguugucuuu

SEQ ID NO: 468751 - RNA, 19 nt, Homo sapiens
gcaagucaguucguauaau

SEQ ID NO: 468752 - RNA, 19 nt, Homo sapiens
ggaaaccuccuugcuacua

SEQ ID NO: 468753 - RNA, 19 nt, Homo sapiens
gcgcagagcuagggaaagu

SEQ ID NO: 468754 - RNA, 19 nt, Homo sapiens
ggaagaaugugcuguucgu

SEQ ID NO: 468755 - RNA, 19 nt, Homo sapiens
ccaacuauguggcagcauu

SEQ ID NO: 468756 - RNA, 19 nt, Homo sapiens
uagggaaagugaaagguaa

SEQ ID NO: 468757 - RNA, 19 nt, Homo sapiens
guuaaaagauggucaagaa

SEQ ID NO: 468758 - RNA, 19 nt, Homo sapiens
ugugaaagcuacugaagug

SEQ ID NO: 468759 - RNA, 19 nt, Homo sapiens
cgacugaguagacuuguuu

SEQ ID NO: 468760 - RNA, 19 nt, Homo sapiens
ccauaucagugggcuauuu

SEQ ID NO: 468761 - RNA, 19 nt, Homo sapiens
uguccaggcucauaauaaa

SEQ ID NO: 468762 - RNA, 19 nt, Homo sapiens
ugaagugccuugggaaaug

SEQ ID NO: 468763 - RNA, 19 nt, Homo sapiens
gaguagacuuguuuacauc

SEQ ID NO: 468764 - RNA, 19 nt, Homo sapiens
gcacaaggaguuugauucu

SEQ ID NO: 468765 - RNA, 19 nt, Homo sapiens
guaacuuuauugggugaua

SEQ ID NO: 468766 - RNA, 19 nt, Homo sapiens
ugaguagacuuguuuacau

SEQ ID NO: 468767 - RNA, 19 nt, Homo sapiens
gcagaucaccagcaaagug

SEQ ID NO: 468768 - RNA, 19 nt, Homo sapiens
gaguuugauucuuaccuuu

SEQ ID NO: 468769 - RNA, 19 nt, Homo sapiens
guuaggagugugcauauuu

SEQ ID NO: 468770 - RNA, 19 nt, Homo sapiens
gcagagcuagggaaaguga

SEQ ID NO: 468771 - RNA, 19 nt, Homo sapiens
cagaggacauuaacuggau

SEQ ID NO: 468772 - RNA, 19 nt, Homo sapiens
gaccagaugcuaagaguca

SEQ ID NO: 468773 - RNA, 19 nt, Homo sapiens
aaaccuccuugcuacuaua

SEQ ID NO: 468774 - RNA, 19 nt, Homo sapiens
ucucuuugcugauuauguu

SEQ ID NO: 468775 - RNA, 19 nt, Homo sapiens
ggacucagcaccuccaaag

SEQ ID NO: 468776 - RNA, 19 nt, Homo sapiens
ugacagccauccucaccuu

SEQ ID NO: 468777 - RNA, 19 nt, Homo sapiens
guguguuccuuucuugaua

SEQ ID NO: 468778 - RNA, 19 nt, Homo sapiens
cgucuuauguaugguuuaa

SEQ ID NO: 468779 - RNA, 19 nt, Homo sapiens
ggacauuaacuggaucauu

SEQ ID NO: 468780 - RNA, 19 nt, Homo sapiens
agugagaucuggaggaaug

SEQ ID NO: 468781 - RNA, 19 nt, Homo sapiens
acacaaggauguuaaaaga

SEQ ID NO: 468782 - RNA, 19 nt, Homo sapiens
uuugugaacugcuuccuuu

SEQ ID NO: 468783 - RNA, 19 nt, Homo sapiens
ccagcaaagugcacugaug

SEQ ID NO: 468784 - RNA, 19 nt, Homo sapiens
caucuaaguccuaacuauu

SEQ ID NO: 468785 - RNA, 19 nt, Homo sapiens
gcuaagagucaaaggaaug

SEQ ID NO: 468786 - RNA, 19 nt, Homo sapiens
ggaaagugaaagguaauga

SEQ ID NO: 468787 - RNA, 19 nt, Homo sapiens
cuacagacaacuucaucua

SEQ ID NO: 468788 - RNA, 19 nt, Homo sapiens
cauccugucucccuacuuc

SEQ ID NO: 468789 - RNA, 19 nt, Homo sapiens
gcaguguccuucucuucau

SEQ ID NO: 468790 - RNA, 19 nt, Homo sapiens
gcuugauacuccuaacuug

SEQ ID NO: 468791 - RNA, 19 nt, Homo sapiens
uauagcgucuuauguaugg

SEQ ID NO: 468792 - RNA, 19 nt, Homo sapiens
aguggaaccugguguguga

SEQ ID NO: 468793 - RNA, 19 nt, Homo sapiens
ucaucuaaguccuaacuau

SEQ ID NO: 468794 - RNA, 19 nt, Homo sapiens
acagacaacuucaucuaag

SEQ ID NO: 468795 - RNA, 19 nt, Homo sapiens
guguaauugucuucucuuu

SEQ ID NO: 468796 - RNA, 19 nt, Homo sapiens
cuuuaguccuguaacuuua

SEQ ID NO: 468797 - RNA, 19 nt, Homo sapiens
cuguugggcuccuucauuu

SEQ ID NO: 468798 - RNA, 19 nt, Homo sapiens
caugggaggauauuacaaa

SEQ ID NO: 468799 - RNA, 19 nt, Homo sapiens
gcaaagugcacugaugugu

SEQ ID NO: 468800 - RNA, 19 nt, Homo sapiens
ggucgugcgcccuauguaa

SEQ ID NO: 468801 - RNA, 19 nt, Homo sapiens
ggaggaaugugagaagcau

SEQ ID NO: 468802 - RNA, 19 nt, Homo sapiens
gagcaccaccuuccucuag

SEQ ID NO: 468803 - RNA, 19 nt, Homo sapiens
caagaaaggcccacaaucc

SEQ ID NO: 468804 - RNA, 19 nt, Homo sapiens
ggcugcugcugcaauauuu

SEQ ID NO: 468805 - RNA, 19 nt, Homo sapiens
uucauagucuuucagagua

SEQ ID NO: 468806 - RNA, 19 nt, Homo sapiens
uacuauagcgucuuaugua

SEQ ID NO: 468807 - RNA, 19 nt, Homo sapiens
caacuauguggcagcauuu

SEQ ID NO: 468808 - RNA, 19 nt, Homo sapiens
ugucuucucuuugcugauu

SEQ ID NO: 468809 - RNA, 19 nt, Homo sapiens
agugaaagguaaugaagau

SEQ ID NO: 468810 - RNA, 19 nt, Homo sapiens
gcaggagagcgcagagcua

SEQ ID NO: 468811 - RNA, 19 nt, Homo sapiens
gaaaaggccccuaauaagg

SEQ ID NO: 468812 - RNA, 19 nt, Homo sapiens
ccuggcugcugcugcaaua

SEQ ID NO: 468813 - RNA, 19 nt, Homo sapiens
gcuguugggcuccuucauu

SEQ ID NO: 468814 - RNA, 19 nt, Homo sapiens
acugaugugugagcucuua

SEQ ID NO: 468815 - RNA, 19 nt, Homo sapiens
agaaugagcagaugcagau

SEQ ID NO: 468816 - RNA, 19 nt, Homo sapiens
gagcgcagagcuagggaaa

SEQ ID NO: 468817 - RNA, 19 nt, Homo sapiens
uaaaagcacagccuucuaa

SEQ ID NO: 468818 - RNA, 19 nt, Homo sapiens
guucauagucuuucagagu

SEQ ID NO: 468819 - RNA, 19 nt, Homo sapiens
ugagagagaugagcaacgu

SEQ ID NO: 468820 - RNA, 19 nt, Homo sapiens
acuauagcgucuuauguau

SEQ ID NO: 468821 - RNA, 19 nt, Homo sapiens
ucuaacaucgcuuccagua

SEQ ID NO: 468822 - RNA, 19 nt, Homo sapiens
gcucagcgccagcaucauc

SEQ ID NO: 468823 - RNA, 19 nt, Homo sapiens
aaauuuaucaggugagaga

SEQ ID NO: 468824 - RNA, 19 nt, Homo sapiens
ggagcagaaugagcagaug

SEQ ID NO: 468825 - RNA, 19 nt, Homo sapiens
uuacagaggacauuaacug

SEQ ID NO: 468826 - RNA, 19 nt, Homo sapiens
caaggaguuugauucuuac

SEQ ID NO: 468827 - RNA, 19 nt, Homo sapiens
guaauugcacaaggaguuu

SEQ ID NO: 468828 - RNA, 19 nt, Homo sapiens
ccaagucacacaaggaugu

SEQ ID NO: 468829 - RNA, 19 nt, Homo sapiens
gaacugcgauugaauaaca

SEQ ID NO: 468830 - RNA, 19 nt, Homo sapiens
ggaaguccuugcacaaaua

SEQ ID NO: 468831 - RNA, 19 nt, Homo sapiens
gaaaccagcugcacauguu

SEQ ID NO: 468832 - RNA, 19 nt, Homo sapiens
acaaauaggcgcuuaauaa

SEQ ID NO: 468833 - RNA, 19 nt, Homo sapiens
ggaggaaguucaccuuuga

SEQ ID NO: 468834 - RNA, 19 nt, Homo sapiens
ucacagaacucuauuugga

SEQ ID NO: 468835 - RNA, 19 nt, Homo sapiens
gaucaacgaugggcaauuc

SEQ ID NO: 468836 - RNA, 19 nt, Homo sapiens
ggauagaccugagcaacaa

SEQ ID NO: 468837 - RNA, 19 nt, Homo sapiens
gcccagaacccuuucauuu

SEQ ID NO: 468838 - RNA, 19 nt, Homo sapiens
gugaaucucuccauugaug

SEQ ID NO: 468839 - RNA, 19 nt, Homo sapiens
gaucaugccugugccaaug

SEQ ID NO: 468840 - RNA, 19 nt, Homo sapiens
caacaaggugucagaaauu

SEQ ID NO: 468841 - RNA, 19 nt, Homo sapiens
ggugacaacugcagugaga

SEQ ID NO: 468842 - RNA, 19 nt, Homo sapiens
caaccaggcuuugucaaga

SEQ ID NO: 468843 - RNA, 19 nt, Homo sapiens
gaccaccgcugccagaaug

SEQ ID NO: 468844 - RNA, 19 nt, Homo sapiens
ccaagggcauucccaagaa

SEQ ID NO: 468845 - RNA, 19 nt, Homo sapiens
acaaugggauccuucugua

SEQ ID NO: 468846 - RNA, 19 nt, Homo sapiens
gcagugagaaccaggauga

SEQ ID NO: 468847 - RNA, 19 nt, Homo sapiens
caacaagaucaguuccuua

SEQ ID NO: 468848 - RNA, 19 nt, Homo sapiens
ucacucggauccauaagaa

SEQ ID NO: 468849 - RNA, 19 nt, Homo sapiens
gugagugcaugccagguua

SEQ ID NO: 468850 - RNA, 19 nt, Homo sapiens
ggaggccacugggauguuu

SEQ ID NO: 468851 - RNA, 19 nt, Homo sapiens
agacuggacuugagugaga

SEQ ID NO: 468852 - RNA, 19 nt, Homo sapiens
acaacaaggugucagaaau

SEQ ID NO: 468853 - RNA, 19 nt, Homo sapiens
acaacgagcugcaggacuu

SEQ ID NO: 468854 - RNA, 19 nt, Homo sapiens
gaaugucacagaacucuau

SEQ ID NO: 468855 - RNA, 19 nt, Homo sapiens
ugaacucgcugguccucua

SEQ ID NO: 468856 - RNA, 19 nt, Homo sapiens
caacaucacucggauccau

SEQ ID NO: 468857 - RNA, 19 nt, Homo sapiens
gcacuccaaccaccuguuu

SEQ ID NO: 468858 - RNA, 19 nt, Homo sapiens
gaacaccgagcgccuggaa

SEQ ID NO: 468859 - RNA, 19 nt, Homo sapiens
ggacaacgaccacauugca

SEQ ID NO: 468860 - RNA, 19 nt, Homo sapiens
ggugaagacuggcuacaag

SEQ ID NO: 468861 - RNA, 19 nt, Homo sapiens
ccaaagagcaguacuucau

SEQ ID NO: 468862 - RNA, 19 nt, Homo sapiens
ccaacaagaucaacugcau

SEQ ID NO: 468863 - RNA, 19 nt, Homo sapiens
caagaucaguuccuuaagc

SEQ ID NO: 468864 - RNA, 19 nt, Homo sapiens
ccaagaaugucacagaacu

SEQ ID NO: 468865 - RNA, 19 nt, Homo sapiens
ccagaacccuuucauuugc

SEQ ID NO: 468866 - RNA, 19 nt, Homo sapiens
ucacugcucucccuguaug

SEQ ID NO: 468867 - RNA, 19 nt, Homo sapiens
gugagcagcugguggacuu

SEQ ID NO: 468868 - RNA, 19 nt, Homo sapiens
caaagagcaguacuucauu

SEQ ID NO: 468869 - RNA, 19 nt, Homo sapiens
uggaugaagucaacagcua

SEQ ID NO: 468870 - RNA, 19 nt, Homo sapiens
gaagacuggcuacaaggaa

SEQ ID NO: 468871 - RNA, 19 nt, Homo sapiens
gccugaagcucaccaagau

SEQ ID NO: 468872 - RNA, 19 nt, Homo sapiens
aaagagcaguacuucauuc

SEQ ID NO: 468873 - RNA, 19 nt, Homo sapiens
gcacaaauaggcgcuuaau

SEQ ID NO: 468874 - RNA, 19 nt, Homo sapiens
gaucugaacccaugucaac

SEQ ID NO: 468875 - RNA, 19 nt, Homo sapiens
gcaacaacaagaucaguuc

SEQ ID NO: 468876 - RNA, 19 nt, Homo sapiens
cggaggaaguucaccuuug

SEQ ID NO: 468877 - RNA, 19 nt, Homo sapiens
gcccguggaugucaacuca

SEQ ID NO: 468878 - RNA, 19 nt, Homo sapiens
ggacugagugccagaaugg

SEQ ID NO: 468879 - RNA, 19 nt, Homo sapiens
gaucaguuccuuaagcaau

SEQ ID NO: 468880 - RNA, 19 nt, Homo sapiens
caaggugucagaaauugaa

SEQ ID NO: 468881 - RNA, 19 nt, Homo sapiens
guguccagcuucaaccaua

SEQ ID NO: 468882 - RNA, 19 nt, Homo sapiens
gcugugcccucugcgcaua

SEQ ID NO: 468883 - RNA, 19 nt, Homo sapiens
cugcaggacuucaccaaga

SEQ ID NO: 468884 - RNA, 19 nt, Homo sapiens
uggugaaucucuccauuga

SEQ ID NO: 468885 - RNA, 19 nt, Homo sapiens
gaccugagcaacaacaaga

SEQ ID NO: 468886 - RNA, 19 nt, Homo sapiens
ggaacucaauggcaacaac

SEQ ID NO: 468887 - RNA, 19 nt, Homo sapiens
gcaacaacaaggugucaga

SEQ ID NO: 468888 - RNA, 19 nt, Homo sapiens
gcagcgaugggaccucuuu

SEQ ID NO: 468889 - RNA, 19 nt, Homo sapiens
aaacuuacacaucugaaga

SEQ ID NO: 468890 - RNA, 19 nt, Homo sapiens
gggcagaucaagagcaaga

SEQ ID NO: 468891 - RNA, 19 nt, Homo sapiens
gagcugaacggcaucaagu

SEQ ID NO: 468892 - RNA, 19 nt, Homo sapiens
uggcagagguccagaagag

SEQ ID NO: 468893 - RNA, 19 nt, Homo sapiens
cggaaguccuugcacaaau

SEQ ID NO: 468894 - RNA, 19 nt, Homo sapiens
cuauaagggucgagacugu

SEQ ID NO: 468895 - RNA, 19 nt, Homo sapiens
ucaccacgccugccaagaa

SEQ ID NO: 468896 - RNA, 19 nt, Homo sapiens
gaaccgggcauugcucguu

SEQ ID NO: 468897 - RNA, 19 nt, Homo sapiens
cagaacugcgauugaauaa

SEQ ID NO: 468898 - RNA, 19 nt, Homo sapiens
gaucagcugcauugaggaa

SEQ ID NO: 468899 - RNA, 19 nt, Homo sapiens
aacaagaucaguuccuuaa

SEQ ID NO: 468900 - RNA, 19 nt, Homo sapiens
ucaccaagacgcagaugaa

SEQ ID NO: 468901 - RNA, 19 nt, Homo sapiens
cgaaaccuguacaucaaca

SEQ ID NO: 468902 - RNA, 19 nt, Homo sapiens
aaaucaaucugagcaacaa

SEQ ID NO: 468903 - RNA, 19 nt, Homo sapiens
acagaaagcuacggaggau

SEQ ID NO: 468904 - RNA, 19 nt, Homo sapiens
uccgaaaccuguacaucaa

SEQ ID NO: 468905 - RNA, 19 nt, Homo sapiens
gcgaggcgccacucuaugu

SEQ ID NO: 468906 - RNA, 19 nt, Homo sapiens
gaacucaauggcaacaaca

SEQ ID NO: 468907 - RNA, 19 nt, Homo sapiens
gaauaacaaugagauuucc

SEQ ID NO: 468908 - RNA, 19 nt, Homo sapiens
ucucacugcucucccugua

SEQ ID NO: 468909 - RNA, 19 nt, Homo sapiens
gacaaugggauccuucugu

SEQ ID NO: 468910 - RNA, 19 nt, Homo sapiens
gagaaguugcucaguguca

SEQ ID NO: 468911 - RNA, 19 nt, Homo sapiens
gggacugagugccagaaug

SEQ ID NO: 468912 - RNA, 19 nt, Homo sapiens
gcaauuccuccuucaccaa

SEQ ID NO: 468913 - RNA, 19 nt, Homo sapiens
acaacaagaucaguuccuu

SEQ ID NO: 468914 - RNA, 19 nt, Homo sapiens
aacaaggugucagaaauug

SEQ ID NO: 468915 - RNA, 19 nt, Homo sapiens
cccagaacccuuucauuug

SEQ ID NO: 468916 - RNA, 19 nt, Homo sapiens
caacgaccacauugcaguu

SEQ ID NO: 468917 - RNA, 19 nt, Homo sapiens
caacaacaaggugucagaa

SEQ ID NO: 468918 - RNA, 19 nt, Homo sapiens
acaaugagauuuccauccu

SEQ ID NO: 468919 - RNA, 19 nt, Homo sapiens
cacaaauaggcgcuuaaua

SEQ ID NO: 468920 - RNA, 19 nt, Homo sapiens
ccacaccguugagcugguu

SEQ ID NO: 468921 - RNA, 19 nt, Homo sapiens
cagcgaggcgccacucuau

SEQ ID NO: 468922 - RNA, 19 nt, Homo sapiens
gugcugagacgaucaacga

SEQ ID NO: 468923 - RNA, 19 nt, Homo sapiens
ucacugaccugcaaaacug

SEQ ID NO: 468924 - RNA, 19 nt, Homo sapiens
acacuuaccugcaguucac

SEQ ID NO: 468925 - RNA, 19 nt, Homo sapiens
gaaguuugaaugccaaggu

SEQ ID NO: 468926 - RNA, 19 nt, Homo sapiens
ugagccagcugaccacucu

SEQ ID NO: 468927 - RNA, 19 nt, Homo sapiens
ucccaagaaugucacagaa

SEQ ID NO: 468928 - RNA, 19 nt, Homo sapiens
gguccucuauggaaacaag

SEQ ID NO: 468929 - RNA, 19 nt, Homo sapiens
gaacagaacuccaucaaag

SEQ ID NO: 468930 - RNA, 19 nt, Homo sapiens
gaaauaauaucaccaggau

SEQ ID NO: 468931 - RNA, 19 nt, Homo sapiens
ucacaucgcugguccugua

SEQ ID NO: 468932 - RNA, 19 nt, Homo sapiens
gaauagacaucagcaagaa

SEQ ID NO: 468933 - RNA, 19 nt, Homo sapiens
ccagaaagguuaugcauca

SEQ ID NO: 468934 - RNA, 19 nt, Homo sapiens
gcgagaagcucaucacugu

SEQ ID NO: 468935 - RNA, 19 nt, Homo sapiens
gcaaguccuuccagaauug

SEQ ID NO: 468936 - RNA, 19 nt, Homo sapiens
ggagauuccugccaacuug

SEQ ID NO: 468937 - RNA, 19 nt, Homo sapiens
gcucaucacugucaacuuc

SEQ ID NO: 468938 - RNA, 19 nt, Homo sapiens
caagccaccucccugaaua

SEQ ID NO: 468939 - RNA, 19 nt, Homo sapiens
gaaagguuaugcaucaugu

SEQ ID NO: 468940 - RNA, 19 nt, Homo sapiens
ggaacaagaucaccgagau

SEQ ID NO: 468941 - RNA, 19 nt, Homo sapiens
gaaauacgccuagaacaga

SEQ ID NO: 468942 - RNA, 19 nt, Homo sapiens
aaaugaagcuggagaggaa

SEQ ID NO: 468943 - RNA, 19 nt, Homo sapiens
ugaaguggcuggccgacua

SEQ ID NO: 468944 - RNA, 19 nt, Homo sapiens
gaccuggacagaaauaaua

SEQ ID NO: 468945 - RNA, 19 nt, Homo sapiens
gaacaagaauaagcugcaa

SEQ ID NO: 468946 - RNA, 19 nt, Homo sapiens
ccauaaaccuccuguccaa

SEQ ID NO: 468947 - RNA, 19 nt, Homo sapiens
uaacagccgugcccagaga

SEQ ID NO: 468948 - RNA, 19 nt, Homo sapiens
ggaaggaaaccaccuaaca

SEQ ID NO: 468949 - RNA, 19 nt, Homo sapiens
acaagaaacugaagcgaau

SEQ ID NO: 468950 - RNA, 19 nt, Homo sapiens
gaaagggcuugauggagau

SEQ ID NO: 468951 - RNA, 19 nt, Homo sapiens
ucacaucucuuucccaucu

SEQ ID NO: 468952 - RNA, 19 nt, Homo sapiens
uagaagagguggagagaca

SEQ ID NO: 468953 - RNA, 19 nt, Homo sapiens
gaacaagaucaccgagauu

SEQ ID NO: 468954 - RNA, 19 nt, Homo sapiens
ggacuucgcugggcucaag

SEQ ID NO: 468955 - RNA, 19 nt, Homo sapiens
agaggaagguaaagaagaa

SEQ ID NO: 468956 - RNA, 19 nt, Homo sapiens
caaagacuccuacguggaa

SEQ ID NO: 468957 - RNA, 19 nt, Homo sapiens
agagggagcuuucgaugga

SEQ ID NO: 468958 - RNA, 19 nt, Homo sapiens
ggagggcaucgucgaaaua

SEQ ID NO: 468959 - RNA, 19 nt, Homo sapiens
gcauggcuccugugcauuu

SEQ ID NO: 468960 - RNA, 19 nt, Homo sapiens
acaacgagcugcaggacuu

SEQ ID NO: 468961 - RNA, 19 nt, Homo sapiens
cgacagcgacggacaguug

SEQ ID NO: 468962 - RNA, 19 nt, Homo sapiens
cgacugcgccugaacaaga

SEQ ID NO: 468963 - RNA, 19 nt, Homo sapiens
caaccacaguguacagugu

SEQ ID NO: 468964 - RNA, 19 nt, Homo sapiens
gagaagcucaucacuguca

SEQ ID NO: 468965 - RNA, 19 nt, Homo sapiens
gcucaggcuccgaggauua

SEQ ID NO: 468966 - RNA, 19 nt, Homo sapiens
ucaacuugcucucccugua

SEQ ID NO: 468967 - RNA, 19 nt, Homo sapiens
gacaaaggaacuccaaaga

SEQ ID NO: 468968 - RNA, 19 nt, Homo sapiens
ggacaaaggaacuccaaag

SEQ ID NO: 468969 - RNA, 19 nt, Homo sapiens
gccuugaccuggacagaaa

SEQ ID NO: 468970 - RNA, 19 nt, Homo sapiens
gaucaacaacuacgugugu

SEQ ID NO: 468971 - RNA, 19 nt, Homo sapiens
agacuagauuugagugaaa

SEQ ID NO: 468972 - RNA, 19 nt, Homo sapiens
gaucaacccagaugacugu

SEQ ID NO: 468973 - RNA, 19 nt, Homo sapiens
ccaacccacuccacuguga

SEQ ID NO: 468974 - RNA, 19 nt, Homo sapiens
gagaggaagguaaagaaga

SEQ ID NO: 468975 - RNA, 19 nt, Homo sapiens
gcucagccuucaaguguca

SEQ ID NO: 468976 - RNA, 19 nt, Homo sapiens
ucaacgaccucacaucucu

SEQ ID NO: 468977 - RNA, 19 nt, Homo sapiens
ccagaggcaugcccaagga

SEQ ID NO: 468978 - RNA, 19 nt, Homo sapiens
gaaccuaguaguggacaaa

SEQ ID NO: 468979 - RNA, 19 nt, Homo sapiens
uaacuacacaggugagcua

SEQ ID NO: 468980 - RNA, 19 nt, Homo sapiens
gcaaagggccaguggacau

SEQ ID NO: 468981 - RNA, 19 nt, Homo sapiens
gaaugacaaugagguaucu

SEQ ID NO: 468982 - RNA, 19 nt, Homo sapiens
gaaggaaaccaccuaacag

SEQ ID NO: 468983 - RNA, 19 nt, Homo sapiens
ucaaggagauucccaucca

SEQ ID NO: 468984 - RNA, 19 nt, Homo sapiens
ggcaagugguugaggaaga

SEQ ID NO: 468985 - RNA, 19 nt, Homo sapiens
acaacaagcugcagaccau

SEQ ID NO: 468986 - RNA, 19 nt, Homo sapiens
cacaucagcugcauugaag

SEQ ID NO: 468987 - RNA, 19 nt, Homo sapiens
ucucaccucuccacucuga

SEQ ID NO: 468988 - RNA, 19 nt, Homo sapiens
uggcggaugugcagaagaa

SEQ ID NO: 468989 - RNA, 19 nt, Homo sapiens
ccacaucagcugcauugaa

SEQ ID NO: 468990 - RNA, 19 nt, Homo sapiens
ucaccaggaucaccaagau

SEQ ID NO: 468991 - RNA, 19 nt, Homo sapiens
gcuccucguuuguagaaga

SEQ ID NO: 468992 - RNA, 19 nt, Homo sapiens
cggcauccuucucuacaaa

SEQ ID NO: 468993 - RNA, 19 nt, Homo sapiens
ccacucugauccugagcua

SEQ ID NO: 468994 - RNA, 19 nt, Homo sapiens
gcaagugguugaggaagag

SEQ ID NO: 468995 - RNA, 19 nt, Homo sapiens
gaggaaagggcuugaugga

SEQ ID NO: 468996 - RNA, 19 nt, Homo sapiens
caacugggaccucauacau

SEQ ID NO: 468997 - RNA, 19 nt, Homo sapiens
ccacagaugccaccaugga

SEQ ID NO: 468998 - RNA, 19 nt, Homo sapiens
gcaccugccaccugaguga

SEQ ID NO: 468999 - RNA, 19 nt, Homo sapiens
cauccagacacuccacuua

SEQ ID NO: 469000 - RNA, 19 nt, Homo sapiens
cgaauagacaucagcaaga

SEQ ID NO: 469001 - RNA, 19 nt, Homo sapiens
ccucauacaugugcaagug

SEQ ID NO: 469002 - RNA, 19 nt, Homo sapiens
aauaauaucaccaggauca

SEQ ID NO: 469003 - RNA, 19 nt, Homo sapiens
guaacaauaagaucaagga

SEQ ID NO: 469004 - RNA, 19 nt, Homo sapiens
caggagccuucacccagua

SEQ ID NO: 469005 - RNA, 19 nt, Homo sapiens
aagaaugacucugccaaug

SEQ ID NO: 469006 - RNA, 19 nt, Homo sapiens
ugagacugcugucccucua

SEQ ID NO: 469007 - RNA, 19 nt, Homo sapiens
cagacuagauuugagugaa

SEQ ID NO: 469008 - RNA, 19 nt, Homo sapiens
uggacgggaucaacaacua

SEQ ID NO: 469009 - RNA, 19 nt, Homo sapiens
gagcagugcaccuguaugg

SEQ ID NO: 469010 - RNA, 19 nt, Homo sapiens
ccaccucccugaauauguc

SEQ ID NO: 469011 - RNA, 19 nt, Homo sapiens
caucagcaagaaucagaua

SEQ ID NO: 469012 - RNA, 19 nt, Homo sapiens
aaacugaagcgaauagaca

SEQ ID NO: 469013 - RNA, 19 nt, Homo sapiens
gcacugccaacaagagaau

SEQ ID NO: 469014 - RNA, 19 nt, Homo sapiens
gaagcucaccagacuagau

SEQ ID NO: 469015 - RNA, 19 nt, Homo sapiens
cacaaucaauggcuacaca

SEQ ID NO: 469016 - RNA, 19 nt, Homo sapiens
gcaagaauaacgggacaug

SEQ ID NO: 469017 - RNA, 19 nt, Homo sapiens
acaaugagguaucuguucu

SEQ ID NO: 469018 - RNA, 19 nt, Homo sapiens
caacuugcucucccuguau

SEQ ID NO: 469019 - RNA, 19 nt, Homo sapiens
aaauacgccuagaacagaa

SEQ ID NO: 469020 - RNA, 19 nt, Homo sapiens
uggccuggcucucggauug

SEQ ID NO: 469021 - RNA, 19 nt, Homo sapiens
caacaacaacaacaucagu

SEQ ID NO: 469022 - RNA, 19 nt, Homo sapiens
ucaguggacccuucuguga

SEQ ID NO: 469023 - RNA, 19 nt, Homo sapiens
ccaguggacaucaacauug

SEQ ID NO: 469024 - RNA, 19 nt, Homo sapiens
gacugcgccugaacaagaa

SEQ ID NO: 469025 - RNA, 19 nt, Homo sapiens
gccaagggacuguuugaug

SEQ ID NO: 469026 - RNA, 19 nt, Homo sapiens
cgaaauacgccuagaacag

SEQ ID NO: 469027 - RNA, 19 nt, Homo sapiens
gaagguaaagaagaagaga

SEQ ID NO: 469028 - RNA, 19 nt, Homo sapiens
caacuacguguguaucugu

SEQ ID NO: 469029 - RNA, 19 nt, Homo sapiens
caacuucacuauugucuug

SEQ ID NO: 469030 - RNA, 19 nt, Homo sapiens
caaccaaacucuaauucaa

SEQ ID NO: 469031 - RNA, 19 nt, Homo sapiens
ccagggaacgguagauuua

SEQ ID NO: 469032 - RNA, 19 nt, Homo sapiens
ccuuauagcuaucauguga

SEQ ID NO: 469033 - RNA, 19 nt, Homo sapiens
uagacaagccacaaaguua

SEQ ID NO: 469034 - RNA, 19 nt, Homo sapiens
gugcuaggauugauuaugu

SEQ ID NO: 469035 - RNA, 19 nt, Homo sapiens
gcuaucaugugaauaaagu

SEQ ID NO: 469036 - RNA, 19 nt, Homo sapiens
guagugcuaggauugauua

SEQ ID NO: 469037 - RNA, 19 nt, Homo sapiens
gaccugcacucacaauauc

SEQ ID NO: 469038 - RNA, 19 nt, Homo sapiens
uuucucaacuucacuauug

SEQ ID NO: 469039 - RNA, 19 nt, Homo sapiens
ugucagcccuuauagcuau

SEQ ID NO: 469040 - RNA, 19 nt, Homo sapiens
gcacucacaauaucugcua

SEQ ID NO: 469041 - RNA, 19 nt, Homo sapiens
ggaguuggagcucaaguug

SEQ ID NO: 469042 - RNA, 19 nt, Homo sapiens
agacaagccacaaaguuaa

SEQ ID NO: 469043 - RNA, 19 nt, Homo sapiens
caagggcugccaaguguuu

SEQ ID NO: 469044 - RNA, 19 nt, Homo sapiens
gauuauguguucuccaaag

SEQ ID NO: 469045 - RNA, 19 nt, Homo sapiens
gcaaccaaacucuaauuca

SEQ ID NO: 469046 - RNA, 19 nt, Homo sapiens
uaggauugauuauguguuc

SEQ ID NO: 469047 - RNA, 19 nt, Homo sapiens
caauaucugcuaugcugua

SEQ ID NO: 469048 - RNA, 19 nt, Homo sapiens
cccaagggcugccaagugu

SEQ ID NO: 469049 - RNA, 19 nt, Homo sapiens
ggagcuguuucucaacuuc

SEQ ID NO: 469050 - RNA, 19 nt, Homo sapiens
gacaagccacaaaguuaaa

SEQ ID NO: 469051 - RNA, 19 nt, Homo sapiens
ggagggagaaggaguugga

SEQ ID NO: 469052 - RNA, 19 nt, Homo sapiens
uaucugcuaugcuguagug

SEQ ID NO: 469053 - RNA, 19 nt, Homo sapiens
agaaggaguuggagcucaa

SEQ ID NO: 469054 - RNA, 19 nt, Homo sapiens
aauguuagaggaagucuuu

SEQ ID NO: 469055 - RNA, 19 nt, Homo sapiens
cugcuaugcuguagugcua

SEQ ID NO: 469056 - RNA, 19 nt, Homo sapiens
guccugggauugacugaga

SEQ ID NO: 469057 - RNA, 19 nt, Homo sapiens
gauuacgguuauucuuaug

SEQ ID NO: 469058 - RNA, 19 nt, Homo sapiens
uauguguucuccaaagaug

SEQ ID NO: 469059 - RNA, 19 nt, Homo sapiens
cacacggucugcaaccaaa

SEQ ID NO: 469060 - RNA, 19 nt, Homo sapiens
agggaacgguagauuuauu

SEQ ID NO: 469061 - RNA, 19 nt, Homo sapiens
ucacuauugucuugauuac

SEQ ID NO: 469062 - RNA, 19 nt, Homo sapiens
caaccugccagaaggaaug

SEQ ID NO: 469063 - RNA, 19 nt, Homo sapiens
gccagggaacgguagauuu

SEQ ID NO: 469064 - RNA, 19 nt, Homo sapiens
uugauuauguguucuccaa

SEQ ID NO: 469065 - RNA, 19 nt, Homo sapiens
ggugugcccucagaaaucu

SEQ ID NO: 469066 - RNA, 19 nt, Homo sapiens
gggaacgguagauuuauuc

SEQ ID NO: 469067 - RNA, 19 nt, Homo sapiens
gaggagaaaccugccauag

SEQ ID NO: 469068 - RNA, 19 nt, Homo sapiens
ugaccugcacucacaauau

SEQ ID NO: 469069 - RNA, 19 nt, Homo sapiens
aguuggagcucaaguugga

SEQ ID NO: 469070 - RNA, 19 nt, Homo sapiens
ggucugcaaccaaacucua

SEQ ID NO: 469071 - RNA, 19 nt, Homo sapiens
uuagacaagccacaaaguu

SEQ ID NO: 469072 - RNA, 19 nt, Homo sapiens
cccgggagcuguuucucaa

SEQ ID NO: 469073 - RNA, 19 nt, Homo sapiens
gggagcuguuucucaacuu

SEQ ID NO: 469074 - RNA, 19 nt, Homo sapiens
gccagggugugucuuugau

SEQ ID NO: 469075 - RNA, 19 nt, Homo sapiens
cgaggagaaaccugccaua

SEQ ID NO: 469076 - RNA, 19 nt, Homo sapiens
cuugugagguccuaucagu

SEQ ID NO: 469077 - RNA, 19 nt, Homo sapiens
uuacgguuauucuuaugug

SEQ ID NO: 469078 - RNA, 19 nt, Homo sapiens
ccccaacucuuaacugaaa

SEQ ID NO: 469079 - RNA, 19 nt, Homo sapiens
cauccgagggcaccuguga

SEQ ID NO: 469080 - RNA, 19 nt, Homo sapiens
gcccuuauagcuaucaugu

SEQ ID NO: 469081 - RNA, 19 nt, Homo sapiens
ccugccagaaggaauguua

SEQ ID NO: 469082 - RNA, 19 nt, Homo sapiens
ccaagccgcugugaaaaug

SEQ ID NO: 469083 - RNA, 19 nt, Homo sapiens
agaaggaauguuagaggaa

SEQ ID NO: 469084 - RNA, 19 nt, Homo sapiens
uaauucaaccugccagaag

SEQ ID NO: 469085 - RNA, 19 nt, Homo sapiens
caccacacaucccuucaac

SEQ ID NO: 469086 - RNA, 19 nt, Homo sapiens
ugaucugucucaccacaca

SEQ ID NO: 469087 - RNA, 19 nt, Homo sapiens
ugaugauguaggauuguua

SEQ ID NO: 469088 - RNA, 19 nt, Homo sapiens
ccacacggucugcaaccaa

SEQ ID NO: 469089 - RNA, 19 nt, Homo sapiens
caacccacacggucugcaa

SEQ ID NO: 469090 - RNA, 19 nt, Homo sapiens
gaugauguaggauuguuac

SEQ ID NO: 469091 - RNA, 19 nt, Homo sapiens
gccaugguccugggauuga

SEQ ID NO: 469092 - RNA, 19 nt, Homo sapiens
uagccagggugugucuuug

SEQ ID NO: 469093 - RNA, 19 nt, Homo sapiens
gcuaggauugauuaugugu

SEQ ID NO: 469094 - RNA, 19 nt, Homo sapiens
gccaguugaucaaugaaua

SEQ ID NO: 469095 - RNA, 19 nt, Homo sapiens
cuucaaagcuggagucugu

SEQ ID NO: 469096 - RNA, 19 nt, Homo sapiens
ggccaauguuugaugcuua

SEQ ID NO: 469097 - RNA, 19 nt, Homo sapiens
gccaauguuugaugcuuaa

SEQ ID NO: 469098 - RNA, 19 nt, Homo sapiens
ugacuuauggccaauguuu

SEQ ID NO: 469099 - RNA, 19 nt, Homo sapiens
ggaggaagccugggaagug

SEQ ID NO: 469100 - RNA, 19 nt, Homo sapiens
ugacacuuguggcaucaaa

SEQ ID NO: 469101 - RNA, 19 nt, Homo sapiens
guggaaggcucuggaaagu

SEQ ID NO: 469102 - RNA, 19 nt, Homo sapiens
ugugggaaauccugcguuu

SEQ ID NO: 469103 - RNA, 19 nt, Homo sapiens
ccaguugaucaaugaauaa

SEQ ID NO: 469104 - RNA, 19 nt, Homo sapiens
aagcuugauuccugccaua

SEQ ID NO: 469105 - RNA, 19 nt, Homo sapiens
cagcaggcuuucaagaagu

SEQ ID NO: 469106 - RNA, 19 nt, Homo sapiens
agucuguccuccuaagaaa

SEQ ID NO: 469107 - RNA, 19 nt, Homo sapiens
gagucuguccuccuaagaa

SEQ ID NO: 469108 - RNA, 19 nt, Homo sapiens
acuccugccuucaccauga

SEQ ID NO: 469109 - RNA, 19 nt, Homo sapiens
gaagugccaguugaucaau

SEQ ID NO: 469110 - RNA, 19 nt, Homo sapiens
gggaagaagagauguuguc

SEQ ID NO: 469111 - RNA, 19 nt, Homo sapiens
caauuucugugagauggau

SEQ ID NO: 469112 - RNA, 19 nt, Homo sapiens
gcccagugccuuagauaca

SEQ ID NO: 469113 - RNA, 19 nt, Homo sapiens
ucuggaaaguccuucaaag

SEQ ID NO: 469114 - RNA, 19 nt, Homo sapiens
acacuuguggcaucaaaug

SEQ ID NO: 469115 - RNA, 19 nt, Homo sapiens
cccagugccuuagauacaa

SEQ ID NO: 469116 - RNA, 19 nt, Homo sapiens
agugccaguugaucaauga

SEQ ID NO: 469117 - RNA, 19 nt, Homo sapiens
caagaagugccaguugauc

SEQ ID NO: 469118 - RNA, 19 nt, Homo sapiens
cuugauuccugccauaugg

SEQ ID NO: 469119 - RNA, 19 nt, Homo sapiens
aaaucugcccagugccuua

SEQ ID NO: 469120 - RNA, 19 nt, Homo sapiens
agaagugccaguugaucaa

SEQ ID NO: 469121 - RNA, 19 nt, Homo sapiens
aagaagugccaguugauca

SEQ ID NO: 469122 - RNA, 19 nt, Homo sapiens
gggcaugugugggaaaucc

SEQ ID NO: 469123 - RNA, 19 nt, Homo sapiens
cagggaagaagagauguug

SEQ ID NO: 469124 - RNA, 19 nt, Homo sapiens
caaaugccuggauccuguu

SEQ ID NO: 469125 - RNA, 19 nt, Homo sapiens
gaagccaaaugacaaauaa

SEQ ID NO: 469126 - RNA, 19 nt, Homo sapiens
gaacaguauugcuuuguaa

SEQ ID NO: 469127 - RNA, 19 nt, Homo sapiens
aaacugagauguugucuau

SEQ ID NO: 469128 - RNA, 19 nt, Homo sapiens
uaaacaaccugaagacuug

SEQ ID NO: 469129 - RNA, 19 nt, Homo sapiens
ggacacacauacagugauu

SEQ ID NO: 469130 - RNA, 19 nt, Homo sapiens
ccaaaccacuguacaaaga

SEQ ID NO: 469131 - RNA, 19 nt, Homo sapiens
gaacucaggugccuuaaaa

SEQ ID NO: 469132 - RNA, 19 nt, Homo sapiens
gauaauccuuuccauguga

SEQ ID NO: 469133 - RNA, 19 nt, Homo sapiens
guaauaggauuucccauag

SEQ ID NO: 469134 - RNA, 19 nt, Homo sapiens
gcacaaacaugaggaaucu

SEQ ID NO: 469135 - RNA, 19 nt, Homo sapiens
uaaauacugugacaaggaa

SEQ ID NO: 469136 - RNA, 19 nt, Homo sapiens
gaaugucucuccugcacaa

SEQ ID NO: 469137 - RNA, 19 nt, Homo sapiens
uuacauugcugccaaauca

SEQ ID NO: 469138 - RNA, 19 nt, Homo sapiens
gaaucuggcugcuguguag

SEQ ID NO: 469139 - RNA, 19 nt, Homo sapiens
gcugauggcuagauugaga

SEQ ID NO: 469140 - RNA, 19 nt, Homo sapiens
gaagacuugugaaaucaau

SEQ ID NO: 469141 - RNA, 19 nt, Homo sapiens
guaugaaacugagauguug

SEQ ID NO: 469142 - RNA, 19 nt, Homo sapiens
gagauguugucuauagcua

SEQ ID NO: 469143 - RNA, 19 nt, Homo sapiens
guaauagagucuguaauag

SEQ ID NO: 469144 - RNA, 19 nt, Homo sapiens
gacaguaaccuuucucuuc

SEQ ID NO: 469145 - RNA, 19 nt, Homo sapiens
gcaagagcauggaauucau

SEQ ID NO: 469146 - RNA, 19 nt, Homo sapiens
caaucaauguuuacucgaa

SEQ ID NO: 469147 - RNA, 19 nt, Homo sapiens
gugacgcaaucaauguuua

SEQ ID NO: 469148 - RNA, 19 nt, Homo sapiens
ugaaugaguucuguaugaa

SEQ ID NO: 469149 - RNA, 19 nt, Homo sapiens
gauuaccuguagugcuuua

SEQ ID NO: 469150 - RNA, 19 nt, Homo sapiens
aauagagucuguaauagga

SEQ ID NO: 469151 - RNA, 19 nt, Homo sapiens
acaguaaccuuucucuuca

SEQ ID NO: 469152 - RNA, 19 nt, Homo sapiens
guauagacacacacacaua

SEQ ID NO: 469153 - RNA, 19 nt, Homo sapiens
gauguugucuauagcuaug

SEQ ID NO: 469154 - RNA, 19 nt, Homo sapiens
caaguuuacuccauuacau

SEQ ID NO: 469155 - RNA, 19 nt, Homo sapiens
gcugaccaaccaaauaaua

SEQ ID NO: 469156 - RNA, 19 nt, Homo sapiens
ucaaaugcauaccacaaau

SEQ ID NO: 469157 - RNA, 19 nt, Homo sapiens
agaacaguauugcuuugua

SEQ ID NO: 469158 - RNA, 19 nt, Homo sapiens
gaaaagaacaguauugcuu

SEQ ID NO: 469159 - RNA, 19 nt, Homo sapiens
ccugaagacuugugaaauc

SEQ ID NO: 469160 - RNA, 19 nt, Homo sapiens
uugaaugaguucuguauga

SEQ ID NO: 469161 - RNA, 19 nt, Homo sapiens
uguaauaggauuucccaua

SEQ ID NO: 469162 - RNA, 19 nt, Homo sapiens
cauugaagcugaaaaguuu

SEQ ID NO: 469163 - RNA, 19 nt, Homo sapiens
ucagagacuuuacuugcuu

SEQ ID NO: 469164 - RNA, 19 nt, Homo sapiens
gaaugaguucuguaugaaa

SEQ ID NO: 469165 - RNA, 19 nt, Homo sapiens
agaggauucuuacaaauuc

SEQ ID NO: 469166 - RNA, 19 nt, Homo sapiens
guaaauacugugacaagga

SEQ ID NO: 469167 - RNA, 19 nt, Homo sapiens
gacuuuacuugcuucauga

SEQ ID NO: 469168 - RNA, 19 nt, Homo sapiens
agacuuuacuugcuucaug

SEQ ID NO: 469169 - RNA, 19 nt, Homo sapiens
aaacacaggagaauguauu

SEQ ID NO: 469170 - RNA, 19 nt, Homo sapiens
gugcugaccaaccaaauaa

SEQ ID NO: 469171 - RNA, 19 nt, Homo sapiens
cgaagccaaaugacaaaua

SEQ ID NO: 469172 - RNA, 19 nt, Homo sapiens
acacacauaugcacacaca

SEQ ID NO: 469173 - RNA, 19 nt, Homo sapiens
gcuccuuccuggucaagaa

SEQ ID NO: 469174 - RNA, 19 nt, Homo sapiens
ggacuaccgcugcuccauu

SEQ ID NO: 469175 - RNA, 19 nt, Homo sapiens
gaacuggacacacauacag

SEQ ID NO: 469176 - RNA, 19 nt, Homo sapiens
ccacaaaugcaauaauaca

SEQ ID NO: 469177 - RNA, 19 nt, Homo sapiens
gacuaccgcugcuccauuc

SEQ ID NO: 469178 - RNA, 19 nt, Homo sapiens
ggagccgggugacuucaga

SEQ ID NO: 469179 - RNA, 19 nt, Homo sapiens
acugagauguugucuauag

SEQ ID NO: 469180 - RNA, 19 nt, Homo sapiens
gaaacugagauguugucua

SEQ ID NO: 469181 - RNA, 19 nt, Homo sapiens
cacauacagugauuauuuc

SEQ ID NO: 469182 - RNA, 19 nt, Homo sapiens
uaaaggagccgggugacuu

SEQ ID NO: 469183 - RNA, 19 nt, Homo sapiens
gaagaggaaagacuacagu

SEQ ID NO: 469184 - RNA, 19 nt, Homo sapiens
ucucuccucuuuccggaua

SEQ ID NO: 469185 - RNA, 19 nt, Homo sapiens
cacaggagaauguauuaaa

SEQ ID NO: 469186 - RNA, 19 nt, Homo sapiens
aauaggauuucccauagga

SEQ ID NO: 469187 - RNA, 19 nt, Homo sapiens
gauuuacauugcugccaaa

SEQ ID NO: 469188 - RNA, 19 nt, Homo sapiens
aagauaauccuuuccaugu

SEQ ID NO: 469189 - RNA, 19 nt, Homo sapiens
uugauuaccuguagugcuu

SEQ ID NO: 469190 - RNA, 19 nt, Homo sapiens
ggaauucauguguuuaaag

SEQ ID NO: 469191 - RNA, 19 nt, Homo sapiens
ggaaucuggcugcugugua

SEQ ID NO: 469192 - RNA, 19 nt, Homo sapiens
gcgaugcccagucuagaaa

SEQ ID NO: 469193 - RNA, 19 nt, Homo sapiens
cauuagugaugaagaggaa

SEQ ID NO: 469194 - RNA, 19 nt, Homo sapiens
ggauacuccucaucuuugg

SEQ ID NO: 469195 - RNA, 19 nt, Homo sapiens
caaaugcauaccacaaaug

SEQ ID NO: 469196 - RNA, 19 nt, Homo sapiens
gcacacacacacacacaca

SEQ ID NO: 469197 - RNA, 19 nt, Homo sapiens
ccaaaugacaaauaaaguc

SEQ ID NO: 469198 - RNA, 19 nt, Homo sapiens
gacccauucugauguaaag

SEQ ID NO: 469199 - RNA, 19 nt, Homo sapiens
aauggccucucuccucuuu

SEQ ID NO: 469200 - RNA, 19 nt, Homo sapiens
uuaaagaugggaauaagug

SEQ ID NO: 469201 - RNA, 19 nt, Homo sapiens
gaacaaaacacaggagaau

SEQ ID NO: 469202 - RNA, 19 nt, Homo sapiens
uagagucuguaauaggauu

SEQ ID NO: 469203 - RNA, 19 nt, Homo sapiens
aaagaaauaccagugcaaa

SEQ ID NO: 469204 - RNA, 19 nt, Homo sapiens
gauugaaugaguucuguau

SEQ ID NO: 469205 - RNA, 19 nt, Homo sapiens
gaggauucuuacaaauuca

SEQ ID NO: 469206 - RNA, 19 nt, Homo sapiens
cuguagugcuuuaaaguau

SEQ ID NO: 469207 - RNA, 19 nt, Homo sapiens
cagacccgcuggcaagaug

SEQ ID NO: 469208 - RNA, 19 nt, Homo sapiens
ggacacauuagaacucaca

SEQ ID NO: 469209 - RNA, 19 nt, Homo sapiens
aaaccacuguacaaagaau

SEQ ID NO: 469210 - RNA, 19 nt, Homo sapiens
gcuccauugucuuacuauu

SEQ ID NO: 469211 - RNA, 19 nt, Homo sapiens
ucacugcaacagagcauuu

SEQ ID NO: 469212 - RNA, 19 nt, Homo sapiens
acagcgaacuggacacaca

SEQ ID NO: 469213 - RNA, 19 nt, Homo sapiens
gagucaauguaaauuugug

SEQ ID NO: 469214 - RNA, 19 nt, Homo sapiens
gcauuucaacgccuccaaa

SEQ ID NO: 469215 - RNA, 19 nt, Homo sapiens
uuucugggcuggccaaaca

SEQ ID NO: 469216 - RNA, 19 nt, Homo sapiens
uuacuugcuucaugauuag

SEQ ID NO: 469217 - RNA, 19 nt, Homo sapiens
auaaacaaccugaagacuu

SEQ ID NO: 469218 - RNA, 19 nt, Homo sapiens
gggaauaagugcaaaagag

SEQ ID NO: 469219 - RNA, 19 nt, Homo sapiens
cgcaugcuccauugucuua

SEQ ID NO: 469220 - RNA, 19 nt, Homo sapiens
ccuguagugcuuuaaagua

SEQ ID NO: 469221 - RNA, 19 nt, Homo sapiens
acaugucgguugucugguu

SEQ ID NO: 469222 - RNA, 19 nt, Homo sapiens
uauagacacacacacauau

SEQ ID NO: 469223 - RNA, 19 nt, Homo sapiens
ucacuccgaagccaaauga

SEQ ID NO: 469224 - RNA, 19 nt, Homo sapiens
cugaagacuugugaaauca

SEQ ID NO: 469225 - RNA, 19 nt, Homo sapiens
uaacauagcucgagaggua

SEQ ID NO: 469226 - RNA, 19 nt, Homo sapiens
gaggaaauguuacaaauga

SEQ ID NO: 469227 - RNA, 19 nt, Homo sapiens
gaacaccuuugcagaauaa

SEQ ID NO: 469228 - RNA, 19 nt, Homo sapiens
gaagagaugacauugauaa

SEQ ID NO: 469229 - RNA, 19 nt, Homo sapiens
ugaugaagcucacagaaua

SEQ ID NO: 469230 - RNA, 19 nt, Homo sapiens
gaaagaaggaugucaagaa

SEQ ID NO: 469231 - RNA, 19 nt, Homo sapiens
ggaaagacuucaugcaguu

SEQ ID NO: 469232 - RNA, 19 nt, Homo sapiens
gcacagaaaucuccaacau

SEQ ID NO: 469233 - RNA, 19 nt, Homo sapiens
ggaaauggacccagaauau

SEQ ID NO: 469234 - RNA, 19 nt, Homo sapiens
gggagaagauuauagagaa

SEQ ID NO: 469235 - RNA, 19 nt, Homo sapiens
gaagaaaccaguacgugua

SEQ ID NO: 469236 - RNA, 19 nt, Homo sapiens
ucaagaaggugaaauccua

SEQ ID NO: 469237 - RNA, 19 nt, Homo sapiens
gaacuauacugaggaagaa

SEQ ID NO: 469238 - RNA, 19 nt, Homo sapiens
guaacacucugauuucauu

SEQ ID NO: 469239 - RNA, 19 nt, Homo sapiens
ggacauugaacaaaguuua

SEQ ID NO: 469240 - RNA, 19 nt, Homo sapiens
ggaacaccuuugcagaaua

SEQ ID NO: 469241 - RNA, 19 nt, Homo sapiens
agaagaagaugaagagcua

SEQ ID NO: 469242 - RNA, 19 nt, Homo sapiens
gcacagagcaagaagaaga

SEQ ID NO: 469243 - RNA, 19 nt, Homo sapiens
ccugaaauguguagcuuua

SEQ ID NO: 469244 - RNA, 19 nt, Homo sapiens
ugaauugguugaucucuuu

SEQ ID NO: 469245 - RNA, 19 nt, Homo sapiens
caacgagaaugguauacaa

SEQ ID NO: 469246 - RNA, 19 nt, Homo sapiens
gagaugacauugauaacau

SEQ ID NO: 469247 - RNA, 19 nt, Homo sapiens
gaagagaggauuguagaaa

SEQ ID NO: 469248 - RNA, 19 nt, Homo sapiens
ggagaagauuauagagaaa

SEQ ID NO: 469249 - RNA, 19 nt, Homo sapiens
ggcgauaccuggucauuga

SEQ ID NO: 469250 - RNA, 19 nt, Homo sapiens
gaaccugguccaccuuaua

SEQ ID NO: 469251 - RNA, 19 nt, Homo sapiens
gcagaugacuuugauucuu

SEQ ID NO: 469252 - RNA, 19 nt, Homo sapiens
gaagaaacgggcaacuaaa

SEQ ID NO: 469253 - RNA, 19 nt, Homo sapiens
aaagaagacugcagagaug

SEQ ID NO: 469254 - RNA, 19 nt, Homo sapiens
gagacucgauucaauuguu

SEQ ID NO: 469255 - RNA, 19 nt, Homo sapiens
cugaaacacuaccgaaaua

SEQ ID NO: 469256 - RNA, 19 nt, Homo sapiens
cuaaagcgccuaaaucuga

SEQ ID NO: 469257 - RNA, 19 nt, Homo sapiens
gaaacacuaccgaaauauu

SEQ ID NO: 469258 - RNA, 19 nt, Homo sapiens
caacgaaggaucaguauca

SEQ ID NO: 469259 - RNA, 19 nt, Homo sapiens
gaugaagacauuacaacua

SEQ ID NO: 469260 - RNA, 19 nt, Homo sapiens
guugacagaugaagacauu

SEQ ID NO: 469261 - RNA, 19 nt, Homo sapiens
caacaaggaagacucauug

SEQ ID NO: 469262 - RNA, 19 nt, Homo sapiens
uuacacaacuggaugaaug

SEQ ID NO: 469263 - RNA, 19 nt, Homo sapiens
ggacugaauugguugaucu

SEQ ID NO: 469264 - RNA, 19 nt, Homo sapiens
ccuaaagccuagaaauaaa

SEQ ID NO: 469265 - RNA, 19 nt, Homo sapiens
ggaaagagagagagcagaa

SEQ ID NO: 469266 - RNA, 19 nt, Homo sapiens
agaagagucugccaccuaa

SEQ ID NO: 469267 - RNA, 19 nt, Homo sapiens
ugacuuugauucuugguuu

SEQ ID NO: 469268 - RNA, 19 nt, Homo sapiens
gauugaaccuccuaaacga

SEQ ID NO: 469269 - RNA, 19 nt, Homo sapiens
gagagugaguugacagaug

SEQ ID NO: 469270 - RNA, 19 nt, Homo sapiens
gagaagagucugccaccua

SEQ ID NO: 469271 - RNA, 19 nt, Homo sapiens
caauugcuuugcuugguua

SEQ ID NO: 469272 - RNA, 19 nt, Homo sapiens
gaagagcuacugucugaga

SEQ ID NO: 469273 - RNA, 19 nt, Homo sapiens
cagaugacuuugauucuug

SEQ ID NO: 469274 - RNA, 19 nt, Homo sapiens
gaagcaagaauucaacgaa

SEQ ID NO: 469275 - RNA, 19 nt, Homo sapiens
ggaguauucagcuguauuu

SEQ ID NO: 469276 - RNA, 19 nt, Homo sapiens
agaaagagcugagauaaaa

SEQ ID NO: 469277 - RNA, 19 nt, Homo sapiens
guacguguauuccgucuca

SEQ ID NO: 469278 - RNA, 19 nt, Homo sapiens
ggaauuaaccuggcaagug

SEQ ID NO: 469279 - RNA, 19 nt, Homo sapiens
gaaauggacccagaauaug

SEQ ID NO: 469280 - RNA, 19 nt, Homo sapiens
ugagaaauauggaagagau

SEQ ID NO: 469281 - RNA, 19 nt, Homo sapiens
guagaaagagcugagauaa

SEQ ID NO: 469282 - RNA, 19 nt, Homo sapiens
agaaagagaggauaaauuc

SEQ ID NO: 469283 - RNA, 19 nt, Homo sapiens
gaagaaagagaggauaaau

SEQ ID NO: 469284 - RNA, 19 nt, Homo sapiens
acagaaaucuccaacaucu

SEQ ID NO: 469285 - RNA, 19 nt, Homo sapiens
gaagacauuacaacuauuc

SEQ ID NO: 469286 - RNA, 19 nt, Homo sapiens
agacucgauucaauuguua

SEQ ID NO: 469287 - RNA, 19 nt, Homo sapiens
gaagcucacagaauaaaga

SEQ ID NO: 469288 - RNA, 19 nt, Homo sapiens
acaacuggaugaaugaauu

SEQ ID NO: 469289 - RNA, 19 nt, Homo sapiens
aaagaaggaugucaagaag

SEQ ID NO: 469290 - RNA, 19 nt, Homo sapiens
ggaacguugcaaugaauua

SEQ ID NO: 469291 - RNA, 19 nt, Homo sapiens
agagugaguugacagauga

SEQ ID NO: 469292 - RNA, 19 nt, Homo sapiens
ggcaagugcugaugugguu

SEQ ID NO: 469293 - RNA, 19 nt, Homo sapiens
gcaagaagaagaugaagag

SEQ ID NO: 469294 - RNA, 19 nt, Homo sapiens
gaauaaagggugaggaaag

SEQ ID NO: 469295 - RNA, 19 nt, Homo sapiens
ugaaagagaaccuagauuc

SEQ ID NO: 469296 - RNA, 19 nt, Homo sapiens
agaagaaacgggcaacuaa

SEQ ID NO: 469297 - RNA, 19 nt, Homo sapiens
cugaggaggucauggagua

SEQ ID NO: 469298 - RNA, 19 nt, Homo sapiens
gcaaaggaaagaacuauac

SEQ ID NO: 469299 - RNA, 19 nt, Homo sapiens
cgaaggaucaguaucaaga

SEQ ID NO: 469300 - RNA, 19 nt, Homo sapiens
uggaagagaugacauugau

SEQ ID NO: 469301 - RNA, 19 nt, Homo sapiens
uuuauugccugaugucuuu

SEQ ID NO: 469302 - RNA, 19 nt, Homo sapiens
augaagagcuacugucuga

SEQ ID NO: 469303 - RNA, 19 nt, Homo sapiens
gauacaaggcuccauuuca

SEQ ID NO: 469304 - RNA, 19 nt, Homo sapiens
aaagaacuauacugaggaa

SEQ ID NO: 469305 - RNA, 19 nt, Homo sapiens
gcaaugaauuacaggacau

SEQ ID NO: 469306 - RNA, 19 nt, Homo sapiens
cccagaauaugaagagaaa

SEQ ID NO: 469307 - RNA, 19 nt, Homo sapiens
cgaaaguguuguaaucauc

SEQ ID NO: 469308 - RNA, 19 nt, Homo sapiens
agaauaaccugcaugaacu

SEQ ID NO: 469309 - RNA, 19 nt, Homo sapiens
acuaaccgcuugcuccuaa

SEQ ID NO: 469310 - RNA, 19 nt, Homo sapiens
gcuggagacuaccgccaua

SEQ ID NO: 469311 - RNA, 19 nt, Homo sapiens
ugagagcucuggaaagaag

SEQ ID NO: 469312 - RNA, 19 nt, Homo sapiens
agauuugacugguuuauca

SEQ ID NO: 469313 - RNA, 19 nt, Homo sapiens
gagaagggcgagaagaaga

SEQ ID NO: 469314 - RNA, 19 nt, Homo sapiens
gaaaccaguacguguauuc

SEQ ID NO: 469315 - RNA, 19 nt, Homo sapiens
gcaaauucaucuuuaugcu

SEQ ID NO: 469316 - RNA, 19 nt, Homo sapiens
caucuccacugaacaugaa

SEQ ID NO: 469317 - RNA, 19 nt, Homo sapiens
aauaaagggugaggaaaga

SEQ ID NO: 469318 - RNA, 19 nt, Homo sapiens
gaaauugaggaaagagaga

SEQ ID NO: 469319 - RNA, 19 nt, Homo sapiens
guuuagauuugacugguuu

SEQ ID NO: 469320 - RNA, 19 nt, Homo sapiens
caagauacaaggcuccauu

SEQ ID NO: 469321 - RNA, 19 nt, Homo sapiens
ucacacaggguuucacaaa

SEQ ID NO: 469322 - RNA, 19 nt, Homo sapiens
ggauaaauuccuagaagug

SEQ ID NO: 469323 - RNA, 19 nt, Homo sapiens
gaugaagcucacagaauaa

SEQ ID NO: 469324 - RNA, 19 nt, Homo sapiens
uaaagcgccuaaaucugaa

SEQ ID NO: 469325 - RNA, 19 nt, Homo sapiens
uaacauagcucgagaggua

SEQ ID NO: 469326 - RNA, 19 nt, Homo sapiens
gaggaaauguuacaaauga

SEQ ID NO: 469327 - RNA, 19 nt, Homo sapiens
gaacaccuuugcagaauaa

SEQ ID NO: 469328 - RNA, 19 nt, Homo sapiens
gaagagaugacauugauaa

SEQ ID NO: 469329 - RNA, 19 nt, Homo sapiens
ugaugaagcucacagaaua

SEQ ID NO: 469330 - RNA, 19 nt, Homo sapiens
gaaagaaggaugucaagaa

SEQ ID NO: 469331 - RNA, 19 nt, Homo sapiens
ggaaagacuucaugcaguu

SEQ ID NO: 469332 - RNA, 19 nt, Homo sapiens
gcacagaaaucuccaacau

SEQ ID NO: 469333 - RNA, 19 nt, Homo sapiens
ggaaauggacccagaauau

SEQ ID NO: 469334 - RNA, 19 nt, Homo sapiens
gggagaagauuauagagaa

SEQ ID NO: 469335 - RNA, 19 nt, Homo sapiens
gaagaaaccaguacgugua

SEQ ID NO: 469336 - RNA, 19 nt, Homo sapiens
ucaagaaggugaaauccua

SEQ ID NO: 469337 - RNA, 19 nt, Homo sapiens
gaacuauacugaggaagaa

SEQ ID NO: 469338 - RNA, 19 nt, Homo sapiens
guaacacucugauuucauu

SEQ ID NO: 469339 - RNA, 19 nt, Homo sapiens
ggacauugaacaaaguuua

SEQ ID NO: 469340 - RNA, 19 nt, Homo sapiens
ggaacaccuuugcagaaua

SEQ ID NO: 469341 - RNA, 19 nt, Homo sapiens
agaagaagaugaagagcua

SEQ ID NO: 469342 - RNA, 19 nt, Homo sapiens
gcacagagcaagaagaaga

SEQ ID NO: 469343 - RNA, 19 nt, Homo sapiens
ccugaaauguguagcuuua

SEQ ID NO: 469344 - RNA, 19 nt, Homo sapiens
ugaauugguugaucucuuu

SEQ ID NO: 469345 - RNA, 19 nt, Homo sapiens
caacgagaaugguauacaa

SEQ ID NO: 469346 - RNA, 19 nt, Homo sapiens
gagaugacauugauaacau

SEQ ID NO: 469347 - RNA, 19 nt, Homo sapiens
gaagagaggauuguagaaa

SEQ ID NO: 469348 - RNA, 19 nt, Homo sapiens
ggagaagauuauagagaaa

SEQ ID NO: 469349 - RNA, 19 nt, Homo sapiens
ggcgauaccuggucauuga

SEQ ID NO: 469350 - RNA, 19 nt, Homo sapiens
gaaccugguccaccuuaua

SEQ ID NO: 469351 - RNA, 19 nt, Homo sapiens
gcagaugacuuugauucuu

SEQ ID NO: 469352 - RNA, 19 nt, Homo sapiens
gaagaaacgggcaacuaaa

SEQ ID NO: 469353 - RNA, 19 nt, Homo sapiens
aaagaagacugcagagaug

SEQ ID NO: 469354 - RNA, 19 nt, Homo sapiens
gagacucgauucaauuguu

SEQ ID NO: 469355 - RNA, 19 nt, Homo sapiens
cuaaagcgccuaaaucuga

SEQ ID NO: 469356 - RNA, 19 nt, Homo sapiens
caacgaaggaucaguauca

SEQ ID NO: 469357 - RNA, 19 nt, Homo sapiens
gaugaagacauuacaacua

SEQ ID NO: 469358 - RNA, 19 nt, Homo sapiens
guugacagaugaagacauu

SEQ ID NO: 469359 - RNA, 19 nt, Homo sapiens
caacaaggaagacucauug

SEQ ID NO: 469360 - RNA, 19 nt, Homo sapiens
uuacacaacuggaugaaug

SEQ ID NO: 469361 - RNA, 19 nt, Homo sapiens
ggacugaauugguugaucu

SEQ ID NO: 469362 - RNA, 19 nt, Homo sapiens
ccuaaagccuagaaauaaa

SEQ ID NO: 469363 - RNA, 19 nt, Homo sapiens
ggaaagagagagagcagaa

SEQ ID NO: 469364 - RNA, 19 nt, Homo sapiens
agaagagucugccaccuaa

SEQ ID NO: 469365 - RNA, 19 nt, Homo sapiens
ugacuuugauucuugguuu

SEQ ID NO: 469366 - RNA, 19 nt, Homo sapiens
gauugaaccuccuaaacga

SEQ ID NO: 469367 - RNA, 19 nt, Homo sapiens
gagagugaguugacagaug

SEQ ID NO: 469368 - RNA, 19 nt, Homo sapiens
gagaagagucugccaccua

SEQ ID NO: 469369 - RNA, 19 nt, Homo sapiens
gaagagcuacugucugaga

SEQ ID NO: 469370 - RNA, 19 nt, Homo sapiens
cagaugacuuugauucuug

SEQ ID NO: 469371 - RNA, 19 nt, Homo sapiens
gaagcaagaauucaacgaa

SEQ ID NO: 469372 - RNA, 19 nt, Homo sapiens
ggaguauucagcuguauuu

SEQ ID NO: 469373 - RNA, 19 nt, Homo sapiens
agaaagagcugagauaaaa

SEQ ID NO: 469374 - RNA, 19 nt, Homo sapiens
guacguguauuccgucuca

SEQ ID NO: 469375 - RNA, 19 nt, Homo sapiens
ggaauuaaccuggcaagug

SEQ ID NO: 469376 - RNA, 19 nt, Homo sapiens
gaaauggacccagaauaug

SEQ ID NO: 469377 - RNA, 19 nt, Homo sapiens
ugagaaauauggaagagau

SEQ ID NO: 469378 - RNA, 19 nt, Homo sapiens
guagaaagagcugagauaa

SEQ ID NO: 469379 - RNA, 19 nt, Homo sapiens
agaaagagaggauaaauuc

SEQ ID NO: 469380 - RNA, 19 nt, Homo sapiens
gaagaaagagaggauaaau

SEQ ID NO: 469381 - RNA, 19 nt, Homo sapiens
acagaaaucuccaacaucu

SEQ ID NO: 469382 - RNA, 19 nt, Homo sapiens
gaagacauuacaacuauuc

SEQ ID NO: 469383 - RNA, 19 nt, Homo sapiens
agacucgauucaauuguua

SEQ ID NO: 469384 - RNA, 19 nt, Homo sapiens
gaagcucacagaauaaaga

SEQ ID NO: 469385 - RNA, 19 nt, Homo sapiens
acaacuggaugaaugaauu

SEQ ID NO: 469386 - RNA, 19 nt, Homo sapiens
aaagaaggaugucaagaag

SEQ ID NO: 469387 - RNA, 19 nt, Homo sapiens
ggaacguugcaaugaauua

SEQ ID NO: 469388 - RNA, 19 nt, Homo sapiens
agagugaguugacagauga

SEQ ID NO: 469389 - RNA, 19 nt, Homo sapiens
ggcaagugcugaugugguu

SEQ ID NO: 469390 - RNA, 19 nt, Homo sapiens
gcaagaagaagaugaagag

SEQ ID NO: 469391 - RNA, 19 nt, Homo sapiens
gaauaaagggugaggaaag

SEQ ID NO: 469392 - RNA, 19 nt, Homo sapiens
ugaaagagaaccuagauuc

SEQ ID NO: 469393 - RNA, 19 nt, Homo sapiens
agaagaaacgggcaacuaa

SEQ ID NO: 469394 - RNA, 19 nt, Homo sapiens
cugaggaggucauggagua

SEQ ID NO: 469395 - RNA, 19 nt, Homo sapiens
gcaaaggaaagaacuauac

SEQ ID NO: 469396 - RNA, 19 nt, Homo sapiens
cgaaggaucaguaucaaga

SEQ ID NO: 469397 - RNA, 19 nt, Homo sapiens
uggaagagaugacauugau

SEQ ID NO: 469398 - RNA, 19 nt, Homo sapiens
uuuauugccugaugucuuu

SEQ ID NO: 469399 - RNA, 19 nt, Homo sapiens
augaagagcuacugucuga

SEQ ID NO: 469400 - RNA, 19 nt, Homo sapiens
gauacaaggcuccauuuca

SEQ ID NO: 469401 - RNA, 19 nt, Homo sapiens
cccagaauaugaagagaaa

SEQ ID NO: 469402 - RNA, 19 nt, Homo sapiens
aaagaacuauacugaggaa

SEQ ID NO: 469403 - RNA, 19 nt, Homo sapiens
gcaaugaauuacaggacau

SEQ ID NO: 469404 - RNA, 19 nt, Homo sapiens
cgaaaguguuguaaucauc

SEQ ID NO: 469405 - RNA, 19 nt, Homo sapiens
agaauaaccugcaugaacu

SEQ ID NO: 469406 - RNA, 19 nt, Homo sapiens
acuaaccgcuugcuccuaa

SEQ ID NO: 469407 - RNA, 19 nt, Homo sapiens
gcuggagacuaccgccaua

SEQ ID NO: 469408 - RNA, 19 nt, Homo sapiens
ugagagcucuggaaagaag

SEQ ID NO: 469409 - RNA, 19 nt, Homo sapiens
agauuugacugguuuauca

SEQ ID NO: 469410 - RNA, 19 nt, Homo sapiens
gagaagggcgagaagaaga

SEQ ID NO: 469411 - RNA, 19 nt, Homo sapiens
gaaaccaguacguguauuc

SEQ ID NO: 469412 - RNA, 19 nt, Homo sapiens
gcaaauucaucuuuaugcu

SEQ ID NO: 469413 - RNA, 19 nt, Homo sapiens
caucuccacugaacaugaa

SEQ ID NO: 469414 - RNA, 19 nt, Homo sapiens
aauaaagggugaggaaaga

SEQ ID NO: 469415 - RNA, 19 nt, Homo sapiens
gaaauugaggaaagagaga

SEQ ID NO: 469416 - RNA, 19 nt, Homo sapiens
guuuagauuugacugguuu

SEQ ID NO: 469417 - RNA, 19 nt, Homo sapiens
caagauacaaggcuccauu

SEQ ID NO: 469418 - RNA, 19 nt, Homo sapiens
ucacacaggguuucacaaa

SEQ ID NO: 469419 - RNA, 19 nt, Homo sapiens
ggauaaauuccuagaagug

SEQ ID NO: 469420 - RNA, 19 nt, Homo sapiens
gaugaagcucacagaauaa

SEQ ID NO: 469421 - RNA, 19 nt, Homo sapiens
acugagagcucuggaaaga

SEQ ID NO: 469422 - RNA, 19 nt, Homo sapiens
auacaaggcuccauuucau

SEQ ID NO: 469423 - RNA, 19 nt, Homo sapiens
ggaagagaugacauugaua

SEQ ID NO: 469424 - RNA, 19 nt, Homo sapiens
aaacuggacuaaacgagau

SEQ ID NO: 469425 - RNA, 19 nt, Homo sapiens
gaagaaauguggauaaaga

SEQ ID NO: 469426 - RNA, 19 nt, Homo sapiens
ggacuuaaaugaagaagaa

SEQ ID NO: 469427 - RNA, 19 nt, Homo sapiens
ggaaagaauuaccagaaua

SEQ ID NO: 469428 - RNA, 19 nt, Homo sapiens
gaaaggaggugcuaagaca

SEQ ID NO: 469429 - RNA, 19 nt, Homo sapiens
gcacuucgguuacucaauu

SEQ ID NO: 469430 - RNA, 19 nt, Homo sapiens
ccgcauagcucauaggaua

SEQ ID NO: 469431 - RNA, 19 nt, Homo sapiens
gcacuggguuguuucuaua

SEQ ID NO: 469432 - RNA, 19 nt, Homo sapiens
gaaacagucugcccuccua

SEQ ID NO: 469433 - RNA, 19 nt, Homo sapiens
ggaaaugaauccugguuau

SEQ ID NO: 469434 - RNA, 19 nt, Homo sapiens
gaagaaggcugaggagaau

SEQ ID NO: 469435 - RNA, 19 nt, Homo sapiens
ggaugacgcugaaguagaa

SEQ ID NO: 469436 - RNA, 19 nt, Homo sapiens
caaauucaauguccucuug

SEQ ID NO: 469437 - RNA, 19 nt, Homo sapiens
ccauugcacucaucacuua

SEQ ID NO: 469438 - RNA, 19 nt, Homo sapiens
caacuugaacggaaucuua

SEQ ID NO: 469439 - RNA, 19 nt, Homo sapiens
caaaugggccucaaagauu

SEQ ID NO: 469440 - RNA, 19 nt, Homo sapiens
gaacguggaucagaaagug

SEQ ID NO: 469441 - RNA, 19 nt, Homo sapiens
acacacacauacacaaaua

SEQ ID NO: 469442 - RNA, 19 nt, Homo sapiens
caaagcagaugaacgcuau

SEQ ID NO: 469443 - RNA, 19 nt, Homo sapiens
uaaggagacugaagaaaga

SEQ ID NO: 469444 - RNA, 19 nt, Homo sapiens
ggaagaggaugaggaagaa

SEQ ID NO: 469445 - RNA, 19 nt, Homo sapiens
gcaggaaaccgaagagaaa

SEQ ID NO: 469446 - RNA, 19 nt, Homo sapiens
gagaaacugucaccaaauc

SEQ ID NO: 469447 - RNA, 19 nt, Homo sapiens
gaaaauauguggguggaua

SEQ ID NO: 469448 - RNA, 19 nt, Homo sapiens
gaagaggaaguacggcuua

SEQ ID NO: 469449 - RNA, 19 nt, Homo sapiens
gugaaaggguggacuuaaa

SEQ ID NO: 469450 - RNA, 19 nt, Homo sapiens
gaugagagcagccagauga

SEQ ID NO: 469451 - RNA, 19 nt, Homo sapiens
ccaaagcaguggcaacuug

SEQ ID NO: 469452 - RNA, 19 nt, Homo sapiens
caacacagccaagguuaua

SEQ ID NO: 469453 - RNA, 19 nt, Homo sapiens
ccaagugucucccauccua

SEQ ID NO: 469454 - RNA, 19 nt, Homo sapiens
ggugauaaauguacaguag

SEQ ID NO: 469455 - RNA, 19 nt, Homo sapiens
gaagugggacggaugauga

SEQ ID NO: 469456 - RNA, 19 nt, Homo sapiens
ggaaauagaaggaaacagu

SEQ ID NO: 469457 - RNA, 19 nt, Homo sapiens
ggaaauggaagaggaagua

SEQ ID NO: 469458 - RNA, 19 nt, Homo sapiens
gcagaccgaugaguaugua

SEQ ID NO: 469459 - RNA, 19 nt, Homo sapiens
gcacucaucacuuaucuga

SEQ ID NO: 469460 - RNA, 19 nt, Homo sapiens
gaagagagugauucugauu

SEQ ID NO: 469461 - RNA, 19 nt, Homo sapiens
ggaugaacgugaacaguca

SEQ ID NO: 469462 - RNA, 19 nt, Homo sapiens
ggaagaggaagaugaagaa

SEQ ID NO: 469463 - RNA, 19 nt, Homo sapiens
gagaaggugcccaguaauu

SEQ ID NO: 469464 - RNA, 19 nt, Homo sapiens
gagcugcccuccuggauca

SEQ ID NO: 469465 - RNA, 19 nt, Homo sapiens
ggacgaaggccaccgaaug

SEQ ID NO: 469466 - RNA, 19 nt, Homo sapiens
ccaaauagcgaagaaguuu

SEQ ID NO: 469467 - RNA, 19 nt, Homo sapiens
gaaauagaaggaaacaguu

SEQ ID NO: 469468 - RNA, 19 nt, Homo sapiens
uggagaaggugcccaguaa

SEQ ID NO: 469469 - RNA, 19 nt, Homo sapiens
ccagugaguucauuuguca

SEQ ID NO: 469470 - RNA, 19 nt, Homo sapiens
ggccugggcuuaaaucuuc

SEQ ID NO: 469471 - RNA, 19 nt, Homo sapiens
gcaaagauucgguggaaau

SEQ ID NO: 469472 - RNA, 19 nt, Homo sapiens
uguauuggauggcuucuuu

SEQ ID NO: 469473 - RNA, 19 nt, Homo sapiens
guggguggauaguauauuu

SEQ ID NO: 469474 - RNA, 19 nt, Homo sapiens
ggaagagagugaggaugaa

SEQ ID NO: 469475 - RNA, 19 nt, Homo sapiens
uaaaggaaaggauucguaa

SEQ ID NO: 469476 - RNA, 19 nt, Homo sapiens
gaaagaauuaccagaauac

SEQ ID NO: 469477 - RNA, 19 nt, Homo sapiens
gaagaaagaaguugaaucc

SEQ ID NO: 469478 - RNA, 19 nt, Homo sapiens
agaauaagcucccugaacu

SEQ ID NO: 469479 - RNA, 19 nt, Homo sapiens
aaagagagcagaagaagga

SEQ ID NO: 469480 - RNA, 19 nt, Homo sapiens
cagccaagguuauauguca

SEQ ID NO: 469481 - RNA, 19 nt, Homo sapiens
caaccacccauauauguuu

SEQ ID NO: 469482 - RNA, 19 nt, Homo sapiens
aaucuuagccgaugaaaug

SEQ ID NO: 469483 - RNA, 19 nt, Homo sapiens
gaggaaacgccgucagaaa

SEQ ID NO: 469484 - RNA, 19 nt, Homo sapiens
ccaguaauuucgaagaaug

SEQ ID NO: 469485 - RNA, 19 nt, Homo sapiens
ggaggaagaggaagaugaa

SEQ ID NO: 469486 - RNA, 19 nt, Homo sapiens
ugaggaagaagaugaagua

SEQ ID NO: 469487 - RNA, 19 nt, Homo sapiens
caccuaggcuauucaaaug

SEQ ID NO: 469488 - RNA, 19 nt, Homo sapiens
uggaauaugugaucaagug

SEQ ID NO: 469489 - RNA, 19 nt, Homo sapiens
ggaccccgcugcagaauaa

SEQ ID NO: 469490 - RNA, 19 nt, Homo sapiens
gaaagaccauacagaccau

SEQ ID NO: 469491 - RNA, 19 nt, Homo sapiens
gcacugauaaccaggagaa

SEQ ID NO: 469492 - RNA, 19 nt, Homo sapiens
caucaucgucuauaaacua

SEQ ID NO: 469493 - RNA, 19 nt, Homo sapiens
gcaaugaagaggaggaaga

SEQ ID NO: 469494 - RNA, 19 nt, Homo sapiens
ggaagccaguggauuucaa

SEQ ID NO: 469495 - RNA, 19 nt, Homo sapiens
ugacaucucucaugaccau

SEQ ID NO: 469496 - RNA, 19 nt, Homo sapiens
ggacauaugaauuugacaa

SEQ ID NO: 469497 - RNA, 19 nt, Homo sapiens
gagagaaugcggcgacuga

SEQ ID NO: 469498 - RNA, 19 nt, Homo sapiens
ccgagaagcuggagaagca

SEQ ID NO: 469499 - RNA, 19 nt, Homo sapiens
ggagcaggaugaacgugaa

SEQ ID NO: 469500 - RNA, 19 nt, Homo sapiens
ccaaagaggaagagaguga

SEQ ID NO: 469501 - RNA, 19 nt, Homo sapiens
gcacacuccucgcgagcaa

SEQ ID NO: 469502 - RNA, 19 nt, Homo sapiens
cugcuuugcugaagaaauu

SEQ ID NO: 469503 - RNA, 19 nt, Homo sapiens
ugguuucccuguauaauaa

SEQ ID NO: 469504 - RNA, 19 nt, Homo sapiens
gugaagagagugauucuga

SEQ ID NO: 469505 - RNA, 19 nt, Homo sapiens
uauaggcacuggguuguuu

SEQ ID NO: 469506 - RNA, 19 nt, Homo sapiens
cugagaaacugucaccaaa

SEQ ID NO: 469507 - RNA, 19 nt, Homo sapiens
caucgaagacggcaauuug

SEQ ID NO: 469508 - RNA, 19 nt, Homo sapiens
agucugcccuccuaauuaa

SEQ ID NO: 469509 - RNA, 19 nt, Homo sapiens
gaaaugaauccugguuaug

SEQ ID NO: 469510 - RNA, 19 nt, Homo sapiens
caaagcaaccguggaacua

SEQ ID NO: 469511 - RNA, 19 nt, Homo sapiens
gaucaacacagccaagguu

SEQ ID NO: 469512 - RNA, 19 nt, Homo sapiens
guuggugcuuuccuaauaa

SEQ ID NO: 469513 - RNA, 19 nt, Homo sapiens
gauuucaccugcauauaca

SEQ ID NO: 469514 - RNA, 19 nt, Homo sapiens
gaaaggguggacuuaaaug

SEQ ID NO: 469515 - RNA, 19 nt, Homo sapiens
gaaggccaccgaaugaaga

SEQ ID NO: 469516 - RNA, 19 nt, Homo sapiens
caaagauucgguggaaaua

SEQ ID NO: 469517 - RNA, 19 nt, Homo sapiens
agacguggaugaugaauac

SEQ ID NO: 469518 - RNA, 19 nt, Homo sapiens
agagagugauucugauuau

SEQ ID NO: 469519 - RNA, 19 nt, Homo sapiens
uguuggugcuuuccuaaua

SEQ ID NO: 469520 - RNA, 19 nt, Homo sapiens
ccaaaugggccucaaagau

SEQ ID NO: 469521 - RNA, 19 nt, Homo sapiens
ucgauacugugauaaacua

SEQ ID NO: 469522 - RNA, 19 nt, Homo sapiens
auacaguggucaucuuuga

SEQ ID NO: 469523 - RNA, 19 nt, Homo sapiens
gacgaaggccaccgaauga

SEQ ID NO: 469524 - RNA, 19 nt, Homo sapiens
gaauccugguuaugaaguu

SEQ ID NO: 469525 - RNA, 19 nt, Homo sapiens
gaagaaauguggauaaaga

SEQ ID NO: 469526 - RNA, 19 nt, Homo sapiens
ggacuuaaaugaagaagaa

SEQ ID NO: 469527 - RNA, 19 nt, Homo sapiens
ggaaagaauuaccagaaua

SEQ ID NO: 469528 - RNA, 19 nt, Homo sapiens
gaaaggaggugcuaagaca

SEQ ID NO: 469529 - RNA, 19 nt, Homo sapiens
gcacuucgguuacucaauu

SEQ ID NO: 469530 - RNA, 19 nt, Homo sapiens
ccgcauagcucauaggaua

SEQ ID NO: 469531 - RNA, 19 nt, Homo sapiens
gcacuggguuguuucuaua

SEQ ID NO: 469532 - RNA, 19 nt, Homo sapiens
gaaacagucugcccuccua

SEQ ID NO: 469533 - RNA, 19 nt, Homo sapiens
ggaaaugaauccugguuau

SEQ ID NO: 469534 - RNA, 19 nt, Homo sapiens
gaagaaggcugaggagaau

SEQ ID NO: 469535 - RNA, 19 nt, Homo sapiens
ggaugacgcugaaguagaa

SEQ ID NO: 469536 - RNA, 19 nt, Homo sapiens
caaauucaauguccucuug

SEQ ID NO: 469537 - RNA, 19 nt, Homo sapiens
ccauugcacucaucacuua

SEQ ID NO: 469538 - RNA, 19 nt, Homo sapiens
caacuugaacggaaucuua

SEQ ID NO: 469539 - RNA, 19 nt, Homo sapiens
caaaugggccucaaagauu

SEQ ID NO: 469540 - RNA, 19 nt, Homo sapiens
gaacguggaucagaaagug

SEQ ID NO: 469541 - RNA, 19 nt, Homo sapiens
acacacacauacacaaaua

SEQ ID NO: 469542 - RNA, 19 nt, Homo sapiens
caaagcagaugaacgcuau

SEQ ID NO: 469543 - RNA, 19 nt, Homo sapiens
uaaggagacugaagaaaga

SEQ ID NO: 469544 - RNA, 19 nt, Homo sapiens
ggaagaggaugaggaagaa

SEQ ID NO: 469545 - RNA, 19 nt, Homo sapiens
gcaggaaaccgaagagaaa

SEQ ID NO: 469546 - RNA, 19 nt, Homo sapiens
gagaaacugucaccaaauc

SEQ ID NO: 469547 - RNA, 19 nt, Homo sapiens
gaaaauauguggguggaua

SEQ ID NO: 469548 - RNA, 19 nt, Homo sapiens
gaagaggaaguacggcuua

SEQ ID NO: 469549 - RNA, 19 nt, Homo sapiens
gugaaaggguggacuuaaa

SEQ ID NO: 469550 - RNA, 19 nt, Homo sapiens
gaugagagcagccagauga

SEQ ID NO: 469551 - RNA, 19 nt, Homo sapiens
ccaaagcaguggcaacuug

SEQ ID NO: 469552 - RNA, 19 nt, Homo sapiens
caacacagccaagguuaua

SEQ ID NO: 469553 - RNA, 19 nt, Homo sapiens
ccaagugucucccauccua

SEQ ID NO: 469554 - RNA, 19 nt, Homo sapiens
ggugauaaauguacaguag

SEQ ID NO: 469555 - RNA, 19 nt, Homo sapiens
gaagugggacggaugauga

SEQ ID NO: 469556 - RNA, 19 nt, Homo sapiens
ggaaauggaagaggaagua

SEQ ID NO: 469557 - RNA, 19 nt, Homo sapiens
gcagaccgaugaguaugua

SEQ ID NO: 469558 - RNA, 19 nt, Homo sapiens
gcacucaucacuuaucuga

SEQ ID NO: 469559 - RNA, 19 nt, Homo sapiens
gaagagagugauucugauu

SEQ ID NO: 469560 - RNA, 19 nt, Homo sapiens
ggaugaacgugaacaguca

SEQ ID NO: 469561 - RNA, 19 nt, Homo sapiens
ggaagaggaagaugaagaa

SEQ ID NO: 469562 - RNA, 19 nt, Homo sapiens
gagcugcccuccuggauca

SEQ ID NO: 469563 - RNA, 19 nt, Homo sapiens
ggacgaaggccaccgaaug

SEQ ID NO: 469564 - RNA, 19 nt, Homo sapiens
ccaaauagcgaagaaguuu

SEQ ID NO: 469565 - RNA, 19 nt, Homo sapiens
ccagugaguucauuuguca

SEQ ID NO: 469566 - RNA, 19 nt, Homo sapiens
ggccugggcuuaaaucuuc

SEQ ID NO: 469567 - RNA, 19 nt, Homo sapiens
gcaaagauucgguggaaau

SEQ ID NO: 469568 - RNA, 19 nt, Homo sapiens
uguauuggauggcuucuuu

SEQ ID NO: 469569 - RNA, 19 nt, Homo sapiens
guggguggauaguauauuu

SEQ ID NO: 469570 - RNA, 19 nt, Homo sapiens
ggaagagagugaggaugaa

SEQ ID NO: 469571 - RNA, 19 nt, Homo sapiens
uaaaggaaaggauucguaa

SEQ ID NO: 469572 - RNA, 19 nt, Homo sapiens
gaaagaauuaccagaauac

SEQ ID NO: 469573 - RNA, 19 nt, Homo sapiens
gaagaaagaaguugaaucc

SEQ ID NO: 469574 - RNA, 19 nt, Homo sapiens
agaauaagcucccugaacu

SEQ ID NO: 469575 - RNA, 19 nt, Homo sapiens
aaagagagcagaagaagga

SEQ ID NO: 469576 - RNA, 19 nt, Homo sapiens
cagccaagguuauauguca

SEQ ID NO: 469577 - RNA, 19 nt, Homo sapiens
caaccacccauauauguuu

SEQ ID NO: 469578 - RNA, 19 nt, Homo sapiens
aaucuuagccgaugaaaug

SEQ ID NO: 469579 - RNA, 19 nt, Homo sapiens
gaggaaacgccgucagaaa

SEQ ID NO: 469580 - RNA, 19 nt, Homo sapiens
ccaguaauuucgaagaaug

SEQ ID NO: 469581 - RNA, 19 nt, Homo sapiens
ggaggaagaggaagaugaa

SEQ ID NO: 469582 - RNA, 19 nt, Homo sapiens
ugaggaagaagaugaagua

SEQ ID NO: 469583 - RNA, 19 nt, Homo sapiens
caccuaggcuauucaaaug

SEQ ID NO: 469584 - RNA, 19 nt, Homo sapiens
uggaauaugugaucaagug

SEQ ID NO: 469585 - RNA, 19 nt, Homo sapiens
ggaccccgcugcagaauaa

SEQ ID NO: 469586 - RNA, 19 nt, Homo sapiens
gaaagaccauacagaccau

SEQ ID NO: 469587 - RNA, 19 nt, Homo sapiens
gcacugauaaccaggagaa

SEQ ID NO: 469588 - RNA, 19 nt, Homo sapiens
caucaucgucuauaaacua

SEQ ID NO: 469589 - RNA, 19 nt, Homo sapiens
gcaaugaagaggaggaaga

SEQ ID NO: 469590 - RNA, 19 nt, Homo sapiens
ggaagccaguggauuucaa

SEQ ID NO: 469591 - RNA, 19 nt, Homo sapiens
ugacaucucucaugaccau

SEQ ID NO: 469592 - RNA, 19 nt, Homo sapiens
ggacauaugaauuugacaa

SEQ ID NO: 469593 - RNA, 19 nt, Homo sapiens
gagagaaugcggcgacuga

SEQ ID NO: 469594 - RNA, 19 nt, Homo sapiens
ccgagaagcuggagaagca

SEQ ID NO: 469595 - RNA, 19 nt, Homo sapiens
ggagcaggaugaacgugaa

SEQ ID NO: 469596 - RNA, 19 nt, Homo sapiens
ccaaagaggaagagaguga

SEQ ID NO: 469597 - RNA, 19 nt, Homo sapiens
gcacacuccucgcgagcaa

SEQ ID NO: 469598 - RNA, 19 nt, Homo sapiens
cugcuuugcugaagaaauu

SEQ ID NO: 469599 - RNA, 19 nt, Homo sapiens
ugguuucccuguauaauaa

SEQ ID NO: 469600 - RNA, 19 nt, Homo sapiens
gugaagagagugauucuga

SEQ ID NO: 469601 - RNA, 19 nt, Homo sapiens
uauaggcacuggguuguuu

SEQ ID NO: 469602 - RNA, 19 nt, Homo sapiens
cugagaaacugucaccaaa

SEQ ID NO: 469603 - RNA, 19 nt, Homo sapiens
caucgaagacggcaauuug

SEQ ID NO: 469604 - RNA, 19 nt, Homo sapiens
agucugcccuccuaauuaa

SEQ ID NO: 469605 - RNA, 19 nt, Homo sapiens
gaaaugaauccugguuaug

SEQ ID NO: 469606 - RNA, 19 nt, Homo sapiens
caaagcaaccguggaacua

SEQ ID NO: 469607 - RNA, 19 nt, Homo sapiens
gaucaacacagccaagguu

SEQ ID NO: 469608 - RNA, 19 nt, Homo sapiens
guuggugcuuuccuaauaa

SEQ ID NO: 469609 - RNA, 19 nt, Homo sapiens
gauuucaccugcauauaca

SEQ ID NO: 469610 - RNA, 19 nt, Homo sapiens
gaaaggguggacuuaaaug

SEQ ID NO: 469611 - RNA, 19 nt, Homo sapiens
gaaggccaccgaaugaaga

SEQ ID NO: 469612 - RNA, 19 nt, Homo sapiens
caaagauucgguggaaaua

SEQ ID NO: 469613 - RNA, 19 nt, Homo sapiens
agacguggaugaugaauac

SEQ ID NO: 469614 - RNA, 19 nt, Homo sapiens
agagagugauucugauuau

SEQ ID NO: 469615 - RNA, 19 nt, Homo sapiens
uguuggugcuuuccuaaua

SEQ ID NO: 469616 - RNA, 19 nt, Homo sapiens
ccaaaugggccucaaagau

SEQ ID NO: 469617 - RNA, 19 nt, Homo sapiens
ucgauacugugauaaacua

SEQ ID NO: 469618 - RNA, 19 nt, Homo sapiens
auacaguggucaucuuuga

SEQ ID NO: 469619 - RNA, 19 nt, Homo sapiens
gacgaaggccaccgaauga

SEQ ID NO: 469620 - RNA, 19 nt, Homo sapiens
gaauccugguuaugaaguu

SEQ ID NO: 469621 - RNA, 19 nt, Homo sapiens
aaagaaagacaggcguuua

SEQ ID NO: 469622 - RNA, 19 nt, Homo sapiens
cgaagaaugugguguuggu

SEQ ID NO: 469623 - RNA, 19 nt, Homo sapiens
gcucuaugaucugaacaaa

SEQ ID NO: 469624 - RNA, 19 nt, Homo sapiens
guacaguaguuagauuuca

SEQ ID NO: 469625 - RNA, 19 nt, Homo sapiens
gcaaagaacuuccaccauu

SEQ ID NO: 469626 - RNA, 19 nt, Homo sapiens
uaaaggagauaguccauua

SEQ ID NO: 469627 - RNA, 19 nt, Homo sapiens
guacuacacucauuguuua

SEQ ID NO: 469628 - RNA, 19 nt, Homo sapiens
gaggacagcuugcuucuuu

SEQ ID NO: 469629 - RNA, 19 nt, Homo sapiens
gaaaugagaucuagagaac

SEQ ID NO: 469630 - RNA, 19 nt, Homo sapiens
gaacaacacugaucaucug

SEQ ID NO: 469631 - RNA, 19 nt, Homo sapiens
ggagauaguccauuacaua

SEQ ID NO: 469632 - RNA, 19 nt, Homo sapiens
ccagaugacuuucuaacua

SEQ ID NO: 469633 - RNA, 19 nt, Homo sapiens
gaagguauaugccaaaucu

SEQ ID NO: 469634 - RNA, 19 nt, Homo sapiens
gaagcaggaucuccaacua

SEQ ID NO: 469635 - RNA, 19 nt, Homo sapiens
gcagaccucuuccuauuga

SEQ ID NO: 469636 - RNA, 19 nt, Homo sapiens
ggaagucauuugauagaaa

SEQ ID NO: 469637 - RNA, 19 nt, Homo sapiens
aaagaagaaucccaacaua

SEQ ID NO: 469638 - RNA, 19 nt, Homo sapiens
ccugguagaucaagcauua

SEQ ID NO: 469639 - RNA, 19 nt, Homo sapiens
caauuugccuggauucuuu

SEQ ID NO: 469640 - RNA, 19 nt, Homo sapiens
caacauuccugucuuuaau

SEQ ID NO: 469641 - RNA, 19 nt, Homo sapiens
gauagagaaugguggcaua

SEQ ID NO: 469642 - RNA, 19 nt, Homo sapiens
caagagaagcuucauguuu

SEQ ID NO: 469643 - RNA, 19 nt, Homo sapiens
gaagaucagugcuuugaca

SEQ ID NO: 469644 - RNA, 19 nt, Homo sapiens
ggaugauaguggaauaaua

SEQ ID NO: 469645 - RNA, 19 nt, Homo sapiens
gaaccggccuuacuuucaa

SEQ ID NO: 469646 - RNA, 19 nt, Homo sapiens
gaugaggaaugugcaauuu

SEQ ID NO: 469647 - RNA, 19 nt, Homo sapiens
caaagggaacagugaauua

SEQ ID NO: 469648 - RNA, 19 nt, Homo sapiens
ggaccaagcuauaguaugc

SEQ ID NO: 469649 - RNA, 19 nt, Homo sapiens
gcagaaaugauauacauga

SEQ ID NO: 469650 - RNA, 19 nt, Homo sapiens
gaucaagcauuacacacaa

SEQ ID NO: 469651 - RNA, 19 nt, Homo sapiens
aagagaagcuucauguuug

SEQ ID NO: 469652 - RNA, 19 nt, Homo sapiens
gcaagaaguuaucaucaca

SEQ ID NO: 469653 - RNA, 19 nt, Homo sapiens
ggaaguacuugcagacugu

SEQ ID NO: 469654 - RNA, 19 nt, Homo sapiens
caaagaacuuccaccauuc

SEQ ID NO: 469655 - RNA, 19 nt, Homo sapiens
gaugacaacugaacagcuu

SEQ ID NO: 469656 - RNA, 19 nt, Homo sapiens
gcaggagccuuuggaacua

SEQ ID NO: 469657 - RNA, 19 nt, Homo sapiens
aaaggacucuguugaagaa

SEQ ID NO: 469658 - RNA, 19 nt, Homo sapiens
gaaaugauacaccugaaga

SEQ ID NO: 469659 - RNA, 19 nt, Homo sapiens
gaaagaagauggguuuuga

SEQ ID NO: 469660 - RNA, 19 nt, Homo sapiens
uauagaagauguggcauuu

SEQ ID NO: 469661 - RNA, 19 nt, Homo sapiens
gaaagaagaaucccaacau

SEQ ID NO: 469662 - RNA, 19 nt, Homo sapiens
gagaaggaccgaccagaaa

SEQ ID NO: 469663 - RNA, 19 nt, Homo sapiens
gacauuguauuaccacuug

SEQ ID NO: 469664 - RNA, 19 nt, Homo sapiens
gcuaugcuguugucuuauu

SEQ ID NO: 469665 - RNA, 19 nt, Homo sapiens
aagaauaccugagacuuaa

SEQ ID NO: 469666 - RNA, 19 nt, Homo sapiens
agaaguagauuccguuuua

SEQ ID NO: 469667 - RNA, 19 nt, Homo sapiens
uuacaaagacaaagccuua

SEQ ID NO: 469668 - RNA, 19 nt, Homo sapiens
cuuauuugcugcagaauuu

SEQ ID NO: 469669 - RNA, 19 nt, Homo sapiens
ucacguaucuuccaaguac

SEQ ID NO: 469670 - RNA, 19 nt, Homo sapiens
ggaguugguuugaaucugu

SEQ ID NO: 469671 - RNA, 19 nt, Homo sapiens
gaaggcagagccacuauug

SEQ ID NO: 469672 - RNA, 19 nt, Homo sapiens
gcaggaucuucuaagguua

SEQ ID NO: 469673 - RNA, 19 nt, Homo sapiens
ggaaccagcugaggcuauu

SEQ ID NO: 469674 - RNA, 19 nt, Homo sapiens
ggaauaauaaugugggauu

SEQ ID NO: 469675 - RNA, 19 nt, Homo sapiens
aaacuuauuugcugcagaa

SEQ ID NO: 469676 - RNA, 19 nt, Homo sapiens
ucagaagacuacuauaugu

SEQ ID NO: 469677 - RNA, 19 nt, Homo sapiens
gaagucauuugauagaaag

SEQ ID NO: 469678 - RNA, 19 nt, Homo sapiens
caaaugcagugucuuccaa

SEQ ID NO: 469679 - RNA, 19 nt, Homo sapiens
gaagagagaaagauuuauc

SEQ ID NO: 469680 - RNA, 19 nt, Homo sapiens
ggacuuaggcguuuacagu

SEQ ID NO: 469681 - RNA, 19 nt, Homo sapiens
ggacaugccauacgaaauc

SEQ ID NO: 469682 - RNA, 19 nt, Homo sapiens
gaggagagaccaagaacaa

SEQ ID NO: 469683 - RNA, 19 nt, Homo sapiens
uaaguaaguuuggcaaguu

SEQ ID NO: 469684 - RNA, 19 nt, Homo sapiens
gcccagacauuuacaaagu

SEQ ID NO: 469685 - RNA, 19 nt, Homo sapiens
agucuacucuuucugcuua

SEQ ID NO: 469686 - RNA, 19 nt, Homo sapiens
caagagggauccaguuugg

SEQ ID NO: 469687 - RNA, 19 nt, Homo sapiens
acagcuacauugagauaua

SEQ ID NO: 469688 - RNA, 19 nt, Homo sapiens
agaagaaucccaacauaaa

SEQ ID NO: 469689 - RNA, 19 nt, Homo sapiens
caaauuuguugccauacuu

SEQ ID NO: 469690 - RNA, 19 nt, Homo sapiens
gcauuaacuucaucuguuc

SEQ ID NO: 469691 - RNA, 19 nt, Homo sapiens
caaguuggccauuuaaaga

SEQ ID NO: 469692 - RNA, 19 nt, Homo sapiens
gacaaagccuuacaaacuc

SEQ ID NO: 469693 - RNA, 19 nt, Homo sapiens
guaaggaaagggcugauuu

SEQ ID NO: 469694 - RNA, 19 nt, Homo sapiens
gggauuauguuaagaguac

SEQ ID NO: 469695 - RNA, 19 nt, Homo sapiens
gauuugugaugcaguguuu

SEQ ID NO: 469696 - RNA, 19 nt, Homo sapiens
guuggacacuuaguuauuu

SEQ ID NO: 469697 - RNA, 19 nt, Homo sapiens
ggauuuguguuuacucguu

SEQ ID NO: 469698 - RNA, 19 nt, Homo sapiens
uuacaacauuccugucuuu

SEQ ID NO: 469699 - RNA, 19 nt, Homo sapiens
gcagauguccugggucuuu

SEQ ID NO: 469700 - RNA, 19 nt, Homo sapiens
guacuccaauccagaauuc

SEQ ID NO: 469701 - RNA, 19 nt, Homo sapiens
gauaguccauuacauagca

SEQ ID NO: 469702 - RNA, 19 nt, Homo sapiens
aaacuuggaggaaacaaua

SEQ ID NO: 469703 - RNA, 19 nt, Homo sapiens
uggcagaccucuuccuauu

SEQ ID NO: 469704 - RNA, 19 nt, Homo sapiens
acacgggaguaguuaauaa

SEQ ID NO: 469705 - RNA, 19 nt, Homo sapiens
caaacucacuaugaaggua

SEQ ID NO: 469706 - RNA, 19 nt, Homo sapiens
gggcacacauugaagguau

SEQ ID NO: 469707 - RNA, 19 nt, Homo sapiens
guaaaggacucuguugaag

SEQ ID NO: 469708 - RNA, 19 nt, Homo sapiens
caagugaauugccgcagaa

SEQ ID NO: 469709 - RNA, 19 nt, Homo sapiens
gacaacaaauuggcacaaa

SEQ ID NO: 469710 - RNA, 19 nt, Homo sapiens
gaaucuuccuggucccuuu

SEQ ID NO: 469711 - RNA, 19 nt, Homo sapiens
aaagucguuucaacucuua

SEQ ID NO: 469712 - RNA, 19 nt, Homo sapiens
gagaaagauuuaucagucu

SEQ ID NO: 469713 - RNA, 19 nt, Homo sapiens
caaagucguuucaacucuu

SEQ ID NO: 469714 - RNA, 19 nt, Homo sapiens
gaucagugcuuugacagau

SEQ ID NO: 469715 - RNA, 19 nt, Homo sapiens
cguuuacagucccuaauua

SEQ ID NO: 469716 - RNA, 19 nt, Homo sapiens
caacuuucuuuccacguuu

SEQ ID NO: 469717 - RNA, 19 nt, Homo sapiens
ugacuuagaaucagaaaga

SEQ ID NO: 469718 - RNA, 19 nt, Homo sapiens
agacaaagccuuacaaacu

SEQ ID NO: 469719 - RNA, 19 nt, Homo sapiens
ggucagaagcaagaaguua

SEQ ID NO: 469720 - RNA, 19 nt, Homo sapiens
gauguuaucccuccagaug

SEQ ID NO: 469721 - RNA, 19 nt, Homo sapiens
cugaagaacugagaaagaa

SEQ ID NO: 469722 - RNA, 19 nt, Homo sapiens
gaugaagagagaaagauuu

SEQ ID NO: 469723 - RNA, 19 nt, Homo sapiens
ggaugaaggacaugccaua

SEQ ID NO: 469724 - RNA, 19 nt, Homo sapiens
ggaaacaauaccagugaaa

SEQ ID NO: 469725 - RNA, 19 nt, Homo sapiens
gcaaagaacuuccaccauu

SEQ ID NO: 469726 - RNA, 19 nt, Homo sapiens
uaaaggagauaguccauua

SEQ ID NO: 469727 - RNA, 19 nt, Homo sapiens
gaggacagcuugcuucuuu

SEQ ID NO: 469728 - RNA, 19 nt, Homo sapiens
gaacaacacugaucaucug

SEQ ID NO: 469729 - RNA, 19 nt, Homo sapiens
ggagauaguccauuacaua

SEQ ID NO: 469730 - RNA, 19 nt, Homo sapiens
ccagaugacuuucuaacua

SEQ ID NO: 469731 - RNA, 19 nt, Homo sapiens
gaagguauaugccaaaucu

SEQ ID NO: 469732 - RNA, 19 nt, Homo sapiens
gaagcaggaucuccaacua

SEQ ID NO: 469733 - RNA, 19 nt, Homo sapiens
gcagaccucuuccuauuga

SEQ ID NO: 469734 - RNA, 19 nt, Homo sapiens
ggaagucauuugauagaaa

SEQ ID NO: 469735 - RNA, 19 nt, Homo sapiens
aaagaagaaucccaacaua

SEQ ID NO: 469736 - RNA, 19 nt, Homo sapiens
ccugguagaucaagcauua

SEQ ID NO: 469737 - RNA, 19 nt, Homo sapiens
caauuugccuggauucuuu

SEQ ID NO: 469738 - RNA, 19 nt, Homo sapiens
caacauuccugucuuuaau

SEQ ID NO: 469739 - RNA, 19 nt, Homo sapiens
gauagagaaugguggcaua

SEQ ID NO: 469740 - RNA, 19 nt, Homo sapiens
caagagaagcuucauguuu

SEQ ID NO: 469741 - RNA, 19 nt, Homo sapiens
gaagaucagugcuuugaca

SEQ ID NO: 469742 - RNA, 19 nt, Homo sapiens
ggaugauaguggaauaaua

SEQ ID NO: 469743 - RNA, 19 nt, Homo sapiens
gaaccggccuuacuuucaa

SEQ ID NO: 469744 - RNA, 19 nt, Homo sapiens
gaugaggaaugugcaauuu

SEQ ID NO: 469745 - RNA, 19 nt, Homo sapiens
caaagggaacagugaauua

SEQ ID NO: 469746 - RNA, 19 nt, Homo sapiens
ggaccaagcuauaguaugc

SEQ ID NO: 469747 - RNA, 19 nt, Homo sapiens
gcagaaaugauauacauga

SEQ ID NO: 469748 - RNA, 19 nt, Homo sapiens
gaucaagcauuacacacaa

SEQ ID NO: 469749 - RNA, 19 nt, Homo sapiens
aagagaagcuucauguuug

SEQ ID NO: 469750 - RNA, 19 nt, Homo sapiens
gcaagaaguuaucaucaca

SEQ ID NO: 469751 - RNA, 19 nt, Homo sapiens
ggaaguacuugcagacugu

SEQ ID NO: 469752 - RNA, 19 nt, Homo sapiens
guaagaagacuacuauaug

SEQ ID NO: 469753 - RNA, 19 nt, Homo sapiens
caaagaacuuccaccauuc

SEQ ID NO: 469754 - RNA, 19 nt, Homo sapiens
gaugacaacugaacagcuu

SEQ ID NO: 469755 - RNA, 19 nt, Homo sapiens
gcaggagccuuuggaacua

SEQ ID NO: 469756 - RNA, 19 nt, Homo sapiens
aaaggacucuguugaagaa

SEQ ID NO: 469757 - RNA, 19 nt, Homo sapiens
gaaaugauacaccugaaga

SEQ ID NO: 469758 - RNA, 19 nt, Homo sapiens
gaaagaagauggguuuuga

SEQ ID NO: 469759 - RNA, 19 nt, Homo sapiens
uauagaagauguggcauuu

SEQ ID NO: 469760 - RNA, 19 nt, Homo sapiens
gaaagaagaaucccaacau

SEQ ID NO: 469761 - RNA, 19 nt, Homo sapiens
gagaaggaccgaccagaaa

SEQ ID NO: 469762 - RNA, 19 nt, Homo sapiens
gacauuguauuaccacuug

SEQ ID NO: 469763 - RNA, 19 nt, Homo sapiens
gcuaugcuguugucuuauu

SEQ ID NO: 469764 - RNA, 19 nt, Homo sapiens
aagaauaccugagacuuaa

SEQ ID NO: 469765 - RNA, 19 nt, Homo sapiens
agaaguagauuccguuuua

SEQ ID NO: 469766 - RNA, 19 nt, Homo sapiens
uuacaaagacaaagccuua

SEQ ID NO: 469767 - RNA, 19 nt, Homo sapiens
cuuauuugcugcagaauuu

SEQ ID NO: 469768 - RNA, 19 nt, Homo sapiens
ggaguugguuugaaucugu

SEQ ID NO: 469769 - RNA, 19 nt, Homo sapiens
gaaggcagagccacuauug

SEQ ID NO: 469770 - RNA, 19 nt, Homo sapiens
gcaggaucuucuaagguua

SEQ ID NO: 469771 - RNA, 19 nt, Homo sapiens
ggaaccagcugaggcuauu

SEQ ID NO: 469772 - RNA, 19 nt, Homo sapiens
ggaauaauaaugugggauu

SEQ ID NO: 469773 - RNA, 19 nt, Homo sapiens
aaacuuauuugcugcagaa

SEQ ID NO: 469774 - RNA, 19 nt, Homo sapiens
gaagucauuugauagaaag

SEQ ID NO: 469775 - RNA, 19 nt, Homo sapiens
caaaugcagugucuuccaa

SEQ ID NO: 469776 - RNA, 19 nt, Homo sapiens
gaagagagaaagauuuauc

SEQ ID NO: 469777 - RNA, 19 nt, Homo sapiens
ggacuuaggcguuuacagu

SEQ ID NO: 469778 - RNA, 19 nt, Homo sapiens
ggacaugccauacgaaauc

SEQ ID NO: 469779 - RNA, 19 nt, Homo sapiens
gaggagagaccaagaacaa

SEQ ID NO: 469780 - RNA, 19 nt, Homo sapiens
uaaguaaguuuggcaaguu

SEQ ID NO: 469781 - RNA, 19 nt, Homo sapiens
gcccagacauuuacaaagu

SEQ ID NO: 469782 - RNA, 19 nt, Homo sapiens
agucuacucuuucugcuua

SEQ ID NO: 469783 - RNA, 19 nt, Homo sapiens
caagagggauccaguuugg

SEQ ID NO: 469784 - RNA, 19 nt, Homo sapiens
agaagaaucccaacauaaa

SEQ ID NO: 469785 - RNA, 19 nt, Homo sapiens
caaauuuguugccauacuu

SEQ ID NO: 469786 - RNA, 19 nt, Homo sapiens
gcauuaacuucaucuguuc

SEQ ID NO: 469787 - RNA, 19 nt, Homo sapiens
caaguuggccauuuaaaga

SEQ ID NO: 469788 - RNA, 19 nt, Homo sapiens
gacaaagccuuacaaacuc

SEQ ID NO: 469789 - RNA, 19 nt, Homo sapiens
guaaggaaagggcugauuu

SEQ ID NO: 469790 - RNA, 19 nt, Homo sapiens
ggauuuguguuuacucguu

SEQ ID NO: 469791 - RNA, 19 nt, Homo sapiens
uuacaacauuccugucuuu

SEQ ID NO: 469792 - RNA, 19 nt, Homo sapiens
gcagauguccugggucuuu

SEQ ID NO: 469793 - RNA, 19 nt, Homo sapiens
guacuccaauccagaauuc

SEQ ID NO: 469794 - RNA, 19 nt, Homo sapiens
gauaguccauuacauagca

SEQ ID NO: 469795 - RNA, 19 nt, Homo sapiens
aaacuuggaggaaacaaua

SEQ ID NO: 469796 - RNA, 19 nt, Homo sapiens
uggcagaccucuuccuauu

SEQ ID NO: 469797 - RNA, 19 nt, Homo sapiens
acacgggaguaguuaauaa

SEQ ID NO: 469798 - RNA, 19 nt, Homo sapiens
caaacucacuaugaaggua

SEQ ID NO: 469799 - RNA, 19 nt, Homo sapiens
gggcacacauugaagguau

SEQ ID NO: 469800 - RNA, 19 nt, Homo sapiens
guaaaggacucuguugaag

SEQ ID NO: 469801 - RNA, 19 nt, Homo sapiens
caagugaauugccgcagaa

SEQ ID NO: 469802 - RNA, 19 nt, Homo sapiens
gacaacaaauuggcacaaa

SEQ ID NO: 469803 - RNA, 19 nt, Homo sapiens
gaaucuuccuggucccuuu

SEQ ID NO: 469804 - RNA, 19 nt, Homo sapiens
aaagucguuucaacucuua

SEQ ID NO: 469805 - RNA, 19 nt, Homo sapiens
gagaaagauuuaucagucu

SEQ ID NO: 469806 - RNA, 19 nt, Homo sapiens
caacuuucuuuccacguuu

SEQ ID NO: 469807 - RNA, 19 nt, Homo sapiens
caaagucguuucaacucuu

SEQ ID NO: 469808 - RNA, 19 nt, Homo sapiens
gaucagugcuuugacagau

SEQ ID NO: 469809 - RNA, 19 nt, Homo sapiens
cguuuacagucccuaauua

SEQ ID NO: 469810 - RNA, 19 nt, Homo sapiens
ugacuuagaaucagaaaga

SEQ ID NO: 469811 - RNA, 19 nt, Homo sapiens
gauguuaucccuccagaug

SEQ ID NO: 469812 - RNA, 19 nt, Homo sapiens
agacaaagccuuacaaacu

SEQ ID NO: 469813 - RNA, 19 nt, Homo sapiens
ggucagaagcaagaaguua

SEQ ID NO: 469814 - RNA, 19 nt, Homo sapiens
cugaagaacugagaaagaa

SEQ ID NO: 469815 - RNA, 19 nt, Homo sapiens
gaugaagagagaaagauuu

SEQ ID NO: 469816 - RNA, 19 nt, Homo sapiens
ggaugaaggacaugccaua

SEQ ID NO: 469817 - RNA, 19 nt, Homo sapiens
ggaaacaauaccagugaaa

SEQ ID NO: 469818 - RNA, 19 nt, Homo sapiens
cgggaguaguuaauaauaa

SEQ ID NO: 469819 - RNA, 19 nt, Homo sapiens
gaagaaguagauuccguuu

SEQ ID NO: 469820 - RNA, 19 nt, Homo sapiens
uaaagccucuggauuugug

SEQ ID NO: 469821 - RNA, 19 nt, Homo sapiens
guauggaguucauggaaau

SEQ ID NO: 469822 - RNA, 19 nt, Homo sapiens
ggagaugaaggaggacuua

SEQ ID NO: 469823 - RNA, 19 nt, Homo sapiens
gaggaaacaauaccaguga

SEQ ID NO: 469824 - RNA, 19 nt, Homo sapiens
uagcaauacuucagugaga

SEQ ID NO: 469825 - RNA, 19 nt, Homo sapiens
gaaaggagcugcccgagua

SEQ ID NO: 469826 - RNA, 19 nt, Homo sapiens
gcacaccgcugcagaacaa

SEQ ID NO: 469827 - RNA, 19 nt, Homo sapiens
ccaaggauuucaaggaaua

SEQ ID NO: 469828 - RNA, 19 nt, Homo sapiens
ccaagaagaugaagaagau

SEQ ID NO: 469829 - RNA, 19 nt, Homo sapiens
gaaaguggcucagaagaag

SEQ ID NO: 469830 - RNA, 19 nt, Homo sapiens
gaaggaggaugacagugaa

SEQ ID NO: 469831 - RNA, 19 nt, Homo sapiens
gcauaggccuuagcaguaa

SEQ ID NO: 469832 - RNA, 19 nt, Homo sapiens
agacagcccucaaugcuaa

SEQ ID NO: 469833 - RNA, 19 nt, Homo sapiens
gaucauggccuacaagaug

SEQ ID NO: 469834 - RNA, 19 nt, Homo sapiens
gcaaggagguggacuacag

SEQ ID NO: 469835 - RNA, 19 nt, Homo sapiens
gaaccaaagcgaccauuga

SEQ ID NO: 469836 - RNA, 19 nt, Homo sapiens
ggucaaugguguccucaaa

SEQ ID NO: 469837 - RNA, 19 nt, Homo sapiens
gaccagcacucccaagguu

SEQ ID NO: 469838 - RNA, 19 nt, Homo sapiens
ugaagaaaguggcucagaa

SEQ ID NO: 469839 - RNA, 19 nt, Homo sapiens
gaaggucaccgcaugaaga

SEQ ID NO: 469840 - RNA, 19 nt, Homo sapiens
uuaaauaccucaggcuuga

SEQ ID NO: 469841 - RNA, 19 nt, Homo sapiens
ggcagaagcaccaggaaua

SEQ ID NO: 469842 - RNA, 19 nt, Homo sapiens
cagcagauguaguuucaga

SEQ ID NO: 469843 - RNA, 19 nt, Homo sapiens
gcaccaagacccugaugaa

SEQ ID NO: 469844 - RNA, 19 nt, Homo sapiens
ccaaggcaguggccacgua

SEQ ID NO: 469845 - RNA, 19 nt, Homo sapiens
caucauggaagauuacuuu

SEQ ID NO: 469846 - RNA, 19 nt, Homo sapiens
caagcaagaugucgaugau

SEQ ID NO: 469847 - RNA, 19 nt, Homo sapiens
gaagauuacuuugcguauc

SEQ ID NO: 469848 - RNA, 19 nt, Homo sapiens
ggaaaccauucucaucauc

SEQ ID NO: 469849 - RNA, 19 nt, Homo sapiens
gaggaaaccauucucauca

SEQ ID NO: 469850 - RNA, 19 nt, Homo sapiens
ccaagccggucgugaguga

SEQ ID NO: 469851 - RNA, 19 nt, Homo sapiens
ggaggaguuugaucuguuc

SEQ ID NO: 469852 - RNA, 19 nt, Homo sapiens
ggacagacgccugccauug

SEQ ID NO: 469853 - RNA, 19 nt, Homo sapiens
caccaggaauaccucaaua

SEQ ID NO: 469854 - RNA, 19 nt, Homo sapiens
ccaucgcgcucaucacgua

SEQ ID NO: 469855 - RNA, 19 nt, Homo sapiens
ggcauaggccuuagcagua

SEQ ID NO: 469856 - RNA, 19 nt, Homo sapiens
agaugucgaugaugaauau

SEQ ID NO: 469857 - RNA, 19 nt, Homo sapiens
gaagaaaguggcucagaag

SEQ ID NO: 469858 - RNA, 19 nt, Homo sapiens
cagcaggccucaugguaug

SEQ ID NO: 469859 - RNA, 19 nt, Homo sapiens
gguagcagcagauguaguu

SEQ ID NO: 469860 - RNA, 19 nt, Homo sapiens
ucaacgaccuagagaagga

SEQ ID NO: 469861 - RNA, 19 nt, Homo sapiens
gaagauaaaggagcgcauu

SEQ ID NO: 469862 - RNA, 19 nt, Homo sapiens
cacccaaccucaccaagaa

SEQ ID NO: 469863 - RNA, 19 nt, Homo sapiens
gcagacacugugaucauuu

SEQ ID NO: 469864 - RNA, 19 nt, Homo sapiens
aauuugagcuucuugauag

SEQ ID NO: 469865 - RNA, 19 nt, Homo sapiens
ggaagucgaggcccaguug

SEQ ID NO: 469866 - RNA, 19 nt, Homo sapiens
ggaagaccauccagaccau

SEQ ID NO: 469867 - RNA, 19 nt, Homo sapiens
gaagaagauuccagaucca

SEQ ID NO: 469868 - RNA, 19 nt, Homo sapiens
ugauagaauucuucccaaa

SEQ ID NO: 469869 - RNA, 19 nt, Homo sapiens
gagcacaaacgcaucaaug

SEQ ID NO: 469870 - RNA, 19 nt, Homo sapiens
ucaaugguguccucaaaca

SEQ ID NO: 469871 - RNA, 19 nt, Homo sapiens
gcgacucacugacggagaa

SEQ ID NO: 469872 - RNA, 19 nt, Homo sapiens
ggaguuugaucuguucaug

SEQ ID NO: 469873 - RNA, 19 nt, Homo sapiens
guacaugauuguggacgaa

SEQ ID NO: 469874 - RNA, 19 nt, Homo sapiens
ucucaacgcuguccaacug

SEQ ID NO: 469875 - RNA, 19 nt, Homo sapiens
agauguaguuucagacuug

SEQ ID NO: 469876 - RNA, 19 nt, Homo sapiens
gaggaccgcucaggaagug

SEQ ID NO: 469877 - RNA, 19 nt, Homo sapiens
gcaagcccguggacuucaa

SEQ ID NO: 469878 - RNA, 19 nt, Homo sapiens
ggaggaaaccauucucauc

SEQ ID NO: 469879 - RNA, 19 nt, Homo sapiens
acgaguacaucaucaaaga

SEQ ID NO: 469880 - RNA, 19 nt, Homo sapiens
gcaagcucaucgaccagaa

SEQ ID NO: 469881 - RNA, 19 nt, Homo sapiens
ggcagacacugugaucauu

SEQ ID NO: 469882 - RNA, 19 nt, Homo sapiens
gacgagaccagccagauga

SEQ ID NO: 469883 - RNA, 19 nt, Homo sapiens
cugagaagcuggagaagca

SEQ ID NO: 469884 - RNA, 19 nt, Homo sapiens
ugagauggcauaggccuua

SEQ ID NO: 469885 - RNA, 19 nt, Homo sapiens
gaggaggaccgcucaggaa

SEQ ID NO: 469886 - RNA, 19 nt, Homo sapiens
gaggagguccggcagaaga

SEQ ID NO: 469887 - RNA, 19 nt, Homo sapiens
ccucguggaucaucaagga

SEQ ID NO: 469888 - RNA, 19 nt, Homo sapiens
acaaagugcugcuguucug

SEQ ID NO: 469889 - RNA, 19 nt, Homo sapiens
ggaccugaaugaggaggaa

SEQ ID NO: 469890 - RNA, 19 nt, Homo sapiens
gaggaggaguuugaucugu

SEQ ID NO: 469891 - RNA, 19 nt, Homo sapiens
agcaagaugucgaugauga

SEQ ID NO: 469892 - RNA, 19 nt, Homo sapiens
gagacagcccucaaugcua

SEQ ID NO: 469893 - RNA, 19 nt, Homo sapiens
gcuguaggacuguuuguga

SEQ ID NO: 469894 - RNA, 19 nt, Homo sapiens
ucaccaagaagaugaagaa

SEQ ID NO: 469895 - RNA, 19 nt, Homo sapiens
ggaagauuacuuugcguau

SEQ ID NO: 469896 - RNA, 19 nt, Homo sapiens
gcaagaugucgaugaugaa

SEQ ID NO: 469897 - RNA, 19 nt, Homo sapiens
aggaauaccucaauagcau

SEQ ID NO: 469898 - RNA, 19 nt, Homo sapiens
gaagcgagacgcccauucu

SEQ ID NO: 469899 - RNA, 19 nt, Homo sapiens
gaaguggcagcgaagaaga

SEQ ID NO: 469900 - RNA, 19 nt, Homo sapiens
agaaggaggaugacaguga

SEQ ID NO: 469901 - RNA, 19 nt, Homo sapiens
gcucaucacguaccucaug

SEQ ID NO: 469902 - RNA, 19 nt, Homo sapiens
gagaaugccaagcaagaug

SEQ ID NO: 469903 - RNA, 19 nt, Homo sapiens
gcuccgaggucugauagug

SEQ ID NO: 469904 - RNA, 19 nt, Homo sapiens
ugccaaggauuucaaggaa

SEQ ID NO: 469905 - RNA, 19 nt, Homo sapiens
uggaguacgucaucaagug

SEQ ID NO: 469906 - RNA, 19 nt, Homo sapiens
gcaugccucuaguccaguu

SEQ ID NO: 469907 - RNA, 19 nt, Homo sapiens
ucacugagaagcuggagaa

SEQ ID NO: 469908 - RNA, 19 nt, Homo sapiens
ggacacagcgcuggagaca

SEQ ID NO: 469909 - RNA, 19 nt, Homo sapiens
ggaugucaaacaguaauaa

SEQ ID NO: 469910 - RNA, 19 nt, Homo sapiens
ggacaacaugcaccagaug

SEQ ID NO: 469911 - RNA, 19 nt, Homo sapiens
uggagcggcugaccuguga

SEQ ID NO: 469912 - RNA, 19 nt, Homo sapiens
cugcuguucugccaaauga

SEQ ID NO: 469913 - RNA, 19 nt, Homo sapiens
gugcugcuguucugccaaa

SEQ ID NO: 469914 - RNA, 19 nt, Homo sapiens
gagccucggguaaauuuga

SEQ ID NO: 469915 - RNA, 19 nt, Homo sapiens
ccaagacccugaugaacac

SEQ ID NO: 469916 - RNA, 19 nt, Homo sapiens
caagauccguuggaaguac

SEQ ID NO: 469917 - RNA, 19 nt, Homo sapiens
agucagcgcuuauggucaa

SEQ ID NO: 469918 - RNA, 19 nt, Homo sapiens
gaggucugauagugaagaa

SEQ ID NO: 469919 - RNA, 19 nt, Homo sapiens
ggagacagcccucaaugcu

SEQ ID NO: 469920 - RNA, 19 nt, Homo sapiens
ggaagagggcgaggaggaa

SEQ ID NO: 469921 - RNA, 19 nt, Homo sapiens
agaaaguggcucagaagaa

SEQ ID NO: 469922 - RNA, 19 nt, Homo sapiens
ggaauaccucaauagcauu

SEQ ID NO: 469923 - RNA, 19 nt, Homo sapiens
gagaagcuguaggacuguu

SEQ ID NO: 469924 - RNA, 19 nt, Homo sapiens
acaaccagaugaaaggaau

SEQ ID NO: 469925 - RNA, 19 nt, Homo sapiens
gaacaugaaugagaaguug

SEQ ID NO: 469926 - RNA, 19 nt, Homo sapiens
caacagcucccaccacuua

SEQ ID NO: 469927 - RNA, 19 nt, Homo sapiens
gaaacuaccuccguauguu

SEQ ID NO: 469928 - RNA, 19 nt, Homo sapiens
ccacaaccaucaacaggaa

SEQ ID NO: 469929 - RNA, 19 nt, Homo sapiens
gaagaaaccuuauuuuagg

SEQ ID NO: 469930 - RNA, 19 nt, Homo sapiens
gcacacauuccauuuguug

SEQ ID NO: 469931 - RNA, 19 nt, Homo sapiens
gacagcagaucgaguccua

SEQ ID NO: 469932 - RNA, 19 nt, Homo sapiens
gaugacgccugagauguuu

SEQ ID NO: 469933 - RNA, 19 nt, Homo sapiens
gugacgaucuggauuugaa

SEQ ID NO: 469934 - RNA, 19 nt, Homo sapiens
aaggagaacucaccagaga

SEQ ID NO: 469935 - RNA, 19 nt, Homo sapiens
ggcagaagcccgugaaguu

SEQ ID NO: 469936 - RNA, 19 nt, Homo sapiens
ggaaacuaccuccguaugu

SEQ ID NO: 469937 - RNA, 19 nt, Homo sapiens
gcuccgaggugggaaacua

SEQ ID NO: 469938 - RNA, 19 nt, Homo sapiens
acgcugagauggagaagaa

SEQ ID NO: 469939 - RNA, 19 nt, Homo sapiens
ucaggaagaaaccuuauuu

SEQ ID NO: 469940 - RNA, 19 nt, Homo sapiens
cagagaaguuugcccugaa

SEQ ID NO: 469941 - RNA, 19 nt, Homo sapiens
ggagaucgaugggcagaag

SEQ ID NO: 469942 - RNA, 19 nt, Homo sapiens
gcagggcuaguaacaguuu

SEQ ID NO: 469943 - RNA, 19 nt, Homo sapiens
ggaagaaaccuuauuuuag

SEQ ID NO: 469944 - RNA, 19 nt, Homo sapiens
acacuaaggaucacggaua

SEQ ID NO: 469945 - RNA, 19 nt, Homo sapiens
gcaacgaugagaaguacaa

SEQ ID NO: 469946 - RNA, 19 nt, Homo sapiens
gaccagcgcgucaucauca

SEQ ID NO: 469947 - RNA, 19 nt, Homo sapiens
ccuggaacaugaaugagaa

SEQ ID NO: 469948 - RNA, 19 nt, Homo sapiens
cagcugugauccaugagaa

SEQ ID NO: 469949 - RNA, 19 nt, Homo sapiens
gcagaagcccgugaaguuc

SEQ ID NO: 469950 - RNA, 19 nt, Homo sapiens
gcaagaccuucgggcagaa

SEQ ID NO: 469951 - RNA, 19 nt, Homo sapiens
cggcacacauuccauuugu

SEQ ID NO: 469952 - RNA, 19 nt, Homo sapiens
ccacggagcaucucagaag

SEQ ID NO: 469953 - RNA, 19 nt, Homo sapiens
ugaacccgcugacguuugu

SEQ ID NO: 469954 - RNA, 19 nt, Homo sapiens
ggaacaugaaugagaaguu

SEQ ID NO: 469955 - RNA, 19 nt, Homo sapiens
ggaggcgacuagccacugu

SEQ ID NO: 469956 - RNA, 19 nt, Homo sapiens
ggagaacucaccagagaag

SEQ ID NO: 469957 - RNA, 19 nt, Homo sapiens
gccuucaccuggaacauga

SEQ ID NO: 469958 - RNA, 19 nt, Homo sapiens
ugacagacgcugagaugga

SEQ ID NO: 469959 - RNA, 19 nt, Homo sapiens
gaccaugacccagcuguga

SEQ ID NO: 469960 - RNA, 19 nt, Homo sapiens
ccaccuaccucagggaaca

SEQ ID NO: 469961 - RNA, 19 nt, Homo sapiens
gaagagaggaagaaaauag

SEQ ID NO: 469962 - RNA, 19 nt, Homo sapiens
gacggcgaguucuacauga

SEQ ID NO: 469963 - RNA, 19 nt, Homo sapiens
guuccgagguucucuguac

SEQ ID NO: 469964 - RNA, 19 nt, Homo sapiens
ucaccuggaacaugaauga

SEQ ID NO: 469965 - RNA, 19 nt, Homo sapiens
gagacgccuucaccuggaa

SEQ ID NO: 469966 - RNA, 19 nt, Homo sapiens
ccucggaaguggaagagau

SEQ ID NO: 469967 - RNA, 19 nt, Homo sapiens
gagauugccauccggaaca

SEQ ID NO: 469968 - RNA, 19 nt, Homo sapiens
ccaccagugugacccuguu

SEQ ID NO: 469969 - RNA, 19 nt, Homo sapiens
cgacggcgaguucuacaug

SEQ ID NO: 469970 - RNA, 19 nt, Homo sapiens
gggaaacuaccuccguaug

SEQ ID NO: 469971 - RNA, 19 nt, Homo sapiens
ucaucaagcugaacaucca

SEQ ID NO: 469972 - RNA, 19 nt, Homo sapiens
gauucuggauggcaacgau

SEQ ID NO: 469973 - RNA, 19 nt, Homo sapiens
ccagugugacccuguuaaa

SEQ ID NO: 469974 - RNA, 19 nt, Homo sapiens
caggucauguucaauuucu

SEQ ID NO: 469975 - RNA, 19 nt, Homo sapiens
ugaugacgccugagauguu

SEQ ID NO: 469976 - RNA, 19 nt, Homo sapiens
aggcagggcuaguaacagu

SEQ ID NO: 469977 - RNA, 19 nt, Homo sapiens
ggucauguucaauuucuuc

SEQ ID NO: 469978 - RNA, 19 nt, Homo sapiens
gcuggcaucagaagaccua

SEQ ID NO: 469979 - RNA, 19 nt, Homo sapiens
gcccacugcuggagacucu

SEQ ID NO: 469980 - RNA, 19 nt, Homo sapiens
ggacgacggcgaguucuac

SEQ ID NO: 469981 - RNA, 19 nt, Homo sapiens
agugggacaugucagagaa

SEQ ID NO: 469982 - RNA, 19 nt, Homo sapiens
acccagcugugauccauga

SEQ ID NO: 469983 - RNA, 19 nt, Homo sapiens
gcaugggccgagacaagaa

SEQ ID NO: 469984 - RNA, 19 nt, Homo sapiens
gcugagauggagaagaaga

SEQ ID NO: 469985 - RNA, 19 nt, Homo sapiens
auaguugcaucgucacaug

SEQ ID NO: 469986 - RNA, 19 nt, Homo sapiens
ggcacacauuccauuuguu

SEQ ID NO: 469987 - RNA, 19 nt, Homo sapiens
cacggagcaucucagaaga

SEQ ID NO: 469988 - RNA, 19 nt, Homo sapiens
aaacuaccuccguauguuc

SEQ ID NO: 469989 - RNA, 19 nt, Homo sapiens
gggaacagaaggccaagag

SEQ ID NO: 469990 - RNA, 19 nt, Homo sapiens
ugacccagcugugauccau

SEQ ID NO: 469991 - RNA, 19 nt, Homo sapiens
guacccacccugcccaaca

SEQ ID NO: 469992 - RNA, 19 nt, Homo sapiens
cacuaaggaucacggauac

SEQ ID NO: 469993 - RNA, 19 nt, Homo sapiens
cuccguauguuccgagguu

SEQ ID NO: 469994 - RNA, 19 nt, Homo sapiens
gggucaggaagaaaccuua

SEQ ID NO: 469995 - RNA, 19 nt, Homo sapiens
gcccuucccggcacacauu

SEQ ID NO: 469996 - RNA, 19 nt, Homo sapiens
agagaaguuugcccugaag

SEQ ID NO: 469997 - RNA, 19 nt, Homo sapiens
gagugggacaugucagaga

SEQ ID NO: 469998 - RNA, 19 nt, Homo sapiens
gagacaagaagagaaccuu

SEQ ID NO: 469999 - RNA, 19 nt, Homo sapiens
aacagaaggccaagaggaa

SEQ ID NO: 470000 - RNA, 19 nt, Homo sapiens
uggcaacgaugagaaguac

SEQ ID NO: 470001 - RNA, 19 nt, Homo sapiens
ggaaguggaagagauucug

SEQ ID NO: 470002 - RNA, 19 nt, Homo sapiens
ggucaggaagaaaccuuau

SEQ ID NO: 470003 - RNA, 19 nt, Homo sapiens
guugcaucgucacauggua

SEQ ID NO: 470004 - RNA, 19 nt, Homo sapiens
guugaugacgccugagaug

SEQ ID NO: 470005 - RNA, 19 nt, Homo sapiens
ccaggcagggcuaguaaca

SEQ ID NO: 470006 - RNA, 19 nt, Homo sapiens
ugaaugagaaguugaugac

SEQ ID NO: 470007 - RNA, 19 nt, Homo sapiens
ccacugcuggagacucuga

SEQ ID NO: 470008 - RNA, 19 nt, Homo sapiens
gggaguuugucaccaccau

SEQ ID NO: 470009 - RNA, 19 nt, Homo sapiens
ucugugacgaucuggauuu

SEQ ID NO: 470010 - RNA, 19 nt, Homo sapiens
ggauggcaacgaugagaag

SEQ ID NO: 470011 - RNA, 19 nt, Homo sapiens
gccaucgccucugccauca

SEQ ID NO: 470012 - RNA, 19 nt, Homo sapiens
gccgugccaugcuccacaa

SEQ ID NO: 470013 - RNA, 19 nt, Homo sapiens
gaaagaagcucuagaacaa

SEQ ID NO: 470014 - RNA, 19 nt, Homo sapiens
ggacaaaccuuaaggcauu

SEQ ID NO: 470015 - RNA, 19 nt, Homo sapiens
gaaguuggcuaacaaauug

SEQ ID NO: 470016 - RNA, 19 nt, Homo sapiens
gcugaaguaugcugaauua

SEQ ID NO: 470017 - RNA, 19 nt, Homo sapiens
ggaguaagcugacaguuuc

SEQ ID NO: 470018 - RNA, 19 nt, Homo sapiens
gaacuugacuggagaugug

SEQ ID NO: 470019 - RNA, 19 nt, Homo sapiens
gcauuuggcuccagaaaga

SEQ ID NO: 470020 - RNA, 19 nt, Homo sapiens
ugaaggagcugaagaggaa

SEQ ID NO: 470021 - RNA, 19 nt, Homo sapiens
gaaguaugcugaauuacga

SEQ ID NO: 470022 - RNA, 19 nt, Homo sapiens
gagcagaccaaucacauua

SEQ ID NO: 470023 - RNA, 19 nt, Homo sapiens
caaaguguuucauggauuu

SEQ ID NO: 470024 - RNA, 19 nt, Homo sapiens
gaagaagagugggaagaaa

SEQ ID NO: 470025 - RNA, 19 nt, Homo sapiens
gcaccuggcugcaguggaa

SEQ ID NO: 470026 - RNA, 19 nt, Homo sapiens
gcaaaguguuucauggauu

SEQ ID NO: 470027 - RNA, 19 nt, Homo sapiens
caaacuaccucuuguuaca

SEQ ID NO: 470028 - RNA, 19 nt, Homo sapiens
gaauggugcugaugguaaa

SEQ ID NO: 470029 - RNA, 19 nt, Homo sapiens
gcagaccaaucacauuauu

SEQ ID NO: 470030 - RNA, 19 nt, Homo sapiens
ucaaguggcaguuucauua

SEQ ID NO: 470031 - RNA, 19 nt, Homo sapiens
gaucucacauuccaucuau

SEQ ID NO: 470032 - RNA, 19 nt, Homo sapiens
gaagaaaguagaacaugaa

SEQ ID NO: 470033 - RNA, 19 nt, Homo sapiens
guacugacauuuacuccaa

SEQ ID NO: 470034 - RNA, 19 nt, Homo sapiens
ggaaauccaguuaugagua

SEQ ID NO: 470035 - RNA, 19 nt, Homo sapiens
ccucaggucuuuaauguga

SEQ ID NO: 470036 - RNA, 19 nt, Homo sapiens
gaagaucuaaccaaggaua

SEQ ID NO: 470037 - RNA, 19 nt, Homo sapiens
ggaaggagaaccucaguga

SEQ ID NO: 470038 - RNA, 19 nt, Homo sapiens
uugaagagcuggaaacuau

SEQ ID NO: 470039 - RNA, 19 nt, Homo sapiens
ggaugaaggugauaaagca

SEQ ID NO: 470040 - RNA, 19 nt, Homo sapiens
gaacauaccacugaacuag

SEQ ID NO: 470041 - RNA, 19 nt, Homo sapiens
gcacaaacauccgcuccuu

SEQ ID NO: 470042 - RNA, 19 nt, Homo sapiens
gaaauccaguuaugaguac

SEQ ID NO: 470043 - RNA, 19 nt, Homo sapiens
gaacauguuggaagucgua

SEQ ID NO: 470044 - RNA, 19 nt, Homo sapiens
gauauuagcuccuuauacc

SEQ ID NO: 470045 - RNA, 19 nt, Homo sapiens
ugacagagcagaccaauca

SEQ ID NO: 470046 - RNA, 19 nt, Homo sapiens
caacaccuguacccaauau

SEQ ID NO: 470047 - RNA, 19 nt, Homo sapiens
ggagggaguuuggcaagaa

SEQ ID NO: 470048 - RNA, 19 nt, Homo sapiens
ggaacaaagugucggaaca

SEQ ID NO: 470049 - RNA, 19 nt, Homo sapiens
gaacauuuacggaugagaa

SEQ ID NO: 470050 - RNA, 19 nt, Homo sapiens
cgacaucagggaacauuua

SEQ ID NO: 470051 - RNA, 19 nt, Homo sapiens
ugaagaaacuagagaucaa

SEQ ID NO: 470052 - RNA, 19 nt, Homo sapiens
cucaacagaugcuaaauuu

SEQ ID NO: 470053 - RNA, 19 nt, Homo sapiens
ggagaugugugugcuguga

SEQ ID NO: 470054 - RNA, 19 nt, Homo sapiens
aaauacaccuguuaaagga

SEQ ID NO: 470055 - RNA, 19 nt, Homo sapiens
ggaugaaugaggaggauua

SEQ ID NO: 470056 - RNA, 19 nt, Homo sapiens
aaacauuggugcagaacaa

SEQ ID NO: 470057 - RNA, 19 nt, Homo sapiens
caaacucccugcaaagugu

SEQ ID NO: 470058 - RNA, 19 nt, Homo sapiens
gaucaaacuucgacauuuu

SEQ ID NO: 470059 - RNA, 19 nt, Homo sapiens
ucaccaaacucccugcaaa

SEQ ID NO: 470060 - RNA, 19 nt, Homo sapiens
caaugagucuagccuacua

SEQ ID NO: 470061 - RNA, 19 nt, Homo sapiens
agaagaaaguagaacauga

SEQ ID NO: 470062 - RNA, 19 nt, Homo sapiens
ggaacaggauagugaagug

SEQ ID NO: 470063 - RNA, 19 nt, Homo sapiens
ccaagacuccagaaauaua

SEQ ID NO: 470064 - RNA, 19 nt, Homo sapiens
ugaaugaggaggauuauga

SEQ ID NO: 470065 - RNA, 19 nt, Homo sapiens
gaaacuagagaucaaacuu

SEQ ID NO: 470066 - RNA, 19 nt, Homo sapiens
gaagaaagaaagaucaagu

SEQ ID NO: 470067 - RNA, 19 nt, Homo sapiens
gcaaugggaccuccuccua

SEQ ID NO: 470068 - RNA, 19 nt, Homo sapiens
aagaagaucuaaccaagga

SEQ ID NO: 470069 - RNA, 19 nt, Homo sapiens
auagggagguguuuauaaa

SEQ ID NO: 470070 - RNA, 19 nt, Homo sapiens
ccgcaggccuagcuguuua

SEQ ID NO: 470071 - RNA, 19 nt, Homo sapiens
guaaagaaagagaaaguga

SEQ ID NO: 470072 - RNA, 19 nt, Homo sapiens
gaucugaaguuggcuaaca

SEQ ID NO: 470073 - RNA, 19 nt, Homo sapiens
gggaggcauuccuuaguuu

SEQ ID NO: 470074 - RNA, 19 nt, Homo sapiens
acauaccacugaacuagua

SEQ ID NO: 470075 - RNA, 19 nt, Homo sapiens
gggaguaagcugacaguuu

SEQ ID NO: 470076 - RNA, 19 nt, Homo sapiens
ccugguagcucucuugguu

SEQ ID NO: 470077 - RNA, 19 nt, Homo sapiens
gaaagaggaagaugagcaa

SEQ ID NO: 470078 - RNA, 19 nt, Homo sapiens
ugaaagauaucaucaaacg

SEQ ID NO: 470079 - RNA, 19 nt, Homo sapiens
caguauaagugguggcuuu

SEQ ID NO: 470080 - RNA, 19 nt, Homo sapiens
aaaccacaauugagauuug

SEQ ID NO: 470081 - RNA, 19 nt, Homo sapiens
uaaacgagauguggaagga

SEQ ID NO: 470082 - RNA, 19 nt, Homo sapiens
gacaaaccuuaaggcauua

SEQ ID NO: 470083 - RNA, 19 nt, Homo sapiens
ggaagaagagugggaagaa

SEQ ID NO: 470084 - RNA, 19 nt, Homo sapiens
cuacagaacccaucucgaa

SEQ ID NO: 470085 - RNA, 19 nt, Homo sapiens
ugagaccggugaugagaaa

SEQ ID NO: 470086 - RNA, 19 nt, Homo sapiens
gaaugaagaaggccuaauc

SEQ ID NO: 470087 - RNA, 19 nt, Homo sapiens
ggaacucacuuggcaguca

SEQ ID NO: 470088 - RNA, 19 nt, Homo sapiens
gcaagcacuacaagaagua

SEQ ID NO: 470089 - RNA, 19 nt, Homo sapiens
gagagcauccuaaguuaau

SEQ ID NO: 470090 - RNA, 19 nt, Homo sapiens
gagaucaaacuucgacauu

SEQ ID NO: 470091 - RNA, 19 nt, Homo sapiens
gaagaaacuagagaucaaa

SEQ ID NO: 470092 - RNA, 19 nt, Homo sapiens
ggaagagaauggacugaac

SEQ ID NO: 470093 - RNA, 19 nt, Homo sapiens
gaaugaagagccagucaga

SEQ ID NO: 470094 - RNA, 19 nt, Homo sapiens
ggauuucaaccaagaauga

SEQ ID NO: 470095 - RNA, 19 nt, Homo sapiens
ccagacagcuaugauacuu

SEQ ID NO: 470096 - RNA, 19 nt, Homo sapiens
ggaaaugagaaugaguuua

SEQ ID NO: 470097 - RNA, 19 nt, Homo sapiens
aaagagaugcugaggguaa

SEQ ID NO: 470098 - RNA, 19 nt, Homo sapiens
gaaccucagugauuuuauu

SEQ ID NO: 470099 - RNA, 19 nt, Homo sapiens
ggagagcauccuaaguuaa

SEQ ID NO: 470100 - RNA, 19 nt, Homo sapiens
gaagagaacaaagaacuca

SEQ ID NO: 470101 - RNA, 19 nt, Homo sapiens
gauaccaaaucagaagaaa

SEQ ID NO: 470102 - RNA, 19 nt, Homo sapiens
acccauaccuugagaauuc

SEQ ID NO: 470103 - RNA, 19 nt, Homo sapiens
agucagaaguccagaaaga

SEQ ID NO: 470104 - RNA, 19 nt, Homo sapiens
ggaguggaaaugagaauga

SEQ ID NO: 470105 - RNA, 19 nt, Homo sapiens
ggagguaccacuggaauug

SEQ ID NO: 470106 - RNA, 19 nt, Homo sapiens
caaggaugauuggaacaaa

SEQ ID NO: 470107 - RNA, 19 nt, Homo sapiens
auccaagacuccagaaaua

SEQ ID NO: 470108 - RNA, 19 nt, Homo sapiens
acaagacgaugaagaaugg

SEQ ID NO: 470109 - RNA, 19 nt, Homo sapiens
gaauucugguucauacugu

SEQ ID NO: 470110 - RNA, 19 nt, Homo sapiens
gcucaacagaugcuaaauu

SEQ ID NO: 470111 - RNA, 19 nt, Homo sapiens
caaguugacccggaaagua

SEQ ID NO: 470112 - RNA, 19 nt, Homo sapiens
auaggaagccugugaguuu

SEQ ID NO: 470113 - RNA, 19 nt, Homo sapiens
gcacagacauguacacaaa

SEQ ID NO: 470114 - RNA, 19 nt, Homo sapiens
ggaagaagcagccaaagua

SEQ ID NO: 470115 - RNA, 19 nt, Homo sapiens
gagaagcacuggaguauca

SEQ ID NO: 470116 - RNA, 19 nt, Homo sapiens
gaucaaauguuuccuagau

SEQ ID NO: 470117 - RNA, 19 nt, Homo sapiens
ggaagacuaugaaguaaau

SEQ ID NO: 470118 - RNA, 19 nt, Homo sapiens
gaacagacccaccacauca

SEQ ID NO: 470119 - RNA, 19 nt, Homo sapiens
ccaagacacugacagauga

SEQ ID NO: 470120 - RNA, 19 nt, Homo sapiens
gcaaugcaccgcucacuaa

SEQ ID NO: 470121 - RNA, 19 nt, Homo sapiens
gaucaaacuucggcacuuu

SEQ ID NO: 470122 - RNA, 19 nt, Homo sapiens
gcuacuauccugacaguua

SEQ ID NO: 470123 - RNA, 19 nt, Homo sapiens
uaagaaaggucccucaaca

SEQ ID NO: 470124 - RNA, 19 nt, Homo sapiens
ggugaaagguguuuauaca

SEQ ID NO: 470125 - RNA, 19 nt, Homo sapiens
caagaaggaugaggagaaa

SEQ ID NO: 470126 - RNA, 19 nt, Homo sapiens
gaagaagcagccaaaguaa

SEQ ID NO: 470127 - RNA, 19 nt, Homo sapiens
gcacuuggcugcuguugag

SEQ ID NO: 470128 - RNA, 19 nt, Homo sapiens
gaggaagacuaugaaguaa

SEQ ID NO: 470129 - RNA, 19 nt, Homo sapiens
ggaaagaaggcgacaguga

SEQ ID NO: 470130 - RNA, 19 nt, Homo sapiens
gcaagaacuacaagaagua

SEQ ID NO: 470131 - RNA, 19 nt, Homo sapiens
uaaaggacauuaucaagag

SEQ ID NO: 470132 - RNA, 19 nt, Homo sapiens
ucacuaaacugccgaucaa

SEQ ID NO: 470133 - RNA, 19 nt, Homo sapiens
gcaaagagaaaccaacaga

SEQ ID NO: 470134 - RNA, 19 nt, Homo sapiens
ugaggaagacuaugaagua

SEQ ID NO: 470135 - RNA, 19 nt, Homo sapiens
gaagagggauaagcagguu

SEQ ID NO: 470136 - RNA, 19 nt, Homo sapiens
gagaguucaucacuacgua

SEQ ID NO: 470137 - RNA, 19 nt, Homo sapiens
cagcagcacuuccaacaga

SEQ ID NO: 470138 - RNA, 19 nt, Homo sapiens
ccaaagcccugccauugug

SEQ ID NO: 470139 - RNA, 19 nt, Homo sapiens
guaaugcuccuuuggguuu

SEQ ID NO: 470140 - RNA, 19 nt, Homo sapiens
gcucaacuuuccugacaaa

SEQ ID NO: 470141 - RNA, 19 nt, Homo sapiens
caacaaaugcucaacuuuc

SEQ ID NO: 470142 - RNA, 19 nt, Homo sapiens
gagaagaggagcaagaaga

SEQ ID NO: 470143 - RNA, 19 nt, Homo sapiens
gaaacuauaagaagaggaa

SEQ ID NO: 470144 - RNA, 19 nt, Homo sapiens
ugacaaaggcaaagagaaa

SEQ ID NO: 470145 - RNA, 19 nt, Homo sapiens
gaacaguggggucuuauua

SEQ ID NO: 470146 - RNA, 19 nt, Homo sapiens
gaacagcccagauucagau

SEQ ID NO: 470147 - RNA, 19 nt, Homo sapiens
cuaggaagguucaugcaaa

SEQ ID NO: 470148 - RNA, 19 nt, Homo sapiens
gaagaaggagcccaaggaa

SEQ ID NO: 470149 - RNA, 19 nt, Homo sapiens
aaagaugacuggaacaaag

SEQ ID NO: 470150 - RNA, 19 nt, Homo sapiens
caacagacaugcaaaacuu

SEQ ID NO: 470151 - RNA, 19 nt, Homo sapiens
ugaaagguguuuauacaag

SEQ ID NO: 470152 - RNA, 19 nt, Homo sapiens
ccuccaaacuacugcauuu

SEQ ID NO: 470153 - RNA, 19 nt, Homo sapiens
ggcaagaacuacaagaagu

SEQ ID NO: 470154 - RNA, 19 nt, Homo sapiens
ccucaacaccuuacacuaa

SEQ ID NO: 470155 - RNA, 19 nt, Homo sapiens
gcaaacaugucagcaaugc

SEQ ID NO: 470156 - RNA, 19 nt, Homo sapiens
gcaaggaugaggaugagaa

SEQ ID NO: 470157 - RNA, 19 nt, Homo sapiens
uugaggagcuggagacuau

SEQ ID NO: 470158 - RNA, 19 nt, Homo sapiens
gagaaggaguccgagaaga

SEQ ID NO: 470159 - RNA, 19 nt, Homo sapiens
gaacaaaguguccgagcau

SEQ ID NO: 470160 - RNA, 19 nt, Homo sapiens
gaaauugagcccaaacuac

SEQ ID NO: 470161 - RNA, 19 nt, Homo sapiens
uggaggcacuggaaaugua

SEQ ID NO: 470162 - RNA, 19 nt, Homo sapiens
caaacuacuagggaaauua

SEQ ID NO: 470163 - RNA, 19 nt, Homo sapiens
gcagcugccuacaaauuca

SEQ ID NO: 470164 - RNA, 19 nt, Homo sapiens
ucaaggacuucuguuuaaa

SEQ ID NO: 470165 - RNA, 19 nt, Homo sapiens
uucaaggacuucuguuuaa

SEQ ID NO: 470166 - RNA, 19 nt, Homo sapiens
ggagaaggagccaaaggaa

SEQ ID NO: 470167 - RNA, 19 nt, Homo sapiens
gaggguccaugccuuccua

SEQ ID NO: 470168 - RNA, 19 nt, Homo sapiens
ggaaugcugcccuaaagga

SEQ ID NO: 470169 - RNA, 19 nt, Homo sapiens
ugaaugaggaagacuauga

SEQ ID NO: 470170 - RNA, 19 nt, Homo sapiens
gcagaauaauugccugucu

SEQ ID NO: 470171 - RNA, 19 nt, Homo sapiens
ggaccgcaauguggaaaug

SEQ ID NO: 470172 - RNA, 19 nt, Homo sapiens
ggguacaccucccuccaaa

SEQ ID NO: 470173 - RNA, 19 nt, Homo sapiens
gaaaccaacagacaugcaa

SEQ ID NO: 470174 - RNA, 19 nt, Homo sapiens
ugaccgaccuggaugaaca

SEQ ID NO: 470175 - RNA, 19 nt, Homo sapiens
gaggugaacagcccagauu

SEQ ID NO: 470176 - RNA, 19 nt, Homo sapiens
gaaucuagaagaagaggaa

SEQ ID NO: 470177 - RNA, 19 nt, Homo sapiens
ccaagaaggaugaggagaa

SEQ ID NO: 470178 - RNA, 19 nt, Homo sapiens
caauaguguucaugccauu

SEQ ID NO: 470179 - RNA, 19 nt, Homo sapiens
gaaugaggaagacuaugaa

SEQ ID NO: 470180 - RNA, 19 nt, Homo sapiens
cagcgaggcucccaagaag

SEQ ID NO: 470181 - RNA, 19 nt, Homo sapiens
ccacagaugagaagaagga

SEQ ID NO: 470182 - RNA, 19 nt, Homo sapiens
ccaaaacagucaacacaaa

SEQ ID NO: 470183 - RNA, 19 nt, Homo sapiens
ccaaacuacuagggaaauu

SEQ ID NO: 470184 - RNA, 19 nt, Homo sapiens
ggacuucuguuuaaaagau

SEQ ID NO: 470185 - RNA, 19 nt, Homo sapiens
gcccaaagcccugccauug

SEQ ID NO: 470186 - RNA, 19 nt, Homo sapiens
gaccucugcuucccaacaa

SEQ ID NO: 470187 - RNA, 19 nt, Homo sapiens
ucaaugaauggaugaauga

SEQ ID NO: 470188 - RNA, 19 nt, Homo sapiens
gaucccagcgagugaaauu

SEQ ID NO: 470189 - RNA, 19 nt, Homo sapiens
ucacugaggauaagaacaa

SEQ ID NO: 470190 - RNA, 19 nt, Homo sapiens
cgaacccucuacauccuaa

SEQ ID NO: 470191 - RNA, 19 nt, Homo sapiens
gaagauuucagccaagaca

SEQ ID NO: 470192 - RNA, 19 nt, Homo sapiens
acauggagcagcugaagua

SEQ ID NO: 470193 - RNA, 19 nt, Homo sapiens
cagacaagccuuccacaug

SEQ ID NO: 470194 - RNA, 19 nt, Homo sapiens
gaggaaaggaagaucaaau

SEQ ID NO: 470195 - RNA, 19 nt, Homo sapiens
caagaaguauauacaagcu

SEQ ID NO: 470196 - RNA, 19 nt, Homo sapiens
gcuacaauuucaggaagaa

SEQ ID NO: 470197 - RNA, 19 nt, Homo sapiens
gcguuacgauuuccagaau

SEQ ID NO: 470198 - RNA, 19 nt, Homo sapiens
ccuacaaauucaagaguga

SEQ ID NO: 470199 - RNA, 19 nt, Homo sapiens
guacaguugcuacaauuuc

SEQ ID NO: 470200 - RNA, 19 nt, Homo sapiens
ggaugaaugaggaagacua

SEQ ID NO: 470201 - RNA, 19 nt, Homo sapiens
ggacaccgacaccuucaau

SEQ ID NO: 470202 - RNA, 19 nt, Homo sapiens
ggaagguucaugcaaagug

SEQ ID NO: 470203 - RNA, 19 nt, Homo sapiens
uggcaaacaugucagcaau

SEQ ID NO: 470204 - RNA, 19 nt, Homo sapiens
gaaugcugcccuaaaggaa

SEQ ID NO: 470205 - RNA, 19 nt, Homo sapiens
guucaucacuacguaagga

SEQ ID NO: 470206 - RNA, 19 nt, Homo sapiens
caacaaacuccucccucaa

SEQ ID NO: 470207 - RNA, 19 nt, Homo sapiens
gcgagaagcacuggaguau

SEQ ID NO: 470208 - RNA, 19 nt, Homo sapiens
caaagaugacuggaacaaa

SEQ ID NO: 470209 - RNA, 19 nt, Homo sapiens
cacuggaaauguacaaaga

SEQ ID NO: 470210 - RNA, 19 nt, Homo sapiens
ccagguggaugcugagagu

SEQ ID NO: 470211 - RNA, 19 nt, Homo sapiens
ccaagacuccagagaucua

SEQ ID NO: 470212 - RNA, 19 nt, Homo sapiens
guccaagacuccagagauc

SEQ ID NO: 470213 - RNA, 19 nt, Homo sapiens
gcacagacauguacacaaa

SEQ ID NO: 470214 - RNA, 19 nt, Homo sapiens
ggaagaagcagccaaagua

SEQ ID NO: 470215 - RNA, 19 nt, Homo sapiens
gagaagcacuggaguauca

SEQ ID NO: 470216 - RNA, 19 nt, Homo sapiens
gaucaaauguuuccuagau

SEQ ID NO: 470217 - RNA, 19 nt, Homo sapiens
ggaagacuaugaaguaaau

SEQ ID NO: 470218 - RNA, 19 nt, Homo sapiens
gaacagacccaccacauca

SEQ ID NO: 470219 - RNA, 19 nt, Homo sapiens
ccaagacacugacagauga

SEQ ID NO: 470220 - RNA, 19 nt, Homo sapiens
gcaaugcaccgcucacuaa

SEQ ID NO: 470221 - RNA, 19 nt, Homo sapiens
gaucaaacuucggcacuuu

SEQ ID NO: 470222 - RNA, 19 nt, Homo sapiens
gcuacuauccugacaguua

SEQ ID NO: 470223 - RNA, 19 nt, Homo sapiens
uaagaaaggucccucaaca

SEQ ID NO: 470224 - RNA, 19 nt, Homo sapiens
ggugaaagguguuuauaca

SEQ ID NO: 470225 - RNA, 19 nt, Homo sapiens
caagaaggaugaggagaaa

SEQ ID NO: 470226 - RNA, 19 nt, Homo sapiens
gaagaagcagccaaaguaa

SEQ ID NO: 470227 - RNA, 19 nt, Homo sapiens
gcacuuggcugcuguugag

SEQ ID NO: 470228 - RNA, 19 nt, Homo sapiens
gaggaagacuaugaaguaa

SEQ ID NO: 470229 - RNA, 19 nt, Homo sapiens
ggaaagaaggcgacaguga

SEQ ID NO: 470230 - RNA, 19 nt, Homo sapiens
gcaagaacuacaagaagua

SEQ ID NO: 470231 - RNA, 19 nt, Homo sapiens
uaaaggacauuaucaagag

SEQ ID NO: 470232 - RNA, 19 nt, Homo sapiens
ucacuaaacugccgaucaa

SEQ ID NO: 470233 - RNA, 19 nt, Homo sapiens
gcaaagagaaaccaacaga

SEQ ID NO: 470234 - RNA, 19 nt, Homo sapiens
ugaggaagacuaugaagua

SEQ ID NO: 470235 - RNA, 19 nt, Homo sapiens
gaagagggauaagcagguu

SEQ ID NO: 470236 - RNA, 19 nt, Homo sapiens
gagaguucaucacuacgua

SEQ ID NO: 470237 - RNA, 19 nt, Homo sapiens
cagcagcacuuccaacaga

SEQ ID NO: 470238 - RNA, 19 nt, Homo sapiens
gcucaacuuuccugacaaa

SEQ ID NO: 470239 - RNA, 19 nt, Homo sapiens
caacaaaugcucaacuuuc

SEQ ID NO: 470240 - RNA, 19 nt, Homo sapiens
gagaagaggagcaagaaga

SEQ ID NO: 470241 - RNA, 19 nt, Homo sapiens
gaaacuauaagaagaggaa

SEQ ID NO: 470242 - RNA, 19 nt, Homo sapiens
ugacaaaggcaaagagaaa

SEQ ID NO: 470243 - RNA, 19 nt, Homo sapiens
gaacaguggggucuuauua

SEQ ID NO: 470244 - RNA, 19 nt, Homo sapiens
gaacagcccagauucagau

SEQ ID NO: 470245 - RNA, 19 nt, Homo sapiens
cuaggaagguucaugcaaa

SEQ ID NO: 470246 - RNA, 19 nt, Homo sapiens
gaagaaggagcccaaggaa

SEQ ID NO: 470247 - RNA, 19 nt, Homo sapiens
aaagaugacuggaacaaag

SEQ ID NO: 470248 - RNA, 19 nt, Homo sapiens
caacagacaugcaaaacuu

SEQ ID NO: 470249 - RNA, 19 nt, Homo sapiens
ugaaagguguuuauacaag

SEQ ID NO: 470250 - RNA, 19 nt, Homo sapiens
ccuccaaacuacugcauuu

SEQ ID NO: 470251 - RNA, 19 nt, Homo sapiens
ggcaagaacuacaagaagu

SEQ ID NO: 470252 - RNA, 19 nt, Homo sapiens
ccucaacaccuuacacuaa

SEQ ID NO: 470253 - RNA, 19 nt, Homo sapiens
gcaaacaugucagcaaugc

SEQ ID NO: 470254 - RNA, 19 nt, Homo sapiens
gcaaggaugaggaugagaa

SEQ ID NO: 470255 - RNA, 19 nt, Homo sapiens
uugaggagcuggagacuau

SEQ ID NO: 470256 - RNA, 19 nt, Homo sapiens
gagaaggaguccgagaaga

SEQ ID NO: 470257 - RNA, 19 nt, Homo sapiens
gaacaaaguguccgagcau

SEQ ID NO: 470258 - RNA, 19 nt, Homo sapiens
gaaauugagcccaaacuac

SEQ ID NO: 470259 - RNA, 19 nt, Homo sapiens
uggaggcacuggaaaugua

SEQ ID NO: 470260 - RNA, 19 nt, Homo sapiens
caaacuacuagggaaauua

SEQ ID NO: 470261 - RNA, 19 nt, Homo sapiens
gcagcugccuacaaauuca

SEQ ID NO: 470262 - RNA, 19 nt, Homo sapiens
ucaaggacuucuguuuaaa

SEQ ID NO: 470263 - RNA, 19 nt, Homo sapiens
uucaaggacuucuguuuaa

SEQ ID NO: 470264 - RNA, 19 nt, Homo sapiens
ggagaaggagccaaaggaa

SEQ ID NO: 470265 - RNA, 19 nt, Homo sapiens
gaggguccaugccuuccua

SEQ ID NO: 470266 - RNA, 19 nt, Homo sapiens
ggaaugcugcccuaaagga

SEQ ID NO: 470267 - RNA, 19 nt, Homo sapiens
ugaaugaggaagacuauga

SEQ ID NO: 470268 - RNA, 19 nt, Homo sapiens
gcagaauaauugccugucu

SEQ ID NO: 470269 - RNA, 19 nt, Homo sapiens
ggaccgcaauguggaaaug

SEQ ID NO: 470270 - RNA, 19 nt, Homo sapiens
ggguacaccucccuccaaa

SEQ ID NO: 470271 - RNA, 19 nt, Homo sapiens
gaaaccaacagacaugcaa

SEQ ID NO: 470272 - RNA, 19 nt, Homo sapiens
ugaccgaccuggaugaaca

SEQ ID NO: 470273 - RNA, 19 nt, Homo sapiens
gaggugaacagcccagauu

SEQ ID NO: 470274 - RNA, 19 nt, Homo sapiens
gaaucuagaagaagaggaa

SEQ ID NO: 470275 - RNA, 19 nt, Homo sapiens
ccaagaaggaugaggagaa

SEQ ID NO: 470276 - RNA, 19 nt, Homo sapiens
caauaguguucaugccauu

SEQ ID NO: 470277 - RNA, 19 nt, Homo sapiens
gaaugaggaagacuaugaa

SEQ ID NO: 470278 - RNA, 19 nt, Homo sapiens
cagcgaggcucccaagaag

SEQ ID NO: 470279 - RNA, 19 nt, Homo sapiens
ccacagaugagaagaagga

SEQ ID NO: 470280 - RNA, 19 nt, Homo sapiens
ccaaaacagucaacacaaa

SEQ ID NO: 470281 - RNA, 19 nt, Homo sapiens
ccaaacuacuagggaaauu

SEQ ID NO: 470282 - RNA, 19 nt, Homo sapiens
ggacuucuguuuaaaagau

SEQ ID NO: 470283 - RNA, 19 nt, Homo sapiens
gaccucugcuucccaacaa

SEQ ID NO: 470284 - RNA, 19 nt, Homo sapiens
ucaaugaauggaugaauga

SEQ ID NO: 470285 - RNA, 19 nt, Homo sapiens
gaucccagcgagugaaauu

SEQ ID NO: 470286 - RNA, 19 nt, Homo sapiens
ucacugaggauaagaacaa

SEQ ID NO: 470287 - RNA, 19 nt, Homo sapiens
gaagauuucagccaagaca

SEQ ID NO: 470288 - RNA, 19 nt, Homo sapiens
acauggagcagcugaagua

SEQ ID NO: 470289 - RNA, 19 nt, Homo sapiens
cagacaagccuuccacaug

SEQ ID NO: 470290 - RNA, 19 nt, Homo sapiens
gaggaaaggaagaucaaau

SEQ ID NO: 470291 - RNA, 19 nt, Homo sapiens
caagaaguauauacaagcu

SEQ ID NO: 470292 - RNA, 19 nt, Homo sapiens
gcuacaauuucaggaagaa

SEQ ID NO: 470293 - RNA, 19 nt, Homo sapiens
gcguuacgauuuccagaau

SEQ ID NO: 470294 - RNA, 19 nt, Homo sapiens
ccuacaaauucaagaguga

SEQ ID NO: 470295 - RNA, 19 nt, Homo sapiens
guacaguugcuacaauuuc

SEQ ID NO: 470296 - RNA, 19 nt, Homo sapiens
uggcaaacaugucagcaau

SEQ ID NO: 470297 - RNA, 19 nt, Homo sapiens
ggaugaaugaggaagacua

SEQ ID NO: 470298 - RNA, 19 nt, Homo sapiens
ggacaccgacaccuucaau

SEQ ID NO: 470299 - RNA, 19 nt, Homo sapiens
ggaagguucaugcaaagug

SEQ ID NO: 470300 - RNA, 19 nt, Homo sapiens
gaaugcugcccuaaaggaa

SEQ ID NO: 470301 - RNA, 19 nt, Homo sapiens
guucaucacuacguaagga

SEQ ID NO: 470302 - RNA, 19 nt, Homo sapiens
caacaaacuccucccucaa

SEQ ID NO: 470303 - RNA, 19 nt, Homo sapiens
gcgagaagcacuggaguau

SEQ ID NO: 470304 - RNA, 19 nt, Homo sapiens
caaagaugacuggaacaaa

SEQ ID NO: 470305 - RNA, 19 nt, Homo sapiens
cacuggaaauguacaaaga

SEQ ID NO: 470306 - RNA, 19 nt, Homo sapiens
ccagguggaugcugagagu

SEQ ID NO: 470307 - RNA, 19 nt, Homo sapiens
ccaagacuccagagaucua

SEQ ID NO: 470308 - RNA, 19 nt, Homo sapiens
guccaagacuccagagauc

SEQ ID NO: 470309 - RNA, 19 nt, Homo sapiens
cuaaacugccgaucaaaug

SEQ ID NO: 470310 - RNA, 19 nt, Homo sapiens
gcaauguggaaauguuuau

SEQ ID NO: 470311 - RNA, 19 nt, Homo sapiens
caaacuccucccucaauga

SEQ ID NO: 470312 - RNA, 19 nt, Homo sapiens
acaaacuccucccucaaug

SEQ ID NO: 470313 - RNA, 19 nt, Homo sapiens
gaucuuggcucuccugaua

SEQ ID NO: 470314 - RNA, 19 nt, Homo sapiens
gaagauggcugacaaaauu

SEQ ID NO: 470315 - RNA, 19 nt, Homo sapiens
gcagagacgacaagaauua

SEQ ID NO: 470316 - RNA, 19 nt, Homo sapiens
gagagaacauguaguggua

SEQ ID NO: 470317 - RNA, 19 nt, Homo sapiens
ggagacagcugggcacaaa

SEQ ID NO: 470318 - RNA, 19 nt, Homo sapiens
gcagggaccucaagacaau

SEQ ID NO: 470319 - RNA, 19 nt, Homo sapiens
gcacuguggcaauauauua

SEQ ID NO: 470320 - RNA, 19 nt, Homo sapiens
ggaacaaacucucccuuca

SEQ ID NO: 470321 - RNA, 19 nt, Homo sapiens
caagauccaugagacaaua

SEQ ID NO: 470322 - RNA, 19 nt, Homo sapiens
gugcuucucucacuccuua

SEQ ID NO: 470323 - RNA, 19 nt, Homo sapiens
gaaccuaucaucauuaauc

SEQ ID NO: 470324 - RNA, 19 nt, Homo sapiens
caaauaugaugccacuaaa

SEQ ID NO: 470325 - RNA, 19 nt, Homo sapiens
ugacugaugugguggguaa

SEQ ID NO: 470326 - RNA, 19 nt, Homo sapiens
gaacauguagugguaauga

SEQ ID NO: 470327 - RNA, 19 nt, Homo sapiens
cagaaccuaucaucauuaa

SEQ ID NO: 470328 - RNA, 19 nt, Homo sapiens
ccaaauaugaugccacuaa

SEQ ID NO: 470329 - RNA, 19 nt, Homo sapiens
caagcacuguggcaauaua

SEQ ID NO: 470330 - RNA, 19 nt, Homo sapiens
ugauugaacuggacaaaga

SEQ ID NO: 470331 - RNA, 19 nt, Homo sapiens
aaacggaagcugcgaauuu

SEQ ID NO: 470332 - RNA, 19 nt, Homo sapiens
ccucagaucugcccuaauc

SEQ ID NO: 470333 - RNA, 19 nt, Homo sapiens
ggcaauauauuaagacaca

SEQ ID NO: 470334 - RNA, 19 nt, Homo sapiens
agacccagaugaauucuuu

SEQ ID NO: 470335 - RNA, 19 nt, Homo sapiens
cauaggaccucuagauagu

SEQ ID NO: 470336 - RNA, 19 nt, Homo sapiens
ugaagagggucucacaaga

SEQ ID NO: 470337 - RNA, 19 nt, Homo sapiens
gauaacagaauccaauuuc

SEQ ID NO: 470338 - RNA, 19 nt, Homo sapiens
ucaaccagcugaagacuca

SEQ ID NO: 470339 - RNA, 19 nt, Homo sapiens
ccacaucaguauuggaguu

SEQ ID NO: 470340 - RNA, 19 nt, Homo sapiens
ggaaacggcuagauaucca

SEQ ID NO: 470341 - RNA, 19 nt, Homo sapiens
aaaccacaaugcaaagaaa

SEQ ID NO: 470342 - RNA, 19 nt, Homo sapiens
gguaaugagugcuuggaau

SEQ ID NO: 470343 - RNA, 19 nt, Homo sapiens
gagaacauguagugguaau

SEQ ID NO: 470344 - RNA, 19 nt, Homo sapiens
gaaaccacaaugcaaagaa

SEQ ID NO: 470345 - RNA, 19 nt, Homo sapiens
ccaaaucccucccuguucu

SEQ ID NO: 470346 - RNA, 19 nt, Homo sapiens
caaacucucccuucacuug

SEQ ID NO: 470347 - RNA, 19 nt, Homo sapiens
aaagacagcuuguuaugac

SEQ ID NO: 470348 - RNA, 19 nt, Homo sapiens
ucaagacaaugacugaugu

SEQ ID NO: 470349 - RNA, 19 nt, Homo sapiens
ggagauugcuacucuagac

SEQ ID NO: 470350 - RNA, 19 nt, Homo sapiens
gagaugugacucauucauu

SEQ ID NO: 470351 - RNA, 19 nt, Homo sapiens
ggaccucuagauaguguua

SEQ ID NO: 470352 - RNA, 19 nt, Homo sapiens
gccuagggcuggagaauag

SEQ ID NO: 470353 - RNA, 19 nt, Homo sapiens
gaaucuugccuuucccuuu

SEQ ID NO: 470354 - RNA, 19 nt, Homo sapiens
cagcagagacgacaagaau

SEQ ID NO: 470355 - RNA, 19 nt, Homo sapiens
gagcugaguucuacuucca

SEQ ID NO: 470356 - RNA, 19 nt, Homo sapiens
ccagaaccuaucaucauua

SEQ ID NO: 470357 - RNA, 19 nt, Homo sapiens
gggaguuugucaucuguga

SEQ ID NO: 470358 - RNA, 19 nt, Homo sapiens
ucuauaagcuaguugaucu

SEQ ID NO: 470359 - RNA, 19 nt, Homo sapiens
uaagucagaugccgaggau

SEQ ID NO: 470360 - RNA, 19 nt, Homo sapiens
auauggaucucuuggcuuu

SEQ ID NO: 470361 - RNA, 19 nt, Homo sapiens
gcucaguacuucccacagu

SEQ ID NO: 470362 - RNA, 19 nt, Homo sapiens
guaaugagugcuuggaaug

SEQ ID NO: 470363 - RNA, 19 nt, Homo sapiens
ccucaggguuucaucaaug

SEQ ID NO: 470364 - RNA, 19 nt, Homo sapiens
cagaaucccaggccuauau

SEQ ID NO: 470365 - RNA, 19 nt, Homo sapiens
gaaugaagagggucucaca

SEQ ID NO: 470366 - RNA, 19 nt, Homo sapiens
gcaggaccuugugaucuug

SEQ ID NO: 470367 - RNA, 19 nt, Homo sapiens
ggagaauagcgcugaguug

SEQ ID NO: 470368 - RNA, 19 nt, Homo sapiens
cugcaccaauucuugauuu

SEQ ID NO: 470369 - RNA, 19 nt, Homo sapiens
uuaaucaugucaucagugu

SEQ ID NO: 470370 - RNA, 19 nt, Homo sapiens
caucauuaaucaugucauc

SEQ ID NO: 470371 - RNA, 19 nt, Homo sapiens
ucaaaggauucgugaacug

SEQ ID NO: 470372 - RNA, 19 nt, Homo sapiens
ggaguuuuguucuuuauug

SEQ ID NO: 470373 - RNA, 19 nt, Homo sapiens
cuacauaggaccucuagau

SEQ ID NO: 470374 - RNA, 19 nt, Homo sapiens
uccaagcacuguggcaaua

SEQ ID NO: 470375 - RNA, 19 nt, Homo sapiens
gauucagccuuguccaaau

SEQ ID NO: 470376 - RNA, 19 nt, Homo sapiens
agaugugacucauucauuc

SEQ ID NO: 470377 - RNA, 19 nt, Homo sapiens
uacauaggaccucuagaua

SEQ ID NO: 470378 - RNA, 19 nt, Homo sapiens
uuaaguccuuggugauuga

SEQ ID NO: 470379 - RNA, 19 nt, Homo sapiens
auucagccuuguccaaaua

SEQ ID NO: 470380 - RNA, 19 nt, Homo sapiens
caggagagccucacauucu

SEQ ID NO: 470381 - RNA, 19 nt, Homo sapiens
gaauccaauuuccuuccuu

SEQ ID NO: 470382 - RNA, 19 nt, Homo sapiens
ugauucgacugcaccaauu

SEQ ID NO: 470383 - RNA, 19 nt, Homo sapiens
ugaagacccagaugaauuc

SEQ ID NO: 470384 - RNA, 19 nt, Homo sapiens
gacagcuuguuaugacauu

SEQ ID NO: 470385 - RNA, 19 nt, Homo sapiens
ggauucagccuuguccaaa

SEQ ID NO: 470386 - RNA, 19 nt, Homo sapiens
ugaggaaacggcuagauau

SEQ ID NO: 470387 - RNA, 19 nt, Homo sapiens
aaucuugccuuucccuuuc

SEQ ID NO: 470388 - RNA, 19 nt, Homo sapiens
aaaagaagauggcugacaa

SEQ ID NO: 470389 - RNA, 19 nt, Homo sapiens
gcgccgagcugaguucuac

SEQ ID NO: 470390 - RNA, 19 nt, Homo sapiens
uuauugauguuacccaguu

SEQ ID NO: 470391 - RNA, 19 nt, Homo sapiens
gcuguugguucaaggacaa

SEQ ID NO: 470392 - RNA, 19 nt, Homo sapiens
cgacugcaccaauucuuga

SEQ ID NO: 470393 - RNA, 19 nt, Homo sapiens
caacaagauccaugagaca

SEQ ID NO: 470394 - RNA, 19 nt, Homo sapiens
ugacccgaaugaucagaaa

SEQ ID NO: 470395 - RNA, 19 nt, Homo sapiens
gaacaaacucucccuucac

SEQ ID NO: 470396 - RNA, 19 nt, Homo sapiens
ucucacaagacaccuguua

SEQ ID NO: 470397 - RNA, 19 nt, Homo sapiens
gccgauacuucuacuccaa

SEQ ID NO: 470398 - RNA, 19 nt, Homo sapiens
accagaaccuaucaucauu

SEQ ID NO: 470399 - RNA, 19 nt, Homo sapiens
uaugaugccacuaaacaaa

SEQ ID NO: 470400 - RNA, 19 nt, Homo sapiens
agagagagaacauguagug

SEQ ID NO: 470401 - RNA, 19 nt, Homo sapiens
aaucaugucaucaguguug

SEQ ID NO: 470402 - RNA, 19 nt, Homo sapiens
agaaggaagcucaguacuu

SEQ ID NO: 470403 - RNA, 19 nt, Homo sapiens
gcuggaaccaugagaagga

SEQ ID NO: 470404 - RNA, 19 nt, Homo sapiens
gcucuaaacccacagaacu

SEQ ID NO: 470405 - RNA, 19 nt, Homo sapiens
gcgcugaguuggguuugug

SEQ ID NO: 470406 - RNA, 19 nt, Homo sapiens
caauagaaaccaucaacca

SEQ ID NO: 470407 - RNA, 19 nt, Homo sapiens
gaggaaacggcuagauauc

SEQ ID NO: 470408 - RNA, 19 nt, Homo sapiens
cuagauaguguuagagaga

SEQ ID NO: 470409 - RNA, 19 nt, Homo sapiens
ucacaagacaccuguuauc

SEQ ID NO: 470410 - RNA, 19 nt, Homo sapiens
aaggauucgugaacuggua

SEQ ID NO: 470411 - RNA, 19 nt, Homo sapiens
gcccugggaauccggaaua

SEQ ID NO: 470412 - RNA, 19 nt, Homo sapiens
gacaacaagauccaugaga

SEQ ID NO: 470413 - RNA, 19 nt, Homo sapiens
gaucuuggcucuccugaua

SEQ ID NO: 470414 - RNA, 19 nt, Homo sapiens
gaagauggcugacaaaauu

SEQ ID NO: 470415 - RNA, 19 nt, Homo sapiens
gcagagacgacaagaauua

SEQ ID NO: 470416 - RNA, 19 nt, Homo sapiens
gagagaacauguaguggua

SEQ ID NO: 470417 - RNA, 19 nt, Homo sapiens
ggagacagcugggcacaaa

SEQ ID NO: 470418 - RNA, 19 nt, Homo sapiens
gcacuguggcaauauauua

SEQ ID NO: 470419 - RNA, 19 nt, Homo sapiens
ggaacaaacucucccuuca

SEQ ID NO: 470420 - RNA, 19 nt, Homo sapiens
gugcuucucucacuccuua

SEQ ID NO: 470421 - RNA, 19 nt, Homo sapiens
gaaccuaucaucauuaauc

SEQ ID NO: 470422 - RNA, 19 nt, Homo sapiens
caaauaugaugccacuaaa

SEQ ID NO: 470423 - RNA, 19 nt, Homo sapiens
ugacugaugugguggguaa

SEQ ID NO: 470424 - RNA, 19 nt, Homo sapiens
gaacauguagugguaauga

SEQ ID NO: 470425 - RNA, 19 nt, Homo sapiens
cagaaccuaucaucauuaa

SEQ ID NO: 470426 - RNA, 19 nt, Homo sapiens
ccaaauaugaugccacuaa

SEQ ID NO: 470427 - RNA, 19 nt, Homo sapiens
caagcacuguggcaauaua

SEQ ID NO: 470428 - RNA, 19 nt, Homo sapiens
ugauugaacuggacaaaga

SEQ ID NO: 470429 - RNA, 19 nt, Homo sapiens
aaacggaagcugcgaauuu

SEQ ID NO: 470430 - RNA, 19 nt, Homo sapiens
ccucagaucugcccuaauc

SEQ ID NO: 470431 - RNA, 19 nt, Homo sapiens
ggcaauauauuaagacaca

SEQ ID NO: 470432 - RNA, 19 nt, Homo sapiens
agacccagaugaauucuuu

SEQ ID NO: 470433 - RNA, 19 nt, Homo sapiens
cauaggaccucuagauagu

SEQ ID NO: 470434 - RNA, 19 nt, Homo sapiens
ugaagagggucucacaaga

SEQ ID NO: 470435 - RNA, 19 nt, Homo sapiens
gauaacagaauccaauuuc

SEQ ID NO: 470436 - RNA, 19 nt, Homo sapiens
ccacaucaguauuggaguu

SEQ ID NO: 470437 - RNA, 19 nt, Homo sapiens
ggaaacggcuagauaucca

SEQ ID NO: 470438 - RNA, 19 nt, Homo sapiens
aaaccacaaugcaaagaaa

SEQ ID NO: 470439 - RNA, 19 nt, Homo sapiens
gguaaugagugcuuggaau

SEQ ID NO: 470440 - RNA, 19 nt, Homo sapiens
gagaacauguagugguaau

SEQ ID NO: 470441 - RNA, 19 nt, Homo sapiens
gaaaccacaaugcaaagaa

SEQ ID NO: 470442 - RNA, 19 nt, Homo sapiens
ccaaaucccucccuguucu

SEQ ID NO: 470443 - RNA, 19 nt, Homo sapiens
caaacucucccuucacuug

SEQ ID NO: 470444 - RNA, 19 nt, Homo sapiens
aaagacagcuuguuaugac

SEQ ID NO: 470445 - RNA, 19 nt, Homo sapiens
ggagauugcuacucuagac

SEQ ID NO: 470446 - RNA, 19 nt, Homo sapiens
gagaugugacucauucauu

SEQ ID NO: 470447 - RNA, 19 nt, Homo sapiens
ggaccucuagauaguguua

SEQ ID NO: 470448 - RNA, 19 nt, Homo sapiens
gccuagggcuggagaauag

SEQ ID NO: 470449 - RNA, 19 nt, Homo sapiens
gaaucuugccuuucccuuu

SEQ ID NO: 470450 - RNA, 19 nt, Homo sapiens
cagcagagacgacaagaau

SEQ ID NO: 470451 - RNA, 19 nt, Homo sapiens
gagcugaguucuacuucca

SEQ ID NO: 470452 - RNA, 19 nt, Homo sapiens
ccagaaccuaucaucauua

SEQ ID NO: 470453 - RNA, 19 nt, Homo sapiens
gggaguuugucaucuguga

SEQ ID NO: 470454 - RNA, 19 nt, Homo sapiens
ucuauaagcuaguugaucu

SEQ ID NO: 470455 - RNA, 19 nt, Homo sapiens
uaagucagaugccgaggau

SEQ ID NO: 470456 - RNA, 19 nt, Homo sapiens
auauggaucucuuggcuuu

SEQ ID NO: 470457 - RNA, 19 nt, Homo sapiens
gcucaguacuucccacagu

SEQ ID NO: 470458 - RNA, 19 nt, Homo sapiens
guaaugagugcuuggaaug

SEQ ID NO: 470459 - RNA, 19 nt, Homo sapiens
acaagacaaugacugaugu

SEQ ID NO: 470460 - RNA, 19 nt, Homo sapiens
cagaaucccaggccuauau

SEQ ID NO: 470461 - RNA, 19 nt, Homo sapiens
gaaugaagagggucucaca

SEQ ID NO: 470462 - RNA, 19 nt, Homo sapiens
gcaggaccuugugaucuug

SEQ ID NO: 470463 - RNA, 19 nt, Homo sapiens
ggagaauagcgcugaguug

SEQ ID NO: 470464 - RNA, 19 nt, Homo sapiens
cugcaccaauucuugauuu

SEQ ID NO: 470465 - RNA, 19 nt, Homo sapiens
uuaaucaugucaucagugu

SEQ ID NO: 470466 - RNA, 19 nt, Homo sapiens
caucauuaaucaugucauc

SEQ ID NO: 470467 - RNA, 19 nt, Homo sapiens
ucaaaggauucgugaacug

SEQ ID NO: 470468 - RNA, 19 nt, Homo sapiens
ggaguuuuguucuuuauug

SEQ ID NO: 470469 - RNA, 19 nt, Homo sapiens
cuacauaggaccucuagau

SEQ ID NO: 470470 - RNA, 19 nt, Homo sapiens
uccaagcacuguggcaaua

SEQ ID NO: 470471 - RNA, 19 nt, Homo sapiens
gauucagccuuguccaaau

SEQ ID NO: 470472 - RNA, 19 nt, Homo sapiens
agaugugacucauucauuc

SEQ ID NO: 470473 - RNA, 19 nt, Homo sapiens
uacauaggaccucuagaua

SEQ ID NO: 470474 - RNA, 19 nt, Homo sapiens
uuaaguccuuggugauuga

SEQ ID NO: 470475 - RNA, 19 nt, Homo sapiens
auucagccuuguccaaaua

SEQ ID NO: 470476 - RNA, 19 nt, Homo sapiens
caggagagccucacauucu

SEQ ID NO: 470477 - RNA, 19 nt, Homo sapiens
gaauccaauuuccuuccuu

SEQ ID NO: 470478 - RNA, 19 nt, Homo sapiens
ugauucgacugcaccaauu

SEQ ID NO: 470479 - RNA, 19 nt, Homo sapiens
ugaagacccagaugaauuc

SEQ ID NO: 470480 - RNA, 19 nt, Homo sapiens
gacagcuuguuaugacauu

SEQ ID NO: 470481 - RNA, 19 nt, Homo sapiens
ggauucagccuuguccaaa

SEQ ID NO: 470482 - RNA, 19 nt, Homo sapiens
ugaggaaacggcuagauau

SEQ ID NO: 470483 - RNA, 19 nt, Homo sapiens
aaucuugccuuucccuuuc

SEQ ID NO: 470484 - RNA, 19 nt, Homo sapiens
aaaagaagauggcugacaa

SEQ ID NO: 470485 - RNA, 19 nt, Homo sapiens
gcgccgagcugaguucuac

SEQ ID NO: 470486 - RNA, 19 nt, Homo sapiens
uuauugauguuacccaguu

SEQ ID NO: 470487 - RNA, 19 nt, Homo sapiens
gcuguugguucaaggacaa

SEQ ID NO: 470488 - RNA, 19 nt, Homo sapiens
cgacugcaccaauucuuga

SEQ ID NO: 470489 - RNA, 19 nt, Homo sapiens
ugacccgaaugaucagaaa

SEQ ID NO: 470490 - RNA, 19 nt, Homo sapiens
gaacaaacucucccuucac

SEQ ID NO: 470491 - RNA, 19 nt, Homo sapiens
ucucacaagacaccuguua

SEQ ID NO: 470492 - RNA, 19 nt, Homo sapiens
gccgauacuucuacuccaa

SEQ ID NO: 470493 - RNA, 19 nt, Homo sapiens
cuagacaacaagacaauga

SEQ ID NO: 470494 - RNA, 19 nt, Homo sapiens
accagaaccuaucaucauu

SEQ ID NO: 470495 - RNA, 19 nt, Homo sapiens
uaugaugccacuaaacaaa

SEQ ID NO: 470496 - RNA, 19 nt, Homo sapiens
agagagagaacauguagug

SEQ ID NO: 470497 - RNA, 19 nt, Homo sapiens
acaacaagacaaugacuga

SEQ ID NO: 470498 - RNA, 19 nt, Homo sapiens
aaucaugucaucaguguug

SEQ ID NO: 470499 - RNA, 19 nt, Homo sapiens
agaaggaagcucaguacuu

SEQ ID NO: 470500 - RNA, 19 nt, Homo sapiens
gcuggaaccaugagaagga

SEQ ID NO: 470501 - RNA, 19 nt, Homo sapiens
gcucuaaacccacagaacu

SEQ ID NO: 470502 - RNA, 19 nt, Homo sapiens
gcgcugaguuggguuugug

SEQ ID NO: 470503 - RNA, 19 nt, Homo sapiens
gaggaaacggcuagauauc

SEQ ID NO: 470504 - RNA, 19 nt, Homo sapiens
cuagauaguguuagagaga

SEQ ID NO: 470505 - RNA, 19 nt, Homo sapiens
ucacaagacaccuguuauc

SEQ ID NO: 470506 - RNA, 19 nt, Homo sapiens
gcccugggaauccggaaua

SEQ ID NO: 470507 - RNA, 19 nt, Homo sapiens
aauucuaccucaaaggauu

SEQ ID NO: 470508 - RNA, 19 nt, Homo sapiens
aaggauucgugaacuggua

SEQ ID NO: 470509 - RNA, 19 nt, Homo sapiens
gagccucacauucuucuuc

SEQ ID NO: 470510 - RNA, 19 nt, Homo sapiens
gaaacgggccuaaaaccaa

SEQ ID NO: 470511 - RNA, 19 nt, Homo sapiens
ucccuugucugcccaguug

SEQ ID NO: 470512 - RNA, 19 nt, Homo sapiens
uuggagaugugacucauuc

SEQ ID NO: 470513 - RNA, 19 nt, Homo sapiens
ggaggaagauggcagauaa

SEQ ID NO: 470514 - RNA, 19 nt, Homo sapiens
acagauggcuuccaaguaa

SEQ ID NO: 470515 - RNA, 19 nt, Homo sapiens
gaauuaagaucgccaaguc

SEQ ID NO: 470516 - RNA, 19 nt, Homo sapiens
gaagauggcagauaagguu

SEQ ID NO: 470517 - RNA, 19 nt, Homo sapiens
ggagacagauggcuuccaa

SEQ ID NO: 470518 - RNA, 19 nt, Homo sapiens
gagacgagcugcuuucuac

SEQ ID NO: 470519 - RNA, 19 nt, Homo sapiens
gagauuucaugcucaguuu

SEQ ID NO: 470520 - RNA, 19 nt, Homo sapiens
ccucuacucuccagcuuua

SEQ ID NO: 470521 - RNA, 19 nt, Homo sapiens
ggacugguguugcccuuug

SEQ ID NO: 470522 - RNA, 19 nt, Homo sapiens
ucauugagcuggacaagga

SEQ ID NO: 470523 - RNA, 19 nt, Homo sapiens
gugaggaacucgcgaacuu

SEQ ID NO: 470524 - RNA, 19 nt, Homo sapiens
uuaagagccucgucauuga

SEQ ID NO: 470525 - RNA, 19 nt, Homo sapiens
gaacaggugcugggaauuc

SEQ ID NO: 470526 - RNA, 19 nt, Homo sapiens
gggaguacaucaacugcaa

SEQ ID NO: 470527 - RNA, 19 nt, Homo sapiens
gagaucgccucccuugaug

SEQ ID NO: 470528 - RNA, 19 nt, Homo sapiens
acauggaucucuuggcuuu

SEQ ID NO: 470529 - RNA, 19 nt, Homo sapiens
gcaaacagaagaggaaguu

SEQ ID NO: 470530 - RNA, 19 nt, Homo sapiens
ggaucuacauuuccaauac

SEQ ID NO: 470531 - RNA, 19 nt, Homo sapiens
caagauccaugagaccauu

SEQ ID NO: 470532 - RNA, 19 nt, Homo sapiens
gcuggaggcugugcuuuga

SEQ ID NO: 470533 - RNA, 19 nt, Homo sapiens
ccacugaaggcccaaauga

SEQ ID NO: 470534 - RNA, 19 nt, Homo sapiens
gcugugcuuugacauugua

SEQ ID NO: 470535 - RNA, 19 nt, Homo sapiens
gaauucgccugaccuaacu

SEQ ID NO: 470536 - RNA, 19 nt, Homo sapiens
caucaaccaugucauuagu

SEQ ID NO: 470537 - RNA, 19 nt, Homo sapiens
accaaaggcugcuggguuu

SEQ ID NO: 470538 - RNA, 19 nt, Homo sapiens
cgccagaucuucaguugug

SEQ ID NO: 470539 - RNA, 19 nt, Homo sapiens
gauccuagcaaacagaaga

SEQ ID NO: 470540 - RNA, 19 nt, Homo sapiens
gacagauggcuuccaagua

SEQ ID NO: 470541 - RNA, 19 nt, Homo sapiens
ggaauucgccugaccuaac

SEQ ID NO: 470542 - RNA, 19 nt, Homo sapiens
gaaccgggucugugaggaa

SEQ ID NO: 470543 - RNA, 19 nt, Homo sapiens
caacugcaaccguuacuuc

SEQ ID NO: 470544 - RNA, 19 nt, Homo sapiens
guuaggugccuccuucuuu

SEQ ID NO: 470545 - RNA, 19 nt, Homo sapiens
gauggcagauaagguucua

SEQ ID NO: 470546 - RNA, 19 nt, Homo sapiens
gcuuugacauuguaagaca

SEQ ID NO: 470547 - RNA, 19 nt, Homo sapiens
uuaauuggguucagcagau

SEQ ID NO: 470548 - RNA, 19 nt, Homo sapiens
gagcccggaucgacaaauc

SEQ ID NO: 470549 - RNA, 19 nt, Homo sapiens
uaacugcucagggaucuuu

SEQ ID NO: 470550 - RNA, 19 nt, Homo sapiens
ucaaccaugucauuagugu

SEQ ID NO: 470551 - RNA, 19 nt, Homo sapiens
uuggguauuugcacuauuu

SEQ ID NO: 470552 - RNA, 19 nt, Homo sapiens
cugcuggguuugcauguuu

SEQ ID NO: 470553 - RNA, 19 nt, Homo sapiens
ggagagacgagcugcuuuc

SEQ ID NO: 470554 - RNA, 19 nt, Homo sapiens
cagauggcuuccaaguaaa

SEQ ID NO: 470555 - RNA, 19 nt, Homo sapiens
ggguuugcauguuuacaga

SEQ ID NO: 470556 - RNA, 19 nt, Homo sapiens
guaagacauuuccgaacca

SEQ ID NO: 470557 - RNA, 19 nt, Homo sapiens
uagcauggccugagguaug

SEQ ID NO: 470558 - RNA, 19 nt, Homo sapiens
gcaguaggcaggcacaucu

SEQ ID NO: 470559 - RNA, 19 nt, Homo sapiens
gauccaggaggccaucaaa

SEQ ID NO: 470560 - RNA, 19 nt, Homo sapiens
uggaacaggugcugggaau

SEQ ID NO: 470561 - RNA, 19 nt, Homo sapiens
uuuaagagccucgucauug

SEQ ID NO: 470562 - RNA, 19 nt, Homo sapiens
aaggaaaacugcuggauga

SEQ ID NO: 470563 - RNA, 19 nt, Homo sapiens
aaaagccucugacacaaaa

SEQ ID NO: 470564 - RNA, 19 nt, Homo sapiens
ggacacuccaguucucuag

SEQ ID NO: 470565 - RNA, 19 nt, Homo sapiens
uaagacauuuccgaaccaa

SEQ ID NO: 470566 - RNA, 19 nt, Homo sapiens
gaggagagacgagcugcuu

SEQ ID NO: 470567 - RNA, 19 nt, Homo sapiens
ugaagacccagagagauuu

SEQ ID NO: 470568 - RNA, 19 nt, Homo sapiens
ucuggcagguuuggaaauu

SEQ ID NO: 470569 - RNA, 19 nt, Homo sapiens
cugaagacccagagagauu

SEQ ID NO: 470570 - RNA, 19 nt, Homo sapiens
ucgcgaacuuggauuagga

SEQ ID NO: 470571 - RNA, 19 nt, Homo sapiens
aagcuucggaucuacauuu

SEQ ID NO: 470572 - RNA, 19 nt, Homo sapiens
gaaagcuucggaucuacau

SEQ ID NO: 470573 - RNA, 19 nt, Homo sapiens
uggcagguuuggaaauuuc

SEQ ID NO: 470574 - RNA, 19 nt, Homo sapiens
ugucaucaaccaugucauu

SEQ ID NO: 470575 - RNA, 19 nt, Homo sapiens
cuggagaccucaacgucaa

SEQ ID NO: 470576 - RNA, 19 nt, Homo sapiens
ggaauuaagaucgccaagu

SEQ ID NO: 470577 - RNA, 19 nt, Homo sapiens
gaucuacauuuccaauacg

SEQ ID NO: 470578 - RNA, 19 nt, Homo sapiens
ggaacucgcgaacuuggau

SEQ ID NO: 470579 - RNA, 19 nt, Homo sapiens
gaaggcaggaacuggaaca

SEQ ID NO: 470580 - RNA, 19 nt, Homo sapiens
gaagacccagagagauuuc

SEQ ID NO: 470581 - RNA, 19 nt, Homo sapiens
gaacucgcgaacuuggauu

SEQ ID NO: 470582 - RNA, 19 nt, Homo sapiens
gaggcugugcuuugacauu

SEQ ID NO: 470583 - RNA, 19 nt, Homo sapiens
gcaauuuucuggccucuac

SEQ ID NO: 470584 - RNA, 19 nt, Homo sapiens
gucaucaaccaugucauua

SEQ ID NO: 470585 - RNA, 19 nt, Homo sapiens
gggcaggagcggaaucugu

SEQ ID NO: 470586 - RNA, 19 nt, Homo sapiens
ggagcaaguuuucuaugug

SEQ ID NO: 470587 - RNA, 19 nt, Homo sapiens
gggagcaaguuuucuaugu

SEQ ID NO: 470588 - RNA, 19 nt, Homo sapiens
gcgaaggcaggaacuggaa

SEQ ID NO: 470589 - RNA, 19 nt, Homo sapiens
guaggcaggcacaucuuug

SEQ ID NO: 470590 - RNA, 19 nt, Homo sapiens
gaugucaagauccaugaga

SEQ ID NO: 470591 - RNA, 19 nt, Homo sapiens
gagcgggaguacaucaacu

SEQ ID NO: 470592 - RNA, 19 nt, Homo sapiens
ggaagauggcagauaaggu

SEQ ID NO: 470593 - RNA, 19 nt, Homo sapiens
cguagccgccucuggguaa

SEQ ID NO: 470594 - RNA, 19 nt, Homo sapiens
uaauuggguucagcagaug

SEQ ID NO: 470595 - RNA, 19 nt, Homo sapiens
gaugauccuagcaaacaga

SEQ ID NO: 470596 - RNA, 19 nt, Homo sapiens
gcugcuggguuugcauguu

SEQ ID NO: 470597 - RNA, 19 nt, Homo sapiens
aggcugugcuuugacauug

SEQ ID NO: 470598 - RNA, 19 nt, Homo sapiens
gauuucaugcucaguuuua

SEQ ID NO: 470599 - RNA, 19 nt, Homo sapiens
ccaccaaucagcaggagau

SEQ ID NO: 470600 - RNA, 19 nt, Homo sapiens
ccauugucaucaaccaugu

SEQ ID NO: 470601 - RNA, 19 nt, Homo sapiens
ggagcuuguuccagagucu

SEQ ID NO: 470602 - RNA, 19 nt, Homo sapiens
acacuccaguucucuagca

SEQ ID NO: 470603 - RNA, 19 nt, Homo sapiens
ugucugcugucacccucua

SEQ ID NO: 470604 - RNA, 19 nt, Homo sapiens
agacauuuccgaaccaaag

SEQ ID NO: 470605 - RNA, 19 nt, Homo sapiens
agacagauggcuuccaagu

SEQ ID NO: 470606 - RNA, 19 nt, Homo sapiens
cuagcaaacagaagaggaa

SEQ ID NO: 470607 - RNA, 19 nt, Homo sapiens
gugcuuugacauuguaaga

SEQ ID NO: 470608 - RNA, 19 nt, Homo sapiens
ugaggagugucugcuguca

SEQ ID NO: 470609 - RNA, 19 nt, Homo sapiens
ggaacaggugcugggaauu

SEQ ID NO: 470610 - RNA, 19 nt, Homo sapiens
ggacuucauccaggaaugg

SEQ ID NO: 470611 - RNA, 19 nt, Homo sapiens
gaucgccucccuugauguc

SEQ ID NO: 470612 - RNA, 19 nt, Homo sapiens
gacccuaacgaccagaaga

SEQ ID NO: 470613 - RNA, 19 nt, Homo sapiens
ggaggaagauggcugacaa

SEQ ID NO: 470614 - RNA, 19 nt, Homo sapiens
gaagauggcugacaaaauc

SEQ ID NO: 470615 - RNA, 19 nt, Homo sapiens
ucagugcucuggacaguaa

SEQ ID NO: 470616 - RNA, 19 nt, Homo sapiens
cagagggacuucaugcuaa

SEQ ID NO: 470617 - RNA, 19 nt, Homo sapiens
gagcagauccucagaaugg

SEQ ID NO: 470618 - RNA, 19 nt, Homo sapiens
ggacucccaugacaaggaa

SEQ ID NO: 470619 - RNA, 19 nt, Homo sapiens
ucaucgagcuggacaaaga

SEQ ID NO: 470620 - RNA, 19 nt, Homo sapiens
gacaaggaauacaucaaug

SEQ ID NO: 470621 - RNA, 19 nt, Homo sapiens
gggagcagauccucagaau

SEQ ID NO: 470622 - RNA, 19 nt, Homo sapiens
gcaaacagaagcggaaguu

SEQ ID NO: 470623 - RNA, 19 nt, Homo sapiens
gaucagugcucuggacagu

SEQ ID NO: 470624 - RNA, 19 nt, Homo sapiens
uaagauccaugagacgauu

SEQ ID NO: 470625 - RNA, 19 nt, Homo sapiens
ggagguggaggagccauua

SEQ ID NO: 470626 - RNA, 19 nt, Homo sapiens
uaaaccagcucaagaucca

SEQ ID NO: 470627 - RNA, 19 nt, Homo sapiens
gagaggaaacuggaucaaa

SEQ ID NO: 470628 - RNA, 19 nt, Homo sapiens
caaaggcuauguccaagac

SEQ ID NO: 470629 - RNA, 19 nt, Homo sapiens
ccagagggacuucaugcua

SEQ ID NO: 470630 - RNA, 19 nt, Homo sapiens
ggcaguaugugaagaccaa

SEQ ID NO: 470631 - RNA, 19 nt, Homo sapiens
ucaaggugaugacagaugu

SEQ ID NO: 470632 - RNA, 19 nt, Homo sapiens
acauggaccucuuggcauu

SEQ ID NO: 470633 - RNA, 19 nt, Homo sapiens
gaugaucccagcaaacaga

SEQ ID NO: 470634 - RNA, 19 nt, Homo sapiens
gaugagcagcuuccuccua

SEQ ID NO: 470635 - RNA, 19 nt, Homo sapiens
ugacaaggaauacaucaau

SEQ ID NO: 470636 - RNA, 19 nt, Homo sapiens
agaggaaacuggaucaaac

SEQ ID NO: 470637 - RNA, 19 nt, Homo sapiens
ggaagcugcgacucuauau

SEQ ID NO: 470638 - RNA, 19 nt, Homo sapiens
gacaaaauccucccucaaa

SEQ ID NO: 470639 - RNA, 19 nt, Homo sapiens
ccucacagcccugcuauug

SEQ ID NO: 470640 - RNA, 19 nt, Homo sapiens
acaaguauuuccagcagau

SEQ ID NO: 470641 - RNA, 19 nt, Homo sapiens
gcaggacucccaugacaag

SEQ ID NO: 470642 - RNA, 19 nt, Homo sapiens
ugaagaggcccaugaagca

SEQ ID NO: 470643 - RNA, 19 nt, Homo sapiens
ccauaaaccagcucaagau

SEQ ID NO: 470644 - RNA, 19 nt, Homo sapiens
gaagaggcccaugaagcaa

SEQ ID NO: 470645 - RNA, 19 nt, Homo sapiens
gacaguaagauccaugaga

SEQ ID NO: 470646 - RNA, 19 nt, Homo sapiens
caauugucaucaaccaugu

SEQ ID NO: 470647 - RNA, 19 nt, Homo sapiens
gcacgcugcuccucaugcu

SEQ ID NO: 470648 - RNA, 19 nt, Homo sapiens
cggaagcugcgacucuaua

SEQ ID NO: 470649 - RNA, 19 nt, Homo sapiens
ggucaucgagcuggacaaa

SEQ ID NO: 470650 - RNA, 19 nt, Homo sapiens
gaggaagauggcugacaaa

SEQ ID NO: 470651 - RNA, 19 nt, Homo sapiens
gagacgauugaguccauaa

SEQ ID NO: 470652 - RNA, 19 nt, Homo sapiens
cugcaggacucccaugaca

SEQ ID NO: 470653 - RNA, 19 nt, Homo sapiens
augagcagcuuccuccuau

SEQ ID NO: 470654 - RNA, 19 nt, Homo sapiens
gcagcacgacggaacuuuc

SEQ ID NO: 470655 - RNA, 19 nt, Homo sapiens
ugagacgauugaguccaua

SEQ ID NO: 470656 - RNA, 19 nt, Homo sapiens
ggacggcuuccaggugaaa

SEQ ID NO: 470657 - RNA, 19 nt, Homo sapiens
ucaagaguuuggucaucga

SEQ ID NO: 470658 - RNA, 19 nt, Homo sapiens
ccaaaggcuauguccaaga

SEQ ID NO: 470659 - RNA, 19 nt, Homo sapiens
guguggggcuggauuaaaa

SEQ ID NO: 470660 - RNA, 19 nt, Homo sapiens
guucucuucuuucuucaag

SEQ ID NO: 470661 - RNA, 19 nt, Homo sapiens
ggauuccgacggcagcauu

SEQ ID NO: 470662 - RNA, 19 nt, Homo sapiens
cucuauaucuccaacacuu

SEQ ID NO: 470663 - RNA, 19 nt, Homo sapiens
gagguggaggagccauuaa

SEQ ID NO: 470664 - RNA, 19 nt, Homo sapiens
gcugaaguuuucugagauu

SEQ ID NO: 470665 - RNA, 19 nt, Homo sapiens
gggaagcuccuggaugauc

SEQ ID NO: 470666 - RNA, 19 nt, Homo sapiens
ucaauggggacaaguauuu

SEQ ID NO: 470667 - RNA, 19 nt, Homo sapiens
gaagcugcgacucuauauc

SEQ ID NO: 470668 - RNA, 19 nt, Homo sapiens
gggacuucaugcuaagcuu

SEQ ID NO: 470669 - RNA, 19 nt, Homo sapiens
guaagauccaugagacgau

SEQ ID NO: 470670 - RNA, 19 nt, Homo sapiens
ggaaacuggaucaaaccau

SEQ ID NO: 470671 - RNA, 19 nt, Homo sapiens
ggaagauggcugacaaaau

SEQ ID NO: 470672 - RNA, 19 nt, Homo sapiens
cagcacgacggaacuuuca

SEQ ID NO: 470673 - RNA, 19 nt, Homo sapiens
caaggugaugacagaugua

SEQ ID NO: 470674 - RNA, 19 nt, Homo sapiens
cauaaaccagcucaagauc

SEQ ID NO: 470675 - RNA, 19 nt, Homo sapiens
ggagcagauccucagaaug

SEQ ID NO: 470676 - RNA, 19 nt, Homo sapiens
gcugcacgcugcuccucau

SEQ ID NO: 470677 - RNA, 19 nt, Homo sapiens
gauccagagggacuucaug

SEQ ID NO: 470678 - RNA, 19 nt, Homo sapiens
aggcuuacauggaccucuu

SEQ ID NO: 470679 - RNA, 19 nt, Homo sapiens
gguggaggagccauuaaag

SEQ ID NO: 470680 - RNA, 19 nt, Homo sapiens
aagcugcgacucuauaucu

SEQ ID NO: 470681 - RNA, 19 nt, Homo sapiens
ggaagaaagucgacagaga

SEQ ID NO: 470682 - RNA, 19 nt, Homo sapiens
ggaaagcacagauucauuu

SEQ ID NO: 470683 - RNA, 19 nt, Homo sapiens
uuacgugguuuguguauua

SEQ ID NO: 470684 - RNA, 19 nt, Homo sapiens
gaauaaguguugccuuguu

SEQ ID NO: 470685 - RNA, 19 nt, Homo sapiens
gaaagcacagauucauuua

SEQ ID NO: 470686 - RNA, 19 nt, Homo sapiens
ugucucagauucauucuua

SEQ ID NO: 470687 - RNA, 19 nt, Homo sapiens
gaugauggcuuuucaauga

SEQ ID NO: 470688 - RNA, 19 nt, Homo sapiens
gaacugagaacuuaaucuu

SEQ ID NO: 470689 - RNA, 19 nt, Homo sapiens
gaaggaaccagugauagua

SEQ ID NO: 470690 - RNA, 19 nt, Homo sapiens
guaccuugcuuacauaaau

SEQ ID NO: 470691 - RNA, 19 nt, Homo sapiens
ggcgagaucucacugauga

SEQ ID NO: 470692 - RNA, 19 nt, Homo sapiens
ucagugaaauucuuaguga

SEQ ID NO: 470693 - RNA, 19 nt, Homo sapiens
caacagagagccaacagaa

SEQ ID NO: 470694 - RNA, 19 nt, Homo sapiens
gaaagacgacgagaacauu

SEQ ID NO: 470695 - RNA, 19 nt, Homo sapiens
gaagaaagacgacgagaac

SEQ ID NO: 470696 - RNA, 19 nt, Homo sapiens
gagauuggcaagauuauug

SEQ ID NO: 470697 - RNA, 19 nt, Homo sapiens
gaaaguagaaguggauaug

SEQ ID NO: 470698 - RNA, 19 nt, Homo sapiens
gcacagauucauuuaacaa

SEQ ID NO: 470699 - RNA, 19 nt, Homo sapiens
gaggaaggaaccagugaua

SEQ ID NO: 470700 - RNA, 19 nt, Homo sapiens
ggagacacaccuugaagaa

SEQ ID NO: 470701 - RNA, 19 nt, Homo sapiens
gaaagucgacagagacaau

SEQ ID NO: 470702 - RNA, 19 nt, Homo sapiens
gaaggaggccgcagagcaa

SEQ ID NO: 470703 - RNA, 19 nt, Homo sapiens
cugaagauccagaugauua

SEQ ID NO: 470704 - RNA, 19 nt, Homo sapiens
ccaacagaauggugaagaa

SEQ ID NO: 470705 - RNA, 19 nt, Homo sapiens
gaaaggagaaccguacaug

SEQ ID NO: 470706 - RNA, 19 nt, Homo sapiens
ucagucaccuuucuuaagu

SEQ ID NO: 470707 - RNA, 19 nt, Homo sapiens
gaagaaggcacgucuacuc

SEQ ID NO: 470708 - RNA, 19 nt, Homo sapiens
gaacaagcagcuaacaaag

SEQ ID NO: 470709 - RNA, 19 nt, Homo sapiens
gguguuacgugguuugugu

SEQ ID NO: 470710 - RNA, 19 nt, Homo sapiens
ggaaggaaccagugauagu

SEQ ID NO: 470711 - RNA, 19 nt, Homo sapiens
caccaggguuugugggaua

SEQ ID NO: 470712 - RNA, 19 nt, Homo sapiens
ucaccuuucuuaaguguug

SEQ ID NO: 470713 - RNA, 19 nt, Homo sapiens
aauaaguguugccuuguuu

SEQ ID NO: 470714 - RNA, 19 nt, Homo sapiens
gaaaauugcagcugagauu

SEQ ID NO: 470715 - RNA, 19 nt, Homo sapiens
aaacgaauacgaagcagaa

SEQ ID NO: 470716 - RNA, 19 nt, Homo sapiens
agacacaccuugaagaaac

SEQ ID NO: 470717 - RNA, 19 nt, Homo sapiens
agaacaagcagcuaacaaa

SEQ ID NO: 470718 - RNA, 19 nt, Homo sapiens
gaaugcagguccucaaacg

SEQ ID NO: 470719 - RNA, 19 nt, Homo sapiens
gauacaauccauacaguca

SEQ ID NO: 470720 - RNA, 19 nt, Homo sapiens
cagauucauucuuaaggaa

SEQ ID NO: 470721 - RNA, 19 nt, Homo sapiens
ucagauucauucuuaagga

SEQ ID NO: 470722 - RNA, 19 nt, Homo sapiens
guugugcggucugaaagua

SEQ ID NO: 470723 - RNA, 19 nt, Homo sapiens
acagucaucucgccuacaa

SEQ ID NO: 470724 - RNA, 19 nt, Homo sapiens
gaacgacaccaggagaaga

SEQ ID NO: 470725 - RNA, 19 nt, Homo sapiens
ccgcguaccuugcuuacau

SEQ ID NO: 470726 - RNA, 19 nt, Homo sapiens
uuaaugguguuacgugguu

SEQ ID NO: 470727 - RNA, 19 nt, Homo sapiens
acagagagccaacagaaug

SEQ ID NO: 470728 - RNA, 19 nt, Homo sapiens
ccucaucagugaaauucuu

SEQ ID NO: 470729 - RNA, 19 nt, Homo sapiens
ugauuaugaugauggcuuu

SEQ ID NO: 470730 - RNA, 19 nt, Homo sapiens
cagaaaagauagaguacaa

SEQ ID NO: 470731 - RNA, 19 nt, Homo sapiens
uacaugagguacagcagaa

SEQ ID NO: 470732 - RNA, 19 nt, Homo sapiens
uaacaaaggcgaggagaag

SEQ ID NO: 470733 - RNA, 19 nt, Homo sapiens
agaaguggauauggagaaa

SEQ ID NO: 470734 - RNA, 19 nt, Homo sapiens
aagcacagauucauuuaac

SEQ ID NO: 470735 - RNA, 19 nt, Homo sapiens
gaaccguacaugagcauuc

SEQ ID NO: 470736 - RNA, 19 nt, Homo sapiens
cgugguuuguguauuaauu

SEQ ID NO: 470737 - RNA, 19 nt, Homo sapiens
gagacacaccuugaagaaa

SEQ ID NO: 470738 - RNA, 19 nt, Homo sapiens
caaaggcgaggagaagaaa

SEQ ID NO: 470739 - RNA, 19 nt, Homo sapiens
gaagaacaagcagcuaaca

SEQ ID NO: 470740 - RNA, 19 nt, Homo sapiens
gcagguccaguccuuaaug

SEQ ID NO: 470741 - RNA, 19 nt, Homo sapiens
gaaaagauagaguacaaug

SEQ ID NO: 470742 - RNA, 19 nt, Homo sapiens
agaucucacugaugaagaa

SEQ ID NO: 470743 - RNA, 19 nt, Homo sapiens
gaaggccuaucauaauucc

SEQ ID NO: 470744 - RNA, 19 nt, Homo sapiens
gagaaaccaccgccucauc

SEQ ID NO: 470745 - RNA, 19 nt, Homo sapiens
agaguacaaugaaucuaug

SEQ ID NO: 470746 - RNA, 19 nt, Homo sapiens
cuaaaguugugggagauug

SEQ ID NO: 470747 - RNA, 19 nt, Homo sapiens
guacaaugaaucuaugaag

SEQ ID NO: 470748 - RNA, 19 nt, Homo sapiens
ggagauuggcaagauuauu

SEQ ID NO: 470749 - RNA, 19 nt, Homo sapiens
gguccaguccuuaaugguu

SEQ ID NO: 470750 - RNA, 19 nt, Homo sapiens
aaaggagaaccguacauga

SEQ ID NO: 470751 - RNA, 19 nt, Homo sapiens
gauagaguacaaugaaucu

SEQ ID NO: 470752 - RNA, 19 nt, Homo sapiens
cagaggagacacaccuuga

SEQ ID NO: 470753 - RNA, 19 nt, Homo sapiens
gacguucggucaguuguca

SEQ ID NO: 470754 - RNA, 19 nt, Homo sapiens
gaggaagaaagucgacaga

SEQ ID NO: 470755 - RNA, 19 nt, Homo sapiens
cuuuggaucuuguuucuag

SEQ ID NO: 470756 - RNA, 19 nt, Homo sapiens
gacacaccuugaagaaaca

SEQ ID NO: 470757 - RNA, 19 nt, Homo sapiens
aaguagaaguggauaugga

SEQ ID NO: 470758 - RNA, 19 nt, Homo sapiens
gaagauccagaugauuaug

SEQ ID NO: 470759 - RNA, 19 nt, Homo sapiens
gcccagcacaccaggguuu

SEQ ID NO: 470760 - RNA, 19 nt, Homo sapiens
ugggagauuggcaagauua

SEQ ID NO: 470761 - RNA, 19 nt, Homo sapiens
ggagagcaacagugcaaca

SEQ ID NO: 470762 - RNA, 19 nt, Homo sapiens
ccgcugaugcccuacauga

SEQ ID NO: 470763 - RNA, 19 nt, Homo sapiens
ugaagauccagaugauuau

SEQ ID NO: 470764 - RNA, 19 nt, Homo sapiens
gugggagauuggcaagauu

SEQ ID NO: 470765 - RNA, 19 nt, Homo sapiens
cauaccagaagaugagaaa

SEQ ID NO: 470766 - RNA, 19 nt, Homo sapiens
ggaggagccaccaacagau

SEQ ID NO: 470767 - RNA, 19 nt, Homo sapiens
acaaaggcgaggagaagaa

SEQ ID NO: 470768 - RNA, 19 nt, Homo sapiens
uagaaugcagguccucaaa

SEQ ID NO: 470769 - RNA, 19 nt, Homo sapiens
auacgaagcagaaaagaua

SEQ ID NO: 470770 - RNA, 19 nt, Homo sapiens
uuucuuaaguguugugaag

SEQ ID NO: 470771 - RNA, 19 nt, Homo sapiens
gagaacuuaaucuuccaaa

SEQ ID NO: 470772 - RNA, 19 nt, Homo sapiens
gaggagccaccaacagauc

SEQ ID NO: 470773 - RNA, 19 nt, Homo sapiens
gaggagacacaccuugaag

SEQ ID NO: 470774 - RNA, 19 nt, Homo sapiens
acgagaacauuccgaugga

SEQ ID NO: 470775 - RNA, 19 nt, Homo sapiens
agaagaaagacgacgagaa

SEQ ID NO: 470776 - RNA, 19 nt, Homo sapiens
ggaagaacaagcagcuaac

SEQ ID NO: 470777 - RNA, 19 nt, Homo sapiens
ggagaagaagaggaaauuc

SEQ ID NO: 470778 - RNA, 19 nt, Homo sapiens
cggcagguccaguccuuaa

SEQ ID NO: 470779 - RNA, 19 nt, Homo sapiens
agaaaccaccgccucauca

SEQ ID NO: 470780 - RNA, 19 nt, Homo sapiens
ccagaugauuaugaugaug

SEQ ID NO: 470781 - RNA, 19 nt, Homo sapiens
gaagauaacuggccucauu

SEQ ID NO: 470782 - RNA, 19 nt, Homo sapiens
gaaggaaggugcucacauu

SEQ ID NO: 470783 - RNA, 19 nt, Homo sapiens
ggacauggcuguucauugu

SEQ ID NO: 470784 - RNA, 19 nt, Homo sapiens
ggguaacucuucuugauua

SEQ ID NO: 470785 - RNA, 19 nt, Homo sapiens
agacagaucuggaauguga

SEQ ID NO: 470786 - RNA, 19 nt, Homo sapiens
gcucacauuccuuaaauua

SEQ ID NO: 470787 - RNA, 19 nt, Homo sapiens
guagaaagcgugagaaguu

SEQ ID NO: 470788 - RNA, 19 nt, Homo sapiens
uaacuggccucauuucuuc

SEQ ID NO: 470789 - RNA, 19 nt, Homo sapiens
ccaaaugcaaugugaaaua

SEQ ID NO: 470790 - RNA, 19 nt, Homo sapiens
gcauagagcagcacuaaau

SEQ ID NO: 470791 - RNA, 19 nt, Homo sapiens
gaaggguguuguaguuuau

SEQ ID NO: 470792 - RNA, 19 nt, Homo sapiens
ugagaaggguguuguaguu

SEQ ID NO: 470793 - RNA, 19 nt, Homo sapiens
gagcgaugauucugacauu

SEQ ID NO: 470794 - RNA, 19 nt, Homo sapiens
agaaggguguuguaguuua

SEQ ID NO: 470795 - RNA, 19 nt, Homo sapiens
uaaaugacaccacuaaaga

SEQ ID NO: 470796 - RNA, 19 nt, Homo sapiens
gaugauacagcacugauaa

SEQ ID NO: 470797 - RNA, 19 nt, Homo sapiens
gauaaccacucguagaaag

SEQ ID NO: 470798 - RNA, 19 nt, Homo sapiens
uagaaagcgugagaaguua

SEQ ID NO: 470799 - RNA, 19 nt, Homo sapiens
gaauacugcagcuuccuua

SEQ ID NO: 470800 - RNA, 19 nt, Homo sapiens
gaaucuaacugguggacau

SEQ ID NO: 470801 - RNA, 19 nt, Homo sapiens
gcggaagucgucacucuua

SEQ ID NO: 470802 - RNA, 19 nt, Homo sapiens
gcuaucauacuggcuauua

SEQ ID NO: 470803 - RNA, 19 nt, Homo sapiens
gagagaaaccuguguugug

SEQ ID NO: 470804 - RNA, 19 nt, Homo sapiens
gcuguucauuguacuguuu

SEQ ID NO: 470805 - RNA, 19 nt, Homo sapiens
ucuggaaugugaagcguua

SEQ ID NO: 470806 - RNA, 19 nt, Homo sapiens
gaagucgucacucuuaaga

SEQ ID NO: 470807 - RNA, 19 nt, Homo sapiens
gcgauaaccacucguagaa

SEQ ID NO: 470808 - RNA, 19 nt, Homo sapiens
gaaguguuagagugucuua

SEQ ID NO: 470809 - RNA, 19 nt, Homo sapiens
guaauaaccaaaugcaaug

SEQ ID NO: 470810 - RNA, 19 nt, Homo sapiens
gguaacucuucuugauuaa

SEQ ID NO: 470811 - RNA, 19 nt, Homo sapiens
ucugugaaguagcuaauaa

SEQ ID NO: 470812 - RNA, 19 nt, Homo sapiens
uaagcaugcucuaaagaau

SEQ ID NO: 470813 - RNA, 19 nt, Homo sapiens
gaaaaugaaagccaaguuu

SEQ ID NO: 470814 - RNA, 19 nt, Homo sapiens
ggaaauagagaggagcaaa

SEQ ID NO: 470815 - RNA, 19 nt, Homo sapiens
gugcucacauuccuuaaau

SEQ ID NO: 470816 - RNA, 19 nt, Homo sapiens
cagaagacgguugcauuua

SEQ ID NO: 470817 - RNA, 19 nt, Homo sapiens
ucagaagacgguugcauuu

SEQ ID NO: 470818 - RNA, 19 nt, Homo sapiens
gaaugaaguguuagagugu

SEQ ID NO: 470819 - RNA, 19 nt, Homo sapiens
gcugaugcuuugggaagua

SEQ ID NO: 470820 - RNA, 19 nt, Homo sapiens
gcacaggccagagcgauga

SEQ ID NO: 470821 - RNA, 19 nt, Homo sapiens
uaucaaguguugggaaaga

SEQ ID NO: 470822 - RNA, 19 nt, Homo sapiens
ccaaaucugcuccauggaa

SEQ ID NO: 470823 - RNA, 19 nt, Homo sapiens
gcacgguggugaggcaguu

SEQ ID NO: 470824 - RNA, 19 nt, Homo sapiens
gagaaggguguuguaguuu

SEQ ID NO: 470825 - RNA, 19 nt, Homo sapiens
gauaacaucaagcccaaau

SEQ ID NO: 470826 - RNA, 19 nt, Homo sapiens
agaagacgguugcauuuac

SEQ ID NO: 470827 - RNA, 19 nt, Homo sapiens
ggaugauacagcacugaua

SEQ ID NO: 470828 - RNA, 19 nt, Homo sapiens
gcgaugauucugacauuug

SEQ ID NO: 470829 - RNA, 19 nt, Homo sapiens
gaauggguaacucuucuug

SEQ ID NO: 470830 - RNA, 19 nt, Homo sapiens
gaaguggaauggguaacuc

SEQ ID NO: 470831 - RNA, 19 nt, Homo sapiens
aauaucaaguguugggaaa

SEQ ID NO: 470832 - RNA, 19 nt, Homo sapiens
gguuuacacuggauaugga

SEQ ID NO: 470833 - RNA, 19 nt, Homo sapiens
gugaagcguuauagaagau

SEQ ID NO: 470834 - RNA, 19 nt, Homo sapiens
cuaaagaaacgaucagaca

SEQ ID NO: 470835 - RNA, 19 nt, Homo sapiens
gcacuaaaugacaccacua

SEQ ID NO: 470836 - RNA, 19 nt, Homo sapiens
ugaugaugcugaugcuuug

SEQ ID NO: 470837 - RNA, 19 nt, Homo sapiens
caugcuggcugccuccauu

SEQ ID NO: 470838 - RNA, 19 nt, Homo sapiens
gcagcuuccuuacaacagu

SEQ ID NO: 470839 - RNA, 19 nt, Homo sapiens
cgugagaaguuacuacaag

SEQ ID NO: 470840 - RNA, 19 nt, Homo sapiens
gaauguggauuagauuuug

SEQ ID NO: 470841 - RNA, 19 nt, Homo sapiens
cggaagucgucacucuuaa

SEQ ID NO: 470842 - RNA, 19 nt, Homo sapiens
gaaaaccugcuaagaagaa

SEQ ID NO: 470843 - RNA, 19 nt, Homo sapiens
gaaugugaagcguuauaga

SEQ ID NO: 470844 - RNA, 19 nt, Homo sapiens
aaagaaacgaucagacaga

SEQ ID NO: 470845 - RNA, 19 nt, Homo sapiens
aaagccaaguuucaacaga

SEQ ID NO: 470846 - RNA, 19 nt, Homo sapiens
aaacuucggguaaaccaaa

SEQ ID NO: 470847 - RNA, 19 nt, Homo sapiens
auaaccaaaugcaauguga

SEQ ID NO: 470848 - RNA, 19 nt, Homo sapiens
ugggaaguauguuaauuuc

SEQ ID NO: 470849 - RNA, 19 nt, Homo sapiens
aaagaaaaccugcuaagaa

SEQ ID NO: 470850 - RNA, 19 nt, Homo sapiens
ugugaagcguuauagaaga

SEQ ID NO: 470851 - RNA, 19 nt, Homo sapiens
cuaaaugacaccacuaaag

SEQ ID NO: 470852 - RNA, 19 nt, Homo sapiens
uaacaucaagcccaaaucu

SEQ ID NO: 470853 - RNA, 19 nt, Homo sapiens
caacagaugaaagugagaa

SEQ ID NO: 470854 - RNA, 19 nt, Homo sapiens
uaagagagaaaccuguguu

SEQ ID NO: 470855 - RNA, 19 nt, Homo sapiens
ccaggaaagccaggucuaa

SEQ ID NO: 470856 - RNA, 19 nt, Homo sapiens
uacacuggauauggaaaua

SEQ ID NO: 470857 - RNA, 19 nt, Homo sapiens
gaagacgguugcauuuacc

SEQ ID NO: 470858 - RNA, 19 nt, Homo sapiens
uuacuggacucuuuugaaa

SEQ ID NO: 470859 - RNA, 19 nt, Homo sapiens
uuaagcaugcucuaaagaa

SEQ ID NO: 470860 - RNA, 19 nt, Homo sapiens
ggugacauuugugaaacuu

SEQ ID NO: 470861 - RNA, 19 nt, Homo sapiens
ccucccauauguccagauu

SEQ ID NO: 470862 - RNA, 19 nt, Homo sapiens
gaaauagagaggagcaaaa

SEQ ID NO: 470863 - RNA, 19 nt, Homo sapiens
cacuggauauggaaauaga

SEQ ID NO: 470864 - RNA, 19 nt, Homo sapiens
uacugcagcuuccuuacaa

SEQ ID NO: 470865 - RNA, 19 nt, Homo sapiens
guccagauucucuugauga

SEQ ID NO: 470866 - RNA, 19 nt, Homo sapiens
caggaaagccaggucuaaa

SEQ ID NO: 470867 - RNA, 19 nt, Homo sapiens
guaauuuuauggccuguga

SEQ ID NO: 470868 - RNA, 19 nt, Homo sapiens
aaugugaagcguuauagaa

SEQ ID NO: 470869 - RNA, 19 nt, Homo sapiens
ggaaugugaagcguuauag

SEQ ID NO: 470870 - RNA, 19 nt, Homo sapiens
aagaaacgaucagacagau

SEQ ID NO: 470871 - RNA, 19 nt, Homo sapiens
ugacaccacuaaagaaacg

SEQ ID NO: 470872 - RNA, 19 nt, Homo sapiens
aaugacaccacuaaagaaa

SEQ ID NO: 470873 - RNA, 19 nt, Homo sapiens
gucagaagacgguugcauu

SEQ ID NO: 470874 - RNA, 19 nt, Homo sapiens
ucugacauuugggaugaua

SEQ ID NO: 470875 - RNA, 19 nt, Homo sapiens
aaaugacaccacuaaagaa

SEQ ID NO: 470876 - RNA, 19 nt, Homo sapiens
uggcauagagcagcacuaa

SEQ ID NO: 470877 - RNA, 19 nt, Homo sapiens
ggaagucgucacucuuaag

SEQ ID NO: 470878 - RNA, 19 nt, Homo sapiens
cgaugauucugacauuugg

SEQ ID NO: 470879 - RNA, 19 nt, Homo sapiens
gaaagccaggucuaaaauu

SEQ ID NO: 470880 - RNA, 19 nt, Homo sapiens
gcuuugggaaguauguuaa

SEQ ID NO: 470881 - RNA, 19 nt, Homo sapiens
gaagauaacuggccucauu

SEQ ID NO: 470882 - RNA, 19 nt, Homo sapiens
gaaggaaggugcucacauu

SEQ ID NO: 470883 - RNA, 19 nt, Homo sapiens
ggacauggcuguucauugu

SEQ ID NO: 470884 - RNA, 19 nt, Homo sapiens
ggguaacucuucuugauua

SEQ ID NO: 470885 - RNA, 19 nt, Homo sapiens
agacagaucuggaauguga

SEQ ID NO: 470886 - RNA, 19 nt, Homo sapiens
gcucacauuccuuaaauua

SEQ ID NO: 470887 - RNA, 19 nt, Homo sapiens
guagaaagcgugagaaguu

SEQ ID NO: 470888 - RNA, 19 nt, Homo sapiens
uaacuggccucauuucuuc

SEQ ID NO: 470889 - RNA, 19 nt, Homo sapiens
ccaaaugcaaugugaaaua

SEQ ID NO: 470890 - RNA, 19 nt, Homo sapiens
gcauagagcagcacuaaau

SEQ ID NO: 470891 - RNA, 19 nt, Homo sapiens
gaaggguguuguaguuuau

SEQ ID NO: 470892 - RNA, 19 nt, Homo sapiens
ugagaaggguguuguaguu

SEQ ID NO: 470893 - RNA, 19 nt, Homo sapiens
gagcgaugauucugacauu

SEQ ID NO: 470894 - RNA, 19 nt, Homo sapiens
agaaggguguuguaguuua

SEQ ID NO: 470895 - RNA, 19 nt, Homo sapiens
uaaaugacaccacuaaaga

SEQ ID NO: 470896 - RNA, 19 nt, Homo sapiens
gaugauacagcacugauaa

SEQ ID NO: 470897 - RNA, 19 nt, Homo sapiens
gauaaccacucguagaaag

SEQ ID NO: 470898 - RNA, 19 nt, Homo sapiens
uagaaagcgugagaaguua

SEQ ID NO: 470899 - RNA, 19 nt, Homo sapiens
gaauacugcagcuuccuua

SEQ ID NO: 470900 - RNA, 19 nt, Homo sapiens
gaaucuaacugguggacau

SEQ ID NO: 470901 - RNA, 19 nt, Homo sapiens
gcggaagucgucacucuua

SEQ ID NO: 470902 - RNA, 19 nt, Homo sapiens
gcuaucauacuggcuauua

SEQ ID NO: 470903 - RNA, 19 nt, Homo sapiens
gagagaaaccuguguugug

SEQ ID NO: 470904 - RNA, 19 nt, Homo sapiens
gcuguucauuguacuguuu

SEQ ID NO: 470905 - RNA, 19 nt, Homo sapiens
ucuggaaugugaagcguua

SEQ ID NO: 470906 - RNA, 19 nt, Homo sapiens
gaagucgucacucuuaaga

SEQ ID NO: 470907 - RNA, 19 nt, Homo sapiens
gcgauaaccacucguagaa

SEQ ID NO: 470908 - RNA, 19 nt, Homo sapiens
gaaguguuagagugucuua

SEQ ID NO: 470909 - RNA, 19 nt, Homo sapiens
guaauaaccaaaugcaaug

SEQ ID NO: 470910 - RNA, 19 nt, Homo sapiens
gguaacucuucuugauuaa

SEQ ID NO: 470911 - RNA, 19 nt, Homo sapiens
ucugugaaguagcuaauaa

SEQ ID NO: 470912 - RNA, 19 nt, Homo sapiens
uaagcaugcucuaaagaau

SEQ ID NO: 470913 - RNA, 19 nt, Homo sapiens
gaaaaugaaagccaaguuu

SEQ ID NO: 470914 - RNA, 19 nt, Homo sapiens
ggaaauagagaggagcaaa

SEQ ID NO: 470915 - RNA, 19 nt, Homo sapiens
gugcucacauuccuuaaau

SEQ ID NO: 470916 - RNA, 19 nt, Homo sapiens
cagaagacgguugcauuua

SEQ ID NO: 470917 - RNA, 19 nt, Homo sapiens
ucagaagacgguugcauuu

SEQ ID NO: 470918 - RNA, 19 nt, Homo sapiens
gaaugaaguguuagagugu

SEQ ID NO: 470919 - RNA, 19 nt, Homo sapiens
gcugaugcuuugggaagua

SEQ ID NO: 470920 - RNA, 19 nt, Homo sapiens
gcacaggccagagcgauga

SEQ ID NO: 470921 - RNA, 19 nt, Homo sapiens
uaucaaguguugggaaaga

SEQ ID NO: 470922 - RNA, 19 nt, Homo sapiens
ccaaaucugcuccauggaa

SEQ ID NO: 470923 - RNA, 19 nt, Homo sapiens
gcacgguggugaggcaguu

SEQ ID NO: 470924 - RNA, 19 nt, Homo sapiens
gagaaggguguuguaguuu

SEQ ID NO: 470925 - RNA, 19 nt, Homo sapiens
gauaacaucaagcccaaau

SEQ ID NO: 470926 - RNA, 19 nt, Homo sapiens
agaagacgguugcauuuac

SEQ ID NO: 470927 - RNA, 19 nt, Homo sapiens
ggaugauacagcacugaua

SEQ ID NO: 470928 - RNA, 19 nt, Homo sapiens
gcgaugauucugacauuug

SEQ ID NO: 470929 - RNA, 19 nt, Homo sapiens
gaauggguaacucuucuug

SEQ ID NO: 470930 - RNA, 19 nt, Homo sapiens
gaaguggaauggguaacuc

SEQ ID NO: 470931 - RNA, 19 nt, Homo sapiens
aauaucaaguguugggaaa

SEQ ID NO: 470932 - RNA, 19 nt, Homo sapiens
gguuuacacuggauaugga

SEQ ID NO: 470933 - RNA, 19 nt, Homo sapiens
gugaagcguuauagaagau

SEQ ID NO: 470934 - RNA, 19 nt, Homo sapiens
cuaaagaaacgaucagaca

SEQ ID NO: 470935 - RNA, 19 nt, Homo sapiens
gcacuaaaugacaccacua

SEQ ID NO: 470936 - RNA, 19 nt, Homo sapiens
ugaugaugcugaugcuuug

SEQ ID NO: 470937 - RNA, 19 nt, Homo sapiens
gcagcuuccuuacaacagu

SEQ ID NO: 470938 - RNA, 19 nt, Homo sapiens
cgugagaaguuacuacaag

SEQ ID NO: 470939 - RNA, 19 nt, Homo sapiens
gaauguggauuagauuuug

SEQ ID NO: 470940 - RNA, 19 nt, Homo sapiens
cggaagucgucacucuuaa

SEQ ID NO: 470941 - RNA, 19 nt, Homo sapiens
ggaccaggaaagauaauuc

SEQ ID NO: 470942 - RNA, 19 nt, Homo sapiens
gaaaaccugcuaagaagaa

SEQ ID NO: 470943 - RNA, 19 nt, Homo sapiens
gaaugugaagcguuauaga

SEQ ID NO: 470944 - RNA, 19 nt, Homo sapiens
aaagaaacgaucagacaga

SEQ ID NO: 470945 - RNA, 19 nt, Homo sapiens
aaagccaaguuucaacaga

SEQ ID NO: 470946 - RNA, 19 nt, Homo sapiens
aaacuucggguaaaccaaa

SEQ ID NO: 470947 - RNA, 19 nt, Homo sapiens
auaaccaaaugcaauguga

SEQ ID NO: 470948 - RNA, 19 nt, Homo sapiens
ugggaaguauguuaauuuc

SEQ ID NO: 470949 - RNA, 19 nt, Homo sapiens
aaagaaaaccugcuaagaa

SEQ ID NO: 470950 - RNA, 19 nt, Homo sapiens
ugugaagcguuauagaaga

SEQ ID NO: 470951 - RNA, 19 nt, Homo sapiens
cuaaaugacaccacuaaag

SEQ ID NO: 470952 - RNA, 19 nt, Homo sapiens
uaacaucaagcccaaaucu

SEQ ID NO: 470953 - RNA, 19 nt, Homo sapiens
caacagaugaaagugagaa

SEQ ID NO: 470954 - RNA, 19 nt, Homo sapiens
uaagagagaaaccuguguu

SEQ ID NO: 470955 - RNA, 19 nt, Homo sapiens
uacacuggauauggaaaua

SEQ ID NO: 470956 - RNA, 19 nt, Homo sapiens
gaagacgguugcauuuacc

SEQ ID NO: 470957 - RNA, 19 nt, Homo sapiens
uuacuggacucuuuugaaa

SEQ ID NO: 470958 - RNA, 19 nt, Homo sapiens
uuaagcaugcucuaaagaa

SEQ ID NO: 470959 - RNA, 19 nt, Homo sapiens
ggugacauuugugaaacuu

SEQ ID NO: 470960 - RNA, 19 nt, Homo sapiens
ccucccauauguccagauu

SEQ ID NO: 470961 - RNA, 19 nt, Homo sapiens
gaaauagagaggagcaaaa

SEQ ID NO: 470962 - RNA, 19 nt, Homo sapiens
cacuggauauggaaauaga

SEQ ID NO: 470963 - RNA, 19 nt, Homo sapiens
uacugcagcuuccuuacaa

SEQ ID NO: 470964 - RNA, 19 nt, Homo sapiens
guccagauucucuugauga

SEQ ID NO: 470965 - RNA, 19 nt, Homo sapiens
guaauuuuauggccuguga

SEQ ID NO: 470966 - RNA, 19 nt, Homo sapiens
aaugugaagcguuauagaa

SEQ ID NO: 470967 - RNA, 19 nt, Homo sapiens
ggaaugugaagcguuauag

SEQ ID NO: 470968 - RNA, 19 nt, Homo sapiens
aagaaacgaucagacagau

SEQ ID NO: 470969 - RNA, 19 nt, Homo sapiens
ugacaccacuaaagaaacg

SEQ ID NO: 470970 - RNA, 19 nt, Homo sapiens
aaugacaccacuaaagaaa

SEQ ID NO: 470971 - RNA, 19 nt, Homo sapiens
gucagaagacgguugcauu

SEQ ID NO: 470972 - RNA, 19 nt, Homo sapiens
ucugacauuugggaugaua

SEQ ID NO: 470973 - RNA, 19 nt, Homo sapiens
aaaugacaccacuaaagaa

SEQ ID NO: 470974 - RNA, 19 nt, Homo sapiens
uggcauagagcagcacuaa

SEQ ID NO: 470975 - RNA, 19 nt, Homo sapiens
ggaagucgucacucuuaag

SEQ ID NO: 470976 - RNA, 19 nt, Homo sapiens
cgaugauucugacauuugg

SEQ ID NO: 470977 - RNA, 19 nt, Homo sapiens
gcuuugggaaguauguuaa

SEQ ID NO: 470978 - RNA, 19 nt, Homo sapiens
ucccauauguccagauucu

SEQ ID NO: 470979 - RNA, 19 nt, Homo sapiens
aagccaaguuucaacagau

SEQ ID NO: 470980 - RNA, 19 nt, Homo sapiens
agucgucacucuuaagaag

SEQ ID NO: 470981 - RNA, 19 nt, Homo sapiens
gaagauaacuggccucauu

SEQ ID NO: 470982 - RNA, 19 nt, Homo sapiens
gaaggaaggugcucacauu

SEQ ID NO: 470983 - RNA, 19 nt, Homo sapiens
ggacauggcuguucauugu

SEQ ID NO: 470984 - RNA, 19 nt, Homo sapiens
ggguaacucuucuugauua

SEQ ID NO: 470985 - RNA, 19 nt, Homo sapiens
agacagaucuggaauguga

SEQ ID NO: 470986 - RNA, 19 nt, Homo sapiens
gcucacauuccuuaaauua

SEQ ID NO: 470987 - RNA, 19 nt, Homo sapiens
guagaaagcgugagaaguu

SEQ ID NO: 470988 - RNA, 19 nt, Homo sapiens
uaacuggccucauuucuuc

SEQ ID NO: 470989 - RNA, 19 nt, Homo sapiens
ccaaaugcaaugugaaaua

SEQ ID NO: 470990 - RNA, 19 nt, Homo sapiens
gcauagagcagcacuaaau

SEQ ID NO: 470991 - RNA, 19 nt, Homo sapiens
gaaggguguuguaguuuau

SEQ ID NO: 470992 - RNA, 19 nt, Homo sapiens
ugagaaggguguuguaguu

SEQ ID NO: 470993 - RNA, 19 nt, Homo sapiens
gagcgaugauucugacauu

SEQ ID NO: 470994 - RNA, 19 nt, Homo sapiens
agaaggguguuguaguuua

SEQ ID NO: 470995 - RNA, 19 nt, Homo sapiens
uaaaugacaccacuaaaga

SEQ ID NO: 470996 - RNA, 19 nt, Homo sapiens
gaugauacagcacugauaa

SEQ ID NO: 470997 - RNA, 19 nt, Homo sapiens
gauaaccacucguagaaag

SEQ ID NO: 470998 - RNA, 19 nt, Homo sapiens
uagaaagcgugagaaguua

SEQ ID NO: 470999 - RNA, 19 nt, Homo sapiens
gaauacugcagcuuccuua

SEQ ID NO: 471000 - RNA, 19 nt, Homo sapiens
gaaucuaacugguggacau

SEQ ID NO: 471001 - RNA, 19 nt, Homo sapiens
gcggaagucgucacucuua

SEQ ID NO: 471002 - RNA, 19 nt, Homo sapiens
gcuaucauacuggcuauua

SEQ ID NO: 471003 - RNA, 19 nt, Homo sapiens
gagagaaaccuguguugug

SEQ ID NO: 471004 - RNA, 19 nt, Homo sapiens
gcuguucauuguacuguuu

SEQ ID NO: 471005 - RNA, 19 nt, Homo sapiens
ucuggaaugugaagcguua

SEQ ID NO: 471006 - RNA, 19 nt, Homo sapiens
gaagucgucacucuuaaga

SEQ ID NO: 471007 - RNA, 19 nt, Homo sapiens
gcgauaaccacucguagaa

SEQ ID NO: 471008 - RNA, 19 nt, Homo sapiens
gaaguguuagagugucuua

SEQ ID NO: 471009 - RNA, 19 nt, Homo sapiens
guaauaaccaaaugcaaug

SEQ ID NO: 471010 - RNA, 19 nt, Homo sapiens
gguaacucuucuugauuaa

SEQ ID NO: 471011 - RNA, 19 nt, Homo sapiens
ucugugaaguagcuaauaa

SEQ ID NO: 471012 - RNA, 19 nt, Homo sapiens
uaagcaugcucuaaagaau

SEQ ID NO: 471013 - RNA, 19 nt, Homo sapiens
gaaaaugaaagccaaguuu

SEQ ID NO: 471014 - RNA, 19 nt, Homo sapiens
ggaaauagagaggagcaaa

SEQ ID NO: 471015 - RNA, 19 nt, Homo sapiens
gugcucacauuccuuaaau

SEQ ID NO: 471016 - RNA, 19 nt, Homo sapiens
cagaagacgguugcauuua

SEQ ID NO: 471017 - RNA, 19 nt, Homo sapiens
ucagaagacgguugcauuu

SEQ ID NO: 471018 - RNA, 19 nt, Homo sapiens
gaaugaaguguuagagugu

SEQ ID NO: 471019 - RNA, 19 nt, Homo sapiens
gcugaugcuuugggaagua

SEQ ID NO: 471020 - RNA, 19 nt, Homo sapiens
gcacaggccagagcgauga

SEQ ID NO: 471021 - RNA, 19 nt, Homo sapiens
uaucaaguguugggaaaga

SEQ ID NO: 471022 - RNA, 19 nt, Homo sapiens
ccaaaucugcuccauggaa

SEQ ID NO: 471023 - RNA, 19 nt, Homo sapiens
gcacgguggugaggcaguu

SEQ ID NO: 471024 - RNA, 19 nt, Homo sapiens
gagaaggguguuguaguuu

SEQ ID NO: 471025 - RNA, 19 nt, Homo sapiens
gauaacaucaagcccaaau

SEQ ID NO: 471026 - RNA, 19 nt, Homo sapiens
agaagacgguugcauuuac

SEQ ID NO: 471027 - RNA, 19 nt, Homo sapiens
ggaugauacagcacugaua

SEQ ID NO: 471028 - RNA, 19 nt, Homo sapiens
gcgaugauucugacauuug

SEQ ID NO: 471029 - RNA, 19 nt, Homo sapiens
gaauggguaacucuucuug

SEQ ID NO: 471030 - RNA, 19 nt, Homo sapiens
gaaguggaauggguaacuc

SEQ ID NO: 471031 - RNA, 19 nt, Homo sapiens
aauaucaaguguugggaaa

SEQ ID NO: 471032 - RNA, 19 nt, Homo sapiens
gguuuacacuggauaugga

SEQ ID NO: 471033 - RNA, 19 nt, Homo sapiens
gugaagcguuauagaagau

SEQ ID NO: 471034 - RNA, 19 nt, Homo sapiens
cuaaagaaacgaucagaca

SEQ ID NO: 471035 - RNA, 19 nt, Homo sapiens
gcacuaaaugacaccacua

SEQ ID NO: 471036 - RNA, 19 nt, Homo sapiens
ugaugaugcugaugcuuug

SEQ ID NO: 471037 - RNA, 19 nt, Homo sapiens
caugcuggcugccuccauu

SEQ ID NO: 471038 - RNA, 19 nt, Homo sapiens
gcagcuuccuuacaacagu

SEQ ID NO: 471039 - RNA, 19 nt, Homo sapiens
cgugagaaguuacuacaag

SEQ ID NO: 471040 - RNA, 19 nt, Homo sapiens
gaauguggauuagauuuug

SEQ ID NO: 471041 - RNA, 19 nt, Homo sapiens
cggaagucgucacucuuaa

SEQ ID NO: 471042 - RNA, 19 nt, Homo sapiens
gaaaaccugcuaagaagaa

SEQ ID NO: 471043 - RNA, 19 nt, Homo sapiens
gaaugugaagcguuauaga

SEQ ID NO: 471044 - RNA, 19 nt, Homo sapiens
aaagaaacgaucagacaga

SEQ ID NO: 471045 - RNA, 19 nt, Homo sapiens
aaagccaaguuucaacaga

SEQ ID NO: 471046 - RNA, 19 nt, Homo sapiens
aaacuucggguaaaccaaa

SEQ ID NO: 471047 - RNA, 19 nt, Homo sapiens
auaaccaaaugcaauguga

SEQ ID NO: 471048 - RNA, 19 nt, Homo sapiens
ugggaaguauguuaauuuc

SEQ ID NO: 471049 - RNA, 19 nt, Homo sapiens
aaagaaaaccugcuaagaa

SEQ ID NO: 471050 - RNA, 19 nt, Homo sapiens
ugugaagcguuauagaaga

SEQ ID NO: 471051 - RNA, 19 nt, Homo sapiens
cuaaaugacaccacuaaag

SEQ ID NO: 471052 - RNA, 19 nt, Homo sapiens
uaacaucaagcccaaaucu

SEQ ID NO: 471053 - RNA, 19 nt, Homo sapiens
caacagaugaaagugagaa

SEQ ID NO: 471054 - RNA, 19 nt, Homo sapiens
uaagagagaaaccuguguu

SEQ ID NO: 471055 - RNA, 19 nt, Homo sapiens
ccaggaaagccaggucuaa

SEQ ID NO: 471056 - RNA, 19 nt, Homo sapiens
uacacuggauauggaaaua

SEQ ID NO: 471057 - RNA, 19 nt, Homo sapiens
gaagacgguugcauuuacc

SEQ ID NO: 471058 - RNA, 19 nt, Homo sapiens
uuacuggacucuuuugaaa

SEQ ID NO: 471059 - RNA, 19 nt, Homo sapiens
uuaagcaugcucuaaagaa

SEQ ID NO: 471060 - RNA, 19 nt, Homo sapiens
ggugacauuugugaaacuu

SEQ ID NO: 471061 - RNA, 19 nt, Homo sapiens
ccucccauauguccagauu

SEQ ID NO: 471062 - RNA, 19 nt, Homo sapiens
gaaauagagaggagcaaaa

SEQ ID NO: 471063 - RNA, 19 nt, Homo sapiens
cacuggauauggaaauaga

SEQ ID NO: 471064 - RNA, 19 nt, Homo sapiens
uacugcagcuuccuuacaa

SEQ ID NO: 471065 - RNA, 19 nt, Homo sapiens
guccagauucucuugauga

SEQ ID NO: 471066 - RNA, 19 nt, Homo sapiens
caggaaagccaggucuaaa

SEQ ID NO: 471067 - RNA, 19 nt, Homo sapiens
guaauuuuauggccuguga

SEQ ID NO: 471068 - RNA, 19 nt, Homo sapiens
aaugugaagcguuauagaa

SEQ ID NO: 471069 - RNA, 19 nt, Homo sapiens
ggaaugugaagcguuauag

SEQ ID NO: 471070 - RNA, 19 nt, Homo sapiens
aagaaacgaucagacagau

SEQ ID NO: 471071 - RNA, 19 nt, Homo sapiens
ugacaccacuaaagaaacg

SEQ ID NO: 471072 - RNA, 19 nt, Homo sapiens
aaugacaccacuaaagaaa

SEQ ID NO: 471073 - RNA, 19 nt, Homo sapiens
gucagaagacgguugcauu

SEQ ID NO: 471074 - RNA, 19 nt, Homo sapiens
ucugacauuugggaugaua

SEQ ID NO: 471075 - RNA, 19 nt, Homo sapiens
aaaugacaccacuaaagaa

SEQ ID NO: 471076 - RNA, 19 nt, Homo sapiens
uggcauagagcagcacuaa

SEQ ID NO: 471077 - RNA, 19 nt, Homo sapiens
ggaagucgucacucuuaag

SEQ ID NO: 471078 - RNA, 19 nt, Homo sapiens
cgaugauucugacauuugg

SEQ ID NO: 471079 - RNA, 19 nt, Homo sapiens
gaaagccaggucuaaaauu

SEQ ID NO: 471080 - RNA, 19 nt, Homo sapiens
gcuuugggaaguauguuaa

SEQ ID NO: 471081 - RNA, 19 nt, Homo sapiens
gaagauaacuggccucauu

SEQ ID NO: 471082 - RNA, 19 nt, Homo sapiens
ggacauggcuguucauugu

SEQ ID NO: 471083 - RNA, 19 nt, Homo sapiens
ggguaacucuucuugauua

SEQ ID NO: 471084 - RNA, 19 nt, Homo sapiens
agacagaucuggaauguga

SEQ ID NO: 471085 - RNA, 19 nt, Homo sapiens
guagaaagcgugagaaguu

SEQ ID NO: 471086 - RNA, 19 nt, Homo sapiens
uaacuggccucauuucuuc

SEQ ID NO: 471087 - RNA, 19 nt, Homo sapiens
ccaaaugcaaugugaaaua

SEQ ID NO: 471088 - RNA, 19 nt, Homo sapiens
gcauagagcagcacuaaau

SEQ ID NO: 471089 - RNA, 19 nt, Homo sapiens
gaaggguguuguaguuuau

SEQ ID NO: 471090 - RNA, 19 nt, Homo sapiens
ugagaaggguguuguaguu

SEQ ID NO: 471091 - RNA, 19 nt, Homo sapiens
gagcgaugauucugacauu

SEQ ID NO: 471092 - RNA, 19 nt, Homo sapiens
agaaggguguuguaguuua

SEQ ID NO: 471093 - RNA, 19 nt, Homo sapiens
uaaaugacaccacuaaaga

SEQ ID NO: 471094 - RNA, 19 nt, Homo sapiens
gaugauacagcacugauaa

SEQ ID NO: 471095 - RNA, 19 nt, Homo sapiens
gauaaccacucguagaaag

SEQ ID NO: 471096 - RNA, 19 nt, Homo sapiens
uagaaagcgugagaaguua

SEQ ID NO: 471097 - RNA, 19 nt, Homo sapiens
gaauacugcagcuuccuua

SEQ ID NO: 471098 - RNA, 19 nt, Homo sapiens
gaaucuaacugguggacau

SEQ ID NO: 471099 - RNA, 19 nt, Homo sapiens
gcggaagucgucacucuua

SEQ ID NO: 471100 - RNA, 19 nt, Homo sapiens
gcuaucauacuggcuauua

SEQ ID NO: 471101 - RNA, 19 nt, Homo sapiens
gagagaaaccuguguugug

SEQ ID NO: 471102 - RNA, 19 nt, Homo sapiens
gcuguucauuguacuguuu

SEQ ID NO: 471103 - RNA, 19 nt, Homo sapiens
ucuggaaugugaagcguua

SEQ ID NO: 471104 - RNA, 19 nt, Homo sapiens
gaagucgucacucuuaaga

SEQ ID NO: 471105 - RNA, 19 nt, Homo sapiens
gcgauaaccacucguagaa

SEQ ID NO: 471106 - RNA, 19 nt, Homo sapiens
gaaguguuagagugucuua

SEQ ID NO: 471107 - RNA, 19 nt, Homo sapiens
guaauaaccaaaugcaaug

SEQ ID NO: 471108 - RNA, 19 nt, Homo sapiens
gguaacucuucuugauuaa

SEQ ID NO: 471109 - RNA, 19 nt, Homo sapiens
ucugugaaguagcuaauaa

SEQ ID NO: 471110 - RNA, 19 nt, Homo sapiens
uaagcaugcucuaaagaau

SEQ ID NO: 471111 - RNA, 19 nt, Homo sapiens
gaaaaugaaagccaaguuu

SEQ ID NO: 471112 - RNA, 19 nt, Homo sapiens
ggaaauagagaggagcaaa

SEQ ID NO: 471113 - RNA, 19 nt, Homo sapiens
cagaagacgguugcauuua

SEQ ID NO: 471114 - RNA, 19 nt, Homo sapiens
ucagaagacgguugcauuu

SEQ ID NO: 471115 - RNA, 19 nt, Homo sapiens
gaaugaaguguuagagugu

SEQ ID NO: 471116 - RNA, 19 nt, Homo sapiens
gcugaugcuuugggaagua

SEQ ID NO: 471117 - RNA, 19 nt, Homo sapiens
gcacaggccagagcgauga

SEQ ID NO: 471118 - RNA, 19 nt, Homo sapiens
uaucaaguguugggaaaga

SEQ ID NO: 471119 - RNA, 19 nt, Homo sapiens
gcuauuauauggaaaugcu

SEQ ID NO: 471120 - RNA, 19 nt, Homo sapiens
ccaaaucugcuccauggaa

SEQ ID NO: 471121 - RNA, 19 nt, Homo sapiens
gcacgguggugaggcaguu

SEQ ID NO: 471122 - RNA, 19 nt, Homo sapiens
gagaaggguguuguaguuu

SEQ ID NO: 471123 - RNA, 19 nt, Homo sapiens
gauaacaucaagcccaaau

SEQ ID NO: 471124 - RNA, 19 nt, Homo sapiens
agaagacgguugcauuuac

SEQ ID NO: 471125 - RNA, 19 nt, Homo sapiens
ggaugauacagcacugaua

SEQ ID NO: 471126 - RNA, 19 nt, Homo sapiens
gcgaugauucugacauuug

SEQ ID NO: 471127 - RNA, 19 nt, Homo sapiens
gaauggguaacucuucuug

SEQ ID NO: 471128 - RNA, 19 nt, Homo sapiens
gaaguggaauggguaacuc

SEQ ID NO: 471129 - RNA, 19 nt, Homo sapiens
aauaucaaguguugggaaa

SEQ ID NO: 471130 - RNA, 19 nt, Homo sapiens
gguuuacacuggauaugga

SEQ ID NO: 471131 - RNA, 19 nt, Homo sapiens
gugaagcguuauagaagau

SEQ ID NO: 471132 - RNA, 19 nt, Homo sapiens
cuaaagaaacgaucagaca

SEQ ID NO: 471133 - RNA, 19 nt, Homo sapiens
gcacuaaaugacaccacua

SEQ ID NO: 471134 - RNA, 19 nt, Homo sapiens
ugaugaugcugaugcuuug

SEQ ID NO: 471135 - RNA, 19 nt, Homo sapiens
caugcuggcugccuccauu

SEQ ID NO: 471136 - RNA, 19 nt, Homo sapiens
gcagcuuccuuacaacagu

SEQ ID NO: 471137 - RNA, 19 nt, Homo sapiens
gaauguggauuagauuuug

SEQ ID NO: 471138 - RNA, 19 nt, Homo sapiens
cgugagaaguuacuacaag

SEQ ID NO: 471139 - RNA, 19 nt, Homo sapiens
gaaaaccugcuaagaagaa

SEQ ID NO: 471140 - RNA, 19 nt, Homo sapiens
cggaagucgucacucuuaa

SEQ ID NO: 471141 - RNA, 19 nt, Homo sapiens
gaaugugaagcguuauaga

SEQ ID NO: 471142 - RNA, 19 nt, Homo sapiens
aaagaaacgaucagacaga

SEQ ID NO: 471143 - RNA, 19 nt, Homo sapiens
aaagccaaguuucaacaga

SEQ ID NO: 471144 - RNA, 19 nt, Homo sapiens
aaacuucggguaaaccaaa

SEQ ID NO: 471145 - RNA, 19 nt, Homo sapiens
auaaccaaaugcaauguga

SEQ ID NO: 471146 - RNA, 19 nt, Homo sapiens
ugggaaguauguuaauuuc

SEQ ID NO: 471147 - RNA, 19 nt, Homo sapiens
aaagaaaaccugcuaagaa

SEQ ID NO: 471148 - RNA, 19 nt, Homo sapiens
ugugaagcguuauagaaga

SEQ ID NO: 471149 - RNA, 19 nt, Homo sapiens
cuaaaugacaccacuaaag

SEQ ID NO: 471150 - RNA, 19 nt, Homo sapiens
uaacaucaagcccaaaucu

SEQ ID NO: 471151 - RNA, 19 nt, Homo sapiens
caacagaugaaagugagaa

SEQ ID NO: 471152 - RNA, 19 nt, Homo sapiens
uaagagagaaaccuguguu

SEQ ID NO: 471153 - RNA, 19 nt, Homo sapiens
ccaggaaagccaggucuaa

SEQ ID NO: 471154 - RNA, 19 nt, Homo sapiens
uacacuggauauggaaaua

SEQ ID NO: 471155 - RNA, 19 nt, Homo sapiens
gaagacgguugcauuuacc

SEQ ID NO: 471156 - RNA, 19 nt, Homo sapiens
uuacuggacucuuuugaaa

SEQ ID NO: 471157 - RNA, 19 nt, Homo sapiens
uuaagcaugcucuaaagaa

SEQ ID NO: 471158 - RNA, 19 nt, Homo sapiens
ggugacauuugugaaacuu

SEQ ID NO: 471159 - RNA, 19 nt, Homo sapiens
ccucccauauguccagauu

SEQ ID NO: 471160 - RNA, 19 nt, Homo sapiens
gaaauagagaggagcaaaa

SEQ ID NO: 471161 - RNA, 19 nt, Homo sapiens
cacuggauauggaaauaga

SEQ ID NO: 471162 - RNA, 19 nt, Homo sapiens
uacugcagcuuccuuacaa

SEQ ID NO: 471163 - RNA, 19 nt, Homo sapiens
guccagauucucuugauga

SEQ ID NO: 471164 - RNA, 19 nt, Homo sapiens
caggaaagccaggucuaaa

SEQ ID NO: 471165 - RNA, 19 nt, Homo sapiens
guaauuuuauggccuguga

SEQ ID NO: 471166 - RNA, 19 nt, Homo sapiens
aaugugaagcguuauagaa

SEQ ID NO: 471167 - RNA, 19 nt, Homo sapiens
ggaaugugaagcguuauag

SEQ ID NO: 471168 - RNA, 19 nt, Homo sapiens
aagaaacgaucagacagau

SEQ ID NO: 471169 - RNA, 19 nt, Homo sapiens
ugacaccacuaaagaaacg

SEQ ID NO: 471170 - RNA, 19 nt, Homo sapiens
aaugacaccacuaaagaaa

SEQ ID NO: 471171 - RNA, 19 nt, Homo sapiens
gucagaagacgguugcauu

SEQ ID NO: 471172 - RNA, 19 nt, Homo sapiens
aaaugacaccacuaaagaa

SEQ ID NO: 471173 - RNA, 19 nt, Homo sapiens
ucugacauuugggaugaua

SEQ ID NO: 471174 - RNA, 19 nt, Homo sapiens
uggcauagagcagcacuaa

SEQ ID NO: 471175 - RNA, 19 nt, Homo sapiens
ggaagucgucacucuuaag

SEQ ID NO: 471176 - RNA, 19 nt, Homo sapiens
gaaagccaggucuaaaauu

SEQ ID NO: 471177 - RNA, 19 nt, Homo sapiens
cgaugauucugacauuugg

SEQ ID NO: 471178 - RNA, 19 nt, Homo sapiens
gcuuugggaaguauguuaa

SEQ ID NO: 471179 - RNA, 19 nt, Homo sapiens
ucccauauguccagauucu

SEQ ID NO: 471180 - RNA, 19 nt, Homo sapiens
aagccaaguuucaacagau

SEQ ID NO: 471181 - RNA, 19 nt, Homo sapiens
gaagauaacuggccucauu

SEQ ID NO: 471182 - RNA, 19 nt, Homo sapiens
gaaggaaggugcucacauu

SEQ ID NO: 471183 - RNA, 19 nt, Homo sapiens
ggacauggcuguucauugu

SEQ ID NO: 471184 - RNA, 19 nt, Homo sapiens
ggguaacucuucuugauua

SEQ ID NO: 471185 - RNA, 19 nt, Homo sapiens
agacagaucuggaauguga

SEQ ID NO: 471186 - RNA, 19 nt, Homo sapiens
gcucacauuccuuaaauua

SEQ ID NO: 471187 - RNA, 19 nt, Homo sapiens
guagaaagcgugagaaguu

SEQ ID NO: 471188 - RNA, 19 nt, Homo sapiens
uaacuggccucauuucuuc

SEQ ID NO: 471189 - RNA, 19 nt, Homo sapiens
ccaaaugcaaugugaaaua

SEQ ID NO: 471190 - RNA, 19 nt, Homo sapiens
gcauagagcagcacuaaau

SEQ ID NO: 471191 - RNA, 19 nt, Homo sapiens
gaaggguguuguaguuuau

SEQ ID NO: 471192 - RNA, 19 nt, Homo sapiens
ugagaaggguguuguaguu

SEQ ID NO: 471193 - RNA, 19 nt, Homo sapiens
gagcgaugauucugacauu

SEQ ID NO: 471194 - RNA, 19 nt, Homo sapiens
agaaggguguuguaguuua

SEQ ID NO: 471195 - RNA, 19 nt, Homo sapiens
uaaaugacaccacuaaaga

SEQ ID NO: 471196 - RNA, 19 nt, Homo sapiens
gaugauacagcacugauaa

SEQ ID NO: 471197 - RNA, 19 nt, Homo sapiens
gauaaccacucguagaaag

SEQ ID NO: 471198 - RNA, 19 nt, Homo sapiens
uagaaagcgugagaaguua

SEQ ID NO: 471199 - RNA, 19 nt, Homo sapiens
gaauacugcagcuuccuua

SEQ ID NO: 471200 - RNA, 19 nt, Homo sapiens
gaaucuaacugguggacau

SEQ ID NO: 471201 - RNA, 19 nt, Homo sapiens
gcggaagucgucacucuua

SEQ ID NO: 471202 - RNA, 19 nt, Homo sapiens
gcuaucauacuggcuauua

SEQ ID NO: 471203 - RNA, 19 nt, Homo sapiens
gagagaaaccuguguugug

SEQ ID NO: 471204 - RNA, 19 nt, Homo sapiens
gcuguucauuguacuguuu

SEQ ID NO: 471205 - RNA, 19 nt, Homo sapiens
ucuggaaugugaagcguua

SEQ ID NO: 471206 - RNA, 19 nt, Homo sapiens
gaagucgucacucuuaaga

SEQ ID NO: 471207 - RNA, 19 nt, Homo sapiens
gcgauaaccacucguagaa

SEQ ID NO: 471208 - RNA, 19 nt, Homo sapiens
gaaguguuagagugucuua

SEQ ID NO: 471209 - RNA, 19 nt, Homo sapiens
guaauaaccaaaugcaaug

SEQ ID NO: 471210 - RNA, 19 nt, Homo sapiens
gguaacucuucuugauuaa

SEQ ID NO: 471211 - RNA, 19 nt, Homo sapiens
ucugugaaguagcuaauaa

SEQ ID NO: 471212 - RNA, 19 nt, Homo sapiens
uaagcaugcucuaaagaau

SEQ ID NO: 471213 - RNA, 19 nt, Homo sapiens
gaaaaugaaagccaaguuu

SEQ ID NO: 471214 - RNA, 19 nt, Homo sapiens
ggaaauagagaggagcaaa

SEQ ID NO: 471215 - RNA, 19 nt, Homo sapiens
gugcucacauuccuuaaau

SEQ ID NO: 471216 - RNA, 19 nt, Homo sapiens
cagaagacgguugcauuua

SEQ ID NO: 471217 - RNA, 19 nt, Homo sapiens
ucagaagacgguugcauuu

SEQ ID NO: 471218 - RNA, 19 nt, Homo sapiens
gaaugaaguguuagagugu

SEQ ID NO: 471219 - RNA, 19 nt, Homo sapiens
gcugaugcuuugggaagua

SEQ ID NO: 471220 - RNA, 19 nt, Homo sapiens
gcacaggccagagcgauga

SEQ ID NO: 471221 - RNA, 19 nt, Homo sapiens
uaucaaguguugggaaaga

SEQ ID NO: 471222 - RNA, 19 nt, Homo sapiens
ccaaaucugcuccauggaa

SEQ ID NO: 471223 - RNA, 19 nt, Homo sapiens
gcacgguggugaggcaguu

SEQ ID NO: 471224 - RNA, 19 nt, Homo sapiens
gagaaggguguuguaguuu

SEQ ID NO: 471225 - RNA, 19 nt, Homo sapiens
gauaacaucaagcccaaau

SEQ ID NO: 471226 - RNA, 19 nt, Homo sapiens
agaagacgguugcauuuac

SEQ ID NO: 471227 - RNA, 19 nt, Homo sapiens
ggaugauacagcacugaua

SEQ ID NO: 471228 - RNA, 19 nt, Homo sapiens
gcgaugauucugacauuug

SEQ ID NO: 471229 - RNA, 19 nt, Homo sapiens
gaauggguaacucuucuug

SEQ ID NO: 471230 - RNA, 19 nt, Homo sapiens
gaaguggaauggguaacuc

SEQ ID NO: 471231 - RNA, 19 nt, Homo sapiens
aauaucaaguguugggaaa

SEQ ID NO: 471232 - RNA, 19 nt, Homo sapiens
gguuuacacuggauaugga

SEQ ID NO: 471233 - RNA, 19 nt, Homo sapiens
gugaagcguuauagaagau

SEQ ID NO: 471234 - RNA, 19 nt, Homo sapiens
cuaaagaaacgaucagaca

SEQ ID NO: 471235 - RNA, 19 nt, Homo sapiens
gcacuaaaugacaccacua

SEQ ID NO: 471236 - RNA, 19 nt, Homo sapiens
ugaugaugcugaugcuuug

SEQ ID NO: 471237 - RNA, 19 nt, Homo sapiens
gcagcuuccuuacaacagu

SEQ ID NO: 471238 - RNA, 19 nt, Homo sapiens
cgugagaaguuacuacaag

SEQ ID NO: 471239 - RNA, 19 nt, Homo sapiens
gaauguggauuagauuuug

SEQ ID NO: 471240 - RNA, 19 nt, Homo sapiens
cggaagucgucacucuuaa

SEQ ID NO: 471241 - RNA, 19 nt, Homo sapiens
ggaccaggaaagauaauuc

SEQ ID NO: 471242 - RNA, 19 nt, Homo sapiens
gaaaaccugcuaagaagaa

SEQ ID NO: 471243 - RNA, 19 nt, Homo sapiens
gaaugugaagcguuauaga

SEQ ID NO: 471244 - RNA, 19 nt, Homo sapiens
aaagaaacgaucagacaga

SEQ ID NO: 471245 - RNA, 19 nt, Homo sapiens
aaagccaaguuucaacaga

SEQ ID NO: 471246 - RNA, 19 nt, Homo sapiens
aaacuucggguaaaccaaa

SEQ ID NO: 471247 - RNA, 19 nt, Homo sapiens
auaaccaaaugcaauguga

SEQ ID NO: 471248 - RNA, 19 nt, Homo sapiens
ugggaaguauguuaauuuc

SEQ ID NO: 471249 - RNA, 19 nt, Homo sapiens
aaagaaaaccugcuaagaa

SEQ ID NO: 471250 - RNA, 19 nt, Homo sapiens
ugugaagcguuauagaaga

SEQ ID NO: 471251 - RNA, 19 nt, Homo sapiens
cuaaaugacaccacuaaag

SEQ ID NO: 471252 - RNA, 19 nt, Homo sapiens
uaacaucaagcccaaaucu

SEQ ID NO: 471253 - RNA, 19 nt, Homo sapiens
caacagaugaaagugagaa

SEQ ID NO: 471254 - RNA, 19 nt, Homo sapiens
uaagagagaaaccuguguu

SEQ ID NO: 471255 - RNA, 19 nt, Homo sapiens
uacacuggauauggaaaua

SEQ ID NO: 471256 - RNA, 19 nt, Homo sapiens
gaagacgguugcauuuacc

SEQ ID NO: 471257 - RNA, 19 nt, Homo sapiens
uuacuggacucuuuugaaa

SEQ ID NO: 471258 - RNA, 19 nt, Homo sapiens
uuaagcaugcucuaaagaa

SEQ ID NO: 471259 - RNA, 19 nt, Homo sapiens
ggugacauuugugaaacuu

SEQ ID NO: 471260 - RNA, 19 nt, Homo sapiens
ccucccauauguccagauu

SEQ ID NO: 471261 - RNA, 19 nt, Homo sapiens
gaaauagagaggagcaaaa

SEQ ID NO: 471262 - RNA, 19 nt, Homo sapiens
cacuggauauggaaauaga

SEQ ID NO: 471263 - RNA, 19 nt, Homo sapiens
uacugcagcuuccuuacaa

SEQ ID NO: 471264 - RNA, 19 nt, Homo sapiens
guccagauucucuugauga

SEQ ID NO: 471265 - RNA, 19 nt, Homo sapiens
guaauuuuauggccuguga

SEQ ID NO: 471266 - RNA, 19 nt, Homo sapiens
aaugugaagcguuauagaa

SEQ ID NO: 471267 - RNA, 19 nt, Homo sapiens
ggaaugugaagcguuauag

SEQ ID NO: 471268 - RNA, 19 nt, Homo sapiens
aagaaacgaucagacagau

SEQ ID NO: 471269 - RNA, 19 nt, Homo sapiens
ugacaccacuaaagaaacg

SEQ ID NO: 471270 - RNA, 19 nt, Homo sapiens
aaugacaccacuaaagaaa

SEQ ID NO: 471271 - RNA, 19 nt, Homo sapiens
gucagaagacgguugcauu

SEQ ID NO: 471272 - RNA, 19 nt, Homo sapiens
ucugacauuugggaugaua

SEQ ID NO: 471273 - RNA, 19 nt, Homo sapiens
aaaugacaccacuaaagaa

SEQ ID NO: 471274 - RNA, 19 nt, Homo sapiens
uggcauagagcagcacuaa

SEQ ID NO: 471275 - RNA, 19 nt, Homo sapiens
ggaagucgucacucuuaag

SEQ ID NO: 471276 - RNA, 19 nt, Homo sapiens
cgaugauucugacauuugg

SEQ ID NO: 471277 - RNA, 19 nt, Homo sapiens
gcuuugggaaguauguuaa

SEQ ID NO: 471278 - RNA, 19 nt, Homo sapiens
ucccauauguccagauucu

SEQ ID NO: 471279 - RNA, 19 nt, Homo sapiens
aagccaaguuucaacagau

SEQ ID NO: 471280 - RNA, 19 nt, Homo sapiens
agucgucacucuuaagaag

SEQ ID NO: 471281 - RNA, 19 nt, Homo sapiens
gaagauaacuggccucauu

SEQ ID NO: 471282 - RNA, 19 nt, Homo sapiens
ggacauggcuguucauugu

SEQ ID NO: 471283 - RNA, 19 nt, Homo sapiens
ggguaacucuucuugauua

SEQ ID NO: 471284 - RNA, 19 nt, Homo sapiens
agacagaucuggaauguga

SEQ ID NO: 471285 - RNA, 19 nt, Homo sapiens
guagaaagcgugagaaguu

SEQ ID NO: 471286 - RNA, 19 nt, Homo sapiens
uaacuggccucauuucuuc

SEQ ID NO: 471287 - RNA, 19 nt, Homo sapiens
ccaaaugcaaugugaaaua

SEQ ID NO: 471288 - RNA, 19 nt, Homo sapiens
gcauagagcagcacuaaau

SEQ ID NO: 471289 - RNA, 19 nt, Homo sapiens
gaaggguguuguaguuuau

SEQ ID NO: 471290 - RNA, 19 nt, Homo sapiens
ugagaaggguguuguaguu

SEQ ID NO: 471291 - RNA, 19 nt, Homo sapiens
gagcgaugauucugacauu

SEQ ID NO: 471292 - RNA, 19 nt, Homo sapiens
agaaggguguuguaguuua

SEQ ID NO: 471293 - RNA, 19 nt, Homo sapiens
uaaaugacaccacuaaaga

SEQ ID NO: 471294 - RNA, 19 nt, Homo sapiens
gaugauacagcacugauaa

SEQ ID NO: 471295 - RNA, 19 nt, Homo sapiens
gauaaccacucguagaaag

SEQ ID NO: 471296 - RNA, 19 nt, Homo sapiens
uagaaagcgugagaaguua

SEQ ID NO: 471297 - RNA, 19 nt, Homo sapiens
gaauacugcagcuuccuua

SEQ ID NO: 471298 - RNA, 19 nt, Homo sapiens
gaaucuaacugguggacau

SEQ ID NO: 471299 - RNA, 19 nt, Homo sapiens
gcggaagucgucacucuua

SEQ ID NO: 471300 - RNA, 19 nt, Homo sapiens
gcuaucauacuggcuauua

SEQ ID NO: 471301 - RNA, 19 nt, Homo sapiens
gagagaaaccuguguugug

SEQ ID NO: 471302 - RNA, 19 nt, Homo sapiens
gcuguucauuguacuguuu

SEQ ID NO: 471303 - RNA, 19 nt, Homo sapiens
ucuggaaugugaagcguua

SEQ ID NO: 471304 - RNA, 19 nt, Homo sapiens
gaagucgucacucuuaaga

SEQ ID NO: 471305 - RNA, 19 nt, Homo sapiens
gcgauaaccacucguagaa

SEQ ID NO: 471306 - RNA, 19 nt, Homo sapiens
gaaguguuagagugucuua

SEQ ID NO: 471307 - RNA, 19 nt, Homo sapiens
guaauaaccaaaugcaaug

SEQ ID NO: 471308 - RNA, 19 nt, Homo sapiens
gguaacucuucuugauuaa

SEQ ID NO: 471309 - RNA, 19 nt, Homo sapiens
ucugugaaguagcuaauaa

SEQ ID NO: 471310 - RNA, 19 nt, Homo sapiens
uaagcaugcucuaaagaau

SEQ ID NO: 471311 - RNA, 19 nt, Homo sapiens
gaaaaugaaagccaaguuu

SEQ ID NO: 471312 - RNA, 19 nt, Homo sapiens
ggaaauagagaggagcaaa

SEQ ID NO: 471313 - RNA, 19 nt, Homo sapiens
cagaagacgguugcauuua

SEQ ID NO: 471314 - RNA, 19 nt, Homo sapiens
ucagaagacgguugcauuu

SEQ ID NO: 471315 - RNA, 19 nt, Homo sapiens
gaaugaaguguuagagugu

SEQ ID NO: 471316 - RNA, 19 nt, Homo sapiens
gcugaugcuuugggaagua

SEQ ID NO: 471317 - RNA, 19 nt, Homo sapiens
gcacaggccagagcgauga

SEQ ID NO: 471318 - RNA, 19 nt, Homo sapiens
uaucaaguguugggaaaga

SEQ ID NO: 471319 - RNA, 19 nt, Homo sapiens
gcuauuauauggaaaugcu

SEQ ID NO: 471320 - RNA, 19 nt, Homo sapiens
ccaaaucugcuccauggaa

SEQ ID NO: 471321 - RNA, 19 nt, Homo sapiens
gcacgguggugaggcaguu

SEQ ID NO: 471322 - RNA, 19 nt, Homo sapiens
gagaaggguguuguaguuu

SEQ ID NO: 471323 - RNA, 19 nt, Homo sapiens
gauaacaucaagcccaaau

SEQ ID NO: 471324 - RNA, 19 nt, Homo sapiens
agaagacgguugcauuuac

SEQ ID NO: 471325 - RNA, 19 nt, Homo sapiens
ggaugauacagcacugaua

SEQ ID NO: 471326 - RNA, 19 nt, Homo sapiens
gcgaugauucugacauuug

SEQ ID NO: 471327 - RNA, 19 nt, Homo sapiens
gaauggguaacucuucuug

SEQ ID NO: 471328 - RNA, 19 nt, Homo sapiens
gaaguggaauggguaacuc

SEQ ID NO: 471329 - RNA, 19 nt, Homo sapiens
aauaucaaguguugggaaa

SEQ ID NO: 471330 - RNA, 19 nt, Homo sapiens
gguuuacacuggauaugga

SEQ ID NO: 471331 - RNA, 19 nt, Homo sapiens
gugaagcguuauagaagau

SEQ ID NO: 471332 - RNA, 19 nt, Homo sapiens
cuaaagaaacgaucagaca

SEQ ID NO: 471333 - RNA, 19 nt, Homo sapiens
gcacuaaaugacaccacua

SEQ ID NO: 471334 - RNA, 19 nt, Homo sapiens
ugaugaugcugaugcuuug

SEQ ID NO: 471335 - RNA, 19 nt, Homo sapiens
gcagcuuccuuacaacagu

SEQ ID NO: 471336 - RNA, 19 nt, Homo sapiens
gaauguggauuagauuuug

SEQ ID NO: 471337 - RNA, 19 nt, Homo sapiens
ggaccaggaaagauaauuc

SEQ ID NO: 471338 - RNA, 19 nt, Homo sapiens
cgugagaaguuacuacaag

SEQ ID NO: 471339 - RNA, 19 nt, Homo sapiens
gaaaaccugcuaagaagaa

SEQ ID NO: 471340 - RNA, 19 nt, Homo sapiens
cggaagucgucacucuuaa

SEQ ID NO: 471341 - RNA, 19 nt, Homo sapiens
gaaugugaagcguuauaga

SEQ ID NO: 471342 - RNA, 19 nt, Homo sapiens
aaagaaacgaucagacaga

SEQ ID NO: 471343 - RNA, 19 nt, Homo sapiens
aaagccaaguuucaacaga

SEQ ID NO: 471344 - RNA, 19 nt, Homo sapiens
aaacuucggguaaaccaaa

SEQ ID NO: 471345 - RNA, 19 nt, Homo sapiens
auaaccaaaugcaauguga

SEQ ID NO: 471346 - RNA, 19 nt, Homo sapiens
ugggaaguauguuaauuuc

SEQ ID NO: 471347 - RNA, 19 nt, Homo sapiens
aaagaaaaccugcuaagaa

SEQ ID NO: 471348 - RNA, 19 nt, Homo sapiens
ugugaagcguuauagaaga

SEQ ID NO: 471349 - RNA, 19 nt, Homo sapiens
cuaaaugacaccacuaaag

SEQ ID NO: 471350 - RNA, 19 nt, Homo sapiens
uaacaucaagcccaaaucu

SEQ ID NO: 471351 - RNA, 19 nt, Homo sapiens
caacagaugaaagugagaa

SEQ ID NO: 471352 - RNA, 19 nt, Homo sapiens
uaagagagaaaccuguguu

SEQ ID NO: 471353 - RNA, 19 nt, Homo sapiens
uacacuggauauggaaaua

SEQ ID NO: 471354 - RNA, 19 nt, Homo sapiens
gaagacgguugcauuuacc

SEQ ID NO: 471355 - RNA, 19 nt, Homo sapiens
uuacuggacucuuuugaaa

SEQ ID NO: 471356 - RNA, 19 nt, Homo sapiens
uuaagcaugcucuaaagaa

SEQ ID NO: 471357 - RNA, 19 nt, Homo sapiens
ggugacauuugugaaacuu

SEQ ID NO: 471358 - RNA, 19 nt, Homo sapiens
ccucccauauguccagauu

SEQ ID NO: 471359 - RNA, 19 nt, Homo sapiens
gaaauagagaggagcaaaa

SEQ ID NO: 471360 - RNA, 19 nt, Homo sapiens
cacuggauauggaaauaga

SEQ ID NO: 471361 - RNA, 19 nt, Homo sapiens
uacugcagcuuccuuacaa

SEQ ID NO: 471362 - RNA, 19 nt, Homo sapiens
guccagauucucuugauga

SEQ ID NO: 471363 - RNA, 19 nt, Homo sapiens
guaauuuuauggccuguga

SEQ ID NO: 471364 - RNA, 19 nt, Homo sapiens
aaugugaagcguuauagaa

SEQ ID NO: 471365 - RNA, 19 nt, Homo sapiens
ggaaugugaagcguuauag

SEQ ID NO: 471366 - RNA, 19 nt, Homo sapiens
aagaaacgaucagacagau

SEQ ID NO: 471367 - RNA, 19 nt, Homo sapiens
ugacaccacuaaagaaacg

SEQ ID NO: 471368 - RNA, 19 nt, Homo sapiens
aaugacaccacuaaagaaa

SEQ ID NO: 471369 - RNA, 19 nt, Homo sapiens
gucagaagacgguugcauu

SEQ ID NO: 471370 - RNA, 19 nt, Homo sapiens
aaaugacaccacuaaagaa

SEQ ID NO: 471371 - RNA, 19 nt, Homo sapiens
ucugacauuugggaugaua

SEQ ID NO: 471372 - RNA, 19 nt, Homo sapiens
uggcauagagcagcacuaa

SEQ ID NO: 471373 - RNA, 19 nt, Homo sapiens
ggaagucgucacucuuaag

SEQ ID NO: 471374 - RNA, 19 nt, Homo sapiens
cgaugauucugacauuugg

SEQ ID NO: 471375 - RNA, 19 nt, Homo sapiens
gcuuugggaaguauguuaa

SEQ ID NO: 471376 - RNA, 19 nt, Homo sapiens
ucccauauguccagauucu

SEQ ID NO: 471377 - RNA, 19 nt, Homo sapiens
aagccaaguuucaacagau

SEQ ID NO: 471378 - RNA, 19 nt, Homo sapiens
agucgucacucuuaagaag

SEQ ID NO: 471379 - RNA, 19 nt, Homo sapiens
gaauaaaagccaaaagaag

SEQ ID NO: 471380 - RNA, 19 nt, Homo sapiens
gacauggcuguucauugua

SEQ ID NO: 471381 - RNA, 19 nt, Homo sapiens
ggaaagagaggaaccaaua

SEQ ID NO: 471382 - RNA, 19 nt, Homo sapiens
caagaaagcuuccuucaac

SEQ ID NO: 471383 - RNA, 19 nt, Homo sapiens
ugacaaagccucugaaaga

SEQ ID NO: 471384 - RNA, 19 nt, Homo sapiens
gagaagaaauacagucaau

SEQ ID NO: 471385 - RNA, 19 nt, Homo sapiens
ggaaagagccuaacaucuc

SEQ ID NO: 471386 - RNA, 19 nt, Homo sapiens
cgaaugaggugcagaacau

SEQ ID NO: 471387 - RNA, 19 nt, Homo sapiens
gaagagaguucuggauguc

SEQ ID NO: 471388 - RNA, 19 nt, Homo sapiens
caaccuguuugccauguuu

SEQ ID NO: 471389 - RNA, 19 nt, Homo sapiens
gcaagaaagcuuccuucaa

SEQ ID NO: 471390 - RNA, 19 nt, Homo sapiens
gagcccaccuccaaugaga

SEQ ID NO: 471391 - RNA, 19 nt, Homo sapiens
gauggguccucuagacuug

SEQ ID NO: 471392 - RNA, 19 nt, Homo sapiens
gagauucccaccuuccaua

SEQ ID NO: 471393 - RNA, 19 nt, Homo sapiens
gacaaagccucugaaagau

SEQ ID NO: 471394 - RNA, 19 nt, Homo sapiens
ggcacgagcuccugcagaa

SEQ ID NO: 471395 - RNA, 19 nt, Homo sapiens
gagaagaucaaccuguuug

SEQ ID NO: 471396 - RNA, 19 nt, Homo sapiens
gagcucaggguccuuguuu

SEQ ID NO: 471397 - RNA, 19 nt, Homo sapiens
cgaagagaguucuggaugu

SEQ ID NO: 471398 - RNA, 19 nt, Homo sapiens
ggaggaagaggaagaagga

SEQ ID NO: 471399 - RNA, 19 nt, Homo sapiens
caaagcggaucaagaagag

SEQ ID NO: 471400 - RNA, 19 nt, Homo sapiens
gggacuaugugcuauguca

SEQ ID NO: 471401 - RNA, 19 nt, Homo sapiens
ccugauggcuggugugguu

SEQ ID NO: 471402 - RNA, 19 nt, Homo sapiens
ccugaaggcugcacgaaug

SEQ ID NO: 471403 - RNA, 19 nt, Homo sapiens
gugaggagauucccaccuu

SEQ ID NO: 471404 - RNA, 19 nt, Homo sapiens
ggacacagaacucauggau

SEQ ID NO: 471405 - RNA, 19 nt, Homo sapiens
ggaagaagaagaggaggaa

SEQ ID NO: 471406 - RNA, 19 nt, Homo sapiens
ggagaagaucaaccuguuu

SEQ ID NO: 471407 - RNA, 19 nt, Homo sapiens
gcuacaagaacuaccgaua

SEQ ID NO: 471408 - RNA, 19 nt, Homo sapiens
gagcaugcuucccuaggau

SEQ ID NO: 471409 - RNA, 19 nt, Homo sapiens
gggcaagaccuccuacuuc

SEQ ID NO: 471410 - RNA, 19 nt, Homo sapiens
ucgcuacccugcuguuauu

SEQ ID NO: 471411 - RNA, 19 nt, Homo sapiens
aagaagagcaagaugauug

SEQ ID NO: 471412 - RNA, 19 nt, Homo sapiens
ccaaagcggaucaagaaga

SEQ ID NO: 471413 - RNA, 19 nt, Homo sapiens
uggagaagaucaaccuguu

SEQ ID NO: 471414 - RNA, 19 nt, Homo sapiens
ccauuucaguucaguuuca

SEQ ID NO: 471415 - RNA, 19 nt, Homo sapiens
ugacugcccuccgaagaga

SEQ ID NO: 471416 - RNA, 19 nt, Homo sapiens
cgagcaugcuucccuagga

SEQ ID NO: 471417 - RNA, 19 nt, Homo sapiens
gaaagagaggaaccaauac

SEQ ID NO: 471418 - RNA, 19 nt, Homo sapiens
agaacccgcucuucacaga

SEQ ID NO: 471419 - RNA, 19 nt, Homo sapiens
gagccaaagcggaucaaga

SEQ ID NO: 471420 - RNA, 19 nt, Homo sapiens
gucaaugcgugcuucuuug

SEQ ID NO: 471421 - RNA, 19 nt, Homo sapiens
cgucaaugcgugcuucuuu

SEQ ID NO: 471422 - RNA, 19 nt, Homo sapiens
ggacaugcacagcuacauc

SEQ ID NO: 471423 - RNA, 19 nt, Homo sapiens
gccaaggccuucucuaagc

SEQ ID NO: 471424 - RNA, 19 nt, Homo sapiens
gcuuugugcucauuaccuu

SEQ ID NO: 471425 - RNA, 19 nt, Homo sapiens
gcagcaggacugugggaaa

SEQ ID NO: 471426 - RNA, 19 nt, Homo sapiens
ggauaggagcagugaguga

SEQ ID NO: 471427 - RNA, 19 nt, Homo sapiens
ccacuucuacgacuucuuc

SEQ ID NO: 471428 - RNA, 19 nt, Homo sapiens
ggagaagaaauacagucaa

SEQ ID NO: 471429 - RNA, 19 nt, Homo sapiens
gggagaagaaauacaguca

SEQ ID NO: 471430 - RNA, 19 nt, Homo sapiens
ugcacacacucaccucuaa

SEQ ID NO: 471431 - RNA, 19 nt, Homo sapiens
gauggacacagaacucaug

SEQ ID NO: 471432 - RNA, 19 nt, Homo sapiens
ucaagaagagcaagaugau

SEQ ID NO: 471433 - RNA, 19 nt, Homo sapiens
gcaggaagccauagaugcu

SEQ ID NO: 471434 - RNA, 19 nt, Homo sapiens
ggauggguccucuagacuu

SEQ ID NO: 471435 - RNA, 19 nt, Homo sapiens
cagcaggacugugggaaag

SEQ ID NO: 471436 - RNA, 19 nt, Homo sapiens
ccguauacaugcccaagug

SEQ ID NO: 471437 - RNA, 19 nt, Homo sapiens
gaucaagaagagcaagaug

SEQ ID NO: 471438 - RNA, 19 nt, Homo sapiens
ccaaaaguguugacugugu

SEQ ID NO: 471439 - RNA, 19 nt, Homo sapiens
gcaggacugugggaaagag

SEQ ID NO: 471440 - RNA, 19 nt, Homo sapiens
caagaagagcaagaugauu

SEQ ID NO: 471441 - RNA, 19 nt, Homo sapiens
agccaaagcggaucaagaa

SEQ ID NO: 471442 - RNA, 19 nt, Homo sapiens
gguuugugguccucaccua

SEQ ID NO: 471443 - RNA, 19 nt, Homo sapiens
uccauagccuccaaacaug

SEQ ID NO: 471444 - RNA, 19 nt, Homo sapiens
cagcggugccaaccucuuu

SEQ ID NO: 471445 - RNA, 19 nt, Homo sapiens
aacaucaaguucaacaguu

SEQ ID NO: 471446 - RNA, 19 nt, Homo sapiens
gcugugugccguauacaug

SEQ ID NO: 471447 - RNA, 19 nt, Homo sapiens
ccaaccugauggacacaga

SEQ ID NO: 471448 - RNA, 19 nt, Homo sapiens
acaucaaguucaacaguuc

SEQ ID NO: 471449 - RNA, 19 nt, Homo sapiens
gggaaagagccuaacaucu

SEQ ID NO: 471450 - RNA, 19 nt, Homo sapiens
gcugaagacaacuuggauu

SEQ ID NO: 471451 - RNA, 19 nt, Homo sapiens
gaggaaccaauaccuucaa

SEQ ID NO: 471452 - RNA, 19 nt, Homo sapiens
uauacaugcccaaguguga

SEQ ID NO: 471453 - RNA, 19 nt, Homo sapiens
gccaaccucuuugcguuuc

SEQ ID NO: 471454 - RNA, 19 nt, Homo sapiens
acucuguucuccaucaaga

SEQ ID NO: 471455 - RNA, 19 nt, Homo sapiens
ucaugacucuguucuccau

SEQ ID NO: 471456 - RNA, 19 nt, Homo sapiens
uggcuggugugguuugguu

SEQ ID NO: 471457 - RNA, 19 nt, Homo sapiens
cugaagacaacuuggauug

SEQ ID NO: 471458 - RNA, 19 nt, Homo sapiens
gccggugggugaggagauu

SEQ ID NO: 471459 - RNA, 19 nt, Homo sapiens
gcugaugggugcccuuucc

SEQ ID NO: 471460 - RNA, 19 nt, Homo sapiens
aagaagaagaggaggaaga

SEQ ID NO: 471461 - RNA, 19 nt, Homo sapiens
acugugagaucaagaaucg

SEQ ID NO: 471462 - RNA, 19 nt, Homo sapiens
cuacaagaacuaccgauac

SEQ ID NO: 471463 - RNA, 19 nt, Homo sapiens
cuggcacacuuccuucaaa

SEQ ID NO: 471464 - RNA, 19 nt, Homo sapiens
ggcaagaaagcuuccuuca

SEQ ID NO: 471465 - RNA, 19 nt, Homo sapiens
acaaagccucugaaagaug

SEQ ID NO: 471466 - RNA, 19 nt, Homo sapiens
gucauuaguccuuugucua

SEQ ID NO: 471467 - RNA, 19 nt, Homo sapiens
gcucaggguccuuguuucu

SEQ ID NO: 471468 - RNA, 19 nt, Homo sapiens
gggcugaagacaacuugga

SEQ ID NO: 471469 - RNA, 19 nt, Homo sapiens
accaggacaugcacagcua

SEQ ID NO: 471470 - RNA, 19 nt, Homo sapiens
agaagaggaggaagaggaa

SEQ ID NO: 471471 - RNA, 19 nt, Homo sapiens
ccagaacccgcucuucaca

SEQ ID NO: 471472 - RNA, 19 nt, Homo sapiens
gagcugcugcacacacuca

SEQ ID NO: 471473 - RNA, 19 nt, Homo sapiens
ggaggcagaggugacaguu

SEQ ID NO: 471474 - RNA, 19 nt, Homo sapiens
cuggaugucuggcucaaag

SEQ ID NO: 471475 - RNA, 19 nt, Homo sapiens
gagugacgaugagccaaag

SEQ ID NO: 471476 - RNA, 19 nt, Homo sapiens
cagccucucucgggcaaga

SEQ ID NO: 471477 - RNA, 19 nt, Homo sapiens
cagcaggaagccauagaug

SEQ ID NO: 471478 - RNA, 19 nt, Homo sapiens
gcugacugcccuccgaaga

SEQ ID NO: 471479 - RNA, 19 nt, Homo sapiens
uugccaaggccuucucuaa

SEQ ID NO: 471480 - RNA, 19 nt, Homo sapiens
cugcuguuauucucuucua

SEQ ID NO: 471481 - RNA, 19 nt, Homo sapiens
ccaaauagauggaaacuac

SEQ ID NO: 471482 - RNA, 19 nt, Homo sapiens
gcauauaauuggccacauu

SEQ ID NO: 471483 - RNA, 19 nt, Homo sapiens
ggagacaaagugcauauaa

SEQ ID NO: 471484 - RNA, 19 nt, Homo sapiens
gcacugggaucaugacuac

SEQ ID NO: 471485 - RNA, 19 nt, Homo sapiens
gagacaaagugcauauaau

SEQ ID NO: 471486 - RNA, 19 nt, Homo sapiens
aaacauaccgggagccaua

SEQ ID NO: 471487 - RNA, 19 nt, Homo sapiens
gaacaucucuuugccuacu

SEQ ID NO: 471488 - RNA, 19 nt, Homo sapiens
ccucaucucucucaauaug

SEQ ID NO: 471489 - RNA, 19 nt, Homo sapiens
aauuugaggucuucuauga

SEQ ID NO: 471490 - RNA, 19 nt, Homo sapiens
cgccucaucucucucaaua

SEQ ID NO: 471491 - RNA, 19 nt, Homo sapiens
ccagggcacugucugaaga

SEQ ID NO: 471492 - RNA, 19 nt, Homo sapiens
gaagaaggaacccaaugug

SEQ ID NO: 471493 - RNA, 19 nt, Homo sapiens
gacaaagugcauauaauug

SEQ ID NO: 471494 - RNA, 19 nt, Homo sapiens
gcgaauacagcaaguguga

SEQ ID NO: 471495 - RNA, 19 nt, Homo sapiens
cagguuacaucgcauagug

SEQ ID NO: 471496 - RNA, 19 nt, Homo sapiens
gaaccucaccugcccaauc

SEQ ID NO: 471497 - RNA, 19 nt, Homo sapiens
caucuuggaacaucucuuu

SEQ ID NO: 471498 - RNA, 19 nt, Homo sapiens
gaacuucuggcucuugauc

SEQ ID NO: 471499 - RNA, 19 nt, Homo sapiens
ggaugaauuugaggucuuc

SEQ ID NO: 471500 - RNA, 19 nt, Homo sapiens
gcuggagcuggaauuauua

SEQ ID NO: 471501 - RNA, 19 nt, Homo sapiens
gaccugcacugggaucaug

SEQ ID NO: 471502 - RNA, 19 nt, Homo sapiens
cuacagggcucgagaaacc

SEQ ID NO: 471503 - RNA, 19 nt, Homo sapiens
agaccuacauccugaaucu

SEQ ID NO: 471504 - RNA, 19 nt, Homo sapiens
ggcacaaccugguauaucg

SEQ ID NO: 471505 - RNA, 19 nt, Homo sapiens
gaggagacaaagugcauau

SEQ ID NO: 471506 - RNA, 19 nt, Homo sapiens
cuaccuacaucggccuuaa

SEQ ID NO: 471507 - RNA, 19 nt, Homo sapiens
ccaucaagcugugcaaucu

SEQ ID NO: 471508 - RNA, 19 nt, Homo sapiens
uuugaggucuucuaugaug

SEQ ID NO: 471509 - RNA, 19 nt, Homo sapiens
cacccuggcugcucaguuc

SEQ ID NO: 471510 - RNA, 19 nt, Homo sapiens
ugaagaaggaacccaaugu

SEQ ID NO: 471511 - RNA, 19 nt, Homo sapiens
gaauuugaggucuucuaug

SEQ ID NO: 471512 - RNA, 19 nt, Homo sapiens
gaauuguagccagguauga

SEQ ID NO: 471513 - RNA, 19 nt, Homo sapiens
guacuggacaggagacauc

SEQ ID NO: 471514 - RNA, 19 nt, Homo sapiens
caaggccacuguuuugcua

SEQ ID NO: 471515 - RNA, 19 nt, Homo sapiens
ugaauuugaggucuucuau

SEQ ID NO: 471516 - RNA, 19 nt, Homo sapiens
ggaucgaggagacaaagug

SEQ ID NO: 471517 - RNA, 19 nt, Homo sapiens
acaaagugcauauaauugg

SEQ ID NO: 471518 - RNA, 19 nt, Homo sapiens
ugugggcacugggacauuu

SEQ ID NO: 471519 - RNA, 19 nt, Homo sapiens
gcacuggcagcuucucuac

SEQ ID NO: 471520 - RNA, 19 nt, Homo sapiens
gggcgaauacagcaagugu

SEQ ID NO: 471521 - RNA, 19 nt, Homo sapiens
cauauaauuggccacauuc

SEQ ID NO: 471522 - RNA, 19 nt, Homo sapiens
cugcgcacccucagaauug

SEQ ID NO: 471523 - RNA, 19 nt, Homo sapiens
uaccguguguaccaaauag

SEQ ID NO: 471524 - RNA, 19 nt, Homo sapiens
aaccucaccugcccaaucu

SEQ ID NO: 471525 - RNA, 19 nt, Homo sapiens
uggaugaauuugaggucuu

SEQ ID NO: 471526 - RNA, 19 nt, Homo sapiens
ccuggcugcucaguucuuu

SEQ ID NO: 471527 - RNA, 19 nt, Homo sapiens
ccaucaaccucgggcugaa

SEQ ID NO: 471528 - RNA, 19 nt, Homo sapiens
cagugcaacuaccuacauc

SEQ ID NO: 471529 - RNA, 19 nt, Homo sapiens
cgaauuguagccagguaug

SEQ ID NO: 471530 - RNA, 19 nt, Homo sapiens
uguaccaaauagauggaaa

SEQ ID NO: 471531 - RNA, 19 nt, Homo sapiens
guuaccguguguaccaaau

SEQ ID NO: 471532 - RNA, 19 nt, Homo sapiens
gacauuuucucaucuugga

SEQ ID NO: 471533 - RNA, 19 nt, Homo sapiens
gcacugggacauuuucuca

SEQ ID NO: 471534 - RNA, 19 nt, Homo sapiens
ggacagaacuaaagaacaa

SEQ ID NO: 471535 - RNA, 19 nt, Homo sapiens
gcagagaggucgccguuga

SEQ ID NO: 471536 - RNA, 19 nt, Homo sapiens
ggaggucaauggcuuauau

SEQ ID NO: 471537 - RNA, 19 nt, Homo sapiens
caaggcaguuucuggguuu

SEQ ID NO: 471538 - RNA, 19 nt, Homo sapiens
ccugauggcuacucuguuu

SEQ ID NO: 471539 - RNA, 19 nt, Homo sapiens
caugaugccuaucuugaaa

SEQ ID NO: 471540 - RNA, 19 nt, Homo sapiens
ugaaaccacuacaggcuuu

SEQ ID NO: 471541 - RNA, 19 nt, Homo sapiens
gggacgagcuuggaggaaa

SEQ ID NO: 471542 - RNA, 19 nt, Homo sapiens
cagcacaucuacacucuca

SEQ ID NO: 471543 - RNA, 19 nt, Homo sapiens
ggaaggcaacacaauggua

SEQ ID NO: 471544 - RNA, 19 nt, Homo sapiens
caagaaggcagacgugguu

SEQ ID NO: 471545 - RNA, 19 nt, Homo sapiens
cgaauacaaucgacagaag

SEQ ID NO: 471546 - RNA, 19 nt, Homo sapiens
gcacaucuacacucucaau

SEQ ID NO: 471547 - RNA, 19 nt, Homo sapiens
acacaaugguacccaagaa

SEQ ID NO: 471548 - RNA, 19 nt, Homo sapiens
ggaauuggcccaguucauc

SEQ ID NO: 471549 - RNA, 19 nt, Homo sapiens
gcauugacuacgugcuuua

SEQ ID NO: 471550 - RNA, 19 nt, Homo sapiens
guggagaccucaacaugca

SEQ ID NO: 471551 - RNA, 19 nt, Homo sapiens
gcugaagccauuucccuuu

SEQ ID NO: 471552 - RNA, 19 nt, Homo sapiens
ggacaucuaccuagcacau

SEQ ID NO: 471553 - RNA, 19 nt, Homo sapiens
agcaggagcugaagccauu

SEQ ID NO: 471554 - RNA, 19 nt, Homo sapiens
ggacuuccaguaccugaga

SEQ ID NO: 471555 - RNA, 19 nt, Homo sapiens
gcaguggccucugugucuu

SEQ ID NO: 471556 - RNA, 19 nt, Homo sapiens
gaggucaauggcuuauaua

SEQ ID NO: 471557 - RNA, 19 nt, Homo sapiens
gcugcugccugcugaagga

SEQ ID NO: 471558 - RNA, 19 nt, Homo sapiens
gagcuuacccagcacaucu

SEQ ID NO: 471559 - RNA, 19 nt, Homo sapiens
uggaggagguguggaguga

SEQ ID NO: 471560 - RNA, 19 nt, Homo sapiens
gaggaaggcaacacaaugg

SEQ ID NO: 471561 - RNA, 19 nt, Homo sapiens
ggagugagcaggacuucca

SEQ ID NO: 471562 - RNA, 19 nt, Homo sapiens
ggacgagcuuggaggaaaa

SEQ ID NO: 471563 - RNA, 19 nt, Homo sapiens
caccuucgcuagcuaugug

SEQ ID NO: 471564 - RNA, 19 nt, Homo sapiens
uaaguggcauggugcucaa

SEQ ID NO: 471565 - RNA, 19 nt, Homo sapiens
caagggaggcccaggaucu

SEQ ID NO: 471566 - RNA, 19 nt, Homo sapiens
ugaugugugugcuaaagga

SEQ ID NO: 471567 - RNA, 19 nt, Homo sapiens
gaagccauuucccuuuggu

SEQ ID NO: 471568 - RNA, 19 nt, Homo sapiens
cugaagccauuucccuuug

SEQ ID NO: 471569 - RNA, 19 nt, Homo sapiens
gaaggacaucuaccuagca

SEQ ID NO: 471570 - RNA, 19 nt, Homo sapiens
ggucgccguugaugugugu

SEQ ID NO: 471571 - RNA, 19 nt, Homo sapiens
caacaugcacccagaagac

SEQ ID NO: 471572 - RNA, 19 nt, Homo sapiens
ggaacggucuagggagaag

SEQ ID NO: 471573 - RNA, 19 nt, Homo sapiens
cauccaauccaggagcuua

SEQ ID NO: 471574 - RNA, 19 nt, Homo sapiens
ugaggaaggcaacacaaug

SEQ ID NO: 471575 - RNA, 19 nt, Homo sapiens
gugcucaacgccuauguga

SEQ ID NO: 471576 - RNA, 19 nt, Homo sapiens
gugagcaggacuuccagua

SEQ ID NO: 471577 - RNA, 19 nt, Homo sapiens
gagcuucgaccuggcuuug

SEQ ID NO: 471578 - RNA, 19 nt, Homo sapiens
acagaaggacaucuaccua

SEQ ID NO: 471579 - RNA, 19 nt, Homo sapiens
gggccaccuucgcuagcua

SEQ ID NO: 471580 - RNA, 19 nt, Homo sapiens
uccaguaccugagacagaa

SEQ ID NO: 471581 - RNA, 19 nt, Homo sapiens
gcugugggcaggugcauuc

SEQ ID NO: 471582 - RNA, 19 nt, Homo sapiens
gcgaagaaggaacggucua

SEQ ID NO: 471583 - RNA, 19 nt, Homo sapiens
gugggcaggugcauucuac

SEQ ID NO: 471584 - RNA, 19 nt, Homo sapiens
guugaugugugugcuaaag

SEQ ID NO: 471585 - RNA, 19 nt, Homo sapiens
uugacuacgugcuuuacaa

SEQ ID NO: 471586 - RNA, 19 nt, Homo sapiens
ucaugaugccuaucuugaa

SEQ ID NO: 471587 - RNA, 19 nt, Homo sapiens
agacgugguucuguugugu

SEQ ID NO: 471588 - RNA, 19 nt, Homo sapiens
ggucaauggcuuauauagg

SEQ ID NO: 471589 - RNA, 19 nt, Homo sapiens
caaccaugaagcucaacuu

SEQ ID NO: 471590 - RNA, 19 nt, Homo sapiens
cagaagcugucaccuaccu

SEQ ID NO: 471591 - RNA, 19 nt, Homo sapiens
acaggaggucaauggcuua

SEQ ID NO: 471592 - RNA, 19 nt, Homo sapiens
ccguugaugugugugcuaa

SEQ ID NO: 471593 - RNA, 19 nt, Homo sapiens
agaggucgccguugaugug

SEQ ID NO: 471594 - RNA, 19 nt, Homo sapiens
cuucaagggcucugaggaa

SEQ ID NO: 471595 - RNA, 19 nt, Homo sapiens
ggcaguggccucugugucu

SEQ ID NO: 471596 - RNA, 19 nt, Homo sapiens
cgcauugacuacgugcuuu

SEQ ID NO: 471597 - RNA, 19 nt, Homo sapiens
gagaggucgccguugaugu

SEQ ID NO: 471598 - RNA, 19 nt, Homo sapiens
gauggcuacucuguuugug

SEQ ID NO: 471599 - RNA, 19 nt, Homo sapiens
guguggagaccucaacaug

SEQ ID NO: 471600 - RNA, 19 nt, Homo sapiens
ccaucuccaugccgaauac

SEQ ID NO: 471601 - RNA, 19 nt, Homo sapiens
ugaagccauuucccuuugg

SEQ ID NO: 471602 - RNA, 19 nt, Homo sapiens
ucuugaaacucgggacuuc

SEQ ID NO: 471603 - RNA, 19 nt, Homo sapiens
gaguggacagggcuucaug

SEQ ID NO: 471604 - RNA, 19 nt, Homo sapiens
ucaacaugcacccagaaga

SEQ ID NO: 471605 - RNA, 19 nt, Homo sapiens
ugacauagaugaaguggua

SEQ ID NO: 471606 - RNA, 19 nt, Homo sapiens
ggaaauauucucauccuua

SEQ ID NO: 471607 - RNA, 19 nt, Homo sapiens
gaagagaucgacaguauuu

SEQ ID NO: 471608 - RNA, 19 nt, Homo sapiens
gcaggaccauggcuauuua

SEQ ID NO: 471609 - RNA, 19 nt, Homo sapiens
ggagagaauuugauuaugu

SEQ ID NO: 471610 - RNA, 19 nt, Homo sapiens
gaaacaggaugggaaauau

SEQ ID NO: 471611 - RNA, 19 nt, Homo sapiens
gaaauauucucauccuuag

SEQ ID NO: 471612 - RNA, 19 nt, Homo sapiens
gaggagccaucgacagaua

SEQ ID NO: 471613 - RNA, 19 nt, Homo sapiens
ggaggcauauugugugaaa

SEQ ID NO: 471614 - RNA, 19 nt, Homo sapiens
gcaaagauguacucauucu

SEQ ID NO: 471615 - RNA, 19 nt, Homo sapiens
uagaugaagugguauauga

SEQ ID NO: 471616 - RNA, 19 nt, Homo sapiens
caaagaagggagagaauuu

SEQ ID NO: 471617 - RNA, 19 nt, Homo sapiens
uggcaaagauguacucauu

SEQ ID NO: 471618 - RNA, 19 nt, Homo sapiens
ugacgaagauucaccuuau

SEQ ID NO: 471619 - RNA, 19 nt, Homo sapiens
aagaagagaucgacaguau

SEQ ID NO: 471620 - RNA, 19 nt, Homo sapiens
gaacaaaguagaggaaaga

SEQ ID NO: 471621 - RNA, 19 nt, Homo sapiens
gaagagguacgccaaagaa

SEQ ID NO: 471622 - RNA, 19 nt, Homo sapiens
gaagcaguuuggaaauauu

SEQ ID NO: 471623 - RNA, 19 nt, Homo sapiens
gcacagcgaagacugcuaa

SEQ ID NO: 471624 - RNA, 19 nt, Homo sapiens
gaagggagagaauuugauu

SEQ ID NO: 471625 - RNA, 19 nt, Homo sapiens
ggaaagaaugaaagaauug

SEQ ID NO: 471626 - RNA, 19 nt, Homo sapiens
gagagaauuugauuaugug

SEQ ID NO: 471627 - RNA, 19 nt, Homo sapiens
gaagauucaccuuaucaaa

SEQ ID NO: 471628 - RNA, 19 nt, Homo sapiens
caaaguagaggaaagaaug

SEQ ID NO: 471629 - RNA, 19 nt, Homo sapiens
gagagugauuuggcauaua

SEQ ID NO: 471630 - RNA, 19 nt, Homo sapiens
cagaagcacugucgcucua

SEQ ID NO: 471631 - RNA, 19 nt, Homo sapiens
gaauuuacccacauggauu

SEQ ID NO: 471632 - RNA, 19 nt, Homo sapiens
cgaagcaguuuggaaauau

SEQ ID NO: 471633 - RNA, 19 nt, Homo sapiens
gaggaaagaaugaaagaau

SEQ ID NO: 471634 - RNA, 19 nt, Homo sapiens
gaaacgauuaccacccaua

SEQ ID NO: 471635 - RNA, 19 nt, Homo sapiens
gagggaagaucuugauggu

SEQ ID NO: 471636 - RNA, 19 nt, Homo sapiens
gcugaaggaugguuagaca

SEQ ID NO: 471637 - RNA, 19 nt, Homo sapiens
gcacagcacgcucgacuuc

SEQ ID NO: 471638 - RNA, 19 nt, Homo sapiens
ucgaagcaguuuggaaaua

SEQ ID NO: 471639 - RNA, 19 nt, Homo sapiens
ugaaacaggaugggaaaua

SEQ ID NO: 471640 - RNA, 19 nt, Homo sapiens
gguagagauugaccaaaug

SEQ ID NO: 471641 - RNA, 19 nt, Homo sapiens
cagcgaagacugcuaaaug

SEQ ID NO: 471642 - RNA, 19 nt, Homo sapiens
guauuguccuguggaauuu

SEQ ID NO: 471643 - RNA, 19 nt, Homo sapiens
gcaguggcaaagaagauua

SEQ ID NO: 471644 - RNA, 19 nt, Homo sapiens
gaagcacugucgcucuaug

SEQ ID NO: 471645 - RNA, 19 nt, Homo sapiens
aaacaagaacggcagcuuu

SEQ ID NO: 471646 - RNA, 19 nt, Homo sapiens
ucacuaugguagagauuga

SEQ ID NO: 471647 - RNA, 19 nt, Homo sapiens
caaccuacacaaacaagaa

SEQ ID NO: 471648 - RNA, 19 nt, Homo sapiens
ugcuggaccuucagaguua

SEQ ID NO: 471649 - RNA, 19 nt, Homo sapiens
gaagaucaguagccccuaa

SEQ ID NO: 471650 - RNA, 19 nt, Homo sapiens
caaagauggucacuauggu

SEQ ID NO: 471651 - RNA, 19 nt, Homo sapiens
gauguuaauuuggcagaga

SEQ ID NO: 471652 - RNA, 19 nt, Homo sapiens
ggaagaucuugaugguguu

SEQ ID NO: 471653 - RNA, 19 nt, Homo sapiens
guacaugacaucaaaauga

SEQ ID NO: 471654 - RNA, 19 nt, Homo sapiens
ucacaugugcugcaaauag

SEQ ID NO: 471655 - RNA, 19 nt, Homo sapiens
gggagagaauuugauuaug

SEQ ID NO: 471656 - RNA, 19 nt, Homo sapiens
ccaaagauggucacuaugg

SEQ ID NO: 471657 - RNA, 19 nt, Homo sapiens
aaucacaugugcugcaaau

SEQ ID NO: 471658 - RNA, 19 nt, Homo sapiens
guaagaaauacaugcgaaa

SEQ ID NO: 471659 - RNA, 19 nt, Homo sapiens
ccaaagaagggagagaauu

SEQ ID NO: 471660 - RNA, 19 nt, Homo sapiens
caugggcaguggcaaagaa

SEQ ID NO: 471661 - RNA, 19 nt, Homo sapiens
gaauugagucaggacagua

SEQ ID NO: 471662 - RNA, 19 nt, Homo sapiens
gaaugaaagaauugaguca

SEQ ID NO: 471663 - RNA, 19 nt, Homo sapiens
caaaaugagucaggcaauu

SEQ ID NO: 471664 - RNA, 19 nt, Homo sapiens
cacugucgcucuaugaaga

SEQ ID NO: 471665 - RNA, 19 nt, Homo sapiens
cagaagaagauuccacaug

SEQ ID NO: 471666 - RNA, 19 nt, Homo sapiens
aaagauggucacuauggua

SEQ ID NO: 471667 - RNA, 19 nt, Homo sapiens
caaagaagagaucgacagu

SEQ ID NO: 471668 - RNA, 19 nt, Homo sapiens
gaagaucuugaugguguuu

SEQ ID NO: 471669 - RNA, 19 nt, Homo sapiens
ggcaggaccauggcuauuu

SEQ ID NO: 471670 - RNA, 19 nt, Homo sapiens
agauuacacuggcaaagau

SEQ ID NO: 471671 - RNA, 19 nt, Homo sapiens
agagugauuuggcauauac

SEQ ID NO: 471672 - RNA, 19 nt, Homo sapiens
aaacaggaugggaaauauu

SEQ ID NO: 471673 - RNA, 19 nt, Homo sapiens
cuuagacaaucuuaaagga

SEQ ID NO: 471674 - RNA, 19 nt, Homo sapiens
gacgaagauucaccuuauc

SEQ ID NO: 471675 - RNA, 19 nt, Homo sapiens
ccacgucuccagaagaaga

SEQ ID NO: 471676 - RNA, 19 nt, Homo sapiens
ugacagcuguuccaaucuc

SEQ ID NO: 471677 - RNA, 19 nt, Homo sapiens
uuugacagcuguuccaauc

SEQ ID NO: 471678 - RNA, 19 nt, Homo sapiens
uaaaggagacugcuaucag

SEQ ID NO: 471679 - RNA, 19 nt, Homo sapiens
ggagacggaggcauauugu

SEQ ID NO: 471680 - RNA, 19 nt, Homo sapiens
gcaaggcaaagaagagauc

SEQ ID NO: 471681 - RNA, 19 nt, Homo sapiens
gagaauuuacccacaugga

SEQ ID NO: 471682 - RNA, 19 nt, Homo sapiens
cuucauacuuggaauugug

SEQ ID NO: 471683 - RNA, 19 nt, Homo sapiens
uguauuguccuguggaauu

SEQ ID NO: 471684 - RNA, 19 nt, Homo sapiens
agacugcuaucagguucua

SEQ ID NO: 471685 - RNA, 19 nt, Homo sapiens
agagagugauuuggcauau

SEQ ID NO: 471686 - RNA, 19 nt, Homo sapiens
gguauaugacgaagauuca

SEQ ID NO: 471687 - RNA, 19 nt, Homo sapiens
uuagcaaccuacacaaaca

SEQ ID NO: 471688 - RNA, 19 nt, Homo sapiens
ugaacaaaguagaggaaag

SEQ ID NO: 471689 - RNA, 19 nt, Homo sapiens
aacaggaugggaaauauuu

SEQ ID NO: 471690 - RNA, 19 nt, Homo sapiens
gaaagcuaaacccugaaga

SEQ ID NO: 471691 - RNA, 19 nt, Homo sapiens
uugaugagcuuaggguguu

SEQ ID NO: 471692 - RNA, 19 nt, Homo sapiens
caucaugggcaguggcaaa

SEQ ID NO: 471693 - RNA, 19 nt, Homo sapiens
cagagagugauuuggcaua

SEQ ID NO: 471694 - RNA, 19 nt, Homo sapiens
acucgaagcaguuuggaaa

SEQ ID NO: 471695 - RNA, 19 nt, Homo sapiens
cuccacgucuccagaagaa

SEQ ID NO: 471696 - RNA, 19 nt, Homo sapiens
aaagaagggagagaauuug

SEQ ID NO: 471697 - RNA, 19 nt, Homo sapiens
gauggucacuaugguagag

SEQ ID NO: 471698 - RNA, 19 nt, Homo sapiens
agacggaggcauauugugu

SEQ ID NO: 471699 - RNA, 19 nt, Homo sapiens
aaaugagucaggcaauuga

SEQ ID NO: 471700 - RNA, 19 nt, Homo sapiens
cagcuuugccaauuugaga

SEQ ID NO: 471701 - RNA, 19 nt, Homo sapiens
guugaaacaggaugggaaa

SEQ ID NO: 471702 - RNA, 19 nt, Homo sapiens
caugggaguuucucagacu

SEQ ID NO: 471703 - RNA, 19 nt, Homo sapiens
aaaguagaggaaagaauga

SEQ ID NO: 471704 - RNA, 19 nt, Homo sapiens
uaaaaggccuccaguccau

SEQ ID NO: 471705 - RNA, 19 nt, Homo sapiens
ggaugaaucuguaacuuaa

SEQ ID NO: 471706 - RNA, 19 nt, Homo sapiens
gcaguuauguugucgugua

SEQ ID NO: 471707 - RNA, 19 nt, Homo sapiens
ccacauuucucauuuggua

SEQ ID NO: 471708 - RNA, 19 nt, Homo sapiens
caagugugguuacaaauga

SEQ ID NO: 471709 - RNA, 19 nt, Homo sapiens
ccucagauuucuucuagua

SEQ ID NO: 471710 - RNA, 19 nt, Homo sapiens
caaaugaacccauggaaug

SEQ ID NO: 471711 - RNA, 19 nt, Homo sapiens
gcauuagucuggugauuuc

SEQ ID NO: 471712 - RNA, 19 nt, Homo sapiens
gggaugaaucuguaacuua

SEQ ID NO: 471713 - RNA, 19 nt, Homo sapiens
gaugaaugauuauggucua

SEQ ID NO: 471714 - RNA, 19 nt, Homo sapiens
aggcagggcuugucaauga

SEQ ID NO: 471715 - RNA, 19 nt, Homo sapiens
acagucaccugaacaauga

SEQ ID NO: 471716 - RNA, 19 nt, Homo sapiens
caucaucucuugcuugcuu

SEQ ID NO: 471717 - RNA, 19 nt, Homo sapiens
gacuaaguauugcugaauu

SEQ ID NO: 471718 - RNA, 19 nt, Homo sapiens
gaaugcuucuucaaagguu

SEQ ID NO: 471719 - RNA, 19 nt, Homo sapiens
gaaugauuauggucuauac

SEQ ID NO: 471720 - RNA, 19 nt, Homo sapiens
ccagucacauagagaauug

SEQ ID NO: 471721 - RNA, 19 nt, Homo sapiens
cuugaaaucuugcugaaau

SEQ ID NO: 471722 - RNA, 19 nt, Homo sapiens
uugaagaaauucccacauu

SEQ ID NO: 471723 - RNA, 19 nt, Homo sapiens
ggccucagauuucuucuag

SEQ ID NO: 471724 - RNA, 19 nt, Homo sapiens
cugcagggaugaaucugua

SEQ ID NO: 471725 - RNA, 19 nt, Homo sapiens
ggaaaauacuggaaugcuu

SEQ ID NO: 471726 - RNA, 19 nt, Homo sapiens
caaugaggcagaucagauu

SEQ ID NO: 471727 - RNA, 19 nt, Homo sapiens
gaaaucuugcugaaauguu

SEQ ID NO: 471728 - RNA, 19 nt, Homo sapiens
gcucuguuguguuuauuca

SEQ ID NO: 471729 - RNA, 19 nt, Homo sapiens
ugaauuugcaguuauguug

SEQ ID NO: 471730 - RNA, 19 nt, Homo sapiens
gacagagaaugaccacauc

SEQ ID NO: 471731 - RNA, 19 nt, Homo sapiens
ugggaucuauaccaauuaa

SEQ ID NO: 471732 - RNA, 19 nt, Homo sapiens
aauuauagccugaauguuc

SEQ ID NO: 471733 - RNA, 19 nt, Homo sapiens
gggcucgggugggauguuu

SEQ ID NO: 471734 - RNA, 19 nt, Homo sapiens
aguauuugcuucugaugaa

SEQ ID NO: 471735 - RNA, 19 nt, Homo sapiens
ccgugcugcuuuccaaaua

SEQ ID NO: 471736 - RNA, 19 nt, Homo sapiens
uguuggcucuguuguguuu

SEQ ID NO: 471737 - RNA, 19 nt, Homo sapiens
aaaucuugcugaaauguuc

SEQ ID NO: 471738 - RNA, 19 nt, Homo sapiens
caaggagggugugaagaca

SEQ ID NO: 471739 - RNA, 19 nt, Homo sapiens
gggcagccaaucaaugaaa

SEQ ID NO: 471740 - RNA, 19 nt, Homo sapiens
uagccugaauguucgcuuu

SEQ ID NO: 471741 - RNA, 19 nt, Homo sapiens
ccaagugugguuacaaaug

SEQ ID NO: 471742 - RNA, 19 nt, Homo sapiens
acaaaggugucugcggaaa

SEQ ID NO: 471743 - RNA, 19 nt, Homo sapiens
gauguuuguuggcucuguu

SEQ ID NO: 471744 - RNA, 19 nt, Homo sapiens
ccugaacaaugacccauca

SEQ ID NO: 471745 - RNA, 19 nt, Homo sapiens
ggacauucaccacgaugau

SEQ ID NO: 471746 - RNA, 19 nt, Homo sapiens
gcagggcacaguuucuaga

SEQ ID NO: 471747 - RNA, 19 nt, Homo sapiens
ggaaugcuucuucaaaggu

SEQ ID NO: 471748 - RNA, 19 nt, Homo sapiens
ggugauuucaguucuguga

SEQ ID NO: 471749 - RNA, 19 nt, Homo sapiens
ggccguccauccucgcauu

SEQ ID NO: 471750 - RNA, 19 nt, Homo sapiens
gaauuugcaguuauguugu

SEQ ID NO: 471751 - RNA, 19 nt, Homo sapiens
guggugcaguucaagauca

SEQ ID NO: 471752 - RNA, 19 nt, Homo sapiens
ggaucuauaccaauuaaac

SEQ ID NO: 471753 - RNA, 19 nt, Homo sapiens
acauagagaauugguguuu

SEQ ID NO: 471754 - RNA, 19 nt, Homo sapiens
uguuaucuuuguucaggua

SEQ ID NO: 471755 - RNA, 19 nt, Homo sapiens
ugaccaugccgaccacaaa

SEQ ID NO: 471756 - RNA, 19 nt, Homo sapiens
ucaaugaggcagaucagau

SEQ ID NO: 471757 - RNA, 19 nt, Homo sapiens
aaaugaacccauggaauga

SEQ ID NO: 471758 - RNA, 19 nt, Homo sapiens
uuccaagugugguuacaaa

SEQ ID NO: 471759 - RNA, 19 nt, Homo sapiens
guauaagagcuacuuccaa

SEQ ID NO: 471760 - RNA, 19 nt, Homo sapiens
uauguugucguguauaaga

SEQ ID NO: 471761 - RNA, 19 nt, Homo sapiens
gugugaagacagagaauga

SEQ ID NO: 471762 - RNA, 19 nt, Homo sapiens
cauagagaauugguguuuc

SEQ ID NO: 471763 - RNA, 19 nt, Homo sapiens
auacuggaaugcuucuuca

SEQ ID NO: 471764 - RNA, 19 nt, Homo sapiens
uuacaggcacaggugauua

SEQ ID NO: 471765 - RNA, 19 nt, Homo sapiens
ucacuccagucacauagag

SEQ ID NO: 471766 - RNA, 19 nt, Homo sapiens
aagauauuguggguacuuu

SEQ ID NO: 471767 - RNA, 19 nt, Homo sapiens
caagauauuguggguacuu

SEQ ID NO: 471768 - RNA, 19 nt, Homo sapiens
gugccgugcugcuuuccaa

SEQ ID NO: 471769 - RNA, 19 nt, Homo sapiens
cccauggaaugaugacuuc

SEQ ID NO: 471770 - RNA, 19 nt, Homo sapiens
acaaaugaacccauggaau

SEQ ID NO: 471771 - RNA, 19 nt, Homo sapiens
cuggaaugcuucuucaaag

SEQ ID NO: 471772 - RNA, 19 nt, Homo sapiens
uacaggcacaggugauuaa

SEQ ID NO: 471773 - RNA, 19 nt, Homo sapiens
agacagagaaugaccacau

SEQ ID NO: 471774 - RNA, 19 nt, Homo sapiens
gacauucaccacgaugauu

SEQ ID NO: 471775 - RNA, 19 nt, Homo sapiens
gcuccguggugcaguucaa

SEQ ID NO: 471776 - RNA, 19 nt, Homo sapiens
gcaaggauuggcacaacca

SEQ ID NO: 471777 - RNA, 19 nt, Homo sapiens
gucaguauauggaaaaguu

SEQ ID NO: 471778 - RNA, 19 nt, Homo sapiens
gacugucacuugcuguuac

SEQ ID NO: 471779 - RNA, 19 nt, Homo sapiens
acauucaccacgaugauuu

SEQ ID NO: 471780 - RNA, 19 nt, Homo sapiens
ggaaacucgaggacauuca

SEQ ID NO: 471781 - RNA, 19 nt, Homo sapiens
aaaggugucugcggaaacu

SEQ ID NO: 471782 - RNA, 19 nt, Homo sapiens
uugcugaauuugcaguuau

SEQ ID NO: 471783 - RNA, 19 nt, Homo sapiens
aagacuaaguauugcugaa

SEQ ID NO: 471784 - RNA, 19 nt, Homo sapiens
auucccacauuucucauuu

SEQ ID NO: 471785 - RNA, 19 nt, Homo sapiens
uggaaaaguugaagggaaa

SEQ ID NO: 471786 - RNA, 19 nt, Homo sapiens
cgaggacauucaccacgau

SEQ ID NO: 471787 - RNA, 19 nt, Homo sapiens
ccaaggagggugugaagac

SEQ ID NO: 471788 - RNA, 19 nt, Homo sapiens
caguuauguugucguguau

SEQ ID NO: 471789 - RNA, 19 nt, Homo sapiens
aaguauugcugaauuugca

SEQ ID NO: 471790 - RNA, 19 nt, Homo sapiens
agacugucacuugcuguua

SEQ ID NO: 471791 - RNA, 19 nt, Homo sapiens
ugugugcucauuuguguuu

SEQ ID NO: 471792 - RNA, 19 nt, Homo sapiens
ggauguuuguuggcucugu

SEQ ID NO: 471793 - RNA, 19 nt, Homo sapiens
uugcuugcuugaaaucuug

SEQ ID NO: 471794 - RNA, 19 nt, Homo sapiens
ucucuugcuugcuugaaau

SEQ ID NO: 471795 - RNA, 19 nt, Homo sapiens
uacagucaccugaacaaug

SEQ ID NO: 471796 - RNA, 19 nt, Homo sapiens
guauuugcuucugaugaau

SEQ ID NO: 471797 - RNA, 19 nt, Homo sapiens
ucuaguauuugcuucugau

SEQ ID NO: 471798 - RNA, 19 nt, Homo sapiens
cagagaaugaccacaucaa

SEQ ID NO: 471799 - RNA, 19 nt, Homo sapiens
gcggaaacucgaggacauu

SEQ ID NO: 471800 - RNA, 19 nt, Homo sapiens
aggagggugugaagacaga

SEQ ID NO: 471801 - RNA, 19 nt, Homo sapiens
ucugaugaaugauuauggu

SEQ ID NO: 471802 - RNA, 19 nt, Homo sapiens
ugcuucugaugaaugauua

SEQ ID NO: 471803 - RNA, 19 nt, Homo sapiens
uggaaugcuucuucaaagg

SEQ ID NO: 471804 - RNA, 19 nt, Homo sapiens
uuugugugcucauuugugu

SEQ ID NO: 471805 - RNA, 19 nt, Homo sapiens
guacguagcuguuacaugu

SEQ ID NO: 471806 - RNA, 19 nt, Homo sapiens
gcacaagcauauugcauuu

SEQ ID NO: 471807 - RNA, 19 nt, Homo sapiens
gaaguaacauuucaagaag

SEQ ID NO: 471808 - RNA, 19 nt, Homo sapiens
ggcaaucugucuuuaagua

SEQ ID NO: 471809 - RNA, 19 nt, Homo sapiens
ucauucagcucuuaucuuu

SEQ ID NO: 471810 - RNA, 19 nt, Homo sapiens
uaaauaggccugcuuagaa

SEQ ID NO: 471811 - RNA, 19 nt, Homo sapiens
guacauaaaguaacuggua

SEQ ID NO: 471812 - RNA, 19 nt, Homo sapiens
uaaauacucccuaaccuaa

SEQ ID NO: 471813 - RNA, 19 nt, Homo sapiens
gcacggagcauaggguaua

SEQ ID NO: 471814 - RNA, 19 nt, Homo sapiens
agacacaccugcacaguug

SEQ ID NO: 471815 - RNA, 19 nt, Homo sapiens
gaaagccuauugugaacga

SEQ ID NO: 471816 - RNA, 19 nt, Homo sapiens
uugcauaccuuguucaauu

SEQ ID NO: 471817 - RNA, 19 nt, Homo sapiens
gacgggaggugucuacuga

SEQ ID NO: 471818 - RNA, 19 nt, Homo sapiens
cagaucagauuccgauuug

SEQ ID NO: 471819 - RNA, 19 nt, Homo sapiens
guggugcaguuuaagauua

SEQ ID NO: 471820 - RNA, 19 nt, Homo sapiens
gcaaguauacuagcagaaa

SEQ ID NO: 471821 - RNA, 19 nt, Homo sapiens
guaaauacucccuaaccua

SEQ ID NO: 471822 - RNA, 19 nt, Homo sapiens
ggaugaagauacaauugau

SEQ ID NO: 471823 - RNA, 19 nt, Homo sapiens
ggaaauggaggaugaagau

SEQ ID NO: 471824 - RNA, 19 nt, Homo sapiens
gccauaguaucguggauuu

SEQ ID NO: 471825 - RNA, 19 nt, Homo sapiens
gcagaucagauuccgauuu

SEQ ID NO: 471826 - RNA, 19 nt, Homo sapiens
guagggcaaucugucuuua

SEQ ID NO: 471827 - RNA, 19 nt, Homo sapiens
gcucuuaucuuuauauucc

SEQ ID NO: 471828 - RNA, 19 nt, Homo sapiens
guucuguggugcaguuuaa

SEQ ID NO: 471829 - RNA, 19 nt, Homo sapiens
aauaucaccuuguuccaaa

SEQ ID NO: 471830 - RNA, 19 nt, Homo sapiens
gaagauacaauugaugugu

SEQ ID NO: 471831 - RNA, 19 nt, Homo sapiens
ggaaauaaagcuacuuggu

SEQ ID NO: 471832 - RNA, 19 nt, Homo sapiens
gaaauggaggaugaagaua

SEQ ID NO: 471833 - RNA, 19 nt, Homo sapiens
gcuuagaaguaacauuuca

SEQ ID NO: 471834 - RNA, 19 nt, Homo sapiens
gcauacaccacuuaguaaa

SEQ ID NO: 471835 - RNA, 19 nt, Homo sapiens
gguauaggguagcacaugu

SEQ ID NO: 471836 - RNA, 19 nt, Homo sapiens
uagcacauguggcaaggaa

SEQ ID NO: 471837 - RNA, 19 nt, Homo sapiens
caagaaggaaauaaagcua

SEQ ID NO: 471838 - RNA, 19 nt, Homo sapiens
caaugaggcagaucagauu

SEQ ID NO: 471839 - RNA, 19 nt, Homo sapiens
aaugaaagccuauugugaa

SEQ ID NO: 471840 - RNA, 19 nt, Homo sapiens
uaaugaaagccuauuguga

SEQ ID NO: 471841 - RNA, 19 nt, Homo sapiens
caccacauccugacuacua

SEQ ID NO: 471842 - RNA, 19 nt, Homo sapiens
aaauaggccugcuuagaag

SEQ ID NO: 471843 - RNA, 19 nt, Homo sapiens
gcgucuuguuguuuaaaua

SEQ ID NO: 471844 - RNA, 19 nt, Homo sapiens
agacugagaacaacaauca

SEQ ID NO: 471845 - RNA, 19 nt, Homo sapiens
gaccaagauuacauucuca

SEQ ID NO: 471846 - RNA, 19 nt, Homo sapiens
ggaggaugaagauacaauu

SEQ ID NO: 471847 - RNA, 19 nt, Homo sapiens
aggcauacaccacuuagua

SEQ ID NO: 471848 - RNA, 19 nt, Homo sapiens
gaugccaaacaaagaauaa

SEQ ID NO: 471849 - RNA, 19 nt, Homo sapiens
gaaaauugaggcuuagaaa

SEQ ID NO: 471850 - RNA, 19 nt, Homo sapiens
gaggaugaagauacaauug

SEQ ID NO: 471851 - RNA, 19 nt, Homo sapiens
gggcaaccaaucaaugaaa

SEQ ID NO: 471852 - RNA, 19 nt, Homo sapiens
uaagaggcauacaccacuu

SEQ ID NO: 471853 - RNA, 19 nt, Homo sapiens
cgggaggugucuacugaaa

SEQ ID NO: 471854 - RNA, 19 nt, Homo sapiens
ggcauacaccacuuaguaa

SEQ ID NO: 471855 - RNA, 19 nt, Homo sapiens
ccaaugguauguuuugauu

SEQ ID NO: 471856 - RNA, 19 nt, Homo sapiens
cugcuuagaaguaacauuu

SEQ ID NO: 471857 - RNA, 19 nt, Homo sapiens
acauaaauaggccugcuua

SEQ ID NO: 471858 - RNA, 19 nt, Homo sapiens
cuaaacagccaaugguaug

SEQ ID NO: 471859 - RNA, 19 nt, Homo sapiens
gauaaaacacugaaccauu

SEQ ID NO: 471860 - RNA, 19 nt, Homo sapiens
uaacuaaacagccaauggu

SEQ ID NO: 471861 - RNA, 19 nt, Homo sapiens
guaaaaccaaggacaauuu

SEQ ID NO: 471862 - RNA, 19 nt, Homo sapiens
ccagguauuuucuguauau

SEQ ID NO: 471863 - RNA, 19 nt, Homo sapiens
agaccaagauuacauucuc

SEQ ID NO: 471864 - RNA, 19 nt, Homo sapiens
gacugauacugaugccaaa

SEQ ID NO: 471865 - RNA, 19 nt, Homo sapiens
cuaggucccauguuaauau

SEQ ID NO: 471866 - RNA, 19 nt, Homo sapiens
aguaacauuucaagaagga

SEQ ID NO: 471867 - RNA, 19 nt, Homo sapiens
acugagaacaacaaucaua

SEQ ID NO: 471868 - RNA, 19 nt, Homo sapiens
gcaaucugucuuuaaguag

SEQ ID NO: 471869 - RNA, 19 nt, Homo sapiens
agauacaauugauguguuc

SEQ ID NO: 471870 - RNA, 19 nt, Homo sapiens
gaugaagauacaauugaug

SEQ ID NO: 471871 - RNA, 19 nt, Homo sapiens
ugauacugaugccaaacaa

SEQ ID NO: 471872 - RNA, 19 nt, Homo sapiens
auaaauaggccugcuuaga

SEQ ID NO: 471873 - RNA, 19 nt, Homo sapiens
caugcucauucagcucuua

SEQ ID NO: 471874 - RNA, 19 nt, Homo sapiens
ucaaugaggcagaucagau

SEQ ID NO: 471875 - RNA, 19 nt, Homo sapiens
caaguauacuagcagaaaa

SEQ ID NO: 471876 - RNA, 19 nt, Homo sapiens
ggucccauguuaauaugca

SEQ ID NO: 471877 - RNA, 19 nt, Homo sapiens
uaaagcuacuugguguuuc

SEQ ID NO: 471878 - RNA, 19 nt, Homo sapiens
gcuguuuucuuuauucuga

SEQ ID NO: 471879 - RNA, 19 nt, Homo sapiens
ugcauaccuuguucaauug

SEQ ID NO: 471880 - RNA, 19 nt, Homo sapiens
uuaguggcaugcucauuca

SEQ ID NO: 471881 - RNA, 19 nt, Homo sapiens
aauggaggaugaagauaca

SEQ ID NO: 471882 - RNA, 19 nt, Homo sapiens
auaaaacacugaaccauuc

SEQ ID NO: 471883 - RNA, 19 nt, Homo sapiens
guagggauaaauuacucua

SEQ ID NO: 471884 - RNA, 19 nt, Homo sapiens
ggaggugucuacugaaaag

SEQ ID NO: 471885 - RNA, 19 nt, Homo sapiens
gaucagauuccgauuugac

SEQ ID NO: 471886 - RNA, 19 nt, Homo sapiens
gcacauguggcaaggaaaa

SEQ ID NO: 471887 - RNA, 19 nt, Homo sapiens
auaaagcuacuugguguuu

SEQ ID NO: 471888 - RNA, 19 nt, Homo sapiens
ccugguaccucuuuuguga

SEQ ID NO: 471889 - RNA, 19 nt, Homo sapiens
cugcacaguuggaaaugga

SEQ ID NO: 471890 - RNA, 19 nt, Homo sapiens
cauucuagccugcacuuau

SEQ ID NO: 471891 - RNA, 19 nt, Homo sapiens
ccauguuaauaugcaagua

SEQ ID NO: 471892 - RNA, 19 nt, Homo sapiens
uucucuaggucccauguua

SEQ ID NO: 471893 - RNA, 19 nt, Homo sapiens
gauacugaugccaaacaaa

SEQ ID NO: 471894 - RNA, 19 nt, Homo sapiens
gaaggaaauaaagcuacuu

SEQ ID NO: 471895 - RNA, 19 nt, Homo sapiens
uuagaaaacugcaauuugg

SEQ ID NO: 471896 - RNA, 19 nt, Homo sapiens
aguuggaaauggaggauga

SEQ ID NO: 471897 - RNA, 19 nt, Homo sapiens
ucaagacugagaacaacaa

SEQ ID NO: 471898 - RNA, 19 nt, Homo sapiens
aaagcuacuugguguuucu

SEQ ID NO: 471899 - RNA, 19 nt, Homo sapiens
cuaaugaaagccuauugug

SEQ ID NO: 471900 - RNA, 19 nt, Homo sapiens
gcaaccaaucaaugaaaca

SEQ ID NO: 471901 - RNA, 19 nt, Homo sapiens
ggcaaccaaucaaugaaac

SEQ ID NO: 471902 - RNA, 19 nt, Homo sapiens
uaggucccauguuaauaug

SEQ ID NO: 471903 - RNA, 19 nt, Homo sapiens
ccaaacaaagaauaacagu

SEQ ID NO: 471904 - RNA, 19 nt, Homo sapiens
agaaggaaauaaagcuacu

SEQ ID NO: 471905 - RNA, 19 nt, Homo sapiens
gcacagagguggacuucaa

SEQ ID NO: 471906 - RNA, 19 nt, Homo sapiens
gaacugaugcugcccuuua

SEQ ID NO: 471907 - RNA, 19 nt, Homo sapiens
gaaggaggcguguuuguaa

SEQ ID NO: 471908 - RNA, 19 nt, Homo sapiens
gaaguuagagguccgagaa

SEQ ID NO: 471909 - RNA, 19 nt, Homo sapiens
gggcuaugcuggaggauga

SEQ ID NO: 471910 - RNA, 19 nt, Homo sapiens
gcagucaguuccauuaagu

SEQ ID NO: 471911 - RNA, 19 nt, Homo sapiens
ccacauggcucuguucauc

SEQ ID NO: 471912 - RNA, 19 nt, Homo sapiens
gaagccaacuugacuugca

SEQ ID NO: 471913 - RNA, 19 nt, Homo sapiens
gaucacagcccacgcuuca

SEQ ID NO: 471914 - RNA, 19 nt, Homo sapiens
ucacaacccuuugcuggaa

SEQ ID NO: 471915 - RNA, 19 nt, Homo sapiens
gauacuggcuucuacuucu

SEQ ID NO: 471916 - RNA, 19 nt, Homo sapiens
ggaugagggugucuauauc

SEQ ID NO: 471917 - RNA, 19 nt, Homo sapiens
gcaaccugcugcugaagga

SEQ ID NO: 471918 - RNA, 19 nt, Homo sapiens
gcaugaaggucaccaaagc

SEQ ID NO: 471919 - RNA, 19 nt, Homo sapiens
gaccucauaucguugguau

SEQ ID NO: 471920 - RNA, 19 nt, Homo sapiens
gagcgaugcuggcgucuac

SEQ ID NO: 471921 - RNA, 19 nt, Homo sapiens
gaaccugaccugccuugug

SEQ ID NO: 471922 - RNA, 19 nt, Homo sapiens
caaauguucuuggaucauc

SEQ ID NO: 471923 - RNA, 19 nt, Homo sapiens
gaggaugcccacucccaua

SEQ ID NO: 471924 - RNA, 19 nt, Homo sapiens
ccaaugaggcacccaguga

SEQ ID NO: 471925 - RNA, 19 nt, Homo sapiens
gagcuggcccuaucucaug

SEQ ID NO: 471926 - RNA, 19 nt, Homo sapiens
caacaccucacucuucuuc

SEQ ID NO: 471927 - RNA, 19 nt, Homo sapiens
ggccacaaauguucuugga

SEQ ID NO: 471928 - RNA, 19 nt, Homo sapiens
caucuguucugccucaaau

SEQ ID NO: 471929 - RNA, 19 nt, Homo sapiens
cacccacacucuauacuug

SEQ ID NO: 471930 - RNA, 19 nt, Homo sapiens
gucaaccgcuggucagaug

SEQ ID NO: 471931 - RNA, 19 nt, Homo sapiens
gcucauugauccugaugca

SEQ ID NO: 471932 - RNA, 19 nt, Homo sapiens
gcacagaagccaacuugac

SEQ ID NO: 471933 - RNA, 19 nt, Homo sapiens
gggcacagaagccaacuug

SEQ ID NO: 471934 - RNA, 19 nt, Homo sapiens
gaacggcgugggcucuuug

SEQ ID NO: 471935 - RNA, 19 nt, Homo sapiens
gagcgagauucaccuccaa

SEQ ID NO: 471936 - RNA, 19 nt, Homo sapiens
ucacggccaucugguacua

SEQ ID NO: 471937 - RNA, 19 nt, Homo sapiens
gcacccacacucuauacuu

SEQ ID NO: 471938 - RNA, 19 nt, Homo sapiens
cagcuacccugcagucagu

SEQ ID NO: 471939 - RNA, 19 nt, Homo sapiens
ccaagacgcccaccaugau

SEQ ID NO: 471940 - RNA, 19 nt, Homo sapiens
ggaaggacaggcagugaca

SEQ ID NO: 471941 - RNA, 19 nt, Homo sapiens
agaaggaggcguguuugua

SEQ ID NO: 471942 - RNA, 19 nt, Homo sapiens
gaaggggucuugccugcuu

SEQ ID NO: 471943 - RNA, 19 nt, Homo sapiens
gcuccgcuuugcagccaua

SEQ ID NO: 471944 - RNA, 19 nt, Homo sapiens
aaccugaccugccuugugu

SEQ ID NO: 471945 - RNA, 19 nt, Homo sapiens
ggacucugguuccuacaac

SEQ ID NO: 471946 - RNA, 19 nt, Homo sapiens
gaggccaacucccugaagu

SEQ ID NO: 471947 - RNA, 19 nt, Homo sapiens
gcaucacggccaucuggua

SEQ ID NO: 471948 - RNA, 19 nt, Homo sapiens
ccagaccuaucaccuugga

SEQ ID NO: 471949 - RNA, 19 nt, Homo sapiens
gccauaacuuugacacaag

SEQ ID NO: 471950 - RNA, 19 nt, Homo sapiens
cacaaauguucuuggauca

SEQ ID NO: 471951 - RNA, 19 nt, Homo sapiens
ggaagaggagggcuuguac

SEQ ID NO: 471952 - RNA, 19 nt, Homo sapiens
ccacacuggugcugucaca

SEQ ID NO: 471953 - RNA, 19 nt, Homo sapiens
gaugacaccuauguuugca

SEQ ID NO: 471954 - RNA, 19 nt, Homo sapiens
gugaugacaccuauguuug

SEQ ID NO: 471955 - RNA, 19 nt, Homo sapiens
ccagauccauggcugugau

SEQ ID NO: 471956 - RNA, 19 nt, Homo sapiens
cgcuacagcugguacaaga

SEQ ID NO: 471957 - RNA, 19 nt, Homo sapiens
gagaaggaggcguguuugu

SEQ ID NO: 471958 - RNA, 19 nt, Homo sapiens
ccacgcacccacacucuau

SEQ ID NO: 471959 - RNA, 19 nt, Homo sapiens
caacuuccgcuucgagauc

SEQ ID NO: 471960 - RNA, 19 nt, Homo sapiens
cagccugacucuccaccuu

SEQ ID NO: 471961 - RNA, 19 nt, Homo sapiens
cugcugagcuggcccuauc

SEQ ID NO: 471962 - RNA, 19 nt, Homo sapiens
ggagaaggaggcguguuug

SEQ ID NO: 471963 - RNA, 19 nt, Homo sapiens
ggaggaugagggugucuau

SEQ ID NO: 471964 - RNA, 19 nt, Homo sapiens
cagaagccaacuugacuug

SEQ ID NO: 471965 - RNA, 19 nt, Homo sapiens
cugcuccacucccuacgua

SEQ ID NO: 471966 - RNA, 19 nt, Homo sapiens
uggagaaggaggcguguuu

SEQ ID NO: 471967 - RNA, 19 nt, Homo sapiens
gcuuugcagccauaacuuu

SEQ ID NO: 471968 - RNA, 19 nt, Homo sapiens
gauccgagaccuggaggaa

SEQ ID NO: 471969 - RNA, 19 nt, Homo sapiens
ccagugaucuccgcuacag

SEQ ID NO: 471970 - RNA, 19 nt, Homo sapiens
ggguacgccuccaaaccaa

SEQ ID NO: 471971 - RNA, 19 nt, Homo sapiens
uugcaugguucuggaauga

SEQ ID NO: 471972 - RNA, 19 nt, Homo sapiens
gaugagggugucuauaucu

SEQ ID NO: 471973 - RNA, 19 nt, Homo sapiens
gcaccuuggucacaguaac

SEQ ID NO: 471974 - RNA, 19 nt, Homo sapiens
caagacgcccaccaugaug

SEQ ID NO: 471975 - RNA, 19 nt, Homo sapiens
gcccagggaugaggguuuc

SEQ ID NO: 471976 - RNA, 19 nt, Homo sapiens
ucagggaugccaccuccua

SEQ ID NO: 471977 - RNA, 19 nt, Homo sapiens
gaggaugagggugucuaua

SEQ ID NO: 471978 - RNA, 19 nt, Homo sapiens
agccauaacuuugacacaa

SEQ ID NO: 471979 - RNA, 19 nt, Homo sapiens
ggagauucacaacccuuug

SEQ ID NO: 471980 - RNA, 19 nt, Homo sapiens
ggcugcagcugcuccacaa

SEQ ID NO: 471981 - RNA, 19 nt, Homo sapiens
caacucccuuggaaaugca

SEQ ID NO: 471982 - RNA, 19 nt, Homo sapiens
gggcugauacuggcuucua

SEQ ID NO: 471983 - RNA, 19 nt, Homo sapiens
cggcugcacuuggccacua

SEQ ID NO: 471984 - RNA, 19 nt, Homo sapiens
guacgccuccaaaccaaga

SEQ ID NO: 471985 - RNA, 19 nt, Homo sapiens
agaccacgcagcucauuga

SEQ ID NO: 471986 - RNA, 19 nt, Homo sapiens
aggaugagggugucuauau

SEQ ID NO: 471987 - RNA, 19 nt, Homo sapiens
ccacuguccuggccauugc

SEQ ID NO: 471988 - RNA, 19 nt, Homo sapiens
ggaggcguguuuguaagca

SEQ ID NO: 471989 - RNA, 19 nt, Homo sapiens
cugcuaacuucuccugguu

SEQ ID NO: 471990 - RNA, 19 nt, Homo sapiens
ccaucagccuccacaucuu

SEQ ID NO: 471991 - RNA, 19 nt, Homo sapiens
gcagcucauugauccugau

SEQ ID NO: 471992 - RNA, 19 nt, Homo sapiens
gcaaccugcgccugaccua

SEQ ID NO: 471993 - RNA, 19 nt, Homo sapiens
cagcucaccuacacauggu

SEQ ID NO: 471994 - RNA, 19 nt, Homo sapiens
cgccagcuguucucacugu

SEQ ID NO: 471995 - RNA, 19 nt, Homo sapiens
ccugcagucaguuccauua

SEQ ID NO: 471996 - RNA, 19 nt, Homo sapiens
guccugggcucugccucua

SEQ ID NO: 471997 - RNA, 19 nt, Homo sapiens
cccaagacgcccaccauga

SEQ ID NO: 471998 - RNA, 19 nt, Homo sapiens
agaacggcgugggcucuuu

SEQ ID NO: 471999 - RNA, 19 nt, Homo sapiens
gcagagcaugggcgagaau

SEQ ID NO: 472000 - RNA, 19 nt, Homo sapiens
ugugcaaccugcugcugaa

SEQ ID NO: 472001 - RNA, 19 nt, Homo sapiens
gggaugaggguuucuacag

SEQ ID NO: 472002 - RNA, 19 nt, Homo sapiens
ccgcuggucagaugugaaa

SEQ ID NO: 472003 - RNA, 19 nt, Homo sapiens
ggacgugcagggugugaag

SEQ ID NO: 472004 - RNA, 19 nt, Homo sapiens
gaugcagccacaugugaga

SEQ ID NO: 472005 - RNA, 19 nt, Homo sapiens
acucagaugucaagaagua

SEQ ID NO: 472006 - RNA, 19 nt, Homo sapiens
gaaaagggacugugaguaa

SEQ ID NO: 472007 - RNA, 19 nt, Homo sapiens
gaaaggccuucaacugcaa

SEQ ID NO: 472008 - RNA, 19 nt, Homo sapiens
gaaugucccugcuccacaa

SEQ ID NO: 472009 - RNA, 19 nt, Homo sapiens
gugacuaacuaugcaauaa

SEQ ID NO: 472010 - RNA, 19 nt, Homo sapiens
ggacaaaggcugacagacu

SEQ ID NO: 472011 - RNA, 19 nt, Homo sapiens
gcaaauacugcaacaagga

SEQ ID NO: 472012 - RNA, 19 nt, Homo sapiens
ccacucagaugucaagaag

SEQ ID NO: 472013 - RNA, 19 nt, Homo sapiens
ggacuuugaugaagaccau

SEQ ID NO: 472014 - RNA, 19 nt, Homo sapiens
aaagguacacugguauuua

SEQ ID NO: 472015 - RNA, 19 nt, Homo sapiens
ccacaggacuuugaugaag

SEQ ID NO: 472016 - RNA, 19 nt, Homo sapiens
gacuaacuaugcaauaauc

SEQ ID NO: 472017 - RNA, 19 nt, Homo sapiens
gcuuugagcuacaggacaa

SEQ ID NO: 472018 - RNA, 19 nt, Homo sapiens
aagguacacugguauuuau

SEQ ID NO: 472019 - RNA, 19 nt, Homo sapiens
gcaauuuaacaaugucuga

SEQ ID NO: 472020 - RNA, 19 nt, Homo sapiens
aguaauggcugucacuugu

SEQ ID NO: 472021 - RNA, 19 nt, Homo sapiens
cacgaggugugacuaacua

SEQ ID NO: 472022 - RNA, 19 nt, Homo sapiens
ggaaacguuuuguauaguu

SEQ ID NO: 472023 - RNA, 19 nt, Homo sapiens
uaaagguacacugguauuu

SEQ ID NO: 472024 - RNA, 19 nt, Homo sapiens
caaauacugcaacaaggaa

SEQ ID NO: 472025 - RNA, 19 nt, Homo sapiens
cacaggacuuugaugaaga

SEQ ID NO: 472026 - RNA, 19 nt, Homo sapiens
caaggaaacguuuuguaua

SEQ ID NO: 472027 - RNA, 19 nt, Homo sapiens
ccaaucggaagccuaacua

SEQ ID NO: 472028 - RNA, 19 nt, Homo sapiens
gaguaauggcugucacuug

SEQ ID NO: 472029 - RNA, 19 nt, Homo sapiens
gguacacugguauuuauau

SEQ ID NO: 472030 - RNA, 19 nt, Homo sapiens
ccagagcuguuuggauaca

SEQ ID NO: 472031 - RNA, 19 nt, Homo sapiens
gacccacacuggcgagaag

SEQ ID NO: 472032 - RNA, 19 nt, Homo sapiens
gcgagcugcaggacucuaa

SEQ ID NO: 472033 - RNA, 19 nt, Homo sapiens
ccugggaggaagauguuua

SEQ ID NO: 472034 - RNA, 19 nt, Homo sapiens
cgaugugucucccagaacu

SEQ ID NO: 472035 - RNA, 19 nt, Homo sapiens
ccgggcaauuuaacaaugu

SEQ ID NO: 472036 - RNA, 19 nt, Homo sapiens
aaagggacugugaguaaug

SEQ ID NO: 472037 - RNA, 19 nt, Homo sapiens
aaggaaacguuuuguauag

SEQ ID NO: 472038 - RNA, 19 nt, Homo sapiens
uuaaagguacacugguauu

SEQ ID NO: 472039 - RNA, 19 nt, Homo sapiens
uauuucagccuccuguuug

SEQ ID NO: 472040 - RNA, 19 nt, Homo sapiens
cuauuucagccuccuguuu

SEQ ID NO: 472041 - RNA, 19 nt, Homo sapiens
gagcccaggcagcuauuuc

SEQ ID NO: 472042 - RNA, 19 nt, Homo sapiens
gaguccggcugcucaggau

SEQ ID NO: 472043 - RNA, 19 nt, Homo sapiens
gaugugucucccagaacua

SEQ ID NO: 472044 - RNA, 19 nt, Homo sapiens
ucaaggaaacguuuuguau

SEQ ID NO: 472045 - RNA, 19 nt, Homo sapiens
uuccugagcuggccugucu

SEQ ID NO: 472046 - RNA, 19 nt, Homo sapiens
gaggugugacuaacuaugc

SEQ ID NO: 472047 - RNA, 19 nt, Homo sapiens
aauacugcaacaaggaaua

SEQ ID NO: 472048 - RNA, 19 nt, Homo sapiens
ggacccacacuggcgagaa

SEQ ID NO: 472049 - RNA, 19 nt, Homo sapiens
gagcugcaggacucuaauc

SEQ ID NO: 472050 - RNA, 19 nt, Homo sapiens
ggccuucaacugcaaauac

SEQ ID NO: 472051 - RNA, 19 nt, Homo sapiens
caacaaagcaugcucagua

SEQ ID NO: 472052 - RNA, 19 nt, Homo sapiens
gcaaugagcuggaggagau

SEQ ID NO: 472053 - RNA, 19 nt, Homo sapiens
gcaaugagaucgauacaca

SEQ ID NO: 472054 - RNA, 19 nt, Homo sapiens
gaagaaggcaugaaccaua

SEQ ID NO: 472055 - RNA, 19 nt, Homo sapiens
guaacaagcuuaaaucaag

SEQ ID NO: 472056 - RNA, 19 nt, Homo sapiens
gcgaagggcugaccaguug

SEQ ID NO: 472057 - RNA, 19 nt, Homo sapiens
ccaaauugcugagauguuu

SEQ ID NO: 472058 - RNA, 19 nt, Homo sapiens
gaaacaguguggauguaaa

SEQ ID NO: 472059 - RNA, 19 nt, Homo sapiens
uaacaggcauugcacuaaa

SEQ ID NO: 472060 - RNA, 19 nt, Homo sapiens
gcuguuaucugucuuuaug

SEQ ID NO: 472061 - RNA, 19 nt, Homo sapiens
gaaggcugauuccaacaaa

SEQ ID NO: 472062 - RNA, 19 nt, Homo sapiens
gggcagagcucacguugca

SEQ ID NO: 472063 - RNA, 19 nt, Homo sapiens
ggacuuugguuauguugga

SEQ ID NO: 472064 - RNA, 19 nt, Homo sapiens
ccucauggcuguuaucugu

SEQ ID NO: 472065 - RNA, 19 nt, Homo sapiens
caaagcaugcucaguauug

SEQ ID NO: 472066 - RNA, 19 nt, Homo sapiens
gagcucacguugcauugaa

SEQ ID NO: 472067 - RNA, 19 nt, Homo sapiens
uaguaggucugcacacaua

SEQ ID NO: 472068 - RNA, 19 nt, Homo sapiens
gauagcuccuucaugcuuu

SEQ ID NO: 472069 - RNA, 19 nt, Homo sapiens
ccacaguauuguucuugua

SEQ ID NO: 472070 - RNA, 19 nt, Homo sapiens
gguggcauuugcugaauaa

SEQ ID NO: 472071 - RNA, 19 nt, Homo sapiens
gggaaaugcuguggccuuu

SEQ ID NO: 472072 - RNA, 19 nt, Homo sapiens
gaguaaagaugcugguauc

SEQ ID NO: 472073 - RNA, 19 nt, Homo sapiens
ggaaagcacccgucguaug

SEQ ID NO: 472074 - RNA, 19 nt, Homo sapiens
uggcugaaauuaugucaaa

SEQ ID NO: 472075 - RNA, 19 nt, Homo sapiens
ggcauuugcugaauaacaa

SEQ ID NO: 472076 - RNA, 19 nt, Homo sapiens
gagcuaugcacaccaaauu

SEQ ID NO: 472077 - RNA, 19 nt, Homo sapiens
gguaucaggacuuugguua

SEQ ID NO: 472078 - RNA, 19 nt, Homo sapiens
gaaagcacccgucguaugc

SEQ ID NO: 472079 - RNA, 19 nt, Homo sapiens
gagccaaacccgucacuga

SEQ ID NO: 472080 - RNA, 19 nt, Homo sapiens
gauguuuaguagcugauaa

SEQ ID NO: 472081 - RNA, 19 nt, Homo sapiens
caaccaacgugcaacaaag

SEQ ID NO: 472082 - RNA, 19 nt, Homo sapiens
caacacacacacacacaaa

SEQ ID NO: 472083 - RNA, 19 nt, Homo sapiens
gcacacauaacacacauca

SEQ ID NO: 472084 - RNA, 19 nt, Homo sapiens
aaagugaugugauuuaugc

SEQ ID NO: 472085 - RNA, 19 nt, Homo sapiens
gcugggaagugguuaagug

SEQ ID NO: 472086 - RNA, 19 nt, Homo sapiens
caacagaacaacaacaaag

SEQ ID NO: 472087 - RNA, 19 nt, Homo sapiens
gcagagcucacguugcauu

SEQ ID NO: 472088 - RNA, 19 nt, Homo sapiens
gcugaugagucgcuggaaa

SEQ ID NO: 472089 - RNA, 19 nt, Homo sapiens
uugacacacucaccauuua

SEQ ID NO: 472090 - RNA, 19 nt, Homo sapiens
ugagaucgauacacagaau

SEQ ID NO: 472091 - RNA, 19 nt, Homo sapiens
aagaaggcaugaaccauau

SEQ ID NO: 472092 - RNA, 19 nt, Homo sapiens
gaggucaggcgcugucuuu

SEQ ID NO: 472093 - RNA, 19 nt, Homo sapiens
gugaaacaguguggaugua

SEQ ID NO: 472094 - RNA, 19 nt, Homo sapiens
gucaauauauagagacuuc

SEQ ID NO: 472095 - RNA, 19 nt, Homo sapiens
ugaaauggaugaaaaccua

SEQ ID NO: 472096 - RNA, 19 nt, Homo sapiens
uaucaggacuuugguuaug

SEQ ID NO: 472097 - RNA, 19 nt, Homo sapiens
gugaugugauuuaugcauu

SEQ ID NO: 472098 - RNA, 19 nt, Homo sapiens
gauuagacaauguggaauu

SEQ ID NO: 472099 - RNA, 19 nt, Homo sapiens
caaaugcugucgggcaaga

SEQ ID NO: 472100 - RNA, 19 nt, Homo sapiens
gcugagauguuuaguagcu

SEQ ID NO: 472101 - RNA, 19 nt, Homo sapiens
caacagcaacaacaacaga

SEQ ID NO: 472102 - RNA, 19 nt, Homo sapiens
aaugugcuguugauucuuu

SEQ ID NO: 472103 - RNA, 19 nt, Homo sapiens
acacaacccucccgagaag

SEQ ID NO: 472104 - RNA, 19 nt, Homo sapiens
ugaaccauaucaaccaaga

SEQ ID NO: 472105 - RNA, 19 nt, Homo sapiens
caaauugcugagauguuua

SEQ ID NO: 472106 - RNA, 19 nt, Homo sapiens
gauguaauauaggguuugu

SEQ ID NO: 472107 - RNA, 19 nt, Homo sapiens
guacauaguggucauuugg

SEQ ID NO: 472108 - RNA, 19 nt, Homo sapiens
ucugucagcuucccaacaa

SEQ ID NO: 472109 - RNA, 19 nt, Homo sapiens
cucaugguauuaucuagua

SEQ ID NO: 472110 - RNA, 19 nt, Homo sapiens
uugcugagauguuuaguag

SEQ ID NO: 472111 - RNA, 19 nt, Homo sapiens
cagccagccugcucgugua

SEQ ID NO: 472112 - RNA, 19 nt, Homo sapiens
gcugaaauuaugucaaaug

SEQ ID NO: 472113 - RNA, 19 nt, Homo sapiens
caacaacaacagaacaaca

SEQ ID NO: 472114 - RNA, 19 nt, Homo sapiens
cauaacaggcauugcacua

SEQ ID NO: 472115 - RNA, 19 nt, Homo sapiens
gaaggcaugaaccauauca

SEQ ID NO: 472116 - RNA, 19 nt, Homo sapiens
aaagcaugcucaguauuga

SEQ ID NO: 472117 - RNA, 19 nt, Homo sapiens
aacaaagcaugcucaguau

SEQ ID NO: 472118 - RNA, 19 nt, Homo sapiens
uuccaaagguuguacauag

SEQ ID NO: 472119 - RNA, 19 nt, Homo sapiens
acacauaacacacaucagu

SEQ ID NO: 472120 - RNA, 19 nt, Homo sapiens
gcaagauagcuccuucaug

SEQ ID NO: 472121 - RNA, 19 nt, Homo sapiens
ucacauggcccuggauaug

SEQ ID NO: 472122 - RNA, 19 nt, Homo sapiens
cuagagcuaugcacaccaa

SEQ ID NO: 472123 - RNA, 19 nt, Homo sapiens
gcaugagaacuaaauagau

SEQ ID NO: 472124 - RNA, 19 nt, Homo sapiens
uagacaauguggaauuaca

SEQ ID NO: 472125 - RNA, 19 nt, Homo sapiens
ugaauguuguccuguguca

SEQ ID NO: 472126 - RNA, 19 nt, Homo sapiens
gugaagugauugacauuuu

SEQ ID NO: 472127 - RNA, 19 nt, Homo sapiens
ugacacacucaccauuuaa

SEQ ID NO: 472128 - RNA, 19 nt, Homo sapiens
ggaugaacaaggagaacaa

SEQ ID NO: 472129 - RNA, 19 nt, Homo sapiens
acaccaaauugcugagaug

SEQ ID NO: 472130 - RNA, 19 nt, Homo sapiens
ccaaccaacgugcaacaaa

SEQ ID NO: 472131 - RNA, 19 nt, Homo sapiens
ucaggacuuugguuauguu

SEQ ID NO: 472132 - RNA, 19 nt, Homo sapiens
ugaaacaguguggauguaa

SEQ ID NO: 472133 - RNA, 19 nt, Homo sapiens
guagcauacugaugagaca

SEQ ID NO: 472134 - RNA, 19 nt, Homo sapiens
caugaaccauaucaaccaa

SEQ ID NO: 472135 - RNA, 19 nt, Homo sapiens
caugaaggaggcugagaaa

SEQ ID NO: 472136 - RNA, 19 nt, Homo sapiens
cagcaaaagugcaguagug

SEQ ID NO: 472137 - RNA, 19 nt, Homo sapiens
gagaguaaagaugcuggua

SEQ ID NO: 472138 - RNA, 19 nt, Homo sapiens
ggccgaagacgcagacaug

SEQ ID NO: 472139 - RNA, 19 nt, Homo sapiens
cuggaaagcacccgucgua

SEQ ID NO: 472140 - RNA, 19 nt, Homo sapiens
ggauaugggcaaugagauc

SEQ ID NO: 472141 - RNA, 19 nt, Homo sapiens
gcaugaaccauaucaacca

SEQ ID NO: 472142 - RNA, 19 nt, Homo sapiens
cacaguauuguucuuguaa

SEQ ID NO: 472143 - RNA, 19 nt, Homo sapiens
ggcucuaacuccuugaugu

SEQ ID NO: 472144 - RNA, 19 nt, Homo sapiens
gucaguuugugaagugauu

SEQ ID NO: 472145 - RNA, 19 nt, Homo sapiens
ugucuccucugucaguuug

SEQ ID NO: 472146 - RNA, 19 nt, Homo sapiens
ccuccugucuccucuguca

SEQ ID NO: 472147 - RNA, 19 nt, Homo sapiens
acaguguggauguaaauuu

SEQ ID NO: 472148 - RNA, 19 nt, Homo sapiens
caacaacagaacaacaaca

SEQ ID NO: 472149 - RNA, 19 nt, Homo sapiens
caacaaaaccagaauugau

SEQ ID NO: 472150 - RNA, 19 nt, Homo sapiens
aacaaaugaugcccgagaa

SEQ ID NO: 472151 - RNA, 19 nt, Homo sapiens
caacaaagcaugcucagua

SEQ ID NO: 472152 - RNA, 19 nt, Homo sapiens
gcaaugagcuggaggagau

SEQ ID NO: 472153 - RNA, 19 nt, Homo sapiens
gcaaugagaucgauacaca

SEQ ID NO: 472154 - RNA, 19 nt, Homo sapiens
guaacaagcuuaaaucaag

SEQ ID NO: 472155 - RNA, 19 nt, Homo sapiens
gcgaagggcugaccaguug

SEQ ID NO: 472156 - RNA, 19 nt, Homo sapiens
ccaaauugcugagauguuu

SEQ ID NO: 472157 - RNA, 19 nt, Homo sapiens
gaaacaguguggauguaaa

SEQ ID NO: 472158 - RNA, 19 nt, Homo sapiens
uaacaggcauugcacuaaa

SEQ ID NO: 472159 - RNA, 19 nt, Homo sapiens
gcuguuaucugucuuuaug

SEQ ID NO: 472160 - RNA, 19 nt, Homo sapiens
gaaggcugauuccaacaaa

SEQ ID NO: 472161 - RNA, 19 nt, Homo sapiens
gggcagagcucacguugca

SEQ ID NO: 472162 - RNA, 19 nt, Homo sapiens
ggacuuugguuauguugga

SEQ ID NO: 472163 - RNA, 19 nt, Homo sapiens
ccucauggcuguuaucugu

SEQ ID NO: 472164 - RNA, 19 nt, Homo sapiens
gagcucacguugcauugaa

SEQ ID NO: 472165 - RNA, 19 nt, Homo sapiens
caaagcaugcucaguauug

SEQ ID NO: 472166 - RNA, 19 nt, Homo sapiens
uaguaggucugcacacaua

SEQ ID NO: 472167 - RNA, 19 nt, Homo sapiens
gauagcuccuucaugcuuu

SEQ ID NO: 472168 - RNA, 19 nt, Homo sapiens
ccacaguauuguucuugua

SEQ ID NO: 472169 - RNA, 19 nt, Homo sapiens
gguggcauuugcugaauaa

SEQ ID NO: 472170 - RNA, 19 nt, Homo sapiens
gaguaaagaugcugguauc

SEQ ID NO: 472171 - RNA, 19 nt, Homo sapiens
ggaaagcacccgucguaug

SEQ ID NO: 472172 - RNA, 19 nt, Homo sapiens
uggcugaaauuaugucaaa

SEQ ID NO: 472173 - RNA, 19 nt, Homo sapiens
ggcauuugcugaauaacaa

SEQ ID NO: 472174 - RNA, 19 nt, Homo sapiens
gagcuaugcacaccaaauu

SEQ ID NO: 472175 - RNA, 19 nt, Homo sapiens
gguaucaggacuuugguua

SEQ ID NO: 472176 - RNA, 19 nt, Homo sapiens
gaaagcacccgucguaugc

SEQ ID NO: 472177 - RNA, 19 nt, Homo sapiens
gagccaaacccgucacuga

SEQ ID NO: 472178 - RNA, 19 nt, Homo sapiens
gauguuuaguagcugauaa

SEQ ID NO: 472179 - RNA, 19 nt, Homo sapiens
caaccaacgugcaacaaag

SEQ ID NO: 472180 - RNA, 19 nt, Homo sapiens
caacacacacacacacaaa

SEQ ID NO: 472181 - RNA, 19 nt, Homo sapiens
gcacacauaacacacauca

SEQ ID NO: 472182 - RNA, 19 nt, Homo sapiens
aaagugaugugauuuaugc

SEQ ID NO: 472183 - RNA, 19 nt, Homo sapiens
gcugggaagugguuaagug

SEQ ID NO: 472184 - RNA, 19 nt, Homo sapiens
caacagaacaacaacaaag

SEQ ID NO: 472185 - RNA, 19 nt, Homo sapiens
gcagagcucacguugcauu

SEQ ID NO: 472186 - RNA, 19 nt, Homo sapiens
gcugaugagucgcuggaaa

SEQ ID NO: 472187 - RNA, 19 nt, Homo sapiens
uugacacacucaccauuua

SEQ ID NO: 472188 - RNA, 19 nt, Homo sapiens
gaggucaggcgcugucuuu

SEQ ID NO: 472189 - RNA, 19 nt, Homo sapiens
ugagaucgauacacagaau

SEQ ID NO: 472190 - RNA, 19 nt, Homo sapiens
gugaaacaguguggaugua

SEQ ID NO: 472191 - RNA, 19 nt, Homo sapiens
gucaauauauagagacuuc

SEQ ID NO: 472192 - RNA, 19 nt, Homo sapiens
ugaaauggaugaaaaccua

SEQ ID NO: 472193 - RNA, 19 nt, Homo sapiens
uaucaggacuuugguuaug

SEQ ID NO: 472194 - RNA, 19 nt, Homo sapiens
gugaugugauuuaugcauu

SEQ ID NO: 472195 - RNA, 19 nt, Homo sapiens
gauuagacaauguggaauu

SEQ ID NO: 472196 - RNA, 19 nt, Homo sapiens
caaaugcugucgggcaaga

SEQ ID NO: 472197 - RNA, 19 nt, Homo sapiens
gcugagauguuuaguagcu

SEQ ID NO: 472198 - RNA, 19 nt, Homo sapiens
caacagcaacaacaacaga

SEQ ID NO: 472199 - RNA, 19 nt, Homo sapiens
aaugugcuguugauucuuu

SEQ ID NO: 472200 - RNA, 19 nt, Homo sapiens
acacaacccucccgagaag

SEQ ID NO: 472201 - RNA, 19 nt, Homo sapiens
caaauugcugagauguuua

SEQ ID NO: 472202 - RNA, 19 nt, Homo sapiens
gauguaauauaggguuugu

SEQ ID NO: 472203 - RNA, 19 nt, Homo sapiens
guacauaguggucauuugg

SEQ ID NO: 472204 - RNA, 19 nt, Homo sapiens
ucugucagcuucccaacaa

SEQ ID NO: 472205 - RNA, 19 nt, Homo sapiens
cucaugguauuaucuagua

SEQ ID NO: 472206 - RNA, 19 nt, Homo sapiens
uugcugagauguuuaguag

SEQ ID NO: 472207 - RNA, 19 nt, Homo sapiens
cagccagccugcucgugua

SEQ ID NO: 472208 - RNA, 19 nt, Homo sapiens
gcugaaauuaugucaaaug

SEQ ID NO: 472209 - RNA, 19 nt, Homo sapiens
caacaacaacagaacaaca

SEQ ID NO: 472210 - RNA, 19 nt, Homo sapiens
cauaacaggcauugcacua

SEQ ID NO: 472211 - RNA, 19 nt, Homo sapiens
aaagcaugcucaguauuga

SEQ ID NO: 472212 - RNA, 19 nt, Homo sapiens
aacaaagcaugcucaguau

SEQ ID NO: 472213 - RNA, 19 nt, Homo sapiens
uuccaaagguuguacauag

SEQ ID NO: 472214 - RNA, 19 nt, Homo sapiens
acacauaacacacaucagu

SEQ ID NO: 472215 - RNA, 19 nt, Homo sapiens
gcaagauagcuccuucaug

SEQ ID NO: 472216 - RNA, 19 nt, Homo sapiens
ucacauggcccuggauaug

SEQ ID NO: 472217 - RNA, 19 nt, Homo sapiens
cuagagcuaugcacaccaa

SEQ ID NO: 472218 - RNA, 19 nt, Homo sapiens
gcaugagaacuaaauagau

SEQ ID NO: 472219 - RNA, 19 nt, Homo sapiens
uagacaauguggaauuaca

SEQ ID NO: 472220 - RNA, 19 nt, Homo sapiens
ugaauguuguccuguguca

SEQ ID NO: 472221 - RNA, 19 nt, Homo sapiens
gugaagugauugacauuuu

SEQ ID NO: 472222 - RNA, 19 nt, Homo sapiens
ugacacacucaccauuuaa

SEQ ID NO: 472223 - RNA, 19 nt, Homo sapiens
ggaugaacaaggagaacaa

SEQ ID NO: 472224 - RNA, 19 nt, Homo sapiens
acaccaaauugcugagaug

SEQ ID NO: 472225 - RNA, 19 nt, Homo sapiens
ccaaccaacgugcaacaaa

SEQ ID NO: 472226 - RNA, 19 nt, Homo sapiens
ucaggacuuugguuauguu

SEQ ID NO: 472227 - RNA, 19 nt, Homo sapiens
ugaaacaguguggauguaa

SEQ ID NO: 472228 - RNA, 19 nt, Homo sapiens
guagcauacugaugagaca

SEQ ID NO: 472229 - RNA, 19 nt, Homo sapiens
gagaguaaagaugcuggua

SEQ ID NO: 472230 - RNA, 19 nt, Homo sapiens
cuggaaagcacccgucgua

SEQ ID NO: 472231 - RNA, 19 nt, Homo sapiens
cagcaaaagugcaguagug

SEQ ID NO: 472232 - RNA, 19 nt, Homo sapiens
ggccgaagacgcagacaug

SEQ ID NO: 472233 - RNA, 19 nt, Homo sapiens
ggauaugggcaaugagauc

SEQ ID NO: 472234 - RNA, 19 nt, Homo sapiens
cacaguauuguucuuguaa

SEQ ID NO: 472235 - RNA, 19 nt, Homo sapiens
ggcucuaacuccuugaugu

SEQ ID NO: 472236 - RNA, 19 nt, Homo sapiens
gucaguuugugaagugauu

SEQ ID NO: 472237 - RNA, 19 nt, Homo sapiens
ugucuccucugucaguuug

SEQ ID NO: 472238 - RNA, 19 nt, Homo sapiens
ccuccugucuccucuguca

SEQ ID NO: 472239 - RNA, 19 nt, Homo sapiens
acaguguggauguaaauuu

SEQ ID NO: 472240 - RNA, 19 nt, Homo sapiens
caacaacagaacaacaaca

SEQ ID NO: 472241 - RNA, 19 nt, Homo sapiens
caacaaaaccagaauugau

SEQ ID NO: 472242 - RNA, 19 nt, Homo sapiens
aacaaaugaugcccgagaa

SEQ ID NO: 472243 - RNA, 19 nt, Homo sapiens
aaacaguguggauguaaau

SEQ ID NO: 472244 - RNA, 19 nt, Homo sapiens
uaauauaggguuuguuugc

SEQ ID NO: 472245 - RNA, 19 nt, Homo sapiens
ccaaagguuguacauagug

SEQ ID NO: 472246 - RNA, 19 nt, Homo sapiens
ucucuuggucucuuucuuu

SEQ ID NO: 472247 - RNA, 19 nt, Homo sapiens
ugucagcuucccaacaaua

SEQ ID NO: 472248 - RNA, 19 nt, Homo sapiens
ucgacaggaucauggagaa

SEQ ID NO: 472249 - RNA, 19 nt, Homo sapiens
ggacgaacgggagcagaug

SEQ ID NO: 472250 - RNA, 19 nt, Homo sapiens
guaauauaggguuuguuug

SEQ ID NO: 472251 - RNA, 19 nt, Homo sapiens
ggaaggaaauucacaagaa

SEQ ID NO: 472252 - RNA, 19 nt, Homo sapiens
gaaggaaauucacaagaaa

SEQ ID NO: 472253 - RNA, 19 nt, Homo sapiens
gaaagaauccauccuuaaa

SEQ ID NO: 472254 - RNA, 19 nt, Homo sapiens
gaacaaagagccuggugua

SEQ ID NO: 472255 - RNA, 19 nt, Homo sapiens
caaagagccugguguaguu

SEQ ID NO: 472256 - RNA, 19 nt, Homo sapiens
ccaaauugcugucauauag

SEQ ID NO: 472257 - RNA, 19 nt, Homo sapiens
ugaaagggcagaaucauua

SEQ ID NO: 472258 - RNA, 19 nt, Homo sapiens
gaucagaguuggugcuuug

SEQ ID NO: 472259 - RNA, 19 nt, Homo sapiens
cagaaagaauccauccuua

SEQ ID NO: 472260 - RNA, 19 nt, Homo sapiens
gaagaugucucucagaaac

SEQ ID NO: 472261 - RNA, 19 nt, Homo sapiens
gagcugaaguuacagaaga

SEQ ID NO: 472262 - RNA, 19 nt, Homo sapiens
gacagagcauuucacuuua

SEQ ID NO: 472263 - RNA, 19 nt, Homo sapiens
agacagagcauuucacuuu

SEQ ID NO: 472264 - RNA, 19 nt, Homo sapiens
ccaaaguacugggauuaua

SEQ ID NO: 472265 - RNA, 19 nt, Homo sapiens
gcacaaagacagaaagaau

SEQ ID NO: 472266 - RNA, 19 nt, Homo sapiens
ucacggagcucuggagaaa

SEQ ID NO: 472267 - RNA, 19 nt, Homo sapiens
gaaauugcaauacguaguu

SEQ ID NO: 472268 - RNA, 19 nt, Homo sapiens
gaauaugccacucuguuaa

SEQ ID NO: 472269 - RNA, 19 nt, Homo sapiens
uuacagcaaugcccaaauu

SEQ ID NO: 472270 - RNA, 19 nt, Homo sapiens
gcauuucacuuuacagcaa

SEQ ID NO: 472271 - RNA, 19 nt, Homo sapiens
cuaauacagucugguaaua

SEQ ID NO: 472272 - RNA, 19 nt, Homo sapiens
gaucgugugaugaaacuua

SEQ ID NO: 472273 - RNA, 19 nt, Homo sapiens
gggaaucuguagguuauuu

SEQ ID NO: 472274 - RNA, 19 nt, Homo sapiens
gaccauaucccuaucaugu

SEQ ID NO: 472275 - RNA, 19 nt, Homo sapiens
ggauugggaugaaguuuua

SEQ ID NO: 472276 - RNA, 19 nt, Homo sapiens
uaauagagauggaguaucg

SEQ ID NO: 472277 - RNA, 19 nt, Homo sapiens
ucaccgagcugaaguuaca

SEQ ID NO: 472278 - RNA, 19 nt, Homo sapiens
uuaggaaguucacaaugua

SEQ ID NO: 472279 - RNA, 19 nt, Homo sapiens
ucucauaacgugauugaua

SEQ ID NO: 472280 - RNA, 19 nt, Homo sapiens
gaagagaaugaaaguuuga

SEQ ID NO: 472281 - RNA, 19 nt, Homo sapiens
ugaauaugccacucuguua

SEQ ID NO: 472282 - RNA, 19 nt, Homo sapiens
ggaaguucacaauguauuu

SEQ ID NO: 472283 - RNA, 19 nt, Homo sapiens
gaagaagaagagaaugaaa

SEQ ID NO: 472284 - RNA, 19 nt, Homo sapiens
gagaagaaagaaagauuga

SEQ ID NO: 472285 - RNA, 19 nt, Homo sapiens
uagaggaaaugcugaaugu

SEQ ID NO: 472286 - RNA, 19 nt, Homo sapiens
gaguugcccugaaggauug

SEQ ID NO: 472287 - RNA, 19 nt, Homo sapiens
ccauaucccuaucauguug

SEQ ID NO: 472288 - RNA, 19 nt, Homo sapiens
gcaauacguaguucuagaa

SEQ ID NO: 472289 - RNA, 19 nt, Homo sapiens
ccauacaccuuccagauca

SEQ ID NO: 472290 - RNA, 19 nt, Homo sapiens
gauggaguaucgcuauguu

SEQ ID NO: 472291 - RNA, 19 nt, Homo sapiens
gaggaaaugcugaauguuc

SEQ ID NO: 472292 - RNA, 19 nt, Homo sapiens
gauuauacuucaugcuguu

SEQ ID NO: 472293 - RNA, 19 nt, Homo sapiens
ccuauaagguuuugugaua

SEQ ID NO: 472294 - RNA, 19 nt, Homo sapiens
aaugaaaguuugaguggaa

SEQ ID NO: 472295 - RNA, 19 nt, Homo sapiens
caagugaucgugugaugaa

SEQ ID NO: 472296 - RNA, 19 nt, Homo sapiens
gaaaccccgucucuaauaa

SEQ ID NO: 472297 - RNA, 19 nt, Homo sapiens
agaagagaaugaaaguuug

SEQ ID NO: 472298 - RNA, 19 nt, Homo sapiens
ggaaggaagaugucucuca

SEQ ID NO: 472299 - RNA, 19 nt, Homo sapiens
ugaaacuuaucacuucuga

SEQ ID NO: 472300 - RNA, 19 nt, Homo sapiens
gagccauguuguuugaauu

SEQ ID NO: 472301 - RNA, 19 nt, Homo sapiens
gaaacggagagaugugaaa

SEQ ID NO: 472302 - RNA, 19 nt, Homo sapiens
cucauaacgugauugauaa

SEQ ID NO: 472303 - RNA, 19 nt, Homo sapiens
ggaagaugucucucagaaa

SEQ ID NO: 472304 - RNA, 19 nt, Homo sapiens
gcccucagcuugauaaagg

SEQ ID NO: 472305 - RNA, 19 nt, Homo sapiens
gauaaguccaagccagaua

SEQ ID NO: 472306 - RNA, 19 nt, Homo sapiens
caaaggcaaugugcagaau

SEQ ID NO: 472307 - RNA, 19 nt, Homo sapiens
agaaagaauccauccuuaa

SEQ ID NO: 472308 - RNA, 19 nt, Homo sapiens
cagaguuggugcuuuguau

SEQ ID NO: 472309 - RNA, 19 nt, Homo sapiens
agaaaacacugaacaaaga

SEQ ID NO: 472310 - RNA, 19 nt, Homo sapiens
gcaaugugcagaauauaca

SEQ ID NO: 472311 - RNA, 19 nt, Homo sapiens
gaauccauccuuaaaguca

SEQ ID NO: 472312 - RNA, 19 nt, Homo sapiens
caaaguacugggauuauag

SEQ ID NO: 472313 - RNA, 19 nt, Homo sapiens
aggaagaugucucucagaa

SEQ ID NO: 472314 - RNA, 19 nt, Homo sapiens
cuuaggaaguucacaaugu

SEQ ID NO: 472315 - RNA, 19 nt, Homo sapiens
cagaagaagaagagaauga

SEQ ID NO: 472316 - RNA, 19 nt, Homo sapiens
aagaauccauccuuaaagu

SEQ ID NO: 472317 - RNA, 19 nt, Homo sapiens
ucgagaccaucgugacuaa

SEQ ID NO: 472318 - RNA, 19 nt, Homo sapiens
gccaauagcagaccauauc

SEQ ID NO: 472319 - RNA, 19 nt, Homo sapiens
gguacagaauaguugauau

SEQ ID NO: 472320 - RNA, 19 nt, Homo sapiens
gagauggaguaucgcuaug

SEQ ID NO: 472321 - RNA, 19 nt, Homo sapiens
gaagcuacgacuagacaga

SEQ ID NO: 472322 - RNA, 19 nt, Homo sapiens
cuaaugcugacgcaaauaa

SEQ ID NO: 472323 - RNA, 19 nt, Homo sapiens
gcaggagaauggugugaac

SEQ ID NO: 472324 - RNA, 19 nt, Homo sapiens
acagucggauaauggauuu

SEQ ID NO: 472325 - RNA, 19 nt, Homo sapiens
aaauugcugucauauagga

SEQ ID NO: 472326 - RNA, 19 nt, Homo sapiens
ucaaauucgugauaucucu

SEQ ID NO: 472327 - RNA, 19 nt, Homo sapiens
aucuguagcuucaugaaua

SEQ ID NO: 472328 - RNA, 19 nt, Homo sapiens
gugauacuauacuguccua

SEQ ID NO: 472329 - RNA, 19 nt, Homo sapiens
gaagaagagaaugaaaguu

SEQ ID NO: 472330 - RNA, 19 nt, Homo sapiens
gaaggcaucgucaagucaa

SEQ ID NO: 472331 - RNA, 19 nt, Homo sapiens
gaacauaguuuuggagcau

SEQ ID NO: 472332 - RNA, 19 nt, Homo sapiens
gaugaaacuuaucacuucu

SEQ ID NO: 472333 - RNA, 19 nt, Homo sapiens
gaaugugucucugguacag

SEQ ID NO: 472334 - RNA, 19 nt, Homo sapiens
ucgcagauuguuacuauuu

SEQ ID NO: 472335 - RNA, 19 nt, Homo sapiens
gaauauacacaaggaagau

SEQ ID NO: 472336 - RNA, 19 nt, Homo sapiens
gaaagaaagauugaaacca

SEQ ID NO: 472337 - RNA, 19 nt, Homo sapiens
gaaagggcagaaucauuag

SEQ ID NO: 472338 - RNA, 19 nt, Homo sapiens
caucagcaguggcacaaag

SEQ ID NO: 472339 - RNA, 19 nt, Homo sapiens
gaaggauugggaugaaguu

SEQ ID NO: 472340 - RNA, 19 nt, Homo sapiens
uagcagaccauaucccuau

SEQ ID NO: 472341 - RNA, 19 nt, Homo sapiens
guucgggacuaucuucugu

SEQ ID NO: 472342 - RNA, 19 nt, Homo sapiens
gauacuauacuguccuaau

SEQ ID NO: 472343 - RNA, 19 nt, Homo sapiens
cugaguaugccuguaauua

SEQ ID NO: 472344 - RNA, 19 nt, Homo sapiens
aaggcaaugugcagaauau

SEQ ID NO: 472345 - RNA, 19 nt, Homo sapiens
ggcagaaucauuagcgaaa

SEQ ID NO: 472346 - RNA, 19 nt, Homo sapiens
gcagaaugagaaauuuaga

SEQ ID NO: 472347 - RNA, 19 nt, Homo sapiens
uaagggauuuaaaguuugg

SEQ ID NO: 472348 - RNA, 19 nt, Homo sapiens
gcuacuguacccagccuua

SEQ ID NO: 472349 - RNA, 19 nt, Homo sapiens
cugggaaucuguagguuau

SEQ ID NO: 472350 - RNA, 19 nt, Homo sapiens
auacaggcauccaaaucaa

SEQ ID NO: 472351 - RNA, 19 nt, Homo sapiens
ggacggaucuggcugagaa

SEQ ID NO: 472352 - RNA, 19 nt, Homo sapiens
uaaaggcccucgcacauuu

SEQ ID NO: 472353 - RNA, 19 nt, Homo sapiens
gcaagcagcugggaucugu

SEQ ID NO: 472354 - RNA, 19 nt, Homo sapiens
uugagaagaucuacaagua

SEQ ID NO: 472355 - RNA, 19 nt, Homo sapiens
gagaagaucuacaaguacu

SEQ ID NO: 472356 - RNA, 19 nt, Homo sapiens
gguauucugugaccaugaa

SEQ ID NO: 472357 - RNA, 19 nt, Homo sapiens
uaacagggccacuggaaga

SEQ ID NO: 472358 - RNA, 19 nt, Homo sapiens
agacuuugcuguggacuuu

SEQ ID NO: 472359 - RNA, 19 nt, Homo sapiens
guaaaggcccucgcacauu

SEQ ID NO: 472360 - RNA, 19 nt, Homo sapiens
gauaacagggccacuggaa

SEQ ID NO: 472361 - RNA, 19 nt, Homo sapiens
gagcacagcgaacugaaau

SEQ ID NO: 472362 - RNA, 19 nt, Homo sapiens
gggaggccauucagaaagu

SEQ ID NO: 472363 - RNA, 19 nt, Homo sapiens
gcuguggacuuugagaaga

SEQ ID NO: 472364 - RNA, 19 nt, Homo sapiens
gcuggucccuccacugaag

SEQ ID NO: 472365 - RNA, 19 nt, Homo sapiens
gcacagcgaacugaaaucg

SEQ ID NO: 472366 - RNA, 19 nt, Homo sapiens
gaccugcucaugucacuuc

SEQ ID NO: 472367 - RNA, 19 nt, Homo sapiens
gcgagaagcggcagcuagu

SEQ ID NO: 472368 - RNA, 19 nt, Homo sapiens
uugcaggacuccacucaca

SEQ ID NO: 472369 - RNA, 19 nt, Homo sapiens
gugaccaugaauaaaguua

SEQ ID NO: 472370 - RNA, 19 nt, Homo sapiens
gggccagcauccucaccuu

SEQ ID NO: 472371 - RNA, 19 nt, Homo sapiens
ggaggccauucagaaagug

SEQ ID NO: 472372 - RNA, 19 nt, Homo sapiens
ccagcauccucaccuucuu

SEQ ID NO: 472373 - RNA, 19 nt, Homo sapiens
cguaaaggcccucgcacau

SEQ ID NO: 472374 - RNA, 19 nt, Homo sapiens
cgagcacagcgaacugaaa

SEQ ID NO: 472375 - RNA, 19 nt, Homo sapiens
cagcccugguugagcauau

SEQ ID NO: 472376 - RNA, 19 nt, Homo sapiens
uaagaugccccauacuuug

SEQ ID NO: 472377 - RNA, 19 nt, Homo sapiens
ccgggaggccauucagaaa

SEQ ID NO: 472378 - RNA, 19 nt, Homo sapiens
gcacugcccaccguaaagg

SEQ ID NO: 472379 - RNA, 19 nt, Homo sapiens
cuaagaugccccauacuuu

SEQ ID NO: 472380 - RNA, 19 nt, Homo sapiens
gaagaaacaugccaguuaa

SEQ ID NO: 472381 - RNA, 19 nt, Homo sapiens
gcaaagaccuauacaaauc

SEQ ID NO: 472382 - RNA, 19 nt, Homo sapiens
ugaaauaacuguucucuug

SEQ ID NO: 472383 - RNA, 19 nt, Homo sapiens
gcuacuggauucuuuauua

SEQ ID NO: 472384 - RNA, 19 nt, Homo sapiens
gaacagacauuuaucuuac

SEQ ID NO: 472385 - RNA, 19 nt, Homo sapiens
gaacaugucauugucauua

SEQ ID NO: 472386 - RNA, 19 nt, Homo sapiens
ggaagaaaccauuacaaua

SEQ ID NO: 472387 - RNA, 19 nt, Homo sapiens
gaagaaaccauuacaauag

SEQ ID NO: 472388 - RNA, 19 nt, Homo sapiens
gaggcuggcuuauguuaua

SEQ ID NO: 472389 - RNA, 19 nt, Homo sapiens
guacacagauaaucacuau

SEQ ID NO: 472390 - RNA, 19 nt, Homo sapiens
ggaacaggauccacuuuga

SEQ ID NO: 472391 - RNA, 19 nt, Homo sapiens
gaacacaaaccauaccaaa

SEQ ID NO: 472392 - RNA, 19 nt, Homo sapiens
gagcuuauccuaucuguga

SEQ ID NO: 472393 - RNA, 19 nt, Homo sapiens
gaaauuccaugggcuaaau

SEQ ID NO: 472394 - RNA, 19 nt, Homo sapiens
caugaugacugcuuggaua

SEQ ID NO: 472395 - RNA, 19 nt, Homo sapiens
auacugaccuggugacuuu

SEQ ID NO: 472396 - RNA, 19 nt, Homo sapiens
ccuauaagccuauguguuu

SEQ ID NO: 472397 - RNA, 19 nt, Homo sapiens
cagcagacaugauugaaga

SEQ ID NO: 472398 - RNA, 19 nt, Homo sapiens
ggacuuaaaugccacaaac

SEQ ID NO: 472399 - RNA, 19 nt, Homo sapiens
cagcaaagaccuauacaaa

SEQ ID NO: 472400 - RNA, 19 nt, Homo sapiens
ccaccaaguucaagucaaa

SEQ ID NO: 472401 - RNA, 19 nt, Homo sapiens
agaagaaacaugccaguua

SEQ ID NO: 472402 - RNA, 19 nt, Homo sapiens
gagcagaacuaucauugag

SEQ ID NO: 472403 - RNA, 19 nt, Homo sapiens
gcuaagaacagacauuuau

SEQ ID NO: 472404 - RNA, 19 nt, Homo sapiens
ucaauacgcguuccuuaua

SEQ ID NO: 472405 - RNA, 19 nt, Homo sapiens
acaaagaacacaaaccaua

SEQ ID NO: 472406 - RNA, 19 nt, Homo sapiens
gaacaguccgcuaaagcua

SEQ ID NO: 472407 - RNA, 19 nt, Homo sapiens
gauaaucacuauagagaac

SEQ ID NO: 472408 - RNA, 19 nt, Homo sapiens
gaacaggauccacuuugaa

SEQ ID NO: 472409 - RNA, 19 nt, Homo sapiens
ccagaugggugacgaacaa

SEQ ID NO: 472410 - RNA, 19 nt, Homo sapiens
uaaaugccacaaacaguua

SEQ ID NO: 472411 - RNA, 19 nt, Homo sapiens
ggagucacaugccauagga

SEQ ID NO: 472412 - RNA, 19 nt, Homo sapiens
ucagguaccuauuauuguu

SEQ ID NO: 472413 - RNA, 19 nt, Homo sapiens
ccagcaaaccauagauuua

SEQ ID NO: 472414 - RNA, 19 nt, Homo sapiens
aagaauagcuacacucaca

SEQ ID NO: 472415 - RNA, 19 nt, Homo sapiens
ccagauugguggugaauuc

SEQ ID NO: 472416 - RNA, 19 nt, Homo sapiens
uggcuuauguuauaccuaa

SEQ ID NO: 472417 - RNA, 19 nt, Homo sapiens
cuuccaagguuguauuuaa

SEQ ID NO: 472418 - RNA, 19 nt, Homo sapiens
gaguugaguuguaguacuu

SEQ ID NO: 472419 - RNA, 19 nt, Homo sapiens
uagaggcuauggaaaguuu

SEQ ID NO: 472420 - RNA, 19 nt, Homo sapiens
gcacaaagaacacaaacca

SEQ ID NO: 472421 - RNA, 19 nt, Homo sapiens
cuuguacccuguuauauuu

SEQ ID NO: 472422 - RNA, 19 nt, Homo sapiens
gauuugagcagaacuauca

SEQ ID NO: 472423 - RNA, 19 nt, Homo sapiens
cagcaacacuccugaccaa

SEQ ID NO: 472424 - RNA, 19 nt, Homo sapiens
gaucgagccugcagacaag

SEQ ID NO: 472425 - RNA, 19 nt, Homo sapiens
cagcaaaccauagauuuaa

SEQ ID NO: 472426 - RNA, 19 nt, Homo sapiens
ccaugaggcuuccaagguu

SEQ ID NO: 472427 - RNA, 19 nt, Homo sapiens
acauaaggcuugugcauca

SEQ ID NO: 472428 - RNA, 19 nt, Homo sapiens
auacaaaucagccuucuuu

SEQ ID NO: 472429 - RNA, 19 nt, Homo sapiens
caacugagggauucaauuc

SEQ ID NO: 472430 - RNA, 19 nt, Homo sapiens
gcacaucagcaaagaccua

SEQ ID NO: 472431 - RNA, 19 nt, Homo sapiens
ucacacaacugagggauuc

SEQ ID NO: 472432 - RNA, 19 nt, Homo sapiens
gggaagaaaccauuacaau

SEQ ID NO: 472433 - RNA, 19 nt, Homo sapiens
gaauagcuacacucacaaa

SEQ ID NO: 472434 - RNA, 19 nt, Homo sapiens
gauaaaagauacccagaau

SEQ ID NO: 472435 - RNA, 19 nt, Homo sapiens
aaacugacgaaaccuauaa

SEQ ID NO: 472436 - RNA, 19 nt, Homo sapiens
gcacgaguuucugguaugu

SEQ ID NO: 472437 - RNA, 19 nt, Homo sapiens
ucaaguaguggaaguguuu

SEQ ID NO: 472438 - RNA, 19 nt, Homo sapiens
agacucagguaccuauuau

SEQ ID NO: 472439 - RNA, 19 nt, Homo sapiens
caauacgcguuccuuauag

SEQ ID NO: 472440 - RNA, 19 nt, Homo sapiens
gauccuggaaccuuuaauu

SEQ ID NO: 472441 - RNA, 19 nt, Homo sapiens
ugacgaacaaugacaguuu

SEQ ID NO: 472442 - RNA, 19 nt, Homo sapiens
cagauaaucacuauagaga

SEQ ID NO: 472443 - RNA, 19 nt, Homo sapiens
ucagugaccuccagauugg

SEQ ID NO: 472444 - RNA, 19 nt, Homo sapiens
gcccguguguuauguauca

SEQ ID NO: 472445 - RNA, 19 nt, Homo sapiens
acaguuugcccguguguua

SEQ ID NO: 472446 - RNA, 19 nt, Homo sapiens
gcaaaccauagauuuaaga

SEQ ID NO: 472447 - RNA, 19 nt, Homo sapiens
acacaaaccauaccaaaca

SEQ ID NO: 472448 - RNA, 19 nt, Homo sapiens
gcaacuuuccagaguauga

SEQ ID NO: 472449 - RNA, 19 nt, Homo sapiens
caaagacucagguaccuau

SEQ ID NO: 472450 - RNA, 19 nt, Homo sapiens
gcugcaacuuuccagagua

SEQ ID NO: 472451 - RNA, 19 nt, Homo sapiens
caagaagcauuggcuaugg

SEQ ID NO: 472452 - RNA, 19 nt, Homo sapiens
guugaguuguaguacuuua

SEQ ID NO: 472453 - RNA, 19 nt, Homo sapiens
ccuggaaccuuuaauuaag

SEQ ID NO: 472454 - RNA, 19 nt, Homo sapiens
gaugacugcuuggauagga

SEQ ID NO: 472455 - RNA, 19 nt, Homo sapiens
cugcuagaauggaagauuu

SEQ ID NO: 472456 - RNA, 19 nt, Homo sapiens
ggucagagucccaugauag

SEQ ID NO: 472457 - RNA, 19 nt, Homo sapiens
caaaucagccuucuuuuau

SEQ ID NO: 472458 - RNA, 19 nt, Homo sapiens
acacagauaaucacuauag

SEQ ID NO: 472459 - RNA, 19 nt, Homo sapiens
gaugguuaccuuauuucua

SEQ ID NO: 472460 - RNA, 19 nt, Homo sapiens
gaugggugacgaacaauga

SEQ ID NO: 472461 - RNA, 19 nt, Homo sapiens
uaucuuguacccuguuaua

SEQ ID NO: 472462 - RNA, 19 nt, Homo sapiens
ccagguuacucccacaguu

SEQ ID NO: 472463 - RNA, 19 nt, Homo sapiens
cgagguggcccuacgugua

SEQ ID NO: 472464 - RNA, 19 nt, Homo sapiens
uaacugccagcaaaccaua

SEQ ID NO: 472465 - RNA, 19 nt, Homo sapiens
aaauaacuguucucuugga

SEQ ID NO: 472466 - RNA, 19 nt, Homo sapiens
acagguaucccaccaaguu

SEQ ID NO: 472467 - RNA, 19 nt, Homo sapiens
gagaugacaagcacgaguu

SEQ ID NO: 472468 - RNA, 19 nt, Homo sapiens
uccgaaugcugcacuauga

SEQ ID NO: 472469 - RNA, 19 nt, Homo sapiens
cagaagucauuccggagaa

SEQ ID NO: 472470 - RNA, 19 nt, Homo sapiens
auugauaacugccagcaaa

SEQ ID NO: 472471 - RNA, 19 nt, Homo sapiens
gcuacaccuucuaccauga

SEQ ID NO: 472472 - RNA, 19 nt, Homo sapiens
ucagacacacauauucuuu

SEQ ID NO: 472473 - RNA, 19 nt, Homo sapiens
gaauggaagauuucaccuu

SEQ ID NO: 472474 - RNA, 19 nt, Homo sapiens
ugacuuguguauuaaacug

SEQ ID NO: 472475 - RNA, 19 nt, Homo sapiens
gauuucaccuucaaugacu

SEQ ID NO: 472476 - RNA, 19 nt, Homo sapiens
ucagacugcuagaauggaa

SEQ ID NO: 472477 - RNA, 19 nt, Homo sapiens
gcagagauuugagcagaac

SEQ ID NO: 472478 - RNA, 19 nt, Homo sapiens
caaagaccuauacaaauca

SEQ ID NO: 472479 - RNA, 19 nt, Homo sapiens
caaaccauaccaaacaaug

SEQ ID NO: 472480 - RNA, 19 nt, Homo sapiens
ccaggaagcugcugaagaa

SEQ ID NO: 472481 - RNA, 19 nt, Homo sapiens
ggaggaauaucaggaguau

SEQ ID NO: 472482 - RNA, 19 nt, Homo sapiens
ggauggacguguucaugaa

SEQ ID NO: 472483 - RNA, 19 nt, Homo sapiens
gauguagcauguucuaugu

SEQ ID NO: 472484 - RNA, 19 nt, Homo sapiens
ccacaggacuggugaagag

SEQ ID NO: 472485 - RNA, 19 nt, Homo sapiens
ggaauucccuacugaucug

SEQ ID NO: 472486 - RNA, 19 nt, Homo sapiens
ggauguagcauguucuaug

SEQ ID NO: 472487 - RNA, 19 nt, Homo sapiens
ggaagcugcugaagaacca

SEQ ID NO: 472488 - RNA, 19 nt, Homo sapiens
gggaggagcuguguucucu

SEQ ID NO: 472489 - RNA, 19 nt, Homo sapiens
gcgcggauguagcauguuc

SEQ ID NO: 472490 - RNA, 19 nt, Homo sapiens
aggaauaucaggaguauga

SEQ ID NO: 472491 - RNA, 19 nt, Homo sapiens
gaucuuccuuccgcucuga

SEQ ID NO: 472492 - RNA, 19 nt, Homo sapiens
ggaacaggccucacaucug

SEQ ID NO: 472493 - RNA, 19 nt, Homo sapiens
uagcauguucuauguguuu

SEQ ID NO: 472494 - RNA, 19 nt, Homo sapiens
gcugaagaaccacugauug

SEQ ID NO: 472495 - RNA, 19 nt, Homo sapiens
ccgagaaggugugguacaa

SEQ ID NO: 472496 - RNA, 19 nt, Homo sapiens
guuagugucuguccaucug

SEQ ID NO: 472497 - RNA, 19 nt, Homo sapiens
cugaagaaccacugauuga

SEQ ID NO: 472498 - RNA, 19 nt, Homo sapiens
gguacaagguguggcuuca

SEQ ID NO: 472499 - RNA, 19 nt, Homo sapiens
gacccgagaagguguggua

SEQ ID NO: 472500 - RNA, 19 nt, Homo sapiens
ccaaggaacaggccucaca

SEQ ID NO: 472501 - RNA, 19 nt, Homo sapiens
uguagcauguucuaugugu

SEQ ID NO: 472502 - RNA, 19 nt, Homo sapiens
gaggaauucccuacugauc

SEQ ID NO: 472503 - RNA, 19 nt, Homo sapiens
ccucggagccuguguuagu

SEQ ID NO: 472504 - RNA, 19 nt, Homo sapiens
ggaaguggcccaggaagcu

SEQ ID NO: 472505 - RNA, 19 nt, Homo sapiens
guagcauguucuauguguu

SEQ ID NO: 472506 - RNA, 19 nt, Homo sapiens
gcggauguagcauguucua

SEQ ID NO: 472507 - RNA, 19 nt, Homo sapiens
ggaggaauucccuacugau

SEQ ID NO: 472508 - RNA, 19 nt, Homo sapiens
ggaagcaagacccgagaag

SEQ ID NO: 472509 - RNA, 19 nt, Homo sapiens
uacaagguguggcuucagu

SEQ ID NO: 472510 - RNA, 19 nt, Homo sapiens
ccagggcuguccuuagacu

SEQ ID NO: 472511 - RNA, 19 nt, Homo sapiens
cggcggagaagaccaagga

SEQ ID NO: 472512 - RNA, 19 nt, Homo sapiens
ccgccaggauggacguguu

SEQ ID NO: 472513 - RNA, 19 nt, Homo sapiens
aagcaagacccgagaaggu

SEQ ID NO: 472514 - RNA, 19 nt, Homo sapiens
ggaggaagaugcuaaguug

SEQ ID NO: 472515 - RNA, 19 nt, Homo sapiens
gggagaagauuuccaauau

SEQ ID NO: 472516 - RNA, 19 nt, Homo sapiens
gaaagucaguggugaguga

SEQ ID NO: 472517 - RNA, 19 nt, Homo sapiens
ggauguagaugcugaaaga

SEQ ID NO: 472518 - RNA, 19 nt, Homo sapiens
gcagaauugucuacuauau

SEQ ID NO: 472519 - RNA, 19 nt, Homo sapiens
gcacauagcaggaguuugu

SEQ ID NO: 472520 - RNA, 19 nt, Homo sapiens
ggagaagauuuccaauauu

SEQ ID NO: 472521 - RNA, 19 nt, Homo sapiens
gaagaggaacaguuaauug

SEQ ID NO: 472522 - RNA, 19 nt, Homo sapiens
ucaaggagcuggaaaggau

SEQ ID NO: 472523 - RNA, 19 nt, Homo sapiens
gaggaacaguuaauugaau

SEQ ID NO: 472524 - RNA, 19 nt, Homo sapiens
gugcacaccugaacacuug

SEQ ID NO: 472525 - RNA, 19 nt, Homo sapiens
gcacggucuugguuucuaa

SEQ ID NO: 472526 - RNA, 19 nt, Homo sapiens
ggacaagcacuuucucaga

SEQ ID NO: 472527 - RNA, 19 nt, Homo sapiens
gcacagagccacccagagu

SEQ ID NO: 472528 - RNA, 19 nt, Homo sapiens
gcacaacaaagcucugaaa

SEQ ID NO: 472529 - RNA, 19 nt, Homo sapiens
ggagcaggauugguuuaaa

SEQ ID NO: 472530 - RNA, 19 nt, Homo sapiens
aaucaagucucgagucaga

SEQ ID NO: 472531 - RNA, 19 nt, Homo sapiens
gcugaaagagagaagauaa

SEQ ID NO: 472532 - RNA, 19 nt, Homo sapiens
cagaggagauccggaaguu

SEQ ID NO: 472533 - RNA, 19 nt, Homo sapiens
gaagauaacacaggagauc

SEQ ID NO: 472534 - RNA, 19 nt, Homo sapiens
ucaagaagccucaaagagu

SEQ ID NO: 472535 - RNA, 19 nt, Homo sapiens
ccgcagaauugucuacuau

SEQ ID NO: 472536 - RNA, 19 nt, Homo sapiens
gcaggaggcugggacuuca

SEQ ID NO: 472537 - RNA, 19 nt, Homo sapiens
augaagaccuccugaguga

SEQ ID NO: 472538 - RNA, 19 nt, Homo sapiens
ggaagaugcuaaguugcuu

SEQ ID NO: 472539 - RNA, 19 nt, Homo sapiens
aagggucgguggaauuuaa

SEQ ID NO: 472540 - RNA, 19 nt, Homo sapiens
agaauugucuacuauaugg

SEQ ID NO: 472541 - RNA, 19 nt, Homo sapiens
uaacacaggagaucaagga

SEQ ID NO: 472542 - RNA, 19 nt, Homo sapiens
gagcaggauugguuuaaaa

SEQ ID NO: 472543 - RNA, 19 nt, Homo sapiens
ggucuugguuucuaacauc

SEQ ID NO: 472544 - RNA, 19 nt, Homo sapiens
cagcugaucuaccgaugga

SEQ ID NO: 472545 - RNA, 19 nt, Homo sapiens
uucaagcuguugccaaaua

SEQ ID NO: 472546 - RNA, 19 nt, Homo sapiens
ggagaucucagaaucaagu

SEQ ID NO: 472547 - RNA, 19 nt, Homo sapiens
cugaacacuuggaggaaua

SEQ ID NO: 472548 - RNA, 19 nt, Homo sapiens
aaaagaagaggaacaguua

SEQ ID NO: 472549 - RNA, 19 nt, Homo sapiens
gaugcuaaguugcuucaag

SEQ ID NO: 472550 - RNA, 19 nt, Homo sapiens
gcagggaagccgagaagga

SEQ ID NO: 472551 - RNA, 19 nt, Homo sapiens
ggaggcgucugcugacagu

SEQ ID NO: 472552 - RNA, 19 nt, Homo sapiens
agaaggagauccaggacau

SEQ ID NO: 472553 - RNA, 19 nt, Homo sapiens
ggcaagcccuggagaagca

SEQ ID NO: 472554 - RNA, 19 nt, Homo sapiens
agaaucaagucucgaguca

SEQ ID NO: 472555 - RNA, 19 nt, Homo sapiens
guggagaucucagaaucaa

SEQ ID NO: 472556 - RNA, 19 nt, Homo sapiens
gcaaguggaagaucaugau

SEQ ID NO: 472557 - RNA, 19 nt, Homo sapiens
uccagugccugcagaaauu

SEQ ID NO: 472558 - RNA, 19 nt, Homo sapiens
ggaucuggcuggguccaaa

SEQ ID NO: 472559 - RNA, 19 nt, Homo sapiens
gggugugucugaaggagaa

SEQ ID NO: 472560 - RNA, 19 nt, Homo sapiens
gaggaauaaaguucuguuu

SEQ ID NO: 472561 - RNA, 19 nt, Homo sapiens
ggacuucagccaaggacaa

SEQ ID NO: 472562 - RNA, 19 nt, Homo sapiens
agagcaaagucuccaguga

SEQ ID NO: 472563 - RNA, 19 nt, Homo sapiens
aaagagagaagauaacaca

SEQ ID NO: 472564 - RNA, 19 nt, Homo sapiens
agaaggcccuggagcacaa

SEQ ID NO: 472565 - RNA, 19 nt, Homo sapiens
aagaggaacaguuaauuga

SEQ ID NO: 472566 - RNA, 19 nt, Homo sapiens
ccacaaagggagccgaaga

SEQ ID NO: 472567 - RNA, 19 nt, Homo sapiens
gcucaagaagccucaaaga

SEQ ID NO: 472568 - RNA, 19 nt, Homo sapiens
cacacaggcuucccagaga

SEQ ID NO: 472569 - RNA, 19 nt, Homo sapiens
ggagauuacauuucagcuu

SEQ ID NO: 472570 - RNA, 19 nt, Homo sapiens
gaagaggugccagguagga

SEQ ID NO: 472571 - RNA, 19 nt, Homo sapiens
gagcacauagcaggaguuu

SEQ ID NO: 472572 - RNA, 19 nt, Homo sapiens
gaggagauccggaaguucu

SEQ ID NO: 472573 - RNA, 19 nt, Homo sapiens
ggaugaagaccuccugagu

SEQ ID NO: 472574 - RNA, 19 nt, Homo sapiens
ggauggcaguguggccuuu

SEQ ID NO: 472575 - RNA, 19 nt, Homo sapiens
cucaggagauuacauuuca

SEQ ID NO: 472576 - RNA, 19 nt, Homo sapiens
aaacgugccggcucaagaa

SEQ ID NO: 472577 - RNA, 19 nt, Homo sapiens
caaacgugccggcucaaga

SEQ ID NO: 472578 - RNA, 19 nt, Homo sapiens
gcuucucccuguuccugua

SEQ ID NO: 472579 - RNA, 19 nt, Homo sapiens
aaagagugccagccacaaa

SEQ ID NO: 472580 - RNA, 19 nt, Homo sapiens
ugggagaagauuuccaaua

SEQ ID NO: 472581 - RNA, 19 nt, Homo sapiens
ggugugagcagcaggacaa

SEQ ID NO: 472582 - RNA, 19 nt, Homo sapiens
gcacauacauggggcacuu

SEQ ID NO: 472583 - RNA, 19 nt, Homo sapiens
ggaggaauaaaguucuguu

SEQ ID NO: 472584 - RNA, 19 nt, Homo sapiens
caggccaccucuucccaaa

SEQ ID NO: 472585 - RNA, 19 nt, Homo sapiens
gagauguucuuggggcuua

SEQ ID NO: 472586 - RNA, 19 nt, Homo sapiens
gccuggauacuucuaauga

SEQ ID NO: 472587 - RNA, 19 nt, Homo sapiens
ccuccugccuggauacuuc

SEQ ID NO: 472588 - RNA, 19 nt, Homo sapiens
ccagguggccagggagaua

SEQ ID NO: 472589 - RNA, 19 nt, Homo sapiens
gcacauaggagggccacau

SEQ ID NO: 472590 - RNA, 19 nt, Homo sapiens
ggacccaccaguucaucuu

SEQ ID NO: 472591 - RNA, 19 nt, Homo sapiens
gggagcaggauugguuuaa

SEQ ID NO: 472592 - RNA, 19 nt, Homo sapiens
ucgaguacuugcaccagaa

SEQ ID NO: 472593 - RNA, 19 nt, Homo sapiens
uucugugccuggccuauua

SEQ ID NO: 472594 - RNA, 19 nt, Homo sapiens
ggcccaagcccaagacugu

SEQ ID NO: 472595 - RNA, 19 nt, Homo sapiens
ucaagucucgagucagauu

SEQ ID NO: 472596 - RNA, 19 nt, Homo sapiens
ugaaagagagaagauaaca

SEQ ID NO: 472597 - RNA, 19 nt, Homo sapiens
cggagcugcuucaggagaa

SEQ ID NO: 472598 - RNA, 19 nt, Homo sapiens
uuacccagcuguuccacau

SEQ ID NO: 472599 - RNA, 19 nt, Homo sapiens
agaagaggaacaguuaauu

SEQ ID NO: 472600 - RNA, 19 nt, Homo sapiens
gagacuccaugcagcugau

SEQ ID NO: 472601 - RNA, 19 nt, Homo sapiens
cagaauugucuacuauaug

SEQ ID NO: 472602 - RNA, 19 nt, Homo sapiens
caccuggaguggcagaaga

SEQ ID NO: 472603 - RNA, 19 nt, Homo sapiens
gauaaaacccucccugaag

SEQ ID NO: 472604 - RNA, 19 nt, Homo sapiens
gaccuggacgugcucagaa

SEQ ID NO: 472605 - RNA, 19 nt, Homo sapiens
ccgcaccacccucucagua

SEQ ID NO: 472606 - RNA, 19 nt, Homo sapiens
ggcacggucuugguuucua

SEQ ID NO: 472607 - RNA, 19 nt, Homo sapiens
ggucccaccgucuuaaaug

SEQ ID NO: 472608 - RNA, 19 nt, Homo sapiens
aaagaagaggaacaguuaa

SEQ ID NO: 472609 - RNA, 19 nt, Homo sapiens
gcagcaggacaagcacuuu

SEQ ID NO: 472610 - RNA, 19 nt, Homo sapiens
ucugguaaaugcucugcuu

SEQ ID NO: 472611 - RNA, 19 nt, Homo sapiens
cugcaggcauccucaagug

SEQ ID NO: 472612 - RNA, 19 nt, Homo sapiens
caaggugaaagacggcaaa

SEQ ID NO: 472613 - RNA, 19 nt, Homo sapiens
gcagcaggaggaacucaug

SEQ ID NO: 472614 - RNA, 19 nt, Homo sapiens
gguaugcacugguuccuua

SEQ ID NO: 472615 - RNA, 19 nt, Homo sapiens
caaugaggcuuaugaaaug

SEQ ID NO: 472616 - RNA, 19 nt, Homo sapiens
ggaauucccugaagcaaca

SEQ ID NO: 472617 - RNA, 19 nt, Homo sapiens
caacaugaauuaagaacug

SEQ ID NO: 472618 - RNA, 19 nt, Homo sapiens
guucagaaguuguuaguga

SEQ ID NO: 472619 - RNA, 19 nt, Homo sapiens
cuacgaaccugaagccuaa

SEQ ID NO: 472620 - RNA, 19 nt, Homo sapiens
ugaaaugccuucugaggaa

SEQ ID NO: 472621 - RNA, 19 nt, Homo sapiens
ccaaagagcaagugacaaa

SEQ ID NO: 472622 - RNA, 19 nt, Homo sapiens
gaaacuaugcaccuauaaa

SEQ ID NO: 472623 - RNA, 19 nt, Homo sapiens
gacuaccacuuauuucuaa

SEQ ID NO: 472624 - RNA, 19 nt, Homo sapiens
guaccuuucugacaauaaa

SEQ ID NO: 472625 - RNA, 19 nt, Homo sapiens
gaaggaauucuggaagaua

SEQ ID NO: 472626 - RNA, 19 nt, Homo sapiens
gggcaagaaugaagaagga

SEQ ID NO: 472627 - RNA, 19 nt, Homo sapiens
ggaaggguaucaagacuac

SEQ ID NO: 472628 - RNA, 19 nt, Homo sapiens
gaacugacacaaaggacaa

SEQ ID NO: 472629 - RNA, 19 nt, Homo sapiens
ggaaggaauucuggaagau

SEQ ID NO: 472630 - RNA, 19 nt, Homo sapiens
gaacuguuguuugaugugu

SEQ ID NO: 472631 - RNA, 19 nt, Homo sapiens
aaguggcugugauuaauua

SEQ ID NO: 472632 - RNA, 19 nt, Homo sapiens
cgacgacagugugguguaa

SEQ ID NO: 472633 - RNA, 19 nt, Homo sapiens
gcuucaaucuacgauguua

SEQ ID NO: 472634 - RNA, 19 nt, Homo sapiens
caugacauuucucaaaguu

SEQ ID NO: 472635 - RNA, 19 nt, Homo sapiens
gaaccugaagccuaagaaa

SEQ ID NO: 472636 - RNA, 19 nt, Homo sapiens
cuuaugaaaugccuucuga

SEQ ID NO: 472637 - RNA, 19 nt, Homo sapiens
gguguaaaggaauucauua

SEQ ID NO: 472638 - RNA, 19 nt, Homo sapiens
gagcaagugacaaauguug

SEQ ID NO: 472639 - RNA, 19 nt, Homo sapiens
uggcugugauuaauuauug

SEQ ID NO: 472640 - RNA, 19 nt, Homo sapiens
cagaaguuguuagugauuu

SEQ ID NO: 472641 - RNA, 19 nt, Homo sapiens
ggaauucauuagccaugga

SEQ ID NO: 472642 - RNA, 19 nt, Homo sapiens
acaaugaggcuuaugaaau

SEQ ID NO: 472643 - RNA, 19 nt, Homo sapiens
caaacaggguguggcagaa

SEQ ID NO: 472644 - RNA, 19 nt, Homo sapiens
aacguuaucucauugcaaa

SEQ ID NO: 472645 - RNA, 19 nt, Homo sapiens
ucaauccugucaauguuug

SEQ ID NO: 472646 - RNA, 19 nt, Homo sapiens
uaugugagcaugaaacuau

SEQ ID NO: 472647 - RNA, 19 nt, Homo sapiens
gacaaugaggcuuaugaaa

SEQ ID NO: 472648 - RNA, 19 nt, Homo sapiens
ugacagcaguagcccagaa

SEQ ID NO: 472649 - RNA, 19 nt, Homo sapiens
uaucccaucucacuuuaau

SEQ ID NO: 472650 - RNA, 19 nt, Homo sapiens
aaggaauucuggaagauau

SEQ ID NO: 472651 - RNA, 19 nt, Homo sapiens
gucaauguuugcuuuaugu

SEQ ID NO: 472652 - RNA, 19 nt, Homo sapiens
uaucuuugcucccaguuuc

SEQ ID NO: 472653 - RNA, 19 nt, Homo sapiens
gaccaaagagcaagugaca

SEQ ID NO: 472654 - RNA, 19 nt, Homo sapiens
aagcaacacugccagaagu

SEQ ID NO: 472655 - RNA, 19 nt, Homo sapiens
ugaagaaggaggaauuuua

SEQ ID NO: 472656 - RNA, 19 nt, Homo sapiens
auuaagaacugacacaaag

SEQ ID NO: 472657 - RNA, 19 nt, Homo sapiens
ugacuaccacuuauuucua

SEQ ID NO: 472658 - RNA, 19 nt, Homo sapiens
ggagggagcagggagcauu

SEQ ID NO: 472659 - RNA, 19 nt, Homo sapiens
aagagcaagugacaaaugu

SEQ ID NO: 472660 - RNA, 19 nt, Homo sapiens
gaauuaagaacugacacaa

SEQ ID NO: 472661 - RNA, 19 nt, Homo sapiens
ucccaucucacuuuaauaa

SEQ ID NO: 472662 - RNA, 19 nt, Homo sapiens
augaaacuaugcaccuaua

SEQ ID NO: 472663 - RNA, 19 nt, Homo sapiens
gaggaaggguaucaagacu

SEQ ID NO: 472664 - RNA, 19 nt, Homo sapiens
cauuagccauggauguauu

SEQ ID NO: 472665 - RNA, 19 nt, Homo sapiens
gcaagugacaaauguugga

SEQ ID NO: 472666 - RNA, 19 nt, Homo sapiens
ccagaaguguguuuuggua

SEQ ID NO: 472667 - RNA, 19 nt, Homo sapiens
cagcagugauugaaguauc

SEQ ID NO: 472668 - RNA, 19 nt, Homo sapiens
ccugaagccuaagaaauau

SEQ ID NO: 472669 - RNA, 19 nt, Homo sapiens
gggaacuguuguuugaugu

SEQ ID NO: 472670 - RNA, 19 nt, Homo sapiens
cuucaauccugucaauguu

SEQ ID NO: 472671 - RNA, 19 nt, Homo sapiens
gaagcaacacugccagaag

SEQ ID NO: 472672 - RNA, 19 nt, Homo sapiens
caagugcucaguuccaaug

SEQ ID NO: 472673 - RNA, 19 nt, Homo sapiens
ugacguauugugaaauuug

SEQ ID NO: 472674 - RNA, 19 nt, Homo sapiens
caguguaucucgaagucuu

SEQ ID NO: 472675 - RNA, 19 nt, Homo sapiens
gucaugacauuucucaaag

SEQ ID NO: 472676 - RNA, 19 nt, Homo sapiens
guuccaaugugcccaguca

SEQ ID NO: 472677 - RNA, 19 nt, Homo sapiens
uagaagagguagagaaaau

SEQ ID NO: 472678 - RNA, 19 nt, Homo sapiens
accugaagccuaagaaaua

SEQ ID NO: 472679 - RNA, 19 nt, Homo sapiens
aggaaggaauucuggaaga

SEQ ID NO: 472680 - RNA, 19 nt, Homo sapiens
uggcaacaguggcugagaa

SEQ ID NO: 472681 - RNA, 19 nt, Homo sapiens
uaagaacugacacaaagga

SEQ ID NO: 472682 - RNA, 19 nt, Homo sapiens
uuuaucccaucucacuuua

SEQ ID NO: 472683 - RNA, 19 nt, Homo sapiens
acagugugguguaaaggaa

SEQ ID NO: 472684 - RNA, 19 nt, Homo sapiens
gacguauugugaaauuugu

SEQ ID NO: 472685 - RNA, 19 nt, Homo sapiens
agaaguuguuagugauuug

SEQ ID NO: 472686 - RNA, 19 nt, Homo sapiens
ccaaugugcccagucauga

SEQ ID NO: 472687 - RNA, 19 nt, Homo sapiens
aaagagcaagugacaaaug

SEQ ID NO: 472688 - RNA, 19 nt, Homo sapiens
gcuguaccuuucugacaau

SEQ ID NO: 472689 - RNA, 19 nt, Homo sapiens
ugugaaugcuguaccuuuc

SEQ ID NO: 472690 - RNA, 19 nt, Homo sapiens
ugucaauguuugcuuuaug

SEQ ID NO: 472691 - RNA, 19 nt, Homo sapiens
uaaguggcugugauuaauu

SEQ ID NO: 472692 - RNA, 19 nt, Homo sapiens
gcagaagcagcaggaaaga

SEQ ID NO: 472693 - RNA, 19 nt, Homo sapiens
gaagaaggaggaauuuuag

SEQ ID NO: 472694 - RNA, 19 nt, Homo sapiens
gcucccaguuucuugagau

SEQ ID NO: 472695 - RNA, 19 nt, Homo sapiens
ugacaaugaggcuuaugaa

SEQ ID NO: 472696 - RNA, 19 nt, Homo sapiens
gaaagugggguguugaaga

SEQ ID NO: 472697 - RNA, 19 nt, Homo sapiens
uaauagccauuugaagaag

SEQ ID NO: 472698 - RNA, 19 nt, Homo sapiens
gucuaagaauaaugacgua

SEQ ID NO: 472699 - RNA, 19 nt, Homo sapiens
agucaugacauuucucaaa

SEQ ID NO: 472700 - RNA, 19 nt, Homo sapiens
uggcuucaaucuacgaugu

SEQ ID NO: 472701 - RNA, 19 nt, Homo sapiens
guuccauccuguacaagug

SEQ ID NO: 472702 - RNA, 19 nt, Homo sapiens
caacaguggcugagaagac

SEQ ID NO: 472703 - RNA, 19 nt, Homo sapiens
ggcagaagcagcaggaaag

SEQ ID NO: 472704 - RNA, 19 nt, Homo sapiens
uggcugagaagaccaaaga

SEQ ID NO: 472705 - RNA, 19 nt, Homo sapiens
gguagcagggucuuugugu

SEQ ID NO: 472706 - RNA, 19 nt, Homo sapiens
ugaaugcuguaccuuucug

SEQ ID NO: 472707 - RNA, 19 nt, Homo sapiens
gaagcagcaggaaagacaa

SEQ ID NO: 472708 - RNA, 19 nt, Homo sapiens
uuuagaagagguagagaaa

SEQ ID NO: 472709 - RNA, 19 nt, Homo sapiens
ugaaacuaugcaccuauaa

SEQ ID NO: 472710 - RNA, 19 nt, Homo sapiens
ugagaagaccaaagagcaa

SEQ ID NO: 472711 - RNA, 19 nt, Homo sapiens
ucagaaguuguuagugauu

SEQ ID NO: 472712 - RNA, 19 nt, Homo sapiens
uacaagugcucaguuccaa

SEQ ID NO: 472713 - RNA, 19 nt, Homo sapiens
gaagaccaaagagcaagug

SEQ ID NO: 472714 - RNA, 19 nt, Homo sapiens
caacaugaauuaagaacug

SEQ ID NO: 472715 - RNA, 19 nt, Homo sapiens
guucagaaguuguuaguga

SEQ ID NO: 472716 - RNA, 19 nt, Homo sapiens
cuacgaaccugaagccuaa

SEQ ID NO: 472717 - RNA, 19 nt, Homo sapiens
ccaaagagcaagugacaaa

SEQ ID NO: 472718 - RNA, 19 nt, Homo sapiens
gaaacuaugcaccuauaaa

SEQ ID NO: 472719 - RNA, 19 nt, Homo sapiens
gacuaccacuuauuucuaa

SEQ ID NO: 472720 - RNA, 19 nt, Homo sapiens
ggaaggguaucaagacuac

SEQ ID NO: 472721 - RNA, 19 nt, Homo sapiens
gaacugacacaaaggacaa

SEQ ID NO: 472722 - RNA, 19 nt, Homo sapiens
gcaaggaaggguaucaaga

SEQ ID NO: 472723 - RNA, 19 nt, Homo sapiens
gcuucaaucuacgauguua

SEQ ID NO: 472724 - RNA, 19 nt, Homo sapiens
caugacauuucucaaaguu

SEQ ID NO: 472725 - RNA, 19 nt, Homo sapiens
gaaccugaagccuaagaaa

SEQ ID NO: 472726 - RNA, 19 nt, Homo sapiens
gagcaagugacaaauguug

SEQ ID NO: 472727 - RNA, 19 nt, Homo sapiens
cagaaguuguuagugauuu

SEQ ID NO: 472728 - RNA, 19 nt, Homo sapiens
caaacaggguguggcagaa

SEQ ID NO: 472729 - RNA, 19 nt, Homo sapiens
aacguuaucucauugcaaa

SEQ ID NO: 472730 - RNA, 19 nt, Homo sapiens
uaugugagcaugaaacuau

SEQ ID NO: 472731 - RNA, 19 nt, Homo sapiens
ugacagcaguagcccagaa

SEQ ID NO: 472732 - RNA, 19 nt, Homo sapiens
uaucccaucucacuuuaau

SEQ ID NO: 472733 - RNA, 19 nt, Homo sapiens
uaucuuugcucccaguuuc

SEQ ID NO: 472734 - RNA, 19 nt, Homo sapiens
gaccaaagagcaagugaca

SEQ ID NO: 472735 - RNA, 19 nt, Homo sapiens
ugaagaaggaggaauuuua

SEQ ID NO: 472736 - RNA, 19 nt, Homo sapiens
auuaagaacugacacaaag

SEQ ID NO: 472737 - RNA, 19 nt, Homo sapiens
ugacuaccacuuauuucua

SEQ ID NO: 472738 - RNA, 19 nt, Homo sapiens
ggagggagcagggagcauu

SEQ ID NO: 472739 - RNA, 19 nt, Homo sapiens
aagagcaagugacaaaugu

SEQ ID NO: 472740 - RNA, 19 nt, Homo sapiens
gaauuaagaacugacacaa

SEQ ID NO: 472741 - RNA, 19 nt, Homo sapiens
ucccaucucacuuuaauaa

SEQ ID NO: 472742 - RNA, 19 nt, Homo sapiens
augaaacuaugcaccuaua

SEQ ID NO: 472743 - RNA, 19 nt, Homo sapiens
gcaagugacaaauguugga

SEQ ID NO: 472744 - RNA, 19 nt, Homo sapiens
cauuagccauggauguauu

SEQ ID NO: 472745 - RNA, 19 nt, Homo sapiens
cagcagugauugaaguauc

SEQ ID NO: 472746 - RNA, 19 nt, Homo sapiens
ccugaagccuaagaaauau

SEQ ID NO: 472747 - RNA, 19 nt, Homo sapiens
caagugcucaguuccaaug

SEQ ID NO: 472748 - RNA, 19 nt, Homo sapiens
ugacguauugugaaauuug

SEQ ID NO: 472749 - RNA, 19 nt, Homo sapiens
caguguaucucgaagucuu

SEQ ID NO: 472750 - RNA, 19 nt, Homo sapiens
gucaugacauuucucaaag

SEQ ID NO: 472751 - RNA, 19 nt, Homo sapiens
guuccaaugugcccaguca

SEQ ID NO: 472752 - RNA, 19 nt, Homo sapiens
uagaagagguagagaaaau

SEQ ID NO: 472753 - RNA, 19 nt, Homo sapiens
accugaagccuaagaaaua

SEQ ID NO: 472754 - RNA, 19 nt, Homo sapiens
uggcaacaguggcugagaa

SEQ ID NO: 472755 - RNA, 19 nt, Homo sapiens
uaagaacugacacaaagga

SEQ ID NO: 472756 - RNA, 19 nt, Homo sapiens
uuuaucccaucucacuuua

SEQ ID NO: 472757 - RNA, 19 nt, Homo sapiens
gacguauugugaaauuugu

SEQ ID NO: 472758 - RNA, 19 nt, Homo sapiens
agaaguuguuagugauuug

SEQ ID NO: 472759 - RNA, 19 nt, Homo sapiens
ccaaugugcccagucauga

SEQ ID NO: 472760 - RNA, 19 nt, Homo sapiens
aaagagcaagugacaaaug

SEQ ID NO: 472761 - RNA, 19 nt, Homo sapiens
gcagaagcagcaggaaaga

SEQ ID NO: 472762 - RNA, 19 nt, Homo sapiens
gaagaaggaggaauuuuag

SEQ ID NO: 472763 - RNA, 19 nt, Homo sapiens
gcucccaguuucuugagau

SEQ ID NO: 472764 - RNA, 19 nt, Homo sapiens
uaauagccauuugaagaag

SEQ ID NO: 472765 - RNA, 19 nt, Homo sapiens
gucuaagaauaaugacgua

SEQ ID NO: 472766 - RNA, 19 nt, Homo sapiens
agucaugacauuucucaaa

SEQ ID NO: 472767 - RNA, 19 nt, Homo sapiens
uggcuucaaucuacgaugu

SEQ ID NO: 472768 - RNA, 19 nt, Homo sapiens
guuccauccuguacaagug

SEQ ID NO: 472769 - RNA, 19 nt, Homo sapiens
caaggaaggguaucaagac

SEQ ID NO: 472770 - RNA, 19 nt, Homo sapiens
caacaguggcugagaagac

SEQ ID NO: 472771 - RNA, 19 nt, Homo sapiens
gguagcagggucuuugugu

SEQ ID NO: 472772 - RNA, 19 nt, Homo sapiens
ggcagaagcagcaggaaag

SEQ ID NO: 472773 - RNA, 19 nt, Homo sapiens
uggcugagaagaccaaaga

SEQ ID NO: 472774 - RNA, 19 nt, Homo sapiens
uuuagaagagguagagaaa

SEQ ID NO: 472775 - RNA, 19 nt, Homo sapiens
ugaaacuaugcaccuauaa

SEQ ID NO: 472776 - RNA, 19 nt, Homo sapiens
ucagaaguuguuagugauu

SEQ ID NO: 472777 - RNA, 19 nt, Homo sapiens
gaagcagcaggaaagacaa

SEQ ID NO: 472778 - RNA, 19 nt, Homo sapiens
uacaagugcucaguuccaa

SEQ ID NO: 472779 - RNA, 19 nt, Homo sapiens
ugagaagaccaaagagcaa

SEQ ID NO: 472780 - RNA, 19 nt, Homo sapiens
agaagcagcaggaaagaca

SEQ ID NO: 472781 - RNA, 19 nt, Homo sapiens
ucaugacauuucucaaagu

SEQ ID NO: 472782 - RNA, 19 nt, Homo sapiens
guacaagugcucaguucca

SEQ ID NO: 472783 - RNA, 19 nt, Homo sapiens
ucaagacuacgaaccugaa

SEQ ID NO: 472784 - RNA, 19 nt, Homo sapiens
gaagaccaaagagcaagug

SEQ ID NO: 472785 - RNA, 19 nt, Homo sapiens
uuucggugcuucccuuuca

SEQ ID NO: 472786 - RNA, 19 nt, Homo sapiens
gcccagucaugacauuucu

SEQ ID NO: 472787 - RNA, 19 nt, Homo sapiens
uguggcugcugcugagaaa

SEQ ID NO: 472788 - RNA, 19 nt, Homo sapiens
gagggagcagggagcauug

SEQ ID NO: 472789 - RNA, 19 nt, Homo sapiens
caaagagcaagugacaaau

SEQ ID NO: 472790 - RNA, 19 nt, Homo sapiens
caugguagcagggucuuug

SEQ ID NO: 472791 - RNA, 19 nt, Homo sapiens
ugaauuaagaacugacaca

SEQ ID NO: 472792 - RNA, 19 nt, Homo sapiens
acuaugcaccuauaaauac

SEQ ID NO: 472793 - RNA, 19 nt, Homo sapiens
gaggguguucucuauguag

SEQ ID NO: 472794 - RNA, 19 nt, Homo sapiens
caugaaacuaugcaccuau

SEQ ID NO: 472795 - RNA, 19 nt, Homo sapiens
ccagucaugacauuucuca

SEQ ID NO: 472796 - RNA, 19 nt, Homo sapiens
cugaagugaauacauggua

SEQ ID NO: 472797 - RNA, 19 nt, Homo sapiens
gcaacaugaauuaagaacu

SEQ ID NO: 472798 - RNA, 19 nt, Homo sapiens
gcaguggugacggguguga

SEQ ID NO: 472799 - RNA, 19 nt, Homo sapiens
uugcuguuguucagaaguu

SEQ ID NO: 472800 - RNA, 19 nt, Homo sapiens
ggugcuucccuuucacuga

SEQ ID NO: 472801 - RNA, 19 nt, Homo sapiens
ggaccaguugggcaaggaa

SEQ ID NO: 472802 - RNA, 19 nt, Homo sapiens
gagccaagaccaaggagaa

SEQ ID NO: 472803 - RNA, 19 nt, Homo sapiens
gaccaaggagaauguugua

SEQ ID NO: 472804 - RNA, 19 nt, Homo sapiens
caccauggaugucuucaag

SEQ ID NO: 472805 - RNA, 19 nt, Homo sapiens
caaggagaauguuguacag

SEQ ID NO: 472806 - RNA, 19 nt, Homo sapiens
gcacacccaccauggaugu

SEQ ID NO: 472807 - RNA, 19 nt, Homo sapiens
cagcguggaugaccugaag

SEQ ID NO: 472808 - RNA, 19 nt, Homo sapiens
ccaaagagaaagaggaagu

SEQ ID NO: 472809 - RNA, 19 nt, Homo sapiens
aaacuugagcccacuccua

SEQ ID NO: 472810 - RNA, 19 nt, Homo sapiens
ccaaggagaauguuguaca

SEQ ID NO: 472811 - RNA, 19 nt, Homo sapiens
cagcugagaagaccaagga

SEQ ID NO: 472812 - RNA, 19 nt, Homo sapiens
ugaccucaguggccgagaa

SEQ ID NO: 472813 - RNA, 19 nt, Homo sapiens
ccaagaccaaggagaaugu

SEQ ID NO: 472814 - RNA, 19 nt, Homo sapiens
ucaacacuguggccaccaa

SEQ ID NO: 472815 - RNA, 19 nt, Homo sapiens
gacggaagcagcugagaag

SEQ ID NO: 472816 - RNA, 19 nt, Homo sapiens
ugacggaagcagcugagaa

SEQ ID NO: 472817 - RNA, 19 nt, Homo sapiens
ggaggaggcggagaacauc

SEQ ID NO: 472818 - RNA, 19 nt, Homo sapiens
caaagagaaagaggaagug

SEQ ID NO: 472819 - RNA, 19 nt, Homo sapiens
ugagcagcgucaacacugu

SEQ ID NO: 472820 - RNA, 19 nt, Homo sapiens
aacuugagcccacuccuaa

SEQ ID NO: 472821 - RNA, 19 nt, Homo sapiens
gcuucuccaucgccaagga

SEQ ID NO: 472822 - RNA, 19 nt, Homo sapiens
ucagagcucuuccucauga

SEQ ID NO: 472823 - RNA, 19 nt, Homo sapiens
uaguguaacuggaaucuuu

SEQ ID NO: 472824 - RNA, 19 nt, Homo sapiens
gaaaaugaccaaaucagua

SEQ ID NO: 472825 - RNA, 19 nt, Homo sapiens
caggagagcugggcacaug

SEQ ID NO: 472826 - RNA, 19 nt, Homo sapiens
gcaaguuugugaccuccaa

SEQ ID NO: 472827 - RNA, 19 nt, Homo sapiens
ccagcagccugaagaagaa

SEQ ID NO: 472828 - RNA, 19 nt, Homo sapiens
gcaagaaugccagcugcua

SEQ ID NO: 472829 - RNA, 19 nt, Homo sapiens
uggcaccucuuucuucuga

SEQ ID NO: 472830 - RNA, 19 nt, Homo sapiens
caaagacuccacaggcaaa

SEQ ID NO: 472831 - RNA, 19 nt, Homo sapiens
ccuccugucucuuuccuuu

SEQ ID NO: 472832 - RNA, 19 nt, Homo sapiens
gccaaccgcuccagcuaug

SEQ ID NO: 472833 - RNA, 19 nt, Homo sapiens
gaaugccagcugcuacuuu

SEQ ID NO: 472834 - RNA, 19 nt, Homo sapiens
gggcaaggacgagcucuuu

SEQ ID NO: 472835 - RNA, 19 nt, Homo sapiens
ggacuucuucuucgaguuc

SEQ ID NO: 472836 - RNA, 19 nt, Homo sapiens
gucaacaucuacaguguca

SEQ ID NO: 472837 - RNA, 19 nt, Homo sapiens
cgacugccguuuccucauc

SEQ ID NO: 472838 - RNA, 19 nt, Homo sapiens
ugccaacccucccugcuaa

SEQ ID NO: 472839 - RNA, 19 nt, Homo sapiens
ggaccugucugccaaucag

SEQ ID NO: 472840 - RNA, 19 nt, Homo sapiens
acucagagcucuuccucau

SEQ ID NO: 472841 - RNA, 19 nt, Homo sapiens
gccagcagccugaagaaga

SEQ ID NO: 472842 - RNA, 19 nt, Homo sapiens
aacuggaaauagcgaaaua

SEQ ID NO: 472843 - RNA, 19 nt, Homo sapiens
auaacaagguggccaucaa

SEQ ID NO: 472844 - RNA, 19 nt, Homo sapiens
uuugugaccuccaagaaga

SEQ ID NO: 472845 - RNA, 19 nt, Homo sapiens
gaucgaccgcgacaccaaa

SEQ ID NO: 472846 - RNA, 19 nt, Homo sapiens
ggcguccaauggcaaguuu

SEQ ID NO: 472847 - RNA, 19 nt, Homo sapiens
aaugccagcugcuacuuug

SEQ ID NO: 472848 - RNA, 19 nt, Homo sapiens
gacugacccuugugguguu

SEQ ID NO: 472849 - RNA, 19 nt, Homo sapiens
gagccuuauuucucuggaa

SEQ ID NO: 472850 - RNA, 19 nt, Homo sapiens
gcgagucuggcaccucuuu

SEQ ID NO: 472851 - RNA, 19 nt, Homo sapiens
cgacacuccuguggacuuc

SEQ ID NO: 472852 - RNA, 19 nt, Homo sapiens
caaacuggaaauagcgaaa

SEQ ID NO: 472853 - RNA, 19 nt, Homo sapiens
cacccuagccugacuggaa

SEQ ID NO: 472854 - RNA, 19 nt, Homo sapiens
gcgccuacaacaucaaaga

SEQ ID NO: 472855 - RNA, 19 nt, Homo sapiens
caacugcggcaacaaguac

SEQ ID NO: 472856 - RNA, 19 nt, Homo sapiens
uagcuucaaacuggaaaua

SEQ ID NO: 472857 - RNA, 19 nt, Homo sapiens
ugaagaagaagcagaucug

SEQ ID NO: 472858 - RNA, 19 nt, Homo sapiens
ucaacugcggcaacaagua

SEQ ID NO: 472859 - RNA, 19 nt, Homo sapiens
acacugagggcguccaaug

SEQ ID NO: 472860 - RNA, 19 nt, Homo sapiens
ucuacagugucacccguaa

SEQ ID NO: 472861 - RNA, 19 nt, Homo sapiens
ggcuaggacugacccuugu

SEQ ID NO: 472862 - RNA, 19 nt, Homo sapiens
uaacaagguggccaucaag

SEQ ID NO: 472863 - RNA, 19 nt, Homo sapiens
guacccacacgggcaagua

SEQ ID NO: 472864 - RNA, 19 nt, Homo sapiens
acccucaggucaacaucua

SEQ ID NO: 472865 - RNA, 19 nt, Homo sapiens
ggcgucgacucgcucauca

SEQ ID NO: 472866 - RNA, 19 nt, Homo sapiens
cuggaaauagcgaaauaaa

SEQ ID NO: 472867 - RNA, 19 nt, Homo sapiens
gcuucaaacuggaaauagc

SEQ ID NO: 472868 - RNA, 19 nt, Homo sapiens
guucugcgacuauaacaag

SEQ ID NO: 472869 - RNA, 19 nt, Homo sapiens
acacuccuguggacuucuu

SEQ ID NO: 472870 - RNA, 19 nt, Homo sapiens
gaaguggagcgugcacauc

SEQ ID NO: 472871 - RNA, 19 nt, Homo sapiens
cugaaggccucggcggaaa

SEQ ID NO: 472872 - RNA, 19 nt, Homo sapiens
gcugcuacuuugacaucga

SEQ ID NO: 472873 - RNA, 19 nt, Homo sapiens
gcgacacuccuguggacuu

SEQ ID NO: 472874 - RNA, 19 nt, Homo sapiens
caucaacugcggcaacaag

SEQ ID NO: 472875 - RNA, 19 nt, Homo sapiens
cuccagcuaugacgucuuc

SEQ ID NO: 472876 - RNA, 19 nt, Homo sapiens
uccaauggcaaguuuguga

SEQ ID NO: 472877 - RNA, 19 nt, Homo sapiens
ggagagcugggcacauguc

SEQ ID NO: 472878 - RNA, 19 nt, Homo sapiens
cagcugcuacuuugacauc

SEQ ID NO: 472879 - RNA, 19 nt, Homo sapiens
gccagcugcuacuuugaca

SEQ ID NO: 472880 - RNA, 19 nt, Homo sapiens
ggagagaguuugaggugua

SEQ ID NO: 472881 - RNA, 19 nt, Homo sapiens
gcagauggcaagaagauug

SEQ ID NO: 472882 - RNA, 19 nt, Homo sapiens
gagaaacugccacaugaaa

SEQ ID NO: 472883 - RNA, 19 nt, Homo sapiens
uggagaaacugccacauga

SEQ ID NO: 472884 - RNA, 19 nt, Homo sapiens
gagagugaauuaugacaca

SEQ ID NO: 472885 - RNA, 19 nt, Homo sapiens
gcuaugccuucaucgagua

SEQ ID NO: 472886 - RNA, 19 nt, Homo sapiens
gaauacacauggucuacag

SEQ ID NO: 472887 - RNA, 19 nt, Homo sapiens
gcacuccgcuuacaaacac

SEQ ID NO: 472888 - RNA, 19 nt, Homo sapiens
gaaaagacgggaaaagauu

SEQ ID NO: 472889 - RNA, 19 nt, Homo sapiens
guacggaccuaucaaaaga

SEQ ID NO: 472890 - RNA, 19 nt, Homo sapiens
agacagagcuuaaaaugug

SEQ ID NO: 472891 - RNA, 19 nt, Homo sapiens
uggcgagagugaauuauga

SEQ ID NO: 472892 - RNA, 19 nt, Homo sapiens
gaaguggagacagagcuua

SEQ ID NO: 472893 - RNA, 19 nt, Homo sapiens
gagacaugcacuccgcuua

SEQ ID NO: 472894 - RNA, 19 nt, Homo sapiens
ggagaaacugccacaugaa

SEQ ID NO: 472895 - RNA, 19 nt, Homo sapiens
ggagaauggguauuugaug

SEQ ID NO: 472896 - RNA, 19 nt, Homo sapiens
ugaauuaugacacaacaga

SEQ ID NO: 472897 - RNA, 19 nt, Homo sapiens
caacgacagccgagacaug

SEQ ID NO: 472898 - RNA, 19 nt, Homo sapiens
acacgcagauggcaagaag

SEQ ID NO: 472899 - RNA, 19 nt, Homo sapiens
acaguaagcggucaggaaa

SEQ ID NO: 472900 - RNA, 19 nt, Homo sapiens
gaauuaugacacaacagaa

SEQ ID NO: 472901 - RNA, 19 nt, Homo sapiens
gccguacauucgagaguuu

SEQ ID NO: 472902 - RNA, 19 nt, Homo sapiens
aauccaagcuccggagaga

SEQ ID NO: 472903 - RNA, 19 nt, Homo sapiens
gacaugcacuccgcuuaca

SEQ ID NO: 472904 - RNA, 19 nt, Homo sapiens
uacacauggucuacaguaa

SEQ ID NO: 472905 - RNA, 19 nt, Homo sapiens
acaccacaaucaaccuuau

SEQ ID NO: 472906 - RNA, 19 nt, Homo sapiens
agcaagaaguggagacaga

SEQ ID NO: 472907 - RNA, 19 nt, Homo sapiens
gguguacggaccuaucaaa

SEQ ID NO: 472908 - RNA, 19 nt, Homo sapiens
ggagacagagcuuaaaaug

SEQ ID NO: 472909 - RNA, 19 nt, Homo sapiens
ggaaaagacgggaaaagau

SEQ ID NO: 472910 - RNA, 19 nt, Homo sapiens
cuaccuggcuccggagaau

SEQ ID NO: 472911 - RNA, 19 nt, Homo sapiens
ucacaaugaucccaaugcu

SEQ ID NO: 472912 - RNA, 19 nt, Homo sapiens
gugggacccucacaaugau

SEQ ID NO: 472913 - RNA, 19 nt, Homo sapiens
cccgugacccuauuccaua

SEQ ID NO: 472914 - RNA, 19 nt, Homo sapiens
auacacauggucuacagua

SEQ ID NO: 472915 - RNA, 19 nt, Homo sapiens
gggaugccuucaagacucu

SEQ ID NO: 472916 - RNA, 19 nt, Homo sapiens
gcauugcgccguacauucg

SEQ ID NO: 472917 - RNA, 19 nt, Homo sapiens
caaccuuauuguggcauug

SEQ ID NO: 472918 - RNA, 19 nt, Homo sapiens
cagauggcaagaagauuga

SEQ ID NO: 472919 - RNA, 19 nt, Homo sapiens
aaagaauacacauggucua

SEQ ID NO: 472920 - RNA, 19 nt, Homo sapiens
gagagaguuugagguguac

SEQ ID NO: 472921 - RNA, 19 nt, Homo sapiens
caugcacuccgcuuacaaa

SEQ ID NO: 472922 - RNA, 19 nt, Homo sapiens
ugacaccucccgcuacgau

SEQ ID NO: 472923 - RNA, 19 nt, Homo sapiens
ucaaccuuauuguggcauu

SEQ ID NO: 472924 - RNA, 19 nt, Homo sapiens
cgaacacgagcgagacaug

SEQ ID NO: 472925 - RNA, 19 nt, Homo sapiens
gagcggcgacagcaagaag

SEQ ID NO: 472926 - RNA, 19 nt, Homo sapiens
uacaguaagcggucaggaa

SEQ ID NO: 472927 - RNA, 19 nt, Homo sapiens
cgccguacauucgagaguu

SEQ ID NO: 472928 - RNA, 19 nt, Homo sapiens
aaacaccacaaucaaccuu

SEQ ID NO: 472929 - RNA, 19 nt, Homo sapiens
cgacagccgagacauguac

SEQ ID NO: 472930 - RNA, 19 nt, Homo sapiens
ccucggugguaccagaaga

SEQ ID NO: 472931 - RNA, 19 nt, Homo sapiens
cacauggucuacaguaagc

SEQ ID NO: 472932 - RNA, 19 nt, Homo sapiens
agacuuaccucaacacuuc

SEQ ID NO: 472933 - RNA, 19 nt, Homo sapiens
ucacggagccugaagauga

SEQ ID NO: 472934 - RNA, 19 nt, Homo sapiens
gcccuaaccacacuauuua

SEQ ID NO: 472935 - RNA, 19 nt, Homo sapiens
gccaagaaguagcaccuuu

SEQ ID NO: 472936 - RNA, 19 nt, Homo sapiens
gcuuuaagaucacgcagaa

SEQ ID NO: 472937 - RNA, 19 nt, Homo sapiens
gaacaacgccaugaagauc

SEQ ID NO: 472938 - RNA, 19 nt, Homo sapiens
ucaaugagaagaucaagaa

SEQ ID NO: 472939 - RNA, 19 nt, Homo sapiens
cugcagggcuuuaagauca

SEQ ID NO: 472940 - RNA, 19 nt, Homo sapiens
gccaagaccgacucagaua

SEQ ID NO: 472941 - RNA, 19 nt, Homo sapiens
gaucaagaaggaugagcua

SEQ ID NO: 472942 - RNA, 19 nt, Homo sapiens
gagaagaggaagcccaaga

SEQ ID NO: 472943 - RNA, 19 nt, Homo sapiens
caagaaggaugagcuaaaa

SEQ ID NO: 472944 - RNA, 19 nt, Homo sapiens
ggagaaacccagggcuaaa

SEQ ID NO: 472945 - RNA, 19 nt, Homo sapiens
ucaagaaggaugagcuaaa

SEQ ID NO: 472946 - RNA, 19 nt, Homo sapiens
ggaguuugacaaugaggua

SEQ ID NO: 472947 - RNA, 19 nt, Homo sapiens
gcuguuaggccggaauuaa

SEQ ID NO: 472948 - RNA, 19 nt, Homo sapiens
ccuaaccacacuauuuaua

SEQ ID NO: 472949 - RNA, 19 nt, Homo sapiens
gaccgacucagauaucauu

SEQ ID NO: 472950 - RNA, 19 nt, Homo sapiens
caaggagguccgucuggua

SEQ ID NO: 472951 - RNA, 19 nt, Homo sapiens
gagaauccaccgaaucaca

SEQ ID NO: 472952 - RNA, 19 nt, Homo sapiens
ccaugaagaucuccuuugc

SEQ ID NO: 472953 - RNA, 19 nt, Homo sapiens
ucguggaguuugacaauga

SEQ ID NO: 472954 - RNA, 19 nt, Homo sapiens
augagaagaucaagaagga

SEQ ID NO: 472955 - RNA, 19 nt, Homo sapiens
ccucaacacuucacuccau

SEQ ID NO: 472956 - RNA, 19 nt, Homo sapiens
cagaacaacgccaugaaga

SEQ ID NO: 472957 - RNA, 19 nt, Homo sapiens
gcagaacaacgccaugaag

SEQ ID NO: 472958 - RNA, 19 nt, Homo sapiens
ucaguucccuggcuucaag

SEQ ID NO: 472959 - RNA, 19 nt, Homo sapiens
gcaagcgggagaagaggaa

SEQ ID NO: 472960 - RNA, 19 nt, Homo sapiens
cagauaucauugccaagau

SEQ ID NO: 472961 - RNA, 19 nt, Homo sapiens
caagaccgacucagauauc

SEQ ID NO: 472962 - RNA, 19 nt, Homo sapiens
ucagauaucauugccaaga

SEQ ID NO: 472963 - RNA, 19 nt, Homo sapiens
cagccgacguugggacaaa

SEQ ID NO: 472964 - RNA, 19 nt, Homo sapiens
gaucuccuuugccaagaag

SEQ ID NO: 472965 - RNA, 19 nt, Homo sapiens
caccgaaucacaucuuguu

SEQ ID NO: 472966 - RNA, 19 nt, Homo sapiens
ccaagaccgacucagauau

SEQ ID NO: 472967 - RNA, 19 nt, Homo sapiens
gagaaacccagggcuaaag

SEQ ID NO: 472968 - RNA, 19 nt, Homo sapiens
agauaucauugccaagaug

SEQ ID NO: 472969 - RNA, 19 nt, Homo sapiens
cgcccuaaccacacuauuu

SEQ ID NO: 472970 - RNA, 19 nt, Homo sapiens
gccaucuucucccaguuug

SEQ ID NO: 472971 - RNA, 19 nt, Homo sapiens
cauugcaccuggcgcuguu

SEQ ID NO: 472972 - RNA, 19 nt, Homo sapiens
cgaaucacaucuuguuccu

SEQ ID NO: 472973 - RNA, 19 nt, Homo sapiens
ccaggccuuugucaucuuc

SEQ ID NO: 472974 - RNA, 19 nt, Homo sapiens
gccaugaagaucuccuuug

SEQ ID NO: 472975 - RNA, 19 nt, Homo sapiens
ccacacuauuuauaucaac

SEQ ID NO: 472976 - RNA, 19 nt, Homo sapiens
cugagaauccaccgaauca

SEQ ID NO: 472977 - RNA, 19 nt, Homo sapiens
uggagaaacccagggcuaa

SEQ ID NO: 472978 - RNA, 19 nt, Homo sapiens
gacguugggacaaaggauu

SEQ ID NO: 472979 - RNA, 19 nt, Homo sapiens
agaacaacgccaugaagau

SEQ ID NO: 472980 - RNA, 19 nt, Homo sapiens
ggcaugacaucgccuucgu

SEQ ID NO: 472981 - RNA, 19 nt, Homo sapiens
gcuuaugccaggacagaug

SEQ ID NO: 472982 - RNA, 19 nt, Homo sapiens
gccaggccuuugucaucuu

SEQ ID NO: 472983 - RNA, 19 nt, Homo sapiens
aaacccagggcuaaaguca

SEQ ID NO: 472984 - RNA, 19 nt, Homo sapiens
gaaacccagggcuaaaguc

SEQ ID NO: 472985 - RNA, 19 nt, Homo sapiens
ggagaccaacgagcucaug

SEQ ID NO: 472986 - RNA, 19 nt, Homo sapiens
ggguuucccuuucuaugac

SEQ ID NO: 472987 - RNA, 19 nt, Homo sapiens
cagcuuaugccaggacaga

SEQ ID NO: 472988 - RNA, 19 nt, Homo sapiens
uauaucaacaaccucaaug

SEQ ID NO: 472989 - RNA, 19 nt, Homo sapiens
cugcccagccucuuucuga

SEQ ID NO: 472990 - RNA, 19 nt, Homo sapiens
gaaauccgguaaccaauaa

SEQ ID NO: 472991 - RNA, 19 nt, Homo sapiens
ugaggcagauguauaauaa

SEQ ID NO: 472992 - RNA, 19 nt, Homo sapiens
gaacucauucucaccaaua

SEQ ID NO: 472993 - RNA, 19 nt, Homo sapiens
uaagaagcauuacagauug

SEQ ID NO: 472994 - RNA, 19 nt, Homo sapiens
aaaucuaggugcuacguua

SEQ ID NO: 472995 - RNA, 19 nt, Homo sapiens
gcagugaggcagauguaua

SEQ ID NO: 472996 - RNA, 19 nt, Homo sapiens
caacagaauaugccguaua

SEQ ID NO: 472997 - RNA, 19 nt, Homo sapiens
uaagaaauccgguaaccaa

SEQ ID NO: 472998 - RNA, 19 nt, Homo sapiens
ucagaucccuggcagagaa

SEQ ID NO: 472999 - RNA, 19 nt, Homo sapiens
cuaaguauccuaagaaauc

SEQ ID NO: 473000 - RNA, 19 nt, Homo sapiens
gcacagcuugcaaaggaua

SEQ ID NO: 473001 - RNA, 19 nt, Homo sapiens
ucaaaucgcugacuuaccu

SEQ ID NO: 473002 - RNA, 19 nt, Homo sapiens
gaacaacaacagaauaugc

SEQ ID NO: 473003 - RNA, 19 nt, Homo sapiens
gcagauguauaauaauagg

SEQ ID NO: 473004 - RNA, 19 nt, Homo sapiens
auaauagccuuguuugugu

SEQ ID NO: 473005 - RNA, 19 nt, Homo sapiens
caauaauagucucguggaa

SEQ ID NO: 473006 - RNA, 19 nt, Homo sapiens
ucaagaaugccauagcaaa

SEQ ID NO: 473007 - RNA, 19 nt, Homo sapiens
agaaauccgguaaccaaua

SEQ ID NO: 473008 - RNA, 19 nt, Homo sapiens
uauaauagccuuguuugug

SEQ ID NO: 473009 - RNA, 19 nt, Homo sapiens
gagcagugaggcagaugua

SEQ ID NO: 473010 - RNA, 19 nt, Homo sapiens
caagaaugccauagcaaau

SEQ ID NO: 473011 - RNA, 19 nt, Homo sapiens
ugagaagacugaaaacauu

SEQ ID NO: 473012 - RNA, 19 nt, Homo sapiens
uuaccuaaguauccuaaga

SEQ ID NO: 473013 - RNA, 19 nt, Homo sapiens
gugaggcagauguauaaua

SEQ ID NO: 473014 - RNA, 19 nt, Homo sapiens
cagugaggcagauguauaa

SEQ ID NO: 473015 - RNA, 19 nt, Homo sapiens
uagaagcaaucaagaaugc

SEQ ID NO: 473016 - RNA, 19 nt, Homo sapiens
uuagcaaaguggaaucuau

SEQ ID NO: 473017 - RNA, 19 nt, Homo sapiens
aacagaauaugccguauag

SEQ ID NO: 473018 - RNA, 19 nt, Homo sapiens
aaagagaggugggccaucu

SEQ ID NO: 473019 - RNA, 19 nt, Homo sapiens
caagucagaguacuggauu

SEQ ID NO: 473020 - RNA, 19 nt, Homo sapiens
gugaacaacaacagaauau

SEQ ID NO: 473021 - RNA, 19 nt, Homo sapiens
acaaugagaucaggaaacu

SEQ ID NO: 473022 - RNA, 19 nt, Homo sapiens
uaauagccuuguuuguguu

SEQ ID NO: 473023 - RNA, 19 nt, Homo sapiens
uccagaaagugaaacuaaa

SEQ ID NO: 473024 - RNA, 19 nt, Homo sapiens
ccaguuugaugcuauugau

SEQ ID NO: 473025 - RNA, 19 nt, Homo sapiens
aaaauaaacuccacucucu

SEQ ID NO: 473026 - RNA, 19 nt, Homo sapiens
aaucaagaaugccauagca

SEQ ID NO: 473027 - RNA, 19 nt, Homo sapiens
aauaauaggcccucuugga

SEQ ID NO: 473028 - RNA, 19 nt, Homo sapiens
guagaagcaaucaagaaug

SEQ ID NO: 473029 - RNA, 19 nt, Homo sapiens
gugcugguuugccaacuga

SEQ ID NO: 473030 - RNA, 19 nt, Homo sapiens
cagaauaugccguauaggu

SEQ ID NO: 473031 - RNA, 19 nt, Homo sapiens
acuccacucucuaugcuaa

SEQ ID NO: 473032 - RNA, 19 nt, Homo sapiens
gcuuaagacugcugcugau

SEQ ID NO: 473033 - RNA, 19 nt, Homo sapiens
auaauaggcccucuuggaa

SEQ ID NO: 473034 - RNA, 19 nt, Homo sapiens
ggauguagaagcaaucaag

SEQ ID NO: 473035 - RNA, 19 nt, Homo sapiens
caauaagaagcauuacaga

SEQ ID NO: 473036 - RNA, 19 nt, Homo sapiens
aauaggcccucuuggaaca

SEQ ID NO: 473037 - RNA, 19 nt, Homo sapiens
gugaagaagagauggaaga

SEQ ID NO: 473038 - RNA, 19 nt, Homo sapiens
gauauugccaggagaagca

SEQ ID NO: 473039 - RNA, 19 nt, Homo sapiens
ccaauaagaagcauuacag

SEQ ID NO: 473040 - RNA, 19 nt, Homo sapiens
guauaaaauucccgucauu

SEQ ID NO: 473041 - RNA, 19 nt, Homo sapiens
aauaaacuccacucucuau

SEQ ID NO: 473042 - RNA, 19 nt, Homo sapiens
ccucuggcaucucucaaau

SEQ ID NO: 473043 - RNA, 19 nt, Homo sapiens
gauguagaagcaaucaaga

SEQ ID NO: 473044 - RNA, 19 nt, Homo sapiens
gcaagucagaguacuggau

SEQ ID NO: 473045 - RNA, 19 nt, Homo sapiens
uaaaguuccgcaagucaga

SEQ ID NO: 473046 - RNA, 19 nt, Homo sapiens
gugcuacguuagaccaguu

SEQ ID NO: 473047 - RNA, 19 nt, Homo sapiens
cucauucucaccaauaaua

SEQ ID NO: 473048 - RNA, 19 nt, Homo sapiens
uagaccaguuugaugcuau

SEQ ID NO: 473049 - RNA, 19 nt, Homo sapiens
auaauagucucguggaacu

SEQ ID NO: 473050 - RNA, 19 nt, Homo sapiens
aaacuccacucucuaugcu

SEQ ID NO: 473051 - RNA, 19 nt, Homo sapiens
aaauaaacuccacucucua

SEQ ID NO: 473052 - RNA, 19 nt, Homo sapiens
agaccaguuugaugcuauu

SEQ ID NO: 473053 - RNA, 19 nt, Homo sapiens
gcccacugaugauggugaa

SEQ ID NO: 473054 - RNA, 19 nt, Homo sapiens
uuuauaaaguuccgcaagu

SEQ ID NO: 473055 - RNA, 19 nt, Homo sapiens
auaauaauaggcccucuug

SEQ ID NO: 473056 - RNA, 19 nt, Homo sapiens
uguagaagcaaucaagaau

SEQ ID NO: 473057 - RNA, 19 nt, Homo sapiens
aagaagcauuacagauugu

SEQ ID NO: 473058 - RNA, 19 nt, Homo sapiens
uaccuaaguauccuaagaa

SEQ ID NO: 473059 - RNA, 19 nt, Homo sapiens
ucucucaaaucgcugacuu

SEQ ID NO: 473060 - RNA, 19 nt, Homo sapiens
agaaugccauagcaaaugc

SEQ ID NO: 473061 - RNA, 19 nt, Homo sapiens
cacugaugauggugaagaa

SEQ ID NO: 473062 - RNA, 19 nt, Homo sapiens
ccacugaugauggugaaga

SEQ ID NO: 473063 - RNA, 19 nt, Homo sapiens
guauaauagccuuguuugu

SEQ ID NO: 473064 - RNA, 19 nt, Homo sapiens
uuagaccaguuugaugcua

SEQ ID NO: 473065 - RNA, 19 nt, Homo sapiens
ugacaaugagaucaggaaa

SEQ ID NO: 473066 - RNA, 19 nt, Homo sapiens
uuccagaaagugaaacuaa

SEQ ID NO: 473067 - RNA, 19 nt, Homo sapiens
uauaaaguuccgcaaguca

SEQ ID NO: 473068 - RNA, 19 nt, Homo sapiens
uaaaauucccgucauugaa

SEQ ID NO: 473069 - RNA, 19 nt, Homo sapiens
uuauaaaguuccgcaaguc

SEQ ID NO: 473070 - RNA, 19 nt, Homo sapiens
uuagugaacaacaacagaa

SEQ ID NO: 473071 - RNA, 19 nt, Homo sapiens
ccguauaggugagggacuu

SEQ ID NO: 473072 - RNA, 19 nt, Homo sapiens
aacucauucucaccaauaa

SEQ ID NO: 473073 - RNA, 19 nt, Homo sapiens
uagcaaaguggaaucuauc

SEQ ID NO: 473074 - RNA, 19 nt, Homo sapiens
agugaacaacaacagaaua

SEQ ID NO: 473075 - RNA, 19 nt, Homo sapiens
aagaaugccauagcaaaug

SEQ ID NO: 473076 - RNA, 19 nt, Homo sapiens
ggugcugguuugccaacug

SEQ ID NO: 473077 - RNA, 19 nt, Homo sapiens
ucuggcaucucucaaaucg

SEQ ID NO: 473078 - RNA, 19 nt, Homo sapiens
uaaacuccacucucuaugc

SEQ ID NO: 473079 - RNA, 19 nt, Homo sapiens
ugaugauggugaagaagag

SEQ ID NO: 473080 - RNA, 19 nt, Homo sapiens
aaaauucccgucauugaaa

SEQ ID NO: 473081 - RNA, 19 nt, Homo sapiens
ccagaaagugaaacuaaaa

SEQ ID NO: 473082 - RNA, 19 nt, Homo sapiens
accuaaguauccuaagaaa

SEQ ID NO: 473083 - RNA, 19 nt, Homo sapiens
aauagccuuguuuguguua

SEQ ID NO: 473084 - RNA, 19 nt, Homo sapiens
caaacggggugcacagcuu

SEQ ID NO: 473085 - RNA, 19 nt, Homo sapiens
gaaagugaaacuaaaagag

SEQ ID NO: 473086 - RNA, 19 nt, Homo sapiens
guuagugaacaacaacaga

SEQ ID NO: 473087 - RNA, 19 nt, Homo sapiens
ccaaagaacuccaaacaag

SEQ ID NO: 473088 - RNA, 19 nt, Homo sapiens
ucagaaagaucaagccaaa

SEQ ID NO: 473089 - RNA, 19 nt, Homo sapiens
ugaauuugauccucuguga

SEQ ID NO: 473090 - RNA, 19 nt, Homo sapiens
caaggaagagguacuguug

SEQ ID NO: 473091 - RNA, 19 nt, Homo sapiens
gacaagcacaugaauuuga

SEQ ID NO: 473092 - RNA, 19 nt, Homo sapiens
gaaagaucaagccaaagaa

SEQ ID NO: 473093 - RNA, 19 nt, Homo sapiens
gaugcgaggccuucuuuga

SEQ ID NO: 473094 - RNA, 19 nt, Homo sapiens
gguaugagaccuccuaugg

SEQ ID NO: 473095 - RNA, 19 nt, Homo sapiens
ggaccuccucccaaagaua

SEQ ID NO: 473096 - RNA, 19 nt, Homo sapiens
agaaagaucaagccaaaga

SEQ ID NO: 473097 - RNA, 19 nt, Homo sapiens
gaacuccaaacaagcagaa

SEQ ID NO: 473098 - RNA, 19 nt, Homo sapiens
cauauugauuacaggauga

SEQ ID NO: 473099 - RNA, 19 nt, Homo sapiens
ugugaugaguucagaaaga

SEQ ID NO: 473100 - RNA, 19 nt, Homo sapiens
ggaagagggacuccaaugg

SEQ ID NO: 473101 - RNA, 19 nt, Homo sapiens
gggaugcgaggccuucuuu

SEQ ID NO: 473102 - RNA, 19 nt, Homo sapiens
acaagcacaugaauuugau

SEQ ID NO: 473103 - RNA, 19 nt, Homo sapiens
gugaugaguucagaaagau

SEQ ID NO: 473104 - RNA, 19 nt, Homo sapiens
uugacaagcacaugaauuu

SEQ ID NO: 473105 - RNA, 19 nt, Homo sapiens
gaugaguucagaaagauca

SEQ ID NO: 473106 - RNA, 19 nt, Homo sapiens
ugacugugaugaguucaga

SEQ ID NO: 473107 - RNA, 19 nt, Homo sapiens
gccaaagaacuccaaacaa

SEQ ID NO: 473108 - RNA, 19 nt, Homo sapiens
gauccucugugacugugau

SEQ ID NO: 473109 - RNA, 19 nt, Homo sapiens
aaagaacuccaaacaagca

SEQ ID NO: 473110 - RNA, 19 nt, Homo sapiens
aagcagaaagggaagagaa

SEQ ID NO: 473111 - RNA, 19 nt, Homo sapiens
aggaagagguacuguugca

SEQ ID NO: 473112 - RNA, 19 nt, Homo sapiens
gaaucuggucucaaugaca

SEQ ID NO: 473113 - RNA, 19 nt, Homo sapiens
gggcaagagcagcaagaug

SEQ ID NO: 473114 - RNA, 19 nt, Homo sapiens
ugacaagcacaugaauuug

SEQ ID NO: 473115 - RNA, 19 nt, Homo sapiens
acaaggaagagguacuguu

SEQ ID NO: 473116 - RNA, 19 nt, Homo sapiens
ccacaaggaagagguacug

SEQ ID NO: 473117 - RNA, 19 nt, Homo sapiens
gaccuccucccaaagauac

SEQ ID NO: 473118 - RNA, 19 nt, Homo sapiens
gaacugggcucauccacaa

SEQ ID NO: 473119 - RNA, 19 nt, Homo sapiens
gauaucagaccaaaucaua

SEQ ID NO: 473120 - RNA, 19 nt, Homo sapiens
gaucaccuaugccaagaaa

SEQ ID NO: 473121 - RNA, 19 nt, Homo sapiens
ccagggaacuccaaauuca

SEQ ID NO: 473122 - RNA, 19 nt, Homo sapiens
gcaggccuuugucauauuu

SEQ ID NO: 473123 - RNA, 19 nt, Homo sapiens
cuaaugagaugauguuauc

SEQ ID NO: 473124 - RNA, 19 nt, Homo sapiens
uuacagggauuuaagauca

SEQ ID NO: 473125 - RNA, 19 nt, Homo sapiens
gugaaggacuuaaauuauc

SEQ ID NO: 473126 - RNA, 19 nt, Homo sapiens
ugagacagcuacaaggauu

SEQ ID NO: 473127 - RNA, 19 nt, Homo sapiens
gaaauacgaaggccuuaau

SEQ ID NO: 473128 - RNA, 19 nt, Homo sapiens
ucaccuaugccaagaaaua

SEQ ID NO: 473129 - RNA, 19 nt, Homo sapiens
gguguuauuuacaguguuu

SEQ ID NO: 473130 - RNA, 19 nt, Homo sapiens
gggcaggccuuugucauau

SEQ ID NO: 473131 - RNA, 19 nt, Homo sapiens
caaggaaauucaacaccaa

SEQ ID NO: 473132 - RNA, 19 nt, Homo sapiens
gcuaauacccaaggaaauu

SEQ ID NO: 473133 - RNA, 19 nt, Homo sapiens
uuaaagaccaugaagauga

SEQ ID NO: 473134 - RNA, 19 nt, Homo sapiens
cuuaauaacuuaccagaag

SEQ ID NO: 473135 - RNA, 19 nt, Homo sapiens
gaacuccaaauucagcuaa

SEQ ID NO: 473136 - RNA, 19 nt, Homo sapiens
ggugaacuaugaaauacga

SEQ ID NO: 473137 - RNA, 19 nt, Homo sapiens
cuacaaggauuuccauuuu

SEQ ID NO: 473138 - RNA, 19 nt, Homo sapiens
gcuacaaggauuuccauuu

SEQ ID NO: 473139 - RNA, 19 nt, Homo sapiens
uugaagagaucccuauaug

SEQ ID NO: 473140 - RNA, 19 nt, Homo sapiens
uauccaugcuguuuaauca

SEQ ID NO: 473141 - RNA, 19 nt, Homo sapiens
ugauuacccuccaaacuau

SEQ ID NO: 473142 - RNA, 19 nt, Homo sapiens
cagaccaaaucauacaauu

SEQ ID NO: 473143 - RNA, 19 nt, Homo sapiens
gauguuauccaugcuguuu

SEQ ID NO: 473144 - RNA, 19 nt, Homo sapiens
agaagagacuaaugagaug

SEQ ID NO: 473145 - RNA, 19 nt, Homo sapiens
cagaagagacuaaugagau

SEQ ID NO: 473146 - RNA, 19 nt, Homo sapiens
caaggaaguacgucuggua

SEQ ID NO: 473147 - RNA, 19 nt, Homo sapiens
acauuuggcugggucauuu

SEQ ID NO: 473148 - RNA, 19 nt, Homo sapiens
ccacaaaugccuugagaca

SEQ ID NO: 473149 - RNA, 19 nt, Homo sapiens
gaacagacugcaacaacca

SEQ ID NO: 473150 - RNA, 19 nt, Homo sapiens
uaaagaccaugaagaugag

SEQ ID NO: 473151 - RNA, 19 nt, Homo sapiens
gaauugaagagaucccuau

SEQ ID NO: 473152 - RNA, 19 nt, Homo sapiens
ugacauugcuuuuguugaa

SEQ ID NO: 473153 - RNA, 19 nt, Homo sapiens
ggaaauucaacaccaaauc

SEQ ID NO: 473154 - RNA, 19 nt, Homo sapiens
uagccuuggugaacuauga

SEQ ID NO: 473155 - RNA, 19 nt, Homo sapiens
uguuauccaugcuguuuaa

SEQ ID NO: 473156 - RNA, 19 nt, Homo sapiens
acacaaacauggauaucag

SEQ ID NO: 473157 - RNA, 19 nt, Homo sapiens
ggaggcaugacauugcuuu

SEQ ID NO: 473158 - RNA, 19 nt, Homo sapiens
gaagagacuaaugagauga

SEQ ID NO: 473159 - RNA, 19 nt, Homo sapiens
cugauuacccuccaaacua

SEQ ID NO: 473160 - RNA, 19 nt, Homo sapiens
cagcuaauacccaaggaaa

SEQ ID NO: 473161 - RNA, 19 nt, Homo sapiens
ggccagggaacuccaaauu

SEQ ID NO: 473162 - RNA, 19 nt, Homo sapiens
guaaaccaaugcgaauaca

SEQ ID NO: 473163 - RNA, 19 nt, Homo sapiens
ccugaagaauuuaacacaa

SEQ ID NO: 473164 - RNA, 19 nt, Homo sapiens
cuaugaagaucaccuaugc

SEQ ID NO: 473165 - RNA, 19 nt, Homo sapiens
ucaguucccuggcuucaag

SEQ ID NO: 473166 - RNA, 19 nt, Homo sapiens
uaccagaagagacuaauga

SEQ ID NO: 473167 - RNA, 19 nt, Homo sapiens
ggcaggccuuugucauauu

SEQ ID NO: 473168 - RNA, 19 nt, Homo sapiens
ggacauuguggcuuuaaag

SEQ ID NO: 473169 - RNA, 19 nt, Homo sapiens
gguggacauuguggcuuua

SEQ ID NO: 473170 - RNA, 19 nt, Homo sapiens
gagaugaggaggaguaaaa

SEQ ID NO: 473171 - RNA, 19 nt, Homo sapiens
uuaaggaacugggcucauc

SEQ ID NO: 473172 - RNA, 19 nt, Homo sapiens
uaacuuaccagaagagacu

SEQ ID NO: 473173 - RNA, 19 nt, Homo sapiens
gaaauucaacaccaaaucc

SEQ ID NO: 473174 - RNA, 19 nt, Homo sapiens
gcaacaaccacaaacaaaa

SEQ ID NO: 473175 - RNA, 19 nt, Homo sapiens
gacauuguggcuuuaaaga

SEQ ID NO: 473176 - RNA, 19 nt, Homo sapiens
gaagcgcgaagcugggauu

SEQ ID NO: 473177 - RNA, 19 nt, Homo sapiens
gagcugccagggaugcuuu

SEQ ID NO: 473178 - RNA, 19 nt, Homo sapiens
aauacgaaggccuuaauuu

SEQ ID NO: 473179 - RNA, 19 nt, Homo sapiens
uuagagaugaggaggagua

SEQ ID NO: 473180 - RNA, 19 nt, Homo sapiens
ugggauagucgucuuuaaa

SEQ ID NO: 473181 - RNA, 19 nt, Homo sapiens
gggaugcuuuacagggauu

SEQ ID NO: 473182 - RNA, 19 nt, Homo sapiens
acuccaaauucagcuaaua

SEQ ID NO: 473183 - RNA, 19 nt, Homo sapiens
guagucggcguaggccuua

SEQ ID NO: 473184 - RNA, 19 nt, Homo sapiens
agacuaaugagaugauguu

SEQ ID NO: 473185 - RNA, 19 nt, Homo sapiens
aggaagaauugaagagauc

SEQ ID NO: 473186 - RNA, 19 nt, Homo sapiens
cuuggugaacuaugaaaua

SEQ ID NO: 473187 - RNA, 19 nt, Homo sapiens
ccagaagagacuaaugaga

SEQ ID NO: 473188 - RNA, 19 nt, Homo sapiens
aaggaagaauugaagagau

SEQ ID NO: 473189 - RNA, 19 nt, Homo sapiens
gguaaaccaaugcgaauac

SEQ ID NO: 473190 - RNA, 19 nt, Homo sapiens
gcuaugaagaucaccuaug

SEQ ID NO: 473191 - RNA, 19 nt, Homo sapiens
aaaggaagaauugaagaga

SEQ ID NO: 473192 - RNA, 19 nt, Homo sapiens
gacuuaaauuauccagugu

SEQ ID NO: 473193 - RNA, 19 nt, Homo sapiens
ugaaggacuuaaauuaucc

SEQ ID NO: 473194 - RNA, 19 nt, Homo sapiens
uaucagaccaaaucauaca

SEQ ID NO: 473195 - RNA, 19 nt, Homo sapiens
ggaacuccaaauucagcua

SEQ ID NO: 473196 - RNA, 19 nt, Homo sapiens
gagacagcuacaaggauuu

SEQ ID NO: 473197 - RNA, 19 nt, Homo sapiens
ugguggacauuguggcuuu

SEQ ID NO: 473198 - RNA, 19 nt, Homo sapiens
gauuacccuccaaacuaua

SEQ ID NO: 473199 - RNA, 19 nt, Homo sapiens
ugaaauacgaaggccuuaa

SEQ ID NO: 473200 - RNA, 19 nt, Homo sapiens
acauggauaucagaccaaa

SEQ ID NO: 473201 - RNA, 19 nt, Homo sapiens
aaaccaaugcgaauacagu

SEQ ID NO: 473202 - RNA, 19 nt, Homo sapiens
caccuaugccaagaaauaa

SEQ ID NO: 473203 - RNA, 19 nt, Homo sapiens
gccagggaacuccaaauuc

SEQ ID NO: 473204 - RNA, 19 nt, Homo sapiens
gggauagucgucuuuaaaa

SEQ ID NO: 473205 - RNA, 19 nt, Homo sapiens
aaauacgaaggccuuaauu

SEQ ID NO: 473206 - RNA, 19 nt, Homo sapiens
uggcuccguuuccugcuuu

SEQ ID NO: 473207 - RNA, 19 nt, Homo sapiens
ccagggaggcaugacauug

SEQ ID NO: 473208 - RNA, 19 nt, Homo sapiens
uauaugcccuguuuucuca

SEQ ID NO: 473209 - RNA, 19 nt, Homo sapiens
aggccuuugucauauuuaa

SEQ ID NO: 473210 - RNA, 19 nt, Homo sapiens
aagaucaccuaugccaaga

SEQ ID NO: 473211 - RNA, 19 nt, Homo sapiens
ugcaacaaccacaaacaaa

SEQ ID NO: 473212 - RNA, 19 nt, Homo sapiens
agacugcaacaaccacaaa

SEQ ID NO: 473213 - RNA, 19 nt, Homo sapiens
gcuuuaaagaccaugaaga

SEQ ID NO: 473214 - RNA, 19 nt, Homo sapiens
cgaaggccuuaauuuugua

SEQ ID NO: 473215 - RNA, 19 nt, Homo sapiens
auacgaaggccuuaauuuu

SEQ ID NO: 473216 - RNA, 19 nt, Homo sapiens
uaacacaaacauggauauc

SEQ ID NO: 473217 - RNA, 19 nt, Homo sapiens
gacuugguguuauuuacag

SEQ ID NO: 473218 - RNA, 19 nt, Homo sapiens
auacauaccucacccauga

SEQ ID NO: 473219 - RNA, 19 nt, Homo sapiens
gaaggaaacacaaagagaa

SEQ ID NO: 473220 - RNA, 19 nt, Homo sapiens
uauauuaccuguucugcuu

SEQ ID NO: 473221 - RNA, 19 nt, Homo sapiens
gugaaagacuauuaucaga

SEQ ID NO: 473222 - RNA, 19 nt, Homo sapiens
acaaagagaaugugaaaga

SEQ ID NO: 473223 - RNA, 19 nt, Homo sapiens
ggaaagauaccuccuacuc

SEQ ID NO: 473224 - RNA, 19 nt, Homo sapiens
aagagaaugugaaagacua

SEQ ID NO: 473225 - RNA, 19 nt, Homo sapiens
ggaaggaaacacaaagaga

SEQ ID NO: 473226 - RNA, 19 nt, Homo sapiens
cuaaacagcauaaggaaga

SEQ ID NO: 473227 - RNA, 19 nt, Homo sapiens
aaacaacggcugcauuuca

SEQ ID NO: 473228 - RNA, 19 nt, Homo sapiens
ggaaacacaaagagaaugu

SEQ ID NO: 473229 - RNA, 19 nt, Homo sapiens
gagcaacaugcccaaguuu

SEQ ID NO: 473230 - RNA, 19 nt, Homo sapiens
gaccagacagauaaggaua

SEQ ID NO: 473231 - RNA, 19 nt, Homo sapiens
gcaacaugcccaaguuuua

SEQ ID NO: 473232 - RNA, 19 nt, Homo sapiens
ccagacagauaaggauaga

SEQ ID NO: 473233 - RNA, 19 nt, Homo sapiens
gaaagagaauaguuuugga

SEQ ID NO: 473234 - RNA, 19 nt, Homo sapiens
ggaaugacucgaccagaca

SEQ ID NO: 473235 - RNA, 19 nt, Homo sapiens
caaaacaacggcugcauuu

SEQ ID NO: 473236 - RNA, 19 nt, Homo sapiens
agagcaacaugcccaaguu

SEQ ID NO: 473237 - RNA, 19 nt, Homo sapiens
uauugugacuacugcgaua

SEQ ID NO: 473238 - RNA, 19 nt, Homo sapiens
caaagagaaugugaaagac

SEQ ID NO: 473239 - RNA, 19 nt, Homo sapiens
ugacucgaccagacagaua

SEQ ID NO: 473240 - RNA, 19 nt, Homo sapiens
aacaacggcugcauuucaa

SEQ ID NO: 473241 - RNA, 19 nt, Homo sapiens
gcaguuuuccuuuguauug

SEQ ID NO: 473242 - RNA, 19 nt, Homo sapiens
gaggccauaugccaaugau

SEQ ID NO: 473243 - RNA, 19 nt, Homo sapiens
gggaccugcuccuggaaug

SEQ ID NO: 473244 - RNA, 19 nt, Homo sapiens
cugcugugauacugaguuu

SEQ ID NO: 473245 - RNA, 19 nt, Homo sapiens
gaggggaggccuuauugua

SEQ ID NO: 473246 - RNA, 19 nt, Homo sapiens
gacucgaccagacagauaa

SEQ ID NO: 473247 - RNA, 19 nt, Homo sapiens
gauaccuccuacuccauuc

SEQ ID NO: 473248 - RNA, 19 nt, Homo sapiens
gcaguggaaggaaacacaa

SEQ ID NO: 473249 - RNA, 19 nt, Homo sapiens
ggccuuauuguaucgguuu

SEQ ID NO: 473250 - RNA, 19 nt, Homo sapiens
ggaggccauaugccaauga

SEQ ID NO: 473251 - RNA, 19 nt, Homo sapiens
ggaccugcuccuggaauga

SEQ ID NO: 473252 - RNA, 19 nt, Homo sapiens
caacggcugcauuucaaca

SEQ ID NO: 473253 - RNA, 19 nt, Homo sapiens
gugacuacugcgauacaua

SEQ ID NO: 473254 - RNA, 19 nt, Homo sapiens
ggagaucaugcugcuguga

SEQ ID NO: 473255 - RNA, 19 nt, Homo sapiens
gagaaugugaaagacuauu

SEQ ID NO: 473256 - RNA, 19 nt, Homo sapiens
ccuguccuaugaaagagaa

SEQ ID NO: 473257 - RNA, 19 nt, Homo sapiens
gguuuuauauuaccuguuc

SEQ ID NO: 473258 - RNA, 19 nt, Homo sapiens
ggggagaagugggacaaaa

SEQ ID NO: 473259 - RNA, 19 nt, Homo sapiens
guggaaggaaacacaaaga

SEQ ID NO: 473260 - RNA, 19 nt, Homo sapiens
uuucuaaacagcauaagga

SEQ ID NO: 473261 - RNA, 19 nt, Homo sapiens
gggaggccauaugccaaug

SEQ ID NO: 473262 - RNA, 19 nt, Homo sapiens
agacuauuaucagaaaugg

SEQ ID NO: 473263 - RNA, 19 nt, Homo sapiens
ugacuacugcgauacauac

SEQ ID NO: 473264 - RNA, 19 nt, Homo sapiens
ggauagaggggaggccuua

SEQ ID NO: 473265 - RNA, 19 nt, Homo sapiens
gaugcaguuuuccuuugua

SEQ ID NO: 473266 - RNA, 19 nt, Homo sapiens
ccuccucgcccugguauga

SEQ ID NO: 473267 - RNA, 19 nt, Homo sapiens
gauaaugucucucaagauu

SEQ ID NO: 473268 - RNA, 19 nt, Homo sapiens
ggaugaagcucgugagauu

SEQ ID NO: 473269 - RNA, 19 nt, Homo sapiens
ggaaagugauguauggaaa

SEQ ID NO: 473270 - RNA, 19 nt, Homo sapiens
gaaggaaagugauguaugg

SEQ ID NO: 473271 - RNA, 19 nt, Homo sapiens
gaauaugguuugaacaguu

SEQ ID NO: 473272 - RNA, 19 nt, Homo sapiens
cugcauaguugaagauuua

SEQ ID NO: 473273 - RNA, 19 nt, Homo sapiens
gucagugccuccuuuauua

SEQ ID NO: 473274 - RNA, 19 nt, Homo sapiens
gaagugagauacagcaaca

SEQ ID NO: 473275 - RNA, 19 nt, Homo sapiens
gaaauugagucaugaaacu

SEQ ID NO: 473276 - RNA, 19 nt, Homo sapiens
gucacuagauuaucaguua

SEQ ID NO: 473277 - RNA, 19 nt, Homo sapiens
gcaacagccggauuaguua

SEQ ID NO: 473278 - RNA, 19 nt, Homo sapiens
gcgauaaugucucucaaga

SEQ ID NO: 473279 - RNA, 19 nt, Homo sapiens
ggaaguaagaaguuuguuu

SEQ ID NO: 473280 - RNA, 19 nt, Homo sapiens
gcaaaggacaauucacaaa

SEQ ID NO: 473281 - RNA, 19 nt, Homo sapiens
gaagauuuauggacagaag

SEQ ID NO: 473282 - RNA, 19 nt, Homo sapiens
ucaugaaacuguaaccauu

SEQ ID NO: 473283 - RNA, 19 nt, Homo sapiens
gagaaaccuuuaagcugaa

SEQ ID NO: 473284 - RNA, 19 nt, Homo sapiens
aagcugaacuugagauaug

SEQ ID NO: 473285 - RNA, 19 nt, Homo sapiens
gagcuaagcauuucuacug

SEQ ID NO: 473286 - RNA, 19 nt, Homo sapiens
gaauacacaucuuaaagcu

SEQ ID NO: 473287 - RNA, 19 nt, Homo sapiens
guucagcguuugccuuauu

SEQ ID NO: 473288 - RNA, 19 nt, Homo sapiens
uaaugucucucaagauuuc

SEQ ID NO: 473289 - RNA, 19 nt, Homo sapiens
gaacuugagauauguaaag

SEQ ID NO: 473290 - RNA, 19 nt, Homo sapiens
gaaacuaaaguccuuaugg

SEQ ID NO: 473291 - RNA, 19 nt, Homo sapiens
gagcaaaggacaauucaca

SEQ ID NO: 473292 - RNA, 19 nt, Homo sapiens
ucaguuaugagcaguguua

SEQ ID NO: 473293 - RNA, 19 nt, Homo sapiens
ggacagaaggaaagugaug

SEQ ID NO: 473294 - RNA, 19 nt, Homo sapiens
guaguuuccuccacauuca

SEQ ID NO: 473295 - RNA, 19 nt, Homo sapiens
uauauacccuucuacuuca

SEQ ID NO: 473296 - RNA, 19 nt, Homo sapiens
uaggauauauacccuucua

SEQ ID NO: 473297 - RNA, 19 nt, Homo sapiens
aaaggacaauucacaaauc

SEQ ID NO: 473298 - RNA, 19 nt, Homo sapiens
caaaggacaauucacaaau

SEQ ID NO: 473299 - RNA, 19 nt, Homo sapiens
guacagguuguguuuguuu

SEQ ID NO: 473300 - RNA, 19 nt, Homo sapiens
gcaggaagaggcagaggaa

SEQ ID NO: 473301 - RNA, 19 nt, Homo sapiens
gcaugaauacacaucuuaa

SEQ ID NO: 473302 - RNA, 19 nt, Homo sapiens
gcuuuacucuucauucugu

SEQ ID NO: 473303 - RNA, 19 nt, Homo sapiens
gauauauacccuucuacuu

SEQ ID NO: 473304 - RNA, 19 nt, Homo sapiens
guaggguaccgucuguuua

SEQ ID NO: 473305 - RNA, 19 nt, Homo sapiens
aauuaagggucauugcuuu

SEQ ID NO: 473306 - RNA, 19 nt, Homo sapiens
gcguuugccuuauuugaau

SEQ ID NO: 473307 - RNA, 19 nt, Homo sapiens
gcuaaugucuuacuuuugu

SEQ ID NO: 473308 - RNA, 19 nt, Homo sapiens
cuugagauauguaaagaga

SEQ ID NO: 473309 - RNA, 19 nt, Homo sapiens
ggaagcuguugcaggaaga

SEQ ID NO: 473310 - RNA, 19 nt, Homo sapiens
ggucauugcuuuguugucu

SEQ ID NO: 473311 - RNA, 19 nt, Homo sapiens
gcacugaauaugcauuuua

SEQ ID NO: 473312 - RNA, 19 nt, Homo sapiens
gaaacuguaaccauugaau

SEQ ID NO: 473313 - RNA, 19 nt, Homo sapiens
guggaugucagcaugaaua

SEQ ID NO: 473314 - RNA, 19 nt, Homo sapiens
caguuaggcuacaguucua

SEQ ID NO: 473315 - RNA, 19 nt, Homo sapiens
uacagguuguguuuguuua

SEQ ID NO: 473316 - RNA, 19 nt, Homo sapiens
uaagggucauugcuuuguu

SEQ ID NO: 473317 - RNA, 19 nt, Homo sapiens
gggauggggucuagaauug

SEQ ID NO: 473318 - RNA, 19 nt, Homo sapiens
ggcugaaacuuagugauug

SEQ ID NO: 473319 - RNA, 19 nt, Homo sapiens
gcugcauaguugaagauuu

SEQ ID NO: 473320 - RNA, 19 nt, Homo sapiens
cagcaugaauacacaucuu

SEQ ID NO: 473321 - RNA, 19 nt, Homo sapiens
gaaccuguacagcuggaaa

SEQ ID NO: 473322 - RNA, 19 nt, Homo sapiens
aauggucacuagauuauca

SEQ ID NO: 473323 - RNA, 19 nt, Homo sapiens
ugagauauguaaagagacu

SEQ ID NO: 473324 - RNA, 19 nt, Homo sapiens
caguucagcguuugccuua

SEQ ID NO: 473325 - RNA, 19 nt, Homo sapiens
gaacggaacacagguccau

SEQ ID NO: 473326 - RNA, 19 nt, Homo sapiens
aaggacaauucacaaauca

SEQ ID NO: 473327 - RNA, 19 nt, Homo sapiens
cgaaauuaccacagugaga

SEQ ID NO: 473328 - RNA, 19 nt, Homo sapiens
agagcugucuauuuaguau

SEQ ID NO: 473329 - RNA, 19 nt, Homo sapiens
ucucaagauuucaaaguca

SEQ ID NO: 473330 - RNA, 19 nt, Homo sapiens
gcgcuuccggccauucaua

SEQ ID NO: 473331 - RNA, 19 nt, Homo sapiens
gaaccauaauaggcucaga

SEQ ID NO: 473332 - RNA, 19 nt, Homo sapiens
ugucagugccuccuuuauu

SEQ ID NO: 473333 - RNA, 19 nt, Homo sapiens
ccuuuaagcugaacuugag

SEQ ID NO: 473334 - RNA, 19 nt, Homo sapiens
guacugagaaaccuuuaag

SEQ ID NO: 473335 - RNA, 19 nt, Homo sapiens
uacagcaacagccggauua

SEQ ID NO: 473336 - RNA, 19 nt, Homo sapiens
acaauucacaaaucaggua

SEQ ID NO: 473337 - RNA, 19 nt, Homo sapiens
agaccuacuuuauuugaca

SEQ ID NO: 473338 - RNA, 19 nt, Homo sapiens
gaugaagcucgugagauuu

SEQ ID NO: 473339 - RNA, 19 nt, Homo sapiens
gguagccccugaaccauaa

SEQ ID NO: 473340 - RNA, 19 nt, Homo sapiens
ggaguuaauggucacuaga

SEQ ID NO: 473341 - RNA, 19 nt, Homo sapiens
ggaaacuaaaguccuuaug

SEQ ID NO: 473342 - RNA, 19 nt, Homo sapiens
uggcugaaacuuagugauu

SEQ ID NO: 473343 - RNA, 19 nt, Homo sapiens
uaguuacaguucagcguuu

SEQ ID NO: 473344 - RNA, 19 nt, Homo sapiens
ccuccacauucacgaaauu

SEQ ID NO: 473345 - RNA, 19 nt, Homo sapiens
gacaguuuaccucuggaua

SEQ ID NO: 473346 - RNA, 19 nt, Homo sapiens
auauauacccuucuacuuc

SEQ ID NO: 473347 - RNA, 19 nt, Homo sapiens
caugaaacuguaaccauug

SEQ ID NO: 473348 - RNA, 19 nt, Homo sapiens
agugagagcuaagcauuuc

SEQ ID NO: 473349 - RNA, 19 nt, Homo sapiens
ggaagaggcagaggaagag

SEQ ID NO: 473350 - RNA, 19 nt, Homo sapiens
ucagugccuccuuuauuaa

SEQ ID NO: 473351 - RNA, 19 nt, Homo sapiens
guaagaaguuuguuuuggu

SEQ ID NO: 473352 - RNA, 19 nt, Homo sapiens
ggauauauacccuucuacu

SEQ ID NO: 473353 - RNA, 19 nt, Homo sapiens
ggaacacagguccauggaa

SEQ ID NO: 473354 - RNA, 19 nt, Homo sapiens
auacacuacuuguggaugu

SEQ ID NO: 473355 - RNA, 19 nt, Homo sapiens
ucacaugcacugaauaugc

SEQ ID NO: 473356 - RNA, 19 nt, Homo sapiens
ugaauaugguuugaacagu

SEQ ID NO: 473357 - RNA, 19 nt, Homo sapiens
ggaaaauggaagugagaua

SEQ ID NO: 473358 - RNA, 19 nt, Homo sapiens
gagcugucuauuuaguaua

SEQ ID NO: 473359 - RNA, 19 nt, Homo sapiens
ucauaugagauuugggaua

SEQ ID NO: 473360 - RNA, 19 nt, Homo sapiens
gcugaguauucgaggaaau

SEQ ID NO: 473361 - RNA, 19 nt, Homo sapiens
gcugaaacuuagugauugc

SEQ ID NO: 473362 - RNA, 19 nt, Homo sapiens
agcaacagccggauuaguu

SEQ ID NO: 473363 - RNA, 19 nt, Homo sapiens
acagaaggaaagugaugua

SEQ ID NO: 473364 - RNA, 19 nt, Homo sapiens
ugagagcuaagcauuucua

SEQ ID NO: 473365 - RNA, 19 nt, Homo sapiens
acagugagagcuaagcauu

SEQ ID NO: 473366 - RNA, 19 nt, Homo sapiens
aaaugacccugaagaacag

SEQ ID NO: 473367 - RNA, 19 nt, Homo sapiens
gaagaccgcugccauuggu

SEQ ID NO: 473368 - RNA, 19 nt, Homo sapiens
caacaaagaccgcuacauc

SEQ ID NO: 473369 - RNA, 19 nt, Homo sapiens
ccauugguguugagaauaa

SEQ ID NO: 473370 - RNA, 19 nt, Homo sapiens
ucacuccucuguccuauga

SEQ ID NO: 473371 - RNA, 19 nt, Homo sapiens
ugaaggagauguggacuga

SEQ ID NO: 473372 - RNA, 19 nt, Homo sapiens
ucaacaagcccaagaguga

SEQ ID NO: 473373 - RNA, 19 nt, Homo sapiens
caagaacaauacccaagug

SEQ ID NO: 473374 - RNA, 19 nt, Homo sapiens
ccaagccagucaacaaaga

SEQ ID NO: 473375 - RNA, 19 nt, Homo sapiens
uaacaccgguccacucucu

SEQ ID NO: 473376 - RNA, 19 nt, Homo sapiens
gaagugggucgcaggaaga

SEQ ID NO: 473377 - RNA, 19 nt, Homo sapiens
ggagauguggacugaggua

SEQ ID NO: 473378 - RNA, 19 nt, Homo sapiens
cacagucagucaagaacaa

SEQ ID NO: 473379 - RNA, 19 nt, Homo sapiens
ucacacagucagucaagaa

SEQ ID NO: 473380 - RNA, 19 nt, Homo sapiens
ccacuuacugguuggcuuu

SEQ ID NO: 473381 - RNA, 19 nt, Homo sapiens
gaauaauaaagcucugugu

SEQ ID NO: 473382 - RNA, 19 nt, Homo sapiens
cccaagugcucaucaacug

SEQ ID NO: 473383 - RNA, 19 nt, Homo sapiens
ggaggaaacgggagugaac

SEQ ID NO: 473384 - RNA, 19 nt, Homo sapiens
ggaagucccgccucucucu

SEQ ID NO: 473385 - RNA, 19 nt, Homo sapiens
gcaagggcaagaagaaguc

SEQ ID NO: 473386 - RNA, 19 nt, Homo sapiens
uaugaagaccgcugccauu

SEQ ID NO: 473387 - RNA, 19 nt, Homo sapiens
uggagaacgugaaggagau

SEQ ID NO: 473388 - RNA, 19 nt, Homo sapiens
gagcguagugaccaucaug

SEQ ID NO: 473389 - RNA, 19 nt, Homo sapiens
guccaagccagucaacaaa

SEQ ID NO: 473390 - RNA, 19 nt, Homo sapiens
gaaucagacugccuuuccu

SEQ ID NO: 473391 - RNA, 19 nt, Homo sapiens
ucaagaacaauacccaagu

SEQ ID NO: 473392 - RNA, 19 nt, Homo sapiens
ugccauugguguugagaau

SEQ ID NO: 473393 - RNA, 19 nt, Homo sapiens
gagaauaauaaagcucugu

SEQ ID NO: 473394 - RNA, 19 nt, Homo sapiens
acaaagaccgcuacaucuc

SEQ ID NO: 473395 - RNA, 19 nt, Homo sapiens
cagacugccuuuccuuuug

SEQ ID NO: 473396 - RNA, 19 nt, Homo sapiens
ggccacgccuccacuuacu

SEQ ID NO: 473397 - RNA, 19 nt, Homo sapiens
gccauugguguugagaaua

SEQ ID NO: 473398 - RNA, 19 nt, Homo sapiens
gcucacacagucagucaag

SEQ ID NO: 473399 - RNA, 19 nt, Homo sapiens
ggcaagggcaagaagaagu

SEQ ID NO: 473400 - RNA, 19 nt, Homo sapiens
guggcaagggcaagaagaa

SEQ ID NO: 473401 - RNA, 19 nt, Homo sapiens
ugucuucauugucauaaac

SEQ ID NO: 473402 - RNA, 19 nt, Homo sapiens
gagagcguagugaccauca

SEQ ID NO: 473403 - RNA, 19 nt, Homo sapiens
gaacagaacuuuguccuuu

SEQ ID NO: 473404 - RNA, 19 nt, Homo sapiens
gaagaacgcacccauguua

SEQ ID NO: 473405 - RNA, 19 nt, Homo sapiens
gaacaccggugagguauau

SEQ ID NO: 473406 - RNA, 19 nt, Homo sapiens
caacacaggugacucuuuc

SEQ ID NO: 473407 - RNA, 19 nt, Homo sapiens
gcacagcuauugaugagau

SEQ ID NO: 473408 - RNA, 19 nt, Homo sapiens
gaaguuugcuuuggcuaaa

SEQ ID NO: 473409 - RNA, 19 nt, Homo sapiens
gagaaugccaguacuuuga

SEQ ID NO: 473410 - RNA, 19 nt, Homo sapiens
cagguuaucugaguucauu

SEQ ID NO: 473411 - RNA, 19 nt, Homo sapiens
gaaugccaguacuuugaaa

SEQ ID NO: 473412 - RNA, 19 nt, Homo sapiens
caacaugaacugccagaug

SEQ ID NO: 473413 - RNA, 19 nt, Homo sapiens
cgauuaaaguacugcauga

SEQ ID NO: 473414 - RNA, 19 nt, Homo sapiens
ggagaaugccaguacuuug

SEQ ID NO: 473415 - RNA, 19 nt, Homo sapiens
gauugugucucauucaucu

SEQ ID NO: 473416 - RNA, 19 nt, Homo sapiens
caacaucacagucacauac

SEQ ID NO: 473417 - RNA, 19 nt, Homo sapiens
gacgaacaccggugaggua

SEQ ID NO: 473418 - RNA, 19 nt, Homo sapiens
ggggaaauguuuaagcuaa

SEQ ID NO: 473419 - RNA, 19 nt, Homo sapiens
gggaaagaguggaauucug

SEQ ID NO: 473420 - RNA, 19 nt, Homo sapiens
ggacuuuguguucauuuga

SEQ ID NO: 473421 - RNA, 19 nt, Homo sapiens
gugacucuuucccuugaua

SEQ ID NO: 473422 - RNA, 19 nt, Homo sapiens
gggagaaugccaguacuuu

SEQ ID NO: 473423 - RNA, 19 nt, Homo sapiens
gaacgcacccauguuaaag

SEQ ID NO: 473424 - RNA, 19 nt, Homo sapiens
cuauuggugugccgauuaa

SEQ ID NO: 473425 - RNA, 19 nt, Homo sapiens
cauguaaucccagcacuuu

SEQ ID NO: 473426 - RNA, 19 nt, Homo sapiens
guggcacuuuguucaguua

SEQ ID NO: 473427 - RNA, 19 nt, Homo sapiens
ggaaugggacguggaaaca

SEQ ID NO: 473428 - RNA, 19 nt, Homo sapiens
uaaggacuuuguguucauu

SEQ ID NO: 473429 - RNA, 19 nt, Homo sapiens
ccagucaucagcccucuuu

SEQ ID NO: 473430 - RNA, 19 nt, Homo sapiens
auacauccguggcagcaaa

SEQ ID NO: 473431 - RNA, 19 nt, Homo sapiens
ucauucaucuucagacaca

SEQ ID NO: 473432 - RNA, 19 nt, Homo sapiens
aaauaaggacuuuguguuc

SEQ ID NO: 473433 - RNA, 19 nt, Homo sapiens
uaacaacacaggugacucu

SEQ ID NO: 473434 - RNA, 19 nt, Homo sapiens
aauaaggacuuuguguuca

SEQ ID NO: 473435 - RNA, 19 nt, Homo sapiens
uuugccaucuuucucuuua

SEQ ID NO: 473436 - RNA, 19 nt, Homo sapiens
ggaagaggacguggaaugg

SEQ ID NO: 473437 - RNA, 19 nt, Homo sapiens
ugccugacaugcugaagaa

SEQ ID NO: 473438 - RNA, 19 nt, Homo sapiens
gcucagcuuuaacaacaca

SEQ ID NO: 473439 - RNA, 19 nt, Homo sapiens
ccaguacuuugaaauagca

SEQ ID NO: 473440 - RNA, 19 nt, Homo sapiens
gagaagcuccgagaacaca

SEQ ID NO: 473441 - RNA, 19 nt, Homo sapiens
gaaaauaaggacuuugugu

SEQ ID NO: 473442 - RNA, 19 nt, Homo sapiens
caaguggccgcaagaggaa

SEQ ID NO: 473443 - RNA, 19 nt, Homo sapiens
aagcagaggacaacaugaa

SEQ ID NO: 473444 - RNA, 19 nt, Homo sapiens
cagauugugucucauucau

SEQ ID NO: 473445 - RNA, 19 nt, Homo sapiens
agaacgcacccauguuaaa

SEQ ID NO: 473446 - RNA, 19 nt, Homo sapiens
gcacagcuggagcagguau

SEQ ID NO: 473447 - RNA, 19 nt, Homo sapiens
gggauguccugggagaaug

SEQ ID NO: 473448 - RNA, 19 nt, Homo sapiens
ugaaguuugcuuuggcuaa

SEQ ID NO: 473449 - RNA, 19 nt, Homo sapiens
gaagcagaggacaacauga

SEQ ID NO: 473450 - RNA, 19 nt, Homo sapiens
cacccucucuggcucuuug

SEQ ID NO: 473451 - RNA, 19 nt, Homo sapiens
cagaaaaguucaccuugga

SEQ ID NO: 473452 - RNA, 19 nt, Homo sapiens
guacuggugcccuaguuuc

SEQ ID NO: 473453 - RNA, 19 nt, Homo sapiens
cauauaugcuagguaucuu

SEQ ID NO: 473454 - RNA, 19 nt, Homo sapiens
ugaagcagaggacaacaug

SEQ ID NO: 473455 - RNA, 19 nt, Homo sapiens
ucuauuggugugccgauua

SEQ ID NO: 473456 - RNA, 19 nt, Homo sapiens
cuugauaaagucauaggua

SEQ ID NO: 473457 - RNA, 19 nt, Homo sapiens
gaucaggggaaauguuuaa

SEQ ID NO: 473458 - RNA, 19 nt, Homo sapiens
ugaagaacgcacccauguu

SEQ ID NO: 473459 - RNA, 19 nt, Homo sapiens
caucacagucacauacaga

SEQ ID NO: 473460 - RNA, 19 nt, Homo sapiens
gcauguaaucccagcacuu

SEQ ID NO: 473461 - RNA, 19 nt, Homo sapiens
agugggugcuugugcauau

SEQ ID NO: 473462 - RNA, 19 nt, Homo sapiens
aaugggacguggaaacauc

SEQ ID NO: 473463 - RNA, 19 nt, Homo sapiens
acagucacauacagagaug

SEQ ID NO: 473464 - RNA, 19 nt, Homo sapiens
gugggugcuugugcauaua

SEQ ID NO: 473465 - RNA, 19 nt, Homo sapiens
gagaaaauaaggacuuugu

SEQ ID NO: 473466 - RNA, 19 nt, Homo sapiens
ugccaucuuucucuuuaga

SEQ ID NO: 473467 - RNA, 19 nt, Homo sapiens
gcagcggaccgaagagaag

SEQ ID NO: 473468 - RNA, 19 nt, Homo sapiens
cgaacaccggugagguaua

SEQ ID NO: 473469 - RNA, 19 nt, Homo sapiens
ucucauucaucuucagaca

SEQ ID NO: 473470 - RNA, 19 nt, Homo sapiens
agaggaagaggacguggaa

SEQ ID NO: 473471 - RNA, 19 nt, Homo sapiens
ccaacaucacagucacaua

SEQ ID NO: 473472 - RNA, 19 nt, Homo sapiens
gcagaggacaacaugaacu

SEQ ID NO: 473473 - RNA, 19 nt, Homo sapiens
auaaggacuuuguguucau

SEQ ID NO: 473474 - RNA, 19 nt, Homo sapiens
gccaguacuuugaaauagc

SEQ ID NO: 473475 - RNA, 19 nt, Homo sapiens
ugccaguacuuugaaauag

SEQ ID NO: 473476 - RNA, 19 nt, Homo sapiens
cugaagaacgcacccaugu

SEQ ID NO: 473477 - RNA, 19 nt, Homo sapiens
gaguggaauucuggguguu

SEQ ID NO: 473478 - RNA, 19 nt, Homo sapiens
acaacacaggugacucuuu

SEQ ID NO: 473479 - RNA, 19 nt, Homo sapiens
gaagcuccgagaacacaca

SEQ ID NO: 473480 - RNA, 19 nt, Homo sapiens
agaaugccaguacuuugaa

SEQ ID NO: 473481 - RNA, 19 nt, Homo sapiens
ugccggaacuaucguacug

SEQ ID NO: 473482 - RNA, 19 nt, Homo sapiens
aagaacgcacccauguuaa

SEQ ID NO: 473483 - RNA, 19 nt, Homo sapiens
uccgagaacacacagauug

SEQ ID NO: 473484 - RNA, 19 nt, Homo sapiens
gcuccgagaacacacagau

SEQ ID NO: 473485 - RNA, 19 nt, Homo sapiens
aggaagaggacguggaaug

SEQ ID NO: 473486 - RNA, 19 nt, Homo sapiens
cagaggacaacaugaacug

SEQ ID NO: 473487 - RNA, 19 nt, Homo sapiens
cauuugaaguuugcuuugg

SEQ ID NO: 473488 - RNA, 19 nt, Homo sapiens
gaaugggacguggaaacau

SEQ ID NO: 473489 - RNA, 19 nt, Homo sapiens
ucacagucacauacagaga

SEQ ID NO: 473490 - RNA, 19 nt, Homo sapiens
gaaaugaucaaugaaguga

SEQ ID NO: 473491 - RNA, 19 nt, Homo sapiens
auagaaggcuguaucauug

SEQ ID NO: 473492 - RNA, 19 nt, Homo sapiens
gagaaauuguugagaagga

SEQ ID NO: 473493 - RNA, 19 nt, Homo sapiens
caaaauagaucgcggauuc

SEQ ID NO: 473494 - RNA, 19 nt, Homo sapiens
gcaagugaauaugcggaua

SEQ ID NO: 473495 - RNA, 19 nt, Homo sapiens
uguauuagaugaugcagaa

SEQ ID NO: 473496 - RNA, 19 nt, Homo sapiens
gaaauuguugagaaggaua

SEQ ID NO: 473497 - RNA, 19 nt, Homo sapiens
acuaugggauuguuuguau

SEQ ID NO: 473498 - RNA, 19 nt, Homo sapiens
cagaaagugcagaagguua

SEQ ID NO: 473499 - RNA, 19 nt, Homo sapiens
agugagaaauuguugagaa

SEQ ID NO: 473500 - RNA, 19 nt, Homo sapiens
caacuagaaaugaucaaug

SEQ ID NO: 473501 - RNA, 19 nt, Homo sapiens
aaugaucaaugaagugaga

SEQ ID NO: 473502 - RNA, 19 nt, Homo sapiens
ggauucagguguggcucua

SEQ ID NO: 473503 - RNA, 19 nt, Homo sapiens
gaagugagaaauuguugag

SEQ ID NO: 473504 - RNA, 19 nt, Homo sapiens
ucuaugagcaagugaauau

SEQ ID NO: 473505 - RNA, 19 nt, Homo sapiens
ggugugcucuuugugaaau

SEQ ID NO: 473506 - RNA, 19 nt, Homo sapiens
gauguccuuuguccaaugu

SEQ ID NO: 473507 - RNA, 19 nt, Homo sapiens
gugagaaauuguugagaag

SEQ ID NO: 473508 - RNA, 19 nt, Homo sapiens
gugaauaugcggauagaag

SEQ ID NO: 473509 - RNA, 19 nt, Homo sapiens
agaaagugcagaagguuau

SEQ ID NO: 473510 - RNA, 19 nt, Homo sapiens
gugcgggugugcucuuugu

SEQ ID NO: 473511 - RNA, 19 nt, Homo sapiens
gucagaaagugcagaaggu

SEQ ID NO: 473512 - RNA, 19 nt, Homo sapiens
aaacaacugggucggauca

SEQ ID NO: 473513 - RNA, 19 nt, Homo sapiens
uuagauguccuuuguccaa

SEQ ID NO: 473514 - RNA, 19 nt, Homo sapiens
gaaagugcagaagguuaug

SEQ ID NO: 473515 - RNA, 19 nt, Homo sapiens
cgggugugcucuuugugaa

SEQ ID NO: 473516 - RNA, 19 nt, Homo sapiens
gaucaaugaagugagaaau

SEQ ID NO: 473517 - RNA, 19 nt, Homo sapiens
caagugaauaugcggauag

SEQ ID NO: 473518 - RNA, 19 nt, Homo sapiens
gcccaucaaccucaucuuc

SEQ ID NO: 473519 - RNA, 19 nt, Homo sapiens
gcgggugugcucuuuguga

SEQ ID NO: 473520 - RNA, 19 nt, Homo sapiens
aaggcuguaucauugguuu

SEQ ID NO: 473521 - RNA, 19 nt, Homo sapiens
gaaccuuguauuagaugau

SEQ ID NO: 473522 - RNA, 19 nt, Homo sapiens
cuaugggauuguuuguauu

SEQ ID NO: 473523 - RNA, 19 nt, Homo sapiens
cuagaaaugaucaaugaag

SEQ ID NO: 473524 - RNA, 19 nt, Homo sapiens
acaacugggucggaucaug

SEQ ID NO: 473525 - RNA, 19 nt, Homo sapiens
ccaucaaccucaucuucag

SEQ ID NO: 473526 - RNA, 19 nt, Homo sapiens
agaaauuguugagaaggau

SEQ ID NO: 473527 - RNA, 19 nt, Homo sapiens
ugaaccuuguauuagauga

SEQ ID NO: 473528 - RNA, 19 nt, Homo sapiens
gaaggcuguaucauugguu

SEQ ID NO: 473529 - RNA, 19 nt, Homo sapiens
gcgugcgggugugcucuuu

SEQ ID NO: 473530 - RNA, 19 nt, Homo sapiens
agaaaugaucaaugaagug

SEQ ID NO: 473531 - RNA, 19 nt, Homo sapiens
ugggucggaucaugcuaaa

SEQ ID NO: 473532 - RNA, 19 nt, Homo sapiens
ucagaaagugcagaagguu

SEQ ID NO: 473533 - RNA, 19 nt, Homo sapiens
ugaagugagaaauuguuga

SEQ ID NO: 473534 - RNA, 19 nt, Homo sapiens
uauuagaugaugcagaaga

SEQ ID NO: 473535 - RNA, 19 nt, Homo sapiens
uguccuuuguccaauguga

SEQ ID NO: 473536 - RNA, 19 nt, Homo sapiens
uagauguccuuuguccaau

SEQ ID NO: 473537 - RNA, 19 nt, Homo sapiens
caucaaccucaucuucaga

SEQ ID NO: 473538 - RNA, 19 nt, Homo sapiens
gagaguagccugcaacauu

SEQ ID NO: 473539 - RNA, 19 nt, Homo sapiens
guacaagggcuaucuggua

SEQ ID NO: 473540 - RNA, 19 nt, Homo sapiens
auacauagauggagcuuug

SEQ ID NO: 473541 - RNA, 19 nt, Homo sapiens
gaaagccagugauggugaa

SEQ ID NO: 473542 - RNA, 19 nt, Homo sapiens
ggaagaagaggaagaagau

SEQ ID NO: 473543 - RNA, 19 nt, Homo sapiens
uaucagagguguggaagaa

SEQ ID NO: 473544 - RNA, 19 nt, Homo sapiens
ccagugauggugaaacuua

SEQ ID NO: 473545 - RNA, 19 nt, Homo sapiens
ucaauggacuaacaggaaa

SEQ ID NO: 473546 - RNA, 19 nt, Homo sapiens
gguguaauaauguccuuua

SEQ ID NO: 473547 - RNA, 19 nt, Homo sapiens
ggaagaagauggggaaaug

SEQ ID NO: 473548 - RNA, 19 nt, Homo sapiens
ggacaucugggugaaguuu

SEQ ID NO: 473549 - RNA, 19 nt, Homo sapiens
ucagagguguggaagaaga

SEQ ID NO: 473550 - RNA, 19 nt, Homo sapiens
ucccaaaccuuuccucaau

SEQ ID NO: 473551 - RNA, 19 nt, Homo sapiens
uacaagggcuaucugguau

SEQ ID NO: 473552 - RNA, 19 nt, Homo sapiens
agaguagccugcaacauuc

SEQ ID NO: 473553 - RNA, 19 nt, Homo sapiens
acagaagaauacauagaug

SEQ ID NO: 473554 - RNA, 19 nt, Homo sapiens
ccaaaccuuuccucaaugg

SEQ ID NO: 473555 - RNA, 19 nt, Homo sapiens
gagaauagcaucuuuugug

SEQ ID NO: 473556 - RNA, 19 nt, Homo sapiens
ggaaaugagagaauagcau

SEQ ID NO: 473557 - RNA, 19 nt, Homo sapiens
gcaaauacagaagaauaca

SEQ ID NO: 473558 - RNA, 19 nt, Homo sapiens
gcuugcaaauacagaagaa

SEQ ID NO: 473559 - RNA, 19 nt, Homo sapiens
cagugauggugaaacuuaa

SEQ ID NO: 473560 - RNA, 19 nt, Homo sapiens
caagggcuaucugguaucu

SEQ ID NO: 473561 - RNA, 19 nt, Homo sapiens
gaagaagaggaagaagaug

SEQ ID NO: 473562 - RNA, 19 nt, Homo sapiens
aacauucggccgugguuua

SEQ ID NO: 473563 - RNA, 19 nt, Homo sapiens
ggccgugguuuacaugagu

SEQ ID NO: 473564 - RNA, 19 nt, Homo sapiens
agaagaauacauagaugga

SEQ ID NO: 473565 - RNA, 19 nt, Homo sapiens
gcagcuugcaaauacagaa

SEQ ID NO: 473566 - RNA, 19 nt, Homo sapiens
gcuaucugguaucuguaga

SEQ ID NO: 473567 - RNA, 19 nt, Homo sapiens
caggaaagccagugauggu

SEQ ID NO: 473568 - RNA, 19 nt, Homo sapiens
cccaaaccuuuccucaaug

SEQ ID NO: 473569 - RNA, 19 nt, Homo sapiens
gcaacauucggccgugguu

SEQ ID NO: 473570 - RNA, 19 nt, Homo sapiens
gagagaauagcaucuuuug

SEQ ID NO: 473571 - RNA, 19 nt, Homo sapiens
augagagaauagcaucuuu

SEQ ID NO: 473572 - RNA, 19 nt, Homo sapiens
uggaagaagaggaagaaga

SEQ ID NO: 473573 - RNA, 19 nt, Homo sapiens
agggcuaucugguaucugu

SEQ ID NO: 473574 - RNA, 19 nt, Homo sapiens
acaucugggugaaguuuua

SEQ ID NO: 473575 - RNA, 19 nt, Homo sapiens
caacauucggccgugguuu

SEQ ID NO: 473576 - RNA, 19 nt, Homo sapiens
uaacaggaaagccagugau

SEQ ID NO: 473577 - RNA, 19 nt, Homo sapiens
ugcgguaccugcuguaguc

SEQ ID NO: 473578 - RNA, 19 nt, Homo sapiens
gacaagaaguuaucauuga

SEQ ID NO: 473579 - RNA, 19 nt, Homo sapiens
gaacgaguauaaauaaugg

SEQ ID NO: 473580 - RNA, 19 nt, Homo sapiens
guaauacgaggaaauagua

SEQ ID NO: 473581 - RNA, 19 nt, Homo sapiens
ggaaauaguaucaucaugu

SEQ ID NO: 473582 - RNA, 19 nt, Homo sapiens
gcauuaaagugaaagaauc

SEQ ID NO: 473583 - RNA, 19 nt, Homo sapiens
caacagaacaauauuggaa

SEQ ID NO: 473584 - RNA, 19 nt, Homo sapiens
ggacaagaaguuaucauug

SEQ ID NO: 473585 - RNA, 19 nt, Homo sapiens
gcagacauguccaaggaau

SEQ ID NO: 473586 - RNA, 19 nt, Homo sapiens
ggacaacagaacaauauug

SEQ ID NO: 473587 - RNA, 19 nt, Homo sapiens
caaaggguuuuaugcauua

SEQ ID NO: 473588 - RNA, 19 nt, Homo sapiens
ggaacgaguauaaauaaug

SEQ ID NO: 473589 - RNA, 19 nt, Homo sapiens
uagaauaucagcucucauu

SEQ ID NO: 473590 - RNA, 19 nt, Homo sapiens
gauuugaucccuuuaugaa

SEQ ID NO: 473591 - RNA, 19 nt, Homo sapiens
uuaugaaccuugugauaga

SEQ ID NO: 473592 - RNA, 19 nt, Homo sapiens
uggcagacauguccaagga

SEQ ID NO: 473593 - RNA, 19 nt, Homo sapiens
uauagaauaucagcucuca

SEQ ID NO: 473594 - RNA, 19 nt, Homo sapiens
acagaacaauauuggaaug

SEQ ID NO: 473595 - RNA, 19 nt, Homo sapiens
gugguaauacgaggaaaua

SEQ ID NO: 473596 - RNA, 19 nt, Homo sapiens
guggacaacagaacaauau

SEQ ID NO: 473597 - RNA, 19 nt, Homo sapiens
gaguauacaccaugagcaa

SEQ ID NO: 473598 - RNA, 19 nt, Homo sapiens
gguaauacgaggaaauagu

SEQ ID NO: 473599 - RNA, 19 nt, Homo sapiens
aauaucagcucucauucca

SEQ ID NO: 473600 - RNA, 19 nt, Homo sapiens
ucaaaggguuuuaugcauu

SEQ ID NO: 473601 - RNA, 19 nt, Homo sapiens
gacaacagaacaauauugg

SEQ ID NO: 473602 - RNA, 19 nt, Homo sapiens
cccauguccucucuccaua

SEQ ID NO: 473603 - RNA, 19 nt, Homo sapiens
gaggaaauaguaucaucau

SEQ ID NO: 473604 - RNA, 19 nt, Homo sapiens
gauggcgacuaguggacaa

SEQ ID NO: 473605 - RNA, 19 nt, Homo sapiens
guguggagauggcgacuag

SEQ ID NO: 473606 - RNA, 19 nt, Homo sapiens
agacauguccaaggaauau

SEQ ID NO: 473607 - RNA, 19 nt, Homo sapiens
cuuggaacgaguauaaaua

SEQ ID NO: 473608 - RNA, 19 nt, Homo sapiens
guuagaagccuuggaacga

SEQ ID NO: 473609 - RNA, 19 nt, Homo sapiens
cauguuagaagccuuggaa

SEQ ID NO: 473610 - RNA, 19 nt, Homo sapiens
ugaaccuugugauagauga

SEQ ID NO: 473611 - RNA, 19 nt, Homo sapiens
ucagcucucauuccaguuu

SEQ ID NO: 473612 - RNA, 19 nt, Homo sapiens
agaaacccauguccucucu

SEQ ID NO: 473613 - RNA, 19 nt, Homo sapiens
ggucauguacauuuucaua

SEQ ID NO: 473614 - RNA, 19 nt, Homo sapiens
guauaaauaauggcuguuc

SEQ ID NO: 473615 - RNA, 19 nt, Homo sapiens
uggacaagaaguuaucauu

SEQ ID NO: 473616 - RNA, 19 nt, Homo sapiens
cgaggaaauaguaucauca

SEQ ID NO: 473617 - RNA, 19 nt, Homo sapiens
gaaccuugugauagaugaa

SEQ ID NO: 473618 - RNA, 19 nt, Homo sapiens
guauacaccaugagcaaag

SEQ ID NO: 473619 - RNA, 19 nt, Homo sapiens
cagacauguccaaggaaua

SEQ ID NO: 473620 - RNA, 19 nt, Homo sapiens
acgaggaaauaguaucauc

SEQ ID NO: 473621 - RNA, 19 nt, Homo sapiens
gcgacuaguggacaacaga

SEQ ID NO: 473622 - RNA, 19 nt, Homo sapiens
agaugaauguguggagaug

SEQ ID NO: 473623 - RNA, 19 nt, Homo sapiens
cuuuaugaaccuugugaua

SEQ ID NO: 473624 - RNA, 19 nt, Homo sapiens
uuaaaugguggcagacaug

SEQ ID NO: 473625 - RNA, 19 nt, Homo sapiens
agaacaauauuggaauggu

SEQ ID NO: 473626 - RNA, 19 nt, Homo sapiens
uaugaaccuugugauagau

SEQ ID NO: 473627 - RNA, 19 nt, Homo sapiens
aggaaauaguaucaucaug

SEQ ID NO: 473628 - RNA, 19 nt, Homo sapiens
cgacuaguggacaacagaa

SEQ ID NO: 473629 - RNA, 19 nt, Homo sapiens
gaaauuguguagaguguuu

SEQ ID NO: 473630 - RNA, 19 nt, Homo sapiens
cgucauaccuuuaucuaua

SEQ ID NO: 473631 - RNA, 19 nt, Homo sapiens
ucagaaagaucaagccaaa

SEQ ID NO: 473632 - RNA, 19 nt, Homo sapiens
caaugcgucuugugaaauu

SEQ ID NO: 473633 - RNA, 19 nt, Homo sapiens
gcaaguaccugugguggau

SEQ ID NO: 473634 - RNA, 19 nt, Homo sapiens
ugaauuugauccucuguga

SEQ ID NO: 473635 - RNA, 19 nt, Homo sapiens
gaccuuagcauacuguuga

SEQ ID NO: 473636 - RNA, 19 nt, Homo sapiens
ccaccaagaccuuagcaua

SEQ ID NO: 473637 - RNA, 19 nt, Homo sapiens
uuaaagccauauuggagua

SEQ ID NO: 473638 - RNA, 19 nt, Homo sapiens
ugagauguauccugcaaga

SEQ ID NO: 473639 - RNA, 19 nt, Homo sapiens
gcauagagcaauuaaacug

SEQ ID NO: 473640 - RNA, 19 nt, Homo sapiens
gaaagaucaagccaaagaa

SEQ ID NO: 473641 - RNA, 19 nt, Homo sapiens
gacuauagaaugagaugua

SEQ ID NO: 473642 - RNA, 19 nt, Homo sapiens
ucagaagcaucaaguuuua

SEQ ID NO: 473643 - RNA, 19 nt, Homo sapiens
gacauuggauuugguggaa

SEQ ID NO: 473644 - RNA, 19 nt, Homo sapiens
ugacaagcauaugaauuug

SEQ ID NO: 473645 - RNA, 19 nt, Homo sapiens
gcaaccagagcgugaagaa

SEQ ID NO: 473646 - RNA, 19 nt, Homo sapiens
agaaagaucaagccaaaga

SEQ ID NO: 473647 - RNA, 19 nt, Homo sapiens
gcagcacauugacuauaga

SEQ ID NO: 473648 - RNA, 19 nt, Homo sapiens
cagcuugcauuguuucuag

SEQ ID NO: 473649 - RNA, 19 nt, Homo sapiens
gagacgaacuacagaacag

SEQ ID NO: 473650 - RNA, 19 nt, Homo sapiens
gcacguaccagagguggaa

SEQ ID NO: 473651 - RNA, 19 nt, Homo sapiens
guagaguguuugugagcuu

SEQ ID NO: 473652 - RNA, 19 nt, Homo sapiens
ugugaugaguucagaaaga

SEQ ID NO: 473653 - RNA, 19 nt, Homo sapiens
gugaaauuguguagagugu

SEQ ID NO: 473654 - RNA, 19 nt, Homo sapiens
caaagauacuggcauugcu

SEQ ID NO: 473655 - RNA, 19 nt, Homo sapiens
gugaugaguucagaaagau

SEQ ID NO: 473656 - RNA, 19 nt, Homo sapiens
ggaguagcgaggaaucuga

SEQ ID NO: 473657 - RNA, 19 nt, Homo sapiens
ugcaaugcgucuugugaaa

SEQ ID NO: 473658 - RNA, 19 nt, Homo sapiens
agaggugguuaaagccaua

SEQ ID NO: 473659 - RNA, 19 nt, Homo sapiens
gaacugaggcaggcauucu

SEQ ID NO: 473660 - RNA, 19 nt, Homo sapiens
caagucaaacgcagaagga

SEQ ID NO: 473661 - RNA, 19 nt, Homo sapiens
gacaagcauaugaauuuga

SEQ ID NO: 473662 - RNA, 19 nt, Homo sapiens
guucccucauucugcauua

SEQ ID NO: 473663 - RNA, 19 nt, Homo sapiens
gcaaugcgucuugugaaau

SEQ ID NO: 473664 - RNA, 19 nt, Homo sapiens
gggaagaggcacuguagca

SEQ ID NO: 473665 - RNA, 19 nt, Homo sapiens
gggagaacuugguauccau

SEQ ID NO: 473666 - RNA, 19 nt, Homo sapiens
gaugaguucagaaagauca

SEQ ID NO: 473667 - RNA, 19 nt, Homo sapiens
gauccucugugauugugau

SEQ ID NO: 473668 - RNA, 19 nt, Homo sapiens
aaucuucauuggcaccuuu

SEQ ID NO: 473669 - RNA, 19 nt, Homo sapiens
gguggaacagcaaucauga

SEQ ID NO: 473670 - RNA, 19 nt, Homo sapiens
gaacuugguauccaugacu

SEQ ID NO: 473671 - RNA, 19 nt, Homo sapiens
gucauaccuuuaucuauag

SEQ ID NO: 473672 - RNA, 19 nt, Homo sapiens
cccaugggcccaccaauug

SEQ ID NO: 473673 - RNA, 19 nt, Homo sapiens
ggaccaucccagcagguaa

SEQ ID NO: 473674 - RNA, 19 nt, Homo sapiens
aaugagauguauccugcaa

SEQ ID NO: 473675 - RNA, 19 nt, Homo sapiens
cugcccagcuugcauuguu

SEQ ID NO: 473676 - RNA, 19 nt, Homo sapiens
aauuugauccucugugauu

SEQ ID NO: 473677 - RNA, 19 nt, Homo sapiens
uaacuguggacauuggauu

SEQ ID NO: 473678 - RNA, 19 nt, Homo sapiens
aggaaugcguccaccaaga

SEQ ID NO: 473679 - RNA, 19 nt, Homo sapiens
gagaacuugguauccauga

SEQ ID NO: 473680 - RNA, 19 nt, Homo sapiens
gaagcaaccagagcgugaa

SEQ ID NO: 473681 - RNA, 19 nt, Homo sapiens
gccaaagaaugcgaagcaa

SEQ ID NO: 473682 - RNA, 19 nt, Homo sapiens
ucacugagcaaccaagagu

SEQ ID NO: 473683 - RNA, 19 nt, Homo sapiens
gauggccgaaucuucauug

SEQ ID NO: 473684 - RNA, 19 nt, Homo sapiens
gcauacuguugauccaucu

SEQ ID NO: 473685 - RNA, 19 nt, Homo sapiens
ccaagaccuuagcauacug

SEQ ID NO: 473686 - RNA, 19 nt, Homo sapiens
ggcaagggaucgcuuacac

SEQ ID NO: 473687 - RNA, 19 nt, Homo sapiens
agauguauccugcaagaug

SEQ ID NO: 473688 - RNA, 19 nt, Homo sapiens
uagaguguuugugagcuuu

SEQ ID NO: 473689 - RNA, 19 nt, Homo sapiens
ggaaugcguccaccaagac

SEQ ID NO: 473690 - RNA, 19 nt, Homo sapiens
aaagaucaagccaaagaau

SEQ ID NO: 473691 - RNA, 19 nt, Homo sapiens
aaguaccugugguggauuu

SEQ ID NO: 473692 - RNA, 19 nt, Homo sapiens
uggcaagaguagcaagaug

SEQ ID NO: 473693 - RNA, 19 nt, Homo sapiens
cccucauucugcauuaaua

SEQ ID NO: 473694 - RNA, 19 nt, Homo sapiens
gcucgagggacgccaauag

SEQ ID NO: 473695 - RNA, 19 nt, Homo sapiens
gaccaucccagcagguaau

SEQ ID NO: 473696 - RNA, 19 nt, Homo sapiens
caaccagagcgugaagaaa

SEQ ID NO: 473697 - RNA, 19 nt, Homo sapiens
ccucauucugcauuaauaa

SEQ ID NO: 473698 - RNA, 19 nt, Homo sapiens
ccaggaaugcguccaccaa

SEQ ID NO: 473699 - RNA, 19 nt, Homo sapiens
ugcagcacauugacuauag

SEQ ID NO: 473700 - RNA, 19 nt, Homo sapiens
gcgggcaagggaucgcuua

SEQ ID NO: 473701 - RNA, 19 nt, Homo sapiens
caccaagaccuuagcauac

SEQ ID NO: 473702 - RNA, 19 nt, Homo sapiens
ccugcaagauggccgaauc

SEQ ID NO: 473703 - RNA, 19 nt, Homo sapiens
cuugugaaauuguguagag

SEQ ID NO: 473704 - RNA, 19 nt, Homo sapiens
ggcagcugguagaggagua

SEQ ID NO: 473705 - RNA, 19 nt, Homo sapiens
cauagagcaauuaaacugu

SEQ ID NO: 473706 - RNA, 19 nt, Homo sapiens
ccaaagauacuggcauugc

SEQ ID NO: 473707 - RNA, 19 nt, Homo sapiens
cauuggauuugguggaaca

SEQ ID NO: 473708 - RNA, 19 nt, Homo sapiens
agaaggacugccucacuga

SEQ ID NO: 473709 - RNA, 19 nt, Homo sapiens
acugaggcaggcauucuua

SEQ ID NO: 473710 - RNA, 19 nt, Homo sapiens
gaauuugauccucugugau

SEQ ID NO: 473711 - RNA, 19 nt, Homo sapiens
ggugguuaaagccauauug

SEQ ID NO: 473712 - RNA, 19 nt, Homo sapiens
cagggaagaggcacuguag

SEQ ID NO: 473713 - RNA, 19 nt, Homo sapiens
ugauugugaugaguucaga

SEQ ID NO: 473714 - RNA, 19 nt, Homo sapiens
uuacaccugagacgaacua

SEQ ID NO: 473715 - RNA, 19 nt, Homo sapiens
guucucagcagcagcaagu

SEQ ID NO: 473716 - RNA, 19 nt, Homo sapiens
gaaucuucauuggcaccuu

SEQ ID NO: 473717 - RNA, 19 nt, Homo sapiens
cagcacauugacuauagaa

SEQ ID NO: 473718 - RNA, 19 nt, Homo sapiens
aagaucaagccaaagaaug

SEQ ID NO: 473719 - RNA, 19 nt, Homo sapiens
ggauuugguggaacagcaa

SEQ ID NO: 473720 - RNA, 19 nt, Homo sapiens
gaaauuguguagaguguuu

SEQ ID NO: 473721 - RNA, 19 nt, Homo sapiens
cgucauaccuuuaucuaua

SEQ ID NO: 473722 - RNA, 19 nt, Homo sapiens
ucagaaagaucaagccaaa

SEQ ID NO: 473723 - RNA, 19 nt, Homo sapiens
caagaacacuuaacagcuu

SEQ ID NO: 473724 - RNA, 19 nt, Homo sapiens
gaacucagaaggcaacauu

SEQ ID NO: 473725 - RNA, 19 nt, Homo sapiens
caaugcgucuugugaaauu

SEQ ID NO: 473726 - RNA, 19 nt, Homo sapiens
gcaaguaccugugguggau

SEQ ID NO: 473727 - RNA, 19 nt, Homo sapiens
cuuaacagcuucaggcuuu

SEQ ID NO: 473728 - RNA, 19 nt, Homo sapiens
ugaauuugauccucuguga

SEQ ID NO: 473729 - RNA, 19 nt, Homo sapiens
gaaucuacuuucucuuaug

SEQ ID NO: 473730 - RNA, 19 nt, Homo sapiens
gaccuuagcauacuguuga

SEQ ID NO: 473731 - RNA, 19 nt, Homo sapiens
ccaccaagaccuuagcaua

SEQ ID NO: 473732 - RNA, 19 nt, Homo sapiens
uuaaagccauauuggagua

SEQ ID NO: 473733 - RNA, 19 nt, Homo sapiens
gcacuucuccagcauaugu

SEQ ID NO: 473734 - RNA, 19 nt, Homo sapiens
ugagauguauccugcaaga

SEQ ID NO: 473735 - RNA, 19 nt, Homo sapiens
gcauagagcaauuaaacug

SEQ ID NO: 473736 - RNA, 19 nt, Homo sapiens
gaaagaucaagccaaagaa

SEQ ID NO: 473737 - RNA, 19 nt, Homo sapiens
gacuauagaaugagaugua

SEQ ID NO: 473738 - RNA, 19 nt, Homo sapiens
ucagaagcaucaaguuuua

SEQ ID NO: 473739 - RNA, 19 nt, Homo sapiens
gacauuggauuugguggaa

SEQ ID NO: 473740 - RNA, 19 nt, Homo sapiens
gggcacuucuccagcauau

SEQ ID NO: 473741 - RNA, 19 nt, Homo sapiens
cugaaucuacuuucucuua

SEQ ID NO: 473742 - RNA, 19 nt, Homo sapiens
ugacaagcauaugaauuug

SEQ ID NO: 473743 - RNA, 19 nt, Homo sapiens
gaaggcaacauucccugaa

SEQ ID NO: 473744 - RNA, 19 nt, Homo sapiens
gcaaccagagcgugaagaa

SEQ ID NO: 473745 - RNA, 19 nt, Homo sapiens
agaaagaucaagccaaaga

SEQ ID NO: 473746 - RNA, 19 nt, Homo sapiens
gcagcacauugacuauaga

SEQ ID NO: 473747 - RNA, 19 nt, Homo sapiens
gcaacauucccugaacaua

SEQ ID NO: 473748 - RNA, 19 nt, Homo sapiens
cagcuugcauuguuucuag

SEQ ID NO: 473749 - RNA, 19 nt, Homo sapiens
gcacguaccagagguggaa

SEQ ID NO: 473750 - RNA, 19 nt, Homo sapiens
gagacgaacuacagaacag

SEQ ID NO: 473751 - RNA, 19 nt, Homo sapiens
caacauucccugaacauac

SEQ ID NO: 473752 - RNA, 19 nt, Homo sapiens
guagaguguuugugagcuu

SEQ ID NO: 473753 - RNA, 19 nt, Homo sapiens
ugugaugaguucagaaaga

SEQ ID NO: 473754 - RNA, 19 nt, Homo sapiens
gugaaauuguguagagugu

SEQ ID NO: 473755 - RNA, 19 nt, Homo sapiens
caaagauacuggcauugcu

SEQ ID NO: 473756 - RNA, 19 nt, Homo sapiens
gugaugaguucagaaagau

SEQ ID NO: 473757 - RNA, 19 nt, Homo sapiens
ggaguagcgaggaaucuga

SEQ ID NO: 473758 - RNA, 19 nt, Homo sapiens
ugcaaugcgucuugugaaa

SEQ ID NO: 473759 - RNA, 19 nt, Homo sapiens
agaggugguuaaagccaua

SEQ ID NO: 473760 - RNA, 19 nt, Homo sapiens
gaacugaggcaggcauucu

SEQ ID NO: 473761 - RNA, 19 nt, Homo sapiens
gacaagcauaugaauuuga

SEQ ID NO: 473762 - RNA, 19 nt, Homo sapiens
caagucaaacgcagaagga

SEQ ID NO: 473763 - RNA, 19 nt, Homo sapiens
guucccucauucugcauua

SEQ ID NO: 473764 - RNA, 19 nt, Homo sapiens
gcaaugcgucuugugaaau

SEQ ID NO: 473765 - RNA, 19 nt, Homo sapiens
gggaagaggcacuguagca

SEQ ID NO: 473766 - RNA, 19 nt, Homo sapiens
gggagaacuugguauccau

SEQ ID NO: 473767 - RNA, 19 nt, Homo sapiens
gaugaguucagaaagauca

SEQ ID NO: 473768 - RNA, 19 nt, Homo sapiens
gauccucugugauugugau

SEQ ID NO: 473769 - RNA, 19 nt, Homo sapiens
aaucuucauuggcaccuuu

SEQ ID NO: 473770 - RNA, 19 nt, Homo sapiens
gguggaacagcaaucauga

SEQ ID NO: 473771 - RNA, 19 nt, Homo sapiens
gaacuugguauccaugacu

SEQ ID NO: 473772 - RNA, 19 nt, Homo sapiens
gucauaccuuuaucuauag

SEQ ID NO: 473773 - RNA, 19 nt, Homo sapiens
ucaagucuccacacagcua

SEQ ID NO: 473774 - RNA, 19 nt, Homo sapiens
cccaugggcccaccaauug

SEQ ID NO: 473775 - RNA, 19 nt, Homo sapiens
ggaccaucccagcagguaa

SEQ ID NO: 473776 - RNA, 19 nt, Homo sapiens
aaugagauguauccugcaa

SEQ ID NO: 473777 - RNA, 19 nt, Homo sapiens
cugcccagcuugcauuguu

SEQ ID NO: 473778 - RNA, 19 nt, Homo sapiens
ccaccagaaucuccucuac

SEQ ID NO: 473779 - RNA, 19 nt, Homo sapiens
aauuugauccucugugauu

SEQ ID NO: 473780 - RNA, 19 nt, Homo sapiens
uaacuguggacauuggauu

SEQ ID NO: 473781 - RNA, 19 nt, Homo sapiens
aggaaugcguccaccaaga

SEQ ID NO: 473782 - RNA, 19 nt, Homo sapiens
gagaacuugguauccauga

SEQ ID NO: 473783 - RNA, 19 nt, Homo sapiens
gaagcaaccagagcgugaa

SEQ ID NO: 473784 - RNA, 19 nt, Homo sapiens
gccaaagaaugcgaagcaa

SEQ ID NO: 473785 - RNA, 19 nt, Homo sapiens
gauggccgaaucuucauug

SEQ ID NO: 473786 - RNA, 19 nt, Homo sapiens
ucauucugcuugcugauca

SEQ ID NO: 473787 - RNA, 19 nt, Homo sapiens
ucacugagcaaccaagagu

SEQ ID NO: 473788 - RNA, 19 nt, Homo sapiens
gcauacuguugauccaucu

SEQ ID NO: 473789 - RNA, 19 nt, Homo sapiens
ccaagaccuuagcauacug

SEQ ID NO: 473790 - RNA, 19 nt, Homo sapiens
agauguauccugcaagaug

SEQ ID NO: 473791 - RNA, 19 nt, Homo sapiens
aaucuacuuucucuuaugg

SEQ ID NO: 473792 - RNA, 19 nt, Homo sapiens
uagaguguuugugagcuuu

SEQ ID NO: 473793 - RNA, 19 nt, Homo sapiens
gcugaucaagaacacuuaa

SEQ ID NO: 473794 - RNA, 19 nt, Homo sapiens
ggaaugcguccaccaagac

SEQ ID NO: 473795 - RNA, 19 nt, Homo sapiens
gaucaagaacacuuaacag

SEQ ID NO: 473796 - RNA, 19 nt, Homo sapiens
aaagaucaagccaaagaau

SEQ ID NO: 473797 - RNA, 19 nt, Homo sapiens
uggcaagaguagcaagaug

SEQ ID NO: 473798 - RNA, 19 nt, Homo sapiens
aaguaccugugguggauuu

SEQ ID NO: 473799 - RNA, 19 nt, Homo sapiens
cccucauucugcauuaaua

SEQ ID NO: 473800 - RNA, 19 nt, Homo sapiens
gcucgagggacgccaauag

SEQ ID NO: 473801 - RNA, 19 nt, Homo sapiens
gaccaucccagcagguaau

SEQ ID NO: 473802 - RNA, 19 nt, Homo sapiens
caaccagagcgugaagaaa

SEQ ID NO: 473803 - RNA, 19 nt, Homo sapiens
ccucauucugcauuaauaa

SEQ ID NO: 473804 - RNA, 19 nt, Homo sapiens
aggcuuuccugauacuuug

SEQ ID NO: 473805 - RNA, 19 nt, Homo sapiens
ccaggaaugcguccaccaa

SEQ ID NO: 473806 - RNA, 19 nt, Homo sapiens
ugcagcacauugacuauag

SEQ ID NO: 473807 - RNA, 19 nt, Homo sapiens
ggcugaaucuacuuucucu

SEQ ID NO: 473808 - RNA, 19 nt, Homo sapiens
caccaagaccuuagcauac

SEQ ID NO: 473809 - RNA, 19 nt, Homo sapiens
ccugcaagauggccgaauc

SEQ ID NO: 473810 - RNA, 19 nt, Homo sapiens
cuugugaaauuguguagag

SEQ ID NO: 473811 - RNA, 19 nt, Homo sapiens
ggcagcugguagaggagua

SEQ ID NO: 473812 - RNA, 19 nt, Homo sapiens
gauacuuugacgaagguaa

SEQ ID NO: 473813 - RNA, 19 nt, Homo sapiens
gcuuuucucuccagucauu

SEQ ID NO: 473814 - RNA, 19 nt, Homo sapiens
cauagagcaauuaaacugu

SEQ ID NO: 473815 - RNA, 19 nt, Homo sapiens
ccaaagauacuggcauugc

SEQ ID NO: 473816 - RNA, 19 nt, Homo sapiens
cauuggauuugguggaaca

SEQ ID NO: 473817 - RNA, 19 nt, Homo sapiens
gaauuugauccucugugau

SEQ ID NO: 473818 - RNA, 19 nt, Homo sapiens
acugaggcaggcauucuua

SEQ ID NO: 473819 - RNA, 19 nt, Homo sapiens
agaaggacugccucacuga

SEQ ID NO: 473820 - RNA, 19 nt, Homo sapiens
gaaauuguguagaguguuu

SEQ ID NO: 473821 - RNA, 19 nt, Homo sapiens
cgucauaccuuuaucuaua

SEQ ID NO: 473822 - RNA, 19 nt, Homo sapiens
ucagaaagaucaagccaaa

SEQ ID NO: 473823 - RNA, 19 nt, Homo sapiens
gaacucagaaggcaacauu

SEQ ID NO: 473824 - RNA, 19 nt, Homo sapiens
caaugcgucuugugaaauu

SEQ ID NO: 473825 - RNA, 19 nt, Homo sapiens
gcaaguaccugugguggau

SEQ ID NO: 473826 - RNA, 19 nt, Homo sapiens
ugaauuugauccucuguga

SEQ ID NO: 473827 - RNA, 19 nt, Homo sapiens
gaaucuacuuucucuuaug

SEQ ID NO: 473828 - RNA, 19 nt, Homo sapiens
caaugacaccuuccugaua

SEQ ID NO: 473829 - RNA, 19 nt, Homo sapiens
gaccuuagcauacuguuga

SEQ ID NO: 473830 - RNA, 19 nt, Homo sapiens
ccaccaagaccuuagcaua

SEQ ID NO: 473831 - RNA, 19 nt, Homo sapiens
uguggucgcugaucaauga

SEQ ID NO: 473832 - RNA, 19 nt, Homo sapiens
uuaaagccauauuggagua

SEQ ID NO: 473833 - RNA, 19 nt, Homo sapiens
gcacuucuccagcauaugu

SEQ ID NO: 473834 - RNA, 19 nt, Homo sapiens
ugagauguauccugcaaga

SEQ ID NO: 473835 - RNA, 19 nt, Homo sapiens
uaacuguggucgcugauca

SEQ ID NO: 473836 - RNA, 19 nt, Homo sapiens
gcauagagcaauuaaacug

SEQ ID NO: 473837 - RNA, 19 nt, Homo sapiens
gaaagaucaagccaaagaa

SEQ ID NO: 473838 - RNA, 19 nt, Homo sapiens
gacuauagaaugagaugua

SEQ ID NO: 473839 - RNA, 19 nt, Homo sapiens
ucagaagcaucaaguuuua

SEQ ID NO: 473840 - RNA, 19 nt, Homo sapiens
gacauuggauuugguggaa

SEQ ID NO: 473841 - RNA, 19 nt, Homo sapiens
gggcacuucuccagcauau

SEQ ID NO: 473842 - RNA, 19 nt, Homo sapiens
cugaaucuacuuucucuua

SEQ ID NO: 473843 - RNA, 19 nt, Homo sapiens
ugacaagcauaugaauuug

SEQ ID NO: 473844 - RNA, 19 nt, Homo sapiens
gaaggcaacauucccugaa

SEQ ID NO: 473845 - RNA, 19 nt, Homo sapiens
gcaaccagagcgugaagaa

SEQ ID NO: 473846 - RNA, 19 nt, Homo sapiens
agaaagaucaagccaaaga

SEQ ID NO: 473847 - RNA, 19 nt, Homo sapiens
gcagcacauugacuauaga

SEQ ID NO: 473848 - RNA, 19 nt, Homo sapiens
gcaacauucccugaacaua

SEQ ID NO: 473849 - RNA, 19 nt, Homo sapiens
cagcuugcauuguuucuag

SEQ ID NO: 473850 - RNA, 19 nt, Homo sapiens
gcacguaccagagguggaa

SEQ ID NO: 473851 - RNA, 19 nt, Homo sapiens
gagacgaacuacagaacag

SEQ ID NO: 473852 - RNA, 19 nt, Homo sapiens
caacauucccugaacauac

SEQ ID NO: 473853 - RNA, 19 nt, Homo sapiens
guagaguguuugugagcuu

SEQ ID NO: 473854 - RNA, 19 nt, Homo sapiens
ugugaugaguucagaaaga

SEQ ID NO: 473855 - RNA, 19 nt, Homo sapiens
gugaaauuguguagagugu

SEQ ID NO: 473856 - RNA, 19 nt, Homo sapiens
caaagauacuggcauugcu

SEQ ID NO: 473857 - RNA, 19 nt, Homo sapiens
gugaugaguucagaaagau

SEQ ID NO: 473858 - RNA, 19 nt, Homo sapiens
ggaguagcgaggaaucuga

SEQ ID NO: 473859 - RNA, 19 nt, Homo sapiens
ugcaaugcgucuugugaaa

SEQ ID NO: 473860 - RNA, 19 nt, Homo sapiens
agaggugguuaaagccaua

SEQ ID NO: 473861 - RNA, 19 nt, Homo sapiens
gaacugaggcaggcauucu

SEQ ID NO: 473862 - RNA, 19 nt, Homo sapiens
gacaagcauaugaauuuga

SEQ ID NO: 473863 - RNA, 19 nt, Homo sapiens
caagucaaacgcagaagga

SEQ ID NO: 473864 - RNA, 19 nt, Homo sapiens
guucccucauucugcauua

SEQ ID NO: 473865 - RNA, 19 nt, Homo sapiens
gcaaugcgucuugugaaau

SEQ ID NO: 473866 - RNA, 19 nt, Homo sapiens
gggaagaggcacuguagca

SEQ ID NO: 473867 - RNA, 19 nt, Homo sapiens
gggagaacuugguauccau

SEQ ID NO: 473868 - RNA, 19 nt, Homo sapiens
gaugaguucagaaagauca

SEQ ID NO: 473869 - RNA, 19 nt, Homo sapiens
gauccucugugauugugau

SEQ ID NO: 473870 - RNA, 19 nt, Homo sapiens
aaucuucauuggcaccuuu

SEQ ID NO: 473871 - RNA, 19 nt, Homo sapiens
aaugacaccuuccugauac

SEQ ID NO: 473872 - RNA, 19 nt, Homo sapiens
gguggaacagcaaucauga

SEQ ID NO: 473873 - RNA, 19 nt, Homo sapiens
acaccuuccugauacuuug

SEQ ID NO: 473874 - RNA, 19 nt, Homo sapiens
gaacuugguauccaugacu

SEQ ID NO: 473875 - RNA, 19 nt, Homo sapiens
ucaagucuccacacagcua

SEQ ID NO: 473876 - RNA, 19 nt, Homo sapiens
gucauaccuuuaucuauag

SEQ ID NO: 473877 - RNA, 19 nt, Homo sapiens
cccaugggcccaccaauug

SEQ ID NO: 473878 - RNA, 19 nt, Homo sapiens
ggaccaucccagcagguaa

SEQ ID NO: 473879 - RNA, 19 nt, Homo sapiens
aaugagauguauccugcaa

SEQ ID NO: 473880 - RNA, 19 nt, Homo sapiens
cugcccagcuugcauuguu

SEQ ID NO: 473881 - RNA, 19 nt, Homo sapiens
ccaccagaaucuccucuac

SEQ ID NO: 473882 - RNA, 19 nt, Homo sapiens
aauuugauccucugugauu

SEQ ID NO: 473883 - RNA, 19 nt, Homo sapiens
uaacuguggacauuggauu

SEQ ID NO: 473884 - RNA, 19 nt, Homo sapiens
aggaaugcguccaccaaga

SEQ ID NO: 473885 - RNA, 19 nt, Homo sapiens
gagaacuugguauccauga

SEQ ID NO: 473886 - RNA, 19 nt, Homo sapiens
gaagcaaccagagcgugaa

SEQ ID NO: 473887 - RNA, 19 nt, Homo sapiens
gccaaagaaugcgaagcaa

SEQ ID NO: 473888 - RNA, 19 nt, Homo sapiens
gauggccgaaucuucauug

SEQ ID NO: 473889 - RNA, 19 nt, Homo sapiens
ucacugagcaaccaagagu

SEQ ID NO: 473890 - RNA, 19 nt, Homo sapiens
gcauacuguugauccaucu

SEQ ID NO: 473891 - RNA, 19 nt, Homo sapiens
ccaagaccuuagcauacug

SEQ ID NO: 473892 - RNA, 19 nt, Homo sapiens
agauguauccugcaagaug

SEQ ID NO: 473893 - RNA, 19 nt, Homo sapiens
aaucuacuuucucuuaugg

SEQ ID NO: 473894 - RNA, 19 nt, Homo sapiens
uagaguguuugugagcuuu

SEQ ID NO: 473895 - RNA, 19 nt, Homo sapiens
ggaaugcguccaccaagac

SEQ ID NO: 473896 - RNA, 19 nt, Homo sapiens
aaagaucaagccaaagaau

SEQ ID NO: 473897 - RNA, 19 nt, Homo sapiens
uggcaagaguagcaagaug

SEQ ID NO: 473898 - RNA, 19 nt, Homo sapiens
aaguaccugugguggauuu

SEQ ID NO: 473899 - RNA, 19 nt, Homo sapiens
cccucauucugcauuaaua

SEQ ID NO: 473900 - RNA, 19 nt, Homo sapiens
gcucgagggacgccaauag

SEQ ID NO: 473901 - RNA, 19 nt, Homo sapiens
gaccaucccagcagguaau

SEQ ID NO: 473902 - RNA, 19 nt, Homo sapiens
caaccagagcgugaagaaa

SEQ ID NO: 473903 - RNA, 19 nt, Homo sapiens
ccucauucugcauuaauaa

SEQ ID NO: 473904 - RNA, 19 nt, Homo sapiens
ccaggaaugcguccaccaa

SEQ ID NO: 473905 - RNA, 19 nt, Homo sapiens
gacaccuuccugauacuuu

SEQ ID NO: 473906 - RNA, 19 nt, Homo sapiens
ugcagcacauugacuauag

SEQ ID NO: 473907 - RNA, 19 nt, Homo sapiens
ggcugaaucuacuuucucu

SEQ ID NO: 473908 - RNA, 19 nt, Homo sapiens
caccaagaccuuagcauac

SEQ ID NO: 473909 - RNA, 19 nt, Homo sapiens
ccugcaagauggccgaauc

SEQ ID NO: 473910 - RNA, 19 nt, Homo sapiens
ucaaugacaccuuccugau

SEQ ID NO: 473911 - RNA, 19 nt, Homo sapiens
cuugugaaauuguguagag

SEQ ID NO: 473912 - RNA, 19 nt, Homo sapiens
ggcagcugguagaggagua

SEQ ID NO: 473913 - RNA, 19 nt, Homo sapiens
gauacuuugacgaagguaa

SEQ ID NO: 473914 - RNA, 19 nt, Homo sapiens
cauagagcaauuaaacugu

SEQ ID NO: 473915 - RNA, 19 nt, Homo sapiens
ccaaagauacuggcauugc

SEQ ID NO: 473916 - RNA, 19 nt, Homo sapiens
cauuggauuugguggaaca

SEQ ID NO: 473917 - RNA, 19 nt, Homo sapiens
gaauuugauccucugugau

SEQ ID NO: 473918 - RNA, 19 nt, Homo sapiens
acugaggcaggcauucuua

SEQ ID NO: 473919 - RNA, 19 nt, Homo sapiens
agaaggacugccucacuga

SEQ ID NO: 473920 - RNA, 19 nt, Homo sapiens
gaaauuguguagaguguuu

SEQ ID NO: 473921 - RNA, 19 nt, Homo sapiens
cgucauaccuuuaucuaua

SEQ ID NO: 473922 - RNA, 19 nt, Homo sapiens
ucagaaagaucaagccaaa

SEQ ID NO: 473923 - RNA, 19 nt, Homo sapiens
gaacucagaaggcaacauu

SEQ ID NO: 473924 - RNA, 19 nt, Homo sapiens
caaugcgucuugugaaauu

SEQ ID NO: 473925 - RNA, 19 nt, Homo sapiens
gcaaguaccugugguggau

SEQ ID NO: 473926 - RNA, 19 nt, Homo sapiens
gcaaacugcaaaugagaua

SEQ ID NO: 473927 - RNA, 19 nt, Homo sapiens
ugaauuugauccucuguga

SEQ ID NO: 473928 - RNA, 19 nt, Homo sapiens
gaaucuacuuucucuuaug

SEQ ID NO: 473929 - RNA, 19 nt, Homo sapiens
gaccuuagcauacuguuga

SEQ ID NO: 473930 - RNA, 19 nt, Homo sapiens
ccaccaagaccuuagcaua

SEQ ID NO: 473931 - RNA, 19 nt, Homo sapiens
uguggucgcugaucaauga

SEQ ID NO: 473932 - RNA, 19 nt, Homo sapiens
uuaaagccauauuggagua

SEQ ID NO: 473933 - RNA, 19 nt, Homo sapiens
gcacuucuccagcauaugu

SEQ ID NO: 473934 - RNA, 19 nt, Homo sapiens
aaugacaccuuccugguaa

SEQ ID NO: 473935 - RNA, 19 nt, Homo sapiens
ugagauguauccugcaaga

SEQ ID NO: 473936 - RNA, 19 nt, Homo sapiens
uaacuguggucgcugauca

SEQ ID NO: 473937 - RNA, 19 nt, Homo sapiens
gcauagagcaauuaaacug

SEQ ID NO: 473938 - RNA, 19 nt, Homo sapiens
gaaagaucaagccaaagaa

SEQ ID NO: 473939 - RNA, 19 nt, Homo sapiens
gacuauagaaugagaugua

SEQ ID NO: 473940 - RNA, 19 nt, Homo sapiens
ucagaagcaucaaguuuua

SEQ ID NO: 473941 - RNA, 19 nt, Homo sapiens
cugguaacauuucauauug

SEQ ID NO: 473942 - RNA, 19 nt, Homo sapiens
gacauuggauuugguggaa

SEQ ID NO: 473943 - RNA, 19 nt, Homo sapiens
gggcacuucuccagcauau

SEQ ID NO: 473944 - RNA, 19 nt, Homo sapiens
cugaaucuacuuucucuua

SEQ ID NO: 473945 - RNA, 19 nt, Homo sapiens
caaugacaccuuccuggua

SEQ ID NO: 473946 - RNA, 19 nt, Homo sapiens
ugacaagcauaugaauuug

SEQ ID NO: 473947 - RNA, 19 nt, Homo sapiens
gaaggcaacauucccugaa

SEQ ID NO: 473948 - RNA, 19 nt, Homo sapiens
gcaaccagagcgugaagaa

SEQ ID NO: 473949 - RNA, 19 nt, Homo sapiens
agaaagaucaagccaaaga

SEQ ID NO: 473950 - RNA, 19 nt, Homo sapiens
gcagcacauugacuauaga

SEQ ID NO: 473951 - RNA, 19 nt, Homo sapiens
gcaacauucccugaacaua

SEQ ID NO: 473952 - RNA, 19 nt, Homo sapiens
gagagcauccuaacagcaa

SEQ ID NO: 473953 - RNA, 19 nt, Homo sapiens
cagcuugcauuguuucuag

SEQ ID NO: 473954 - RNA, 19 nt, Homo sapiens
gcacguaccagagguggaa

SEQ ID NO: 473955 - RNA, 19 nt, Homo sapiens
gagacgaacuacagaacag

SEQ ID NO: 473956 - RNA, 19 nt, Homo sapiens
caacauucccugaacauac

SEQ ID NO: 473957 - RNA, 19 nt, Homo sapiens
gagauacuuugacgaaggu

SEQ ID NO: 473958 - RNA, 19 nt, Homo sapiens
guagaguguuugugagcuu

SEQ ID NO: 473959 - RNA, 19 nt, Homo sapiens
ugugaugaguucagaaaga

SEQ ID NO: 473960 - RNA, 19 nt, Homo sapiens
gugaaauuguguagagugu

SEQ ID NO: 473961 - RNA, 19 nt, Homo sapiens
acaccuuccugguaacauu

SEQ ID NO: 473962 - RNA, 19 nt, Homo sapiens
caaagauacuggcauugcu

SEQ ID NO: 473963 - RNA, 19 nt, Homo sapiens
gugaugaguucagaaagau

SEQ ID NO: 473964 - RNA, 19 nt, Homo sapiens
ggaguagcgaggaaucuga

SEQ ID NO: 473965 - RNA, 19 nt, Homo sapiens
ugcaaugcgucuugugaaa

SEQ ID NO: 473966 - RNA, 19 nt, Homo sapiens
agaggugguuaaagccaua

SEQ ID NO: 473967 - RNA, 19 nt, Homo sapiens
gaacugaggcaggcauucu

SEQ ID NO: 473968 - RNA, 19 nt, Homo sapiens
gacaagcauaugaauuuga

SEQ ID NO: 473969 - RNA, 19 nt, Homo sapiens
caagucaaacgcagaagga

SEQ ID NO: 473970 - RNA, 19 nt, Homo sapiens
guucccucauucugcauua

SEQ ID NO: 473971 - RNA, 19 nt, Homo sapiens
gcaaugcgucuugugaaau

SEQ ID NO: 473972 - RNA, 19 nt, Homo sapiens
gggaagaggcacuguagca

SEQ ID NO: 473973 - RNA, 19 nt, Homo sapiens
gggagaacuugguauccau

SEQ ID NO: 473974 - RNA, 19 nt, Homo sapiens
gaugaguucagaaagauca

SEQ ID NO: 473975 - RNA, 19 nt, Homo sapiens
gauccucugugauugugau

SEQ ID NO: 473976 - RNA, 19 nt, Homo sapiens
aaucuucauuggcaccuuu

SEQ ID NO: 473977 - RNA, 19 nt, Homo sapiens
ccugguaacauuucauauu

SEQ ID NO: 473978 - RNA, 19 nt, Homo sapiens
gguggaacagcaaucauga

SEQ ID NO: 473979 - RNA, 19 nt, Homo sapiens
gcucaccaccaccugauga

SEQ ID NO: 473980 - RNA, 19 nt, Homo sapiens
gaacuugguauccaugacu

SEQ ID NO: 473981 - RNA, 19 nt, Homo sapiens
gucauaccuuuaucuauag

SEQ ID NO: 473982 - RNA, 19 nt, Homo sapiens
gguaacauuucauauugcu

SEQ ID NO: 473983 - RNA, 19 nt, Homo sapiens
ucaagucuccacacagcua

SEQ ID NO: 473984 - RNA, 19 nt, Homo sapiens
uaacagcaaacugcaaaug

SEQ ID NO: 473985 - RNA, 19 nt, Homo sapiens
ggugagagcauccuaacag

SEQ ID NO: 473986 - RNA, 19 nt, Homo sapiens
aaugagauacuuugacgaa

SEQ ID NO: 473987 - RNA, 19 nt, Homo sapiens
cccaugggcccaccaauug

SEQ ID NO: 473988 - RNA, 19 nt, Homo sapiens
ggaccaucccagcagguaa

SEQ ID NO: 473989 - RNA, 19 nt, Homo sapiens
aaugagauguauccugcaa

SEQ ID NO: 473990 - RNA, 19 nt, Homo sapiens
cugcccagcuugcauuguu

SEQ ID NO: 473991 - RNA, 19 nt, Homo sapiens
ccaccagaaucuccucuac

SEQ ID NO: 473992 - RNA, 19 nt, Homo sapiens
aauuugauccucugugauu

SEQ ID NO: 473993 - RNA, 19 nt, Homo sapiens
ccuaacagcaaacugcaaa

SEQ ID NO: 473994 - RNA, 19 nt, Homo sapiens
uaacuguggacauuggauu

SEQ ID NO: 473995 - RNA, 19 nt, Homo sapiens
cagcaaacugcaaaugaga

SEQ ID NO: 473996 - RNA, 19 nt, Homo sapiens
acagcaaacugcaaaugag

SEQ ID NO: 473997 - RNA, 19 nt, Homo sapiens
guaagugggaucuguggau

SEQ ID NO: 473998 - RNA, 19 nt, Homo sapiens
aggaaugcguccaccaaga

SEQ ID NO: 473999 - RNA, 19 nt, Homo sapiens
gagaacuugguauccauga

SEQ ID NO: 474000 - RNA, 19 nt, Homo sapiens
gaagcaaccagagcgugaa

SEQ ID NO: 474001 - RNA, 19 nt, Homo sapiens
gccaaagaaugcgaagcaa

SEQ ID NO: 474002 - RNA, 19 nt, Homo sapiens
gauggccgaaucuucauug

SEQ ID NO: 474003 - RNA, 19 nt, Homo sapiens
ucacugagcaaccaagagu

SEQ ID NO: 474004 - RNA, 19 nt, Homo sapiens
gcauacuguugauccaucu

SEQ ID NO: 474005 - RNA, 19 nt, Homo sapiens
ccaagaccuuagcauacug

SEQ ID NO: 474006 - RNA, 19 nt, Homo sapiens
agauguauccugcaagaug

SEQ ID NO: 474007 - RNA, 19 nt, Homo sapiens
aaucuacuuucucuuaugg

SEQ ID NO: 474008 - RNA, 19 nt, Homo sapiens
uagaguguuugugagcuuu

SEQ ID NO: 474009 - RNA, 19 nt, Homo sapiens
ggaaugcguccaccaagac

SEQ ID NO: 474010 - RNA, 19 nt, Homo sapiens
aaagaucaagccaaagaau

SEQ ID NO: 474011 - RNA, 19 nt, Homo sapiens
uggcaagaguagcaagaug

SEQ ID NO: 474012 - RNA, 19 nt, Homo sapiens
aaguaccugugguggauuu

SEQ ID NO: 474013 - RNA, 19 nt, Homo sapiens
cccucauucugcauuaaua

SEQ ID NO: 474014 - RNA, 19 nt, Homo sapiens
gcucgagggacgccaauag

SEQ ID NO: 474015 - RNA, 19 nt, Homo sapiens
gaccaucccagcagguaau

SEQ ID NO: 474016 - RNA, 19 nt, Homo sapiens
caaccagagcgugaagaaa

SEQ ID NO: 474017 - RNA, 19 nt, Homo sapiens
ccucauucugcauuaauaa

SEQ ID NO: 474018 - RNA, 19 nt, Homo sapiens
ccaggaaugcguccaccaa

SEQ ID NO: 474019 - RNA, 19 nt, Homo sapiens
ugcagcacauugacuauag

SEQ ID NO: 474020 - RNA, 19 nt, Homo sapiens
gaaauuguguagaguguuu

SEQ ID NO: 474021 - RNA, 19 nt, Homo sapiens
cgucauaccuuuaucuaua

SEQ ID NO: 474022 - RNA, 19 nt, Homo sapiens
ucagaaagaucaagccaaa

SEQ ID NO: 474023 - RNA, 19 nt, Homo sapiens
gaacucagaaggcaacauu

SEQ ID NO: 474024 - RNA, 19 nt, Homo sapiens
caaugcgucuugugaaauu

SEQ ID NO: 474025 - RNA, 19 nt, Homo sapiens
gcaaguaccugugguggau

SEQ ID NO: 474026 - RNA, 19 nt, Homo sapiens
ugaauuugauccucuguga

SEQ ID NO: 474027 - RNA, 19 nt, Homo sapiens
gaaucuacuuucucuuaug

SEQ ID NO: 474028 - RNA, 19 nt, Homo sapiens
gaccuuagcauacuguuga

SEQ ID NO: 474029 - RNA, 19 nt, Homo sapiens
ccaccaagaccuuagcaua

SEQ ID NO: 474030 - RNA, 19 nt, Homo sapiens
uguggucgcugaucaauga

SEQ ID NO: 474031 - RNA, 19 nt, Homo sapiens
uuaaagccauauuggagua

SEQ ID NO: 474032 - RNA, 19 nt, Homo sapiens
gcacuucuccagcauaugu

SEQ ID NO: 474033 - RNA, 19 nt, Homo sapiens
aaugacaccuuccugguaa

SEQ ID NO: 474034 - RNA, 19 nt, Homo sapiens
ugagauguauccugcaaga

SEQ ID NO: 474035 - RNA, 19 nt, Homo sapiens
uaacuguggucgcugauca

SEQ ID NO: 474036 - RNA, 19 nt, Homo sapiens
gcauagagcaauuaaacug

SEQ ID NO: 474037 - RNA, 19 nt, Homo sapiens
gaaagaucaagccaaagaa

SEQ ID NO: 474038 - RNA, 19 nt, Homo sapiens
gacuauagaaugagaugua

SEQ ID NO: 474039 - RNA, 19 nt, Homo sapiens
ucagaagcaucaaguuuua

SEQ ID NO: 474040 - RNA, 19 nt, Homo sapiens
cugguaacauuucauauug

SEQ ID NO: 474041 - RNA, 19 nt, Homo sapiens
gacauuggauuugguggaa

SEQ ID NO: 474042 - RNA, 19 nt, Homo sapiens
gggcacuucuccagcauau

SEQ ID NO: 474043 - RNA, 19 nt, Homo sapiens
cugaaucuacuuucucuua

SEQ ID NO: 474044 - RNA, 19 nt, Homo sapiens
caaugacaccuuccuggua

SEQ ID NO: 474045 - RNA, 19 nt, Homo sapiens
ugacaagcauaugaauuug

SEQ ID NO: 474046 - RNA, 19 nt, Homo sapiens
gaaggcaacauucccugaa

SEQ ID NO: 474047 - RNA, 19 nt, Homo sapiens
gcaaccagagcgugaagaa

SEQ ID NO: 474048 - RNA, 19 nt, Homo sapiens
agaaagaucaagccaaaga

SEQ ID NO: 474049 - RNA, 19 nt, Homo sapiens
gcagcacauugacuauaga

SEQ ID NO: 474050 - RNA, 19 nt, Homo sapiens
gcaacauucccugaacaua

SEQ ID NO: 474051 - RNA, 19 nt, Homo sapiens
cagcuugcauuguuucuag

SEQ ID NO: 474052 - RNA, 19 nt, Homo sapiens
gcacguaccagagguggaa

SEQ ID NO: 474053 - RNA, 19 nt, Homo sapiens
gagacgaacuacagaacag

SEQ ID NO: 474054 - RNA, 19 nt, Homo sapiens
caacauucccugaacauac

SEQ ID NO: 474055 - RNA, 19 nt, Homo sapiens
gagauacuuugacgaaggu

SEQ ID NO: 474056 - RNA, 19 nt, Homo sapiens
guagaguguuugugagcuu

SEQ ID NO: 474057 - RNA, 19 nt, Homo sapiens
ugugaugaguucagaaaga

SEQ ID NO: 474058 - RNA, 19 nt, Homo sapiens
gugaaauuguguagagugu

SEQ ID NO: 474059 - RNA, 19 nt, Homo sapiens
acaccuuccugguaacauu

SEQ ID NO: 474060 - RNA, 19 nt, Homo sapiens
caaagauacuggcauugcu

SEQ ID NO: 474061 - RNA, 19 nt, Homo sapiens
gugaugaguucagaaagau

SEQ ID NO: 474062 - RNA, 19 nt, Homo sapiens
ggaguagcgaggaaucuga

SEQ ID NO: 474063 - RNA, 19 nt, Homo sapiens
ugcaaugcgucuugugaaa

SEQ ID NO: 474064 - RNA, 19 nt, Homo sapiens
agaggugguuaaagccaua

SEQ ID NO: 474065 - RNA, 19 nt, Homo sapiens
gaacugaggcaggcauucu

SEQ ID NO: 474066 - RNA, 19 nt, Homo sapiens
gacaagcauaugaauuuga

SEQ ID NO: 474067 - RNA, 19 nt, Homo sapiens
caagucaaacgcagaagga

SEQ ID NO: 474068 - RNA, 19 nt, Homo sapiens
guucccucauucugcauua

SEQ ID NO: 474069 - RNA, 19 nt, Homo sapiens
gcaaugcgucuugugaaau

SEQ ID NO: 474070 - RNA, 19 nt, Homo sapiens
gggaagaggcacuguagca

SEQ ID NO: 474071 - RNA, 19 nt, Homo sapiens
gggagaacuugguauccau

SEQ ID NO: 474072 - RNA, 19 nt, Homo sapiens
gaugaguucagaaagauca

SEQ ID NO: 474073 - RNA, 19 nt, Homo sapiens
ccugguaacauuucauauu

SEQ ID NO: 474074 - RNA, 19 nt, Homo sapiens
gauccucugugauugugau

SEQ ID NO: 474075 - RNA, 19 nt, Homo sapiens
aaucuucauuggcaccuuu

SEQ ID NO: 474076 - RNA, 19 nt, Homo sapiens
gguggaacagcaaucauga

SEQ ID NO: 474077 - RNA, 19 nt, Homo sapiens
gaacuugguauccaugacu

SEQ ID NO: 474078 - RNA, 19 nt, Homo sapiens
ucaagucuccacacagcua

SEQ ID NO: 474079 - RNA, 19 nt, Homo sapiens
gucauaccuuuaucuauag

SEQ ID NO: 474080 - RNA, 19 nt, Homo sapiens
gguaacauuucauauugcu

SEQ ID NO: 474081 - RNA, 19 nt, Homo sapiens
cccaugggcccaccaauug

SEQ ID NO: 474082 - RNA, 19 nt, Homo sapiens
ggaccaucccagcagguaa

SEQ ID NO: 474083 - RNA, 19 nt, Homo sapiens
aaugagauguauccugcaa

SEQ ID NO: 474084 - RNA, 19 nt, Homo sapiens
cugcccagcuugcauuguu

SEQ ID NO: 474085 - RNA, 19 nt, Homo sapiens
ccaccagaaucuccucuac

SEQ ID NO: 474086 - RNA, 19 nt, Homo sapiens
aauuugauccucugugauu

SEQ ID NO: 474087 - RNA, 19 nt, Homo sapiens
uaacuguggacauuggauu

SEQ ID NO: 474088 - RNA, 19 nt, Homo sapiens
aggaaugcguccaccaaga

SEQ ID NO: 474089 - RNA, 19 nt, Homo sapiens
gagaacuugguauccauga

SEQ ID NO: 474090 - RNA, 19 nt, Homo sapiens
gaagcaaccagagcgugaa

SEQ ID NO: 474091 - RNA, 19 nt, Homo sapiens
gccaaagaaugcgaagcaa

SEQ ID NO: 474092 - RNA, 19 nt, Homo sapiens
gauggccgaaucuucauug

SEQ ID NO: 474093 - RNA, 19 nt, Homo sapiens
ucacugagcaaccaagagu

SEQ ID NO: 474094 - RNA, 19 nt, Homo sapiens
gcauacuguugauccaucu

SEQ ID NO: 474095 - RNA, 19 nt, Homo sapiens
ccaagaccuuagcauacug

SEQ ID NO: 474096 - RNA, 19 nt, Homo sapiens
agauguauccugcaagaug

SEQ ID NO: 474097 - RNA, 19 nt, Homo sapiens
aaucuacuuucucuuaugg

SEQ ID NO: 474098 - RNA, 19 nt, Homo sapiens
uagaguguuugugagcuuu

SEQ ID NO: 474099 - RNA, 19 nt, Homo sapiens
ggaaugcguccaccaagac

SEQ ID NO: 474100 - RNA, 19 nt, Homo sapiens
aaagaucaagccaaagaau

SEQ ID NO: 474101 - RNA, 19 nt, Homo sapiens
uggcaagaguagcaagaug

SEQ ID NO: 474102 - RNA, 19 nt, Homo sapiens
aaguaccugugguggauuu

SEQ ID NO: 474103 - RNA, 19 nt, Homo sapiens
cccucauucugcauuaaua

SEQ ID NO: 474104 - RNA, 19 nt, Homo sapiens
gcucgagggacgccaauag

SEQ ID NO: 474105 - RNA, 19 nt, Homo sapiens
gaccaucccagcagguaau

SEQ ID NO: 474106 - RNA, 19 nt, Homo sapiens
caaccagagcgugaagaaa

SEQ ID NO: 474107 - RNA, 19 nt, Homo sapiens
ccucauucugcauuaauaa

SEQ ID NO: 474108 - RNA, 19 nt, Homo sapiens
ccaggaaugcguccaccaa

SEQ ID NO: 474109 - RNA, 19 nt, Homo sapiens
ugcagcacauugacuauag

SEQ ID NO: 474110 - RNA, 19 nt, Homo sapiens
ggcugaaucuacuuucucu

SEQ ID NO: 474111 - RNA, 19 nt, Homo sapiens
caccaagaccuuagcauac

SEQ ID NO: 474112 - RNA, 19 nt, Homo sapiens
ccugcaagauggccgaauc

SEQ ID NO: 474113 - RNA, 19 nt, Homo sapiens
gauacuuugacgaagguaa

SEQ ID NO: 474114 - RNA, 19 nt, Homo sapiens
cuugugaaauuguguagag

SEQ ID NO: 474115 - RNA, 19 nt, Homo sapiens
ggcagcugguagaggagua

SEQ ID NO: 474116 - RNA, 19 nt, Homo sapiens
cauagagcaauuaaacugu

SEQ ID NO: 474117 - RNA, 19 nt, Homo sapiens
ccaaagauacuggcauugc

SEQ ID NO: 474118 - RNA, 19 nt, Homo sapiens
cauuggauuugguggaaca

SEQ ID NO: 474119 - RNA, 19 nt, Homo sapiens
gaauuugauccucugugau

SEQ ID NO: 474120 - RNA, 19 nt, Homo sapiens
caagaugccuauucucauu

SEQ ID NO: 474121 - RNA, 19 nt, Homo sapiens
gacaagggcuucacacugu

SEQ ID NO: 474122 - RNA, 19 nt, Homo sapiens
ccaaacacauguccuugaa

SEQ ID NO: 474123 - RNA, 19 nt, Homo sapiens
aaacacauguccuugaaga

SEQ ID NO: 474124 - RNA, 19 nt, Homo sapiens
gaacugcuccucuacuugu

SEQ ID NO: 474125 - RNA, 19 nt, Homo sapiens
gaagacuuguccucugcua

SEQ ID NO: 474126 - RNA, 19 nt, Homo sapiens
gcagaugucuucagaugac

SEQ ID NO: 474127 - RNA, 19 nt, Homo sapiens
cagauuggcuggcuaacug

SEQ ID NO: 474128 - RNA, 19 nt, Homo sapiens
gaacaagggccuccgaaac

SEQ ID NO: 474129 - RNA, 19 nt, Homo sapiens
gcagagagauauuuugugu

SEQ ID NO: 474130 - RNA, 19 nt, Homo sapiens
gagaacaagaugccuauuc

SEQ ID NO: 474131 - RNA, 19 nt, Homo sapiens
ggaacaagggccuccgaaa

SEQ ID NO: 474132 - RNA, 19 nt, Homo sapiens
gaaggacgucucaccguau

SEQ ID NO: 474133 - RNA, 19 nt, Homo sapiens
cugcagaugucuucagaug

SEQ ID NO: 474134 - RNA, 19 nt, Homo sapiens
ccuugaagauggcauaugu

SEQ ID NO: 474135 - RNA, 19 nt, Homo sapiens
ccuccuuacucuuggauaa

SEQ ID NO: 474136 - RNA, 19 nt, Homo sapiens
aagaggagauuuucuguuu

SEQ ID NO: 474137 - RNA, 19 nt, Homo sapiens
ucgagaagcugcagauguc

SEQ ID NO: 474138 - RNA, 19 nt, Homo sapiens
gaacuucagcgaggccaaa

SEQ ID NO: 474139 - RNA, 19 nt, Homo sapiens
gaagucgccggaugcacua

SEQ ID NO: 474140 - RNA, 19 nt, Homo sapiens
gccaggacaucaagcagau

SEQ ID NO: 474141 - RNA, 19 nt, Homo sapiens
gugcagguccucaagaaga

SEQ ID NO: 474142 - RNA, 19 nt, Homo sapiens
uggcauaugucucgaagag

SEQ ID NO: 474143 - RNA, 19 nt, Homo sapiens
ggaagggagaggagaggaa

SEQ ID NO: 474144 - RNA, 19 nt, Homo sapiens
ccaagaucuucaagggauu

SEQ ID NO: 474145 - RNA, 19 nt, Homo sapiens
gagaaagaagaggagauuu

SEQ ID NO: 474146 - RNA, 19 nt, Homo sapiens
ggaacugcuccucuacuug

SEQ ID NO: 474147 - RNA, 19 nt, Homo sapiens
ggacgucucaccguauuuc

SEQ ID NO: 474148 - RNA, 19 nt, Homo sapiens
gccaaacacauguccuuga

SEQ ID NO: 474149 - RNA, 19 nt, Homo sapiens
gaggagauuuucuguuugu

SEQ ID NO: 474150 - RNA, 19 nt, Homo sapiens
ugcuggaggucaaguauau

SEQ ID NO: 474151 - RNA, 19 nt, Homo sapiens
gaacaagaugccuauucuc

SEQ ID NO: 474152 - RNA, 19 nt, Homo sapiens
aaggacgucucaccguauu

SEQ ID NO: 474153 - RNA, 19 nt, Homo sapiens
agagaaagaagaggagauu

SEQ ID NO: 474154 - RNA, 19 nt, Homo sapiens
gggagaacaagaugccuau

SEQ ID NO: 474155 - RNA, 19 nt, Homo sapiens
acacauguccuugaagaug

SEQ ID NO: 474156 - RNA, 19 nt, Homo sapiens
uguggacacucaccuguuc

SEQ ID NO: 474157 - RNA, 19 nt, Homo sapiens
cagcgaggccaaacacaug

SEQ ID NO: 474158 - RNA, 19 nt, Homo sapiens
cggugcagguccucaagaa

SEQ ID NO: 474159 - RNA, 19 nt, Homo sapiens
ccuuacucuuggauaaaua

SEQ ID NO: 474160 - RNA, 19 nt, Homo sapiens
gcccaggucaauacucuga

SEQ ID NO: 474161 - RNA, 19 nt, Homo sapiens
ggaggucaaguauaugaag

SEQ ID NO: 474162 - RNA, 19 nt, Homo sapiens
gaagagggguguccaugac

SEQ ID NO: 474163 - RNA, 19 nt, Homo sapiens
ccuauucucauuuccaaga

SEQ ID NO: 474164 - RNA, 19 nt, Homo sapiens
aacaagaugccuauucuca

SEQ ID NO: 474165 - RNA, 19 nt, Homo sapiens
cggaugcacuagcccugaa

SEQ ID NO: 474166 - RNA, 19 nt, Homo sapiens
gacggugccagucuccuuu

SEQ ID NO: 474167 - RNA, 19 nt, Homo sapiens
gagaagcugcagaugucuu

SEQ ID NO: 474168 - RNA, 19 nt, Homo sapiens
caggacaucaagcagauug

SEQ ID NO: 474169 - RNA, 19 nt, Homo sapiens
cauccaagcccaggucaau

SEQ ID NO: 474170 - RNA, 19 nt, Homo sapiens
caccguauuucaagaacuc

SEQ ID NO: 474171 - RNA, 19 nt, Homo sapiens
ucaagaagacaggcaagga

SEQ ID NO: 474172 - RNA, 19 nt, Homo sapiens
gcagcaagagaaagaagag

SEQ ID NO: 474173 - RNA, 19 nt, Homo sapiens
guauaugaaggacgucuca

SEQ ID NO: 474174 - RNA, 19 nt, Homo sapiens
gugcuggaggucaaguaua

SEQ ID NO: 474175 - RNA, 19 nt, Homo sapiens
agaaagaagaggagauuuu

SEQ ID NO: 474176 - RNA, 19 nt, Homo sapiens
ccucugcuacccaugauga

SEQ ID NO: 474177 - RNA, 19 nt, Homo sapiens
ggagauuuucuguuuguuu

SEQ ID NO: 474178 - RNA, 19 nt, Homo sapiens
aagcagauuggcuggcuaa

SEQ ID NO: 474179 - RNA, 19 nt, Homo sapiens
ggccaaggaugaggcuagu

SEQ ID NO: 474180 - RNA, 19 nt, Homo sapiens
agagagauauuuuguguac

SEQ ID NO: 474181 - RNA, 19 nt, Homo sapiens
ggagaacaagaugccuauu

SEQ ID NO: 474182 - RNA, 19 nt, Homo sapiens
caagaucuucaagggauug

SEQ ID NO: 474183 - RNA, 19 nt, Homo sapiens
gucagcagcaagagaaaga

SEQ ID NO: 474184 - RNA, 19 nt, Homo sapiens
aaccauagucuucaucauc

SEQ ID NO: 474185 - RNA, 19 nt, Homo sapiens
ucucuccuccuuacucuug

SEQ ID NO: 474186 - RNA, 19 nt, Homo sapiens
gaagaggagauuuucuguu

SEQ ID NO: 474187 - RNA, 19 nt, Homo sapiens
aaaccauagucuucaucau

SEQ ID NO: 474188 - RNA, 19 nt, Homo sapiens
ugccuauucucauuuccaa

SEQ ID NO: 474189 - RNA, 19 nt, Homo sapiens
cagccugucugugcacauc

SEQ ID NO: 474190 - RNA, 19 nt, Homo sapiens
cccuggcccugcuaacuga

SEQ ID NO: 474191 - RNA, 19 nt, Homo sapiens
ggagccaggacaucaagca

SEQ ID NO: 474192 - RNA, 19 nt, Homo sapiens
aagcccaggucaauacucu

SEQ ID NO: 474193 - RNA, 19 nt, Homo sapiens
gugggcgacugccauccaa

SEQ ID NO: 474194 - RNA, 19 nt, Homo sapiens
agaugccuauucucauuuc

SEQ ID NO: 474195 - RNA, 19 nt, Homo sapiens
gaaaguaccaugagaaaua

SEQ ID NO: 474196 - RNA, 19 nt, Homo sapiens
cagcauagcuuugaaauaa

SEQ ID NO: 474197 - RNA, 19 nt, Homo sapiens
gcacaaaggaugauuaauu

SEQ ID NO: 474198 - RNA, 19 nt, Homo sapiens
gaaucaggaugcuguauuu

SEQ ID NO: 474199 - RNA, 19 nt, Homo sapiens
gaaauccacucuccagaug

SEQ ID NO: 474200 - RNA, 19 nt, Homo sapiens
caaaguagacugcuuaaau

SEQ ID NO: 474201 - RNA, 19 nt, Homo sapiens
gagcaggaauuaaauaaag

SEQ ID NO: 474202 - RNA, 19 nt, Homo sapiens
guacaggguugccacaauu

SEQ ID NO: 474203 - RNA, 19 nt, Homo sapiens
uaauaaagcagccucauuu

SEQ ID NO: 474204 - RNA, 19 nt, Homo sapiens
caaagugucuccauuagca

SEQ ID NO: 474205 - RNA, 19 nt, Homo sapiens
cacaaaggaugauuaauuc

SEQ ID NO: 474206 - RNA, 19 nt, Homo sapiens
gcuguaagcugguagaauc

SEQ ID NO: 474207 - RNA, 19 nt, Homo sapiens
gacaguaucugcaguucuu

SEQ ID NO: 474208 - RNA, 19 nt, Homo sapiens
gcauagcuuugaaauaaug

SEQ ID NO: 474209 - RNA, 19 nt, Homo sapiens
gaggugaggugacgggaaa

SEQ ID NO: 474210 - RNA, 19 nt, Homo sapiens
caugagaaauaucagagua

SEQ ID NO: 474211 - RNA, 19 nt, Homo sapiens
aaagcagccucauuuaauu

SEQ ID NO: 474212 - RNA, 19 nt, Homo sapiens
gccaagaauuacagcuuua

SEQ ID NO: 474213 - RNA, 19 nt, Homo sapiens
gagcagcgcaccagaugua

SEQ ID NO: 474214 - RNA, 19 nt, Homo sapiens
gagagugaauuauggguau

SEQ ID NO: 474215 - RNA, 19 nt, Homo sapiens
gggauacccugcgaaagua

SEQ ID NO: 474216 - RNA, 19 nt, Homo sapiens
ggaaacaccuccgccugaa

SEQ ID NO: 474217 - RNA, 19 nt, Homo sapiens
ccaaggacaugaccauuag

SEQ ID NO: 474218 - RNA, 19 nt, Homo sapiens
gaaauacacagcauagcuu

SEQ ID NO: 474219 - RNA, 19 nt, Homo sapiens
aggcaaagauggagagauu

SEQ ID NO: 474220 - RNA, 19 nt, Homo sapiens
gcaacuuguucaccaggua

SEQ ID NO: 474221 - RNA, 19 nt, Homo sapiens
gcugggagccgagagauua

SEQ ID NO: 474222 - RNA, 19 nt, Homo sapiens
auacugaucugagcuguaa

SEQ ID NO: 474223 - RNA, 19 nt, Homo sapiens
cuagaacaguacaagguua

SEQ ID NO: 474224 - RNA, 19 nt, Homo sapiens
gagggugccuuucccaaga

SEQ ID NO: 474225 - RNA, 19 nt, Homo sapiens
gaacaggcagcuugaaauc

SEQ ID NO: 474226 - RNA, 19 nt, Homo sapiens
accaaggucugcugucuua

SEQ ID NO: 474227 - RNA, 19 nt, Homo sapiens
gaguugacuuucccuugua

SEQ ID NO: 474228 - RNA, 19 nt, Homo sapiens
cagagaacgugaugucaga

SEQ ID NO: 474229 - RNA, 19 nt, Homo sapiens
ggagugccguuugaccaua

SEQ ID NO: 474230 - RNA, 19 nt, Homo sapiens
caaggucugcugucuuaua

SEQ ID NO: 474231 - RNA, 19 nt, Homo sapiens
guagacugcuuaaauugau

SEQ ID NO: 474232 - RNA, 19 nt, Homo sapiens
ggacaugaccauuagaaca

SEQ ID NO: 474233 - RNA, 19 nt, Homo sapiens
caauucugcugaacucauu

SEQ ID NO: 474234 - RNA, 19 nt, Homo sapiens
gagaacaggcagcuugaaa

SEQ ID NO: 474235 - RNA, 19 nt, Homo sapiens
ccaaucacauggcauuuua

SEQ ID NO: 474236 - RNA, 19 nt, Homo sapiens
gauuaauucugggacuaua

SEQ ID NO: 474237 - RNA, 19 nt, Homo sapiens
ucaggaugcuguauuuaga

SEQ ID NO: 474238 - RNA, 19 nt, Homo sapiens
ucaaugguguagaaugauu

SEQ ID NO: 474239 - RNA, 19 nt, Homo sapiens
ggaaucaggaugcuguauu

SEQ ID NO: 474240 - RNA, 19 nt, Homo sapiens
guaauaaagcagccucauu

SEQ ID NO: 474241 - RNA, 19 nt, Homo sapiens
gaaacccaccuuuuauuua

SEQ ID NO: 474242 - RNA, 19 nt, Homo sapiens
gcaaagauggagagauuca

SEQ ID NO: 474243 - RNA, 19 nt, Homo sapiens
gcgaaaguaccaugagaaa

SEQ ID NO: 474244 - RNA, 19 nt, Homo sapiens
cagcuaagauuacaagacu

SEQ ID NO: 474245 - RNA, 19 nt, Homo sapiens
ggcaagggauugaaacaca

SEQ ID NO: 474246 - RNA, 19 nt, Homo sapiens
ugaagcagcuguuacuuuu

SEQ ID NO: 474247 - RNA, 19 nt, Homo sapiens
caaaaugucuucagaugau

SEQ ID NO: 474248 - RNA, 19 nt, Homo sapiens
gaagaaaggauccccagua

SEQ ID NO: 474249 - RNA, 19 nt, Homo sapiens
gcaacuuacugacccuugu

SEQ ID NO: 474250 - RNA, 19 nt, Homo sapiens
gguagaaucugagccaaag

SEQ ID NO: 474251 - RNA, 19 nt, Homo sapiens
auacugagcaggaauuaaa

SEQ ID NO: 474252 - RNA, 19 nt, Homo sapiens
caaauagaaacccaccuuu

SEQ ID NO: 474253 - RNA, 19 nt, Homo sapiens
uaagaaugccggaaagaug

SEQ ID NO: 474254 - RNA, 19 nt, Homo sapiens
ccacaauucugcugaacuc

SEQ ID NO: 474255 - RNA, 19 nt, Homo sapiens
guaagcugguagaaucuga

SEQ ID NO: 474256 - RNA, 19 nt, Homo sapiens
uuucaaugguguagaauga

SEQ ID NO: 474257 - RNA, 19 nt, Homo sapiens
gcaagggauugaaacacau

SEQ ID NO: 474258 - RNA, 19 nt, Homo sapiens
gagaagccacgcccuaugu

SEQ ID NO: 474259 - RNA, 19 nt, Homo sapiens
acauauagacugaaugcua

SEQ ID NO: 474260 - RNA, 19 nt, Homo sapiens
caguaacagugaucccuuu

SEQ ID NO: 474261 - RNA, 19 nt, Homo sapiens
ggacaaggagcauaguaca

SEQ ID NO: 474262 - RNA, 19 nt, Homo sapiens
uauagagagugaauuaugg

SEQ ID NO: 474263 - RNA, 19 nt, Homo sapiens
ugaguugacuuucccuugu

SEQ ID NO: 474264 - RNA, 19 nt, Homo sapiens
gagccaaaguagacugcuu

SEQ ID NO: 474265 - RNA, 19 nt, Homo sapiens
ggaaauacacagcauagcu

SEQ ID NO: 474266 - RNA, 19 nt, Homo sapiens
gaagccacgcccuauguga

SEQ ID NO: 474267 - RNA, 19 nt, Homo sapiens
gcaagggccgaauaguuga

SEQ ID NO: 474268 - RNA, 19 nt, Homo sapiens
gaagugcugcuggaaguga

SEQ ID NO: 474269 - RNA, 19 nt, Homo sapiens
uagaaucugagccaaagua

SEQ ID NO: 474270 - RNA, 19 nt, Homo sapiens
ccgaauaguugagaaaugg

SEQ ID NO: 474271 - RNA, 19 nt, Homo sapiens
gauugaaacacaucucuuc

SEQ ID NO: 474272 - RNA, 19 nt, Homo sapiens
gccauccauuccaacguua

SEQ ID NO: 474273 - RNA, 19 nt, Homo sapiens
caaaggaugauuaauucug

SEQ ID NO: 474274 - RNA, 19 nt, Homo sapiens
ucaagcaaguaauaaagca

SEQ ID NO: 474275 - RNA, 19 nt, Homo sapiens
gccgaauaguugagaaaug

SEQ ID NO: 474276 - RNA, 19 nt, Homo sapiens
gaaaagaagggcugcaaug

SEQ ID NO: 474277 - RNA, 19 nt, Homo sapiens
gccguuugaccauacauua

SEQ ID NO: 474278 - RNA, 19 nt, Homo sapiens
gaacucauugcugaaauca

SEQ ID NO: 474279 - RNA, 19 nt, Homo sapiens
guucacacauacccucuuc

SEQ ID NO: 474280 - RNA, 19 nt, Homo sapiens
cgggaucgcuggcacaaag

SEQ ID NO: 474281 - RNA, 19 nt, Homo sapiens
gaucuuaaucaucccaguu

SEQ ID NO: 474282 - RNA, 19 nt, Homo sapiens
gaacagcaugugcagaucu

SEQ ID NO: 474283 - RNA, 19 nt, Homo sapiens
caucauacagucuccuuau

SEQ ID NO: 474284 - RNA, 19 nt, Homo sapiens
cgcaagggccgaauaguug

SEQ ID NO: 474285 - RNA, 19 nt, Homo sapiens
ucagcccaguucacacaua

SEQ ID NO: 474286 - RNA, 19 nt, Homo sapiens
ggaggaaggaagccugguu

SEQ ID NO: 474287 - RNA, 19 nt, Homo sapiens
uagacugaaugcuauaauc

SEQ ID NO: 474288 - RNA, 19 nt, Homo sapiens
aauagaaacccaccuuuua

SEQ ID NO: 474289 - RNA, 19 nt, Homo sapiens
ucaaauagaaacccaccuu

SEQ ID NO: 474290 - RNA, 19 nt, Homo sapiens
acagugaucccuuuucuua

SEQ ID NO: 474291 - RNA, 19 nt, Homo sapiens
ggcacaaaguucuggugaa

SEQ ID NO: 474292 - RNA, 19 nt, Homo sapiens
ccagaagcguggcgugaag

SEQ ID NO: 474293 - RNA, 19 nt, Homo sapiens
agacuccucugucaguuuc

SEQ ID NO: 474294 - RNA, 19 nt, Homo sapiens
agccaagaauuacagcuuu

SEQ ID NO: 474295 - RNA, 19 nt, Homo sapiens
ggaaagagcuagcgcugaa

SEQ ID NO: 474296 - RNA, 19 nt, Homo sapiens
gaaacugcaugcuguugua

SEQ ID NO: 474297 - RNA, 19 nt, Homo sapiens
aaacaucagucuccaaaga

SEQ ID NO: 474298 - RNA, 19 nt, Homo sapiens
caaaggccaucuccuaaug

SEQ ID NO: 474299 - RNA, 19 nt, Homo sapiens
uacaauaggugguggaauu

SEQ ID NO: 474300 - RNA, 19 nt, Homo sapiens
gaagugauacgguuugaga

SEQ ID NO: 474301 - RNA, 19 nt, Homo sapiens
gagcagcgcuuacggaaac

SEQ ID NO: 474302 - RNA, 19 nt, Homo sapiens
aacaauggcuccaaagaaa

SEQ ID NO: 474303 - RNA, 19 nt, Homo sapiens
uaacugauccugagaagau

SEQ ID NO: 474304 - RNA, 19 nt, Homo sapiens
gguggaguauugauauaaa

SEQ ID NO: 474305 - RNA, 19 nt, Homo sapiens
caacaauggcuccaaagaa

SEQ ID NO: 474306 - RNA, 19 nt, Homo sapiens
gaaacucuagucaaccaua

SEQ ID NO: 474307 - RNA, 19 nt, Homo sapiens
gaacaggaggaucaauuug

SEQ ID NO: 474308 - RNA, 19 nt, Homo sapiens
guaaacaucagucuccaaa

SEQ ID NO: 474309 - RNA, 19 nt, Homo sapiens
caucaacaauggcuccaaa

SEQ ID NO: 474310 - RNA, 19 nt, Homo sapiens
uaaaucauccuaccauguu

SEQ ID NO: 474311 - RNA, 19 nt, Homo sapiens
gaacacagcccaguuugca

SEQ ID NO: 474312 - RNA, 19 nt, Homo sapiens
uugcugagcuccugaguga

SEQ ID NO: 474313 - RNA, 19 nt, Homo sapiens
agaaccacgugaucaagua

SEQ ID NO: 474314 - RNA, 19 nt, Homo sapiens
aaucagacauuugguuuga

SEQ ID NO: 474315 - RNA, 19 nt, Homo sapiens
gaagaaggugcuagccaaa

SEQ ID NO: 474316 - RNA, 19 nt, Homo sapiens
ggagcuagaggaagaagaa

SEQ ID NO: 474317 - RNA, 19 nt, Homo sapiens
gcaaaggccaucuccuaau

SEQ ID NO: 474318 - RNA, 19 nt, Homo sapiens
ggccaacaaugacuucuuc

SEQ ID NO: 474319 - RNA, 19 nt, Homo sapiens
gcuccugagugacuacauu

SEQ ID NO: 474320 - RNA, 19 nt, Homo sapiens
acaucagucuccaaagaua

SEQ ID NO: 474321 - RNA, 19 nt, Homo sapiens
augagaagcuuuccgagaa

SEQ ID NO: 474322 - RNA, 19 nt, Homo sapiens
ggcaaaggccaucuccuaa

SEQ ID NO: 474323 - RNA, 19 nt, Homo sapiens
gugcuggucuccucaagau

SEQ ID NO: 474324 - RNA, 19 nt, Homo sapiens
ugaaucagacauuugguuu

SEQ ID NO: 474325 - RNA, 19 nt, Homo sapiens
aaaucauccuaccauguua

SEQ ID NO: 474326 - RNA, 19 nt, Homo sapiens
ccacagaugccgucagcaa

SEQ ID NO: 474327 - RNA, 19 nt, Homo sapiens
guaaaucauccuaccaugu

SEQ ID NO: 474328 - RNA, 19 nt, Homo sapiens
gaacugggaauaacguuuu

SEQ ID NO: 474329 - RNA, 19 nt, Homo sapiens
ggaacugggaauaacguuu

SEQ ID NO: 474330 - RNA, 19 nt, Homo sapiens
ccaaggacuucaagaacca

SEQ ID NO: 474331 - RNA, 19 nt, Homo sapiens
ugauacgguuugagaaaga

SEQ ID NO: 474332 - RNA, 19 nt, Homo sapiens
ucagagaguucuuggaaaa

SEQ ID NO: 474333 - RNA, 19 nt, Homo sapiens
aagccacacugcagaagaa

SEQ ID NO: 474334 - RNA, 19 nt, Homo sapiens
gaacaggccaacaaugacu

SEQ ID NO: 474335 - RNA, 19 nt, Homo sapiens
gaaucagacauuugguuug

SEQ ID NO: 474336 - RNA, 19 nt, Homo sapiens
agaacaggaggaucaauuu

SEQ ID NO: 474337 - RNA, 19 nt, Homo sapiens
gggaugggguggaguauug

SEQ ID NO: 474338 - RNA, 19 nt, Homo sapiens
agaaagagaaauccaagga

SEQ ID NO: 474339 - RNA, 19 nt, Homo sapiens
caaagagucuagccaugcu

SEQ ID NO: 474340 - RNA, 19 nt, Homo sapiens
ggaaacugcaugcuguugu

SEQ ID NO: 474341 - RNA, 19 nt, Homo sapiens
cgucagagaguucuuggaa

SEQ ID NO: 474342 - RNA, 19 nt, Homo sapiens
gauaggggaugguaugaau

SEQ ID NO: 474343 - RNA, 19 nt, Homo sapiens
caguggagcuauccuugga

SEQ ID NO: 474344 - RNA, 19 nt, Homo sapiens
acaauaggugguggaauua

SEQ ID NO: 474345 - RNA, 19 nt, Homo sapiens
ccagagcccaccuguguga

SEQ ID NO: 474346 - RNA, 19 nt, Homo sapiens
ucaagaaccacgugaucaa

SEQ ID NO: 474347 - RNA, 19 nt, Homo sapiens
ccaacaagccugauaagcu

SEQ ID NO: 474348 - RNA, 19 nt, Homo sapiens
auaacuacaucccuucuuc

SEQ ID NO: 474349 - RNA, 19 nt, Homo sapiens
gauuugacagucgguauaa

SEQ ID NO: 474350 - RNA, 19 nt, Homo sapiens
ggaagaagaacaggaggau

SEQ ID NO: 474351 - RNA, 19 nt, Homo sapiens
ucgggugacucaauaugaa

SEQ ID NO: 474352 - RNA, 19 nt, Homo sapiens
aggaacaggccaacaauga

SEQ ID NO: 474353 - RNA, 19 nt, Homo sapiens
gugacuuucugggucuuua

SEQ ID NO: 474354 - RNA, 19 nt, Homo sapiens
gggccaacaagccugauaa

SEQ ID NO: 474355 - RNA, 19 nt, Homo sapiens
gucagagaguucuuggaaa

SEQ ID NO: 474356 - RNA, 19 nt, Homo sapiens
gaagauuuagugacuuucu

SEQ ID NO: 474357 - RNA, 19 nt, Homo sapiens
ccuacaaaguuacaacaca

SEQ ID NO: 474358 - RNA, 19 nt, Homo sapiens
aagaagaacaggaggauca

SEQ ID NO: 474359 - RNA, 19 nt, Homo sapiens
aauaggugguggaauuaug

SEQ ID NO: 474360 - RNA, 19 nt, Homo sapiens
agacacuccuuuacucaca

SEQ ID NO: 474361 - RNA, 19 nt, Homo sapiens
gaaauccaaggacuucaag

SEQ ID NO: 474362 - RNA, 19 nt, Homo sapiens
acacagcccaguuugcaaa

SEQ ID NO: 474363 - RNA, 19 nt, Homo sapiens
uccaggagguagaguguga

SEQ ID NO: 474364 - RNA, 19 nt, Homo sapiens
augaggagcuagaggaaga

SEQ ID NO: 474365 - RNA, 19 nt, Homo sapiens
aggcaaaggccaucuccua

SEQ ID NO: 474366 - RNA, 19 nt, Homo sapiens
ugggauccaugaagaacaa

SEQ ID NO: 474367 - RNA, 19 nt, Homo sapiens
caucagucuccaaagauaa

SEQ ID NO: 474368 - RNA, 19 nt, Homo sapiens
acagacaagcuuaccauug

SEQ ID NO: 474369 - RNA, 19 nt, Homo sapiens
gaagauaggggaugguaug

SEQ ID NO: 474370 - RNA, 19 nt, Homo sapiens
aagaacaggaggaucaauu

SEQ ID NO: 474371 - RNA, 19 nt, Homo sapiens
ggacagcacacaaaauaau

SEQ ID NO: 474372 - RNA, 19 nt, Homo sapiens
ucgagaggauuucaacagu

SEQ ID NO: 474373 - RNA, 19 nt, Homo sapiens
cuccaaagauaacuacauc

SEQ ID NO: 474374 - RNA, 19 nt, Homo sapiens
ggaugugguuuaggaacug

SEQ ID NO: 474375 - RNA, 19 nt, Homo sapiens
ucaacaauggcuccaaaga

SEQ ID NO: 474376 - RNA, 19 nt, Homo sapiens
caacagugguccgaaaaga

SEQ ID NO: 474377 - RNA, 19 nt, Homo sapiens
aaacucuagucaaccauag

SEQ ID NO: 474378 - RNA, 19 nt, Homo sapiens
acauuugguuugaggagaa

SEQ ID NO: 474379 - RNA, 19 nt, Homo sapiens
ucaggaagccacaaauucu

SEQ ID NO: 474380 - RNA, 19 nt, Homo sapiens
gaccagcgcaugaagacau

SEQ ID NO: 474381 - RNA, 19 nt, Homo sapiens
gcacacaaaauaaucagaa

SEQ ID NO: 474382 - RNA, 19 nt, Homo sapiens
ccucaggaagccacaaauu

SEQ ID NO: 474383 - RNA, 19 nt, Homo sapiens
gcuggucuccucaagaugu

SEQ ID NO: 474384 - RNA, 19 nt, Homo sapiens
gugauacgguuugagaaag

SEQ ID NO: 474385 - RNA, 19 nt, Homo sapiens
ugagaagcuuuccgagaag

SEQ ID NO: 474386 - RNA, 19 nt, Homo sapiens
uauaacugauccugagaag

SEQ ID NO: 474387 - RNA, 19 nt, Homo sapiens
ugauuugacagucgguaua

SEQ ID NO: 474388 - RNA, 19 nt, Homo sapiens
caaccuaugaggagcuaga

SEQ ID NO: 474389 - RNA, 19 nt, Homo sapiens
ggguggaguauugauauaa

SEQ ID NO: 474390 - RNA, 19 nt, Homo sapiens
aaagaagugauacgguuug

SEQ ID NO: 474391 - RNA, 19 nt, Homo sapiens
ggagcagcgcuuacggaaa

SEQ ID NO: 474392 - RNA, 19 nt, Homo sapiens
gcaaaaugaccaucaagau

SEQ ID NO: 474393 - RNA, 19 nt, Homo sapiens
guauaacugauccugagaa

SEQ ID NO: 474394 - RNA, 19 nt, Homo sapiens
gccaaccuaugaggagcua

SEQ ID NO: 474395 - RNA, 19 nt, Homo sapiens
ggaaagagcuagcgcugaa

SEQ ID NO: 474396 - RNA, 19 nt, Homo sapiens
gaaacugcaugcuguugua

SEQ ID NO: 474397 - RNA, 19 nt, Homo sapiens
aaacaucagucuccaaaga

SEQ ID NO: 474398 - RNA, 19 nt, Homo sapiens
caaaggccaucuccuaaug

SEQ ID NO: 474399 - RNA, 19 nt, Homo sapiens
uacaauaggugguggaauu

SEQ ID NO: 474400 - RNA, 19 nt, Homo sapiens
gaagugauacgguuugaga

SEQ ID NO: 474401 - RNA, 19 nt, Homo sapiens
gagcagcgcuuacggaaac

SEQ ID NO: 474402 - RNA, 19 nt, Homo sapiens
aacaauggcuccaaagaaa

SEQ ID NO: 474403 - RNA, 19 nt, Homo sapiens
gguggaguauugauauaaa

SEQ ID NO: 474404 - RNA, 19 nt, Homo sapiens
caacaauggcuccaaagaa

SEQ ID NO: 474405 - RNA, 19 nt, Homo sapiens
gaaacucuagucaaccaua

SEQ ID NO: 474406 - RNA, 19 nt, Homo sapiens
caucaacaauggcuccaaa

SEQ ID NO: 474407 - RNA, 19 nt, Homo sapiens
guaaacaucagucuccaaa

SEQ ID NO: 474408 - RNA, 19 nt, Homo sapiens
uaaaucauccuaccauguu

SEQ ID NO: 474409 - RNA, 19 nt, Homo sapiens
gaacacagcccaguuugca

SEQ ID NO: 474410 - RNA, 19 nt, Homo sapiens
uugcugagcuccugaguga

SEQ ID NO: 474411 - RNA, 19 nt, Homo sapiens
agaaccacgugaucaagua

SEQ ID NO: 474412 - RNA, 19 nt, Homo sapiens
aaucagacauuugguuuga

SEQ ID NO: 474413 - RNA, 19 nt, Homo sapiens
gcaaaggccaucuccuaau

SEQ ID NO: 474414 - RNA, 19 nt, Homo sapiens
ggccaacaaugacuucuuc

SEQ ID NO: 474415 - RNA, 19 nt, Homo sapiens
gcuccugagugacuacauu

SEQ ID NO: 474416 - RNA, 19 nt, Homo sapiens
acaucagucuccaaagaua

SEQ ID NO: 474417 - RNA, 19 nt, Homo sapiens
augagaagcuuuccgagaa

SEQ ID NO: 474418 - RNA, 19 nt, Homo sapiens
ggcaaaggccaucuccuaa

SEQ ID NO: 474419 - RNA, 19 nt, Homo sapiens
gugcuggucuccucaagau

SEQ ID NO: 474420 - RNA, 19 nt, Homo sapiens
ugaaucagacauuugguuu

SEQ ID NO: 474421 - RNA, 19 nt, Homo sapiens
aaaucauccuaccauguua

SEQ ID NO: 474422 - RNA, 19 nt, Homo sapiens
ccacagaugccgucagcaa

SEQ ID NO: 474423 - RNA, 19 nt, Homo sapiens
guaaaucauccuaccaugu

SEQ ID NO: 474424 - RNA, 19 nt, Homo sapiens
gaacugggaauaacguuuu

SEQ ID NO: 474425 - RNA, 19 nt, Homo sapiens
ggaacugggaauaacguuu

SEQ ID NO: 474426 - RNA, 19 nt, Homo sapiens
ccaaggacuucaagaacca

SEQ ID NO: 474427 - RNA, 19 nt, Homo sapiens
ugauacgguuugagaaaga

SEQ ID NO: 474428 - RNA, 19 nt, Homo sapiens
ucagagaguucuuggaaaa

SEQ ID NO: 474429 - RNA, 19 nt, Homo sapiens
aagccacacugcagaagaa

SEQ ID NO: 474430 - RNA, 19 nt, Homo sapiens
gaacaggccaacaaugacu

SEQ ID NO: 474431 - RNA, 19 nt, Homo sapiens
gaaucagacauuugguuug

SEQ ID NO: 474432 - RNA, 19 nt, Homo sapiens
gggaugggguggaguauug

SEQ ID NO: 474433 - RNA, 19 nt, Homo sapiens
agaaagagaaauccaagga

SEQ ID NO: 474434 - RNA, 19 nt, Homo sapiens
caaagagucuagccaugcu

SEQ ID NO: 474435 - RNA, 19 nt, Homo sapiens
ggaaacugcaugcuguugu

SEQ ID NO: 474436 - RNA, 19 nt, Homo sapiens
cgucagagaguucuuggaa

SEQ ID NO: 474437 - RNA, 19 nt, Homo sapiens
acaauaggugguggaauua

SEQ ID NO: 474438 - RNA, 19 nt, Homo sapiens
ccagagcccaccuguguga

SEQ ID NO: 474439 - RNA, 19 nt, Homo sapiens
ucaagaaccacgugaucaa

SEQ ID NO: 474440 - RNA, 19 nt, Homo sapiens
ccaacaagccugauaagcu

SEQ ID NO: 474441 - RNA, 19 nt, Homo sapiens
auaacuacaucccuucuuc

SEQ ID NO: 474442 - RNA, 19 nt, Homo sapiens
ucgggugacucaauaugaa

SEQ ID NO: 474443 - RNA, 19 nt, Homo sapiens
aggaacaggccaacaauga

SEQ ID NO: 474444 - RNA, 19 nt, Homo sapiens
gugacuuucugggucuuua

SEQ ID NO: 474445 - RNA, 19 nt, Homo sapiens
gggccaacaagccugauaa

SEQ ID NO: 474446 - RNA, 19 nt, Homo sapiens
gucagagaguucuuggaaa

SEQ ID NO: 474447 - RNA, 19 nt, Homo sapiens
gaagauuuagugacuuucu

SEQ ID NO: 474448 - RNA, 19 nt, Homo sapiens
ccuacaaaguuacaacaca

SEQ ID NO: 474449 - RNA, 19 nt, Homo sapiens
aauaggugguggaauuaug

SEQ ID NO: 474450 - RNA, 19 nt, Homo sapiens
agacacuccuuuacucaca

SEQ ID NO: 474451 - RNA, 19 nt, Homo sapiens
gaaauccaaggacuucaag

SEQ ID NO: 474452 - RNA, 19 nt, Homo sapiens
acacagcccaguuugcaaa

SEQ ID NO: 474453 - RNA, 19 nt, Homo sapiens
uccaggagguagaguguga

SEQ ID NO: 474454 - RNA, 19 nt, Homo sapiens
aggcaaaggccaucuccua

SEQ ID NO: 474455 - RNA, 19 nt, Homo sapiens
caucagucuccaaagauaa

SEQ ID NO: 474456 - RNA, 19 nt, Homo sapiens
ugggauccaugaagaacaa

SEQ ID NO: 474457 - RNA, 19 nt, Homo sapiens
acagacaagcuuaccauug

SEQ ID NO: 474458 - RNA, 19 nt, Homo sapiens
cuccaaagauaacuacauc

SEQ ID NO: 474459 - RNA, 19 nt, Homo sapiens
ucgagaggauuucaacagu

SEQ ID NO: 474460 - RNA, 19 nt, Homo sapiens
ggaugugguuuaggaacug

SEQ ID NO: 474461 - RNA, 19 nt, Homo sapiens
caacagugguccgaaaaga

SEQ ID NO: 474462 - RNA, 19 nt, Homo sapiens
aaacucuagucaaccauag

SEQ ID NO: 474463 - RNA, 19 nt, Homo sapiens
acauuugguuugaggagaa

SEQ ID NO: 474464 - RNA, 19 nt, Homo sapiens
ucaacaauggcuccaaaga

SEQ ID NO: 474465 - RNA, 19 nt, Homo sapiens
gaccagcgcaugaagacau

SEQ ID NO: 474466 - RNA, 19 nt, Homo sapiens
gcuggucuccucaagaugu

SEQ ID NO: 474467 - RNA, 19 nt, Homo sapiens
gugauacgguuugagaaag

SEQ ID NO: 474468 - RNA, 19 nt, Homo sapiens
ugagaagcuuuccgagaag

SEQ ID NO: 474469 - RNA, 19 nt, Homo sapiens
ggguggaguauugauauaa

SEQ ID NO: 474470 - RNA, 19 nt, Homo sapiens
aaagaagugauacgguuug

SEQ ID NO: 474471 - RNA, 19 nt, Homo sapiens
ggagcagcgcuuacggaaa

SEQ ID NO: 474472 - RNA, 19 nt, Homo sapiens
gcaaaaugaccaucaagau

SEQ ID NO: 474473 - RNA, 19 nt, Homo sapiens
aaaguuacaacacagacaa

SEQ ID NO: 474474 - RNA, 19 nt, Homo sapiens
gauaacuacaucccuucuu

SEQ ID NO: 474475 - RNA, 19 nt, Homo sapiens
ucaagaugaaugaaucaga

SEQ ID NO: 474476 - RNA, 19 nt, Homo sapiens
uuacaacacagacaagcuu

SEQ ID NO: 474477 - RNA, 19 nt, Homo sapiens
aauccaaggacuucaagaa

SEQ ID NO: 474478 - RNA, 19 nt, Homo sapiens
aagaagugauacgguuuga

SEQ ID NO: 474479 - RNA, 19 nt, Homo sapiens
uggcugagguggaagaaaa

SEQ ID NO: 474480 - RNA, 19 nt, Homo sapiens
ccaugaagaacaagaccaa

SEQ ID NO: 474481 - RNA, 19 nt, Homo sapiens
guuuaggaacugggaauaa

SEQ ID NO: 474482 - RNA, 19 nt, Homo sapiens
caagccacacugcagaaga

SEQ ID NO: 474483 - RNA, 19 nt, Homo sapiens
ggaacaggccaacaaugac

SEQ ID NO: 474484 - RNA, 19 nt, Homo sapiens
acugcaugcuguuguagaa

SEQ ID NO: 474485 - RNA, 19 nt, Homo sapiens
agugaaaguugggaaggaa

SEQ ID NO: 474486 - RNA, 19 nt, Homo sapiens
gggaauaacguuuucuguu

SEQ ID NO: 474487 - RNA, 19 nt, Homo sapiens
uucaggaugugguuuagga

SEQ ID NO: 474488 - RNA, 19 nt, Homo sapiens
uacaacacagacaagcuua

SEQ ID NO: 474489 - RNA, 19 nt, Homo sapiens
gggguggaguauugauaua

SEQ ID NO: 474490 - RNA, 19 nt, Homo sapiens
gccacaggaucucuuugca

SEQ ID NO: 474491 - RNA, 19 nt, Homo sapiens
agagaaauccaaggacuuc

SEQ ID NO: 474492 - RNA, 19 nt, Homo sapiens
ugaagaacaagaccaagag

SEQ ID NO: 474493 - RNA, 19 nt, Homo sapiens
ccaggaacaggccaacaau

SEQ ID NO: 474494 - RNA, 19 nt, Homo sapiens
gaaaguugggaaggaagau

SEQ ID NO: 474495 - RNA, 19 nt, Homo sapiens
ggaaagagcuagcgcugaa

SEQ ID NO: 474496 - RNA, 19 nt, Homo sapiens
gaaacugcaugcuguugua

SEQ ID NO: 474497 - RNA, 19 nt, Homo sapiens
aaacaucagucuccaaaga

SEQ ID NO: 474498 - RNA, 19 nt, Homo sapiens
caaaggccaucuccuaaug

SEQ ID NO: 474499 - RNA, 19 nt, Homo sapiens
uacaauaggugguggaauu

SEQ ID NO: 474500 - RNA, 19 nt, Homo sapiens
gaagugauacgguuugaga

SEQ ID NO: 474501 - RNA, 19 nt, Homo sapiens
gagcagcgcuuacggaaac

SEQ ID NO: 474502 - RNA, 19 nt, Homo sapiens
aacaauggcuccaaagaaa

SEQ ID NO: 474503 - RNA, 19 nt, Homo sapiens
uaacugauccugagaagau

SEQ ID NO: 474504 - RNA, 19 nt, Homo sapiens
gguggaguauugauauaaa

SEQ ID NO: 474505 - RNA, 19 nt, Homo sapiens
caacaauggcuccaaagaa

SEQ ID NO: 474506 - RNA, 19 nt, Homo sapiens
gaaacucuagucaaccaua

SEQ ID NO: 474507 - RNA, 19 nt, Homo sapiens
gaacaggaggaucaauuug

SEQ ID NO: 474508 - RNA, 19 nt, Homo sapiens
guaaacaucagucuccaaa

SEQ ID NO: 474509 - RNA, 19 nt, Homo sapiens
caucaacaauggcuccaaa

SEQ ID NO: 474510 - RNA, 19 nt, Homo sapiens
uaaaucauccuaccauguu

SEQ ID NO: 474511 - RNA, 19 nt, Homo sapiens
gaacacagcccaguuugca

SEQ ID NO: 474512 - RNA, 19 nt, Homo sapiens
uugcugagcuccugaguga

SEQ ID NO: 474513 - RNA, 19 nt, Homo sapiens
agaaccacgugaucaagua

SEQ ID NO: 474514 - RNA, 19 nt, Homo sapiens
aaucagacauuugguuuga

SEQ ID NO: 474515 - RNA, 19 nt, Homo sapiens
gaagaaggugcuagccaaa

SEQ ID NO: 474516 - RNA, 19 nt, Homo sapiens
ggagcuagaggaagaagaa

SEQ ID NO: 474517 - RNA, 19 nt, Homo sapiens
gcaaaggccaucuccuaau

SEQ ID NO: 474518 - RNA, 19 nt, Homo sapiens
ggccaacaaugacuucuuc

SEQ ID NO: 474519 - RNA, 19 nt, Homo sapiens
gcuccugagugacuacauu

SEQ ID NO: 474520 - RNA, 19 nt, Homo sapiens
acaucagucuccaaagaua

SEQ ID NO: 474521 - RNA, 19 nt, Homo sapiens
augagaagcuuuccgagaa

SEQ ID NO: 474522 - RNA, 19 nt, Homo sapiens
ggcaaaggccaucuccuaa

SEQ ID NO: 474523 - RNA, 19 nt, Homo sapiens
gugcuggucuccucaagau

SEQ ID NO: 474524 - RNA, 19 nt, Homo sapiens
ugaaucagacauuugguuu

SEQ ID NO: 474525 - RNA, 19 nt, Homo sapiens
aaaucauccuaccauguua

SEQ ID NO: 474526 - RNA, 19 nt, Homo sapiens
ccacagaugccgucagcaa

SEQ ID NO: 474527 - RNA, 19 nt, Homo sapiens
guaaaucauccuaccaugu

SEQ ID NO: 474528 - RNA, 19 nt, Homo sapiens
gaacugggaauaacguuuu

SEQ ID NO: 474529 - RNA, 19 nt, Homo sapiens
ggaacugggaauaacguuu

SEQ ID NO: 474530 - RNA, 19 nt, Homo sapiens
ccaaggacuucaagaacca

SEQ ID NO: 474531 - RNA, 19 nt, Homo sapiens
ugauacgguuugagaaaga

SEQ ID NO: 474532 - RNA, 19 nt, Homo sapiens
ucagagaguucuuggaaaa

SEQ ID NO: 474533 - RNA, 19 nt, Homo sapiens
gaacaggccaacaaugacu

SEQ ID NO: 474534 - RNA, 19 nt, Homo sapiens
gaaucagacauuugguuug

SEQ ID NO: 474535 - RNA, 19 nt, Homo sapiens
agaacaggaggaucaauuu

SEQ ID NO: 474536 - RNA, 19 nt, Homo sapiens
gggaugggguggaguauug

SEQ ID NO: 474537 - RNA, 19 nt, Homo sapiens
agaaagagaaauccaagga

SEQ ID NO: 474538 - RNA, 19 nt, Homo sapiens
caaagagucuagccaugcu

SEQ ID NO: 474539 - RNA, 19 nt, Homo sapiens
ggaaacugcaugcuguugu

SEQ ID NO: 474540 - RNA, 19 nt, Homo sapiens
cgucagagaguucuuggaa

SEQ ID NO: 474541 - RNA, 19 nt, Homo sapiens
gauaggggaugguaugaau

SEQ ID NO: 474542 - RNA, 19 nt, Homo sapiens
caguggagcuauccuugga

SEQ ID NO: 474543 - RNA, 19 nt, Homo sapiens
acaauaggugguggaauua

SEQ ID NO: 474544 - RNA, 19 nt, Homo sapiens
ccagagcccaccuguguga

SEQ ID NO: 474545 - RNA, 19 nt, Homo sapiens
ucaagaaccacgugaucaa

SEQ ID NO: 474546 - RNA, 19 nt, Homo sapiens
auaacuacaucccuucuuc

SEQ ID NO: 474547 - RNA, 19 nt, Homo sapiens
gauuugacagucgguauaa

SEQ ID NO: 474548 - RNA, 19 nt, Homo sapiens
ggaagaagaacaggaggau

SEQ ID NO: 474549 - RNA, 19 nt, Homo sapiens
ucgggugacucaauaugaa

SEQ ID NO: 474550 - RNA, 19 nt, Homo sapiens
aggaacaggccaacaauga

SEQ ID NO: 474551 - RNA, 19 nt, Homo sapiens
gugacuuucugggucuuua

SEQ ID NO: 474552 - RNA, 19 nt, Homo sapiens
gucagagaguucuuggaaa

SEQ ID NO: 474553 - RNA, 19 nt, Homo sapiens
gaagauuuagugacuuucu

SEQ ID NO: 474554 - RNA, 19 nt, Homo sapiens
ccuacaaaguuacaacaca

SEQ ID NO: 474555 - RNA, 19 nt, Homo sapiens
aagaagaacaggaggauca

SEQ ID NO: 474556 - RNA, 19 nt, Homo sapiens
aauaggugguggaauuaug

SEQ ID NO: 474557 - RNA, 19 nt, Homo sapiens
agacacuccuuuacucaca

SEQ ID NO: 474558 - RNA, 19 nt, Homo sapiens
gaaauccaaggacuucaag

SEQ ID NO: 474559 - RNA, 19 nt, Homo sapiens
acacagcccaguuugcaaa

SEQ ID NO: 474560 - RNA, 19 nt, Homo sapiens
uccaggagguagaguguga

SEQ ID NO: 474561 - RNA, 19 nt, Homo sapiens
augaggagcuagaggaaga

SEQ ID NO: 474562 - RNA, 19 nt, Homo sapiens
aggcaaaggccaucuccua

SEQ ID NO: 474563 - RNA, 19 nt, Homo sapiens
caucagucuccaaagauaa

SEQ ID NO: 474564 - RNA, 19 nt, Homo sapiens
ugggauccaugaagaacaa

SEQ ID NO: 474565 - RNA, 19 nt, Homo sapiens
acagacaagcuuaccauug

SEQ ID NO: 474566 - RNA, 19 nt, Homo sapiens
gaagauaggggaugguaug

SEQ ID NO: 474567 - RNA, 19 nt, Homo sapiens
aagaacaggaggaucaauu

SEQ ID NO: 474568 - RNA, 19 nt, Homo sapiens
ucgagaggauuucaacagu

SEQ ID NO: 474569 - RNA, 19 nt, Homo sapiens
cuccaaagauaacuacauc

SEQ ID NO: 474570 - RNA, 19 nt, Homo sapiens
ggacagcacacaaaauaau

SEQ ID NO: 474571 - RNA, 19 nt, Homo sapiens
ggaugugguuuaggaacug

SEQ ID NO: 474572 - RNA, 19 nt, Homo sapiens
ucaacaauggcuccaaaga

SEQ ID NO: 474573 - RNA, 19 nt, Homo sapiens
caacagugguccgaaaaga

SEQ ID NO: 474574 - RNA, 19 nt, Homo sapiens
aaacucuagucaaccauag

SEQ ID NO: 474575 - RNA, 19 nt, Homo sapiens
acauuugguuugaggagaa

SEQ ID NO: 474576 - RNA, 19 nt, Homo sapiens
ucaggaagccacaaauucu

SEQ ID NO: 474577 - RNA, 19 nt, Homo sapiens
gcuggucuccucaagaugu

SEQ ID NO: 474578 - RNA, 19 nt, Homo sapiens
gcacacaaaauaaucagaa

SEQ ID NO: 474579 - RNA, 19 nt, Homo sapiens
ccucaggaagccacaaauu

SEQ ID NO: 474580 - RNA, 19 nt, Homo sapiens
gugauacgguuugagaaag

SEQ ID NO: 474581 - RNA, 19 nt, Homo sapiens
ugagaagcuuuccgagaag

SEQ ID NO: 474582 - RNA, 19 nt, Homo sapiens
uauaacugauccugagaag

SEQ ID NO: 474583 - RNA, 19 nt, Homo sapiens
ugauuugacagucgguaua

SEQ ID NO: 474584 - RNA, 19 nt, Homo sapiens
caaccuaugaggagcuaga

SEQ ID NO: 474585 - RNA, 19 nt, Homo sapiens
ggguggaguauugauauaa

SEQ ID NO: 474586 - RNA, 19 nt, Homo sapiens
aaagaagugauacgguuug

SEQ ID NO: 474587 - RNA, 19 nt, Homo sapiens
ggagcagcgcuuacggaaa

SEQ ID NO: 474588 - RNA, 19 nt, Homo sapiens
gcaaaaugaccaucaagau

SEQ ID NO: 474589 - RNA, 19 nt, Homo sapiens
guauaacugauccugagaa

SEQ ID NO: 474590 - RNA, 19 nt, Homo sapiens
ucaagaugaaugaaucaga

SEQ ID NO: 474591 - RNA, 19 nt, Homo sapiens
gccaaccuaugaggagcua

SEQ ID NO: 474592 - RNA, 19 nt, Homo sapiens
gauaacuacaucccuucuu

SEQ ID NO: 474593 - RNA, 19 nt, Homo sapiens
uuacaacacagacaagcuu

SEQ ID NO: 474594 - RNA, 19 nt, Homo sapiens
aaaguuacaacacagacaa

SEQ ID NO: 474595 - RNA, 19 nt, Homo sapiens
gggaagagauugaagaaga

SEQ ID NO: 474596 - RNA, 19 nt, Homo sapiens
ccacagaaguuguauuaga

SEQ ID NO: 474597 - RNA, 19 nt, Homo sapiens
ggaagagauugaagaagaa

SEQ ID NO: 474598 - RNA, 19 nt, Homo sapiens
ggcaugacauucugcaaua

SEQ ID NO: 474599 - RNA, 19 nt, Homo sapiens
uaaaagugcugccauguua

SEQ ID NO: 474600 - RNA, 19 nt, Homo sapiens
gaacagauaucuaaaacga

SEQ ID NO: 474601 - RNA, 19 nt, Homo sapiens
gcaagcaaauauuuacaug

SEQ ID NO: 474602 - RNA, 19 nt, Homo sapiens
guacuuagaaucacuaguu

SEQ ID NO: 474603 - RNA, 19 nt, Homo sapiens
gaaguuguauuagaugaug

SEQ ID NO: 474604 - RNA, 19 nt, Homo sapiens
gaaaagaagugggaagauu

SEQ ID NO: 474605 - RNA, 19 nt, Homo sapiens
ggaagaugcucaaauuacu

SEQ ID NO: 474606 - RNA, 19 nt, Homo sapiens
ccaguuacaucaagaacaa

SEQ ID NO: 474607 - RNA, 19 nt, Homo sapiens
caacacagcugccuuugcu

SEQ ID NO: 474608 - RNA, 19 nt, Homo sapiens
gcauauagaguaacaacaa

SEQ ID NO: 474609 - RNA, 19 nt, Homo sapiens
gggaagauuugagaaagaa

SEQ ID NO: 474610 - RNA, 19 nt, Homo sapiens
ggagaagauagaccaguua

SEQ ID NO: 474611 - RNA, 19 nt, Homo sapiens
cauagaaauugguguauca

SEQ ID NO: 474612 - RNA, 19 nt, Homo sapiens
gaagauagaccaguuacau

SEQ ID NO: 474613 - RNA, 19 nt, Homo sapiens
gaaagggaaccuauccuau

SEQ ID NO: 474614 - RNA, 19 nt, Homo sapiens
uguauuagaugaugacaga

SEQ ID NO: 474615 - RNA, 19 nt, Homo sapiens
cagaagauauuagugcaaa

SEQ ID NO: 474616 - RNA, 19 nt, Homo sapiens
ccaaugcuuugaauaaugu

SEQ ID NO: 474617 - RNA, 19 nt, Homo sapiens
aagaagaccuuggauguug

SEQ ID NO: 474618 - RNA, 19 nt, Homo sapiens
ugaaucggaugcaugguuu

SEQ ID NO: 474619 - RNA, 19 nt, Homo sapiens
gaguggagcaggaauauug

SEQ ID NO: 474620 - RNA, 19 nt, Homo sapiens
ggaaagagauuuugaacag

SEQ ID NO: 474621 - RNA, 19 nt, Homo sapiens
caaucaagaugaaugaauc

SEQ ID NO: 474622 - RNA, 19 nt, Homo sapiens
gaagugggaagauuugaga

SEQ ID NO: 474623 - RNA, 19 nt, Homo sapiens
gaaacuucaugucaguguu

SEQ ID NO: 474624 - RNA, 19 nt, Homo sapiens
gcaaauuagcaagcaaaua

SEQ ID NO: 474625 - RNA, 19 nt, Homo sapiens
aaaccguuaucaucaagua

SEQ ID NO: 474626 - RNA, 19 nt, Homo sapiens
gaucauacugcuuuaucua

SEQ ID NO: 474627 - RNA, 19 nt, Homo sapiens
uaaguggacuguggcauga

SEQ ID NO: 474628 - RNA, 19 nt, Homo sapiens
ggacggagaggaccuguuc

SEQ ID NO: 474629 - RNA, 19 nt, Homo sapiens
ugacuacauucgucuuauu

SEQ ID NO: 474630 - RNA, 19 nt, Homo sapiens
ggucaaaguggguaaagaa

SEQ ID NO: 474631 - RNA, 19 nt, Homo sapiens
ccaaagccauugccuagca

SEQ ID NO: 474632 - RNA, 19 nt, Homo sapiens
acucauugcuccuagaauu

SEQ ID NO: 474633 - RNA, 19 nt, Homo sapiens
gagcaggaauauugaggau

SEQ ID NO: 474634 - RNA, 19 nt, Homo sapiens
caacuuaggaaacuucaug

SEQ ID NO: 474635 - RNA, 19 nt, Homo sapiens
gaaauugguguaucagauc

SEQ ID NO: 474636 - RNA, 19 nt, Homo sapiens
ugacauagaaauuggugua

SEQ ID NO: 474637 - RNA, 19 nt, Homo sapiens
cacagaaguuguauuagau

SEQ ID NO: 474638 - RNA, 19 nt, Homo sapiens
aagaacgagugaaggauuu

SEQ ID NO: 474639 - RNA, 19 nt, Homo sapiens
gaaaugggaagaugcucaa

SEQ ID NO: 474640 - RNA, 19 nt, Homo sapiens
gugcugccauguuagguaa

SEQ ID NO: 474641 - RNA, 19 nt, Homo sapiens
caucaaguacuuagaauca

SEQ ID NO: 474642 - RNA, 19 nt, Homo sapiens
aaugaugguugcuaacaaa

SEQ ID NO: 474643 - RNA, 19 nt, Homo sapiens
gaagaugcucaaauuacuu

SEQ ID NO: 474644 - RNA, 19 nt, Homo sapiens
ccacugaguuuguagaaaa

SEQ ID NO: 474645 - RNA, 19 nt, Homo sapiens
guaaagaagacucaucauc

SEQ ID NO: 474646 - RNA, 19 nt, Homo sapiens
caaaguggguaaagaagac

SEQ ID NO: 474647 - RNA, 19 nt, Homo sapiens
cagaaguuguauuagauga

SEQ ID NO: 474648 - RNA, 19 nt, Homo sapiens
uugcagagguugaggagaa

SEQ ID NO: 474649 - RNA, 19 nt, Homo sapiens
gaaucuggaucagcaacuu

SEQ ID NO: 474650 - RNA, 19 nt, Homo sapiens
agaaauugguguaucagau

SEQ ID NO: 474651 - RNA, 19 nt, Homo sapiens
aaagaagacucaucaucca

SEQ ID NO: 474652 - RNA, 19 nt, Homo sapiens
ugaagugaauuaccaaugc

SEQ ID NO: 474653 - RNA, 19 nt, Homo sapiens
ugccgacgcugucaacaaa

SEQ ID NO: 474654 - RNA, 19 nt, Homo sapiens
uuaaggcaguucuuggaaa

SEQ ID NO: 474655 - RNA, 19 nt, Homo sapiens
ugaaagggaaccuauccua

SEQ ID NO: 474656 - RNA, 19 nt, Homo sapiens
gggaagaugcucaaauuac

SEQ ID NO: 474657 - RNA, 19 nt, Homo sapiens
ggaagcccaccgacuuuga

SEQ ID NO: 474658 - RNA, 19 nt, Homo sapiens
ggauguuguuccaguuaug

SEQ ID NO: 474659 - RNA, 19 nt, Homo sapiens
augggaagaugcucaaauu

SEQ ID NO: 474660 - RNA, 19 nt, Homo sapiens
cuagagcaguuaauacaca

SEQ ID NO: 474661 - RNA, 19 nt, Homo sapiens
gaauuaccaaugcuuugaa

SEQ ID NO: 474662 - RNA, 19 nt, Homo sapiens
gaagugaauuaccaaugcu

SEQ ID NO: 474663 - RNA, 19 nt, Homo sapiens
acacaacaacagcugauaa

SEQ ID NO: 474664 - RNA, 19 nt, Homo sapiens
ucuuauugcugcagugaaa

SEQ ID NO: 474665 - RNA, 19 nt, Homo sapiens
ggaucauacugcuuuaucu

SEQ ID NO: 474666 - RNA, 19 nt, Homo sapiens
ugaggaucauacugcuuua

SEQ ID NO: 474667 - RNA, 19 nt, Homo sapiens
uaaggcaguucuuggaaag

SEQ ID NO: 474668 - RNA, 19 nt, Homo sapiens
ucagcgacuuucuugguuu

SEQ ID NO: 474669 - RNA, 19 nt, Homo sapiens
acacacacacucugacauu

SEQ ID NO: 474670 - RNA, 19 nt, Homo sapiens
ccaucuaaauaaaccacua

SEQ ID NO: 474671 - RNA, 19 nt, Homo sapiens
uuaagaagaccuuggaugu

SEQ ID NO: 474672 - RNA, 19 nt, Homo sapiens
uaagaagaccuuggauguu

SEQ ID NO: 474673 - RNA, 19 nt, Homo sapiens
uaagauuguugccguuaag

SEQ ID NO: 474674 - RNA, 19 nt, Homo sapiens
uagaaucacuaguucaaac

SEQ ID NO: 474675 - RNA, 19 nt, Homo sapiens
gaaagaacgagugaaggau

SEQ ID NO: 474676 - RNA, 19 nt, Homo sapiens
ucauacugcuuuaucuaga

SEQ ID NO: 474677 - RNA, 19 nt, Homo sapiens
acacagcugccuuugcuaa

SEQ ID NO: 474678 - RNA, 19 nt, Homo sapiens
ggaaacuucaugucagugu

SEQ ID NO: 474679 - RNA, 19 nt, Homo sapiens
ugacaaucaagaugaauga

SEQ ID NO: 474680 - RNA, 19 nt, Homo sapiens
acccacagaaguuguauua

SEQ ID NO: 474681 - RNA, 19 nt, Homo sapiens
ugaagaagaagcaaaugga

SEQ ID NO: 474682 - RNA, 19 nt, Homo sapiens
cacacacacucugacauuu

SEQ ID NO: 474683 - RNA, 19 nt, Homo sapiens
cacaacaacagcugauaaa

SEQ ID NO: 474684 - RNA, 19 nt, Homo sapiens
aaagaacgagugaaggauu

SEQ ID NO: 474685 - RNA, 19 nt, Homo sapiens
agaaagaacgagugaagga

SEQ ID NO: 474686 - RNA, 19 nt, Homo sapiens
aaaugaugguugcuaacaa

SEQ ID NO: 474687 - RNA, 19 nt, Homo sapiens
gaugcaugguuugaagaaa

SEQ ID NO: 474688 - RNA, 19 nt, Homo sapiens
gaauauugaggauggugaa

SEQ ID NO: 474689 - RNA, 19 nt, Homo sapiens
gauugaagaagaagcaaau

SEQ ID NO: 474690 - RNA, 19 nt, Homo sapiens
gaugacagagaagaucuuu

SEQ ID NO: 474691 - RNA, 19 nt, Homo sapiens
aggagaagauagaccaguu

SEQ ID NO: 474692 - RNA, 19 nt, Homo sapiens
gaaaagcagcagcaauuug

SEQ ID NO: 474693 - RNA, 19 nt, Homo sapiens
cagcgacuuucuugguuug

SEQ ID NO: 474694 - RNA, 19 nt, Homo sapiens
gcaagaccagaaaauuuua

SEQ ID NO: 474695 - RNA, 19 nt, Homo sapiens
guaaagaggugaagcauau

SEQ ID NO: 474696 - RNA, 19 nt, Homo sapiens
gaagaugucugcugaugau

SEQ ID NO: 474697 - RNA, 19 nt, Homo sapiens
gaaguaacaccauauauca

SEQ ID NO: 474698 - RNA, 19 nt, Homo sapiens
gagcuacauucuccugaua

SEQ ID NO: 474699 - RNA, 19 nt, Homo sapiens
caagaagccaucauuagua

SEQ ID NO: 474700 - RNA, 19 nt, Homo sapiens
gaucugaccuuacauuugc

SEQ ID NO: 474701 - RNA, 19 nt, Homo sapiens
ucucuaggcugcauguuaa

SEQ ID NO: 474702 - RNA, 19 nt, Homo sapiens
gaagaucaucccucucaaa

SEQ ID NO: 474703 - RNA, 19 nt, Homo sapiens
ccauggaccugcacucuug

SEQ ID NO: 474704 - RNA, 19 nt, Homo sapiens
cauccgaaaucuauacuug

SEQ ID NO: 474705 - RNA, 19 nt, Homo sapiens
gaggugaggcuuacuauuc

SEQ ID NO: 474706 - RNA, 19 nt, Homo sapiens
gaucaucccucucaaaaug

SEQ ID NO: 474707 - RNA, 19 nt, Homo sapiens
cugcugagcugaucaagga

SEQ ID NO: 474708 - RNA, 19 nt, Homo sapiens
gaagccaucauuaguauca

SEQ ID NO: 474709 - RNA, 19 nt, Homo sapiens
cgaagccgauuguauuugu

SEQ ID NO: 474710 - RNA, 19 nt, Homo sapiens
aagaagccaucauuaguau

SEQ ID NO: 474711 - RNA, 19 nt, Homo sapiens
uaucaagaagccaucauua

SEQ ID NO: 474712 - RNA, 19 nt, Homo sapiens
ggaccaggauacuuguuca

SEQ ID NO: 474713 - RNA, 19 nt, Homo sapiens
gaucaaggaagucucucua

SEQ ID NO: 474714 - RNA, 19 nt, Homo sapiens
aggauuugcugcucuauga

SEQ ID NO: 474715 - RNA, 19 nt, Homo sapiens
guaacaccauauaucaaga

SEQ ID NO: 474716 - RNA, 19 nt, Homo sapiens
cgagaaguaacaccauaua

SEQ ID NO: 474717 - RNA, 19 nt, Homo sapiens
caaguucauccgagaagua

SEQ ID NO: 474718 - RNA, 19 nt, Homo sapiens
guaugggacugcuuguaug

SEQ ID NO: 474719 - RNA, 19 nt, Homo sapiens
caagaggugaggcuuacua

SEQ ID NO: 474720 - RNA, 19 nt, Homo sapiens
ggaagaucaucccucucaa

SEQ ID NO: 474721 - RNA, 19 nt, Homo sapiens
gagaaguaacaccauauau

SEQ ID NO: 474722 - RNA, 19 nt, Homo sapiens
ggcuuacuauucacuauga

SEQ ID NO: 474723 - RNA, 19 nt, Homo sapiens
ucaagaagccaucauuagu

SEQ ID NO: 474724 - RNA, 19 nt, Homo sapiens
ggaucugaccuuacauuug

SEQ ID NO: 474725 - RNA, 19 nt, Homo sapiens
agaaggauuugcugcucua

SEQ ID NO: 474726 - RNA, 19 nt, Homo sapiens
auccuacgcugcaaagaua

SEQ ID NO: 474727 - RNA, 19 nt, Homo sapiens
gcuauccacaccaacauaa

SEQ ID NO: 474728 - RNA, 19 nt, Homo sapiens
guccgaagccgauuguauu

SEQ ID NO: 474729 - RNA, 19 nt, Homo sapiens
gaggcuuacuauucacuau

SEQ ID NO: 474730 - RNA, 19 nt, Homo sapiens
cauguuaaauggccaagag

SEQ ID NO: 474731 - RNA, 19 nt, Homo sapiens
ccacagcuacccacuuguu

SEQ ID NO: 474732 - RNA, 19 nt, Homo sapiens
ccacagcacacuccugguu

SEQ ID NO: 474733 - RNA, 19 nt, Homo sapiens
ugccacagcuacccacuug

SEQ ID NO: 474734 - RNA, 19 nt, Homo sapiens
gaagccgauuguauuugug

SEQ ID NO: 474735 - RNA, 19 nt, Homo sapiens
gauccuacgcugcaaagau

SEQ ID NO: 474736 - RNA, 19 nt, Homo sapiens
agggagaacugaccaugga

SEQ ID NO: 474737 - RNA, 19 nt, Homo sapiens
uugaaaggcugaagauguc

SEQ ID NO: 474738 - RNA, 19 nt, Homo sapiens
ggagacacaucgggaucug

SEQ ID NO: 474739 - RNA, 19 nt, Homo sapiens
aaaacuagaugguggaaga

SEQ ID NO: 474740 - RNA, 19 nt, Homo sapiens
gcaguaaagaggugaagca

SEQ ID NO: 474741 - RNA, 19 nt, Homo sapiens
agaaguaacaccauauauc

SEQ ID NO: 474742 - RNA, 19 nt, Homo sapiens
ggccaagaggugaggcuua

SEQ ID NO: 474743 - RNA, 19 nt, Homo sapiens
aaacagauugauagagcua

SEQ ID NO: 474744 - RNA, 19 nt, Homo sapiens
uccgagaaguaacaccaua

SEQ ID NO: 474745 - RNA, 19 nt, Homo sapiens
gaccuuacauuugcuacca

SEQ ID NO: 474746 - RNA, 19 nt, Homo sapiens
ucccuuggaucugaccuua

SEQ ID NO: 474747 - RNA, 19 nt, Homo sapiens
gccaagaggugaggcuuac

SEQ ID NO: 474748 - RNA, 19 nt, Homo sapiens
gauagcaggaacacguuga

SEQ ID NO: 474749 - RNA, 19 nt, Homo sapiens
gugcuuugcugcuagaaac

SEQ ID NO: 474750 - RNA, 19 nt, Homo sapiens
cggccaaagucacucguau

SEQ ID NO: 474751 - RNA, 19 nt, Homo sapiens
uccgaaaucuauacuugga

SEQ ID NO: 474752 - RNA, 19 nt, Homo sapiens
ccuuggaucugaccuuaca

SEQ ID NO: 474753 - RNA, 19 nt, Homo sapiens
ucauggcugugacugagaa

SEQ ID NO: 474754 - RNA, 19 nt, Homo sapiens
auggagaccuguccucaug

SEQ ID NO: 474755 - RNA, 19 nt, Homo sapiens
aaagaggugaagcauauug

SEQ ID NO: 474756 - RNA, 19 nt, Homo sapiens
cguaugggacugcuuguau

SEQ ID NO: 474757 - RNA, 19 nt, Homo sapiens
cugaagaugucugcugaug

SEQ ID NO: 474758 - RNA, 19 nt, Homo sapiens
gcaccaaggacaggaagau

SEQ ID NO: 474759 - RNA, 19 nt, Homo sapiens
caucauuaguaucagaucu

SEQ ID NO: 474760 - RNA, 19 nt, Homo sapiens
ugaagaugucugcugauga

SEQ ID NO: 474761 - RNA, 19 nt, Homo sapiens
gccaaagucacucguaugg

SEQ ID NO: 474762 - RNA, 19 nt, Homo sapiens
aggugaggcuuacuauuca

SEQ ID NO: 474763 - RNA, 19 nt, Homo sapiens
gcugcucuaugacuguaug

SEQ ID NO: 474764 - RNA, 19 nt, Homo sapiens
guacagcaggaggcaguaa

SEQ ID NO: 474765 - RNA, 19 nt, Homo sapiens
ccacagguguuggcugaac

SEQ ID NO: 474766 - RNA, 19 nt, Homo sapiens
gcuccagcagcauauugua

SEQ ID NO: 474767 - RNA, 19 nt, Homo sapiens
gguggaagacagcaaugga

SEQ ID NO: 474768 - RNA, 19 nt, Homo sapiens
guagcuauccacaccaaca

SEQ ID NO: 474769 - RNA, 19 nt, Homo sapiens
ggccugggcaucagcauca

SEQ ID NO: 474770 - RNA, 19 nt, Homo sapiens
aaaaugugcuuugcugcua

SEQ ID NO: 474771 - RNA, 19 nt, Homo sapiens
aggaagaucaucccucuca

SEQ ID NO: 474772 - RNA, 19 nt, Homo sapiens
ggucaaguucauccgagaa

SEQ ID NO: 474773 - RNA, 19 nt, Homo sapiens
gaugguggaagacagcaau

SEQ ID NO: 474774 - RNA, 19 nt, Homo sapiens
uuugaaaggcugaagaugu

SEQ ID NO: 474775 - RNA, 19 nt, Homo sapiens
guucauccgagaaguaaca

SEQ ID NO: 474776 - RNA, 19 nt, Homo sapiens
aguaaagaggugaagcaua

SEQ ID NO: 474777 - RNA, 19 nt, Homo sapiens
uauccacaccaacauaaug

SEQ ID NO: 474778 - RNA, 19 nt, Homo sapiens
aagcaugccggaucuggaa

SEQ ID NO: 474779 - RNA, 19 nt, Homo sapiens
uaugggacugcuuguauga

SEQ ID NO: 474780 - RNA, 19 nt, Homo sapiens
ggccaaagucacucguaug

SEQ ID NO: 474781 - RNA, 19 nt, Homo sapiens
gaacaggcaaaacuagaug

SEQ ID NO: 474782 - RNA, 19 nt, Homo sapiens
uaggcugcauguuaaaugg

SEQ ID NO: 474783 - RNA, 19 nt, Homo sapiens
ccaaggacaggaagaucau

SEQ ID NO: 474784 - RNA, 19 nt, Homo sapiens
agagcuacauucuccugau

SEQ ID NO: 474785 - RNA, 19 nt, Homo sapiens
acagauugauagagcuaca

SEQ ID NO: 474786 - RNA, 19 nt, Homo sapiens
gacugucacaagaaauauu

SEQ ID NO: 474787 - RNA, 19 nt, Homo sapiens
uaaagaggugaagcauauu

SEQ ID NO: 474788 - RNA, 19 nt, Homo sapiens
gaagaugucugcugaugau

SEQ ID NO: 474789 - RNA, 19 nt, Homo sapiens
gaaguaacaccauauauca

SEQ ID NO: 474790 - RNA, 19 nt, Homo sapiens
caagaagccaucauuagua

SEQ ID NO: 474791 - RNA, 19 nt, Homo sapiens
gaucugaccuuacauuugc

SEQ ID NO: 474792 - RNA, 19 nt, Homo sapiens
ucucuaggcugcauguuaa

SEQ ID NO: 474793 - RNA, 19 nt, Homo sapiens
gaagaucaucccucucaaa

SEQ ID NO: 474794 - RNA, 19 nt, Homo sapiens
ccauggaccugcacucuug

SEQ ID NO: 474795 - RNA, 19 nt, Homo sapiens
cauccgaaaucuauacuug

SEQ ID NO: 474796 - RNA, 19 nt, Homo sapiens
gaggugaggcuuacuauuc

SEQ ID NO: 474797 - RNA, 19 nt, Homo sapiens
gaucaucccucucaaaaug

SEQ ID NO: 474798 - RNA, 19 nt, Homo sapiens
cugcugagcugaucaagga

SEQ ID NO: 474799 - RNA, 19 nt, Homo sapiens
gaagccaucauuaguauca

SEQ ID NO: 474800 - RNA, 19 nt, Homo sapiens
cgaagccgauuguauuugu

SEQ ID NO: 474801 - RNA, 19 nt, Homo sapiens
aagaagccaucauuaguau

SEQ ID NO: 474802 - RNA, 19 nt, Homo sapiens
uaucaagaagccaucauua

SEQ ID NO: 474803 - RNA, 19 nt, Homo sapiens
ggaccaggauacuuguuca

SEQ ID NO: 474804 - RNA, 19 nt, Homo sapiens
gaucaaggaagucucucua

SEQ ID NO: 474805 - RNA, 19 nt, Homo sapiens
aggauuugcugcucuauga

SEQ ID NO: 474806 - RNA, 19 nt, Homo sapiens
guaacaccauauaucaaga

SEQ ID NO: 474807 - RNA, 19 nt, Homo sapiens
cgagaaguaacaccauaua

SEQ ID NO: 474808 - RNA, 19 nt, Homo sapiens
caaguucauccgagaagua

SEQ ID NO: 474809 - RNA, 19 nt, Homo sapiens
guaugggacugcuuguaug

SEQ ID NO: 474810 - RNA, 19 nt, Homo sapiens
caagaggugaggcuuacua

SEQ ID NO: 474811 - RNA, 19 nt, Homo sapiens
ggaagaucaucccucucaa

SEQ ID NO: 474812 - RNA, 19 nt, Homo sapiens
gagaaguaacaccauauau

SEQ ID NO: 474813 - RNA, 19 nt, Homo sapiens
ggcuuacuauucacuauga

SEQ ID NO: 474814 - RNA, 19 nt, Homo sapiens
ucaagaagccaucauuagu

SEQ ID NO: 474815 - RNA, 19 nt, Homo sapiens
ggaucugaccuuacauuug

SEQ ID NO: 474816 - RNA, 19 nt, Homo sapiens
agaaggauuugcugcucua

SEQ ID NO: 474817 - RNA, 19 nt, Homo sapiens
guccgaagccgauuguauu

SEQ ID NO: 474818 - RNA, 19 nt, Homo sapiens
gaggcuuacuauucacuau

SEQ ID NO: 474819 - RNA, 19 nt, Homo sapiens
cauguuaaauggccaagag

SEQ ID NO: 474820 - RNA, 19 nt, Homo sapiens
ccacagcuacccacuuguu

SEQ ID NO: 474821 - RNA, 19 nt, Homo sapiens
ugccacagcuacccacuug

SEQ ID NO: 474822 - RNA, 19 nt, Homo sapiens
gaagccgauuguauuugug

SEQ ID NO: 474823 - RNA, 19 nt, Homo sapiens
agggagaacugaccaugga

SEQ ID NO: 474824 - RNA, 19 nt, Homo sapiens
uugaaaggcugaagauguc

SEQ ID NO: 474825 - RNA, 19 nt, Homo sapiens
ggagacacaucgggaucug

SEQ ID NO: 474826 - RNA, 19 nt, Homo sapiens
agaaguaacaccauauauc

SEQ ID NO: 474827 - RNA, 19 nt, Homo sapiens
aaaacuagaugguggaaga

SEQ ID NO: 474828 - RNA, 19 nt, Homo sapiens
gaaaacaggcaaaacuaga

SEQ ID NO: 474829 - RNA, 19 nt, Homo sapiens
ggccaagaggugaggcuua

SEQ ID NO: 474830 - RNA, 19 nt, Homo sapiens
gaccuuacauuugcuacca

SEQ ID NO: 474831 - RNA, 19 nt, Homo sapiens
uccgagaaguaacaccaua

SEQ ID NO: 474832 - RNA, 19 nt, Homo sapiens
ucccuuggaucugaccuua

SEQ ID NO: 474833 - RNA, 19 nt, Homo sapiens
gccaagaggugaggcuuac

SEQ ID NO: 474834 - RNA, 19 nt, Homo sapiens
gugcuuugcugcuagaaac

SEQ ID NO: 474835 - RNA, 19 nt, Homo sapiens
cggccaaagucacucguau

SEQ ID NO: 474836 - RNA, 19 nt, Homo sapiens
uccgaaaucuauacuugga

SEQ ID NO: 474837 - RNA, 19 nt, Homo sapiens
ccuuggaucugaccuuaca

SEQ ID NO: 474838 - RNA, 19 nt, Homo sapiens
ucauggcugugacugagaa

SEQ ID NO: 474839 - RNA, 19 nt, Homo sapiens
auggagaccuguccucaug

SEQ ID NO: 474840 - RNA, 19 nt, Homo sapiens
cguaugggacugcuuguau

SEQ ID NO: 474841 - RNA, 19 nt, Homo sapiens
cugaagaugucugcugaug

SEQ ID NO: 474842 - RNA, 19 nt, Homo sapiens
gcaccaaggacaggaagau

SEQ ID NO: 474843 - RNA, 19 nt, Homo sapiens
ugaagaugucugcugauga

SEQ ID NO: 474844 - RNA, 19 nt, Homo sapiens
caucauuaguaucagaucu

SEQ ID NO: 474845 - RNA, 19 nt, Homo sapiens
gccaaagucacucguaugg

SEQ ID NO: 474846 - RNA, 19 nt, Homo sapiens
aggugaggcuuacuauuca

SEQ ID NO: 474847 - RNA, 19 nt, Homo sapiens
gcugcucuaugacuguaug

SEQ ID NO: 474848 - RNA, 19 nt, Homo sapiens
gcuccagcagcauauugua

SEQ ID NO: 474849 - RNA, 19 nt, Homo sapiens
gguggaagacagcaaugga

SEQ ID NO: 474850 - RNA, 19 nt, Homo sapiens
aaaaugugcuuugcugcua

SEQ ID NO: 474851 - RNA, 19 nt, Homo sapiens
ggccugggcaucagcauca

SEQ ID NO: 474852 - RNA, 19 nt, Homo sapiens
aggaagaucaucccucuca

SEQ ID NO: 474853 - RNA, 19 nt, Homo sapiens
ggucaaguucauccgagaa

SEQ ID NO: 474854 - RNA, 19 nt, Homo sapiens
gaugguggaagacagcaau

SEQ ID NO: 474855 - RNA, 19 nt, Homo sapiens
uuugaaaggcugaagaugu

SEQ ID NO: 474856 - RNA, 19 nt, Homo sapiens
guucauccgagaaguaaca

SEQ ID NO: 474857 - RNA, 19 nt, Homo sapiens
aagcaugccggaucuggaa

SEQ ID NO: 474858 - RNA, 19 nt, Homo sapiens
uaugggacugcuuguauga

SEQ ID NO: 474859 - RNA, 19 nt, Homo sapiens
ggccaaagucacucguaug

SEQ ID NO: 474860 - RNA, 19 nt, Homo sapiens
ggaaaacaggcaaaacuag

SEQ ID NO: 474861 - RNA, 19 nt, Homo sapiens
uaggcugcauguuaaaugg

SEQ ID NO: 474862 - RNA, 19 nt, Homo sapiens
ccaaggacaggaagaucau

SEQ ID NO: 474863 - RNA, 19 nt, Homo sapiens
gacugucacaagaaauauu

SEQ ID NO: 474864 - RNA, 19 nt, Homo sapiens
gaaguucacuggagucuug

SEQ ID NO: 474865 - RNA, 19 nt, Homo sapiens
caaaucugcugccauguua

SEQ ID NO: 474866 - RNA, 19 nt, Homo sapiens
gaauaugccuuggcuguuu

SEQ ID NO: 474867 - RNA, 19 nt, Homo sapiens
gaacgugccucggguacua

SEQ ID NO: 474868 - RNA, 19 nt, Homo sapiens
gaagaugucucuaagaaac

SEQ ID NO: 474869 - RNA, 19 nt, Homo sapiens
gcacacuuguaguagauua

SEQ ID NO: 474870 - RNA, 19 nt, Homo sapiens
gcaaaggagucccuagaga

SEQ ID NO: 474871 - RNA, 19 nt, Homo sapiens
gcaaggcgcucucucuuag

SEQ ID NO: 474872 - RNA, 19 nt, Homo sapiens
ccacaaguauccagcuuaa

SEQ ID NO: 474873 - RNA, 19 nt, Homo sapiens
gaaauauccuuuggaacaa

SEQ ID NO: 474874 - RNA, 19 nt, Homo sapiens
ggaauguggugguccauga

SEQ ID NO: 474875 - RNA, 19 nt, Homo sapiens
gcagucacuuugaugauuu

SEQ ID NO: 474876 - RNA, 19 nt, Homo sapiens
uuaaucaccuccacucaua

SEQ ID NO: 474877 - RNA, 19 nt, Homo sapiens
ucaaggaaauguacucuau

SEQ ID NO: 474878 - RNA, 19 nt, Homo sapiens
gcaaagaagauaaaguuga

SEQ ID NO: 474879 - RNA, 19 nt, Homo sapiens
gagagcaccuccagaacaa

SEQ ID NO: 474880 - RNA, 19 nt, Homo sapiens
gaaaccggcugucaaaguc

SEQ ID NO: 474881 - RNA, 19 nt, Homo sapiens
gcuuuaauauggcuuguaa

SEQ ID NO: 474882 - RNA, 19 nt, Homo sapiens
ggaaauguacucuauuaug

SEQ ID NO: 474883 - RNA, 19 nt, Homo sapiens
gugacaggauguucuauaa

SEQ ID NO: 474884 - RNA, 19 nt, Homo sapiens
ggaaacaaauacacucaag

SEQ ID NO: 474885 - RNA, 19 nt, Homo sapiens
acuaacagcugaaguaaug

SEQ ID NO: 474886 - RNA, 19 nt, Homo sapiens
gaagguaaguagaguuucu

SEQ ID NO: 474887 - RNA, 19 nt, Homo sapiens
cgucauacuccaacuauua

SEQ ID NO: 474888 - RNA, 19 nt, Homo sapiens
cagaugaguuuagguaauu

SEQ ID NO: 474889 - RNA, 19 nt, Homo sapiens
gcacacuguuggaauguau

SEQ ID NO: 474890 - RNA, 19 nt, Homo sapiens
gcugagauguuacgcuuug

SEQ ID NO: 474891 - RNA, 19 nt, Homo sapiens
aaucauaaccugcuaacua

SEQ ID NO: 474892 - RNA, 19 nt, Homo sapiens
uggaauggcuuucaacuuc

SEQ ID NO: 474893 - RNA, 19 nt, Homo sapiens
ccacucaaaguaagauuua

SEQ ID NO: 474894 - RNA, 19 nt, Homo sapiens
uagagucaaucauguguuu

SEQ ID NO: 474895 - RNA, 19 nt, Homo sapiens
uaagaaaccggcugucaaa

SEQ ID NO: 474896 - RNA, 19 nt, Homo sapiens
uaucagagaccauguaguu

SEQ ID NO: 474897 - RNA, 19 nt, Homo sapiens
gaucagaaguaggaaggaa

SEQ ID NO: 474898 - RNA, 19 nt, Homo sapiens
guccaugacuggcuauauu

SEQ ID NO: 474899 - RNA, 19 nt, Homo sapiens
caacuucaacggaaacaaa

SEQ ID NO: 474900 - RNA, 19 nt, Homo sapiens
ucacaaacuuaacauggaa

SEQ ID NO: 474901 - RNA, 19 nt, Homo sapiens
caaauuuccuaccguuguu

SEQ ID NO: 474902 - RNA, 19 nt, Homo sapiens
caaagaagauaaaguugac

SEQ ID NO: 474903 - RNA, 19 nt, Homo sapiens
acagaugacucacuccauu

SEQ ID NO: 474904 - RNA, 19 nt, Homo sapiens
ggaauggcuuucaacuuca

SEQ ID NO: 474905 - RNA, 19 nt, Homo sapiens
caaggacuuucucugguuu

SEQ ID NO: 474906 - RNA, 19 nt, Homo sapiens
gaccacaucagaacaauau

SEQ ID NO: 474907 - RNA, 19 nt, Homo sapiens
uagaugaacugcuugaagu

SEQ ID NO: 474908 - RNA, 19 nt, Homo sapiens
gagguaugauuguaaagau

SEQ ID NO: 474909 - RNA, 19 nt, Homo sapiens
uggaauguaugcuaauuga

SEQ ID NO: 474910 - RNA, 19 nt, Homo sapiens
aaauaccucuggcuuagaa

SEQ ID NO: 474911 - RNA, 19 nt, Homo sapiens
uuggguagcucccugauuu

SEQ ID NO: 474912 - RNA, 19 nt, Homo sapiens
gaaggcuggugcuugaguu

SEQ ID NO: 474913 - RNA, 19 nt, Homo sapiens
guucaacuuuccacucaaa

SEQ ID NO: 474914 - RNA, 19 nt, Homo sapiens
agaaauauccuuuggaaca

SEQ ID NO: 474915 - RNA, 19 nt, Homo sapiens
uuacugaaguuaucugugu

SEQ ID NO: 474916 - RNA, 19 nt, Homo sapiens
gacaggauguucuauaagg

SEQ ID NO: 474917 - RNA, 19 nt, Homo sapiens
cuuuaucccuugguaauua

SEQ ID NO: 474918 - RNA, 19 nt, Homo sapiens
gaaguuugcacaggucuuu

SEQ ID NO: 474919 - RNA, 19 nt, Homo sapiens
gguauuguuuggaauuguu

SEQ ID NO: 474920 - RNA, 19 nt, Homo sapiens
gcaaauuuccuaccguugu

SEQ ID NO: 474921 - RNA, 19 nt, Homo sapiens
gcuuguaauucuugacauu

SEQ ID NO: 474922 - RNA, 19 nt, Homo sapiens
cuaguuugcuuuaauaugg

SEQ ID NO: 474923 - RNA, 19 nt, Homo sapiens
ccagaugaguuuagguaau

SEQ ID NO: 474924 - RNA, 19 nt, Homo sapiens
gcuuucaacuucauuguca

SEQ ID NO: 474925 - RNA, 19 nt, Homo sapiens
aaggaaggcuggugcuuga

SEQ ID NO: 474926 - RNA, 19 nt, Homo sapiens
cagcugaaguaaugacaga

SEQ ID NO: 474927 - RNA, 19 nt, Homo sapiens
ggagaaaucaagcacuguu

SEQ ID NO: 474928 - RNA, 19 nt, Homo sapiens
gcugauccguucucucuuc

SEQ ID NO: 474929 - RNA, 19 nt, Homo sapiens
cagaggaauugaagccauu

SEQ ID NO: 474930 - RNA, 19 nt, Homo sapiens
caccuccacucauauuaaa

SEQ ID NO: 474931 - RNA, 19 nt, Homo sapiens
uuaaauaccucuggcuuag

SEQ ID NO: 474932 - RNA, 19 nt, Homo sapiens
gauuuggaauguucugaug

SEQ ID NO: 474933 - RNA, 19 nt, Homo sapiens
ucucuuagaugaacugcuu

SEQ ID NO: 474934 - RNA, 19 nt, Homo sapiens
ggcagucacuuugaugauu

SEQ ID NO: 474935 - RNA, 19 nt, Homo sapiens
gagucaaucauguguuuaa

SEQ ID NO: 474936 - RNA, 19 nt, Homo sapiens
gggagaagaccgacuaaca

SEQ ID NO: 474937 - RNA, 19 nt, Homo sapiens
ggacuugucguuacguguu

SEQ ID NO: 474938 - RNA, 19 nt, Homo sapiens
uaaauucagcuaaggagaa

SEQ ID NO: 474939 - RNA, 19 nt, Homo sapiens
gcuucccgguucaucauua

SEQ ID NO: 474940 - RNA, 19 nt, Homo sapiens
ccagaacaaggaaagauuu

SEQ ID NO: 474941 - RNA, 19 nt, Homo sapiens
gcuaacuaguuugcuuuaa

SEQ ID NO: 474942 - RNA, 19 nt, Homo sapiens
uuucuuggccacugaauua

SEQ ID NO: 474943 - RNA, 19 nt, Homo sapiens
gaaguaaugacagauuguu

SEQ ID NO: 474944 - RNA, 19 nt, Homo sapiens
acaaggacuuucucugguu

SEQ ID NO: 474945 - RNA, 19 nt, Homo sapiens
ggugacaggauguucuaua

SEQ ID NO: 474946 - RNA, 19 nt, Homo sapiens
gcacaggucuuugguugcu

SEQ ID NO: 474947 - RNA, 19 nt, Homo sapiens
ugacagcuaucccaggaau

SEQ ID NO: 474948 - RNA, 19 nt, Homo sapiens
cagcagaggcagaggaauu

SEQ ID NO: 474949 - RNA, 19 nt, Homo sapiens
uaccaugaauucuugaguu

SEQ ID NO: 474950 - RNA, 19 nt, Homo sapiens
agagaaacccugcaaagga

SEQ ID NO: 474951 - RNA, 19 nt, Homo sapiens
guugauagcaaagaagaua

SEQ ID NO: 474952 - RNA, 19 nt, Homo sapiens
aucaagcacuguuccaaua

SEQ ID NO: 474953 - RNA, 19 nt, Homo sapiens
gaagaugaagaccagagaa

SEQ ID NO: 474954 - RNA, 19 nt, Homo sapiens
ccucagcacacuuguagua

SEQ ID NO: 474955 - RNA, 19 nt, Homo sapiens
uuguaaagauugagcauug

SEQ ID NO: 474956 - RNA, 19 nt, Homo sapiens
uguaugagguaugauugua

SEQ ID NO: 474957 - RNA, 19 nt, Homo sapiens
ggucaugauuucugugaag

SEQ ID NO: 474958 - RNA, 19 nt, Homo sapiens
cauguuagcugucuuugcu

SEQ ID NO: 474959 - RNA, 19 nt, Homo sapiens
gugcugauucucuuccuua

SEQ ID NO: 474960 - RNA, 19 nt, Homo sapiens
aaauucagcuaaggagaaa

SEQ ID NO: 474961 - RNA, 19 nt, Homo sapiens
ugaaggaaguuggcaguca

SEQ ID NO: 474962 - RNA, 19 nt, Homo sapiens
gaauguaugcuaauugaac

SEQ ID NO: 474963 - RNA, 19 nt, Homo sapiens
ccaaaacacuuaggaagaa

SEQ ID NO: 474964 - RNA, 19 nt, Homo sapiens
gggcaaagguggaaaugaa

SEQ ID NO: 474965 - RNA, 19 nt, Homo sapiens
gcacacuggugguccauga

SEQ ID NO: 474966 - RNA, 19 nt, Homo sapiens
caaugugacugcugacaaa

SEQ ID NO: 474967 - RNA, 19 nt, Homo sapiens
gaaaguaauggaccaguga

SEQ ID NO: 474968 - RNA, 19 nt, Homo sapiens
ggagaccauugcaucauug

SEQ ID NO: 474969 - RNA, 19 nt, Homo sapiens
guucaugaguuuggagaua

SEQ ID NO: 474970 - RNA, 19 nt, Homo sapiens
gaaaguacaaagacaggaa

SEQ ID NO: 474971 - RNA, 19 nt, Homo sapiens
ccugcuagcuguagaaaug

SEQ ID NO: 474972 - RNA, 19 nt, Homo sapiens
gcagaugacuugggcaaag

SEQ ID NO: 474973 - RNA, 19 nt, Homo sapiens
gugcagguccucacuuuaa

SEQ ID NO: 474974 - RNA, 19 nt, Homo sapiens
ggaaaugaagaaaguacaa

SEQ ID NO: 474975 - RNA, 19 nt, Homo sapiens
gagcagaaggaaaguaaug

SEQ ID NO: 474976 - RNA, 19 nt, Homo sapiens
ugaagaaaguacaaagaca

SEQ ID NO: 474977 - RNA, 19 nt, Homo sapiens
gugcagggcaucaucaauu

SEQ ID NO: 474978 - RNA, 19 nt, Homo sapiens
ggaagucguuuggcuugug

SEQ ID NO: 474979 - RNA, 19 nt, Homo sapiens
gcaaagguggaaaugaaga

SEQ ID NO: 474980 - RNA, 19 nt, Homo sapiens
uuaauccucuauccagaaa

SEQ ID NO: 474981 - RNA, 19 nt, Homo sapiens
ugcagggcaucaucaauuu

SEQ ID NO: 474982 - RNA, 19 nt, Homo sapiens
gcaaugugacugcugacaa

SEQ ID NO: 474983 - RNA, 19 nt, Homo sapiens
uauugaagauucugugauc

SEQ ID NO: 474984 - RNA, 19 nt, Homo sapiens
gauaauacggcaggcugua

SEQ ID NO: 474985 - RNA, 19 nt, Homo sapiens
cgaugugucuauugaagau

SEQ ID NO: 474986 - RNA, 19 nt, Homo sapiens
gaugaagagaggcauguug

SEQ ID NO: 474987 - RNA, 19 nt, Homo sapiens
gcagaaggaaaguaaugga

SEQ ID NO: 474988 - RNA, 19 nt, Homo sapiens
ucccuuggauguagucuga

SEQ ID NO: 474989 - RNA, 19 nt, Homo sapiens
uggccgaugugucuauuga

SEQ ID NO: 474990 - RNA, 19 nt, Homo sapiens
ucguuuggcuuguggugua

SEQ ID NO: 474991 - RNA, 19 nt, Homo sapiens
caaagguggaaaugaagaa

SEQ ID NO: 474992 - RNA, 19 nt, Homo sapiens
gaggcauguuggagacuug

SEQ ID NO: 474993 - RNA, 19 nt, Homo sapiens
aggagaccauugcaucauu

SEQ ID NO: 474994 - RNA, 19 nt, Homo sapiens
gccgaugugucuauugaag

SEQ ID NO: 474995 - RNA, 19 nt, Homo sapiens
guaauggaccagugaaggu

SEQ ID NO: 474996 - RNA, 19 nt, Homo sapiens
ucaucaauuucgagcagaa

SEQ ID NO: 474997 - RNA, 19 nt, Homo sapiens
ucgagcagaaggaaaguaa

SEQ ID NO: 474998 - RNA, 19 nt, Homo sapiens
uucaugaguuuggagauaa

SEQ ID NO: 474999 - RNA, 19 nt, Homo sapiens
ugugacugcugacaaagau

SEQ ID NO: 475000 - RNA, 19 nt, Homo sapiens
guuggagacuugggcaaug

SEQ ID NO: 475001 - RNA, 19 nt, Homo sapiens
aagaugguguggccgaugu

SEQ ID NO: 475002 - RNA, 19 nt, Homo sapiens
ggagacuugggcaauguga

SEQ ID NO: 475003 - RNA, 19 nt, Homo sapiens
ucaugaguuuggagauaau

SEQ ID NO: 475004 - RNA, 19 nt, Homo sapiens
aaaguacaaagacaggaaa

SEQ ID NO: 475005 - RNA, 19 nt, Homo sapiens
gcagggcaucaucaauuuc

SEQ ID NO: 475006 - RNA, 19 nt, Homo sapiens
ucacuuuaauccucuaucc

SEQ ID NO: 475007 - RNA, 19 nt, Homo sapiens
gcagguccucacuuuaauc

SEQ ID NO: 475008 - RNA, 19 nt, Homo sapiens
acacuggugguccaugaaa

SEQ ID NO: 475009 - RNA, 19 nt, Homo sapiens
ucaggagaccauugcauca

SEQ ID NO: 475010 - RNA, 19 nt, Homo sapiens
ggaagcauuaaaggacuga

SEQ ID NO: 475011 - RNA, 19 nt, Homo sapiens
cagaugacuugggcaaagg

SEQ ID NO: 475012 - RNA, 19 nt, Homo sapiens
ggaugaagagaggcauguu

SEQ ID NO: 475013 - RNA, 19 nt, Homo sapiens
ggacaaaccucagcccuaa

SEQ ID NO: 475014 - RNA, 19 nt, Homo sapiens
acaguaagcugcucuauug

SEQ ID NO: 475015 - RNA, 19 nt, Homo sapiens
gaauguaacugaaagauac

SEQ ID NO: 475016 - RNA, 19 nt, Homo sapiens
ucagagagcuaaauuacaa

SEQ ID NO: 475017 - RNA, 19 nt, Homo sapiens
guaaaugcuuugugugauu

SEQ ID NO: 475018 - RNA, 19 nt, Homo sapiens
ggagcacgcuuacuaccuu

SEQ ID NO: 475019 - RNA, 19 nt, Homo sapiens
aaagauacauggcuugcaa

SEQ ID NO: 475020 - RNA, 19 nt, Homo sapiens
guaaucaacugggagaaug

SEQ ID NO: 475021 - RNA, 19 nt, Homo sapiens
guaagcugcucuauuguag

SEQ ID NO: 475022 - RNA, 19 nt, Homo sapiens
uaaaugcuuugugugauug

SEQ ID NO: 475023 - RNA, 19 nt, Homo sapiens
ggaacaacaggccuuauuc

SEQ ID NO: 475024 - RNA, 19 nt, Homo sapiens
gcugacggcugcaucuguu

SEQ ID NO: 475025 - RNA, 19 nt, Homo sapiens
gguauagaguacugcagaa

SEQ ID NO: 475026 - RNA, 19 nt, Homo sapiens
uauagaguacugcagaaua

SEQ ID NO: 475027 - RNA, 19 nt, Homo sapiens
gggagaauguaacugaaag

SEQ ID NO: 475028 - RNA, 19 nt, Homo sapiens
ggacuuugguuccuuugac

SEQ ID NO: 475029 - RNA, 19 nt, Homo sapiens
ccuauucuauugcaguuau

SEQ ID NO: 475030 - RNA, 19 nt, Homo sapiens
ggucauaucaaucauagca

SEQ ID NO: 475031 - RNA, 19 nt, Homo sapiens
gaacgucaccgaggagaag

SEQ ID NO: 475032 - RNA, 19 nt, Homo sapiens
aaguaaaccacgaucguua

SEQ ID NO: 475033 - RNA, 19 nt, Homo sapiens
ggaugccuuucuaguccua

SEQ ID NO: 475034 - RNA, 19 nt, Homo sapiens
guagugguauagaguacug

SEQ ID NO: 475035 - RNA, 19 nt, Homo sapiens
uaguaaaugcuuuguguga

SEQ ID NO: 475036 - RNA, 19 nt, Homo sapiens
guggucauaucaaucauag

SEQ ID NO: 475037 - RNA, 19 nt, Homo sapiens
gaacggggacacuuacaaa

SEQ ID NO: 475038 - RNA, 19 nt, Homo sapiens
gcuggaagccaucaaacug

SEQ ID NO: 475039 - RNA, 19 nt, Homo sapiens
caauggugguggucauauc

SEQ ID NO: 475040 - RNA, 19 nt, Homo sapiens
guaaaccacgaucguuaug

SEQ ID NO: 475041 - RNA, 19 nt, Homo sapiens
ggagaauguaacugaaaga

SEQ ID NO: 475042 - RNA, 19 nt, Homo sapiens
gaacaacaggccuuauucc

SEQ ID NO: 475043 - RNA, 19 nt, Homo sapiens
auagaguacugcagaauac

SEQ ID NO: 475044 - RNA, 19 nt, Homo sapiens
gagaauguaacugaaagau

SEQ ID NO: 475045 - RNA, 19 nt, Homo sapiens
ugugggagcacgcuuacua

SEQ ID NO: 475046 - RNA, 19 nt, Homo sapiens
ccuggaaccucacaucaac

SEQ ID NO: 475047 - RNA, 19 nt, Homo sapiens
gguggucauaucaaucaua

SEQ ID NO: 475048 - RNA, 19 nt, Homo sapiens
gcaagugauugaaaauagu

SEQ ID NO: 475049 - RNA, 19 nt, Homo sapiens
aguaagcugcucuauugua

SEQ ID NO: 475050 - RNA, 19 nt, Homo sapiens
gaguauguuaagcucuuua

SEQ ID NO: 475051 - RNA, 19 nt, Homo sapiens
guuaugcugaguauguuaa

SEQ ID NO: 475052 - RNA, 19 nt, Homo sapiens
uugacaaguuuaaggagaa

SEQ ID NO: 475053 - RNA, 19 nt, Homo sapiens
cugaguauguuaagcucuu

SEQ ID NO: 475054 - RNA, 19 nt, Homo sapiens
aaaucaggauccacugcaa

SEQ ID NO: 475055 - RNA, 19 nt, Homo sapiens
gacuuugguuccuuugaca

SEQ ID NO: 475056 - RNA, 19 nt, Homo sapiens
guccuauucuauugcaguu

SEQ ID NO: 475057 - RNA, 19 nt, Homo sapiens
ggcaagugauugaaaauag

SEQ ID NO: 475058 - RNA, 19 nt, Homo sapiens
ugaguauguuaagcucuuu

SEQ ID NO: 475059 - RNA, 19 nt, Homo sapiens
aaaccacgaucguuaugcu

SEQ ID NO: 475060 - RNA, 19 nt, Homo sapiens
aaaguaaaccacgaucguu

SEQ ID NO: 475061 - RNA, 19 nt, Homo sapiens
gaagcugacggcugcaucu

SEQ ID NO: 475062 - RNA, 19 nt, Homo sapiens
guagggaugccuuucuagu

SEQ ID NO: 475063 - RNA, 19 nt, Homo sapiens
caacugggagaauguaacu

SEQ ID NO: 475064 - RNA, 19 nt, Homo sapiens
uuguagggaugccuuucua

SEQ ID NO: 475065 - RNA, 19 nt, Homo sapiens
uacaguaagcugcucuauu

SEQ ID NO: 475066 - RNA, 19 nt, Homo sapiens
gugguggucauaucaauca

SEQ ID NO: 475067 - RNA, 19 nt, Homo sapiens
caggauccacugcaaggaa

SEQ ID NO: 475068 - RNA, 19 nt, Homo sapiens
caaauugcugcuuguccaa

SEQ ID NO: 475069 - RNA, 19 nt, Homo sapiens
gcucuauuguagcauuucu

SEQ ID NO: 475070 - RNA, 19 nt, Homo sapiens
gaaagauacauggcuugca

SEQ ID NO: 475071 - RNA, 19 nt, Homo sapiens
aggaacaacaggccuuauu

SEQ ID NO: 475072 - RNA, 19 nt, Homo sapiens
cggggacacuuacaaauug

SEQ ID NO: 475073 - RNA, 19 nt, Homo sapiens
uggcuugguuucaauaagg

SEQ ID NO: 475074 - RNA, 19 nt, Homo sapiens
guucaauggugguggucau

SEQ ID NO: 475075 - RNA, 19 nt, Homo sapiens
cccuaacggugguggagaa

SEQ ID NO: 475076 - RNA, 19 nt, Homo sapiens
cuucagagagcuaaauuac

SEQ ID NO: 475077 - RNA, 19 nt, Homo sapiens
cgaucguuaugcugaguau

SEQ ID NO: 475078 - RNA, 19 nt, Homo sapiens
ggguuggcuugguuucaau

SEQ ID NO: 475079 - RNA, 19 nt, Homo sapiens
ucuauuguagcauuucuug

SEQ ID NO: 475080 - RNA, 19 nt, Homo sapiens
ggccaagggagauguuaca

SEQ ID NO: 475081 - RNA, 19 nt, Homo sapiens
guauagaguacugcagaau

SEQ ID NO: 475082 - RNA, 19 nt, Homo sapiens
ggcuugguuucaauaagga

SEQ ID NO: 475083 - RNA, 19 nt, Homo sapiens
ugacaaguuuaaggagaag

SEQ ID NO: 475084 - RNA, 19 nt, Homo sapiens
ggaaagggcugcuaugauu

SEQ ID NO: 475085 - RNA, 19 nt, Homo sapiens
cugaaggccuccauuugua

SEQ ID NO: 475086 - RNA, 19 nt, Homo sapiens
uaacgacaaugacaaugau

SEQ ID NO: 475087 - RNA, 19 nt, Homo sapiens
gggcugcuaugauugagaa

SEQ ID NO: 475088 - RNA, 19 nt, Homo sapiens
gaugagcacccaauaaaca

SEQ ID NO: 475089 - RNA, 19 nt, Homo sapiens
gggaaacacuccuaguucu

SEQ ID NO: 475090 - RNA, 19 nt, Homo sapiens
guaacgacaaugacaauga

SEQ ID NO: 475091 - RNA, 19 nt, Homo sapiens
gagggaaacacuccuaguu

SEQ ID NO: 475092 - RNA, 19 nt, Homo sapiens
uaauaacgguaacgacaau

SEQ ID NO: 475093 - RNA, 19 nt, Homo sapiens
gaaagggcugcuaugauug

SEQ ID NO: 475094 - RNA, 19 nt, Homo sapiens
gagcacccaauaaacauuu

SEQ ID NO: 475095 - RNA, 19 nt, Homo sapiens
acccagaggucucccuaua

SEQ ID NO: 475096 - RNA, 19 nt, Homo sapiens
ggucugaaggccuccauuu

SEQ ID NO: 475097 - RNA, 19 nt, Homo sapiens
gggaauguuuggcaaccuu

SEQ ID NO: 475098 - RNA, 19 nt, Homo sapiens
caaugacaaugaugauuac

SEQ ID NO: 475099 - RNA, 19 nt, Homo sapiens
uggaugagcacccaauaaa

SEQ ID NO: 475100 - RNA, 19 nt, Homo sapiens
ucacgaggcccuguucauu

SEQ ID NO: 475101 - RNA, 19 nt, Homo sapiens
cauggugacuggaauggau

SEQ ID NO: 475102 - RNA, 19 nt, Homo sapiens
caaccuuuguguuacagau

SEQ ID NO: 475103 - RNA, 19 nt, Homo sapiens
gcacucagagcgcaagaag

SEQ ID NO: 475104 - RNA, 19 nt, Homo sapiens
ggaugcauuuacugacguu

SEQ ID NO: 475105 - RNA, 19 nt, Homo sapiens
uuuggcaaccuuuguguua

SEQ ID NO: 475106 - RNA, 19 nt, Homo sapiens
aaagggcugcuaugauuga

SEQ ID NO: 475107 - RNA, 19 nt, Homo sapiens
ggaauguuuggcaaccuuu

SEQ ID NO: 475108 - RNA, 19 nt, Homo sapiens
gacaaugacaaugaugauu

SEQ ID NO: 475109 - RNA, 19 nt, Homo sapiens
gaauggaugagcacccaau

SEQ ID NO: 475110 - RNA, 19 nt, Homo sapiens
accuuuguguuacagauua

SEQ ID NO: 475111 - RNA, 19 nt, Homo sapiens
caagcucgacgccuucuuc

SEQ ID NO: 475112 - RNA, 19 nt, Homo sapiens
ggaaacacuccuaguucuc

SEQ ID NO: 475113 - RNA, 19 nt, Homo sapiens
gaggcccuguucauucuuc

SEQ ID NO: 475114 - RNA, 19 nt, Homo sapiens
ggaguggauccgagacaug

SEQ ID NO: 475115 - RNA, 19 nt, Homo sapiens
ucugaaggccuccauuugu

SEQ ID NO: 475116 - RNA, 19 nt, Homo sapiens
ccagaggucucccuauacc

SEQ ID NO: 475117 - RNA, 19 nt, Homo sapiens
acucuguacuggaugcauu

SEQ ID NO: 475118 - RNA, 19 nt, Homo sapiens
cgacaaugacaaugaugau

SEQ ID NO: 475119 - RNA, 19 nt, Homo sapiens
gaauguuuggcaaccuuug

SEQ ID NO: 475120 - RNA, 19 nt, Homo sapiens
ugcauuuacugacguuguu

SEQ ID NO: 475121 - RNA, 19 nt, Homo sapiens
gaguggauccgagacaugu

SEQ ID NO: 475122 - RNA, 19 nt, Homo sapiens
uggcaaccuuuguguuaca

SEQ ID NO: 475123 - RNA, 19 nt, Homo sapiens
gccagccacuguguuguca

SEQ ID NO: 475124 - RNA, 19 nt, Homo sapiens
ggaugagcacccaauaaac

SEQ ID NO: 475125 - RNA, 19 nt, Homo sapiens
ccauccacgugcaccaguu

SEQ ID NO: 475126 - RNA, 19 nt, Homo sapiens
cacgaggcccuguucauuc

SEQ ID NO: 475127 - RNA, 19 nt, Homo sapiens
ucacugggcgaguaaugau

SEQ ID NO: 475128 - RNA, 19 nt, Homo sapiens
cuccuucaucucuuuaaua

SEQ ID NO: 475129 - RNA, 19 nt, Homo sapiens
ccuuuguguuacagauuaa

SEQ ID NO: 475130 - RNA, 19 nt, Homo sapiens
guacuggaugcauuuacug

SEQ ID NO: 475131 - RNA, 19 nt, Homo sapiens
gggugcagcucucuuuuca

SEQ ID NO: 475132 - RNA, 19 nt, Homo sapiens
acgaggcccuguucauucu

SEQ ID NO: 475133 - RNA, 19 nt, Homo sapiens
caggagcucuguccgcaaa

SEQ ID NO: 475134 - RNA, 19 nt, Homo sapiens
ccaaaaugcugaguucuaa

SEQ ID NO: 475135 - RNA, 19 nt, Homo sapiens
ccaaggcacucugggagaa

SEQ ID NO: 475136 - RNA, 19 nt, Homo sapiens
gcucgaggcuggucauggu

SEQ ID NO: 475137 - RNA, 19 nt, Homo sapiens
gaucaacugcuccgucuuc

SEQ ID NO: 475138 - RNA, 19 nt, Homo sapiens
ugagugugcuggaggaaga

SEQ ID NO: 475139 - RNA, 19 nt, Homo sapiens
ccacugcacugggugauuc

SEQ ID NO: 475140 - RNA, 19 nt, Homo sapiens
gcacaagcccgaccucaac

SEQ ID NO: 475141 - RNA, 19 nt, Homo sapiens
gauggaguacggcgacuuu

SEQ ID NO: 475142 - RNA, 19 nt, Homo sapiens
acaugaagguggacgauuc

SEQ ID NO: 475143 - RNA, 19 nt, Homo sapiens
ccaagugcacgcucagaaa

SEQ ID NO: 475144 - RNA, 19 nt, Homo sapiens
gugagggcaugaccugcua

SEQ ID NO: 475145 - RNA, 19 nt, Homo sapiens
ggagacaccgugcguuaca

SEQ ID NO: 475146 - RNA, 19 nt, Homo sapiens
cugcacggcuccuacuuug

SEQ ID NO: 475147 - RNA, 19 nt, Homo sapiens
ggcggugccugucucagaa

SEQ ID NO: 475148 - RNA, 19 nt, Homo sapiens
ggguggcccucaucgagaa

SEQ ID NO: 475149 - RNA, 19 nt, Homo sapiens
ccggagacaccgugcguua

SEQ ID NO: 475150 - RNA, 19 nt, Homo sapiens
gggcaugaccugcuacuac

SEQ ID NO: 475151 - RNA, 19 nt, Homo sapiens
gaggaagcagguccaguga

SEQ ID NO: 475152 - RNA, 19 nt, Homo sapiens
ccacgcagaauaccucgaa

SEQ ID NO: 475153 - RNA, 19 nt, Homo sapiens
gcagugagggugucuucug

SEQ ID NO: 475154 - RNA, 19 nt, Homo sapiens
agaaggcgcuggccaagcu

SEQ ID NO: 475155 - RNA, 19 nt, Homo sapiens
ggaguacggcgacuuuguc

SEQ ID NO: 475156 - RNA, 19 nt, Homo sapiens
gaugggaaccacggacuga

SEQ ID NO: 475157 - RNA, 19 nt, Homo sapiens
cguccacccugcagaacaa

SEQ ID NO: 475158 - RNA, 19 nt, Homo sapiens
gcugcacggcuccuacuuu

SEQ ID NO: 475159 - RNA, 19 nt, Homo sapiens
ggaggcagaaguuguggau

SEQ ID NO: 475160 - RNA, 19 nt, Homo sapiens
gugagggugucuucuggau

SEQ ID NO: 475161 - RNA, 19 nt, Homo sapiens
gggagaacaaugugagcuu

SEQ ID NO: 475162 - RNA, 19 nt, Homo sapiens
gaucuugucccagcuagag

SEQ ID NO: 475163 - RNA, 19 nt, Homo sapiens
gacaugcugcccugugaug

SEQ ID NO: 475164 - RNA, 19 nt, Homo sapiens
gcguggaggagcagaaaug

SEQ ID NO: 475165 - RNA, 19 nt, Homo sapiens
gccaagugcacgcucagaa

SEQ ID NO: 475166 - RNA, 19 nt, Homo sapiens
acgacaugcugcccuguga

SEQ ID NO: 475167 - RNA, 19 nt, Homo sapiens
gaggacgcuugagccagaa

SEQ ID NO: 475168 - RNA, 19 nt, Homo sapiens
acaaggacgaggaggagaa

SEQ ID NO: 475169 - RNA, 19 nt, Homo sapiens
gaccucaucugggccaaaa

SEQ ID NO: 475170 - RNA, 19 nt, Homo sapiens
ggcacaagcccgaccucaa

SEQ ID NO: 475171 - RNA, 19 nt, Homo sapiens
gcaccgacagcuucaacgu

SEQ ID NO: 475172 - RNA, 19 nt, Homo sapiens
gaccugcuacuaccugaca

SEQ ID NO: 475173 - RNA, 19 nt, Homo sapiens
caacaugaagguggacgau

SEQ ID NO: 475174 - RNA, 19 nt, Homo sapiens
cguugacacugaccucauc

SEQ ID NO: 475175 - RNA, 19 nt, Homo sapiens
cgaccgcugugaccaccau

SEQ ID NO: 475176 - RNA, 19 nt, Homo sapiens
gaguacggcgacuuuguca

SEQ ID NO: 475177 - RNA, 19 nt, Homo sapiens
gggccaaaaugcugaguuc

SEQ ID NO: 475178 - RNA, 19 nt, Homo sapiens
caagugcacgcucagaaac

SEQ ID NO: 475179 - RNA, 19 nt, Homo sapiens
cuaaagagauggaacauaa

SEQ ID NO: 475180 - RNA, 19 nt, Homo sapiens
gcaacuagcucaauggauu

SEQ ID NO: 475181 - RNA, 19 nt, Homo sapiens
caaaggaccucauggcuaa

SEQ ID NO: 475182 - RNA, 19 nt, Homo sapiens
agaaggagcuuuagcauuu

SEQ ID NO: 475183 - RNA, 19 nt, Homo sapiens
gcuagaaccuccuguagua

SEQ ID NO: 475184 - RNA, 19 nt, Homo sapiens
gaacuucucugcugcaaug

SEQ ID NO: 475185 - RNA, 19 nt, Homo sapiens
ggaaauuggugaagagaaa

SEQ ID NO: 475186 - RNA, 19 nt, Homo sapiens
gagccagaaucuucaauua

SEQ ID NO: 475187 - RNA, 19 nt, Homo sapiens
acaagacccuuauagauua

SEQ ID NO: 475188 - RNA, 19 nt, Homo sapiens
ggauaaggcucaauuacuu

SEQ ID NO: 475189 - RNA, 19 nt, Homo sapiens
caacugagguggcuauaga

SEQ ID NO: 475190 - RNA, 19 nt, Homo sapiens
cgacagcgcuggaauccua

SEQ ID NO: 475191 - RNA, 19 nt, Homo sapiens
ugacaaagauucuggauuc

SEQ ID NO: 475192 - RNA, 19 nt, Homo sapiens
ggacaucucuacagcaaug

SEQ ID NO: 475193 - RNA, 19 nt, Homo sapiens
gagagaaggagaaggauua

SEQ ID NO: 475194 - RNA, 19 nt, Homo sapiens
gcgcuggaauccuauaaua

SEQ ID NO: 475195 - RNA, 19 nt, Homo sapiens
gcaaccaccugaauuucua

SEQ ID NO: 475196 - RNA, 19 nt, Homo sapiens
ggagcugccuacuacauua

SEQ ID NO: 475197 - RNA, 19 nt, Homo sapiens
ggucuuagauacagaacua

SEQ ID NO: 475198 - RNA, 19 nt, Homo sapiens
gcagaggccaguacauuua

SEQ ID NO: 475199 - RNA, 19 nt, Homo sapiens
gaaguaagcguuccaaauc

SEQ ID NO: 475200 - RNA, 19 nt, Homo sapiens
ucauuaagaucucgaagua

SEQ ID NO: 475201 - RNA, 19 nt, Homo sapiens
gaagauagaggaaguacuu

SEQ ID NO: 475202 - RNA, 19 nt, Homo sapiens
ggaagaagaucuguaucaa

SEQ ID NO: 475203 - RNA, 19 nt, Homo sapiens
uauggacucucaaauguua

SEQ ID NO: 475204 - RNA, 19 nt, Homo sapiens
aaacagauccuacugauga

SEQ ID NO: 475205 - RNA, 19 nt, Homo sapiens
gcacccagguccuauagaa

SEQ ID NO: 475206 - RNA, 19 nt, Homo sapiens
gggcucagcugaacucuau

SEQ ID NO: 475207 - RNA, 19 nt, Homo sapiens
gacaagacccuuauagauu

SEQ ID NO: 475208 - RNA, 19 nt, Homo sapiens
agaaagagcuucagagucu

SEQ ID NO: 475209 - RNA, 19 nt, Homo sapiens
ggauacagaagaaccauua

SEQ ID NO: 475210 - RNA, 19 nt, Homo sapiens
gcucuaugaugucagcuua

SEQ ID NO: 475211 - RNA, 19 nt, Homo sapiens
caagaacaguuggccaaua

SEQ ID NO: 475212 - RNA, 19 nt, Homo sapiens
caucaucccuuuaaacuca

SEQ ID NO: 475213 - RNA, 19 nt, Homo sapiens
agacgaagcuucaguaucu

SEQ ID NO: 475214 - RNA, 19 nt, Homo sapiens
gcugaacgcucuaugaugu

SEQ ID NO: 475215 - RNA, 19 nt, Homo sapiens
gcucuaugaugucuuauga

SEQ ID NO: 475216 - RNA, 19 nt, Homo sapiens
ggacaagacccuuauagau

SEQ ID NO: 475217 - RNA, 19 nt, Homo sapiens
ggagaucucuguucagucu

SEQ ID NO: 475218 - RNA, 19 nt, Homo sapiens
caaaucuucugaacacaaa

SEQ ID NO: 475219 - RNA, 19 nt, Homo sapiens
gaagaaauagugcagaaga

SEQ ID NO: 475220 - RNA, 19 nt, Homo sapiens
gagaaugcauuugaucuug

SEQ ID NO: 475221 - RNA, 19 nt, Homo sapiens
uagaagaacuaacugagaa

SEQ ID NO: 475222 - RNA, 19 nt, Homo sapiens
gaaacucuaucuucuacug

SEQ ID NO: 475223 - RNA, 19 nt, Homo sapiens
gcagaacguuccaugaugu

SEQ ID NO: 475224 - RNA, 19 nt, Homo sapiens
gaugaagucugugcugaaa

SEQ ID NO: 475225 - RNA, 19 nt, Homo sapiens
gaagucaucugagccaguu

SEQ ID NO: 475226 - RNA, 19 nt, Homo sapiens
gauauaagccagacuugaa

SEQ ID NO: 475227 - RNA, 19 nt, Homo sapiens
aaacagaucgcacagagua

SEQ ID NO: 475228 - RNA, 19 nt, Homo sapiens
gaagaagaucuguaucaaa

SEQ ID NO: 475229 - RNA, 19 nt, Homo sapiens
gcugagcgcucuaugaugu

SEQ ID NO: 475230 - RNA, 19 nt, Homo sapiens
cacaauguauuuccucuuu

SEQ ID NO: 475231 - RNA, 19 nt, Homo sapiens
cccagaaucccauauauua

SEQ ID NO: 475232 - RNA, 19 nt, Homo sapiens
ggcauugaguugugauaua

SEQ ID NO: 475233 - RNA, 19 nt, Homo sapiens
ugauggagaucuguaauaa

SEQ ID NO: 475234 - RNA, 19 nt, Homo sapiens
ugaagcagauuuagugaga

SEQ ID NO: 475235 - RNA, 19 nt, Homo sapiens
gaaagugaacaugguauaa

SEQ ID NO: 475236 - RNA, 19 nt, Homo sapiens
agagcagacucaaguaaua

SEQ ID NO: 475237 - RNA, 19 nt, Homo sapiens
ccaagauucugcuauguug

SEQ ID NO: 475238 - RNA, 19 nt, Homo sapiens
caucggagauugcagauuc

SEQ ID NO: 475239 - RNA, 19 nt, Homo sapiens
uaaagccacuugggucaua

SEQ ID NO: 475240 - RNA, 19 nt, Homo sapiens
guagauagauugagguuuu

SEQ ID NO: 475241 - RNA, 19 nt, Homo sapiens
gguagaagaaggagcuuua

SEQ ID NO: 475242 - RNA, 19 nt, Homo sapiens
caugaucccuacagacuaa

SEQ ID NO: 475243 - RNA, 19 nt, Homo sapiens
gcacaggagcugccuacua

SEQ ID NO: 475244 - RNA, 19 nt, Homo sapiens
gaacgucuuacaagccuua

SEQ ID NO: 475245 - RNA, 19 nt, Homo sapiens
ugacuuguaugguaucuga

SEQ ID NO: 475246 - RNA, 19 nt, Homo sapiens
ucaugaugcuuacagguua

SEQ ID NO: 475247 - RNA, 19 nt, Homo sapiens
ccaggagucuaccaaauga

SEQ ID NO: 475248 - RNA, 19 nt, Homo sapiens
gaacuaacugagaaaugua

SEQ ID NO: 475249 - RNA, 19 nt, Homo sapiens
uguagagucugcaguagua

SEQ ID NO: 475250 - RNA, 19 nt, Homo sapiens
cuacagaggugccaucauc

SEQ ID NO: 475251 - RNA, 19 nt, Homo sapiens
gcugaucgaucuaugaugu

SEQ ID NO: 475252 - RNA, 19 nt, Homo sapiens
caucaaagaucauguuggu

SEQ ID NO: 475253 - RNA, 19 nt, Homo sapiens
caaagauucuggauuccuu

SEQ ID NO: 475254 - RNA, 19 nt, Homo sapiens
gaaugcauuugaucuugaa

SEQ ID NO: 475255 - RNA, 19 nt, Homo sapiens
gaagaagguuuagcagauc

SEQ ID NO: 475256 - RNA, 19 nt, Homo sapiens
caucagagccuccuguuau

SEQ ID NO: 475257 - RNA, 19 nt, Homo sapiens
ucaggauccuuacagguua

SEQ ID NO: 475258 - RNA, 19 nt, Homo sapiens
gaaaggaauuaaucuaucc

SEQ ID NO: 475259 - RNA, 19 nt, Homo sapiens
uaugaacgcuccaugaugu

SEQ ID NO: 475260 - RNA, 19 nt, Homo sapiens
uaugaacgcuccaugaugu

SEQ ID NO: 475261 - RNA, 19 nt, Homo sapiens
cauggaugcucagauguua

SEQ ID NO: 475262 - RNA, 19 nt, Homo sapiens
ccaagcacaucaacaacaa

SEQ ID NO: 475263 - RNA, 19 nt, Homo sapiens
gcauugaguugugauauag

SEQ ID NO: 475264 - RNA, 19 nt, Homo sapiens
caaugggccuuguaccaaa

SEQ ID NO: 475265 - RNA, 19 nt, Homo sapiens
agaagaagguuuagcagau

SEQ ID NO: 475266 - RNA, 19 nt, Homo sapiens
cgacgaaggucuagaucug

SEQ ID NO: 475267 - RNA, 19 nt, Homo sapiens
ccuuagagcuggcauugaa

SEQ ID NO: 475268 - RNA, 19 nt, Homo sapiens
gaaaguaguggaggagaaa

SEQ ID NO: 475269 - RNA, 19 nt, Homo sapiens
gcucagcccuaaagaaagu

SEQ ID NO: 475270 - RNA, 19 nt, Homo sapiens
gcuccaugaugucagcuua

SEQ ID NO: 475271 - RNA, 19 nt, Homo sapiens
gauuaggucaugaugcuua

SEQ ID NO: 475272 - RNA, 19 nt, Homo sapiens
caacgauggugcuggaguu

SEQ ID NO: 475273 - RNA, 19 nt, Homo sapiens
cgacagcagugccugaguu

SEQ ID NO: 475274 - RNA, 19 nt, Homo sapiens
uuuagggucugauagaaua

SEQ ID NO: 475275 - RNA, 19 nt, Homo sapiens
aaagugguauguuguguga

SEQ ID NO: 475276 - RNA, 19 nt, Homo sapiens
agaacacccuuaagaagaa

SEQ ID NO: 475277 - RNA, 19 nt, Homo sapiens
uagugaagcugacauugaa

SEQ ID NO: 475278 - RNA, 19 nt, Homo sapiens
cugaugaaauucccacuaa

SEQ ID NO: 475279 - RNA, 19 nt, Homo sapiens
cuaaagagauggaacauaa

SEQ ID NO: 475280 - RNA, 19 nt, Homo sapiens
gcaacuagcucaauggauu

SEQ ID NO: 475281 - RNA, 19 nt, Homo sapiens
agaaggagcuuuagcauuu

SEQ ID NO: 475282 - RNA, 19 nt, Homo sapiens
gcuagaaccuccuguagua

SEQ ID NO: 475283 - RNA, 19 nt, Homo sapiens
cagcaagacuguauauaua

SEQ ID NO: 475284 - RNA, 19 nt, Homo sapiens
ggaaauuggugaagagaaa

SEQ ID NO: 475285 - RNA, 19 nt, Homo sapiens
gagccagaaucuucaauua

SEQ ID NO: 475286 - RNA, 19 nt, Homo sapiens
acaagacccuuauagauua

SEQ ID NO: 475287 - RNA, 19 nt, Homo sapiens
ggauaaggcucaauuacuu

SEQ ID NO: 475288 - RNA, 19 nt, Homo sapiens
caacugagguggcuauaga

SEQ ID NO: 475289 - RNA, 19 nt, Homo sapiens
cgacagcgcuggaauccua

SEQ ID NO: 475290 - RNA, 19 nt, Homo sapiens
ugacaaagauucuggauuc

SEQ ID NO: 475291 - RNA, 19 nt, Homo sapiens
gcgcuggaauccuauaaua

SEQ ID NO: 475292 - RNA, 19 nt, Homo sapiens
gaaccaagccacaaaguga

SEQ ID NO: 475293 - RNA, 19 nt, Homo sapiens
ggagcugccuacuacauua

SEQ ID NO: 475294 - RNA, 19 nt, Homo sapiens
ggucuuagauacagaacua

SEQ ID NO: 475295 - RNA, 19 nt, Homo sapiens
gaaguggaauucaaacguu

SEQ ID NO: 475296 - RNA, 19 nt, Homo sapiens
cuauuuagcuucccgauuu

SEQ ID NO: 475297 - RNA, 19 nt, Homo sapiens
gaaguaagcguuccaaauc

SEQ ID NO: 475298 - RNA, 19 nt, Homo sapiens
ucauuaagaucucgaagua

SEQ ID NO: 475299 - RNA, 19 nt, Homo sapiens
gaagauagaggaaguacuu

SEQ ID NO: 475300 - RNA, 19 nt, Homo sapiens
ggaagaagaucuguaucaa

SEQ ID NO: 475301 - RNA, 19 nt, Homo sapiens
uauggacucucaaauguua

SEQ ID NO: 475302 - RNA, 19 nt, Homo sapiens
aaacagauccuacugauga

SEQ ID NO: 475303 - RNA, 19 nt, Homo sapiens
gcacccagguccuauagaa

SEQ ID NO: 475304 - RNA, 19 nt, Homo sapiens
gacaagacccuuauagauu

SEQ ID NO: 475305 - RNA, 19 nt, Homo sapiens
agaaagagcuucagagucu

SEQ ID NO: 475306 - RNA, 19 nt, Homo sapiens
ggauacagaagaaccauua

SEQ ID NO: 475307 - RNA, 19 nt, Homo sapiens
gggcuauaguuguaucuua

SEQ ID NO: 475308 - RNA, 19 nt, Homo sapiens
gcucuaugaugucagcuua

SEQ ID NO: 475309 - RNA, 19 nt, Homo sapiens
caucaucccuuuaaacuca

SEQ ID NO: 475310 - RNA, 19 nt, Homo sapiens
agacgaagcuucaguaucu

SEQ ID NO: 475311 - RNA, 19 nt, Homo sapiens
gcugaacgcucuaugaugu

SEQ ID NO: 475312 - RNA, 19 nt, Homo sapiens
gcucuaugaugucuuauga

SEQ ID NO: 475313 - RNA, 19 nt, Homo sapiens
ggacaagacccuuauagau

SEQ ID NO: 475314 - RNA, 19 nt, Homo sapiens
ggagaucucuguucagucu

SEQ ID NO: 475315 - RNA, 19 nt, Homo sapiens
gcaagacuguauauauaug

SEQ ID NO: 475316 - RNA, 19 nt, Homo sapiens
cacaagaacuggauuggaa

SEQ ID NO: 475317 - RNA, 19 nt, Homo sapiens
caaaucuucugaacacaaa

SEQ ID NO: 475318 - RNA, 19 nt, Homo sapiens
gaagaaauagugcagaaga

SEQ ID NO: 475319 - RNA, 19 nt, Homo sapiens
uagaagaacuaacugagaa

SEQ ID NO: 475320 - RNA, 19 nt, Homo sapiens
gaaacucuaucuucuacug

SEQ ID NO: 475321 - RNA, 19 nt, Homo sapiens
gcagaacguuccaugaugu

SEQ ID NO: 475322 - RNA, 19 nt, Homo sapiens
gaugaagucugugcugaaa

SEQ ID NO: 475323 - RNA, 19 nt, Homo sapiens
gaagucaucugagccaguu

SEQ ID NO: 475324 - RNA, 19 nt, Homo sapiens
gauauaagccagacuugaa

SEQ ID NO: 475325 - RNA, 19 nt, Homo sapiens
aaacagaucgcacagagua

SEQ ID NO: 475326 - RNA, 19 nt, Homo sapiens
gaagaagaucuguaucaaa

SEQ ID NO: 475327 - RNA, 19 nt, Homo sapiens
gcugagcgcucuaugaugu

SEQ ID NO: 475328 - RNA, 19 nt, Homo sapiens
cccagaaucccauauauua

SEQ ID NO: 475329 - RNA, 19 nt, Homo sapiens
gacaguaacucgaugcaau

SEQ ID NO: 475330 - RNA, 19 nt, Homo sapiens
ugaagcagauuuagugaga

SEQ ID NO: 475331 - RNA, 19 nt, Homo sapiens
gaaagugaacaugguauaa

SEQ ID NO: 475332 - RNA, 19 nt, Homo sapiens
agagcagacucaaguaaua

SEQ ID NO: 475333 - RNA, 19 nt, Homo sapiens
ccaagauucugcuauguug

SEQ ID NO: 475334 - RNA, 19 nt, Homo sapiens
caucggagauugcagauuc

SEQ ID NO: 475335 - RNA, 19 nt, Homo sapiens
gguagaagaaggagcuuua

SEQ ID NO: 475336 - RNA, 19 nt, Homo sapiens
caugaucccuacagacuaa

SEQ ID NO: 475337 - RNA, 19 nt, Homo sapiens
gcacaggagcugccuacua

SEQ ID NO: 475338 - RNA, 19 nt, Homo sapiens
gaacgucuuacaagccuua

SEQ ID NO: 475339 - RNA, 19 nt, Homo sapiens
ugacuuguaugguaucuga

SEQ ID NO: 475340 - RNA, 19 nt, Homo sapiens
ucaugaugcuuacagguua

SEQ ID NO: 475341 - RNA, 19 nt, Homo sapiens
ccaggagucuaccaaauga

SEQ ID NO: 475342 - RNA, 19 nt, Homo sapiens
gaacuaacugagaaaugua

SEQ ID NO: 475343 - RNA, 19 nt, Homo sapiens
uguagagucugcaguagua

SEQ ID NO: 475344 - RNA, 19 nt, Homo sapiens
cuacagaggugccaucauc

SEQ ID NO: 475345 - RNA, 19 nt, Homo sapiens
gcugaucgaucuaugaugu

SEQ ID NO: 475346 - RNA, 19 nt, Homo sapiens
caucaaagaucauguuggu

SEQ ID NO: 475347 - RNA, 19 nt, Homo sapiens
caaagauucuggauuccuu

SEQ ID NO: 475348 - RNA, 19 nt, Homo sapiens
gaagaagguuuagcagauc

SEQ ID NO: 475349 - RNA, 19 nt, Homo sapiens
caucagagccuccuguuau

SEQ ID NO: 475350 - RNA, 19 nt, Homo sapiens
ucaggauccuuacagguua

SEQ ID NO: 475351 - RNA, 19 nt, Homo sapiens
gaaaggaauuaaucuaucc

SEQ ID NO: 475352 - RNA, 19 nt, Homo sapiens
ggcuauaguuguaucuuaa

SEQ ID NO: 475353 - RNA, 19 nt, Homo sapiens
uaugaacgcuccaugaugu

SEQ ID NO: 475354 - RNA, 19 nt, Homo sapiens
uaugaacgcuccaugaugu

SEQ ID NO: 475355 - RNA, 19 nt, Homo sapiens
cauggaugcucagauguua

SEQ ID NO: 475356 - RNA, 19 nt, Homo sapiens
ccaagcacaucaacaacaa

SEQ ID NO: 475357 - RNA, 19 nt, Homo sapiens
ccuuaaugaugguuucuua

SEQ ID NO: 475358 - RNA, 19 nt, Homo sapiens
agaagaagguuuagcagau

SEQ ID NO: 475359 - RNA, 19 nt, Homo sapiens
cgacgaaggucuagaucug

SEQ ID NO: 475360 - RNA, 19 nt, Homo sapiens
ccuuagagcuggcauugaa

SEQ ID NO: 475361 - RNA, 19 nt, Homo sapiens
gaaaguaguggaggagaaa

SEQ ID NO: 475362 - RNA, 19 nt, Homo sapiens
gcucagcccuaaagaaagu

SEQ ID NO: 475363 - RNA, 19 nt, Homo sapiens
gcuccaugaugucagcuua

SEQ ID NO: 475364 - RNA, 19 nt, Homo sapiens
gauuaggucaugaugcuua

SEQ ID NO: 475365 - RNA, 19 nt, Homo sapiens
caacgauggugcuggaguu

SEQ ID NO: 475366 - RNA, 19 nt, Homo sapiens
cgacagcagugccugaguu

SEQ ID NO: 475367 - RNA, 19 nt, Homo sapiens
agaacacccuuaagaagaa

SEQ ID NO: 475368 - RNA, 19 nt, Homo sapiens
uagugaagcugacauugaa

SEQ ID NO: 475369 - RNA, 19 nt, Homo sapiens
cugaugaaauucccacuaa

SEQ ID NO: 475370 - RNA, 19 nt, Homo sapiens
gauacagaacuacgauaua

SEQ ID NO: 475371 - RNA, 19 nt, Homo sapiens
caaaacaaccccauuaaaa

SEQ ID NO: 475372 - RNA, 19 nt, Homo sapiens
ggauaguguuuauggagaa

SEQ ID NO: 475373 - RNA, 19 nt, Homo sapiens
uaaugcagcugccaugugu

SEQ ID NO: 475374 - RNA, 19 nt, Homo sapiens
agaucaagcuccagggaua

SEQ ID NO: 475375 - RNA, 19 nt, Homo sapiens
gcagcugaccgaucuauga

SEQ ID NO: 475376 - RNA, 19 nt, Homo sapiens
ugaaacaaauacacccauu

SEQ ID NO: 475377 - RNA, 19 nt, Homo sapiens
aaacaaauacacccauuga

SEQ ID NO: 475378 - RNA, 19 nt, Homo sapiens
ugaaagagggcuccagaaa

SEQ ID NO: 475379 - RNA, 19 nt, Homo sapiens
cuaaagagauggaacauaa

SEQ ID NO: 475380 - RNA, 19 nt, Homo sapiens
gcaacuagcucaauggauu

SEQ ID NO: 475381 - RNA, 19 nt, Homo sapiens
caaaggaccucauggcuaa

SEQ ID NO: 475382 - RNA, 19 nt, Homo sapiens
agaaggagcuuuagcauuu

SEQ ID NO: 475383 - RNA, 19 nt, Homo sapiens
gcuagaaccuccuguagua

SEQ ID NO: 475384 - RNA, 19 nt, Homo sapiens
gaacuucucugcugcaaug

SEQ ID NO: 475385 - RNA, 19 nt, Homo sapiens
ggaaauuggugaagagaaa

SEQ ID NO: 475386 - RNA, 19 nt, Homo sapiens
gagccagaaucuucaauua

SEQ ID NO: 475387 - RNA, 19 nt, Homo sapiens
acaagacccuuauagauua

SEQ ID NO: 475388 - RNA, 19 nt, Homo sapiens
ggauaaggcucaauuacuu

SEQ ID NO: 475389 - RNA, 19 nt, Homo sapiens
caacugagguggcuauaga

SEQ ID NO: 475390 - RNA, 19 nt, Homo sapiens
cgacagcgcuggaauccua

SEQ ID NO: 475391 - RNA, 19 nt, Homo sapiens
ugacaaagauucuggauuc

SEQ ID NO: 475392 - RNA, 19 nt, Homo sapiens
ggacaucucuacagcaaug

SEQ ID NO: 475393 - RNA, 19 nt, Homo sapiens
gagagaaggagaaggauua

SEQ ID NO: 475394 - RNA, 19 nt, Homo sapiens
gcgcuggaauccuauaaua

SEQ ID NO: 475395 - RNA, 19 nt, Homo sapiens
gcaaccaccugaauuucua

SEQ ID NO: 475396 - RNA, 19 nt, Homo sapiens
ggagcugccuacuacauua

SEQ ID NO: 475397 - RNA, 19 nt, Homo sapiens
ggucuuagauacagaacua

SEQ ID NO: 475398 - RNA, 19 nt, Homo sapiens
gcagaggccaguacauuua

SEQ ID NO: 475399 - RNA, 19 nt, Homo sapiens
gaaguaagcguuccaaauc

SEQ ID NO: 475400 - RNA, 19 nt, Homo sapiens
ucauuaagaucucgaagua

SEQ ID NO: 475401 - RNA, 19 nt, Homo sapiens
gaagauagaggaaguacuu

SEQ ID NO: 475402 - RNA, 19 nt, Homo sapiens
ggaagaagaucuguaucaa

SEQ ID NO: 475403 - RNA, 19 nt, Homo sapiens
uauggacucucaaauguua

SEQ ID NO: 475404 - RNA, 19 nt, Homo sapiens
aaacagauccuacugauga

SEQ ID NO: 475405 - RNA, 19 nt, Homo sapiens
gcacccagguccuauagaa

SEQ ID NO: 475406 - RNA, 19 nt, Homo sapiens
gggcucagcugaacucuau

SEQ ID NO: 475407 - RNA, 19 nt, Homo sapiens
gacaagacccuuauagauu

SEQ ID NO: 475408 - RNA, 19 nt, Homo sapiens
agaaagagcuucagagucu

SEQ ID NO: 475409 - RNA, 19 nt, Homo sapiens
ggauacagaagaaccauua

SEQ ID NO: 475410 - RNA, 19 nt, Homo sapiens
gcucuaugaugucagcuua

SEQ ID NO: 475411 - RNA, 19 nt, Homo sapiens
caagaacaguuggccaaua

SEQ ID NO: 475412 - RNA, 19 nt, Homo sapiens
caucaucccuuuaaacuca

SEQ ID NO: 475413 - RNA, 19 nt, Homo sapiens
agacgaagcuucaguaucu

SEQ ID NO: 475414 - RNA, 19 nt, Homo sapiens
gcugaacgcucuaugaugu

SEQ ID NO: 475415 - RNA, 19 nt, Homo sapiens
gcucuaugaugucuuauga

SEQ ID NO: 475416 - RNA, 19 nt, Homo sapiens
ggacaagacccuuauagau

SEQ ID NO: 475417 - RNA, 19 nt, Homo sapiens
ggagaucucuguucagucu

SEQ ID NO: 475418 - RNA, 19 nt, Homo sapiens
caaaucuucugaacacaaa

SEQ ID NO: 475419 - RNA, 19 nt, Homo sapiens
gaagaaauagugcagaaga

SEQ ID NO: 475420 - RNA, 19 nt, Homo sapiens
gagaaugcauuugaucuug

SEQ ID NO: 475421 - RNA, 19 nt, Homo sapiens
gaaacucuaucuucuacug

SEQ ID NO: 475422 - RNA, 19 nt, Homo sapiens
gcagaacguuccaugaugu

SEQ ID NO: 475423 - RNA, 19 nt, Homo sapiens
gaugaagucugugcugaaa

SEQ ID NO: 475424 - RNA, 19 nt, Homo sapiens
gaagucaucugagccaguu

SEQ ID NO: 475425 - RNA, 19 nt, Homo sapiens
gauauaagccagacuugaa

SEQ ID NO: 475426 - RNA, 19 nt, Homo sapiens
aaacagaucgcacagagua

SEQ ID NO: 475427 - RNA, 19 nt, Homo sapiens
gaagaagaucuguaucaaa

SEQ ID NO: 475428 - RNA, 19 nt, Homo sapiens
gcugagcgcucuaugaugu

SEQ ID NO: 475429 - RNA, 19 nt, Homo sapiens
cacaauguauuuccucuuu

SEQ ID NO: 475430 - RNA, 19 nt, Homo sapiens
cccagaaucccauauauua

SEQ ID NO: 475431 - RNA, 19 nt, Homo sapiens
ggcauugaguugugauaua

SEQ ID NO: 475432 - RNA, 19 nt, Homo sapiens
ugauggagaucuguaauaa

SEQ ID NO: 475433 - RNA, 19 nt, Homo sapiens
ugaagcagauuuagugaga

SEQ ID NO: 475434 - RNA, 19 nt, Homo sapiens
gaaagugaacaugguauaa

SEQ ID NO: 475435 - RNA, 19 nt, Homo sapiens
agagcagacucaaguaaua

SEQ ID NO: 475436 - RNA, 19 nt, Homo sapiens
ccaagauucugcuauguug

SEQ ID NO: 475437 - RNA, 19 nt, Homo sapiens
caucggagauugcagauuc

SEQ ID NO: 475438 - RNA, 19 nt, Homo sapiens
uaaagccacuugggucaua

SEQ ID NO: 475439 - RNA, 19 nt, Homo sapiens
guagauagauugagguuuu

SEQ ID NO: 475440 - RNA, 19 nt, Homo sapiens
gguagaagaaggagcuuua

SEQ ID NO: 475441 - RNA, 19 nt, Homo sapiens
caugaucccuacagacuaa

SEQ ID NO: 475442 - RNA, 19 nt, Homo sapiens
gcacaggagcugccuacua

SEQ ID NO: 475443 - RNA, 19 nt, Homo sapiens
gaacgucuuacaagccuua

SEQ ID NO: 475444 - RNA, 19 nt, Homo sapiens
ccaggagucuaccaaauga

SEQ ID NO: 475445 - RNA, 19 nt, Homo sapiens
ugacuuguaugguaucuga

SEQ ID NO: 475446 - RNA, 19 nt, Homo sapiens
ucaugaugcuuacagguua

SEQ ID NO: 475447 - RNA, 19 nt, Homo sapiens
uguagagucugcaguagua

SEQ ID NO: 475448 - RNA, 19 nt, Homo sapiens
cuacagaggugccaucauc

SEQ ID NO: 475449 - RNA, 19 nt, Homo sapiens
gcugaucgaucuaugaugu

SEQ ID NO: 475450 - RNA, 19 nt, Homo sapiens
caucaaagaucauguuggu

SEQ ID NO: 475451 - RNA, 19 nt, Homo sapiens
caaagauucuggauuccuu

SEQ ID NO: 475452 - RNA, 19 nt, Homo sapiens
gaaugcauuugaucuugaa

SEQ ID NO: 475453 - RNA, 19 nt, Homo sapiens
gaagaagguuuagcagauc

SEQ ID NO: 475454 - RNA, 19 nt, Homo sapiens
caucagagccuccuguuau

SEQ ID NO: 475455 - RNA, 19 nt, Homo sapiens
ucaggauccuuacagguua

SEQ ID NO: 475456 - RNA, 19 nt, Homo sapiens
gaaaggaauuaaucuaucc

SEQ ID NO: 475457 - RNA, 19 nt, Homo sapiens
uaugaacgcuccaugaugu

SEQ ID NO: 475458 - RNA, 19 nt, Homo sapiens
uaugaacgcuccaugaugu

SEQ ID NO: 475459 - RNA, 19 nt, Homo sapiens
cauggaugcucagauguua

SEQ ID NO: 475460 - RNA, 19 nt, Homo sapiens
ccaagcacaucaacaacaa

SEQ ID NO: 475461 - RNA, 19 nt, Homo sapiens
gcauugaguugugauauag

SEQ ID NO: 475462 - RNA, 19 nt, Homo sapiens
caaugggccuuguaccaaa

SEQ ID NO: 475463 - RNA, 19 nt, Homo sapiens
agaagaagguuuagcagau

SEQ ID NO: 475464 - RNA, 19 nt, Homo sapiens
cgacgaaggucuagaucug

SEQ ID NO: 475465 - RNA, 19 nt, Homo sapiens
ccuuagagcuggcauugaa

SEQ ID NO: 475466 - RNA, 19 nt, Homo sapiens
gaaaguaguggaggagaaa

SEQ ID NO: 475467 - RNA, 19 nt, Homo sapiens
gcucagcccuaaagaaagu

SEQ ID NO: 475468 - RNA, 19 nt, Homo sapiens
gcuccaugaugucagcuua

SEQ ID NO: 475469 - RNA, 19 nt, Homo sapiens
gauuaggucaugaugcuua

SEQ ID NO: 475470 - RNA, 19 nt, Homo sapiens
caacgauggugcuggaguu

SEQ ID NO: 475471 - RNA, 19 nt, Homo sapiens
cgacagcagugccugaguu

SEQ ID NO: 475472 - RNA, 19 nt, Homo sapiens
uuuagggucugauagaaua

SEQ ID NO: 475473 - RNA, 19 nt, Homo sapiens
aaagugguauguuguguga

SEQ ID NO: 475474 - RNA, 19 nt, Homo sapiens
agaacacccuuaagaagaa

SEQ ID NO: 475475 - RNA, 19 nt, Homo sapiens
uagugaagcugacauugaa

SEQ ID NO: 475476 - RNA, 19 nt, Homo sapiens
cugaugaaauucccacuaa

SEQ ID NO: 475477 - RNA, 19 nt, Homo sapiens
gauacagaacuacgauaua

SEQ ID NO: 475478 - RNA, 19 nt, Homo sapiens
gaacccauccuaguugauu

SEQ ID NO: 475479 - RNA, 19 nt, Homo sapiens
cuaaagagauggaacauaa

SEQ ID NO: 475480 - RNA, 19 nt, Homo sapiens
caaaggaccucauggcuaa

SEQ ID NO: 475481 - RNA, 19 nt, Homo sapiens
agaaggagcuuuagcauuu

SEQ ID NO: 475482 - RNA, 19 nt, Homo sapiens
gcuagaaccuccuguagua

SEQ ID NO: 475483 - RNA, 19 nt, Homo sapiens
gaacuucucugcugcaaug

SEQ ID NO: 475484 - RNA, 19 nt, Homo sapiens
ggaaauuggugaagagaaa

SEQ ID NO: 475485 - RNA, 19 nt, Homo sapiens
gagccagaaucuucaauua

SEQ ID NO: 475486 - RNA, 19 nt, Homo sapiens
ggauaaggcucaauuacuu

SEQ ID NO: 475487 - RNA, 19 nt, Homo sapiens
caacugagguggcuauaga

SEQ ID NO: 475488 - RNA, 19 nt, Homo sapiens
cgacagcgcuggaauccua

SEQ ID NO: 475489 - RNA, 19 nt, Homo sapiens
ugacaaagauucuggauuc

SEQ ID NO: 475490 - RNA, 19 nt, Homo sapiens
ggacaucucuacagcaaug

SEQ ID NO: 475491 - RNA, 19 nt, Homo sapiens
gagagaaggagaaggauua

SEQ ID NO: 475492 - RNA, 19 nt, Homo sapiens
gcgcuggaauccuauaaua

SEQ ID NO: 475493 - RNA, 19 nt, Homo sapiens
gcaaccaccugaauuucua

SEQ ID NO: 475494 - RNA, 19 nt, Homo sapiens
ggucuuagauacagaacua

SEQ ID NO: 475495 - RNA, 19 nt, Homo sapiens
gcagaggccaguacauuua

SEQ ID NO: 475496 - RNA, 19 nt, Homo sapiens
gaaguaagcguuccaaauc

SEQ ID NO: 475497 - RNA, 19 nt, Homo sapiens
ucauuaagaucucgaagua

SEQ ID NO: 475498 - RNA, 19 nt, Homo sapiens
gaagauagaggaaguacuu

SEQ ID NO: 475499 - RNA, 19 nt, Homo sapiens
ggaagaagaucuguaucaa

SEQ ID NO: 475500 - RNA, 19 nt, Homo sapiens
aaacagauccuacugauga

SEQ ID NO: 475501 - RNA, 19 nt, Homo sapiens
gggcucagcugaacucuau

SEQ ID NO: 475502 - RNA, 19 nt, Homo sapiens
agaaagagcuucagagucu

SEQ ID NO: 475503 - RNA, 19 nt, Homo sapiens
ggauacagaagaaccauua

SEQ ID NO: 475504 - RNA, 19 nt, Homo sapiens
gcucuaugaugucagcuua

SEQ ID NO: 475505 - RNA, 19 nt, Homo sapiens
caagaacaguuggccaaua

SEQ ID NO: 475506 - RNA, 19 nt, Homo sapiens
caucaucccuuuaaacuca

SEQ ID NO: 475507 - RNA, 19 nt, Homo sapiens
agacgaagcuucaguaucu

SEQ ID NO: 475508 - RNA, 19 nt, Homo sapiens
gcugaacgcucuaugaugu

SEQ ID NO: 475509 - RNA, 19 nt, Homo sapiens
gcucuaugaugucuuauga

SEQ ID NO: 475510 - RNA, 19 nt, Homo sapiens
ggagaucucuguucagucu

SEQ ID NO: 475511 - RNA, 19 nt, Homo sapiens
caaaucuucugaacacaaa

SEQ ID NO: 475512 - RNA, 19 nt, Homo sapiens
gaagaaauagugcagaaga

SEQ ID NO: 475513 - RNA, 19 nt, Homo sapiens
gagaaugcauuugaucuug

SEQ ID NO: 475514 - RNA, 19 nt, Homo sapiens
uagaagaacuaacugagaa

SEQ ID NO: 475515 - RNA, 19 nt, Homo sapiens
gaaacucuaucuucuacug

SEQ ID NO: 475516 - RNA, 19 nt, Homo sapiens
gaugaagucugugcugaaa

SEQ ID NO: 475517 - RNA, 19 nt, Homo sapiens
gaagucaucugagccaguu

SEQ ID NO: 475518 - RNA, 19 nt, Homo sapiens
gauauaagccagacuugaa

SEQ ID NO: 475519 - RNA, 19 nt, Homo sapiens
aaacagaucgcacagagua

SEQ ID NO: 475520 - RNA, 19 nt, Homo sapiens
gaagaagaucuguaucaaa

SEQ ID NO: 475521 - RNA, 19 nt, Homo sapiens
gcugagcgcucuaugaugu

SEQ ID NO: 475522 - RNA, 19 nt, Homo sapiens
cacaauguauuuccucuuu

SEQ ID NO: 475523 - RNA, 19 nt, Homo sapiens
ggcauugaguugugauaua

SEQ ID NO: 475524 - RNA, 19 nt, Homo sapiens
ugauggagaucuguaauaa

SEQ ID NO: 475525 - RNA, 19 nt, Homo sapiens
ugaagcagauuuagugaga

SEQ ID NO: 475526 - RNA, 19 nt, Homo sapiens
gaaagugaacaugguauaa

SEQ ID NO: 475527 - RNA, 19 nt, Homo sapiens
agagcagacucaaguaaua

SEQ ID NO: 475528 - RNA, 19 nt, Homo sapiens
caucggagauugcagauuc

SEQ ID NO: 475529 - RNA, 19 nt, Homo sapiens
uaaagccacuugggucaua

SEQ ID NO: 475530 - RNA, 19 nt, Homo sapiens
guagauagauugagguuuu

SEQ ID NO: 475531 - RNA, 19 nt, Homo sapiens
gguagaagaaggagcuuua

SEQ ID NO: 475532 - RNA, 19 nt, Homo sapiens
gaacgucuuacaagccuua

SEQ ID NO: 475533 - RNA, 19 nt, Homo sapiens
ugacuuguaugguaucuga

SEQ ID NO: 475534 - RNA, 19 nt, Homo sapiens
ccaggagucuaccaaauga

SEQ ID NO: 475535 - RNA, 19 nt, Homo sapiens
gaacuaacugagaaaugua

SEQ ID NO: 475536 - RNA, 19 nt, Homo sapiens
uguagagucugcaguagua

SEQ ID NO: 475537 - RNA, 19 nt, Homo sapiens
cuacagaggugccaucauc

SEQ ID NO: 475538 - RNA, 19 nt, Homo sapiens
gcugaucgaucuaugaugu

SEQ ID NO: 475539 - RNA, 19 nt, Homo sapiens
caucaaagaucauguuggu

SEQ ID NO: 475540 - RNA, 19 nt, Homo sapiens
caaagauucuggauuccuu

SEQ ID NO: 475541 - RNA, 19 nt, Homo sapiens
gaaugcauuugaucuugaa

SEQ ID NO: 475542 - RNA, 19 nt, Homo sapiens
gaagaagguuuagcagauc

SEQ ID NO: 475543 - RNA, 19 nt, Homo sapiens
caucagagccuccuguuau

SEQ ID NO: 475544 - RNA, 19 nt, Homo sapiens
gaaaggaauuaaucuaucc

SEQ ID NO: 475545 - RNA, 19 nt, Homo sapiens
uaugaacgcuccaugaugu

SEQ ID NO: 475546 - RNA, 19 nt, Homo sapiens
uaugaacgcuccaugaugu

SEQ ID NO: 475547 - RNA, 19 nt, Homo sapiens
ccaagcacaucaacaacaa

SEQ ID NO: 475548 - RNA, 19 nt, Homo sapiens
gcauugaguugugauauag

SEQ ID NO: 475549 - RNA, 19 nt, Homo sapiens
caaugggccuuguaccaaa

SEQ ID NO: 475550 - RNA, 19 nt, Homo sapiens
agaagaagguuuagcagau

SEQ ID NO: 475551 - RNA, 19 nt, Homo sapiens
cgacgaaggucuagaucug

SEQ ID NO: 475552 - RNA, 19 nt, Homo sapiens
ccuuagagcuggcauugaa

SEQ ID NO: 475553 - RNA, 19 nt, Homo sapiens
gaaaguaguggaggagaaa

SEQ ID NO: 475554 - RNA, 19 nt, Homo sapiens
gcucagcccuaaagaaagu

SEQ ID NO: 475555 - RNA, 19 nt, Homo sapiens
gcuccaugaugucagcuua

SEQ ID NO: 475556 - RNA, 19 nt, Homo sapiens
caacgauggugcuggaguu

SEQ ID NO: 475557 - RNA, 19 nt, Homo sapiens
cgacagcagugccugaguu

SEQ ID NO: 475558 - RNA, 19 nt, Homo sapiens
uuuagggucugauagaaua

SEQ ID NO: 475559 - RNA, 19 nt, Homo sapiens
aaagugguauguuguguga

SEQ ID NO: 475560 - RNA, 19 nt, Homo sapiens
agaacacccuuaagaagaa

SEQ ID NO: 475561 - RNA, 19 nt, Homo sapiens
uagugaagcugacauugaa

SEQ ID NO: 475562 - RNA, 19 nt, Homo sapiens
cugaugaaauucccacuaa

SEQ ID NO: 475563 - RNA, 19 nt, Homo sapiens
gauacagaacuacgauaua

SEQ ID NO: 475564 - RNA, 19 nt, Homo sapiens
aaacaaauacacccauuga

SEQ ID NO: 475565 - RNA, 19 nt, Homo sapiens
gaacccauccuaguugauu

SEQ ID NO: 475566 - RNA, 19 nt, Homo sapiens
ggauaguguuuauggagaa

SEQ ID NO: 475567 - RNA, 19 nt, Homo sapiens
uaaugcagcugccaugugu

SEQ ID NO: 475568 - RNA, 19 nt, Homo sapiens
agaucaagcuccagggaua

SEQ ID NO: 475569 - RNA, 19 nt, Homo sapiens
gcagcugaccgaucuauga

SEQ ID NO: 475570 - RNA, 19 nt, Homo sapiens
ugaaacaaauacacccauu

SEQ ID NO: 475571 - RNA, 19 nt, Homo sapiens
ugaaagagggcuccagaaa

SEQ ID NO: 475572 - RNA, 19 nt, Homo sapiens
ccacuugggucauaagaag

SEQ ID NO: 475573 - RNA, 19 nt, Homo sapiens
gaaacaaauacacccauug

SEQ ID NO: 475574 - RNA, 19 nt, Homo sapiens
ggaugaagaggaagaagaa

SEQ ID NO: 475575 - RNA, 19 nt, Homo sapiens
aggaggagcuacuauagaa

SEQ ID NO: 475576 - RNA, 19 nt, Homo sapiens
gaagaucuguaucaaaaga

SEQ ID NO: 475577 - RNA, 19 nt, Homo sapiens
guaaguaguaugccagaaa

SEQ ID NO: 475578 - RNA, 19 nt, Homo sapiens
ccagagccaucaaagauca

SEQ ID NO: 475579 - RNA, 19 nt, Homo sapiens
cuaaagagauggaacauaa

SEQ ID NO: 475580 - RNA, 19 nt, Homo sapiens
gcaacuagcucaauggauu

SEQ ID NO: 475581 - RNA, 19 nt, Homo sapiens
caaaggaccucauggcuaa

SEQ ID NO: 475582 - RNA, 19 nt, Homo sapiens
agaaggagcuuuagcauuu

SEQ ID NO: 475583 - RNA, 19 nt, Homo sapiens
gcuagaaccuccuguagua

SEQ ID NO: 475584 - RNA, 19 nt, Homo sapiens
gaacuucucugcugcaaug

SEQ ID NO: 475585 - RNA, 19 nt, Homo sapiens
ggaaauuggugaagagaaa

SEQ ID NO: 475586 - RNA, 19 nt, Homo sapiens
gagccagaaucuucaauua

SEQ ID NO: 475587 - RNA, 19 nt, Homo sapiens
acaagacccuuauagauua

SEQ ID NO: 475588 - RNA, 19 nt, Homo sapiens
ggauaaggcucaauuacuu

SEQ ID NO: 475589 - RNA, 19 nt, Homo sapiens
caacugagguggcuauaga

SEQ ID NO: 475590 - RNA, 19 nt, Homo sapiens
cgacagcgcuggaauccua

SEQ ID NO: 475591 - RNA, 19 nt, Homo sapiens
ugacaaagauucuggauuc

SEQ ID NO: 475592 - RNA, 19 nt, Homo sapiens
ggacaucucuacagcaaug

SEQ ID NO: 475593 - RNA, 19 nt, Homo sapiens
gagagaaggagaaggauua

SEQ ID NO: 475594 - RNA, 19 nt, Homo sapiens
gcgcuggaauccuauaaua

SEQ ID NO: 475595 - RNA, 19 nt, Homo sapiens
gcaaccaccugaauuucua

SEQ ID NO: 475596 - RNA, 19 nt, Homo sapiens
ggagcugccuacuacauua

SEQ ID NO: 475597 - RNA, 19 nt, Homo sapiens
ggucuuagauacagaacua

SEQ ID NO: 475598 - RNA, 19 nt, Homo sapiens
gcagaggccaguacauuua

SEQ ID NO: 475599 - RNA, 19 nt, Homo sapiens
gaaguaagcguuccaaauc

SEQ ID NO: 475600 - RNA, 19 nt, Homo sapiens
ucauuaagaucucgaagua

SEQ ID NO: 475601 - RNA, 19 nt, Homo sapiens
gaagauagaggaaguacuu

SEQ ID NO: 475602 - RNA, 19 nt, Homo sapiens
ggaagaagaucuguaucaa

SEQ ID NO: 475603 - RNA, 19 nt, Homo sapiens
uauggacucucaaauguua

SEQ ID NO: 475604 - RNA, 19 nt, Homo sapiens
aaacagauccuacugauga

SEQ ID NO: 475605 - RNA, 19 nt, Homo sapiens
gcacccagguccuauagaa

SEQ ID NO: 475606 - RNA, 19 nt, Homo sapiens
gggcucagcugaacucuau

SEQ ID NO: 475607 - RNA, 19 nt, Homo sapiens
gacaagacccuuauagauu

SEQ ID NO: 475608 - RNA, 19 nt, Homo sapiens
agaaagagcuucagagucu

SEQ ID NO: 475609 - RNA, 19 nt, Homo sapiens
ggauacagaagaaccauua

SEQ ID NO: 475610 - RNA, 19 nt, Homo sapiens
gcucuaugaugucagcuua

SEQ ID NO: 475611 - RNA, 19 nt, Homo sapiens
caagaacaguuggccaaua

SEQ ID NO: 475612 - RNA, 19 nt, Homo sapiens
caucaucccuuuaaacuca

SEQ ID NO: 475613 - RNA, 19 nt, Homo sapiens
agacgaagcuucaguaucu

SEQ ID NO: 475614 - RNA, 19 nt, Homo sapiens
gcugaacgcucuaugaugu

SEQ ID NO: 475615 - RNA, 19 nt, Homo sapiens
gcucuaugaugucuuauga

SEQ ID NO: 475616 - RNA, 19 nt, Homo sapiens
ggacaagacccuuauagau

SEQ ID NO: 475617 - RNA, 19 nt, Homo sapiens
ggagaucucuguucagucu

SEQ ID NO: 475618 - RNA, 19 nt, Homo sapiens
caaaucuucugaacacaaa

SEQ ID NO: 475619 - RNA, 19 nt, Homo sapiens
gaagaaauagugcagaaga

SEQ ID NO: 475620 - RNA, 19 nt, Homo sapiens
gagaaugcauuugaucuug

SEQ ID NO: 475621 - RNA, 19 nt, Homo sapiens
uagaagaacuaacugagaa

SEQ ID NO: 475622 - RNA, 19 nt, Homo sapiens
gaaacucuaucuucuacug

SEQ ID NO: 475623 - RNA, 19 nt, Homo sapiens
gcagaacguuccaugaugu

SEQ ID NO: 475624 - RNA, 19 nt, Homo sapiens
gaugaagucugugcugaaa

SEQ ID NO: 475625 - RNA, 19 nt, Homo sapiens
gaagucaucugagccaguu

SEQ ID NO: 475626 - RNA, 19 nt, Homo sapiens
gauauaagccagacuugaa

SEQ ID NO: 475627 - RNA, 19 nt, Homo sapiens
aaacagaucgcacagagua

SEQ ID NO: 475628 - RNA, 19 nt, Homo sapiens
gaagaagaucuguaucaaa

SEQ ID NO: 475629 - RNA, 19 nt, Homo sapiens
gcugagcgcucuaugaugu

SEQ ID NO: 475630 - RNA, 19 nt, Homo sapiens
cacaauguauuuccucuuu

SEQ ID NO: 475631 - RNA, 19 nt, Homo sapiens
cccagaaucccauauauua

SEQ ID NO: 475632 - RNA, 19 nt, Homo sapiens
ggcauugaguugugauaua

SEQ ID NO: 475633 - RNA, 19 nt, Homo sapiens
ugauggagaucuguaauaa

SEQ ID NO: 475634 - RNA, 19 nt, Homo sapiens
ugaagcagauuuagugaga

SEQ ID NO: 475635 - RNA, 19 nt, Homo sapiens
gaaagugaacaugguauaa

SEQ ID NO: 475636 - RNA, 19 nt, Homo sapiens
agagcagacucaaguaaua

SEQ ID NO: 475637 - RNA, 19 nt, Homo sapiens
ccaagauucugcuauguug

SEQ ID NO: 475638 - RNA, 19 nt, Homo sapiens
caucggagauugcagauuc

SEQ ID NO: 475639 - RNA, 19 nt, Homo sapiens
uaaagccacuugggucaua

SEQ ID NO: 475640 - RNA, 19 nt, Homo sapiens
guagauagauugagguuuu

SEQ ID NO: 475641 - RNA, 19 nt, Homo sapiens
gguagaagaaggagcuuua

SEQ ID NO: 475642 - RNA, 19 nt, Homo sapiens
caugaucccuacagacuaa

SEQ ID NO: 475643 - RNA, 19 nt, Homo sapiens
gcacaggagcugccuacua

SEQ ID NO: 475644 - RNA, 19 nt, Homo sapiens
gaacgucuuacaagccuua

SEQ ID NO: 475645 - RNA, 19 nt, Homo sapiens
ugacuuguaugguaucuga

SEQ ID NO: 475646 - RNA, 19 nt, Homo sapiens
ucaugaugcuuacagguua

SEQ ID NO: 475647 - RNA, 19 nt, Homo sapiens
ccaggagucuaccaaauga

SEQ ID NO: 475648 - RNA, 19 nt, Homo sapiens
ggccuaggaucaguucuua

SEQ ID NO: 475649 - RNA, 19 nt, Homo sapiens
gaacuaacugagaaaugua

SEQ ID NO: 475650 - RNA, 19 nt, Homo sapiens
uguagagucugcaguagua

SEQ ID NO: 475651 - RNA, 19 nt, Homo sapiens
cuacagaggugccaucauc

SEQ ID NO: 475652 - RNA, 19 nt, Homo sapiens
gcugaucgaucuaugaugu

SEQ ID NO: 475653 - RNA, 19 nt, Homo sapiens
caucaaagaucauguuggu

SEQ ID NO: 475654 - RNA, 19 nt, Homo sapiens
caaagauucuggauuccuu

SEQ ID NO: 475655 - RNA, 19 nt, Homo sapiens
gaaugcauuugaucuugaa

SEQ ID NO: 475656 - RNA, 19 nt, Homo sapiens
gaagaagguuuagcagauc

SEQ ID NO: 475657 - RNA, 19 nt, Homo sapiens
caucagagccuccuguuau

SEQ ID NO: 475658 - RNA, 19 nt, Homo sapiens
ucaggauccuuacagguua

SEQ ID NO: 475659 - RNA, 19 nt, Homo sapiens
gaaaggaauuaaucuaucc

SEQ ID NO: 475660 - RNA, 19 nt, Homo sapiens
uaugaacgcuccaugaugu

SEQ ID NO: 475661 - RNA, 19 nt, Homo sapiens
uaugaacgcuccaugaugu

SEQ ID NO: 475662 - RNA, 19 nt, Homo sapiens
cauggaugcucagauguua

SEQ ID NO: 475663 - RNA, 19 nt, Homo sapiens
ccaagcacaucaacaacaa

SEQ ID NO: 475664 - RNA, 19 nt, Homo sapiens
gcauugaguugugauauag

SEQ ID NO: 475665 - RNA, 19 nt, Homo sapiens
caaugggccuuguaccaaa

SEQ ID NO: 475666 - RNA, 19 nt, Homo sapiens
agaagaagguuuagcagau

SEQ ID NO: 475667 - RNA, 19 nt, Homo sapiens
cgacgaaggucuagaucug

SEQ ID NO: 475668 - RNA, 19 nt, Homo sapiens
ccuuagagcuggcauugaa

SEQ ID NO: 475669 - RNA, 19 nt, Homo sapiens
gaaaguaguggaggagaaa

SEQ ID NO: 475670 - RNA, 19 nt, Homo sapiens
gcucagcccuaaagaaagu

SEQ ID NO: 475671 - RNA, 19 nt, Homo sapiens
gcuccaugaugucagcuua

SEQ ID NO: 475672 - RNA, 19 nt, Homo sapiens
gauuaggucaugaugcuua

SEQ ID NO: 475673 - RNA, 19 nt, Homo sapiens
caacgauggugcuggaguu

SEQ ID NO: 475674 - RNA, 19 nt, Homo sapiens
cgacagcagugccugaguu

SEQ ID NO: 475675 - RNA, 19 nt, Homo sapiens
uuuagggucugauagaaua

SEQ ID NO: 475676 - RNA, 19 nt, Homo sapiens
aaagugguauguuguguga

SEQ ID NO: 475677 - RNA, 19 nt, Homo sapiens
ccuuguagcugucuucuug

SEQ ID NO: 475678 - RNA, 19 nt, Homo sapiens
agaacacccuuaagaagaa

SEQ ID NO: 475679 - RNA, 19 nt, Homo sapiens
cuaaagagauggaacauaa

SEQ ID NO: 475680 - RNA, 19 nt, Homo sapiens
gcaacuagcucaauggauu

SEQ ID NO: 475681 - RNA, 19 nt, Homo sapiens
caaaggaccucauggcuaa

SEQ ID NO: 475682 - RNA, 19 nt, Homo sapiens
agaaggagcuuuagcauuu

SEQ ID NO: 475683 - RNA, 19 nt, Homo sapiens
gcuagaaccuccuguagua

SEQ ID NO: 475684 - RNA, 19 nt, Homo sapiens
gaacuucucugcugcaaug

SEQ ID NO: 475685 - RNA, 19 nt, Homo sapiens
ggaaauuggugaagagaaa

SEQ ID NO: 475686 - RNA, 19 nt, Homo sapiens
gagccagaaucuucaauua

SEQ ID NO: 475687 - RNA, 19 nt, Homo sapiens
acaagacccuuauagauua

SEQ ID NO: 475688 - RNA, 19 nt, Homo sapiens
ggauaaggcucaauuacuu

SEQ ID NO: 475689 - RNA, 19 nt, Homo sapiens
caacugagguggcuauaga

SEQ ID NO: 475690 - RNA, 19 nt, Homo sapiens
cgacagcgcuggaauccua

SEQ ID NO: 475691 - RNA, 19 nt, Homo sapiens
ugacaaagauucuggauuc

SEQ ID NO: 475692 - RNA, 19 nt, Homo sapiens
ggacaucucuacagcaaug

SEQ ID NO: 475693 - RNA, 19 nt, Homo sapiens
gagagaaggagaaggauua

SEQ ID NO: 475694 - RNA, 19 nt, Homo sapiens
gcgcuggaauccuauaaua

SEQ ID NO: 475695 - RNA, 19 nt, Homo sapiens
gcaaccaccugaauuucua

SEQ ID NO: 475696 - RNA, 19 nt, Homo sapiens
ggagcugccuacuacauua

SEQ ID NO: 475697 - RNA, 19 nt, Homo sapiens
ggucuuagauacagaacua

SEQ ID NO: 475698 - RNA, 19 nt, Homo sapiens
gcagaggccaguacauuua

SEQ ID NO: 475699 - RNA, 19 nt, Homo sapiens
gaaguaagcguuccaaauc

SEQ ID NO: 475700 - RNA, 19 nt, Homo sapiens
ucauuaagaucucgaagua

SEQ ID NO: 475701 - RNA, 19 nt, Homo sapiens
gaagauagaggaaguacuu

SEQ ID NO: 475702 - RNA, 19 nt, Homo sapiens
ggaagaagaucuguaucaa

SEQ ID NO: 475703 - RNA, 19 nt, Homo sapiens
uauggacucucaaauguua

SEQ ID NO: 475704 - RNA, 19 nt, Homo sapiens
aaacagauccuacugauga

SEQ ID NO: 475705 - RNA, 19 nt, Homo sapiens
gcacccagguccuauagaa

SEQ ID NO: 475706 - RNA, 19 nt, Homo sapiens
gggcucagcugaacucuau

SEQ ID NO: 475707 - RNA, 19 nt, Homo sapiens
gacaagacccuuauagauu

SEQ ID NO: 475708 - RNA, 19 nt, Homo sapiens
agaaagagcuucagagucu

SEQ ID NO: 475709 - RNA, 19 nt, Homo sapiens
ggauacagaagaaccauua

SEQ ID NO: 475710 - RNA, 19 nt, Homo sapiens
gcucuaugaugucagcuua

SEQ ID NO: 475711 - RNA, 19 nt, Homo sapiens
caagaacaguuggccaaua

SEQ ID NO: 475712 - RNA, 19 nt, Homo sapiens
caucaucccuuuaaacuca

SEQ ID NO: 475713 - RNA, 19 nt, Homo sapiens
agacgaagcuucaguaucu

SEQ ID NO: 475714 - RNA, 19 nt, Homo sapiens
gcugaacgcucuaugaugu

SEQ ID NO: 475715 - RNA, 19 nt, Homo sapiens
gcucuaugaugucuuauga

SEQ ID NO: 475716 - RNA, 19 nt, Homo sapiens
ggacaagacccuuauagau

SEQ ID NO: 475717 - RNA, 19 nt, Homo sapiens
ggagaucucuguucagucu

SEQ ID NO: 475718 - RNA, 19 nt, Homo sapiens
caaaucuucugaacacaaa

SEQ ID NO: 475719 - RNA, 19 nt, Homo sapiens
gaagaaauagugcagaaga

SEQ ID NO: 475720 - RNA, 19 nt, Homo sapiens
gagaaugcauuugaucuug

SEQ ID NO: 475721 - RNA, 19 nt, Homo sapiens
uagaagaacuaacugagaa

SEQ ID NO: 475722 - RNA, 19 nt, Homo sapiens
gaaacucuaucuucuacug

SEQ ID NO: 475723 - RNA, 19 nt, Homo sapiens
gcagaacguuccaugaugu

SEQ ID NO: 475724 - RNA, 19 nt, Homo sapiens
gaugaagucugugcugaaa

SEQ ID NO: 475725 - RNA, 19 nt, Homo sapiens
gaagucaucugagccaguu

SEQ ID NO: 475726 - RNA, 19 nt, Homo sapiens
gauauaagccagacuugaa

SEQ ID NO: 475727 - RNA, 19 nt, Homo sapiens
aaacagaucgcacagagua

SEQ ID NO: 475728 - RNA, 19 nt, Homo sapiens
gaagaagaucuguaucaaa

SEQ ID NO: 475729 - RNA, 19 nt, Homo sapiens
gcugagcgcucuaugaugu

SEQ ID NO: 475730 - RNA, 19 nt, Homo sapiens
cacaauguauuuccucuuu

SEQ ID NO: 475731 - RNA, 19 nt, Homo sapiens
cccagaaucccauauauua

SEQ ID NO: 475732 - RNA, 19 nt, Homo sapiens
ggcauugaguugugauaua

SEQ ID NO: 475733 - RNA, 19 nt, Homo sapiens
ugauggagaucuguaauaa

SEQ ID NO: 475734 - RNA, 19 nt, Homo sapiens
ugaagcagauuuagugaga

SEQ ID NO: 475735 - RNA, 19 nt, Homo sapiens
gaaagugaacaugguauaa

SEQ ID NO: 475736 - RNA, 19 nt, Homo sapiens
agagcagacucaaguaaua

SEQ ID NO: 475737 - RNA, 19 nt, Homo sapiens
ccaagauucugcuauguug

SEQ ID NO: 475738 - RNA, 19 nt, Homo sapiens
caucggagauugcagauuc

SEQ ID NO: 475739 - RNA, 19 nt, Homo sapiens
uaaagccacuugggucaua

SEQ ID NO: 475740 - RNA, 19 nt, Homo sapiens
guagauagauugagguuuu

SEQ ID NO: 475741 - RNA, 19 nt, Homo sapiens
gguagaagaaggagcuuua

SEQ ID NO: 475742 - RNA, 19 nt, Homo sapiens
caugaucccuacagacuaa

SEQ ID NO: 475743 - RNA, 19 nt, Homo sapiens
gcacaggagcugccuacua

SEQ ID NO: 475744 - RNA, 19 nt, Homo sapiens
gaacgucuuacaagccuua

SEQ ID NO: 475745 - RNA, 19 nt, Homo sapiens
ugacuuguaugguaucuga

SEQ ID NO: 475746 - RNA, 19 nt, Homo sapiens
ucaugaugcuuacagguua

SEQ ID NO: 475747 - RNA, 19 nt, Homo sapiens
ccaggagucuaccaaauga

SEQ ID NO: 475748 - RNA, 19 nt, Homo sapiens
gaacuaacugagaaaugua

SEQ ID NO: 475749 - RNA, 19 nt, Homo sapiens
uguagagucugcaguagua

SEQ ID NO: 475750 - RNA, 19 nt, Homo sapiens
cuacagaggugccaucauc

SEQ ID NO: 475751 - RNA, 19 nt, Homo sapiens
gcugaucgaucuaugaugu

SEQ ID NO: 475752 - RNA, 19 nt, Homo sapiens
caucaaagaucauguuggu

SEQ ID NO: 475753 - RNA, 19 nt, Homo sapiens
caaagauucuggauuccuu

SEQ ID NO: 475754 - RNA, 19 nt, Homo sapiens
gaaugcauuugaucuugaa

SEQ ID NO: 475755 - RNA, 19 nt, Homo sapiens
gaagaagguuuagcagauc

SEQ ID NO: 475756 - RNA, 19 nt, Homo sapiens
caucagagccuccuguuau

SEQ ID NO: 475757 - RNA, 19 nt, Homo sapiens
ucaggauccuuacagguua

SEQ ID NO: 475758 - RNA, 19 nt, Homo sapiens
gaaaggaauuaaucuaucc

SEQ ID NO: 475759 - RNA, 19 nt, Homo sapiens
uaugaacgcuccaugaugu

SEQ ID NO: 475760 - RNA, 19 nt, Homo sapiens
uaugaacgcuccaugaugu

SEQ ID NO: 475761 - RNA, 19 nt, Homo sapiens
cauggaugcucagauguua

SEQ ID NO: 475762 - RNA, 19 nt, Homo sapiens
ccaagcacaucaacaacaa

SEQ ID NO: 475763 - RNA, 19 nt, Homo sapiens
gcauugaguugugauauag

SEQ ID NO: 475764 - RNA, 19 nt, Homo sapiens
caaugggccuuguaccaaa

SEQ ID NO: 475765 - RNA, 19 nt, Homo sapiens
agaagaagguuuagcagau

SEQ ID NO: 475766 - RNA, 19 nt, Homo sapiens
cgacgaaggucuagaucug

SEQ ID NO: 475767 - RNA, 19 nt, Homo sapiens
ccuuagagcuggcauugaa

SEQ ID NO: 475768 - RNA, 19 nt, Homo sapiens
gaaaguaguggaggagaaa

SEQ ID NO: 475769 - RNA, 19 nt, Homo sapiens
gcucagcccuaaagaaagu

SEQ ID NO: 475770 - RNA, 19 nt, Homo sapiens
gcuccaugaugucagcuua

SEQ ID NO: 475771 - RNA, 19 nt, Homo sapiens
gauuaggucaugaugcuua

SEQ ID NO: 475772 - RNA, 19 nt, Homo sapiens
caacgauggugcuggaguu

SEQ ID NO: 475773 - RNA, 19 nt, Homo sapiens
cgacagcagugccugaguu

SEQ ID NO: 475774 - RNA, 19 nt, Homo sapiens
uuuagggucugauagaaua

SEQ ID NO: 475775 - RNA, 19 nt, Homo sapiens
aaagugguauguuguguga

SEQ ID NO: 475776 - RNA, 19 nt, Homo sapiens
agaacacccuuaagaagaa

SEQ ID NO: 475777 - RNA, 19 nt, Homo sapiens
uagugaagcugacauugaa

SEQ ID NO: 475778 - RNA, 19 nt, Homo sapiens
cugaugaaauucccacuaa

SEQ ID NO: 475779 - RNA, 19 nt, Homo sapiens
gaacagaaguccuuaagca

SEQ ID NO: 475780 - RNA, 19 nt, Homo sapiens
gagcaaaguucagcaagua

SEQ ID NO: 475781 - RNA, 19 nt, Homo sapiens
gaaaugucaugugagguua

SEQ ID NO: 475782 - RNA, 19 nt, Homo sapiens
caacuaggcucauacucaa

SEQ ID NO: 475783 - RNA, 19 nt, Homo sapiens
ggacaugggugggcucuga

SEQ ID NO: 475784 - RNA, 19 nt, Homo sapiens
ggaaaucgccaggaaagua

SEQ ID NO: 475785 - RNA, 19 nt, Homo sapiens
caacucaacuaggcucaua

SEQ ID NO: 475786 - RNA, 19 nt, Homo sapiens
ugucagcacuuccaguuua

SEQ ID NO: 475787 - RNA, 19 nt, Homo sapiens
gauacaaucugggauaguu

SEQ ID NO: 475788 - RNA, 19 nt, Homo sapiens
ggacuacucagcacuguuu

SEQ ID NO: 475789 - RNA, 19 nt, Homo sapiens
cagaaucccugauguuaau

SEQ ID NO: 475790 - RNA, 19 nt, Homo sapiens
caucaagaaugaggauaua

SEQ ID NO: 475791 - RNA, 19 nt, Homo sapiens
ggaaaugucaugugagguu

SEQ ID NO: 475792 - RNA, 19 nt, Homo sapiens
gaacuauccuaucccugaa

SEQ ID NO: 475793 - RNA, 19 nt, Homo sapiens
cauacucaauugaugguua

SEQ ID NO: 475794 - RNA, 19 nt, Homo sapiens
aaagugggaucaucgguaa

SEQ ID NO: 475795 - RNA, 19 nt, Homo sapiens
ggaaugauuucuaugaacu

SEQ ID NO: 475796 - RNA, 19 nt, Homo sapiens
ccaagucugugaauguaaa

SEQ ID NO: 475797 - RNA, 19 nt, Homo sapiens
ggagagcccucaggaaauc

SEQ ID NO: 475798 - RNA, 19 nt, Homo sapiens
gcucagauguccacuacug

SEQ ID NO: 475799 - RNA, 19 nt, Homo sapiens
caagaaugaggauauagua

SEQ ID NO: 475800 - RNA, 19 nt, Homo sapiens
gaauuggugugccuuaaag

SEQ ID NO: 475801 - RNA, 19 nt, Homo sapiens
ggaggccuuugaaacauuu

SEQ ID NO: 475802 - RNA, 19 nt, Homo sapiens
ucaagggcguguuucgaua

SEQ ID NO: 475803 - RNA, 19 nt, Homo sapiens
ccaggaaacugcuacuugu

SEQ ID NO: 475804 - RNA, 19 nt, Homo sapiens
guuacaagcuuccugacaa

SEQ ID NO: 475805 - RNA, 19 nt, Homo sapiens
gggcugggcucugagauga

SEQ ID NO: 475806 - RNA, 19 nt, Homo sapiens
caaucgggauggucacuuu

SEQ ID NO: 475807 - RNA, 19 nt, Homo sapiens
aaugagggcugaguuauga

SEQ ID NO: 475808 - RNA, 19 nt, Homo sapiens
gggaaugagggcugaguua

SEQ ID NO: 475809 - RNA, 19 nt, Homo sapiens
gaggaugcauucuguugga

SEQ ID NO: 475810 - RNA, 19 nt, Homo sapiens
ggaauuggugugccuuaaa

SEQ ID NO: 475811 - RNA, 19 nt, Homo sapiens
uaaaggcucuugguaucuu

SEQ ID NO: 475812 - RNA, 19 nt, Homo sapiens
cauauuggcuguuuguuuu

SEQ ID NO: 475813 - RNA, 19 nt, Homo sapiens
ccagagaccaggaggguuu

SEQ ID NO: 475814 - RNA, 19 nt, Homo sapiens
gaaugagggcugaguuaug

SEQ ID NO: 475815 - RNA, 19 nt, Homo sapiens
guccaagucugugaaugua

SEQ ID NO: 475816 - RNA, 19 nt, Homo sapiens
caagaugggccgauacaau

SEQ ID NO: 475817 - RNA, 19 nt, Homo sapiens
gcaaguagagcagaguuug

SEQ ID NO: 475818 - RNA, 19 nt, Homo sapiens
gaaaucgccaggaaaguag

SEQ ID NO: 475819 - RNA, 19 nt, Homo sapiens
uaagcacaaugcagccuuu

SEQ ID NO: 475820 - RNA, 19 nt, Homo sapiens
gccuuuaauuccuuacuuu

SEQ ID NO: 475821 - RNA, 19 nt, Homo sapiens
acucagcacuguuugaaga

SEQ ID NO: 475822 - RNA, 19 nt, Homo sapiens
aaaaggaaaugucauguga

SEQ ID NO: 475823 - RNA, 19 nt, Homo sapiens
agagacauauuggcuguuu

SEQ ID NO: 475824 - RNA, 19 nt, Homo sapiens
aaucuuuccucuucucauu

SEQ ID NO: 475825 - RNA, 19 nt, Homo sapiens
gcaaaguucagcaaguaga

SEQ ID NO: 475826 - RNA, 19 nt, Homo sapiens
ggauaucaagggcguguuu

SEQ ID NO: 475827 - RNA, 19 nt, Homo sapiens
gcccuuggguuuccugguu

SEQ ID NO: 475828 - RNA, 19 nt, Homo sapiens
ccagaaucccugauguuaa

SEQ ID NO: 475829 - RNA, 19 nt, Homo sapiens
ggaaugagggcugaguuau

SEQ ID NO: 475830 - RNA, 19 nt, Homo sapiens
aaaucaugcucaaguguga

SEQ ID NO: 475831 - RNA, 19 nt, Homo sapiens
uuccauuucuuucugguua

SEQ ID NO: 475832 - RNA, 19 nt, Homo sapiens
aaugaugaauucugcaaga

SEQ ID NO: 475833 - RNA, 19 nt, Homo sapiens
gagcuauagccuuuaauuc

SEQ ID NO: 475834 - RNA, 19 nt, Homo sapiens
aguaaaggcucuugguauc

SEQ ID NO: 475835 - RNA, 19 nt, Homo sapiens
ccaguaaaggcucuuggua

SEQ ID NO: 475836 - RNA, 19 nt, Homo sapiens
cagcacuguuugaagauug

SEQ ID NO: 475837 - RNA, 19 nt, Homo sapiens
gaacuuguagccagaaugc

SEQ ID NO: 475838 - RNA, 19 nt, Homo sapiens
aaggagagcccucaggaaa

SEQ ID NO: 475839 - RNA, 19 nt, Homo sapiens
caaugucaccuuugaggaa

SEQ ID NO: 475840 - RNA, 19 nt, Homo sapiens
gaggauauaguagccauga

SEQ ID NO: 475841 - RNA, 19 nt, Homo sapiens
ucaacuaggcucauacuca

SEQ ID NO: 475842 - RNA, 19 nt, Homo sapiens
gaggaauuggugugccuua

SEQ ID NO: 475843 - RNA, 19 nt, Homo sapiens
gaccagaaucccugauguu

SEQ ID NO: 475844 - RNA, 19 nt, Homo sapiens
guuggaaugauuucuauga

SEQ ID NO: 475845 - RNA, 19 nt, Homo sapiens
uuacaagcuuccugacaau

SEQ ID NO: 475846 - RNA, 19 nt, Homo sapiens
ggauauaguagccaugaca

SEQ ID NO: 475847 - RNA, 19 nt, Homo sapiens
acaauuccauuucuuucug

SEQ ID NO: 475848 - RNA, 19 nt, Homo sapiens
gcucguggccaaagcaaug

SEQ ID NO: 475849 - RNA, 19 nt, Homo sapiens
gguggagggugaguuugaa

SEQ ID NO: 475850 - RNA, 19 nt, Homo sapiens
gcuauagccuuuaauuccu

SEQ ID NO: 475851 - RNA, 19 nt, Homo sapiens
guaucuuucuguuggaaug

SEQ ID NO: 475852 - RNA, 19 nt, Homo sapiens
gaugguuauuagacaauuc

SEQ ID NO: 475853 - RNA, 19 nt, Homo sapiens
gcugaguuaugaaaagaua

SEQ ID NO: 475854 - RNA, 19 nt, Homo sapiens
ggaguuacccugggacaca

SEQ ID NO: 475855 - RNA, 19 nt, Homo sapiens
cuugagcuauagccuuuaa

SEQ ID NO: 475856 - RNA, 19 nt, Homo sapiens
caguaaaggcucuugguau

SEQ ID NO: 475857 - RNA, 19 nt, Homo sapiens
gaacgcaauguuucuagag

SEQ ID NO: 475858 - RNA, 19 nt, Homo sapiens
ugaccagaaucccugaugu

SEQ ID NO: 475859 - RNA, 19 nt, Homo sapiens
ugagcuauagccuuuaauu

SEQ ID NO: 475860 - RNA, 19 nt, Homo sapiens
ccucuucucauuaccagua

SEQ ID NO: 475861 - RNA, 19 nt, Homo sapiens
uaagcauggucccuuguca

SEQ ID NO: 475862 - RNA, 19 nt, Homo sapiens
ugagacuauucaucaagaa

SEQ ID NO: 475863 - RNA, 19 nt, Homo sapiens
aggcaucacuuuccuggau

SEQ ID NO: 475864 - RNA, 19 nt, Homo sapiens
ugagcaaaguucagcaagu

SEQ ID NO: 475865 - RNA, 19 nt, Homo sapiens
ccucgucacccauagguuu

SEQ ID NO: 475866 - RNA, 19 nt, Homo sapiens
ggagauuggggcugauuua

SEQ ID NO: 475867 - RNA, 19 nt, Homo sapiens
gcccugaucgagccacuuu

SEQ ID NO: 475868 - RNA, 19 nt, Homo sapiens
ucugucaccuuccaucuuc

SEQ ID NO: 475869 - RNA, 19 nt, Homo sapiens
acauauuggcuguuuguuu

SEQ ID NO: 475870 - RNA, 19 nt, Homo sapiens
gagacauauuggcuguuug

SEQ ID NO: 475871 - RNA, 19 nt, Homo sapiens
acaugaagcuucgggaaca

SEQ ID NO: 475872 - RNA, 19 nt, Homo sapiens
guccaaagccaaggagauu

SEQ ID NO: 475873 - RNA, 19 nt, Homo sapiens
caaggagagcccucaggaa

SEQ ID NO: 475874 - RNA, 19 nt, Homo sapiens
aaaucuggcccuuggguuu

SEQ ID NO: 475875 - RNA, 19 nt, Homo sapiens
uggaggccuuugaaacauu

SEQ ID NO: 475876 - RNA, 19 nt, Homo sapiens
gaguuacccugggacacaa

SEQ ID NO: 475877 - RNA, 19 nt, Homo sapiens
aaauauugguggugguauc

SEQ ID NO: 475878 - RNA, 19 nt, Homo sapiens
gaggacuacucagcacugu

SEQ ID NO: 475879 - RNA, 19 nt, Homo sapiens
gagcaaagauuccagcaua

SEQ ID NO: 475880 - RNA, 19 nt, Homo sapiens
ccacgugucugcccaauua

SEQ ID NO: 475881 - RNA, 19 nt, Homo sapiens
gcacugggcuggagagaaa

SEQ ID NO: 475882 - RNA, 19 nt, Homo sapiens
gacaggagcuacaaaguaa

SEQ ID NO: 475883 - RNA, 19 nt, Homo sapiens
gaagaugggucauaauuac

SEQ ID NO: 475884 - RNA, 19 nt, Homo sapiens
gaagaacacuggaagcaau

SEQ ID NO: 475885 - RNA, 19 nt, Homo sapiens
gagugaagauuugucauua

SEQ ID NO: 475886 - RNA, 19 nt, Homo sapiens
ggaauacuacugacaauuu

SEQ ID NO: 475887 - RNA, 19 nt, Homo sapiens
gaacaauaccugugucaaa

SEQ ID NO: 475888 - RNA, 19 nt, Homo sapiens
caaauaccaucuacauuga

SEQ ID NO: 475889 - RNA, 19 nt, Homo sapiens
caagacauccuauuaauga

SEQ ID NO: 475890 - RNA, 19 nt, Homo sapiens
ggaaagaacuuggcuagca

SEQ ID NO: 475891 - RNA, 19 nt, Homo sapiens
gaaagaacuuggcuagcaa

SEQ ID NO: 475892 - RNA, 19 nt, Homo sapiens
guacgugucuuacgacuau

SEQ ID NO: 475893 - RNA, 19 nt, Homo sapiens
gcuaucagcucaagaacaa

SEQ ID NO: 475894 - RNA, 19 nt, Homo sapiens
caagaugagugaagauuug

SEQ ID NO: 475895 - RNA, 19 nt, Homo sapiens
ccgaagagcuugacuacuu

SEQ ID NO: 475896 - RNA, 19 nt, Homo sapiens
ggagagagcauauggaaga

SEQ ID NO: 475897 - RNA, 19 nt, Homo sapiens
uggagaacgugcucuauua

SEQ ID NO: 475898 - RNA, 19 nt, Homo sapiens
gcacagagaaugacuacaa

SEQ ID NO: 475899 - RNA, 19 nt, Homo sapiens
ccaugaauaucacagcuua

SEQ ID NO: 475900 - RNA, 19 nt, Homo sapiens
gagaagaagugcaauggau

SEQ ID NO: 475901 - RNA, 19 nt, Homo sapiens
ggucacagcucagcauauu

SEQ ID NO: 475902 - RNA, 19 nt, Homo sapiens
ggaaugugguuuaugguau

SEQ ID NO: 475903 - RNA, 19 nt, Homo sapiens
gaggagaacuuugaacuuc

SEQ ID NO: 475904 - RNA, 19 nt, Homo sapiens
gagauacacauguuugaua

SEQ ID NO: 475905 - RNA, 19 nt, Homo sapiens
ccaaauaccaucuacauug

SEQ ID NO: 475906 - RNA, 19 nt, Homo sapiens
gaaugugguuuaugguauu

SEQ ID NO: 475907 - RNA, 19 nt, Homo sapiens
ggacuggucugaugagaag

SEQ ID NO: 475908 - RNA, 19 nt, Homo sapiens
caagguaugugaugaguuc

SEQ ID NO: 475909 - RNA, 19 nt, Homo sapiens
ggaguucccugcacagaga

SEQ ID NO: 475910 - RNA, 19 nt, Homo sapiens
agucaaagaucucauaaga

SEQ ID NO: 475911 - RNA, 19 nt, Homo sapiens
ggauagcccucuggcauuu

SEQ ID NO: 475912 - RNA, 19 nt, Homo sapiens
gaaacuggagcgauucuaa

SEQ ID NO: 475913 - RNA, 19 nt, Homo sapiens
gcuaugagauacacauguu

SEQ ID NO: 475914 - RNA, 19 nt, Homo sapiens
guaaggaugagcaguauuu

SEQ ID NO: 475915 - RNA, 19 nt, Homo sapiens
gaauacuacugacaauuuc

SEQ ID NO: 475916 - RNA, 19 nt, Homo sapiens
ggaagcauauugucacaca

SEQ ID NO: 475917 - RNA, 19 nt, Homo sapiens
guaacaaccgcaccaauuu

SEQ ID NO: 475918 - RNA, 19 nt, Homo sapiens
caagagaggagaacuuuga

SEQ ID NO: 475919 - RNA, 19 nt, Homo sapiens
gaaaaggccugcagugaug

SEQ ID NO: 475920 - RNA, 19 nt, Homo sapiens
uaacaaccgcaccaauuua

SEQ ID NO: 475921 - RNA, 19 nt, Homo sapiens
caccagauauccacauuga

SEQ ID NO: 475922 - RNA, 19 nt, Homo sapiens
gcaauaagacaaacacugu

SEQ ID NO: 475923 - RNA, 19 nt, Homo sapiens
gagagaaacugcccuacca

SEQ ID NO: 475924 - RNA, 19 nt, Homo sapiens
aaacauucaucuucucuga

SEQ ID NO: 475925 - RNA, 19 nt, Homo sapiens
caaggagucuacauugcua

SEQ ID NO: 475926 - RNA, 19 nt, Homo sapiens
gaccaggacuuguuguaug

SEQ ID NO: 475927 - RNA, 19 nt, Homo sapiens
caaccagacugcaguggaa

SEQ ID NO: 475928 - RNA, 19 nt, Homo sapiens
cuacauugcuacucugauu

SEQ ID NO: 475929 - RNA, 19 nt, Homo sapiens
gaauugaucccuaugacaa

SEQ ID NO: 475930 - RNA, 19 nt, Homo sapiens
ucacaagacauccuauuaa

SEQ ID NO: 475931 - RNA, 19 nt, Homo sapiens
gaauacagcaggagugguu

SEQ ID NO: 475932 - RNA, 19 nt, Homo sapiens
caacgacuguggagacaug

SEQ ID NO: 475933 - RNA, 19 nt, Homo sapiens
gcauagagcggaucacguu

SEQ ID NO: 475934 - RNA, 19 nt, Homo sapiens
ugacuucgguuucaagaug

SEQ ID NO: 475935 - RNA, 19 nt, Homo sapiens
caacaagcgguacaucuuu

SEQ ID NO: 475936 - RNA, 19 nt, Homo sapiens
gaaggauuguggagauuca

SEQ ID NO: 475937 - RNA, 19 nt, Homo sapiens
gaugugaaguggcccaaug

SEQ ID NO: 475938 - RNA, 19 nt, Homo sapiens
gugaagauuugucauuaga

SEQ ID NO: 475939 - RNA, 19 nt, Homo sapiens
cuacaaagguggugcaucu

SEQ ID NO: 475940 - RNA, 19 nt, Homo sapiens
gcaaagauuccagcauaaa

SEQ ID NO: 475941 - RNA, 19 nt, Homo sapiens
cuacuucacuccacaacaa

SEQ ID NO: 475942 - RNA, 19 nt, Homo sapiens
ccagagggauugccagaug

SEQ ID NO: 475943 - RNA, 19 nt, Homo sapiens
gugaugaguugacugugua

SEQ ID NO: 475944 - RNA, 19 nt, Homo sapiens
guaccgagauugugcagau

SEQ ID NO: 475945 - RNA, 19 nt, Homo sapiens
gaaaaucaauugugagcuu

SEQ ID NO: 475946 - RNA, 19 nt, Homo sapiens
gaagaugccccuaugauaa

SEQ ID NO: 475947 - RNA, 19 nt, Homo sapiens
ugaagaugggucauaauua

SEQ ID NO: 475948 - RNA, 19 nt, Homo sapiens
ugacaggagcuacaaagua

SEQ ID NO: 475949 - RNA, 19 nt, Homo sapiens
ggaagcagaaggugugauu

SEQ ID NO: 475950 - RNA, 19 nt, Homo sapiens
caacaccaaugacuuugug

SEQ ID NO: 475951 - RNA, 19 nt, Homo sapiens
gcaggaugcucccaagauc

SEQ ID NO: 475952 - RNA, 19 nt, Homo sapiens
gagagaaaaucaauuguga

SEQ ID NO: 475953 - RNA, 19 nt, Homo sapiens
cacaagacauccuauuaau

SEQ ID NO: 475954 - RNA, 19 nt, Homo sapiens
caugagagcagcccaguuu

SEQ ID NO: 475955 - RNA, 19 nt, Homo sapiens
gaauacacccuuaacaagu

SEQ ID NO: 475956 - RNA, 19 nt, Homo sapiens
aaugugaccuugaggauga

SEQ ID NO: 475957 - RNA, 19 nt, Homo sapiens
caauaccugugucaaagaa

SEQ ID NO: 475958 - RNA, 19 nt, Homo sapiens
ggaauacacccuuaacaag

SEQ ID NO: 475959 - RNA, 19 nt, Homo sapiens
guaucccacuguccuauaa

SEQ ID NO: 475960 - RNA, 19 nt, Homo sapiens
gaucggucaucaccuuuga

SEQ ID NO: 475961 - RNA, 19 nt, Homo sapiens
gagaaggauuguggagauu

SEQ ID NO: 475962 - RNA, 19 nt, Homo sapiens
gagggcugcuaguaacuuu

SEQ ID NO: 475963 - RNA, 19 nt, Homo sapiens
cagcagcgcucugucauuc

SEQ ID NO: 475964 - RNA, 19 nt, Homo sapiens
ugagguagcuaauccagau

SEQ ID NO: 475965 - RNA, 19 nt, Homo sapiens
gaucuccuccuacacagua

SEQ ID NO: 475966 - RNA, 19 nt, Homo sapiens
caagagcagugauguguac

SEQ ID NO: 475967 - RNA, 19 nt, Homo sapiens
gcgacgggauggaugauug

SEQ ID NO: 475968 - RNA, 19 nt, Homo sapiens
gaagaagugcaauggauuc

SEQ ID NO: 475969 - RNA, 19 nt, Homo sapiens
agacaacagugaugaaagu

SEQ ID NO: 475970 - RNA, 19 nt, Homo sapiens
gcagugaacagcagucuuc

SEQ ID NO: 475971 - RNA, 19 nt, Homo sapiens
acacaacaccaaugacuuu

SEQ ID NO: 475972 - RNA, 19 nt, Homo sapiens
ccaccaagauugccaggau

SEQ ID NO: 475973 - RNA, 19 nt, Homo sapiens
ucauggacuuuguguguaa

SEQ ID NO: 475974 - RNA, 19 nt, Homo sapiens
gaauaucacagcuuaccuu

SEQ ID NO: 475975 - RNA, 19 nt, Homo sapiens
uaccacaguuucauuauca

SEQ ID NO: 475976 - RNA, 19 nt, Homo sapiens
ugaguugacuguguacaaa

SEQ ID NO: 475977 - RNA, 19 nt, Homo sapiens
ugagaaggauuguggagau

SEQ ID NO: 475978 - RNA, 19 nt, Homo sapiens
ugagaucggucaucaccuu

SEQ ID NO: 475979 - RNA, 19 nt, Homo sapiens
caaagaagcuguucaauau

SEQ ID NO: 475980 - RNA, 19 nt, Homo sapiens
caacaaaucccuagaaaua

SEQ ID NO: 475981 - RNA, 19 nt, Homo sapiens
ggacauuucuuacaacaua

SEQ ID NO: 475982 - RNA, 19 nt, Homo sapiens
ugaaagcccucccuuauua

SEQ ID NO: 475983 - RNA, 19 nt, Homo sapiens
agaagaagcucaugaauug

SEQ ID NO: 475984 - RNA, 19 nt, Homo sapiens
gaaaguagcagaaauaaca

SEQ ID NO: 475985 - RNA, 19 nt, Homo sapiens
caagucagcugaagagaaa

SEQ ID NO: 475986 - RNA, 19 nt, Homo sapiens
gagaaggaauuuacagauu

SEQ ID NO: 475987 - RNA, 19 nt, Homo sapiens
gaaauagcauggagaagga

SEQ ID NO: 475988 - RNA, 19 nt, Homo sapiens
gaacuacugagucuuauaa

SEQ ID NO: 475989 - RNA, 19 nt, Homo sapiens
gagcaccacuucuaugauu

SEQ ID NO: 475990 - RNA, 19 nt, Homo sapiens
ggaaacaacuagcaaucaa

SEQ ID NO: 475991 - RNA, 19 nt, Homo sapiens
caaagcacuucucaacaua

SEQ ID NO: 475992 - RNA, 19 nt, Homo sapiens
gcagaaauucgacaauaua

SEQ ID NO: 475993 - RNA, 19 nt, Homo sapiens
gaaaggaugcuugauguaa

SEQ ID NO: 475994 - RNA, 19 nt, Homo sapiens
gacaagguauugauggaua

SEQ ID NO: 475995 - RNA, 19 nt, Homo sapiens
gaagaaacccuuuaucucu

SEQ ID NO: 475996 - RNA, 19 nt, Homo sapiens
ucaaagaagcuguucaaua

SEQ ID NO: 475997 - RNA, 19 nt, Homo sapiens
cagaggaacuggcauuuga

SEQ ID NO: 475998 - RNA, 19 nt, Homo sapiens
gaaauauacggcauuauga

SEQ ID NO: 475999 - RNA, 19 nt, Homo sapiens
caggagagauccagcagua

SEQ ID NO: 476000 - RNA, 19 nt, Homo sapiens
gagaacaaacuuacuauga

SEQ ID NO: 476001 - RNA, 19 nt, Homo sapiens
gaggaaaguagcagaaaua

SEQ ID NO: 476002 - RNA, 19 nt, Homo sapiens
gaagauacaguagaaauga

SEQ ID NO: 476003 - RNA, 19 nt, Homo sapiens
gcaaugauaccgucuuuau

SEQ ID NO: 476004 - RNA, 19 nt, Homo sapiens
uaacaaugcuacaggaaga

SEQ ID NO: 476005 - RNA, 19 nt, Homo sapiens
ccagguuucuguuuacaua

SEQ ID NO: 476006 - RNA, 19 nt, Homo sapiens
ggacaguguuguaaugaau

SEQ ID NO: 476007 - RNA, 19 nt, Homo sapiens
aaacucaggucuauuaauc

SEQ ID NO: 476008 - RNA, 19 nt, Homo sapiens
gcaaaacucaggucuauua

SEQ ID NO: 476009 - RNA, 19 nt, Homo sapiens
uaacagcuuugcuuaaugu

SEQ ID NO: 476010 - RNA, 19 nt, Homo sapiens
aacagaagcugaucgcaua

SEQ ID NO: 476011 - RNA, 19 nt, Homo sapiens
gugcugauguuuauagauu

SEQ ID NO: 476012 - RNA, 19 nt, Homo sapiens
uaaagcugguugggaauua

SEQ ID NO: 476013 - RNA, 19 nt, Homo sapiens
uugcaaaccucaagaacua

SEQ ID NO: 476014 - RNA, 19 nt, Homo sapiens
ggaguacacuggaaaggau

SEQ ID NO: 476015 - RNA, 19 nt, Homo sapiens
ucaagaagaugaacgagau

SEQ ID NO: 476016 - RNA, 19 nt, Homo sapiens
gaagacaaggaauguuuaa

SEQ ID NO: 476017 - RNA, 19 nt, Homo sapiens
gcaaugccuucuucccaaa

SEQ ID NO: 476018 - RNA, 19 nt, Homo sapiens
gaaagugaaacagaaagua

SEQ ID NO: 476019 - RNA, 19 nt, Homo sapiens
ggaagaauuuauuggaaca

SEQ ID NO: 476020 - RNA, 19 nt, Homo sapiens
ggaggaaaguagcagaaau

SEQ ID NO: 476021 - RNA, 19 nt, Homo sapiens
aagcagaccugggcacaua

SEQ ID NO: 476022 - RNA, 19 nt, Homo sapiens
gcauugauaucuuuacagu

SEQ ID NO: 476023 - RNA, 19 nt, Homo sapiens
cccaagaucugcuucugua

SEQ ID NO: 476024 - RNA, 19 nt, Homo sapiens
acaaaucccuagaaauaga

SEQ ID NO: 476025 - RNA, 19 nt, Homo sapiens
acaguugaguggcauauaa

SEQ ID NO: 476026 - RNA, 19 nt, Homo sapiens
ucgcauagcuauagagaau

SEQ ID NO: 476027 - RNA, 19 nt, Homo sapiens
cauaguagcagucuuagaa

SEQ ID NO: 476028 - RNA, 19 nt, Homo sapiens
uuacauaguagcagucuua

SEQ ID NO: 476029 - RNA, 19 nt, Homo sapiens
aaaucagccuuacuguuua

SEQ ID NO: 476030 - RNA, 19 nt, Homo sapiens
caacucacuuuacuugaau

SEQ ID NO: 476031 - RNA, 19 nt, Homo sapiens
gcaacgaauggaagaauuu

SEQ ID NO: 476032 - RNA, 19 nt, Homo sapiens
agacacauauuucucuuug

SEQ ID NO: 476033 - RNA, 19 nt, Homo sapiens
caguagaaaugacagauga

SEQ ID NO: 476034 - RNA, 19 nt, Homo sapiens
ggcagaaauucgacaauau

SEQ ID NO: 476035 - RNA, 19 nt, Homo sapiens
gaccaccacuguuggagaa

SEQ ID NO: 476036 - RNA, 19 nt, Homo sapiens
ucacuuuacuugaaucaga

SEQ ID NO: 476037 - RNA, 19 nt, Homo sapiens
caacugcgaguauuaaaug

SEQ ID NO: 476038 - RNA, 19 nt, Homo sapiens
guucggacauuucuuacaa

SEQ ID NO: 476039 - RNA, 19 nt, Homo sapiens
uggcagaaauucgacaaua

SEQ ID NO: 476040 - RNA, 19 nt, Homo sapiens
acaaagcacuucucaacau

SEQ ID NO: 476041 - RNA, 19 nt, Homo sapiens
ccacagauguuugcagugu

SEQ ID NO: 476042 - RNA, 19 nt, Homo sapiens
cgacaacucacuuuacuug

SEQ ID NO: 476043 - RNA, 19 nt, Homo sapiens
ugauaaagaugacaccaau

SEQ ID NO: 476044 - RNA, 19 nt, Homo sapiens
gggcagcacuuuauuugca

SEQ ID NO: 476045 - RNA, 19 nt, Homo sapiens
ccauauagaagauacagua

SEQ ID NO: 476046 - RNA, 19 nt, Homo sapiens
ggauauguuucaucaagau

SEQ ID NO: 476047 - RNA, 19 nt, Homo sapiens
gcagaaucuucaccaucua

SEQ ID NO: 476048 - RNA, 19 nt, Homo sapiens
ggaaaggaugcuugaugua

SEQ ID NO: 476049 - RNA, 19 nt, Homo sapiens
caacgaauggaagaauuua

SEQ ID NO: 476050 - RNA, 19 nt, Homo sapiens
acaauuggauggcagcauu

SEQ ID NO: 476051 - RNA, 19 nt, Homo sapiens
uaguagcagucuuagaaua

SEQ ID NO: 476052 - RNA, 19 nt, Homo sapiens
gcuucuguaucaucuauaa

SEQ ID NO: 476053 - RNA, 19 nt, Homo sapiens
guacgcagaucccaauuuu

SEQ ID NO: 476054 - RNA, 19 nt, Homo sapiens
aggcgaagguuucaaagaa

SEQ ID NO: 476055 - RNA, 19 nt, Homo sapiens
auacauuucugcagacauu

SEQ ID NO: 476056 - RNA, 19 nt, Homo sapiens
gauuaugucuaagcauuug

SEQ ID NO: 476057 - RNA, 19 nt, Homo sapiens
uagaagaagcucaugaauu

SEQ ID NO: 476058 - RNA, 19 nt, Homo sapiens
guacagccaucagaauuag

SEQ ID NO: 476059 - RNA, 19 nt, Homo sapiens
acaacucacuuuacuugaa

SEQ ID NO: 476060 - RNA, 19 nt, Homo sapiens
gaaauugcucgacaacuca

SEQ ID NO: 476061 - RNA, 19 nt, Homo sapiens
gugcagaacugaaaagauu

SEQ ID NO: 476062 - RNA, 19 nt, Homo sapiens
gguccuagguuauaaaauu

SEQ ID NO: 476063 - RNA, 19 nt, Homo sapiens
aaacgaagacugagugaau

SEQ ID NO: 476064 - RNA, 19 nt, Homo sapiens
aagaagcuguucaauaugu

SEQ ID NO: 476065 - RNA, 19 nt, Homo sapiens
gaagcgaagaaacccuuua

SEQ ID NO: 476066 - RNA, 19 nt, Homo sapiens
cuaagccucucccaagauu

SEQ ID NO: 476067 - RNA, 19 nt, Homo sapiens
gcagcugcccuacgaguuu

SEQ ID NO: 476068 - RNA, 19 nt, Homo sapiens
cagacuagaccacacauuu

SEQ ID NO: 476069 - RNA, 19 nt, Homo sapiens
ugcgaaagguacaaauuaa

SEQ ID NO: 476070 - RNA, 19 nt, Homo sapiens
cagcuuugcuuaauguuca

SEQ ID NO: 476071 - RNA, 19 nt, Homo sapiens
caacuuuaaugguguccuu

SEQ ID NO: 476072 - RNA, 19 nt, Homo sapiens
gaguucaccucccacaguu

SEQ ID NO: 476073 - RNA, 19 nt, Homo sapiens
gcauagcuauagagaaugg

SEQ ID NO: 476074 - RNA, 19 nt, Homo sapiens
aaacuuauagagaggcuua

SEQ ID NO: 476075 - RNA, 19 nt, Homo sapiens
agcaggaacuguuauuaaa

SEQ ID NO: 476076 - RNA, 19 nt, Homo sapiens
caauaacagcuuugcuuaa

SEQ ID NO: 476077 - RNA, 19 nt, Homo sapiens
gaacuggcauuugauccau

SEQ ID NO: 476078 - RNA, 19 nt, Homo sapiens
uaaaguuacugggccauau

SEQ ID NO: 476079 - RNA, 19 nt, Homo sapiens
ggagugaaauacuauauga

SEQ ID NO: 476080 - RNA, 19 nt, Homo sapiens
gaaauuagcugagauucau

SEQ ID NO: 476081 - RNA, 19 nt, Homo sapiens
ggaguuauauucuggguuu

SEQ ID NO: 476082 - RNA, 19 nt, Homo sapiens
guacagacguucccacauu

SEQ ID NO: 476083 - RNA, 19 nt, Homo sapiens
caaguaaucugacagcauu

SEQ ID NO: 476084 - RNA, 19 nt, Homo sapiens
ccaagacgcugcucaagaa

SEQ ID NO: 476085 - RNA, 19 nt, Homo sapiens
gaagucagauuauguacau

SEQ ID NO: 476086 - RNA, 19 nt, Homo sapiens
uuaaaccacucauucguua

SEQ ID NO: 476087 - RNA, 19 nt, Homo sapiens
ugaaggagcacccggauua

SEQ ID NO: 476088 - RNA, 19 nt, Homo sapiens
gcaaggaaauuagcugaga

SEQ ID NO: 476089 - RNA, 19 nt, Homo sapiens
gauguccacugcuuucuaa

SEQ ID NO: 476090 - RNA, 19 nt, Homo sapiens
aaagugagccuaugcuaua

SEQ ID NO: 476091 - RNA, 19 nt, Homo sapiens
ggagaagucagauuaugua

SEQ ID NO: 476092 - RNA, 19 nt, Homo sapiens
gggaggagaagucagauua

SEQ ID NO: 476093 - RNA, 19 nt, Homo sapiens
gaacuucgguguuuucuug

SEQ ID NO: 476094 - RNA, 19 nt, Homo sapiens
gagguuguuugaugcuuua

SEQ ID NO: 476095 - RNA, 19 nt, Homo sapiens
gaaagagaaggaaguuaaa

SEQ ID NO: 476096 - RNA, 19 nt, Homo sapiens
agacugaacuucgguguuu

SEQ ID NO: 476097 - RNA, 19 nt, Homo sapiens
gcuauuugauccuuucuga

SEQ ID NO: 476098 - RNA, 19 nt, Homo sapiens
ugaaagagaaggaaguuaa

SEQ ID NO: 476099 - RNA, 19 nt, Homo sapiens
gcucgucgcauuuguuaua

SEQ ID NO: 476100 - RNA, 19 nt, Homo sapiens
caagguaacacucaucgua

SEQ ID NO: 476101 - RNA, 19 nt, Homo sapiens
cuaaauguguuucaaggaa

SEQ ID NO: 476102 - RNA, 19 nt, Homo sapiens
ggucacggguuucccaauu

SEQ ID NO: 476103 - RNA, 19 nt, Homo sapiens
uaucugagcauuuccauuu

SEQ ID NO: 476104 - RNA, 19 nt, Homo sapiens
gacgagaucuugagguugu

SEQ ID NO: 476105 - RNA, 19 nt, Homo sapiens
gagccuaugcuauaaguuu

SEQ ID NO: 476106 - RNA, 19 nt, Homo sapiens
uaaccgaugugaacgcaaa

SEQ ID NO: 476107 - RNA, 19 nt, Homo sapiens
guacaguauuuaucaccua

SEQ ID NO: 476108 - RNA, 19 nt, Homo sapiens
gaguuucuguguccaauug

SEQ ID NO: 476109 - RNA, 19 nt, Homo sapiens
gaggagaagucagauuaug

SEQ ID NO: 476110 - RNA, 19 nt, Homo sapiens
gagcucgucgcauuuguua

SEQ ID NO: 476111 - RNA, 19 nt, Homo sapiens
acagaaauaucgaccauca

SEQ ID NO: 476112 - RNA, 19 nt, Homo sapiens
ggguugguuuguuaauuua

SEQ ID NO: 476113 - RNA, 19 nt, Homo sapiens
guauaaugcugaucugaca

SEQ ID NO: 476114 - RNA, 19 nt, Homo sapiens
ugacugacguccacucuca

SEQ ID NO: 476115 - RNA, 19 nt, Homo sapiens
ccaaccaccuuauuuccuu

SEQ ID NO: 476116 - RNA, 19 nt, Homo sapiens
aaugggaccuugaggguuu

SEQ ID NO: 476117 - RNA, 19 nt, Homo sapiens
gauccuuucugaagcaguu

SEQ ID NO: 476118 - RNA, 19 nt, Homo sapiens
ggaaauuagcugagauuca

SEQ ID NO: 476119 - RNA, 19 nt, Homo sapiens
uaauugugcuggauucuca

SEQ ID NO: 476120 - RNA, 19 nt, Homo sapiens
ggaaaauacuggagacgaa

SEQ ID NO: 476121 - RNA, 19 nt, Homo sapiens
ccacugcuuucuaacaaga

SEQ ID NO: 476122 - RNA, 19 nt, Homo sapiens
ggccauggaugaaggacaa

SEQ ID NO: 476123 - RNA, 19 nt, Homo sapiens
uggguugguuuguuaauuu

SEQ ID NO: 476124 - RNA, 19 nt, Homo sapiens
gauuagaacaacacagaaa

SEQ ID NO: 476125 - RNA, 19 nt, Homo sapiens
ccagauggaaauacguuua

SEQ ID NO: 476126 - RNA, 19 nt, Homo sapiens
ggaaugggaggacaggauu

SEQ ID NO: 476127 - RNA, 19 nt, Homo sapiens
agaaugauguccacugcuu

SEQ ID NO: 476128 - RNA, 19 nt, Homo sapiens
ucacaacguuaagaugaaa

SEQ ID NO: 476129 - RNA, 19 nt, Homo sapiens
gagaggcgaagcccacuuu

SEQ ID NO: 476130 - RNA, 19 nt, Homo sapiens
augcugaucugacaauuga

SEQ ID NO: 476131 - RNA, 19 nt, Homo sapiens
gaaaacgggcaaaauaauu

SEQ ID NO: 476132 - RNA, 19 nt, Homo sapiens
gcacccggauuacaaguac

SEQ ID NO: 476133 - RNA, 19 nt, Homo sapiens
guagagcugaguguuaaua

SEQ ID NO: 476134 - RNA, 19 nt, Homo sapiens
gaaggaaguuaaaaccuau

SEQ ID NO: 476135 - RNA, 19 nt, Homo sapiens
gcaaugaggaaaucugaca

SEQ ID NO: 476136 - RNA, 19 nt, Homo sapiens
uaagagacagagcccauuu

SEQ ID NO: 476137 - RNA, 19 nt, Homo sapiens
acgcggagcucgucgcauu

SEQ ID NO: 476138 - RNA, 19 nt, Homo sapiens
gcgagaugaucagcaugua

SEQ ID NO: 476139 - RNA, 19 nt, Homo sapiens
cagggcaggucacggguuu

SEQ ID NO: 476140 - RNA, 19 nt, Homo sapiens
ccaccuuauuuccuuguuu

SEQ ID NO: 476141 - RNA, 19 nt, Homo sapiens
gcaagauggcccaggagaa

SEQ ID NO: 476142 - RNA, 19 nt, Homo sapiens
cacaaucgcugaaccaaaa

SEQ ID NO: 476143 - RNA, 19 nt, Homo sapiens
gggaaauuaucuguaugaa

SEQ ID NO: 476144 - RNA, 19 nt, Homo sapiens
caaggaaauuagcugagau

SEQ ID NO: 476145 - RNA, 19 nt, Homo sapiens
ucugacaauugacguguaa

SEQ ID NO: 476146 - RNA, 19 nt, Homo sapiens
aaucacaacguuaagauga

SEQ ID NO: 476147 - RNA, 19 nt, Homo sapiens
ugagguuguuugaugcuuu

SEQ ID NO: 476148 - RNA, 19 nt, Homo sapiens
cagugucgcuccaauucaa

SEQ ID NO: 476149 - RNA, 19 nt, Homo sapiens
guccacugcuuucuaacaa

SEQ ID NO: 476150 - RNA, 19 nt, Homo sapiens
gaaaucugacagggaaauu

SEQ ID NO: 476151 - RNA, 19 nt, Homo sapiens
ggaggagaagucagauuau

SEQ ID NO: 476152 - RNA, 19 nt, Homo sapiens
gaaugauguccacugcuuu

SEQ ID NO: 476153 - RNA, 19 nt, Homo sapiens
ucgagaauagcuuuaagua

SEQ ID NO: 476154 - RNA, 19 nt, Homo sapiens
acacagaaauaucgaccau

SEQ ID NO: 476155 - RNA, 19 nt, Homo sapiens
ucuuguaaaugcauuguga

SEQ ID NO: 476156 - RNA, 19 nt, Homo sapiens
gcccugagccgacugugaa

SEQ ID NO: 476157 - RNA, 19 nt, Homo sapiens
uaacucaccgggaccuuga

SEQ ID NO: 476158 - RNA, 19 nt, Homo sapiens
aaaccacucauucguuaaa

SEQ ID NO: 476159 - RNA, 19 nt, Homo sapiens
agccuaugcuauaaguuua

SEQ ID NO: 476160 - RNA, 19 nt, Homo sapiens
agacgcugcucaagaagga

SEQ ID NO: 476161 - RNA, 19 nt, Homo sapiens
cugacagcauuaaauauug

SEQ ID NO: 476162 - RNA, 19 nt, Homo sapiens
ucucacacacacagaaaua

SEQ ID NO: 476163 - RNA, 19 nt, Homo sapiens
uuguagagcugaguguuaa

SEQ ID NO: 476164 - RNA, 19 nt, Homo sapiens
aaauaauugugcuggauuc

SEQ ID NO: 476165 - RNA, 19 nt, Homo sapiens
cgagaauagcuuuaaguau

SEQ ID NO: 476166 - RNA, 19 nt, Homo sapiens
gguguuuauugguacauug

SEQ ID NO: 476167 - RNA, 19 nt, Homo sapiens
gggaaaacgggcaaaauaa

SEQ ID NO: 476168 - RNA, 19 nt, Homo sapiens
gaaugggaggacaggauuu

SEQ ID NO: 476169 - RNA, 19 nt, Homo sapiens
cgagucaacaaauuuaaga

SEQ ID NO: 476170 - RNA, 19 nt, Homo sapiens
cagcugaaauagccaaugc

SEQ ID NO: 476171 - RNA, 19 nt, Homo sapiens
cuuaaaggacucucucuga

SEQ ID NO: 476172 - RNA, 19 nt, Homo sapiens
ugagcaccacuacgacuua

SEQ ID NO: 476173 - RNA, 19 nt, Homo sapiens
cugacgagaucuugagguu

SEQ ID NO: 476174 - RNA, 19 nt, Homo sapiens
agaaggaaguuaaaaccua

SEQ ID NO: 476175 - RNA, 19 nt, Homo sapiens
ggaaaucugacagggaaau

SEQ ID NO: 476176 - RNA, 19 nt, Homo sapiens
gcuccaaccaccuuauuuc

SEQ ID NO: 476177 - RNA, 19 nt, Homo sapiens
ucgagcagaauuuaucuaa

SEQ ID NO: 476178 - RNA, 19 nt, Homo sapiens
uuauguaucugagcauuuc

SEQ ID NO: 476179 - RNA, 19 nt, Homo sapiens
gaauggaccuuguauagau

SEQ ID NO: 476180 - RNA, 19 nt, Homo sapiens
ccaagacgcucaugaagaa

SEQ ID NO: 476181 - RNA, 19 nt, Homo sapiens
guaguuugcugccucuuua

SEQ ID NO: 476182 - RNA, 19 nt, Homo sapiens
ugacaccguugguaauuua

SEQ ID NO: 476183 - RNA, 19 nt, Homo sapiens
ugaaggagcacccggauua

SEQ ID NO: 476184 - RNA, 19 nt, Homo sapiens
gcugagaauuugccaauau

SEQ ID NO: 476185 - RNA, 19 nt, Homo sapiens
gguaggagcuuugcaggaa

SEQ ID NO: 476186 - RNA, 19 nt, Homo sapiens
guauagaucuggaggaaag

SEQ ID NO: 476187 - RNA, 19 nt, Homo sapiens
ugagagagauccuggacuu

SEQ ID NO: 476188 - RNA, 19 nt, Homo sapiens
gaaagggagagaaguuuga

SEQ ID NO: 476189 - RNA, 19 nt, Homo sapiens
gaaagaagaggagagagaa

SEQ ID NO: 476190 - RNA, 19 nt, Homo sapiens
aagauucggcucuguauua

SEQ ID NO: 476191 - RNA, 19 nt, Homo sapiens
gcacccggauuauaaauac

SEQ ID NO: 476192 - RNA, 19 nt, Homo sapiens
gaaucagucugccgagaau

SEQ ID NO: 476193 - RNA, 19 nt, Homo sapiens
gagaagagaguguuugcaa

SEQ ID NO: 476194 - RNA, 19 nt, Homo sapiens
gggaauggaccuuguauag

SEQ ID NO: 476195 - RNA, 19 nt, Homo sapiens
gcacaguuugagauaaaua

SEQ ID NO: 476196 - RNA, 19 nt, Homo sapiens
auucggcucuguauuauuu

SEQ ID NO: 476197 - RNA, 19 nt, Homo sapiens
ggagaggcuucuugcugaa

SEQ ID NO: 476198 - RNA, 19 nt, Homo sapiens
caccguugguaauuuauaa

SEQ ID NO: 476199 - RNA, 19 nt, Homo sapiens
ggaauggaccuuguauaga

SEQ ID NO: 476200 - RNA, 19 nt, Homo sapiens
gagagauccuggacuucuu

SEQ ID NO: 476201 - RNA, 19 nt, Homo sapiens
ccaugaaauuacuguguuu

SEQ ID NO: 476202 - RNA, 19 nt, Homo sapiens
gagauaaacauggcaauca

SEQ ID NO: 476203 - RNA, 19 nt, Homo sapiens
gaucccaacuuuccauuuu

SEQ ID NO: 476204 - RNA, 19 nt, Homo sapiens
agaagagaguguuugcaaa

SEQ ID NO: 476205 - RNA, 19 nt, Homo sapiens
ccaguuugccucucucuuu

SEQ ID NO: 476206 - RNA, 19 nt, Homo sapiens
gauaaacauggcaaucaaa

SEQ ID NO: 476207 - RNA, 19 nt, Homo sapiens
ucaugaagaaggauaagua

SEQ ID NO: 476208 - RNA, 19 nt, Homo sapiens
uuugaaauauggacacuga

SEQ ID NO: 476209 - RNA, 19 nt, Homo sapiens
ucucuguggucuuguuuaa

SEQ ID NO: 476210 - RNA, 19 nt, Homo sapiens
uaagaaacagcauggagaa

SEQ ID NO: 476211 - RNA, 19 nt, Homo sapiens
gaagaggagagagaaagaa

SEQ ID NO: 476212 - RNA, 19 nt, Homo sapiens
ugaaauauggacacugaaa

SEQ ID NO: 476213 - RNA, 19 nt, Homo sapiens
guacaguauuuaucgagau

SEQ ID NO: 476214 - RNA, 19 nt, Homo sapiens
gaggaaagaaagcuacgaa

SEQ ID NO: 476215 - RNA, 19 nt, Homo sapiens
cgagaauccauguauauau

SEQ ID NO: 476216 - RNA, 19 nt, Homo sapiens
gaagagaguguuugcaaaa

SEQ ID NO: 476217 - RNA, 19 nt, Homo sapiens
agauaaacauggcaaucaa

SEQ ID NO: 476218 - RNA, 19 nt, Homo sapiens
ggaaagaaagcuacgaaaa

SEQ ID NO: 476219 - RNA, 19 nt, Homo sapiens
aaagaaagggagagaaguu

SEQ ID NO: 476220 - RNA, 19 nt, Homo sapiens
gaggcuucuugcugaauuu

SEQ ID NO: 476221 - RNA, 19 nt, Homo sapiens
aaaccaagacgcucaugaa

SEQ ID NO: 476222 - RNA, 19 nt, Homo sapiens
gcaagauggcccaggagaa

SEQ ID NO: 476223 - RNA, 19 nt, Homo sapiens
ccuuauaacagguacauuu

SEQ ID NO: 476224 - RNA, 19 nt, Homo sapiens
ggacugagagaaagaagag

SEQ ID NO: 476225 - RNA, 19 nt, Homo sapiens
agacuaggacugagagaaa

SEQ ID NO: 476226 - RNA, 19 nt, Homo sapiens
ggagcacccggauuauaaa

SEQ ID NO: 476227 - RNA, 19 nt, Homo sapiens
cugagaauuugccaauauu

SEQ ID NO: 476228 - RNA, 19 nt, Homo sapiens
gcaggaaguuugcaaaagu

SEQ ID NO: 476229 - RNA, 19 nt, Homo sapiens
ccaaucccauccacacuca

SEQ ID NO: 476230 - RNA, 19 nt, Homo sapiens
gcaaaugacagcugcaaaa

SEQ ID NO: 476231 - RNA, 19 nt, Homo sapiens
gagcuuugcaggaaguuug

SEQ ID NO: 476232 - RNA, 19 nt, Homo sapiens
gaaagaaagggagagaagu

SEQ ID NO: 476233 - RNA, 19 nt, Homo sapiens
uuuguucgaucccaacuuu

SEQ ID NO: 476234 - RNA, 19 nt, Homo sapiens
gcucgcagaccuacaugaa

SEQ ID NO: 476235 - RNA, 19 nt, Homo sapiens
gcagagaagagaguguuug

SEQ ID NO: 476236 - RNA, 19 nt, Homo sapiens
ccgagaauccauguauaua

SEQ ID NO: 476237 - RNA, 19 nt, Homo sapiens
gcaagcaacuuuuguacag

SEQ ID NO: 476238 - RNA, 19 nt, Homo sapiens
augcacaguuugagauaaa

SEQ ID NO: 476239 - RNA, 19 nt, Homo sapiens
gccgagaauccauguauau

SEQ ID NO: 476240 - RNA, 19 nt, Homo sapiens
agaaagaagaggagagaga

SEQ ID NO: 476241 - RNA, 19 nt, Homo sapiens
aggagcacccggauuauaa

SEQ ID NO: 476242 - RNA, 19 nt, Homo sapiens
gaaggagcacccggauuau

SEQ ID NO: 476243 - RNA, 19 nt, Homo sapiens
gcugaaauuuaggacaguu

SEQ ID NO: 476244 - RNA, 19 nt, Homo sapiens
ugagcgcccugcaguacaa

SEQ ID NO: 476245 - RNA, 19 nt, Homo sapiens
ugcgagcgcugcacaugaa

SEQ ID NO: 476246 - RNA, 19 nt, Homo sapiens
gaaauauggacacugaaaa

SEQ ID NO: 476247 - RNA, 19 nt, Homo sapiens
ugccgagaauccauguaua

SEQ ID NO: 476248 - RNA, 19 nt, Homo sapiens
aaauggccaugcagguuga

SEQ ID NO: 476249 - RNA, 19 nt, Homo sapiens
aaaccgcgaugccgacaag

SEQ ID NO: 476250 - RNA, 19 nt, Homo sapiens
gaggagagagaaagaaagg

SEQ ID NO: 476251 - RNA, 19 nt, Homo sapiens
agaggcuucuugcugaauu

SEQ ID NO: 476252 - RNA, 19 nt, Homo sapiens
cagguacauuuucaacuua

SEQ ID NO: 476253 - RNA, 19 nt, Homo sapiens
ggacaguugcaaacgugaa

SEQ ID NO: 476254 - RNA, 19 nt, Homo sapiens
caaaagaggagaguaagaa

SEQ ID NO: 476255 - RNA, 19 nt, Homo sapiens
ccagcagacuucacauguc

SEQ ID NO: 476256 - RNA, 19 nt, Homo sapiens
ugaaucagucugccgagaa

SEQ ID NO: 476257 - RNA, 19 nt, Homo sapiens
gacaguugcaaacgugaaa

SEQ ID NO: 476258 - RNA, 19 nt, Homo sapiens
gagaaagaaagggagagaa

SEQ ID NO: 476259 - RNA, 19 nt, Homo sapiens
gaaacagcauggagaaaac

SEQ ID NO: 476260 - RNA, 19 nt, Homo sapiens
uaugcacaguuugagauaa

SEQ ID NO: 476261 - RNA, 19 nt, Homo sapiens
ccaccuacagcauguccua

SEQ ID NO: 476262 - RNA, 19 nt, Homo sapiens
aacggcagcuacagcauga

SEQ ID NO: 476263 - RNA, 19 nt, Homo sapiens
agauucggcucuguauuau

SEQ ID NO: 476264 - RNA, 19 nt, Homo sapiens
caucacccacagcaaauga

SEQ ID NO: 476265 - RNA, 19 nt, Homo sapiens
aagaggagaguaagaaaca

SEQ ID NO: 476266 - RNA, 19 nt, Homo sapiens
aagaggagagagaaagaaa

SEQ ID NO: 476267 - RNA, 19 nt, Homo sapiens
caagauggcccaggagaac

SEQ ID NO: 476268 - RNA, 19 nt, Homo sapiens
aauaaguacuggcgaacca

SEQ ID NO: 476269 - RNA, 19 nt, Homo sapiens
ccgcgaugccgacaagaaa

SEQ ID NO: 476270 - RNA, 19 nt, Homo sapiens
gacuaggacugagagaaag

SEQ ID NO: 476271 - RNA, 19 nt, Homo sapiens
gacaguuacgcgcacauga

SEQ ID NO: 476272 - RNA, 19 nt, Homo sapiens
ggacaguuacgcgcacaug

SEQ ID NO: 476273 - RNA, 19 nt, Homo sapiens
uaaaagauucggcucugua

SEQ ID NO: 476274 - RNA, 19 nt, Homo sapiens
accaugaaauuacuguguu

SEQ ID NO: 476275 - RNA, 19 nt, Homo sapiens
guugacaccguugguaauu

SEQ ID NO: 476276 - RNA, 19 nt, Homo sapiens
ccaucucuguggucuuguu

SEQ ID NO: 476277 - RNA, 19 nt, Homo sapiens
auucugcagcugaaauuua

SEQ ID NO: 476278 - RNA, 19 nt, Homo sapiens
agaaagaaagggagagaag

SEQ ID NO: 476279 - RNA, 19 nt, Homo sapiens
gggaaucgcuguguuauuu

SEQ ID NO: 476280 - RNA, 19 nt, Homo sapiens
ccaagacgcugcucaagaa

SEQ ID NO: 476281 - RNA, 19 nt, Homo sapiens
gcgcuaauguguucagauu

SEQ ID NO: 476282 - RNA, 19 nt, Homo sapiens
gcuaauguguucagauuuc

SEQ ID NO: 476283 - RNA, 19 nt, Homo sapiens
gcagcuaaagccaauguua

SEQ ID NO: 476284 - RNA, 19 nt, Homo sapiens
gccgugaucuguuugauau

SEQ ID NO: 476285 - RNA, 19 nt, Homo sapiens
ggguuauucuguuacauuu

SEQ ID NO: 476286 - RNA, 19 nt, Homo sapiens
gcaguuagccaaggaguga

SEQ ID NO: 476287 - RNA, 19 nt, Homo sapiens
cgugaucuguuugauauuu

SEQ ID NO: 476288 - RNA, 19 nt, Homo sapiens
cagcuaaagccaauguuaa

SEQ ID NO: 476289 - RNA, 19 nt, Homo sapiens
gcugggaaucgcuguguua

SEQ ID NO: 476290 - RNA, 19 nt, Homo sapiens
agacgcugcucaagaaaga

SEQ ID NO: 476291 - RNA, 19 nt, Homo sapiens
gaggccagcuggagaacug

SEQ ID NO: 476292 - RNA, 19 nt, Homo sapiens
ccaagaugcacaauucuga

SEQ ID NO: 476293 - RNA, 19 nt, Homo sapiens
cuacuuuguuucaggguuu

SEQ ID NO: 476294 - RNA, 19 nt, Homo sapiens
cagcuucuguccaaucaug

SEQ ID NO: 476295 - RNA, 19 nt, Homo sapiens
gaaugggagaaacauagua

SEQ ID NO: 476296 - RNA, 19 nt, Homo sapiens
ggggagggcugaaaguuuu

SEQ ID NO: 476297 - RNA, 19 nt, Homo sapiens
gcucgguagugaagucuga

SEQ ID NO: 476298 - RNA, 19 nt, Homo sapiens
gcggguuccugcugauuug

SEQ ID NO: 476299 - RNA, 19 nt, Homo sapiens
gaaggaguauccggacuac

SEQ ID NO: 476300 - RNA, 19 nt, Homo sapiens
gggaggggcuacuuuguuu

SEQ ID NO: 476301 - RNA, 19 nt, Homo sapiens
cauguugaguuggugauuu

SEQ ID NO: 476302 - RNA, 19 nt, Homo sapiens
ggugauuucugccgugauc

SEQ ID NO: 476303 - RNA, 19 nt, Homo sapiens
gcuaaagccaauguuaauu

SEQ ID NO: 476304 - RNA, 19 nt, Homo sapiens
gcaguacagcccaaugaug

SEQ ID NO: 476305 - RNA, 19 nt, Homo sapiens
gcgcggagcauuuugauaa

SEQ ID NO: 476306 - RNA, 19 nt, Homo sapiens
gaugcacaauucugagauc

SEQ ID NO: 476307 - RNA, 19 nt, Homo sapiens
ugauauuucuucgcgcuaa

SEQ ID NO: 476308 - RNA, 19 nt, Homo sapiens
guccaaucauguugaguug

SEQ ID NO: 476309 - RNA, 19 nt, Homo sapiens
uuccaggguuauucuguua

SEQ ID NO: 476310 - RNA, 19 nt, Homo sapiens
guuccaggguuauucuguu

SEQ ID NO: 476311 - RNA, 19 nt, Homo sapiens
gaaucgcuguguuauuugc

SEQ ID NO: 476312 - RNA, 19 nt, Homo sapiens
ugcuguagcugucggguuu

SEQ ID NO: 476313 - RNA, 19 nt, Homo sapiens
uuucugccgugaucuguuu

SEQ ID NO: 476314 - RNA, 19 nt, Homo sapiens
gauauuucuucgcgcuaau

SEQ ID NO: 476315 - RNA, 19 nt, Homo sapiens
ggagugaaugggagaaaca

SEQ ID NO: 476316 - RNA, 19 nt, Homo sapiens
ugaaggaguauccggacua

SEQ ID NO: 476317 - RNA, 19 nt, Homo sapiens
ggaaucgcuguguuauuug

SEQ ID NO: 476318 - RNA, 19 nt, Homo sapiens
cccaugggcucgguaguga

SEQ ID NO: 476319 - RNA, 19 nt, Homo sapiens
gcuguguuauuugcaaaga

SEQ ID NO: 476320 - RNA, 19 nt, Homo sapiens
ggacgccuuguuuagcuuu

SEQ ID NO: 476321 - RNA, 19 nt, Homo sapiens
gugaaugggagaaacauag

SEQ ID NO: 476322 - RNA, 19 nt, Homo sapiens
gaaaaugggacuucuagag

SEQ ID NO: 476323 - RNA, 19 nt, Homo sapiens
uaagucaggagcagcgaaa

SEQ ID NO: 476324 - RNA, 19 nt, Homo sapiens
ccaggguuauucuguuaca

SEQ ID NO: 476325 - RNA, 19 nt, Homo sapiens
gcucaagaaagauaaguac

SEQ ID NO: 476326 - RNA, 19 nt, Homo sapiens
gugaucuguuugauauuuc

SEQ ID NO: 476327 - RNA, 19 nt, Homo sapiens
ggugaggccagcuggagaa

SEQ ID NO: 476328 - RNA, 19 nt, Homo sapiens
ggaggcgcaggcaagagua

SEQ ID NO: 476329 - RNA, 19 nt, Homo sapiens
ccgugcacaugaaggagua

SEQ ID NO: 476330 - RNA, 19 nt, Homo sapiens
guagggacacccacacaag

SEQ ID NO: 476331 - RNA, 19 nt, Homo sapiens
agaccaggaccgugugaaa

SEQ ID NO: 476332 - RNA, 19 nt, Homo sapiens
gaccugcgcgacaugauca

SEQ ID NO: 476333 - RNA, 19 nt, Homo sapiens
aggaguauccggacuacaa

SEQ ID NO: 476334 - RNA, 19 nt, Homo sapiens
guguucagauuucguuugg

SEQ ID NO: 476335 - RNA, 19 nt, Homo sapiens
ccagucgugucgcgucugu

SEQ ID NO: 476336 - RNA, 19 nt, Homo sapiens
cugggacuguugccuugua

SEQ ID NO: 476337 - RNA, 19 nt, Homo sapiens
ucaagaaagauaaguacuc

SEQ ID NO: 476338 - RNA, 19 nt, Homo sapiens
gccgagaagcgaccauuca

SEQ ID NO: 476339 - RNA, 19 nt, Homo sapiens
cuuguuaguuugcaguuag

SEQ ID NO: 476340 - RNA, 19 nt, Homo sapiens
gcaaaauggcccuggagaa

SEQ ID NO: 476341 - RNA, 19 nt, Homo sapiens
caagacgcugcucaagaaa

SEQ ID NO: 476342 - RNA, 19 nt, Homo sapiens
gggacgccuuguuuagcuu

SEQ ID NO: 476343 - RNA, 19 nt, Homo sapiens
ucuggagacugaacucaag

SEQ ID NO: 476344 - RNA, 19 nt, Homo sapiens
gcugcuccuuucaccuuug

SEQ ID NO: 476345 - RNA, 19 nt, Homo sapiens
guacagccuucuggagacu

SEQ ID NO: 476346 - RNA, 19 nt, Homo sapiens
cgugugaaacggcccauga

SEQ ID NO: 476347 - RNA, 19 nt, Homo sapiens
ggaguauccggacuacaag

SEQ ID NO: 476348 - RNA, 19 nt, Homo sapiens
uguccaaucauguugaguu

SEQ ID NO: 476349 - RNA, 19 nt, Homo sapiens
ucuuguuaguuugcaguua

SEQ ID NO: 476350 - RNA, 19 nt, Homo sapiens
gaaaauguugucuuguuag

SEQ ID NO: 476351 - RNA, 19 nt, Homo sapiens
guuuauagcuguuguguuu

SEQ ID NO: 476352 - RNA, 19 nt, Homo sapiens
gcauauguguucagguuua

SEQ ID NO: 476353 - RNA, 19 nt, Homo sapiens
gcucuaagcugcagcaaga

SEQ ID NO: 476354 - RNA, 19 nt, Homo sapiens
guuaauaucucacacaguu

SEQ ID NO: 476355 - RNA, 19 nt, Homo sapiens
gcuggaagcugcucaaaga

SEQ ID NO: 476356 - RNA, 19 nt, Homo sapiens
gaacuggaaucaacugcuu

SEQ ID NO: 476357 - RNA, 19 nt, Homo sapiens
gcaagcaccuggcggagaa

SEQ ID NO: 476358 - RNA, 19 nt, Homo sapiens
gccaaacacuguaagcuuu

SEQ ID NO: 476359 - RNA, 19 nt, Homo sapiens
ccuaauuucuccauguuua

SEQ ID NO: 476360 - RNA, 19 nt, Homo sapiens
guaaucagaugccauuuua

SEQ ID NO: 476361 - RNA, 19 nt, Homo sapiens
gcaguuccguuaaggguuu

SEQ ID NO: 476362 - RNA, 19 nt, Homo sapiens
uaaaugagaagacguguuu

SEQ ID NO: 476363 - RNA, 19 nt, Homo sapiens
gaugauagcauauguguuc

SEQ ID NO: 476364 - RNA, 19 nt, Homo sapiens
ggguuaauauagcauguua

SEQ ID NO: 476365 - RNA, 19 nt, Homo sapiens
gcgagaaacuugcauugga

SEQ ID NO: 476366 - RNA, 19 nt, Homo sapiens
ggacagacgaagaguuuaa

SEQ ID NO: 476367 - RNA, 19 nt, Homo sapiens
caagagaaacuguguguga

SEQ ID NO: 476368 - RNA, 19 nt, Homo sapiens
aaacgcaacucaaaucugu

SEQ ID NO: 476369 - RNA, 19 nt, Homo sapiens
caagaucccuuucauucga

SEQ ID NO: 476370 - RNA, 19 nt, Homo sapiens
gacaagaucccuuucauuc

SEQ ID NO: 476371 - RNA, 19 nt, Homo sapiens
gaaacuccucucuacuuua

SEQ ID NO: 476372 - RNA, 19 nt, Homo sapiens
uagcauauguguucagguu

SEQ ID NO: 476373 - RNA, 19 nt, Homo sapiens
caagaaggcgaguuaguuu

SEQ ID NO: 476374 - RNA, 19 nt, Homo sapiens
gcaagaaggcgaguuaguu

SEQ ID NO: 476375 - RNA, 19 nt, Homo sapiens
ccaacgagcuuccggacuu

SEQ ID NO: 476376 - RNA, 19 nt, Homo sapiens
gacccgagcuggugcaaga

SEQ ID NO: 476377 - RNA, 19 nt, Homo sapiens
ggagagggacuaagugcua

SEQ ID NO: 476378 - RNA, 19 nt, Homo sapiens
caauaugccguguagaaua

SEQ ID NO: 476379 - RNA, 19 nt, Homo sapiens
gagaggagacuguuugaug

SEQ ID NO: 476380 - RNA, 19 nt, Homo sapiens
cgagaaacuugcauuggaa

SEQ ID NO: 476381 - RNA, 19 nt, Homo sapiens
aaucugugcuggacuuuaa

SEQ ID NO: 476382 - RNA, 19 nt, Homo sapiens
gcaaccagcauucgagaaa

SEQ ID NO: 476383 - RNA, 19 nt, Homo sapiens
caagagagaugaaaacguu

SEQ ID NO: 476384 - RNA, 19 nt, Homo sapiens
gguguuggauuauuucaau

SEQ ID NO: 476385 - RNA, 19 nt, Homo sapiens
agaaacuccucucuacuuu

SEQ ID NO: 476386 - RNA, 19 nt, Homo sapiens
gacgaagaguuuaaagaga

SEQ ID NO: 476387 - RNA, 19 nt, Homo sapiens
gaaauuaucaccagcuuuu

SEQ ID NO: 476388 - RNA, 19 nt, Homo sapiens
gagacuguuugauguggua

SEQ ID NO: 476389 - RNA, 19 nt, Homo sapiens
gaaauaaaaucagcuggaa

SEQ ID NO: 476390 - RNA, 19 nt, Homo sapiens
cuacuugucgcuaaauaua

SEQ ID NO: 476391 - RNA, 19 nt, Homo sapiens
aaacuccucucuacuuuag

SEQ ID NO: 476392 - RNA, 19 nt, Homo sapiens
gaggagaauuagccaaaca

SEQ ID NO: 476393 - RNA, 19 nt, Homo sapiens
ucaaaucugugcuggacuu

SEQ ID NO: 476394 - RNA, 19 nt, Homo sapiens
cgaagaguuuaaagagaaa

SEQ ID NO: 476395 - RNA, 19 nt, Homo sapiens
acgaagaguuuaaagagaa

SEQ ID NO: 476396 - RNA, 19 nt, Homo sapiens
ucaagcacauggcugacua

SEQ ID NO: 476397 - RNA, 19 nt, Homo sapiens
cagcuaaucaugucaaguu

SEQ ID NO: 476398 - RNA, 19 nt, Homo sapiens
gacacuauguacugcguuu

SEQ ID NO: 476399 - RNA, 19 nt, Homo sapiens
aaagugacaguaucccuua

SEQ ID NO: 476400 - RNA, 19 nt, Homo sapiens
ccagcaagaaggcgaguua

SEQ ID NO: 476401 - RNA, 19 nt, Homo sapiens
gaccugugauuguuguuau

SEQ ID NO: 476402 - RNA, 19 nt, Homo sapiens
gcaugaugauagcauaugu

SEQ ID NO: 476403 - RNA, 19 nt, Homo sapiens
gaggagaggagacuguuug

SEQ ID NO: 476404 - RNA, 19 nt, Homo sapiens
guugauauauaccuucugu

SEQ ID NO: 476405 - RNA, 19 nt, Homo sapiens
ccugucagauuguugauau

SEQ ID NO: 476406 - RNA, 19 nt, Homo sapiens
cuuccuaccuugcaacaaa

SEQ ID NO: 476407 - RNA, 19 nt, Homo sapiens
gcgcuauguuugauuccua

SEQ ID NO: 476408 - RNA, 19 nt, Homo sapiens
aagggauucuguagcuuua

SEQ ID NO: 476409 - RNA, 19 nt, Homo sapiens
agaauuagccaaacacugu

SEQ ID NO: 476410 - RNA, 19 nt, Homo sapiens
ugaugguguuggauuauuu

SEQ ID NO: 476411 - RNA, 19 nt, Homo sapiens
ugaaaucagugaggugaga

SEQ ID NO: 476412 - RNA, 19 nt, Homo sapiens
gcaggcgaauucccguuug

SEQ ID NO: 476413 - RNA, 19 nt, Homo sapiens
ucaaucugcaggcuucuua

SEQ ID NO: 476414 - RNA, 19 nt, Homo sapiens
agaggagacuguuugaugu

SEQ ID NO: 476415 - RNA, 19 nt, Homo sapiens
gcaauaugccguguagaau

SEQ ID NO: 476416 - RNA, 19 nt, Homo sapiens
gggaggagaauuagccaaa

SEQ ID NO: 476417 - RNA, 19 nt, Homo sapiens
uaauugcaccaacuccuua

SEQ ID NO: 476418 - RNA, 19 nt, Homo sapiens
cgacaagaucccuuucauu

SEQ ID NO: 476419 - RNA, 19 nt, Homo sapiens
gaauuagccaaacacugua

SEQ ID NO: 476420 - RNA, 19 nt, Homo sapiens
gcgacaagaucccuuucau

SEQ ID NO: 476421 - RNA, 19 nt, Homo sapiens
ggaccuggauuuuaacuuc

SEQ ID NO: 476422 - RNA, 19 nt, Homo sapiens
cgagagagagggagagaga

SEQ ID NO: 476423 - RNA, 19 nt, Homo sapiens
gaaucgugaugguguugga

SEQ ID NO: 476424 - RNA, 19 nt, Homo sapiens
ccaccuugguuuuguuuua

SEQ ID NO: 476425 - RNA, 19 nt, Homo sapiens
caacgagcuuccggacuug

SEQ ID NO: 476426 - RNA, 19 nt, Homo sapiens
cacuggaucuaucuaaaug

SEQ ID NO: 476427 - RNA, 19 nt, Homo sapiens
cugaagggcuagaguuuua

SEQ ID NO: 476428 - RNA, 19 nt, Homo sapiens
ccuuguaaauguaaucaga

SEQ ID NO: 476429 - RNA, 19 nt, Homo sapiens
gauucaaacgcaacucaaa

SEQ ID NO: 476430 - RNA, 19 nt, Homo sapiens
cauguuauccugucuaucu

SEQ ID NO: 476431 - RNA, 19 nt, Homo sapiens
ggugagagagcgagagaga

SEQ ID NO: 476432 - RNA, 19 nt, Homo sapiens
acuaagugcuagagacuau

SEQ ID NO: 476433 - RNA, 19 nt, Homo sapiens
uuaaaccacuggaucuauc

SEQ ID NO: 476434 - RNA, 19 nt, Homo sapiens
gggaaacauacauuuauuc

SEQ ID NO: 476435 - RNA, 19 nt, Homo sapiens
guucuugcacgcucuuuaa

SEQ ID NO: 476436 - RNA, 19 nt, Homo sapiens
gugaugguguuggauuauu

SEQ ID NO: 476437 - RNA, 19 nt, Homo sapiens
aaggacagacgaagaguuu

SEQ ID NO: 476438 - RNA, 19 nt, Homo sapiens
gaccaccacucgcuguaca

SEQ ID NO: 476439 - RNA, 19 nt, Homo sapiens
ucaaagacagcgacaagau

SEQ ID NO: 476440 - RNA, 19 nt, Homo sapiens
uguguguguuuauuccuua

SEQ ID NO: 476441 - RNA, 19 nt, Homo sapiens
gcugucgggucucuaguuc

SEQ ID NO: 476442 - RNA, 19 nt, Homo sapiens
caaagacagcgacaagauc

SEQ ID NO: 476443 - RNA, 19 nt, Homo sapiens
gcucaaagacagcgacaag

SEQ ID NO: 476444 - RNA, 19 nt, Homo sapiens
ccauccauccugugcaaua

SEQ ID NO: 476445 - RNA, 19 nt, Homo sapiens
ucgugaugguguuggauua

SEQ ID NO: 476446 - RNA, 19 nt, Homo sapiens
ggggaaacauacauuuauu

SEQ ID NO: 476447 - RNA, 19 nt, Homo sapiens
ccacuggaucuaucuaaau

SEQ ID NO: 476448 - RNA, 19 nt, Homo sapiens
ccuuauagguguaaaugag

SEQ ID NO: 476449 - RNA, 19 nt, Homo sapiens
ggaggagaggagacuguuu

SEQ ID NO: 476450 - RNA, 19 nt, Homo sapiens
gaagcgcgucuaccuguuc

SEQ ID NO: 476451 - RNA, 19 nt, Homo sapiens
gaaauaaucuugaccuuga

SEQ ID NO: 476452 - RNA, 19 nt, Homo sapiens
ggacaucaauggagaaauu

SEQ ID NO: 476453 - RNA, 19 nt, Homo sapiens
gaaauaagcuauggguaaa

SEQ ID NO: 476454 - RNA, 19 nt, Homo sapiens
guauagggcucagaaauua

SEQ ID NO: 476455 - RNA, 19 nt, Homo sapiens
ggaagcagauggagaggua

SEQ ID NO: 476456 - RNA, 19 nt, Homo sapiens
gaagguggcuguugugaau

SEQ ID NO: 476457 - RNA, 19 nt, Homo sapiens
ggacaucagcugacuaaua

SEQ ID NO: 476458 - RNA, 19 nt, Homo sapiens
ggaaguugauggcaauaaa

SEQ ID NO: 476459 - RNA, 19 nt, Homo sapiens
gaauaacguuggaccauug

SEQ ID NO: 476460 - RNA, 19 nt, Homo sapiens
gacaucagcugacuaauag

SEQ ID NO: 476461 - RNA, 19 nt, Homo sapiens
ccaagaagcucggcaaaug

SEQ ID NO: 476462 - RNA, 19 nt, Homo sapiens
ccaagugacuggucuagaa

SEQ ID NO: 476463 - RNA, 19 nt, Homo sapiens
gcacauuaacuuucucaua

SEQ ID NO: 476464 - RNA, 19 nt, Homo sapiens
gaaguacccugacuauaag

SEQ ID NO: 476465 - RNA, 19 nt, Homo sapiens
ugacaaaccuagagaaaca

SEQ ID NO: 476466 - RNA, 19 nt, Homo sapiens
gcaaacugcucccagaugu

SEQ ID NO: 476467 - RNA, 19 nt, Homo sapiens
agaaguacccugacuauaa

SEQ ID NO: 476468 - RNA, 19 nt, Homo sapiens
uagagaaacagccauauua

SEQ ID NO: 476469 - RNA, 19 nt, Homo sapiens
ggaauaacguuggaccauu

SEQ ID NO: 476470 - RNA, 19 nt, Homo sapiens
cauuaacguuugcuacuua

SEQ ID NO: 476471 - RNA, 19 nt, Homo sapiens
gcaaagagcaacaacugaa

SEQ ID NO: 476472 - RNA, 19 nt, Homo sapiens
uaauagaggugugcaugua

SEQ ID NO: 476473 - RNA, 19 nt, Homo sapiens
guugugaccuuaggacuua

SEQ ID NO: 476474 - RNA, 19 nt, Homo sapiens
guacugaaguguugaccaa

SEQ ID NO: 476475 - RNA, 19 nt, Homo sapiens
uccaagcacugaagucuua

SEQ ID NO: 476476 - RNA, 19 nt, Homo sapiens
guggaggccuuuagcauuu

SEQ ID NO: 476477 - RNA, 19 nt, Homo sapiens
caagaccucugauggcaaa

SEQ ID NO: 476478 - RNA, 19 nt, Homo sapiens
gagagagacauaagaaauu

SEQ ID NO: 476479 - RNA, 19 nt, Homo sapiens
ugaaauaagcuauggguaa

SEQ ID NO: 476480 - RNA, 19 nt, Homo sapiens
gaaagaaaggcaacucaug

SEQ ID NO: 476481 - RNA, 19 nt, Homo sapiens
gacagaaaguggaagaaga

SEQ ID NO: 476482 - RNA, 19 nt, Homo sapiens
ggaucucgcuggaaagcua

SEQ ID NO: 476483 - RNA, 19 nt, Homo sapiens
ucaaaggacuggaaagaca

SEQ ID NO: 476484 - RNA, 19 nt, Homo sapiens
caguuuagcugauguuguu

SEQ ID NO: 476485 - RNA, 19 nt, Homo sapiens
guaaugcaccugacagaaa

SEQ ID NO: 476486 - RNA, 19 nt, Homo sapiens
ccaacaagccucacucuga

SEQ ID NO: 476487 - RNA, 19 nt, Homo sapiens
caagucaauugccauuauu

SEQ ID NO: 476488 - RNA, 19 nt, Homo sapiens
gagcaacaacugaauguga

SEQ ID NO: 476489 - RNA, 19 nt, Homo sapiens
guuggaccauugugaguua

SEQ ID NO: 476490 - RNA, 19 nt, Homo sapiens
aaacaacacuggagagucu

SEQ ID NO: 476491 - RNA, 19 nt, Homo sapiens
gaaacagcgucagcaaaug

SEQ ID NO: 476492 - RNA, 19 nt, Homo sapiens
ucaagucaauugccauuau

SEQ ID NO: 476493 - RNA, 19 nt, Homo sapiens
gaauuucucuuuacuucuc

SEQ ID NO: 476494 - RNA, 19 nt, Homo sapiens
caacaagcaaacaacaaua

SEQ ID NO: 476495 - RNA, 19 nt, Homo sapiens
ucucauacacugacuguua

SEQ ID NO: 476496 - RNA, 19 nt, Homo sapiens
gaacaacaggugcuugaug

SEQ ID NO: 476497 - RNA, 19 nt, Homo sapiens
gaaacaccacccuaaaguu

SEQ ID NO: 476498 - RNA, 19 nt, Homo sapiens
gcaagcagcaccuggagaa

SEQ ID NO: 476499 - RNA, 19 nt, Homo sapiens
uaaacagaaugaagaagga

SEQ ID NO: 476500 - RNA, 19 nt, Homo sapiens
ugauuuaccucaggaguuu

SEQ ID NO: 476501 - RNA, 19 nt, Homo sapiens
guugauggcaauaaaguua

SEQ ID NO: 476502 - RNA, 19 nt, Homo sapiens
uacacugacuguuacuuua

SEQ ID NO: 476503 - RNA, 19 nt, Homo sapiens
cacauuaacuuucucauac

SEQ ID NO: 476504 - RNA, 19 nt, Homo sapiens
ggaaagcuaugacaaaccu

SEQ ID NO: 476505 - RNA, 19 nt, Homo sapiens
cauaaagcguccaaugaau

SEQ ID NO: 476506 - RNA, 19 nt, Homo sapiens
gaguggagauucugaugga

SEQ ID NO: 476507 - RNA, 19 nt, Homo sapiens
ggcgaguccuugucuagua

SEQ ID NO: 476508 - RNA, 19 nt, Homo sapiens
ugaugggacugcuuaugua

SEQ ID NO: 476509 - RNA, 19 nt, Homo sapiens
cuccaucucucuacuuuaa

SEQ ID NO: 476510 - RNA, 19 nt, Homo sapiens
gaccuuaggacuuaaagaa

SEQ ID NO: 476511 - RNA, 19 nt, Homo sapiens
gagaggagccacauaucaa

SEQ ID NO: 476512 - RNA, 19 nt, Homo sapiens
ggagaaguacccugacuau

SEQ ID NO: 476513 - RNA, 19 nt, Homo sapiens
ggugugggcuaaagaugaa

SEQ ID NO: 476514 - RNA, 19 nt, Homo sapiens
gcacaauagguuacuuaaa

SEQ ID NO: 476515 - RNA, 19 nt, Homo sapiens
ccuccaggcuucagcuaua

SEQ ID NO: 476516 - RNA, 19 nt, Homo sapiens
ugacuggucuagaaauaau

SEQ ID NO: 476517 - RNA, 19 nt, Homo sapiens
ccuaacugguucauccuua

SEQ ID NO: 476518 - RNA, 19 nt, Homo sapiens
ggagaggagccacauauca

SEQ ID NO: 476519 - RNA, 19 nt, Homo sapiens
gcacagccacugaaccuau

SEQ ID NO: 476520 - RNA, 19 nt, Homo sapiens
aaaggcaacucauggguau

SEQ ID NO: 476521 - RNA, 19 nt, Homo sapiens
ggacugcuuauguagauuu

SEQ ID NO: 476522 - RNA, 19 nt, Homo sapiens
ggacaguguuaaaucuuag

SEQ ID NO: 476523 - RNA, 19 nt, Homo sapiens
gcaaacaacaauaucaaca

SEQ ID NO: 476524 - RNA, 19 nt, Homo sapiens
ggagccacauaucaaagaa

SEQ ID NO: 476525 - RNA, 19 nt, Homo sapiens
gcagcaacaagaacaaauu

SEQ ID NO: 476526 - RNA, 19 nt, Homo sapiens
acaauacaauggaaguuga

SEQ ID NO: 476527 - RNA, 19 nt, Homo sapiens
ggaaaugaaacugaugauu

SEQ ID NO: 476528 - RNA, 19 nt, Homo sapiens
gauggaagucugugcauga

SEQ ID NO: 476529 - RNA, 19 nt, Homo sapiens
aaagauuguugugaccuua

SEQ ID NO: 476530 - RNA, 19 nt, Homo sapiens
cggcaguacuucaauguug

SEQ ID NO: 476531 - RNA, 19 nt, Homo sapiens
gcaaugaaccccacauaaa

SEQ ID NO: 476532 - RNA, 19 nt, Homo sapiens
caaccuuggugcugcugua

SEQ ID NO: 476533 - RNA, 19 nt, Homo sapiens
aaauggagcuggccaagca

SEQ ID NO: 476534 - RNA, 19 nt, Homo sapiens
caccuucccuugcauguga

SEQ ID NO: 476535 - RNA, 19 nt, Homo sapiens
aaacaccacccuaaaguug

SEQ ID NO: 476536 - RNA, 19 nt, Homo sapiens
gaagugugggccauaugua

SEQ ID NO: 476537 - RNA, 19 nt, Homo sapiens
gcuuauuucuucaacauuc

SEQ ID NO: 476538 - RNA, 19 nt, Homo sapiens
cacuucaaaugacaacuua

SEQ ID NO: 476539 - RNA, 19 nt, Homo sapiens
caacaacaagagauugaaa

SEQ ID NO: 476540 - RNA, 19 nt, Homo sapiens
gaaaugcggcaguacuuca

SEQ ID NO: 476541 - RNA, 19 nt, Homo sapiens
gagaaacagcgucagcaaa

SEQ ID NO: 476542 - RNA, 19 nt, Homo sapiens
uuaaauaguugggacauca

SEQ ID NO: 476543 - RNA, 19 nt, Homo sapiens
gagccugggaugccuguua

SEQ ID NO: 476544 - RNA, 19 nt, Homo sapiens
caagaagcucggcaaauga

SEQ ID NO: 476545 - RNA, 19 nt, Homo sapiens
caaaugacaacuuaaccaa

SEQ ID NO: 476546 - RNA, 19 nt, Homo sapiens
gagcaagugccaaauuugu

SEQ ID NO: 476547 - RNA, 19 nt, Homo sapiens
ccaagcacauuaacuuucu

SEQ ID NO: 476548 - RNA, 19 nt, Homo sapiens
ggucagcugccgccauuaa

SEQ ID NO: 476549 - RNA, 19 nt, Homo sapiens
gaacuuuggcgaaauaaaa

SEQ ID NO: 476550 - RNA, 19 nt, Homo sapiens
ccacacaacucaucuaccu

SEQ ID NO: 476551 - RNA, 19 nt, Homo sapiens
gaaauaaucuugaccuuga

SEQ ID NO: 476552 - RNA, 19 nt, Homo sapiens
ggacaucaauggagaaauu

SEQ ID NO: 476553 - RNA, 19 nt, Homo sapiens
gaaauaagcuauggguaaa

SEQ ID NO: 476554 - RNA, 19 nt, Homo sapiens
guauagggcucagaaauua

SEQ ID NO: 476555 - RNA, 19 nt, Homo sapiens
ggaagcagauggagaggua

SEQ ID NO: 476556 - RNA, 19 nt, Homo sapiens
gaagguggcuguugugaau

SEQ ID NO: 476557 - RNA, 19 nt, Homo sapiens
ggacaucagcugacuaaua

SEQ ID NO: 476558 - RNA, 19 nt, Homo sapiens
ggaaguugauggcaauaaa

SEQ ID NO: 476559 - RNA, 19 nt, Homo sapiens
gaauaacguuggaccauug

SEQ ID NO: 476560 - RNA, 19 nt, Homo sapiens
gacaucagcugacuaauag

SEQ ID NO: 476561 - RNA, 19 nt, Homo sapiens
ccaagaagcucggcaaaug

SEQ ID NO: 476562 - RNA, 19 nt, Homo sapiens
ccaagugacuggucuagaa

SEQ ID NO: 476563 - RNA, 19 nt, Homo sapiens
gcacauuaacuuucucaua

SEQ ID NO: 476564 - RNA, 19 nt, Homo sapiens
gaaguacccugacuauaag

SEQ ID NO: 476565 - RNA, 19 nt, Homo sapiens
ugacaaaccuagagaaaca

SEQ ID NO: 476566 - RNA, 19 nt, Homo sapiens
gcaaacugcucccagaugu

SEQ ID NO: 476567 - RNA, 19 nt, Homo sapiens
agaaguacccugacuauaa

SEQ ID NO: 476568 - RNA, 19 nt, Homo sapiens
uagagaaacagccauauua

SEQ ID NO: 476569 - RNA, 19 nt, Homo sapiens
ggaauaacguuggaccauu

SEQ ID NO: 476570 - RNA, 19 nt, Homo sapiens
cauuaacguuugcuacuua

SEQ ID NO: 476571 - RNA, 19 nt, Homo sapiens
cuacugggcuuuccucuug

SEQ ID NO: 476572 - RNA, 19 nt, Homo sapiens
gcaaagagcaacaacugaa

SEQ ID NO: 476573 - RNA, 19 nt, Homo sapiens
uaauagaggugugcaugua

SEQ ID NO: 476574 - RNA, 19 nt, Homo sapiens
guugugaccuuaggacuua

SEQ ID NO: 476575 - RNA, 19 nt, Homo sapiens
guacugaaguguugaccaa

SEQ ID NO: 476576 - RNA, 19 nt, Homo sapiens
uccaagcacugaagucuua

SEQ ID NO: 476577 - RNA, 19 nt, Homo sapiens
guggaggccuuuagcauuu

SEQ ID NO: 476578 - RNA, 19 nt, Homo sapiens
caagaccucugauggcaaa

SEQ ID NO: 476579 - RNA, 19 nt, Homo sapiens
gagagagacauaagaaauu

SEQ ID NO: 476580 - RNA, 19 nt, Homo sapiens
ugaaauaagcuauggguaa

SEQ ID NO: 476581 - RNA, 19 nt, Homo sapiens
gaaagaaaggcaacucaug

SEQ ID NO: 476582 - RNA, 19 nt, Homo sapiens
gacagaaaguggaagaaga

SEQ ID NO: 476583 - RNA, 19 nt, Homo sapiens
ggaucucgcuggaaagcua

SEQ ID NO: 476584 - RNA, 19 nt, Homo sapiens
ucaaaggacuggaaagaca

SEQ ID NO: 476585 - RNA, 19 nt, Homo sapiens
caguuuagcugauguuguu

SEQ ID NO: 476586 - RNA, 19 nt, Homo sapiens
gcacugcacuggguaggaa

SEQ ID NO: 476587 - RNA, 19 nt, Homo sapiens
guaaugcaccugacagaaa

SEQ ID NO: 476588 - RNA, 19 nt, Homo sapiens
ccaacaagccucacucuga

SEQ ID NO: 476589 - RNA, 19 nt, Homo sapiens
caagucaauugccauuauu

SEQ ID NO: 476590 - RNA, 19 nt, Homo sapiens
gagcaacaacugaauguga

SEQ ID NO: 476591 - RNA, 19 nt, Homo sapiens
guuggaccauugugaguua

SEQ ID NO: 476592 - RNA, 19 nt, Homo sapiens
aaacaacacuggagagucu

SEQ ID NO: 476593 - RNA, 19 nt, Homo sapiens
gaaacagcgucagcaaaug

SEQ ID NO: 476594 - RNA, 19 nt, Homo sapiens
ugacaugauuccuguuuga

SEQ ID NO: 476595 - RNA, 19 nt, Homo sapiens
ucaagucaauugccauuau

SEQ ID NO: 476596 - RNA, 19 nt, Homo sapiens
ggacaagccuccccaaaug

SEQ ID NO: 476597 - RNA, 19 nt, Homo sapiens
gaauuucucuuuacuucuc

SEQ ID NO: 476598 - RNA, 19 nt, Homo sapiens
caacaagcaaacaacaaua

SEQ ID NO: 476599 - RNA, 19 nt, Homo sapiens
ucucauacacugacuguua

SEQ ID NO: 476600 - RNA, 19 nt, Homo sapiens
gaacaacaggugcuugaug

SEQ ID NO: 476601 - RNA, 19 nt, Homo sapiens
gaaacaccacccuaaaguu

SEQ ID NO: 476602 - RNA, 19 nt, Homo sapiens
gcaagcagcaccuggagaa

SEQ ID NO: 476603 - RNA, 19 nt, Homo sapiens
uaaacagaaugaagaagga

SEQ ID NO: 476604 - RNA, 19 nt, Homo sapiens
guugauggcaauaaaguua

SEQ ID NO: 476605 - RNA, 19 nt, Homo sapiens
uacacugacuguuacuuua

SEQ ID NO: 476606 - RNA, 19 nt, Homo sapiens
cacauuaacuuucucauac

SEQ ID NO: 476607 - RNA, 19 nt, Homo sapiens
ggaaagcuaugacaaaccu

SEQ ID NO: 476608 - RNA, 19 nt, Homo sapiens
cauaaagcguccaaugaau

SEQ ID NO: 476609 - RNA, 19 nt, Homo sapiens
gaguggagauucugaugga

SEQ ID NO: 476610 - RNA, 19 nt, Homo sapiens
ggcgaguccuugucuagua

SEQ ID NO: 476611 - RNA, 19 nt, Homo sapiens
ugaugggacugcuuaugua

SEQ ID NO: 476612 - RNA, 19 nt, Homo sapiens
cuccaucucucuacuuuaa

SEQ ID NO: 476613 - RNA, 19 nt, Homo sapiens
gaccuuaggacuuaaagaa

SEQ ID NO: 476614 - RNA, 19 nt, Homo sapiens
gagaggagccacauaucaa

SEQ ID NO: 476615 - RNA, 19 nt, Homo sapiens
ggagaaguacccugacuau

SEQ ID NO: 476616 - RNA, 19 nt, Homo sapiens
ggugugggcuaaagaugaa

SEQ ID NO: 476617 - RNA, 19 nt, Homo sapiens
gcacaauagguuacuuaaa

SEQ ID NO: 476618 - RNA, 19 nt, Homo sapiens
ccuccaggcuucagcuaua

SEQ ID NO: 476619 - RNA, 19 nt, Homo sapiens
ugacuggucuagaaauaau

SEQ ID NO: 476620 - RNA, 19 nt, Homo sapiens
ccuaacugguucauccuua

SEQ ID NO: 476621 - RNA, 19 nt, Homo sapiens
ggagaggagccacauauca

SEQ ID NO: 476622 - RNA, 19 nt, Homo sapiens
gcacagccacugaaccuau

SEQ ID NO: 476623 - RNA, 19 nt, Homo sapiens
aaaggcaacucauggguau

SEQ ID NO: 476624 - RNA, 19 nt, Homo sapiens
ggacugcuuauguagauuu

SEQ ID NO: 476625 - RNA, 19 nt, Homo sapiens
ggacaguguuaaaucuuag

SEQ ID NO: 476626 - RNA, 19 nt, Homo sapiens
gcaaacaacaauaucaaca

SEQ ID NO: 476627 - RNA, 19 nt, Homo sapiens
ggagccacauaucaaagaa

SEQ ID NO: 476628 - RNA, 19 nt, Homo sapiens
gcagcaacaagaacaaauu

SEQ ID NO: 476629 - RNA, 19 nt, Homo sapiens
acaauacaauggaaguuga

SEQ ID NO: 476630 - RNA, 19 nt, Homo sapiens
ggaaaugaaacugaugauu

SEQ ID NO: 476631 - RNA, 19 nt, Homo sapiens
gaugacaugauuccuguuu

SEQ ID NO: 476632 - RNA, 19 nt, Homo sapiens
gauggaagucugugcauga

SEQ ID NO: 476633 - RNA, 19 nt, Homo sapiens
aaagauuguugugaccuua

SEQ ID NO: 476634 - RNA, 19 nt, Homo sapiens
cggcaguacuucaauguug

SEQ ID NO: 476635 - RNA, 19 nt, Homo sapiens
gcaaugaaccccacauaaa

SEQ ID NO: 476636 - RNA, 19 nt, Homo sapiens
caaccuuggugcugcugua

SEQ ID NO: 476637 - RNA, 19 nt, Homo sapiens
aaauggagcuggccaagca

SEQ ID NO: 476638 - RNA, 19 nt, Homo sapiens
caccuucccuugcauguga

SEQ ID NO: 476639 - RNA, 19 nt, Homo sapiens
aaacaccacccuaaaguug

SEQ ID NO: 476640 - RNA, 19 nt, Homo sapiens
gaagugugggccauaugua

SEQ ID NO: 476641 - RNA, 19 nt, Homo sapiens
gcuuauuucuucaacauuc

SEQ ID NO: 476642 - RNA, 19 nt, Homo sapiens
cacuucaaaugacaacuua

SEQ ID NO: 476643 - RNA, 19 nt, Homo sapiens
caacaacaagagauugaaa

SEQ ID NO: 476644 - RNA, 19 nt, Homo sapiens
gaaaugcggcaguacuuca

SEQ ID NO: 476645 - RNA, 19 nt, Homo sapiens
gagaaacagcgucagcaaa

SEQ ID NO: 476646 - RNA, 19 nt, Homo sapiens
uuaaauaguugggacauca

SEQ ID NO: 476647 - RNA, 19 nt, Homo sapiens
gagccugggaugccuguua

SEQ ID NO: 476648 - RNA, 19 nt, Homo sapiens
caagaagcucggcaaauga

SEQ ID NO: 476649 - RNA, 19 nt, Homo sapiens
caaaugacaacuuaaccaa

SEQ ID NO: 476650 - RNA, 19 nt, Homo sapiens
gagcaagugccaaauuugu

SEQ ID NO: 476651 - RNA, 19 nt, Homo sapiens
uaagaaaccuggcauuuaa

SEQ ID NO: 476652 - RNA, 19 nt, Homo sapiens
ggaaacauuugcacucuuu

SEQ ID NO: 476653 - RNA, 19 nt, Homo sapiens
gaaacugacuggaaacuuc

SEQ ID NO: 476654 - RNA, 19 nt, Homo sapiens
ggucaucuguuguuaaauu

SEQ ID NO: 476655 - RNA, 19 nt, Homo sapiens
gcucgaaacugacuggaaa

SEQ ID NO: 476656 - RNA, 19 nt, Homo sapiens
gagcaagcguggaggauga

SEQ ID NO: 476657 - RNA, 19 nt, Homo sapiens
aagcggagcucgaaacuga

SEQ ID NO: 476658 - RNA, 19 nt, Homo sapiens
cuagagaguuugaggauug

SEQ ID NO: 476659 - RNA, 19 nt, Homo sapiens
aaugagagauugcaaaugu

SEQ ID NO: 476660 - RNA, 19 nt, Homo sapiens
gcagcgaaaucaacgagaa

SEQ ID NO: 476661 - RNA, 19 nt, Homo sapiens
guacagauuugcuuucucu

SEQ ID NO: 476662 - RNA, 19 nt, Homo sapiens
ucacugcagucuuaagaaa

SEQ ID NO: 476663 - RNA, 19 nt, Homo sapiens
gggcaaggcugaccugaag

SEQ ID NO: 476664 - RNA, 19 nt, Homo sapiens
gcaugugucauccauauuu

SEQ ID NO: 476665 - RNA, 19 nt, Homo sapiens
gcaguuaaccuucaagaca

SEQ ID NO: 476666 - RNA, 19 nt, Homo sapiens
ccucaggcuuugcgauuua

SEQ ID NO: 476667 - RNA, 19 nt, Homo sapiens
uuaagaaaccuggcauuua

SEQ ID NO: 476668 - RNA, 19 nt, Homo sapiens
ggaggaagucggugaagaa

SEQ ID NO: 476669 - RNA, 19 nt, Homo sapiens
aaacuuaccuuucccuuuu

SEQ ID NO: 476670 - RNA, 19 nt, Homo sapiens
cuuguucacugcagucuua

SEQ ID NO: 476671 - RNA, 19 nt, Homo sapiens
aaacggugcugcugggaaa

SEQ ID NO: 476672 - RNA, 19 nt, Homo sapiens
ggcaagcucuggagacuuc

SEQ ID NO: 476673 - RNA, 19 nt, Homo sapiens
gauugcaaauguaguguau

SEQ ID NO: 476674 - RNA, 19 nt, Homo sapiens
uguguuaugugaucaguuu

SEQ ID NO: 476675 - RNA, 19 nt, Homo sapiens
gcaacucguacccaaauuu

SEQ ID NO: 476676 - RNA, 19 nt, Homo sapiens
gaacaagccgcacgucaag

SEQ ID NO: 476677 - RNA, 19 nt, Homo sapiens
gcaagcaugugucauccau

SEQ ID NO: 476678 - RNA, 19 nt, Homo sapiens
uguuggagcuuuccucaaa

SEQ ID NO: 476679 - RNA, 19 nt, Homo sapiens
ugaaaucuguucugggaau

SEQ ID NO: 476680 - RNA, 19 nt, Homo sapiens
agaauucccuuuggacauu

SEQ ID NO: 476681 - RNA, 19 nt, Homo sapiens
ggaacaacccgucuacaca

SEQ ID NO: 476682 - RNA, 19 nt, Homo sapiens
ugagucauuugcaguguuu

SEQ ID NO: 476683 - RNA, 19 nt, Homo sapiens
gcagcgacgucaucuccaa

SEQ ID NO: 476684 - RNA, 19 nt, Homo sapiens
aagcaugugucauccauau

SEQ ID NO: 476685 - RNA, 19 nt, Homo sapiens
caaaggguauggucaucug

SEQ ID NO: 476686 - RNA, 19 nt, Homo sapiens
gagaggaccaaccagaauu

SEQ ID NO: 476687 - RNA, 19 nt, Homo sapiens
gguaaaagcuuugguuugu

SEQ ID NO: 476688 - RNA, 19 nt, Homo sapiens
ccuuugggcugccuuauau

SEQ ID NO: 476689 - RNA, 19 nt, Homo sapiens
ggaguaaacaauagucuag

SEQ ID NO: 476690 - RNA, 19 nt, Homo sapiens
gcaagacgcugggcaagcu

SEQ ID NO: 476691 - RNA, 19 nt, Homo sapiens
aauauggcauccuucaauu

SEQ ID NO: 476692 - RNA, 19 nt, Homo sapiens
guguaucacugagucauuu

SEQ ID NO: 476693 - RNA, 19 nt, Homo sapiens
aaaacaaacuggaaacuug

SEQ ID NO: 476694 - RNA, 19 nt, Homo sapiens
acagaauuguguuauguga

SEQ ID NO: 476695 - RNA, 19 nt, Homo sapiens
aaaccuggcauuuaaauca

SEQ ID NO: 476696 - RNA, 19 nt, Homo sapiens
gaauucccuuuggacauuu

SEQ ID NO: 476697 - RNA, 19 nt, Homo sapiens
cacccuagauuuguauaaa

SEQ ID NO: 476698 - RNA, 19 nt, Homo sapiens
guauggucaucuguuguua

SEQ ID NO: 476699 - RNA, 19 nt, Homo sapiens
gaaaucuguucugggaaug

SEQ ID NO: 476700 - RNA, 19 nt, Homo sapiens
aaacaauagucuagagaag

SEQ ID NO: 476701 - RNA, 19 nt, Homo sapiens
cuaaaucucucugccuguu

SEQ ID NO: 476702 - RNA, 19 nt, Homo sapiens
gauggagaaucgugugauc

SEQ ID NO: 476703 - RNA, 19 nt, Homo sapiens
agaauuguguuaugugauc

SEQ ID NO: 476704 - RNA, 19 nt, Homo sapiens
acagauuugcuuucucuua

SEQ ID NO: 476705 - RNA, 19 nt, Homo sapiens
ggaggaugauggagaaucg

SEQ ID NO: 476706 - RNA, 19 nt, Homo sapiens
acacaaacaugaccuaucc

SEQ ID NO: 476707 - RNA, 19 nt, Homo sapiens
caacgaguuugaccaguac

SEQ ID NO: 476708 - RNA, 19 nt, Homo sapiens
gucaacggcuccagcaaga

SEQ ID NO: 476709 - RNA, 19 nt, Homo sapiens
uaauauggcauccuucaau

SEQ ID NO: 476710 - RNA, 19 nt, Homo sapiens
gcaauuaugggaguaaaca

SEQ ID NO: 476711 - RNA, 19 nt, Homo sapiens
caaccagaauucccuuugg

SEQ ID NO: 476712 - RNA, 19 nt, Homo sapiens
guaaggagagguuuuaauu

SEQ ID NO: 476713 - RNA, 19 nt, Homo sapiens
gauuugcuuucucuuacaa

SEQ ID NO: 476714 - RNA, 19 nt, Homo sapiens
cagauuugcuuucucuuac

SEQ ID NO: 476715 - RNA, 19 nt, Homo sapiens
gcuagagaguuugaggauu

SEQ ID NO: 476716 - RNA, 19 nt, Homo sapiens
uugcaaauguaguguauca

SEQ ID NO: 476717 - RNA, 19 nt, Homo sapiens
acaauagucuagagaagca

SEQ ID NO: 476718 - RNA, 19 nt, Homo sapiens
ucagaacaccagcaguuaa

SEQ ID NO: 476719 - RNA, 19 nt, Homo sapiens
gggaaacauuugcacucuu

SEQ ID NO: 476720 - RNA, 19 nt, Homo sapiens
guaaacaauagucuagaga

SEQ ID NO: 476721 - RNA, 19 nt, Homo sapiens
caaauuuccaagacacaaa

SEQ ID NO: 476722 - RNA, 19 nt, Homo sapiens
gcaagcaaaggagaugaaa

SEQ ID NO: 476723 - RNA, 19 nt, Homo sapiens
cuagagaagcauuugguaa

SEQ ID NO: 476724 - RNA, 19 nt, Homo sapiens
uauguacuguguaugauuc

SEQ ID NO: 476725 - RNA, 19 nt, Homo sapiens
uggccgagaugauccuaaa

SEQ ID NO: 476726 - RNA, 19 nt, Homo sapiens
uuacugcuguggcuagaga

SEQ ID NO: 476727 - RNA, 19 nt, Homo sapiens
cugacagaccuuaaucuua

SEQ ID NO: 476728 - RNA, 19 nt, Homo sapiens
gguauggucaucuguuguu

SEQ ID NO: 476729 - RNA, 19 nt, Homo sapiens
caguuaaccuucaagacau

SEQ ID NO: 476730 - RNA, 19 nt, Homo sapiens
aggaggagcugccuuaaaa

SEQ ID NO: 476731 - RNA, 19 nt, Homo sapiens
gaacagugugcccuagcuu

SEQ ID NO: 476732 - RNA, 19 nt, Homo sapiens
acucuuaguugaacagugu

SEQ ID NO: 476733 - RNA, 19 nt, Homo sapiens
caacgagaaacuggacuuu

SEQ ID NO: 476734 - RNA, 19 nt, Homo sapiens
aagcaaaggagaugaaauc

SEQ ID NO: 476735 - RNA, 19 nt, Homo sapiens
gggaguaaacaauagucua

SEQ ID NO: 476736 - RNA, 19 nt, Homo sapiens
aaaucucucugccuguuug

SEQ ID NO: 476737 - RNA, 19 nt, Homo sapiens
gagcgaggaggacaaguuc

SEQ ID NO: 476738 - RNA, 19 nt, Homo sapiens
cguggaggaugauggagaa

SEQ ID NO: 476739 - RNA, 19 nt, Homo sapiens
caacucguacccaaauuuc

SEQ ID NO: 476740 - RNA, 19 nt, Homo sapiens
gaacuccagcuccuacuac

SEQ ID NO: 476741 - RNA, 19 nt, Homo sapiens
gcaaguuucuuuguauucc

SEQ ID NO: 476742 - RNA, 19 nt, Homo sapiens
caccagcaguuaaccuuca

SEQ ID NO: 476743 - RNA, 19 nt, Homo sapiens
ccaagcgcauuacccacuu

SEQ ID NO: 476744 - RNA, 19 nt, Homo sapiens
gaccuauccaagcgcauua

SEQ ID NO: 476745 - RNA, 19 nt, Homo sapiens
guacccaaauuuccaagac

SEQ ID NO: 476746 - RNA, 19 nt, Homo sapiens
gaaagcggagcucgaaacu

SEQ ID NO: 476747 - RNA, 19 nt, Homo sapiens
cgcggagacucgccaguuu

SEQ ID NO: 476748 - RNA, 19 nt, Homo sapiens
gaagcucgcggaccaguac

SEQ ID NO: 476749 - RNA, 19 nt, Homo sapiens
ggagaaucgugugaucagu

SEQ ID NO: 476750 - RNA, 19 nt, Homo sapiens
ugccuuauauugugugugu

SEQ ID NO: 476751 - RNA, 19 nt, Homo sapiens
ccaauaaccucauucuuug

SEQ ID NO: 476752 - RNA, 19 nt, Homo sapiens
gcauuaagcauuccacaua

SEQ ID NO: 476753 - RNA, 19 nt, Homo sapiens
gccaauaaccucauucuuu

SEQ ID NO: 476754 - RNA, 19 nt, Homo sapiens
agaaggagguugacuguug

SEQ ID NO: 476755 - RNA, 19 nt, Homo sapiens
ggaaaggaaucagagacaa

SEQ ID NO: 476756 - RNA, 19 nt, Homo sapiens
ucauuacugucuccuguua

SEQ ID NO: 476757 - RNA, 19 nt, Homo sapiens
ccagcucccucuucccuua

SEQ ID NO: 476758 - RNA, 19 nt, Homo sapiens
cauuaagcauuccacauaa

SEQ ID NO: 476759 - RNA, 19 nt, Homo sapiens
gaaaggaaucagagacaau

SEQ ID NO: 476760 - RNA, 19 nt, Homo sapiens
ggugggcguuggacucuuu

SEQ ID NO: 476761 - RNA, 19 nt, Homo sapiens
auucugcccuugccucuua

SEQ ID NO: 476762 - RNA, 19 nt, Homo sapiens
uggcugaguuggaccagua

SEQ ID NO: 476763 - RNA, 19 nt, Homo sapiens
gcaagacgcugggcaagcu

SEQ ID NO: 476764 - RNA, 19 nt, Homo sapiens
ggccuuaccacuccuauga

SEQ ID NO: 476765 - RNA, 19 nt, Homo sapiens
ggagaaggagguugacugu

SEQ ID NO: 476766 - RNA, 19 nt, Homo sapiens
cacccacacugaaagauga

SEQ ID NO: 476767 - RNA, 19 nt, Homo sapiens
agaaagaccacccggacua

SEQ ID NO: 476768 - RNA, 19 nt, Homo sapiens
ggaggcugcugaacgaaag

SEQ ID NO: 476769 - RNA, 19 nt, Homo sapiens
gauucaggcuccguccuaa

SEQ ID NO: 476770 - RNA, 19 nt, Homo sapiens
guaugcagcacaagaaaga

SEQ ID NO: 476771 - RNA, 19 nt, Homo sapiens
aaauuaaagguuccgguua

SEQ ID NO: 476772 - RNA, 19 nt, Homo sapiens
gagaucagccacgagguaa

SEQ ID NO: 476773 - RNA, 19 nt, Homo sapiens
caaauccacauguaacuca

SEQ ID NO: 476774 - RNA, 19 nt, Homo sapiens
ccuguuauuuaucucagua

SEQ ID NO: 476775 - RNA, 19 nt, Homo sapiens
ggauucaggcuccguccua

SEQ ID NO: 476776 - RNA, 19 nt, Homo sapiens
ccaauucugugccaauaac

SEQ ID NO: 476777 - RNA, 19 nt, Homo sapiens
ggaguucucaucccuucaa

SEQ ID NO: 476778 - RNA, 19 nt, Homo sapiens
ggacuuaguggaguucuca

SEQ ID NO: 476779 - RNA, 19 nt, Homo sapiens
gcacccacacugaaagaug

SEQ ID NO: 476780 - RNA, 19 nt, Homo sapiens
gaucagccacgagguaaug

SEQ ID NO: 476781 - RNA, 19 nt, Homo sapiens
ugagaucagccacgaggua

SEQ ID NO: 476782 - RNA, 19 nt, Homo sapiens
ggcggacgaugacaaguuc

SEQ ID NO: 476783 - RNA, 19 nt, Homo sapiens
aaaggaaucagagacaauu

SEQ ID NO: 476784 - RNA, 19 nt, Homo sapiens
gagcuggaccgcacaccuu

SEQ ID NO: 476785 - RNA, 19 nt, Homo sapiens
gggagcagccaguauauac

SEQ ID NO: 476786 - RNA, 19 nt, Homo sapiens
uaacucugcauuaagcauu

SEQ ID NO: 476787 - RNA, 19 nt, Homo sapiens
ggacacgguuuuccacuuc

SEQ ID NO: 476788 - RNA, 19 nt, Homo sapiens
cgagggacuuaguggaguu

SEQ ID NO: 476789 - RNA, 19 nt, Homo sapiens
gagcagccaguauauacga

SEQ ID NO: 476790 - RNA, 19 nt, Homo sapiens
caacauggagaccuuugau

SEQ ID NO: 476791 - RNA, 19 nt, Homo sapiens
uacugucuccuguuauuua

SEQ ID NO: 476792 - RNA, 19 nt, Homo sapiens
auccacauguaacucauua

SEQ ID NO: 476793 - RNA, 19 nt, Homo sapiens
gggcugagaguagcuuuga

SEQ ID NO: 476794 - RNA, 19 nt, Homo sapiens
cagaggagaaggagguuga

SEQ ID NO: 476795 - RNA, 19 nt, Homo sapiens
gaagcucgcggaccaguac

SEQ ID NO: 476796 - RNA, 19 nt, Homo sapiens
cuagaauccugaccuguac

SEQ ID NO: 476797 - RNA, 19 nt, Homo sapiens
acuagaauccugaccugua

SEQ ID NO: 476798 - RNA, 19 nt, Homo sapiens
caaccuccaugaccuugag

SEQ ID NO: 476799 - RNA, 19 nt, Homo sapiens
ggaagccucacaucgacuu

SEQ ID NO: 476800 - RNA, 19 nt, Homo sapiens
gcgggaagccucacaucga

SEQ ID NO: 476801 - RNA, 19 nt, Homo sapiens
ccagggugguuggugguaa

SEQ ID NO: 476802 - RNA, 19 nt, Homo sapiens
gccacgagguaauguccaa

SEQ ID NO: 476803 - RNA, 19 nt, Homo sapiens
ccucaggacccuauuaugg

SEQ ID NO: 476804 - RNA, 19 nt, Homo sapiens
ggaagcucgcggaccagua

SEQ ID NO: 476805 - RNA, 19 nt, Homo sapiens
ucuggaggcugcugaacga

SEQ ID NO: 476806 - RNA, 19 nt, Homo sapiens
ugggcaaggucaagaagga

SEQ ID NO: 476807 - RNA, 19 nt, Homo sapiens
cagcaaagccccaggagaa

SEQ ID NO: 476808 - RNA, 19 nt, Homo sapiens
cuacucggccuucuccuau

SEQ ID NO: 476809 - RNA, 19 nt, Homo sapiens
aagcccaggugaagacaga

SEQ ID NO: 476810 - RNA, 19 nt, Homo sapiens
ccuuugauguggcugaguu

SEQ ID NO: 476811 - RNA, 19 nt, Homo sapiens
gaaagaccacccggacuac

SEQ ID NO: 476812 - RNA, 19 nt, Homo sapiens
auuacugucuccuguuauu

SEQ ID NO: 476813 - RNA, 19 nt, Homo sapiens
ggugguuggugguaaggau

SEQ ID NO: 476814 - RNA, 19 nt, Homo sapiens
aaagcaagccgcacgucaa

SEQ ID NO: 476815 - RNA, 19 nt, Homo sapiens
cuacucagcagccggcuau

SEQ ID NO: 476816 - RNA, 19 nt, Homo sapiens
cagccugugugcccuguuc

SEQ ID NO: 476817 - RNA, 19 nt, Homo sapiens
gauccaauucugugccaau

SEQ ID NO: 476818 - RNA, 19 nt, Homo sapiens
ggagaacaggcuggacaga

SEQ ID NO: 476819 - RNA, 19 nt, Homo sapiens
acucggccuucuccuauau

SEQ ID NO: 476820 - RNA, 19 nt, Homo sapiens
ccucacagaucgccuacac

SEQ ID NO: 476821 - RNA, 19 nt, Homo sapiens
ugucuccuguuauuuaucu

SEQ ID NO: 476822 - RNA, 19 nt, Homo sapiens
guucucaucccuucaaugc

SEQ ID NO: 476823 - RNA, 19 nt, Homo sapiens
gguggcaucggaggccuua

SEQ ID NO: 476824 - RNA, 19 nt, Homo sapiens
ccaaagcccaggugaagac

SEQ ID NO: 476825 - RNA, 19 nt, Homo sapiens
gagcugggcaaggucaaga

SEQ ID NO: 476826 - RNA, 19 nt, Homo sapiens
gcccucaggacccuauuau

SEQ ID NO: 476827 - RNA, 19 nt, Homo sapiens
cauggagaccuuugaugug

SEQ ID NO: 476828 - RNA, 19 nt, Homo sapiens
ccaggaaaggaaucagaga

SEQ ID NO: 476829 - RNA, 19 nt, Homo sapiens
uacucggccuucuccuaua

SEQ ID NO: 476830 - RNA, 19 nt, Homo sapiens
ccaacauggagaccuuuga

SEQ ID NO: 476831 - RNA, 19 nt, Homo sapiens
caauaaccucauucuuugu

SEQ ID NO: 476832 - RNA, 19 nt, Homo sapiens
gagaaggagguugacuguu

SEQ ID NO: 476833 - RNA, 19 nt, Homo sapiens
cauccaggcccacuacaag

SEQ ID NO: 476834 - RNA, 19 nt, Homo sapiens
auccaauucugugccaaua

SEQ ID NO: 476835 - RNA, 19 nt, Homo sapiens
gaguucucaucccuucaau

SEQ ID NO: 476836 - RNA, 19 nt, Homo sapiens
ggacacuccgccuggaucu

SEQ ID NO: 476837 - RNA, 19 nt, Homo sapiens
ggagagaauucuacauuua

SEQ ID NO: 476838 - RNA, 19 nt, Homo sapiens
ccucagagcuguuaucuua

SEQ ID NO: 476839 - RNA, 19 nt, Homo sapiens
gaaacuggauucucgauuu

SEQ ID NO: 476840 - RNA, 19 nt, Homo sapiens
guacauauguuguggguuu

SEQ ID NO: 476841 - RNA, 19 nt, Homo sapiens
gaagagauagucaagauuu

SEQ ID NO: 476842 - RNA, 19 nt, Homo sapiens
gcagugcgcuggaggauga

SEQ ID NO: 476843 - RNA, 19 nt, Homo sapiens
ggacagccguuuccagauu

SEQ ID NO: 476844 - RNA, 19 nt, Homo sapiens
gcagugaguuuauaagaga

SEQ ID NO: 476845 - RNA, 19 nt, Homo sapiens
gaaccagcauucucuuauu

SEQ ID NO: 476846 - RNA, 19 nt, Homo sapiens
caacguaaacccauugaua

SEQ ID NO: 476847 - RNA, 19 nt, Homo sapiens
aaacugugcuuugcaaaua

SEQ ID NO: 476848 - RNA, 19 nt, Homo sapiens
gacacaagcucauaauguu

SEQ ID NO: 476849 - RNA, 19 nt, Homo sapiens
gagaugugguuuccaauga

SEQ ID NO: 476850 - RNA, 19 nt, Homo sapiens
gguaagcuuuccaucuuua

SEQ ID NO: 476851 - RNA, 19 nt, Homo sapiens
gagcuguuaucuuaguuua

SEQ ID NO: 476852 - RNA, 19 nt, Homo sapiens
gaaguaauuuccaguucuu

SEQ ID NO: 476853 - RNA, 19 nt, Homo sapiens
acacagggauuuacaaguu

SEQ ID NO: 476854 - RNA, 19 nt, Homo sapiens
guaauaauuuggcuucaga

SEQ ID NO: 476855 - RNA, 19 nt, Homo sapiens
gauugaaacucacugcaaa

SEQ ID NO: 476856 - RNA, 19 nt, Homo sapiens
gaccugagcuugaauuucu

SEQ ID NO: 476857 - RNA, 19 nt, Homo sapiens
ucaauuagcaggcugauuu

SEQ ID NO: 476858 - RNA, 19 nt, Homo sapiens
gcaaguauguugguacguu

SEQ ID NO: 476859 - RNA, 19 nt, Homo sapiens
gaaaaugcauggcaaaguu

SEQ ID NO: 476860 - RNA, 19 nt, Homo sapiens
guagagauauucuuacaag

SEQ ID NO: 476861 - RNA, 19 nt, Homo sapiens
gggaagagauagucaagau

SEQ ID NO: 476862 - RNA, 19 nt, Homo sapiens
caaguauguugguacguua

SEQ ID NO: 476863 - RNA, 19 nt, Homo sapiens
gcuggaggaugaaguguuu

SEQ ID NO: 476864 - RNA, 19 nt, Homo sapiens
guagaagucugagugguuu

SEQ ID NO: 476865 - RNA, 19 nt, Homo sapiens
aaacugagcucucuuccau

SEQ ID NO: 476866 - RNA, 19 nt, Homo sapiens
caacauccccuuuuauuua

SEQ ID NO: 476867 - RNA, 19 nt, Homo sapiens
gaaugucaguuucaaauac

SEQ ID NO: 476868 - RNA, 19 nt, Homo sapiens
gggaagugauuuaaauaug

SEQ ID NO: 476869 - RNA, 19 nt, Homo sapiens
guggugagguggaaacuuu

SEQ ID NO: 476870 - RNA, 19 nt, Homo sapiens
ggacagaaccaccugaugu

SEQ ID NO: 476871 - RNA, 19 nt, Homo sapiens
ggagaaaacugaugucuuc

SEQ ID NO: 476872 - RNA, 19 nt, Homo sapiens
cagcacaacuguuacucua

SEQ ID NO: 476873 - RNA, 19 nt, Homo sapiens
agaagaugcugaugauauu

SEQ ID NO: 476874 - RNA, 19 nt, Homo sapiens
ggaaugucaguuucaaaua

SEQ ID NO: 476875 - RNA, 19 nt, Homo sapiens
gaaacucgcaucgccaaua

SEQ ID NO: 476876 - RNA, 19 nt, Homo sapiens
gacuuaagaucagaguuua

SEQ ID NO: 476877 - RNA, 19 nt, Homo sapiens
gucuguaucuugacaauuu

SEQ ID NO: 476878 - RNA, 19 nt, Homo sapiens
uaauuuggcuucagaaugg

SEQ ID NO: 476879 - RNA, 19 nt, Homo sapiens
gauaaaccaucagauuuca

SEQ ID NO: 476880 - RNA, 19 nt, Homo sapiens
gagaagaagaugcugauga

SEQ ID NO: 476881 - RNA, 19 nt, Homo sapiens
ugacauugcuguaucaaag

SEQ ID NO: 476882 - RNA, 19 nt, Homo sapiens
ggaaaauucugcucuuuga

SEQ ID NO: 476883 - RNA, 19 nt, Homo sapiens
ggauauuucucaguuauuc

SEQ ID NO: 476884 - RNA, 19 nt, Homo sapiens
ggaagugauuuaaauaugc

SEQ ID NO: 476885 - RNA, 19 nt, Homo sapiens
aaccagcauucucuuauua

SEQ ID NO: 476886 - RNA, 19 nt, Homo sapiens
ggaagcguccgcacaguaa

SEQ ID NO: 476887 - RNA, 19 nt, Homo sapiens
gaaacucacugcaaaauca

SEQ ID NO: 476888 - RNA, 19 nt, Homo sapiens
ucacagaggauuacauuug

SEQ ID NO: 476889 - RNA, 19 nt, Homo sapiens
ucugagauuuggcuuauuu

SEQ ID NO: 476890 - RNA, 19 nt, Homo sapiens
gggcagagauguuucuuuu

SEQ ID NO: 476891 - RNA, 19 nt, Homo sapiens
gcauugacagaauaucuua

SEQ ID NO: 476892 - RNA, 19 nt, Homo sapiens
cauguggccuaacuugaua

SEQ ID NO: 476893 - RNA, 19 nt, Homo sapiens
ggaaggguguucuuucucu

SEQ ID NO: 476894 - RNA, 19 nt, Homo sapiens
uuagcaggcugauuucuuu

SEQ ID NO: 476895 - RNA, 19 nt, Homo sapiens
ccuuauaccuccuugauug

SEQ ID NO: 476896 - RNA, 19 nt, Homo sapiens
gaccugguguucacauauu

SEQ ID NO: 476897 - RNA, 19 nt, Homo sapiens
gaucuaaccagcuucuuga

SEQ ID NO: 476898 - RNA, 19 nt, Homo sapiens
gaggaugaaguguuugaua

SEQ ID NO: 476899 - RNA, 19 nt, Homo sapiens
gcaugacacuguuaacaag

SEQ ID NO: 476900 - RNA, 19 nt, Homo sapiens
gauaacaacucaggauuuu

SEQ ID NO: 476901 - RNA, 19 nt, Homo sapiens
ggacuugaaaucauaauca

SEQ ID NO: 476902 - RNA, 19 nt, Homo sapiens
guacuuaaacugugcuuug

SEQ ID NO: 476903 - RNA, 19 nt, Homo sapiens
gggauccugcuguuuauua

SEQ ID NO: 476904 - RNA, 19 nt, Homo sapiens
aaacugaugucuucuaugc

SEQ ID NO: 476905 - RNA, 19 nt, Homo sapiens
agaagaagaugcugaugau

SEQ ID NO: 476906 - RNA, 19 nt, Homo sapiens
caaggccacaugaaacuua

SEQ ID NO: 476907 - RNA, 19 nt, Homo sapiens
ggaagucuguaucuugaca

SEQ ID NO: 476908 - RNA, 19 nt, Homo sapiens
gaucagaguuuacuuuuca

SEQ ID NO: 476909 - RNA, 19 nt, Homo sapiens
gaaaacugaugucuucuau

SEQ ID NO: 476910 - RNA, 19 nt, Homo sapiens
gaaacgguguaugacauug

SEQ ID NO: 476911 - RNA, 19 nt, Homo sapiens
uaacuaagcauugacagaa

SEQ ID NO: 476912 - RNA, 19 nt, Homo sapiens
uggccuaacuugauacaaa

SEQ ID NO: 476913 - RNA, 19 nt, Homo sapiens
gaagguggauccgcaucuu

SEQ ID NO: 476914 - RNA, 19 nt, Homo sapiens
gggaguugguggagauauu

SEQ ID NO: 476915 - RNA, 19 nt, Homo sapiens
gggcauauguauccuugug

SEQ ID NO: 476916 - RNA, 19 nt, Homo sapiens
gacagccguuuccagauuu

SEQ ID NO: 476917 - RNA, 19 nt, Homo sapiens
guacagcuauaguagagau

SEQ ID NO: 476918 - RNA, 19 nt, Homo sapiens
uacguuauguccugguuua

SEQ ID NO: 476919 - RNA, 19 nt, Homo sapiens
ucaagaacaucaccaagca

SEQ ID NO: 476920 - RNA, 19 nt, Homo sapiens
gaaacguuauacuccauuc

SEQ ID NO: 476921 - RNA, 19 nt, Homo sapiens
ggacaacuggaaguaauuu

SEQ ID NO: 476922 - RNA, 19 nt, Homo sapiens
ccucuaggcuccucgaaga

SEQ ID NO: 476923 - RNA, 19 nt, Homo sapiens
caaccacaauaaagaugaa

SEQ ID NO: 476924 - RNA, 19 nt, Homo sapiens
gaaugagccuuaccuaucc

SEQ ID NO: 476925 - RNA, 19 nt, Homo sapiens
ucaggauauuucucaguua

SEQ ID NO: 476926 - RNA, 19 nt, Homo sapiens
ucaaugcacugucgacauc

SEQ ID NO: 476927 - RNA, 19 nt, Homo sapiens
ugacuuaagaucagaguuu

SEQ ID NO: 476928 - RNA, 19 nt, Homo sapiens
gugcagagcuggguuccuu

SEQ ID NO: 476929 - RNA, 19 nt, Homo sapiens
acugagcucucuuccauuu

SEQ ID NO: 476930 - RNA, 19 nt, Homo sapiens
caggauauuucucaguuau

SEQ ID NO: 476931 - RNA, 19 nt, Homo sapiens
cagaucaaauuguuuaugg

SEQ ID NO: 476932 - RNA, 19 nt, Homo sapiens
gaguuaaagugaaaugagu

SEQ ID NO: 476933 - RNA, 19 nt, Homo sapiens
gcaaagaaauuggaaaaca

SEQ ID NO: 476934 - RNA, 19 nt, Homo sapiens
gaagaagaugcugaugaua

SEQ ID NO: 476935 - RNA, 19 nt, Homo sapiens
gcucauaauguuccaugua

SEQ ID NO: 476936 - RNA, 19 nt, Homo sapiens
gcgagaagaucccguucau

SEQ ID NO: 476937 - RNA, 19 nt, Homo sapiens
gaucgacgcuucacguuga

SEQ ID NO: 476938 - RNA, 19 nt, Homo sapiens
gaacugcugcccaccuaua

SEQ ID NO: 476939 - RNA, 19 nt, Homo sapiens
aagcaaaggcuccgguuua

SEQ ID NO: 476940 - RNA, 19 nt, Homo sapiens
caaagggguuuaugguuua

SEQ ID NO: 476941 - RNA, 19 nt, Homo sapiens
gggaacugcugcccaccua

SEQ ID NO: 476942 - RNA, 19 nt, Homo sapiens
gaacuccggagaccacaaa

SEQ ID NO: 476943 - RNA, 19 nt, Homo sapiens
ggagaggucuggccuaucc

SEQ ID NO: 476944 - RNA, 19 nt, Homo sapiens
gggagagccgcacaacaua

SEQ ID NO: 476945 - RNA, 19 nt, Homo sapiens
cugcaguccucccaugaua

SEQ ID NO: 476946 - RNA, 19 nt, Homo sapiens
gaagcaaaggcuccgguuu

SEQ ID NO: 476947 - RNA, 19 nt, Homo sapiens
cgaacagguuggaagcaaa

SEQ ID NO: 476948 - RNA, 19 nt, Homo sapiens
gggcggagucagucuuuaa

SEQ ID NO: 476949 - RNA, 19 nt, Homo sapiens
cgcacaacauacaauuaua

SEQ ID NO: 476950 - RNA, 19 nt, Homo sapiens
acaaagggguuuaugguuu

SEQ ID NO: 476951 - RNA, 19 nt, Homo sapiens
agcaaaggcuccgguuuaa

SEQ ID NO: 476952 - RNA, 19 nt, Homo sapiens
gaacagguuggaagcaaag

SEQ ID NO: 476953 - RNA, 19 nt, Homo sapiens
ccgcacaacauacaauuau

SEQ ID NO: 476954 - RNA, 19 nt, Homo sapiens
gcucugggcuuggggauaa

SEQ ID NO: 476955 - RNA, 19 nt, Homo sapiens
caaccgagcagaggcuuug

SEQ ID NO: 476956 - RNA, 19 nt, Homo sapiens
caaaggcuccgguuuaagc

SEQ ID NO: 476957 - RNA, 19 nt, Homo sapiens
gaagaccuuuccauuuuca

SEQ ID NO: 476958 - RNA, 19 nt, Homo sapiens
gcugcugccuccucaucuu

SEQ ID NO: 476959 - RNA, 19 nt, Homo sapiens
ccgaacagguuggaagcaa

SEQ ID NO: 476960 - RNA, 19 nt, Homo sapiens
aaagugugccgaacagguu

SEQ ID NO: 476961 - RNA, 19 nt, Homo sapiens
gagagccgcacaacauaca

SEQ ID NO: 476962 - RNA, 19 nt, Homo sapiens
gccgcacaacauacaauua

SEQ ID NO: 476963 - RNA, 19 nt, Homo sapiens
cccaggcugucaacccuuu

SEQ ID NO: 476964 - RNA, 19 nt, Homo sapiens
cauucaggacgcccucuua

SEQ ID NO: 476965 - RNA, 19 nt, Homo sapiens
ccaaguuccucggcaacga

SEQ ID NO: 476966 - RNA, 19 nt, Homo sapiens
ugggagaggucuggccuau

SEQ ID NO: 476967 - RNA, 19 nt, Homo sapiens
ggagagccgcacaacauac

SEQ ID NO: 476968 - RNA, 19 nt, Homo sapiens
ucaggacgcccucuuaagg

SEQ ID NO: 476969 - RNA, 19 nt, Homo sapiens
gcagaggcuuuggguacag

SEQ ID NO: 476970 - RNA, 19 nt, Homo sapiens
ccacggaaggucggucuga

SEQ ID NO: 476971 - RNA, 19 nt, Homo sapiens
ggcggagucagucuuuaaa

SEQ ID NO: 476972 - RNA, 19 nt, Homo sapiens
gcaaaggcuccgguuuaag

SEQ ID NO: 476973 - RNA, 19 nt, Homo sapiens
ccuggcagcugucggaacu

SEQ ID NO: 476974 - RNA, 19 nt, Homo sapiens
gcauucgacucuccccaaa

SEQ ID NO: 476975 - RNA, 19 nt, Homo sapiens
gcucucccacuccauacaa

SEQ ID NO: 476976 - RNA, 19 nt, Homo sapiens
cagaggcuuuggguacaga

SEQ ID NO: 476977 - RNA, 19 nt, Homo sapiens
gucaguaggccucagaaca

SEQ ID NO: 476978 - RNA, 19 nt, Homo sapiens
gagccgcacaacauacaau

SEQ ID NO: 476979 - RNA, 19 nt, Homo sapiens
ggcaccagacagcggauuu

SEQ ID NO: 476980 - RNA, 19 nt, Homo sapiens
gacagcggauuuugcauuc

SEQ ID NO: 476981 - RNA, 19 nt, Homo sapiens
ucaagcacauggcggauua

SEQ ID NO: 476982 - RNA, 19 nt, Homo sapiens
ggacuaagaagcaagauug

SEQ ID NO: 476983 - RNA, 19 nt, Homo sapiens
cagaguagauuaacugaau

SEQ ID NO: 476984 - RNA, 19 nt, Homo sapiens
gggcgucgcugccuuaaug

SEQ ID NO: 476985 - RNA, 19 nt, Homo sapiens
ggagaacgcugcuguuagg

SEQ ID NO: 476986 - RNA, 19 nt, Homo sapiens
ggaagacucucgcuuuuaa

SEQ ID NO: 476987 - RNA, 19 nt, Homo sapiens
gaagggaccacccaagaaa

SEQ ID NO: 476988 - RNA, 19 nt, Homo sapiens
ggaccaggcagguaacaua

SEQ ID NO: 476989 - RNA, 19 nt, Homo sapiens
gcaggaagacucucgcuuu

SEQ ID NO: 476990 - RNA, 19 nt, Homo sapiens
guagagcgauccugggaaa

SEQ ID NO: 476991 - RNA, 19 nt, Homo sapiens
gagaagguguggaagauag

SEQ ID NO: 476992 - RNA, 19 nt, Homo sapiens
acacaaaucucaggaacaa

SEQ ID NO: 476993 - RNA, 19 nt, Homo sapiens
caacugaguccaaggcuuu

SEQ ID NO: 476994 - RNA, 19 nt, Homo sapiens
ggacaaagccucuguuuuc

SEQ ID NO: 476995 - RNA, 19 nt, Homo sapiens
ccacugagcacccguguga

SEQ ID NO: 476996 - RNA, 19 nt, Homo sapiens
gaacaaacggucccagagu

SEQ ID NO: 476997 - RNA, 19 nt, Homo sapiens
gcacgucgcacuucgaguu

SEQ ID NO: 476998 - RNA, 19 nt, Homo sapiens
auaaacaccuggucauuuc

SEQ ID NO: 476999 - RNA, 19 nt, Homo sapiens
cacaggugcuuauuccuaa

SEQ ID NO: 477000 - RNA, 19 nt, Homo sapiens
gccagaggcugcaggaaga

SEQ ID NO: 477001 - RNA, 19 nt, Homo sapiens
ggaagggaccacccaagaa

SEQ ID NO: 477002 - RNA, 19 nt, Homo sapiens
gggcugaguguggaaauua

SEQ ID NO: 477003 - RNA, 19 nt, Homo sapiens
ccucaacccucccuaaaca

SEQ ID NO: 477004 - RNA, 19 nt, Homo sapiens
gccuguaucuggugucuga

SEQ ID NO: 477005 - RNA, 19 nt, Homo sapiens
aggaugaaaugaaguuuga

SEQ ID NO: 477006 - RNA, 19 nt, Homo sapiens
gccaccagcugccuccuuu

SEQ ID NO: 477007 - RNA, 19 nt, Homo sapiens
guaagaggagguagaguug

SEQ ID NO: 477008 - RNA, 19 nt, Homo sapiens
ggacggacacugacagaca

SEQ ID NO: 477009 - RNA, 19 nt, Homo sapiens
uauaaacaccuggucauuu

SEQ ID NO: 477010 - RNA, 19 nt, Homo sapiens
cagcuucucugguugaaag

SEQ ID NO: 477011 - RNA, 19 nt, Homo sapiens
cuucucagcuucucugguu

SEQ ID NO: 477012 - RNA, 19 nt, Homo sapiens
guagggaccaggcagguaa

SEQ ID NO: 477013 - RNA, 19 nt, Homo sapiens
gaaguuguguccaguucag

SEQ ID NO: 477014 - RNA, 19 nt, Homo sapiens
ucacaggugcuuauuccua

SEQ ID NO: 477015 - RNA, 19 nt, Homo sapiens
cacauuggccugcagagua

SEQ ID NO: 477016 - RNA, 19 nt, Homo sapiens
uuaacugaaugaccaaaga

SEQ ID NO: 477017 - RNA, 19 nt, Homo sapiens
cacacugucuggacucaaa

SEQ ID NO: 477018 - RNA, 19 nt, Homo sapiens
gagguagaguugagaaggu

SEQ ID NO: 477019 - RNA, 19 nt, Homo sapiens
cagauccaguguauuccua

SEQ ID NO: 477020 - RNA, 19 nt, Homo sapiens
gcaggaaagcaacuuaaag

SEQ ID NO: 477021 - RNA, 19 nt, Homo sapiens
gagaagcauucaccauggu

SEQ ID NO: 477022 - RNA, 19 nt, Homo sapiens
gauggauguuucugaguca

SEQ ID NO: 477023 - RNA, 19 nt, Homo sapiens
guaaggucuuucucuggaa

SEQ ID NO: 477024 - RNA, 19 nt, Homo sapiens
cgucaggccugcagcacaa

SEQ ID NO: 477025 - RNA, 19 nt, Homo sapiens
ccgugugacucuuuccaua

SEQ ID NO: 477026 - RNA, 19 nt, Homo sapiens
gaccaaagagcaacagaag

SEQ ID NO: 477027 - RNA, 19 nt, Homo sapiens
ugagugaggcaugguauaa

SEQ ID NO: 477028 - RNA, 19 nt, Homo sapiens
ugucagauccaguguauuc

SEQ ID NO: 477029 - RNA, 19 nt, Homo sapiens
gcaagcagccagggucaga

SEQ ID NO: 477030 - RNA, 19 nt, Homo sapiens
gcucacacacucucauuca

SEQ ID NO: 477031 - RNA, 19 nt, Homo sapiens
guauaaacaccuggucauu

SEQ ID NO: 477032 - RNA, 19 nt, Homo sapiens
gugacucuuuccauaugua

SEQ ID NO: 477033 - RNA, 19 nt, Homo sapiens
ugccaggacugaauaaagu

SEQ ID NO: 477034 - RNA, 19 nt, Homo sapiens
acgaggagcugcuggaagu

SEQ ID NO: 477035 - RNA, 19 nt, Homo sapiens
gcacccgugugacucuuuc

SEQ ID NO: 477036 - RNA, 19 nt, Homo sapiens
gaguagugaugggccguuu

SEQ ID NO: 477037 - RNA, 19 nt, Homo sapiens
cggauuacccggacuacaa

SEQ ID NO: 477038 - RNA, 19 nt, Homo sapiens
gaguagauuaacugaauga

SEQ ID NO: 477039 - RNA, 19 nt, Homo sapiens
gugugacucuuuccauaug

SEQ ID NO: 477040 - RNA, 19 nt, Homo sapiens
gaagaauagcaaacucauc

SEQ ID NO: 477041 - RNA, 19 nt, Homo sapiens
uagugauucuugucuuuga

SEQ ID NO: 477042 - RNA, 19 nt, Homo sapiens
gggagagaccaucgacuug

SEQ ID NO: 477043 - RNA, 19 nt, Homo sapiens
uagcaucgcagaccugguu

SEQ ID NO: 477044 - RNA, 19 nt, Homo sapiens
gaguugagaagguguggaa

SEQ ID NO: 477045 - RNA, 19 nt, Homo sapiens
ggcaggaaagcaacuuaaa

SEQ ID NO: 477046 - RNA, 19 nt, Homo sapiens
caccagcugccuccuuuaa

SEQ ID NO: 477047 - RNA, 19 nt, Homo sapiens
ggccuggaguggugggauu

SEQ ID NO: 477048 - RNA, 19 nt, Homo sapiens
ucaugugagugaagagaug

SEQ ID NO: 477049 - RNA, 19 nt, Homo sapiens
gauucaaguccgugugauu

SEQ ID NO: 477050 - RNA, 19 nt, Homo sapiens
gggccuuucuugcgcucua

SEQ ID NO: 477051 - RNA, 19 nt, Homo sapiens
caggaagacucucgcuuuu

SEQ ID NO: 477052 - RNA, 19 nt, Homo sapiens
gguccacccucaguacuca

SEQ ID NO: 477053 - RNA, 19 nt, Homo sapiens
gccugaaacucucccaagu

SEQ ID NO: 477054 - RNA, 19 nt, Homo sapiens
ccugggaaauccuuugauc

SEQ ID NO: 477055 - RNA, 19 nt, Homo sapiens
gguucugacugguguuuua

SEQ ID NO: 477056 - RNA, 19 nt, Homo sapiens
ccaaaugaaacaaguaugc

SEQ ID NO: 477057 - RNA, 19 nt, Homo sapiens
ggccaaaugaaacaaguau

SEQ ID NO: 477058 - RNA, 19 nt, Homo sapiens
agaggccgaugaacgcauu

SEQ ID NO: 477059 - RNA, 19 nt, Homo sapiens
gcagaguagauuaacugaa

SEQ ID NO: 477060 - RNA, 19 nt, Homo sapiens
caggaaagcaacuuaaagg

SEQ ID NO: 477061 - RNA, 19 nt, Homo sapiens
ggaggagucgcugggcuuu

SEQ ID NO: 477062 - RNA, 19 nt, Homo sapiens
uaacguggggauaauaaua

SEQ ID NO: 477063 - RNA, 19 nt, Homo sapiens
ugucuaggccucuauguca

SEQ ID NO: 477064 - RNA, 19 nt, Homo sapiens
gcccugugguucugcaugu

SEQ ID NO: 477065 - RNA, 19 nt, Homo sapiens
ccaucgacuuggccaguga

SEQ ID NO: 477066 - RNA, 19 nt, Homo sapiens
aaacaucuugcaacccaaa

SEQ ID NO: 477067 - RNA, 19 nt, Homo sapiens
ccuaauaaacaucuugcaa

SEQ ID NO: 477068 - RNA, 19 nt, Homo sapiens
gagugaggcaugguauaaa

SEQ ID NO: 477069 - RNA, 19 nt, Homo sapiens
acauuggccugcagaguag

SEQ ID NO: 477070 - RNA, 19 nt, Homo sapiens
ucagagacagggcuugguu

SEQ ID NO: 477071 - RNA, 19 nt, Homo sapiens
cugcaugucugugcucuuc

SEQ ID NO: 477072 - RNA, 19 nt, Homo sapiens
ugucuguggucuuggagaa

SEQ ID NO: 477073 - RNA, 19 nt, Homo sapiens
ccucuacagccuaccuaua

SEQ ID NO: 477074 - RNA, 19 nt, Homo sapiens
ugagaagguguggaagaua

SEQ ID NO: 477075 - RNA, 19 nt, Homo sapiens
ggccugcagaguagauuaa

SEQ ID NO: 477076 - RNA, 19 nt, Homo sapiens
aaccagcuguuuacauaca

SEQ ID NO: 477077 - RNA, 19 nt, Homo sapiens
caagauugggccacacugu

SEQ ID NO: 477078 - RNA, 19 nt, Homo sapiens
acgaggagccggaggaaga

SEQ ID NO: 477079 - RNA, 19 nt, Homo sapiens
caugaagaauagcaaacuc

SEQ ID NO: 477080 - RNA, 19 nt, Homo sapiens
gggagaacgcugcuguuag

SEQ ID NO: 477081 - RNA, 19 nt, Homo sapiens
gaaauaaccugcucauugu

SEQ ID NO: 477082 - RNA, 19 nt, Homo sapiens
ggaaauaaccugcucauug

SEQ ID NO: 477083 - RNA, 19 nt, Homo sapiens
gaauauaacugcagugucu

SEQ ID NO: 477084 - RNA, 19 nt, Homo sapiens
ggaaauauacuucagauuc

SEQ ID NO: 477085 - RNA, 19 nt, Homo sapiens
guuaauaccuguuggaaau

SEQ ID NO: 477086 - RNA, 19 nt, Homo sapiens
uaacugcagugucuuguuu

SEQ ID NO: 477087 - RNA, 19 nt, Homo sapiens
gaauagcuuuggaaucuug

SEQ ID NO: 477088 - RNA, 19 nt, Homo sapiens
gcacauuccagcucuauuu

SEQ ID NO: 477089 - RNA, 19 nt, Homo sapiens
ggagaacguugccuuauac

SEQ ID NO: 477090 - RNA, 19 nt, Homo sapiens
gcacucagcugcaauucuc

SEQ ID NO: 477091 - RNA, 19 nt, Homo sapiens
gcuagaaaguuuagagugu

SEQ ID NO: 477092 - RNA, 19 nt, Homo sapiens
ggcaagacguuccguaaga

SEQ ID NO: 477093 - RNA, 19 nt, Homo sapiens
gcaauucccuuuucuaaau

SEQ ID NO: 477094 - RNA, 19 nt, Homo sapiens
ugacagauuuguuauccuu

SEQ ID NO: 477095 - RNA, 19 nt, Homo sapiens
uggagaacguugccuuaua

SEQ ID NO: 477096 - RNA, 19 nt, Homo sapiens
aagaauagcuuuggaaucu

SEQ ID NO: 477097 - RNA, 19 nt, Homo sapiens
ucagacaaccuaucaauug

SEQ ID NO: 477098 - RNA, 19 nt, Homo sapiens
gcaaugaugagcauaugaa

SEQ ID NO: 477099 - RNA, 19 nt, Homo sapiens
gaacguugccuuauacucu

SEQ ID NO: 477100 - RNA, 19 nt, Homo sapiens
gcacccaccucuggagaaa

SEQ ID NO: 477101 - RNA, 19 nt, Homo sapiens
gggcgaaucuaucagacaa

SEQ ID NO: 477102 - RNA, 19 nt, Homo sapiens
ccacagcaguaauuucaau

SEQ ID NO: 477103 - RNA, 19 nt, Homo sapiens
gaguugguauucuggauga

SEQ ID NO: 477104 - RNA, 19 nt, Homo sapiens
gaaucuaucagacaaccua

SEQ ID NO: 477105 - RNA, 19 nt, Homo sapiens
cauuccagcucuauuuaaa

SEQ ID NO: 477106 - RNA, 19 nt, Homo sapiens
caaaugccaauauccagua

SEQ ID NO: 477107 - RNA, 19 nt, Homo sapiens
ggaaacuugucccuaucaa

SEQ ID NO: 477108 - RNA, 19 nt, Homo sapiens
caaagggacccgaucaaau

SEQ ID NO: 477109 - RNA, 19 nt, Homo sapiens
caauugggcugaugauguc

SEQ ID NO: 477110 - RNA, 19 nt, Homo sapiens
gaccacagcaguaauuuca

SEQ ID NO: 477111 - RNA, 19 nt, Homo sapiens
gcacgugucccaacugcaa

SEQ ID NO: 477112 - RNA, 19 nt, Homo sapiens
aaagggacccgaucaaaug

SEQ ID NO: 477113 - RNA, 19 nt, Homo sapiens
gguguucgcuauccagaau

SEQ ID NO: 477114 - RNA, 19 nt, Homo sapiens
gaaacuugucccuaucaaa

SEQ ID NO: 477115 - RNA, 19 nt, Homo sapiens
caacaaagggacccgauca

SEQ ID NO: 477116 - RNA, 19 nt, Homo sapiens
gcaagaauagcuuuggaau

SEQ ID NO: 477117 - RNA, 19 nt, Homo sapiens
gaauuaagugacagauuug

SEQ ID NO: 477118 - RNA, 19 nt, Homo sapiens
gggaacaaccugaccauca

SEQ ID NO: 477119 - RNA, 19 nt, Homo sapiens
caaaggaaauauacuucag

SEQ ID NO: 477120 - RNA, 19 nt, Homo sapiens
cuucuuccuuuccuuguua

SEQ ID NO: 477121 - RNA, 19 nt, Homo sapiens
ccaaugagacguucuaaac

SEQ ID NO: 477122 - RNA, 19 nt, Homo sapiens
gagagcagggcaagaagaa

SEQ ID NO: 477123 - RNA, 19 nt, Homo sapiens
cagcugcaauucuccgaaa

SEQ ID NO: 477124 - RNA, 19 nt, Homo sapiens
gcaagcaauucccaaacca

SEQ ID NO: 477125 - RNA, 19 nt, Homo sapiens
caacugagcgccuccuauc

SEQ ID NO: 477126 - RNA, 19 nt, Homo sapiens
gacacagcauuuaaacuca

SEQ ID NO: 477127 - RNA, 19 nt, Homo sapiens
gcucacaggcugcaaagga

SEQ ID NO: 477128 - RNA, 19 nt, Homo sapiens
gauaacagcaccugcacau

SEQ ID NO: 477129 - RNA, 19 nt, Homo sapiens
uagaaaguuuagaguguug

SEQ ID NO: 477130 - RNA, 19 nt, Homo sapiens
gaacuuguaaggccaacug

SEQ ID NO: 477131 - RNA, 19 nt, Homo sapiens
guauugaguugguauucug

SEQ ID NO: 477132 - RNA, 19 nt, Homo sapiens
gaucaaaugccaauaucca

SEQ ID NO: 477133 - RNA, 19 nt, Homo sapiens
cuagaaaguuuagaguguu

SEQ ID NO: 477134 - RNA, 19 nt, Homo sapiens
gggcaaugaugagcauaug

SEQ ID NO: 477135 - RNA, 19 nt, Homo sapiens
ggacgcgugggaacccuua

SEQ ID NO: 477136 - RNA, 19 nt, Homo sapiens
gaugccugcuuucaguuga

SEQ ID NO: 477137 - RNA, 19 nt, Homo sapiens
uuuaauugcucccuucuuc

SEQ ID NO: 477138 - RNA, 19 nt, Homo sapiens
acaauugugucuacuacau

SEQ ID NO: 477139 - RNA, 19 nt, Homo sapiens
ugacacagcauuuaaacuc

SEQ ID NO: 477140 - RNA, 19 nt, Homo sapiens
ccagaccacagcaguaauu

SEQ ID NO: 477141 - RNA, 19 nt, Homo sapiens
gggaggcccugaagaugca

SEQ ID NO: 477142 - RNA, 19 nt, Homo sapiens
cagaagcccucccagaacu

SEQ ID NO: 477143 - RNA, 19 nt, Homo sapiens
cagacaaccuaucaauugg

SEQ ID NO: 477144 - RNA, 19 nt, Homo sapiens
ggagagcagggcaagaaga

SEQ ID NO: 477145 - RNA, 19 nt, Homo sapiens
gaagcccucccagaacuuu

SEQ ID NO: 477146 - RNA, 19 nt, Homo sapiens
ggaaucuuguccuccaaag

SEQ ID NO: 477147 - RNA, 19 nt, Homo sapiens
ucaauugggcugaugaugu

SEQ ID NO: 477148 - RNA, 19 nt, Homo sapiens
acacagcauuuaaacucaa

SEQ ID NO: 477149 - RNA, 19 nt, Homo sapiens
cacauuccagcucuauuua

SEQ ID NO: 477150 - RNA, 19 nt, Homo sapiens
guauuguccuccuucugaa

SEQ ID NO: 477151 - RNA, 19 nt, Homo sapiens
agaaacccauugucugcaa

SEQ ID NO: 477152 - RNA, 19 nt, Homo sapiens
uaacacaaagaaacccauu

SEQ ID NO: 477153 - RNA, 19 nt, Homo sapiens
gcaagacguuccguaagac

SEQ ID NO: 477154 - RNA, 19 nt, Homo sapiens
ccaaaggaaauauacuuca

SEQ ID NO: 477155 - RNA, 19 nt, Homo sapiens
gcggaaacuugucccuauc

SEQ ID NO: 477156 - RNA, 19 nt, Homo sapiens
uguuggaaauggauuauca

SEQ ID NO: 477157 - RNA, 19 nt, Homo sapiens
caaguacagcccaaucuca

SEQ ID NO: 477158 - RNA, 19 nt, Homo sapiens
cagaaucccaccaugauca

SEQ ID NO: 477159 - RNA, 19 nt, Homo sapiens
gcaaugcagaccaucaaca

SEQ ID NO: 477160 - RNA, 19 nt, Homo sapiens
cagcugcagccaccucuaa

SEQ ID NO: 477161 - RNA, 19 nt, Homo sapiens
caagaaagcaaggaagaag

SEQ ID NO: 477162 - RNA, 19 nt, Homo sapiens
cgcggaaacuugucccuau

SEQ ID NO: 477163 - RNA, 19 nt, Homo sapiens
guuauucaccucccugaug

SEQ ID NO: 477164 - RNA, 19 nt, Homo sapiens
uaucagacaaccuaucaau

SEQ ID NO: 477165 - RNA, 19 nt, Homo sapiens
aaugagacguucuaaacca

SEQ ID NO: 477166 - RNA, 19 nt, Homo sapiens
uguauuguccuccuucuga

SEQ ID NO: 477167 - RNA, 19 nt, Homo sapiens
acaaagggacccgaucaaa

SEQ ID NO: 477168 - RNA, 19 nt, Homo sapiens
guaacugcuugagguaugu

SEQ ID NO: 477169 - RNA, 19 nt, Homo sapiens
uguaacugcuugagguaug

SEQ ID NO: 477170 - RNA, 19 nt, Homo sapiens
cacagcauuuaaacucaaa

SEQ ID NO: 477171 - RNA, 19 nt, Homo sapiens
guacugugugugcuuuaaa

SEQ ID NO: 477172 - RNA, 19 nt, Homo sapiens
uauggagaacguugccuua

SEQ ID NO: 477173 - RNA, 19 nt, Homo sapiens
ucacgaagaacuuguaagg

SEQ ID NO: 477174 - RNA, 19 nt, Homo sapiens
ugacagugcagaauguuuc

SEQ ID NO: 477175 - RNA, 19 nt, Homo sapiens
ccgaucaaaugccaauauc

SEQ ID NO: 477176 - RNA, 19 nt, Homo sapiens
ccaccaugaucaacaaagg

SEQ ID NO: 477177 - RNA, 19 nt, Homo sapiens
caagaauagcuuuggaauc

SEQ ID NO: 477178 - RNA, 19 nt, Homo sapiens
aaacuugucccuaucaaac

SEQ ID NO: 477179 - RNA, 19 nt, Homo sapiens
gcagugucuuguuuuguuu

SEQ ID NO: 477180 - RNA, 19 nt, Homo sapiens
ggucacgaagaacuuguaa

SEQ ID NO: 477181 - RNA, 19 nt, Homo sapiens
gaacuggacucaucuguua

SEQ ID NO: 477182 - RNA, 19 nt, Homo sapiens
gaaaugggcuggucaagug

SEQ ID NO: 477183 - RNA, 19 nt, Homo sapiens
uaacaacccuaccaauuaa

SEQ ID NO: 477184 - RNA, 19 nt, Homo sapiens
guaacaacccuaccaauua

SEQ ID NO: 477185 - RNA, 19 nt, Homo sapiens
uaucagggcuccaacuuua

SEQ ID NO: 477186 - RNA, 19 nt, Homo sapiens
gacaagcagugacacauua

SEQ ID NO: 477187 - RNA, 19 nt, Homo sapiens
ggacagcucuugccauugu

SEQ ID NO: 477188 - RNA, 19 nt, Homo sapiens
gaucaucucuccaaacaug

SEQ ID NO: 477189 - RNA, 19 nt, Homo sapiens
gcacaacucuugcucagau

SEQ ID NO: 477190 - RNA, 19 nt, Homo sapiens
caaccaacauggaagaauu

SEQ ID NO: 477191 - RNA, 19 nt, Homo sapiens
ucaaguggauuacagagua

SEQ ID NO: 477192 - RNA, 19 nt, Homo sapiens
ccagucagcuucacgcuaa

SEQ ID NO: 477193 - RNA, 19 nt, Homo sapiens
ggaaauauaucacauaacc

SEQ ID NO: 477194 - RNA, 19 nt, Homo sapiens
ugaaggaugugguaaaguu

SEQ ID NO: 477195 - RNA, 19 nt, Homo sapiens
gcaaacugauguacuggaa

SEQ ID NO: 477196 - RNA, 19 nt, Homo sapiens
guucaucucuacaggauuu

SEQ ID NO: 477197 - RNA, 19 nt, Homo sapiens
gaaggaagaggcaguaaug

SEQ ID NO: 477198 - RNA, 19 nt, Homo sapiens
caaauuagaccugguguuu

SEQ ID NO: 477199 - RNA, 19 nt, Homo sapiens
caacauggaagaauucuga

SEQ ID NO: 477200 - RNA, 19 nt, Homo sapiens
gaccuuaauuggacuuauu

SEQ ID NO: 477201 - RNA, 19 nt, Homo sapiens
uuagugagcucagcagaua

SEQ ID NO: 477202 - RNA, 19 nt, Homo sapiens
gcaagcacaucagccagua

SEQ ID NO: 477203 - RNA, 19 nt, Homo sapiens
gcaagaggcuucgaagagu

SEQ ID NO: 477204 - RNA, 19 nt, Homo sapiens
gcaaggacaagauggagua

SEQ ID NO: 477205 - RNA, 19 nt, Homo sapiens
ggaaacgcuuggcaacuug

SEQ ID NO: 477206 - RNA, 19 nt, Homo sapiens
cacgugaaguguugaauuu

SEQ ID NO: 477207 - RNA, 19 nt, Homo sapiens
ucaagcaacuggacaacaa

SEQ ID NO: 477208 - RNA, 19 nt, Homo sapiens
caaaucaauccaacuagua

SEQ ID NO: 477209 - RNA, 19 nt, Homo sapiens
gugaugagcuccagagaca

SEQ ID NO: 477210 - RNA, 19 nt, Homo sapiens
caaugggaaucaauuaguu

SEQ ID NO: 477211 - RNA, 19 nt, Homo sapiens
acagauaguuaacugauga

SEQ ID NO: 477212 - RNA, 19 nt, Homo sapiens
gaugagcuccagagacaua

SEQ ID NO: 477213 - RNA, 19 nt, Homo sapiens
gcagcagccuuuacagaau

SEQ ID NO: 477214 - RNA, 19 nt, Homo sapiens
gaauaacguuucucaacca

SEQ ID NO: 477215 - RNA, 19 nt, Homo sapiens
agacauagaagaacccaua

SEQ ID NO: 477216 - RNA, 19 nt, Homo sapiens
gcacaucuucgcuggcaua

SEQ ID NO: 477217 - RNA, 19 nt, Homo sapiens
ccaauaacuuugaauacug

SEQ ID NO: 477218 - RNA, 19 nt, Homo sapiens
gaaaacagauaguuaacug

SEQ ID NO: 477219 - RNA, 19 nt, Homo sapiens
gaaggucaacaaauucaaa

SEQ ID NO: 477220 - RNA, 19 nt, Homo sapiens
caucuucgcuggcauacug

SEQ ID NO: 477221 - RNA, 19 nt, Homo sapiens
caaaacaucucauuuacga

SEQ ID NO: 477222 - RNA, 19 nt, Homo sapiens
cuaauggaaugcagaauca

SEQ ID NO: 477223 - RNA, 19 nt, Homo sapiens
ggaauauucuugcucaaaa

SEQ ID NO: 477224 - RNA, 19 nt, Homo sapiens
caagaggcuucgaagaguu

SEQ ID NO: 477225 - RNA, 19 nt, Homo sapiens
gggcaaaucaguuggcaaa

SEQ ID NO: 477226 - RNA, 19 nt, Homo sapiens
gugaucaucucuccaaaca

SEQ ID NO: 477227 - RNA, 19 nt, Homo sapiens
aguggaaggucaacaaauu

SEQ ID NO: 477228 - RNA, 19 nt, Homo sapiens
aaagcaaacugauguacug

SEQ ID NO: 477229 - RNA, 19 nt, Homo sapiens
gcagccauuucucaagauu

SEQ ID NO: 477230 - RNA, 19 nt, Homo sapiens
caggacagcuucugggaau

SEQ ID NO: 477231 - RNA, 19 nt, Homo sapiens
ggaguucccguuacaauca

SEQ ID NO: 477232 - RNA, 19 nt, Homo sapiens
gcucauuucugcagguaau

SEQ ID NO: 477233 - RNA, 19 nt, Homo sapiens
gaaggaugugguaaaguuu

SEQ ID NO: 477234 - RNA, 19 nt, Homo sapiens
gcaacuggacaacaacaaa

SEQ ID NO: 477235 - RNA, 19 nt, Homo sapiens
uaaucaagcuauacucaca

SEQ ID NO: 477236 - RNA, 19 nt, Homo sapiens
gcaguuggaggaauugcua

SEQ ID NO: 477237 - RNA, 19 nt, Homo sapiens
caauaccacugcaguuaca

SEQ ID NO: 477238 - RNA, 19 nt, Homo sapiens
ucaaaucaauccaacuagu

SEQ ID NO: 477239 - RNA, 19 nt, Homo sapiens
gcacuuguuuacacaccuu

SEQ ID NO: 477240 - RNA, 19 nt, Homo sapiens
ugggacagcucuugccauu

SEQ ID NO: 477241 - RNA, 19 nt, Homo sapiens
gccagagaauaacaauaaa

SEQ ID NO: 477242 - RNA, 19 nt, Homo sapiens
cagaauauucagagucuuu

SEQ ID NO: 477243 - RNA, 19 nt, Homo sapiens
ggcgauggcuacagaagga

SEQ ID NO: 477244 - RNA, 19 nt, Homo sapiens
aauuagaccugguguuuca

SEQ ID NO: 477245 - RNA, 19 nt, Homo sapiens
gggcuggucaaguggauua

SEQ ID NO: 477246 - RNA, 19 nt, Homo sapiens
gaacgcaccauugaagaau

SEQ ID NO: 477247 - RNA, 19 nt, Homo sapiens
ggucaacaaauucaaauca

SEQ ID NO: 477248 - RNA, 19 nt, Homo sapiens
cagcggcgauggcuacaga

SEQ ID NO: 477249 - RNA, 19 nt, Homo sapiens
cgggagaacuggacucauc

SEQ ID NO: 477250 - RNA, 19 nt, Homo sapiens
ggaauguucuaaaagguuu

SEQ ID NO: 477251 - RNA, 19 nt, Homo sapiens
ggaagaggcaguaaugaac

SEQ ID NO: 477252 - RNA, 19 nt, Homo sapiens
ggagaaggaagaggcagua

SEQ ID NO: 477253 - RNA, 19 nt, Homo sapiens
ggacagcuucugggaauau

SEQ ID NO: 477254 - RNA, 19 nt, Homo sapiens
gaugagcgaucagaagaag

SEQ ID NO: 477255 - RNA, 19 nt, Homo sapiens
caacagcuagaacugguaa

SEQ ID NO: 477256 - RNA, 19 nt, Homo sapiens
ucaaaacgcaccagaauaa

SEQ ID NO: 477257 - RNA, 19 nt, Homo sapiens
cagcagccuuuacagaaug

SEQ ID NO: 477258 - RNA, 19 nt, Homo sapiens
gggaugagcgaucagaaga

SEQ ID NO: 477259 - RNA, 19 nt, Homo sapiens
cacgauaggugcuguuagu

SEQ ID NO: 477260 - RNA, 19 nt, Homo sapiens
caaauuugcaaguucagaa

SEQ ID NO: 477261 - RNA, 19 nt, Homo sapiens
uggaaacgcuuggcaacuu

SEQ ID NO: 477262 - RNA, 19 nt, Homo sapiens
agaaucuucccaucucuua

SEQ ID NO: 477263 - RNA, 19 nt, Homo sapiens
ucagagucuuucaaauuug

SEQ ID NO: 477264 - RNA, 19 nt, Homo sapiens
gcacaucagccaguaguuc

SEQ ID NO: 477265 - RNA, 19 nt, Homo sapiens
uguaacaacccuaccaauu

SEQ ID NO: 477266 - RNA, 19 nt, Homo sapiens
agccagagaauaacaauaa

SEQ ID NO: 477267 - RNA, 19 nt, Homo sapiens
caagugguaguguacagua

SEQ ID NO: 477268 - RNA, 19 nt, Homo sapiens
cugaggguuuguccuguua

SEQ ID NO: 477269 - RNA, 19 nt, Homo sapiens
ggaaaugggcuggucaagu

SEQ ID NO: 477270 - RNA, 19 nt, Homo sapiens
uacuauagcuccuguaacu

SEQ ID NO: 477271 - RNA, 19 nt, Homo sapiens
guacagguucagaauauuc

SEQ ID NO: 477272 - RNA, 19 nt, Homo sapiens
ucagcaggaucaaucaaau

SEQ ID NO: 477273 - RNA, 19 nt, Homo sapiens
ucaaacaccugcugcuacu

SEQ ID NO: 477274 - RNA, 19 nt, Homo sapiens
gauagugggacuuccaaug

SEQ ID NO: 477275 - RNA, 19 nt, Homo sapiens
uuacagacucuuccuggua

SEQ ID NO: 477276 - RNA, 19 nt, Homo sapiens
gggaauauucuugcucaaa

SEQ ID NO: 477277 - RNA, 19 nt, Homo sapiens
ccacuccuccugcuucaaa

SEQ ID NO: 477278 - RNA, 19 nt, Homo sapiens
cuguacagguucagaauau

SEQ ID NO: 477279 - RNA, 19 nt, Homo sapiens
ccaguacuaugccagaauc

SEQ ID NO: 477280 - RNA, 19 nt, Homo sapiens
acaguuccgguccaaauua

SEQ ID NO: 477281 - RNA, 19 nt, Homo sapiens
gcaaauaaccauugucaua

SEQ ID NO: 477282 - RNA, 19 nt, Homo sapiens
guacacaacucacuccuuu

SEQ ID NO: 477283 - RNA, 19 nt, Homo sapiens
ccaggcaucugacauaaua

SEQ ID NO: 477284 - RNA, 19 nt, Homo sapiens
caaauugccucuccaagaa

SEQ ID NO: 477285 - RNA, 19 nt, Homo sapiens
ggaagaagaugaagaggau

SEQ ID NO: 477286 - RNA, 19 nt, Homo sapiens
guaagacuguguaagauuu

SEQ ID NO: 477287 - RNA, 19 nt, Homo sapiens
ggacaaggcccauuaugaa

SEQ ID NO: 477288 - RNA, 19 nt, Homo sapiens
ugacaacccuuuagaauca

SEQ ID NO: 477289 - RNA, 19 nt, Homo sapiens
ccaagaaagugaagaagaa

SEQ ID NO: 477290 - RNA, 19 nt, Homo sapiens
ucaaagaaguguauacaga

SEQ ID NO: 477291 - RNA, 19 nt, Homo sapiens
aggcauagaucuaaaguaa

SEQ ID NO: 477292 - RNA, 19 nt, Homo sapiens
gaagugagccugugaucaa

SEQ ID NO: 477293 - RNA, 19 nt, Homo sapiens
gcaaauucauguagagaga

SEQ ID NO: 477294 - RNA, 19 nt, Homo sapiens
gaagggcacucuauauaag

SEQ ID NO: 477295 - RNA, 19 nt, Homo sapiens
gcagggauguggaauaaca

SEQ ID NO: 477296 - RNA, 19 nt, Homo sapiens
caaggaaccucaaagaagu

SEQ ID NO: 477297 - RNA, 19 nt, Homo sapiens
uaaaguaaauggucuccaa

SEQ ID NO: 477298 - RNA, 19 nt, Homo sapiens
gaacuggagaagacauuua

SEQ ID NO: 477299 - RNA, 19 nt, Homo sapiens
ccuaagggcugucagauau

SEQ ID NO: 477300 - RNA, 19 nt, Homo sapiens
gaacuggaagcuaaguaua

SEQ ID NO: 477301 - RNA, 19 nt, Homo sapiens
cuucuuccauguucuauua

SEQ ID NO: 477302 - RNA, 19 nt, Homo sapiens
ccgaaugugucuucagaua

SEQ ID NO: 477303 - RNA, 19 nt, Homo sapiens
aaaccuauaucccuccuaa

SEQ ID NO: 477304 - RNA, 19 nt, Homo sapiens
ccaggaggcugaaugaaug

SEQ ID NO: 477305 - RNA, 19 nt, Homo sapiens
gaauguauuucaccaguag

SEQ ID NO: 477306 - RNA, 19 nt, Homo sapiens
gagaaggcauagaucuaaa

SEQ ID NO: 477307 - RNA, 19 nt, Homo sapiens
ccacaaagccaaucucaau

SEQ ID NO: 477308 - RNA, 19 nt, Homo sapiens
gaaugccacucuguaauug

SEQ ID NO: 477309 - RNA, 19 nt, Homo sapiens
gaacaaggaacuggugaaa

SEQ ID NO: 477310 - RNA, 19 nt, Homo sapiens
uuaaagaagugcucagaga

SEQ ID NO: 477311 - RNA, 19 nt, Homo sapiens
acagauaaaugcaaagaga

SEQ ID NO: 477312 - RNA, 19 nt, Homo sapiens
cagaacagauaaaugcaaa

SEQ ID NO: 477313 - RNA, 19 nt, Homo sapiens
ucugaaugcuucuaaguaa

SEQ ID NO: 477314 - RNA, 19 nt, Homo sapiens
gcacagcacaaauuaguug

SEQ ID NO: 477315 - RNA, 19 nt, Homo sapiens
uaaagcagguucuuguuag

SEQ ID NO: 477316 - RNA, 19 nt, Homo sapiens
gaaggaagaggaagaagau

SEQ ID NO: 477317 - RNA, 19 nt, Homo sapiens
ucacaacaauaccuuaguu

SEQ ID NO: 477318 - RNA, 19 nt, Homo sapiens
acaaauugcuguccaagug

SEQ ID NO: 477319 - RNA, 19 nt, Homo sapiens
ccaacuaagucuugaacaa

SEQ ID NO: 477320 - RNA, 19 nt, Homo sapiens
uaagggcugucagauauaa

SEQ ID NO: 477321 - RNA, 19 nt, Homo sapiens
uuuccaaucuguccuguua

SEQ ID NO: 477322 - RNA, 19 nt, Homo sapiens
gugaagggcacucuauaua

SEQ ID NO: 477323 - RNA, 19 nt, Homo sapiens
uaccagagcccauggauuu

SEQ ID NO: 477324 - RNA, 19 nt, Homo sapiens
gaacagauaaaugcaaaga

SEQ ID NO: 477325 - RNA, 19 nt, Homo sapiens
uguaauccaugacaaauug

SEQ ID NO: 477326 - RNA, 19 nt, Homo sapiens
ugaaaguccugauggagaa

SEQ ID NO: 477327 - RNA, 19 nt, Homo sapiens
gaagugcuccugugucaug

SEQ ID NO: 477328 - RNA, 19 nt, Homo sapiens
caagcaagaacucaucaua

SEQ ID NO: 477329 - RNA, 19 nt, Homo sapiens
caaauuaauuccuguucug

SEQ ID NO: 477330 - RNA, 19 nt, Homo sapiens
uaaccaggcaucugacaua

SEQ ID NO: 477331 - RNA, 19 nt, Homo sapiens
guacaauguucuuagugaa

SEQ ID NO: 477332 - RNA, 19 nt, Homo sapiens
caagaauucccaaagauga

SEQ ID NO: 477333 - RNA, 19 nt, Homo sapiens
gaagcaaggacugaaagua

SEQ ID NO: 477334 - RNA, 19 nt, Homo sapiens
caaggcccauuaugaaaga

SEQ ID NO: 477335 - RNA, 19 nt, Homo sapiens
ugaagggcacucuauauaa

SEQ ID NO: 477336 - RNA, 19 nt, Homo sapiens
ccaaagagggagaaagaaa

SEQ ID NO: 477337 - RNA, 19 nt, Homo sapiens
gcuccugugucauguguuu

SEQ ID NO: 477338 - RNA, 19 nt, Homo sapiens
ggaagaggaagaagaugaa

SEQ ID NO: 477339 - RNA, 19 nt, Homo sapiens
gugagccugugaucaauaa

SEQ ID NO: 477340 - RNA, 19 nt, Homo sapiens
gaaacagaacagauaaaug

SEQ ID NO: 477341 - RNA, 19 nt, Homo sapiens
uggcagggauguggaauaa

SEQ ID NO: 477342 - RNA, 19 nt, Homo sapiens
gugaggagcauaagaagaa

SEQ ID NO: 477343 - RNA, 19 nt, Homo sapiens
gaagccaacaaacaaauga

SEQ ID NO: 477344 - RNA, 19 nt, Homo sapiens
gaacuguguagacaaggua

SEQ ID NO: 477345 - RNA, 19 nt, Homo sapiens
aaacaaggaaccucaaaga

SEQ ID NO: 477346 - RNA, 19 nt, Homo sapiens
gaaaagauggcaacaaaga

SEQ ID NO: 477347 - RNA, 19 nt, Homo sapiens
uuaaagcagguucuuguua

SEQ ID NO: 477348 - RNA, 19 nt, Homo sapiens
guauacagagugaggauaa

SEQ ID NO: 477349 - RNA, 19 nt, Homo sapiens
gaaaagauacaaccaguga

SEQ ID NO: 477350 - RNA, 19 nt, Homo sapiens
gaaugugucuucagauagc

SEQ ID NO: 477351 - RNA, 19 nt, Homo sapiens
ugaagaggaugaacaagag

SEQ ID NO: 477352 - RNA, 19 nt, Homo sapiens
aaaaggauauugcugcaua

SEQ ID NO: 477353 - RNA, 19 nt, Homo sapiens
gacaaggcccauuaugaaa

SEQ ID NO: 477354 - RNA, 19 nt, Homo sapiens
gcaccaggaggcugaauga

SEQ ID NO: 477355 - RNA, 19 nt, Homo sapiens
caaagaugauucgcuagga

SEQ ID NO: 477356 - RNA, 19 nt, Homo sapiens
aaacagaacagauaaaugc

SEQ ID NO: 477357 - RNA, 19 nt, Homo sapiens
ggaauaccccgauuuaauu

SEQ ID NO: 477358 - RNA, 19 nt, Homo sapiens
ucaaagccuugguaaaaua

SEQ ID NO: 477359 - RNA, 19 nt, Homo sapiens
gcuaaaggaaagccuaauu

SEQ ID NO: 477360 - RNA, 19 nt, Homo sapiens
gaaccucaaagaaguguau

SEQ ID NO: 477361 - RNA, 19 nt, Homo sapiens
guccaagaauucccaaaga

SEQ ID NO: 477362 - RNA, 19 nt, Homo sapiens
gaagcaagcauggugagaa

SEQ ID NO: 477363 - RNA, 19 nt, Homo sapiens
ugacguugaugagcccuua

SEQ ID NO: 477364 - RNA, 19 nt, Homo sapiens
aaagaugauucgcuaggaa

SEQ ID NO: 477365 - RNA, 19 nt, Homo sapiens
ugaaugccacucuguaauu

SEQ ID NO: 477366 - RNA, 19 nt, Homo sapiens
gaaagccuaauucagcaaa

SEQ ID NO: 477367 - RNA, 19 nt, Homo sapiens
gaaccaccaagcacaagaa

SEQ ID NO: 477368 - RNA, 19 nt, Homo sapiens
gcugcucuaugacauugua

SEQ ID NO: 477369 - RNA, 19 nt, Homo sapiens
gaggcugaaugaauguauu

SEQ ID NO: 477370 - RNA, 19 nt, Homo sapiens
aagaagugcuccuguguca

SEQ ID NO: 477371 - RNA, 19 nt, Homo sapiens
caauaaugacaacccuuua

SEQ ID NO: 477372 - RNA, 19 nt, Homo sapiens
uguacaauguucuuaguga

SEQ ID NO: 477373 - RNA, 19 nt, Homo sapiens
ucuauuagcuccacaaagc

SEQ ID NO: 477374 - RNA, 19 nt, Homo sapiens
guuaaccacuaccgaaugu

SEQ ID NO: 477375 - RNA, 19 nt, Homo sapiens
uaaaggaaagccuaauuca

SEQ ID NO: 477376 - RNA, 19 nt, Homo sapiens
gcauaucgagcuaaaggaa

SEQ ID NO: 477377 - RNA, 19 nt, Homo sapiens
agaaguguauacagaguga

SEQ ID NO: 477378 - RNA, 19 nt, Homo sapiens
gaaaacaauucuacuuugg

SEQ ID NO: 477379 - RNA, 19 nt, Homo sapiens
aagagacguuucagcagua

SEQ ID NO: 477380 - RNA, 19 nt, Homo sapiens
ucaauaaugacaacccuuu

SEQ ID NO: 477381 - RNA, 19 nt, Homo sapiens
gcagaaagguuuaagauga

SEQ ID NO: 477382 - RNA, 19 nt, Homo sapiens
gaagugaaauugcagauga

SEQ ID NO: 477383 - RNA, 19 nt, Homo sapiens
ggaaaucaauguguaaaug

SEQ ID NO: 477384 - RNA, 19 nt, Homo sapiens
aagaagcagugauguauua

SEQ ID NO: 477385 - RNA, 19 nt, Homo sapiens
ucaaacagcugucuucaug

SEQ ID NO: 477386 - RNA, 19 nt, Homo sapiens
uaaggaaugugccauauau

SEQ ID NO: 477387 - RNA, 19 nt, Homo sapiens
gggagaagcugucaccuau

SEQ ID NO: 477388 - RNA, 19 nt, Homo sapiens
guuagaaccuggaaacgua

SEQ ID NO: 477389 - RNA, 19 nt, Homo sapiens
gaagaacucauacauguug

SEQ ID NO: 477390 - RNA, 19 nt, Homo sapiens
gagaagcugucaccuauuc

SEQ ID NO: 477391 - RNA, 19 nt, Homo sapiens
aaacagcugucuucaugua

SEQ ID NO: 477392 - RNA, 19 nt, Homo sapiens
ggaguccucuuaaguuuga

SEQ ID NO: 477393 - RNA, 19 nt, Homo sapiens
aaacuaagccugcauuuau

SEQ ID NO: 477394 - RNA, 19 nt, Homo sapiens
uuacagaacuggaauagug

SEQ ID NO: 477395 - RNA, 19 nt, Homo sapiens
ggaaagcuuauguggauua

SEQ ID NO: 477396 - RNA, 19 nt, Homo sapiens
gaagauggcgguggagaua

SEQ ID NO: 477397 - RNA, 19 nt, Homo sapiens
uaacuagacuccuuaaucu

SEQ ID NO: 477398 - RNA, 19 nt, Homo sapiens
uaacagggcucuggaacuu

SEQ ID NO: 477399 - RNA, 19 nt, Homo sapiens
gaaggaauuucaaucucaa

SEQ ID NO: 477400 - RNA, 19 nt, Homo sapiens
caaagauuauccaucauug

SEQ ID NO: 477401 - RNA, 19 nt, Homo sapiens
caccaaagauuauccauca

SEQ ID NO: 477402 - RNA, 19 nt, Homo sapiens
guaaaguacuagauguuga

SEQ ID NO: 477403 - RNA, 19 nt, Homo sapiens
caaucgagcucaagcagaa

SEQ ID NO: 477404 - RNA, 19 nt, Homo sapiens
ccacuguaguugccuauaa

SEQ ID NO: 477405 - RNA, 19 nt, Homo sapiens
aagaugauguugacacuaa

SEQ ID NO: 477406 - RNA, 19 nt, Homo sapiens
gaguaaagcagaaagguuu

SEQ ID NO: 477407 - RNA, 19 nt, Homo sapiens
gaaggaaaucaauguguaa

SEQ ID NO: 477408 - RNA, 19 nt, Homo sapiens
agaaggaaaucaaugugua

SEQ ID NO: 477409 - RNA, 19 nt, Homo sapiens
uaaaagaguugcauggaua

SEQ ID NO: 477410 - RNA, 19 nt, Homo sapiens
uaaauacagcgaaugcuua

SEQ ID NO: 477411 - RNA, 19 nt, Homo sapiens
caaauagagcagcauguua

SEQ ID NO: 477412 - RNA, 19 nt, Homo sapiens
gcagaaaucaaauuacaga

SEQ ID NO: 477413 - RNA, 19 nt, Homo sapiens
ggaaaaggaugguuauuca

SEQ ID NO: 477414 - RNA, 19 nt, Homo sapiens
ugucagagguugaaagaga

SEQ ID NO: 477415 - RNA, 19 nt, Homo sapiens
uaaagacgcccucaguaaa

SEQ ID NO: 477416 - RNA, 19 nt, Homo sapiens
ggaagaaggaaaucaaugu

SEQ ID NO: 477417 - RNA, 19 nt, Homo sapiens
uaucagcgcuucccacugu

SEQ ID NO: 477418 - RNA, 19 nt, Homo sapiens
caaacuaagccugcauuua

SEQ ID NO: 477419 - RNA, 19 nt, Homo sapiens
cggaagcauugccuaauaa

SEQ ID NO: 477420 - RNA, 19 nt, Homo sapiens
ucaugaaacugagacauuu

SEQ ID NO: 477421 - RNA, 19 nt, Homo sapiens
cauaaaggacucaagaauu

SEQ ID NO: 477422 - RNA, 19 nt, Homo sapiens
gaaggaaaauugagauuca

SEQ ID NO: 477423 - RNA, 19 nt, Homo sapiens
cuacagaagauuugaguaa

SEQ ID NO: 477424 - RNA, 19 nt, Homo sapiens
gaagcagugauguauuaua

SEQ ID NO: 477425 - RNA, 19 nt, Homo sapiens
gaagauauacaggcccuaa

SEQ ID NO: 477426 - RNA, 19 nt, Homo sapiens
gaacgugaaagccuucuau

SEQ ID NO: 477427 - RNA, 19 nt, Homo sapiens
gaagaagcagugauguauu

SEQ ID NO: 477428 - RNA, 19 nt, Homo sapiens
cagaaaagcuuaauugauc

SEQ ID NO: 477429 - RNA, 19 nt, Homo sapiens
agcgaaugcuuaaagauua

SEQ ID NO: 477430 - RNA, 19 nt, Homo sapiens
cagcaggucuaacugagaa

SEQ ID NO: 477431 - RNA, 19 nt, Homo sapiens
uaccagaaccaaauaagua

SEQ ID NO: 477432 - RNA, 19 nt, Homo sapiens
gaauguuaaugagauggua

SEQ ID NO: 477433 - RNA, 19 nt, Homo sapiens
guaacuagacuccuuaauc

SEQ ID NO: 477434 - RNA, 19 nt, Homo sapiens
gcuaugaccaccaaagauu

SEQ ID NO: 477435 - RNA, 19 nt, Homo sapiens
ggagcuggauggaccaaau

SEQ ID NO: 477436 - RNA, 19 nt, Homo sapiens
gaguuaaguugcauuucuu

SEQ ID NO: 477437 - RNA, 19 nt, Homo sapiens
ccaggaauguuaaugagau

SEQ ID NO: 477438 - RNA, 19 nt, Homo sapiens
caaguauuauugaggcaaa

SEQ ID NO: 477439 - RNA, 19 nt, Homo sapiens
gaaagcuuauguggauuau

SEQ ID NO: 477440 - RNA, 19 nt, Homo sapiens
ugggaaagcuuauguggau

SEQ ID NO: 477441 - RNA, 19 nt, Homo sapiens
gaacuucauccauucucua

SEQ ID NO: 477442 - RNA, 19 nt, Homo sapiens
gggaggaugccguuucuuu

SEQ ID NO: 477443 - RNA, 19 nt, Homo sapiens
gauaaaacuuggccuagaa

SEQ ID NO: 477444 - RNA, 19 nt, Homo sapiens
gauaagacagcaccauuca

SEQ ID NO: 477445 - RNA, 19 nt, Homo sapiens
gaaugugccauauauacaa

SEQ ID NO: 477446 - RNA, 19 nt, Homo sapiens
guuaacaggcuaucaagaa

SEQ ID NO: 477447 - RNA, 19 nt, Homo sapiens
ccauugaacaucuagauuu

SEQ ID NO: 477448 - RNA, 19 nt, Homo sapiens
gauaaugauuuggccaaga

SEQ ID NO: 477449 - RNA, 19 nt, Homo sapiens
gaacucauacauguugaaa

SEQ ID NO: 477450 - RNA, 19 nt, Homo sapiens
ccaaagauuauccaucauu

SEQ ID NO: 477451 - RNA, 19 nt, Homo sapiens
cagaaagguuuaagaugau

SEQ ID NO: 477452 - RNA, 19 nt, Homo sapiens
cgugaaagccuucuauaga

SEQ ID NO: 477453 - RNA, 19 nt, Homo sapiens
caauaaggaaugugccaua

SEQ ID NO: 477454 - RNA, 19 nt, Homo sapiens
gcaaaugacaguguuaaca

SEQ ID NO: 477455 - RNA, 19 nt, Homo sapiens
guaguugccuauaacaauc

SEQ ID NO: 477456 - RNA, 19 nt, Homo sapiens
ggaaugggauaaauuugac

SEQ ID NO: 477457 - RNA, 19 nt, Homo sapiens
gaagcauugccuaauaauu

SEQ ID NO: 477458 - RNA, 19 nt, Homo sapiens
acggaagcauugccuaaua

SEQ ID NO: 477459 - RNA, 19 nt, Homo sapiens
acacugaagucuauaacau

SEQ ID NO: 477460 - RNA, 19 nt, Homo sapiens
cugcuaagauacacauaaa

SEQ ID NO: 477461 - RNA, 19 nt, Homo sapiens
aagcaaagcaggacuguga

SEQ ID NO: 477462 - RNA, 19 nt, Homo sapiens
aacaggcuaucaagaauuu

SEQ ID NO: 477463 - RNA, 19 nt, Homo sapiens
gaacuggaauagugcuuuu

SEQ ID NO: 477464 - RNA, 19 nt, Homo sapiens
caacucaggagauuaugaa

SEQ ID NO: 477465 - RNA, 19 nt, Homo sapiens
gcuaagauacacauaaauc

SEQ ID NO: 477466 - RNA, 19 nt, Homo sapiens
ccucuuaaguuugauagaa

SEQ ID NO: 477467 - RNA, 19 nt, Homo sapiens
acuagacuccuuaaucuua

SEQ ID NO: 477468 - RNA, 19 nt, Homo sapiens
guaaauacagcgaaugcuu

SEQ ID NO: 477469 - RNA, 19 nt, Homo sapiens
aacuaagccugcauuuaua

SEQ ID NO: 477470 - RNA, 19 nt, Homo sapiens
gcaacacugaagucuauaa

SEQ ID NO: 477471 - RNA, 19 nt, Homo sapiens
cagcgaaugcuuaaagauu

SEQ ID NO: 477472 - RNA, 19 nt, Homo sapiens
gaagaaggaaaucaaugug

SEQ ID NO: 477473 - RNA, 19 nt, Homo sapiens
gcuagcaaaugacaguguu

SEQ ID NO: 477474 - RNA, 19 nt, Homo sapiens
auaaugauuuggccaagaa

SEQ ID NO: 477475 - RNA, 19 nt, Homo sapiens
cucaggagauuaugaagaa

SEQ ID NO: 477476 - RNA, 19 nt, Homo sapiens
gauauaaagaguuggguau

SEQ ID NO: 477477 - RNA, 19 nt, Homo sapiens
gcucauaaaggacucaaga

SEQ ID NO: 477478 - RNA, 19 nt, Homo sapiens
auaaagacgcccucaguaa

SEQ ID NO: 477479 - RNA, 19 nt, Homo sapiens
gggaagcuacagaagauuu

SEQ ID NO: 477480 - RNA, 19 nt, Homo sapiens
gcauuucuuugggcuauga

SEQ ID NO: 477481 - RNA, 19 nt, Homo sapiens
gcagaaagguuuaagauga

SEQ ID NO: 477482 - RNA, 19 nt, Homo sapiens
gaagugaaauugcagauga

SEQ ID NO: 477483 - RNA, 19 nt, Homo sapiens
ggaaaucaauguguaaaug

SEQ ID NO: 477484 - RNA, 19 nt, Homo sapiens
aagaagcagugauguauua

SEQ ID NO: 477485 - RNA, 19 nt, Homo sapiens
ucaaacagcugucuucaug

SEQ ID NO: 477486 - RNA, 19 nt, Homo sapiens
uaaggaaugugccauauau

SEQ ID NO: 477487 - RNA, 19 nt, Homo sapiens
gggagaagcugucaccuau

SEQ ID NO: 477488 - RNA, 19 nt, Homo sapiens
guuagaaccuggaaacgua

SEQ ID NO: 477489 - RNA, 19 nt, Homo sapiens
gaagaacucauacauguug

SEQ ID NO: 477490 - RNA, 19 nt, Homo sapiens
gagaagcugucaccuauuc

SEQ ID NO: 477491 - RNA, 19 nt, Homo sapiens
aaacagcugucuucaugua

SEQ ID NO: 477492 - RNA, 19 nt, Homo sapiens
ggaguccucuuaaguuuga

SEQ ID NO: 477493 - RNA, 19 nt, Homo sapiens
aaacuaagccugcauuuau

SEQ ID NO: 477494 - RNA, 19 nt, Homo sapiens
uuacagaacuggaauagug

SEQ ID NO: 477495 - RNA, 19 nt, Homo sapiens
ggaaagcuuauguggauua

SEQ ID NO: 477496 - RNA, 19 nt, Homo sapiens
gaagauggcgguggagaua

SEQ ID NO: 477497 - RNA, 19 nt, Homo sapiens
uaacuagacuccuuaaucu

SEQ ID NO: 477498 - RNA, 19 nt, Homo sapiens
uaacagggcucuggaacuu

SEQ ID NO: 477499 - RNA, 19 nt, Homo sapiens
gaaggaauuucaaucucaa

SEQ ID NO: 477500 - RNA, 19 nt, Homo sapiens
caccaaagauuauccauca

SEQ ID NO: 477501 - RNA, 19 nt, Homo sapiens
caaagauuauccaucauug

SEQ ID NO: 477502 - RNA, 19 nt, Homo sapiens
guaaaguacuagauguuga

SEQ ID NO: 477503 - RNA, 19 nt, Homo sapiens
caaucgagcucaagcagaa

SEQ ID NO: 477504 - RNA, 19 nt, Homo sapiens
ccacuguaguugccuauaa

SEQ ID NO: 477505 - RNA, 19 nt, Homo sapiens
aagaugauguugacacuaa

SEQ ID NO: 477506 - RNA, 19 nt, Homo sapiens
gaguaaagcagaaagguuu

SEQ ID NO: 477507 - RNA, 19 nt, Homo sapiens
gaaggaaaucaauguguaa

SEQ ID NO: 477508 - RNA, 19 nt, Homo sapiens
agaaggaaaucaaugugua

SEQ ID NO: 477509 - RNA, 19 nt, Homo sapiens
uaaaagaguugcauggaua

SEQ ID NO: 477510 - RNA, 19 nt, Homo sapiens
uaaauacagcgaaugcuua

SEQ ID NO: 477511 - RNA, 19 nt, Homo sapiens
caaauagagcagcauguua

SEQ ID NO: 477512 - RNA, 19 nt, Homo sapiens
gcagaaaucaaauuacaga

SEQ ID NO: 477513 - RNA, 19 nt, Homo sapiens
ggaaaaggaugguuauuca

SEQ ID NO: 477514 - RNA, 19 nt, Homo sapiens
ugucagagguugaaagaga

SEQ ID NO: 477515 - RNA, 19 nt, Homo sapiens
uaaagacgcccucaguaaa

SEQ ID NO: 477516 - RNA, 19 nt, Homo sapiens
ggaagaaggaaaucaaugu

SEQ ID NO: 477517 - RNA, 19 nt, Homo sapiens
uaucagcgcuucccacugu

SEQ ID NO: 477518 - RNA, 19 nt, Homo sapiens
caaacuaagccugcauuua

SEQ ID NO: 477519 - RNA, 19 nt, Homo sapiens
cggaagcauugccuaauaa

SEQ ID NO: 477520 - RNA, 19 nt, Homo sapiens
ucaugaaacugagacauuu

SEQ ID NO: 477521 - RNA, 19 nt, Homo sapiens
cauaaaggacucaagaauu

SEQ ID NO: 477522 - RNA, 19 nt, Homo sapiens
gaaggaaaauugagauuca

SEQ ID NO: 477523 - RNA, 19 nt, Homo sapiens
cuacagaagauuugaguaa

SEQ ID NO: 477524 - RNA, 19 nt, Homo sapiens
gaagcagugauguauuaua

SEQ ID NO: 477525 - RNA, 19 nt, Homo sapiens
gaagauauacaggcccuaa

SEQ ID NO: 477526 - RNA, 19 nt, Homo sapiens
gaacgugaaagccuucuau

SEQ ID NO: 477527 - RNA, 19 nt, Homo sapiens
gaagaagcagugauguauu

SEQ ID NO: 477528 - RNA, 19 nt, Homo sapiens
cagaaaagcuuaauugauc

SEQ ID NO: 477529 - RNA, 19 nt, Homo sapiens
agcgaaugcuuaaagauua

SEQ ID NO: 477530 - RNA, 19 nt, Homo sapiens
gcacuaugaccaccaaaga

SEQ ID NO: 477531 - RNA, 19 nt, Homo sapiens
cagcaggucuaacugagaa

SEQ ID NO: 477532 - RNA, 19 nt, Homo sapiens
uaccagaaccaaauaagua

SEQ ID NO: 477533 - RNA, 19 nt, Homo sapiens
gaauguuaaugagauggua

SEQ ID NO: 477534 - RNA, 19 nt, Homo sapiens
guaacuagacuccuuaauc

SEQ ID NO: 477535 - RNA, 19 nt, Homo sapiens
gcgcugagaagcacuauga

SEQ ID NO: 477536 - RNA, 19 nt, Homo sapiens
ggagcuggauggaccaaau

SEQ ID NO: 477537 - RNA, 19 nt, Homo sapiens
gaagcacuaugaccaccaa

SEQ ID NO: 477538 - RNA, 19 nt, Homo sapiens
gaguuaaguugcauuucuu

SEQ ID NO: 477539 - RNA, 19 nt, Homo sapiens
ccaggaauguuaaugagau

SEQ ID NO: 477540 - RNA, 19 nt, Homo sapiens
caaguauuauugaggcaaa

SEQ ID NO: 477541 - RNA, 19 nt, Homo sapiens
gaaagcuuauguggauuau

SEQ ID NO: 477542 - RNA, 19 nt, Homo sapiens
ugggaaagcuuauguggau

SEQ ID NO: 477543 - RNA, 19 nt, Homo sapiens
gaacuucauccauucucua

SEQ ID NO: 477544 - RNA, 19 nt, Homo sapiens
gauaaaacuuggccuagaa

SEQ ID NO: 477545 - RNA, 19 nt, Homo sapiens
gauaagacagcaccauuca

SEQ ID NO: 477546 - RNA, 19 nt, Homo sapiens
gaaugugccauauauacaa

SEQ ID NO: 477547 - RNA, 19 nt, Homo sapiens
guuaacaggcuaucaagaa

SEQ ID NO: 477548 - RNA, 19 nt, Homo sapiens
gauaaugauuuggccaaga

SEQ ID NO: 477549 - RNA, 19 nt, Homo sapiens
ccauugaacaucuagauuu

SEQ ID NO: 477550 - RNA, 19 nt, Homo sapiens
ccaaagauuauccaucauu

SEQ ID NO: 477551 - RNA, 19 nt, Homo sapiens
gaacucauacauguugaaa

SEQ ID NO: 477552 - RNA, 19 nt, Homo sapiens
cagaaagguuuaagaugau

SEQ ID NO: 477553 - RNA, 19 nt, Homo sapiens
cgugaaagccuucuauaga

SEQ ID NO: 477554 - RNA, 19 nt, Homo sapiens
caauaaggaaugugccaua

SEQ ID NO: 477555 - RNA, 19 nt, Homo sapiens
gcaaaugacaguguuaaca

SEQ ID NO: 477556 - RNA, 19 nt, Homo sapiens
guaguugccuauaacaauc

SEQ ID NO: 477557 - RNA, 19 nt, Homo sapiens
ggaaugggauaaauuugac

SEQ ID NO: 477558 - RNA, 19 nt, Homo sapiens
gaagcauugccuaauaauu

SEQ ID NO: 477559 - RNA, 19 nt, Homo sapiens
acggaagcauugccuaaua

SEQ ID NO: 477560 - RNA, 19 nt, Homo sapiens
acacugaagucuauaacau

SEQ ID NO: 477561 - RNA, 19 nt, Homo sapiens
cugcuaagauacacauaaa

SEQ ID NO: 477562 - RNA, 19 nt, Homo sapiens
aagcaaagcaggacuguga

SEQ ID NO: 477563 - RNA, 19 nt, Homo sapiens
aacaggcuaucaagaauuu

SEQ ID NO: 477564 - RNA, 19 nt, Homo sapiens
gaacuggaauagugcuuuu

SEQ ID NO: 477565 - RNA, 19 nt, Homo sapiens
caacucaggagauuaugaa

SEQ ID NO: 477566 - RNA, 19 nt, Homo sapiens
gcuaagauacacauaaauc

SEQ ID NO: 477567 - RNA, 19 nt, Homo sapiens
ccucuuaaguuugauagaa

SEQ ID NO: 477568 - RNA, 19 nt, Homo sapiens
acuagacuccuuaaucuua

SEQ ID NO: 477569 - RNA, 19 nt, Homo sapiens
guaaauacagcgaaugcuu

SEQ ID NO: 477570 - RNA, 19 nt, Homo sapiens
aacuaagccugcauuuaua

SEQ ID NO: 477571 - RNA, 19 nt, Homo sapiens
gauauaaagaguuggguau

SEQ ID NO: 477572 - RNA, 19 nt, Homo sapiens
gcaacacugaagucuauaa

SEQ ID NO: 477573 - RNA, 19 nt, Homo sapiens
cagcgaaugcuuaaagauu

SEQ ID NO: 477574 - RNA, 19 nt, Homo sapiens
gaagaaggaaaucaaugug

SEQ ID NO: 477575 - RNA, 19 nt, Homo sapiens
gcuagcaaaugacaguguu

SEQ ID NO: 477576 - RNA, 19 nt, Homo sapiens
auaaugauuuggccaagaa

SEQ ID NO: 477577 - RNA, 19 nt, Homo sapiens
cucaggagauuaugaagaa

SEQ ID NO: 477578 - RNA, 19 nt, Homo sapiens
gcucauaaaggacucaaga

SEQ ID NO: 477579 - RNA, 19 nt, Homo sapiens
auaaagacgcccucaguaa

SEQ ID NO: 477580 - RNA, 19 nt, Homo sapiens
gggaagcuacagaagauuu

SEQ ID NO: 477581 - RNA, 19 nt, Homo sapiens
cuacaaagcuuggcuauua

SEQ ID NO: 477582 - RNA, 19 nt, Homo sapiens
gaacauuaaugaccucaaa

SEQ ID NO: 477583 - RNA, 19 nt, Homo sapiens
gagcaaaggugguagagaa

SEQ ID NO: 477584 - RNA, 19 nt, Homo sapiens
cgagaaagguuuacaggua

SEQ ID NO: 477585 - RNA, 19 nt, Homo sapiens
gagaaggauuagaaaguua

SEQ ID NO: 477586 - RNA, 19 nt, Homo sapiens
gcacaaguacuuugguuua

SEQ ID NO: 477587 - RNA, 19 nt, Homo sapiens
ugugaaaucucuccucuua

SEQ ID NO: 477588 - RNA, 19 nt, Homo sapiens
ggagaaggauuagaaaguu

SEQ ID NO: 477589 - RNA, 19 nt, Homo sapiens
gagauguugucaauguuua

SEQ ID NO: 477590 - RNA, 19 nt, Homo sapiens
gaagauuccuuauguggau

SEQ ID NO: 477591 - RNA, 19 nt, Homo sapiens
gaagagaagaacaaaguuu

SEQ ID NO: 477592 - RNA, 19 nt, Homo sapiens
caaaggaguucuucaccaa

SEQ ID NO: 477593 - RNA, 19 nt, Homo sapiens
ugaagaagcccaacaggua

SEQ ID NO: 477594 - RNA, 19 nt, Homo sapiens
gaauguggaugcacgaaug

SEQ ID NO: 477595 - RNA, 19 nt, Homo sapiens
ugagagauguugucaaugu

SEQ ID NO: 477596 - RNA, 19 nt, Homo sapiens
gaacauugccaaccauuuc

SEQ ID NO: 477597 - RNA, 19 nt, Homo sapiens
gguagaauauagugagauu

SEQ ID NO: 477598 - RNA, 19 nt, Homo sapiens
ugaaaucucuccucuuauc

SEQ ID NO: 477599 - RNA, 19 nt, Homo sapiens
agacaaacccaauggaaua

SEQ ID NO: 477600 - RNA, 19 nt, Homo sapiens
gcagaacaauggaaucuac

SEQ ID NO: 477601 - RNA, 19 nt, Homo sapiens
caacaucaguuuacuugca

SEQ ID NO: 477602 - RNA, 19 nt, Homo sapiens
gaaggaugccaaugaugua

SEQ ID NO: 477603 - RNA, 19 nt, Homo sapiens
ggcaacaaaugcauuauuc

SEQ ID NO: 477604 - RNA, 19 nt, Homo sapiens
gaacaauggaaucuacaaa

SEQ ID NO: 477605 - RNA, 19 nt, Homo sapiens
uaaaguagcaguucuucuu

SEQ ID NO: 477606 - RNA, 19 nt, Homo sapiens
gagcauucaugucuauugu

SEQ ID NO: 477607 - RNA, 19 nt, Homo sapiens
gcagugaaauaaauguauc

SEQ ID NO: 477608 - RNA, 19 nt, Homo sapiens
gaaaauaauugggcaguga

SEQ ID NO: 477609 - RNA, 19 nt, Homo sapiens
gcacuugcagcccagaaua

SEQ ID NO: 477610 - RNA, 19 nt, Homo sapiens
uaaccagucuucuuaccaa

SEQ ID NO: 477611 - RNA, 19 nt, Homo sapiens
gaaauuucguacagcugaa

SEQ ID NO: 477612 - RNA, 19 nt, Homo sapiens
ugaaccagauaccaaguuu

SEQ ID NO: 477613 - RNA, 19 nt, Homo sapiens
uaaagaaugcugauaguca

SEQ ID NO: 477614 - RNA, 19 nt, Homo sapiens
gcauucaugucuauugugu

SEQ ID NO: 477615 - RNA, 19 nt, Homo sapiens
gauguaugauguugguuug

SEQ ID NO: 477616 - RNA, 19 nt, Homo sapiens
caagagcaccuacuacguu

SEQ ID NO: 477617 - RNA, 19 nt, Homo sapiens
guaccaauccaaugugaaa

SEQ ID NO: 477618 - RNA, 19 nt, Homo sapiens
ugugguauaugaaguauug

SEQ ID NO: 477619 - RNA, 19 nt, Homo sapiens
cccaacagguagaacuuua

SEQ ID NO: 477620 - RNA, 19 nt, Homo sapiens
uuaaauauccacaggguuu

SEQ ID NO: 477621 - RNA, 19 nt, Homo sapiens
agaaguuugugguauauga

SEQ ID NO: 477622 - RNA, 19 nt, Homo sapiens
gagagauguugucaauguu

SEQ ID NO: 477623 - RNA, 19 nt, Homo sapiens
gcuauuagagcauuaugaa

SEQ ID NO: 477624 - RNA, 19 nt, Homo sapiens
uuucuucacuguaccauuu

SEQ ID NO: 477625 - RNA, 19 nt, Homo sapiens
ucugagagauguugucaau

SEQ ID NO: 477626 - RNA, 19 nt, Homo sapiens
gaauaaaguagcaguucuu

SEQ ID NO: 477627 - RNA, 19 nt, Homo sapiens
cacaaguacuuugguuuaa

SEQ ID NO: 477628 - RNA, 19 nt, Homo sapiens
gaaggacuuuuccagauuu

SEQ ID NO: 477629 - RNA, 19 nt, Homo sapiens
ucguacagcugaaauauag

SEQ ID NO: 477630 - RNA, 19 nt, Homo sapiens
ggacgacugcuguucaaug

SEQ ID NO: 477631 - RNA, 19 nt, Homo sapiens
ggauguaugauguugguuu

SEQ ID NO: 477632 - RNA, 19 nt, Homo sapiens
cuacuacguuucuggaaug

SEQ ID NO: 477633 - RNA, 19 nt, Homo sapiens
ggauacccaaggacaguua

SEQ ID NO: 477634 - RNA, 19 nt, Homo sapiens
uaauugggcagugaaauaa

SEQ ID NO: 477635 - RNA, 19 nt, Homo sapiens
uuagagcuauugcaaacuu

SEQ ID NO: 477636 - RNA, 19 nt, Homo sapiens
ccaauggaauaaagaugga

SEQ ID NO: 477637 - RNA, 19 nt, Homo sapiens
caaacccaauggaauaaag

SEQ ID NO: 477638 - RNA, 19 nt, Homo sapiens
ggaacauugccaaccauuu

SEQ ID NO: 477639 - RNA, 19 nt, Homo sapiens
ggaagagaagaacaaaguu

SEQ ID NO: 477640 - RNA, 19 nt, Homo sapiens
guuuacagguacauacauu

SEQ ID NO: 477641 - RNA, 19 nt, Homo sapiens
caaggacaguuaauuaagc

SEQ ID NO: 477642 - RNA, 19 nt, Homo sapiens
uugaggagcugaacuucuu

SEQ ID NO: 477643 - RNA, 19 nt, Homo sapiens
auaauugggcagugaaaua

SEQ ID NO: 477644 - RNA, 19 nt, Homo sapiens
aaacucacguuguccaaag

SEQ ID NO: 477645 - RNA, 19 nt, Homo sapiens
gaccaacugugaaccuaca

SEQ ID NO: 477646 - RNA, 19 nt, Homo sapiens
gacaaacccaauggaauaa

SEQ ID NO: 477647 - RNA, 19 nt, Homo sapiens
aaagaagauuccuuaugug

SEQ ID NO: 477648 - RNA, 19 nt, Homo sapiens
aagagcaccuacuacguuu

SEQ ID NO: 477649 - RNA, 19 nt, Homo sapiens
ugaaauauaggcaggaugu

SEQ ID NO: 477650 - RNA, 19 nt, Homo sapiens
agaauuccaugcaccucua

SEQ ID NO: 477651 - RNA, 19 nt, Homo sapiens
gcagacccacgguucauug

SEQ ID NO: 477652 - RNA, 19 nt, Homo sapiens
ucaccaagcacaaguacuu

SEQ ID NO: 477653 - RNA, 19 nt, Homo sapiens
ccaugcaccucuaaucauc

SEQ ID NO: 477654 - RNA, 19 nt, Homo sapiens
gaaguuugugguauaugaa

SEQ ID NO: 477655 - RNA, 19 nt, Homo sapiens
gaaaguuauguggcagaua

SEQ ID NO: 477656 - RNA, 19 nt, Homo sapiens
ugaaggaugccaaugaugu

SEQ ID NO: 477657 - RNA, 19 nt, Homo sapiens
gcuugaaggaugccaauga

SEQ ID NO: 477658 - RNA, 19 nt, Homo sapiens
guccaaagcugggcaagag

SEQ ID NO: 477659 - RNA, 19 nt, Homo sapiens
ggagcauucaugucuauug

SEQ ID NO: 477660 - RNA, 19 nt, Homo sapiens
caacaaaugcauuauucca

SEQ ID NO: 477661 - RNA, 19 nt, Homo sapiens
caacagguagaacuuuaug

SEQ ID NO: 477662 - RNA, 19 nt, Homo sapiens
ucucuccucuuaucuccua

SEQ ID NO: 477663 - RNA, 19 nt, Homo sapiens
cggaugaggguauauauuc

SEQ ID NO: 477664 - RNA, 19 nt, Homo sapiens
acccaaggacaguuaauua

SEQ ID NO: 477665 - RNA, 19 nt, Homo sapiens
auucaugucuauuguguug

SEQ ID NO: 477666 - RNA, 19 nt, Homo sapiens
acaauggaaucuacaaagg

SEQ ID NO: 477667 - RNA, 19 nt, Homo sapiens
gguuugccaucccguaaga

SEQ ID NO: 477668 - RNA, 19 nt, Homo sapiens
gcucucgccuuccagcaau

SEQ ID NO: 477669 - RNA, 19 nt, Homo sapiens
ccagacaaacccaauggaa

SEQ ID NO: 477670 - RNA, 19 nt, Homo sapiens
cccaaggacaguuaauuaa

SEQ ID NO: 477671 - RNA, 19 nt, Homo sapiens
ggagcagacuguggagcaa

SEQ ID NO: 477672 - RNA, 19 nt, Homo sapiens
aagcagagcguauccugaa

SEQ ID NO: 477673 - RNA, 19 nt, Homo sapiens
gcagagcuccaggccauga

SEQ ID NO: 477674 - RNA, 19 nt, Homo sapiens
aaagguuucuaugguacua

SEQ ID NO: 477675 - RNA, 19 nt, Homo sapiens
caacugugaaccuacaaga

SEQ ID NO: 477676 - RNA, 19 nt, Homo sapiens
ccaaugauguaccaaucca

SEQ ID NO: 477677 - RNA, 19 nt, Homo sapiens
ccacuaaagaaugcugaua

SEQ ID NO: 477678 - RNA, 19 nt, Homo sapiens
uuugacaucuuccaguuug

SEQ ID NO: 477679 - RNA, 19 nt, Homo sapiens
ccaaccauuucuucacugu

SEQ ID NO: 477680 - RNA, 19 nt, Homo sapiens
ucagaaaggagcagacugu

SEQ ID NO: 477681 - RNA, 19 nt, Homo sapiens
gaaauucaccuucgauguu

SEQ ID NO: 477682 - RNA, 19 nt, Homo sapiens
cagaagacaucccacgauu

SEQ ID NO: 477683 - RNA, 19 nt, Homo sapiens
gugaagauccagauucuaa

SEQ ID NO: 477684 - RNA, 19 nt, Homo sapiens
gaaugaaccuaaggagaug

SEQ ID NO: 477685 - RNA, 19 nt, Homo sapiens
gaagacaucccacgauuac

SEQ ID NO: 477686 - RNA, 19 nt, Homo sapiens
acaaggagguguccacugu

SEQ ID NO: 477687 - RNA, 19 nt, Homo sapiens
caccuucgauguugagaaa

SEQ ID NO: 477688 - RNA, 19 nt, Homo sapiens
caggaacacugccuacuuc

SEQ ID NO: 477689 - RNA, 19 nt, Homo sapiens
ccauuaaacaugcugauuu

SEQ ID NO: 477690 - RNA, 19 nt, Homo sapiens
cuaaggagaugcugacucu

SEQ ID NO: 477691 - RNA, 19 nt, Homo sapiens
gggcugagcguguuguuau

SEQ ID NO: 477692 - RNA, 19 nt, Homo sapiens
ggaaauucaccuucgaugu

SEQ ID NO: 477693 - RNA, 19 nt, Homo sapiens
gcaagcacacgcccaacuu

SEQ ID NO: 477694 - RNA, 19 nt, Homo sapiens
aaauucaccuucgauguug

SEQ ID NO: 477695 - RNA, 19 nt, Homo sapiens
agaagacaucccacgauua

SEQ ID NO: 477696 - RNA, 19 nt, Homo sapiens
ggaaccacaugggcaggaa

SEQ ID NO: 477697 - RNA, 19 nt, Homo sapiens
ucuuuggccuccagguuua

SEQ ID NO: 477698 - RNA, 19 nt, Homo sapiens
cgacaucacucugcagcau

SEQ ID NO: 477699 - RNA, 19 nt, Homo sapiens
gcagaagacaucccacgau

SEQ ID NO: 477700 - RNA, 19 nt, Homo sapiens
aaggagaugcugacucuaa

SEQ ID NO: 477701 - RNA, 19 nt, Homo sapiens
agaaugaaccuaaggagau

SEQ ID NO: 477702 - RNA, 19 nt, Homo sapiens
uggaaucgcuucagcuucu

SEQ ID NO: 477703 - RNA, 19 nt, Homo sapiens
caagcacacgcccaacuuu

SEQ ID NO: 477704 - RNA, 19 nt, Homo sapiens
ggucuccaguagucucuga

SEQ ID NO: 477705 - RNA, 19 nt, Homo sapiens
gagaugcugacucuaagug

SEQ ID NO: 477706 - RNA, 19 nt, Homo sapiens
gccuccagguuuaugauga

SEQ ID NO: 477707 - RNA, 19 nt, Homo sapiens
cugcugagccucuuucugu

SEQ ID NO: 477708 - RNA, 19 nt, Homo sapiens
ccuccagguuuaugaugaa

SEQ ID NO: 477709 - RNA, 19 nt, Homo sapiens
aaggagguguccacuguuc

SEQ ID NO: 477710 - RNA, 19 nt, Homo sapiens
aggccgagcuggauaaacu

SEQ ID NO: 477711 - RNA, 19 nt, Homo sapiens
gaagauccagauucuaagc

SEQ ID NO: 477712 - RNA, 19 nt, Homo sapiens
caaggugaagauccagauu

SEQ ID NO: 477713 - RNA, 19 nt, Homo sapiens
gggaauugcugggcuuuug

SEQ ID NO: 477714 - RNA, 19 nt, Homo sapiens
guaccuggucucuccuuug

SEQ ID NO: 477715 - RNA, 19 nt, Homo sapiens
uaccuggucucuccuuugg

SEQ ID NO: 477716 - RNA, 19 nt, Homo sapiens
gagugcagcugagcgacau

SEQ ID NO: 477717 - RNA, 19 nt, Homo sapiens
ccaucgaccugcagaagac

SEQ ID NO: 477718 - RNA, 19 nt, Homo sapiens
ggucuuuggccuccagguu

SEQ ID NO: 477719 - RNA, 19 nt, Homo sapiens
ggaacacugccuacuucug

SEQ ID NO: 477720 - RNA, 19 nt, Homo sapiens
acaggaacacugccuacuu

SEQ ID NO: 477721 - RNA, 19 nt, Homo sapiens
gcgagagaguggccaagcu

SEQ ID NO: 477722 - RNA, 19 nt, Homo sapiens
agauccagauucuaagcaa

SEQ ID NO: 477723 - RNA, 19 nt, Homo sapiens
cuuuccaccugcagaauga

SEQ ID NO: 477724 - RNA, 19 nt, Homo sapiens
uggccaagcucguguucca

SEQ ID NO: 477725 - RNA, 19 nt, Homo sapiens
ccuucgauguugagaaauc

SEQ ID NO: 477726 - RNA, 19 nt, Homo sapiens
agcgagaacagcucaauga

SEQ ID NO: 477727 - RNA, 19 nt, Homo sapiens
ggaaucgcuucagcuucug

SEQ ID NO: 477728 - RNA, 19 nt, Homo sapiens
ggagaugcugacucuaagu

SEQ ID NO: 477729 - RNA, 19 nt, Homo sapiens
gcugagccucuuucuguca

SEQ ID NO: 477730 - RNA, 19 nt, Homo sapiens
uccauccgcuuccuguuca

SEQ ID NO: 477731 - RNA, 19 nt, Homo sapiens
gcaagaaacuggaaaccua

SEQ ID NO: 477732 - RNA, 19 nt, Homo sapiens
ggagaaagcugauguaaaa

SEQ ID NO: 477733 - RNA, 19 nt, Homo sapiens
gaacuuguguauacauuug

SEQ ID NO: 477734 - RNA, 19 nt, Homo sapiens
gcauauacccgcauaguuu

SEQ ID NO: 477735 - RNA, 19 nt, Homo sapiens
caaaauaccugaugcaaaa

SEQ ID NO: 477736 - RNA, 19 nt, Homo sapiens
gcaagguguuacaauauuu

SEQ ID NO: 477737 - RNA, 19 nt, Homo sapiens
aaacaauccugaaacauga

SEQ ID NO: 477738 - RNA, 19 nt, Homo sapiens
gagcaaggaguguguauaa

SEQ ID NO: 477739 - RNA, 19 nt, Homo sapiens
gaaggcaaguuacaaagau

SEQ ID NO: 477740 - RNA, 19 nt, Homo sapiens
gguauuauccuuaaccuuu

SEQ ID NO: 477741 - RNA, 19 nt, Homo sapiens
ugagaaagguggaaaguuc

SEQ ID NO: 477742 - RNA, 19 nt, Homo sapiens
ggacaaagcuaagaaagac

SEQ ID NO: 477743 - RNA, 19 nt, Homo sapiens
agacuauacugaauccuua

SEQ ID NO: 477744 - RNA, 19 nt, Homo sapiens
caacauccuuggguauuaa

SEQ ID NO: 477745 - RNA, 19 nt, Homo sapiens
gauggugucuguauagaug

SEQ ID NO: 477746 - RNA, 19 nt, Homo sapiens
uauagcaccuugaguugua

SEQ ID NO: 477747 - RNA, 19 nt, Homo sapiens
caucagaguuuccaaaaua

SEQ ID NO: 477748 - RNA, 19 nt, Homo sapiens
gcucauacuuugcaucaga

SEQ ID NO: 477749 - RNA, 19 nt, Homo sapiens
acaauuacauggagacuau

SEQ ID NO: 477750 - RNA, 19 nt, Homo sapiens
agaaauccauaucguguaa

SEQ ID NO: 477751 - RNA, 19 nt, Homo sapiens
ggagaaggcaaguuacaaa

SEQ ID NO: 477752 - RNA, 19 nt, Homo sapiens
gaauucaagugacuaucuu

SEQ ID NO: 477753 - RNA, 19 nt, Homo sapiens
ggcaagguguuacaauauu

SEQ ID NO: 477754 - RNA, 19 nt, Homo sapiens
cagagcaccuccuguuauu

SEQ ID NO: 477755 - RNA, 19 nt, Homo sapiens
gguauuagcagaauugguu

SEQ ID NO: 477756 - RNA, 19 nt, Homo sapiens
gauaugagccucuucucuu

SEQ ID NO: 477757 - RNA, 19 nt, Homo sapiens
gaccuucccucaagauaau

SEQ ID NO: 477758 - RNA, 19 nt, Homo sapiens
gacagaagaaccucaaauu

SEQ ID NO: 477759 - RNA, 19 nt, Homo sapiens
caaggaguguguauaagga

SEQ ID NO: 477760 - RNA, 19 nt, Homo sapiens
gaauugguuucuucugaga

SEQ ID NO: 477761 - RNA, 19 nt, Homo sapiens
aagaugaacuuguguauac

SEQ ID NO: 477762 - RNA, 19 nt, Homo sapiens
cagaagcuuuguuaaauca

SEQ ID NO: 477763 - RNA, 19 nt, Homo sapiens
ggaaucugaugaagccuau

SEQ ID NO: 477764 - RNA, 19 nt, Homo sapiens
uugaagaccuggagcaauu

SEQ ID NO: 477765 - RNA, 19 nt, Homo sapiens
gggaauggcuguuauugac

SEQ ID NO: 477766 - RNA, 19 nt, Homo sapiens
caucugugcucauacuuug

SEQ ID NO: 477767 - RNA, 19 nt, Homo sapiens
gacauuggguggcuggauu

SEQ ID NO: 477768 - RNA, 19 nt, Homo sapiens
cgggcaagguguuacaaua

SEQ ID NO: 477769 - RNA, 19 nt, Homo sapiens
gauaacuacugaagagaca

SEQ ID NO: 477770 - RNA, 19 nt, Homo sapiens
ucacagaggccacugagaa

SEQ ID NO: 477771 - RNA, 19 nt, Homo sapiens
ccugaaacaugaaacaaga

SEQ ID NO: 477772 - RNA, 19 nt, Homo sapiens
guuacaaccaucacuauaa

SEQ ID NO: 477773 - RNA, 19 nt, Homo sapiens
uggcuacuauccuuacaua

SEQ ID NO: 477774 - RNA, 19 nt, Homo sapiens
caagggaugcuaaugacua

SEQ ID NO: 477775 - RNA, 19 nt, Homo sapiens
ccauguugcuugacucuga

SEQ ID NO: 477776 - RNA, 19 nt, Homo sapiens
cuucuugccuugauaacua

SEQ ID NO: 477777 - RNA, 19 nt, Homo sapiens
gaugaagccuaucaauuuu

SEQ ID NO: 477778 - RNA, 19 nt, Homo sapiens
gauagaccuucccucaaga

SEQ ID NO: 477779 - RNA, 19 nt, Homo sapiens
gaaacuggaaaccuaaaga

SEQ ID NO: 477780 - RNA, 19 nt, Homo sapiens
ccagaagauuuccuuacaa

SEQ ID NO: 477781 - RNA, 19 nt, Homo sapiens
ccucuucucuuucauagga

SEQ ID NO: 477782 - RNA, 19 nt, Homo sapiens
caaaguguguaggaagaaa

SEQ ID NO: 477783 - RNA, 19 nt, Homo sapiens
ccaucaaagugaauucauu

SEQ ID NO: 477784 - RNA, 19 nt, Homo sapiens
acagaagaaccucaaauuu

SEQ ID NO: 477785 - RNA, 19 nt, Homo sapiens
caagaaacuggaaaccuaa

SEQ ID NO: 477786 - RNA, 19 nt, Homo sapiens
cagaagauuuccuuacaag

SEQ ID NO: 477787 - RNA, 19 nt, Homo sapiens
gaaaguaugauagcagugu

SEQ ID NO: 477788 - RNA, 19 nt, Homo sapiens
gcucuuuacccauccauuu

SEQ ID NO: 477789 - RNA, 19 nt, Homo sapiens
gaaaauuacuucggccaaa

SEQ ID NO: 477790 - RNA, 19 nt, Homo sapiens
gcaacaaaauguacaacuu

SEQ ID NO: 477791 - RNA, 19 nt, Homo sapiens
agacuuggcuacuauccuu

SEQ ID NO: 477792 - RNA, 19 nt, Homo sapiens
caagguauuagcagaauug

SEQ ID NO: 477793 - RNA, 19 nt, Homo sapiens
gaucaagguauuagcagaa

SEQ ID NO: 477794 - RNA, 19 nt, Homo sapiens
gaagauuuccuuacaagac

SEQ ID NO: 477795 - RNA, 19 nt, Homo sapiens
caacuucuugccuugauaa

SEQ ID NO: 477796 - RNA, 19 nt, Homo sapiens
gaagcuuuguuaaaucaag

SEQ ID NO: 477797 - RNA, 19 nt, Homo sapiens
ucagaagcuuuguuaaauc

SEQ ID NO: 477798 - RNA, 19 nt, Homo sapiens
cacacuaucugccacaaug

SEQ ID NO: 477799 - RNA, 19 nt, Homo sapiens
cagaagaaccucaaauuuu

SEQ ID NO: 477800 - RNA, 19 nt, Homo sapiens
gcuugcuccuagacaauua

SEQ ID NO: 477801 - RNA, 19 nt, Homo sapiens
ccauuuauuugaacacuca

SEQ ID NO: 477802 - RNA, 19 nt, Homo sapiens
gguagagacuauaaaauug

SEQ ID NO: 477803 - RNA, 19 nt, Homo sapiens
gagaccagccaacuucuug

SEQ ID NO: 477804 - RNA, 19 nt, Homo sapiens
gggcaagguguuacaauau

SEQ ID NO: 477805 - RNA, 19 nt, Homo sapiens
gguuauaggugaugcaacu

SEQ ID NO: 477806 - RNA, 19 nt, Homo sapiens
gguggaaaguucacaguac

SEQ ID NO: 477807 - RNA, 19 nt, Homo sapiens
cauaaucaacgucacacua

SEQ ID NO: 477808 - RNA, 19 nt, Homo sapiens
ccaacuucuugccuugaua

SEQ ID NO: 477809 - RNA, 19 nt, Homo sapiens
gaugagccacuagauauga

SEQ ID NO: 477810 - RNA, 19 nt, Homo sapiens
caucagauauuggguaaac

SEQ ID NO: 477811 - RNA, 19 nt, Homo sapiens
agauagaccuucccucaag

SEQ ID NO: 477812 - RNA, 19 nt, Homo sapiens
ggaauucaagugacuaucu

SEQ ID NO: 477813 - RNA, 19 nt, Homo sapiens
gcaaggaguguguauaagg

SEQ ID NO: 477814 - RNA, 19 nt, Homo sapiens
uuacaaccaucacuauaag

SEQ ID NO: 477815 - RNA, 19 nt, Homo sapiens
auaugagccucuucucuuu

SEQ ID NO: 477816 - RNA, 19 nt, Homo sapiens
uaaaucaaguggaguaucc

SEQ ID NO: 477817 - RNA, 19 nt, Homo sapiens
aaaccaaaguguguaggaa

SEQ ID NO: 477818 - RNA, 19 nt, Homo sapiens
cauuauaccucuuuaucca

SEQ ID NO: 477819 - RNA, 19 nt, Homo sapiens
aaaguaugauagcagugua

SEQ ID NO: 477820 - RNA, 19 nt, Homo sapiens
uauaggugaugcaacuuga

SEQ ID NO: 477821 - RNA, 19 nt, Homo sapiens
cuggaaaccuaaagauguu

SEQ ID NO: 477822 - RNA, 19 nt, Homo sapiens
gagccucuucucuuucaua

SEQ ID NO: 477823 - RNA, 19 nt, Homo sapiens
ucccuuggcuuacaggaaa

SEQ ID NO: 477824 - RNA, 19 nt, Homo sapiens
agaagaaccucaaauuuuc

SEQ ID NO: 477825 - RNA, 19 nt, Homo sapiens
aaggcaaguuacaaagaua

SEQ ID NO: 477826 - RNA, 19 nt, Homo sapiens
guaaggagaaagcugaugu

SEQ ID NO: 477827 - RNA, 19 nt, Homo sapiens
gagacuauacugaauccuu

SEQ ID NO: 477828 - RNA, 19 nt, Homo sapiens
cauggagacuauacugaau

SEQ ID NO: 477829 - RNA, 19 nt, Homo sapiens
gaagaauggagacccacuu

SEQ ID NO: 477830 - RNA, 19 nt, Homo sapiens
guuauugacugggaagaau

SEQ ID NO: 477831 - RNA, 19 nt, Homo sapiens
gcaagaaacuggaaaccua

SEQ ID NO: 477832 - RNA, 19 nt, Homo sapiens
ggagaaagcugauguaaaa

SEQ ID NO: 477833 - RNA, 19 nt, Homo sapiens
gaacuuguguauacauuug

SEQ ID NO: 477834 - RNA, 19 nt, Homo sapiens
gcauauacccgcauaguuu

SEQ ID NO: 477835 - RNA, 19 nt, Homo sapiens
caaaauaccugaugcaaaa

SEQ ID NO: 477836 - RNA, 19 nt, Homo sapiens
gcaagguguuacaauauuu

SEQ ID NO: 477837 - RNA, 19 nt, Homo sapiens
aaacaauccugaaacauga

SEQ ID NO: 477838 - RNA, 19 nt, Homo sapiens
gagcaaggaguguguauaa

SEQ ID NO: 477839 - RNA, 19 nt, Homo sapiens
gaacaauauguccaucuua

SEQ ID NO: 477840 - RNA, 19 nt, Homo sapiens
ugagaaagguggaaaguuc

SEQ ID NO: 477841 - RNA, 19 nt, Homo sapiens
ggacaaagcuaagaaagac

SEQ ID NO: 477842 - RNA, 19 nt, Homo sapiens
agacuauacugaauccuua

SEQ ID NO: 477843 - RNA, 19 nt, Homo sapiens
gauggugucuguauagaug

SEQ ID NO: 477844 - RNA, 19 nt, Homo sapiens
uauagcaccuugaguugua

SEQ ID NO: 477845 - RNA, 19 nt, Homo sapiens
caucagaguuuccaaaaua

SEQ ID NO: 477846 - RNA, 19 nt, Homo sapiens
gcucauacuuugcaucaga

SEQ ID NO: 477847 - RNA, 19 nt, Homo sapiens
acaauuacauggagacuau

SEQ ID NO: 477848 - RNA, 19 nt, Homo sapiens
gcaaagggaugcuaaugac

SEQ ID NO: 477849 - RNA, 19 nt, Homo sapiens
gaauucaagugacuaucuu

SEQ ID NO: 477850 - RNA, 19 nt, Homo sapiens
ggcaagguguuacaauauu

SEQ ID NO: 477851 - RNA, 19 nt, Homo sapiens
cagagcaccuccuguuauu

SEQ ID NO: 477852 - RNA, 19 nt, Homo sapiens
gauaugagccucuucucuu

SEQ ID NO: 477853 - RNA, 19 nt, Homo sapiens
gacagaagaaccucaaauu

SEQ ID NO: 477854 - RNA, 19 nt, Homo sapiens
caaggaguguguauaagga

SEQ ID NO: 477855 - RNA, 19 nt, Homo sapiens
aagaugaacuuguguauac

SEQ ID NO: 477856 - RNA, 19 nt, Homo sapiens
cagaagcuuuguuaaauca

SEQ ID NO: 477857 - RNA, 19 nt, Homo sapiens
uugaagaccuggagcaauu

SEQ ID NO: 477858 - RNA, 19 nt, Homo sapiens
gggaauggcuguuauugac

SEQ ID NO: 477859 - RNA, 19 nt, Homo sapiens
caucugugcucauacuuug

SEQ ID NO: 477860 - RNA, 19 nt, Homo sapiens
gacauuggguggcuggauu

SEQ ID NO: 477861 - RNA, 19 nt, Homo sapiens
cgggcaagguguuacaaua

SEQ ID NO: 477862 - RNA, 19 nt, Homo sapiens
gauaacuacugaagagaca

SEQ ID NO: 477863 - RNA, 19 nt, Homo sapiens
ucacagaggccacugagaa

SEQ ID NO: 477864 - RNA, 19 nt, Homo sapiens
ccugaaacaugaaacaaga

SEQ ID NO: 477865 - RNA, 19 nt, Homo sapiens
cagguuagcugaaaugaac

SEQ ID NO: 477866 - RNA, 19 nt, Homo sapiens
guuacaaccaucacuauaa

SEQ ID NO: 477867 - RNA, 19 nt, Homo sapiens
uggcuacuauccuuacaua

SEQ ID NO: 477868 - RNA, 19 nt, Homo sapiens
ccauguugcuugacucuga

SEQ ID NO: 477869 - RNA, 19 nt, Homo sapiens
cuucuugccuugauaacua

SEQ ID NO: 477870 - RNA, 19 nt, Homo sapiens
gaaacuggaaaccuaaaga

SEQ ID NO: 477871 - RNA, 19 nt, Homo sapiens
ccagaagauuuccuuacaa

SEQ ID NO: 477872 - RNA, 19 nt, Homo sapiens
ccucuucucuuucauagga

SEQ ID NO: 477873 - RNA, 19 nt, Homo sapiens
caaaguguguaggaagaaa

SEQ ID NO: 477874 - RNA, 19 nt, Homo sapiens
ccaucaaagugaauucauu

SEQ ID NO: 477875 - RNA, 19 nt, Homo sapiens
acagaagaaccucaaauuu

SEQ ID NO: 477876 - RNA, 19 nt, Homo sapiens
caagaaacuggaaaccuaa

SEQ ID NO: 477877 - RNA, 19 nt, Homo sapiens
cagaagauuuccuuacaag

SEQ ID NO: 477878 - RNA, 19 nt, Homo sapiens
ugaacaauauguccaucuu

SEQ ID NO: 477879 - RNA, 19 nt, Homo sapiens
gaaaguaugauagcagugu

SEQ ID NO: 477880 - RNA, 19 nt, Homo sapiens
gcucuuuacccauccauuu

SEQ ID NO: 477881 - RNA, 19 nt, Homo sapiens
gaaaauuacuucggccaaa

SEQ ID NO: 477882 - RNA, 19 nt, Homo sapiens
gcaacaaaauguacaacuu

SEQ ID NO: 477883 - RNA, 19 nt, Homo sapiens
agacuuggcuacuauccuu

SEQ ID NO: 477884 - RNA, 19 nt, Homo sapiens
caacuucuugccuugauaa

SEQ ID NO: 477885 - RNA, 19 nt, Homo sapiens
gaagauuuccuuacaagac

SEQ ID NO: 477886 - RNA, 19 nt, Homo sapiens
gaagcuuuguuaaaucaag

SEQ ID NO: 477887 - RNA, 19 nt, Homo sapiens
ucagaagcuuuguuaaauc

SEQ ID NO: 477888 - RNA, 19 nt, Homo sapiens
cacacuaucugccacaaug

SEQ ID NO: 477889 - RNA, 19 nt, Homo sapiens
cagaagaaccucaaauuuu

SEQ ID NO: 477890 - RNA, 19 nt, Homo sapiens
gcuugcuccuagacaauua

SEQ ID NO: 477891 - RNA, 19 nt, Homo sapiens
ccauuuauuugaacacuca

SEQ ID NO: 477892 - RNA, 19 nt, Homo sapiens
ggcaaagggaugcuaauga

SEQ ID NO: 477893 - RNA, 19 nt, Homo sapiens
gguagagacuauaaaauug

SEQ ID NO: 477894 - RNA, 19 nt, Homo sapiens
gagaccagccaacuucuug

SEQ ID NO: 477895 - RNA, 19 nt, Homo sapiens
gggcaagguguuacaauau

SEQ ID NO: 477896 - RNA, 19 nt, Homo sapiens
gguuauaggugaugcaacu

SEQ ID NO: 477897 - RNA, 19 nt, Homo sapiens
gguggaaaguucacaguac

SEQ ID NO: 477898 - RNA, 19 nt, Homo sapiens
cauaaucaacgucacacua

SEQ ID NO: 477899 - RNA, 19 nt, Homo sapiens
ccaacuucuugccuugaua

SEQ ID NO: 477900 - RNA, 19 nt, Homo sapiens
gaugagccacuagauauga

SEQ ID NO: 477901 - RNA, 19 nt, Homo sapiens
caucagauauuggguaaac

SEQ ID NO: 477902 - RNA, 19 nt, Homo sapiens
ggaauucaagugacuaucu

SEQ ID NO: 477903 - RNA, 19 nt, Homo sapiens
gcaaggaguguguauaagg

SEQ ID NO: 477904 - RNA, 19 nt, Homo sapiens
uuacaaccaucacuauaag

SEQ ID NO: 477905 - RNA, 19 nt, Homo sapiens
auaugagccucuucucuuu

SEQ ID NO: 477906 - RNA, 19 nt, Homo sapiens
aaagggaugcuaaugacua

SEQ ID NO: 477907 - RNA, 19 nt, Homo sapiens
uaaaucaaguggaguaucc

SEQ ID NO: 477908 - RNA, 19 nt, Homo sapiens
aaaccaaaguguguaggaa

SEQ ID NO: 477909 - RNA, 19 nt, Homo sapiens
cauuauaccucuuuaucca

SEQ ID NO: 477910 - RNA, 19 nt, Homo sapiens
aaaguaugauagcagugua

SEQ ID NO: 477911 - RNA, 19 nt, Homo sapiens
cuggaaaccuaaagauguu

SEQ ID NO: 477912 - RNA, 19 nt, Homo sapiens
gagccucuucucuuucaua

SEQ ID NO: 477913 - RNA, 19 nt, Homo sapiens
uauaggugaugcaacuuga

SEQ ID NO: 477914 - RNA, 19 nt, Homo sapiens
agaagaaccucaaauuuuc

SEQ ID NO: 477915 - RNA, 19 nt, Homo sapiens
caauauguccaucuuaaag

SEQ ID NO: 477916 - RNA, 19 nt, Homo sapiens
guaaggagaaagcugaugu

SEQ ID NO: 477917 - RNA, 19 nt, Homo sapiens
gagacuauacugaauccuu

SEQ ID NO: 477918 - RNA, 19 nt, Homo sapiens
cauggagacuauacugaau

SEQ ID NO: 477919 - RNA, 19 nt, Homo sapiens
gaagaauggagacccacuu

SEQ ID NO: 477920 - RNA, 19 nt, Homo sapiens
guuauugacugggaagaau

SEQ ID NO: 477921 - RNA, 19 nt, Homo sapiens
cccagaagauuuccuuaca

SEQ ID NO: 477922 - RNA, 19 nt, Homo sapiens
ggagcaaggaguguguaua

SEQ ID NO: 477923 - RNA, 19 nt, Homo sapiens
ggagacagaagaaccucaa

SEQ ID NO: 477924 - RNA, 19 nt, Homo sapiens
uauugcagcuguuauagca

SEQ ID NO: 477925 - RNA, 19 nt, Homo sapiens
aguauaaugcgaaguauga

SEQ ID NO: 477926 - RNA, 19 nt, Homo sapiens
gcucacauaaauucagaaa

SEQ ID NO: 477927 - RNA, 19 nt, Homo sapiens
caaccaucacuauaagaaa

SEQ ID NO: 477928 - RNA, 19 nt, Homo sapiens
acaagaccaucuggacaaa

SEQ ID NO: 477929 - RNA, 19 nt, Homo sapiens
guagcgaguuuguaauugc

SEQ ID NO: 477930 - RNA, 19 nt, Homo sapiens
gcugaaaugaacaauaugu

SEQ ID NO: 477931 - RNA, 19 nt, Homo sapiens
gagacaaggugcuaacaua

SEQ ID NO: 477932 - RNA, 19 nt, Homo sapiens
gagaagaacuauaacaugu

SEQ ID NO: 477933 - RNA, 19 nt, Homo sapiens
ugaagaagauccaugagaa

SEQ ID NO: 477934 - RNA, 19 nt, Homo sapiens
gaagaacuauaacauguac

SEQ ID NO: 477935 - RNA, 19 nt, Homo sapiens
agacagaggugguggaaga

SEQ ID NO: 477936 - RNA, 19 nt, Homo sapiens
gagaaggugugcagcaaug

SEQ ID NO: 477937 - RNA, 19 nt, Homo sapiens
acaacaaccuucugacuga

SEQ ID NO: 477938 - RNA, 19 nt, Homo sapiens
ccugugaccuggacaauga

SEQ ID NO: 477939 - RNA, 19 nt, Homo sapiens
guaccggauucucucuuua

SEQ ID NO: 477940 - RNA, 19 nt, Homo sapiens
acucugagcugaccgaauu

SEQ ID NO: 477941 - RNA, 19 nt, Homo sapiens
gcagaaggauaucgacaag

SEQ ID NO: 477942 - RNA, 19 nt, Homo sapiens
agaaggauaucgacaagga

SEQ ID NO: 477943 - RNA, 19 nt, Homo sapiens
ggaaguaggagaauuugau

SEQ ID NO: 477944 - RNA, 19 nt, Homo sapiens
aagaagcccugccugauga

SEQ ID NO: 477945 - RNA, 19 nt, Homo sapiens
agagugagauguagaaagu

SEQ ID NO: 477946 - RNA, 19 nt, Homo sapiens
gugaaucgguuguucuuuc

SEQ ID NO: 477947 - RNA, 19 nt, Homo sapiens
gaagaagauccaugagaau

SEQ ID NO: 477948 - RNA, 19 nt, Homo sapiens
ggagagaucccugcagaau

SEQ ID NO: 477949 - RNA, 19 nt, Homo sapiens
caacaagaccuucgacucu

SEQ ID NO: 477950 - RNA, 19 nt, Homo sapiens
gcaucaagcagaaggauau

SEQ ID NO: 477951 - RNA, 19 nt, Homo sapiens
gaagauccaugagaaugag

SEQ ID NO: 477952 - RNA, 19 nt, Homo sapiens
caucgggccuugcaaauac

SEQ ID NO: 477953 - RNA, 19 nt, Homo sapiens
caagaagcccugccugaug

SEQ ID NO: 477954 - RNA, 19 nt, Homo sapiens
gcaaugacaacaagaccuu

SEQ ID NO: 477955 - RNA, 19 nt, Homo sapiens
gaaguaggagaauuugaug

SEQ ID NO: 477956 - RNA, 19 nt, Homo sapiens
gguggaaguaggagaauuu

SEQ ID NO: 477957 - RNA, 19 nt, Homo sapiens
gcaguuucuuuucacauua

SEQ ID NO: 477958 - RNA, 19 nt, Homo sapiens
caucaccauuuccuccuuu

SEQ ID NO: 477959 - RNA, 19 nt, Homo sapiens
gcaagaagcccugccugau

SEQ ID NO: 477960 - RNA, 19 nt, Homo sapiens
guaggagaauuugaugaug

SEQ ID NO: 477961 - RNA, 19 nt, Homo sapiens
acaaggugcuaacauagau

SEQ ID NO: 477962 - RNA, 19 nt, Homo sapiens
gacaaggugcuaacauaga

SEQ ID NO: 477963 - RNA, 19 nt, Homo sapiens
cgagaagaacuauaacaug

SEQ ID NO: 477964 - RNA, 19 nt, Homo sapiens
gaggacaacaaccuucuga

SEQ ID NO: 477965 - RNA, 19 nt, Homo sapiens
ucucuuuaguguucuguuu

SEQ ID NO: 477966 - RNA, 19 nt, Homo sapiens
ggacaacaaccuucugacu

SEQ ID NO: 477967 - RNA, 19 nt, Homo sapiens
ugugcgagcuggaugagaa

SEQ ID NO: 477968 - RNA, 19 nt, Homo sapiens
acauuaggcuguugguuca

SEQ ID NO: 477969 - RNA, 19 nt, Homo sapiens
gugcuaacauagauuuaag

SEQ ID NO: 477970 - RNA, 19 nt, Homo sapiens
gugcagcaaugacaacaag

SEQ ID NO: 477971 - RNA, 19 nt, Homo sapiens
caacuuuucucuuuagugu

SEQ ID NO: 477972 - RNA, 19 nt, Homo sapiens
gcugggcucugccuuaaac

SEQ ID NO: 477973 - RNA, 19 nt, Homo sapiens
agugagauguagaaaguug

SEQ ID NO: 477974 - RNA, 19 nt, Homo sapiens
ggcuguugguucaaacuuu

SEQ ID NO: 477975 - RNA, 19 nt, Homo sapiens
gaucuucuuucuccuuugc

SEQ ID NO: 477976 - RNA, 19 nt, Homo sapiens
cacacgauguugucaagga

SEQ ID NO: 477977 - RNA, 19 nt, Homo sapiens
gaaguaacagacacacgau

SEQ ID NO: 477978 - RNA, 19 nt, Homo sapiens
ggacugccaggcuguuuca

SEQ ID NO: 477979 - RNA, 19 nt, Homo sapiens
cagaauccaccaaccagaa

SEQ ID NO: 477980 - RNA, 19 nt, Homo sapiens
ggugcuaacauagauuuaa

SEQ ID NO: 477981 - RNA, 19 nt, Homo sapiens
gggccuggaucuucuuucu

SEQ ID NO: 477982 - RNA, 19 nt, Homo sapiens
gcauugcaccacccgcuuu

SEQ ID NO: 477983 - RNA, 19 nt, Homo sapiens
gugaagaagauccaugaga

SEQ ID NO: 477984 - RNA, 19 nt, Homo sapiens
gcccaguucaucaccauuu

SEQ ID NO: 477985 - RNA, 19 nt, Homo sapiens
ccagaaccaccacugcaaa

SEQ ID NO: 477986 - RNA, 19 nt, Homo sapiens
ucaagagugagauguagaa

SEQ ID NO: 477987 - RNA, 19 nt, Homo sapiens
aaaucaagagugagaugua

SEQ ID NO: 477988 - RNA, 19 nt, Homo sapiens
cugcugggcucugccuuaa

SEQ ID NO: 477989 - RNA, 19 nt, Homo sapiens
agaagauccaugagaauga

SEQ ID NO: 477990 - RNA, 19 nt, Homo sapiens
gggugaagaagauccauga

SEQ ID NO: 477991 - RNA, 19 nt, Homo sapiens
ccuccaagcauuucaugaa

SEQ ID NO: 477992 - RNA, 19 nt, Homo sapiens
uuuagcauguuccuccuuu

SEQ ID NO: 477993 - RNA, 19 nt, Homo sapiens
uggaucuucuuucuccuuu

SEQ ID NO: 477994 - RNA, 19 nt, Homo sapiens
ucacauaagcccaguucau

SEQ ID NO: 477995 - RNA, 19 nt, Homo sapiens
gcuaacauagauuuaagug

SEQ ID NO: 477996 - RNA, 19 nt, Homo sapiens
ggagacaaggugcuaacau

SEQ ID NO: 477997 - RNA, 19 nt, Homo sapiens
cuacaucgggccuugcaaa

SEQ ID NO: 477998 - RNA, 19 nt, Homo sapiens
aguaaugacuuagaaacug

SEQ ID NO: 477999 - RNA, 19 nt, Homo sapiens
agagaucccugcagaaucc

SEQ ID NO: 478000 - RNA, 19 nt, Homo sapiens
caaagggaaguaacagaca

SEQ ID NO: 478001 - RNA, 19 nt, Homo sapiens
ugagauguagaaaguugua

SEQ ID NO: 478002 - RNA, 19 nt, Homo sapiens
gagagaucccugcagaauc

SEQ ID NO: 478003 - RNA, 19 nt, Homo sapiens
uaacccaagacaugacauu

SEQ ID NO: 478004 - RNA, 19 nt, Homo sapiens
aaucaagagugagauguag

SEQ ID NO: 478005 - RNA, 19 nt, Homo sapiens
cauugcagcuucaacuuuu

SEQ ID NO: 478006 - RNA, 19 nt, Homo sapiens
uaccggauucucucuuuaa

SEQ ID NO: 478007 - RNA, 19 nt, Homo sapiens
aguaccggauucucucuuu

SEQ ID NO: 478008 - RNA, 19 nt, Homo sapiens
ugaucuaaauccacuccuu

SEQ ID NO: 478009 - RNA, 19 nt, Homo sapiens
ugaugauggugcagaggaa

SEQ ID NO: 478010 - RNA, 19 nt, Homo sapiens
cagacuuuguguucauuuc

SEQ ID NO: 478011 - RNA, 19 nt, Homo sapiens
acuaauacuuaccgaguca

SEQ ID NO: 478012 - RNA, 19 nt, Homo sapiens
ucuuuaguguucuguuuga

SEQ ID NO: 478013 - RNA, 19 nt, Homo sapiens
ccacaguaccggauucucu

SEQ ID NO: 478014 - RNA, 19 nt, Homo sapiens
ggacaaugacaaguacauc

SEQ ID NO: 478015 - RNA, 19 nt, Homo sapiens
gugcagaggaaaccgaaga

SEQ ID NO: 478016 - RNA, 19 nt, Homo sapiens
guaacugagagaaagauuc

SEQ ID NO: 478017 - RNA, 19 nt, Homo sapiens
gcucaguggugggagagau

SEQ ID NO: 478018 - RNA, 19 nt, Homo sapiens
caugacauucuuagcugua

SEQ ID NO: 478019 - RNA, 19 nt, Homo sapiens
gcauuaauagucccauuuu

SEQ ID NO: 478020 - RNA, 19 nt, Homo sapiens
ccagguggaaguaggagaa

SEQ ID NO: 478021 - RNA, 19 nt, Homo sapiens
caugagggccuggaucuuc

SEQ ID NO: 478022 - RNA, 19 nt, Homo sapiens
cacauaagcccaguucauc

SEQ ID NO: 478023 - RNA, 19 nt, Homo sapiens
gcucugccuuaaacacaca

SEQ ID NO: 478024 - RNA, 19 nt, Homo sapiens
agaggugacugagguaucu

SEQ ID NO: 478025 - RNA, 19 nt, Homo sapiens
gaacuauaacauguacauc

SEQ ID NO: 478026 - RNA, 19 nt, Homo sapiens
ggaugaggacaacaaccuu

SEQ ID NO: 478027 - RNA, 19 nt, Homo sapiens
gcaccaagaagggccacaa

SEQ ID NO: 478028 - RNA, 19 nt, Homo sapiens
ggaucuucuuucuccuuug

SEQ ID NO: 478029 - RNA, 19 nt, Homo sapiens
aaaguggaguuggugaauc

SEQ ID NO: 478030 - RNA, 19 nt, Homo sapiens
acauugcagcuucaacuuu

SEQ ID NO: 478031 - RNA, 19 nt, Homo sapiens
gcaccaaacuugaagauga

SEQ ID NO: 478032 - RNA, 19 nt, Homo sapiens
gaagugaccuaacagcuuu

SEQ ID NO: 478033 - RNA, 19 nt, Homo sapiens
gaacuucaaccuucuauaa

SEQ ID NO: 478034 - RNA, 19 nt, Homo sapiens
gagaguuucuucuucauaa

SEQ ID NO: 478035 - RNA, 19 nt, Homo sapiens
caugugaccugcaguauuu

SEQ ID NO: 478036 - RNA, 19 nt, Homo sapiens
uauaagugcugcaaguuua

SEQ ID NO: 478037 - RNA, 19 nt, Homo sapiens
aaacggacgucuauaauga

SEQ ID NO: 478038 - RNA, 19 nt, Homo sapiens
ggaagacaaugcuggcuaa

SEQ ID NO: 478039 - RNA, 19 nt, Homo sapiens
cagaacaggugaagaauau

SEQ ID NO: 478040 - RNA, 19 nt, Homo sapiens
aggaauagcuguuauaguu

SEQ ID NO: 478041 - RNA, 19 nt, Homo sapiens
gauauuugcccuuaguuua

SEQ ID NO: 478042 - RNA, 19 nt, Homo sapiens
cuaaguaacuguaauagga

SEQ ID NO: 478043 - RNA, 19 nt, Homo sapiens
aaacaagcauugcaagaaa

SEQ ID NO: 478044 - RNA, 19 nt, Homo sapiens
cgucagcccucaaacuuua

SEQ ID NO: 478045 - RNA, 19 nt, Homo sapiens
caaccuugcuaaccuuaua

SEQ ID NO: 478046 - RNA, 19 nt, Homo sapiens
ggaaguccauugacccaaa

SEQ ID NO: 478047 - RNA, 19 nt, Homo sapiens
gaacaaggacuuuggagau

SEQ ID NO: 478048 - RNA, 19 nt, Homo sapiens
guauaaauaugccuggauu

SEQ ID NO: 478049 - RNA, 19 nt, Homo sapiens
gaaauacuaggaacuaaga

SEQ ID NO: 478050 - RNA, 19 nt, Homo sapiens
ccagugagaugagaaauau

SEQ ID NO: 478051 - RNA, 19 nt, Homo sapiens
ggacaucuccagucagaaa

SEQ ID NO: 478052 - RNA, 19 nt, Homo sapiens
ggaauagcuguuauaguua

SEQ ID NO: 478053 - RNA, 19 nt, Homo sapiens
ggaacuaagacauuucuaa

SEQ ID NO: 478054 - RNA, 19 nt, Homo sapiens
ggaaauaccuuuguaaacc

SEQ ID NO: 478055 - RNA, 19 nt, Homo sapiens
gagaagaugcaaccaguuu

SEQ ID NO: 478056 - RNA, 19 nt, Homo sapiens
gaacuaccaucuuuuauuc

SEQ ID NO: 478057 - RNA, 19 nt, Homo sapiens
caagagaagggaaauacua

SEQ ID NO: 478058 - RNA, 19 nt, Homo sapiens
gagaagguuugaagguuug

SEQ ID NO: 478059 - RNA, 19 nt, Homo sapiens
gaagacacaagaacauuug

SEQ ID NO: 478060 - RNA, 19 nt, Homo sapiens
gaugacagaguacuuguaa

SEQ ID NO: 478061 - RNA, 19 nt, Homo sapiens
guaaugggugcaacuaaua

SEQ ID NO: 478062 - RNA, 19 nt, Homo sapiens
guacaguaauuccauuugu

SEQ ID NO: 478063 - RNA, 19 nt, Homo sapiens
ugagagcugugaaugaauu

SEQ ID NO: 478064 - RNA, 19 nt, Homo sapiens
gcaccuaguuacagugguu

SEQ ID NO: 478065 - RNA, 19 nt, Homo sapiens
gaauagcuguuauaguuac

SEQ ID NO: 478066 - RNA, 19 nt, Homo sapiens
gaaaucuguuguagacugu

SEQ ID NO: 478067 - RNA, 19 nt, Homo sapiens
ggaaugccaaacacucuua

SEQ ID NO: 478068 - RNA, 19 nt, Homo sapiens
gcacaacuugcuagaauga

SEQ ID NO: 478069 - RNA, 19 nt, Homo sapiens
ggagcaagcuguggaaugg

SEQ ID NO: 478070 - RNA, 19 nt, Homo sapiens
ggucuucuuuaccaauaua

SEQ ID NO: 478071 - RNA, 19 nt, Homo sapiens
gaggagacaagacuacuuu

SEQ ID NO: 478072 - RNA, 19 nt, Homo sapiens
gaacaggugaagaauaugu

SEQ ID NO: 478073 - RNA, 19 nt, Homo sapiens
uaaguuagagcacaacaaa

SEQ ID NO: 478074 - RNA, 19 nt, Homo sapiens
guacauacguuggaacaag

SEQ ID NO: 478075 - RNA, 19 nt, Homo sapiens
gaaugcaaccuucuuuaau

SEQ ID NO: 478076 - RNA, 19 nt, Homo sapiens
gaaagguauugaagaacug

SEQ ID NO: 478077 - RNA, 19 nt, Homo sapiens
gggaaauacuaggaacuaa

SEQ ID NO: 478078 - RNA, 19 nt, Homo sapiens
guagaucagucuucaugug

SEQ ID NO: 478079 - RNA, 19 nt, Homo sapiens
agagaagguuugaagguuu

SEQ ID NO: 478080 - RNA, 19 nt, Homo sapiens
uauauuguguugcagauga

SEQ ID NO: 478081 - RNA, 19 nt, Homo sapiens
ggaagugaccuaacagcuu

SEQ ID NO: 478082 - RNA, 19 nt, Homo sapiens
uaauauaagugcugcaagu

SEQ ID NO: 478083 - RNA, 19 nt, Homo sapiens
cgaaugcaaccuucuuuaa

SEQ ID NO: 478084 - RNA, 19 nt, Homo sapiens
aacacaagaucuucaauga

SEQ ID NO: 478085 - RNA, 19 nt, Homo sapiens
ugauauagcuggucaagac

SEQ ID NO: 478086 - RNA, 19 nt, Homo sapiens
gcuagacgccuucaagcua

SEQ ID NO: 478087 - RNA, 19 nt, Homo sapiens
gcuguggaaugguauaaga

SEQ ID NO: 478088 - RNA, 19 nt, Homo sapiens
uagaaugacugauggauac

SEQ ID NO: 478089 - RNA, 19 nt, Homo sapiens
gaaaagaccccuuaacaca

SEQ ID NO: 478090 - RNA, 19 nt, Homo sapiens
ggacgucuauaaugacagu

SEQ ID NO: 478091 - RNA, 19 nt, Homo sapiens
cuagacgccuucaagcuaa

SEQ ID NO: 478092 - RNA, 19 nt, Homo sapiens
gaaauaccuuuguaaaccu

SEQ ID NO: 478093 - RNA, 19 nt, Homo sapiens
aaacaaggaaguccauuga

SEQ ID NO: 478094 - RNA, 19 nt, Homo sapiens
guauaugugucuuuaccaa

SEQ ID NO: 478095 - RNA, 19 nt, Homo sapiens
acaaacaggccuucgagua

SEQ ID NO: 478096 - RNA, 19 nt, Homo sapiens
ucuauuaccuugcuaccaa

SEQ ID NO: 478097 - RNA, 19 nt, Homo sapiens
guuguagacuguuaacuuc

SEQ ID NO: 478098 - RNA, 19 nt, Homo sapiens
ggucacaguuaucccaaug

SEQ ID NO: 478099 - RNA, 19 nt, Homo sapiens
caccaaacuugaagaugaa

SEQ ID NO: 478100 - RNA, 19 nt, Homo sapiens
aacaaggacuuuggagaua

SEQ ID NO: 478101 - RNA, 19 nt, Homo sapiens
caacuaauaggccacaaga

SEQ ID NO: 478102 - RNA, 19 nt, Homo sapiens
ugacagaguacuuguaaug

SEQ ID NO: 478103 - RNA, 19 nt, Homo sapiens
agcggaaccuguacuauuu

SEQ ID NO: 478104 - RNA, 19 nt, Homo sapiens
uagagaagguuugaagguu

SEQ ID NO: 478105 - RNA, 19 nt, Homo sapiens
ggaaacacaagaucuucaa

SEQ ID NO: 478106 - RNA, 19 nt, Homo sapiens
gaacgucaucggcuacaga

SEQ ID NO: 478107 - RNA, 19 nt, Homo sapiens
ccagaacaggugaagaaua

SEQ ID NO: 478108 - RNA, 19 nt, Homo sapiens
ucucaggcguuucaucaaa

SEQ ID NO: 478109 - RNA, 19 nt, Homo sapiens
gcauugcaagaaauuguua

SEQ ID NO: 478110 - RNA, 19 nt, Homo sapiens
gguuugaagguuugaguua

SEQ ID NO: 478111 - RNA, 19 nt, Homo sapiens
uaaauucagugugccaaau

SEQ ID NO: 478112 - RNA, 19 nt, Homo sapiens
guaaaccugcagaacauuu

SEQ ID NO: 478113 - RNA, 19 nt, Homo sapiens
cacaaacggacgucuauaa

SEQ ID NO: 478114 - RNA, 19 nt, Homo sapiens
ggagaugacagaguacuug

SEQ ID NO: 478115 - RNA, 19 nt, Homo sapiens
ggacaaauaaaccuucuac

SEQ ID NO: 478116 - RNA, 19 nt, Homo sapiens
uaacacacacuaguaauuc

SEQ ID NO: 478117 - RNA, 19 nt, Homo sapiens
caaacggacgucuauaaug

SEQ ID NO: 478118 - RNA, 19 nt, Homo sapiens
cuucauaaaucuacagaca

SEQ ID NO: 478119 - RNA, 19 nt, Homo sapiens
aaguggaacuaccaucuuu

SEQ ID NO: 478120 - RNA, 19 nt, Homo sapiens
gguccuauccgagaacuaa

SEQ ID NO: 478121 - RNA, 19 nt, Homo sapiens
cuacaacugcuacucguaa

SEQ ID NO: 478122 - RNA, 19 nt, Homo sapiens
uaaugacaguacuaacuug

SEQ ID NO: 478123 - RNA, 19 nt, Homo sapiens
gaacagugugaaagagcua

SEQ ID NO: 478124 - RNA, 19 nt, Homo sapiens
acuaggaacuaagacauuu

SEQ ID NO: 478125 - RNA, 19 nt, Homo sapiens
gagaagggaaauacuagga

SEQ ID NO: 478126 - RNA, 19 nt, Homo sapiens
aaucuguuguagacuguua

SEQ ID NO: 478127 - RNA, 19 nt, Homo sapiens
agugagagcugugaaugaa

SEQ ID NO: 478128 - RNA, 19 nt, Homo sapiens
cccaauggacacuaaguua

SEQ ID NO: 478129 - RNA, 19 nt, Homo sapiens
gcuucgcgcugcugcguuu

SEQ ID NO: 478130 - RNA, 19 nt, Homo sapiens
uguaaugggugcaacuaau

SEQ ID NO: 478131 - RNA, 19 nt, Homo sapiens
gaaaugcccuguacucugu

SEQ ID NO: 478132 - RNA, 19 nt, Homo sapiens
gaacaggauucuuuggaaa

SEQ ID NO: 478133 - RNA, 19 nt, Homo sapiens
gaaccgagcugacauuuug

SEQ ID NO: 478134 - RNA, 19 nt, Homo sapiens
cugcagagcuuacaauuga

SEQ ID NO: 478135 - RNA, 19 nt, Homo sapiens
gaagguggauucagugcuu

SEQ ID NO: 478136 - RNA, 19 nt, Homo sapiens
gauaaacuaugaggacauu

SEQ ID NO: 478137 - RNA, 19 nt, Homo sapiens
gcacgaagccaaacuggaa

SEQ ID NO: 478138 - RNA, 19 nt, Homo sapiens
gaaaggagucagcuucaaa

SEQ ID NO: 478139 - RNA, 19 nt, Homo sapiens
ucugagaucuguugauuga

SEQ ID NO: 478140 - RNA, 19 nt, Homo sapiens
gaaacaacauuuaguucag

SEQ ID NO: 478141 - RNA, 19 nt, Homo sapiens
gguugaagcagaagaauaa

SEQ ID NO: 478142 - RNA, 19 nt, Homo sapiens
ccaaggagcagcuguuuga

SEQ ID NO: 478143 - RNA, 19 nt, Homo sapiens
gcaaacgcccuucuggaaa

SEQ ID NO: 478144 - RNA, 19 nt, Homo sapiens
cgaacaggauucuuuggaa

SEQ ID NO: 478145 - RNA, 19 nt, Homo sapiens
ucugagaauuguugagaua

SEQ ID NO: 478146 - RNA, 19 nt, Homo sapiens
ggaaaggagucagcuucaa

SEQ ID NO: 478147 - RNA, 19 nt, Homo sapiens
ucaaagacguggcaggaau

SEQ ID NO: 478148 - RNA, 19 nt, Homo sapiens
agaauaaggagaaggauaa

SEQ ID NO: 478149 - RNA, 19 nt, Homo sapiens
aagaugagcugaauaucga

SEQ ID NO: 478150 - RNA, 19 nt, Homo sapiens
ugagaucuguugauugaug

SEQ ID NO: 478151 - RNA, 19 nt, Homo sapiens
caagcgaacaggauucuuu

SEQ ID NO: 478152 - RNA, 19 nt, Homo sapiens
gagaucuguugauugauga

SEQ ID NO: 478153 - RNA, 19 nt, Homo sapiens
gagaauuguugagauacuu

SEQ ID NO: 478154 - RNA, 19 nt, Homo sapiens
gaagaugagcugaauaucg

SEQ ID NO: 478155 - RNA, 19 nt, Homo sapiens
cagcugagguuugcacuuc

SEQ ID NO: 478156 - RNA, 19 nt, Homo sapiens
ggucaucgcgguugucaug

SEQ ID NO: 478157 - RNA, 19 nt, Homo sapiens
ggugguacuuucuauuuua

SEQ ID NO: 478158 - RNA, 19 nt, Homo sapiens
gcacagugacuucugagau

SEQ ID NO: 478159 - RNA, 19 nt, Homo sapiens
ggcaaacgcccuucuggaa

SEQ ID NO: 478160 - RNA, 19 nt, Homo sapiens
ggaagaacagaaagugguu

SEQ ID NO: 478161 - RNA, 19 nt, Homo sapiens
gcauggaacacuucgaguu

SEQ ID NO: 478162 - RNA, 19 nt, Homo sapiens
gggcugacaucgccaacau

SEQ ID NO: 478163 - RNA, 19 nt, Homo sapiens
gccauccugugguauguuu

SEQ ID NO: 478164 - RNA, 19 nt, Homo sapiens
uaaacuaugaggacauuga

SEQ ID NO: 478165 - RNA, 19 nt, Homo sapiens
cuucugagaucuguugauu

SEQ ID NO: 478166 - RNA, 19 nt, Homo sapiens
ugacaaguuugaagagaag

SEQ ID NO: 478167 - RNA, 19 nt, Homo sapiens
ccagcucacucaucaaugg

SEQ ID NO: 478168 - RNA, 19 nt, Homo sapiens
aggaagugauaaacuauga

SEQ ID NO: 478169 - RNA, 19 nt, Homo sapiens
caaacgcccuucuggaaaa

SEQ ID NO: 478170 - RNA, 19 nt, Homo sapiens
aggacaaccuggacaaguu

SEQ ID NO: 478171 - RNA, 19 nt, Homo sapiens
agaaggugcugcaggacaa

SEQ ID NO: 478172 - RNA, 19 nt, Homo sapiens
gugaugaaggucuccauaa

SEQ ID NO: 478173 - RNA, 19 nt, Homo sapiens
ggaccggcacgucuucauu

SEQ ID NO: 478174 - RNA, 19 nt, Homo sapiens
aguagucccugcacaguga

SEQ ID NO: 478175 - RNA, 19 nt, Homo sapiens
gaucccaguuuccuacaag

SEQ ID NO: 478176 - RNA, 19 nt, Homo sapiens
ucauccagcucacucauca

SEQ ID NO: 478177 - RNA, 19 nt, Homo sapiens
cacagugacuucugagauc

SEQ ID NO: 478178 - RNA, 19 nt, Homo sapiens
uaggugguacuuucuauuu

SEQ ID NO: 478179 - RNA, 19 nt, Homo sapiens
gucaugagccuccugaaug

SEQ ID NO: 478180 - RNA, 19 nt, Homo sapiens
gcagaagaauaaggagaag

SEQ ID NO: 478181 - RNA, 19 nt, Homo sapiens
caggagaggcgggagauuu

SEQ ID NO: 478182 - RNA, 19 nt, Homo sapiens
gccaaggccuacagacaca

SEQ ID NO: 478183 - RNA, 19 nt, Homo sapiens
agagcaagauccuguccaa

SEQ ID NO: 478184 - RNA, 19 nt, Homo sapiens
gcgaguuuguggauuaucu

SEQ ID NO: 478185 - RNA, 19 nt, Homo sapiens
gcagagcuuacaauugaga

SEQ ID NO: 478186 - RNA, 19 nt, Homo sapiens
uuacugcucugagaauugu

SEQ ID NO: 478187 - RNA, 19 nt, Homo sapiens
cggcacgucuucauugauc

SEQ ID NO: 478188 - RNA, 19 nt, Homo sapiens
gugcggagccucuuuaagg

SEQ ID NO: 478189 - RNA, 19 nt, Homo sapiens
uccgcgaguuuguggauua

SEQ ID NO: 478190 - RNA, 19 nt, Homo sapiens
ugaagcagaagaauaagga

SEQ ID NO: 478191 - RNA, 19 nt, Homo sapiens
cauguggacuggugcaagu

SEQ ID NO: 478192 - RNA, 19 nt, Homo sapiens
gcgaggaggagaccgaaga

SEQ ID NO: 478193 - RNA, 19 nt, Homo sapiens
acagaaagugguugcguuu

SEQ ID NO: 478194 - RNA, 19 nt, Homo sapiens
caaggaagaacagaaagug

SEQ ID NO: 478195 - RNA, 19 nt, Homo sapiens
gaccggcacgucuucauug

SEQ ID NO: 478196 - RNA, 19 nt, Homo sapiens
gaagggaucaacggauugu

SEQ ID NO: 478197 - RNA, 19 nt, Homo sapiens
gcgaacaggauucuuugga

SEQ ID NO: 478198 - RNA, 19 nt, Homo sapiens
caacauuuaguucagaauc

SEQ ID NO: 478199 - RNA, 19 nt, Homo sapiens
ugaugaaggucuccauaac

SEQ ID NO: 478200 - RNA, 19 nt, Homo sapiens
caagguugaagcagaagaa

SEQ ID NO: 478201 - RNA, 19 nt, Homo sapiens
gcucugagaauuguugaga

SEQ ID NO: 478202 - RNA, 19 nt, Homo sapiens
aagaauaaggagaaggaua

SEQ ID NO: 478203 - RNA, 19 nt, Homo sapiens
caaagacguggcaggaaug

SEQ ID NO: 478204 - RNA, 19 nt, Homo sapiens
aagggaagguggauucagu

SEQ ID NO: 478205 - RNA, 19 nt, Homo sapiens
cauucagacuccaaacaga

SEQ ID NO: 478206 - RNA, 19 nt, Homo sapiens
agacagucguucccagugu

SEQ ID NO: 478207 - RNA, 19 nt, Homo sapiens
gagcugacaccaggauuca

SEQ ID NO: 478208 - RNA, 19 nt, Homo sapiens
ggaucccaguuuccuacaa

SEQ ID NO: 478209 - RNA, 19 nt, Homo sapiens
agaagaauaaggagaagga

SEQ ID NO: 478210 - RNA, 19 nt, Homo sapiens
gggaaaggagucagcuuca

SEQ ID NO: 478211 - RNA, 19 nt, Homo sapiens
acaggauucuuuggaaaug

SEQ ID NO: 478212 - RNA, 19 nt, Homo sapiens
cugaagaugagcugaauau

SEQ ID NO: 478213 - RNA, 19 nt, Homo sapiens
ugacuucugagaucuguug

SEQ ID NO: 478214 - RNA, 19 nt, Homo sapiens
guccaaggaagaacagaaa

SEQ ID NO: 478215 - RNA, 19 nt, Homo sapiens
ucgccaacaucugcaauga

SEQ ID NO: 478216 - RNA, 19 nt, Homo sapiens
ucgagcagcugaagaugag

SEQ ID NO: 478217 - RNA, 19 nt, Homo sapiens
gcgacgugguggaagucua

SEQ ID NO: 478218 - RNA, 19 nt, Homo sapiens
ccacagaccaugucaucgu

SEQ ID NO: 478219 - RNA, 19 nt, Homo sapiens
gguagaaauggauggaaug

SEQ ID NO: 478220 - RNA, 19 nt, Homo sapiens
uugacaaguuugaagagaa

SEQ ID NO: 478221 - RNA, 19 nt, Homo sapiens
guuuguggauuaucugaag

SEQ ID NO: 478222 - RNA, 19 nt, Homo sapiens
ucaugagccuccugaaugc

SEQ ID NO: 478223 - RNA, 19 nt, Homo sapiens
gacggaguccuguguuugu

SEQ ID NO: 478224 - RNA, 19 nt, Homo sapiens
cgugcacacucucaacuuc

SEQ ID NO: 478225 - RNA, 19 nt, Homo sapiens
acacuuccgugcacacucu

SEQ ID NO: 478226 - RNA, 19 nt, Homo sapiens
agucacgcaugcaguguug

SEQ ID NO: 478227 - RNA, 19 nt, Homo sapiens
guggacuggugcaaguuga

SEQ ID NO: 478228 - RNA, 19 nt, Homo sapiens
cugacggaguccuguguuu

SEQ ID NO: 478229 - RNA, 19 nt, Homo sapiens
ccaaggaagaacagaaagu

SEQ ID NO: 478230 - RNA, 19 nt, Homo sapiens
gcagagcugacaccaggau

SEQ ID NO: 478231 - RNA, 19 nt, Homo sapiens
ucaagaaggugaagaagaa

SEQ ID NO: 478232 - RNA, 19 nt, Homo sapiens
gcaagaagaugaccuacca

SEQ ID NO: 478233 - RNA, 19 nt, Homo sapiens
gccaaacgcacgaguauua

SEQ ID NO: 478234 - RNA, 19 nt, Homo sapiens
gaagaugaccuaccagaag

SEQ ID NO: 478235 - RNA, 19 nt, Homo sapiens
ccauuaaccuccucccaaa

SEQ ID NO: 478236 - RNA, 19 nt, Homo sapiens
agaagaagcucaccuacca

SEQ ID NO: 478237 - RNA, 19 nt, Homo sapiens
ugacacggaucuauaccaa

SEQ ID NO: 478238 - RNA, 19 nt, Homo sapiens
agaagaagauccgccugua

SEQ ID NO: 478239 - RNA, 19 nt, Homo sapiens
gaagcucaccuaccaguuc

SEQ ID NO: 478240 - RNA, 19 nt, Homo sapiens
aagaugaccuaccagaaga

SEQ ID NO: 478241 - RNA, 19 nt, Homo sapiens
ugaagaagaagcucaccua

SEQ ID NO: 478242 - RNA, 19 nt, Homo sapiens
guaaaguuauucucaaucc

SEQ ID NO: 478243 - RNA, 19 nt, Homo sapiens
acauggagcuggagcagau

SEQ ID NO: 478244 - RNA, 19 nt, Homo sapiens
ccuaugacacggaucuaua

SEQ ID NO: 478245 - RNA, 19 nt, Homo sapiens
gagacaggcagcaagaaga

SEQ ID NO: 478246 - RNA, 19 nt, Homo sapiens
gaagaagauccgccuguac

SEQ ID NO: 478247 - RNA, 19 nt, Homo sapiens
cagaugcacguccucgaua

SEQ ID NO: 478248 - RNA, 19 nt, Homo sapiens
ggagagccauagcgaccau

SEQ ID NO: 478249 - RNA, 19 nt, Homo sapiens
gcacgaguauuaccccuau

SEQ ID NO: 478250 - RNA, 19 nt, Homo sapiens
ucucaaguccguauguaaa

SEQ ID NO: 478251 - RNA, 19 nt, Homo sapiens
gaagggcaaccgcaagaag

SEQ ID NO: 478252 - RNA, 19 nt, Homo sapiens
gcagaugcacguccucgau

SEQ ID NO: 478253 - RNA, 19 nt, Homo sapiens
ggagacaggcagcaagaag

SEQ ID NO: 478254 - RNA, 19 nt, Homo sapiens
gaucuauaccaacgccaaa

SEQ ID NO: 478255 - RNA, 19 nt, Homo sapiens
aaucagaucuccccucuca

SEQ ID NO: 478256 - RNA, 19 nt, Homo sapiens
gcaagacgggcgaggucaa

SEQ ID NO: 478257 - RNA, 19 nt, Homo sapiens
cagaagggcaaccgcaaga

SEQ ID NO: 478258 - RNA, 19 nt, Homo sapiens
agacaggcagcaagaagaa

SEQ ID NO: 478259 - RNA, 19 nt, Homo sapiens
ucaaguccguauguaaauc

SEQ ID NO: 478260 - RNA, 19 nt, Homo sapiens
gaagaccuggugcccuaug

SEQ ID NO: 478261 - RNA, 19 nt, Homo sapiens
caaguccguauguaaauca

SEQ ID NO: 478262 - RNA, 19 nt, Homo sapiens
guccguauguaaaucagau

SEQ ID NO: 478263 - RNA, 19 nt, Homo sapiens
ggcaaccgcaagaagauga

SEQ ID NO: 478264 - RNA, 19 nt, Homo sapiens
gucaagaaggugaagaaga

SEQ ID NO: 478265 - RNA, 19 nt, Homo sapiens
ucugguggguggacaagga

SEQ ID NO: 478266 - RNA, 19 nt, Homo sapiens
aagcucaccuaccaguuca

SEQ ID NO: 478267 - RNA, 19 nt, Homo sapiens
agaagaugaccuaccagaa

SEQ ID NO: 478268 - RNA, 19 nt, Homo sapiens
gcagcucuaccgccacaug

SEQ ID NO: 478269 - RNA, 19 nt, Homo sapiens
gagcuucgccgagaacaac

SEQ ID NO: 478270 - RNA, 19 nt, Homo sapiens
acagcgaguucgagagcuu

SEQ ID NO: 478271 - RNA, 19 nt, Homo sapiens
agucucaaguccguaugua

SEQ ID NO: 478272 - RNA, 19 nt, Homo sapiens
gauguuacaggcgugcaaa

SEQ ID NO: 478273 - RNA, 19 nt, Homo sapiens
gguacugccuugggagucu

SEQ ID NO: 478274 - RNA, 19 nt, Homo sapiens
agagccauagcgaccauua

SEQ ID NO: 478275 - RNA, 19 nt, Homo sapiens
aagaccuggugcccuauga

SEQ ID NO: 478276 - RNA, 19 nt, Homo sapiens
gggagucucaaguccguau

SEQ ID NO: 478277 - RNA, 19 nt, Homo sapiens
ccaguucagcggcgaagug

SEQ ID NO: 478278 - RNA, 19 nt, Homo sapiens
cgggcgaggucaagaaggu

SEQ ID NO: 478279 - RNA, 19 nt, Homo sapiens
gcaagaagcugcgccugua

SEQ ID NO: 478280 - RNA, 19 nt, Homo sapiens
ccaauucucuggaacuauu

SEQ ID NO: 478281 - RNA, 19 nt, Homo sapiens
cagauggcgucuucuauga

SEQ ID NO: 478282 - RNA, 19 nt, Homo sapiens
gagcuguuaucaucucaga

SEQ ID NO: 478283 - RNA, 19 nt, Homo sapiens
guacccagauggcgucuuc

SEQ ID NO: 478284 - RNA, 19 nt, Homo sapiens
gggauuucuuugucaugua

SEQ ID NO: 478285 - RNA, 19 nt, Homo sapiens
ucugggagcuguuaucauc

SEQ ID NO: 478286 - RNA, 19 nt, Homo sapiens
gugcugcccugccauaauc

SEQ ID NO: 478287 - RNA, 19 nt, Homo sapiens
ggagugcugcccugccaua

SEQ ID NO: 478288 - RNA, 19 nt, Homo sapiens
ggaccuauggaccacuaua

SEQ ID NO: 478289 - RNA, 19 nt, Homo sapiens
cuggacagcugcaagcauu

SEQ ID NO: 478290 - RNA, 19 nt, Homo sapiens
gagauuuccuaguuauguc

SEQ ID NO: 478291 - RNA, 19 nt, Homo sapiens
ggauuucuuugucauguac

SEQ ID NO: 478292 - RNA, 19 nt, Homo sapiens
gcaagcgcaugaccuacca

SEQ ID NO: 478293 - RNA, 19 nt, Homo sapiens
ccagauggcgucuucuaug

SEQ ID NO: 478294 - RNA, 19 nt, Homo sapiens
ucugagauuuccuaguuau

SEQ ID NO: 478295 - RNA, 19 nt, Homo sapiens
aagguucccucuugucaga

SEQ ID NO: 478296 - RNA, 19 nt, Homo sapiens
caggaccuauggaccacua

SEQ ID NO: 478297 - RNA, 19 nt, Homo sapiens
gcgcaugaccuaccagaag

SEQ ID NO: 478298 - RNA, 19 nt, Homo sapiens
caagcucaccuaccaguuc

SEQ ID NO: 478299 - RNA, 19 nt, Homo sapiens
uaucagaggaggaagacuu

SEQ ID NO: 478300 - RNA, 19 nt, Homo sapiens
cauuccagcuacccugauu

SEQ ID NO: 478301 - RNA, 19 nt, Homo sapiens
ucacaucuguccccucauu

SEQ ID NO: 478302 - RNA, 19 nt, Homo sapiens
ccucugggauuucuuuguc

SEQ ID NO: 478303 - RNA, 19 nt, Homo sapiens
uguaaacccugaaucucau

SEQ ID NO: 478304 - RNA, 19 nt, Homo sapiens
gggaaccgcaagcgcauga

SEQ ID NO: 478305 - RNA, 19 nt, Homo sapiens
ccugagcccuguccaaggu

SEQ ID NO: 478306 - RNA, 19 nt, Homo sapiens
ugagauuuccuaguuaugu

SEQ ID NO: 478307 - RNA, 19 nt, Homo sapiens
gagcuucucugggauuuuc

SEQ ID NO: 478308 - RNA, 19 nt, Homo sapiens
gcaagcucaccuaccaguu

SEQ ID NO: 478309 - RNA, 19 nt, Homo sapiens
gaucucuucgcccaucuau

SEQ ID NO: 478310 - RNA, 19 nt, Homo sapiens
gaucgcugugugucuguaa

SEQ ID NO: 478311 - RNA, 19 nt, Homo sapiens
ccagcccugugcuaucaga

SEQ ID NO: 478312 - RNA, 19 nt, Homo sapiens
cuguaaacccugaaucuca

SEQ ID NO: 478313 - RNA, 19 nt, Homo sapiens
ggacagcgagucggaugag

SEQ ID NO: 478314 - RNA, 19 nt, Homo sapiens
gggagcuguuaucaucuca

SEQ ID NO: 478315 - RNA, 19 nt, Homo sapiens
gaagagaggccaaauguua

SEQ ID NO: 478316 - RNA, 19 nt, Homo sapiens
gaagguaacaggcaucuuu

SEQ ID NO: 478317 - RNA, 19 nt, Homo sapiens
ggaaauacuuaucccaaug

SEQ ID NO: 478318 - RNA, 19 nt, Homo sapiens
ggacugauggaaauacuua

SEQ ID NO: 478319 - RNA, 19 nt, Homo sapiens
ggccaaauguuacaaugaa

SEQ ID NO: 478320 - RNA, 19 nt, Homo sapiens
gaaauacuuaucccaauga

SEQ ID NO: 478321 - RNA, 19 nt, Homo sapiens
ggaaacgccagacuucuau

SEQ ID NO: 478322 - RNA, 19 nt, Homo sapiens
gggaagagaggccaaaugu

SEQ ID NO: 478323 - RNA, 19 nt, Homo sapiens
uaacaggcaucuuucuucu

SEQ ID NO: 478324 - RNA, 19 nt, Homo sapiens
cuuaauggaugcaccaaga

SEQ ID NO: 478325 - RNA, 19 nt, Homo sapiens
acaggcaucuuucuucuca

SEQ ID NO: 478326 - RNA, 19 nt, Homo sapiens
agacuucuauccucauuca

SEQ ID NO: 478327 - RNA, 19 nt, Homo sapiens
gaggccaaauguuacaaug

SEQ ID NO: 478328 - RNA, 19 nt, Homo sapiens
guaacaggcaucuuucuuc

SEQ ID NO: 478329 - RNA, 19 nt, Homo sapiens
ccagacuucuauccucauu

SEQ ID NO: 478330 - RNA, 19 nt, Homo sapiens
augaaugcguguuauguuu

SEQ ID NO: 478331 - RNA, 19 nt, Homo sapiens
auacuuaucccaaugaaug

SEQ ID NO: 478332 - RNA, 19 nt, Homo sapiens
uaauggaugcaccaagaua

SEQ ID NO: 478333 - RNA, 19 nt, Homo sapiens
ggaagagaggccaaauguu

SEQ ID NO: 478334 - RNA, 19 nt, Homo sapiens
gauauaugacccugucugu

SEQ ID NO: 478335 - RNA, 19 nt, Homo sapiens
gguaagugcggugcaguuu

SEQ ID NO: 478336 - RNA, 19 nt, Homo sapiens
gagucuaucugguaacacu

SEQ ID NO: 478337 - RNA, 19 nt, Homo sapiens
cggaaacgccagacuucua

SEQ ID NO: 478338 - RNA, 19 nt, Homo sapiens
uggaaauacuuaucccaau

SEQ ID NO: 478339 - RNA, 19 nt, Homo sapiens
gguaacaggcaucuuucuu

SEQ ID NO: 478340 - RNA, 19 nt, Homo sapiens
gaugcaccaagauauauga

SEQ ID NO: 478341 - RNA, 19 nt, Homo sapiens
gaaugcguguuauguuuug

SEQ ID NO: 478342 - RNA, 19 nt, Homo sapiens
caaugaaugcguguuaugu

SEQ ID NO: 478343 - RNA, 19 nt, Homo sapiens
ccaaugaaugcguguuaug

SEQ ID NO: 478344 - RNA, 19 nt, Homo sapiens
ggucggaaacgccagacuu

SEQ ID NO: 478345 - RNA, 19 nt, Homo sapiens
ggaugcaccaagauauaug

SEQ ID NO: 478346 - RNA, 19 nt, Homo sapiens
uguugagucuaucugguaa

SEQ ID NO: 478347 - RNA, 19 nt, Homo sapiens
uaagugcggugcaguuuuc

SEQ ID NO: 478348 - RNA, 19 nt, Homo sapiens
ucccaaugaaugcguguua

SEQ ID NO: 478349 - RNA, 19 nt, Homo sapiens
aaugaaugcguguuauguu

SEQ ID NO: 478350 - RNA, 19 nt, Homo sapiens
cccaaugaaugcguguuau

SEQ ID NO: 478351 - RNA, 19 nt, Homo sapiens
cgcagaacuucagccauga

SEQ ID NO: 478352 - RNA, 19 nt, Homo sapiens
gaagguggucauaauauua

SEQ ID NO: 478353 - RNA, 19 nt, Homo sapiens
ggaagguggucauaauauu

SEQ ID NO: 478354 - RNA, 19 nt, Homo sapiens
ccaggugacuugugcauug

SEQ ID NO: 478355 - RNA, 19 nt, Homo sapiens
guguagugauggauaauuu

SEQ ID NO: 478356 - RNA, 19 nt, Homo sapiens
gugcauugcuuuauuuagu

SEQ ID NO: 478357 - RNA, 19 nt, Homo sapiens
gaaauggacccugcugaug

SEQ ID NO: 478358 - RNA, 19 nt, Homo sapiens
gaauguacucugugcauga

SEQ ID NO: 478359 - RNA, 19 nt, Homo sapiens
cagggaagguggucauaau

SEQ ID NO: 478360 - RNA, 19 nt, Homo sapiens
gccaaugaauguacucugu

SEQ ID NO: 478361 - RNA, 19 nt, Homo sapiens
caguauagauuaccaggau

SEQ ID NO: 478362 - RNA, 19 nt, Homo sapiens
gcauugcuuuauuuaguug

SEQ ID NO: 478363 - RNA, 19 nt, Homo sapiens
ccacuuaugccaaugaaug

SEQ ID NO: 478364 - RNA, 19 nt, Homo sapiens
caugagauuuguuaacaca

SEQ ID NO: 478365 - RNA, 19 nt, Homo sapiens
caccuucacuggcagacua

SEQ ID NO: 478366 - RNA, 19 nt, Homo sapiens
cauguguagugauggauaa

SEQ ID NO: 478367 - RNA, 19 nt, Homo sapiens
ggaagacagccauguguag

SEQ ID NO: 478368 - RNA, 19 nt, Homo sapiens
gggaagguggucauaauau

SEQ ID NO: 478369 - RNA, 19 nt, Homo sapiens
agacagccauguguaguga

SEQ ID NO: 478370 - RNA, 19 nt, Homo sapiens
uaacacacauuuucugaga

SEQ ID NO: 478371 - RNA, 19 nt, Homo sapiens
ugacuugugcauugcuuua

SEQ ID NO: 478372 - RNA, 19 nt, Homo sapiens
ucucugaucccucaauuug

SEQ ID NO: 478373 - RNA, 19 nt, Homo sapiens
gaagacagccauguguagu

SEQ ID NO: 478374 - RNA, 19 nt, Homo sapiens
cuugugcauugcuuuauuu

SEQ ID NO: 478375 - RNA, 19 nt, Homo sapiens
ugagauuuguuaacacaca

SEQ ID NO: 478376 - RNA, 19 nt, Homo sapiens
cagacuagauaaauugcau

SEQ ID NO: 478377 - RNA, 19 nt, Homo sapiens
ugauggagcaguuuacaga

SEQ ID NO: 478378 - RNA, 19 nt, Homo sapiens
ucugagagcagguauggaa

SEQ ID NO: 478379 - RNA, 19 nt, Homo sapiens
cgaaauggacccugcugau

SEQ ID NO: 478380 - RNA, 19 nt, Homo sapiens
cauguccacuuaugccaau

SEQ ID NO: 478381 - RNA, 19 nt, Homo sapiens
gagauuuguuaacacacau

SEQ ID NO: 478382 - RNA, 19 nt, Homo sapiens
ccucucugaucccucaauu

SEQ ID NO: 478383 - RNA, 19 nt, Homo sapiens
uggcagacuagauaaauug

SEQ ID NO: 478384 - RNA, 19 nt, Homo sapiens
gaguggcgcagguaacaga

SEQ ID NO: 478385 - RNA, 19 nt, Homo sapiens
gauggagcaguuuacagaa

SEQ ID NO: 478386 - RNA, 19 nt, Homo sapiens
ucacuggcagacuagauaa

SEQ ID NO: 478387 - RNA, 19 nt, Homo sapiens
aaauauagaacgccaaacu

SEQ ID NO: 478388 - RNA, 19 nt, Homo sapiens
cuggcagacuagauaaauu

SEQ ID NO: 478389 - RNA, 19 nt, Homo sapiens
ucugaucccucaauuuggu

SEQ ID NO: 478390 - RNA, 19 nt, Homo sapiens
aauguacucugugcaugaa

SEQ ID NO: 478391 - RNA, 19 nt, Homo sapiens
auggagcaguuuacagaaa

SEQ ID NO: 478392 - RNA, 19 nt, Homo sapiens
aauggacccugcugaugga

SEQ ID NO: 478393 - RNA, 19 nt, Homo sapiens
uggaagacagccaugugua

SEQ ID NO: 478394 - RNA, 19 nt, Homo sapiens
gagagcagguauggaagac

SEQ ID NO: 478395 - RNA, 19 nt, Homo sapiens
guauagauuaccaggaugu

SEQ ID NO: 478396 - RNA, 19 nt, Homo sapiens
uuacugcccaggugacuug

SEQ ID NO: 478397 - RNA, 19 nt, Homo sapiens
acagccauguguagugaug

SEQ ID NO: 478398 - RNA, 19 nt, Homo sapiens
caaaauauagaacgccaaa

SEQ ID NO: 478399 - RNA, 19 nt, Homo sapiens
ggugacuugugcauugcuu

SEQ ID NO: 478400 - RNA, 19 nt, Homo sapiens
agggaagguggucauaaua

SEQ ID NO: 478401 - RNA, 19 nt, Homo sapiens
ucagggaagguggucauaa

SEQ ID NO: 478402 - RNA, 19 nt, Homo sapiens
ugagagcagguauggaaga

SEQ ID NO: 478403 - RNA, 19 nt, Homo sapiens
gaacgccaaacugcucuca

SEQ ID NO: 478404 - RNA, 19 nt, Homo sapiens
acuugugcauugcuuuauu

SEQ ID NO: 478405 - RNA, 19 nt, Homo sapiens
guccacuuaugccaaugaa

SEQ ID NO: 478406 - RNA, 19 nt, Homo sapiens
gcgaguggcgcagguaaca

SEQ ID NO: 478407 - RNA, 19 nt, Homo sapiens
ggacuucccuguguaguuu

SEQ ID NO: 478408 - RNA, 19 nt, Homo sapiens
cggagcaccuggucuauaa

SEQ ID NO: 478409 - RNA, 19 nt, Homo sapiens
gcaacaagaacaacuuuga

SEQ ID NO: 478410 - RNA, 19 nt, Homo sapiens
gcaagaguuucguuuaugg

SEQ ID NO: 478411 - RNA, 19 nt, Homo sapiens
gaaaggcgccauccagugu

SEQ ID NO: 478412 - RNA, 19 nt, Homo sapiens
gaacaacuuugaggaagag

SEQ ID NO: 478413 - RNA, 19 nt, Homo sapiens
ggaaggcaccuaccuguuc

SEQ ID NO: 478414 - RNA, 19 nt, Homo sapiens
agauggaccugccugcaua

SEQ ID NO: 478415 - RNA, 19 nt, Homo sapiens
ggccagaaguaccagacua

SEQ ID NO: 478416 - RNA, 19 nt, Homo sapiens
caagaacaacuuugaggaa

SEQ ID NO: 478417 - RNA, 19 nt, Homo sapiens
gggagggcuucaucaacua

SEQ ID NO: 478418 - RNA, 19 nt, Homo sapiens
gcauagacuugaagguaca

SEQ ID NO: 478419 - RNA, 19 nt, Homo sapiens
ggaggaaguuggaguuuug

SEQ ID NO: 478420 - RNA, 19 nt, Homo sapiens
gcauaggaguuuggaggaa

SEQ ID NO: 478421 - RNA, 19 nt, Homo sapiens
ucacugugcuguccaccaa

SEQ ID NO: 478422 - RNA, 19 nt, Homo sapiens
gggcaggcauagacuugaa

SEQ ID NO: 478423 - RNA, 19 nt, Homo sapiens
acacaggacucugcaagga

SEQ ID NO: 478424 - RNA, 19 nt, Homo sapiens
ccaccaagcagacagaaga

SEQ ID NO: 478425 - RNA, 19 nt, Homo sapiens
gcugcugcaucgacaguuu

SEQ ID NO: 478426 - RNA, 19 nt, Homo sapiens
cugcaagaguuucguuuau

SEQ ID NO: 478427 - RNA, 19 nt, Homo sapiens
ggacacggccaacgucaca

SEQ ID NO: 478428 - RNA, 19 nt, Homo sapiens
acaguuuccuggaguguga

SEQ ID NO: 478429 - RNA, 19 nt, Homo sapiens
caacaagaacaacuaccuu

SEQ ID NO: 478430 - RNA, 19 nt, Homo sapiens
agaacaacuuugaggaaga

SEQ ID NO: 478431 - RNA, 19 nt, Homo sapiens
ccaagcagacagaagacua

SEQ ID NO: 478432 - RNA, 19 nt, Homo sapiens
agaaguaccagacuagaug

SEQ ID NO: 478433 - RNA, 19 nt, Homo sapiens
accagacucuugccuguuu

SEQ ID NO: 478434 - RNA, 19 nt, Homo sapiens
ugguagccaucuuggguua

SEQ ID NO: 478435 - RNA, 19 nt, Homo sapiens
ggagccgacugccugaaca

SEQ ID NO: 478436 - RNA, 19 nt, Homo sapiens
acacggagcaccuggucua

SEQ ID NO: 478437 - RNA, 19 nt, Homo sapiens
aggcauagacuugaaggua

SEQ ID NO: 478438 - RNA, 19 nt, Homo sapiens
ucaagaaccagagaaagga

SEQ ID NO: 478439 - RNA, 19 nt, Homo sapiens
caacaagaacaacuuugag

SEQ ID NO: 478440 - RNA, 19 nt, Homo sapiens
gcaccacccagaacugcaa

SEQ ID NO: 478441 - RNA, 19 nt, Homo sapiens
caguuccgcugcagcaaug

SEQ ID NO: 478442 - RNA, 19 nt, Homo sapiens
ggaggcugcuugggcaaca

SEQ ID NO: 478443 - RNA, 19 nt, Homo sapiens
ugcaagaguuucguuuaug

SEQ ID NO: 478444 - RNA, 19 nt, Homo sapiens
acacggaugucaggguaga

SEQ ID NO: 478445 - RNA, 19 nt, Homo sapiens
ggaaguuggaguuuuguuu

SEQ ID NO: 478446 - RNA, 19 nt, Homo sapiens
gcaacaagaacaacuaccu

SEQ ID NO: 478447 - RNA, 19 nt, Homo sapiens
uaaaagugguuuguggaaa

SEQ ID NO: 478448 - RNA, 19 nt, Homo sapiens
uaccuauggugguuguuau

SEQ ID NO: 478449 - RNA, 19 nt, Homo sapiens
ucugcaagaguuucguuua

SEQ ID NO: 478450 - RNA, 19 nt, Homo sapiens
ccagggagggcuucaucaa

SEQ ID NO: 478451 - RNA, 19 nt, Homo sapiens
gcuccacugucuccacuac

SEQ ID NO: 478452 - RNA, 19 nt, Homo sapiens
agcagugccucgagucuug

SEQ ID NO: 478453 - RNA, 19 nt, Homo sapiens
uuaccuauggugguuguua

SEQ ID NO: 478454 - RNA, 19 nt, Homo sapiens
gaucugcaagaguuucguu

SEQ ID NO: 478455 - RNA, 19 nt, Homo sapiens
gcuguggcaugggugaaga

SEQ ID NO: 478456 - RNA, 19 nt, Homo sapiens
cuguguaguuugugcugua

SEQ ID NO: 478457 - RNA, 19 nt, Homo sapiens
gagcuccagcgcauccauu

SEQ ID NO: 478458 - RNA, 19 nt, Homo sapiens
ccgacugccugaacagcuu

SEQ ID NO: 478459 - RNA, 19 nt, Homo sapiens
gcaaggccccuccauggaa

SEQ ID NO: 478460 - RNA, 19 nt, Homo sapiens
caagaguuucguuuaugga

SEQ ID NO: 478461 - RNA, 19 nt, Homo sapiens
cagaaguaccagacuagau

SEQ ID NO: 478462 - RNA, 19 nt, Homo sapiens
agggagggcuucaucaacu

SEQ ID NO: 478463 - RNA, 19 nt, Homo sapiens
gaaguuggaguuuuguuuc

SEQ ID NO: 478464 - RNA, 19 nt, Homo sapiens
gaaaacccuugggccagaa

SEQ ID NO: 478465 - RNA, 19 nt, Homo sapiens
ccugucagcccacccaguu

SEQ ID NO: 478466 - RNA, 19 nt, Homo sapiens
caaggccccuccauggaaa

SEQ ID NO: 478467 - RNA, 19 nt, Homo sapiens
ugacagugacuagcucaga

SEQ ID NO: 478468 - RNA, 19 nt, Homo sapiens
gccuagaccagcagacaga

SEQ ID NO: 478469 - RNA, 19 nt, Homo sapiens
uguaguuugugcuguaaag

SEQ ID NO: 478470 - RNA, 19 nt, Homo sapiens
ggaguuuuguuuccucugu

SEQ ID NO: 478471 - RNA, 19 nt, Homo sapiens
gaagguacaaccccaggaa

SEQ ID NO: 478472 - RNA, 19 nt, Homo sapiens
uggcaacaagaacaacuuu

SEQ ID NO: 478473 - RNA, 19 nt, Homo sapiens
gcuucgugcuggacaccaa

SEQ ID NO: 478474 - RNA, 19 nt, Homo sapiens
uguguaguuugugcuguaa

SEQ ID NO: 478475 - RNA, 19 nt, Homo sapiens
guuauggcaacaagaacaa

SEQ ID NO: 478476 - RNA, 19 nt, Homo sapiens
ccagaaaccuccaguagga

SEQ ID NO: 478477 - RNA, 19 nt, Homo sapiens
guacaccacuucaauaaca

SEQ ID NO: 478478 - RNA, 19 nt, Homo sapiens
acaacgaacucuccagaaa

SEQ ID NO: 478479 - RNA, 19 nt, Homo sapiens
caacgucuguggacugaau

SEQ ID NO: 478480 - RNA, 19 nt, Homo sapiens
gauguacaccacuucaaua

SEQ ID NO: 478481 - RNA, 19 nt, Homo sapiens
ucuguggacugaaugaaua

SEQ ID NO: 478482 - RNA, 19 nt, Homo sapiens
ggcccacgcucaccacuuu

SEQ ID NO: 478483 - RNA, 19 nt, Homo sapiens
ucaaagauguacaccacuu

SEQ ID NO: 478484 - RNA, 19 nt, Homo sapiens
uggcuaggcuggucucaaa

SEQ ID NO: 478485 - RNA, 19 nt, Homo sapiens
cgugacagguggaaccaua

SEQ ID NO: 478486 - RNA, 19 nt, Homo sapiens
ccaaagugcugagauuaca

SEQ ID NO: 478487 - RNA, 19 nt, Homo sapiens
gagacagaguuucgcuuug

SEQ ID NO: 478488 - RNA, 19 nt, Homo sapiens
acaaugaugucuccaacga

SEQ ID NO: 478489 - RNA, 19 nt, Homo sapiens
ugaauaaacccuccucauc

SEQ ID NO: 478490 - RNA, 19 nt, Homo sapiens
gugcugagauuacagacau

SEQ ID NO: 478491 - RNA, 19 nt, Homo sapiens
ugccucagcuucccgagua

SEQ ID NO: 478492 - RNA, 19 nt, Homo sapiens
agacagaguuucgcuuugu

SEQ ID NO: 478493 - RNA, 19 nt, Homo sapiens
gcaaugcacgaucucaguu

SEQ ID NO: 478494 - RNA, 19 nt, Homo sapiens
ugagacagaguuucgcuuu

SEQ ID NO: 478495 - RNA, 19 nt, Homo sapiens
caauaacaagugacccuaa

SEQ ID NO: 478496 - RNA, 19 nt, Homo sapiens
caaccuaccaggaaguuuc

SEQ ID NO: 478497 - RNA, 19 nt, Homo sapiens
acagcaaacucucuaggau

SEQ ID NO: 478498 - RNA, 19 nt, Homo sapiens
cauaacagcaaacucucua

SEQ ID NO: 478499 - RNA, 19 nt, Homo sapiens
guggaaccauaacaacgaa

SEQ ID NO: 478500 - RNA, 19 nt, Homo sapiens
ucacccaccucuucacucu

SEQ ID NO: 478501 - RNA, 19 nt, Homo sapiens
ugcaaccucugccuccuaa

SEQ ID NO: 478502 - RNA, 19 nt, Homo sapiens
aagugucggugaauaguga

SEQ ID NO: 478503 - RNA, 19 nt, Homo sapiens
ccucaacuuccaucaauga

SEQ ID NO: 478504 - RNA, 19 nt, Homo sapiens
ccuuaagugucggugaaua

SEQ ID NO: 478505 - RNA, 19 nt, Homo sapiens
aauaaacccuccucaucca

SEQ ID NO: 478506 - RNA, 19 nt, Homo sapiens
ccaggucucuagcguaaaa

SEQ ID NO: 478507 - RNA, 19 nt, Homo sapiens
gguggaaccauaacaacga

SEQ ID NO: 478508 - RNA, 19 nt, Homo sapiens
ucccucaacuuccaucaau

SEQ ID NO: 478509 - RNA, 19 nt, Homo sapiens
ucauccugcuguucccaua

SEQ ID NO: 478510 - RNA, 19 nt, Homo sapiens
aauaacaagugacccuaag

SEQ ID NO: 478511 - RNA, 19 nt, Homo sapiens
acccaccucuucacucuga

SEQ ID NO: 478512 - RNA, 19 nt, Homo sapiens
ggaaauggccacgcuucuc

SEQ ID NO: 478513 - RNA, 19 nt, Homo sapiens
gcguaaaacuaucuacaau

SEQ ID NO: 478514 - RNA, 19 nt, Homo sapiens
caacgaacucuccagaaac

SEQ ID NO: 478515 - RNA, 19 nt, Homo sapiens
caaccucugccuccuaagu

SEQ ID NO: 478516 - RNA, 19 nt, Homo sapiens
caccaugcccagcugcuuu

SEQ ID NO: 478517 - RNA, 19 nt, Homo sapiens
caaagauguacaccacuuc

SEQ ID NO: 478518 - RNA, 19 nt, Homo sapiens
ucccaaagugcugagauua

SEQ ID NO: 478519 - RNA, 19 nt, Homo sapiens
cagcuucccgaguaacuga

SEQ ID NO: 478520 - RNA, 19 nt, Homo sapiens
uccagcaccuucccucuca

SEQ ID NO: 478521 - RNA, 19 nt, Homo sapiens
cagcacugguuccccuuua

SEQ ID NO: 478522 - RNA, 19 nt, Homo sapiens
gcugagauuacagacauga

SEQ ID NO: 478523 - RNA, 19 nt, Homo sapiens
cucccaaagugcugagauu

SEQ ID NO: 478524 - RNA, 19 nt, Homo sapiens
gagccuuuggucucuacua

SEQ ID NO: 478525 - RNA, 19 nt, Homo sapiens
aaagugcugagauuacaga

SEQ ID NO: 478526 - RNA, 19 nt, Homo sapiens
ccccugagcucaaagaugu

SEQ ID NO: 478527 - RNA, 19 nt, Homo sapiens
cuaccucccucaacuucca

SEQ ID NO: 478528 - RNA, 19 nt, Homo sapiens
aaagauguacaccacuuca

SEQ ID NO: 478529 - RNA, 19 nt, Homo sapiens
gcacagagcaagaauaaau

SEQ ID NO: 478530 - RNA, 19 nt, Homo sapiens
guccauaagugaacaauuu

SEQ ID NO: 478531 - RNA, 19 nt, Homo sapiens
gagaacaacuuggucauga

SEQ ID NO: 478532 - RNA, 19 nt, Homo sapiens
gagcaagaauaaauacuga

SEQ ID NO: 478533 - RNA, 19 nt, Homo sapiens
ggaaugaacuacuggucuu

SEQ ID NO: 478534 - RNA, 19 nt, Homo sapiens
gaguugagguccuagauga

SEQ ID NO: 478535 - RNA, 19 nt, Homo sapiens
gagaagaucccgcuacaug

SEQ ID NO: 478536 - RNA, 19 nt, Homo sapiens
ggucaugaauuuagaguuc

SEQ ID NO: 478537 - RNA, 19 nt, Homo sapiens
gagaagaugacgaugauga

SEQ ID NO: 478538 - RNA, 19 nt, Homo sapiens
acaacuuggucaugaauuu

SEQ ID NO: 478539 - RNA, 19 nt, Homo sapiens
guugggaucucauaaaugg

SEQ ID NO: 478540 - RNA, 19 nt, Homo sapiens
gaagaucccgcuacaugug

SEQ ID NO: 478541 - RNA, 19 nt, Homo sapiens
caacuuggucaugaauuua

SEQ ID NO: 478542 - RNA, 19 nt, Homo sapiens
gaacaacuuggucaugaau

SEQ ID NO: 478543 - RNA, 19 nt, Homo sapiens
gcauucagaagcucauuaa

SEQ ID NO: 478544 - RNA, 19 nt, Homo sapiens
gcucagguuucccagugua

SEQ ID NO: 478545 - RNA, 19 nt, Homo sapiens
cgaugaugaugaagauauu

SEQ ID NO: 478546 - RNA, 19 nt, Homo sapiens
cggcacagagcaagaauaa

SEQ ID NO: 478547 - RNA, 19 nt, Homo sapiens
ugacgaugaugaugaagau

SEQ ID NO: 478548 - RNA, 19 nt, Homo sapiens
gaaacagaagguacccaaa

SEQ ID NO: 478549 - RNA, 19 nt, Homo sapiens
gaauggagaagaugacgau

SEQ ID NO: 478550 - RNA, 19 nt, Homo sapiens
caacaugcaggaaggauuc

SEQ ID NO: 478551 - RNA, 19 nt, Homo sapiens
uauguuugcucuuggaaug

SEQ ID NO: 478552 - RNA, 19 nt, Homo sapiens
gguauugccuccuggaaac

SEQ ID NO: 478553 - RNA, 19 nt, Homo sapiens
gaagcaccgugaagguauc

SEQ ID NO: 478554 - RNA, 19 nt, Homo sapiens
cagagggacuacuaugugu

SEQ ID NO: 478555 - RNA, 19 nt, Homo sapiens
uggagaagaugacgaugau

SEQ ID NO: 478556 - RNA, 19 nt, Homo sapiens
uauuuggucucauuucaga

SEQ ID NO: 478557 - RNA, 19 nt, Homo sapiens
gaagaugacgaugaugaug

SEQ ID NO: 478558 - RNA, 19 nt, Homo sapiens
gauuauguuugcucuugga

SEQ ID NO: 478559 - RNA, 19 nt, Homo sapiens
cacagagcaagaauaaaua

SEQ ID NO: 478560 - RNA, 19 nt, Homo sapiens
cagaagcaccgugaaggua

SEQ ID NO: 478561 - RNA, 19 nt, Homo sapiens
agaugacgaugaugaugaa

SEQ ID NO: 478562 - RNA, 19 nt, Homo sapiens
agaacaacuuggucaugaa

SEQ ID NO: 478563 - RNA, 19 nt, Homo sapiens
ccucagugccucuguggua

SEQ ID NO: 478564 - RNA, 19 nt, Homo sapiens
ucagacgaguccauaagug

SEQ ID NO: 478565 - RNA, 19 nt, Homo sapiens
uacgauccauccuccuuaa

SEQ ID NO: 478566 - RNA, 19 nt, Homo sapiens
ccacagcuguuugcagaag

SEQ ID NO: 478567 - RNA, 19 nt, Homo sapiens
ucacugaguccguaucugu

SEQ ID NO: 478568 - RNA, 19 nt, Homo sapiens
gcagaagcaccgugaaggu

SEQ ID NO: 478569 - RNA, 19 nt, Homo sapiens
ccagagggacuacuaugug

SEQ ID NO: 478570 - RNA, 19 nt, Homo sapiens
cagacgaguccauaaguga

SEQ ID NO: 478571 - RNA, 19 nt, Homo sapiens
ucuauuuggucucauuuca

SEQ ID NO: 478572 - RNA, 19 nt, Homo sapiens
ucacuugggaucaugagaa

SEQ ID NO: 478573 - RNA, 19 nt, Homo sapiens
cuacgauccauccuccuua

SEQ ID NO: 478574 - RNA, 19 nt, Homo sapiens
gcaagaauaaauacugacu

SEQ ID NO: 478575 - RNA, 19 nt, Homo sapiens
gaucaugagaaggguauug

SEQ ID NO: 478576 - RNA, 19 nt, Homo sapiens
uugauuauguuugcucuug

SEQ ID NO: 478577 - RNA, 19 nt, Homo sapiens
gacauguugggaucucaua

SEQ ID NO: 478578 - RNA, 19 nt, Homo sapiens
uggagaagaucccgcuaca

SEQ ID NO: 478579 - RNA, 19 nt, Homo sapiens
ggcauucagaagcucauua

SEQ ID NO: 478580 - RNA, 19 nt, Homo sapiens
cauguugggaucucauaaa

SEQ ID NO: 478581 - RNA, 19 nt, Homo sapiens
gguccuagaugagaacaac

SEQ ID NO: 478582 - RNA, 19 nt, Homo sapiens
ggguauugccuccuggaaa

SEQ ID NO: 478583 - RNA, 19 nt, Homo sapiens
ccuccacgucugagucuua

SEQ ID NO: 478584 - RNA, 19 nt, Homo sapiens
gaaugaacuacuggucuug

SEQ ID NO: 478585 - RNA, 19 nt, Homo sapiens
aagaugacgaugaugauga

SEQ ID NO: 478586 - RNA, 19 nt, Homo sapiens
aaacagaagguacccaaac

SEQ ID NO: 478587 - RNA, 19 nt, Homo sapiens
cagcagcgaagagaugauu

SEQ ID NO: 478588 - RNA, 19 nt, Homo sapiens
uuacagcagcgaagagaug

SEQ ID NO: 478589 - RNA, 19 nt, Homo sapiens
aaaagugaauucccaguca

SEQ ID NO: 478590 - RNA, 19 nt, Homo sapiens
agaagcaccgugaagguau

SEQ ID NO: 478591 - RNA, 19 nt, Homo sapiens
gaugaugaugaagauauug

SEQ ID NO: 478592 - RNA, 19 nt, Homo sapiens
gggaucaugagaaggguau

SEQ ID NO: 478593 - RNA, 19 nt, Homo sapiens
agacgaguccauaagugaa

SEQ ID NO: 478594 - RNA, 19 nt, Homo sapiens
guugagguccuagaugaga

SEQ ID NO: 478595 - RNA, 19 nt, Homo sapiens
gcagcgaagagaugauuuu

SEQ ID NO: 478596 - RNA, 19 nt, Homo sapiens
agaagaucccgcuacaugu

SEQ ID NO: 478597 - RNA, 19 nt, Homo sapiens
gaacacaacucuuugguua

SEQ ID NO: 478598 - RNA, 19 nt, Homo sapiens
gagaauaccuuaauacuga

SEQ ID NO: 478599 - RNA, 19 nt, Homo sapiens
gagaaaggguguuguguuu

SEQ ID NO: 478600 - RNA, 19 nt, Homo sapiens
caacuuaaaucccagaauu

SEQ ID NO: 478601 - RNA, 19 nt, Homo sapiens
gaaguagaauguuugcuuu

SEQ ID NO: 478602 - RNA, 19 nt, Homo sapiens
gaaaacaggugcuuaauug

SEQ ID NO: 478603 - RNA, 19 nt, Homo sapiens
gaaagccucugauugagaa

SEQ ID NO: 478604 - RNA, 19 nt, Homo sapiens
ggaagucauuggcuuaauu

SEQ ID NO: 478605 - RNA, 19 nt, Homo sapiens
gcaauuuccuagacaauga

SEQ ID NO: 478606 - RNA, 19 nt, Homo sapiens
gaagagugcucaacagaca

SEQ ID NO: 478607 - RNA, 19 nt, Homo sapiens
gcacacauaucuccuguuc

SEQ ID NO: 478608 - RNA, 19 nt, Homo sapiens
agacuuaucuggaauguga

SEQ ID NO: 478609 - RNA, 19 nt, Homo sapiens
ccaacaagcaugugauuua

SEQ ID NO: 478610 - RNA, 19 nt, Homo sapiens
caagccaucucuuucauuu

SEQ ID NO: 478611 - RNA, 19 nt, Homo sapiens
gacccacgcuguacaagua

SEQ ID NO: 478612 - RNA, 19 nt, Homo sapiens
gcaugagaauaccuuaaua

SEQ ID NO: 478613 - RNA, 19 nt, Homo sapiens
gaagucauuggcuuaauua

SEQ ID NO: 478614 - RNA, 19 nt, Homo sapiens
caaggucucuucuccauug

SEQ ID NO: 478615 - RNA, 19 nt, Homo sapiens
ggaugaggaugaugacaaa

SEQ ID NO: 478616 - RNA, 19 nt, Homo sapiens
agaaauauguucagccaaa

SEQ ID NO: 478617 - RNA, 19 nt, Homo sapiens
ccaucuaccuggauaagua

SEQ ID NO: 478618 - RNA, 19 nt, Homo sapiens
gaacagcucuuuuaauaca

SEQ ID NO: 478619 - RNA, 19 nt, Homo sapiens
gcugguguguggacaaaua

SEQ ID NO: 478620 - RNA, 19 nt, Homo sapiens
cauuauaucuggcuuccua

SEQ ID NO: 478621 - RNA, 19 nt, Homo sapiens
caacagacaguucccagua

SEQ ID NO: 478622 - RNA, 19 nt, Homo sapiens
ggagucuaguuccaaauuu

SEQ ID NO: 478623 - RNA, 19 nt, Homo sapiens
gauggagucacauuaauaa

SEQ ID NO: 478624 - RNA, 19 nt, Homo sapiens
ccaaaucgauggagucaca

SEQ ID NO: 478625 - RNA, 19 nt, Homo sapiens
ugaauacaguagcaucaua

SEQ ID NO: 478626 - RNA, 19 nt, Homo sapiens
caaagaacaucguaauaac

SEQ ID NO: 478627 - RNA, 19 nt, Homo sapiens
cacauaaacucaagcaaga

SEQ ID NO: 478628 - RNA, 19 nt, Homo sapiens
auaaaccacuuccucauuu

SEQ ID NO: 478629 - RNA, 19 nt, Homo sapiens
guaaugagagcccaucaaa

SEQ ID NO: 478630 - RNA, 19 nt, Homo sapiens
uggaugaccuagaauauga

SEQ ID NO: 478631 - RNA, 19 nt, Homo sapiens
gaaauagugauguagcaaa

SEQ ID NO: 478632 - RNA, 19 nt, Homo sapiens
caucaccuuuguuucaaua

SEQ ID NO: 478633 - RNA, 19 nt, Homo sapiens
agaaagaggacacaaguuu

SEQ ID NO: 478634 - RNA, 19 nt, Homo sapiens
ggacaaauaugggaaugag

SEQ ID NO: 478635 - RNA, 19 nt, Homo sapiens
gaggagggcuauuacaaag

SEQ ID NO: 478636 - RNA, 19 nt, Homo sapiens
ccaguaagguaaugagaug

SEQ ID NO: 478637 - RNA, 19 nt, Homo sapiens
ggauuucucucccuaucaa

SEQ ID NO: 478638 - RNA, 19 nt, Homo sapiens
gacaagauacuaaugaaga

SEQ ID NO: 478639 - RNA, 19 nt, Homo sapiens
guuccaccaugguuaguua

SEQ ID NO: 478640 - RNA, 19 nt, Homo sapiens
uaagcugaauccucacuaa

SEQ ID NO: 478641 - RNA, 19 nt, Homo sapiens
ucuaaggcaugcacacaua

SEQ ID NO: 478642 - RNA, 19 nt, Homo sapiens
caucaaauccugaguguca

SEQ ID NO: 478643 - RNA, 19 nt, Homo sapiens
ugaguuaccuuauccuuag

SEQ ID NO: 478644 - RNA, 19 nt, Homo sapiens
caacaagcccuuugaccaa

SEQ ID NO: 478645 - RNA, 19 nt, Homo sapiens
uaccuuauccuuagaagua

SEQ ID NO: 478646 - RNA, 19 nt, Homo sapiens
caacucaccuuaaauuagc

SEQ ID NO: 478647 - RNA, 19 nt, Homo sapiens
guaccaugguguuccuuaa

SEQ ID NO: 478648 - RNA, 19 nt, Homo sapiens
gauguuuguuccuguuaaa

SEQ ID NO: 478649 - RNA, 19 nt, Homo sapiens
cacaaaagcuguacagauu

SEQ ID NO: 478650 - RNA, 19 nt, Homo sapiens
ggagaaaggguguuguguu

SEQ ID NO: 478651 - RNA, 19 nt, Homo sapiens
gaacagggugaaccacuga

SEQ ID NO: 478652 - RNA, 19 nt, Homo sapiens
gagucuaguuccaaauuug

SEQ ID NO: 478653 - RNA, 19 nt, Homo sapiens
caaggcagguuugacacua

SEQ ID NO: 478654 - RNA, 19 nt, Homo sapiens
ccaccaugguuaguuauuu

SEQ ID NO: 478655 - RNA, 19 nt, Homo sapiens
caucauaccuauaguuggu

SEQ ID NO: 478656 - RNA, 19 nt, Homo sapiens
caucaucucuacauuccuu

SEQ ID NO: 478657 - RNA, 19 nt, Homo sapiens
acacauaucuccuguucuc

SEQ ID NO: 478658 - RNA, 19 nt, Homo sapiens
gaaacuggaaucccaacaa

SEQ ID NO: 478659 - RNA, 19 nt, Homo sapiens
gagaagagugcucaacaga

SEQ ID NO: 478660 - RNA, 19 nt, Homo sapiens
gaaaguucuucaccauagu

SEQ ID NO: 478661 - RNA, 19 nt, Homo sapiens
ccaaauggaggccuacaaa

SEQ ID NO: 478662 - RNA, 19 nt, Homo sapiens
caacaagcaugugauuuac

SEQ ID NO: 478663 - RNA, 19 nt, Homo sapiens
acacaacucuuugguuaau

SEQ ID NO: 478664 - RNA, 19 nt, Homo sapiens
ggagaagagugcucaacag

SEQ ID NO: 478665 - RNA, 19 nt, Homo sapiens
aauaacacauggaagcaaa

SEQ ID NO: 478666 - RNA, 19 nt, Homo sapiens
cuacugccggugauuauua

SEQ ID NO: 478667 - RNA, 19 nt, Homo sapiens
agacgaugauuauuucaga

SEQ ID NO: 478668 - RNA, 19 nt, Homo sapiens
uaaaccacuuccucauuug

SEQ ID NO: 478669 - RNA, 19 nt, Homo sapiens
ccuuagaaguagaauguuu

SEQ ID NO: 478670 - RNA, 19 nt, Homo sapiens
gugacaagauacuaaugaa

SEQ ID NO: 478671 - RNA, 19 nt, Homo sapiens
gacagaggaugaugaggau

SEQ ID NO: 478672 - RNA, 19 nt, Homo sapiens
gaacuaugaccuccugcuu

SEQ ID NO: 478673 - RNA, 19 nt, Homo sapiens
cgaauuuggucaagugcaa

SEQ ID NO: 478674 - RNA, 19 nt, Homo sapiens
ccaagugacaagauacuaa

SEQ ID NO: 478675 - RNA, 19 nt, Homo sapiens
cccuguacaugcauaaaua

SEQ ID NO: 478676 - RNA, 19 nt, Homo sapiens
ggucucuucuccauuguug

SEQ ID NO: 478677 - RNA, 19 nt, Homo sapiens
caagaaagaggacacaagu

SEQ ID NO: 478678 - RNA, 19 nt, Homo sapiens
cgauggagucacauuaaua

SEQ ID NO: 478679 - RNA, 19 nt, Homo sapiens
gcaugugauuuacguggaa

SEQ ID NO: 478680 - RNA, 19 nt, Homo sapiens
gucauuggcuuaauuagag

SEQ ID NO: 478681 - RNA, 19 nt, Homo sapiens
gaugaggucggguacauau

SEQ ID NO: 478682 - RNA, 19 nt, Homo sapiens
gguuggaccuucgaauuug

SEQ ID NO: 478683 - RNA, 19 nt, Homo sapiens
aguaaaugcuuaacuguag

SEQ ID NO: 478684 - RNA, 19 nt, Homo sapiens
guacaaguaacauccaaga

SEQ ID NO: 478685 - RNA, 19 nt, Homo sapiens
gaaccgcuuucgagacgau

SEQ ID NO: 478686 - RNA, 19 nt, Homo sapiens
aaacaacagccuuaauuca

SEQ ID NO: 478687 - RNA, 19 nt, Homo sapiens
acuaugaccuccugcuuga

SEQ ID NO: 478688 - RNA, 19 nt, Homo sapiens
aaugagagcccaucaaauc

SEQ ID NO: 478689 - RNA, 19 nt, Homo sapiens
caccaugguuaguuauuug

SEQ ID NO: 478690 - RNA, 19 nt, Homo sapiens
ggguuggaccuucgaauuu

SEQ ID NO: 478691 - RNA, 19 nt, Homo sapiens
gaccauaggcaaacucugu

SEQ ID NO: 478692 - RNA, 19 nt, Homo sapiens
gauguaccaacucaccuua

SEQ ID NO: 478693 - RNA, 19 nt, Homo sapiens
cauaucuccuguucucuga

SEQ ID NO: 478694 - RNA, 19 nt, Homo sapiens
acugaaagccucugauuga

SEQ ID NO: 478695 - RNA, 19 nt, Homo sapiens
ggacacaaguuuugcacaa

SEQ ID NO: 478696 - RNA, 19 nt, Homo sapiens
ccacgaggaugcgaacaga

SEQ ID NO: 478697 - RNA, 19 nt, Homo sapiens
gaacgacucugaugaugua

SEQ ID NO: 478698 - RNA, 19 nt, Homo sapiens
gaaacucccuguaaacuaa

SEQ ID NO: 478699 - RNA, 19 nt, Homo sapiens
gaacaugaaaugcuucuuu

SEQ ID NO: 478700 - RNA, 19 nt, Homo sapiens
ccacagacccuuccaagua

SEQ ID NO: 478701 - RNA, 19 nt, Homo sapiens
ccaaguaaguccaacgaaa

SEQ ID NO: 478702 - RNA, 19 nt, Homo sapiens
gauaaacaccugaaauuuc

SEQ ID NO: 478703 - RNA, 19 nt, Homo sapiens
ggacaucaccucacacaug

SEQ ID NO: 478704 - RNA, 19 nt, Homo sapiens
ggacugaggucaaaaucua

SEQ ID NO: 478705 - RNA, 19 nt, Homo sapiens
ccacauggaugauauggau

SEQ ID NO: 478706 - RNA, 19 nt, Homo sapiens
gaagauaaacaccugaaau

SEQ ID NO: 478707 - RNA, 19 nt, Homo sapiens
gaacgcgccuucugauugg

SEQ ID NO: 478708 - RNA, 19 nt, Homo sapiens
ugaaagagaacaugaaaug

SEQ ID NO: 478709 - RNA, 19 nt, Homo sapiens
ggaaacucccuguaaacua

SEQ ID NO: 478710 - RNA, 19 nt, Homo sapiens
cauggaaacucccuguaaa

SEQ ID NO: 478711 - RNA, 19 nt, Homo sapiens
ccacaagcaguccagauua

SEQ ID NO: 478712 - RNA, 19 nt, Homo sapiens
cacagacccuuccaaguaa

SEQ ID NO: 478713 - RNA, 19 nt, Homo sapiens
gaauugcagugauuugcuu

SEQ ID NO: 478714 - RNA, 19 nt, Homo sapiens
ucacagccaugaagauaug

SEQ ID NO: 478715 - RNA, 19 nt, Homo sapiens
caugagaauugcagugauu

SEQ ID NO: 478716 - RNA, 19 nt, Homo sapiens
acuaaaagcuucaggguua

SEQ ID NO: 478717 - RNA, 19 nt, Homo sapiens
gcuaaacccugacccaucu

SEQ ID NO: 478718 - RNA, 19 nt, Homo sapiens
gaagauaugcugguuguag

SEQ ID NO: 478719 - RNA, 19 nt, Homo sapiens
gaggugauagugugguuua

SEQ ID NO: 478720 - RNA, 19 nt, Homo sapiens
cugaugaacuggucacuga

SEQ ID NO: 478721 - RNA, 19 nt, Homo sapiens
gaaggacaguuaugaaacg

SEQ ID NO: 478722 - RNA, 19 nt, Homo sapiens
uggaugauauggaugauga

SEQ ID NO: 478723 - RNA, 19 nt, Homo sapiens
caucuucugaggucaauua

SEQ ID NO: 478724 - RNA, 19 nt, Homo sapiens
gggaaggacaguuaugaaa

SEQ ID NO: 478725 - RNA, 19 nt, Homo sapiens
gaauguguaucuauuugag

SEQ ID NO: 478726 - RNA, 19 nt, Homo sapiens
gguugaauguguaucuauu

SEQ ID NO: 478727 - RNA, 19 nt, Homo sapiens
ggaguugaauggugcauac

SEQ ID NO: 478728 - RNA, 19 nt, Homo sapiens
ugauauggaugaugaagau

SEQ ID NO: 478729 - RNA, 19 nt, Homo sapiens
caaagucagccgugaauuc

SEQ ID NO: 478730 - RNA, 19 nt, Homo sapiens
ugaugaaucugaugaacug

SEQ ID NO: 478731 - RNA, 19 nt, Homo sapiens
cacaagcaguccagauuau

SEQ ID NO: 478732 - RNA, 19 nt, Homo sapiens
ggugucaauugcuuauuug

SEQ ID NO: 478733 - RNA, 19 nt, Homo sapiens
guuuguggcuucauggaaa

SEQ ID NO: 478734 - RNA, 19 nt, Homo sapiens
ccacgguuguccagcaauu

SEQ ID NO: 478735 - RNA, 19 nt, Homo sapiens
ggacagccaggacuccauu

SEQ ID NO: 478736 - RNA, 19 nt, Homo sapiens
gguuaugucuauguucauu

SEQ ID NO: 478737 - RNA, 19 nt, Homo sapiens
aagagaacaugaaaugcuu

SEQ ID NO: 478738 - RNA, 19 nt, Homo sapiens
gccaaacgccgaccaagga

SEQ ID NO: 478739 - RNA, 19 nt, Homo sapiens
ugaacgcgccuucugauug

SEQ ID NO: 478740 - RNA, 19 nt, Homo sapiens
caagcaguccagauuauau

SEQ ID NO: 478741 - RNA, 19 nt, Homo sapiens
ggaaagcgaggaguugaau

SEQ ID NO: 478742 - RNA, 19 nt, Homo sapiens
uaugauggccgaggugaua

SEQ ID NO: 478743 - RNA, 19 nt, Homo sapiens
gaugaacuggucacugauu

SEQ ID NO: 478744 - RNA, 19 nt, Homo sapiens
ggaaaacucacuaccauga

SEQ ID NO: 478745 - RNA, 19 nt, Homo sapiens
cagauuauauaagcggaaa

SEQ ID NO: 478746 - RNA, 19 nt, Homo sapiens
aaacgagucagcuggauga

SEQ ID NO: 478747 - RNA, 19 nt, Homo sapiens
gugauagugugguuuaugg

SEQ ID NO: 478748 - RNA, 19 nt, Homo sapiens
cgacucugaugauguagau

SEQ ID NO: 478749 - RNA, 19 nt, Homo sapiens
uggugucaauugcuuauuu

SEQ ID NO: 478750 - RNA, 19 nt, Homo sapiens
aagauaugcugguuguaga

SEQ ID NO: 478751 - RNA, 19 nt, Homo sapiens
ccaguacccugaugcuaca

SEQ ID NO: 478752 - RNA, 19 nt, Homo sapiens
gcagaccugacauccagua

SEQ ID NO: 478753 - RNA, 19 nt, Homo sapiens
ccacaguagacacauauga

SEQ ID NO: 478754 - RNA, 19 nt, Homo sapiens
guagaugacacugaugauu

SEQ ID NO: 478755 - RNA, 19 nt, Homo sapiens
gcuucaggguuaugucuau

SEQ ID NO: 478756 - RNA, 19 nt, Homo sapiens
ggaaggacaguuaugaaac

SEQ ID NO: 478757 - RNA, 19 nt, Homo sapiens
caaguaaguccaacgaaag

SEQ ID NO: 478758 - RNA, 19 nt, Homo sapiens
caacaaauacccagaugcu

SEQ ID NO: 478759 - RNA, 19 nt, Homo sapiens
ucauggaaacucccuguaa

SEQ ID NO: 478760 - RNA, 19 nt, Homo sapiens
guaaggaagaagauaaaca

SEQ ID NO: 478761 - RNA, 19 nt, Homo sapiens
ugauguagaugacacugau

SEQ ID NO: 478762 - RNA, 19 nt, Homo sapiens
caauuucucacuuugcauu

SEQ ID NO: 478763 - RNA, 19 nt, Homo sapiens
cuucugaggucaauuaaaa

SEQ ID NO: 478764 - RNA, 19 nt, Homo sapiens
gccacaagcaguccagauu

SEQ ID NO: 478765 - RNA, 19 nt, Homo sapiens
ucaccagucugaugagucu

SEQ ID NO: 478766 - RNA, 19 nt, Homo sapiens
gguuguccagcaauuaaua

SEQ ID NO: 478767 - RNA, 19 nt, Homo sapiens
ccgaugugauugauaguca

SEQ ID NO: 478768 - RNA, 19 nt, Homo sapiens
aagcaguccagauuauaua

SEQ ID NO: 478769 - RNA, 19 nt, Homo sapiens
ccaugaagauaugcugguu

SEQ ID NO: 478770 - RNA, 19 nt, Homo sapiens
uagaugacacugaugauuc

SEQ ID NO: 478771 - RNA, 19 nt, Homo sapiens
guuuauugguugaaugugu

SEQ ID NO: 478772 - RNA, 19 nt, Homo sapiens
ucaggguuaugucuauguu

SEQ ID NO: 478773 - RNA, 19 nt, Homo sapiens
ucucaugaauuagauagug

SEQ ID NO: 478774 - RNA, 19 nt, Homo sapiens
gccgugggaaggacaguua

SEQ ID NO: 478775 - RNA, 19 nt, Homo sapiens
uacaacaaauacccagaug

SEQ ID NO: 478776 - RNA, 19 nt, Homo sapiens
gaaagagaacaugaaaugc

SEQ ID NO: 478777 - RNA, 19 nt, Homo sapiens
acaagcaguccagauuaua

SEQ ID NO: 478778 - RNA, 19 nt, Homo sapiens
guugaauggugcauacaag

SEQ ID NO: 478779 - RNA, 19 nt, Homo sapiens
gaaagcgaggaguugaaug

SEQ ID NO: 478780 - RNA, 19 nt, Homo sapiens
augcuucuuucucaguuua

SEQ ID NO: 478781 - RNA, 19 nt, Homo sapiens
aaaugcuucuuucucaguu

SEQ ID NO: 478782 - RNA, 19 nt, Homo sapiens
uacaauuucucacuuugca

SEQ ID NO: 478783 - RNA, 19 nt, Homo sapiens
gcauuccgaugugauugau

SEQ ID NO: 478784 - RNA, 19 nt, Homo sapiens
uuuauggacugaggucaaa

SEQ ID NO: 478785 - RNA, 19 nt, Homo sapiens
ucaguuuauugguugaaug

SEQ ID NO: 478786 - RNA, 19 nt, Homo sapiens
agaugacacugaugauucu

SEQ ID NO: 478787 - RNA, 19 nt, Homo sapiens
augaagauaugcugguugu

SEQ ID NO: 478788 - RNA, 19 nt, Homo sapiens
caucaccucacacauggaa

SEQ ID NO: 478789 - RNA, 19 nt, Homo sapiens
ggucaaaaucuaagaaguu

SEQ ID NO: 478790 - RNA, 19 nt, Homo sapiens
augaacuggucacugauuu

SEQ ID NO: 478791 - RNA, 19 nt, Homo sapiens
aaagagaacaugaaaugcu

SEQ ID NO: 478792 - RNA, 19 nt, Homo sapiens
ccugugccauaccaguuaa

SEQ ID NO: 478793 - RNA, 19 nt, Homo sapiens
caucaccugugccauacca

SEQ ID NO: 478794 - RNA, 19 nt, Homo sapiens
ucgaacgacucugaugaug

SEQ ID NO: 478795 - RNA, 19 nt, Homo sapiens
uauggaugaugaagaugau

SEQ ID NO: 478796 - RNA, 19 nt, Homo sapiens
guggugugaauaaaucuuu

SEQ ID NO: 478797 - RNA, 19 nt, Homo sapiens
ggacuucuaugacaaauaa

SEQ ID NO: 478798 - RNA, 19 nt, Homo sapiens
ggagagagguuauggguau

SEQ ID NO: 478799 - RNA, 19 nt, Homo sapiens
caaaggcagauacaaauaa

SEQ ID NO: 478800 - RNA, 19 nt, Homo sapiens
gaucuggugucgaauagga

SEQ ID NO: 478801 - RNA, 19 nt, Homo sapiens
acacagacaugcagcaguu

SEQ ID NO: 478802 - RNA, 19 nt, Homo sapiens
gcuccugggugucuguaua

SEQ ID NO: 478803 - RNA, 19 nt, Homo sapiens
cugcugagcuuacuggaaa

SEQ ID NO: 478804 - RNA, 19 nt, Homo sapiens
agagugaucuggugucgaa

SEQ ID NO: 478805 - RNA, 19 nt, Homo sapiens
ggaaaggcugcucgugaua

SEQ ID NO: 478806 - RNA, 19 nt, Homo sapiens
ccaaaggcagauacaaaua

SEQ ID NO: 478807 - RNA, 19 nt, Homo sapiens
gaccuucuguugaacuuug

SEQ ID NO: 478808 - RNA, 19 nt, Homo sapiens
ucauuggccuuaccaguug

SEQ ID NO: 478809 - RNA, 19 nt, Homo sapiens
ggaagcugguggauugcaa

SEQ ID NO: 478810 - RNA, 19 nt, Homo sapiens
ugcaggagcugaaggcaaa

SEQ ID NO: 478811 - RNA, 19 nt, Homo sapiens
gaaaggcugcucgugauau

SEQ ID NO: 478812 - RNA, 19 nt, Homo sapiens
acacauagaagcauucaug

SEQ ID NO: 478813 - RNA, 19 nt, Homo sapiens
gagcccacguggacuucua

SEQ ID NO: 478814 - RNA, 19 nt, Homo sapiens
uaacaucucgucccucugu

SEQ ID NO: 478815 - RNA, 19 nt, Homo sapiens
ugacaaauaagcccauguu

SEQ ID NO: 478816 - RNA, 19 nt, Homo sapiens
gaugucuccuuccuucaga

SEQ ID NO: 478817 - RNA, 19 nt, Homo sapiens
ccauguagauucgcagaug

SEQ ID NO: 478818 - RNA, 19 nt, Homo sapiens
ggaggacccauguagauuc

SEQ ID NO: 478819 - RNA, 19 nt, Homo sapiens
gaagcuggaacacagaaga

SEQ ID NO: 478820 - RNA, 19 nt, Homo sapiens
caaggugucagcccagaaa

SEQ ID NO: 478821 - RNA, 19 nt, Homo sapiens
gccaaaggcagauacaaau

SEQ ID NO: 478822 - RNA, 19 nt, Homo sapiens
gaauaggaggacccaugua

SEQ ID NO: 478823 - RNA, 19 nt, Homo sapiens
uagcaggaccuucuguuga

SEQ ID NO: 478824 - RNA, 19 nt, Homo sapiens
aaaggcugcucgugauaug

SEQ ID NO: 478825 - RNA, 19 nt, Homo sapiens
gagagagguuauggguauu

SEQ ID NO: 478826 - RNA, 19 nt, Homo sapiens
gacaaauaagcccauguuu

SEQ ID NO: 478827 - RNA, 19 nt, Homo sapiens
cccagaaacugcugagcuu

SEQ ID NO: 478828 - RNA, 19 nt, Homo sapiens
ucugugcccugcaaccuuu

SEQ ID NO: 478829 - RNA, 19 nt, Homo sapiens
agcaggaccuucuguugaa

SEQ ID NO: 478830 - RNA, 19 nt, Homo sapiens
guagcaggaccuucuguug

SEQ ID NO: 478831 - RNA, 19 nt, Homo sapiens
ugagggugcugaacuaugc

SEQ ID NO: 478832 - RNA, 19 nt, Homo sapiens
uagcaagccuguggguaga

SEQ ID NO: 478833 - RNA, 19 nt, Homo sapiens
gcuccgugcuuguccuuag

SEQ ID NO: 478834 - RNA, 19 nt, Homo sapiens
gggaagaacaggaaaagaa

SEQ ID NO: 478835 - RNA, 19 nt, Homo sapiens
gacugcugcuuaucaacaa

SEQ ID NO: 478836 - RNA, 19 nt, Homo sapiens
ccagaaacugcugagcuua

SEQ ID NO: 478837 - RNA, 19 nt, Homo sapiens
cgccaaaggcagauacaaa

SEQ ID NO: 478838 - RNA, 19 nt, Homo sapiens
gucauuggccuuaccaguu

SEQ ID NO: 478839 - RNA, 19 nt, Homo sapiens
aggaaaggcugcucgugau

SEQ ID NO: 478840 - RNA, 19 nt, Homo sapiens
gcgcuguacugugcaggaa

SEQ ID NO: 478841 - RNA, 19 nt, Homo sapiens
cgaauaggaggacccaugu

SEQ ID NO: 478842 - RNA, 19 nt, Homo sapiens
gugaucuggugucgaauag

SEQ ID NO: 478843 - RNA, 19 nt, Homo sapiens
gcuguacugugcaggaaag

SEQ ID NO: 478844 - RNA, 19 nt, Homo sapiens
cacguggacuucuaugaca

SEQ ID NO: 478845 - RNA, 19 nt, Homo sapiens
gaggguagcaggaccuucu

SEQ ID NO: 478846 - RNA, 19 nt, Homo sapiens
cgacugcugcuuaucaaca

SEQ ID NO: 478847 - RNA, 19 nt, Homo sapiens
gaggacccauguagauucg

SEQ ID NO: 478848 - RNA, 19 nt, Homo sapiens
gaggagguugugucucuug

SEQ ID NO: 478849 - RNA, 19 nt, Homo sapiens
gaaaagaagcuggaacaca

SEQ ID NO: 478850 - RNA, 19 nt, Homo sapiens
uaggaggacccauguagau

SEQ ID NO: 478851 - RNA, 19 nt, Homo sapiens
acaaauaagcccauguuuu

SEQ ID NO: 478852 - RNA, 19 nt, Homo sapiens
cuacugggcacugaacuug

SEQ ID NO: 478853 - RNA, 19 nt, Homo sapiens
ggguauuggugucucuauc

SEQ ID NO: 478854 - RNA, 19 nt, Homo sapiens
gagagguuauggguauugg

SEQ ID NO: 478855 - RNA, 19 nt, Homo sapiens
ccaguugucaggagucugu

SEQ ID NO: 478856 - RNA, 19 nt, Homo sapiens
gcaaggugucagcccagaa

SEQ ID NO: 478857 - RNA, 19 nt, Homo sapiens
gguagcaggaccuucuguu

SEQ ID NO: 478858 - RNA, 19 nt, Homo sapiens
ccuuacacauagaagcauu

SEQ ID NO: 478859 - RNA, 19 nt, Homo sapiens
gaaaaggacgaguucaagu

SEQ ID NO: 478860 - RNA, 19 nt, Homo sapiens
gaagggcagacgguacaug

SEQ ID NO: 478861 - RNA, 19 nt, Homo sapiens
aguccugccuuacacauag

SEQ ID NO: 478862 - RNA, 19 nt, Homo sapiens
uccaugcucugccugacuu

SEQ ID NO: 478863 - RNA, 19 nt, Homo sapiens
gguugugucucuugcucau

SEQ ID NO: 478864 - RNA, 19 nt, Homo sapiens
cagaagagaggagguugug

SEQ ID NO: 478865 - RNA, 19 nt, Homo sapiens
aauaggaggacccauguag

SEQ ID NO: 478866 - RNA, 19 nt, Homo sapiens
gcaggaccuucuguugaac

SEQ ID NO: 478867 - RNA, 19 nt, Homo sapiens
aggcuuaggagagagguua

SEQ ID NO: 478868 - RNA, 19 nt, Homo sapiens
guccuggccucaacagaac

SEQ ID NO: 478869 - RNA, 19 nt, Homo sapiens
gaagaccaagcagaaguaa

SEQ ID NO: 478870 - RNA, 19 nt, Homo sapiens
agaagaccaagcagaagua

SEQ ID NO: 478871 - RNA, 19 nt, Homo sapiens
gcaccagcccagcagaaga

SEQ ID NO: 478872 - RNA, 19 nt, Homo sapiens
ccugagcccugcccuucaa

SEQ ID NO: 478873 - RNA, 19 nt, Homo sapiens
cagaagaccaagcagaagu

SEQ ID NO: 478874 - RNA, 19 nt, Homo sapiens
gcagaagaccaagcagaag

SEQ ID NO: 478875 - RNA, 19 nt, Homo sapiens
gaaccaugcauccccaaaa

SEQ ID NO: 478876 - RNA, 19 nt, Homo sapiens
gaagagagacuuaagauga

SEQ ID NO: 478877 - RNA, 19 nt, Homo sapiens
gaaugaagcugaaggucuu

SEQ ID NO: 478878 - RNA, 19 nt, Homo sapiens
gacuuaagaugaaagcaaa

SEQ ID NO: 478879 - RNA, 19 nt, Homo sapiens
uaagggaccauacagagua

SEQ ID NO: 478880 - RNA, 19 nt, Homo sapiens
gaagcugaaggucuuagua

SEQ ID NO: 478881 - RNA, 19 nt, Homo sapiens
aagagagacuuaagaugaa

SEQ ID NO: 478882 - RNA, 19 nt, Homo sapiens
ugauucagcucccuuauac

SEQ ID NO: 478883 - RNA, 19 nt, Homo sapiens
cccauuaaauucacuuuca

SEQ ID NO: 478884 - RNA, 19 nt, Homo sapiens
gaguauuccucucuucaca

SEQ ID NO: 478885 - RNA, 19 nt, Homo sapiens
gaagaccaagcagaaguaa

SEQ ID NO: 478886 - RNA, 19 nt, Homo sapiens
agaccaagcagaaguaaug

SEQ ID NO: 478887 - RNA, 19 nt, Homo sapiens
uaugaagcuuucuuuccua

SEQ ID NO: 478888 - RNA, 19 nt, Homo sapiens
gcccugcccuucaauaguc

SEQ ID NO: 478889 - RNA, 19 nt, Homo sapiens
ggucuuaguaccagagcua

SEQ ID NO: 478890 - RNA, 19 nt, Homo sapiens
gaagcuuucuuuccuacac

SEQ ID NO: 478891 - RNA, 19 nt, Homo sapiens
ccacagccaugcccuugag

SEQ ID NO: 478892 - RNA, 19 nt, Homo sapiens
gaaugugcuaugaagcuuu

SEQ ID NO: 478893 - RNA, 19 nt, Homo sapiens
agagagacuuaagaugaaa

SEQ ID NO: 478894 - RNA, 19 nt, Homo sapiens
agaagaccaagcagaagua

SEQ ID NO: 478895 - RNA, 19 nt, Homo sapiens
gcaccagcccagcagaaga

SEQ ID NO: 478896 - RNA, 19 nt, Homo sapiens
ccuaucccauucuguguau

SEQ ID NO: 478897 - RNA, 19 nt, Homo sapiens
ccugagcccugcccuucaa

SEQ ID NO: 478898 - RNA, 19 nt, Homo sapiens
cuaugaagcuuucuuuccu

SEQ ID NO: 478899 - RNA, 19 nt, Homo sapiens
gugcuaugaagcuuucuuu

SEQ ID NO: 478900 - RNA, 19 nt, Homo sapiens
aaaagaaugugcuaugaag

SEQ ID NO: 478901 - RNA, 19 nt, Homo sapiens
aaaugauucagcucccuua

SEQ ID NO: 478902 - RNA, 19 nt, Homo sapiens
agacuuaagaugaaagcaa

SEQ ID NO: 478903 - RNA, 19 nt, Homo sapiens
ugaagagagacuuaagaug

SEQ ID NO: 478904 - RNA, 19 nt, Homo sapiens
caucugaagagagacuuaa

SEQ ID NO: 478905 - RNA, 19 nt, Homo sapiens
cagaagaccaagcagaagu

SEQ ID NO: 478906 - RNA, 19 nt, Homo sapiens
gagcccugcccuucaauag

SEQ ID NO: 478907 - RNA, 19 nt, Homo sapiens
agaaugugcuaugaagcuu

SEQ ID NO: 478908 - RNA, 19 nt, Homo sapiens
gcagaagaccaagcagaag

SEQ ID NO: 478909 - RNA, 19 nt, Homo sapiens
gaaccaugcauccccaaaa

SEQ ID NO: 478910 - RNA, 19 nt, Homo sapiens
aaugugcuaugaagcuuuc

SEQ ID NO: 478911 - RNA, 19 nt, Homo sapiens
ugaguucccagcagcagaa

SEQ ID NO: 478912 - RNA, 19 nt, Homo sapiens
cagcugcucagaauucauc

SEQ ID NO: 478913 - RNA, 19 nt, Homo sapiens
gcuaugaagcuuucuuucc

SEQ ID NO: 478914 - RNA, 19 nt, Homo sapiens
uaucccauucuguguauga

SEQ ID NO: 478915 - RNA, 19 nt, Homo sapiens
gaaauauccuccugugaca

SEQ ID NO: 478916 - RNA, 19 nt, Homo sapiens
caaaguauccacccaagag

SEQ ID NO: 478917 - RNA, 19 nt, Homo sapiens
gcagugccagcagaaauau

SEQ ID NO: 478918 - RNA, 19 nt, Homo sapiens
cagcagugccagcagaaau

SEQ ID NO: 478919 - RNA, 19 nt, Homo sapiens
cagaaauauccuccuguga

SEQ ID NO: 478920 - RNA, 19 nt, Homo sapiens
cacccugccagucaaagua

SEQ ID NO: 478921 - RNA, 19 nt, Homo sapiens
ucaaaguauccacccaaga

SEQ ID NO: 478922 - RNA, 19 nt, Homo sapiens
agcagugccagcagaaaua

SEQ ID NO: 478923 - RNA, 19 nt, Homo sapiens
gaaauauccuccugugaca

SEQ ID NO: 478924 - RNA, 19 nt, Homo sapiens
caaaguauccaccgaagag

SEQ ID NO: 478925 - RNA, 19 nt, Homo sapiens
gcagugccagcagaaauau

SEQ ID NO: 478926 - RNA, 19 nt, Homo sapiens
cagcagugccagcagaaau

SEQ ID NO: 478927 - RNA, 19 nt, Homo sapiens
ccaaaguauccaccgaaga

SEQ ID NO: 478928 - RNA, 19 nt, Homo sapiens
cagaaauauccuccuguga

SEQ ID NO: 478929 - RNA, 19 nt, Homo sapiens
agcagugccagcagaaaua

SEQ ID NO: 478930 - RNA, 19 nt, Homo sapiens
cacccugccagccaaagua

SEQ ID NO: 478931 - RNA, 19 nt, Homo sapiens
gaaaggauagggauaauug

SEQ ID NO: 478932 - RNA, 19 nt, Homo sapiens
ggcaugagcuucuacuauc

SEQ ID NO: 478933 - RNA, 19 nt, Homo sapiens
gaaauauccucuggugaca

SEQ ID NO: 478934 - RNA, 19 nt, Homo sapiens
uaucaacaguagcaaugua

SEQ ID NO: 478935 - RNA, 19 nt, Homo sapiens
auaauuggcucaccucguu

SEQ ID NO: 478936 - RNA, 19 nt, Homo sapiens
ccagcaggaugucuuauca

SEQ ID NO: 478937 - RNA, 19 nt, Homo sapiens
ucuacuaucugugcaauug

SEQ ID NO: 478938 - RNA, 19 nt, Homo sapiens
gcaauugucacuuuucuuu

SEQ ID NO: 478939 - RNA, 19 nt, Homo sapiens
cuaaacuccugguacuuga

SEQ ID NO: 478940 - RNA, 19 nt, Homo sapiens
ccucaugacuccuaaacuc

SEQ ID NO: 478941 - RNA, 19 nt, Homo sapiens
caggaugucuuaucaacag

SEQ ID NO: 478942 - RNA, 19 nt, Homo sapiens
ucugugcaauugucacuuu

SEQ ID NO: 478943 - RNA, 19 nt, Homo sapiens
gcaugagcuucuacuaucu

SEQ ID NO: 478944 - RNA, 19 nt, Homo sapiens
ccugugaucugcccaugau

SEQ ID NO: 478945 - RNA, 19 nt, Homo sapiens
ccaccugcaucuucucauc

SEQ ID NO: 478946 - RNA, 19 nt, Homo sapiens
gaugucuuaucaacaguag

SEQ ID NO: 478947 - RNA, 19 nt, Homo sapiens
caagagcaaguaacagcuu

SEQ ID NO: 478948 - RNA, 19 nt, Homo sapiens
caaaguguccacccaagag

SEQ ID NO: 478949 - RNA, 19 nt, Homo sapiens
ggaugucuuaucaacagua

SEQ ID NO: 478950 - RNA, 19 nt, Homo sapiens
ugggugccaucaaagaauu

SEQ ID NO: 478951 - RNA, 19 nt, Homo sapiens
ccuaaacuccugguacuug

SEQ ID NO: 478952 - RNA, 19 nt, Homo sapiens
cgaaaggauagggauaauu

SEQ ID NO: 478953 - RNA, 19 nt, Homo sapiens
ccaaaguguccacccaaga

SEQ ID NO: 478954 - RNA, 19 nt, Homo sapiens
gcagugccagcagaaauau

SEQ ID NO: 478955 - RNA, 19 nt, Homo sapiens
cacgaaaggauagggauaa

SEQ ID NO: 478956 - RNA, 19 nt, Homo sapiens
auacacagggagcuucuuu

SEQ ID NO: 478957 - RNA, 19 nt, Homo sapiens
gcaggaugucuuaucaaca

SEQ ID NO: 478958 - RNA, 19 nt, Homo sapiens
uggcaugagcuucuacuau

SEQ ID NO: 478959 - RNA, 19 nt, Homo sapiens
gguggagacugagcaaagg

SEQ ID NO: 478960 - RNA, 19 nt, Homo sapiens
cagcagugccagcagaaau

SEQ ID NO: 478961 - RNA, 19 nt, Homo sapiens
uuugaugucuucugucucu

SEQ ID NO: 478962 - RNA, 19 nt, Homo sapiens
caccuggcaugagcuucua

SEQ ID NO: 478963 - RNA, 19 nt, Homo sapiens
cagcuccaccugcaucuuc

SEQ ID NO: 478964 - RNA, 19 nt, Homo sapiens
gaugauccccgacagcaaa

SEQ ID NO: 478965 - RNA, 19 nt, Homo sapiens
agcagugccagcagaaaua

SEQ ID NO: 478966 - RNA, 19 nt, Homo sapiens
gggugccaucaaagaauua

SEQ ID NO: 478967 - RNA, 19 nt, Homo sapiens
ugugaucugcccaugauga

SEQ ID NO: 478968 - RNA, 19 nt, Homo sapiens
cauagucucucucuuauuu

SEQ ID NO: 478969 - RNA, 19 nt, Homo sapiens
gcucuucccucauuaaauu

SEQ ID NO: 478970 - RNA, 19 nt, Homo sapiens
gaccaaggcuucaucaagu

SEQ ID NO: 478971 - RNA, 19 nt, Homo sapiens
gcaaggauacaccaaaguu

SEQ ID NO: 478972 - RNA, 19 nt, Homo sapiens
caucaaaguuccugagcaa

SEQ ID NO: 478973 - RNA, 19 nt, Homo sapiens
gaauuaagcagaaagucuu

SEQ ID NO: 478974 - RNA, 19 nt, Homo sapiens
gagcaaggauacaccaaag

SEQ ID NO: 478975 - RNA, 19 nt, Homo sapiens
caaagaguguguccacgau

SEQ ID NO: 478976 - RNA, 19 nt, Homo sapiens
gccauagucucucucuuau

SEQ ID NO: 478977 - RNA, 19 nt, Homo sapiens
agaccaagcagaaguaauu

SEQ ID NO: 478978 - RNA, 19 nt, Homo sapiens
guaauuuggugcacagaca

SEQ ID NO: 478979 - RNA, 19 nt, Homo sapiens
cagcagaagcagaccuuua

SEQ ID NO: 478980 - RNA, 19 nt, Homo sapiens
ccacuaagacuuucugcuu

SEQ ID NO: 478981 - RNA, 19 nt, Homo sapiens
ucacacacacucugaagaa

SEQ ID NO: 478982 - RNA, 19 nt, Homo sapiens
gagcuuagaggauucuuca

SEQ ID NO: 478983 - RNA, 19 nt, Homo sapiens
gcuuagaggauucuucaaa

SEQ ID NO: 478984 - RNA, 19 nt, Homo sapiens
ccagagccauguccuucaa

SEQ ID NO: 478985 - RNA, 19 nt, Homo sapiens
gaagaccaagcagaaguaa

SEQ ID NO: 478986 - RNA, 19 nt, Homo sapiens
ugagccaggugccaucaaa

SEQ ID NO: 478987 - RNA, 19 nt, Homo sapiens
ccuguaagccccugaauua

SEQ ID NO: 478988 - RNA, 19 nt, Homo sapiens
agccauagucucucucuua

SEQ ID NO: 478989 - RNA, 19 nt, Homo sapiens
uuugaagcaugaguucuua

SEQ ID NO: 478990 - RNA, 19 nt, Homo sapiens
ucugaagauucgaaugaaa

SEQ ID NO: 478991 - RNA, 19 nt, Homo sapiens
aagacuuucugcuuaauuc

SEQ ID NO: 478992 - RNA, 19 nt, Homo sapiens
caucuguuucugugucuua

SEQ ID NO: 478993 - RNA, 19 nt, Homo sapiens
gaacaccucgaccuucucu

SEQ ID NO: 478994 - RNA, 19 nt, Homo sapiens
ugucuuaauugucuguaga

SEQ ID NO: 478995 - RNA, 19 nt, Homo sapiens
agaagaccaagcagaagua

SEQ ID NO: 478996 - RNA, 19 nt, Homo sapiens
caaccuggaaacacaaaga

SEQ ID NO: 478997 - RNA, 19 nt, Homo sapiens
ccaaggcuucaucaaguuu

SEQ ID NO: 478998 - RNA, 19 nt, Homo sapiens
gaccaagcagaaguaauuu

SEQ ID NO: 478999 - RNA, 19 nt, Homo sapiens
caaggagccaugccacuca

SEQ ID NO: 479000 - RNA, 19 nt, Homo sapiens
gccuccaccucaggaaaua

SEQ ID NO: 479001 - RNA, 19 nt, Homo sapiens
cuuagaggauucuucaaag

SEQ ID NO: 479002 - RNA, 19 nt, Homo sapiens
cuguuucugugucuuaauu

SEQ ID NO: 479003 - RNA, 19 nt, Homo sapiens
caaggauacaccaaaguuc

SEQ ID NO: 479004 - RNA, 19 nt, Homo sapiens
uucaggagcuuagaggauu

SEQ ID NO: 479005 - RNA, 19 nt, Homo sapiens
cagcucagcagaagaccaa

SEQ ID NO: 479006 - RNA, 19 nt, Homo sapiens
ugaccaaggcuucaucaag

SEQ ID NO: 479007 - RNA, 19 nt, Homo sapiens
gagcagcugaagaccagaa

SEQ ID NO: 479008 - RNA, 19 nt, Homo sapiens
gagaagccaaccaccagau

SEQ ID NO: 479009 - RNA, 19 nt, Homo sapiens
ccaggugccaucaaaguuc

SEQ ID NO: 479010 - RNA, 19 nt, Homo sapiens
uuccugcucuucccucauu

SEQ ID NO: 479011 - RNA, 19 nt, Homo sapiens
ugaauuaagcagaaagucu

SEQ ID NO: 479012 - RNA, 19 nt, Homo sapiens
gucucucucuuauuuguau

SEQ ID NO: 479013 - RNA, 19 nt, Homo sapiens
uagucucucucuuauuugu

SEQ ID NO: 479014 - RNA, 19 nt, Homo sapiens
cagaagaccaagcagaagu

SEQ ID NO: 479015 - RNA, 19 nt, Homo sapiens
gcagaagaccaagcagaag

SEQ ID NO: 479016 - RNA, 19 nt, Homo sapiens
ugagcaaggauacaccaaa

SEQ ID NO: 479017 - RNA, 19 nt, Homo sapiens
ccuggaaacacaaagauuc

SEQ ID NO: 479018 - RNA, 19 nt, Homo sapiens
gccaggugccaucaaaguu

SEQ ID NO: 479019 - RNA, 19 nt, Homo sapiens
cugaacaccucgaccuucu

SEQ ID NO: 479020 - RNA, 19 nt, Homo sapiens
ccucaggaaauauuuguuc

SEQ ID NO: 479021 - RNA, 19 nt, Homo sapiens
ccacgauccuuugaagcau

SEQ ID NO: 479022 - RNA, 19 nt, Homo sapiens
ggacacccucuucccaucu

SEQ ID NO: 479023 - RNA, 19 nt, Homo sapiens
accaaggcuucaucaaguu

SEQ ID NO: 479024 - RNA, 19 nt, Homo sapiens
ccacucaaagguuccacaa

SEQ ID NO: 479025 - RNA, 19 nt, Homo sapiens
cacacacacucugaagaau

SEQ ID NO: 479026 - RNA, 19 nt, Homo sapiens
gacacccucuucccaucug

SEQ ID NO: 479027 - RNA, 19 nt, Homo sapiens
ucaggagcuuagaggauuc

SEQ ID NO: 479028 - RNA, 19 nt, Homo sapiens
ccacaaccuggaaacacaa

SEQ ID NO: 479029 - RNA, 19 nt, Homo sapiens
gccaugccacucaaagguu

SEQ ID NO: 479030 - RNA, 19 nt, Homo sapiens
uguccacgauccuuugaag

SEQ ID NO: 479031 - RNA, 19 nt, Homo sapiens
gagaagacauccuaaauaa

SEQ ID NO: 479032 - RNA, 19 nt, Homo sapiens
gaagaucacugaccuagaa

SEQ ID NO: 479033 - RNA, 19 nt, Homo sapiens
ggacaaagcuuggagacua

SEQ ID NO: 479034 - RNA, 19 nt, Homo sapiens
ggagugugcugacaucuua

SEQ ID NO: 479035 - RNA, 19 nt, Homo sapiens
gaacuguacucauauaaga

SEQ ID NO: 479036 - RNA, 19 nt, Homo sapiens
uaaauaagguguugcauga

SEQ ID NO: 479037 - RNA, 19 nt, Homo sapiens
caagguagcugaugaucua

SEQ ID NO: 479038 - RNA, 19 nt, Homo sapiens
gcaccuaucugacaucauu

SEQ ID NO: 479039 - RNA, 19 nt, Homo sapiens
ggaagacgauuaugccuuu

SEQ ID NO: 479040 - RNA, 19 nt, Homo sapiens
gagggcaagucauauauua

SEQ ID NO: 479041 - RNA, 19 nt, Homo sapiens
gaagggccaugguauagua

SEQ ID NO: 479042 - RNA, 19 nt, Homo sapiens
caacagagguucaacacaa

SEQ ID NO: 479043 - RNA, 19 nt, Homo sapiens
gcaugaggccuuucuauua

SEQ ID NO: 479044 - RNA, 19 nt, Homo sapiens
gaucauaacuguagacaag

SEQ ID NO: 479045 - RNA, 19 nt, Homo sapiens
gcaccgaaguucugcauaa

SEQ ID NO: 479046 - RNA, 19 nt, Homo sapiens
ggagaaagucaauaucuua

SEQ ID NO: 479047 - RNA, 19 nt, Homo sapiens
ccacacauaugcagcaaua

SEQ ID NO: 479048 - RNA, 19 nt, Homo sapiens
gaaggaaccuauuguagau

SEQ ID NO: 479049 - RNA, 19 nt, Homo sapiens
ggagaagacauccuaaaua

SEQ ID NO: 479050 - RNA, 19 nt, Homo sapiens
gggagaagcucaaagaguu

SEQ ID NO: 479051 - RNA, 19 nt, Homo sapiens
ucaaggaccugaauacauu

SEQ ID NO: 479052 - RNA, 19 nt, Homo sapiens
ggagaagggugaccaguug

SEQ ID NO: 479053 - RNA, 19 nt, Homo sapiens
ggaaguggaucauggagaa

SEQ ID NO: 479054 - RNA, 19 nt, Homo sapiens
acucagagcuugcuaauga

SEQ ID NO: 479055 - RNA, 19 nt, Homo sapiens
ucacugaccuagaacauuu

SEQ ID NO: 479056 - RNA, 19 nt, Homo sapiens
gcucagaucuguucagugu

SEQ ID NO: 479057 - RNA, 19 nt, Homo sapiens
gaaauaggccauccugauu

SEQ ID NO: 479058 - RNA, 19 nt, Homo sapiens
uuacagaccuggcugcaua

SEQ ID NO: 479059 - RNA, 19 nt, Homo sapiens
ggaaauaucagaagcauca

SEQ ID NO: 479060 - RNA, 19 nt, Homo sapiens
ggacucagaugaccuaaag

SEQ ID NO: 479061 - RNA, 19 nt, Homo sapiens
caaguccagugaugaaaua

SEQ ID NO: 479062 - RNA, 19 nt, Homo sapiens
caagacaggucaagaacuu

SEQ ID NO: 479063 - RNA, 19 nt, Homo sapiens
uaaaugaggcccagaaauu

SEQ ID NO: 479064 - RNA, 19 nt, Homo sapiens
gcagagaagcugacacuuu

SEQ ID NO: 479065 - RNA, 19 nt, Homo sapiens
guccaaugcugcaaacuua

SEQ ID NO: 479066 - RNA, 19 nt, Homo sapiens
cagagaagcugaaagacaa

SEQ ID NO: 479067 - RNA, 19 nt, Homo sapiens
ggaacuagaugauguuugg

SEQ ID NO: 479068 - RNA, 19 nt, Homo sapiens
ggaagaaucccuagaauac

SEQ ID NO: 479069 - RNA, 19 nt, Homo sapiens
ggagcuggccgaagacuua

SEQ ID NO: 479070 - RNA, 19 nt, Homo sapiens
cuaaagaacuggaucaaca

SEQ ID NO: 479071 - RNA, 19 nt, Homo sapiens
caacaagcguuuccugaau

SEQ ID NO: 479072 - RNA, 19 nt, Homo sapiens
ggagauagaaagguuaaua

SEQ ID NO: 479073 - RNA, 19 nt, Homo sapiens
ccacuaacauucagaggaa

SEQ ID NO: 479074 - RNA, 19 nt, Homo sapiens
ggacuucagugcagaacuu

SEQ ID NO: 479075 - RNA, 19 nt, Homo sapiens
gaaaaggaguuggcaguua

SEQ ID NO: 479076 - RNA, 19 nt, Homo sapiens
gcagagggcaagucauaua

SEQ ID NO: 479077 - RNA, 19 nt, Homo sapiens
ggacuuaaguuggaagaau

SEQ ID NO: 479078 - RNA, 19 nt, Homo sapiens
guaaggagagccuaaauga

SEQ ID NO: 479079 - RNA, 19 nt, Homo sapiens
ggaaauacuugacaacaac

SEQ ID NO: 479080 - RNA, 19 nt, Homo sapiens
cagagaagcugacacuuuc

SEQ ID NO: 479081 - RNA, 19 nt, Homo sapiens
caaacgaaaucaagacuca

SEQ ID NO: 479082 - RNA, 19 nt, Homo sapiens
gaacaugagcccaaguuug

SEQ ID NO: 479083 - RNA, 19 nt, Homo sapiens
gaagaaacgggacgauuug

SEQ ID NO: 479084 - RNA, 19 nt, Homo sapiens
ggagggaguugcuggagaa

SEQ ID NO: 479085 - RNA, 19 nt, Homo sapiens
ucagaagcaugaagacuuu

SEQ ID NO: 479086 - RNA, 19 nt, Homo sapiens
ggaagacgcucugauccuu

SEQ ID NO: 479087 - RNA, 19 nt, Homo sapiens
gagcuagaccagcagauua

SEQ ID NO: 479088 - RNA, 19 nt, Homo sapiens
gaagacauccuaaauaagg

SEQ ID NO: 479089 - RNA, 19 nt, Homo sapiens
caggaaaccuacucaagaa

SEQ ID NO: 479090 - RNA, 19 nt, Homo sapiens
gaucauugcucaaagaaac

SEQ ID NO: 479091 - RNA, 19 nt, Homo sapiens
ggaucuagaugaugaggaa

SEQ ID NO: 479092 - RNA, 19 nt, Homo sapiens
caagaagcaucagcuauug

SEQ ID NO: 479093 - RNA, 19 nt, Homo sapiens
gcaggaaaccuacucaaga

SEQ ID NO: 479094 - RNA, 19 nt, Homo sapiens
aagcacaacugauugauga

SEQ ID NO: 479095 - RNA, 19 nt, Homo sapiens
gaacauugccagccaugaa

SEQ ID NO: 479096 - RNA, 19 nt, Homo sapiens
agacaagacugcaaccaaa

SEQ ID NO: 479097 - RNA, 19 nt, Homo sapiens
caagcagacuuuaaauguu

SEQ ID NO: 479098 - RNA, 19 nt, Homo sapiens
gaaagaccaugaggacuuc

SEQ ID NO: 479099 - RNA, 19 nt, Homo sapiens
gagaagaucauaacuguag

SEQ ID NO: 479100 - RNA, 19 nt, Homo sapiens
gaaccaauaugccaaugag

SEQ ID NO: 479101 - RNA, 19 nt, Homo sapiens
ucugggaacuguacucaua

SEQ ID NO: 479102 - RNA, 19 nt, Homo sapiens
ucacugaccugaaggacaa

SEQ ID NO: 479103 - RNA, 19 nt, Homo sapiens
ggaaacagcagaagagauc

SEQ ID NO: 479104 - RNA, 19 nt, Homo sapiens
caaagacgccacuaacauu

SEQ ID NO: 479105 - RNA, 19 nt, Homo sapiens
ggaaaggaccugauugcuu

SEQ ID NO: 479106 - RNA, 19 nt, Homo sapiens
agcaugagauugacucuua

SEQ ID NO: 479107 - RNA, 19 nt, Homo sapiens
aggcaaauguggaagauaa

SEQ ID NO: 479108 - RNA, 19 nt, Homo sapiens
agaaauugcuggagaaaca

SEQ ID NO: 479109 - RNA, 19 nt, Homo sapiens
gagauaaggugaccauacu

SEQ ID NO: 479110 - RNA, 19 nt, Homo sapiens
uaugaagacccaacuaaua

SEQ ID NO: 479111 - RNA, 19 nt, Homo sapiens
guaaagaagggccauggua

SEQ ID NO: 479112 - RNA, 19 nt, Homo sapiens
gaaccacgcauucaagaga

SEQ ID NO: 479113 - RNA, 19 nt, Homo sapiens
gucagaagcuugaggauuc

SEQ ID NO: 479114 - RNA, 19 nt, Homo sapiens
uacauuggcugaagauuug

SEQ ID NO: 479115 - RNA, 19 nt, Homo sapiens
ggacaguuccauuugaauu

SEQ ID NO: 479116 - RNA, 19 nt, Homo sapiens
aaacauggaucagagagaa

SEQ ID NO: 479117 - RNA, 19 nt, Homo sapiens
gacaguuccauuugaauua

SEQ ID NO: 479118 - RNA, 19 nt, Homo sapiens
aagcagaggugcaaacgaa

SEQ ID NO: 479119 - RNA, 19 nt, Homo sapiens
gccaguaccuuccuucaau

SEQ ID NO: 479120 - RNA, 19 nt, Homo sapiens
aaacaagccuaaagaccaa

SEQ ID NO: 479121 - RNA, 19 nt, Homo sapiens
gcaauuggaagacgauuau

SEQ ID NO: 479122 - RNA, 19 nt, Homo sapiens
gauguuggcucgagaggau

SEQ ID NO: 479123 - RNA, 19 nt, Homo sapiens
gaaaggugaugucuuaacg

SEQ ID NO: 479124 - RNA, 19 nt, Homo sapiens
uaacuauggugcugaugaa

SEQ ID NO: 479125 - RNA, 19 nt, Homo sapiens
gaagagaagaucauaacug

SEQ ID NO: 479126 - RNA, 19 nt, Homo sapiens
agacauugcuggccaugaa

SEQ ID NO: 479127 - RNA, 19 nt, Homo sapiens
ugaagaaacgggacgauuu

SEQ ID NO: 479128 - RNA, 19 nt, Homo sapiens
cgaaggagcagauugagaa

SEQ ID NO: 479129 - RNA, 19 nt, Homo sapiens
gcagaggcuugcagaugaa

SEQ ID NO: 479130 - RNA, 19 nt, Homo sapiens
ucaacaagguagcugauga

SEQ ID NO: 479131 - RNA, 19 nt, Homo sapiens
gcaaagaucuuaccaaugu

SEQ ID NO: 479132 - RNA, 19 nt, Homo sapiens
gcaagaagcuguccgauga

SEQ ID NO: 479133 - RNA, 19 nt, Homo sapiens
caacagagguaaggauuua

SEQ ID NO: 479134 - RNA, 19 nt, Homo sapiens
gagaggaacugauuacaaa

SEQ ID NO: 479135 - RNA, 19 nt, Homo sapiens
gcaaagaccuggcuucugu

SEQ ID NO: 479136 - RNA, 19 nt, Homo sapiens
gacaagaccucauuaagaa

SEQ ID NO: 479137 - RNA, 19 nt, Homo sapiens
gaagaaacaugcccugcua

SEQ ID NO: 479138 - RNA, 19 nt, Homo sapiens
caacaucacugcccucaaa

SEQ ID NO: 479139 - RNA, 19 nt, Homo sapiens
gaagaagccuggaucaaug

SEQ ID NO: 479140 - RNA, 19 nt, Homo sapiens
gaacagagauggccauguc

SEQ ID NO: 479141 - RNA, 19 nt, Homo sapiens
gcaagaaguuuauguuguu

SEQ ID NO: 479142 - RNA, 19 nt, Homo sapiens
aaagaaacaucaagccuua

SEQ ID NO: 479143 - RNA, 19 nt, Homo sapiens
ugaaugaggugaucaguuu

SEQ ID NO: 479144 - RNA, 19 nt, Homo sapiens
ccacagagaugcugaugaa

SEQ ID NO: 479145 - RNA, 19 nt, Homo sapiens
ggacaagaccucauuaaga

SEQ ID NO: 479146 - RNA, 19 nt, Homo sapiens
caaccaagcuaauucagaa

SEQ ID NO: 479147 - RNA, 19 nt, Homo sapiens
gcacgaagacuuugagaaa

SEQ ID NO: 479148 - RNA, 19 nt, Homo sapiens
cagaugagcuugccaguga

SEQ ID NO: 479149 - RNA, 19 nt, Homo sapiens
gcacaagggugaaauugau

SEQ ID NO: 479150 - RNA, 19 nt, Homo sapiens
gaauucagcaugauguuua

SEQ ID NO: 479151 - RNA, 19 nt, Homo sapiens
gaaucaagcucuaaacaca

SEQ ID NO: 479152 - RNA, 19 nt, Homo sapiens
gaagaaacaugaagcuuuu

SEQ ID NO: 479153 - RNA, 19 nt, Homo sapiens
gagccaagcugaaugaauc

SEQ ID NO: 479154 - RNA, 19 nt, Homo sapiens
gagacuaucaguuggauua

SEQ ID NO: 479155 - RNA, 19 nt, Homo sapiens
gaagaaacacgaagcuuug

SEQ ID NO: 479156 - RNA, 19 nt, Homo sapiens
ugaagcagcugcccucauu

SEQ ID NO: 479157 - RNA, 19 nt, Homo sapiens
gagaagaguugcaagaagu

SEQ ID NO: 479158 - RNA, 19 nt, Homo sapiens
guaaaggcauguuggagaa

SEQ ID NO: 479159 - RNA, 19 nt, Homo sapiens
ggaaguguauggcaugaug

SEQ ID NO: 479160 - RNA, 19 nt, Homo sapiens
caacaaggauugguggaaa

SEQ ID NO: 479161 - RNA, 19 nt, Homo sapiens
gaacaaccacuaugcaaug

SEQ ID NO: 479162 - RNA, 19 nt, Homo sapiens
cugaagagcuggagaaaug

SEQ ID NO: 479163 - RNA, 19 nt, Homo sapiens
ccacugaacugaaaggaau

SEQ ID NO: 479164 - RNA, 19 nt, Homo sapiens
gaagaaagaguuaaugaag

SEQ ID NO: 479165 - RNA, 19 nt, Homo sapiens
gaaaagagccagaaacuga

SEQ ID NO: 479166 - RNA, 19 nt, Homo sapiens
gaaggacauuaacaaggua

SEQ ID NO: 479167 - RNA, 19 nt, Homo sapiens
ucaaagagaugcugaagag

SEQ ID NO: 479168 - RNA, 19 nt, Homo sapiens
gaaggaagccgcucugaca

SEQ ID NO: 479169 - RNA, 19 nt, Homo sapiens
ucagaagcaucaagcauuu

SEQ ID NO: 479170 - RNA, 19 nt, Homo sapiens
gauauugaauuguggcuau

SEQ ID NO: 479171 - RNA, 19 nt, Homo sapiens
gcaauuuaaucgcaauguu

SEQ ID NO: 479172 - RNA, 19 nt, Homo sapiens
ccacaaggaucgcgugaau

SEQ ID NO: 479173 - RNA, 19 nt, Homo sapiens
gacaugaucucgccagugu

SEQ ID NO: 479174 - RNA, 19 nt, Homo sapiens
gaagucugcucgucugaug

SEQ ID NO: 479175 - RNA, 19 nt, Homo sapiens
uggaagaaaucaaagcuuu

SEQ ID NO: 479176 - RNA, 19 nt, Homo sapiens
gaaaggcgaacguggauga

SEQ ID NO: 479177 - RNA, 19 nt, Homo sapiens
gaagaacaaucaccaugag

SEQ ID NO: 479178 - RNA, 19 nt, Homo sapiens
agaaauugcuggacaugaa

SEQ ID NO: 479179 - RNA, 19 nt, Homo sapiens
gaacuuggugcaguacuua

SEQ ID NO: 479180 - RNA, 19 nt, Homo sapiens
ggaagaagccuggaucaau

SEQ ID NO: 479181 - RNA, 19 nt, Homo sapiens
cagaugagcuagccaagga

SEQ ID NO: 479182 - RNA, 19 nt, Homo sapiens
ucaaagcaguuacacagaa

SEQ ID NO: 479183 - RNA, 19 nt, Homo sapiens
ggagaaagcuggccaaaag

SEQ ID NO: 479184 - RNA, 19 nt, Homo sapiens
cugaugagcucaagaguug

SEQ ID NO: 479185 - RNA, 19 nt, Homo sapiens
cgggaggccuucuugaaua

SEQ ID NO: 479186 - RNA, 19 nt, Homo sapiens
ggaaaagauuacagcauua

SEQ ID NO: 479187 - RNA, 19 nt, Homo sapiens
gucagaagcuggaagauuc

SEQ ID NO: 479188 - RNA, 19 nt, Homo sapiens
gggaggcacugaaagcaaa

SEQ ID NO: 479189 - RNA, 19 nt, Homo sapiens
ccacagaugaagcuuauaa

SEQ ID NO: 479190 - RNA, 19 nt, Homo sapiens
ggaagaguccuuggaauau

SEQ ID NO: 479191 - RNA, 19 nt, Homo sapiens
ggagaagaguugcaagaag

SEQ ID NO: 479192 - RNA, 19 nt, Homo sapiens
acacgaagcuuugauguca

SEQ ID NO: 479193 - RNA, 19 nt, Homo sapiens
ggucaaagcuaggagaauc

SEQ ID NO: 479194 - RNA, 19 nt, Homo sapiens
gcccugagaucaagcagaa

SEQ ID NO: 479195 - RNA, 19 nt, Homo sapiens
aagaauggauugaagagaa

SEQ ID NO: 479196 - RNA, 19 nt, Homo sapiens
ugaaauugaugcccaugaa

SEQ ID NO: 479197 - RNA, 19 nt, Homo sapiens
agaaagaguuaaugaagug

SEQ ID NO: 479198 - RNA, 19 nt, Homo sapiens
ucacugcccucaaagauca

SEQ ID NO: 479199 - RNA, 19 nt, Homo sapiens
gaagaguccuuggaauauc

SEQ ID NO: 479200 - RNA, 19 nt, Homo sapiens
uggaagaacuauaucauuc

SEQ ID NO: 479201 - RNA, 19 nt, Homo sapiens
ggagauauccuuaccuuac

SEQ ID NO: 479202 - RNA, 19 nt, Homo sapiens
ggagauuucuuggauagug

SEQ ID NO: 479203 - RNA, 19 nt, Homo sapiens
gcugaagcccugcuagaua

SEQ ID NO: 479204 - RNA, 19 nt, Homo sapiens
gaagcgagaggaacugauu

SEQ ID NO: 479205 - RNA, 19 nt, Homo sapiens
gcucagagggaaagccuua

SEQ ID NO: 479206 - RNA, 19 nt, Homo sapiens
ccaaacacguucaguccaa

SEQ ID NO: 479207 - RNA, 19 nt, Homo sapiens
ugaagaaacaugaagcuuu

SEQ ID NO: 479208 - RNA, 19 nt, Homo sapiens
cggcaaagaucuuaccaau

SEQ ID NO: 479209 - RNA, 19 nt, Homo sapiens
caaccacuaugcaauggaa

SEQ ID NO: 479210 - RNA, 19 nt, Homo sapiens
gcacgagggucuggagaga

SEQ ID NO: 479211 - RNA, 19 nt, Homo sapiens
uaagaagcacgaagacuuu

SEQ ID NO: 479212 - RNA, 19 nt, Homo sapiens
uuaaugaagugaaccaguu

SEQ ID NO: 479213 - RNA, 19 nt, Homo sapiens
cuacagcaauggaucaaug

SEQ ID NO: 479214 - RNA, 19 nt, Homo sapiens
gcagguggaagaacuauau

SEQ ID NO: 479215 - RNA, 19 nt, Homo sapiens
caaccaacuugcagggaaa

SEQ ID NO: 479216 - RNA, 19 nt, Homo sapiens
ggacaugaaccacgcauca

SEQ ID NO: 479217 - RNA, 19 nt, Homo sapiens
gaauugaugccuuggagaa

SEQ ID NO: 479218 - RNA, 19 nt, Homo sapiens
agauauggcugcucaugaa

SEQ ID NO: 479219 - RNA, 19 nt, Homo sapiens
gcuugaagacagaugauua

SEQ ID NO: 479220 - RNA, 19 nt, Homo sapiens
ugaaggacauuaacaaggu

SEQ ID NO: 479221 - RNA, 19 nt, Homo sapiens
ugaagaaacacgaagcuuu

SEQ ID NO: 479222 - RNA, 19 nt, Homo sapiens
gaaguggcagcucguauga

SEQ ID NO: 479223 - RNA, 19 nt, Homo sapiens
gcagcagcauccaggcuuu

SEQ ID NO: 479224 - RNA, 19 nt, Homo sapiens
gcauggaccugcagcucuu

SEQ ID NO: 479225 - RNA, 19 nt, Homo sapiens
gcucaugaagaaagaguua

SEQ ID NO: 479226 - RNA, 19 nt, Homo sapiens
aggaggagcucuaccagaa

SEQ ID NO: 479227 - RNA, 19 nt, Homo sapiens
gaaacacgaagcuuugaug

SEQ ID NO: 479228 - RNA, 19 nt, Homo sapiens
cagaugaagcuuauaaaga

SEQ ID NO: 479229 - RNA, 19 nt, Homo sapiens
gaaguucagcgcuuuaaca

SEQ ID NO: 479230 - RNA, 19 nt, Homo sapiens
gaaauccgagccaugagaa

SEQ ID NO: 479231 - RNA, 19 nt, Homo sapiens
gaaagcagcugauggauga

SEQ ID NO: 479232 - RNA, 19 nt, Homo sapiens
ggaaagagaugaaugagaa

SEQ ID NO: 479233 - RNA, 19 nt, Homo sapiens
gcaaagaccugaccagugu

SEQ ID NO: 479234 - RNA, 19 nt, Homo sapiens
gcacgaaaccuucacaaua

SEQ ID NO: 479235 - RNA, 19 nt, Homo sapiens
ggacaaggcucuccaguuc

SEQ ID NO: 479236 - RNA, 19 nt, Homo sapiens
gcacuaaucugcaaacugu

SEQ ID NO: 479237 - RNA, 19 nt, Homo sapiens
gcagggaggugaagcagua

SEQ ID NO: 479238 - RNA, 19 nt, Homo sapiens
gacaugacguuauuaguuu

SEQ ID NO: 479239 - RNA, 19 nt, Homo sapiens
gaacagaucaucagacuuc

SEQ ID NO: 479240 - RNA, 19 nt, Homo sapiens
gcaaggaccugaccagugu

SEQ ID NO: 479241 - RNA, 19 nt, Homo sapiens
cacgaaaccuucacaauaa

SEQ ID NO: 479242 - RNA, 19 nt, Homo sapiens
gaacaucgaugcggaagga

SEQ ID NO: 479243 - RNA, 19 nt, Homo sapiens
gggaggagaugcagacuug

SEQ ID NO: 479244 - RNA, 19 nt, Homo sapiens
gcaaguggaucacggacaa

SEQ ID NO: 479245 - RNA, 19 nt, Homo sapiens
ggaaaacccugaugagaaa

SEQ ID NO: 479246 - RNA, 19 nt, Homo sapiens
gaacuaccaugaccagaag

SEQ ID NO: 479247 - RNA, 19 nt, Homo sapiens
gcacaaggccuuugaggau

SEQ ID NO: 479248 - RNA, 19 nt, Homo sapiens
ccagugacaugacguuauu

SEQ ID NO: 479249 - RNA, 19 nt, Homo sapiens
ggacacggcggauaaauuc

SEQ ID NO: 479250 - RNA, 19 nt, Homo sapiens
ggaagaagcagcuggaauc

SEQ ID NO: 479251 - RNA, 19 nt, Homo sapiens
ggaggaaagagaugaauga

SEQ ID NO: 479252 - RNA, 19 nt, Homo sapiens
gcagggauccuuccaugaa

SEQ ID NO: 479253 - RNA, 19 nt, Homo sapiens
gcgggaaguuguucagaaa

SEQ ID NO: 479254 - RNA, 19 nt, Homo sapiens
agagagaccuggcucaaug

SEQ ID NO: 479255 - RNA, 19 nt, Homo sapiens
agaaauccaucaucaccua

SEQ ID NO: 479256 - RNA, 19 nt, Homo sapiens
ucaccgaucucuacaagga

SEQ ID NO: 479257 - RNA, 19 nt, Homo sapiens
ucaaucggauguuggcuaa

SEQ ID NO: 479258 - RNA, 19 nt, Homo sapiens
cagacaagaucaaggagaa

SEQ ID NO: 479259 - RNA, 19 nt, Homo sapiens
ccucuugucugccgaguuu

SEQ ID NO: 479260 - RNA, 19 nt, Homo sapiens
guuaaugucaccaacuuua

SEQ ID NO: 479261 - RNA, 19 nt, Homo sapiens
acgacgagcuggauaauga

SEQ ID NO: 479262 - RNA, 19 nt, Homo sapiens
ucaggaaggucgugaaaca

SEQ ID NO: 479263 - RNA, 19 nt, Homo sapiens
uggaacugcucaugaagua

SEQ ID NO: 479264 - RNA, 19 nt, Homo sapiens
ccaaacgacucuggaaguu

SEQ ID NO: 479265 - RNA, 19 nt, Homo sapiens
ugacaugacguuauuaguu

SEQ ID NO: 479266 - RNA, 19 nt, Homo sapiens
gcagaucagccgggacuua

SEQ ID NO: 479267 - RNA, 19 nt, Homo sapiens
agaagcagcuggaaucauc

SEQ ID NO: 479268 - RNA, 19 nt, Homo sapiens
agaaagagaacuaccauga

SEQ ID NO: 479269 - RNA, 19 nt, Homo sapiens
uaaaggccuuggcagauga

SEQ ID NO: 479270 - RNA, 19 nt, Homo sapiens
ccaggaugcugagaacuuu

SEQ ID NO: 479271 - RNA, 19 nt, Homo sapiens
gaccugaucgacuuugaua

SEQ ID NO: 479272 - RNA, 19 nt, Homo sapiens
ccaccacgcuugagcugaa

SEQ ID NO: 479273 - RNA, 19 nt, Homo sapiens
ugaaggacguggcggaaga

SEQ ID NO: 479274 - RNA, 19 nt, Homo sapiens
ccaaugaggcacagcagua

SEQ ID NO: 479275 - RNA, 19 nt, Homo sapiens
gugcaacuguucaugaaga

SEQ ID NO: 479276 - RNA, 19 nt, Homo sapiens
gagacaaccuggagcuaca

SEQ ID NO: 479277 - RNA, 19 nt, Homo sapiens
ggaaaccuauacucagaca

SEQ ID NO: 479278 - RNA, 19 nt, Homo sapiens
gaaguuugaggauuucuug

SEQ ID NO: 479279 - RNA, 19 nt, Homo sapiens
gagaugaagaccuugauga

SEQ ID NO: 479280 - RNA, 19 nt, Homo sapiens
agaaggagcagaucuauuc

SEQ ID NO: 479281 - RNA, 19 nt, Homo sapiens
gcaggcuacccucauguua

SEQ ID NO: 479282 - RNA, 19 nt, Homo sapiens
cuaagagccugcugacaug

SEQ ID NO: 479283 - RNA, 19 nt, Homo sapiens
ucacugagguguucuucau

SEQ ID NO: 479284 - RNA, 19 nt, Homo sapiens
caugaaggguggcuagaga

SEQ ID NO: 479285 - RNA, 19 nt, Homo sapiens
uuugagaggucccggauaa

SEQ ID NO: 479286 - RNA, 19 nt, Homo sapiens
uugaagaccugcuacagaa

SEQ ID NO: 479287 - RNA, 19 nt, Homo sapiens
gagcuggcccugagaaaug

SEQ ID NO: 479288 - RNA, 19 nt, Homo sapiens
ccacagaguuugaaaaugu

SEQ ID NO: 479289 - RNA, 19 nt, Homo sapiens
gcuaagagccugcugacau

SEQ ID NO: 479290 - RNA, 19 nt, Homo sapiens
uggagaagcucaucaagag

SEQ ID NO: 479291 - RNA, 19 nt, Homo sapiens
gcugaggcguggcugauug

SEQ ID NO: 479292 - RNA, 19 nt, Homo sapiens
gaacugcucaugaaguauc

SEQ ID NO: 479293 - RNA, 19 nt, Homo sapiens
gggaacagaucaucagacu

SEQ ID NO: 479294 - RNA, 19 nt, Homo sapiens
gagccaagcugcagaucag

SEQ ID NO: 479295 - RNA, 19 nt, Homo sapiens
cucaggagcuggagaaaga

SEQ ID NO: 479296 - RNA, 19 nt, Homo sapiens
gcugaaagaacgccagauu

SEQ ID NO: 479297 - RNA, 19 nt, Homo sapiens
gacaauauacugcgccuau

SEQ ID NO: 479298 - RNA, 19 nt, Homo sapiens
gaccaucacuguccugaac

SEQ ID NO: 479299 - RNA, 19 nt, Homo sapiens
gggcucccaugacauugua

SEQ ID NO: 479300 - RNA, 19 nt, Homo sapiens
ccagggaugucuccucugu

SEQ ID NO: 479301 - RNA, 19 nt, Homo sapiens
caggauaacuuuggguaug

SEQ ID NO: 479302 - RNA, 19 nt, Homo sapiens
ccaacaaucagaaagugua

SEQ ID NO: 479303 - RNA, 19 nt, Homo sapiens
uuaaugcccugauacacaa

SEQ ID NO: 479304 - RNA, 19 nt, Homo sapiens
ucaagaggcaugaggcuuu

SEQ ID NO: 479305 - RNA, 19 nt, Homo sapiens
ggaugucuccuaugaugaa

SEQ ID NO: 479306 - RNA, 19 nt, Homo sapiens
ggaggccucuguccuacug

SEQ ID NO: 479307 - RNA, 19 nt, Homo sapiens
ggccuuuaaugcccugaua

SEQ ID NO: 479308 - RNA, 19 nt, Homo sapiens
gauaaauuccgcuucuuca

SEQ ID NO: 479309 - RNA, 19 nt, Homo sapiens
agaaguggcuggccgagau

SEQ ID NO: 479310 - RNA, 19 nt, Homo sapiens
gcaagcacaaggccuuuga

SEQ ID NO: 479311 - RNA, 19 nt, Homo sapiens
ccagugugcucaucuuaca

SEQ ID NO: 479312 - RNA, 19 nt, Homo sapiens
agacugagaagaugauuga

SEQ ID NO: 479313 - RNA, 19 nt, Homo sapiens
ggccucaucuggaccauca

SEQ ID NO: 479314 - RNA, 19 nt, Homo sapiens
cagaggagauccgcgagaa

SEQ ID NO: 479315 - RNA, 19 nt, Homo sapiens
ggauaaauuccgcuucuuc

SEQ ID NO: 479316 - RNA, 19 nt, Homo sapiens
gauaaaggccuuggcagau

SEQ ID NO: 479317 - RNA, 19 nt, Homo sapiens
aaacgacucuggaaguucu

SEQ ID NO: 479318 - RNA, 19 nt, Homo sapiens
gaaaccuucacaauaaaug

SEQ ID NO: 479319 - RNA, 19 nt, Homo sapiens
aaacaggccagcccaguga

SEQ ID NO: 479320 - RNA, 19 nt, Homo sapiens
ggaaauggggcaagacuuu

SEQ ID NO: 479321 - RNA, 19 nt, Homo sapiens
gagaaggugcagcugauug

SEQ ID NO: 479322 - RNA, 19 nt, Homo sapiens
gaccagugugcucaucuua

SEQ ID NO: 479323 - RNA, 19 nt, Homo sapiens
cuggagagaugcugccaaa

SEQ ID NO: 479324 - RNA, 19 nt, Homo sapiens
ugacaucggccacagaguu

SEQ ID NO: 479325 - RNA, 19 nt, Homo sapiens
ggaugucuccucuguggaa

SEQ ID NO: 479326 - RNA, 19 nt, Homo sapiens
cagaggccauccagaacaa

SEQ ID NO: 479327 - RNA, 19 nt, Homo sapiens
gaagaagcagcuggaauca

SEQ ID NO: 479328 - RNA, 19 nt, Homo sapiens
ccaagugaaugugcggaaa

SEQ ID NO: 479329 - RNA, 19 nt, Homo sapiens
cacaauaaauggcuaaagc

SEQ ID NO: 479330 - RNA, 19 nt, Homo sapiens
caaccgggauaaggucuug

SEQ ID NO: 479331 - RNA, 19 nt, Homo sapiens
cggaagagaucgccaauua

SEQ ID NO: 479332 - RNA, 19 nt, Homo sapiens
ggacaugucuuacgaugaa

SEQ ID NO: 479333 - RNA, 19 nt, Homo sapiens
gaagaaaucugccaaggau

SEQ ID NO: 479334 - RNA, 19 nt, Homo sapiens
caacagggaucuacagaaa

SEQ ID NO: 479335 - RNA, 19 nt, Homo sapiens
ggaaagaaaugaucgacaa

SEQ ID NO: 479336 - RNA, 19 nt, Homo sapiens
ccaaagagauccaucaguu

SEQ ID NO: 479337 - RNA, 19 nt, Homo sapiens
ggagaaaccacccaaauuu

SEQ ID NO: 479338 - RNA, 19 nt, Homo sapiens
gaacaaaccaucaucauuc

SEQ ID NO: 479339 - RNA, 19 nt, Homo sapiens
ggaacgagcuccacaagau

SEQ ID NO: 479340 - RNA, 19 nt, Homo sapiens
ugaaagaccuugcugaaga

SEQ ID NO: 479341 - RNA, 19 nt, Homo sapiens
gaugagaaguccauaauca

SEQ ID NO: 479342 - RNA, 19 nt, Homo sapiens
gcucagaaccaacacauua

SEQ ID NO: 479343 - RNA, 19 nt, Homo sapiens
gagaaaccacccaaauuua

SEQ ID NO: 479344 - RNA, 19 nt, Homo sapiens
gaaaggugcuugacaaugc

SEQ ID NO: 479345 - RNA, 19 nt, Homo sapiens
ggccugaccugauagauuu

SEQ ID NO: 479346 - RNA, 19 nt, Homo sapiens
gaagagcaccgacgaggua

SEQ ID NO: 479347 - RNA, 19 nt, Homo sapiens
gaagcaagccgaagccuuu

SEQ ID NO: 479348 - RNA, 19 nt, Homo sapiens
gaacaaaggacgagcucua

SEQ ID NO: 479349 - RNA, 19 nt, Homo sapiens
ggacaaagagaaagacaaa

SEQ ID NO: 479350 - RNA, 19 nt, Homo sapiens
guaaaugguugaagcauca

SEQ ID NO: 479351 - RNA, 19 nt, Homo sapiens
gaacuugcauccaacaaag

SEQ ID NO: 479352 - RNA, 19 nt, Homo sapiens
agacagacauugccgcaua

SEQ ID NO: 479353 - RNA, 19 nt, Homo sapiens
caacggcgcuacagaacaa

SEQ ID NO: 479354 - RNA, 19 nt, Homo sapiens
gaaaugaaggugcuaguau

SEQ ID NO: 479355 - RNA, 19 nt, Homo sapiens
ggacacucuugcccaaaua

SEQ ID NO: 479356 - RNA, 19 nt, Homo sapiens
gugcagaucuagacaaaug

SEQ ID NO: 479357 - RNA, 19 nt, Homo sapiens
caaagacgaugaggaaaug

SEQ ID NO: 479358 - RNA, 19 nt, Homo sapiens
uggaaaggcugacuacauu

SEQ ID NO: 479359 - RNA, 19 nt, Homo sapiens
ucaaucaccuggcagauga

SEQ ID NO: 479360 - RNA, 19 nt, Homo sapiens
gaagagaucgccaauuaca

SEQ ID NO: 479361 - RNA, 19 nt, Homo sapiens
gaacuggcuuugcggaaug

SEQ ID NO: 479362 - RNA, 19 nt, Homo sapiens
aaacacguauucaagcuaa

SEQ ID NO: 479363 - RNA, 19 nt, Homo sapiens
gaagaaacacguauucaag

SEQ ID NO: 479364 - RNA, 19 nt, Homo sapiens
caucaacucuggacauuca

SEQ ID NO: 479365 - RNA, 19 nt, Homo sapiens
ggaaggauggccucaauga

SEQ ID NO: 479366 - RNA, 19 nt, Homo sapiens
gagcagagaguccaucuug

SEQ ID NO: 479367 - RNA, 19 nt, Homo sapiens
guggagaccuuacagagaa

SEQ ID NO: 479368 - RNA, 19 nt, Homo sapiens
gaacacaguggagaccuua

SEQ ID NO: 479369 - RNA, 19 nt, Homo sapiens
acagggaucuacagaaauu

SEQ ID NO: 479370 - RNA, 19 nt, Homo sapiens
gugcagcuguuaauaaaga

SEQ ID NO: 479371 - RNA, 19 nt, Homo sapiens
ggaagaaggagaucgaaga

SEQ ID NO: 479372 - RNA, 19 nt, Homo sapiens
agaaauuccugcaagauug

SEQ ID NO: 479373 - RNA, 19 nt, Homo sapiens
caacaaggccugggaaaga

SEQ ID NO: 479374 - RNA, 19 nt, Homo sapiens
cuuauguggugacuuauua

SEQ ID NO: 479375 - RNA, 19 nt, Homo sapiens
gcauugaacuugggaaauc

SEQ ID NO: 479376 - RNA, 19 nt, Homo sapiens
cagagaagcuggaggaucu

SEQ ID NO: 479377 - RNA, 19 nt, Homo sapiens
ggagauggcagaagaggaa

SEQ ID NO: 479378 - RNA, 19 nt, Homo sapiens
uaaaugauggcaaugagua

SEQ ID NO: 479379 - RNA, 19 nt, Homo sapiens
gcgaaguggcccuugauua

SEQ ID NO: 479380 - RNA, 19 nt, Homo sapiens
gaaagaccuugcugaagag

SEQ ID NO: 479381 - RNA, 19 nt, Homo sapiens
caaagaauggcuugacaaa

SEQ ID NO: 479382 - RNA, 19 nt, Homo sapiens
ugagugaccugcagaagga

SEQ ID NO: 479383 - RNA, 19 nt, Homo sapiens
aaaugaaggugcuaguauu

SEQ ID NO: 479384 - RNA, 19 nt, Homo sapiens
ucaaugcacugauacacaa

SEQ ID NO: 479385 - RNA, 19 nt, Homo sapiens
ggccuucaaugcacugaua

SEQ ID NO: 479386 - RNA, 19 nt, Homo sapiens
gugcagcagucugagauua

SEQ ID NO: 479387 - RNA, 19 nt, Homo sapiens
cuacaaagaugcaaagacu

SEQ ID NO: 479388 - RNA, 19 nt, Homo sapiens
gagguucucugcccuggaa

SEQ ID NO: 479389 - RNA, 19 nt, Homo sapiens
caaaguggauaaacuguac

SEQ ID NO: 479390 - RNA, 19 nt, Homo sapiens
ucugaacaaucgcaaauuu

SEQ ID NO: 479391 - RNA, 19 nt, Homo sapiens
ggagaucuuugggcguaua

SEQ ID NO: 479392 - RNA, 19 nt, Homo sapiens
acacauggauccaggcuau

SEQ ID NO: 479393 - RNA, 19 nt, Homo sapiens
cgacagccauccugaaagu

SEQ ID NO: 479394 - RNA, 19 nt, Homo sapiens
gagaacugguugacaggaa

SEQ ID NO: 479395 - RNA, 19 nt, Homo sapiens
ggcagaugcugaugacauu

SEQ ID NO: 479396 - RNA, 19 nt, Homo sapiens
gaagaggcaagcuggauga

SEQ ID NO: 479397 - RNA, 19 nt, Homo sapiens
ccagagcugugcagaucua

SEQ ID NO: 479398 - RNA, 19 nt, Homo sapiens
ggaguucuguuaucaagag

SEQ ID NO: 479399 - RNA, 19 nt, Homo sapiens
gcagcaaccugggaugaga

SEQ ID NO: 479400 - RNA, 19 nt, Homo sapiens
gaaauugaugcacguaaug

SEQ ID NO: 479401 - RNA, 19 nt, Homo sapiens
gagcaggagcuguacauga

SEQ ID NO: 479402 - RNA, 19 nt, Homo sapiens
gacagcggcucgagaugaa

SEQ ID NO: 479403 - RNA, 19 nt, Homo sapiens
gcucaucucugacaucaac

SEQ ID NO: 479404 - RNA, 19 nt, Homo sapiens
gaugaaggccuuagcuguu

SEQ ID NO: 479405 - RNA, 19 nt, Homo sapiens
acaccggccugaccugaua

SEQ ID NO: 479406 - RNA, 19 nt, Homo sapiens
ccagagugccgccaccuua

SEQ ID NO: 479407 - RNA, 19 nt, Homo sapiens
gagccgagcacgaagguuu

SEQ ID NO: 479408 - RNA, 19 nt, Homo sapiens
ggagagaucagaacacagu

SEQ ID NO: 479409 - RNA, 19 nt, Homo sapiens
uggcagaacuugcauccaa

SEQ ID NO: 479410 - RNA, 19 nt, Homo sapiens
cacagucucuggucaagaa

SEQ ID NO: 479411 - RNA, 19 nt, Homo sapiens
gugaagccgugcagaagaa

SEQ ID NO: 479412 - RNA, 19 nt, Homo sapiens
gaagguggacucuauugau

SEQ ID NO: 479413 - RNA, 19 nt, Homo sapiens
caaggaaggcgaagacaug

SEQ ID NO: 479414 - RNA, 19 nt, Homo sapiens
gggaauaccuacuggaacu

SEQ ID NO: 479415 - RNA, 19 nt, Homo sapiens
gguccuggcacaauguuua

SEQ ID NO: 479416 - RNA, 19 nt, Homo sapiens
gagaacaaguuucccaaaa

SEQ ID NO: 479417 - RNA, 19 nt, Homo sapiens
ugaaauugaugcacguaau

SEQ ID NO: 479418 - RNA, 19 nt, Homo sapiens
gaaagugagcgcauuagca

SEQ ID NO: 479419 - RNA, 19 nt, Homo sapiens
gccgaagccuuucuuaaca

SEQ ID NO: 479420 - RNA, 19 nt, Homo sapiens
cgagugcaaugaaaccaaa

SEQ ID NO: 479421 - RNA, 19 nt, Homo sapiens
gaaacacguauucaagcua

SEQ ID NO: 479422 - RNA, 19 nt, Homo sapiens
gcagacagcaagaggaaga

SEQ ID NO: 479423 - RNA, 19 nt, Homo sapiens
ggacaggagccguaccuau

SEQ ID NO: 479424 - RNA, 19 nt, Homo sapiens
gcaaacaaggccgaacuuu

SEQ ID NO: 479425 - RNA, 19 nt, Homo sapiens
gcagaccgaugcccaguac

SEQ ID NO: 479426 - RNA, 19 nt, Homo sapiens
caaaccaucaucauucuga

SEQ ID NO: 479427 - RNA, 19 nt, Homo sapiens
ggaaacugaagacaacaaa

SEQ ID NO: 479428 - RNA, 19 nt, Homo sapiens
guacagugaugucaacaac

SEQ ID NO: 479429 - RNA, 19 nt, Homo sapiens
cagaaacgguggacacaag

SEQ ID NO: 479430 - RNA, 19 nt, Homo sapiens
gaugagagacacagguuau

SEQ ID NO: 479431 - RNA, 19 nt, Homo sapiens
gagcaggaauuacacauga

SEQ ID NO: 479432 - RNA, 19 nt, Homo sapiens
ccaaggaggugauuaaaca

SEQ ID NO: 479433 - RNA, 19 nt, Homo sapiens
gagaagcugugcagaagaa

SEQ ID NO: 479434 - RNA, 19 nt, Homo sapiens
gaugaagacugcagguuau

SEQ ID NO: 479435 - RNA, 19 nt, Homo sapiens
uuaccuauguggcuacuua

SEQ ID NO: 479436 - RNA, 19 nt, Homo sapiens
ggcgagagcucacccuuga

SEQ ID NO: 479437 - RNA, 19 nt, Homo sapiens
ccaaugcgcuggccaaugg

SEQ ID NO: 479438 - RNA, 19 nt, Homo sapiens
gcaaacaugucuucaagcu

SEQ ID NO: 479439 - RNA, 19 nt, Homo sapiens
gagcaggucuaccgaguca

SEQ ID NO: 479440 - RNA, 19 nt, Homo sapiens
gcgcaaacaugucuucaag

SEQ ID NO: 479441 - RNA, 19 nt, Homo sapiens
gcaaagaccgcauugucaa

SEQ ID NO: 479442 - RNA, 19 nt, Homo sapiens
gaacacccuugcagcacaa

SEQ ID NO: 479443 - RNA, 19 nt, Homo sapiens
ccacagacuuugacagcuu

SEQ ID NO: 479444 - RNA, 19 nt, Homo sapiens
ccagagagcacucggauau

SEQ ID NO: 479445 - RNA, 19 nt, Homo sapiens
gagauggacuagcuuucaa

SEQ ID NO: 479446 - RNA, 19 nt, Homo sapiens
ugacauugccgagcaguua

SEQ ID NO: 479447 - RNA, 19 nt, Homo sapiens
agaagucaaucauuaccua

SEQ ID NO: 479448 - RNA, 19 nt, Homo sapiens
uggcugagcugcaggaaau

SEQ ID NO: 479449 - RNA, 19 nt, Homo sapiens
ucaacgccaucgugcauaa

SEQ ID NO: 479450 - RNA, 19 nt, Homo sapiens
cagcaaagacggcagagaa

SEQ ID NO: 479451 - RNA, 19 nt, Homo sapiens
gaagaagucagccaaggau

SEQ ID NO: 479452 - RNA, 19 nt, Homo sapiens
gagaaggagcgaaagagaa

SEQ ID NO: 479453 - RNA, 19 nt, Homo sapiens
ggagaaggagcgaaagaga

SEQ ID NO: 479454 - RNA, 19 nt, Homo sapiens
gaaaaggaacugggacuua

SEQ ID NO: 479455 - RNA, 19 nt, Homo sapiens
ggagagauggacuagcuuu

SEQ ID NO: 479456 - RNA, 19 nt, Homo sapiens
ggacaaggcacugcaguuc

SEQ ID NO: 479457 - RNA, 19 nt, Homo sapiens
ggacaagguggacaaggaa

SEQ ID NO: 479458 - RNA, 19 nt, Homo sapiens
caacgucaauguacacaac

SEQ ID NO: 479459 - RNA, 19 nt, Homo sapiens
ggacaccacagacaaguuc

SEQ ID NO: 479460 - RNA, 19 nt, Homo sapiens
agaaggagguggaggcaau

SEQ ID NO: 479461 - RNA, 19 nt, Homo sapiens
gagaggaggcacaagaaga

SEQ ID NO: 479462 - RNA, 19 nt, Homo sapiens
ccaggaauauguucugucu

SEQ ID NO: 479463 - RNA, 19 nt, Homo sapiens
ggaccaucauccuucgauu

SEQ ID NO: 479464 - RNA, 19 nt, Homo sapiens
ggaagaaggcugccaacag

SEQ ID NO: 479465 - RNA, 19 nt, Homo sapiens
gaugggcgagcaggaauua

SEQ ID NO: 479466 - RNA, 19 nt, Homo sapiens
ucaacauccugcucaagaa

SEQ ID NO: 479467 - RNA, 19 nt, Homo sapiens
aggaauauguucugucuca

SEQ ID NO: 479468 - RNA, 19 nt, Homo sapiens
ggcagaacguguacugugu

SEQ ID NO: 479469 - RNA, 19 nt, Homo sapiens
agacaaggcugaggagauc

SEQ ID NO: 479470 - RNA, 19 nt, Homo sapiens
gggaaagaguauagaccuu

SEQ ID NO: 479471 - RNA, 19 nt, Homo sapiens
gcaagagaauuggcaaggu

SEQ ID NO: 479472 - RNA, 19 nt, Homo sapiens
agaaggagcgaaagagaaa

SEQ ID NO: 479473 - RNA, 19 nt, Homo sapiens
cgagacaaauuccgagagu

SEQ ID NO: 479474 - RNA, 19 nt, Homo sapiens
guaaugcacacuauaaucu

SEQ ID NO: 479475 - RNA, 19 nt, Homo sapiens
agaugaagacugcagguua

SEQ ID NO: 479476 - RNA, 19 nt, Homo sapiens
ggaaggacagucucaacga

SEQ ID NO: 479477 - RNA, 19 nt, Homo sapiens
agacugcuguggccucuga

SEQ ID NO: 479478 - RNA, 19 nt, Homo sapiens
cgggagagauacugccaaa

SEQ ID NO: 479479 - RNA, 19 nt, Homo sapiens
gcccuucucuucugcuguu

SEQ ID NO: 479480 - RNA, 19 nt, Homo sapiens
ggacaacugccugcugcua

SEQ ID NO: 479481 - RNA, 19 nt, Homo sapiens
ggccuacgcuggagacaag

SEQ ID NO: 479482 - RNA, 19 nt, Homo sapiens
gccgccagcugguaucuga

SEQ ID NO: 479483 - RNA, 19 nt, Homo sapiens
cauccagaacuaccacuua

SEQ ID NO: 479484 - RNA, 19 nt, Homo sapiens
gcagcgucgccuuugauua

SEQ ID NO: 479485 - RNA, 19 nt, Homo sapiens
cagcauuuccugcaagauu

SEQ ID NO: 479486 - RNA, 19 nt, Homo sapiens
agaaccagcugcaguccuu

SEQ ID NO: 479487 - RNA, 19 nt, Homo sapiens
uaccauuacuucuccaaga

SEQ ID NO: 479488 - RNA, 19 nt, Homo sapiens
ggacuggcuucagcugguu

SEQ ID NO: 479489 - RNA, 19 nt, Homo sapiens
cgagcuggaugaccuggaa

SEQ ID NO: 479490 - RNA, 19 nt, Homo sapiens
gcguccagcuucucaugaa

SEQ ID NO: 479491 - RNA, 19 nt, Homo sapiens
ggagagauacugccaaagc

SEQ ID NO: 479492 - RNA, 19 nt, Homo sapiens
cccgcaaccugcauacuaa

SEQ ID NO: 479493 - RNA, 19 nt, Homo sapiens
acuauaaucugcagaaugc

SEQ ID NO: 479494 - RNA, 19 nt, Homo sapiens
gaagacaacaaggagaaga

SEQ ID NO: 479495 - RNA, 19 nt, Homo sapiens
ggagacagaagacaacaag

SEQ ID NO: 479496 - RNA, 19 nt, Homo sapiens
gagacaaauuccgagaguu

SEQ ID NO: 479497 - RNA, 19 nt, Homo sapiens
aggcagaggugaagaagca

SEQ ID NO: 479498 - RNA, 19 nt, Homo sapiens
ggaaaaggcagacuccauu

SEQ ID NO: 479499 - RNA, 19 nt, Homo sapiens
ggaggcacaagaagaauca

SEQ ID NO: 479500 - RNA, 19 nt, Homo sapiens
cauccacgccgacaagauu

SEQ ID NO: 479501 - RNA, 19 nt, Homo sapiens
gagagaagaccaaagucau

SEQ ID NO: 479502 - RNA, 19 nt, Homo sapiens
gcacggcucugggacuucu

SEQ ID NO: 479503 - RNA, 19 nt, Homo sapiens
cagaagacaacaaggagaa

SEQ ID NO: 479504 - RNA, 19 nt, Homo sapiens
ccgcggaucuagucaucaa

SEQ ID NO: 479505 - RNA, 19 nt, Homo sapiens
ggucaggagcgcguagaua

SEQ ID NO: 479506 - RNA, 19 nt, Homo sapiens
gcaggaauuacacaugaug

SEQ ID NO: 479507 - RNA, 19 nt, Homo sapiens
ggcagaagcaccaggcauu

SEQ ID NO: 479508 - RNA, 19 nt, Homo sapiens
gcccgcaaccugcauacua

SEQ ID NO: 479509 - RNA, 19 nt, Homo sapiens
gaauauguucugucucaca

SEQ ID NO: 479510 - RNA, 19 nt, Homo sapiens
ugagagagaagaccaaagu

SEQ ID NO: 479511 - RNA, 19 nt, Homo sapiens
ggcaaagaccgcauuguca

SEQ ID NO: 479512 - RNA, 19 nt, Homo sapiens
cgagaaagggaacuuggaa

SEQ ID NO: 479513 - RNA, 19 nt, Homo sapiens
gcccaaguuuaccgagaaa

SEQ ID NO: 479514 - RNA, 19 nt, Homo sapiens
cagagcgccugguggagaa

SEQ ID NO: 479515 - RNA, 19 nt, Homo sapiens
cauuacuucuccaagauga

SEQ ID NO: 479516 - RNA, 19 nt, Homo sapiens
gaagucaaucauuaccuau

SEQ ID NO: 479517 - RNA, 19 nt, Homo sapiens
gagacaaggcugaggagau

SEQ ID NO: 479518 - RNA, 19 nt, Homo sapiens
gcagccaggacaugauuga

SEQ ID NO: 479519 - RNA, 19 nt, Homo sapiens
uggacaagguggacaagga

SEQ ID NO: 479520 - RNA, 19 nt, Homo sapiens
agacgcagcgcagcaauuu

SEQ ID NO: 479521 - RNA, 19 nt, Homo sapiens
uagaggagcgggagaagga

SEQ ID NO: 479522 - RNA, 19 nt, Homo sapiens
ugacuaugcuccgagacaa

SEQ ID NO: 479523 - RNA, 19 nt, Homo sapiens
caacauccacgccgacaag

SEQ ID NO: 479524 - RNA, 19 nt, Homo sapiens
gacggaaaccaccgacuga

SEQ ID NO: 479525 - RNA, 19 nt, Homo sapiens
ggaagcacgaagccauuga

SEQ ID NO: 479526 - RNA, 19 nt, Homo sapiens
guggaaggcaagagaauug

SEQ ID NO: 479527 - RNA, 19 nt, Homo sapiens
agacagaagacaacaagga

SEQ ID NO: 479528 - RNA, 19 nt, Homo sapiens
agacaaauuccgagaguuc

SEQ ID NO: 479529 - RNA, 19 nt, Homo sapiens
ggaaauccagggccaguac

SEQ ID NO: 479530 - RNA, 19 nt, Homo sapiens
ccaacaaccagaaggucua

SEQ ID NO: 479531 - RNA, 19 nt, Homo sapiens
gaaacaagcuuaauaggaa

SEQ ID NO: 479532 - RNA, 19 nt, Homo sapiens
caaagcguguucuguaaua

SEQ ID NO: 479533 - RNA, 19 nt, Homo sapiens
gaaacgagguguucuucuu

SEQ ID NO: 479534 - RNA, 19 nt, Homo sapiens
gaagaaugcaccacaguuu

SEQ ID NO: 479535 - RNA, 19 nt, Homo sapiens
uauugaagguguuguguua

SEQ ID NO: 479536 - RNA, 19 nt, Homo sapiens
gaggagaaaugccaaggaa

SEQ ID NO: 479537 - RNA, 19 nt, Homo sapiens
ggagaaaugccaaggaauu

SEQ ID NO: 479538 - RNA, 19 nt, Homo sapiens
ggaagaugauguugugaug

SEQ ID NO: 479539 - RNA, 19 nt, Homo sapiens
cauaguaccauaccacuua

SEQ ID NO: 479540 - RNA, 19 nt, Homo sapiens
gaggauauauauagcauag

SEQ ID NO: 479541 - RNA, 19 nt, Homo sapiens
caacuuggcuucacauacu

SEQ ID NO: 479542 - RNA, 19 nt, Homo sapiens
ggaguucaguacaaggaua

SEQ ID NO: 479543 - RNA, 19 nt, Homo sapiens
uaaagagacuggagauauc

SEQ ID NO: 479544 - RNA, 19 nt, Homo sapiens
gagaauacaugguugaaaa

SEQ ID NO: 479545 - RNA, 19 nt, Homo sapiens
ccaaggaauuuaagagaau

SEQ ID NO: 479546 - RNA, 19 nt, Homo sapiens
ggacacuucuuugcuguug

SEQ ID NO: 479547 - RNA, 19 nt, Homo sapiens
gaaacucgaguacuuguug

SEQ ID NO: 479548 - RNA, 19 nt, Homo sapiens
ccaauaaaguuucuguauc

SEQ ID NO: 479549 - RNA, 19 nt, Homo sapiens
guucucaucuaccggauuu

SEQ ID NO: 479550 - RNA, 19 nt, Homo sapiens
gcaaaucaugcugaacuua

SEQ ID NO: 479551 - RNA, 19 nt, Homo sapiens
cagaaugacccagaaguua

SEQ ID NO: 479552 - RNA, 19 nt, Homo sapiens
gccaaggaauuuaagagaa

SEQ ID NO: 479553 - RNA, 19 nt, Homo sapiens
gcaccacaguuuaaagcaa

SEQ ID NO: 479554 - RNA, 19 nt, Homo sapiens
guuaucauguucucaaaga

SEQ ID NO: 479555 - RNA, 19 nt, Homo sapiens
guugggacaugcaaauaaa

SEQ ID NO: 479556 - RNA, 19 nt, Homo sapiens
ggguaucccugaccuuuau

SEQ ID NO: 479557 - RNA, 19 nt, Homo sapiens
uuuguuggcuuucuuauga

SEQ ID NO: 479558 - RNA, 19 nt, Homo sapiens
caucaugagucuccggaaa

SEQ ID NO: 479559 - RNA, 19 nt, Homo sapiens
aaaagagccugacagaaua

SEQ ID NO: 479560 - RNA, 19 nt, Homo sapiens
caaacuugguggcgaaugu

SEQ ID NO: 479561 - RNA, 19 nt, Homo sapiens
guacaaggauaaagagacu

SEQ ID NO: 479562 - RNA, 19 nt, Homo sapiens
ggaaagcaaaucagagguu

SEQ ID NO: 479563 - RNA, 19 nt, Homo sapiens
ucccugaccuuuaugauga

SEQ ID NO: 479564 - RNA, 19 nt, Homo sapiens
gaaugacuguugcuuuuaa

SEQ ID NO: 479565 - RNA, 19 nt, Homo sapiens
aauaugaggcauccacuua

SEQ ID NO: 479566 - RNA, 19 nt, Homo sapiens
ggaagaggauauauauagc

SEQ ID NO: 479567 - RNA, 19 nt, Homo sapiens
caaucuaugccguguauuu

SEQ ID NO: 479568 - RNA, 19 nt, Homo sapiens
cagugaaacucgaguacuu

SEQ ID NO: 479569 - RNA, 19 nt, Homo sapiens
caccacaguuuaaagcaaa

SEQ ID NO: 479570 - RNA, 19 nt, Homo sapiens
ggaaaagccuggucuccaa

SEQ ID NO: 479571 - RNA, 19 nt, Homo sapiens
caaaucaugcugaacuuau

SEQ ID NO: 479572 - RNA, 19 nt, Homo sapiens
gauaaagagacuggagaua

SEQ ID NO: 479573 - RNA, 19 nt, Homo sapiens
agaggaagaugauguugug

SEQ ID NO: 479574 - RNA, 19 nt, Homo sapiens
guaguagugcuguauugua

SEQ ID NO: 479575 - RNA, 19 nt, Homo sapiens
ucaggcucuuuaugaauua

SEQ ID NO: 479576 - RNA, 19 nt, Homo sapiens
gaggaaugacuguugcuuu

SEQ ID NO: 479577 - RNA, 19 nt, Homo sapiens
gaaaacugcuaaaggguau

SEQ ID NO: 479578 - RNA, 19 nt, Homo sapiens
uggcagagcccaaugcaaa

SEQ ID NO: 479579 - RNA, 19 nt, Homo sapiens
uaaaagagccugacagaau

SEQ ID NO: 479580 - RNA, 19 nt, Homo sapiens
aaacaucucauuccuuugu

SEQ ID NO: 479581 - RNA, 19 nt, Homo sapiens
gguguuguguuacaguuau

SEQ ID NO: 479582 - RNA, 19 nt, Homo sapiens
ucagaaccuuggauuacaa

SEQ ID NO: 479583 - RNA, 19 nt, Homo sapiens
gacuggagauaucaaggaa

SEQ ID NO: 479584 - RNA, 19 nt, Homo sapiens
ccucuaauuuacucagaaa

SEQ ID NO: 479585 - RNA, 19 nt, Homo sapiens
aagaaugcaccacaguuua

SEQ ID NO: 479586 - RNA, 19 nt, Homo sapiens
ucgaguacuuguugacauu

SEQ ID NO: 479587 - RNA, 19 nt, Homo sapiens
agaaugcaccacaguuuaa

SEQ ID NO: 479588 - RNA, 19 nt, Homo sapiens
gcaaaucagagguucagau

SEQ ID NO: 479589 - RNA, 19 nt, Homo sapiens
guacaucaacaucuucuca

SEQ ID NO: 479590 - RNA, 19 nt, Homo sapiens
gaagaggauauauauagca

SEQ ID NO: 479591 - RNA, 19 nt, Homo sapiens
aaacgagguguucuucuuu

SEQ ID NO: 479592 - RNA, 19 nt, Homo sapiens
aaagccuggucuccaauaa

SEQ ID NO: 479593 - RNA, 19 nt, Homo sapiens
ucagaaacaagcuuaauag

SEQ ID NO: 479594 - RNA, 19 nt, Homo sapiens
uauuugagaugaguuguug

SEQ ID NO: 479595 - RNA, 19 nt, Homo sapiens
uggaagaggauauauauag

SEQ ID NO: 479596 - RNA, 19 nt, Homo sapiens
uccuaacccucuagcuuua

SEQ ID NO: 479597 - RNA, 19 nt, Homo sapiens
gaaugcaccacaguuuaaa

SEQ ID NO: 479598 - RNA, 19 nt, Homo sapiens
agaaacaagcuuaauagga

SEQ ID NO: 479599 - RNA, 19 nt, Homo sapiens
cgaguccaguucucaucua

SEQ ID NO: 479600 - RNA, 19 nt, Homo sapiens
gagccugacagaauaguug

SEQ ID NO: 479601 - RNA, 19 nt, Homo sapiens
guauaugguucauuaagcu

SEQ ID NO: 479602 - RNA, 19 nt, Homo sapiens
caguaguagugcuguauug

SEQ ID NO: 479603 - RNA, 19 nt, Homo sapiens
cucaggcucuuuaugaauu

SEQ ID NO: 479604 - RNA, 19 nt, Homo sapiens
uaagagaauacaugguuga

SEQ ID NO: 479605 - RNA, 19 nt, Homo sapiens
gaugggaguucaguacaag

SEQ ID NO: 479606 - RNA, 19 nt, Homo sapiens
gaaugacccagaaguuauc

SEQ ID NO: 479607 - RNA, 19 nt, Homo sapiens
uaaacccacucgagcagau

SEQ ID NO: 479608 - RNA, 19 nt, Homo sapiens
aaacucgaguacuuguuga

SEQ ID NO: 479609 - RNA, 19 nt, Homo sapiens
gcauugccacuuucaccua

SEQ ID NO: 479610 - RNA, 19 nt, Homo sapiens
gaacuccaugcuccacuga

SEQ ID NO: 479611 - RNA, 19 nt, Homo sapiens
auaaagagacuggagauau

SEQ ID NO: 479612 - RNA, 19 nt, Homo sapiens
cagagguucagauuccuua

SEQ ID NO: 479613 - RNA, 19 nt, Homo sapiens
uagaagccacugacaauuc

SEQ ID NO: 479614 - RNA, 19 nt, Homo sapiens
ugacagaauaguuggagaa

SEQ ID NO: 479615 - RNA, 19 nt, Homo sapiens
agaaugacccagaaguuau

SEQ ID NO: 479616 - RNA, 19 nt, Homo sapiens
uaagucagaaccuuggauu

SEQ ID NO: 479617 - RNA, 19 nt, Homo sapiens
ggauaaagagacuggagau

SEQ ID NO: 479618 - RNA, 19 nt, Homo sapiens
ucagaaugacccagaaguu

SEQ ID NO: 479619 - RNA, 19 nt, Homo sapiens
gaugaguuguugggacaug

SEQ ID NO: 479620 - RNA, 19 nt, Homo sapiens
uaccauaccacuuauaaag

SEQ ID NO: 479621 - RNA, 19 nt, Homo sapiens
guaccauaccacuuauaaa

SEQ ID NO: 479622 - RNA, 19 nt, Homo sapiens
ccucgagcccuucucagua

SEQ ID NO: 479623 - RNA, 19 nt, Homo sapiens
ugcaaucuaugccguguau

SEQ ID NO: 479624 - RNA, 19 nt, Homo sapiens
gaguucaguacaaggauaa

SEQ ID NO: 479625 - RNA, 19 nt, Homo sapiens
gagcccaaugcaaaguuua

SEQ ID NO: 479626 - RNA, 19 nt, Homo sapiens
ggacaugcaaauaaaauga

SEQ ID NO: 479627 - RNA, 19 nt, Homo sapiens
gugcuaaugcugaggagaa

SEQ ID NO: 479628 - RNA, 19 nt, Homo sapiens
cuuauaaaguggaaacucu

SEQ ID NO: 479629 - RNA, 19 nt, Homo sapiens
agcguguucuguaauauuu

SEQ ID NO: 479630 - RNA, 19 nt, Homo sapiens
ugaugggaguucaguacaa

SEQ ID NO: 479631 - RNA, 19 nt, Homo sapiens
ugacugagcucaccacaaa

SEQ ID NO: 479632 - RNA, 19 nt, Homo sapiens
ggacauggcugcucagauc

SEQ ID NO: 479633 - RNA, 19 nt, Homo sapiens
gagagaaccuggugugcaa

SEQ ID NO: 479634 - RNA, 19 nt, Homo sapiens
ugaagaagcugaggcauga

SEQ ID NO: 479635 - RNA, 19 nt, Homo sapiens
ggugaaagaggacguguua

SEQ ID NO: 479636 - RNA, 19 nt, Homo sapiens
ccaugugcguccauauuua

SEQ ID NO: 479637 - RNA, 19 nt, Homo sapiens
gucgagagcuggccaaaga

SEQ ID NO: 479638 - RNA, 19 nt, Homo sapiens
gcaguuguaugcugugguu

SEQ ID NO: 479639 - RNA, 19 nt, Homo sapiens
ucaaaucccucuccaacug

SEQ ID NO: 479640 - RNA, 19 nt, Homo sapiens
ggaguuugcuggacuuucu

SEQ ID NO: 479641 - RNA, 19 nt, Homo sapiens
cagaauugguuguaaauac

SEQ ID NO: 479642 - RNA, 19 nt, Homo sapiens
caucauagcaauaacauuc

SEQ ID NO: 479643 - RNA, 19 nt, Homo sapiens
ccaagggccucaacgugaa

SEQ ID NO: 479644 - RNA, 19 nt, Homo sapiens
ggagagagaggcuucaauc

SEQ ID NO: 479645 - RNA, 19 nt, Homo sapiens
gaccuaggguggccugaga

SEQ ID NO: 479646 - RNA, 19 nt, Homo sapiens
caaucaagcagacauagaa

SEQ ID NO: 479647 - RNA, 19 nt, Homo sapiens
gcuugugggugauguuuga

SEQ ID NO: 479648 - RNA, 19 nt, Homo sapiens
uccagaagcugcccucuau

SEQ ID NO: 479649 - RNA, 19 nt, Homo sapiens
ggaagaggaaccaggagaa

SEQ ID NO: 479650 - RNA, 19 nt, Homo sapiens
gacaguuuguggcaucuug

SEQ ID NO: 479651 - RNA, 19 nt, Homo sapiens
ccaagucggcacccuuuaa

SEQ ID NO: 479652 - RNA, 19 nt, Homo sapiens
ggacagcccaggaaacaag

SEQ ID NO: 479653 - RNA, 19 nt, Homo sapiens
cagaggagcccauuuacau

SEQ ID NO: 479654 - RNA, 19 nt, Homo sapiens
gcaaucaagcagacauaga

SEQ ID NO: 479655 - RNA, 19 nt, Homo sapiens
gugcagguguggagagaga

SEQ ID NO: 479656 - RNA, 19 nt, Homo sapiens
gaccauggguagcaacaag

SEQ ID NO: 479657 - RNA, 19 nt, Homo sapiens
uuucagaggagcccauuua

SEQ ID NO: 479658 - RNA, 19 nt, Homo sapiens
ucagugugcccaucuguaa

SEQ ID NO: 479659 - RNA, 19 nt, Homo sapiens
augagaagcuggugcaguu

SEQ ID NO: 479660 - RNA, 19 nt, Homo sapiens
gauuucagaugacuaugca

SEQ ID NO: 479661 - RNA, 19 nt, Homo sapiens
guagauuucagaugacuau

SEQ ID NO: 479662 - RNA, 19 nt, Homo sapiens
ccagcgagcucucaaaucc

SEQ ID NO: 479663 - RNA, 19 nt, Homo sapiens
ccacggagcaguucagagu

SEQ ID NO: 479664 - RNA, 19 nt, Homo sapiens
gagaaagugagaccacgaa

SEQ ID NO: 479665 - RNA, 19 nt, Homo sapiens
gugccugccuaugaaauuu

SEQ ID NO: 479666 - RNA, 19 nt, Homo sapiens
gaggcuaacucucccaaaa

SEQ ID NO: 479667 - RNA, 19 nt, Homo sapiens
gaaagugagaccacgaaag

SEQ ID NO: 479668 - RNA, 19 nt, Homo sapiens
agaagcuggugcaguugua

SEQ ID NO: 479669 - RNA, 19 nt, Homo sapiens
gaccuguccuucaagaaag

SEQ ID NO: 479670 - RNA, 19 nt, Homo sapiens
uggcucggcucauugaaga

SEQ ID NO: 479671 - RNA, 19 nt, Homo sapiens
gaaccuggugugcaaagug

SEQ ID NO: 479672 - RNA, 19 nt, Homo sapiens
uauccagaauugguuguaa

SEQ ID NO: 479673 - RNA, 19 nt, Homo sapiens
caugugcguccauauuuaa

SEQ ID NO: 479674 - RNA, 19 nt, Homo sapiens
cauucgagauggcagauuc

SEQ ID NO: 479675 - RNA, 19 nt, Homo sapiens
ccagaauugguuguaaaua

SEQ ID NO: 479676 - RNA, 19 nt, Homo sapiens
gggcugagcuggggaauca

SEQ ID NO: 479677 - RNA, 19 nt, Homo sapiens
agaccuguccuucaagaaa

SEQ ID NO: 479678 - RNA, 19 nt, Homo sapiens
uguaugcugugguuucaga

SEQ ID NO: 479679 - RNA, 19 nt, Homo sapiens
uaacucaugaggagggaaa

SEQ ID NO: 479680 - RNA, 19 nt, Homo sapiens
ccucaggaaccaacaauuc

SEQ ID NO: 479681 - RNA, 19 nt, Homo sapiens
gaagaggaaccaggagaag

SEQ ID NO: 479682 - RNA, 19 nt, Homo sapiens
ccucuuugguggcauggaa

SEQ ID NO: 479683 - RNA, 19 nt, Homo sapiens
aaagugagaccacgaaagg

SEQ ID NO: 479684 - RNA, 19 nt, Homo sapiens
agacauagaagagccaaga

SEQ ID NO: 479685 - RNA, 19 nt, Homo sapiens
gcucagcacaggacagaca

SEQ ID NO: 479686 - RNA, 19 nt, Homo sapiens
ucaaaucugggcucacuca

SEQ ID NO: 479687 - RNA, 19 nt, Homo sapiens
gcugaggagugguauuuug

SEQ ID NO: 479688 - RNA, 19 nt, Homo sapiens
ccuucgagaucaucacuuc

SEQ ID NO: 479689 - RNA, 19 nt, Homo sapiens
guuguaugcugugguuuca

SEQ ID NO: 479690 - RNA, 19 nt, Homo sapiens
gagaagcuggugcaguugu

SEQ ID NO: 479691 - RNA, 19 nt, Homo sapiens
cguccaagccgcagacuca

SEQ ID NO: 479692 - RNA, 19 nt, Homo sapiens
acacaaacagaccucagaa

SEQ ID NO: 479693 - RNA, 19 nt, Homo sapiens
gcauauugucugauuaaac

SEQ ID NO: 479694 - RNA, 19 nt, Homo sapiens
gcguccauauuuaacaugu

SEQ ID NO: 479695 - RNA, 19 nt, Homo sapiens
ggucugaggaugcauucga

SEQ ID NO: 479696 - RNA, 19 nt, Homo sapiens
ccaaggccacggagcaguu

SEQ ID NO: 479697 - RNA, 19 nt, Homo sapiens
aggcccaggucaugaagaa

SEQ ID NO: 479698 - RNA, 19 nt, Homo sapiens
gguuguaaauacuuugcau

SEQ ID NO: 479699 - RNA, 19 nt, Homo sapiens
gugcguccauauuuaacau

SEQ ID NO: 479700 - RNA, 19 nt, Homo sapiens
caacgugaagcacuacaag

SEQ ID NO: 479701 - RNA, 19 nt, Homo sapiens
cacaaacagaccucagaaa

SEQ ID NO: 479702 - RNA, 19 nt, Homo sapiens
cguccauauuuaacaugua

SEQ ID NO: 479703 - RNA, 19 nt, Homo sapiens
ucaaacccugcccuccuua

SEQ ID NO: 479704 - RNA, 19 nt, Homo sapiens
cagaagcugcccucuaugg

SEQ ID NO: 479705 - RNA, 19 nt, Homo sapiens
gccucaacgugaagcacua

SEQ ID NO: 479706 - RNA, 19 nt, Homo sapiens
ccacgaaaggugccuacug

SEQ ID NO: 479707 - RNA, 19 nt, Homo sapiens
caagucuucucccguccau

SEQ ID NO: 479708 - RNA, 19 nt, Homo sapiens
ggacuggcuguguaaccuu

SEQ ID NO: 479709 - RNA, 19 nt, Homo sapiens
ucacggaguacaugagcaa

SEQ ID NO: 479710 - RNA, 19 nt, Homo sapiens
acaaacagaccucagaaaa

SEQ ID NO: 479711 - RNA, 19 nt, Homo sapiens
cuuugcauauugucugauu

SEQ ID NO: 479712 - RNA, 19 nt, Homo sapiens
uccaugugcguccauauuu

SEQ ID NO: 479713 - RNA, 19 nt, Homo sapiens
gccauggccucugcaacug

SEQ ID NO: 479714 - RNA, 19 nt, Homo sapiens
cggcacccuuuaacucaug

SEQ ID NO: 479715 - RNA, 19 nt, Homo sapiens
gaacagcauggaggcagau

SEQ ID NO: 479716 - RNA, 19 nt, Homo sapiens
caagagcaagcccaaggau

SEQ ID NO: 479717 - RNA, 19 nt, Homo sapiens
ucgggauccugcugacuga

SEQ ID NO: 479718 - RNA, 19 nt, Homo sapiens
cagcauggaggcagaugug

SEQ ID NO: 479719 - RNA, 19 nt, Homo sapiens
cgucggaggcaucauggaa

SEQ ID NO: 479720 - RNA, 19 nt, Homo sapiens
cucaaacccugcccuccuu

SEQ ID NO: 479721 - RNA, 19 nt, Homo sapiens
aaaggaccauggguagcaa

SEQ ID NO: 479722 - RNA, 19 nt, Homo sapiens
gaagcuggugcaguuguau

SEQ ID NO: 479723 - RNA, 19 nt, Homo sapiens
auccagaauugguuguaaa

SEQ ID NO: 479724 - RNA, 19 nt, Homo sapiens
gagccuagcccugggacau

SEQ ID NO: 479725 - RNA, 19 nt, Homo sapiens
ucaagcagacauagaagag

SEQ ID NO: 479726 - RNA, 19 nt, Homo sapiens
agucaaaucugggcucacu

SEQ ID NO: 479727 - RNA, 19 nt, Homo sapiens
ugaggaugcauucgagaug

SEQ ID NO: 479728 - RNA, 19 nt, Homo sapiens
aggcugaggagugguauuu

SEQ ID NO: 479729 - RNA, 19 nt, Homo sapiens
ucagaggagcccauuuaca

SEQ ID NO: 479730 - RNA, 19 nt, Homo sapiens
gaagcugaggcaugagaag

SEQ ID NO: 479731 - RNA, 19 nt, Homo sapiens
gggcaucggugcuuaauuu

SEQ ID NO: 479732 - RNA, 19 nt, Homo sapiens
uagcuaaucuuccuucuaa

SEQ ID NO: 479733 - RNA, 19 nt, Homo sapiens
gcaaaggcaucuggacuug

SEQ ID NO: 479734 - RNA, 19 nt, Homo sapiens
gcaaucuaccuaauaagua

SEQ ID NO: 479735 - RNA, 19 nt, Homo sapiens
gcuaaucuuccuucuaaua

SEQ ID NO: 479736 - RNA, 19 nt, Homo sapiens
gcagauacuugagccauug

SEQ ID NO: 479737 - RNA, 19 nt, Homo sapiens
uaacugcagccaacuauuu

SEQ ID NO: 479738 - RNA, 19 nt, Homo sapiens
gaaagccuaugccacuguu

SEQ ID NO: 479739 - RNA, 19 nt, Homo sapiens
gcucuggucugacaugguu

SEQ ID NO: 479740 - RNA, 19 nt, Homo sapiens
ugaauauccuacuguguaa

SEQ ID NO: 479741 - RNA, 19 nt, Homo sapiens
caauggcgcuucucuaugg

SEQ ID NO: 479742 - RNA, 19 nt, Homo sapiens
ugauaaacauccauucaga

SEQ ID NO: 479743 - RNA, 19 nt, Homo sapiens
ugacuugaauucuacuuug

SEQ ID NO: 479744 - RNA, 19 nt, Homo sapiens
gcaaagcuuuccccucaua

SEQ ID NO: 479745 - RNA, 19 nt, Homo sapiens
ugacaugguuucucucugu

SEQ ID NO: 479746 - RNA, 19 nt, Homo sapiens
ugaaauggagguugaauau

SEQ ID NO: 479747 - RNA, 19 nt, Homo sapiens
ccauucagaucauauccua

SEQ ID NO: 479748 - RNA, 19 nt, Homo sapiens
aaaggcaucuggacuuguu

SEQ ID NO: 479749 - RNA, 19 nt, Homo sapiens
ugaagaguauccaaaguuc

SEQ ID NO: 479750 - RNA, 19 nt, Homo sapiens
gaaugaucacuuucuguaa

SEQ ID NO: 479751 - RNA, 19 nt, Homo sapiens
agacuagacuuuacaacug

SEQ ID NO: 479752 - RNA, 19 nt, Homo sapiens
gcgcuucucuauggacuuu

SEQ ID NO: 479753 - RNA, 19 nt, Homo sapiens
gcauugcuuugccuuauca

SEQ ID NO: 479754 - RNA, 19 nt, Homo sapiens
cuauagggcuggaaucugu

SEQ ID NO: 479755 - RNA, 19 nt, Homo sapiens
ggucugacaugguuucucu

SEQ ID NO: 479756 - RNA, 19 nt, Homo sapiens
ucaaugugcucuggucuga

SEQ ID NO: 479757 - RNA, 19 nt, Homo sapiens
guacaauggcgauuauguu

SEQ ID NO: 479758 - RNA, 19 nt, Homo sapiens
gacuugaauucuacuuuga

SEQ ID NO: 479759 - RNA, 19 nt, Homo sapiens
uaacaggucagaauuucaa

SEQ ID NO: 479760 - RNA, 19 nt, Homo sapiens
aaacauccauucagaucau

SEQ ID NO: 479761 - RNA, 19 nt, Homo sapiens
gaauucaucuggcauugcu

SEQ ID NO: 479762 - RNA, 19 nt, Homo sapiens
acagugaucucuucaaggu

SEQ ID NO: 479763 - RNA, 19 nt, Homo sapiens
guaccuaaauacgcugaaa

SEQ ID NO: 479764 - RNA, 19 nt, Homo sapiens
ccggaaauuugaagaguau

SEQ ID NO: 479765 - RNA, 19 nt, Homo sapiens
acaauaacaagaccacuuu

SEQ ID NO: 479766 - RNA, 19 nt, Homo sapiens
caaucuaccuaauaaguac

SEQ ID NO: 479767 - RNA, 19 nt, Homo sapiens
gguaacagauccccguuuu

SEQ ID NO: 479768 - RNA, 19 nt, Homo sapiens
uguaacggcuauuugcaaa

SEQ ID NO: 479769 - RNA, 19 nt, Homo sapiens
gccuguaccuguuaucaau

SEQ ID NO: 479770 - RNA, 19 nt, Homo sapiens
gacuagacuuuacaacugu

SEQ ID NO: 479771 - RNA, 19 nt, Homo sapiens
cuaaauacgcugaaaugga

SEQ ID NO: 479772 - RNA, 19 nt, Homo sapiens
caauggcgauuauguucug

SEQ ID NO: 479773 - RNA, 19 nt, Homo sapiens
cuacagugaucucuucaag

SEQ ID NO: 479774 - RNA, 19 nt, Homo sapiens
uguaugagacuagacuuua

SEQ ID NO: 479775 - RNA, 19 nt, Homo sapiens
uugaauauccuacugugua

SEQ ID NO: 479776 - RNA, 19 nt, Homo sapiens
cuacgggcaucggugcuua

SEQ ID NO: 479777 - RNA, 19 nt, Homo sapiens
gagccauugugcaguguau

SEQ ID NO: 479778 - RNA, 19 nt, Homo sapiens
uagagauuguugucuguga

SEQ ID NO: 479779 - RNA, 19 nt, Homo sapiens
guauggauauaguagagau

SEQ ID NO: 479780 - RNA, 19 nt, Homo sapiens
uucaagcucuggguaauaa

SEQ ID NO: 479781 - RNA, 19 nt, Homo sapiens
gauauaguagagauuguug

SEQ ID NO: 479782 - RNA, 19 nt, Homo sapiens
gcccuaaacaggcaccuuu

SEQ ID NO: 479783 - RNA, 19 nt, Homo sapiens
gcgauuauguucuguaccu

SEQ ID NO: 479784 - RNA, 19 nt, Homo sapiens
gauaaacauccauucagau

SEQ ID NO: 479785 - RNA, 19 nt, Homo sapiens
ccaaguguguaugagacua

SEQ ID NO: 479786 - RNA, 19 nt, Homo sapiens
uguaacaggucagaauuuc

SEQ ID NO: 479787 - RNA, 19 nt, Homo sapiens
gagguugaauauccuacug

SEQ ID NO: 479788 - RNA, 19 nt, Homo sapiens
aaauggagguugaauaucc

SEQ ID NO: 479789 - RNA, 19 nt, Homo sapiens
gagauuguugucugugaaa

SEQ ID NO: 479790 - RNA, 19 nt, Homo sapiens
ccauguuccucguccacua

SEQ ID NO: 479791 - RNA, 19 nt, Homo sapiens
gagacuagacuuuacaacu

SEQ ID NO: 479792 - RNA, 19 nt, Homo sapiens
guaugagacuagacuuuac

SEQ ID NO: 479793 - RNA, 19 nt, Homo sapiens
ggauauaguagagauuguu

SEQ ID NO: 479794 - RNA, 19 nt, Homo sapiens
uugcaaagcagauacuuga

SEQ ID NO: 479795 - RNA, 19 nt, Homo sapiens
acuugaagcuuuccaaugg

SEQ ID NO: 479796 - RNA, 19 nt, Homo sapiens
gaagaguauccaaaguuca

SEQ ID NO: 479797 - RNA, 19 nt, Homo sapiens
aggagauacuggauacaaa

SEQ ID NO: 479798 - RNA, 19 nt, Homo sapiens
uaucaucucaucuggaguu

SEQ ID NO: 479799 - RNA, 19 nt, Homo sapiens
ggaaagccuaugccacugu

SEQ ID NO: 479800 - RNA, 19 nt, Homo sapiens
agauuuauccuguuuguuc

SEQ ID NO: 479801 - RNA, 19 nt, Homo sapiens
gaaauggagguugaauauc

SEQ ID NO: 479802 - RNA, 19 nt, Homo sapiens
acgcugaaauggagguuga

SEQ ID NO: 479803 - RNA, 19 nt, Homo sapiens
agugguaccuccggaaauu

SEQ ID NO: 479804 - RNA, 19 nt, Homo sapiens
gguuuuggcuugugguuaa

SEQ ID NO: 479805 - RNA, 19 nt, Homo sapiens
gauuguugucugugaaauu

SEQ ID NO: 479806 - RNA, 19 nt, Homo sapiens
ggcaaaggcaucuggacuu

SEQ ID NO: 479807 - RNA, 19 nt, Homo sapiens
caacuugaagcuuuccaau

SEQ ID NO: 479808 - RNA, 19 nt, Homo sapiens
gauuuauccuguuuguucu

SEQ ID NO: 479809 - RNA, 19 nt, Homo sapiens
cuuguaguguaaagaauga

SEQ ID NO: 479810 - RNA, 19 nt, Homo sapiens
gcuauuugcaaagcagaua

SEQ ID NO: 479811 - RNA, 19 nt, Homo sapiens
guaauuuuccugcuacuuu

SEQ ID NO: 479812 - RNA, 19 nt, Homo sapiens
gagcaaaagagcaucauga

SEQ ID NO: 479813 - RNA, 19 nt, Homo sapiens
ggcaucggugcuuaauuua

SEQ ID NO: 479814 - RNA, 19 nt, Homo sapiens
agagauuguugucugugaa

SEQ ID NO: 479815 - RNA, 19 nt, Homo sapiens
uccggaaauuugaagagua

SEQ ID NO: 479816 - RNA, 19 nt, Homo sapiens
ucauagccuguaccuguua

SEQ ID NO: 479817 - RNA, 19 nt, Homo sapiens
caaggucaacugcaguguu

SEQ ID NO: 479818 - RNA, 19 nt, Homo sapiens
gucacaaucccuucuauag

SEQ ID NO: 479819 - RNA, 19 nt, Homo sapiens
gcugaugacuggguaacag

SEQ ID NO: 479820 - RNA, 19 nt, Homo sapiens
guguaacaggucagaauuu

SEQ ID NO: 479821 - RNA, 19 nt, Homo sapiens
guaccuguaacggcuauuu

SEQ ID NO: 479822 - RNA, 19 nt, Homo sapiens
aagagcaucaugaguggua

SEQ ID NO: 479823 - RNA, 19 nt, Homo sapiens
guugauaaacauccauuca

SEQ ID NO: 479824 - RNA, 19 nt, Homo sapiens
aaugaucacuuucuguaac

SEQ ID NO: 479825 - RNA, 19 nt, Homo sapiens
ccacguauggauauaguag

SEQ ID NO: 479826 - RNA, 19 nt, Homo sapiens
uaacggcuauuugcaaagc

SEQ ID NO: 479827 - RNA, 19 nt, Homo sapiens
ccuaaggaaucucagaaaa

SEQ ID NO: 479828 - RNA, 19 nt, Homo sapiens
aaugugcucuggucugaca

SEQ ID NO: 479829 - RNA, 19 nt, Homo sapiens
ggagauacuggauacaaaa

SEQ ID NO: 479830 - RNA, 19 nt, Homo sapiens
cuaaucuuccuucuaauag

SEQ ID NO: 479831 - RNA, 19 nt, Homo sapiens
gaaccuggguggcuuauga

SEQ ID NO: 479832 - RNA, 19 nt, Homo sapiens
ggaaauauuugucuucuca

SEQ ID NO: 479833 - RNA, 19 nt, Homo sapiens
gcacagaaacucacuauau

SEQ ID NO: 479834 - RNA, 19 nt, Homo sapiens
ggacaacucuguaaucaag

SEQ ID NO: 479835 - RNA, 19 nt, Homo sapiens
cacagaaacucacuauaua

SEQ ID NO: 479836 - RNA, 19 nt, Homo sapiens
guacaaacuucuccuaugu

SEQ ID NO: 479837 - RNA, 19 nt, Homo sapiens
gauauggacucucuaagga

SEQ ID NO: 479838 - RNA, 19 nt, Homo sapiens
uagcuugggugucuucuua

SEQ ID NO: 479839 - RNA, 19 nt, Homo sapiens
gaaacucacuauauaaguc

SEQ ID NO: 479840 - RNA, 19 nt, Homo sapiens
cagaguagcagaaauuuaa

SEQ ID NO: 479841 - RNA, 19 nt, Homo sapiens
caaacccacucccaaauga

SEQ ID NO: 479842 - RNA, 19 nt, Homo sapiens
uaacagaguagcagaaauu

SEQ ID NO: 479843 - RNA, 19 nt, Homo sapiens
gagaauuaaugaugagguu

SEQ ID NO: 479844 - RNA, 19 nt, Homo sapiens
ggcaauauccaaauaauga

SEQ ID NO: 479845 - RNA, 19 nt, Homo sapiens
gacaguugcuucuuagcua

SEQ ID NO: 479846 - RNA, 19 nt, Homo sapiens
aaacuucuccuaugucuuu

SEQ ID NO: 479847 - RNA, 19 nt, Homo sapiens
gcuacuaucugauuuacug

SEQ ID NO: 479848 - RNA, 19 nt, Homo sapiens
gcuaugcccuggccacuug

SEQ ID NO: 479849 - RNA, 19 nt, Homo sapiens
cuaguaagcauuugaguuu

SEQ ID NO: 479850 - RNA, 19 nt, Homo sapiens
gacccuggauggcuacuaa

SEQ ID NO: 479851 - RNA, 19 nt, Homo sapiens
gagcaaacccacucccaaa

SEQ ID NO: 479852 - RNA, 19 nt, Homo sapiens
ccagauguccacaacaaua

SEQ ID NO: 479853 - RNA, 19 nt, Homo sapiens
ggaaacugguggcaauauc

SEQ ID NO: 479854 - RNA, 19 nt, Homo sapiens
guacacagacauacgguuu

SEQ ID NO: 479855 - RNA, 19 nt, Homo sapiens
gaaaagauacugaugcauu

SEQ ID NO: 479856 - RNA, 19 nt, Homo sapiens
cuucaaggcuacuaucuga

SEQ ID NO: 479857 - RNA, 19 nt, Homo sapiens
ccacaaagacccagagcaa

SEQ ID NO: 479858 - RNA, 19 nt, Homo sapiens
uggcgacaguugcuucuua

SEQ ID NO: 479859 - RNA, 19 nt, Homo sapiens
uugggugucuucuuauuua

SEQ ID NO: 479860 - RNA, 19 nt, Homo sapiens
ucacauaggaaacuugaaa

SEQ ID NO: 479861 - RNA, 19 nt, Homo sapiens
caccagauguccacaacaa

SEQ ID NO: 479862 - RNA, 19 nt, Homo sapiens
ucaagcugcugaaacugua

SEQ ID NO: 479863 - RNA, 19 nt, Homo sapiens
caaggcuacuaucugauuu

SEQ ID NO: 479864 - RNA, 19 nt, Homo sapiens
gcaaacccacucccaaaug

SEQ ID NO: 479865 - RNA, 19 nt, Homo sapiens
gaaagcccuuauuccauuc

SEQ ID NO: 479866 - RNA, 19 nt, Homo sapiens
guaauuggaauacauggaa

SEQ ID NO: 479867 - RNA, 19 nt, Homo sapiens
cuacguagcuaguaagcau

SEQ ID NO: 479868 - RNA, 19 nt, Homo sapiens
gagaacaguuuuacaauag

SEQ ID NO: 479869 - RNA, 19 nt, Homo sapiens
caggacaacucuguaauca

SEQ ID NO: 479870 - RNA, 19 nt, Homo sapiens
ggacauuuguguacucacu

SEQ ID NO: 479871 - RNA, 19 nt, Homo sapiens
ggaaauggaguccuucaag

SEQ ID NO: 479872 - RNA, 19 nt, Homo sapiens
gccgaacgcuuguaauugg

SEQ ID NO: 479873 - RNA, 19 nt, Homo sapiens
guuggaggaucugaacaua

SEQ ID NO: 479874 - RNA, 19 nt, Homo sapiens
ggugucugcuuagaguuua

SEQ ID NO: 479875 - RNA, 19 nt, Homo sapiens
gguucuaccucaagauguu

SEQ ID NO: 479876 - RNA, 19 nt, Homo sapiens
cuauugcucugagaaagua

SEQ ID NO: 479877 - RNA, 19 nt, Homo sapiens
ugaaaggucugaggaugau

SEQ ID NO: 479878 - RNA, 19 nt, Homo sapiens
gggccgaacgcuuguaauu

SEQ ID NO: 479879 - RNA, 19 nt, Homo sapiens
uggaggaucugaacauaca

SEQ ID NO: 479880 - RNA, 19 nt, Homo sapiens
gagaguagagaacaacaug

SEQ ID NO: 479881 - RNA, 19 nt, Homo sapiens
aaguacauguggcuucaua

SEQ ID NO: 479882 - RNA, 19 nt, Homo sapiens
ucugaguggugucugcuua

SEQ ID NO: 479883 - RNA, 19 nt, Homo sapiens
ugaaggcaguacuuauaga

SEQ ID NO: 479884 - RNA, 19 nt, Homo sapiens
gauuuacugugcugaauac

SEQ ID NO: 479885 - RNA, 19 nt, Homo sapiens
cuacuaagaggauagagaa

SEQ ID NO: 479886 - RNA, 19 nt, Homo sapiens
aaacugguauggcuauucu

SEQ ID NO: 479887 - RNA, 19 nt, Homo sapiens
ccaaguacauguggcuuca

SEQ ID NO: 479888 - RNA, 19 nt, Homo sapiens
gaacgcuuguaauuggaau

SEQ ID NO: 479889 - RNA, 19 nt, Homo sapiens
gaacauacagagcccacau

SEQ ID NO: 479890 - RNA, 19 nt, Homo sapiens
aauaugaaguacagcagaa

SEQ ID NO: 479891 - RNA, 19 nt, Homo sapiens
gcagugucuuaguugauga

SEQ ID NO: 479892 - RNA, 19 nt, Homo sapiens
ucauagugcugaaaagaua

SEQ ID NO: 479893 - RNA, 19 nt, Homo sapiens
gcaggacaacucuguaauc

SEQ ID NO: 479894 - RNA, 19 nt, Homo sapiens
gcuugggugucuucuuauu

SEQ ID NO: 479895 - RNA, 19 nt, Homo sapiens
gagcuucuuccuuguaguu

SEQ ID NO: 479896 - RNA, 19 nt, Homo sapiens
guaacagaguagcagaaau

SEQ ID NO: 479897 - RNA, 19 nt, Homo sapiens
ucaaggcuacuaucugauu

SEQ ID NO: 479898 - RNA, 19 nt, Homo sapiens
gaacuggaacuacguagcu

SEQ ID NO: 479899 - RNA, 19 nt, Homo sapiens
gaaugccucccucaaagga

SEQ ID NO: 479900 - RNA, 19 nt, Homo sapiens
ccaagcaacuuuccuuucc

SEQ ID NO: 479901 - RNA, 19 nt, Homo sapiens
ccaaauaaugaguagugua

SEQ ID NO: 479902 - RNA, 19 nt, Homo sapiens
cuugaaggcaguacuuaua

SEQ ID NO: 479903 - RNA, 19 nt, Homo sapiens
gcuaguaagcauuugaguu

SEQ ID NO: 479904 - RNA, 19 nt, Homo sapiens
cugaggaugauguagauua

SEQ ID NO: 479905 - RNA, 19 nt, Homo sapiens
ucauaaaacucuagcauuc

SEQ ID NO: 479906 - RNA, 19 nt, Homo sapiens
ucaaauuugugcagugucu

SEQ ID NO: 479907 - RNA, 19 nt, Homo sapiens
acaacucuguaaucaagaa

SEQ ID NO: 479908 - RNA, 19 nt, Homo sapiens
ggucugaggaugauguaga

SEQ ID NO: 479909 - RNA, 19 nt, Homo sapiens
guggcaauauccaaauaau

SEQ ID NO: 479910 - RNA, 19 nt, Homo sapiens
guacuaagcacagaaacuc

SEQ ID NO: 479911 - RNA, 19 nt, Homo sapiens
caugagugcugagauaugg

SEQ ID NO: 479912 - RNA, 19 nt, Homo sapiens
cuggguggcuuaugagaga

SEQ ID NO: 479913 - RNA, 19 nt, Homo sapiens
ugguauggcuauucuugaa

SEQ ID NO: 479914 - RNA, 19 nt, Homo sapiens
aaauuugugcagugucuua

SEQ ID NO: 479915 - RNA, 19 nt, Homo sapiens
ccacaacaauaugaaguac

SEQ ID NO: 479916 - RNA, 19 nt, Homo sapiens
gauguccacaacaauauga

SEQ ID NO: 479917 - RNA, 19 nt, Homo sapiens
aaaagauacugaugcauug

SEQ ID NO: 479918 - RNA, 19 nt, Homo sapiens
gcaguacuuauagaccuua

SEQ ID NO: 479919 - RNA, 19 nt, Homo sapiens
acacagacauacgguuuag

SEQ ID NO: 479920 - RNA, 19 nt, Homo sapiens
cagaaacucacuauauaag

SEQ ID NO: 479921 - RNA, 19 nt, Homo sapiens
ccacauuuccacaccagaa

SEQ ID NO: 479922 - RNA, 19 nt, Homo sapiens
ggagauuccuucauaaaac

SEQ ID NO: 479923 - RNA, 19 nt, Homo sapiens
acaacaauaugaaguacag

SEQ ID NO: 479924 - RNA, 19 nt, Homo sapiens
gaauuaaugaugagguuac

SEQ ID NO: 479925 - RNA, 19 nt, Homo sapiens
guugaugagugccucuguu

SEQ ID NO: 479926 - RNA, 19 nt, Homo sapiens
gagaaauuauuagguagac

SEQ ID NO: 479927 - RNA, 19 nt, Homo sapiens
ucaccgggcaauccaagua

SEQ ID NO: 479928 - RNA, 19 nt, Homo sapiens
aguacaaacuucuccuaug

SEQ ID NO: 479929 - RNA, 19 nt, Homo sapiens
uuauccagcuauacucauu

SEQ ID NO: 479930 - RNA, 19 nt, Homo sapiens
gguggcaauauccaaauaa

SEQ ID NO: 479931 - RNA, 19 nt, Homo sapiens
gcagauagaugcugaugaa

SEQ ID NO: 479932 - RNA, 19 nt, Homo sapiens
gaacuuuccucagccauua

SEQ ID NO: 479933 - RNA, 19 nt, Homo sapiens
gauagaugcugaugaauug

SEQ ID NO: 479934 - RNA, 19 nt, Homo sapiens
aaacuuacaucacgacuuu

SEQ ID NO: 479935 - RNA, 19 nt, Homo sapiens
ugacaggaguggaacagua

SEQ ID NO: 479936 - RNA, 19 nt, Homo sapiens
gcacaauggguuucaauga

SEQ ID NO: 479937 - RNA, 19 nt, Homo sapiens
agaggaagcugcaugaaug

SEQ ID NO: 479938 - RNA, 19 nt, Homo sapiens
uaucagucaugccuuauuu

SEQ ID NO: 479939 - RNA, 19 nt, Homo sapiens
cauuaucagucaugccuua

SEQ ID NO: 479940 - RNA, 19 nt, Homo sapiens
acaaugggauuuagguuga

SEQ ID NO: 479941 - RNA, 19 nt, Homo sapiens
ggaagcugcaugaauguaa

SEQ ID NO: 479942 - RNA, 19 nt, Homo sapiens
gaagcugcaugaauguaau

SEQ ID NO: 479943 - RNA, 19 nt, Homo sapiens
aggauccgcuguaugguua

SEQ ID NO: 479944 - RNA, 19 nt, Homo sapiens
agaaggcccugacaacaau

SEQ ID NO: 479945 - RNA, 19 nt, Homo sapiens
ucagcaagguguugugaau

SEQ ID NO: 479946 - RNA, 19 nt, Homo sapiens
caaugugucaugaguguuu

SEQ ID NO: 479947 - RNA, 19 nt, Homo sapiens
agcaagguguugugaauuu

SEQ ID NO: 479948 - RNA, 19 nt, Homo sapiens
gaacaguagacccacaaga

SEQ ID NO: 479949 - RNA, 19 nt, Homo sapiens
ugucaugaguguuuaaauc

SEQ ID NO: 479950 - RNA, 19 nt, Homo sapiens
gcaagguguugugaauuuc

SEQ ID NO: 479951 - RNA, 19 nt, Homo sapiens
agauaugucuggcacaaug

SEQ ID NO: 479952 - RNA, 19 nt, Homo sapiens
acagacagcuuucgaagac

SEQ ID NO: 479953 - RNA, 19 nt, Homo sapiens
gcugaugaauugcagagau

SEQ ID NO: 479954 - RNA, 19 nt, Homo sapiens
ccucagccauuaucaguca

SEQ ID NO: 479955 - RNA, 19 nt, Homo sapiens
ugacaacaaugggauuuag

SEQ ID NO: 479956 - RNA, 19 nt, Homo sapiens
guguuuaaaucaagaggaa

SEQ ID NO: 479957 - RNA, 19 nt, Homo sapiens
gcagaaggcccugacaaca

SEQ ID NO: 479958 - RNA, 19 nt, Homo sapiens
cagaaggcccugacaacaa

SEQ ID NO: 479959 - RNA, 19 nt, Homo sapiens
uuucaaugcuggauagaga

SEQ ID NO: 479960 - RNA, 19 nt, Homo sapiens
guaaucaacauuccaacug

SEQ ID NO: 479961 - RNA, 19 nt, Homo sapiens
gaauuucccauaugaugau

SEQ ID NO: 479962 - RNA, 19 nt, Homo sapiens
acucugggcuguacugaau

SEQ ID NO: 479963 - RNA, 19 nt, Homo sapiens
guuacaccauuuagaacuu

SEQ ID NO: 479964 - RNA, 19 nt, Homo sapiens
guugugaauuucccauaug

SEQ ID NO: 479965 - RNA, 19 nt, Homo sapiens
cuggagacuugccggcuua

SEQ ID NO: 479966 - RNA, 19 nt, Homo sapiens
agauagaugcugaugaauu

SEQ ID NO: 479967 - RNA, 19 nt, Homo sapiens
cgauacagcaccaauggaa

SEQ ID NO: 479968 - RNA, 19 nt, Homo sapiens
gcaaaauguuuaagucaca

SEQ ID NO: 479969 - RNA, 19 nt, Homo sapiens
ucaagaggaagcugcauga

SEQ ID NO: 479970 - RNA, 19 nt, Homo sapiens
caacaaugggauuuagguu

SEQ ID NO: 479971 - RNA, 19 nt, Homo sapiens
gagacaacacuuuaucagu

SEQ ID NO: 479972 - RNA, 19 nt, Homo sapiens
aaagaacucugggcuguac

SEQ ID NO: 479973 - RNA, 19 nt, Homo sapiens
ucuagucuguuacaccauu

SEQ ID NO: 479974 - RNA, 19 nt, Homo sapiens
cagcaccaauggaaagauc

SEQ ID NO: 479975 - RNA, 19 nt, Homo sapiens
caguagacccacaagaauu

SEQ ID NO: 479976 - RNA, 19 nt, Homo sapiens
gcuggaggauacaaaccuu

SEQ ID NO: 479977 - RNA, 19 nt, Homo sapiens
aaacucaggauccgcugua

SEQ ID NO: 479978 - RNA, 19 nt, Homo sapiens
ugaauuucccauaugauga

SEQ ID NO: 479979 - RNA, 19 nt, Homo sapiens
gugaauuucccauaugaug

SEQ ID NO: 479980 - RNA, 19 nt, Homo sapiens
gauacagcaccaauggaaa

SEQ ID NO: 479981 - RNA, 19 nt, Homo sapiens
agagauaugucuggcacaa

SEQ ID NO: 479982 - RNA, 19 nt, Homo sapiens
cugaauggcuggagacaac

SEQ ID NO: 479983 - RNA, 19 nt, Homo sapiens
ucaaugcuggauagagaua

SEQ ID NO: 479984 - RNA, 19 nt, Homo sapiens
ggacaggaugggcagauag

SEQ ID NO: 479985 - RNA, 19 nt, Homo sapiens
uggcauugcuggaggauac

SEQ ID NO: 479986 - RNA, 19 nt, Homo sapiens
caugaguguuuaaaucaag

SEQ ID NO: 479987 - RNA, 19 nt, Homo sapiens
aacaguagacccacaagaa

SEQ ID NO: 479988 - RNA, 19 nt, Homo sapiens
ggagacaacacuuuaucag

SEQ ID NO: 479989 - RNA, 19 nt, Homo sapiens
ggcuggagacaacacuuua

SEQ ID NO: 479990 - RNA, 19 nt, Homo sapiens
uaaagaacucugggcugua

SEQ ID NO: 479991 - RNA, 19 nt, Homo sapiens
gacaggaugggcagauaga

SEQ ID NO: 479992 - RNA, 19 nt, Homo sapiens
cugaugaauugcagagaug

SEQ ID NO: 479993 - RNA, 19 nt, Homo sapiens
gagacuugccggcuuaugg

SEQ ID NO: 479994 - RNA, 19 nt, Homo sapiens
ucuguuacaccauuuagaa

SEQ ID NO: 479995 - RNA, 19 nt, Homo sapiens
uaagaucuagucuguuaca

SEQ ID NO: 479996 - RNA, 19 nt, Homo sapiens
uuacuuugcugcuguagcu

SEQ ID NO: 479997 - RNA, 19 nt, Homo sapiens
uggacaggaugggcagaua

SEQ ID NO: 479998 - RNA, 19 nt, Homo sapiens
gaacucugggcuguacuga

SEQ ID NO: 479999 - RNA, 19 nt, Homo sapiens
ugccuucgguaauauguau

SEQ ID NO: 480000 - RNA, 19 nt, Homo sapiens
gucaugaguguuuaaauca

SEQ ID NO: 480001 - RNA, 19 nt, Homo sapiens
gaggaagcugcaugaaugu

SEQ ID NO: 480002 - RNA, 19 nt, Homo sapiens
gacaggaguggaacaguag

SEQ ID NO: 480003 - RNA, 19 nt, Homo sapiens
uugugaauuucccauauga

SEQ ID NO: 480004 - RNA, 19 nt, Homo sapiens
acaguagacccacaagaau

SEQ ID NO: 480005 - RNA, 19 nt, Homo sapiens
aaugugucaugaguguuua

SEQ ID NO: 480006 - RNA, 19 nt, Homo sapiens
uguugugaauuucccauau

SEQ ID NO: 480007 - RNA, 19 nt, Homo sapiens
gcucagcaagguguuguga

SEQ ID NO: 480008 - RNA, 19 nt, Homo sapiens
aaacgauacagcaccaaug

SEQ ID NO: 480009 - RNA, 19 nt, Homo sapiens
gaggauacaaaccuuuuaa

SEQ ID NO: 480010 - RNA, 19 nt, Homo sapiens
caggauccgcuguaugguu

SEQ ID NO: 480011 - RNA, 19 nt, Homo sapiens
cuagucuguuacaccauuu

SEQ ID NO: 480012 - RNA, 19 nt, Homo sapiens
cugcaugaauguaaucaac

SEQ ID NO: 480013 - RNA, 19 nt, Homo sapiens
ccaauggaaagaucaccuu

SEQ ID NO: 480014 - RNA, 19 nt, Homo sapiens
cccaggcugugaauucaau

SEQ ID NO: 480015 - RNA, 19 nt, Homo sapiens
aguagacccacaagaauug

SEQ ID NO: 480016 - RNA, 19 nt, Homo sapiens
aagaggaagcugcaugaau

SEQ ID NO: 480017 - RNA, 19 nt, Homo sapiens
caagaggaagcugcaugaa

SEQ ID NO: 480018 - RNA, 19 nt, Homo sapiens
caggaugggcagauagaug

SEQ ID NO: 480019 - RNA, 19 nt, Homo sapiens
gacacagucuggcauugcu

SEQ ID NO: 480020 - RNA, 19 nt, Homo sapiens
auggaaagaucaccuucga

SEQ ID NO: 480021 - RNA, 19 nt, Homo sapiens
gcuggagacaacacuuuau

SEQ ID NO: 480022 - RNA, 19 nt, Homo sapiens
ggaggauacaaaccuuuua

SEQ ID NO: 480023 - RNA, 19 nt, Homo sapiens
cucuuugccuucgguaaua

SEQ ID NO: 480024 - RNA, 19 nt, Homo sapiens
cagcaagguguugugaauu

SEQ ID NO: 480025 - RNA, 19 nt, Homo sapiens
uucaaugugucaugagugu

SEQ ID NO: 480026 - RNA, 19 nt, Homo sapiens
uaaacuuacaucacgacuu

SEQ ID NO: 480027 - RNA, 19 nt, Homo sapiens
gaaacaaggugcuuuauaa

SEQ ID NO: 480028 - RNA, 19 nt, Homo sapiens
ucaaugaccucaagacaua

SEQ ID NO: 480029 - RNA, 19 nt, Homo sapiens
caacaaagccaucauaaug

SEQ ID NO: 480030 - RNA, 19 nt, Homo sapiens
gaaccacuauuacgugaaa

SEQ ID NO: 480031 - RNA, 19 nt, Homo sapiens
ggagauauauugaaacaag

SEQ ID NO: 480032 - RNA, 19 nt, Homo sapiens
caacauaugacaacaagua

SEQ ID NO: 480033 - RNA, 19 nt, Homo sapiens
gaacaagccaggacucaaa

SEQ ID NO: 480034 - RNA, 19 nt, Homo sapiens
gaagauagcagaaggaaag

SEQ ID NO: 480035 - RNA, 19 nt, Homo sapiens
caagaucaguugcuuauag

SEQ ID NO: 480036 - RNA, 19 nt, Homo sapiens
gacagcagcucaaauuguu

SEQ ID NO: 480037 - RNA, 19 nt, Homo sapiens
gagaagaaauaaugaugga

SEQ ID NO: 480038 - RNA, 19 nt, Homo sapiens
gcaaaugguuauaucacaa

SEQ ID NO: 480039 - RNA, 19 nt, Homo sapiens
caaaagaacucugguaauu

SEQ ID NO: 480040 - RNA, 19 nt, Homo sapiens
gaauucagcaauagagaua

SEQ ID NO: 480041 - RNA, 19 nt, Homo sapiens
guuaaaggaugcacuucua

SEQ ID NO: 480042 - RNA, 19 nt, Homo sapiens
caacauggcugcugaucca

SEQ ID NO: 480043 - RNA, 19 nt, Homo sapiens
uaagacagcagcucaaauu

SEQ ID NO: 480044 - RNA, 19 nt, Homo sapiens
gauggaagcuugcaaagac

SEQ ID NO: 480045 - RNA, 19 nt, Homo sapiens
gaaagcaaguucaaaagaa

SEQ ID NO: 480046 - RNA, 19 nt, Homo sapiens
gaauacccauuucaugaug

SEQ ID NO: 480047 - RNA, 19 nt, Homo sapiens
gaaauauacccuagagaug

SEQ ID NO: 480048 - RNA, 19 nt, Homo sapiens
ggaaagcuaugggcuacaa

SEQ ID NO: 480049 - RNA, 19 nt, Homo sapiens
gaucaguugcuuauagaua

SEQ ID NO: 480050 - RNA, 19 nt, Homo sapiens
aaagagaagccauauauug

SEQ ID NO: 480051 - RNA, 19 nt, Homo sapiens
caucaaaggcaacauauga

SEQ ID NO: 480052 - RNA, 19 nt, Homo sapiens
gaagguugcuauugacaca

SEQ ID NO: 480053 - RNA, 19 nt, Homo sapiens
caaggugcuuuauaagauu

SEQ ID NO: 480054 - RNA, 19 nt, Homo sapiens
gccaggagaugaaauauac

SEQ ID NO: 480055 - RNA, 19 nt, Homo sapiens
uaacuugggagauauauug

SEQ ID NO: 480056 - RNA, 19 nt, Homo sapiens
acaaagccaucauaauguu

SEQ ID NO: 480057 - RNA, 19 nt, Homo sapiens
cuucuuaacuugggagaua

SEQ ID NO: 480058 - RNA, 19 nt, Homo sapiens
uaaaugacuuugacucagu

SEQ ID NO: 480059 - RNA, 19 nt, Homo sapiens
gaugaaauauacccuagag

SEQ ID NO: 480060 - RNA, 19 nt, Homo sapiens
gaaguacccauggccuuua

SEQ ID NO: 480061 - RNA, 19 nt, Homo sapiens
caaaucaugucccagagau

SEQ ID NO: 480062 - RNA, 19 nt, Homo sapiens
acaaggugcuuuauaagau

SEQ ID NO: 480063 - RNA, 19 nt, Homo sapiens
gauaagauccacacacaca

SEQ ID NO: 480064 - RNA, 19 nt, Homo sapiens
gcugagagaguucuucaaa

SEQ ID NO: 480065 - RNA, 19 nt, Homo sapiens
ugaaacaaggugcuuuaua

SEQ ID NO: 480066 - RNA, 19 nt, Homo sapiens
gguaaucugaguucuuuaa

SEQ ID NO: 480067 - RNA, 19 nt, Homo sapiens
gcagaagaauggcaugaac

SEQ ID NO: 480068 - RNA, 19 nt, Homo sapiens
gacacaggguaccgacaua

SEQ ID NO: 480069 - RNA, 19 nt, Homo sapiens
gaaacagcauucccaucau

SEQ ID NO: 480070 - RNA, 19 nt, Homo sapiens
uuacacaucuuacugucaa

SEQ ID NO: 480071 - RNA, 19 nt, Homo sapiens
uauccaaccugaggaauga

SEQ ID NO: 480072 - RNA, 19 nt, Homo sapiens
ggucaacaaagccaucaua

SEQ ID NO: 480073 - RNA, 19 nt, Homo sapiens
gggaaaagguacaauaaga

SEQ ID NO: 480074 - RNA, 19 nt, Homo sapiens
uaucacaagucaaaucugu

SEQ ID NO: 480075 - RNA, 19 nt, Homo sapiens
gagaauggcaaaugguuau

SEQ ID NO: 480076 - RNA, 19 nt, Homo sapiens
gaaacaaccaacauauaca

SEQ ID NO: 480077 - RNA, 19 nt, Homo sapiens
gguuauaucacaagucaaa

SEQ ID NO: 480078 - RNA, 19 nt, Homo sapiens
gaccucaagacauauauuu

SEQ ID NO: 480079 - RNA, 19 nt, Homo sapiens
gaucucucuugcauccuua

SEQ ID NO: 480080 - RNA, 19 nt, Homo sapiens
gugauuugcugcaccuuga

SEQ ID NO: 480081 - RNA, 19 nt, Homo sapiens
ucacugucauacugucaua

SEQ ID NO: 480082 - RNA, 19 nt, Homo sapiens
ccgcauaccucuaagugau

SEQ ID NO: 480083 - RNA, 19 nt, Homo sapiens
aagauaagauccacacaca

SEQ ID NO: 480084 - RNA, 19 nt, Homo sapiens
ucagucacauugaaguaaa

SEQ ID NO: 480085 - RNA, 19 nt, Homo sapiens
uaauguuugugcaguguaa

SEQ ID NO: 480086 - RNA, 19 nt, Homo sapiens
ccagcuagauuauguggau

SEQ ID NO: 480087 - RNA, 19 nt, Homo sapiens
uaagccaggagaugaaaua

SEQ ID NO: 480088 - RNA, 19 nt, Homo sapiens
uaagggagccugugcaaca

SEQ ID NO: 480089 - RNA, 19 nt, Homo sapiens
gcuaugggcuacaaaucau

SEQ ID NO: 480090 - RNA, 19 nt, Homo sapiens
gacauugaagccuugaaua

SEQ ID NO: 480091 - RNA, 19 nt, Homo sapiens
ggacauugaagccuugaau

SEQ ID NO: 480092 - RNA, 19 nt, Homo sapiens
uaaaggaugcacuucuaaa

SEQ ID NO: 480093 - RNA, 19 nt, Homo sapiens
gagaugagaauggcaaaug

SEQ ID NO: 480094 - RNA, 19 nt, Homo sapiens
ugaaauauacccuagagau

SEQ ID NO: 480095 - RNA, 19 nt, Homo sapiens
gauaucuucuacuguggaa

SEQ ID NO: 480096 - RNA, 19 nt, Homo sapiens
gagaccaucuuggcuaaca

SEQ ID NO: 480097 - RNA, 19 nt, Homo sapiens
guugagaggacuacaugua

SEQ ID NO: 480098 - RNA, 19 nt, Homo sapiens
agacaucaaaggcaacaua

SEQ ID NO: 480099 - RNA, 19 nt, Homo sapiens
ggaugcacuucuaaacuca

SEQ ID NO: 480100 - RNA, 19 nt, Homo sapiens
aaacagcauucccaucauc

SEQ ID NO: 480101 - RNA, 19 nt, Homo sapiens
ggcaaaugguuauaucaca

SEQ ID NO: 480102 - RNA, 19 nt, Homo sapiens
aaauauacccuagagauga

SEQ ID NO: 480103 - RNA, 19 nt, Homo sapiens
cggugaagguugcuauuga

SEQ ID NO: 480104 - RNA, 19 nt, Homo sapiens
gauccacacacacauuauu

SEQ ID NO: 480105 - RNA, 19 nt, Homo sapiens
acauugaagccuugaauaa

SEQ ID NO: 480106 - RNA, 19 nt, Homo sapiens
cuugggagauauauugaaa

SEQ ID NO: 480107 - RNA, 19 nt, Homo sapiens
ugaaacaaccaacauauac

SEQ ID NO: 480108 - RNA, 19 nt, Homo sapiens
gauccauacuuacacaucu

SEQ ID NO: 480109 - RNA, 19 nt, Homo sapiens
ggcaacauaugacaacaag

SEQ ID NO: 480110 - RNA, 19 nt, Homo sapiens
gaaaccccgucucuacuaa

SEQ ID NO: 480111 - RNA, 19 nt, Homo sapiens
aagaagaaaugaaggacau

SEQ ID NO: 480112 - RNA, 19 nt, Homo sapiens
aagaucaguugcuuauaga

SEQ ID NO: 480113 - RNA, 19 nt, Homo sapiens
ccuauaaucccagcacuuu

SEQ ID NO: 480114 - RNA, 19 nt, Homo sapiens
gagaagauagcagaaggaa

SEQ ID NO: 480115 - RNA, 19 nt, Homo sapiens
auaaaacccugccuuguaa

SEQ ID NO: 480116 - RNA, 19 nt, Homo sapiens
gcuugaaacaaccaacaua

SEQ ID NO: 480117 - RNA, 19 nt, Homo sapiens
uugguaaucugaguucuuu

SEQ ID NO: 480118 - RNA, 19 nt, Homo sapiens
gguaguagcguugguaauc

SEQ ID NO: 480119 - RNA, 19 nt, Homo sapiens
caaucugggugaauguuuc

SEQ ID NO: 480120 - RNA, 19 nt, Homo sapiens
ggaauccaaucugggugaa

SEQ ID NO: 480121 - RNA, 19 nt, Homo sapiens
ugagaauggcaaaugguua

SEQ ID NO: 480122 - RNA, 19 nt, Homo sapiens
gaaaggugcggagggaaga

SEQ ID NO: 480123 - RNA, 19 nt, Homo sapiens
uaagauccacacacacauu

SEQ ID NO: 480124 - RNA, 19 nt, Homo sapiens
cauugaagccuugaauaaa

SEQ ID NO: 480125 - RNA, 19 nt, Homo sapiens
ucgagaccaucuuggcuaa

SEQ ID NO: 480126 - RNA, 19 nt, Homo sapiens
aaacagacacagccaagau

SEQ ID NO: 480127 - RNA, 19 nt, Homo sapiens
gaauaaaucugcugucuug

SEQ ID NO: 480128 - RNA, 19 nt, Homo sapiens
gcaaaucucugaaggaucu

SEQ ID NO: 480129 - RNA, 19 nt, Homo sapiens
ugacuucccuggccuauuu

SEQ ID NO: 480130 - RNA, 19 nt, Homo sapiens
ggagagagacguguacaua

SEQ ID NO: 480131 - RNA, 19 nt, Homo sapiens
aggcaaagcugaauaaauc

SEQ ID NO: 480132 - RNA, 19 nt, Homo sapiens
acauugagcuccucucuug

SEQ ID NO: 480133 - RNA, 19 nt, Homo sapiens
gaacacagacgugcucaug

SEQ ID NO: 480134 - RNA, 19 nt, Homo sapiens
gcgcacugcuguccacaaa

SEQ ID NO: 480135 - RNA, 19 nt, Homo sapiens
cggagaagcugccuaucaa

SEQ ID NO: 480136 - RNA, 19 nt, Homo sapiens
ugacagccaugaagacaga

SEQ ID NO: 480137 - RNA, 19 nt, Homo sapiens
gcaaggccaucgacuacau

SEQ ID NO: 480138 - RNA, 19 nt, Homo sapiens
ggaggguguuccuacauga

SEQ ID NO: 480139 - RNA, 19 nt, Homo sapiens
acacagacgugcucaugga

SEQ ID NO: 480140 - RNA, 19 nt, Homo sapiens
gcacugaggcaaagcugaa

SEQ ID NO: 480141 - RNA, 19 nt, Homo sapiens
gcacgacugucagcagaug

SEQ ID NO: 480142 - RNA, 19 nt, Homo sapiens
gggagagccuguacagcuu

SEQ ID NO: 480143 - RNA, 19 nt, Homo sapiens
ggaggcuucucuacaggaa

SEQ ID NO: 480144 - RNA, 19 nt, Homo sapiens
ccacuccauugaagaugua

SEQ ID NO: 480145 - RNA, 19 nt, Homo sapiens
gccagcagcuccauugaca

SEQ ID NO: 480146 - RNA, 19 nt, Homo sapiens
gccuacagcuucuccauca

SEQ ID NO: 480147 - RNA, 19 nt, Homo sapiens
ggcgcgaucuugacccuaa

SEQ ID NO: 480148 - RNA, 19 nt, Homo sapiens
ccaggugacucagcuauuc

SEQ ID NO: 480149 - RNA, 19 nt, Homo sapiens
agagagacguguacauagu

SEQ ID NO: 480150 - RNA, 19 nt, Homo sapiens
aagcaaaucucugaaggau

SEQ ID NO: 480151 - RNA, 19 nt, Homo sapiens
caaccaagacagugacuuc

SEQ ID NO: 480152 - RNA, 19 nt, Homo sapiens
gcggagaagcugccuauca

SEQ ID NO: 480153 - RNA, 19 nt, Homo sapiens
gagagagacguguacauag

SEQ ID NO: 480154 - RNA, 19 nt, Homo sapiens
gaggcaaagcugaauaaau

SEQ ID NO: 480155 - RNA, 19 nt, Homo sapiens
ccacaacgccauugagaag

SEQ ID NO: 480156 - RNA, 19 nt, Homo sapiens
ggucguagaugcggagaag

SEQ ID NO: 480157 - RNA, 19 nt, Homo sapiens
ggccugguaucaaggaaga

SEQ ID NO: 480158 - RNA, 19 nt, Homo sapiens
gaagagagggguacauuuc

SEQ ID NO: 480159 - RNA, 19 nt, Homo sapiens
gcaacacagcaaccagaaa

SEQ ID NO: 480160 - RNA, 19 nt, Homo sapiens
cgacaucgaagacaugcuu

SEQ ID NO: 480161 - RNA, 19 nt, Homo sapiens
gaaccaucuuggcaacagu

SEQ ID NO: 480162 - RNA, 19 nt, Homo sapiens
ggaaccaucuuggcaacag

SEQ ID NO: 480163 - RNA, 19 nt, Homo sapiens
gcggcugcauugagaguga

SEQ ID NO: 480164 - RNA, 19 nt, Homo sapiens
ccaccagcgucuaccauag

SEQ ID NO: 480165 - RNA, 19 nt, Homo sapiens
caacacagcaaccagaaac

SEQ ID NO: 480166 - RNA, 19 nt, Homo sapiens
gcuccuccaucaaugacaa

SEQ ID NO: 480167 - RNA, 19 nt, Homo sapiens
ccagagccguggagagaag

SEQ ID NO: 480168 - RNA, 19 nt, Homo sapiens
gagagacguguacauagug

SEQ ID NO: 480169 - RNA, 19 nt, Homo sapiens
ugugugaccugcuucuugu

SEQ ID NO: 480170 - RNA, 19 nt, Homo sapiens
gcacugcuguccacaaaag

SEQ ID NO: 480171 - RNA, 19 nt, Homo sapiens
gaaggcggcaggucucagu

SEQ ID NO: 480172 - RNA, 19 nt, Homo sapiens
cgacuacauucgcuuucug

SEQ ID NO: 480173 - RNA, 19 nt, Homo sapiens
gcgcaaggccaucgacuac

SEQ ID NO: 480174 - RNA, 19 nt, Homo sapiens
gcaaagcugaauaaaucug

SEQ ID NO: 480175 - RNA, 19 nt, Homo sapiens
aagacaugcuucagcuuau

SEQ ID NO: 480176 - RNA, 19 nt, Homo sapiens
ucaacaaccaagacaguga

SEQ ID NO: 480177 - RNA, 19 nt, Homo sapiens
cggaggguguuccuacaug

SEQ ID NO: 480178 - RNA, 19 nt, Homo sapiens
ugacagcuguggugaucca

SEQ ID NO: 480179 - RNA, 19 nt, Homo sapiens
ugaccgacaucgaagacau

SEQ ID NO: 480180 - RNA, 19 nt, Homo sapiens
gaugcuggcucaccuuucc

SEQ ID NO: 480181 - RNA, 19 nt, Homo sapiens
gcaguggagggaacacaga

SEQ ID NO: 480182 - RNA, 19 nt, Homo sapiens
gcacccacuccauugaaga

SEQ ID NO: 480183 - RNA, 19 nt, Homo sapiens
acucuggccuccacaguuc

SEQ ID NO: 480184 - RNA, 19 nt, Homo sapiens
acaaggccgugcagcuguu

SEQ ID NO: 480185 - RNA, 19 nt, Homo sapiens
ccacgggccuugcauuuuc

SEQ ID NO: 480186 - RNA, 19 nt, Homo sapiens
gcccacaacgccauugaga

SEQ ID NO: 480187 - RNA, 19 nt, Homo sapiens
ugcuucagcuuaucaacaa

SEQ ID NO: 480188 - RNA, 19 nt, Homo sapiens
ccagccagcagcuccauug

SEQ ID NO: 480189 - RNA, 19 nt, Homo sapiens
uguggcggcugcauugaga

SEQ ID NO: 480190 - RNA, 19 nt, Homo sapiens
cuuguagccuccucuggaa

SEQ ID NO: 480191 - RNA, 19 nt, Homo sapiens
agacggagccacugugaag

SEQ ID NO: 480192 - RNA, 19 nt, Homo sapiens
ggaagagagggguacauuu

SEQ ID NO: 480193 - RNA, 19 nt, Homo sapiens
ucugacagcuguggugauc

SEQ ID NO: 480194 - RNA, 19 nt, Homo sapiens
caucgacuacauucgcuuu

SEQ ID NO: 480195 - RNA, 19 nt, Homo sapiens
ccacugucacuuccagcua

SEQ ID NO: 480196 - RNA, 19 nt, Homo sapiens
ugaauaaaucugcugucuu

SEQ ID NO: 480197 - RNA, 19 nt, Homo sapiens
gagaaguuuuguacagaga

SEQ ID NO: 480198 - RNA, 19 nt, Homo sapiens
gcugacggaagccaacuug

SEQ ID NO: 480199 - RNA, 19 nt, Homo sapiens
ggccgaaggcagugcaaga

SEQ ID NO: 480200 - RNA, 19 nt, Homo sapiens
uguccugcgucgaagcuuu

SEQ ID NO: 480201 - RNA, 19 nt, Homo sapiens
cugaauaaaucugcugucu

SEQ ID NO: 480202 - RNA, 19 nt, Homo sapiens
gaaguuuuguacagagaau

SEQ ID NO: 480203 - RNA, 19 nt, Homo sapiens
cagccagccugaccaucug

SEQ ID NO: 480204 - RNA, 19 nt, Homo sapiens
ccuuggugcuucucuuugu

SEQ ID NO: 480205 - RNA, 19 nt, Homo sapiens
gcaaccagaaacucaagca

SEQ ID NO: 480206 - RNA, 19 nt, Homo sapiens
caaggccaucgacuacauu

SEQ ID NO: 480207 - RNA, 19 nt, Homo sapiens
uaucaacaaccaagacagu

SEQ ID NO: 480208 - RNA, 19 nt, Homo sapiens
ccgggaggcuucucuacag

SEQ ID NO: 480209 - RNA, 19 nt, Homo sapiens
agagacguguacauagugu

SEQ ID NO: 480210 - RNA, 19 nt, Homo sapiens
cagcagcuccauugacaag

SEQ ID NO: 480211 - RNA, 19 nt, Homo sapiens
agacaugcuucagcuuauc

SEQ ID NO: 480212 - RNA, 19 nt, Homo sapiens
ggugggcacugaggcaaag

SEQ ID NO: 480213 - RNA, 19 nt, Homo sapiens
gcacacccagguccagagu

SEQ ID NO: 480214 - RNA, 19 nt, Homo sapiens
gaaggcagugcaagagacu

SEQ ID NO: 480215 - RNA, 19 nt, Homo sapiens
guuccugugugaccugcuu

SEQ ID NO: 480216 - RNA, 19 nt, Homo sapiens
aaagcaaaucucugaagga

SEQ ID NO: 480217 - RNA, 19 nt, Homo sapiens
cugaggcaaagcugaauaa

SEQ ID NO: 480218 - RNA, 19 nt, Homo sapiens
gcugcugaccgacaucgaa

SEQ ID NO: 480219 - RNA, 19 nt, Homo sapiens
cccugucucuagccacuuu

SEQ ID NO: 480220 - RNA, 19 nt, Homo sapiens
gacaugcuucagcuuauca

SEQ ID NO: 480221 - RNA, 19 nt, Homo sapiens
uacagcuucuccaucaguu

SEQ ID NO: 480222 - RNA, 19 nt, Homo sapiens
cuauguggcggcugcauug

SEQ ID NO: 480223 - RNA, 19 nt, Homo sapiens
agcgagcacugaacugugu

SEQ ID NO: 480224 - RNA, 19 nt, Homo sapiens
ugacagcccagucuuugag

SEQ ID NO: 480225 - RNA, 19 nt, Homo sapiens
cacaaaagcaaaucucuga

SEQ ID NO: 480226 - RNA, 19 nt, Homo sapiens
gaccgacaucgaagacaug

SEQ ID NO: 480227 - RNA, 19 nt, Homo sapiens
gagcggagcuggucuguga

SEQ ID NO: 480228 - RNA, 19 nt, Homo sapiens
gaagagagcugugaauucu

SEQ ID NO: 480229 - RNA, 19 nt, Homo sapiens
caagagaaagugcccauua

SEQ ID NO: 480230 - RNA, 19 nt, Homo sapiens
gcacaagucuggcguucug

SEQ ID NO: 480231 - RNA, 19 nt, Homo sapiens
gaaaggcggacaacccaua

SEQ ID NO: 480232 - RNA, 19 nt, Homo sapiens
aaacucagcugcaacaaca

SEQ ID NO: 480233 - RNA, 19 nt, Homo sapiens
gaacccuacucucuccuuu

SEQ ID NO: 480234 - RNA, 19 nt, Homo sapiens
gcaagguguuccugcauga

SEQ ID NO: 480235 - RNA, 19 nt, Homo sapiens
gcugguaaauggugugauu

SEQ ID NO: 480236 - RNA, 19 nt, Homo sapiens
guagaccgcucacggauuc

SEQ ID NO: 480237 - RNA, 19 nt, Homo sapiens
gcggaugcaugaaauaaug

SEQ ID NO: 480238 - RNA, 19 nt, Homo sapiens
gccagcagaugauuguuaa

SEQ ID NO: 480239 - RNA, 19 nt, Homo sapiens
gaagaucgaggacuuuaau

SEQ ID NO: 480240 - RNA, 19 nt, Homo sapiens
cgauaucgcuccuccauca

SEQ ID NO: 480241 - RNA, 19 nt, Homo sapiens
aagagaaagugcccauuaa

SEQ ID NO: 480242 - RNA, 19 nt, Homo sapiens
agaguucccugacuuguuu

SEQ ID NO: 480243 - RNA, 19 nt, Homo sapiens
gcagucugguggacaauga

SEQ ID NO: 480244 - RNA, 19 nt, Homo sapiens
gaagcccucuauuggauga

SEQ ID NO: 480245 - RNA, 19 nt, Homo sapiens
gaugccuacucuucucuua

SEQ ID NO: 480246 - RNA, 19 nt, Homo sapiens
gcaggucaaucauaaacug

SEQ ID NO: 480247 - RNA, 19 nt, Homo sapiens
gcugugcgcucucauuuua

SEQ ID NO: 480248 - RNA, 19 nt, Homo sapiens
cacaaugccuguaaugaug

SEQ ID NO: 480249 - RNA, 19 nt, Homo sapiens
caacagacgguaaugauca

SEQ ID NO: 480250 - RNA, 19 nt, Homo sapiens
ggacagcgcucuggcaaaa

SEQ ID NO: 480251 - RNA, 19 nt, Homo sapiens
caaggagagucuauacugu

SEQ ID NO: 480252 - RNA, 19 nt, Homo sapiens
ggaccauucugaccacaau

SEQ ID NO: 480253 - RNA, 19 nt, Homo sapiens
augcaaaggucaaagauga

SEQ ID NO: 480254 - RNA, 19 nt, Homo sapiens
gagcuggucugugaaguca

SEQ ID NO: 480255 - RNA, 19 nt, Homo sapiens
gacaacccauaauaucauu

SEQ ID NO: 480256 - RNA, 19 nt, Homo sapiens
ccaccucucucucgauuuc

SEQ ID NO: 480257 - RNA, 19 nt, Homo sapiens
gaacccagcugaccccauu

SEQ ID NO: 480258 - RNA, 19 nt, Homo sapiens
uaaagcugcugucacuaga

SEQ ID NO: 480259 - RNA, 19 nt, Homo sapiens
gaaacaggcagaucuggau

SEQ ID NO: 480260 - RNA, 19 nt, Homo sapiens
ugaccacacugaagacaga

SEQ ID NO: 480261 - RNA, 19 nt, Homo sapiens
gaagaagagagcugugaau

SEQ ID NO: 480262 - RNA, 19 nt, Homo sapiens
caccaggccuucugcaaga

SEQ ID NO: 480263 - RNA, 19 nt, Homo sapiens
ggacaacccauaauaucau

SEQ ID NO: 480264 - RNA, 19 nt, Homo sapiens
ccagacggcugcccuucaa

SEQ ID NO: 480265 - RNA, 19 nt, Homo sapiens
ggugacauccucccaggua

SEQ ID NO: 480266 - RNA, 19 nt, Homo sapiens
guaaucaagugggagaguu

SEQ ID NO: 480267 - RNA, 19 nt, Homo sapiens
ggacagacgccaagaugca

SEQ ID NO: 480268 - RNA, 19 nt, Homo sapiens
gacgagaugcugcaauuug

SEQ ID NO: 480269 - RNA, 19 nt, Homo sapiens
gaaggccauugauuacauc

SEQ ID NO: 480270 - RNA, 19 nt, Homo sapiens
cccauaauaucauugagaa

SEQ ID NO: 480271 - RNA, 19 nt, Homo sapiens
cacauuaccuuccuucucu

SEQ ID NO: 480272 - RNA, 19 nt, Homo sapiens
ggaagaagagagcugugaa

SEQ ID NO: 480273 - RNA, 19 nt, Homo sapiens
ugcagcaggucaaucauaa

SEQ ID NO: 480274 - RNA, 19 nt, Homo sapiens
caacaacagacgguaauga

SEQ ID NO: 480275 - RNA, 19 nt, Homo sapiens
ucgacgagaugcugcaauu

SEQ ID NO: 480276 - RNA, 19 nt, Homo sapiens
gcaguguccugucauucga

SEQ ID NO: 480277 - RNA, 19 nt, Homo sapiens
gcagaugggcagcagaguu

SEQ ID NO: 480278 - RNA, 19 nt, Homo sapiens
ccacaaugccuguaaugau

SEQ ID NO: 480279 - RNA, 19 nt, Homo sapiens
guaaugaucacgccaacau

SEQ ID NO: 480280 - RNA, 19 nt, Homo sapiens
gggcaacuccuauucuuca

SEQ ID NO: 480281 - RNA, 19 nt, Homo sapiens
ccaggaagcccucuauugg

SEQ ID NO: 480282 - RNA, 19 nt, Homo sapiens
gugcuuggguuugccauga

SEQ ID NO: 480283 - RNA, 19 nt, Homo sapiens
gcucuggaguacuugaaau

SEQ ID NO: 480284 - RNA, 19 nt, Homo sapiens
caacccauaauaucauuga

SEQ ID NO: 480285 - RNA, 19 nt, Homo sapiens
ccaaggagagucuauacug

SEQ ID NO: 480286 - RNA, 19 nt, Homo sapiens
gcacacugguugagaucca

SEQ ID NO: 480287 - RNA, 19 nt, Homo sapiens
ucuuauggcugguaaaugg

SEQ ID NO: 480288 - RNA, 19 nt, Homo sapiens
gaugaugccuacucuucuc

SEQ ID NO: 480289 - RNA, 19 nt, Homo sapiens
gccaggaagcccucuauug

SEQ ID NO: 480290 - RNA, 19 nt, Homo sapiens
uccagcagccuuugauaua

SEQ ID NO: 480291 - RNA, 19 nt, Homo sapiens
cagggcaacuccuauucuu

SEQ ID NO: 480292 - RNA, 19 nt, Homo sapiens
guccugagcgucuuuguga

SEQ ID NO: 480293 - RNA, 19 nt, Homo sapiens
gagaguucccugacuuguu

SEQ ID NO: 480294 - RNA, 19 nt, Homo sapiens
ccuuaaagcugcugucacu

SEQ ID NO: 480295 - RNA, 19 nt, Homo sapiens
ucgaggacuuuaaucagaa

SEQ ID NO: 480296 - RNA, 19 nt, Homo sapiens
cagcauaccgcaagguguu

SEQ ID NO: 480297 - RNA, 19 nt, Homo sapiens
gcacaucacagggaagcuu

SEQ ID NO: 480298 - RNA, 19 nt, Homo sapiens
ugcugaagcuggcaaauca

SEQ ID NO: 480299 - RNA, 19 nt, Homo sapiens
gggcagcagugggaccauu

SEQ ID NO: 480300 - RNA, 19 nt, Homo sapiens
gaguugcuguagcgucuug

SEQ ID NO: 480301 - RNA, 19 nt, Homo sapiens
gaguuucucucuccugaac

SEQ ID NO: 480302 - RNA, 19 nt, Homo sapiens
cagcugugcgcucucauuu

SEQ ID NO: 480303 - RNA, 19 nt, Homo sapiens
ugaaaccucaggccaagaa

SEQ ID NO: 480304 - RNA, 19 nt, Homo sapiens
ggaugcggcucuggccuau

SEQ ID NO: 480305 - RNA, 19 nt, Homo sapiens
ggacuuuaaucagaauguc

SEQ ID NO: 480306 - RNA, 19 nt, Homo sapiens
gcuccuccaucaaugacaa

SEQ ID NO: 480307 - RNA, 19 nt, Homo sapiens
gcggacaacccauaauauc

SEQ ID NO: 480308 - RNA, 19 nt, Homo sapiens
ggacgucugcaaucacugu

SEQ ID NO: 480309 - RNA, 19 nt, Homo sapiens
cgagcacacugguugagau

SEQ ID NO: 480310 - RNA, 19 nt, Homo sapiens
gcuggcugcucaagaaagu

SEQ ID NO: 480311 - RNA, 19 nt, Homo sapiens
ucuauuggaugaugcaaag

SEQ ID NO: 480312 - RNA, 19 nt, Homo sapiens
ccuacuccauugacucuga

SEQ ID NO: 480313 - RNA, 19 nt, Homo sapiens
ccgugaaccuggcugaaug

SEQ ID NO: 480314 - RNA, 19 nt, Homo sapiens
agaaagugcccauuaagca

SEQ ID NO: 480315 - RNA, 19 nt, Homo sapiens
guacagccggucaccauuc

SEQ ID NO: 480316 - RNA, 19 nt, Homo sapiens
gcagcugugcgcucucauu

SEQ ID NO: 480317 - RNA, 19 nt, Homo sapiens
ugccuacucuucucuuaug

SEQ ID NO: 480318 - RNA, 19 nt, Homo sapiens
aggaagcccucuauuggau

SEQ ID NO: 480319 - RNA, 19 nt, Homo sapiens
gagaugcugcaauuuguca

SEQ ID NO: 480320 - RNA, 19 nt, Homo sapiens
gaaggagaaaggcggacaa

SEQ ID NO: 480321 - RNA, 19 nt, Homo sapiens
ccuccagccuuccugaguu

SEQ ID NO: 480322 - RNA, 19 nt, Homo sapiens
aagcugcugucacuagaug

SEQ ID NO: 480323 - RNA, 19 nt, Homo sapiens
agaagagagcugugaauuc

SEQ ID NO: 480324 - RNA, 19 nt, Homo sapiens
ccacugaggcaggcuuuga

SEQ ID NO: 480325 - RNA, 19 nt, Homo sapiens
gguaaauggugugauuguc

SEQ ID NO: 480326 - RNA, 19 nt, Homo sapiens
gcagcaggucaaucauaaa

SEQ ID NO: 480327 - RNA, 19 nt, Homo sapiens
gcaaagugcuuauaaugug

SEQ ID NO: 480328 - RNA, 19 nt, Homo sapiens
guacagagcuuucuuuugu

SEQ ID NO: 480329 - RNA, 19 nt, Homo sapiens
gcaacugacuucauuugug

SEQ ID NO: 480330 - RNA, 19 nt, Homo sapiens
gaggagaccuuugaugaau

SEQ ID NO: 480331 - RNA, 19 nt, Homo sapiens
gagcagcuacuguaacuuu

SEQ ID NO: 480332 - RNA, 19 nt, Homo sapiens
ggagugagcagcuacugua

SEQ ID NO: 480333 - RNA, 19 nt, Homo sapiens
ggacugugcugaagaguac

SEQ ID NO: 480334 - RNA, 19 nt, Homo sapiens
uauaauguguguuguguga

SEQ ID NO: 480335 - RNA, 19 nt, Homo sapiens
cagcuuggcucgauguuug

SEQ ID NO: 480336 - RNA, 19 nt, Homo sapiens
ggagaccuuugaugaauuc

SEQ ID NO: 480337 - RNA, 19 nt, Homo sapiens
aguauuagcuuacccaaug

SEQ ID NO: 480338 - RNA, 19 nt, Homo sapiens
ggauggcaccacuuauuua

SEQ ID NO: 480339 - RNA, 19 nt, Homo sapiens
caagggauggcaccacuua

SEQ ID NO: 480340 - RNA, 19 nt, Homo sapiens
uggcaccacuuauuuauug

SEQ ID NO: 480341 - RNA, 19 nt, Homo sapiens
gggaggagaccuuugauga

SEQ ID NO: 480342 - RNA, 19 nt, Homo sapiens
agacagaucucaccuacca

SEQ ID NO: 480343 - RNA, 19 nt, Homo sapiens
ggacucaggucuguaacug

SEQ ID NO: 480344 - RNA, 19 nt, Homo sapiens
aguguaaccucaguauuua

SEQ ID NO: 480345 - RNA, 19 nt, Homo sapiens
ggaggagaccuuugaugaa

SEQ ID NO: 480346 - RNA, 19 nt, Homo sapiens
caagauggaagucaccuuu

SEQ ID NO: 480347 - RNA, 19 nt, Homo sapiens
agaggcaacugacuucauu

SEQ ID NO: 480348 - RNA, 19 nt, Homo sapiens
ggaagagggagaccaaaug

SEQ ID NO: 480349 - RNA, 19 nt, Homo sapiens
gaccuuugaugaauucuuc

SEQ ID NO: 480350 - RNA, 19 nt, Homo sapiens
gaagagggagaccaaaugu

SEQ ID NO: 480351 - RNA, 19 nt, Homo sapiens
gggauggcaccacuuauuu

SEQ ID NO: 480352 - RNA, 19 nt, Homo sapiens
caaagugcuuauaaugugu

SEQ ID NO: 480353 - RNA, 19 nt, Homo sapiens
gggaugauuugccgacaug

SEQ ID NO: 480354 - RNA, 19 nt, Homo sapiens
agacgggcaucaugaagaa

SEQ ID NO: 480355 - RNA, 19 nt, Homo sapiens
ggaagacgggcaucaugaa

SEQ ID NO: 480356 - RNA, 19 nt, Homo sapiens
ggacagagccaccccauga

SEQ ID NO: 480357 - RNA, 19 nt, Homo sapiens
gcagcgacccuugguguuu

SEQ ID NO: 480358 - RNA, 19 nt, Homo sapiens
agacagacccagugaguga

SEQ ID NO: 480359 - RNA, 19 nt, Homo sapiens
gcgugaagaucaagaugga

SEQ ID NO: 480360 - RNA, 19 nt, Homo sapiens
gcaccaagagugaaugauc

SEQ ID NO: 480361 - RNA, 19 nt, Homo sapiens
gcuuauggguggcuuucaa

SEQ ID NO: 480362 - RNA, 19 nt, Homo sapiens
aaguguaaccucaguauuu

SEQ ID NO: 480363 - RNA, 19 nt, Homo sapiens
gagacgaagugaaaacaaa

SEQ ID NO: 480364 - RNA, 19 nt, Homo sapiens
ccucccagcugcuuuacuu

SEQ ID NO: 480365 - RNA, 19 nt, Homo sapiens
gauggcaccacuuauuuau

SEQ ID NO: 480366 - RNA, 19 nt, Homo sapiens
gagugugugugcuugaaug

SEQ ID NO: 480367 - RNA, 19 nt, Homo sapiens
ugccaugaguauuagcuua

SEQ ID NO: 480368 - RNA, 19 nt, Homo sapiens
ugugugugcuugaauguga

SEQ ID NO: 480369 - RNA, 19 nt, Homo sapiens
gcaccuagcaccucuacca

SEQ ID NO: 480370 - RNA, 19 nt, Homo sapiens
ugagacaggccauguguau

SEQ ID NO: 480371 - RNA, 19 nt, Homo sapiens
uacacgaccuucagcaaga

SEQ ID NO: 480372 - RNA, 19 nt, Homo sapiens
ggcaaagugcuuauaaugu

SEQ ID NO: 480373 - RNA, 19 nt, Homo sapiens
gcaccagugucugcuagug

SEQ ID NO: 480374 - RNA, 19 nt, Homo sapiens
ggccauguguauaccuuug

SEQ ID NO: 480375 - RNA, 19 nt, Homo sapiens
ucaggcaaagugcuuauaa

SEQ ID NO: 480376 - RNA, 19 nt, Homo sapiens
gaaucaggcaaagugcuua

SEQ ID NO: 480377 - RNA, 19 nt, Homo sapiens
ugucagugguuucuacuuc

SEQ ID NO: 480378 - RNA, 19 nt, Homo sapiens
gaggaagacgggcaucaug

SEQ ID NO: 480379 - RNA, 19 nt, Homo sapiens
caggcaaagugcuuauaau

SEQ ID NO: 480380 - RNA, 19 nt, Homo sapiens
gugagcagcuacuguaacu

SEQ ID NO: 480381 - RNA, 19 nt, Homo sapiens
gcuugaaugugagugugua

SEQ ID NO: 480382 - RNA, 19 nt, Homo sapiens
gggccaagccggguaagaa

SEQ ID NO: 480383 - RNA, 19 nt, Homo sapiens
ccacagcucugggccucuu

SEQ ID NO: 480384 - RNA, 19 nt, Homo sapiens
caccacuuauuuauuguug

SEQ ID NO: 480385 - RNA, 19 nt, Homo sapiens
gagacaggccauguguaua

SEQ ID NO: 480386 - RNA, 19 nt, Homo sapiens
gugcuuauaauguguguug

SEQ ID NO: 480387 - RNA, 19 nt, Homo sapiens
ccaaugggacugugcugaa

SEQ ID NO: 480388 - RNA, 19 nt, Homo sapiens
ucacaguccuauguacaga

SEQ ID NO: 480389 - RNA, 19 nt, Homo sapiens
gaaugugaguguguauguc

SEQ ID NO: 480390 - RNA, 19 nt, Homo sapiens
gagugaaucaggcaaagug

SEQ ID NO: 480391 - RNA, 19 nt, Homo sapiens
gggaagagggagaccaaau

SEQ ID NO: 480392 - RNA, 19 nt, Homo sapiens
gaagacgggcaucaugaag

SEQ ID NO: 480393 - RNA, 19 nt, Homo sapiens
ggaugcugacccaggaaua

SEQ ID NO: 480394 - RNA, 19 nt, Homo sapiens
guaugucagugguuucuac

SEQ ID NO: 480395 - RNA, 19 nt, Homo sapiens
caguucagcuccaccagau

SEQ ID NO: 480396 - RNA, 19 nt, Homo sapiens
caacagaccagagaaugag

SEQ ID NO: 480397 - RNA, 19 nt, Homo sapiens
uuuaugcacagccuaguua

SEQ ID NO: 480398 - RNA, 19 nt, Homo sapiens
gagggaagagggagaccaa

SEQ ID NO: 480399 - RNA, 19 nt, Homo sapiens
ccaccucccauuucuguug

SEQ ID NO: 480400 - RNA, 19 nt, Homo sapiens
gaugaguugaggugauauu

SEQ ID NO: 480401 - RNA, 19 nt, Homo sapiens
gaugauuugccgacauguu

SEQ ID NO: 480402 - RNA, 19 nt, Homo sapiens
gcacagccuaguuaucaag

SEQ ID NO: 480403 - RNA, 19 nt, Homo sapiens
gcaccacuuauuuauuguu

SEQ ID NO: 480404 - RNA, 19 nt, Homo sapiens
gggacugugcugaagagua

SEQ ID NO: 480405 - RNA, 19 nt, Homo sapiens
acaacagaccagagaauga

SEQ ID NO: 480406 - RNA, 19 nt, Homo sapiens
ccacaacagaccagagaau

SEQ ID NO: 480407 - RNA, 19 nt, Homo sapiens
aaagacagacccagugagu

SEQ ID NO: 480408 - RNA, 19 nt, Homo sapiens
gaagaucaagauggaguuc

SEQ ID NO: 480409 - RNA, 19 nt, Homo sapiens
aaacugcagcccaugauca

SEQ ID NO: 480410 - RNA, 19 nt, Homo sapiens
agacaggccauguguauac

SEQ ID NO: 480411 - RNA, 19 nt, Homo sapiens
guguguaugucagugguuu

SEQ ID NO: 480412 - RNA, 19 nt, Homo sapiens
cagcgacccuugguguuuc

SEQ ID NO: 480413 - RNA, 19 nt, Homo sapiens
gagacuagcuggggcuuau

SEQ ID NO: 480414 - RNA, 19 nt, Homo sapiens
gagugagcagcuacuguaa

SEQ ID NO: 480415 - RNA, 19 nt, Homo sapiens
uugaggagacgaagugaaa

SEQ ID NO: 480416 - RNA, 19 nt, Homo sapiens
caaugggacugugcugaag

SEQ ID NO: 480417 - RNA, 19 nt, Homo sapiens
cuuauaauguguguugugu

SEQ ID NO: 480418 - RNA, 19 nt, Homo sapiens
uaaccucuaacccucauug

SEQ ID NO: 480419 - RNA, 19 nt, Homo sapiens
gcaccguguccuccucuga

SEQ ID NO: 480420 - RNA, 19 nt, Homo sapiens
gaucccuguuucagcaguu

SEQ ID NO: 480421 - RNA, 19 nt, Homo sapiens
ugaaugugaguguguaugu

SEQ ID NO: 480422 - RNA, 19 nt, Homo sapiens
gugagugugugugcuugaa

SEQ ID NO: 480423 - RNA, 19 nt, Homo sapiens
aggcaaagugcuuauaaug

SEQ ID NO: 480424 - RNA, 19 nt, Homo sapiens
aggagaccuuugaugaauu

SEQ ID NO: 480425 - RNA, 19 nt, Homo sapiens
gaagaagugggagcagcuu

SEQ ID NO: 480426 - RNA, 19 nt, Homo sapiens
ggucacaguccuauguaca

SEQ ID NO: 480427 - RNA, 19 nt, Homo sapiens
gaagacagcccucaaggaa

SEQ ID NO: 480428 - RNA, 19 nt, Homo sapiens
agacagcccucaaggaaga

SEQ ID NO: 480429 - RNA, 19 nt, Homo sapiens
agaugcagcugaaguacua

SEQ ID NO: 480430 - RNA, 19 nt, Homo sapiens
ccgaaagucucuucaagga

SEQ ID NO: 480431 - RNA, 19 nt, Homo sapiens
gcaagaacccgagcacgaa

SEQ ID NO: 480432 - RNA, 19 nt, Homo sapiens
ucaaggagaugcggcaguu

SEQ ID NO: 480433 - RNA, 19 nt, Homo sapiens
gcacggagagagacgaguu

SEQ ID NO: 480434 - RNA, 19 nt, Homo sapiens
gcccaccaaccaaguguua

SEQ ID NO: 480435 - RNA, 19 nt, Homo sapiens
gcaccuggaccucaucaag

SEQ ID NO: 480436 - RNA, 19 nt, Homo sapiens
ccuauuaccagcucaugaa

SEQ ID NO: 480437 - RNA, 19 nt, Homo sapiens
ccaucucucugccuucugu

SEQ ID NO: 480438 - RNA, 19 nt, Homo sapiens
ucauccaagucuccaagaa

SEQ ID NO: 480439 - RNA, 19 nt, Homo sapiens
cagcugaaguacuacaacu

SEQ ID NO: 480440 - RNA, 19 nt, Homo sapiens
uggcgcagaugcagcugaa

SEQ ID NO: 480441 - RNA, 19 nt, Homo sapiens
ugaagacagcccucaagga

SEQ ID NO: 480442 - RNA, 19 nt, Homo sapiens
gcgcagaugcagcugaagu

SEQ ID NO: 480443 - RNA, 19 nt, Homo sapiens
cgcgaaaggugcugaucau

SEQ ID NO: 480444 - RNA, 19 nt, Homo sapiens
cgccgaaagucucuucaag

SEQ ID NO: 480445 - RNA, 19 nt, Homo sapiens
ccaagucuccaagaaguuc

SEQ ID NO: 480446 - RNA, 19 nt, Homo sapiens
ccuuugugcugcccgaguu

SEQ ID NO: 480447 - RNA, 19 nt, Homo sapiens
gguguuggacggugucauc

SEQ ID NO: 480448 - RNA, 19 nt, Homo sapiens
cgcagaugcagcugaagua

SEQ ID NO: 480449 - RNA, 19 nt, Homo sapiens
ccaccaaccaaguguuaca

SEQ ID NO: 480450 - RNA, 19 nt, Homo sapiens
ucacugaccucgccaagga

SEQ ID NO: 480451 - RNA, 19 nt, Homo sapiens
ccaaggagauccagacacu

SEQ ID NO: 480452 - RNA, 19 nt, Homo sapiens
gcagaagggacggcucuuu

SEQ ID NO: 480453 - RNA, 19 nt, Homo sapiens
gcuccaagaucccggucaa

SEQ ID NO: 480454 - RNA, 19 nt, Homo sapiens
gaucaaggucaucaaguca

SEQ ID NO: 480455 - RNA, 19 nt, Homo sapiens
cgaucaaggucaucaaguc

SEQ ID NO: 480456 - RNA, 19 nt, Homo sapiens
ggccaauuaucgugucuuc

SEQ ID NO: 480457 - RNA, 19 nt, Homo sapiens
gcucaaggacgacaucuac

SEQ ID NO: 480458 - RNA, 19 nt, Homo sapiens
caagucagccaacaugaag

SEQ ID NO: 480459 - RNA, 19 nt, Homo sapiens
caucaagucagccaacaug

SEQ ID NO: 480460 - RNA, 19 nt, Homo sapiens
aaggagauccagacacuga

SEQ ID NO: 480461 - RNA, 19 nt, Homo sapiens
ucaagucagccaacaugaa

SEQ ID NO: 480462 - RNA, 19 nt, Homo sapiens
ccaauuaucgugucuucuc

SEQ ID NO: 480463 - RNA, 19 nt, Homo sapiens
cagaagggacggcucuuuc

SEQ ID NO: 480464 - RNA, 19 nt, Homo sapiens
gcucuuccuugcgcucuau

SEQ ID NO: 480465 - RNA, 19 nt, Homo sapiens
ccaagaucccggucaagug

SEQ ID NO: 480466 - RNA, 19 nt, Homo sapiens
caucgucacggaacucaug

SEQ ID NO: 480467 - RNA, 19 nt, Homo sapiens
ccugcaagguggcugacuu

SEQ ID NO: 480468 - RNA, 19 nt, Homo sapiens
ggaggucuacgugcucaug

SEQ ID NO: 480469 - RNA, 19 nt, Homo sapiens
gcugggugaaggcuacuuu

SEQ ID NO: 480470 - RNA, 19 nt, Homo sapiens
ccaacaugaagcucacuga

SEQ ID NO: 480471 - RNA, 19 nt, Homo sapiens
uggcugagggcaugagcua

SEQ ID NO: 480472 - RNA, 19 nt, Homo sapiens
ggagauccagacacugaag

SEQ ID NO: 480473 - RNA, 19 nt, Homo sapiens
caggcucugugcccucgaa

SEQ ID NO: 480474 - RNA, 19 nt, Homo sapiens
gaugggaacuuguguguua

SEQ ID NO: 480475 - RNA, 19 nt, Homo sapiens
ucagagagaucaguaaaua

SEQ ID NO: 480476 - RNA, 19 nt, Homo sapiens
gaugaucacugugcuauaa

SEQ ID NO: 480477 - RNA, 19 nt, Homo sapiens
gaagggcuauggauuaguu

SEQ ID NO: 480478 - RNA, 19 nt, Homo sapiens
ggaauuaacuccacaccau

SEQ ID NO: 480479 - RNA, 19 nt, Homo sapiens
gcaaugacuuugaaucuag

SEQ ID NO: 480480 - RNA, 19 nt, Homo sapiens
ugucacaacuguuauguuu

SEQ ID NO: 480481 - RNA, 19 nt, Homo sapiens
gguuugaaaugaagacuuu

SEQ ID NO: 480482 - RNA, 19 nt, Homo sapiens
ucagaagggcuauggauua

SEQ ID NO: 480483 - RNA, 19 nt, Homo sapiens
gaaauuccacagucaacua

SEQ ID NO: 480484 - RNA, 19 nt, Homo sapiens
cauacuguguaccuaauua

SEQ ID NO: 480485 - RNA, 19 nt, Homo sapiens
uaagggauuuguaguauca

SEQ ID NO: 480486 - RNA, 19 nt, Homo sapiens
ugaaggcacuacauugaaa

SEQ ID NO: 480487 - RNA, 19 nt, Homo sapiens
ggaaauugaacaagaaaug

SEQ ID NO: 480488 - RNA, 19 nt, Homo sapiens
caaggaagcccgcaauguu

SEQ ID NO: 480489 - RNA, 19 nt, Homo sapiens
guacugaaaccaccauauu

SEQ ID NO: 480490 - RNA, 19 nt, Homo sapiens
gacguuagguaguuuguug

SEQ ID NO: 480491 - RNA, 19 nt, Homo sapiens
gaacaagaaaugcaucugu

SEQ ID NO: 480492 - RNA, 19 nt, Homo sapiens
gaauuaacuccacaccaua

SEQ ID NO: 480493 - RNA, 19 nt, Homo sapiens
uggcaaauuuguaucagua

SEQ ID NO: 480494 - RNA, 19 nt, Homo sapiens
aaaugcaucugucuuagaa

SEQ ID NO: 480495 - RNA, 19 nt, Homo sapiens
gaaaccaccauauuacaga

SEQ ID NO: 480496 - RNA, 19 nt, Homo sapiens
gcaguguagucucaauuau

SEQ ID NO: 480497 - RNA, 19 nt, Homo sapiens
cuuagaaacuggagauuau

SEQ ID NO: 480498 - RNA, 19 nt, Homo sapiens
uaagugggcuguucagaag

SEQ ID NO: 480499 - RNA, 19 nt, Homo sapiens
gugaaugguuugaaaugaa

SEQ ID NO: 480500 - RNA, 19 nt, Homo sapiens
acaaguaugcuuugccuua

SEQ ID NO: 480501 - RNA, 19 nt, Homo sapiens
gaaacuggagauuauuuga

SEQ ID NO: 480502 - RNA, 19 nt, Homo sapiens
gaaaugcaucugucuuaga

SEQ ID NO: 480503 - RNA, 19 nt, Homo sapiens
ucaaauauaggcauucuga

SEQ ID NO: 480504 - RNA, 19 nt, Homo sapiens
ucccuuagcuauaugaauu

SEQ ID NO: 480505 - RNA, 19 nt, Homo sapiens
gagaaagguugggacagaa

SEQ ID NO: 480506 - RNA, 19 nt, Homo sapiens
caacuaaugcgacuuaugg

SEQ ID NO: 480507 - RNA, 19 nt, Homo sapiens
ucaaauccuugcauacuuc

SEQ ID NO: 480508 - RNA, 19 nt, Homo sapiens
ugccuuauuuccacauuua

SEQ ID NO: 480509 - RNA, 19 nt, Homo sapiens
gagauuauuugauguuagg

SEQ ID NO: 480510 - RNA, 19 nt, Homo sapiens
caaguaugcuuugccuuau

SEQ ID NO: 480511 - RNA, 19 nt, Homo sapiens
guauagcaguguagucuca

SEQ ID NO: 480512 - RNA, 19 nt, Homo sapiens
gaaaguaauugugacuaac

SEQ ID NO: 480513 - RNA, 19 nt, Homo sapiens
cacgugugguucucaaaua

SEQ ID NO: 480514 - RNA, 19 nt, Homo sapiens
gcaguuauuugaguguaug

SEQ ID NO: 480515 - RNA, 19 nt, Homo sapiens
gaucagaagcagcaguuau

SEQ ID NO: 480516 - RNA, 19 nt, Homo sapiens
ggagauuauuugauguuag

SEQ ID NO: 480517 - RNA, 19 nt, Homo sapiens
gcaaauguuuucaguuaga

SEQ ID NO: 480518 - RNA, 19 nt, Homo sapiens
agagaaagguugggacaga

SEQ ID NO: 480519 - RNA, 19 nt, Homo sapiens
aaggaagcccgcaauguua

SEQ ID NO: 480520 - RNA, 19 nt, Homo sapiens
ggcacuacauugaaauaug

SEQ ID NO: 480521 - RNA, 19 nt, Homo sapiens
agaagcagcaguuauuuga

SEQ ID NO: 480522 - RNA, 19 nt, Homo sapiens
guugagcaaugacuuugaa

SEQ ID NO: 480523 - RNA, 19 nt, Homo sapiens
cauggaaacugagugaaug

SEQ ID NO: 480524 - RNA, 19 nt, Homo sapiens
gagcaaugacuuugaaucu

SEQ ID NO: 480525 - RNA, 19 nt, Homo sapiens
ugacuaacaaguaugcuuu

SEQ ID NO: 480526 - RNA, 19 nt, Homo sapiens
cagaagggcuauggauuag

SEQ ID NO: 480527 - RNA, 19 nt, Homo sapiens
gugcuauaauguacugaaa

SEQ ID NO: 480528 - RNA, 19 nt, Homo sapiens
guaacuaagugggcuguuc

SEQ ID NO: 480529 - RNA, 19 nt, Homo sapiens
gagcuagggaugcaaaugu

SEQ ID NO: 480530 - RNA, 19 nt, Homo sapiens
gucaaauccuugcauacuu

SEQ ID NO: 480531 - RNA, 19 nt, Homo sapiens
aguaugcuuugccuuauuu

SEQ ID NO: 480532 - RNA, 19 nt, Homo sapiens
caguguagucucaauuaua

SEQ ID NO: 480533 - RNA, 19 nt, Homo sapiens
ucacugugcuauaauguac

SEQ ID NO: 480534 - RNA, 19 nt, Homo sapiens
ccucaagaaugaaaugaag

SEQ ID NO: 480535 - RNA, 19 nt, Homo sapiens
uacugaaaccaccauauua

SEQ ID NO: 480536 - RNA, 19 nt, Homo sapiens
ggaaacugagugaaugguu

SEQ ID NO: 480537 - RNA, 19 nt, Homo sapiens
caagauguaaagaagauug

SEQ ID NO: 480538 - RNA, 19 nt, Homo sapiens
aaaccaccauauuacagaa

SEQ ID NO: 480539 - RNA, 19 nt, Homo sapiens
uuguuucucuggcaaauuu

SEQ ID NO: 480540 - RNA, 19 nt, Homo sapiens
guucucaaauauaggcauu

SEQ ID NO: 480541 - RNA, 19 nt, Homo sapiens
aaauauaggcauucugaug

SEQ ID NO: 480542 - RNA, 19 nt, Homo sapiens
gcacgugugguucucaaau

SEQ ID NO: 480543 - RNA, 19 nt, Homo sapiens
cugagugaaugguuugaaa

SEQ ID NO: 480544 - RNA, 19 nt, Homo sapiens
cuguguaccuaauuaugua

SEQ ID NO: 480545 - RNA, 19 nt, Homo sapiens
uaacuccacaccauaguau

SEQ ID NO: 480546 - RNA, 19 nt, Homo sapiens
ugaaugguuugaaaugaag

SEQ ID NO: 480547 - RNA, 19 nt, Homo sapiens
guguaugaauggaaugaug

SEQ ID NO: 480548 - RNA, 19 nt, Homo sapiens
cagcaguuauuugagugua

SEQ ID NO: 480549 - RNA, 19 nt, Homo sapiens
uuaccucgcugacccuaug

SEQ ID NO: 480550 - RNA, 19 nt, Homo sapiens
gagugaaugguuugaaaug

SEQ ID NO: 480551 - RNA, 19 nt, Homo sapiens
cagagagaucaguaaauaa

SEQ ID NO: 480552 - RNA, 19 nt, Homo sapiens
ugacaccccugcccauuuu

SEQ ID NO: 480553 - RNA, 19 nt, Homo sapiens
aagcagcaguuauuugagu

SEQ ID NO: 480554 - RNA, 19 nt, Homo sapiens
gcauuguuauacauacugu

SEQ ID NO: 480555 - RNA, 19 nt, Homo sapiens
uaaaauguaugcuguugug

SEQ ID NO: 480556 - RNA, 19 nt, Homo sapiens
gaaggcacuacauugaaau

SEQ ID NO: 480557 - RNA, 19 nt, Homo sapiens
gcgcugccgagaagcuuua

SEQ ID NO: 480558 - RNA, 19 nt, Homo sapiens
gcaucugucuuagaaacug

SEQ ID NO: 480559 - RNA, 19 nt, Homo sapiens
cuaagugggcuguucagaa

SEQ ID NO: 480560 - RNA, 19 nt, Homo sapiens
ucacaacuguuauguuuuc

SEQ ID NO: 480561 - RNA, 19 nt, Homo sapiens
gauguaaagaagauugaga

SEQ ID NO: 480562 - RNA, 19 nt, Homo sapiens
gaaauugaacaagaaaugc

SEQ ID NO: 480563 - RNA, 19 nt, Homo sapiens
uaacuaagugggcuguuca

SEQ ID NO: 480564 - RNA, 19 nt, Homo sapiens
acugucaaauccuugcaua

SEQ ID NO: 480565 - RNA, 19 nt, Homo sapiens
ggcuauggauuaguuugaa

SEQ ID NO: 480566 - RNA, 19 nt, Homo sapiens
cagaagcagcaguuauuug

SEQ ID NO: 480567 - RNA, 19 nt, Homo sapiens
gcuauaauguacugaaacc

SEQ ID NO: 480568 - RNA, 19 nt, Homo sapiens
gcauucugaugggaacuug

SEQ ID NO: 480569 - RNA, 19 nt, Homo sapiens
ugaucacugugcuauaaug

SEQ ID NO: 480570 - RNA, 19 nt, Homo sapiens
ucagaagcagcaguuauuu

SEQ ID NO: 480571 - RNA, 19 nt, Homo sapiens
aacuggagauuauuugaug

SEQ ID NO: 480572 - RNA, 19 nt, Homo sapiens
agaaaugcaucugucuuag

SEQ ID NO: 480573 - RNA, 19 nt, Homo sapiens
gcuagggaugcaaauguuu

SEQ ID NO: 480574 - RNA, 19 nt, Homo sapiens
gaagagcaagcuaucauua

SEQ ID NO: 480575 - RNA, 19 nt, Homo sapiens
ccaaggaagugaauaaguu

SEQ ID NO: 480576 - RNA, 19 nt, Homo sapiens
ggucugugcugcaugguua

SEQ ID NO: 480577 - RNA, 19 nt, Homo sapiens
gaaccaaacccauuccaaa

SEQ ID NO: 480578 - RNA, 19 nt, Homo sapiens
guuauauacuccuggauua

SEQ ID NO: 480579 - RNA, 19 nt, Homo sapiens
aagaauaguugcaguguuu

SEQ ID NO: 480580 - RNA, 19 nt, Homo sapiens
gggcauacauuuccugcuu

SEQ ID NO: 480581 - RNA, 19 nt, Homo sapiens
ccaaacccauuccaaagaa

SEQ ID NO: 480582 - RNA, 19 nt, Homo sapiens
guagacaucucugugaaga

SEQ ID NO: 480583 - RNA, 19 nt, Homo sapiens
agagcaagcuaucauuaaa

SEQ ID NO: 480584 - RNA, 19 nt, Homo sapiens
ucagauggcuuauucaaac

SEQ ID NO: 480585 - RNA, 19 nt, Homo sapiens
acuccuggauuauagauua

SEQ ID NO: 480586 - RNA, 19 nt, Homo sapiens
ugacggagcugaccagacu

SEQ ID NO: 480587 - RNA, 19 nt, Homo sapiens
guaugacggucgaaccaaa

SEQ ID NO: 480588 - RNA, 19 nt, Homo sapiens
gugguaagaaucuaguuua

SEQ ID NO: 480589 - RNA, 19 nt, Homo sapiens
ggauaguugugguaagaau

SEQ ID NO: 480590 - RNA, 19 nt, Homo sapiens
gaaagaauaguugcagugu

SEQ ID NO: 480591 - RNA, 19 nt, Homo sapiens
caaggaagugaauaaguuu

SEQ ID NO: 480592 - RNA, 19 nt, Homo sapiens
uauaucaccuugaagaagu

SEQ ID NO: 480593 - RNA, 19 nt, Homo sapiens
caagcuaucauuaaacaug

SEQ ID NO: 480594 - RNA, 19 nt, Homo sapiens
uaggauaguugugguaaga

SEQ ID NO: 480595 - RNA, 19 nt, Homo sapiens
gcauacauuuccugcuuuc

SEQ ID NO: 480596 - RNA, 19 nt, Homo sapiens
caaacccauuccaaagaaa

SEQ ID NO: 480597 - RNA, 19 nt, Homo sapiens
caguaaagggcauacauuu

SEQ ID NO: 480598 - RNA, 19 nt, Homo sapiens
gcuccaaggaagugaauaa

SEQ ID NO: 480599 - RNA, 19 nt, Homo sapiens
ucaaaccuccuuagagcua

SEQ ID NO: 480600 - RNA, 19 nt, Homo sapiens
ggcauacauuuccugcuuu

SEQ ID NO: 480601 - RNA, 19 nt, Homo sapiens
aaagaauaguugcaguguu

SEQ ID NO: 480602 - RNA, 19 nt, Homo sapiens
gguuauauacuccuggauu

SEQ ID NO: 480603 - RNA, 19 nt, Homo sapiens
gaauaguugcaguguuuau

SEQ ID NO: 480604 - RNA, 19 nt, Homo sapiens
caacagcagcacaguaaag

SEQ ID NO: 480605 - RNA, 19 nt, Homo sapiens
gcgucuauaucaccuugaa

SEQ ID NO: 480606 - RNA, 19 nt, Homo sapiens
uuccugcuuucaccaauua

SEQ ID NO: 480607 - RNA, 19 nt, Homo sapiens
guaaagggcauacauuucc

SEQ ID NO: 480608 - RNA, 19 nt, Homo sapiens
aagagcaagcuaucauuaa

SEQ ID NO: 480609 - RNA, 19 nt, Homo sapiens
uugcaguguuuauaggaua

SEQ ID NO: 480610 - RNA, 19 nt, Homo sapiens
auuaaccacugaauugcua

SEQ ID NO: 480611 - RNA, 19 nt, Homo sapiens
ugugcugcaugguuauaua

SEQ ID NO: 480612 - RNA, 19 nt, Homo sapiens
gauuaaaagucucuguaga

SEQ ID NO: 480613 - RNA, 19 nt, Homo sapiens
ugaagagcaagcuaucauu

SEQ ID NO: 480614 - RNA, 19 nt, Homo sapiens
ggucgaaccaaacccauuc

SEQ ID NO: 480615 - RNA, 19 nt, Homo sapiens
aaacuaagaagaccaaagc

SEQ ID NO: 480616 - RNA, 19 nt, Homo sapiens
agcaagcuaucauuaaaca

SEQ ID NO: 480617 - RNA, 19 nt, Homo sapiens
acaguaaagggcauacauu

SEQ ID NO: 480618 - RNA, 19 nt, Homo sapiens
caguagguguuuucacaua

SEQ ID NO: 480619 - RNA, 19 nt, Homo sapiens
ucaccuugaagaaguauga

SEQ ID NO: 480620 - RNA, 19 nt, Homo sapiens
aguuucagauggcuuauuc

SEQ ID NO: 480621 - RNA, 19 nt, Homo sapiens
gagcaagcuaucauuaaac

SEQ ID NO: 480622 - RNA, 19 nt, Homo sapiens
gugaagagcaagcuaucau

SEQ ID NO: 480623 - RNA, 19 nt, Homo sapiens
gaugggaagaagaagauca

SEQ ID NO: 480624 - RNA, 19 nt, Homo sapiens
cauaagauuaggguccuuu

SEQ ID NO: 480625 - RNA, 19 nt, Homo sapiens
uauaggauaguugugguaa

SEQ ID NO: 480626 - RNA, 19 nt, Homo sapiens
cuaccgaugggaagaagaa

SEQ ID NO: 480627 - RNA, 19 nt, Homo sapiens
ugaccagacuuuuccagaa

SEQ ID NO: 480628 - RNA, 19 nt, Homo sapiens
cuguagacaucucugugaa

SEQ ID NO: 480629 - RNA, 19 nt, Homo sapiens
ggccagauagcuagguuuc

SEQ ID NO: 480630 - RNA, 19 nt, Homo sapiens
ccgcgaugguguuguugga

SEQ ID NO: 480631 - RNA, 19 nt, Homo sapiens
gagcuaccgaugggaagaa

SEQ ID NO: 480632 - RNA, 19 nt, Homo sapiens
gucuauaucaccuugaaga

SEQ ID NO: 480633 - RNA, 19 nt, Homo sapiens
uaauuggucugugcugcau

SEQ ID NO: 480634 - RNA, 19 nt, Homo sapiens
cgaaccaaacccauuccaa

SEQ ID NO: 480635 - RNA, 19 nt, Homo sapiens
gcugcaugguuauauacuc

SEQ ID NO: 480636 - RNA, 19 nt, Homo sapiens
gauaguugugguaagaauc

SEQ ID NO: 480637 - RNA, 19 nt, Homo sapiens
auaucaccuugaagaagua

SEQ ID NO: 480638 - RNA, 19 nt, Homo sapiens
gaccagacuuuuccagaag

SEQ ID NO: 480639 - RNA, 19 nt, Homo sapiens
cuccuggauuauagauuaa

SEQ ID NO: 480640 - RNA, 19 nt, Homo sapiens
guugcaguguuuauaggau

SEQ ID NO: 480641 - RNA, 19 nt, Homo sapiens
uaaagggcauacauuuccu

SEQ ID NO: 480642 - RNA, 19 nt, Homo sapiens
gagcuccaaggaagugaau

SEQ ID NO: 480643 - RNA, 19 nt, Homo sapiens
gaauggagacuucuaauuu

SEQ ID NO: 480644 - RNA, 19 nt, Homo sapiens
acaauggacuguacaauaa

SEQ ID NO: 480645 - RNA, 19 nt, Homo sapiens
cagcagaaaugauaccuaa

SEQ ID NO: 480646 - RNA, 19 nt, Homo sapiens
ggacuuaacguauuucuug

SEQ ID NO: 480647 - RNA, 19 nt, Homo sapiens
cuacagagauucaagaugu

SEQ ID NO: 480648 - RNA, 19 nt, Homo sapiens
gacaauggacuguacaaua

SEQ ID NO: 480649 - RNA, 19 nt, Homo sapiens
caggacagguuuauuugua

SEQ ID NO: 480650 - RNA, 19 nt, Homo sapiens
ucauuuaacugaacuguga

SEQ ID NO: 480651 - RNA, 19 nt, Homo sapiens
guaagucaguaauguugua

SEQ ID NO: 480652 - RNA, 19 nt, Homo sapiens
gaccaggacagguuuauuu

SEQ ID NO: 480653 - RNA, 19 nt, Homo sapiens
ggagacuucuaauuuguau

SEQ ID NO: 480654 - RNA, 19 nt, Homo sapiens
guaucuauccugcuuauuu

SEQ ID NO: 480655 - RNA, 19 nt, Homo sapiens
guacaguucccaucacgua

SEQ ID NO: 480656 - RNA, 19 nt, Homo sapiens
guaugcagcagaaaugaua

SEQ ID NO: 480657 - RNA, 19 nt, Homo sapiens
ugaccaaagucuucaacaa

SEQ ID NO: 480658 - RNA, 19 nt, Homo sapiens
agacaugaauggagacuuc

SEQ ID NO: 480659 - RNA, 19 nt, Homo sapiens
ucacguaagucaguaaugu

SEQ ID NO: 480660 - RNA, 19 nt, Homo sapiens
ggaaucgugauguccaaua

SEQ ID NO: 480661 - RNA, 19 nt, Homo sapiens
gcaguuggacuuaacguau

SEQ ID NO: 480662 - RNA, 19 nt, Homo sapiens
gauucaagauguauguuca

SEQ ID NO: 480663 - RNA, 19 nt, Homo sapiens
ggacagguuuauuuguauc

SEQ ID NO: 480664 - RNA, 19 nt, Homo sapiens
ggagggaaacagaagcuuu

SEQ ID NO: 480665 - RNA, 19 nt, Homo sapiens
aauggagacuucuaauuug

SEQ ID NO: 480666 - RNA, 19 nt, Homo sapiens
caucggaguugacagugaa

SEQ ID NO: 480667 - RNA, 19 nt, Homo sapiens
gcagaaaugauaccuaaac

SEQ ID NO: 480668 - RNA, 19 nt, Homo sapiens
guuugcaucucgcguauau

SEQ ID NO: 480669 - RNA, 19 nt, Homo sapiens
caacaaggagagggaagua

SEQ ID NO: 480670 - RNA, 19 nt, Homo sapiens
ccaaagucuucaacaagga

SEQ ID NO: 480671 - RNA, 19 nt, Homo sapiens
gaaucgugauguccaauac

SEQ ID NO: 480672 - RNA, 19 nt, Homo sapiens
guucagcaguuggacuuaa

SEQ ID NO: 480673 - RNA, 19 nt, Homo sapiens
ccuugugccucucaucuuu

SEQ ID NO: 480674 - RNA, 19 nt, Homo sapiens
caguuggacuuaacguauu

SEQ ID NO: 480675 - RNA, 19 nt, Homo sapiens
gaccaaagucuucaacaag

SEQ ID NO: 480676 - RNA, 19 nt, Homo sapiens
gacuuaacguauuucuuga

SEQ ID NO: 480677 - RNA, 19 nt, Homo sapiens
ugaauggagacuucuaauu

SEQ ID NO: 480678 - RNA, 19 nt, Homo sapiens
cagcaucaaguauguggua

SEQ ID NO: 480679 - RNA, 19 nt, Homo sapiens
guaucagcaucaaguaugu

SEQ ID NO: 480680 - RNA, 19 nt, Homo sapiens
agauguauguucagcaguu

SEQ ID NO: 480681 - RNA, 19 nt, Homo sapiens
gaguugacagugaaacaaa

SEQ ID NO: 480682 - RNA, 19 nt, Homo sapiens
acaaggagagggaaguaaa

SEQ ID NO: 480683 - RNA, 19 nt, Homo sapiens
cagaaaugauaccuaaacu

SEQ ID NO: 480684 - RNA, 19 nt, Homo sapiens
gauguauguucagcaguug

SEQ ID NO: 480685 - RNA, 19 nt, Homo sapiens
gagaauggaaucgugaugu

SEQ ID NO: 480686 - RNA, 19 nt, Homo sapiens
ggaguugacagugaaacaa

SEQ ID NO: 480687 - RNA, 19 nt, Homo sapiens
caugaauggagacuucuaa

SEQ ID NO: 480688 - RNA, 19 nt, Homo sapiens
gggagccucugccuuguac

SEQ ID NO: 480689 - RNA, 19 nt, Homo sapiens
cuuaacguauuucuugaga

SEQ ID NO: 480690 - RNA, 19 nt, Homo sapiens
uaaguaaggcuguugaaaa

SEQ ID NO: 480691 - RNA, 19 nt, Homo sapiens
guaugugguacuacuguaa

SEQ ID NO: 480692 - RNA, 19 nt, Homo sapiens
uaaccuaguaucagcauca

SEQ ID NO: 480693 - RNA, 19 nt, Homo sapiens
ggacaauggacuguacaau

SEQ ID NO: 480694 - RNA, 19 nt, Homo sapiens
ggaaggcgaauccccauaa

SEQ ID NO: 480695 - RNA, 19 nt, Homo sapiens
aacaggaggugcugaccaa

SEQ ID NO: 480696 - RNA, 19 nt, Homo sapiens
caucagaaguuugcaucuc

SEQ ID NO: 480697 - RNA, 19 nt, Homo sapiens
gcagcagaaaugauaccua

SEQ ID NO: 480698 - RNA, 19 nt, Homo sapiens
aauguuguaugcagcagaa

SEQ ID NO: 480699 - RNA, 19 nt, Homo sapiens
agaauggaaucgugauguc

SEQ ID NO: 480700 - RNA, 19 nt, Homo sapiens
uccuacagcuacagagauu

SEQ ID NO: 480701 - RNA, 19 nt, Homo sapiens
ucaucggaguugacaguga

SEQ ID NO: 480702 - RNA, 19 nt, Homo sapiens
aauguacucuagagaaugg

SEQ ID NO: 480703 - RNA, 19 nt, Homo sapiens
aggacagguuuauuuguau

SEQ ID NO: 480704 - RNA, 19 nt, Homo sapiens
guugacagugaaacaaauu

SEQ ID NO: 480705 - RNA, 19 nt, Homo sapiens
aggaggugcugaccaaagu

SEQ ID NO: 480706 - RNA, 19 nt, Homo sapiens
ccucugccuuguacaguuc

SEQ ID NO: 480707 - RNA, 19 nt, Homo sapiens
aguuggacuuaacguauuu

SEQ ID NO: 480708 - RNA, 19 nt, Homo sapiens
uggacuguacaauaaguua

SEQ ID NO: 480709 - RNA, 19 nt, Homo sapiens
gagggaaacagaagcuuuu

SEQ ID NO: 480710 - RNA, 19 nt, Homo sapiens
cuacagcuacagagauuca

SEQ ID NO: 480711 - RNA, 19 nt, Homo sapiens
guacuacuguaagagacau

SEQ ID NO: 480712 - RNA, 19 nt, Homo sapiens
gcagagggaaggcgaaucc

SEQ ID NO: 480713 - RNA, 19 nt, Homo sapiens
guuugcaucauuuaacuga

SEQ ID NO: 480714 - RNA, 19 nt, Homo sapiens
ccuaguaucagcaucaagu

SEQ ID NO: 480715 - RNA, 19 nt, Homo sapiens
aagaaguaaccuaguauca

SEQ ID NO: 480716 - RNA, 19 nt, Homo sapiens
aaguaaggcuguugaaaau

SEQ ID NO: 480717 - RNA, 19 nt, Homo sapiens
gugccucucaucuuuauca

SEQ ID NO: 480718 - RNA, 19 nt, Homo sapiens
guuguaugcagcagaaaug

SEQ ID NO: 480719 - RNA, 19 nt, Homo sapiens
gccucugccuuguacaguu

SEQ ID NO: 480720 - RNA, 19 nt, Homo sapiens
cagcuacagagauucaaga

SEQ ID NO: 480721 - RNA, 19 nt, Homo sapiens
uggagacuucuaauuugua

SEQ ID NO: 480722 - RNA, 19 nt, Homo sapiens
ccauaaguaaggcuguuga

SEQ ID NO: 480723 - RNA, 19 nt, Homo sapiens
ggacuguacaauaaguuac

SEQ ID NO: 480724 - RNA, 19 nt, Homo sapiens
gacagugaaacaaauuuac

SEQ ID NO: 480725 - RNA, 19 nt, Homo sapiens
uaucaucggaguugacagu

SEQ ID NO: 480726 - RNA, 19 nt, Homo sapiens
cuaguaucagcaucaagua

SEQ ID NO: 480727 - RNA, 19 nt, Homo sapiens
cauaaguaaggcuguugaa

SEQ ID NO: 480728 - RNA, 19 nt, Homo sapiens
aauggacuguacaauaagu

SEQ ID NO: 480729 - RNA, 19 nt, Homo sapiens
gaacccuugugccucucau

SEQ ID NO: 480730 - RNA, 19 nt, Homo sapiens
auggagacuucuaauuugu

SEQ ID NO: 480731 - RNA, 19 nt, Homo sapiens
ccaggacagguuuauuugu

SEQ ID NO: 480732 - RNA, 19 nt, Homo sapiens
guucaaagcuagcauauua

SEQ ID NO: 480733 - RNA, 19 nt, Homo sapiens
ggaagcagauguuaauauu

SEQ ID NO: 480734 - RNA, 19 nt, Homo sapiens
gaagagguauugaaugcua

SEQ ID NO: 480735 - RNA, 19 nt, Homo sapiens
gaaguuggaugacaaugaa

SEQ ID NO: 480736 - RNA, 19 nt, Homo sapiens
gaagaccuguuuaauaugu

SEQ ID NO: 480737 - RNA, 19 nt, Homo sapiens
uggaagaccuguuuaauau

SEQ ID NO: 480738 - RNA, 19 nt, Homo sapiens
gaaaugaacaggagucaau

SEQ ID NO: 480739 - RNA, 19 nt, Homo sapiens
uggcaaggcuaaagaaauu

SEQ ID NO: 480740 - RNA, 19 nt, Homo sapiens
uauggaagcuauacagaaa

SEQ ID NO: 480741 - RNA, 19 nt, Homo sapiens
gcaagaggaucggguguau

SEQ ID NO: 480742 - RNA, 19 nt, Homo sapiens
ucaaguugcuaaugcuaua

SEQ ID NO: 480743 - RNA, 19 nt, Homo sapiens
gaaggaguagagaaauuua

SEQ ID NO: 480744 - RNA, 19 nt, Homo sapiens
agacauguaugagcaauuu

SEQ ID NO: 480745 - RNA, 19 nt, Homo sapiens
agauguagccucaguaaua

SEQ ID NO: 480746 - RNA, 19 nt, Homo sapiens
ggucaguaguuaaauaaug

SEQ ID NO: 480747 - RNA, 19 nt, Homo sapiens
uagcagaccuuggaagaaa

SEQ ID NO: 480748 - RNA, 19 nt, Homo sapiens
gaugggagguaucaaagga

SEQ ID NO: 480749 - RNA, 19 nt, Homo sapiens
gacacaauauaccaaguuu

SEQ ID NO: 480750 - RNA, 19 nt, Homo sapiens
ggaagaauccaaagaguag

SEQ ID NO: 480751 - RNA, 19 nt, Homo sapiens
gguauugaaugcuaugcua

SEQ ID NO: 480752 - RNA, 19 nt, Homo sapiens
uugaaggacugauagauaa

SEQ ID NO: 480753 - RNA, 19 nt, Homo sapiens
ugaaaggcaugaugggauu

SEQ ID NO: 480754 - RNA, 19 nt, Homo sapiens
ugacucaguugaauaccua

SEQ ID NO: 480755 - RNA, 19 nt, Homo sapiens
uagauaaagucaacgaguu

SEQ ID NO: 480756 - RNA, 19 nt, Homo sapiens
gauuauguuuguuggauug

SEQ ID NO: 480757 - RNA, 19 nt, Homo sapiens
uuaaagaacuugugaagcu

SEQ ID NO: 480758 - RNA, 19 nt, Homo sapiens
uagaugacuuugaaccuuu

SEQ ID NO: 480759 - RNA, 19 nt, Homo sapiens
gauguagccucaguaauag

SEQ ID NO: 480760 - RNA, 19 nt, Homo sapiens
agaaauggauccugucauc

SEQ ID NO: 480761 - RNA, 19 nt, Homo sapiens
aaacaguccuggucaguag

SEQ ID NO: 480762 - RNA, 19 nt, Homo sapiens
gccaagcauugcauuugua

SEQ ID NO: 480763 - RNA, 19 nt, Homo sapiens
gcaaggcuaaagaaauuaa

SEQ ID NO: 480764 - RNA, 19 nt, Homo sapiens
gaacauauagaugacuuug

SEQ ID NO: 480765 - RNA, 19 nt, Homo sapiens
gacccuacuuuaucuaguu

SEQ ID NO: 480766 - RNA, 19 nt, Homo sapiens
gaucaagaacuagacagua

SEQ ID NO: 480767 - RNA, 19 nt, Homo sapiens
cgacauugaaggacugaua

SEQ ID NO: 480768 - RNA, 19 nt, Homo sapiens
auagagaaguugaaacaug

SEQ ID NO: 480769 - RNA, 19 nt, Homo sapiens
ugacaaugaagcacuuaua

SEQ ID NO: 480770 - RNA, 19 nt, Homo sapiens
ggacacccacuaaaggaaa

SEQ ID NO: 480771 - RNA, 19 nt, Homo sapiens
ggacagauuuuaugagcaa

SEQ ID NO: 480772 - RNA, 19 nt, Homo sapiens
gggaacauauagaugacuu

SEQ ID NO: 480773 - RNA, 19 nt, Homo sapiens
guagauguagccucaguaa

SEQ ID NO: 480774 - RNA, 19 nt, Homo sapiens
ccuggucaguaguuaaaua

SEQ ID NO: 480775 - RNA, 19 nt, Homo sapiens
ggaugacaaugaagcacuu

SEQ ID NO: 480776 - RNA, 19 nt, Homo sapiens
caaagcaagaauuccauuu

SEQ ID NO: 480777 - RNA, 19 nt, Homo sapiens
ggccaagcauugcauuugu

SEQ ID NO: 480778 - RNA, 19 nt, Homo sapiens
uuucaaagguggcgacaug

SEQ ID NO: 480779 - RNA, 19 nt, Homo sapiens
uagcaaacuucuugguaug

SEQ ID NO: 480780 - RNA, 19 nt, Homo sapiens
uuagcaaacuucuugguau

SEQ ID NO: 480781 - RNA, 19 nt, Homo sapiens
ggcaugaugggauucaaua

SEQ ID NO: 480782 - RNA, 19 nt, Homo sapiens
uaaagaacuugugaagcuu

SEQ ID NO: 480783 - RNA, 19 nt, Homo sapiens
caacaaauggccaaaauga

SEQ ID NO: 480784 - RNA, 19 nt, Homo sapiens
aaagaugggagguaucaaa

SEQ ID NO: 480785 - RNA, 19 nt, Homo sapiens
ugaaggaguagagaaauuu

SEQ ID NO: 480786 - RNA, 19 nt, Homo sapiens
caaugaagcacuuauagag

SEQ ID NO: 480787 - RNA, 19 nt, Homo sapiens
uuggaagaccuguuuaaua

SEQ ID NO: 480788 - RNA, 19 nt, Homo sapiens
gugaagcaacuaagagaaa

SEQ ID NO: 480789 - RNA, 19 nt, Homo sapiens
ggcgacaugucuaagaaug

SEQ ID NO: 480790 - RNA, 19 nt, Homo sapiens
augaagcacuuauagagaa

SEQ ID NO: 480791 - RNA, 19 nt, Homo sapiens
cugaaggaguagagaaauu

SEQ ID NO: 480792 - RNA, 19 nt, Homo sapiens
aauguuaagucugcuauug

SEQ ID NO: 480793 - RNA, 19 nt, Homo sapiens
gaagcuauacagaaaugga

SEQ ID NO: 480794 - RNA, 19 nt, Homo sapiens
guggcgacaugucuaagaa

SEQ ID NO: 480795 - RNA, 19 nt, Homo sapiens
gaucggguguaucaacaag

SEQ ID NO: 480796 - RNA, 19 nt, Homo sapiens
gacaaugaagcacuuauag

SEQ ID NO: 480797 - RNA, 19 nt, Homo sapiens
uggaagcuauacagaaaug

SEQ ID NO: 480798 - RNA, 19 nt, Homo sapiens
gaacuugugaagcuuguag

SEQ ID NO: 480799 - RNA, 19 nt, Homo sapiens
ccaagcauugcauuuguaa

SEQ ID NO: 480800 - RNA, 19 nt, Homo sapiens
ggaagaccuguuuaauaug

SEQ ID NO: 480801 - RNA, 19 nt, Homo sapiens
ggcaucuggucuuaacaaa

SEQ ID NO: 480802 - RNA, 19 nt, Homo sapiens
uaaacaguccuggucagua

SEQ ID NO: 480803 - RNA, 19 nt, Homo sapiens
gcaugaugggauucaauaa

SEQ ID NO: 480804 - RNA, 19 nt, Homo sapiens
caggaagaauccaaagagu

SEQ ID NO: 480805 - RNA, 19 nt, Homo sapiens
caaccaggaagaauccaaa

SEQ ID NO: 480806 - RNA, 19 nt, Homo sapiens
uaaacaaccaggaagaauc

SEQ ID NO: 480807 - RNA, 19 nt, Homo sapiens
uggauaguaugaaugauca

SEQ ID NO: 480808 - RNA, 19 nt, Homo sapiens
gggccucgcuaaggaauuc

SEQ ID NO: 480809 - RNA, 19 nt, Homo sapiens
gaaauggauccugucauca

SEQ ID NO: 480810 - RNA, 19 nt, Homo sapiens
gcguugggacccuacuuua

SEQ ID NO: 480811 - RNA, 19 nt, Homo sapiens
gcaagggagugguaaaaca

SEQ ID NO: 480812 - RNA, 19 nt, Homo sapiens
agggagaaauacaugguuu

SEQ ID NO: 480813 - RNA, 19 nt, Homo sapiens
guaaacaaccaggaagaau

SEQ ID NO: 480814 - RNA, 19 nt, Homo sapiens
ugaaguuggaugacaauga

SEQ ID NO: 480815 - RNA, 19 nt, Homo sapiens
uaagucugcuauugaucuu

SEQ ID NO: 480816 - RNA, 19 nt, Homo sapiens
ccucaguaauagugacaaa

SEQ ID NO: 480817 - RNA, 19 nt, Homo sapiens
gaaaugcuucaaguugcua

SEQ ID NO: 480818 - RNA, 19 nt, Homo sapiens
ccacaaacaagaagacucu

SEQ ID NO: 480819 - RNA, 19 nt, Homo sapiens
gugauuauguuuguuggau

SEQ ID NO: 480820 - RNA, 19 nt, Homo sapiens
gcauggacacccacuaaag

SEQ ID NO: 480821 - RNA, 19 nt, Homo sapiens
guuggaagcagauguuaau

SEQ ID NO: 480822 - RNA, 19 nt, Homo sapiens
gauccuaggguucuucauc

SEQ ID NO: 480823 - RNA, 19 nt, Homo sapiens
caaguuugcacagauggua

SEQ ID NO: 480824 - RNA, 19 nt, Homo sapiens
guacggauggugccaaagu

SEQ ID NO: 480825 - RNA, 19 nt, Homo sapiens
gagcaaaggaaaugaacag

SEQ ID NO: 480826 - RNA, 19 nt, Homo sapiens
ggacccuacuuuaucuagu

SEQ ID NO: 480827 - RNA, 19 nt, Homo sapiens
uuaaagcugucaagauggu

SEQ ID NO: 480828 - RNA, 19 nt, Homo sapiens
ucucgaaggccaagcauug

SEQ ID NO: 480829 - RNA, 19 nt, Homo sapiens
ccucagcguuucccuucuu

SEQ ID NO: 480830 - RNA, 19 nt, Homo sapiens
ugacacaauauaccaaguu

SEQ ID NO: 480831 - RNA, 19 nt, Homo sapiens
ugaaugaucaagaacuaga

SEQ ID NO: 480832 - RNA, 19 nt, Homo sapiens
gaaagugacugaagagcuu

SEQ ID NO: 480833 - RNA, 19 nt, Homo sapiens
ggaagaaagugacugaaga

SEQ ID NO: 480834 - RNA, 19 nt, Homo sapiens
uaaaggaccugccugaugu

SEQ ID NO: 480835 - RNA, 19 nt, Homo sapiens
gaagagauuucacccaaca

SEQ ID NO: 480836 - RNA, 19 nt, Homo sapiens
aaacgacgcucaucaaaca

SEQ ID NO: 480837 - RNA, 19 nt, Homo sapiens
agacaaagccuuccagaaa

SEQ ID NO: 480838 - RNA, 19 nt, Homo sapiens
caacggcaaucaagcguaa

SEQ ID NO: 480839 - RNA, 19 nt, Homo sapiens
gcuaagaaguuucagacaa

SEQ ID NO: 480840 - RNA, 19 nt, Homo sapiens
caagauggcugcugagaag

SEQ ID NO: 480841 - RNA, 19 nt, Homo sapiens
gcgaagcccuuguccugua

SEQ ID NO: 480842 - RNA, 19 nt, Homo sapiens
gaaggcaaacaaagaauuu

SEQ ID NO: 480843 - RNA, 19 nt, Homo sapiens
uuacacagcuuaccucuca

SEQ ID NO: 480844 - RNA, 19 nt, Homo sapiens
gaaauauguuacacucaga

SEQ ID NO: 480845 - RNA, 19 nt, Homo sapiens
gaacucauccuugcuguga

SEQ ID NO: 480846 - RNA, 19 nt, Homo sapiens
gcaaguuccaugauauuaa

SEQ ID NO: 480847 - RNA, 19 nt, Homo sapiens
acagagagauuauauccuu

SEQ ID NO: 480848 - RNA, 19 nt, Homo sapiens
gggagauucugacucuuaa

SEQ ID NO: 480849 - RNA, 19 nt, Homo sapiens
gcaagccuuuguucuuuga

SEQ ID NO: 480850 - RNA, 19 nt, Homo sapiens
gaucagaaacagagagauu

SEQ ID NO: 480851 - RNA, 19 nt, Homo sapiens
cagaaaugaugaaaccaaa

SEQ ID NO: 480852 - RNA, 19 nt, Homo sapiens
gaucgaaggcaaacaaaga

SEQ ID NO: 480853 - RNA, 19 nt, Homo sapiens
gacaucaucuuacagaauc

SEQ ID NO: 480854 - RNA, 19 nt, Homo sapiens
caggagcccuugagaaguu

SEQ ID NO: 480855 - RNA, 19 nt, Homo sapiens
gcaaacgacgcucaucaaa

SEQ ID NO: 480856 - RNA, 19 nt, Homo sapiens
ggaccugccugaugugcaa

SEQ ID NO: 480857 - RNA, 19 nt, Homo sapiens
gacaaagccuuccagaaag

SEQ ID NO: 480858 - RNA, 19 nt, Homo sapiens
uauuaggacuggcugauaa

SEQ ID NO: 480859 - RNA, 19 nt, Homo sapiens
gaaaugaugaaaccaaauc

SEQ ID NO: 480860 - RNA, 19 nt, Homo sapiens
gcaaaacuaucuaugagaa

SEQ ID NO: 480861 - RNA, 19 nt, Homo sapiens
acaauaagccucugguuga

SEQ ID NO: 480862 - RNA, 19 nt, Homo sapiens
ugcaagagcucaucacuca

SEQ ID NO: 480863 - RNA, 19 nt, Homo sapiens
ccugaaauaugcaaaugaa

SEQ ID NO: 480864 - RNA, 19 nt, Homo sapiens
cagcuuaccucucaggaau

SEQ ID NO: 480865 - RNA, 19 nt, Homo sapiens
caacgucaccccagaauua

SEQ ID NO: 480866 - RNA, 19 nt, Homo sapiens
gaaacgcuuugucaugcuu

SEQ ID NO: 480867 - RNA, 19 nt, Homo sapiens
ucaagacucugguguucaa

SEQ ID NO: 480868 - RNA, 19 nt, Homo sapiens
gcaaucaagcguaaugaga

SEQ ID NO: 480869 - RNA, 19 nt, Homo sapiens
gaauuacggucagccuuau

SEQ ID NO: 480870 - RNA, 19 nt, Homo sapiens
ccagcaaguuccaugauau

SEQ ID NO: 480871 - RNA, 19 nt, Homo sapiens
caauaagccucugguugaa

SEQ ID NO: 480872 - RNA, 19 nt, Homo sapiens
gagggucucuuggcugaaa

SEQ ID NO: 480873 - RNA, 19 nt, Homo sapiens
ccuaugugcuggugaagaa

SEQ ID NO: 480874 - RNA, 19 nt, Homo sapiens
gggcaagaguuuaacaucu

SEQ ID NO: 480875 - RNA, 19 nt, Homo sapiens
ucaagggcaucuuuggauu

SEQ ID NO: 480876 - RNA, 19 nt, Homo sapiens
acaaagccuuccagaaaga

SEQ ID NO: 480877 - RNA, 19 nt, Homo sapiens
cuaaggagcgccuguuuga

SEQ ID NO: 480878 - RNA, 19 nt, Homo sapiens
cuaagaaguuucagacaag

SEQ ID NO: 480879 - RNA, 19 nt, Homo sapiens
ugacuuacaucaagcuauc

SEQ ID NO: 480880 - RNA, 19 nt, Homo sapiens
cagggaaggugucuaaucu

SEQ ID NO: 480881 - RNA, 19 nt, Homo sapiens
gcucaagccagaucagaaa

SEQ ID NO: 480882 - RNA, 19 nt, Homo sapiens
ggagauucuucagauuauu

SEQ ID NO: 480883 - RNA, 19 nt, Homo sapiens
ucugauggaugcugaaaga

SEQ ID NO: 480884 - RNA, 19 nt, Homo sapiens
ugacagaguccugaaauau

SEQ ID NO: 480885 - RNA, 19 nt, Homo sapiens
cagugaagauugacaaagu

SEQ ID NO: 480886 - RNA, 19 nt, Homo sapiens
ucucaggaaugcuacguuu

SEQ ID NO: 480887 - RNA, 19 nt, Homo sapiens
ggaauuggaacgcuugugu

SEQ ID NO: 480888 - RNA, 19 nt, Homo sapiens
gaggacaaguuggaacaga

SEQ ID NO: 480889 - RNA, 19 nt, Homo sapiens
cugcaagccuuuguucuuu

SEQ ID NO: 480890 - RNA, 19 nt, Homo sapiens
gagagauuauauccuugaa

SEQ ID NO: 480891 - RNA, 19 nt, Homo sapiens
uaacgaagcagcuauuguc

SEQ ID NO: 480892 - RNA, 19 nt, Homo sapiens
agaauuacggucagccuua

SEQ ID NO: 480893 - RNA, 19 nt, Homo sapiens
ucaguaccauggauuugaa

SEQ ID NO: 480894 - RNA, 19 nt, Homo sapiens
gcaaaugaaguaaauucug

SEQ ID NO: 480895 - RNA, 19 nt, Homo sapiens
gcaagauggcugcugagaa

SEQ ID NO: 480896 - RNA, 19 nt, Homo sapiens
uaacagacacaaauucaca

SEQ ID NO: 480897 - RNA, 19 nt, Homo sapiens
caaucaagcguaaugagaa

SEQ ID NO: 480898 - RNA, 19 nt, Homo sapiens
gaacaucaagaauggaaag

SEQ ID NO: 480899 - RNA, 19 nt, Homo sapiens
caaauucacagggaagaaa

SEQ ID NO: 480900 - RNA, 19 nt, Homo sapiens
cccagcaaguuccaugaua

SEQ ID NO: 480901 - RNA, 19 nt, Homo sapiens
gacagaguccugaaauaug

SEQ ID NO: 480902 - RNA, 19 nt, Homo sapiens
gcugaaagcgaagaaacua

SEQ ID NO: 480903 - RNA, 19 nt, Homo sapiens
gagcuucugaccgauaaua

SEQ ID NO: 480904 - RNA, 19 nt, Homo sapiens
gaagaaagugacugaagag

SEQ ID NO: 480905 - RNA, 19 nt, Homo sapiens
gguaacagacacaaauuca

SEQ ID NO: 480906 - RNA, 19 nt, Homo sapiens
ccuguugucuucugguaaa

SEQ ID NO: 480907 - RNA, 19 nt, Homo sapiens
uugcauagcuaccugacuu

SEQ ID NO: 480908 - RNA, 19 nt, Homo sapiens
aauuagaggcucaggcuua

SEQ ID NO: 480909 - RNA, 19 nt, Homo sapiens
gaccugauccgacucuaug

SEQ ID NO: 480910 - RNA, 19 nt, Homo sapiens
gauacuugcuucugguucu

SEQ ID NO: 480911 - RNA, 19 nt, Homo sapiens
cuaaaggaccugccugaug

SEQ ID NO: 480912 - RNA, 19 nt, Homo sapiens
ugaaguaaauucugaugcu

SEQ ID NO: 480913 - RNA, 19 nt, Homo sapiens
gaaacagagagauuauauc

SEQ ID NO: 480914 - RNA, 19 nt, Homo sapiens
cauccgcuauugugcauau

SEQ ID NO: 480915 - RNA, 19 nt, Homo sapiens
gaccgauaauagauacuug

SEQ ID NO: 480916 - RNA, 19 nt, Homo sapiens
gauugccuuuggucaguaa

SEQ ID NO: 480917 - RNA, 19 nt, Homo sapiens
ugugagcugugauugauug

SEQ ID NO: 480918 - RNA, 19 nt, Homo sapiens
uggagauucuucagauuau

SEQ ID NO: 480919 - RNA, 19 nt, Homo sapiens
gggauagccugaguuugga

SEQ ID NO: 480920 - RNA, 19 nt, Homo sapiens
uuggaacgcuugugugaga

SEQ ID NO: 480921 - RNA, 19 nt, Homo sapiens
agugaacgcuaagaaguuu

SEQ ID NO: 480922 - RNA, 19 nt, Homo sapiens
cgaaggcaaacaaagaauu

SEQ ID NO: 480923 - RNA, 19 nt, Homo sapiens
ggacaauaagccucugguu

SEQ ID NO: 480924 - RNA, 19 nt, Homo sapiens
ccucaagacucugguguuc

SEQ ID NO: 480925 - RNA, 19 nt, Homo sapiens
aaacaggcagcuaccauga

SEQ ID NO: 480926 - RNA, 19 nt, Homo sapiens
gaagcaugcagaggaauug

SEQ ID NO: 480927 - RNA, 19 nt, Homo sapiens
cuugagaaguuuaucuaug

SEQ ID NO: 480928 - RNA, 19 nt, Homo sapiens
guuuggagauucuucagau

SEQ ID NO: 480929 - RNA, 19 nt, Homo sapiens
cuaccugacuuacaucaag

SEQ ID NO: 480930 - RNA, 19 nt, Homo sapiens
ccagucagccaucaaugaa

SEQ ID NO: 480931 - RNA, 19 nt, Homo sapiens
ggaugccaagaccaaauua

SEQ ID NO: 480932 - RNA, 19 nt, Homo sapiens
caaaauaucugccaguuua

SEQ ID NO: 480933 - RNA, 19 nt, Homo sapiens
uaacugcccugcauuguaa

SEQ ID NO: 480934 - RNA, 19 nt, Homo sapiens
caacaaagaugacguaacu

SEQ ID NO: 480935 - RNA, 19 nt, Homo sapiens
caacagcuguggaaacaaa

SEQ ID NO: 480936 - RNA, 19 nt, Homo sapiens
uaacaaagcuuuacuugcu

SEQ ID NO: 480937 - RNA, 19 nt, Homo sapiens
caauaacucucucuccuuu

SEQ ID NO: 480938 - RNA, 19 nt, Homo sapiens
gaauggaaguuucaaggaa

SEQ ID NO: 480939 - RNA, 19 nt, Homo sapiens
gagcaucucuuaccugugu

SEQ ID NO: 480940 - RNA, 19 nt, Homo sapiens
gagaaugccuugaagacaa

SEQ ID NO: 480941 - RNA, 19 nt, Homo sapiens
ggaguagaguuuaagcuuu

SEQ ID NO: 480942 - RNA, 19 nt, Homo sapiens
gaaacucccaagaugauua

SEQ ID NO: 480943 - RNA, 19 nt, Homo sapiens
caugguaucugcauuaguu

SEQ ID NO: 480944 - RNA, 19 nt, Homo sapiens
gcucauuuguccuugauaa

SEQ ID NO: 480945 - RNA, 19 nt, Homo sapiens
ccaaaguguuagccaauaa

SEQ ID NO: 480946 - RNA, 19 nt, Homo sapiens
gaagaaggguggaaaaguu

SEQ ID NO: 480947 - RNA, 19 nt, Homo sapiens
gcaaauaacaucauuacca

SEQ ID NO: 480948 - RNA, 19 nt, Homo sapiens
ccaaagcucuuaguaaaca

SEQ ID NO: 480949 - RNA, 19 nt, Homo sapiens
gaggaggcuuugcaacuuu

SEQ ID NO: 480950 - RNA, 19 nt, Homo sapiens
guaucugccucuacaagua

SEQ ID NO: 480951 - RNA, 19 nt, Homo sapiens
cuacauacauucggaagaa

SEQ ID NO: 480952 - RNA, 19 nt, Homo sapiens
uagaggaguuaaagcauaa

SEQ ID NO: 480953 - RNA, 19 nt, Homo sapiens
gaacuggccaucauucaug

SEQ ID NO: 480954 - RNA, 19 nt, Homo sapiens
gaagaaagguggaaaaggu

SEQ ID NO: 480955 - RNA, 19 nt, Homo sapiens
gaacaaugccgcaaaauau

SEQ ID NO: 480956 - RNA, 19 nt, Homo sapiens
gaaacaacuacaagcuaua

SEQ ID NO: 480957 - RNA, 19 nt, Homo sapiens
caaggaagcuuugaauguc

SEQ ID NO: 480958 - RNA, 19 nt, Homo sapiens
gcccagcucugccgugaaa

SEQ ID NO: 480959 - RNA, 19 nt, Homo sapiens
gaguagaguuuaagcuuuc

SEQ ID NO: 480960 - RNA, 19 nt, Homo sapiens
gaacagaggaggcuuugca

SEQ ID NO: 480961 - RNA, 19 nt, Homo sapiens
gaaccugggccuccaagaa

SEQ ID NO: 480962 - RNA, 19 nt, Homo sapiens
caucaauacucacaccaaa

SEQ ID NO: 480963 - RNA, 19 nt, Homo sapiens
gaacaaggacagggagauu

SEQ ID NO: 480964 - RNA, 19 nt, Homo sapiens
agccaaagcucuuaguaaa

SEQ ID NO: 480965 - RNA, 19 nt, Homo sapiens
gaaggagcuuuauggacaa

SEQ ID NO: 480966 - RNA, 19 nt, Homo sapiens
ggaagaaggaggcaauuag

SEQ ID NO: 480967 - RNA, 19 nt, Homo sapiens
gcugcaaacuucaaacuca

SEQ ID NO: 480968 - RNA, 19 nt, Homo sapiens
agaaacaacuacaagcuau

SEQ ID NO: 480969 - RNA, 19 nt, Homo sapiens
ccaagaagaaagugaaauu

SEQ ID NO: 480970 - RNA, 19 nt, Homo sapiens
gaauugagaaugccuugaa

SEQ ID NO: 480971 - RNA, 19 nt, Homo sapiens
gaucaacaaagaugacgua

SEQ ID NO: 480972 - RNA, 19 nt, Homo sapiens
gcucaaagcaauugggaaa

SEQ ID NO: 480973 - RNA, 19 nt, Homo sapiens
auagagaucucguccgaaa

SEQ ID NO: 480974 - RNA, 19 nt, Homo sapiens
gagaaagccaaagcucuua

SEQ ID NO: 480975 - RNA, 19 nt, Homo sapiens
cacaagcuauccaguggua

SEQ ID NO: 480976 - RNA, 19 nt, Homo sapiens
gaaaaugcagcugaaauua

SEQ ID NO: 480977 - RNA, 19 nt, Homo sapiens
gaagaaggaggcaauuagu

SEQ ID NO: 480978 - RNA, 19 nt, Homo sapiens
uaagagaagcugcaaacuu

SEQ ID NO: 480979 - RNA, 19 nt, Homo sapiens
gcuauccagugguaucaaa

SEQ ID NO: 480980 - RNA, 19 nt, Homo sapiens
aguuuaagcuuuccaagaa

SEQ ID NO: 480981 - RNA, 19 nt, Homo sapiens
guauagccaugaagaagau

SEQ ID NO: 480982 - RNA, 19 nt, Homo sapiens
auagaggaguuaaagcaua

SEQ ID NO: 480983 - RNA, 19 nt, Homo sapiens
cggaaggaguagaguuuaa

SEQ ID NO: 480984 - RNA, 19 nt, Homo sapiens
guaacugcccugcauugua

SEQ ID NO: 480985 - RNA, 19 nt, Homo sapiens
aaaugcagcugaaauuaag

SEQ ID NO: 480986 - RNA, 19 nt, Homo sapiens
ucaagaccgucaauaagau

SEQ ID NO: 480987 - RNA, 19 nt, Homo sapiens
aaaccaggcugaacaaugc

SEQ ID NO: 480988 - RNA, 19 nt, Homo sapiens
aagcuuuacuugcuaugua

SEQ ID NO: 480989 - RNA, 19 nt, Homo sapiens
caacagaugugggauuacu

SEQ ID NO: 480990 - RNA, 19 nt, Homo sapiens
ggaacgcuaugaugaaugc

SEQ ID NO: 480991 - RNA, 19 nt, Homo sapiens
aaagaaacagcaacagaaa

SEQ ID NO: 480992 - RNA, 19 nt, Homo sapiens
ugacguaacugcccugcau

SEQ ID NO: 480993 - RNA, 19 nt, Homo sapiens
guccgaaacucccaagaug

SEQ ID NO: 480994 - RNA, 19 nt, Homo sapiens
gacaaguguuauaccguuu

SEQ ID NO: 480995 - RNA, 19 nt, Homo sapiens
ccauugaggucuucacaca

SEQ ID NO: 480996 - RNA, 19 nt, Homo sapiens
ggaggcaauuagugaccua

SEQ ID NO: 480997 - RNA, 19 nt, Homo sapiens
caagaccgucaauaagaua

SEQ ID NO: 480998 - RNA, 19 nt, Homo sapiens
gcuuauuucugcuuacuca

SEQ ID NO: 480999 - RNA, 19 nt, Homo sapiens
gcauagaggaguuaaagca

SEQ ID NO: 481000 - RNA, 19 nt, Homo sapiens
gcuuagcaguguauagaga

SEQ ID NO: 481001 - RNA, 19 nt, Homo sapiens
aaagaaggaucagauugga

SEQ ID NO: 481002 - RNA, 19 nt, Homo sapiens
gauaagagaagcugcaaac

SEQ ID NO: 481003 - RNA, 19 nt, Homo sapiens
gaaccgguauggccagaac

SEQ ID NO: 481004 - RNA, 19 nt, Homo sapiens
uagagcugcuucaggaauu

SEQ ID NO: 481005 - RNA, 19 nt, Homo sapiens
acgcuaugaugaaugcuua

SEQ ID NO: 481006 - RNA, 19 nt, Homo sapiens
auaacucucucuccuuuga

SEQ ID NO: 481007 - RNA, 19 nt, Homo sapiens
gagaagcauagaggaguua

SEQ ID NO: 481008 - RNA, 19 nt, Homo sapiens
accaacagaugugggauua

SEQ ID NO: 481009 - RNA, 19 nt, Homo sapiens
ugaaugucaucaauacuca

SEQ ID NO: 481010 - RNA, 19 nt, Homo sapiens
gcaacaguaucugccucua

SEQ ID NO: 481011 - RNA, 19 nt, Homo sapiens
uacaacagcuguggaaaca

SEQ ID NO: 481012 - RNA, 19 nt, Homo sapiens
agaaggaggcaauuaguga

SEQ ID NO: 481013 - RNA, 19 nt, Homo sapiens
gaaguuucaaggaagcuuu

SEQ ID NO: 481014 - RNA, 19 nt, Homo sapiens
gaccauggcacaguugaaa

SEQ ID NO: 481015 - RNA, 19 nt, Homo sapiens
caaaccaggcugaacaaug

SEQ ID NO: 481016 - RNA, 19 nt, Homo sapiens
uacuacagaucaacaaaga

SEQ ID NO: 481017 - RNA, 19 nt, Homo sapiens
agaaggaucagauuggaaa

SEQ ID NO: 481018 - RNA, 19 nt, Homo sapiens
ucucuuaccuguguuaauc

SEQ ID NO: 481019 - RNA, 19 nt, Homo sapiens
gaccgucaauaagauacua

SEQ ID NO: 481020 - RNA, 19 nt, Homo sapiens
guaaagugguaugccuuau

SEQ ID NO: 481021 - RNA, 19 nt, Homo sapiens
ggagauagucaaccaaagg

SEQ ID NO: 481022 - RNA, 19 nt, Homo sapiens
ggcaauuagugaccuacaa

SEQ ID NO: 481023 - RNA, 19 nt, Homo sapiens
ugagaagcauagaggaguu

SEQ ID NO: 481024 - RNA, 19 nt, Homo sapiens
ugucuaauauugagaagca

SEQ ID NO: 481025 - RNA, 19 nt, Homo sapiens
caacuacaagcuauagaau

SEQ ID NO: 481026 - RNA, 19 nt, Homo sapiens
cuacagaucaacaaagaug

SEQ ID NO: 481027 - RNA, 19 nt, Homo sapiens
ccaagaugauuaugaugag

SEQ ID NO: 481028 - RNA, 19 nt, Homo sapiens
gaguacaggcugaacagaa

SEQ ID NO: 481029 - RNA, 19 nt, Homo sapiens
gaguuuaagcuuuccaaga

SEQ ID NO: 481030 - RNA, 19 nt, Homo sapiens
ucauuaccauuaacaagga

SEQ ID NO: 481031 - RNA, 19 nt, Homo sapiens
gcagaacuggccaucauuc

SEQ ID NO: 481032 - RNA, 19 nt, Homo sapiens
gaaagggucuuaauucuau

SEQ ID NO: 481033 - RNA, 19 nt, Homo sapiens
gaaagacccuugaaagaga

SEQ ID NO: 481034 - RNA, 19 nt, Homo sapiens
gcucgagucuuuaauauaa

SEQ ID NO: 481035 - RNA, 19 nt, Homo sapiens
ggacaaagcccaaaggaaa

SEQ ID NO: 481036 - RNA, 19 nt, Homo sapiens
gcaagaagauccuaaugau

SEQ ID NO: 481037 - RNA, 19 nt, Homo sapiens
gacuugaccuagaauauua

SEQ ID NO: 481038 - RNA, 19 nt, Homo sapiens
aaagagaacccaccuaaua

SEQ ID NO: 481039 - RNA, 19 nt, Homo sapiens
ccacagaggugcaacuuga

SEQ ID NO: 481040 - RNA, 19 nt, Homo sapiens
gaagauugcugaccuugga

SEQ ID NO: 481041 - RNA, 19 nt, Homo sapiens
ucaaagcacugucaaauuc

SEQ ID NO: 481042 - RNA, 19 nt, Homo sapiens
gcaauccauuuaacucaua

SEQ ID NO: 481043 - RNA, 19 nt, Homo sapiens
uuucagagcuuucccauuu

SEQ ID NO: 481044 - RNA, 19 nt, Homo sapiens
uaaaggagguuaucaucuu

SEQ ID NO: 481045 - RNA, 19 nt, Homo sapiens
gcagcuggcuucacagauu

SEQ ID NO: 481046 - RNA, 19 nt, Homo sapiens
acacauaucugcaugguau

SEQ ID NO: 481047 - RNA, 19 nt, Homo sapiens
ggacucgaauuuacagaaa

SEQ ID NO: 481048 - RNA, 19 nt, Homo sapiens
gaacggagaucuggguuuc

SEQ ID NO: 481049 - RNA, 19 nt, Homo sapiens
gcaauagacuagaacugaa

SEQ ID NO: 481050 - RNA, 19 nt, Homo sapiens
gggcagagauacccuguga

SEQ ID NO: 481051 - RNA, 19 nt, Homo sapiens
gaagucaguucgcaauuca

SEQ ID NO: 481052 - RNA, 19 nt, Homo sapiens
gaagaaauuuguggcaaug

SEQ ID NO: 481053 - RNA, 19 nt, Homo sapiens
caaauuccuuucauccuuu

SEQ ID NO: 481054 - RNA, 19 nt, Homo sapiens
gaaauaggcagcuguagau

SEQ ID NO: 481055 - RNA, 19 nt, Homo sapiens
gagauguacuugaggcuuu

SEQ ID NO: 481056 - RNA, 19 nt, Homo sapiens
ggagccagauggauugaaa

SEQ ID NO: 481057 - RNA, 19 nt, Homo sapiens
gaacugaauuaucuucuac

SEQ ID NO: 481058 - RNA, 19 nt, Homo sapiens
gggaaauccuucagcaauu

SEQ ID NO: 481059 - RNA, 19 nt, Homo sapiens
acagaaccauugaauagua

SEQ ID NO: 481060 - RNA, 19 nt, Homo sapiens
ggaaagggucuuaauucua

SEQ ID NO: 481061 - RNA, 19 nt, Homo sapiens
ccagauggauugaaagaug

SEQ ID NO: 481062 - RNA, 19 nt, Homo sapiens
ggaaucuacuuugucauuu

SEQ ID NO: 481063 - RNA, 19 nt, Homo sapiens
uacagggucuugauuauuu

SEQ ID NO: 481064 - RNA, 19 nt, Homo sapiens
gaaauccgguugcugaagu

SEQ ID NO: 481065 - RNA, 19 nt, Homo sapiens
ggaagaaauuuguggcaau

SEQ ID NO: 481066 - RNA, 19 nt, Homo sapiens
guaaaugccguacaauaaa

SEQ ID NO: 481067 - RNA, 19 nt, Homo sapiens
gaacaagagcaagaacaua

SEQ ID NO: 481068 - RNA, 19 nt, Homo sapiens
cagcagaaauuaauugcaa

SEQ ID NO: 481069 - RNA, 19 nt, Homo sapiens
ggaauucuggugauauuaa

SEQ ID NO: 481070 - RNA, 19 nt, Homo sapiens
cagcacaucucaagaaaca

SEQ ID NO: 481071 - RNA, 19 nt, Homo sapiens
gacuagaacugaauuaucu

SEQ ID NO: 481072 - RNA, 19 nt, Homo sapiens
ggaaauccuucagcaauuc

SEQ ID NO: 481073 - RNA, 19 nt, Homo sapiens
aaacagcacuagaugaaau

SEQ ID NO: 481074 - RNA, 19 nt, Homo sapiens
ggaaaugcuucuccaccaa

SEQ ID NO: 481075 - RNA, 19 nt, Homo sapiens
ggaaauaggcagcuguaga

SEQ ID NO: 481076 - RNA, 19 nt, Homo sapiens
aaacagaaccauugaauag

SEQ ID NO: 481077 - RNA, 19 nt, Homo sapiens
ggccacaggugacuauuug

SEQ ID NO: 481078 - RNA, 19 nt, Homo sapiens
ucaaguggaucaucaaauc

SEQ ID NO: 481079 - RNA, 19 nt, Homo sapiens
guacaccuauaacaucuga

SEQ ID NO: 481080 - RNA, 19 nt, Homo sapiens
aaucagacauguuccugua

SEQ ID NO: 481081 - RNA, 19 nt, Homo sapiens
aaagagcuaugaaggugua

SEQ ID NO: 481082 - RNA, 19 nt, Homo sapiens
gaagaucacauugcauuga

SEQ ID NO: 481083 - RNA, 19 nt, Homo sapiens
gaagcgccaggcagaauua

SEQ ID NO: 481084 - RNA, 19 nt, Homo sapiens
gggaaagggucuuaauucu

SEQ ID NO: 481085 - RNA, 19 nt, Homo sapiens
ggaguuaauggaacacaua

SEQ ID NO: 481086 - RNA, 19 nt, Homo sapiens
gcaauucagacccuaauga

SEQ ID NO: 481087 - RNA, 19 nt, Homo sapiens
cuaaagcaauagacuagaa

SEQ ID NO: 481088 - RNA, 19 nt, Homo sapiens
ucagagcuuucccauuuaa

SEQ ID NO: 481089 - RNA, 19 nt, Homo sapiens
gccaaagacuaauggacua

SEQ ID NO: 481090 - RNA, 19 nt, Homo sapiens
gaaacagacucuuguacac

SEQ ID NO: 481091 - RNA, 19 nt, Homo sapiens
ugaaagagaacccaccuaa

SEQ ID NO: 481092 - RNA, 19 nt, Homo sapiens
gcaggaaauugaggaaaug

SEQ ID NO: 481093 - RNA, 19 nt, Homo sapiens
cauccacacugacauuaaa

SEQ ID NO: 481094 - RNA, 19 nt, Homo sapiens
gaacacauaucugcauggu

SEQ ID NO: 481095 - RNA, 19 nt, Homo sapiens
uaauagaaccuguaacuuc

SEQ ID NO: 481096 - RNA, 19 nt, Homo sapiens
guaaccaccuuucuauaca

SEQ ID NO: 481097 - RNA, 19 nt, Homo sapiens
cagaaccauugaauaguaa

SEQ ID NO: 481098 - RNA, 19 nt, Homo sapiens
ucaaauuccuuucauccuu

SEQ ID NO: 481099 - RNA, 19 nt, Homo sapiens
gagauacccugugaagaug

SEQ ID NO: 481100 - RNA, 19 nt, Homo sapiens
guaccuuuccuucccauua

SEQ ID NO: 481101 - RNA, 19 nt, Homo sapiens
ugaaagauguggaaauagg

SEQ ID NO: 481102 - RNA, 19 nt, Homo sapiens
caggaauucuggugauauu

SEQ ID NO: 481103 - RNA, 19 nt, Homo sapiens
gcugcuauuucccuacaua

SEQ ID NO: 481104 - RNA, 19 nt, Homo sapiens
ggaccaaggccaagaagga

SEQ ID NO: 481105 - RNA, 19 nt, Homo sapiens
gcacaucucaagaaacaga

SEQ ID NO: 481106 - RNA, 19 nt, Homo sapiens
gaaauuuguggcaaugaaa

SEQ ID NO: 481107 - RNA, 19 nt, Homo sapiens
ucuauuugcugucaguuaa

SEQ ID NO: 481108 - RNA, 19 nt, Homo sapiens
gaaaugcuucuccaccaaa

SEQ ID NO: 481109 - RNA, 19 nt, Homo sapiens
aauagaaccuguaacuuca

SEQ ID NO: 481110 - RNA, 19 nt, Homo sapiens
aaucggaucuggcuauaau

SEQ ID NO: 481111 - RNA, 19 nt, Homo sapiens
gcaagaagaaucagagagu

SEQ ID NO: 481112 - RNA, 19 nt, Homo sapiens
ugaaacagcacuagaugaa

SEQ ID NO: 481113 - RNA, 19 nt, Homo sapiens
gauaccaugugauccgaaa

SEQ ID NO: 481114 - RNA, 19 nt, Homo sapiens
guaccuuuauugagcuuaa

SEQ ID NO: 481115 - RNA, 19 nt, Homo sapiens
uaauugcaauggagugauu

SEQ ID NO: 481116 - RNA, 19 nt, Homo sapiens
gaaaaguggugccguuaug

SEQ ID NO: 481117 - RNA, 19 nt, Homo sapiens
gccauucucugcugcuauu

SEQ ID NO: 481118 - RNA, 19 nt, Homo sapiens
ucauugcacuugaguuuau

SEQ ID NO: 481119 - RNA, 19 nt, Homo sapiens
ggcuuugccuuucugauuu

SEQ ID NO: 481120 - RNA, 19 nt, Homo sapiens
uccuguaugucuucuauua

SEQ ID NO: 481121 - RNA, 19 nt, Homo sapiens
guacagcagagacauuaaa

SEQ ID NO: 481122 - RNA, 19 nt, Homo sapiens
caaaggaaaucugaaacuc

SEQ ID NO: 481123 - RNA, 19 nt, Homo sapiens
gaacccaccuaauaaaaug

SEQ ID NO: 481124 - RNA, 19 nt, Homo sapiens
gaaagagaacccaccuaau

SEQ ID NO: 481125 - RNA, 19 nt, Homo sapiens
agagaguccuguugaaaga

SEQ ID NO: 481126 - RNA, 19 nt, Homo sapiens
uaaaccagagaacaucuua

SEQ ID NO: 481127 - RNA, 19 nt, Homo sapiens
caagaagauccuaaugauu

SEQ ID NO: 481128 - RNA, 19 nt, Homo sapiens
gaggcucgagucuuuaaua

SEQ ID NO: 481129 - RNA, 19 nt, Homo sapiens
cagaaaagcucaaggugaa

SEQ ID NO: 481130 - RNA, 19 nt, Homo sapiens
aagagaacccaccuaauaa

SEQ ID NO: 481131 - RNA, 19 nt, Homo sapiens
gagaagcgaaugcaggaaa

SEQ ID NO: 481132 - RNA, 19 nt, Homo sapiens
gaaagaagaugcugagaaa

SEQ ID NO: 481133 - RNA, 19 nt, Homo sapiens
ggacaucauuccuguauua

SEQ ID NO: 481134 - RNA, 19 nt, Homo sapiens
gaagagcaauuucccuuua

SEQ ID NO: 481135 - RNA, 19 nt, Homo sapiens
gaagaagacugcccaaauc

SEQ ID NO: 481136 - RNA, 19 nt, Homo sapiens
uaacaugucucuaagcauu

SEQ ID NO: 481137 - RNA, 19 nt, Homo sapiens
gcgagaagcugaaaggaaa

SEQ ID NO: 481138 - RNA, 19 nt, Homo sapiens
ggagaaacguguuaauugu

SEQ ID NO: 481139 - RNA, 19 nt, Homo sapiens
ucucacagcucaaagauaa

SEQ ID NO: 481140 - RNA, 19 nt, Homo sapiens
gaacacaagguaugguaua

SEQ ID NO: 481141 - RNA, 19 nt, Homo sapiens
caagugagcuggcuucauc

SEQ ID NO: 481142 - RNA, 19 nt, Homo sapiens
gcucaaauguguucgagaa

SEQ ID NO: 481143 - RNA, 19 nt, Homo sapiens
ugaagaugcugcacaguuu

SEQ ID NO: 481144 - RNA, 19 nt, Homo sapiens
gaagaggcaggcugaguua

SEQ ID NO: 481145 - RNA, 19 nt, Homo sapiens
gaucauucauacugacaua

SEQ ID NO: 481146 - RNA, 19 nt, Homo sapiens
gcaagaucauucauacuga

SEQ ID NO: 481147 - RNA, 19 nt, Homo sapiens
gaaauagcaaggaaaugua

SEQ ID NO: 481148 - RNA, 19 nt, Homo sapiens
gcccagaggugaaacuaaa

SEQ ID NO: 481149 - RNA, 19 nt, Homo sapiens
ccauaugccuuugcaauaa

SEQ ID NO: 481150 - RNA, 19 nt, Homo sapiens
gaaaagauuuguugcaaug

SEQ ID NO: 481151 - RNA, 19 nt, Homo sapiens
caaaguggcucuggguuau

SEQ ID NO: 481152 - RNA, 19 nt, Homo sapiens
guuguucucuggauccuua

SEQ ID NO: 481153 - RNA, 19 nt, Homo sapiens
caucauuccuguauuauag

SEQ ID NO: 481154 - RNA, 19 nt, Homo sapiens
gcagaaaccuauaggaaaa

SEQ ID NO: 481155 - RNA, 19 nt, Homo sapiens
ucugagggaucaccacuua

SEQ ID NO: 481156 - RNA, 19 nt, Homo sapiens
uaauuuagcagucccauuu

SEQ ID NO: 481157 - RNA, 19 nt, Homo sapiens
gaagaugcugcacaguuua

SEQ ID NO: 481158 - RNA, 19 nt, Homo sapiens
cgaugaagaugaugaugaa

SEQ ID NO: 481159 - RNA, 19 nt, Homo sapiens
ucaaguggaucaucaaauc

SEQ ID NO: 481160 - RNA, 19 nt, Homo sapiens
ugaagaugaugaugaagaa

SEQ ID NO: 481161 - RNA, 19 nt, Homo sapiens
uaacagaaguacugcgaau

SEQ ID NO: 481162 - RNA, 19 nt, Homo sapiens
ucauuaaggugccucguuu

SEQ ID NO: 481163 - RNA, 19 nt, Homo sapiens
gaaacgaaguugagaaaau

SEQ ID NO: 481164 - RNA, 19 nt, Homo sapiens
gacagaagcagaacgguuu

SEQ ID NO: 481165 - RNA, 19 nt, Homo sapiens
gcucaaagauaacagugau

SEQ ID NO: 481166 - RNA, 19 nt, Homo sapiens
gaggcaggcugaguuauug

SEQ ID NO: 481167 - RNA, 19 nt, Homo sapiens
guaaaugcacccuguaaau

SEQ ID NO: 481168 - RNA, 19 nt, Homo sapiens
guacuguuguuugacauuu

SEQ ID NO: 481169 - RNA, 19 nt, Homo sapiens
aacgggagauuauuuguuu

SEQ ID NO: 481170 - RNA, 19 nt, Homo sapiens
gcagucccauuugugauuu

SEQ ID NO: 481171 - RNA, 19 nt, Homo sapiens
gagacagccuuggaugaaa

SEQ ID NO: 481172 - RNA, 19 nt, Homo sapiens
ggagacagccuuggaugaa

SEQ ID NO: 481173 - RNA, 19 nt, Homo sapiens
uuaacaggauuacaaguga

SEQ ID NO: 481174 - RNA, 19 nt, Homo sapiens
cugcacaguuuacagauuu

SEQ ID NO: 481175 - RNA, 19 nt, Homo sapiens
caaauguguucgagaaagu

SEQ ID NO: 481176 - RNA, 19 nt, Homo sapiens
uaacagugaucacauucau

SEQ ID NO: 481177 - RNA, 19 nt, Homo sapiens
gaucaucaaauccaacuau

SEQ ID NO: 481178 - RNA, 19 nt, Homo sapiens
gcagugggcagaauacuuc

SEQ ID NO: 481179 - RNA, 19 nt, Homo sapiens
caagaaauagcaaggaaau

SEQ ID NO: 481180 - RNA, 19 nt, Homo sapiens
gcaaauucuaccaauauug

SEQ ID NO: 481181 - RNA, 19 nt, Homo sapiens
cagaaagugauuacacaua

SEQ ID NO: 481182 - RNA, 19 nt, Homo sapiens
cauaguaggcaauacaauu

SEQ ID NO: 481183 - RNA, 19 nt, Homo sapiens
cggugacucucauucuuua

SEQ ID NO: 481184 - RNA, 19 nt, Homo sapiens
ggaauauaaucuugaugag

SEQ ID NO: 481185 - RNA, 19 nt, Homo sapiens
caaucuugguugugaauau

SEQ ID NO: 481186 - RNA, 19 nt, Homo sapiens
ucugggcgcuguaaguuaa

SEQ ID NO: 481187 - RNA, 19 nt, Homo sapiens
uagcaaauguucccaguac

SEQ ID NO: 481188 - RNA, 19 nt, Homo sapiens
agaagaugcugagaaagaa

SEQ ID NO: 481189 - RNA, 19 nt, Homo sapiens
guuauaagaugucauucuc

SEQ ID NO: 481190 - RNA, 19 nt, Homo sapiens
agaugaagaugauguagau

SEQ ID NO: 481191 - RNA, 19 nt, Homo sapiens
cagcugcaccuuccaauga

SEQ ID NO: 481192 - RNA, 19 nt, Homo sapiens
cagcagaaaccuauaggaa

SEQ ID NO: 481193 - RNA, 19 nt, Homo sapiens
gagaaagugaucccaguga

SEQ ID NO: 481194 - RNA, 19 nt, Homo sapiens
agauaacagugaucacauu

SEQ ID NO: 481195 - RNA, 19 nt, Homo sapiens
gaaacaauaacaugucucu

SEQ ID NO: 481196 - RNA, 19 nt, Homo sapiens
gagguacuguuguuugaca

SEQ ID NO: 481197 - RNA, 19 nt, Homo sapiens
ggagaacugcgacacauca

SEQ ID NO: 481198 - RNA, 19 nt, Homo sapiens
gaggagaacugcgacacau

SEQ ID NO: 481199 - RNA, 19 nt, Homo sapiens
ccgggcagcugacuuguug

SEQ ID NO: 481200 - RNA, 19 nt, Homo sapiens
ugaagaagacugcccaaau

SEQ ID NO: 481201 - RNA, 19 nt, Homo sapiens
ucaggaacuugcgaacaua

SEQ ID NO: 481202 - RNA, 19 nt, Homo sapiens
cacaguaagugcaagauca

SEQ ID NO: 481203 - RNA, 19 nt, Homo sapiens
caucaaauccaacuaucaa

SEQ ID NO: 481204 - RNA, 19 nt, Homo sapiens
gaagucaguggauugaaug

SEQ ID NO: 481205 - RNA, 19 nt, Homo sapiens
gaacaaaagggauuagaga

SEQ ID NO: 481206 - RNA, 19 nt, Homo sapiens
agaaacguguuaauugugu

SEQ ID NO: 481207 - RNA, 19 nt, Homo sapiens
guaaguuaagcucuacaua

SEQ ID NO: 481208 - RNA, 19 nt, Homo sapiens
acaaaguggcucuggguua

SEQ ID NO: 481209 - RNA, 19 nt, Homo sapiens
uaaaugcacccuguaaaug

SEQ ID NO: 481210 - RNA, 19 nt, Homo sapiens
gcaacuggacgaugaagau

SEQ ID NO: 481211 - RNA, 19 nt, Homo sapiens
gacccuacguggauagaau

SEQ ID NO: 481212 - RNA, 19 nt, Homo sapiens
ccagugacccaaacaaaga

SEQ ID NO: 481213 - RNA, 19 nt, Homo sapiens
gccggagccucaacagaaa

SEQ ID NO: 481214 - RNA, 19 nt, Homo sapiens
gaucaugcuugucuagaac

SEQ ID NO: 481215 - RNA, 19 nt, Homo sapiens
uaaguuaagcucuacauag

SEQ ID NO: 481216 - RNA, 19 nt, Homo sapiens
aagagcaauuucccuuuaa

SEQ ID NO: 481217 - RNA, 19 nt, Homo sapiens
gcuuugagguacuguuguu

SEQ ID NO: 481218 - RNA, 19 nt, Homo sapiens
ggccggagccucaacagaa

SEQ ID NO: 481219 - RNA, 19 nt, Homo sapiens
aauauugcauucugagcua

SEQ ID NO: 481220 - RNA, 19 nt, Homo sapiens
gaagaugcugagaaagaaa

SEQ ID NO: 481221 - RNA, 19 nt, Homo sapiens
agaagucaguggauugaau

SEQ ID NO: 481222 - RNA, 19 nt, Homo sapiens
gaaguacugcgaaucuugu

SEQ ID NO: 481223 - RNA, 19 nt, Homo sapiens
acaauaacaugucucuaag

SEQ ID NO: 481224 - RNA, 19 nt, Homo sapiens
cagcuccuaugaacaauuc

SEQ ID NO: 481225 - RNA, 19 nt, Homo sapiens
caaaugcagaaagugauua

SEQ ID NO: 481226 - RNA, 19 nt, Homo sapiens
aagaagaugcugagaaaga

SEQ ID NO: 481227 - RNA, 19 nt, Homo sapiens
ucaaggguuagauuacuua

SEQ ID NO: 481228 - RNA, 19 nt, Homo sapiens
cacauucauuccauaggua

SEQ ID NO: 481229 - RNA, 19 nt, Homo sapiens
uggagaaacguguuaauug

SEQ ID NO: 481230 - RNA, 19 nt, Homo sapiens
caaaagggauuagagaaga

SEQ ID NO: 481231 - RNA, 19 nt, Homo sapiens
gcugcacaguuuacagauu

SEQ ID NO: 481232 - RNA, 19 nt, Homo sapiens
gaacguggcugcagacauu

SEQ ID NO: 481233 - RNA, 19 nt, Homo sapiens
acaaagaaguguuggauua

SEQ ID NO: 481234 - RNA, 19 nt, Homo sapiens
gaaguaagcucugcauguu

SEQ ID NO: 481235 - RNA, 19 nt, Homo sapiens
caccagagcuuugcuaaua

SEQ ID NO: 481236 - RNA, 19 nt, Homo sapiens
ccacuaccaugaagaaauu

SEQ ID NO: 481237 - RNA, 19 nt, Homo sapiens
gcauuguucuuaccaaauu

SEQ ID NO: 481238 - RNA, 19 nt, Homo sapiens
gaaggaagguucugauggu

SEQ ID NO: 481239 - RNA, 19 nt, Homo sapiens
ucagaaggauguaugauga

SEQ ID NO: 481240 - RNA, 19 nt, Homo sapiens
gaagucagaugcuccaaag

SEQ ID NO: 481241 - RNA, 19 nt, Homo sapiens
guagacaaauugauagaug

SEQ ID NO: 481242 - RNA, 19 nt, Homo sapiens
gugaucaucucauugcuaa

SEQ ID NO: 481243 - RNA, 19 nt, Homo sapiens
gcgaggaguucauucagaa

SEQ ID NO: 481244 - RNA, 19 nt, Homo sapiens
cagaagauccugacacuga

SEQ ID NO: 481245 - RNA, 19 nt, Homo sapiens
agaaugugcuuuagaguau

SEQ ID NO: 481246 - RNA, 19 nt, Homo sapiens
cagcagcucugaugacgaa

SEQ ID NO: 481247 - RNA, 19 nt, Homo sapiens
ggaaaccaauugucagaag

SEQ ID NO: 481248 - RNA, 19 nt, Homo sapiens
caaccugucuucaguguag

SEQ ID NO: 481249 - RNA, 19 nt, Homo sapiens
gcucauugauggcauuguu

SEQ ID NO: 481250 - RNA, 19 nt, Homo sapiens
gugaagacauggaaucugu

SEQ ID NO: 481251 - RNA, 19 nt, Homo sapiens
gcaggaagcgcgaggaguu

SEQ ID NO: 481252 - RNA, 19 nt, Homo sapiens
uacaaucacugcccacuga

SEQ ID NO: 481253 - RNA, 19 nt, Homo sapiens
caaggaaggccuaaucaug

SEQ ID NO: 481254 - RNA, 19 nt, Homo sapiens
ugacguacaucacaagcaa

SEQ ID NO: 481255 - RNA, 19 nt, Homo sapiens
ucaagaaugugcuuuagag

SEQ ID NO: 481256 - RNA, 19 nt, Homo sapiens
uuacagaugugcuauuagu

SEQ ID NO: 481257 - RNA, 19 nt, Homo sapiens
ccugugagguccaugauug

SEQ ID NO: 481258 - RNA, 19 nt, Homo sapiens
aggcuggagugauuuguua

SEQ ID NO: 481259 - RNA, 19 nt, Homo sapiens
gcaguguauugccuguuaa

SEQ ID NO: 481260 - RNA, 19 nt, Homo sapiens
guuaagacuuguccuguag

SEQ ID NO: 481261 - RNA, 19 nt, Homo sapiens
ggaaggccuaaucauguua

SEQ ID NO: 481262 - RNA, 19 nt, Homo sapiens
gaucaucucauugcuaaga

SEQ ID NO: 481263 - RNA, 19 nt, Homo sapiens
gacaagugcuacauugaag

SEQ ID NO: 481264 - RNA, 19 nt, Homo sapiens
gaacuggguggcugugcua

SEQ ID NO: 481265 - RNA, 19 nt, Homo sapiens
guaucaagaaugugcuuua

SEQ ID NO: 481266 - RNA, 19 nt, Homo sapiens
aagcaaacccaucgucuuu

SEQ ID NO: 481267 - RNA, 19 nt, Homo sapiens
ucagacaccucggcucauu

SEQ ID NO: 481268 - RNA, 19 nt, Homo sapiens
gggaaaagcccaaggaaaa

SEQ ID NO: 481269 - RNA, 19 nt, Homo sapiens
gaggaaaccaauugucaga

SEQ ID NO: 481270 - RNA, 19 nt, Homo sapiens
ccagagcuuugcuaauaau

SEQ ID NO: 481271 - RNA, 19 nt, Homo sapiens
gaugacuccuacuccauug

SEQ ID NO: 481272 - RNA, 19 nt, Homo sapiens
cacggugacuuccacagua

SEQ ID NO: 481273 - RNA, 19 nt, Homo sapiens
gcagaggagagcaguaaga

SEQ ID NO: 481274 - RNA, 19 nt, Homo sapiens
gcacguaaccaaggcuuug

SEQ ID NO: 481275 - RNA, 19 nt, Homo sapiens
ugacgugcaucggcuguuu

SEQ ID NO: 481276 - RNA, 19 nt, Homo sapiens
gggaggaaaccaauuguca

SEQ ID NO: 481277 - RNA, 19 nt, Homo sapiens
uugcuucccucagaaauaa

SEQ ID NO: 481278 - RNA, 19 nt, Homo sapiens
gcccuuaugucgucaccuu

SEQ ID NO: 481279 - RNA, 19 nt, Homo sapiens
gagaacggaguagaacuuu

SEQ ID NO: 481280 - RNA, 19 nt, Homo sapiens
uguuaagacuuguccugua

SEQ ID NO: 481281 - RNA, 19 nt, Homo sapiens
gaacccaacaccagagcuu

SEQ ID NO: 481282 - RNA, 19 nt, Homo sapiens
ugagcaaccugucuucagu

SEQ ID NO: 481283 - RNA, 19 nt, Homo sapiens
aagaaugugcuuuagagua

SEQ ID NO: 481284 - RNA, 19 nt, Homo sapiens
uguaggagaagccuuagua

SEQ ID NO: 481285 - RNA, 19 nt, Homo sapiens
uggccaaacucauuacugu

SEQ ID NO: 481286 - RNA, 19 nt, Homo sapiens
ugacugcccuggccaaacu

SEQ ID NO: 481287 - RNA, 19 nt, Homo sapiens
gagcuugagucgugaagac

SEQ ID NO: 481288 - RNA, 19 nt, Homo sapiens
acugacauauguagacaaa

SEQ ID NO: 481289 - RNA, 19 nt, Homo sapiens
caagugcuacauugaagaa

SEQ ID NO: 481290 - RNA, 19 nt, Homo sapiens
guguauugccuguuaauug

SEQ ID NO: 481291 - RNA, 19 nt, Homo sapiens
ccaaauuugauaccauuga

SEQ ID NO: 481292 - RNA, 19 nt, Homo sapiens
caaacucauuacugucaau

SEQ ID NO: 481293 - RNA, 19 nt, Homo sapiens
ccaauugucagaaggaugu

SEQ ID NO: 481294 - RNA, 19 nt, Homo sapiens
gaaguguuggauuacagua

SEQ ID NO: 481295 - RNA, 19 nt, Homo sapiens
uggcugugcuaacaaagaa

SEQ ID NO: 481296 - RNA, 19 nt, Homo sapiens
ggguggcugugcuaacaaa

SEQ ID NO: 481297 - RNA, 19 nt, Homo sapiens
caacaaguccacgaaguca

SEQ ID NO: 481298 - RNA, 19 nt, Homo sapiens
acagagauccaacagcaaa

SEQ ID NO: 481299 - RNA, 19 nt, Homo sapiens
cuacauugaagaacacaaa

SEQ ID NO: 481300 - RNA, 19 nt, Homo sapiens
agacaagugcuacauugaa

SEQ ID NO: 481301 - RNA, 19 nt, Homo sapiens
caacaccagagcuuugcua

SEQ ID NO: 481302 - RNA, 19 nt, Homo sapiens
ggccuaaucauguuacaau

SEQ ID NO: 481303 - RNA, 19 nt, Homo sapiens
uaucaagaaugugcuuuag

SEQ ID NO: 481304 - RNA, 19 nt, Homo sapiens
gcucaaaacucuaccaaac

SEQ ID NO: 481305 - RNA, 19 nt, Homo sapiens
gcaccucucccuaggauac

SEQ ID NO: 481306 - RNA, 19 nt, Homo sapiens
uuacagcuuugaccaaugg

SEQ ID NO: 481307 - RNA, 19 nt, Homo sapiens
gaaugugcuuuagaguaug

SEQ ID NO: 481308 - RNA, 19 nt, Homo sapiens
gaccuacgcagccucaaug

SEQ ID NO: 481309 - RNA, 19 nt, Homo sapiens
gcccuggccaaacucauua

SEQ ID NO: 481310 - RNA, 19 nt, Homo sapiens
uggcuucaguguccucauu

SEQ ID NO: 481311 - RNA, 19 nt, Homo sapiens
aaagaaguguuggauuaca

SEQ ID NO: 481312 - RNA, 19 nt, Homo sapiens
aguauaaacuggacaacca

SEQ ID NO: 481313 - RNA, 19 nt, Homo sapiens
gcagaaaagucaggucuuc

SEQ ID NO: 481314 - RNA, 19 nt, Homo sapiens
gacaaguaccgcacagaga

SEQ ID NO: 481315 - RNA, 19 nt, Homo sapiens
aguuugagcugguguuugu

SEQ ID NO: 481316 - RNA, 19 nt, Homo sapiens
aggaaggccuaaucauguu

SEQ ID NO: 481317 - RNA, 19 nt, Homo sapiens
gcaaggaaggccuaaucau

SEQ ID NO: 481318 - RNA, 19 nt, Homo sapiens
gcucuugcccaauaccaaa

SEQ ID NO: 481319 - RNA, 19 nt, Homo sapiens
guuuguaggagaagccuua

SEQ ID NO: 481320 - RNA, 19 nt, Homo sapiens
gccaaacucauuacuguca

SEQ ID NO: 481321 - RNA, 19 nt, Homo sapiens
gagcagcugcguacacaca

SEQ ID NO: 481322 - RNA, 19 nt, Homo sapiens
gaugugcuauuagugcaau

SEQ ID NO: 481323 - RNA, 19 nt, Homo sapiens
uaauuaguguggucaagag

SEQ ID NO: 481324 - RNA, 19 nt, Homo sapiens
ucagucuuauuacagcuuu

SEQ ID NO: 481325 - RNA, 19 nt, Homo sapiens
ccaaacucauuacugucaa

SEQ ID NO: 481326 - RNA, 19 nt, Homo sapiens
guuagagaauggcuucagu

SEQ ID NO: 481327 - RNA, 19 nt, Homo sapiens
gaacggaguagaacuuucc

SEQ ID NO: 481328 - RNA, 19 nt, Homo sapiens
uacagugccugguagacaa

SEQ ID NO: 481329 - RNA, 19 nt, Homo sapiens
agaaguaagcucugcaugu

SEQ ID NO: 481330 - RNA, 19 nt, Homo sapiens
uauuacagcuuugaccaau

SEQ ID NO: 481331 - RNA, 19 nt, Homo sapiens
aaggaaggccuaaucaugu

SEQ ID NO: 481332 - RNA, 19 nt, Homo sapiens
ggacaaagcuguaggacaa

SEQ ID NO: 481333 - RNA, 19 nt, Homo sapiens
caagauggcucuagagaau

SEQ ID NO: 481334 - RNA, 19 nt, Homo sapiens
caaagaaucugguagaagu

SEQ ID NO: 481335 - RNA, 19 nt, Homo sapiens
gagaaauacccgaauuaua

SEQ ID NO: 481336 - RNA, 19 nt, Homo sapiens
caacagcgaugauuacagu

SEQ ID NO: 481337 - RNA, 19 nt, Homo sapiens
gagagaaauacccgaauua

SEQ ID NO: 481338 - RNA, 19 nt, Homo sapiens
cgaagaugcugccgaagaa

SEQ ID NO: 481339 - RNA, 19 nt, Homo sapiens
acaaagaccuaccuagaug

SEQ ID NO: 481340 - RNA, 19 nt, Homo sapiens
uaacaaagaaucugguaga

SEQ ID NO: 481341 - RNA, 19 nt, Homo sapiens
acugaaagcuguaacucua

SEQ ID NO: 481342 - RNA, 19 nt, Homo sapiens
ccaggaggcacagaaauua

SEQ ID NO: 481343 - RNA, 19 nt, Homo sapiens
gcaagcagcugggauacca

SEQ ID NO: 481344 - RNA, 19 nt, Homo sapiens
agagagaaauacccgaauu

SEQ ID NO: 481345 - RNA, 19 nt, Homo sapiens
gaaagccacacacucaaga

SEQ ID NO: 481346 - RNA, 19 nt, Homo sapiens
uuacagcccucacuuucuu

SEQ ID NO: 481347 - RNA, 19 nt, Homo sapiens
gaaauacccgaauuauaag

SEQ ID NO: 481348 - RNA, 19 nt, Homo sapiens
cuacaaagaccuaccuaga

SEQ ID NO: 481349 - RNA, 19 nt, Homo sapiens
gcaagauggcucuagagaa

SEQ ID NO: 481350 - RNA, 19 nt, Homo sapiens
gcgaagaugcugccgaaga

SEQ ID NO: 481351 - RNA, 19 nt, Homo sapiens
uaaaggccuuauucauuuc

SEQ ID NO: 481352 - RNA, 19 nt, Homo sapiens
acaaugcaaucauaugcuu

SEQ ID NO: 481353 - RNA, 19 nt, Homo sapiens
ggguaacauuggcuacaaa

SEQ ID NO: 481354 - RNA, 19 nt, Homo sapiens
gccgaagaauugcaguuug

SEQ ID NO: 481355 - RNA, 19 nt, Homo sapiens
gcaccagcuaggccacuua

SEQ ID NO: 481356 - RNA, 19 nt, Homo sapiens
gccacacacucaagaaugg

SEQ ID NO: 481357 - RNA, 19 nt, Homo sapiens
gaaacucagagaucagcaa

SEQ ID NO: 481358 - RNA, 19 nt, Homo sapiens
aaaggcaacguccaggaua

SEQ ID NO: 481359 - RNA, 19 nt, Homo sapiens
gcuguaacucuaaguauca

SEQ ID NO: 481360 - RNA, 19 nt, Homo sapiens
guccagcugugcaagagaa

SEQ ID NO: 481361 - RNA, 19 nt, Homo sapiens
aaucauaugcuucugcuau

SEQ ID NO: 481362 - RNA, 19 nt, Homo sapiens
gaagaauugcaguuugcuu

SEQ ID NO: 481363 - RNA, 19 nt, Homo sapiens
gcccucacuuucuuauguu

SEQ ID NO: 481364 - RNA, 19 nt, Homo sapiens
uaacuuacagcccucacuu

SEQ ID NO: 481365 - RNA, 19 nt, Homo sapiens
guaggacaaucggguaaca

SEQ ID NO: 481366 - RNA, 19 nt, Homo sapiens
ugaaagcuguaacucuaag

SEQ ID NO: 481367 - RNA, 19 nt, Homo sapiens
auaugcuucugcuauguua

SEQ ID NO: 481368 - RNA, 19 nt, Homo sapiens
ucuagagaaucccagaaug

SEQ ID NO: 481369 - RNA, 19 nt, Homo sapiens
aacaaagaaucugguagaa

SEQ ID NO: 481370 - RNA, 19 nt, Homo sapiens
cuaccuagaugcuccuuuu

SEQ ID NO: 481371 - RNA, 19 nt, Homo sapiens
gagugaagcgacccaugaa

SEQ ID NO: 481372 - RNA, 19 nt, Homo sapiens
uaacauuggcuacaaagac

SEQ ID NO: 481373 - RNA, 19 nt, Homo sapiens
ggcgcaagauggcucuaga

SEQ ID NO: 481374 - RNA, 19 nt, Homo sapiens
gaagugaguuuuggauagu

SEQ ID NO: 481375 - RNA, 19 nt, Homo sapiens
uacaaagaccuaccuagau

SEQ ID NO: 481376 - RNA, 19 nt, Homo sapiens
agagaaauacccgaauuau

SEQ ID NO: 481377 - RNA, 19 nt, Homo sapiens
agagugaagcgacccauga

SEQ ID NO: 481378 - RNA, 19 nt, Homo sapiens
aaagcuguaacucuaagua

SEQ ID NO: 481379 - RNA, 19 nt, Homo sapiens
gaacucuggcaccuuucaa

SEQ ID NO: 481380 - RNA, 19 nt, Homo sapiens
gaagugcaacuggacaaca

SEQ ID NO: 481381 - RNA, 19 nt, Homo sapiens
ccgaagaauugcaguuugc

SEQ ID NO: 481382 - RNA, 19 nt, Homo sapiens
acucagagaucagcaagca

SEQ ID NO: 481383 - RNA, 19 nt, Homo sapiens
uacgaaagccacacacuca

SEQ ID NO: 481384 - RNA, 19 nt, Homo sapiens
ccagaaugcgaaacucaga

SEQ ID NO: 481385 - RNA, 19 nt, Homo sapiens
uaaaggcaacguccaggau

SEQ ID NO: 481386 - RNA, 19 nt, Homo sapiens
uucgaacucuggcaccuuu

SEQ ID NO: 481387 - RNA, 19 nt, Homo sapiens
cagcugugcaagagaauau

SEQ ID NO: 481388 - RNA, 19 nt, Homo sapiens
ccacuuaccgcccaucaac

SEQ ID NO: 481389 - RNA, 19 nt, Homo sapiens
aagaauggagcaccagcua

SEQ ID NO: 481390 - RNA, 19 nt, Homo sapiens
ccaugcacagagagaaaua

SEQ ID NO: 481391 - RNA, 19 nt, Homo sapiens
uacaggccaugcacagaga

SEQ ID NO: 481392 - RNA, 19 nt, Homo sapiens
uauucaacagcgaugauua

SEQ ID NO: 481393 - RNA, 19 nt, Homo sapiens
cggguaacauuggcuacaa

SEQ ID NO: 481394 - RNA, 19 nt, Homo sapiens
agggaugacuguacgaaag

SEQ ID NO: 481395 - RNA, 19 nt, Homo sapiens
ucugcuauguuaagcguau

SEQ ID NO: 481396 - RNA, 19 nt, Homo sapiens
cguaacaaagaaucuggua

SEQ ID NO: 481397 - RNA, 19 nt, Homo sapiens
ggccaugcacagagagaaa

SEQ ID NO: 481398 - RNA, 19 nt, Homo sapiens
gcacugaaagcuguaacuc

SEQ ID NO: 481399 - RNA, 19 nt, Homo sapiens
gaagaugcugccgaagaau

SEQ ID NO: 481400 - RNA, 19 nt, Homo sapiens
gaaacgggagaaaacagua

SEQ ID NO: 481401 - RNA, 19 nt, Homo sapiens
guaacauuggcuacaaaga

SEQ ID NO: 481402 - RNA, 19 nt, Homo sapiens
ucuuuucucuggcuaauaa

SEQ ID NO: 481403 - RNA, 19 nt, Homo sapiens
guauucaacagcgaugauu

SEQ ID NO: 481404 - RNA, 19 nt, Homo sapiens
acaaagcuguaggacaauc

SEQ ID NO: 481405 - RNA, 19 nt, Homo sapiens
gggcggagaaaugcaaguu

SEQ ID NO: 481406 - RNA, 19 nt, Homo sapiens
aagaugcugccgaagaauu

SEQ ID NO: 481407 - RNA, 19 nt, Homo sapiens
uccaggaggcacagaaauu

SEQ ID NO: 481408 - RNA, 19 nt, Homo sapiens
augcgaaacucagagauca

SEQ ID NO: 481409 - RNA, 19 nt, Homo sapiens
ugacaaugcaaucauaugc

SEQ ID NO: 481410 - RNA, 19 nt, Homo sapiens
ccucacuuucuuauguuua

SEQ ID NO: 481411 - RNA, 19 nt, Homo sapiens
agcccucacuuucuuaugu

SEQ ID NO: 481412 - RNA, 19 nt, Homo sapiens
cgaaagccacacacucaag

SEQ ID NO: 481413 - RNA, 19 nt, Homo sapiens
gcgaagugcaacuggacaa

SEQ ID NO: 481414 - RNA, 19 nt, Homo sapiens
ucuggcaccuuucaauuuu

SEQ ID NO: 481415 - RNA, 19 nt, Homo sapiens
uaacguaacaaagaaucug

SEQ ID NO: 481416 - RNA, 19 nt, Homo sapiens
acucuaaguaucaguguga

SEQ ID NO: 481417 - RNA, 19 nt, Homo sapiens
gaaagcuguaacucuaagu

SEQ ID NO: 481418 - RNA, 19 nt, Homo sapiens
ggcggagaaaugcaaguuu

SEQ ID NO: 481419 - RNA, 19 nt, Homo sapiens
gaagagagauuugauaguu

SEQ ID NO: 481420 - RNA, 19 nt, Homo sapiens
gagcauaccuggaaaugaa

SEQ ID NO: 481421 - RNA, 19 nt, Homo sapiens
ggugagaucucuauuauau

SEQ ID NO: 481422 - RNA, 19 nt, Homo sapiens
gcagcacgcuugacaauga

SEQ ID NO: 481423 - RNA, 19 nt, Homo sapiens
gaagcagccuccuuauauu

SEQ ID NO: 481424 - RNA, 19 nt, Homo sapiens
ccacaaacccugccucuuu

SEQ ID NO: 481425 - RNA, 19 nt, Homo sapiens
gaacaaccuuaaagaaauc

SEQ ID NO: 481426 - RNA, 19 nt, Homo sapiens
ggaguuggcugagaaguug

SEQ ID NO: 481427 - RNA, 19 nt, Homo sapiens
gaagaucggagacaaguga

SEQ ID NO: 481428 - RNA, 19 nt, Homo sapiens
gauauuaccucuccagaac

SEQ ID NO: 481429 - RNA, 19 nt, Homo sapiens
ggaaguggaaauugcaaua

SEQ ID NO: 481430 - RNA, 19 nt, Homo sapiens
gagagagacuucaccuguu

SEQ ID NO: 481431 - RNA, 19 nt, Homo sapiens
ugaagcagccuccuuauau

SEQ ID NO: 481432 - RNA, 19 nt, Homo sapiens
ccagauggcuuugugauuc

SEQ ID NO: 481433 - RNA, 19 nt, Homo sapiens
ugaaggaccuggauauuac

SEQ ID NO: 481434 - RNA, 19 nt, Homo sapiens
gaccauggcucccucaucu

SEQ ID NO: 481435 - RNA, 19 nt, Homo sapiens
uacaggagcucaucucaga

SEQ ID NO: 481436 - RNA, 19 nt, Homo sapiens
ggaaauugcaauaaagaga

SEQ ID NO: 481437 - RNA, 19 nt, Homo sapiens
ggugauaauuguccuggaa

SEQ ID NO: 481438 - RNA, 19 nt, Homo sapiens
gaaguggaaauugcaauaa

SEQ ID NO: 481439 - RNA, 19 nt, Homo sapiens
gugaacaaccuuaaagaaa

SEQ ID NO: 481440 - RNA, 19 nt, Homo sapiens
ucucuaggaugucgucuuu

SEQ ID NO: 481441 - RNA, 19 nt, Homo sapiens
gcguugaguugcccuguaa

SEQ ID NO: 481442 - RNA, 19 nt, Homo sapiens
gaaguuggaaguggaaauu

SEQ ID NO: 481443 - RNA, 19 nt, Homo sapiens
gcaaaagggcuuccuaaaa

SEQ ID NO: 481444 - RNA, 19 nt, Homo sapiens
cagcagagcauaccuggaa

SEQ ID NO: 481445 - RNA, 19 nt, Homo sapiens
ucuccacacugcuguuuaa

SEQ ID NO: 481446 - RNA, 19 nt, Homo sapiens
gugaagcagccuccuuaua

SEQ ID NO: 481447 - RNA, 19 nt, Homo sapiens
ucacaaggauccacugacu

SEQ ID NO: 481448 - RNA, 19 nt, Homo sapiens
aagaguggcuucuggacaa

SEQ ID NO: 481449 - RNA, 19 nt, Homo sapiens
ggugaacaaccuuaaagaa

SEQ ID NO: 481450 - RNA, 19 nt, Homo sapiens
cugaaggaccuggauauua

SEQ ID NO: 481451 - RNA, 19 nt, Homo sapiens
ugcaggagcuggagaagga

SEQ ID NO: 481452 - RNA, 19 nt, Homo sapiens
cagugaagcagccuccuua

SEQ ID NO: 481453 - RNA, 19 nt, Homo sapiens
gaauauuggaucacaagga

SEQ ID NO: 481454 - RNA, 19 nt, Homo sapiens
ggauauuaccucuccagaa

SEQ ID NO: 481455 - RNA, 19 nt, Homo sapiens
gagaagaaagcaggaguug

SEQ ID NO: 481456 - RNA, 19 nt, Homo sapiens
gagagcagacuggaagaaa

SEQ ID NO: 481457 - RNA, 19 nt, Homo sapiens
agagagacuucaccuguuc

SEQ ID NO: 481458 - RNA, 19 nt, Homo sapiens
gaggucacaugcccuaucu

SEQ ID NO: 481459 - RNA, 19 nt, Homo sapiens
acauguuucugccuucuuu

SEQ ID NO: 481460 - RNA, 19 nt, Homo sapiens
ucacuucaccaucaacauu

SEQ ID NO: 481461 - RNA, 19 nt, Homo sapiens
ggaaugcaucucucagguu

SEQ ID NO: 481462 - RNA, 19 nt, Homo sapiens
uaucuuguaugguuugcaa

SEQ ID NO: 481463 - RNA, 19 nt, Homo sapiens
uuggugagaucucuauuau

SEQ ID NO: 481464 - RNA, 19 nt, Homo sapiens
ugccagggcugaagaagau

SEQ ID NO: 481465 - RNA, 19 nt, Homo sapiens
ccacagcucagcacuggaa

SEQ ID NO: 481466 - RNA, 19 nt, Homo sapiens
uagccaacauggugaacaa

SEQ ID NO: 481467 - RNA, 19 nt, Homo sapiens
gaugucgucuuuggugaga

SEQ ID NO: 481468 - RNA, 19 nt, Homo sapiens
acaaggauccacugacuau

SEQ ID NO: 481469 - RNA, 19 nt, Homo sapiens
aauauuggaucacaaggau

SEQ ID NO: 481470 - RNA, 19 nt, Homo sapiens
cuaacccucuguccacuga

SEQ ID NO: 481471 - RNA, 19 nt, Homo sapiens
gaagcuccagguggcauua

SEQ ID NO: 481472 - RNA, 19 nt, Homo sapiens
gugauucccuccagugaag

SEQ ID NO: 481473 - RNA, 19 nt, Homo sapiens
ggauuuuccuggacuauga

SEQ ID NO: 481474 - RNA, 19 nt, Homo sapiens
ugcaggaggugauaauugu

SEQ ID NO: 481475 - RNA, 19 nt, Homo sapiens
uaacggcacacuugacaau

SEQ ID NO: 481476 - RNA, 19 nt, Homo sapiens
aagcagccuccuuauauuu

SEQ ID NO: 481477 - RNA, 19 nt, Homo sapiens
gaacucugaaccaccuuug

SEQ ID NO: 481478 - RNA, 19 nt, Homo sapiens
gaaacacagaaaucuagga

SEQ ID NO: 481479 - RNA, 19 nt, Homo sapiens
agaagaugcugaggacaug

SEQ ID NO: 481480 - RNA, 19 nt, Homo sapiens
aggauccacugacuauuga

SEQ ID NO: 481481 - RNA, 19 nt, Homo sapiens
ggcauggucuccuucuaca

SEQ ID NO: 481482 - RNA, 19 nt, Homo sapiens
ccacaucacucuggaucca

SEQ ID NO: 481483 - RNA, 19 nt, Homo sapiens
caucuacuccuucucugaa

SEQ ID NO: 481484 - RNA, 19 nt, Homo sapiens
cuucaguccugguuucaau

SEQ ID NO: 481485 - RNA, 19 nt, Homo sapiens
gugccuccaugccaaguug

SEQ ID NO: 481486 - RNA, 19 nt, Homo sapiens
gcagccuccuuauauuugg

SEQ ID NO: 481487 - RNA, 19 nt, Homo sapiens
gagacucugugcgcaggaa

SEQ ID NO: 481488 - RNA, 19 nt, Homo sapiens
guggaaacacagaaaucua

SEQ ID NO: 481489 - RNA, 19 nt, Homo sapiens
gaagaaaacaguggaaaca

SEQ ID NO: 481490 - RNA, 19 nt, Homo sapiens
uaaagagagcagacuggaa

SEQ ID NO: 481491 - RNA, 19 nt, Homo sapiens
guggaaauugcaauaaaga

SEQ ID NO: 481492 - RNA, 19 nt, Homo sapiens
ucuaggaugucgucuuugg

SEQ ID NO: 481493 - RNA, 19 nt, Homo sapiens
cacaaacccugccucuuuu

SEQ ID NO: 481494 - RNA, 19 nt, Homo sapiens
ccacagcuucugccaggaa

SEQ ID NO: 481495 - RNA, 19 nt, Homo sapiens
cagcagcacgcuugacaau

SEQ ID NO: 481496 - RNA, 19 nt, Homo sapiens
caacauggugaacaaccuu

SEQ ID NO: 481497 - RNA, 19 nt, Homo sapiens
aaggauccacugacuauug

SEQ ID NO: 481498 - RNA, 19 nt, Homo sapiens
gcagagcauaccuggaaau

SEQ ID NO: 481499 - RNA, 19 nt, Homo sapiens
agagggagcagcugagaau

SEQ ID NO: 481500 - RNA, 19 nt, Homo sapiens
agguagaugugacaggaaa

SEQ ID NO: 481501 - RNA, 19 nt, Homo sapiens
gaaccugaaggaccuggau

SEQ ID NO: 481502 - RNA, 19 nt, Homo sapiens
aaacacagaaaucuaggau

SEQ ID NO: 481503 - RNA, 19 nt, Homo sapiens
caacauuccugccccagau

SEQ ID NO: 481504 - RNA, 19 nt, Homo sapiens
aguggcuucuggacaauuu

SEQ ID NO: 481505 - RNA, 19 nt, Homo sapiens
gagagggagcagcugagaa

SEQ ID NO: 481506 - RNA, 19 nt, Homo sapiens
ggaggucacaugcccuauc

SEQ ID NO: 481507 - RNA, 19 nt, Homo sapiens
gauccacugacuauugaug

SEQ ID NO: 481508 - RNA, 19 nt, Homo sapiens
aaacugaaagugaaauagg

SEQ ID NO: 481509 - RNA, 19 nt, Homo sapiens
guuucugccuucuuuaugg

SEQ ID NO: 481510 - RNA, 19 nt, Homo sapiens
uggaaacacagaaaucuag

SEQ ID NO: 481511 - RNA, 19 nt, Homo sapiens
aaacaguggaaacacagaa

SEQ ID NO: 481512 - RNA, 19 nt, Homo sapiens
aagcaggaguuggcugaga

SEQ ID NO: 481513 - RNA, 19 nt, Homo sapiens
cagaagaucggagacaagu

SEQ ID NO: 481514 - RNA, 19 nt, Homo sapiens
uaggauucacgcagaguuu

SEQ ID NO: 481515 - RNA, 19 nt, Homo sapiens
ugagaagaaagcaggaguu

SEQ ID NO: 481516 - RNA, 19 nt, Homo sapiens
gcccuuugcuggguaugug

SEQ ID NO: 481517 - RNA, 19 nt, Homo sapiens
cagcacgcuugacaaugau

SEQ ID NO: 481518 - RNA, 19 nt, Homo sapiens
uuuggugagaucucuauua

SEQ ID NO: 481519 - RNA, 19 nt, Homo sapiens
gaaagaaguucaugaauug

SEQ ID NO: 481520 - RNA, 19 nt, Homo sapiens
ggaaagaaguucaugaauu

SEQ ID NO: 481521 - RNA, 19 nt, Homo sapiens
gaacauagauuaguuagag

SEQ ID NO: 481522 - RNA, 19 nt, Homo sapiens
ggaaugacaucaaaugguu

SEQ ID NO: 481523 - RNA, 19 nt, Homo sapiens
gaaugaugaugguauagua

SEQ ID NO: 481524 - RNA, 19 nt, Homo sapiens
ggaggaaucuguaaaccaa

SEQ ID NO: 481525 - RNA, 19 nt, Homo sapiens
cagaggaugugaagugaua

SEQ ID NO: 481526 - RNA, 19 nt, Homo sapiens
gaaggugggacuuauuaua

SEQ ID NO: 481527 - RNA, 19 nt, Homo sapiens
gcugaugucuucauuguau

SEQ ID NO: 481528 - RNA, 19 nt, Homo sapiens
uaggaaagaugacugcuaa

SEQ ID NO: 481529 - RNA, 19 nt, Homo sapiens
uaagaaagaucugaaggaa

SEQ ID NO: 481530 - RNA, 19 nt, Homo sapiens
ccagcuaaauugauuguuu

SEQ ID NO: 481531 - RNA, 19 nt, Homo sapiens
gaugugaagugauacaaga

SEQ ID NO: 481532 - RNA, 19 nt, Homo sapiens
aaagaugacugcuaauuca

SEQ ID NO: 481533 - RNA, 19 nt, Homo sapiens
gaaagaugacugcuaauuc

SEQ ID NO: 481534 - RNA, 19 nt, Homo sapiens
gcaauugugaccaaauaua

SEQ ID NO: 481535 - RNA, 19 nt, Homo sapiens
agaaagaucugaaggaaag

SEQ ID NO: 481536 - RNA, 19 nt, Homo sapiens
gauagaggcauguuggaua

SEQ ID NO: 481537 - RNA, 19 nt, Homo sapiens
ggaaagaugacugcuaauu

SEQ ID NO: 481538 - RNA, 19 nt, Homo sapiens
cuacccaucucuuuacuuu

SEQ ID NO: 481539 - RNA, 19 nt, Homo sapiens
gagggaguaucgaaagaaa

SEQ ID NO: 481540 - RNA, 19 nt, Homo sapiens
agaaauggcuggucucaca

SEQ ID NO: 481541 - RNA, 19 nt, Homo sapiens
ggauauguauggcaaguca

SEQ ID NO: 481542 - RNA, 19 nt, Homo sapiens
gauaugugcggcuuugaua

SEQ ID NO: 481543 - RNA, 19 nt, Homo sapiens
acaaagggcuggaaagaag

SEQ ID NO: 481544 - RNA, 19 nt, Homo sapiens
ugaaaaugcugaagcuuua

SEQ ID NO: 481545 - RNA, 19 nt, Homo sapiens
cuacagauaugaccuuaca

SEQ ID NO: 481546 - RNA, 19 nt, Homo sapiens
gugaaggacuugcaauugu

SEQ ID NO: 481547 - RNA, 19 nt, Homo sapiens
gcuaaucuccacccaauga

SEQ ID NO: 481548 - RNA, 19 nt, Homo sapiens
cagcuaaucuccacccaau

SEQ ID NO: 481549 - RNA, 19 nt, Homo sapiens
cagcuaaauugauuguuug

SEQ ID NO: 481550 - RNA, 19 nt, Homo sapiens
aaacacaccugcugauguc

SEQ ID NO: 481551 - RNA, 19 nt, Homo sapiens
cuuaaagucuaaagaggua

SEQ ID NO: 481552 - RNA, 19 nt, Homo sapiens
cuacaccgguucuuauguu

SEQ ID NO: 481553 - RNA, 19 nt, Homo sapiens
gguauggaaggcuuuguua

SEQ ID NO: 481554 - RNA, 19 nt, Homo sapiens
ccacaaagcaagagccuau

SEQ ID NO: 481555 - RNA, 19 nt, Homo sapiens
ccaauucucaggauggaua

SEQ ID NO: 481556 - RNA, 19 nt, Homo sapiens
ggaacugauugcucucuuc

SEQ ID NO: 481557 - RNA, 19 nt, Homo sapiens
ggacugguacaaugagaaa

SEQ ID NO: 481558 - RNA, 19 nt, Homo sapiens
agaagcagauagccaauuc

SEQ ID NO: 481559 - RNA, 19 nt, Homo sapiens
ggauauuccagcuaaauug

SEQ ID NO: 481560 - RNA, 19 nt, Homo sapiens
gauauuccagcuaaauuga

SEQ ID NO: 481561 - RNA, 19 nt, Homo sapiens
gacuacagauaugaccuua

SEQ ID NO: 481562 - RNA, 19 nt, Homo sapiens
ucuggaggcuguagagaaa

SEQ ID NO: 481563 - RNA, 19 nt, Homo sapiens
uaaagcuguuucugaaguu

SEQ ID NO: 481564 - RNA, 19 nt, Homo sapiens
caagaaggcagaaccacaa

SEQ ID NO: 481565 - RNA, 19 nt, Homo sapiens
gcugaagcuuuaauuagau

SEQ ID NO: 481566 - RNA, 19 nt, Homo sapiens
accaggaaauucagaagua

SEQ ID NO: 481567 - RNA, 19 nt, Homo sapiens
caagaaaugccgcuuacug

SEQ ID NO: 481568 - RNA, 19 nt, Homo sapiens
uugcaauugugaccaaaua

SEQ ID NO: 481569 - RNA, 19 nt, Homo sapiens
cuauuaagauugucacauc

SEQ ID NO: 481570 - RNA, 19 nt, Homo sapiens
gaaggaaagcaugaaaugu

SEQ ID NO: 481571 - RNA, 19 nt, Homo sapiens
gaaguuugucgcauuccua

SEQ ID NO: 481572 - RNA, 19 nt, Homo sapiens
gaagauggcagaggaugug

SEQ ID NO: 481573 - RNA, 19 nt, Homo sapiens
ggugggacuuauuauauca

SEQ ID NO: 481574 - RNA, 19 nt, Homo sapiens
acucaacgcuaguacaguu

SEQ ID NO: 481575 - RNA, 19 nt, Homo sapiens
gaaggacuugcaauuguga

SEQ ID NO: 481576 - RNA, 19 nt, Homo sapiens
ugaaggacuugcaauugug

SEQ ID NO: 481577 - RNA, 19 nt, Homo sapiens
ucuaugaaccaaagaguuu

SEQ ID NO: 481578 - RNA, 19 nt, Homo sapiens
guacuugaaccaggaaauu

SEQ ID NO: 481579 - RNA, 19 nt, Homo sapiens
gaagucauucaucuaauag

SEQ ID NO: 481580 - RNA, 19 nt, Homo sapiens
caaaugcagccacugaaug

SEQ ID NO: 481581 - RNA, 19 nt, Homo sapiens
gaucugaaggaaagcauga

SEQ ID NO: 481582 - RNA, 19 nt, Homo sapiens
uuaaagcuguuucugaagu

SEQ ID NO: 481583 - RNA, 19 nt, Homo sapiens
cgacuacaccgguucuuau

SEQ ID NO: 481584 - RNA, 19 nt, Homo sapiens
ccaggaaauucagaaguau

SEQ ID NO: 481585 - RNA, 19 nt, Homo sapiens
gauagccaauucucaggau

SEQ ID NO: 481586 - RNA, 19 nt, Homo sapiens
ugaaggaaagcaugaaaug

SEQ ID NO: 481587 - RNA, 19 nt, Homo sapiens
ggagguguccauccugcua

SEQ ID NO: 481588 - RNA, 19 nt, Homo sapiens
caaacacaccugcugaugu

SEQ ID NO: 481589 - RNA, 19 nt, Homo sapiens
gaugucagugcuucuauga

SEQ ID NO: 481590 - RNA, 19 nt, Homo sapiens
gcagaaccacaaagcaaga

SEQ ID NO: 481591 - RNA, 19 nt, Homo sapiens
ggcagaggaugugaaguga

SEQ ID NO: 481592 - RNA, 19 nt, Homo sapiens
gaaagaaaauggauauucc

SEQ ID NO: 481593 - RNA, 19 nt, Homo sapiens
gcgcccugaugaagaaauu

SEQ ID NO: 481594 - RNA, 19 nt, Homo sapiens
uuacaagaaaugccgcuua

SEQ ID NO: 481595 - RNA, 19 nt, Homo sapiens
ucuuaaaccuuccagugaa

SEQ ID NO: 481596 - RNA, 19 nt, Homo sapiens
ccuaugcucuuugcacuug

SEQ ID NO: 481597 - RNA, 19 nt, Homo sapiens
gugaagugauacaagaaau

SEQ ID NO: 481598 - RNA, 19 nt, Homo sapiens
ugcugaagcuuuaauuaga

SEQ ID NO: 481599 - RNA, 19 nt, Homo sapiens
auagaggcauguuggauau

SEQ ID NO: 481600 - RNA, 19 nt, Homo sapiens
aaaugcagccacugaauga

SEQ ID NO: 481601 - RNA, 19 nt, Homo sapiens
cugaaggugggacuuauua

SEQ ID NO: 481602 - RNA, 19 nt, Homo sapiens
uaucaaagaacagaaguug

SEQ ID NO: 481603 - RNA, 19 nt, Homo sapiens
gaaugacaucaaaugguuu

SEQ ID NO: 481604 - RNA, 19 nt, Homo sapiens
guucuuauguuucgguucu

SEQ ID NO: 481605 - RNA, 19 nt, Homo sapiens
gaaguaucuuuaguaugug

SEQ ID NO: 481606 - RNA, 19 nt, Homo sapiens
uggcuggucucacaaagau

SEQ ID NO: 481607 - RNA, 19 nt, Homo sapiens
uacuggagcucuggaugua

SEQ ID NO: 481608 - RNA, 19 nt, Homo sapiens
gacaggucauggucucaga

SEQ ID NO: 481609 - RNA, 19 nt, Homo sapiens
gaaauggcuggucucacaa

SEQ ID NO: 481610 - RNA, 19 nt, Homo sapiens
aaacaagcagcauuuaaag

SEQ ID NO: 481611 - RNA, 19 nt, Homo sapiens
cugcugaugucuucauugu

SEQ ID NO: 481612 - RNA, 19 nt, Homo sapiens
gcaaugugcaugguuguca

SEQ ID NO: 481613 - RNA, 19 nt, Homo sapiens
cuuacuagcuguugauguc

SEQ ID NO: 481614 - RNA, 19 nt, Homo sapiens
cguauacauccauuucaua

SEQ ID NO: 481615 - RNA, 19 nt, Homo sapiens
gcucguauacauccauuuc

SEQ ID NO: 481616 - RNA, 19 nt, Homo sapiens
gagaagcagauagccaauu

SEQ ID NO: 481617 - RNA, 19 nt, Homo sapiens
ugacaugaaucgacuacac

SEQ ID NO: 481618 - RNA, 19 nt, Homo sapiens
gaaguugggccuugaaaau

SEQ ID NO: 481619 - RNA, 19 nt, Homo sapiens
ggaaaucagugaagauaaa

SEQ ID NO: 481620 - RNA, 19 nt, Homo sapiens
gaaaugaaaucucuagaag

SEQ ID NO: 481621 - RNA, 19 nt, Homo sapiens
ggucguagauuuaaaggaa

SEQ ID NO: 481622 - RNA, 19 nt, Homo sapiens
ggacaaguuucuaaaggaa

SEQ ID NO: 481623 - RNA, 19 nt, Homo sapiens
caacaagaaucccuaaaca

SEQ ID NO: 481624 - RNA, 19 nt, Homo sapiens
gaacauugcauaaagcauu

SEQ ID NO: 481625 - RNA, 19 nt, Homo sapiens
gaaauuugcuagugaugau

SEQ ID NO: 481626 - RNA, 19 nt, Homo sapiens
agaagaagaugcugaaaug

SEQ ID NO: 481627 - RNA, 19 nt, Homo sapiens
ggagaccaguaguuuagua

SEQ ID NO: 481628 - RNA, 19 nt, Homo sapiens
agauaaaggucaaguacua

SEQ ID NO: 481629 - RNA, 19 nt, Homo sapiens
aaacgaaauuugcuaguga

SEQ ID NO: 481630 - RNA, 19 nt, Homo sapiens
agaagaaccugcauccaaa

SEQ ID NO: 481631 - RNA, 19 nt, Homo sapiens
agaagaugcugaaaugaaa

SEQ ID NO: 481632 - RNA, 19 nt, Homo sapiens
gcuaagaaauuuguagaga

SEQ ID NO: 481633 - RNA, 19 nt, Homo sapiens
aaacagaccugcuaauacu

SEQ ID NO: 481634 - RNA, 19 nt, Homo sapiens
cagaaggucuccaagcaaa

SEQ ID NO: 481635 - RNA, 19 nt, Homo sapiens
cauugaaucugcuaagaaa

SEQ ID NO: 481636 - RNA, 19 nt, Homo sapiens
caaagaaacagaccugcua

SEQ ID NO: 481637 - RNA, 19 nt, Homo sapiens
gcauuuaagggaucaauuu

SEQ ID NO: 481638 - RNA, 19 nt, Homo sapiens
gagaagaaacagacaaaga

SEQ ID NO: 481639 - RNA, 19 nt, Homo sapiens
gagaagaacauugcauaaa

SEQ ID NO: 481640 - RNA, 19 nt, Homo sapiens
gaaaagagcaagagaagaa

SEQ ID NO: 481641 - RNA, 19 nt, Homo sapiens
ggccggaaccuuaaagaua

SEQ ID NO: 481642 - RNA, 19 nt, Homo sapiens
acaagaaucccuaaacaaa

SEQ ID NO: 481643 - RNA, 19 nt, Homo sapiens
ggccagaaguacaaagaaa

SEQ ID NO: 481644 - RNA, 19 nt, Homo sapiens
gaaacagaccugcuaauac

SEQ ID NO: 481645 - RNA, 19 nt, Homo sapiens
gaagaacauugcauaaagc

SEQ ID NO: 481646 - RNA, 19 nt, Homo sapiens
ccauuaaauugccuuugua

SEQ ID NO: 481647 - RNA, 19 nt, Homo sapiens
agaagaacauugcauaaag

SEQ ID NO: 481648 - RNA, 19 nt, Homo sapiens
gaagauaaaggucaaguac

SEQ ID NO: 481649 - RNA, 19 nt, Homo sapiens
aagaaucccuaaacaaaug

SEQ ID NO: 481650 - RNA, 19 nt, Homo sapiens
ggucaaguacuaaauauuc

SEQ ID NO: 481651 - RNA, 19 nt, Homo sapiens
gggacaaguuucuaaagga

SEQ ID NO: 481652 - RNA, 19 nt, Homo sapiens
agaaacagaccugcuaaua

SEQ ID NO: 481653 - RNA, 19 nt, Homo sapiens
gccaaaaucugucaucaaa

SEQ ID NO: 481654 - RNA, 19 nt, Homo sapiens
gagcuaaacaggagcaaga

SEQ ID NO: 481655 - RNA, 19 nt, Homo sapiens
gccggaaccuuaaagauag

SEQ ID NO: 481656 - RNA, 19 nt, Homo sapiens
aguggaagcuaaauuaaga

SEQ ID NO: 481657 - RNA, 19 nt, Homo sapiens
aggcagaacucauggaaau

SEQ ID NO: 481658 - RNA, 19 nt, Homo sapiens
gaaccugcauccaaacaac

SEQ ID NO: 481659 - RNA, 19 nt, Homo sapiens
agaagaaacagacaaagaa

SEQ ID NO: 481660 - RNA, 19 nt, Homo sapiens
cuaaacaaauggaagucaa

SEQ ID NO: 481661 - RNA, 19 nt, Homo sapiens
caagaaucccuaaacaaau

SEQ ID NO: 481662 - RNA, 19 nt, Homo sapiens
aauagaagaccaacaagaa

SEQ ID NO: 481663 - RNA, 19 nt, Homo sapiens
gaagaagaugcugaaauga

SEQ ID NO: 481664 - RNA, 19 nt, Homo sapiens
gauaaaggucaaguacuaa

SEQ ID NO: 481665 - RNA, 19 nt, Homo sapiens
caacugaugcaacucuuga

SEQ ID NO: 481666 - RNA, 19 nt, Homo sapiens
gaagaaacagacaaagaag

SEQ ID NO: 481667 - RNA, 19 nt, Homo sapiens
gucaaaaggucguagauuu

SEQ ID NO: 481668 - RNA, 19 nt, Homo sapiens
ccaaagaugcaaauaaugg

SEQ ID NO: 481669 - RNA, 19 nt, Homo sapiens
gcauugaaucugcuaagaa

SEQ ID NO: 481670 - RNA, 19 nt, Homo sapiens
uuaaaggcuucccaacuga

SEQ ID NO: 481671 - RNA, 19 nt, Homo sapiens
gcagaacucauggaaauca

SEQ ID NO: 481672 - RNA, 19 nt, Homo sapiens
gagcaaauccaaggcagaa

SEQ ID NO: 481673 - RNA, 19 nt, Homo sapiens
agaaacagacaaagaagaa

SEQ ID NO: 481674 - RNA, 19 nt, Homo sapiens
caaggaagcauuggguaaa

SEQ ID NO: 481675 - RNA, 19 nt, Homo sapiens
guuagaagauaaaggucaa

SEQ ID NO: 481676 - RNA, 19 nt, Homo sapiens
agccaaagaugcaaauaau

SEQ ID NO: 481677 - RNA, 19 nt, Homo sapiens
cucaaaucauggugaaaua

SEQ ID NO: 481678 - RNA, 19 nt, Homo sapiens
gaauguauuguucuguuug

SEQ ID NO: 481679 - RNA, 19 nt, Homo sapiens
gaaaaggaaaggguaauaa

SEQ ID NO: 481680 - RNA, 19 nt, Homo sapiens
guauuguucuguuuguguu

SEQ ID NO: 481681 - RNA, 19 nt, Homo sapiens
gagaccaguaguuuaguaa

SEQ ID NO: 481682 - RNA, 19 nt, Homo sapiens
ugagaagaacauugcauaa

SEQ ID NO: 481683 - RNA, 19 nt, Homo sapiens
ccacgggacaaguuucuaa

SEQ ID NO: 481684 - RNA, 19 nt, Homo sapiens
caaauaaugguaaccuaca

SEQ ID NO: 481685 - RNA, 19 nt, Homo sapiens
aagaagaugcugaaaugaa

SEQ ID NO: 481686 - RNA, 19 nt, Homo sapiens
guggaagcauugagcaaau

SEQ ID NO: 481687 - RNA, 19 nt, Homo sapiens
aagaagaaccugcauccaa

SEQ ID NO: 481688 - RNA, 19 nt, Homo sapiens
ucaaaaggucguagauuua

SEQ ID NO: 481689 - RNA, 19 nt, Homo sapiens
ugaugaacaugaugaacau

SEQ ID NO: 481690 - RNA, 19 nt, Homo sapiens
uaauagaagaccaacaaga

SEQ ID NO: 481691 - RNA, 19 nt, Homo sapiens
gaagaugcugaaaugaaau

SEQ ID NO: 481692 - RNA, 19 nt, Homo sapiens
aaagaaacagaccugcuaa

SEQ ID NO: 481693 - RNA, 19 nt, Homo sapiens
auuaaaggcuucccaacug

SEQ ID NO: 481694 - RNA, 19 nt, Homo sapiens
caaggcagaacucauggaa

SEQ ID NO: 481695 - RNA, 19 nt, Homo sapiens
guaaagccaaagaugcaaa

SEQ ID NO: 481696 - RNA, 19 nt, Homo sapiens
gaggggauaauucuauuua

SEQ ID NO: 481697 - RNA, 19 nt, Homo sapiens
uccauuaaauugccuuugu

SEQ ID NO: 481698 - RNA, 19 nt, Homo sapiens
caagagaagaaacagacaa

SEQ ID NO: 481699 - RNA, 19 nt, Homo sapiens
gagcaagagaagaaacaga

SEQ ID NO: 481700 - RNA, 19 nt, Homo sapiens
ggaaaaggaaaggguaaua

SEQ ID NO: 481701 - RNA, 19 nt, Homo sapiens
gcaagaagcaaaacaaaag

SEQ ID NO: 481702 - RNA, 19 nt, Homo sapiens
caaaaggucguagauuuaa

SEQ ID NO: 481703 - RNA, 19 nt, Homo sapiens
aagccaaagaugcaaauaa

SEQ ID NO: 481704 - RNA, 19 nt, Homo sapiens
uagaagaagaugcugaaau

SEQ ID NO: 481705 - RNA, 19 nt, Homo sapiens
ugaaccgucuaacaacaga

SEQ ID NO: 481706 - RNA, 19 nt, Homo sapiens
ucauggaaaucagugaaga

SEQ ID NO: 481707 - RNA, 19 nt, Homo sapiens
cuagugaugaugaacauga

SEQ ID NO: 481708 - RNA, 19 nt, Homo sapiens
cgaaauuugcuagugauga

SEQ ID NO: 481709 - RNA, 19 nt, Homo sapiens
gaccaacaagaaucccuaa

SEQ ID NO: 481710 - RNA, 19 nt, Homo sapiens
aagaagcacugaagaaaau

SEQ ID NO: 481711 - RNA, 19 nt, Homo sapiens
acaaguuucuaaaggaaca

SEQ ID NO: 481712 - RNA, 19 nt, Homo sapiens
guuagaagaagaugcugaa

SEQ ID NO: 481713 - RNA, 19 nt, Homo sapiens
acagaccugcuaauacuuu

SEQ ID NO: 481714 - RNA, 19 nt, Homo sapiens
gcaaauccaaggcagaacu

SEQ ID NO: 481715 - RNA, 19 nt, Homo sapiens
uagaugaucagaccuguag

SEQ ID NO: 481716 - RNA, 19 nt, Homo sapiens
gccugggucugguaaagga

SEQ ID NO: 481717 - RNA, 19 nt, Homo sapiens
aaaggaaaggguaauaaag

SEQ ID NO: 481718 - RNA, 19 nt, Homo sapiens
gcaaaagaggggauaauuc

SEQ ID NO: 481719 - RNA, 19 nt, Homo sapiens
gaaaauagaagccauguuu

SEQ ID NO: 481720 - RNA, 19 nt, Homo sapiens
cgaaagagaaggaguagaa

SEQ ID NO: 481721 - RNA, 19 nt, Homo sapiens
ucagagacguggcauauca

SEQ ID NO: 481722 - RNA, 19 nt, Homo sapiens
ugagacagguggaaggaaa

SEQ ID NO: 481723 - RNA, 19 nt, Homo sapiens
gagaaggaguagaaaggau

SEQ ID NO: 481724 - RNA, 19 nt, Homo sapiens
gacaacauggcacagaaua

SEQ ID NO: 481725 - RNA, 19 nt, Homo sapiens
acagguacuucgucaguuu

SEQ ID NO: 481726 - RNA, 19 nt, Homo sapiens
gguacagucucauuuccaa

SEQ ID NO: 481727 - RNA, 19 nt, Homo sapiens
gaaagagaaggaguagaaa

SEQ ID NO: 481728 - RNA, 19 nt, Homo sapiens
guacuucgucaguuuguaa

SEQ ID NO: 481729 - RNA, 19 nt, Homo sapiens
cggguuagaucgucaggaa

SEQ ID NO: 481730 - RNA, 19 nt, Homo sapiens
aggaaaagccuaaagauua

SEQ ID NO: 481731 - RNA, 19 nt, Homo sapiens
agacuauggugaauacaug

SEQ ID NO: 481732 - RNA, 19 nt, Homo sapiens
gaaggaguagaaaggauga

SEQ ID NO: 481733 - RNA, 19 nt, Homo sapiens
caacauggcacagaauauc

SEQ ID NO: 481734 - RNA, 19 nt, Homo sapiens
cgacaagcaacaacaauca

SEQ ID NO: 481735 - RNA, 19 nt, Homo sapiens
gaagccauguuucgaagac

SEQ ID NO: 481736 - RNA, 19 nt, Homo sapiens
ggucucgaauuuauuugga

SEQ ID NO: 481737 - RNA, 19 nt, Homo sapiens
acaagcaacaacaaucaua

SEQ ID NO: 481738 - RNA, 19 nt, Homo sapiens
ugagugaccagacgaaaga

SEQ ID NO: 481739 - RNA, 19 nt, Homo sapiens
uauggugaauacauggaua

SEQ ID NO: 481740 - RNA, 19 nt, Homo sapiens
agacaugaguccgaaacaa

SEQ ID NO: 481741 - RNA, 19 nt, Homo sapiens
agacgaaagagaaggagua

SEQ ID NO: 481742 - RNA, 19 nt, Homo sapiens
gagacguggcauaucaaua

SEQ ID NO: 481743 - RNA, 19 nt, Homo sapiens
ggaguagaaaggaugauuc

SEQ ID NO: 481744 - RNA, 19 nt, Homo sapiens
ucuagcaacuaaugagaug

SEQ ID NO: 481745 - RNA, 19 nt, Homo sapiens
ccaguuugguucuugaaag

SEQ ID NO: 481746 - RNA, 19 nt, Homo sapiens
aagacaacauggcacagaa

SEQ ID NO: 481747 - RNA, 19 nt, Homo sapiens
ccugaaucgugugcacuua

SEQ ID NO: 481748 - RNA, 19 nt, Homo sapiens
aaaggggucucgaauuuau

SEQ ID NO: 481749 - RNA, 19 nt, Homo sapiens
guuucgaagaccuguauua

SEQ ID NO: 481750 - RNA, 19 nt, Homo sapiens
ccucagagacguggcauau

SEQ ID NO: 481751 - RNA, 19 nt, Homo sapiens
caagcaacaacaaucauag

SEQ ID NO: 481752 - RNA, 19 nt, Homo sapiens
ggauagugaaguuuaccaa

SEQ ID NO: 481753 - RNA, 19 nt, Homo sapiens
gguacuucgucaguuugua

SEQ ID NO: 481754 - RNA, 19 nt, Homo sapiens
uggcacagaauaucaguau

SEQ ID NO: 481755 - RNA, 19 nt, Homo sapiens
gcgacaagcaacaacaauc

SEQ ID NO: 481756 - RNA, 19 nt, Homo sapiens
gacaugaguccgaaacaac

SEQ ID NO: 481757 - RNA, 19 nt, Homo sapiens
aaagacaacauggcacaga

SEQ ID NO: 481758 - RNA, 19 nt, Homo sapiens
cuuuggccaucauuuggua

SEQ ID NO: 481759 - RNA, 19 nt, Homo sapiens
gugaccagacgaaagagaa

SEQ ID NO: 481760 - RNA, 19 nt, Homo sapiens
auagaagccauguuucgaa

SEQ ID NO: 481761 - RNA, 19 nt, Homo sapiens
ugaaucgugugcacuuacu

SEQ ID NO: 481762 - RNA, 19 nt, Homo sapiens
ccaagucauguauaaucuu

SEQ ID NO: 481763 - RNA, 19 nt, Homo sapiens
gggcugcucggguuagauc

SEQ ID NO: 481764 - RNA, 19 nt, Homo sapiens
caugaguccgaaacaacua

SEQ ID NO: 481765 - RNA, 19 nt, Homo sapiens
uaaucuuuauggcuuccaa

SEQ ID NO: 481766 - RNA, 19 nt, Homo sapiens
uccaagucauguauaaucu

SEQ ID NO: 481767 - RNA, 19 nt, Homo sapiens
aaggaugauucuucuuugg

SEQ ID NO: 481768 - RNA, 19 nt, Homo sapiens
aaagagaaggaguagaaag

SEQ ID NO: 481769 - RNA, 19 nt, Homo sapiens
uuacagguacuucgucagu

SEQ ID NO: 481770 - RNA, 19 nt, Homo sapiens
gcaaagagcucaaaugaag

SEQ ID NO: 481771 - RNA, 19 nt, Homo sapiens
gaagcuaaaugcagugaua

SEQ ID NO: 481772 - RNA, 19 nt, Homo sapiens
ggaaaugugccuuauguua

SEQ ID NO: 481773 - RNA, 19 nt, Homo sapiens
ggaaguauguccucaguga

SEQ ID NO: 481774 - RNA, 19 nt, Homo sapiens
ggaagauccugaagaaauu

SEQ ID NO: 481775 - RNA, 19 nt, Homo sapiens
gcagacaccuccagauuug

SEQ ID NO: 481776 - RNA, 19 nt, Homo sapiens
gaagaagucucugguaguu

SEQ ID NO: 481777 - RNA, 19 nt, Homo sapiens
ccaaagggauagauauuaa

SEQ ID NO: 481778 - RNA, 19 nt, Homo sapiens
cacaaaggcugauuucuaa

SEQ ID NO: 481779 - RNA, 19 nt, Homo sapiens
gaaaugugccuuauguuaa

SEQ ID NO: 481780 - RNA, 19 nt, Homo sapiens
gauggucagucuuuaguua

SEQ ID NO: 481781 - RNA, 19 nt, Homo sapiens
cgaagaguauuacaugaua

SEQ ID NO: 481782 - RNA, 19 nt, Homo sapiens
ugaauaagcugguguuugu

SEQ ID NO: 481783 - RNA, 19 nt, Homo sapiens
gauaugagcucugaaaaua

SEQ ID NO: 481784 - RNA, 19 nt, Homo sapiens
gagagaagauuacaguuuc

SEQ ID NO: 481785 - RNA, 19 nt, Homo sapiens
gaaagugaauuuacucagu

SEQ ID NO: 481786 - RNA, 19 nt, Homo sapiens
ugaggaaucugguauugua

SEQ ID NO: 481787 - RNA, 19 nt, Homo sapiens
gaaacucacugcagaaucu

SEQ ID NO: 481788 - RNA, 19 nt, Homo sapiens
agacguacauagaaacuua

SEQ ID NO: 481789 - RNA, 19 nt, Homo sapiens
ugaaagugaugcucaaauu

SEQ ID NO: 481790 - RNA, 19 nt, Homo sapiens
ugaagaaaguggcaauaaa

SEQ ID NO: 481791 - RNA, 19 nt, Homo sapiens
ggaaaguucugaggaaguu

SEQ ID NO: 481792 - RNA, 19 nt, Homo sapiens
gaggagagguuugaaguug

SEQ ID NO: 481793 - RNA, 19 nt, Homo sapiens
uguccagacuucuuuauua

SEQ ID NO: 481794 - RNA, 19 nt, Homo sapiens
gaaaucaucuguucuaccu

SEQ ID NO: 481795 - RNA, 19 nt, Homo sapiens
gaaaugcaguugcgaagag

SEQ ID NO: 481796 - RNA, 19 nt, Homo sapiens
ccacugcuguuaauuaaug

SEQ ID NO: 481797 - RNA, 19 nt, Homo sapiens
gcagagaauuggaaguaug

SEQ ID NO: 481798 - RNA, 19 nt, Homo sapiens
cagaauuguuggaacuuua

SEQ ID NO: 481799 - RNA, 19 nt, Homo sapiens
gaacaaagcaguaguacac

SEQ ID NO: 481800 - RNA, 19 nt, Homo sapiens
caucaucugugaagaaaga

SEQ ID NO: 481801 - RNA, 19 nt, Homo sapiens
gcagugauaugagcucuga

SEQ ID NO: 481802 - RNA, 19 nt, Homo sapiens
guaaagaaacucaaaguca

SEQ ID NO: 481803 - RNA, 19 nt, Homo sapiens
gaagauacuugcuguugag

SEQ ID NO: 481804 - RNA, 19 nt, Homo sapiens
ugaaauuacugaaguggaa

SEQ ID NO: 481805 - RNA, 19 nt, Homo sapiens
gcacaagaccagccuuauu

SEQ ID NO: 481806 - RNA, 19 nt, Homo sapiens
ccuaugacuugaaugaaua

SEQ ID NO: 481807 - RNA, 19 nt, Homo sapiens
agucauaccugaagucuga

SEQ ID NO: 481808 - RNA, 19 nt, Homo sapiens
gaucaucuguuacguacug

SEQ ID NO: 481809 - RNA, 19 nt, Homo sapiens
gacaauaccauccauaaga

SEQ ID NO: 481810 - RNA, 19 nt, Homo sapiens
ggagaaugcugauagugau

SEQ ID NO: 481811 - RNA, 19 nt, Homo sapiens
gcaguaggauagaauuuua

SEQ ID NO: 481812 - RNA, 19 nt, Homo sapiens
gagcugggcuacuguauac

SEQ ID NO: 481813 - RNA, 19 nt, Homo sapiens
gagaaaggagaaaguagua

SEQ ID NO: 481814 - RNA, 19 nt, Homo sapiens
aaccagauauugcuucuaa

SEQ ID NO: 481815 - RNA, 19 nt, Homo sapiens
ggaaguugaugcagcugaa

SEQ ID NO: 481816 - RNA, 19 nt, Homo sapiens
gccaacagcuccuucuaga

SEQ ID NO: 481817 - RNA, 19 nt, Homo sapiens
gaaagugaugcucaaauug

SEQ ID NO: 481818 - RNA, 19 nt, Homo sapiens
uaaaguaaccaccaaaugu

SEQ ID NO: 481819 - RNA, 19 nt, Homo sapiens
ggaaucugguauuguagaa

SEQ ID NO: 481820 - RNA, 19 nt, Homo sapiens
gauuacaguuucaucagaa

SEQ ID NO: 481821 - RNA, 19 nt, Homo sapiens
acacaaaggcugauuucua

SEQ ID NO: 481822 - RNA, 19 nt, Homo sapiens
aaagcuggcuauccucuaa

SEQ ID NO: 481823 - RNA, 19 nt, Homo sapiens
ugaaaucauuggcuucuau

SEQ ID NO: 481824 - RNA, 19 nt, Homo sapiens
gcaacaccauugagaauac

SEQ ID NO: 481825 - RNA, 19 nt, Homo sapiens
gcagugagcugaaaagugu

SEQ ID NO: 481826 - RNA, 19 nt, Homo sapiens
ggccaaagagagaagauua

SEQ ID NO: 481827 - RNA, 19 nt, Homo sapiens
gaacuggaguaccuucuac

SEQ ID NO: 481828 - RNA, 19 nt, Homo sapiens
ugcagaaucuuucacagua

SEQ ID NO: 481829 - RNA, 19 nt, Homo sapiens
cacaagaccagccuuauuu

SEQ ID NO: 481830 - RNA, 19 nt, Homo sapiens
acaauaccauccauaagaa

SEQ ID NO: 481831 - RNA, 19 nt, Homo sapiens
agagucaucuucuauguug

SEQ ID NO: 481832 - RNA, 19 nt, Homo sapiens
gaggaaacgugcccaacga

SEQ ID NO: 481833 - RNA, 19 nt, Homo sapiens
caucuguucuaccucuuua

SEQ ID NO: 481834 - RNA, 19 nt, Homo sapiens
gcaguugcgaagaguauua

SEQ ID NO: 481835 - RNA, 19 nt, Homo sapiens
gggaucauaucauugaaau

SEQ ID NO: 481836 - RNA, 19 nt, Homo sapiens
agacccaccuccaccuuua

SEQ ID NO: 481837 - RNA, 19 nt, Homo sapiens
gaagauuacaguuucauca

SEQ ID NO: 481838 - RNA, 19 nt, Homo sapiens
caucagaaagggagaagua

SEQ ID NO: 481839 - RNA, 19 nt, Homo sapiens
gaugaacaaagcaguagua

SEQ ID NO: 481840 - RNA, 19 nt, Homo sapiens
gaaacgugcccaacgagaa

SEQ ID NO: 481841 - RNA, 19 nt, Homo sapiens
caacugggccucccucuuc

SEQ ID NO: 481842 - RNA, 19 nt, Homo sapiens
uauguuggcuacaguuaaa

SEQ ID NO: 481843 - RNA, 19 nt, Homo sapiens
caaauugaagugcuuacua

SEQ ID NO: 481844 - RNA, 19 nt, Homo sapiens
ccaccuuccuucaccuaua

SEQ ID NO: 481845 - RNA, 19 nt, Homo sapiens
gcugaaaaguguccauaua

SEQ ID NO: 481846 - RNA, 19 nt, Homo sapiens
ggacugccguacaccuuug

SEQ ID NO: 481847 - RNA, 19 nt, Homo sapiens
gcacuuugcuauuucuuuu

SEQ ID NO: 481848 - RNA, 19 nt, Homo sapiens
uaacagaagaacuggagua

SEQ ID NO: 481849 - RNA, 19 nt, Homo sapiens
ggagagguuugaaguugau

SEQ ID NO: 481850 - RNA, 19 nt, Homo sapiens
caacauauccagccacagu

SEQ ID NO: 481851 - RNA, 19 nt, Homo sapiens
gcugauagugauagaauuu

SEQ ID NO: 481852 - RNA, 19 nt, Homo sapiens
gaagaaaguggcaauaaaa

SEQ ID NO: 481853 - RNA, 19 nt, Homo sapiens
gccaaagggauagauauua

SEQ ID NO: 481854 - RNA, 19 nt, Homo sapiens
uagauuuguucuccucaua

SEQ ID NO: 481855 - RNA, 19 nt, Homo sapiens
ccaccaaugucucagucua

SEQ ID NO: 481856 - RNA, 19 nt, Homo sapiens
gcaagucagcauuccgaua

SEQ ID NO: 481857 - RNA, 19 nt, Homo sapiens
ccaaggaacugaaaaugaa

SEQ ID NO: 481858 - RNA, 19 nt, Homo sapiens
gaaguaacacugcaaaucg

SEQ ID NO: 481859 - RNA, 19 nt, Homo sapiens
cauagaaacuuaggcacuu

SEQ ID NO: 481860 - RNA, 19 nt, Homo sapiens
gggaauguguggcaguaga

SEQ ID NO: 481861 - RNA, 19 nt, Homo sapiens
gaguagugcugauaguugu

SEQ ID NO: 481862 - RNA, 19 nt, Homo sapiens
ggugaggaaucugguauug

SEQ ID NO: 481863 - RNA, 19 nt, Homo sapiens
cagaaagggagaaguauga

SEQ ID NO: 481864 - RNA, 19 nt, Homo sapiens
aaacuuaggcacuuugcua

SEQ ID NO: 481865 - RNA, 19 nt, Homo sapiens
guguauuucuucaaccaua

SEQ ID NO: 481866 - RNA, 19 nt, Homo sapiens
gaauccuccuucagccaua

SEQ ID NO: 481867 - RNA, 19 nt, Homo sapiens
gaaaucauuggcuucuauu

SEQ ID NO: 481868 - RNA, 19 nt, Homo sapiens
ggaguagugcugauaguug

SEQ ID NO: 481869 - RNA, 19 nt, Homo sapiens
uggaagagguucaaaguac

SEQ ID NO: 481870 - RNA, 19 nt, Homo sapiens
gaaacuaacuccguaauga

SEQ ID NO: 481871 - RNA, 19 nt, Homo sapiens
gaaagugaguuggauauuu

SEQ ID NO: 481872 - RNA, 19 nt, Homo sapiens
caauaaagcuucaccaaga

SEQ ID NO: 481873 - RNA, 19 nt, Homo sapiens
acaauucggucuuuacuua

SEQ ID NO: 481874 - RNA, 19 nt, Homo sapiens
caacuugguuucagaauau

SEQ ID NO: 481875 - RNA, 19 nt, Homo sapiens
uaacuugccuuacauauca

SEQ ID NO: 481876 - RNA, 19 nt, Homo sapiens
gcagauagaaguuauugua

SEQ ID NO: 481877 - RNA, 19 nt, Homo sapiens
cuaaguaacugcaugguuu

SEQ ID NO: 481878 - RNA, 19 nt, Homo sapiens
ugaaauuucugcugacuuu

SEQ ID NO: 481879 - RNA, 19 nt, Homo sapiens
uggaauagcucaaauuuca

SEQ ID NO: 481880 - RNA, 19 nt, Homo sapiens
gaacggcaauguauuccaa

SEQ ID NO: 481881 - RNA, 19 nt, Homo sapiens
cuaaauaacuugccuuaca

SEQ ID NO: 481882 - RNA, 19 nt, Homo sapiens
uuaaggaucuuguguauca

SEQ ID NO: 481883 - RNA, 19 nt, Homo sapiens
uggcauugcuggauuauaa

SEQ ID NO: 481884 - RNA, 19 nt, Homo sapiens
guagaagauuccauaauug

SEQ ID NO: 481885 - RNA, 19 nt, Homo sapiens
gaaggcaacuccuacuugu

SEQ ID NO: 481886 - RNA, 19 nt, Homo sapiens
ugaaagagaggauggguua

SEQ ID NO: 481887 - RNA, 19 nt, Homo sapiens
caacaaggguacagaagau

SEQ ID NO: 481888 - RNA, 19 nt, Homo sapiens
ugcccuagauuguaaauua

SEQ ID NO: 481889 - RNA, 19 nt, Homo sapiens
gaagaaagugaguuggaua

SEQ ID NO: 481890 - RNA, 19 nt, Homo sapiens
gguagaagauaaagaggaa

SEQ ID NO: 481891 - RNA, 19 nt, Homo sapiens
ccacagauuugguagaaga

SEQ ID NO: 481892 - RNA, 19 nt, Homo sapiens
gaagaugaacccacagauu

SEQ ID NO: 481893 - RNA, 19 nt, Homo sapiens
caaagcagauagaaguuau

SEQ ID NO: 481894 - RNA, 19 nt, Homo sapiens
gaaacuaguacauuuguga

SEQ ID NO: 481895 - RNA, 19 nt, Homo sapiens
gaugcagucuucaaucaaa

SEQ ID NO: 481896 - RNA, 19 nt, Homo sapiens
ggagaaacaaucuuuaugu

SEQ ID NO: 481897 - RNA, 19 nt, Homo sapiens
cagaaucauuguugaacua

SEQ ID NO: 481898 - RNA, 19 nt, Homo sapiens
gaagaaacaguagaagauu

SEQ ID NO: 481899 - RNA, 19 nt, Homo sapiens
caagaagguugcccaggaa

SEQ ID NO: 481900 - RNA, 19 nt, Homo sapiens
uaagagacccauacagaaa

SEQ ID NO: 481901 - RNA, 19 nt, Homo sapiens
ucacagcucuuccucugaa

SEQ ID NO: 481902 - RNA, 19 nt, Homo sapiens
ggaucucucuggcaacaaa

SEQ ID NO: 481903 - RNA, 19 nt, Homo sapiens
uacuuaaccugcccuaaua

SEQ ID NO: 481904 - RNA, 19 nt, Homo sapiens
guacaucaagucagaauga

SEQ ID NO: 481905 - RNA, 19 nt, Homo sapiens
gaguaaauguuccuuugug

SEQ ID NO: 481906 - RNA, 19 nt, Homo sapiens
gcucuagcaucaguaagua

SEQ ID NO: 481907 - RNA, 19 nt, Homo sapiens
acagagauauuucccaguu

SEQ ID NO: 481908 - RNA, 19 nt, Homo sapiens
ccacuaugauuauugaugu

SEQ ID NO: 481909 - RNA, 19 nt, Homo sapiens
gaacaacuugguuucagaa

SEQ ID NO: 481910 - RNA, 19 nt, Homo sapiens
gggcuguuaugaucaguaa

SEQ ID NO: 481911 - RNA, 19 nt, Homo sapiens
uaauugggcuguuaugauc

SEQ ID NO: 481912 - RNA, 19 nt, Homo sapiens
ggucuugggcuucugguua

SEQ ID NO: 481913 - RNA, 19 nt, Homo sapiens
gagugcagauacaacuaua

SEQ ID NO: 481914 - RNA, 19 nt, Homo sapiens
gcaaauaacauugugaagu

SEQ ID NO: 481915 - RNA, 19 nt, Homo sapiens
acaacuugguuucagaaua

SEQ ID NO: 481916 - RNA, 19 nt, Homo sapiens
gcccuagauuguaaauuaa

SEQ ID NO: 481917 - RNA, 19 nt, Homo sapiens
ugaacuaccugaaacaagu

SEQ ID NO: 481918 - RNA, 19 nt, Homo sapiens
ggucuuaccagaaucauug

SEQ ID NO: 481919 - RNA, 19 nt, Homo sapiens
guaagagacccauacagaa

SEQ ID NO: 481920 - RNA, 19 nt, Homo sapiens
gcagauacaacuauacugu

SEQ ID NO: 481921 - RNA, 19 nt, Homo sapiens
cagauuugguagaagauaa

SEQ ID NO: 481922 - RNA, 19 nt, Homo sapiens
uagcauagauugagaacag

SEQ ID NO: 481923 - RNA, 19 nt, Homo sapiens
uuuaguggcucuuuaauuc

SEQ ID NO: 481924 - RNA, 19 nt, Homo sapiens
cagagauauuucccaguua

SEQ ID NO: 481925 - RNA, 19 nt, Homo sapiens
agugggaucugaugaguaa

SEQ ID NO: 481926 - RNA, 19 nt, Homo sapiens
ggcaauguauuccaagaug

SEQ ID NO: 481927 - RNA, 19 nt, Homo sapiens
gaugaagaguaacgccauu

SEQ ID NO: 481928 - RNA, 19 nt, Homo sapiens
aagaugaacccacagauuu

SEQ ID NO: 481929 - RNA, 19 nt, Homo sapiens
caaguuaucaggacagaga

SEQ ID NO: 481930 - RNA, 19 nt, Homo sapiens
ccaaagcagauagaaguua

SEQ ID NO: 481931 - RNA, 19 nt, Homo sapiens
gugcaacaauucggucuuu

SEQ ID NO: 481932 - RNA, 19 nt, Homo sapiens
caaauuagugccucggaaa

SEQ ID NO: 481933 - RNA, 19 nt, Homo sapiens
uaguuaaccugaaagauuc

SEQ ID NO: 481934 - RNA, 19 nt, Homo sapiens
ccuaaucaaugaagaaagu

SEQ ID NO: 481935 - RNA, 19 nt, Homo sapiens
gaucugaugaguaaauguu

SEQ ID NO: 481936 - RNA, 19 nt, Homo sapiens
gauggagaaacaaucuuua

SEQ ID NO: 481937 - RNA, 19 nt, Homo sapiens
ucaucaaucugaacuacaa

SEQ ID NO: 481938 - RNA, 19 nt, Homo sapiens
guucaagcacacuuaauaa

SEQ ID NO: 481939 - RNA, 19 nt, Homo sapiens
cauauucuccuacauguau

SEQ ID NO: 481940 - RNA, 19 nt, Homo sapiens
gugaauaucuaaguuugug

SEQ ID NO: 481941 - RNA, 19 nt, Homo sapiens
gcgauaauauugcugaaaa

SEQ ID NO: 481942 - RNA, 19 nt, Homo sapiens
gcuguuaugaucaguaauu

SEQ ID NO: 481943 - RNA, 19 nt, Homo sapiens
gauggagggugaaguaaaa

SEQ ID NO: 481944 - RNA, 19 nt, Homo sapiens
guauguaugugagcaguug

SEQ ID NO: 481945 - RNA, 19 nt, Homo sapiens
aauaaagcuucaccaagaa

SEQ ID NO: 481946 - RNA, 19 nt, Homo sapiens
gaagaugugucuggugaac

SEQ ID NO: 481947 - RNA, 19 nt, Homo sapiens
gcaaaaccacacugaguua

SEQ ID NO: 481948 - RNA, 19 nt, Homo sapiens
aaacuacuagggcaugaua

SEQ ID NO: 481949 - RNA, 19 nt, Homo sapiens
gcuugagacuggaaccaaa

SEQ ID NO: 481950 - RNA, 19 nt, Homo sapiens
aaagagaaguugccuuggu

SEQ ID NO: 481951 - RNA, 19 nt, Homo sapiens
ggaugaagaaacaguagaa

SEQ ID NO: 481952 - RNA, 19 nt, Homo sapiens
gaaauggguacaucaaguc

SEQ ID NO: 481953 - RNA, 19 nt, Homo sapiens
cguaagagacccauacaga

SEQ ID NO: 481954 - RNA, 19 nt, Homo sapiens
gagaagauuuuccagcaaa

SEQ ID NO: 481955 - RNA, 19 nt, Homo sapiens
uaauugaggaugaagauga

SEQ ID NO: 481956 - RNA, 19 nt, Homo sapiens
ugaagaaacaguagaagau

SEQ ID NO: 481957 - RNA, 19 nt, Homo sapiens
caguaaguauuuagcagaa

SEQ ID NO: 481958 - RNA, 19 nt, Homo sapiens
agacccggaugaagaguaa

SEQ ID NO: 481959 - RNA, 19 nt, Homo sapiens
agaaauggguacaucaagu

SEQ ID NO: 481960 - RNA, 19 nt, Homo sapiens
gauuugaacggcaauguau

SEQ ID NO: 481961 - RNA, 19 nt, Homo sapiens
gcagaaacuaacuccguaa

SEQ ID NO: 481962 - RNA, 19 nt, Homo sapiens
ccuccucauuccuaaauaa

SEQ ID NO: 481963 - RNA, 19 nt, Homo sapiens
ggauggagggugaaguaaa

SEQ ID NO: 481964 - RNA, 19 nt, Homo sapiens
ccaguggcuucaaggaauu

SEQ ID NO: 481965 - RNA, 19 nt, Homo sapiens
gaaacgggcacagaagaga

SEQ ID NO: 481966 - RNA, 19 nt, Homo sapiens
gaaucuagaaagcguaaga

SEQ ID NO: 481967 - RNA, 19 nt, Homo sapiens
aaaggcagaagcagaagua

SEQ ID NO: 481968 - RNA, 19 nt, Homo sapiens
gcaguggcacaagaucuua

SEQ ID NO: 481969 - RNA, 19 nt, Homo sapiens
caagucagaaugauguuga

SEQ ID NO: 481970 - RNA, 19 nt, Homo sapiens
gguggaagaugaaaugaaa

SEQ ID NO: 481971 - RNA, 19 nt, Homo sapiens
ugcaaucucuucucucuua

SEQ ID NO: 481972 - RNA, 19 nt, Homo sapiens
gaagaugaaaugaaagcua

SEQ ID NO: 481973 - RNA, 19 nt, Homo sapiens
aaucacugcugaacagaua

SEQ ID NO: 481974 - RNA, 19 nt, Homo sapiens
ucucaaggcugguuauuuc

SEQ ID NO: 481975 - RNA, 19 nt, Homo sapiens
agaagaggguggaagauga

SEQ ID NO: 481976 - RNA, 19 nt, Homo sapiens
caaaggguaucuuaaaugc

SEQ ID NO: 481977 - RNA, 19 nt, Homo sapiens
ccagaagacuuuggcauug

SEQ ID NO: 481978 - RNA, 19 nt, Homo sapiens
ccaaaucacugcugaacag

SEQ ID NO: 481979 - RNA, 19 nt, Homo sapiens
aaacgaagaagaacugauu

SEQ ID NO: 481980 - RNA, 19 nt, Homo sapiens
gaggauacccagugucuau

SEQ ID NO: 481981 - RNA, 19 nt, Homo sapiens
uggcucaagugcugcauua

SEQ ID NO: 481982 - RNA, 19 nt, Homo sapiens
uaaaugcaaucucuucucu

SEQ ID NO: 481983 - RNA, 19 nt, Homo sapiens
gaaauaugacacucccaaa

SEQ ID NO: 481984 - RNA, 19 nt, Homo sapiens
gaccugaccuugcaguaca

SEQ ID NO: 481985 - RNA, 19 nt, Homo sapiens
gaagaggguggaagaugaa

SEQ ID NO: 481986 - RNA, 19 nt, Homo sapiens
cugaggugcuguugguuua

SEQ ID NO: 481987 - RNA, 19 nt, Homo sapiens
ccacugaggugcuguuggu

SEQ ID NO: 481988 - RNA, 19 nt, Homo sapiens
caagaaauccaggugcuuu

SEQ ID NO: 481989 - RNA, 19 nt, Homo sapiens
gacgagaccugaccuugca

SEQ ID NO: 481990 - RNA, 19 nt, Homo sapiens
cagugucuauucuggguua

SEQ ID NO: 481991 - RNA, 19 nt, Homo sapiens
aaggguaucuuaaaugcaa

SEQ ID NO: 481992 - RNA, 19 nt, Homo sapiens
ccaaaggguaucuuaaaug

SEQ ID NO: 481993 - RNA, 19 nt, Homo sapiens
gaggugcuguugguuuauu

SEQ ID NO: 481994 - RNA, 19 nt, Homo sapiens
ccagcaagaggaaauauga

SEQ ID NO: 481995 - RNA, 19 nt, Homo sapiens
gcccuccucucccaagaaa

SEQ ID NO: 481996 - RNA, 19 nt, Homo sapiens
cuaagggguuuucuaauaa

SEQ ID NO: 481997 - RNA, 19 nt, Homo sapiens
acuaagggguuuucuaaua

SEQ ID NO: 481998 - RNA, 19 nt, Homo sapiens
gugaagccauaaacaggaa

SEQ ID NO: 481999 - RNA, 19 nt, Homo sapiens
gcucaagugcugcauuaga

SEQ ID NO: 482000 - RNA, 19 nt, Homo sapiens
gaggguggaagaugaaaug

SEQ ID NO: 482001 - RNA, 19 nt, Homo sapiens
cagaagacuuuggcauugu

SEQ ID NO: 482002 - RNA, 19 nt, Homo sapiens
guggaacuaucugaugauu

SEQ ID NO: 482003 - RNA, 19 nt, Homo sapiens
gguguuggcucuauuugcu

SEQ ID NO: 482004 - RNA, 19 nt, Homo sapiens
ugaaggaccagcccuagga

SEQ ID NO: 482005 - RNA, 19 nt, Homo sapiens
ugucuggaaugcucaaugu

SEQ ID NO: 482006 - RNA, 19 nt, Homo sapiens
ccucggcaacaauuacuua

SEQ ID NO: 482007 - RNA, 19 nt, Homo sapiens
gcaguacaacaucuacaau

SEQ ID NO: 482008 - RNA, 19 nt, Homo sapiens
ugaggcugcugucauuugu

SEQ ID NO: 482009 - RNA, 19 nt, Homo sapiens
cauuagacguggaacuauc

SEQ ID NO: 482010 - RNA, 19 nt, Homo sapiens
cuacaauguuggcucaagu

SEQ ID NO: 482011 - RNA, 19 nt, Homo sapiens
gcaaucucuucucucuuag

SEQ ID NO: 482012 - RNA, 19 nt, Homo sapiens
ucuauuugcugucacucaa

SEQ ID NO: 482013 - RNA, 19 nt, Homo sapiens
ugaaagcuaugggacucuu

SEQ ID NO: 482014 - RNA, 19 nt, Homo sapiens
ggaaugcucaaugucaaau

SEQ ID NO: 482015 - RNA, 19 nt, Homo sapiens
guuagagaagugcuuacua

SEQ ID NO: 482016 - RNA, 19 nt, Homo sapiens
gauacccagugucuauucu

SEQ ID NO: 482017 - RNA, 19 nt, Homo sapiens
guuccaucgugaagccaua

SEQ ID NO: 482018 - RNA, 19 nt, Homo sapiens
gcucucagccauagugaag

SEQ ID NO: 482019 - RNA, 19 nt, Homo sapiens
caacuucaccucggcaaca

SEQ ID NO: 482020 - RNA, 19 nt, Homo sapiens
ggauacccagugucuauuc

SEQ ID NO: 482021 - RNA, 19 nt, Homo sapiens
cauaaacaggaaugccuuu

SEQ ID NO: 482022 - RNA, 19 nt, Homo sapiens
ucucagccauagugaagga

SEQ ID NO: 482023 - RNA, 19 nt, Homo sapiens
aaugcaaucucuucucucu

SEQ ID NO: 482024 - RNA, 19 nt, Homo sapiens
agaagacuuuggcauugug

SEQ ID NO: 482025 - RNA, 19 nt, Homo sapiens
cagaagaggguggaagaug

SEQ ID NO: 482026 - RNA, 19 nt, Homo sapiens
gcugucauuugugguguug

SEQ ID NO: 482027 - RNA, 19 nt, Homo sapiens
caaggcugguuauuucaac

SEQ ID NO: 482028 - RNA, 19 nt, Homo sapiens
acguggaacuaucugauga

SEQ ID NO: 482029 - RNA, 19 nt, Homo sapiens
gcauuagacguggaacuau

SEQ ID NO: 482030 - RNA, 19 nt, Homo sapiens
gaaagcuaugggacucuug

SEQ ID NO: 482031 - RNA, 19 nt, Homo sapiens
gcccugcucucagccauag

SEQ ID NO: 482032 - RNA, 19 nt, Homo sapiens
gcgauucuccccucauuuu

SEQ ID NO: 482033 - RNA, 19 nt, Homo sapiens
gagaccugaccuugcagua

SEQ ID NO: 482034 - RNA, 19 nt, Homo sapiens
gaagccauaaacaggaaug

SEQ ID NO: 482035 - RNA, 19 nt, Homo sapiens
caauagccuugagccuaga

SEQ ID NO: 482036 - RNA, 19 nt, Homo sapiens
uggcucagcgggaguuuga

SEQ ID NO: 482037 - RNA, 19 nt, Homo sapiens
caguacaacaucuacaaug

SEQ ID NO: 482038 - RNA, 19 nt, Homo sapiens
gcaaugucucccacacugu

SEQ ID NO: 482039 - RNA, 19 nt, Homo sapiens
cuggaaugcucaaugucaa

SEQ ID NO: 482040 - RNA, 19 nt, Homo sapiens
gacguggaacuaucugaug

SEQ ID NO: 482041 - RNA, 19 nt, Homo sapiens
uccagaagacuuuggcauu

SEQ ID NO: 482042 - RNA, 19 nt, Homo sapiens
uuacuaagggguuuucuaa

SEQ ID NO: 482043 - RNA, 19 nt, Homo sapiens
ggaggauacccagugucua

SEQ ID NO: 482044 - RNA, 19 nt, Homo sapiens
caagaggaaauaugacacu

SEQ ID NO: 482045 - RNA, 19 nt, Homo sapiens
cggcaacaauuacuuaccu

SEQ ID NO: 482046 - RNA, 19 nt, Homo sapiens
gaaugcucaaugucaaaug

SEQ ID NO: 482047 - RNA, 19 nt, Homo sapiens
gaugaaaugaaagcuaugg

SEQ ID NO: 482048 - RNA, 19 nt, Homo sapiens
ucaugacccuucccuccau

SEQ ID NO: 482049 - RNA, 19 nt, Homo sapiens
gcugguuauuucaacuuca

SEQ ID NO: 482050 - RNA, 19 nt, Homo sapiens
ugucaaaugggaccggauu

SEQ ID NO: 482051 - RNA, 19 nt, Homo sapiens
uaaacaggaaugccuuugg

SEQ ID NO: 482052 - RNA, 19 nt, Homo sapiens
ucaaggcugguuauuucaa

SEQ ID NO: 482053 - RNA, 19 nt, Homo sapiens
gaagacuuuggcauugugu

SEQ ID NO: 482054 - RNA, 19 nt, Homo sapiens
ggguggaagaugaaaugaa

SEQ ID NO: 482055 - RNA, 19 nt, Homo sapiens
caucgugaagccauaaaca

SEQ ID NO: 482056 - RNA, 19 nt, Homo sapiens
ugcauuagacguggaacua

SEQ ID NO: 482057 - RNA, 19 nt, Homo sapiens
guacagauaucauuucuug

SEQ ID NO: 482058 - RNA, 19 nt, Homo sapiens
gggaagcucuuuagcaaua

SEQ ID NO: 482059 - RNA, 19 nt, Homo sapiens
ggagaaagaugaaagaauc

SEQ ID NO: 482060 - RNA, 19 nt, Homo sapiens
uagaugagguggugaaaua

SEQ ID NO: 482061 - RNA, 19 nt, Homo sapiens
ggaggaauguuaaguaaga

SEQ ID NO: 482062 - RNA, 19 nt, Homo sapiens
agaaugaaguugcugauua

SEQ ID NO: 482063 - RNA, 19 nt, Homo sapiens
gaaugaaguugcugauuau

SEQ ID NO: 482064 - RNA, 19 nt, Homo sapiens
gggccgagcuguuauuauu

SEQ ID NO: 482065 - RNA, 19 nt, Homo sapiens
ccaaagaagugacucgaaa

SEQ ID NO: 482066 - RNA, 19 nt, Homo sapiens
aaaccaugcuguagaauuu

SEQ ID NO: 482067 - RNA, 19 nt, Homo sapiens
ccaacuuucuguacuaaua

SEQ ID NO: 482068 - RNA, 19 nt, Homo sapiens
gaaccucuuuccugaauau

SEQ ID NO: 482069 - RNA, 19 nt, Homo sapiens
gccgagcuguuauuauuua

SEQ ID NO: 482070 - RNA, 19 nt, Homo sapiens
guacuaggacguuuauuaa

SEQ ID NO: 482071 - RNA, 19 nt, Homo sapiens
guucacagguucccauuga

SEQ ID NO: 482072 - RNA, 19 nt, Homo sapiens
ugaaguugcugauuaugaa

SEQ ID NO: 482073 - RNA, 19 nt, Homo sapiens
gcauggaauuuguguauca

SEQ ID NO: 482074 - RNA, 19 nt, Homo sapiens
ggaaauauaguccuaaucu

SEQ ID NO: 482075 - RNA, 19 nt, Homo sapiens
ggugauagcaguugucauu

SEQ ID NO: 482076 - RNA, 19 nt, Homo sapiens
caaggaauuuacagugauu

SEQ ID NO: 482077 - RNA, 19 nt, Homo sapiens
ggauugaacagaagcuuaa

SEQ ID NO: 482078 - RNA, 19 nt, Homo sapiens
gaagaagaaugaaguugcu

SEQ ID NO: 482079 - RNA, 19 nt, Homo sapiens
guaacacuuuagagguuua

SEQ ID NO: 482080 - RNA, 19 nt, Homo sapiens
ggguaacacuuuagagguu

SEQ ID NO: 482081 - RNA, 19 nt, Homo sapiens
uuucugaacuucugcaauu

SEQ ID NO: 482082 - RNA, 19 nt, Homo sapiens
gaaggagaaagaugaaaga

SEQ ID NO: 482083 - RNA, 19 nt, Homo sapiens
gaaaaugagugagcaaaau

SEQ ID NO: 482084 - RNA, 19 nt, Homo sapiens
ugaggacuuucauacauuu

SEQ ID NO: 482085 - RNA, 19 nt, Homo sapiens
uagcaguugucauucagua

SEQ ID NO: 482086 - RNA, 19 nt, Homo sapiens
guccauaagugcuucauca

SEQ ID NO: 482087 - RNA, 19 nt, Homo sapiens
gcauauggaucuuauucag

SEQ ID NO: 482088 - RNA, 19 nt, Homo sapiens
guaaaaccaugcuguagaa

SEQ ID NO: 482089 - RNA, 19 nt, Homo sapiens
gguaacacuuuagagguuu

SEQ ID NO: 482090 - RNA, 19 nt, Homo sapiens
acagugaacuacauauugu

SEQ ID NO: 482091 - RNA, 19 nt, Homo sapiens
gcacaaaguagcacagaag

SEQ ID NO: 482092 - RNA, 19 nt, Homo sapiens
ccucuuuccugaauauuga

SEQ ID NO: 482093 - RNA, 19 nt, Homo sapiens
gaauugaaagggaaacuca

SEQ ID NO: 482094 - RNA, 19 nt, Homo sapiens
gaugcgaccuacucaaucu

SEQ ID NO: 482095 - RNA, 19 nt, Homo sapiens
gaagcuuaauguuuacaag

SEQ ID NO: 482096 - RNA, 19 nt, Homo sapiens
gaacuacauauuguccaua

SEQ ID NO: 482097 - RNA, 19 nt, Homo sapiens
gagaugcgaccuacucaau

SEQ ID NO: 482098 - RNA, 19 nt, Homo sapiens
gaguugggccacuaucuuu

SEQ ID NO: 482099 - RNA, 19 nt, Homo sapiens
cuggaggaauguuaaguaa

SEQ ID NO: 482100 - RNA, 19 nt, Homo sapiens
uuaaggauuuacuguguga

SEQ ID NO: 482101 - RNA, 19 nt, Homo sapiens
uaaagcauauacucacagu

SEQ ID NO: 482102 - RNA, 19 nt, Homo sapiens
uaagguacaguuaggguaa

SEQ ID NO: 482103 - RNA, 19 nt, Homo sapiens
ugccaucacuggauaaugu

SEQ ID NO: 482104 - RNA, 19 nt, Homo sapiens
ccaaggaauuuacagugau

SEQ ID NO: 482105 - RNA, 19 nt, Homo sapiens
uaugagaguuguccuacga

SEQ ID NO: 482106 - RNA, 19 nt, Homo sapiens
ugaaauuuguucucaagca

SEQ ID NO: 482107 - RNA, 19 nt, Homo sapiens
ccuaauauaguuucucuug

SEQ ID NO: 482108 - RNA, 19 nt, Homo sapiens
uaucauuucuuguguaugc

SEQ ID NO: 482109 - RNA, 19 nt, Homo sapiens
acauuugacucuuuaguuc

SEQ ID NO: 482110 - RNA, 19 nt, Homo sapiens
gaacucuccaaggaauuua

SEQ ID NO: 482111 - RNA, 19 nt, Homo sapiens
gggauugaacagaagcuua

SEQ ID NO: 482112 - RNA, 19 nt, Homo sapiens
uaacuuguuuccuugaucu

SEQ ID NO: 482113 - RNA, 19 nt, Homo sapiens
aguacuaggacguuuauua

SEQ ID NO: 482114 - RNA, 19 nt, Homo sapiens
ggaaggagaaagaugaaag

SEQ ID NO: 482115 - RNA, 19 nt, Homo sapiens
uguaugccaugacuugaaa

SEQ ID NO: 482116 - RNA, 19 nt, Homo sapiens
ccacagugaacuacauauu

SEQ ID NO: 482117 - RNA, 19 nt, Homo sapiens
aaacugaagauuuguagga

SEQ ID NO: 482118 - RNA, 19 nt, Homo sapiens
gaaaccccgucucuacuaa

SEQ ID NO: 482119 - RNA, 19 nt, Homo sapiens
ugauagcaguugucauuca

SEQ ID NO: 482120 - RNA, 19 nt, Homo sapiens
uccaaggaauuuacaguga

SEQ ID NO: 482121 - RNA, 19 nt, Homo sapiens
uaggugccaucacuggaua

SEQ ID NO: 482122 - RNA, 19 nt, Homo sapiens
ccuacgagguuaaagaaca

SEQ ID NO: 482123 - RNA, 19 nt, Homo sapiens
gcuccgccauggcuccuaa

SEQ ID NO: 482124 - RNA, 19 nt, Homo sapiens
guacuuuacugugaggaau

SEQ ID NO: 482125 - RNA, 19 nt, Homo sapiens
ggugaaaacuugccacuag

SEQ ID NO: 482126 - RNA, 19 nt, Homo sapiens
uaaaauugcuggugaaaac

SEQ ID NO: 482127 - RNA, 19 nt, Homo sapiens
gcaguugucauucaguaau

SEQ ID NO: 482128 - RNA, 19 nt, Homo sapiens
ggaagcucuuuagcaauau

SEQ ID NO: 482129 - RNA, 19 nt, Homo sapiens
ggaauguuaaguaagagaa

SEQ ID NO: 482130 - RNA, 19 nt, Homo sapiens
aagaagggcagccaaggua

SEQ ID NO: 482131 - RNA, 19 nt, Homo sapiens
gcuccaaacagcagucuga

SEQ ID NO: 482132 - RNA, 19 nt, Homo sapiens
cguuaaggauuuacugugu

SEQ ID NO: 482133 - RNA, 19 nt, Homo sapiens
guccuaaucuuuacuaucc

SEQ ID NO: 482134 - RNA, 19 nt, Homo sapiens
gauagcaguugucauucag

SEQ ID NO: 482135 - RNA, 19 nt, Homo sapiens
gaagcucuuuagcaauauc

SEQ ID NO: 482136 - RNA, 19 nt, Homo sapiens
cagauaucauuucuugugu

SEQ ID NO: 482137 - RNA, 19 nt, Homo sapiens
ccugaauauugacauguaa

SEQ ID NO: 482138 - RNA, 19 nt, Homo sapiens
gcauaugagaguuguccua

SEQ ID NO: 482139 - RNA, 19 nt, Homo sapiens
ccuguaaucucagcuacuu

SEQ ID NO: 482140 - RNA, 19 nt, Homo sapiens
uugggaagcucuuuagcaa

SEQ ID NO: 482141 - RNA, 19 nt, Homo sapiens
cagaguacuaggacguuua

SEQ ID NO: 482142 - RNA, 19 nt, Homo sapiens
cauuguugcuuccuucuuc

SEQ ID NO: 482143 - RNA, 19 nt, Homo sapiens
acccagcacccaugaaaua

SEQ ID NO: 482144 - RNA, 19 nt, Homo sapiens
ccucuacucuugucuaaaa

SEQ ID NO: 482145 - RNA, 19 nt, Homo sapiens
acucacaguucaguaguuu

SEQ ID NO: 482146 - RNA, 19 nt, Homo sapiens
aagcauauacucacaguuc

SEQ ID NO: 482147 - RNA, 19 nt, Homo sapiens
acagauaucauuucuugug

SEQ ID NO: 482148 - RNA, 19 nt, Homo sapiens
ucacagguucccauugauu

SEQ ID NO: 482149 - RNA, 19 nt, Homo sapiens
gcacaauauuacaacuucu

SEQ ID NO: 482150 - RNA, 19 nt, Homo sapiens
gcauuugcuuauuugacaa

SEQ ID NO: 482151 - RNA, 19 nt, Homo sapiens
caguugucauucaguaauu

SEQ ID NO: 482152 - RNA, 19 nt, Homo sapiens
gcuuaauguuuacaagugu

SEQ ID NO: 482153 - RNA, 19 nt, Homo sapiens
uuuauagucuagagccuuu

SEQ ID NO: 482154 - RNA, 19 nt, Homo sapiens
gaagaaugaaguugcugau

SEQ ID NO: 482155 - RNA, 19 nt, Homo sapiens
ugacccagaucaucauuuu

SEQ ID NO: 482156 - RNA, 19 nt, Homo sapiens
aguaagcacauauuuggua

SEQ ID NO: 482157 - RNA, 19 nt, Homo sapiens
gaacauggcucucuaugcu

SEQ ID NO: 482158 - RNA, 19 nt, Homo sapiens
ggaaggcucagaggaauaa

SEQ ID NO: 482159 - RNA, 19 nt, Homo sapiens
ggaauaacgaggacauuuc

SEQ ID NO: 482160 - RNA, 19 nt, Homo sapiens
gcaagaacaggguccagaa

SEQ ID NO: 482161 - RNA, 19 nt, Homo sapiens
gcccuugcuuccuucaaua

SEQ ID NO: 482162 - RNA, 19 nt, Homo sapiens
gaacaggguccagaacaug

SEQ ID NO: 482163 - RNA, 19 nt, Homo sapiens
caucaucccgccucuguuu

SEQ ID NO: 482164 - RNA, 19 nt, Homo sapiens
caggaaggcucagaggaau

SEQ ID NO: 482165 - RNA, 19 nt, Homo sapiens
ucaggaaggcucagaggaa

SEQ ID NO: 482166 - RNA, 19 nt, Homo sapiens
gcccugcccuugcuuccuu

SEQ ID NO: 482167 - RNA, 19 nt, Homo sapiens
gcugucauuuccacugaga

SEQ ID NO: 482168 - RNA, 19 nt, Homo sapiens
cgaggacauuuccaucauc

SEQ ID NO: 482169 - RNA, 19 nt, Homo sapiens
agaacaggguccagaacau

SEQ ID NO: 482170 - RNA, 19 nt, Homo sapiens
caugggagcucguuuucuu

SEQ ID NO: 482171 - RNA, 19 nt, Homo sapiens
gaauaacgaggacauuucc

SEQ ID NO: 482172 - RNA, 19 nt, Homo sapiens
ugacgucgguggaaaacaa

SEQ ID NO: 482173 - RNA, 19 nt, Homo sapiens
uccagaacauggcucucua

SEQ ID NO: 482174 - RNA, 19 nt, Homo sapiens
ccuacuacaccacuucuga

SEQ ID NO: 482175 - RNA, 19 nt, Homo sapiens
gaucaccccuuccuacuac

SEQ ID NO: 482176 - RNA, 19 nt, Homo sapiens
ccuggagccuggaccacaa

SEQ ID NO: 482177 - RNA, 19 nt, Homo sapiens
gaggaauaacgaggacauu

SEQ ID NO: 482178 - RNA, 19 nt, Homo sapiens
ccagaacauggcucucuau

SEQ ID NO: 482179 - RNA, 19 nt, Homo sapiens
ucccugacaugcaagaaca

SEQ ID NO: 482180 - RNA, 19 nt, Homo sapiens
aggaauaacgaggacauuu

SEQ ID NO: 482181 - RNA, 19 nt, Homo sapiens
acgcugucauuuccacuga

SEQ ID NO: 482182 - RNA, 19 nt, Homo sapiens
acgaggacauuuccaucau

SEQ ID NO: 482183 - RNA, 19 nt, Homo sapiens
cagaacauggcucucuaug

SEQ ID NO: 482184 - RNA, 19 nt, Homo sapiens
agaucucccugacaugcaa

SEQ ID NO: 482185 - RNA, 19 nt, Homo sapiens
gagagaagaucaagucaga

SEQ ID NO: 482186 - RNA, 19 nt, Homo sapiens
gaugagaucuccuuuguca

SEQ ID NO: 482187 - RNA, 19 nt, Homo sapiens
ggauggcuguuuauaauuu

SEQ ID NO: 482188 - RNA, 19 nt, Homo sapiens
gaaaugcagucccuggauu

SEQ ID NO: 482189 - RNA, 19 nt, Homo sapiens
ggaagggaauguccaaaga

SEQ ID NO: 482190 - RNA, 19 nt, Homo sapiens
gaaaguaaagguaaagaug

SEQ ID NO: 482191 - RNA, 19 nt, Homo sapiens
gaagaagaaaguaaaggua

SEQ ID NO: 482192 - RNA, 19 nt, Homo sapiens
gggcccagcucccaguuua

SEQ ID NO: 482193 - RNA, 19 nt, Homo sapiens
ggugaaagguuccaugaau

SEQ ID NO: 482194 - RNA, 19 nt, Homo sapiens
ggauguagcugcugcuugu

SEQ ID NO: 482195 - RNA, 19 nt, Homo sapiens
gacuuaaacugcuuacaaa

SEQ ID NO: 482196 - RNA, 19 nt, Homo sapiens
ggacuuaaacugcuuacaa

SEQ ID NO: 482197 - RNA, 19 nt, Homo sapiens
cgaggacucugaagaagaa

SEQ ID NO: 482198 - RNA, 19 nt, Homo sapiens
gcaagaccuuugacuacaa

SEQ ID NO: 482199 - RNA, 19 nt, Homo sapiens
gaacaugaacgaggaagaa

SEQ ID NO: 482200 - RNA, 19 nt, Homo sapiens
gauccaaauccucaucuua

SEQ ID NO: 482201 - RNA, 19 nt, Homo sapiens
ggaggaagguucucuuugc

SEQ ID NO: 482202 - RNA, 19 nt, Homo sapiens
gaucuccuuugucaacuuu

SEQ ID NO: 482203 - RNA, 19 nt, Homo sapiens
caaggauggcuguuuauaa

SEQ ID NO: 482204 - RNA, 19 nt, Homo sapiens
gaagaagaacuagccagua

SEQ ID NO: 482205 - RNA, 19 nt, Homo sapiens
caaagaagaagaagaaagu

SEQ ID NO: 482206 - RNA, 19 nt, Homo sapiens
guaaugagggugacaguga

SEQ ID NO: 482207 - RNA, 19 nt, Homo sapiens
caaauccucaucuuacuuu

SEQ ID NO: 482208 - RNA, 19 nt, Homo sapiens
uaugauggcuuccgagaau

SEQ ID NO: 482209 - RNA, 19 nt, Homo sapiens
aaggauggcuguuuauaau

SEQ ID NO: 482210 - RNA, 19 nt, Homo sapiens
ucccaaggauggcuguuua

SEQ ID NO: 482211 - RNA, 19 nt, Homo sapiens
gagcgaggacucugaagaa

SEQ ID NO: 482212 - RNA, 19 nt, Homo sapiens
gggaggagaaugccaauga

SEQ ID NO: 482213 - RNA, 19 nt, Homo sapiens
gaacugacuuuggaaacca

SEQ ID NO: 482214 - RNA, 19 nt, Homo sapiens
cgccagauguucuuuguga

SEQ ID NO: 482215 - RNA, 19 nt, Homo sapiens
gagaaucggaguuugagaa

SEQ ID NO: 482216 - RNA, 19 nt, Homo sapiens
gcauugagagggaggagua

SEQ ID NO: 482217 - RNA, 19 nt, Homo sapiens
gugaaagguuccaugaaug

SEQ ID NO: 482218 - RNA, 19 nt, Homo sapiens
gaauggccaugucuacaag

SEQ ID NO: 482219 - RNA, 19 nt, Homo sapiens
cagagacacuggaguucaa

SEQ ID NO: 482220 - RNA, 19 nt, Homo sapiens
cagaggaguuugacagcaa

SEQ ID NO: 482221 - RNA, 19 nt, Homo sapiens
gaacccaagcuacgaugaa

SEQ ID NO: 482222 - RNA, 19 nt, Homo sapiens
gacauuucguugacucuga

SEQ ID NO: 482223 - RNA, 19 nt, Homo sapiens
ucgaugagaucuccuuugu

SEQ ID NO: 482224 - RNA, 19 nt, Homo sapiens
ugaaagguuccaugaauga

SEQ ID NO: 482225 - RNA, 19 nt, Homo sapiens
cccagaauguguugucaaa

SEQ ID NO: 482226 - RNA, 19 nt, Homo sapiens
gcucugggccauggacuua

SEQ ID NO: 482227 - RNA, 19 nt, Homo sapiens
gaagaagaagaaaguaaag

SEQ ID NO: 482228 - RNA, 19 nt, Homo sapiens
agaagaaaccgaugaguca

SEQ ID NO: 482229 - RNA, 19 nt, Homo sapiens
caggaucccucuaugagau

SEQ ID NO: 482230 - RNA, 19 nt, Homo sapiens
cagaauguguugucaaagg

SEQ ID NO: 482231 - RNA, 19 nt, Homo sapiens
ggaguucaacgacgucuau

SEQ ID NO: 482232 - RNA, 19 nt, Homo sapiens
caaagaauggccaugucua

SEQ ID NO: 482233 - RNA, 19 nt, Homo sapiens
gauggcuguuuauaauuug

SEQ ID NO: 482234 - RNA, 19 nt, Homo sapiens
gaguuugugucuagugaug

SEQ ID NO: 482235 - RNA, 19 nt, Homo sapiens
ugaauaugcugacucugau

SEQ ID NO: 482236 - RNA, 19 nt, Homo sapiens
gccuugagcuaauggagaa

SEQ ID NO: 482237 - RNA, 19 nt, Homo sapiens
gggccuauuucuacuuuca

SEQ ID NO: 482238 - RNA, 19 nt, Homo sapiens
aagaagaacuagccaguac

SEQ ID NO: 482239 - RNA, 19 nt, Homo sapiens
gcaccacaggcaagaauga

SEQ ID NO: 482240 - RNA, 19 nt, Homo sapiens
ggcagcugcuuuccuuuga

SEQ ID NO: 482241 - RNA, 19 nt, Homo sapiens
ggccaugucuacaaguaug

SEQ ID NO: 482242 - RNA, 19 nt, Homo sapiens
ggaguuaacagaagguauc

SEQ ID NO: 482243 - RNA, 19 nt, Homo sapiens
ccaaggauggcuguuuaua

SEQ ID NO: 482244 - RNA, 19 nt, Homo sapiens
gaggugaaagguuccauga

SEQ ID NO: 482245 - RNA, 19 nt, Homo sapiens
gcucccaguuuacuugguu

SEQ ID NO: 482246 - RNA, 19 nt, Homo sapiens
caagaaggcaggcgagauc

SEQ ID NO: 482247 - RNA, 19 nt, Homo sapiens
aagcagggcacucaguaua

SEQ ID NO: 482248 - RNA, 19 nt, Homo sapiens
ccaagcagggcacucagua

SEQ ID NO: 482249 - RNA, 19 nt, Homo sapiens
ggcaagaccuuugacuaca

SEQ ID NO: 482250 - RNA, 19 nt, Homo sapiens
gaagaaaguaaagguaaag

SEQ ID NO: 482251 - RNA, 19 nt, Homo sapiens
gaaggaggaaggcaagauc

SEQ ID NO: 482252 - RNA, 19 nt, Homo sapiens
guaccaguuucuccucaug

SEQ ID NO: 482253 - RNA, 19 nt, Homo sapiens
gugggcagcugcuuuccuu

SEQ ID NO: 482254 - RNA, 19 nt, Homo sapiens
gauggucgacugagguuga

SEQ ID NO: 482255 - RNA, 19 nt, Homo sapiens
ggacucugaagaagaagaa

SEQ ID NO: 482256 - RNA, 19 nt, Homo sapiens
guaaagguaaagauggaaa

SEQ ID NO: 482257 - RNA, 19 nt, Homo sapiens
agucaaagaagaagaagaa

SEQ ID NO: 482258 - RNA, 19 nt, Homo sapiens
gaugaggaccagcaugaug

SEQ ID NO: 482259 - RNA, 19 nt, Homo sapiens
gggcaaugcaggauccaaa

SEQ ID NO: 482260 - RNA, 19 nt, Homo sapiens
uggauucugugccaucuga

SEQ ID NO: 482261 - RNA, 19 nt, Homo sapiens
ggagcgaggacucugaaga

SEQ ID NO: 482262 - RNA, 19 nt, Homo sapiens
aagggaauguccaaagaga

SEQ ID NO: 482263 - RNA, 19 nt, Homo sapiens
cgaugaauaugcugacucu

SEQ ID NO: 482264 - RNA, 19 nt, Homo sapiens
cuacuacucguuccuuuga

SEQ ID NO: 482265 - RNA, 19 nt, Homo sapiens
cgucuuaacucugcugcuu

SEQ ID NO: 482266 - RNA, 19 nt, Homo sapiens
gaagaacuagccaguacuc

SEQ ID NO: 482267 - RNA, 19 nt, Homo sapiens
gaagaucaagucagaccau

SEQ ID NO: 482268 - RNA, 19 nt, Homo sapiens
ucugccagcuccuccagua

SEQ ID NO: 482269 - RNA, 19 nt, Homo sapiens
gugaagaggaggaagaugu

SEQ ID NO: 482270 - RNA, 19 nt, Homo sapiens
gcaagauccgggaggagaa

SEQ ID NO: 482271 - RNA, 19 nt, Homo sapiens
caagaccuuugacuacaag

SEQ ID NO: 482272 - RNA, 19 nt, Homo sapiens
gccuauuucuacuuucauu

SEQ ID NO: 482273 - RNA, 19 nt, Homo sapiens
gcagagacacuggaguuca

SEQ ID NO: 482274 - RNA, 19 nt, Homo sapiens
ccuuugacuuugaaauuga

SEQ ID NO: 482275 - RNA, 19 nt, Homo sapiens
cuaagagggacaagucaaa

SEQ ID NO: 482276 - RNA, 19 nt, Homo sapiens
gaauguccaaagagaagaa

SEQ ID NO: 482277 - RNA, 19 nt, Homo sapiens
ggaggagaaugccaaugac

SEQ ID NO: 482278 - RNA, 19 nt, Homo sapiens
cagauguucuuugugauca

SEQ ID NO: 482279 - RNA, 19 nt, Homo sapiens
ucauggaggugcgcuucua

SEQ ID NO: 482280 - RNA, 19 nt, Homo sapiens
gaauagcaagacaggcaaa

SEQ ID NO: 482281 - RNA, 19 nt, Homo sapiens
ccagccagucuuugagaua

SEQ ID NO: 482282 - RNA, 19 nt, Homo sapiens
gggcagcugcuuuccuuug

SEQ ID NO: 482283 - RNA, 19 nt, Homo sapiens
aagaguuugugucuaguga

SEQ ID NO: 482284 - RNA, 19 nt, Homo sapiens
gcgagagcuucaagagcaa

SEQ ID NO: 482285 - RNA, 19 nt, Homo sapiens
ggagaaugaugcccuggaa

SEQ ID NO: 482286 - RNA, 19 nt, Homo sapiens
aaagcuggcugcaagaauu

SEQ ID NO: 482287 - RNA, 19 nt, Homo sapiens
agcaggaacuggccaagua

SEQ ID NO: 482288 - RNA, 19 nt, Homo sapiens
ccaaccagacggagaauga

SEQ ID NO: 482289 - RNA, 19 nt, Homo sapiens
gcaaagcuggcugcaagaa

SEQ ID NO: 482290 - RNA, 19 nt, Homo sapiens
ggcuugagcugcagagauc

SEQ ID NO: 482291 - RNA, 19 nt, Homo sapiens
agagaucugcuaacucaaa

SEQ ID NO: 482292 - RNA, 19 nt, Homo sapiens
gagaucugcuaacucaaac

SEQ ID NO: 482293 - RNA, 19 nt, Homo sapiens
ggaacuggccaaguacuuc

SEQ ID NO: 482294 - RNA, 19 nt, Homo sapiens
ccuggaaccugaagaucug

SEQ ID NO: 482295 - RNA, 19 nt, Homo sapiens
gaacuggccaaguacuucu

SEQ ID NO: 482296 - RNA, 19 nt, Homo sapiens
agacuuucacauccuguua

SEQ ID NO: 482297 - RNA, 19 nt, Homo sapiens
caaagcuggcugcaagaau

SEQ ID NO: 482298 - RNA, 19 nt, Homo sapiens
aggaugaaaugaggcuuga

SEQ ID NO: 482299 - RNA, 19 nt, Homo sapiens
gcaggaacuggccaaguac

SEQ ID NO: 482300 - RNA, 19 nt, Homo sapiens
ggaacucuauggucaucua

SEQ ID NO: 482301 - RNA, 19 nt, Homo sapiens
aggagccgguugacuauua

SEQ ID NO: 482302 - RNA, 19 nt, Homo sapiens
caacaucuacauccuaaau

SEQ ID NO: 482303 - RNA, 19 nt, Homo sapiens
gcgccauccugaucucuuu

SEQ ID NO: 482304 - RNA, 19 nt, Homo sapiens
caagagccgugccuacagu

SEQ ID NO: 482305 - RNA, 19 nt, Homo sapiens
gaagacggccaccaacauc

SEQ ID NO: 482306 - RNA, 19 nt, Homo sapiens
ggaggagccgguugacuau

SEQ ID NO: 482307 - RNA, 19 nt, Homo sapiens
cggaggagccgguugacua

SEQ ID NO: 482308 - RNA, 19 nt, Homo sapiens
cacgguggcuugcaacaug

SEQ ID NO: 482309 - RNA, 19 nt, Homo sapiens
ccugaucucuuucaucuac

SEQ ID NO: 482310 - RNA, 19 nt, Homo sapiens
gagcgcaagaucaccuuaa

SEQ ID NO: 482311 - RNA, 19 nt, Homo sapiens
accaacaucuacauccuaa

SEQ ID NO: 482312 - RNA, 19 nt, Homo sapiens
cuagucaccuccacguugu

SEQ ID NO: 482313 - RNA, 19 nt, Homo sapiens
cauccuaaaucuggccauu

SEQ ID NO: 482314 - RNA, 19 nt, Homo sapiens
ugagucagcugucggucau

SEQ ID NO: 482315 - RNA, 19 nt, Homo sapiens
gcuggugggcuucguguug

SEQ ID NO: 482316 - RNA, 19 nt, Homo sapiens
gaggagccagggcgaaaug

SEQ ID NO: 482317 - RNA, 19 nt, Homo sapiens
ggagcgcaagaucaccuua

SEQ ID NO: 482318 - RNA, 19 nt, Homo sapiens
gcuacgugcucaucauugc

SEQ ID NO: 482319 - RNA, 19 nt, Homo sapiens
caacuucaagcgcucuuuc

SEQ ID NO: 482320 - RNA, 19 nt, Homo sapiens
ggagccgguugacuauuac

SEQ ID NO: 482321 - RNA, 19 nt, Homo sapiens
ggcgaaaugcgucccagaa

SEQ ID NO: 482322 - RNA, 19 nt, Homo sapiens
gcgcaagaucaccuuaaug

SEQ ID NO: 482323 - RNA, 19 nt, Homo sapiens
gcucagcgugcccuuccua

SEQ ID NO: 482324 - RNA, 19 nt, Homo sapiens
acaucuacauccuaaaucu

SEQ ID NO: 482325 - RNA, 19 nt, Homo sapiens
ucaccagcaucuacugucu

SEQ ID NO: 482326 - RNA, 19 nt, Homo sapiens
ucuauggcuuucucucaga

SEQ ID NO: 482327 - RNA, 19 nt, Homo sapiens
gcaagaucaccuuaauggu

SEQ ID NO: 482328 - RNA, 19 nt, Homo sapiens
cgcaagaucaccuuaaugg

SEQ ID NO: 482329 - RNA, 19 nt, Homo sapiens
ggacgcggucaacauguuc

SEQ ID NO: 482330 - RNA, 19 nt, Homo sapiens
uggacgcggucaacauguu

SEQ ID NO: 482331 - RNA, 19 nt, Homo sapiens
ucugcuggaugccuuucua

SEQ ID NO: 482332 - RNA, 19 nt, Homo sapiens
ugaagacggccaccaacau

SEQ ID NO: 482333 - RNA, 19 nt, Homo sapiens
caccguggccaagguagua

SEQ ID NO: 482334 - RNA, 19 nt, Homo sapiens
accagcaucuacugucuga

SEQ ID NO: 482335 - RNA, 19 nt, Homo sapiens
agacggccaccaacaucua

SEQ ID NO: 482336 - RNA, 19 nt, Homo sapiens
guuguacacauuucucaug

SEQ ID NO: 482337 - RNA, 19 nt, Homo sapiens
gcagcgccauccugaucuc

SEQ ID NO: 482338 - RNA, 19 nt, Homo sapiens
caccaacaucuacauccua

SEQ ID NO: 482339 - RNA, 19 nt, Homo sapiens
ccaccaacaucuacauccu

SEQ ID NO: 482340 - RNA, 19 nt, Homo sapiens
cagcgugcccuuccuaguc

SEQ ID NO: 482341 - RNA, 19 nt, Homo sapiens
ccuacaguguggaagacuu

SEQ ID NO: 482342 - RNA, 19 nt, Homo sapiens
ucuccuuccuccucuccua

SEQ ID NO: 482343 - RNA, 19 nt, Homo sapiens
ugaugguggugaugguguu

SEQ ID NO: 482344 - RNA, 19 nt, Homo sapiens
gugcucaucauugcuaaga

SEQ ID NO: 482345 - RNA, 19 nt, Homo sapiens
gugcuacgugcucaucauu

SEQ ID NO: 482346 - RNA, 19 nt, Homo sapiens
gcaacacacuugucauuua

SEQ ID NO: 482347 - RNA, 19 nt, Homo sapiens
agacagagccguacuauga

SEQ ID NO: 482348 - RNA, 19 nt, Homo sapiens
caacacacuugucauuuau

SEQ ID NO: 482349 - RNA, 19 nt, Homo sapiens
ggaagaagucugagaagaa

SEQ ID NO: 482350 - RNA, 19 nt, Homo sapiens
gaagaagucugagaagaag

SEQ ID NO: 482351 - RNA, 19 nt, Homo sapiens
cgagugggcuccucuaaga

SEQ ID NO: 482352 - RNA, 19 nt, Homo sapiens
ggacaaaucccggcugaau

SEQ ID NO: 482353 - RNA, 19 nt, Homo sapiens
agaagcagcugcaccauca

SEQ ID NO: 482354 - RNA, 19 nt, Homo sapiens
acacaggguucaucaucua

SEQ ID NO: 482355 - RNA, 19 nt, Homo sapiens
uauccuauaugccuucuug

SEQ ID NO: 482356 - RNA, 19 nt, Homo sapiens
agaagaaggucacccgaau

SEQ ID NO: 482357 - RNA, 19 nt, Homo sapiens
acaaaucccggcugaauga

SEQ ID NO: 482358 - RNA, 19 nt, Homo sapiens
caucuacacuuucauucug

SEQ ID NO: 482359 - RNA, 19 nt, Homo sapiens
uuaaaggcauguuugacuu

SEQ ID NO: 482360 - RNA, 19 nt, Homo sapiens
uggcuucccuucuacauau

SEQ ID NO: 482361 - RNA, 19 nt, Homo sapiens
caucuugcccaucaugaua

SEQ ID NO: 482362 - RNA, 19 nt, Homo sapiens
gaagaaggucacccgaaug

SEQ ID NO: 482363 - RNA, 19 nt, Homo sapiens
uauaugccuucuugucuga

SEQ ID NO: 482364 - RNA, 19 nt, Homo sapiens
gugccaacccuauccuaua

SEQ ID NO: 482365 - RNA, 19 nt, Homo sapiens
acuaugaccugacaagcaa

SEQ ID NO: 482366 - RNA, 19 nt, Homo sapiens
ggcuauccauuccauuuga

SEQ ID NO: 482367 - RNA, 19 nt, Homo sapiens
guacacaggguucaucauc

SEQ ID NO: 482368 - RNA, 19 nt, Homo sapiens
ugccaacccuauccuauau

SEQ ID NO: 482369 - RNA, 19 nt, Homo sapiens
ugaagaccaucaccaacau

SEQ ID NO: 482370 - RNA, 19 nt, Homo sapiens
acacacuugucauuuaugu

SEQ ID NO: 482371 - RNA, 19 nt, Homo sapiens
caucaucuacacuuucauu

SEQ ID NO: 482372 - RNA, 19 nt, Homo sapiens
gaagaccaucaccaacauu

SEQ ID NO: 482373 - RNA, 19 nt, Homo sapiens
acaguaagcaggacaaauc

SEQ ID NO: 482374 - RNA, 19 nt, Homo sapiens
caacuggccaggugaaucu

SEQ ID NO: 482375 - RNA, 19 nt, Homo sapiens
cgugguggcugucuucauc

SEQ ID NO: 482376 - RNA, 19 nt, Homo sapiens
cuaagaggaagaagucuga

SEQ ID NO: 482377 - RNA, 19 nt, Homo sapiens
guccucacauucaucuauu

SEQ ID NO: 482378 - RNA, 19 nt, Homo sapiens
gacaaaucccggcugaaug

SEQ ID NO: 482379 - RNA, 19 nt, Homo sapiens
aaggugaaguccucuggaa

SEQ ID NO: 482380 - RNA, 19 nt, Homo sapiens
ggugaaguccucuggaauc

SEQ ID NO: 482381 - RNA, 19 nt, Homo sapiens
ucaaucaguucaccagcau

SEQ ID NO: 482382 - RNA, 19 nt, Homo sapiens
uuugcuaccuguucauuau

SEQ ID NO: 482383 - RNA, 19 nt, Homo sapiens
acacuugucauuuauguca

SEQ ID NO: 482384 - RNA, 19 nt, Homo sapiens
ggcaacacacuugucauuu

SEQ ID NO: 482385 - RNA, 19 nt, Homo sapiens
gggagcggagugacaguaa

SEQ ID NO: 482386 - RNA, 19 nt, Homo sapiens
ucugcuggcuucccuucua

SEQ ID NO: 482387 - RNA, 19 nt, Homo sapiens
aggaagaagucugagaaga

SEQ ID NO: 482388 - RNA, 19 nt, Homo sapiens
gaccaucaccaacauuuac

SEQ ID NO: 482389 - RNA, 19 nt, Homo sapiens
uuuguggucugcaucauug

SEQ ID NO: 482390 - RNA, 19 nt, Homo sapiens
gguucaucaucuacacuuu

SEQ ID NO: 482391 - RNA, 19 nt, Homo sapiens
uggcaacacacuugucauu

SEQ ID NO: 482392 - RNA, 19 nt, Homo sapiens
agaccaucaccaacauuua

SEQ ID NO: 482393 - RNA, 19 nt, Homo sapiens
ggagcggagugacaguaag

SEQ ID NO: 482394 - RNA, 19 nt, Homo sapiens
agaggaagaagucugagaa

SEQ ID NO: 482395 - RNA, 19 nt, Homo sapiens
caaccuggccaucgcagau

SEQ ID NO: 482396 - RNA, 19 nt, Homo sapiens
ccuccaaaccaguaucuga

SEQ ID NO: 482397 - RNA, 19 nt, Homo sapiens
caacaccucaaaccagaca

SEQ ID NO: 482398 - RNA, 19 nt, Homo sapiens
cggccaagaugaucaccau

SEQ ID NO: 482399 - RNA, 19 nt, Homo sapiens
ccaacccuauccuauaugc

SEQ ID NO: 482400 - RNA, 19 nt, Homo sapiens
cuggucaucuugcccauca

SEQ ID NO: 482401 - RNA, 19 nt, Homo sapiens
ucuugcccaucaugauaua

SEQ ID NO: 482402 - RNA, 19 nt, Homo sapiens
aagaccaucaccaacauuu

SEQ ID NO: 482403 - RNA, 19 nt, Homo sapiens
gcaguccucacauucaucu

SEQ ID NO: 482404 - RNA, 19 nt, Homo sapiens
gccguacuaugaccugaca

SEQ ID NO: 482405 - RNA, 19 nt, Homo sapiens
ccagacagagccguacuau

SEQ ID NO: 482406 - RNA, 19 nt, Homo sapiens
gaggaagaagucugagaag

SEQ ID NO: 482407 - RNA, 19 nt, Homo sapiens
ugucuuugcuaccuguuca

SEQ ID NO: 482408 - RNA, 19 nt, Homo sapiens
ucaguucaccagcaucuuc

SEQ ID NO: 482409 - RNA, 19 nt, Homo sapiens
ucaauggaagccacacaug

SEQ ID NO: 482410 - RNA, 19 nt, Homo sapiens
aaggugagcggcacagaug

SEQ ID NO: 482411 - RNA, 19 nt, Homo sapiens
ccuccgcuaugccaagaug

SEQ ID NO: 482412 - RNA, 19 nt, Homo sapiens
ucauuaucaucaaggugaa

SEQ ID NO: 482413 - RNA, 19 nt, Homo sapiens
ggucaucuugcccaucaug

SEQ ID NO: 482414 - RNA, 19 nt, Homo sapiens
ucaccaacauuuacauccu

SEQ ID NO: 482415 - RNA, 19 nt, Homo sapiens
caaggugagcggcacagau

SEQ ID NO: 482416 - RNA, 19 nt, Homo sapiens
cuacauauucaacguuucu

SEQ ID NO: 482417 - RNA, 19 nt, Homo sapiens
guucaucaucuacacuuuc

SEQ ID NO: 482418 - RNA, 19 nt, Homo sapiens
gcagcugcaccaucaacug

SEQ ID NO: 482419 - RNA, 19 nt, Homo sapiens
ucucucugcuggucaucuu

SEQ ID NO: 482420 - RNA, 19 nt, Homo sapiens
aggcauguuugacuuugug

SEQ ID NO: 482421 - RNA, 19 nt, Homo sapiens
gccggguggucaugacugu

SEQ ID NO: 482422 - RNA, 19 nt, Homo sapiens
caacauuuacauccucaac

SEQ ID NO: 482423 - RNA, 19 nt, Homo sapiens
guaacucgcuggucaucua

SEQ ID NO: 482424 - RNA, 19 nt, Homo sapiens
ggacaugcuucauccauca

SEQ ID NO: 482425 - RNA, 19 nt, Homo sapiens
cgaggagccugccuucuuu

SEQ ID NO: 482426 - RNA, 19 nt, Homo sapiens
gagccggcuucaucaucua

SEQ ID NO: 482427 - RNA, 19 nt, Homo sapiens
agacugaggaggaggauga

SEQ ID NO: 482428 - RNA, 19 nt, Homo sapiens
ccaguucaccagcauauuc

SEQ ID NO: 482429 - RNA, 19 nt, Homo sapiens
ccgaggagccugccuucuu

SEQ ID NO: 482430 - RNA, 19 nt, Homo sapiens
agaacgcccuguccuacug

SEQ ID NO: 482431 - RNA, 19 nt, Homo sapiens
cgagccggcuucaucaucu

SEQ ID NO: 482432 - RNA, 19 nt, Homo sapiens
gcagaguggccagcaagga

SEQ ID NO: 482433 - RNA, 19 nt, Homo sapiens
caaccaguucaccagcaua

SEQ ID NO: 482434 - RNA, 19 nt, Homo sapiens
ccgacgagcucuucaugcu

SEQ ID NO: 482435 - RNA, 19 nt, Homo sapiens
ccagcagaguggccagcaa

SEQ ID NO: 482436 - RNA, 19 nt, Homo sapiens
gcgcugcccuaugccaaca

SEQ ID NO: 482437 - RNA, 19 nt, Homo sapiens
uggugggccugcuggguaa

SEQ ID NO: 482438 - RNA, 19 nt, Homo sapiens
ucugcuggaugcccuucua

SEQ ID NO: 482439 - RNA, 19 nt, Homo sapiens
ucaaccaguucaccagcau

SEQ ID NO: 482440 - RNA, 19 nt, Homo sapiens
gcccuucagucaccaacgu

SEQ ID NO: 482441 - RNA, 19 nt, Homo sapiens
gcaacgcccuggucaucuu

SEQ ID NO: 482442 - RNA, 19 nt, Homo sapiens
gauggucguggucgucuuu

SEQ ID NO: 482443 - RNA, 19 nt, Homo sapiens
ucaaccacgugucccuuau

SEQ ID NO: 482444 - RNA, 19 nt, Homo sapiens
gucaaccacgugucccuua

SEQ ID NO: 482445 - RNA, 19 nt, Homo sapiens
ucgacggccucaacauguu

SEQ ID NO: 482446 - RNA, 19 nt, Homo sapiens
ccgacgagcucuucaugcu

SEQ ID NO: 482447 - RNA, 19 nt, Homo sapiens
ucugcuggaugccuuucua

SEQ ID NO: 482448 - RNA, 19 nt, Homo sapiens
ucaccagcgucuucugucu

SEQ ID NO: 482449 - RNA, 19 nt, Homo sapiens
gcaggcgcucggagaagaa

SEQ ID NO: 482450 - RNA, 19 nt, Homo sapiens
uggccaagcucaucaaccu

SEQ ID NO: 482451 - RNA, 19 nt, Homo sapiens
ggucguggucgucuuugug

SEQ ID NO: 482452 - RNA, 19 nt, Homo sapiens
caggaccaccaccuucuga

SEQ ID NO: 482453 - RNA, 19 nt, Homo sapiens
ggaagcccugcaaccagaa

SEQ ID NO: 482454 - RNA, 19 nt, Homo sapiens
ggaacacgcuggucaucua

SEQ ID NO: 482455 - RNA, 19 nt, Homo sapiens
gauguuggcugcccuucuu

SEQ ID NO: 482456 - RNA, 19 nt, Homo sapiens
ucaccaacaucuacauucu

SEQ ID NO: 482457 - RNA, 19 nt, Homo sapiens
gugcugcgcuucgccaaga

SEQ ID NO: 482458 - RNA, 19 nt, Homo sapiens
ugaagaccgucaccaacau

SEQ ID NO: 482459 - RNA, 19 nt, Homo sapiens
ucaaccaguucaccagugu

SEQ ID NO: 482460 - RNA, 19 nt, Homo sapiens
caacaucuacauucucaac

SEQ ID NO: 482461 - RNA, 19 nt, Homo sapiens
gaagaccgucaccaacauc

SEQ ID NO: 482462 - RNA, 19 nt, Homo sapiens
accaacaucuacauucuca

SEQ ID NO: 482463 - RNA, 19 nt, Homo sapiens
cuuccucucugacaacuuc

SEQ ID NO: 482464 - RNA, 19 nt, Homo sapiens
gaacacgcuggucaucuac

SEQ ID NO: 482465 - RNA, 19 nt, Homo sapiens
ccaguucaccagugucuuc

SEQ ID NO: 482466 - RNA, 19 nt, Homo sapiens
gcgccgucuucaucaucua

SEQ ID NO: 482467 - RNA, 19 nt, Homo sapiens
gaccgucaccaacaucuac

SEQ ID NO: 482468 - RNA, 19 nt, Homo sapiens
gaaagcagcuggugauuua

SEQ ID NO: 482469 - RNA, 19 nt, Homo sapiens
gaacggagacgacaccuuu

SEQ ID NO: 482470 - RNA, 19 nt, Homo sapiens
uaagagaucuggacccaaa

SEQ ID NO: 482471 - RNA, 19 nt, Homo sapiens
ugaggaagaugacgaguaa

SEQ ID NO: 482472 - RNA, 19 nt, Homo sapiens
gaagcaaggccuuugauga

SEQ ID NO: 482473 - RNA, 19 nt, Homo sapiens
gcaaggccuuugaugauau

SEQ ID NO: 482474 - RNA, 19 nt, Homo sapiens
gaaugcauauuucgguuug

SEQ ID NO: 482475 - RNA, 19 nt, Homo sapiens
gaaagcaaguguucacaac

SEQ ID NO: 482476 - RNA, 19 nt, Homo sapiens
gggcaguucugaguguuua

SEQ ID NO: 482477 - RNA, 19 nt, Homo sapiens
gaccauaaccgcaggauuc

SEQ ID NO: 482478 - RNA, 19 nt, Homo sapiens
guaauaaacaggccacaga

SEQ ID NO: 482479 - RNA, 19 nt, Homo sapiens
uugaugauauugccacaua

SEQ ID NO: 482480 - RNA, 19 nt, Homo sapiens
gagcaagacauacugaaug

SEQ ID NO: 482481 - RNA, 19 nt, Homo sapiens
gaagagaagcaaggccuuu

SEQ ID NO: 482482 - RNA, 19 nt, Homo sapiens
gccaagaguucgauguuag

SEQ ID NO: 482483 - RNA, 19 nt, Homo sapiens
cgaagaucaugcccaagaa

SEQ ID NO: 482484 - RNA, 19 nt, Homo sapiens
gaugaaauacucggagaaa

SEQ ID NO: 482485 - RNA, 19 nt, Homo sapiens
gcuaaagcaucagagaaga

SEQ ID NO: 482486 - RNA, 19 nt, Homo sapiens
cgacacaugcccuugauga

SEQ ID NO: 482487 - RNA, 19 nt, Homo sapiens
ucagcuauguguauaugaa

SEQ ID NO: 482488 - RNA, 19 nt, Homo sapiens
gaaaaucagcuauguguau

SEQ ID NO: 482489 - RNA, 19 nt, Homo sapiens
gauguuaguguuuccauug

SEQ ID NO: 482490 - RNA, 19 nt, Homo sapiens
cacaugcccuugaugagaa

SEQ ID NO: 482491 - RNA, 19 nt, Homo sapiens
caaggccuuugaugauauu

SEQ ID NO: 482492 - RNA, 19 nt, Homo sapiens
caaagagacccagggauga

SEQ ID NO: 482493 - RNA, 19 nt, Homo sapiens
ccaccuuucauguguaaua

SEQ ID NO: 482494 - RNA, 19 nt, Homo sapiens
gccauucuguuagauacua

SEQ ID NO: 482495 - RNA, 19 nt, Homo sapiens
guuaguguuuccauuguau

SEQ ID NO: 482496 - RNA, 19 nt, Homo sapiens
cugagaagauuaauaagag

SEQ ID NO: 482497 - RNA, 19 nt, Homo sapiens
agaagcaucuggcccacaa

SEQ ID NO: 482498 - RNA, 19 nt, Homo sapiens
acuauaaggccaugacuaa

SEQ ID NO: 482499 - RNA, 19 nt, Homo sapiens
uaauaaaccuuugcaaacg

SEQ ID NO: 482500 - RNA, 19 nt, Homo sapiens
ccaaguaccaguauaagca

SEQ ID NO: 482501 - RNA, 19 nt, Homo sapiens
cauacugaaugcauauuuc

SEQ ID NO: 482502 - RNA, 19 nt, Homo sapiens
gcauauuucgguuugugua

SEQ ID NO: 482503 - RNA, 19 nt, Homo sapiens
agaguucgauguuaguguu

SEQ ID NO: 482504 - RNA, 19 nt, Homo sapiens
gaagggagugucagaagca

SEQ ID NO: 482505 - RNA, 19 nt, Homo sapiens
gagacgacaccuuugcaaa

SEQ ID NO: 482506 - RNA, 19 nt, Homo sapiens
caaguauugucagguauuc

SEQ ID NO: 482507 - RNA, 19 nt, Homo sapiens
aagacauacugaaugcaua

SEQ ID NO: 482508 - RNA, 19 nt, Homo sapiens
ugccaagaguucgauguua

SEQ ID NO: 482509 - RNA, 19 nt, Homo sapiens
caagugaaagcaaguguuc

SEQ ID NO: 482510 - RNA, 19 nt, Homo sapiens
ggccaugacuaaacuaggu

SEQ ID NO: 482511 - RNA, 19 nt, Homo sapiens
gccacauacuucucuaaga

SEQ ID NO: 482512 - RNA, 19 nt, Homo sapiens
guauaagcaucucccaucu

SEQ ID NO: 482513 - RNA, 19 nt, Homo sapiens
acaccaaguaccaguauaa

SEQ ID NO: 482514 - RNA, 19 nt, Homo sapiens
ccacugcuuugucucugaa

SEQ ID NO: 482515 - RNA, 19 nt, Homo sapiens
cagguauucucuccauaga

SEQ ID NO: 482516 - RNA, 19 nt, Homo sapiens
ggugauuuaugaagagauc

SEQ ID NO: 482517 - RNA, 19 nt, Homo sapiens
agcaaggccuuugaugaua

SEQ ID NO: 482518 - RNA, 19 nt, Homo sapiens
gcaagugaaagcaaguguu

SEQ ID NO: 482519 - RNA, 19 nt, Homo sapiens
ucaggugcauagcaaguga

SEQ ID NO: 482520 - RNA, 19 nt, Homo sapiens
caccuuucauguguaauaa

SEQ ID NO: 482521 - RNA, 19 nt, Homo sapiens
gacaguuaauaaaccuuug

SEQ ID NO: 482522 - RNA, 19 nt, Homo sapiens
uaaacaggccacagacuuc

SEQ ID NO: 482523 - RNA, 19 nt, Homo sapiens
gcacacacacacaccaagu

SEQ ID NO: 482524 - RNA, 19 nt, Homo sapiens
ccgaagaucaugcccaaga

SEQ ID NO: 482525 - RNA, 19 nt, Homo sapiens
agaaucaucccgaagauca

SEQ ID NO: 482526 - RNA, 19 nt, Homo sapiens
ugagggcaguucugagugu

SEQ ID NO: 482527 - RNA, 19 nt, Homo sapiens
gaugagcaagacauacuga

SEQ ID NO: 482528 - RNA, 19 nt, Homo sapiens
ggagacgacaccuuugcaa

SEQ ID NO: 482529 - RNA, 19 nt, Homo sapiens
gucaucaggugcauagcaa

SEQ ID NO: 482530 - RNA, 19 nt, Homo sapiens
aaucagcuauguguauaug

SEQ ID NO: 482531 - RNA, 19 nt, Homo sapiens
gagaaaaucagcuaugugu

SEQ ID NO: 482532 - RNA, 19 nt, Homo sapiens
aagcaaggccuuugaugau

SEQ ID NO: 482533 - RNA, 19 nt, Homo sapiens
caagacauacugaaugcau

SEQ ID NO: 482534 - RNA, 19 nt, Homo sapiens
gcagaacguggugaccuuu

SEQ ID NO: 482535 - RNA, 19 nt, Homo sapiens
agaaagcagcuggugauuu

SEQ ID NO: 482536 - RNA, 19 nt, Homo sapiens
gagaaagcagcuggugauu

SEQ ID NO: 482537 - RNA, 19 nt, Homo sapiens
gaagccagcagaggacgaa

SEQ ID NO: 482538 - RNA, 19 nt, Homo sapiens
guucugaguguuuaauuuc

SEQ ID NO: 482539 - RNA, 19 nt, Homo sapiens
ccacagacugcgugagaga

SEQ ID NO: 482540 - RNA, 19 nt, Homo sapiens
uaaagcaucagagaagaga

SEQ ID NO: 482541 - RNA, 19 nt, Homo sapiens
gaagaucaugcccaagaag

SEQ ID NO: 482542 - RNA, 19 nt, Homo sapiens
ccucccaccuuucaugugu

SEQ ID NO: 482543 - RNA, 19 nt, Homo sapiens
acccagggaugaugcuaaa

SEQ ID NO: 482544 - RNA, 19 nt, Homo sapiens
ccuuauaauugaugagcaa

SEQ ID NO: 482545 - RNA, 19 nt, Homo sapiens
cgauguuaguguuuccauu

SEQ ID NO: 482546 - RNA, 19 nt, Homo sapiens
gagaagcaaggccuuugau

SEQ ID NO: 482547 - RNA, 19 nt, Homo sapiens
gauauugccacauacuucu

SEQ ID NO: 482548 - RNA, 19 nt, Homo sapiens
gcauagcaagugaaagcaa

SEQ ID NO: 482549 - RNA, 19 nt, Homo sapiens
auaaaccuuugcaaacguu

SEQ ID NO: 482550 - RNA, 19 nt, Homo sapiens
acacaugcccuugaugaga

SEQ ID NO: 482551 - RNA, 19 nt, Homo sapiens
acagaaucaucccgaagau

SEQ ID NO: 482552 - RNA, 19 nt, Homo sapiens
cacagaaucaucccgaaga

SEQ ID NO: 482553 - RNA, 19 nt, Homo sapiens
gaaacuauaaggccaugac

SEQ ID NO: 482554 - RNA, 19 nt, Homo sapiens
cacaccaaguaccaguaua

SEQ ID NO: 482555 - RNA, 19 nt, Homo sapiens
gcauuuacacacacacaca

SEQ ID NO: 482556 - RNA, 19 nt, Homo sapiens
gagggcaguucugaguguu

SEQ ID NO: 482557 - RNA, 19 nt, Homo sapiens
gcuggugauuuaugaagag

SEQ ID NO: 482558 - RNA, 19 nt, Homo sapiens
ccaggaaaagcaaauauuu

SEQ ID NO: 482559 - RNA, 19 nt, Homo sapiens
cagcagaggacgaaaauga

SEQ ID NO: 482560 - RNA, 19 nt, Homo sapiens
guacuccccucauccgauu

SEQ ID NO: 482561 - RNA, 19 nt, Homo sapiens
ugaaugcauauuucgguuu

SEQ ID NO: 482562 - RNA, 19 nt, Homo sapiens
uguuaguguuuccauugua

SEQ ID NO: 482563 - RNA, 19 nt, Homo sapiens
caucagagaagagaagcaa

SEQ ID NO: 482564 - RNA, 19 nt, Homo sapiens
agaacguggugaccuuuca

SEQ ID NO: 482565 - RNA, 19 nt, Homo sapiens
agagaaagcagcuggugau

SEQ ID NO: 482566 - RNA, 19 nt, Homo sapiens
agacauacugaaugcauau

SEQ ID NO: 482567 - RNA, 19 nt, Homo sapiens
gaaacuugagcgucauuuu

SEQ ID NO: 482568 - RNA, 19 nt, Homo sapiens
gaaaacagcuggugauuua

SEQ ID NO: 482569 - RNA, 19 nt, Homo sapiens
ggaaugauuuggauaauga

SEQ ID NO: 482570 - RNA, 19 nt, Homo sapiens
gaacggagacgacgccuuu

SEQ ID NO: 482571 - RNA, 19 nt, Homo sapiens
ugaggaagaugacgaguaa

SEQ ID NO: 482572 - RNA, 19 nt, Homo sapiens
ccaaauacuucucuaagga

SEQ ID NO: 482573 - RNA, 19 nt, Homo sapiens
cacgagagaucuggaaaua

SEQ ID NO: 482574 - RNA, 19 nt, Homo sapiens
gaaagcaaguguucacaac

SEQ ID NO: 482575 - RNA, 19 nt, Homo sapiens
gaugaaagccucggagaaa

SEQ ID NO: 482576 - RNA, 19 nt, Homo sapiens
gagcaagacauacuuaaug

SEQ ID NO: 482577 - RNA, 19 nt, Homo sapiens
gggcaguucugaguguuua

SEQ ID NO: 482578 - RNA, 19 nt, Homo sapiens
caacauuggucgauucagu

SEQ ID NO: 482579 - RNA, 19 nt, Homo sapiens
cgagagaucuggaaauagg

SEQ ID NO: 482580 - RNA, 19 nt, Homo sapiens
caaaaggccuucgaugaua

SEQ ID NO: 482581 - RNA, 19 nt, Homo sapiens
gaaauagggaggcccaaga

SEQ ID NO: 482582 - RNA, 19 nt, Homo sapiens
gaugagcaagacauacuua

SEQ ID NO: 482583 - RNA, 19 nt, Homo sapiens
ccaacuaccucugagaaga

SEQ ID NO: 482584 - RNA, 19 nt, Homo sapiens
gaaaugauucggaggaagu

SEQ ID NO: 482585 - RNA, 19 nt, Homo sapiens
gcagaggaaggaaaugauu

SEQ ID NO: 482586 - RNA, 19 nt, Homo sapiens
gccaagaguucgauguuag

SEQ ID NO: 482587 - RNA, 19 nt, Homo sapiens
cgaagaucaugcccaagaa

SEQ ID NO: 482588 - RNA, 19 nt, Homo sapiens
gagaaaguaugaggcuaug

SEQ ID NO: 482589 - RNA, 19 nt, Homo sapiens
gggaaugauuuggauaaug

SEQ ID NO: 482590 - RNA, 19 nt, Homo sapiens
cacgguuggugcucaaaua

SEQ ID NO: 482591 - RNA, 19 nt, Homo sapiens
ccaugcaccuaccuuagaa

SEQ ID NO: 482592 - RNA, 19 nt, Homo sapiens
ccaccuuucauguguaaua

SEQ ID NO: 482593 - RNA, 19 nt, Homo sapiens
caaauacuucucuaaggaa

SEQ ID NO: 482594 - RNA, 19 nt, Homo sapiens
acacaacauuggucgauuc

SEQ ID NO: 482595 - RNA, 19 nt, Homo sapiens
agaagcaucuggcccacaa

SEQ ID NO: 482596 - RNA, 19 nt, Homo sapiens
caagaagccagcagaggaa

SEQ ID NO: 482597 - RNA, 19 nt, Homo sapiens
aguaugaggcuaugacuaa

SEQ ID NO: 482598 - RNA, 19 nt, Homo sapiens
uaauaaaccuuugcaaacg

SEQ ID NO: 482599 - RNA, 19 nt, Homo sapiens
ccaaguaccaguauaagca

SEQ ID NO: 482600 - RNA, 19 nt, Homo sapiens
gaacacacacaacauuggu

SEQ ID NO: 482601 - RNA, 19 nt, Homo sapiens
ucagaacacacacaacauu

SEQ ID NO: 482602 - RNA, 19 nt, Homo sapiens
ugagaagauucacgagaga

SEQ ID NO: 482603 - RNA, 19 nt, Homo sapiens
guaugaggcuaugacuaaa

SEQ ID NO: 482604 - RNA, 19 nt, Homo sapiens
gccaaauacuucucuaagg

SEQ ID NO: 482605 - RNA, 19 nt, Homo sapiens
ugccaagaguucgauguua

SEQ ID NO: 482606 - RNA, 19 nt, Homo sapiens
caagugaaagcaaguguuc

SEQ ID NO: 482607 - RNA, 19 nt, Homo sapiens
gaagagagacgcggaacag

SEQ ID NO: 482608 - RNA, 19 nt, Homo sapiens
gguugaacguccucagaug

SEQ ID NO: 482609 - RNA, 19 nt, Homo sapiens
gcucugacuuucucucucu

SEQ ID NO: 482610 - RNA, 19 nt, Homo sapiens
gcucaaauaccagagaaga

SEQ ID NO: 482611 - RNA, 19 nt, Homo sapiens
acaccaaguaccaguauaa

SEQ ID NO: 482612 - RNA, 19 nt, Homo sapiens
ggugauuuaugaagagauc

SEQ ID NO: 482613 - RNA, 19 nt, Homo sapiens
gaaaguaugaggcuaugac

SEQ ID NO: 482614 - RNA, 19 nt, Homo sapiens
acacacacacgcacacaaa

SEQ ID NO: 482615 - RNA, 19 nt, Homo sapiens
gcaccuaccuuagaaaaca

SEQ ID NO: 482616 - RNA, 19 nt, Homo sapiens
gcaagugaaagcaaguguu

SEQ ID NO: 482617 - RNA, 19 nt, Homo sapiens
ucaggugcauagcaaguga

SEQ ID NO: 482618 - RNA, 19 nt, Homo sapiens
gaaaaccaacuaccucuga

SEQ ID NO: 482619 - RNA, 19 nt, Homo sapiens
ggaagugccagaagcaucu

SEQ ID NO: 482620 - RNA, 19 nt, Homo sapiens
caccuuucauguguaauaa

SEQ ID NO: 482621 - RNA, 19 nt, Homo sapiens
gacaguuaauaaaccuuug

SEQ ID NO: 482622 - RNA, 19 nt, Homo sapiens
gcagucagaacacacacaa

SEQ ID NO: 482623 - RNA, 19 nt, Homo sapiens
caagacauacuuaaugcau

SEQ ID NO: 482624 - RNA, 19 nt, Homo sapiens
gucauucuguuagauacua

SEQ ID NO: 482625 - RNA, 19 nt, Homo sapiens
uguuagcguuuacguugua

SEQ ID NO: 482626 - RNA, 19 nt, Homo sapiens
aaacagcuggugauuuaug

SEQ ID NO: 482627 - RNA, 19 nt, Homo sapiens
ccaaaacaauuacacacaa

SEQ ID NO: 482628 - RNA, 19 nt, Homo sapiens
ccgaagaucaugcccaaga

SEQ ID NO: 482629 - RNA, 19 nt, Homo sapiens
acacaaaccacaccacaca

SEQ ID NO: 482630 - RNA, 19 nt, Homo sapiens
uagcguuuacguuguauuu

SEQ ID NO: 482631 - RNA, 19 nt, Homo sapiens
gugcucaaauaccagagaa

SEQ ID NO: 482632 - RNA, 19 nt, Homo sapiens
ugagggcaguucugagugu

SEQ ID NO: 482633 - RNA, 19 nt, Homo sapiens
ucaaauaccagagaagauc

SEQ ID NO: 482634 - RNA, 19 nt, Homo sapiens
gucaucaggugcauagcaa

SEQ ID NO: 482635 - RNA, 19 nt, Homo sapiens
cagaacacacacaacauug

SEQ ID NO: 482636 - RNA, 19 nt, Homo sapiens
caacuaccucugagaagau

SEQ ID NO: 482637 - RNA, 19 nt, Homo sapiens
cagcagaggaaggaaauga

SEQ ID NO: 482638 - RNA, 19 nt, Homo sapiens
gacuuucucucucuuucga

SEQ ID NO: 482639 - RNA, 19 nt, Homo sapiens
gcagaacguggugaccuuu

SEQ ID NO: 482640 - RNA, 19 nt, Homo sapiens
gaagccagcagaggaagga

SEQ ID NO: 482641 - RNA, 19 nt, Homo sapiens
gaacguccucagaugacuu

SEQ ID NO: 482642 - RNA, 19 nt, Homo sapiens
guucugaguguuuaauuuc

SEQ ID NO: 482643 - RNA, 19 nt, Homo sapiens
ggagacgacgccuuugcaa

SEQ ID NO: 482644 - RNA, 19 nt, Homo sapiens
cagcgacccugaggaagau

SEQ ID NO: 482645 - RNA, 19 nt, Homo sapiens
ccacagacugcgugagaga

SEQ ID NO: 482646 - RNA, 19 nt, Homo sapiens
gaagaucaugcccaagaag

SEQ ID NO: 482647 - RNA, 19 nt, Homo sapiens
ccucccaccuuucaugugu

SEQ ID NO: 482648 - RNA, 19 nt, Homo sapiens
ggaggaagugccagaagca

SEQ ID NO: 482649 - RNA, 19 nt, Homo sapiens
gcauagcaagugaaagcaa

SEQ ID NO: 482650 - RNA, 19 nt, Homo sapiens
guugaacguccucagauga

SEQ ID NO: 482651 - RNA, 19 nt, Homo sapiens
auaaaccuuugcaaacguu

SEQ ID NO: 482652 - RNA, 19 nt, Homo sapiens
uauccaugcaccuaccuua

SEQ ID NO: 482653 - RNA, 19 nt, Homo sapiens
aacagcuggugauuuauga

SEQ ID NO: 482654 - RNA, 19 nt, Homo sapiens
aaauagggaggcccaagaa

SEQ ID NO: 482655 - RNA, 19 nt, Homo sapiens
cacaccaaguaccaguaua

SEQ ID NO: 482656 - RNA, 19 nt, Homo sapiens
gagggcaguucugaguguu

SEQ ID NO: 482657 - RNA, 19 nt, Homo sapiens
gcuggugauuuaugaagag

SEQ ID NO: 482658 - RNA, 19 nt, Homo sapiens
ggaagagagacgcggaaca

SEQ ID NO: 482659 - RNA, 19 nt, Homo sapiens
guacuccccucauccgauu

SEQ ID NO: 482660 - RNA, 19 nt, Homo sapiens
agaacguggugaccuuuca

SEQ ID NO: 482661 - RNA, 19 nt, Homo sapiens
agagaaaguaugaggcuau

SEQ ID NO: 482662 - RNA, 19 nt, Homo sapiens
guauaagcaucugccaucu

SEQ ID NO: 482663 - RNA, 19 nt, Homo sapiens
ucccaccuuucauguguaa

SEQ ID NO: 482664 - RNA, 19 nt, Homo sapiens
ggcuaugacuaaacuaggu

SEQ ID NO: 482665 - RNA, 19 nt, Homo sapiens
cacacacacacaccaagua

SEQ ID NO: 482666 - RNA, 19 nt, Homo sapiens
gcaagacauacuuaaugca

SEQ ID NO: 482667 - RNA, 19 nt, Homo sapiens
ugagcaagacauacuuaau

SEQ ID NO: 482668 - RNA, 19 nt, Homo sapiens
gaaaacagcuggugauuua

SEQ ID NO: 482669 - RNA, 19 nt, Homo sapiens
ggaaugauuuggauaauga

SEQ ID NO: 482670 - RNA, 19 nt, Homo sapiens
gaacggagacgacgccuuu

SEQ ID NO: 482671 - RNA, 19 nt, Homo sapiens
ugaggaagaugacgaguaa

SEQ ID NO: 482672 - RNA, 19 nt, Homo sapiens
cgagagaucuggacccaaa

SEQ ID NO: 482673 - RNA, 19 nt, Homo sapiens
ccaaauacuucucuaagga

SEQ ID NO: 482674 - RNA, 19 nt, Homo sapiens
gaaagcaaguguucacaac

SEQ ID NO: 482675 - RNA, 19 nt, Homo sapiens
gaugaaagccucggagaaa

SEQ ID NO: 482676 - RNA, 19 nt, Homo sapiens
gagcaagacauacuuaaug

SEQ ID NO: 482677 - RNA, 19 nt, Homo sapiens
gggcaguucugaguguuua

SEQ ID NO: 482678 - RNA, 19 nt, Homo sapiens
caaaaggccuucgaugaua

SEQ ID NO: 482679 - RNA, 19 nt, Homo sapiens
gaugagcaagacauacuua

SEQ ID NO: 482680 - RNA, 19 nt, Homo sapiens
ccaacuaccucugagaaga

SEQ ID NO: 482681 - RNA, 19 nt, Homo sapiens
gaaaugauucggaggaagu

SEQ ID NO: 482682 - RNA, 19 nt, Homo sapiens
gcagaggaaggaaaugauu

SEQ ID NO: 482683 - RNA, 19 nt, Homo sapiens
gccaagaguucgauguuag

SEQ ID NO: 482684 - RNA, 19 nt, Homo sapiens
cgaagaucaugcccaagaa

SEQ ID NO: 482685 - RNA, 19 nt, Homo sapiens
gagaaaguaugaggcuaug

SEQ ID NO: 482686 - RNA, 19 nt, Homo sapiens
gggaaugauuuggauaaug

SEQ ID NO: 482687 - RNA, 19 nt, Homo sapiens
cacgguuggugcucaaaua

SEQ ID NO: 482688 - RNA, 19 nt, Homo sapiens
ccaugcaccuaccuuagaa

SEQ ID NO: 482689 - RNA, 19 nt, Homo sapiens
ccaccuuucauguguaaua

SEQ ID NO: 482690 - RNA, 19 nt, Homo sapiens
caaauacuucucuaaggaa

SEQ ID NO: 482691 - RNA, 19 nt, Homo sapiens
agaagcaucuggcccacaa

SEQ ID NO: 482692 - RNA, 19 nt, Homo sapiens
caagaagccagcagaggaa

SEQ ID NO: 482693 - RNA, 19 nt, Homo sapiens
aguaugaggcuaugacuaa

SEQ ID NO: 482694 - RNA, 19 nt, Homo sapiens
uaauaaaccuuugcaaacg

SEQ ID NO: 482695 - RNA, 19 nt, Homo sapiens
ccaaguaccaguauaagca

SEQ ID NO: 482696 - RNA, 19 nt, Homo sapiens
ugagaagauucacgagaga

SEQ ID NO: 482697 - RNA, 19 nt, Homo sapiens
guaugaggcuaugacuaaa

SEQ ID NO: 482698 - RNA, 19 nt, Homo sapiens
gccaaauacuucucuaagg

SEQ ID NO: 482699 - RNA, 19 nt, Homo sapiens
ugccaagaguucgauguua

SEQ ID NO: 482700 - RNA, 19 nt, Homo sapiens
caagugaaagcaaguguuc

SEQ ID NO: 482701 - RNA, 19 nt, Homo sapiens
gguugaacguccucagaug

SEQ ID NO: 482702 - RNA, 19 nt, Homo sapiens
gcucugacuuucucucucu

SEQ ID NO: 482703 - RNA, 19 nt, Homo sapiens
gcucaaauaccagagaaga

SEQ ID NO: 482704 - RNA, 19 nt, Homo sapiens
acaccaaguaccaguauaa

SEQ ID NO: 482705 - RNA, 19 nt, Homo sapiens
ggugauuuaugaagagauc

SEQ ID NO: 482706 - RNA, 19 nt, Homo sapiens
gaaaguaugaggcuaugac

SEQ ID NO: 482707 - RNA, 19 nt, Homo sapiens
acacacacacgcacacaaa

SEQ ID NO: 482708 - RNA, 19 nt, Homo sapiens
gcaccuaccuuagaaaaca

SEQ ID NO: 482709 - RNA, 19 nt, Homo sapiens
gcaagugaaagcaaguguu

SEQ ID NO: 482710 - RNA, 19 nt, Homo sapiens
ucaggugcauagcaaguga

SEQ ID NO: 482711 - RNA, 19 nt, Homo sapiens
gaaaaccaacuaccucuga

SEQ ID NO: 482712 - RNA, 19 nt, Homo sapiens
ggaagugccagaagcaucu

SEQ ID NO: 482713 - RNA, 19 nt, Homo sapiens
caccuuucauguguaauaa

SEQ ID NO: 482714 - RNA, 19 nt, Homo sapiens
gacaguuaauaaaccuuug

SEQ ID NO: 482715 - RNA, 19 nt, Homo sapiens
caagacauacuuaaugcau

SEQ ID NO: 482716 - RNA, 19 nt, Homo sapiens
gucauucuguuagauacua

SEQ ID NO: 482717 - RNA, 19 nt, Homo sapiens
uguuagcguuuacguugua

SEQ ID NO: 482718 - RNA, 19 nt, Homo sapiens
aaacagcuggugauuuaug

SEQ ID NO: 482719 - RNA, 19 nt, Homo sapiens
ccgaagaucaugcccaaga

SEQ ID NO: 482720 - RNA, 19 nt, Homo sapiens
acacaaaccacaccacaca

SEQ ID NO: 482721 - RNA, 19 nt, Homo sapiens
uagcguuuacguuguauuu

SEQ ID NO: 482722 - RNA, 19 nt, Homo sapiens
gugcucaaauaccagagaa

SEQ ID NO: 482723 - RNA, 19 nt, Homo sapiens
ugagggcaguucugagugu

SEQ ID NO: 482724 - RNA, 19 nt, Homo sapiens
gucaucaggugcauagcaa

SEQ ID NO: 482725 - RNA, 19 nt, Homo sapiens
caacuaccucugagaagau

SEQ ID NO: 482726 - RNA, 19 nt, Homo sapiens
cagcagaggaaggaaauga

SEQ ID NO: 482727 - RNA, 19 nt, Homo sapiens
ucaaauaccagagaagauc

SEQ ID NO: 482728 - RNA, 19 nt, Homo sapiens
gacuuucucucucuuucga

SEQ ID NO: 482729 - RNA, 19 nt, Homo sapiens
gcagaacguggugaccuuu

SEQ ID NO: 482730 - RNA, 19 nt, Homo sapiens
gaagccagcagaggaagga

SEQ ID NO: 482731 - RNA, 19 nt, Homo sapiens
gaacguccucagaugacuu

SEQ ID NO: 482732 - RNA, 19 nt, Homo sapiens
guucugaguguuuaauuuc

SEQ ID NO: 482733 - RNA, 19 nt, Homo sapiens
ggagacgacgccuuugcaa

SEQ ID NO: 482734 - RNA, 19 nt, Homo sapiens
cagcgacccugaggaagau

SEQ ID NO: 482735 - RNA, 19 nt, Homo sapiens
ccacagacugcgugagaga

SEQ ID NO: 482736 - RNA, 19 nt, Homo sapiens
gaagaucaugcccaagaag

SEQ ID NO: 482737 - RNA, 19 nt, Homo sapiens
ccucccaccuuucaugugu

SEQ ID NO: 482738 - RNA, 19 nt, Homo sapiens
ggaggaagugccagaagca

SEQ ID NO: 482739 - RNA, 19 nt, Homo sapiens
gcauagcaagugaaagcaa

SEQ ID NO: 482740 - RNA, 19 nt, Homo sapiens
guugaacguccucagauga

SEQ ID NO: 482741 - RNA, 19 nt, Homo sapiens
auaaaccuuugcaaacguu

SEQ ID NO: 482742 - RNA, 19 nt, Homo sapiens
uauccaugcaccuaccuua

SEQ ID NO: 482743 - RNA, 19 nt, Homo sapiens
aacagcuggugauuuauga

SEQ ID NO: 482744 - RNA, 19 nt, Homo sapiens
cacaccaaguaccaguaua

SEQ ID NO: 482745 - RNA, 19 nt, Homo sapiens
gagggcaguucugaguguu

SEQ ID NO: 482746 - RNA, 19 nt, Homo sapiens
gcuggugauuuaugaagag

SEQ ID NO: 482747 - RNA, 19 nt, Homo sapiens
guacuccccucauccgauu

SEQ ID NO: 482748 - RNA, 19 nt, Homo sapiens
agaacguggugaccuuuca

SEQ ID NO: 482749 - RNA, 19 nt, Homo sapiens
agagaaaguaugaggcuau

SEQ ID NO: 482750 - RNA, 19 nt, Homo sapiens
guauaagcaucugccaucu

SEQ ID NO: 482751 - RNA, 19 nt, Homo sapiens
ucccaccuuucauguguaa

SEQ ID NO: 482752 - RNA, 19 nt, Homo sapiens
ggcuaugacuaaacuaggu

SEQ ID NO: 482753 - RNA, 19 nt, Homo sapiens
cacacacacacaccaagua

SEQ ID NO: 482754 - RNA, 19 nt, Homo sapiens
gaguacgcacggucugauu

SEQ ID NO: 482755 - RNA, 19 nt, Homo sapiens
gcaagacauacuuaaugca

SEQ ID NO: 482756 - RNA, 19 nt, Homo sapiens
ugagcaagacauacuuaau

SEQ ID NO: 482757 - RNA, 19 nt, Homo sapiens
cucuuucgauucuuccaua

SEQ ID NO: 482758 - RNA, 19 nt, Homo sapiens
gugcauagcaagugaaagc

SEQ ID NO: 482759 - RNA, 19 nt, Homo sapiens
gaggcuaugacuaaacuag

SEQ ID NO: 482760 - RNA, 19 nt, Homo sapiens
aauaaaccuuugcaaacgu

SEQ ID NO: 482761 - RNA, 19 nt, Homo sapiens
ccacacacacacacacaca

SEQ ID NO: 482762 - RNA, 19 nt, Homo sapiens
ccaaaaggccuucgaugau

SEQ ID NO: 482763 - RNA, 19 nt, Homo sapiens
aggccacccucccaccuuu

SEQ ID NO: 482764 - RNA, 19 nt, Homo sapiens
gugccaagaguucgauguu

SEQ ID NO: 482765 - RNA, 19 nt, Homo sapiens
gcaguucugaguguuuaau

SEQ ID NO: 482766 - RNA, 19 nt, Homo sapiens
gaaaaguugagcgucauuu

SEQ ID NO: 482767 - RNA, 19 nt, Homo sapiens
cagaggaaggaaaugauuc

SEQ ID NO: 482768 - RNA, 19 nt, Homo sapiens
gaaagcaacuggugauuua

SEQ ID NO: 482769 - RNA, 19 nt, Homo sapiens
gaacggagacgaugccuuu

SEQ ID NO: 482770 - RNA, 19 nt, Homo sapiens
ucaggaagaugacgaguaa

SEQ ID NO: 482771 - RNA, 19 nt, Homo sapiens
aaacaaguaucgucaggua

SEQ ID NO: 482772 - RNA, 19 nt, Homo sapiens
caagacaucuggacccaaa

SEQ ID NO: 482773 - RNA, 19 nt, Homo sapiens
cauuaaagcucuacugugu

SEQ ID NO: 482774 - RNA, 19 nt, Homo sapiens
gccauucuguuagauauua

SEQ ID NO: 482775 - RNA, 19 nt, Homo sapiens
gaaagcaaguguucacaac

SEQ ID NO: 482776 - RNA, 19 nt, Homo sapiens
gaugaaagccucggagaaa

SEQ ID NO: 482777 - RNA, 19 nt, Homo sapiens
gagcaagacauacuuaaug

SEQ ID NO: 482778 - RNA, 19 nt, Homo sapiens
gcuagggccuucgaugaua

SEQ ID NO: 482779 - RNA, 19 nt, Homo sapiens
gggcaguucugaguguuua

SEQ ID NO: 482780 - RNA, 19 nt, Homo sapiens
gaauacauuuggugaaucu

SEQ ID NO: 482781 - RNA, 19 nt, Homo sapiens
uaggguugguucucaaaua

SEQ ID NO: 482782 - RNA, 19 nt, Homo sapiens
gaugagcaagacauacuua

SEQ ID NO: 482783 - RNA, 19 nt, Homo sapiens
gaucagcgacccucaggaa

SEQ ID NO: 482784 - RNA, 19 nt, Homo sapiens
cggagacgaugccuuugua

SEQ ID NO: 482785 - RNA, 19 nt, Homo sapiens
gcagaggaaggaaaugauu

SEQ ID NO: 482786 - RNA, 19 nt, Homo sapiens
gagccagccagcagcauua

SEQ ID NO: 482787 - RNA, 19 nt, Homo sapiens
acacuacccuccucucuuc

SEQ ID NO: 482788 - RNA, 19 nt, Homo sapiens
gccaagaguucgauguuag

SEQ ID NO: 482789 - RNA, 19 nt, Homo sapiens
gauguuaguguuucuguug

SEQ ID NO: 482790 - RNA, 19 nt, Homo sapiens
gaagaucacgcccgagaag

SEQ ID NO: 482791 - RNA, 19 nt, Homo sapiens
ggaauacauuuggugaauc

SEQ ID NO: 482792 - RNA, 19 nt, Homo sapiens
gcauauuucaguuugugua

SEQ ID NO: 482793 - RNA, 19 nt, Homo sapiens
uaauaaaccuuugcaaacg

SEQ ID NO: 482794 - RNA, 19 nt, Homo sapiens
ucccagaugugaccacuga

SEQ ID NO: 482795 - RNA, 19 nt, Homo sapiens
agaguucgauguuaguguu

SEQ ID NO: 482796 - RNA, 19 nt, Homo sapiens
ccaccuuucaugcguaaua

SEQ ID NO: 482797 - RNA, 19 nt, Homo sapiens
gaccuaggguugguucuca

SEQ ID NO: 482798 - RNA, 19 nt, Homo sapiens
acaaguaucgucagguauu

SEQ ID NO: 482799 - RNA, 19 nt, Homo sapiens
ugccaagaguucgauguua

SEQ ID NO: 482800 - RNA, 19 nt, Homo sapiens
caagugaaagcaaguguuc

SEQ ID NO: 482801 - RNA, 19 nt, Homo sapiens
ucagguguauagcaaguga

SEQ ID NO: 482802 - RNA, 19 nt, Homo sapiens
ccacagagugcgugagaga

SEQ ID NO: 482803 - RNA, 19 nt, Homo sapiens
ucaaauaccagagaagaug

SEQ ID NO: 482804 - RNA, 19 nt, Homo sapiens
ggccaugacuaaacuaggu

SEQ ID NO: 482805 - RNA, 19 nt, Homo sapiens
aguaugaggccaugacuaa

SEQ ID NO: 482806 - RNA, 19 nt, Homo sapiens
gugccauucuguuagauau

SEQ ID NO: 482807 - RNA, 19 nt, Homo sapiens
ggugauuuaugaagagauc

SEQ ID NO: 482808 - RNA, 19 nt, Homo sapiens
gaagggagugccagaagca

SEQ ID NO: 482809 - RNA, 19 nt, Homo sapiens
uggaauacauuuggugaau

SEQ ID NO: 482810 - RNA, 19 nt, Homo sapiens
gcacacacacacacacaca

SEQ ID NO: 482811 - RNA, 19 nt, Homo sapiens
caaguaucgucagguauuc

SEQ ID NO: 482812 - RNA, 19 nt, Homo sapiens
gcaagugaaagcaaguguu

SEQ ID NO: 482813 - RNA, 19 nt, Homo sapiens
aagcaucccuggagacaag

SEQ ID NO: 482814 - RNA, 19 nt, Homo sapiens
gucaucagguguauagcaa

SEQ ID NO: 482815 - RNA, 19 nt, Homo sapiens
gagaaaaucaucuaugugu

SEQ ID NO: 482816 - RNA, 19 nt, Homo sapiens
ccaugcaccuaccucagaa

SEQ ID NO: 482817 - RNA, 19 nt, Homo sapiens
caagacauacuuaaugcau

SEQ ID NO: 482818 - RNA, 19 nt, Homo sapiens
caucagguguauagcaagu

SEQ ID NO: 482819 - RNA, 19 nt, Homo sapiens
agaaagcaacuggugauuu

SEQ ID NO: 482820 - RNA, 19 nt, Homo sapiens
ugagaagguuaacaagaca

SEQ ID NO: 482821 - RNA, 19 nt, Homo sapiens
gaaaguaugaggccaugac

SEQ ID NO: 482822 - RNA, 19 nt, Homo sapiens
gcaccuaccucagaaaaca

SEQ ID NO: 482823 - RNA, 19 nt, Homo sapiens
gagaaagcaacuggugauu

SEQ ID NO: 482824 - RNA, 19 nt, Homo sapiens
caccuuucaugcguaauaa

SEQ ID NO: 482825 - RNA, 19 nt, Homo sapiens
acacaaacacacacacaug

SEQ ID NO: 482826 - RNA, 19 nt, Homo sapiens
ugagggcaguucugagugu

SEQ ID NO: 482827 - RNA, 19 nt, Homo sapiens
cagcagaggaaggaaauga

SEQ ID NO: 482828 - RNA, 19 nt, Homo sapiens
gagaaagagugggaaaaga

SEQ ID NO: 482829 - RNA, 19 nt, Homo sapiens
cagcagcauuaaagcucua

SEQ ID NO: 482830 - RNA, 19 nt, Homo sapiens
gcagaacguggugaccuuu

SEQ ID NO: 482831 - RNA, 19 nt, Homo sapiens
aaacuaaauaccucugaga

SEQ ID NO: 482832 - RNA, 19 nt, Homo sapiens
gaagccagcagaggaagga

SEQ ID NO: 482833 - RNA, 19 nt, Homo sapiens
cgagaagccagcagaggaa

SEQ ID NO: 482834 - RNA, 19 nt, Homo sapiens
guucugaguguuuaauuuc

SEQ ID NO: 482835 - RNA, 19 nt, Homo sapiens
ccuccucucuucccagaug

SEQ ID NO: 482836 - RNA, 19 nt, Homo sapiens
cagcgacccucaggaagau

SEQ ID NO: 482837 - RNA, 19 nt, Homo sapiens
gcauuuacacaaacacaca

SEQ ID NO: 482838 - RNA, 19 nt, Homo sapiens
caacuggugauuuaugaag

SEQ ID NO: 482839 - RNA, 19 nt, Homo sapiens
cugagaagguuaacaagac

SEQ ID NO: 482840 - RNA, 19 nt, Homo sapiens
ccucugagaagguuaacaa

SEQ ID NO: 482841 - RNA, 19 nt, Homo sapiens
auaaacgggucgcagacuu

SEQ ID NO: 482842 - RNA, 19 nt, Homo sapiens
guauaggcaucucccaacu

SEQ ID NO: 482843 - RNA, 19 nt, Homo sapiens
guuaguguuucuguuguau

SEQ ID NO: 482844 - RNA, 19 nt, Homo sapiens
gcggaucccucgucaucag

SEQ ID NO: 482845 - RNA, 19 nt, Homo sapiens
acagagugcgugagagaaa

SEQ ID NO: 482846 - RNA, 19 nt, Homo sapiens
cuagggccuucgaugauau

SEQ ID NO: 482847 - RNA, 19 nt, Homo sapiens
auaaaccuuugcaaacguu

SEQ ID NO: 482848 - RNA, 19 nt, Homo sapiens
gcaacuggugauuuaugaa

SEQ ID NO: 482849 - RNA, 19 nt, Homo sapiens
agcaacuggugauuuauga

SEQ ID NO: 482850 - RNA, 19 nt, Homo sapiens
cagagaagaugcaaaagca

SEQ ID NO: 482851 - RNA, 19 nt, Homo sapiens
cacaccaaguaccaguaua

SEQ ID NO: 482852 - RNA, 19 nt, Homo sapiens
gagggcaguucugaguguu

SEQ ID NO: 482853 - RNA, 19 nt, Homo sapiens
guacuccccucauccgauu

SEQ ID NO: 482854 - RNA, 19 nt, Homo sapiens
uguuaguguuucuguugua

SEQ ID NO: 482855 - RNA, 19 nt, Homo sapiens
agaacguggugaccuuuca

SEQ ID NO: 482856 - RNA, 19 nt, Homo sapiens
ucagcgacccucaggaaga

SEQ ID NO: 482857 - RNA, 19 nt, Homo sapiens
aagcuagggccuucgauga

SEQ ID NO: 482858 - RNA, 19 nt, Homo sapiens
gccaguuaauaaaccuuug

SEQ ID NO: 482859 - RNA, 19 nt, Homo sapiens
caacacuacccuccucucu

SEQ ID NO: 482860 - RNA, 19 nt, Homo sapiens
cggagaaaaucaucuaugu

SEQ ID NO: 482861 - RNA, 19 nt, Homo sapiens
cacacacacacaccaagua

SEQ ID NO: 482862 - RNA, 19 nt, Homo sapiens
ucuggaaggugggaagaga

SEQ ID NO: 482863 - RNA, 19 nt, Homo sapiens
gcaagacauacuuaaugca

SEQ ID NO: 482864 - RNA, 19 nt, Homo sapiens
ugagcaagacauacuuaau

SEQ ID NO: 482865 - RNA, 19 nt, Homo sapiens
cgauguuaguguuucuguu

SEQ ID NO: 482866 - RNA, 19 nt, Homo sapiens
uaaacgggucgcagacuuc

SEQ ID NO: 482867 - RNA, 19 nt, Homo sapiens
gaaagagugggaaaagaug

SEQ ID NO: 482868 - RNA, 19 nt, Homo sapiens
gaaagcaacuggugauuua

SEQ ID NO: 482869 - RNA, 19 nt, Homo sapiens
gaacggagacgaugccuuu

SEQ ID NO: 482870 - RNA, 19 nt, Homo sapiens
ucaggaagaugacgaguaa

SEQ ID NO: 482871 - RNA, 19 nt, Homo sapiens
aaacaaguaucgucaggua

SEQ ID NO: 482872 - RNA, 19 nt, Homo sapiens
caagacaucuggacccaaa

SEQ ID NO: 482873 - RNA, 19 nt, Homo sapiens
gccauucuguuagauauua

SEQ ID NO: 482874 - RNA, 19 nt, Homo sapiens
gaaagcaaguguucacaac

SEQ ID NO: 482875 - RNA, 19 nt, Homo sapiens
gaugaaagccucggagaaa

SEQ ID NO: 482876 - RNA, 19 nt, Homo sapiens
gagcaagacauacuuaaug

SEQ ID NO: 482877 - RNA, 19 nt, Homo sapiens
gggcaguucugaguguuua

SEQ ID NO: 482878 - RNA, 19 nt, Homo sapiens
caaaaggccuucgaugaua

SEQ ID NO: 482879 - RNA, 19 nt, Homo sapiens
uaggguugguucucaaaua

SEQ ID NO: 482880 - RNA, 19 nt, Homo sapiens
gaugagcaagacauacuua

SEQ ID NO: 482881 - RNA, 19 nt, Homo sapiens
gaucagcgacccucaggaa

SEQ ID NO: 482882 - RNA, 19 nt, Homo sapiens
cggagacgaugccuuugua

SEQ ID NO: 482883 - RNA, 19 nt, Homo sapiens
gcagaggaaggaaaugauu

SEQ ID NO: 482884 - RNA, 19 nt, Homo sapiens
acacuacccuccucucuuc

SEQ ID NO: 482885 - RNA, 19 nt, Homo sapiens
gccaagaguucgauguuag

SEQ ID NO: 482886 - RNA, 19 nt, Homo sapiens
gauguuaguguuucuguug

SEQ ID NO: 482887 - RNA, 19 nt, Homo sapiens
gaagaucacgcccgagaag

SEQ ID NO: 482888 - RNA, 19 nt, Homo sapiens
gcauauuucaguuugugua

SEQ ID NO: 482889 - RNA, 19 nt, Homo sapiens
uaauaaaccuuugcaaacg

SEQ ID NO: 482890 - RNA, 19 nt, Homo sapiens
ucccagaugugaccacuga

SEQ ID NO: 482891 - RNA, 19 nt, Homo sapiens
agaguucgauguuaguguu

SEQ ID NO: 482892 - RNA, 19 nt, Homo sapiens
ccaccuuucaugcguaaua

SEQ ID NO: 482893 - RNA, 19 nt, Homo sapiens
acaaguaucgucagguauu

SEQ ID NO: 482894 - RNA, 19 nt, Homo sapiens
ugccaagaguucgauguua

SEQ ID NO: 482895 - RNA, 19 nt, Homo sapiens
gaccuaggguugguucuca

SEQ ID NO: 482896 - RNA, 19 nt, Homo sapiens
caagugaaagcaaguguuc

SEQ ID NO: 482897 - RNA, 19 nt, Homo sapiens
ucagguguauagcaaguga

SEQ ID NO: 482898 - RNA, 19 nt, Homo sapiens
ccacagagugcgugagaga

SEQ ID NO: 482899 - RNA, 19 nt, Homo sapiens
ggccaugacuaaacuaggu

SEQ ID NO: 482900 - RNA, 19 nt, Homo sapiens
aguaugaggccaugacuaa

SEQ ID NO: 482901 - RNA, 19 nt, Homo sapiens
ucaaauaccagagaagaug

SEQ ID NO: 482902 - RNA, 19 nt, Homo sapiens
gugccauucuguuagauau

SEQ ID NO: 482903 - RNA, 19 nt, Homo sapiens
ggugauuuaugaagagauc

SEQ ID NO: 482904 - RNA, 19 nt, Homo sapiens
gaagggagugccagaagca

SEQ ID NO: 482905 - RNA, 19 nt, Homo sapiens
gcacacacacacacacaca

SEQ ID NO: 482906 - RNA, 19 nt, Homo sapiens
caaguaucgucagguauuc

SEQ ID NO: 482907 - RNA, 19 nt, Homo sapiens
gcaagugaaagcaaguguu

SEQ ID NO: 482908 - RNA, 19 nt, Homo sapiens
gcaaaaggccuucgaugau

SEQ ID NO: 482909 - RNA, 19 nt, Homo sapiens
gucaucagguguauagcaa

SEQ ID NO: 482910 - RNA, 19 nt, Homo sapiens
gagaaaaucaucuaugugu

SEQ ID NO: 482911 - RNA, 19 nt, Homo sapiens
ccaugcaccuaccucagaa

SEQ ID NO: 482912 - RNA, 19 nt, Homo sapiens
caagacauacuuaaugcau

SEQ ID NO: 482913 - RNA, 19 nt, Homo sapiens
caucagguguauagcaagu

SEQ ID NO: 482914 - RNA, 19 nt, Homo sapiens
agaaagcaacuggugauuu

SEQ ID NO: 482915 - RNA, 19 nt, Homo sapiens
ugagaagguuaacaagaca

SEQ ID NO: 482916 - RNA, 19 nt, Homo sapiens
gaaaguaugaggccaugac

SEQ ID NO: 482917 - RNA, 19 nt, Homo sapiens
gcaccuaccucagaaaaca

SEQ ID NO: 482918 - RNA, 19 nt, Homo sapiens
gagaaagcaacuggugauu

SEQ ID NO: 482919 - RNA, 19 nt, Homo sapiens
caccuuucaugcguaauaa

SEQ ID NO: 482920 - RNA, 19 nt, Homo sapiens
acacaaacacacacacaug

SEQ ID NO: 482921 - RNA, 19 nt, Homo sapiens
ugagggcaguucugagugu

SEQ ID NO: 482922 - RNA, 19 nt, Homo sapiens
cagcagaggaaggaaauga

SEQ ID NO: 482923 - RNA, 19 nt, Homo sapiens
gagaaagagugggaaaaga

SEQ ID NO: 482924 - RNA, 19 nt, Homo sapiens
gcagaacguggugaccuuu

SEQ ID NO: 482925 - RNA, 19 nt, Homo sapiens
aaacuaaauaccucugaga

SEQ ID NO: 482926 - RNA, 19 nt, Homo sapiens
gaagccagcagaggaagga

SEQ ID NO: 482927 - RNA, 19 nt, Homo sapiens
cgagaagccagcagaggaa

SEQ ID NO: 482928 - RNA, 19 nt, Homo sapiens
guucugaguguuuaauuuc

SEQ ID NO: 482929 - RNA, 19 nt, Homo sapiens
ccuccucucuucccagaug

SEQ ID NO: 482930 - RNA, 19 nt, Homo sapiens
cagcgacccucaggaagau

SEQ ID NO: 482931 - RNA, 19 nt, Homo sapiens
gcauuuacacaaacacaca

SEQ ID NO: 482932 - RNA, 19 nt, Homo sapiens
caacuggugauuuaugaag

SEQ ID NO: 482933 - RNA, 19 nt, Homo sapiens
cugagaagguuaacaagac

SEQ ID NO: 482934 - RNA, 19 nt, Homo sapiens
ccucugagaagguuaacaa

SEQ ID NO: 482935 - RNA, 19 nt, Homo sapiens
auaaacgggucgcagacuu

SEQ ID NO: 482936 - RNA, 19 nt, Homo sapiens
guauaggcaucucccaacu

SEQ ID NO: 482937 - RNA, 19 nt, Homo sapiens
guuaguguuucuguuguau

SEQ ID NO: 482938 - RNA, 19 nt, Homo sapiens
gcggaucccucgucaucag

SEQ ID NO: 482939 - RNA, 19 nt, Homo sapiens
acagagugcgugagagaaa

SEQ ID NO: 482940 - RNA, 19 nt, Homo sapiens
auaaaccuuugcaaacguu

SEQ ID NO: 482941 - RNA, 19 nt, Homo sapiens
gcaacuggugauuuaugaa

SEQ ID NO: 482942 - RNA, 19 nt, Homo sapiens
agcaacuggugauuuauga

SEQ ID NO: 482943 - RNA, 19 nt, Homo sapiens
cacaccaaguaccaguaua

SEQ ID NO: 482944 - RNA, 19 nt, Homo sapiens
gagggcaguucugaguguu

SEQ ID NO: 482945 - RNA, 19 nt, Homo sapiens
guacuccccucauccgauu

SEQ ID NO: 482946 - RNA, 19 nt, Homo sapiens
uguuaguguuucuguugua

SEQ ID NO: 482947 - RNA, 19 nt, Homo sapiens
agaacguggugaccuuuca

SEQ ID NO: 482948 - RNA, 19 nt, Homo sapiens
ucagcgacccucaggaaga

SEQ ID NO: 482949 - RNA, 19 nt, Homo sapiens
gccaguuaauaaaccuuug

SEQ ID NO: 482950 - RNA, 19 nt, Homo sapiens
cggagaaaaucaucuaugu

SEQ ID NO: 482951 - RNA, 19 nt, Homo sapiens
caacacuacccuccucucu

SEQ ID NO: 482952 - RNA, 19 nt, Homo sapiens
cacacacacacaccaagua

SEQ ID NO: 482953 - RNA, 19 nt, Homo sapiens
gcaagacauacuuaaugca

SEQ ID NO: 482954 - RNA, 19 nt, Homo sapiens
ugagcaagacauacuuaau

SEQ ID NO: 482955 - RNA, 19 nt, Homo sapiens
cgauguuaguguuucuguu

SEQ ID NO: 482956 - RNA, 19 nt, Homo sapiens
gaaagagugggaaaagaug

SEQ ID NO: 482957 - RNA, 19 nt, Homo sapiens
uaaacgggucgcagacuuc

SEQ ID NO: 482958 - RNA, 19 nt, Homo sapiens
aauaaaccuuugcaaacgu

SEQ ID NO: 482959 - RNA, 19 nt, Homo sapiens
cugauuguuucgauucuuc

SEQ ID NO: 482960 - RNA, 19 nt, Homo sapiens
gaaaacuaaauaccucuga

SEQ ID NO: 482961 - RNA, 19 nt, Homo sapiens
ggggaaugauuuugauaau

SEQ ID NO: 482962 - RNA, 19 nt, Homo sapiens
aggccacccucccaccuuu

SEQ ID NO: 482963 - RNA, 19 nt, Homo sapiens
gugccaagaguucgauguu

SEQ ID NO: 482964 - RNA, 19 nt, Homo sapiens
guauagcaagugaaagcaa

SEQ ID NO: 482965 - RNA, 19 nt, Homo sapiens
gggaaugauuuugauaaug

SEQ ID NO: 482966 - RNA, 19 nt, Homo sapiens
guaugaggccaugacuaaa

SEQ ID NO: 482967 - RNA, 19 nt, Homo sapiens
ucacucuguuuccuguuca

SEQ ID NO: 482968 - RNA, 19 nt, Homo sapiens
gaaagcagcuggugguuua

SEQ ID NO: 482969 - RNA, 19 nt, Homo sapiens
gaacggagacgacgccuuu

SEQ ID NO: 482970 - RNA, 19 nt, Homo sapiens
ugaggaagaugacgaguaa

SEQ ID NO: 482971 - RNA, 19 nt, Homo sapiens
caagacaucuggacccaaa

SEQ ID NO: 482972 - RNA, 19 nt, Homo sapiens
gaaaggccuucgaugauau

SEQ ID NO: 482973 - RNA, 19 nt, Homo sapiens
gcagugugccauucuguua

SEQ ID NO: 482974 - RNA, 19 nt, Homo sapiens
gaaagcaaguguucacaac

SEQ ID NO: 482975 - RNA, 19 nt, Homo sapiens
uaaacgggcugcagacuuc

SEQ ID NO: 482976 - RNA, 19 nt, Homo sapiens
gccaaauacuucucuaaga

SEQ ID NO: 482977 - RNA, 19 nt, Homo sapiens
cagggaugaugcucaaaua

SEQ ID NO: 482978 - RNA, 19 nt, Homo sapiens
gccauucuguuagacauua

SEQ ID NO: 482979 - RNA, 19 nt, Homo sapiens
gaugaaauccucggagaaa

SEQ ID NO: 482980 - RNA, 19 nt, Homo sapiens
ggucaugacuaaacuaggu

SEQ ID NO: 482981 - RNA, 19 nt, Homo sapiens
gcucaaauaucagagaagu

SEQ ID NO: 482982 - RNA, 19 nt, Homo sapiens
ucagagaaguuacgaaagg

SEQ ID NO: 482983 - RNA, 19 nt, Homo sapiens
cgaagaucaugcccaagaa

SEQ ID NO: 482984 - RNA, 19 nt, Homo sapiens
ggagaagauuaacaagaca

SEQ ID NO: 482985 - RNA, 19 nt, Homo sapiens
ccacaggaaucagguugaa

SEQ ID NO: 482986 - RNA, 19 nt, Homo sapiens
gaaaaucgucuauguguau

SEQ ID NO: 482987 - RNA, 19 nt, Homo sapiens
uaucagagaaguuacgaaa

SEQ ID NO: 482988 - RNA, 19 nt, Homo sapiens
ggaagaaaaugguuugaag

SEQ ID NO: 482989 - RNA, 19 nt, Homo sapiens
gaucgaaaccacaggaauc

SEQ ID NO: 482990 - RNA, 19 nt, Homo sapiens
caagaagccagcagaggaa

SEQ ID NO: 482991 - RNA, 19 nt, Homo sapiens
uaauaaaccuuugcaaacg

SEQ ID NO: 482992 - RNA, 19 nt, Homo sapiens
ccaaguaccaguauaagca

SEQ ID NO: 482993 - RNA, 19 nt, Homo sapiens
gaagccagcagaggaagaa

SEQ ID NO: 482994 - RNA, 19 nt, Homo sapiens
caaguauugucagguauuc

SEQ ID NO: 482995 - RNA, 19 nt, Homo sapiens
caagugaaagcaaguguuc

SEQ ID NO: 482996 - RNA, 19 nt, Homo sapiens
gguugaacguccucagaug

SEQ ID NO: 482997 - RNA, 19 nt, Homo sapiens
guauaagcaucucccaucu

SEQ ID NO: 482998 - RNA, 19 nt, Homo sapiens
acaccaaguaccaguauaa

SEQ ID NO: 482999 - RNA, 19 nt, Homo sapiens
gggaugaugcucaaauauc

SEQ ID NO: 483000 - RNA, 19 nt, Homo sapiens
gcaagugaaagcaaguguu

SEQ ID NO: 483001 - RNA, 19 nt, Homo sapiens
ucaggugcauagcaaguga

SEQ ID NO: 483002 - RNA, 19 nt, Homo sapiens
uggagaagauuaacaagac

SEQ ID NO: 483003 - RNA, 19 nt, Homo sapiens
gacaguuaauaaaccuuug

SEQ ID NO: 483004 - RNA, 19 nt, Homo sapiens
guaccuuggagaagauuaa

SEQ ID NO: 483005 - RNA, 19 nt, Homo sapiens
guaaacgggcugcagacuu

SEQ ID NO: 483006 - RNA, 19 nt, Homo sapiens
gcacacacacacaccaagu

SEQ ID NO: 483007 - RNA, 19 nt, Homo sapiens
ccgaagaucaugcccaaga

SEQ ID NO: 483008 - RNA, 19 nt, Homo sapiens
caaggagacccagggauga

SEQ ID NO: 483009 - RNA, 19 nt, Homo sapiens
gagaaaaucgucuaugugu

SEQ ID NO: 483010 - RNA, 19 nt, Homo sapiens
gucaucaggugcauagcaa

SEQ ID NO: 483011 - RNA, 19 nt, Homo sapiens
gcuggugguuuaugaagag

SEQ ID NO: 483012 - RNA, 19 nt, Homo sapiens
gcagaacguggugaccuuu

SEQ ID NO: 483013 - RNA, 19 nt, Homo sapiens
agaggcaucuggcccacaa

SEQ ID NO: 483014 - RNA, 19 nt, Homo sapiens
gaacguccucagaugacuu

SEQ ID NO: 483015 - RNA, 19 nt, Homo sapiens
ccaccuuucaugcguagua

SEQ ID NO: 483016 - RNA, 19 nt, Homo sapiens
cagcgacccugaggaagau

SEQ ID NO: 483017 - RNA, 19 nt, Homo sapiens
ccacagacugcgugagaga

SEQ ID NO: 483018 - RNA, 19 nt, Homo sapiens
gaagaucaugcccaagaag

SEQ ID NO: 483019 - RNA, 19 nt, Homo sapiens
ggagacgacgccuuugcaa

SEQ ID NO: 483020 - RNA, 19 nt, Homo sapiens
gcauagcaagugaaagcaa

SEQ ID NO: 483021 - RNA, 19 nt, Homo sapiens
guugaacguccucagauga

SEQ ID NO: 483022 - RNA, 19 nt, Homo sapiens
auaaaccuuugcaaacguu

SEQ ID NO: 483023 - RNA, 19 nt, Homo sapiens
uggcguuuccgcuguauuu

SEQ ID NO: 483024 - RNA, 19 nt, Homo sapiens
cacaccaaguaccaguaua

SEQ ID NO: 483025 - RNA, 19 nt, Homo sapiens
ggugguuuaugaagagauc

SEQ ID NO: 483026 - RNA, 19 nt, Homo sapiens
guacuccccucauccgauu

SEQ ID NO: 483027 - RNA, 19 nt, Homo sapiens
agaacguggugaccuuuca

SEQ ID NO: 483028 - RNA, 19 nt, Homo sapiens
ggaaugauuuugguaacga

SEQ ID NO: 483029 - RNA, 19 nt, Homo sapiens
caccuuucaugcguaguaa

SEQ ID NO: 483030 - RNA, 19 nt, Homo sapiens
aaucgucuauguguauaug

SEQ ID NO: 483031 - RNA, 19 nt, Homo sapiens
cacacacacacaccaagua

SEQ ID NO: 483032 - RNA, 19 nt, Homo sapiens
ccagggaugaugcucaaau

SEQ ID NO: 483033 - RNA, 19 nt, Homo sapiens
gcagcuggugguuuaugaa

SEQ ID NO: 483034 - RNA, 19 nt, Homo sapiens
gugcauagcaagugaaagc

SEQ ID NO: 483035 - RNA, 19 nt, Homo sapiens
gaaagagugggaaaagaug

SEQ ID NO: 483036 - RNA, 19 nt, Homo sapiens
agaaagcagcuggugguuu

SEQ ID NO: 483037 - RNA, 19 nt, Homo sapiens
gagaaagcagcuggugguu

SEQ ID NO: 483038 - RNA, 19 nt, Homo sapiens
gaggucaugacuaaacuag

SEQ ID NO: 483039 - RNA, 19 nt, Homo sapiens
aauaaaccuuugcaaacgu

SEQ ID NO: 483040 - RNA, 19 nt, Homo sapiens
gagaagauuaacaagacau

SEQ ID NO: 483041 - RNA, 19 nt, Homo sapiens
cggagaaaaucgucuaugu

SEQ ID NO: 483042 - RNA, 19 nt, Homo sapiens
gcaagacaugcuuaaugca

SEQ ID NO: 483043 - RNA, 19 nt, Homo sapiens
gugccaagaguucgauguu

SEQ ID NO: 483044 - RNA, 19 nt, Homo sapiens
ucacucuguuuccuguuca

SEQ ID NO: 483045 - RNA, 19 nt, Homo sapiens
gaugcucaaauaucagaga

SEQ ID NO: 483046 - RNA, 19 nt, Homo sapiens
ugccaagaguucgauguug

SEQ ID NO: 483047 - RNA, 19 nt, Homo sapiens
agaaaaucgucuaugugua

SEQ ID NO: 483048 - RNA, 19 nt, Homo sapiens
gaaaaguugagcgucauuu

SEQ ID NO: 483049 - RNA, 19 nt, Homo sapiens
ucgucuauguguauaugaa

SEQ ID NO: 483050 - RNA, 19 nt, Homo sapiens
ccacacacgcacacacaca

SEQ ID NO: 483051 - RNA, 19 nt, Homo sapiens
ccccagaugugacuacuga

SEQ ID NO: 483052 - RNA, 19 nt, Homo sapiens
acagacugcgugagagaaa

SEQ ID NO: 483053 - RNA, 19 nt, Homo sapiens
cuucgaugauauugccaaa

SEQ ID NO: 483054 - RNA, 19 nt, Homo sapiens
acacaccaaguaccaguau

SEQ ID NO: 483055 - RNA, 19 nt, Homo sapiens
agugugccauucuguuaga

SEQ ID NO: 483056 - RNA, 19 nt, Homo sapiens
cugaggaagaugacgagua

SEQ ID NO: 483057 - RNA, 19 nt, Homo sapiens
gaaagcagcuggugguuua

SEQ ID NO: 483058 - RNA, 19 nt, Homo sapiens
gaacggagacgacgccuuu

SEQ ID NO: 483059 - RNA, 19 nt, Homo sapiens
ugaggaagaugacgaguaa

SEQ ID NO: 483060 - RNA, 19 nt, Homo sapiens
gaaaggccuucgaugauau

SEQ ID NO: 483061 - RNA, 19 nt, Homo sapiens
gcagugugccauucuguua

SEQ ID NO: 483062 - RNA, 19 nt, Homo sapiens
gaaagcaaguguucacaac

SEQ ID NO: 483063 - RNA, 19 nt, Homo sapiens
uaaacgggcugcagacuuc

SEQ ID NO: 483064 - RNA, 19 nt, Homo sapiens
gccaaauacuucucuaaga

SEQ ID NO: 483065 - RNA, 19 nt, Homo sapiens
cagggaugaugcucaaaua

SEQ ID NO: 483066 - RNA, 19 nt, Homo sapiens
gccauucuguuagacauua

SEQ ID NO: 483067 - RNA, 19 nt, Homo sapiens
gaugaaauccucggagaaa

SEQ ID NO: 483068 - RNA, 19 nt, Homo sapiens
ggucaugacuaaacuaggu

SEQ ID NO: 483069 - RNA, 19 nt, Homo sapiens
gcucaaauaucagagaagu

SEQ ID NO: 483070 - RNA, 19 nt, Homo sapiens
ucagagaaguuacgaaagg

SEQ ID NO: 483071 - RNA, 19 nt, Homo sapiens
ccacaggaaucagguugaa

SEQ ID NO: 483072 - RNA, 19 nt, Homo sapiens
gaaaaucgucuauguguau

SEQ ID NO: 483073 - RNA, 19 nt, Homo sapiens
uaucagagaaguuacgaaa

SEQ ID NO: 483074 - RNA, 19 nt, Homo sapiens
gaucgaaaccacaggaauc

SEQ ID NO: 483075 - RNA, 19 nt, Homo sapiens
uaauaaaccuuugcaaacg

SEQ ID NO: 483076 - RNA, 19 nt, Homo sapiens
ccaaguaccaguauaagca

SEQ ID NO: 483077 - RNA, 19 nt, Homo sapiens
caaguauugucagguauuc

SEQ ID NO: 483078 - RNA, 19 nt, Homo sapiens
caagugaaagcaaguguuc

SEQ ID NO: 483079 - RNA, 19 nt, Homo sapiens
gguugaacguccucagaug

SEQ ID NO: 483080 - RNA, 19 nt, Homo sapiens
guauaagcaucucccaucu

SEQ ID NO: 483081 - RNA, 19 nt, Homo sapiens
acaccaaguaccaguauaa

SEQ ID NO: 483082 - RNA, 19 nt, Homo sapiens
gcaagugaaagcaaguguu

SEQ ID NO: 483083 - RNA, 19 nt, Homo sapiens
ucaggugcauagcaaguga

SEQ ID NO: 483084 - RNA, 19 nt, Homo sapiens
gggaugaugcucaaauauc

SEQ ID NO: 483085 - RNA, 19 nt, Homo sapiens
gacaguuaauaaaccuuug

SEQ ID NO: 483086 - RNA, 19 nt, Homo sapiens
guaaacgggcugcagacuu

SEQ ID NO: 483087 - RNA, 19 nt, Homo sapiens
gcacacacacacaccaagu

SEQ ID NO: 483088 - RNA, 19 nt, Homo sapiens
caaggagacccagggauga

SEQ ID NO: 483089 - RNA, 19 nt, Homo sapiens
gagaaaaucgucuaugugu

SEQ ID NO: 483090 - RNA, 19 nt, Homo sapiens
gucaucaggugcauagcaa

SEQ ID NO: 483091 - RNA, 19 nt, Homo sapiens
gcuggugguuuaugaagag

SEQ ID NO: 483092 - RNA, 19 nt, Homo sapiens
gcagaacguggugaccuuu

SEQ ID NO: 483093 - RNA, 19 nt, Homo sapiens
gaacguccucagaugacuu

SEQ ID NO: 483094 - RNA, 19 nt, Homo sapiens
ccaccuuucaugcguagua

SEQ ID NO: 483095 - RNA, 19 nt, Homo sapiens
ggagacgacgccuuugcaa

SEQ ID NO: 483096 - RNA, 19 nt, Homo sapiens
cagcgacccugaggaagau

SEQ ID NO: 483097 - RNA, 19 nt, Homo sapiens
ccacagacugcgugagaga

SEQ ID NO: 483098 - RNA, 19 nt, Homo sapiens
gcauagcaagugaaagcaa

SEQ ID NO: 483099 - RNA, 19 nt, Homo sapiens
guugaacguccucagauga

SEQ ID NO: 483100 - RNA, 19 nt, Homo sapiens
auaaaccuuugcaaacguu

SEQ ID NO: 483101 - RNA, 19 nt, Homo sapiens
uggcguuuccgcuguauuu

SEQ ID NO: 483102 - RNA, 19 nt, Homo sapiens
cacaccaaguaccaguaua

SEQ ID NO: 483103 - RNA, 19 nt, Homo sapiens
ggugguuuaugaagagauc

SEQ ID NO: 483104 - RNA, 19 nt, Homo sapiens
guacuccccucauccgauu

SEQ ID NO: 483105 - RNA, 19 nt, Homo sapiens
agaacguggugaccuuuca

SEQ ID NO: 483106 - RNA, 19 nt, Homo sapiens
ggaaugauuuugguaacga

SEQ ID NO: 483107 - RNA, 19 nt, Homo sapiens
caccuuucaugcguaguaa

SEQ ID NO: 483108 - RNA, 19 nt, Homo sapiens
aaucgucuauguguauaug

SEQ ID NO: 483109 - RNA, 19 nt, Homo sapiens
cacacacacacaccaagua

SEQ ID NO: 483110 - RNA, 19 nt, Homo sapiens
ccagggaugaugcucaaau

SEQ ID NO: 483111 - RNA, 19 nt, Homo sapiens
gcagcuggugguuuaugaa

SEQ ID NO: 483112 - RNA, 19 nt, Homo sapiens
gugcauagcaagugaaagc

SEQ ID NO: 483113 - RNA, 19 nt, Homo sapiens
agaaagcagcuggugguuu

SEQ ID NO: 483114 - RNA, 19 nt, Homo sapiens
gagaaagcagcuggugguu

SEQ ID NO: 483115 - RNA, 19 nt, Homo sapiens
gaaagagugggaaaagaug

SEQ ID NO: 483116 - RNA, 19 nt, Homo sapiens
gaggucaugacuaaacuag

SEQ ID NO: 483117 - RNA, 19 nt, Homo sapiens
aauaaaccuuugcaaacgu

SEQ ID NO: 483118 - RNA, 19 nt, Homo sapiens
cggagaaaaucgucuaugu

SEQ ID NO: 483119 - RNA, 19 nt, Homo sapiens
gcaagacaugcuuaaugca

SEQ ID NO: 483120 - RNA, 19 nt, Homo sapiens
gugccaagaguucgauguu

SEQ ID NO: 483121 - RNA, 19 nt, Homo sapiens
ucacucuguuuccuguuca

SEQ ID NO: 483122 - RNA, 19 nt, Homo sapiens
gaugcucaaauaucagaga

SEQ ID NO: 483123 - RNA, 19 nt, Homo sapiens
ugccaagaguucgauguug

SEQ ID NO: 483124 - RNA, 19 nt, Homo sapiens
gaaaaguugagcgucauuu

SEQ ID NO: 483125 - RNA, 19 nt, Homo sapiens
ucgucuauguguauaugaa

SEQ ID NO: 483126 - RNA, 19 nt, Homo sapiens
agaaaaucgucuaugugua

SEQ ID NO: 483127 - RNA, 19 nt, Homo sapiens
ccacacacgcacacacaca

SEQ ID NO: 483128 - RNA, 19 nt, Homo sapiens
ccccagaugugacuacuga

SEQ ID NO: 483129 - RNA, 19 nt, Homo sapiens
cuucgaugauauugccaaa

SEQ ID NO: 483130 - RNA, 19 nt, Homo sapiens
acagacugcgugagagaaa

SEQ ID NO: 483131 - RNA, 19 nt, Homo sapiens
acacaccaaguaccaguau

SEQ ID NO: 483132 - RNA, 19 nt, Homo sapiens
agugugccauucuguuaga

SEQ ID NO: 483133 - RNA, 19 nt, Homo sapiens
cugaggaagaugacgagua

SEQ ID NO: 483134 - RNA, 19 nt, Homo sapiens
gcaaugacauaaccaauuu

SEQ ID NO: 483135 - RNA, 19 nt, Homo sapiens
gaaauuaccagcagugaaa

SEQ ID NO: 483136 - RNA, 19 nt, Homo sapiens
gcagaggccuuauggauau

SEQ ID NO: 483137 - RNA, 19 nt, Homo sapiens
gcaugaaccagcaauauua

SEQ ID NO: 483138 - RNA, 19 nt, Homo sapiens
caacauugauccagucauu

SEQ ID NO: 483139 - RNA, 19 nt, Homo sapiens
ggaaugaugggucaaguua

SEQ ID NO: 483140 - RNA, 19 nt, Homo sapiens
gcaccgagguugcauucua

SEQ ID NO: 483141 - RNA, 19 nt, Homo sapiens
gguagaugcuugauuguuu

SEQ ID NO: 483142 - RNA, 19 nt, Homo sapiens
gaaauccucuguuaaugug

SEQ ID NO: 483143 - RNA, 19 nt, Homo sapiens
ggaaagaccucagaguguu

SEQ ID NO: 483144 - RNA, 19 nt, Homo sapiens
acaaacaguuccaugaaua

SEQ ID NO: 483145 - RNA, 19 nt, Homo sapiens
caacaugccuucagaugga

SEQ ID NO: 483146 - RNA, 19 nt, Homo sapiens
ccacuguucuguucucaua

SEQ ID NO: 483147 - RNA, 19 nt, Homo sapiens
ggaaaaugcuuauugauga

SEQ ID NO: 483148 - RNA, 19 nt, Homo sapiens
gagguugcauucuagauaa

SEQ ID NO: 483149 - RNA, 19 nt, Homo sapiens
caaagaagagucaacauug

SEQ ID NO: 483150 - RNA, 19 nt, Homo sapiens
auaauggacucucagaaua

SEQ ID NO: 483151 - RNA, 19 nt, Homo sapiens
caugguagaugcuugauug

SEQ ID NO: 483152 - RNA, 19 nt, Homo sapiens
gaacuguguuucaaaugga

SEQ ID NO: 483153 - RNA, 19 nt, Homo sapiens
gguauaccuugcuacaaua

SEQ ID NO: 483154 - RNA, 19 nt, Homo sapiens
gaagacaaagcacaccaua

SEQ ID NO: 483155 - RNA, 19 nt, Homo sapiens
agagggaaauguacacuuu

SEQ ID NO: 483156 - RNA, 19 nt, Homo sapiens
gaaggggcgucauaaauuu

SEQ ID NO: 483157 - RNA, 19 nt, Homo sapiens
aaaccaagguccaaugaug

SEQ ID NO: 483158 - RNA, 19 nt, Homo sapiens
caacaugucuguggcuuuc

SEQ ID NO: 483159 - RNA, 19 nt, Homo sapiens
ccacgguuauuuaagcaua

SEQ ID NO: 483160 - RNA, 19 nt, Homo sapiens
ggaacuguguuucaaaugg

SEQ ID NO: 483161 - RNA, 19 nt, Homo sapiens
guaagcagccuuugugguu

SEQ ID NO: 483162 - RNA, 19 nt, Homo sapiens
gacaaacaguuccaugaau

SEQ ID NO: 483163 - RNA, 19 nt, Homo sapiens
gaauaguucaggagacuuu

SEQ ID NO: 483164 - RNA, 19 nt, Homo sapiens
gcaccacccacacagaaua

SEQ ID NO: 483165 - RNA, 19 nt, Homo sapiens
cagcagauguugcacacaa

SEQ ID NO: 483166 - RNA, 19 nt, Homo sapiens
auaaguggcuguuucauca

SEQ ID NO: 483167 - RNA, 19 nt, Homo sapiens
agacaaagcacaccauaug

SEQ ID NO: 483168 - RNA, 19 nt, Homo sapiens
gauggagucuugcucuugu

SEQ ID NO: 483169 - RNA, 19 nt, Homo sapiens
ucaaagaagagucaacauu

SEQ ID NO: 483170 - RNA, 19 nt, Homo sapiens
caccauauguccacuguuc

SEQ ID NO: 483171 - RNA, 19 nt, Homo sapiens
ugaaaggugugaacagcuu

SEQ ID NO: 483172 - RNA, 19 nt, Homo sapiens
gauggaaauucacaguaug

SEQ ID NO: 483173 - RNA, 19 nt, Homo sapiens
ugauggaaauucacaguau

SEQ ID NO: 483174 - RNA, 19 nt, Homo sapiens
gcacuggacagcaucagaa

SEQ ID NO: 483175 - RNA, 19 nt, Homo sapiens
aagcagccuuugugguuua

SEQ ID NO: 483176 - RNA, 19 nt, Homo sapiens
ucuauuagcagccauauug

SEQ ID NO: 483177 - RNA, 19 nt, Homo sapiens
agagagagaguguguguuu

SEQ ID NO: 483178 - RNA, 19 nt, Homo sapiens
gaaaacaucuagcccaaag

SEQ ID NO: 483179 - RNA, 19 nt, Homo sapiens
caggaaagcaugcauugaa

SEQ ID NO: 483180 - RNA, 19 nt, Homo sapiens
gaaggguaagggaauuuaa

SEQ ID NO: 483181 - RNA, 19 nt, Homo sapiens
gauaugaccagggacagua

SEQ ID NO: 483182 - RNA, 19 nt, Homo sapiens
gcccaaagguaaguugcua

SEQ ID NO: 483183 - RNA, 19 nt, Homo sapiens
gauguuggaugacaauaac

SEQ ID NO: 483184 - RNA, 19 nt, Homo sapiens
ggugugcuauaaagauaaa

SEQ ID NO: 483185 - RNA, 19 nt, Homo sapiens
uaauggacucucagaauaa

SEQ ID NO: 483186 - RNA, 19 nt, Homo sapiens
ccaaucaacucaauaugac

SEQ ID NO: 483187 - RNA, 19 nt, Homo sapiens
cgagguugcauucuagaua

SEQ ID NO: 483188 - RNA, 19 nt, Homo sapiens
ucaacuuucuuaucuggaa

SEQ ID NO: 483189 - RNA, 19 nt, Homo sapiens
gggacaaggucagcaguau

SEQ ID NO: 483190 - RNA, 19 nt, Homo sapiens
ggacagcagccaccuaugg

SEQ ID NO: 483191 - RNA, 19 nt, Homo sapiens
gacaaccaaugggaaacua

SEQ ID NO: 483192 - RNA, 19 nt, Homo sapiens
gagcaugccaguacagaau

SEQ ID NO: 483193 - RNA, 19 nt, Homo sapiens
ggagugcaguggcgcaauc

SEQ ID NO: 483194 - RNA, 19 nt, Homo sapiens
gagauggagucuugcucuu

SEQ ID NO: 483195 - RNA, 19 nt, Homo sapiens
gagagagaguguguguuug

SEQ ID NO: 483196 - RNA, 19 nt, Homo sapiens
agaauuacuuuguguugga

SEQ ID NO: 483197 - RNA, 19 nt, Homo sapiens
guauguuuaugaaggguaa

SEQ ID NO: 483198 - RNA, 19 nt, Homo sapiens
aggaaagcaugcauugaaa

SEQ ID NO: 483199 - RNA, 19 nt, Homo sapiens
uguuucaaauggacuguua

SEQ ID NO: 483200 - RNA, 19 nt, Homo sapiens
uaagcagccuuugugguuu

SEQ ID NO: 483201 - RNA, 19 nt, Homo sapiens
ggaaauuaccagcagugaa

SEQ ID NO: 483202 - RNA, 19 nt, Homo sapiens
agacagauuccucccuaua

SEQ ID NO: 483203 - RNA, 19 nt, Homo sapiens
gaccaaauaugaguaugca

SEQ ID NO: 483204 - RNA, 19 nt, Homo sapiens
cagaaucagaugacaauga

SEQ ID NO: 483205 - RNA, 19 nt, Homo sapiens
ucacagagcaugccaguac

SEQ ID NO: 483206 - RNA, 19 nt, Homo sapiens
ugacaaacaguuccaugaa

SEQ ID NO: 483207 - RNA, 19 nt, Homo sapiens
gaagauguuggaugacaau

SEQ ID NO: 483208 - RNA, 19 nt, Homo sapiens
gaugagguuuauucuaucu

SEQ ID NO: 483209 - RNA, 19 nt, Homo sapiens
cagaagauguuggaugaca

SEQ ID NO: 483210 - RNA, 19 nt, Homo sapiens
guggauaaguggcuguuuc

SEQ ID NO: 483211 - RNA, 19 nt, Homo sapiens
caguagccaguaucuauua

SEQ ID NO: 483212 - RNA, 19 nt, Homo sapiens
aauauuacccugauggaaa

SEQ ID NO: 483213 - RNA, 19 nt, Homo sapiens
acagauuccucccuauaga

SEQ ID NO: 483214 - RNA, 19 nt, Homo sapiens
gccuucagauggaauggua

SEQ ID NO: 483215 - RNA, 19 nt, Homo sapiens
gcacacaaacuugguauac

SEQ ID NO: 483216 - RNA, 19 nt, Homo sapiens
ccacacagaauaugccuau

SEQ ID NO: 483217 - RNA, 19 nt, Homo sapiens
caaaauaugcagucucuuu

SEQ ID NO: 483218 - RNA, 19 nt, Homo sapiens
gaaagugguaauccucuuc

SEQ ID NO: 483219 - RNA, 19 nt, Homo sapiens
ggugugaacagcuuuguau

SEQ ID NO: 483220 - RNA, 19 nt, Homo sapiens
gccaacagcaagaugcaua

SEQ ID NO: 483221 - RNA, 19 nt, Homo sapiens
gaaugaugggucaaguuaa

SEQ ID NO: 483222 - RNA, 19 nt, Homo sapiens
caaacaguuccaugaauau

SEQ ID NO: 483223 - RNA, 19 nt, Homo sapiens
ugguauaccuugcuacaau

SEQ ID NO: 483224 - RNA, 19 nt, Homo sapiens
guccugugccugauuauuu

SEQ ID NO: 483225 - RNA, 19 nt, Homo sapiens
uucagaagauguuggauga

SEQ ID NO: 483226 - RNA, 19 nt, Homo sapiens
gauaaguggcuguuucauc

SEQ ID NO: 483227 - RNA, 19 nt, Homo sapiens
ggcaugaaccagcaauauu

SEQ ID NO: 483228 - RNA, 19 nt, Homo sapiens
ggacccaaucaacucaaua

SEQ ID NO: 483229 - RNA, 19 nt, Homo sapiens
gcccagggaauaagaugua

SEQ ID NO: 483230 - RNA, 19 nt, Homo sapiens
gugguaauccucuucuaaa

SEQ ID NO: 483231 - RNA, 19 nt, Homo sapiens
ugugaggcaauaagaauua

SEQ ID NO: 483232 - RNA, 19 nt, Homo sapiens
uauaauggacucucagaau

SEQ ID NO: 483233 - RNA, 19 nt, Homo sapiens
ccuuugugguuuaguuaua

SEQ ID NO: 483234 - RNA, 19 nt, Homo sapiens
gaagacacguuguuaccua

SEQ ID NO: 483235 - RNA, 19 nt, Homo sapiens
gcaaagagaauauggcaaa

SEQ ID NO: 483236 - RNA, 19 nt, Homo sapiens
ccacacagcuuucccugaa

SEQ ID NO: 483237 - RNA, 19 nt, Homo sapiens
gaauuaagccuccuucuca

SEQ ID NO: 483238 - RNA, 19 nt, Homo sapiens
gagcagaguggaaugaaua

SEQ ID NO: 483239 - RNA, 19 nt, Homo sapiens
gaugcugucuuguuaugua

SEQ ID NO: 483240 - RNA, 19 nt, Homo sapiens
uaaauaaucugcuguaagc

SEQ ID NO: 483241 - RNA, 19 nt, Homo sapiens
gcaaaucuguggccuccaa

SEQ ID NO: 483242 - RNA, 19 nt, Homo sapiens
gaaaaugccuaugaagaua

SEQ ID NO: 483243 - RNA, 19 nt, Homo sapiens
ggaagaccaucaaagugaa

SEQ ID NO: 483244 - RNA, 19 nt, Homo sapiens
ccaaggagaauccauauga

SEQ ID NO: 483245 - RNA, 19 nt, Homo sapiens
gaaaauccuuugaguuuga

SEQ ID NO: 483246 - RNA, 19 nt, Homo sapiens
gggaagaccaucaaaguga

SEQ ID NO: 483247 - RNA, 19 nt, Homo sapiens
guuguuaccuaggaaguua

SEQ ID NO: 483248 - RNA, 19 nt, Homo sapiens
cgaagucuccuaccaguuu

SEQ ID NO: 483249 - RNA, 19 nt, Homo sapiens
gagcauggaugaaguuucg

SEQ ID NO: 483250 - RNA, 19 nt, Homo sapiens
caagaucccuccccagaua

SEQ ID NO: 483251 - RNA, 19 nt, Homo sapiens
agaauuaacuccaucuaca

SEQ ID NO: 483252 - RNA, 19 nt, Homo sapiens
cgagaggccuuccgcaaau

SEQ ID NO: 483253 - RNA, 19 nt, Homo sapiens
gaccaugacugccaacaag

SEQ ID NO: 483254 - RNA, 19 nt, Homo sapiens
gaaaggcaaaggccaauca

SEQ ID NO: 483255 - RNA, 19 nt, Homo sapiens
cgacgaagacacguuguua

SEQ ID NO: 483256 - RNA, 19 nt, Homo sapiens
ggucuauccuuucaugaga

SEQ ID NO: 483257 - RNA, 19 nt, Homo sapiens
gagcauguguggagagaag

SEQ ID NO: 483258 - RNA, 19 nt, Homo sapiens
gcauuggucuauccuuuca

SEQ ID NO: 483259 - RNA, 19 nt, Homo sapiens
ggacuggcuuccuguguca

SEQ ID NO: 483260 - RNA, 19 nt, Homo sapiens
guaacaagcaaagagaaua

SEQ ID NO: 483261 - RNA, 19 nt, Homo sapiens
aagcuuguccaaagaauua

SEQ ID NO: 483262 - RNA, 19 nt, Homo sapiens
ccaggauacuguuuguaaa

SEQ ID NO: 483263 - RNA, 19 nt, Homo sapiens
ugaaacagcaucacugaga

SEQ ID NO: 483264 - RNA, 19 nt, Homo sapiens
gaggaaagaagagauuaaa

SEQ ID NO: 483265 - RNA, 19 nt, Homo sapiens
gaauuaacuccaucuacaa

SEQ ID NO: 483266 - RNA, 19 nt, Homo sapiens
gagaagaaccccaagagua

SEQ ID NO: 483267 - RNA, 19 nt, Homo sapiens
agaguggaaugaauaaguu

SEQ ID NO: 483268 - RNA, 19 nt, Homo sapiens
ccaucaaagugaagacauu

SEQ ID NO: 483269 - RNA, 19 nt, Homo sapiens
gagaggaaagaagagauua

SEQ ID NO: 483270 - RNA, 19 nt, Homo sapiens
caucuacaaugccaagaga

SEQ ID NO: 483271 - RNA, 19 nt, Homo sapiens
gcagugagaccuuuucuuu

SEQ ID NO: 483272 - RNA, 19 nt, Homo sapiens
cagaugcugucuuguuaug

SEQ ID NO: 483273 - RNA, 19 nt, Homo sapiens
cagaaaauccuuugaguuu

SEQ ID NO: 483274 - RNA, 19 nt, Homo sapiens
uauggagucucagauguuu

SEQ ID NO: 483275 - RNA, 19 nt, Homo sapiens
auaaucugcuguaagcuuu

SEQ ID NO: 483276 - RNA, 19 nt, Homo sapiens
aaaugaaguuucuccacaa

SEQ ID NO: 483277 - RNA, 19 nt, Homo sapiens
gcgagaggccuuccgcaaa

SEQ ID NO: 483278 - RNA, 19 nt, Homo sapiens
guauagcagugagaccuuu

SEQ ID NO: 483279 - RNA, 19 nt, Homo sapiens
cagcaagggcucuggguuu

SEQ ID NO: 483280 - RNA, 19 nt, Homo sapiens
caaagagaauauggcaaau

SEQ ID NO: 483281 - RNA, 19 nt, Homo sapiens
gaguggagcaguacuuaga

SEQ ID NO: 483282 - RNA, 19 nt, Homo sapiens
agaagaagccaucgcgaaa

SEQ ID NO: 483283 - RNA, 19 nt, Homo sapiens
agugggaacuggucagaaa

SEQ ID NO: 483284 - RNA, 19 nt, Homo sapiens
ggacuuaaagagccgaaga

SEQ ID NO: 483285 - RNA, 19 nt, Homo sapiens
ggagcaguacuuagaagaa

SEQ ID NO: 483286 - RNA, 19 nt, Homo sapiens
gccaagagaggaaagaaga

SEQ ID NO: 483287 - RNA, 19 nt, Homo sapiens
gcaagucccagagcagaaa

SEQ ID NO: 483288 - RNA, 19 nt, Homo sapiens
ccaagcgcaccuuugaaua

SEQ ID NO: 483289 - RNA, 19 nt, Homo sapiens
caagacagggagcuaagaa

SEQ ID NO: 483290 - RNA, 19 nt, Homo sapiens
gaagucuccuaccaguuuc

SEQ ID NO: 483291 - RNA, 19 nt, Homo sapiens
guaaauaaucugcuguaag

SEQ ID NO: 483292 - RNA, 19 nt, Homo sapiens
gcgaguggagcaguacuua

SEQ ID NO: 483293 - RNA, 19 nt, Homo sapiens
cugcauuggucuauccuuu

SEQ ID NO: 483294 - RNA, 19 nt, Homo sapiens
ccagagguguacuguguca

SEQ ID NO: 483295 - RNA, 19 nt, Homo sapiens
ugccagagguguacugugu

SEQ ID NO: 483296 - RNA, 19 nt, Homo sapiens
caaggagaauccauaugag

SEQ ID NO: 483297 - RNA, 19 nt, Homo sapiens
ccaagaguaagcccaguaa

SEQ ID NO: 483298 - RNA, 19 nt, Homo sapiens
acagggagcuaagaaagug

SEQ ID NO: 483299 - RNA, 19 nt, Homo sapiens
ucugggaucugaccgauuc

SEQ ID NO: 483300 - RNA, 19 nt, Homo sapiens
ccacugagaaugguacuga

SEQ ID NO: 483301 - RNA, 19 nt, Homo sapiens
gagcaguacuuagaagaac

SEQ ID NO: 483302 - RNA, 19 nt, Homo sapiens
gaauguaauacccucaaug

SEQ ID NO: 483303 - RNA, 19 nt, Homo sapiens
gaggaagaaugagcugauc

SEQ ID NO: 483304 - RNA, 19 nt, Homo sapiens
uuuccaagguccuagauga

SEQ ID NO: 483305 - RNA, 19 nt, Homo sapiens
agaacuccuuggacucuuu

SEQ ID NO: 483306 - RNA, 19 nt, Homo sapiens
gagaaccaacccaaguuug

SEQ ID NO: 483307 - RNA, 19 nt, Homo sapiens
ccacccaccugucccuuca

SEQ ID NO: 483308 - RNA, 19 nt, Homo sapiens
gcauggcaccagggucuua

SEQ ID NO: 483309 - RNA, 19 nt, Homo sapiens
gauggcagcagacgcuuug

SEQ ID NO: 483310 - RNA, 19 nt, Homo sapiens
aagaagccaucgcgaaaca

SEQ ID NO: 483311 - RNA, 19 nt, Homo sapiens
auaugaggauguggacuua

SEQ ID NO: 483312 - RNA, 19 nt, Homo sapiens
ccuccgagauggucagugu

SEQ ID NO: 483313 - RNA, 19 nt, Homo sapiens
cagcucauccgaaucuuug

SEQ ID NO: 483314 - RNA, 19 nt, Homo sapiens
gagaucugcccaaggagaa

SEQ ID NO: 483315 - RNA, 19 nt, Homo sapiens
gcaacaaaaugaaguuucu

SEQ ID NO: 483316 - RNA, 19 nt, Homo sapiens
aacaagaauuccagcauca

SEQ ID NO: 483317 - RNA, 19 nt, Homo sapiens
gagguguacugugucauca

SEQ ID NO: 483318 - RNA, 19 nt, Homo sapiens
ccuccagccucaaugaaga

SEQ ID NO: 483319 - RNA, 19 nt, Homo sapiens
cccagcaacugucugagaa

SEQ ID NO: 483320 - RNA, 19 nt, Homo sapiens
ugagaaccaacccaaguuu

SEQ ID NO: 483321 - RNA, 19 nt, Homo sapiens
cccaggauacuguuuguaa

SEQ ID NO: 483322 - RNA, 19 nt, Homo sapiens
gcccaccucugccuucauc

SEQ ID NO: 483323 - RNA, 19 nt, Homo sapiens
cgacuccgacgaugaaugu

SEQ ID NO: 483324 - RNA, 19 nt, Homo sapiens
ccaagaggcacagccauga

SEQ ID NO: 483325 - RNA, 19 nt, Homo sapiens
augaggauguggacuuaaa

SEQ ID NO: 483326 - RNA, 19 nt, Homo sapiens
gcauacccauacccucugu

SEQ ID NO: 483327 - RNA, 19 nt, Homo sapiens
uggagcacguggacuuuga

SEQ ID NO: 483328 - RNA, 19 nt, Homo sapiens
caagagaggaaagaagaga

SEQ ID NO: 483329 - RNA, 19 nt, Homo sapiens
gaagauauugugggagauc

SEQ ID NO: 483330 - RNA, 19 nt, Homo sapiens
gcagaugcugucuuguuau

SEQ ID NO: 483331 - RNA, 19 nt, Homo sapiens
uuaagccuccuucucagua

SEQ ID NO: 483332 - RNA, 19 nt, Homo sapiens
cagggaagaccaucaaagu

SEQ ID NO: 483333 - RNA, 19 nt, Homo sapiens
gagccgaaaugaccaugac

SEQ ID NO: 483334 - RNA, 19 nt, Homo sapiens
gaagacacguuguuaccua

SEQ ID NO: 483335 - RNA, 19 nt, Homo sapiens
gcaaagagaauauggcaaa

SEQ ID NO: 483336 - RNA, 19 nt, Homo sapiens
ccacacagcuuucccugaa

SEQ ID NO: 483337 - RNA, 19 nt, Homo sapiens
gaauuaagccuccuucuca

SEQ ID NO: 483338 - RNA, 19 nt, Homo sapiens
gagcagaguggaaugaaua

SEQ ID NO: 483339 - RNA, 19 nt, Homo sapiens
gaugcugucuuguuaugua

SEQ ID NO: 483340 - RNA, 19 nt, Homo sapiens
uaaauaaucugcuguaagc

SEQ ID NO: 483341 - RNA, 19 nt, Homo sapiens
gcaaaucuguggccuccaa

SEQ ID NO: 483342 - RNA, 19 nt, Homo sapiens
gaaaaugccuaugaagaua

SEQ ID NO: 483343 - RNA, 19 nt, Homo sapiens
ggaagaccaucaaagugaa

SEQ ID NO: 483344 - RNA, 19 nt, Homo sapiens
ccaaggagaauccauauga

SEQ ID NO: 483345 - RNA, 19 nt, Homo sapiens
gaaaauccuuugaguuuga

SEQ ID NO: 483346 - RNA, 19 nt, Homo sapiens
gggaagaccaucaaaguga

SEQ ID NO: 483347 - RNA, 19 nt, Homo sapiens
guuguuaccuaggaaguua

SEQ ID NO: 483348 - RNA, 19 nt, Homo sapiens
cgaagucuccuaccaguuu

SEQ ID NO: 483349 - RNA, 19 nt, Homo sapiens
gagcauggaugaaguuucg

SEQ ID NO: 483350 - RNA, 19 nt, Homo sapiens
agaauuaacuccaucuaca

SEQ ID NO: 483351 - RNA, 19 nt, Homo sapiens
cgagaggccuuccgcaaau

SEQ ID NO: 483352 - RNA, 19 nt, Homo sapiens
gaccaugacugccaacaag

SEQ ID NO: 483353 - RNA, 19 nt, Homo sapiens
gaaaggcaaaggccaauca

SEQ ID NO: 483354 - RNA, 19 nt, Homo sapiens
cgacgaagacacguuguua

SEQ ID NO: 483355 - RNA, 19 nt, Homo sapiens
ggucuauccuuucaugaga

SEQ ID NO: 483356 - RNA, 19 nt, Homo sapiens
gcauuggucuauccuuuca

SEQ ID NO: 483357 - RNA, 19 nt, Homo sapiens
ggacuggcuuccuguguca

SEQ ID NO: 483358 - RNA, 19 nt, Homo sapiens
guaacaagcaaagagaaua

SEQ ID NO: 483359 - RNA, 19 nt, Homo sapiens
aagcuuguccaaagaauua

SEQ ID NO: 483360 - RNA, 19 nt, Homo sapiens
ccaggauacuguuuguaaa

SEQ ID NO: 483361 - RNA, 19 nt, Homo sapiens
ugaaacagcaucacugaga

SEQ ID NO: 483362 - RNA, 19 nt, Homo sapiens
gaggaaagaagagauuaaa

SEQ ID NO: 483363 - RNA, 19 nt, Homo sapiens
gaauuaacuccaucuacaa

SEQ ID NO: 483364 - RNA, 19 nt, Homo sapiens
agaguggaaugaauaaguu

SEQ ID NO: 483365 - RNA, 19 nt, Homo sapiens
ccaucaaagugaagacauu

SEQ ID NO: 483366 - RNA, 19 nt, Homo sapiens
gagaggaaagaagagauua

SEQ ID NO: 483367 - RNA, 19 nt, Homo sapiens
caucuacaaugccaagaga

SEQ ID NO: 483368 - RNA, 19 nt, Homo sapiens
gcagugagaccuuuucuuu

SEQ ID NO: 483369 - RNA, 19 nt, Homo sapiens
cagaugcugucuuguuaug

SEQ ID NO: 483370 - RNA, 19 nt, Homo sapiens
cagaaaauccuuugaguuu

SEQ ID NO: 483371 - RNA, 19 nt, Homo sapiens
uauggagucucagauguuu

SEQ ID NO: 483372 - RNA, 19 nt, Homo sapiens
auaaucugcuguaagcuuu

SEQ ID NO: 483373 - RNA, 19 nt, Homo sapiens
aaaugaaguuucuccacaa

SEQ ID NO: 483374 - RNA, 19 nt, Homo sapiens
gcgagaggccuuccgcaaa

SEQ ID NO: 483375 - RNA, 19 nt, Homo sapiens
guauagcagugagaccuuu

SEQ ID NO: 483376 - RNA, 19 nt, Homo sapiens
caaagagaauauggcaaau

SEQ ID NO: 483377 - RNA, 19 nt, Homo sapiens
gaguggagcaguacuuaga

SEQ ID NO: 483378 - RNA, 19 nt, Homo sapiens
cagcaagggcucuggguuu

SEQ ID NO: 483379 - RNA, 19 nt, Homo sapiens
agaagaagccaucgcgaaa

SEQ ID NO: 483380 - RNA, 19 nt, Homo sapiens
agugggaacuggucagaaa

SEQ ID NO: 483381 - RNA, 19 nt, Homo sapiens
ggacuuaaagagccgaaga

SEQ ID NO: 483382 - RNA, 19 nt, Homo sapiens
ggagcaguacuuagaagaa

SEQ ID NO: 483383 - RNA, 19 nt, Homo sapiens
gccaagagaggaaagaaga

SEQ ID NO: 483384 - RNA, 19 nt, Homo sapiens
caagacagggagcuaagaa

SEQ ID NO: 483385 - RNA, 19 nt, Homo sapiens
gaagucuccuaccaguuuc

SEQ ID NO: 483386 - RNA, 19 nt, Homo sapiens
guaaauaaucugcuguaag

SEQ ID NO: 483387 - RNA, 19 nt, Homo sapiens
gcgaguggagcaguacuua

SEQ ID NO: 483388 - RNA, 19 nt, Homo sapiens
cugcauuggucuauccuuu

SEQ ID NO: 483389 - RNA, 19 nt, Homo sapiens
ccagagguguacuguguca

SEQ ID NO: 483390 - RNA, 19 nt, Homo sapiens
ugccagagguguacugugu

SEQ ID NO: 483391 - RNA, 19 nt, Homo sapiens
caaggagaauccauaugag

SEQ ID NO: 483392 - RNA, 19 nt, Homo sapiens
acagggagcuaagaaagug

SEQ ID NO: 483393 - RNA, 19 nt, Homo sapiens
ucugggaucugaccgauuc

SEQ ID NO: 483394 - RNA, 19 nt, Homo sapiens
ccacugagaaugguacuga

SEQ ID NO: 483395 - RNA, 19 nt, Homo sapiens
gagcaguacuuagaagaac

SEQ ID NO: 483396 - RNA, 19 nt, Homo sapiens
gaauguaauacccucaaug

SEQ ID NO: 483397 - RNA, 19 nt, Homo sapiens
gaggaagaaugagcugauc

SEQ ID NO: 483398 - RNA, 19 nt, Homo sapiens
uuuccaagguccuagauga

SEQ ID NO: 483399 - RNA, 19 nt, Homo sapiens
agaacuccuuggacucuuu

SEQ ID NO: 483400 - RNA, 19 nt, Homo sapiens
gagaaccaacccaaguuug

SEQ ID NO: 483401 - RNA, 19 nt, Homo sapiens
gcauggcaccagggucuua

SEQ ID NO: 483402 - RNA, 19 nt, Homo sapiens
gauggcagcagacgcuuug

SEQ ID NO: 483403 - RNA, 19 nt, Homo sapiens
aagaagccaucgcgaaaca

SEQ ID NO: 483404 - RNA, 19 nt, Homo sapiens
auaugaggauguggacuua

SEQ ID NO: 483405 - RNA, 19 nt, Homo sapiens
ccuccgagauggucagugu

SEQ ID NO: 483406 - RNA, 19 nt, Homo sapiens
cagcucauccgaaucuuug

SEQ ID NO: 483407 - RNA, 19 nt, Homo sapiens
gagaucugcccaaggagaa

SEQ ID NO: 483408 - RNA, 19 nt, Homo sapiens
gcaacaaaaugaaguuucu

SEQ ID NO: 483409 - RNA, 19 nt, Homo sapiens
aacaagaauuccagcauca

SEQ ID NO: 483410 - RNA, 19 nt, Homo sapiens
gagguguacugugucauca

SEQ ID NO: 483411 - RNA, 19 nt, Homo sapiens
ugagaaccaacccaaguuu

SEQ ID NO: 483412 - RNA, 19 nt, Homo sapiens
ccuccagccucaaugaaga

SEQ ID NO: 483413 - RNA, 19 nt, Homo sapiens
cccagcaacugucugagaa

SEQ ID NO: 483414 - RNA, 19 nt, Homo sapiens
cccaggauacuguuuguaa

SEQ ID NO: 483415 - RNA, 19 nt, Homo sapiens
gcccaccucugccuucauc

SEQ ID NO: 483416 - RNA, 19 nt, Homo sapiens
cgacuccgacgaugaaugu

SEQ ID NO: 483417 - RNA, 19 nt, Homo sapiens
ccaagaggcacagccauga

SEQ ID NO: 483418 - RNA, 19 nt, Homo sapiens
augaggauguggacuuaaa

SEQ ID NO: 483419 - RNA, 19 nt, Homo sapiens
gcauacccauacccucugu

SEQ ID NO: 483420 - RNA, 19 nt, Homo sapiens
uggagcacguggacuuuga

SEQ ID NO: 483421 - RNA, 19 nt, Homo sapiens
caagagaggaaagaagaga

SEQ ID NO: 483422 - RNA, 19 nt, Homo sapiens
gaagauauugugggagauc

SEQ ID NO: 483423 - RNA, 19 nt, Homo sapiens
gcagaugcugucuuguuau

SEQ ID NO: 483424 - RNA, 19 nt, Homo sapiens
uuaagccuccuucucagua

SEQ ID NO: 483425 - RNA, 19 nt, Homo sapiens
gagccgaaaugaccaugac

SEQ ID NO: 483426 - RNA, 19 nt, Homo sapiens
cagggaagaccaucaaagu

SEQ ID NO: 483427 - RNA, 19 nt, Homo sapiens
gaggauguggacuuaaaga

SEQ ID NO: 483428 - RNA, 19 nt, Homo sapiens
aggaggcgcugauggugaa

SEQ ID NO: 483429 - RNA, 19 nt, Homo sapiens
ccaagcuuguccaaagaau

SEQ ID NO: 483430 - RNA, 19 nt, Homo sapiens
ggaacuggucagaaaggaa

SEQ ID NO: 483431 - RNA, 19 nt, Homo sapiens
gaacuccuuggacucuuug

SEQ ID NO: 483432 - RNA, 19 nt, Homo sapiens
cauaugaggauguggacuu

SEQ ID NO: 483433 - RNA, 19 nt, Homo sapiens
caccucugccuucaucaua

SEQ ID NO: 483434 - RNA, 19 nt, Homo sapiens
ggaaagugaucuagaaauu

SEQ ID NO: 483435 - RNA, 19 nt, Homo sapiens
gcaguuaguuuaucuugua

SEQ ID NO: 483436 - RNA, 19 nt, Homo sapiens
ccaagagaaugcuuauuua

SEQ ID NO: 483437 - RNA, 19 nt, Homo sapiens
ugacagagccauugaaaua

SEQ ID NO: 483438 - RNA, 19 nt, Homo sapiens
gaaagaauagaacgaguua

SEQ ID NO: 483439 - RNA, 19 nt, Homo sapiens
ccagaaagccauugacuua

SEQ ID NO: 483440 - RNA, 19 nt, Homo sapiens
guacuuaguucucuuguug

SEQ ID NO: 483441 - RNA, 19 nt, Homo sapiens
gauaaggccuucuguacuu

SEQ ID NO: 483442 - RNA, 19 nt, Homo sapiens
guaagaagguggaggaaga

SEQ ID NO: 483443 - RNA, 19 nt, Homo sapiens
gaaaugcaucuguuacaua

SEQ ID NO: 483444 - RNA, 19 nt, Homo sapiens
gaagguggaggaagacuua

SEQ ID NO: 483445 - RNA, 19 nt, Homo sapiens
gcagugaaguaaauucuau

SEQ ID NO: 483446 - RNA, 19 nt, Homo sapiens
caaccuagaucaccuuaug

SEQ ID NO: 483447 - RNA, 19 nt, Homo sapiens
guaauguccuucugauaaa

SEQ ID NO: 483448 - RNA, 19 nt, Homo sapiens
gcucagaacccagcaaaua

SEQ ID NO: 483449 - RNA, 19 nt, Homo sapiens
gaaagccauugacuuauuc

SEQ ID NO: 483450 - RNA, 19 nt, Homo sapiens
ucacugcuaucaucauuaa

SEQ ID NO: 483451 - RNA, 19 nt, Homo sapiens
ggauaaaguuuguguugga

SEQ ID NO: 483452 - RNA, 19 nt, Homo sapiens
gaagauuacugcucugagu

SEQ ID NO: 483453 - RNA, 19 nt, Homo sapiens
uaaagaaggugugauugaa

SEQ ID NO: 483454 - RNA, 19 nt, Homo sapiens
ggaaauaagguaguacuuu

SEQ ID NO: 483455 - RNA, 19 nt, Homo sapiens
gaauagaacgaguuaagaa

SEQ ID NO: 483456 - RNA, 19 nt, Homo sapiens
guacuuugcuuauuugaag

SEQ ID NO: 483457 - RNA, 19 nt, Homo sapiens
cuaccaguguuucaauuua

SEQ ID NO: 483458 - RNA, 19 nt, Homo sapiens
gccaagagaaugcuuauuu

SEQ ID NO: 483459 - RNA, 19 nt, Homo sapiens
uaagaaggcucgagaagag

SEQ ID NO: 483460 - RNA, 19 nt, Homo sapiens
agaaagccauugacuuauu

SEQ ID NO: 483461 - RNA, 19 nt, Homo sapiens
gaacaucggagaaaguaug

SEQ ID NO: 483462 - RNA, 19 nt, Homo sapiens
ugaggaaagugaucuagaa

SEQ ID NO: 483463 - RNA, 19 nt, Homo sapiens
gcaaauauuaccauaagug

SEQ ID NO: 483464 - RNA, 19 nt, Homo sapiens
cauuugagcuuguguguuc

SEQ ID NO: 483465 - RNA, 19 nt, Homo sapiens
caucaucacugcuaucauc

SEQ ID NO: 483466 - RNA, 19 nt, Homo sapiens
uaagggaaauaagguagua

SEQ ID NO: 483467 - RNA, 19 nt, Homo sapiens
uaaagggccuguuaauucu

SEQ ID NO: 483468 - RNA, 19 nt, Homo sapiens
uuacagugguuugccauua

SEQ ID NO: 483469 - RNA, 19 nt, Homo sapiens
ggaagaagcagcccaugau

SEQ ID NO: 483470 - RNA, 19 nt, Homo sapiens
gaaagugaucuagaaauug

SEQ ID NO: 483471 - RNA, 19 nt, Homo sapiens
guugugcauucaauucuua

SEQ ID NO: 483472 - RNA, 19 nt, Homo sapiens
cguaauguccuucugauaa

SEQ ID NO: 483473 - RNA, 19 nt, Homo sapiens
ggacucaaugaaauucuua

SEQ ID NO: 483474 - RNA, 19 nt, Homo sapiens
acagagccauugaaauaaa

SEQ ID NO: 483475 - RNA, 19 nt, Homo sapiens
gaggauaaaguuuguguug

SEQ ID NO: 483476 - RNA, 19 nt, Homo sapiens
cagggaauauacuuaugua

SEQ ID NO: 483477 - RNA, 19 nt, Homo sapiens
ccuuauggaugucgcaaua

SEQ ID NO: 483478 - RNA, 19 nt, Homo sapiens
gaacgagcuucgggccuuu

SEQ ID NO: 483479 - RNA, 19 nt, Homo sapiens
gggaaugccugguaauuuu

SEQ ID NO: 483480 - RNA, 19 nt, Homo sapiens
ggagaaaguaugagcgaaa

SEQ ID NO: 483481 - RNA, 19 nt, Homo sapiens
gaaagcacacagacuucua

SEQ ID NO: 483482 - RNA, 19 nt, Homo sapiens
gguaggagcagugaaguaa

SEQ ID NO: 483483 - RNA, 19 nt, Homo sapiens
aggcaaacauaacucauuu

SEQ ID NO: 483484 - RNA, 19 nt, Homo sapiens
caucacugcuaucaucauu

SEQ ID NO: 483485 - RNA, 19 nt, Homo sapiens
ccuguaaauuggauuauga

SEQ ID NO: 483486 - RNA, 19 nt, Homo sapiens
gaacaguuucuucuggauu

SEQ ID NO: 483487 - RNA, 19 nt, Homo sapiens
uagaucaccuuauggaugu

SEQ ID NO: 483488 - RNA, 19 nt, Homo sapiens
gaacccagcaaauauguca

SEQ ID NO: 483489 - RNA, 19 nt, Homo sapiens
ccucugaccuucucaucaa

SEQ ID NO: 483490 - RNA, 19 nt, Homo sapiens
aaauaaagcccuugcugaa

SEQ ID NO: 483491 - RNA, 19 nt, Homo sapiens
cagaaguuaugguggcuuu

SEQ ID NO: 483492 - RNA, 19 nt, Homo sapiens
guucuaacccuuugcugua

SEQ ID NO: 483493 - RNA, 19 nt, Homo sapiens
gugcaaugcugaaagaagu

SEQ ID NO: 483494 - RNA, 19 nt, Homo sapiens
ugacauugcuacguuucua

SEQ ID NO: 483495 - RNA, 19 nt, Homo sapiens
gaccacccguauuucagua

SEQ ID NO: 483496 - RNA, 19 nt, Homo sapiens
ugaagaugcuagugcaaug

SEQ ID NO: 483497 - RNA, 19 nt, Homo sapiens
guacacaagcagacagaaa

SEQ ID NO: 483498 - RNA, 19 nt, Homo sapiens
gcucuuaaauaguguaacu

SEQ ID NO: 483499 - RNA, 19 nt, Homo sapiens
uaugguaauuguaggguaa

SEQ ID NO: 483500 - RNA, 19 nt, Homo sapiens
aaauuuaaagggccuguua

SEQ ID NO: 483501 - RNA, 19 nt, Homo sapiens
gaagaagccagacgacagu

SEQ ID NO: 483502 - RNA, 19 nt, Homo sapiens
agguugcccuuaaaucuua

SEQ ID NO: 483503 - RNA, 19 nt, Homo sapiens
gaggcaaacauaacucauu

SEQ ID NO: 483504 - RNA, 19 nt, Homo sapiens
ggagauaacggaggagaug

SEQ ID NO: 483505 - RNA, 19 nt, Homo sapiens
uaggagcagugaaguaaau

SEQ ID NO: 483506 - RNA, 19 nt, Homo sapiens
agacuuccauucuggcaaa

SEQ ID NO: 483507 - RNA, 19 nt, Homo sapiens
cuagugcaaugcugaaaga

SEQ ID NO: 483508 - RNA, 19 nt, Homo sapiens
aaaaguggcugcuauugaa

SEQ ID NO: 483509 - RNA, 19 nt, Homo sapiens
gaggaaagugaucuagaaa

SEQ ID NO: 483510 - RNA, 19 nt, Homo sapiens
gcagguugcccuuaaaucu

SEQ ID NO: 483511 - RNA, 19 nt, Homo sapiens
uggaaugccuggacucaau

SEQ ID NO: 483512 - RNA, 19 nt, Homo sapiens
gacagagccauugaaauaa

SEQ ID NO: 483513 - RNA, 19 nt, Homo sapiens
caagaaaugggagaugaaa

SEQ ID NO: 483514 - RNA, 19 nt, Homo sapiens
gagcuucgggccuuuguga

SEQ ID NO: 483515 - RNA, 19 nt, Homo sapiens
gauaaaguuuguguuggau

SEQ ID NO: 483516 - RNA, 19 nt, Homo sapiens
gcagggaauauacuuaugu

SEQ ID NO: 483517 - RNA, 19 nt, Homo sapiens
aagggccuguuaauucuua

SEQ ID NO: 483518 - RNA, 19 nt, Homo sapiens
ugauaaagaaggugugauu

SEQ ID NO: 483519 - RNA, 19 nt, Homo sapiens
gguguuuggucuucuacuu

SEQ ID NO: 483520 - RNA, 19 nt, Homo sapiens
guucuagucuguucugucu

SEQ ID NO: 483521 - RNA, 19 nt, Homo sapiens
ggucaagcguaauguccuu

SEQ ID NO: 483522 - RNA, 19 nt, Homo sapiens
cagaacaucggagaaagua

SEQ ID NO: 483523 - RNA, 19 nt, Homo sapiens
gggaagaagcagcccauga

SEQ ID NO: 483524 - RNA, 19 nt, Homo sapiens
cagcucagccuuacaagug

SEQ ID NO: 483525 - RNA, 19 nt, Homo sapiens
cagaagacauuggaaagag

SEQ ID NO: 483526 - RNA, 19 nt, Homo sapiens
caugcaggauccagaaguu

SEQ ID NO: 483527 - RNA, 19 nt, Homo sapiens
gagcgagagaucaaagaaa

SEQ ID NO: 483528 - RNA, 19 nt, Homo sapiens
uaccugacauugcuacguu

SEQ ID NO: 483529 - RNA, 19 nt, Homo sapiens
auucagcucuuaaauagug

SEQ ID NO: 483530 - RNA, 19 nt, Homo sapiens
gcuuucugcuugcuacauu

SEQ ID NO: 483531 - RNA, 19 nt, Homo sapiens
acccaaagguuaugaaucu

SEQ ID NO: 483532 - RNA, 19 nt, Homo sapiens
gaaaauaccaaggaagaaa

SEQ ID NO: 483533 - RNA, 19 nt, Homo sapiens
gaagaagcagcccaugauc

SEQ ID NO: 483534 - RNA, 19 nt, Homo sapiens
ggaaggagcugcgcuguga

SEQ ID NO: 483535 - RNA, 19 nt, Homo sapiens
gaacauacacugugaacuc

SEQ ID NO: 483536 - RNA, 19 nt, Homo sapiens
gagacaggcucguguuguu

SEQ ID NO: 483537 - RNA, 19 nt, Homo sapiens
ggaggccgcuuacguaaag

SEQ ID NO: 483538 - RNA, 19 nt, Homo sapiens
acacaaggcucccucuguu

SEQ ID NO: 483539 - RNA, 19 nt, Homo sapiens
ggacuucaguguguguauu

SEQ ID NO: 483540 - RNA, 19 nt, Homo sapiens
gcaccuacccucccuccua

SEQ ID NO: 483541 - RNA, 19 nt, Homo sapiens
cuccaaaucugccuagaaa

SEQ ID NO: 483542 - RNA, 19 nt, Homo sapiens
gggccacgcucuugaggaa

SEQ ID NO: 483543 - RNA, 19 nt, Homo sapiens
gagaaauacugcggagaga

SEQ ID NO: 483544 - RNA, 19 nt, Homo sapiens
gaacaagccaggcguguac

SEQ ID NO: 483545 - RNA, 19 nt, Homo sapiens
acaugaggaucacaaauga

SEQ ID NO: 483546 - RNA, 19 nt, Homo sapiens
gggacuggaucaaagagaa

SEQ ID NO: 483547 - RNA, 19 nt, Homo sapiens
ggucuucaauggcuacaug

SEQ ID NO: 483548 - RNA, 19 nt, Homo sapiens
gaggcgcguuuguguauau

SEQ ID NO: 483549 - RNA, 19 nt, Homo sapiens
cgucgucacuuguaccaaa

SEQ ID NO: 483550 - RNA, 19 nt, Homo sapiens
cugaauaccucuccuacga

SEQ ID NO: 483551 - RNA, 19 nt, Homo sapiens
ggaggacacuggugguucu

SEQ ID NO: 483552 - RNA, 19 nt, Homo sapiens
ggagaaaccggcagaguac

SEQ ID NO: 483553 - RNA, 19 nt, Homo sapiens
ugacuucaccuucgacuau

SEQ ID NO: 483554 - RNA, 19 nt, Homo sapiens
ggaacaagccaggcgugua

SEQ ID NO: 483555 - RNA, 19 nt, Homo sapiens
caccgacaccggcuucuua

SEQ ID NO: 483556 - RNA, 19 nt, Homo sapiens
ggaagugccucucgaaaag

SEQ ID NO: 483557 - RNA, 19 nt, Homo sapiens
gcagcgucaucgccuacua

SEQ ID NO: 483558 - RNA, 19 nt, Homo sapiens
ggacgccucccaugucuuc

SEQ ID NO: 483559 - RNA, 19 nt, Homo sapiens
acauugaggugcccaacaa

SEQ ID NO: 483560 - RNA, 19 nt, Homo sapiens
guacagcggagucccauuc

SEQ ID NO: 483561 - RNA, 19 nt, Homo sapiens
ccacuacccacccaacauu

SEQ ID NO: 483562 - RNA, 19 nt, Homo sapiens
ucaacaacgucaagaaggu

SEQ ID NO: 483563 - RNA, 19 nt, Homo sapiens
uggagaaaccggcagagua

SEQ ID NO: 483564 - RNA, 19 nt, Homo sapiens
gcugaucggccuccucuug

SEQ ID NO: 483565 - RNA, 19 nt, Homo sapiens
ggaggaaggcguggaguuc

SEQ ID NO: 483566 - RNA, 19 nt, Homo sapiens
ucaaugacuucaccuucga

SEQ ID NO: 483567 - RNA, 19 nt, Homo sapiens
gacugcacauggaacauug

SEQ ID NO: 483568 - RNA, 19 nt, Homo sapiens
gcaccgaccacagcgauga

SEQ ID NO: 483569 - RNA, 19 nt, Homo sapiens
cauacacugugaacucaau

SEQ ID NO: 483570 - RNA, 19 nt, Homo sapiens
ggacacuggugguucuacu

SEQ ID NO: 483571 - RNA, 19 nt, Homo sapiens
gaacgacugcggagacaac

SEQ ID NO: 483572 - RNA, 19 nt, Homo sapiens
gcucggaggacccuggaaa

SEQ ID NO: 483573 - RNA, 19 nt, Homo sapiens
cccagaacauacacuguga

SEQ ID NO: 483574 - RNA, 19 nt, Homo sapiens
ccacagcgaugagcucaac

SEQ ID NO: 483575 - RNA, 19 nt, Homo sapiens
gcggagagaggucccaguu

SEQ ID NO: 483576 - RNA, 19 nt, Homo sapiens
gaggaucacaaaugagaau

SEQ ID NO: 483577 - RNA, 19 nt, Homo sapiens
aaggugcgcuucaaauucu

SEQ ID NO: 483578 - RNA, 19 nt, Homo sapiens
caacaaccagcaugugaag

SEQ ID NO: 483579 - RNA, 19 nt, Homo sapiens
ggugagauccgcgucauca

SEQ ID NO: 483580 - RNA, 19 nt, Homo sapiens
gacagaggauucagguacu

SEQ ID NO: 483581 - RNA, 19 nt, Homo sapiens
ggagaucaauggggagaaa

SEQ ID NO: 483582 - RNA, 19 nt, Homo sapiens
ucaagaagguggaaaagca

SEQ ID NO: 483583 - RNA, 19 nt, Homo sapiens
ugagaaggacugcgacugu

SEQ ID NO: 483584 - RNA, 19 nt, Homo sapiens
ccaacaaccagcaugugaa

SEQ ID NO: 483585 - RNA, 19 nt, Homo sapiens
gcuccaaaucugccuagaa

SEQ ID NO: 483586 - RNA, 19 nt, Homo sapiens
ggccacaucugcggugcuu

SEQ ID NO: 483587 - RNA, 19 nt, Homo sapiens
gaacguccugcucaucaca

SEQ ID NO: 483588 - RNA, 19 nt, Homo sapiens
cagaacguccugcucauca

SEQ ID NO: 483589 - RNA, 19 nt, Homo sapiens
uacaugaggaucacaaaug

SEQ ID NO: 483590 - RNA, 19 nt, Homo sapiens
gacuucaguguguguauuu

SEQ ID NO: 483591 - RNA, 19 nt, Homo sapiens
cgaggcgcguuuguguaua

SEQ ID NO: 483592 - RNA, 19 nt, Homo sapiens
aacauugacugcacaugga

SEQ ID NO: 483593 - RNA, 19 nt, Homo sapiens
ucacgugcaagaacaaguu

SEQ ID NO: 483594 - RNA, 19 nt, Homo sapiens
uguggaggccgcuuacgua

SEQ ID NO: 483595 - RNA, 19 nt, Homo sapiens
caguguguguauuugugua

SEQ ID NO: 483596 - RNA, 19 nt, Homo sapiens
caacucccggcacgagaaa

SEQ ID NO: 483597 - RNA, 19 nt, Homo sapiens
ccgaggcgcguuuguguau

SEQ ID NO: 483598 - RNA, 19 nt, Homo sapiens
guggaggccgcuuacguaa

SEQ ID NO: 483599 - RNA, 19 nt, Homo sapiens
gcgcguuuguguauaucug

SEQ ID NO: 483600 - RNA, 19 nt, Homo sapiens
guagcgacggcucagauga

SEQ ID NO: 483601 - RNA, 19 nt, Homo sapiens
ugacugcacauggaacauu

SEQ ID NO: 483602 - RNA, 19 nt, Homo sapiens
cacaaggcucccucuguuu

SEQ ID NO: 483603 - RNA, 19 nt, Homo sapiens
ggacuacguggagaucaau

SEQ ID NO: 483604 - RNA, 19 nt, Homo sapiens
cuccagggcuccaaaucug

SEQ ID NO: 483605 - RNA, 19 nt, Homo sapiens
aacauacacugugaacuca

SEQ ID NO: 483606 - RNA, 19 nt, Homo sapiens
acaaggcucccucuguuuc

SEQ ID NO: 483607 - RNA, 19 nt, Homo sapiens
gagcaggggugcaguuguc

SEQ ID NO: 483608 - RNA, 19 nt, Homo sapiens
gcgaccuggugacggugua

SEQ ID NO: 483609 - RNA, 19 nt, Homo sapiens
acacuggugguucuacuga

SEQ ID NO: 483610 - RNA, 19 nt, Homo sapiens
gggaagugccucucgaaaa

SEQ ID NO: 483611 - RNA, 19 nt, Homo sapiens
caacagcaacaagaucaca

SEQ ID NO: 483612 - RNA, 19 nt, Homo sapiens
cagcuguggaggccgcuua

SEQ ID NO: 483613 - RNA, 19 nt, Homo sapiens
gcuuugaggccaccuucuu

SEQ ID NO: 483614 - RNA, 19 nt, Homo sapiens
ccuacaaccugaccuucca

SEQ ID NO: 483615 - RNA, 19 nt, Homo sapiens
gacuucaccuucgacuaug

SEQ ID NO: 483616 - RNA, 19 nt, Homo sapiens
gaggauucagguacucaga

SEQ ID NO: 483617 - RNA, 19 nt, Homo sapiens
acugugggcugcggucauu

SEQ ID NO: 483618 - RNA, 19 nt, Homo sapiens
gugaacgacugcggagaca

SEQ ID NO: 483619 - RNA, 19 nt, Homo sapiens
cccaacaaccagcauguga

SEQ ID NO: 483620 - RNA, 19 nt, Homo sapiens
gcuacaugaggaucacaaa

SEQ ID NO: 483621 - RNA, 19 nt, Homo sapiens
gcgcugaagcugcuguaca

SEQ ID NO: 483622 - RNA, 19 nt, Homo sapiens
aggguggacuucagugugu

SEQ ID NO: 483623 - RNA, 19 nt, Homo sapiens
ggaggacccuggaaaacag

SEQ ID NO: 483624 - RNA, 19 nt, Homo sapiens
uuucgggacuggaucaaag

SEQ ID NO: 483625 - RNA, 19 nt, Homo sapiens
gccaccaguucacgugcaa

SEQ ID NO: 483626 - RNA, 19 nt, Homo sapiens
cagcaacaagaucacaguu

SEQ ID NO: 483627 - RNA, 19 nt, Homo sapiens
guccugcucaucacacuga

SEQ ID NO: 483628 - RNA, 19 nt, Homo sapiens
cgaggagcgcguagucaug

SEQ ID NO: 483629 - RNA, 19 nt, Homo sapiens
gaagaaauguagccaaauu

SEQ ID NO: 483630 - RNA, 19 nt, Homo sapiens
gcagagaguucuuacuuau

SEQ ID NO: 483631 - RNA, 19 nt, Homo sapiens
gaccugaccugccuaaaga

SEQ ID NO: 483632 - RNA, 19 nt, Homo sapiens
caucauucaucuccauuua

SEQ ID NO: 483633 - RNA, 19 nt, Homo sapiens
gggaagagacuaucacaaa

SEQ ID NO: 483634 - RNA, 19 nt, Homo sapiens
ccagggaucucuuuccaaa

SEQ ID NO: 483635 - RNA, 19 nt, Homo sapiens
gagcaggacaugagacaua

SEQ ID NO: 483636 - RNA, 19 nt, Homo sapiens
uagaagaaauguagccaaa

SEQ ID NO: 483637 - RNA, 19 nt, Homo sapiens
gaacaguuuggcugcauua

SEQ ID NO: 483638 - RNA, 19 nt, Homo sapiens
ggagacauaauuacucuuu

SEQ ID NO: 483639 - RNA, 19 nt, Homo sapiens
gaaucucuauuacucugua

SEQ ID NO: 483640 - RNA, 19 nt, Homo sapiens
agagaguucuuacuuauug

SEQ ID NO: 483641 - RNA, 19 nt, Homo sapiens
ggcaguauaugaaauccua

SEQ ID NO: 483642 - RNA, 19 nt, Homo sapiens
gagcagagaguucuuacuu

SEQ ID NO: 483643 - RNA, 19 nt, Homo sapiens
guucagagacuacaacaaa

SEQ ID NO: 483644 - RNA, 19 nt, Homo sapiens
caacagcgaagacaugaaa

SEQ ID NO: 483645 - RNA, 19 nt, Homo sapiens
gugcaaagcaucagaaaga

SEQ ID NO: 483646 - RNA, 19 nt, Homo sapiens
gcucaugccuuucaggaau

SEQ ID NO: 483647 - RNA, 19 nt, Homo sapiens
gaaccuucauuggguguaa

SEQ ID NO: 483648 - RNA, 19 nt, Homo sapiens
ggacuccacuuugaagguu

SEQ ID NO: 483649 - RNA, 19 nt, Homo sapiens
gcagggaacuaggaacaug

SEQ ID NO: 483650 - RNA, 19 nt, Homo sapiens
caagcaaucucugugcaaa

SEQ ID NO: 483651 - RNA, 19 nt, Homo sapiens
ucaaacuuccauccuauua

SEQ ID NO: 483652 - RNA, 19 nt, Homo sapiens
caacaacagcaucuuagaa

SEQ ID NO: 483653 - RNA, 19 nt, Homo sapiens
cuauaggacuccacuuuga

SEQ ID NO: 483654 - RNA, 19 nt, Homo sapiens
acaccuauguugccuugua

SEQ ID NO: 483655 - RNA, 19 nt, Homo sapiens
ggaagagacuaucacaaaa

SEQ ID NO: 483656 - RNA, 19 nt, Homo sapiens
ccauguagcuaaguauuau

SEQ ID NO: 483657 - RNA, 19 nt, Homo sapiens
cauuacagaugaacaccua

SEQ ID NO: 483658 - RNA, 19 nt, Homo sapiens
aaagacccauuacagauga

SEQ ID NO: 483659 - RNA, 19 nt, Homo sapiens
gguguacgaugucaagaug

SEQ ID NO: 483660 - RNA, 19 nt, Homo sapiens
agacaagaaucaaguaucu

SEQ ID NO: 483661 - RNA, 19 nt, Homo sapiens
agauaacacugaaagagaa

SEQ ID NO: 483662 - RNA, 19 nt, Homo sapiens
gaaaugaggccaggagaca

SEQ ID NO: 483663 - RNA, 19 nt, Homo sapiens
ucacagaaccucuacuuca

SEQ ID NO: 483664 - RNA, 19 nt, Homo sapiens
gagccaggguagaucauau

SEQ ID NO: 483665 - RNA, 19 nt, Homo sapiens
cugagacuguggaguaaua

SEQ ID NO: 483666 - RNA, 19 nt, Homo sapiens
uaucugagacuguggagua

SEQ ID NO: 483667 - RNA, 19 nt, Homo sapiens
ggaaacagugagacaagaa

SEQ ID NO: 483668 - RNA, 19 nt, Homo sapiens
uaaagaaguuaugcccauu

SEQ ID NO: 483669 - RNA, 19 nt, Homo sapiens
gccuuacucuuaucuuaaa

SEQ ID NO: 483670 - RNA, 19 nt, Homo sapiens
aaucagaucugcgugaguu

SEQ ID NO: 483671 - RNA, 19 nt, Homo sapiens
ugcaaagccuguaagauga

SEQ ID NO: 483672 - RNA, 19 nt, Homo sapiens
agaaugcaauauacuguga

SEQ ID NO: 483673 - RNA, 19 nt, Homo sapiens
auacagcccuuucgguuau

SEQ ID NO: 483674 - RNA, 19 nt, Homo sapiens
caaagacccauuacagaug

SEQ ID NO: 483675 - RNA, 19 nt, Homo sapiens
aaacuuccauccuauuagu

SEQ ID NO: 483676 - RNA, 19 nt, Homo sapiens
cauucaaacuuccauccua

SEQ ID NO: 483677 - RNA, 19 nt, Homo sapiens
ccaaagacccauuacagau

SEQ ID NO: 483678 - RNA, 19 nt, Homo sapiens
gaaauccuagcagauguaa

SEQ ID NO: 483679 - RNA, 19 nt, Homo sapiens
ugaccugccuaaagacuga

SEQ ID NO: 483680 - RNA, 19 nt, Homo sapiens
caacuuuguucagagacua

SEQ ID NO: 483681 - RNA, 19 nt, Homo sapiens
ucagagauccagcgaagaa

SEQ ID NO: 483682 - RNA, 19 nt, Homo sapiens
acaauacaguggcuggaaa

SEQ ID NO: 483683 - RNA, 19 nt, Homo sapiens
ggagaaugaagauuuggaa

SEQ ID NO: 483684 - RNA, 19 nt, Homo sapiens
acaggagaaugaagauuug

SEQ ID NO: 483685 - RNA, 19 nt, Homo sapiens
uauguugccuuguacaaau

SEQ ID NO: 483686 - RNA, 19 nt, Homo sapiens
gaaaauggcacugaugauu

SEQ ID NO: 483687 - RNA, 19 nt, Homo sapiens
caguuuggcugcauuaaag

SEQ ID NO: 483688 - RNA, 19 nt, Homo sapiens
gagaguucuuacuuauuga

SEQ ID NO: 483689 - RNA, 19 nt, Homo sapiens
gaugugagggcuauguuga

SEQ ID NO: 483690 - RNA, 19 nt, Homo sapiens
cacaggagaaugaagauuu

SEQ ID NO: 483691 - RNA, 19 nt, Homo sapiens
cugcaaagccuguaagaug

SEQ ID NO: 483692 - RNA, 19 nt, Homo sapiens
aagccagcauccagaauuu

SEQ ID NO: 483693 - RNA, 19 nt, Homo sapiens
uggaaucaaugucaguuug

SEQ ID NO: 483694 - RNA, 19 nt, Homo sapiens
gguuaaacuucaauucaca

SEQ ID NO: 483695 - RNA, 19 nt, Homo sapiens
agcagagaguucuuacuua

SEQ ID NO: 483696 - RNA, 19 nt, Homo sapiens
gaagcccacuuucugugau

SEQ ID NO: 483697 - RNA, 19 nt, Homo sapiens
acucaagccuccuagcauu

SEQ ID NO: 483698 - RNA, 19 nt, Homo sapiens
ggacaugagacauagauac

SEQ ID NO: 483699 - RNA, 19 nt, Homo sapiens
cagauaacacugaaagaga

SEQ ID NO: 483700 - RNA, 19 nt, Homo sapiens
gcucuuugccucuaauuca

SEQ ID NO: 483701 - RNA, 19 nt, Homo sapiens
ggaguccauucuucuuuag

SEQ ID NO: 483702 - RNA, 19 nt, Homo sapiens
aauccaagcuccagaaacu

SEQ ID NO: 483703 - RNA, 19 nt, Homo sapiens
caucugguggugugcauua

SEQ ID NO: 483704 - RNA, 19 nt, Homo sapiens
acaagaaucaaguaucuga

SEQ ID NO: 483705 - RNA, 19 nt, Homo sapiens
gaaacagugagacaagaau

SEQ ID NO: 483706 - RNA, 19 nt, Homo sapiens
gcagauaacacugaaagag

SEQ ID NO: 483707 - RNA, 19 nt, Homo sapiens
uauacagcccuuucgguua

SEQ ID NO: 483708 - RNA, 19 nt, Homo sapiens
caugagacauagauacagu

SEQ ID NO: 483709 - RNA, 19 nt, Homo sapiens
gacauggcaucaccuccaa

SEQ ID NO: 483710 - RNA, 19 nt, Homo sapiens
gaagaagaacaagaugguu

SEQ ID NO: 483711 - RNA, 19 nt, Homo sapiens
gagaaugaagauuuggaaa

SEQ ID NO: 483712 - RNA, 19 nt, Homo sapiens
caggguagaucauaugacu

SEQ ID NO: 483713 - RNA, 19 nt, Homo sapiens
gaauuuccucccucucuga

SEQ ID NO: 483714 - RNA, 19 nt, Homo sapiens
ugugaugccuuccuacuca

SEQ ID NO: 483715 - RNA, 19 nt, Homo sapiens
gaaaagaauccuaaugcuu

SEQ ID NO: 483716 - RNA, 19 nt, Homo sapiens
gcaguaggacuauaaacca

SEQ ID NO: 483717 - RNA, 19 nt, Homo sapiens
ggaauccaagcuccagaaa

SEQ ID NO: 483718 - RNA, 19 nt, Homo sapiens
gaaacugcaagcacacaug

SEQ ID NO: 483719 - RNA, 19 nt, Homo sapiens
gaaccucuacuucagaucu

SEQ ID NO: 483720 - RNA, 19 nt, Homo sapiens
caccacaagugcacagaug

SEQ ID NO: 483721 - RNA, 19 nt, Homo sapiens
gauggcugcugguuucaca

SEQ ID NO: 483722 - RNA, 19 nt, Homo sapiens
caagaaugcaauauacugu

SEQ ID NO: 483723 - RNA, 19 nt, Homo sapiens
cagcagcaguaggacuaua

SEQ ID NO: 483724 - RNA, 19 nt, Homo sapiens
aagaagaacaagaugguuu

SEQ ID NO: 483725 - RNA, 19 nt, Homo sapiens
ugaaagagaaucagaucug

SEQ ID NO: 483726 - RNA, 19 nt, Homo sapiens
caggagacauaauuacucu

SEQ ID NO: 483727 - RNA, 19 nt, Homo sapiens
guguuuacauauccagaaa

SEQ ID NO: 483728 - RNA, 19 nt, Homo sapiens
ggaggcggguaugaccuaa

SEQ ID NO: 483729 - RNA, 19 nt, Homo sapiens
ggaugaggcucuuggauua

SEQ ID NO: 483730 - RNA, 19 nt, Homo sapiens
gaaauauaguccaagcuuu

SEQ ID NO: 483731 - RNA, 19 nt, Homo sapiens
gaacaugccugagcagaag

SEQ ID NO: 483732 - RNA, 19 nt, Homo sapiens
gggacaaagugaugaguaa

SEQ ID NO: 483733 - RNA, 19 nt, Homo sapiens
ccugagaagucuugcuuua

SEQ ID NO: 483734 - RNA, 19 nt, Homo sapiens
gaaccacccuugagagaag

SEQ ID NO: 483735 - RNA, 19 nt, Homo sapiens
guagacauguuucccuauu

SEQ ID NO: 483736 - RNA, 19 nt, Homo sapiens
ugagaagucuugcuuuaug

SEQ ID NO: 483737 - RNA, 19 nt, Homo sapiens
aaacuuacguggcuacuca

SEQ ID NO: 483738 - RNA, 19 nt, Homo sapiens
guaaaguggucccagaugu

SEQ ID NO: 483739 - RNA, 19 nt, Homo sapiens
gcaccagucagaauaaaga

SEQ ID NO: 483740 - RNA, 19 nt, Homo sapiens
aaagguaacuucauucacu

SEQ ID NO: 483741 - RNA, 19 nt, Homo sapiens
guaacuucauucacugauu

SEQ ID NO: 483742 - RNA, 19 nt, Homo sapiens
gggaugaggcucuuggauu

SEQ ID NO: 483743 - RNA, 19 nt, Homo sapiens
gaagccagguguugaagac

SEQ ID NO: 483744 - RNA, 19 nt, Homo sapiens
gcucuuggauuaaaaggua

SEQ ID NO: 483745 - RNA, 19 nt, Homo sapiens
agacaaaacucauuaguag

SEQ ID NO: 483746 - RNA, 19 nt, Homo sapiens
gcacagcaacaccacagaa

SEQ ID NO: 483747 - RNA, 19 nt, Homo sapiens
gagaagucuugcuuuaugg

SEQ ID NO: 483748 - RNA, 19 nt, Homo sapiens
ggaacaugccugagcagaa

SEQ ID NO: 483749 - RNA, 19 nt, Homo sapiens
cugauuagcuaugacauga

SEQ ID NO: 483750 - RNA, 19 nt, Homo sapiens
cgaagaaccacccuugaga

SEQ ID NO: 483751 - RNA, 19 nt, Homo sapiens
ggcaguacaugugcacaaa

SEQ ID NO: 483752 - RNA, 19 nt, Homo sapiens
acacuaggauucagauugg

SEQ ID NO: 483753 - RNA, 19 nt, Homo sapiens
ccacuugcauggugcuuca

SEQ ID NO: 483754 - RNA, 19 nt, Homo sapiens
gggaggaggccaugcagaa

SEQ ID NO: 483755 - RNA, 19 nt, Homo sapiens
gcccuuauguacccaccua

SEQ ID NO: 483756 - RNA, 19 nt, Homo sapiens
ucaagguccugcagaagau

SEQ ID NO: 483757 - RNA, 19 nt, Homo sapiens
ggacaaagugaugaguaaa

SEQ ID NO: 483758 - RNA, 19 nt, Homo sapiens
guucguguuuagaguauga

SEQ ID NO: 483759 - RNA, 19 nt, Homo sapiens
gacacuaggauucagauug

SEQ ID NO: 483760 - RNA, 19 nt, Homo sapiens
gcuaugacaugaggguuca

SEQ ID NO: 483761 - RNA, 19 nt, Homo sapiens
ccaagagcaucaucaacca

SEQ ID NO: 483762 - RNA, 19 nt, Homo sapiens
cagaagaucggaaaagaua

SEQ ID NO: 483763 - RNA, 19 nt, Homo sapiens
aaacagggaugaggcucuu

SEQ ID NO: 483764 - RNA, 19 nt, Homo sapiens
gcuggaagucccucuaaga

SEQ ID NO: 483765 - RNA, 19 nt, Homo sapiens
cggaaaagauacauucauu

SEQ ID NO: 483766 - RNA, 19 nt, Homo sapiens
acaaagugaugaguaaagu

SEQ ID NO: 483767 - RNA, 19 nt, Homo sapiens
gugggugccuuccagaaau

SEQ ID NO: 483768 - RNA, 19 nt, Homo sapiens
gcucaggaaggacgaagaa

SEQ ID NO: 483769 - RNA, 19 nt, Homo sapiens
ugggugccuuccagaaaua

SEQ ID NO: 483770 - RNA, 19 nt, Homo sapiens
caacaccacagaacaagca

SEQ ID NO: 483771 - RNA, 19 nt, Homo sapiens
gaguaugacacuaggauuc

SEQ ID NO: 483772 - RNA, 19 nt, Homo sapiens
uagacauguuucccuauug

SEQ ID NO: 483773 - RNA, 19 nt, Homo sapiens
agaaauauaguccaagcuu

SEQ ID NO: 483774 - RNA, 19 nt, Homo sapiens
cagcaacaccacagaacaa

SEQ ID NO: 483775 - RNA, 19 nt, Homo sapiens
guucaggccccuaaaauaa

SEQ ID NO: 483776 - RNA, 19 nt, Homo sapiens
gaugaggcucuuggauuaa

SEQ ID NO: 483777 - RNA, 19 nt, Homo sapiens
agaucaagguccugcagaa

SEQ ID NO: 483778 - RNA, 19 nt, Homo sapiens
aaauauaguccaagcuuuc

SEQ ID NO: 483779 - RNA, 19 nt, Homo sapiens
uucauucacugauuagcua

SEQ ID NO: 483780 - RNA, 19 nt, Homo sapiens
gagcagaagggugucauca

SEQ ID NO: 483781 - RNA, 19 nt, Homo sapiens
uuuaugggcucaagaaugc

SEQ ID NO: 483782 - RNA, 19 nt, Homo sapiens
gacaaagugaugaguaaag

SEQ ID NO: 483783 - RNA, 19 nt, Homo sapiens
gggcauccuuagcaaccaa

SEQ ID NO: 483784 - RNA, 19 nt, Homo sapiens
cuggaagccugcaagucua

SEQ ID NO: 483785 - RNA, 19 nt, Homo sapiens
gcuggaagaaggagaguca

SEQ ID NO: 483786 - RNA, 19 nt, Homo sapiens
cauguuucccuauugcuuu

SEQ ID NO: 483787 - RNA, 19 nt, Homo sapiens
acucagaggcgaagcuuga

SEQ ID NO: 483788 - RNA, 19 nt, Homo sapiens
ggguucguguuuagaguau

SEQ ID NO: 483789 - RNA, 19 nt, Homo sapiens
uuacguggcuacucagcau

SEQ ID NO: 483790 - RNA, 19 nt, Homo sapiens
uaaaguggucccagaugug

SEQ ID NO: 483791 - RNA, 19 nt, Homo sapiens
gacgaagaaccacccuuga

SEQ ID NO: 483792 - RNA, 19 nt, Homo sapiens
gcaagucuaagaucuccau

SEQ ID NO: 483793 - RNA, 19 nt, Homo sapiens
ccagucagaauaaagaauc

SEQ ID NO: 483794 - RNA, 19 nt, Homo sapiens
agacauguuucccuauugc

SEQ ID NO: 483795 - RNA, 19 nt, Homo sapiens
gaagccugcaagucuaaga

SEQ ID NO: 483796 - RNA, 19 nt, Homo sapiens
aggagaaucccuacuggaa

SEQ ID NO: 483797 - RNA, 19 nt, Homo sapiens
auaggcaccagucagaaua

SEQ ID NO: 483798 - RNA, 19 nt, Homo sapiens
gaagucccucuaagaccaa

SEQ ID NO: 483799 - RNA, 19 nt, Homo sapiens
cauaggcaccagucagaau

SEQ ID NO: 483800 - RNA, 19 nt, Homo sapiens
ggccugagaagucuugcuu

SEQ ID NO: 483801 - RNA, 19 nt, Homo sapiens
aagaaccacccuugagaga

SEQ ID NO: 483802 - RNA, 19 nt, Homo sapiens
gaguaaaguggucccagau

SEQ ID NO: 483803 - RNA, 19 nt, Homo sapiens
caaagugaugaguaaagug

SEQ ID NO: 483804 - RNA, 19 nt, Homo sapiens
aaacucauuaguagacaug

SEQ ID NO: 483805 - RNA, 19 nt, Homo sapiens
gcaggacaauggggacaaa

SEQ ID NO: 483806 - RNA, 19 nt, Homo sapiens
augaggcucuuggauuaaa

SEQ ID NO: 483807 - RNA, 19 nt, Homo sapiens
gaucaagguccugcagaag

SEQ ID NO: 483808 - RNA, 19 nt, Homo sapiens
cagucagaauaaagaauca

SEQ ID NO: 483809 - RNA, 19 nt, Homo sapiens
cucauuaguagacauguuu

SEQ ID NO: 483810 - RNA, 19 nt, Homo sapiens
uuccagaaauauaguccaa

SEQ ID NO: 483811 - RNA, 19 nt, Homo sapiens
ugccacauuugccaggaaa

SEQ ID NO: 483812 - RNA, 19 nt, Homo sapiens
ccaggaaacaaugcugcua

SEQ ID NO: 483813 - RNA, 19 nt, Homo sapiens
agagucagcaggacaaugg

SEQ ID NO: 483814 - RNA, 19 nt, Homo sapiens
ggaggaggccaugcagaag

SEQ ID NO: 483815 - RNA, 19 nt, Homo sapiens
aaaugcuaguggcugauau

SEQ ID NO: 483816 - RNA, 19 nt, Homo sapiens
ucaggccccuaaaauaauu

SEQ ID NO: 483817 - RNA, 19 nt, Homo sapiens
ucacugauuagcuaugaca

SEQ ID NO: 483818 - RNA, 19 nt, Homo sapiens
agaaagagcuugacaguaa

SEQ ID NO: 483819 - RNA, 19 nt, Homo sapiens
ggagaauucuuacauguuu

SEQ ID NO: 483820 - RNA, 19 nt, Homo sapiens
ugcaagagcugaauuauaa

SEQ ID NO: 483821 - RNA, 19 nt, Homo sapiens
gaaccuaaguuucaguuga

SEQ ID NO: 483822 - RNA, 19 nt, Homo sapiens
ggaaguaguucacaaaaua

SEQ ID NO: 483823 - RNA, 19 nt, Homo sapiens
ugaaguaucuguauccaaa

SEQ ID NO: 483824 - RNA, 19 nt, Homo sapiens
uaaaggaacuggauauauc

SEQ ID NO: 483825 - RNA, 19 nt, Homo sapiens
gaaaggaaguaguucacaa

SEQ ID NO: 483826 - RNA, 19 nt, Homo sapiens
gagcuucacucccuuaguu

SEQ ID NO: 483827 - RNA, 19 nt, Homo sapiens
gaacaugacccuaucacaa

SEQ ID NO: 483828 - RNA, 19 nt, Homo sapiens
ucaagagccuggaagauuu

SEQ ID NO: 483829 - RNA, 19 nt, Homo sapiens
gaaagagcuugacaguaaa

SEQ ID NO: 483830 - RNA, 19 nt, Homo sapiens
gaugauguuucgugaagua

SEQ ID NO: 483831 - RNA, 19 nt, Homo sapiens
ggugguauuuagucuauua

SEQ ID NO: 483832 - RNA, 19 nt, Homo sapiens
caaauucuguuucuugaga

SEQ ID NO: 483833 - RNA, 19 nt, Homo sapiens
gaaaggcauucucugaaga

SEQ ID NO: 483834 - RNA, 19 nt, Homo sapiens
agaaugcccugauuaauga

SEQ ID NO: 483835 - RNA, 19 nt, Homo sapiens
ucacugaacuuacccagaa

SEQ ID NO: 483836 - RNA, 19 nt, Homo sapiens
gaauaugacuucaaaugca

SEQ ID NO: 483837 - RNA, 19 nt, Homo sapiens
gcacagugauguuagacaa

SEQ ID NO: 483838 - RNA, 19 nt, Homo sapiens
gaccgcaccuucagucuuu

SEQ ID NO: 483839 - RNA, 19 nt, Homo sapiens
ggacaagguuauguguaua

SEQ ID NO: 483840 - RNA, 19 nt, Homo sapiens
gaaaggagaaguuaagcaa

SEQ ID NO: 483841 - RNA, 19 nt, Homo sapiens
uaauagaguugcugaaugu

SEQ ID NO: 483842 - RNA, 19 nt, Homo sapiens
gacaaauucuguuucuuga

SEQ ID NO: 483843 - RNA, 19 nt, Homo sapiens
ggaacuggauauaucaaga

SEQ ID NO: 483844 - RNA, 19 nt, Homo sapiens
gaauaauacaccagagaua

SEQ ID NO: 483845 - RNA, 19 nt, Homo sapiens
gacacuagcuaauaucaau

SEQ ID NO: 483846 - RNA, 19 nt, Homo sapiens
gaaauacaccuacgaacau

SEQ ID NO: 483847 - RNA, 19 nt, Homo sapiens
gugcguagcugcuccuuug

SEQ ID NO: 483848 - RNA, 19 nt, Homo sapiens
cagcagagcgccuguauug

SEQ ID NO: 483849 - RNA, 19 nt, Homo sapiens
ccacaacuauauuaucaug

SEQ ID NO: 483850 - RNA, 19 nt, Homo sapiens
cgagagcugucuagguuaa

SEQ ID NO: 483851 - RNA, 19 nt, Homo sapiens
gagaagagaauauuagcuu

SEQ ID NO: 483852 - RNA, 19 nt, Homo sapiens
cacauuggcuauuuaaaga

SEQ ID NO: 483853 - RNA, 19 nt, Homo sapiens
guucaaagccaaguuuaua

SEQ ID NO: 483854 - RNA, 19 nt, Homo sapiens
guugauagcaagugaauuu

SEQ ID NO: 483855 - RNA, 19 nt, Homo sapiens
caaaguaucaggacgagaa

SEQ ID NO: 483856 - RNA, 19 nt, Homo sapiens
gaaagaaaggccagcaaau

SEQ ID NO: 483857 - RNA, 19 nt, Homo sapiens
ggcaaagagugaucagaaa

SEQ ID NO: 483858 - RNA, 19 nt, Homo sapiens
caccagagauaauaugaga

SEQ ID NO: 483859 - RNA, 19 nt, Homo sapiens
ggaguuaggcuauucacaa

SEQ ID NO: 483860 - RNA, 19 nt, Homo sapiens
uguuauagguuguuggaua

SEQ ID NO: 483861 - RNA, 19 nt, Homo sapiens
gggcucagcuuucagaagu

SEQ ID NO: 483862 - RNA, 19 nt, Homo sapiens
gaaagcauccuagaacuca

SEQ ID NO: 483863 - RNA, 19 nt, Homo sapiens
gcaauugaaagaacagaaa

SEQ ID NO: 483864 - RNA, 19 nt, Homo sapiens
ucagaaaugugaaggacaa

SEQ ID NO: 483865 - RNA, 19 nt, Homo sapiens
gauagugggcucuguagaa

SEQ ID NO: 483866 - RNA, 19 nt, Homo sapiens
ggaacuugauggcccuaaa

SEQ ID NO: 483867 - RNA, 19 nt, Homo sapiens
ugucacagcuggaugauca

SEQ ID NO: 483868 - RNA, 19 nt, Homo sapiens
auccaaagcugaauacauu

SEQ ID NO: 483869 - RNA, 19 nt, Homo sapiens
caaaagaggucucaaugug

SEQ ID NO: 483870 - RNA, 19 nt, Homo sapiens
gauuaaugaugaacuagug

SEQ ID NO: 483871 - RNA, 19 nt, Homo sapiens
caguauagagcaugaauuu

SEQ ID NO: 483872 - RNA, 19 nt, Homo sapiens
agacugaguugauuucugu

SEQ ID NO: 483873 - RNA, 19 nt, Homo sapiens
ggagcacgcugccaaugau

SEQ ID NO: 483874 - RNA, 19 nt, Homo sapiens
caaaugcuguauucuucuu

SEQ ID NO: 483875 - RNA, 19 nt, Homo sapiens
cuauguaacugcauugaga

SEQ ID NO: 483876 - RNA, 19 nt, Homo sapiens
gaaguuaagcaacaucuag

SEQ ID NO: 483877 - RNA, 19 nt, Homo sapiens
aaagaaaggccagcaaauu

SEQ ID NO: 483878 - RNA, 19 nt, Homo sapiens
cagaaugcccugauuaaug

SEQ ID NO: 483879 - RNA, 19 nt, Homo sapiens
uaagagaaaggaaguaguu

SEQ ID NO: 483880 - RNA, 19 nt, Homo sapiens
gaaaacgcccagagauuua

SEQ ID NO: 483881 - RNA, 19 nt, Homo sapiens
ccagaugucuaugaucauu

SEQ ID NO: 483882 - RNA, 19 nt, Homo sapiens
uauauaaccucgacagucu

SEQ ID NO: 483883 - RNA, 19 nt, Homo sapiens
gcuaauaucaauagaagga

SEQ ID NO: 483884 - RNA, 19 nt, Homo sapiens
uaagcaacaucuagcaaau

SEQ ID NO: 483885 - RNA, 19 nt, Homo sapiens
caucaugcaucuuacugaa

SEQ ID NO: 483886 - RNA, 19 nt, Homo sapiens
caagagccuggaagauuua

SEQ ID NO: 483887 - RNA, 19 nt, Homo sapiens
guauagagcaugaaaucaa

SEQ ID NO: 483888 - RNA, 19 nt, Homo sapiens
guuauuagggugguauuua

SEQ ID NO: 483889 - RNA, 19 nt, Homo sapiens
gagauggguuugacaaggu

SEQ ID NO: 483890 - RNA, 19 nt, Homo sapiens
ucacaaccacucauucaaa

SEQ ID NO: 483891 - RNA, 19 nt, Homo sapiens
cuggauauaucaagacuga

SEQ ID NO: 483892 - RNA, 19 nt, Homo sapiens
caaguucggcagcagcuua

SEQ ID NO: 483893 - RNA, 19 nt, Homo sapiens
ccuggaagauuuacaagau

SEQ ID NO: 483894 - RNA, 19 nt, Homo sapiens
ggaacugcuugacguagga

SEQ ID NO: 483895 - RNA, 19 nt, Homo sapiens
ugaaaggcauucucugaag

SEQ ID NO: 483896 - RNA, 19 nt, Homo sapiens
guaacugacaacuugaaua

SEQ ID NO: 483897 - RNA, 19 nt, Homo sapiens
auagaaggauguacauuuc

SEQ ID NO: 483898 - RNA, 19 nt, Homo sapiens
agacaaauucuguuucuug

SEQ ID NO: 483899 - RNA, 19 nt, Homo sapiens
agucauggcugcugagaau

SEQ ID NO: 483900 - RNA, 19 nt, Homo sapiens
gaugugaaugagagaaaua

SEQ ID NO: 483901 - RNA, 19 nt, Homo sapiens
ggaaaacgcccagagauuu

SEQ ID NO: 483902 - RNA, 19 nt, Homo sapiens
acagcuggaugaucaauau

SEQ ID NO: 483903 - RNA, 19 nt, Homo sapiens
caagggaguuaggcuauuc

SEQ ID NO: 483904 - RNA, 19 nt, Homo sapiens
gaauucgacaguaugauga

SEQ ID NO: 483905 - RNA, 19 nt, Homo sapiens
gggccuccauccuuuggua

SEQ ID NO: 483906 - RNA, 19 nt, Homo sapiens
cgacagucuuggcaccuaa

SEQ ID NO: 483907 - RNA, 19 nt, Homo sapiens
agcguaaucuucaggauaa

SEQ ID NO: 483908 - RNA, 19 nt, Homo sapiens
ccauggaaaucagacagua

SEQ ID NO: 483909 - RNA, 19 nt, Homo sapiens
agacaaagacaaauucugu

SEQ ID NO: 483910 - RNA, 19 nt, Homo sapiens
gguugggccuccauccuuu

SEQ ID NO: 483911 - RNA, 19 nt, Homo sapiens
ggaggaauuggaacagaaa

SEQ ID NO: 483912 - RNA, 19 nt, Homo sapiens
uggaagauuuacaagauga

SEQ ID NO: 483913 - RNA, 19 nt, Homo sapiens
guaacugcauugagaacug

SEQ ID NO: 483914 - RNA, 19 nt, Homo sapiens
gacaguaaagucagaaaug

SEQ ID NO: 483915 - RNA, 19 nt, Homo sapiens
ugagacuguuggugaaauu

SEQ ID NO: 483916 - RNA, 19 nt, Homo sapiens
ccugauuaaugaugaacua

SEQ ID NO: 483917 - RNA, 19 nt, Homo sapiens
ucagagcacagugauguua

SEQ ID NO: 483918 - RNA, 19 nt, Homo sapiens
agaaagagcuugacaguaa

SEQ ID NO: 483919 - RNA, 19 nt, Homo sapiens
ugcaagagcugaauuauaa

SEQ ID NO: 483920 - RNA, 19 nt, Homo sapiens
ggaaguaguucacaaaaua

SEQ ID NO: 483921 - RNA, 19 nt, Homo sapiens
ugaaguaucuguauccaaa

SEQ ID NO: 483922 - RNA, 19 nt, Homo sapiens
uaaaggaacuggauauauc

SEQ ID NO: 483923 - RNA, 19 nt, Homo sapiens
gaaaggaaguaguucacaa

SEQ ID NO: 483924 - RNA, 19 nt, Homo sapiens
gagcuucacucccuuaguu

SEQ ID NO: 483925 - RNA, 19 nt, Homo sapiens
caucacagcugaacuuguu

SEQ ID NO: 483926 - RNA, 19 nt, Homo sapiens
gaacaugacccuaucacaa

SEQ ID NO: 483927 - RNA, 19 nt, Homo sapiens
ucaagagccuggaagauuu

SEQ ID NO: 483928 - RNA, 19 nt, Homo sapiens
gaaagagcuugacaguaaa

SEQ ID NO: 483929 - RNA, 19 nt, Homo sapiens
agaaugcccugauuaauga

SEQ ID NO: 483930 - RNA, 19 nt, Homo sapiens
ucacugaacuuacccagaa

SEQ ID NO: 483931 - RNA, 19 nt, Homo sapiens
gaauaugacuucaaaugca

SEQ ID NO: 483932 - RNA, 19 nt, Homo sapiens
gcacagugauguuagacaa

SEQ ID NO: 483933 - RNA, 19 nt, Homo sapiens
gaccgcaccuucagucuuu

SEQ ID NO: 483934 - RNA, 19 nt, Homo sapiens
ggacaagguuauguguaua

SEQ ID NO: 483935 - RNA, 19 nt, Homo sapiens
uaauagaguugcugaaugu

SEQ ID NO: 483936 - RNA, 19 nt, Homo sapiens
ggaacuggauauaucaaga

SEQ ID NO: 483937 - RNA, 19 nt, Homo sapiens
gaaauacaccuacgaacau

SEQ ID NO: 483938 - RNA, 19 nt, Homo sapiens
gugcguagcugcuccuuug

SEQ ID NO: 483939 - RNA, 19 nt, Homo sapiens
cagcagagcgccuguauug

SEQ ID NO: 483940 - RNA, 19 nt, Homo sapiens
cgagagcugucuagguuaa

SEQ ID NO: 483941 - RNA, 19 nt, Homo sapiens
acagaagagugacauguuu

SEQ ID NO: 483942 - RNA, 19 nt, Homo sapiens
agagugacauguuuacaaa

SEQ ID NO: 483943 - RNA, 19 nt, Homo sapiens
ggcaaagagugaucagaaa

SEQ ID NO: 483944 - RNA, 19 nt, Homo sapiens
cagcugaacuuguugagau

SEQ ID NO: 483945 - RNA, 19 nt, Homo sapiens
gggcucagcuuucagaagu

SEQ ID NO: 483946 - RNA, 19 nt, Homo sapiens
gaaagcauccuagaacuca

SEQ ID NO: 483947 - RNA, 19 nt, Homo sapiens
gcaauugaaagaacagaaa

SEQ ID NO: 483948 - RNA, 19 nt, Homo sapiens
ucagaaaugugaaggacaa

SEQ ID NO: 483949 - RNA, 19 nt, Homo sapiens
aaacugauacccuuugaaa

SEQ ID NO: 483950 - RNA, 19 nt, Homo sapiens
ggaacuugauggcccuaaa

SEQ ID NO: 483951 - RNA, 19 nt, Homo sapiens
ugucacagcuggaugauca

SEQ ID NO: 483952 - RNA, 19 nt, Homo sapiens
caaaagaggucucaaugug

SEQ ID NO: 483953 - RNA, 19 nt, Homo sapiens
gauuaaugaugaacuagug

SEQ ID NO: 483954 - RNA, 19 nt, Homo sapiens
agacugaguugauuucugu

SEQ ID NO: 483955 - RNA, 19 nt, Homo sapiens
ggagcacgcugccaaugau

SEQ ID NO: 483956 - RNA, 19 nt, Homo sapiens
cagaaugcccugauuaaug

SEQ ID NO: 483957 - RNA, 19 nt, Homo sapiens
uaagagaaaggaaguaguu

SEQ ID NO: 483958 - RNA, 19 nt, Homo sapiens
gaaaacgcccagagauuua

SEQ ID NO: 483959 - RNA, 19 nt, Homo sapiens
ccagaugucuaugaucauu

SEQ ID NO: 483960 - RNA, 19 nt, Homo sapiens
caagagccuggaagauuua

SEQ ID NO: 483961 - RNA, 19 nt, Homo sapiens
guauagagcaugaaaucaa

SEQ ID NO: 483962 - RNA, 19 nt, Homo sapiens
uauauaaccucgacagucu

SEQ ID NO: 483963 - RNA, 19 nt, Homo sapiens
cuggauauaucaagacuga

SEQ ID NO: 483964 - RNA, 19 nt, Homo sapiens
caaguucggcagcagcuua

SEQ ID NO: 483965 - RNA, 19 nt, Homo sapiens
ccuggaagauuuacaagau

SEQ ID NO: 483966 - RNA, 19 nt, Homo sapiens
cagaagagugacauguuua

SEQ ID NO: 483967 - RNA, 19 nt, Homo sapiens
agucauggcugcugagaau

SEQ ID NO: 483968 - RNA, 19 nt, Homo sapiens
gaugugaaugagagaaaua

SEQ ID NO: 483969 - RNA, 19 nt, Homo sapiens
ggaaaacgcccagagauuu

SEQ ID NO: 483970 - RNA, 19 nt, Homo sapiens
acagcuggaugaucaauau

SEQ ID NO: 483971 - RNA, 19 nt, Homo sapiens
cgacagucuuggcaccuaa

SEQ ID NO: 483972 - RNA, 19 nt, Homo sapiens
gggccuccauccuuuggua

SEQ ID NO: 483973 - RNA, 19 nt, Homo sapiens
agcguaaucuucaggauaa

SEQ ID NO: 483974 - RNA, 19 nt, Homo sapiens
ccauggaaaucagacagua

SEQ ID NO: 483975 - RNA, 19 nt, Homo sapiens
gguugggccuccauccuuu

SEQ ID NO: 483976 - RNA, 19 nt, Homo sapiens
ggaggaauuggaacagaaa

SEQ ID NO: 483977 - RNA, 19 nt, Homo sapiens
uggaagauuuacaagauga

SEQ ID NO: 483978 - RNA, 19 nt, Homo sapiens
gacaguaaagucagaaaug

SEQ ID NO: 483979 - RNA, 19 nt, Homo sapiens
ugagacuguuggugaaauu

SEQ ID NO: 483980 - RNA, 19 nt, Homo sapiens
ccugauuaaugaugaacua

SEQ ID NO: 483981 - RNA, 19 nt, Homo sapiens
ucagagcacagugauguua

SEQ ID NO: 483982 - RNA, 19 nt, Homo sapiens
cugagaauauuccugagaa

SEQ ID NO: 483983 - RNA, 19 nt, Homo sapiens
guugaacccuacacgaaga

SEQ ID NO: 483984 - RNA, 19 nt, Homo sapiens
cucgagagcugucuagguu

SEQ ID NO: 483985 - RNA, 19 nt, Homo sapiens
gaaggacaagguuaugugu

SEQ ID NO: 483986 - RNA, 19 nt, Homo sapiens
ugacaucauucgcaauuac

SEQ ID NO: 483987 - RNA, 19 nt, Homo sapiens
gcacaagguggcaggaugu

SEQ ID NO: 483988 - RNA, 19 nt, Homo sapiens
gaaugagagaaauacagua

SEQ ID NO: 483989 - RNA, 19 nt, Homo sapiens
gauaaagaugugaaugaga

SEQ ID NO: 483990 - RNA, 19 nt, Homo sapiens
aaagagugaucagaaacaa

SEQ ID NO: 483991 - RNA, 19 nt, Homo sapiens
ccaaugguguggcaaagag

SEQ ID NO: 483992 - RNA, 19 nt, Homo sapiens
aggacaagguuauguguau

SEQ ID NO: 483993 - RNA, 19 nt, Homo sapiens
acaguaaagucagaaaugu

SEQ ID NO: 483994 - RNA, 19 nt, Homo sapiens
guaccuggcacagugguua

SEQ ID NO: 483995 - RNA, 19 nt, Homo sapiens
cauccuagaacucauuaaa

SEQ ID NO: 483996 - RNA, 19 nt, Homo sapiens
gcacgaugggcucagcuuu

SEQ ID NO: 483997 - RNA, 19 nt, Homo sapiens
gaaugucacugaacuuacc

SEQ ID NO: 483998 - RNA, 19 nt, Homo sapiens
ugucugaaguguaagugaa

SEQ ID NO: 483999 - RNA, 19 nt, Homo sapiens
caucguuacugaagagcuu

SEQ ID NO: 484000 - RNA, 19 nt, Homo sapiens
cuacgaacaugacccuauc

SEQ ID NO: 484001 - RNA, 19 nt, Homo sapiens
uggaucagcugcagaacug

SEQ ID NO: 484002 - RNA, 19 nt, Homo sapiens
auaauagaguugcugaaug

SEQ ID NO: 484003 - RNA, 19 nt, Homo sapiens
aaaggaaguaguucacaaa

SEQ ID NO: 484004 - RNA, 19 nt, Homo sapiens
gaaaugugaaggacaaggu

SEQ ID NO: 484005 - RNA, 19 nt, Homo sapiens
gaaaggaaaauucuggaaa

SEQ ID NO: 484006 - RNA, 19 nt, Homo sapiens
ggaagacccaauccagaug

SEQ ID NO: 484007 - RNA, 19 nt, Homo sapiens
uguugaagaugcuuguauu

SEQ ID NO: 484008 - RNA, 19 nt, Homo sapiens
gaacacagaagagugacau

SEQ ID NO: 484009 - RNA, 19 nt, Homo sapiens
ggauauaucaagacugagu

SEQ ID NO: 484010 - RNA, 19 nt, Homo sapiens
guacgaacuucagcagcuu

SEQ ID NO: 484011 - RNA, 19 nt, Homo sapiens
gcaggaugucucaguggua

SEQ ID NO: 484012 - RNA, 19 nt, Homo sapiens
agaaauacaccuacgaaca

SEQ ID NO: 484013 - RNA, 19 nt, Homo sapiens
ggaauuggaacagaaauac

SEQ ID NO: 484014 - RNA, 19 nt, Homo sapiens
ggagcagguucaccagcuu

SEQ ID NO: 484015 - RNA, 19 nt, Homo sapiens
caaagagugaucagaaaca

SEQ ID NO: 484016 - RNA, 19 nt, Homo sapiens
caauccagaugucuaugau

SEQ ID NO: 484017 - RNA, 19 nt, Homo sapiens
gaacuugauggcccuaaag

SEQ ID NO: 484018 - RNA, 19 nt, Homo sapiens
gagcaaagcuguuguuuca

SEQ ID NO: 484019 - RNA, 19 nt, Homo sapiens
ggacugaguugccugguua

SEQ ID NO: 484020 - RNA, 19 nt, Homo sapiens
gaacagaugcugagccaua

SEQ ID NO: 484021 - RNA, 19 nt, Homo sapiens
gcaggaaacucucaaugaa

SEQ ID NO: 484022 - RNA, 19 nt, Homo sapiens
ggacaacaaugaaucagaa

SEQ ID NO: 484023 - RNA, 19 nt, Homo sapiens
ggugagaggugaaagcaua

SEQ ID NO: 484024 - RNA, 19 nt, Homo sapiens
guacuuggcugucuggauu

SEQ ID NO: 484025 - RNA, 19 nt, Homo sapiens
gaagaaaucaugccgaaug

SEQ ID NO: 484026 - RNA, 19 nt, Homo sapiens
gaaacuguguaaagauuga

SEQ ID NO: 484027 - RNA, 19 nt, Homo sapiens
gaaaguuaaucuccaggaa

SEQ ID NO: 484028 - RNA, 19 nt, Homo sapiens
ugaaggaucucuggaauga

SEQ ID NO: 484029 - RNA, 19 nt, Homo sapiens
caauggaaaucuucagaaa

SEQ ID NO: 484030 - RNA, 19 nt, Homo sapiens
ggacauggcuggacaaaau

SEQ ID NO: 484031 - RNA, 19 nt, Homo sapiens
ggacugaggauccauuauu

SEQ ID NO: 484032 - RNA, 19 nt, Homo sapiens
cagaaacuguguaaagauu

SEQ ID NO: 484033 - RNA, 19 nt, Homo sapiens
ggauaggacuccauuucuu

SEQ ID NO: 484034 - RNA, 19 nt, Homo sapiens
agaaagggauggauaggaa

SEQ ID NO: 484035 - RNA, 19 nt, Homo sapiens
ucaguucucugguucaauu

SEQ ID NO: 484036 - RNA, 19 nt, Homo sapiens
ggaaggauuucaacauuuu

SEQ ID NO: 484037 - RNA, 19 nt, Homo sapiens
gggaaaugcugcagaaucu

SEQ ID NO: 484038 - RNA, 19 nt, Homo sapiens
gauaggacuccauuucuuu

SEQ ID NO: 484039 - RNA, 19 nt, Homo sapiens
uaggauaacuugcuuucuu

SEQ ID NO: 484040 - RNA, 19 nt, Homo sapiens
gaaacucuacccugaagaa

SEQ ID NO: 484041 - RNA, 19 nt, Homo sapiens
gugauuauuuccaacauga

SEQ ID NO: 484042 - RNA, 19 nt, Homo sapiens
gaaaugcugcagaaucuug

SEQ ID NO: 484043 - RNA, 19 nt, Homo sapiens
gagcccuccuggcaaguua

SEQ ID NO: 484044 - RNA, 19 nt, Homo sapiens
gacugaggauccauuauug

SEQ ID NO: 484045 - RNA, 19 nt, Homo sapiens
ggaaagggcagcaauaagg

SEQ ID NO: 484046 - RNA, 19 nt, Homo sapiens
gcaccaggaugaugacaag

SEQ ID NO: 484047 - RNA, 19 nt, Homo sapiens
guucacagcuggagcaaag

SEQ ID NO: 484048 - RNA, 19 nt, Homo sapiens
caucagagcucccauugac

SEQ ID NO: 484049 - RNA, 19 nt, Homo sapiens
gaaccacauuuccucuguu

SEQ ID NO: 484050 - RNA, 19 nt, Homo sapiens
ccacugcgcuuccucuauc

SEQ ID NO: 484051 - RNA, 19 nt, Homo sapiens
ugaguugccugguuagcua

SEQ ID NO: 484052 - RNA, 19 nt, Homo sapiens
uggaacagcuggagacaug

SEQ ID NO: 484053 - RNA, 19 nt, Homo sapiens
ggacuccauuucuuucuuc

SEQ ID NO: 484054 - RNA, 19 nt, Homo sapiens
ugagacauuugaacacuga

SEQ ID NO: 484055 - RNA, 19 nt, Homo sapiens
caacaaccgcuggagcuua

SEQ ID NO: 484056 - RNA, 19 nt, Homo sapiens
gcaguucuccuccuauguu

SEQ ID NO: 484057 - RNA, 19 nt, Homo sapiens
gcccaaaccuucagaacca

SEQ ID NO: 484058 - RNA, 19 nt, Homo sapiens
ucaacauucugacuucaaa

SEQ ID NO: 484059 - RNA, 19 nt, Homo sapiens
ccagggcaguugacaggua

SEQ ID NO: 484060 - RNA, 19 nt, Homo sapiens
ccugugaucugagacauuu

SEQ ID NO: 484061 - RNA, 19 nt, Homo sapiens
uaagggcuaugauggagaa

SEQ ID NO: 484062 - RNA, 19 nt, Homo sapiens
uaagcuggcuguaccuguu

SEQ ID NO: 484063 - RNA, 19 nt, Homo sapiens
uggaaggauuucaacauuu

SEQ ID NO: 484064 - RNA, 19 nt, Homo sapiens
gagcaacguucaggugguu

SEQ ID NO: 484065 - RNA, 19 nt, Homo sapiens
gaaauucugccgggacauu

SEQ ID NO: 484066 - RNA, 19 nt, Homo sapiens
ucagggcaguggcuucuuu

SEQ ID NO: 484067 - RNA, 19 nt, Homo sapiens
gauaggaaguagaccucuu

SEQ ID NO: 484068 - RNA, 19 nt, Homo sapiens
uaacuugcuuucuucuuuc

SEQ ID NO: 484069 - RNA, 19 nt, Homo sapiens
gggcuucaguucucugguu

SEQ ID NO: 484070 - RNA, 19 nt, Homo sapiens
caagcuguguuaacuguuc

SEQ ID NO: 484071 - RNA, 19 nt, Homo sapiens
gaucugagacauuugaaca

SEQ ID NO: 484072 - RNA, 19 nt, Homo sapiens
cagaggaacugcacaucau

SEQ ID NO: 484073 - RNA, 19 nt, Homo sapiens
ggacuuugguuaccugacu

SEQ ID NO: 484074 - RNA, 19 nt, Homo sapiens
gaacacugagccaauggaa

SEQ ID NO: 484075 - RNA, 19 nt, Homo sapiens
gauuugcccugugaucuga

SEQ ID NO: 484076 - RNA, 19 nt, Homo sapiens
aacaaccgcuggagcuuaa

SEQ ID NO: 484077 - RNA, 19 nt, Homo sapiens
ggaugacccucugaccaaa

SEQ ID NO: 484078 - RNA, 19 nt, Homo sapiens
ucagagggcccaauuggaa

SEQ ID NO: 484079 - RNA, 19 nt, Homo sapiens
gaggagaauauaccugaaa

SEQ ID NO: 484080 - RNA, 19 nt, Homo sapiens
aaggaucucuggaaugaug

SEQ ID NO: 484081 - RNA, 19 nt, Homo sapiens
ggaauccuccucaauuaca

SEQ ID NO: 484082 - RNA, 19 nt, Homo sapiens
ugaaagaccagcaggaugu

SEQ ID NO: 484083 - RNA, 19 nt, Homo sapiens
ggacaaaauucuggaguug

SEQ ID NO: 484084 - RNA, 19 nt, Homo sapiens
gccgaggccucaacucaga

SEQ ID NO: 484085 - RNA, 19 nt, Homo sapiens
gaauccuccucaauuacaa

SEQ ID NO: 484086 - RNA, 19 nt, Homo sapiens
gaccaaagagcagaagauu

SEQ ID NO: 484087 - RNA, 19 nt, Homo sapiens
caaugaaucagaacagaug

SEQ ID NO: 484088 - RNA, 19 nt, Homo sapiens
gcacagacacaggauagga

SEQ ID NO: 484089 - RNA, 19 nt, Homo sapiens
ggaaaucuucagaaacugu

SEQ ID NO: 484090 - RNA, 19 nt, Homo sapiens
caggaaagggcagcaauaa

SEQ ID NO: 484091 - RNA, 19 nt, Homo sapiens
ccaguuggcugagaugauc

SEQ ID NO: 484092 - RNA, 19 nt, Homo sapiens
gagcacagacacaggauag

SEQ ID NO: 484093 - RNA, 19 nt, Homo sapiens
ccauaggucuaaauaggau

SEQ ID NO: 484094 - RNA, 19 nt, Homo sapiens
gacccuugaugccuucuga

SEQ ID NO: 484095 - RNA, 19 nt, Homo sapiens
gaauggugacccacuguug

SEQ ID NO: 484096 - RNA, 19 nt, Homo sapiens
acacugagccaauggaaau

SEQ ID NO: 484097 - RNA, 19 nt, Homo sapiens
cagcuucacggucaaauau

SEQ ID NO: 484098 - RNA, 19 nt, Homo sapiens
ucaaugaacuggacaaaag

SEQ ID NO: 484099 - RNA, 19 nt, Homo sapiens
gugaaacucuacccugaag

SEQ ID NO: 484100 - RNA, 19 nt, Homo sapiens
ucaggaaagggcagcaaua

SEQ ID NO: 484101 - RNA, 19 nt, Homo sapiens
gagcugaagggacugaguu

SEQ ID NO: 484102 - RNA, 19 nt, Homo sapiens
gaugaucuuuaaccuccuu

SEQ ID NO: 484103 - RNA, 19 nt, Homo sapiens
gcucaagcccugaauuucu

SEQ ID NO: 484104 - RNA, 19 nt, Homo sapiens
uguguuaacuguucaaacu

SEQ ID NO: 484105 - RNA, 19 nt, Homo sapiens
cacauuuccucuguucuuu

SEQ ID NO: 484106 - RNA, 19 nt, Homo sapiens
cauccgccauuaccaguug

SEQ ID NO: 484107 - RNA, 19 nt, Homo sapiens
gcagcacaauuugcggaaa

SEQ ID NO: 484108 - RNA, 19 nt, Homo sapiens
gaggugaaagcauaacaug

SEQ ID NO: 484109 - RNA, 19 nt, Homo sapiens
ccacauuuccucuguucuu

SEQ ID NO: 484110 - RNA, 19 nt, Homo sapiens
cuaauagacagguggauga

SEQ ID NO: 484111 - RNA, 19 nt, Homo sapiens
ggauuuaagggcuaugaug

SEQ ID NO: 484112 - RNA, 19 nt, Homo sapiens
auggaaggauuucaacauu

SEQ ID NO: 484113 - RNA, 19 nt, Homo sapiens
ccaggauccuacccaguug

SEQ ID NO: 484114 - RNA, 19 nt, Homo sapiens
cuugaugccuucugacuuc

SEQ ID NO: 484115 - RNA, 19 nt, Homo sapiens
acagguggaugaacugcaa

SEQ ID NO: 484116 - RNA, 19 nt, Homo sapiens
gaaaucauccgccauuacc

SEQ ID NO: 484117 - RNA, 19 nt, Homo sapiens
caacaugaaccagcucuca

SEQ ID NO: 484118 - RNA, 19 nt, Homo sapiens
ggaaaugucuuguguuguu

SEQ ID NO: 484119 - RNA, 19 nt, Homo sapiens
ccaacgaccugcagcaaua

SEQ ID NO: 484120 - RNA, 19 nt, Homo sapiens
gcauagccuuucuguauuu

SEQ ID NO: 484121 - RNA, 19 nt, Homo sapiens
ggagaagcaucgugaguga

SEQ ID NO: 484122 - RNA, 19 nt, Homo sapiens
gaaacaggauggcccaaug

SEQ ID NO: 484123 - RNA, 19 nt, Homo sapiens
ccacuuugguguuucauaa

SEQ ID NO: 484124 - RNA, 19 nt, Homo sapiens
cagcauagccuuucuguau

SEQ ID NO: 484125 - RNA, 19 nt, Homo sapiens
gaucauggaugcuaccaau

SEQ ID NO: 484126 - RNA, 19 nt, Homo sapiens
gagcagagaugugggaaug

SEQ ID NO: 484127 - RNA, 19 nt, Homo sapiens
ggaaacaaccagucaguga

SEQ ID NO: 484128 - RNA, 19 nt, Homo sapiens
gaaaugucuuguguuguuu

SEQ ID NO: 484129 - RNA, 19 nt, Homo sapiens
gaaaucaucaugggcuaua

SEQ ID NO: 484130 - RNA, 19 nt, Homo sapiens
gaaugugggugaucugcuu

SEQ ID NO: 484131 - RNA, 19 nt, Homo sapiens
gaggaucccggaaauuuaa

SEQ ID NO: 484132 - RNA, 19 nt, Homo sapiens
gaguugaauuaucagcuua

SEQ ID NO: 484133 - RNA, 19 nt, Homo sapiens
gaaggaggcgucacuuuca

SEQ ID NO: 484134 - RNA, 19 nt, Homo sapiens
gagcagguaucuugagaag

SEQ ID NO: 484135 - RNA, 19 nt, Homo sapiens
gaccaacaaucccaagaau

SEQ ID NO: 484136 - RNA, 19 nt, Homo sapiens
ucaagaccauccuggcuaa

SEQ ID NO: 484137 - RNA, 19 nt, Homo sapiens
gaacggaagcugcagaaag

SEQ ID NO: 484138 - RNA, 19 nt, Homo sapiens
ugcaagaucugaauggaaa

SEQ ID NO: 484139 - RNA, 19 nt, Homo sapiens
aaggaaaugucuuguguug

SEQ ID NO: 484140 - RNA, 19 nt, Homo sapiens
auaaggauguguucucuga

SEQ ID NO: 484141 - RNA, 19 nt, Homo sapiens
ucacuuggguggagaagga

SEQ ID NO: 484142 - RNA, 19 nt, Homo sapiens
ggaagagagugcaggaucu

SEQ ID NO: 484143 - RNA, 19 nt, Homo sapiens
gagauugaccagcaguaua

SEQ ID NO: 484144 - RNA, 19 nt, Homo sapiens
caacaugucauuugcugaa

SEQ ID NO: 484145 - RNA, 19 nt, Homo sapiens
gggcguccauccuguggua

SEQ ID NO: 484146 - RNA, 19 nt, Homo sapiens
gaagaggcggcaacagauu

SEQ ID NO: 484147 - RNA, 19 nt, Homo sapiens
gaucaucugaaacuacuaa

SEQ ID NO: 484148 - RNA, 19 nt, Homo sapiens
ccaacaaucccaagaaugu

SEQ ID NO: 484149 - RNA, 19 nt, Homo sapiens
ucagacccgucaacaaauu

SEQ ID NO: 484150 - RNA, 19 nt, Homo sapiens
cagaggaucccggaaauuu

SEQ ID NO: 484151 - RNA, 19 nt, Homo sapiens
caacagauugccugcauug

SEQ ID NO: 484152 - RNA, 19 nt, Homo sapiens
aaaugaaagugguagagaa

SEQ ID NO: 484153 - RNA, 19 nt, Homo sapiens
gaaucacgccuucuacaga

SEQ ID NO: 484154 - RNA, 19 nt, Homo sapiens
uaaccuugcugacauccaa

SEQ ID NO: 484155 - RNA, 19 nt, Homo sapiens
aacggaagcugcagaaaga

SEQ ID NO: 484156 - RNA, 19 nt, Homo sapiens
gaagagagugcaggaucua

SEQ ID NO: 484157 - RNA, 19 nt, Homo sapiens
gaaucaagcaguuucuuca

SEQ ID NO: 484158 - RNA, 19 nt, Homo sapiens
cagccucucugcagaauuc

SEQ ID NO: 484159 - RNA, 19 nt, Homo sapiens
uccaucagcucuacaguga

SEQ ID NO: 484160 - RNA, 19 nt, Homo sapiens
gauaacgucauuagcagaa

SEQ ID NO: 484161 - RNA, 19 nt, Homo sapiens
ggccaccuauagcuacaua

SEQ ID NO: 484162 - RNA, 19 nt, Homo sapiens
ggaagaggcggcaacagau

SEQ ID NO: 484163 - RNA, 19 nt, Homo sapiens
caucagcucuacagugaca

SEQ ID NO: 484164 - RNA, 19 nt, Homo sapiens
agaaggacaucagcgguaa

SEQ ID NO: 484165 - RNA, 19 nt, Homo sapiens
gguacaacaugcugaccaa

SEQ ID NO: 484166 - RNA, 19 nt, Homo sapiens
caggaugacuuugauuuca

SEQ ID NO: 484167 - RNA, 19 nt, Homo sapiens
uaucuaagcccuagguuuc

SEQ ID NO: 484168 - RNA, 19 nt, Homo sapiens
ugaugcaguuuggaaauaa

SEQ ID NO: 484169 - RNA, 19 nt, Homo sapiens
cacuuuagauucauugaug

SEQ ID NO: 484170 - RNA, 19 nt, Homo sapiens
agaccaaguuuaucugugu

SEQ ID NO: 484171 - RNA, 19 nt, Homo sapiens
ggacguugcagcucucaga

SEQ ID NO: 484172 - RNA, 19 nt, Homo sapiens
agaaucacaugccacuuug

SEQ ID NO: 484173 - RNA, 19 nt, Homo sapiens
cagagcagguaucuugaga

SEQ ID NO: 484174 - RNA, 19 nt, Homo sapiens
agucgaauguucucuauca

SEQ ID NO: 484175 - RNA, 19 nt, Homo sapiens
gaucauaaggucaggagau

SEQ ID NO: 484176 - RNA, 19 nt, Homo sapiens
cauagccuuucuguauuua

SEQ ID NO: 484177 - RNA, 19 nt, Homo sapiens
caucugaaacuacuaacuu

SEQ ID NO: 484178 - RNA, 19 nt, Homo sapiens
gaagaccaaguuuaucugu

SEQ ID NO: 484179 - RNA, 19 nt, Homo sapiens
ccaguucacuacuaaaguc

SEQ ID NO: 484180 - RNA, 19 nt, Homo sapiens
gagucaagauugggcauau

SEQ ID NO: 484181 - RNA, 19 nt, Homo sapiens
acaacaugcugaccaacaa

SEQ ID NO: 484182 - RNA, 19 nt, Homo sapiens
uaaagugugcauugacaaa

SEQ ID NO: 484183 - RNA, 19 nt, Homo sapiens
cuucagacccgucaacaaa

SEQ ID NO: 484184 - RNA, 19 nt, Homo sapiens
gaauggaaacaaccaguca

SEQ ID NO: 484185 - RNA, 19 nt, Homo sapiens
ugaaagugguagagaaucu

SEQ ID NO: 484186 - RNA, 19 nt, Homo sapiens
cuucagagcagguaucuug

SEQ ID NO: 484187 - RNA, 19 nt, Homo sapiens
gcaggagaaucgcuugaac

SEQ ID NO: 484188 - RNA, 19 nt, Homo sapiens
gaaaccccgucucuacuaa

SEQ ID NO: 484189 - RNA, 19 nt, Homo sapiens
aagaaucacaugccacuuu

SEQ ID NO: 484190 - RNA, 19 nt, Homo sapiens
ccacuggucuaucucuauc

SEQ ID NO: 484191 - RNA, 19 nt, Homo sapiens
guggugaucuccaacaucu

SEQ ID NO: 484192 - RNA, 19 nt, Homo sapiens
ugaguugaauuaucagcuu

SEQ ID NO: 484193 - RNA, 19 nt, Homo sapiens
gcuacauacuccuggcauu

SEQ ID NO: 484194 - RNA, 19 nt, Homo sapiens
ucccugaguugaauuauca

SEQ ID NO: 484195 - RNA, 19 nt, Homo sapiens
agaggaucccggaaauuua

SEQ ID NO: 484196 - RNA, 19 nt, Homo sapiens
gagagugcaggaucuagaa

SEQ ID NO: 484197 - RNA, 19 nt, Homo sapiens
caaauagaagauaggacua

SEQ ID NO: 484198 - RNA, 19 nt, Homo sapiens
caaauaaggauguguucuc

SEQ ID NO: 484199 - RNA, 19 nt, Homo sapiens
gaggaggcauucggaaagu

SEQ ID NO: 484200 - RNA, 19 nt, Homo sapiens
caucaugggcuauaagauc

SEQ ID NO: 484201 - RNA, 19 nt, Homo sapiens
ugaugaacauggaagaauc

SEQ ID NO: 484202 - RNA, 19 nt, Homo sapiens
gaaucuccaggaugacuuu

SEQ ID NO: 484203 - RNA, 19 nt, Homo sapiens
agugacagcuucccaaugg

SEQ ID NO: 484204 - RNA, 19 nt, Homo sapiens
cuacuucugcuaucuuuga

SEQ ID NO: 484205 - RNA, 19 nt, Homo sapiens
uagauucauugaugcaguu

SEQ ID NO: 484206 - RNA, 19 nt, Homo sapiens
ccauugaccugccgauguc

SEQ ID NO: 484207 - RNA, 19 nt, Homo sapiens
ggaggaggcauucggaaag

SEQ ID NO: 484208 - RNA, 19 nt, Homo sapiens
uauaagaucauggaugcua

SEQ ID NO: 484209 - RNA, 19 nt, Homo sapiens
caaaagugaugaacaugga

SEQ ID NO: 484210 - RNA, 19 nt, Homo sapiens
gcguccaguucacuacuaa

SEQ ID NO: 484211 - RNA, 19 nt, Homo sapiens
ugaaacuacuaacuuugug

SEQ ID NO: 484212 - RNA, 19 nt, Homo sapiens
gagaacggaagcugcagaa

SEQ ID NO: 484213 - RNA, 19 nt, Homo sapiens
gaugcaguuuggaaauaau

SEQ ID NO: 484214 - RNA, 19 nt, Homo sapiens
uugaugcaguuuggaaaua

SEQ ID NO: 484215 - RNA, 19 nt, Homo sapiens
ggaggcauucggaaaguau

SEQ ID NO: 484216 - RNA, 19 nt, Homo sapiens
ugaacaacaugucauuugc

SEQ ID NO: 484217 - RNA, 19 nt, Homo sapiens
aaaaggaaaugucuugugu

SEQ ID NO: 484218 - RNA, 19 nt, Homo sapiens
ggaaaugucuuguguuguu

SEQ ID NO: 484219 - RNA, 19 nt, Homo sapiens
ccaacgaccugcagcaaua

SEQ ID NO: 484220 - RNA, 19 nt, Homo sapiens
gcauagccuuucuguauuu

SEQ ID NO: 484221 - RNA, 19 nt, Homo sapiens
ggagaagcaucgugaguga

SEQ ID NO: 484222 - RNA, 19 nt, Homo sapiens
ccacuuugguguuucauaa

SEQ ID NO: 484223 - RNA, 19 nt, Homo sapiens
cagcauagccuuucuguau

SEQ ID NO: 484224 - RNA, 19 nt, Homo sapiens
gaucauggaugcuaccaau

SEQ ID NO: 484225 - RNA, 19 nt, Homo sapiens
gagcagagaugugggaaug

SEQ ID NO: 484226 - RNA, 19 nt, Homo sapiens
ggaaacaaccagucaguga

SEQ ID NO: 484227 - RNA, 19 nt, Homo sapiens
gaaaugucuuguguuguuu

SEQ ID NO: 484228 - RNA, 19 nt, Homo sapiens
gaaaucaucaugggcuaua

SEQ ID NO: 484229 - RNA, 19 nt, Homo sapiens
gaaugugggugaucugcuu

SEQ ID NO: 484230 - RNA, 19 nt, Homo sapiens
gaggaucccggaaauuuaa

SEQ ID NO: 484231 - RNA, 19 nt, Homo sapiens
gaguugaauuaucagcuua

SEQ ID NO: 484232 - RNA, 19 nt, Homo sapiens
gaaggaggcgucacuuuca

SEQ ID NO: 484233 - RNA, 19 nt, Homo sapiens
gagcagguaucuugagaag

SEQ ID NO: 484234 - RNA, 19 nt, Homo sapiens
gaccaacaaucccaagaau

SEQ ID NO: 484235 - RNA, 19 nt, Homo sapiens
ucaagaccauccuggcuaa

SEQ ID NO: 484236 - RNA, 19 nt, Homo sapiens
gaacggaagcugcagaaag

SEQ ID NO: 484237 - RNA, 19 nt, Homo sapiens
ugcaagaucugaauggaaa

SEQ ID NO: 484238 - RNA, 19 nt, Homo sapiens
aaggaaaugucuuguguug

SEQ ID NO: 484239 - RNA, 19 nt, Homo sapiens
auaaggauguguucucuga

SEQ ID NO: 484240 - RNA, 19 nt, Homo sapiens
ucacuuggguggagaagga

SEQ ID NO: 484241 - RNA, 19 nt, Homo sapiens
ggaagagagugcaggaucu

SEQ ID NO: 484242 - RNA, 19 nt, Homo sapiens
gagauugaccagcaguaua

SEQ ID NO: 484243 - RNA, 19 nt, Homo sapiens
caacaugucauuugcugaa

SEQ ID NO: 484244 - RNA, 19 nt, Homo sapiens
gggcguccauccuguggua

SEQ ID NO: 484245 - RNA, 19 nt, Homo sapiens
gaagaggcggcaacagauu

SEQ ID NO: 484246 - RNA, 19 nt, Homo sapiens
gaucaucugaaacuacuaa

SEQ ID NO: 484247 - RNA, 19 nt, Homo sapiens
ccaacaaucccaagaaugu

SEQ ID NO: 484248 - RNA, 19 nt, Homo sapiens
ucagacccgucaacaaauu

SEQ ID NO: 484249 - RNA, 19 nt, Homo sapiens
cagaggaucccggaaauuu

SEQ ID NO: 484250 - RNA, 19 nt, Homo sapiens
caacagauugccugcauug

SEQ ID NO: 484251 - RNA, 19 nt, Homo sapiens
aaaugaaagugguagagaa

SEQ ID NO: 484252 - RNA, 19 nt, Homo sapiens
gaaucacgccuucuacaga

SEQ ID NO: 484253 - RNA, 19 nt, Homo sapiens
uaaccuugcugacauccaa

SEQ ID NO: 484254 - RNA, 19 nt, Homo sapiens
aacggaagcugcagaaaga

SEQ ID NO: 484255 - RNA, 19 nt, Homo sapiens
gaagagagugcaggaucua

SEQ ID NO: 484256 - RNA, 19 nt, Homo sapiens
gaaucaagcaguuucuuca

SEQ ID NO: 484257 - RNA, 19 nt, Homo sapiens
cagccucucugcagaauuc

SEQ ID NO: 484258 - RNA, 19 nt, Homo sapiens
uccaucagcucuacaguga

SEQ ID NO: 484259 - RNA, 19 nt, Homo sapiens
gauaacgucauuagcagaa

SEQ ID NO: 484260 - RNA, 19 nt, Homo sapiens
ggccaccuauagcuacaua

SEQ ID NO: 484261 - RNA, 19 nt, Homo sapiens
ggaagaggcggcaacagau

SEQ ID NO: 484262 - RNA, 19 nt, Homo sapiens
agaaggacaucagcgguaa

SEQ ID NO: 484263 - RNA, 19 nt, Homo sapiens
gguacaacaugcugaccaa

SEQ ID NO: 484264 - RNA, 19 nt, Homo sapiens
caucagcucuacagugaca

SEQ ID NO: 484265 - RNA, 19 nt, Homo sapiens
caggaugacuuugauuuca

SEQ ID NO: 484266 - RNA, 19 nt, Homo sapiens
uaucuaagcccuagguuuc

SEQ ID NO: 484267 - RNA, 19 nt, Homo sapiens
ugaugcaguuuggaaauaa

SEQ ID NO: 484268 - RNA, 19 nt, Homo sapiens
cacuuuagauucauugaug

SEQ ID NO: 484269 - RNA, 19 nt, Homo sapiens
agaccaaguuuaucugugu

SEQ ID NO: 484270 - RNA, 19 nt, Homo sapiens
ggacguugcagcucucaga

SEQ ID NO: 484271 - RNA, 19 nt, Homo sapiens
cagagcagguaucuugaga

SEQ ID NO: 484272 - RNA, 19 nt, Homo sapiens
agucgaauguucucuauca

SEQ ID NO: 484273 - RNA, 19 nt, Homo sapiens
agaaucacaugccacuuug

SEQ ID NO: 484274 - RNA, 19 nt, Homo sapiens
gaucauaaggucaggagau

SEQ ID NO: 484275 - RNA, 19 nt, Homo sapiens
cauagccuuucuguauuua

SEQ ID NO: 484276 - RNA, 19 nt, Homo sapiens
caucugaaacuacuaacuu

SEQ ID NO: 484277 - RNA, 19 nt, Homo sapiens
gaagaccaaguuuaucugu

SEQ ID NO: 484278 - RNA, 19 nt, Homo sapiens
ccaguucacuacuaaaguc

SEQ ID NO: 484279 - RNA, 19 nt, Homo sapiens
acaacaugcugaccaacaa

SEQ ID NO: 484280 - RNA, 19 nt, Homo sapiens
uaaagugugcauugacaaa

SEQ ID NO: 484281 - RNA, 19 nt, Homo sapiens
cuucagacccgucaacaaa

SEQ ID NO: 484282 - RNA, 19 nt, Homo sapiens
gagucaagauugggcauau

SEQ ID NO: 484283 - RNA, 19 nt, Homo sapiens
gaauggaaacaaccaguca

SEQ ID NO: 484284 - RNA, 19 nt, Homo sapiens
ugaaagugguagagaaucu

SEQ ID NO: 484285 - RNA, 19 nt, Homo sapiens
cuucagagcagguaucuug

SEQ ID NO: 484286 - RNA, 19 nt, Homo sapiens
gcaggagaaucgcuugaac

SEQ ID NO: 484287 - RNA, 19 nt, Homo sapiens
gaaaccccgucucuacuaa

SEQ ID NO: 484288 - RNA, 19 nt, Homo sapiens
ccacuggucuaucucuauc

SEQ ID NO: 484289 - RNA, 19 nt, Homo sapiens
guggugaucuccaacaucu

SEQ ID NO: 484290 - RNA, 19 nt, Homo sapiens
aagaaucacaugccacuuu

SEQ ID NO: 484291 - RNA, 19 nt, Homo sapiens
ugaguugaauuaucagcuu

SEQ ID NO: 484292 - RNA, 19 nt, Homo sapiens
gcuacauacuccuggcauu

SEQ ID NO: 484293 - RNA, 19 nt, Homo sapiens
ucccugaguugaauuauca

SEQ ID NO: 484294 - RNA, 19 nt, Homo sapiens
agaggaucccggaaauuua

SEQ ID NO: 484295 - RNA, 19 nt, Homo sapiens
gagagugcaggaucuagaa

SEQ ID NO: 484296 - RNA, 19 nt, Homo sapiens
caaauagaagauaggacua

SEQ ID NO: 484297 - RNA, 19 nt, Homo sapiens
caaauaaggauguguucuc

SEQ ID NO: 484298 - RNA, 19 nt, Homo sapiens
gaggaggcauucggaaagu

SEQ ID NO: 484299 - RNA, 19 nt, Homo sapiens
caucaugggcuauaagauc

SEQ ID NO: 484300 - RNA, 19 nt, Homo sapiens
ugaugaacauggaagaauc

SEQ ID NO: 484301 - RNA, 19 nt, Homo sapiens
gaaucuccaggaugacuuu

SEQ ID NO: 484302 - RNA, 19 nt, Homo sapiens
agugacagcuucccaaugg

SEQ ID NO: 484303 - RNA, 19 nt, Homo sapiens
cuacuucugcuaucuuuga

SEQ ID NO: 484304 - RNA, 19 nt, Homo sapiens
uagauucauugaugcaguu

SEQ ID NO: 484305 - RNA, 19 nt, Homo sapiens
ccauugaccugccgauguc

SEQ ID NO: 484306 - RNA, 19 nt, Homo sapiens
ggaggaggcauucggaaag

SEQ ID NO: 484307 - RNA, 19 nt, Homo sapiens
uauaagaucauggaugcua

SEQ ID NO: 484308 - RNA, 19 nt, Homo sapiens
caaaagugaugaacaugga

SEQ ID NO: 484309 - RNA, 19 nt, Homo sapiens
gcguccaguucacuacuaa

SEQ ID NO: 484310 - RNA, 19 nt, Homo sapiens
ugaaacuacuaacuuugug

SEQ ID NO: 484311 - RNA, 19 nt, Homo sapiens
gagaacggaagcugcagaa

SEQ ID NO: 484312 - RNA, 19 nt, Homo sapiens
gaugcaguuuggaaauaau

SEQ ID NO: 484313 - RNA, 19 nt, Homo sapiens
uugaugcaguuuggaaaua

SEQ ID NO: 484314 - RNA, 19 nt, Homo sapiens
ggaggcauucggaaaguau

SEQ ID NO: 484315 - RNA, 19 nt, Homo sapiens
ugaacaacaugucauuugc

SEQ ID NO: 484316 - RNA, 19 nt, Homo sapiens
aaaaggaaaugucuugugu

SEQ ID NO: 484317 - RNA, 19 nt, Homo sapiens
auagagaaaugagugaaug

SEQ ID NO: 484318 - RNA, 19 nt, Homo sapiens
gaacuaaacuaucagguaa

SEQ ID NO: 484319 - RNA, 19 nt, Homo sapiens
gcaaagaacucacaugcua

SEQ ID NO: 484320 - RNA, 19 nt, Homo sapiens
cagauaaacuugcaagaua

SEQ ID NO: 484321 - RNA, 19 nt, Homo sapiens
gaaaggaggcucucaguaa

SEQ ID NO: 484322 - RNA, 19 nt, Homo sapiens
gcaaugaagucuccuuauu

SEQ ID NO: 484323 - RNA, 19 nt, Homo sapiens
gagaaauccuuacaaaguu

SEQ ID NO: 484324 - RNA, 19 nt, Homo sapiens
gaauuugacuacagguaua

SEQ ID NO: 484325 - RNA, 19 nt, Homo sapiens
gaagcaauauuggaucuaa

SEQ ID NO: 484326 - RNA, 19 nt, Homo sapiens
gaacugcuuuacacuauug

SEQ ID NO: 484327 - RNA, 19 nt, Homo sapiens
ggaggcagcuucuaacaau

SEQ ID NO: 484328 - RNA, 19 nt, Homo sapiens
gcagguggaucaauucuau

SEQ ID NO: 484329 - RNA, 19 nt, Homo sapiens
gcauguagcugugguuauu

SEQ ID NO: 484330 - RNA, 19 nt, Homo sapiens
aaccaaagcuucagauaaa

SEQ ID NO: 484331 - RNA, 19 nt, Homo sapiens
ggaaucaaguccaacaguu

SEQ ID NO: 484332 - RNA, 19 nt, Homo sapiens
guaccuauauccugacauu

SEQ ID NO: 484333 - RNA, 19 nt, Homo sapiens
gggcauccaucauuuggua

SEQ ID NO: 484334 - RNA, 19 nt, Homo sapiens
gaacucacaugcuagaaag

SEQ ID NO: 484335 - RNA, 19 nt, Homo sapiens
gaaucaaguccaacaguua

SEQ ID NO: 484336 - RNA, 19 nt, Homo sapiens
cuagagaaauccuuacaaa

SEQ ID NO: 484337 - RNA, 19 nt, Homo sapiens
gaacggcuguugcuaaagg

SEQ ID NO: 484338 - RNA, 19 nt, Homo sapiens
aaaggaggcucucaguaaa

SEQ ID NO: 484339 - RNA, 19 nt, Homo sapiens
gaaaccaaagcuucagaua

SEQ ID NO: 484340 - RNA, 19 nt, Homo sapiens
caagaaaggaagcaaauga

SEQ ID NO: 484341 - RNA, 19 nt, Homo sapiens
agacaaagccuucgguaaa

SEQ ID NO: 484342 - RNA, 19 nt, Homo sapiens
acacagaucugccucuaug

SEQ ID NO: 484343 - RNA, 19 nt, Homo sapiens
gaucagagugacaagaaua

SEQ ID NO: 484344 - RNA, 19 nt, Homo sapiens
gaagagaggagaauauugg

SEQ ID NO: 484345 - RNA, 19 nt, Homo sapiens
cagaacugcuuuacacuau

SEQ ID NO: 484346 - RNA, 19 nt, Homo sapiens
caaucuagcuacagugaug

SEQ ID NO: 484347 - RNA, 19 nt, Homo sapiens
gaacuucauuccauaacgu

SEQ ID NO: 484348 - RNA, 19 nt, Homo sapiens
uaauacaacuggaugaaca

SEQ ID NO: 484349 - RNA, 19 nt, Homo sapiens
ugaaaugcuugaaaccaaa

SEQ ID NO: 484350 - RNA, 19 nt, Homo sapiens
caagaauguuucaacucua

SEQ ID NO: 484351 - RNA, 19 nt, Homo sapiens
cagaacaagauaccaaaua

SEQ ID NO: 484352 - RNA, 19 nt, Homo sapiens
caaugggagucucucagua

SEQ ID NO: 484353 - RNA, 19 nt, Homo sapiens
acaaaguucuucaguuuca

SEQ ID NO: 484354 - RNA, 19 nt, Homo sapiens
ucaguagaauuucgacauu

SEQ ID NO: 484355 - RNA, 19 nt, Homo sapiens
gcaacgauucuucuucaaa

SEQ ID NO: 484356 - RNA, 19 nt, Homo sapiens
gaacugacccaaguaaagu

SEQ ID NO: 484357 - RNA, 19 nt, Homo sapiens
aaaccaaagcuucagauaa

SEQ ID NO: 484358 - RNA, 19 nt, Homo sapiens
cugcgagacuacaaaguua

SEQ ID NO: 484359 - RNA, 19 nt, Homo sapiens
uaacucagaucaacuccau

SEQ ID NO: 484360 - RNA, 19 nt, Homo sapiens
aaacacagaucugccucua

SEQ ID NO: 484361 - RNA, 19 nt, Homo sapiens
gaacacugacgcacaggaa

SEQ ID NO: 484362 - RNA, 19 nt, Homo sapiens
cagaggccguugguacuua

SEQ ID NO: 484363 - RNA, 19 nt, Homo sapiens
caagaacucauuugugguu

SEQ ID NO: 484364 - RNA, 19 nt, Homo sapiens
gcagaugacagaacaagau

SEQ ID NO: 484365 - RNA, 19 nt, Homo sapiens
gagauuccacucuguagaa

SEQ ID NO: 484366 - RNA, 19 nt, Homo sapiens
gaaggcaauuggagaaacu

SEQ ID NO: 484367 - RNA, 19 nt, Homo sapiens
ccaaauacuuagaagaucu

SEQ ID NO: 484368 - RNA, 19 nt, Homo sapiens
uagcugugguuauuucaaa

SEQ ID NO: 484369 - RNA, 19 nt, Homo sapiens
cauggugacugaagaacuu

SEQ ID NO: 484370 - RNA, 19 nt, Homo sapiens
ugccagaacuaaacuauca

SEQ ID NO: 484371 - RNA, 19 nt, Homo sapiens
gaacaccaugcucauagaa

SEQ ID NO: 484372 - RNA, 19 nt, Homo sapiens
ggaaauccaaugcauguag

SEQ ID NO: 484373 - RNA, 19 nt, Homo sapiens
ggaguguugugacugaaau

SEQ ID NO: 484374 - RNA, 19 nt, Homo sapiens
aaccgaagauuuguacuuu

SEQ ID NO: 484375 - RNA, 19 nt, Homo sapiens
acaagaauguuucaacucu

SEQ ID NO: 484376 - RNA, 19 nt, Homo sapiens
agagaaauccuuacaaagu

SEQ ID NO: 484377 - RNA, 19 nt, Homo sapiens
ggaagagaggagaauauug

SEQ ID NO: 484378 - RNA, 19 nt, Homo sapiens
caaugaagucuccuuauuc

SEQ ID NO: 484379 - RNA, 19 nt, Homo sapiens
ugacaaagguuauguuccu

SEQ ID NO: 484380 - RNA, 19 nt, Homo sapiens
ccgaagauuuguacuuugu

SEQ ID NO: 484381 - RNA, 19 nt, Homo sapiens
gcaaauccccuacugauga

SEQ ID NO: 484382 - RNA, 19 nt, Homo sapiens
ggaacugacccaaguaaag

SEQ ID NO: 484383 - RNA, 19 nt, Homo sapiens
caacgauucuucuucaaaa

SEQ ID NO: 484384 - RNA, 19 nt, Homo sapiens
gcaagauaagacaacuuua

SEQ ID NO: 484385 - RNA, 19 nt, Homo sapiens
ugacugaaaugcuugaaac

SEQ ID NO: 484386 - RNA, 19 nt, Homo sapiens
gugaugagcuggcaguuuu

SEQ ID NO: 484387 - RNA, 19 nt, Homo sapiens
gcuugggcauccaucauuu

SEQ ID NO: 484388 - RNA, 19 nt, Homo sapiens
gugaugauuuccaauguca

SEQ ID NO: 484389 - RNA, 19 nt, Homo sapiens
guuaaggcaucaauugaca

SEQ ID NO: 484390 - RNA, 19 nt, Homo sapiens
gguacaacgugucaaccaa

SEQ ID NO: 484391 - RNA, 19 nt, Homo sapiens
ugacaagaauguuucaacu

SEQ ID NO: 484392 - RNA, 19 nt, Homo sapiens
agaacaagauaccaaauac

SEQ ID NO: 484393 - RNA, 19 nt, Homo sapiens
gggaagagaggagaauauu

SEQ ID NO: 484394 - RNA, 19 nt, Homo sapiens
ggaaauucggcaucuguug

SEQ ID NO: 484395 - RNA, 19 nt, Homo sapiens
gaaaggaagcaaaugaaaa

SEQ ID NO: 484396 - RNA, 19 nt, Homo sapiens
ggucuuaacucagaucaac

SEQ ID NO: 484397 - RNA, 19 nt, Homo sapiens
gggagucucucaguagaau

SEQ ID NO: 484398 - RNA, 19 nt, Homo sapiens
cuaagcaaccgaagauuug

SEQ ID NO: 484399 - RNA, 19 nt, Homo sapiens
aggcaucaauugacaagaa

SEQ ID NO: 484400 - RNA, 19 nt, Homo sapiens
ugagagagcgcuagcaugu

SEQ ID NO: 484401 - RNA, 19 nt, Homo sapiens
cagccucgauuucaagaga

SEQ ID NO: 484402 - RNA, 19 nt, Homo sapiens
caagauaccaaauacuuag

SEQ ID NO: 484403 - RNA, 19 nt, Homo sapiens
uggagcagguggaucaauu

SEQ ID NO: 484404 - RNA, 19 nt, Homo sapiens
gacaaagccuucgguaaac

SEQ ID NO: 484405 - RNA, 19 nt, Homo sapiens
caguagaauuucgacauuu

SEQ ID NO: 484406 - RNA, 19 nt, Homo sapiens
caacugagaaggcaauugg

SEQ ID NO: 484407 - RNA, 19 nt, Homo sapiens
acaccaugcucauagaaga

SEQ ID NO: 484408 - RNA, 19 nt, Homo sapiens
gcaagacgaauuugacuac

SEQ ID NO: 484409 - RNA, 19 nt, Homo sapiens
guuagcauuucuagaauag

SEQ ID NO: 484410 - RNA, 19 nt, Homo sapiens
ggucguguuuccaaagaga

SEQ ID NO: 484411 - RNA, 19 nt, Homo sapiens
cguguuagcauuucuagaa

SEQ ID NO: 484412 - RNA, 19 nt, Homo sapiens
agaacuaaacuaucaggua

SEQ ID NO: 484413 - RNA, 19 nt, Homo sapiens
gaaacuagaggagcaaucu

SEQ ID NO: 484414 - RNA, 19 nt, Homo sapiens
cugaaaugcuugaaaccaa

SEQ ID NO: 484415 - RNA, 19 nt, Homo sapiens
ccagagacucgaacacuga

SEQ ID NO: 484416 - RNA, 19 nt, Homo sapiens
aggaacggcuguugcuaaa

SEQ ID NO: 484417 - RNA, 19 nt, Homo sapiens
ggagcaaucuaccaaaaug

SEQ ID NO: 484418 - RNA, 19 nt, Homo sapiens
gaaacaauaugcaauguga

SEQ ID NO: 484419 - RNA, 19 nt, Homo sapiens
guacaaagaccacacauuu

SEQ ID NO: 484420 - RNA, 19 nt, Homo sapiens
guagagaguuucgaaguua

SEQ ID NO: 484421 - RNA, 19 nt, Homo sapiens
gcaggcagcugaccuuuga

SEQ ID NO: 484422 - RNA, 19 nt, Homo sapiens
gcaaugagcuuguguucca

SEQ ID NO: 484423 - RNA, 19 nt, Homo sapiens
gcacguggaggaacucuua

SEQ ID NO: 484424 - RNA, 19 nt, Homo sapiens
gcacauucaucauugagaa

SEQ ID NO: 484425 - RNA, 19 nt, Homo sapiens
cuaaagcuguugauggaua

SEQ ID NO: 484426 - RNA, 19 nt, Homo sapiens
cagcagcgguggccucuuu

SEQ ID NO: 484427 - RNA, 19 nt, Homo sapiens
agaaugagcugaagaaacu

SEQ ID NO: 484428 - RNA, 19 nt, Homo sapiens
gaacaacugcugcgugaug

SEQ ID NO: 484429 - RNA, 19 nt, Homo sapiens
gagcaggccuugcgcuguu

SEQ ID NO: 484430 - RNA, 19 nt, Homo sapiens
gguaaaagcugaucugguu

SEQ ID NO: 484431 - RNA, 19 nt, Homo sapiens
acagaacccugaccaugua

SEQ ID NO: 484432 - RNA, 19 nt, Homo sapiens
gcaaguggucccugaguuu

SEQ ID NO: 484433 - RNA, 19 nt, Homo sapiens
gaugaggucuucuccaagu

SEQ ID NO: 484434 - RNA, 19 nt, Homo sapiens
gagaagcuuugcccuccua

SEQ ID NO: 484435 - RNA, 19 nt, Homo sapiens
ugauggagguguugaagaa

SEQ ID NO: 484436 - RNA, 19 nt, Homo sapiens
guaagguuguguacacuga

SEQ ID NO: 484437 - RNA, 19 nt, Homo sapiens
gcagccaccuggaggacua

SEQ ID NO: 484438 - RNA, 19 nt, Homo sapiens
ggcuaaagcuguugaugga

SEQ ID NO: 484439 - RNA, 19 nt, Homo sapiens
ggccaagucucugcuuaaa

SEQ ID NO: 484440 - RNA, 19 nt, Homo sapiens
guggugagauccugaacaa

SEQ ID NO: 484441 - RNA, 19 nt, Homo sapiens
caucuguccucauguguug

SEQ ID NO: 484442 - RNA, 19 nt, Homo sapiens
gaaguuaggaggacucaag

SEQ ID NO: 484443 - RNA, 19 nt, Homo sapiens
gaaauucaaggccgaagug

SEQ ID NO: 484444 - RNA, 19 nt, Homo sapiens
aaacugcagugaaagacaa

SEQ ID NO: 484445 - RNA, 19 nt, Homo sapiens
aagauugggucuaggauau

SEQ ID NO: 484446 - RNA, 19 nt, Homo sapiens
gaucauggcauccaagagu

SEQ ID NO: 484447 - RNA, 19 nt, Homo sapiens
gaccagcacauucaucauu

SEQ ID NO: 484448 - RNA, 19 nt, Homo sapiens
gcagcuauuugaaugagau

SEQ ID NO: 484449 - RNA, 19 nt, Homo sapiens
cuacaguccuggugugaga

SEQ ID NO: 484450 - RNA, 19 nt, Homo sapiens
caaggccuguagagaguuu

SEQ ID NO: 484451 - RNA, 19 nt, Homo sapiens
cgacgggaccuucuuguug

SEQ ID NO: 484452 - RNA, 19 nt, Homo sapiens
gaaguuggccgagaucauc

SEQ ID NO: 484453 - RNA, 19 nt, Homo sapiens
gccuugcgcuguugcguaa

SEQ ID NO: 484454 - RNA, 19 nt, Homo sapiens
aaaugcaucuguccucaug

SEQ ID NO: 484455 - RNA, 19 nt, Homo sapiens
uaaagcuguugauggauau

SEQ ID NO: 484456 - RNA, 19 nt, Homo sapiens
uguggaaccugaaaccauu

SEQ ID NO: 484457 - RNA, 19 nt, Homo sapiens
gugaagcggucguguugug

SEQ ID NO: 484458 - RNA, 19 nt, Homo sapiens
ccacgcuucucuuuggaaa

SEQ ID NO: 484459 - RNA, 19 nt, Homo sapiens
ggcaaggccuguagagagu

SEQ ID NO: 484460 - RNA, 19 nt, Homo sapiens
agacggcccuccagcagaa

SEQ ID NO: 484461 - RNA, 19 nt, Homo sapiens
gaggauccaagcucaguuu

SEQ ID NO: 484462 - RNA, 19 nt, Homo sapiens
auugagagcccaagguuua

SEQ ID NO: 484463 - RNA, 19 nt, Homo sapiens
guccucauguguugaugua

SEQ ID NO: 484464 - RNA, 19 nt, Homo sapiens
gcggucguguugugaguuu

SEQ ID NO: 484465 - RNA, 19 nt, Homo sapiens
gaagacccagaccaaguuu

SEQ ID NO: 484466 - RNA, 19 nt, Homo sapiens
gcuuugcccuccuaagaga

SEQ ID NO: 484467 - RNA, 19 nt, Homo sapiens
uauaacauguacccacaga

SEQ ID NO: 484468 - RNA, 19 nt, Homo sapiens
gggaugccauugacuugga

SEQ ID NO: 484469 - RNA, 19 nt, Homo sapiens
aaagacaagcugcaaauca

SEQ ID NO: 484470 - RNA, 19 nt, Homo sapiens
agacagagagagagaaaga

SEQ ID NO: 484471 - RNA, 19 nt, Homo sapiens
uaagagagagagacagaga

SEQ ID NO: 484472 - RNA, 19 nt, Homo sapiens
uguagagaguuucgaaguu

SEQ ID NO: 484473 - RNA, 19 nt, Homo sapiens
caggccaagucucugcuua

SEQ ID NO: 484474 - RNA, 19 nt, Homo sapiens
gcgcuuuagugacucagaa

SEQ ID NO: 484475 - RNA, 19 nt, Homo sapiens
ggaagcagcagaccaucau

SEQ ID NO: 484476 - RNA, 19 nt, Homo sapiens
ugaaagacaagcugcaaau

SEQ ID NO: 484477 - RNA, 19 nt, Homo sapiens
gagagagugugugggucua

SEQ ID NO: 484478 - RNA, 19 nt, Homo sapiens
gcucagcagcuauuugaau

SEQ ID NO: 484479 - RNA, 19 nt, Homo sapiens
ggaaacaauaugcaaugug

SEQ ID NO: 484480 - RNA, 19 nt, Homo sapiens
ucucaugaauguuugaauc

SEQ ID NO: 484481 - RNA, 19 nt, Homo sapiens
caccaucgccuggaaguuu

SEQ ID NO: 484482 - RNA, 19 nt, Homo sapiens
gaaagacaagcugcaaauc

SEQ ID NO: 484483 - RNA, 19 nt, Homo sapiens
gagucucaguucaguguug

SEQ ID NO: 484484 - RNA, 19 nt, Homo sapiens
gcuccuuccuguaguaaca

SEQ ID NO: 484485 - RNA, 19 nt, Homo sapiens
ccagcacauucaucauuga

SEQ ID NO: 484486 - RNA, 19 nt, Homo sapiens
ugaaggggcucaaaagaug

SEQ ID NO: 484487 - RNA, 19 nt, Homo sapiens
gugagaaguuggccgagau

SEQ ID NO: 484488 - RNA, 19 nt, Homo sapiens
acacagagaaugagcugaa

SEQ ID NO: 484489 - RNA, 19 nt, Homo sapiens
cggcugggauccugguuga

SEQ ID NO: 484490 - RNA, 19 nt, Homo sapiens
aagcugaucugguuugacu

SEQ ID NO: 484491 - RNA, 19 nt, Homo sapiens
aaagauugggucuaggaua

SEQ ID NO: 484492 - RNA, 19 nt, Homo sapiens
gaaucccacgcuucucuuu

SEQ ID NO: 484493 - RNA, 19 nt, Homo sapiens
acacuccugugcuggcuaa

SEQ ID NO: 484494 - RNA, 19 nt, Homo sapiens
aggaugaggucuucuccaa

SEQ ID NO: 484495 - RNA, 19 nt, Homo sapiens
gcaucaccaucgccuggaa

SEQ ID NO: 484496 - RNA, 19 nt, Homo sapiens
ugaagacccagaccaaguu

SEQ ID NO: 484497 - RNA, 19 nt, Homo sapiens
cagagaaugagcugaagaa

SEQ ID NO: 484498 - RNA, 19 nt, Homo sapiens
gagagugugugggucuaug

SEQ ID NO: 484499 - RNA, 19 nt, Homo sapiens
gagaauucgaccuggauga

SEQ ID NO: 484500 - RNA, 19 nt, Homo sapiens
ccaaggagaaccucguguu

SEQ ID NO: 484501 - RNA, 19 nt, Homo sapiens
aggaacaugucacugaaga

SEQ ID NO: 484502 - RNA, 19 nt, Homo sapiens
caacgccgacaaccacauu

SEQ ID NO: 484503 - RNA, 19 nt, Homo sapiens
cagaucaaccagacauuug

SEQ ID NO: 484504 - RNA, 19 nt, Homo sapiens
gugugugggucuauguaaa

SEQ ID NO: 484505 - RNA, 19 nt, Homo sapiens
caaugcagccagaccuauu

SEQ ID NO: 484506 - RNA, 19 nt, Homo sapiens
gucugucucugucauggua

SEQ ID NO: 484507 - RNA, 19 nt, Homo sapiens
gugcagaguccgugacaga

SEQ ID NO: 484508 - RNA, 19 nt, Homo sapiens
ggugagauccugaacaacu

SEQ ID NO: 484509 - RNA, 19 nt, Homo sapiens
gagaaugagcugaagaaac

SEQ ID NO: 484510 - RNA, 19 nt, Homo sapiens
gcccaagguuuaaacuucu

SEQ ID NO: 484511 - RNA, 19 nt, Homo sapiens
gaaaagauugggucuagga

SEQ ID NO: 484512 - RNA, 19 nt, Homo sapiens
acaaagagguagaaaagau

SEQ ID NO: 484513 - RNA, 19 nt, Homo sapiens
ccacguuucccgggauaua

SEQ ID NO: 484514 - RNA, 19 nt, Homo sapiens
cgagugcaguggugagauc

SEQ ID NO: 484515 - RNA, 19 nt, Homo sapiens
aagcugaacgugcacauga

SEQ ID NO: 484516 - RNA, 19 nt, Homo sapiens
ucagaucaaccagacauuu

SEQ ID NO: 484517 - RNA, 19 nt, Homo sapiens
uugcguaacuggcuguguu

SEQ ID NO: 484518 - RNA, 19 nt, Homo sapiens
ggacacagagaaugaguua

SEQ ID NO: 484519 - RNA, 19 nt, Homo sapiens
gaaguuugauucucaggaa

SEQ ID NO: 484520 - RNA, 19 nt, Homo sapiens
ccaagucucugcucaagaa

SEQ ID NO: 484521 - RNA, 19 nt, Homo sapiens
cuaaagcuguugauggaua

SEQ ID NO: 484522 - RNA, 19 nt, Homo sapiens
gagaacacccgcaaugauu

SEQ ID NO: 484523 - RNA, 19 nt, Homo sapiens
gagauucagugacucagaa

SEQ ID NO: 484524 - RNA, 19 nt, Homo sapiens
gaacaacugcugcgucaug

SEQ ID NO: 484525 - RNA, 19 nt, Homo sapiens
ccauugaggugcggcauua

SEQ ID NO: 484526 - RNA, 19 nt, Homo sapiens
ggaccuuccuccugagauu

SEQ ID NO: 484527 - RNA, 19 nt, Homo sapiens
gcacguucaucauugagaa

SEQ ID NO: 484528 - RNA, 19 nt, Homo sapiens
gaaucacucuuguggaugu

SEQ ID NO: 484529 - RNA, 19 nt, Homo sapiens
gcaaguggucccugaguuu

SEQ ID NO: 484530 - RNA, 19 nt, Homo sapiens
ugaauuaccuuaucuacgu

SEQ ID NO: 484531 - RNA, 19 nt, Homo sapiens
gaaagaauguuuuggaauc

SEQ ID NO: 484532 - RNA, 19 nt, Homo sapiens
cucauaaugugaaguguua

SEQ ID NO: 484533 - RNA, 19 nt, Homo sapiens
gcaacaggcccaugaccua

SEQ ID NO: 484534 - RNA, 19 nt, Homo sapiens
gcagccaccuggaggacua

SEQ ID NO: 484535 - RNA, 19 nt, Homo sapiens
ggagugcgaguauguguuu

SEQ ID NO: 484536 - RNA, 19 nt, Homo sapiens
agaaacaccuccagaucaa

SEQ ID NO: 484537 - RNA, 19 nt, Homo sapiens
acacagagaaugaguuaaa

SEQ ID NO: 484538 - RNA, 19 nt, Homo sapiens
gaugaaguauacuccaaau

SEQ ID NO: 484539 - RNA, 19 nt, Homo sapiens
gaagggagugcgaguaugu

SEQ ID NO: 484540 - RNA, 19 nt, Homo sapiens
caccauugcuuggaaguuu

SEQ ID NO: 484541 - RNA, 19 nt, Homo sapiens
ccacacagcuccagaacac

SEQ ID NO: 484542 - RNA, 19 nt, Homo sapiens
cagagucggugacagaaga

SEQ ID NO: 484543 - RNA, 19 nt, Homo sapiens
ggacggaauuacacuuucu

SEQ ID NO: 484544 - RNA, 19 nt, Homo sapiens
gaaauucaaggccgaagug

SEQ ID NO: 484545 - RNA, 19 nt, Homo sapiens
cuacaguccuggugugaga

SEQ ID NO: 484546 - RNA, 19 nt, Homo sapiens
gaccagcacguucaucauu

SEQ ID NO: 484547 - RNA, 19 nt, Homo sapiens
ccaugaaucgcuucucuuu

SEQ ID NO: 484548 - RNA, 19 nt, Homo sapiens
aaccauggcuguguggaua

SEQ ID NO: 484549 - RNA, 19 nt, Homo sapiens
gaaucccaguucaguguug

SEQ ID NO: 484550 - RNA, 19 nt, Homo sapiens
gaaguuggccgagaucauc

SEQ ID NO: 484551 - RNA, 19 nt, Homo sapiens
gaaguguuaauacuaguug

SEQ ID NO: 484552 - RNA, 19 nt, Homo sapiens
gaauuuaccaggacggaau

SEQ ID NO: 484553 - RNA, 19 nt, Homo sapiens
uuacaauccuguuugaauc

SEQ ID NO: 484554 - RNA, 19 nt, Homo sapiens
aauacuaguugugaccuua

SEQ ID NO: 484555 - RNA, 19 nt, Homo sapiens
uuuggaaucugaugccuuu

SEQ ID NO: 484556 - RNA, 19 nt, Homo sapiens
agacggcccuccagcagaa

SEQ ID NO: 484557 - RNA, 19 nt, Homo sapiens
gaggauccaagcucaguuu

SEQ ID NO: 484558 - RNA, 19 nt, Homo sapiens
ggcgagaucuugaacaacu

SEQ ID NO: 484559 - RNA, 19 nt, Homo sapiens
gaagacccagaccaaguuu

SEQ ID NO: 484560 - RNA, 19 nt, Homo sapiens
ccagcacguucaucauuga

SEQ ID NO: 484561 - RNA, 19 nt, Homo sapiens
cagaaacaccuccagauca

SEQ ID NO: 484562 - RNA, 19 nt, Homo sapiens
uauaacauguacccacaga

SEQ ID NO: 484563 - RNA, 19 nt, Homo sapiens
agacuugaauuaccuuauc

SEQ ID NO: 484564 - RNA, 19 nt, Homo sapiens
gcaucaccauugcuuggaa

SEQ ID NO: 484565 - RNA, 19 nt, Homo sapiens
aaacaucucaagccucauu

SEQ ID NO: 484566 - RNA, 19 nt, Homo sapiens
gggcagagucggugacaga

SEQ ID NO: 484567 - RNA, 19 nt, Homo sapiens
gaauaugucccugaaacga

SEQ ID NO: 484568 - RNA, 19 nt, Homo sapiens
agaacacccgcaaugauua

SEQ ID NO: 484569 - RNA, 19 nt, Homo sapiens
gggccgagcgagauuguaa

SEQ ID NO: 484570 - RNA, 19 nt, Homo sapiens
caguagaucuugauaaucc

SEQ ID NO: 484571 - RNA, 19 nt, Homo sapiens
ucucaagccucauuggaau

SEQ ID NO: 484572 - RNA, 19 nt, Homo sapiens
guggcgagaucuugaacaa

SEQ ID NO: 484573 - RNA, 19 nt, Homo sapiens
gccaaaagaugaaguauac

SEQ ID NO: 484574 - RNA, 19 nt, Homo sapiens
cgagcgagauuguaaacca

SEQ ID NO: 484575 - RNA, 19 nt, Homo sapiens
ggaagcagcagaccaucau

SEQ ID NO: 484576 - RNA, 19 nt, Homo sapiens
caaauacuacacaccaguu

SEQ ID NO: 484577 - RNA, 19 nt, Homo sapiens
gcgaagggagugcgaguau

SEQ ID NO: 484578 - RNA, 19 nt, Homo sapiens
ugaggugcggcauuauuua

SEQ ID NO: 484579 - RNA, 19 nt, Homo sapiens
gcaugggacucaguagauc

SEQ ID NO: 484580 - RNA, 19 nt, Homo sapiens
gcuugggagacuugaauua

SEQ ID NO: 484581 - RNA, 19 nt, Homo sapiens
cucaguagaucuugauaau

SEQ ID NO: 484582 - RNA, 19 nt, Homo sapiens
cgagaagccaacaauggua

SEQ ID NO: 484583 - RNA, 19 nt, Homo sapiens
gcgagucugcuacugcuaa

SEQ ID NO: 484584 - RNA, 19 nt, Homo sapiens
gugagaaguuggccgagau

SEQ ID NO: 484585 - RNA, 19 nt, Homo sapiens
ugcuaaagcuguugaugga

SEQ ID NO: 484586 - RNA, 19 nt, Homo sapiens
gagcgagauuguaaaccau

SEQ ID NO: 484587 - RNA, 19 nt, Homo sapiens
gaggugcggcauuauuuau

SEQ ID NO: 484588 - RNA, 19 nt, Homo sapiens
guucaacagggagaauuua

SEQ ID NO: 484589 - RNA, 19 nt, Homo sapiens
ugaagacccagaccaaguu

SEQ ID NO: 484590 - RNA, 19 nt, Homo sapiens
guugugaccuuaguguuuc

SEQ ID NO: 484591 - RNA, 19 nt, Homo sapiens
ugugaaguguuaauacuag

SEQ ID NO: 484592 - RNA, 19 nt, Homo sapiens
aggaaucacucuuguggau

SEQ ID NO: 484593 - RNA, 19 nt, Homo sapiens
ccaaggagaaccucguguu

SEQ ID NO: 484594 - RNA, 19 nt, Homo sapiens
guucaguguugguggaaau

SEQ ID NO: 484595 - RNA, 19 nt, Homo sapiens
gaacacccgcaaugauuac

SEQ ID NO: 484596 - RNA, 19 nt, Homo sapiens
gaacgagaacacccgcaau

SEQ ID NO: 484597 - RNA, 19 nt, Homo sapiens
ccaagcaugggacucagua

SEQ ID NO: 484598 - RNA, 19 nt, Homo sapiens
ccagaaacaccuccagauc

SEQ ID NO: 484599 - RNA, 19 nt, Homo sapiens
cgagucugcuacugcuaaa

SEQ ID NO: 484600 - RNA, 19 nt, Homo sapiens
aagaugaaguauacuccaa

SEQ ID NO: 484601 - RNA, 19 nt, Homo sapiens
gcuggaagccuugcugaug

SEQ ID NO: 484602 - RNA, 19 nt, Homo sapiens
ggagacuugaauuaccuua

SEQ ID NO: 484603 - RNA, 19 nt, Homo sapiens
ggacucaguagaucuugau

SEQ ID NO: 484604 - RNA, 19 nt, Homo sapiens
aagcugaacgugcacauga

SEQ ID NO: 484605 - RNA, 19 nt, Homo sapiens
cuuggaaguuugauucuca

SEQ ID NO: 484606 - RNA, 19 nt, Homo sapiens
gggacucaguagaucuuga

SEQ ID NO: 484607 - RNA, 19 nt, Homo sapiens
cgagaacacccgcaaugau

SEQ ID NO: 484608 - RNA, 19 nt, Homo sapiens
caggacggaauuacacuuu

SEQ ID NO: 484609 - RNA, 19 nt, Homo sapiens
uaacauguacccacagaac

SEQ ID NO: 484610 - RNA, 19 nt, Homo sapiens
caacagggagaauuuacca

SEQ ID NO: 484611 - RNA, 19 nt, Homo sapiens
ccacuguucucugggacaa

SEQ ID NO: 484612 - RNA, 19 nt, Homo sapiens
ggccaagucucugcucaag

SEQ ID NO: 484613 - RNA, 19 nt, Homo sapiens
caaguggucccugaguuug

SEQ ID NO: 484614 - RNA, 19 nt, Homo sapiens
uaaagcuguugauggauac

SEQ ID NO: 484615 - RNA, 19 nt, Homo sapiens
acaagcaacaggcccauga

SEQ ID NO: 484616 - RNA, 19 nt, Homo sapiens
caagccacaggcacccuua

SEQ ID NO: 484617 - RNA, 19 nt, Homo sapiens
ucugagaguuuaguuguag

SEQ ID NO: 484618 - RNA, 19 nt, Homo sapiens
ggacagagcuacagaccua

SEQ ID NO: 484619 - RNA, 19 nt, Homo sapiens
gaacauacagacacauuua

SEQ ID NO: 484620 - RNA, 19 nt, Homo sapiens
ggauggcucuccacagaua

SEQ ID NO: 484621 - RNA, 19 nt, Homo sapiens
gauagaaacuccugcuaau

SEQ ID NO: 484622 - RNA, 19 nt, Homo sapiens
ggacauuuauucccagcua

SEQ ID NO: 484623 - RNA, 19 nt, Homo sapiens
ggacaugugguuacuagua

SEQ ID NO: 484624 - RNA, 19 nt, Homo sapiens
ccaagaagcccaaggauga

SEQ ID NO: 484625 - RNA, 19 nt, Homo sapiens
ggagaccacuggagagcua

SEQ ID NO: 484626 - RNA, 19 nt, Homo sapiens
gcucugcccuguucaagaa

SEQ ID NO: 484627 - RNA, 19 nt, Homo sapiens
gcacuuggauuggugaaga

SEQ ID NO: 484628 - RNA, 19 nt, Homo sapiens
ugaagaggauccagauuug

SEQ ID NO: 484629 - RNA, 19 nt, Homo sapiens
gcagaaagcacuggagaaa

SEQ ID NO: 484630 - RNA, 19 nt, Homo sapiens
cugcacagcuugauagaaa

SEQ ID NO: 484631 - RNA, 19 nt, Homo sapiens
ccaauccacuccuuccuuu

SEQ ID NO: 484632 - RNA, 19 nt, Homo sapiens
cuacaagccugaacagaug

SEQ ID NO: 484633 - RNA, 19 nt, Homo sapiens
agaaagcacuggagaaauc

SEQ ID NO: 484634 - RNA, 19 nt, Homo sapiens
ggaagugcccgcugagaaa

SEQ ID NO: 484635 - RNA, 19 nt, Homo sapiens
gaccugcucuggacacuug

SEQ ID NO: 484636 - RNA, 19 nt, Homo sapiens
ccaaagaccuguccauucg

SEQ ID NO: 484637 - RNA, 19 nt, Homo sapiens
ggagaaaucaucaacaaca

SEQ ID NO: 484638 - RNA, 19 nt, Homo sapiens
caggauggcucuccacaga

SEQ ID NO: 484639 - RNA, 19 nt, Homo sapiens
gaacaggaccucacuaagc

SEQ ID NO: 484640 - RNA, 19 nt, Homo sapiens
ggaaagggaccaaccacuu

SEQ ID NO: 484641 - RNA, 19 nt, Homo sapiens
ucauagauccuaagccaua

SEQ ID NO: 484642 - RNA, 19 nt, Homo sapiens
gaaagggaccaaccacuuc

SEQ ID NO: 484643 - RNA, 19 nt, Homo sapiens
gugaaacucugaaccugaa

SEQ ID NO: 484644 - RNA, 19 nt, Homo sapiens
guaccuaggauauguuaaa

SEQ ID NO: 484645 - RNA, 19 nt, Homo sapiens
cuaccauggugccuucuua

SEQ ID NO: 484646 - RNA, 19 nt, Homo sapiens
ccaaagcccuagugcugaa

SEQ ID NO: 484647 - RNA, 19 nt, Homo sapiens
gcaggaacauacagacaca

SEQ ID NO: 484648 - RNA, 19 nt, Homo sapiens
gacaacagccucaguaugg

SEQ ID NO: 484649 - RNA, 19 nt, Homo sapiens
gagaagaugugugaaacuc

SEQ ID NO: 484650 - RNA, 19 nt, Homo sapiens
uuaguugcaugaccacaua

SEQ ID NO: 484651 - RNA, 19 nt, Homo sapiens
uagagaacauccagccauu

SEQ ID NO: 484652 - RNA, 19 nt, Homo sapiens
ggaacauacagacacauuu

SEQ ID NO: 484653 - RNA, 19 nt, Homo sapiens
gcucagaugugaccauggu

SEQ ID NO: 484654 - RNA, 19 nt, Homo sapiens
cagaugagccugcccuuug

SEQ ID NO: 484655 - RNA, 19 nt, Homo sapiens
ggucgcaguucaacaagga

SEQ ID NO: 484656 - RNA, 19 nt, Homo sapiens
guauguaugugugugcuuu

SEQ ID NO: 484657 - RNA, 19 nt, Homo sapiens
ggccagggauagaggauau

SEQ ID NO: 484658 - RNA, 19 nt, Homo sapiens
gcugugacaucuacguaug

SEQ ID NO: 484659 - RNA, 19 nt, Homo sapiens
guauguaccuaggauaugu

SEQ ID NO: 484660 - RNA, 19 nt, Homo sapiens
gaacauccagccauucucu

SEQ ID NO: 484661 - RNA, 19 nt, Homo sapiens
gaacccucgucaccaguug

SEQ ID NO: 484662 - RNA, 19 nt, Homo sapiens
ccaaguggcugugacaucu

SEQ ID NO: 484663 - RNA, 19 nt, Homo sapiens
caagugugcuggccucucu

SEQ ID NO: 484664 - RNA, 19 nt, Homo sapiens
acagacacauuuacacuag

SEQ ID NO: 484665 - RNA, 19 nt, Homo sapiens
aaagccugguggacauuua

SEQ ID NO: 484666 - RNA, 19 nt, Homo sapiens
ugaagcugguggccacuuu

SEQ ID NO: 484667 - RNA, 19 nt, Homo sapiens
guuacuagccuucuucuca

SEQ ID NO: 484668 - RNA, 19 nt, Homo sapiens
gggccgacauggugacaga

SEQ ID NO: 484669 - RNA, 19 nt, Homo sapiens
gggaauggcgcaccguuug

SEQ ID NO: 484670 - RNA, 19 nt, Homo sapiens
gcggcucuaugucgacuuu

SEQ ID NO: 484671 - RNA, 19 nt, Homo sapiens
gauccuaagccauaaaaua

SEQ ID NO: 484672 - RNA, 19 nt, Homo sapiens
ggaucuugcucagcucaaa

SEQ ID NO: 484673 - RNA, 19 nt, Homo sapiens
guacguuacuagccuucuu

SEQ ID NO: 484674 - RNA, 19 nt, Homo sapiens
ugauagaaacuccugcuaa

SEQ ID NO: 484675 - RNA, 19 nt, Homo sapiens
ggaagggcacugagucugu

SEQ ID NO: 484676 - RNA, 19 nt, Homo sapiens
cuggagaaaucaucaacaa

SEQ ID NO: 484677 - RNA, 19 nt, Homo sapiens
ggaauggcgcaccguuuga

SEQ ID NO: 484678 - RNA, 19 nt, Homo sapiens
ggugagacacugcacagaa

SEQ ID NO: 484679 - RNA, 19 nt, Homo sapiens
guaugugugugcuuuaucu

SEQ ID NO: 484680 - RNA, 19 nt, Homo sapiens
uuacuagccuucuucucaa

SEQ ID NO: 484681 - RNA, 19 nt, Homo sapiens
cugaagaggauccagauuu

SEQ ID NO: 484682 - RNA, 19 nt, Homo sapiens
ggagcaccaucuugcaaca

SEQ ID NO: 484683 - RNA, 19 nt, Homo sapiens
cauagauccuaagccauaa

SEQ ID NO: 484684 - RNA, 19 nt, Homo sapiens
gcugagauucuucguguau

SEQ ID NO: 484685 - RNA, 19 nt, Homo sapiens
gacaugugguuacuaguac

SEQ ID NO: 484686 - RNA, 19 nt, Homo sapiens
ccauggugccuucuuauga

SEQ ID NO: 484687 - RNA, 19 nt, Homo sapiens
gggagaagaugugugaaac

SEQ ID NO: 484688 - RNA, 19 nt, Homo sapiens
ugaagacucagaccaaguu

SEQ ID NO: 484689 - RNA, 19 nt, Homo sapiens
gaaagccugguggacauuu

SEQ ID NO: 484690 - RNA, 19 nt, Homo sapiens
gugaaagccugguggacau

SEQ ID NO: 484691 - RNA, 19 nt, Homo sapiens
gugagacacugcacagaag

SEQ ID NO: 484692 - RNA, 19 nt, Homo sapiens
ggacggauaggcaggaaca

SEQ ID NO: 484693 - RNA, 19 nt, Homo sapiens
uuggauuggugaagacaua

SEQ ID NO: 484694 - RNA, 19 nt, Homo sapiens
agaugagccugcccuuuga

SEQ ID NO: 484695 - RNA, 19 nt, Homo sapiens
aagaaucagucaacguguu

SEQ ID NO: 484696 - RNA, 19 nt, Homo sapiens
gccaaagaccuguccauuc

SEQ ID NO: 484697 - RNA, 19 nt, Homo sapiens
acaugugucuaucugcuuu

SEQ ID NO: 484698 - RNA, 19 nt, Homo sapiens
ccucagggcacuuggauug

SEQ ID NO: 484699 - RNA, 19 nt, Homo sapiens
gggacaaugccuucucuga

SEQ ID NO: 484700 - RNA, 19 nt, Homo sapiens
gagaaaucaucaacaacac

SEQ ID NO: 484701 - RNA, 19 nt, Homo sapiens
uagaaacuccugcuaaugg

SEQ ID NO: 484702 - RNA, 19 nt, Homo sapiens
cuagugcccuacuuucaga

SEQ ID NO: 484703 - RNA, 19 nt, Homo sapiens
gcacagaagacagcagcaa

SEQ ID NO: 484704 - RNA, 19 nt, Homo sapiens
ggagggagaacccaaagag

SEQ ID NO: 484705 - RNA, 19 nt, Homo sapiens
gagaggagugugugugugu

SEQ ID NO: 484706 - RNA, 19 nt, Homo sapiens
ugagauucuucguguauag

SEQ ID NO: 484707 - RNA, 19 nt, Homo sapiens
uagaggauauugggucuca

SEQ ID NO: 484708 - RNA, 19 nt, Homo sapiens
gcaucaccauugcccaugu

SEQ ID NO: 484709 - RNA, 19 nt, Homo sapiens
gcugaucauuggcuucauc

SEQ ID NO: 484710 - RNA, 19 nt, Homo sapiens
caucguccauggcaaccaa

SEQ ID NO: 484711 - RNA, 19 nt, Homo sapiens
ucugccagcuucacacuug

SEQ ID NO: 484712 - RNA, 19 nt, Homo sapiens
caacaccugcggcaucuuc

SEQ ID NO: 484713 - RNA, 19 nt, Homo sapiens
gaaagcacuggagaaauca

SEQ ID NO: 484714 - RNA, 19 nt, Homo sapiens
gguggccacuuucagacaa

SEQ ID NO: 484715 - RNA, 19 nt, Homo sapiens
cuacgugacaacacaaauu

SEQ ID NO: 484716 - RNA, 19 nt, Homo sapiens
ggaaugggaagcagcucaa

SEQ ID NO: 484717 - RNA, 19 nt, Homo sapiens
gcucaugcccugccaagca

SEQ ID NO: 484718 - RNA, 19 nt, Homo sapiens
caacuucacuacuucugua

SEQ ID NO: 484719 - RNA, 19 nt, Homo sapiens
caucuuggcucucaugguu

SEQ ID NO: 484720 - RNA, 19 nt, Homo sapiens
gauuggagcugauucaucu

SEQ ID NO: 484721 - RNA, 19 nt, Homo sapiens
aaagagcaaugcaaaugaa

SEQ ID NO: 484722 - RNA, 19 nt, Homo sapiens
gaacccagccaacuaugaa

SEQ ID NO: 484723 - RNA, 19 nt, Homo sapiens
ccacaauaccaacaauaua

SEQ ID NO: 484724 - RNA, 19 nt, Homo sapiens
caaagagcaaugcaaauga

SEQ ID NO: 484725 - RNA, 19 nt, Homo sapiens
gcaaauacgacuucuacau

SEQ ID NO: 484726 - RNA, 19 nt, Homo sapiens
caucaaagagcaaugcaaa

SEQ ID NO: 484727 - RNA, 19 nt, Homo sapiens
caaauacgacuucuacauc

SEQ ID NO: 484728 - RNA, 19 nt, Homo sapiens
gaggcuugauuggcaaaua

SEQ ID NO: 484729 - RNA, 19 nt, Homo sapiens
ucucaucuuucauaccaua

SEQ ID NO: 484730 - RNA, 19 nt, Homo sapiens
uaacugcaggacaugauua

SEQ ID NO: 484731 - RNA, 19 nt, Homo sapiens
ucaaagagcaaugcaaaug

SEQ ID NO: 484732 - RNA, 19 nt, Homo sapiens
caaccacaauaccaacaau

SEQ ID NO: 484733 - RNA, 19 nt, Homo sapiens
gaaaucacuucucuaaaag

SEQ ID NO: 484734 - RNA, 19 nt, Homo sapiens
aagauucgguuauggguau

SEQ ID NO: 484735 - RNA, 19 nt, Homo sapiens
ugcaggacaugauuauuga

SEQ ID NO: 484736 - RNA, 19 nt, Homo sapiens
caguacuguuucugaauaa

SEQ ID NO: 484737 - RNA, 19 nt, Homo sapiens
guuaagcuguguucaguac

SEQ ID NO: 484738 - RNA, 19 nt, Homo sapiens
aagcuucacuucaacuuca

SEQ ID NO: 484739 - RNA, 19 nt, Homo sapiens
cuacauccauauucucauc

SEQ ID NO: 484740 - RNA, 19 nt, Homo sapiens
caucuuucauaccauauca

SEQ ID NO: 484741 - RNA, 19 nt, Homo sapiens
cgacuucuacauccauauu

SEQ ID NO: 484742 - RNA, 19 nt, Homo sapiens
cauccauauucucaucuuu

SEQ ID NO: 484743 - RNA, 19 nt, Homo sapiens
aaccauaccaaccacaaua

SEQ ID NO: 484744 - RNA, 19 nt, Homo sapiens
uaagcuguguucaguacug

SEQ ID NO: 484745 - RNA, 19 nt, Homo sapiens
auacuugccuuuucaauug

SEQ ID NO: 484746 - RNA, 19 nt, Homo sapiens
aagagaacccagccaacua

SEQ ID NO: 484747 - RNA, 19 nt, Homo sapiens
cacuucaacuucacuacuu

SEQ ID NO: 484748 - RNA, 19 nt, Homo sapiens
gauuauugaggcuugauug

SEQ ID NO: 484749 - RNA, 19 nt, Homo sapiens
ugaaguuccuugucuuugc

SEQ ID NO: 484750 - RNA, 19 nt, Homo sapiens
cugcaggacaugauuauug

SEQ ID NO: 484751 - RNA, 19 nt, Homo sapiens
uaugaaguuccuugucuuu

SEQ ID NO: 484752 - RNA, 19 nt, Homo sapiens
gcuguguucaguacuguuu

SEQ ID NO: 484753 - RNA, 19 nt, Homo sapiens
guaacugcaggacaugauu

SEQ ID NO: 484754 - RNA, 19 nt, Homo sapiens
cacaauaccaacaauauac

SEQ ID NO: 484755 - RNA, 19 nt, Homo sapiens
cacuauacccacaaccaua

SEQ ID NO: 484756 - RNA, 19 nt, Homo sapiens
ugucuuugccuucaucuug

SEQ ID NO: 484757 - RNA, 19 nt, Homo sapiens
agagaacccagccaacuau

SEQ ID NO: 484758 - RNA, 19 nt, Homo sapiens
acuaugaaguuccuugucu

SEQ ID NO: 484759 - RNA, 19 nt, Homo sapiens
cuaugaaguuccuugucuu

SEQ ID NO: 484760 - RNA, 19 nt, Homo sapiens
caauugucacuugaugaua

SEQ ID NO: 484761 - RNA, 19 nt, Homo sapiens
uccauauucucaucuuuca

SEQ ID NO: 484762 - RNA, 19 nt, Homo sapiens
caaccacuauacccacaac

SEQ ID NO: 484763 - RNA, 19 nt, Homo sapiens
uaccauaucacacuacuac

SEQ ID NO: 484764 - RNA, 19 nt, Homo sapiens
gauacuugccuuuucaauu

SEQ ID NO: 484765 - RNA, 19 nt, Homo sapiens
uacgacuucuacauccaua

SEQ ID NO: 484766 - RNA, 19 nt, Homo sapiens
cuucuguagucucaucuug

SEQ ID NO: 484767 - RNA, 19 nt, Homo sapiens
uggcaaauacgacuucuac

SEQ ID NO: 484768 - RNA, 19 nt, Homo sapiens
caaccauaccaaccacaau

SEQ ID NO: 484769 - RNA, 19 nt, Homo sapiens
gagaacccagccaacuaug

SEQ ID NO: 484770 - RNA, 19 nt, Homo sapiens
ccaaccacaauaccaacaa

SEQ ID NO: 484771 - RNA, 19 nt, Homo sapiens
aaccacaauaccaacaaua

SEQ ID NO: 484772 - RNA, 19 nt, Homo sapiens
aaagagaacccagccaacu

SEQ ID NO: 484773 - RNA, 19 nt, Homo sapiens
gcaagaagauuucaaagaa

SEQ ID NO: 484774 - RNA, 19 nt, Homo sapiens
ggacuuaaaugaacuuuga

SEQ ID NO: 484775 - RNA, 19 nt, Homo sapiens
ggacuuagcuuucacuaca

SEQ ID NO: 484776 - RNA, 19 nt, Homo sapiens
gagacugacuuuaucaaua

SEQ ID NO: 484777 - RNA, 19 nt, Homo sapiens
gaauaagucucccacaguu

SEQ ID NO: 484778 - RNA, 19 nt, Homo sapiens
gcaaacaggacuuaaauga

SEQ ID NO: 484779 - RNA, 19 nt, Homo sapiens
aaacggaacuugccuguga

SEQ ID NO: 484780 - RNA, 19 nt, Homo sapiens
gaacuugccugugaauuuc

SEQ ID NO: 484781 - RNA, 19 nt, Homo sapiens
gaacgaauuuguaucucuu

SEQ ID NO: 484782 - RNA, 19 nt, Homo sapiens
gaagacacccauaaagaaa

SEQ ID NO: 484783 - RNA, 19 nt, Homo sapiens
cgacaaagaucauauccau

SEQ ID NO: 484784 - RNA, 19 nt, Homo sapiens
ggagauccuugguuucaaa

SEQ ID NO: 484785 - RNA, 19 nt, Homo sapiens
ggaacuugccugugaauuu

SEQ ID NO: 484786 - RNA, 19 nt, Homo sapiens
gauaugaucuccauguagu

SEQ ID NO: 484787 - RNA, 19 nt, Homo sapiens
uaaaguugcugucugaguu

SEQ ID NO: 484788 - RNA, 19 nt, Homo sapiens
ggacaucacaccaaagauu

SEQ ID NO: 484789 - RNA, 19 nt, Homo sapiens
guacagagaugccaagaac

SEQ ID NO: 484790 - RNA, 19 nt, Homo sapiens
gaaaaugggacuaguaaua

SEQ ID NO: 484791 - RNA, 19 nt, Homo sapiens
gagaagacacccauaaaga

SEQ ID NO: 484792 - RNA, 19 nt, Homo sapiens
cacgguaacugccaugaua

SEQ ID NO: 484793 - RNA, 19 nt, Homo sapiens
gcaauuuaauggcaaagga

SEQ ID NO: 484794 - RNA, 19 nt, Homo sapiens
ugaccuacguuucuguaua

SEQ ID NO: 484795 - RNA, 19 nt, Homo sapiens
gaagagaauccgaagaaga

SEQ ID NO: 484796 - RNA, 19 nt, Homo sapiens
ggaguuuauuaaccacuua

SEQ ID NO: 484797 - RNA, 19 nt, Homo sapiens
gaacgggcaccaacaagaa

SEQ ID NO: 484798 - RNA, 19 nt, Homo sapiens
ggaggugaauggaagagaa

SEQ ID NO: 484799 - RNA, 19 nt, Homo sapiens
ucaauaaucuaaccgacaa

SEQ ID NO: 484800 - RNA, 19 nt, Homo sapiens
ucaaggacaucacaccaaa

SEQ ID NO: 484801 - RNA, 19 nt, Homo sapiens
aaacaggacuuaaaugaac

SEQ ID NO: 484802 - RNA, 19 nt, Homo sapiens
gaagacaacagaaacacaa

SEQ ID NO: 484803 - RNA, 19 nt, Homo sapiens
gaacuuugaucucuguuuu

SEQ ID NO: 484804 - RNA, 19 nt, Homo sapiens
caugauagcccgagaguug

SEQ ID NO: 484805 - RNA, 19 nt, Homo sapiens
ucacuacacuacaggauau

SEQ ID NO: 484806 - RNA, 19 nt, Homo sapiens
uugaggagcugaagaaguu

SEQ ID NO: 484807 - RNA, 19 nt, Homo sapiens
ccagagugcucgauacugu

SEQ ID NO: 484808 - RNA, 19 nt, Homo sapiens
auauaaaccugcagaguga

SEQ ID NO: 484809 - RNA, 19 nt, Homo sapiens
gaggagaagacacccauaa

SEQ ID NO: 484810 - RNA, 19 nt, Homo sapiens
guuaaguacugcuuccauu

SEQ ID NO: 484811 - RNA, 19 nt, Homo sapiens
guggaguccugccaugaua

SEQ ID NO: 484812 - RNA, 19 nt, Homo sapiens
gcagggaguuugugaugca

SEQ ID NO: 484813 - RNA, 19 nt, Homo sapiens
gaaauaagucaaguguuug

SEQ ID NO: 484814 - RNA, 19 nt, Homo sapiens
cagagaggcuggaggugaa

SEQ ID NO: 484815 - RNA, 19 nt, Homo sapiens
ugaggauccugcagaauga

SEQ ID NO: 484816 - RNA, 19 nt, Homo sapiens
ggaugcaguccaccuauaa

SEQ ID NO: 484817 - RNA, 19 nt, Homo sapiens
caaacaggacuuaaaugaa

SEQ ID NO: 484818 - RNA, 19 nt, Homo sapiens
aaaccacacugcagaagga

SEQ ID NO: 484819 - RNA, 19 nt, Homo sapiens
guauacagcuguguugcuu

SEQ ID NO: 484820 - RNA, 19 nt, Homo sapiens
gcagggaagacaacagaaa

SEQ ID NO: 484821 - RNA, 19 nt, Homo sapiens
gacaucacaccaaagauuu

SEQ ID NO: 484822 - RNA, 19 nt, Homo sapiens
guaauaaagaggaugaguu

SEQ ID NO: 484823 - RNA, 19 nt, Homo sapiens
gaacgaguaaagccuagaa

SEQ ID NO: 484824 - RNA, 19 nt, Homo sapiens
gaccuacguuucuguauac

SEQ ID NO: 484825 - RNA, 19 nt, Homo sapiens
ucccacaguuguauaaauu

SEQ ID NO: 484826 - RNA, 19 nt, Homo sapiens
acaaagaucauauccaugu

SEQ ID NO: 484827 - RNA, 19 nt, Homo sapiens
ggagaagacacccauaaag

SEQ ID NO: 484828 - RNA, 19 nt, Homo sapiens
aguaaagccuagaaucaaa

SEQ ID NO: 484829 - RNA, 19 nt, Homo sapiens
ugaagaacuuugugaccaa

SEQ ID NO: 484830 - RNA, 19 nt, Homo sapiens
cgagagacacgguggguaa

SEQ ID NO: 484831 - RNA, 19 nt, Homo sapiens
ccaacaaaguacagagaug

SEQ ID NO: 484832 - RNA, 19 nt, Homo sapiens
acacgaugcugcugccaaa

SEQ ID NO: 484833 - RNA, 19 nt, Homo sapiens
caagacaggcugcgaaaca

SEQ ID NO: 484834 - RNA, 19 nt, Homo sapiens
ccgauaagcugagauuaca

SEQ ID NO: 484835 - RNA, 19 nt, Homo sapiens
uacugaaacugcuuugaaa

SEQ ID NO: 484836 - RNA, 19 nt, Homo sapiens
gaaacggaccaaugucugu

SEQ ID NO: 484837 - RNA, 19 nt, Homo sapiens
caagaacgaauuuguaucu

SEQ ID NO: 484838 - RNA, 19 nt, Homo sapiens
gagcaacuggacuaucuuu

SEQ ID NO: 484839 - RNA, 19 nt, Homo sapiens
uaauaaagaggaugaguuc

SEQ ID NO: 484840 - RNA, 19 nt, Homo sapiens
agaagacacccauaaagaa

SEQ ID NO: 484841 - RNA, 19 nt, Homo sapiens
ggaacgggcaccaacaaga

SEQ ID NO: 484842 - RNA, 19 nt, Homo sapiens
uguuugagauugcacuuaa

SEQ ID NO: 484843 - RNA, 19 nt, Homo sapiens
aagagaauccgaagaagaa

SEQ ID NO: 484844 - RNA, 19 nt, Homo sapiens
gcucgauacuguuaauuac

SEQ ID NO: 484845 - RNA, 19 nt, Homo sapiens
gaguaaagccuagaaucaa

SEQ ID NO: 484846 - RNA, 19 nt, Homo sapiens
cgaguaaagccuagaauca

SEQ ID NO: 484847 - RNA, 19 nt, Homo sapiens
ggagugcaguggcgugauc

SEQ ID NO: 484848 - RNA, 19 nt, Homo sapiens
ggaagagaauccgaagaag

SEQ ID NO: 484849 - RNA, 19 nt, Homo sapiens
cugcuuccauucauuguuu

SEQ ID NO: 484850 - RNA, 19 nt, Homo sapiens
caggacaguuucagugaug

SEQ ID NO: 484851 - RNA, 19 nt, Homo sapiens
aagaucauauccaugugua

SEQ ID NO: 484852 - RNA, 19 nt, Homo sapiens
cuaguuaaauagcacaguu

SEQ ID NO: 484853 - RNA, 19 nt, Homo sapiens
gaacugaacaaagacaaca

SEQ ID NO: 484854 - RNA, 19 nt, Homo sapiens
cgccauagcuguucuugag

SEQ ID NO: 484855 - RNA, 19 nt, Homo sapiens
gcaaaggaaagacaagaca

SEQ ID NO: 484856 - RNA, 19 nt, Homo sapiens
ucagacacauugggacaaa

SEQ ID NO: 484857 - RNA, 19 nt, Homo sapiens
ucuuaaaguugcugucuga

SEQ ID NO: 484858 - RNA, 19 nt, Homo sapiens
gcgcugaacaucuuaaagu

SEQ ID NO: 484859 - RNA, 19 nt, Homo sapiens
ccaguuccaccuuuacuuu

SEQ ID NO: 484860 - RNA, 19 nt, Homo sapiens
cggaugcaguccaccuaua

SEQ ID NO: 484861 - RNA, 19 nt, Homo sapiens
gauguuguguuacuguaca

SEQ ID NO: 484862 - RNA, 19 nt, Homo sapiens
gagauuacaggaguuuauu

SEQ ID NO: 484863 - RNA, 19 nt, Homo sapiens
ggccaugaaccauuauaaa

SEQ ID NO: 484864 - RNA, 19 nt, Homo sapiens
gauccuugguuucaaaguc

SEQ ID NO: 484865 - RNA, 19 nt, Homo sapiens
caucaccacugcuuucucu

SEQ ID NO: 484866 - RNA, 19 nt, Homo sapiens
gcuaaaagcaccagagaaa

SEQ ID NO: 484867 - RNA, 19 nt, Homo sapiens
gaggacagcaauuuaaugg

SEQ ID NO: 484868 - RNA, 19 nt, Homo sapiens
ggaggacagcaauuuaaug

SEQ ID NO: 484869 - RNA, 19 nt, Homo sapiens
guacugcuuccauucauug

SEQ ID NO: 484870 - RNA, 19 nt, Homo sapiens
cuauacauauggcucuuga

SEQ ID NO: 484871 - RNA, 19 nt, Homo sapiens
gaucuguauucuuaguuuc

SEQ ID NO: 484872 - RNA, 19 nt, Homo sapiens
gaaaaucaaaugcuuccua

SEQ ID NO: 484873 - RNA, 19 nt, Homo sapiens
gcaagaagauuucaaagaa

SEQ ID NO: 484874 - RNA, 19 nt, Homo sapiens
ggacuuaaaugaacuuuga

SEQ ID NO: 484875 - RNA, 19 nt, Homo sapiens
ggacuuagcuuucacuaca

SEQ ID NO: 484876 - RNA, 19 nt, Homo sapiens
gagacugacuuuaucaaua

SEQ ID NO: 484877 - RNA, 19 nt, Homo sapiens
gaauaagucucccacaguu

SEQ ID NO: 484878 - RNA, 19 nt, Homo sapiens
gcaaacaggacuuaaauga

SEQ ID NO: 484879 - RNA, 19 nt, Homo sapiens
aaacggaacuugccuguga

SEQ ID NO: 484880 - RNA, 19 nt, Homo sapiens
gaacuugccugugaauuuc

SEQ ID NO: 484881 - RNA, 19 nt, Homo sapiens
gaacgaauuuguaucucuu

SEQ ID NO: 484882 - RNA, 19 nt, Homo sapiens
gaagacacccauaaagaaa

SEQ ID NO: 484883 - RNA, 19 nt, Homo sapiens
cgacaaagaucauauccau

SEQ ID NO: 484884 - RNA, 19 nt, Homo sapiens
ggagauccuugguuucaaa

SEQ ID NO: 484885 - RNA, 19 nt, Homo sapiens
ggaacuugccugugaauuu

SEQ ID NO: 484886 - RNA, 19 nt, Homo sapiens
gauaugaucuccauguagu

SEQ ID NO: 484887 - RNA, 19 nt, Homo sapiens
uaaaguugcugucugaguu

SEQ ID NO: 484888 - RNA, 19 nt, Homo sapiens
ggacaucacaccaaagauu

SEQ ID NO: 484889 - RNA, 19 nt, Homo sapiens
guacagagaugccaagaac

SEQ ID NO: 484890 - RNA, 19 nt, Homo sapiens
gaaaaugggacuaguaaua

SEQ ID NO: 484891 - RNA, 19 nt, Homo sapiens
gagaagacacccauaaaga

SEQ ID NO: 484892 - RNA, 19 nt, Homo sapiens
cacgguaacugccaugaua

SEQ ID NO: 484893 - RNA, 19 nt, Homo sapiens
gcaauuuaauggcaaagga

SEQ ID NO: 484894 - RNA, 19 nt, Homo sapiens
ugaccuacguuucuguaua

SEQ ID NO: 484895 - RNA, 19 nt, Homo sapiens
gaagagaauccgaagaaga

SEQ ID NO: 484896 - RNA, 19 nt, Homo sapiens
gaacgggcaccaacaagaa

SEQ ID NO: 484897 - RNA, 19 nt, Homo sapiens
ggaggugaauggaagagaa

SEQ ID NO: 484898 - RNA, 19 nt, Homo sapiens
ucaauaaucuaaccgacaa

SEQ ID NO: 484899 - RNA, 19 nt, Homo sapiens
ucaaggacaucacaccaaa

SEQ ID NO: 484900 - RNA, 19 nt, Homo sapiens
aaacaggacuuaaaugaac

SEQ ID NO: 484901 - RNA, 19 nt, Homo sapiens
gaagacaacagaaacacaa

SEQ ID NO: 484902 - RNA, 19 nt, Homo sapiens
gaacuuugaucucuguuuu

SEQ ID NO: 484903 - RNA, 19 nt, Homo sapiens
caugauagcccgagaguug

SEQ ID NO: 484904 - RNA, 19 nt, Homo sapiens
ucacuacacuacaggauau

SEQ ID NO: 484905 - RNA, 19 nt, Homo sapiens
uugaggagcugaagaaguu

SEQ ID NO: 484906 - RNA, 19 nt, Homo sapiens
ccagagugcucgauacugu

SEQ ID NO: 484907 - RNA, 19 nt, Homo sapiens
auauaaaccugcagaguga

SEQ ID NO: 484908 - RNA, 19 nt, Homo sapiens
gaggagaagacacccauaa

SEQ ID NO: 484909 - RNA, 19 nt, Homo sapiens
guuaaguacugcuuccauu

SEQ ID NO: 484910 - RNA, 19 nt, Homo sapiens
guggaguccugccaugaua

SEQ ID NO: 484911 - RNA, 19 nt, Homo sapiens
gcagggaguuugugaugca

SEQ ID NO: 484912 - RNA, 19 nt, Homo sapiens
gaaauaagucaaguguuug

SEQ ID NO: 484913 - RNA, 19 nt, Homo sapiens
cagagaggcuggaggugaa

SEQ ID NO: 484914 - RNA, 19 nt, Homo sapiens
ugaggauccugcagaauga

SEQ ID NO: 484915 - RNA, 19 nt, Homo sapiens
ggaugcaguccaccuauaa

SEQ ID NO: 484916 - RNA, 19 nt, Homo sapiens
caaacaggacuuaaaugaa

SEQ ID NO: 484917 - RNA, 19 nt, Homo sapiens
aaaccacacugcagaagga

SEQ ID NO: 484918 - RNA, 19 nt, Homo sapiens
guauacagcuguguugcuu

SEQ ID NO: 484919 - RNA, 19 nt, Homo sapiens
gcagggaagacaacagaaa

SEQ ID NO: 484920 - RNA, 19 nt, Homo sapiens
gacaucacaccaaagauuu

SEQ ID NO: 484921 - RNA, 19 nt, Homo sapiens
guaauaaagaggaugaguu

SEQ ID NO: 484922 - RNA, 19 nt, Homo sapiens
gaacgaguaaagccuagaa

SEQ ID NO: 484923 - RNA, 19 nt, Homo sapiens
gaccuacguuucuguauac

SEQ ID NO: 484924 - RNA, 19 nt, Homo sapiens
ucccacaguuguauaaauu

SEQ ID NO: 484925 - RNA, 19 nt, Homo sapiens
acaaagaucauauccaugu

SEQ ID NO: 484926 - RNA, 19 nt, Homo sapiens
gagcagcagccagaguuua

SEQ ID NO: 484927 - RNA, 19 nt, Homo sapiens
cagcagccagaguuuauua

SEQ ID NO: 484928 - RNA, 19 nt, Homo sapiens
ggagaagacacccauaaag

SEQ ID NO: 484929 - RNA, 19 nt, Homo sapiens
aguaaagccuagaaucaaa

SEQ ID NO: 484930 - RNA, 19 nt, Homo sapiens
ugaagaacuuugugaccaa

SEQ ID NO: 484931 - RNA, 19 nt, Homo sapiens
cgagagacacgguggguaa

SEQ ID NO: 484932 - RNA, 19 nt, Homo sapiens
ccaacaaaguacagagaug

SEQ ID NO: 484933 - RNA, 19 nt, Homo sapiens
acacgaugcugcugccaaa

SEQ ID NO: 484934 - RNA, 19 nt, Homo sapiens
caagacaggcugcgaaaca

SEQ ID NO: 484935 - RNA, 19 nt, Homo sapiens
uacugaaacugcuuugaaa

SEQ ID NO: 484936 - RNA, 19 nt, Homo sapiens
gaaacggaccaaugucugu

SEQ ID NO: 484937 - RNA, 19 nt, Homo sapiens
caagaacgaauuuguaucu

SEQ ID NO: 484938 - RNA, 19 nt, Homo sapiens
gagcaacuggacuaucuuu

SEQ ID NO: 484939 - RNA, 19 nt, Homo sapiens
uaauaaagaggaugaguuc

SEQ ID NO: 484940 - RNA, 19 nt, Homo sapiens
agaagacacccauaaagaa

SEQ ID NO: 484941 - RNA, 19 nt, Homo sapiens
ggaacgggcaccaacaaga

SEQ ID NO: 484942 - RNA, 19 nt, Homo sapiens
uguuugagauugcacuuaa

SEQ ID NO: 484943 - RNA, 19 nt, Homo sapiens
aagagaauccgaagaagaa

SEQ ID NO: 484944 - RNA, 19 nt, Homo sapiens
gcucgauacuguuaauuac

SEQ ID NO: 484945 - RNA, 19 nt, Homo sapiens
gaguaaagccuagaaucaa

SEQ ID NO: 484946 - RNA, 19 nt, Homo sapiens
cgaguaaagccuagaauca

SEQ ID NO: 484947 - RNA, 19 nt, Homo sapiens
ggaagagaauccgaagaag

SEQ ID NO: 484948 - RNA, 19 nt, Homo sapiens
cugcuuccauucauuguuu

SEQ ID NO: 484949 - RNA, 19 nt, Homo sapiens
caggacaguuucagugaug

SEQ ID NO: 484950 - RNA, 19 nt, Homo sapiens
aagaucauauccaugugua

SEQ ID NO: 484951 - RNA, 19 nt, Homo sapiens
cuaguuaaauagcacaguu

SEQ ID NO: 484952 - RNA, 19 nt, Homo sapiens
gaacugaacaaagacaaca

SEQ ID NO: 484953 - RNA, 19 nt, Homo sapiens
cgccauagcuguucuugag

SEQ ID NO: 484954 - RNA, 19 nt, Homo sapiens
gcaaaggaaagacaagaca

SEQ ID NO: 484955 - RNA, 19 nt, Homo sapiens
ucagacacauugggacaaa

SEQ ID NO: 484956 - RNA, 19 nt, Homo sapiens
ucuuaaaguugcugucuga

SEQ ID NO: 484957 - RNA, 19 nt, Homo sapiens
gcgcugaacaucuuaaagu

SEQ ID NO: 484958 - RNA, 19 nt, Homo sapiens
cggaugcaguccaccuaua

SEQ ID NO: 484959 - RNA, 19 nt, Homo sapiens
ccaguuccaccuuuacuuu

SEQ ID NO: 484960 - RNA, 19 nt, Homo sapiens
gauguuguguuacuguaca

SEQ ID NO: 484961 - RNA, 19 nt, Homo sapiens
ggccaugaaccauuauaaa

SEQ ID NO: 484962 - RNA, 19 nt, Homo sapiens
gauccuugguuucaaaguc

SEQ ID NO: 484963 - RNA, 19 nt, Homo sapiens
caucaccacugcuuucucu

SEQ ID NO: 484964 - RNA, 19 nt, Homo sapiens
gcuaaaagcaccagagaaa

SEQ ID NO: 484965 - RNA, 19 nt, Homo sapiens
gaggacagcaauuuaaugg

SEQ ID NO: 484966 - RNA, 19 nt, Homo sapiens
ggaggacagcaauuuaaug

SEQ ID NO: 484967 - RNA, 19 nt, Homo sapiens
guacugcuuccauucauug

SEQ ID NO: 484968 - RNA, 19 nt, Homo sapiens
cuauacauauggcucuuga

SEQ ID NO: 484969 - RNA, 19 nt, Homo sapiens
gaucuguauucuuaguuuc

SEQ ID NO: 484970 - RNA, 19 nt, Homo sapiens
gaaaaucaaaugcuuccua

SEQ ID NO: 484971 - RNA, 19 nt, Homo sapiens
cccaacauauauacugaaa

SEQ ID NO: 484972 - RNA, 19 nt, Homo sapiens
gggaaaagcaagaagauuu

SEQ ID NO: 484973 - RNA, 19 nt, Homo sapiens
gcaagaagauuucaaagaa

SEQ ID NO: 484974 - RNA, 19 nt, Homo sapiens
ggacuuaaaugaacuuuga

SEQ ID NO: 484975 - RNA, 19 nt, Homo sapiens
gaauuaaccugcacugaaa

SEQ ID NO: 484976 - RNA, 19 nt, Homo sapiens
ggacuuagcuuucacuaca

SEQ ID NO: 484977 - RNA, 19 nt, Homo sapiens
gagacugacuuuaucaaua

SEQ ID NO: 484978 - RNA, 19 nt, Homo sapiens
gaauaagucucccacaguu

SEQ ID NO: 484979 - RNA, 19 nt, Homo sapiens
gcaaacaggacuuaaauga

SEQ ID NO: 484980 - RNA, 19 nt, Homo sapiens
aaacggaacuugccuguga

SEQ ID NO: 484981 - RNA, 19 nt, Homo sapiens
gaaccagucucuucucuca

SEQ ID NO: 484982 - RNA, 19 nt, Homo sapiens
gaacuugccugugaauuuc

SEQ ID NO: 484983 - RNA, 19 nt, Homo sapiens
gaacgaauuuguaucucuu

SEQ ID NO: 484984 - RNA, 19 nt, Homo sapiens
gaagacacccauaaagaaa

SEQ ID NO: 484985 - RNA, 19 nt, Homo sapiens
cgacaaagaucauauccau

SEQ ID NO: 484986 - RNA, 19 nt, Homo sapiens
ggagauccuugguuucaaa

SEQ ID NO: 484987 - RNA, 19 nt, Homo sapiens
ggaacuugccugugaauuu

SEQ ID NO: 484988 - RNA, 19 nt, Homo sapiens
gauaugaucuccauguagu

SEQ ID NO: 484989 - RNA, 19 nt, Homo sapiens
uaaaguugcugucugaguu

SEQ ID NO: 484990 - RNA, 19 nt, Homo sapiens
ggacaucacaccaaagauu

SEQ ID NO: 484991 - RNA, 19 nt, Homo sapiens
guacagagaugccaagaac

SEQ ID NO: 484992 - RNA, 19 nt, Homo sapiens
gaaaaugggacuaguaaua

SEQ ID NO: 484993 - RNA, 19 nt, Homo sapiens
gagaagacacccauaaaga

SEQ ID NO: 484994 - RNA, 19 nt, Homo sapiens
gcagguagacccauucaaa

SEQ ID NO: 484995 - RNA, 19 nt, Homo sapiens
cacgguaacugccaugaua

SEQ ID NO: 484996 - RNA, 19 nt, Homo sapiens
gcaauuuaauggcaaagga

SEQ ID NO: 484997 - RNA, 19 nt, Homo sapiens
gaccaugucucaaguucaa

SEQ ID NO: 484998 - RNA, 19 nt, Homo sapiens
ugaccuacguuucuguaua

SEQ ID NO: 484999 - RNA, 19 nt, Homo sapiens
gaagagaauccgaagaaga

SEQ ID NO: 485000 - RNA, 19 nt, Homo sapiens
gaacgggcaccaacaagaa

SEQ ID NO: 485001 - RNA, 19 nt, Homo sapiens
ggaggugaauggaagagaa

SEQ ID NO: 485002 - RNA, 19 nt, Homo sapiens
ucaauaaucuaaccgacaa

SEQ ID NO: 485003 - RNA, 19 nt, Homo sapiens
ucaaggacaucacaccaaa

SEQ ID NO: 485004 - RNA, 19 nt, Homo sapiens
gccaaauacugaacaagaa

SEQ ID NO: 485005 - RNA, 19 nt, Homo sapiens
aaacaggacuuaaaugaac

SEQ ID NO: 485006 - RNA, 19 nt, Homo sapiens
gaagacaacagaaacacaa

SEQ ID NO: 485007 - RNA, 19 nt, Homo sapiens
ucacagccuuugaugagua

SEQ ID NO: 485008 - RNA, 19 nt, Homo sapiens
gaacuuugaucucuguuuu

SEQ ID NO: 485009 - RNA, 19 nt, Homo sapiens
caugauagcccgagaguug

SEQ ID NO: 485010 - RNA, 19 nt, Homo sapiens
ucacuacacuacaggauau

SEQ ID NO: 485011 - RNA, 19 nt, Homo sapiens
uugaggagcugaagaaguu

SEQ ID NO: 485012 - RNA, 19 nt, Homo sapiens
ccagagugcucgauacugu

SEQ ID NO: 485013 - RNA, 19 nt, Homo sapiens
auauaaaccugcagaguga

SEQ ID NO: 485014 - RNA, 19 nt, Homo sapiens
gaggagaagacacccauaa

SEQ ID NO: 485015 - RNA, 19 nt, Homo sapiens
guuaaguacugcuuccauu

SEQ ID NO: 485016 - RNA, 19 nt, Homo sapiens
guggaguccugccaugaua

SEQ ID NO: 485017 - RNA, 19 nt, Homo sapiens
gcagggaguuugugaugca

SEQ ID NO: 485018 - RNA, 19 nt, Homo sapiens
gaaauaagucaaguguuug

SEQ ID NO: 485019 - RNA, 19 nt, Homo sapiens
cagagaggcuggaggugaa

SEQ ID NO: 485020 - RNA, 19 nt, Homo sapiens
ugaggauccugcagaauga

SEQ ID NO: 485021 - RNA, 19 nt, Homo sapiens
ggaugcaguccaccuauaa

SEQ ID NO: 485022 - RNA, 19 nt, Homo sapiens
caaacaggacuuaaaugaa

SEQ ID NO: 485023 - RNA, 19 nt, Homo sapiens
aaaccacacugcagaagga

SEQ ID NO: 485024 - RNA, 19 nt, Homo sapiens
guauacagcuguguugcuu

SEQ ID NO: 485025 - RNA, 19 nt, Homo sapiens
gcagggaagacaacagaaa

SEQ ID NO: 485026 - RNA, 19 nt, Homo sapiens
gacaucacaccaaagauuu

SEQ ID NO: 485027 - RNA, 19 nt, Homo sapiens
guaauaaagaggaugaguu

SEQ ID NO: 485028 - RNA, 19 nt, Homo sapiens
gaacgaguaaagccuagaa

SEQ ID NO: 485029 - RNA, 19 nt, Homo sapiens
ugaauuaaccugcacugaa

SEQ ID NO: 485030 - RNA, 19 nt, Homo sapiens
gaccuacguuucuguauac

SEQ ID NO: 485031 - RNA, 19 nt, Homo sapiens
ucccacaguuguauaaauu

SEQ ID NO: 485032 - RNA, 19 nt, Homo sapiens
acaaagaucauauccaugu

SEQ ID NO: 485033 - RNA, 19 nt, Homo sapiens
cagcagccagaguuuauua

SEQ ID NO: 485034 - RNA, 19 nt, Homo sapiens
ggagaagacacccauaaag

SEQ ID NO: 485035 - RNA, 19 nt, Homo sapiens
aguaaagccuagaaucaaa

SEQ ID NO: 485036 - RNA, 19 nt, Homo sapiens
ugaagaacuuugugaccaa

SEQ ID NO: 485037 - RNA, 19 nt, Homo sapiens
gagcagcagccagaguuua

SEQ ID NO: 485038 - RNA, 19 nt, Homo sapiens
cgagagacacgguggguaa

SEQ ID NO: 485039 - RNA, 19 nt, Homo sapiens
ccaacaaaguacagagaug

SEQ ID NO: 485040 - RNA, 19 nt, Homo sapiens
acacgaugcugcugccaaa

SEQ ID NO: 485041 - RNA, 19 nt, Homo sapiens
caagacaggcugcgaaaca

SEQ ID NO: 485042 - RNA, 19 nt, Homo sapiens
uacugaaacugcuuugaaa

SEQ ID NO: 485043 - RNA, 19 nt, Homo sapiens
gaaacggaccaaugucugu

SEQ ID NO: 485044 - RNA, 19 nt, Homo sapiens
caagaacgaauuuguaucu

SEQ ID NO: 485045 - RNA, 19 nt, Homo sapiens
gagcaacuggacuaucuuu

SEQ ID NO: 485046 - RNA, 19 nt, Homo sapiens
uaauaaagaggaugaguuc

SEQ ID NO: 485047 - RNA, 19 nt, Homo sapiens
agaagacacccauaaagaa

SEQ ID NO: 485048 - RNA, 19 nt, Homo sapiens
ggaacgggcaccaacaaga

SEQ ID NO: 485049 - RNA, 19 nt, Homo sapiens
uguuugagauugcacuuaa

SEQ ID NO: 485050 - RNA, 19 nt, Homo sapiens
aagagaauccgaagaagaa

SEQ ID NO: 485051 - RNA, 19 nt, Homo sapiens
gcucgauacuguuaauuac

SEQ ID NO: 485052 - RNA, 19 nt, Homo sapiens
gaguaaagccuagaaucaa

SEQ ID NO: 485053 - RNA, 19 nt, Homo sapiens
cgaguaaagccuagaauca

SEQ ID NO: 485054 - RNA, 19 nt, Homo sapiens
ggaagagaauccgaagaag

SEQ ID NO: 485055 - RNA, 19 nt, Homo sapiens
cugcuuccauucauuguuu

SEQ ID NO: 485056 - RNA, 19 nt, Homo sapiens
caggacaguuucagugaug

SEQ ID NO: 485057 - RNA, 19 nt, Homo sapiens
aagaucauauccaugugua

SEQ ID NO: 485058 - RNA, 19 nt, Homo sapiens
cuaguuaaauagcacaguu

SEQ ID NO: 485059 - RNA, 19 nt, Homo sapiens
gaacugaacaaagacaaca

SEQ ID NO: 485060 - RNA, 19 nt, Homo sapiens
cgccauagcuguucuugag

SEQ ID NO: 485061 - RNA, 19 nt, Homo sapiens
gcaaaggaaagacaagaca

SEQ ID NO: 485062 - RNA, 19 nt, Homo sapiens
ggagccaaauacugaacaa

SEQ ID NO: 485063 - RNA, 19 nt, Homo sapiens
ucagacacauugggacaaa

SEQ ID NO: 485064 - RNA, 19 nt, Homo sapiens
ucuuaaaguugcugucuga

SEQ ID NO: 485065 - RNA, 19 nt, Homo sapiens
gcgcugaacaucuuaaagu

SEQ ID NO: 485066 - RNA, 19 nt, Homo sapiens
ccaguuccaccuuuacuuu

SEQ ID NO: 485067 - RNA, 19 nt, Homo sapiens
cggaugcaguccaccuaua

SEQ ID NO: 485068 - RNA, 19 nt, Homo sapiens
gauguuguguuacuguaca

SEQ ID NO: 485069 - RNA, 19 nt, Homo sapiens
ggccaugaaccauuauaaa

SEQ ID NO: 485070 - RNA, 19 nt, Homo sapiens
gauccuugguuucaaaguc

SEQ ID NO: 485071 - RNA, 19 nt, Homo sapiens
gaaagcuguuuaccugcau

SEQ ID NO: 485072 - RNA, 19 nt, Homo sapiens
caucaccacugcuuucucu

SEQ ID NO: 485073 - RNA, 19 nt, Homo sapiens
gcaagaagauuucaaagaa

SEQ ID NO: 485074 - RNA, 19 nt, Homo sapiens
ggacuuaaaugaacuuuga

SEQ ID NO: 485075 - RNA, 19 nt, Homo sapiens
ggacuuagcuuucacuaca

SEQ ID NO: 485076 - RNA, 19 nt, Homo sapiens
gagacugacuuuaucaaua

SEQ ID NO: 485077 - RNA, 19 nt, Homo sapiens
gaauaagucucccacaguu

SEQ ID NO: 485078 - RNA, 19 nt, Homo sapiens
gcaaacaggacuuaaauga

SEQ ID NO: 485079 - RNA, 19 nt, Homo sapiens
aaacggaacuugccuguga

SEQ ID NO: 485080 - RNA, 19 nt, Homo sapiens
gaacuugccugugaauuuc

SEQ ID NO: 485081 - RNA, 19 nt, Homo sapiens
gaacgaauuuguaucucuu

SEQ ID NO: 485082 - RNA, 19 nt, Homo sapiens
gaagacacccauaaagaaa

SEQ ID NO: 485083 - RNA, 19 nt, Homo sapiens
cgacaaagaucauauccau

SEQ ID NO: 485084 - RNA, 19 nt, Homo sapiens
ggagauccuugguuucaaa

SEQ ID NO: 485085 - RNA, 19 nt, Homo sapiens
ggaacuugccugugaauuu

SEQ ID NO: 485086 - RNA, 19 nt, Homo sapiens
gauaugaucuccauguagu

SEQ ID NO: 485087 - RNA, 19 nt, Homo sapiens
uaaaguugcugucugaguu

SEQ ID NO: 485088 - RNA, 19 nt, Homo sapiens
ggacaucacaccaaagauu

SEQ ID NO: 485089 - RNA, 19 nt, Homo sapiens
guacagagaugccaagaac

SEQ ID NO: 485090 - RNA, 19 nt, Homo sapiens
gaaaaugggacuaguaaua

SEQ ID NO: 485091 - RNA, 19 nt, Homo sapiens
gagaagacacccauaaaga

SEQ ID NO: 485092 - RNA, 19 nt, Homo sapiens
cacgguaacugccaugaua

SEQ ID NO: 485093 - RNA, 19 nt, Homo sapiens
gcaauuuaauggcaaagga

SEQ ID NO: 485094 - RNA, 19 nt, Homo sapiens
ugaccuacguuucuguaua

SEQ ID NO: 485095 - RNA, 19 nt, Homo sapiens
gaagagaauccgaagaaga

SEQ ID NO: 485096 - RNA, 19 nt, Homo sapiens
gaacgggcaccaacaagaa

SEQ ID NO: 485097 - RNA, 19 nt, Homo sapiens
ggaggugaauggaagagaa

SEQ ID NO: 485098 - RNA, 19 nt, Homo sapiens
ucaauaaucuaaccgacaa

SEQ ID NO: 485099 - RNA, 19 nt, Homo sapiens
ucaaggacaucacaccaaa

SEQ ID NO: 485100 - RNA, 19 nt, Homo sapiens
aaacaggacuuaaaugaac

SEQ ID NO: 485101 - RNA, 19 nt, Homo sapiens
gaagacaacagaaacacaa

SEQ ID NO: 485102 - RNA, 19 nt, Homo sapiens
gaacuuugaucucuguuuu

SEQ ID NO: 485103 - RNA, 19 nt, Homo sapiens
caugauagcccgagaguug

SEQ ID NO: 485104 - RNA, 19 nt, Homo sapiens
ucacuacacuacaggauau

SEQ ID NO: 485105 - RNA, 19 nt, Homo sapiens
uugaggagcugaagaaguu

SEQ ID NO: 485106 - RNA, 19 nt, Homo sapiens
ccagagugcucgauacugu

SEQ ID NO: 485107 - RNA, 19 nt, Homo sapiens
auauaaaccugcagaguga

SEQ ID NO: 485108 - RNA, 19 nt, Homo sapiens
gaggagaagacacccauaa

SEQ ID NO: 485109 - RNA, 19 nt, Homo sapiens
guuaaguacugcuuccauu

SEQ ID NO: 485110 - RNA, 19 nt, Homo sapiens
guggaguccugccaugaua

SEQ ID NO: 485111 - RNA, 19 nt, Homo sapiens
gcagggaguuugugaugca

SEQ ID NO: 485112 - RNA, 19 nt, Homo sapiens
gaaauaagucaaguguuug

SEQ ID NO: 485113 - RNA, 19 nt, Homo sapiens
cagagaggcuggaggugaa

SEQ ID NO: 485114 - RNA, 19 nt, Homo sapiens
ugaggauccugcagaauga

SEQ ID NO: 485115 - RNA, 19 nt, Homo sapiens
ggaugcaguccaccuauaa

SEQ ID NO: 485116 - RNA, 19 nt, Homo sapiens
caaacaggacuuaaaugaa

SEQ ID NO: 485117 - RNA, 19 nt, Homo sapiens
aaaccacacugcagaagga

SEQ ID NO: 485118 - RNA, 19 nt, Homo sapiens
guauacagcuguguugcuu

SEQ ID NO: 485119 - RNA, 19 nt, Homo sapiens
gcagggaagacaacagaaa

SEQ ID NO: 485120 - RNA, 19 nt, Homo sapiens
gacaucacaccaaagauuu

SEQ ID NO: 485121 - RNA, 19 nt, Homo sapiens
guaauaaagaggaugaguu

SEQ ID NO: 485122 - RNA, 19 nt, Homo sapiens
gaacgaguaaagccuagaa

SEQ ID NO: 485123 - RNA, 19 nt, Homo sapiens
gaccuacguuucuguauac

SEQ ID NO: 485124 - RNA, 19 nt, Homo sapiens
ucccacaguuguauaaauu

SEQ ID NO: 485125 - RNA, 19 nt, Homo sapiens
acaaagaucauauccaugu

SEQ ID NO: 485126 - RNA, 19 nt, Homo sapiens
ggagaagacacccauaaag

SEQ ID NO: 485127 - RNA, 19 nt, Homo sapiens
aguaaagccuagaaucaaa

SEQ ID NO: 485128 - RNA, 19 nt, Homo sapiens
ugaagaacuuugugaccaa

SEQ ID NO: 485129 - RNA, 19 nt, Homo sapiens
cgagagacacgguggguaa

SEQ ID NO: 485130 - RNA, 19 nt, Homo sapiens
ccaacaaaguacagagaug

SEQ ID NO: 485131 - RNA, 19 nt, Homo sapiens
acacgaugcugcugccaaa

SEQ ID NO: 485132 - RNA, 19 nt, Homo sapiens
caagacaggcugcgaaaca

SEQ ID NO: 485133 - RNA, 19 nt, Homo sapiens
uacugaaacugcuuugaaa

SEQ ID NO: 485134 - RNA, 19 nt, Homo sapiens
gaaacggaccaaugucugu

SEQ ID NO: 485135 - RNA, 19 nt, Homo sapiens
caagaacgaauuuguaucu

SEQ ID NO: 485136 - RNA, 19 nt, Homo sapiens
gagcaacuggacuaucuuu

SEQ ID NO: 485137 - RNA, 19 nt, Homo sapiens
uaauaaagaggaugaguuc

SEQ ID NO: 485138 - RNA, 19 nt, Homo sapiens
agaagacacccauaaagaa

SEQ ID NO: 485139 - RNA, 19 nt, Homo sapiens
ggaacgggcaccaacaaga

SEQ ID NO: 485140 - RNA, 19 nt, Homo sapiens
uguuugagauugcacuuaa

SEQ ID NO: 485141 - RNA, 19 nt, Homo sapiens
aagagaauccgaagaagaa

SEQ ID NO: 485142 - RNA, 19 nt, Homo sapiens
gcucgauacuguuaauuac

SEQ ID NO: 485143 - RNA, 19 nt, Homo sapiens
gaguaaagccuagaaucaa

SEQ ID NO: 485144 - RNA, 19 nt, Homo sapiens
cgaguaaagccuagaauca

SEQ ID NO: 485145 - RNA, 19 nt, Homo sapiens
ggaagagaauccgaagaag

SEQ ID NO: 485146 - RNA, 19 nt, Homo sapiens
cugcuuccauucauuguuu

SEQ ID NO: 485147 - RNA, 19 nt, Homo sapiens
caggacaguuucagugaug

SEQ ID NO: 485148 - RNA, 19 nt, Homo sapiens
aagaucauauccaugugua

SEQ ID NO: 485149 - RNA, 19 nt, Homo sapiens
cuaguuaaauagcacaguu

SEQ ID NO: 485150 - RNA, 19 nt, Homo sapiens
cgccauagcuguucuugag

SEQ ID NO: 485151 - RNA, 19 nt, Homo sapiens
gcaaaggaaagacaagaca

SEQ ID NO: 485152 - RNA, 19 nt, Homo sapiens
cggaugcaguccaccuaua

SEQ ID NO: 485153 - RNA, 19 nt, Homo sapiens
ucagacacauugggacaaa

SEQ ID NO: 485154 - RNA, 19 nt, Homo sapiens
ucuuaaaguugcugucuga

SEQ ID NO: 485155 - RNA, 19 nt, Homo sapiens
gcgcugaacaucuuaaagu

SEQ ID NO: 485156 - RNA, 19 nt, Homo sapiens
ccaguuccaccuuuacuuu

SEQ ID NO: 485157 - RNA, 19 nt, Homo sapiens
gauguuguguuacuguaca

SEQ ID NO: 485158 - RNA, 19 nt, Homo sapiens
ggccaugaaccauuauaaa

SEQ ID NO: 485159 - RNA, 19 nt, Homo sapiens
gcagcagccagaaagcaua

SEQ ID NO: 485160 - RNA, 19 nt, Homo sapiens
gauccuugguuucaaaguc

SEQ ID NO: 485161 - RNA, 19 nt, Homo sapiens
gaggacagcaauuuaaugg

SEQ ID NO: 485162 - RNA, 19 nt, Homo sapiens
caucaccacugcuuucucu

SEQ ID NO: 485163 - RNA, 19 nt, Homo sapiens
gcuaaaagcaccagagaaa

SEQ ID NO: 485164 - RNA, 19 nt, Homo sapiens
ggaggacagcaauuuaaug

SEQ ID NO: 485165 - RNA, 19 nt, Homo sapiens
guacugcuuccauucauug

SEQ ID NO: 485166 - RNA, 19 nt, Homo sapiens
cuauacauauggcucuuga

SEQ ID NO: 485167 - RNA, 19 nt, Homo sapiens
gaucuguauucuuaguuuc

SEQ ID NO: 485168 - RNA, 19 nt, Homo sapiens
gaaaaucaaaugcuuccua

SEQ ID NO: 485169 - RNA, 19 nt, Homo sapiens
cccaacauauauacugaaa

SEQ ID NO: 485170 - RNA, 19 nt, Homo sapiens
gggaaaagcaagaagauuu

SEQ ID NO: 485171 - RNA, 19 nt, Homo sapiens
caaagaucauauccaugug

SEQ ID NO: 485172 - RNA, 19 nt, Homo sapiens
ccacugcuuucucuuccaa

SEQ ID NO: 485173 - RNA, 19 nt, Homo sapiens
guacagcgcugcuaaauuu

SEQ ID NO: 485174 - RNA, 19 nt, Homo sapiens
cuaaugagcuagugucuua

SEQ ID NO: 485175 - RNA, 19 nt, Homo sapiens
gaaaucagguagaccauau

SEQ ID NO: 485176 - RNA, 19 nt, Homo sapiens
gaacaacaguaguuucuca

SEQ ID NO: 485177 - RNA, 19 nt, Homo sapiens
gcaaauuucucucuuucuu

SEQ ID NO: 485178 - RNA, 19 nt, Homo sapiens
aaacuaggcuucuguaauc

SEQ ID NO: 485179 - RNA, 19 nt, Homo sapiens
gcugagagaguauaaauaa

SEQ ID NO: 485180 - RNA, 19 nt, Homo sapiens
aaacucagcugaagugguu

SEQ ID NO: 485181 - RNA, 19 nt, Homo sapiens
cgacuaaccuaucuaugaa

SEQ ID NO: 485182 - RNA, 19 nt, Homo sapiens
caacagauacuauaacaga

SEQ ID NO: 485183 - RNA, 19 nt, Homo sapiens
caccuaagcuuucagugua

SEQ ID NO: 485184 - RNA, 19 nt, Homo sapiens
gcaauacaacuuuaccaua

SEQ ID NO: 485185 - RNA, 19 nt, Homo sapiens
agaguuagcugauaaggaa

SEQ ID NO: 485186 - RNA, 19 nt, Homo sapiens
caaacucgcuuagguagaa

SEQ ID NO: 485187 - RNA, 19 nt, Homo sapiens
cagagaaucuuaaggucua

SEQ ID NO: 485188 - RNA, 19 nt, Homo sapiens
ggugggagacuuuccauua

SEQ ID NO: 485189 - RNA, 19 nt, Homo sapiens
gaguauuccuagcaaauuu

SEQ ID NO: 485190 - RNA, 19 nt, Homo sapiens
ggaauaaacagugagcaua

SEQ ID NO: 485191 - RNA, 19 nt, Homo sapiens
ccacauaaaugcuccuugu

SEQ ID NO: 485192 - RNA, 19 nt, Homo sapiens
acaaguaguucaugaguau

SEQ ID NO: 485193 - RNA, 19 nt, Homo sapiens
gauaaggccuacuauacau

SEQ ID NO: 485194 - RNA, 19 nt, Homo sapiens
ucaccaaacuaguaucauu

SEQ ID NO: 485195 - RNA, 19 nt, Homo sapiens
gaauaaacagugagcauau

SEQ ID NO: 485196 - RNA, 19 nt, Homo sapiens
gacaaguaguucaugagua

SEQ ID NO: 485197 - RNA, 19 nt, Homo sapiens
gaaacuaggcuucuguaau

SEQ ID NO: 485198 - RNA, 19 nt, Homo sapiens
gaagccugcuggaauguga

SEQ ID NO: 485199 - RNA, 19 nt, Homo sapiens
ugacuuagaccuauacuga

SEQ ID NO: 485200 - RNA, 19 nt, Homo sapiens
gugauuugguugcacuuua

SEQ ID NO: 485201 - RNA, 19 nt, Homo sapiens
ggacucugcuuaaacaaag

SEQ ID NO: 485202 - RNA, 19 nt, Homo sapiens
gaagauguggaucccuuua

SEQ ID NO: 485203 - RNA, 19 nt, Homo sapiens
gcuggugguuugaucauuu

SEQ ID NO: 485204 - RNA, 19 nt, Homo sapiens
gugggagacuuuccauuaa

SEQ ID NO: 485205 - RNA, 19 nt, Homo sapiens
gaaaagcauucgucaaaga

SEQ ID NO: 485206 - RNA, 19 nt, Homo sapiens
ccagauauccacauaaaug

SEQ ID NO: 485207 - RNA, 19 nt, Homo sapiens
gagacagccugauggagaa

SEQ ID NO: 485208 - RNA, 19 nt, Homo sapiens
gggcugaccuagaccaguu

SEQ ID NO: 485209 - RNA, 19 nt, Homo sapiens
ucucacauguugcuaguuu

SEQ ID NO: 485210 - RNA, 19 nt, Homo sapiens
aggcuaaacucaagauuug

SEQ ID NO: 485211 - RNA, 19 nt, Homo sapiens
ugacacagaugggauguau

SEQ ID NO: 485212 - RNA, 19 nt, Homo sapiens
gagggcacaucuccagaaa

SEQ ID NO: 485213 - RNA, 19 nt, Homo sapiens
gagcgucacugcccaccaa

SEQ ID NO: 485214 - RNA, 19 nt, Homo sapiens
aaacauugcugccuuuguc

SEQ ID NO: 485215 - RNA, 19 nt, Homo sapiens
guaacgugcugcucaagga

SEQ ID NO: 485216 - RNA, 19 nt, Homo sapiens
caguagaguuagcugauaa

SEQ ID NO: 485217 - RNA, 19 nt, Homo sapiens
caaccucaccaaacuagua

SEQ ID NO: 485218 - RNA, 19 nt, Homo sapiens
gccaugauguuuacaagau

SEQ ID NO: 485219 - RNA, 19 nt, Homo sapiens
ccaguagaguuagcugaua

SEQ ID NO: 485220 - RNA, 19 nt, Homo sapiens
caccaaaggucaaugucaa

SEQ ID NO: 485221 - RNA, 19 nt, Homo sapiens
uaaggccuacuauacauua

SEQ ID NO: 485222 - RNA, 19 nt, Homo sapiens
ugaaagaucucugucacau

SEQ ID NO: 485223 - RNA, 19 nt, Homo sapiens
gcuagugucuuauggucuu

SEQ ID NO: 485224 - RNA, 19 nt, Homo sapiens
uaacauggccagccucuuc

SEQ ID NO: 485225 - RNA, 19 nt, Homo sapiens
ugacagaugcaaguuauuu

SEQ ID NO: 485226 - RNA, 19 nt, Homo sapiens
ggaaaucagguagaccaua

SEQ ID NO: 485227 - RNA, 19 nt, Homo sapiens
ucacuaggcuaaacucaag

SEQ ID NO: 485228 - RNA, 19 nt, Homo sapiens
gggagacuuuccauuaaau

SEQ ID NO: 485229 - RNA, 19 nt, Homo sapiens
uggaauaacuaucucacuu

SEQ ID NO: 485230 - RNA, 19 nt, Homo sapiens
aaacgcacaucccaugaga

SEQ ID NO: 485231 - RNA, 19 nt, Homo sapiens
acagugagcauaucuggua

SEQ ID NO: 485232 - RNA, 19 nt, Homo sapiens
caacuuagcggaaacuucu

SEQ ID NO: 485233 - RNA, 19 nt, Homo sapiens
gucuaacuguggaauauaa

SEQ ID NO: 485234 - RNA, 19 nt, Homo sapiens
acacagaugggauguauga

SEQ ID NO: 485235 - RNA, 19 nt, Homo sapiens
aagcaguucucacauguug

SEQ ID NO: 485236 - RNA, 19 nt, Homo sapiens
uagcaaauuucucucuuuc

SEQ ID NO: 485237 - RNA, 19 nt, Homo sapiens
cuagcaaauuucucucuuu

SEQ ID NO: 485238 - RNA, 19 nt, Homo sapiens
aaaggucaaugucaagaga

SEQ ID NO: 485239 - RNA, 19 nt, Homo sapiens
ggaauaacuaucucacuuc

SEQ ID NO: 485240 - RNA, 19 nt, Homo sapiens
ucgcuuagguagaaacuau

SEQ ID NO: 485241 - RNA, 19 nt, Homo sapiens
gcaugauucuucucuugug

SEQ ID NO: 485242 - RNA, 19 nt, Homo sapiens
gcaaggcugacuucucuga

SEQ ID NO: 485243 - RNA, 19 nt, Homo sapiens
gaacccaacagucccuuau

SEQ ID NO: 485244 - RNA, 19 nt, Homo sapiens
ucaaacgacuaaccuaucu

SEQ ID NO: 485245 - RNA, 19 nt, Homo sapiens
gauguuaaauggaauucgu

SEQ ID NO: 485246 - RNA, 19 nt, Homo sapiens
guaaauccuucuuguacag

SEQ ID NO: 485247 - RNA, 19 nt, Homo sapiens
aaugacagaugcaaguuau

SEQ ID NO: 485248 - RNA, 19 nt, Homo sapiens
uaagcuccaugugcauaua

SEQ ID NO: 485249 - RNA, 19 nt, Homo sapiens
cagggucacuguccuugaa

SEQ ID NO: 485250 - RNA, 19 nt, Homo sapiens
ggaauggaauaacuaucuc

SEQ ID NO: 485251 - RNA, 19 nt, Homo sapiens
ugucacauuugaauucuug

SEQ ID NO: 485252 - RNA, 19 nt, Homo sapiens
gaagacacagucagcacaa

SEQ ID NO: 485253 - RNA, 19 nt, Homo sapiens
cacaaacauugcugccuuu

SEQ ID NO: 485254 - RNA, 19 nt, Homo sapiens
caagauggcgaccaccaaa

SEQ ID NO: 485255 - RNA, 19 nt, Homo sapiens
aaagagagcuuaaaaugca

SEQ ID NO: 485256 - RNA, 19 nt, Homo sapiens
uaaugacagaugcaaguua

SEQ ID NO: 485257 - RNA, 19 nt, Homo sapiens
gcugaguacuggaauaaac

SEQ ID NO: 485258 - RNA, 19 nt, Homo sapiens
ugggagacuuuccauuaaa

SEQ ID NO: 485259 - RNA, 19 nt, Homo sapiens
cugguacucuggcaaauga

SEQ ID NO: 485260 - RNA, 19 nt, Homo sapiens
gaccuauacugaaagaucu

SEQ ID NO: 485261 - RNA, 19 nt, Homo sapiens
aauuaaagaugccauagca

SEQ ID NO: 485262 - RNA, 19 nt, Homo sapiens
aggaagugguaguucuuua

SEQ ID NO: 485263 - RNA, 19 nt, Homo sapiens
uuccagauauccacauaaa

SEQ ID NO: 485264 - RNA, 19 nt, Homo sapiens
cuucuugcaucuaaugaaa

SEQ ID NO: 485265 - RNA, 19 nt, Homo sapiens
uagcugauaaggaaacuuu

SEQ ID NO: 485266 - RNA, 19 nt, Homo sapiens
caaaauccaugugaucauu

SEQ ID NO: 485267 - RNA, 19 nt, Homo sapiens
gaaaauugcaugaaacuag

SEQ ID NO: 485268 - RNA, 19 nt, Homo sapiens
gggaaaagcauucgucaaa

SEQ ID NO: 485269 - RNA, 19 nt, Homo sapiens
gcuauuaaaguuugugugu

SEQ ID NO: 485270 - RNA, 19 nt, Homo sapiens
ccaguaacgugcugcucaa

SEQ ID NO: 485271 - RNA, 19 nt, Homo sapiens
aaagaaagaaagagggaaa

SEQ ID NO: 485272 - RNA, 19 nt, Homo sapiens
acuuagaccuauacugaaa

SEQ ID NO: 485273 - RNA, 19 nt, Homo sapiens
gaugaucucuucccauuua

SEQ ID NO: 485274 - RNA, 19 nt, Homo sapiens
gaagauauauggauacaga

SEQ ID NO: 485275 - RNA, 19 nt, Homo sapiens
guauauagcuacaccuuua

SEQ ID NO: 485276 - RNA, 19 nt, Homo sapiens
ggacaggacuucaaucaga

SEQ ID NO: 485277 - RNA, 19 nt, Homo sapiens
gaaguaacguggaaaucua

SEQ ID NO: 485278 - RNA, 19 nt, Homo sapiens
caaauucaguauccuguua

SEQ ID NO: 485279 - RNA, 19 nt, Homo sapiens
ggacguggccuuucugaua

SEQ ID NO: 485280 - RNA, 19 nt, Homo sapiens
gaauugagcuacuaaaugg

SEQ ID NO: 485281 - RNA, 19 nt, Homo sapiens
ccacaaggcugacgucuuc

SEQ ID NO: 485282 - RNA, 19 nt, Homo sapiens
gcaggcagcucaucucaug

SEQ ID NO: 485283 - RNA, 19 nt, Homo sapiens
gaaagaaggccaccuggaa

SEQ ID NO: 485284 - RNA, 19 nt, Homo sapiens
gaaggaaccucacaguagu

SEQ ID NO: 485285 - RNA, 19 nt, Homo sapiens
gaaugacaguguuggaauu

SEQ ID NO: 485286 - RNA, 19 nt, Homo sapiens
ggagaaaugccaaagauga

SEQ ID NO: 485287 - RNA, 19 nt, Homo sapiens
gaauauagcauggaauuga

SEQ ID NO: 485288 - RNA, 19 nt, Homo sapiens
gagacaagcuguggaaaug

SEQ ID NO: 485289 - RNA, 19 nt, Homo sapiens
gaacuugucugaugaucuc

SEQ ID NO: 485290 - RNA, 19 nt, Homo sapiens
aaaggaaacugagcaaauu

SEQ ID NO: 485291 - RNA, 19 nt, Homo sapiens
aggaaugucuucaaucaua

SEQ ID NO: 485292 - RNA, 19 nt, Homo sapiens
gagcauauucucuaguaua

SEQ ID NO: 485293 - RNA, 19 nt, Homo sapiens
gauuagacgugaccagauu

SEQ ID NO: 485294 - RNA, 19 nt, Homo sapiens
ggagcagaguuguuuguuu

SEQ ID NO: 485295 - RNA, 19 nt, Homo sapiens
gacguggccuuucugauaa

SEQ ID NO: 485296 - RNA, 19 nt, Homo sapiens
gagauugcuucaguacuua

SEQ ID NO: 485297 - RNA, 19 nt, Homo sapiens
uaaaggugauuccagauga

SEQ ID NO: 485298 - RNA, 19 nt, Homo sapiens
gagauccuauucuaacaaa

SEQ ID NO: 485299 - RNA, 19 nt, Homo sapiens
ggaaggaaccucacaguag

SEQ ID NO: 485300 - RNA, 19 nt, Homo sapiens
gcguagagcuggcagauuc

SEQ ID NO: 485301 - RNA, 19 nt, Homo sapiens
ccaagucagugcuuuagaa

SEQ ID NO: 485302 - RNA, 19 nt, Homo sapiens
ggaauugagcuacuaaaug

SEQ ID NO: 485303 - RNA, 19 nt, Homo sapiens
ccauuauucuguuugguua

SEQ ID NO: 485304 - RNA, 19 nt, Homo sapiens
guuaugagauucccaguuc

SEQ ID NO: 485305 - RNA, 19 nt, Homo sapiens
gauugauccuguuugauuu

SEQ ID NO: 485306 - RNA, 19 nt, Homo sapiens
cagcagaauuugaucuaaa

SEQ ID NO: 485307 - RNA, 19 nt, Homo sapiens
cacaauauaugaugccaaa

SEQ ID NO: 485308 - RNA, 19 nt, Homo sapiens
ggacugugauggccagaga

SEQ ID NO: 485309 - RNA, 19 nt, Homo sapiens
gaggaaugcuucguauuau

SEQ ID NO: 485310 - RNA, 19 nt, Homo sapiens
ccagauugauccuguuuga

SEQ ID NO: 485311 - RNA, 19 nt, Homo sapiens
ucacggaaacucuuugaua

SEQ ID NO: 485312 - RNA, 19 nt, Homo sapiens
ucaaaccacugacuuaaca

SEQ ID NO: 485313 - RNA, 19 nt, Homo sapiens
gauaaugcauccugaaagg

SEQ ID NO: 485314 - RNA, 19 nt, Homo sapiens
ggaaugucuucaaucauau

SEQ ID NO: 485315 - RNA, 19 nt, Homo sapiens
uagaaugaauggagaaaug

SEQ ID NO: 485316 - RNA, 19 nt, Homo sapiens
agaggaaugcuucguauua

SEQ ID NO: 485317 - RNA, 19 nt, Homo sapiens
agucagugcuuuagaaauu

SEQ ID NO: 485318 - RNA, 19 nt, Homo sapiens
gcagaggcauaucuuggaa

SEQ ID NO: 485319 - RNA, 19 nt, Homo sapiens
caaauuagaaugacagugu

SEQ ID NO: 485320 - RNA, 19 nt, Homo sapiens
gagcagaguuguuuguuuu

SEQ ID NO: 485321 - RNA, 19 nt, Homo sapiens
uggcaaauagcaucaauua

SEQ ID NO: 485322 - RNA, 19 nt, Homo sapiens
gaaauucccaauaagcauu

SEQ ID NO: 485323 - RNA, 19 nt, Homo sapiens
guggaaaucuaauguggaa

SEQ ID NO: 485324 - RNA, 19 nt, Homo sapiens
ccauaugcacuuaacauua

SEQ ID NO: 485325 - RNA, 19 nt, Homo sapiens
ggaaauggcagaggcauau

SEQ ID NO: 485326 - RNA, 19 nt, Homo sapiens
cgacuauuguugaaguuaa

SEQ ID NO: 485327 - RNA, 19 nt, Homo sapiens
agcauaagcugcauacgua

SEQ ID NO: 485328 - RNA, 19 nt, Homo sapiens
uaucacagauuuaccuaga

SEQ ID NO: 485329 - RNA, 19 nt, Homo sapiens
cuagaugugucuuuacuga

SEQ ID NO: 485330 - RNA, 19 nt, Homo sapiens
cauguucucuuggacuuua

SEQ ID NO: 485331 - RNA, 19 nt, Homo sapiens
ccacagggaccaagaaaga

SEQ ID NO: 485332 - RNA, 19 nt, Homo sapiens
gcacaacaguauuuaccau

SEQ ID NO: 485333 - RNA, 19 nt, Homo sapiens
gaugugucuuuacugaaua

SEQ ID NO: 485334 - RNA, 19 nt, Homo sapiens
guccugaaguuggaauuua

SEQ ID NO: 485335 - RNA, 19 nt, Homo sapiens
guagguagauagaaaagua

SEQ ID NO: 485336 - RNA, 19 nt, Homo sapiens
caagaccuuugcaaacauu

SEQ ID NO: 485337 - RNA, 19 nt, Homo sapiens
gguaauugcauuugaagaa

SEQ ID NO: 485338 - RNA, 19 nt, Homo sapiens
uauguuggcucucgacuau

SEQ ID NO: 485339 - RNA, 19 nt, Homo sapiens
acagauuguuccucuuaua

SEQ ID NO: 485340 - RNA, 19 nt, Homo sapiens
gggaauauagcauggaauu

SEQ ID NO: 485341 - RNA, 19 nt, Homo sapiens
agagauugcuucaguacuu

SEQ ID NO: 485342 - RNA, 19 nt, Homo sapiens
gcagauacccauuuaaggu

SEQ ID NO: 485343 - RNA, 19 nt, Homo sapiens
ugacaaugauguauaugug

SEQ ID NO: 485344 - RNA, 19 nt, Homo sapiens
caucucauguccugaaguu

SEQ ID NO: 485345 - RNA, 19 nt, Homo sapiens
gaaacugagcaaauucauu

SEQ ID NO: 485346 - RNA, 19 nt, Homo sapiens
uaaaguaucucugcuucau

SEQ ID NO: 485347 - RNA, 19 nt, Homo sapiens
ggauuuccauuauucuguu

SEQ ID NO: 485348 - RNA, 19 nt, Homo sapiens
gaaaagaucccaacacauc

SEQ ID NO: 485349 - RNA, 19 nt, Homo sapiens
gagaaaugccaaagaugaa

SEQ ID NO: 485350 - RNA, 19 nt, Homo sapiens
gcaaauagcaucaauuacc

SEQ ID NO: 485351 - RNA, 19 nt, Homo sapiens
ugaagaauguguuaauguc

SEQ ID NO: 485352 - RNA, 19 nt, Homo sapiens
gaaggaccguguugauguc

SEQ ID NO: 485353 - RNA, 19 nt, Homo sapiens
gagagauccuauucuaaca

SEQ ID NO: 485354 - RNA, 19 nt, Homo sapiens
gaaagaggaaauccacaga

SEQ ID NO: 485355 - RNA, 19 nt, Homo sapiens
caaggagggauguuucuaa

SEQ ID NO: 485356 - RNA, 19 nt, Homo sapiens
guggcaagguuucuacaaa

SEQ ID NO: 485357 - RNA, 19 nt, Homo sapiens
gcauggaauugagcuacua

SEQ ID NO: 485358 - RNA, 19 nt, Homo sapiens
cauaauaaagccaugauug

SEQ ID NO: 485359 - RNA, 19 nt, Homo sapiens
guaaugagaccaucacagu

SEQ ID NO: 485360 - RNA, 19 nt, Homo sapiens
gaauaacaaucugaagucu

SEQ ID NO: 485361 - RNA, 19 nt, Homo sapiens
gaauuuggaggcaguaguu

SEQ ID NO: 485362 - RNA, 19 nt, Homo sapiens
ucgauaggauguugaaaug

SEQ ID NO: 485363 - RNA, 19 nt, Homo sapiens
aggaaaaugugcucaauua

SEQ ID NO: 485364 - RNA, 19 nt, Homo sapiens
gaucuuggcaccaccuauu

SEQ ID NO: 485365 - RNA, 19 nt, Homo sapiens
ccuguuaagugucauauuc

SEQ ID NO: 485366 - RNA, 19 nt, Homo sapiens
uuacagugguuggaagaua

SEQ ID NO: 485367 - RNA, 19 nt, Homo sapiens
ggagagauccuauucuaac

SEQ ID NO: 485368 - RNA, 19 nt, Homo sapiens
ucaucaaucugcucaguug

SEQ ID NO: 485369 - RNA, 19 nt, Homo sapiens
cuaaagugauugguauuga

SEQ ID NO: 485370 - RNA, 19 nt, Homo sapiens
gauaggauguugaaaugcu

SEQ ID NO: 485371 - RNA, 19 nt, Homo sapiens
aaucacacuuggacucuuu

SEQ ID NO: 485372 - RNA, 19 nt, Homo sapiens
cugaugaucucuucccauu

SEQ ID NO: 485373 - RNA, 19 nt, Homo sapiens
gagaugaggucuuauuaua

SEQ ID NO: 485374 - RNA, 19 nt, Homo sapiens
gaaggucuuucuuuacuua

SEQ ID NO: 485375 - RNA, 19 nt, Homo sapiens
ggaaaaggauuguaagaua

SEQ ID NO: 485376 - RNA, 19 nt, Homo sapiens
ggauguggcuguuuccuuu

SEQ ID NO: 485377 - RNA, 19 nt, Homo sapiens
ccaaguagcugcaacaaca

SEQ ID NO: 485378 - RNA, 19 nt, Homo sapiens
gaaggaaucuacacugaag

SEQ ID NO: 485379 - RNA, 19 nt, Homo sapiens
uaaagagggugauguggaa

SEQ ID NO: 485380 - RNA, 19 nt, Homo sapiens
ggaaugauguaguaacaca

SEQ ID NO: 485381 - RNA, 19 nt, Homo sapiens
gcacaacuauaaccuaugg

SEQ ID NO: 485382 - RNA, 19 nt, Homo sapiens
ccaccaugcucaacuaauu

SEQ ID NO: 485383 - RNA, 19 nt, Homo sapiens
caaaggauguggcuguuuc

SEQ ID NO: 485384 - RNA, 19 nt, Homo sapiens
cagguaacauguuuauuga

SEQ ID NO: 485385 - RNA, 19 nt, Homo sapiens
gaaagaggauaucagaaaa

SEQ ID NO: 485386 - RNA, 19 nt, Homo sapiens
ugaaagaggauaucagaaa

SEQ ID NO: 485387 - RNA, 19 nt, Homo sapiens
guaccacaaugaauucuga

SEQ ID NO: 485388 - RNA, 19 nt, Homo sapiens
gaaauugucgcccuucaug

SEQ ID NO: 485389 - RNA, 19 nt, Homo sapiens
gggaaagaguccacgugua

SEQ ID NO: 485390 - RNA, 19 nt, Homo sapiens
gugcaaagaagauguaauu

SEQ ID NO: 485391 - RNA, 19 nt, Homo sapiens
caucucagccucccaagua

SEQ ID NO: 485392 - RNA, 19 nt, Homo sapiens
ccagguaacauguuuauug

SEQ ID NO: 485393 - RNA, 19 nt, Homo sapiens
gaaaagacauaaucaugga

SEQ ID NO: 485394 - RNA, 19 nt, Homo sapiens
gaacaauccauccacaaau

SEQ ID NO: 485395 - RNA, 19 nt, Homo sapiens
ggcucaagcuucccaagua

SEQ ID NO: 485396 - RNA, 19 nt, Homo sapiens
gauguaguaacacagauua

SEQ ID NO: 485397 - RNA, 19 nt, Homo sapiens
ggaaagaguccacguguac

SEQ ID NO: 485398 - RNA, 19 nt, Homo sapiens
ccacguguacuauuucuuu

SEQ ID NO: 485399 - RNA, 19 nt, Homo sapiens
gaguccacguguacuauuu

SEQ ID NO: 485400 - RNA, 19 nt, Homo sapiens
uccaagagaugaagaacaa

SEQ ID NO: 485401 - RNA, 19 nt, Homo sapiens
guagagaugaggucuuauu

SEQ ID NO: 485402 - RNA, 19 nt, Homo sapiens
aacaauccauccacaaauu

SEQ ID NO: 485403 - RNA, 19 nt, Homo sapiens
cagaguuuguggagaaauu

SEQ ID NO: 485404 - RNA, 19 nt, Homo sapiens
gaauugugaagacucauuu

SEQ ID NO: 485405 - RNA, 19 nt, Homo sapiens
cacaaugaauucugaacuu

SEQ ID NO: 485406 - RNA, 19 nt, Homo sapiens
ggacagguuccuuaugguu

SEQ ID NO: 485407 - RNA, 19 nt, Homo sapiens
cuaugggaaugauguagua

SEQ ID NO: 485408 - RNA, 19 nt, Homo sapiens
aaccauguuuggcuaauuu

SEQ ID NO: 485409 - RNA, 19 nt, Homo sapiens
ggaggacaguggcacaauc

SEQ ID NO: 485410 - RNA, 19 nt, Homo sapiens
gacaggauuauacaucaua

SEQ ID NO: 485411 - RNA, 19 nt, Homo sapiens
guacaugcauaugagaaau

SEQ ID NO: 485412 - RNA, 19 nt, Homo sapiens
gagcuguacaugcauauga

SEQ ID NO: 485413 - RNA, 19 nt, Homo sapiens
guaguaacacagauuauuc

SEQ ID NO: 485414 - RNA, 19 nt, Homo sapiens
uagagaugaggucuuauua

SEQ ID NO: 485415 - RNA, 19 nt, Homo sapiens
ggacaggauuauacaucau

SEQ ID NO: 485416 - RNA, 19 nt, Homo sapiens
gagcuuguggacaggauua

SEQ ID NO: 485417 - RNA, 19 nt, Homo sapiens
gaaaagaaaaccucaugaa

SEQ ID NO: 485418 - RNA, 19 nt, Homo sapiens
gaagaaguccaugggauuc

SEQ ID NO: 485419 - RNA, 19 nt, Homo sapiens
acaaugaauucugaacuug

SEQ ID NO: 485420 - RNA, 19 nt, Homo sapiens
gcucaagcuucccaaguag

SEQ ID NO: 485421 - RNA, 19 nt, Homo sapiens
caaccauguuuggcuaauu

SEQ ID NO: 485422 - RNA, 19 nt, Homo sapiens
uccaugggauucuaaugua

SEQ ID NO: 485423 - RNA, 19 nt, Homo sapiens
uuguagagaugaggucuua

SEQ ID NO: 485424 - RNA, 19 nt, Homo sapiens
ggacaguggcacaaucaug

SEQ ID NO: 485425 - RNA, 19 nt, Homo sapiens
acaauccauccacaaauua

SEQ ID NO: 485426 - RNA, 19 nt, Homo sapiens
uuccuacuaucaucucuua

SEQ ID NO: 485427 - RNA, 19 nt, Homo sapiens
acaccaccaugcucaacua

SEQ ID NO: 485428 - RNA, 19 nt, Homo sapiens
gcaaaugaaggaaucuaca

SEQ ID NO: 485429 - RNA, 19 nt, Homo sapiens
uaaacaguguaccacaaug

SEQ ID NO: 485430 - RNA, 19 nt, Homo sapiens
ugaagaaguccaugggauu

SEQ ID NO: 485431 - RNA, 19 nt, Homo sapiens
gaaguccaugggauucuaa

SEQ ID NO: 485432 - RNA, 19 nt, Homo sapiens
gcaaaggauguggcuguuu

SEQ ID NO: 485433 - RNA, 19 nt, Homo sapiens
uuauugagcuguacaugca

SEQ ID NO: 485434 - RNA, 19 nt, Homo sapiens
guuucgaacugagaucuaa

SEQ ID NO: 485435 - RNA, 19 nt, Homo sapiens
gaaucuacacugaaguuuc

SEQ ID NO: 485436 - RNA, 19 nt, Homo sapiens
ccuuaugguuccugguaua

SEQ ID NO: 485437 - RNA, 19 nt, Homo sapiens
aaacaguguaccacaauga

SEQ ID NO: 485438 - RNA, 19 nt, Homo sapiens
gcaaccauguuuggcuaau

SEQ ID NO: 485439 - RNA, 19 nt, Homo sapiens
ggucuuucuuuacuuaaca

SEQ ID NO: 485440 - RNA, 19 nt, Homo sapiens
caugggauucuaauguaua

SEQ ID NO: 485441 - RNA, 19 nt, Homo sapiens
caaugaauucugaacuuga

SEQ ID NO: 485442 - RNA, 19 nt, Homo sapiens
ccaugggauucuaauguau

SEQ ID NO: 485443 - RNA, 19 nt, Homo sapiens
agaacaauccauccacaaa

SEQ ID NO: 485444 - RNA, 19 nt, Homo sapiens
cuagaauugugaagacuca

SEQ ID NO: 485445 - RNA, 19 nt, Homo sapiens
acaccagccucccaaaaua

SEQ ID NO: 485446 - RNA, 19 nt, Homo sapiens
ggaaucuacacugaaguuu

SEQ ID NO: 485447 - RNA, 19 nt, Homo sapiens
acaguagcccugaaugaaa

SEQ ID NO: 485448 - RNA, 19 nt, Homo sapiens
cagacgaaauuaugaacca

SEQ ID NO: 485449 - RNA, 19 nt, Homo sapiens
caacacugccagacgaaau

SEQ ID NO: 485450 - RNA, 19 nt, Homo sapiens
ccuacuaucaucucuuaaa

SEQ ID NO: 485451 - RNA, 19 nt, Homo sapiens
gaggacaguggcacaauca

SEQ ID NO: 485452 - RNA, 19 nt, Homo sapiens
augaaggaaucuacacuga

SEQ ID NO: 485453 - RNA, 19 nt, Homo sapiens
caagagaugaagaacaauc

SEQ ID NO: 485454 - RNA, 19 nt, Homo sapiens
uggacaggauuauacauca

SEQ ID NO: 485455 - RNA, 19 nt, Homo sapiens
aaagaguccacguguacua

SEQ ID NO: 485456 - RNA, 19 nt, Homo sapiens
ccucaugaauggaguaaaa

SEQ ID NO: 485457 - RNA, 19 nt, Homo sapiens
aagaaaaccucaugaaugg

SEQ ID NO: 485458 - RNA, 19 nt, Homo sapiens
cuacagacaugugcaacca

SEQ ID NO: 485459 - RNA, 19 nt, Homo sapiens
gagcagcaaaugaaggaau

SEQ ID NO: 485460 - RNA, 19 nt, Homo sapiens
cagaaauugucgcccuuca

SEQ ID NO: 485461 - RNA, 19 nt, Homo sapiens
aaagugcaaagaagaugua

SEQ ID NO: 485462 - RNA, 19 nt, Homo sapiens
uaaccuaugggaaugaugu

SEQ ID NO: 485463 - RNA, 19 nt, Homo sapiens
acuaaacaguguaccacaa

SEQ ID NO: 485464 - RNA, 19 nt, Homo sapiens
uggcccagguaacauguuu

SEQ ID NO: 485465 - RNA, 19 nt, Homo sapiens
ggauuauacaucauacuuc

SEQ ID NO: 485466 - RNA, 19 nt, Homo sapiens
caguguaccacaaugaauu

SEQ ID NO: 485467 - RNA, 19 nt, Homo sapiens
ggagaaauucaugcaagga

SEQ ID NO: 485468 - RNA, 19 nt, Homo sapiens
ugggaaugauguaguaaca

SEQ ID NO: 485469 - RNA, 19 nt, Homo sapiens
gaauucugaacuugacuau

SEQ ID NO: 485470 - RNA, 19 nt, Homo sapiens
uuacaguagcccugaauga

SEQ ID NO: 485471 - RNA, 19 nt, Homo sapiens
aaagaaaaccucaugaaug

SEQ ID NO: 485472 - RNA, 19 nt, Homo sapiens
caccaugcucaacuaauuu

SEQ ID NO: 485473 - RNA, 19 nt, Homo sapiens
gcaaucagcuucauauuuc

SEQ ID NO: 485474 - RNA, 19 nt, Homo sapiens
gaaacggucuuuaugaauu

SEQ ID NO: 485475 - RNA, 19 nt, Homo sapiens
gcaaagggauuacuagaga

SEQ ID NO: 485476 - RNA, 19 nt, Homo sapiens
ugaaacaacucaugucuuu

SEQ ID NO: 485477 - RNA, 19 nt, Homo sapiens
ggaaagaauuuguaucaug

SEQ ID NO: 485478 - RNA, 19 nt, Homo sapiens
gcccauggauucagaaaua

SEQ ID NO: 485479 - RNA, 19 nt, Homo sapiens
caaggagucuucuaaugua

SEQ ID NO: 485480 - RNA, 19 nt, Homo sapiens
cuaaaggaguugaguauuu

SEQ ID NO: 485481 - RNA, 19 nt, Homo sapiens
ugucaaagcugcaugugua

SEQ ID NO: 485482 - RNA, 19 nt, Homo sapiens
gugaacaacuggaaauaaa

SEQ ID NO: 485483 - RNA, 19 nt, Homo sapiens
gaacugggccuuaacuguu

SEQ ID NO: 485484 - RNA, 19 nt, Homo sapiens
acacggcacugucucuuua

SEQ ID NO: 485485 - RNA, 19 nt, Homo sapiens
ccaaagcaaucauuaagug

SEQ ID NO: 485486 - RNA, 19 nt, Homo sapiens
agacaaaugugcucuaugu

SEQ ID NO: 485487 - RNA, 19 nt, Homo sapiens
gcaauauucuugacuccuu

SEQ ID NO: 485488 - RNA, 19 nt, Homo sapiens
caacucaugucuuuauuag

SEQ ID NO: 485489 - RNA, 19 nt, Homo sapiens
cagaaacggucuuuaugaa

SEQ ID NO: 485490 - RNA, 19 nt, Homo sapiens
ucaaaucucuccaccucua

SEQ ID NO: 485491 - RNA, 19 nt, Homo sapiens
agaaauaucuuugguggaa

SEQ ID NO: 485492 - RNA, 19 nt, Homo sapiens
uaaaggaguugaguauuug

SEQ ID NO: 485493 - RNA, 19 nt, Homo sapiens
gaucauauaaugcgggaua

SEQ ID NO: 485494 - RNA, 19 nt, Homo sapiens
uaucuuaucuacugacuga

SEQ ID NO: 485495 - RNA, 19 nt, Homo sapiens
ggugguacuuuguaucuaa

SEQ ID NO: 485496 - RNA, 19 nt, Homo sapiens
gaaauauaccuaccucuuc

SEQ ID NO: 485497 - RNA, 19 nt, Homo sapiens
ggaaauaaaguaggaaaga

SEQ ID NO: 485498 - RNA, 19 nt, Homo sapiens
gaauugcaguaaagucuug

SEQ ID NO: 485499 - RNA, 19 nt, Homo sapiens
acaaauagcauacaccaaa

SEQ ID NO: 485500 - RNA, 19 nt, Homo sapiens
caaccaaguuucuuuccuu

SEQ ID NO: 485501 - RNA, 19 nt, Homo sapiens
ggaaauauaccuaccucuu

SEQ ID NO: 485502 - RNA, 19 nt, Homo sapiens
ggacauacaaagagccuaa

SEQ ID NO: 485503 - RNA, 19 nt, Homo sapiens
gcugaucucuguagaaucu

SEQ ID NO: 485504 - RNA, 19 nt, Homo sapiens
cacuuaaacuugcacauuu

SEQ ID NO: 485505 - RNA, 19 nt, Homo sapiens
uagcauacaccaaacauuu

SEQ ID NO: 485506 - RNA, 19 nt, Homo sapiens
aaucagugguguuacauuu

SEQ ID NO: 485507 - RNA, 19 nt, Homo sapiens
ccaguugucuaaaggauga

SEQ ID NO: 485508 - RNA, 19 nt, Homo sapiens
cuuagaggcuugaugauga

SEQ ID NO: 485509 - RNA, 19 nt, Homo sapiens
aaacuauccuucucuuuca

SEQ ID NO: 485510 - RNA, 19 nt, Homo sapiens
uaucaggcuuuccuuguuu

SEQ ID NO: 485511 - RNA, 19 nt, Homo sapiens
agaaagaauugcaguaaag

SEQ ID NO: 485512 - RNA, 19 nt, Homo sapiens
ucacagaaacggucuuuau

SEQ ID NO: 485513 - RNA, 19 nt, Homo sapiens
gaacaacuggaaauaaagu

SEQ ID NO: 485514 - RNA, 19 nt, Homo sapiens
caccaaacauuucugugaa

SEQ ID NO: 485515 - RNA, 19 nt, Homo sapiens
ugaaaucagugguguuaca

SEQ ID NO: 485516 - RNA, 19 nt, Homo sapiens
gaaauaucuuugguggaaa

SEQ ID NO: 485517 - RNA, 19 nt, Homo sapiens
agucagaacuauaacauuc

SEQ ID NO: 485518 - RNA, 19 nt, Homo sapiens
ugacuaaguugcaagaucu

SEQ ID NO: 485519 - RNA, 19 nt, Homo sapiens
ggagucuucuaauguaaau

SEQ ID NO: 485520 - RNA, 19 nt, Homo sapiens
gaaacaacucaugucuuua

SEQ ID NO: 485521 - RNA, 19 nt, Homo sapiens
aaauugaacugggccuuaa

SEQ ID NO: 485522 - RNA, 19 nt, Homo sapiens
caaagggauuacuagagaa

SEQ ID NO: 485523 - RNA, 19 nt, Homo sapiens
uagacugaguaaaguguua

SEQ ID NO: 485524 - RNA, 19 nt, Homo sapiens
caaauggugugagcaaauc

SEQ ID NO: 485525 - RNA, 19 nt, Homo sapiens
gaucuaagaggauucaaca

SEQ ID NO: 485526 - RNA, 19 nt, Homo sapiens
gcaaauggugugagcaaau

SEQ ID NO: 485527 - RNA, 19 nt, Homo sapiens
gcauuuggcccauggauuc

SEQ ID NO: 485528 - RNA, 19 nt, Homo sapiens
ucaaggagucuucuaaugu

SEQ ID NO: 485529 - RNA, 19 nt, Homo sapiens
gcagauaagcguguggaaa

SEQ ID NO: 485530 - RNA, 19 nt, Homo sapiens
aaagacaaaugugcucuau

SEQ ID NO: 485531 - RNA, 19 nt, Homo sapiens
aacgauaccugacuauguu

SEQ ID NO: 485532 - RNA, 19 nt, Homo sapiens
gccagaguguggauuauuc

SEQ ID NO: 485533 - RNA, 19 nt, Homo sapiens
cuaaguauaagcacucuuu

SEQ ID NO: 485534 - RNA, 19 nt, Homo sapiens
uaaauugaacugggccuua

SEQ ID NO: 485535 - RNA, 19 nt, Homo sapiens
auacaaagagccuaagaaa

SEQ ID NO: 485536 - RNA, 19 nt, Homo sapiens
uaagaggauucaacaccuu

SEQ ID NO: 485537 - RNA, 19 nt, Homo sapiens
ggugugagcaaaucagaaa

SEQ ID NO: 485538 - RNA, 19 nt, Homo sapiens
gcucuguggugguacuuug

SEQ ID NO: 485539 - RNA, 19 nt, Homo sapiens
acagaaacggucuuuauga

SEQ ID NO: 485540 - RNA, 19 nt, Homo sapiens
gaccaaagcaaucauuaag

SEQ ID NO: 485541 - RNA, 19 nt, Homo sapiens
ugaauuccuuuauccaugu

SEQ ID NO: 485542 - RNA, 19 nt, Homo sapiens
ccaguugaauuccuuuauc

SEQ ID NO: 485543 - RNA, 19 nt, Homo sapiens
caacgacacgguagaguuc

SEQ ID NO: 485544 - RNA, 19 nt, Homo sapiens
uggaaacgauaccugacua

SEQ ID NO: 485545 - RNA, 19 nt, Homo sapiens
ugaacauucuguacugguu

SEQ ID NO: 485546 - RNA, 19 nt, Homo sapiens
gaaagaauugcaguaaagu

SEQ ID NO: 485547 - RNA, 19 nt, Homo sapiens
ugaucucuguagaaucuua

SEQ ID NO: 485548 - RNA, 19 nt, Homo sapiens
gcacauuugaauucauuug

SEQ ID NO: 485549 - RNA, 19 nt, Homo sapiens
gagcccaguugaauuccuu

SEQ ID NO: 485550 - RNA, 19 nt, Homo sapiens
guacgauguuuaccuugug

SEQ ID NO: 485551 - RNA, 19 nt, Homo sapiens
guaaugacugagauuugua

SEQ ID NO: 485552 - RNA, 19 nt, Homo sapiens
caaauagcauacaccaaac

SEQ ID NO: 485553 - RNA, 19 nt, Homo sapiens
caaagcaaucauuaaguga

SEQ ID NO: 485554 - RNA, 19 nt, Homo sapiens
gcaaaaggagauuaaauug

SEQ ID NO: 485555 - RNA, 19 nt, Homo sapiens
ccaaguuucuuuccuucau

SEQ ID NO: 485556 - RNA, 19 nt, Homo sapiens
gugaaacuauccuucucuu

SEQ ID NO: 485557 - RNA, 19 nt, Homo sapiens
gcauuugaauacuccuguu

SEQ ID NO: 485558 - RNA, 19 nt, Homo sapiens
ccagagaucaccaugacuu

SEQ ID NO: 485559 - RNA, 19 nt, Homo sapiens
gaucacagaaacggucuuu

SEQ ID NO: 485560 - RNA, 19 nt, Homo sapiens
gaaacgauaccugacuaug

SEQ ID NO: 485561 - RNA, 19 nt, Homo sapiens
uguaaugacugagauuugu

SEQ ID NO: 485562 - RNA, 19 nt, Homo sapiens
uaggauguaugcuguuugu

SEQ ID NO: 485563 - RNA, 19 nt, Homo sapiens
ccuguuaguagcagaaaua

SEQ ID NO: 485564 - RNA, 19 nt, Homo sapiens
ccugguccaucgcagauaa

SEQ ID NO: 485565 - RNA, 19 nt, Homo sapiens
ucaauuccaugugaccauu

SEQ ID NO: 485566 - RNA, 19 nt, Homo sapiens
cugauucaauuccauguga

SEQ ID NO: 485567 - RNA, 19 nt, Homo sapiens
gcaacugauucaauuccau

SEQ ID NO: 485568 - RNA, 19 nt, Homo sapiens
caaguuucuuuccuucaug

SEQ ID NO: 485569 - RNA, 19 nt, Homo sapiens
acaccaaacauuucuguga

SEQ ID NO: 485570 - RNA, 19 nt, Homo sapiens
ggccuuaacuguuguugac

SEQ ID NO: 485571 - RNA, 19 nt, Homo sapiens
cacugucucuuuacacuga

SEQ ID NO: 485572 - RNA, 19 nt, Homo sapiens
aaacgauaccugacuaugu

SEQ ID NO: 485573 - RNA, 19 nt, Homo sapiens
ggaagaaagugaugaguuc

SEQ ID NO: 485574 - RNA, 19 nt, Homo sapiens
gaagaaguuuccucucaaa

SEQ ID NO: 485575 - RNA, 19 nt, Homo sapiens
caucagaaguauacaauug

SEQ ID NO: 485576 - RNA, 19 nt, Homo sapiens
ugaagaagaugaugaagga

SEQ ID NO: 485577 - RNA, 19 nt, Homo sapiens
gggcaaggaugcugucauu

SEQ ID NO: 485578 - RNA, 19 nt, Homo sapiens
ggccuaaucuuugaaguuu

SEQ ID NO: 485579 - RNA, 19 nt, Homo sapiens
gagguuugguuucuuguuu

SEQ ID NO: 485580 - RNA, 19 nt, Homo sapiens
uacaguggcugaucacaua

SEQ ID NO: 485581 - RNA, 19 nt, Homo sapiens
agaagccucuuaagaagua

SEQ ID NO: 485582 - RNA, 19 nt, Homo sapiens
gggaagaccucaauuacca

SEQ ID NO: 485583 - RNA, 19 nt, Homo sapiens
gaaguuuguucuuugguau

SEQ ID NO: 485584 - RNA, 19 nt, Homo sapiens
agaaggagcuagaaucuca

SEQ ID NO: 485585 - RNA, 19 nt, Homo sapiens
ccaaggagcacaugaagaa

SEQ ID NO: 485586 - RNA, 19 nt, Homo sapiens
uaaggaagaugguauaggu

SEQ ID NO: 485587 - RNA, 19 nt, Homo sapiens
ggccagagccucagccaua

SEQ ID NO: 485588 - RNA, 19 nt, Homo sapiens
ggagaggcaucuguucauu

SEQ ID NO: 485589 - RNA, 19 nt, Homo sapiens
ugacauggaugaggagauu

SEQ ID NO: 485590 - RNA, 19 nt, Homo sapiens
gagaacaacccaccagaga

SEQ ID NO: 485591 - RNA, 19 nt, Homo sapiens
ccacagcucuucccuggau

SEQ ID NO: 485592 - RNA, 19 nt, Homo sapiens
agguggaggugcaauauua

SEQ ID NO: 485593 - RNA, 19 nt, Homo sapiens
ccagaacuguagguuauaa

SEQ ID NO: 485594 - RNA, 19 nt, Homo sapiens
gcucuucccuggaugaugu

SEQ ID NO: 485595 - RNA, 19 nt, Homo sapiens
ugaaguuuguucuuuggua

SEQ ID NO: 485596 - RNA, 19 nt, Homo sapiens
ggagugaaaccaauucuca

SEQ ID NO: 485597 - RNA, 19 nt, Homo sapiens
gaagucaucagaaguauac

SEQ ID NO: 485598 - RNA, 19 nt, Homo sapiens
uaaagcauguaggagauuu

SEQ ID NO: 485599 - RNA, 19 nt, Homo sapiens
ggaagaugguauaggugaa

SEQ ID NO: 485600 - RNA, 19 nt, Homo sapiens
gcaggaggauuugucucua

SEQ ID NO: 485601 - RNA, 19 nt, Homo sapiens
acgaguagcuucugacaug

SEQ ID NO: 485602 - RNA, 19 nt, Homo sapiens
gaaguccaauaaagcaugu

SEQ ID NO: 485603 - RNA, 19 nt, Homo sapiens
caggaggauuugucucuaa

SEQ ID NO: 485604 - RNA, 19 nt, Homo sapiens
cuuggguccuucauuauua

SEQ ID NO: 485605 - RNA, 19 nt, Homo sapiens
gguggugucuaucguuauu

SEQ ID NO: 485606 - RNA, 19 nt, Homo sapiens
ggaggauaauggcucuauu

SEQ ID NO: 485607 - RNA, 19 nt, Homo sapiens
gcauggaagucaucagaag

SEQ ID NO: 485608 - RNA, 19 nt, Homo sapiens
cgacguggaugacauggau

SEQ ID NO: 485609 - RNA, 19 nt, Homo sapiens
ucucacagcucaugguaug

SEQ ID NO: 485610 - RNA, 19 nt, Homo sapiens
ggacugugcugaagaugac

SEQ ID NO: 485611 - RNA, 19 nt, Homo sapiens
gauggacgaugaugccaau

SEQ ID NO: 485612 - RNA, 19 nt, Homo sapiens
guuauaaggcagucacuuu

SEQ ID NO: 485613 - RNA, 19 nt, Homo sapiens
gaagauaggacgaguagcu

SEQ ID NO: 485614 - RNA, 19 nt, Homo sapiens
gaggauaauggcucuauug

SEQ ID NO: 485615 - RNA, 19 nt, Homo sapiens
gaugagaucaaccuugcua

SEQ ID NO: 485616 - RNA, 19 nt, Homo sapiens
gaccguggaugagguggua

SEQ ID NO: 485617 - RNA, 19 nt, Homo sapiens
ugaaggcucuggauacagu

SEQ ID NO: 485618 - RNA, 19 nt, Homo sapiens
ugccagaacuguagguuau

SEQ ID NO: 485619 - RNA, 19 nt, Homo sapiens
ggaagucaucagaaguaua

SEQ ID NO: 485620 - RNA, 19 nt, Homo sapiens
acaaacugauggacgauga

SEQ ID NO: 485621 - RNA, 19 nt, Homo sapiens
gagagccacagccaugaua

SEQ ID NO: 485622 - RNA, 19 nt, Homo sapiens
gaacaacccaccagagacu

SEQ ID NO: 485623 - RNA, 19 nt, Homo sapiens
ggacgaugaugccaauggu

SEQ ID NO: 485624 - RNA, 19 nt, Homo sapiens
gaccuagagucauggaugu

SEQ ID NO: 485625 - RNA, 19 nt, Homo sapiens
gcaaggaugcugucauuuu

SEQ ID NO: 485626 - RNA, 19 nt, Homo sapiens
ugacaugugugccucagau

SEQ ID NO: 485627 - RNA, 19 nt, Homo sapiens
ccaccuggcuggcaagaag

SEQ ID NO: 485628 - RNA, 19 nt, Homo sapiens
ggcugcagcugacacauga

SEQ ID NO: 485629 - RNA, 19 nt, Homo sapiens
gcugaaggcucuggauaca

SEQ ID NO: 485630 - RNA, 19 nt, Homo sapiens
ucaaugccaugacuuccaa

SEQ ID NO: 485631 - RNA, 19 nt, Homo sapiens
ugcuauggcuguaaaggua

SEQ ID NO: 485632 - RNA, 19 nt, Homo sapiens
agacaacucucucccuuac

SEQ ID NO: 485633 - RNA, 19 nt, Homo sapiens
ggugaaggcggcuguguga

SEQ ID NO: 485634 - RNA, 19 nt, Homo sapiens
gaaguuuccucucaaaauc

SEQ ID NO: 485635 - RNA, 19 nt, Homo sapiens
gacacaccaucuccaguug

SEQ ID NO: 485636 - RNA, 19 nt, Homo sapiens
gggaggguacugagaauga

SEQ ID NO: 485637 - RNA, 19 nt, Homo sapiens
aaaagaagcugcgcgauga

SEQ ID NO: 485638 - RNA, 19 nt, Homo sapiens
ccacacugcaggaggauuu

SEQ ID NO: 485639 - RNA, 19 nt, Homo sapiens
ggugcaauauuacaacauc

SEQ ID NO: 485640 - RNA, 19 nt, Homo sapiens
gcugcugguuugccuauau

SEQ ID NO: 485641 - RNA, 19 nt, Homo sapiens
agacgcauguugacugaga

SEQ ID NO: 485642 - RNA, 19 nt, Homo sapiens
caaaugggguuuucugugu

SEQ ID NO: 485643 - RNA, 19 nt, Homo sapiens
gcacaguggagguggagaa

SEQ ID NO: 485644 - RNA, 19 nt, Homo sapiens
gcggcugugugaccacuuu

SEQ ID NO: 485645 - RNA, 19 nt, Homo sapiens
guauugaugugggucagaa

SEQ ID NO: 485646 - RNA, 19 nt, Homo sapiens
ccuaaucuuugaaguuugu

SEQ ID NO: 485647 - RNA, 19 nt, Homo sapiens
caacccugcucacuucauc

SEQ ID NO: 485648 - RNA, 19 nt, Homo sapiens
gagcacaugaagaagauga

SEQ ID NO: 485649 - RNA, 19 nt, Homo sapiens
auaaucaccucaaggacuu

SEQ ID NO: 485650 - RNA, 19 nt, Homo sapiens
ucagaaguauacaauugga

SEQ ID NO: 485651 - RNA, 19 nt, Homo sapiens
gaggugcaauauuacaaca

SEQ ID NO: 485652 - RNA, 19 nt, Homo sapiens
gaaagcagagaaggagcua

SEQ ID NO: 485653 - RNA, 19 nt, Homo sapiens
acaauuggaccguggauga

SEQ ID NO: 485654 - RNA, 19 nt, Homo sapiens
caauuaccaugacccaaca

SEQ ID NO: 485655 - RNA, 19 nt, Homo sapiens
aauaaagcauguaggagau

SEQ ID NO: 485656 - RNA, 19 nt, Homo sapiens
aaucugaauuucccaagug

SEQ ID NO: 485657 - RNA, 19 nt, Homo sapiens
acaaacagguuaaaaggaa

SEQ ID NO: 485658 - RNA, 19 nt, Homo sapiens
gagaggcaucuguucauug

SEQ ID NO: 485659 - RNA, 19 nt, Homo sapiens
ggguucagcuucugucucu

SEQ ID NO: 485660 - RNA, 19 nt, Homo sapiens
auccuuggguccuucauua

SEQ ID NO: 485661 - RNA, 19 nt, Homo sapiens
gcagagaaggagcuagaau

SEQ ID NO: 485662 - RNA, 19 nt, Homo sapiens
ucucuugacucgccauaau

SEQ ID NO: 485663 - RNA, 19 nt, Homo sapiens
uggcugcccucaacauaga

SEQ ID NO: 485664 - RNA, 19 nt, Homo sapiens
agaagaugaugaaggacuu

SEQ ID NO: 485665 - RNA, 19 nt, Homo sapiens
cguaacauccacaaacuga

SEQ ID NO: 485666 - RNA, 19 nt, Homo sapiens
gauguaugcguccgucuug

SEQ ID NO: 485667 - RNA, 19 nt, Homo sapiens
gggaagauaggacgaguag

SEQ ID NO: 485668 - RNA, 19 nt, Homo sapiens
gauuugacccauuccgauu

SEQ ID NO: 485669 - RNA, 19 nt, Homo sapiens
cagagggauuugacccauu

SEQ ID NO: 485670 - RNA, 19 nt, Homo sapiens
cugcaccgcuggcaacaga

SEQ ID NO: 485671 - RNA, 19 nt, Homo sapiens
cugguggugucuaucguua

SEQ ID NO: 485672 - RNA, 19 nt, Homo sapiens
gccauaaucaccucaagga

SEQ ID NO: 485673 - RNA, 19 nt, Homo sapiens
gaacaaacaucaucaaagu

SEQ ID NO: 485674 - RNA, 19 nt, Homo sapiens
ggagguauaugcaguauuu

SEQ ID NO: 485675 - RNA, 19 nt, Homo sapiens
aaacaggacuugagcaaua

SEQ ID NO: 485676 - RNA, 19 nt, Homo sapiens
ggacagaacagaauaauau

SEQ ID NO: 485677 - RNA, 19 nt, Homo sapiens
gaagaaaggccgucuguga

SEQ ID NO: 485678 - RNA, 19 nt, Homo sapiens
ggaaacagauucauugucu

SEQ ID NO: 485679 - RNA, 19 nt, Homo sapiens
ggaaaggucagacaaauga

SEQ ID NO: 485680 - RNA, 19 nt, Homo sapiens
gaacuagccacaaucagua

SEQ ID NO: 485681 - RNA, 19 nt, Homo sapiens
gaaaggaaacagauucauu

SEQ ID NO: 485682 - RNA, 19 nt, Homo sapiens
gaaacuggauucuaaagag

SEQ ID NO: 485683 - RNA, 19 nt, Homo sapiens
aaacaaacccuacaacuau

SEQ ID NO: 485684 - RNA, 19 nt, Homo sapiens
caaacaaacccuacaacua

SEQ ID NO: 485685 - RNA, 19 nt, Homo sapiens
ggaugccucuaaugaguua

SEQ ID NO: 485686 - RNA, 19 nt, Homo sapiens
aaagagagcugugaagaug

SEQ ID NO: 485687 - RNA, 19 nt, Homo sapiens
gaaagcgucucugagugua

SEQ ID NO: 485688 - RNA, 19 nt, Homo sapiens
cuugagaacugauguaauu

SEQ ID NO: 485689 - RNA, 19 nt, Homo sapiens
gaaauuggacagaacagaa

SEQ ID NO: 485690 - RNA, 19 nt, Homo sapiens
ugugaaagcucgccaguug

SEQ ID NO: 485691 - RNA, 19 nt, Homo sapiens
ugaaauuaaugccuuggua

SEQ ID NO: 485692 - RNA, 19 nt, Homo sapiens
gcacaugggugaaaaguau

SEQ ID NO: 485693 - RNA, 19 nt, Homo sapiens
ggaggaggaugaauuugau

SEQ ID NO: 485694 - RNA, 19 nt, Homo sapiens
ggaggaggaggaugaauuu

SEQ ID NO: 485695 - RNA, 19 nt, Homo sapiens
caaaguccagguccauuua

SEQ ID NO: 485696 - RNA, 19 nt, Homo sapiens
gcaaaguccagguccauuu

SEQ ID NO: 485697 - RNA, 19 nt, Homo sapiens
gaaaagaaauuggacagaa

SEQ ID NO: 485698 - RNA, 19 nt, Homo sapiens
ggaagccacucaccacugu

SEQ ID NO: 485699 - RNA, 19 nt, Homo sapiens
ucaaguugcuggugaaugu

SEQ ID NO: 485700 - RNA, 19 nt, Homo sapiens
uauaaugggugaaggcaaa

SEQ ID NO: 485701 - RNA, 19 nt, Homo sapiens
gaguuaaguucuucuacaa

SEQ ID NO: 485702 - RNA, 19 nt, Homo sapiens
aaacugaaccuccgaaaug

SEQ ID NO: 485703 - RNA, 19 nt, Homo sapiens
caaaaugucuuccuaacaa

SEQ ID NO: 485704 - RNA, 19 nt, Homo sapiens
caucuaggguauauacaaa

SEQ ID NO: 485705 - RNA, 19 nt, Homo sapiens
cauaauuccugcuauuguu

SEQ ID NO: 485706 - RNA, 19 nt, Homo sapiens
ccaccaaguuuauauuuag

SEQ ID NO: 485707 - RNA, 19 nt, Homo sapiens
gagcagguguaugaucuuu

SEQ ID NO: 485708 - RNA, 19 nt, Homo sapiens
gagaaucagccaagauauu

SEQ ID NO: 485709 - RNA, 19 nt, Homo sapiens
ugaaggaggugauuuguac

SEQ ID NO: 485710 - RNA, 19 nt, Homo sapiens
gagauggucugcucuacau

SEQ ID NO: 485711 - RNA, 19 nt, Homo sapiens
gaaagcccauaccugcaaa

SEQ ID NO: 485712 - RNA, 19 nt, Homo sapiens
caagcaguaugucaucaaa

SEQ ID NO: 485713 - RNA, 19 nt, Homo sapiens
gaggaugaguuaaguucuu

SEQ ID NO: 485714 - RNA, 19 nt, Homo sapiens
gauauuaguugucuuucca

SEQ ID NO: 485715 - RNA, 19 nt, Homo sapiens
ggucagacaaaugaaauua

SEQ ID NO: 485716 - RNA, 19 nt, Homo sapiens
gaggugauuuguaccgaaa

SEQ ID NO: 485717 - RNA, 19 nt, Homo sapiens
gaacugauaagaacaaugc

SEQ ID NO: 485718 - RNA, 19 nt, Homo sapiens
caugagcccugaauuguuc

SEQ ID NO: 485719 - RNA, 19 nt, Homo sapiens
ugaauuugauagagaggua

SEQ ID NO: 485720 - RNA, 19 nt, Homo sapiens
gagacacauuggcuuugua

SEQ ID NO: 485721 - RNA, 19 nt, Homo sapiens
ggaaauaucgggacacacu

SEQ ID NO: 485722 - RNA, 19 nt, Homo sapiens
ggaaagcgucucugagugu

SEQ ID NO: 485723 - RNA, 19 nt, Homo sapiens
gcuggugaauguauuauag

SEQ ID NO: 485724 - RNA, 19 nt, Homo sapiens
gcguaaauauugacaucuu

SEQ ID NO: 485725 - RNA, 19 nt, Homo sapiens
gcaaacaggacuugagcaa

SEQ ID NO: 485726 - RNA, 19 nt, Homo sapiens
gcccugaauuguucucaaa

SEQ ID NO: 485727 - RNA, 19 nt, Homo sapiens
caaacccagugucagaauu

SEQ ID NO: 485728 - RNA, 19 nt, Homo sapiens
ggucugcucuacauuguca

SEQ ID NO: 485729 - RNA, 19 nt, Homo sapiens
cgucauaauuccugcuauu

SEQ ID NO: 485730 - RNA, 19 nt, Homo sapiens
ggagaaacaaaugacauaa

SEQ ID NO: 485731 - RNA, 19 nt, Homo sapiens
aaacuggauucuaaagaga

SEQ ID NO: 485732 - RNA, 19 nt, Homo sapiens
aaaggaaacagauucauug

SEQ ID NO: 485733 - RNA, 19 nt, Homo sapiens
uaacuuaaacacagagcua

SEQ ID NO: 485734 - RNA, 19 nt, Homo sapiens
gaggaaagcgucucugagu

SEQ ID NO: 485735 - RNA, 19 nt, Homo sapiens
aucaaaggaucgaccauua

SEQ ID NO: 485736 - RNA, 19 nt, Homo sapiens
aacaaacccuacaacuaua

SEQ ID NO: 485737 - RNA, 19 nt, Homo sapiens
ccauggcuuugcaguauuu

SEQ ID NO: 485738 - RNA, 19 nt, Homo sapiens
guaauacccaucuaggaaa

SEQ ID NO: 485739 - RNA, 19 nt, Homo sapiens
acacauugauggacuuuua

SEQ ID NO: 485740 - RNA, 19 nt, Homo sapiens
gaagcaggaucacaaaaga

SEQ ID NO: 485741 - RNA, 19 nt, Homo sapiens
gaaaagaucaggagacuag

SEQ ID NO: 485742 - RNA, 19 nt, Homo sapiens
ccaaaggaccagagucuug

SEQ ID NO: 485743 - RNA, 19 nt, Homo sapiens
gauauuuggaugccucuaa

SEQ ID NO: 485744 - RNA, 19 nt, Homo sapiens
uuaguugucuuuccauguu

SEQ ID NO: 485745 - RNA, 19 nt, Homo sapiens
guugaagucuugagaacug

SEQ ID NO: 485746 - RNA, 19 nt, Homo sapiens
gcagaacugauaagaacaa

SEQ ID NO: 485747 - RNA, 19 nt, Homo sapiens
cuuaaggaguaguugauaa

SEQ ID NO: 485748 - RNA, 19 nt, Homo sapiens
gauaaaagcaguaggagaa

SEQ ID NO: 485749 - RNA, 19 nt, Homo sapiens
gaagaugucccgguagcaa

SEQ ID NO: 485750 - RNA, 19 nt, Homo sapiens
cccugaaacuggauucuaa

SEQ ID NO: 485751 - RNA, 19 nt, Homo sapiens
gaagggaaaggucagacaa

SEQ ID NO: 485752 - RNA, 19 nt, Homo sapiens
guuaaguucuucuacaagu

SEQ ID NO: 485753 - RNA, 19 nt, Homo sapiens
agaaucagccaagauauuu

SEQ ID NO: 485754 - RNA, 19 nt, Homo sapiens
cacauuggcuuuguaaauc

SEQ ID NO: 485755 - RNA, 19 nt, Homo sapiens
ggaucaaguugcuggugaa

SEQ ID NO: 485756 - RNA, 19 nt, Homo sapiens
ucaguagcguaaauauuga

SEQ ID NO: 485757 - RNA, 19 nt, Homo sapiens
gcucuaggaugcugugucu

SEQ ID NO: 485758 - RNA, 19 nt, Homo sapiens
cuacaugagcccugaauug

SEQ ID NO: 485759 - RNA, 19 nt, Homo sapiens
guagagugguuuguacaga

SEQ ID NO: 485760 - RNA, 19 nt, Homo sapiens
gcccagcucuugucucagu

SEQ ID NO: 485761 - RNA, 19 nt, Homo sapiens
gcuauaaaaugcuggauug

SEQ ID NO: 485762 - RNA, 19 nt, Homo sapiens
gagcauuuguccuaaucug

SEQ ID NO: 485763 - RNA, 19 nt, Homo sapiens
gcgagcugcugaacaggaa

SEQ ID NO: 485764 - RNA, 19 nt, Homo sapiens
gggacacacugauacuuca

SEQ ID NO: 485765 - RNA, 19 nt, Homo sapiens
caaacuucaucggaaauau

SEQ ID NO: 485766 - RNA, 19 nt, Homo sapiens
agagucgccuccucgauuu

SEQ ID NO: 485767 - RNA, 19 nt, Homo sapiens
gaggcagaaucaaaucaug

SEQ ID NO: 485768 - RNA, 19 nt, Homo sapiens
cggcaaaucuccuucuuuu

SEQ ID NO: 485769 - RNA, 19 nt, Homo sapiens
uggcagaacugauaagaac

SEQ ID NO: 485770 - RNA, 19 nt, Homo sapiens
cagcaaugccaagagauua

SEQ ID NO: 485771 - RNA, 19 nt, Homo sapiens
ggagaggugacgcuuguga

SEQ ID NO: 485772 - RNA, 19 nt, Homo sapiens
ugaguuaaguucuucuaca

SEQ ID NO: 485773 - RNA, 19 nt, Homo sapiens
ucuaauagcugaacugauu

SEQ ID NO: 485774 - RNA, 19 nt, Homo sapiens
gaaauugcaaccauucuua

SEQ ID NO: 485775 - RNA, 19 nt, Homo sapiens
gcccauauguuguaaagua

SEQ ID NO: 485776 - RNA, 19 nt, Homo sapiens
gaagguagggucauauuaa

SEQ ID NO: 485777 - RNA, 19 nt, Homo sapiens
uaagagaccugaucacaga

SEQ ID NO: 485778 - RNA, 19 nt, Homo sapiens
ggagaagggucuuauggaa

SEQ ID NO: 485779 - RNA, 19 nt, Homo sapiens
aagcaagacuucaagaaua

SEQ ID NO: 485780 - RNA, 19 nt, Homo sapiens
gaaaguuccucaagaugga

SEQ ID NO: 485781 - RNA, 19 nt, Homo sapiens
acaaguaccuguugaauca

SEQ ID NO: 485782 - RNA, 19 nt, Homo sapiens
gaacugauucaaacuguaa

SEQ ID NO: 485783 - RNA, 19 nt, Homo sapiens
ggaaguguauuuaaagcaa

SEQ ID NO: 485784 - RNA, 19 nt, Homo sapiens
ugccaaaccuguaucaaua

SEQ ID NO: 485785 - RNA, 19 nt, Homo sapiens
uggaguggcuggucaguua

SEQ ID NO: 485786 - RNA, 19 nt, Homo sapiens
gaacuuugguccgaugauu

SEQ ID NO: 485787 - RNA, 19 nt, Homo sapiens
caaaggcuauuguugcauu

SEQ ID NO: 485788 - RNA, 19 nt, Homo sapiens
caagaaaccacuaggaauu

SEQ ID NO: 485789 - RNA, 19 nt, Homo sapiens
gauaaugugcaaccaauuu

SEQ ID NO: 485790 - RNA, 19 nt, Homo sapiens
gaaaggacuagaauauuug

SEQ ID NO: 485791 - RNA, 19 nt, Homo sapiens
aaucagaucuucaggaaau

SEQ ID NO: 485792 - RNA, 19 nt, Homo sapiens
gaagaauccugagcagaga

SEQ ID NO: 485793 - RNA, 19 nt, Homo sapiens
gcuggucaguuaacagaua

SEQ ID NO: 485794 - RNA, 19 nt, Homo sapiens
gaagacaguuugacuaagc

SEQ ID NO: 485795 - RNA, 19 nt, Homo sapiens
ugaggugauucaagaaaua

SEQ ID NO: 485796 - RNA, 19 nt, Homo sapiens
caaggaauccggucaaguu

SEQ ID NO: 485797 - RNA, 19 nt, Homo sapiens
gaagaagauggaacuauga

SEQ ID NO: 485798 - RNA, 19 nt, Homo sapiens
ggacuacuuugauaagcaa

SEQ ID NO: 485799 - RNA, 19 nt, Homo sapiens
gaacuacagaugcgguuaa

SEQ ID NO: 485800 - RNA, 19 nt, Homo sapiens
agaagaagauggaacuaug

SEQ ID NO: 485801 - RNA, 19 nt, Homo sapiens
caugaacccuucccuaugu

SEQ ID NO: 485802 - RNA, 19 nt, Homo sapiens
cuauggagaucaaagcuaa

SEQ ID NO: 485803 - RNA, 19 nt, Homo sapiens
ggaauugaaggaauauuug

SEQ ID NO: 485804 - RNA, 19 nt, Homo sapiens
uaagcagccugaagaaguu

SEQ ID NO: 485805 - RNA, 19 nt, Homo sapiens
ccaaaccuguaucaauauu

SEQ ID NO: 485806 - RNA, 19 nt, Homo sapiens
gcucaucaauuucauuucu

SEQ ID NO: 485807 - RNA, 19 nt, Homo sapiens
gaaguguauucucuuguuc

SEQ ID NO: 485808 - RNA, 19 nt, Homo sapiens
uaacuauucuggagaccaa

SEQ ID NO: 485809 - RNA, 19 nt, Homo sapiens
uaacagauacaauggcaaa

SEQ ID NO: 485810 - RNA, 19 nt, Homo sapiens
guaaucagaacaugcauga

SEQ ID NO: 485811 - RNA, 19 nt, Homo sapiens
ccgaugauuucaccgauuu

SEQ ID NO: 485812 - RNA, 19 nt, Homo sapiens
gcaaccaauuuauacuuuc

SEQ ID NO: 485813 - RNA, 19 nt, Homo sapiens
gaccaugauugaacauaau

SEQ ID NO: 485814 - RNA, 19 nt, Homo sapiens
gcugauauacauccaauga

SEQ ID NO: 485815 - RNA, 19 nt, Homo sapiens
agaaauggcugaaggaaaa

SEQ ID NO: 485816 - RNA, 19 nt, Homo sapiens
agcaagacuucaagaauaa

SEQ ID NO: 485817 - RNA, 19 nt, Homo sapiens
agaccaugauugaacauaa

SEQ ID NO: 485818 - RNA, 19 nt, Homo sapiens
gugaagacaguuugacuaa

SEQ ID NO: 485819 - RNA, 19 nt, Homo sapiens
ugacagcccauauguugua

SEQ ID NO: 485820 - RNA, 19 nt, Homo sapiens
ggaauccggucaaguuguc

SEQ ID NO: 485821 - RNA, 19 nt, Homo sapiens
caggauagcuuuggugaag

SEQ ID NO: 485822 - RNA, 19 nt, Homo sapiens
acuaggaauugaaggaaua

SEQ ID NO: 485823 - RNA, 19 nt, Homo sapiens
ugacuaagcagccugaaga

SEQ ID NO: 485824 - RNA, 19 nt, Homo sapiens
caaccauucuuaaaucuac

SEQ ID NO: 485825 - RNA, 19 nt, Homo sapiens
guacauuccuugauuucca

SEQ ID NO: 485826 - RNA, 19 nt, Homo sapiens
guacaugcccagguaaauu

SEQ ID NO: 485827 - RNA, 19 nt, Homo sapiens
gaucaaagcuaaaagacau

SEQ ID NO: 485828 - RNA, 19 nt, Homo sapiens
gcaaaacgcaauacuguaa

SEQ ID NO: 485829 - RNA, 19 nt, Homo sapiens
ggcaguaguucucaaaugg

SEQ ID NO: 485830 - RNA, 19 nt, Homo sapiens
ccacaagcacgaugaguga

SEQ ID NO: 485831 - RNA, 19 nt, Homo sapiens
cagaagcuauggagaucaa

SEQ ID NO: 485832 - RNA, 19 nt, Homo sapiens
caagaaugccaaaccugua

SEQ ID NO: 485833 - RNA, 19 nt, Homo sapiens
uaaaguacuauggcaguua

SEQ ID NO: 485834 - RNA, 19 nt, Homo sapiens
guaaaguacuauggcaguu

SEQ ID NO: 485835 - RNA, 19 nt, Homo sapiens
gacaagaucaggauagcuu

SEQ ID NO: 485836 - RNA, 19 nt, Homo sapiens
ggaugaagaugagcuggau

SEQ ID NO: 485837 - RNA, 19 nt, Homo sapiens
cgaaacaagacauuaauag

SEQ ID NO: 485838 - RNA, 19 nt, Homo sapiens
aaaguacuauggcaguuau

SEQ ID NO: 485839 - RNA, 19 nt, Homo sapiens
gguccgaguucccagaguu

SEQ ID NO: 485840 - RNA, 19 nt, Homo sapiens
agaagggucuuauggaagu

SEQ ID NO: 485841 - RNA, 19 nt, Homo sapiens
gucaaguugucgcaauuaa

SEQ ID NO: 485842 - RNA, 19 nt, Homo sapiens
ccagucauuuccuaagcua

SEQ ID NO: 485843 - RNA, 19 nt, Homo sapiens
gaugauaacccaguagcaa

SEQ ID NO: 485844 - RNA, 19 nt, Homo sapiens
gauucaaacuguaauaagc

SEQ ID NO: 485845 - RNA, 19 nt, Homo sapiens
ugaagguagggucauauua

SEQ ID NO: 485846 - RNA, 19 nt, Homo sapiens
ugcauucacucuaagauga

SEQ ID NO: 485847 - RNA, 19 nt, Homo sapiens
aaugguacaugcccaggua

SEQ ID NO: 485848 - RNA, 19 nt, Homo sapiens
gaagauggaacuaugaaaa

SEQ ID NO: 485849 - RNA, 19 nt, Homo sapiens
ggaagaagaagauggaacu

SEQ ID NO: 485850 - RNA, 19 nt, Homo sapiens
uuaaagcaauacacaagga

SEQ ID NO: 485851 - RNA, 19 nt, Homo sapiens
gcaugaacccuucccuaug

SEQ ID NO: 485852 - RNA, 19 nt, Homo sapiens
caaauccaccaccaacauu

SEQ ID NO: 485853 - RNA, 19 nt, Homo sapiens
gcaaccauucuuaaaucua

SEQ ID NO: 485854 - RNA, 19 nt, Homo sapiens
gaucuaauagcugaacuga

SEQ ID NO: 485855 - RNA, 19 nt, Homo sapiens
gaacaaaagaaguguauuc

SEQ ID NO: 485856 - RNA, 19 nt, Homo sapiens
gaacuucgucagagauaca

SEQ ID NO: 485857 - RNA, 19 nt, Homo sapiens
agauggagacuuugacuuu

SEQ ID NO: 485858 - RNA, 19 nt, Homo sapiens
ggucaaguugucgcaauua

SEQ ID NO: 485859 - RNA, 19 nt, Homo sapiens
uaagcaagacuucaagaau

SEQ ID NO: 485860 - RNA, 19 nt, Homo sapiens
gaagaagaagauggaacua

SEQ ID NO: 485861 - RNA, 19 nt, Homo sapiens
gaacagcaacgagaauugg

SEQ ID NO: 485862 - RNA, 19 nt, Homo sapiens
gagagcuacugcaacacaa

SEQ ID NO: 485863 - RNA, 19 nt, Homo sapiens
ggauguuucuguugauuuu

SEQ ID NO: 485864 - RNA, 19 nt, Homo sapiens
gcaauaauggcaguaguuc

SEQ ID NO: 485865 - RNA, 19 nt, Homo sapiens
ucaguuaacagauacaaug

SEQ ID NO: 485866 - RNA, 19 nt, Homo sapiens
gcauugggaccagucauuu

SEQ ID NO: 485867 - RNA, 19 nt, Homo sapiens
caauggaacccuugcacaa

SEQ ID NO: 485868 - RNA, 19 nt, Homo sapiens
ggauagcuuuggugaaggu

SEQ ID NO: 485869 - RNA, 19 nt, Homo sapiens
gcgccuaagaguaaacuaa

SEQ ID NO: 485870 - RNA, 19 nt, Homo sapiens
uguaauaggaacuccauuu

SEQ ID NO: 485871 - RNA, 19 nt, Homo sapiens
agaaggacaugcaaaauug

SEQ ID NO: 485872 - RNA, 19 nt, Homo sapiens
gcaaugugacagcccauau

SEQ ID NO: 485873 - RNA, 19 nt, Homo sapiens
gaacagagacuccuaguug

SEQ ID NO: 485874 - RNA, 19 nt, Homo sapiens
gggaauaacugccauagaa

SEQ ID NO: 485875 - RNA, 19 nt, Homo sapiens
ccagagcuauggucagaua

SEQ ID NO: 485876 - RNA, 19 nt, Homo sapiens
gaaacagugucuuguaaag

SEQ ID NO: 485877 - RNA, 19 nt, Homo sapiens
gugaaacagugucuuguaa

SEQ ID NO: 485878 - RNA, 19 nt, Homo sapiens
caaacaaccagaagaagua

SEQ ID NO: 485879 - RNA, 19 nt, Homo sapiens
gaagggcucucuugacagu

SEQ ID NO: 485880 - RNA, 19 nt, Homo sapiens
gaagaggaaggaacuauga

SEQ ID NO: 485881 - RNA, 19 nt, Homo sapiens
gaugggcacuguccgagua

SEQ ID NO: 485882 - RNA, 19 nt, Homo sapiens
gaagagauccggcagaagu

SEQ ID NO: 485883 - RNA, 19 nt, Homo sapiens
gggaagggcucucuugaca

SEQ ID NO: 485884 - RNA, 19 nt, Homo sapiens
guacauuggucagguauau

SEQ ID NO: 485885 - RNA, 19 nt, Homo sapiens
ggauggagacuacgaguuu

SEQ ID NO: 485886 - RNA, 19 nt, Homo sapiens
agaaauggcugaaggaaag

SEQ ID NO: 485887 - RNA, 19 nt, Homo sapiens
gcaggucaacuuacagaua

SEQ ID NO: 485888 - RNA, 19 nt, Homo sapiens
caacaaaacuucugagcaa

SEQ ID NO: 485889 - RNA, 19 nt, Homo sapiens
ggauuuauauuggcgcuuu

SEQ ID NO: 485890 - RNA, 19 nt, Homo sapiens
gcugauauccauccaauga

SEQ ID NO: 485891 - RNA, 19 nt, Homo sapiens
gaagaaguauuugaugucu

SEQ ID NO: 485892 - RNA, 19 nt, Homo sapiens
cagaagaaguauuugaugu

SEQ ID NO: 485893 - RNA, 19 nt, Homo sapiens
gcccucauguagucaaaua

SEQ ID NO: 485894 - RNA, 19 nt, Homo sapiens
ggaauaacugccauagaaa

SEQ ID NO: 485895 - RNA, 19 nt, Homo sapiens
ugacagcccucauguaguc

SEQ ID NO: 485896 - RNA, 19 nt, Homo sapiens
ggucagguauauuaucuca

SEQ ID NO: 485897 - RNA, 19 nt, Homo sapiens
caagcggaauacagugaua

SEQ ID NO: 485898 - RNA, 19 nt, Homo sapiens
ggaccaggacgaugaagaa

SEQ ID NO: 485899 - RNA, 19 nt, Homo sapiens
gcuauggucagauaacuuu

SEQ ID NO: 485900 - RNA, 19 nt, Homo sapiens
gaauaacugccauagaaau

SEQ ID NO: 485901 - RNA, 19 nt, Homo sapiens
uaaagagaccggccagauu

SEQ ID NO: 485902 - RNA, 19 nt, Homo sapiens
caacagcuuuggcaagagu

SEQ ID NO: 485903 - RNA, 19 nt, Homo sapiens
cagaagugauucaggaaau

SEQ ID NO: 485904 - RNA, 19 nt, Homo sapiens
gguagcaggucaacuuaca

SEQ ID NO: 485905 - RNA, 19 nt, Homo sapiens
uaucaaggcaggaaauauu

SEQ ID NO: 485906 - RNA, 19 nt, Homo sapiens
caaauccuccucccacauu

SEQ ID NO: 485907 - RNA, 19 nt, Homo sapiens
gguauauuaucucaaagga

SEQ ID NO: 485908 - RNA, 19 nt, Homo sapiens
aagaagagacggcaacaaa

SEQ ID NO: 485909 - RNA, 19 nt, Homo sapiens
ggaaggaacuaugaaaaga

SEQ ID NO: 485910 - RNA, 19 nt, Homo sapiens
ggaaauuggauacaacugu

SEQ ID NO: 485911 - RNA, 19 nt, Homo sapiens
ggagauaaucaaagaaauc

SEQ ID NO: 485912 - RNA, 19 nt, Homo sapiens
agugauagcugggaaaguu

SEQ ID NO: 485913 - RNA, 19 nt, Homo sapiens
ggagacuacgaguuucuua

SEQ ID NO: 485914 - RNA, 19 nt, Homo sapiens
cugcgagacuuaauuaaug

SEQ ID NO: 485915 - RNA, 19 nt, Homo sapiens
aaaguuggaugaagauagu

SEQ ID NO: 485916 - RNA, 19 nt, Homo sapiens
ggucagauaacuuuacaga

SEQ ID NO: 485917 - RNA, 19 nt, Homo sapiens
gccagauuguugcuauuaa

SEQ ID NO: 485918 - RNA, 19 nt, Homo sapiens
gauaucaaggcaggaaaua

SEQ ID NO: 485919 - RNA, 19 nt, Homo sapiens
aaagagaccggccagauug

SEQ ID NO: 485920 - RNA, 19 nt, Homo sapiens
aaccauccuuucuugaaua

SEQ ID NO: 485921 - RNA, 19 nt, Homo sapiens
agaagaggaugaaauggau

SEQ ID NO: 485922 - RNA, 19 nt, Homo sapiens
gaagugauucaggaaauug

SEQ ID NO: 485923 - RNA, 19 nt, Homo sapiens
acauuggucagguauauua

SEQ ID NO: 485924 - RNA, 19 nt, Homo sapiens
gcaggagauugaagagauc

SEQ ID NO: 485925 - RNA, 19 nt, Homo sapiens
ccaaaggagugucaauacu

SEQ ID NO: 485926 - RNA, 19 nt, Homo sapiens
cauagaggcuaagaagaga

SEQ ID NO: 485927 - RNA, 19 nt, Homo sapiens
gagacuacgaguuucuuaa

SEQ ID NO: 485928 - RNA, 19 nt, Homo sapiens
gaagaugaaauagcuacaa

SEQ ID NO: 485929 - RNA, 19 nt, Homo sapiens
gagcaaggccaggcuguga

SEQ ID NO: 485930 - RNA, 19 nt, Homo sapiens
aaaccauccuuucuugaau

SEQ ID NO: 485931 - RNA, 19 nt, Homo sapiens
ggaagaggaaggaacuaug

SEQ ID NO: 485932 - RNA, 19 nt, Homo sapiens
ccauggaugugaaacugaa

SEQ ID NO: 485933 - RNA, 19 nt, Homo sapiens
acagacuuauggaucguua

SEQ ID NO: 485934 - RNA, 19 nt, Homo sapiens
gacuacgaguuucuuaaga

SEQ ID NO: 485935 - RNA, 19 nt, Homo sapiens
caggagauaaucaaagaaa

SEQ ID NO: 485936 - RNA, 19 nt, Homo sapiens
ggccagauuguugcuauua

SEQ ID NO: 485937 - RNA, 19 nt, Homo sapiens
ggugaucaaugcagaggau

SEQ ID NO: 485938 - RNA, 19 nt, Homo sapiens
gauggagccaauacuauga

SEQ ID NO: 485939 - RNA, 19 nt, Homo sapiens
auacugcgagacuuaauua

SEQ ID NO: 485940 - RNA, 19 nt, Homo sapiens
caaaggagugucaauacug

SEQ ID NO: 485941 - RNA, 19 nt, Homo sapiens
uccaggagauaaucaaaga

SEQ ID NO: 485942 - RNA, 19 nt, Homo sapiens
ggaugaagauaguuuaacc

SEQ ID NO: 485943 - RNA, 19 nt, Homo sapiens
cagaagaggaugaaaugga

SEQ ID NO: 485944 - RNA, 19 nt, Homo sapiens
gaaacugaaacgccaggaa

SEQ ID NO: 485945 - RNA, 19 nt, Homo sapiens
caggucaacuuacagauac

SEQ ID NO: 485946 - RNA, 19 nt, Homo sapiens
acaaccagaagaaguauuu

SEQ ID NO: 485947 - RNA, 19 nt, Homo sapiens
cuggauggcuugccucaug

SEQ ID NO: 485948 - RNA, 19 nt, Homo sapiens
gugaugagaugggcacugu

SEQ ID NO: 485949 - RNA, 19 nt, Homo sapiens
gucaauacugcgagacuua

SEQ ID NO: 485950 - RNA, 19 nt, Homo sapiens
agaagugauucaggaaauu

SEQ ID NO: 485951 - RNA, 19 nt, Homo sapiens
ugauggagcaggagauuga

SEQ ID NO: 485952 - RNA, 19 nt, Homo sapiens
ccaaugagggcaaucuuca

SEQ ID NO: 485953 - RNA, 19 nt, Homo sapiens
ggaacagagacuccuaguu

SEQ ID NO: 485954 - RNA, 19 nt, Homo sapiens
ccaaacaaccagaagaagu

SEQ ID NO: 485955 - RNA, 19 nt, Homo sapiens
uauguacauuggucaggua

SEQ ID NO: 485956 - RNA, 19 nt, Homo sapiens
gaagaggaugaaauggauu

SEQ ID NO: 485957 - RNA, 19 nt, Homo sapiens
ccagauuguugcuauuaag

SEQ ID NO: 485958 - RNA, 19 nt, Homo sapiens
ugaaacagugucuuguaaa

SEQ ID NO: 485959 - RNA, 19 nt, Homo sapiens
aacagagacuccuaguuga

SEQ ID NO: 485960 - RNA, 19 nt, Homo sapiens
uggcuugccucauguuugu

SEQ ID NO: 485961 - RNA, 19 nt, Homo sapiens
acgaguuucuuaagaguug

SEQ ID NO: 485962 - RNA, 19 nt, Homo sapiens
ugucaggagugccaaagga

SEQ ID NO: 485963 - RNA, 19 nt, Homo sapiens
uaaccaaacaaccagaaga

SEQ ID NO: 485964 - RNA, 19 nt, Homo sapiens
ccauagaggcuaagaagag

SEQ ID NO: 485965 - RNA, 19 nt, Homo sapiens
uauggaucguuauggagua

SEQ ID NO: 485966 - RNA, 19 nt, Homo sapiens
gcuugccucauguuuguua

SEQ ID NO: 485967 - RNA, 19 nt, Homo sapiens
gaagggaugagaccaugca

SEQ ID NO: 485968 - RNA, 19 nt, Homo sapiens
aaacugaaacgccaggaau

SEQ ID NO: 485969 - RNA, 19 nt, Homo sapiens
ugcgagacuuaauuaauga

SEQ ID NO: 485970 - RNA, 19 nt, Homo sapiens
ccagaagaaguauuugaug

SEQ ID NO: 485971 - RNA, 19 nt, Homo sapiens
uugaagagauccggcagaa

SEQ ID NO: 485972 - RNA, 19 nt, Homo sapiens
ggacaguggaggaccuuca

SEQ ID NO: 485973 - RNA, 19 nt, Homo sapiens
ccacuuaucucccauauga

SEQ ID NO: 485974 - RNA, 19 nt, Homo sapiens
ggauacugcuuguuacuua

SEQ ID NO: 485975 - RNA, 19 nt, Homo sapiens
gaagagaguuauucauaga

SEQ ID NO: 485976 - RNA, 19 nt, Homo sapiens
gcaauaaccuuccuaguac

SEQ ID NO: 485977 - RNA, 19 nt, Homo sapiens
gaacuuacuucuuggauca

SEQ ID NO: 485978 - RNA, 19 nt, Homo sapiens
gagaacugcuacuuauaua

SEQ ID NO: 485979 - RNA, 19 nt, Homo sapiens
uuaaggagcugugcaauaa

SEQ ID NO: 485980 - RNA, 19 nt, Homo sapiens
gaagagaaguagaaauaca

SEQ ID NO: 485981 - RNA, 19 nt, Homo sapiens
cagaagagaaguagaaaua

SEQ ID NO: 485982 - RNA, 19 nt, Homo sapiens
gaaaguagccacgagaauu

SEQ ID NO: 485983 - RNA, 19 nt, Homo sapiens
gcaaacacauaccaagaga

SEQ ID NO: 485984 - RNA, 19 nt, Homo sapiens
uagcauguguguaaacuuu

SEQ ID NO: 485985 - RNA, 19 nt, Homo sapiens
gaacgcuacacaagaaaua

SEQ ID NO: 485986 - RNA, 19 nt, Homo sapiens
ggaacaugcuacugaaguu

SEQ ID NO: 485987 - RNA, 19 nt, Homo sapiens
caaaugcccugucuuacug

SEQ ID NO: 485988 - RNA, 19 nt, Homo sapiens
cuagaacgcuacacaagaa

SEQ ID NO: 485989 - RNA, 19 nt, Homo sapiens
gaauaucacggguugaauu

SEQ ID NO: 485990 - RNA, 19 nt, Homo sapiens
caaagaaucagcuagcaaa

SEQ ID NO: 485991 - RNA, 19 nt, Homo sapiens
caagacuguugaagcauaa

SEQ ID NO: 485992 - RNA, 19 nt, Homo sapiens
uaacagaauuggcaaaugc

SEQ ID NO: 485993 - RNA, 19 nt, Homo sapiens
cacauucccugacuuugua

SEQ ID NO: 485994 - RNA, 19 nt, Homo sapiens
cgaagagaguuauucauag

SEQ ID NO: 485995 - RNA, 19 nt, Homo sapiens
gaagaggccaugugucuca

SEQ ID NO: 485996 - RNA, 19 nt, Homo sapiens
caagagaccuacaaaagaa

SEQ ID NO: 485997 - RNA, 19 nt, Homo sapiens
ucgaagagaguuauucaua

SEQ ID NO: 485998 - RNA, 19 nt, Homo sapiens
guaaaggaaaguuugguaa

SEQ ID NO: 485999 - RNA, 19 nt, Homo sapiens
gcaaacagucuuaggaauc

SEQ ID NO: 486000 - RNA, 19 nt, Homo sapiens
gaucacagcaaauucauca

SEQ ID NO: 486001 - RNA, 19 nt, Homo sapiens
ccagggaccucauuucaag

SEQ ID NO: 486002 - RNA, 19 nt, Homo sapiens
ggaguucuuugcuaugaau

SEQ ID NO: 486003 - RNA, 19 nt, Homo sapiens
agucauagcauguguguaa

SEQ ID NO: 486004 - RNA, 19 nt, Homo sapiens
gagaauugugcuacuuaua

SEQ ID NO: 486005 - RNA, 19 nt, Homo sapiens
gaacaugcuacugaaguuu

SEQ ID NO: 486006 - RNA, 19 nt, Homo sapiens
gcucagagaaguacuugaa

SEQ ID NO: 486007 - RNA, 19 nt, Homo sapiens
gaaaagcaaagcaaguuua

SEQ ID NO: 486008 - RNA, 19 nt, Homo sapiens
ugguaaagcuguuggaaug

SEQ ID NO: 486009 - RNA, 19 nt, Homo sapiens
ugagugaguguguaacuua

SEQ ID NO: 486010 - RNA, 19 nt, Homo sapiens
ugcaauaaccuuccuagua

SEQ ID NO: 486011 - RNA, 19 nt, Homo sapiens
gaauaugcaccacuuggaa

SEQ ID NO: 486012 - RNA, 19 nt, Homo sapiens
aaaggaaaguuugguaaug

SEQ ID NO: 486013 - RNA, 19 nt, Homo sapiens
gcucagaagagaaguagaa

SEQ ID NO: 486014 - RNA, 19 nt, Homo sapiens
ggaaaguuugguaauguuu

SEQ ID NO: 486015 - RNA, 19 nt, Homo sapiens
gaacuggcaucaaaacaga

SEQ ID NO: 486016 - RNA, 19 nt, Homo sapiens
aggaggaacuggcaucaaa

SEQ ID NO: 486017 - RNA, 19 nt, Homo sapiens
uguaggauacugcuuguua

SEQ ID NO: 486018 - RNA, 19 nt, Homo sapiens
gacaggaacaugcuacuga

SEQ ID NO: 486019 - RNA, 19 nt, Homo sapiens
ggucuuguguccuucaaau

SEQ ID NO: 486020 - RNA, 19 nt, Homo sapiens
gugaguguguaacuuauug

SEQ ID NO: 486021 - RNA, 19 nt, Homo sapiens
guuaaggagcugugcaaua

SEQ ID NO: 486022 - RNA, 19 nt, Homo sapiens
gcaaaugcccugucuuacu

SEQ ID NO: 486023 - RNA, 19 nt, Homo sapiens
gaacugcuacuuauauaac

SEQ ID NO: 486024 - RNA, 19 nt, Homo sapiens
ggaagacuuugaaauuggu

SEQ ID NO: 486025 - RNA, 19 nt, Homo sapiens
agauauauguacagacuug

SEQ ID NO: 486026 - RNA, 19 nt, Homo sapiens
gaaggucggaugcaugaug

SEQ ID NO: 486027 - RNA, 19 nt, Homo sapiens
auagagaacuucagaaacu

SEQ ID NO: 486028 - RNA, 19 nt, Homo sapiens
uggaacaguuuauagagaa

SEQ ID NO: 486029 - RNA, 19 nt, Homo sapiens
gguaaaggaaaguuuggua

SEQ ID NO: 486030 - RNA, 19 nt, Homo sapiens
cuacuuauacugguucaua

SEQ ID NO: 486031 - RNA, 19 nt, Homo sapiens
gaauugugcuacuuauacu

SEQ ID NO: 486032 - RNA, 19 nt, Homo sapiens
aagcaaagcaaguuuauuc

SEQ ID NO: 486033 - RNA, 19 nt, Homo sapiens
ucagagaaguacuugaaca

SEQ ID NO: 486034 - RNA, 19 nt, Homo sapiens
gauacugcuuguuacuuau

SEQ ID NO: 486035 - RNA, 19 nt, Homo sapiens
caucauggaccgaucuaaa

SEQ ID NO: 486036 - RNA, 19 nt, Homo sapiens
acaagccgguucagaauca

SEQ ID NO: 486037 - RNA, 19 nt, Homo sapiens
cgagaauugugcuacuuau

SEQ ID NO: 486038 - RNA, 19 nt, Homo sapiens
uaccagagucuaccuaauu

SEQ ID NO: 486039 - RNA, 19 nt, Homo sapiens
gcagugggcuuuggaagac

SEQ ID NO: 486040 - RNA, 19 nt, Homo sapiens
gagugaguguguaacuuau

SEQ ID NO: 486041 - RNA, 19 nt, Homo sapiens
ucacagcaaauucaucaaa

SEQ ID NO: 486042 - RNA, 19 nt, Homo sapiens
ccacuuggaacaguuuaua

SEQ ID NO: 486043 - RNA, 19 nt, Homo sapiens
ggaauaugcaccacuugga

SEQ ID NO: 486044 - RNA, 19 nt, Homo sapiens
cagcgggucuuguguccuu

SEQ ID NO: 486045 - RNA, 19 nt, Homo sapiens
gcaaagcaaguuuauucug

SEQ ID NO: 486046 - RNA, 19 nt, Homo sapiens
ucucgugacucagcaaauu

SEQ ID NO: 486047 - RNA, 19 nt, Homo sapiens
aaaguagccacgagaauug

SEQ ID NO: 486048 - RNA, 19 nt, Homo sapiens
acaggaacaugcuacugaa

SEQ ID NO: 486049 - RNA, 19 nt, Homo sapiens
caaacagucuuaggaaucg

SEQ ID NO: 486050 - RNA, 19 nt, Homo sapiens
gaccucauuucaagacugu

SEQ ID NO: 486051 - RNA, 19 nt, Homo sapiens
agagaacugcuacuuauau

SEQ ID NO: 486052 - RNA, 19 nt, Homo sapiens
cagagaacugcuacuuaua

SEQ ID NO: 486053 - RNA, 19 nt, Homo sapiens
acacauaccaagagaccua

SEQ ID NO: 486054 - RNA, 19 nt, Homo sapiens
agagaguuauucauagaga

SEQ ID NO: 486055 - RNA, 19 nt, Homo sapiens
aaggaaaguuugguaaugu

SEQ ID NO: 486056 - RNA, 19 nt, Homo sapiens
guaaagcuguuggaaugag

SEQ ID NO: 486057 - RNA, 19 nt, Homo sapiens
guaccugagugagugugua

SEQ ID NO: 486058 - RNA, 19 nt, Homo sapiens
cagcaaauuccuugucaga

SEQ ID NO: 486059 - RNA, 19 nt, Homo sapiens
cagaagaggccaugugucu

SEQ ID NO: 486060 - RNA, 19 nt, Homo sapiens
ucaauaaacaugacacucu

SEQ ID NO: 486061 - RNA, 19 nt, Homo sapiens
agaaucagcuagcaaacag

SEQ ID NO: 486062 - RNA, 19 nt, Homo sapiens
caccuucggcauccuaaua

SEQ ID NO: 486063 - RNA, 19 nt, Homo sapiens
uuggaagacuuugaaauug

SEQ ID NO: 486064 - RNA, 19 nt, Homo sapiens
gggauuugcuugggauaca

SEQ ID NO: 486065 - RNA, 19 nt, Homo sapiens
cuaccuccauuuagggauu

SEQ ID NO: 486066 - RNA, 19 nt, Homo sapiens
aaacaugacacucugaagu

SEQ ID NO: 486067 - RNA, 19 nt, Homo sapiens
caucaaaaccaucaaauug

SEQ ID NO: 486068 - RNA, 19 nt, Homo sapiens
gcaccacuuggaacaguuu

SEQ ID NO: 486069 - RNA, 19 nt, Homo sapiens
ucacaagccgguucagaau

SEQ ID NO: 486070 - RNA, 19 nt, Homo sapiens
guaggauacugcuuguuac

SEQ ID NO: 486071 - RNA, 19 nt, Homo sapiens
uagcaaacagucuuaggaa

SEQ ID NO: 486072 - RNA, 19 nt, Homo sapiens
uagacuguaugguuauuuc

SEQ ID NO: 486073 - RNA, 19 nt, Homo sapiens
gaagaaaucucaaacagua

SEQ ID NO: 486074 - RNA, 19 nt, Homo sapiens
gcaaagaucucaccaacaa

SEQ ID NO: 486075 - RNA, 19 nt, Homo sapiens
caaaguaccucaagucaaa

SEQ ID NO: 486076 - RNA, 19 nt, Homo sapiens
gaaagaagauaccuuggaa

SEQ ID NO: 486077 - RNA, 19 nt, Homo sapiens
gauagacgcuucauguuaa

SEQ ID NO: 486078 - RNA, 19 nt, Homo sapiens
ggaaagcucucaaagcaaa

SEQ ID NO: 486079 - RNA, 19 nt, Homo sapiens
gauggaagcuugagcauag

SEQ ID NO: 486080 - RNA, 19 nt, Homo sapiens
aaugaaagcuuccuaaaug

SEQ ID NO: 486081 - RNA, 19 nt, Homo sapiens
gaagauaccuuggaauuuu

SEQ ID NO: 486082 - RNA, 19 nt, Homo sapiens
gcuauucacuggugccaua

SEQ ID NO: 486083 - RNA, 19 nt, Homo sapiens
gaacagcucccuccagaga

SEQ ID NO: 486084 - RNA, 19 nt, Homo sapiens
gaaagcagcacauugucua

SEQ ID NO: 486085 - RNA, 19 nt, Homo sapiens
gaagaaauaaccgaaauga

SEQ ID NO: 486086 - RNA, 19 nt, Homo sapiens
caaggaaacacaugaaauu

SEQ ID NO: 486087 - RNA, 19 nt, Homo sapiens
guacuuaaaugcagacaca

SEQ ID NO: 486088 - RNA, 19 nt, Homo sapiens
aagcugcgcuccugacaua

SEQ ID NO: 486089 - RNA, 19 nt, Homo sapiens
gauauuguccaucgagaua

SEQ ID NO: 486090 - RNA, 19 nt, Homo sapiens
ggcaagaucuucggucaaa

SEQ ID NO: 486091 - RNA, 19 nt, Homo sapiens
ggacccagcugacagauac

SEQ ID NO: 486092 - RNA, 19 nt, Homo sapiens
caagauagacgcuucaugu

SEQ ID NO: 486093 - RNA, 19 nt, Homo sapiens
cuaagacgauggaggaauu

SEQ ID NO: 486094 - RNA, 19 nt, Homo sapiens
aaagagaccuccagagaag

SEQ ID NO: 486095 - RNA, 19 nt, Homo sapiens
gaaggagccuauggaguug

SEQ ID NO: 486096 - RNA, 19 nt, Homo sapiens
gcccugaucuucugacguu

SEQ ID NO: 486097 - RNA, 19 nt, Homo sapiens
cggcauagcuauauugaca

SEQ ID NO: 486098 - RNA, 19 nt, Homo sapiens
caacauaccacaccuucuu

SEQ ID NO: 486099 - RNA, 19 nt, Homo sapiens
ugaaggagccuauggaguu

SEQ ID NO: 486100 - RNA, 19 nt, Homo sapiens
ggaaaaguccugaaaauau

SEQ ID NO: 486101 - RNA, 19 nt, Homo sapiens
agacaauucuuuccaugaa

SEQ ID NO: 486102 - RNA, 19 nt, Homo sapiens
ugaauaguguucuacuuga

SEQ ID NO: 486103 - RNA, 19 nt, Homo sapiens
ucaaagagaccuccagaga

SEQ ID NO: 486104 - RNA, 19 nt, Homo sapiens
ggaaagaagauaccuugga

SEQ ID NO: 486105 - RNA, 19 nt, Homo sapiens
caaagagaccuccagagaa

SEQ ID NO: 486106 - RNA, 19 nt, Homo sapiens
gaagauuccuaacauuggu

SEQ ID NO: 486107 - RNA, 19 nt, Homo sapiens
gaaauuguggcgaucaaga

SEQ ID NO: 486108 - RNA, 19 nt, Homo sapiens
cgacagcccugaucuucug

SEQ ID NO: 486109 - RNA, 19 nt, Homo sapiens
ccaauuaacaccaaugaau

SEQ ID NO: 486110 - RNA, 19 nt, Homo sapiens
agauagacgcuucauguua

SEQ ID NO: 486111 - RNA, 19 nt, Homo sapiens
ggacaaaguaccucaaguc

SEQ ID NO: 486112 - RNA, 19 nt, Homo sapiens
uugcagaaauccauucauu

SEQ ID NO: 486113 - RNA, 19 nt, Homo sapiens
aaggagaguugguagcuuu

SEQ ID NO: 486114 - RNA, 19 nt, Homo sapiens
gacaguagccauucccauu

SEQ ID NO: 486115 - RNA, 19 nt, Homo sapiens
gcaaggacauccagaaccu

SEQ ID NO: 486116 - RNA, 19 nt, Homo sapiens
ggaguugaaggaagcauuu

SEQ ID NO: 486117 - RNA, 19 nt, Homo sapiens
cuauggaguuguacuuaaa

SEQ ID NO: 486118 - RNA, 19 nt, Homo sapiens
caugaagauuccuaacauu

SEQ ID NO: 486119 - RNA, 19 nt, Homo sapiens
ucaccucucucauggaaga

SEQ ID NO: 486120 - RNA, 19 nt, Homo sapiens
gaagacagagacaccauuc

SEQ ID NO: 486121 - RNA, 19 nt, Homo sapiens
gaaucacccuacauuucaa

SEQ ID NO: 486122 - RNA, 19 nt, Homo sapiens
ccuauggaguuguacuuaa

SEQ ID NO: 486123 - RNA, 19 nt, Homo sapiens
guagguacuucccaucuag

SEQ ID NO: 486124 - RNA, 19 nt, Homo sapiens
gaagccagggcccaaauug

SEQ ID NO: 486125 - RNA, 19 nt, Homo sapiens
gggagucauuuaauacuuc

SEQ ID NO: 486126 - RNA, 19 nt, Homo sapiens
gcagcacauugucuaauag

SEQ ID NO: 486127 - RNA, 19 nt, Homo sapiens
ccacaaugauguccuaaaa

SEQ ID NO: 486128 - RNA, 19 nt, Homo sapiens
gcauagcuauauugacaca

SEQ ID NO: 486129 - RNA, 19 nt, Homo sapiens
uggaagaaaugccaaaugg

SEQ ID NO: 486130 - RNA, 19 nt, Homo sapiens
ucgaauugcuggaagaaau

SEQ ID NO: 486131 - RNA, 19 nt, Homo sapiens
ucaugaagauuccuaacau

SEQ ID NO: 486132 - RNA, 19 nt, Homo sapiens
caaugaaagcuuccuaaau

SEQ ID NO: 486133 - RNA, 19 nt, Homo sapiens
uaggaccacuuccaucuga

SEQ ID NO: 486134 - RNA, 19 nt, Homo sapiens
caaagaaaauagacaccua

SEQ ID NO: 486135 - RNA, 19 nt, Homo sapiens
gaaccgccacucauucaug

SEQ ID NO: 486136 - RNA, 19 nt, Homo sapiens
aagaagauaccuuggaauu

SEQ ID NO: 486137 - RNA, 19 nt, Homo sapiens
ucggugggcuguauucuug

SEQ ID NO: 486138 - RNA, 19 nt, Homo sapiens
aaucaccucucucauggaa

SEQ ID NO: 486139 - RNA, 19 nt, Homo sapiens
ggaagaaauaaccgaaaug

SEQ ID NO: 486140 - RNA, 19 nt, Homo sapiens
gcagaaccgccacucauuc

SEQ ID NO: 486141 - RNA, 19 nt, Homo sapiens
caaaagaagccaagucaaa

SEQ ID NO: 486142 - RNA, 19 nt, Homo sapiens
uauuguccaucgagauaua

SEQ ID NO: 486143 - RNA, 19 nt, Homo sapiens
gaucuuacugcacagcuuu

SEQ ID NO: 486144 - RNA, 19 nt, Homo sapiens
ccaaugaaagcuuccuaaa

SEQ ID NO: 486145 - RNA, 19 nt, Homo sapiens
agaauuuacugaaguugga

SEQ ID NO: 486146 - RNA, 19 nt, Homo sapiens
ggagucauuuaauacuuca

SEQ ID NO: 486147 - RNA, 19 nt, Homo sapiens
uaaaaucacugcgcaaguu

SEQ ID NO: 486148 - RNA, 19 nt, Homo sapiens
ccacaaccagacauucuaa

SEQ ID NO: 486149 - RNA, 19 nt, Homo sapiens
uggaagaaauaaccgaaau

SEQ ID NO: 486150 - RNA, 19 nt, Homo sapiens
agcagcacauugucuaaua

SEQ ID NO: 486151 - RNA, 19 nt, Homo sapiens
cuacuugaccuaaugaaga

SEQ ID NO: 486152 - RNA, 19 nt, Homo sapiens
cuacaucuaucagcuaauc

SEQ ID NO: 486153 - RNA, 19 nt, Homo sapiens
ugacauaccaugagaaugc

SEQ ID NO: 486154 - RNA, 19 nt, Homo sapiens
aagaagaaaucucaaacag

SEQ ID NO: 486155 - RNA, 19 nt, Homo sapiens
gaaggucucccugccaaug

SEQ ID NO: 486156 - RNA, 19 nt, Homo sapiens
aaagugaaauugaccaacu

SEQ ID NO: 486157 - RNA, 19 nt, Homo sapiens
cgauggacagccuuuauuu

SEQ ID NO: 486158 - RNA, 19 nt, Homo sapiens
gacaaaguaccucaaguca

SEQ ID NO: 486159 - RNA, 19 nt, Homo sapiens
acagauacuugacagaaca

SEQ ID NO: 486160 - RNA, 19 nt, Homo sapiens
ggaagaaaugccaaaugga

SEQ ID NO: 486161 - RNA, 19 nt, Homo sapiens
agagaugacuguggcaaga

SEQ ID NO: 486162 - RNA, 19 nt, Homo sapiens
ggauggaagcuugagcaua

SEQ ID NO: 486163 - RNA, 19 nt, Homo sapiens
guaugugacccgugacaaa

SEQ ID NO: 486164 - RNA, 19 nt, Homo sapiens
cagcagaucucagcagaac

SEQ ID NO: 486165 - RNA, 19 nt, Homo sapiens
ugacagauacuugacagaa

SEQ ID NO: 486166 - RNA, 19 nt, Homo sapiens
gcgauggacagccuuuauu

SEQ ID NO: 486167 - RNA, 19 nt, Homo sapiens
ucagaaggcaauaaugcua

SEQ ID NO: 486168 - RNA, 19 nt, Homo sapiens
ccauaagaaugauauuguc

SEQ ID NO: 486169 - RNA, 19 nt, Homo sapiens
aauaaugugucaacuagag

SEQ ID NO: 486170 - RNA, 19 nt, Homo sapiens
caacagccugcaacucuug

SEQ ID NO: 486171 - RNA, 19 nt, Homo sapiens
ccaacagccugcaacucuu

SEQ ID NO: 486172 - RNA, 19 nt, Homo sapiens
gaaaagcagagucggcaua

SEQ ID NO: 486173 - RNA, 19 nt, Homo sapiens
gagggaggcugaaauguuu

SEQ ID NO: 486174 - RNA, 19 nt, Homo sapiens
gaaacgagauuccuucauc

SEQ ID NO: 486175 - RNA, 19 nt, Homo sapiens
ccaguuugcuuuccacuua

SEQ ID NO: 486176 - RNA, 19 nt, Homo sapiens
guaccaaucucuccacuga

SEQ ID NO: 486177 - RNA, 19 nt, Homo sapiens
gaaagucccgcgaauauga

SEQ ID NO: 486178 - RNA, 19 nt, Homo sapiens
gaagaaggaugaggagaug

SEQ ID NO: 486179 - RNA, 19 nt, Homo sapiens
gggagaagcuggccaaugg

SEQ ID NO: 486180 - RNA, 19 nt, Homo sapiens
gagaaagucccgcgaauau

SEQ ID NO: 486181 - RNA, 19 nt, Homo sapiens
gcgagugccucaugaagaa

SEQ ID NO: 486182 - RNA, 19 nt, Homo sapiens
ccaagaaucugaagacucu

SEQ ID NO: 486183 - RNA, 19 nt, Homo sapiens
agaaagaggugaagaacga

SEQ ID NO: 486184 - RNA, 19 nt, Homo sapiens
gaaaucaacgccaagaaga

SEQ ID NO: 486185 - RNA, 19 nt, Homo sapiens
caaguggucuguagaguuc

SEQ ID NO: 486186 - RNA, 19 nt, Homo sapiens
gggaagcuguggaucauga

SEQ ID NO: 486187 - RNA, 19 nt, Homo sapiens
ccacugaccugucgcugaa

SEQ ID NO: 486188 - RNA, 19 nt, Homo sapiens
gaagauagcccuggauaag

SEQ ID NO: 486189 - RNA, 19 nt, Homo sapiens
gugagaagaucaagcaguu

SEQ ID NO: 486190 - RNA, 19 nt, Homo sapiens
ucaaacugaugaagaaaga

SEQ ID NO: 486191 - RNA, 19 nt, Homo sapiens
gucaauggaugccagaauu

SEQ ID NO: 486192 - RNA, 19 nt, Homo sapiens
cauguuagguggagcaguu

SEQ ID NO: 486193 - RNA, 19 nt, Homo sapiens
gaaagagggaggcugaaau

SEQ ID NO: 486194 - RNA, 19 nt, Homo sapiens
gagcaaaugcauaaacguu

SEQ ID NO: 486195 - RNA, 19 nt, Homo sapiens
ggugagguguaauuauuug

SEQ ID NO: 486196 - RNA, 19 nt, Homo sapiens
ucaaggacccgaaacugua

SEQ ID NO: 486197 - RNA, 19 nt, Homo sapiens
caccugaaccuaauguaua

SEQ ID NO: 486198 - RNA, 19 nt, Homo sapiens
gcaaaugcauaaacguuuu

SEQ ID NO: 486199 - RNA, 19 nt, Homo sapiens
agauagcccuggauaagaa

SEQ ID NO: 486200 - RNA, 19 nt, Homo sapiens
aggaggagcuggaggacua

SEQ ID NO: 486201 - RNA, 19 nt, Homo sapiens
ccaaagucauugaaaccaa

SEQ ID NO: 486202 - RNA, 19 nt, Homo sapiens
ggaaagagggaggcugaaa

SEQ ID NO: 486203 - RNA, 19 nt, Homo sapiens
aagaagagccuccacauca

SEQ ID NO: 486204 - RNA, 19 nt, Homo sapiens
uggagaagauggagcaaga

SEQ ID NO: 486205 - RNA, 19 nt, Homo sapiens
gagcgcgagugccucauga

SEQ ID NO: 486206 - RNA, 19 nt, Homo sapiens
ggaaaucaacgccaagaag

SEQ ID NO: 486207 - RNA, 19 nt, Homo sapiens
gcuuuccacuuaagacaaa

SEQ ID NO: 486208 - RNA, 19 nt, Homo sapiens
gagguguaauuauuuguca

SEQ ID NO: 486209 - RNA, 19 nt, Homo sapiens
ggagggugagguguaauua

SEQ ID NO: 486210 - RNA, 19 nt, Homo sapiens
cagcguuccugacuucuug

SEQ ID NO: 486211 - RNA, 19 nt, Homo sapiens
gcacgaaacccagaaacug

SEQ ID NO: 486212 - RNA, 19 nt, Homo sapiens
gcaugaagcagaagaugga

SEQ ID NO: 486213 - RNA, 19 nt, Homo sapiens
ggacagaucccuccaaacc

SEQ ID NO: 486214 - RNA, 19 nt, Homo sapiens
gaucaugauugaguucugu

SEQ ID NO: 486215 - RNA, 19 nt, Homo sapiens
ugaagcagcagcucaaaga

SEQ ID NO: 486216 - RNA, 19 nt, Homo sapiens
caagcggacacgcaaauuu

SEQ ID NO: 486217 - RNA, 19 nt, Homo sapiens
gccauucccugcagaguca

SEQ ID NO: 486218 - RNA, 19 nt, Homo sapiens
agggugagguguaauuauu

SEQ ID NO: 486219 - RNA, 19 nt, Homo sapiens
guucugcggaugcuucuua

SEQ ID NO: 486220 - RNA, 19 nt, Homo sapiens
agaagagccuccacaucaa

SEQ ID NO: 486221 - RNA, 19 nt, Homo sapiens
gcucaaagaccaguacuuc

SEQ ID NO: 486222 - RNA, 19 nt, Homo sapiens
ggaaggaaagcaugaagca

SEQ ID NO: 486223 - RNA, 19 nt, Homo sapiens
gaaagcaugaagcagaaga

SEQ ID NO: 486224 - RNA, 19 nt, Homo sapiens
ucagcagcaucaccaguaa

SEQ ID NO: 486225 - RNA, 19 nt, Homo sapiens
ggagucccaccuugcauuu

SEQ ID NO: 486226 - RNA, 19 nt, Homo sapiens
ugaagaaagaggugaagaa

SEQ ID NO: 486227 - RNA, 19 nt, Homo sapiens
gcgaagaugagaagaagga

SEQ ID NO: 486228 - RNA, 19 nt, Homo sapiens
ggagaaccauacucagaac

SEQ ID NO: 486229 - RNA, 19 nt, Homo sapiens
caacccagucugcuccaua

SEQ ID NO: 486230 - RNA, 19 nt, Homo sapiens
cuacaaccagcgcaugaua

SEQ ID NO: 486231 - RNA, 19 nt, Homo sapiens
gaagaaagaggugaagaac

SEQ ID NO: 486232 - RNA, 19 nt, Homo sapiens
gcagccaacagaucucaaa

SEQ ID NO: 486233 - RNA, 19 nt, Homo sapiens
gaaacacgagaaccagaug

SEQ ID NO: 486234 - RNA, 19 nt, Homo sapiens
cagcgaagaugagaagaag

SEQ ID NO: 486235 - RNA, 19 nt, Homo sapiens
cgacagcagcggaaggaaa

SEQ ID NO: 486236 - RNA, 19 nt, Homo sapiens
ugauugagauggcccagau

SEQ ID NO: 486237 - RNA, 19 nt, Homo sapiens
aaagagggaggcugaaaug

SEQ ID NO: 486238 - RNA, 19 nt, Homo sapiens
cucaggagauggccucauu

SEQ ID NO: 486239 - RNA, 19 nt, Homo sapiens
gaaccuggagcgucagcaa

SEQ ID NO: 486240 - RNA, 19 nt, Homo sapiens
agacccagcugaguaacaa

SEQ ID NO: 486241 - RNA, 19 nt, Homo sapiens
uuuacaaggccaagaauaa

SEQ ID NO: 486242 - RNA, 19 nt, Homo sapiens
ugaaagacacgcccuacga

SEQ ID NO: 486243 - RNA, 19 nt, Homo sapiens
ccuaauguauauucuccuu

SEQ ID NO: 486244 - RNA, 19 nt, Homo sapiens
aagaugagaagaaggauga

SEQ ID NO: 486245 - RNA, 19 nt, Homo sapiens
gcacacacauacgcguaca

SEQ ID NO: 486246 - RNA, 19 nt, Homo sapiens
ggucaggguccaagaggaa

SEQ ID NO: 486247 - RNA, 19 nt, Homo sapiens
aggaaagcaugaagcagaa

SEQ ID NO: 486248 - RNA, 19 nt, Homo sapiens
ggacuaugguaccaaucuc

SEQ ID NO: 486249 - RNA, 19 nt, Homo sapiens
agagaaagucccgcgaaua

SEQ ID NO: 486250 - RNA, 19 nt, Homo sapiens
ccaaguggucuguagaguu

SEQ ID NO: 486251 - RNA, 19 nt, Homo sapiens
ccgagguggucauguguga

SEQ ID NO: 486252 - RNA, 19 nt, Homo sapiens
accagaaccugaaggaaug

SEQ ID NO: 486253 - RNA, 19 nt, Homo sapiens
cacgaaacccagaaacuga

SEQ ID NO: 486254 - RNA, 19 nt, Homo sapiens
ucauugaaaccaagaguga

SEQ ID NO: 486255 - RNA, 19 nt, Homo sapiens
ggacuacaucguggagauu

SEQ ID NO: 486256 - RNA, 19 nt, Homo sapiens
caagaagagccuccacauc

SEQ ID NO: 486257 - RNA, 19 nt, Homo sapiens
ccaacgaggugugggagau

SEQ ID NO: 486258 - RNA, 19 nt, Homo sapiens
gaugaggagaugagauuuc

SEQ ID NO: 486259 - RNA, 19 nt, Homo sapiens
gagagcauggacuauggua

SEQ ID NO: 486260 - RNA, 19 nt, Homo sapiens
ugaagauagcccuggauaa

SEQ ID NO: 486261 - RNA, 19 nt, Homo sapiens
acacauacgcguacacaca

SEQ ID NO: 486262 - RNA, 19 nt, Homo sapiens
agagggaggcugaaauguu

SEQ ID NO: 486263 - RNA, 19 nt, Homo sapiens
cauucucugugaacaugua

SEQ ID NO: 486264 - RNA, 19 nt, Homo sapiens
gaagaacgagguggagaag

SEQ ID NO: 486265 - RNA, 19 nt, Homo sapiens
gagguggucaugugugaga

SEQ ID NO: 486266 - RNA, 19 nt, Homo sapiens
ugaagacucuacagaaacg

SEQ ID NO: 486267 - RNA, 19 nt, Homo sapiens
gaagcuguggaucaugauu

SEQ ID NO: 486268 - RNA, 19 nt, Homo sapiens
gggugagguguaauuauuu

SEQ ID NO: 486269 - RNA, 19 nt, Homo sapiens
gagcaggagauguucuuca

SEQ ID NO: 486270 - RNA, 19 nt, Homo sapiens
aagagaaagucccgcgaau

SEQ ID NO: 486271 - RNA, 19 nt, Homo sapiens
ugugugagaccaugaaaga

SEQ ID NO: 486272 - RNA, 19 nt, Homo sapiens
gcagaauguauauaacaca

SEQ ID NO: 486273 - RNA, 19 nt, Homo sapiens
ggacugacguguagaacaa

SEQ ID NO: 486274 - RNA, 19 nt, Homo sapiens
ugaaagggaugcuugagua

SEQ ID NO: 486275 - RNA, 19 nt, Homo sapiens
gaaggaaauucaacuacug

SEQ ID NO: 486276 - RNA, 19 nt, Homo sapiens
gaagaaggaaauucaacua

SEQ ID NO: 486277 - RNA, 19 nt, Homo sapiens
gcacgcggcuuguugacuu

SEQ ID NO: 486278 - RNA, 19 nt, Homo sapiens
gagaagcguuucccagugu

SEQ ID NO: 486279 - RNA, 19 nt, Homo sapiens
gggacaacaucuacaaguu

SEQ ID NO: 486280 - RNA, 19 nt, Homo sapiens
ucaagauccucaagaagaa

SEQ ID NO: 486281 - RNA, 19 nt, Homo sapiens
gaagggaagucggaacaca

SEQ ID NO: 486282 - RNA, 19 nt, Homo sapiens
agugugcggucaauauuua

SEQ ID NO: 486283 - RNA, 19 nt, Homo sapiens
guacuucugucagcugauu

SEQ ID NO: 486284 - RNA, 19 nt, Homo sapiens
aagaagaaguugcgaagga

SEQ ID NO: 486285 - RNA, 19 nt, Homo sapiens
ggagugugcggucaauauu

SEQ ID NO: 486286 - RNA, 19 nt, Homo sapiens
aaauguauauggugaugga

SEQ ID NO: 486287 - RNA, 19 nt, Homo sapiens
gucaagauccucaagaaga

SEQ ID NO: 486288 - RNA, 19 nt, Homo sapiens
gaaacauccuccggcugaa

SEQ ID NO: 486289 - RNA, 19 nt, Homo sapiens
uguauauggugauggagua

SEQ ID NO: 486290 - RNA, 19 nt, Homo sapiens
ccaccgaggucaucuacca

SEQ ID NO: 486291 - RNA, 19 nt, Homo sapiens
caucuacacucaggacuuc

SEQ ID NO: 486292 - RNA, 19 nt, Homo sapiens
gaagucggaacacaaggaa

SEQ ID NO: 486293 - RNA, 19 nt, Homo sapiens
ugacuguggugccguacuu

SEQ ID NO: 486294 - RNA, 19 nt, Homo sapiens
gaaaauguauauggugaug

SEQ ID NO: 486295 - RNA, 19 nt, Homo sapiens
caacgaagagaagcagaaa

SEQ ID NO: 486296 - RNA, 19 nt, Homo sapiens
ggaggccagucacaaugga

SEQ ID NO: 486297 - RNA, 19 nt, Homo sapiens
ccaacggccuggacaccuu

SEQ ID NO: 486298 - RNA, 19 nt, Homo sapiens
gcaggagggccgucaagau

SEQ ID NO: 486299 - RNA, 19 nt, Homo sapiens
ggaagucggaacacaagga

SEQ ID NO: 486300 - RNA, 19 nt, Homo sapiens
gcaggagugugcggucaau

SEQ ID NO: 486301 - RNA, 19 nt, Homo sapiens
ccaaggccguguguaugaa

SEQ ID NO: 486302 - RNA, 19 nt, Homo sapiens
aaucguuucuguuggaaga

SEQ ID NO: 486303 - RNA, 19 nt, Homo sapiens
ucucugaccugcugaaagg

SEQ ID NO: 486304 - RNA, 19 nt, Homo sapiens
gaagagaagcagaaaaugu

SEQ ID NO: 486305 - RNA, 19 nt, Homo sapiens
gagaagggaagucggaaca

SEQ ID NO: 486306 - RNA, 19 nt, Homo sapiens
gagugugcggucaauauuu

SEQ ID NO: 486307 - RNA, 19 nt, Homo sapiens
gaggaggccagucacaaug

SEQ ID NO: 486308 - RNA, 19 nt, Homo sapiens
gaagaggaggccagucaca

SEQ ID NO: 486309 - RNA, 19 nt, Homo sapiens
cagaagaggaggccaguca

SEQ ID NO: 486310 - RNA, 19 nt, Homo sapiens
ggccuggaguaccugcaua

SEQ ID NO: 486311 - RNA, 19 nt, Homo sapiens
gcugguggauguguuauac

SEQ ID NO: 486312 - RNA, 19 nt, Homo sapiens
agaaggaaauucaacuacu

SEQ ID NO: 486313 - RNA, 19 nt, Homo sapiens
ccgucaagauccucaagaa

SEQ ID NO: 486314 - RNA, 19 nt, Homo sapiens
ccaagcucaucggcaagua

SEQ ID NO: 486315 - RNA, 19 nt, Homo sapiens
gaaagggaugcuugaguac

SEQ ID NO: 486316 - RNA, 19 nt, Homo sapiens
ccagcugguggauguguua

SEQ ID NO: 486317 - RNA, 19 nt, Homo sapiens
agaagaaguugcgaaggau

SEQ ID NO: 486318 - RNA, 19 nt, Homo sapiens
caacgugaagaaggaaauu

SEQ ID NO: 486319 - RNA, 19 nt, Homo sapiens
caggagggccgucaagauc

SEQ ID NO: 486320 - RNA, 19 nt, Homo sapiens
ugguggauguguuauacaa

SEQ ID NO: 486321 - RNA, 19 nt, Homo sapiens
cccaaggccguguguauga

SEQ ID NO: 486322 - RNA, 19 nt, Homo sapiens
gauggaguacugcgugugu

SEQ ID NO: 486323 - RNA, 19 nt, Homo sapiens
cggccuccaugcacuuuau

SEQ ID NO: 486324 - RNA, 19 nt, Homo sapiens
aagggaugcuugaguacga

SEQ ID NO: 486325 - RNA, 19 nt, Homo sapiens
gcuucaagguggacaucug

SEQ ID NO: 486326 - RNA, 19 nt, Homo sapiens
gcucuuacggcaaggugaa

SEQ ID NO: 486327 - RNA, 19 nt, Homo sapiens
gggaggccaacgugaagaa

SEQ ID NO: 486328 - RNA, 19 nt, Homo sapiens
aagagaagcagaaaaugua

SEQ ID NO: 486329 - RNA, 19 nt, Homo sapiens
gcagugcacgcggcuuguu

SEQ ID NO: 486330 - RNA, 19 nt, Homo sapiens
cagcugagcaccaaaucca

SEQ ID NO: 486331 - RNA, 19 nt, Homo sapiens
gcgcagcugagcaccaaau

SEQ ID NO: 486332 - RNA, 19 nt, Homo sapiens
cugcauagccagggcauug

SEQ ID NO: 486333 - RNA, 19 nt, Homo sapiens
ggauguguuauacaacgaa

SEQ ID NO: 486334 - RNA, 19 nt, Homo sapiens
aggccaacgugaagaagga

SEQ ID NO: 486335 - RNA, 19 nt, Homo sapiens
aauaaaagguggauuugag

SEQ ID NO: 486336 - RNA, 19 nt, Homo sapiens
ugauugacggccuggagua

SEQ ID NO: 486337 - RNA, 19 nt, Homo sapiens
aaggaaauucaacuacuga

SEQ ID NO: 486338 - RNA, 19 nt, Homo sapiens
cacuuuauguggagacuac

SEQ ID NO: 486339 - RNA, 19 nt, Homo sapiens
cagccgggacugacgugua

SEQ ID NO: 486340 - RNA, 19 nt, Homo sapiens
gcauagccagggcauugug

SEQ ID NO: 486341 - RNA, 19 nt, Homo sapiens
ggagggccgucaagauccu

SEQ ID NO: 486342 - RNA, 19 nt, Homo sapiens
gagaagcagaaaauguaua

SEQ ID NO: 486343 - RNA, 19 nt, Homo sapiens
gaugugagguuuccacuau

SEQ ID NO: 486344 - RNA, 19 nt, Homo sapiens
caagguagaugugagguuu

SEQ ID NO: 486345 - RNA, 19 nt, Homo sapiens
gauccaggcucaucuacaa

SEQ ID NO: 486346 - RNA, 19 nt, Homo sapiens
gcacagccacgauaauaga

SEQ ID NO: 486347 - RNA, 19 nt, Homo sapiens
gcgcacagccacgauaaua

SEQ ID NO: 486348 - RNA, 19 nt, Homo sapiens
cuacugccaugacaagaaa

SEQ ID NO: 486349 - RNA, 19 nt, Homo sapiens
ggacugaggcucccguuuc

SEQ ID NO: 486350 - RNA, 19 nt, Homo sapiens
gcauuggagugcucugcua

SEQ ID NO: 486351 - RNA, 19 nt, Homo sapiens
gcagaaaagcgagaaauua

SEQ ID NO: 486352 - RNA, 19 nt, Homo sapiens
gggagaacauaugaugaaa

SEQ ID NO: 486353 - RNA, 19 nt, Homo sapiens
gauaauagaggaaguugca

SEQ ID NO: 486354 - RNA, 19 nt, Homo sapiens
ucaggaauuucagccaaua

SEQ ID NO: 486355 - RNA, 19 nt, Homo sapiens
uuuccaggcuucucagaua

SEQ ID NO: 486356 - RNA, 19 nt, Homo sapiens
ggaaauuugggaaugugua

SEQ ID NO: 486357 - RNA, 19 nt, Homo sapiens
ccaccucauuugucuuuau

SEQ ID NO: 486358 - RNA, 19 nt, Homo sapiens
aggugaagauugcagauuu

SEQ ID NO: 486359 - RNA, 19 nt, Homo sapiens
ucaagucgcagauagagaa

SEQ ID NO: 486360 - RNA, 19 nt, Homo sapiens
gagaacauaugaugaaaag

SEQ ID NO: 486361 - RNA, 19 nt, Homo sapiens
cagaugcccugaccuacug

SEQ ID NO: 486362 - RNA, 19 nt, Homo sapiens
ggauauccacccuuugaga

SEQ ID NO: 486363 - RNA, 19 nt, Homo sapiens
gcgagaaauuagaugaaca

SEQ ID NO: 486364 - RNA, 19 nt, Homo sapiens
ccaauauccugcgccugua

SEQ ID NO: 486365 - RNA, 19 nt, Homo sapiens
caccucauuugucuuuauu

SEQ ID NO: 486366 - RNA, 19 nt, Homo sapiens
gugggacacuggacuacuu

SEQ ID NO: 486367 - RNA, 19 nt, Homo sapiens
ggggugagcucuacaagga

SEQ ID NO: 486368 - RNA, 19 nt, Homo sapiens
gcagauagagaaggaagga

SEQ ID NO: 486369 - RNA, 19 nt, Homo sapiens
ccgauggcgucaggaauuu

SEQ ID NO: 486370 - RNA, 19 nt, Homo sapiens
acaaggagcugcagaaaag

SEQ ID NO: 486371 - RNA, 19 nt, Homo sapiens
gaacauaugaugaaaaggu

SEQ ID NO: 486372 - RNA, 19 nt, Homo sapiens
guggauuuguggugcauug

SEQ ID NO: 486373 - RNA, 19 nt, Homo sapiens
guaccuggcucggcucaag

SEQ ID NO: 486374 - RNA, 19 nt, Homo sapiens
ggaauuucagccaauagga

SEQ ID NO: 486375 - RNA, 19 nt, Homo sapiens
gcgccuguauaacuauuuc

SEQ ID NO: 486376 - RNA, 19 nt, Homo sapiens
gaaauuugggaauguguac

SEQ ID NO: 486377 - RNA, 19 nt, Homo sapiens
ccaggaaguaccucucuga

SEQ ID NO: 486378 - RNA, 19 nt, Homo sapiens
gacugaggcucccguuucu

SEQ ID NO: 486379 - RNA, 19 nt, Homo sapiens
gaccgcagcacuccaguuc

SEQ ID NO: 486380 - RNA, 19 nt, Homo sapiens
gaaaagcgagaaauuagau

SEQ ID NO: 486381 - RNA, 19 nt, Homo sapiens
ucagauaccagcccuugga

SEQ ID NO: 486382 - RNA, 19 nt, Homo sapiens
aauaggagccagccaggaa

SEQ ID NO: 486383 - RNA, 19 nt, Homo sapiens
cuacuugccgccagaaaug

SEQ ID NO: 486384 - RNA, 19 nt, Homo sapiens
ggugaagauugcagauuuu

SEQ ID NO: 486385 - RNA, 19 nt, Homo sapiens
ccgcgaagccuguguagca

SEQ ID NO: 486386 - RNA, 19 nt, Homo sapiens
ugagagcgccucccacagu

SEQ ID NO: 486387 - RNA, 19 nt, Homo sapiens
gcagaugcccugaccuacu

SEQ ID NO: 486388 - RNA, 19 nt, Homo sapiens
aaagcgagaaauuagauga

SEQ ID NO: 486389 - RNA, 19 nt, Homo sapiens
ugugagguuuccacuauca

SEQ ID NO: 486390 - RNA, 19 nt, Homo sapiens
ugggauauccacccuuuga

SEQ ID NO: 486391 - RNA, 19 nt, Homo sapiens
gaggugaagauugcagauu

SEQ ID NO: 486392 - RNA, 19 nt, Homo sapiens
uuggagugcucugcuauga

SEQ ID NO: 486393 - RNA, 19 nt, Homo sapiens
gagauauuaagccagagaa

SEQ ID NO: 486394 - RNA, 19 nt, Homo sapiens
cuacaaggagcugcagaaa

SEQ ID NO: 486395 - RNA, 19 nt, Homo sapiens
guguagcacugagacauca

SEQ ID NO: 486396 - RNA, 19 nt, Homo sapiens
gcucugccaccucauuugu

SEQ ID NO: 486397 - RNA, 19 nt, Homo sapiens
gagguuuccacuaucaaug

SEQ ID NO: 486398 - RNA, 19 nt, Homo sapiens
ccacgauaauagaggaagu

SEQ ID NO: 486399 - RNA, 19 nt, Homo sapiens
cagcgcacagccacgauaa

SEQ ID NO: 486400 - RNA, 19 nt, Homo sapiens
gucaggaauuucagccaau

SEQ ID NO: 486401 - RNA, 19 nt, Homo sapiens
ccguuucuguccuuucuau

SEQ ID NO: 486402 - RNA, 19 nt, Homo sapiens
guuucuguccuuucuauug

SEQ ID NO: 486403 - RNA, 19 nt, Homo sapiens
ccacagugagacuuacaga

SEQ ID NO: 486404 - RNA, 19 nt, Homo sapiens
agucgcagauagagaagga

SEQ ID NO: 486405 - RNA, 19 nt, Homo sapiens
uggcucggcucaaggaaag

SEQ ID NO: 486406 - RNA, 19 nt, Homo sapiens
gauggcgucaggaauuuca

SEQ ID NO: 486407 - RNA, 19 nt, Homo sapiens
gacgcauccucaagguaga

SEQ ID NO: 486408 - RNA, 19 nt, Homo sapiens
ggaccgcagcacuccaguu

SEQ ID NO: 486409 - RNA, 19 nt, Homo sapiens
ccucccacagugagacuua

SEQ ID NO: 486410 - RNA, 19 nt, Homo sapiens
ccugagaggaagacaaugu

SEQ ID NO: 486411 - RNA, 19 nt, Homo sapiens
caauauccugcgccuguau

SEQ ID NO: 486412 - RNA, 19 nt, Homo sapiens
acagacgcauccucaaggu

SEQ ID NO: 486413 - RNA, 19 nt, Homo sapiens
augagcugcuggugggaua

SEQ ID NO: 486414 - RNA, 19 nt, Homo sapiens
ggauuuguggugcauugga

SEQ ID NO: 486415 - RNA, 19 nt, Homo sapiens
ggcuacagcagaccaaaca

SEQ ID NO: 486416 - RNA, 19 nt, Homo sapiens
ggagaacauaugaugaaaa

SEQ ID NO: 486417 - RNA, 19 nt, Homo sapiens
uugcagaugcccugaccua

SEQ ID NO: 486418 - RNA, 19 nt, Homo sapiens
gccgggaaauugagaucca

SEQ ID NO: 486419 - RNA, 19 nt, Homo sapiens
ccaagaggcuccagaauaa

SEQ ID NO: 486420 - RNA, 19 nt, Homo sapiens
ucaaggagaugaagaagaa

SEQ ID NO: 486421 - RNA, 19 nt, Homo sapiens
guucauggcuggagaagug

SEQ ID NO: 486422 - RNA, 19 nt, Homo sapiens
gaaucaagccugaccaaga

SEQ ID NO: 486423 - RNA, 19 nt, Homo sapiens
ucaccgagcucccaucuuc

SEQ ID NO: 486424 - RNA, 19 nt, Homo sapiens
gcuccagaauaaaguauga

SEQ ID NO: 486425 - RNA, 19 nt, Homo sapiens
gggucccgcucaucaagua

SEQ ID NO: 486426 - RNA, 19 nt, Homo sapiens
gcgcuucgaugcggacuau

SEQ ID NO: 486427 - RNA, 19 nt, Homo sapiens
gcacccacccuguucucua

SEQ ID NO: 486428 - RNA, 19 nt, Homo sapiens
aaucaagccugaccaagag

SEQ ID NO: 486429 - RNA, 19 nt, Homo sapiens
agaagaacccuaugaccaa

SEQ ID NO: 486430 - RNA, 19 nt, Homo sapiens
ccacauggccaaaguguac

SEQ ID NO: 486431 - RNA, 19 nt, Homo sapiens
accaagaggcuccagaaua

SEQ ID NO: 486432 - RNA, 19 nt, Homo sapiens
augaagacaugaaggagaa

SEQ ID NO: 486433 - RNA, 19 nt, Homo sapiens
cccaagagcucaggaacau

SEQ ID NO: 486434 - RNA, 19 nt, Homo sapiens
gcagagggagugugcgaau

SEQ ID NO: 486435 - RNA, 19 nt, Homo sapiens
ccucagggauggagacucu

SEQ ID NO: 486436 - RNA, 19 nt, Homo sapiens
agaacccuaugaccaacua

SEQ ID NO: 486437 - RNA, 19 nt, Homo sapiens
gaaguucauggcuggagaa

SEQ ID NO: 486438 - RNA, 19 nt, Homo sapiens
gaggccagguucccaagag

SEQ ID NO: 486439 - RNA, 19 nt, Homo sapiens
acacgucguucaaggagau

SEQ ID NO: 486440 - RNA, 19 nt, Homo sapiens
ggucaagguggucuauguu

SEQ ID NO: 486441 - RNA, 19 nt, Homo sapiens
gaaggucaagguggucuau

SEQ ID NO: 486442 - RNA, 19 nt, Homo sapiens
caagaggcuccagaauaaa

SEQ ID NO: 486443 - RNA, 19 nt, Homo sapiens
cuggagaaguguccuaugg

SEQ ID NO: 486444 - RNA, 19 nt, Homo sapiens
gcggugaccuggaaaagug

SEQ ID NO: 486445 - RNA, 19 nt, Homo sapiens
ugaccaagaggcuccagaa

SEQ ID NO: 486446 - RNA, 19 nt, Homo sapiens
gagggagugugcgaaucaa

SEQ ID NO: 486447 - RNA, 19 nt, Homo sapiens
gcagaaugagcgcuucgau

SEQ ID NO: 486448 - RNA, 19 nt, Homo sapiens
gaggcuccagaauaaagua

SEQ ID NO: 486449 - RNA, 19 nt, Homo sapiens
gaccaagaggcuccagaau

SEQ ID NO: 486450 - RNA, 19 nt, Homo sapiens
gcgaaucaagccugaccaa

SEQ ID NO: 486451 - RNA, 19 nt, Homo sapiens
ucaccguggcgcagaauga

SEQ ID NO: 486452 - RNA, 19 nt, Homo sapiens
gagcugauccaggacaucu

SEQ ID NO: 486453 - RNA, 19 nt, Homo sapiens
uucucuaccucuucuauga

SEQ ID NO: 486454 - RNA, 19 nt, Homo sapiens
aaaagauccuggaguuugu

SEQ ID NO: 486455 - RNA, 19 nt, Homo sapiens
gcucaucaaguacuuugca

SEQ ID NO: 486456 - RNA, 19 nt, Homo sapiens
cgggugcccuuccuugagu

SEQ ID NO: 486457 - RNA, 19 nt, Homo sapiens
cacccacccuguucucuac

SEQ ID NO: 486458 - RNA, 19 nt, Homo sapiens
agagggagugugcgaauca

SEQ ID NO: 486459 - RNA, 19 nt, Homo sapiens
gaugaagaagaacccuaug

SEQ ID NO: 486460 - RNA, 19 nt, Homo sapiens
ucuaugaagacaugaagga

SEQ ID NO: 486461 - RNA, 19 nt, Homo sapiens
gucaagguggucuauguug

SEQ ID NO: 486462 - RNA, 19 nt, Homo sapiens
gaaacaaggucgacaacua

SEQ ID NO: 486463 - RNA, 19 nt, Homo sapiens
gaaccuaucuauacauuca

SEQ ID NO: 486464 - RNA, 19 nt, Homo sapiens
gcacagaggcugaaguuaa

SEQ ID NO: 486465 - RNA, 19 nt, Homo sapiens
gcacuucucuugauguaga

SEQ ID NO: 486466 - RNA, 19 nt, Homo sapiens
gaguuugacuucuugguua

SEQ ID NO: 486467 - RNA, 19 nt, Homo sapiens
gaagcagacucacuaacuu

SEQ ID NO: 486468 - RNA, 19 nt, Homo sapiens
gaagaaaacgggaaacuua

SEQ ID NO: 486469 - RNA, 19 nt, Homo sapiens
gagcacuucucuugaugua

SEQ ID NO: 486470 - RNA, 19 nt, Homo sapiens
ugaggucuguuucaaauuu

SEQ ID NO: 486471 - RNA, 19 nt, Homo sapiens
uagaagcuguuacaaguuu

SEQ ID NO: 486472 - RNA, 19 nt, Homo sapiens
gaaaggaagggccaagaaa

SEQ ID NO: 486473 - RNA, 19 nt, Homo sapiens
gaugguagcccaccuagaa

SEQ ID NO: 486474 - RNA, 19 nt, Homo sapiens
uaaaggaguuugacuucuu

SEQ ID NO: 486475 - RNA, 19 nt, Homo sapiens
caacugcacacaagagaua

SEQ ID NO: 486476 - RNA, 19 nt, Homo sapiens
gcaauggugagcaguguua

SEQ ID NO: 486477 - RNA, 19 nt, Homo sapiens
ggacagggaagaugacaaa

SEQ ID NO: 486478 - RNA, 19 nt, Homo sapiens
gaaauacgggacagaauug

SEQ ID NO: 486479 - RNA, 19 nt, Homo sapiens
ccaaauaaauagagucauc

SEQ ID NO: 486480 - RNA, 19 nt, Homo sapiens
uaaauagagucaucaguca

SEQ ID NO: 486481 - RNA, 19 nt, Homo sapiens
gacaaugaaucuagaagug

SEQ ID NO: 486482 - RNA, 19 nt, Homo sapiens
gagaaaagcgucauugaua

SEQ ID NO: 486483 - RNA, 19 nt, Homo sapiens
cacagaggcugaaguuaaa

SEQ ID NO: 486484 - RNA, 19 nt, Homo sapiens
guaaucaacugcacacaag

SEQ ID NO: 486485 - RNA, 19 nt, Homo sapiens
gagguggguuauacagaua

SEQ ID NO: 486486 - RNA, 19 nt, Homo sapiens
ccaaauaccacaaguugaa

SEQ ID NO: 486487 - RNA, 19 nt, Homo sapiens
caagggauauacaagcauu

SEQ ID NO: 486488 - RNA, 19 nt, Homo sapiens
ggagguggguuauacagau

SEQ ID NO: 486489 - RNA, 19 nt, Homo sapiens
ccuagaagcuguuacaagu

SEQ ID NO: 486490 - RNA, 19 nt, Homo sapiens
gcuugucccuguugaguaa

SEQ ID NO: 486491 - RNA, 19 nt, Homo sapiens
caacucuuccugccaaaua

SEQ ID NO: 486492 - RNA, 19 nt, Homo sapiens
caacaacgcauucucacuu

SEQ ID NO: 486493 - RNA, 19 nt, Homo sapiens
ccaauggccuuuacuugau

SEQ ID NO: 486494 - RNA, 19 nt, Homo sapiens
gcauugacauuuccuccuu

SEQ ID NO: 486495 - RNA, 19 nt, Homo sapiens
cagaugaaguggaagcauu

SEQ ID NO: 486496 - RNA, 19 nt, Homo sapiens
gaagugcagccacaacaaa

SEQ ID NO: 486497 - RNA, 19 nt, Homo sapiens
gaagacaggcacaucaaau

SEQ ID NO: 486498 - RNA, 19 nt, Homo sapiens
ccauaaagguccagugcuu

SEQ ID NO: 486499 - RNA, 19 nt, Homo sapiens
aaagaugcauugaggaaga

SEQ ID NO: 486500 - RNA, 19 nt, Homo sapiens
ggaaggagacaaugaaucu

SEQ ID NO: 486501 - RNA, 19 nt, Homo sapiens
aaucaggacucaguuguaa

SEQ ID NO: 486502 - RNA, 19 nt, Homo sapiens
cagacucacuaacuuauga

SEQ ID NO: 486503 - RNA, 19 nt, Homo sapiens
ggaguaugcucuuaaacag

SEQ ID NO: 486504 - RNA, 19 nt, Homo sapiens
gcaaacugauccacucgau

SEQ ID NO: 486505 - RNA, 19 nt, Homo sapiens
gaaaacagccccagccaaa

SEQ ID NO: 486506 - RNA, 19 nt, Homo sapiens
gcacacaagagauacagaa

SEQ ID NO: 486507 - RNA, 19 nt, Homo sapiens
agacguguauccaagaauu

SEQ ID NO: 486508 - RNA, 19 nt, Homo sapiens
caaugaagcagacucacua

SEQ ID NO: 486509 - RNA, 19 nt, Homo sapiens
ccuccgugcuggauaauuu

SEQ ID NO: 486510 - RNA, 19 nt, Homo sapiens
uaaagagacagcaaugauu

SEQ ID NO: 486511 - RNA, 19 nt, Homo sapiens
ggaaacacaacaacgcauu

SEQ ID NO: 486512 - RNA, 19 nt, Homo sapiens
caucagaggaucacacauu

SEQ ID NO: 486513 - RNA, 19 nt, Homo sapiens
gauaacagcaucagaggau

SEQ ID NO: 486514 - RNA, 19 nt, Homo sapiens
gagagauguugaugaacuu

SEQ ID NO: 486515 - RNA, 19 nt, Homo sapiens
ggucaaaacuacaagauau

SEQ ID NO: 486516 - RNA, 19 nt, Homo sapiens
agaugaagaugaugauguu

SEQ ID NO: 486517 - RNA, 19 nt, Homo sapiens
cagauacuauucuagaugu

SEQ ID NO: 486518 - RNA, 19 nt, Homo sapiens
ugaaauacgggacagaauu

SEQ ID NO: 486519 - RNA, 19 nt, Homo sapiens
ucaauacguuuauggaauc

SEQ ID NO: 486520 - RNA, 19 nt, Homo sapiens
cagaggaucacacauuaaa

SEQ ID NO: 486521 - RNA, 19 nt, Homo sapiens
gcagaugaagcccuugaaa

SEQ ID NO: 486522 - RNA, 19 nt, Homo sapiens
uaagacguguauccaagaa

SEQ ID NO: 486523 - RNA, 19 nt, Homo sapiens
gcacaucagcguuuguugu

SEQ ID NO: 486524 - RNA, 19 nt, Homo sapiens
acauggaacccuaaguuua

SEQ ID NO: 486525 - RNA, 19 nt, Homo sapiens
ugacagcggugaagaucga

SEQ ID NO: 486526 - RNA, 19 nt, Homo sapiens
uaugaagccuccaagcuau

SEQ ID NO: 486527 - RNA, 19 nt, Homo sapiens
ccugaggucuguuucaaau

SEQ ID NO: 486528 - RNA, 19 nt, Homo sapiens
gcagugacccgagccauau

SEQ ID NO: 486529 - RNA, 19 nt, Homo sapiens
acucugcguuuauggaaua

SEQ ID NO: 486530 - RNA, 19 nt, Homo sapiens
gacauggaacccuaaguuu

SEQ ID NO: 486531 - RNA, 19 nt, Homo sapiens
uuugagagauguugaugaa

SEQ ID NO: 486532 - RNA, 19 nt, Homo sapiens
aagaagcucuaaaggaguu

SEQ ID NO: 486533 - RNA, 19 nt, Homo sapiens
ugaugaagaugaagaugau

SEQ ID NO: 486534 - RNA, 19 nt, Homo sapiens
caacaaaacagccaguuaa

SEQ ID NO: 486535 - RNA, 19 nt, Homo sapiens
acaacgcauucucacuuua

SEQ ID NO: 486536 - RNA, 19 nt, Homo sapiens
uuaccaaacucaaggaaca

SEQ ID NO: 486537 - RNA, 19 nt, Homo sapiens
aaaggaguuugacuucuug

SEQ ID NO: 486538 - RNA, 19 nt, Homo sapiens
gugaagaucgagauacaaa

SEQ ID NO: 486539 - RNA, 19 nt, Homo sapiens
ugaagguaaugaaacagaa

SEQ ID NO: 486540 - RNA, 19 nt, Homo sapiens
ugaugaagguaaugaaaca

SEQ ID NO: 486541 - RNA, 19 nt, Homo sapiens
ccugagaaaucugguuaaa

SEQ ID NO: 486542 - RNA, 19 nt, Homo sapiens
ugagagauguugaugaacu

SEQ ID NO: 486543 - RNA, 19 nt, Homo sapiens
guuggaguaugcucuuaaa

SEQ ID NO: 486544 - RNA, 19 nt, Homo sapiens
gaaaguaagacguguaucc

SEQ ID NO: 486545 - RNA, 19 nt, Homo sapiens
uaacauggaaacacaacaa

SEQ ID NO: 486546 - RNA, 19 nt, Homo sapiens
ccacuaaucccaacaucga

SEQ ID NO: 486547 - RNA, 19 nt, Homo sapiens
ggagaacuagcaggccuua

SEQ ID NO: 486548 - RNA, 19 nt, Homo sapiens
acugggaccuggagaacua

SEQ ID NO: 486549 - RNA, 19 nt, Homo sapiens
gaauguggaccagggagua

SEQ ID NO: 486550 - RNA, 19 nt, Homo sapiens
gagcugacgcacuggcuaa

SEQ ID NO: 486551 - RNA, 19 nt, Homo sapiens
acaggcacaucaaauucua

SEQ ID NO: 486552 - RNA, 19 nt, Homo sapiens
augaagcccuugaaaguga

SEQ ID NO: 486553 - RNA, 19 nt, Homo sapiens
guggaagcauugacauuuc

SEQ ID NO: 486554 - RNA, 19 nt, Homo sapiens
gaaauuaauagggcagaug

SEQ ID NO: 486555 - RNA, 19 nt, Homo sapiens
ggaguuugacuucuugguu

SEQ ID NO: 486556 - RNA, 19 nt, Homo sapiens
ugaagaugaugauguugau

SEQ ID NO: 486557 - RNA, 19 nt, Homo sapiens
gaaguuaaagagacagcaa

SEQ ID NO: 486558 - RNA, 19 nt, Homo sapiens
gaaacacaacaacgcauuc

SEQ ID NO: 486559 - RNA, 19 nt, Homo sapiens
gcacucugcguuuauggaa

SEQ ID NO: 486560 - RNA, 19 nt, Homo sapiens
aucagaggaucacacauua

SEQ ID NO: 486561 - RNA, 19 nt, Homo sapiens
ggaagacauggaacccuaa

SEQ ID NO: 486562 - RNA, 19 nt, Homo sapiens
gaagucagaugucauuuca

SEQ ID NO: 486563 - RNA, 19 nt, Homo sapiens
caaaguucguuccaaguua

SEQ ID NO: 486564 - RNA, 19 nt, Homo sapiens
ggacagcgaugaugaugau

SEQ ID NO: 486565 - RNA, 19 nt, Homo sapiens
gaagacagcaaacaaaguu

SEQ ID NO: 486566 - RNA, 19 nt, Homo sapiens
ccaagaaggccgucaagua

SEQ ID NO: 486567 - RNA, 19 nt, Homo sapiens
cagcuucccuucccacauu

SEQ ID NO: 486568 - RNA, 19 nt, Homo sapiens
gaacagcauccgugagcua

SEQ ID NO: 486569 - RNA, 19 nt, Homo sapiens
aaaguucguuccaaguuaa

SEQ ID NO: 486570 - RNA, 19 nt, Homo sapiens
uaaagaagacagcaaacaa

SEQ ID NO: 486571 - RNA, 19 nt, Homo sapiens
ggaacacgcgguagacuau

SEQ ID NO: 486572 - RNA, 19 nt, Homo sapiens
gaugguggcuccuguuguc

SEQ ID NO: 486573 - RNA, 19 nt, Homo sapiens
caagaaggccgucaaguac

SEQ ID NO: 486574 - RNA, 19 nt, Homo sapiens
ggaccgagaccgcuucaug

SEQ ID NO: 486575 - RNA, 19 nt, Homo sapiens
gagagaugauugacaggau

SEQ ID NO: 486576 - RNA, 19 nt, Homo sapiens
caaacaaaguucguuccaa

SEQ ID NO: 486577 - RNA, 19 nt, Homo sapiens
aaagaagacagcaaacaaa

SEQ ID NO: 486578 - RNA, 19 nt, Homo sapiens
gagauucgaggcuucauug

SEQ ID NO: 486579 - RNA, 19 nt, Homo sapiens
gugaggagcuggaggacau

SEQ ID NO: 486580 - RNA, 19 nt, Homo sapiens
gaaaguuuguggaggucau

SEQ ID NO: 486581 - RNA, 19 nt, Homo sapiens
ggaagucagaugucauuuc

SEQ ID NO: 486582 - RNA, 19 nt, Homo sapiens
gcuggcuggugcccuauuu

SEQ ID NO: 486583 - RNA, 19 nt, Homo sapiens
ccaaggacagcgaugauga

SEQ ID NO: 486584 - RNA, 19 nt, Homo sapiens
ggacagcccagcucugagu

SEQ ID NO: 486585 - RNA, 19 nt, Homo sapiens
gcaggaccacgaccaguga

SEQ ID NO: 486586 - RNA, 19 nt, Homo sapiens
gaaggaggagcuggaagaa

SEQ ID NO: 486587 - RNA, 19 nt, Homo sapiens
ggaagaaaaucaugaucau

SEQ ID NO: 486588 - RNA, 19 nt, Homo sapiens
cgaaggaggagcuggaaga

SEQ ID NO: 486589 - RNA, 19 nt, Homo sapiens
ccaggacccucucccuugu

SEQ ID NO: 486590 - RNA, 19 nt, Homo sapiens
acuccacgcuguccagaaa

SEQ ID NO: 486591 - RNA, 19 nt, Homo sapiens
acagugagaucaucaagcu

SEQ ID NO: 486592 - RNA, 19 nt, Homo sapiens
ccucugggaucaucaugga

SEQ ID NO: 486593 - RNA, 19 nt, Homo sapiens
ggagauucgaggcuucauu

SEQ ID NO: 486594 - RNA, 19 nt, Homo sapiens
gaccugaggauccggaaga

SEQ ID NO: 486595 - RNA, 19 nt, Homo sapiens
ugucccagaugcaguauuc

SEQ ID NO: 486596 - RNA, 19 nt, Homo sapiens
aagccagcguugcauguuu

SEQ ID NO: 486597 - RNA, 19 nt, Homo sapiens
gaucgaguacaauguggaa

SEQ ID NO: 486598 - RNA, 19 nt, Homo sapiens
acaaccagcugcccauuuu

SEQ ID NO: 486599 - RNA, 19 nt, Homo sapiens
uuucaggccugcagucuca

SEQ ID NO: 486600 - RNA, 19 nt, Homo sapiens
gguggcuccuguugucuug

SEQ ID NO: 486601 - RNA, 19 nt, Homo sapiens
cagcgaugaugaugaugau

SEQ ID NO: 486602 - RNA, 19 nt, Homo sapiens
gacaggaucgaguacaaug

SEQ ID NO: 486603 - RNA, 19 nt, Homo sapiens
ggagagccagggagagaug

SEQ ID NO: 486604 - RNA, 19 nt, Homo sapiens
gcgaugaugaugaugaugu

SEQ ID NO: 486605 - RNA, 19 nt, Homo sapiens
acaaaguucguuccaaguu

SEQ ID NO: 486606 - RNA, 19 nt, Homo sapiens
gucaucgccuccacuguug

SEQ ID NO: 486607 - RNA, 19 nt, Homo sapiens
cgucaucgccuccacuguu

SEQ ID NO: 486608 - RNA, 19 nt, Homo sapiens
ucaucaagcuggagaacag

SEQ ID NO: 486609 - RNA, 19 nt, Homo sapiens
acauaaagaagacagcaaa

SEQ ID NO: 486610 - RNA, 19 nt, Homo sapiens
uugacaagaucgcagagaa

SEQ ID NO: 486611 - RNA, 19 nt, Homo sapiens
aggaggagcuggaagaacu

SEQ ID NO: 486612 - RNA, 19 nt, Homo sapiens
gcaaacaaaguucguucca

SEQ ID NO: 486613 - RNA, 19 nt, Homo sapiens
ggagcuggaagaacucaug

SEQ ID NO: 486614 - RNA, 19 nt, Homo sapiens
gaggcuucauugacaagau

SEQ ID NO: 486615 - RNA, 19 nt, Homo sapiens
ggugucacgugucccagau

SEQ ID NO: 486616 - RNA, 19 nt, Homo sapiens
gggcccagguucugcucuu

SEQ ID NO: 486617 - RNA, 19 nt, Homo sapiens
gcacagugagaucaucaag

SEQ ID NO: 486618 - RNA, 19 nt, Homo sapiens
auucgaggcuucauugaca

SEQ ID NO: 486619 - RNA, 19 nt, Homo sapiens
gcaagaggaaggccugaac

SEQ ID NO: 486620 - RNA, 19 nt, Homo sapiens
ggacaggcagggagaugca

SEQ ID NO: 486621 - RNA, 19 nt, Homo sapiens
ugauugacaggaucgagua

SEQ ID NO: 486622 - RNA, 19 nt, Homo sapiens
gagcuacacgacauguuca

SEQ ID NO: 486623 - RNA, 19 nt, Homo sapiens
uggaggucaugucggagua

SEQ ID NO: 486624 - RNA, 19 nt, Homo sapiens
aucaucaucugcuguguga

SEQ ID NO: 486625 - RNA, 19 nt, Homo sapiens
caaggacagcgaugaugau

SEQ ID NO: 486626 - RNA, 19 nt, Homo sapiens
gaacacgcgguagacuaug

SEQ ID NO: 486627 - RNA, 19 nt, Homo sapiens
gggcuucucaugggaaaug

SEQ ID NO: 486628 - RNA, 19 nt, Homo sapiens
ggccacauggugcugcuuu

SEQ ID NO: 486629 - RNA, 19 nt, Homo sapiens
agaaggccgucaaguacca

SEQ ID NO: 486630 - RNA, 19 nt, Homo sapiens
guacaaccagcugcccauu

SEQ ID NO: 486631 - RNA, 19 nt, Homo sapiens
gggaugguggcuccuguug

SEQ ID NO: 486632 - RNA, 19 nt, Homo sapiens
cgaugaugaugaugauguc

SEQ ID NO: 486633 - RNA, 19 nt, Homo sapiens
ugggaagucagaugucauu

SEQ ID NO: 486634 - RNA, 19 nt, Homo sapiens
gacauaaagaagacagcaa

SEQ ID NO: 486635 - RNA, 19 nt, Homo sapiens
ccuagaagccacccaaacu

SEQ ID NO: 486636 - RNA, 19 nt, Homo sapiens
gagacgcggcacagugaga

SEQ ID NO: 486637 - RNA, 19 nt, Homo sapiens
ugugaccacuguccguguu

SEQ ID NO: 486638 - RNA, 19 nt, Homo sapiens
cagcagcuagggaggcaaa

SEQ ID NO: 486639 - RNA, 19 nt, Homo sapiens
uugacaggaucgaguacaa

SEQ ID NO: 486640 - RNA, 19 nt, Homo sapiens
ugagcuacacgacauguuc

SEQ ID NO: 486641 - RNA, 19 nt, Homo sapiens
uacaaccagcugcccauuu

SEQ ID NO: 486642 - RNA, 19 nt, Homo sapiens
caagccagcguugcauguu

SEQ ID NO: 486643 - RNA, 19 nt, Homo sapiens
guuccaaguuaaagagcau

SEQ ID NO: 486644 - RNA, 19 nt, Homo sapiens
gagcuggaagaacucaugu

SEQ ID NO: 486645 - RNA, 19 nt, Homo sapiens
acacaggccacgcuuccuu

SEQ ID NO: 486646 - RNA, 19 nt, Homo sapiens
uggaacacgcgguagacua

SEQ ID NO: 486647 - RNA, 19 nt, Homo sapiens
caggaucgaguacaaugug

SEQ ID NO: 486648 - RNA, 19 nt, Homo sapiens
gagccagggagagaugauu

SEQ ID NO: 486649 - RNA, 19 nt, Homo sapiens
guggagagccagggagaga

SEQ ID NO: 486650 - RNA, 19 nt, Homo sapiens
gaggucaugucggaguaca

SEQ ID NO: 486651 - RNA, 19 nt, Homo sapiens
agccagcguugcauguuug

SEQ ID NO: 486652 - RNA, 19 nt, Homo sapiens
guccaucgagcaagaggaa

SEQ ID NO: 486653 - RNA, 19 nt, Homo sapiens
uggagagggccgugucuga

SEQ ID NO: 486654 - RNA, 19 nt, Homo sapiens
aagaagacagcaaacaaag

SEQ ID NO: 486655 - RNA, 19 nt, Homo sapiens
cuaaagagcugacuuguuu

SEQ ID NO: 486656 - RNA, 19 nt, Homo sapiens
gaaaugugaucuucccaua

SEQ ID NO: 486657 - RNA, 19 nt, Homo sapiens
gaacaucccucaguaacuu

SEQ ID NO: 486658 - RNA, 19 nt, Homo sapiens
gcacugaaauaaacugauu

SEQ ID NO: 486659 - RNA, 19 nt, Homo sapiens
gaaacuggcugcucauugu

SEQ ID NO: 486660 - RNA, 19 nt, Homo sapiens
ggagugagcuaaauugauc

SEQ ID NO: 486661 - RNA, 19 nt, Homo sapiens
cuaagaaacucuacaguau

SEQ ID NO: 486662 - RNA, 19 nt, Homo sapiens
ggagaagcauauugaagaa

SEQ ID NO: 486663 - RNA, 19 nt, Homo sapiens
aaacucggcuuaacauuga

SEQ ID NO: 486664 - RNA, 19 nt, Homo sapiens
uaggaaaucuucaagugua

SEQ ID NO: 486665 - RNA, 19 nt, Homo sapiens
guuguagucucucauauuu

SEQ ID NO: 486666 - RNA, 19 nt, Homo sapiens
gaaucagggugagauguua

SEQ ID NO: 486667 - RNA, 19 nt, Homo sapiens
ggaaagcucuugugagacu

SEQ ID NO: 486668 - RNA, 19 nt, Homo sapiens
gcagacagaagguauaauu

SEQ ID NO: 486669 - RNA, 19 nt, Homo sapiens
gaugaauacugggagaaua

SEQ ID NO: 486670 - RNA, 19 nt, Homo sapiens
gcuaagaaacucuacagua

SEQ ID NO: 486671 - RNA, 19 nt, Homo sapiens
gacaagaucucagaacaug

SEQ ID NO: 486672 - RNA, 19 nt, Homo sapiens
gaaacucggcuuaacauug

SEQ ID NO: 486673 - RNA, 19 nt, Homo sapiens
ccuaagcucuggaaauauu

SEQ ID NO: 486674 - RNA, 19 nt, Homo sapiens
caucugagguuaugcuuug

SEQ ID NO: 486675 - RNA, 19 nt, Homo sapiens
ugacucagcuaacaaucua

SEQ ID NO: 486676 - RNA, 19 nt, Homo sapiens
gcuaggaaaucuucaagug

SEQ ID NO: 486677 - RNA, 19 nt, Homo sapiens
gguaaaggacauuugcuua

SEQ ID NO: 486678 - RNA, 19 nt, Homo sapiens
gagcugacuuguuugaaau

SEQ ID NO: 486679 - RNA, 19 nt, Homo sapiens
caagaucucagaacaugua

SEQ ID NO: 486680 - RNA, 19 nt, Homo sapiens
ugggaaagcucuugugaga

SEQ ID NO: 486681 - RNA, 19 nt, Homo sapiens
ucaaggagcuucacgacau

SEQ ID NO: 486682 - RNA, 19 nt, Homo sapiens
ggagaaggcacgagaugaa

SEQ ID NO: 486683 - RNA, 19 nt, Homo sapiens
caaauacaaugaagcucaa

SEQ ID NO: 486684 - RNA, 19 nt, Homo sapiens
ucacugaauucuuaucaug

SEQ ID NO: 486685 - RNA, 19 nt, Homo sapiens
gcaaaaggcugacgguaug

SEQ ID NO: 486686 - RNA, 19 nt, Homo sapiens
gcucuuaguuguucagcuu

SEQ ID NO: 486687 - RNA, 19 nt, Homo sapiens
gaucauugacucacagauu

SEQ ID NO: 486688 - RNA, 19 nt, Homo sapiens
uuaaugagcuuggcagguu

SEQ ID NO: 486689 - RNA, 19 nt, Homo sapiens
ccuguugugugucagauua

SEQ ID NO: 486690 - RNA, 19 nt, Homo sapiens
gggcuuacaguuuggaaua

SEQ ID NO: 486691 - RNA, 19 nt, Homo sapiens
agggugagauguuagauaa

SEQ ID NO: 486692 - RNA, 19 nt, Homo sapiens
ggaaaucccagcacucugu

SEQ ID NO: 486693 - RNA, 19 nt, Homo sapiens
aagaaacucuacaguauca

SEQ ID NO: 486694 - RNA, 19 nt, Homo sapiens
agacagagccaaggcaaua

SEQ ID NO: 486695 - RNA, 19 nt, Homo sapiens
cccagaaacugcaauguau

SEQ ID NO: 486696 - RNA, 19 nt, Homo sapiens
gagcuucacgacauguuua

SEQ ID NO: 486697 - RNA, 19 nt, Homo sapiens
gaaacucuacaguaucauu

SEQ ID NO: 486698 - RNA, 19 nt, Homo sapiens
caacuuugagcuaggauaa

SEQ ID NO: 486699 - RNA, 19 nt, Homo sapiens
ggaaugugaucuaccugau

SEQ ID NO: 486700 - RNA, 19 nt, Homo sapiens
uggaggugaugaccaaaua

SEQ ID NO: 486701 - RNA, 19 nt, Homo sapiens
gcauggagaagcauauuga

SEQ ID NO: 486702 - RNA, 19 nt, Homo sapiens
ggccuuugcucuccucuga

SEQ ID NO: 486703 - RNA, 19 nt, Homo sapiens
gcucauuguuagaaaguga

SEQ ID NO: 486704 - RNA, 19 nt, Homo sapiens
cagaaacugcaauguauuu

SEQ ID NO: 486705 - RNA, 19 nt, Homo sapiens
ggcacgagaugaaacgaaa

SEQ ID NO: 486706 - RNA, 19 nt, Homo sapiens
agaagcauauugaagaaga

SEQ ID NO: 486707 - RNA, 19 nt, Homo sapiens
caccagaggcuacacagua

SEQ ID NO: 486708 - RNA, 19 nt, Homo sapiens
gggacaaggugcuagaauc

SEQ ID NO: 486709 - RNA, 19 nt, Homo sapiens
gacuuuguauugauuguga

SEQ ID NO: 486710 - RNA, 19 nt, Homo sapiens
gagcuuggcagguucuuug

SEQ ID NO: 486711 - RNA, 19 nt, Homo sapiens
gcuuugacuuuaacgcuuu

SEQ ID NO: 486712 - RNA, 19 nt, Homo sapiens
auccuaagcucuggaaaua

SEQ ID NO: 486713 - RNA, 19 nt, Homo sapiens
agagcugacuuguuugaaa

SEQ ID NO: 486714 - RNA, 19 nt, Homo sapiens
gaauacaacaugugaaggu

SEQ ID NO: 486715 - RNA, 19 nt, Homo sapiens
uguauucacucauguguuc

SEQ ID NO: 486716 - RNA, 19 nt, Homo sapiens
acaaggugcuagaauccua

SEQ ID NO: 486717 - RNA, 19 nt, Homo sapiens
gagaauggagucugaaugg

SEQ ID NO: 486718 - RNA, 19 nt, Homo sapiens
gcucgaaauuacuggcaaa

SEQ ID NO: 486719 - RNA, 19 nt, Homo sapiens
gaaucacuguggaaaugug

SEQ ID NO: 486720 - RNA, 19 nt, Homo sapiens
ccguugggcugaauuaaga

SEQ ID NO: 486721 - RNA, 19 nt, Homo sapiens
cgacugagauuaagaaaag

SEQ ID NO: 486722 - RNA, 19 nt, Homo sapiens
guaacuugauauucacaug

SEQ ID NO: 486723 - RNA, 19 nt, Homo sapiens
cucaguaacuugauauuca

SEQ ID NO: 486724 - RNA, 19 nt, Homo sapiens
cucccaaggugcuguauuu

SEQ ID NO: 486725 - RNA, 19 nt, Homo sapiens
gaagcauauugaagaagau

SEQ ID NO: 486726 - RNA, 19 nt, Homo sapiens
aaugugaucuucccauauc

SEQ ID NO: 486727 - RNA, 19 nt, Homo sapiens
caaggagcuucacgacaug

SEQ ID NO: 486728 - RNA, 19 nt, Homo sapiens
gcccauggcuaugauguca

SEQ ID NO: 486729 - RNA, 19 nt, Homo sapiens
gaucuucccauaucaucaa

SEQ ID NO: 486730 - RNA, 19 nt, Homo sapiens
caaaugaaucacuguggaa

SEQ ID NO: 486731 - RNA, 19 nt, Homo sapiens
gcgacccguuccuuuguuu

SEQ ID NO: 486732 - RNA, 19 nt, Homo sapiens
gagaaggcacgagaugaaa

SEQ ID NO: 486733 - RNA, 19 nt, Homo sapiens
gcaacaagagacaaaauaa

SEQ ID NO: 486734 - RNA, 19 nt, Homo sapiens
ucacucauguguuccagau

SEQ ID NO: 486735 - RNA, 19 nt, Homo sapiens
ggucuaaagagcugacuug

SEQ ID NO: 486736 - RNA, 19 nt, Homo sapiens
ggaaguuuguggaggugau

SEQ ID NO: 486737 - RNA, 19 nt, Homo sapiens
gaggaaacucggcuuaaca

SEQ ID NO: 486738 - RNA, 19 nt, Homo sapiens
gauaacauagaguugaaug

SEQ ID NO: 486739 - RNA, 19 nt, Homo sapiens
ugaagagcauggagaagca

SEQ ID NO: 486740 - RNA, 19 nt, Homo sapiens
ggagggaccaggaugauac

SEQ ID NO: 486741 - RNA, 19 nt, Homo sapiens
ucucauauuuacucaagga

SEQ ID NO: 486742 - RNA, 19 nt, Homo sapiens
uguagucucucauauuuac

SEQ ID NO: 486743 - RNA, 19 nt, Homo sapiens
cagcggcagcucgaaauua

SEQ ID NO: 486744 - RNA, 19 nt, Homo sapiens
uggagaagcauauugaaga

SEQ ID NO: 486745 - RNA, 19 nt, Homo sapiens
ggaaacucggcuuaacauu

SEQ ID NO: 486746 - RNA, 19 nt, Homo sapiens
ccauggcuaugaugucaga

SEQ ID NO: 486747 - RNA, 19 nt, Homo sapiens
uccauuagcuuccuuugca

SEQ ID NO: 486748 - RNA, 19 nt, Homo sapiens
caaggagggaccaggauga

SEQ ID NO: 486749 - RNA, 19 nt, Homo sapiens
ccaagcaagcccucaguga

SEQ ID NO: 486750 - RNA, 19 nt, Homo sapiens
gaacaccagaggcuacaca

SEQ ID NO: 486751 - RNA, 19 nt, Homo sapiens
ucaggaaguaggaaauaaa

SEQ ID NO: 486752 - RNA, 19 nt, Homo sapiens
gugugugucucaggaagua

SEQ ID NO: 486753 - RNA, 19 nt, Homo sapiens
auacagucaucugagguua

SEQ ID NO: 486754 - RNA, 19 nt, Homo sapiens
gggacuggcagaugucauu

SEQ ID NO: 486755 - RNA, 19 nt, Homo sapiens
ggaauaaaguccaggaguu

SEQ ID NO: 486756 - RNA, 19 nt, Homo sapiens
cgacaggccuuaaaugaga

SEQ ID NO: 486757 - RNA, 19 nt, Homo sapiens
ggaggaagcugaugagaac

SEQ ID NO: 486758 - RNA, 19 nt, Homo sapiens
gaauaaaguccaggaguug

SEQ ID NO: 486759 - RNA, 19 nt, Homo sapiens
ggccugcacuguccugauu

SEQ ID NO: 486760 - RNA, 19 nt, Homo sapiens
ggaagcugaugagaacuau

SEQ ID NO: 486761 - RNA, 19 nt, Homo sapiens
guuggcagcugcucauuca

SEQ ID NO: 486762 - RNA, 19 nt, Homo sapiens
ucacagugguuggauaaug

SEQ ID NO: 486763 - RNA, 19 nt, Homo sapiens
caacaagugcaauucaaug

SEQ ID NO: 486764 - RNA, 19 nt, Homo sapiens
gcacuaggagcaccaggaa

SEQ ID NO: 486765 - RNA, 19 nt, Homo sapiens
ggaggcagcugaagaucac

SEQ ID NO: 486766 - RNA, 19 nt, Homo sapiens
gcagaagggcagacaguuc

SEQ ID NO: 486767 - RNA, 19 nt, Homo sapiens
ccgaauaccgggagaagaa

SEQ ID NO: 486768 - RNA, 19 nt, Homo sapiens
aagcugaugagaacuauaa

SEQ ID NO: 486769 - RNA, 19 nt, Homo sapiens
ucguggagcucaucaacaa

SEQ ID NO: 486770 - RNA, 19 nt, Homo sapiens
cacagugguuggauaaugu

SEQ ID NO: 486771 - RNA, 19 nt, Homo sapiens
cacaagguccggacaauuc

SEQ ID NO: 486772 - RNA, 19 nt, Homo sapiens
gaaccugcgcgaugagauc

SEQ ID NO: 486773 - RNA, 19 nt, Homo sapiens
ccuccuagcagucaucauu

SEQ ID NO: 486774 - RNA, 19 nt, Homo sapiens
gaagaacguggagcggauu

SEQ ID NO: 486775 - RNA, 19 nt, Homo sapiens
ucaagacggcccuggagaa

SEQ ID NO: 486776 - RNA, 19 nt, Homo sapiens
gaacuauaacuccgucaac

SEQ ID NO: 486777 - RNA, 19 nt, Homo sapiens
ccacaagguccggacaauu

SEQ ID NO: 486778 - RNA, 19 nt, Homo sapiens
cgucacagugguuggauaa

SEQ ID NO: 486779 - RNA, 19 nt, Homo sapiens
gcgucacagugguuggaua

SEQ ID NO: 486780 - RNA, 19 nt, Homo sapiens
gagcugcacgacauauuca

SEQ ID NO: 486781 - RNA, 19 nt, Homo sapiens
cagcuugaacgcaguauuc

SEQ ID NO: 486782 - RNA, 19 nt, Homo sapiens
gaagaaaagggaauuccaa

SEQ ID NO: 486783 - RNA, 19 nt, Homo sapiens
gcgagguguuuguguccaa

SEQ ID NO: 486784 - RNA, 19 nt, Homo sapiens
gaaggaggaagcugaugag

SEQ ID NO: 486785 - RNA, 19 nt, Homo sapiens
agaaggaggaagcugauga

SEQ ID NO: 486786 - RNA, 19 nt, Homo sapiens
caucaacaagugcaauuca

SEQ ID NO: 486787 - RNA, 19 nt, Homo sapiens
gaagcugaugagaacuaua

SEQ ID NO: 486788 - RNA, 19 nt, Homo sapiens
agacggcccuggagaacca

SEQ ID NO: 486789 - RNA, 19 nt, Homo sapiens
ugcacgacauauucacuuu

SEQ ID NO: 486790 - RNA, 19 nt, Homo sapiens
acgaggaguucuuccacaa

SEQ ID NO: 486791 - RNA, 19 nt, Homo sapiens
ugacucgacaggccuuaaa

SEQ ID NO: 486792 - RNA, 19 nt, Homo sapiens
augcugggauggugucuga

SEQ ID NO: 486793 - RNA, 19 nt, Homo sapiens
cagcugaagaucaccaaug

SEQ ID NO: 486794 - RNA, 19 nt, Homo sapiens
cuaccgaaguggagaugca

SEQ ID NO: 486795 - RNA, 19 nt, Homo sapiens
ucaacaagugcaauucaau

SEQ ID NO: 486796 - RNA, 19 nt, Homo sapiens
agaaacagcaggucaccau

SEQ ID NO: 486797 - RNA, 19 nt, Homo sapiens
ggacacacgguuuuguaaa

SEQ ID NO: 486798 - RNA, 19 nt, Homo sapiens
gacaggccuuaaaugagau

SEQ ID NO: 486799 - RNA, 19 nt, Homo sapiens
gagguguuuguguccaaua

SEQ ID NO: 486800 - RNA, 19 nt, Homo sapiens
ugacagcucggacgaagag

SEQ ID NO: 486801 - RNA, 19 nt, Homo sapiens
caucaccgucguccuccua

SEQ ID NO: 486802 - RNA, 19 nt, Homo sapiens
cgucaacacaagaaugaga

SEQ ID NO: 486803 - RNA, 19 nt, Homo sapiens
ggugucugaugaggaguug

SEQ ID NO: 486804 - RNA, 19 nt, Homo sapiens
gcugggauggugucugaug

SEQ ID NO: 486805 - RNA, 19 nt, Homo sapiens
uaacuccgucaacacaaga

SEQ ID NO: 486806 - RNA, 19 nt, Homo sapiens
cuauaacuccgucaacaca

SEQ ID NO: 486807 - RNA, 19 nt, Homo sapiens
ccauagagccccagaagga

SEQ ID NO: 486808 - RNA, 19 nt, Homo sapiens
gcagcuugaacgcaguauu

SEQ ID NO: 486809 - RNA, 19 nt, Homo sapiens
cucgacaggccuuaaauga

SEQ ID NO: 486810 - RNA, 19 nt, Homo sapiens
cugggauggugucugauga

SEQ ID NO: 486811 - RNA, 19 nt, Homo sapiens
gguccugucccagcaauuc

SEQ ID NO: 486812 - RNA, 19 nt, Homo sapiens
gcaauucguggagcucauc

SEQ ID NO: 486813 - RNA, 19 nt, Homo sapiens
gcaagucccucuuugauga

SEQ ID NO: 486814 - RNA, 19 nt, Homo sapiens
gaacucugcugugaaguga

SEQ ID NO: 486815 - RNA, 19 nt, Homo sapiens
gagcuaacauauaucauca

SEQ ID NO: 486816 - RNA, 19 nt, Homo sapiens
gaagagcuaacauauauca

SEQ ID NO: 486817 - RNA, 19 nt, Homo sapiens
auucagagauccucaagua

SEQ ID NO: 486818 - RNA, 19 nt, Homo sapiens
ucaauagccucaacaaaca

SEQ ID NO: 486819 - RNA, 19 nt, Homo sapiens
gagcccagcuggacguuga

SEQ ID NO: 486820 - RNA, 19 nt, Homo sapiens
ggaaagaccuuagcaacac

SEQ ID NO: 486821 - RNA, 19 nt, Homo sapiens
gauuugaacucugcuguga

SEQ ID NO: 486822 - RNA, 19 nt, Homo sapiens
acacaggguucuagauuug

SEQ ID NO: 486823 - RNA, 19 nt, Homo sapiens
ggacagagaaccugaagca

SEQ ID NO: 486824 - RNA, 19 nt, Homo sapiens
auaaagcaguggaaauuga

SEQ ID NO: 486825 - RNA, 19 nt, Homo sapiens
uggagaagcugacaaucuu

SEQ ID NO: 486826 - RNA, 19 nt, Homo sapiens
gaaagaccuuagcaacaca

SEQ ID NO: 486827 - RNA, 19 nt, Homo sapiens
gaguugggcuccaucuuuc

SEQ ID NO: 486828 - RNA, 19 nt, Homo sapiens
uugcucagcuccaggauuu

SEQ ID NO: 486829 - RNA, 19 nt, Homo sapiens
gcaggguacuugggagaaa

SEQ ID NO: 486830 - RNA, 19 nt, Homo sapiens
gcaguuggcacacaugguu

SEQ ID NO: 486831 - RNA, 19 nt, Homo sapiens
agucgaaacuggcuucuau

SEQ ID NO: 486832 - RNA, 19 nt, Homo sapiens
ggacaucaauagccucaac

SEQ ID NO: 486833 - RNA, 19 nt, Homo sapiens
gaccuuagcaacacauuug

SEQ ID NO: 486834 - RNA, 19 nt, Homo sapiens
ccaauugaccucuuucuuc

SEQ ID NO: 486835 - RNA, 19 nt, Homo sapiens
cacacaggguucuagauuu

SEQ ID NO: 486836 - RNA, 19 nt, Homo sapiens
gacucaaucugccaaaugu

SEQ ID NO: 486837 - RNA, 19 nt, Homo sapiens
gaacaggaggaaaccauuc

SEQ ID NO: 486838 - RNA, 19 nt, Homo sapiens
ugaacccucucuacucuga

SEQ ID NO: 486839 - RNA, 19 nt, Homo sapiens
uggcuucuauguccaauga

SEQ ID NO: 486840 - RNA, 19 nt, Homo sapiens
ugauaaagcaguggaaauu

SEQ ID NO: 486841 - RNA, 19 nt, Homo sapiens
cagagauccucaaguacuu

SEQ ID NO: 486842 - RNA, 19 nt, Homo sapiens
gggcagacaccaugcagaa

SEQ ID NO: 486843 - RNA, 19 nt, Homo sapiens
ucaaacaggacaucaauag

SEQ ID NO: 486844 - RNA, 19 nt, Homo sapiens
gauaaagcaguggaaauug

SEQ ID NO: 486845 - RNA, 19 nt, Homo sapiens
gagguuguuuccacuagga

SEQ ID NO: 486846 - RNA, 19 nt, Homo sapiens
gggaaagaccuuagcaaca

SEQ ID NO: 486847 - RNA, 19 nt, Homo sapiens
ugaguugggcuccaucuuu

SEQ ID NO: 486848 - RNA, 19 nt, Homo sapiens
ggaacaggaggaaaccauu

SEQ ID NO: 486849 - RNA, 19 nt, Homo sapiens
gcagacaccaugcagaaca

SEQ ID NO: 486850 - RNA, 19 nt, Homo sapiens
acacacaggguucuagauu

SEQ ID NO: 486851 - RNA, 19 nt, Homo sapiens
cgacaacgcagugaauuca

SEQ ID NO: 486852 - RNA, 19 nt, Homo sapiens
uggcacacaugguuaagga

SEQ ID NO: 486853 - RNA, 19 nt, Homo sapiens
gaaauugaagagcuaacau

SEQ ID NO: 486854 - RNA, 19 nt, Homo sapiens
caucaaacaggacaucaau

SEQ ID NO: 486855 - RNA, 19 nt, Homo sapiens
uaaagcaguggaaauugaa

SEQ ID NO: 486856 - RNA, 19 nt, Homo sapiens
gcgcaagucccucuuugau

SEQ ID NO: 486857 - RNA, 19 nt, Homo sapiens
ggaaauugaagagcuaaca

SEQ ID NO: 486858 - RNA, 19 nt, Homo sapiens
uauguccaaugacuucaaa

SEQ ID NO: 486859 - RNA, 19 nt, Homo sapiens
gaugauaaagcaguggaaa

SEQ ID NO: 486860 - RNA, 19 nt, Homo sapiens
caucaauagccucaacaaa

SEQ ID NO: 486861 - RNA, 19 nt, Homo sapiens
gggagguuguuuccacuag

SEQ ID NO: 486862 - RNA, 19 nt, Homo sapiens
gaaacacacaggguucuag

SEQ ID NO: 486863 - RNA, 19 nt, Homo sapiens
ucaaaucgguuuuagaagu

SEQ ID NO: 486864 - RNA, 19 nt, Homo sapiens
gcagacccgucagaaugga

SEQ ID NO: 486865 - RNA, 19 nt, Homo sapiens
caucaucuuuguggucuuc

SEQ ID NO: 486866 - RNA, 19 nt, Homo sapiens
gaucgacgagaacgugcua

SEQ ID NO: 486867 - RNA, 19 nt, Homo sapiens
cucauugucuucuucauca

SEQ ID NO: 486868 - RNA, 19 nt, Homo sapiens
gucgacaauuguugaguug

SEQ ID NO: 486869 - RNA, 19 nt, Homo sapiens
ggagaagcugacaaucuug

SEQ ID NO: 486870 - RNA, 19 nt, Homo sapiens
aggaagcguuggcagcaaa

SEQ ID NO: 486871 - RNA, 19 nt, Homo sapiens
ccaccacccucaggccuau

SEQ ID NO: 486872 - RNA, 19 nt, Homo sapiens
agucgacaauuguugaguu

SEQ ID NO: 486873 - RNA, 19 nt, Homo sapiens
cugcagacccgucagaaug

SEQ ID NO: 486874 - RNA, 19 nt, Homo sapiens
ugacucaaucugccaaaug

SEQ ID NO: 486875 - RNA, 19 nt, Homo sapiens
acaggguucuagauuugaa

SEQ ID NO: 486876 - RNA, 19 nt, Homo sapiens
cauccucauugucuucuuc

SEQ ID NO: 486877 - RNA, 19 nt, Homo sapiens
caaaucgguuuuagaagug

SEQ ID NO: 486878 - RNA, 19 nt, Homo sapiens
aagcgcaagucccucuuug

SEQ ID NO: 486879 - RNA, 19 nt, Homo sapiens
aaacacacaggguucuaga

SEQ ID NO: 486880 - RNA, 19 nt, Homo sapiens
ggaucggacccaggaguuu

SEQ ID NO: 486881 - RNA, 19 nt, Homo sapiens
ucagagauccucaaguacu

SEQ ID NO: 486882 - RNA, 19 nt, Homo sapiens
aguggaaauugaagagcua

SEQ ID NO: 486883 - RNA, 19 nt, Homo sapiens
cccuggaacugcuaagaau

SEQ ID NO: 486884 - RNA, 19 nt, Homo sapiens
cuugaacccucucuacucu

SEQ ID NO: 486885 - RNA, 19 nt, Homo sapiens
aggaaaccauucagaggau

SEQ ID NO: 486886 - RNA, 19 nt, Homo sapiens
gaucggacccaggaguuuc

SEQ ID NO: 486887 - RNA, 19 nt, Homo sapiens
gcacaaccccugacauugg

SEQ ID NO: 486888 - RNA, 19 nt, Homo sapiens
cuggaacugcuaagaauga

SEQ ID NO: 486889 - RNA, 19 nt, Homo sapiens
gucccucuuugaugauaaa

SEQ ID NO: 486890 - RNA, 19 nt, Homo sapiens
cagacaccaugcagaacau

SEQ ID NO: 486891 - RNA, 19 nt, Homo sapiens
uuugaacucugcugugaag

SEQ ID NO: 486892 - RNA, 19 nt, Homo sapiens
ugggagaaaggcccuguuu

SEQ ID NO: 486893 - RNA, 19 nt, Homo sapiens
gggaucggacccaggaguu

SEQ ID NO: 486894 - RNA, 19 nt, Homo sapiens
acaccaugcagaacauuga

SEQ ID NO: 486895 - RNA, 19 nt, Homo sapiens
ccaccuuccugugagugaa

SEQ ID NO: 486896 - RNA, 19 nt, Homo sapiens
gcuccaucuuucagcaguu

SEQ ID NO: 486897 - RNA, 19 nt, Homo sapiens
caauagccucaacaaacaa

SEQ ID NO: 486898 - RNA, 19 nt, Homo sapiens
uagaagugaggacagagaa

SEQ ID NO: 486899 - RNA, 19 nt, Homo sapiens
uagccucaacaaacaaauu

SEQ ID NO: 486900 - RNA, 19 nt, Homo sapiens
uuucccaauugaccucuuu

SEQ ID NO: 486901 - RNA, 19 nt, Homo sapiens
ugaacucugcugugaagug

SEQ ID NO: 486902 - RNA, 19 nt, Homo sapiens
ugaaacacacaggguucua

SEQ ID NO: 486903 - RNA, 19 nt, Homo sapiens
gcuugaacccucucuacuc

SEQ ID NO: 486904 - RNA, 19 nt, Homo sapiens
uucagaggaucgacgagaa

SEQ ID NO: 486905 - RNA, 19 nt, Homo sapiens
agagcuaacauauaucauc

SEQ ID NO: 486906 - RNA, 19 nt, Homo sapiens
gaggacagagaaccugaag

SEQ ID NO: 486907 - RNA, 19 nt, Homo sapiens
gacccacuccaacaccauu

SEQ ID NO: 486908 - RNA, 19 nt, Homo sapiens
ggacuaaucugcuaucuuc

SEQ ID NO: 486909 - RNA, 19 nt, Homo sapiens
gagagaagauuaugcauga

SEQ ID NO: 486910 - RNA, 19 nt, Homo sapiens
uaaagaaggucaagaagaa

SEQ ID NO: 486911 - RNA, 19 nt, Homo sapiens
agaaagagcucagcaagua

SEQ ID NO: 486912 - RNA, 19 nt, Homo sapiens
cuaaagcacuugagucuaa

SEQ ID NO: 486913 - RNA, 19 nt, Homo sapiens
ggacaaacuugacaccaaa

SEQ ID NO: 486914 - RNA, 19 nt, Homo sapiens
gcaagcaucuucagucaga

SEQ ID NO: 486915 - RNA, 19 nt, Homo sapiens
gcacuugagucuaauaaau

SEQ ID NO: 486916 - RNA, 19 nt, Homo sapiens
ugaagaagaugccucagua

SEQ ID NO: 486917 - RNA, 19 nt, Homo sapiens
gauuaugcaugaugugaua

SEQ ID NO: 486918 - RNA, 19 nt, Homo sapiens
gcacaaacauauaucaucu

SEQ ID NO: 486919 - RNA, 19 nt, Homo sapiens
aaacaaagauccacacaca

SEQ ID NO: 486920 - RNA, 19 nt, Homo sapiens
cauaauaccuuguguugug

SEQ ID NO: 486921 - RNA, 19 nt, Homo sapiens
cagaugcccuguuuaauga

SEQ ID NO: 486922 - RNA, 19 nt, Homo sapiens
gcauaacgauuguggaaga

SEQ ID NO: 486923 - RNA, 19 nt, Homo sapiens
gggaaguccuccagucuaa

SEQ ID NO: 486924 - RNA, 19 nt, Homo sapiens
ggacuccgauuaucaagga

SEQ ID NO: 486925 - RNA, 19 nt, Homo sapiens
caacuuauacgaccugauu

SEQ ID NO: 486926 - RNA, 19 nt, Homo sapiens
ggucauacaucaucguguu

SEQ ID NO: 486927 - RNA, 19 nt, Homo sapiens
gcacauugcuuggguaugg

SEQ ID NO: 486928 - RNA, 19 nt, Homo sapiens
gaagucacccggucucuga

SEQ ID NO: 486929 - RNA, 19 nt, Homo sapiens
uaucaucucuguaccauuc

SEQ ID NO: 486930 - RNA, 19 nt, Homo sapiens
guacugaagcacaaacaua

SEQ ID NO: 486931 - RNA, 19 nt, Homo sapiens
uaagauuugugaccuugua

SEQ ID NO: 486932 - RNA, 19 nt, Homo sapiens
caagcucgaugccuauaaa

SEQ ID NO: 486933 - RNA, 19 nt, Homo sapiens
gagcagaucgcgacccuuu

SEQ ID NO: 486934 - RNA, 19 nt, Homo sapiens
guuaugaucugcugccuau

SEQ ID NO: 486935 - RNA, 19 nt, Homo sapiens
aaacagugcucaugcuuca

SEQ ID NO: 486936 - RNA, 19 nt, Homo sapiens
ggagugagagccaaagaaa

SEQ ID NO: 486937 - RNA, 19 nt, Homo sapiens
gauagguucuacucacauu

SEQ ID NO: 486938 - RNA, 19 nt, Homo sapiens
gagaagcucaugugcaauu

SEQ ID NO: 486939 - RNA, 19 nt, Homo sapiens
aagagaagcucaugugcaa

SEQ ID NO: 486940 - RNA, 19 nt, Homo sapiens
ggaucaggcuccaacaaug

SEQ ID NO: 486941 - RNA, 19 nt, Homo sapiens
gaugaagaauccuauacug

SEQ ID NO: 486942 - RNA, 19 nt, Homo sapiens
gguagaaauuuggguguuu

SEQ ID NO: 486943 - RNA, 19 nt, Homo sapiens
ggacucugcugacucuuuc

SEQ ID NO: 486944 - RNA, 19 nt, Homo sapiens
aagcuagucugucuugaaa

SEQ ID NO: 486945 - RNA, 19 nt, Homo sapiens
cuagugauguccucucaaa

SEQ ID NO: 486946 - RNA, 19 nt, Homo sapiens
ucauagagaugucuguguu

SEQ ID NO: 486947 - RNA, 19 nt, Homo sapiens
ccacaaggcucagaugaag

SEQ ID NO: 486948 - RNA, 19 nt, Homo sapiens
uaacgauuguggaagauau

SEQ ID NO: 486949 - RNA, 19 nt, Homo sapiens
ugaaaguacugaagcacaa

SEQ ID NO: 486950 - RNA, 19 nt, Homo sapiens
uuugugaccuuguacauaa

SEQ ID NO: 486951 - RNA, 19 nt, Homo sapiens
gcucuaaagcagaaacuaa

SEQ ID NO: 486952 - RNA, 19 nt, Homo sapiens
gaauggaccagaacagaug

SEQ ID NO: 486953 - RNA, 19 nt, Homo sapiens
guauggaacgguagaaauu

SEQ ID NO: 486954 - RNA, 19 nt, Homo sapiens
gugcacagcaggagaaauu

SEQ ID NO: 486955 - RNA, 19 nt, Homo sapiens
ggugugagccugaaugaga

SEQ ID NO: 486956 - RNA, 19 nt, Homo sapiens
ccagaugcccuguuuaaug

SEQ ID NO: 486957 - RNA, 19 nt, Homo sapiens
ggccauguguguauuacuu

SEQ ID NO: 486958 - RNA, 19 nt, Homo sapiens
guggaucaguuaagcauga

SEQ ID NO: 486959 - RNA, 19 nt, Homo sapiens
cagauuauccucaguuuca

SEQ ID NO: 486960 - RNA, 19 nt, Homo sapiens
gugaugcccucuucuuguu

SEQ ID NO: 486961 - RNA, 19 nt, Homo sapiens
ccaaggcaccguagacaaa

SEQ ID NO: 486962 - RNA, 19 nt, Homo sapiens
ggacgacgaccuguggaua

SEQ ID NO: 486963 - RNA, 19 nt, Homo sapiens
uaucagaaucucaguguuu

SEQ ID NO: 486964 - RNA, 19 nt, Homo sapiens
ggaccuuguuugucgaaga

SEQ ID NO: 486965 - RNA, 19 nt, Homo sapiens
gcauugugguguucucuuc

SEQ ID NO: 486966 - RNA, 19 nt, Homo sapiens
gaaacuaaagcagcaaaug

SEQ ID NO: 486967 - RNA, 19 nt, Homo sapiens
agagaugucuguguucuug

SEQ ID NO: 486968 - RNA, 19 nt, Homo sapiens
uauacgaccugauuuccuu

SEQ ID NO: 486969 - RNA, 19 nt, Homo sapiens
uguauuacuugucuaguga

SEQ ID NO: 486970 - RNA, 19 nt, Homo sapiens
cuauaaagcugaugaucca

SEQ ID NO: 486971 - RNA, 19 nt, Homo sapiens
cuaaucugcuaucuucauu

SEQ ID NO: 486972 - RNA, 19 nt, Homo sapiens
acacuacccuuauaucucu

SEQ ID NO: 486973 - RNA, 19 nt, Homo sapiens
gagaagauuaugcaugaug

SEQ ID NO: 486974 - RNA, 19 nt, Homo sapiens
gugccacccugaaggagua

SEQ ID NO: 486975 - RNA, 19 nt, Homo sapiens
ugacggaaaucaauauugc

SEQ ID NO: 486976 - RNA, 19 nt, Homo sapiens
gaagcacaaacauauauca

SEQ ID NO: 486977 - RNA, 19 nt, Homo sapiens
gaaucucaguguuugaaag

SEQ ID NO: 486978 - RNA, 19 nt, Homo sapiens
gcaggccauguguguauua

SEQ ID NO: 486979 - RNA, 19 nt, Homo sapiens
uaagagaagauggucauuu

SEQ ID NO: 486980 - RNA, 19 nt, Homo sapiens
ggaggugacaaucaggaua

SEQ ID NO: 486981 - RNA, 19 nt, Homo sapiens
ugcaugaugugauaaagaa

SEQ ID NO: 486982 - RNA, 19 nt, Homo sapiens
acaccaaacacuacccuua

SEQ ID NO: 486983 - RNA, 19 nt, Homo sapiens
ugucgaagauguugguuuc

SEQ ID NO: 486984 - RNA, 19 nt, Homo sapiens
ugauaaagaaggucaagaa

SEQ ID NO: 486985 - RNA, 19 nt, Homo sapiens
gggcauaacgauuguggaa

SEQ ID NO: 486986 - RNA, 19 nt, Homo sapiens
accaaacacuacccuuaua

SEQ ID NO: 486987 - RNA, 19 nt, Homo sapiens
gcaccuugcugaggacugu

SEQ ID NO: 486988 - RNA, 19 nt, Homo sapiens
ggauagcacugcgccacaa

SEQ ID NO: 486989 - RNA, 19 nt, Homo sapiens
gaagaucaaggacccuaug

SEQ ID NO: 486990 - RNA, 19 nt, Homo sapiens
aggacuguaugaagcauua

SEQ ID NO: 486991 - RNA, 19 nt, Homo sapiens
gaaugaauacuggagagaa

SEQ ID NO: 486992 - RNA, 19 nt, Homo sapiens
ggacaagcucgaugccuau

SEQ ID NO: 486993 - RNA, 19 nt, Homo sapiens
caucguguuuguaagagaa

SEQ ID NO: 486994 - RNA, 19 nt, Homo sapiens
gaugcccucuucuuguuug

SEQ ID NO: 486995 - RNA, 19 nt, Homo sapiens
guucagugaugcccucuuc

SEQ ID NO: 486996 - RNA, 19 nt, Homo sapiens
ccaccaaauuucucaugga

SEQ ID NO: 486997 - RNA, 19 nt, Homo sapiens
ggacacuauugaggacaaa

SEQ ID NO: 486998 - RNA, 19 nt, Homo sapiens
cccggucucugaaagauuu

SEQ ID NO: 486999 - RNA, 19 nt, Homo sapiens
gcagaucgcgacccuuugu

SEQ ID NO: 487000 - RNA, 19 nt, Homo sapiens
gcauuucucccguaugaau

SEQ ID NO: 487001 - RNA, 19 nt, Homo sapiens
uugcauuucucccguauga

SEQ ID NO: 487002 - RNA, 19 nt, Homo sapiens
guccagaugcccuguuuaa

SEQ ID NO: 487003 - RNA, 19 nt, Homo sapiens
gcuagucugucuugaaacu

SEQ ID NO: 487004 - RNA, 19 nt, Homo sapiens
gguuucccuuucucuguua

SEQ ID NO: 487005 - RNA, 19 nt, Homo sapiens
gauguugguuucccuuucu

SEQ ID NO: 487006 - RNA, 19 nt, Homo sapiens
aagagaagauggucauuuu

SEQ ID NO: 487007 - RNA, 19 nt, Homo sapiens
ggaauggaccagaacagau

SEQ ID NO: 487008 - RNA, 19 nt, Homo sapiens
gaacaaggcuggcguagaa

SEQ ID NO: 487009 - RNA, 19 nt, Homo sapiens
agaaggagcugaauaagua

SEQ ID NO: 487010 - RNA, 19 nt, Homo sapiens
ggaaggugcuuaucaugga

SEQ ID NO: 487011 - RNA, 19 nt, Homo sapiens
ggacaaggcgaacaucaaa

SEQ ID NO: 487012 - RNA, 19 nt, Homo sapiens
ugaaggcacuggacaagaa

SEQ ID NO: 487013 - RNA, 19 nt, Homo sapiens
gcauggagcccaccuauca

SEQ ID NO: 487014 - RNA, 19 nt, Homo sapiens
ggacgaggacgaugacuug

SEQ ID NO: 487015 - RNA, 19 nt, Homo sapiens
gauccagcaugccaaugua

SEQ ID NO: 487016 - RNA, 19 nt, Homo sapiens
ucaaagaccuaucccagau

SEQ ID NO: 487017 - RNA, 19 nt, Homo sapiens
caaagguggugaagacguu

SEQ ID NO: 487018 - RNA, 19 nt, Homo sapiens
gagcuucgccacaugcaua

SEQ ID NO: 487019 - RNA, 19 nt, Homo sapiens
acaagaagcuggaggacau

SEQ ID NO: 487020 - RNA, 19 nt, Homo sapiens
ucgcagauguguccaagaa

SEQ ID NO: 487021 - RNA, 19 nt, Homo sapiens
acauagagcaggacacaua

SEQ ID NO: 487022 - RNA, 19 nt, Homo sapiens
gaucaaggacuccaugaag

SEQ ID NO: 487023 - RNA, 19 nt, Homo sapiens
gaaccuguggcccuucgua

SEQ ID NO: 487024 - RNA, 19 nt, Homo sapiens
gcaucaccauuguugaaga

SEQ ID NO: 487025 - RNA, 19 nt, Homo sapiens
cugaggaccuucugugaga

SEQ ID NO: 487026 - RNA, 19 nt, Homo sapiens
ggacauagagcaggacaca

SEQ ID NO: 487027 - RNA, 19 nt, Homo sapiens
gcugagggcaucaccauug

SEQ ID NO: 487028 - RNA, 19 nt, Homo sapiens
gaaggugcuuaucauggau

SEQ ID NO: 487029 - RNA, 19 nt, Homo sapiens
uggagaagcuguguagugu

SEQ ID NO: 487030 - RNA, 19 nt, Homo sapiens
ccacaugcauaucgcagau

SEQ ID NO: 487031 - RNA, 19 nt, Homo sapiens
ggaguuauucggaguguca

SEQ ID NO: 487032 - RNA, 19 nt, Homo sapiens
gaacaucaaagaccuaucc

SEQ ID NO: 487033 - RNA, 19 nt, Homo sapiens
gggcaucaccauuguugaa

SEQ ID NO: 487034 - RNA, 19 nt, Homo sapiens
cguaugaucugcuggacau

SEQ ID NO: 487035 - RNA, 19 nt, Homo sapiens
ugaagacguugaaggagau

SEQ ID NO: 487036 - RNA, 19 nt, Homo sapiens
acagcagccucauccguaa

SEQ ID NO: 487037 - RNA, 19 nt, Homo sapiens
gagggcaucaccauuguug

SEQ ID NO: 487038 - RNA, 19 nt, Homo sapiens
gcaugcgcaucuugucuuc

SEQ ID NO: 487039 - RNA, 19 nt, Homo sapiens
ucuagcagaugauuguaug

SEQ ID NO: 487040 - RNA, 19 nt, Homo sapiens
uggcaaagguggugaagac

SEQ ID NO: 487041 - RNA, 19 nt, Homo sapiens
gcucucgucuggcaaaggu

SEQ ID NO: 487042 - RNA, 19 nt, Homo sapiens
gucuggaggccauuuauuu

SEQ ID NO: 487043 - RNA, 19 nt, Homo sapiens
gcucaucguguaugucaug

SEQ ID NO: 487044 - RNA, 19 nt, Homo sapiens
gaaggagcugaauaaguau

SEQ ID NO: 487045 - RNA, 19 nt, Homo sapiens
cagaaggagcugaauaagu

SEQ ID NO: 487046 - RNA, 19 nt, Homo sapiens
acaaggcgaacaucaaaga

SEQ ID NO: 487047 - RNA, 19 nt, Homo sapiens
gaaccuggccaagcugauc

SEQ ID NO: 487048 - RNA, 19 nt, Homo sapiens
gcaccuacaaccucuacug

SEQ ID NO: 487049 - RNA, 19 nt, Homo sapiens
ccacggagaagucgguuca

SEQ ID NO: 487050 - RNA, 19 nt, Homo sapiens
gaguggaaggugcuuauca

SEQ ID NO: 487051 - RNA, 19 nt, Homo sapiens
guggagaagcuguguagug

SEQ ID NO: 487052 - RNA, 19 nt, Homo sapiens
uaccagaaggagcugaaua

SEQ ID NO: 487053 - RNA, 19 nt, Homo sapiens
accagaaggagcugaauaa

SEQ ID NO: 487054 - RNA, 19 nt, Homo sapiens
uccaggccauggcguauga

SEQ ID NO: 487055 - RNA, 19 nt, Homo sapiens
caccauuguugaagacauc

SEQ ID NO: 487056 - RNA, 19 nt, Homo sapiens
caagugggaggugcucauu

SEQ ID NO: 487057 - RNA, 19 nt, Homo sapiens
gggaguggaaggugcuuau

SEQ ID NO: 487058 - RNA, 19 nt, Homo sapiens
cgacccgcuuccuggauga

SEQ ID NO: 487059 - RNA, 19 nt, Homo sapiens
cucauuggcuccucacaca

SEQ ID NO: 487060 - RNA, 19 nt, Homo sapiens
ugcaugagcucacguucca

SEQ ID NO: 487061 - RNA, 19 nt, Homo sapiens
uagcagaugauuguaugaa

SEQ ID NO: 487062 - RNA, 19 nt, Homo sapiens
ggccauggcguaugaucug

SEQ ID NO: 487063 - RNA, 19 nt, Homo sapiens
gcugcaaaaugucagauau

SEQ ID NO: 487064 - RNA, 19 nt, Homo sapiens
gguguggccaugucagaga

SEQ ID NO: 487065 - RNA, 19 nt, Homo sapiens
cuacgaggcccagguguuc

SEQ ID NO: 487066 - RNA, 19 nt, Homo sapiens
ucuggaggccauuuauuug

SEQ ID NO: 487067 - RNA, 19 nt, Homo sapiens
gaaggcacuggacaagaag

SEQ ID NO: 487068 - RNA, 19 nt, Homo sapiens
gcaagugggaggugcucau

SEQ ID NO: 487069 - RNA, 19 nt, Homo sapiens
gcggaguuauucggagugu

SEQ ID NO: 487070 - RNA, 19 nt, Homo sapiens
aggagaaccuggccaagcu

SEQ ID NO: 487071 - RNA, 19 nt, Homo sapiens
caucaccauuguugaagac

SEQ ID NO: 487072 - RNA, 19 nt, Homo sapiens
aguggaaggugcuuaucau

SEQ ID NO: 487073 - RNA, 19 nt, Homo sapiens
ccacggacaaggcgaacau

SEQ ID NO: 487074 - RNA, 19 nt, Homo sapiens
cagaggacacagcccaguu

SEQ ID NO: 487075 - RNA, 19 nt, Homo sapiens
caagaagcuggaggacauu

SEQ ID NO: 487076 - RNA, 19 nt, Homo sapiens
agugggaggugcucauugg

SEQ ID NO: 487077 - RNA, 19 nt, Homo sapiens
caaagaccuaucccagauc

SEQ ID NO: 487078 - RNA, 19 nt, Homo sapiens
gcgaacaucaaagaccuau

SEQ ID NO: 487079 - RNA, 19 nt, Homo sapiens
cugagggcaucaccauugu

SEQ ID NO: 487080 - RNA, 19 nt, Homo sapiens
ucacagcucuuaauaauug

SEQ ID NO: 487081 - RNA, 19 nt, Homo sapiens
gaagaugaccucuggguua

SEQ ID NO: 487082 - RNA, 19 nt, Homo sapiens
gagaagaaauguuaaagug

SEQ ID NO: 487083 - RNA, 19 nt, Homo sapiens
gcagaagauugcaugaaua

SEQ ID NO: 487084 - RNA, 19 nt, Homo sapiens
gaaggaaagacaucacuua

SEQ ID NO: 487085 - RNA, 19 nt, Homo sapiens
gaaggcgaauggaagauaa

SEQ ID NO: 487086 - RNA, 19 nt, Homo sapiens
gauccagaauguaaagaua

SEQ ID NO: 487087 - RNA, 19 nt, Homo sapiens
caaagucuguagauuguuu

SEQ ID NO: 487088 - RNA, 19 nt, Homo sapiens
acccagagcuaauuauuua

SEQ ID NO: 487089 - RNA, 19 nt, Homo sapiens
ugaauaaacccaaggauaa

SEQ ID NO: 487090 - RNA, 19 nt, Homo sapiens
ggauaaagucuccuuaauu

SEQ ID NO: 487091 - RNA, 19 nt, Homo sapiens
ggucaaagcugauuguuuu

SEQ ID NO: 487092 - RNA, 19 nt, Homo sapiens
gacagaaggugaaagauuc

SEQ ID NO: 487093 - RNA, 19 nt, Homo sapiens
cauaaauccugugaaguua

SEQ ID NO: 487094 - RNA, 19 nt, Homo sapiens
gaaauucccaagcuuauga

SEQ ID NO: 487095 - RNA, 19 nt, Homo sapiens
guaaaucggagaacaagua

SEQ ID NO: 487096 - RNA, 19 nt, Homo sapiens
ggacagaaggugaaagauu

SEQ ID NO: 487097 - RNA, 19 nt, Homo sapiens
gaagacuacuacaagauug

SEQ ID NO: 487098 - RNA, 19 nt, Homo sapiens
aacaauggcugaccagaua

SEQ ID NO: 487099 - RNA, 19 nt, Homo sapiens
gaauuuaccacuaagcuuu

SEQ ID NO: 487100 - RNA, 19 nt, Homo sapiens
gaaaacagauuacuaagca

SEQ ID NO: 487101 - RNA, 19 nt, Homo sapiens
gucuguagauuguuucuua

SEQ ID NO: 487102 - RNA, 19 nt, Homo sapiens
aaauguugcugucauguaa

SEQ ID NO: 487103 - RNA, 19 nt, Homo sapiens
caacaaggcaaaccguuaa

SEQ ID NO: 487104 - RNA, 19 nt, Homo sapiens
gaaaagcucugcaaaacug

SEQ ID NO: 487105 - RNA, 19 nt, Homo sapiens
gaagauugcaugaauaagu

SEQ ID NO: 487106 - RNA, 19 nt, Homo sapiens
gaaaagagccuaauaaagg

SEQ ID NO: 487107 - RNA, 19 nt, Homo sapiens
gaagaagguauuacuguug

SEQ ID NO: 487108 - RNA, 19 nt, Homo sapiens
gaauaaacccaaggauaaa

SEQ ID NO: 487109 - RNA, 19 nt, Homo sapiens
ggaggaugcuauugauaau

SEQ ID NO: 487110 - RNA, 19 nt, Homo sapiens
gcaaguaaaucggagaaca

SEQ ID NO: 487111 - RNA, 19 nt, Homo sapiens
caacaaagaaagcaacaga

SEQ ID NO: 487112 - RNA, 19 nt, Homo sapiens
gguguauacucuugaugua

SEQ ID NO: 487113 - RNA, 19 nt, Homo sapiens
agagugacaugauucguaa

SEQ ID NO: 487114 - RNA, 19 nt, Homo sapiens
gaauggaagauaaugcuuu

SEQ ID NO: 487115 - RNA, 19 nt, Homo sapiens
ggaucggucugcagaagaa

SEQ ID NO: 487116 - RNA, 19 nt, Homo sapiens
gagagugacaugauucgua

SEQ ID NO: 487117 - RNA, 19 nt, Homo sapiens
caucaaagucuguagauug

SEQ ID NO: 487118 - RNA, 19 nt, Homo sapiens
aaugacagaucuucuagaa

SEQ ID NO: 487119 - RNA, 19 nt, Homo sapiens
cagaagauugcaugaauaa

SEQ ID NO: 487120 - RNA, 19 nt, Homo sapiens
uaccagaugcauucuauua

SEQ ID NO: 487121 - RNA, 19 nt, Homo sapiens
guagauuguuucuuacaug

SEQ ID NO: 487122 - RNA, 19 nt, Homo sapiens
gcuguuggaugauauaaag

SEQ ID NO: 487123 - RNA, 19 nt, Homo sapiens
cauaugaucuacuaccaau

SEQ ID NO: 487124 - RNA, 19 nt, Homo sapiens
ccagauaguuacagugugu

SEQ ID NO: 487125 - RNA, 19 nt, Homo sapiens
aaauauugcugcugcuuug

SEQ ID NO: 487126 - RNA, 19 nt, Homo sapiens
gaaagcaacagaaggaaag

SEQ ID NO: 487127 - RNA, 19 nt, Homo sapiens
gaugaccucuggguuagaa

SEQ ID NO: 487128 - RNA, 19 nt, Homo sapiens
guaaaccucuagauaaugc

SEQ ID NO: 487129 - RNA, 19 nt, Homo sapiens
uguaagugcucgccagaaa

SEQ ID NO: 487130 - RNA, 19 nt, Homo sapiens
aauaauugaucguggcuuu

SEQ ID NO: 487131 - RNA, 19 nt, Homo sapiens
agaagaagguauuacuguu

SEQ ID NO: 487132 - RNA, 19 nt, Homo sapiens
gaucacauacucugaagug

SEQ ID NO: 487133 - RNA, 19 nt, Homo sapiens
aaucggagaacaaguauaa

SEQ ID NO: 487134 - RNA, 19 nt, Homo sapiens
gggaaaagaugccauuaug

SEQ ID NO: 487135 - RNA, 19 nt, Homo sapiens
caagaaagaaggcgaaugg

SEQ ID NO: 487136 - RNA, 19 nt, Homo sapiens
guauuacuguuguagagaa

SEQ ID NO: 487137 - RNA, 19 nt, Homo sapiens
acauaaauccugugaaguu

SEQ ID NO: 487138 - RNA, 19 nt, Homo sapiens
ucaacaaggcaaaccguua

SEQ ID NO: 487139 - RNA, 19 nt, Homo sapiens
gcucuuacccagcugauga

SEQ ID NO: 487140 - RNA, 19 nt, Homo sapiens
aaagaaagcaacagaagga

SEQ ID NO: 487141 - RNA, 19 nt, Homo sapiens
ggaggagaauauauuagag

SEQ ID NO: 487142 - RNA, 19 nt, Homo sapiens
gcaaaccguuaagaaagga

SEQ ID NO: 487143 - RNA, 19 nt, Homo sapiens
uaauggaacuacggaagaa

SEQ ID NO: 487144 - RNA, 19 nt, Homo sapiens
gaaagauuccaugcgagua

SEQ ID NO: 487145 - RNA, 19 nt, Homo sapiens
caucuuaacuuagcagaag

SEQ ID NO: 487146 - RNA, 19 nt, Homo sapiens
ggccauccuugaagaagaa

SEQ ID NO: 487147 - RNA, 19 nt, Homo sapiens
gaucuacuaccaauugaga

SEQ ID NO: 487148 - RNA, 19 nt, Homo sapiens
ggcaauggcauaugaucua

SEQ ID NO: 487149 - RNA, 19 nt, Homo sapiens
uaaagaugcugaauaaacc

SEQ ID NO: 487150 - RNA, 19 nt, Homo sapiens
aaaugagagugacaugauu

SEQ ID NO: 487151 - RNA, 19 nt, Homo sapiens
gaacuacggaagaaaauuu

SEQ ID NO: 487152 - RNA, 19 nt, Homo sapiens
uaacuuagcagaagauugc

SEQ ID NO: 487153 - RNA, 19 nt, Homo sapiens
caaggcaaaccguuaagaa

SEQ ID NO: 487154 - RNA, 19 nt, Homo sapiens
uaagcaaguuguccaucuu

SEQ ID NO: 487155 - RNA, 19 nt, Homo sapiens
gauuauuacuggauuuguc

SEQ ID NO: 487156 - RNA, 19 nt, Homo sapiens
ugaagacuacuacaagauu

SEQ ID NO: 487157 - RNA, 19 nt, Homo sapiens
aaagucucaugcugaagua

SEQ ID NO: 487158 - RNA, 19 nt, Homo sapiens
acauauugcgguuguguua

SEQ ID NO: 487159 - RNA, 19 nt, Homo sapiens
aauggcauaugaucuacua

SEQ ID NO: 487160 - RNA, 19 nt, Homo sapiens
gcccugauaaucucuuuaa

SEQ ID NO: 487161 - RNA, 19 nt, Homo sapiens
caaguaaaucggagaacaa

SEQ ID NO: 487162 - RNA, 19 nt, Homo sapiens
cugaauaaacccaaggaua

SEQ ID NO: 487163 - RNA, 19 nt, Homo sapiens
uucccaagcuuaugaaaga

SEQ ID NO: 487164 - RNA, 19 nt, Homo sapiens
uaaauauugcugcugcuuu

SEQ ID NO: 487165 - RNA, 19 nt, Homo sapiens
uggaggaugcuauugauaa

SEQ ID NO: 487166 - RNA, 19 nt, Homo sapiens
uaugaucuacuaccaauug

SEQ ID NO: 487167 - RNA, 19 nt, Homo sapiens
gaugaaaagagccuaauaa

SEQ ID NO: 487168 - RNA, 19 nt, Homo sapiens
gaccagauaguuacagugu

SEQ ID NO: 487169 - RNA, 19 nt, Homo sapiens
ccagaugcauucuauuacu

SEQ ID NO: 487170 - RNA, 19 nt, Homo sapiens
cagcauauauuuacuucac

SEQ ID NO: 487171 - RNA, 19 nt, Homo sapiens
ggagaacaaguauaaagca

SEQ ID NO: 487172 - RNA, 19 nt, Homo sapiens
ucaaaagaauggccauauu

SEQ ID NO: 487173 - RNA, 19 nt, Homo sapiens
ggcaaaccguuaagaaagg

SEQ ID NO: 487174 - RNA, 19 nt, Homo sapiens
caacagaaggaaagacauc

SEQ ID NO: 487175 - RNA, 19 nt, Homo sapiens
acaugaaucucagguguau

SEQ ID NO: 487176 - RNA, 19 nt, Homo sapiens
uuagaguuguggguaauuu

SEQ ID NO: 487177 - RNA, 19 nt, Homo sapiens
ggaauaauggcuuuucaaa

SEQ ID NO: 487178 - RNA, 19 nt, Homo sapiens
agaaacccagagcuaauua

SEQ ID NO: 487179 - RNA, 19 nt, Homo sapiens
gcaauggcauaugaucuac

SEQ ID NO: 487180 - RNA, 19 nt, Homo sapiens
gaagagaacacaugaagaa

SEQ ID NO: 487181 - RNA, 19 nt, Homo sapiens
ccucauggccucuaaauua

SEQ ID NO: 487182 - RNA, 19 nt, Homo sapiens
gaugggagcuuacaaaugg

SEQ ID NO: 487183 - RNA, 19 nt, Homo sapiens
gcagggaucuccagaagug

SEQ ID NO: 487184 - RNA, 19 nt, Homo sapiens
ggagaguggagauuaauua

SEQ ID NO: 487185 - RNA, 19 nt, Homo sapiens
gggagacucuaguguauuu

SEQ ID NO: 487186 - RNA, 19 nt, Homo sapiens
guacgaggcuggaagaaau

SEQ ID NO: 487187 - RNA, 19 nt, Homo sapiens
caucauagagugugaauuu

SEQ ID NO: 487188 - RNA, 19 nt, Homo sapiens
ggaaugaaguacagagaug

SEQ ID NO: 487189 - RNA, 19 nt, Homo sapiens
gaaaggucauuaucuguuc

SEQ ID NO: 487190 - RNA, 19 nt, Homo sapiens
ggaaugauuucuguauguu

SEQ ID NO: 487191 - RNA, 19 nt, Homo sapiens
caaggauaguguuagauuu

SEQ ID NO: 487192 - RNA, 19 nt, Homo sapiens
gacgagagaugcaggaaau

SEQ ID NO: 487193 - RNA, 19 nt, Homo sapiens
gauggagccucuuacagaa

SEQ ID NO: 487194 - RNA, 19 nt, Homo sapiens
gaguggaccuacccuauga

SEQ ID NO: 487195 - RNA, 19 nt, Homo sapiens
acacaugcuuuacaaguuu

SEQ ID NO: 487196 - RNA, 19 nt, Homo sapiens
cagaauggcugacuugaag

SEQ ID NO: 487197 - RNA, 19 nt, Homo sapiens
gagaacacaugaagaagag

SEQ ID NO: 487198 - RNA, 19 nt, Homo sapiens
gggaaugauuucuguaugu

SEQ ID NO: 487199 - RNA, 19 nt, Homo sapiens
cuaauuagcuguccuuacu

SEQ ID NO: 487200 - RNA, 19 nt, Homo sapiens
gaggcuggaagaaauauua

SEQ ID NO: 487201 - RNA, 19 nt, Homo sapiens
gagugugaauuucuauuug

SEQ ID NO: 487202 - RNA, 19 nt, Homo sapiens
acacacacaugcuuuacaa

SEQ ID NO: 487203 - RNA, 19 nt, Homo sapiens
gcacagaauggcugacuug

SEQ ID NO: 487204 - RNA, 19 nt, Homo sapiens
gaagccaucuaccuagcaa

SEQ ID NO: 487205 - RNA, 19 nt, Homo sapiens
gagaguggagauuaauuaa

SEQ ID NO: 487206 - RNA, 19 nt, Homo sapiens
cccauaauuugcuuuagua

SEQ ID NO: 487207 - RNA, 19 nt, Homo sapiens
uccaucaacuucaggaaua

SEQ ID NO: 487208 - RNA, 19 nt, Homo sapiens
aaagugccuugcaucauuu

SEQ ID NO: 487209 - RNA, 19 nt, Homo sapiens
gaaucugccacauuucuuu

SEQ ID NO: 487210 - RNA, 19 nt, Homo sapiens
ggacuucugcaauagauga

SEQ ID NO: 487211 - RNA, 19 nt, Homo sapiens
ccagauagaaaggucauua

SEQ ID NO: 487212 - RNA, 19 nt, Homo sapiens
gaugucaccacuccagaua

SEQ ID NO: 487213 - RNA, 19 nt, Homo sapiens
gcuggaagaaauauuagua

SEQ ID NO: 487214 - RNA, 19 nt, Homo sapiens
gcagauaauccaguugaaa

SEQ ID NO: 487215 - RNA, 19 nt, Homo sapiens
gaagugcagccuuuguuau

SEQ ID NO: 487216 - RNA, 19 nt, Homo sapiens
gcaacaucauagaguguga

SEQ ID NO: 487217 - RNA, 19 nt, Homo sapiens
gucauuaucuguucauucu

SEQ ID NO: 487218 - RNA, 19 nt, Homo sapiens
cuacagaaacauggaauaa

SEQ ID NO: 487219 - RNA, 19 nt, Homo sapiens
gugggagacucuaguguau

SEQ ID NO: 487220 - RNA, 19 nt, Homo sapiens
gugggagaguggagauuaa

SEQ ID NO: 487221 - RNA, 19 nt, Homo sapiens
ggaguucccuucccuucca

SEQ ID NO: 487222 - RNA, 19 nt, Homo sapiens
cacacaugcuuuacaaguu

SEQ ID NO: 487223 - RNA, 19 nt, Homo sapiens
auagaaaggucauuaucug

SEQ ID NO: 487224 - RNA, 19 nt, Homo sapiens
uaaugggaaugauuucugu

SEQ ID NO: 487225 - RNA, 19 nt, Homo sapiens
cgagagaugcaggaaauuu

SEQ ID NO: 487226 - RNA, 19 nt, Homo sapiens
aauuagcuguccuuacuuu

SEQ ID NO: 487227 - RNA, 19 nt, Homo sapiens
aaaagugccuugcaucauu

SEQ ID NO: 487228 - RNA, 19 nt, Homo sapiens
ugauggagccucuuacaga

SEQ ID NO: 487229 - RNA, 19 nt, Homo sapiens
uagaugacacugaugguuu

SEQ ID NO: 487230 - RNA, 19 nt, Homo sapiens
gaagagcaacaucauagag

SEQ ID NO: 487231 - RNA, 19 nt, Homo sapiens
agaagugcagccuuuguua

SEQ ID NO: 487232 - RNA, 19 nt, Homo sapiens
guucuuaggcccauauuca

SEQ ID NO: 487233 - RNA, 19 nt, Homo sapiens
guccagaucugccccauaa

SEQ ID NO: 487234 - RNA, 19 nt, Homo sapiens
aaagccaaacguuguauuu

SEQ ID NO: 487235 - RNA, 19 nt, Homo sapiens
uugcaaagagguauuauug

SEQ ID NO: 487236 - RNA, 19 nt, Homo sapiens
ggaguggaccuacccuaug

SEQ ID NO: 487237 - RNA, 19 nt, Homo sapiens
acaaggauaguguuagauu

SEQ ID NO: 487238 - RNA, 19 nt, Homo sapiens
cagccuuuguuauugcaua

SEQ ID NO: 487239 - RNA, 19 nt, Homo sapiens
uugaggugcuuuacuaaug

SEQ ID NO: 487240 - RNA, 19 nt, Homo sapiens
uaaugauucugugagauug

SEQ ID NO: 487241 - RNA, 19 nt, Homo sapiens
gugcuuaaacacaaggaua

SEQ ID NO: 487242 - RNA, 19 nt, Homo sapiens
ugucaccacuccagauaga

SEQ ID NO: 487243 - RNA, 19 nt, Homo sapiens
caaagagguauuauugcaa

SEQ ID NO: 487244 - RNA, 19 nt, Homo sapiens
auacuucucugcaacuugu

SEQ ID NO: 487245 - RNA, 19 nt, Homo sapiens
acaggcaguuugaagagaa

SEQ ID NO: 487246 - RNA, 19 nt, Homo sapiens
cuccagaagugcagccuuu

SEQ ID NO: 487247 - RNA, 19 nt, Homo sapiens
caagagguacuaugcaaag

SEQ ID NO: 487248 - RNA, 19 nt, Homo sapiens
cuaauaaaccaauguagca

SEQ ID NO: 487249 - RNA, 19 nt, Homo sapiens
uauaguaccaagugcuuaa

SEQ ID NO: 487250 - RNA, 19 nt, Homo sapiens
ggauuuguccaucaacuuc

SEQ ID NO: 487251 - RNA, 19 nt, Homo sapiens
ugcaauagaugacacugau

SEQ ID NO: 487252 - RNA, 19 nt, Homo sapiens
gaaaagcaagcuaccugua

SEQ ID NO: 487253 - RNA, 19 nt, Homo sapiens
gcuuuccucucuaugaugu

SEQ ID NO: 487254 - RNA, 19 nt, Homo sapiens
gcgcacacacacaugcuuu

SEQ ID NO: 487255 - RNA, 19 nt, Homo sapiens
gauguuggacuucugcaau

SEQ ID NO: 487256 - RNA, 19 nt, Homo sapiens
agaaaggucauuaucuguu

SEQ ID NO: 487257 - RNA, 19 nt, Homo sapiens
uaaccuauuacaccaaguu

SEQ ID NO: 487258 - RNA, 19 nt, Homo sapiens
ggaaucugccacauuucuu

SEQ ID NO: 487259 - RNA, 19 nt, Homo sapiens
ggacuugcaaagagguauu

SEQ ID NO: 487260 - RNA, 19 nt, Homo sapiens
ugaaguacagagaugcuuu

SEQ ID NO: 487261 - RNA, 19 nt, Homo sapiens
gcacaaacaaaacuccuuu

SEQ ID NO: 487262 - RNA, 19 nt, Homo sapiens
uuaaguauguaagggaaga

SEQ ID NO: 487263 - RNA, 19 nt, Homo sapiens
uuagcuguccuuacuuuaa

SEQ ID NO: 487264 - RNA, 19 nt, Homo sapiens
guacagagaugcuuuugcu

SEQ ID NO: 487265 - RNA, 19 nt, Homo sapiens
acagaaacauggaauaacc

SEQ ID NO: 487266 - RNA, 19 nt, Homo sapiens
uuaccuggauuguucuuag

SEQ ID NO: 487267 - RNA, 19 nt, Homo sapiens
ccucuuacagaaacauuaa

SEQ ID NO: 487268 - RNA, 19 nt, Homo sapiens
agagaacacaugaagaaga

SEQ ID NO: 487269 - RNA, 19 nt, Homo sapiens
ggaauaugaagccaucuac

SEQ ID NO: 487270 - RNA, 19 nt, Homo sapiens
cagaagugcagccuuuguu

SEQ ID NO: 487271 - RNA, 19 nt, Homo sapiens
gcuuacaaaugggaggaaa

SEQ ID NO: 487272 - RNA, 19 nt, Homo sapiens
uccuggauauugcagauaa

SEQ ID NO: 487273 - RNA, 19 nt, Homo sapiens
gcuuugcuuuccucucuau

SEQ ID NO: 487274 - RNA, 19 nt, Homo sapiens
ccaagagguacuaugcaaa

SEQ ID NO: 487275 - RNA, 19 nt, Homo sapiens
ugaggugcuuuacuaaugg

SEQ ID NO: 487276 - RNA, 19 nt, Homo sapiens
ugaagaagaggaugauuuu

SEQ ID NO: 487277 - RNA, 19 nt, Homo sapiens
gggagaguggagauuaauu

SEQ ID NO: 487278 - RNA, 19 nt, Homo sapiens
cucuugaggugcuuuacua

SEQ ID NO: 487279 - RNA, 19 nt, Homo sapiens
accaagugcuuaaacacaa

SEQ ID NO: 487280 - RNA, 19 nt, Homo sapiens
ccaagcggcucaagaauaa

SEQ ID NO: 487281 - RNA, 19 nt, Homo sapiens
ucaaggagaugaagaagaa

SEQ ID NO: 487282 - RNA, 19 nt, Homo sapiens
ucaccgagcucccaucuuc

SEQ ID NO: 487283 - RNA, 19 nt, Homo sapiens
ggauggagacucugaaaga

SEQ ID NO: 487284 - RNA, 19 nt, Homo sapiens
gacgguaggucaugucugu

SEQ ID NO: 487285 - RNA, 19 nt, Homo sapiens
guggugaccuggagaagug

SEQ ID NO: 487286 - RNA, 19 nt, Homo sapiens
caacauagugagauucugu

SEQ ID NO: 487287 - RNA, 19 nt, Homo sapiens
ugaccaagcggcucaagaa

SEQ ID NO: 487288 - RNA, 19 nt, Homo sapiens
gggucccgcucaucaagua

SEQ ID NO: 487289 - RNA, 19 nt, Homo sapiens
gcgcuucgaugcggacuau

SEQ ID NO: 487290 - RNA, 19 nt, Homo sapiens
gcacccacccuguucucua

SEQ ID NO: 487291 - RNA, 19 nt, Homo sapiens
agaagaacccuaugaccaa

SEQ ID NO: 487292 - RNA, 19 nt, Homo sapiens
gaaacccucagcucagaga

SEQ ID NO: 487293 - RNA, 19 nt, Homo sapiens
augaagacaugaaggagaa

SEQ ID NO: 487294 - RNA, 19 nt, Homo sapiens
gaggugggaggaucauuug

SEQ ID NO: 487295 - RNA, 19 nt, Homo sapiens
cccaagagcucaggaacau

SEQ ID NO: 487296 - RNA, 19 nt, Homo sapiens
gaccaaccugggcaacaua

SEQ ID NO: 487297 - RNA, 19 nt, Homo sapiens
gcagagggagugugcgaau

SEQ ID NO: 487298 - RNA, 19 nt, Homo sapiens
ccucagggauggagacucu

SEQ ID NO: 487299 - RNA, 19 nt, Homo sapiens
ccacacaacacccacaauc

SEQ ID NO: 487300 - RNA, 19 nt, Homo sapiens
ucuguaaucccagcaauuu

SEQ ID NO: 487301 - RNA, 19 nt, Homo sapiens
agaacccuaugaccaacua

SEQ ID NO: 487302 - RNA, 19 nt, Homo sapiens
gaaguucauggucggagaa

SEQ ID NO: 487303 - RNA, 19 nt, Homo sapiens
ugaggugggaggaucauuu

SEQ ID NO: 487304 - RNA, 19 nt, Homo sapiens
cauagugagauucuguuaa

SEQ ID NO: 487305 - RNA, 19 nt, Homo sapiens
gguaggucaugucuguaau

SEQ ID NO: 487306 - RNA, 19 nt, Homo sapiens
acacgucguucaaggagau

SEQ ID NO: 487307 - RNA, 19 nt, Homo sapiens
gaggccagguucccaagag

SEQ ID NO: 487308 - RNA, 19 nt, Homo sapiens
ggucaagguggucuauguu

SEQ ID NO: 487309 - RNA, 19 nt, Homo sapiens
gaaggucaagguggucuau

SEQ ID NO: 487310 - RNA, 19 nt, Homo sapiens
gauggagacucugaaagac

SEQ ID NO: 487311 - RNA, 19 nt, Homo sapiens
caaccugggcaacauagug

SEQ ID NO: 487312 - RNA, 19 nt, Homo sapiens
accaagcggcucaagaaua

SEQ ID NO: 487313 - RNA, 19 nt, Homo sapiens
gagggagugugcgaaucaa

SEQ ID NO: 487314 - RNA, 19 nt, Homo sapiens
gggacagcuuccuggagaa

SEQ ID NO: 487315 - RNA, 19 nt, Homo sapiens
cagagaacaacccugcauu

SEQ ID NO: 487316 - RNA, 19 nt, Homo sapiens
aggaaacccucagcucaga

SEQ ID NO: 487317 - RNA, 19 nt, Homo sapiens
gcagaaugagcgcuucgau

SEQ ID NO: 487318 - RNA, 19 nt, Homo sapiens
guucauggucggagaagug

SEQ ID NO: 487319 - RNA, 19 nt, Homo sapiens
guucaaagccccagggauu

SEQ ID NO: 487320 - RNA, 19 nt, Homo sapiens
gcgaaucaaaccugaccaa

SEQ ID NO: 487321 - RNA, 19 nt, Homo sapiens
acauagugagauucuguua

SEQ ID NO: 487322 - RNA, 19 nt, Homo sapiens
agaccaaccugggcaacau

SEQ ID NO: 487323 - RNA, 19 nt, Homo sapiens
cccaggaguucgagaccaa

SEQ ID NO: 487324 - RNA, 19 nt, Homo sapiens
cgguaggucaugucuguaa

SEQ ID NO: 487325 - RNA, 19 nt, Homo sapiens
gaccaagcggcucaagaau

SEQ ID NO: 487326 - RNA, 19 nt, Homo sapiens
ucaccguggcgcagaauga

SEQ ID NO: 487327 - RNA, 19 nt, Homo sapiens
gcaacauagugagauucug

SEQ ID NO: 487328 - RNA, 19 nt, Homo sapiens
agagaacaacccugcauuc

SEQ ID NO: 487329 - RNA, 19 nt, Homo sapiens
uucucuaccucuucuauga

SEQ ID NO: 487330 - RNA, 19 nt, Homo sapiens
ugggcaacauagugagauu

SEQ ID NO: 487331 - RNA, 19 nt, Homo sapiens
cauuugagcccaggaguuc

SEQ ID NO: 487332 - RNA, 19 nt, Homo sapiens
aaaagauccuggaguuugu

SEQ ID NO: 487333 - RNA, 19 nt, Homo sapiens
gcucaucaaguacuuugca

SEQ ID NO: 487334 - RNA, 19 nt, Homo sapiens
cacacaacacccacaauca

SEQ ID NO: 487335 - RNA, 19 nt, Homo sapiens
cgggugcccuuccuugagu

SEQ ID NO: 487336 - RNA, 19 nt, Homo sapiens
cacccacccuguucucuac

SEQ ID NO: 487337 - RNA, 19 nt, Homo sapiens
guaaucccagcaauuugga

SEQ ID NO: 487338 - RNA, 19 nt, Homo sapiens
agagggagugugcgaauca

SEQ ID NO: 487339 - RNA, 19 nt, Homo sapiens
gaugaagaagaacccuaug

SEQ ID NO: 487340 - RNA, 19 nt, Homo sapiens
ucuaugaagacaugaagga

SEQ ID NO: 487341 - RNA, 19 nt, Homo sapiens
gucaagguggucuauguug

SEQ ID NO: 487342 - RNA, 19 nt, Homo sapiens
ccaaugggcucaagaauaa

SEQ ID NO: 487343 - RNA, 19 nt, Homo sapiens
ucaaggagaugaagaagaa

SEQ ID NO: 487344 - RNA, 19 nt, Homo sapiens
gcaagacccucccuccaaa

SEQ ID NO: 487345 - RNA, 19 nt, Homo sapiens
gcucaagaauaaaguauga

SEQ ID NO: 487346 - RNA, 19 nt, Homo sapiens
gaccucaucucuacaaaga

SEQ ID NO: 487347 - RNA, 19 nt, Homo sapiens
guucauggcuggagaagug

SEQ ID NO: 487348 - RNA, 19 nt, Homo sapiens
cacaauaggccacgaauuu

SEQ ID NO: 487349 - RNA, 19 nt, Homo sapiens
aguagaagacucagaauua

SEQ ID NO: 487350 - RNA, 19 nt, Homo sapiens
guagaagacucagaauuag

SEQ ID NO: 487351 - RNA, 19 nt, Homo sapiens
gacccucccuccaaagaaa

SEQ ID NO: 487352 - RNA, 19 nt, Homo sapiens
guuaugacaugcccauuca

SEQ ID NO: 487353 - RNA, 19 nt, Homo sapiens
gaaucuacccugaccaaug

SEQ ID NO: 487354 - RNA, 19 nt, Homo sapiens
uaaccgggcucccaucuac

SEQ ID NO: 487355 - RNA, 19 nt, Homo sapiens
gcuaagggcccaugugauc

SEQ ID NO: 487356 - RNA, 19 nt, Homo sapiens
caauaggccacgaauuuga

SEQ ID NO: 487357 - RNA, 19 nt, Homo sapiens
gggucccgcucaucaagua

SEQ ID NO: 487358 - RNA, 19 nt, Homo sapiens
cacccuggcugccugcuaa

SEQ ID NO: 487359 - RNA, 19 nt, Homo sapiens
gcgcuucgaugcggacuau

SEQ ID NO: 487360 - RNA, 19 nt, Homo sapiens
ccucagggcuggagacucu

SEQ ID NO: 487361 - RNA, 19 nt, Homo sapiens
gcacccacccuguucucua

SEQ ID NO: 487362 - RNA, 19 nt, Homo sapiens
ccagauggacacugagaaa

SEQ ID NO: 487363 - RNA, 19 nt, Homo sapiens
agaagaacccuaugaccaa

SEQ ID NO: 487364 - RNA, 19 nt, Homo sapiens
agaagacucagaauuagaa

SEQ ID NO: 487365 - RNA, 19 nt, Homo sapiens
aaucuacccugaccaaugg

SEQ ID NO: 487366 - RNA, 19 nt, Homo sapiens
gcugguaggaucacaauag

SEQ ID NO: 487367 - RNA, 19 nt, Homo sapiens
gagggagugugcgaaucua

SEQ ID NO: 487368 - RNA, 19 nt, Homo sapiens
augaagacaugaaggagaa

SEQ ID NO: 487369 - RNA, 19 nt, Homo sapiens
ggaagaaccagggcagcuu

SEQ ID NO: 487370 - RNA, 19 nt, Homo sapiens
uggauacagugaguuauga

SEQ ID NO: 487371 - RNA, 19 nt, Homo sapiens
gcagagggagugugcgaau

SEQ ID NO: 487372 - RNA, 19 nt, Homo sapiens
gcggcgaccuagagaagug

SEQ ID NO: 487373 - RNA, 19 nt, Homo sapiens
cagccuggaugacaagcaa

SEQ ID NO: 487374 - RNA, 19 nt, Homo sapiens
agaacccuaugaccaacua

SEQ ID NO: 487375 - RNA, 19 nt, Homo sapiens
uacagugaguuaugacaug

SEQ ID NO: 487376 - RNA, 19 nt, Homo sapiens
gaucacaauaggccacgaa

SEQ ID NO: 487377 - RNA, 19 nt, Homo sapiens
accaaugggcucaagaaua

SEQ ID NO: 487378 - RNA, 19 nt, Homo sapiens
gcgaaucuacccugaccaa

SEQ ID NO: 487379 - RNA, 19 nt, Homo sapiens
acacgucguucaaggagau

SEQ ID NO: 487380 - RNA, 19 nt, Homo sapiens
ggucaagguggucuauguu

SEQ ID NO: 487381 - RNA, 19 nt, Homo sapiens
gaaggucaagguggucuau

SEQ ID NO: 487382 - RNA, 19 nt, Homo sapiens
gccaaugcccuugcuguga

SEQ ID NO: 487383 - RNA, 19 nt, Homo sapiens
cccaggagguuguggauac

SEQ ID NO: 487384 - RNA, 19 nt, Homo sapiens
gagcugguaggaucacaau

SEQ ID NO: 487385 - RNA, 19 nt, Homo sapiens
ugacaugcccauucacuac

SEQ ID NO: 487386 - RNA, 19 nt, Homo sapiens
acaauaggccacgaauuug

SEQ ID NO: 487387 - RNA, 19 nt, Homo sapiens
ugaccaaugggcucaagaa

SEQ ID NO: 487388 - RNA, 19 nt, Homo sapiens
ggcuggagacucugaaaga

SEQ ID NO: 487389 - RNA, 19 nt, Homo sapiens
agaggaacauggagcugau

SEQ ID NO: 487390 - RNA, 19 nt, Homo sapiens
agcagaggcuggaggauca

SEQ ID NO: 487391 - RNA, 19 nt, Homo sapiens
gcagaaugagcgcuucgau

SEQ ID NO: 487392 - RNA, 19 nt, Homo sapiens
uagaagacucagaauuaga

SEQ ID NO: 487393 - RNA, 19 nt, Homo sapiens
guggauacagugaguuaug

SEQ ID NO: 487394 - RNA, 19 nt, Homo sapiens
ucacaauaggccacgaauu

SEQ ID NO: 487395 - RNA, 19 nt, Homo sapiens
ugugccagauggacacuga

SEQ ID NO: 487396 - RNA, 19 nt, Homo sapiens
guaaccgggcucccaucua

SEQ ID NO: 487397 - RNA, 19 nt, Homo sapiens
gaccaaugggcucaagaau

SEQ ID NO: 487398 - RNA, 19 nt, Homo sapiens
caaugcccuugcugugaga

SEQ ID NO: 487399 - RNA, 19 nt, Homo sapiens
ucaccguggcgcagaauga

SEQ ID NO: 487400 - RNA, 19 nt, Homo sapiens
gguuguggauacagugagu

SEQ ID NO: 487401 - RNA, 19 nt, Homo sapiens
gagguuguggauacaguga

SEQ ID NO: 487402 - RNA, 19 nt, Homo sapiens
gggcucaagaauaaaguau

SEQ ID NO: 487403 - RNA, 19 nt, Homo sapiens
uucucuaccucuucuauga

SEQ ID NO: 487404 - RNA, 19 nt, Homo sapiens
ggucuccuacuaccauuuc

SEQ ID NO: 487405 - RNA, 19 nt, Homo sapiens
ccaggagguuguggauaca

SEQ ID NO: 487406 - RNA, 19 nt, Homo sapiens
gcucaucaaguacuuugca

SEQ ID NO: 487407 - RNA, 19 nt, Homo sapiens
aaaagauccuggaguuugu

SEQ ID NO: 487408 - RNA, 19 nt, Homo sapiens
gcuggagacucugaaagac

SEQ ID NO: 487409 - RNA, 19 nt, Homo sapiens
gauacagugaguuaugaca

SEQ ID NO: 487410 - RNA, 19 nt, Homo sapiens
gaggcuggaggaucauuuc

SEQ ID NO: 487411 - RNA, 19 nt, Homo sapiens
cugcuaagggcccauguga

SEQ ID NO: 487412 - RNA, 19 nt, Homo sapiens
cacccacccuguucucuac

SEQ ID NO: 487413 - RNA, 19 nt, Homo sapiens
gcggucuccuacuaccauu

SEQ ID NO: 487414 - RNA, 19 nt, Homo sapiens
ggucuauguugcccgaaac

SEQ ID NO: 487415 - RNA, 19 nt, Homo sapiens
aaguagaagacucagaauu

SEQ ID NO: 487416 - RNA, 19 nt, Homo sapiens
acuacagccuggaugacaa

SEQ ID NO: 487417 - RNA, 19 nt, Homo sapiens
agacucagaauuagaagag

SEQ ID NO: 487418 - RNA, 19 nt, Homo sapiens
gaugaagaagaacccuaug

SEQ ID NO: 487419 - RNA, 19 nt, Homo sapiens
ucuaugaagacaugaagga

SEQ ID NO: 487420 - RNA, 19 nt, Homo sapiens
acguggcggucuccuacua

SEQ ID NO: 487421 - RNA, 19 nt, Homo sapiens
gucaagguggucuauguug

SEQ ID NO: 487422 - RNA, 19 nt, Homo sapiens
gaaagaagguggaugaaac

SEQ ID NO: 487423 - RNA, 19 nt, Homo sapiens
gaaggaaccuccauaaacu

SEQ ID NO: 487424 - RNA, 19 nt, Homo sapiens
caaacaaucucugugauga

SEQ ID NO: 487425 - RNA, 19 nt, Homo sapiens
acaaaucguucuacaguuu

SEQ ID NO: 487426 - RNA, 19 nt, Homo sapiens
aagaaucucugaaagcaua

SEQ ID NO: 487427 - RNA, 19 nt, Homo sapiens
gccaaagacuguaugguuu

SEQ ID NO: 487428 - RNA, 19 nt, Homo sapiens
caacguggauucaggaaau

SEQ ID NO: 487429 - RNA, 19 nt, Homo sapiens
gaugaaacagugcuagaua

SEQ ID NO: 487430 - RNA, 19 nt, Homo sapiens
guacaaacaaucucuguga

SEQ ID NO: 487431 - RNA, 19 nt, Homo sapiens
ggaguagagugugcccuua

SEQ ID NO: 487432 - RNA, 19 nt, Homo sapiens
ccuuugagcugcugacuuu

SEQ ID NO: 487433 - RNA, 19 nt, Homo sapiens
ggaaggaaccuccauaaac

SEQ ID NO: 487434 - RNA, 19 nt, Homo sapiens
gagguuugaugaaaucuau

SEQ ID NO: 487435 - RNA, 19 nt, Homo sapiens
ucaauuuccuccuucauga

SEQ ID NO: 487436 - RNA, 19 nt, Homo sapiens
gaaagacagacaccagauu

SEQ ID NO: 487437 - RNA, 19 nt, Homo sapiens
ggaaagaagguggaugaaa

SEQ ID NO: 487438 - RNA, 19 nt, Homo sapiens
gaaauuguggauaugauug

SEQ ID NO: 487439 - RNA, 19 nt, Homo sapiens
gaaagaaaaucccaugaca

SEQ ID NO: 487440 - RNA, 19 nt, Homo sapiens
caggagacgucauuugaga

SEQ ID NO: 487441 - RNA, 19 nt, Homo sapiens
ggauaugauugaacagaau

SEQ ID NO: 487442 - RNA, 19 nt, Homo sapiens
ggaaauuguggauaugauu

SEQ ID NO: 487443 - RNA, 19 nt, Homo sapiens
caaauacuaucuucaaucc

SEQ ID NO: 487444 - RNA, 19 nt, Homo sapiens
gcaaauacuaucuucaauc

SEQ ID NO: 487445 - RNA, 19 nt, Homo sapiens
aaugagagguuugaugaaa

SEQ ID NO: 487446 - RNA, 19 nt, Homo sapiens
ggagacgucauuugagaaa

SEQ ID NO: 487447 - RNA, 19 nt, Homo sapiens
gcugagagccucccaaagu

SEQ ID NO: 487448 - RNA, 19 nt, Homo sapiens
gacaaaucguucuacaguu

SEQ ID NO: 487449 - RNA, 19 nt, Homo sapiens
agacucaccuuuccacuca

SEQ ID NO: 487450 - RNA, 19 nt, Homo sapiens
gaacucugagcaagaugua

SEQ ID NO: 487451 - RNA, 19 nt, Homo sapiens
gcaagagugcaaauacuau

SEQ ID NO: 487452 - RNA, 19 nt, Homo sapiens
ggaaacagauaaaacugaa

SEQ ID NO: 487453 - RNA, 19 nt, Homo sapiens
ggaaggugaugcaguucau

SEQ ID NO: 487454 - RNA, 19 nt, Homo sapiens
gaaaugccaaagacuguau

SEQ ID NO: 487455 - RNA, 19 nt, Homo sapiens
ccguaacucugacacagua

SEQ ID NO: 487456 - RNA, 19 nt, Homo sapiens
agaaugagagguuugauga

SEQ ID NO: 487457 - RNA, 19 nt, Homo sapiens
ggacccaaagcaugaaauu

SEQ ID NO: 487458 - RNA, 19 nt, Homo sapiens
ggagccagauccagagcuu

SEQ ID NO: 487459 - RNA, 19 nt, Homo sapiens
agaagaaucucugaaagca

SEQ ID NO: 487460 - RNA, 19 nt, Homo sapiens
gaaccuccauaaacuucug

SEQ ID NO: 487461 - RNA, 19 nt, Homo sapiens
caacaccgccauccuuuca

SEQ ID NO: 487462 - RNA, 19 nt, Homo sapiens
ggcaagagugcaaauacua

SEQ ID NO: 487463 - RNA, 19 nt, Homo sapiens
guucuacaguuuccaaauc

SEQ ID NO: 487464 - RNA, 19 nt, Homo sapiens
ugacaaaucguucuacagu

SEQ ID NO: 487465 - RNA, 19 nt, Homo sapiens
gagaggaggaguagagugu

SEQ ID NO: 487466 - RNA, 19 nt, Homo sapiens
ugagagguuugaugaaauc

SEQ ID NO: 487467 - RNA, 19 nt, Homo sapiens
gaaaaucccaugacaaauc

SEQ ID NO: 487468 - RNA, 19 nt, Homo sapiens
ugaaacagugcuagauaaa

SEQ ID NO: 487469 - RNA, 19 nt, Homo sapiens
augaaacagugcuagauaa

SEQ ID NO: 487470 - RNA, 19 nt, Homo sapiens
gaaaggauggugggagaug

SEQ ID NO: 487471 - RNA, 19 nt, Homo sapiens
ugacacaguaguaauuuga

SEQ ID NO: 487472 - RNA, 19 nt, Homo sapiens
gugcaaauacuaucuucaa

SEQ ID NO: 487473 - RNA, 19 nt, Homo sapiens
guaccugggaagaguauuu

SEQ ID NO: 487474 - RNA, 19 nt, Homo sapiens
aaagguggauggcaagagu

SEQ ID NO: 487475 - RNA, 19 nt, Homo sapiens
cagauucucuuccucuucu

SEQ ID NO: 487476 - RNA, 19 nt, Homo sapiens
gauggugggagaugaaaga

SEQ ID NO: 487477 - RNA, 19 nt, Homo sapiens
gaaugagagguuugaugaa

SEQ ID NO: 487478 - RNA, 19 nt, Homo sapiens
gagugcaaauacuaucuuc

SEQ ID NO: 487479 - RNA, 19 nt, Homo sapiens
aaaccuucaucaauggaaa

SEQ ID NO: 487480 - RNA, 19 nt, Homo sapiens
acaccgccauccuuucauu

SEQ ID NO: 487481 - RNA, 19 nt, Homo sapiens
gcagggacaacguggauuc

SEQ ID NO: 487482 - RNA, 19 nt, Homo sapiens
cuacuaccauuuccaaagg

SEQ ID NO: 487483 - RNA, 19 nt, Homo sapiens
uggauaugauugaacagaa

SEQ ID NO: 487484 - RNA, 19 nt, Homo sapiens
caucugcaccuacccuaaa

SEQ ID NO: 487485 - RNA, 19 nt, Homo sapiens
uaacucugacacaguagua

SEQ ID NO: 487486 - RNA, 19 nt, Homo sapiens
gauggcaagagugcaaaua

SEQ ID NO: 487487 - RNA, 19 nt, Homo sapiens
caugacaaaucguucuaca

SEQ ID NO: 487488 - RNA, 19 nt, Homo sapiens
gaaaccuucaucaauggaa

SEQ ID NO: 487489 - RNA, 19 nt, Homo sapiens
aacaguaugucaccacuuc

SEQ ID NO: 487490 - RNA, 19 nt, Homo sapiens
cuagagggaguugguauuu

SEQ ID NO: 487491 - RNA, 19 nt, Homo sapiens
ugaugcaguucaugggaaa

SEQ ID NO: 487492 - RNA, 19 nt, Homo sapiens
agugugcccuuaguucaua

SEQ ID NO: 487493 - RNA, 19 nt, Homo sapiens
aaagacagacaccagauuc

SEQ ID NO: 487494 - RNA, 19 nt, Homo sapiens
aaaggauggugggagauga

SEQ ID NO: 487495 - RNA, 19 nt, Homo sapiens
ccaaagacuguaugguuuc

SEQ ID NO: 487496 - RNA, 19 nt, Homo sapiens
caaguuccuuuauguagcu

SEQ ID NO: 487497 - RNA, 19 nt, Homo sapiens
gauaugauugaacagaaug

SEQ ID NO: 487498 - RNA, 19 nt, Homo sapiens
uagagggaguugguauuug

SEQ ID NO: 487499 - RNA, 19 nt, Homo sapiens
cauaaacuucugcauggaa

SEQ ID NO: 487500 - RNA, 19 nt, Homo sapiens
aagacuguaugguuuccua

SEQ ID NO: 487501 - RNA, 19 nt, Homo sapiens
ccaaccuucugguguggaa

SEQ ID NO: 487502 - RNA, 19 nt, Homo sapiens
ucaggaaauuguggauaug

SEQ ID NO: 487503 - RNA, 19 nt, Homo sapiens
ucacuguugcccagaauga

SEQ ID NO: 487504 - RNA, 19 nt, Homo sapiens
agagggacccaaagcauga

SEQ ID NO: 487505 - RNA, 19 nt, Homo sapiens
ugccaaagacuguaugguu

SEQ ID NO: 487506 - RNA, 19 nt, Homo sapiens
cugagagccucccaaagug

SEQ ID NO: 487507 - RNA, 19 nt, Homo sapiens
uucaggaaauuguggauau

SEQ ID NO: 487508 - RNA, 19 nt, Homo sapiens
ggaugaaacagugcuagau

SEQ ID NO: 487509 - RNA, 19 nt, Homo sapiens
gaucaugguacagugagaa

SEQ ID NO: 487510 - RNA, 19 nt, Homo sapiens
acuuucagcuggaacuuga

SEQ ID NO: 487511 - RNA, 19 nt, Homo sapiens
ggaacucugagcaagaugu

SEQ ID NO: 487512 - RNA, 19 nt, Homo sapiens
ggccaggaaagaugugaaa

SEQ ID NO: 487513 - RNA, 19 nt, Homo sapiens
caugguacagugagaaguu

SEQ ID NO: 487514 - RNA, 19 nt, Homo sapiens
ugggaaagaagguggauga

SEQ ID NO: 487515 - RNA, 19 nt, Homo sapiens
uaaagagggacccaaagca

SEQ ID NO: 487516 - RNA, 19 nt, Homo sapiens
ggucacaggguuuguuucu

SEQ ID NO: 487517 - RNA, 19 nt, Homo sapiens
acuguaugguuuccuacua

SEQ ID NO: 487518 - RNA, 19 nt, Homo sapiens
cgaaaugccaaagacugua

SEQ ID NO: 487519 - RNA, 19 nt, Homo sapiens
ucccaacuauucuuuccaa

SEQ ID NO: 487520 - RNA, 19 nt, Homo sapiens
acaaacaaucucugugaug

SEQ ID NO: 487521 - RNA, 19 nt, Homo sapiens
uacaaacaaucucugugau

SEQ ID NO: 487522 - RNA, 19 nt, Homo sapiens
ccacgacccucauaauaaa

SEQ ID NO: 487523 - RNA, 19 nt, Homo sapiens
caaagacaacuuccuauuu

SEQ ID NO: 487524 - RNA, 19 nt, Homo sapiens
acacgucgauucugucuaa

SEQ ID NO: 487525 - RNA, 19 nt, Homo sapiens
gacgacaucuuuaucauca

SEQ ID NO: 487526 - RNA, 19 nt, Homo sapiens
gcaaagacaacuuccuauu

SEQ ID NO: 487527 - RNA, 19 nt, Homo sapiens
ccaacaccauguccaacua

SEQ ID NO: 487528 - RNA, 19 nt, Homo sapiens
gggcaaagacaacuuccua

SEQ ID NO: 487529 - RNA, 19 nt, Homo sapiens
ggagaacacccaagaugug

SEQ ID NO: 487530 - RNA, 19 nt, Homo sapiens
ccaccacgcuuggcugauu

SEQ ID NO: 487531 - RNA, 19 nt, Homo sapiens
gcacccaccucccuacucu

SEQ ID NO: 487532 - RNA, 19 nt, Homo sapiens
gaaguugccaggugaauac

SEQ ID NO: 487533 - RNA, 19 nt, Homo sapiens
ccaaagugcugggauuaca

SEQ ID NO: 487534 - RNA, 19 nt, Homo sapiens
caaaggcgaagugcaguuu

SEQ ID NO: 487535 - RNA, 19 nt, Homo sapiens
cucaugagcucccaucuuc

SEQ ID NO: 487536 - RNA, 19 nt, Homo sapiens
auaaacacgucgauucugu

SEQ ID NO: 487537 - RNA, 19 nt, Homo sapiens
gacaacuuccuauuuauca

SEQ ID NO: 487538 - RNA, 19 nt, Homo sapiens
ggacgacgacaucuuuauc

SEQ ID NO: 487539 - RNA, 19 nt, Homo sapiens
cgaccuggaugaucgagau

SEQ ID NO: 487540 - RNA, 19 nt, Homo sapiens
gcgggacgacgacaucuuu

SEQ ID NO: 487541 - RNA, 19 nt, Homo sapiens
gcacccacgacccucauaa

SEQ ID NO: 487542 - RNA, 19 nt, Homo sapiens
uggucucccucuaucauua

SEQ ID NO: 487543 - RNA, 19 nt, Homo sapiens
cgccugaccagcuuuauaa

SEQ ID NO: 487544 - RNA, 19 nt, Homo sapiens
cccacgacccucauaauaa

SEQ ID NO: 487545 - RNA, 19 nt, Homo sapiens
gcggagaacacccaagaug

SEQ ID NO: 487546 - RNA, 19 nt, Homo sapiens
gugaauacuuccgguacaa

SEQ ID NO: 487547 - RNA, 19 nt, Homo sapiens
ggaugaagggcaaagacaa

SEQ ID NO: 487548 - RNA, 19 nt, Homo sapiens
gcgccugaccagcuuuaua

SEQ ID NO: 487549 - RNA, 19 nt, Homo sapiens
ggugaauacuuccgguaca

SEQ ID NO: 487550 - RNA, 19 nt, Homo sapiens
caccacgcuuggcugauuu

SEQ ID NO: 487551 - RNA, 19 nt, Homo sapiens
uaauaaacacgucgauucu

SEQ ID NO: 487552 - RNA, 19 nt, Homo sapiens
auaauaaacacgucgauuc

SEQ ID NO: 487553 - RNA, 19 nt, Homo sapiens
guugccaggugaauacuuc

SEQ ID NO: 487554 - RNA, 19 nt, Homo sapiens
ugucaccacuuuacagaag

SEQ ID NO: 487555 - RNA, 19 nt, Homo sapiens
gacgacgacaucuuuauca

SEQ ID NO: 487556 - RNA, 19 nt, Homo sapiens
ccauccagaucuucaccaa

SEQ ID NO: 487557 - RNA, 19 nt, Homo sapiens
cauaauaaacacgucgauu

SEQ ID NO: 487558 - RNA, 19 nt, Homo sapiens
ccaccucugucucccaaag

SEQ ID NO: 487559 - RNA, 19 nt, Homo sapiens
gcaucagcuuggcggagaa

SEQ ID NO: 487560 - RNA, 19 nt, Homo sapiens
acccacgacccucauaaua

SEQ ID NO: 487561 - RNA, 19 nt, Homo sapiens
guuguggucucccucuauc

SEQ ID NO: 487562 - RNA, 19 nt, Homo sapiens
ccaaggccaaggugaucua

SEQ ID NO: 487563 - RNA, 19 nt, Homo sapiens
agaaguugccaggugaaua

SEQ ID NO: 487564 - RNA, 19 nt, Homo sapiens
cggaguaacugggaguaca

SEQ ID NO: 487565 - RNA, 19 nt, Homo sapiens
gggacgacgacaucuuuau

SEQ ID NO: 487566 - RNA, 19 nt, Homo sapiens
gcucccaucuucccaucca

SEQ ID NO: 487567 - RNA, 19 nt, Homo sapiens
gagugucgccacccugaga

SEQ ID NO: 487568 - RNA, 19 nt, Homo sapiens
guggcacacucaaccuuca

SEQ ID NO: 487569 - RNA, 19 nt, Homo sapiens
agacaacuuccuauuuauc

SEQ ID NO: 487570 - RNA, 19 nt, Homo sapiens
ggcaaagacaacuuccuau

SEQ ID NO: 487571 - RNA, 19 nt, Homo sapiens
gaugaagggcaaagacaac

SEQ ID NO: 487572 - RNA, 19 nt, Homo sapiens
ugccucagccuccggagua

SEQ ID NO: 487573 - RNA, 19 nt, Homo sapiens
cgacgacaucuuuaucauc

SEQ ID NO: 487574 - RNA, 19 nt, Homo sapiens
aggccaaggugaucuacau

SEQ ID NO: 487575 - RNA, 19 nt, Homo sapiens
cggagaacacccaagaugu

SEQ ID NO: 487576 - RNA, 19 nt, Homo sapiens
gcuccaaggccaaggugau

SEQ ID NO: 487577 - RNA, 19 nt, Homo sapiens
caacacacauauacacuaa

SEQ ID NO: 487578 - RNA, 19 nt, Homo sapiens
caacaggccugcagacuca

SEQ ID NO: 487579 - RNA, 19 nt, Homo sapiens
ggacaaaguucagaaugga

SEQ ID NO: 487580 - RNA, 19 nt, Homo sapiens
gcucugaggucuuugaugu

SEQ ID NO: 487581 - RNA, 19 nt, Homo sapiens
gaaaggugauucugauucu

SEQ ID NO: 487582 - RNA, 19 nt, Homo sapiens
ggagaccucugacccuuau

SEQ ID NO: 487583 - RNA, 19 nt, Homo sapiens
cuacaggucugcuacaaug

SEQ ID NO: 487584 - RNA, 19 nt, Homo sapiens
aaaucgggcugguuaauga

SEQ ID NO: 487585 - RNA, 19 nt, Homo sapiens
gcacggcucugugaugugu

SEQ ID NO: 487586 - RNA, 19 nt, Homo sapiens
gcagaugucauuucagaga

SEQ ID NO: 487587 - RNA, 19 nt, Homo sapiens
auaauaaucuggccaguag

SEQ ID NO: 487588 - RNA, 19 nt, Homo sapiens
caggaaaucgggcugguua

SEQ ID NO: 487589 - RNA, 19 nt, Homo sapiens
ggucuuugaugucacagaa

SEQ ID NO: 487590 - RNA, 19 nt, Homo sapiens
aacaagagauccaguuuca

SEQ ID NO: 487591 - RNA, 19 nt, Homo sapiens
ucacaaacccaaggcauuu

SEQ ID NO: 487592 - RNA, 19 nt, Homo sapiens
caagagauccaguuucaca

SEQ ID NO: 487593 - RNA, 19 nt, Homo sapiens
gaaaucgggcugguuaaug

SEQ ID NO: 487594 - RNA, 19 nt, Homo sapiens
uggagagacuguagaauca

SEQ ID NO: 487595 - RNA, 19 nt, Homo sapiens
ucaaauggcugggcagagu

SEQ ID NO: 487596 - RNA, 19 nt, Homo sapiens
gcucaggagucaacacaca

SEQ ID NO: 487597 - RNA, 19 nt, Homo sapiens
gagaagaggaagcaaguuc

SEQ ID NO: 487598 - RNA, 19 nt, Homo sapiens
uaagcuggauggagaggaa

SEQ ID NO: 487599 - RNA, 19 nt, Homo sapiens
aaaaggaacugaacauugu

SEQ ID NO: 487600 - RNA, 19 nt, Homo sapiens
ugacucugcuccauccauu

SEQ ID NO: 487601 - RNA, 19 nt, Homo sapiens
gaaucuugcucaggaaauc

SEQ ID NO: 487602 - RNA, 19 nt, Homo sapiens
aggcagaugucauuucaga

SEQ ID NO: 487603 - RNA, 19 nt, Homo sapiens
cuaggcagaugucauuuca

SEQ ID NO: 487604 - RNA, 19 nt, Homo sapiens
ggaugaugguuacaaugug

SEQ ID NO: 487605 - RNA, 19 nt, Homo sapiens
gggcacggcucugugaugu

SEQ ID NO: 487606 - RNA, 19 nt, Homo sapiens
ggagucaacacacauauac

SEQ ID NO: 487607 - RNA, 19 nt, Homo sapiens
gcagguggcuaagcuggau

SEQ ID NO: 487608 - RNA, 19 nt, Homo sapiens
uacaaaggcuucucuccau

SEQ ID NO: 487609 - RNA, 19 nt, Homo sapiens
gccaguagacauuugguuu

SEQ ID NO: 487610 - RNA, 19 nt, Homo sapiens
ggauggagagacuguagaa

SEQ ID NO: 487611 - RNA, 19 nt, Homo sapiens
gcugaauccugaagacaag

SEQ ID NO: 487612 - RNA, 19 nt, Homo sapiens
gaagcacccaucccuccua

SEQ ID NO: 487613 - RNA, 19 nt, Homo sapiens
ugcaaucugugguuucaaa

SEQ ID NO: 487614 - RNA, 19 nt, Homo sapiens
ggaaaucgggcugguuaau

SEQ ID NO: 487615 - RNA, 19 nt, Homo sapiens
cagaacggcuuggaaucuu

SEQ ID NO: 487616 - RNA, 19 nt, Homo sapiens
cuuguuggcucuucauguu

SEQ ID NO: 487617 - RNA, 19 nt, Homo sapiens
cagaugucauuucagagaa

SEQ ID NO: 487618 - RNA, 19 nt, Homo sapiens
cauauacacuaaggaggaa

SEQ ID NO: 487619 - RNA, 19 nt, Homo sapiens
gugcaguguuggccuauca

SEQ ID NO: 487620 - RNA, 19 nt, Homo sapiens
ggugcaaucugugguuuca

SEQ ID NO: 487621 - RNA, 19 nt, Homo sapiens
caaccgacgcucugagaug

SEQ ID NO: 487622 - RNA, 19 nt, Homo sapiens
ccucaaggaucugcauuca

SEQ ID NO: 487623 - RNA, 19 nt, Homo sapiens
gaauggaagaugggagaaa

SEQ ID NO: 487624 - RNA, 19 nt, Homo sapiens
uuuaggcugucacuacuuu

SEQ ID NO: 487625 - RNA, 19 nt, Homo sapiens
ucuuugaugucacagaauu

SEQ ID NO: 487626 - RNA, 19 nt, Homo sapiens
uugcugaccuucucugugu

SEQ ID NO: 487627 - RNA, 19 nt, Homo sapiens
gggcuucuucacccauuua

SEQ ID NO: 487628 - RNA, 19 nt, Homo sapiens
ccagacaccuaucgcuuac

SEQ ID NO: 487629 - RNA, 19 nt, Homo sapiens
acacacauauacacuaagg

SEQ ID NO: 487630 - RNA, 19 nt, Homo sapiens
gaugucauuucagagaaga

SEQ ID NO: 487631 - RNA, 19 nt, Homo sapiens
caaaaggaacugaacauug

SEQ ID NO: 487632 - RNA, 19 nt, Homo sapiens
ggacugggagacuguagau

SEQ ID NO: 487633 - RNA, 19 nt, Homo sapiens
uaacaagagauccaguuuc

SEQ ID NO: 487634 - RNA, 19 nt, Homo sapiens
ucaacacacauauacacua

SEQ ID NO: 487635 - RNA, 19 nt, Homo sapiens
ccucucacccauucccuua

SEQ ID NO: 487636 - RNA, 19 nt, Homo sapiens
caccaacucugugaaacug

SEQ ID NO: 487637 - RNA, 19 nt, Homo sapiens
aaccgacgcucugagauga

SEQ ID NO: 487638 - RNA, 19 nt, Homo sapiens
uggaugacuugcacaacuu

SEQ ID NO: 487639 - RNA, 19 nt, Homo sapiens
ucaggagucaacacacaua

SEQ ID NO: 487640 - RNA, 19 nt, Homo sapiens
acugggagacuguagauuu

SEQ ID NO: 487641 - RNA, 19 nt, Homo sapiens
ggaugacuugcacaacuuu

SEQ ID NO: 487642 - RNA, 19 nt, Homo sapiens
ggagcugaauccugaagac

SEQ ID NO: 487643 - RNA, 19 nt, Homo sapiens
uaucaggaccaucggugua

SEQ ID NO: 487644 - RNA, 19 nt, Homo sapiens
cgggcugguuaaugaauaa

SEQ ID NO: 487645 - RNA, 19 nt, Homo sapiens
aaaggugauucugauucua

SEQ ID NO: 487646 - RNA, 19 nt, Homo sapiens
guuguccucugcugacuuc

SEQ ID NO: 487647 - RNA, 19 nt, Homo sapiens
cugagguccugcuggcaua

SEQ ID NO: 487648 - RNA, 19 nt, Homo sapiens
acggcucugugauguguua

SEQ ID NO: 487649 - RNA, 19 nt, Homo sapiens
agaacggcuuggaaucuug

SEQ ID NO: 487650 - RNA, 19 nt, Homo sapiens
uccagacaccuaucgcuua

SEQ ID NO: 487651 - RNA, 19 nt, Homo sapiens
gggugacucugggcucuga

SEQ ID NO: 487652 - RNA, 19 nt, Homo sapiens
ucucugaagugcuccaagu

SEQ ID NO: 487653 - RNA, 19 nt, Homo sapiens
uggacaaaguucagaaugg

SEQ ID NO: 487654 - RNA, 19 nt, Homo sapiens
agaggaagcaaguucagaa

SEQ ID NO: 487655 - RNA, 19 nt, Homo sapiens
gcuggcauaugagaugaau

SEQ ID NO: 487656 - RNA, 19 nt, Homo sapiens
ggucuggaguggagaacag

SEQ ID NO: 487657 - RNA, 19 nt, Homo sapiens
cagaauuuguggaccuaca

SEQ ID NO: 487658 - RNA, 19 nt, Homo sapiens
ucugaggucuuugauguca

SEQ ID NO: 487659 - RNA, 19 nt, Homo sapiens
ucugggcucugaggucuuu

SEQ ID NO: 487660 - RNA, 19 nt, Homo sapiens
ucgggcugguuaaugaaua

SEQ ID NO: 487661 - RNA, 19 nt, Homo sapiens
ggaaucuugcucaggaaau

SEQ ID NO: 487662 - RNA, 19 nt, Homo sapiens
ccucuaugcuguucacaac

SEQ ID NO: 487663 - RNA, 19 nt, Homo sapiens
cagcacagucuucucugaa

SEQ ID NO: 487664 - RNA, 19 nt, Homo sapiens
agagauccaguuucacaaa

SEQ ID NO: 487665 - RNA, 19 nt, Homo sapiens
aauaauaaucuggccagua

SEQ ID NO: 487666 - RNA, 19 nt, Homo sapiens
gcgagguguucucagcaau

SEQ ID NO: 487667 - RNA, 19 nt, Homo sapiens
cagagaagaggaagcaagu

SEQ ID NO: 487668 - RNA, 19 nt, Homo sapiens
gaagaggaagcaaguucag

SEQ ID NO: 487669 - RNA, 19 nt, Homo sapiens
ucugaagugcuccaaguuu

SEQ ID NO: 487670 - RNA, 19 nt, Homo sapiens
ccauuuaggcugucacuac

SEQ ID NO: 487671 - RNA, 19 nt, Homo sapiens
aauauaggguuuggugcaa

SEQ ID NO: 487672 - RNA, 19 nt, Homo sapiens
gacaaaguucagaauggaa

SEQ ID NO: 487673 - RNA, 19 nt, Homo sapiens
ggcaucguguccaugucua

SEQ ID NO: 487674 - RNA, 19 nt, Homo sapiens
ugaggucuuugaugucaca

SEQ ID NO: 487675 - RNA, 19 nt, Homo sapiens
ucucuaugguggacaaagu

SEQ ID NO: 487676 - RNA, 19 nt, Homo sapiens
ccaguagacauuugguuuc

SEQ ID NO: 487677 - RNA, 19 nt, Homo sapiens
gaacugaacuuaauucuca

SEQ ID NO: 487678 - RNA, 19 nt, Homo sapiens
gaucuuauauggagaauga

SEQ ID NO: 487679 - RNA, 19 nt, Homo sapiens
gauaagggaugaagaugua

SEQ ID NO: 487680 - RNA, 19 nt, Homo sapiens
gaaacccuaucucuacuaa

SEQ ID NO: 487681 - RNA, 19 nt, Homo sapiens
ccugaaaccuuaaauauca

SEQ ID NO: 487682 - RNA, 19 nt, Homo sapiens
ggcccaagcugaagacuuu

SEQ ID NO: 487683 - RNA, 19 nt, Homo sapiens
gaagaaccauagagaagau

SEQ ID NO: 487684 - RNA, 19 nt, Homo sapiens
ucaaggaacugugcuauau

SEQ ID NO: 487685 - RNA, 19 nt, Homo sapiens
agaaauagcuacagugaca

SEQ ID NO: 487686 - RNA, 19 nt, Homo sapiens
ucugaucccuuccuuguua

SEQ ID NO: 487687 - RNA, 19 nt, Homo sapiens
ccgaagaacugaacuuaau

SEQ ID NO: 487688 - RNA, 19 nt, Homo sapiens
acagaaugcuacaagaaua

SEQ ID NO: 487689 - RNA, 19 nt, Homo sapiens
gauaaauuguuccaagaga

SEQ ID NO: 487690 - RNA, 19 nt, Homo sapiens
ggacaaagcacaacuucug

SEQ ID NO: 487691 - RNA, 19 nt, Homo sapiens
gagaagaucugucaauucc

SEQ ID NO: 487692 - RNA, 19 nt, Homo sapiens
aagaacagcuccuuucaga

SEQ ID NO: 487693 - RNA, 19 nt, Homo sapiens
ccaaguggauccaaucugu

SEQ ID NO: 487694 - RNA, 19 nt, Homo sapiens
gaagaggucaucaucaugu

SEQ ID NO: 487695 - RNA, 19 nt, Homo sapiens
gcugaagacuuugauaaau

SEQ ID NO: 487696 - RNA, 19 nt, Homo sapiens
ggacacaggaagaaccaua

SEQ ID NO: 487697 - RNA, 19 nt, Homo sapiens
uagagaagaucugucaauu

SEQ ID NO: 487698 - RNA, 19 nt, Homo sapiens
uagcuacagugacagauuu

SEQ ID NO: 487699 - RNA, 19 nt, Homo sapiens
uaagaaauagcuacaguga

SEQ ID NO: 487700 - RNA, 19 nt, Homo sapiens
ggaagaauauuuugaaugg

SEQ ID NO: 487701 - RNA, 19 nt, Homo sapiens
uaauguacguacuaccuaa

SEQ ID NO: 487702 - RNA, 19 nt, Homo sapiens
gaugaaacccuaucucuac

SEQ ID NO: 487703 - RNA, 19 nt, Homo sapiens
gaagaacugaacuuaauuc

SEQ ID NO: 487704 - RNA, 19 nt, Homo sapiens
gacgauuucuuaugguuug

SEQ ID NO: 487705 - RNA, 19 nt, Homo sapiens
gauccgaaaccuuaagaaa

SEQ ID NO: 487706 - RNA, 19 nt, Homo sapiens
gcccagggaugcaaagguu

SEQ ID NO: 487707 - RNA, 19 nt, Homo sapiens
ggaagaaccauagagaaga

SEQ ID NO: 487708 - RNA, 19 nt, Homo sapiens
caaggugauuuaucucaug

SEQ ID NO: 487709 - RNA, 19 nt, Homo sapiens
caaagucaugggaagaaua

SEQ ID NO: 487710 - RNA, 19 nt, Homo sapiens
ccaaggccaaggugauuua

SEQ ID NO: 487711 - RNA, 19 nt, Homo sapiens
gaaacaggacacaggaaga

SEQ ID NO: 487712 - RNA, 19 nt, Homo sapiens
ccaagucuuucuucaguuc

SEQ ID NO: 487713 - RNA, 19 nt, Homo sapiens
caugagaaaucccagagau

SEQ ID NO: 487714 - RNA, 19 nt, Homo sapiens
ggagaguccacguuuauuc

SEQ ID NO: 487715 - RNA, 19 nt, Homo sapiens
cuaaaaggaugucuaaaug

SEQ ID NO: 487716 - RNA, 19 nt, Homo sapiens
ggagaaucguuugaacuca

SEQ ID NO: 487717 - RNA, 19 nt, Homo sapiens
cuauaugggucaugguuug

SEQ ID NO: 487718 - RNA, 19 nt, Homo sapiens
cagaaugcuacaagaauaa

SEQ ID NO: 487719 - RNA, 19 nt, Homo sapiens
gaaaccccaucucuacuaa

SEQ ID NO: 487720 - RNA, 19 nt, Homo sapiens
gaguguugauuauguagug

SEQ ID NO: 487721 - RNA, 19 nt, Homo sapiens
gcaggaagaggucaucauc

SEQ ID NO: 487722 - RNA, 19 nt, Homo sapiens
caugucggacgauuucuua

SEQ ID NO: 487723 - RNA, 19 nt, Homo sapiens
gaaaacaagauguccaauu

SEQ ID NO: 487724 - RNA, 19 nt, Homo sapiens
ggacgauuucuuaugguuu

SEQ ID NO: 487725 - RNA, 19 nt, Homo sapiens
caaacugguuggcugagau

SEQ ID NO: 487726 - RNA, 19 nt, Homo sapiens
gugaugaguucgugauaag

SEQ ID NO: 487727 - RNA, 19 nt, Homo sapiens
ggcauagcuuucccuacua

SEQ ID NO: 487728 - RNA, 19 nt, Homo sapiens
aaggaugucuaaauguuug

SEQ ID NO: 487729 - RNA, 19 nt, Homo sapiens
ugagguaggagaaucguuu

SEQ ID NO: 487730 - RNA, 19 nt, Homo sapiens
ccugaguguugauuaugua

SEQ ID NO: 487731 - RNA, 19 nt, Homo sapiens
ggaagaggucaucaucaug

SEQ ID NO: 487732 - RNA, 19 nt, Homo sapiens
gacaaagcacaacuucuga

SEQ ID NO: 487733 - RNA, 19 nt, Homo sapiens
cgaagaacugaacuuaauu

SEQ ID NO: 487734 - RNA, 19 nt, Homo sapiens
gacguuagaacccgaagaa

SEQ ID NO: 487735 - RNA, 19 nt, Homo sapiens
gagaaaucccagagauguu

SEQ ID NO: 487736 - RNA, 19 nt, Homo sapiens
cgugaugaguucgugauaa

SEQ ID NO: 487737 - RNA, 19 nt, Homo sapiens
caaagcacaacuucugaga

SEQ ID NO: 487738 - RNA, 19 nt, Homo sapiens
uugcaauguuucccguuua

SEQ ID NO: 487739 - RNA, 19 nt, Homo sapiens
ggaggcagagguugcaaug

SEQ ID NO: 487740 - RNA, 19 nt, Homo sapiens
ccauagagaagaucuguca

SEQ ID NO: 487741 - RNA, 19 nt, Homo sapiens
uuaagaaaccaaagucaug

SEQ ID NO: 487742 - RNA, 19 nt, Homo sapiens
agaaaucccagagauguuu

SEQ ID NO: 487743 - RNA, 19 nt, Homo sapiens
agagugagauuggguauac

SEQ ID NO: 487744 - RNA, 19 nt, Homo sapiens
gggaugaagauguaauaau

SEQ ID NO: 487745 - RNA, 19 nt, Homo sapiens
guaggagaaucguuugaac

SEQ ID NO: 487746 - RNA, 19 nt, Homo sapiens
aagcugaagacuuugauaa

SEQ ID NO: 487747 - RNA, 19 nt, Homo sapiens
aaacaggacacaggaagaa

SEQ ID NO: 487748 - RNA, 19 nt, Homo sapiens
caucaugucggacgauuuc

SEQ ID NO: 487749 - RNA, 19 nt, Homo sapiens
aggaagaggucaucaucau

SEQ ID NO: 487750 - RNA, 19 nt, Homo sapiens
guuagaacccgaagaacug

SEQ ID NO: 487751 - RNA, 19 nt, Homo sapiens
aaaaguacgugaugaguuc

SEQ ID NO: 487752 - RNA, 19 nt, Homo sapiens
ccaaagucaugggaagaau

SEQ ID NO: 487753 - RNA, 19 nt, Homo sapiens
ugagaaaucccagagaugu

SEQ ID NO: 487754 - RNA, 19 nt, Homo sapiens
aggcauagcuuucccuacu

SEQ ID NO: 487755 - RNA, 19 nt, Homo sapiens
uuacagaaugcuacaagaa

SEQ ID NO: 487756 - RNA, 19 nt, Homo sapiens
ugaugaaacccuaucucua

SEQ ID NO: 487757 - RNA, 19 nt, Homo sapiens
uaucaaaccucugcaucuc

SEQ ID NO: 487758 - RNA, 19 nt, Homo sapiens
caagaauaauguacguacu

SEQ ID NO: 487759 - RNA, 19 nt, Homo sapiens
gaaaaguacgugaugaguu

SEQ ID NO: 487760 - RNA, 19 nt, Homo sapiens
ccaaggugauuuaucucau

SEQ ID NO: 487761 - RNA, 19 nt, Homo sapiens
guuaugaggagcugaaaca

SEQ ID NO: 487762 - RNA, 19 nt, Homo sapiens
gucaaggaacugugcuaua

SEQ ID NO: 487763 - RNA, 19 nt, Homo sapiens
aaagucaugggaagaauau

SEQ ID NO: 487764 - RNA, 19 nt, Homo sapiens
gguaggagaaucguuugaa

SEQ ID NO: 487765 - RNA, 19 nt, Homo sapiens
ugauucuccuguccuugua

SEQ ID NO: 487766 - RNA, 19 nt, Homo sapiens
ccuccugaguguugauuau

SEQ ID NO: 487767 - RNA, 19 nt, Homo sapiens
ucaagaacagcuccuuuca

SEQ ID NO: 487768 - RNA, 19 nt, Homo sapiens
gcuauaugggucaugguuu

SEQ ID NO: 487769 - RNA, 19 nt, Homo sapiens
aaggaacugugcuauaugg

SEQ ID NO: 487770 - RNA, 19 nt, Homo sapiens
aaggugauuuaucucauga

SEQ ID NO: 487771 - RNA, 19 nt, Homo sapiens
gaugccaaguggauccaau

SEQ ID NO: 487772 - RNA, 19 nt, Homo sapiens
aggcagagguugcaaugag

SEQ ID NO: 487773 - RNA, 19 nt, Homo sapiens
cugagaccauccuggcuaa

SEQ ID NO: 487774 - RNA, 19 nt, Homo sapiens
caagcugaagacuuugaua

SEQ ID NO: 487775 - RNA, 19 nt, Homo sapiens
caaggaacugugcuauaug

SEQ ID NO: 487776 - RNA, 19 nt, Homo sapiens
agucaugggaagaauauuu

SEQ ID NO: 487777 - RNA, 19 nt, Homo sapiens
gaacagaacuucaaauacu

SEQ ID NO: 487778 - RNA, 19 nt, Homo sapiens
gaagaaauccugaggcuuu

SEQ ID NO: 487779 - RNA, 19 nt, Homo sapiens
gaaacgaagcuaugugaaa

SEQ ID NO: 487780 - RNA, 19 nt, Homo sapiens
gauuuggguugguggauua

SEQ ID NO: 487781 - RNA, 19 nt, Homo sapiens
gagaguaggaugcugauuu

SEQ ID NO: 487782 - RNA, 19 nt, Homo sapiens
gcacagcaguaucccuuga

SEQ ID NO: 487783 - RNA, 19 nt, Homo sapiens
agacucagcugacuguuga

SEQ ID NO: 487784 - RNA, 19 nt, Homo sapiens
gaacuucaaauacuuccua

SEQ ID NO: 487785 - RNA, 19 nt, Homo sapiens
ggaacuaaaugaacagaac

SEQ ID NO: 487786 - RNA, 19 nt, Homo sapiens
auaaagaccuagcaagaug

SEQ ID NO: 487787 - RNA, 19 nt, Homo sapiens
ugacaauugugaugcauau

SEQ ID NO: 487788 - RNA, 19 nt, Homo sapiens
guccuagucucccuuguuu

SEQ ID NO: 487789 - RNA, 19 nt, Homo sapiens
cuucacggcucuuccuaua

SEQ ID NO: 487790 - RNA, 19 nt, Homo sapiens
caauugugaugcauaucua

SEQ ID NO: 487791 - RNA, 19 nt, Homo sapiens
gaaauccugaggcuuugua

SEQ ID NO: 487792 - RNA, 19 nt, Homo sapiens
cuauagaccaguuugaaua

SEQ ID NO: 487793 - RNA, 19 nt, Homo sapiens
guagugugcuuccuugcuu

SEQ ID NO: 487794 - RNA, 19 nt, Homo sapiens
uagaccaguuugaauauga

SEQ ID NO: 487795 - RNA, 19 nt, Homo sapiens
gggcgaccauugaguccua

SEQ ID NO: 487796 - RNA, 19 nt, Homo sapiens
acacagcuauaaagaccua

SEQ ID NO: 487797 - RNA, 19 nt, Homo sapiens
accgagagaugguauauga

SEQ ID NO: 487798 - RNA, 19 nt, Homo sapiens
ucucuuaggcacaguaaua

SEQ ID NO: 487799 - RNA, 19 nt, Homo sapiens
gcacuagcucuuccuuuga

SEQ ID NO: 487800 - RNA, 19 nt, Homo sapiens
ccuugaccauguuuaauaa

SEQ ID NO: 487801 - RNA, 19 nt, Homo sapiens
caguaucccuugaagaaau

SEQ ID NO: 487802 - RNA, 19 nt, Homo sapiens
cagcgagucaguaacuuua

SEQ ID NO: 487803 - RNA, 19 nt, Homo sapiens
ggauuuggguugguggauu

SEQ ID NO: 487804 - RNA, 19 nt, Homo sapiens
gcagcgagucaguaacuuu

SEQ ID NO: 487805 - RNA, 19 nt, Homo sapiens
ccucaggauuguugugauu

SEQ ID NO: 487806 - RNA, 19 nt, Homo sapiens
gccaaggacucuaggucaa

SEQ ID NO: 487807 - RNA, 19 nt, Homo sapiens
guugguggauuaacagaug

SEQ ID NO: 487808 - RNA, 19 nt, Homo sapiens
ccagagacacagcuauaaa

SEQ ID NO: 487809 - RNA, 19 nt, Homo sapiens
ugaugcauaucuacaaaug

SEQ ID NO: 487810 - RNA, 19 nt, Homo sapiens
ucaagacuauagaccaguu

SEQ ID NO: 487811 - RNA, 19 nt, Homo sapiens
guauaugacugcacuagcu

SEQ ID NO: 487812 - RNA, 19 nt, Homo sapiens
gauugcagccuuuguagug

SEQ ID NO: 487813 - RNA, 19 nt, Homo sapiens
gacucuaggucaaauguca

SEQ ID NO: 487814 - RNA, 19 nt, Homo sapiens
aaacgaagcuaugugaaaa

SEQ ID NO: 487815 - RNA, 19 nt, Homo sapiens
cggccaaggugaguuguuu

SEQ ID NO: 487816 - RNA, 19 nt, Homo sapiens
ggucgucuaucucccuguu

SEQ ID NO: 487817 - RNA, 19 nt, Homo sapiens
ucagcugacuguugagaga

SEQ ID NO: 487818 - RNA, 19 nt, Homo sapiens
uagaaacgaagcuauguga

SEQ ID NO: 487819 - RNA, 19 nt, Homo sapiens
cagaaauccuguucguauc

SEQ ID NO: 487820 - RNA, 19 nt, Homo sapiens
cgaaggaccugcggcaucu

SEQ ID NO: 487821 - RNA, 19 nt, Homo sapiens
caaggacucuaggucaaau

SEQ ID NO: 487822 - RNA, 19 nt, Homo sapiens
cuauaaagaccuagcaaga

SEQ ID NO: 487823 - RNA, 19 nt, Homo sapiens
ggauuguugugauuguaga

SEQ ID NO: 487824 - RNA, 19 nt, Homo sapiens
ugcacuagcucuuccuuug

SEQ ID NO: 487825 - RNA, 19 nt, Homo sapiens
gagagagcagcacaucauu

SEQ ID NO: 487826 - RNA, 19 nt, Homo sapiens
cuacaaauccagagacaca

SEQ ID NO: 487827 - RNA, 19 nt, Homo sapiens
gcaguaucccuugaagaaa

SEQ ID NO: 487828 - RNA, 19 nt, Homo sapiens
uggauuaacagauggaauu

SEQ ID NO: 487829 - RNA, 19 nt, Homo sapiens
ggaguggccuacaaaucca

SEQ ID NO: 487830 - RNA, 19 nt, Homo sapiens
aaauaugaaccucgagaaa

SEQ ID NO: 487831 - RNA, 19 nt, Homo sapiens
cuaggucaaaugucaauaa

SEQ ID NO: 487832 - RNA, 19 nt, Homo sapiens
gagagcagcacaucauuuu

SEQ ID NO: 487833 - RNA, 19 nt, Homo sapiens
gcuccuugaccauguuuaa

SEQ ID NO: 487834 - RNA, 19 nt, Homo sapiens
auaugaaccucgagaaagu

SEQ ID NO: 487835 - RNA, 19 nt, Homo sapiens
ugugaugcauaucuacaaa

SEQ ID NO: 487836 - RNA, 19 nt, Homo sapiens
gaaggguaaccgagagaug

SEQ ID NO: 487837 - RNA, 19 nt, Homo sapiens
gaaauacuuuugcucucaa

SEQ ID NO: 487838 - RNA, 19 nt, Homo sapiens
caggauuguugugauugua

SEQ ID NO: 487839 - RNA, 19 nt, Homo sapiens
uaaauaugaaccucgagaa

SEQ ID NO: 487840 - RNA, 19 nt, Homo sapiens
uaggcacaguaauagcuua

SEQ ID NO: 487841 - RNA, 19 nt, Homo sapiens
gaggaguggccuacaaauc

SEQ ID NO: 487842 - RNA, 19 nt, Homo sapiens
gcgagucaguaacuuuaag

SEQ ID NO: 487843 - RNA, 19 nt, Homo sapiens
ugagagagcagcacaucau

SEQ ID NO: 487844 - RNA, 19 nt, Homo sapiens
guuugaauaugaugguugu

SEQ ID NO: 487845 - RNA, 19 nt, Homo sapiens
gaacuaaaugaacagaacu

SEQ ID NO: 487846 - RNA, 19 nt, Homo sapiens
gacuauagaccaguuugaa

SEQ ID NO: 487847 - RNA, 19 nt, Homo sapiens
uggagacggugccgaagga

SEQ ID NO: 487848 - RNA, 19 nt, Homo sapiens
agaguaggaugcugauuuu

SEQ ID NO: 487849 - RNA, 19 nt, Homo sapiens
guucgcuggucaagacuau

SEQ ID NO: 487850 - RNA, 19 nt, Homo sapiens
ucaggauuguugugauugu

SEQ ID NO: 487851 - RNA, 19 nt, Homo sapiens
ggccuugggcgaccauuga

SEQ ID NO: 487852 - RNA, 19 nt, Homo sapiens
gaauaugaugguugugaca

SEQ ID NO: 487853 - RNA, 19 nt, Homo sapiens
ccaaggacucuaggucaaa

SEQ ID NO: 487854 - RNA, 19 nt, Homo sapiens
ggaauugaggagagaguag

SEQ ID NO: 487855 - RNA, 19 nt, Homo sapiens
ggauuaacagauggaauug

SEQ ID NO: 487856 - RNA, 19 nt, Homo sapiens
gugcuuccuugcuuccuau

SEQ ID NO: 487857 - RNA, 19 nt, Homo sapiens
gagcagcacaucauuuuau

SEQ ID NO: 487858 - RNA, 19 nt, Homo sapiens
agagagcagcacaucauuu

SEQ ID NO: 487859 - RNA, 19 nt, Homo sapiens
uaaccgagagaugguauau

SEQ ID NO: 487860 - RNA, 19 nt, Homo sapiens
uauaaagaccuagcaagau

SEQ ID NO: 487861 - RNA, 19 nt, Homo sapiens
aagaaauccugaggcuuug

SEQ ID NO: 487862 - RNA, 19 nt, Homo sapiens
ugucucagccucugggauu

SEQ ID NO: 487863 - RNA, 19 nt, Homo sapiens
ucuacucccucuugacugu

SEQ ID NO: 487864 - RNA, 19 nt, Homo sapiens
cacuagcucuuccuuugau

SEQ ID NO: 487865 - RNA, 19 nt, Homo sapiens
ugccucugcuuauuucuug

SEQ ID NO: 487866 - RNA, 19 nt, Homo sapiens
agagacacagcuauaaaga

SEQ ID NO: 487867 - RNA, 19 nt, Homo sapiens
guagaaacgaagcuaugug

SEQ ID NO: 487868 - RNA, 19 nt, Homo sapiens
ggugaguuguuuuaggaua

SEQ ID NO: 487869 - RNA, 19 nt, Homo sapiens
ggagguagguccuuuucuc

SEQ ID NO: 487870 - RNA, 19 nt, Homo sapiens
uccuugaccauguuuaaua

SEQ ID NO: 487871 - RNA, 19 nt, Homo sapiens
acagcugggucuccaagug

SEQ ID NO: 487872 - RNA, 19 nt, Homo sapiens
cagagacacagcuauaaag

SEQ ID NO: 487873 - RNA, 19 nt, Homo sapiens
gggccuguuugcuguguuc

SEQ ID NO: 487874 - RNA, 19 nt, Homo sapiens
uaacuuuaagccaggugua

SEQ ID NO: 487875 - RNA, 19 nt, Homo sapiens
agcaguaucccuugaagaa

SEQ ID NO: 487876 - RNA, 19 nt, Homo sapiens
ccuccugccucugcuuauu

SEQ ID NO: 487877 - RNA, 19 nt, Homo sapiens
gcaagaaacugguggagaa

SEQ ID NO: 487878 - RNA, 19 nt, Homo sapiens
ggaggaauaugaugaggaa

SEQ ID NO: 487879 - RNA, 19 nt, Homo sapiens
gaagaaauacgccaaguca

SEQ ID NO: 487880 - RNA, 19 nt, Homo sapiens
gaagaaggacaaccgcuuu

SEQ ID NO: 487881 - RNA, 19 nt, Homo sapiens
gcaacaagaucaccaucau

SEQ ID NO: 487882 - RNA, 19 nt, Homo sapiens
ugaaagacaucguuaaggu

SEQ ID NO: 487883 - RNA, 19 nt, Homo sapiens
ugacagacgugcucaaagu

SEQ ID NO: 487884 - RNA, 19 nt, Homo sapiens
ccagcaggcuaccagaaua

SEQ ID NO: 487885 - RNA, 19 nt, Homo sapiens
ucaaggacauguuggaguu

SEQ ID NO: 487886 - RNA, 19 nt, Homo sapiens
ggacgaggcugauguugac

SEQ ID NO: 487887 - RNA, 19 nt, Homo sapiens
ggaaggagcgggagcacaa

SEQ ID NO: 487888 - RNA, 19 nt, Homo sapiens
aagaagaacugggcgagua

SEQ ID NO: 487889 - RNA, 19 nt, Homo sapiens
ggaggagaauuucguuauc

SEQ ID NO: 487890 - RNA, 19 nt, Homo sapiens
gaaggacagugagaagguu

SEQ ID NO: 487891 - RNA, 19 nt, Homo sapiens
gaauuucguuauccuguuc

SEQ ID NO: 487892 - RNA, 19 nt, Homo sapiens
gagcauugauggugaggau

SEQ ID NO: 487893 - RNA, 19 nt, Homo sapiens
cuacaucgguguggugaaa

SEQ ID NO: 487894 - RNA, 19 nt, Homo sapiens
ggugauugcuggccgauuc

SEQ ID NO: 487895 - RNA, 19 nt, Homo sapiens
ggaagggcuuucuguucaa

SEQ ID NO: 487896 - RNA, 19 nt, Homo sapiens
cggaagggcuuucuguuca

SEQ ID NO: 487897 - RNA, 19 nt, Homo sapiens
gcagaggacauucuagaga

SEQ ID NO: 487898 - RNA, 19 nt, Homo sapiens
gagcagaggacauucuaga

SEQ ID NO: 487899 - RNA, 19 nt, Homo sapiens
gaacugggcgaguauuaca

SEQ ID NO: 487900 - RNA, 19 nt, Homo sapiens
ugagaagguugucagcauu

SEQ ID NO: 487901 - RNA, 19 nt, Homo sapiens
cgacuacgaucgcaucaag

SEQ ID NO: 487902 - RNA, 19 nt, Homo sapiens
guacaacacagaccaguuc

SEQ ID NO: 487903 - RNA, 19 nt, Homo sapiens
ggcaugaccucgaccuaug

SEQ ID NO: 487904 - RNA, 19 nt, Homo sapiens
gaacaacaaggugaaagug

SEQ ID NO: 487905 - RNA, 19 nt, Homo sapiens
gagaagguugucagcauuu

SEQ ID NO: 487906 - RNA, 19 nt, Homo sapiens
ggaagaggaggaagaagau

SEQ ID NO: 487907 - RNA, 19 nt, Homo sapiens
gaccaguucucucccuaug

SEQ ID NO: 487908 - RNA, 19 nt, Homo sapiens
gggcugaggaagaauauga

SEQ ID NO: 487909 - RNA, 19 nt, Homo sapiens
caauaucgauaauguuguc

SEQ ID NO: 487910 - RNA, 19 nt, Homo sapiens
ggaagaggaggaggaauau

SEQ ID NO: 487911 - RNA, 19 nt, Homo sapiens
gcagugagaaagaagaaga

SEQ ID NO: 487912 - RNA, 19 nt, Homo sapiens
aagaagcuguuuggucuaa

SEQ ID NO: 487913 - RNA, 19 nt, Homo sapiens
ggaagaauaugaguaugcu

SEQ ID NO: 487914 - RNA, 19 nt, Homo sapiens
gaaauacgccaagucaucu

SEQ ID NO: 487915 - RNA, 19 nt, Homo sapiens
ccuccaauaucgauaaugu

SEQ ID NO: 487916 - RNA, 19 nt, Homo sapiens
ggaauaugaugaggaagag

SEQ ID NO: 487917 - RNA, 19 nt, Homo sapiens
acaccuaccuggauacaca

SEQ ID NO: 487918 - RNA, 19 nt, Homo sapiens
ucacuccgcuucgcgauug

SEQ ID NO: 487919 - RNA, 19 nt, Homo sapiens
gugagcaccuggagccuau

SEQ ID NO: 487920 - RNA, 19 nt, Homo sapiens
gugagaagguugucagcau

SEQ ID NO: 487921 - RNA, 19 nt, Homo sapiens
cgggacaccuaccuggaua

SEQ ID NO: 487922 - RNA, 19 nt, Homo sapiens
gcgacuggguaaccacuga

SEQ ID NO: 487923 - RNA, 19 nt, Homo sapiens
ugaguaugcuuucgaugau

SEQ ID NO: 487924 - RNA, 19 nt, Homo sapiens
ugaggaagaauaugaguau

SEQ ID NO: 487925 - RNA, 19 nt, Homo sapiens
gaugacagacgugcucaaa

SEQ ID NO: 487926 - RNA, 19 nt, Homo sapiens
gcagaucaagucaguagug

SEQ ID NO: 487927 - RNA, 19 nt, Homo sapiens
ggauggagcagaggacauu

SEQ ID NO: 487928 - RNA, 19 nt, Homo sapiens
ggacgaagaggaggaggaa

SEQ ID NO: 487929 - RNA, 19 nt, Homo sapiens
gagcuugaaagacugguuu

SEQ ID NO: 487930 - RNA, 19 nt, Homo sapiens
uggccaaccugaaaccaaa

SEQ ID NO: 487931 - RNA, 19 nt, Homo sapiens
gggcgaguauuacaugaag

SEQ ID NO: 487932 - RNA, 19 nt, Homo sapiens
aggcugauguugacgauga

SEQ ID NO: 487933 - RNA, 19 nt, Homo sapiens
ccacggccauuuccuugau

SEQ ID NO: 487934 - RNA, 19 nt, Homo sapiens
gaagcuguuuggucuaaaa

SEQ ID NO: 487935 - RNA, 19 nt, Homo sapiens
acaacaaggugaaagugau

SEQ ID NO: 487936 - RNA, 19 nt, Homo sapiens
cagcguggcggcuuuggua

SEQ ID NO: 487937 - RNA, 19 nt, Homo sapiens
gugacuuccucaucuuuga

SEQ ID NO: 487938 - RNA, 19 nt, Homo sapiens
aagaggaggaggaauauga

SEQ ID NO: 487939 - RNA, 19 nt, Homo sapiens
aggaagaggaggaggaaua

SEQ ID NO: 487940 - RNA, 19 nt, Homo sapiens
cuuccuacauugcaagaaa

SEQ ID NO: 487941 - RNA, 19 nt, Homo sapiens
ucucugagcuggaaaaguu

SEQ ID NO: 487942 - RNA, 19 nt, Homo sapiens
agacaucguuaaggucauu

SEQ ID NO: 487943 - RNA, 19 nt, Homo sapiens
uccaggugcugaacaugua

SEQ ID NO: 487944 - RNA, 19 nt, Homo sapiens
cagcguggauggcaacaag

SEQ ID NO: 487945 - RNA, 19 nt, Homo sapiens
cgcaugagcuugaaagacu

SEQ ID NO: 487946 - RNA, 19 nt, Homo sapiens
cuacaaggaugacauugcu

SEQ ID NO: 487947 - RNA, 19 nt, Homo sapiens
guucauugccuaccaguuc

SEQ ID NO: 487948 - RNA, 19 nt, Homo sapiens
gcgaguauuacaugaagaa

SEQ ID NO: 487949 - RNA, 19 nt, Homo sapiens
ggaccucaaggacauguug

SEQ ID NO: 487950 - RNA, 19 nt, Homo sapiens
gaagggcuuucuguucaag

SEQ ID NO: 487951 - RNA, 19 nt, Homo sapiens
agaaauacgccaagucauc

SEQ ID NO: 487952 - RNA, 19 nt, Homo sapiens
agaagagccugaggacgaa

SEQ ID NO: 487953 - RNA, 19 nt, Homo sapiens
caacaagaucaccaucaug

SEQ ID NO: 487954 - RNA, 19 nt, Homo sapiens
ccaaaaggaagaaguuuaa

SEQ ID NO: 487955 - RNA, 19 nt, Homo sapiens
gaagaacugggcgaguauu

SEQ ID NO: 487956 - RNA, 19 nt, Homo sapiens
ggaccagcgagaagaagaa

SEQ ID NO: 487957 - RNA, 19 nt, Homo sapiens
cagcgaggacagcaacuuu

SEQ ID NO: 487958 - RNA, 19 nt, Homo sapiens
ggcggauuguucuggauuu

SEQ ID NO: 487959 - RNA, 19 nt, Homo sapiens
caacacagaccaguucucu

SEQ ID NO: 487960 - RNA, 19 nt, Homo sapiens
gaggaagaauaugaguaug

SEQ ID NO: 487961 - RNA, 19 nt, Homo sapiens
ggaggaagaggaggaggaa

SEQ ID NO: 487962 - RNA, 19 nt, Homo sapiens
gaacaccaucucccugaag

SEQ ID NO: 487963 - RNA, 19 nt, Homo sapiens
ccaagaacaacaaggugaa

SEQ ID NO: 487964 - RNA, 19 nt, Homo sapiens
ggauggcauuguccguaug

SEQ ID NO: 487965 - RNA, 19 nt, Homo sapiens
caagaacaacaaggugaaa

SEQ ID NO: 487966 - RNA, 19 nt, Homo sapiens
gcucccagacgcccaugua

SEQ ID NO: 487967 - RNA, 19 nt, Homo sapiens
ucucugaccucaccaugca

SEQ ID NO: 487968 - RNA, 19 nt, Homo sapiens
cccaggaacuuagaaaaua

SEQ ID NO: 487969 - RNA, 19 nt, Homo sapiens
cgccaugucugcugugauc

SEQ ID NO: 487970 - RNA, 19 nt, Homo sapiens
aagaacugggcgaguauua

SEQ ID NO: 487971 - RNA, 19 nt, Homo sapiens
ggagggaccagcgagaaga

SEQ ID NO: 487972 - RNA, 19 nt, Homo sapiens
auaauguuguccuggauga

SEQ ID NO: 487973 - RNA, 19 nt, Homo sapiens
agaauuucguuauccuguu

SEQ ID NO: 487974 - RNA, 19 nt, Homo sapiens
gggcgacacaggccucauu

SEQ ID NO: 487975 - RNA, 19 nt, Homo sapiens
gaauaugaguaugcuuucg

SEQ ID NO: 487976 - RNA, 19 nt, Homo sapiens
gaggagaauuucguuaucc

SEQ ID NO: 487977 - RNA, 19 nt, Homo sapiens
ggaagaagaugacgacuuu

SEQ ID NO: 487978 - RNA, 19 nt, Homo sapiens
gaacaugacuucacagaug

SEQ ID NO: 487979 - RNA, 19 nt, Homo sapiens
ggacagcacugacucauau

SEQ ID NO: 487980 - RNA, 19 nt, Homo sapiens
gaggagaucuucaauaugu

SEQ ID NO: 487981 - RNA, 19 nt, Homo sapiens
ccaaagaacucaagaacaa

SEQ ID NO: 487982 - RNA, 19 nt, Homo sapiens
ggaaagcugugauuaccua

SEQ ID NO: 487983 - RNA, 19 nt, Homo sapiens
ggagagggaugcuauuuau

SEQ ID NO: 487984 - RNA, 19 nt, Homo sapiens
ccagagaccuucuacauug

SEQ ID NO: 487985 - RNA, 19 nt, Homo sapiens
aaagaaggcucaagacauu

SEQ ID NO: 487986 - RNA, 19 nt, Homo sapiens
gaaccuagaugaucaggau

SEQ ID NO: 487987 - RNA, 19 nt, Homo sapiens
cagaggagaucuucaauau

SEQ ID NO: 487988 - RNA, 19 nt, Homo sapiens
ugaaagaccuggaccuuga

SEQ ID NO: 487989 - RNA, 19 nt, Homo sapiens
gucgaaagcucuacaauug

SEQ ID NO: 487990 - RNA, 19 nt, Homo sapiens
gcacacccauccuuccaua

SEQ ID NO: 487991 - RNA, 19 nt, Homo sapiens
gcaacgaccagacauauuu

SEQ ID NO: 487992 - RNA, 19 nt, Homo sapiens
gcacaucaaugaccuaugg

SEQ ID NO: 487993 - RNA, 19 nt, Homo sapiens
gcucaaggauguccaauca

SEQ ID NO: 487994 - RNA, 19 nt, Homo sapiens
ggaccagggugaugugauu

SEQ ID NO: 487995 - RNA, 19 nt, Homo sapiens
ccaaagacaccuacuauga

SEQ ID NO: 487996 - RNA, 19 nt, Homo sapiens
gagcaucuuugaaauguau

SEQ ID NO: 487997 - RNA, 19 nt, Homo sapiens
gcaaguuccuacugggaua

SEQ ID NO: 487998 - RNA, 19 nt, Homo sapiens
uaagaagccucauguagug

SEQ ID NO: 487999 - RNA, 19 nt, Homo sapiens
gugagaagcugcagcaaug

SEQ ID NO: 488000 - RNA, 19 nt, Homo sapiens
caagaaagguagaaaggau

SEQ ID NO: 488001 - RNA, 19 nt, Homo sapiens
gaugcaggcuuaucaguau

SEQ ID NO: 488002 - RNA, 19 nt, Homo sapiens
gaacagggacgcccagaug

SEQ ID NO: 488003 - RNA, 19 nt, Homo sapiens
ccacauacaucaagagagu

SEQ ID NO: 488004 - RNA, 19 nt, Homo sapiens
gcagggcuauggugacaaa

SEQ ID NO: 488005 - RNA, 19 nt, Homo sapiens
ucacagaucaggacaauga

SEQ ID NO: 488006 - RNA, 19 nt, Homo sapiens
gaacuugagcucaguguau

SEQ ID NO: 488007 - RNA, 19 nt, Homo sapiens
ugaauggacuguuuagaug

SEQ ID NO: 488008 - RNA, 19 nt, Homo sapiens
ucaugaagauugacauuga

SEQ ID NO: 488009 - RNA, 19 nt, Homo sapiens
ggagaucuucaauauguua

SEQ ID NO: 488010 - RNA, 19 nt, Homo sapiens
caagagagagccaaguuaa

SEQ ID NO: 488011 - RNA, 19 nt, Homo sapiens
gagaggagggaaaguauuu

SEQ ID NO: 488012 - RNA, 19 nt, Homo sapiens
gcaccaaacucagcacaug

SEQ ID NO: 488013 - RNA, 19 nt, Homo sapiens
gagaaugaguagaacaguu

SEQ ID NO: 488014 - RNA, 19 nt, Homo sapiens
gaucaacagugaggaauuc

SEQ ID NO: 488015 - RNA, 19 nt, Homo sapiens
ggguagagcugguugacaa

SEQ ID NO: 488016 - RNA, 19 nt, Homo sapiens
ugacaaaccucuugcugau

SEQ ID NO: 488017 - RNA, 19 nt, Homo sapiens
gaaagggcccagcacaauu

SEQ ID NO: 488018 - RNA, 19 nt, Homo sapiens
gcaagaagcccaggaaauc

SEQ ID NO: 488019 - RNA, 19 nt, Homo sapiens
ccaagaaauuuguggaaga

SEQ ID NO: 488020 - RNA, 19 nt, Homo sapiens
ggacucugguuaccucuga

SEQ ID NO: 488021 - RNA, 19 nt, Homo sapiens
gagagagccaaguuaaaua

SEQ ID NO: 488022 - RNA, 19 nt, Homo sapiens
ccaagaagaccaccaagaa

SEQ ID NO: 488023 - RNA, 19 nt, Homo sapiens
gaugaggagucagauauug

SEQ ID NO: 488024 - RNA, 19 nt, Homo sapiens
gugaggaauucgaagauuu

SEQ ID NO: 488025 - RNA, 19 nt, Homo sapiens
ccaaagucuucaugaauug

SEQ ID NO: 488026 - RNA, 19 nt, Homo sapiens
ggacccaccuccugaagau

SEQ ID NO: 488027 - RNA, 19 nt, Homo sapiens
guagaaaggauguggauga

SEQ ID NO: 488028 - RNA, 19 nt, Homo sapiens
ugaagaugaugaacuagaa

SEQ ID NO: 488029 - RNA, 19 nt, Homo sapiens
caaugaguaugaugaagaa

SEQ ID NO: 488030 - RNA, 19 nt, Homo sapiens
ggaagaauacaaugaugaa

SEQ ID NO: 488031 - RNA, 19 nt, Homo sapiens
aaagaugucuacaaccauu

SEQ ID NO: 488032 - RNA, 19 nt, Homo sapiens
uggaugagcugaaagaugu

SEQ ID NO: 488033 - RNA, 19 nt, Homo sapiens
ucaaggauguccaaucaau

SEQ ID NO: 488034 - RNA, 19 nt, Homo sapiens
ggaggaagaguaugaguau

SEQ ID NO: 488035 - RNA, 19 nt, Homo sapiens
caaugacgaugaugaugaa

SEQ ID NO: 488036 - RNA, 19 nt, Homo sapiens
uugagaagaugcaggcuua

SEQ ID NO: 488037 - RNA, 19 nt, Homo sapiens
cccaaagucuucaugaauu

SEQ ID NO: 488038 - RNA, 19 nt, Homo sapiens
ggucaauggugaaggagaa

SEQ ID NO: 488039 - RNA, 19 nt, Homo sapiens
uuaaggaacugagagauga

SEQ ID NO: 488040 - RNA, 19 nt, Homo sapiens
ggaagagggagaugaagaa

SEQ ID NO: 488041 - RNA, 19 nt, Homo sapiens
ugaaugcccugccucagaa

SEQ ID NO: 488042 - RNA, 19 nt, Homo sapiens
gaauaagaagccucaugua

SEQ ID NO: 488043 - RNA, 19 nt, Homo sapiens
ugaaagaugucuacaacca

SEQ ID NO: 488044 - RNA, 19 nt, Homo sapiens
gcugaaagaugucuacaac

SEQ ID NO: 488045 - RNA, 19 nt, Homo sapiens
gggagagggaugcuauuua

SEQ ID NO: 488046 - RNA, 19 nt, Homo sapiens
ccuauuccuucaaguauuu

SEQ ID NO: 488047 - RNA, 19 nt, Homo sapiens
gaagcugacuggaucuaca

SEQ ID NO: 488048 - RNA, 19 nt, Homo sapiens
ggcugaagaugaugaacua

SEQ ID NO: 488049 - RNA, 19 nt, Homo sapiens
gcagccaccucacagauca

SEQ ID NO: 488050 - RNA, 19 nt, Homo sapiens
gaggaagaauacaaugaug

SEQ ID NO: 488051 - RNA, 19 nt, Homo sapiens
gcagaacggcggaaacaga

SEQ ID NO: 488052 - RNA, 19 nt, Homo sapiens
ccaccuucaucccuuauuu

SEQ ID NO: 488053 - RNA, 19 nt, Homo sapiens
gagaaccaccugacaguga

SEQ ID NO: 488054 - RNA, 19 nt, Homo sapiens
aaacacggcuagacaaugg

SEQ ID NO: 488055 - RNA, 19 nt, Homo sapiens
gcacugacucauauauuga

SEQ ID NO: 488056 - RNA, 19 nt, Homo sapiens
ggaaagggcccagcacaau

SEQ ID NO: 488057 - RNA, 19 nt, Homo sapiens
gagggaugcuauuuauuca

SEQ ID NO: 488058 - RNA, 19 nt, Homo sapiens
ccaccaaauuccucaguga

SEQ ID NO: 488059 - RNA, 19 nt, Homo sapiens
auaaaggccuguagucgaa

SEQ ID NO: 488060 - RNA, 19 nt, Homo sapiens
gaugaccaguuucucaaga

SEQ ID NO: 488061 - RNA, 19 nt, Homo sapiens
aggcaaaccuuccaagaga

SEQ ID NO: 488062 - RNA, 19 nt, Homo sapiens
ggacuuugacuaugaugaa

SEQ ID NO: 488063 - RNA, 19 nt, Homo sapiens
guaaacccaggauagaaua

SEQ ID NO: 488064 - RNA, 19 nt, Homo sapiens
gaaagcucaucaucugcaa

SEQ ID NO: 488065 - RNA, 19 nt, Homo sapiens
acaaacacaucacacucua

SEQ ID NO: 488066 - RNA, 19 nt, Homo sapiens
guaggagcaucuuugaaau

SEQ ID NO: 488067 - RNA, 19 nt, Homo sapiens
caggagcccuugaagaaau

SEQ ID NO: 488068 - RNA, 19 nt, Homo sapiens
gcaggagcauguggugaaa

SEQ ID NO: 488069 - RNA, 19 nt, Homo sapiens
gaagaugacgacuuuaugg

SEQ ID NO: 488070 - RNA, 19 nt, Homo sapiens
ugaccaguuucucaagaua

SEQ ID NO: 488071 - RNA, 19 nt, Homo sapiens
ggacaauuucccugaacua

SEQ ID NO: 488072 - RNA, 19 nt, Homo sapiens
ugaagauccugaagcagaa

SEQ ID NO: 488073 - RNA, 19 nt, Homo sapiens
cauccugugucucaaguuu

SEQ ID NO: 488074 - RNA, 19 nt, Homo sapiens
ccaagagagagccaaguua

SEQ ID NO: 488075 - RNA, 19 nt, Homo sapiens
cacccauccuuccauaaua

SEQ ID NO: 488076 - RNA, 19 nt, Homo sapiens
aguggaagcugcccaaaga

SEQ ID NO: 488077 - RNA, 19 nt, Homo sapiens
ggacuuaauuugagcauaa

SEQ ID NO: 488078 - RNA, 19 nt, Homo sapiens
uaacaucacuggcacauga

SEQ ID NO: 488079 - RNA, 19 nt, Homo sapiens
ggaaagaaauucagaaacu

SEQ ID NO: 488080 - RNA, 19 nt, Homo sapiens
cgcauaagcuguugaauuu

SEQ ID NO: 488081 - RNA, 19 nt, Homo sapiens
gaaacugggugcugauuau

SEQ ID NO: 488082 - RNA, 19 nt, Homo sapiens
ggacaagaaugaaguaaag

SEQ ID NO: 488083 - RNA, 19 nt, Homo sapiens
guugagaugugcaguguua

SEQ ID NO: 488084 - RNA, 19 nt, Homo sapiens
uggcuaagcuaccgauuua

SEQ ID NO: 488085 - RNA, 19 nt, Homo sapiens
ucaugaagaucucaguuua

SEQ ID NO: 488086 - RNA, 19 nt, Homo sapiens
gaucuuuacuuguggcuaa

SEQ ID NO: 488087 - RNA, 19 nt, Homo sapiens
gcaauuggcaugggacuua

SEQ ID NO: 488088 - RNA, 19 nt, Homo sapiens
gcacagcuccuaucaacaa

SEQ ID NO: 488089 - RNA, 19 nt, Homo sapiens
agaaagaacuagaugguau

SEQ ID NO: 488090 - RNA, 19 nt, Homo sapiens
acaaauauuuccuguguug

SEQ ID NO: 488091 - RNA, 19 nt, Homo sapiens
gaaagaaauucagaaacug

SEQ ID NO: 488092 - RNA, 19 nt, Homo sapiens
ggaaacaggcuucacaugu

SEQ ID NO: 488093 - RNA, 19 nt, Homo sapiens
ccaaagcucuagggaguaa

SEQ ID NO: 488094 - RNA, 19 nt, Homo sapiens
agauucagcucacgguuua

SEQ ID NO: 488095 - RNA, 19 nt, Homo sapiens
ugaaguggcuguaauugau

SEQ ID NO: 488096 - RNA, 19 nt, Homo sapiens
uggcagagcuggcagauuc

SEQ ID NO: 488097 - RNA, 19 nt, Homo sapiens
uuaaagaccucauggaucu

SEQ ID NO: 488098 - RNA, 19 nt, Homo sapiens
aaacugaacacaacaaaga

SEQ ID NO: 488099 - RNA, 19 nt, Homo sapiens
gaaagaacuagaugguauu

SEQ ID NO: 488100 - RNA, 19 nt, Homo sapiens
gcaacacuguccaaucuca

SEQ ID NO: 488101 - RNA, 19 nt, Homo sapiens
gaacuagaaccaaucacaa

SEQ ID NO: 488102 - RNA, 19 nt, Homo sapiens
gaccagagcacuucuagga

SEQ ID NO: 488103 - RNA, 19 nt, Homo sapiens
gagacaugccaaacaaaua

SEQ ID NO: 488104 - RNA, 19 nt, Homo sapiens
ggagagcugucccuugcuu

SEQ ID NO: 488105 - RNA, 19 nt, Homo sapiens
gaggaaagaaauucagaaa

SEQ ID NO: 488106 - RNA, 19 nt, Homo sapiens
caagauggugugcacaaua

SEQ ID NO: 488107 - RNA, 19 nt, Homo sapiens
caaauggccuuuacuucca

SEQ ID NO: 488108 - RNA, 19 nt, Homo sapiens
gggacugcauugucuguuu

SEQ ID NO: 488109 - RNA, 19 nt, Homo sapiens
guaaggaugaucuacguaa

SEQ ID NO: 488110 - RNA, 19 nt, Homo sapiens
gcacaugagaucuucgaaa

SEQ ID NO: 488111 - RNA, 19 nt, Homo sapiens
uaaggaugaucuacguaaa

SEQ ID NO: 488112 - RNA, 19 nt, Homo sapiens
aaggagagguuacaacaau

SEQ ID NO: 488113 - RNA, 19 nt, Homo sapiens
agaacuagaugguauuauc

SEQ ID NO: 488114 - RNA, 19 nt, Homo sapiens
ugucuuggaucuuuacuug

SEQ ID NO: 488115 - RNA, 19 nt, Homo sapiens
uguguguucuucacuguua

SEQ ID NO: 488116 - RNA, 19 nt, Homo sapiens
ggagagguuacaacaauga

SEQ ID NO: 488117 - RNA, 19 nt, Homo sapiens
uggagaaccugcugcuauu

SEQ ID NO: 488118 - RNA, 19 nt, Homo sapiens
cauaagcuguugaauuugg

SEQ ID NO: 488119 - RNA, 19 nt, Homo sapiens
ggccuuuacuuccaccuaa

SEQ ID NO: 488120 - RNA, 19 nt, Homo sapiens
agagagaacuagaaccaau

SEQ ID NO: 488121 - RNA, 19 nt, Homo sapiens
gcaugggacuuaauuugag

SEQ ID NO: 488122 - RNA, 19 nt, Homo sapiens
uagaugguauuauccaaga

SEQ ID NO: 488123 - RNA, 19 nt, Homo sapiens
cacgaugucuuggaucuuu

SEQ ID NO: 488124 - RNA, 19 nt, Homo sapiens
cagaguugauccagcauau

SEQ ID NO: 488125 - RNA, 19 nt, Homo sapiens
gcuggaccaugcacuagaa

SEQ ID NO: 488126 - RNA, 19 nt, Homo sapiens
gaagagcgugugacaguuc

SEQ ID NO: 488127 - RNA, 19 nt, Homo sapiens
aagauggugugcacaauau

SEQ ID NO: 488128 - RNA, 19 nt, Homo sapiens
gauccagcauauuccacua

SEQ ID NO: 488129 - RNA, 19 nt, Homo sapiens
gaaggagagguuacaacaa

SEQ ID NO: 488130 - RNA, 19 nt, Homo sapiens
aaucagcuguuauauaugg

SEQ ID NO: 488131 - RNA, 19 nt, Homo sapiens
gagaaccugcugcuauuga

SEQ ID NO: 488132 - RNA, 19 nt, Homo sapiens
gaaauacuucucagcaaag

SEQ ID NO: 488133 - RNA, 19 nt, Homo sapiens
caaacaguggaaagacuua

SEQ ID NO: 488134 - RNA, 19 nt, Homo sapiens
uuaaagagccaagcuagaa

SEQ ID NO: 488135 - RNA, 19 nt, Homo sapiens
cagcuccuaucaacaagaa

SEQ ID NO: 488136 - RNA, 19 nt, Homo sapiens
uuacuuccaccuaagaaua

SEQ ID NO: 488137 - RNA, 19 nt, Homo sapiens
ucugcaauauggaugauuu

SEQ ID NO: 488138 - RNA, 19 nt, Homo sapiens
ggacgagaagaaagaagaa

SEQ ID NO: 488139 - RNA, 19 nt, Homo sapiens
gcuaagcuaccgauuuaug

SEQ ID NO: 488140 - RNA, 19 nt, Homo sapiens
gaguugauccagcauauuc

SEQ ID NO: 488141 - RNA, 19 nt, Homo sapiens
ugagcagauugaaauguuu

SEQ ID NO: 488142 - RNA, 19 nt, Homo sapiens
acaacaaacugaacacaac

SEQ ID NO: 488143 - RNA, 19 nt, Homo sapiens
uauucgagaucuccagaaa

SEQ ID NO: 488144 - RNA, 19 nt, Homo sapiens
ggcaugggacuuaauuuga

SEQ ID NO: 488145 - RNA, 19 nt, Homo sapiens
gcaguguuacaacuccuua

SEQ ID NO: 488146 - RNA, 19 nt, Homo sapiens
caaagucuggaguguauug

SEQ ID NO: 488147 - RNA, 19 nt, Homo sapiens
ccagaugccagccuuauuc

SEQ ID NO: 488148 - RNA, 19 nt, Homo sapiens
caucaaauggccuuuacuu

SEQ ID NO: 488149 - RNA, 19 nt, Homo sapiens
agaaugaaguaaagaaggu

SEQ ID NO: 488150 - RNA, 19 nt, Homo sapiens
gcagaguugauccagcaua

SEQ ID NO: 488151 - RNA, 19 nt, Homo sapiens
uaaauuuucugcagaguug

SEQ ID NO: 488152 - RNA, 19 nt, Homo sapiens
caauuggcaugggacuuaa

SEQ ID NO: 488153 - RNA, 19 nt, Homo sapiens
cuauugaccuggugaugga

SEQ ID NO: 488154 - RNA, 19 nt, Homo sapiens
agacaugccaaacaaauau

SEQ ID NO: 488155 - RNA, 19 nt, Homo sapiens
gaagaaggaaccugauucg

SEQ ID NO: 488156 - RNA, 19 nt, Homo sapiens
uucgagaucuccagaaaga

SEQ ID NO: 488157 - RNA, 19 nt, Homo sapiens
cugagcagauugaaauguu

SEQ ID NO: 488158 - RNA, 19 nt, Homo sapiens
ggacugcauugucuguuuu

SEQ ID NO: 488159 - RNA, 19 nt, Homo sapiens
uguuacaacuccuuaugaa

SEQ ID NO: 488160 - RNA, 19 nt, Homo sapiens
gcagcggaagauaauauuu

SEQ ID NO: 488161 - RNA, 19 nt, Homo sapiens
ucaacaagaagcagccuuu

SEQ ID NO: 488162 - RNA, 19 nt, Homo sapiens
uaaagcccaguaucaauga

SEQ ID NO: 488163 - RNA, 19 nt, Homo sapiens
ugauggagcuuauguacac

SEQ ID NO: 488164 - RNA, 19 nt, Homo sapiens
gugaagagcgugugacagu

SEQ ID NO: 488165 - RNA, 19 nt, Homo sapiens
agcaaagucuggaguguau

SEQ ID NO: 488166 - RNA, 19 nt, Homo sapiens
cuugagacaugccaaacaa

SEQ ID NO: 488167 - RNA, 19 nt, Homo sapiens
ggaaugagccccugaccuu

SEQ ID NO: 488168 - RNA, 19 nt, Homo sapiens
gaagcagccuuuugugugu

SEQ ID NO: 488169 - RNA, 19 nt, Homo sapiens
gagcagauugaaauguuug

SEQ ID NO: 488170 - RNA, 19 nt, Homo sapiens
gcucuagggaguaaagcua

SEQ ID NO: 488171 - RNA, 19 nt, Homo sapiens
cagaaagaacuagauggua

SEQ ID NO: 488172 - RNA, 19 nt, Homo sapiens
agaaacugggugcugauua

SEQ ID NO: 488173 - RNA, 19 nt, Homo sapiens
gaauauuaaagaccucaug

SEQ ID NO: 488174 - RNA, 19 nt, Homo sapiens
aaagggagagagagaacua

SEQ ID NO: 488175 - RNA, 19 nt, Homo sapiens
guggagaaccugcugcuau

SEQ ID NO: 488176 - RNA, 19 nt, Homo sapiens
gaaguggcuguaauugaug

SEQ ID NO: 488177 - RNA, 19 nt, Homo sapiens
gagaggaagugcucagaua

SEQ ID NO: 488178 - RNA, 19 nt, Homo sapiens
caacauugcuucccucuuc

SEQ ID NO: 488179 - RNA, 19 nt, Homo sapiens
ccaaucagcucaugugguu

SEQ ID NO: 488180 - RNA, 19 nt, Homo sapiens
caauacagaccaagauuua

SEQ ID NO: 488181 - RNA, 19 nt, Homo sapiens
gguacaagauggucauuga

SEQ ID NO: 488182 - RNA, 19 nt, Homo sapiens
ccacuucucucacacuuug

SEQ ID NO: 488183 - RNA, 19 nt, Homo sapiens
ggagcacacuggaguauuc

SEQ ID NO: 488184 - RNA, 19 nt, Homo sapiens
cauugcagcuguccucaua

SEQ ID NO: 488185 - RNA, 19 nt, Homo sapiens
caccaucgcugaucccaaa

SEQ ID NO: 488186 - RNA, 19 nt, Homo sapiens
cagaaaccauggcugcuaa

SEQ ID NO: 488187 - RNA, 19 nt, Homo sapiens
gcaauacagaccaagauuu

SEQ ID NO: 488188 - RNA, 19 nt, Homo sapiens
gaagggcacaucaucauug

SEQ ID NO: 488189 - RNA, 19 nt, Homo sapiens
ccucacagcugccaacaga

SEQ ID NO: 488190 - RNA, 19 nt, Homo sapiens
cagcuguccucauaacuuu

SEQ ID NO: 488191 - RNA, 19 nt, Homo sapiens
gaaacuggaauuaacuuga

SEQ ID NO: 488192 - RNA, 19 nt, Homo sapiens
gagaacaucaucuuugaga

SEQ ID NO: 488193 - RNA, 19 nt, Homo sapiens
gcaaaggacauuucugcaa

SEQ ID NO: 488194 - RNA, 19 nt, Homo sapiens
gcacgucaaugcccucauc

SEQ ID NO: 488195 - RNA, 19 nt, Homo sapiens
ggagcauccugaacagauu

SEQ ID NO: 488196 - RNA, 19 nt, Homo sapiens
gguccgaucuaccgucaaa

SEQ ID NO: 488197 - RNA, 19 nt, Homo sapiens
ccaacuaccucaacuggau

SEQ ID NO: 488198 - RNA, 19 nt, Homo sapiens
gaggagaacaucaucuuug

SEQ ID NO: 488199 - RNA, 19 nt, Homo sapiens
uggagcagcugucaucauu

SEQ ID NO: 488200 - RNA, 19 nt, Homo sapiens
caucgagacuuccaacuuc

SEQ ID NO: 488201 - RNA, 19 nt, Homo sapiens
gagcagcugucaucauucu

SEQ ID NO: 488202 - RNA, 19 nt, Homo sapiens
gcaagcauccuacuaugug

SEQ ID NO: 488203 - RNA, 19 nt, Homo sapiens
gagagucccuucaacaaac

SEQ ID NO: 488204 - RNA, 19 nt, Homo sapiens
gaacaucaucuuugagagu

SEQ ID NO: 488205 - RNA, 19 nt, Homo sapiens
ccaagaccaucaaguuugu

SEQ ID NO: 488206 - RNA, 19 nt, Homo sapiens
caacugcuguguccagauc

SEQ ID NO: 488207 - RNA, 19 nt, Homo sapiens
gggaagcugcccaucguua

SEQ ID NO: 488208 - RNA, 19 nt, Homo sapiens
uaauugcccugcuggugua

SEQ ID NO: 488209 - RNA, 19 nt, Homo sapiens
caagugccaucccacauuc

SEQ ID NO: 488210 - RNA, 19 nt, Homo sapiens
uaacuugagaggagcaaua

SEQ ID NO: 488211 - RNA, 19 nt, Homo sapiens
caucaagacugcccacaag

SEQ ID NO: 488212 - RNA, 19 nt, Homo sapiens
accaagagcuggagaagga

SEQ ID NO: 488213 - RNA, 19 nt, Homo sapiens
ggucaacgccagcgaauca

SEQ ID NO: 488214 - RNA, 19 nt, Homo sapiens
caugucagcuucuucaaag

SEQ ID NO: 488215 - RNA, 19 nt, Homo sapiens
ggaaaucgcccagcugaag

SEQ ID NO: 488216 - RNA, 19 nt, Homo sapiens
ggaggagaacaucaucuuu

SEQ ID NO: 488217 - RNA, 19 nt, Homo sapiens
cggagucagugccuuaauu

SEQ ID NO: 488218 - RNA, 19 nt, Homo sapiens
ucaacuggauggugaggaa

SEQ ID NO: 488219 - RNA, 19 nt, Homo sapiens
gaggccagcugacuaugau

SEQ ID NO: 488220 - RNA, 19 nt, Homo sapiens
ggagucagugccuuaauug

SEQ ID NO: 488221 - RNA, 19 nt, Homo sapiens
ggucuacuaucacaacauc

SEQ ID NO: 488222 - RNA, 19 nt, Homo sapiens
aggagaacaucaucuuuga

SEQ ID NO: 488223 - RNA, 19 nt, Homo sapiens
ucaccaagaccaucaaguu

SEQ ID NO: 488224 - RNA, 19 nt, Homo sapiens
gaucaugggaggcuacuuc

SEQ ID NO: 488225 - RNA, 19 nt, Homo sapiens
acaagaagcccaucgacuu

SEQ ID NO: 488226 - RNA, 19 nt, Homo sapiens
caugcagacuggaucauug

SEQ ID NO: 488227 - RNA, 19 nt, Homo sapiens
ucaccuccguggucuacua

SEQ ID NO: 488228 - RNA, 19 nt, Homo sapiens
ccaaugagcggcugaagca

SEQ ID NO: 488229 - RNA, 19 nt, Homo sapiens
gaggagcaauacagaccaa

SEQ ID NO: 488230 - RNA, 19 nt, Homo sapiens
ccuacuauguggccauuga

SEQ ID NO: 488231 - RNA, 19 nt, Homo sapiens
ggaaggagaacgacgucuu

SEQ ID NO: 488232 - RNA, 19 nt, Homo sapiens
gcagcuguccucauaacuu

SEQ ID NO: 488233 - RNA, 19 nt, Homo sapiens
caacaucaccauucguauc

SEQ ID NO: 488234 - RNA, 19 nt, Homo sapiens
aaacuggaauuaacuugag

SEQ ID NO: 488235 - RNA, 19 nt, Homo sapiens
ggaagcugcccaucguuau

SEQ ID NO: 488236 - RNA, 19 nt, Homo sapiens
ccaagugccaucccacauu

SEQ ID NO: 488237 - RNA, 19 nt, Homo sapiens
gaaaacauccuccaaaagg

SEQ ID NO: 488238 - RNA, 19 nt, Homo sapiens
ugaggaaccuggcagacau

SEQ ID NO: 488239 - RNA, 19 nt, Homo sapiens
ggccuuaccuacgcccuaa

SEQ ID NO: 488240 - RNA, 19 nt, Homo sapiens
gcagucgugugcuacuuca

SEQ ID NO: 488241 - RNA, 19 nt, Homo sapiens
gccgucaucuccuauguca

SEQ ID NO: 488242 - RNA, 19 nt, Homo sapiens
gcuccacccugcucugugu

SEQ ID NO: 488243 - RNA, 19 nt, Homo sapiens
cacagcacauggcuucauu

SEQ ID NO: 488244 - RNA, 19 nt, Homo sapiens
ugccaaugccuacgucuua

SEQ ID NO: 488245 - RNA, 19 nt, Homo sapiens
caccaagaccaucaaguuu

SEQ ID NO: 488246 - RNA, 19 nt, Homo sapiens
gugcagaccuggugaucgu

SEQ ID NO: 488247 - RNA, 19 nt, Homo sapiens
uagaaggacucaccaccau

SEQ ID NO: 488248 - RNA, 19 nt, Homo sapiens
ccacccagcuuccacuucu

SEQ ID NO: 488249 - RNA, 19 nt, Homo sapiens
aaccauggcugcuaaaugc

SEQ ID NO: 488250 - RNA, 19 nt, Homo sapiens
ggccuaugcuucgcagaaa

SEQ ID NO: 488251 - RNA, 19 nt, Homo sapiens
gcacgucuuccuacucuuc

SEQ ID NO: 488252 - RNA, 19 nt, Homo sapiens
caucgcugaucccaaagaa

SEQ ID NO: 488253 - RNA, 19 nt, Homo sapiens
cgccaacguugucuucuug

SEQ ID NO: 488254 - RNA, 19 nt, Homo sapiens
caaacaacgguacaagaug

SEQ ID NO: 488255 - RNA, 19 nt, Homo sapiens
gaagcagaccaacgagaug

SEQ ID NO: 488256 - RNA, 19 nt, Homo sapiens
gaaaugacugcuggacaga

SEQ ID NO: 488257 - RNA, 19 nt, Homo sapiens
cauugaaacuggaauuaac

SEQ ID NO: 488258 - RNA, 19 nt, Homo sapiens
gaagucagagcuccaaggu

SEQ ID NO: 488259 - RNA, 19 nt, Homo sapiens
gagcauccugaacagauuu

SEQ ID NO: 488260 - RNA, 19 nt, Homo sapiens
ugagagucccuucaacaaa

SEQ ID NO: 488261 - RNA, 19 nt, Homo sapiens
gagcaauacagaccaagau

SEQ ID NO: 488262 - RNA, 19 nt, Homo sapiens
gaagcugcccaucguuaug

SEQ ID NO: 488263 - RNA, 19 nt, Homo sapiens
guacaagauggucauugaa

SEQ ID NO: 488264 - RNA, 19 nt, Homo sapiens
acaaacaacgguacaagau

SEQ ID NO: 488265 - RNA, 19 nt, Homo sapiens
cgacaccaaucagcucaug

SEQ ID NO: 488266 - RNA, 19 nt, Homo sapiens
ccauugaaacuggaauuaa

SEQ ID NO: 488267 - RNA, 19 nt, Homo sapiens
gccauugaaacuggaauua

SEQ ID NO: 488268 - RNA, 19 nt, Homo sapiens
cgucuuagcugugcuucug

SEQ ID NO: 488269 - RNA, 19 nt, Homo sapiens
gggccacugugcaucuuug

SEQ ID NO: 488270 - RNA, 19 nt, Homo sapiens
ucaagacugcccacaagaa

SEQ ID NO: 488271 - RNA, 19 nt, Homo sapiens
cggaaaacauccuccaaaa

SEQ ID NO: 488272 - RNA, 19 nt, Homo sapiens
gcauugacauccgcaaacu

SEQ ID NO: 488273 - RNA, 19 nt, Homo sapiens
gaaccgacaggaccaagag

SEQ ID NO: 488274 - RNA, 19 nt, Homo sapiens
gcacgccaacguugucuuc

SEQ ID NO: 488275 - RNA, 19 nt, Homo sapiens
gugugauucuccucuacua

SEQ ID NO: 488276 - RNA, 19 nt, Homo sapiens
cagcggcaccauccgauuu

SEQ ID NO: 488277 - RNA, 19 nt, Homo sapiens
ccaaggagcuguauaugau

SEQ ID NO: 488278 - RNA, 19 nt, Homo sapiens
ggaacgagcaucugcagua

SEQ ID NO: 488279 - RNA, 19 nt, Homo sapiens
gaaaggaaccacuggcauu

SEQ ID NO: 488280 - RNA, 19 nt, Homo sapiens
gaaccugauugcagaguug

SEQ ID NO: 488281 - RNA, 19 nt, Homo sapiens
cauccuaccugugguuuaa

SEQ ID NO: 488282 - RNA, 19 nt, Homo sapiens
gcagagcccaucuucauug

SEQ ID NO: 488283 - RNA, 19 nt, Homo sapiens
gaagcccugucccuggaua

SEQ ID NO: 488284 - RNA, 19 nt, Homo sapiens
ggagggcaaaccagaguua

SEQ ID NO: 488285 - RNA, 19 nt, Homo sapiens
gaaagugaauccugaaacc

SEQ ID NO: 488286 - RNA, 19 nt, Homo sapiens
gaacgagcaucugcaguac

SEQ ID NO: 488287 - RNA, 19 nt, Homo sapiens
gaagaaagugaauccugaa

SEQ ID NO: 488288 - RNA, 19 nt, Homo sapiens
gaucaugugcuacugguau

SEQ ID NO: 488289 - RNA, 19 nt, Homo sapiens
gaagcuauggccagaauca

SEQ ID NO: 488290 - RNA, 19 nt, Homo sapiens
aaaggaaccacuggcauua

SEQ ID NO: 488291 - RNA, 19 nt, Homo sapiens
auaaaguucuggccuucua

SEQ ID NO: 488292 - RNA, 19 nt, Homo sapiens
gcgcagagcccaucuucau

SEQ ID NO: 488293 - RNA, 19 nt, Homo sapiens
ccaagcagauguggcaguu

SEQ ID NO: 488294 - RNA, 19 nt, Homo sapiens
uuucaagacugccuuuaug

SEQ ID NO: 488295 - RNA, 19 nt, Homo sapiens
ggauaaugcaguauuucaa

SEQ ID NO: 488296 - RNA, 19 nt, Homo sapiens
ccuggauaaugcaguauuu

SEQ ID NO: 488297 - RNA, 19 nt, Homo sapiens
cagagcccaucuucauuga

SEQ ID NO: 488298 - RNA, 19 nt, Homo sapiens
gaugacuccuuucuucagu

SEQ ID NO: 488299 - RNA, 19 nt, Homo sapiens
ugagaacaauccagaaagg

SEQ ID NO: 488300 - RNA, 19 nt, Homo sapiens
gauaaugcaguauuucaag

SEQ ID NO: 488301 - RNA, 19 nt, Homo sapiens
gggagaaguggaccucauu

SEQ ID NO: 488302 - RNA, 19 nt, Homo sapiens
ggagaaguggaccucauug

SEQ ID NO: 488303 - RNA, 19 nt, Homo sapiens
uaugcuggaucaugugcua

SEQ ID NO: 488304 - RNA, 19 nt, Homo sapiens
gcagaaaggccagauugag

SEQ ID NO: 488305 - RNA, 19 nt, Homo sapiens
gaccugguauggacucucu

SEQ ID NO: 488306 - RNA, 19 nt, Homo sapiens
cuucauugaugccaacuuc

SEQ ID NO: 488307 - RNA, 19 nt, Homo sapiens
uggaagcuauggccagaau

SEQ ID NO: 488308 - RNA, 19 nt, Homo sapiens
ggccucaucuccuccucaa

SEQ ID NO: 488309 - RNA, 19 nt, Homo sapiens
agaagcaucugccacaaaa

SEQ ID NO: 488310 - RNA, 19 nt, Homo sapiens
ccacaaaagcggaagauga

SEQ ID NO: 488311 - RNA, 19 nt, Homo sapiens
agcggaagaugacuccuuu

SEQ ID NO: 488312 - RNA, 19 nt, Homo sapiens
gucccuggauaaugcagua

SEQ ID NO: 488313 - RNA, 19 nt, Homo sapiens
uauggacucucugcagcua

SEQ ID NO: 488314 - RNA, 19 nt, Homo sapiens
aagcagauguggcaguucu

SEQ ID NO: 488315 - RNA, 19 nt, Homo sapiens
agaacaauccagaaaggaa

SEQ ID NO: 488316 - RNA, 19 nt, Homo sapiens
uaccugugguuuaagaaau

SEQ ID NO: 488317 - RNA, 19 nt, Homo sapiens
gagaacaauccagaaagga

SEQ ID NO: 488318 - RNA, 19 nt, Homo sapiens
ccugagaacaauccagaaa

SEQ ID NO: 488319 - RNA, 19 nt, Homo sapiens
aguggaagcugaaccugau

SEQ ID NO: 488320 - RNA, 19 nt, Homo sapiens
ggcagaaaggccagauuga

SEQ ID NO: 488321 - RNA, 19 nt, Homo sapiens
cggcagaaaggccagauug

SEQ ID NO: 488322 - RNA, 19 nt, Homo sapiens
ugaaccugauugcagaguu

SEQ ID NO: 488323 - RNA, 19 nt, Homo sapiens
gaaccacuggcauuaucga

SEQ ID NO: 488324 - RNA, 19 nt, Homo sapiens
gcuuugaccauuccaagga

SEQ ID NO: 488325 - RNA, 19 nt, Homo sapiens
ccuuuaugcuggaucaugu

SEQ ID NO: 488326 - RNA, 19 nt, Homo sapiens
guacaucgugaccugguau

SEQ ID NO: 488327 - RNA, 19 nt, Homo sapiens
cuacugguauaaaguucug

SEQ ID NO: 488328 - RNA, 19 nt, Homo sapiens
gugcuacugguauaaaguu

SEQ ID NO: 488329 - RNA, 19 nt, Homo sapiens
uccaaggagcuguauauga

SEQ ID NO: 488330 - RNA, 19 nt, Homo sapiens
ccuggugugugacagauca

SEQ ID NO: 488331 - RNA, 19 nt, Homo sapiens
aggaaccacuggcauuauc

SEQ ID NO: 488332 - RNA, 19 nt, Homo sapiens
acgagcaucugcaguacau

SEQ ID NO: 488333 - RNA, 19 nt, Homo sapiens
gagaaguggaccucauugg

SEQ ID NO: 488334 - RNA, 19 nt, Homo sapiens
ccugaaacccggcagaaag

SEQ ID NO: 488335 - RNA, 19 nt, Homo sapiens
ggaaguggaagcugaaccu

SEQ ID NO: 488336 - RNA, 19 nt, Homo sapiens
ccagauugagggagaagug

SEQ ID NO: 488337 - RNA, 19 nt, Homo sapiens
caaggagcuguauaugaug

SEQ ID NO: 488338 - RNA, 19 nt, Homo sapiens
aucgagaccuggaagcuau

SEQ ID NO: 488339 - RNA, 19 nt, Homo sapiens
cuaccugugguuuaagaaa

SEQ ID NO: 488340 - RNA, 19 nt, Homo sapiens
uaucgagaccuggaagcua

SEQ ID NO: 488341 - RNA, 19 nt, Homo sapiens
ggauggcacugaugacuuu

SEQ ID NO: 488342 - RNA, 19 nt, Homo sapiens
guaaacagccagguuaaua

SEQ ID NO: 488343 - RNA, 19 nt, Homo sapiens
ggagagagacgaccgugua

SEQ ID NO: 488344 - RNA, 19 nt, Homo sapiens
uaaacagccagguuaauaa

SEQ ID NO: 488345 - RNA, 19 nt, Homo sapiens
caagagucaucaccgcaaa

SEQ ID NO: 488346 - RNA, 19 nt, Homo sapiens
ccaagaacccgcaccaguu

SEQ ID NO: 488347 - RNA, 19 nt, Homo sapiens
ccagcgagcucuguguaaa

SEQ ID NO: 488348 - RNA, 19 nt, Homo sapiens
guacccaccugagcuauuc

SEQ ID NO: 488349 - RNA, 19 nt, Homo sapiens
caagaacccgcaccaguug

SEQ ID NO: 488350 - RNA, 19 nt, Homo sapiens
gaugagggcaggagagaga

SEQ ID NO: 488351 - RNA, 19 nt, Homo sapiens
aaacagccagguuaauaaa

SEQ ID NO: 488352 - RNA, 19 nt, Homo sapiens
ugaagaaugucagaagcaa

SEQ ID NO: 488353 - RNA, 19 nt, Homo sapiens
gcaguugggcucguugaaa

SEQ ID NO: 488354 - RNA, 19 nt, Homo sapiens
ugacagacaaagaggauga

SEQ ID NO: 488355 - RNA, 19 nt, Homo sapiens
cgagcucuguguaaauaug

SEQ ID NO: 488356 - RNA, 19 nt, Homo sapiens
aaaagaaguucaagaguca

SEQ ID NO: 488357 - RNA, 19 nt, Homo sapiens
ccugagcuauucaccagaa

SEQ ID NO: 488358 - RNA, 19 nt, Homo sapiens
ggagggaggaccagaugga

SEQ ID NO: 488359 - RNA, 19 nt, Homo sapiens
ugccggagcuccaggucua

SEQ ID NO: 488360 - RNA, 19 nt, Homo sapiens
agcgagcucuguguaaaua

SEQ ID NO: 488361 - RNA, 19 nt, Homo sapiens
agacaaagaggaugagaag

SEQ ID NO: 488362 - RNA, 19 nt, Homo sapiens
gaggagggaggaccagaug

SEQ ID NO: 488363 - RNA, 19 nt, Homo sapiens
gcaagugaugacagcauga

SEQ ID NO: 488364 - RNA, 19 nt, Homo sapiens
gagcucuguguaaauauga

SEQ ID NO: 488365 - RNA, 19 nt, Homo sapiens
aaaagcacaugccgugaaa

SEQ ID NO: 488366 - RNA, 19 nt, Homo sapiens
caucaacaagugcccagaa

SEQ ID NO: 488367 - RNA, 19 nt, Homo sapiens
cuucgacuaugcagaguuc

SEQ ID NO: 488368 - RNA, 19 nt, Homo sapiens
agaagcaguugggcucguu

SEQ ID NO: 488369 - RNA, 19 nt, Homo sapiens
gugaugacagcaugacaga

SEQ ID NO: 488370 - RNA, 19 nt, Homo sapiens
gcaccaguuguucugcaaa

SEQ ID NO: 488371 - RNA, 19 nt, Homo sapiens
caacaagugcccagaacac

SEQ ID NO: 488372 - RNA, 19 nt, Homo sapiens
caguugggcucguugaaaa

SEQ ID NO: 488373 - RNA, 19 nt, Homo sapiens
ggaggagggaggaccagau

SEQ ID NO: 488374 - RNA, 19 nt, Homo sapiens
caucaccgcaaacccaaga

SEQ ID NO: 488375 - RNA, 19 nt, Homo sapiens
gggauggcacugaugacuu

SEQ ID NO: 488376 - RNA, 19 nt, Homo sapiens
cagacaaagaggaugagaa

SEQ ID NO: 488377 - RNA, 19 nt, Homo sapiens
gagcuauucaccagaaagg

SEQ ID NO: 488378 - RNA, 19 nt, Homo sapiens
cagcgagcucuguguaaau

SEQ ID NO: 488379 - RNA, 19 nt, Homo sapiens
uaccagcgagcucugugua

SEQ ID NO: 488380 - RNA, 19 nt, Homo sapiens
gguagaagcugcuguuuau

SEQ ID NO: 488381 - RNA, 19 nt, Homo sapiens
gcacagcucugaugauuuu

SEQ ID NO: 488382 - RNA, 19 nt, Homo sapiens
caacaaaacugccagcuuu

SEQ ID NO: 488383 - RNA, 19 nt, Homo sapiens
gcaggaacuucgugcagua

SEQ ID NO: 488384 - RNA, 19 nt, Homo sapiens
uaagugggaucuaccaauu

SEQ ID NO: 488385 - RNA, 19 nt, Homo sapiens
gggcacagcucugaugauu

SEQ ID NO: 488386 - RNA, 19 nt, Homo sapiens
caaagcagucucccucuua

SEQ ID NO: 488387 - RNA, 19 nt, Homo sapiens
ucacucagauuguccguuu

SEQ ID NO: 488388 - RNA, 19 nt, Homo sapiens
ggacauggguucucuucuc

SEQ ID NO: 488389 - RNA, 19 nt, Homo sapiens
ggacuucgccgaccaguuc

SEQ ID NO: 488390 - RNA, 19 nt, Homo sapiens
gcauugguauuaucauuca

SEQ ID NO: 488391 - RNA, 19 nt, Homo sapiens
uaacacagccgaacuaguc

SEQ ID NO: 488392 - RNA, 19 nt, Homo sapiens
caguuaaucucccugguuu

SEQ ID NO: 488393 - RNA, 19 nt, Homo sapiens
gaaaguaggguggaccaaa

SEQ ID NO: 488394 - RNA, 19 nt, Homo sapiens
ccaacgcguuugcaaauau

SEQ ID NO: 488395 - RNA, 19 nt, Homo sapiens
ugugaugccuuaccgauuu

SEQ ID NO: 488396 - RNA, 19 nt, Homo sapiens
agcggaaacuacuaaauua

SEQ ID NO: 488397 - RNA, 19 nt, Homo sapiens
uaaauaauggcguuuguug

SEQ ID NO: 488398 - RNA, 19 nt, Homo sapiens
caacgcguuugcaaauauu

SEQ ID NO: 488399 - RNA, 19 nt, Homo sapiens
gguaaaggcacagauguuu

SEQ ID NO: 488400 - RNA, 19 nt, Homo sapiens
caaagaaugaugcaguauu

SEQ ID NO: 488401 - RNA, 19 nt, Homo sapiens
aauaauggcguuuguugua

SEQ ID NO: 488402 - RNA, 19 nt, Homo sapiens
gaagggaagagcauguuug

SEQ ID NO: 488403 - RNA, 19 nt, Homo sapiens
ccacaaggguagucgaaca

SEQ ID NO: 488404 - RNA, 19 nt, Homo sapiens
gcagacgcauugguauuau

SEQ ID NO: 488405 - RNA, 19 nt, Homo sapiens
uagcggaaacuacuaaauu

SEQ ID NO: 488406 - RNA, 19 nt, Homo sapiens
ugcaugacuuccugaaaua

SEQ ID NO: 488407 - RNA, 19 nt, Homo sapiens
cccaaagaaugaugcagua

SEQ ID NO: 488408 - RNA, 19 nt, Homo sapiens
gguaacacccugggaguuu

SEQ ID NO: 488409 - RNA, 19 nt, Homo sapiens
gagcagacgcauugguauu

SEQ ID NO: 488410 - RNA, 19 nt, Homo sapiens
gaagaagaaggagugguaa

SEQ ID NO: 488411 - RNA, 19 nt, Homo sapiens
uaauggcguuuguuguaaa

SEQ ID NO: 488412 - RNA, 19 nt, Homo sapiens
gaagcugcuguuuaugaua

SEQ ID NO: 488413 - RNA, 19 nt, Homo sapiens
uagaagcugcuguuuauga

SEQ ID NO: 488414 - RNA, 19 nt, Homo sapiens
ccuucaagcuguacuguga

SEQ ID NO: 488415 - RNA, 19 nt, Homo sapiens
agaagaagaaggaguggua

SEQ ID NO: 488416 - RNA, 19 nt, Homo sapiens
gaggauaagugggaucuac

SEQ ID NO: 488417 - RNA, 19 nt, Homo sapiens
gcugauugguggaaaguag

SEQ ID NO: 488418 - RNA, 19 nt, Homo sapiens
uaacacugccuuauacugu

SEQ ID NO: 488419 - RNA, 19 nt, Homo sapiens
gguauuaucauucaaagca

SEQ ID NO: 488420 - RNA, 19 nt, Homo sapiens
gaaugaugcaguauuaaag

SEQ ID NO: 488421 - RNA, 19 nt, Homo sapiens
caagguugguuggcugauu

SEQ ID NO: 488422 - RNA, 19 nt, Homo sapiens
gcaauggcuucaggacaug

SEQ ID NO: 488423 - RNA, 19 nt, Homo sapiens
gcacagauguuuugagaac

SEQ ID NO: 488424 - RNA, 19 nt, Homo sapiens
uggcaucucaguccuauuu

SEQ ID NO: 488425 - RNA, 19 nt, Homo sapiens
ccuuaccgauuugaucuua

SEQ ID NO: 488426 - RNA, 19 nt, Homo sapiens
aaagcagucucccucuuau

SEQ ID NO: 488427 - RNA, 19 nt, Homo sapiens
ucaaagcagucucccucuu

SEQ ID NO: 488428 - RNA, 19 nt, Homo sapiens
gaaggagugguaacaguca

SEQ ID NO: 488429 - RNA, 19 nt, Homo sapiens
gcucuuugccaucaacgua

SEQ ID NO: 488430 - RNA, 19 nt, Homo sapiens
aaaguaggguggaccaaag

SEQ ID NO: 488431 - RNA, 19 nt, Homo sapiens
acgauugccuacagcauuu

SEQ ID NO: 488432 - RNA, 19 nt, Homo sapiens
auaauggcguuuguuguaa

SEQ ID NO: 488433 - RNA, 19 nt, Homo sapiens
gugagcagacgcauuggua

SEQ ID NO: 488434 - RNA, 19 nt, Homo sapiens
ucuacaagcccaugcauga

SEQ ID NO: 488435 - RNA, 19 nt, Homo sapiens
gacgauugccuacagcauu

SEQ ID NO: 488436 - RNA, 19 nt, Homo sapiens
ucauagcucugcagacgau

SEQ ID NO: 488437 - RNA, 19 nt, Homo sapiens
gcagucucccucuuauuug

SEQ ID NO: 488438 - RNA, 19 nt, Homo sapiens
agugggaucuaccaauuga

SEQ ID NO: 488439 - RNA, 19 nt, Homo sapiens
gcucauaagugcuuuugga

SEQ ID NO: 488440 - RNA, 19 nt, Homo sapiens
cagauuguccguuugcuau

SEQ ID NO: 488441 - RNA, 19 nt, Homo sapiens
gcagagacaccugagaauc

SEQ ID NO: 488442 - RNA, 19 nt, Homo sapiens
ccuaguggguguuccuguu

SEQ ID NO: 488443 - RNA, 19 nt, Homo sapiens
acaccucgcucccuguuag

SEQ ID NO: 488444 - RNA, 19 nt, Homo sapiens
gcggaaacuacuaaauuau

SEQ ID NO: 488445 - RNA, 19 nt, Homo sapiens
uuucuaacacugccuuaua

SEQ ID NO: 488446 - RNA, 19 nt, Homo sapiens
agaagcugcuguuuaugau

SEQ ID NO: 488447 - RNA, 19 nt, Homo sapiens
ucacaccaguggcuuugau

SEQ ID NO: 488448 - RNA, 19 nt, Homo sapiens
gugggaaacagaucuaaau

SEQ ID NO: 488449 - RNA, 19 nt, Homo sapiens
gcagucagcaccaguucug

SEQ ID NO: 488450 - RNA, 19 nt, Homo sapiens
cccaacgcguuugcaaaua

SEQ ID NO: 488451 - RNA, 19 nt, Homo sapiens
acgcauugguauuaucauu

SEQ ID NO: 488452 - RNA, 19 nt, Homo sapiens
augcaugacuuccugaaau

SEQ ID NO: 488453 - RNA, 19 nt, Homo sapiens
ugacccuccuucacuuuga

SEQ ID NO: 488454 - RNA, 19 nt, Homo sapiens
ucaugacccuccuucacuu

SEQ ID NO: 488455 - RNA, 19 nt, Homo sapiens
uugguaagaucgagcaaug

SEQ ID NO: 488456 - RNA, 19 nt, Homo sapiens
aagaaggagugguaacagu

SEQ ID NO: 488457 - RNA, 19 nt, Homo sapiens
cgccgaggcuuuggaguga

SEQ ID NO: 488458 - RNA, 19 nt, Homo sapiens
aagguugguuggcugauug

SEQ ID NO: 488459 - RNA, 19 nt, Homo sapiens
gcuucgggcucuuuggaau

SEQ ID NO: 488460 - RNA, 19 nt, Homo sapiens
ugguagaagcugcuguuua

SEQ ID NO: 488461 - RNA, 19 nt, Homo sapiens
uaaucucccugguuuaaaa

SEQ ID NO: 488462 - RNA, 19 nt, Homo sapiens
gaccaguuccuccguguca

SEQ ID NO: 488463 - RNA, 19 nt, Homo sapiens
ccugaaauacgacuucuuc

SEQ ID NO: 488464 - RNA, 19 nt, Homo sapiens
ggacacccaaagaaugaug

SEQ ID NO: 488465 - RNA, 19 nt, Homo sapiens
ggaccauuccagucuacaa

SEQ ID NO: 488466 - RNA, 19 nt, Homo sapiens
gccaucaacguauauuuca

SEQ ID NO: 488467 - RNA, 19 nt, Homo sapiens
ucaccagggcugucucuug

SEQ ID NO: 488468 - RNA, 19 nt, Homo sapiens
ugagcaaggucucgaaagc

SEQ ID NO: 488469 - RNA, 19 nt, Homo sapiens
gaagaaggagugguaacag

SEQ ID NO: 488470 - RNA, 19 nt, Homo sapiens
ccauggaugagaagaagaa

SEQ ID NO: 488471 - RNA, 19 nt, Homo sapiens
ccaucaacguauauuucaa

SEQ ID NO: 488472 - RNA, 19 nt, Homo sapiens
ggagcuuaacugcuuguug

SEQ ID NO: 488473 - RNA, 19 nt, Homo sapiens
gugaugccuuaccgauuug

SEQ ID NO: 488474 - RNA, 19 nt, Homo sapiens
ggcugucgcucacucagau

SEQ ID NO: 488475 - RNA, 19 nt, Homo sapiens
ccaguggcuuugauguugu

SEQ ID NO: 488476 - RNA, 19 nt, Homo sapiens
agcagucucccucuuauuu

SEQ ID NO: 488477 - RNA, 19 nt, Homo sapiens
ucuuugccaucaacguaua

SEQ ID NO: 488478 - RNA, 19 nt, Homo sapiens
cauaagugcuuuuggaagu

SEQ ID NO: 488479 - RNA, 19 nt, Homo sapiens
cgggcucuuuggaaucaua

SEQ ID NO: 488480 - RNA, 19 nt, Homo sapiens
ggacaaaccuuuccuuccu

SEQ ID NO: 488481 - RNA, 19 nt, Homo sapiens
gaaaucagagucuacguau

SEQ ID NO: 488482 - RNA, 19 nt, Homo sapiens
ccacagcuguucaguuugu

SEQ ID NO: 488483 - RNA, 19 nt, Homo sapiens
cagccuagguucccauuug

SEQ ID NO: 488484 - RNA, 19 nt, Homo sapiens
uuccacagcuguucaguuu

SEQ ID NO: 488485 - RNA, 19 nt, Homo sapiens
caucaagaccgccaagauu

SEQ ID NO: 488486 - RNA, 19 nt, Homo sapiens
gagcagcugugggccugua

SEQ ID NO: 488487 - RNA, 19 nt, Homo sapiens
ccauguggaugucaccaaa

SEQ ID NO: 488488 - RNA, 19 nt, Homo sapiens
cgagucaucaucucuguuu

SEQ ID NO: 488489 - RNA, 19 nt, Homo sapiens
cagagucuacguaucauuu

SEQ ID NO: 488490 - RNA, 19 nt, Homo sapiens
gggcugugcugcuccuguu

SEQ ID NO: 488491 - RNA, 19 nt, Homo sapiens
caaauucuugcuggucuua

SEQ ID NO: 488492 - RNA, 19 nt, Homo sapiens
aaucagagucuacguauca

SEQ ID NO: 488493 - RNA, 19 nt, Homo sapiens
ggacagucaugggaaugug

SEQ ID NO: 488494 - RNA, 19 nt, Homo sapiens
agggugaacaggacaauua

SEQ ID NO: 488495 - RNA, 19 nt, Homo sapiens
caacagucccucagcuuca

SEQ ID NO: 488496 - RNA, 19 nt, Homo sapiens
gcugugggccuguaauuca

SEQ ID NO: 488497 - RNA, 19 nt, Homo sapiens
gcagggaauggccuugaaa

SEQ ID NO: 488498 - RNA, 19 nt, Homo sapiens
ucaccgagaucaucaagac

SEQ ID NO: 488499 - RNA, 19 nt, Homo sapiens
gacaguagggaaacaguug

SEQ ID NO: 488500 - RNA, 19 nt, Homo sapiens
ggacaguagggaaacaguu

SEQ ID NO: 488501 - RNA, 19 nt, Homo sapiens
gcagacaugaggcagcauu

SEQ ID NO: 488502 - RNA, 19 nt, Homo sapiens
agaaaucagagucuacgua

SEQ ID NO: 488503 - RNA, 19 nt, Homo sapiens
gaagcuaggugggacucau

SEQ ID NO: 488504 - RNA, 19 nt, Homo sapiens
gggccacgcuucguucuca

SEQ ID NO: 488505 - RNA, 19 nt, Homo sapiens
uguccgaccucaagcaguu

SEQ ID NO: 488506 - RNA, 19 nt, Homo sapiens
gcgagucccugaugaagcu

SEQ ID NO: 488507 - RNA, 19 nt, Homo sapiens
ggagagacgcgggaaagug

SEQ ID NO: 488508 - RNA, 19 nt, Homo sapiens
cagcauuuccuccacacua

SEQ ID NO: 488509 - RNA, 19 nt, Homo sapiens
cagaguccauguccaucuu

SEQ ID NO: 488510 - RNA, 19 nt, Homo sapiens
guuaccuucugaauccaua

SEQ ID NO: 488511 - RNA, 19 nt, Homo sapiens
acaggacaauuacgagaug

SEQ ID NO: 488512 - RNA, 19 nt, Homo sapiens
cuacguaucauuuacuuag

SEQ ID NO: 488513 - RNA, 19 nt, Homo sapiens
ggcagggaauggccuugaa

SEQ ID NO: 488514 - RNA, 19 nt, Homo sapiens
gcaaacccaggacaucugu

SEQ ID NO: 488515 - RNA, 19 nt, Homo sapiens
cccuagccauuuccgaaua

SEQ ID NO: 488516 - RNA, 19 nt, Homo sapiens
caacuucaccgagaucauc

SEQ ID NO: 488517 - RNA, 19 nt, Homo sapiens
cagcagagcagggcgcaaa

SEQ ID NO: 488518 - RNA, 19 nt, Homo sapiens
acaacaagcggcugaagga

SEQ ID NO: 488519 - RNA, 19 nt, Homo sapiens
acagugcaaugugaugaaa

SEQ ID NO: 488520 - RNA, 19 nt, Homo sapiens
agacaauucacauccauau

SEQ ID NO: 488521 - RNA, 19 nt, Homo sapiens
gguccuaggguguuucaga

SEQ ID NO: 488522 - RNA, 19 nt, Homo sapiens
cguaagaagcugaaaccuu

SEQ ID NO: 488523 - RNA, 19 nt, Homo sapiens
ggacucauuccuaauucug

SEQ ID NO: 488524 - RNA, 19 nt, Homo sapiens
gugggacucauuccuaauu

SEQ ID NO: 488525 - RNA, 19 nt, Homo sapiens
gcugggagccacagauauc

SEQ ID NO: 488526 - RNA, 19 nt, Homo sapiens
gcugaaggacgacauuaag

SEQ ID NO: 488527 - RNA, 19 nt, Homo sapiens
ccuguuaccuucugaaucc

SEQ ID NO: 488528 - RNA, 19 nt, Homo sapiens
gacagacaauucacaucca

SEQ ID NO: 488529 - RNA, 19 nt, Homo sapiens
gaucuccauugaccucuac

SEQ ID NO: 488530 - RNA, 19 nt, Homo sapiens
guuguaaugagacuugauu

SEQ ID NO: 488531 - RNA, 19 nt, Homo sapiens
ccagccagguggaagaaag

SEQ ID NO: 488532 - RNA, 19 nt, Homo sapiens
ggacaacuucaccgagauc

SEQ ID NO: 488533 - RNA, 19 nt, Homo sapiens
ggacgagacgcagguguca

SEQ ID NO: 488534 - RNA, 19 nt, Homo sapiens
uaauucugccguuguaaug

SEQ ID NO: 488535 - RNA, 19 nt, Homo sapiens
ggcugaaggacgacauuaa

SEQ ID NO: 488536 - RNA, 19 nt, Homo sapiens
agagucuacguaucauuua

SEQ ID NO: 488537 - RNA, 19 nt, Homo sapiens
acaauuacgagaugcaugu

SEQ ID NO: 488538 - RNA, 19 nt, Homo sapiens
gcagaugcagaguccaugu

SEQ ID NO: 488539 - RNA, 19 nt, Homo sapiens
gagucuacguaucauuuac

SEQ ID NO: 488540 - RNA, 19 nt, Homo sapiens
cgacauuaaguccaucaug

SEQ ID NO: 488541 - RNA, 19 nt, Homo sapiens
caccagggaugcaauucca

SEQ ID NO: 488542 - RNA, 19 nt, Homo sapiens
ucaaauucuugcuggucuu

SEQ ID NO: 488543 - RNA, 19 nt, Homo sapiens
gugaacaggacaauuacga

SEQ ID NO: 488544 - RNA, 19 nt, Homo sapiens
ugaaggacgacauuaaguc

SEQ ID NO: 488545 - RNA, 19 nt, Homo sapiens
gcagaguccauguccaucu

SEQ ID NO: 488546 - RNA, 19 nt, Homo sapiens
acucguccagguauaaaua

SEQ ID NO: 488547 - RNA, 19 nt, Homo sapiens
aggugggacucauuccuaa

SEQ ID NO: 488548 - RNA, 19 nt, Homo sapiens
ucaguuugucggucucuuu

SEQ ID NO: 488549 - RNA, 19 nt, Homo sapiens
aagauucaguccagcagau

SEQ ID NO: 488550 - RNA, 19 nt, Homo sapiens
ggaggcagggacagucaug

SEQ ID NO: 488551 - RNA, 19 nt, Homo sapiens
ccuucugaauccauaugua

SEQ ID NO: 488552 - RNA, 19 nt, Homo sapiens
guauuacucguccagguau

SEQ ID NO: 488553 - RNA, 19 nt, Homo sapiens
cagcugugggccuguaauu

SEQ ID NO: 488554 - RNA, 19 nt, Homo sapiens
cagggacagucaugggaau

SEQ ID NO: 488555 - RNA, 19 nt, Homo sapiens
cagacaauucacauccaua

SEQ ID NO: 488556 - RNA, 19 nt, Homo sapiens
gggacucauuccuaauucu

SEQ ID NO: 488557 - RNA, 19 nt, Homo sapiens
gcccugagccacauauguc

SEQ ID NO: 488558 - RNA, 19 nt, Homo sapiens
gagucaucaucucuguuug

SEQ ID NO: 488559 - RNA, 19 nt, Homo sapiens
gggcaccagggaugcaauu

SEQ ID NO: 488560 - RNA, 19 nt, Homo sapiens
gugcugcuccuguuaccuu

SEQ ID NO: 488561 - RNA, 19 nt, Homo sapiens
uccuaauucugccguugua

SEQ ID NO: 488562 - RNA, 19 nt, Homo sapiens
gaguccauguccaucuugu

SEQ ID NO: 488563 - RNA, 19 nt, Homo sapiens
gacaauucacauccauaug

SEQ ID NO: 488564 - RNA, 19 nt, Homo sapiens
acagacaauucacauccau

SEQ ID NO: 488565 - RNA, 19 nt, Homo sapiens
uauuacucguccagguaua

SEQ ID NO: 488566 - RNA, 19 nt, Homo sapiens
ccuagccauuuccgaauag

SEQ ID NO: 488567 - RNA, 19 nt, Homo sapiens
cauuaacucagcagacaug

SEQ ID NO: 488568 - RNA, 19 nt, Homo sapiens
acaauucacauccauaugc

SEQ ID NO: 488569 - RNA, 19 nt, Homo sapiens
cuaauucugccguuguaau

SEQ ID NO: 488570 - RNA, 19 nt, Homo sapiens
acccgagccuguugucaga

SEQ ID NO: 488571 - RNA, 19 nt, Homo sapiens
gcgcaaacccaggacaucu

SEQ ID NO: 488572 - RNA, 19 nt, Homo sapiens
cgugacccacucagccuua

SEQ ID NO: 488573 - RNA, 19 nt, Homo sapiens
gucuacguaucauuuacuu

SEQ ID NO: 488574 - RNA, 19 nt, Homo sapiens
ggacaauuacgagaugcau

SEQ ID NO: 488575 - RNA, 19 nt, Homo sapiens
auccauauguagagauuuc

SEQ ID NO: 488576 - RNA, 19 nt, Homo sapiens
cagccuagguucccauuug

SEQ ID NO: 488577 - RNA, 19 nt, Homo sapiens
caucaagaccgccaagauu

SEQ ID NO: 488578 - RNA, 19 nt, Homo sapiens
cgagucaucaucucuguuu

SEQ ID NO: 488579 - RNA, 19 nt, Homo sapiens
gcuaaugaccugccucugu

SEQ ID NO: 488580 - RNA, 19 nt, Homo sapiens
agggugaacaggacaauua

SEQ ID NO: 488581 - RNA, 19 nt, Homo sapiens
ucaccgagaucaucaagac

SEQ ID NO: 488582 - RNA, 19 nt, Homo sapiens
gacaguagggaaacaguug

SEQ ID NO: 488583 - RNA, 19 nt, Homo sapiens
ggacaguagggaaacaguu

SEQ ID NO: 488584 - RNA, 19 nt, Homo sapiens
gaagcuaggugggacucau

SEQ ID NO: 488585 - RNA, 19 nt, Homo sapiens
gggccacgcuucguucuca

SEQ ID NO: 488586 - RNA, 19 nt, Homo sapiens
uguccgaccucaagcaguu

SEQ ID NO: 488587 - RNA, 19 nt, Homo sapiens
gcgagucccugaugaagcu

SEQ ID NO: 488588 - RNA, 19 nt, Homo sapiens
ggagagacgcgggaaagug

SEQ ID NO: 488589 - RNA, 19 nt, Homo sapiens
ggcuggaccucgacacaga

SEQ ID NO: 488590 - RNA, 19 nt, Homo sapiens
acaggacaauuacgagaug

SEQ ID NO: 488591 - RNA, 19 nt, Homo sapiens
cccuagccauuuccgaaua

SEQ ID NO: 488592 - RNA, 19 nt, Homo sapiens
caacuucaccgagaucauc

SEQ ID NO: 488593 - RNA, 19 nt, Homo sapiens
acaacaagcggcugaagga

SEQ ID NO: 488594 - RNA, 19 nt, Homo sapiens
ggacucauuccuaauucug

SEQ ID NO: 488595 - RNA, 19 nt, Homo sapiens
gugggacucauuccuaauu

SEQ ID NO: 488596 - RNA, 19 nt, Homo sapiens
gaucuccauugaccucuac

SEQ ID NO: 488597 - RNA, 19 nt, Homo sapiens
gcugaaggacgacauuaag

SEQ ID NO: 488598 - RNA, 19 nt, Homo sapiens
guuguaaugagacuugauu

SEQ ID NO: 488599 - RNA, 19 nt, Homo sapiens
ccagccagguggaagaaag

SEQ ID NO: 488600 - RNA, 19 nt, Homo sapiens
ggacgagacgcagguguca

SEQ ID NO: 488601 - RNA, 19 nt, Homo sapiens
ggacaacuucaccgagauc

SEQ ID NO: 488602 - RNA, 19 nt, Homo sapiens
uaauucugccguuguaaug

SEQ ID NO: 488603 - RNA, 19 nt, Homo sapiens
ggcugaaggacgacauuaa

SEQ ID NO: 488604 - RNA, 19 nt, Homo sapiens
cgacauuaaguccaucaug

SEQ ID NO: 488605 - RNA, 19 nt, Homo sapiens
acaauuacgagaugcaugu

SEQ ID NO: 488606 - RNA, 19 nt, Homo sapiens
gugaacaggacaauuacga

SEQ ID NO: 488607 - RNA, 19 nt, Homo sapiens
ugaaggacgacauuaaguc

SEQ ID NO: 488608 - RNA, 19 nt, Homo sapiens
ucguccagcucaagccuuu

SEQ ID NO: 488609 - RNA, 19 nt, Homo sapiens
aggugggacucauuccuaa

SEQ ID NO: 488610 - RNA, 19 nt, Homo sapiens
gggacucauuccuaauucu

SEQ ID NO: 488611 - RNA, 19 nt, Homo sapiens
gcccugagccacauauguc

SEQ ID NO: 488612 - RNA, 19 nt, Homo sapiens
gagucaucaucucuguuug

SEQ ID NO: 488613 - RNA, 19 nt, Homo sapiens
uccuaauucugccguugua

SEQ ID NO: 488614 - RNA, 19 nt, Homo sapiens
ggaccucgacacagacucu

SEQ ID NO: 488615 - RNA, 19 nt, Homo sapiens
ccuagccauuuccgaauag

SEQ ID NO: 488616 - RNA, 19 nt, Homo sapiens
cuaauucugccguuguaau

SEQ ID NO: 488617 - RNA, 19 nt, Homo sapiens
acccgagccuguugucaga

SEQ ID NO: 488618 - RNA, 19 nt, Homo sapiens
ucaagccuuugcgaagcua

SEQ ID NO: 488619 - RNA, 19 nt, Homo sapiens
ggacaauuacgagaugcau

SEQ ID NO: 488620 - RNA, 19 nt, Homo sapiens
gaacauggauggaaacuga

SEQ ID NO: 488621 - RNA, 19 nt, Homo sapiens
ggaccaaccuccucuacaa

SEQ ID NO: 488622 - RNA, 19 nt, Homo sapiens
gauggaaacugaccaccua

SEQ ID NO: 488623 - RNA, 19 nt, Homo sapiens
gaagauccgugacgacgaa

SEQ ID NO: 488624 - RNA, 19 nt, Homo sapiens
ugaugaaacucuccgguua

SEQ ID NO: 488625 - RNA, 19 nt, Homo sapiens
gacaaagacuguaacugaa

SEQ ID NO: 488626 - RNA, 19 nt, Homo sapiens
gaaacugaccaccuacuuu

SEQ ID NO: 488627 - RNA, 19 nt, Homo sapiens
gaacgggaccggaagaaga

SEQ ID NO: 488628 - RNA, 19 nt, Homo sapiens
agacaaagacuguaacuga

SEQ ID NO: 488629 - RNA, 19 nt, Homo sapiens
ggaaagagaaagaaagaau

SEQ ID NO: 488630 - RNA, 19 nt, Homo sapiens
aagaagaucugcucccauu

SEQ ID NO: 488631 - RNA, 19 nt, Homo sapiens
aaagugggauggaagaauu

SEQ ID NO: 488632 - RNA, 19 nt, Homo sapiens
gggcugaucuucaauaagg

SEQ ID NO: 488633 - RNA, 19 nt, Homo sapiens
ggaagaagaggaagcgaaa

SEQ ID NO: 488634 - RNA, 19 nt, Homo sapiens
gagugcagguugaaagaaa

SEQ ID NO: 488635 - RNA, 19 nt, Homo sapiens
agaauuaaauccagaguuc

SEQ ID NO: 488636 - RNA, 19 nt, Homo sapiens
gagagagagugaagugaau

SEQ ID NO: 488637 - RNA, 19 nt, Homo sapiens
ccacugagccugagucugu

SEQ ID NO: 488638 - RNA, 19 nt, Homo sapiens
gcauauggaugauaaagcu

SEQ ID NO: 488639 - RNA, 19 nt, Homo sapiens
ggagagagagugaagugaa

SEQ ID NO: 488640 - RNA, 19 nt, Homo sapiens
caaggaaucagugucguua

SEQ ID NO: 488641 - RNA, 19 nt, Homo sapiens
gaggugagcaugagcuuga

SEQ ID NO: 488642 - RNA, 19 nt, Homo sapiens
cgaaagagaaggccaggaa

SEQ ID NO: 488643 - RNA, 19 nt, Homo sapiens
caaagacuguaacugaaca

SEQ ID NO: 488644 - RNA, 19 nt, Homo sapiens
gauacaaagugggauggaa

SEQ ID NO: 488645 - RNA, 19 nt, Homo sapiens
ggaccuagggaaagagaaa

SEQ ID NO: 488646 - RNA, 19 nt, Homo sapiens
gacagcgacugcaugagaa

SEQ ID NO: 488647 - RNA, 19 nt, Homo sapiens
agacagaggcaacugauga

SEQ ID NO: 488648 - RNA, 19 nt, Homo sapiens
cgacagcgacugcaugaga

SEQ ID NO: 488649 - RNA, 19 nt, Homo sapiens
ccaccuacuuuguccagaa

SEQ ID NO: 488650 - RNA, 19 nt, Homo sapiens
uauggaacauggauggaaa

SEQ ID NO: 488651 - RNA, 19 nt, Homo sapiens
aauaaaagcuggagagaga

SEQ ID NO: 488652 - RNA, 19 nt, Homo sapiens
aaacugaccaccuacuuug

SEQ ID NO: 488653 - RNA, 19 nt, Homo sapiens
ggagcuggugugacuguua

SEQ ID NO: 488654 - RNA, 19 nt, Homo sapiens
ggaaacugaccaccuacuu

SEQ ID NO: 488655 - RNA, 19 nt, Homo sapiens
caaaaugagugcagguuga

SEQ ID NO: 488656 - RNA, 19 nt, Homo sapiens
guggugcucugcugaguug

SEQ ID NO: 488657 - RNA, 19 nt, Homo sapiens
ugaagugaaugcaagauac

SEQ ID NO: 488658 - RNA, 19 nt, Homo sapiens
cauacucuuuccaugcaua

SEQ ID NO: 488659 - RNA, 19 nt, Homo sapiens
gaaacucuccgguuaugag

SEQ ID NO: 488660 - RNA, 19 nt, Homo sapiens
gaauacauacucuuuccau

SEQ ID NO: 488661 - RNA, 19 nt, Homo sapiens
gaugaaacucuccgguuau

SEQ ID NO: 488662 - RNA, 19 nt, Homo sapiens
gaagugaaugcaagauaca

SEQ ID NO: 488663 - RNA, 19 nt, Homo sapiens
gugaagugaaugcaagaua

SEQ ID NO: 488664 - RNA, 19 nt, Homo sapiens
gagcuggugugacuguuac

SEQ ID NO: 488665 - RNA, 19 nt, Homo sapiens
gaaucagugucguuaucug

SEQ ID NO: 488666 - RNA, 19 nt, Homo sapiens
gagacagacacaacaguau

SEQ ID NO: 488667 - RNA, 19 nt, Homo sapiens
ugugaaagauaggauguga

SEQ ID NO: 488668 - RNA, 19 nt, Homo sapiens
gaaugcaagauacaaagug

SEQ ID NO: 488669 - RNA, 19 nt, Homo sapiens
gaagaucugcucccauucg

SEQ ID NO: 488670 - RNA, 19 nt, Homo sapiens
ggaagaaaacacaaaagaa

SEQ ID NO: 488671 - RNA, 19 nt, Homo sapiens
gaugugaggugagcaugag

SEQ ID NO: 488672 - RNA, 19 nt, Homo sapiens
caccuacuuuguccagaaa

SEQ ID NO: 488673 - RNA, 19 nt, Homo sapiens
gacacaacaguaucugaaa

SEQ ID NO: 488674 - RNA, 19 nt, Homo sapiens
agagacagacacaacagua

SEQ ID NO: 488675 - RNA, 19 nt, Homo sapiens
aguggcauauggaugauaa

SEQ ID NO: 488676 - RNA, 19 nt, Homo sapiens
ccgggcugaucuucaauaa

SEQ ID NO: 488677 - RNA, 19 nt, Homo sapiens
acagaucccaugugagaaa

SEQ ID NO: 488678 - RNA, 19 nt, Homo sapiens
gagcuggaggcgaagauga

SEQ ID NO: 488679 - RNA, 19 nt, Homo sapiens
guuaugagacaaagacugu

SEQ ID NO: 488680 - RNA, 19 nt, Homo sapiens
gagccugagucugucuuug

SEQ ID NO: 488681 - RNA, 19 nt, Homo sapiens
agacacaacaguaucugaa

SEQ ID NO: 488682 - RNA, 19 nt, Homo sapiens
uaugagacaaagacuguaa

SEQ ID NO: 488683 - RNA, 19 nt, Homo sapiens
gacagaggcaacugaugaa

SEQ ID NO: 488684 - RNA, 19 nt, Homo sapiens
ugcagagccuggccaagaa

SEQ ID NO: 488685 - RNA, 19 nt, Homo sapiens
ugaguugggucaagugcau

SEQ ID NO: 488686 - RNA, 19 nt, Homo sapiens
gagcugagagacagacaca

SEQ ID NO: 488687 - RNA, 19 nt, Homo sapiens
acucaaggcucagaaacug

SEQ ID NO: 488688 - RNA, 19 nt, Homo sapiens
cauuggaccuagggaaaga

SEQ ID NO: 488689 - RNA, 19 nt, Homo sapiens
gucguuaucugaccguauc

SEQ ID NO: 488690 - RNA, 19 nt, Homo sapiens
uacauacucuuuccaugca

SEQ ID NO: 488691 - RNA, 19 nt, Homo sapiens
ggaugugaggugagcauga

SEQ ID NO: 488692 - RNA, 19 nt, Homo sapiens
aacaggagcuggugugacu

SEQ ID NO: 488693 - RNA, 19 nt, Homo sapiens
uauggaugauaaagcugua

SEQ ID NO: 488694 - RNA, 19 nt, Homo sapiens
gaaagaaaacaggugaauu

SEQ ID NO: 488695 - RNA, 19 nt, Homo sapiens
gagagugaagugaaugcaa

SEQ ID NO: 488696 - RNA, 19 nt, Homo sapiens
gugcucugcugaguuguga

SEQ ID NO: 488697 - RNA, 19 nt, Homo sapiens
gcauauauggaacauggau

SEQ ID NO: 488698 - RNA, 19 nt, Homo sapiens
ugaggcagccaaagaggaa

SEQ ID NO: 488699 - RNA, 19 nt, Homo sapiens
caaagugggauggaagaau

SEQ ID NO: 488700 - RNA, 19 nt, Homo sapiens
gaccucggccucuccaugu

SEQ ID NO: 488701 - RNA, 19 nt, Homo sapiens
gaccguaucccaaugucau

SEQ ID NO: 488702 - RNA, 19 nt, Homo sapiens
gaaauuccggaagcgagaa

SEQ ID NO: 488703 - RNA, 19 nt, Homo sapiens
ccugagguguggcauaugg

SEQ ID NO: 488704 - RNA, 19 nt, Homo sapiens
aggaaucagugucguuauc

SEQ ID NO: 488705 - RNA, 19 nt, Homo sapiens
gaagaauuaaauccagagu

SEQ ID NO: 488706 - RNA, 19 nt, Homo sapiens
ggaaucagugucguuaucu

SEQ ID NO: 488707 - RNA, 19 nt, Homo sapiens
acacaacaguaucugaaaa

SEQ ID NO: 488708 - RNA, 19 nt, Homo sapiens
gaucccaugugagaaagag

SEQ ID NO: 488709 - RNA, 19 nt, Homo sapiens
ugucuuugcucuggauguu

SEQ ID NO: 488710 - RNA, 19 nt, Homo sapiens
ggccuggucugagucuuuc

SEQ ID NO: 488711 - RNA, 19 nt, Homo sapiens
uaucugaccguaucccaau

SEQ ID NO: 488712 - RNA, 19 nt, Homo sapiens
uuuaguggcauauggauga

SEQ ID NO: 488713 - RNA, 19 nt, Homo sapiens
gcaugugaguugggucaag

SEQ ID NO: 488714 - RNA, 19 nt, Homo sapiens
gucccaggaucuccacaga

SEQ ID NO: 488715 - RNA, 19 nt, Homo sapiens
ucaaggaaucagugucguu

SEQ ID NO: 488716 - RNA, 19 nt, Homo sapiens
ggaugauaaagcuguaaau

SEQ ID NO: 488717 - RNA, 19 nt, Homo sapiens
cugcagagccuggccaaga

SEQ ID NO: 488718 - RNA, 19 nt, Homo sapiens
caugugaguugggucaagu

SEQ ID NO: 488719 - RNA, 19 nt, Homo sapiens
gcauuuuacugcucagaau

SEQ ID NO: 488720 - RNA, 19 nt, Homo sapiens
gcgaggagcucaccuuuga

SEQ ID NO: 488721 - RNA, 19 nt, Homo sapiens
gaaccaagaucuagauagu

SEQ ID NO: 488722 - RNA, 19 nt, Homo sapiens
ccacccaccuucagaaaua

SEQ ID NO: 488723 - RNA, 19 nt, Homo sapiens
gaaccucuaugacuuugaa

SEQ ID NO: 488724 - RNA, 19 nt, Homo sapiens
ccacagaaacuuuguacua

SEQ ID NO: 488725 - RNA, 19 nt, Homo sapiens
gcacaaguuugccuacaau

SEQ ID NO: 488726 - RNA, 19 nt, Homo sapiens
aauauuaccuggugaaaug

SEQ ID NO: 488727 - RNA, 19 nt, Homo sapiens
gcacuuaggacaagaaugu

SEQ ID NO: 488728 - RNA, 19 nt, Homo sapiens
ggagguggaugccaggaaa

SEQ ID NO: 488729 - RNA, 19 nt, Homo sapiens
ccaacuaccuggugcagaa

SEQ ID NO: 488730 - RNA, 19 nt, Homo sapiens
aaagucaccugccuacaaa

SEQ ID NO: 488731 - RNA, 19 nt, Homo sapiens
gggcgucacugcacaaguu

SEQ ID NO: 488732 - RNA, 19 nt, Homo sapiens
ggaccaagcucugccuuca

SEQ ID NO: 488733 - RNA, 19 nt, Homo sapiens
gauaugaccucugcaucuu

SEQ ID NO: 488734 - RNA, 19 nt, Homo sapiens
ucgaguaccugugcgauua

SEQ ID NO: 488735 - RNA, 19 nt, Homo sapiens
ggcagaaucucaagugugu

SEQ ID NO: 488736 - RNA, 19 nt, Homo sapiens
ggagauggcuuccccacua

SEQ ID NO: 488737 - RNA, 19 nt, Homo sapiens
ggcaacaucucccacuuug

SEQ ID NO: 488738 - RNA, 19 nt, Homo sapiens
gaaucugguucuccucuug

SEQ ID NO: 488739 - RNA, 19 nt, Homo sapiens
caaaucgugugguacagaa

SEQ ID NO: 488740 - RNA, 19 nt, Homo sapiens
gaagauccgcgaacaggaa

SEQ ID NO: 488741 - RNA, 19 nt, Homo sapiens
gcaaaguacaggccaagaa

SEQ ID NO: 488742 - RNA, 19 nt, Homo sapiens
aaaaugaacugucgacuga

SEQ ID NO: 488743 - RNA, 19 nt, Homo sapiens
gagagaucauuaccucaga

SEQ ID NO: 488744 - RNA, 19 nt, Homo sapiens
gagacuguaugcccugcua

SEQ ID NO: 488745 - RNA, 19 nt, Homo sapiens
ugggauucauggccuauua

SEQ ID NO: 488746 - RNA, 19 nt, Homo sapiens
gagcucaccuuugauuaca

SEQ ID NO: 488747 - RNA, 19 nt, Homo sapiens
gaaagauggcggaaaauuu

SEQ ID NO: 488748 - RNA, 19 nt, Homo sapiens
gaagguaccuagggcucuu

SEQ ID NO: 488749 - RNA, 19 nt, Homo sapiens
gcuguagggucucuucuuc

SEQ ID NO: 488750 - RNA, 19 nt, Homo sapiens
cagaaacuuuguacuagug

SEQ ID NO: 488751 - RNA, 19 nt, Homo sapiens
gaaacuuuguacuagugaa

SEQ ID NO: 488752 - RNA, 19 nt, Homo sapiens
gaggagcucaccuuugauu

SEQ ID NO: 488753 - RNA, 19 nt, Homo sapiens
caacaucucccacuuuguc

SEQ ID NO: 488754 - RNA, 19 nt, Homo sapiens
gcaucacuguagagaauga

SEQ ID NO: 488755 - RNA, 19 nt, Homo sapiens
ucaagcaguuccacaagga

SEQ ID NO: 488756 - RNA, 19 nt, Homo sapiens
aaugaacugucgacugaaa

SEQ ID NO: 488757 - RNA, 19 nt, Homo sapiens
ggggaaagauggcggaaaa

SEQ ID NO: 488758 - RNA, 19 nt, Homo sapiens
caaaguacaggccaagaau

SEQ ID NO: 488759 - RNA, 19 nt, Homo sapiens
cacagaaacuuuguacuag

SEQ ID NO: 488760 - RNA, 19 nt, Homo sapiens
gguguacaacgucuucaua

SEQ ID NO: 488761 - RNA, 19 nt, Homo sapiens
aaagauggcggaaaauuua

SEQ ID NO: 488762 - RNA, 19 nt, Homo sapiens
gagaagauucgcaagaaca

SEQ ID NO: 488763 - RNA, 19 nt, Homo sapiens
uggagaagauucgcaagaa

SEQ ID NO: 488764 - RNA, 19 nt, Homo sapiens
gagcuggaaccaagaucua

SEQ ID NO: 488765 - RNA, 19 nt, Homo sapiens
caagaacagcuucgucaug

SEQ ID NO: 488766 - RNA, 19 nt, Homo sapiens
ggagaagauucgcaagaac

SEQ ID NO: 488767 - RNA, 19 nt, Homo sapiens
gugaggacuucucuaggaa

SEQ ID NO: 488768 - RNA, 19 nt, Homo sapiens
ccacaaggacuuagaaagg

SEQ ID NO: 488769 - RNA, 19 nt, Homo sapiens
gcaguuccacaaggacuua

SEQ ID NO: 488770 - RNA, 19 nt, Homo sapiens
uguaugcccugcuaucaga

SEQ ID NO: 488771 - RNA, 19 nt, Homo sapiens
ugugaggacuucucuagga

SEQ ID NO: 488772 - RNA, 19 nt, Homo sapiens
acgcaucacuguagagaau

SEQ ID NO: 488773 - RNA, 19 nt, Homo sapiens
cuaagaagcggguccguau

SEQ ID NO: 488774 - RNA, 19 nt, Homo sapiens
ggagugggcaucaauaaaa

SEQ ID NO: 488775 - RNA, 19 nt, Homo sapiens
gcuccuaccugcucuacgu

SEQ ID NO: 488776 - RNA, 19 nt, Homo sapiens
gcccuccugucgagaauga

SEQ ID NO: 488777 - RNA, 19 nt, Homo sapiens
acaagaagauccgcgaaca

SEQ ID NO: 488778 - RNA, 19 nt, Homo sapiens
gcuucugccuggagauuga

SEQ ID NO: 488779 - RNA, 19 nt, Homo sapiens
ggcuaugacugcccaaauc

SEQ ID NO: 488780 - RNA, 19 nt, Homo sapiens
ucguguacaucaaugagua

SEQ ID NO: 488781 - RNA, 19 nt, Homo sapiens
gaauauuaccuggugaaau

SEQ ID NO: 488782 - RNA, 19 nt, Homo sapiens
gaagcggguccguauugaa

SEQ ID NO: 488783 - RNA, 19 nt, Homo sapiens
caccuuugauuacaacaug

SEQ ID NO: 488784 - RNA, 19 nt, Homo sapiens
ggaauauuaccuggugaaa

SEQ ID NO: 488785 - RNA, 19 nt, Homo sapiens
ggugaaauggcguggauau

SEQ ID NO: 488786 - RNA, 19 nt, Homo sapiens
cuucagggcugcauaucug

SEQ ID NO: 488787 - RNA, 19 nt, Homo sapiens
ggacgcaucacuguagaga

SEQ ID NO: 488788 - RNA, 19 nt, Homo sapiens
uuacagugcuggguagugu

SEQ ID NO: 488789 - RNA, 19 nt, Homo sapiens
gugccuagcccgacaugaa

SEQ ID NO: 488790 - RNA, 19 nt, Homo sapiens
uguacaacgucuucauaga

SEQ ID NO: 488791 - RNA, 19 nt, Homo sapiens
ccacuggucucaaaaguca

SEQ ID NO: 488792 - RNA, 19 nt, Homo sapiens
cuagauaguccguagauag

SEQ ID NO: 488793 - RNA, 19 nt, Homo sapiens
acagaaacuuuguacuagu

SEQ ID NO: 488794 - RNA, 19 nt, Homo sapiens
caacaucaagacucucugu

SEQ ID NO: 488795 - RNA, 19 nt, Homo sapiens
ggagguaggcugggaccaa

SEQ ID NO: 488796 - RNA, 19 nt, Homo sapiens
ccgcaaauaccucuucuag

SEQ ID NO: 488797 - RNA, 19 nt, Homo sapiens
ggagcucaccuuugauuac

SEQ ID NO: 488798 - RNA, 19 nt, Homo sapiens
guacaccccucaacccuau

SEQ ID NO: 488799 - RNA, 19 nt, Homo sapiens
ggaaccaagaucuagauag

SEQ ID NO: 488800 - RNA, 19 nt, Homo sapiens
ggaaagauggcggaaaauu

SEQ ID NO: 488801 - RNA, 19 nt, Homo sapiens
gggauucauggccuauuaa

SEQ ID NO: 488802 - RNA, 19 nt, Homo sapiens
aagaagcggguccguauug

SEQ ID NO: 488803 - RNA, 19 nt, Homo sapiens
guacgugggagagaucauu

SEQ ID NO: 488804 - RNA, 19 nt, Homo sapiens
gauagcacuuaggacaaga

SEQ ID NO: 488805 - RNA, 19 nt, Homo sapiens
caaccacagaaacuuugua

SEQ ID NO: 488806 - RNA, 19 nt, Homo sapiens
agaagcggguccguauuga

SEQ ID NO: 488807 - RNA, 19 nt, Homo sapiens
acaaguuugccuacaauga

SEQ ID NO: 488808 - RNA, 19 nt, Homo sapiens
cagcguguguugcaagucu

SEQ ID NO: 488809 - RNA, 19 nt, Homo sapiens
guccguagauagcacuuag

SEQ ID NO: 488810 - RNA, 19 nt, Homo sapiens
caacccagccccagaauau

SEQ ID NO: 488811 - RNA, 19 nt, Homo sapiens
gcagguguacaacgucuuc

SEQ ID NO: 488812 - RNA, 19 nt, Homo sapiens
auucauggccuauuaagga

SEQ ID NO: 488813 - RNA, 19 nt, Homo sapiens
gcaagaacagcuucgucau

SEQ ID NO: 488814 - RNA, 19 nt, Homo sapiens
ccugugcgauuacaagaag

SEQ ID NO: 488815 - RNA, 19 nt, Homo sapiens
aaguacaggccaagaauug

SEQ ID NO: 488816 - RNA, 19 nt, Homo sapiens
uccgcgaacaggaauauua

SEQ ID NO: 488817 - RNA, 19 nt, Homo sapiens
uaagaagcggguccguauu

SEQ ID NO: 488818 - RNA, 19 nt, Homo sapiens
aaaguacaggccaagaauu

SEQ ID NO: 488819 - RNA, 19 nt, Homo sapiens
ccauguggcagaaggcaaa

SEQ ID NO: 488820 - RNA, 19 nt, Homo sapiens
gaacagaacucuaacaaca

SEQ ID NO: 488821 - RNA, 19 nt, Homo sapiens
gcaaagcacuuauggaaug

SEQ ID NO: 488822 - RNA, 19 nt, Homo sapiens
ggacugaugucaaggcaua

SEQ ID NO: 488823 - RNA, 19 nt, Homo sapiens
gaacuugguuguagagcua

SEQ ID NO: 488824 - RNA, 19 nt, Homo sapiens
uaagaaggcugaauaacaa

SEQ ID NO: 488825 - RNA, 19 nt, Homo sapiens
ggaagcagcucaucacugu

SEQ ID NO: 488826 - RNA, 19 nt, Homo sapiens
ccucagaacuugcaacuuu

SEQ ID NO: 488827 - RNA, 19 nt, Homo sapiens
ggacggaacugaagagauc

SEQ ID NO: 488828 - RNA, 19 nt, Homo sapiens
caagggaacuguuuggaaa

SEQ ID NO: 488829 - RNA, 19 nt, Homo sapiens
gagauugguugcuuucuaa

SEQ ID NO: 488830 - RNA, 19 nt, Homo sapiens
gauauaggacucccaaaua

SEQ ID NO: 488831 - RNA, 19 nt, Homo sapiens
ccagggaaauggauauaua

SEQ ID NO: 488832 - RNA, 19 nt, Homo sapiens
gcacaaagccaccucuuga

SEQ ID NO: 488833 - RNA, 19 nt, Homo sapiens
caaccuuucuaccuuaaua

SEQ ID NO: 488834 - RNA, 19 nt, Homo sapiens
ugaagcaguucucuuuaua

SEQ ID NO: 488835 - RNA, 19 nt, Homo sapiens
ggacaucgcugagaucaca

SEQ ID NO: 488836 - RNA, 19 nt, Homo sapiens
ggaggaaacuucugauucu

SEQ ID NO: 488837 - RNA, 19 nt, Homo sapiens
ggagauugguugcuuucua

SEQ ID NO: 488838 - RNA, 19 nt, Homo sapiens
gaagccagaugaugaugaa

SEQ ID NO: 488839 - RNA, 19 nt, Homo sapiens
gagaagcucugcaagaauc

SEQ ID NO: 488840 - RNA, 19 nt, Homo sapiens
gauaguuuguggauucuaa

SEQ ID NO: 488841 - RNA, 19 nt, Homo sapiens
gaauggaaccuuugacuau

SEQ ID NO: 488842 - RNA, 19 nt, Homo sapiens
gaccagauaugcaguuaga

SEQ ID NO: 488843 - RNA, 19 nt, Homo sapiens
gaaucaaccuuucuaccuu

SEQ ID NO: 488844 - RNA, 19 nt, Homo sapiens
gcaaaaccaugucuauuaa

SEQ ID NO: 488845 - RNA, 19 nt, Homo sapiens
gaugguggauucucacuga

SEQ ID NO: 488846 - RNA, 19 nt, Homo sapiens
ggaauacacugagcagaga

SEQ ID NO: 488847 - RNA, 19 nt, Homo sapiens
gaagucauuucacaucgaa

SEQ ID NO: 488848 - RNA, 19 nt, Homo sapiens
ggaaagaagucacauuagc

SEQ ID NO: 488849 - RNA, 19 nt, Homo sapiens
ccaaagagguacugguguu

SEQ ID NO: 488850 - RNA, 19 nt, Homo sapiens
gaacuugcaacuuuaauuc

SEQ ID NO: 488851 - RNA, 19 nt, Homo sapiens
gagagaauauggagagaca

SEQ ID NO: 488852 - RNA, 19 nt, Homo sapiens
gcacaggauuggugacuca

SEQ ID NO: 488853 - RNA, 19 nt, Homo sapiens
gaacugaagagaucgaaug

SEQ ID NO: 488854 - RNA, 19 nt, Homo sapiens
gauuggcacuguugaagaa

SEQ ID NO: 488855 - RNA, 19 nt, Homo sapiens
ggagaaguauggguccuuu

SEQ ID NO: 488856 - RNA, 19 nt, Homo sapiens
gaaacuaacugcauuuacc

SEQ ID NO: 488857 - RNA, 19 nt, Homo sapiens
ggagauggaugaggacuuc

SEQ ID NO: 488858 - RNA, 19 nt, Homo sapiens
ccaaggaccagacaaauga

SEQ ID NO: 488859 - RNA, 19 nt, Homo sapiens
auauaggacucccaaauaa

SEQ ID NO: 488860 - RNA, 19 nt, Homo sapiens
gaagcaguucucuuuauaa

SEQ ID NO: 488861 - RNA, 19 nt, Homo sapiens
guagugaaguuuacguaug

SEQ ID NO: 488862 - RNA, 19 nt, Homo sapiens
gggacaggcugcccuuuga

SEQ ID NO: 488863 - RNA, 19 nt, Homo sapiens
gggaugaaccgaaggaauu

SEQ ID NO: 488864 - RNA, 19 nt, Homo sapiens
acagugggauggagaagua

SEQ ID NO: 488865 - RNA, 19 nt, Homo sapiens
aaagcaaacucgauccaaa

SEQ ID NO: 488866 - RNA, 19 nt, Homo sapiens
cgaacaagaucaaggaaca

SEQ ID NO: 488867 - RNA, 19 nt, Homo sapiens
caacaaggcccucaucuac

SEQ ID NO: 488868 - RNA, 19 nt, Homo sapiens
gaacacaaugagacgauuu

SEQ ID NO: 488869 - RNA, 19 nt, Homo sapiens
caaagcggaugaaaguaga

SEQ ID NO: 488870 - RNA, 19 nt, Homo sapiens
cagcguggauuauaauaug

SEQ ID NO: 488871 - RNA, 19 nt, Homo sapiens
ccgaaagaauugcaaggua

SEQ ID NO: 488872 - RNA, 19 nt, Homo sapiens
guccaaagccgaaagaauu

SEQ ID NO: 488873 - RNA, 19 nt, Homo sapiens
uccuaaaguugcagaauua

SEQ ID NO: 488874 - RNA, 19 nt, Homo sapiens
gaugaugguuuggaacauu

SEQ ID NO: 488875 - RNA, 19 nt, Homo sapiens
aaucaaccuuucuaccuua

SEQ ID NO: 488876 - RNA, 19 nt, Homo sapiens
ggagaaugcaauccgcuua

SEQ ID NO: 488877 - RNA, 19 nt, Homo sapiens
ggaauggaaccuuugacua

SEQ ID NO: 488878 - RNA, 19 nt, Homo sapiens
gcgaaggccucagaacuug

SEQ ID NO: 488879 - RNA, 19 nt, Homo sapiens
ugacggaacagaacucuaa

SEQ ID NO: 488880 - RNA, 19 nt, Homo sapiens
aaagaaagauuggcacugu

SEQ ID NO: 488881 - RNA, 19 nt, Homo sapiens
gagaggacaucgcugagau

SEQ ID NO: 488882 - RNA, 19 nt, Homo sapiens
ggaagggaauuugcuggaa

SEQ ID NO: 488883 - RNA, 19 nt, Homo sapiens
cugaagagaucgaaugaga

SEQ ID NO: 488884 - RNA, 19 nt, Homo sapiens
gaaagaagucacauuagca

SEQ ID NO: 488885 - RNA, 19 nt, Homo sapiens
gguggagaauguuaugaaa

SEQ ID NO: 488886 - RNA, 19 nt, Homo sapiens
gcagcaaagucacaauaca

SEQ ID NO: 488887 - RNA, 19 nt, Homo sapiens
gaacgucggccguggcuau

SEQ ID NO: 488888 - RNA, 19 nt, Homo sapiens
gaagcagccauaauagaaa

SEQ ID NO: 488889 - RNA, 19 nt, Homo sapiens
gaugaggacuucgauguca

SEQ ID NO: 488890 - RNA, 19 nt, Homo sapiens
gaagagaucgaaugagaag

SEQ ID NO: 488891 - RNA, 19 nt, Homo sapiens
gaagaugaacucuaugaag

SEQ ID NO: 488892 - RNA, 19 nt, Homo sapiens
acaagaggcugaugcuguu

SEQ ID NO: 488893 - RNA, 19 nt, Homo sapiens
gccauaaggaaucuaaaua

SEQ ID NO: 488894 - RNA, 19 nt, Homo sapiens
ccaguagccucagccauuu

SEQ ID NO: 488895 - RNA, 19 nt, Homo sapiens
gaguauuuaucccgcuaua

SEQ ID NO: 488896 - RNA, 19 nt, Homo sapiens
ggcgacagcuggcagagaa

SEQ ID NO: 488897 - RNA, 19 nt, Homo sapiens
ggaaacuucugauucuucu

SEQ ID NO: 488898 - RNA, 19 nt, Homo sapiens
gagaaucuaugcgaaucaa

SEQ ID NO: 488899 - RNA, 19 nt, Homo sapiens
ccaccaauauguaucuuca

SEQ ID NO: 488900 - RNA, 19 nt, Homo sapiens
cugaugcuguugcagauua

SEQ ID NO: 488901 - RNA, 19 nt, Homo sapiens
gagcacaagcgggcaguua

SEQ ID NO: 488902 - RNA, 19 nt, Homo sapiens
gaauauggagagacagaaa

SEQ ID NO: 488903 - RNA, 19 nt, Homo sapiens
ggucaucgcagccacauug

SEQ ID NO: 488904 - RNA, 19 nt, Homo sapiens
gcugagauaugaugauuuu

SEQ ID NO: 488905 - RNA, 19 nt, Homo sapiens
gaacauagaaaaccaaaga

SEQ ID NO: 488906 - RNA, 19 nt, Homo sapiens
gcaaagagaagugcgucua

SEQ ID NO: 488907 - RNA, 19 nt, Homo sapiens
ugaagcagccauaauagaa

SEQ ID NO: 488908 - RNA, 19 nt, Homo sapiens
gaggaagauuggagaaaca

SEQ ID NO: 488909 - RNA, 19 nt, Homo sapiens
gaauccaugugcgauguuu

SEQ ID NO: 488910 - RNA, 19 nt, Homo sapiens
gagacuuacugaacacaau

SEQ ID NO: 488911 - RNA, 19 nt, Homo sapiens
ugggaaagaagucacauua

SEQ ID NO: 488912 - RNA, 19 nt, Homo sapiens
caucgaagccaugauuuaa

SEQ ID NO: 488913 - RNA, 19 nt, Homo sapiens
ggacuucgaugucauuuuc

SEQ ID NO: 488914 - RNA, 19 nt, Homo sapiens
gaaguccuguggagaugga

SEQ ID NO: 488915 - RNA, 19 nt, Homo sapiens
gaaagucgagagagccaaa

SEQ ID NO: 488916 - RNA, 19 nt, Homo sapiens
ggagacagccauaaggaau

SEQ ID NO: 488917 - RNA, 19 nt, Homo sapiens
agauagcacugccuucuug

SEQ ID NO: 488918 - RNA, 19 nt, Homo sapiens
ugagaacugugacaucaau

SEQ ID NO: 488919 - RNA, 19 nt, Homo sapiens
uaugagaacugugacauca

SEQ ID NO: 488920 - RNA, 19 nt, Homo sapiens
gaacagaacucuaacaaca

SEQ ID NO: 488921 - RNA, 19 nt, Homo sapiens
gaagaucccucuagaaaug

SEQ ID NO: 488922 - RNA, 19 nt, Homo sapiens
gaacgaggauuauacagaa

SEQ ID NO: 488923 - RNA, 19 nt, Homo sapiens
gcaaagcacuuauggaaug

SEQ ID NO: 488924 - RNA, 19 nt, Homo sapiens
ggacugaugucaaggcaua

SEQ ID NO: 488925 - RNA, 19 nt, Homo sapiens
ggaaagagacuccaagaaa

SEQ ID NO: 488926 - RNA, 19 nt, Homo sapiens
gaacuugguuguagagcua

SEQ ID NO: 488927 - RNA, 19 nt, Homo sapiens
uaagaaggcugaauaacaa

SEQ ID NO: 488928 - RNA, 19 nt, Homo sapiens
ggaagcagcucaucacugu

SEQ ID NO: 488929 - RNA, 19 nt, Homo sapiens
gaaaugaggacuuugguaa

SEQ ID NO: 488930 - RNA, 19 nt, Homo sapiens
ccucagaacuugcaacuuu

SEQ ID NO: 488931 - RNA, 19 nt, Homo sapiens
ggacggaacugaagagauc

SEQ ID NO: 488932 - RNA, 19 nt, Homo sapiens
ggacacaccuucacuuauc

SEQ ID NO: 488933 - RNA, 19 nt, Homo sapiens
caagggaacuguuuggaaa

SEQ ID NO: 488934 - RNA, 19 nt, Homo sapiens
gauauaggacucccaaaua

SEQ ID NO: 488935 - RNA, 19 nt, Homo sapiens
ccagggaaauggauauaua

SEQ ID NO: 488936 - RNA, 19 nt, Homo sapiens
gcacaaagccaccucuuga

SEQ ID NO: 488937 - RNA, 19 nt, Homo sapiens
caaccuuucuaccuuaaua

SEQ ID NO: 488938 - RNA, 19 nt, Homo sapiens
ugaagcaguucucuuuaua

SEQ ID NO: 488939 - RNA, 19 nt, Homo sapiens
ggacaucgcugagaucaca

SEQ ID NO: 488940 - RNA, 19 nt, Homo sapiens
gaagccagaugaugaugaa

SEQ ID NO: 488941 - RNA, 19 nt, Homo sapiens
gagaagcucugcaagaauc

SEQ ID NO: 488942 - RNA, 19 nt, Homo sapiens
gaaagagacuccaagaaaa

SEQ ID NO: 488943 - RNA, 19 nt, Homo sapiens
gauaguuuguggauucuaa

SEQ ID NO: 488944 - RNA, 19 nt, Homo sapiens
gaauggaaccuuugacuau

SEQ ID NO: 488945 - RNA, 19 nt, Homo sapiens
gaccagauaugcaguuaga

SEQ ID NO: 488946 - RNA, 19 nt, Homo sapiens
gaaucaaccuuucuaccuu

SEQ ID NO: 488947 - RNA, 19 nt, Homo sapiens
gcaaaaccaugucuauuaa

SEQ ID NO: 488948 - RNA, 19 nt, Homo sapiens
ggaauacacugagcagaga

SEQ ID NO: 488949 - RNA, 19 nt, Homo sapiens
ggaaggagaaggagaagaa

SEQ ID NO: 488950 - RNA, 19 nt, Homo sapiens
ggaaagaagucacauuagc

SEQ ID NO: 488951 - RNA, 19 nt, Homo sapiens
ccaaagagguacugguguu

SEQ ID NO: 488952 - RNA, 19 nt, Homo sapiens
gaacuugcaacuuuaauuc

SEQ ID NO: 488953 - RNA, 19 nt, Homo sapiens
gagagaauauggagagaca

SEQ ID NO: 488954 - RNA, 19 nt, Homo sapiens
gaacgaaaggaaucggaua

SEQ ID NO: 488955 - RNA, 19 nt, Homo sapiens
cagaagaucccucuagaaa

SEQ ID NO: 488956 - RNA, 19 nt, Homo sapiens
gcacaggauuggugacuca

SEQ ID NO: 488957 - RNA, 19 nt, Homo sapiens
gaacugaagagaucgaaug

SEQ ID NO: 488958 - RNA, 19 nt, Homo sapiens
gauuggcacuguugaagaa

SEQ ID NO: 488959 - RNA, 19 nt, Homo sapiens
ggagaaguauggguccuuu

SEQ ID NO: 488960 - RNA, 19 nt, Homo sapiens
gaacccaaccuauaacuuc

SEQ ID NO: 488961 - RNA, 19 nt, Homo sapiens
gaaaguaguauucauugga

SEQ ID NO: 488962 - RNA, 19 nt, Homo sapiens
gaaacuaacugcauuuacc

SEQ ID NO: 488963 - RNA, 19 nt, Homo sapiens
ggagauggaugaggacuuc

SEQ ID NO: 488964 - RNA, 19 nt, Homo sapiens
ccaaggaccagacaaauga

SEQ ID NO: 488965 - RNA, 19 nt, Homo sapiens
gaaggugacggaagggaua

SEQ ID NO: 488966 - RNA, 19 nt, Homo sapiens
auauaggacucccaaauaa

SEQ ID NO: 488967 - RNA, 19 nt, Homo sapiens
gaagcaguucucuuuauaa

SEQ ID NO: 488968 - RNA, 19 nt, Homo sapiens
guagugaaguuuacguaug

SEQ ID NO: 488969 - RNA, 19 nt, Homo sapiens
gggacaggcugcccuuuga

SEQ ID NO: 488970 - RNA, 19 nt, Homo sapiens
gggaugaaccgaaggaauu

SEQ ID NO: 488971 - RNA, 19 nt, Homo sapiens
acagugggauggagaagua

SEQ ID NO: 488972 - RNA, 19 nt, Homo sapiens
aaagcaaacucgauccaaa

SEQ ID NO: 488973 - RNA, 19 nt, Homo sapiens
cgaacaagaucaaggaaca

SEQ ID NO: 488974 - RNA, 19 nt, Homo sapiens
caacaaggcccucaucuac

SEQ ID NO: 488975 - RNA, 19 nt, Homo sapiens
gaacacaaugagacgauuu

SEQ ID NO: 488976 - RNA, 19 nt, Homo sapiens
gauguagccuuuaccuguu

SEQ ID NO: 488977 - RNA, 19 nt, Homo sapiens
caaagcggaugaaaguaga

SEQ ID NO: 488978 - RNA, 19 nt, Homo sapiens
cagcguggauuauaauaug

SEQ ID NO: 488979 - RNA, 19 nt, Homo sapiens
ccgaaagaauugcaaggua

SEQ ID NO: 488980 - RNA, 19 nt, Homo sapiens
guccaaagccgaaagaauu

SEQ ID NO: 488981 - RNA, 19 nt, Homo sapiens
uccuaaaguugcagaauua

SEQ ID NO: 488982 - RNA, 19 nt, Homo sapiens
gaugaugguuuggaacauu

SEQ ID NO: 488983 - RNA, 19 nt, Homo sapiens
aaucaaccuuucuaccuua

SEQ ID NO: 488984 - RNA, 19 nt, Homo sapiens
ggagaaugcaauccgcuua

SEQ ID NO: 488985 - RNA, 19 nt, Homo sapiens
ggaauggaaccuuugacua

SEQ ID NO: 488986 - RNA, 19 nt, Homo sapiens
gcgaaggccucagaacuug

SEQ ID NO: 488987 - RNA, 19 nt, Homo sapiens
ugacggaacagaacucuaa

SEQ ID NO: 488988 - RNA, 19 nt, Homo sapiens
aaagaaagauuggcacugu

SEQ ID NO: 488989 - RNA, 19 nt, Homo sapiens
gagaggacaucgcugagau

SEQ ID NO: 488990 - RNA, 19 nt, Homo sapiens
ggaagggaauuugcuggaa

SEQ ID NO: 488991 - RNA, 19 nt, Homo sapiens
cugaagagaucgaaugaga

SEQ ID NO: 488992 - RNA, 19 nt, Homo sapiens
gaaagaagucacauuagca

SEQ ID NO: 488993 - RNA, 19 nt, Homo sapiens
gguggagaauguuaugaaa

SEQ ID NO: 488994 - RNA, 19 nt, Homo sapiens
gcagcaaagucacaauaca

SEQ ID NO: 488995 - RNA, 19 nt, Homo sapiens
gaacgucggccguggcuau

SEQ ID NO: 488996 - RNA, 19 nt, Homo sapiens
gaagcagccauaauagaaa

SEQ ID NO: 488997 - RNA, 19 nt, Homo sapiens
gaugaggacuucgauguca

SEQ ID NO: 488998 - RNA, 19 nt, Homo sapiens
gaagagaucgaaugagaag

SEQ ID NO: 488999 - RNA, 19 nt, Homo sapiens
gaagaugaacucuaugaag

SEQ ID NO: 489000 - RNA, 19 nt, Homo sapiens
acaagaggcugaugcuguu

SEQ ID NO: 489001 - RNA, 19 nt, Homo sapiens
gccauaaggaaucuaaaua

SEQ ID NO: 489002 - RNA, 19 nt, Homo sapiens
ggaacgaggauuauacaga

SEQ ID NO: 489003 - RNA, 19 nt, Homo sapiens
ccaguagccucagccauuu

SEQ ID NO: 489004 - RNA, 19 nt, Homo sapiens
ggagagagggucccggaaa

SEQ ID NO: 489005 - RNA, 19 nt, Homo sapiens
gaguauuuaucccgcuaua

SEQ ID NO: 489006 - RNA, 19 nt, Homo sapiens
ggcgacagcuggcagagaa

SEQ ID NO: 489007 - RNA, 19 nt, Homo sapiens
gguauaacguguuuuguuu

SEQ ID NO: 489008 - RNA, 19 nt, Homo sapiens
gagaaucuaugcgaaucaa

SEQ ID NO: 489009 - RNA, 19 nt, Homo sapiens
ccaccaauauguaucuuca

SEQ ID NO: 489010 - RNA, 19 nt, Homo sapiens
gaaguguccucagguuuca

SEQ ID NO: 489011 - RNA, 19 nt, Homo sapiens
cugaugcuguugcagauua

SEQ ID NO: 489012 - RNA, 19 nt, Homo sapiens
gagcacaagcgggcaguua

SEQ ID NO: 489013 - RNA, 19 nt, Homo sapiens
gaauauggagagacagaaa

SEQ ID NO: 489014 - RNA, 19 nt, Homo sapiens
gaacauagaaaaccaaaga

SEQ ID NO: 489015 - RNA, 19 nt, Homo sapiens
gcaaagagaagugcgucua

SEQ ID NO: 489016 - RNA, 19 nt, Homo sapiens
ugaagcagccauaauagaa

SEQ ID NO: 489017 - RNA, 19 nt, Homo sapiens
gaggaagauuggagaaaca

SEQ ID NO: 489018 - RNA, 19 nt, Homo sapiens
gaauccaugugcgauguuu

SEQ ID NO: 489019 - RNA, 19 nt, Homo sapiens
gaaaaugcaucugagugua

SEQ ID NO: 489020 - RNA, 19 nt, Homo sapiens
gaacagacccucacucucu

SEQ ID NO: 489021 - RNA, 19 nt, Homo sapiens
gcaggagcaucacaauuug

SEQ ID NO: 489022 - RNA, 19 nt, Homo sapiens
ggcaggagcaucacaauuu

SEQ ID NO: 489023 - RNA, 19 nt, Homo sapiens
uaacaugaccaguaacaga

SEQ ID NO: 489024 - RNA, 19 nt, Homo sapiens
gaggaaguauugguggaaa

SEQ ID NO: 489025 - RNA, 19 nt, Homo sapiens
ggaggugguggacaucaua

SEQ ID NO: 489026 - RNA, 19 nt, Homo sapiens
uaacagacgacuacagcaa

SEQ ID NO: 489027 - RNA, 19 nt, Homo sapiens
cuccuaacaugaccaguaa

SEQ ID NO: 489028 - RNA, 19 nt, Homo sapiens
ggagccaucugugccauca

SEQ ID NO: 489029 - RNA, 19 nt, Homo sapiens
caucaucgugguaguuauu

SEQ ID NO: 489030 - RNA, 19 nt, Homo sapiens
gccaucaucgugguaguua

SEQ ID NO: 489031 - RNA, 19 nt, Homo sapiens
gcaaacccaggcacaagug

SEQ ID NO: 489032 - RNA, 19 nt, Homo sapiens
cgugguaguuauuguaauc

SEQ ID NO: 489033 - RNA, 19 nt, Homo sapiens
caucgugguaguuauugua

SEQ ID NO: 489034 - RNA, 19 nt, Homo sapiens
guggacaucauacguguga

SEQ ID NO: 489035 - RNA, 19 nt, Homo sapiens
ccuccuaacaugaccagua

SEQ ID NO: 489036 - RNA, 19 nt, Homo sapiens
gcaggcaggagcaucacaa

SEQ ID NO: 489037 - RNA, 19 nt, Homo sapiens
uggaggaggugguggacau

SEQ ID NO: 489038 - RNA, 19 nt, Homo sapiens
ggacaucauacgugugaac

SEQ ID NO: 489039 - RNA, 19 nt, Homo sapiens
cuaaagaggaaguauuggu

SEQ ID NO: 489040 - RNA, 19 nt, Homo sapiens
aagcuaaagaggaaguauu

SEQ ID NO: 489041 - RNA, 19 nt, Homo sapiens
gaccaguaacagacgacua

SEQ ID NO: 489042 - RNA, 19 nt, Homo sapiens
gugugaacguggacaaggu

SEQ ID NO: 489043 - RNA, 19 nt, Homo sapiens
gaacagacccucacucucu

SEQ ID NO: 489044 - RNA, 19 nt, Homo sapiens
ggucaccgcuggagaagaa

SEQ ID NO: 489045 - RNA, 19 nt, Homo sapiens
gcaggagcaucacaauuug

SEQ ID NO: 489046 - RNA, 19 nt, Homo sapiens
gguauuagcccuucuacuu

SEQ ID NO: 489047 - RNA, 19 nt, Homo sapiens
gagcgaauccguccucuug

SEQ ID NO: 489048 - RNA, 19 nt, Homo sapiens
ggcaggagcaucacaauuu

SEQ ID NO: 489049 - RNA, 19 nt, Homo sapiens
gagcaaaugugcaacaaaa

SEQ ID NO: 489050 - RNA, 19 nt, Homo sapiens
guaguuggccuuguucuuu

SEQ ID NO: 489051 - RNA, 19 nt, Homo sapiens
cugaagagcuggaagaaag

SEQ ID NO: 489052 - RNA, 19 nt, Homo sapiens
uaacaugaccaguaacaga

SEQ ID NO: 489053 - RNA, 19 nt, Homo sapiens
guauuagcccuucuacuuu

SEQ ID NO: 489054 - RNA, 19 nt, Homo sapiens
ggacugaagagcuggaaga

SEQ ID NO: 489055 - RNA, 19 nt, Homo sapiens
gaggaaguauugguggaaa

SEQ ID NO: 489056 - RNA, 19 nt, Homo sapiens
ggaggugguggacaucaua

SEQ ID NO: 489057 - RNA, 19 nt, Homo sapiens
ggagaagaaccaccacugu

SEQ ID NO: 489058 - RNA, 19 nt, Homo sapiens
uaacagacgacuacagcaa

SEQ ID NO: 489059 - RNA, 19 nt, Homo sapiens
cuccuaacaugaccaguaa

SEQ ID NO: 489060 - RNA, 19 nt, Homo sapiens
ggagccaucugugccauca

SEQ ID NO: 489061 - RNA, 19 nt, Homo sapiens
ggaagaaagcagucaguac

SEQ ID NO: 489062 - RNA, 19 nt, Homo sapiens
uauuagcccuucuacuuuc

SEQ ID NO: 489063 - RNA, 19 nt, Homo sapiens
ccucgaaggucuccacucu

SEQ ID NO: 489064 - RNA, 19 nt, Homo sapiens
caucaucgugguaguuauu

SEQ ID NO: 489065 - RNA, 19 nt, Homo sapiens
ccaccacuguccucgaugu

SEQ ID NO: 489066 - RNA, 19 nt, Homo sapiens
gccaucaucgugguaguua

SEQ ID NO: 489067 - RNA, 19 nt, Homo sapiens
gcaaacccaggcacaagug

SEQ ID NO: 489068 - RNA, 19 nt, Homo sapiens
ccuguacccucuucugugu

SEQ ID NO: 489069 - RNA, 19 nt, Homo sapiens
uaguuggccuuguucuuug

SEQ ID NO: 489070 - RNA, 19 nt, Homo sapiens
caucgugguaguuauugua

SEQ ID NO: 489071 - RNA, 19 nt, Homo sapiens
gcaguuccguccacuucag

SEQ ID NO: 489072 - RNA, 19 nt, Homo sapiens
guggacaucauacguguga

SEQ ID NO: 489073 - RNA, 19 nt, Homo sapiens
ccuccuaacaugaccagua

SEQ ID NO: 489074 - RNA, 19 nt, Homo sapiens
aggcggagcuuggcaguuc

SEQ ID NO: 489075 - RNA, 19 nt, Homo sapiens
gcaggcaggagcaucacaa

SEQ ID NO: 489076 - RNA, 19 nt, Homo sapiens
uagcccuucuacuuucuuu

SEQ ID NO: 489077 - RNA, 19 nt, Homo sapiens
uggaggaggugguggacau

SEQ ID NO: 489078 - RNA, 19 nt, Homo sapiens
ggacaucauacgugugaac

SEQ ID NO: 489079 - RNA, 19 nt, Homo sapiens
ucccaagccuggagcgaau

SEQ ID NO: 489080 - RNA, 19 nt, Homo sapiens
caacaaaacccugggacuu

SEQ ID NO: 489081 - RNA, 19 nt, Homo sapiens
cgugguaguuauuguaagg

SEQ ID NO: 489082 - RNA, 19 nt, Homo sapiens
cuaaagaggaaguauuggu

SEQ ID NO: 489083 - RNA, 19 nt, Homo sapiens
aagcuaaagaggaaguauu

SEQ ID NO: 489084 - RNA, 19 nt, Homo sapiens
gaccaguaacagacgacua

SEQ ID NO: 489085 - RNA, 19 nt, Homo sapiens
uggaagaaagcagucagua

SEQ ID NO: 489086 - RNA, 19 nt, Homo sapiens
gugugaacguggacaaggu

SEQ ID NO: 489087 - RNA, 19 nt, Homo sapiens
gaagagcuggaagaaagca

SEQ ID NO: 489088 - RNA, 19 nt, Homo sapiens
ggaagggucuauugucuuu

SEQ ID NO: 489089 - RNA, 19 nt, Homo sapiens
guaaauagccagcuguuau

SEQ ID NO: 489090 - RNA, 19 nt, Homo sapiens
gaaguucaguauguuauga

SEQ ID NO: 489091 - RNA, 19 nt, Homo sapiens
gcaauagucccucuccuuu

SEQ ID NO: 489092 - RNA, 19 nt, Homo sapiens
uaucuaagcugugguguga

SEQ ID NO: 489093 - RNA, 19 nt, Homo sapiens
cuccaaaccucaccaguaa

SEQ ID NO: 489094 - RNA, 19 nt, Homo sapiens
gaggaagggucuauugucu

SEQ ID NO: 489095 - RNA, 19 nt, Homo sapiens
guaugggacuugcuggaaa

SEQ ID NO: 489096 - RNA, 19 nt, Homo sapiens
ccaagucccuucauuugca

SEQ ID NO: 489097 - RNA, 19 nt, Homo sapiens
gcguccagcauguuaauua

SEQ ID NO: 489098 - RNA, 19 nt, Homo sapiens
ucuaagcuguggugugaaa

SEQ ID NO: 489099 - RNA, 19 nt, Homo sapiens
gagcagggauaucuaagcu

SEQ ID NO: 489100 - RNA, 19 nt, Homo sapiens
ggccacaauugaucucuug

SEQ ID NO: 489101 - RNA, 19 nt, Homo sapiens
cccauuaguucuuguauca

SEQ ID NO: 489102 - RNA, 19 nt, Homo sapiens
guauguaagugucuugaag

SEQ ID NO: 489103 - RNA, 19 nt, Homo sapiens
caucuucuuuguauccauu

SEQ ID NO: 489104 - RNA, 19 nt, Homo sapiens
uuagguacaucuucuuugu

SEQ ID NO: 489105 - RNA, 19 nt, Homo sapiens
auagccagcuguuauuuau

SEQ ID NO: 489106 - RNA, 19 nt, Homo sapiens
uaugauggaccaauaauuc

SEQ ID NO: 489107 - RNA, 19 nt, Homo sapiens
cauguuaauuagcguauca

SEQ ID NO: 489108 - RNA, 19 nt, Homo sapiens
gggagcguccagcauguua

SEQ ID NO: 489109 - RNA, 19 nt, Homo sapiens
uaguuuacuucagcucuua

SEQ ID NO: 489110 - RNA, 19 nt, Homo sapiens
guccaggcuuccuuaggua

SEQ ID NO: 489111 - RNA, 19 nt, Homo sapiens
gcgcaaauacugguggaaa

SEQ ID NO: 489112 - RNA, 19 nt, Homo sapiens
ccuccaaaccucaccagua

SEQ ID NO: 489113 - RNA, 19 nt, Homo sapiens
cauuaguucuuguaucaca

SEQ ID NO: 489114 - RNA, 19 nt, Homo sapiens
cucauugggugaacugauu

SEQ ID NO: 489115 - RNA, 19 nt, Homo sapiens
ccaaaccucaccaguaaca

SEQ ID NO: 489116 - RNA, 19 nt, Homo sapiens
gccaucauccucaucauca

SEQ ID NO: 489117 - RNA, 19 nt, Homo sapiens
uggccuuccuuuccucuuu

SEQ ID NO: 489118 - RNA, 19 nt, Homo sapiens
gcgcauccagauugugaaa

SEQ ID NO: 489119 - RNA, 19 nt, Homo sapiens
cccaauuccugccugaaau

SEQ ID NO: 489120 - RNA, 19 nt, Homo sapiens
uuccaucacucuucucuca

SEQ ID NO: 489121 - RNA, 19 nt, Homo sapiens
agucugcccugccuagaga

SEQ ID NO: 489122 - RNA, 19 nt, Homo sapiens
gcauccagauugugaaaau

SEQ ID NO: 489123 - RNA, 19 nt, Homo sapiens
uggaugaggugguggacau

SEQ ID NO: 489124 - RNA, 19 nt, Homo sapiens
ggacuauugagcccagaga

SEQ ID NO: 489125 - RNA, 19 nt, Homo sapiens
acuagucacugccaaugug

SEQ ID NO: 489126 - RNA, 19 nt, Homo sapiens
guacuagucacugccaaug

SEQ ID NO: 489127 - RNA, 19 nt, Homo sapiens
gagcguccagcauguuaau

SEQ ID NO: 489128 - RNA, 19 nt, Homo sapiens
gggugaacguggacaaggu

SEQ ID NO: 489129 - RNA, 19 nt, Homo sapiens
ucggguuucucccuacauu

SEQ ID NO: 489130 - RNA, 19 nt, Homo sapiens
ggagcguccagcauguuaa

SEQ ID NO: 489131 - RNA, 19 nt, Homo sapiens
uguccaggcuuccuuaggu

SEQ ID NO: 489132 - RNA, 19 nt, Homo sapiens
ucacugccaauguguguau

SEQ ID NO: 489133 - RNA, 19 nt, Homo sapiens
cguccagcauguuaauuag

SEQ ID NO: 489134 - RNA, 19 nt, Homo sapiens
caauagucccucuccuuuc

SEQ ID NO: 489135 - RNA, 19 nt, Homo sapiens
uuacuucagcucuuaaauc

SEQ ID NO: 489136 - RNA, 19 nt, Homo sapiens
caucaucauaguuuacuuc

SEQ ID NO: 489137 - RNA, 19 nt, Homo sapiens
agccagcuguuauuuauac

SEQ ID NO: 489138 - RNA, 19 nt, Homo sapiens
gcuaucccuuuccauuucu

SEQ ID NO: 489139 - RNA, 19 nt, Homo sapiens
ugcuaucccuuuccauuuc

SEQ ID NO: 489140 - RNA, 19 nt, Homo sapiens
ggccuuccuuuccucuuuc

SEQ ID NO: 489141 - RNA, 19 nt, Homo sapiens
uauuuggucuguuuguagu

SEQ ID NO: 489142 - RNA, 19 nt, Homo sapiens
uguaaauagccagcuguua

SEQ ID NO: 489143 - RNA, 19 nt, Homo sapiens
uucaguauguuaugaugga

SEQ ID NO: 489144 - RNA, 19 nt, Homo sapiens
cugcuaucccuuuccauuu

SEQ ID NO: 489145 - RNA, 19 nt, Homo sapiens
uacauacugcuaucccuuu

SEQ ID NO: 489146 - RNA, 19 nt, Homo sapiens
cuucuucccucagauuuag

SEQ ID NO: 489147 - RNA, 19 nt, Homo sapiens
caagucccuucauuugcau

SEQ ID NO: 489148 - RNA, 19 nt, Homo sapiens
augaucaucuugggaguga

SEQ ID NO: 489149 - RNA, 19 nt, Homo sapiens
ucucaaccuguguuucuuu

SEQ ID NO: 489150 - RNA, 19 nt, Homo sapiens
ccaucacucuucucucaac

SEQ ID NO: 489151 - RNA, 19 nt, Homo sapiens
ccucuuuccuccucacucu

SEQ ID NO: 489152 - RNA, 19 nt, Homo sapiens
cucaucaucaucauaguuu

SEQ ID NO: 489153 - RNA, 19 nt, Homo sapiens
ccucucagccauaucuuuc

SEQ ID NO: 489154 - RNA, 19 nt, Homo sapiens
gaggugguggacaucauga

SEQ ID NO: 489155 - RNA, 19 nt, Homo sapiens
cauccucaucaucaucaua

SEQ ID NO: 489156 - RNA, 19 nt, Homo sapiens
gguauguaagugucuugaa

SEQ ID NO: 489157 - RNA, 19 nt, Homo sapiens
guucuuguaucacauuuuc

SEQ ID NO: 489158 - RNA, 19 nt, Homo sapiens
ccucaucaucaucauaguu

SEQ ID NO: 489159 - RNA, 19 nt, Homo sapiens
uuuggucuguuuguaguuu

SEQ ID NO: 489160 - RNA, 19 nt, Homo sapiens
ccaccucucagccauaucu

SEQ ID NO: 489161 - RNA, 19 nt, Homo sapiens
ggagaaagauuggaauuau

SEQ ID NO: 489162 - RNA, 19 nt, Homo sapiens
gaaagagaauagacaguau

SEQ ID NO: 489163 - RNA, 19 nt, Homo sapiens
uaaagcacaugucucauuu

SEQ ID NO: 489164 - RNA, 19 nt, Homo sapiens
ccauuuaacugcaguguaa

SEQ ID NO: 489165 - RNA, 19 nt, Homo sapiens
gaaagaagaaguuaccauu

SEQ ID NO: 489166 - RNA, 19 nt, Homo sapiens
gcagucaacuccaggguuu

SEQ ID NO: 489167 - RNA, 19 nt, Homo sapiens
gcuaacaucucaucuuaau

SEQ ID NO: 489168 - RNA, 19 nt, Homo sapiens
gcacaugucucauuuuaaa

SEQ ID NO: 489169 - RNA, 19 nt, Homo sapiens
caagcugugugaagaaaua

SEQ ID NO: 489170 - RNA, 19 nt, Homo sapiens
ccaaguggaugaacugaaa

SEQ ID NO: 489171 - RNA, 19 nt, Homo sapiens
gaaucuagccaccuguuua

SEQ ID NO: 489172 - RNA, 19 nt, Homo sapiens
gaagaaauaggaaagaaga

SEQ ID NO: 489173 - RNA, 19 nt, Homo sapiens
cuuaugagcuaucuacuaa

SEQ ID NO: 489174 - RNA, 19 nt, Homo sapiens
gaauaagggccuagacaaa

SEQ ID NO: 489175 - RNA, 19 nt, Homo sapiens
caugcuaccugauucauuu

SEQ ID NO: 489176 - RNA, 19 nt, Homo sapiens
ugucuuaucuaccaguuua

SEQ ID NO: 489177 - RNA, 19 nt, Homo sapiens
guacucacauggcaauuau

SEQ ID NO: 489178 - RNA, 19 nt, Homo sapiens
aagaagagguuccagacua

SEQ ID NO: 489179 - RNA, 19 nt, Homo sapiens
caugguaccuguucuucua

SEQ ID NO: 489180 - RNA, 19 nt, Homo sapiens
uugagaagaugaagguuua

SEQ ID NO: 489181 - RNA, 19 nt, Homo sapiens
gcuaagauaccuucugaaa

SEQ ID NO: 489182 - RNA, 19 nt, Homo sapiens
ucuuaaaucugccuaguuu

SEQ ID NO: 489183 - RNA, 19 nt, Homo sapiens
gcaaucgugucgcuaauag

SEQ ID NO: 489184 - RNA, 19 nt, Homo sapiens
caacacuaaugccucuuaa

SEQ ID NO: 489185 - RNA, 19 nt, Homo sapiens
gaacaaauuagucuguaga

SEQ ID NO: 489186 - RNA, 19 nt, Homo sapiens
uugcuaacaucucaucuua

SEQ ID NO: 489187 - RNA, 19 nt, Homo sapiens
gcaucaguauuuccuauug

SEQ ID NO: 489188 - RNA, 19 nt, Homo sapiens
uagcauagcacaaacguuu

SEQ ID NO: 489189 - RNA, 19 nt, Homo sapiens
uggcaucuguuaucuagua

SEQ ID NO: 489190 - RNA, 19 nt, Homo sapiens
ucagacaaguaaaguauga

SEQ ID NO: 489191 - RNA, 19 nt, Homo sapiens
gaucuuaggcccacuugaa

SEQ ID NO: 489192 - RNA, 19 nt, Homo sapiens
gagcauucuuugugguuaa

SEQ ID NO: 489193 - RNA, 19 nt, Homo sapiens
caagagacaguauugcuaa

SEQ ID NO: 489194 - RNA, 19 nt, Homo sapiens
aagcaucacucugagaaua

SEQ ID NO: 489195 - RNA, 19 nt, Homo sapiens
uaagagcucagacaaguaa

SEQ ID NO: 489196 - RNA, 19 nt, Homo sapiens
gcacaaacugaagauguua

SEQ ID NO: 489197 - RNA, 19 nt, Homo sapiens
gaacguucccgagccuuua

SEQ ID NO: 489198 - RNA, 19 nt, Homo sapiens
gugcugaucauucacaaua

SEQ ID NO: 489199 - RNA, 19 nt, Homo sapiens
caaauuagucuguagaauc

SEQ ID NO: 489200 - RNA, 19 nt, Homo sapiens
gagaauagacaguaugaca

SEQ ID NO: 489201 - RNA, 19 nt, Homo sapiens
ugaaugagauaaagaagag

SEQ ID NO: 489202 - RNA, 19 nt, Homo sapiens
aaacuaacguacucacaug

SEQ ID NO: 489203 - RNA, 19 nt, Homo sapiens
ccucuuaauugcaucagua

SEQ ID NO: 489204 - RNA, 19 nt, Homo sapiens
gcaguugauuugagaagau

SEQ ID NO: 489205 - RNA, 19 nt, Homo sapiens
ucaacccucuucucacuuu

SEQ ID NO: 489206 - RNA, 19 nt, Homo sapiens
ccaugugacucaagccuuu

SEQ ID NO: 489207 - RNA, 19 nt, Homo sapiens
acacuaaugccucuuaauu

SEQ ID NO: 489208 - RNA, 19 nt, Homo sapiens
gagagaacaaggaguuaaa

SEQ ID NO: 489209 - RNA, 19 nt, Homo sapiens
gcacuuccauaugccauga

SEQ ID NO: 489210 - RNA, 19 nt, Homo sapiens
ugaaagagaauagacagua

SEQ ID NO: 489211 - RNA, 19 nt, Homo sapiens
gacucaagccuuucacaua

SEQ ID NO: 489212 - RNA, 19 nt, Homo sapiens
ccgcuagucuuaugagcua

SEQ ID NO: 489213 - RNA, 19 nt, Homo sapiens
ccacuauccuugccaaaca

SEQ ID NO: 489214 - RNA, 19 nt, Homo sapiens
uaaaugacgcacaaacuga

SEQ ID NO: 489215 - RNA, 19 nt, Homo sapiens
gcucagacaaguaaaguau

SEQ ID NO: 489216 - RNA, 19 nt, Homo sapiens
caucucaucuuaaugucuu

SEQ ID NO: 489217 - RNA, 19 nt, Homo sapiens
gugaagaaauaggaaagaa

SEQ ID NO: 489218 - RNA, 19 nt, Homo sapiens
agacagcacuuccauaugc

SEQ ID NO: 489219 - RNA, 19 nt, Homo sapiens
ccaaaccuuucaauucaug

SEQ ID NO: 489220 - RNA, 19 nt, Homo sapiens
gguaaauuccucugacuug

SEQ ID NO: 489221 - RNA, 19 nt, Homo sapiens
uacaguggauagcuugaua

SEQ ID NO: 489222 - RNA, 19 nt, Homo sapiens
aaacauagaucugguagcu

SEQ ID NO: 489223 - RNA, 19 nt, Homo sapiens
uggcuaagauaccuucuga

SEQ ID NO: 489224 - RNA, 19 nt, Homo sapiens
cugcacagcugaagcauca

SEQ ID NO: 489225 - RNA, 19 nt, Homo sapiens
gaaaagcccaaaccgaaua

SEQ ID NO: 489226 - RNA, 19 nt, Homo sapiens
acaaagugauggagacuca

SEQ ID NO: 489227 - RNA, 19 nt, Homo sapiens
gaaauaggaaagaagaagu

SEQ ID NO: 489228 - RNA, 19 nt, Homo sapiens
uuagaagcacacagaauua

SEQ ID NO: 489229 - RNA, 19 nt, Homo sapiens
ucuaagagcucagacaagu

SEQ ID NO: 489230 - RNA, 19 nt, Homo sapiens
uggaugaacugaaaggaau

SEQ ID NO: 489231 - RNA, 19 nt, Homo sapiens
cgaguucucaagugucuua

SEQ ID NO: 489232 - RNA, 19 nt, Homo sapiens
gaagccauggcgauucuuu

SEQ ID NO: 489233 - RNA, 19 nt, Homo sapiens
cgaauacggucagcaguca

SEQ ID NO: 489234 - RNA, 19 nt, Homo sapiens
gacaggauuguauaucuuu

SEQ ID NO: 489235 - RNA, 19 nt, Homo sapiens
ccaaggauaugagagaaca

SEQ ID NO: 489236 - RNA, 19 nt, Homo sapiens
gcucgagccauguguauga

SEQ ID NO: 489237 - RNA, 19 nt, Homo sapiens
gccaagacaggauuguaua

SEQ ID NO: 489238 - RNA, 19 nt, Homo sapiens
uauccaaaccuuucaauuc

SEQ ID NO: 489239 - RNA, 19 nt, Homo sapiens
ccucugacuugccaaagaa

SEQ ID NO: 489240 - RNA, 19 nt, Homo sapiens
ucgugucgcuaauagaaua

SEQ ID NO: 489241 - RNA, 19 nt, Homo sapiens
gagacaguauugcuaacau

SEQ ID NO: 489242 - RNA, 19 nt, Homo sapiens
uuccaugccuccagguuua

SEQ ID NO: 489243 - RNA, 19 nt, Homo sapiens
caagcucacuauuaucauc

SEQ ID NO: 489244 - RNA, 19 nt, Homo sapiens
gaggagaaagauuggaauu

SEQ ID NO: 489245 - RNA, 19 nt, Homo sapiens
uaaccaaggauaugagaga

SEQ ID NO: 489246 - RNA, 19 nt, Homo sapiens
ggaaucauggucagaaaca

SEQ ID NO: 489247 - RNA, 19 nt, Homo sapiens
uuaaagcacaugucucauu

SEQ ID NO: 489248 - RNA, 19 nt, Homo sapiens
gcuaccugauucauuuauu

SEQ ID NO: 489249 - RNA, 19 nt, Homo sapiens
gggcuugauuccuguugaa

SEQ ID NO: 489250 - RNA, 19 nt, Homo sapiens
ucacauggcaauuauuugu

SEQ ID NO: 489251 - RNA, 19 nt, Homo sapiens
gccaagcugugugaagaaa

SEQ ID NO: 489252 - RNA, 19 nt, Homo sapiens
ggauuuacauggccaagcu

SEQ ID NO: 489253 - RNA, 19 nt, Homo sapiens
gaaccucaagcucacuauu

SEQ ID NO: 489254 - RNA, 19 nt, Homo sapiens
gagaauaagggccuagaca

SEQ ID NO: 489255 - RNA, 19 nt, Homo sapiens
gaauagcgaguucucaagu

SEQ ID NO: 489256 - RNA, 19 nt, Homo sapiens
aagcacaugucucauuuua

SEQ ID NO: 489257 - RNA, 19 nt, Homo sapiens
uaacugcaguguaagaaaa

SEQ ID NO: 489258 - RNA, 19 nt, Homo sapiens
agacaggauuguauaucuu

SEQ ID NO: 489259 - RNA, 19 nt, Homo sapiens
ugugaaacuugaaagagaa

SEQ ID NO: 489260 - RNA, 19 nt, Homo sapiens
gagaagaugaagguuuaaa

SEQ ID NO: 489261 - RNA, 19 nt, Homo sapiens
ggaaauccaacaccagaaa

SEQ ID NO: 489262 - RNA, 19 nt, Homo sapiens
ccaguuagcagaaucaaga

SEQ ID NO: 489263 - RNA, 19 nt, Homo sapiens
caacaggaacccagcaauc

SEQ ID NO: 489264 - RNA, 19 nt, Homo sapiens
caccagaaauaacaugauc

SEQ ID NO: 489265 - RNA, 19 nt, Homo sapiens
gaacccagcaaucgaccaa

SEQ ID NO: 489266 - RNA, 19 nt, Homo sapiens
gaaauccaacaccagaaau

SEQ ID NO: 489267 - RNA, 19 nt, Homo sapiens
cauaggaggaccuguguga

SEQ ID NO: 489268 - RNA, 19 nt, Homo sapiens
acccagcaaucgaccaaua

SEQ ID NO: 489269 - RNA, 19 nt, Homo sapiens
ucaggagcauggacaggaa

SEQ ID NO: 489270 - RNA, 19 nt, Homo sapiens
aaauccaacaccagaaaua

SEQ ID NO: 489271 - RNA, 19 nt, Homo sapiens
gaaucaagaccuacaccau

SEQ ID NO: 489272 - RNA, 19 nt, Homo sapiens
ucugcucucucacugcaua

SEQ ID NO: 489273 - RNA, 19 nt, Homo sapiens
uaccaaacguggccuaaaa

SEQ ID NO: 489274 - RNA, 19 nt, Homo sapiens
gaagguguagggagugaag

SEQ ID NO: 489275 - RNA, 19 nt, Homo sapiens
caacaccagaaauaacaug

SEQ ID NO: 489276 - RNA, 19 nt, Homo sapiens
uuagcagaaucaagaccua

SEQ ID NO: 489277 - RNA, 19 nt, Homo sapiens
uguagggagugaagucuca

SEQ ID NO: 489278 - RNA, 19 nt, Homo sapiens
aauccaacaccagaaauaa

SEQ ID NO: 489279 - RNA, 19 nt, Homo sapiens
cuuggcaucugcucucuca

SEQ ID NO: 489280 - RNA, 19 nt, Homo sapiens
aucaagaccuacaccauca

SEQ ID NO: 489281 - RNA, 19 nt, Homo sapiens
ccagaaauaacaugaucca

SEQ ID NO: 489282 - RNA, 19 nt, Homo sapiens
uggaagguguagggaguga

SEQ ID NO: 489283 - RNA, 19 nt, Homo sapiens
gaagauugcugaagaauua

SEQ ID NO: 489284 - RNA, 19 nt, Homo sapiens
gcaagcaacugaauguuua

SEQ ID NO: 489285 - RNA, 19 nt, Homo sapiens
gaaaguaaguugcaagaaa

SEQ ID NO: 489286 - RNA, 19 nt, Homo sapiens
gaaaggauguugacacaaa

SEQ ID NO: 489287 - RNA, 19 nt, Homo sapiens
ggaaauaaaugacaaggaa

SEQ ID NO: 489288 - RNA, 19 nt, Homo sapiens
gaacagaacagcaaagauu

SEQ ID NO: 489289 - RNA, 19 nt, Homo sapiens
agaaagagacucagaauua

SEQ ID NO: 489290 - RNA, 19 nt, Homo sapiens
gaaauuggauucuaaagca

SEQ ID NO: 489291 - RNA, 19 nt, Homo sapiens
gaagagaugacuaagcuua

SEQ ID NO: 489292 - RNA, 19 nt, Homo sapiens
aaacacagcuacucuuaaa

SEQ ID NO: 489293 - RNA, 19 nt, Homo sapiens
gaaagaaauugaggacaaa

SEQ ID NO: 489294 - RNA, 19 nt, Homo sapiens
gaacugagacagaaagaaa

SEQ ID NO: 489295 - RNA, 19 nt, Homo sapiens
agaggaagauuuacagaua

SEQ ID NO: 489296 - RNA, 19 nt, Homo sapiens
gagcaugguuucagaagaa

SEQ ID NO: 489297 - RNA, 19 nt, Homo sapiens
gaagcaacuugaaauagaa

SEQ ID NO: 489298 - RNA, 19 nt, Homo sapiens
gaaagagacucagaauuag

SEQ ID NO: 489299 - RNA, 19 nt, Homo sapiens
gaauauacccauugaagaa

SEQ ID NO: 489300 - RNA, 19 nt, Homo sapiens
caacaaauguacugaagau

SEQ ID NO: 489301 - RNA, 19 nt, Homo sapiens
gaaagaaguacaugauuug

SEQ ID NO: 489302 - RNA, 19 nt, Homo sapiens
caagugagcuggaagagau

SEQ ID NO: 489303 - RNA, 19 nt, Homo sapiens
ccacaaggcauuuauguaa

SEQ ID NO: 489304 - RNA, 19 nt, Homo sapiens
caaacuguaucucgaaauu

SEQ ID NO: 489305 - RNA, 19 nt, Homo sapiens
ggaaaccugucauuguauu

SEQ ID NO: 489306 - RNA, 19 nt, Homo sapiens
gaaacccaauuaagaaaug

SEQ ID NO: 489307 - RNA, 19 nt, Homo sapiens
ccaaaucacugagaaagaa

SEQ ID NO: 489308 - RNA, 19 nt, Homo sapiens
gaacugcaauguggaaaug

SEQ ID NO: 489309 - RNA, 19 nt, Homo sapiens
ccuaauaacgugaaacuua

SEQ ID NO: 489310 - RNA, 19 nt, Homo sapiens
caagaauacugaauacuuc

SEQ ID NO: 489311 - RNA, 19 nt, Homo sapiens
ggaagaaucuaauaaagcu

SEQ ID NO: 489312 - RNA, 19 nt, Homo sapiens
gcagguaucacuacuauug

SEQ ID NO: 489313 - RNA, 19 nt, Homo sapiens
gcagaaagcaagcaacuga

SEQ ID NO: 489314 - RNA, 19 nt, Homo sapiens
gcaccaauaugauaagauc

SEQ ID NO: 489315 - RNA, 19 nt, Homo sapiens
gcgaugugauggaauuuaa

SEQ ID NO: 489316 - RNA, 19 nt, Homo sapiens
gaacagaacaagaacuaau

SEQ ID NO: 489317 - RNA, 19 nt, Homo sapiens
gacauuagaagaaggaaua

SEQ ID NO: 489318 - RNA, 19 nt, Homo sapiens
gaaagaaaguaaguugcaa

SEQ ID NO: 489319 - RNA, 19 nt, Homo sapiens
gagaagagcuaaaacagaa

SEQ ID NO: 489320 - RNA, 19 nt, Homo sapiens
gaacagcaaagauuggaaa

SEQ ID NO: 489321 - RNA, 19 nt, Homo sapiens
gauaacagcuuuugaggaa

SEQ ID NO: 489322 - RNA, 19 nt, Homo sapiens
gaaaguaaguacagaagcu

SEQ ID NO: 489323 - RNA, 19 nt, Homo sapiens
gaucuacacugaaguuugg

SEQ ID NO: 489324 - RNA, 19 nt, Homo sapiens
ccaaaggcauauacaguga

SEQ ID NO: 489325 - RNA, 19 nt, Homo sapiens
cuagaggaauccagagaua

SEQ ID NO: 489326 - RNA, 19 nt, Homo sapiens
gagaaucaguguaguuaag

SEQ ID NO: 489327 - RNA, 19 nt, Homo sapiens
agaaagaaauugaggacaa

SEQ ID NO: 489328 - RNA, 19 nt, Homo sapiens
gaaggaauacaagacaaua

SEQ ID NO: 489329 - RNA, 19 nt, Homo sapiens
agaagcaacuugaaauaga

SEQ ID NO: 489330 - RNA, 19 nt, Homo sapiens
gaagaaagagacucagaau

SEQ ID NO: 489331 - RNA, 19 nt, Homo sapiens
gaaacagaaacccaauuaa

SEQ ID NO: 489332 - RNA, 19 nt, Homo sapiens
caagugauaugacccuaga

SEQ ID NO: 489333 - RNA, 19 nt, Homo sapiens
agaaguacaugauuuggaa

SEQ ID NO: 489334 - RNA, 19 nt, Homo sapiens
caaagaaaccugugcuaga

SEQ ID NO: 489335 - RNA, 19 nt, Homo sapiens
uacagaagcugaacugaga

SEQ ID NO: 489336 - RNA, 19 nt, Homo sapiens
ugauucagauccugcuuua

SEQ ID NO: 489337 - RNA, 19 nt, Homo sapiens
gaaacgagaacucaagaau

SEQ ID NO: 489338 - RNA, 19 nt, Homo sapiens
uaaggaggcugaaaagaua

SEQ ID NO: 489339 - RNA, 19 nt, Homo sapiens
cuggaaaccugucauugua

SEQ ID NO: 489340 - RNA, 19 nt, Homo sapiens
aguaauagcugaugaagca

SEQ ID NO: 489341 - RNA, 19 nt, Homo sapiens
agaaacagaaacccaauua

SEQ ID NO: 489342 - RNA, 19 nt, Homo sapiens
caaauguacugaagaugau

SEQ ID NO: 489343 - RNA, 19 nt, Homo sapiens
gaaaacacagcuacucuua

SEQ ID NO: 489344 - RNA, 19 nt, Homo sapiens
aaagaaaccugugcuagau

SEQ ID NO: 489345 - RNA, 19 nt, Homo sapiens
gaagaauuauugagaacag

SEQ ID NO: 489346 - RNA, 19 nt, Homo sapiens
ucacuacuauugauccaaa

SEQ ID NO: 489347 - RNA, 19 nt, Homo sapiens
aaacgagaacucaagaaua

SEQ ID NO: 489348 - RNA, 19 nt, Homo sapiens
gaagaaggaauacaagaca

SEQ ID NO: 489349 - RNA, 19 nt, Homo sapiens
gcaugaaugauuuguguuu

SEQ ID NO: 489350 - RNA, 19 nt, Homo sapiens
uaaagcaguuccuucacaa

SEQ ID NO: 489351 - RNA, 19 nt, Homo sapiens
ggacaagagugaagaaaau

SEQ ID NO: 489352 - RNA, 19 nt, Homo sapiens
gagaaagaaguacaugauu

SEQ ID NO: 489353 - RNA, 19 nt, Homo sapiens
uauugagggucauucuuua

SEQ ID NO: 489354 - RNA, 19 nt, Homo sapiens
gaacuucagcaggagaaua

SEQ ID NO: 489355 - RNA, 19 nt, Homo sapiens
gcucauucguuugugguua

SEQ ID NO: 489356 - RNA, 19 nt, Homo sapiens
gaaacagcaucauuugacu

SEQ ID NO: 489357 - RNA, 19 nt, Homo sapiens
gaauccagagauaaaguua

SEQ ID NO: 489358 - RNA, 19 nt, Homo sapiens
cagagaaucaguguaguua

SEQ ID NO: 489359 - RNA, 19 nt, Homo sapiens
gaggaagauuuacagauag

SEQ ID NO: 489360 - RNA, 19 nt, Homo sapiens
ggaagaaaccaggcaaguu

SEQ ID NO: 489361 - RNA, 19 nt, Homo sapiens
ucaagaguuucaacaaaug

SEQ ID NO: 489362 - RNA, 19 nt, Homo sapiens
guaguuaaggagccuaaua

SEQ ID NO: 489363 - RNA, 19 nt, Homo sapiens
gaucauggcauauccaaag

SEQ ID NO: 489364 - RNA, 19 nt, Homo sapiens
gaaagugccaaacagaaau

SEQ ID NO: 489365 - RNA, 19 nt, Homo sapiens
gaagggaacgggcuuucuu

SEQ ID NO: 489366 - RNA, 19 nt, Homo sapiens
gaaguuuggagcuauaaga

SEQ ID NO: 489367 - RNA, 19 nt, Homo sapiens
gaaagcaagcaacugaaug

SEQ ID NO: 489368 - RNA, 19 nt, Homo sapiens
uagaauaugugagagaaga

SEQ ID NO: 489369 - RNA, 19 nt, Homo sapiens
ugagaagauugcugaagaa

SEQ ID NO: 489370 - RNA, 19 nt, Homo sapiens
gagaaacagcaucauuuga

SEQ ID NO: 489371 - RNA, 19 nt, Homo sapiens
gaaaugguagcacuuaugg

SEQ ID NO: 489372 - RNA, 19 nt, Homo sapiens
ucacagacaccuaucagaa

SEQ ID NO: 489373 - RNA, 19 nt, Homo sapiens
gauguugacacaaauagaa

SEQ ID NO: 489374 - RNA, 19 nt, Homo sapiens
gagacuaucuguggacauc

SEQ ID NO: 489375 - RNA, 19 nt, Homo sapiens
caaagaacaagaacaguca

SEQ ID NO: 489376 - RNA, 19 nt, Homo sapiens
guaaauuggacaagaguga

SEQ ID NO: 489377 - RNA, 19 nt, Homo sapiens
cuucaagaguuucaacaaa

SEQ ID NO: 489378 - RNA, 19 nt, Homo sapiens
acagaaacccaauuaagaa

SEQ ID NO: 489379 - RNA, 19 nt, Homo sapiens
gauaugacccuagaacuca

SEQ ID NO: 489380 - RNA, 19 nt, Homo sapiens
ccaccagcuucucaucuuu

SEQ ID NO: 489381 - RNA, 19 nt, Homo sapiens
gcaacugaauguuuaugag

SEQ ID NO: 489382 - RNA, 19 nt, Homo sapiens
cagcaaagauuggaaaauu

SEQ ID NO: 489383 - RNA, 19 nt, Homo sapiens
ggaauaaucucaagaauca

SEQ ID NO: 489384 - RNA, 19 nt, Homo sapiens
uaaagcagaugguuuguua

SEQ ID NO: 489385 - RNA, 19 nt, Homo sapiens
gaacugggcucugguaauu

SEQ ID NO: 489386 - RNA, 19 nt, Homo sapiens
ggaagaaucugagcaaauu

SEQ ID NO: 489387 - RNA, 19 nt, Homo sapiens
gaacagacaugucaaggau

SEQ ID NO: 489388 - RNA, 19 nt, Homo sapiens
agaaauguguugcuaguua

SEQ ID NO: 489389 - RNA, 19 nt, Homo sapiens
gaaaguggccugucaagug

SEQ ID NO: 489390 - RNA, 19 nt, Homo sapiens
gaucaaagacaaauggaaa

SEQ ID NO: 489391 - RNA, 19 nt, Homo sapiens
ugaagucaccgcuauguua

SEQ ID NO: 489392 - RNA, 19 nt, Homo sapiens
ccaaaucccuuucaugucu

SEQ ID NO: 489393 - RNA, 19 nt, Homo sapiens
gaaaauguauccagaggaa

SEQ ID NO: 489394 - RNA, 19 nt, Homo sapiens
gauguacgaucucaugaau

SEQ ID NO: 489395 - RNA, 19 nt, Homo sapiens
gggaggaggcagaagauua

SEQ ID NO: 489396 - RNA, 19 nt, Homo sapiens
gcagaugguuuguuaagag

SEQ ID NO: 489397 - RNA, 19 nt, Homo sapiens
caagaaauguguugcuagu

SEQ ID NO: 489398 - RNA, 19 nt, Homo sapiens
acagacaugucaaggauaa

SEQ ID NO: 489399 - RNA, 19 nt, Homo sapiens
cuaagcauguagccaguua

SEQ ID NO: 489400 - RNA, 19 nt, Homo sapiens
gcacacagggaaauguuaa

SEQ ID NO: 489401 - RNA, 19 nt, Homo sapiens
gcaagagaguacuguguca

SEQ ID NO: 489402 - RNA, 19 nt, Homo sapiens
aaagacaaauggaaaguuc

SEQ ID NO: 489403 - RNA, 19 nt, Homo sapiens
cggaaugcaucaacuacua

SEQ ID NO: 489404 - RNA, 19 nt, Homo sapiens
ccagaggaauugauuguca

SEQ ID NO: 489405 - RNA, 19 nt, Homo sapiens
gagaagcccuacccaugga

SEQ ID NO: 489406 - RNA, 19 nt, Homo sapiens
gaaauguguugcuaguuac

SEQ ID NO: 489407 - RNA, 19 nt, Homo sapiens
gaacaucauagaacugguu

SEQ ID NO: 489408 - RNA, 19 nt, Homo sapiens
gcauguagccaguuaagga

SEQ ID NO: 489409 - RNA, 19 nt, Homo sapiens
ugagcaaauuguccugaua

SEQ ID NO: 489410 - RNA, 19 nt, Homo sapiens
ggaacaugcccacaacuug

SEQ ID NO: 489411 - RNA, 19 nt, Homo sapiens
gauaagaacaucauagaac

SEQ ID NO: 489412 - RNA, 19 nt, Homo sapiens
caagggaaccggcaagaga

SEQ ID NO: 489413 - RNA, 19 nt, Homo sapiens
ggaggaaggcacaccacua

SEQ ID NO: 489414 - RNA, 19 nt, Homo sapiens
ugagugaugggcuuuauuu

SEQ ID NO: 489415 - RNA, 19 nt, Homo sapiens
guuauuagcagaagcaaau

SEQ ID NO: 489416 - RNA, 19 nt, Homo sapiens
ggcaaaggcagaggaauuu

SEQ ID NO: 489417 - RNA, 19 nt, Homo sapiens
acuaugacguggugaacua

SEQ ID NO: 489418 - RNA, 19 nt, Homo sapiens
ggauaagaacaucauagaa

SEQ ID NO: 489419 - RNA, 19 nt, Homo sapiens
ggacucacccuccacaaag

SEQ ID NO: 489420 - RNA, 19 nt, Homo sapiens
caggagcaaucacaggaaa

SEQ ID NO: 489421 - RNA, 19 nt, Homo sapiens
gaacuugguccccucaaua

SEQ ID NO: 489422 - RNA, 19 nt, Homo sapiens
gaugguuuguuaagaguuc

SEQ ID NO: 489423 - RNA, 19 nt, Homo sapiens
gggaagcauucuccuaugg

SEQ ID NO: 489424 - RNA, 19 nt, Homo sapiens
cagcagaacagacauguca

SEQ ID NO: 489425 - RNA, 19 nt, Homo sapiens
uagucgagcauuauucuua

SEQ ID NO: 489426 - RNA, 19 nt, Homo sapiens
uuucaugucuuuccacuuc

SEQ ID NO: 489427 - RNA, 19 nt, Homo sapiens
gaagucaccgcuauguuag

SEQ ID NO: 489428 - RNA, 19 nt, Homo sapiens
cauggaaaguggccuguca

SEQ ID NO: 489429 - RNA, 19 nt, Homo sapiens
gggcuacuaccaaaugaaa

SEQ ID NO: 489430 - RNA, 19 nt, Homo sapiens
gauggaacaugcccacaac

SEQ ID NO: 489431 - RNA, 19 nt, Homo sapiens
ucaccgcuauguuagagaa

SEQ ID NO: 489432 - RNA, 19 nt, Homo sapiens
auaaguauuugcagcagaa

SEQ ID NO: 489433 - RNA, 19 nt, Homo sapiens
ggagauggcagaacuuggu

SEQ ID NO: 489434 - RNA, 19 nt, Homo sapiens
ccaaccaccugcccuucuu

SEQ ID NO: 489435 - RNA, 19 nt, Homo sapiens
gagcaaauuguccugauag

SEQ ID NO: 489436 - RNA, 19 nt, Homo sapiens
gaaggcaaaggcagaggaa

SEQ ID NO: 489437 - RNA, 19 nt, Homo sapiens
gaucacaggagcaaucaca

SEQ ID NO: 489438 - RNA, 19 nt, Homo sapiens
uguacgaucucaugaaucu

SEQ ID NO: 489439 - RNA, 19 nt, Homo sapiens
ggcagcuagucgagcauua

SEQ ID NO: 489440 - RNA, 19 nt, Homo sapiens
gggaagaaucugagcaaau

SEQ ID NO: 489441 - RNA, 19 nt, Homo sapiens
uuuacgaucuguuuccaaa

SEQ ID NO: 489442 - RNA, 19 nt, Homo sapiens
gcugcgcaauuacuacuau

SEQ ID NO: 489443 - RNA, 19 nt, Homo sapiens
gcuaguuacccaacauuau

SEQ ID NO: 489444 - RNA, 19 nt, Homo sapiens
ggaggaggcagaagauuac

SEQ ID NO: 489445 - RNA, 19 nt, Homo sapiens
ccagugcaguuucuaagca

SEQ ID NO: 489446 - RNA, 19 nt, Homo sapiens
aaauguauccagaggaauu

SEQ ID NO: 489447 - RNA, 19 nt, Homo sapiens
gguggaauaaucucaagaa

SEQ ID NO: 489448 - RNA, 19 nt, Homo sapiens
gaagaaucugagcaaauug

SEQ ID NO: 489449 - RNA, 19 nt, Homo sapiens
cccaaagccuggccacaga

SEQ ID NO: 489450 - RNA, 19 nt, Homo sapiens
gugaugggcuuuauuugcu

SEQ ID NO: 489451 - RNA, 19 nt, Homo sapiens
uuauaaagcagaugguuug

SEQ ID NO: 489452 - RNA, 19 nt, Homo sapiens
acugaucccuggccacuga

SEQ ID NO: 489453 - RNA, 19 nt, Homo sapiens
gaugaaaggaagugaaguc

SEQ ID NO: 489454 - RNA, 19 nt, Homo sapiens
gucgagcauuauucuuaua

SEQ ID NO: 489455 - RNA, 19 nt, Homo sapiens
caaaucccuuucaugucuu

SEQ ID NO: 489456 - RNA, 19 nt, Homo sapiens
ggauggaacaugcccacaa

SEQ ID NO: 489457 - RNA, 19 nt, Homo sapiens
gaggaaggcacaccacuac

SEQ ID NO: 489458 - RNA, 19 nt, Homo sapiens
gcacuaucgcaucgacaaa

SEQ ID NO: 489459 - RNA, 19 nt, Homo sapiens
caaagacaaauggaaaguu

SEQ ID NO: 489460 - RNA, 19 nt, Homo sapiens
gagaucuggcugcaagaaa

SEQ ID NO: 489461 - RNA, 19 nt, Homo sapiens
acccugggcugcagacaaa

SEQ ID NO: 489462 - RNA, 19 nt, Homo sapiens
gagaguacugugucauuca

SEQ ID NO: 489463 - RNA, 19 nt, Homo sapiens
aaagaacugggcucuggua

SEQ ID NO: 489464 - RNA, 19 nt, Homo sapiens
guggaauaaucucaagaau

SEQ ID NO: 489465 - RNA, 19 nt, Homo sapiens
gauaggaucaaagacaaau

SEQ ID NO: 489466 - RNA, 19 nt, Homo sapiens
ccaguuaaggaaagaaaga

SEQ ID NO: 489467 - RNA, 19 nt, Homo sapiens
uacgaucuguuuccaaauc

SEQ ID NO: 489468 - RNA, 19 nt, Homo sapiens
caugagugaugggcuuuau

SEQ ID NO: 489469 - RNA, 19 nt, Homo sapiens
cuaguuacccaacauuaug

SEQ ID NO: 489470 - RNA, 19 nt, Homo sapiens
agaucuggcugcaagaaau

SEQ ID NO: 489471 - RNA, 19 nt, Homo sapiens
agaguacugugucauucaa

SEQ ID NO: 489472 - RNA, 19 nt, Homo sapiens
gugggaagcauucuccuau

SEQ ID NO: 489473 - RNA, 19 nt, Homo sapiens
gcaauuuugugcacagaga

SEQ ID NO: 489474 - RNA, 19 nt, Homo sapiens
caaggauaagaacaucaua

SEQ ID NO: 489475 - RNA, 19 nt, Homo sapiens
gcagaacagacaugucaag

SEQ ID NO: 489476 - RNA, 19 nt, Homo sapiens
aaagggcuacuaccaaaug

SEQ ID NO: 489477 - RNA, 19 nt, Homo sapiens
cagaugguuuguuaagagu

SEQ ID NO: 489478 - RNA, 19 nt, Homo sapiens
gaugcuaguuauggagaug

SEQ ID NO: 489479 - RNA, 19 nt, Homo sapiens
ccaaugaccccgcucuuaa

SEQ ID NO: 489480 - RNA, 19 nt, Homo sapiens
gcagcuagucgagcauuau

SEQ ID NO: 489481 - RNA, 19 nt, Homo sapiens
ggaucaaagacaaauggaa

SEQ ID NO: 489482 - RNA, 19 nt, Homo sapiens
gaucuggcugcaagaaaug

SEQ ID NO: 489483 - RNA, 19 nt, Homo sapiens
gaagggaucacaucauuga

SEQ ID NO: 489484 - RNA, 19 nt, Homo sapiens
aaagauccauggagaaauu

SEQ ID NO: 489485 - RNA, 19 nt, Homo sapiens
acaaacagcucaucguaga

SEQ ID NO: 489486 - RNA, 19 nt, Homo sapiens
acagaagaauucccucuaa

SEQ ID NO: 489487 - RNA, 19 nt, Homo sapiens
ccaccaggaugaagacaaa

SEQ ID NO: 489488 - RNA, 19 nt, Homo sapiens
cggaagggaucacaucauu

SEQ ID NO: 489489 - RNA, 19 nt, Homo sapiens
cuucaucgaugccaaauau

SEQ ID NO: 489490 - RNA, 19 nt, Homo sapiens
ggacaucugcgcaguggaa

SEQ ID NO: 489491 - RNA, 19 nt, Homo sapiens
ggacacgugcucagagauu

SEQ ID NO: 489492 - RNA, 19 nt, Homo sapiens
cgaauucucugaucucaac

SEQ ID NO: 489493 - RNA, 19 nt, Homo sapiens
gaacuacaaggccuacaug

SEQ ID NO: 489494 - RNA, 19 nt, Homo sapiens
cagaagaauucccucuaau

SEQ ID NO: 489495 - RNA, 19 nt, Homo sapiens
gacaagcccuggguguuug

SEQ ID NO: 489496 - RNA, 19 nt, Homo sapiens
agacaaacagcucaucgua

SEQ ID NO: 489497 - RNA, 19 nt, Homo sapiens
gacacgugcucagagauuu

SEQ ID NO: 489498 - RNA, 19 nt, Homo sapiens
gcaacuuuauggccaaucu

SEQ ID NO: 489499 - RNA, 19 nt, Homo sapiens
ugacaagcccuggguguuu

SEQ ID NO: 489500 - RNA, 19 nt, Homo sapiens
ucucugaucucaaccuugu

SEQ ID NO: 489501 - RNA, 19 nt, Homo sapiens
gcacugaccaagacguaug

SEQ ID NO: 489502 - RNA, 19 nt, Homo sapiens
uaauugaucagaccuucua

SEQ ID NO: 489503 - RNA, 19 nt, Homo sapiens
aguguuaacuccuugcauu

SEQ ID NO: 489504 - RNA, 19 nt, Homo sapiens
gacagaagaauucccucua

SEQ ID NO: 489505 - RNA, 19 nt, Homo sapiens
gaccaaugccuucaaccuu

SEQ ID NO: 489506 - RNA, 19 nt, Homo sapiens
ggacggaagggaucacauc

SEQ ID NO: 489507 - RNA, 19 nt, Homo sapiens
gguggauucucuguggaua

SEQ ID NO: 489508 - RNA, 19 nt, Homo sapiens
ggaagggaucacaucauug

SEQ ID NO: 489509 - RNA, 19 nt, Homo sapiens
caaauggguacaugacaga

SEQ ID NO: 489510 - RNA, 19 nt, Homo sapiens
ggagaaauugacauuaaag

SEQ ID NO: 489511 - RNA, 19 nt, Homo sapiens
ggaacuggaagaccaauac

SEQ ID NO: 489512 - RNA, 19 nt, Homo sapiens
ucauugggcugcaguaugc

SEQ ID NO: 489513 - RNA, 19 nt, Homo sapiens
guggacacgugcucagaga

SEQ ID NO: 489514 - RNA, 19 nt, Homo sapiens
ccagaugguucgacugcau

SEQ ID NO: 489515 - RNA, 19 nt, Homo sapiens
ucguagagcucguggucaa

SEQ ID NO: 489516 - RNA, 19 nt, Homo sapiens
ugacgugcguguccagaag

SEQ ID NO: 489517 - RNA, 19 nt, Homo sapiens
ccauggagaaauugacauu

SEQ ID NO: 489518 - RNA, 19 nt, Homo sapiens
gcaguggaagcgcuacaug

SEQ ID NO: 489519 - RNA, 19 nt, Homo sapiens
ugacaaccagcaugacuuc

SEQ ID NO: 489520 - RNA, 19 nt, Homo sapiens
gauucucuguggauaugga

SEQ ID NO: 489521 - RNA, 19 nt, Homo sapiens
uggauucucuguggauaug

SEQ ID NO: 489522 - RNA, 19 nt, Homo sapiens
cagaugguucgacugcaua

SEQ ID NO: 489523 - RNA, 19 nt, Homo sapiens
cauggagaaauugacauua

SEQ ID NO: 489524 - RNA, 19 nt, Homo sapiens
gugcguguccagaagauug

SEQ ID NO: 489525 - RNA, 19 nt, Homo sapiens
gucuacaacuucugugaca

SEQ ID NO: 489526 - RNA, 19 nt, Homo sapiens
guuaacuccuugcauucug

SEQ ID NO: 489527 - RNA, 19 nt, Homo sapiens
gggaacuggaagaccaaua

SEQ ID NO: 489528 - RNA, 19 nt, Homo sapiens
uccagaagauugggcagaa

SEQ ID NO: 489529 - RNA, 19 nt, Homo sapiens
cuaccgcaguuuggucauu

SEQ ID NO: 489530 - RNA, 19 nt, Homo sapiens
gccgaauucucugaucuca

SEQ ID NO: 489531 - RNA, 19 nt, Homo sapiens
caugaggacgucaguguca

SEQ ID NO: 489532 - RNA, 19 nt, Homo sapiens
ugcauucugucuacaacuu

SEQ ID NO: 489533 - RNA, 19 nt, Homo sapiens
gaacuggaagaccaauacu

SEQ ID NO: 489534 - RNA, 19 nt, Homo sapiens
gaagauugggcagaacuac

SEQ ID NO: 489535 - RNA, 19 nt, Homo sapiens
uccaggacaucgcaagugu

SEQ ID NO: 489536 - RNA, 19 nt, Homo sapiens
ccaagucgcagccaugaac

SEQ ID NO: 489537 - RNA, 19 nt, Homo sapiens
gcugcaguaugcuggaauc

SEQ ID NO: 489538 - RNA, 19 nt, Homo sapiens
ggagacuaccgcaguuugg

SEQ ID NO: 489539 - RNA, 19 nt, Homo sapiens
ugguucgacugcauaagaa

SEQ ID NO: 489540 - RNA, 19 nt, Homo sapiens
gggcugcaguaugcuggaa

SEQ ID NO: 489541 - RNA, 19 nt, Homo sapiens
gcagccugaggaagucuuu

SEQ ID NO: 489542 - RNA, 19 nt, Homo sapiens
cccagucucugaccaaugc

SEQ ID NO: 489543 - RNA, 19 nt, Homo sapiens
gcaaggacggaagggauca

SEQ ID NO: 489544 - RNA, 19 nt, Homo sapiens
gaugggcaaggucaagguu

SEQ ID NO: 489545 - RNA, 19 nt, Homo sapiens
gagcucguggucaacaaga

SEQ ID NO: 489546 - RNA, 19 nt, Homo sapiens
uuaacuccuugcauucugu

SEQ ID NO: 489547 - RNA, 19 nt, Homo sapiens
uaccgcaguuuggucauug

SEQ ID NO: 489548 - RNA, 19 nt, Homo sapiens
ggucucugaagccggauuu

SEQ ID NO: 489549 - RNA, 19 nt, Homo sapiens
gcucaacaaaucccagucu

SEQ ID NO: 489550 - RNA, 19 nt, Homo sapiens
gcucguggucaacaagaug

SEQ ID NO: 489551 - RNA, 19 nt, Homo sapiens
gacggaagggaucacauca

SEQ ID NO: 489552 - RNA, 19 nt, Homo sapiens
gcaccuuucaggccuugga

SEQ ID NO: 489553 - RNA, 19 nt, Homo sapiens
agauugggcagaacuacaa

SEQ ID NO: 489554 - RNA, 19 nt, Homo sapiens
gaagggaucacaucauuga

SEQ ID NO: 489555 - RNA, 19 nt, Homo sapiens
aaagauccauggagaaauu

SEQ ID NO: 489556 - RNA, 19 nt, Homo sapiens
acaaacagcucaucguaga

SEQ ID NO: 489557 - RNA, 19 nt, Homo sapiens
acagaagaauucccucuaa

SEQ ID NO: 489558 - RNA, 19 nt, Homo sapiens
ccaccaggaugaagacaaa

SEQ ID NO: 489559 - RNA, 19 nt, Homo sapiens
cggaagggaucacaucauu

SEQ ID NO: 489560 - RNA, 19 nt, Homo sapiens
cuucaucgaugccaaauau

SEQ ID NO: 489561 - RNA, 19 nt, Homo sapiens
ggacaucugcgcaguggaa

SEQ ID NO: 489562 - RNA, 19 nt, Homo sapiens
ggacacgugcucagagauu

SEQ ID NO: 489563 - RNA, 19 nt, Homo sapiens
cgaauucucugaucucaac

SEQ ID NO: 489564 - RNA, 19 nt, Homo sapiens
gaacuacaaggccuacaug

SEQ ID NO: 489565 - RNA, 19 nt, Homo sapiens
cagaagaauucccucuaau

SEQ ID NO: 489566 - RNA, 19 nt, Homo sapiens
gacaagcccuggguguuug

SEQ ID NO: 489567 - RNA, 19 nt, Homo sapiens
agacaaacagcucaucgua

SEQ ID NO: 489568 - RNA, 19 nt, Homo sapiens
gacacgugcucagagauuu

SEQ ID NO: 489569 - RNA, 19 nt, Homo sapiens
gcaacuuuauggccaaucu

SEQ ID NO: 489570 - RNA, 19 nt, Homo sapiens
ugacaagcccuggguguuu

SEQ ID NO: 489571 - RNA, 19 nt, Homo sapiens
ucucugaucucaaccuugu

SEQ ID NO: 489572 - RNA, 19 nt, Homo sapiens
gcacugaccaagacguaug

SEQ ID NO: 489573 - RNA, 19 nt, Homo sapiens
uaauugaucagaccuucua

SEQ ID NO: 489574 - RNA, 19 nt, Homo sapiens
aguguuaacuccuugcauu

SEQ ID NO: 489575 - RNA, 19 nt, Homo sapiens
gacagaagaauucccucua

SEQ ID NO: 489576 - RNA, 19 nt, Homo sapiens
ggacggaagggaucacauc

SEQ ID NO: 489577 - RNA, 19 nt, Homo sapiens
gguggauucucuguggaua

SEQ ID NO: 489578 - RNA, 19 nt, Homo sapiens
ggaagggaucacaucauug

SEQ ID NO: 489579 - RNA, 19 nt, Homo sapiens
caaauggguacaugacaga

SEQ ID NO: 489580 - RNA, 19 nt, Homo sapiens
ggagaaauugacauuaaag

SEQ ID NO: 489581 - RNA, 19 nt, Homo sapiens
ggaacuggaagaccaauac

SEQ ID NO: 489582 - RNA, 19 nt, Homo sapiens
ucauugggcugcaguaugc

SEQ ID NO: 489583 - RNA, 19 nt, Homo sapiens
guggacacgugcucagaga

SEQ ID NO: 489584 - RNA, 19 nt, Homo sapiens
ccagaugguucgacugcau

SEQ ID NO: 489585 - RNA, 19 nt, Homo sapiens
ucguagagcucguggucaa

SEQ ID NO: 489586 - RNA, 19 nt, Homo sapiens
ugacgugcguguccagaag

SEQ ID NO: 489587 - RNA, 19 nt, Homo sapiens
ccauggagaaauugacauu

SEQ ID NO: 489588 - RNA, 19 nt, Homo sapiens
gcaguggaagcgcuacaug

SEQ ID NO: 489589 - RNA, 19 nt, Homo sapiens
ugacaaccagcaugacuuc

SEQ ID NO: 489590 - RNA, 19 nt, Homo sapiens
gauucucuguggauaugga

SEQ ID NO: 489591 - RNA, 19 nt, Homo sapiens
uggauucucuguggauaug

SEQ ID NO: 489592 - RNA, 19 nt, Homo sapiens
cagaugguucgacugcaua

SEQ ID NO: 489593 - RNA, 19 nt, Homo sapiens
cauggagaaauugacauua

SEQ ID NO: 489594 - RNA, 19 nt, Homo sapiens
gugcguguccagaagauug

SEQ ID NO: 489595 - RNA, 19 nt, Homo sapiens
gucuacaacuucugugaca

SEQ ID NO: 489596 - RNA, 19 nt, Homo sapiens
guuaacuccuugcauucug

SEQ ID NO: 489597 - RNA, 19 nt, Homo sapiens
gggaacuggaagaccaaua

SEQ ID NO: 489598 - RNA, 19 nt, Homo sapiens
uccagaagauugggcagaa

SEQ ID NO: 489599 - RNA, 19 nt, Homo sapiens
cuaccgcaguuuggucauu

SEQ ID NO: 489600 - RNA, 19 nt, Homo sapiens
gccgaauucucugaucuca

SEQ ID NO: 489601 - RNA, 19 nt, Homo sapiens
caugaggacgucaguguca

SEQ ID NO: 489602 - RNA, 19 nt, Homo sapiens
ugcauucugucuacaacuu

SEQ ID NO: 489603 - RNA, 19 nt, Homo sapiens
gaacuggaagaccaauacu

SEQ ID NO: 489604 - RNA, 19 nt, Homo sapiens
gaagauugggcagaacuac

SEQ ID NO: 489605 - RNA, 19 nt, Homo sapiens
uccaggacaucgcaagugu

SEQ ID NO: 489606 - RNA, 19 nt, Homo sapiens
ccaagucgcagccaugaac

SEQ ID NO: 489607 - RNA, 19 nt, Homo sapiens
gcugcaguaugcuggaauc

SEQ ID NO: 489608 - RNA, 19 nt, Homo sapiens
ggagacuaccgcaguuugg

SEQ ID NO: 489609 - RNA, 19 nt, Homo sapiens
ugguucgacugcauaagaa

SEQ ID NO: 489610 - RNA, 19 nt, Homo sapiens
gggcugcaguaugcuggaa

SEQ ID NO: 489611 - RNA, 19 nt, Homo sapiens
gcaaggacggaagggauca

SEQ ID NO: 489612 - RNA, 19 nt, Homo sapiens
gaugggcaaggucaagguu

SEQ ID NO: 489613 - RNA, 19 nt, Homo sapiens
gagcucguggucaacaaga

SEQ ID NO: 489614 - RNA, 19 nt, Homo sapiens
uuaacuccuugcauucugu

SEQ ID NO: 489615 - RNA, 19 nt, Homo sapiens
uaccgcaguuuggucauug

SEQ ID NO: 489616 - RNA, 19 nt, Homo sapiens
ggucucugaagccggauuu

SEQ ID NO: 489617 - RNA, 19 nt, Homo sapiens
gcucguggucaacaagaug

SEQ ID NO: 489618 - RNA, 19 nt, Homo sapiens
gacggaagggaucacauca

SEQ ID NO: 489619 - RNA, 19 nt, Homo sapiens
gcaccuuucaggccuugga

SEQ ID NO: 489620 - RNA, 19 nt, Homo sapiens
agauugggcagaacuacaa

SEQ ID NO: 489621 - RNA, 19 nt, Homo sapiens
ccacagagcggaacacuua

SEQ ID NO: 489622 - RNA, 19 nt, Homo sapiens
gaucaaacuuccauagcuu

SEQ ID NO: 489623 - RNA, 19 nt, Homo sapiens
gcaaagaugggaaagacua

SEQ ID NO: 489624 - RNA, 19 nt, Homo sapiens
gaacugugcuuuucgcuuu

SEQ ID NO: 489625 - RNA, 19 nt, Homo sapiens
gaacuagucaucagcaaga

SEQ ID NO: 489626 - RNA, 19 nt, Homo sapiens
guaaugcucacuuauguuu

SEQ ID NO: 489627 - RNA, 19 nt, Homo sapiens
gauccggacucaagcaaga

SEQ ID NO: 489628 - RNA, 19 nt, Homo sapiens
aaaguucccucucauugaa

SEQ ID NO: 489629 - RNA, 19 nt, Homo sapiens
gcaacaacuacaaggcuua

SEQ ID NO: 489630 - RNA, 19 nt, Homo sapiens
gcaccuaugcuguggauau

SEQ ID NO: 489631 - RNA, 19 nt, Homo sapiens
acaaagagaugcugacacu

SEQ ID NO: 489632 - RNA, 19 nt, Homo sapiens
cugcagagccuuucauuga

SEQ ID NO: 489633 - RNA, 19 nt, Homo sapiens
uaagccagaugaugaacuu

SEQ ID NO: 489634 - RNA, 19 nt, Homo sapiens
gcagaaauuuuaagccaaa

SEQ ID NO: 489635 - RNA, 19 nt, Homo sapiens
gaucauugguaugcaguau

SEQ ID NO: 489636 - RNA, 19 nt, Homo sapiens
guggacaccugcucugaga

SEQ ID NO: 489637 - RNA, 19 nt, Homo sapiens
gaaaaguucccucucauug

SEQ ID NO: 489638 - RNA, 19 nt, Homo sapiens
gguggaacaggcagaauuu

SEQ ID NO: 489639 - RNA, 19 nt, Homo sapiens
caccugcucugagauguuu

SEQ ID NO: 489640 - RNA, 19 nt, Homo sapiens
gaugggaaagacuacauuu

SEQ ID NO: 489641 - RNA, 19 nt, Homo sapiens
gagcggaacacuuaaggau

SEQ ID NO: 489642 - RNA, 19 nt, Homo sapiens
ggacaccugcucugagaug

SEQ ID NO: 489643 - RNA, 19 nt, Homo sapiens
gcuggucgcuaucuauaag

SEQ ID NO: 489644 - RNA, 19 nt, Homo sapiens
cugagucucugcuggcuaa

SEQ ID NO: 489645 - RNA, 19 nt, Homo sapiens
gcagagccuuucauugacu

SEQ ID NO: 489646 - RNA, 19 nt, Homo sapiens
ucauugaacagacauacua

SEQ ID NO: 489647 - RNA, 19 nt, Homo sapiens
gacaagccauggguguuug

SEQ ID NO: 489648 - RNA, 19 nt, Homo sapiens
ccauauacaacuucuguga

SEQ ID NO: 489649 - RNA, 19 nt, Homo sapiens
gagauuaugauaucaaggu

SEQ ID NO: 489650 - RNA, 19 nt, Homo sapiens
aaacuuccauagcuucauc

SEQ ID NO: 489651 - RNA, 19 nt, Homo sapiens
gacuguagcaugccacuga

SEQ ID NO: 489652 - RNA, 19 nt, Homo sapiens
ggagcagauugccauguca

SEQ ID NO: 489653 - RNA, 19 nt, Homo sapiens
caacuacaaggcuuacaug

SEQ ID NO: 489654 - RNA, 19 nt, Homo sapiens
gaagauuggcaacaacuac

SEQ ID NO: 489655 - RNA, 19 nt, Homo sapiens
cagcuggucgcuaucuaua

SEQ ID NO: 489656 - RNA, 19 nt, Homo sapiens
caagaucaaacuuccauag

SEQ ID NO: 489657 - RNA, 19 nt, Homo sapiens
ugacaagccauggguguuu

SEQ ID NO: 489658 - RNA, 19 nt, Homo sapiens
gaggacaggcaacucauca

SEQ ID NO: 489659 - RNA, 19 nt, Homo sapiens
ccuuggagauuaugauauc

SEQ ID NO: 489660 - RNA, 19 nt, Homo sapiens
cagcaucaacucacuggaa

SEQ ID NO: 489661 - RNA, 19 nt, Homo sapiens
ggacuuccgccaccugauc

SEQ ID NO: 489662 - RNA, 19 nt, Homo sapiens
cuagauagaacauuaagag

SEQ ID NO: 489663 - RNA, 19 nt, Homo sapiens
ucacuuauguuuucucugu

SEQ ID NO: 489664 - RNA, 19 nt, Homo sapiens
caucugugcugucaaagcu

SEQ ID NO: 489665 - RNA, 19 nt, Homo sapiens
cgacugggccaagugcuuu

SEQ ID NO: 489666 - RNA, 19 nt, Homo sapiens
auauacaacuucugugaca

SEQ ID NO: 489667 - RNA, 19 nt, Homo sapiens
gcaacucaucaccgaacua

SEQ ID NO: 489668 - RNA, 19 nt, Homo sapiens
ucuucugggugguuugaua

SEQ ID NO: 489669 - RNA, 19 nt, Homo sapiens
ccuuuaagccagaugauga

SEQ ID NO: 489670 - RNA, 19 nt, Homo sapiens
ucaaugaacugugcuuuuc

SEQ ID NO: 489671 - RNA, 19 nt, Homo sapiens
ccagugugcuugggaucuu

SEQ ID NO: 489672 - RNA, 19 nt, Homo sapiens
caaguccaagcuucuuaaa

SEQ ID NO: 489673 - RNA, 19 nt, Homo sapiens
gaauccauauacaacuucu

SEQ ID NO: 489674 - RNA, 19 nt, Homo sapiens
uuguaaugcucacuuaugu

SEQ ID NO: 489675 - RNA, 19 nt, Homo sapiens
uuaaggauccggacucaag

SEQ ID NO: 489676 - RNA, 19 nt, Homo sapiens
caacucaucaccgaacuag

SEQ ID NO: 489677 - RNA, 19 nt, Homo sapiens
ccagaagauuggcaacaac

SEQ ID NO: 489678 - RNA, 19 nt, Homo sapiens
ggaaaaccacuacgacuuc

SEQ ID NO: 489679 - RNA, 19 nt, Homo sapiens
gggcaaggucaaaguggaa

SEQ ID NO: 489680 - RNA, 19 nt, Homo sapiens
ggaauccauauacaacuuc

SEQ ID NO: 489681 - RNA, 19 nt, Homo sapiens
ugcuugggaucuucaauga

SEQ ID NO: 489682 - RNA, 19 nt, Homo sapiens
ccagugugacuuuaucuuc

SEQ ID NO: 489683 - RNA, 19 nt, Homo sapiens
uccagaagauuggcaacaa

SEQ ID NO: 489684 - RNA, 19 nt, Homo sapiens
caccuaugcuguggauaug

SEQ ID NO: 489685 - RNA, 19 nt, Homo sapiens
ggacaggggagaaacgaaa

SEQ ID NO: 489686 - RNA, 19 nt, Homo sapiens
acaaguccaagcuucuuaa

SEQ ID NO: 489687 - RNA, 19 nt, Homo sapiens
uauauucucgacuguaaug

SEQ ID NO: 489688 - RNA, 19 nt, Homo sapiens
guccuuggagauuaugaua

SEQ ID NO: 489689 - RNA, 19 nt, Homo sapiens
gcauugcaguagggccaaa

SEQ ID NO: 489690 - RNA, 19 nt, Homo sapiens
uggcaaagaugggaaagac

SEQ ID NO: 489691 - RNA, 19 nt, Homo sapiens
cagugugacuuuaucuucu

SEQ ID NO: 489692 - RNA, 19 nt, Homo sapiens
ucucccaaguccaguguga

SEQ ID NO: 489693 - RNA, 19 nt, Homo sapiens
aguccaagcuucuuaaaau

SEQ ID NO: 489694 - RNA, 19 nt, Homo sapiens
ucaccgaacuagucaucag

SEQ ID NO: 489695 - RNA, 19 nt, Homo sapiens
cauuuggcauggcggagaa

SEQ ID NO: 489696 - RNA, 19 nt, Homo sapiens
uuccagggcuguuugucaa

SEQ ID NO: 489697 - RNA, 19 nt, Homo sapiens
gcuccucugucugguuguu

SEQ ID NO: 489698 - RNA, 19 nt, Homo sapiens
ugccguugcugcguucuuu

SEQ ID NO: 489699 - RNA, 19 nt, Homo sapiens
aaacaaguccaagcuucuu

SEQ ID NO: 489700 - RNA, 19 nt, Homo sapiens
uccucugucugguuguuua

SEQ ID NO: 489701 - RNA, 19 nt, Homo sapiens
ccacaaagagaugcugaca

SEQ ID NO: 489702 - RNA, 19 nt, Homo sapiens
ggaacaggcagaauuuuca

SEQ ID NO: 489703 - RNA, 19 nt, Homo sapiens
ucauugguaugcaguaugc

SEQ ID NO: 489704 - RNA, 19 nt, Homo sapiens
agaucaaacuuccauagcu

SEQ ID NO: 489705 - RNA, 19 nt, Homo sapiens
gugcuugggaucuucaaug

SEQ ID NO: 489706 - RNA, 19 nt, Homo sapiens
gagaaacgaaaaccacaaa

SEQ ID NO: 489707 - RNA, 19 nt, Homo sapiens
ccuaugcuguggauaugca

SEQ ID NO: 489708 - RNA, 19 nt, Homo sapiens
aaugcugacuggacugugu

SEQ ID NO: 489709 - RNA, 19 nt, Homo sapiens
uugcugcguucuuucaaug

SEQ ID NO: 489710 - RNA, 19 nt, Homo sapiens
guugcugcguucuuucaau

SEQ ID NO: 489711 - RNA, 19 nt, Homo sapiens
ggaggacaggcaacucauc

SEQ ID NO: 489712 - RNA, 19 nt, Homo sapiens
uggagcagauugccauguc

SEQ ID NO: 489713 - RNA, 19 nt, Homo sapiens
aaaaguccuuggagauuau

SEQ ID NO: 489714 - RNA, 19 nt, Homo sapiens
uuguuuaccuguuccuguu

SEQ ID NO: 489715 - RNA, 19 nt, Homo sapiens
agugucagcuccucugucu

SEQ ID NO: 489716 - RNA, 19 nt, Homo sapiens
aacaaguccaagcuucuua

SEQ ID NO: 489717 - RNA, 19 nt, Homo sapiens
gcucucacccagaccuaug

SEQ ID NO: 489718 - RNA, 19 nt, Homo sapiens
uaagacacugggaggagaa

SEQ ID NO: 489719 - RNA, 19 nt, Homo sapiens
ggccagacuucgugcucau

SEQ ID NO: 489720 - RNA, 19 nt, Homo sapiens
ucgcuuucuuucugcauga

SEQ ID NO: 489721 - RNA, 19 nt, Homo sapiens
ccacagagcggaacacuua

SEQ ID NO: 489722 - RNA, 19 nt, Homo sapiens
cagauuagcucuucagaca

SEQ ID NO: 489723 - RNA, 19 nt, Homo sapiens
gcaaagaugggaaagacua

SEQ ID NO: 489724 - RNA, 19 nt, Homo sapiens
gaacuagucaucagcaaga

SEQ ID NO: 489725 - RNA, 19 nt, Homo sapiens
ggaaaggcaucuaagacau

SEQ ID NO: 489726 - RNA, 19 nt, Homo sapiens
gaaaggcaucuaagacauu

SEQ ID NO: 489727 - RNA, 19 nt, Homo sapiens
gauccggacucaagcaaga

SEQ ID NO: 489728 - RNA, 19 nt, Homo sapiens
aaaguucccucucauugaa

SEQ ID NO: 489729 - RNA, 19 nt, Homo sapiens
caaugaggaugaagccaaa

SEQ ID NO: 489730 - RNA, 19 nt, Homo sapiens
gauuagcucuucagacaca

SEQ ID NO: 489731 - RNA, 19 nt, Homo sapiens
gcaacaacuacaaggcuua

SEQ ID NO: 489732 - RNA, 19 nt, Homo sapiens
gcaccuaugcuguggauau

SEQ ID NO: 489733 - RNA, 19 nt, Homo sapiens
acaaagagaugcugacacu

SEQ ID NO: 489734 - RNA, 19 nt, Homo sapiens
cugcagagccuuucauuga

SEQ ID NO: 489735 - RNA, 19 nt, Homo sapiens
uaagccagaugaugaacuu

SEQ ID NO: 489736 - RNA, 19 nt, Homo sapiens
ucagccagcuuggugguua

SEQ ID NO: 489737 - RNA, 19 nt, Homo sapiens
gaucauugguaugcaguau

SEQ ID NO: 489738 - RNA, 19 nt, Homo sapiens
guggacaccugcucugaga

SEQ ID NO: 489739 - RNA, 19 nt, Homo sapiens
ucuaagacauucaccaaca

SEQ ID NO: 489740 - RNA, 19 nt, Homo sapiens
gaaaaguucccucucauug

SEQ ID NO: 489741 - RNA, 19 nt, Homo sapiens
gguggaacaggcagaauuu

SEQ ID NO: 489742 - RNA, 19 nt, Homo sapiens
acaaaugccuucagcuucu

SEQ ID NO: 489743 - RNA, 19 nt, Homo sapiens
caccugcucugagauguuu

SEQ ID NO: 489744 - RNA, 19 nt, Homo sapiens
gggaaaggcaucuaagaca

SEQ ID NO: 489745 - RNA, 19 nt, Homo sapiens
gaugggaaagacuacauuu

SEQ ID NO: 489746 - RNA, 19 nt, Homo sapiens
ugacaaaugccuucagcuu

SEQ ID NO: 489747 - RNA, 19 nt, Homo sapiens
gagcggaacacuuaaggau

SEQ ID NO: 489748 - RNA, 19 nt, Homo sapiens
ggacaccugcucugagaug

SEQ ID NO: 489749 - RNA, 19 nt, Homo sapiens
gcuggucgcuaucuauaag

SEQ ID NO: 489750 - RNA, 19 nt, Homo sapiens
cugagucucugcuggcuaa

SEQ ID NO: 489751 - RNA, 19 nt, Homo sapiens
gcagagccuuucauugacu

SEQ ID NO: 489752 - RNA, 19 nt, Homo sapiens
ucauugaacagacauacua

SEQ ID NO: 489753 - RNA, 19 nt, Homo sapiens
cuaagacauucaccaacaa

SEQ ID NO: 489754 - RNA, 19 nt, Homo sapiens
gacaagccauggguguuug

SEQ ID NO: 489755 - RNA, 19 nt, Homo sapiens
ccauauacaacuucuguga

SEQ ID NO: 489756 - RNA, 19 nt, Homo sapiens
gagauuaugauaucaaggu

SEQ ID NO: 489757 - RNA, 19 nt, Homo sapiens
gacuguagcaugccacuga

SEQ ID NO: 489758 - RNA, 19 nt, Homo sapiens
ggagcagauugccauguca

SEQ ID NO: 489759 - RNA, 19 nt, Homo sapiens
caacuacaaggcuuacaug

SEQ ID NO: 489760 - RNA, 19 nt, Homo sapiens
gaagauuggcaacaacuac

SEQ ID NO: 489761 - RNA, 19 nt, Homo sapiens
cagcuggucgcuaucuaua

SEQ ID NO: 489762 - RNA, 19 nt, Homo sapiens
ugacaagccauggguguuu

SEQ ID NO: 489763 - RNA, 19 nt, Homo sapiens
gagaccauccggagcuuga

SEQ ID NO: 489764 - RNA, 19 nt, Homo sapiens
gaggacaggcaacucauca

SEQ ID NO: 489765 - RNA, 19 nt, Homo sapiens
ccuuggagauuaugauauc

SEQ ID NO: 489766 - RNA, 19 nt, Homo sapiens
caucuaagacauucaccaa

SEQ ID NO: 489767 - RNA, 19 nt, Homo sapiens
aaaggcaucuaagacauuc

SEQ ID NO: 489768 - RNA, 19 nt, Homo sapiens
cagcaucaacucacuggaa

SEQ ID NO: 489769 - RNA, 19 nt, Homo sapiens
ggacuuccgccaccugauc

SEQ ID NO: 489770 - RNA, 19 nt, Homo sapiens
caucugugcugucaaagcu

SEQ ID NO: 489771 - RNA, 19 nt, Homo sapiens
cgacugggccaagugcuuu

SEQ ID NO: 489772 - RNA, 19 nt, Homo sapiens
auauacaacuucugugaca

SEQ ID NO: 489773 - RNA, 19 nt, Homo sapiens
acccacagcucaacaaguc

SEQ ID NO: 489774 - RNA, 19 nt, Homo sapiens
gcaacucaucaccgaacua

SEQ ID NO: 489775 - RNA, 19 nt, Homo sapiens
ccuuuaagccagaugauga

SEQ ID NO: 489776 - RNA, 19 nt, Homo sapiens
gaauccauauacaacuucu

SEQ ID NO: 489777 - RNA, 19 nt, Homo sapiens
uuaaggauccggacucaag

SEQ ID NO: 489778 - RNA, 19 nt, Homo sapiens
caacucaucaccgaacuag

SEQ ID NO: 489779 - RNA, 19 nt, Homo sapiens
ccagaagauuggcaacaac

SEQ ID NO: 489780 - RNA, 19 nt, Homo sapiens
ggaaaaccacuacgacuuc

SEQ ID NO: 489781 - RNA, 19 nt, Homo sapiens
gggcaaggucaaaguggaa

SEQ ID NO: 489782 - RNA, 19 nt, Homo sapiens
ggaauccauauacaacuuc

SEQ ID NO: 489783 - RNA, 19 nt, Homo sapiens
uccagaagauuggcaacaa

SEQ ID NO: 489784 - RNA, 19 nt, Homo sapiens
caccuaugcuguggauaug

SEQ ID NO: 489785 - RNA, 19 nt, Homo sapiens
gguuaugucccaugaccuu

SEQ ID NO: 489786 - RNA, 19 nt, Homo sapiens
guccuuggagauuaugaua

SEQ ID NO: 489787 - RNA, 19 nt, Homo sapiens
uggcaaagaugggaaagac

SEQ ID NO: 489788 - RNA, 19 nt, Homo sapiens
gacauucaccaacaacagu

SEQ ID NO: 489789 - RNA, 19 nt, Homo sapiens
ucaccgaacuagucaucag

SEQ ID NO: 489790 - RNA, 19 nt, Homo sapiens
cauuuggcauggcggagaa

SEQ ID NO: 489791 - RNA, 19 nt, Homo sapiens
ggaacaggcagaauuuuca

SEQ ID NO: 489792 - RNA, 19 nt, Homo sapiens
ccacaaagagaugcugaca

SEQ ID NO: 489793 - RNA, 19 nt, Homo sapiens
ucauugguaugcaguaugc

SEQ ID NO: 489794 - RNA, 19 nt, Homo sapiens
ccaugaccuugacgugugu

SEQ ID NO: 489795 - RNA, 19 nt, Homo sapiens
cgcagucccugacaaaugc

SEQ ID NO: 489796 - RNA, 19 nt, Homo sapiens
ggaggacaggcaacucauc

SEQ ID NO: 489797 - RNA, 19 nt, Homo sapiens
uggagcagauugccauguc

SEQ ID NO: 489798 - RNA, 19 nt, Homo sapiens
ccuaugcuguggauaugca

SEQ ID NO: 489799 - RNA, 19 nt, Homo sapiens
aaaaguccuuggagauuau

SEQ ID NO: 489800 - RNA, 19 nt, Homo sapiens
ucgcagucccugacaaaug

SEQ ID NO: 489801 - RNA, 19 nt, Homo sapiens
gcucucacccagaccuaug

SEQ ID NO: 489802 - RNA, 19 nt, Homo sapiens
uaagacacugggaggagaa

SEQ ID NO: 489803 - RNA, 19 nt, Homo sapiens
ggccagacuucgugcucau

SEQ ID NO: 489804 - RNA, 19 nt, Homo sapiens
guccuuugccagccucuuu

SEQ ID NO: 489805 - RNA, 19 nt, Homo sapiens
auccggagcuugaggaagu

SEQ ID NO: 489806 - RNA, 19 nt, Homo sapiens
caagguggaacaggcagaa

SEQ ID NO: 489807 - RNA, 19 nt, Homo sapiens
uugcccagcuggucgcuau

SEQ ID NO: 489808 - RNA, 19 nt, Homo sapiens
cagccagcuuggugguuau

SEQ ID NO: 489809 - RNA, 19 nt, Homo sapiens
gccagccucuuuucagauu

SEQ ID NO: 489810 - RNA, 19 nt, Homo sapiens
caaaugccuucagcuucuc

SEQ ID NO: 489811 - RNA, 19 nt, Homo sapiens
agaagauuggcaacaacua

SEQ ID NO: 489812 - RNA, 19 nt, Homo sapiens
uucauugacuccaaguaug

SEQ ID NO: 489813 - RNA, 19 nt, Homo sapiens
agacugagcuugauucuaa

SEQ ID NO: 489814 - RNA, 19 nt, Homo sapiens
ugaaacagcuagguuaaua

SEQ ID NO: 489815 - RNA, 19 nt, Homo sapiens
caaauaaacuccuuaacca

SEQ ID NO: 489816 - RNA, 19 nt, Homo sapiens
gaaaggguguggcuuggaa

SEQ ID NO: 489817 - RNA, 19 nt, Homo sapiens
ggacggaaguggccugaga

SEQ ID NO: 489818 - RNA, 19 nt, Homo sapiens
gauguagucuggucaguga

SEQ ID NO: 489819 - RNA, 19 nt, Homo sapiens
caaggaagaacaaauauga

SEQ ID NO: 489820 - RNA, 19 nt, Homo sapiens
ugagaagagucgagugaua

SEQ ID NO: 489821 - RNA, 19 nt, Homo sapiens
gaguggaucuggagucuga

SEQ ID NO: 489822 - RNA, 19 nt, Homo sapiens
ggagugcgcuagagcauuc

SEQ ID NO: 489823 - RNA, 19 nt, Homo sapiens
gaacaaguaccgagagaau

SEQ ID NO: 489824 - RNA, 19 nt, Homo sapiens
guaggugggucuuggauug

SEQ ID NO: 489825 - RNA, 19 nt, Homo sapiens
cagagaacauuaucaagga

SEQ ID NO: 489826 - RNA, 19 nt, Homo sapiens
ggcaagagcucaggaggaa

SEQ ID NO: 489827 - RNA, 19 nt, Homo sapiens
gaugaaacagcuagguuaa

SEQ ID NO: 489828 - RNA, 19 nt, Homo sapiens
ggaaguggccugagaagag

SEQ ID NO: 489829 - RNA, 19 nt, Homo sapiens
cgagugauauggcuuguag

SEQ ID NO: 489830 - RNA, 19 nt, Homo sapiens
gaaguggccugagaagagu

SEQ ID NO: 489831 - RNA, 19 nt, Homo sapiens
aaauccaacuccaggguua

SEQ ID NO: 489832 - RNA, 19 nt, Homo sapiens
ccaccaaggucuucuuagu

SEQ ID NO: 489833 - RNA, 19 nt, Homo sapiens
acaaguaccgagagaauaa

SEQ ID NO: 489834 - RNA, 19 nt, Homo sapiens
ggaagaacaaauaugauuc

SEQ ID NO: 489835 - RNA, 19 nt, Homo sapiens
gagaagagucgagugauau

SEQ ID NO: 489836 - RNA, 19 nt, Homo sapiens
ggguagagaggacaguuua

SEQ ID NO: 489837 - RNA, 19 nt, Homo sapiens
ccaacaagaccgagaguga

SEQ ID NO: 489838 - RNA, 19 nt, Homo sapiens
gguguggcuuggaacauuu

SEQ ID NO: 489839 - RNA, 19 nt, Homo sapiens
gccuucauguggcuaguua

SEQ ID NO: 489840 - RNA, 19 nt, Homo sapiens
ggacauggacguggugaau

SEQ ID NO: 489841 - RNA, 19 nt, Homo sapiens
ugaugaaacagcuagguua

SEQ ID NO: 489842 - RNA, 19 nt, Homo sapiens
gaucguguguugccauuuu

SEQ ID NO: 489843 - RNA, 19 nt, Homo sapiens
caaaggccguuagggaaau

SEQ ID NO: 489844 - RNA, 19 nt, Homo sapiens
gggcgugacuucagacucu

SEQ ID NO: 489845 - RNA, 19 nt, Homo sapiens
gagcugagagacccuguga

SEQ ID NO: 489846 - RNA, 19 nt, Homo sapiens
guaccgagagaauaacaaa

SEQ ID NO: 489847 - RNA, 19 nt, Homo sapiens
cagaacaaguaccgagaga

SEQ ID NO: 489848 - RNA, 19 nt, Homo sapiens
ggguguggcuuggaacauu

SEQ ID NO: 489849 - RNA, 19 nt, Homo sapiens
uuaaagaaaggcagagauu

SEQ ID NO: 489850 - RNA, 19 nt, Homo sapiens
accaaggucuucuuaguug

SEQ ID NO: 489851 - RNA, 19 nt, Homo sapiens
ccacagacccagagaacau

SEQ ID NO: 489852 - RNA, 19 nt, Homo sapiens
auucuccucucccaaauaa

SEQ ID NO: 489853 - RNA, 19 nt, Homo sapiens
gaaacagcuagguuaauag

SEQ ID NO: 489854 - RNA, 19 nt, Homo sapiens
ccacucccgugaugaaaca

SEQ ID NO: 489855 - RNA, 19 nt, Homo sapiens
acauggacguggugaauca

SEQ ID NO: 489856 - RNA, 19 nt, Homo sapiens
gggcuuccauggugguuuc

SEQ ID NO: 489857 - RNA, 19 nt, Homo sapiens
gcugucagaugugaagaug

SEQ ID NO: 489858 - RNA, 19 nt, Homo sapiens
ggauaggagcuuccagaug

SEQ ID NO: 489859 - RNA, 19 nt, Homo sapiens
uaaagaaaggcagagauug

SEQ ID NO: 489860 - RNA, 19 nt, Homo sapiens
ccaccuccuucuccaauca

SEQ ID NO: 489861 - RNA, 19 nt, Homo sapiens
uaaacuccuuaaccaccua

SEQ ID NO: 489862 - RNA, 19 nt, Homo sapiens
uaccagagccuauggaaag

SEQ ID NO: 489863 - RNA, 19 nt, Homo sapiens
ggagaggagugcgcuagag

SEQ ID NO: 489864 - RNA, 19 nt, Homo sapiens
caacuccaggguuaaagaa

SEQ ID NO: 489865 - RNA, 19 nt, Homo sapiens
ccaaggggcugucagaugu

SEQ ID NO: 489866 - RNA, 19 nt, Homo sapiens
ggcgugggauccagagaga

SEQ ID NO: 489867 - RNA, 19 nt, Homo sapiens
acaaaggccguuagggaaa

SEQ ID NO: 489868 - RNA, 19 nt, Homo sapiens
ccaaauaaacuccuuaacc

SEQ ID NO: 489869 - RNA, 19 nt, Homo sapiens
gcuaccagccugacuaugg

SEQ ID NO: 489870 - RNA, 19 nt, Homo sapiens
caccaaggucuucuuaguu

SEQ ID NO: 489871 - RNA, 19 nt, Homo sapiens
aaagaaaggcagagauugg

SEQ ID NO: 489872 - RNA, 19 nt, Homo sapiens
ccaaggaagaacaaauaug

SEQ ID NO: 489873 - RNA, 19 nt, Homo sapiens
gugaucguguguugccauu

SEQ ID NO: 489874 - RNA, 19 nt, Homo sapiens
guaccagagccuauggaaa

SEQ ID NO: 489875 - RNA, 19 nt, Homo sapiens
ggugggucuuggauuggua

SEQ ID NO: 489876 - RNA, 19 nt, Homo sapiens
gcaaugccugccugaacaa

SEQ ID NO: 489877 - RNA, 19 nt, Homo sapiens
cagacucucuccucucucu

SEQ ID NO: 489878 - RNA, 19 nt, Homo sapiens
gauucuccucucccaaaua

SEQ ID NO: 489879 - RNA, 19 nt, Homo sapiens
caccaccaaggucuucuua

SEQ ID NO: 489880 - RNA, 19 nt, Homo sapiens
gacugagcuugauucuaaa

SEQ ID NO: 489881 - RNA, 19 nt, Homo sapiens
ggguuggguuccagacaga

SEQ ID NO: 489882 - RNA, 19 nt, Homo sapiens
gaacauuaucaaggagaug

SEQ ID NO: 489883 - RNA, 19 nt, Homo sapiens
ggagcuuccagauggguuu

SEQ ID NO: 489884 - RNA, 19 nt, Homo sapiens
guuaauaggaggacagaac

SEQ ID NO: 489885 - RNA, 19 nt, Homo sapiens
gggugggcgugacuucaga

SEQ ID NO: 489886 - RNA, 19 nt, Homo sapiens
ccugugaccucgggacuca

SEQ ID NO: 489887 - RNA, 19 nt, Homo sapiens
gugaugaaacagcuagguu

SEQ ID NO: 489888 - RNA, 19 nt, Homo sapiens
ggaaaggguguggcuugga

SEQ ID NO: 489889 - RNA, 19 nt, Homo sapiens
ccaacuccaggguuaaaga

SEQ ID NO: 489890 - RNA, 19 nt, Homo sapiens
agagugaccucagcaucga

SEQ ID NO: 489891 - RNA, 19 nt, Homo sapiens
agacagggaacacaugcaa

SEQ ID NO: 489892 - RNA, 19 nt, Homo sapiens
ccugagaagagucgaguga

SEQ ID NO: 489893 - RNA, 19 nt, Homo sapiens
ccacuccccucauccacua

SEQ ID NO: 489894 - RNA, 19 nt, Homo sapiens
gagacugagcuugauucua

SEQ ID NO: 489895 - RNA, 19 nt, Homo sapiens
uuaaggggaucuaaaagga

SEQ ID NO: 489896 - RNA, 19 nt, Homo sapiens
gggcgacuaugggcagcaa

SEQ ID NO: 489897 - RNA, 19 nt, Homo sapiens
cucgucagccgaauucuuu

SEQ ID NO: 489898 - RNA, 19 nt, Homo sapiens
ucagccgaauucuuuguca

SEQ ID NO: 489899 - RNA, 19 nt, Homo sapiens
ggggacagaucuugagcaa

SEQ ID NO: 489900 - RNA, 19 nt, Homo sapiens
gguaccagagccuauggaa

SEQ ID NO: 489901 - RNA, 19 nt, Homo sapiens
aauggugggcuccagagua

SEQ ID NO: 489902 - RNA, 19 nt, Homo sapiens
ggaucuggagucugaagga

SEQ ID NO: 489903 - RNA, 19 nt, Homo sapiens
uagagaggacaguuuagga

SEQ ID NO: 489904 - RNA, 19 nt, Homo sapiens
agcaaugccugccugaaca

SEQ ID NO: 489905 - RNA, 19 nt, Homo sapiens
acagacccagagaacauua

SEQ ID NO: 489906 - RNA, 19 nt, Homo sapiens
ugccugugaucguguguug

SEQ ID NO: 489907 - RNA, 19 nt, Homo sapiens
gaagagucgagugauaugg

SEQ ID NO: 489908 - RNA, 19 nt, Homo sapiens
gggagacugagcuugauuc

SEQ ID NO: 489909 - RNA, 19 nt, Homo sapiens
gcaccaccaaggucuucuu

SEQ ID NO: 489910 - RNA, 19 nt, Homo sapiens
cagcugagcguggauugug

SEQ ID NO: 489911 - RNA, 19 nt, Homo sapiens
ggcccaugcuggacuuucu

SEQ ID NO: 489912 - RNA, 19 nt, Homo sapiens
ccucugcuaugucugugau

SEQ ID NO: 489913 - RNA, 19 nt, Homo sapiens
gaacguggcucaacuagau

SEQ ID NO: 489914 - RNA, 19 nt, Homo sapiens
gauaugaucuguuaugcua

SEQ ID NO: 489915 - RNA, 19 nt, Homo sapiens
gaagaaagcaguacugugu

SEQ ID NO: 489916 - RNA, 19 nt, Homo sapiens
uaagugagguauaugauga

SEQ ID NO: 489917 - RNA, 19 nt, Homo sapiens
ggauucagguuucuuauuc

SEQ ID NO: 489918 - RNA, 19 nt, Homo sapiens
uaagauugcuuuccauguu

SEQ ID NO: 489919 - RNA, 19 nt, Homo sapiens
uaacauguaucgcucauuc

SEQ ID NO: 489920 - RNA, 19 nt, Homo sapiens
agaaagcaguacuguguua

SEQ ID NO: 489921 - RNA, 19 nt, Homo sapiens
gaaagauuacguccucaua

SEQ ID NO: 489922 - RNA, 19 nt, Homo sapiens
guacagggauucagguuuc

SEQ ID NO: 489923 - RNA, 19 nt, Homo sapiens
guaauucuguuucaugaga

SEQ ID NO: 489924 - RNA, 19 nt, Homo sapiens
ggaaaugcuugguuugugu

SEQ ID NO: 489925 - RNA, 19 nt, Homo sapiens
gggaggaaaugcuugguuu

SEQ ID NO: 489926 - RNA, 19 nt, Homo sapiens
guaugggcauuaccucuua

SEQ ID NO: 489927 - RNA, 19 nt, Homo sapiens
guaauggcuuugucaauau

SEQ ID NO: 489928 - RNA, 19 nt, Homo sapiens
guggauugcuucuaucuuu

SEQ ID NO: 489929 - RNA, 19 nt, Homo sapiens
aaagagccuugauuacaua

SEQ ID NO: 489930 - RNA, 19 nt, Homo sapiens
ggaaauuucugagagaugu

SEQ ID NO: 489931 - RNA, 19 nt, Homo sapiens
gcaaagacuagguguauau

SEQ ID NO: 489932 - RNA, 19 nt, Homo sapiens
ccuagaaaguuaagaugua

SEQ ID NO: 489933 - RNA, 19 nt, Homo sapiens
gaacuuccgccuuguaaga

SEQ ID NO: 489934 - RNA, 19 nt, Homo sapiens
ucugagagauguguaguua

SEQ ID NO: 489935 - RNA, 19 nt, Homo sapiens
uaaagagccuugauuacau

SEQ ID NO: 489936 - RNA, 19 nt, Homo sapiens
gcuuaaagagccuugauua

SEQ ID NO: 489937 - RNA, 19 nt, Homo sapiens
aguaauggcuuugucaaua

SEQ ID NO: 489938 - RNA, 19 nt, Homo sapiens
ugagagauguguaguuaau

SEQ ID NO: 489939 - RNA, 19 nt, Homo sapiens
cuacacaguccaucaaaua

SEQ ID NO: 489940 - RNA, 19 nt, Homo sapiens
caccuaagccuaacaugua

SEQ ID NO: 489941 - RNA, 19 nt, Homo sapiens
gaauuguccuccugcaguu

SEQ ID NO: 489942 - RNA, 19 nt, Homo sapiens
gagccuugauuacauaaau

SEQ ID NO: 489943 - RNA, 19 nt, Homo sapiens
ugagguauaugaugagugu

SEQ ID NO: 489944 - RNA, 19 nt, Homo sapiens
gaguuuagcauugauauug

SEQ ID NO: 489945 - RNA, 19 nt, Homo sapiens
gaaaugcuugguuugugua

SEQ ID NO: 489946 - RNA, 19 nt, Homo sapiens
ccaccugucuuugcuuaaa

SEQ ID NO: 489947 - RNA, 19 nt, Homo sapiens
gagaagcauuauuuguuuc

SEQ ID NO: 489948 - RNA, 19 nt, Homo sapiens
gauagacuuuguuguuaca

SEQ ID NO: 489949 - RNA, 19 nt, Homo sapiens
gccaacaccuugagaagca

SEQ ID NO: 489950 - RNA, 19 nt, Homo sapiens
ggcauuaccucuuagugau

SEQ ID NO: 489951 - RNA, 19 nt, Homo sapiens
gcuacuggucacaauauua

SEQ ID NO: 489952 - RNA, 19 nt, Homo sapiens
cauaaaggaaccuaaguga

SEQ ID NO: 489953 - RNA, 19 nt, Homo sapiens
gggcauuaccucuuaguga

SEQ ID NO: 489954 - RNA, 19 nt, Homo sapiens
uaugggaucccuaaaugua

SEQ ID NO: 489955 - RNA, 19 nt, Homo sapiens
gcaauuuggauuucauguu

SEQ ID NO: 489956 - RNA, 19 nt, Homo sapiens
gaaauuuaccauugagagu

SEQ ID NO: 489957 - RNA, 19 nt, Homo sapiens
agacccagccucuuuguaa

SEQ ID NO: 489958 - RNA, 19 nt, Homo sapiens
gcauuaccucuuagugaua

SEQ ID NO: 489959 - RNA, 19 nt, Homo sapiens
uaccaccugucuuugcuua

SEQ ID NO: 489960 - RNA, 19 nt, Homo sapiens
ucguaaacuuccuaugaua

SEQ ID NO: 489961 - RNA, 19 nt, Homo sapiens
uugcugcccuucugcuuua

SEQ ID NO: 489962 - RNA, 19 nt, Homo sapiens
uaaaugacccgugguacuu

SEQ ID NO: 489963 - RNA, 19 nt, Homo sapiens
gguuauccauucagguuga

SEQ ID NO: 489964 - RNA, 19 nt, Homo sapiens
aagauugcuuuccauguuu

SEQ ID NO: 489965 - RNA, 19 nt, Homo sapiens
guucaggggucuauuauga

SEQ ID NO: 489966 - RNA, 19 nt, Homo sapiens
ucugcacaauucuauguua

SEQ ID NO: 489967 - RNA, 19 nt, Homo sapiens
ucgaguggauugcuucuau

SEQ ID NO: 489968 - RNA, 19 nt, Homo sapiens
acaucuugcuguugccuua

SEQ ID NO: 489969 - RNA, 19 nt, Homo sapiens
gguauaugaugaguguauu

SEQ ID NO: 489970 - RNA, 19 nt, Homo sapiens
ugugauauuuggcuuucua

SEQ ID NO: 489971 - RNA, 19 nt, Homo sapiens
gguguaaacauaugugaug

SEQ ID NO: 489972 - RNA, 19 nt, Homo sapiens
ugaugaguguauugucuuu

SEQ ID NO: 489973 - RNA, 19 nt, Homo sapiens
uaagugcaauuuggauuuc

SEQ ID NO: 489974 - RNA, 19 nt, Homo sapiens
guagaacguggcucaacua

SEQ ID NO: 489975 - RNA, 19 nt, Homo sapiens
uuaaagagccuugauuaca

SEQ ID NO: 489976 - RNA, 19 nt, Homo sapiens
caaacagaaauucaaguga

SEQ ID NO: 489977 - RNA, 19 nt, Homo sapiens
aguaugggaucccuaaaug

SEQ ID NO: 489978 - RNA, 19 nt, Homo sapiens
gaugaacuuccgccuugua

SEQ ID NO: 489979 - RNA, 19 nt, Homo sapiens
uuacacuuguugccacuuu

SEQ ID NO: 489980 - RNA, 19 nt, Homo sapiens
guaaaauaauccaccguuu

SEQ ID NO: 489981 - RNA, 19 nt, Homo sapiens
cauaugugauguaaauugg

SEQ ID NO: 489982 - RNA, 19 nt, Homo sapiens
caaugaaguugcuauuuug

SEQ ID NO: 489983 - RNA, 19 nt, Homo sapiens
ccaaacagaaauucaagug

SEQ ID NO: 489984 - RNA, 19 nt, Homo sapiens
ggucuauuaugaaauggau

SEQ ID NO: 489985 - RNA, 19 nt, Homo sapiens
gccugugccuuuccuagaa

SEQ ID NO: 489986 - RNA, 19 nt, Homo sapiens
gucguaaacuuccuaugau

SEQ ID NO: 489987 - RNA, 19 nt, Homo sapiens
cuacuggucacaauauuau

SEQ ID NO: 489988 - RNA, 19 nt, Homo sapiens
cauaggcgauuacucuucu

SEQ ID NO: 489989 - RNA, 19 nt, Homo sapiens
gagagucaaugaaguugcu

SEQ ID NO: 489990 - RNA, 19 nt, Homo sapiens
acacuacuguaaguuugua

SEQ ID NO: 489991 - RNA, 19 nt, Homo sapiens
gggauucagguuucuuauu

SEQ ID NO: 489992 - RNA, 19 nt, Homo sapiens
caaagacuagguguauauu

SEQ ID NO: 489993 - RNA, 19 nt, Homo sapiens
gaggaaaugcuugguuugu

SEQ ID NO: 489994 - RNA, 19 nt, Homo sapiens
ggaggaaaugcuugguuug

SEQ ID NO: 489995 - RNA, 19 nt, Homo sapiens
cagggauucagguuucuua

SEQ ID NO: 489996 - RNA, 19 nt, Homo sapiens
uaugaugaguguauugucu

SEQ ID NO: 489997 - RNA, 19 nt, Homo sapiens
uugcuucuaucuuugcuuu

SEQ ID NO: 489998 - RNA, 19 nt, Homo sapiens
uugauacuaugacauguug

SEQ ID NO: 489999 - RNA, 19 nt, Homo sapiens
agucguaaacuuccuauga

SEQ ID NO: 490000 - RNA, 19 nt, Homo sapiens
cauuaccucuuagugauau

SEQ ID NO: 490001 - RNA, 19 nt, Homo sapiens
ucaagguccucgaguggau

SEQ ID NO: 490002 - RNA, 19 nt, Homo sapiens
gccgcaaccaauuuaauaa

SEQ ID NO: 490003 - RNA, 19 nt, Homo sapiens
gcacaauucuauguuaccu

SEQ ID NO: 490004 - RNA, 19 nt, Homo sapiens
ccucauaggcgauuacucu

SEQ ID NO: 490005 - RNA, 19 nt, Homo sapiens
aaugacccgugguacuuaa

SEQ ID NO: 490006 - RNA, 19 nt, Homo sapiens
agacuuuguuguuacacuu

SEQ ID NO: 490007 - RNA, 19 nt, Homo sapiens
gauagucguaaacuuccua

SEQ ID NO: 490008 - RNA, 19 nt, Homo sapiens
ugccgcaaccaauuuaaua

SEQ ID NO: 490009 - RNA, 19 nt, Homo sapiens
ucagguuucuuauucuuac

SEQ ID NO: 490010 - RNA, 19 nt, Homo sapiens
uuuaagggccaaacagaaa

SEQ ID NO: 490011 - RNA, 19 nt, Homo sapiens
cccagccucuuuguaagua

SEQ ID NO: 490012 - RNA, 19 nt, Homo sapiens
gacccagccucuuuguaag

SEQ ID NO: 490013 - RNA, 19 nt, Homo sapiens
gaacaggagucaaugauuu

SEQ ID NO: 490014 - RNA, 19 nt, Homo sapiens
aauaauggcuucacucuua

SEQ ID NO: 490015 - RNA, 19 nt, Homo sapiens
uaggagagcugauaauaua

SEQ ID NO: 490016 - RNA, 19 nt, Homo sapiens
gcacaaacaguucucauua

SEQ ID NO: 490017 - RNA, 19 nt, Homo sapiens
gaagcaaccucuuauguau

SEQ ID NO: 490018 - RNA, 19 nt, Homo sapiens
guaagaggcugaagaagaa

SEQ ID NO: 490019 - RNA, 19 nt, Homo sapiens
gcaauuuacuuucaaggua

SEQ ID NO: 490020 - RNA, 19 nt, Homo sapiens
caaagaaccugaagaagau

SEQ ID NO: 490021 - RNA, 19 nt, Homo sapiens
ggauagcacucaauuuauu

SEQ ID NO: 490022 - RNA, 19 nt, Homo sapiens
gcaaagaaccugaagaaga

SEQ ID NO: 490023 - RNA, 19 nt, Homo sapiens
caagagaaauugggugaua

SEQ ID NO: 490024 - RNA, 19 nt, Homo sapiens
ggaagacgaugaaagauca

SEQ ID NO: 490025 - RNA, 19 nt, Homo sapiens
gaaacuggauugacagaug

SEQ ID NO: 490026 - RNA, 19 nt, Homo sapiens
gcaccugucuguacauauu

SEQ ID NO: 490027 - RNA, 19 nt, Homo sapiens
gcaauaugauguguagaua

SEQ ID NO: 490028 - RNA, 19 nt, Homo sapiens
gcacuucaauuaagccaaa

SEQ ID NO: 490029 - RNA, 19 nt, Homo sapiens
ugacaucauuggagaauuu

SEQ ID NO: 490030 - RNA, 19 nt, Homo sapiens
gcaaagugcugagaaggaa

SEQ ID NO: 490031 - RNA, 19 nt, Homo sapiens
guggauagcacucaauuua

SEQ ID NO: 490032 - RNA, 19 nt, Homo sapiens
gaaggaagagcaagagaaa

SEQ ID NO: 490033 - RNA, 19 nt, Homo sapiens
guagauagagcaugaauga

SEQ ID NO: 490034 - RNA, 19 nt, Homo sapiens
gaaaugaaaguuugucuuc

SEQ ID NO: 490035 - RNA, 19 nt, Homo sapiens
aaacugacaucuuaaagga

SEQ ID NO: 490036 - RNA, 19 nt, Homo sapiens
uaauauggguccuuucauu

SEQ ID NO: 490037 - RNA, 19 nt, Homo sapiens
caaggaagauacauagaau

SEQ ID NO: 490038 - RNA, 19 nt, Homo sapiens
uggcuucacucuuauauuu

SEQ ID NO: 490039 - RNA, 19 nt, Homo sapiens
gcucugaaaugaaaguuug

SEQ ID NO: 490040 - RNA, 19 nt, Homo sapiens
guaaacagacaguauugua

SEQ ID NO: 490041 - RNA, 19 nt, Homo sapiens
ccacugcccuccaaaucua

SEQ ID NO: 490042 - RNA, 19 nt, Homo sapiens
gaauuuaaagucccuauga

SEQ ID NO: 490043 - RNA, 19 nt, Homo sapiens
gugaugcucugaaaugaaa

SEQ ID NO: 490044 - RNA, 19 nt, Homo sapiens
aaccugagcuuucuauuga

SEQ ID NO: 490045 - RNA, 19 nt, Homo sapiens
gauagagcaugaaugaaau

SEQ ID NO: 490046 - RNA, 19 nt, Homo sapiens
guaaggcacuaguacaguu

SEQ ID NO: 490047 - RNA, 19 nt, Homo sapiens
caacaaucugugcuuauua

SEQ ID NO: 490048 - RNA, 19 nt, Homo sapiens
gaaggaaugcaggauauuu

SEQ ID NO: 490049 - RNA, 19 nt, Homo sapiens
aaacugaagcaaccucuua

SEQ ID NO: 490050 - RNA, 19 nt, Homo sapiens
aaaaguagcucuccauuau

SEQ ID NO: 490051 - RNA, 19 nt, Homo sapiens
caucuuaaaggacaacuua

SEQ ID NO: 490052 - RNA, 19 nt, Homo sapiens
gguaagaggcugaagaaga

SEQ ID NO: 490053 - RNA, 19 nt, Homo sapiens
caacaacaauuagccauag

SEQ ID NO: 490054 - RNA, 19 nt, Homo sapiens
guaucacacuguuguauau

SEQ ID NO: 490055 - RNA, 19 nt, Homo sapiens
ggacaaggaagauacauag

SEQ ID NO: 490056 - RNA, 19 nt, Homo sapiens
gaaguaaaggaaagaagaa

SEQ ID NO: 490057 - RNA, 19 nt, Homo sapiens
ggggagaagucaacauuua

SEQ ID NO: 490058 - RNA, 19 nt, Homo sapiens
guaccaagauaaacuuaca

SEQ ID NO: 490059 - RNA, 19 nt, Homo sapiens
ggaauggcgugaccugcaa

SEQ ID NO: 490060 - RNA, 19 nt, Homo sapiens
aguauucacuggauuauga

SEQ ID NO: 490061 - RNA, 19 nt, Homo sapiens
gauaucacaccacgucuuu

SEQ ID NO: 490062 - RNA, 19 nt, Homo sapiens
aggagaaguuuaugaauga

SEQ ID NO: 490063 - RNA, 19 nt, Homo sapiens
gauaaacuuacaccacaua

SEQ ID NO: 490064 - RNA, 19 nt, Homo sapiens
ccuaaucuguguauaucua

SEQ ID NO: 490065 - RNA, 19 nt, Homo sapiens
uuaaaggacugcucugugu

SEQ ID NO: 490066 - RNA, 19 nt, Homo sapiens
ugaagcaaccucuuaugua

SEQ ID NO: 490067 - RNA, 19 nt, Homo sapiens
ggagagcugauaauauauu

SEQ ID NO: 490068 - RNA, 19 nt, Homo sapiens
uagaaggaaugcaggauau

SEQ ID NO: 490069 - RNA, 19 nt, Homo sapiens
caacugaacaggagucaau

SEQ ID NO: 490070 - RNA, 19 nt, Homo sapiens
agacaaccauuucguggaa

SEQ ID NO: 490071 - RNA, 19 nt, Homo sapiens
uaagcaauaugauguguag

SEQ ID NO: 490072 - RNA, 19 nt, Homo sapiens
acaacaaucugugcuuauu

SEQ ID NO: 490073 - RNA, 19 nt, Homo sapiens
caacuuaaaccugagcuuu

SEQ ID NO: 490074 - RNA, 19 nt, Homo sapiens
gcccauauagugcucuuua

SEQ ID NO: 490075 - RNA, 19 nt, Homo sapiens
gauuucacaccuacaauaa

SEQ ID NO: 490076 - RNA, 19 nt, Homo sapiens
gauauaggagagcugauaa

SEQ ID NO: 490077 - RNA, 19 nt, Homo sapiens
guagugaugcucugaaaug

SEQ ID NO: 490078 - RNA, 19 nt, Homo sapiens
gagaagucaacauuuauga

SEQ ID NO: 490079 - RNA, 19 nt, Homo sapiens
gcuucacucuuauauuuga

SEQ ID NO: 490080 - RNA, 19 nt, Homo sapiens
cuaacacaauucaguggua

SEQ ID NO: 490081 - RNA, 19 nt, Homo sapiens
aaggagaaguuuaugaaug

SEQ ID NO: 490082 - RNA, 19 nt, Homo sapiens
gaagaagaaauuugagaca

SEQ ID NO: 490083 - RNA, 19 nt, Homo sapiens
gggcacaucugauccuuac

SEQ ID NO: 490084 - RNA, 19 nt, Homo sapiens
acaaacaguucucauuaca

SEQ ID NO: 490085 - RNA, 19 nt, Homo sapiens
guaguuuccucaguggaua

SEQ ID NO: 490086 - RNA, 19 nt, Homo sapiens
gaauagcaccugucuguac

SEQ ID NO: 490087 - RNA, 19 nt, Homo sapiens
agauagagcaugaaugaaa

SEQ ID NO: 490088 - RNA, 19 nt, Homo sapiens
uuaauccugucuucaauga

SEQ ID NO: 490089 - RNA, 19 nt, Homo sapiens
ugacugccgugugugcuua

SEQ ID NO: 490090 - RNA, 19 nt, Homo sapiens
aaacuuacaccacauacuu

SEQ ID NO: 490091 - RNA, 19 nt, Homo sapiens
ucaguaauauggguccuuu

SEQ ID NO: 490092 - RNA, 19 nt, Homo sapiens
aagaagaacccaaagaaga

SEQ ID NO: 490093 - RNA, 19 nt, Homo sapiens
caaggaugaugaugcugaa

SEQ ID NO: 490094 - RNA, 19 nt, Homo sapiens
guggaagggcagccuauua

SEQ ID NO: 490095 - RNA, 19 nt, Homo sapiens
gaaggagaaguuuaugaau

SEQ ID NO: 490096 - RNA, 19 nt, Homo sapiens
ggagaagucaacauuuaug

SEQ ID NO: 490097 - RNA, 19 nt, Homo sapiens
uauaggagagcugauaaua

SEQ ID NO: 490098 - RNA, 19 nt, Homo sapiens
ugaaggagaaguuuaugaa

SEQ ID NO: 490099 - RNA, 19 nt, Homo sapiens
ugaaguaccuuuugaacaa

SEQ ID NO: 490100 - RNA, 19 nt, Homo sapiens
acagacagcuagugaucuu

SEQ ID NO: 490101 - RNA, 19 nt, Homo sapiens
aaauguacauccugugaau

SEQ ID NO: 490102 - RNA, 19 nt, Homo sapiens
caaaauggaggaaaacuaa

SEQ ID NO: 490103 - RNA, 19 nt, Homo sapiens
ccacaagacaguagugaug

SEQ ID NO: 490104 - RNA, 19 nt, Homo sapiens
ugaaacaaaccaagaacaa

SEQ ID NO: 490105 - RNA, 19 nt, Homo sapiens
ucauuugaguaccaagaua

SEQ ID NO: 490106 - RNA, 19 nt, Homo sapiens
cuauguaaauugacugaga

SEQ ID NO: 490107 - RNA, 19 nt, Homo sapiens
uagccaguaucuguaaaua

SEQ ID NO: 490108 - RNA, 19 nt, Homo sapiens
ggacugcucuguguacacu

SEQ ID NO: 490109 - RNA, 19 nt, Homo sapiens
guauuguaaucccaucaaa

SEQ ID NO: 490110 - RNA, 19 nt, Homo sapiens
ggaauccuguuuuaauuug

SEQ ID NO: 490111 - RNA, 19 nt, Homo sapiens
gaaagugcaggugguggua

SEQ ID NO: 490112 - RNA, 19 nt, Homo sapiens
cgacuguucugccaagcaa

SEQ ID NO: 490113 - RNA, 19 nt, Homo sapiens
gaaaugaacuguaguaggu

SEQ ID NO: 490114 - RNA, 19 nt, Homo sapiens
agaauuagcuugagaguaa

SEQ ID NO: 490115 - RNA, 19 nt, Homo sapiens
ugaacaagcugagaaauua

SEQ ID NO: 490116 - RNA, 19 nt, Homo sapiens
ggaaagagaucugugacua

SEQ ID NO: 490117 - RNA, 19 nt, Homo sapiens
caaagaauguguuucacua

SEQ ID NO: 490118 - RNA, 19 nt, Homo sapiens
ccaccuaagucuucauuua

SEQ ID NO: 490119 - RNA, 19 nt, Homo sapiens
gaagaagcauaaagugaaa

SEQ ID NO: 490120 - RNA, 19 nt, Homo sapiens
gaagaagacucaugugaag

SEQ ID NO: 490121 - RNA, 19 nt, Homo sapiens
gcacuucccuuacuucaga

SEQ ID NO: 490122 - RNA, 19 nt, Homo sapiens
caaauuagcacaacaaaga

SEQ ID NO: 490123 - RNA, 19 nt, Homo sapiens
ggagagcacuggaaagaga

SEQ ID NO: 490124 - RNA, 19 nt, Homo sapiens
gaugagaccuuuacauucu

SEQ ID NO: 490125 - RNA, 19 nt, Homo sapiens
ccaaugcaguguucaauga

SEQ ID NO: 490126 - RNA, 19 nt, Homo sapiens
gaauacaacuucgagagaa

SEQ ID NO: 490127 - RNA, 19 nt, Homo sapiens
ggacagaacacgcaguaaa

SEQ ID NO: 490128 - RNA, 19 nt, Homo sapiens
gaaagcaacaugaaaugaa

SEQ ID NO: 490129 - RNA, 19 nt, Homo sapiens
gaaccauggccuuggauua

SEQ ID NO: 490130 - RNA, 19 nt, Homo sapiens
ggagacaaauugccaagug

SEQ ID NO: 490131 - RNA, 19 nt, Homo sapiens
ucaaugagcuguuugucuu

SEQ ID NO: 490132 - RNA, 19 nt, Homo sapiens
gagaauguguuugauauca

SEQ ID NO: 490133 - RNA, 19 nt, Homo sapiens
uaacugugguugucuuaaa

SEQ ID NO: 490134 - RNA, 19 nt, Homo sapiens
uaacaagacuccuccauac

SEQ ID NO: 490135 - RNA, 19 nt, Homo sapiens
gccagaaucccaaauuaua

SEQ ID NO: 490136 - RNA, 19 nt, Homo sapiens
uuacauauguucacgcaaa

SEQ ID NO: 490137 - RNA, 19 nt, Homo sapiens
acacacaaauccaagaauu

SEQ ID NO: 490138 - RNA, 19 nt, Homo sapiens
gugccagaaucccaaauua

SEQ ID NO: 490139 - RNA, 19 nt, Homo sapiens
gaugaccucugacccauau

SEQ ID NO: 490140 - RNA, 19 nt, Homo sapiens
uucagaaccuguuagauua

SEQ ID NO: 490141 - RNA, 19 nt, Homo sapiens
cacuguggcugaaauauaa

SEQ ID NO: 490142 - RNA, 19 nt, Homo sapiens
gaacacuguggcugaaaua

SEQ ID NO: 490143 - RNA, 19 nt, Homo sapiens
gaauuggccuugcacuuca

SEQ ID NO: 490144 - RNA, 19 nt, Homo sapiens
aaacuagagugcugagaaa

SEQ ID NO: 490145 - RNA, 19 nt, Homo sapiens
gagaagaagcauaaaguga

SEQ ID NO: 490146 - RNA, 19 nt, Homo sapiens
gcugggaacucucuucuuc

SEQ ID NO: 490147 - RNA, 19 nt, Homo sapiens
gcaaaugguuguccugcau

SEQ ID NO: 490148 - RNA, 19 nt, Homo sapiens
gagagaucaucaagagaaa

SEQ ID NO: 490149 - RNA, 19 nt, Homo sapiens
gauuuguucugauguugua

SEQ ID NO: 490150 - RNA, 19 nt, Homo sapiens
caaauccugcacuguauua

SEQ ID NO: 490151 - RNA, 19 nt, Homo sapiens
ccugagaaaucccuaugua

SEQ ID NO: 490152 - RNA, 19 nt, Homo sapiens
gggauacccuacacacaaa

SEQ ID NO: 490153 - RNA, 19 nt, Homo sapiens
caacaaaggaauugaaaca

SEQ ID NO: 490154 - RNA, 19 nt, Homo sapiens
ucacaguguuuguaaauuc

SEQ ID NO: 490155 - RNA, 19 nt, Homo sapiens
gguauagugugcaagugua

SEQ ID NO: 490156 - RNA, 19 nt, Homo sapiens
gcacuguauuaaacaugua

SEQ ID NO: 490157 - RNA, 19 nt, Homo sapiens
gaaaagaauuagcuugaga

SEQ ID NO: 490158 - RNA, 19 nt, Homo sapiens
gccuugcacuucacaauuu

SEQ ID NO: 490159 - RNA, 19 nt, Homo sapiens
guucugauguuguaacuca

SEQ ID NO: 490160 - RNA, 19 nt, Homo sapiens
gaaaccaacaacaaacauu

SEQ ID NO: 490161 - RNA, 19 nt, Homo sapiens
caacaugaaaugaacugua

SEQ ID NO: 490162 - RNA, 19 nt, Homo sapiens
gauaucacaguguuuguaa

SEQ ID NO: 490163 - RNA, 19 nt, Homo sapiens
uaagggaguugauauuuac

SEQ ID NO: 490164 - RNA, 19 nt, Homo sapiens
agggagaucuuaauaccua

SEQ ID NO: 490165 - RNA, 19 nt, Homo sapiens
ugagaguaaugucacuaua

SEQ ID NO: 490166 - RNA, 19 nt, Homo sapiens
ggaauagucagacauuuua

SEQ ID NO: 490167 - RNA, 19 nt, Homo sapiens
gugagggccuugaagauau

SEQ ID NO: 490168 - RNA, 19 nt, Homo sapiens
gaagacucaugugaagaaa

SEQ ID NO: 490169 - RNA, 19 nt, Homo sapiens
uguaagaccauguuuguaa

SEQ ID NO: 490170 - RNA, 19 nt, Homo sapiens
uguaguagguguguaguuu

SEQ ID NO: 490171 - RNA, 19 nt, Homo sapiens
ccagaaucccaaauuauaa

SEQ ID NO: 490172 - RNA, 19 nt, Homo sapiens
agacucaugugaagaaaug

SEQ ID NO: 490173 - RNA, 19 nt, Homo sapiens
ccacaaacacucuaacugu

SEQ ID NO: 490174 - RNA, 19 nt, Homo sapiens
caaugaaaccaacaacaaa

SEQ ID NO: 490175 - RNA, 19 nt, Homo sapiens
agauuaagaugcuacuuga

SEQ ID NO: 490176 - RNA, 19 nt, Homo sapiens
gagaguaaugucacuauau

SEQ ID NO: 490177 - RNA, 19 nt, Homo sapiens
gugccaggguucugaaauu

SEQ ID NO: 490178 - RNA, 19 nt, Homo sapiens
gaauguguuucacuaucuu

SEQ ID NO: 490179 - RNA, 19 nt, Homo sapiens
gaaaagacugugaagauuu

SEQ ID NO: 490180 - RNA, 19 nt, Homo sapiens
ggugguagcagcugaggua

SEQ ID NO: 490181 - RNA, 19 nt, Homo sapiens
uaauuugucuugagcuguu

SEQ ID NO: 490182 - RNA, 19 nt, Homo sapiens
gaacaagcugagaaauuau

SEQ ID NO: 490183 - RNA, 19 nt, Homo sapiens
gaaaaucauccaagucuaa

SEQ ID NO: 490184 - RNA, 19 nt, Homo sapiens
uaagaaccauggccuugga

SEQ ID NO: 490185 - RNA, 19 nt, Homo sapiens
ugagggccuugaagauaua

SEQ ID NO: 490186 - RNA, 19 nt, Homo sapiens
gaaccuguaccaugccaaa

SEQ ID NO: 490187 - RNA, 19 nt, Homo sapiens
gguagcagcugagguaugg

SEQ ID NO: 490188 - RNA, 19 nt, Homo sapiens
gaacuguaguaggugugua

SEQ ID NO: 490189 - RNA, 19 nt, Homo sapiens
gucuugagcuguugucuau

SEQ ID NO: 490190 - RNA, 19 nt, Homo sapiens
ccaguuagaagugcaauuu

SEQ ID NO: 490191 - RNA, 19 nt, Homo sapiens
aaaaguaucuggucauuuc

SEQ ID NO: 490192 - RNA, 19 nt, Homo sapiens
uauauuggauugcaagcuu

SEQ ID NO: 490193 - RNA, 19 nt, Homo sapiens
guaagaccauguuuguaag

SEQ ID NO: 490194 - RNA, 19 nt, Homo sapiens
gcagggagaucuuaauacc

SEQ ID NO: 490195 - RNA, 19 nt, Homo sapiens
cuaacaagacuccuccaua

SEQ ID NO: 490196 - RNA, 19 nt, Homo sapiens
caccuaagucuucauuuaa

SEQ ID NO: 490197 - RNA, 19 nt, Homo sapiens
gugaacaagcugagaaauu

SEQ ID NO: 490198 - RNA, 19 nt, Homo sapiens
guugauauuuacccugaaa

SEQ ID NO: 490199 - RNA, 19 nt, Homo sapiens
gaaaagaaacaacaaagga

SEQ ID NO: 490200 - RNA, 19 nt, Homo sapiens
agaagaagcauaaagugaa

SEQ ID NO: 490201 - RNA, 19 nt, Homo sapiens
ugacuaugccuaauguaaa

SEQ ID NO: 490202 - RNA, 19 nt, Homo sapiens
gaguggaacuugaguacag

SEQ ID NO: 490203 - RNA, 19 nt, Homo sapiens
ugaauuaguagaccagaaa

SEQ ID NO: 490204 - RNA, 19 nt, Homo sapiens
ccaagaagaagacucaugu

SEQ ID NO: 490205 - RNA, 19 nt, Homo sapiens
auagagagaucaucaagag

SEQ ID NO: 490206 - RNA, 19 nt, Homo sapiens
gaauagagagaucaucaag

SEQ ID NO: 490207 - RNA, 19 nt, Homo sapiens
aagcauuuguggucaauau

SEQ ID NO: 490208 - RNA, 19 nt, Homo sapiens
guaccuuugugaaauuguu

SEQ ID NO: 490209 - RNA, 19 nt, Homo sapiens
gagaucaucaagagaaaug

SEQ ID NO: 490210 - RNA, 19 nt, Homo sapiens
ugacgauccucccagagaa

SEQ ID NO: 490211 - RNA, 19 nt, Homo sapiens
cagaaccuguuagauuaaa

SEQ ID NO: 490212 - RNA, 19 nt, Homo sapiens
ccaacaaacaaauguaaga

SEQ ID NO: 490213 - RNA, 19 nt, Homo sapiens
ccaaccaucugaaccauuc

SEQ ID NO: 490214 - RNA, 19 nt, Homo sapiens
ggacguaggaggacuguca

SEQ ID NO: 490215 - RNA, 19 nt, Homo sapiens
aaaccaccaucaagaagaa

SEQ ID NO: 490216 - RNA, 19 nt, Homo sapiens
gaguuggaguucuuuguug

SEQ ID NO: 490217 - RNA, 19 nt, Homo sapiens
ggccaagccuggacucuag

SEQ ID NO: 490218 - RNA, 19 nt, Homo sapiens
ggaguuggaguucuuuguu

SEQ ID NO: 490219 - RNA, 19 nt, Homo sapiens
gcaacgcggucugcugguu

SEQ ID NO: 490220 - RNA, 19 nt, Homo sapiens
gcucuccucucucuuccaa

SEQ ID NO: 490221 - RNA, 19 nt, Homo sapiens
gaagaagauggacguagga

SEQ ID NO: 490222 - RNA, 19 nt, Homo sapiens
gcuucgaggugcccuguga

SEQ ID NO: 490223 - RNA, 19 nt, Homo sapiens
aguacucccuggauuauga

SEQ ID NO: 490224 - RNA, 19 nt, Homo sapiens
gcaguacucccuggauuau

SEQ ID NO: 490225 - RNA, 19 nt, Homo sapiens
caaggugcagccagaagua

SEQ ID NO: 490226 - RNA, 19 nt, Homo sapiens
ggccagaguuacauagaca

SEQ ID NO: 490227 - RNA, 19 nt, Homo sapiens
ucaagaagaacacucugaa

SEQ ID NO: 490228 - RNA, 19 nt, Homo sapiens
gaggugcgggucccuauga

SEQ ID NO: 490229 - RNA, 19 nt, Homo sapiens
caugggaguuggaguucuu

SEQ ID NO: 490230 - RNA, 19 nt, Homo sapiens
ucucaggccuccucaucuu

SEQ ID NO: 490231 - RNA, 19 nt, Homo sapiens
acgacaagcugggcaagaa

SEQ ID NO: 490232 - RNA, 19 nt, Homo sapiens
ugaccgugcuggacuacga

SEQ ID NO: 490233 - RNA, 19 nt, Homo sapiens
gaagaaaaccaccaucaag

SEQ ID NO: 490234 - RNA, 19 nt, Homo sapiens
gaccgcuucucucgcaaug

SEQ ID NO: 490235 - RNA, 19 nt, Homo sapiens
ccuauuacaacgaagcuuu

SEQ ID NO: 490236 - RNA, 19 nt, Homo sapiens
gaaccccuauuacaacgaa

SEQ ID NO: 490237 - RNA, 19 nt, Homo sapiens
aaccauuccugucuucuca

SEQ ID NO: 490238 - RNA, 19 nt, Homo sapiens
guaggaggacugucagauc

SEQ ID NO: 490239 - RNA, 19 nt, Homo sapiens
cgucugcucuccucucucu

SEQ ID NO: 490240 - RNA, 19 nt, Homo sapiens
gggagaccuucgccuucaa

SEQ ID NO: 490241 - RNA, 19 nt, Homo sapiens
cugcaguacucccuggauu

SEQ ID NO: 490242 - RNA, 19 nt, Homo sapiens
agaguuacauagacaaggu

SEQ ID NO: 490243 - RNA, 19 nt, Homo sapiens
ucauggcgguguacgacuu

SEQ ID NO: 490244 - RNA, 19 nt, Homo sapiens
cuagggugcuugagugucu

SEQ ID NO: 490245 - RNA, 19 nt, Homo sapiens
ggaggacugucagauccau

SEQ ID NO: 490246 - RNA, 19 nt, Homo sapiens
gggauuggcagccuuggau

SEQ ID NO: 490247 - RNA, 19 nt, Homo sapiens
gaaccauuccugucuucuc

SEQ ID NO: 490248 - RNA, 19 nt, Homo sapiens
caaccagcuuugcucuuac

SEQ ID NO: 490249 - RNA, 19 nt, Homo sapiens
cgacuucgaccgcuucucu

SEQ ID NO: 490250 - RNA, 19 nt, Homo sapiens
ccgggaagcucaccgucau

SEQ ID NO: 490251 - RNA, 19 nt, Homo sapiens
gggaggagcaggagaagcu

SEQ ID NO: 490252 - RNA, 19 nt, Homo sapiens
ugcaguacucccuggauua

SEQ ID NO: 490253 - RNA, 19 nt, Homo sapiens
ggucucaggccuccucauc

SEQ ID NO: 490254 - RNA, 19 nt, Homo sapiens
uugagugucucugcagaaa

SEQ ID NO: 490255 - RNA, 19 nt, Homo sapiens
ccugaggccaaauaaauau

SEQ ID NO: 490256 - RNA, 19 nt, Homo sapiens
caagccagccccacccuua

SEQ ID NO: 490257 - RNA, 19 nt, Homo sapiens
cgaggugcccugugaccaa

SEQ ID NO: 490258 - RNA, 19 nt, Homo sapiens
ucaucguccuggaggcuaa

SEQ ID NO: 490259 - RNA, 19 nt, Homo sapiens
ucuccucucucuuccaaca

SEQ ID NO: 490260 - RNA, 19 nt, Homo sapiens
ccucaugggaguuggaguu

SEQ ID NO: 490261 - RNA, 19 nt, Homo sapiens
acgcugaacccucacuuug

SEQ ID NO: 490262 - RNA, 19 nt, Homo sapiens
gacgcugaacccucacuuu

SEQ ID NO: 490263 - RNA, 19 nt, Homo sapiens
ggauuaugacuuccagagu

SEQ ID NO: 490264 - RNA, 19 nt, Homo sapiens
uccugaggccaaauaaaua

SEQ ID NO: 490265 - RNA, 19 nt, Homo sapiens
aagcuuccucugacgguua

SEQ ID NO: 490266 - RNA, 19 nt, Homo sapiens
uaggacgacugcaguacuc

SEQ ID NO: 490267 - RNA, 19 nt, Homo sapiens
gggccagaguuacauagac

SEQ ID NO: 490268 - RNA, 19 nt, Homo sapiens
cuccugaggccaaauaaau

SEQ ID NO: 490269 - RNA, 19 nt, Homo sapiens
gcuccugaggccaaauaaa

SEQ ID NO: 490270 - RNA, 19 nt, Homo sapiens
gaaaaccaccaucaagaag

SEQ ID NO: 490271 - RNA, 19 nt, Homo sapiens
ggaggcugauacuacaacu

SEQ ID NO: 490272 - RNA, 19 nt, Homo sapiens
caagaagaacacucugaac

SEQ ID NO: 490273 - RNA, 19 nt, Homo sapiens
ugucagauccauacgucaa

SEQ ID NO: 490274 - RNA, 19 nt, Homo sapiens
gaggacugucagauccaua

SEQ ID NO: 490275 - RNA, 19 nt, Homo sapiens
ucugaaccauuccugucuu

SEQ ID NO: 490276 - RNA, 19 nt, Homo sapiens
gcucuuaccccgcuugaga

SEQ ID NO: 490277 - RNA, 19 nt, Homo sapiens
gagugucucugcagaaaag

SEQ ID NO: 490278 - RNA, 19 nt, Homo sapiens
ggaaagaagugaucacaaa

SEQ ID NO: 490279 - RNA, 19 nt, Homo sapiens
caacucaccugcauguuua

SEQ ID NO: 490280 - RNA, 19 nt, Homo sapiens
ucaaggagcucaccaauga

SEQ ID NO: 490281 - RNA, 19 nt, Homo sapiens
gaacaauucuccaaccuau

SEQ ID NO: 490282 - RNA, 19 nt, Homo sapiens
gaucacagcucuuaaaauu

SEQ ID NO: 490283 - RNA, 19 nt, Homo sapiens
gcuaaucucuuguguuguu

SEQ ID NO: 490284 - RNA, 19 nt, Homo sapiens
uagcuaaucucuuguguug

SEQ ID NO: 490285 - RNA, 19 nt, Homo sapiens
caaaguagccaaagacaau

SEQ ID NO: 490286 - RNA, 19 nt, Homo sapiens
ggaaaugcagccucaguaa

SEQ ID NO: 490287 - RNA, 19 nt, Homo sapiens
ucauagcggugacugcuua

SEQ ID NO: 490288 - RNA, 19 nt, Homo sapiens
gaggagaucacagcucuua

SEQ ID NO: 490289 - RNA, 19 nt, Homo sapiens
caaagacaaucagcagaaa

SEQ ID NO: 490290 - RNA, 19 nt, Homo sapiens
gaacccaacuguggagaug

SEQ ID NO: 490291 - RNA, 19 nt, Homo sapiens
ggagaucacagcucuuaaa

SEQ ID NO: 490292 - RNA, 19 nt, Homo sapiens
gaagugaucacaaagagau

SEQ ID NO: 490293 - RNA, 19 nt, Homo sapiens
gagaugaucgugaccaaga

SEQ ID NO: 490294 - RNA, 19 nt, Homo sapiens
gagaacagcacuacuacug

SEQ ID NO: 490295 - RNA, 19 nt, Homo sapiens
ugacuggauugaccuacua

SEQ ID NO: 490296 - RNA, 19 nt, Homo sapiens
ugaacuccuugcauaagua

SEQ ID NO: 490297 - RNA, 19 nt, Homo sapiens
ccaaagacaaucagcagaa

SEQ ID NO: 490298 - RNA, 19 nt, Homo sapiens
auauguagcuaaucucuug

SEQ ID NO: 490299 - RNA, 19 nt, Homo sapiens
ggaacaauucuccaaccua

SEQ ID NO: 490300 - RNA, 19 nt, Homo sapiens
gaaagaagugaucacaaag

SEQ ID NO: 490301 - RNA, 19 nt, Homo sapiens
ggaagguggaucucaggua

SEQ ID NO: 490302 - RNA, 19 nt, Homo sapiens
gcaaaggaaagaagugauc

SEQ ID NO: 490303 - RNA, 19 nt, Homo sapiens
gugauucguccaguuauua

SEQ ID NO: 490304 - RNA, 19 nt, Homo sapiens
aaagcacacucuuaaucuu

SEQ ID NO: 490305 - RNA, 19 nt, Homo sapiens
gaucucagguagcgagucu

SEQ ID NO: 490306 - RNA, 19 nt, Homo sapiens
aagcauauguagcuaaucu

SEQ ID NO: 490307 - RNA, 19 nt, Homo sapiens
uuaaucuucuuccuuguug

SEQ ID NO: 490308 - RNA, 19 nt, Homo sapiens
caguggcagucucagguua

SEQ ID NO: 490309 - RNA, 19 nt, Homo sapiens
gcaaaagcuuuccuugaug

SEQ ID NO: 490310 - RNA, 19 nt, Homo sapiens
uaaguacaauccauuugca

SEQ ID NO: 490311 - RNA, 19 nt, Homo sapiens
gaacuccuugcauaaguau

SEQ ID NO: 490312 - RNA, 19 nt, Homo sapiens
acaaucagcagaaagcauu

SEQ ID NO: 490313 - RNA, 19 nt, Homo sapiens
aguuagaguugagcuguua

SEQ ID NO: 490314 - RNA, 19 nt, Homo sapiens
acaacucaccugcauguuu

SEQ ID NO: 490315 - RNA, 19 nt, Homo sapiens
caaauccucauccucaguu

SEQ ID NO: 490316 - RNA, 19 nt, Homo sapiens
aaagaagugaucacaaaga

SEQ ID NO: 490317 - RNA, 19 nt, Homo sapiens
aagcuuuccuugaugcaaa

SEQ ID NO: 490318 - RNA, 19 nt, Homo sapiens
ugagcgccguggagaauga

SEQ ID NO: 490319 - RNA, 19 nt, Homo sapiens
agucucagguuaagaagga

SEQ ID NO: 490320 - RNA, 19 nt, Homo sapiens
ccucgaauccacauaguga

SEQ ID NO: 490321 - RNA, 19 nt, Homo sapiens
aagucaagcucaccaacaa

SEQ ID NO: 490322 - RNA, 19 nt, Homo sapiens
gaacggcaggaggauguuu

SEQ ID NO: 490323 - RNA, 19 nt, Homo sapiens
aaugugauucguccaguua

SEQ ID NO: 490324 - RNA, 19 nt, Homo sapiens
caccagaauuuguaaacuc

SEQ ID NO: 490325 - RNA, 19 nt, Homo sapiens
gcacaccagaauuuguaaa

SEQ ID NO: 490326 - RNA, 19 nt, Homo sapiens
ugacaacucaccugcaugu

SEQ ID NO: 490327 - RNA, 19 nt, Homo sapiens
acaauucuccaaccuauuc

SEQ ID NO: 490328 - RNA, 19 nt, Homo sapiens
gcacacucuuaaucuucuu

SEQ ID NO: 490329 - RNA, 19 nt, Homo sapiens
guccuacuuuagugagaua

SEQ ID NO: 490330 - RNA, 19 nt, Homo sapiens
gaaaugcagccucaguaac

SEQ ID NO: 490331 - RNA, 19 nt, Homo sapiens
ccaacgccauguacuccuu

SEQ ID NO: 490332 - RNA, 19 nt, Homo sapiens
cgggaaagagccugcagua

SEQ ID NO: 490333 - RNA, 19 nt, Homo sapiens
uggcacaccagaauuugua

SEQ ID NO: 490334 - RNA, 19 nt, Homo sapiens
gccaggguccagaaacuuu

SEQ ID NO: 490335 - RNA, 19 nt, Homo sapiens
gacagcagguuuuaguuga

SEQ ID NO: 490336 - RNA, 19 nt, Homo sapiens
gcccaggucccgaaagaug

SEQ ID NO: 490337 - RNA, 19 nt, Homo sapiens
aagaagugaucacaaagag

SEQ ID NO: 490338 - RNA, 19 nt, Homo sapiens
ggugacugcuuaucagaac

SEQ ID NO: 490339 - RNA, 19 nt, Homo sapiens
gaauccacauagugagagu

SEQ ID NO: 490340 - RNA, 19 nt, Homo sapiens
cuaaucucuuguguuguua

SEQ ID NO: 490341 - RNA, 19 nt, Homo sapiens
caccaguccuacuuuagug

SEQ ID NO: 490342 - RNA, 19 nt, Homo sapiens
guaaacuccaccaguccua

SEQ ID NO: 490343 - RNA, 19 nt, Homo sapiens
ggcagucucagguuaagaa

SEQ ID NO: 490344 - RNA, 19 nt, Homo sapiens
gcugcaaucccaugacaau

SEQ ID NO: 490345 - RNA, 19 nt, Homo sapiens
gcaaagucaagcucaccaa

SEQ ID NO: 490346 - RNA, 19 nt, Homo sapiens
cuccaccaguccuacuuua

SEQ ID NO: 490347 - RNA, 19 nt, Homo sapiens
ccuaccagcuccagucagu

SEQ ID NO: 490348 - RNA, 19 nt, Homo sapiens
gcaaauccucauccucagu

SEQ ID NO: 490349 - RNA, 19 nt, Homo sapiens
ugugauucguccaguuauu

SEQ ID NO: 490350 - RNA, 19 nt, Homo sapiens
aaaugugauucguccaguu

SEQ ID NO: 490351 - RNA, 19 nt, Homo sapiens
ggacagcagguuuuaguug

SEQ ID NO: 490352 - RNA, 19 nt, Homo sapiens
cgcgagaacagcacuacua

SEQ ID NO: 490353 - RNA, 19 nt, Homo sapiens
gcauauguagcuaaucucu

SEQ ID NO: 490354 - RNA, 19 nt, Homo sapiens
guuuauccaugcugcaauc

SEQ ID NO: 490355 - RNA, 19 nt, Homo sapiens
caaaggaaagaagugauca

SEQ ID NO: 490356 - RNA, 19 nt, Homo sapiens
gacaaaguagccaaagaca

SEQ ID NO: 490357 - RNA, 19 nt, Homo sapiens
ucucuuguguuguuaaacu

SEQ ID NO: 490358 - RNA, 19 nt, Homo sapiens
ccaccaguccuacuuuagu

SEQ ID NO: 490359 - RNA, 19 nt, Homo sapiens
gucgccaccuuccauguga

SEQ ID NO: 490360 - RNA, 19 nt, Homo sapiens
aaccuauucugacaacuca

SEQ ID NO: 490361 - RNA, 19 nt, Homo sapiens
ucuccaaccuauucugaca

SEQ ID NO: 490362 - RNA, 19 nt, Homo sapiens
gcugagcgccguggagaau

SEQ ID NO: 490363 - RNA, 19 nt, Homo sapiens
caucggaacaauucuccaa

SEQ ID NO: 490364 - RNA, 19 nt, Homo sapiens
gagccucgaauccacauag

SEQ ID NO: 490365 - RNA, 19 nt, Homo sapiens
ugacaaaguagccaaagac

SEQ ID NO: 490366 - RNA, 19 nt, Homo sapiens
ccuagaauguguguauuuu

SEQ ID NO: 490367 - RNA, 19 nt, Homo sapiens
cccgaaagaugcagugacu

SEQ ID NO: 490368 - RNA, 19 nt, Homo sapiens
gacaaccaccgcuggaagu

SEQ ID NO: 490369 - RNA, 19 nt, Homo sapiens
cacaaugccagcccaccua

SEQ ID NO: 490370 - RNA, 19 nt, Homo sapiens
ucugacaacucaccugcau

SEQ ID NO: 490371 - RNA, 19 nt, Homo sapiens
caaccuauucugacaacuc

SEQ ID NO: 490372 - RNA, 19 nt, Homo sapiens
gcuuauuuccguccauuuc

SEQ ID NO: 490373 - RNA, 19 nt, Homo sapiens
guacaauccauuugcaaaa

SEQ ID NO: 490374 - RNA, 19 nt, Homo sapiens
ggacaggugcaccggaaac

SEQ ID NO: 490375 - RNA, 19 nt, Homo sapiens
ggauguuuccggugcugaa

SEQ ID NO: 490376 - RNA, 19 nt, Homo sapiens
aaaugcagccucaguaacu

SEQ ID NO: 490377 - RNA, 19 nt, Homo sapiens
aggaaaugcagccucagua

SEQ ID NO: 490378 - RNA, 19 nt, Homo sapiens
gcacuaugaggaauaauua

SEQ ID NO: 490379 - RNA, 19 nt, Homo sapiens
uaaauucuguggcuuauga

SEQ ID NO: 490380 - RNA, 19 nt, Homo sapiens
ccaaugaugaucugaauua

SEQ ID NO: 490381 - RNA, 19 nt, Homo sapiens
gcaaugacagguaaauuaa

SEQ ID NO: 490382 - RNA, 19 nt, Homo sapiens
gcacugagcaggcgaaaga

SEQ ID NO: 490383 - RNA, 19 nt, Homo sapiens
ggcaaugacagguaaauua

SEQ ID NO: 490384 - RNA, 19 nt, Homo sapiens
gcagaauuaugaaagaaga

SEQ ID NO: 490385 - RNA, 19 nt, Homo sapiens
uguaugauguguugugaua

SEQ ID NO: 490386 - RNA, 19 nt, Homo sapiens
gcaguucuuuggauuaaug

SEQ ID NO: 490387 - RNA, 19 nt, Homo sapiens
gcugauuccucaauugaaa

SEQ ID NO: 490388 - RNA, 19 nt, Homo sapiens
gaaauaggagccaaugaug

SEQ ID NO: 490389 - RNA, 19 nt, Homo sapiens
gcacaguguuaaaugaaau

SEQ ID NO: 490390 - RNA, 19 nt, Homo sapiens
cagcaguucuuuggauuaa

SEQ ID NO: 490391 - RNA, 19 nt, Homo sapiens
guacugagauuuugguauu

SEQ ID NO: 490392 - RNA, 19 nt, Homo sapiens
gauacagucccuaaagaaa

SEQ ID NO: 490393 - RNA, 19 nt, Homo sapiens
aaagcacaguguuaaauga

SEQ ID NO: 490394 - RNA, 19 nt, Homo sapiens
gauguguugugauagcuaa

SEQ ID NO: 490395 - RNA, 19 nt, Homo sapiens
auuaagacaugcacuauga

SEQ ID NO: 490396 - RNA, 19 nt, Homo sapiens
ggaaacuccugacagucuu

SEQ ID NO: 490397 - RNA, 19 nt, Homo sapiens
acagguaaauuaagacaug

SEQ ID NO: 490398 - RNA, 19 nt, Homo sapiens
gcuguuugcagaagaaaua

SEQ ID NO: 490399 - RNA, 19 nt, Homo sapiens
gugguuauuucucaacaaa

SEQ ID NO: 490400 - RNA, 19 nt, Homo sapiens
gaagaaauaggagccaaug

SEQ ID NO: 490401 - RNA, 19 nt, Homo sapiens
gaugcugauuccucaauug

SEQ ID NO: 490402 - RNA, 19 nt, Homo sapiens
caaagcacaguguuaaaug

SEQ ID NO: 490403 - RNA, 19 nt, Homo sapiens
gcaaugcagaauuaugaaa

SEQ ID NO: 490404 - RNA, 19 nt, Homo sapiens
ggccagaucucucacaaaa

SEQ ID NO: 490405 - RNA, 19 nt, Homo sapiens
ggaugcugauuccucaauu

SEQ ID NO: 490406 - RNA, 19 nt, Homo sapiens
ccagaucucucacaaaaga

SEQ ID NO: 490407 - RNA, 19 nt, Homo sapiens
gcaaacgggaugcugauuc

SEQ ID NO: 490408 - RNA, 19 nt, Homo sapiens
gacccaagccucagcaguu

SEQ ID NO: 490409 - RNA, 19 nt, Homo sapiens
ucaaugauacagucccuaa

SEQ ID NO: 490410 - RNA, 19 nt, Homo sapiens
uaugaugacucccuuaaaa

SEQ ID NO: 490411 - RNA, 19 nt, Homo sapiens
uuauucagcuucauuugug

SEQ ID NO: 490412 - RNA, 19 nt, Homo sapiens
ucaaugugauucuaauguc

SEQ ID NO: 490413 - RNA, 19 nt, Homo sapiens
gugacuauauagagauguu

SEQ ID NO: 490414 - RNA, 19 nt, Homo sapiens
caugcacuaugaggaauaa

SEQ ID NO: 490415 - RNA, 19 nt, Homo sapiens
guugugauagcuaacauuu

SEQ ID NO: 490416 - RNA, 19 nt, Homo sapiens
cagcuucauuugugucaau

SEQ ID NO: 490417 - RNA, 19 nt, Homo sapiens
augaugaucugaauuacug

SEQ ID NO: 490418 - RNA, 19 nt, Homo sapiens
agaaauaggagccaaugau

SEQ ID NO: 490419 - RNA, 19 nt, Homo sapiens
agacaugcacuaugaggaa

SEQ ID NO: 490420 - RNA, 19 nt, Homo sapiens
aaugggcaaugacagguaa

SEQ ID NO: 490421 - RNA, 19 nt, Homo sapiens
ccucagcaguucuuuggau

SEQ ID NO: 490422 - RNA, 19 nt, Homo sapiens
aaauaggagccaaugauga

SEQ ID NO: 490423 - RNA, 19 nt, Homo sapiens
caaguggcccuguuaaagg

SEQ ID NO: 490424 - RNA, 19 nt, Homo sapiens
caaugugauucuaaugucu

SEQ ID NO: 490425 - RNA, 19 nt, Homo sapiens
caaacgggaugcugauucc

SEQ ID NO: 490426 - RNA, 19 nt, Homo sapiens
ugauacagucccuaaagaa

SEQ ID NO: 490427 - RNA, 19 nt, Homo sapiens
ucagcaguucuuuggauua

SEQ ID NO: 490428 - RNA, 19 nt, Homo sapiens
gaacugccggagcccuuug

SEQ ID NO: 490429 - RNA, 19 nt, Homo sapiens
caauaugaugacucccuua

SEQ ID NO: 490430 - RNA, 19 nt, Homo sapiens
ucagcuguuugcagaagaa

SEQ ID NO: 490431 - RNA, 19 nt, Homo sapiens
acaaagcacaguguuaaau

SEQ ID NO: 490432 - RNA, 19 nt, Homo sapiens
gguuauuucucaacaaagc

SEQ ID NO: 490433 - RNA, 19 nt, Homo sapiens
aauaugaugacucccuuaa

SEQ ID NO: 490434 - RNA, 19 nt, Homo sapiens
gacaugcacuaugaggaau

SEQ ID NO: 490435 - RNA, 19 nt, Homo sapiens
ugucuccacucagcuguuu

SEQ ID NO: 490436 - RNA, 19 nt, Homo sapiens
gaaacuccugacagucuug

SEQ ID NO: 490437 - RNA, 19 nt, Homo sapiens
gagccaaugaugaucugaa

SEQ ID NO: 490438 - RNA, 19 nt, Homo sapiens
gggcaaugacagguaaauu

SEQ ID NO: 490439 - RNA, 19 nt, Homo sapiens
gacauggccagaucucuca

SEQ ID NO: 490440 - RNA, 19 nt, Homo sapiens
gaagcaguugugucagcua

SEQ ID NO: 490441 - RNA, 19 nt, Homo sapiens
gcucggaggaaccagagaa

SEQ ID NO: 490442 - RNA, 19 nt, Homo sapiens
caaugggcaaugacaggua

SEQ ID NO: 490443 - RNA, 19 nt, Homo sapiens
aauaggagccaaugaugau

SEQ ID NO: 490444 - RNA, 19 nt, Homo sapiens
ggaacugccggagcccuuu

SEQ ID NO: 490445 - RNA, 19 nt, Homo sapiens
guaaaaccugucaaugaua

SEQ ID NO: 490446 - RNA, 19 nt, Homo sapiens
uguaaaaccugucaaugau

SEQ ID NO: 490447 - RNA, 19 nt, Homo sapiens
guacgacagcgaccagauc

SEQ ID NO: 490448 - RNA, 19 nt, Homo sapiens
caaugaugaucugaauuac

SEQ ID NO: 490449 - RNA, 19 nt, Homo sapiens
augauacagucccuaaaga

SEQ ID NO: 490450 - RNA, 19 nt, Homo sapiens
gcaaaauccaacaugaaaa

SEQ ID NO: 490451 - RNA, 19 nt, Homo sapiens
caaugcagaauuaugaaag

SEQ ID NO: 490452 - RNA, 19 nt, Homo sapiens
cuuuaaauucuguggcuua

SEQ ID NO: 490453 - RNA, 19 nt, Homo sapiens
acaaguggcccuguuaaag

SEQ ID NO: 490454 - RNA, 19 nt, Homo sapiens
ugaugacucccuuaaaaua

SEQ ID NO: 490455 - RNA, 19 nt, Homo sapiens
ggaggaaccagagaaacuc

SEQ ID NO: 490456 - RNA, 19 nt, Homo sapiens
uuguaucucugaagcaugu

SEQ ID NO: 490457 - RNA, 19 nt, Homo sapiens
cgacagcgaccagaucaag

SEQ ID NO: 490458 - RNA, 19 nt, Homo sapiens
uaaaaccugucaaugauac

SEQ ID NO: 490459 - RNA, 19 nt, Homo sapiens
caaugauacagucccuaaa

SEQ ID NO: 490460 - RNA, 19 nt, Homo sapiens
aagcacaguguuaaaugaa

SEQ ID NO: 490461 - RNA, 19 nt, Homo sapiens
uuauggacauggccagauc

SEQ ID NO: 490462 - RNA, 19 nt, Homo sapiens
gaggaaccagagaaacuca

SEQ ID NO: 490463 - RNA, 19 nt, Homo sapiens
agccaaugaugaucugaau

SEQ ID NO: 490464 - RNA, 19 nt, Homo sapiens
uaugauguguugugauagc

SEQ ID NO: 490465 - RNA, 19 nt, Homo sapiens
agcacaguguuaaaugaaa

SEQ ID NO: 490466 - RNA, 19 nt, Homo sapiens
gaagacguuaauaaacuac

SEQ ID NO: 490467 - RNA, 19 nt, Homo sapiens
gggaugcugauuccucaau

SEQ ID NO: 490468 - RNA, 19 nt, Homo sapiens
gggcaaacgggaugcugau

SEQ ID NO: 490469 - RNA, 19 nt, Homo sapiens
ugacagguaaauuaagaca

SEQ ID NO: 490470 - RNA, 19 nt, Homo sapiens
cucagcaguucuuuggauu

SEQ ID NO: 490471 - RNA, 19 nt, Homo sapiens
gcacuaugaggaauaauua

SEQ ID NO: 490472 - RNA, 19 nt, Homo sapiens
ccaaugaugaucugaauua

SEQ ID NO: 490473 - RNA, 19 nt, Homo sapiens
gcaaugacagguaaauuaa

SEQ ID NO: 490474 - RNA, 19 nt, Homo sapiens
gcacugagcaggcgaaaga

SEQ ID NO: 490475 - RNA, 19 nt, Homo sapiens
ggcaaugacagguaaauua

SEQ ID NO: 490476 - RNA, 19 nt, Homo sapiens
gcagaauuaugaaagaaga

SEQ ID NO: 490477 - RNA, 19 nt, Homo sapiens
uguaugauguguugugaua

SEQ ID NO: 490478 - RNA, 19 nt, Homo sapiens
gcaguucuuuggauuaaug

SEQ ID NO: 490479 - RNA, 19 nt, Homo sapiens
gcugauuccucaauugaaa

SEQ ID NO: 490480 - RNA, 19 nt, Homo sapiens
gaaauaggagccaaugaug

SEQ ID NO: 490481 - RNA, 19 nt, Homo sapiens
gcacaguguuaaaugaaau

SEQ ID NO: 490482 - RNA, 19 nt, Homo sapiens
caaaauggcuuaugaaagg

SEQ ID NO: 490483 - RNA, 19 nt, Homo sapiens
cagcaguucuuuggauuaa

SEQ ID NO: 490484 - RNA, 19 nt, Homo sapiens
guacugagauuuugguauu

SEQ ID NO: 490485 - RNA, 19 nt, Homo sapiens
gauacagucccuaaagaaa

SEQ ID NO: 490486 - RNA, 19 nt, Homo sapiens
aaagcacaguguuaaauga

SEQ ID NO: 490487 - RNA, 19 nt, Homo sapiens
gauguguugugauagcuaa

SEQ ID NO: 490488 - RNA, 19 nt, Homo sapiens
auuaagacaugcacuauga

SEQ ID NO: 490489 - RNA, 19 nt, Homo sapiens
ggaaacuccugacagucuu

SEQ ID NO: 490490 - RNA, 19 nt, Homo sapiens
acagguaaauuaagacaug

SEQ ID NO: 490491 - RNA, 19 nt, Homo sapiens
gcuguuugcagaagaaaua

SEQ ID NO: 490492 - RNA, 19 nt, Homo sapiens
gugguuauuucucaacaaa

SEQ ID NO: 490493 - RNA, 19 nt, Homo sapiens
gaagaaauaggagccaaug

SEQ ID NO: 490494 - RNA, 19 nt, Homo sapiens
gaugcugauuccucaauug

SEQ ID NO: 490495 - RNA, 19 nt, Homo sapiens
caaagcacaguguuaaaug

SEQ ID NO: 490496 - RNA, 19 nt, Homo sapiens
gcaaugcagaauuaugaaa

SEQ ID NO: 490497 - RNA, 19 nt, Homo sapiens
ggccagaucucucacaaaa

SEQ ID NO: 490498 - RNA, 19 nt, Homo sapiens
ggaugcugauuccucaauu

SEQ ID NO: 490499 - RNA, 19 nt, Homo sapiens
gcaaacgggaugcugauuc

SEQ ID NO: 490500 - RNA, 19 nt, Homo sapiens
ccagaucucucacaaaaug

SEQ ID NO: 490501 - RNA, 19 nt, Homo sapiens
gacccaagccucagcaguu

SEQ ID NO: 490502 - RNA, 19 nt, Homo sapiens
ucaaugauacagucccuaa

SEQ ID NO: 490503 - RNA, 19 nt, Homo sapiens
uaugaugacucccuuaaaa

SEQ ID NO: 490504 - RNA, 19 nt, Homo sapiens
uuauucagcuucauuugug

SEQ ID NO: 490505 - RNA, 19 nt, Homo sapiens
ucaaugugauucuaauguc

SEQ ID NO: 490506 - RNA, 19 nt, Homo sapiens
gugacuauauagagauguu

SEQ ID NO: 490507 - RNA, 19 nt, Homo sapiens
caugcacuaugaggaauaa

SEQ ID NO: 490508 - RNA, 19 nt, Homo sapiens
guugugauagcuaacauuu

SEQ ID NO: 490509 - RNA, 19 nt, Homo sapiens
cagcuucauuugugucaau

SEQ ID NO: 490510 - RNA, 19 nt, Homo sapiens
augaugaucugaauuacug

SEQ ID NO: 490511 - RNA, 19 nt, Homo sapiens
agaaauaggagccaaugau

SEQ ID NO: 490512 - RNA, 19 nt, Homo sapiens
agacaugcacuaugaggaa

SEQ ID NO: 490513 - RNA, 19 nt, Homo sapiens
aaugggcaaugacagguaa

SEQ ID NO: 490514 - RNA, 19 nt, Homo sapiens
ccucagcaguucuuuggau

SEQ ID NO: 490515 - RNA, 19 nt, Homo sapiens
aaauaggagccaaugauga

SEQ ID NO: 490516 - RNA, 19 nt, Homo sapiens
caaguggcccuguuaaagg

SEQ ID NO: 490517 - RNA, 19 nt, Homo sapiens
caaugugauucuaaugucu

SEQ ID NO: 490518 - RNA, 19 nt, Homo sapiens
caaacgggaugcugauucc

SEQ ID NO: 490519 - RNA, 19 nt, Homo sapiens
ugauacagucccuaaagaa

SEQ ID NO: 490520 - RNA, 19 nt, Homo sapiens
ucagcaguucuuuggauua

SEQ ID NO: 490521 - RNA, 19 nt, Homo sapiens
gaacugccggagcccuuug

SEQ ID NO: 490522 - RNA, 19 nt, Homo sapiens
caauaugaugacucccuua

SEQ ID NO: 490523 - RNA, 19 nt, Homo sapiens
ucagcuguuugcagaagaa

SEQ ID NO: 490524 - RNA, 19 nt, Homo sapiens
acaaagcacaguguuaaau

SEQ ID NO: 490525 - RNA, 19 nt, Homo sapiens
gguuauuucucaacaaagc

SEQ ID NO: 490526 - RNA, 19 nt, Homo sapiens
aauaugaugacucccuuaa

SEQ ID NO: 490527 - RNA, 19 nt, Homo sapiens
gacaugcacuaugaggaau

SEQ ID NO: 490528 - RNA, 19 nt, Homo sapiens
ugucuccacucagcuguuu

SEQ ID NO: 490529 - RNA, 19 nt, Homo sapiens
gaaacuccugacagucuug

SEQ ID NO: 490530 - RNA, 19 nt, Homo sapiens
gagccaaugaugaucugaa

SEQ ID NO: 490531 - RNA, 19 nt, Homo sapiens
gggcaaugacagguaaauu

SEQ ID NO: 490532 - RNA, 19 nt, Homo sapiens
gacauggccagaucucuca

SEQ ID NO: 490533 - RNA, 19 nt, Homo sapiens
gaagcaguugugucagcua

SEQ ID NO: 490534 - RNA, 19 nt, Homo sapiens
caaugggcaaugacaggua

SEQ ID NO: 490535 - RNA, 19 nt, Homo sapiens
gcucggaggaaccagagaa

SEQ ID NO: 490536 - RNA, 19 nt, Homo sapiens
aauaggagccaaugaugau

SEQ ID NO: 490537 - RNA, 19 nt, Homo sapiens
ggaacugccggagcccuuu

SEQ ID NO: 490538 - RNA, 19 nt, Homo sapiens
guaaaaccugucaaugaua

SEQ ID NO: 490539 - RNA, 19 nt, Homo sapiens
uguaaaaccugucaaugau

SEQ ID NO: 490540 - RNA, 19 nt, Homo sapiens
guacgacagcgaccagauc

SEQ ID NO: 490541 - RNA, 19 nt, Homo sapiens
caaugaugaucugaauuac

SEQ ID NO: 490542 - RNA, 19 nt, Homo sapiens
augauacagucccuaaaga

SEQ ID NO: 490543 - RNA, 19 nt, Homo sapiens
gcaaaauccaacaugaaaa

SEQ ID NO: 490544 - RNA, 19 nt, Homo sapiens
caaugcagaauuaugaaag

SEQ ID NO: 490545 - RNA, 19 nt, Homo sapiens
acaaguggcccuguuaaag

SEQ ID NO: 490546 - RNA, 19 nt, Homo sapiens
ugaugacucccuuaaaaua

SEQ ID NO: 490547 - RNA, 19 nt, Homo sapiens
ggaggaaccagagaaacuc

SEQ ID NO: 490548 - RNA, 19 nt, Homo sapiens
uuguaucucugaagcaugu

SEQ ID NO: 490549 - RNA, 19 nt, Homo sapiens
cgacagcgaccagaucaag

SEQ ID NO: 490550 - RNA, 19 nt, Homo sapiens
uaaaaccugucaaugauac

SEQ ID NO: 490551 - RNA, 19 nt, Homo sapiens
caaugauacagucccuaaa

SEQ ID NO: 490552 - RNA, 19 nt, Homo sapiens
gaggaaccagagaaacuca

SEQ ID NO: 490553 - RNA, 19 nt, Homo sapiens
aagcacaguguuaaaugaa

SEQ ID NO: 490554 - RNA, 19 nt, Homo sapiens
uuauggacauggccagauc

SEQ ID NO: 490555 - RNA, 19 nt, Homo sapiens
agccaaugaugaucugaau

SEQ ID NO: 490556 - RNA, 19 nt, Homo sapiens
uaugauguguugugauagc

SEQ ID NO: 490557 - RNA, 19 nt, Homo sapiens
agcacaguguuaaaugaaa

SEQ ID NO: 490558 - RNA, 19 nt, Homo sapiens
gaagacguuaauaaacuac

SEQ ID NO: 490559 - RNA, 19 nt, Homo sapiens
gggaugcugauuccucaau

SEQ ID NO: 490560 - RNA, 19 nt, Homo sapiens
gggcaaacgggaugcugau

SEQ ID NO: 490561 - RNA, 19 nt, Homo sapiens
ugacagguaaauuaagaca

SEQ ID NO: 490562 - RNA, 19 nt, Homo sapiens
cucagcaguucuuuggauu

SEQ ID NO: 490563 - RNA, 19 nt, Homo sapiens
gcacuaugaggaauaauua

SEQ ID NO: 490564 - RNA, 19 nt, Homo sapiens
uaaauucuguggcuuauga

SEQ ID NO: 490565 - RNA, 19 nt, Homo sapiens
ccaaugaugaucugaauua

SEQ ID NO: 490566 - RNA, 19 nt, Homo sapiens
gcaaugacagguaaauuaa

SEQ ID NO: 490567 - RNA, 19 nt, Homo sapiens
gcacugagcaggcgaaaga

SEQ ID NO: 490568 - RNA, 19 nt, Homo sapiens
ggcaaugacagguaaauua

SEQ ID NO: 490569 - RNA, 19 nt, Homo sapiens
gcagaauuaugaaagaaga

SEQ ID NO: 490570 - RNA, 19 nt, Homo sapiens
uguaugauguguugugaua

SEQ ID NO: 490571 - RNA, 19 nt, Homo sapiens
gcaguucuuuggauuaaug

SEQ ID NO: 490572 - RNA, 19 nt, Homo sapiens
gaaauaggagccaaugaug

SEQ ID NO: 490573 - RNA, 19 nt, Homo sapiens
gcacaguguuaaaugaaau

SEQ ID NO: 490574 - RNA, 19 nt, Homo sapiens
cagcaguucuuuggauuaa

SEQ ID NO: 490575 - RNA, 19 nt, Homo sapiens
guacugagauuuugguauu

SEQ ID NO: 490576 - RNA, 19 nt, Homo sapiens
gauacagucccuaaagaaa

SEQ ID NO: 490577 - RNA, 19 nt, Homo sapiens
aaagcacaguguuaaauga

SEQ ID NO: 490578 - RNA, 19 nt, Homo sapiens
gauguguugugauagcuaa

SEQ ID NO: 490579 - RNA, 19 nt, Homo sapiens
auuaagacaugcacuauga

SEQ ID NO: 490580 - RNA, 19 nt, Homo sapiens
ggaaacuccugacagucuu

SEQ ID NO: 490581 - RNA, 19 nt, Homo sapiens
acagguaaauuaagacaug

SEQ ID NO: 490582 - RNA, 19 nt, Homo sapiens
gcuguuugcagaagaaaua

SEQ ID NO: 490583 - RNA, 19 nt, Homo sapiens
gugguuauuucucaacaaa

SEQ ID NO: 490584 - RNA, 19 nt, Homo sapiens
gaagaaauaggagccaaug

SEQ ID NO: 490585 - RNA, 19 nt, Homo sapiens
caaagcacaguguuaaaug

SEQ ID NO: 490586 - RNA, 19 nt, Homo sapiens
gcaaugcagaauuaugaaa

SEQ ID NO: 490587 - RNA, 19 nt, Homo sapiens
ggccagaucucucacaaaa

SEQ ID NO: 490588 - RNA, 19 nt, Homo sapiens
ccagaucucucacaaaaga

SEQ ID NO: 490589 - RNA, 19 nt, Homo sapiens
gacccaagccucagcaguu

SEQ ID NO: 490590 - RNA, 19 nt, Homo sapiens
ucaaugauacagucccuaa

SEQ ID NO: 490591 - RNA, 19 nt, Homo sapiens
caaacgggaugcuggacau

SEQ ID NO: 490592 - RNA, 19 nt, Homo sapiens
uaugaugacucccuuaaaa

SEQ ID NO: 490593 - RNA, 19 nt, Homo sapiens
uuauucagcuucauuugug

SEQ ID NO: 490594 - RNA, 19 nt, Homo sapiens
ucaaugugauucuaauguc

SEQ ID NO: 490595 - RNA, 19 nt, Homo sapiens
gugacuauauagagauguu

SEQ ID NO: 490596 - RNA, 19 nt, Homo sapiens
caugcacuaugaggaauaa

SEQ ID NO: 490597 - RNA, 19 nt, Homo sapiens
guugugauagcuaacauuu

SEQ ID NO: 490598 - RNA, 19 nt, Homo sapiens
cagcuucauuugugucaau

SEQ ID NO: 490599 - RNA, 19 nt, Homo sapiens
augaugaucugaauuacug

SEQ ID NO: 490600 - RNA, 19 nt, Homo sapiens
agaaauaggagccaaugau

SEQ ID NO: 490601 - RNA, 19 nt, Homo sapiens
agacaugcacuaugaggaa

SEQ ID NO: 490602 - RNA, 19 nt, Homo sapiens
aaugggcaaugacagguaa

SEQ ID NO: 490603 - RNA, 19 nt, Homo sapiens
ccucagcaguucuuuggau

SEQ ID NO: 490604 - RNA, 19 nt, Homo sapiens
aaauaggagccaaugauga

SEQ ID NO: 490605 - RNA, 19 nt, Homo sapiens
caaugugauucuaaugucu

SEQ ID NO: 490606 - RNA, 19 nt, Homo sapiens
ugauacagucccuaaagaa

SEQ ID NO: 490607 - RNA, 19 nt, Homo sapiens
ucagcaguucuuuggauua

SEQ ID NO: 490608 - RNA, 19 nt, Homo sapiens
gaacugccggagcccuuug

SEQ ID NO: 490609 - RNA, 19 nt, Homo sapiens
caauaugaugacucccuua

SEQ ID NO: 490610 - RNA, 19 nt, Homo sapiens
ucagcuguuugcagaagaa

SEQ ID NO: 490611 - RNA, 19 nt, Homo sapiens
acaaagcacaguguuaaau

SEQ ID NO: 490612 - RNA, 19 nt, Homo sapiens
gguuauuucucaacaaagc

SEQ ID NO: 490613 - RNA, 19 nt, Homo sapiens
ugucuccacucagcuguuu

SEQ ID NO: 490614 - RNA, 19 nt, Homo sapiens
aauaugaugacucccuuaa

SEQ ID NO: 490615 - RNA, 19 nt, Homo sapiens
gacaugcacuaugaggaau

SEQ ID NO: 490616 - RNA, 19 nt, Homo sapiens
gaaacuccugacagucuug

SEQ ID NO: 490617 - RNA, 19 nt, Homo sapiens
gggcaaugacagguaaauu

SEQ ID NO: 490618 - RNA, 19 nt, Homo sapiens
gagccaaugaugaucugaa

SEQ ID NO: 490619 - RNA, 19 nt, Homo sapiens
gacauggccagaucucuca

SEQ ID NO: 490620 - RNA, 19 nt, Homo sapiens
gaagcaguugugucagcua

SEQ ID NO: 490621 - RNA, 19 nt, Homo sapiens
aauaggagccaaugaugau

SEQ ID NO: 490622 - RNA, 19 nt, Homo sapiens
gcucggaggaaccagagaa

SEQ ID NO: 490623 - RNA, 19 nt, Homo sapiens
caaugggcaaugacaggua

SEQ ID NO: 490624 - RNA, 19 nt, Homo sapiens
ggaacugccggagcccuuu

SEQ ID NO: 490625 - RNA, 19 nt, Homo sapiens
guaaaaccugucaaugaua

SEQ ID NO: 490626 - RNA, 19 nt, Homo sapiens
uguaaaaccugucaaugau

SEQ ID NO: 490627 - RNA, 19 nt, Homo sapiens
guacgacagcgaccagauc

SEQ ID NO: 490628 - RNA, 19 nt, Homo sapiens
augauacagucccuaaaga

SEQ ID NO: 490629 - RNA, 19 nt, Homo sapiens
caaugaugaucugaauuac

SEQ ID NO: 490630 - RNA, 19 nt, Homo sapiens
caaugcagaauuaugaaag

SEQ ID NO: 490631 - RNA, 19 nt, Homo sapiens
cuuuaaauucuguggcuua

SEQ ID NO: 490632 - RNA, 19 nt, Homo sapiens
gcaaaauccaacaugaaaa

SEQ ID NO: 490633 - RNA, 19 nt, Homo sapiens
ugaugacucccuuaaaaua

SEQ ID NO: 490634 - RNA, 19 nt, Homo sapiens
ggaggaaccagagaaacuc

SEQ ID NO: 490635 - RNA, 19 nt, Homo sapiens
uuguaucucugaagcaugu

SEQ ID NO: 490636 - RNA, 19 nt, Homo sapiens
uaaaaccugucaaugauac

SEQ ID NO: 490637 - RNA, 19 nt, Homo sapiens
cgacagcgaccagaucaag

SEQ ID NO: 490638 - RNA, 19 nt, Homo sapiens
caaugauacagucccuaaa

SEQ ID NO: 490639 - RNA, 19 nt, Homo sapiens
gaggaaccagagaaacuca

SEQ ID NO: 490640 - RNA, 19 nt, Homo sapiens
aagcacaguguuaaaugaa

SEQ ID NO: 490641 - RNA, 19 nt, Homo sapiens
agccaaugaugaucugaau

SEQ ID NO: 490642 - RNA, 19 nt, Homo sapiens
uaugauguguugugauagc

SEQ ID NO: 490643 - RNA, 19 nt, Homo sapiens
agcacaguguuaaaugaaa

SEQ ID NO: 490644 - RNA, 19 nt, Homo sapiens
gaagacguuaauaaacuac

SEQ ID NO: 490645 - RNA, 19 nt, Homo sapiens
ugacagguaaauuaagaca

SEQ ID NO: 490646 - RNA, 19 nt, Homo sapiens
cucagcaguucuuuggauu

SEQ ID NO: 490647 - RNA, 19 nt, Homo sapiens
gcacuaugaggaauaauua

SEQ ID NO: 490648 - RNA, 19 nt, Homo sapiens
ccaaugaugaucugaauua

SEQ ID NO: 490649 - RNA, 19 nt, Homo sapiens
gcaaugacagguaaauuaa

SEQ ID NO: 490650 - RNA, 19 nt, Homo sapiens
gcacugagcaggcgaaaga

SEQ ID NO: 490651 - RNA, 19 nt, Homo sapiens
ggcaaugacagguaaauua

SEQ ID NO: 490652 - RNA, 19 nt, Homo sapiens
gcagaauuaugaaagaaga

SEQ ID NO: 490653 - RNA, 19 nt, Homo sapiens
uguaugauguguugugaua

SEQ ID NO: 490654 - RNA, 19 nt, Homo sapiens
gcaguucuuuggauuaaug

SEQ ID NO: 490655 - RNA, 19 nt, Homo sapiens
gaaauaggagccaaugaug

SEQ ID NO: 490656 - RNA, 19 nt, Homo sapiens
gcacaguguuaaaugaaau

SEQ ID NO: 490657 - RNA, 19 nt, Homo sapiens
caaaauggcuuaugaaagg

SEQ ID NO: 490658 - RNA, 19 nt, Homo sapiens
cagcaguucuuuggauuaa

SEQ ID NO: 490659 - RNA, 19 nt, Homo sapiens
guacugagauuuugguauu

SEQ ID NO: 490660 - RNA, 19 nt, Homo sapiens
gauacagucccuaaagaaa

SEQ ID NO: 490661 - RNA, 19 nt, Homo sapiens
aaagcacaguguuaaauga

SEQ ID NO: 490662 - RNA, 19 nt, Homo sapiens
gauguguugugauagcuaa

SEQ ID NO: 490663 - RNA, 19 nt, Homo sapiens
auuaagacaugcacuauga

SEQ ID NO: 490664 - RNA, 19 nt, Homo sapiens
ggaaacuccugacagucuu

SEQ ID NO: 490665 - RNA, 19 nt, Homo sapiens
acagguaaauuaagacaug

SEQ ID NO: 490666 - RNA, 19 nt, Homo sapiens
gcuguuugcagaagaaaua

SEQ ID NO: 490667 - RNA, 19 nt, Homo sapiens
gugguuauuucucaacaaa

SEQ ID NO: 490668 - RNA, 19 nt, Homo sapiens
gaagaaauaggagccaaug

SEQ ID NO: 490669 - RNA, 19 nt, Homo sapiens
caaagcacaguguuaaaug

SEQ ID NO: 490670 - RNA, 19 nt, Homo sapiens
gcaaugcagaauuaugaaa

SEQ ID NO: 490671 - RNA, 19 nt, Homo sapiens
ggccagaucucucacaaaa

SEQ ID NO: 490672 - RNA, 19 nt, Homo sapiens
ccagaucucucacaaaaug

SEQ ID NO: 490673 - RNA, 19 nt, Homo sapiens
gacccaagccucagcaguu

SEQ ID NO: 490674 - RNA, 19 nt, Homo sapiens
ucaaugauacagucccuaa

SEQ ID NO: 490675 - RNA, 19 nt, Homo sapiens
caaacgggaugcuggacau

SEQ ID NO: 490676 - RNA, 19 nt, Homo sapiens
uaugaugacucccuuaaaa

SEQ ID NO: 490677 - RNA, 19 nt, Homo sapiens
uuauucagcuucauuugug

SEQ ID NO: 490678 - RNA, 19 nt, Homo sapiens
ucaaugugauucuaauguc

SEQ ID NO: 490679 - RNA, 19 nt, Homo sapiens
gugacuauauagagauguu

SEQ ID NO: 490680 - RNA, 19 nt, Homo sapiens
caugcacuaugaggaauaa

SEQ ID NO: 490681 - RNA, 19 nt, Homo sapiens
guugugauagcuaacauuu

SEQ ID NO: 490682 - RNA, 19 nt, Homo sapiens
cagcuucauuugugucaau

SEQ ID NO: 490683 - RNA, 19 nt, Homo sapiens
augaugaucugaauuacug

SEQ ID NO: 490684 - RNA, 19 nt, Homo sapiens
agaaauaggagccaaugau

SEQ ID NO: 490685 - RNA, 19 nt, Homo sapiens
agacaugcacuaugaggaa

SEQ ID NO: 490686 - RNA, 19 nt, Homo sapiens
aaugggcaaugacagguaa

SEQ ID NO: 490687 - RNA, 19 nt, Homo sapiens
ccucagcaguucuuuggau

SEQ ID NO: 490688 - RNA, 19 nt, Homo sapiens
aaauaggagccaaugauga

SEQ ID NO: 490689 - RNA, 19 nt, Homo sapiens
caaugugauucuaaugucu

SEQ ID NO: 490690 - RNA, 19 nt, Homo sapiens
ugauacagucccuaaagaa

SEQ ID NO: 490691 - RNA, 19 nt, Homo sapiens
ucagcaguucuuuggauua

SEQ ID NO: 490692 - RNA, 19 nt, Homo sapiens
gaacugccggagcccuuug

SEQ ID NO: 490693 - RNA, 19 nt, Homo sapiens
caauaugaugacucccuua

SEQ ID NO: 490694 - RNA, 19 nt, Homo sapiens
ucagcuguuugcagaagaa

SEQ ID NO: 490695 - RNA, 19 nt, Homo sapiens
acaaagcacaguguuaaau

SEQ ID NO: 490696 - RNA, 19 nt, Homo sapiens
gguuauuucucaacaaagc

SEQ ID NO: 490697 - RNA, 19 nt, Homo sapiens
ugucuccacucagcuguuu

SEQ ID NO: 490698 - RNA, 19 nt, Homo sapiens
aauaugaugacucccuuaa

SEQ ID NO: 490699 - RNA, 19 nt, Homo sapiens
gacaugcacuaugaggaau

SEQ ID NO: 490700 - RNA, 19 nt, Homo sapiens
gaaacuccugacagucuug

SEQ ID NO: 490701 - RNA, 19 nt, Homo sapiens
gggcaaugacagguaaauu

SEQ ID NO: 490702 - RNA, 19 nt, Homo sapiens
gagccaaugaugaucugaa

SEQ ID NO: 490703 - RNA, 19 nt, Homo sapiens
gacauggccagaucucuca

SEQ ID NO: 490704 - RNA, 19 nt, Homo sapiens
gaagcaguugugucagcua

SEQ ID NO: 490705 - RNA, 19 nt, Homo sapiens
aauaggagccaaugaugau

SEQ ID NO: 490706 - RNA, 19 nt, Homo sapiens
caaugggcaaugacaggua

SEQ ID NO: 490707 - RNA, 19 nt, Homo sapiens
gcucggaggaaccagagaa

SEQ ID NO: 490708 - RNA, 19 nt, Homo sapiens
ggaacugccggagcccuuu

SEQ ID NO: 490709 - RNA, 19 nt, Homo sapiens
guaaaaccugucaaugaua

SEQ ID NO: 490710 - RNA, 19 nt, Homo sapiens
uguaaaaccugucaaugau

SEQ ID NO: 490711 - RNA, 19 nt, Homo sapiens
guacgacagcgaccagauc

SEQ ID NO: 490712 - RNA, 19 nt, Homo sapiens
augauacagucccuaaaga

SEQ ID NO: 490713 - RNA, 19 nt, Homo sapiens
caaugaugaucugaauuac

SEQ ID NO: 490714 - RNA, 19 nt, Homo sapiens
caaugcagaauuaugaaag

SEQ ID NO: 490715 - RNA, 19 nt, Homo sapiens
gcaaaauccaacaugaaaa

SEQ ID NO: 490716 - RNA, 19 nt, Homo sapiens
ggaggaaccagagaaacuc

SEQ ID NO: 490717 - RNA, 19 nt, Homo sapiens
ugaugacucccuuaaaaua

SEQ ID NO: 490718 - RNA, 19 nt, Homo sapiens
uuguaucucugaagcaugu

SEQ ID NO: 490719 - RNA, 19 nt, Homo sapiens
uaaaaccugucaaugauac

SEQ ID NO: 490720 - RNA, 19 nt, Homo sapiens
cgacagcgaccagaucaag

SEQ ID NO: 490721 - RNA, 19 nt, Homo sapiens
caaugauacagucccuaaa

SEQ ID NO: 490722 - RNA, 19 nt, Homo sapiens
aagcacaguguuaaaugaa

SEQ ID NO: 490723 - RNA, 19 nt, Homo sapiens
gaggaaccagagaaacuca

SEQ ID NO: 490724 - RNA, 19 nt, Homo sapiens
agccaaugaugaucugaau

SEQ ID NO: 490725 - RNA, 19 nt, Homo sapiens
uaugauguguugugauagc

SEQ ID NO: 490726 - RNA, 19 nt, Homo sapiens
agcacaguguuaaaugaaa

SEQ ID NO: 490727 - RNA, 19 nt, Homo sapiens
gaagacguuaauaaacuac

SEQ ID NO: 490728 - RNA, 19 nt, Homo sapiens
ugacagguaaauuaagaca

SEQ ID NO: 490729 - RNA, 19 nt, Homo sapiens
cucagcaguucuuuggauu

SEQ ID NO: 490730 - RNA, 19 nt, Homo sapiens
gcaagacgcuccuccugua

SEQ ID NO: 490731 - RNA, 19 nt, Homo sapiens
cacaacaucugguacuuug

SEQ ID NO: 490732 - RNA, 19 nt, Homo sapiens
gaucagggcuaugguuugg

SEQ ID NO: 490733 - RNA, 19 nt, Homo sapiens
uaaggagacuuuguucaug

SEQ ID NO: 490734 - RNA, 19 nt, Homo sapiens
caaugccgccuucaacuuu

SEQ ID NO: 490735 - RNA, 19 nt, Homo sapiens
ccugugacauugugacuga

SEQ ID NO: 490736 - RNA, 19 nt, Homo sapiens
cugcauggcugccuucaau

SEQ ID NO: 490737 - RNA, 19 nt, Homo sapiens
ggacaucuacugccacaag

SEQ ID NO: 490738 - RNA, 19 nt, Homo sapiens
aagaagaaguuugugaaga

SEQ ID NO: 490739 - RNA, 19 nt, Homo sapiens
ccaagaagaaguuugugaa

SEQ ID NO: 490740 - RNA, 19 nt, Homo sapiens
gcacagucaccaacuacuu

SEQ ID NO: 490741 - RNA, 19 nt, Homo sapiens
guaaugccaucgucaucug

SEQ ID NO: 490742 - RNA, 19 nt, Homo sapiens
agaagaaguuugugaagac

SEQ ID NO: 490743 - RNA, 19 nt, Homo sapiens
caccaaaacucauguugaa

SEQ ID NO: 490744 - RNA, 19 nt, Homo sapiens
gucagcaucuacuccauga

SEQ ID NO: 490745 - RNA, 19 nt, Homo sapiens
acacuaaggagacuuuguu

SEQ ID NO: 490746 - RNA, 19 nt, Homo sapiens
ggucacacccaccaaggaa

SEQ ID NO: 490747 - RNA, 19 nt, Homo sapiens
ggugaucgcccucaucuac

SEQ ID NO: 490748 - RNA, 19 nt, Homo sapiens
gcaccaaggcgguuauugc

SEQ ID NO: 490749 - RNA, 19 nt, Homo sapiens
ccacaacaucugguacuuu

SEQ ID NO: 490750 - RNA, 19 nt, Homo sapiens
ccaacuacuucaucgucaa

SEQ ID NO: 490751 - RNA, 19 nt, Homo sapiens
gacugaagccaauaucuca

SEQ ID NO: 490752 - RNA, 19 nt, Homo sapiens
caggauggaucagggcuau

SEQ ID NO: 490753 - RNA, 19 nt, Homo sapiens
cauguacaaucccaucauc

SEQ ID NO: 490754 - RNA, 19 nt, Homo sapiens
gcucuaccauguacaaucc

SEQ ID NO: 490755 - RNA, 19 nt, Homo sapiens
gccaagaagaaguuuguga

SEQ ID NO: 490756 - RNA, 19 nt, Homo sapiens
cuaaggagacuuuguucau

SEQ ID NO: 490757 - RNA, 19 nt, Homo sapiens
caagaagaaguuugugaag

SEQ ID NO: 490758 - RNA, 19 nt, Homo sapiens
uguacaaucccaucaucua

SEQ ID NO: 490759 - RNA, 19 nt, Homo sapiens
guacaaucccaucaucuac

SEQ ID NO: 490760 - RNA, 19 nt, Homo sapiens
ugaucgcccucaucuacuu

SEQ ID NO: 490761 - RNA, 19 nt, Homo sapiens
ggaucagggcuaugguuug

SEQ ID NO: 490762 - RNA, 19 nt, Homo sapiens
gacaucuacugccacaagu

SEQ ID NO: 490763 - RNA, 19 nt, Homo sapiens
acaaucccaucaucuacug

SEQ ID NO: 490764 - RNA, 19 nt, Homo sapiens
ucaaugccgccuucaacuu

SEQ ID NO: 490765 - RNA, 19 nt, Homo sapiens
gccacaacaucugguacuu

SEQ ID NO: 490766 - RNA, 19 nt, Homo sapiens
caacuacuucaucgucaau

SEQ ID NO: 490767 - RNA, 19 nt, Homo sapiens
caucuacugccacaaguuc

SEQ ID NO: 490768 - RNA, 19 nt, Homo sapiens
gggcuaugguuuggguaug

SEQ ID NO: 490769 - RNA, 19 nt, Homo sapiens
caucuggcccugagagcaa

SEQ ID NO: 490770 - RNA, 19 nt, Homo sapiens
ucacacccaccaaggaaga

SEQ ID NO: 490771 - RNA, 19 nt, Homo sapiens
acaaguucauccagcaagu

SEQ ID NO: 490772 - RNA, 19 nt, Homo sapiens
ccauugcugccgacaggua

SEQ ID NO: 490773 - RNA, 19 nt, Homo sapiens
ugaagccaauaucucaucu

SEQ ID NO: 490774 - RNA, 19 nt, Homo sapiens
ggauggaucagggcuaugg

SEQ ID NO: 490775 - RNA, 19 nt, Homo sapiens
gugcugacguuugccaucu

SEQ ID NO: 490776 - RNA, 19 nt, Homo sapiens
ccaaaacucauguugaaau

SEQ ID NO: 490777 - RNA, 19 nt, Homo sapiens
ugacugaagccaauaucuc

SEQ ID NO: 490778 - RNA, 19 nt, Homo sapiens
ccuaccaccucuacuucau

SEQ ID NO: 490779 - RNA, 19 nt, Homo sapiens
cagaaccucuuccccauca

SEQ ID NO: 490780 - RNA, 19 nt, Homo sapiens
guuuggguaugguuugcuu

SEQ ID NO: 490781 - RNA, 19 nt, Homo sapiens
uggaucagggcuaugguuu

SEQ ID NO: 490782 - RNA, 19 nt, Homo sapiens
ccacaaguucauccagcaa

SEQ ID NO: 490783 - RNA, 19 nt, Homo sapiens
agaaguuugugaagaccau

SEQ ID NO: 490784 - RNA, 19 nt, Homo sapiens
gaaacugcauagugaauau

SEQ ID NO: 490785 - RNA, 19 nt, Homo sapiens
ugacaugcaugacuucuuu

SEQ ID NO: 490786 - RNA, 19 nt, Homo sapiens
gggcauugacuguagaaua

SEQ ID NO: 490787 - RNA, 19 nt, Homo sapiens
cagaauagguacuccacuu

SEQ ID NO: 490788 - RNA, 19 nt, Homo sapiens
cuacggaugugaaucaaga

SEQ ID NO: 490789 - RNA, 19 nt, Homo sapiens
ccucaacaauaaaggauuu

SEQ ID NO: 490790 - RNA, 19 nt, Homo sapiens
ggaaacugcauagugaaua

SEQ ID NO: 490791 - RNA, 19 nt, Homo sapiens
uguggaaacugcauaguga

SEQ ID NO: 490792 - RNA, 19 nt, Homo sapiens
guaacauucuugugcuuug

SEQ ID NO: 490793 - RNA, 19 nt, Homo sapiens
ucucuucccuguucuugua

SEQ ID NO: 490794 - RNA, 19 nt, Homo sapiens
ggcauugacuguagaauac

SEQ ID NO: 490795 - RNA, 19 nt, Homo sapiens
gcuuuggcauccucaagua

SEQ ID NO: 490796 - RNA, 19 nt, Homo sapiens
cgagaaacgugacaugcau

SEQ ID NO: 490797 - RNA, 19 nt, Homo sapiens
uaacauucuugugcuuuga

SEQ ID NO: 490798 - RNA, 19 nt, Homo sapiens
ggacuccuggacugcauua

SEQ ID NO: 490799 - RNA, 19 nt, Homo sapiens
acucaucucuggagggauu

SEQ ID NO: 490800 - RNA, 19 nt, Homo sapiens
guagaauacccuagaguuc

SEQ ID NO: 490801 - RNA, 19 nt, Homo sapiens
ggaugugaaucaagagaac

SEQ ID NO: 490802 - RNA, 19 nt, Homo sapiens
cccgagagcagaauaggua

SEQ ID NO: 490803 - RNA, 19 nt, Homo sapiens
ggugcgcacgcuccuguua

SEQ ID NO: 490804 - RNA, 19 nt, Homo sapiens
ccuguuacccuuucucuuc

SEQ ID NO: 490805 - RNA, 19 nt, Homo sapiens
ugaggaucaugcugcuauu

SEQ ID NO: 490806 - RNA, 19 nt, Homo sapiens
uaaugucucucucuauucc

SEQ ID NO: 490807 - RNA, 19 nt, Homo sapiens
ccacaggcaccaugaggau

SEQ ID NO: 490808 - RNA, 19 nt, Homo sapiens
uguagaauacccuagaguu

SEQ ID NO: 490809 - RNA, 19 nt, Homo sapiens
gaucaugcugcuauucaca

SEQ ID NO: 490810 - RNA, 19 nt, Homo sapiens
ccuaaggaaucaacaucuc

SEQ ID NO: 490811 - RNA, 19 nt, Homo sapiens
gaguuccuguaguguccua

SEQ ID NO: 490812 - RNA, 19 nt, Homo sapiens
ugacuccuucuccaucuuu

SEQ ID NO: 490813 - RNA, 19 nt, Homo sapiens
cggcagcaccaguguguga

SEQ ID NO: 490814 - RNA, 19 nt, Homo sapiens
cagcgguccuagccaguuc

SEQ ID NO: 490815 - RNA, 19 nt, Homo sapiens
cccuagaguuccuguagug

SEQ ID NO: 490816 - RNA, 19 nt, Homo sapiens
agaaacgugacaugcauga

SEQ ID NO: 490817 - RNA, 19 nt, Homo sapiens
cuggagggauugcucaaag

SEQ ID NO: 490818 - RNA, 19 nt, Homo sapiens
gcagcgguccuagccaguu

SEQ ID NO: 490819 - RNA, 19 nt, Homo sapiens
cagacucuccuacggaugu

SEQ ID NO: 490820 - RNA, 19 nt, Homo sapiens
ugacuucuuugugggacuu

SEQ ID NO: 490821 - RNA, 19 nt, Homo sapiens
gacuguagaauacccuaga

SEQ ID NO: 490822 - RNA, 19 nt, Homo sapiens
aacgugacaugcaugacuu

SEQ ID NO: 490823 - RNA, 19 nt, Homo sapiens
ggaucaugcugcuauucac

SEQ ID NO: 490824 - RNA, 19 nt, Homo sapiens
gaaaguagcuauguguuaa

SEQ ID NO: 490825 - RNA, 19 nt, Homo sapiens
gaacaaaggacaaguauga

SEQ ID NO: 490826 - RNA, 19 nt, Homo sapiens
aaagacagcuuguugaaua

SEQ ID NO: 490827 - RNA, 19 nt, Homo sapiens
gaacacaaguccuuugcua

SEQ ID NO: 490828 - RNA, 19 nt, Homo sapiens
gaagaagccuugaagaaau

SEQ ID NO: 490829 - RNA, 19 nt, Homo sapiens
gcaaaugaauggaagaaga

SEQ ID NO: 490830 - RNA, 19 nt, Homo sapiens
guacaacucuuacacaaau

SEQ ID NO: 490831 - RNA, 19 nt, Homo sapiens
ucacaugggugcaaucuuu

SEQ ID NO: 490832 - RNA, 19 nt, Homo sapiens
gaagaaaugugcucaggau

SEQ ID NO: 490833 - RNA, 19 nt, Homo sapiens
cuaaagagauugaagcaaa

SEQ ID NO: 490834 - RNA, 19 nt, Homo sapiens
gagaagaaccugaacauga

SEQ ID NO: 490835 - RNA, 19 nt, Homo sapiens
gagaaggucuguacuaaca

SEQ ID NO: 490836 - RNA, 19 nt, Homo sapiens
gaacugcucuacagaagga

SEQ ID NO: 490837 - RNA, 19 nt, Homo sapiens
ggacaaguaugaccucuca

SEQ ID NO: 490838 - RNA, 19 nt, Homo sapiens
ccacaauuaucuugccuua

SEQ ID NO: 490839 - RNA, 19 nt, Homo sapiens
gugaugagcugauugcaaa

SEQ ID NO: 490840 - RNA, 19 nt, Homo sapiens
ggacaaacaagauuccuaa

SEQ ID NO: 490841 - RNA, 19 nt, Homo sapiens
gaaccucuauagaucuuaa

SEQ ID NO: 490842 - RNA, 19 nt, Homo sapiens
gaaggucuguacuaacaaa

SEQ ID NO: 490843 - RNA, 19 nt, Homo sapiens
guaaaaggcucagaucuua

SEQ ID NO: 490844 - RNA, 19 nt, Homo sapiens
gcaaagucgcguuuaauaa

SEQ ID NO: 490845 - RNA, 19 nt, Homo sapiens
ccaaauaaccugcuagcua

SEQ ID NO: 490846 - RNA, 19 nt, Homo sapiens
gaacaccaacuuaagaauu

SEQ ID NO: 490847 - RNA, 19 nt, Homo sapiens
ggaggucaauaaugucuuu

SEQ ID NO: 490848 - RNA, 19 nt, Homo sapiens
gagggaagauuuauguuuc

SEQ ID NO: 490849 - RNA, 19 nt, Homo sapiens
agaaguggcuugacaauca

SEQ ID NO: 490850 - RNA, 19 nt, Homo sapiens
gcaaagagcagaugaaggu

SEQ ID NO: 490851 - RNA, 19 nt, Homo sapiens
gaagugauuucagcacauu

SEQ ID NO: 490852 - RNA, 19 nt, Homo sapiens
ccagggaggucaauaaugu

SEQ ID NO: 490853 - RNA, 19 nt, Homo sapiens
uguagcacauuaccaauua

SEQ ID NO: 490854 - RNA, 19 nt, Homo sapiens
gaaucaacauuuagucuuc

SEQ ID NO: 490855 - RNA, 19 nt, Homo sapiens
gcagaagaaccaagaaauu

SEQ ID NO: 490856 - RNA, 19 nt, Homo sapiens
ggacaaagccaaugaagag

SEQ ID NO: 490857 - RNA, 19 nt, Homo sapiens
guacagaucaagagaauau

SEQ ID NO: 490858 - RNA, 19 nt, Homo sapiens
ggaccuucguuaagugaua

SEQ ID NO: 490859 - RNA, 19 nt, Homo sapiens
gcacuguccugucuuaauc

SEQ ID NO: 490860 - RNA, 19 nt, Homo sapiens
gccaauagauacccauuau

SEQ ID NO: 490861 - RNA, 19 nt, Homo sapiens
gcaguaauaaacucuguua

SEQ ID NO: 490862 - RNA, 19 nt, Homo sapiens
gcagaaagaaacauugauu

SEQ ID NO: 490863 - RNA, 19 nt, Homo sapiens
ggacacuccucagcuuuaa

SEQ ID NO: 490864 - RNA, 19 nt, Homo sapiens
gcaguaaacuuuucaguau

SEQ ID NO: 490865 - RNA, 19 nt, Homo sapiens
ucacugugguguaauauga

SEQ ID NO: 490866 - RNA, 19 nt, Homo sapiens
gaaccaagaaauugaagaa

SEQ ID NO: 490867 - RNA, 19 nt, Homo sapiens
caaagccaaugaagagauu

SEQ ID NO: 490868 - RNA, 19 nt, Homo sapiens
acaauuaucuugccuuauc

SEQ ID NO: 490869 - RNA, 19 nt, Homo sapiens
gaaaugugcucaggauuac

SEQ ID NO: 490870 - RNA, 19 nt, Homo sapiens
gaagagacccggcaagaag

SEQ ID NO: 490871 - RNA, 19 nt, Homo sapiens
gaagauacaggaaacauag

SEQ ID NO: 490872 - RNA, 19 nt, Homo sapiens
ggugaaaccuugucucuac

SEQ ID NO: 490873 - RNA, 19 nt, Homo sapiens
gacuauugcucaaaugauu

SEQ ID NO: 490874 - RNA, 19 nt, Homo sapiens
auucaagccuguugucuua

SEQ ID NO: 490875 - RNA, 19 nt, Homo sapiens
caacagcccuggaagaaac

SEQ ID NO: 490876 - RNA, 19 nt, Homo sapiens
gccagaagauggaagaaga

SEQ ID NO: 490877 - RNA, 19 nt, Homo sapiens
uaccauaaaucaugcguuu

SEQ ID NO: 490878 - RNA, 19 nt, Homo sapiens
gaagcauagucaaguaaga

SEQ ID NO: 490879 - RNA, 19 nt, Homo sapiens
agaaaugugcucaggauua

SEQ ID NO: 490880 - RNA, 19 nt, Homo sapiens
gaccuuaacucuguggaaa

SEQ ID NO: 490881 - RNA, 19 nt, Homo sapiens
gaggagauaucuguccaaa

SEQ ID NO: 490882 - RNA, 19 nt, Homo sapiens
ggcaaagucgcguuuaaua

SEQ ID NO: 490883 - RNA, 19 nt, Homo sapiens
gguaaucacguuaaugaaa

SEQ ID NO: 490884 - RNA, 19 nt, Homo sapiens
gaagaagcaagcugagaaa

SEQ ID NO: 490885 - RNA, 19 nt, Homo sapiens
guucuaauauggagauguu

SEQ ID NO: 490886 - RNA, 19 nt, Homo sapiens
ccuaaggaaugacuuuauu

SEQ ID NO: 490887 - RNA, 19 nt, Homo sapiens
gaggccaacugaacaauuc

SEQ ID NO: 490888 - RNA, 19 nt, Homo sapiens
uaauaugaaugcuguccua

SEQ ID NO: 490889 - RNA, 19 nt, Homo sapiens
aaagcacuguccugucuua

SEQ ID NO: 490890 - RNA, 19 nt, Homo sapiens
ccaaauccaugcaaguguu

SEQ ID NO: 490891 - RNA, 19 nt, Homo sapiens
gaagaaccaagaaauugaa

SEQ ID NO: 490892 - RNA, 19 nt, Homo sapiens
ggacauguacaaauuugaa

SEQ ID NO: 490893 - RNA, 19 nt, Homo sapiens
gguuauaguucuaauaugg

SEQ ID NO: 490894 - RNA, 19 nt, Homo sapiens
gagcuugcuuucugacuug

SEQ ID NO: 490895 - RNA, 19 nt, Homo sapiens
gcaggaggaucacuugagu

SEQ ID NO: 490896 - RNA, 19 nt, Homo sapiens
aaucguagcuuguacagau

SEQ ID NO: 490897 - RNA, 19 nt, Homo sapiens
guaaauccauagucaucuu

SEQ ID NO: 490898 - RNA, 19 nt, Homo sapiens
gcauuuggcugcuucucuu

SEQ ID NO: 490899 - RNA, 19 nt, Homo sapiens
ugaagaagccuugaagaaa

SEQ ID NO: 490900 - RNA, 19 nt, Homo sapiens
ggaagaagaaauacgaaga

SEQ ID NO: 490901 - RNA, 19 nt, Homo sapiens
ccagauaacuuugacgaau

SEQ ID NO: 490902 - RNA, 19 nt, Homo sapiens
agaagaaccugaacaugau

SEQ ID NO: 490903 - RNA, 19 nt, Homo sapiens
acaagaagcugaugaacag

SEQ ID NO: 490904 - RNA, 19 nt, Homo sapiens
gagaaccucuauagaucuu

SEQ ID NO: 490905 - RNA, 19 nt, Homo sapiens
ccugaaagguguucuggaa

SEQ ID NO: 490906 - RNA, 19 nt, Homo sapiens
gauugaagaugaacaaagg

SEQ ID NO: 490907 - RNA, 19 nt, Homo sapiens
uaaaccaacuacgaccuua

SEQ ID NO: 490908 - RNA, 19 nt, Homo sapiens
agaaugguauggaaucuga

SEQ ID NO: 490909 - RNA, 19 nt, Homo sapiens
gcauuguucuucagauguu

SEQ ID NO: 490910 - RNA, 19 nt, Homo sapiens
gagacagaguuucgaucua

SEQ ID NO: 490911 - RNA, 19 nt, Homo sapiens
gaguuuggguuugugauuu

SEQ ID NO: 490912 - RNA, 19 nt, Homo sapiens
gcucauggcuguguaacug

SEQ ID NO: 490913 - RNA, 19 nt, Homo sapiens
agagguagcaguaaacuuu

SEQ ID NO: 490914 - RNA, 19 nt, Homo sapiens
agauggacauguacaaauu

SEQ ID NO: 490915 - RNA, 19 nt, Homo sapiens
gacaaucauuugagcuuug

SEQ ID NO: 490916 - RNA, 19 nt, Homo sapiens
caagugugaugcauuguuc

SEQ ID NO: 490917 - RNA, 19 nt, Homo sapiens
aggcucagaucuuaauuaa

SEQ ID NO: 490918 - RNA, 19 nt, Homo sapiens
agacagaguuucgaucuau

SEQ ID NO: 490919 - RNA, 19 nt, Homo sapiens
ggagacaguuuggccuauu

SEQ ID NO: 490920 - RNA, 19 nt, Homo sapiens
ccaagaaauugaagaacug

SEQ ID NO: 490921 - RNA, 19 nt, Homo sapiens
gaugaacaaaggacaagua

SEQ ID NO: 490922 - RNA, 19 nt, Homo sapiens
ugaagaagcaugaaacuca

SEQ ID NO: 490923 - RNA, 19 nt, Homo sapiens
gcuguaaggugaagaagca

SEQ ID NO: 490924 - RNA, 19 nt, Homo sapiens
gaagaacacguguaaauua

SEQ ID NO: 490925 - RNA, 19 nt, Homo sapiens
gaaacagagugcuaauuua

SEQ ID NO: 490926 - RNA, 19 nt, Homo sapiens
gaacacguguaaauuauug

SEQ ID NO: 490927 - RNA, 19 nt, Homo sapiens
gcacaaagaauuaugguaa

SEQ ID NO: 490928 - RNA, 19 nt, Homo sapiens
ggaaagcccuguacaguag

SEQ ID NO: 490929 - RNA, 19 nt, Homo sapiens
gaaccuaaccacuaccuua

SEQ ID NO: 490930 - RNA, 19 nt, Homo sapiens
uaugggaacucuuggauua

SEQ ID NO: 490931 - RNA, 19 nt, Homo sapiens
gaucaucgcuucuacagau

SEQ ID NO: 490932 - RNA, 19 nt, Homo sapiens
cauaagagaugaugauguu

SEQ ID NO: 490933 - RNA, 19 nt, Homo sapiens
gaacgcagcaauaaaguuu

SEQ ID NO: 490934 - RNA, 19 nt, Homo sapiens
gaggaagcaucuaaaguuu

SEQ ID NO: 490935 - RNA, 19 nt, Homo sapiens
guaaugaaccgcugaauau

SEQ ID NO: 490936 - RNA, 19 nt, Homo sapiens
ggauguaauugaacgauuu

SEQ ID NO: 490937 - RNA, 19 nt, Homo sapiens
ggaaauaugucauguaucc

SEQ ID NO: 490938 - RNA, 19 nt, Homo sapiens
ucaagaauguuucacguuu

SEQ ID NO: 490939 - RNA, 19 nt, Homo sapiens
gguuacaacucaugaauug

SEQ ID NO: 490940 - RNA, 19 nt, Homo sapiens
aaaggaagcugaccugguu

SEQ ID NO: 490941 - RNA, 19 nt, Homo sapiens
gguagaaucuucccaguag

SEQ ID NO: 490942 - RNA, 19 nt, Homo sapiens
aaagagaucuacagacuuc

SEQ ID NO: 490943 - RNA, 19 nt, Homo sapiens
gcucagaaccuaaccacua

SEQ ID NO: 490944 - RNA, 19 nt, Homo sapiens
gcaaagaaacagagugcua

SEQ ID NO: 490945 - RNA, 19 nt, Homo sapiens
gaagagaguacaacuacaa

SEQ ID NO: 490946 - RNA, 19 nt, Homo sapiens
cuagggaaaugaucaguuu

SEQ ID NO: 490947 - RNA, 19 nt, Homo sapiens
gcaaaggcguguccuacug

SEQ ID NO: 490948 - RNA, 19 nt, Homo sapiens
gugggucuauuucuaguua

SEQ ID NO: 490949 - RNA, 19 nt, Homo sapiens
aaacaguucuugugugguu

SEQ ID NO: 490950 - RNA, 19 nt, Homo sapiens
gaauacagauagagcagau

SEQ ID NO: 490951 - RNA, 19 nt, Homo sapiens
gagaguacaacuacaaauu

SEQ ID NO: 490952 - RNA, 19 nt, Homo sapiens
gcacagcugccaagucauu

SEQ ID NO: 490953 - RNA, 19 nt, Homo sapiens
agaaacagagugcuaauuu

SEQ ID NO: 490954 - RNA, 19 nt, Homo sapiens
aagaagagcugacccagau

SEQ ID NO: 490955 - RNA, 19 nt, Homo sapiens
gaggguggaugaaggagaa

SEQ ID NO: 490956 - RNA, 19 nt, Homo sapiens
gauuaaugcuacuugcaaa

SEQ ID NO: 490957 - RNA, 19 nt, Homo sapiens
gcaguaaacaaucaaucua

SEQ ID NO: 490958 - RNA, 19 nt, Homo sapiens
ggaagcaucuaaaguuugc

SEQ ID NO: 490959 - RNA, 19 nt, Homo sapiens
caagaauguuucacguuug

SEQ ID NO: 490960 - RNA, 19 nt, Homo sapiens
ggagauuuguuaaugauac

SEQ ID NO: 490961 - RNA, 19 nt, Homo sapiens
caaagaaacagagugcuaa

SEQ ID NO: 490962 - RNA, 19 nt, Homo sapiens
cugaagauaucaagaaugu

SEQ ID NO: 490963 - RNA, 19 nt, Homo sapiens
cuacagacuucaacacaug

SEQ ID NO: 490964 - RNA, 19 nt, Homo sapiens
gaggcagucucuccuauuc

SEQ ID NO: 490965 - RNA, 19 nt, Homo sapiens
ugacgagcacaaagaauua

SEQ ID NO: 490966 - RNA, 19 nt, Homo sapiens
caagaacgcagcaauaaag

SEQ ID NO: 490967 - RNA, 19 nt, Homo sapiens
aaacugcaguaaacaauca

SEQ ID NO: 490968 - RNA, 19 nt, Homo sapiens
ugaggaagcaucuaaaguu

SEQ ID NO: 490969 - RNA, 19 nt, Homo sapiens
ccacuuuggagauuuguua

SEQ ID NO: 490970 - RNA, 19 nt, Homo sapiens
gauagggauacaugucuua

SEQ ID NO: 490971 - RNA, 19 nt, Homo sapiens
ggaaucuaccaacuguuua

SEQ ID NO: 490972 - RNA, 19 nt, Homo sapiens
guaaggcccaggaguguuu

SEQ ID NO: 490973 - RNA, 19 nt, Homo sapiens
gaaagcgaguacacugcaa

SEQ ID NO: 490974 - RNA, 19 nt, Homo sapiens
gcacagacucccauaugga

SEQ ID NO: 490975 - RNA, 19 nt, Homo sapiens
ucauguaucugaacaacga

SEQ ID NO: 490976 - RNA, 19 nt, Homo sapiens
gguagccaguugaauuuau

SEQ ID NO: 490977 - RNA, 19 nt, Homo sapiens
ugaagcauuuggcauuuau

SEQ ID NO: 490978 - RNA, 19 nt, Homo sapiens
cuagagcaauuuagcuuug

SEQ ID NO: 490979 - RNA, 19 nt, Homo sapiens
gguaaaaccuggugaaaag

SEQ ID NO: 490980 - RNA, 19 nt, Homo sapiens
gcucucagacuacgauauu

SEQ ID NO: 490981 - RNA, 19 nt, Homo sapiens
cuacgauauucucucuuua

SEQ ID NO: 490982 - RNA, 19 nt, Homo sapiens
gcauuuggcauuuauuugu

SEQ ID NO: 490983 - RNA, 19 nt, Homo sapiens
ggucauguguuugaacuuc

SEQ ID NO: 490984 - RNA, 19 nt, Homo sapiens
ucaaucacagcuuguauuu

SEQ ID NO: 490985 - RNA, 19 nt, Homo sapiens
cagcugagcaucaauacuu

SEQ ID NO: 490986 - RNA, 19 nt, Homo sapiens
ugauauagcugaggaagca

SEQ ID NO: 490987 - RNA, 19 nt, Homo sapiens
gagcagauucgcauucuca

SEQ ID NO: 490988 - RNA, 19 nt, Homo sapiens
gaguacaacuacaaauuac

SEQ ID NO: 490989 - RNA, 19 nt, Homo sapiens
uaacauagagccacuuugg

SEQ ID NO: 490990 - RNA, 19 nt, Homo sapiens
ggagggaaauaugucaugu

SEQ ID NO: 490991 - RNA, 19 nt, Homo sapiens
guccaaaggcuuauuauag

SEQ ID NO: 490992 - RNA, 19 nt, Homo sapiens
ggaagagaguacaacuaca

SEQ ID NO: 490993 - RNA, 19 nt, Homo sapiens
caacacauguagaaacacu

SEQ ID NO: 490994 - RNA, 19 nt, Homo sapiens
agggauacaugucuuagaa

SEQ ID NO: 490995 - RNA, 19 nt, Homo sapiens
caugguagccaguugaauu

SEQ ID NO: 490996 - RNA, 19 nt, Homo sapiens
gaccagcugagcaucaaua

SEQ ID NO: 490997 - RNA, 19 nt, Homo sapiens
gcgaucacgagaacaauaa

SEQ ID NO: 490998 - RNA, 19 nt, Homo sapiens
cggaacacuucaugggaua

SEQ ID NO: 490999 - RNA, 19 nt, Homo sapiens
gagccacuuuggagauuug

SEQ ID NO: 491000 - RNA, 19 nt, Homo sapiens
caucaaguacugaacguuu

SEQ ID NO: 491001 - RNA, 19 nt, Homo sapiens
ggauacaugucuuagaaaa

SEQ ID NO: 491002 - RNA, 19 nt, Homo sapiens
acuacgauauucucucuuu

SEQ ID NO: 491003 - RNA, 19 nt, Homo sapiens
ccaguugaauuuauggaau

SEQ ID NO: 491004 - RNA, 19 nt, Homo sapiens
guagccaguugaauuuaug

SEQ ID NO: 491005 - RNA, 19 nt, Homo sapiens
uaugaagcauuuggcauuu

SEQ ID NO: 491006 - RNA, 19 nt, Homo sapiens
gaaucucugucucuguuuc

SEQ ID NO: 491007 - RNA, 19 nt, Homo sapiens
ggauaaacaguaugaaucu

SEQ ID NO: 491008 - RNA, 19 nt, Homo sapiens
gaaaggaaagcccuguaca

SEQ ID NO: 491009 - RNA, 19 nt, Homo sapiens
agggaaauaugucauguau

SEQ ID NO: 491010 - RNA, 19 nt, Homo sapiens
ugaagaacacguguaaauu

SEQ ID NO: 491011 - RNA, 19 nt, Homo sapiens
aaucacagcuuguauuuug

SEQ ID NO: 491012 - RNA, 19 nt, Homo sapiens
gaauggcaaaugugagaaa

SEQ ID NO: 491013 - RNA, 19 nt, Homo sapiens
gagcaauuuagcuuugaua

SEQ ID NO: 491014 - RNA, 19 nt, Homo sapiens
uaaaggcuauggaauacag

SEQ ID NO: 491015 - RNA, 19 nt, Homo sapiens
ccaugaagaacacguguaa

SEQ ID NO: 491016 - RNA, 19 nt, Homo sapiens
uauggaaucuaccaacugu

SEQ ID NO: 491017 - RNA, 19 nt, Homo sapiens
gcacagguaauagcaguga

SEQ ID NO: 491018 - RNA, 19 nt, Homo sapiens
ggaacucgaggguggauga

SEQ ID NO: 491019 - RNA, 19 nt, Homo sapiens
aaaguuacccaaaugaaga

SEQ ID NO: 491020 - RNA, 19 nt, Homo sapiens
gagaaaaguggaauaguuu

SEQ ID NO: 491021 - RNA, 19 nt, Homo sapiens
ugagaaaaguggaauaguu

SEQ ID NO: 491022 - RNA, 19 nt, Homo sapiens
gcacugacuagggaaauga

SEQ ID NO: 491023 - RNA, 19 nt, Homo sapiens
aagguaaggugaaagugaa

SEQ ID NO: 491024 - RNA, 19 nt, Homo sapiens
gaagaacacguguaaauua

SEQ ID NO: 491025 - RNA, 19 nt, Homo sapiens
gaaacagagugcuaauuua

SEQ ID NO: 491026 - RNA, 19 nt, Homo sapiens
gaacacguguaaauuauug

SEQ ID NO: 491027 - RNA, 19 nt, Homo sapiens
gcacaaagaauuaugguaa

SEQ ID NO: 491028 - RNA, 19 nt, Homo sapiens
ggaaagcccuguacaguag

SEQ ID NO: 491029 - RNA, 19 nt, Homo sapiens
gaaccuaaccacuaccuua

SEQ ID NO: 491030 - RNA, 19 nt, Homo sapiens
uaugggaacucuuggauua

SEQ ID NO: 491031 - RNA, 19 nt, Homo sapiens
gaucaucgcuucuacagau

SEQ ID NO: 491032 - RNA, 19 nt, Homo sapiens
cauaagagaugaugauguu

SEQ ID NO: 491033 - RNA, 19 nt, Homo sapiens
gaacgcagcaauaaaguuu

SEQ ID NO: 491034 - RNA, 19 nt, Homo sapiens
gaggaagcaucuaaaguuu

SEQ ID NO: 491035 - RNA, 19 nt, Homo sapiens
guaaugaaccgcugaauau

SEQ ID NO: 491036 - RNA, 19 nt, Homo sapiens
ggauguaauugaacgauuu

SEQ ID NO: 491037 - RNA, 19 nt, Homo sapiens
ggaaauaugucauguaucc

SEQ ID NO: 491038 - RNA, 19 nt, Homo sapiens
ucaagaauguuucacguuu

SEQ ID NO: 491039 - RNA, 19 nt, Homo sapiens
gaaggugaaucuagcuuau

SEQ ID NO: 491040 - RNA, 19 nt, Homo sapiens
gguuacaacucaugaauug

SEQ ID NO: 491041 - RNA, 19 nt, Homo sapiens
aaaggaagcugaccugguu

SEQ ID NO: 491042 - RNA, 19 nt, Homo sapiens
gguagaaucuucccaguag

SEQ ID NO: 491043 - RNA, 19 nt, Homo sapiens
aaagagaucuacagacuuc

SEQ ID NO: 491044 - RNA, 19 nt, Homo sapiens
gcucagaaccuaaccacua

SEQ ID NO: 491045 - RNA, 19 nt, Homo sapiens
gcaaagaaacagagugcua

SEQ ID NO: 491046 - RNA, 19 nt, Homo sapiens
gaagagaguacaacuacaa

SEQ ID NO: 491047 - RNA, 19 nt, Homo sapiens
cuagggaaaugaucaguuu

SEQ ID NO: 491048 - RNA, 19 nt, Homo sapiens
gcaaaggcguguccuacug

SEQ ID NO: 491049 - RNA, 19 nt, Homo sapiens
gugggucuauuucuaguua

SEQ ID NO: 491050 - RNA, 19 nt, Homo sapiens
aaacaguucuugugugguu

SEQ ID NO: 491051 - RNA, 19 nt, Homo sapiens
gaauacagauagagcagau

SEQ ID NO: 491052 - RNA, 19 nt, Homo sapiens
gagaguacaacuacaaauu

SEQ ID NO: 491053 - RNA, 19 nt, Homo sapiens
gcacagcugccaagucauu

SEQ ID NO: 491054 - RNA, 19 nt, Homo sapiens
agaaacagagugcuaauuu

SEQ ID NO: 491055 - RNA, 19 nt, Homo sapiens
aagaagagcugacccagau

SEQ ID NO: 491056 - RNA, 19 nt, Homo sapiens
gaggguggaugaaggagaa

SEQ ID NO: 491057 - RNA, 19 nt, Homo sapiens
gauuaaugcuacuugcaaa

SEQ ID NO: 491058 - RNA, 19 nt, Homo sapiens
gcaguaaacaaucaaucua

SEQ ID NO: 491059 - RNA, 19 nt, Homo sapiens
ggaagcaucuaaaguuugc

SEQ ID NO: 491060 - RNA, 19 nt, Homo sapiens
caagaauguuucacguuug

SEQ ID NO: 491061 - RNA, 19 nt, Homo sapiens
ggagauuuguuaaugauac

SEQ ID NO: 491062 - RNA, 19 nt, Homo sapiens
caaagaaacagagugcuaa

SEQ ID NO: 491063 - RNA, 19 nt, Homo sapiens
gaggcagucucuccuauuc

SEQ ID NO: 491064 - RNA, 19 nt, Homo sapiens
cugaagauaucaagaaugu

SEQ ID NO: 491065 - RNA, 19 nt, Homo sapiens
cuacagacuucaacacaug

SEQ ID NO: 491066 - RNA, 19 nt, Homo sapiens
ugacgagcacaaagaauua

SEQ ID NO: 491067 - RNA, 19 nt, Homo sapiens
caagaacgcagcaauaaag

SEQ ID NO: 491068 - RNA, 19 nt, Homo sapiens
aaacugcaguaaacaauca

SEQ ID NO: 491069 - RNA, 19 nt, Homo sapiens
ugaggaagcaucuaaaguu

SEQ ID NO: 491070 - RNA, 19 nt, Homo sapiens
ccacuuuggagauuuguua

SEQ ID NO: 491071 - RNA, 19 nt, Homo sapiens
gauagggauacaugucuua

SEQ ID NO: 491072 - RNA, 19 nt, Homo sapiens
ggaaucuaccaacuguuua

SEQ ID NO: 491073 - RNA, 19 nt, Homo sapiens
guaaggcccaggaguguuu

SEQ ID NO: 491074 - RNA, 19 nt, Homo sapiens
ucauguaucugaacaacga

SEQ ID NO: 491075 - RNA, 19 nt, Homo sapiens
gguagccaguugaauuuau

SEQ ID NO: 491076 - RNA, 19 nt, Homo sapiens
ugaagcauuuggcauuuau

SEQ ID NO: 491077 - RNA, 19 nt, Homo sapiens
gcucucagacuacgauauu

SEQ ID NO: 491078 - RNA, 19 nt, Homo sapiens
cuagagcaauuuagcuuug

SEQ ID NO: 491079 - RNA, 19 nt, Homo sapiens
gguaaaaccuggugaaaag

SEQ ID NO: 491080 - RNA, 19 nt, Homo sapiens
cuacgauauucucucuuua

SEQ ID NO: 491081 - RNA, 19 nt, Homo sapiens
gcauuuggcauuuauuugu

SEQ ID NO: 491082 - RNA, 19 nt, Homo sapiens
ggucauguguuugaacuuc

SEQ ID NO: 491083 - RNA, 19 nt, Homo sapiens
cagcugagcaucaauacuu

SEQ ID NO: 491084 - RNA, 19 nt, Homo sapiens
ugauauagcugaggaagca

SEQ ID NO: 491085 - RNA, 19 nt, Homo sapiens
gagcagauucgcauucuca

SEQ ID NO: 491086 - RNA, 19 nt, Homo sapiens
gaguacaacuacaaauuac

SEQ ID NO: 491087 - RNA, 19 nt, Homo sapiens
uaacauagagccacuuugg

SEQ ID NO: 491088 - RNA, 19 nt, Homo sapiens
ggagggaaauaugucaugu

SEQ ID NO: 491089 - RNA, 19 nt, Homo sapiens
guccaaaggcuuauuauag

SEQ ID NO: 491090 - RNA, 19 nt, Homo sapiens
ggaagagaguacaacuaca

SEQ ID NO: 491091 - RNA, 19 nt, Homo sapiens
caacacauguagaaacacu

SEQ ID NO: 491092 - RNA, 19 nt, Homo sapiens
agggauacaugucuuagaa

SEQ ID NO: 491093 - RNA, 19 nt, Homo sapiens
caugguagccaguugaauu

SEQ ID NO: 491094 - RNA, 19 nt, Homo sapiens
gaccagcugagcaucaaua

SEQ ID NO: 491095 - RNA, 19 nt, Homo sapiens
caggaaaugcugaagauga

SEQ ID NO: 491096 - RNA, 19 nt, Homo sapiens
gcgaucacgagaacaauaa

SEQ ID NO: 491097 - RNA, 19 nt, Homo sapiens
cggaacacuucaugggaua

SEQ ID NO: 491098 - RNA, 19 nt, Homo sapiens
gagccacuuuggagauuug

SEQ ID NO: 491099 - RNA, 19 nt, Homo sapiens
caucaaguacugaacguuu

SEQ ID NO: 491100 - RNA, 19 nt, Homo sapiens
ggauacaugucuuagaaaa

SEQ ID NO: 491101 - RNA, 19 nt, Homo sapiens
ccaguugaauuuauggaau

SEQ ID NO: 491102 - RNA, 19 nt, Homo sapiens
guagccaguugaauuuaug

SEQ ID NO: 491103 - RNA, 19 nt, Homo sapiens
uaugaagcauuuggcauuu

SEQ ID NO: 491104 - RNA, 19 nt, Homo sapiens
gaaaggaaagcccuguaca

SEQ ID NO: 491105 - RNA, 19 nt, Homo sapiens
agggaaauaugucauguau

SEQ ID NO: 491106 - RNA, 19 nt, Homo sapiens
ugaagaacacguguaaauu

SEQ ID NO: 491107 - RNA, 19 nt, Homo sapiens
acuacgauauucucucuuu

SEQ ID NO: 491108 - RNA, 19 nt, Homo sapiens
gauaacaggcacugacuag

SEQ ID NO: 491109 - RNA, 19 nt, Homo sapiens
aggugaaucuagcuuauuu

SEQ ID NO: 491110 - RNA, 19 nt, Homo sapiens
gaauggcaaaugugagaaa

SEQ ID NO: 491111 - RNA, 19 nt, Homo sapiens
gagcaauuuagcuuugaua

SEQ ID NO: 491112 - RNA, 19 nt, Homo sapiens
uaaaggcuauggaauacag

SEQ ID NO: 491113 - RNA, 19 nt, Homo sapiens
ccaugaagaacacguguaa

SEQ ID NO: 491114 - RNA, 19 nt, Homo sapiens
uauggaaucuaccaacugu

SEQ ID NO: 491115 - RNA, 19 nt, Homo sapiens
gcacagacucacauaugga

SEQ ID NO: 491116 - RNA, 19 nt, Homo sapiens
gcacagguaauagcaguga

SEQ ID NO: 491117 - RNA, 19 nt, Homo sapiens
ggaacucgaggguggauga

SEQ ID NO: 491118 - RNA, 19 nt, Homo sapiens
aaaguuacccaaaugaaga

SEQ ID NO: 491119 - RNA, 19 nt, Homo sapiens
gagaaaaguggaauaguuu

SEQ ID NO: 491120 - RNA, 19 nt, Homo sapiens
ugagaaaaguggaauaguu

SEQ ID NO: 491121 - RNA, 19 nt, Homo sapiens
gcacugacuagggaaauga

SEQ ID NO: 491122 - RNA, 19 nt, Homo sapiens
gaacucuuggauuagcuua

SEQ ID NO: 491123 - RNA, 19 nt, Homo sapiens
uguaaugaaccgcugaaua

SEQ ID NO: 491124 - RNA, 19 nt, Homo sapiens
ggacagugacgaacuauuu

SEQ ID NO: 491125 - RNA, 19 nt, Homo sapiens
gaacuuugcugagccugua

SEQ ID NO: 491126 - RNA, 19 nt, Homo sapiens
ccaaacaucuccacuaaca

SEQ ID NO: 491127 - RNA, 19 nt, Homo sapiens
cgaacaagauuuaugagaa

SEQ ID NO: 491128 - RNA, 19 nt, Homo sapiens
aaagagugcugcccauaaa

SEQ ID NO: 491129 - RNA, 19 nt, Homo sapiens
gaaaguguaccacaucugu

SEQ ID NO: 491130 - RNA, 19 nt, Homo sapiens
guacagauaguaggcuuua

SEQ ID NO: 491131 - RNA, 19 nt, Homo sapiens
ugacugugcugaucuacuu

SEQ ID NO: 491132 - RNA, 19 nt, Homo sapiens
ccagaucucuaccugaaga

SEQ ID NO: 491133 - RNA, 19 nt, Homo sapiens
ccaaaguggucaucugugu

SEQ ID NO: 491134 - RNA, 19 nt, Homo sapiens
ucaauacaguggugaacuu

SEQ ID NO: 491135 - RNA, 19 nt, Homo sapiens
guacauggccaucauacau

SEQ ID NO: 491136 - RNA, 19 nt, Homo sapiens
ugaggacagugacgaacua

SEQ ID NO: 491137 - RNA, 19 nt, Homo sapiens
gagaaaguguaccacaucu

SEQ ID NO: 491138 - RNA, 19 nt, Homo sapiens
ugacggcuguggccuuuga

SEQ ID NO: 491139 - RNA, 19 nt, Homo sapiens
caagauuuaugagaaagug

SEQ ID NO: 491140 - RNA, 19 nt, Homo sapiens
gagcauccgaacaagauuu

SEQ ID NO: 491141 - RNA, 19 nt, Homo sapiens
ggccagagcauccgaacaa

SEQ ID NO: 491142 - RNA, 19 nt, Homo sapiens
ccuccugucugcuuuagaa

SEQ ID NO: 491143 - RNA, 19 nt, Homo sapiens
ugaccugccucccuucaug

SEQ ID NO: 491144 - RNA, 19 nt, Homo sapiens
ucaauucuucccuaucuuu

SEQ ID NO: 491145 - RNA, 19 nt, Homo sapiens
caugacggcuguggccuuu

SEQ ID NO: 491146 - RNA, 19 nt, Homo sapiens
gaaugaggacagugacgaa

SEQ ID NO: 491147 - RNA, 19 nt, Homo sapiens
gaucaucuuagcccacaaa

SEQ ID NO: 491148 - RNA, 19 nt, Homo sapiens
caaaccaaaucacugaacu

SEQ ID NO: 491149 - RNA, 19 nt, Homo sapiens
cuccauggcugcauucaau

SEQ ID NO: 491150 - RNA, 19 nt, Homo sapiens
gcaugcgagugcucauuuc

SEQ ID NO: 491151 - RNA, 19 nt, Homo sapiens
ccuccaaugugcucuccua

SEQ ID NO: 491152 - RNA, 19 nt, Homo sapiens
ucucaauucuucccuaucu

SEQ ID NO: 491153 - RNA, 19 nt, Homo sapiens
ccagggcaguguguacaaa

SEQ ID NO: 491154 - RNA, 19 nt, Homo sapiens
acccagaucucuaccugaa

SEQ ID NO: 491155 - RNA, 19 nt, Homo sapiens
gagcgccaguucagcuuuc

SEQ ID NO: 491156 - RNA, 19 nt, Homo sapiens
gcaacgugguagugaugug

SEQ ID NO: 491157 - RNA, 19 nt, Homo sapiens
ccucggaacccaaucaguu

SEQ ID NO: 491158 - RNA, 19 nt, Homo sapiens
cucaagagcccaaugcauu

SEQ ID NO: 491159 - RNA, 19 nt, Homo sapiens
gaaaacauuccauccuuga

SEQ ID NO: 491160 - RNA, 19 nt, Homo sapiens
gaagugacuccaagaccau

SEQ ID NO: 491161 - RNA, 19 nt, Homo sapiens
uccagaagcguuuauauuc

SEQ ID NO: 491162 - RNA, 19 nt, Homo sapiens
ccacccuccugucugcuuu

SEQ ID NO: 491163 - RNA, 19 nt, Homo sapiens
cagagcauccgaacaagau

SEQ ID NO: 491164 - RNA, 19 nt, Homo sapiens
aaccaaaucacugaacuuu

SEQ ID NO: 491165 - RNA, 19 nt, Homo sapiens
ggcaguguguacaaaguca

SEQ ID NO: 491166 - RNA, 19 nt, Homo sapiens
gugauuggcuaugcauaca

SEQ ID NO: 491167 - RNA, 19 nt, Homo sapiens
ucaagagcccaaugcauuc

SEQ ID NO: 491168 - RNA, 19 nt, Homo sapiens
gcagagucgugugcaugau

SEQ ID NO: 491169 - RNA, 19 nt, Homo sapiens
uugcugagccuguaaaaua

SEQ ID NO: 491170 - RNA, 19 nt, Homo sapiens
acucaaaccaaaucacuga

SEQ ID NO: 491171 - RNA, 19 nt, Homo sapiens
aaucucaauucuucccuau

SEQ ID NO: 491172 - RNA, 19 nt, Homo sapiens
gcaagguggucaaaaugau

SEQ ID NO: 491173 - RNA, 19 nt, Homo sapiens
ccccaaacaucuccacuaa

SEQ ID NO: 491174 - RNA, 19 nt, Homo sapiens
ccugucugcuuuagaagga

SEQ ID NO: 491175 - RNA, 19 nt, Homo sapiens
gcauccagaagcguuuaua

SEQ ID NO: 491176 - RNA, 19 nt, Homo sapiens
gcuguggccuuugauaggu

SEQ ID NO: 491177 - RNA, 19 nt, Homo sapiens
ccuaugcuguccacaacga

SEQ ID NO: 491178 - RNA, 19 nt, Homo sapiens
uaacaccucggaacccaau

SEQ ID NO: 491179 - RNA, 19 nt, Homo sapiens
cagcuucuccuccaaugug

SEQ ID NO: 491180 - RNA, 19 nt, Homo sapiens
uccaacugcucuucacgaa

SEQ ID NO: 491181 - RNA, 19 nt, Homo sapiens
ugagaaaguguaccacauc

SEQ ID NO: 491182 - RNA, 19 nt, Homo sapiens
aaaguggucaucuguguca

SEQ ID NO: 491183 - RNA, 19 nt, Homo sapiens
gggcaacgugguagugaug

SEQ ID NO: 491184 - RNA, 19 nt, Homo sapiens
caucagaaacacccucaca

SEQ ID NO: 491185 - RNA, 19 nt, Homo sapiens
caucaacccagaucucuac

SEQ ID NO: 491186 - RNA, 19 nt, Homo sapiens
gugugacugugcugaucua

SEQ ID NO: 491187 - RNA, 19 nt, Homo sapiens
ccacccucaugcuguguga

SEQ ID NO: 491188 - RNA, 19 nt, Homo sapiens
aaacauuccauccuugagu

SEQ ID NO: 491189 - RNA, 19 nt, Homo sapiens
ccagagcauccgaacaaga

SEQ ID NO: 491190 - RNA, 19 nt, Homo sapiens
gguacuacggccuguucua

SEQ ID NO: 491191 - RNA, 19 nt, Homo sapiens
aaugaaauccacccgguau

SEQ ID NO: 491192 - RNA, 19 nt, Homo sapiens
acgccuagcuucgaaaugg

SEQ ID NO: 491193 - RNA, 19 nt, Homo sapiens
ccgaacaagauuuaugaga

SEQ ID NO: 491194 - RNA, 19 nt, Homo sapiens
ucauuguggugaccucugu

SEQ ID NO: 491195 - RNA, 19 nt, Homo sapiens
cauccagaagcguuuauau

SEQ ID NO: 491196 - RNA, 19 nt, Homo sapiens
cugugugacucaaaccaaa

SEQ ID NO: 491197 - RNA, 19 nt, Homo sapiens
gaucucuaccugaagaagu

SEQ ID NO: 491198 - RNA, 19 nt, Homo sapiens
uggcugcccuuccacaucu

SEQ ID NO: 491199 - RNA, 19 nt, Homo sapiens
cauccgaacaagauuuaug

SEQ ID NO: 491200 - RNA, 19 nt, Homo sapiens
gaucgaauggccagagcau

SEQ ID NO: 491201 - RNA, 19 nt, Homo sapiens
gccgcugucuucgccagua

SEQ ID NO: 491202 - RNA, 19 nt, Homo sapiens
caccuaugcuguccacaac

SEQ ID NO: 491203 - RNA, 19 nt, Homo sapiens
ucaccuaugcuguccacaa

SEQ ID NO: 491204 - RNA, 19 nt, Homo sapiens
uccaagaccaugacagaga

SEQ ID NO: 491205 - RNA, 19 nt, Homo sapiens
gaaauccacccgguaucuc

SEQ ID NO: 491206 - RNA, 19 nt, Homo sapiens
caucuacugcugccucaau

SEQ ID NO: 491207 - RNA, 19 nt, Homo sapiens
guacuacggccuguucuac

SEQ ID NO: 491208 - RNA, 19 nt, Homo sapiens
caauucuucccuaucuuug

SEQ ID NO: 491209 - RNA, 19 nt, Homo sapiens
acucagaccucuccccaaa

SEQ ID NO: 491210 - RNA, 19 nt, Homo sapiens
cgagugcucauuucaggau

SEQ ID NO: 491211 - RNA, 19 nt, Homo sapiens
gaccagcuuuuccucaaga

SEQ ID NO: 491212 - RNA, 19 nt, Homo sapiens
aaaccaaaucacugaacuu

SEQ ID NO: 491213 - RNA, 19 nt, Homo sapiens
ucagaaacacccucacacu

SEQ ID NO: 491214 - RNA, 19 nt, Homo sapiens
ggugauuggcuaugcauac

SEQ ID NO: 491215 - RNA, 19 nt, Homo sapiens
gcuucgaaauggauaacgu

SEQ ID NO: 491216 - RNA, 19 nt, Homo sapiens
ucccaucgccgcugucuuc

SEQ ID NO: 491217 - RNA, 19 nt, Homo sapiens
ccacaacgaaugguacuac

SEQ ID NO: 491218 - RNA, 19 nt, Homo sapiens
agaccaccaucuccacagu

SEQ ID NO: 491219 - RNA, 19 nt, Homo sapiens
ggacagugacgaacuauuu

SEQ ID NO: 491220 - RNA, 19 nt, Homo sapiens
ccaaacaucuccacuaaca

SEQ ID NO: 491221 - RNA, 19 nt, Homo sapiens
cgaacaagauuuaugagaa

SEQ ID NO: 491222 - RNA, 19 nt, Homo sapiens
ccacaagaccaucuacaua

SEQ ID NO: 491223 - RNA, 19 nt, Homo sapiens
caagcggcauccuaaauga

SEQ ID NO: 491224 - RNA, 19 nt, Homo sapiens
gaaaguguaccacaucugu

SEQ ID NO: 491225 - RNA, 19 nt, Homo sapiens
ugacugugcugaucuacuu

SEQ ID NO: 491226 - RNA, 19 nt, Homo sapiens
ccagaucucuaccugaaga

SEQ ID NO: 491227 - RNA, 19 nt, Homo sapiens
ccaaaguggucaucugugu

SEQ ID NO: 491228 - RNA, 19 nt, Homo sapiens
ggaaugggagcccggagua

SEQ ID NO: 491229 - RNA, 19 nt, Homo sapiens
ucaauacaguggugaacuu

SEQ ID NO: 491230 - RNA, 19 nt, Homo sapiens
gacugcagcuaacuuauca

SEQ ID NO: 491231 - RNA, 19 nt, Homo sapiens
guacauggccaucauacau

SEQ ID NO: 491232 - RNA, 19 nt, Homo sapiens
ugaggacagugacgaacua

SEQ ID NO: 491233 - RNA, 19 nt, Homo sapiens
gagaaaguguaccacaucu

SEQ ID NO: 491234 - RNA, 19 nt, Homo sapiens
ugacggcuguggccuuuga

SEQ ID NO: 491235 - RNA, 19 nt, Homo sapiens
guacagauaguagggcuuu

SEQ ID NO: 491236 - RNA, 19 nt, Homo sapiens
caagauuuaugagaaagug

SEQ ID NO: 491237 - RNA, 19 nt, Homo sapiens
gagcauccgaacaagauuu

SEQ ID NO: 491238 - RNA, 19 nt, Homo sapiens
ggccagagcauccgaacaa

SEQ ID NO: 491239 - RNA, 19 nt, Homo sapiens
gcagcuaacuuaucaucac

SEQ ID NO: 491240 - RNA, 19 nt, Homo sapiens
ggacugcagcuaacuuauc

SEQ ID NO: 491241 - RNA, 19 nt, Homo sapiens
caugacggcuguggccuuu

SEQ ID NO: 491242 - RNA, 19 nt, Homo sapiens
ggaguagacugauuuucuu

SEQ ID NO: 491243 - RNA, 19 nt, Homo sapiens
uaacuuaucaucacacaac

SEQ ID NO: 491244 - RNA, 19 nt, Homo sapiens
gaaugaggacagugacgaa

SEQ ID NO: 491245 - RNA, 19 nt, Homo sapiens
gaucaucuuagcccacaaa

SEQ ID NO: 491246 - RNA, 19 nt, Homo sapiens
aaacccagcugugagacaa

SEQ ID NO: 491247 - RNA, 19 nt, Homo sapiens
ccaagcggcauccuaaaug

SEQ ID NO: 491248 - RNA, 19 nt, Homo sapiens
cuccauggcugcauucaau

SEQ ID NO: 491249 - RNA, 19 nt, Homo sapiens
gagacaagagggacaagug

SEQ ID NO: 491250 - RNA, 19 nt, Homo sapiens
acaagaccaucuacauaca

SEQ ID NO: 491251 - RNA, 19 nt, Homo sapiens
acccagaucucuaccugaa

SEQ ID NO: 491252 - RNA, 19 nt, Homo sapiens
gcaacgugguagugaugug

SEQ ID NO: 491253 - RNA, 19 nt, Homo sapiens
gauuaucaccauccaggaa

SEQ ID NO: 491254 - RNA, 19 nt, Homo sapiens
gcuaacuuaucaucacaca

SEQ ID NO: 491255 - RNA, 19 nt, Homo sapiens
ugaguaaacccagcuguga

SEQ ID NO: 491256 - RNA, 19 nt, Homo sapiens
ccucggaacccaaucaguu

SEQ ID NO: 491257 - RNA, 19 nt, Homo sapiens
ccuccugucuggcuuuaga

SEQ ID NO: 491258 - RNA, 19 nt, Homo sapiens
gcccggaguagacugauuu

SEQ ID NO: 491259 - RNA, 19 nt, Homo sapiens
cagcuaacuuaucaucaca

SEQ ID NO: 491260 - RNA, 19 nt, Homo sapiens
gcggcauccuaaaugagua

SEQ ID NO: 491261 - RNA, 19 nt, Homo sapiens
ccgccuagcuucgaaaugg

SEQ ID NO: 491262 - RNA, 19 nt, Homo sapiens
cagagcauccgaacaagau

SEQ ID NO: 491263 - RNA, 19 nt, Homo sapiens
gugauuggcuaugcauaca

SEQ ID NO: 491264 - RNA, 19 nt, Homo sapiens
gcagagucgugugcaugau

SEQ ID NO: 491265 - RNA, 19 nt, Homo sapiens
ccccaaacaucuccacuaa

SEQ ID NO: 491266 - RNA, 19 nt, Homo sapiens
gccaagcggcauccuaaau

SEQ ID NO: 491267 - RNA, 19 nt, Homo sapiens
cacaagaccaucuacauac

SEQ ID NO: 491268 - RNA, 19 nt, Homo sapiens
gcaagguggucaaaaugau

SEQ ID NO: 491269 - RNA, 19 nt, Homo sapiens
uaacaccucggaacccaau

SEQ ID NO: 491270 - RNA, 19 nt, Homo sapiens
gcuguggccuuugauaggu

SEQ ID NO: 491271 - RNA, 19 nt, Homo sapiens
ccuaugcuguccacaacga

SEQ ID NO: 491272 - RNA, 19 nt, Homo sapiens
ugagaaaguguaccacauc

SEQ ID NO: 491273 - RNA, 19 nt, Homo sapiens
aaaguggucaucuguguca

SEQ ID NO: 491274 - RNA, 19 nt, Homo sapiens
gggcaacgugguagugaug

SEQ ID NO: 491275 - RNA, 19 nt, Homo sapiens
caucaacccagaucucuac

SEQ ID NO: 491276 - RNA, 19 nt, Homo sapiens
gugugacugugcugaucua

SEQ ID NO: 491277 - RNA, 19 nt, Homo sapiens
uggccaagcggcauccuaa

SEQ ID NO: 491278 - RNA, 19 nt, Homo sapiens
ccagagcauccgaacaaga

SEQ ID NO: 491279 - RNA, 19 nt, Homo sapiens
gguacuacggccuguucua

SEQ ID NO: 491280 - RNA, 19 nt, Homo sapiens
ucauuguggugaccucugu

SEQ ID NO: 491281 - RNA, 19 nt, Homo sapiens
ccgaacaagauuuaugaga

SEQ ID NO: 491282 - RNA, 19 nt, Homo sapiens
gaucucuaccugaagaagu

SEQ ID NO: 491283 - RNA, 19 nt, Homo sapiens
uggcugcccuuccacaucu

SEQ ID NO: 491284 - RNA, 19 nt, Homo sapiens
cauccgaacaagauuuaug

SEQ ID NO: 491285 - RNA, 19 nt, Homo sapiens
gaucgaauggccagagcau

SEQ ID NO: 491286 - RNA, 19 nt, Homo sapiens
gccgcugucuucgccagua

SEQ ID NO: 491287 - RNA, 19 nt, Homo sapiens
caccuaugcuguccacaac

SEQ ID NO: 491288 - RNA, 19 nt, Homo sapiens
ucaccuaugcuguccacaa

SEQ ID NO: 491289 - RNA, 19 nt, Homo sapiens
ggagcccggaguagacuga

SEQ ID NO: 491290 - RNA, 19 nt, Homo sapiens
gaccaucuacauacacagu

SEQ ID NO: 491291 - RNA, 19 nt, Homo sapiens
caucuacugcugccucaau

SEQ ID NO: 491292 - RNA, 19 nt, Homo sapiens
guacuacggccuguucuac

SEQ ID NO: 491293 - RNA, 19 nt, Homo sapiens
aagaccaucuacauacaca

SEQ ID NO: 491294 - RNA, 19 nt, Homo sapiens
acucagaccucuccccaaa

SEQ ID NO: 491295 - RNA, 19 nt, Homo sapiens
gccacaagaccaucuacau

SEQ ID NO: 491296 - RNA, 19 nt, Homo sapiens
ggugauuggcuaugcauac

SEQ ID NO: 491297 - RNA, 19 nt, Homo sapiens
ccacaacgaaugguacuac

SEQ ID NO: 491298 - RNA, 19 nt, Homo sapiens
gcuucgaaauggauaacgu

SEQ ID NO: 491299 - RNA, 19 nt, Homo sapiens
gggcuuuaccgccuagcuu

SEQ ID NO: 491300 - RNA, 19 nt, Homo sapiens
cugucuggcuuuagaagga

SEQ ID NO: 491301 - RNA, 19 nt, Homo sapiens
gcaaugagcucaaccaugu

SEQ ID NO: 491302 - RNA, 19 nt, Homo sapiens
ugagaaagguaguguauaa

SEQ ID NO: 491303 - RNA, 19 nt, Homo sapiens
gaaagguaguguauaaaug

SEQ ID NO: 491304 - RNA, 19 nt, Homo sapiens
ccaaacaacauuucacuua

SEQ ID NO: 491305 - RNA, 19 nt, Homo sapiens
ggagaaaucccaggagaua

SEQ ID NO: 491306 - RNA, 19 nt, Homo sapiens
ggaaguauuuggauucuag

SEQ ID NO: 491307 - RNA, 19 nt, Homo sapiens
caaagacacuaauaacaug

SEQ ID NO: 491308 - RNA, 19 nt, Homo sapiens
gaacuucuuuccuaucaca

SEQ ID NO: 491309 - RNA, 19 nt, Homo sapiens
caucaaaguuuccagcuau

SEQ ID NO: 491310 - RNA, 19 nt, Homo sapiens
gcauuucgcugguguccuu

SEQ ID NO: 491311 - RNA, 19 nt, Homo sapiens
caacauuucacuuaccaua

SEQ ID NO: 491312 - RNA, 19 nt, Homo sapiens
uaucaguccuguccuauau

SEQ ID NO: 491313 - RNA, 19 nt, Homo sapiens
guauuuggauucuagcauu

SEQ ID NO: 491314 - RNA, 19 nt, Homo sapiens
gccagaaggucccaaacaa

SEQ ID NO: 491315 - RNA, 19 nt, Homo sapiens
uauauacccucuagaaaca

SEQ ID NO: 491316 - RNA, 19 nt, Homo sapiens
ggacagguauauggcuauu

SEQ ID NO: 491317 - RNA, 19 nt, Homo sapiens
uucauaagcucacccuaua

SEQ ID NO: 491318 - RNA, 19 nt, Homo sapiens
caaacaacauuucacuuac

SEQ ID NO: 491319 - RNA, 19 nt, Homo sapiens
acagguauauggcuauuau

SEQ ID NO: 491320 - RNA, 19 nt, Homo sapiens
uggcugcccuaucauauuu

SEQ ID NO: 491321 - RNA, 19 nt, Homo sapiens
gaaggucccaaacaacauu

SEQ ID NO: 491322 - RNA, 19 nt, Homo sapiens
ucagaggagucucgucuug

SEQ ID NO: 491323 - RNA, 19 nt, Homo sapiens
guauaaaugugacaaagac

SEQ ID NO: 491324 - RNA, 19 nt, Homo sapiens
gguguacuguuucccauug

SEQ ID NO: 491325 - RNA, 19 nt, Homo sapiens
ccauugcgguggacaggua

SEQ ID NO: 491326 - RNA, 19 nt, Homo sapiens
ugaggacugucaccaacua

SEQ ID NO: 491327 - RNA, 19 nt, Homo sapiens
gacaaagacacuaauaaca

SEQ ID NO: 491328 - RNA, 19 nt, Homo sapiens
gccagcaucuacuccauga

SEQ ID NO: 491329 - RNA, 19 nt, Homo sapiens
aggcagcuauggucaaauu

SEQ ID NO: 491330 - RNA, 19 nt, Homo sapiens
ugcaaucuaucaacaacua

SEQ ID NO: 491331 - RNA, 19 nt, Homo sapiens
ccaccagguuucauccaaa

SEQ ID NO: 491332 - RNA, 19 nt, Homo sapiens
gcucaagaccaccagguuu

SEQ ID NO: 491333 - RNA, 19 nt, Homo sapiens
ucacugcaaucuaucaaca

SEQ ID NO: 491334 - RNA, 19 nt, Homo sapiens
gguauauggcuauuauuga

SEQ ID NO: 491335 - RNA, 19 nt, Homo sapiens
ccaagagacccaaguuuca

SEQ ID NO: 491336 - RNA, 19 nt, Homo sapiens
gaaaucucaucgucaucug

SEQ ID NO: 491337 - RNA, 19 nt, Homo sapiens
auaccucuguggaugaaua

SEQ ID NO: 491338 - RNA, 19 nt, Homo sapiens
ccaugacagucguguuuga

SEQ ID NO: 491339 - RNA, 19 nt, Homo sapiens
ccaacuacuuccuugugaa

SEQ ID NO: 491340 - RNA, 19 nt, Homo sapiens
gugacaaagacacuaauaa

SEQ ID NO: 491341 - RNA, 19 nt, Homo sapiens
cuacugcugucugaauaaa

SEQ ID NO: 491342 - RNA, 19 nt, Homo sapiens
cuacuugccuucccucagu

SEQ ID NO: 491343 - RNA, 19 nt, Homo sapiens
gauucuagcauuucuacuu

SEQ ID NO: 491344 - RNA, 19 nt, Homo sapiens
gagaaagguaguguauaaa

SEQ ID NO: 491345 - RNA, 19 nt, Homo sapiens
ccaaaccggcaaagcagua

SEQ ID NO: 491346 - RNA, 19 nt, Homo sapiens
gcucaaccauguacaaucc

SEQ ID NO: 491347 - RNA, 19 nt, Homo sapiens
gauugucauuggaaguauu

SEQ ID NO: 491348 - RNA, 19 nt, Homo sapiens
gccaagagacccaaguuuc

SEQ ID NO: 491349 - RNA, 19 nt, Homo sapiens
ucaucaaaguuuccagcua

SEQ ID NO: 491350 - RNA, 19 nt, Homo sapiens
caaaagaaagguugucaaa

SEQ ID NO: 491351 - RNA, 19 nt, Homo sapiens
gggccaaccucaccaacca

SEQ ID NO: 491352 - RNA, 19 nt, Homo sapiens
ggacugucaccaacuacuu

SEQ ID NO: 491353 - RNA, 19 nt, Homo sapiens
ggaaaucucaucgucaucu

SEQ ID NO: 491354 - RNA, 19 nt, Homo sapiens
ugacaaagacacuaauaac

SEQ ID NO: 491355 - RNA, 19 nt, Homo sapiens
caagagacccaaguuucaa

SEQ ID NO: 491356 - RNA, 19 nt, Homo sapiens
cauucucacugcaaucuau

SEQ ID NO: 491357 - RNA, 19 nt, Homo sapiens
cagaaggucccaaacaaca

SEQ ID NO: 491358 - RNA, 19 nt, Homo sapiens
caacaacuaaauagaugga

SEQ ID NO: 491359 - RNA, 19 nt, Homo sapiens
uuauacugguguacuguuu

SEQ ID NO: 491360 - RNA, 19 nt, Homo sapiens
cauuggaaguauuuggauu

SEQ ID NO: 491361 - RNA, 19 nt, Homo sapiens
uuaggcagcuauggucaaa

SEQ ID NO: 491362 - RNA, 19 nt, Homo sapiens
ucgcaggaauuccaaaucu

SEQ ID NO: 491363 - RNA, 19 nt, Homo sapiens
gaaaagagcaacgccaaga

SEQ ID NO: 491364 - RNA, 19 nt, Homo sapiens
guccaugacagucguguuu

SEQ ID NO: 491365 - RNA, 19 nt, Homo sapiens
auacaccauuguuggaauu

SEQ ID NO: 491366 - RNA, 19 nt, Homo sapiens
cauagcgagugguacuuug

SEQ ID NO: 491367 - RNA, 19 nt, Homo sapiens
gaaagguugucaaaaugau

SEQ ID NO: 491368 - RNA, 19 nt, Homo sapiens
cauguacaaucccaucauc

SEQ ID NO: 491369 - RNA, 19 nt, Homo sapiens
gcaaucuaucaacaacuaa

SEQ ID NO: 491370 - RNA, 19 nt, Homo sapiens
gcaugaggacugucaccaa

SEQ ID NO: 491371 - RNA, 19 nt, Homo sapiens
caaccucaccaaccaguuc

SEQ ID NO: 491372 - RNA, 19 nt, Homo sapiens
cuagaaacagaaagcaauu

SEQ ID NO: 491373 - RNA, 19 nt, Homo sapiens
aaagagcaacgccaagaga

SEQ ID NO: 491374 - RNA, 19 nt, Homo sapiens
cggcaaagcaguauguaca

SEQ ID NO: 491375 - RNA, 19 nt, Homo sapiens
cuacagcaaccaagauugu

SEQ ID NO: 491376 - RNA, 19 nt, Homo sapiens
uguacaaucccaucaucua

SEQ ID NO: 491377 - RNA, 19 nt, Homo sapiens
ucugcuggcugcccuauca

SEQ ID NO: 491378 - RNA, 19 nt, Homo sapiens
cauacaccauuguuggaau

SEQ ID NO: 491379 - RNA, 19 nt, Homo sapiens
ccuauauacccucuagaaa

SEQ ID NO: 491380 - RNA, 19 nt, Homo sapiens
cccauucuccuauuuauca

SEQ ID NO: 491381 - RNA, 19 nt, Homo sapiens
ggaccccauucuccuauuu

SEQ ID NO: 491382 - RNA, 19 nt, Homo sapiens
ugggaaaucucaucgucau

SEQ ID NO: 491383 - RNA, 19 nt, Homo sapiens
cagcagaaaccuggauaga

SEQ ID NO: 491384 - RNA, 19 nt, Homo sapiens
guacaaucccaucaucuac

SEQ ID NO: 491385 - RNA, 19 nt, Homo sapiens
ucaguccuguccuauauac

SEQ ID NO: 491386 - RNA, 19 nt, Homo sapiens
gcugguguccuuucaucaa

SEQ ID NO: 491387 - RNA, 19 nt, Homo sapiens
ucagugucuuuauuccaaa

SEQ ID NO: 491388 - RNA, 19 nt, Homo sapiens
auucuagcauuucuacuug

SEQ ID NO: 491389 - RNA, 19 nt, Homo sapiens
guuggucaauuucaucuac

SEQ ID NO: 491390 - RNA, 19 nt, Homo sapiens
guaaaagauuagugugaga

SEQ ID NO: 491391 - RNA, 19 nt, Homo sapiens
caaaguuuccagcuaugau

SEQ ID NO: 491392 - RNA, 19 nt, Homo sapiens
acaaucccaucaucuacug

SEQ ID NO: 491393 - RNA, 19 nt, Homo sapiens
ucauuauacugguguacug

SEQ ID NO: 491394 - RNA, 19 nt, Homo sapiens
gcaaccaagauugucauug

SEQ ID NO: 491395 - RNA, 19 nt, Homo sapiens
cugguguccuuucaucaaa

SEQ ID NO: 491396 - RNA, 19 nt, Homo sapiens
gagcucaaccauguacaau

SEQ ID NO: 491397 - RNA, 19 nt, Homo sapiens
gucaugacauuugcuaucu

SEQ ID NO: 491398 - RNA, 19 nt, Homo sapiens
cucagugucuuuauuccaa

SEQ ID NO: 491399 - RNA, 19 nt, Homo sapiens
acacguuggucaauuucau

SEQ ID NO: 491400 - RNA, 19 nt, Homo sapiens
aagauugucauuggaagua

SEQ ID NO: 491401 - RNA, 19 nt, Homo sapiens
caaaguagguauuucagua

SEQ ID NO: 491402 - RNA, 19 nt, Homo sapiens
gaagaugacucggacauuu

SEQ ID NO: 491403 - RNA, 19 nt, Homo sapiens
gcaaugaucccucugauaa

SEQ ID NO: 491404 - RNA, 19 nt, Homo sapiens
uaacaccucuuguaacuaa

SEQ ID NO: 491405 - RNA, 19 nt, Homo sapiens
ucaagaggcuccaagaaua

SEQ ID NO: 491406 - RNA, 19 nt, Homo sapiens
caagauagaugugaacaaa

SEQ ID NO: 491407 - RNA, 19 nt, Homo sapiens
gaucagaagucagaaguuu

SEQ ID NO: 491408 - RNA, 19 nt, Homo sapiens
gcacagagaagcugaauga

SEQ ID NO: 491409 - RNA, 19 nt, Homo sapiens
auacaaaucugcucuauug

SEQ ID NO: 491410 - RNA, 19 nt, Homo sapiens
gaagauggcugugguagau

SEQ ID NO: 491411 - RNA, 19 nt, Homo sapiens
uauaagagaccauggauua

SEQ ID NO: 491412 - RNA, 19 nt, Homo sapiens
gaacgaauguaacaagcaa

SEQ ID NO: 491413 - RNA, 19 nt, Homo sapiens
cagcaggcauuaccaauuu

SEQ ID NO: 491414 - RNA, 19 nt, Homo sapiens
caagagcacucaucaagau

SEQ ID NO: 491415 - RNA, 19 nt, Homo sapiens
ucaaagcgaucauacuuau

SEQ ID NO: 491416 - RNA, 19 nt, Homo sapiens
gcacuaugcucucagaagu

SEQ ID NO: 491417 - RNA, 19 nt, Homo sapiens
gaauacaaaucugcucuau

SEQ ID NO: 491418 - RNA, 19 nt, Homo sapiens
ucacagugcugguagaaau

SEQ ID NO: 491419 - RNA, 19 nt, Homo sapiens
ggaccuguaugaaacaaug

SEQ ID NO: 491420 - RNA, 19 nt, Homo sapiens
gaaugggacuugagagaca

SEQ ID NO: 491421 - RNA, 19 nt, Homo sapiens
ugacacagccauuccauuu

SEQ ID NO: 491422 - RNA, 19 nt, Homo sapiens
ggauguagccaaucaaaug

SEQ ID NO: 491423 - RNA, 19 nt, Homo sapiens
cauaguaccucacaucaca

SEQ ID NO: 491424 - RNA, 19 nt, Homo sapiens
guauuucaguacccuguua

SEQ ID NO: 491425 - RNA, 19 nt, Homo sapiens
cagcacucguugccaauua

SEQ ID NO: 491426 - RNA, 19 nt, Homo sapiens
ugaaagccaugcauuggaa

SEQ ID NO: 491427 - RNA, 19 nt, Homo sapiens
cagcuggacugcucaagaa

SEQ ID NO: 491428 - RNA, 19 nt, Homo sapiens
guauuaugcugcagaguug

SEQ ID NO: 491429 - RNA, 19 nt, Homo sapiens
gaaacaaugaggcgauuug

SEQ ID NO: 491430 - RNA, 19 nt, Homo sapiens
gaccagcguugcccauuug

SEQ ID NO: 491431 - RNA, 19 nt, Homo sapiens
cagagaagcugaaugaaaa

SEQ ID NO: 491432 - RNA, 19 nt, Homo sapiens
uuuaaugucuggcuuugua

SEQ ID NO: 491433 - RNA, 19 nt, Homo sapiens
auacaucacuaaaggcuaa

SEQ ID NO: 491434 - RNA, 19 nt, Homo sapiens
ggaggaagagcgccuuaaa

SEQ ID NO: 491435 - RNA, 19 nt, Homo sapiens
aaucaaaugugcaccaaga

SEQ ID NO: 491436 - RNA, 19 nt, Homo sapiens
gaccaaagcagcacucguu

SEQ ID NO: 491437 - RNA, 19 nt, Homo sapiens
ggauauaacaugucucugu

SEQ ID NO: 491438 - RNA, 19 nt, Homo sapiens
uaucaagugugcugaaugu

SEQ ID NO: 491439 - RNA, 19 nt, Homo sapiens
agaguugugugcuacauaa

SEQ ID NO: 491440 - RNA, 19 nt, Homo sapiens
gagcugaggcgcagguaaa

SEQ ID NO: 491441 - RNA, 19 nt, Homo sapiens
uaucuaucauuccagguua

SEQ ID NO: 491442 - RNA, 19 nt, Homo sapiens
gacuguggcuuuggaaauu

SEQ ID NO: 491443 - RNA, 19 nt, Homo sapiens
gcaagagcacucaucaaga

SEQ ID NO: 491444 - RNA, 19 nt, Homo sapiens
gaggcgauuugcaagaauu

SEQ ID NO: 491445 - RNA, 19 nt, Homo sapiens
aagaagcucugcugaggaa

SEQ ID NO: 491446 - RNA, 19 nt, Homo sapiens
gagaaggauacaucacuaa

SEQ ID NO: 491447 - RNA, 19 nt, Homo sapiens
agagaaggauacaucacua

SEQ ID NO: 491448 - RNA, 19 nt, Homo sapiens
ggauuaaucaaccuuagaa

SEQ ID NO: 491449 - RNA, 19 nt, Homo sapiens
ccauuucacucuacagaug

SEQ ID NO: 491450 - RNA, 19 nt, Homo sapiens
acacagccauuccauuuca

SEQ ID NO: 491451 - RNA, 19 nt, Homo sapiens
caucaaagcgaucauacuu

SEQ ID NO: 491452 - RNA, 19 nt, Homo sapiens
caaaucugcucuauugaac

SEQ ID NO: 491453 - RNA, 19 nt, Homo sapiens
gagcacucaucaagauaga

SEQ ID NO: 491454 - RNA, 19 nt, Homo sapiens
gcugaauucucauggugaa

SEQ ID NO: 491455 - RNA, 19 nt, Homo sapiens
cagauuucauugaggaauu

SEQ ID NO: 491456 - RNA, 19 nt, Homo sapiens
gaaacaagcagaggaagca

SEQ ID NO: 491457 - RNA, 19 nt, Homo sapiens
ugaccagcguugcccauuu

SEQ ID NO: 491458 - RNA, 19 nt, Homo sapiens
ugucuaaucugcaguaguc

SEQ ID NO: 491459 - RNA, 19 nt, Homo sapiens
gaagucagaaguuuggaau

SEQ ID NO: 491460 - RNA, 19 nt, Homo sapiens
ugacaauuaugcagaaugg

SEQ ID NO: 491461 - RNA, 19 nt, Homo sapiens
ccuaacaccucuuguaacu

SEQ ID NO: 491462 - RNA, 19 nt, Homo sapiens
gagugggcauucauuccua

SEQ ID NO: 491463 - RNA, 19 nt, Homo sapiens
gguauuaugcugcagaguu

SEQ ID NO: 491464 - RNA, 19 nt, Homo sapiens
gaacaaaacccggaaaauc

SEQ ID NO: 491465 - RNA, 19 nt, Homo sapiens
acagagaagcugaaugaaa

SEQ ID NO: 491466 - RNA, 19 nt, Homo sapiens
ucaucaagcuuugguguau

SEQ ID NO: 491467 - RNA, 19 nt, Homo sapiens
caacaaagugagacucugu

SEQ ID NO: 491468 - RNA, 19 nt, Homo sapiens
ggcaggauguagccaauca

SEQ ID NO: 491469 - RNA, 19 nt, Homo sapiens
ggacuguggcuuuggaaau

SEQ ID NO: 491470 - RNA, 19 nt, Homo sapiens
gaaggauacaucacuaaag

SEQ ID NO: 491471 - RNA, 19 nt, Homo sapiens
gccaugcauuggaauuuga

SEQ ID NO: 491472 - RNA, 19 nt, Homo sapiens
gauggacuguggcuuugga

SEQ ID NO: 491473 - RNA, 19 nt, Homo sapiens
ggccgguucugaagucuug

SEQ ID NO: 491474 - RNA, 19 nt, Homo sapiens
ggacagcaggcauuaccaa

SEQ ID NO: 491475 - RNA, 19 nt, Homo sapiens
gccauuccauuucacucua

SEQ ID NO: 491476 - RNA, 19 nt, Homo sapiens
ggacugcucaagaagaaau

SEQ ID NO: 491477 - RNA, 19 nt, Homo sapiens
aaacaucaaagcgaucaua

SEQ ID NO: 491478 - RNA, 19 nt, Homo sapiens
caggagaauugcuugaaca

SEQ ID NO: 491479 - RNA, 19 nt, Homo sapiens
caucaauaacccucuguuu

SEQ ID NO: 491480 - RNA, 19 nt, Homo sapiens
guguuucacucgaggcuuu

SEQ ID NO: 491481 - RNA, 19 nt, Homo sapiens
cauggagccuuauaucaag

SEQ ID NO: 491482 - RNA, 19 nt, Homo sapiens
uguauugucuacuuucuuc

SEQ ID NO: 491483 - RNA, 19 nt, Homo sapiens
gaaaccuuaaguuguauug

SEQ ID NO: 491484 - RNA, 19 nt, Homo sapiens
ggaauguggugggucaaag

SEQ ID NO: 491485 - RNA, 19 nt, Homo sapiens
caucagagaaggauacauc

SEQ ID NO: 491486 - RNA, 19 nt, Homo sapiens
acaaaucugcucuauugaa

SEQ ID NO: 491487 - RNA, 19 nt, Homo sapiens
gaacuccgaagggaaauca

SEQ ID NO: 491488 - RNA, 19 nt, Homo sapiens
ucauggagccuuauaucaa

SEQ ID NO: 491489 - RNA, 19 nt, Homo sapiens
ugguagaaauggaacuaaa

SEQ ID NO: 491490 - RNA, 19 nt, Homo sapiens
ggcaagagcacucaucaag

SEQ ID NO: 491491 - RNA, 19 nt, Homo sapiens
gcguugcccauuugaauuu

SEQ ID NO: 491492 - RNA, 19 nt, Homo sapiens
acaaugaggcgauuugcaa

SEQ ID NO: 491493 - RNA, 19 nt, Homo sapiens
uaagagaccauggauuaau

SEQ ID NO: 491494 - RNA, 19 nt, Homo sapiens
gaagcucugcugaggaaga

SEQ ID NO: 491495 - RNA, 19 nt, Homo sapiens
aaggauacaucacuaaagg

SEQ ID NO: 491496 - RNA, 19 nt, Homo sapiens
ggagugcaccacccuugaa

SEQ ID NO: 491497 - RNA, 19 nt, Homo sapiens
aguggaacaugacaaauuc

SEQ ID NO: 491498 - RNA, 19 nt, Homo sapiens
caguggaacaugacaaauu

SEQ ID NO: 491499 - RNA, 19 nt, Homo sapiens
caauaacccucuguuugca

SEQ ID NO: 491500 - RNA, 19 nt, Homo sapiens
ccaaucaaaugugcaccaa

SEQ ID NO: 491501 - RNA, 19 nt, Homo sapiens
caaaguagguauuucagua

SEQ ID NO: 491502 - RNA, 19 nt, Homo sapiens
gaagaugacucggacauuu

SEQ ID NO: 491503 - RNA, 19 nt, Homo sapiens
gcaaugaucccucugauaa

SEQ ID NO: 491504 - RNA, 19 nt, Homo sapiens
gaagauggcugugguagau

SEQ ID NO: 491505 - RNA, 19 nt, Homo sapiens
uauaagagaccauggauua

SEQ ID NO: 491506 - RNA, 19 nt, Homo sapiens
ucaaagcgaucauacuuau

SEQ ID NO: 491507 - RNA, 19 nt, Homo sapiens
gagagauaaugguguguuu

SEQ ID NO: 491508 - RNA, 19 nt, Homo sapiens
ggaccuguaugaaacaaug

SEQ ID NO: 491509 - RNA, 19 nt, Homo sapiens
gaaugggacuugagagaca

SEQ ID NO: 491510 - RNA, 19 nt, Homo sapiens
ugacacagccauuccauuu

SEQ ID NO: 491511 - RNA, 19 nt, Homo sapiens
ggauguagccaaucaaaug

SEQ ID NO: 491512 - RNA, 19 nt, Homo sapiens
cagcacucguugccaauua

SEQ ID NO: 491513 - RNA, 19 nt, Homo sapiens
guauuucaguacccuguua

SEQ ID NO: 491514 - RNA, 19 nt, Homo sapiens
cagcuggacugcucaagaa

SEQ ID NO: 491515 - RNA, 19 nt, Homo sapiens
gaaacaaugaggcgauuug

SEQ ID NO: 491516 - RNA, 19 nt, Homo sapiens
gaccagcguugcccauuug

SEQ ID NO: 491517 - RNA, 19 nt, Homo sapiens
aaucaaaugugcaccaaga

SEQ ID NO: 491518 - RNA, 19 nt, Homo sapiens
gaccaaagcagcacucguu

SEQ ID NO: 491519 - RNA, 19 nt, Homo sapiens
uaucaagugugcugaaugu

SEQ ID NO: 491520 - RNA, 19 nt, Homo sapiens
gagcugaggcgcagguaaa

SEQ ID NO: 491521 - RNA, 19 nt, Homo sapiens
uaucuaucauuccagguua

SEQ ID NO: 491522 - RNA, 19 nt, Homo sapiens
gacuguggcuuuggaaauu

SEQ ID NO: 491523 - RNA, 19 nt, Homo sapiens
gaggcgauuugcaagaauu

SEQ ID NO: 491524 - RNA, 19 nt, Homo sapiens
aagaagcucugcugaggaa

SEQ ID NO: 491525 - RNA, 19 nt, Homo sapiens
ggauuaaucaaccuuagaa

SEQ ID NO: 491526 - RNA, 19 nt, Homo sapiens
ccauuucacucuacagaug

SEQ ID NO: 491527 - RNA, 19 nt, Homo sapiens
acacagccauuccauuuca

SEQ ID NO: 491528 - RNA, 19 nt, Homo sapiens
caucaaagcgaucauacuu

SEQ ID NO: 491529 - RNA, 19 nt, Homo sapiens
cagauuucauugaggaauu

SEQ ID NO: 491530 - RNA, 19 nt, Homo sapiens
gaaacaagcagaggaagca

SEQ ID NO: 491531 - RNA, 19 nt, Homo sapiens
ugaccagcguugcccauuu

SEQ ID NO: 491532 - RNA, 19 nt, Homo sapiens
gagcaguauuugugugugu

SEQ ID NO: 491533 - RNA, 19 nt, Homo sapiens
ugacaauuaugcagaaugg

SEQ ID NO: 491534 - RNA, 19 nt, Homo sapiens
gagauaaugguguguuuua

SEQ ID NO: 491535 - RNA, 19 nt, Homo sapiens
ucaucaagcuuugguguau

SEQ ID NO: 491536 - RNA, 19 nt, Homo sapiens
ggcaggauguagccaauca

SEQ ID NO: 491537 - RNA, 19 nt, Homo sapiens
ggacuguggcuuuggaaau

SEQ ID NO: 491538 - RNA, 19 nt, Homo sapiens
gauggacuguggcuuugga

SEQ ID NO: 491539 - RNA, 19 nt, Homo sapiens
gccauuccauuucacucua

SEQ ID NO: 491540 - RNA, 19 nt, Homo sapiens
ggacugcucaagaagaaau

SEQ ID NO: 491541 - RNA, 19 nt, Homo sapiens
aaacaucaaagcgaucaua

SEQ ID NO: 491542 - RNA, 19 nt, Homo sapiens
ggccgguucugaagucuug

SEQ ID NO: 491543 - RNA, 19 nt, Homo sapiens
caucaauaacccucuguuu

SEQ ID NO: 491544 - RNA, 19 nt, Homo sapiens
guguuucacucgaggcuuu

SEQ ID NO: 491545 - RNA, 19 nt, Homo sapiens
cauggagccuuauaucaag

SEQ ID NO: 491546 - RNA, 19 nt, Homo sapiens
ucauggagccuuauaucaa

SEQ ID NO: 491547 - RNA, 19 nt, Homo sapiens
acaaugaggcgauuugcaa

SEQ ID NO: 491548 - RNA, 19 nt, Homo sapiens
uaagagaccauggauuaau

SEQ ID NO: 491549 - RNA, 19 nt, Homo sapiens
gcguugcccauuugaauuu

SEQ ID NO: 491550 - RNA, 19 nt, Homo sapiens
gaagcucugcugaggaaga

SEQ ID NO: 491551 - RNA, 19 nt, Homo sapiens
aguggaacaugacaaauuc

SEQ ID NO: 491552 - RNA, 19 nt, Homo sapiens
caguggaacaugacaaauu

SEQ ID NO: 491553 - RNA, 19 nt, Homo sapiens
caauaacccucuguuugca

SEQ ID NO: 491554 - RNA, 19 nt, Homo sapiens
ccaaucaaaugugcaccaa

SEQ ID NO: 491555 - RNA, 19 nt, Homo sapiens
aagagaccauggauuaauc

SEQ ID NO: 491556 - RNA, 19 nt, Homo sapiens
ucaauaacccucuguuugc

SEQ ID NO: 491557 - RNA, 19 nt, Homo sapiens
cagaaugggacuugagaga

SEQ ID NO: 491558 - RNA, 19 nt, Homo sapiens
gugauggacuguggcuuug

SEQ ID NO: 491559 - RNA, 19 nt, Homo sapiens
ccauuugaauuuccuagca

SEQ ID NO: 491560 - RNA, 19 nt, Homo sapiens
ggagagauaaugguguguu

SEQ ID NO: 491561 - RNA, 19 nt, Homo sapiens
uaaauaggagagauaaugg

SEQ ID NO: 491562 - RNA, 19 nt, Homo sapiens
guuaaaggagagacaaaga

SEQ ID NO: 491563 - RNA, 19 nt, Homo sapiens
ggacuugagagacauugau

SEQ ID NO: 491564 - RNA, 19 nt, Homo sapiens
gaccuaccuuugacuccuu

SEQ ID NO: 491565 - RNA, 19 nt, Homo sapiens
gauguagccaaucaaaugu

SEQ ID NO: 491566 - RNA, 19 nt, Homo sapiens
agaaauggcccuuuuagaa

SEQ ID NO: 491567 - RNA, 19 nt, Homo sapiens
ugagagacauugauuuugu

SEQ ID NO: 491568 - RNA, 19 nt, Homo sapiens
gaaauggcccuuuuagaag

SEQ ID NO: 491569 - RNA, 19 nt, Homo sapiens
uaccaagaauggccacugu

SEQ ID NO: 491570 - RNA, 19 nt, Homo sapiens
aagaagaaauggcccuuuu

SEQ ID NO: 491571 - RNA, 19 nt, Homo sapiens
caugccagcucgagcagau

SEQ ID NO: 491572 - RNA, 19 nt, Homo sapiens
caagaagaaauggcccuuu

SEQ ID NO: 491573 - RNA, 19 nt, Homo sapiens
cuggacugcucaagaagaa

SEQ ID NO: 491574 - RNA, 19 nt, Homo sapiens
cagcguugcccauuugaau

SEQ ID NO: 491575 - RNA, 19 nt, Homo sapiens
gccaguggaacaugacaaa

SEQ ID NO: 491576 - RNA, 19 nt, Homo sapiens
agauggcugugguagauau

SEQ ID NO: 491577 - RNA, 19 nt, Homo sapiens
ccaaggaggagugugagaa

SEQ ID NO: 491578 - RNA, 19 nt, Homo sapiens
gaagaaauggcccuuuuag

SEQ ID NO: 491579 - RNA, 19 nt, Homo sapiens
gagagacauugauuuuguu

SEQ ID NO: 491580 - RNA, 19 nt, Homo sapiens
ggaaauuggcaggauguag

SEQ ID NO: 491581 - RNA, 19 nt, Homo sapiens
uauaucaagugugcugaau

SEQ ID NO: 491582 - RNA, 19 nt, Homo sapiens
uagcaaugaucccucugau

SEQ ID NO: 491583 - RNA, 19 nt, Homo sapiens
caguauuuguguguguaua

SEQ ID NO: 491584 - RNA, 19 nt, Homo sapiens
aagcuuugguguauguguu

SEQ ID NO: 491585 - RNA, 19 nt, Homo sapiens
agaccaaggaggaguguga

SEQ ID NO: 491586 - RNA, 19 nt, Homo sapiens
caggauguagccaaucaaa

SEQ ID NO: 491587 - RNA, 19 nt, Homo sapiens
guacaagaaacaucaaagc

SEQ ID NO: 491588 - RNA, 19 nt, Homo sapiens
gaguacaagaaacaucaaa

SEQ ID NO: 491589 - RNA, 19 nt, Homo sapiens
gaccguuuggguuccuuua

SEQ ID NO: 491590 - RNA, 19 nt, Homo sapiens
caucuacccugcugaaccu

SEQ ID NO: 491591 - RNA, 19 nt, Homo sapiens
ugugauggacuguggcuuu

SEQ ID NO: 491592 - RNA, 19 nt, Homo sapiens
caucaagcuuugguguaug

SEQ ID NO: 491593 - RNA, 19 nt, Homo sapiens
aaggagagacaaagacgaa

SEQ ID NO: 491594 - RNA, 19 nt, Homo sapiens
gacuugagagacauugauu

SEQ ID NO: 491595 - RNA, 19 nt, Homo sapiens
ucgagcagauuucauugag

SEQ ID NO: 491596 - RNA, 19 nt, Homo sapiens
ccguaaggauuugaacguu

SEQ ID NO: 491597 - RNA, 19 nt, Homo sapiens
gcagcacucguugccaauu

SEQ ID NO: 491598 - RNA, 19 nt, Homo sapiens
cauggauuaaucaaccuua

SEQ ID NO: 491599 - RNA, 19 nt, Homo sapiens
caaggaggagugugagaag

SEQ ID NO: 491600 - RNA, 19 nt, Homo sapiens
gcaguauuuguguguguau

SEQ ID NO: 491601 - RNA, 19 nt, Homo sapiens
gcagaaggaugauaaagaa

SEQ ID NO: 491602 - RNA, 19 nt, Homo sapiens
gcacagggauggacucaaa

SEQ ID NO: 491603 - RNA, 19 nt, Homo sapiens
gaagauugaugaugaaguu

SEQ ID NO: 491604 - RNA, 19 nt, Homo sapiens
ccaaucaacuggagauaua

SEQ ID NO: 491605 - RNA, 19 nt, Homo sapiens
caaauuagcucgcuuagag

SEQ ID NO: 491606 - RNA, 19 nt, Homo sapiens
gaaagaacauugagaacau

SEQ ID NO: 491607 - RNA, 19 nt, Homo sapiens
gaacaugucucagccagaa

SEQ ID NO: 491608 - RNA, 19 nt, Homo sapiens
caaccaagauaaagaacua

SEQ ID NO: 491609 - RNA, 19 nt, Homo sapiens
ggaaugcgauggcuuacaa

SEQ ID NO: 491610 - RNA, 19 nt, Homo sapiens
ccaagcaacuucuacguaa

SEQ ID NO: 491611 - RNA, 19 nt, Homo sapiens
ggaagaaugucccaucugu

SEQ ID NO: 491612 - RNA, 19 nt, Homo sapiens
gcucugcgcugacuucaaa

SEQ ID NO: 491613 - RNA, 19 nt, Homo sapiens
ggaggaagcagaauuagaa

SEQ ID NO: 491614 - RNA, 19 nt, Homo sapiens
gauagugacuuugaagaaa

SEQ ID NO: 491615 - RNA, 19 nt, Homo sapiens
gaucagagcuaugguguca

SEQ ID NO: 491616 - RNA, 19 nt, Homo sapiens
gaacaugaaccugugauaa

SEQ ID NO: 491617 - RNA, 19 nt, Homo sapiens
uaaaucaccucuccuaauc

SEQ ID NO: 491618 - RNA, 19 nt, Homo sapiens
gucaucaacugaagucuua

SEQ ID NO: 491619 - RNA, 19 nt, Homo sapiens
ggagaaagaggaagaagaa

SEQ ID NO: 491620 - RNA, 19 nt, Homo sapiens
ugagagaucuuccaaauac

SEQ ID NO: 491621 - RNA, 19 nt, Homo sapiens
ggaaggaacuacagcgaau

SEQ ID NO: 491622 - RNA, 19 nt, Homo sapiens
caacacagcagaaggauga

SEQ ID NO: 491623 - RNA, 19 nt, Homo sapiens
gacuauggcuucaaacuga

SEQ ID NO: 491624 - RNA, 19 nt, Homo sapiens
ucacagagaugaugacaca

SEQ ID NO: 491625 - RNA, 19 nt, Homo sapiens
ccacucagauuaugaugaa

SEQ ID NO: 491626 - RNA, 19 nt, Homo sapiens
ucacugaacucacggcaaa

SEQ ID NO: 491627 - RNA, 19 nt, Homo sapiens
gacgcugucucaagauuua

SEQ ID NO: 491628 - RNA, 19 nt, Homo sapiens
caugauagcugcagagcaa

SEQ ID NO: 491629 - RNA, 19 nt, Homo sapiens
gaaagcagcauccggaaga

SEQ ID NO: 491630 - RNA, 19 nt, Homo sapiens
ucaaugagguggcagaaga

SEQ ID NO: 491631 - RNA, 19 nt, Homo sapiens
caacugaggcggcuuaaga

SEQ ID NO: 491632 - RNA, 19 nt, Homo sapiens
gcagugcugugcuuauuau

SEQ ID NO: 491633 - RNA, 19 nt, Homo sapiens
caugagagaucuuccaaau

SEQ ID NO: 491634 - RNA, 19 nt, Homo sapiens
gaaaauggacccuuaauga

SEQ ID NO: 491635 - RNA, 19 nt, Homo sapiens
gaaaagacagucauucaua

SEQ ID NO: 491636 - RNA, 19 nt, Homo sapiens
gaaagcgucuuggaugaug

SEQ ID NO: 491637 - RNA, 19 nt, Homo sapiens
gggaaagcgucuuggauga

SEQ ID NO: 491638 - RNA, 19 nt, Homo sapiens
guaagaacaucuccaagca

SEQ ID NO: 491639 - RNA, 19 nt, Homo sapiens
caagauuuaucgcacguuu

SEQ ID NO: 491640 - RNA, 19 nt, Homo sapiens
gagagucaguauacuaaga

SEQ ID NO: 491641 - RNA, 19 nt, Homo sapiens
ugacuagccuuaacucuuc

SEQ ID NO: 491642 - RNA, 19 nt, Homo sapiens
caacugaagucuuaucaac

SEQ ID NO: 491643 - RNA, 19 nt, Homo sapiens
aaacaggagucaucaagga

SEQ ID NO: 491644 - RNA, 19 nt, Homo sapiens
gaaacaaucacagagauga

SEQ ID NO: 491645 - RNA, 19 nt, Homo sapiens
gaagauaccagcagacgau

SEQ ID NO: 491646 - RNA, 19 nt, Homo sapiens
ugugggaucugguggaaua

SEQ ID NO: 491647 - RNA, 19 nt, Homo sapiens
caauaugucugucuuggau

SEQ ID NO: 491648 - RNA, 19 nt, Homo sapiens
gagagcaucuggagcuaau

SEQ ID NO: 491649 - RNA, 19 nt, Homo sapiens
gaaaaucucugguucucaa

SEQ ID NO: 491650 - RNA, 19 nt, Homo sapiens
gaugaagauugaugaugaa

SEQ ID NO: 491651 - RNA, 19 nt, Homo sapiens
agaugaagauugaugauga

SEQ ID NO: 491652 - RNA, 19 nt, Homo sapiens
caagacaggguuacuauau

SEQ ID NO: 491653 - RNA, 19 nt, Homo sapiens
ggaaucaucucugaagaag

SEQ ID NO: 491654 - RNA, 19 nt, Homo sapiens
ggagauauagauaaaguga

SEQ ID NO: 491655 - RNA, 19 nt, Homo sapiens
gaagcaccgugagcugaua

SEQ ID NO: 491656 - RNA, 19 nt, Homo sapiens
agacauugauugcaaguug

SEQ ID NO: 491657 - RNA, 19 nt, Homo sapiens
gaagaaaugggaaagaaca

SEQ ID NO: 491658 - RNA, 19 nt, Homo sapiens
caacuucuacguaaauuug

SEQ ID NO: 491659 - RNA, 19 nt, Homo sapiens
ggauacgaauggaagauau

SEQ ID NO: 491660 - RNA, 19 nt, Homo sapiens
gcuccaauuuaucuucaua

SEQ ID NO: 491661 - RNA, 19 nt, Homo sapiens
gugaagacauugauugcaa

SEQ ID NO: 491662 - RNA, 19 nt, Homo sapiens
gaaagaagacaaauuagcu

SEQ ID NO: 491663 - RNA, 19 nt, Homo sapiens
caugaggacuaacaaauuc

SEQ ID NO: 491664 - RNA, 19 nt, Homo sapiens
gaaggaugcuggcuauggu

SEQ ID NO: 491665 - RNA, 19 nt, Homo sapiens
caacuggagauauagauaa

SEQ ID NO: 491666 - RNA, 19 nt, Homo sapiens
gcuuaugucugaaggagaa

SEQ ID NO: 491667 - RNA, 19 nt, Homo sapiens
gaagaagagaucagagcua

SEQ ID NO: 491668 - RNA, 19 nt, Homo sapiens
ggugggugcuuaagucuga

SEQ ID NO: 491669 - RNA, 19 nt, Homo sapiens
ggacaagacaggguuacua

SEQ ID NO: 491670 - RNA, 19 nt, Homo sapiens
gagaaagacagaacaugaa

SEQ ID NO: 491671 - RNA, 19 nt, Homo sapiens
caaugucacccuuugauuu

SEQ ID NO: 491672 - RNA, 19 nt, Homo sapiens
ggaauaagacccaaacaac

SEQ ID NO: 491673 - RNA, 19 nt, Homo sapiens
gacaauccuuucucugcua

SEQ ID NO: 491674 - RNA, 19 nt, Homo sapiens
caacacaucccucaguaug

SEQ ID NO: 491675 - RNA, 19 nt, Homo sapiens
gcaccagauuguaaauaug

SEQ ID NO: 491676 - RNA, 19 nt, Homo sapiens
gaaggaaucaucucugaag

SEQ ID NO: 491677 - RNA, 19 nt, Homo sapiens
gggaggaugucaaacacaa

SEQ ID NO: 491678 - RNA, 19 nt, Homo sapiens
gcaguggguuugacuaugg

SEQ ID NO: 491679 - RNA, 19 nt, Homo sapiens
gcccgacugugguaugaua

SEQ ID NO: 491680 - RNA, 19 nt, Homo sapiens
gaggauagcaacaucaguu

SEQ ID NO: 491681 - RNA, 19 nt, Homo sapiens
ggaaagaacauugagaaca

SEQ ID NO: 491682 - RNA, 19 nt, Homo sapiens
gaagauuuccagaugaaga

SEQ ID NO: 491683 - RNA, 19 nt, Homo sapiens
caaugaggaucugguauau

SEQ ID NO: 491684 - RNA, 19 nt, Homo sapiens
cuggaaagguguuacguuu

SEQ ID NO: 491685 - RNA, 19 nt, Homo sapiens
gagaagaugaugaggaaga

SEQ ID NO: 491686 - RNA, 19 nt, Homo sapiens
guaaaggacuacuacaaaa

SEQ ID NO: 491687 - RNA, 19 nt, Homo sapiens
ugacacagcuuccgugacu

SEQ ID NO: 491688 - RNA, 19 nt, Homo sapiens
gaagagaucagagcuaugg

SEQ ID NO: 491689 - RNA, 19 nt, Homo sapiens
aagaaggaaucaucucuga

SEQ ID NO: 491690 - RNA, 19 nt, Homo sapiens
cagccacucuugaugauga

SEQ ID NO: 491691 - RNA, 19 nt, Homo sapiens
gaaagaggaagaagaagca

SEQ ID NO: 491692 - RNA, 19 nt, Homo sapiens
acacaaggauggacaugga

SEQ ID NO: 491693 - RNA, 19 nt, Homo sapiens
ugacucagaucucucaauc

SEQ ID NO: 491694 - RNA, 19 nt, Homo sapiens
gaagauggcaguggguuug

SEQ ID NO: 491695 - RNA, 19 nt, Homo sapiens
gaugaaggguggguuagga

SEQ ID NO: 491696 - RNA, 19 nt, Homo sapiens
uaauaaaucaccucuccua

SEQ ID NO: 491697 - RNA, 19 nt, Homo sapiens
ugaguaugaugaacauuug

SEQ ID NO: 491698 - RNA, 19 nt, Homo sapiens
gaagaaacggcgaguugga

SEQ ID NO: 491699 - RNA, 19 nt, Homo sapiens
gagcaacugaggcggcuua

SEQ ID NO: 491700 - RNA, 19 nt, Homo sapiens
caagcaacuucuacguaaa

SEQ ID NO: 491701 - RNA, 19 nt, Homo sapiens
gcagaaggaugauaaagaa

SEQ ID NO: 491702 - RNA, 19 nt, Homo sapiens
gcacagggauggacucaaa

SEQ ID NO: 491703 - RNA, 19 nt, Homo sapiens
gaagauugaugaugaaguu

SEQ ID NO: 491704 - RNA, 19 nt, Homo sapiens
ccaaucaacuggagauaua

SEQ ID NO: 491705 - RNA, 19 nt, Homo sapiens
caaauuagcucgcuuagag

SEQ ID NO: 491706 - RNA, 19 nt, Homo sapiens
gaaagaacauugagaacau

SEQ ID NO: 491707 - RNA, 19 nt, Homo sapiens
gaacaugucucagccagaa

SEQ ID NO: 491708 - RNA, 19 nt, Homo sapiens
caaccaagauaaagaacua

SEQ ID NO: 491709 - RNA, 19 nt, Homo sapiens
ggaaugcgauggcuuacaa

SEQ ID NO: 491710 - RNA, 19 nt, Homo sapiens
ccaagcaacuucuacguaa

SEQ ID NO: 491711 - RNA, 19 nt, Homo sapiens
ggaagaaugucccaucugu

SEQ ID NO: 491712 - RNA, 19 nt, Homo sapiens
gcucugcgcugacuucaaa

SEQ ID NO: 491713 - RNA, 19 nt, Homo sapiens
ggaggaagcagaauuagaa

SEQ ID NO: 491714 - RNA, 19 nt, Homo sapiens
gauagugacuuugaagaaa

SEQ ID NO: 491715 - RNA, 19 nt, Homo sapiens
gaucagagcuaugguguca

SEQ ID NO: 491716 - RNA, 19 nt, Homo sapiens
gaacaugaaccugugauaa

SEQ ID NO: 491717 - RNA, 19 nt, Homo sapiens
uaaaucaccucuccuaauc

SEQ ID NO: 491718 - RNA, 19 nt, Homo sapiens
gucaucaacugaagucuua

SEQ ID NO: 491719 - RNA, 19 nt, Homo sapiens
ggagaaagaggaagaagaa

SEQ ID NO: 491720 - RNA, 19 nt, Homo sapiens
ugagagaucuuccaaauac

SEQ ID NO: 491721 - RNA, 19 nt, Homo sapiens
ggaaggaacuacagcgaau

SEQ ID NO: 491722 - RNA, 19 nt, Homo sapiens
caacacagcagaaggauga

SEQ ID NO: 491723 - RNA, 19 nt, Homo sapiens
gacuauggcuucaaacuga

SEQ ID NO: 491724 - RNA, 19 nt, Homo sapiens
ucacagagaugaugacaca

SEQ ID NO: 491725 - RNA, 19 nt, Homo sapiens
ccacucagauuaugaugaa

SEQ ID NO: 491726 - RNA, 19 nt, Homo sapiens
ucacugaacucacggcaaa

SEQ ID NO: 491727 - RNA, 19 nt, Homo sapiens
gacgcugucucaagauuua

SEQ ID NO: 491728 - RNA, 19 nt, Homo sapiens
caugauagcugcagagcaa

SEQ ID NO: 491729 - RNA, 19 nt, Homo sapiens
gaaagcagcauccggaaga

SEQ ID NO: 491730 - RNA, 19 nt, Homo sapiens
ucaaugagguggcagaaga

SEQ ID NO: 491731 - RNA, 19 nt, Homo sapiens
caacugaggcggcuuaaga

SEQ ID NO: 491732 - RNA, 19 nt, Homo sapiens
gcagugcugugcuuauuau

SEQ ID NO: 491733 - RNA, 19 nt, Homo sapiens
caugagagaucuuccaaau

SEQ ID NO: 491734 - RNA, 19 nt, Homo sapiens
gaaaauggacccuuaauga

SEQ ID NO: 491735 - RNA, 19 nt, Homo sapiens
gaaaagacagucauucaua

SEQ ID NO: 491736 - RNA, 19 nt, Homo sapiens
gaaagcgucuuggaugaug

SEQ ID NO: 491737 - RNA, 19 nt, Homo sapiens
gggaaagcgucuuggauga

SEQ ID NO: 491738 - RNA, 19 nt, Homo sapiens
guaagaacaucuccaagca

SEQ ID NO: 491739 - RNA, 19 nt, Homo sapiens
caagauuuaucgcacguuu

SEQ ID NO: 491740 - RNA, 19 nt, Homo sapiens
gagagucaguauacuaaga

SEQ ID NO: 491741 - RNA, 19 nt, Homo sapiens
ugacuagccuuaacucuuc

SEQ ID NO: 491742 - RNA, 19 nt, Homo sapiens
caacugaagucuuaucaac

SEQ ID NO: 491743 - RNA, 19 nt, Homo sapiens
aaacaggagucaucaagga

SEQ ID NO: 491744 - RNA, 19 nt, Homo sapiens
gaaacaaucacagagauga

SEQ ID NO: 491745 - RNA, 19 nt, Homo sapiens
gaagauaccagcagacgau

SEQ ID NO: 491746 - RNA, 19 nt, Homo sapiens
ugugggaucugguggaaua

SEQ ID NO: 491747 - RNA, 19 nt, Homo sapiens
caauaugucugucuuggau

SEQ ID NO: 491748 - RNA, 19 nt, Homo sapiens
gagagcaucuggagcuaau

SEQ ID NO: 491749 - RNA, 19 nt, Homo sapiens
gaaaaucucugguucucaa

SEQ ID NO: 491750 - RNA, 19 nt, Homo sapiens
gaugaagauugaugaugaa

SEQ ID NO: 491751 - RNA, 19 nt, Homo sapiens
agaugaagauugaugauga

SEQ ID NO: 491752 - RNA, 19 nt, Homo sapiens
caagacaggguuacuauau

SEQ ID NO: 491753 - RNA, 19 nt, Homo sapiens
ggaaucaucucugaagaag

SEQ ID NO: 491754 - RNA, 19 nt, Homo sapiens
ggagauauagauaaaguga

SEQ ID NO: 491755 - RNA, 19 nt, Homo sapiens
gaagcaccgugagcugaua

SEQ ID NO: 491756 - RNA, 19 nt, Homo sapiens
agacauugauugcaaguug

SEQ ID NO: 491757 - RNA, 19 nt, Homo sapiens
gaagaaaugggaaagaaca

SEQ ID NO: 491758 - RNA, 19 nt, Homo sapiens
caacuucuacguaaauuug

SEQ ID NO: 491759 - RNA, 19 nt, Homo sapiens
ggauacgaauggaagauau

SEQ ID NO: 491760 - RNA, 19 nt, Homo sapiens
gcuccaauuuaucuucaua

SEQ ID NO: 491761 - RNA, 19 nt, Homo sapiens
gugaagacauugauugcaa

SEQ ID NO: 491762 - RNA, 19 nt, Homo sapiens
gaaagaagacaaauuagcu

SEQ ID NO: 491763 - RNA, 19 nt, Homo sapiens
caugaggacuaacaaauuc

SEQ ID NO: 491764 - RNA, 19 nt, Homo sapiens
gaaggaugcuggcuauggu

SEQ ID NO: 491765 - RNA, 19 nt, Homo sapiens
caacuggagauauagauaa

SEQ ID NO: 491766 - RNA, 19 nt, Homo sapiens
gcuuaugucugaaggagaa

SEQ ID NO: 491767 - RNA, 19 nt, Homo sapiens
gaagaagagaucagagcua

SEQ ID NO: 491768 - RNA, 19 nt, Homo sapiens
ggugggugcuuaagucuga

SEQ ID NO: 491769 - RNA, 19 nt, Homo sapiens
ggacaagacaggguuacua

SEQ ID NO: 491770 - RNA, 19 nt, Homo sapiens
gagaaagacagaacaugaa

SEQ ID NO: 491771 - RNA, 19 nt, Homo sapiens
caaugucacccuuugauuu

SEQ ID NO: 491772 - RNA, 19 nt, Homo sapiens
ggaauaagacccaaacaac

SEQ ID NO: 491773 - RNA, 19 nt, Homo sapiens
gacaauccuuucucugcua

SEQ ID NO: 491774 - RNA, 19 nt, Homo sapiens
caacacaucccucaguaug

SEQ ID NO: 491775 - RNA, 19 nt, Homo sapiens
gcaccagauuguaaauaug

SEQ ID NO: 491776 - RNA, 19 nt, Homo sapiens
gaaggaaucaucucugaag

SEQ ID NO: 491777 - RNA, 19 nt, Homo sapiens
gggaggaugucaaacacaa

SEQ ID NO: 491778 - RNA, 19 nt, Homo sapiens
gcaguggguuugacuaugg

SEQ ID NO: 491779 - RNA, 19 nt, Homo sapiens
gcccgacugugguaugaua

SEQ ID NO: 491780 - RNA, 19 nt, Homo sapiens
gaggauagcaacaucaguu

SEQ ID NO: 491781 - RNA, 19 nt, Homo sapiens
ggaaagaacauugagaaca

SEQ ID NO: 491782 - RNA, 19 nt, Homo sapiens
gaagauuuccagaugaaga

SEQ ID NO: 491783 - RNA, 19 nt, Homo sapiens
caaugaggaucugguauau

SEQ ID NO: 491784 - RNA, 19 nt, Homo sapiens
cuggaaagguguuacguuu

SEQ ID NO: 491785 - RNA, 19 nt, Homo sapiens
gagaagaugaugaggaaga

SEQ ID NO: 491786 - RNA, 19 nt, Homo sapiens
guaaaggacuacuacaaaa

SEQ ID NO: 491787 - RNA, 19 nt, Homo sapiens
ugacacagcuuccgugacu

SEQ ID NO: 491788 - RNA, 19 nt, Homo sapiens
gaagagaucagagcuaugg

SEQ ID NO: 491789 - RNA, 19 nt, Homo sapiens
aagaaggaaucaucucuga

SEQ ID NO: 491790 - RNA, 19 nt, Homo sapiens
cagccacucuugaugauga

SEQ ID NO: 491791 - RNA, 19 nt, Homo sapiens
gaaagaggaagaagaagca

SEQ ID NO: 491792 - RNA, 19 nt, Homo sapiens
acacaaggauggacaugga

SEQ ID NO: 491793 - RNA, 19 nt, Homo sapiens
ugacucagaucucucaauc

SEQ ID NO: 491794 - RNA, 19 nt, Homo sapiens
gaagauggcaguggguuug

SEQ ID NO: 491795 - RNA, 19 nt, Homo sapiens
gaugaaggguggguuagga

SEQ ID NO: 491796 - RNA, 19 nt, Homo sapiens
uaauaaaucaccucuccua

SEQ ID NO: 491797 - RNA, 19 nt, Homo sapiens
ugaguaugaugaacauuug

SEQ ID NO: 491798 - RNA, 19 nt, Homo sapiens
gaagaaacggcgaguugga

SEQ ID NO: 491799 - RNA, 19 nt, Homo sapiens
gagcaacugaggcggcuua

SEQ ID NO: 491800 - RNA, 19 nt, Homo sapiens
caagcaacuucuacguaaa

SEQ ID NO: 491801 - RNA, 19 nt, Homo sapiens
gaacugcaauggcuacuua

SEQ ID NO: 491802 - RNA, 19 nt, Homo sapiens
ggacagaaguuaugaagaa

SEQ ID NO: 491803 - RNA, 19 nt, Homo sapiens
gaaacacguugaugaguua

SEQ ID NO: 491804 - RNA, 19 nt, Homo sapiens
gaucaacuuuggaaacuua

SEQ ID NO: 491805 - RNA, 19 nt, Homo sapiens
caacauaaauuuccagaga

SEQ ID NO: 491806 - RNA, 19 nt, Homo sapiens
ccaagaagcugcaaauaau

SEQ ID NO: 491807 - RNA, 19 nt, Homo sapiens
ggaaacacguugaugaguu

SEQ ID NO: 491808 - RNA, 19 nt, Homo sapiens
gagcuuggguugguucuua

SEQ ID NO: 491809 - RNA, 19 nt, Homo sapiens
ggaagcaguuguugauuau

SEQ ID NO: 491810 - RNA, 19 nt, Homo sapiens
aaggugagcuuauauauug

SEQ ID NO: 491811 - RNA, 19 nt, Homo sapiens
gaauuuagcagaacuauca

SEQ ID NO: 491812 - RNA, 19 nt, Homo sapiens
caguagaccuuccuguuua

SEQ ID NO: 491813 - RNA, 19 nt, Homo sapiens
gugaugagauugauugaaa

SEQ ID NO: 491814 - RNA, 19 nt, Homo sapiens
gcauuaagguuccaucaga

SEQ ID NO: 491815 - RNA, 19 nt, Homo sapiens
gauggauccuucaaucaua

SEQ ID NO: 491816 - RNA, 19 nt, Homo sapiens
gaagggaacagguaaagaa

SEQ ID NO: 491817 - RNA, 19 nt, Homo sapiens
gaagggaauuucaggcuau

SEQ ID NO: 491818 - RNA, 19 nt, Homo sapiens
gcagaacuaucaaauccaa

SEQ ID NO: 491819 - RNA, 19 nt, Homo sapiens
gagcaaacucccuuucaua

SEQ ID NO: 491820 - RNA, 19 nt, Homo sapiens
caaaggaggucuucauuuu

SEQ ID NO: 491821 - RNA, 19 nt, Homo sapiens
gaaugacccuguacccuau

SEQ ID NO: 491822 - RNA, 19 nt, Homo sapiens
uggaagcaguuguugauua

SEQ ID NO: 491823 - RNA, 19 nt, Homo sapiens
uaacuuaaauccugaugug

SEQ ID NO: 491824 - RNA, 19 nt, Homo sapiens
ccaaggccauauaaauuaa

SEQ ID NO: 491825 - RNA, 19 nt, Homo sapiens
gcauaagcaugacaguaaa

SEQ ID NO: 491826 - RNA, 19 nt, Homo sapiens
gaagaagcauaaacauaag

SEQ ID NO: 491827 - RNA, 19 nt, Homo sapiens
ucaauaaacugcuaagucu

SEQ ID NO: 491828 - RNA, 19 nt, Homo sapiens
gaaacuaagcaucagaauu

SEQ ID NO: 491829 - RNA, 19 nt, Homo sapiens
acaguacucuuccuuauug

SEQ ID NO: 491830 - RNA, 19 nt, Homo sapiens
ugcaauggcuuuauuaaga

SEQ ID NO: 491831 - RNA, 19 nt, Homo sapiens
ccagauaugucaguauuga

SEQ ID NO: 491832 - RNA, 19 nt, Homo sapiens
ggagucagauguugguuuc

SEQ ID NO: 491833 - RNA, 19 nt, Homo sapiens
acuaagaacccaccauuua

SEQ ID NO: 491834 - RNA, 19 nt, Homo sapiens
gaaaacagccuuaaacaug

SEQ ID NO: 491835 - RNA, 19 nt, Homo sapiens
ggaauacuacacuauguuu

SEQ ID NO: 491836 - RNA, 19 nt, Homo sapiens
ugaaacauaccacaucaua

SEQ ID NO: 491837 - RNA, 19 nt, Homo sapiens
gcauaaacauaagcacaaa

SEQ ID NO: 491838 - RNA, 19 nt, Homo sapiens
gggaacagguaaagaacaa

SEQ ID NO: 491839 - RNA, 19 nt, Homo sapiens
ugaggaagguagaauuuga

SEQ ID NO: 491840 - RNA, 19 nt, Homo sapiens
gcaaacaguguagaauaua

SEQ ID NO: 491841 - RNA, 19 nt, Homo sapiens
guauguaacuaaagcuuug

SEQ ID NO: 491842 - RNA, 19 nt, Homo sapiens
gaacggacaugugccaagu

SEQ ID NO: 491843 - RNA, 19 nt, Homo sapiens
gaagguagaauuugagcaa

SEQ ID NO: 491844 - RNA, 19 nt, Homo sapiens
cagagaaaccucaauuauu

SEQ ID NO: 491845 - RNA, 19 nt, Homo sapiens
gcaaacucccuuucauaaa

SEQ ID NO: 491846 - RNA, 19 nt, Homo sapiens
ggcaagcgcuccacucuca

SEQ ID NO: 491847 - RNA, 19 nt, Homo sapiens
ugcacucacugauauauua

SEQ ID NO: 491848 - RNA, 19 nt, Homo sapiens
agagagaggugcucauguu

SEQ ID NO: 491849 - RNA, 19 nt, Homo sapiens
caucagagcuauggaaaca

SEQ ID NO: 491850 - RNA, 19 nt, Homo sapiens
guugcaaacuugaauagaa

SEQ ID NO: 491851 - RNA, 19 nt, Homo sapiens
guuacgauguuggaauuua

SEQ ID NO: 491852 - RNA, 19 nt, Homo sapiens
cagcaaacaguguagaaua

SEQ ID NO: 491853 - RNA, 19 nt, Homo sapiens
ucuuggaccucuaaauaua

SEQ ID NO: 491854 - RNA, 19 nt, Homo sapiens
gcacggaagggaacaggua

SEQ ID NO: 491855 - RNA, 19 nt, Homo sapiens
gaugagacaccuuugacua

SEQ ID NO: 491856 - RNA, 19 nt, Homo sapiens
gcauaagauucucaacaug

SEQ ID NO: 491857 - RNA, 19 nt, Homo sapiens
gcaauggcuuuauuaagag

SEQ ID NO: 491858 - RNA, 19 nt, Homo sapiens
caaacucccuuucauaaaa

SEQ ID NO: 491859 - RNA, 19 nt, Homo sapiens
gcccaaggccauauaaauu

SEQ ID NO: 491860 - RNA, 19 nt, Homo sapiens
uguccucugugaagaauua

SEQ ID NO: 491861 - RNA, 19 nt, Homo sapiens
gcuccacucucagucuuua

SEQ ID NO: 491862 - RNA, 19 nt, Homo sapiens
gaaagcccaaggccauaua

SEQ ID NO: 491863 - RNA, 19 nt, Homo sapiens
ggcauaagauucucaacau

SEQ ID NO: 491864 - RNA, 19 nt, Homo sapiens
ugcaauggcuacuuaauau

SEQ ID NO: 491865 - RNA, 19 nt, Homo sapiens
caaacaacuuuaugagcuu

SEQ ID NO: 491866 - RNA, 19 nt, Homo sapiens
ugaugaggcuuauguugaa

SEQ ID NO: 491867 - RNA, 19 nt, Homo sapiens
ugagagagauguuguugca

SEQ ID NO: 491868 - RNA, 19 nt, Homo sapiens
ucaauaaagcauccacaua

SEQ ID NO: 491869 - RNA, 19 nt, Homo sapiens
gaguaccgccauuggauua

SEQ ID NO: 491870 - RNA, 19 nt, Homo sapiens
aaucuuggaccucuaaaua

SEQ ID NO: 491871 - RNA, 19 nt, Homo sapiens
cccaaggccauauaaauua

SEQ ID NO: 491872 - RNA, 19 nt, Homo sapiens
uaacuauuaucgugcagaa

SEQ ID NO: 491873 - RNA, 19 nt, Homo sapiens
gcacagcaggaauccauuu

SEQ ID NO: 491874 - RNA, 19 nt, Homo sapiens
gacuauacaucuccuggaa

SEQ ID NO: 491875 - RNA, 19 nt, Homo sapiens
gcugaaacauaccacauca

SEQ ID NO: 491876 - RNA, 19 nt, Homo sapiens
ggagaacuuugcauuaagg

SEQ ID NO: 491877 - RNA, 19 nt, Homo sapiens
aaacagagaaaccucaauu

SEQ ID NO: 491878 - RNA, 19 nt, Homo sapiens
ucucauaccauaagcauuu

SEQ ID NO: 491879 - RNA, 19 nt, Homo sapiens
caauuuggcucucauacca

SEQ ID NO: 491880 - RNA, 19 nt, Homo sapiens
cuacaguacucuuccuuau

SEQ ID NO: 491881 - RNA, 19 nt, Homo sapiens
cucccgaucugcuuuaaua

SEQ ID NO: 491882 - RNA, 19 nt, Homo sapiens
aaagcugucuugaauccua

SEQ ID NO: 491883 - RNA, 19 nt, Homo sapiens
aaucauacacugcaaauug

SEQ ID NO: 491884 - RNA, 19 nt, Homo sapiens
ggaucaguauggaauuuau

SEQ ID NO: 491885 - RNA, 19 nt, Homo sapiens
uguagaauauaccgaguaa

SEQ ID NO: 491886 - RNA, 19 nt, Homo sapiens
gaauguauguaacuaaagc

SEQ ID NO: 491887 - RNA, 19 nt, Homo sapiens
gcaaugaagcccugguaga

SEQ ID NO: 491888 - RNA, 19 nt, Homo sapiens
caaagauauucagccguua

SEQ ID NO: 491889 - RNA, 19 nt, Homo sapiens
ccaaaggaggucuucauuu

SEQ ID NO: 491890 - RNA, 19 nt, Homo sapiens
uaaagguccugaagauaca

SEQ ID NO: 491891 - RNA, 19 nt, Homo sapiens
gcaaaguuaugauuuacac

SEQ ID NO: 491892 - RNA, 19 nt, Homo sapiens
guugggaucuaauuaggaa

SEQ ID NO: 491893 - RNA, 19 nt, Homo sapiens
caagagcaguguuucuaca

SEQ ID NO: 491894 - RNA, 19 nt, Homo sapiens
caauaaagcauccacauac

SEQ ID NO: 491895 - RNA, 19 nt, Homo sapiens
uaaagaggagcuagacaaa

SEQ ID NO: 491896 - RNA, 19 nt, Homo sapiens
gagacaccuuugacuagaa

SEQ ID NO: 491897 - RNA, 19 nt, Homo sapiens
ggagacaagggcuuugaaa

SEQ ID NO: 491898 - RNA, 19 nt, Homo sapiens
uaucuccagugaaauauug

SEQ ID NO: 491899 - RNA, 19 nt, Homo sapiens
agaagcaacugccaaaucu

SEQ ID NO: 491900 - RNA, 19 nt, Homo sapiens
gacuuguacuucacacuuu

SEQ ID NO: 491901 - RNA, 19 nt, Homo sapiens
ugaaagagcucgugcagaa

SEQ ID NO: 491902 - RNA, 19 nt, Homo sapiens
gcaaaugggauauuguuua

SEQ ID NO: 491903 - RNA, 19 nt, Homo sapiens
uaaaucagcucuucagugu

SEQ ID NO: 491904 - RNA, 19 nt, Homo sapiens
gaagaaagugcaagaauau

SEQ ID NO: 491905 - RNA, 19 nt, Homo sapiens
agaagaaagugcaagaaua

SEQ ID NO: 491906 - RNA, 19 nt, Homo sapiens
ggaguaaacuugucagaag

SEQ ID NO: 491907 - RNA, 19 nt, Homo sapiens
cuaccuaacuuacuaugua

SEQ ID NO: 491908 - RNA, 19 nt, Homo sapiens
caaaggagaugcagcaaca

SEQ ID NO: 491909 - RNA, 19 nt, Homo sapiens
ccaaacaagccauauauaa

SEQ ID NO: 491910 - RNA, 19 nt, Homo sapiens
gacagcagcuaaugugaaa

SEQ ID NO: 491911 - RNA, 19 nt, Homo sapiens
gaccucauuucguuuauuu

SEQ ID NO: 491912 - RNA, 19 nt, Homo sapiens
ggacgaugaugacauuaau

SEQ ID NO: 491913 - RNA, 19 nt, Homo sapiens
gauaugagcaggcgaguga

SEQ ID NO: 491914 - RNA, 19 nt, Homo sapiens
caacaaaggcuacagaauc

SEQ ID NO: 491915 - RNA, 19 nt, Homo sapiens
aaucagcucuucaguguga

SEQ ID NO: 491916 - RNA, 19 nt, Homo sapiens
ugagaacuguuacaccuuu

SEQ ID NO: 491917 - RNA, 19 nt, Homo sapiens
auaauuagcugcccucugu

SEQ ID NO: 491918 - RNA, 19 nt, Homo sapiens
gaaauggcuauguaaacua

SEQ ID NO: 491919 - RNA, 19 nt, Homo sapiens
uauaaagacugauggaauc

SEQ ID NO: 491920 - RNA, 19 nt, Homo sapiens
uuacaaggaugacgacaga

SEQ ID NO: 491921 - RNA, 19 nt, Homo sapiens
gcagagaagaauauuagaa

SEQ ID NO: 491922 - RNA, 19 nt, Homo sapiens
gaguaaacuugucagaaga

SEQ ID NO: 491923 - RNA, 19 nt, Homo sapiens
gagaaugggcaguuguuaa

SEQ ID NO: 491924 - RNA, 19 nt, Homo sapiens
gcuaagagacuguaugcaa

SEQ ID NO: 491925 - RNA, 19 nt, Homo sapiens
uggaaucguuagcaaauaa

SEQ ID NO: 491926 - RNA, 19 nt, Homo sapiens
gagcuuacccgccuugaga

SEQ ID NO: 491927 - RNA, 19 nt, Homo sapiens
gcacaguuacuuguucaua

SEQ ID NO: 491928 - RNA, 19 nt, Homo sapiens
gagcaaaugggauauuguu

SEQ ID NO: 491929 - RNA, 19 nt, Homo sapiens
gcagaagauuucacaagca

SEQ ID NO: 491930 - RNA, 19 nt, Homo sapiens
guaacgagcaaaugggaua

SEQ ID NO: 491931 - RNA, 19 nt, Homo sapiens
gaaagugcaagaauauuag

SEQ ID NO: 491932 - RNA, 19 nt, Homo sapiens
ccucagggaccucauauuu

SEQ ID NO: 491933 - RNA, 19 nt, Homo sapiens
gaagauccagaacaguuaa

SEQ ID NO: 491934 - RNA, 19 nt, Homo sapiens
caacuaccauaauuaagca

SEQ ID NO: 491935 - RNA, 19 nt, Homo sapiens
cgaccaacauccagaacuu

SEQ ID NO: 491936 - RNA, 19 nt, Homo sapiens
gacgaggucuucuucaaca

SEQ ID NO: 491937 - RNA, 19 nt, Homo sapiens
ggaacuggcacaaaugaga

SEQ ID NO: 491938 - RNA, 19 nt, Homo sapiens
aaccuuaccuugugccuuu

SEQ ID NO: 491939 - RNA, 19 nt, Homo sapiens
uaaauacucuggcuuucuc

SEQ ID NO: 491940 - RNA, 19 nt, Homo sapiens
gaugaugacauuaaugaug

SEQ ID NO: 491941 - RNA, 19 nt, Homo sapiens
gucagcaucuguacaaaug

SEQ ID NO: 491942 - RNA, 19 nt, Homo sapiens
aaacagcucagcagaagaa

SEQ ID NO: 491943 - RNA, 19 nt, Homo sapiens
cguguuaccuggaaccaaa

SEQ ID NO: 491944 - RNA, 19 nt, Homo sapiens
agaauuuacuggauggaaa

SEQ ID NO: 491945 - RNA, 19 nt, Homo sapiens
gggcaguuguuaaugauuc

SEQ ID NO: 491946 - RNA, 19 nt, Homo sapiens
gaacgugagacaagccauu

SEQ ID NO: 491947 - RNA, 19 nt, Homo sapiens
cuacagagacagcagcuaa

SEQ ID NO: 491948 - RNA, 19 nt, Homo sapiens
cagagguuauuguaugaaa

SEQ ID NO: 491949 - RNA, 19 nt, Homo sapiens
uuacagacguccagagcaa

SEQ ID NO: 491950 - RNA, 19 nt, Homo sapiens
uggcaaagcaaacugauuu

SEQ ID NO: 491951 - RNA, 19 nt, Homo sapiens
guaauagucaguuggcaaa

SEQ ID NO: 491952 - RNA, 19 nt, Homo sapiens
caaagcauuccuuaaguga

SEQ ID NO: 491953 - RNA, 19 nt, Homo sapiens
cuacaaagcauuccuuaag

SEQ ID NO: 491954 - RNA, 19 nt, Homo sapiens
uuucagagguuauuguaug

SEQ ID NO: 491955 - RNA, 19 nt, Homo sapiens
cuauguagguguaugucua

SEQ ID NO: 491956 - RNA, 19 nt, Homo sapiens
gauggaaucguuagcaaau

SEQ ID NO: 491957 - RNA, 19 nt, Homo sapiens
ggcaagcagucuacagaga

SEQ ID NO: 491958 - RNA, 19 nt, Homo sapiens
gcacaugacauagaaaugg

SEQ ID NO: 491959 - RNA, 19 nt, Homo sapiens
gaagugagaaugggcaguu

SEQ ID NO: 491960 - RNA, 19 nt, Homo sapiens
acaaagcauuccuuaagug

SEQ ID NO: 491961 - RNA, 19 nt, Homo sapiens
gccauucacugcugcucua

SEQ ID NO: 491962 - RNA, 19 nt, Homo sapiens
acaagaagauccagaacag

SEQ ID NO: 491963 - RNA, 19 nt, Homo sapiens
guaaacuugucagaagaaa

SEQ ID NO: 491964 - RNA, 19 nt, Homo sapiens
cacaguuacuuguucauau

SEQ ID NO: 491965 - RNA, 19 nt, Homo sapiens
gcagcaaagucucggucaa

SEQ ID NO: 491966 - RNA, 19 nt, Homo sapiens
gaacuuuucuuacaaggau

SEQ ID NO: 491967 - RNA, 19 nt, Homo sapiens
agaaacagcucagcagaag

SEQ ID NO: 491968 - RNA, 19 nt, Homo sapiens
ucacaugccacgcaacaaa

SEQ ID NO: 491969 - RNA, 19 nt, Homo sapiens
gccaaacaagccauauaua

SEQ ID NO: 491970 - RNA, 19 nt, Homo sapiens
caacaggaacuggcacaaa

SEQ ID NO: 491971 - RNA, 19 nt, Homo sapiens
aaugggcaguuguuaauga

SEQ ID NO: 491972 - RNA, 19 nt, Homo sapiens
acaaggaugacgacagaua

SEQ ID NO: 491973 - RNA, 19 nt, Homo sapiens
caaaggcuacagaaucuug

SEQ ID NO: 491974 - RNA, 19 nt, Homo sapiens
auccagauguaguaaguua

SEQ ID NO: 491975 - RNA, 19 nt, Homo sapiens
acaguuacuuguucauaug

SEQ ID NO: 491976 - RNA, 19 nt, Homo sapiens
aaagacugauggaaucguu

SEQ ID NO: 491977 - RNA, 19 nt, Homo sapiens
gcaccuggaacaccuauca

SEQ ID NO: 491978 - RNA, 19 nt, Homo sapiens
agaagauccagaacaguua

SEQ ID NO: 491979 - RNA, 19 nt, Homo sapiens
aaagagcucgugcagaauu

SEQ ID NO: 491980 - RNA, 19 nt, Homo sapiens
agaaauggcuauguaaacu

SEQ ID NO: 491981 - RNA, 19 nt, Homo sapiens
uaacagagagaacacaaag

SEQ ID NO: 491982 - RNA, 19 nt, Homo sapiens
aacaggaacuggcacaaau

SEQ ID NO: 491983 - RNA, 19 nt, Homo sapiens
gcaacaaaggcuacagaau

SEQ ID NO: 491984 - RNA, 19 nt, Homo sapiens
ccacaccgcuggucaucca

SEQ ID NO: 491985 - RNA, 19 nt, Homo sapiens
aauagaagcagaagauuuc

SEQ ID NO: 491986 - RNA, 19 nt, Homo sapiens
uacaaagcauuccuuaagu

SEQ ID NO: 491987 - RNA, 19 nt, Homo sapiens
ggagaugcagcaacaggaa

SEQ ID NO: 491988 - RNA, 19 nt, Homo sapiens
ugaaacagaaggcaaagga

SEQ ID NO: 491989 - RNA, 19 nt, Homo sapiens
aguuaaggcugaaacagaa

SEQ ID NO: 491990 - RNA, 19 nt, Homo sapiens
ucagggaccucauauuuug

SEQ ID NO: 491991 - RNA, 19 nt, Homo sapiens
caaccucagggaccucaua

SEQ ID NO: 491992 - RNA, 19 nt, Homo sapiens
aacaaaggcuacagaaucu

SEQ ID NO: 491993 - RNA, 19 nt, Homo sapiens
gggacgaugaugacauuaa

SEQ ID NO: 491994 - RNA, 19 nt, Homo sapiens
gccagucccuguggugaaa

SEQ ID NO: 491995 - RNA, 19 nt, Homo sapiens
gaacgcugaucaguauuuu

SEQ ID NO: 491996 - RNA, 19 nt, Homo sapiens
agccauauauaaagacuga

SEQ ID NO: 491997 - RNA, 19 nt, Homo sapiens
caaggaugacgacagauau

SEQ ID NO: 491998 - RNA, 19 nt, Homo sapiens
caagaauauuagccacgaa

SEQ ID NO: 491999 - RNA, 19 nt, Homo sapiens
gguuauaccgagaacuuaa

SEQ ID NO: 492000 - RNA, 19 nt, Homo sapiens
uaauaaaacuggcuucauc

SEQ ID NO: 492001 - RNA, 19 nt, Homo sapiens
gaucccaacugguuuauga

SEQ ID NO: 492002 - RNA, 19 nt, Homo sapiens
caucaagacugacauguuc

SEQ ID NO: 492003 - RNA, 19 nt, Homo sapiens
ucuuguaccuggaauauuu

SEQ ID NO: 492004 - RNA, 19 nt, Homo sapiens
ggagaucccaacugguuua

SEQ ID NO: 492005 - RNA, 19 nt, Homo sapiens
ccaacugguuuaugaagaa

SEQ ID NO: 492006 - RNA, 19 nt, Homo sapiens
gcugaagaauggcgugauu

SEQ ID NO: 492007 - RNA, 19 nt, Homo sapiens
acacaagucuucacuccuu

SEQ ID NO: 492008 - RNA, 19 nt, Homo sapiens
agaaagcgcaggagcauaa

SEQ ID NO: 492009 - RNA, 19 nt, Homo sapiens
ggagggaaagcaugucauu

SEQ ID NO: 492010 - RNA, 19 nt, Homo sapiens
agaggacccugauggcuuu

SEQ ID NO: 492011 - RNA, 19 nt, Homo sapiens
gaagaaagcgcaggagcau

SEQ ID NO: 492012 - RNA, 19 nt, Homo sapiens
caacugguuuaugaagaaa

SEQ ID NO: 492013 - RNA, 19 nt, Homo sapiens
ccagacuguugaccucuuu

SEQ ID NO: 492014 - RNA, 19 nt, Homo sapiens
gcagugaccaagaaugaug

SEQ ID NO: 492015 - RNA, 19 nt, Homo sapiens
gaaggcggcugaggacucu

SEQ ID NO: 492016 - RNA, 19 nt, Homo sapiens
cucggcagaucaucaguua

SEQ ID NO: 492017 - RNA, 19 nt, Homo sapiens
gcaaaagcccauugaagaa

SEQ ID NO: 492018 - RNA, 19 nt, Homo sapiens
guggagaucccaacugguu

SEQ ID NO: 492019 - RNA, 19 nt, Homo sapiens
ugagcaagcuggugaacag

SEQ ID NO: 492020 - RNA, 19 nt, Homo sapiens
cggcagaucaucaguuaga

SEQ ID NO: 492021 - RNA, 19 nt, Homo sapiens
gagcauaagagggaauuca

SEQ ID NO: 492022 - RNA, 19 nt, Homo sapiens
aagagggaauucacagaga

SEQ ID NO: 492023 - RNA, 19 nt, Homo sapiens
caagaaugaugggcacuac

SEQ ID NO: 492024 - RNA, 19 nt, Homo sapiens
aaaucgagaagaaguauga

SEQ ID NO: 492025 - RNA, 19 nt, Homo sapiens
gcuccaagccggugaaggu

SEQ ID NO: 492026 - RNA, 19 nt, Homo sapiens
ggcaaaagcccauugaaga

SEQ ID NO: 492027 - RNA, 19 nt, Homo sapiens
ggacgaccucggcagauca

SEQ ID NO: 492028 - RNA, 19 nt, Homo sapiens
uggcagugaccaagaauga

SEQ ID NO: 492029 - RNA, 19 nt, Homo sapiens
cggugaaggugcccgagaa

SEQ ID NO: 492030 - RNA, 19 nt, Homo sapiens
gcauaagagggaauucaca

SEQ ID NO: 492031 - RNA, 19 nt, Homo sapiens
gaagugcaguccaaaaucg

SEQ ID NO: 492032 - RNA, 19 nt, Homo sapiens
ccaagaaugaugggcacua

SEQ ID NO: 492033 - RNA, 19 nt, Homo sapiens
gacauguuccagacuguug

SEQ ID NO: 492034 - RNA, 19 nt, Homo sapiens
aaagcccauugaagaagaa

SEQ ID NO: 492035 - RNA, 19 nt, Homo sapiens
gcugcagccaucccgcuua

SEQ ID NO: 492036 - RNA, 19 nt, Homo sapiens
ucagaugggcagcaacaga

SEQ ID NO: 492037 - RNA, 19 nt, Homo sapiens
gagggaaagcaugucauug

SEQ ID NO: 492038 - RNA, 19 nt, Homo sapiens
gcugguggaguggaucaua

SEQ ID NO: 492039 - RNA, 19 nt, Homo sapiens
cccaacugguuuaugaaga

SEQ ID NO: 492040 - RNA, 19 nt, Homo sapiens
ucaucaagacugacauguu

SEQ ID NO: 492041 - RNA, 19 nt, Homo sapiens
gcaguguggcccugaugug

SEQ ID NO: 492042 - RNA, 19 nt, Homo sapiens
uaucuuguaccuggaauau

SEQ ID NO: 492043 - RNA, 19 nt, Homo sapiens
gguccuuccuauggcauga

SEQ ID NO: 492044 - RNA, 19 nt, Homo sapiens
agguguggcugaagaaugg

SEQ ID NO: 492045 - RNA, 19 nt, Homo sapiens
gccgcgaagugcaguccaa

SEQ ID NO: 492046 - RNA, 19 nt, Homo sapiens
uugggcagcuuggcaguga

SEQ ID NO: 492047 - RNA, 19 nt, Homo sapiens
gcaaauaccucagugauua

SEQ ID NO: 492048 - RNA, 19 nt, Homo sapiens
gaacauauaugaccaaauc

SEQ ID NO: 492049 - RNA, 19 nt, Homo sapiens
ggacggaacuguuagauug

SEQ ID NO: 492050 - RNA, 19 nt, Homo sapiens
gcaagugaguugaagauuu

SEQ ID NO: 492051 - RNA, 19 nt, Homo sapiens
ggacacaacuauccaguau

SEQ ID NO: 492052 - RNA, 19 nt, Homo sapiens
gcaaacaaaucaaagguau

SEQ ID NO: 492053 - RNA, 19 nt, Homo sapiens
gaaguaugcugcuuggaaa

SEQ ID NO: 492054 - RNA, 19 nt, Homo sapiens
ccacugacaucugaauuua

SEQ ID NO: 492055 - RNA, 19 nt, Homo sapiens
gaauguauguaacuaggua

SEQ ID NO: 492056 - RNA, 19 nt, Homo sapiens
aaacaagcaucagaucuua

SEQ ID NO: 492057 - RNA, 19 nt, Homo sapiens
uaaaccaggugaagaaauu

SEQ ID NO: 492058 - RNA, 19 nt, Homo sapiens
ccacugggcauauaaauuu

SEQ ID NO: 492059 - RNA, 19 nt, Homo sapiens
aaauuuagcuuccauguuc

SEQ ID NO: 492060 - RNA, 19 nt, Homo sapiens
ggacauuuauggugcuuug

SEQ ID NO: 492061 - RNA, 19 nt, Homo sapiens
uaguagagauggugaaauu

SEQ ID NO: 492062 - RNA, 19 nt, Homo sapiens
cgaguauuaucuagucuua

SEQ ID NO: 492063 - RNA, 19 nt, Homo sapiens
gaaagaaaccaccaaacga

SEQ ID NO: 492064 - RNA, 19 nt, Homo sapiens
gagcuuauaguccacaaua

SEQ ID NO: 492065 - RNA, 19 nt, Homo sapiens
caaccacauuugacuaauu

SEQ ID NO: 492066 - RNA, 19 nt, Homo sapiens
caucagaucuuagucuuau

SEQ ID NO: 492067 - RNA, 19 nt, Homo sapiens
gaaagauucagauaaguug

SEQ ID NO: 492068 - RNA, 19 nt, Homo sapiens
gaaacagaacaaucagaua

SEQ ID NO: 492069 - RNA, 19 nt, Homo sapiens
ggaaugagaccauguugga

SEQ ID NO: 492070 - RNA, 19 nt, Homo sapiens
ucacuuagguuuaguagag

SEQ ID NO: 492071 - RNA, 19 nt, Homo sapiens
ggaaguaugcugcuuggaa

SEQ ID NO: 492072 - RNA, 19 nt, Homo sapiens
gaucuucacuggacacaag

SEQ ID NO: 492073 - RNA, 19 nt, Homo sapiens
guaaauuuguucugcguau

SEQ ID NO: 492074 - RNA, 19 nt, Homo sapiens
acaaggagaucccacaaug

SEQ ID NO: 492075 - RNA, 19 nt, Homo sapiens
cagauaaguuggauaagau

SEQ ID NO: 492076 - RNA, 19 nt, Homo sapiens
ucagauaaguuggauaaga

SEQ ID NO: 492077 - RNA, 19 nt, Homo sapiens
ccuaugagcauguauguuu

SEQ ID NO: 492078 - RNA, 19 nt, Homo sapiens
uuugaugguuggagaauua

SEQ ID NO: 492079 - RNA, 19 nt, Homo sapiens
gcaucagguucaauggaua

SEQ ID NO: 492080 - RNA, 19 nt, Homo sapiens
ucagaggacggaacuguua

SEQ ID NO: 492081 - RNA, 19 nt, Homo sapiens
caagugaguugaagauuuu

SEQ ID NO: 492082 - RNA, 19 nt, Homo sapiens
gagaucaggaauguuauua

SEQ ID NO: 492083 - RNA, 19 nt, Homo sapiens
gaaauuuagcuuccauguu

SEQ ID NO: 492084 - RNA, 19 nt, Homo sapiens
ggacacaagggaccaauuc

SEQ ID NO: 492085 - RNA, 19 nt, Homo sapiens
gaugggaugccgcguagua

SEQ ID NO: 492086 - RNA, 19 nt, Homo sapiens
ggaauguuauuaccaggau

SEQ ID NO: 492087 - RNA, 19 nt, Homo sapiens
aaacguaguuacuguaugg

SEQ ID NO: 492088 - RNA, 19 nt, Homo sapiens
cuaucagccuuuaagaaua

SEQ ID NO: 492089 - RNA, 19 nt, Homo sapiens
caaacaagcaucagaucuu

SEQ ID NO: 492090 - RNA, 19 nt, Homo sapiens
ggaugucacugaugauucu

SEQ ID NO: 492091 - RNA, 19 nt, Homo sapiens
cuauauggaucuggaagua

SEQ ID NO: 492092 - RNA, 19 nt, Homo sapiens
gauauaaaggacacaacua

SEQ ID NO: 492093 - RNA, 19 nt, Homo sapiens
cagaugaugucuuagaaag

SEQ ID NO: 492094 - RNA, 19 nt, Homo sapiens
gaaucccucuuccugaguu

SEQ ID NO: 492095 - RNA, 19 nt, Homo sapiens
uaaacgagaggcaaacaaa

SEQ ID NO: 492096 - RNA, 19 nt, Homo sapiens
gagcaccucuacauugaca

SEQ ID NO: 492097 - RNA, 19 nt, Homo sapiens
gcuucaagauucaaauuca

SEQ ID NO: 492098 - RNA, 19 nt, Homo sapiens
ggagguggcggucaagcua

SEQ ID NO: 492099 - RNA, 19 nt, Homo sapiens
acacaacuauccaguaugg

SEQ ID NO: 492100 - RNA, 19 nt, Homo sapiens
gaugugaauuguaccagau

SEQ ID NO: 492101 - RNA, 19 nt, Homo sapiens
guaguaagcaacagauaga

SEQ ID NO: 492102 - RNA, 19 nt, Homo sapiens
gcacauguacuuggagcua

SEQ ID NO: 492103 - RNA, 19 nt, Homo sapiens
ccacaauguaugaagaaua

SEQ ID NO: 492104 - RNA, 19 nt, Homo sapiens
cgauaaaccaggugaagaa

SEQ ID NO: 492105 - RNA, 19 nt, Homo sapiens
uuucuuagaucuagaggaa

SEQ ID NO: 492106 - RNA, 19 nt, Homo sapiens
guggagccuucaaacauuu

SEQ ID NO: 492107 - RNA, 19 nt, Homo sapiens
ggguaaaguuggaaguguu

SEQ ID NO: 492108 - RNA, 19 nt, Homo sapiens
gaaaacagcaagugaguug

SEQ ID NO: 492109 - RNA, 19 nt, Homo sapiens
ggaugaccuacgaguauua

SEQ ID NO: 492110 - RNA, 19 nt, Homo sapiens
acaaucaacaugagaauga

SEQ ID NO: 492111 - RNA, 19 nt, Homo sapiens
caaauaccucagugauuaa

SEQ ID NO: 492112 - RNA, 19 nt, Homo sapiens
gauggcagagugcuucuuu

SEQ ID NO: 492113 - RNA, 19 nt, Homo sapiens
ccucuacauugacaucuuu

SEQ ID NO: 492114 - RNA, 19 nt, Homo sapiens
aaggagaucccacaaugua

SEQ ID NO: 492115 - RNA, 19 nt, Homo sapiens
gagcuagucuacaaucaac

SEQ ID NO: 492116 - RNA, 19 nt, Homo sapiens
ggagaucccacaauguaug

SEQ ID NO: 492117 - RNA, 19 nt, Homo sapiens
gggacguccugaaugguaa

SEQ ID NO: 492118 - RNA, 19 nt, Homo sapiens
agaggcaucuucaggagaa

SEQ ID NO: 492119 - RNA, 19 nt, Homo sapiens
gaaguuccauggagaucag

SEQ ID NO: 492120 - RNA, 19 nt, Homo sapiens
gcacccaaacacucgauaa

SEQ ID NO: 492121 - RNA, 19 nt, Homo sapiens
uuacuuguuuggugggaua

SEQ ID NO: 492122 - RNA, 19 nt, Homo sapiens
gagaggcaaacaaaucaaa

SEQ ID NO: 492123 - RNA, 19 nt, Homo sapiens
ccauggagaucaggaaugu

SEQ ID NO: 492124 - RNA, 19 nt, Homo sapiens
gaccaaaucaacaccaguu

SEQ ID NO: 492125 - RNA, 19 nt, Homo sapiens
guaccagauuccauccaaa

SEQ ID NO: 492126 - RNA, 19 nt, Homo sapiens
gcaucagaucuuagucuua

SEQ ID NO: 492127 - RNA, 19 nt, Homo sapiens
gaaauugagguaccuuugg

SEQ ID NO: 492128 - RNA, 19 nt, Homo sapiens
ggagaucaggaauguuauu

SEQ ID NO: 492129 - RNA, 19 nt, Homo sapiens
uagcuuccauguucuacuu

SEQ ID NO: 492130 - RNA, 19 nt, Homo sapiens
gggaacauauaugaccaaa

SEQ ID NO: 492131 - RNA, 19 nt, Homo sapiens
cuacgaguauuaucuaguc

SEQ ID NO: 492132 - RNA, 19 nt, Homo sapiens
cacaagggaccaauucauu

SEQ ID NO: 492133 - RNA, 19 nt, Homo sapiens
uguggagccuucaaacauu

SEQ ID NO: 492134 - RNA, 19 nt, Homo sapiens
aggagcaccucuacauuga

SEQ ID NO: 492135 - RNA, 19 nt, Homo sapiens
agguaggguuccuuucuua

SEQ ID NO: 492136 - RNA, 19 nt, Homo sapiens
gcaaccacauuugacuaau

SEQ ID NO: 492137 - RNA, 19 nt, Homo sapiens
acaggacaguuccacguuu

SEQ ID NO: 492138 - RNA, 19 nt, Homo sapiens
ggcaucagguucaauggau

SEQ ID NO: 492139 - RNA, 19 nt, Homo sapiens
gaagaaggaaaaccuaaaa

SEQ ID NO: 492140 - RNA, 19 nt, Homo sapiens
aaauugagguaccuuugga

SEQ ID NO: 492141 - RNA, 19 nt, Homo sapiens
caggagcaccucuacauug

SEQ ID NO: 492142 - RNA, 19 nt, Homo sapiens
gaccuacgaguauuaucua

SEQ ID NO: 492143 - RNA, 19 nt, Homo sapiens
gaucaggaauguuauuacc

SEQ ID NO: 492144 - RNA, 19 nt, Homo sapiens
gauaaaccaggugaagaaa

SEQ ID NO: 492145 - RNA, 19 nt, Homo sapiens
gagguauuaugaucaugga

SEQ ID NO: 492146 - RNA, 19 nt, Homo sapiens
gaaguguugcuguggaaga

SEQ ID NO: 492147 - RNA, 19 nt, Homo sapiens
gcaaauaccucagugauua

SEQ ID NO: 492148 - RNA, 19 nt, Homo sapiens
gaacauauaugaccaaauc

SEQ ID NO: 492149 - RNA, 19 nt, Homo sapiens
gcaagugaguugaagauuu

SEQ ID NO: 492150 - RNA, 19 nt, Homo sapiens
gcaaacaaaucaaagguau

SEQ ID NO: 492151 - RNA, 19 nt, Homo sapiens
gaaguaugcugcuuggaaa

SEQ ID NO: 492152 - RNA, 19 nt, Homo sapiens
ccacugacaucugaauuua

SEQ ID NO: 492153 - RNA, 19 nt, Homo sapiens
gaauguauguaacuaggua

SEQ ID NO: 492154 - RNA, 19 nt, Homo sapiens
aaacaagcaucagaucuua

SEQ ID NO: 492155 - RNA, 19 nt, Homo sapiens
uaaaccaggugaagaaauu

SEQ ID NO: 492156 - RNA, 19 nt, Homo sapiens
ccacugggcauauaaauuu

SEQ ID NO: 492157 - RNA, 19 nt, Homo sapiens
aaauuuagcuuccauguuc

SEQ ID NO: 492158 - RNA, 19 nt, Homo sapiens
ggacauuuauggugcuuug

SEQ ID NO: 492159 - RNA, 19 nt, Homo sapiens
uaguagagauggugaaauu

SEQ ID NO: 492160 - RNA, 19 nt, Homo sapiens
cgaguauuaucuagucuua

SEQ ID NO: 492161 - RNA, 19 nt, Homo sapiens
gaaagaaaccaccaaacga

SEQ ID NO: 492162 - RNA, 19 nt, Homo sapiens
gagcuuauaguccacaaua

SEQ ID NO: 492163 - RNA, 19 nt, Homo sapiens
caaccacauuugacuaauu

SEQ ID NO: 492164 - RNA, 19 nt, Homo sapiens
caucagaucuuagucuuau

SEQ ID NO: 492165 - RNA, 19 nt, Homo sapiens
gaaagauucagauaaguug

SEQ ID NO: 492166 - RNA, 19 nt, Homo sapiens
gaaacagaacaaucagaua

SEQ ID NO: 492167 - RNA, 19 nt, Homo sapiens
ggaaugagaccauguugga

SEQ ID NO: 492168 - RNA, 19 nt, Homo sapiens
ucacuuagguuuaguagag

SEQ ID NO: 492169 - RNA, 19 nt, Homo sapiens
ggaaguaugcugcuuggaa

SEQ ID NO: 492170 - RNA, 19 nt, Homo sapiens
gaucuucacuggacacaag

SEQ ID NO: 492171 - RNA, 19 nt, Homo sapiens
guaaauuuguucugcguau

SEQ ID NO: 492172 - RNA, 19 nt, Homo sapiens
acaaggagaucccacaaug

SEQ ID NO: 492173 - RNA, 19 nt, Homo sapiens
cagauaaguuggauaagau

SEQ ID NO: 492174 - RNA, 19 nt, Homo sapiens
ucagauaaguuggauaaga

SEQ ID NO: 492175 - RNA, 19 nt, Homo sapiens
ccuaugagcauguauguuu

SEQ ID NO: 492176 - RNA, 19 nt, Homo sapiens
uuugaugguuggagaauua

SEQ ID NO: 492177 - RNA, 19 nt, Homo sapiens
gcaucagguucaauggaua

SEQ ID NO: 492178 - RNA, 19 nt, Homo sapiens
caagugaguugaagauuuu

SEQ ID NO: 492179 - RNA, 19 nt, Homo sapiens
gagaucaggaauguuauua

SEQ ID NO: 492180 - RNA, 19 nt, Homo sapiens
gaaauuuagcuuccauguu

SEQ ID NO: 492181 - RNA, 19 nt, Homo sapiens
ggacacaagggaccaauuc

SEQ ID NO: 492182 - RNA, 19 nt, Homo sapiens
gaugggaugccgcguagua

SEQ ID NO: 492183 - RNA, 19 nt, Homo sapiens
ggaauguuauuaccaggau

SEQ ID NO: 492184 - RNA, 19 nt, Homo sapiens
aaacguaguuacuguaugg

SEQ ID NO: 492185 - RNA, 19 nt, Homo sapiens
cuaucagccuuuaagaaua

SEQ ID NO: 492186 - RNA, 19 nt, Homo sapiens
caaacaagcaucagaucuu

SEQ ID NO: 492187 - RNA, 19 nt, Homo sapiens
ggaugucacugaugauucu

SEQ ID NO: 492188 - RNA, 19 nt, Homo sapiens
cuauauggaucuggaagua

SEQ ID NO: 492189 - RNA, 19 nt, Homo sapiens
cagaugaugucuuagaaag

SEQ ID NO: 492190 - RNA, 19 nt, Homo sapiens
gaaucccucuuccugaguu

SEQ ID NO: 492191 - RNA, 19 nt, Homo sapiens
uaaacgagaggcaaacaaa

SEQ ID NO: 492192 - RNA, 19 nt, Homo sapiens
gagcaccucuacauugaca

SEQ ID NO: 492193 - RNA, 19 nt, Homo sapiens
gcuucaagauucaaauuca

SEQ ID NO: 492194 - RNA, 19 nt, Homo sapiens
ggagguggcggucaagcua

SEQ ID NO: 492195 - RNA, 19 nt, Homo sapiens
gaugugaauuguaccagau

SEQ ID NO: 492196 - RNA, 19 nt, Homo sapiens
guaguaagcaacagauaga

SEQ ID NO: 492197 - RNA, 19 nt, Homo sapiens
gcacauguacuuggagcua

SEQ ID NO: 492198 - RNA, 19 nt, Homo sapiens
ccacaauguaugaagaaua

SEQ ID NO: 492199 - RNA, 19 nt, Homo sapiens
cgauaaaccaggugaagaa

SEQ ID NO: 492200 - RNA, 19 nt, Homo sapiens
uuucuuagaucuagaggaa

SEQ ID NO: 492201 - RNA, 19 nt, Homo sapiens
ggguaaaguuggaaguguu

SEQ ID NO: 492202 - RNA, 19 nt, Homo sapiens
gaaaacagcaagugaguug

SEQ ID NO: 492203 - RNA, 19 nt, Homo sapiens
ggaugaccuacgaguauua

SEQ ID NO: 492204 - RNA, 19 nt, Homo sapiens
acaaucaacaugagaauga

SEQ ID NO: 492205 - RNA, 19 nt, Homo sapiens
caaauaccucagugauuaa

SEQ ID NO: 492206 - RNA, 19 nt, Homo sapiens
gauggcagagugcuucuuu

SEQ ID NO: 492207 - RNA, 19 nt, Homo sapiens
ccucuacauugacaucuuu

SEQ ID NO: 492208 - RNA, 19 nt, Homo sapiens
gagcuagucuacaaucaac

SEQ ID NO: 492209 - RNA, 19 nt, Homo sapiens
aaggagaucccacaaugua

SEQ ID NO: 492210 - RNA, 19 nt, Homo sapiens
gggacguccugaaugguaa

SEQ ID NO: 492211 - RNA, 19 nt, Homo sapiens
agaggcaucuucaggagaa

SEQ ID NO: 492212 - RNA, 19 nt, Homo sapiens
ggagaucccacaauguaug

SEQ ID NO: 492213 - RNA, 19 nt, Homo sapiens
gaaguuccauggagaucag

SEQ ID NO: 492214 - RNA, 19 nt, Homo sapiens
gcacccaaacacucgauaa

SEQ ID NO: 492215 - RNA, 19 nt, Homo sapiens
gagaggcaaacaaaucaaa

SEQ ID NO: 492216 - RNA, 19 nt, Homo sapiens
ccauggagaucaggaaugu

SEQ ID NO: 492217 - RNA, 19 nt, Homo sapiens
gaccaaaucaacaccaguu

SEQ ID NO: 492218 - RNA, 19 nt, Homo sapiens
guaccagauuccauccaaa

SEQ ID NO: 492219 - RNA, 19 nt, Homo sapiens
gcaucagaucuuagucuua

SEQ ID NO: 492220 - RNA, 19 nt, Homo sapiens
gaaauugagguaccuuugg

SEQ ID NO: 492221 - RNA, 19 nt, Homo sapiens
ggagaucaggaauguuauu

SEQ ID NO: 492222 - RNA, 19 nt, Homo sapiens
uagcuuccauguucuacuu

SEQ ID NO: 492223 - RNA, 19 nt, Homo sapiens
gggaacauauaugaccaaa

SEQ ID NO: 492224 - RNA, 19 nt, Homo sapiens
cuacgaguauuaucuaguc

SEQ ID NO: 492225 - RNA, 19 nt, Homo sapiens
cacaagggaccaauucauu

SEQ ID NO: 492226 - RNA, 19 nt, Homo sapiens
aggagcaccucuacauuga

SEQ ID NO: 492227 - RNA, 19 nt, Homo sapiens
agguaggguuccuuucuua

SEQ ID NO: 492228 - RNA, 19 nt, Homo sapiens
gcaaccacauuugacuaau

SEQ ID NO: 492229 - RNA, 19 nt, Homo sapiens
acaggacaguuccacguuu

SEQ ID NO: 492230 - RNA, 19 nt, Homo sapiens
ggcaucagguucaauggau

SEQ ID NO: 492231 - RNA, 19 nt, Homo sapiens
gaagaaggaaaaccuaaaa

SEQ ID NO: 492232 - RNA, 19 nt, Homo sapiens
aaauugagguaccuuugga

SEQ ID NO: 492233 - RNA, 19 nt, Homo sapiens
caggagcaccucuacauug

SEQ ID NO: 492234 - RNA, 19 nt, Homo sapiens
gaccuacgaguauuaucua

SEQ ID NO: 492235 - RNA, 19 nt, Homo sapiens
gaucaggaauguuauuacc

SEQ ID NO: 492236 - RNA, 19 nt, Homo sapiens
gauaaaccaggugaagaaa

SEQ ID NO: 492237 - RNA, 19 nt, Homo sapiens
gagguauuaugaucaugga

SEQ ID NO: 492238 - RNA, 19 nt, Homo sapiens
gaaguguugcuguggaaga

SEQ ID NO: 492239 - RNA, 19 nt, Homo sapiens
caggaugaccuacgaguau

SEQ ID NO: 492240 - RNA, 19 nt, Homo sapiens
caaucaacaugagaaugaa

SEQ ID NO: 492241 - RNA, 19 nt, Homo sapiens
uuucuuggcccaugauuaa

SEQ ID NO: 492242 - RNA, 19 nt, Homo sapiens
ugaagaauccuaugagcau

SEQ ID NO: 492243 - RNA, 19 nt, Homo sapiens
uggauuguguggaaacuau

SEQ ID NO: 492244 - RNA, 19 nt, Homo sapiens
agacggagguggcggucaa

SEQ ID NO: 492245 - RNA, 19 nt, Homo sapiens
agaauucacaggaguuauu

SEQ ID NO: 492246 - RNA, 19 nt, Homo sapiens
cacugggcauauaaauuua

SEQ ID NO: 492247 - RNA, 19 nt, Homo sapiens
ggaaggaaguuguagauug

SEQ ID NO: 492248 - RNA, 19 nt, Homo sapiens
gaccagauguggacaauca

SEQ ID NO: 492249 - RNA, 19 nt, Homo sapiens
guagauugcuuccuucaug

SEQ ID NO: 492250 - RNA, 19 nt, Homo sapiens
ugaaagcgcugauggacaa

SEQ ID NO: 492251 - RNA, 19 nt, Homo sapiens
ccaaccaaguuuauuguaa

SEQ ID NO: 492252 - RNA, 19 nt, Homo sapiens
gcccagaucugcaagcauu

SEQ ID NO: 492253 - RNA, 19 nt, Homo sapiens
gaaggaaguuguagauugc

SEQ ID NO: 492254 - RNA, 19 nt, Homo sapiens
gaagagggacuccagaaug

SEQ ID NO: 492255 - RNA, 19 nt, Homo sapiens
gccgggagcuuuacuucua

SEQ ID NO: 492256 - RNA, 19 nt, Homo sapiens
gagcaacauugaccggauu

SEQ ID NO: 492257 - RNA, 19 nt, Homo sapiens
gcaaagggaaagagaagaa

SEQ ID NO: 492258 - RNA, 19 nt, Homo sapiens
acacaugcaugcucgcuaa

SEQ ID NO: 492259 - RNA, 19 nt, Homo sapiens
gcugggaucucgcuuaagu

SEQ ID NO: 492260 - RNA, 19 nt, Homo sapiens
gaggucagcuaccgcauca

SEQ ID NO: 492261 - RNA, 19 nt, Homo sapiens
gaucugagcgacaucauca

SEQ ID NO: 492262 - RNA, 19 nt, Homo sapiens
ggaaagaggacgguugguu

SEQ ID NO: 492263 - RNA, 19 nt, Homo sapiens
gcacaaccacuaacaacau

SEQ ID NO: 492264 - RNA, 19 nt, Homo sapiens
gauauuguacagccaguuu

SEQ ID NO: 492265 - RNA, 19 nt, Homo sapiens
gauguuaucaagacucuga

SEQ ID NO: 492266 - RNA, 19 nt, Homo sapiens
gacuacgccuugaagcuaa

SEQ ID NO: 492267 - RNA, 19 nt, Homo sapiens
ccuugaagcuaaagaaugu

SEQ ID NO: 492268 - RNA, 19 nt, Homo sapiens
gagaagagggacuccagaa

SEQ ID NO: 492269 - RNA, 19 nt, Homo sapiens
gagcugggacacgauguua

SEQ ID NO: 492270 - RNA, 19 nt, Homo sapiens
cagaauggcugaggagaag

SEQ ID NO: 492271 - RNA, 19 nt, Homo sapiens
gaaugucgagccacucuau

SEQ ID NO: 492272 - RNA, 19 nt, Homo sapiens
ggucagcuaccgcaucaaa

SEQ ID NO: 492273 - RNA, 19 nt, Homo sapiens
accaagaccuucaccaaga

SEQ ID NO: 492274 - RNA, 19 nt, Homo sapiens
ccacgguucaguaccuuua

SEQ ID NO: 492275 - RNA, 19 nt, Homo sapiens
uaacggaugaggucagcua

SEQ ID NO: 492276 - RNA, 19 nt, Homo sapiens
guacagccaguuucucaga

SEQ ID NO: 492277 - RNA, 19 nt, Homo sapiens
gggacacgauguuaucaag

SEQ ID NO: 492278 - RNA, 19 nt, Homo sapiens
caaccuggcccuacucauc

SEQ ID NO: 492279 - RNA, 19 nt, Homo sapiens
ugggaucucgcuuaaguua

SEQ ID NO: 492280 - RNA, 19 nt, Homo sapiens
ugagcgacaucaucaauac

SEQ ID NO: 492281 - RNA, 19 nt, Homo sapiens
ugacuacgccuugaagcua

SEQ ID NO: 492282 - RNA, 19 nt, Homo sapiens
gaauggcugaggagaagaa

SEQ ID NO: 492283 - RNA, 19 nt, Homo sapiens
cugcugggaucucgcuuaa

SEQ ID NO: 492284 - RNA, 19 nt, Homo sapiens
ccaaguuuauuguaauguc

SEQ ID NO: 492285 - RNA, 19 nt, Homo sapiens
ggacgccuaucgggcagaa

SEQ ID NO: 492286 - RNA, 19 nt, Homo sapiens
gagagauguugcaggagau

SEQ ID NO: 492287 - RNA, 19 nt, Homo sapiens
ccacggacccuggacugua

SEQ ID NO: 492288 - RNA, 19 nt, Homo sapiens
gacauugacuacgccuuga

SEQ ID NO: 492289 - RNA, 19 nt, Homo sapiens
gcccaccgccugacaauca

SEQ ID NO: 492290 - RNA, 19 nt, Homo sapiens
aagagggacuccagaaugg

SEQ ID NO: 492291 - RNA, 19 nt, Homo sapiens
gacacgauguuaucaagac

SEQ ID NO: 492292 - RNA, 19 nt, Homo sapiens
ggacacgauguuaucaaga

SEQ ID NO: 492293 - RNA, 19 nt, Homo sapiens
cacggacccuggacuguau

SEQ ID NO: 492294 - RNA, 19 nt, Homo sapiens
gagaaggagguugaucuga

SEQ ID NO: 492295 - RNA, 19 nt, Homo sapiens
ggagaaggagguugaucug

SEQ ID NO: 492296 - RNA, 19 nt, Homo sapiens
ugaaggugguggcugaauc

SEQ ID NO: 492297 - RNA, 19 nt, Homo sapiens
ggaccacucugaccaucac

SEQ ID NO: 492298 - RNA, 19 nt, Homo sapiens
gauuggagcagaccaugug

SEQ ID NO: 492299 - RNA, 19 nt, Homo sapiens
agcagcagcucuacuacaa

SEQ ID NO: 492300 - RNA, 19 nt, Homo sapiens
guacaucguggucucacuu

SEQ ID NO: 492301 - RNA, 19 nt, Homo sapiens
acacugugcuccuguucug

SEQ ID NO: 492302 - RNA, 19 nt, Homo sapiens
ccaagaccuucaccaagag

SEQ ID NO: 492303 - RNA, 19 nt, Homo sapiens
cggaagcccugcaaagcau

SEQ ID NO: 492304 - RNA, 19 nt, Homo sapiens
ugaaggauucguaggaguu

SEQ ID NO: 492305 - RNA, 19 nt, Homo sapiens
uagauugcuuccuucaugu

SEQ ID NO: 492306 - RNA, 19 nt, Homo sapiens
ucaccaagaccuucaccaa

SEQ ID NO: 492307 - RNA, 19 nt, Homo sapiens
cacaggaugccuugaaguu

SEQ ID NO: 492308 - RNA, 19 nt, Homo sapiens
gccagcugcuaacggauga

SEQ ID NO: 492309 - RNA, 19 nt, Homo sapiens
ucagcuaccgcaucaaaga

SEQ ID NO: 492310 - RNA, 19 nt, Homo sapiens
ccagaauggcugaggagaa

SEQ ID NO: 492311 - RNA, 19 nt, Homo sapiens
cacaaccacuaacaacauc

SEQ ID NO: 492312 - RNA, 19 nt, Homo sapiens
gcgaccagauguggacaau

SEQ ID NO: 492313 - RNA, 19 nt, Homo sapiens
gaacaaccuggcccuacuc

SEQ ID NO: 492314 - RNA, 19 nt, Homo sapiens
ggaguucgccagggaagug

SEQ ID NO: 492315 - RNA, 19 nt, Homo sapiens
gcggaaggaaguuguagau

SEQ ID NO: 492316 - RNA, 19 nt, Homo sapiens
gugcuccuguucuggcaaa

SEQ ID NO: 492317 - RNA, 19 nt, Homo sapiens
caacauugaccggauugga

SEQ ID NO: 492318 - RNA, 19 nt, Homo sapiens
gcacaggaugccuugaagu

SEQ ID NO: 492319 - RNA, 19 nt, Homo sapiens
ggagauccugugacuguag

SEQ ID NO: 492320 - RNA, 19 nt, Homo sapiens
agagcuggguggacgagaa

SEQ ID NO: 492321 - RNA, 19 nt, Homo sapiens
gacccuggacuguaucaga

SEQ ID NO: 492322 - RNA, 19 nt, Homo sapiens
gaaggauucguaggaguuc

SEQ ID NO: 492323 - RNA, 19 nt, Homo sapiens
gaaguacaucguggucuca

SEQ ID NO: 492324 - RNA, 19 nt, Homo sapiens
gcggaagcccugcaaagca

SEQ ID NO: 492325 - RNA, 19 nt, Homo sapiens
ccuccaaccaaguuuauug

SEQ ID NO: 492326 - RNA, 19 nt, Homo sapiens
auacguccaugagcugauu

SEQ ID NO: 492327 - RNA, 19 nt, Homo sapiens
ggacgucugccucaaagcu

SEQ ID NO: 492328 - RNA, 19 nt, Homo sapiens
ggguauugaaggauucgua

SEQ ID NO: 492329 - RNA, 19 nt, Homo sapiens
gucaacaggaccacucuga

SEQ ID NO: 492330 - RNA, 19 nt, Homo sapiens
gaagcccugcaaagcauug

SEQ ID NO: 492331 - RNA, 19 nt, Homo sapiens
caaagagaucgcacaggau

SEQ ID NO: 492332 - RNA, 19 nt, Homo sapiens
gacgguugguugugugucu

SEQ ID NO: 492333 - RNA, 19 nt, Homo sapiens
aguuguagauugcuuccuu

SEQ ID NO: 492334 - RNA, 19 nt, Homo sapiens
uaagcggaaggaaguugua

SEQ ID NO: 492335 - RNA, 19 nt, Homo sapiens
gcugggacacgauguuauc

SEQ ID NO: 492336 - RNA, 19 nt, Homo sapiens
agaacaaccuggcccuacu

SEQ ID NO: 492337 - RNA, 19 nt, Homo sapiens
aaagaggacgguugguugu

SEQ ID NO: 492338 - RNA, 19 nt, Homo sapiens
agaggacgguugguugugu

SEQ ID NO: 492339 - RNA, 19 nt, Homo sapiens
ccgggagcuuuacuucuau

SEQ ID NO: 492340 - RNA, 19 nt, Homo sapiens
ggaguguccagaaguacau

SEQ ID NO: 492341 - RNA, 19 nt, Homo sapiens
cagcugugaugaccugcau

SEQ ID NO: 492342 - RNA, 19 nt, Homo sapiens
ccacagaaccccugaaguc

SEQ ID NO: 492343 - RNA, 19 nt, Homo sapiens
gcuaccgcaucaaagagau

SEQ ID NO: 492344 - RNA, 19 nt, Homo sapiens
ggagaccugccagcugcua

SEQ ID NO: 492345 - RNA, 19 nt, Homo sapiens
cggaggagacccuuugaag

SEQ ID NO: 492346 - RNA, 19 nt, Homo sapiens
gcuaagcggaaggaaguug

SEQ ID NO: 492347 - RNA, 19 nt, Homo sapiens
ggaaggaaguuguagauug

SEQ ID NO: 492348 - RNA, 19 nt, Homo sapiens
gaccagauguggacaauca

SEQ ID NO: 492349 - RNA, 19 nt, Homo sapiens
guagauugcuuccuucaug

SEQ ID NO: 492350 - RNA, 19 nt, Homo sapiens
ugaaagcgcugauggacaa

SEQ ID NO: 492351 - RNA, 19 nt, Homo sapiens
ccaaccaaguuuauuguaa

SEQ ID NO: 492352 - RNA, 19 nt, Homo sapiens
gcccagaucugcaagcauu

SEQ ID NO: 492353 - RNA, 19 nt, Homo sapiens
gaaggaaguuguagauugc

SEQ ID NO: 492354 - RNA, 19 nt, Homo sapiens
gaagagggacuccagaaug

SEQ ID NO: 492355 - RNA, 19 nt, Homo sapiens
gccgggagcuuuacuucua

SEQ ID NO: 492356 - RNA, 19 nt, Homo sapiens
gagcaacauugaccggauu

SEQ ID NO: 492357 - RNA, 19 nt, Homo sapiens
gcaaagggaaagagaagaa

SEQ ID NO: 492358 - RNA, 19 nt, Homo sapiens
acacaugcaugcucgcuaa

SEQ ID NO: 492359 - RNA, 19 nt, Homo sapiens
gaggucagcuaccgcauca

SEQ ID NO: 492360 - RNA, 19 nt, Homo sapiens
gaucugagcgacaucauca

SEQ ID NO: 492361 - RNA, 19 nt, Homo sapiens
gcacaaccacuaacaacau

SEQ ID NO: 492362 - RNA, 19 nt, Homo sapiens
gauauuguacagccaguuu

SEQ ID NO: 492363 - RNA, 19 nt, Homo sapiens
gauguuaucaagacucuga

SEQ ID NO: 492364 - RNA, 19 nt, Homo sapiens
gacuacgccuugaagcuaa

SEQ ID NO: 492365 - RNA, 19 nt, Homo sapiens
gagaagagggacuccagaa

SEQ ID NO: 492366 - RNA, 19 nt, Homo sapiens
ccuugaagcuaaagaaugu

SEQ ID NO: 492367 - RNA, 19 nt, Homo sapiens
gagcugggacacgauguua

SEQ ID NO: 492368 - RNA, 19 nt, Homo sapiens
cagaauggcugaggagaag

SEQ ID NO: 492369 - RNA, 19 nt, Homo sapiens
gaaugucgagccacucuau

SEQ ID NO: 492370 - RNA, 19 nt, Homo sapiens
ggucagcuaccgcaucaaa

SEQ ID NO: 492371 - RNA, 19 nt, Homo sapiens
accaagaccuucaccaaga

SEQ ID NO: 492372 - RNA, 19 nt, Homo sapiens
ccacgguucaguaccuuua

SEQ ID NO: 492373 - RNA, 19 nt, Homo sapiens
uaacggaugaggucagcua

SEQ ID NO: 492374 - RNA, 19 nt, Homo sapiens
guacagccaguuucucaga

SEQ ID NO: 492375 - RNA, 19 nt, Homo sapiens
gggacacgauguuaucaag

SEQ ID NO: 492376 - RNA, 19 nt, Homo sapiens
caaccuggcccuacucauc

SEQ ID NO: 492377 - RNA, 19 nt, Homo sapiens
gaauggcugaggagaagaa

SEQ ID NO: 492378 - RNA, 19 nt, Homo sapiens
ugagcgacaucaucaauac

SEQ ID NO: 492379 - RNA, 19 nt, Homo sapiens
ugacuacgccuugaagcua

SEQ ID NO: 492380 - RNA, 19 nt, Homo sapiens
ccaaguuuauuguaauguc

SEQ ID NO: 492381 - RNA, 19 nt, Homo sapiens
ggacgccuaucgggcagaa

SEQ ID NO: 492382 - RNA, 19 nt, Homo sapiens
ccacggacccuggacugua

SEQ ID NO: 492383 - RNA, 19 nt, Homo sapiens
gacauugacuacgccuuga

SEQ ID NO: 492384 - RNA, 19 nt, Homo sapiens
gcccaccgccugacaauca

SEQ ID NO: 492385 - RNA, 19 nt, Homo sapiens
aagagggacuccagaaugg

SEQ ID NO: 492386 - RNA, 19 nt, Homo sapiens
gacacgauguuaucaagac

SEQ ID NO: 492387 - RNA, 19 nt, Homo sapiens
ggacacgauguuaucaaga

SEQ ID NO: 492388 - RNA, 19 nt, Homo sapiens
cacggacccuggacuguau

SEQ ID NO: 492389 - RNA, 19 nt, Homo sapiens
gagaaggagguugaucuga

SEQ ID NO: 492390 - RNA, 19 nt, Homo sapiens
ggagaaggagguugaucug

SEQ ID NO: 492391 - RNA, 19 nt, Homo sapiens
ugaaggugguggcugaauc

SEQ ID NO: 492392 - RNA, 19 nt, Homo sapiens
gauuggagcagaccaugug

SEQ ID NO: 492393 - RNA, 19 nt, Homo sapiens
agcagcagcucuacuacaa

SEQ ID NO: 492394 - RNA, 19 nt, Homo sapiens
guacaucguggucucacuu

SEQ ID NO: 492395 - RNA, 19 nt, Homo sapiens
acacugugcuccuguucug

SEQ ID NO: 492396 - RNA, 19 nt, Homo sapiens
ccaagaccuucaccaagag

SEQ ID NO: 492397 - RNA, 19 nt, Homo sapiens
cggaagcccugcaaagcau

SEQ ID NO: 492398 - RNA, 19 nt, Homo sapiens
uagauugcuuccuucaugu

SEQ ID NO: 492399 - RNA, 19 nt, Homo sapiens
gccagcugcuaacggauga

SEQ ID NO: 492400 - RNA, 19 nt, Homo sapiens
ucaccaagaccuucaccaa

SEQ ID NO: 492401 - RNA, 19 nt, Homo sapiens
cacaggaugccuugaaguu

SEQ ID NO: 492402 - RNA, 19 nt, Homo sapiens
ccagaauggcugaggagaa

SEQ ID NO: 492403 - RNA, 19 nt, Homo sapiens
ucagcuaccgcaucaaaga

SEQ ID NO: 492404 - RNA, 19 nt, Homo sapiens
cacaaccacuaacaacauc

SEQ ID NO: 492405 - RNA, 19 nt, Homo sapiens
gcgaccagauguggacaau

SEQ ID NO: 492406 - RNA, 19 nt, Homo sapiens
gaacaaccuggcccuacuc

SEQ ID NO: 492407 - RNA, 19 nt, Homo sapiens
gcggaaggaaguuguagau

SEQ ID NO: 492408 - RNA, 19 nt, Homo sapiens
gcacaggaugccuugaagu

SEQ ID NO: 492409 - RNA, 19 nt, Homo sapiens
gugcuccuguucuggcaaa

SEQ ID NO: 492410 - RNA, 19 nt, Homo sapiens
caacauugaccggauugga

SEQ ID NO: 492411 - RNA, 19 nt, Homo sapiens
agagcuggguggacgagaa

SEQ ID NO: 492412 - RNA, 19 nt, Homo sapiens
gacccuggacuguaucaga

SEQ ID NO: 492413 - RNA, 19 nt, Homo sapiens
gaaguacaucguggucuca

SEQ ID NO: 492414 - RNA, 19 nt, Homo sapiens
gcggaagcccugcaaagca

SEQ ID NO: 492415 - RNA, 19 nt, Homo sapiens
ccuccaaccaaguuuauug

SEQ ID NO: 492416 - RNA, 19 nt, Homo sapiens
auacguccaugagcugauu

SEQ ID NO: 492417 - RNA, 19 nt, Homo sapiens
ggacgucugccucaaagcu

SEQ ID NO: 492418 - RNA, 19 nt, Homo sapiens
caaagagaucgcacaggau

SEQ ID NO: 492419 - RNA, 19 nt, Homo sapiens
gaagcccugcaaagcauug

SEQ ID NO: 492420 - RNA, 19 nt, Homo sapiens
aguuguagauugcuuccuu

SEQ ID NO: 492421 - RNA, 19 nt, Homo sapiens
uaagcggaaggaaguugua

SEQ ID NO: 492422 - RNA, 19 nt, Homo sapiens
gcugggacacgauguuauc

SEQ ID NO: 492423 - RNA, 19 nt, Homo sapiens
agaacaaccuggcccuacu

SEQ ID NO: 492424 - RNA, 19 nt, Homo sapiens
ccgggagcuuuacuucuau

SEQ ID NO: 492425 - RNA, 19 nt, Homo sapiens
ggagaccugccagcugcua

SEQ ID NO: 492426 - RNA, 19 nt, Homo sapiens
ggaguguccagaaguacau

SEQ ID NO: 492427 - RNA, 19 nt, Homo sapiens
cagcugugaugaccugcau

SEQ ID NO: 492428 - RNA, 19 nt, Homo sapiens
gcuaccgcaucaaagagau

SEQ ID NO: 492429 - RNA, 19 nt, Homo sapiens
ccacagaaccccugaaguc

SEQ ID NO: 492430 - RNA, 19 nt, Homo sapiens
cggaggagacccuuugaag

SEQ ID NO: 492431 - RNA, 19 nt, Homo sapiens
gcuaagcggaaggaaguug

SEQ ID NO: 492432 - RNA, 19 nt, Homo sapiens
gagaccugccagcugcuaa

SEQ ID NO: 492433 - RNA, 19 nt, Homo sapiens
ccaccagugacauugacua

SEQ ID NO: 492434 - RNA, 19 nt, Homo sapiens
ggaagcccugcaaagcauu

SEQ ID NO: 492435 - RNA, 19 nt, Homo sapiens
caucgugagcagacaguug

SEQ ID NO: 492436 - RNA, 19 nt, Homo sapiens
ccugaugcguauggugaaa

SEQ ID NO: 492437 - RNA, 19 nt, Homo sapiens
gagcauccacgaguugucu

SEQ ID NO: 492438 - RNA, 19 nt, Homo sapiens
cugagcgacaucaucaaua

SEQ ID NO: 492439 - RNA, 19 nt, Homo sapiens
agaagagggacuccagaau

SEQ ID NO: 492440 - RNA, 19 nt, Homo sapiens
ggaaggaaguuguagauug

SEQ ID NO: 492441 - RNA, 19 nt, Homo sapiens
gaccagauguggacaauca

SEQ ID NO: 492442 - RNA, 19 nt, Homo sapiens
guagauugcuuccuucaug

SEQ ID NO: 492443 - RNA, 19 nt, Homo sapiens
ugaaagcgcugauggacaa

SEQ ID NO: 492444 - RNA, 19 nt, Homo sapiens
ccaaccaaguuuauuguaa

SEQ ID NO: 492445 - RNA, 19 nt, Homo sapiens
gcccagaucugcaagcauu

SEQ ID NO: 492446 - RNA, 19 nt, Homo sapiens
gaaggaaguuguagauugc

SEQ ID NO: 492447 - RNA, 19 nt, Homo sapiens
gaagagggacuccagaaug

SEQ ID NO: 492448 - RNA, 19 nt, Homo sapiens
gccgggagcuuuacuucua

SEQ ID NO: 492449 - RNA, 19 nt, Homo sapiens
gagcaacauugaccggauu

SEQ ID NO: 492450 - RNA, 19 nt, Homo sapiens
gcaaagggaaagagaagaa

SEQ ID NO: 492451 - RNA, 19 nt, Homo sapiens
acacaugcaugcucgcuaa

SEQ ID NO: 492452 - RNA, 19 nt, Homo sapiens
gcugggaucucgcuuaagu

SEQ ID NO: 492453 - RNA, 19 nt, Homo sapiens
gaucugagcgacaucauca

SEQ ID NO: 492454 - RNA, 19 nt, Homo sapiens
ggaaagaggacgguugguu

SEQ ID NO: 492455 - RNA, 19 nt, Homo sapiens
gcacaaccacuaacaacau

SEQ ID NO: 492456 - RNA, 19 nt, Homo sapiens
gauauuguacagccaguuu

SEQ ID NO: 492457 - RNA, 19 nt, Homo sapiens
gauguuaucaagacucuga

SEQ ID NO: 492458 - RNA, 19 nt, Homo sapiens
gacuacgccuugaagcuaa

SEQ ID NO: 492459 - RNA, 19 nt, Homo sapiens
ccuugaagcuaaagaaugu

SEQ ID NO: 492460 - RNA, 19 nt, Homo sapiens
ggaugaggaugccuugaag

SEQ ID NO: 492461 - RNA, 19 nt, Homo sapiens
gagaagagggacuccagaa

SEQ ID NO: 492462 - RNA, 19 nt, Homo sapiens
gagcugggacacgauguua

SEQ ID NO: 492463 - RNA, 19 nt, Homo sapiens
cagaauggcugaggagaag

SEQ ID NO: 492464 - RNA, 19 nt, Homo sapiens
gaaugucgagccacucuau

SEQ ID NO: 492465 - RNA, 19 nt, Homo sapiens
accaagaccuucaccaaga

SEQ ID NO: 492466 - RNA, 19 nt, Homo sapiens
ccacgguucaguaccuuua

SEQ ID NO: 492467 - RNA, 19 nt, Homo sapiens
guacagccaguuucucaga

SEQ ID NO: 492468 - RNA, 19 nt, Homo sapiens
gggacacgauguuaucaag

SEQ ID NO: 492469 - RNA, 19 nt, Homo sapiens
caaccuggcccuacucauc

SEQ ID NO: 492470 - RNA, 19 nt, Homo sapiens
ugggaucucgcuuaaguua

SEQ ID NO: 492471 - RNA, 19 nt, Homo sapiens
ugagcgacaucaucaauac

SEQ ID NO: 492472 - RNA, 19 nt, Homo sapiens
ugacuacgccuugaagcua

SEQ ID NO: 492473 - RNA, 19 nt, Homo sapiens
gaauggcugaggagaagaa

SEQ ID NO: 492474 - RNA, 19 nt, Homo sapiens
cugcugggaucucgcuuaa

SEQ ID NO: 492475 - RNA, 19 nt, Homo sapiens
ccaaguuuauuguaauguc

SEQ ID NO: 492476 - RNA, 19 nt, Homo sapiens
ggacgccuaucgggcagaa

SEQ ID NO: 492477 - RNA, 19 nt, Homo sapiens
ccacggacccuggacugua

SEQ ID NO: 492478 - RNA, 19 nt, Homo sapiens
gagagauguugcaggagau

SEQ ID NO: 492479 - RNA, 19 nt, Homo sapiens
gacauugacuacgccuuga

SEQ ID NO: 492480 - RNA, 19 nt, Homo sapiens
gcccaccgccugacaauca

SEQ ID NO: 492481 - RNA, 19 nt, Homo sapiens
aagagggacuccagaaugg

SEQ ID NO: 492482 - RNA, 19 nt, Homo sapiens
gacacgauguuaucaagac

SEQ ID NO: 492483 - RNA, 19 nt, Homo sapiens
ggacacgauguuaucaaga

SEQ ID NO: 492484 - RNA, 19 nt, Homo sapiens
cacggacccuggacuguau

SEQ ID NO: 492485 - RNA, 19 nt, Homo sapiens
gagaaggagguugaucuga

SEQ ID NO: 492486 - RNA, 19 nt, Homo sapiens
ggagaaggagguugaucug

SEQ ID NO: 492487 - RNA, 19 nt, Homo sapiens
ugaaggugguggcugaauc

SEQ ID NO: 492488 - RNA, 19 nt, Homo sapiens
ggaccacucugaccaucac

SEQ ID NO: 492489 - RNA, 19 nt, Homo sapiens
gauuggagcagaccaugug

SEQ ID NO: 492490 - RNA, 19 nt, Homo sapiens
agcagcagcucuacuacaa

SEQ ID NO: 492491 - RNA, 19 nt, Homo sapiens
guacaucguggucucacuu

SEQ ID NO: 492492 - RNA, 19 nt, Homo sapiens
acacugugcuccuguucug

SEQ ID NO: 492493 - RNA, 19 nt, Homo sapiens
ccaagaccuucaccaagag

SEQ ID NO: 492494 - RNA, 19 nt, Homo sapiens
cggaagcccugcaaagcau

SEQ ID NO: 492495 - RNA, 19 nt, Homo sapiens
ugaaggauucguaggaguu

SEQ ID NO: 492496 - RNA, 19 nt, Homo sapiens
uagauugcuuccuucaugu

SEQ ID NO: 492497 - RNA, 19 nt, Homo sapiens
ucaccaagaccuucaccaa

SEQ ID NO: 492498 - RNA, 19 nt, Homo sapiens
gccagcugcuaacggauga

SEQ ID NO: 492499 - RNA, 19 nt, Homo sapiens
ccagaauggcugaggagaa

SEQ ID NO: 492500 - RNA, 19 nt, Homo sapiens
cacaaccacuaacaacauc

SEQ ID NO: 492501 - RNA, 19 nt, Homo sapiens
gcgaccagauguggacaau

SEQ ID NO: 492502 - RNA, 19 nt, Homo sapiens
gaacaaccuggcccuacuc

SEQ ID NO: 492503 - RNA, 19 nt, Homo sapiens
ggaguucgccagggaagug

SEQ ID NO: 492504 - RNA, 19 nt, Homo sapiens
gcggaaggaaguuguagau

SEQ ID NO: 492505 - RNA, 19 nt, Homo sapiens
gugcuccuguucuggcaaa

SEQ ID NO: 492506 - RNA, 19 nt, Homo sapiens
caacauugaccggauugga

SEQ ID NO: 492507 - RNA, 19 nt, Homo sapiens
agagcuggguggacgagaa

SEQ ID NO: 492508 - RNA, 19 nt, Homo sapiens
gacccuggacuguaucaga

SEQ ID NO: 492509 - RNA, 19 nt, Homo sapiens
ggagauccugugacuguag

SEQ ID NO: 492510 - RNA, 19 nt, Homo sapiens
gaaggauucguaggaguuc

SEQ ID NO: 492511 - RNA, 19 nt, Homo sapiens
gaaguacaucguggucuca

SEQ ID NO: 492512 - RNA, 19 nt, Homo sapiens
gcggaagcccugcaaagca

SEQ ID NO: 492513 - RNA, 19 nt, Homo sapiens
ccuccaaccaaguuuauug

SEQ ID NO: 492514 - RNA, 19 nt, Homo sapiens
auacguccaugagcugauu

SEQ ID NO: 492515 - RNA, 19 nt, Homo sapiens
ggacgucugccucaaagcu

SEQ ID NO: 492516 - RNA, 19 nt, Homo sapiens
gucaacaggaccacucuga

SEQ ID NO: 492517 - RNA, 19 nt, Homo sapiens
gaagcccugcaaagcauug

SEQ ID NO: 492518 - RNA, 19 nt, Homo sapiens
ggguauugaaggauucgua

SEQ ID NO: 492519 - RNA, 19 nt, Homo sapiens
cggaugaggaugccuugaa

SEQ ID NO: 492520 - RNA, 19 nt, Homo sapiens
aguuguagauugcuuccuu

SEQ ID NO: 492521 - RNA, 19 nt, Homo sapiens
uaagcggaaggaaguugua

SEQ ID NO: 492522 - RNA, 19 nt, Homo sapiens
gacgguugguugugugucu

SEQ ID NO: 492523 - RNA, 19 nt, Homo sapiens
gcugggacacgauguuauc

SEQ ID NO: 492524 - RNA, 19 nt, Homo sapiens
agaacaaccuggcccuacu

SEQ ID NO: 492525 - RNA, 19 nt, Homo sapiens
aaagaggacgguugguugu

SEQ ID NO: 492526 - RNA, 19 nt, Homo sapiens
agaggacgguugguugugu

SEQ ID NO: 492527 - RNA, 19 nt, Homo sapiens
ccgggagcuuuacuucuau

SEQ ID NO: 492528 - RNA, 19 nt, Homo sapiens
ggaguguccagaaguacau

SEQ ID NO: 492529 - RNA, 19 nt, Homo sapiens
cagcugugaugaccugcau

SEQ ID NO: 492530 - RNA, 19 nt, Homo sapiens
ccacagaaccccugaaguc

SEQ ID NO: 492531 - RNA, 19 nt, Homo sapiens
ggagaccugccagcugcua

SEQ ID NO: 492532 - RNA, 19 nt, Homo sapiens
cggaggagacccuuugaag

SEQ ID NO: 492533 - RNA, 19 nt, Homo sapiens
gcuaagcggaaggaaguug

SEQ ID NO: 492534 - RNA, 19 nt, Homo sapiens
ggaagcccugcaaagcauu

SEQ ID NO: 492535 - RNA, 19 nt, Homo sapiens
ccaccagugacauugacua

SEQ ID NO: 492536 - RNA, 19 nt, Homo sapiens
gagaccugccagcugcuaa

SEQ ID NO: 492537 - RNA, 19 nt, Homo sapiens
caucgugagcagacaguug

SEQ ID NO: 492538 - RNA, 19 nt, Homo sapiens
ccugaugcguauggugaaa

SEQ ID NO: 492539 - RNA, 19 nt, Homo sapiens
gagcauccacgaguugucu

SEQ ID NO: 492540 - RNA, 19 nt, Homo sapiens
ggaaggaaguuguagauug

SEQ ID NO: 492541 - RNA, 19 nt, Homo sapiens
gaccagauguggacaauca

SEQ ID NO: 492542 - RNA, 19 nt, Homo sapiens
guagauugcuuccuucaug

SEQ ID NO: 492543 - RNA, 19 nt, Homo sapiens
ugaaagcgcugauggacaa

SEQ ID NO: 492544 - RNA, 19 nt, Homo sapiens
ccaaccaaguuuauuguaa

SEQ ID NO: 492545 - RNA, 19 nt, Homo sapiens
gcccagaucugcaagcauu

SEQ ID NO: 492546 - RNA, 19 nt, Homo sapiens
gaaggaaguuguagauugc

SEQ ID NO: 492547 - RNA, 19 nt, Homo sapiens
gaagagggacuccagaaug

SEQ ID NO: 492548 - RNA, 19 nt, Homo sapiens
gccgggagcuuuacuucua

SEQ ID NO: 492549 - RNA, 19 nt, Homo sapiens
gagcaacauugaccggauu

SEQ ID NO: 492550 - RNA, 19 nt, Homo sapiens
gcaaagggaaagagaagaa

SEQ ID NO: 492551 - RNA, 19 nt, Homo sapiens
acacaugcaugcucgcuaa

SEQ ID NO: 492552 - RNA, 19 nt, Homo sapiens
gaggucagcuaccgcauca

SEQ ID NO: 492553 - RNA, 19 nt, Homo sapiens
gaucugagcgacaucauca

SEQ ID NO: 492554 - RNA, 19 nt, Homo sapiens
gcacaaccacuaacaacau

SEQ ID NO: 492555 - RNA, 19 nt, Homo sapiens
gauauuguacagccaguuu

SEQ ID NO: 492556 - RNA, 19 nt, Homo sapiens
gauguuaucaagacucuga

SEQ ID NO: 492557 - RNA, 19 nt, Homo sapiens
gacuacgccuugaagcuaa

SEQ ID NO: 492558 - RNA, 19 nt, Homo sapiens
gagaagagggacuccagaa

SEQ ID NO: 492559 - RNA, 19 nt, Homo sapiens
ccuugaagcuaaagaaugu

SEQ ID NO: 492560 - RNA, 19 nt, Homo sapiens
gagcugggacacgauguua

SEQ ID NO: 492561 - RNA, 19 nt, Homo sapiens
cagaauggcugaggagaag

SEQ ID NO: 492562 - RNA, 19 nt, Homo sapiens
gaaugucgagccacucuau

SEQ ID NO: 492563 - RNA, 19 nt, Homo sapiens
ggucagcuaccgcaucaaa

SEQ ID NO: 492564 - RNA, 19 nt, Homo sapiens
accaagaccuucaccaaga

SEQ ID NO: 492565 - RNA, 19 nt, Homo sapiens
ccacgguucaguaccuuua

SEQ ID NO: 492566 - RNA, 19 nt, Homo sapiens
uaacggaugaggucagcua

SEQ ID NO: 492567 - RNA, 19 nt, Homo sapiens
guacagccaguuucucaga

SEQ ID NO: 492568 - RNA, 19 nt, Homo sapiens
gggacacgauguuaucaag

SEQ ID NO: 492569 - RNA, 19 nt, Homo sapiens
caaccuggcccuacucauc

SEQ ID NO: 492570 - RNA, 19 nt, Homo sapiens
gaauggcugaggagaagaa

SEQ ID NO: 492571 - RNA, 19 nt, Homo sapiens
ugagcgacaucaucaauac

SEQ ID NO: 492572 - RNA, 19 nt, Homo sapiens
ugacuacgccuugaagcua

SEQ ID NO: 492573 - RNA, 19 nt, Homo sapiens
ccaaguuuauuguaauguc

SEQ ID NO: 492574 - RNA, 19 nt, Homo sapiens
ggacgccuaucgggcagaa

SEQ ID NO: 492575 - RNA, 19 nt, Homo sapiens
ccacggacccuggacugua

SEQ ID NO: 492576 - RNA, 19 nt, Homo sapiens
gacauugacuacgccuuga

SEQ ID NO: 492577 - RNA, 19 nt, Homo sapiens
gcccaccgccugacaauca

SEQ ID NO: 492578 - RNA, 19 nt, Homo sapiens
aagagggacuccagaaugg

SEQ ID NO: 492579 - RNA, 19 nt, Homo sapiens
gacacgauguuaucaagac

SEQ ID NO: 492580 - RNA, 19 nt, Homo sapiens
ggacacgauguuaucaaga

SEQ ID NO: 492581 - RNA, 19 nt, Homo sapiens
cacggacccuggacuguau

SEQ ID NO: 492582 - RNA, 19 nt, Homo sapiens
gagaaggagguugaucuga

SEQ ID NO: 492583 - RNA, 19 nt, Homo sapiens
ggagaaggagguugaucug

SEQ ID NO: 492584 - RNA, 19 nt, Homo sapiens
ugaaggugguggcugaauc

SEQ ID NO: 492585 - RNA, 19 nt, Homo sapiens
ggaccacucugaccaucac

SEQ ID NO: 492586 - RNA, 19 nt, Homo sapiens
gauuggagcagaccaugug

SEQ ID NO: 492587 - RNA, 19 nt, Homo sapiens
agcagcagcucuacuacaa

SEQ ID NO: 492588 - RNA, 19 nt, Homo sapiens
guacaucguggucucacuu

SEQ ID NO: 492589 - RNA, 19 nt, Homo sapiens
acacugugcuccuguucug

SEQ ID NO: 492590 - RNA, 19 nt, Homo sapiens
ccaagaccuucaccaagag

SEQ ID NO: 492591 - RNA, 19 nt, Homo sapiens
cggaagcccugcaaagcau

SEQ ID NO: 492592 - RNA, 19 nt, Homo sapiens
uagauugcuuccuucaugu

SEQ ID NO: 492593 - RNA, 19 nt, Homo sapiens
gccagcugcuaacggauga

SEQ ID NO: 492594 - RNA, 19 nt, Homo sapiens
ucaccaagaccuucaccaa

SEQ ID NO: 492595 - RNA, 19 nt, Homo sapiens
cacaggaugccuugaaguu

SEQ ID NO: 492596 - RNA, 19 nt, Homo sapiens
ccagaauggcugaggagaa

SEQ ID NO: 492597 - RNA, 19 nt, Homo sapiens
ucagcuaccgcaucaaaga

SEQ ID NO: 492598 - RNA, 19 nt, Homo sapiens
cacaaccacuaacaacauc

SEQ ID NO: 492599 - RNA, 19 nt, Homo sapiens
gcgaccagauguggacaau

SEQ ID NO: 492600 - RNA, 19 nt, Homo sapiens
gaacaaccuggcccuacuc

SEQ ID NO: 492601 - RNA, 19 nt, Homo sapiens
gcacaggaugccuugaagu

SEQ ID NO: 492602 - RNA, 19 nt, Homo sapiens
gcggaaggaaguuguagau

SEQ ID NO: 492603 - RNA, 19 nt, Homo sapiens
gugcuccuguucuggcaaa

SEQ ID NO: 492604 - RNA, 19 nt, Homo sapiens
caacauugaccggauugga

SEQ ID NO: 492605 - RNA, 19 nt, Homo sapiens
agagcuggguggacgagaa

SEQ ID NO: 492606 - RNA, 19 nt, Homo sapiens
gacccuggacuguaucaga

SEQ ID NO: 492607 - RNA, 19 nt, Homo sapiens
gaaguacaucguggucuca

SEQ ID NO: 492608 - RNA, 19 nt, Homo sapiens
gcggaagcccugcaaagca

SEQ ID NO: 492609 - RNA, 19 nt, Homo sapiens
ccuccaaccaaguuuauug

SEQ ID NO: 492610 - RNA, 19 nt, Homo sapiens
auacguccaugagcugauu

SEQ ID NO: 492611 - RNA, 19 nt, Homo sapiens
ggacgucugccucaaagcu

SEQ ID NO: 492612 - RNA, 19 nt, Homo sapiens
caaagagaucgcacaggau

SEQ ID NO: 492613 - RNA, 19 nt, Homo sapiens
gucaacaggaccacucuga

SEQ ID NO: 492614 - RNA, 19 nt, Homo sapiens
gaagcccugcaaagcauug

SEQ ID NO: 492615 - RNA, 19 nt, Homo sapiens
aguuguagauugcuuccuu

SEQ ID NO: 492616 - RNA, 19 nt, Homo sapiens
uaagcggaaggaaguugua

SEQ ID NO: 492617 - RNA, 19 nt, Homo sapiens
gcugggacacgauguuauc

SEQ ID NO: 492618 - RNA, 19 nt, Homo sapiens
agaacaaccuggcccuacu

SEQ ID NO: 492619 - RNA, 19 nt, Homo sapiens
aaguuugguuuguaaguuc

SEQ ID NO: 492620 - RNA, 19 nt, Homo sapiens
ccgggagcuuuacuucuau

SEQ ID NO: 492621 - RNA, 19 nt, Homo sapiens
ggaguguccagaaguacau

SEQ ID NO: 492622 - RNA, 19 nt, Homo sapiens
gcuaccgcaucaaagagau

SEQ ID NO: 492623 - RNA, 19 nt, Homo sapiens
cagcugugaugaccugcau

SEQ ID NO: 492624 - RNA, 19 nt, Homo sapiens
ggagaccugccagcugcua

SEQ ID NO: 492625 - RNA, 19 nt, Homo sapiens
ccacagaaccccugaaguc

SEQ ID NO: 492626 - RNA, 19 nt, Homo sapiens
cggaggagacccuuugaag

SEQ ID NO: 492627 - RNA, 19 nt, Homo sapiens
gcuaagcggaaggaaguug

SEQ ID NO: 492628 - RNA, 19 nt, Homo sapiens
gagaccugccagcugcuaa

SEQ ID NO: 492629 - RNA, 19 nt, Homo sapiens
ccaccagugacauugacua

SEQ ID NO: 492630 - RNA, 19 nt, Homo sapiens
ggaagcccugcaaagcauu

SEQ ID NO: 492631 - RNA, 19 nt, Homo sapiens
caucgugagcagacaguug

SEQ ID NO: 492632 - RNA, 19 nt, Homo sapiens
ccugaugcguauggugaaa

SEQ ID NO: 492633 - RNA, 19 nt, Homo sapiens
gagcauccacgaguugucu

SEQ ID NO: 492634 - RNA, 19 nt, Homo sapiens
cugagcgacaucaucaaua

SEQ ID NO: 492635 - RNA, 19 nt, Homo sapiens
agaagagggacuccagaau

SEQ ID NO: 492636 - RNA, 19 nt, Homo sapiens
gaacuuaagucugugaaua

SEQ ID NO: 492637 - RNA, 19 nt, Homo sapiens
ugaauaagccuuuguguua

SEQ ID NO: 492638 - RNA, 19 nt, Homo sapiens
gaauaugccucuacuguga

SEQ ID NO: 492639 - RNA, 19 nt, Homo sapiens
gaauaagccuuuguguuaa

SEQ ID NO: 492640 - RNA, 19 nt, Homo sapiens
uaggaaaguugcaggauua

SEQ ID NO: 492641 - RNA, 19 nt, Homo sapiens
gaauuacucugccucuaaa

SEQ ID NO: 492642 - RNA, 19 nt, Homo sapiens
gacgugagaucaauaagaa

SEQ ID NO: 492643 - RNA, 19 nt, Homo sapiens
gugaaacgauugcugagua

SEQ ID NO: 492644 - RNA, 19 nt, Homo sapiens
gguauucggucacagcaua

SEQ ID NO: 492645 - RNA, 19 nt, Homo sapiens
ggagagccaguuuaucuua

SEQ ID NO: 492646 - RNA, 19 nt, Homo sapiens
gaaaagacuuggagcuuaa

SEQ ID NO: 492647 - RNA, 19 nt, Homo sapiens
ggaauuacucugccucuaa

SEQ ID NO: 492648 - RNA, 19 nt, Homo sapiens
ggaggaagaucuggagaga

SEQ ID NO: 492649 - RNA, 19 nt, Homo sapiens
guaggaaaguugcaggauu

SEQ ID NO: 492650 - RNA, 19 nt, Homo sapiens
uagaaucacuccuagagaa

SEQ ID NO: 492651 - RNA, 19 nt, Homo sapiens
cggugaaacugaacuuaua

SEQ ID NO: 492652 - RNA, 19 nt, Homo sapiens
gcagugaggaugaagauga

SEQ ID NO: 492653 - RNA, 19 nt, Homo sapiens
gcaggaagaauuaaggaaa

SEQ ID NO: 492654 - RNA, 19 nt, Homo sapiens
uugcaggacuuuacuguuu

SEQ ID NO: 492655 - RNA, 19 nt, Homo sapiens
gcaagaggagcuagaauca

SEQ ID NO: 492656 - RNA, 19 nt, Homo sapiens
acgcuuagcugcugaucua

SEQ ID NO: 492657 - RNA, 19 nt, Homo sapiens
acaagaggaucucaucaug

SEQ ID NO: 492658 - RNA, 19 nt, Homo sapiens
gaagcagauugacaacaug

SEQ ID NO: 492659 - RNA, 19 nt, Homo sapiens
gaauucagaagcagauuga

SEQ ID NO: 492660 - RNA, 19 nt, Homo sapiens
caagcuaaaugaaucagau

SEQ ID NO: 492661 - RNA, 19 nt, Homo sapiens
agacaaugaugcuaguuug

SEQ ID NO: 492662 - RNA, 19 nt, Homo sapiens
ggauaaggacaaagagaaa

SEQ ID NO: 492663 - RNA, 19 nt, Homo sapiens
agacuuggagcuuaaauaa

SEQ ID NO: 492664 - RNA, 19 nt, Homo sapiens
aagagaagguuccggaaga

SEQ ID NO: 492665 - RNA, 19 nt, Homo sapiens
gagacaaugaugcuaguuu

SEQ ID NO: 492666 - RNA, 19 nt, Homo sapiens
gcagauugacaacaugaaa

SEQ ID NO: 492667 - RNA, 19 nt, Homo sapiens
ggaagacagcaaagaagaa

SEQ ID NO: 492668 - RNA, 19 nt, Homo sapiens
guagaccugcccuguguua

SEQ ID NO: 492669 - RNA, 19 nt, Homo sapiens
cacagcauauuuagagaaa

SEQ ID NO: 492670 - RNA, 19 nt, Homo sapiens
cgggagaguuugugaguug

SEQ ID NO: 492671 - RNA, 19 nt, Homo sapiens
gccauuugcuuuccuguuc

SEQ ID NO: 492672 - RNA, 19 nt, Homo sapiens
gaugacgugagaucaauaa

SEQ ID NO: 492673 - RNA, 19 nt, Homo sapiens
uaagaagcaggauuguaua

SEQ ID NO: 492674 - RNA, 19 nt, Homo sapiens
caagcggcaggaagaauua

SEQ ID NO: 492675 - RNA, 19 nt, Homo sapiens
uaaagaaugucaggaagag

SEQ ID NO: 492676 - RNA, 19 nt, Homo sapiens
ggcauugcaucugauuuaa

SEQ ID NO: 492677 - RNA, 19 nt, Homo sapiens
uggcauugcaucugauuua

SEQ ID NO: 492678 - RNA, 19 nt, Homo sapiens
gagaguuugugaguugaaa

SEQ ID NO: 492679 - RNA, 19 nt, Homo sapiens
agaagcagauugacaacau

SEQ ID NO: 492680 - RNA, 19 nt, Homo sapiens
agagacagcuacaggacaa

SEQ ID NO: 492681 - RNA, 19 nt, Homo sapiens
gaaacugaacuuauaaucg

SEQ ID NO: 492682 - RNA, 19 nt, Homo sapiens
auaagaagcaggauuguau

SEQ ID NO: 492683 - RNA, 19 nt, Homo sapiens
aggaagaucuggagagaca

SEQ ID NO: 492684 - RNA, 19 nt, Homo sapiens
gcaguacagucuggucaug

SEQ ID NO: 492685 - RNA, 19 nt, Homo sapiens
gagaagggcaguacagucu

SEQ ID NO: 492686 - RNA, 19 nt, Homo sapiens
ggucacagcauauuuagag

SEQ ID NO: 492687 - RNA, 19 nt, Homo sapiens
ggugaaacugaacuuauaa

SEQ ID NO: 492688 - RNA, 19 nt, Homo sapiens
aaugcuguguguucuguua

SEQ ID NO: 492689 - RNA, 19 nt, Homo sapiens
cagaauaugccucuacugu

SEQ ID NO: 492690 - RNA, 19 nt, Homo sapiens
uggaugagcucaaacaaaa

SEQ ID NO: 492691 - RNA, 19 nt, Homo sapiens
gaaaaucaaggccuggaua

SEQ ID NO: 492692 - RNA, 19 nt, Homo sapiens
uaguagaccugcccugugu

SEQ ID NO: 492693 - RNA, 19 nt, Homo sapiens
aaucacuccuagagaagua

SEQ ID NO: 492694 - RNA, 19 nt, Homo sapiens
ggaauucagaagcagauug

SEQ ID NO: 492695 - RNA, 19 nt, Homo sapiens
ggacaagcuaaaugaauca

SEQ ID NO: 492696 - RNA, 19 nt, Homo sapiens
guaaccagcauuuauugga

SEQ ID NO: 492697 - RNA, 19 nt, Homo sapiens
agaaaagacuuggagcuua

SEQ ID NO: 492698 - RNA, 19 nt, Homo sapiens
gaguacagaugcugaagcu

SEQ ID NO: 492699 - RNA, 19 nt, Homo sapiens
ccaagcggcaggaagaauu

SEQ ID NO: 492700 - RNA, 19 nt, Homo sapiens
gacuuggcauugcaucuga

SEQ ID NO: 492701 - RNA, 19 nt, Homo sapiens
gugaauaagccuuuguguu

SEQ ID NO: 492702 - RNA, 19 nt, Homo sapiens
ccuauaagaagcaggauug

SEQ ID NO: 492703 - RNA, 19 nt, Homo sapiens
gaaaggcaagcuccaagag

SEQ ID NO: 492704 - RNA, 19 nt, Homo sapiens
gcuaaaugaaucagaugaa

SEQ ID NO: 492705 - RNA, 19 nt, Homo sapiens
gaccugcccuguguuaugg

SEQ ID NO: 492706 - RNA, 19 nt, Homo sapiens
cagacugacaauugaguua

SEQ ID NO: 492707 - RNA, 19 nt, Homo sapiens
aaggacagacugacaauug

SEQ ID NO: 492708 - RNA, 19 nt, Homo sapiens
gaaacaaaggaggcagaaa

SEQ ID NO: 492709 - RNA, 19 nt, Homo sapiens
gauccuaaagcaagcaaga

SEQ ID NO: 492710 - RNA, 19 nt, Homo sapiens
gaauuaaggaaacgacaag

SEQ ID NO: 492711 - RNA, 19 nt, Homo sapiens
aagaggagcuagaaucacu

SEQ ID NO: 492712 - RNA, 19 nt, Homo sapiens
cagcagcagugaggaugaa

SEQ ID NO: 492713 - RNA, 19 nt, Homo sapiens
gagagccaguuuaucuuac

SEQ ID NO: 492714 - RNA, 19 nt, Homo sapiens
ucacaaggaaauaaagaug

SEQ ID NO: 492715 - RNA, 19 nt, Homo sapiens
agacuggucagcauuagaa

SEQ ID NO: 492716 - RNA, 19 nt, Homo sapiens
guuugugaguugaaaguau

SEQ ID NO: 492717 - RNA, 19 nt, Homo sapiens
aggacagacugacaauuga

SEQ ID NO: 492718 - RNA, 19 nt, Homo sapiens
ucuagaagcugcuguugcu

SEQ ID NO: 492719 - RNA, 19 nt, Homo sapiens
gacaagaggaucucaucau

SEQ ID NO: 492720 - RNA, 19 nt, Homo sapiens
caggaagaauuaaggaaac

SEQ ID NO: 492721 - RNA, 19 nt, Homo sapiens
cuacaggacaagcuaaaug

SEQ ID NO: 492722 - RNA, 19 nt, Homo sapiens
gggagccgccauuugcuuu

SEQ ID NO: 492723 - RNA, 19 nt, Homo sapiens
acaaggaaauaaagaugag

SEQ ID NO: 492724 - RNA, 19 nt, Homo sapiens
ugacgugagaucaauaaga

SEQ ID NO: 492725 - RNA, 19 nt, Homo sapiens
gcaggacuuuacuguuucu

SEQ ID NO: 492726 - RNA, 19 nt, Homo sapiens
gaaaaucuggcucucaaga

SEQ ID NO: 492727 - RNA, 19 nt, Homo sapiens
aggacaagcuaaaugaauc

SEQ ID NO: 492728 - RNA, 19 nt, Homo sapiens
aguaaucgguaguggauca

SEQ ID NO: 492729 - RNA, 19 nt, Homo sapiens
gauaucucuucuccaggaa

SEQ ID NO: 492730 - RNA, 19 nt, Homo sapiens
cuaaagaaugucaggaaga

SEQ ID NO: 492731 - RNA, 19 nt, Homo sapiens
agaugaugcuccucacgaa

SEQ ID NO: 492732 - RNA, 19 nt, Homo sapiens
gcgccucucggcaagauuu

SEQ ID NO: 492733 - RNA, 19 nt, Homo sapiens
gcuuugugaugacgugaga

SEQ ID NO: 492734 - RNA, 19 nt, Homo sapiens
uauaagaagcaggauugua

SEQ ID NO: 492735 - RNA, 19 nt, Homo sapiens
auucuuggcuuuauuguac

SEQ ID NO: 492736 - RNA, 19 nt, Homo sapiens
gcugaaaucuuuacagaaa

SEQ ID NO: 492737 - RNA, 19 nt, Homo sapiens
ggacugaaauacauuaaug

SEQ ID NO: 492738 - RNA, 19 nt, Homo sapiens
gaauaugagccaagaguua

SEQ ID NO: 492739 - RNA, 19 nt, Homo sapiens
uaagaaagcuacuguugau

SEQ ID NO: 492740 - RNA, 19 nt, Homo sapiens
uaaaucagauguuggaguu

SEQ ID NO: 492741 - RNA, 19 nt, Homo sapiens
ggucaaagguuuacaguac

SEQ ID NO: 492742 - RNA, 19 nt, Homo sapiens
gaagucugaucaucggaua

SEQ ID NO: 492743 - RNA, 19 nt, Homo sapiens
acuauaggcugaaaucuuu

SEQ ID NO: 492744 - RNA, 19 nt, Homo sapiens
cuuaacagcuccaaacuau

SEQ ID NO: 492745 - RNA, 19 nt, Homo sapiens
ccucacaggucaaagguuu

SEQ ID NO: 492746 - RNA, 19 nt, Homo sapiens
ccugauagauacugcuuaa

SEQ ID NO: 492747 - RNA, 19 nt, Homo sapiens
ccaagagcaugccgaaaga

SEQ ID NO: 492748 - RNA, 19 nt, Homo sapiens
gccgaaagaugcacagaug

SEQ ID NO: 492749 - RNA, 19 nt, Homo sapiens
ccaugucuguuucaacuaa

SEQ ID NO: 492750 - RNA, 19 nt, Homo sapiens
aaacacaguuaccauacuu

SEQ ID NO: 492751 - RNA, 19 nt, Homo sapiens
ugauuuagcucgagaaguc

SEQ ID NO: 492752 - RNA, 19 nt, Homo sapiens
gaugaugacuaugauaauc

SEQ ID NO: 492753 - RNA, 19 nt, Homo sapiens
uaacagcuccaaacuauag

SEQ ID NO: 492754 - RNA, 19 nt, Homo sapiens
gcaaggcaaagaaaucaaa

SEQ ID NO: 492755 - RNA, 19 nt, Homo sapiens
gaaagcuacuguugaugca

SEQ ID NO: 492756 - RNA, 19 nt, Homo sapiens
ggaguuugccuuccgauau

SEQ ID NO: 492757 - RNA, 19 nt, Homo sapiens
gaccaugucuguuucaacu

SEQ ID NO: 492758 - RNA, 19 nt, Homo sapiens
gcuaagaaagcuacuguug

SEQ ID NO: 492759 - RNA, 19 nt, Homo sapiens
gcacagaugauggcacaaa

SEQ ID NO: 492760 - RNA, 19 nt, Homo sapiens
ugaccacaauucuagauga

SEQ ID NO: 492761 - RNA, 19 nt, Homo sapiens
gaguuugccuuccgauaug

SEQ ID NO: 492762 - RNA, 19 nt, Homo sapiens
ccucagcaguucagaaugu

SEQ ID NO: 492763 - RNA, 19 nt, Homo sapiens
gauagauacugcuuaacag

SEQ ID NO: 492764 - RNA, 19 nt, Homo sapiens
gagccaagaguuauaaauc

SEQ ID NO: 492765 - RNA, 19 nt, Homo sapiens
gaaagaugcacagaugaug

SEQ ID NO: 492766 - RNA, 19 nt, Homo sapiens
aaucuagccuugcugaaug

SEQ ID NO: 492767 - RNA, 19 nt, Homo sapiens
gcgguuaaguguugguuca

SEQ ID NO: 492768 - RNA, 19 nt, Homo sapiens
gaucaucggauaucaugga

SEQ ID NO: 492769 - RNA, 19 nt, Homo sapiens
gugaagaugaugaugauga

SEQ ID NO: 492770 - RNA, 19 nt, Homo sapiens
gaccacaauucuagaugau

SEQ ID NO: 492771 - RNA, 19 nt, Homo sapiens
gaaaagaaaacgugaagau

SEQ ID NO: 492772 - RNA, 19 nt, Homo sapiens
guuaaguguugguucaguu

SEQ ID NO: 492773 - RNA, 19 nt, Homo sapiens
cuaagaaagcuacuguuga

SEQ ID NO: 492774 - RNA, 19 nt, Homo sapiens
aaucagauguuggaguuug

SEQ ID NO: 492775 - RNA, 19 nt, Homo sapiens
aggcugaaaucuuuacaga

SEQ ID NO: 492776 - RNA, 19 nt, Homo sapiens
caaacuauaggcugaaauc

SEQ ID NO: 492777 - RNA, 19 nt, Homo sapiens
gaugaugaugacuaugaua

SEQ ID NO: 492778 - RNA, 19 nt, Homo sapiens
ugacgaugaugaugaugau

SEQ ID NO: 492779 - RNA, 19 nt, Homo sapiens
ugaugaugaugaugacuau

SEQ ID NO: 492780 - RNA, 19 nt, Homo sapiens
ugccauugaucaagccaua

SEQ ID NO: 492781 - RNA, 19 nt, Homo sapiens
ugaaucaucaaaugcauug

SEQ ID NO: 492782 - RNA, 19 nt, Homo sapiens
guacagaugccuacuucuc

SEQ ID NO: 492783 - RNA, 19 nt, Homo sapiens
aaaccacacuaggcaaaga

SEQ ID NO: 492784 - RNA, 19 nt, Homo sapiens
gcuuaacagcuccaaacua

SEQ ID NO: 492785 - RNA, 19 nt, Homo sapiens
ugauagauacugcuuaaca

SEQ ID NO: 492786 - RNA, 19 nt, Homo sapiens
agccaagaguuauaaauca

SEQ ID NO: 492787 - RNA, 19 nt, Homo sapiens
cgaaagaugcacagaugau

SEQ ID NO: 492788 - RNA, 19 nt, Homo sapiens
uaaacacaguuaccauacu

SEQ ID NO: 492789 - RNA, 19 nt, Homo sapiens
ugaugacgaugaugaugau

SEQ ID NO: 492790 - RNA, 19 nt, Homo sapiens
uuaaguguugguucaguua

SEQ ID NO: 492791 - RNA, 19 nt, Homo sapiens
uaaugugggugauuuagcu

SEQ ID NO: 492792 - RNA, 19 nt, Homo sapiens
caaagaacuugcgucaaaa

SEQ ID NO: 492793 - RNA, 19 nt, Homo sapiens
gguugccaccugauagaua

SEQ ID NO: 492794 - RNA, 19 nt, Homo sapiens
gccaagaguuauaaaucag

SEQ ID NO: 492795 - RNA, 19 nt, Homo sapiens
aaagaaaacgugaagauga

SEQ ID NO: 492796 - RNA, 19 nt, Homo sapiens
ccaaguacucccacacuag

SEQ ID NO: 492797 - RNA, 19 nt, Homo sapiens
ccauugaucaagccauauu

SEQ ID NO: 492798 - RNA, 19 nt, Homo sapiens
cacagaugauggcacaaau

SEQ ID NO: 492799 - RNA, 19 nt, Homo sapiens
uacagaauaugagccaaga

SEQ ID NO: 492800 - RNA, 19 nt, Homo sapiens
gucaaagguuuacaguaca

SEQ ID NO: 492801 - RNA, 19 nt, Homo sapiens
uucaagccaugcuaagaaa

SEQ ID NO: 492802 - RNA, 19 nt, Homo sapiens
acaaaauacugccaaugaa

SEQ ID NO: 492803 - RNA, 19 nt, Homo sapiens
cauuaaugugggugauuua

SEQ ID NO: 492804 - RNA, 19 nt, Homo sapiens
ccaagaguuauaaaucaga

SEQ ID NO: 492805 - RNA, 19 nt, Homo sapiens
cagaauaugagccaagagu

SEQ ID NO: 492806 - RNA, 19 nt, Homo sapiens
uaaucuagccuugcugaau

SEQ ID NO: 492807 - RNA, 19 nt, Homo sapiens
ugaagaugaugaugaugac

SEQ ID NO: 492808 - RNA, 19 nt, Homo sapiens
gaacuugcgucaaaaucag

SEQ ID NO: 492809 - RNA, 19 nt, Homo sapiens
ucaaagguuuacaguacag

SEQ ID NO: 492810 - RNA, 19 nt, Homo sapiens
ugaugacuaugauaaucug

SEQ ID NO: 492811 - RNA, 19 nt, Homo sapiens
ugaugaugaugacuaugau

SEQ ID NO: 492812 - RNA, 19 nt, Homo sapiens
caaccucagcaguucagaa

SEQ ID NO: 492813 - RNA, 19 nt, Homo sapiens
accaaguacucccacacua

SEQ ID NO: 492814 - RNA, 19 nt, Homo sapiens
uaugagccaagaguuauaa

SEQ ID NO: 492815 - RNA, 19 nt, Homo sapiens
cacaaaauacugccaauga

SEQ ID NO: 492816 - RNA, 19 nt, Homo sapiens
caucauuaaucggguccaa

SEQ ID NO: 492817 - RNA, 19 nt, Homo sapiens
caugucuguuucaacuaaa

SEQ ID NO: 492818 - RNA, 19 nt, Homo sapiens
guugccaccugauagauac

SEQ ID NO: 492819 - RNA, 19 nt, Homo sapiens
aauaugagccaagaguuau

SEQ ID NO: 492820 - RNA, 19 nt, Homo sapiens
gaugaugacgaugaugaug

SEQ ID NO: 492821 - RNA, 19 nt, Homo sapiens
aaauacugccaaugaauca

SEQ ID NO: 492822 - RNA, 19 nt, Homo sapiens
ugaugaugaugacgaugau

SEQ ID NO: 492823 - RNA, 19 nt, Homo sapiens
gaaaacgugaagaugauga

SEQ ID NO: 492824 - RNA, 19 nt, Homo sapiens
aaaguugucauucauucga

SEQ ID NO: 492825 - RNA, 19 nt, Homo sapiens
cccaagagcaugccgaaag

SEQ ID NO: 492826 - RNA, 19 nt, Homo sapiens
gguuaaguguugguucagu

SEQ ID NO: 492827 - RNA, 19 nt, Homo sapiens
cauauucagguccuagguu

SEQ ID NO: 492828 - RNA, 19 nt, Homo sapiens
gcagaugaugugcgauugg

SEQ ID NO: 492829 - RNA, 19 nt, Homo sapiens
acacuaggcaaagaacuug

SEQ ID NO: 492830 - RNA, 19 nt, Homo sapiens
uguaacauguauacuuggu

SEQ ID NO: 492831 - RNA, 19 nt, Homo sapiens
acgaugaugaugaugauga

SEQ ID NO: 492832 - RNA, 19 nt, Homo sapiens
acgugaagaugaugaugau

SEQ ID NO: 492833 - RNA, 19 nt, Homo sapiens
caaaauacugccaaugaau

SEQ ID NO: 492834 - RNA, 19 nt, Homo sapiens
gaugccuacuucucagucu

SEQ ID NO: 492835 - RNA, 19 nt, Homo sapiens
uacagaugccuacuucuca

SEQ ID NO: 492836 - RNA, 19 nt, Homo sapiens
gaucauaacucuugacuua

SEQ ID NO: 492837 - RNA, 19 nt, Homo sapiens
gagagaagguggaguuauu

SEQ ID NO: 492838 - RNA, 19 nt, Homo sapiens
cagaguaguugaugaguua

SEQ ID NO: 492839 - RNA, 19 nt, Homo sapiens
ggacugaaauacauuaaug

SEQ ID NO: 492840 - RNA, 19 nt, Homo sapiens
gaagagcaauuguaugaug

SEQ ID NO: 492841 - RNA, 19 nt, Homo sapiens
gagaacagauaccaaugua

SEQ ID NO: 492842 - RNA, 19 nt, Homo sapiens
gagaagagcaauuguauga

SEQ ID NO: 492843 - RNA, 19 nt, Homo sapiens
ugagaaagcuaaacaugaa

SEQ ID NO: 492844 - RNA, 19 nt, Homo sapiens
gaguaugacugucccauuu

SEQ ID NO: 492845 - RNA, 19 nt, Homo sapiens
gcaauuguaugauggcuau

SEQ ID NO: 492846 - RNA, 19 nt, Homo sapiens
cagaagagcuagaaaauaa

SEQ ID NO: 492847 - RNA, 19 nt, Homo sapiens
gaacgcugguuucauauag

SEQ ID NO: 492848 - RNA, 19 nt, Homo sapiens
gcagguggauaguauauag

SEQ ID NO: 492849 - RNA, 19 nt, Homo sapiens
aaggcuagcuacuuaauaa

SEQ ID NO: 492850 - RNA, 19 nt, Homo sapiens
guggaguuauuguugauua

SEQ ID NO: 492851 - RNA, 19 nt, Homo sapiens
gaagguggaguuauuguug

SEQ ID NO: 492852 - RNA, 19 nt, Homo sapiens
cagacaauauucaguguga

SEQ ID NO: 492853 - RNA, 19 nt, Homo sapiens
caucagcugcccaguaaua

SEQ ID NO: 492854 - RNA, 19 nt, Homo sapiens
gagaagaaacuaacagaca

SEQ ID NO: 492855 - RNA, 19 nt, Homo sapiens
agaagaaacuaacagacaa

SEQ ID NO: 492856 - RNA, 19 nt, Homo sapiens
cauagaaauuguucaagug

SEQ ID NO: 492857 - RNA, 19 nt, Homo sapiens
gcuagcuacuuaauaauca

SEQ ID NO: 492858 - RNA, 19 nt, Homo sapiens
ugauuuagcucgagaagag

SEQ ID NO: 492859 - RNA, 19 nt, Homo sapiens
uaauaaaccagaagagcua

SEQ ID NO: 492860 - RNA, 19 nt, Homo sapiens
ugcaucagcugcccaguaa

SEQ ID NO: 492861 - RNA, 19 nt, Homo sapiens
gaagacagaguaguugaug

SEQ ID NO: 492862 - RNA, 19 nt, Homo sapiens
caaaauggguggauaucuu

SEQ ID NO: 492863 - RNA, 19 nt, Homo sapiens
agaaauuguucaaguguca

SEQ ID NO: 492864 - RNA, 19 nt, Homo sapiens
gaagaaacuaacagacaau

SEQ ID NO: 492865 - RNA, 19 nt, Homo sapiens
guacgaaagacuugaaaca

SEQ ID NO: 492866 - RNA, 19 nt, Homo sapiens
aggaagaaaucgugcauca

SEQ ID NO: 492867 - RNA, 19 nt, Homo sapiens
gcuaugaugaagaguauga

SEQ ID NO: 492868 - RNA, 19 nt, Homo sapiens
ugauaucucugccgacauc

SEQ ID NO: 492869 - RNA, 19 nt, Homo sapiens
gaaacaagggguuauaaug

SEQ ID NO: 492870 - RNA, 19 nt, Homo sapiens
ugacuuauaaggcuagcua

SEQ ID NO: 492871 - RNA, 19 nt, Homo sapiens
guaugacugucccauuuua

SEQ ID NO: 492872 - RNA, 19 nt, Homo sapiens
guggauaguauauagguuu

SEQ ID NO: 492873 - RNA, 19 nt, Homo sapiens
gaugaagacagaguaguug

SEQ ID NO: 492874 - RNA, 19 nt, Homo sapiens
gcugagaacagauaccaau

SEQ ID NO: 492875 - RNA, 19 nt, Homo sapiens
gagaaagcuaaacaugaaa

SEQ ID NO: 492876 - RNA, 19 nt, Homo sapiens
aaaccacacuaggcaaaga

SEQ ID NO: 492877 - RNA, 19 nt, Homo sapiens
uaucucugccgacaucaua

SEQ ID NO: 492878 - RNA, 19 nt, Homo sapiens
gacaauauucagugugaga

SEQ ID NO: 492879 - RNA, 19 nt, Homo sapiens
acagaguaguugaugaguu

SEQ ID NO: 492880 - RNA, 19 nt, Homo sapiens
uggcuaugaugaagaguau

SEQ ID NO: 492881 - RNA, 19 nt, Homo sapiens
gugcaucagcugcccagua

SEQ ID NO: 492882 - RNA, 19 nt, Homo sapiens
cgacaucauagaaauuguu

SEQ ID NO: 492883 - RNA, 19 nt, Homo sapiens
uaaugugggugauuuagcu

SEQ ID NO: 492884 - RNA, 19 nt, Homo sapiens
caaagaacuugcgucaaaa

SEQ ID NO: 492885 - RNA, 19 nt, Homo sapiens
aaacaagggguuauaauga

SEQ ID NO: 492886 - RNA, 19 nt, Homo sapiens
gcccaguaauaaaccagaa

SEQ ID NO: 492887 - RNA, 19 nt, Homo sapiens
ucgagaagagcaauuguau

SEQ ID NO: 492888 - RNA, 19 nt, Homo sapiens
aagguggaguuauuguuga

SEQ ID NO: 492889 - RNA, 19 nt, Homo sapiens
uagauaaccaaaugagaga

SEQ ID NO: 492890 - RNA, 19 nt, Homo sapiens
guaguugaugaguuagaua

SEQ ID NO: 492891 - RNA, 19 nt, Homo sapiens
uaugauggcuaugaugaag

SEQ ID NO: 492892 - RNA, 19 nt, Homo sapiens
gagaagguggaguuauugu

SEQ ID NO: 492893 - RNA, 19 nt, Homo sapiens
caauauucagugugagauu

SEQ ID NO: 492894 - RNA, 19 nt, Homo sapiens
ugagaacagauaccaaugu

SEQ ID NO: 492895 - RNA, 19 nt, Homo sapiens
uuaccaugguugugauuuc

SEQ ID NO: 492896 - RNA, 19 nt, Homo sapiens
gguggauaguauauagguu

SEQ ID NO: 492897 - RNA, 19 nt, Homo sapiens
cagcagguggauaguauau

SEQ ID NO: 492898 - RNA, 19 nt, Homo sapiens
cauuaaugugggugauuua

SEQ ID NO: 492899 - RNA, 19 nt, Homo sapiens
ccaugguugugauuucuuc

SEQ ID NO: 492900 - RNA, 19 nt, Homo sapiens
uguaugauggcuaugauga

SEQ ID NO: 492901 - RNA, 19 nt, Homo sapiens
gccgacaucauagaaauug

SEQ ID NO: 492902 - RNA, 19 nt, Homo sapiens
gaacuugcgucaaaaucag

SEQ ID NO: 492903 - RNA, 19 nt, Homo sapiens
acgcugguuucauauaguu

SEQ ID NO: 492904 - RNA, 19 nt, Homo sapiens
guuuaugccuguguuucuu

SEQ ID NO: 492905 - RNA, 19 nt, Homo sapiens
accagcagguggauaguau

SEQ ID NO: 492906 - RNA, 19 nt, Homo sapiens
gaagagcuagaaaauaaug

SEQ ID NO: 492907 - RNA, 19 nt, Homo sapiens
uaaaccagaagagcuagaa

SEQ ID NO: 492908 - RNA, 19 nt, Homo sapiens
agaugaagacagaguaguu

SEQ ID NO: 492909 - RNA, 19 nt, Homo sapiens
ccaguaauaaaccagaaga

SEQ ID NO: 492910 - RNA, 19 nt, Homo sapiens
cauuuuagaugaagacaga

SEQ ID NO: 492911 - RNA, 19 nt, Homo sapiens
aaugagagaagguggaguu

SEQ ID NO: 492912 - RNA, 19 nt, Homo sapiens
gauaaccaaaugagagaag

SEQ ID NO: 492913 - RNA, 19 nt, Homo sapiens
aagacagaguaguugauga

SEQ ID NO: 492914 - RNA, 19 nt, Homo sapiens
guaugauggcuaugaugaa

SEQ ID NO: 492915 - RNA, 19 nt, Homo sapiens
cugccgacaucauagaaau

SEQ ID NO: 492916 - RNA, 19 nt, Homo sapiens
ugaugaagaguaugacugu

SEQ ID NO: 492917 - RNA, 19 nt, Homo sapiens
ggguuauaaugagaagaaa

SEQ ID NO: 492918 - RNA, 19 nt, Homo sapiens
gaguuauuguugauuacca

SEQ ID NO: 492919 - RNA, 19 nt, Homo sapiens
ugauggcuaugaugaagag

SEQ ID NO: 492920 - RNA, 19 nt, Homo sapiens
uacgaaagacuugaaacaa

SEQ ID NO: 492921 - RNA, 19 nt, Homo sapiens
gacaucauagaaauuguuc

SEQ ID NO: 492922 - RNA, 19 nt, Homo sapiens
cgagaagagcaauuguaug

SEQ ID NO: 492923 - RNA, 19 nt, Homo sapiens
caaggaagaaaucgugcau

SEQ ID NO: 492924 - RNA, 19 nt, Homo sapiens
augagaaagcuaaacauga

SEQ ID NO: 492925 - RNA, 19 nt, Homo sapiens
ccagaagagcuagaaaaua

SEQ ID NO: 492926 - RNA, 19 nt, Homo sapiens
ucagcugcccaguaauaaa

SEQ ID NO: 492927 - RNA, 19 nt, Homo sapiens
acacuaggcaaagaacuug

SEQ ID NO: 492928 - RNA, 19 nt, Homo sapiens
ccagcagguggauaguaua

SEQ ID NO: 492929 - RNA, 19 nt, Homo sapiens
ugauuaccaugguugugau

SEQ ID NO: 492930 - RNA, 19 nt, Homo sapiens
ugaugcagcuggaagauua

SEQ ID NO: 492931 - RNA, 19 nt, Homo sapiens
caaccuaaauguacuuauc

SEQ ID NO: 492932 - RNA, 19 nt, Homo sapiens
ugaagaagccgcacuacuu

SEQ ID NO: 492933 - RNA, 19 nt, Homo sapiens
gaccgcaaguacacucuaa

SEQ ID NO: 492934 - RNA, 19 nt, Homo sapiens
gaguauggcaucaauguga

SEQ ID NO: 492935 - RNA, 19 nt, Homo sapiens
gaaccgugcuggcuuugag

SEQ ID NO: 492936 - RNA, 19 nt, Homo sapiens
cuacagcacugcaaaauga

SEQ ID NO: 492937 - RNA, 19 nt, Homo sapiens
cuccuuagcugcccagaaa

SEQ ID NO: 492938 - RNA, 19 nt, Homo sapiens
gcaaguacacucuaaccau

SEQ ID NO: 492939 - RNA, 19 nt, Homo sapiens
uaauucggcucaucuccuu

SEQ ID NO: 492940 - RNA, 19 nt, Homo sapiens
gaagauuacacgccuacga

SEQ ID NO: 492941 - RNA, 19 nt, Homo sapiens
gagcaaggaccgcaaguac

SEQ ID NO: 492942 - RNA, 19 nt, Homo sapiens
cagcgaguauggcaucaau

SEQ ID NO: 492943 - RNA, 19 nt, Homo sapiens
gcgaguauggcaucaaugu

SEQ ID NO: 492944 - RNA, 19 nt, Homo sapiens
ccugaaccgugcuggcuuu

SEQ ID NO: 492945 - RNA, 19 nt, Homo sapiens
gaucccagaugcagugacu

SEQ ID NO: 492946 - RNA, 19 nt, Homo sapiens
gcaaggaccgcaaguacac

SEQ ID NO: 492947 - RNA, 19 nt, Homo sapiens
ggccucagacccacgcaua

SEQ ID NO: 492948 - RNA, 19 nt, Homo sapiens
acaccagccuguuuucaua

SEQ ID NO: 492949 - RNA, 19 nt, Homo sapiens
cccagaaauucaucucaga

SEQ ID NO: 492950 - RNA, 19 nt, Homo sapiens
ccacccaaccuaaauguac

SEQ ID NO: 492951 - RNA, 19 nt, Homo sapiens
ggaccgcaaguacacucua

SEQ ID NO: 492952 - RNA, 19 nt, Homo sapiens
gagccacccaaccuaaaug

SEQ ID NO: 492953 - RNA, 19 nt, Homo sapiens
cagccuguuuucauaauaa

SEQ ID NO: 492954 - RNA, 19 nt, Homo sapiens
ucagacccacgcauaauuc

SEQ ID NO: 492955 - RNA, 19 nt, Homo sapiens
aguauggcaucaaugugaa

SEQ ID NO: 492956 - RNA, 19 nt, Homo sapiens
ccugagccacccaaccuaa

SEQ ID NO: 492957 - RNA, 19 nt, Homo sapiens
ccuuagcugcccagaaauu

SEQ ID NO: 492958 - RNA, 19 nt, Homo sapiens
uaacgggguuuacguacug

SEQ ID NO: 492959 - RNA, 19 nt, Homo sapiens
agacuuagguuguuucuua

SEQ ID NO: 492960 - RNA, 19 nt, Homo sapiens
gaaaguauguagccugauu

SEQ ID NO: 492961 - RNA, 19 nt, Homo sapiens
gaagacucaucauuacuua

SEQ ID NO: 492962 - RNA, 19 nt, Homo sapiens
gaagauacgugggccauaa

SEQ ID NO: 492963 - RNA, 19 nt, Homo sapiens
gaaaguagaugaagaugag

SEQ ID NO: 492964 - RNA, 19 nt, Homo sapiens
guauguagccugauugaua

SEQ ID NO: 492965 - RNA, 19 nt, Homo sapiens
cgacaaagguggagagaca

SEQ ID NO: 492966 - RNA, 19 nt, Homo sapiens
ggaagccguuagaagguua

SEQ ID NO: 492967 - RNA, 19 nt, Homo sapiens
gaaccguuaugaaauguau

SEQ ID NO: 492968 - RNA, 19 nt, Homo sapiens
gagauagggucuugcucua

SEQ ID NO: 492969 - RNA, 19 nt, Homo sapiens
gugcccagcuaacuuauuu

SEQ ID NO: 492970 - RNA, 19 nt, Homo sapiens
gcugaaccguuaugaaaug

SEQ ID NO: 492971 - RNA, 19 nt, Homo sapiens
caggaugucucagauuuaa

SEQ ID NO: 492972 - RNA, 19 nt, Homo sapiens
ugaaacaaccagaaacuuu

SEQ ID NO: 492973 - RNA, 19 nt, Homo sapiens
gccgagggcuuuaaugguu

SEQ ID NO: 492974 - RNA, 19 nt, Homo sapiens
gaacugcuuucagagagaa

SEQ ID NO: 492975 - RNA, 19 nt, Homo sapiens
aggagcagcugaaccguua

SEQ ID NO: 492976 - RNA, 19 nt, Homo sapiens
ggaagacucaucauuacuu

SEQ ID NO: 492977 - RNA, 19 nt, Homo sapiens
cagcugaaccguuaugaaa

SEQ ID NO: 492978 - RNA, 19 nt, Homo sapiens
gaagaugagauucagaaga

SEQ ID NO: 492979 - RNA, 19 nt, Homo sapiens
gucaggaugucucagauuu

SEQ ID NO: 492980 - RNA, 19 nt, Homo sapiens
aggaauagcagaauaauug

SEQ ID NO: 492981 - RNA, 19 nt, Homo sapiens
guuagaagguuaaagucaa

SEQ ID NO: 492982 - RNA, 19 nt, Homo sapiens
ccacuacaacccaaacaua

SEQ ID NO: 492983 - RNA, 19 nt, Homo sapiens
aagaugagauucagaagau

SEQ ID NO: 492984 - RNA, 19 nt, Homo sapiens
gauguggacuugaaagaag

SEQ ID NO: 492985 - RNA, 19 nt, Homo sapiens
gcagaaaguagaugaagau

SEQ ID NO: 492986 - RNA, 19 nt, Homo sapiens
aagggaagacucaucauua

SEQ ID NO: 492987 - RNA, 19 nt, Homo sapiens
auacuugccuugacuaaau

SEQ ID NO: 492988 - RNA, 19 nt, Homo sapiens
gaauaauuggugcuuguaa

SEQ ID NO: 492989 - RNA, 19 nt, Homo sapiens
ggaacugcuuucagagaga

SEQ ID NO: 492990 - RNA, 19 nt, Homo sapiens
cagaauaauuggugcuugu

SEQ ID NO: 492991 - RNA, 19 nt, Homo sapiens
uggcaggaauagcagaaua

SEQ ID NO: 492992 - RNA, 19 nt, Homo sapiens
ugucacaccuagaaaguau

SEQ ID NO: 492993 - RNA, 19 nt, Homo sapiens
ggagaaaugccaccacuac

SEQ ID NO: 492994 - RNA, 19 nt, Homo sapiens
caugaaggaugcgguaaug

SEQ ID NO: 492995 - RNA, 19 nt, Homo sapiens
gaaacaaccagaaacuuuu

SEQ ID NO: 492996 - RNA, 19 nt, Homo sapiens
cuacaacccaaacauauga

SEQ ID NO: 492997 - RNA, 19 nt, Homo sapiens
gguaauggcaggaauagca

SEQ ID NO: 492998 - RNA, 19 nt, Homo sapiens
ggacuacaggcacacacua

SEQ ID NO: 492999 - RNA, 19 nt, Homo sapiens
aagauucuccuguggauuu

SEQ ID NO: 493000 - RNA, 19 nt, Homo sapiens
acacuacugugcccagcua

SEQ ID NO: 493001 - RNA, 19 nt, Homo sapiens
gggaagccguuagaagguu

SEQ ID NO: 493002 - RNA, 19 nt, Homo sapiens
gaagaugcaaauccugguu

SEQ ID NO: 493003 - RNA, 19 nt, Homo sapiens
ggugagugaucauuaaacu

SEQ ID NO: 493004 - RNA, 19 nt, Homo sapiens
acgcagauguggacuugaa

SEQ ID NO: 493005 - RNA, 19 nt, Homo sapiens
gaaaugccaccacuacaac

SEQ ID NO: 493006 - RNA, 19 nt, Homo sapiens
gaagaagcacuggaugugu

SEQ ID NO: 493007 - RNA, 19 nt, Homo sapiens
gauggaaucccagaggaaa

SEQ ID NO: 493008 - RNA, 19 nt, Homo sapiens
agacgcagauguggacuug

SEQ ID NO: 493009 - RNA, 19 nt, Homo sapiens
gaauguuguuauugcuaug

SEQ ID NO: 493010 - RNA, 19 nt, Homo sapiens
ugucucagauuuaacaaca

SEQ ID NO: 493011 - RNA, 19 nt, Homo sapiens
ugagugaucauuaaacugu

SEQ ID NO: 493012 - RNA, 19 nt, Homo sapiens
ugaaagggaagacucauca

SEQ ID NO: 493013 - RNA, 19 nt, Homo sapiens
ggaugucucagauuuaaca

SEQ ID NO: 493014 - RNA, 19 nt, Homo sapiens
ggcaggaauagcagaauaa

SEQ ID NO: 493015 - RNA, 19 nt, Homo sapiens
guagaugaaacaaccagaa

SEQ ID NO: 493016 - RNA, 19 nt, Homo sapiens
gaacuccugggcuuaagug

SEQ ID NO: 493017 - RNA, 19 nt, Homo sapiens
guagccugauugauacuug

SEQ ID NO: 493018 - RNA, 19 nt, Homo sapiens
ucaggaugucucagauuua

SEQ ID NO: 493019 - RNA, 19 nt, Homo sapiens
gacuuagguuguuucuuau

SEQ ID NO: 493020 - RNA, 19 nt, Homo sapiens
uauguagccugauugauac

SEQ ID NO: 493021 - RNA, 19 nt, Homo sapiens
gguuccagacuuccuauaa

SEQ ID NO: 493022 - RNA, 19 nt, Homo sapiens
aaggcgagcucgagaguca

SEQ ID NO: 493023 - RNA, 19 nt, Homo sapiens
gagauggggucuugcuuug

SEQ ID NO: 493024 - RNA, 19 nt, Homo sapiens
gacggaagaaguauugguu

SEQ ID NO: 493025 - RNA, 19 nt, Homo sapiens
agaaaugccaccacuacaa

SEQ ID NO: 493026 - RNA, 19 nt, Homo sapiens
ucugguauuuccaagguuu

SEQ ID NO: 493027 - RNA, 19 nt, Homo sapiens
aaagggaagacucaucauu

SEQ ID NO: 493028 - RNA, 19 nt, Homo sapiens
gauacucuaccaugaagga

SEQ ID NO: 493029 - RNA, 19 nt, Homo sapiens
gugauacucuaccaugaag

SEQ ID NO: 493030 - RNA, 19 nt, Homo sapiens
gaugaaacaaccagaaacu

SEQ ID NO: 493031 - RNA, 19 nt, Homo sapiens
uagaugaaacaaccagaaa

SEQ ID NO: 493032 - RNA, 19 nt, Homo sapiens
gggcuuuaaugguuucaca

SEQ ID NO: 493033 - RNA, 19 nt, Homo sapiens
ccgagggcuuuaaugguuu

SEQ ID NO: 493034 - RNA, 19 nt, Homo sapiens
caaaaggacagaucccuaa

SEQ ID NO: 493035 - RNA, 19 nt, Homo sapiens
ugacggagacgcagaugug

SEQ ID NO: 493036 - RNA, 19 nt, Homo sapiens
guuccagacuuccuauaag

SEQ ID NO: 493037 - RNA, 19 nt, Homo sapiens
ccgcucagcuuucccuaag

SEQ ID NO: 493038 - RNA, 19 nt, Homo sapiens
uuuggugagugaucauuaa

SEQ ID NO: 493039 - RNA, 19 nt, Homo sapiens
ggaaggcgagcucgagagu

SEQ ID NO: 493040 - RNA, 19 nt, Homo sapiens
cuccaaggauuccaugaug

SEQ ID NO: 493041 - RNA, 19 nt, Homo sapiens
gguagaagaagcacuggau

SEQ ID NO: 493042 - RNA, 19 nt, Homo sapiens
gcagcugaaccguuaugaa

SEQ ID NO: 493043 - RNA, 19 nt, Homo sapiens
gagugaucauuaaacuguu

SEQ ID NO: 493044 - RNA, 19 nt, Homo sapiens
uuaagauucuccuguggau

SEQ ID NO: 493045 - RNA, 19 nt, Homo sapiens
gcaggaauagcagaauaau

SEQ ID NO: 493046 - RNA, 19 nt, Homo sapiens
gauggggucuugcuuuguu

SEQ ID NO: 493047 - RNA, 19 nt, Homo sapiens
gagaaaugccaccacuaca

SEQ ID NO: 493048 - RNA, 19 nt, Homo sapiens
gcacuggaugugugugaga

SEQ ID NO: 493049 - RNA, 19 nt, Homo sapiens
cagaaacuuuuacuuguga

SEQ ID NO: 493050 - RNA, 19 nt, Homo sapiens
gagucaggaugucucagau

SEQ ID NO: 493051 - RNA, 19 nt, Homo sapiens
gauacuugccuugacuaaa

SEQ ID NO: 493052 - RNA, 19 nt, Homo sapiens
uuccagacuuccuauaaga

SEQ ID NO: 493053 - RNA, 19 nt, Homo sapiens
gacagaucccuaacucgaa

SEQ ID NO: 493054 - RNA, 19 nt, Homo sapiens
cauaugagggaagccguua

SEQ ID NO: 493055 - RNA, 19 nt, Homo sapiens
aaauccugguuucuucuuu

SEQ ID NO: 493056 - RNA, 19 nt, Homo sapiens
uccaaggauuccaugauga

SEQ ID NO: 493057 - RNA, 19 nt, Homo sapiens
cagaauguuguuauugcua

SEQ ID NO: 493058 - RNA, 19 nt, Homo sapiens
ugcaaauccugguuucuuc

SEQ ID NO: 493059 - RNA, 19 nt, Homo sapiens
gaaauuacaggacuuagua

SEQ ID NO: 493060 - RNA, 19 nt, Homo sapiens
gcagcaauaucuauaauga

SEQ ID NO: 493061 - RNA, 19 nt, Homo sapiens
gauagacgcugcugccuuu

SEQ ID NO: 493062 - RNA, 19 nt, Homo sapiens
uaagagaaguggauccuaa

SEQ ID NO: 493063 - RNA, 19 nt, Homo sapiens
uaaucaaccucuccaauuu

SEQ ID NO: 493064 - RNA, 19 nt, Homo sapiens
ggacagcaauguauuugga

SEQ ID NO: 493065 - RNA, 19 nt, Homo sapiens
caauguaucuuccagagaa

SEQ ID NO: 493066 - RNA, 19 nt, Homo sapiens
gaagaaauuacaggacuua

SEQ ID NO: 493067 - RNA, 19 nt, Homo sapiens
gaaacaggaucucgauaag

SEQ ID NO: 493068 - RNA, 19 nt, Homo sapiens
gcagauugcugaugauuuu

SEQ ID NO: 493069 - RNA, 19 nt, Homo sapiens
caauaguacugcaguggua

SEQ ID NO: 493070 - RNA, 19 nt, Homo sapiens
gaagaaauccgacccuaca

SEQ ID NO: 493071 - RNA, 19 nt, Homo sapiens
gcaguuggaugaagaugug

SEQ ID NO: 493072 - RNA, 19 nt, Homo sapiens
ggaaaacaaccaagaaaua

SEQ ID NO: 493073 - RNA, 19 nt, Homo sapiens
ggaauggacagcaauguau

SEQ ID NO: 493074 - RNA, 19 nt, Homo sapiens
gagaggaucugccaaaaga

SEQ ID NO: 493075 - RNA, 19 nt, Homo sapiens
ggagauacuugagcugaga

SEQ ID NO: 493076 - RNA, 19 nt, Homo sapiens
guacugcagugguaaagau

SEQ ID NO: 493077 - RNA, 19 nt, Homo sapiens
guccaaagcucggcagauu

SEQ ID NO: 493078 - RNA, 19 nt, Homo sapiens
cuaaugagcaguuggauga

SEQ ID NO: 493079 - RNA, 19 nt, Homo sapiens
ucuaugagcugaaguccaa

SEQ ID NO: 493080 - RNA, 19 nt, Homo sapiens
ucaaagaggagcaauguau

SEQ ID NO: 493081 - RNA, 19 nt, Homo sapiens
gaauaugggacaaagcauu

SEQ ID NO: 493082 - RNA, 19 nt, Homo sapiens
gagaaguggauccuaauga

SEQ ID NO: 493083 - RNA, 19 nt, Homo sapiens
ccacagaagcucacaaaca

SEQ ID NO: 493084 - RNA, 19 nt, Homo sapiens
agaaacaggaucucgauaa

SEQ ID NO: 493085 - RNA, 19 nt, Homo sapiens
gacaaagcauuauggucuu

SEQ ID NO: 493086 - RNA, 19 nt, Homo sapiens
gggaauggacagcaaugua

SEQ ID NO: 493087 - RNA, 19 nt, Homo sapiens
uccaauuucucauccauaa

SEQ ID NO: 493088 - RNA, 19 nt, Homo sapiens
ccaaagcucggcagauuau

SEQ ID NO: 493089 - RNA, 19 nt, Homo sapiens
gaauggacagcaauguauu

SEQ ID NO: 493090 - RNA, 19 nt, Homo sapiens
cacagaagcucacaaacag

SEQ ID NO: 493091 - RNA, 19 nt, Homo sapiens
cuaaucaaccucuccaauu

SEQ ID NO: 493092 - RNA, 19 nt, Homo sapiens
aaucagguauugaccaaga

SEQ ID NO: 493093 - RNA, 19 nt, Homo sapiens
aguauuagcaggauuugua

SEQ ID NO: 493094 - RNA, 19 nt, Homo sapiens
aauaugggacaaagcauua

SEQ ID NO: 493095 - RNA, 19 nt, Homo sapiens
uaacagugcagcaauaucu

SEQ ID NO: 493096 - RNA, 19 nt, Homo sapiens
gugcagcaauaucuauaau

SEQ ID NO: 493097 - RNA, 19 nt, Homo sapiens
gacaguauuagcaggauuu

SEQ ID NO: 493098 - RNA, 19 nt, Homo sapiens
gagcgccaguggaacaugu

SEQ ID NO: 493099 - RNA, 19 nt, Homo sapiens
agaaauaacacacggaaag

SEQ ID NO: 493100 - RNA, 19 nt, Homo sapiens
ggaaaggucagggaaugga

SEQ ID NO: 493101 - RNA, 19 nt, Homo sapiens
gaaauaacacacggaaagg

SEQ ID NO: 493102 - RNA, 19 nt, Homo sapiens
gaaauccgacccuacaaaa

SEQ ID NO: 493103 - RNA, 19 nt, Homo sapiens
guauuagcaggauuuguaa

SEQ ID NO: 493104 - RNA, 19 nt, Homo sapiens
gaagcucacaaacagagaa

SEQ ID NO: 493105 - RNA, 19 nt, Homo sapiens
agaaguggauccuaaugag

SEQ ID NO: 493106 - RNA, 19 nt, Homo sapiens
caaccucuccaauuucuca

SEQ ID NO: 493107 - RNA, 19 nt, Homo sapiens
caggauuuguaaaggguuu

SEQ ID NO: 493108 - RNA, 19 nt, Homo sapiens
aaagauguccagcugcauu

SEQ ID NO: 493109 - RNA, 19 nt, Homo sapiens
agacgcugcugccuuuaau

SEQ ID NO: 493110 - RNA, 19 nt, Homo sapiens
agaagaaauuacaggacuu

SEQ ID NO: 493111 - RNA, 19 nt, Homo sapiens
gcaauguaucuuccagaga

SEQ ID NO: 493112 - RNA, 19 nt, Homo sapiens
caaagaggagcaauguauc

SEQ ID NO: 493113 - RNA, 19 nt, Homo sapiens
agcaauguauuuggagaua

SEQ ID NO: 493114 - RNA, 19 nt, Homo sapiens
ggcagauuaugaaccaguu

SEQ ID NO: 493115 - RNA, 19 nt, Homo sapiens
ggaucucgauaagcucuau

SEQ ID NO: 493116 - RNA, 19 nt, Homo sapiens
gguauugaccaagaagaaa

SEQ ID NO: 493117 - RNA, 19 nt, Homo sapiens
agaaauccgacccuacaaa

SEQ ID NO: 493118 - RNA, 19 nt, Homo sapiens
gcagauuaugaaccaguuu

SEQ ID NO: 493119 - RNA, 19 nt, Homo sapiens
caccacagaagcucacaaa

SEQ ID NO: 493120 - RNA, 19 nt, Homo sapiens
uauaagugacugaauaugg

SEQ ID NO: 493121 - RNA, 19 nt, Homo sapiens
aaagcucggcagauuauga

SEQ ID NO: 493122 - RNA, 19 nt, Homo sapiens
aaagaaacaggaucucgau

SEQ ID NO: 493123 - RNA, 19 nt, Homo sapiens
ugaccaagaagaaauuaca

SEQ ID NO: 493124 - RNA, 19 nt, Homo sapiens
guauugaccaagaagaaau

SEQ ID NO: 493125 - RNA, 19 nt, Homo sapiens
ugacuuucauuucauuugc

SEQ ID NO: 493126 - RNA, 19 nt, Homo sapiens
gcucacaaacagagaaugg

SEQ ID NO: 493127 - RNA, 19 nt, Homo sapiens
ggcaggaggucgucuuagc

SEQ ID NO: 493128 - RNA, 19 nt, Homo sapiens
aacaggaucucgauaagcu

SEQ ID NO: 493129 - RNA, 19 nt, Homo sapiens
gcauugauccggaaaacaa

SEQ ID NO: 493130 - RNA, 19 nt, Homo sapiens
acggaaaggucagggaaug

SEQ ID NO: 493131 - RNA, 19 nt, Homo sapiens
ccuguacuuuguaauguca

SEQ ID NO: 493132 - RNA, 19 nt, Homo sapiens
agacaguauuagcaggauu

SEQ ID NO: 493133 - RNA, 19 nt, Homo sapiens
cagugcagcaauaucuaua

SEQ ID NO: 493134 - RNA, 19 nt, Homo sapiens
acucagccaucucauccuu

SEQ ID NO: 493135 - RNA, 19 nt, Homo sapiens
guaagagaaguggauccua

SEQ ID NO: 493136 - RNA, 19 nt, Homo sapiens
augaagauguggaggagau

SEQ ID NO: 493137 - RNA, 19 nt, Homo sapiens
uccaaagcucggcagauua

SEQ ID NO: 493138 - RNA, 19 nt, Homo sapiens
aauggacagcaauguauuu

SEQ ID NO: 493139 - RNA, 19 nt, Homo sapiens
cagauuaugaaccaguuug

SEQ ID NO: 493140 - RNA, 19 nt, Homo sapiens
gaccggcugcugagacgaa

SEQ ID NO: 493141 - RNA, 19 nt, Homo sapiens
ccagagaagauuuuauuug

SEQ ID NO: 493142 - RNA, 19 nt, Homo sapiens
ucucaaagaggagcaaugu

SEQ ID NO: 493143 - RNA, 19 nt, Homo sapiens
gucagggaauggacagcaa

SEQ ID NO: 493144 - RNA, 19 nt, Homo sapiens
cccaggauuugguucugaa

SEQ ID NO: 493145 - RNA, 19 nt, Homo sapiens
cccuggaggugaaagaugu

SEQ ID NO: 493146 - RNA, 19 nt, Homo sapiens
uagacgcugcugccuuuaa

SEQ ID NO: 493147 - RNA, 19 nt, Homo sapiens
gacugaauaugggacaaag

SEQ ID NO: 493148 - RNA, 19 nt, Homo sapiens
aaagaggagcaauguaucu

SEQ ID NO: 493149 - RNA, 19 nt, Homo sapiens
ggguaagacaguauuagca

SEQ ID NO: 493150 - RNA, 19 nt, Homo sapiens
ugacugaauaugggacaaa

SEQ ID NO: 493151 - RNA, 19 nt, Homo sapiens
aagaaacaggaucucgaua

SEQ ID NO: 493152 - RNA, 19 nt, Homo sapiens
ccaauuucucauccauaaa

SEQ ID NO: 493153 - RNA, 19 nt, Homo sapiens
ccuaaucaaccucuccaau

SEQ ID NO: 493154 - RNA, 19 nt, Homo sapiens
ggucgucuuagcccugaaa

SEQ ID NO: 493155 - RNA, 19 nt, Homo sapiens
gauguccagcugcauuuag

SEQ ID NO: 493156 - RNA, 19 nt, Homo sapiens
aagauguccagcugcauuu

SEQ ID NO: 493157 - RNA, 19 nt, Homo sapiens
ugcugcagauugcugauga

SEQ ID NO: 493158 - RNA, 19 nt, Homo sapiens
agaaauuacaggacuuagu

SEQ ID NO: 493159 - RNA, 19 nt, Homo sapiens
guaauugccugccuuuaua

SEQ ID NO: 493160 - RNA, 19 nt, Homo sapiens
guuaaagacuugcuuacua

SEQ ID NO: 493161 - RNA, 19 nt, Homo sapiens
caaaguaccuugcaaacca

SEQ ID NO: 493162 - RNA, 19 nt, Homo sapiens
gaauugcgauguaugaugu

SEQ ID NO: 493163 - RNA, 19 nt, Homo sapiens
gauaucgucuucuugauuc

SEQ ID NO: 493164 - RNA, 19 nt, Homo sapiens
ucauagaguuuaucacuga

SEQ ID NO: 493165 - RNA, 19 nt, Homo sapiens
uuauggaucuugacacuuu

SEQ ID NO: 493166 - RNA, 19 nt, Homo sapiens
gaaaggacccaaggaaguu

SEQ ID NO: 493167 - RNA, 19 nt, Homo sapiens
gaguacaaguugaagauau

SEQ ID NO: 493168 - RNA, 19 nt, Homo sapiens
ccacacauaagucaaagua

SEQ ID NO: 493169 - RNA, 19 nt, Homo sapiens
aaugaaagauggagaaaca

SEQ ID NO: 493170 - RNA, 19 nt, Homo sapiens
ucacugaaaugacucacaa

SEQ ID NO: 493171 - RNA, 19 nt, Homo sapiens
ucugauaucuagccaugua

SEQ ID NO: 493172 - RNA, 19 nt, Homo sapiens
uugaagaucuugucauaga

SEQ ID NO: 493173 - RNA, 19 nt, Homo sapiens
ucuaaagaauugcgaugua

SEQ ID NO: 493174 - RNA, 19 nt, Homo sapiens
ugaauuacuuacuggguuu

SEQ ID NO: 493175 - RNA, 19 nt, Homo sapiens
gaucuugucauagaguuua

SEQ ID NO: 493176 - RNA, 19 nt, Homo sapiens
gauauuggugcauguaauu

SEQ ID NO: 493177 - RNA, 19 nt, Homo sapiens
gauggcagaugaggaagaa

SEQ ID NO: 493178 - RNA, 19 nt, Homo sapiens
gaaacgagcuagaaaagca

SEQ ID NO: 493179 - RNA, 19 nt, Homo sapiens
cuaaagaauugcgauguau

SEQ ID NO: 493180 - RNA, 19 nt, Homo sapiens
gaauugaaacgagcuagaa

SEQ ID NO: 493181 - RNA, 19 nt, Homo sapiens
cuagugggauggcagauga

SEQ ID NO: 493182 - RNA, 19 nt, Homo sapiens
guaaaugaaagauggagaa

SEQ ID NO: 493183 - RNA, 19 nt, Homo sapiens
gaaagauggagaaacacaa

SEQ ID NO: 493184 - RNA, 19 nt, Homo sapiens
ggggaaaccauauauaaua

SEQ ID NO: 493185 - RNA, 19 nt, Homo sapiens
guauguuuaugcccuugua

SEQ ID NO: 493186 - RNA, 19 nt, Homo sapiens
ugaagcaaauuauggaucu

SEQ ID NO: 493187 - RNA, 19 nt, Homo sapiens
uaucuagccauguaaauga

SEQ ID NO: 493188 - RNA, 19 nt, Homo sapiens
gaaguuugccaggguuaaa

SEQ ID NO: 493189 - RNA, 19 nt, Homo sapiens
caaggucgaguacaaguug

SEQ ID NO: 493190 - RNA, 19 nt, Homo sapiens
aagacaaggucgaguacaa

SEQ ID NO: 493191 - RNA, 19 nt, Homo sapiens
gaguuuaucacugaaauga

SEQ ID NO: 493192 - RNA, 19 nt, Homo sapiens
ggaagaagaccccacguuu

SEQ ID NO: 493193 - RNA, 19 nt, Homo sapiens
cgaaaggacccaaggaagu

SEQ ID NO: 493194 - RNA, 19 nt, Homo sapiens
aaagaauugcgauguauga

SEQ ID NO: 493195 - RNA, 19 nt, Homo sapiens
cuuguaagcuauacuguag

SEQ ID NO: 493196 - RNA, 19 nt, Homo sapiens
uuuaugcccuuguaagcua

SEQ ID NO: 493197 - RNA, 19 nt, Homo sapiens
gaaugaagaauugaaacga

SEQ ID NO: 493198 - RNA, 19 nt, Homo sapiens
aagacuugcuuacuaugaa

SEQ ID NO: 493199 - RNA, 19 nt, Homo sapiens
aaagauggagaaacacaaa

SEQ ID NO: 493200 - RNA, 19 nt, Homo sapiens
gaagcaaauuauggaucuu

SEQ ID NO: 493201 - RNA, 19 nt, Homo sapiens
gaagaauugaaacgagcua

SEQ ID NO: 493202 - RNA, 19 nt, Homo sapiens
gaagaucuugucauagagu

SEQ ID NO: 493203 - RNA, 19 nt, Homo sapiens
caaauuauggaucuugaca

SEQ ID NO: 493204 - RNA, 19 nt, Homo sapiens
gaagaagaccccacguuug

SEQ ID NO: 493205 - RNA, 19 nt, Homo sapiens
gauggagaaacacaaaguu

SEQ ID NO: 493206 - RNA, 19 nt, Homo sapiens
ucacaaggcaaugucaauu

SEQ ID NO: 493207 - RNA, 19 nt, Homo sapiens
gucaguggauauucuugaa

SEQ ID NO: 493208 - RNA, 19 nt, Homo sapiens
gaccagaauccuuauacug

SEQ ID NO: 493209 - RNA, 19 nt, Homo sapiens
uuaaugaccacacauaagu

SEQ ID NO: 493210 - RNA, 19 nt, Homo sapiens
uguaauugccugccuuuau

SEQ ID NO: 493211 - RNA, 19 nt, Homo sapiens
gaugaccagaauccuuaua

SEQ ID NO: 493212 - RNA, 19 nt, Homo sapiens
ugauauuggugcauguaau

SEQ ID NO: 493213 - RNA, 19 nt, Homo sapiens
uggaggaggugcagaaggu

SEQ ID NO: 493214 - RNA, 19 nt, Homo sapiens
aaagacuugcuuacuauga

SEQ ID NO: 493215 - RNA, 19 nt, Homo sapiens
ggaaguuugccaggguuaa

SEQ ID NO: 493216 - RNA, 19 nt, Homo sapiens
guuuaucacugaaaugacu

SEQ ID NO: 493217 - RNA, 19 nt, Homo sapiens
uaaagaauugcgauguaug

SEQ ID NO: 493218 - RNA, 19 nt, Homo sapiens
uggaagacaaggucgagua

SEQ ID NO: 493219 - RNA, 19 nt, Homo sapiens
gauaucuagccauguaaau

SEQ ID NO: 493220 - RNA, 19 nt, Homo sapiens
ggaagacaaggucgaguac

SEQ ID NO: 493221 - RNA, 19 nt, Homo sapiens
cagaauccuuauacugagu

SEQ ID NO: 493222 - RNA, 19 nt, Homo sapiens
accagaauccuuauacuga

SEQ ID NO: 493223 - RNA, 19 nt, Homo sapiens
cgaguacaaguugaagaua

SEQ ID NO: 493224 - RNA, 19 nt, Homo sapiens
cauagaguuuaucacugaa

SEQ ID NO: 493225 - RNA, 19 nt, Homo sapiens
agacuugcuuacuaugaau

SEQ ID NO: 493226 - RNA, 19 nt, Homo sapiens
agauaucgucuucuugauu

SEQ ID NO: 493227 - RNA, 19 nt, Homo sapiens
ugcaaaccaugccguuguu

SEQ ID NO: 493228 - RNA, 19 nt, Homo sapiens
gaccacacauaagucaaag

SEQ ID NO: 493229 - RNA, 19 nt, Homo sapiens
ugaaagauggagaaacaca

SEQ ID NO: 493230 - RNA, 19 nt, Homo sapiens
uguguuagguauguuuaug

SEQ ID NO: 493231 - RNA, 19 nt, Homo sapiens
ggugauauuggugcaugua

SEQ ID NO: 493232 - RNA, 19 nt, Homo sapiens
ugaugaagcaaauuaugga

SEQ ID NO: 493233 - RNA, 19 nt, Homo sapiens
ugccaggguuaaagacuug

SEQ ID NO: 493234 - RNA, 19 nt, Homo sapiens
aguacaaguugaagauauc

SEQ ID NO: 493235 - RNA, 19 nt, Homo sapiens
ugaccagaauccuuauacu

SEQ ID NO: 493236 - RNA, 19 nt, Homo sapiens
gaauccuuauacugaguca

SEQ ID NO: 493237 - RNA, 19 nt, Homo sapiens
gccuuuauauuaccauacu

SEQ ID NO: 493238 - RNA, 19 nt, Homo sapiens
ugaagaucuugucauagag

SEQ ID NO: 493239 - RNA, 19 nt, Homo sapiens
aaaguaccuugcaaaccau

SEQ ID NO: 493240 - RNA, 19 nt, Homo sapiens
gugauauuggugcauguaa

SEQ ID NO: 493241 - RNA, 19 nt, Homo sapiens
uaaagacuugcuuacuaug

SEQ ID NO: 493242 - RNA, 19 nt, Homo sapiens
ggauggcagaugaggaaga

SEQ ID NO: 493243 - RNA, 19 nt, Homo sapiens
uguaugauguauggcuuug

SEQ ID NO: 493244 - RNA, 19 nt, Homo sapiens
gacaaggucgaguacaagu

SEQ ID NO: 493245 - RNA, 19 nt, Homo sapiens
gaagacaaggucgaguaca

SEQ ID NO: 493246 - RNA, 19 nt, Homo sapiens
agucaaaguaccuugcaaa

SEQ ID NO: 493247 - RNA, 19 nt, Homo sapiens
cagaagguggacaggguaa

SEQ ID NO: 493248 - RNA, 19 nt, Homo sapiens
cauguaauugccugccuuu

SEQ ID NO: 493249 - RNA, 19 nt, Homo sapiens
uggcagaugaggaagaaga

SEQ ID NO: 493250 - RNA, 19 nt, Homo sapiens
aauuauggaucuugacacu

SEQ ID NO: 493251 - RNA, 19 nt, Homo sapiens
gaugaagcaaauuauggau

SEQ ID NO: 493252 - RNA, 19 nt, Homo sapiens
ccuuguaagcuauacugua

SEQ ID NO: 493253 - RNA, 19 nt, Homo sapiens
ugucauagaguuuaucacu

SEQ ID NO: 493254 - RNA, 19 nt, Homo sapiens
uaauugccugccuuuauau

SEQ ID NO: 493255 - RNA, 19 nt, Homo sapiens
agaauugcgauguaugaug

SEQ ID NO: 493256 - RNA, 19 nt, Homo sapiens
ugauaucuagccauguaaa

SEQ ID NO: 493257 - RNA, 19 nt, Homo sapiens
ugggauggcagaugaggaa

SEQ ID NO: 493258 - RNA, 19 nt, Homo sapiens
agcaaauuauggaucuuga

SEQ ID NO: 493259 - RNA, 19 nt, Homo sapiens
ggacauugcuucuacaaau

SEQ ID NO: 493260 - RNA, 19 nt, Homo sapiens
ugacaugucugaaauagaa

SEQ ID NO: 493261 - RNA, 19 nt, Homo sapiens
gagugaaucuggacguuua

SEQ ID NO: 493262 - RNA, 19 nt, Homo sapiens
gguggaaccucaagaauga

SEQ ID NO: 493263 - RNA, 19 nt, Homo sapiens
gaggaaagcguuuauugua

SEQ ID NO: 493264 - RNA, 19 nt, Homo sapiens
gaacaugauugagcuuaaa

SEQ ID NO: 493265 - RNA, 19 nt, Homo sapiens
ggaaagcguuuauuguaga

SEQ ID NO: 493266 - RNA, 19 nt, Homo sapiens
agacacacaugaccaauaa

SEQ ID NO: 493267 - RNA, 19 nt, Homo sapiens
gaaccauccuaauauugua

SEQ ID NO: 493268 - RNA, 19 nt, Homo sapiens
gacauugcuucuacaaaua

SEQ ID NO: 493269 - RNA, 19 nt, Homo sapiens
gcaaugaguugguguuuac

SEQ ID NO: 493270 - RNA, 19 nt, Homo sapiens
ggaagagguuguuggaaga

SEQ ID NO: 493271 - RNA, 19 nt, Homo sapiens
gaaaaggaccagcaaaaua

SEQ ID NO: 493272 - RNA, 19 nt, Homo sapiens
gcacaagaauauaugaaag

SEQ ID NO: 493273 - RNA, 19 nt, Homo sapiens
cagcugcucuauuuaauga

SEQ ID NO: 493274 - RNA, 19 nt, Homo sapiens
aaauacaucucgccuggua

SEQ ID NO: 493275 - RNA, 19 nt, Homo sapiens
gcaaguuccugccacaaau

SEQ ID NO: 493276 - RNA, 19 nt, Homo sapiens
gagcagcacuuugcaacuu

SEQ ID NO: 493277 - RNA, 19 nt, Homo sapiens
ugauugagcuuaaaugauc

SEQ ID NO: 493278 - RNA, 19 nt, Homo sapiens
gaaccauugccauauuaua

SEQ ID NO: 493279 - RNA, 19 nt, Homo sapiens
gaaacccuuugaugagauu

SEQ ID NO: 493280 - RNA, 19 nt, Homo sapiens
agugauuggugguauauua

SEQ ID NO: 493281 - RNA, 19 nt, Homo sapiens
cagaugagccauuacagua

SEQ ID NO: 493282 - RNA, 19 nt, Homo sapiens
aauaaugacucacuugaug

SEQ ID NO: 493283 - RNA, 19 nt, Homo sapiens
gcugaaccauugccauauu

SEQ ID NO: 493284 - RNA, 19 nt, Homo sapiens
ggaguuguuugcaaagcua

SEQ ID NO: 493285 - RNA, 19 nt, Homo sapiens
ccucaagaaugacuuuauu

SEQ ID NO: 493286 - RNA, 19 nt, Homo sapiens
gguaguaauuacagugaaa

SEQ ID NO: 493287 - RNA, 19 nt, Homo sapiens
gagaggaaagcguuuauug

SEQ ID NO: 493288 - RNA, 19 nt, Homo sapiens
gaggaugagugcugacaug

SEQ ID NO: 493289 - RNA, 19 nt, Homo sapiens
ccugaaaccaccaaacuua

SEQ ID NO: 493290 - RNA, 19 nt, Homo sapiens
ggugguauauuacggaaau

SEQ ID NO: 493291 - RNA, 19 nt, Homo sapiens
acaaggcacuucaugauuc

SEQ ID NO: 493292 - RNA, 19 nt, Homo sapiens
gaugagugcugacaugucu

SEQ ID NO: 493293 - RNA, 19 nt, Homo sapiens
aguggcagcugcucuauuu

SEQ ID NO: 493294 - RNA, 19 nt, Homo sapiens
uacggaaccuuuagggaua

SEQ ID NO: 493295 - RNA, 19 nt, Homo sapiens
guagauccauccaagacuu

SEQ ID NO: 493296 - RNA, 19 nt, Homo sapiens
caugugggcuguucauaau

SEQ ID NO: 493297 - RNA, 19 nt, Homo sapiens
gccuauauuugcugcauuu

SEQ ID NO: 493298 - RNA, 19 nt, Homo sapiens
gagaaagcaagaacuaguu

SEQ ID NO: 493299 - RNA, 19 nt, Homo sapiens
ggaaacccuuugaugagau

SEQ ID NO: 493300 - RNA, 19 nt, Homo sapiens
uugaagagaucgacuacaa

SEQ ID NO: 493301 - RNA, 19 nt, Homo sapiens
guauaugcaugcucauugu

SEQ ID NO: 493302 - RNA, 19 nt, Homo sapiens
ggaggaaauugugaaaaua

SEQ ID NO: 493303 - RNA, 19 nt, Homo sapiens
cugaaccauugccauauua

SEQ ID NO: 493304 - RNA, 19 nt, Homo sapiens
gcugcucuauuuaaugaaa

SEQ ID NO: 493305 - RNA, 19 nt, Homo sapiens
ggaaauacggaaccuuuag

SEQ ID NO: 493306 - RNA, 19 nt, Homo sapiens
gaaccucaagaaugacuuu

SEQ ID NO: 493307 - RNA, 19 nt, Homo sapiens
gguagcaucugugacuuga

SEQ ID NO: 493308 - RNA, 19 nt, Homo sapiens
gcauuguuauuacagagaa

SEQ ID NO: 493309 - RNA, 19 nt, Homo sapiens
gugcugacaugucugaaau

SEQ ID NO: 493310 - RNA, 19 nt, Homo sapiens
ucuuguaucucaucucaaa

SEQ ID NO: 493311 - RNA, 19 nt, Homo sapiens
gaacaggagguaucaaacu

SEQ ID NO: 493312 - RNA, 19 nt, Homo sapiens
ugacgauucaugaguguua

SEQ ID NO: 493313 - RNA, 19 nt, Homo sapiens
cccaauggcuuaucuuaca

SEQ ID NO: 493314 - RNA, 19 nt, Homo sapiens
gaugagccauuacaguauc

SEQ ID NO: 493315 - RNA, 19 nt, Homo sapiens
uagcaucugugacuugaau

SEQ ID NO: 493316 - RNA, 19 nt, Homo sapiens
gacaaggcacuucaugauu

SEQ ID NO: 493317 - RNA, 19 nt, Homo sapiens
ccugaugauuccacagaua

SEQ ID NO: 493318 - RNA, 19 nt, Homo sapiens
gcaaagcaacagagugaau

SEQ ID NO: 493319 - RNA, 19 nt, Homo sapiens
acacuaauauggagcaagu

SEQ ID NO: 493320 - RNA, 19 nt, Homo sapiens
aacaggagguaucaaacua

SEQ ID NO: 493321 - RNA, 19 nt, Homo sapiens
cgugugaaccauccuaaua

SEQ ID NO: 493322 - RNA, 19 nt, Homo sapiens
uaacagaacaggagguauc

SEQ ID NO: 493323 - RNA, 19 nt, Homo sapiens
gaacuguggcuguauaugc

SEQ ID NO: 493324 - RNA, 19 nt, Homo sapiens
agaacaugauugagcuuaa

SEQ ID NO: 493325 - RNA, 19 nt, Homo sapiens
guaaguggcagcugcucua

SEQ ID NO: 493326 - RNA, 19 nt, Homo sapiens
uagagugauuggugguaua

SEQ ID NO: 493327 - RNA, 19 nt, Homo sapiens
gugcaaacagcguccauuu

SEQ ID NO: 493328 - RNA, 19 nt, Homo sapiens
gaaagcguuuauuguagag

SEQ ID NO: 493329 - RNA, 19 nt, Homo sapiens
guauguguguugaaacugu

SEQ ID NO: 493330 - RNA, 19 nt, Homo sapiens
cagaacaggagguaucaaa

SEQ ID NO: 493331 - RNA, 19 nt, Homo sapiens
cgacaaggcacuucaugau

SEQ ID NO: 493332 - RNA, 19 nt, Homo sapiens
gcugacaugucugaaauag

SEQ ID NO: 493333 - RNA, 19 nt, Homo sapiens
gugcugaaccauugccaua

SEQ ID NO: 493334 - RNA, 19 nt, Homo sapiens
ugugaaccauccuaauauu

SEQ ID NO: 493335 - RNA, 19 nt, Homo sapiens
gcaguuaucccgugugaac

SEQ ID NO: 493336 - RNA, 19 nt, Homo sapiens
gaaugccaacugccuauau

SEQ ID NO: 493337 - RNA, 19 nt, Homo sapiens
ucaaacagaaauugcauug

SEQ ID NO: 493338 - RNA, 19 nt, Homo sapiens
ggacagccaagacguagau

SEQ ID NO: 493339 - RNA, 19 nt, Homo sapiens
aagaggagccuuuggaguu

SEQ ID NO: 493340 - RNA, 19 nt, Homo sapiens
aggagcagaugagccauua

SEQ ID NO: 493341 - RNA, 19 nt, Homo sapiens
cggaaacccuuugaugaga

SEQ ID NO: 493342 - RNA, 19 nt, Homo sapiens
caugguggacauacaauuu

SEQ ID NO: 493343 - RNA, 19 nt, Homo sapiens
gaaacgacaaggcacuuca

SEQ ID NO: 493344 - RNA, 19 nt, Homo sapiens
acaguauccuugucaguau

SEQ ID NO: 493345 - RNA, 19 nt, Homo sapiens
gaguugguguuuacagugu

SEQ ID NO: 493346 - RNA, 19 nt, Homo sapiens
acagagaaagcaagaacua

SEQ ID NO: 493347 - RNA, 19 nt, Homo sapiens
gcagaugagccauuacagu

SEQ ID NO: 493348 - RNA, 19 nt, Homo sapiens
gagcagaugagccauuaca

SEQ ID NO: 493349 - RNA, 19 nt, Homo sapiens
cgcaaugaguugguguuua

SEQ ID NO: 493350 - RNA, 19 nt, Homo sapiens
gaagucagcagcagaaacg

SEQ ID NO: 493351 - RNA, 19 nt, Homo sapiens
caacuagaggucaucagaa

SEQ ID NO: 493352 - RNA, 19 nt, Homo sapiens
uacacuggaucaccaacua

SEQ ID NO: 493353 - RNA, 19 nt, Homo sapiens
ggcacaagaauauaugaaa

SEQ ID NO: 493354 - RNA, 19 nt, Homo sapiens
aagaaucuauggcaguguu

SEQ ID NO: 493355 - RNA, 19 nt, Homo sapiens
ggagcaguguggagagcuu

SEQ ID NO: 493356 - RNA, 19 nt, Homo sapiens
aaagcuaaguggagagcaa

SEQ ID NO: 493357 - RNA, 19 nt, Homo sapiens
caugauugagcuuaaauga

SEQ ID NO: 493358 - RNA, 19 nt, Homo sapiens
ggcagcugcucuauuuaau

SEQ ID NO: 493359 - RNA, 19 nt, Homo sapiens
ggacauugcuucuacaaau

SEQ ID NO: 493360 - RNA, 19 nt, Homo sapiens
ugacaugucugaaauagaa

SEQ ID NO: 493361 - RNA, 19 nt, Homo sapiens
gagugaaucuggacguuua

SEQ ID NO: 493362 - RNA, 19 nt, Homo sapiens
gguggaaccucaagaauga

SEQ ID NO: 493363 - RNA, 19 nt, Homo sapiens
gaggaaagcguuuauugua

SEQ ID NO: 493364 - RNA, 19 nt, Homo sapiens
gaacaugauugagcuuaaa

SEQ ID NO: 493365 - RNA, 19 nt, Homo sapiens
ggaaagcguuuauuguaga

SEQ ID NO: 493366 - RNA, 19 nt, Homo sapiens
agacacacaugaccaauaa

SEQ ID NO: 493367 - RNA, 19 nt, Homo sapiens
gaaccauccuaauauugua

SEQ ID NO: 493368 - RNA, 19 nt, Homo sapiens
gacauugcuucuacaaaua

SEQ ID NO: 493369 - RNA, 19 nt, Homo sapiens
gcaaugaguugguguuuac

SEQ ID NO: 493370 - RNA, 19 nt, Homo sapiens
ggaagagguuguuggaaga

SEQ ID NO: 493371 - RNA, 19 nt, Homo sapiens
gaaaaggaccagcaaaaua

SEQ ID NO: 493372 - RNA, 19 nt, Homo sapiens
gcacaagaauauaugaaag

SEQ ID NO: 493373 - RNA, 19 nt, Homo sapiens
cagcugcucuauuuaauga

SEQ ID NO: 493374 - RNA, 19 nt, Homo sapiens
aaauacaucucgccuggua

SEQ ID NO: 493375 - RNA, 19 nt, Homo sapiens
gcaaguuccugccacaaau

SEQ ID NO: 493376 - RNA, 19 nt, Homo sapiens
gagcagcacuuugcaacuu

SEQ ID NO: 493377 - RNA, 19 nt, Homo sapiens
ugauugagcuuaaaugauc

SEQ ID NO: 493378 - RNA, 19 nt, Homo sapiens
gaaccauugccauauuaua

SEQ ID NO: 493379 - RNA, 19 nt, Homo sapiens
gaaacccuuugaugagauu

SEQ ID NO: 493380 - RNA, 19 nt, Homo sapiens
agugauuggugguauauua

SEQ ID NO: 493381 - RNA, 19 nt, Homo sapiens
cagaugagccauuacagua

SEQ ID NO: 493382 - RNA, 19 nt, Homo sapiens
aauaaugacucacuugaug

SEQ ID NO: 493383 - RNA, 19 nt, Homo sapiens
gcugaaccauugccauauu

SEQ ID NO: 493384 - RNA, 19 nt, Homo sapiens
ggaguuguuugcaaagcua

SEQ ID NO: 493385 - RNA, 19 nt, Homo sapiens
ccucaagaaugacuuuauu

SEQ ID NO: 493386 - RNA, 19 nt, Homo sapiens
gguaguaauuacagugaaa

SEQ ID NO: 493387 - RNA, 19 nt, Homo sapiens
gagaggaaagcguuuauug

SEQ ID NO: 493388 - RNA, 19 nt, Homo sapiens
gaggaugagugcugacaug

SEQ ID NO: 493389 - RNA, 19 nt, Homo sapiens
ccugaaaccaccaaacuua

SEQ ID NO: 493390 - RNA, 19 nt, Homo sapiens
ggugguauauuacggaaau

SEQ ID NO: 493391 - RNA, 19 nt, Homo sapiens
acaaggcacuucaugauuc

SEQ ID NO: 493392 - RNA, 19 nt, Homo sapiens
gaugagugcugacaugucu

SEQ ID NO: 493393 - RNA, 19 nt, Homo sapiens
aguggcagcugcucuauuu

SEQ ID NO: 493394 - RNA, 19 nt, Homo sapiens
uacggaaccuuuagggaua

SEQ ID NO: 493395 - RNA, 19 nt, Homo sapiens
guagauccauccaagacuu

SEQ ID NO: 493396 - RNA, 19 nt, Homo sapiens
caugugggcuguucauaau

SEQ ID NO: 493397 - RNA, 19 nt, Homo sapiens
uugaagagaucgacuacaa

SEQ ID NO: 493398 - RNA, 19 nt, Homo sapiens
gccuauauuugcugcauuu

SEQ ID NO: 493399 - RNA, 19 nt, Homo sapiens
gagaaagcaagaacuaguu

SEQ ID NO: 493400 - RNA, 19 nt, Homo sapiens
ggaaacccuuugaugagau

SEQ ID NO: 493401 - RNA, 19 nt, Homo sapiens
guauaugcaugcucauugu

SEQ ID NO: 493402 - RNA, 19 nt, Homo sapiens
ggaggaaauugugaaaaua

SEQ ID NO: 493403 - RNA, 19 nt, Homo sapiens
cugaaccauugccauauua

SEQ ID NO: 493404 - RNA, 19 nt, Homo sapiens
gcugcucuauuuaaugaaa

SEQ ID NO: 493405 - RNA, 19 nt, Homo sapiens
ggaaauacggaaccuuuag

SEQ ID NO: 493406 - RNA, 19 nt, Homo sapiens
gaaccucaagaaugacuuu

SEQ ID NO: 493407 - RNA, 19 nt, Homo sapiens
gguagcaucugugacuuga

SEQ ID NO: 493408 - RNA, 19 nt, Homo sapiens
gcauuguuauuacagagaa

SEQ ID NO: 493409 - RNA, 19 nt, Homo sapiens
gugcugacaugucugaaau

SEQ ID NO: 493410 - RNA, 19 nt, Homo sapiens
ucuuguaucucaucucaaa

SEQ ID NO: 493411 - RNA, 19 nt, Homo sapiens
gaacaggagguaucaaacu

SEQ ID NO: 493412 - RNA, 19 nt, Homo sapiens
ugacgauucaugaguguua

SEQ ID NO: 493413 - RNA, 19 nt, Homo sapiens
cccaauggcuuaucuuaca

SEQ ID NO: 493414 - RNA, 19 nt, Homo sapiens
gaugagccauuacaguauc

SEQ ID NO: 493415 - RNA, 19 nt, Homo sapiens
uagcaucugugacuugaau

SEQ ID NO: 493416 - RNA, 19 nt, Homo sapiens
gacaaggcacuucaugauu

SEQ ID NO: 493417 - RNA, 19 nt, Homo sapiens
ccugaugauuccacagaua

SEQ ID NO: 493418 - RNA, 19 nt, Homo sapiens
gcaaagcaacagagugaau

SEQ ID NO: 493419 - RNA, 19 nt, Homo sapiens
acacuaauauggagcaagu

SEQ ID NO: 493420 - RNA, 19 nt, Homo sapiens
aacaggagguaucaaacua

SEQ ID NO: 493421 - RNA, 19 nt, Homo sapiens
cgugugaaccauccuaaua

SEQ ID NO: 493422 - RNA, 19 nt, Homo sapiens
uaacagaacaggagguauc

SEQ ID NO: 493423 - RNA, 19 nt, Homo sapiens
gaacuguggcuguauaugc

SEQ ID NO: 493424 - RNA, 19 nt, Homo sapiens
agaacaugauugagcuuaa

SEQ ID NO: 493425 - RNA, 19 nt, Homo sapiens
guaaguggcagcugcucua

SEQ ID NO: 493426 - RNA, 19 nt, Homo sapiens
uagagugauuggugguaua

SEQ ID NO: 493427 - RNA, 19 nt, Homo sapiens
gugcaaacagcguccauuu

SEQ ID NO: 493428 - RNA, 19 nt, Homo sapiens
gaaagcguuuauuguagag

SEQ ID NO: 493429 - RNA, 19 nt, Homo sapiens
guauguguguugaaacugu

SEQ ID NO: 493430 - RNA, 19 nt, Homo sapiens
cagaacaggagguaucaaa

SEQ ID NO: 493431 - RNA, 19 nt, Homo sapiens
cgacaaggcacuucaugau

SEQ ID NO: 493432 - RNA, 19 nt, Homo sapiens
gcugacaugucugaaauag

SEQ ID NO: 493433 - RNA, 19 nt, Homo sapiens
gugcugaaccauugccaua

SEQ ID NO: 493434 - RNA, 19 nt, Homo sapiens
ugugaaccauccuaauauu

SEQ ID NO: 493435 - RNA, 19 nt, Homo sapiens
gcaguuaucccgugugaac

SEQ ID NO: 493436 - RNA, 19 nt, Homo sapiens
gaaugccaacugccuauau

SEQ ID NO: 493437 - RNA, 19 nt, Homo sapiens
ucaaacagaaauugcauug

SEQ ID NO: 493438 - RNA, 19 nt, Homo sapiens
aagaggagccuuuggaguu

SEQ ID NO: 493439 - RNA, 19 nt, Homo sapiens
ggacagccaagacguagau

SEQ ID NO: 493440 - RNA, 19 nt, Homo sapiens
aggagcagaugagccauua

SEQ ID NO: 493441 - RNA, 19 nt, Homo sapiens
cggaaacccuuugaugaga

SEQ ID NO: 493442 - RNA, 19 nt, Homo sapiens
caugguggacauacaauuu

SEQ ID NO: 493443 - RNA, 19 nt, Homo sapiens
gaaacgacaaggcacuuca

SEQ ID NO: 493444 - RNA, 19 nt, Homo sapiens
acaguauccuugucaguau

SEQ ID NO: 493445 - RNA, 19 nt, Homo sapiens
gaguugguguuuacagugu

SEQ ID NO: 493446 - RNA, 19 nt, Homo sapiens
acagagaaagcaagaacua

SEQ ID NO: 493447 - RNA, 19 nt, Homo sapiens
gcagaugagccauuacagu

SEQ ID NO: 493448 - RNA, 19 nt, Homo sapiens
gagcagaugagccauuaca

SEQ ID NO: 493449 - RNA, 19 nt, Homo sapiens
cgcaaugaguugguguuua

SEQ ID NO: 493450 - RNA, 19 nt, Homo sapiens
gaagucagcagcagaaacg

SEQ ID NO: 493451 - RNA, 19 nt, Homo sapiens
caacuagaggucaucagaa

SEQ ID NO: 493452 - RNA, 19 nt, Homo sapiens
uacacuggaucaccaacua

SEQ ID NO: 493453 - RNA, 19 nt, Homo sapiens
aaagcuaaguggagagcaa

SEQ ID NO: 493454 - RNA, 19 nt, Homo sapiens
ggcacaagaauauaugaaa

SEQ ID NO: 493455 - RNA, 19 nt, Homo sapiens
aagaaucuauggcaguguu

SEQ ID NO: 493456 - RNA, 19 nt, Homo sapiens
ggagcaguguggagagcuu

SEQ ID NO: 493457 - RNA, 19 nt, Homo sapiens
caugauugagcuuaaauga

SEQ ID NO: 493458 - RNA, 19 nt, Homo sapiens
ggcagcugcucuauuuaau

SEQ ID NO: 493459 - RNA, 19 nt, Homo sapiens
ggacauugcuucuacaaau

SEQ ID NO: 493460 - RNA, 19 nt, Homo sapiens
ugacaugucugaaauagaa

SEQ ID NO: 493461 - RNA, 19 nt, Homo sapiens
gagugaaucuggacguuua

SEQ ID NO: 493462 - RNA, 19 nt, Homo sapiens
gguggaaccucaagaauga

SEQ ID NO: 493463 - RNA, 19 nt, Homo sapiens
gaggaaagcguuuauugua

SEQ ID NO: 493464 - RNA, 19 nt, Homo sapiens
gaacaugauugagcuuaaa

SEQ ID NO: 493465 - RNA, 19 nt, Homo sapiens
ggaaagcguuuauuguaga

SEQ ID NO: 493466 - RNA, 19 nt, Homo sapiens
agacacacaugaccaauaa

SEQ ID NO: 493467 - RNA, 19 nt, Homo sapiens
gaaccauccuaauauugua

SEQ ID NO: 493468 - RNA, 19 nt, Homo sapiens
gacauugcuucuacaaaua

SEQ ID NO: 493469 - RNA, 19 nt, Homo sapiens
gcaaugaguugguguuuac

SEQ ID NO: 493470 - RNA, 19 nt, Homo sapiens
ggaagagguuguuggaaga

SEQ ID NO: 493471 - RNA, 19 nt, Homo sapiens
gaaaaggaccagcaaaaua

SEQ ID NO: 493472 - RNA, 19 nt, Homo sapiens
cagcugcucuauuuaauga

SEQ ID NO: 493473 - RNA, 19 nt, Homo sapiens
aaauacaucucgccuggua

SEQ ID NO: 493474 - RNA, 19 nt, Homo sapiens
gcaaguuccugccacaaau

SEQ ID NO: 493475 - RNA, 19 nt, Homo sapiens
gagcagcacuuugcaacuu

SEQ ID NO: 493476 - RNA, 19 nt, Homo sapiens
ugauugagcuuaaaugauc

SEQ ID NO: 493477 - RNA, 19 nt, Homo sapiens
gaaccauugccauauuaua

SEQ ID NO: 493478 - RNA, 19 nt, Homo sapiens
gaaacccuuugaugagauu

SEQ ID NO: 493479 - RNA, 19 nt, Homo sapiens
agugauuggugguauauua

SEQ ID NO: 493480 - RNA, 19 nt, Homo sapiens
cagaugagccauuacagua

SEQ ID NO: 493481 - RNA, 19 nt, Homo sapiens
aauaaugacucacuugaug

SEQ ID NO: 493482 - RNA, 19 nt, Homo sapiens
gcugaaccauugccauauu

SEQ ID NO: 493483 - RNA, 19 nt, Homo sapiens
ggaguuguuugcaaagcua

SEQ ID NO: 493484 - RNA, 19 nt, Homo sapiens
ccucaagaaugacuuuauu

SEQ ID NO: 493485 - RNA, 19 nt, Homo sapiens
gguaguaauuacagugaaa

SEQ ID NO: 493486 - RNA, 19 nt, Homo sapiens
gagaggaaagcguuuauug

SEQ ID NO: 493487 - RNA, 19 nt, Homo sapiens
gaggaugagugcugacaug

SEQ ID NO: 493488 - RNA, 19 nt, Homo sapiens
ccugaaaccaccaaacuua

SEQ ID NO: 493489 - RNA, 19 nt, Homo sapiens
ggugguauauuacggaaau

SEQ ID NO: 493490 - RNA, 19 nt, Homo sapiens
acaaggcacuucaugauuc

SEQ ID NO: 493491 - RNA, 19 nt, Homo sapiens
gaugagugcugacaugucu

SEQ ID NO: 493492 - RNA, 19 nt, Homo sapiens
aguggcagcugcucuauuu

SEQ ID NO: 493493 - RNA, 19 nt, Homo sapiens
uacggaaccuuuagggaua

SEQ ID NO: 493494 - RNA, 19 nt, Homo sapiens
guagauccauccaagacuu

SEQ ID NO: 493495 - RNA, 19 nt, Homo sapiens
caugugggcuguucauaau

SEQ ID NO: 493496 - RNA, 19 nt, Homo sapiens
gccuauauuugcugcauuu

SEQ ID NO: 493497 - RNA, 19 nt, Homo sapiens
ggaaacccuuugaugagau

SEQ ID NO: 493498 - RNA, 19 nt, Homo sapiens
uugaagagaucgacuacaa

SEQ ID NO: 493499 - RNA, 19 nt, Homo sapiens
guauaugcaugcucauugu

SEQ ID NO: 493500 - RNA, 19 nt, Homo sapiens
ggaggaaauugugaaaaua

SEQ ID NO: 493501 - RNA, 19 nt, Homo sapiens
cugaaccauugccauauua

SEQ ID NO: 493502 - RNA, 19 nt, Homo sapiens
gcugcucuauuuaaugaaa

SEQ ID NO: 493503 - RNA, 19 nt, Homo sapiens
ggaaauacggaaccuuuag

SEQ ID NO: 493504 - RNA, 19 nt, Homo sapiens
gaaccucaagaaugacuuu

SEQ ID NO: 493505 - RNA, 19 nt, Homo sapiens
gguagcaucugugacuuga

SEQ ID NO: 493506 - RNA, 19 nt, Homo sapiens
gugcugacaugucugaaau

SEQ ID NO: 493507 - RNA, 19 nt, Homo sapiens
ucuuguaucucaucucaaa

SEQ ID NO: 493508 - RNA, 19 nt, Homo sapiens
gaacaggagguaucaaacu

SEQ ID NO: 493509 - RNA, 19 nt, Homo sapiens
ugacgauucaugaguguua

SEQ ID NO: 493510 - RNA, 19 nt, Homo sapiens
caacuacaggcaagaacua

SEQ ID NO: 493511 - RNA, 19 nt, Homo sapiens
cccaauggcuuaucuuaca

SEQ ID NO: 493512 - RNA, 19 nt, Homo sapiens
gaugagccauuacaguauc

SEQ ID NO: 493513 - RNA, 19 nt, Homo sapiens
uagcaucugugacuugaau

SEQ ID NO: 493514 - RNA, 19 nt, Homo sapiens
gacaaggcacuucaugauu

SEQ ID NO: 493515 - RNA, 19 nt, Homo sapiens
ccugaugauuccacagaua

SEQ ID NO: 493516 - RNA, 19 nt, Homo sapiens
gcaaagcaacagagugaau

SEQ ID NO: 493517 - RNA, 19 nt, Homo sapiens
acacuaauauggagcaagu

SEQ ID NO: 493518 - RNA, 19 nt, Homo sapiens
aacaggagguaucaaacua

SEQ ID NO: 493519 - RNA, 19 nt, Homo sapiens
cgugugaaccauccuaaua

SEQ ID NO: 493520 - RNA, 19 nt, Homo sapiens
uaacagaacaggagguauc

SEQ ID NO: 493521 - RNA, 19 nt, Homo sapiens
gaacuguggcuguauaugc

SEQ ID NO: 493522 - RNA, 19 nt, Homo sapiens
agaacaugauugagcuuaa

SEQ ID NO: 493523 - RNA, 19 nt, Homo sapiens
guaaguggcagcugcucua

SEQ ID NO: 493524 - RNA, 19 nt, Homo sapiens
uagagugauuggugguaua

SEQ ID NO: 493525 - RNA, 19 nt, Homo sapiens
gugcaaacagcguccauuu

SEQ ID NO: 493526 - RNA, 19 nt, Homo sapiens
gaaagcguuuauuguagag

SEQ ID NO: 493527 - RNA, 19 nt, Homo sapiens
guauguguguugaaacugu

SEQ ID NO: 493528 - RNA, 19 nt, Homo sapiens
cagaacaggagguaucaaa

SEQ ID NO: 493529 - RNA, 19 nt, Homo sapiens
cgacaaggcacuucaugau

SEQ ID NO: 493530 - RNA, 19 nt, Homo sapiens
gcugacaugucugaaauag

SEQ ID NO: 493531 - RNA, 19 nt, Homo sapiens
gugcugaaccauugccaua

SEQ ID NO: 493532 - RNA, 19 nt, Homo sapiens
ugugaaccauccuaauauu

SEQ ID NO: 493533 - RNA, 19 nt, Homo sapiens
gcaguuaucccgugugaac

SEQ ID NO: 493534 - RNA, 19 nt, Homo sapiens
gaaugccaacugccuauau

SEQ ID NO: 493535 - RNA, 19 nt, Homo sapiens
ggacagccaagacguagau

SEQ ID NO: 493536 - RNA, 19 nt, Homo sapiens
aggagcagaugagccauua

SEQ ID NO: 493537 - RNA, 19 nt, Homo sapiens
cggaaacccuuugaugaga

SEQ ID NO: 493538 - RNA, 19 nt, Homo sapiens
aagaggagccuuuggaguu

SEQ ID NO: 493539 - RNA, 19 nt, Homo sapiens
caugguggacauacaauuu

SEQ ID NO: 493540 - RNA, 19 nt, Homo sapiens
gaaacgacaaggcacuuca

SEQ ID NO: 493541 - RNA, 19 nt, Homo sapiens
acaguauccuugucaguau

SEQ ID NO: 493542 - RNA, 19 nt, Homo sapiens
gaguugguguuuacagugu

SEQ ID NO: 493543 - RNA, 19 nt, Homo sapiens
gcagaugagccauuacagu

SEQ ID NO: 493544 - RNA, 19 nt, Homo sapiens
gagcagaugagccauuaca

SEQ ID NO: 493545 - RNA, 19 nt, Homo sapiens
cgcaaugaguugguguuua

SEQ ID NO: 493546 - RNA, 19 nt, Homo sapiens
gaagucagcagcagaaacg

SEQ ID NO: 493547 - RNA, 19 nt, Homo sapiens
caacuagaggucaucagaa

SEQ ID NO: 493548 - RNA, 19 nt, Homo sapiens
uacacuggaucaccaacua

SEQ ID NO: 493549 - RNA, 19 nt, Homo sapiens
aaagcuaaguggagagcaa

SEQ ID NO: 493550 - RNA, 19 nt, Homo sapiens
ggagcaguguggagagcuu

SEQ ID NO: 493551 - RNA, 19 nt, Homo sapiens
caugauugagcuuaaauga

SEQ ID NO: 493552 - RNA, 19 nt, Homo sapiens
ggcagcugcucuauuuaau

SEQ ID NO: 493553 - RNA, 19 nt, Homo sapiens
cuacaaauacgaguaacaa

SEQ ID NO: 493554 - RNA, 19 nt, Homo sapiens
gcccuucaauggaggaaau

SEQ ID NO: 493555 - RNA, 19 nt, Homo sapiens
aaauuuaccuaagcccauu

SEQ ID NO: 493556 - RNA, 19 nt, Homo sapiens
cgaaucaugugggcuguuc

SEQ ID NO: 493557 - RNA, 19 nt, Homo sapiens
cagacacacaugaccaaua

SEQ ID NO: 493558 - RNA, 19 nt, Homo sapiens
cggaaauacggaaccuuua

SEQ ID NO: 493559 - RNA, 19 nt, Homo sapiens
ggacauugcuucuacaaau

SEQ ID NO: 493560 - RNA, 19 nt, Homo sapiens
ugacaugucugaaauagaa

SEQ ID NO: 493561 - RNA, 19 nt, Homo sapiens
gagugaaucuggacguuua

SEQ ID NO: 493562 - RNA, 19 nt, Homo sapiens
gguggaaccucaagaauga

SEQ ID NO: 493563 - RNA, 19 nt, Homo sapiens
gaggaaagcguuuauugua

SEQ ID NO: 493564 - RNA, 19 nt, Homo sapiens
gaacaugauugagcuuaaa

SEQ ID NO: 493565 - RNA, 19 nt, Homo sapiens
ggaaagcguuuauuguaga

SEQ ID NO: 493566 - RNA, 19 nt, Homo sapiens
agacacacaugaccaauaa

SEQ ID NO: 493567 - RNA, 19 nt, Homo sapiens
gaaccauccuaauauugua

SEQ ID NO: 493568 - RNA, 19 nt, Homo sapiens
gacauugcuucuacaaaua

SEQ ID NO: 493569 - RNA, 19 nt, Homo sapiens
gcaaugaguugguguuuac

SEQ ID NO: 493570 - RNA, 19 nt, Homo sapiens
ggaagagguuguuggaaga

SEQ ID NO: 493571 - RNA, 19 nt, Homo sapiens
gaaaaggaccagcaaaaua

SEQ ID NO: 493572 - RNA, 19 nt, Homo sapiens
cagcugcucuauuuaauga

SEQ ID NO: 493573 - RNA, 19 nt, Homo sapiens
aaauacaucucgccuggua

SEQ ID NO: 493574 - RNA, 19 nt, Homo sapiens
gcaaguuccugccacaaau

SEQ ID NO: 493575 - RNA, 19 nt, Homo sapiens
gagcagcacuuugcaacuu

SEQ ID NO: 493576 - RNA, 19 nt, Homo sapiens
ugauugagcuuaaaugauc

SEQ ID NO: 493577 - RNA, 19 nt, Homo sapiens
gaaccauugccauauuaua

SEQ ID NO: 493578 - RNA, 19 nt, Homo sapiens
gaaacccuuugaugagauu

SEQ ID NO: 493579 - RNA, 19 nt, Homo sapiens
agugauuggugguauauua

SEQ ID NO: 493580 - RNA, 19 nt, Homo sapiens
cagaugagccauuacagua

SEQ ID NO: 493581 - RNA, 19 nt, Homo sapiens
aauaaugacucacuugaug

SEQ ID NO: 493582 - RNA, 19 nt, Homo sapiens
gcugaaccauugccauauu

SEQ ID NO: 493583 - RNA, 19 nt, Homo sapiens
ggaguuguuugcaaagcua

SEQ ID NO: 493584 - RNA, 19 nt, Homo sapiens
ccucaagaaugacuuuauu

SEQ ID NO: 493585 - RNA, 19 nt, Homo sapiens
gguaguaauuacagugaaa

SEQ ID NO: 493586 - RNA, 19 nt, Homo sapiens
gagaggaaagcguuuauug

SEQ ID NO: 493587 - RNA, 19 nt, Homo sapiens
gaggaugagugcugacaug

SEQ ID NO: 493588 - RNA, 19 nt, Homo sapiens
ccugaaaccaccaaacuua

SEQ ID NO: 493589 - RNA, 19 nt, Homo sapiens
ggugguauauuacggaaau

SEQ ID NO: 493590 - RNA, 19 nt, Homo sapiens
acaaggcacuucaugauuc

SEQ ID NO: 493591 - RNA, 19 nt, Homo sapiens
gaugagugcugacaugucu

SEQ ID NO: 493592 - RNA, 19 nt, Homo sapiens
aguggcagcugcucuauuu

SEQ ID NO: 493593 - RNA, 19 nt, Homo sapiens
uacggaaccuuuagggaua

SEQ ID NO: 493594 - RNA, 19 nt, Homo sapiens
guagauccauccaagacuu

SEQ ID NO: 493595 - RNA, 19 nt, Homo sapiens
caugugggcuguucauaau

SEQ ID NO: 493596 - RNA, 19 nt, Homo sapiens
gccuauauuugcugcauuu

SEQ ID NO: 493597 - RNA, 19 nt, Homo sapiens
ggaaacccuuugaugagau

SEQ ID NO: 493598 - RNA, 19 nt, Homo sapiens
uugaagagaucgacuacaa

SEQ ID NO: 493599 - RNA, 19 nt, Homo sapiens
guauaugcaugcucauugu

SEQ ID NO: 493600 - RNA, 19 nt, Homo sapiens
ggaggaaauugugaaaaua

SEQ ID NO: 493601 - RNA, 19 nt, Homo sapiens
cugaaccauugccauauua

SEQ ID NO: 493602 - RNA, 19 nt, Homo sapiens
gcugcucuauuuaaugaaa

SEQ ID NO: 493603 - RNA, 19 nt, Homo sapiens
ggaaauacggaaccuuuag

SEQ ID NO: 493604 - RNA, 19 nt, Homo sapiens
gaaccucaagaaugacuuu

SEQ ID NO: 493605 - RNA, 19 nt, Homo sapiens
gguagcaucugugacuuga

SEQ ID NO: 493606 - RNA, 19 nt, Homo sapiens
gugcugacaugucugaaau

SEQ ID NO: 493607 - RNA, 19 nt, Homo sapiens
ucuuguaucucaucucaaa

SEQ ID NO: 493608 - RNA, 19 nt, Homo sapiens
gaacaggagguaucaaacu

SEQ ID NO: 493609 - RNA, 19 nt, Homo sapiens
ugacgauucaugaguguua

SEQ ID NO: 493610 - RNA, 19 nt, Homo sapiens
caacuacaggcaagaacua

SEQ ID NO: 493611 - RNA, 19 nt, Homo sapiens
cccaauggcuuaucuuaca

SEQ ID NO: 493612 - RNA, 19 nt, Homo sapiens
gaugagccauuacaguauc

SEQ ID NO: 493613 - RNA, 19 nt, Homo sapiens
uagcaucugugacuugaau

SEQ ID NO: 493614 - RNA, 19 nt, Homo sapiens
gacaaggcacuucaugauu

SEQ ID NO: 493615 - RNA, 19 nt, Homo sapiens
ccugaugauuccacagaua

SEQ ID NO: 493616 - RNA, 19 nt, Homo sapiens
gcaaagcaacagagugaau

SEQ ID NO: 493617 - RNA, 19 nt, Homo sapiens
acacuaauauggagcaagu

SEQ ID NO: 493618 - RNA, 19 nt, Homo sapiens
aacaggagguaucaaacua

SEQ ID NO: 493619 - RNA, 19 nt, Homo sapiens
cgugugaaccauccuaaua

SEQ ID NO: 493620 - RNA, 19 nt, Homo sapiens
uaacagaacaggagguauc

SEQ ID NO: 493621 - RNA, 19 nt, Homo sapiens
gaacuguggcuguauaugc

SEQ ID NO: 493622 - RNA, 19 nt, Homo sapiens
agaacaugauugagcuuaa

SEQ ID NO: 493623 - RNA, 19 nt, Homo sapiens
guaaguggcagcugcucua

SEQ ID NO: 493624 - RNA, 19 nt, Homo sapiens
uagagugauuggugguaua

SEQ ID NO: 493625 - RNA, 19 nt, Homo sapiens
gugcaaacagcguccauuu

SEQ ID NO: 493626 - RNA, 19 nt, Homo sapiens
gaaagcguuuauuguagag

SEQ ID NO: 493627 - RNA, 19 nt, Homo sapiens
guauguguguugaaacugu

SEQ ID NO: 493628 - RNA, 19 nt, Homo sapiens
cagaacaggagguaucaaa

SEQ ID NO: 493629 - RNA, 19 nt, Homo sapiens
cgacaaggcacuucaugau

SEQ ID NO: 493630 - RNA, 19 nt, Homo sapiens
gcugacaugucugaaauag

SEQ ID NO: 493631 - RNA, 19 nt, Homo sapiens
gugcugaaccauugccaua

SEQ ID NO: 493632 - RNA, 19 nt, Homo sapiens
ugugaaccauccuaauauu

SEQ ID NO: 493633 - RNA, 19 nt, Homo sapiens
gcaguuaucccgugugaac

SEQ ID NO: 493634 - RNA, 19 nt, Homo sapiens
gaaugccaacugccuauau

SEQ ID NO: 493635 - RNA, 19 nt, Homo sapiens
ggacagccaagacguagau

SEQ ID NO: 493636 - RNA, 19 nt, Homo sapiens
aggagcagaugagccauua

SEQ ID NO: 493637 - RNA, 19 nt, Homo sapiens
cggaaacccuuugaugaga

SEQ ID NO: 493638 - RNA, 19 nt, Homo sapiens
aagaggagccuuuggaguu

SEQ ID NO: 493639 - RNA, 19 nt, Homo sapiens
caugguggacauacaauuu

SEQ ID NO: 493640 - RNA, 19 nt, Homo sapiens
gaaacgacaaggcacuuca

SEQ ID NO: 493641 - RNA, 19 nt, Homo sapiens
acaguauccuugucaguau

SEQ ID NO: 493642 - RNA, 19 nt, Homo sapiens
gaguugguguuuacagugu

SEQ ID NO: 493643 - RNA, 19 nt, Homo sapiens
gcagaugagccauuacagu

SEQ ID NO: 493644 - RNA, 19 nt, Homo sapiens
gagcagaugagccauuaca

SEQ ID NO: 493645 - RNA, 19 nt, Homo sapiens
cgcaaugaguugguguuua

SEQ ID NO: 493646 - RNA, 19 nt, Homo sapiens
gaagucagcagcagaaacg

SEQ ID NO: 493647 - RNA, 19 nt, Homo sapiens
caacuagaggucaucagaa

SEQ ID NO: 493648 - RNA, 19 nt, Homo sapiens
uacacuggaucaccaacua

SEQ ID NO: 493649 - RNA, 19 nt, Homo sapiens
aaagcuaaguggagagcaa

SEQ ID NO: 493650 - RNA, 19 nt, Homo sapiens
ggagcaguguggagagcuu

SEQ ID NO: 493651 - RNA, 19 nt, Homo sapiens
caugauugagcuuaaauga

SEQ ID NO: 493652 - RNA, 19 nt, Homo sapiens
ggcagcugcucuauuuaau

SEQ ID NO: 493653 - RNA, 19 nt, Homo sapiens
cuacaaauacgaguaacaa

SEQ ID NO: 493654 - RNA, 19 nt, Homo sapiens
gcccuucaauggaggaaau

SEQ ID NO: 493655 - RNA, 19 nt, Homo sapiens
aaauuuaccuaagcccauu

SEQ ID NO: 493656 - RNA, 19 nt, Homo sapiens
cgaaucaugugggcuguuc

SEQ ID NO: 493657 - RNA, 19 nt, Homo sapiens
cagacacacaugaccaaua

SEQ ID NO: 493658 - RNA, 19 nt, Homo sapiens
cggaaauacggaaccuuua

SEQ ID NO: 493659 - RNA, 19 nt, Homo sapiens
gaacaaagaugaccauaac

SEQ ID NO: 493660 - RNA, 19 nt, Homo sapiens
ggaaagaacauaaagguaa

SEQ ID NO: 493661 - RNA, 19 nt, Homo sapiens
gguacaaccuuuauucuuu

SEQ ID NO: 493662 - RNA, 19 nt, Homo sapiens
ugagauggaucacauauuu

SEQ ID NO: 493663 - RNA, 19 nt, Homo sapiens
guagacaccucccugcuua

SEQ ID NO: 493664 - RNA, 19 nt, Homo sapiens
ccacuucuguccauauuua

SEQ ID NO: 493665 - RNA, 19 nt, Homo sapiens
gaauaugucugcuccuuuc

SEQ ID NO: 493666 - RNA, 19 nt, Homo sapiens
gauggagucuugcuauauu

SEQ ID NO: 493667 - RNA, 19 nt, Homo sapiens
aaacaagccugguaggaaa

SEQ ID NO: 493668 - RNA, 19 nt, Homo sapiens
gagauggagucuugcuaua

SEQ ID NO: 493669 - RNA, 19 nt, Homo sapiens
caccacaccuggcuaauuu

SEQ ID NO: 493670 - RNA, 19 nt, Homo sapiens
ccaaauccuucccaaguaa

SEQ ID NO: 493671 - RNA, 19 nt, Homo sapiens
guacaguggugccaucauu

SEQ ID NO: 493672 - RNA, 19 nt, Homo sapiens
acaagaagcucagcaagaa

SEQ ID NO: 493673 - RNA, 19 nt, Homo sapiens
ugaagggaaucacaucuuu

SEQ ID NO: 493674 - RNA, 19 nt, Homo sapiens
ccaaacauaugcacauuca

SEQ ID NO: 493675 - RNA, 19 nt, Homo sapiens
gcagagaaagggacaauga

SEQ ID NO: 493676 - RNA, 19 nt, Homo sapiens
gcuguaagaugucuguuug

SEQ ID NO: 493677 - RNA, 19 nt, Homo sapiens
cagaugaccuccugcaaga

SEQ ID NO: 493678 - RNA, 19 nt, Homo sapiens
ggaaagcuguuugcgauuc

SEQ ID NO: 493679 - RNA, 19 nt, Homo sapiens
gaacuaaagaagaucugua

SEQ ID NO: 493680 - RNA, 19 nt, Homo sapiens
gaagaauccuuuuguagaa

SEQ ID NO: 493681 - RNA, 19 nt, Homo sapiens
ucacuuagcagaaccuuaa

SEQ ID NO: 493682 - RNA, 19 nt, Homo sapiens
ggauguaucgggaagauuu

SEQ ID NO: 493683 - RNA, 19 nt, Homo sapiens
guaagaggcuggaguuguc

SEQ ID NO: 493684 - RNA, 19 nt, Homo sapiens
cccaauagcugcccauuuc

SEQ ID NO: 493685 - RNA, 19 nt, Homo sapiens
uggccaagcugcucaauga

SEQ ID NO: 493686 - RNA, 19 nt, Homo sapiens
gagaauaugucugcuccuu

SEQ ID NO: 493687 - RNA, 19 nt, Homo sapiens
gaaagggacaaugauagua

SEQ ID NO: 493688 - RNA, 19 nt, Homo sapiens
ugaaugggaucaugaaagu

SEQ ID NO: 493689 - RNA, 19 nt, Homo sapiens
caagaugguacaaccuuua

SEQ ID NO: 493690 - RNA, 19 nt, Homo sapiens
gggcaagucuuuaggucuu

SEQ ID NO: 493691 - RNA, 19 nt, Homo sapiens
gcgauucccuggacugguu

SEQ ID NO: 493692 - RNA, 19 nt, Homo sapiens
gcauuuggguaauuuagau

SEQ ID NO: 493693 - RNA, 19 nt, Homo sapiens
gaucuaaggcuguuugcuu

SEQ ID NO: 493694 - RNA, 19 nt, Homo sapiens
ggagguugguuuaaugcaa

SEQ ID NO: 493695 - RNA, 19 nt, Homo sapiens
gauccagccucacuucuag

SEQ ID NO: 493696 - RNA, 19 nt, Homo sapiens
gaaauaaccacugcaaguc

SEQ ID NO: 493697 - RNA, 19 nt, Homo sapiens
ccucauuucuccagauuau

SEQ ID NO: 493698 - RNA, 19 nt, Homo sapiens
ucaugaaaguagacaguuu

SEQ ID NO: 493699 - RNA, 19 nt, Homo sapiens
ggacugaaugggaucauga

SEQ ID NO: 493700 - RNA, 19 nt, Homo sapiens
uaaguaagguccaauucuc

SEQ ID NO: 493701 - RNA, 19 nt, Homo sapiens
gauaguagagugauaugga

SEQ ID NO: 493702 - RNA, 19 nt, Homo sapiens
cgucaacguuguacuguau

SEQ ID NO: 493703 - RNA, 19 nt, Homo sapiens
aagaauagcaucuguacaa

SEQ ID NO: 493704 - RNA, 19 nt, Homo sapiens
ggccugaguuauugagauu

SEQ ID NO: 493705 - RNA, 19 nt, Homo sapiens
gcacauucacuuagcagaa

SEQ ID NO: 493706 - RNA, 19 nt, Homo sapiens
cacaaaaccuguccuauga

SEQ ID NO: 493707 - RNA, 19 nt, Homo sapiens
cccaaauccuucccaagua

SEQ ID NO: 493708 - RNA, 19 nt, Homo sapiens
ggaccacaccgcagcguaa

SEQ ID NO: 493709 - RNA, 19 nt, Homo sapiens
gugggugugugacucuuua

SEQ ID NO: 493710 - RNA, 19 nt, Homo sapiens
acaccucccugcuuagaaa

SEQ ID NO: 493711 - RNA, 19 nt, Homo sapiens
gacaagaagcucagcaaga

SEQ ID NO: 493712 - RNA, 19 nt, Homo sapiens
guacauagugcauuguuuc

SEQ ID NO: 493713 - RNA, 19 nt, Homo sapiens
gaaaagagauaugggaaca

SEQ ID NO: 493714 - RNA, 19 nt, Homo sapiens
gcccagauugucuuaauuu

SEQ ID NO: 493715 - RNA, 19 nt, Homo sapiens
guacagacagagaauaugu

SEQ ID NO: 493716 - RNA, 19 nt, Homo sapiens
ugcaagaacucaucacugu

SEQ ID NO: 493717 - RNA, 19 nt, Homo sapiens
ucugaaaguuguacaugaa

SEQ ID NO: 493718 - RNA, 19 nt, Homo sapiens
caaugauaguagagugaua

SEQ ID NO: 493719 - RNA, 19 nt, Homo sapiens
gagaaagggacaaugauag

SEQ ID NO: 493720 - RNA, 19 nt, Homo sapiens
cauagugcauuguuucugu

SEQ ID NO: 493721 - RNA, 19 nt, Homo sapiens
gggaaagaacauaaaggua

SEQ ID NO: 493722 - RNA, 19 nt, Homo sapiens
gcuaugguguggacugaau

SEQ ID NO: 493723 - RNA, 19 nt, Homo sapiens
gagguugguuuaaugcaau

SEQ ID NO: 493724 - RNA, 19 nt, Homo sapiens
cgacaucacuguucaugcu

SEQ ID NO: 493725 - RNA, 19 nt, Homo sapiens
agagugauauggagcaaga

SEQ ID NO: 493726 - RNA, 19 nt, Homo sapiens
gaugaucaguggacagucu

SEQ ID NO: 493727 - RNA, 19 nt, Homo sapiens
ccuaugagauggagauuac

SEQ ID NO: 493728 - RNA, 19 nt, Homo sapiens
cauaaccacugaagggaau

SEQ ID NO: 493729 - RNA, 19 nt, Homo sapiens
uaugggaaauccaaucaga

SEQ ID NO: 493730 - RNA, 19 nt, Homo sapiens
agagaaagggacaaugaua

SEQ ID NO: 493731 - RNA, 19 nt, Homo sapiens
caaguaagaggcuggaguu

SEQ ID NO: 493732 - RNA, 19 nt, Homo sapiens
gaagcaaggcgguggacuu

SEQ ID NO: 493733 - RNA, 19 nt, Homo sapiens
cggcguaucuucaccaaca

SEQ ID NO: 493734 - RNA, 19 nt, Homo sapiens
gaugguacaaccuuuauuc

SEQ ID NO: 493735 - RNA, 19 nt, Homo sapiens
ucacaggugucagccauug

SEQ ID NO: 493736 - RNA, 19 nt, Homo sapiens
ugguagagauggagucuug

SEQ ID NO: 493737 - RNA, 19 nt, Homo sapiens
gaguuaggaaugagaagua

SEQ ID NO: 493738 - RNA, 19 nt, Homo sapiens
gacuugaacuuuccuggau

SEQ ID NO: 493739 - RNA, 19 nt, Homo sapiens
ggacaaauugcacagaagu

SEQ ID NO: 493740 - RNA, 19 nt, Homo sapiens
gcgguggacuugaacuuuc

SEQ ID NO: 493741 - RNA, 19 nt, Homo sapiens
ccggaugccuucccuaugu

SEQ ID NO: 493742 - RNA, 19 nt, Homo sapiens
agaauagcaucuguacaaa

SEQ ID NO: 493743 - RNA, 19 nt, Homo sapiens
gcuuuggccugaguuauug

SEQ ID NO: 493744 - RNA, 19 nt, Homo sapiens
uugcuugacuucaguuauu

SEQ ID NO: 493745 - RNA, 19 nt, Homo sapiens
ggccacuucuguccauauu

SEQ ID NO: 493746 - RNA, 19 nt, Homo sapiens
gaacuuugggaagccuuua

SEQ ID NO: 493747 - RNA, 19 nt, Homo sapiens
gccggucucucuaaauaug

SEQ ID NO: 493748 - RNA, 19 nt, Homo sapiens
cuguaugucugucauugua

SEQ ID NO: 493749 - RNA, 19 nt, Homo sapiens
ggauccagccucacuucua

SEQ ID NO: 493750 - RNA, 19 nt, Homo sapiens
gcacaaaaccuguccuaug

SEQ ID NO: 493751 - RNA, 19 nt, Homo sapiens
ugauauggagcaagagaua

SEQ ID NO: 493752 - RNA, 19 nt, Homo sapiens
gccagaugcugcagaguca

SEQ ID NO: 493753 - RNA, 19 nt, Homo sapiens
gaggauguaucgggaagau

SEQ ID NO: 493754 - RNA, 19 nt, Homo sapiens
uacuguaugugaugaauug

SEQ ID NO: 493755 - RNA, 19 nt, Homo sapiens
gcccagcacuuuccgucaa

SEQ ID NO: 493756 - RNA, 19 nt, Homo sapiens
acaagaugguacaaccuuu

SEQ ID NO: 493757 - RNA, 19 nt, Homo sapiens
uauggcagaugacaagaug

SEQ ID NO: 493758 - RNA, 19 nt, Homo sapiens
ggacaguaauaagaaugga

SEQ ID NO: 493759 - RNA, 19 nt, Homo sapiens
gaacucugcuugagaacua

SEQ ID NO: 493760 - RNA, 19 nt, Homo sapiens
gagcaaagccugcaacaaa

SEQ ID NO: 493761 - RNA, 19 nt, Homo sapiens
gcaaugagguauaucaacu

SEQ ID NO: 493762 - RNA, 19 nt, Homo sapiens
ugagguauaucaacuucuu

SEQ ID NO: 493763 - RNA, 19 nt, Homo sapiens
caagccaccacauuccuua

SEQ ID NO: 493764 - RNA, 19 nt, Homo sapiens
gaaugucaacagcgccuuu

SEQ ID NO: 493765 - RNA, 19 nt, Homo sapiens
ggaggcagcagaaugucaa

SEQ ID NO: 493766 - RNA, 19 nt, Homo sapiens
gguccaagccaccacauuc

SEQ ID NO: 493767 - RNA, 19 nt, Homo sapiens
ccacucacccuccagacaa

SEQ ID NO: 493768 - RNA, 19 nt, Homo sapiens
gguggaggcagcagaaugu

SEQ ID NO: 493769 - RNA, 19 nt, Homo sapiens
aaugagguauaucaacuuc

SEQ ID NO: 493770 - RNA, 19 nt, Homo sapiens
ggagcaaagccugcaacaa

SEQ ID NO: 493771 - RNA, 19 nt, Homo sapiens
caaugagguauaucaacuu

SEQ ID NO: 493772 - RNA, 19 nt, Homo sapiens
cacucacccuccagacaaa

SEQ ID NO: 493773 - RNA, 19 nt, Homo sapiens
gcaaagccugcaacaaacg

SEQ ID NO: 493774 - RNA, 19 nt, Homo sapiens
gccuggcaaugagguauau

SEQ ID NO: 493775 - RNA, 19 nt, Homo sapiens
acgcuucgccuggcaauga

SEQ ID NO: 493776 - RNA, 19 nt, Homo sapiens
gagcagaaauacuaaagaa

SEQ ID NO: 493777 - RNA, 19 nt, Homo sapiens
cagcacagaugcccgcuua

SEQ ID NO: 493778 - RNA, 19 nt, Homo sapiens
gcagaaauacuaaagaaga

SEQ ID NO: 493779 - RNA, 19 nt, Homo sapiens
ggaccgaauucuuauaaag

SEQ ID NO: 493780 - RNA, 19 nt, Homo sapiens
caagaaguuuagcuacaaa

SEQ ID NO: 493781 - RNA, 19 nt, Homo sapiens
caacaugacguuacucuuc

SEQ ID NO: 493782 - RNA, 19 nt, Homo sapiens
gcaaggaccgaauucuuau

SEQ ID NO: 493783 - RNA, 19 nt, Homo sapiens
agggacagaucauagauuu

SEQ ID NO: 493784 - RNA, 19 nt, Homo sapiens
gcaaacaccgacaagaaau

SEQ ID NO: 493785 - RNA, 19 nt, Homo sapiens
ucaucgagcucuacaagga

SEQ ID NO: 493786 - RNA, 19 nt, Homo sapiens
cacaagaggaccagauuaa

SEQ ID NO: 493787 - RNA, 19 nt, Homo sapiens
ggcaaacaccgacaagaaa

SEQ ID NO: 493788 - RNA, 19 nt, Homo sapiens
uuauaaagcugucaucaac

SEQ ID NO: 493789 - RNA, 19 nt, Homo sapiens
ggcauccacugcaacauga

SEQ ID NO: 493790 - RNA, 19 nt, Homo sapiens
acaagaaguuuagcuacaa

SEQ ID NO: 493791 - RNA, 19 nt, Homo sapiens
gaucagcaaggaccgaauu

SEQ ID NO: 493792 - RNA, 19 nt, Homo sapiens
ccgaguauccacagaagua

SEQ ID NO: 493793 - RNA, 19 nt, Homo sapiens
ucacaagaggaccagauua

SEQ ID NO: 493794 - RNA, 19 nt, Homo sapiens
ccagauggcuguggagaag

SEQ ID NO: 493795 - RNA, 19 nt, Homo sapiens
ugacguuacucuucuccuu

SEQ ID NO: 493796 - RNA, 19 nt, Homo sapiens
gagcagggacagaucauag

SEQ ID NO: 493797 - RNA, 19 nt, Homo sapiens
caacacgggcgagaucaaa

SEQ ID NO: 493798 - RNA, 19 nt, Homo sapiens
agcaaggaccgaauucuua

SEQ ID NO: 493799 - RNA, 19 nt, Homo sapiens
guuuggagcagaaauacua

SEQ ID NO: 493800 - RNA, 19 nt, Homo sapiens
uacaagaaguuuagcuaca

SEQ ID NO: 493801 - RNA, 19 nt, Homo sapiens
caaggaccgaauucuuaua

SEQ ID NO: 493802 - RNA, 19 nt, Homo sapiens
gacgggauccgcaaguuug

SEQ ID NO: 493803 - RNA, 19 nt, Homo sapiens
uggaccagcucaagcaguu

SEQ ID NO: 493804 - RNA, 19 nt, Homo sapiens
ggagcagaaauacuaaaga

SEQ ID NO: 493805 - RNA, 19 nt, Homo sapiens
uggcaaacaccgacaagaa

SEQ ID NO: 493806 - RNA, 19 nt, Homo sapiens
cagcaaggaccgaauucuu

SEQ ID NO: 493807 - RNA, 19 nt, Homo sapiens
caagaggaccagauuaaaa

SEQ ID NO: 493808 - RNA, 19 nt, Homo sapiens
ggagcagggacagaucaua

SEQ ID NO: 493809 - RNA, 19 nt, Homo sapiens
aaggaccgaauucuuauaa

SEQ ID NO: 493810 - RNA, 19 nt, Homo sapiens
gcagggacagaucauagau

SEQ ID NO: 493811 - RNA, 19 nt, Homo sapiens
gcuggugccugugcucuca

SEQ ID NO: 493812 - RNA, 19 nt, Homo sapiens
guuguuuggagcagaaaua

SEQ ID NO: 493813 - RNA, 19 nt, Homo sapiens
ugacgggauccgcaaguuu

SEQ ID NO: 493814 - RNA, 19 nt, Homo sapiens
gagaagucuuuccguuggu

SEQ ID NO: 493815 - RNA, 19 nt, Homo sapiens
ccacugcaacaugacguua

SEQ ID NO: 493816 - RNA, 19 nt, Homo sapiens
acaagaggaccagauuaaa

SEQ ID NO: 493817 - RNA, 19 nt, Homo sapiens
aauguucaaugcagagaau

SEQ ID NO: 493818 - RNA, 19 nt, Homo sapiens
gcaacacgggcgagaucaa

SEQ ID NO: 493819 - RNA, 19 nt, Homo sapiens
cuacaacuacuacaagaag

SEQ ID NO: 493820 - RNA, 19 nt, Homo sapiens
gagcggaugcugacagaac

SEQ ID NO: 493821 - RNA, 19 nt, Homo sapiens
guugggcgcauccuugauu

SEQ ID NO: 493822 - RNA, 19 nt, Homo sapiens
ucaucaaccugggaaggaa

SEQ ID NO: 493823 - RNA, 19 nt, Homo sapiens
ucaaugcagagaauggaaa

SEQ ID NO: 493824 - RNA, 19 nt, Homo sapiens
gaauguucaaugcagagaa

SEQ ID NO: 493825 - RNA, 19 nt, Homo sapiens
caaacaccgacaagaaauc

SEQ ID NO: 493826 - RNA, 19 nt, Homo sapiens
gcaacaugacguuacucuu

SEQ ID NO: 493827 - RNA, 19 nt, Homo sapiens
caaguuugccgcugaugca

SEQ ID NO: 493828 - RNA, 19 nt, Homo sapiens
ggccgaguauccacagaag

SEQ ID NO: 493829 - RNA, 19 nt, Homo sapiens
gaugcugacagaacgaaug

SEQ ID NO: 493830 - RNA, 19 nt, Homo sapiens
ccaccuggaugagaagucu

SEQ ID NO: 493831 - RNA, 19 nt, Homo sapiens
ccgacaagaaauccuauga

SEQ ID NO: 493832 - RNA, 19 nt, Homo sapiens
uggagcggaugcugacaga

SEQ ID NO: 493833 - RNA, 19 nt, Homo sapiens
agaagucuuuccguugguu

SEQ ID NO: 493834 - RNA, 19 nt, Homo sapiens
ccaccaacccgucccugau

SEQ ID NO: 493835 - RNA, 19 nt, Homo sapiens
augcagagaauggaaagua

SEQ ID NO: 493836 - RNA, 19 nt, Homo sapiens
cgacaagaaauccuaugag

SEQ ID NO: 493837 - RNA, 19 nt, Homo sapiens
acaccgacaagaaauccua

SEQ ID NO: 493838 - RNA, 19 nt, Homo sapiens
gaccgaauucuuauaaagc

SEQ ID NO: 493839 - RNA, 19 nt, Homo sapiens
gaccagcucaagcaguuca

SEQ ID NO: 493840 - RNA, 19 nt, Homo sapiens
ugcagagaauggaaaguag

SEQ ID NO: 493841 - RNA, 19 nt, Homo sapiens
cggcauccacugcaacaug

SEQ ID NO: 493842 - RNA, 19 nt, Homo sapiens
gggccgaguauccacagaa

SEQ ID NO: 493843 - RNA, 19 nt, Homo sapiens
aacaugacguuacucuucu

SEQ ID NO: 493844 - RNA, 19 nt, Homo sapiens
auaaagcugucaucaaccu

SEQ ID NO: 493845 - RNA, 19 nt, Homo sapiens
cuuauaaagcugucaucaa

SEQ ID NO: 493846 - RNA, 19 nt, Homo sapiens
aggaccgaauucuuauaaa

SEQ ID NO: 493847 - RNA, 19 nt, Homo sapiens
gucacaagaggaccagauu

SEQ ID NO: 493848 - RNA, 19 nt, Homo sapiens
caacauaacugaaggcaua

SEQ ID NO: 493849 - RNA, 19 nt, Homo sapiens
gaaagaugaucagcuauuu

SEQ ID NO: 493850 - RNA, 19 nt, Homo sapiens
uaaagacacucaaccagaa

SEQ ID NO: 493851 - RNA, 19 nt, Homo sapiens
caacagaaccagacaggua

SEQ ID NO: 493852 - RNA, 19 nt, Homo sapiens
ugagaaauguucagaaugu

SEQ ID NO: 493853 - RNA, 19 nt, Homo sapiens
uaccuucacucgaaacuua

SEQ ID NO: 493854 - RNA, 19 nt, Homo sapiens
aaucugagcuuauuucugu

SEQ ID NO: 493855 - RNA, 19 nt, Homo sapiens
ggaaguaggcguuaucuag

SEQ ID NO: 493856 - RNA, 19 nt, Homo sapiens
ggaaagaugaucagcuauu

SEQ ID NO: 493857 - RNA, 19 nt, Homo sapiens
gcagcugccuccaggauga

SEQ ID NO: 493858 - RNA, 19 nt, Homo sapiens
gagaaauguucagaaugua

SEQ ID NO: 493859 - RNA, 19 nt, Homo sapiens
gcccagaaguuuagggaaa

SEQ ID NO: 493860 - RNA, 19 nt, Homo sapiens
gggaaucucuggcaaaguc

SEQ ID NO: 493861 - RNA, 19 nt, Homo sapiens
gccgauaccuucacucgaa

SEQ ID NO: 493862 - RNA, 19 nt, Homo sapiens
guuccaagaugucuccuuu

SEQ ID NO: 493863 - RNA, 19 nt, Homo sapiens
gugggaaccuugucacauu

SEQ ID NO: 493864 - RNA, 19 nt, Homo sapiens
ccacagguauuuggaagaa

SEQ ID NO: 493865 - RNA, 19 nt, Homo sapiens
gggaaaagcugcaagaaau

SEQ ID NO: 493866 - RNA, 19 nt, Homo sapiens
gugagaaucugagcuuauu

SEQ ID NO: 493867 - RNA, 19 nt, Homo sapiens
caggaugaguuacuugaaa

SEQ ID NO: 493868 - RNA, 19 nt, Homo sapiens
gacaagagccacagguauu

SEQ ID NO: 493869 - RNA, 19 nt, Homo sapiens
gaaccacagcugcagagua

SEQ ID NO: 493870 - RNA, 19 nt, Homo sapiens
ggagcaggcugaccacauc

SEQ ID NO: 493871 - RNA, 19 nt, Homo sapiens
gcugugggcuccucagaga

SEQ ID NO: 493872 - RNA, 19 nt, Homo sapiens
gaaugaaagccuucucaga

SEQ ID NO: 493873 - RNA, 19 nt, Homo sapiens
cggaaaccguguguacuua

SEQ ID NO: 493874 - RNA, 19 nt, Homo sapiens
ccagacagguaacaucaug

SEQ ID NO: 493875 - RNA, 19 nt, Homo sapiens
gaaaccguguguacuuauc

SEQ ID NO: 493876 - RNA, 19 nt, Homo sapiens
ggacaagagccacagguau

SEQ ID NO: 493877 - RNA, 19 nt, Homo sapiens
acggaaagaugaucagcua

SEQ ID NO: 493878 - RNA, 19 nt, Homo sapiens
acucgaaacuuaacucuca

SEQ ID NO: 493879 - RNA, 19 nt, Homo sapiens
gagugagaaucugagcuua

SEQ ID NO: 493880 - RNA, 19 nt, Homo sapiens
gaaguaggcguuaucuagu

SEQ ID NO: 493881 - RNA, 19 nt, Homo sapiens
gaagccaacuauggaggaa

SEQ ID NO: 493882 - RNA, 19 nt, Homo sapiens
gacgggaucuauaacaaca

SEQ ID NO: 493883 - RNA, 19 nt, Homo sapiens
ggaugcaaacagccaguua

SEQ ID NO: 493884 - RNA, 19 nt, Homo sapiens
aaauuugccuugagugugu

SEQ ID NO: 493885 - RNA, 19 nt, Homo sapiens
gagaaucugagcuuauuuc

SEQ ID NO: 493886 - RNA, 19 nt, Homo sapiens
ggagggccuuguccaguuc

SEQ ID NO: 493887 - RNA, 19 nt, Homo sapiens
gaaccagacagguaacauc

SEQ ID NO: 493888 - RNA, 19 nt, Homo sapiens
ccuauggccugacccagaa

SEQ ID NO: 493889 - RNA, 19 nt, Homo sapiens
caagaaauaaagacacuca

SEQ ID NO: 493890 - RNA, 19 nt, Homo sapiens
gugacgggaucuauaacaa

SEQ ID NO: 493891 - RNA, 19 nt, Homo sapiens
ugcagaugcuccagaauga

SEQ ID NO: 493892 - RNA, 19 nt, Homo sapiens
gugggaauccucuacauug

SEQ ID NO: 493893 - RNA, 19 nt, Homo sapiens
gaaaagcugcaagaaauaa

SEQ ID NO: 493894 - RNA, 19 nt, Homo sapiens
uaaacacccuguagguucu

SEQ ID NO: 493895 - RNA, 19 nt, Homo sapiens
ggaaaagcugcaagaaaua

SEQ ID NO: 493896 - RNA, 19 nt, Homo sapiens
ugacuggauucuacaagau

SEQ ID NO: 493897 - RNA, 19 nt, Homo sapiens
ccuguagguucuugauauu

SEQ ID NO: 493898 - RNA, 19 nt, Homo sapiens
gaguacaaacacaggauuu

SEQ ID NO: 493899 - RNA, 19 nt, Homo sapiens
uguguuaccuccuuuccaa

SEQ ID NO: 493900 - RNA, 19 nt, Homo sapiens
ggaaaccguguguacuuau

SEQ ID NO: 493901 - RNA, 19 nt, Homo sapiens
gggacaagagccacaggua

SEQ ID NO: 493902 - RNA, 19 nt, Homo sapiens
gaaagugggaauccucuac

SEQ ID NO: 493903 - RNA, 19 nt, Homo sapiens
gccuacaguucgaagcuuu

SEQ ID NO: 493904 - RNA, 19 nt, Homo sapiens
ggcgaagcccagaaguuua

SEQ ID NO: 493905 - RNA, 19 nt, Homo sapiens
cagaauguacggaaagaug

SEQ ID NO: 493906 - RNA, 19 nt, Homo sapiens
ggaguacaaacacaggauu

SEQ ID NO: 493907 - RNA, 19 nt, Homo sapiens
cagaugcuccagaaugaaa

SEQ ID NO: 493908 - RNA, 19 nt, Homo sapiens
ggaaccuugucacauuugu

SEQ ID NO: 493909 - RNA, 19 nt, Homo sapiens
ugggaaccuugucacauuu

SEQ ID NO: 493910 - RNA, 19 nt, Homo sapiens
cuaaauggcugagcuucuc

SEQ ID NO: 493911 - RNA, 19 nt, Homo sapiens
gaucagcuauuuucaacau

SEQ ID NO: 493912 - RNA, 19 nt, Homo sapiens
ggaugaguuacuugaaauu

SEQ ID NO: 493913 - RNA, 19 nt, Homo sapiens
ccacauccucuuucuggaa

SEQ ID NO: 493914 - RNA, 19 nt, Homo sapiens
gcgaagcccagaaguuuag

SEQ ID NO: 493915 - RNA, 19 nt, Homo sapiens
ccaagaaggugggaaaaug

SEQ ID NO: 493916 - RNA, 19 nt, Homo sapiens
ccgccuucguugucaguua

SEQ ID NO: 493917 - RNA, 19 nt, Homo sapiens
ucacauuuguucucuacca

SEQ ID NO: 493918 - RNA, 19 nt, Homo sapiens
gcgggaaucucuggcaaag

SEQ ID NO: 493919 - RNA, 19 nt, Homo sapiens
cgauuucgcuuuccccuaa

SEQ ID NO: 493920 - RNA, 19 nt, Homo sapiens
cccuguagguucuugauau

SEQ ID NO: 493921 - RNA, 19 nt, Homo sapiens
cauaaacacccuguagguu

SEQ ID NO: 493922 - RNA, 19 nt, Homo sapiens
ggccagcacucugaaacug

SEQ ID NO: 493923 - RNA, 19 nt, Homo sapiens
cagacuuccuggaguacaa

SEQ ID NO: 493924 - RNA, 19 nt, Homo sapiens
gcucagugcuucucaucac

SEQ ID NO: 493925 - RNA, 19 nt, Homo sapiens
augcagacuuccuggagua

SEQ ID NO: 493926 - RNA, 19 nt, Homo sapiens
ugaguuacuugaaauuugc

SEQ ID NO: 493927 - RNA, 19 nt, Homo sapiens
acaagagccacagguauuu

SEQ ID NO: 493928 - RNA, 19 nt, Homo sapiens
cacccaggcuguggaggua

SEQ ID NO: 493929 - RNA, 19 nt, Homo sapiens
ugagugauucucugaguga

SEQ ID NO: 493930 - RNA, 19 nt, Homo sapiens
accagcagcucauggagaa

SEQ ID NO: 493931 - RNA, 19 nt, Homo sapiens
gaaccuugucacauuuguu

SEQ ID NO: 493932 - RNA, 19 nt, Homo sapiens
ggccaugccuacaguucga

SEQ ID NO: 493933 - RNA, 19 nt, Homo sapiens
cauguccauucucaccaua

SEQ ID NO: 493934 - RNA, 19 nt, Homo sapiens
ccgccucacugacuggauu

SEQ ID NO: 493935 - RNA, 19 nt, Homo sapiens
acagguauuuggaagaagu

SEQ ID NO: 493936 - RNA, 19 nt, Homo sapiens
gggugugcgugauggagaa

SEQ ID NO: 493937 - RNA, 19 nt, Homo sapiens
gcacucugaaacugagaaa

SEQ ID NO: 493938 - RNA, 19 nt, Homo sapiens
aggaugaguuacuugaaau

SEQ ID NO: 493939 - RNA, 19 nt, Homo sapiens
gucaacuccuggaccacua

SEQ ID NO: 493940 - RNA, 19 nt, Homo sapiens
gaaacuuaacucucauguc

SEQ ID NO: 493941 - RNA, 19 nt, Homo sapiens
ccgauaccuucacucgaaa

SEQ ID NO: 493942 - RNA, 19 nt, Homo sapiens
cugacuggauucuacaaga

SEQ ID NO: 493943 - RNA, 19 nt, Homo sapiens
gaauguacggaaagaugau

SEQ ID NO: 493944 - RNA, 19 nt, Homo sapiens
agaauguacggaaagauga

SEQ ID NO: 493945 - RNA, 19 nt, Homo sapiens
ugaguguguuaccuccuuu

SEQ ID NO: 493946 - RNA, 19 nt, Homo sapiens
ugaaauuugccuugagugu

SEQ ID NO: 493947 - RNA, 19 nt, Homo sapiens
gcagaugcuccagaaugaa

SEQ ID NO: 493948 - RNA, 19 nt, Homo sapiens
gcacaugcccuucacaaua

SEQ ID NO: 493949 - RNA, 19 nt, Homo sapiens
guaacuggcuuccuuuaaa

SEQ ID NO: 493950 - RNA, 19 nt, Homo sapiens
ggaaauggagcauggaaua

SEQ ID NO: 493951 - RNA, 19 nt, Homo sapiens
caaagaggcucaaugacuu

SEQ ID NO: 493952 - RNA, 19 nt, Homo sapiens
guuauagucuucacucaua

SEQ ID NO: 493953 - RNA, 19 nt, Homo sapiens
ccuaugagguugguuauua

SEQ ID NO: 493954 - RNA, 19 nt, Homo sapiens
cauaaacccuaauccauaa

SEQ ID NO: 493955 - RNA, 19 nt, Homo sapiens
ggaaagccauauaucuuau

SEQ ID NO: 493956 - RNA, 19 nt, Homo sapiens
caugaagucugucgcuaua

SEQ ID NO: 493957 - RNA, 19 nt, Homo sapiens
gcucaaagaggcucaauga

SEQ ID NO: 493958 - RNA, 19 nt, Homo sapiens
gagauugccuuccuauauc

SEQ ID NO: 493959 - RNA, 19 nt, Homo sapiens
ccauaaacccuaauccaua

SEQ ID NO: 493960 - RNA, 19 nt, Homo sapiens
gaaacaacgucuggccauu

SEQ ID NO: 493961 - RNA, 19 nt, Homo sapiens
gaacaacaaagucuugaug

SEQ ID NO: 493962 - RNA, 19 nt, Homo sapiens
ggaccugccucuccucguu

SEQ ID NO: 493963 - RNA, 19 nt, Homo sapiens
caagcacgauggagauuug

SEQ ID NO: 493964 - RNA, 19 nt, Homo sapiens
gacaggugcugcuggauga

SEQ ID NO: 493965 - RNA, 19 nt, Homo sapiens
uaaagaggcccuugaacaa

SEQ ID NO: 493966 - RNA, 19 nt, Homo sapiens
ugaagucugucgcuauaaa

SEQ ID NO: 493967 - RNA, 19 nt, Homo sapiens
gggcucagcuggucacugu

SEQ ID NO: 493968 - RNA, 19 nt, Homo sapiens
caggaggccuuacuuaugu

SEQ ID NO: 493969 - RNA, 19 nt, Homo sapiens
ggagcuaugcuaaguguuu

SEQ ID NO: 493970 - RNA, 19 nt, Homo sapiens
ccagagcuguuccugcuuu

SEQ ID NO: 493971 - RNA, 19 nt, Homo sapiens
cggaaagccauauaucuua

SEQ ID NO: 493972 - RNA, 19 nt, Homo sapiens
uaacuggcuuccuuuaaau

SEQ ID NO: 493973 - RNA, 19 nt, Homo sapiens
uaacagcuaccauuuauag

SEQ ID NO: 493974 - RNA, 19 nt, Homo sapiens
gaugauggcauuucuggaa

SEQ ID NO: 493975 - RNA, 19 nt, Homo sapiens
gaaaagcucugcugcucuu

SEQ ID NO: 493976 - RNA, 19 nt, Homo sapiens
gauaccacccugaugagua

SEQ ID NO: 493977 - RNA, 19 nt, Homo sapiens
ugagauugccuuccuauau

SEQ ID NO: 493978 - RNA, 19 nt, Homo sapiens
gaaauggagcauggaauau

SEQ ID NO: 493979 - RNA, 19 nt, Homo sapiens
acacaggccugacccuaga

SEQ ID NO: 493980 - RNA, 19 nt, Homo sapiens
ucguuuaucuguuguuuga

SEQ ID NO: 493981 - RNA, 19 nt, Homo sapiens
gagauaaccauaguugcua

SEQ ID NO: 493982 - RNA, 19 nt, Homo sapiens
cacaugcccuucacaauag

SEQ ID NO: 493983 - RNA, 19 nt, Homo sapiens
auaccacccugaugaguaa

SEQ ID NO: 493984 - RNA, 19 nt, Homo sapiens
gcggaaagccauauaucuu

SEQ ID NO: 493985 - RNA, 19 nt, Homo sapiens
uuaauucccuggugacuag

SEQ ID NO: 493986 - RNA, 19 nt, Homo sapiens
agacauuaaucccucacua

SEQ ID NO: 493987 - RNA, 19 nt, Homo sapiens
cacauacgaugauggcauu

SEQ ID NO: 493988 - RNA, 19 nt, Homo sapiens
ggaaacugaagcucaaaga

SEQ ID NO: 493989 - RNA, 19 nt, Homo sapiens
caagacgucuccuuugcau

SEQ ID NO: 493990 - RNA, 19 nt, Homo sapiens
gccgagggcuaauucauag

SEQ ID NO: 493991 - RNA, 19 nt, Homo sapiens
ggccgagggcuaauucaua

SEQ ID NO: 493992 - RNA, 19 nt, Homo sapiens
gcuaccauuuauagaguuu

SEQ ID NO: 493993 - RNA, 19 nt, Homo sapiens
gauagcuguuccugaguug

SEQ ID NO: 493994 - RNA, 19 nt, Homo sapiens
aaauggagcauggaauaua

SEQ ID NO: 493995 - RNA, 19 nt, Homo sapiens
ccaggaggccuuacuuaug

SEQ ID NO: 493996 - RNA, 19 nt, Homo sapiens
agacuuaacucaggguuca

SEQ ID NO: 493997 - RNA, 19 nt, Homo sapiens
accauuagcuucccucuuc

SEQ ID NO: 493998 - RNA, 19 nt, Homo sapiens
ccaacaccuuugugccuuu

SEQ ID NO: 493999 - RNA, 19 nt, Homo sapiens
cauggaauauacacagaug

SEQ ID NO: 494000 - RNA, 19 nt, Homo sapiens
aagaggcccuugaacaaug

SEQ ID NO: 494001 - RNA, 19 nt, Homo sapiens
gaguaacuggcuuccuuua

SEQ ID NO: 494002 - RNA, 19 nt, Homo sapiens
guauccagcuccacgacaa

SEQ ID NO: 494003 - RNA, 19 nt, Homo sapiens
ucaaugacuuucccaaggu

SEQ ID NO: 494004 - RNA, 19 nt, Homo sapiens
cuaccagugucugcuauuu

SEQ ID NO: 494005 - RNA, 19 nt, Homo sapiens
uuacuuaugucgucagucu

SEQ ID NO: 494006 - RNA, 19 nt, Homo sapiens
acaacaaagucuugaugug

SEQ ID NO: 494007 - RNA, 19 nt, Homo sapiens
uuacagaugaggaaacuga

SEQ ID NO: 494008 - RNA, 19 nt, Homo sapiens
cagcuaccauuuauagagu

SEQ ID NO: 494009 - RNA, 19 nt, Homo sapiens
guuuaucuguuguuugaga

SEQ ID NO: 494010 - RNA, 19 nt, Homo sapiens
gcaagcacgauggagauuu

SEQ ID NO: 494011 - RNA, 19 nt, Homo sapiens
gcagacccugguauacaua

SEQ ID NO: 494012 - RNA, 19 nt, Homo sapiens
cgaggagcaugaagucugu

SEQ ID NO: 494013 - RNA, 19 nt, Homo sapiens
guagcgagguugggagaga

SEQ ID NO: 494014 - RNA, 19 nt, Homo sapiens
gacauuaaucccucacuau

SEQ ID NO: 494015 - RNA, 19 nt, Homo sapiens
ucaaagaggcucaaugacu

SEQ ID NO: 494016 - RNA, 19 nt, Homo sapiens
caucagucguuuaucuguu

SEQ ID NO: 494017 - RNA, 19 nt, Homo sapiens
guaaaaguacccauuguuu

SEQ ID NO: 494018 - RNA, 19 nt, Homo sapiens
gagcuuugccuggugauga

SEQ ID NO: 494019 - RNA, 19 nt, Homo sapiens
agacgucuccuuugcauau

SEQ ID NO: 494020 - RNA, 19 nt, Homo sapiens
gcaugaagucugucgcuau

SEQ ID NO: 494021 - RNA, 19 nt, Homo sapiens
acccugacccaaucaauua

SEQ ID NO: 494022 - RNA, 19 nt, Homo sapiens
ggagauaaccauaguugcu

SEQ ID NO: 494023 - RNA, 19 nt, Homo sapiens
ggaggcugcuucaccuaca

SEQ ID NO: 494024 - RNA, 19 nt, Homo sapiens
acugugcgguuaccucuuu

SEQ ID NO: 494025 - RNA, 19 nt, Homo sapiens
caacaccuuugugccuuug

SEQ ID NO: 494026 - RNA, 19 nt, Homo sapiens
uaggagcuaugcuaagugu

SEQ ID NO: 494027 - RNA, 19 nt, Homo sapiens
cuaugagguugguuauuau

SEQ ID NO: 494028 - RNA, 19 nt, Homo sapiens
guaacagcuaccauuuaua

SEQ ID NO: 494029 - RNA, 19 nt, Homo sapiens
caacacccgccaucaggaa

SEQ ID NO: 494030 - RNA, 19 nt, Homo sapiens
caccaugucucgaaucaac

SEQ ID NO: 494031 - RNA, 19 nt, Homo sapiens
uccauaaucccaucaagaa

SEQ ID NO: 494032 - RNA, 19 nt, Homo sapiens
agauagcuguuccugaguu

SEQ ID NO: 494033 - RNA, 19 nt, Homo sapiens
gcuauaaagaggcccuuga

SEQ ID NO: 494034 - RNA, 19 nt, Homo sapiens
gccaggaccucgguuucuu

SEQ ID NO: 494035 - RNA, 19 nt, Homo sapiens
gaaacugaagcucaaagag

SEQ ID NO: 494036 - RNA, 19 nt, Homo sapiens
gcuuugaguuucccuagag

SEQ ID NO: 494037 - RNA, 19 nt, Homo sapiens
acauuaaucccucacuauu

SEQ ID NO: 494038 - RNA, 19 nt, Homo sapiens
auaaagaggcccuugaaca

SEQ ID NO: 494039 - RNA, 19 nt, Homo sapiens
ucaugugccucuucuccuu

SEQ ID NO: 494040 - RNA, 19 nt, Homo sapiens
ggugaacaacaaagucuug

SEQ ID NO: 494041 - RNA, 19 nt, Homo sapiens
gcagaccguucgcaguuuu

SEQ ID NO: 494042 - RNA, 19 nt, Homo sapiens
cagcggagaagguguacaa

SEQ ID NO: 494043 - RNA, 19 nt, Homo sapiens
ggagggacagagaacaguu

SEQ ID NO: 494044 - RNA, 19 nt, Homo sapiens
aaacaacgucuggccauug

SEQ ID NO: 494045 - RNA, 19 nt, Homo sapiens
acaguucccugauuaacag

SEQ ID NO: 494046 - RNA, 19 nt, Homo sapiens
ggaccaggugaacaacaaa

SEQ ID NO: 494047 - RNA, 19 nt, Homo sapiens
augaguaacuggcuuccuu

SEQ ID NO: 494048 - RNA, 19 nt, Homo sapiens
gcacaugcccuucacaaua

SEQ ID NO: 494049 - RNA, 19 nt, Homo sapiens
gaacaaagcaucaccaaca

SEQ ID NO: 494050 - RNA, 19 nt, Homo sapiens
guaacuggcuuccuuuaaa

SEQ ID NO: 494051 - RNA, 19 nt, Homo sapiens
gaacgaauauguggaacaa

SEQ ID NO: 494052 - RNA, 19 nt, Homo sapiens
ggaaauggagcauggaaua

SEQ ID NO: 494053 - RNA, 19 nt, Homo sapiens
gaaauugaggcaaauagua

SEQ ID NO: 494054 - RNA, 19 nt, Homo sapiens
ccaaauggauucucacuag

SEQ ID NO: 494055 - RNA, 19 nt, Homo sapiens
caugaagucugucgcuaua

SEQ ID NO: 494056 - RNA, 19 nt, Homo sapiens
ggaauaaugaguucaaaug

SEQ ID NO: 494057 - RNA, 19 nt, Homo sapiens
caaagcaucaccaacauuu

SEQ ID NO: 494058 - RNA, 19 nt, Homo sapiens
gaaacaacgucuggccauu

SEQ ID NO: 494059 - RNA, 19 nt, Homo sapiens
gaacaacaaagucuugaug

SEQ ID NO: 494060 - RNA, 19 nt, Homo sapiens
caauuaaacuguagcucaa

SEQ ID NO: 494061 - RNA, 19 nt, Homo sapiens
ggaccugccucuccucguu

SEQ ID NO: 494062 - RNA, 19 nt, Homo sapiens
gacaggugcugcuggauga

SEQ ID NO: 494063 - RNA, 19 nt, Homo sapiens
uaaagaggcccuugaacaa

SEQ ID NO: 494064 - RNA, 19 nt, Homo sapiens
ugaagucugucgcuauaaa

SEQ ID NO: 494065 - RNA, 19 nt, Homo sapiens
gggcucagcuggucacugu

SEQ ID NO: 494066 - RNA, 19 nt, Homo sapiens
uaacuggcuuccuuuaaau

SEQ ID NO: 494067 - RNA, 19 nt, Homo sapiens
uuacaccucuugcugguuu

SEQ ID NO: 494068 - RNA, 19 nt, Homo sapiens
uaggugggaucaugaguuu

SEQ ID NO: 494069 - RNA, 19 nt, Homo sapiens
ccaaagucguaucaaagaa

SEQ ID NO: 494070 - RNA, 19 nt, Homo sapiens
gauaccacccugaugagua

SEQ ID NO: 494071 - RNA, 19 nt, Homo sapiens
ccacugagaaagaauuaaa

SEQ ID NO: 494072 - RNA, 19 nt, Homo sapiens
agacgucaaucaccacuga

SEQ ID NO: 494073 - RNA, 19 nt, Homo sapiens
gaaauggagcauggaauau

SEQ ID NO: 494074 - RNA, 19 nt, Homo sapiens
agaaguggcugcagauugg

SEQ ID NO: 494075 - RNA, 19 nt, Homo sapiens
cacaugcccuucacaauag

SEQ ID NO: 494076 - RNA, 19 nt, Homo sapiens
auaccacccugaugaguaa

SEQ ID NO: 494077 - RNA, 19 nt, Homo sapiens
acagggaaauugaggcaaa

SEQ ID NO: 494078 - RNA, 19 nt, Homo sapiens
agacauuaaucccucacua

SEQ ID NO: 494079 - RNA, 19 nt, Homo sapiens
gaucaugaguuugcuuugg

SEQ ID NO: 494080 - RNA, 19 nt, Homo sapiens
caagacgucuccuuugcau

SEQ ID NO: 494081 - RNA, 19 nt, Homo sapiens
aaauggagcauggaauaua

SEQ ID NO: 494082 - RNA, 19 nt, Homo sapiens
ggaaauugaggcaaauagu

SEQ ID NO: 494083 - RNA, 19 nt, Homo sapiens
ggaaguucaugauauuuug

SEQ ID NO: 494084 - RNA, 19 nt, Homo sapiens
cauggaauauacacagaug

SEQ ID NO: 494085 - RNA, 19 nt, Homo sapiens
aagaggcccuugaacaaug

SEQ ID NO: 494086 - RNA, 19 nt, Homo sapiens
gaguaacuggcuuccuuua

SEQ ID NO: 494087 - RNA, 19 nt, Homo sapiens
gcaucaccaacauuuauuu

SEQ ID NO: 494088 - RNA, 19 nt, Homo sapiens
cuaguacaauuccuucaau

SEQ ID NO: 494089 - RNA, 19 nt, Homo sapiens
gcagacccugguauacaua

SEQ ID NO: 494090 - RNA, 19 nt, Homo sapiens
cgaggagcaugaagucugu

SEQ ID NO: 494091 - RNA, 19 nt, Homo sapiens
gacauuaaucccucacuau

SEQ ID NO: 494092 - RNA, 19 nt, Homo sapiens
acaacaaagucuugaugug

SEQ ID NO: 494093 - RNA, 19 nt, Homo sapiens
aaucaccacugagaaagaa

SEQ ID NO: 494094 - RNA, 19 nt, Homo sapiens
guuccucaguuuccaaaug

SEQ ID NO: 494095 - RNA, 19 nt, Homo sapiens
agacgucuccuuugcauau

SEQ ID NO: 494096 - RNA, 19 nt, Homo sapiens
gcaugaagucugucgcuau

SEQ ID NO: 494097 - RNA, 19 nt, Homo sapiens
uuacauccuuucccucuuc

SEQ ID NO: 494098 - RNA, 19 nt, Homo sapiens
ucaaaugaacgaauaugug

SEQ ID NO: 494099 - RNA, 19 nt, Homo sapiens
ggaggcugcuucaccuaca

SEQ ID NO: 494100 - RNA, 19 nt, Homo sapiens
aggcaaauaguacauguaa

SEQ ID NO: 494101 - RNA, 19 nt, Homo sapiens
acgaauauguggaacaaag

SEQ ID NO: 494102 - RNA, 19 nt, Homo sapiens
gccuuugguuccucaguuu

SEQ ID NO: 494103 - RNA, 19 nt, Homo sapiens
ggcaaauaguacauguaaa

SEQ ID NO: 494104 - RNA, 19 nt, Homo sapiens
aggaugaggugauggacaa

SEQ ID NO: 494105 - RNA, 19 nt, Homo sapiens
caacacccgccaucaggaa

SEQ ID NO: 494106 - RNA, 19 nt, Homo sapiens
caccaugucucgaaucaac

SEQ ID NO: 494107 - RNA, 19 nt, Homo sapiens
caaaauucuuagccuagua

SEQ ID NO: 494108 - RNA, 19 nt, Homo sapiens
caaagaaguggcugcagau

SEQ ID NO: 494109 - RNA, 19 nt, Homo sapiens
gcuauaaagaggcccuuga

SEQ ID NO: 494110 - RNA, 19 nt, Homo sapiens
gccaggaccucgguuucuu

SEQ ID NO: 494111 - RNA, 19 nt, Homo sapiens
gggaucaugaguuugcuuu

SEQ ID NO: 494112 - RNA, 19 nt, Homo sapiens
auaaagaggcccuugaaca

SEQ ID NO: 494113 - RNA, 19 nt, Homo sapiens
ucaugugccucuucuccuu

SEQ ID NO: 494114 - RNA, 19 nt, Homo sapiens
acauuaaucccucacuauu

SEQ ID NO: 494115 - RNA, 19 nt, Homo sapiens
ugaggcaaauaguacaugu

SEQ ID NO: 494116 - RNA, 19 nt, Homo sapiens
aagcaucaccaacauuuau

SEQ ID NO: 494117 - RNA, 19 nt, Homo sapiens
aaagcaucaccaacauuua

SEQ ID NO: 494118 - RNA, 19 nt, Homo sapiens
ggugaacaacaaagucuug

SEQ ID NO: 494119 - RNA, 19 nt, Homo sapiens
gcagaccguucgcaguuuu

SEQ ID NO: 494120 - RNA, 19 nt, Homo sapiens
cagcggagaagguguacaa

SEQ ID NO: 494121 - RNA, 19 nt, Homo sapiens
aaacaacgucuggccauug

SEQ ID NO: 494122 - RNA, 19 nt, Homo sapiens
gucaaucaccacugagaaa

SEQ ID NO: 494123 - RNA, 19 nt, Homo sapiens
aaagucguaucaaagaagu

SEQ ID NO: 494124 - RNA, 19 nt, Homo sapiens
caaagucguaucaaagaag

SEQ ID NO: 494125 - RNA, 19 nt, Homo sapiens
gaggcaaauaguacaugua

SEQ ID NO: 494126 - RNA, 19 nt, Homo sapiens
cuuuggaaguucaugauau

SEQ ID NO: 494127 - RNA, 19 nt, Homo sapiens
ggaccaggugaacaacaaa

SEQ ID NO: 494128 - RNA, 19 nt, Homo sapiens
augaguaacuggcuuccuu

SEQ ID NO: 494129 - RNA, 19 nt, Homo sapiens
caccacugagaaagaauua

SEQ ID NO: 494130 - RNA, 19 nt, Homo sapiens
ucacuaggugggaucauga

SEQ ID NO: 494131 - RNA, 19 nt, Homo sapiens
cccaaagucguaucaaaga

SEQ ID NO: 494132 - RNA, 19 nt, Homo sapiens
gaauauguggaacaaagca

SEQ ID NO: 494133 - RNA, 19 nt, Homo sapiens
gggaauaaugaguucaaau

SEQ ID NO: 494134 - RNA, 19 nt, Homo sapiens
gcacagccaggugguuuca

SEQ ID NO: 494135 - RNA, 19 nt, Homo sapiens
gaaaagcccaucucacagu

SEQ ID NO: 494136 - RNA, 19 nt, Homo sapiens
cuauaaagaggcccuugaa

SEQ ID NO: 494137 - RNA, 19 nt, Homo sapiens
guacaacacccgccaucag

SEQ ID NO: 494138 - RNA, 19 nt, Homo sapiens
cggcugagcucggauacca

SEQ ID NO: 494139 - RNA, 19 nt, Homo sapiens
ccagugccaucuucuucau

SEQ ID NO: 494140 - RNA, 19 nt, Homo sapiens
gaagucugucgcuauaaag

SEQ ID NO: 494141 - RNA, 19 nt, Homo sapiens
auuaaucccucacuauucu

SEQ ID NO: 494142 - RNA, 19 nt, Homo sapiens
uagcagcggagaaggugua

SEQ ID NO: 494143 - RNA, 19 nt, Homo sapiens
gcugguggacgcggcuuua

SEQ ID NO: 494144 - RNA, 19 nt, Homo sapiens
ucggauaccacccugauga

SEQ ID NO: 494145 - RNA, 19 nt, Homo sapiens
aaagaggcccuugaacaau

SEQ ID NO: 494146 - RNA, 19 nt, Homo sapiens
cauuaaucccucacuauuc

SEQ ID NO: 494147 - RNA, 19 nt, Homo sapiens
caaucaccacugagaaaga

SEQ ID NO: 494148 - RNA, 19 nt, Homo sapiens
ggagggcgcucaucaagua

SEQ ID NO: 494149 - RNA, 19 nt, Homo sapiens
gaaacacgauauuguacua

SEQ ID NO: 494150 - RNA, 19 nt, Homo sapiens
aaacuccacuguacacuua

SEQ ID NO: 494151 - RNA, 19 nt, Homo sapiens
ggcccaagcuucuguagua

SEQ ID NO: 494152 - RNA, 19 nt, Homo sapiens
ucaaguagcugcuggaugu

SEQ ID NO: 494153 - RNA, 19 nt, Homo sapiens
ggaggaaagugaaagugaa

SEQ ID NO: 494154 - RNA, 19 nt, Homo sapiens
gaauugcucugccuugugu

SEQ ID NO: 494155 - RNA, 19 nt, Homo sapiens
acacacaucuuauggcauu

SEQ ID NO: 494156 - RNA, 19 nt, Homo sapiens
uaacgggucuaaucgugua

SEQ ID NO: 494157 - RNA, 19 nt, Homo sapiens
caccaugccuggcuaauau

SEQ ID NO: 494158 - RNA, 19 nt, Homo sapiens
ucaccacaguuguauuuaa

SEQ ID NO: 494159 - RNA, 19 nt, Homo sapiens
gaaccauggugucaauaca

SEQ ID NO: 494160 - RNA, 19 nt, Homo sapiens
ggagguagcaggucuuuca

SEQ ID NO: 494161 - RNA, 19 nt, Homo sapiens
gcaccacacugcgagauga

SEQ ID NO: 494162 - RNA, 19 nt, Homo sapiens
gcaccuaucuggccaccau

SEQ ID NO: 494163 - RNA, 19 nt, Homo sapiens
gcaaggauucaaagaagaa

SEQ ID NO: 494164 - RNA, 19 nt, Homo sapiens
gaaagugaaaggaggaaga

SEQ ID NO: 494165 - RNA, 19 nt, Homo sapiens
acacagggcuauuccuuuc

SEQ ID NO: 494166 - RNA, 19 nt, Homo sapiens
gaauacauaggcacacauu

SEQ ID NO: 494167 - RNA, 19 nt, Homo sapiens
guauguggguuauagcuau

SEQ ID NO: 494168 - RNA, 19 nt, Homo sapiens
ggagcuugcuguguacaaa

SEQ ID NO: 494169 - RNA, 19 nt, Homo sapiens
ccaguccucuguucccuuu

SEQ ID NO: 494170 - RNA, 19 nt, Homo sapiens
ggacagugguucucaaaau

SEQ ID NO: 494171 - RNA, 19 nt, Homo sapiens
cauaucauguagcuucuga

SEQ ID NO: 494172 - RNA, 19 nt, Homo sapiens
gagaauacauaggcacaca

SEQ ID NO: 494173 - RNA, 19 nt, Homo sapiens
gcagugcaguggcaugauc

SEQ ID NO: 494174 - RNA, 19 nt, Homo sapiens
ccaaagugcugggauuaca

SEQ ID NO: 494175 - RNA, 19 nt, Homo sapiens
ccaaagugcugggauuaca

SEQ ID NO: 494176 - RNA, 19 nt, Homo sapiens
ccacaguuguauuuaagug

SEQ ID NO: 494177 - RNA, 19 nt, Homo sapiens
guucaccacaguuguauuu

SEQ ID NO: 494178 - RNA, 19 nt, Homo sapiens
uccaaucucucuccacuga

SEQ ID NO: 494179 - RNA, 19 nt, Homo sapiens
gaggaaagugaaagugaaa

SEQ ID NO: 494180 - RNA, 19 nt, Homo sapiens
cgccagaccuccucucaau

SEQ ID NO: 494181 - RNA, 19 nt, Homo sapiens
ggcgaaacacgauauugua

SEQ ID NO: 494182 - RNA, 19 nt, Homo sapiens
ucacugccauccuguggaa

SEQ ID NO: 494183 - RNA, 19 nt, Homo sapiens
gggccgagguuacauuugg

SEQ ID NO: 494184 - RNA, 19 nt, Homo sapiens
ugccucagcuucccgagua

SEQ ID NO: 494185 - RNA, 19 nt, Homo sapiens
caccacacccagugaauuu

SEQ ID NO: 494186 - RNA, 19 nt, Homo sapiens
ccuaaucccuccaaucucu

SEQ ID NO: 494187 - RNA, 19 nt, Homo sapiens
guagcucccuaaaauaaua

SEQ ID NO: 494188 - RNA, 19 nt, Homo sapiens
gaaagugaaagugaaagga

SEQ ID NO: 494189 - RNA, 19 nt, Homo sapiens
gcugcuggauguugacgaa

SEQ ID NO: 494190 - RNA, 19 nt, Homo sapiens
ucucaaugcucaucacaca

SEQ ID NO: 494191 - RNA, 19 nt, Homo sapiens
cggaguagcugggauuaca

SEQ ID NO: 494192 - RNA, 19 nt, Homo sapiens
ccaccaugccuggcuaaua

SEQ ID NO: 494193 - RNA, 19 nt, Homo sapiens
ccuaucaucugcuccuaau

SEQ ID NO: 494194 - RNA, 19 nt, Homo sapiens
gaggacagcguaggccuuu

SEQ ID NO: 494195 - RNA, 19 nt, Homo sapiens
ggucuaaucguguaggaau

SEQ ID NO: 494196 - RNA, 19 nt, Homo sapiens
gcuccucgcuguggcuuug

SEQ ID NO: 494197 - RNA, 19 nt, Homo sapiens
ccacuguacacuuauagaa

SEQ ID NO: 494198 - RNA, 19 nt, Homo sapiens
gccuacaguucaacccuuu

SEQ ID NO: 494199 - RNA, 19 nt, Homo sapiens
caccacaguuguauuuaag

SEQ ID NO: 494200 - RNA, 19 nt, Homo sapiens
gacagugguucucaaaauu

SEQ ID NO: 494201 - RNA, 19 nt, Homo sapiens
guggcaugaucuuggcuua

SEQ ID NO: 494202 - RNA, 19 nt, Homo sapiens
uguaguagcucccuaaaau

SEQ ID NO: 494203 - RNA, 19 nt, Homo sapiens
ggccaaauccauucuucuu

SEQ ID NO: 494204 - RNA, 19 nt, Homo sapiens
accauggugucaauacaua

SEQ ID NO: 494205 - RNA, 19 nt, Homo sapiens
aauaauacccuaucaucug

SEQ ID NO: 494206 - RNA, 19 nt, Homo sapiens
cccuggagcuugcugugua

SEQ ID NO: 494207 - RNA, 19 nt, Homo sapiens
gagugagacugggacaaga

SEQ ID NO: 494208 - RNA, 19 nt, Homo sapiens
gcuauuccuuuccuccaau

SEQ ID NO: 494209 - RNA, 19 nt, Homo sapiens
acuguacacuuauagaaug

SEQ ID NO: 494210 - RNA, 19 nt, Homo sapiens
cugaguggcuggaaugcuu

SEQ ID NO: 494211 - RNA, 19 nt, Homo sapiens
caaucucucuccacugagu

SEQ ID NO: 494212 - RNA, 19 nt, Homo sapiens
aaagaagaaagcagaguga

SEQ ID NO: 494213 - RNA, 19 nt, Homo sapiens
cugcaaggauucaaagaag

SEQ ID NO: 494214 - RNA, 19 nt, Homo sapiens
aagaugcucugcuggacuu

SEQ ID NO: 494215 - RNA, 19 nt, Homo sapiens
uaucauguagcuucugaaa

SEQ ID NO: 494216 - RNA, 19 nt, Homo sapiens
gaugccagcagcccaagaa

SEQ ID NO: 494217 - RNA, 19 nt, Homo sapiens
gagguuacauuuggagaac

SEQ ID NO: 494218 - RNA, 19 nt, Homo sapiens
gauggucucgaucuccuaa

SEQ ID NO: 494219 - RNA, 19 nt, Homo sapiens
guacacuuauagaaugaag

SEQ ID NO: 494220 - RNA, 19 nt, Homo sapiens
cugcuggacuugagcuuug

SEQ ID NO: 494221 - RNA, 19 nt, Homo sapiens
gcgguucaccacaguugua

SEQ ID NO: 494222 - RNA, 19 nt, Homo sapiens
gccucggccucccaaagua

SEQ ID NO: 494223 - RNA, 19 nt, Homo sapiens
acaccaggcccgagaaaug

SEQ ID NO: 494224 - RNA, 19 nt, Homo sapiens
gacuugagcuuugccuaca

SEQ ID NO: 494225 - RNA, 19 nt, Homo sapiens
gucuaaucguguaggaaua

SEQ ID NO: 494226 - RNA, 19 nt, Homo sapiens
ccgcggugaucgaguguug

SEQ ID NO: 494227 - RNA, 19 nt, Homo sapiens
ugccucagccucccaagua

SEQ ID NO: 494228 - RNA, 19 nt, Homo sapiens
ggaauugcucugccuugug

SEQ ID NO: 494229 - RNA, 19 nt, Homo sapiens
guguaggaauaaagcugua

SEQ ID NO: 494230 - RNA, 19 nt, Homo sapiens
gccaaauccauucuucuug

SEQ ID NO: 494231 - RNA, 19 nt, Homo sapiens
ccucgacccugagcucuau

SEQ ID NO: 494232 - RNA, 19 nt, Homo sapiens
uggguuauagcuaucaaua

SEQ ID NO: 494233 - RNA, 19 nt, Homo sapiens
cgcuaugccugucgaauuc

SEQ ID NO: 494234 - RNA, 19 nt, Homo sapiens
gcuggauguugacgaagga

SEQ ID NO: 494235 - RNA, 19 nt, Homo sapiens
ggaaagugaaagugaaagg

SEQ ID NO: 494236 - RNA, 19 nt, Homo sapiens
cagccucucugggcacuug

SEQ ID NO: 494237 - RNA, 19 nt, Homo sapiens
gaucgugugagucgucguu

SEQ ID NO: 494238 - RNA, 19 nt, Homo sapiens
ggaaccauggugucaauac

SEQ ID NO: 494239 - RNA, 19 nt, Homo sapiens
uacauaggcacacauucua

SEQ ID NO: 494240 - RNA, 19 nt, Homo sapiens
gguauguggguuauagcua

SEQ ID NO: 494241 - RNA, 19 nt, Homo sapiens
ggcaugaucuuggcuuacu

SEQ ID NO: 494242 - RNA, 19 nt, Homo sapiens
acacgauauuguacuaaca

SEQ ID NO: 494243 - RNA, 19 nt, Homo sapiens
ccaggcaccuucaccuaac

SEQ ID NO: 494244 - RNA, 19 nt, Homo sapiens
ugugagucgucguuaaaug

SEQ ID NO: 494245 - RNA, 19 nt, Homo sapiens
gcgaaacacgauauuguac

SEQ ID NO: 494246 - RNA, 19 nt, Homo sapiens
ggaagccaccaucaucucu

SEQ ID NO: 494247 - RNA, 19 nt, Homo sapiens
ccauacaccugccauaccu

SEQ ID NO: 494248 - RNA, 19 nt, Homo sapiens
gcaaguaaguagagauaga

SEQ ID NO: 494249 - RNA, 19 nt, Homo sapiens
ggaggaaagugaaagugaa

SEQ ID NO: 494250 - RNA, 19 nt, Homo sapiens
gaauugcucugccuugugu

SEQ ID NO: 494251 - RNA, 19 nt, Homo sapiens
ggaggcugcugguguggua

SEQ ID NO: 494252 - RNA, 19 nt, Homo sapiens
gcaaacugagggucucuua

SEQ ID NO: 494253 - RNA, 19 nt, Homo sapiens
gcaugcuacuuaaucuaua

SEQ ID NO: 494254 - RNA, 19 nt, Homo sapiens
gaaccuaggcuuggaauuc

SEQ ID NO: 494255 - RNA, 19 nt, Homo sapiens
gggcugggcugguaagugu

SEQ ID NO: 494256 - RNA, 19 nt, Homo sapiens
gcaccacacugcgagauga

SEQ ID NO: 494257 - RNA, 19 nt, Homo sapiens
gcaccuaucuggccaccau

SEQ ID NO: 494258 - RNA, 19 nt, Homo sapiens
guaaguagagauagaaaga

SEQ ID NO: 494259 - RNA, 19 nt, Homo sapiens
guuaaaaccuggcacuaua

SEQ ID NO: 494260 - RNA, 19 nt, Homo sapiens
gaaagugaaaggaggaaga

SEQ ID NO: 494261 - RNA, 19 nt, Homo sapiens
gggcaaguaaguagagaua

SEQ ID NO: 494262 - RNA, 19 nt, Homo sapiens
gcaagccacauauguaaau

SEQ ID NO: 494263 - RNA, 19 nt, Homo sapiens
gauaaugcaagccacauau

SEQ ID NO: 494264 - RNA, 19 nt, Homo sapiens
ccaccucucuguaucuuuc

SEQ ID NO: 494265 - RNA, 19 nt, Homo sapiens
gaggaaagugaaagugaaa

SEQ ID NO: 494266 - RNA, 19 nt, Homo sapiens
ggacugauuucccuaugcu

SEQ ID NO: 494267 - RNA, 19 nt, Homo sapiens
ucuuugagcaugcuacuua

SEQ ID NO: 494268 - RNA, 19 nt, Homo sapiens
gaagacaggagcucacucu

SEQ ID NO: 494269 - RNA, 19 nt, Homo sapiens
gaaagugaaagugaaagga

SEQ ID NO: 494270 - RNA, 19 nt, Homo sapiens
caagccacauauguaaauu

SEQ ID NO: 494271 - RNA, 19 nt, Homo sapiens
ggcacuauauccuaacugu

SEQ ID NO: 494272 - RNA, 19 nt, Homo sapiens
ggggagggaugauggauaa

SEQ ID NO: 494273 - RNA, 19 nt, Homo sapiens
gcugggagcucugcggaau

SEQ ID NO: 494274 - RNA, 19 nt, Homo sapiens
gagcaugcuacuuaaucua

SEQ ID NO: 494275 - RNA, 19 nt, Homo sapiens
gcacuauauccuaacugua

SEQ ID NO: 494276 - RNA, 19 nt, Homo sapiens
gaggacagcguaggccuuu

SEQ ID NO: 494277 - RNA, 19 nt, Homo sapiens
ucacacugaucuggguuaa

SEQ ID NO: 494278 - RNA, 19 nt, Homo sapiens
gaagccagcaggcaaacug

SEQ ID NO: 494279 - RNA, 19 nt, Homo sapiens
caaguaaguagagauagaa

SEQ ID NO: 494280 - RNA, 19 nt, Homo sapiens
gcuccucgcuguggcuuug

SEQ ID NO: 494281 - RNA, 19 nt, Homo sapiens
gagggaugauggauaagag

SEQ ID NO: 494282 - RNA, 19 nt, Homo sapiens
gccuacaguucaacccuuu

SEQ ID NO: 494283 - RNA, 19 nt, Homo sapiens
acacugaucuggguuaaaa

SEQ ID NO: 494284 - RNA, 19 nt, Homo sapiens
gaggaagccagcaggcaaa

SEQ ID NO: 494285 - RNA, 19 nt, Homo sapiens
ggagaagaaaccuaaccuu

SEQ ID NO: 494286 - RNA, 19 nt, Homo sapiens
guagagauagaaagagguu

SEQ ID NO: 494287 - RNA, 19 nt, Homo sapiens
ggagggaugauggauaaga

SEQ ID NO: 494288 - RNA, 19 nt, Homo sapiens
cccuggagcuugcugugua

SEQ ID NO: 494289 - RNA, 19 nt, Homo sapiens
gagugagacugggacaaga

SEQ ID NO: 494290 - RNA, 19 nt, Homo sapiens
cugcaaggauucaaagaag

SEQ ID NO: 494291 - RNA, 19 nt, Homo sapiens
ccucugcccuccaccucua

SEQ ID NO: 494292 - RNA, 19 nt, Homo sapiens
aagaugcucugcuggacuu

SEQ ID NO: 494293 - RNA, 19 nt, Homo sapiens
gcaaggauucaaagaaggu

SEQ ID NO: 494294 - RNA, 19 nt, Homo sapiens
ggagcucugcggaaucuga

SEQ ID NO: 494295 - RNA, 19 nt, Homo sapiens
gaugccagcagcccaagaa

SEQ ID NO: 494296 - RNA, 19 nt, Homo sapiens
cugcuggacuugagcuuug

SEQ ID NO: 494297 - RNA, 19 nt, Homo sapiens
ucccaucccuucucaaucu

SEQ ID NO: 494298 - RNA, 19 nt, Homo sapiens
gacauggguauuucuguga

SEQ ID NO: 494299 - RNA, 19 nt, Homo sapiens
gacuugagcuuugccuaca

SEQ ID NO: 494300 - RNA, 19 nt, Homo sapiens
ggcuuggaauucacacuga

SEQ ID NO: 494301 - RNA, 19 nt, Homo sapiens
ggaauugcucugccuugug

SEQ ID NO: 494302 - RNA, 19 nt, Homo sapiens
gcuuugacauggguauuuc

SEQ ID NO: 494303 - RNA, 19 nt, Homo sapiens
ccgcggugaucgaguguug

SEQ ID NO: 494304 - RNA, 19 nt, Homo sapiens
aaugcaagccacauaugua

SEQ ID NO: 494305 - RNA, 19 nt, Homo sapiens
gcagaaccuaggcuuggaa

SEQ ID NO: 494306 - RNA, 19 nt, Homo sapiens
cgcuaugccugucgaauuc

SEQ ID NO: 494307 - RNA, 19 nt, Homo sapiens
ccucgacccugagcucuau

SEQ ID NO: 494308 - RNA, 19 nt, Homo sapiens
ggaaagugaaagugaaagg

SEQ ID NO: 494309 - RNA, 19 nt, Homo sapiens
cacuauauccuaacuguag

SEQ ID NO: 494310 - RNA, 19 nt, Homo sapiens
cagccucucugggcacuug

SEQ ID NO: 494311 - RNA, 19 nt, Homo sapiens
gagggugggcacuggauug

SEQ ID NO: 494312 - RNA, 19 nt, Homo sapiens
aaccuaggcuuggaauuca

SEQ ID NO: 494313 - RNA, 19 nt, Homo sapiens
ugauuucccuaugcucauu

SEQ ID NO: 494314 - RNA, 19 nt, Homo sapiens
uaaugcaagccacauaugu

SEQ ID NO: 494315 - RNA, 19 nt, Homo sapiens
ccaggcaccuucaccuaac

SEQ ID NO: 494316 - RNA, 19 nt, Homo sapiens
ugagcaugcuacuuaaucu

SEQ ID NO: 494317 - RNA, 19 nt, Homo sapiens
uaaccuucuuuaguucuga

SEQ ID NO: 494318 - RNA, 19 nt, Homo sapiens
acucuaguacucacauuaa

SEQ ID NO: 494319 - RNA, 19 nt, Homo sapiens
ggcagaaccuaggcuugga

SEQ ID NO: 494320 - RNA, 19 nt, Homo sapiens
agacaggagcucacucuca

SEQ ID NO: 494321 - RNA, 19 nt, Homo sapiens
ccauacaccugccauaccu

SEQ ID NO: 494322 - RNA, 19 nt, Homo sapiens
ggucgcagcgccaugaagu

SEQ ID NO: 494323 - RNA, 19 nt, Homo sapiens
cggaauugcucugccuugu

SEQ ID NO: 494324 - RNA, 19 nt, Homo sapiens
aaugggaggcuagaaguuu

SEQ ID NO: 494325 - RNA, 19 nt, Homo sapiens
agauaaugcaagccacaua

SEQ ID NO: 494326 - RNA, 19 nt, Homo sapiens
gcucauuucguccucuuuc

SEQ ID NO: 494327 - RNA, 19 nt, Homo sapiens
aaacugagggucucuuagg

SEQ ID NO: 494328 - RNA, 19 nt, Homo sapiens
augcaagccacauauguaa

SEQ ID NO: 494329 - RNA, 19 nt, Homo sapiens
uggaggaaagugaaaguga

SEQ ID NO: 494330 - RNA, 19 nt, Homo sapiens
ccaccugcaaggauucaaa

SEQ ID NO: 494331 - RNA, 19 nt, Homo sapiens
ccaccauacaccugccaua

SEQ ID NO: 494332 - RNA, 19 nt, Homo sapiens
aaauaagcagaaacaggua

SEQ ID NO: 494333 - RNA, 19 nt, Homo sapiens
gugcuccaccucucuguau

SEQ ID NO: 494334 - RNA, 19 nt, Homo sapiens
caucccaucccuucucaau

SEQ ID NO: 494335 - RNA, 19 nt, Homo sapiens
gagccagcacccaggaaga

SEQ ID NO: 494336 - RNA, 19 nt, Homo sapiens
ugaggucacccuggaggua

SEQ ID NO: 494337 - RNA, 19 nt, Homo sapiens
gcaccuggguaagggacau

SEQ ID NO: 494338 - RNA, 19 nt, Homo sapiens
aagagguuccugggaguua

SEQ ID NO: 494339 - RNA, 19 nt, Homo sapiens
cuuugagcaugcuacuuaa

SEQ ID NO: 494340 - RNA, 19 nt, Homo sapiens
gcuuggaauucacacugau

SEQ ID NO: 494341 - RNA, 19 nt, Homo sapiens
cccaggcaccuucaccuaa

SEQ ID NO: 494342 - RNA, 19 nt, Homo sapiens
cuucuuuaguucugaggaa

SEQ ID NO: 494343 - RNA, 19 nt, Homo sapiens
cucuaguacucacauuaaa

SEQ ID NO: 494344 - RNA, 19 nt, Homo sapiens
uaacuguaggacucuuuga

SEQ ID NO: 494345 - RNA, 19 nt, Homo sapiens
ccugcaaggauucaaagaa

SEQ ID NO: 494346 - RNA, 19 nt, Homo sapiens
caucccuucucaaucuuuc

SEQ ID NO: 494347 - RNA, 19 nt, Homo sapiens
gcccuacccugaccaugac

SEQ ID NO: 494348 - RNA, 19 nt, Homo sapiens
ggaggaaagugaaagugaa

SEQ ID NO: 494349 - RNA, 19 nt, Homo sapiens
gaauugcucugccuugugu

SEQ ID NO: 494350 - RNA, 19 nt, Homo sapiens
gcaccacacugcgagauga

SEQ ID NO: 494351 - RNA, 19 nt, Homo sapiens
gcaccuaucuggccaccau

SEQ ID NO: 494352 - RNA, 19 nt, Homo sapiens
gaaagugaaaggaggaaga

SEQ ID NO: 494353 - RNA, 19 nt, Homo sapiens
ggagcuugcuguguacaaa

SEQ ID NO: 494354 - RNA, 19 nt, Homo sapiens
gaggaaagugaaagugaaa

SEQ ID NO: 494355 - RNA, 19 nt, Homo sapiens
gaaagugaaagugaaagga

SEQ ID NO: 494356 - RNA, 19 nt, Homo sapiens
gcugggagcucugcggaau

SEQ ID NO: 494357 - RNA, 19 nt, Homo sapiens
gccuacaguucaacccuuu

SEQ ID NO: 494358 - RNA, 19 nt, Homo sapiens
gcuccucgcuguggcuuug

SEQ ID NO: 494359 - RNA, 19 nt, Homo sapiens
cccuggagcuugcugugua

SEQ ID NO: 494360 - RNA, 19 nt, Homo sapiens
gagugagacugggacaaga

SEQ ID NO: 494361 - RNA, 19 nt, Homo sapiens
aagaugcucugcuggacuu

SEQ ID NO: 494362 - RNA, 19 nt, Homo sapiens
ggagcucugcggaaucuga

SEQ ID NO: 494363 - RNA, 19 nt, Homo sapiens
gaugccagcagcccaagaa

SEQ ID NO: 494364 - RNA, 19 nt, Homo sapiens
cugcuggacuugagcuuug

SEQ ID NO: 494365 - RNA, 19 nt, Homo sapiens
gacuugagcuuugccuaca

SEQ ID NO: 494366 - RNA, 19 nt, Homo sapiens
ggaauugcucugccuugug

SEQ ID NO: 494367 - RNA, 19 nt, Homo sapiens
ccgcggugaucgaguguug

SEQ ID NO: 494368 - RNA, 19 nt, Homo sapiens
cgcuaugccugucgaauuc

SEQ ID NO: 494369 - RNA, 19 nt, Homo sapiens
ccucgacccugagcucuau

SEQ ID NO: 494370 - RNA, 19 nt, Homo sapiens
cagccucucugggcacuug

SEQ ID NO: 494371 - RNA, 19 nt, Homo sapiens
ggaaagugaaagugaaagg

SEQ ID NO: 494372 - RNA, 19 nt, Homo sapiens
ccaggcaccuucaccuaac

SEQ ID NO: 494373 - RNA, 19 nt, Homo sapiens
ccauacaccugccauaccu

SEQ ID NO: 494374 - RNA, 19 nt, Homo sapiens
cggaauugcucugccuugu

SEQ ID NO: 494375 - RNA, 19 nt, Homo sapiens
ggucgcagcgccaugaagu

SEQ ID NO: 494376 - RNA, 19 nt, Homo sapiens
ccaccauacaccugccaua

SEQ ID NO: 494377 - RNA, 19 nt, Homo sapiens
uggaggaaagugaaaguga

SEQ ID NO: 494378 - RNA, 19 nt, Homo sapiens
ugaggucacccuggaggua

SEQ ID NO: 494379 - RNA, 19 nt, Homo sapiens
gcaccuggguaagggacau

SEQ ID NO: 494380 - RNA, 19 nt, Homo sapiens
cccaggcaccuucaccuaa

SEQ ID NO: 494381 - RNA, 19 nt, Homo sapiens
acgcuaugccugucgaauu

SEQ ID NO: 494382 - RNA, 19 nt, Homo sapiens
ggauggggcuuggcugaug

SEQ ID NO: 494383 - RNA, 19 nt, Homo sapiens
guacagaccuucauagaaa

SEQ ID NO: 494384 - RNA, 19 nt, Homo sapiens
ggaaaucagauacauguua

SEQ ID NO: 494385 - RNA, 19 nt, Homo sapiens
gaagcaagcccuuauaguu

SEQ ID NO: 494386 - RNA, 19 nt, Homo sapiens
gcaaucaagcuauuagaua

SEQ ID NO: 494387 - RNA, 19 nt, Homo sapiens
gagaauguauugcggauau

SEQ ID NO: 494388 - RNA, 19 nt, Homo sapiens
aagaugagcuucuaaaguu

SEQ ID NO: 494389 - RNA, 19 nt, Homo sapiens
ggacugaaauuacagaagu

SEQ ID NO: 494390 - RNA, 19 nt, Homo sapiens
aagaguagcuuccuauuga

SEQ ID NO: 494391 - RNA, 19 nt, Homo sapiens
agacauagguacuaauuug

SEQ ID NO: 494392 - RNA, 19 nt, Homo sapiens
ugaaugagcuaaauagugu

SEQ ID NO: 494393 - RNA, 19 nt, Homo sapiens
cgacaaaccgaccaauuua

SEQ ID NO: 494394 - RNA, 19 nt, Homo sapiens
gauagugucugcuucaaau

SEQ ID NO: 494395 - RNA, 19 nt, Homo sapiens
gguguuaacugagcuuaua

SEQ ID NO: 494396 - RNA, 19 nt, Homo sapiens
ccaaggaucuuuaucaagu

SEQ ID NO: 494397 - RNA, 19 nt, Homo sapiens
ugaaaugucugcuauaaag

SEQ ID NO: 494398 - RNA, 19 nt, Homo sapiens
gaagucagauucagagagu

SEQ ID NO: 494399 - RNA, 19 nt, Homo sapiens
caaagaagguguuauccau

SEQ ID NO: 494400 - RNA, 19 nt, Homo sapiens
cagcaaaucugauccaaca

SEQ ID NO: 494401 - RNA, 19 nt, Homo sapiens
ucacaguucuuucuucuga

SEQ ID NO: 494402 - RNA, 19 nt, Homo sapiens
gagagcauuucugaauuua

SEQ ID NO: 494403 - RNA, 19 nt, Homo sapiens
gaaugaagacucaguauag

SEQ ID NO: 494404 - RNA, 19 nt, Homo sapiens
caauauugcuuuccugaga

SEQ ID NO: 494405 - RNA, 19 nt, Homo sapiens
ucagaagacuuacuaugaa

SEQ ID NO: 494406 - RNA, 19 nt, Homo sapiens
ggaaugaagacucaguaua

SEQ ID NO: 494407 - RNA, 19 nt, Homo sapiens
agaaaucucugcucuuguu

SEQ ID NO: 494408 - RNA, 19 nt, Homo sapiens
uuagauggcuccaauaugu

SEQ ID NO: 494409 - RNA, 19 nt, Homo sapiens
uaaagagcauuguucaaga

SEQ ID NO: 494410 - RNA, 19 nt, Homo sapiens
gaaaugaacgugagggaau

SEQ ID NO: 494411 - RNA, 19 nt, Homo sapiens
gauauucugggcuaauuua

SEQ ID NO: 494412 - RNA, 19 nt, Homo sapiens
gagcauuguucaagaguau

SEQ ID NO: 494413 - RNA, 19 nt, Homo sapiens
ccuugaggcuuguauauuu

SEQ ID NO: 494414 - RNA, 19 nt, Homo sapiens
ucagggauguuauucauug

SEQ ID NO: 494415 - RNA, 19 nt, Homo sapiens
ggauuucagugguaccuuu

SEQ ID NO: 494416 - RNA, 19 nt, Homo sapiens
gcagagaacagagaaugua

SEQ ID NO: 494417 - RNA, 19 nt, Homo sapiens
aagaagguguuauccauuu

SEQ ID NO: 494418 - RNA, 19 nt, Homo sapiens
agagagcauuucugaauuu

SEQ ID NO: 494419 - RNA, 19 nt, Homo sapiens
aacccuaucuggagaguua

SEQ ID NO: 494420 - RNA, 19 nt, Homo sapiens
gaagacuuacuaugaauga

SEQ ID NO: 494421 - RNA, 19 nt, Homo sapiens
gaugaggugucuacuguuc

SEQ ID NO: 494422 - RNA, 19 nt, Homo sapiens
ggaaacggcccaagucugu

SEQ ID NO: 494423 - RNA, 19 nt, Homo sapiens
ggacguuuguguggaaauu

SEQ ID NO: 494424 - RNA, 19 nt, Homo sapiens
gagaacagagaauguauug

SEQ ID NO: 494425 - RNA, 19 nt, Homo sapiens
gaacuucauuguggacaga

SEQ ID NO: 494426 - RNA, 19 nt, Homo sapiens
gcuaugaauuugcuagaug

SEQ ID NO: 494427 - RNA, 19 nt, Homo sapiens
cagaagaaauaaagaguag

SEQ ID NO: 494428 - RNA, 19 nt, Homo sapiens
uaccaaagcuaaacaaucu

SEQ ID NO: 494429 - RNA, 19 nt, Homo sapiens
gaacaguggcuuccucuag

SEQ ID NO: 494430 - RNA, 19 nt, Homo sapiens
ggaaugccaagaagaauug

SEQ ID NO: 494431 - RNA, 19 nt, Homo sapiens
gaaacuaauucugaagcaa

SEQ ID NO: 494432 - RNA, 19 nt, Homo sapiens
uaagagagaagaccauuau

SEQ ID NO: 494433 - RNA, 19 nt, Homo sapiens
caagacauagguacuaauu

SEQ ID NO: 494434 - RNA, 19 nt, Homo sapiens
aagcaacacucagcugaua

SEQ ID NO: 494435 - RNA, 19 nt, Homo sapiens
caaaucugauccaacaguu

SEQ ID NO: 494436 - RNA, 19 nt, Homo sapiens
ggaauuauugacaggauuu

SEQ ID NO: 494437 - RNA, 19 nt, Homo sapiens
gagagaagaccauuaugug

SEQ ID NO: 494438 - RNA, 19 nt, Homo sapiens
ucaagaguauguuaaguca

SEQ ID NO: 494439 - RNA, 19 nt, Homo sapiens
caauaugucccacaaguug

SEQ ID NO: 494440 - RNA, 19 nt, Homo sapiens
cggcaaauauuguuaugga

SEQ ID NO: 494441 - RNA, 19 nt, Homo sapiens
ggaauuccagcaaaucuga

SEQ ID NO: 494442 - RNA, 19 nt, Homo sapiens
uguaaaguguuaaguguug

SEQ ID NO: 494443 - RNA, 19 nt, Homo sapiens
cagaggagcagagcaguua

SEQ ID NO: 494444 - RNA, 19 nt, Homo sapiens
gaaagcagagaacagagaa

SEQ ID NO: 494445 - RNA, 19 nt, Homo sapiens
ggagaaaacugcuuuaugc

SEQ ID NO: 494446 - RNA, 19 nt, Homo sapiens
gagcagggaaugccaagaa

SEQ ID NO: 494447 - RNA, 19 nt, Homo sapiens
ucaaagacuuguucaggau

SEQ ID NO: 494448 - RNA, 19 nt, Homo sapiens
gacauggcguggaaaauua

SEQ ID NO: 494449 - RNA, 19 nt, Homo sapiens
gaacacaugcagguugaaa

SEQ ID NO: 494450 - RNA, 19 nt, Homo sapiens
gacuguguguaaaguguua

SEQ ID NO: 494451 - RNA, 19 nt, Homo sapiens
gaugugccuuccuuaguga

SEQ ID NO: 494452 - RNA, 19 nt, Homo sapiens
aagaaacucuggacugugu

SEQ ID NO: 494453 - RNA, 19 nt, Homo sapiens
gaaggaaacggcccaaguc

SEQ ID NO: 494454 - RNA, 19 nt, Homo sapiens
acacucagcugauauucug

SEQ ID NO: 494455 - RNA, 19 nt, Homo sapiens
gcaacacucagcugauauu

SEQ ID NO: 494456 - RNA, 19 nt, Homo sapiens
ggaaagcagagaacagaga

SEQ ID NO: 494457 - RNA, 19 nt, Homo sapiens
guaaagagcauuguucaag

SEQ ID NO: 494458 - RNA, 19 nt, Homo sapiens
uuucugaugucucaacuuu

SEQ ID NO: 494459 - RNA, 19 nt, Homo sapiens
ggaacaaacugccaaaagu

SEQ ID NO: 494460 - RNA, 19 nt, Homo sapiens
ccaaaguucugggauuguu

SEQ ID NO: 494461 - RNA, 19 nt, Homo sapiens
ucaagggccaggcauauuu

SEQ ID NO: 494462 - RNA, 19 nt, Homo sapiens
uggaugugcuuaugaaguu

SEQ ID NO: 494463 - RNA, 19 nt, Homo sapiens
cuucauaaauucccucaau

SEQ ID NO: 494464 - RNA, 19 nt, Homo sapiens
agaagaccauuaugugaga

SEQ ID NO: 494465 - RNA, 19 nt, Homo sapiens
ucaaaugugucccaaggau

SEQ ID NO: 494466 - RNA, 19 nt, Homo sapiens
cagaagacuuacuaugaau

SEQ ID NO: 494467 - RNA, 19 nt, Homo sapiens
ggacuaaagaaacagauuc

SEQ ID NO: 494468 - RNA, 19 nt, Homo sapiens
gaaggaaaucagauacaug

SEQ ID NO: 494469 - RNA, 19 nt, Homo sapiens
caacaaucaagcauccaua

SEQ ID NO: 494470 - RNA, 19 nt, Homo sapiens
uauggagacuuuagaagga

SEQ ID NO: 494471 - RNA, 19 nt, Homo sapiens
acucaaggauuauugucua

SEQ ID NO: 494472 - RNA, 19 nt, Homo sapiens
uuaagaaacucuggacugu

SEQ ID NO: 494473 - RNA, 19 nt, Homo sapiens
aaauggauguuggcucuuu

SEQ ID NO: 494474 - RNA, 19 nt, Homo sapiens
gcuaaauaguguuucagau

SEQ ID NO: 494475 - RNA, 19 nt, Homo sapiens
ggacgaggaacuucauugu

SEQ ID NO: 494476 - RNA, 19 nt, Homo sapiens
ccagaagaaauaaagagua

SEQ ID NO: 494477 - RNA, 19 nt, Homo sapiens
gaagaaaacagaagguuau

SEQ ID NO: 494478 - RNA, 19 nt, Homo sapiens
gcuacuaugugaauucucu

SEQ ID NO: 494479 - RNA, 19 nt, Homo sapiens
gcuccaauaugucccacaa

SEQ ID NO: 494480 - RNA, 19 nt, Homo sapiens
gaaaugucugcuauaaaga

SEQ ID NO: 494481 - RNA, 19 nt, Homo sapiens
gugccucucuuuccuguug

SEQ ID NO: 494482 - RNA, 19 nt, Homo sapiens
ggauguacagaccuucaua

SEQ ID NO: 494483 - RNA, 19 nt, Homo sapiens
gaauaaauaugcugcuuug

SEQ ID NO: 494484 - RNA, 19 nt, Homo sapiens
gaugaccacuucuccauug

SEQ ID NO: 494485 - RNA, 19 nt, Homo sapiens
ucagcuaccuggauauuga

SEQ ID NO: 494486 - RNA, 19 nt, Homo sapiens
gaaauucaguaggagagaa

SEQ ID NO: 494487 - RNA, 19 nt, Homo sapiens
ggaauaaauaugcugcuuu

SEQ ID NO: 494488 - RNA, 19 nt, Homo sapiens
ggaagacgccuguguacga

SEQ ID NO: 494489 - RNA, 19 nt, Homo sapiens
gcaaagaauucaccaugac

SEQ ID NO: 494490 - RNA, 19 nt, Homo sapiens
gaugaugaaugggaaugaa

SEQ ID NO: 494491 - RNA, 19 nt, Homo sapiens
gaguggagcguuucauuga

SEQ ID NO: 494492 - RNA, 19 nt, Homo sapiens
cagcuggacucauggaugu

SEQ ID NO: 494493 - RNA, 19 nt, Homo sapiens
gggauucucuacgaaauuc

SEQ ID NO: 494494 - RNA, 19 nt, Homo sapiens
ucauggaugugcacccuuu

SEQ ID NO: 494495 - RNA, 19 nt, Homo sapiens
cgcaaagaauucaccauga

SEQ ID NO: 494496 - RNA, 19 nt, Homo sapiens
gcaagaaggcagccaagca

SEQ ID NO: 494497 - RNA, 19 nt, Homo sapiens
cacgucagcuaccuggaua

SEQ ID NO: 494498 - RNA, 19 nt, Homo sapiens
acuagagccuggaauaaau

SEQ ID NO: 494499 - RNA, 19 nt, Homo sapiens
guggagcguuucauugaga

SEQ ID NO: 494500 - RNA, 19 nt, Homo sapiens
ggaguaugggaccagaaua

SEQ ID NO: 494501 - RNA, 19 nt, Homo sapiens
uaucugcgcagcucuggua

SEQ ID NO: 494502 - RNA, 19 nt, Homo sapiens
cuagagccuggaauaaaua

SEQ ID NO: 494503 - RNA, 19 nt, Homo sapiens
caccugggauucucuacga

SEQ ID NO: 494504 - RNA, 19 nt, Homo sapiens
cuacuagagccuggaauaa

SEQ ID NO: 494505 - RNA, 19 nt, Homo sapiens
gaguaugggaccagaauag

SEQ ID NO: 494506 - RNA, 19 nt, Homo sapiens
auaaauaugcugcuuugug

SEQ ID NO: 494507 - RNA, 19 nt, Homo sapiens
cgaguggagcguuucauug

SEQ ID NO: 494508 - RNA, 19 nt, Homo sapiens
gccaagcccaccagccuaa

SEQ ID NO: 494509 - RNA, 19 nt, Homo sapiens
gaaggcagccaagcacaag

SEQ ID NO: 494510 - RNA, 19 nt, Homo sapiens
uagggaagacgccugugua

SEQ ID NO: 494511 - RNA, 19 nt, Homo sapiens
uaugcugcuuuguggauuu

SEQ ID NO: 494512 - RNA, 19 nt, Homo sapiens
gauccguccucauuuuauu

SEQ ID NO: 494513 - RNA, 19 nt, Homo sapiens
cagacugccugccuugaag

SEQ ID NO: 494514 - RNA, 19 nt, Homo sapiens
uacuagagccuggaauaaa

SEQ ID NO: 494515 - RNA, 19 nt, Homo sapiens
ucagccuucugcaggagua

SEQ ID NO: 494516 - RNA, 19 nt, Homo sapiens
gcccugcaguaccucaaga

SEQ ID NO: 494517 - RNA, 19 nt, Homo sapiens
gagcguuucauugagauug

SEQ ID NO: 494518 - RNA, 19 nt, Homo sapiens
uggaauaaauaugcugcuu

SEQ ID NO: 494519 - RNA, 19 nt, Homo sapiens
ugcaguaccucaagaucau

SEQ ID NO: 494520 - RNA, 19 nt, Homo sapiens
ugucauggcucugcaacca

SEQ ID NO: 494521 - RNA, 19 nt, Homo sapiens
gcuccgugcccaaagcaaa

SEQ ID NO: 494522 - RNA, 19 nt, Homo sapiens
caagcccaccagccuaauu

SEQ ID NO: 494523 - RNA, 19 nt, Homo sapiens
gaugaaugggaaugaaauc

SEQ ID NO: 494524 - RNA, 19 nt, Homo sapiens
gguggagccugaugaugac

SEQ ID NO: 494525 - RNA, 19 nt, Homo sapiens
gagccuggaauaaauaugc

SEQ ID NO: 494526 - RNA, 19 nt, Homo sapiens
ccugaggacauuccgguuu

SEQ ID NO: 494527 - RNA, 19 nt, Homo sapiens
uguacgaccuucucaaagc

SEQ ID NO: 494528 - RNA, 19 nt, Homo sapiens
aagcccaccagccuaauuu

SEQ ID NO: 494529 - RNA, 19 nt, Homo sapiens
gcugccguguccucaguga

SEQ ID NO: 494530 - RNA, 19 nt, Homo sapiens
uguguacgaccuucucaaa

SEQ ID NO: 494531 - RNA, 19 nt, Homo sapiens
agguggagccugaugauga

SEQ ID NO: 494532 - RNA, 19 nt, Homo sapiens
uauuggugaugaugaaugg

SEQ ID NO: 494533 - RNA, 19 nt, Homo sapiens
cugaggagcaggccuuuca

SEQ ID NO: 494534 - RNA, 19 nt, Homo sapiens
ccugucgaguggagcguuu

SEQ ID NO: 494535 - RNA, 19 nt, Homo sapiens
cauggcaggcagcaaguga

SEQ ID NO: 494536 - RNA, 19 nt, Homo sapiens
gaauaaauaugcugcuuug

SEQ ID NO: 494537 - RNA, 19 nt, Homo sapiens
gauggaggcucacgaagua

SEQ ID NO: 494538 - RNA, 19 nt, Homo sapiens
gaugaccacuucuccauug

SEQ ID NO: 494539 - RNA, 19 nt, Homo sapiens
gcucuuggguucuguaguu

SEQ ID NO: 494540 - RNA, 19 nt, Homo sapiens
ucagcuaccuggauauuga

SEQ ID NO: 494541 - RNA, 19 nt, Homo sapiens
gaaauucaguaggagagaa

SEQ ID NO: 494542 - RNA, 19 nt, Homo sapiens
ggaauaaauaugcugcuuu

SEQ ID NO: 494543 - RNA, 19 nt, Homo sapiens
ggaagacgccuguguacga

SEQ ID NO: 494544 - RNA, 19 nt, Homo sapiens
gcaaagaauucaccaugac

SEQ ID NO: 494545 - RNA, 19 nt, Homo sapiens
gaugaugaaugggaaugaa

SEQ ID NO: 494546 - RNA, 19 nt, Homo sapiens
gaguggagcguuucauuga

SEQ ID NO: 494547 - RNA, 19 nt, Homo sapiens
ggacgguauuacaaacaaa

SEQ ID NO: 494548 - RNA, 19 nt, Homo sapiens
gaaggaggcgggacgguau

SEQ ID NO: 494549 - RNA, 19 nt, Homo sapiens
cagcuggacucauggaugu

SEQ ID NO: 494550 - RNA, 19 nt, Homo sapiens
gcucgucggcuguguauug

SEQ ID NO: 494551 - RNA, 19 nt, Homo sapiens
guacgcauguccacagcuu

SEQ ID NO: 494552 - RNA, 19 nt, Homo sapiens
gggauucucuacgaaauuc

SEQ ID NO: 494553 - RNA, 19 nt, Homo sapiens
gcugcgggcugccuaguau

SEQ ID NO: 494554 - RNA, 19 nt, Homo sapiens
ucauggaugugcacccuuu

SEQ ID NO: 494555 - RNA, 19 nt, Homo sapiens
cgcaaagaauucaccauga

SEQ ID NO: 494556 - RNA, 19 nt, Homo sapiens
gcaagaaggcagccaagca

SEQ ID NO: 494557 - RNA, 19 nt, Homo sapiens
cacgucagcuaccuggaua

SEQ ID NO: 494558 - RNA, 19 nt, Homo sapiens
gggacgguauuacaaacaa

SEQ ID NO: 494559 - RNA, 19 nt, Homo sapiens
acuagagccuggaauaaau

SEQ ID NO: 494560 - RNA, 19 nt, Homo sapiens
guggagcguuucauugaga

SEQ ID NO: 494561 - RNA, 19 nt, Homo sapiens
ggaguaugggaccagaaua

SEQ ID NO: 494562 - RNA, 19 nt, Homo sapiens
uaucugcgcagcucuggua

SEQ ID NO: 494563 - RNA, 19 nt, Homo sapiens
cuagagccuggaauaaaua

SEQ ID NO: 494564 - RNA, 19 nt, Homo sapiens
caccugggauucucuacga

SEQ ID NO: 494565 - RNA, 19 nt, Homo sapiens
cuacuagagccuggaauaa

SEQ ID NO: 494566 - RNA, 19 nt, Homo sapiens
gaguaugggaccagaauag

SEQ ID NO: 494567 - RNA, 19 nt, Homo sapiens
auaaauaugcugcuuugug

SEQ ID NO: 494568 - RNA, 19 nt, Homo sapiens
cgaguggagcguuucauug

SEQ ID NO: 494569 - RNA, 19 nt, Homo sapiens
gccaagcccaccagccuaa

SEQ ID NO: 494570 - RNA, 19 nt, Homo sapiens
ccagauggaggcucacgaa

SEQ ID NO: 494571 - RNA, 19 nt, Homo sapiens
gugcccaagugaguccuua

SEQ ID NO: 494572 - RNA, 19 nt, Homo sapiens
gaaggcagccaagcacaag

SEQ ID NO: 494573 - RNA, 19 nt, Homo sapiens
uagggaagacgccugugua

SEQ ID NO: 494574 - RNA, 19 nt, Homo sapiens
uaugcugcuuuguggauuu

SEQ ID NO: 494575 - RNA, 19 nt, Homo sapiens
gauccguccucauuuuauu

SEQ ID NO: 494576 - RNA, 19 nt, Homo sapiens
cagacugccugccuugaag

SEQ ID NO: 494577 - RNA, 19 nt, Homo sapiens
gaggagggaaugagugaag

SEQ ID NO: 494578 - RNA, 19 nt, Homo sapiens
uacuagagccuggaauaaa

SEQ ID NO: 494579 - RNA, 19 nt, Homo sapiens
gcccugcaguaccucaaga

SEQ ID NO: 494580 - RNA, 19 nt, Homo sapiens
gagcguuucauugagauug

SEQ ID NO: 494581 - RNA, 19 nt, Homo sapiens
ucagccuucugcaggagua

SEQ ID NO: 494582 - RNA, 19 nt, Homo sapiens
uggaauaaauaugcugcuu

SEQ ID NO: 494583 - RNA, 19 nt, Homo sapiens
ugcaguaccucaagaucau

SEQ ID NO: 494584 - RNA, 19 nt, Homo sapiens
ugucauggcucugcaacca

SEQ ID NO: 494585 - RNA, 19 nt, Homo sapiens
caagcccaccagccuaauu

SEQ ID NO: 494586 - RNA, 19 nt, Homo sapiens
gaugaaugggaaugaaauc

SEQ ID NO: 494587 - RNA, 19 nt, Homo sapiens
gguggagccugaugaugac

SEQ ID NO: 494588 - RNA, 19 nt, Homo sapiens
gagccuggaauaaauaugc

SEQ ID NO: 494589 - RNA, 19 nt, Homo sapiens
ccugaggacauuccgguuu

SEQ ID NO: 494590 - RNA, 19 nt, Homo sapiens
aagcccaccagccuaauuu

SEQ ID NO: 494591 - RNA, 19 nt, Homo sapiens
uguacgaccuucucaaagc

SEQ ID NO: 494592 - RNA, 19 nt, Homo sapiens
gcgggacgguauuacaaac

SEQ ID NO: 494593 - RNA, 19 nt, Homo sapiens
gcugccguguccucaguga

SEQ ID NO: 494594 - RNA, 19 nt, Homo sapiens
agguggagccugaugauga

SEQ ID NO: 494595 - RNA, 19 nt, Homo sapiens
uguguacgaccuucucaaa

SEQ ID NO: 494596 - RNA, 19 nt, Homo sapiens
ggcgggacgguauuacaaa

SEQ ID NO: 494597 - RNA, 19 nt, Homo sapiens
ggacggaggagggaaugag

SEQ ID NO: 494598 - RNA, 19 nt, Homo sapiens
cggaggagggaaugaguga

SEQ ID NO: 494599 - RNA, 19 nt, Homo sapiens
uauuggugaugaugaaugg

SEQ ID NO: 494600 - RNA, 19 nt, Homo sapiens
cugaggagcaggccuuuca

SEQ ID NO: 494601 - RNA, 19 nt, Homo sapiens
ccugucgaguggagcguuu

SEQ ID NO: 494602 - RNA, 19 nt, Homo sapiens
cauggcaggcagcaaguga

SEQ ID NO: 494603 - RNA, 19 nt, Homo sapiens
gaauaaauaugcugcuuug

SEQ ID NO: 494604 - RNA, 19 nt, Homo sapiens
gauggaggcucacgaagua

SEQ ID NO: 494605 - RNA, 19 nt, Homo sapiens
gaugaccacuucuccauug

SEQ ID NO: 494606 - RNA, 19 nt, Homo sapiens
gcucuuggguucuguaguu

SEQ ID NO: 494607 - RNA, 19 nt, Homo sapiens
ucagcuaccuggauauuga

SEQ ID NO: 494608 - RNA, 19 nt, Homo sapiens
gaaauucaguaggagagaa

SEQ ID NO: 494609 - RNA, 19 nt, Homo sapiens
ggaauaaauaugcugcuuu

SEQ ID NO: 494610 - RNA, 19 nt, Homo sapiens
ggaagacgccuguguacga

SEQ ID NO: 494611 - RNA, 19 nt, Homo sapiens
gcaaagaauucaccaugac

SEQ ID NO: 494612 - RNA, 19 nt, Homo sapiens
gaugaugaaugggaaugaa

SEQ ID NO: 494613 - RNA, 19 nt, Homo sapiens
gaguggagcguuucauuga

SEQ ID NO: 494614 - RNA, 19 nt, Homo sapiens
ggacgguauuacaaacaaa

SEQ ID NO: 494615 - RNA, 19 nt, Homo sapiens
gaaggaggcgggacgguau

SEQ ID NO: 494616 - RNA, 19 nt, Homo sapiens
cagcuggacucauggaugu

SEQ ID NO: 494617 - RNA, 19 nt, Homo sapiens
gcucgucggcuguguauug

SEQ ID NO: 494618 - RNA, 19 nt, Homo sapiens
guacgcauguccacagcuu

SEQ ID NO: 494619 - RNA, 19 nt, Homo sapiens
gggauucucuacgaaauuc

SEQ ID NO: 494620 - RNA, 19 nt, Homo sapiens
gcugcgggcugccuaguau

SEQ ID NO: 494621 - RNA, 19 nt, Homo sapiens
ucauggaugugcacccuuu

SEQ ID NO: 494622 - RNA, 19 nt, Homo sapiens
cgcaaagaauucaccauga

SEQ ID NO: 494623 - RNA, 19 nt, Homo sapiens
gcaagaaggcagccaagca

SEQ ID NO: 494624 - RNA, 19 nt, Homo sapiens
cacgucagcuaccuggaua

SEQ ID NO: 494625 - RNA, 19 nt, Homo sapiens
gggacgguauuacaaacaa

SEQ ID NO: 494626 - RNA, 19 nt, Homo sapiens
acuagagccuggaauaaau

SEQ ID NO: 494627 - RNA, 19 nt, Homo sapiens
guggagcguuucauugaga

SEQ ID NO: 494628 - RNA, 19 nt, Homo sapiens
gaggacagcagacucuuca

SEQ ID NO: 494629 - RNA, 19 nt, Homo sapiens
ggaguaugggaccagaaua

SEQ ID NO: 494630 - RNA, 19 nt, Homo sapiens
uaucugcgcagcucuggua

SEQ ID NO: 494631 - RNA, 19 nt, Homo sapiens
cuagagccuggaauaaaua

SEQ ID NO: 494632 - RNA, 19 nt, Homo sapiens
caccugggauucucuacga

SEQ ID NO: 494633 - RNA, 19 nt, Homo sapiens
cuacuagagccuggaauaa

SEQ ID NO: 494634 - RNA, 19 nt, Homo sapiens
gaguaugggaccagaauag

SEQ ID NO: 494635 - RNA, 19 nt, Homo sapiens
auaaauaugcugcuuugug

SEQ ID NO: 494636 - RNA, 19 nt, Homo sapiens
cgaguggagcguuucauug

SEQ ID NO: 494637 - RNA, 19 nt, Homo sapiens
gccaagcccaccagccuaa

SEQ ID NO: 494638 - RNA, 19 nt, Homo sapiens
ccagauggaggcucacgaa

SEQ ID NO: 494639 - RNA, 19 nt, Homo sapiens
gugcccaagugaguccuua

SEQ ID NO: 494640 - RNA, 19 nt, Homo sapiens
gaaggcagccaagcacaag

SEQ ID NO: 494641 - RNA, 19 nt, Homo sapiens
uagggaagacgccugugua

SEQ ID NO: 494642 - RNA, 19 nt, Homo sapiens
uaugcugcuuuguggauuu

SEQ ID NO: 494643 - RNA, 19 nt, Homo sapiens
gauccguccucauuuuauu

SEQ ID NO: 494644 - RNA, 19 nt, Homo sapiens
cagacugccugccuugaag

SEQ ID NO: 494645 - RNA, 19 nt, Homo sapiens
ggacagcagacucuucacu

SEQ ID NO: 494646 - RNA, 19 nt, Homo sapiens
gaggagggaaugagugaag

SEQ ID NO: 494647 - RNA, 19 nt, Homo sapiens
uacuagagccuggaauaaa

SEQ ID NO: 494648 - RNA, 19 nt, Homo sapiens
gcccugcaguaccucaaga

SEQ ID NO: 494649 - RNA, 19 nt, Homo sapiens
gagcguuucauugagauug

SEQ ID NO: 494650 - RNA, 19 nt, Homo sapiens
ggaggacagcagacucuuc

SEQ ID NO: 494651 - RNA, 19 nt, Homo sapiens
ucagccuucugcaggagua

SEQ ID NO: 494652 - RNA, 19 nt, Homo sapiens
uggaauaaauaugcugcuu

SEQ ID NO: 494653 - RNA, 19 nt, Homo sapiens
ugcaguaccucaagaucau

SEQ ID NO: 494654 - RNA, 19 nt, Homo sapiens
ugucauggcucugcaacca

SEQ ID NO: 494655 - RNA, 19 nt, Homo sapiens
caagcccaccagccuaauu

SEQ ID NO: 494656 - RNA, 19 nt, Homo sapiens
gaugaaugggaaugaaauc

SEQ ID NO: 494657 - RNA, 19 nt, Homo sapiens
gguggagccugaugaugac

SEQ ID NO: 494658 - RNA, 19 nt, Homo sapiens
gagccuggaauaaauaugc

SEQ ID NO: 494659 - RNA, 19 nt, Homo sapiens
ccugaggacauuccgguuu

SEQ ID NO: 494660 - RNA, 19 nt, Homo sapiens
aagcccaccagccuaauuu

SEQ ID NO: 494661 - RNA, 19 nt, Homo sapiens
uguacgaccuucucaaagc

SEQ ID NO: 494662 - RNA, 19 nt, Homo sapiens
gcgggacgguauuacaaac

SEQ ID NO: 494663 - RNA, 19 nt, Homo sapiens
gcugccguguccucaguga

SEQ ID NO: 494664 - RNA, 19 nt, Homo sapiens
agguggagccugaugauga

SEQ ID NO: 494665 - RNA, 19 nt, Homo sapiens
uguguacgaccuucucaaa

SEQ ID NO: 494666 - RNA, 19 nt, Homo sapiens
ggcgggacgguauuacaaa

SEQ ID NO: 494667 - RNA, 19 nt, Homo sapiens
ggacggaggagggaaugag

SEQ ID NO: 494668 - RNA, 19 nt, Homo sapiens
cggaggagggaaugaguga

SEQ ID NO: 494669 - RNA, 19 nt, Homo sapiens
uauuggugaugaugaaugg

SEQ ID NO: 494670 - RNA, 19 nt, Homo sapiens
cugaggagcaggccuuuca

SEQ ID NO: 494671 - RNA, 19 nt, Homo sapiens
ccugucgaguggagcguuu

SEQ ID NO: 494672 - RNA, 19 nt, Homo sapiens
cauggcaggcagcaaguga

SEQ ID NO: 494673 - RNA, 19 nt, Homo sapiens
gaggaaugcuuuaguguaa

SEQ ID NO: 494674 - RNA, 19 nt, Homo sapiens
aaagauagcaagccaauua

SEQ ID NO: 494675 - RNA, 19 nt, Homo sapiens
gauccaggcuguacauuga

SEQ ID NO: 494676 - RNA, 19 nt, Homo sapiens
gaacagcguuuccguaaaa

SEQ ID NO: 494677 - RNA, 19 nt, Homo sapiens
gauucgaaaugcacaguua

SEQ ID NO: 494678 - RNA, 19 nt, Homo sapiens
gcagauugaagaugaaaua

SEQ ID NO: 494679 - RNA, 19 nt, Homo sapiens
ggaugaugcucacauauuc

SEQ ID NO: 494680 - RNA, 19 nt, Homo sapiens
cagauuggcuccauggaaa

SEQ ID NO: 494681 - RNA, 19 nt, Homo sapiens
aaaccgagaucauaggaaa

SEQ ID NO: 494682 - RNA, 19 nt, Homo sapiens
gcaaugauuucucuucucu

SEQ ID NO: 494683 - RNA, 19 nt, Homo sapiens
acacacgucuugagaugua

SEQ ID NO: 494684 - RNA, 19 nt, Homo sapiens
ggaaugcuuuaguguaaug

SEQ ID NO: 494685 - RNA, 19 nt, Homo sapiens
gaaaaucacuggcacuguu

SEQ ID NO: 494686 - RNA, 19 nt, Homo sapiens
ggaccaaccugugaugaau

SEQ ID NO: 494687 - RNA, 19 nt, Homo sapiens
gcccaaagauugacauaca

SEQ ID NO: 494688 - RNA, 19 nt, Homo sapiens
gagaauuuauggcauuuca

SEQ ID NO: 494689 - RNA, 19 nt, Homo sapiens
ccagagaauuuauggcauu

SEQ ID NO: 494690 - RNA, 19 nt, Homo sapiens
ggaucaagcugagaaacaa

SEQ ID NO: 494691 - RNA, 19 nt, Homo sapiens
gcaaacaggcagaagaaga

SEQ ID NO: 494692 - RNA, 19 nt, Homo sapiens
gaaagagucuaugguggau

SEQ ID NO: 494693 - RNA, 19 nt, Homo sapiens
guuaaacucuggagaugga

SEQ ID NO: 494694 - RNA, 19 nt, Homo sapiens
aaacuuuacuggcaauguu

SEQ ID NO: 494695 - RNA, 19 nt, Homo sapiens
caacaccguuauugcuaaa

SEQ ID NO: 494696 - RNA, 19 nt, Homo sapiens
uagaauugguuauggugua

SEQ ID NO: 494697 - RNA, 19 nt, Homo sapiens
ggaccaagaacuauauuuc

SEQ ID NO: 494698 - RNA, 19 nt, Homo sapiens
caaacaggcagaagaagaa

SEQ ID NO: 494699 - RNA, 19 nt, Homo sapiens
gcagggaccaagaacuaua

SEQ ID NO: 494700 - RNA, 19 nt, Homo sapiens
gacuggaaguuaagaaaga

SEQ ID NO: 494701 - RNA, 19 nt, Homo sapiens
ggaccgcccucuggaagaa

SEQ ID NO: 494702 - RNA, 19 nt, Homo sapiens
ggcaaagucugaaauaggu

SEQ ID NO: 494703 - RNA, 19 nt, Homo sapiens
uugaaagacuggaaguuaa

SEQ ID NO: 494704 - RNA, 19 nt, Homo sapiens
gcacaguuagcacaguaua

SEQ ID NO: 494705 - RNA, 19 nt, Homo sapiens
gaaacaugaggaaugcuuu

SEQ ID NO: 494706 - RNA, 19 nt, Homo sapiens
uacagcagcucaaagaguu

SEQ ID NO: 494707 - RNA, 19 nt, Homo sapiens
guauauagcguauuuggau

SEQ ID NO: 494708 - RNA, 19 nt, Homo sapiens
acaggaugaugcucacaua

SEQ ID NO: 494709 - RNA, 19 nt, Homo sapiens
uggagcagauugaagauga

SEQ ID NO: 494710 - RNA, 19 nt, Homo sapiens
gaagauuccaacaggauga

SEQ ID NO: 494711 - RNA, 19 nt, Homo sapiens
gacaacaccguuauugcua

SEQ ID NO: 494712 - RNA, 19 nt, Homo sapiens
caugaggaaugcuuuagug

SEQ ID NO: 494713 - RNA, 19 nt, Homo sapiens
ccuuggagauaucgaagua

SEQ ID NO: 494714 - RNA, 19 nt, Homo sapiens
ugaaagagugggagaaguu

SEQ ID NO: 494715 - RNA, 19 nt, Homo sapiens
ucucuucucuggaggcuuu

SEQ ID NO: 494716 - RNA, 19 nt, Homo sapiens
ucacuuugccugaugguaa

SEQ ID NO: 494717 - RNA, 19 nt, Homo sapiens
uuacacacgucuugagaug

SEQ ID NO: 494718 - RNA, 19 nt, Homo sapiens
aaacaugaggaaugcuuua

SEQ ID NO: 494719 - RNA, 19 nt, Homo sapiens
aaacuaaaccuuucuacuc

SEQ ID NO: 494720 - RNA, 19 nt, Homo sapiens
ggagcuguuugcccugaaa

SEQ ID NO: 494721 - RNA, 19 nt, Homo sapiens
ugacauguaccucgaagaa

SEQ ID NO: 494722 - RNA, 19 nt, Homo sapiens
ggaagugaaacaugaggaa

SEQ ID NO: 494723 - RNA, 19 nt, Homo sapiens
ucaaagaguuccgcagcaa

SEQ ID NO: 494724 - RNA, 19 nt, Homo sapiens
gcugagaaacaacuugaaa

SEQ ID NO: 494725 - RNA, 19 nt, Homo sapiens
ggagcagauugaagaugaa

SEQ ID NO: 494726 - RNA, 19 nt, Homo sapiens
acaacaccguuauugcuaa

SEQ ID NO: 494727 - RNA, 19 nt, Homo sapiens
ggagauggagcuuucuaug

SEQ ID NO: 494728 - RNA, 19 nt, Homo sapiens
guuaauauccgcacaagag

SEQ ID NO: 494729 - RNA, 19 nt, Homo sapiens
ucacuggcacuguuaauau

SEQ ID NO: 494730 - RNA, 19 nt, Homo sapiens
aaacguacgacaacaauuc

SEQ ID NO: 494731 - RNA, 19 nt, Homo sapiens
uggaaagaaugauugcuau

SEQ ID NO: 494732 - RNA, 19 nt, Homo sapiens
gaagaacaaagaaggaucu

SEQ ID NO: 494733 - RNA, 19 nt, Homo sapiens
cagagaauuuauggcauuu

SEQ ID NO: 494734 - RNA, 19 nt, Homo sapiens
gauguggcccuuugauaga

SEQ ID NO: 494735 - RNA, 19 nt, Homo sapiens
cuauagauguggcccuuug

SEQ ID NO: 494736 - RNA, 19 nt, Homo sapiens
agucuaugguggauguuua

SEQ ID NO: 494737 - RNA, 19 nt, Homo sapiens
cagcaaacaggcagaagaa

SEQ ID NO: 494738 - RNA, 19 nt, Homo sapiens
gcagcaaacaggcagaaga

SEQ ID NO: 494739 - RNA, 19 nt, Homo sapiens
gcacaagagacaauaaggu

SEQ ID NO: 494740 - RNA, 19 nt, Homo sapiens
ugccggauauugaaugaaa

SEQ ID NO: 494741 - RNA, 19 nt, Homo sapiens
gauagcaagccaauuaaag

SEQ ID NO: 494742 - RNA, 19 nt, Homo sapiens
gaccaaccugugaugaaua

SEQ ID NO: 494743 - RNA, 19 nt, Homo sapiens
guggaaagaaugauugcua

SEQ ID NO: 494744 - RNA, 19 nt, Homo sapiens
ccaguugcccaucagauuu

SEQ ID NO: 494745 - RNA, 19 nt, Homo sapiens
gaaaacagucugaaugaau

SEQ ID NO: 494746 - RNA, 19 nt, Homo sapiens
guucaaaugccggauauug

SEQ ID NO: 494747 - RNA, 19 nt, Homo sapiens
agaauugguuaugguguaa

SEQ ID NO: 494748 - RNA, 19 nt, Homo sapiens
ugaggaaugcuuuagugua

SEQ ID NO: 494749 - RNA, 19 nt, Homo sapiens
gcacaguauaacuucauuu

SEQ ID NO: 494750 - RNA, 19 nt, Homo sapiens
aagcagauauggagacucu

SEQ ID NO: 494751 - RNA, 19 nt, Homo sapiens
ggaaggcaaagcagauaug

SEQ ID NO: 494752 - RNA, 19 nt, Homo sapiens
caaguucaaaugccggaua

SEQ ID NO: 494753 - RNA, 19 nt, Homo sapiens
cgucuugagauguauaaua

SEQ ID NO: 494754 - RNA, 19 nt, Homo sapiens
acaggcagaagaagaauuu

SEQ ID NO: 494755 - RNA, 19 nt, Homo sapiens
ccauggagcagauugaaga

SEQ ID NO: 494756 - RNA, 19 nt, Homo sapiens
caacuaccacagucuauag

SEQ ID NO: 494757 - RNA, 19 nt, Homo sapiens
gaaagacuggaaguuaaga

SEQ ID NO: 494758 - RNA, 19 nt, Homo sapiens
caaauucauggcagacauu

SEQ ID NO: 494759 - RNA, 19 nt, Homo sapiens
uggauucuauuaugacaug

SEQ ID NO: 494760 - RNA, 19 nt, Homo sapiens
gugaaggcauggaaagagu

SEQ ID NO: 494761 - RNA, 19 nt, Homo sapiens
gagauggagcuuucuaugg

SEQ ID NO: 494762 - RNA, 19 nt, Homo sapiens
gaaacaacuugaaaacagu

SEQ ID NO: 494763 - RNA, 19 nt, Homo sapiens
uuugaaagacuggaaguua

SEQ ID NO: 494764 - RNA, 19 nt, Homo sapiens
gauuggugcuggugaagag

SEQ ID NO: 494765 - RNA, 19 nt, Homo sapiens
ccaaauucauggcagacau

SEQ ID NO: 494766 - RNA, 19 nt, Homo sapiens
cuaccacagucuauagaug

SEQ ID NO: 494767 - RNA, 19 nt, Homo sapiens
ccaacuaccacagucuaua

SEQ ID NO: 494768 - RNA, 19 nt, Homo sapiens
caccguuauugcuaaagua

SEQ ID NO: 494769 - RNA, 19 nt, Homo sapiens
aaagagagccaauaaaaug

SEQ ID NO: 494770 - RNA, 19 nt, Homo sapiens
caaagaguuccgcagcaaa

SEQ ID NO: 494771 - RNA, 19 nt, Homo sapiens
ggaacgcaccauuucugaa

SEQ ID NO: 494772 - RNA, 19 nt, Homo sapiens
gggaacgcaccauuucuga

SEQ ID NO: 494773 - RNA, 19 nt, Homo sapiens
gaggaaugcuuuaguguaa

SEQ ID NO: 494774 - RNA, 19 nt, Homo sapiens
aaagauagcaagccaauua

SEQ ID NO: 494775 - RNA, 19 nt, Homo sapiens
gauccaggcuguacauuga

SEQ ID NO: 494776 - RNA, 19 nt, Homo sapiens
gaacagcguuuccguaaaa

SEQ ID NO: 494777 - RNA, 19 nt, Homo sapiens
gauucgaaaugcacaguua

SEQ ID NO: 494778 - RNA, 19 nt, Homo sapiens
gcagauugaagaugaaaua

SEQ ID NO: 494779 - RNA, 19 nt, Homo sapiens
ggaugaugcucacauauuc

SEQ ID NO: 494780 - RNA, 19 nt, Homo sapiens
cagauuggcuccauggaaa

SEQ ID NO: 494781 - RNA, 19 nt, Homo sapiens
aaaccgagaucauaggaaa

SEQ ID NO: 494782 - RNA, 19 nt, Homo sapiens
gcaaugauuucucuucucu

SEQ ID NO: 494783 - RNA, 19 nt, Homo sapiens
agaauuggauuauggugua

SEQ ID NO: 494784 - RNA, 19 nt, Homo sapiens
acacacgucuugagaugua

SEQ ID NO: 494785 - RNA, 19 nt, Homo sapiens
ggaaugcuuuaguguaaug

SEQ ID NO: 494786 - RNA, 19 nt, Homo sapiens
ggaccaaccugugaugaau

SEQ ID NO: 494787 - RNA, 19 nt, Homo sapiens
gcccaaagauugacauaca

SEQ ID NO: 494788 - RNA, 19 nt, Homo sapiens
gagaauuuauggcauuuca

SEQ ID NO: 494789 - RNA, 19 nt, Homo sapiens
ccagagaauuuauggcauu

SEQ ID NO: 494790 - RNA, 19 nt, Homo sapiens
ggaucaagcugagaaacaa

SEQ ID NO: 494791 - RNA, 19 nt, Homo sapiens
gcaaacaggcagaagaaga

SEQ ID NO: 494792 - RNA, 19 nt, Homo sapiens
gaaagagucuaugguggau

SEQ ID NO: 494793 - RNA, 19 nt, Homo sapiens
guuaaacucuggagaugga

SEQ ID NO: 494794 - RNA, 19 nt, Homo sapiens
aaacuuuacuggcaauguu

SEQ ID NO: 494795 - RNA, 19 nt, Homo sapiens
caacaccguuauugcuaaa

SEQ ID NO: 494796 - RNA, 19 nt, Homo sapiens
ggaccaagaacuauauuuc

SEQ ID NO: 494797 - RNA, 19 nt, Homo sapiens
caaacaggcagaagaagaa

SEQ ID NO: 494798 - RNA, 19 nt, Homo sapiens
gcagggaccaagaacuaua

SEQ ID NO: 494799 - RNA, 19 nt, Homo sapiens
gacuggaaguuaagaaaga

SEQ ID NO: 494800 - RNA, 19 nt, Homo sapiens
ggaccgcccucuggaagaa

SEQ ID NO: 494801 - RNA, 19 nt, Homo sapiens
uugaaagacuggaaguuaa

SEQ ID NO: 494802 - RNA, 19 nt, Homo sapiens
gcacaguuagcacaguaua

SEQ ID NO: 494803 - RNA, 19 nt, Homo sapiens
gaaacaugaggaaugcuuu

SEQ ID NO: 494804 - RNA, 19 nt, Homo sapiens
uacagcagcucaaagaguu

SEQ ID NO: 494805 - RNA, 19 nt, Homo sapiens
guauauagcguauuuggau

SEQ ID NO: 494806 - RNA, 19 nt, Homo sapiens
acaggaugaugcucacaua

SEQ ID NO: 494807 - RNA, 19 nt, Homo sapiens
gaauuggauuaugguguaa

SEQ ID NO: 494808 - RNA, 19 nt, Homo sapiens
uggagcagauugaagauga

SEQ ID NO: 494809 - RNA, 19 nt, Homo sapiens
gaagauuccaacaggauga

SEQ ID NO: 494810 - RNA, 19 nt, Homo sapiens
gacaacaccguuauugcua

SEQ ID NO: 494811 - RNA, 19 nt, Homo sapiens
caugaggaaugcuuuagug

SEQ ID NO: 494812 - RNA, 19 nt, Homo sapiens
ccuuggagauaucgaagua

SEQ ID NO: 494813 - RNA, 19 nt, Homo sapiens
ugaaagagugggagaaguu

SEQ ID NO: 494814 - RNA, 19 nt, Homo sapiens
ucucuucucuggaggcuuu

SEQ ID NO: 494815 - RNA, 19 nt, Homo sapiens
ucacuuugccugaugguaa

SEQ ID NO: 494816 - RNA, 19 nt, Homo sapiens
uuacacacgucuugagaug

SEQ ID NO: 494817 - RNA, 19 nt, Homo sapiens
aaacaugaggaaugcuuua

SEQ ID NO: 494818 - RNA, 19 nt, Homo sapiens
aaacuaaaccuuucuacuc

SEQ ID NO: 494819 - RNA, 19 nt, Homo sapiens
ggagcuguuugcccugaaa

SEQ ID NO: 494820 - RNA, 19 nt, Homo sapiens
ugacauguaccucgaagaa

SEQ ID NO: 494821 - RNA, 19 nt, Homo sapiens
ggaagugaaacaugaggaa

SEQ ID NO: 494822 - RNA, 19 nt, Homo sapiens
ucaaagaguuccgcagcaa

SEQ ID NO: 494823 - RNA, 19 nt, Homo sapiens
gcugagaaacaacuugaaa

SEQ ID NO: 494824 - RNA, 19 nt, Homo sapiens
ggagcagauugaagaugaa

SEQ ID NO: 494825 - RNA, 19 nt, Homo sapiens
acaacaccguuauugcuaa

SEQ ID NO: 494826 - RNA, 19 nt, Homo sapiens
ggagauggagcuuucuaug

SEQ ID NO: 494827 - RNA, 19 nt, Homo sapiens
guuaauauccgcacaagag

SEQ ID NO: 494828 - RNA, 19 nt, Homo sapiens
uggaaagaaugauugcuau

SEQ ID NO: 494829 - RNA, 19 nt, Homo sapiens
cagagaauuuauggcauuu

SEQ ID NO: 494830 - RNA, 19 nt, Homo sapiens
gauguggcccuuugauaga

SEQ ID NO: 494831 - RNA, 19 nt, Homo sapiens
cuauagauguggcccuuug

SEQ ID NO: 494832 - RNA, 19 nt, Homo sapiens
gaagaacaaagaaggaucu

SEQ ID NO: 494833 - RNA, 19 nt, Homo sapiens
agucuaugguggauguuua

SEQ ID NO: 494834 - RNA, 19 nt, Homo sapiens
cagcaaacaggcagaagaa

SEQ ID NO: 494835 - RNA, 19 nt, Homo sapiens
gcagcaaacaggcagaaga

SEQ ID NO: 494836 - RNA, 19 nt, Homo sapiens
gcacaagagacaauaaggu

SEQ ID NO: 494837 - RNA, 19 nt, Homo sapiens
ugccggauauugaaugaaa

SEQ ID NO: 494838 - RNA, 19 nt, Homo sapiens
gauagcaagccaauuaaag

SEQ ID NO: 494839 - RNA, 19 nt, Homo sapiens
gaccaaccugugaugaaua

SEQ ID NO: 494840 - RNA, 19 nt, Homo sapiens
guggaaagaaugauugcua

SEQ ID NO: 494841 - RNA, 19 nt, Homo sapiens
ccaguugcccaucagauuu

SEQ ID NO: 494842 - RNA, 19 nt, Homo sapiens
gaaaacagucugaaugaau

SEQ ID NO: 494843 - RNA, 19 nt, Homo sapiens
guucaaaugccggauauug

SEQ ID NO: 494844 - RNA, 19 nt, Homo sapiens
ugaggaaugcuuuagugua

SEQ ID NO: 494845 - RNA, 19 nt, Homo sapiens
gcacaguauaacuucauuu

SEQ ID NO: 494846 - RNA, 19 nt, Homo sapiens
aagcagauauggagacucu

SEQ ID NO: 494847 - RNA, 19 nt, Homo sapiens
ggaaggcaaagcagauaug

SEQ ID NO: 494848 - RNA, 19 nt, Homo sapiens
caaguucaaaugccggaua

SEQ ID NO: 494849 - RNA, 19 nt, Homo sapiens
cgucuugagauguauaaua

SEQ ID NO: 494850 - RNA, 19 nt, Homo sapiens
acaggcagaagaagaauuu

SEQ ID NO: 494851 - RNA, 19 nt, Homo sapiens
ccauggagcagauugaaga

SEQ ID NO: 494852 - RNA, 19 nt, Homo sapiens
caacuaccacagucuauag

SEQ ID NO: 494853 - RNA, 19 nt, Homo sapiens
gaaagacuggaaguuaaga

SEQ ID NO: 494854 - RNA, 19 nt, Homo sapiens
caaauucauggcagacauu

SEQ ID NO: 494855 - RNA, 19 nt, Homo sapiens
uggauucuauuaugacaug

SEQ ID NO: 494856 - RNA, 19 nt, Homo sapiens
gugaagccauggaaagagu

SEQ ID NO: 494857 - RNA, 19 nt, Homo sapiens
gagauggagcuuucuaugg

SEQ ID NO: 494858 - RNA, 19 nt, Homo sapiens
gaaacaacuugaaaacagu

SEQ ID NO: 494859 - RNA, 19 nt, Homo sapiens
uuugaaagacuggaaguua

SEQ ID NO: 494860 - RNA, 19 nt, Homo sapiens
ccaaauucauggcagacau

SEQ ID NO: 494861 - RNA, 19 nt, Homo sapiens
gauuggugcuggugaagag

SEQ ID NO: 494862 - RNA, 19 nt, Homo sapiens
cuaccacagucuauagaug

SEQ ID NO: 494863 - RNA, 19 nt, Homo sapiens
ccaacuaccacagucuaua

SEQ ID NO: 494864 - RNA, 19 nt, Homo sapiens
caccguuauugcuaaagua

SEQ ID NO: 494865 - RNA, 19 nt, Homo sapiens
aaagagagccaauaaaaug

SEQ ID NO: 494866 - RNA, 19 nt, Homo sapiens
caaagaguuccgcagcaaa

SEQ ID NO: 494867 - RNA, 19 nt, Homo sapiens
ggaacgcaccauuucugaa

SEQ ID NO: 494868 - RNA, 19 nt, Homo sapiens
gggaacgcaccauuucuga

SEQ ID NO: 494869 - RNA, 19 nt, Homo sapiens
ggauccaggcuguacauug

SEQ ID NO: 494870 - RNA, 19 nt, Homo sapiens
aaagguacgacaacaauuc

SEQ ID NO: 494871 - RNA, 19 nt, Homo sapiens
caguugcccaucagauuua

SEQ ID NO: 494872 - RNA, 19 nt, Homo sapiens
gaaugaauuuggugaaaag

SEQ ID NO: 494873 - RNA, 19 nt, Homo sapiens
gaacaaaguuuaccagaaa

SEQ ID NO: 494874 - RNA, 19 nt, Homo sapiens
gaauugagauggaacauuu

SEQ ID NO: 494875 - RNA, 19 nt, Homo sapiens
gggaggagauugcuucuua

SEQ ID NO: 494876 - RNA, 19 nt, Homo sapiens
gaaaccaaauccaaacaaa

SEQ ID NO: 494877 - RNA, 19 nt, Homo sapiens
ccagaaauaucuucacuug

SEQ ID NO: 494878 - RNA, 19 nt, Homo sapiens
caacuggaauaucuaauug

SEQ ID NO: 494879 - RNA, 19 nt, Homo sapiens
gaaaguaccaggugaacaa

SEQ ID NO: 494880 - RNA, 19 nt, Homo sapiens
ggagauugcuucuuauuac

SEQ ID NO: 494881 - RNA, 19 nt, Homo sapiens
ugaaacaacuggaauaucu

SEQ ID NO: 494882 - RNA, 19 nt, Homo sapiens
agagaaaucuugggaaauu

SEQ ID NO: 494883 - RNA, 19 nt, Homo sapiens
ccagagaaaucuugggaaa

SEQ ID NO: 494884 - RNA, 19 nt, Homo sapiens
ucagagaccuuccagaaau

SEQ ID NO: 494885 - RNA, 19 nt, Homo sapiens
gaaagcaguugagacaaga

SEQ ID NO: 494886 - RNA, 19 nt, Homo sapiens
ggaggagugugauaaauag

SEQ ID NO: 494887 - RNA, 19 nt, Homo sapiens
agaaauaucuucacuuguc

SEQ ID NO: 494888 - RNA, 19 nt, Homo sapiens
gaaauaucuucacuuguca

SEQ ID NO: 494889 - RNA, 19 nt, Homo sapiens
cagaaauacuacuguguaa

SEQ ID NO: 494890 - RNA, 19 nt, Homo sapiens
gaacauuucccagaauuug

SEQ ID NO: 494891 - RNA, 19 nt, Homo sapiens
gggcaaauauaauggcuau

SEQ ID NO: 494892 - RNA, 19 nt, Homo sapiens
cagagaccuuccagaaaua

SEQ ID NO: 494893 - RNA, 19 nt, Homo sapiens
aagcucaacucucuuauug

SEQ ID NO: 494894 - RNA, 19 nt, Homo sapiens
gaaguuacccaggcaauga

SEQ ID NO: 494895 - RNA, 19 nt, Homo sapiens
ccuguaaccugucaaagaa

SEQ ID NO: 494896 - RNA, 19 nt, Homo sapiens
ucauucacaucgcagauua

SEQ ID NO: 494897 - RNA, 19 nt, Homo sapiens
gagcagcacuaccauugug

SEQ ID NO: 494898 - RNA, 19 nt, Homo sapiens
gaaauugaccugaaacaac

SEQ ID NO: 494899 - RNA, 19 nt, Homo sapiens
ccucagacauggccaagaa

SEQ ID NO: 494900 - RNA, 19 nt, Homo sapiens
ugaacaaaguuuaccagaa

SEQ ID NO: 494901 - RNA, 19 nt, Homo sapiens
ugucaaggguucaagauug

SEQ ID NO: 494902 - RNA, 19 nt, Homo sapiens
ccagaaauacuacugugua

SEQ ID NO: 494903 - RNA, 19 nt, Homo sapiens
gaaauacuacuguguaagg

SEQ ID NO: 494904 - RNA, 19 nt, Homo sapiens
gagaugggcuggugaagcu

SEQ ID NO: 494905 - RNA, 19 nt, Homo sapiens
gcaaacgucaucuucagaa

SEQ ID NO: 494906 - RNA, 19 nt, Homo sapiens
gaagcucugugccgggaaa

SEQ ID NO: 494907 - RNA, 19 nt, Homo sapiens
uaucuucacuugucauugu

SEQ ID NO: 494908 - RNA, 19 nt, Homo sapiens
aaauaggccugcauccauu

SEQ ID NO: 494909 - RNA, 19 nt, Homo sapiens
ccaaugcugaucucuguua

SEQ ID NO: 494910 - RNA, 19 nt, Homo sapiens
gaaacaacuggaauaucua

SEQ ID NO: 494911 - RNA, 19 nt, Homo sapiens
gagcacgccuguacuagag

SEQ ID NO: 494912 - RNA, 19 nt, Homo sapiens
gaucgacuugccaaauuua

SEQ ID NO: 494913 - RNA, 19 nt, Homo sapiens
gaagcucaacucucuuauu

SEQ ID NO: 494914 - RNA, 19 nt, Homo sapiens
gaugagaucuauggagaca

SEQ ID NO: 494915 - RNA, 19 nt, Homo sapiens
gagaaaucuugggaaauug

SEQ ID NO: 494916 - RNA, 19 nt, Homo sapiens
gcuaaggacgucauucuga

SEQ ID NO: 494917 - RNA, 19 nt, Homo sapiens
ggaggagauugcuucuuau

SEQ ID NO: 494918 - RNA, 19 nt, Homo sapiens
acacauguauuuggugauu

SEQ ID NO: 494919 - RNA, 19 nt, Homo sapiens
ugagaucuauggagacaug

SEQ ID NO: 494920 - RNA, 19 nt, Homo sapiens
gccaagcuauugaccuuug

SEQ ID NO: 494921 - RNA, 19 nt, Homo sapiens
gaggcugcuuucuccuuua

SEQ ID NO: 494922 - RNA, 19 nt, Homo sapiens
acaugaaggugaaaccaaa

SEQ ID NO: 494923 - RNA, 19 nt, Homo sapiens
gccugggucuccuaaagua

SEQ ID NO: 494924 - RNA, 19 nt, Homo sapiens
ccagaaagcaguugagaca

SEQ ID NO: 494925 - RNA, 19 nt, Homo sapiens
ucaagauuguuccugcuuu

SEQ ID NO: 494926 - RNA, 19 nt, Homo sapiens
ggaaauugaccugaaacaa

SEQ ID NO: 494927 - RNA, 19 nt, Homo sapiens
cagccaagcuauugaccuu

SEQ ID NO: 494928 - RNA, 19 nt, Homo sapiens
agacaggguuucaccaugu

SEQ ID NO: 494929 - RNA, 19 nt, Homo sapiens
ugaucgacuugccaaauuu

SEQ ID NO: 494930 - RNA, 19 nt, Homo sapiens
cagcuugucucauugucaa

SEQ ID NO: 494931 - RNA, 19 nt, Homo sapiens
gcuauugaccuuuguuuag

SEQ ID NO: 494932 - RNA, 19 nt, Homo sapiens
uaccucacuuuacacaaua

SEQ ID NO: 494933 - RNA, 19 nt, Homo sapiens
aggucaaacucuacaauuu

SEQ ID NO: 494934 - RNA, 19 nt, Homo sapiens
gaggucaaacucuacaauu

SEQ ID NO: 494935 - RNA, 19 nt, Homo sapiens
gaggagauugcuucuuauu

SEQ ID NO: 494936 - RNA, 19 nt, Homo sapiens
aaucagagaccuuccagaa

SEQ ID NO: 494937 - RNA, 19 nt, Homo sapiens
ggacucagguggcccuacu

SEQ ID NO: 494938 - RNA, 19 nt, Homo sapiens
ggaguucacggagcgguua

SEQ ID NO: 494939 - RNA, 19 nt, Homo sapiens
guccaaugcugaucucugu

SEQ ID NO: 494940 - RNA, 19 nt, Homo sapiens
gcgauucucuugccucaac

SEQ ID NO: 494941 - RNA, 19 nt, Homo sapiens
agaaagcaguugagacaag

SEQ ID NO: 494942 - RNA, 19 nt, Homo sapiens
uaaauaggccugcauccau

SEQ ID NO: 494943 - RNA, 19 nt, Homo sapiens
aaauugaccugaaacaacu

SEQ ID NO: 494944 - RNA, 19 nt, Homo sapiens
gcagccggauccaggaguu

SEQ ID NO: 494945 - RNA, 19 nt, Homo sapiens
gcaaauauaauggcuaugc

SEQ ID NO: 494946 - RNA, 19 nt, Homo sapiens
ggcaucaggcuuucuuaaa

SEQ ID NO: 494947 - RNA, 19 nt, Homo sapiens
uuggaaaccugccuacaga

SEQ ID NO: 494948 - RNA, 19 nt, Homo sapiens
uguguaagggccagaaaua

SEQ ID NO: 494949 - RNA, 19 nt, Homo sapiens
gacaggguuucaccauguu

SEQ ID NO: 494950 - RNA, 19 nt, Homo sapiens
ggaauugagauggaacauu

SEQ ID NO: 494951 - RNA, 19 nt, Homo sapiens
guaagggccagaaauaucu

SEQ ID NO: 494952 - RNA, 19 nt, Homo sapiens
ugagagcacgccuguacua

SEQ ID NO: 494953 - RNA, 19 nt, Homo sapiens
cagcaaacgucaucuucag

SEQ ID NO: 494954 - RNA, 19 nt, Homo sapiens
uugaucgacuugccaaauu

SEQ ID NO: 494955 - RNA, 19 nt, Homo sapiens
gucaaggguucaagauugu

SEQ ID NO: 494956 - RNA, 19 nt, Homo sapiens
gcuuugaguacccgaauuu

SEQ ID NO: 494957 - RNA, 19 nt, Homo sapiens
gaccugguuucucucucua

SEQ ID NO: 494958 - RNA, 19 nt, Homo sapiens
ggacucgggcaaauauaau

SEQ ID NO: 494959 - RNA, 19 nt, Homo sapiens
auaccucacuuuacacaau

SEQ ID NO: 494960 - RNA, 19 nt, Homo sapiens
ccucagacucuaagaaaga

SEQ ID NO: 494961 - RNA, 19 nt, Homo sapiens
gugagcagcacuaccauug

SEQ ID NO: 494962 - RNA, 19 nt, Homo sapiens
uccaagaccugguuucucu

SEQ ID NO: 494963 - RNA, 19 nt, Homo sapiens
cuacagacccugaaguuac

SEQ ID NO: 494964 - RNA, 19 nt, Homo sapiens
gaaagaaguuggggacaca

SEQ ID NO: 494965 - RNA, 19 nt, Homo sapiens
ggccucaaaugcaccaugu

SEQ ID NO: 494966 - RNA, 19 nt, Homo sapiens
aggaggagugugauaaaua

SEQ ID NO: 494967 - RNA, 19 nt, Homo sapiens
caggaggagugugauaaau

SEQ ID NO: 494968 - RNA, 19 nt, Homo sapiens
aaauaagagcucaggauga

SEQ ID NO: 494969 - RNA, 19 nt, Homo sapiens
uguaaccugucaaagaaga

SEQ ID NO: 494970 - RNA, 19 nt, Homo sapiens
ccaggaggagugugauaaa

SEQ ID NO: 494971 - RNA, 19 nt, Homo sapiens
gcugcuuucuccuuuacuu

SEQ ID NO: 494972 - RNA, 19 nt, Homo sapiens
ggccagaaauaucuucacu

SEQ ID NO: 494973 - RNA, 19 nt, Homo sapiens
gcaaagauagcgagaaaua

SEQ ID NO: 494974 - RNA, 19 nt, Homo sapiens
gcaguaagcuaugaucaug

SEQ ID NO: 494975 - RNA, 19 nt, Homo sapiens
ugaauuccaugcacagaua

SEQ ID NO: 494976 - RNA, 19 nt, Homo sapiens
gguggaagcaguucacuua

SEQ ID NO: 494977 - RNA, 19 nt, Homo sapiens
ggaagcaguucacuuaaag

SEQ ID NO: 494978 - RNA, 19 nt, Homo sapiens
gaggaucacuugagccuau

SEQ ID NO: 494979 - RNA, 19 nt, Homo sapiens
agaaagggcuggucacaga

SEQ ID NO: 494980 - RNA, 19 nt, Homo sapiens
cgacaacggccacauuauu

SEQ ID NO: 494981 - RNA, 19 nt, Homo sapiens
gacgacaacggccacauua

SEQ ID NO: 494982 - RNA, 19 nt, Homo sapiens
aaagauagcgagaaauaug

SEQ ID NO: 494983 - RNA, 19 nt, Homo sapiens
acgcaaagauagcgagaaa

SEQ ID NO: 494984 - RNA, 19 nt, Homo sapiens
ggacgacaacggccacauu

SEQ ID NO: 494985 - RNA, 19 nt, Homo sapiens
uggaagcaguucacuuaaa

SEQ ID NO: 494986 - RNA, 19 nt, Homo sapiens
cacugucccuggucucuua

SEQ ID NO: 494987 - RNA, 19 nt, Homo sapiens
ucacgcagcucaagauugc

SEQ ID NO: 494988 - RNA, 19 nt, Homo sapiens
agaaauaugccgaggagaa

SEQ ID NO: 494989 - RNA, 19 nt, Homo sapiens
gacaacggccacauuauuc

SEQ ID NO: 494990 - RNA, 19 nt, Homo sapiens
acuuaaaggccaugaguua

SEQ ID NO: 494991 - RNA, 19 nt, Homo sapiens
ugaagcaaaucguguccuu

SEQ ID NO: 494992 - RNA, 19 nt, Homo sapiens
ucacuugagccuauuaguu

SEQ ID NO: 494993 - RNA, 19 nt, Homo sapiens
gcgugcagcuagagaugaa

SEQ ID NO: 494994 - RNA, 19 nt, Homo sapiens
gaaagggcuggucacagaa

SEQ ID NO: 494995 - RNA, 19 nt, Homo sapiens
cacuugagccuauuaguug

SEQ ID NO: 494996 - RNA, 19 nt, Homo sapiens
gaucacgcagcucaagauu

SEQ ID NO: 494997 - RNA, 19 nt, Homo sapiens
gaaauaugccgaggagaac

SEQ ID NO: 494998 - RNA, 19 nt, Homo sapiens
caaagauagcgagaaauau

SEQ ID NO: 494999 - RNA, 19 nt, Homo sapiens
ggagaaagggcuggucaca

SEQ ID NO: 495000 - RNA, 19 nt, Homo sapiens
caagucaggaggucaagug

SEQ ID NO: 495001 - RNA, 19 nt, Homo sapiens
cgcaguggaugaagcaaau

SEQ ID NO: 495002 - RNA, 19 nt, Homo sapiens
cagcaaucccuucgcgaaa

SEQ ID NO: 495003 - RNA, 19 nt, Homo sapiens
caagcugaccaacaaccua

SEQ ID NO: 495004 - RNA, 19 nt, Homo sapiens
guuggaggcugcaguaagc

SEQ ID NO: 495005 - RNA, 19 nt, Homo sapiens
ggaucacuugagccuauua

SEQ ID NO: 495006 - RNA, 19 nt, Homo sapiens
ugaagaagaacgcgaaggu

SEQ ID NO: 495007 - RNA, 19 nt, Homo sapiens
acuauaugcugcucaugga

SEQ ID NO: 495008 - RNA, 19 nt, Homo sapiens
gaagucugagucccugaga

SEQ ID NO: 495009 - RNA, 19 nt, Homo sapiens
gaggagaacuucaaaaccu

SEQ ID NO: 495010 - RNA, 19 nt, Homo sapiens
uuucccaccuuccaaguga

SEQ ID NO: 495011 - RNA, 19 nt, Homo sapiens
gagcgugcagcuagagaug

SEQ ID NO: 495012 - RNA, 19 nt, Homo sapiens
agaaggcucugggcuccaa

SEQ ID NO: 495013 - RNA, 19 nt, Homo sapiens
gaaaggcuuccgggacugu

SEQ ID NO: 495014 - RNA, 19 nt, Homo sapiens
ggaucacgcagcucaagau

SEQ ID NO: 495015 - RNA, 19 nt, Homo sapiens
uaccagaaccaucggauca

SEQ ID NO: 495016 - RNA, 19 nt, Homo sapiens
gcgcaguggaugaagcaaa

SEQ ID NO: 495017 - RNA, 19 nt, Homo sapiens
ggaggcugcaguaagcuau

SEQ ID NO: 495018 - RNA, 19 nt, Homo sapiens
gaggcaggaggaucacuug

SEQ ID NO: 495019 - RNA, 19 nt, Homo sapiens
ccgagaugaucgucaccaa

SEQ ID NO: 495020 - RNA, 19 nt, Homo sapiens
ucccauggccgacuauaug

SEQ ID NO: 495021 - RNA, 19 nt, Homo sapiens
ucacuuaaaggccaugagu

SEQ ID NO: 495022 - RNA, 19 nt, Homo sapiens
guggaagcaguucacuuaa

SEQ ID NO: 495023 - RNA, 19 nt, Homo sapiens
gcuuccacguggucuaugu

SEQ ID NO: 495024 - RNA, 19 nt, Homo sapiens
uuaguuggaggcugcagua

SEQ ID NO: 495025 - RNA, 19 nt, Homo sapiens
gcacagcuggaugguggaa

SEQ ID NO: 495026 - RNA, 19 nt, Homo sapiens
cagcugggcaccgagauga

SEQ ID NO: 495027 - RNA, 19 nt, Homo sapiens
cggcagggaugcacuucag

SEQ ID NO: 495028 - RNA, 19 nt, Homo sapiens
gaggucaagugugcaugca

SEQ ID NO: 495029 - RNA, 19 nt, Homo sapiens
ccaaguaagaagucugagu

SEQ ID NO: 495030 - RNA, 19 nt, Homo sapiens
caacggccacauuauucug

SEQ ID NO: 495031 - RNA, 19 nt, Homo sapiens
gcaaagauagcgagaaaua

SEQ ID NO: 495032 - RNA, 19 nt, Homo sapiens
ggagaaagguggacauguc

SEQ ID NO: 495033 - RNA, 19 nt, Homo sapiens
ugaauuccaugcacagaua

SEQ ID NO: 495034 - RNA, 19 nt, Homo sapiens
cgacaacggccacauuauu

SEQ ID NO: 495035 - RNA, 19 nt, Homo sapiens
gaacacaccagagagagaa

SEQ ID NO: 495036 - RNA, 19 nt, Homo sapiens
acagugacuuguucaguaa

SEQ ID NO: 495037 - RNA, 19 nt, Homo sapiens
gacgacaacggccacauua

SEQ ID NO: 495038 - RNA, 19 nt, Homo sapiens
gaaggacaaggaagugaaa

SEQ ID NO: 495039 - RNA, 19 nt, Homo sapiens
ucacuuugguucauguuug

SEQ ID NO: 495040 - RNA, 19 nt, Homo sapiens
gcugagacgucuaggaaca

SEQ ID NO: 495041 - RNA, 19 nt, Homo sapiens
aaagauagcgagaaauaug

SEQ ID NO: 495042 - RNA, 19 nt, Homo sapiens
acgcaaagauagcgagaaa

SEQ ID NO: 495043 - RNA, 19 nt, Homo sapiens
ggacgacaacggccacauu

SEQ ID NO: 495044 - RNA, 19 nt, Homo sapiens
acauggaguugucguguuu

SEQ ID NO: 495045 - RNA, 19 nt, Homo sapiens
gcaggugaccgucuuuguu

SEQ ID NO: 495046 - RNA, 19 nt, Homo sapiens
ucacgcagcucaagauugc

SEQ ID NO: 495047 - RNA, 19 nt, Homo sapiens
agaaauaugccgaggagaa

SEQ ID NO: 495048 - RNA, 19 nt, Homo sapiens
gacaacggccacauuauuc

SEQ ID NO: 495049 - RNA, 19 nt, Homo sapiens
ugaagcaaaucguguccuu

SEQ ID NO: 495050 - RNA, 19 nt, Homo sapiens
gcgugcagcuagagaugaa

SEQ ID NO: 495051 - RNA, 19 nt, Homo sapiens
ggaacacaccagagagaga

SEQ ID NO: 495052 - RNA, 19 nt, Homo sapiens
gaucacgcagcucaagauu

SEQ ID NO: 495053 - RNA, 19 nt, Homo sapiens
gaauaaagugcauguuuug

SEQ ID NO: 495054 - RNA, 19 nt, Homo sapiens
gaccgcaggugaccgucuu

SEQ ID NO: 495055 - RNA, 19 nt, Homo sapiens
gaaauaugccgaggagaac

SEQ ID NO: 495056 - RNA, 19 nt, Homo sapiens
caaagauagcgagaaauau

SEQ ID NO: 495057 - RNA, 19 nt, Homo sapiens
caggugaccgucuuuguug

SEQ ID NO: 495058 - RNA, 19 nt, Homo sapiens
gcagagugccaacccuuca

SEQ ID NO: 495059 - RNA, 19 nt, Homo sapiens
aagcugagacgucuaggaa

SEQ ID NO: 495060 - RNA, 19 nt, Homo sapiens
cgcaguggaugaagcaaau

SEQ ID NO: 495061 - RNA, 19 nt, Homo sapiens
gaccgucuuuguugaaugc

SEQ ID NO: 495062 - RNA, 19 nt, Homo sapiens
cagcaaucccuucgcgaaa

SEQ ID NO: 495063 - RNA, 19 nt, Homo sapiens
caagcugaccaacaaccua

SEQ ID NO: 495064 - RNA, 19 nt, Homo sapiens
cacuuugguucauguuuga

SEQ ID NO: 495065 - RNA, 19 nt, Homo sapiens
gagugccaacccuucaaua

SEQ ID NO: 495066 - RNA, 19 nt, Homo sapiens
ugaagaagaacgcgaaggu

SEQ ID NO: 495067 - RNA, 19 nt, Homo sapiens
acuauaugcugcucaugga

SEQ ID NO: 495068 - RNA, 19 nt, Homo sapiens
uuucccaccuuccaaguga

SEQ ID NO: 495069 - RNA, 19 nt, Homo sapiens
cacauggaguugucguguu

SEQ ID NO: 495070 - RNA, 19 nt, Homo sapiens
gaggagaacuucaaaaccu

SEQ ID NO: 495071 - RNA, 19 nt, Homo sapiens
gagcgugcagcuagagaug

SEQ ID NO: 495072 - RNA, 19 nt, Homo sapiens
ugaaggacaaggaagugaa

SEQ ID NO: 495073 - RNA, 19 nt, Homo sapiens
gaaaggcuuccgggacugu

SEQ ID NO: 495074 - RNA, 19 nt, Homo sapiens
ggaucacgcagcucaagau

SEQ ID NO: 495075 - RNA, 19 nt, Homo sapiens
uaccagaaccaucggauca

SEQ ID NO: 495076 - RNA, 19 nt, Homo sapiens
gcgcaguggaugaagcaaa

SEQ ID NO: 495077 - RNA, 19 nt, Homo sapiens
gugacuuguucaguaaauu

SEQ ID NO: 495078 - RNA, 19 nt, Homo sapiens
ggacaaggaagugaaagcu

SEQ ID NO: 495079 - RNA, 19 nt, Homo sapiens
ugacuuguucaguaaauuc

SEQ ID NO: 495080 - RNA, 19 nt, Homo sapiens
ccgagaugaucgucaccaa

SEQ ID NO: 495081 - RNA, 19 nt, Homo sapiens
ugaaagcugagacgucuag

SEQ ID NO: 495082 - RNA, 19 nt, Homo sapiens
ucccauggccgacuauaug

SEQ ID NO: 495083 - RNA, 19 nt, Homo sapiens
guguuucccuucacuuugg

SEQ ID NO: 495084 - RNA, 19 nt, Homo sapiens
ucuaggaacacaccagaga

SEQ ID NO: 495085 - RNA, 19 nt, Homo sapiens
gcuuccacguggucuaugu

SEQ ID NO: 495086 - RNA, 19 nt, Homo sapiens
ggugaccgucuuuguugaa

SEQ ID NO: 495087 - RNA, 19 nt, Homo sapiens
cagcugggcaccgagauga

SEQ ID NO: 495088 - RNA, 19 nt, Homo sapiens
uaggaacacaccagagaga

SEQ ID NO: 495089 - RNA, 19 nt, Homo sapiens
cggcagggaugcacuucag

SEQ ID NO: 495090 - RNA, 19 nt, Homo sapiens
ugaccgucuuuguugaaug

SEQ ID NO: 495091 - RNA, 19 nt, Homo sapiens
caacggccacauuauucug

SEQ ID NO: 495092 - RNA, 19 nt, Homo sapiens
ggaaggaagugauauuuau

SEQ ID NO: 495093 - RNA, 19 nt, Homo sapiens
gcaaagauagcgagaaaua

SEQ ID NO: 495094 - RNA, 19 nt, Homo sapiens
ugaauuccaugcacagaua

SEQ ID NO: 495095 - RNA, 19 nt, Homo sapiens
guagauacauguagauacu

SEQ ID NO: 495096 - RNA, 19 nt, Homo sapiens
cgacaacggccacauuauu

SEQ ID NO: 495097 - RNA, 19 nt, Homo sapiens
gacgacaacggccacauua

SEQ ID NO: 495098 - RNA, 19 nt, Homo sapiens
aaagauagcgagaaauaug

SEQ ID NO: 495099 - RNA, 19 nt, Homo sapiens
acgcaaagauagcgagaaa

SEQ ID NO: 495100 - RNA, 19 nt, Homo sapiens
ggacgacaacggccacauu

SEQ ID NO: 495101 - RNA, 19 nt, Homo sapiens
ucacgcagcucaagauugc

SEQ ID NO: 495102 - RNA, 19 nt, Homo sapiens
cggaaggaagugauauuua

SEQ ID NO: 495103 - RNA, 19 nt, Homo sapiens
caagggcaagcaaggaaua

SEQ ID NO: 495104 - RNA, 19 nt, Homo sapiens
agaaauaugccgaggagaa

SEQ ID NO: 495105 - RNA, 19 nt, Homo sapiens
gacaacggccacauuauuc

SEQ ID NO: 495106 - RNA, 19 nt, Homo sapiens
ugaagcaaaucguguccuu

SEQ ID NO: 495107 - RNA, 19 nt, Homo sapiens
gcggaaggaagugauauuu

SEQ ID NO: 495108 - RNA, 19 nt, Homo sapiens
gcgugcagcuagagaugaa

SEQ ID NO: 495109 - RNA, 19 nt, Homo sapiens
acauguagauacuguagau

SEQ ID NO: 495110 - RNA, 19 nt, Homo sapiens
gaucacgcagcucaagauu

SEQ ID NO: 495111 - RNA, 19 nt, Homo sapiens
gaaauaugccgaggagaac

SEQ ID NO: 495112 - RNA, 19 nt, Homo sapiens
caaagauagcgagaaauau

SEQ ID NO: 495113 - RNA, 19 nt, Homo sapiens
uagauacuguagauacugu

SEQ ID NO: 495114 - RNA, 19 nt, Homo sapiens
cccuugggcuaucgaagua

SEQ ID NO: 495115 - RNA, 19 nt, Homo sapiens
cgcaguggaugaagcaaau

SEQ ID NO: 495116 - RNA, 19 nt, Homo sapiens
cagcaaucccuucgcgaaa

SEQ ID NO: 495117 - RNA, 19 nt, Homo sapiens
caagcugaccaacaaccua

SEQ ID NO: 495118 - RNA, 19 nt, Homo sapiens
gaggcggaaggaagugaua

SEQ ID NO: 495119 - RNA, 19 nt, Homo sapiens
ugaagaagaacgcgaaggu

SEQ ID NO: 495120 - RNA, 19 nt, Homo sapiens
acuauaugcugcucaugga

SEQ ID NO: 495121 - RNA, 19 nt, Homo sapiens
agauacauguagauacugu

SEQ ID NO: 495122 - RNA, 19 nt, Homo sapiens
gaggagaacuucaaaaccu

SEQ ID NO: 495123 - RNA, 19 nt, Homo sapiens
uuucccaccuuccaaguga

SEQ ID NO: 495124 - RNA, 19 nt, Homo sapiens
gaaaggcuuccgggacugu

SEQ ID NO: 495125 - RNA, 19 nt, Homo sapiens
ggaucacgcagcucaagau

SEQ ID NO: 495126 - RNA, 19 nt, Homo sapiens
uaccagaaccaucggauca

SEQ ID NO: 495127 - RNA, 19 nt, Homo sapiens
gagcgugcagcuagagaug

SEQ ID NO: 495128 - RNA, 19 nt, Homo sapiens
gcgcaguggaugaagcaaa

SEQ ID NO: 495129 - RNA, 19 nt, Homo sapiens
ccgagaugaucgucaccaa

SEQ ID NO: 495130 - RNA, 19 nt, Homo sapiens
ucccauggccgacuauaug

SEQ ID NO: 495131 - RNA, 19 nt, Homo sapiens
uacuguagauacuguagau

SEQ ID NO: 495132 - RNA, 19 nt, Homo sapiens
gcuuccacguggucuaugu

SEQ ID NO: 495133 - RNA, 19 nt, Homo sapiens
ggcaagcaaggaauacguu

SEQ ID NO: 495134 - RNA, 19 nt, Homo sapiens
gccggcaguugcaguguag

SEQ ID NO: 495135 - RNA, 19 nt, Homo sapiens
cagcugggcaccgagauga

SEQ ID NO: 495136 - RNA, 19 nt, Homo sapiens
cggcagggaugcacuucag

SEQ ID NO: 495137 - RNA, 19 nt, Homo sapiens
ggcggaaggaagugauauu

SEQ ID NO: 495138 - RNA, 19 nt, Homo sapiens
caacggccacauuauucug

SEQ ID NO: 495139 - RNA, 19 nt, Homo sapiens
gcaggcaguucuuaaauaa

SEQ ID NO: 495140 - RNA, 19 nt, Homo sapiens
gggcagagcuucuaccaaa

SEQ ID NO: 495141 - RNA, 19 nt, Homo sapiens
caacagcacuggaauccua

SEQ ID NO: 495142 - RNA, 19 nt, Homo sapiens
ggcaagaacuggauagaaa

SEQ ID NO: 495143 - RNA, 19 nt, Homo sapiens
gauggcaccuugaucauaa

SEQ ID NO: 495144 - RNA, 19 nt, Homo sapiens
gaacagccacaaacaagua

SEQ ID NO: 495145 - RNA, 19 nt, Homo sapiens
gcaguaacuuccaugauga

SEQ ID NO: 495146 - RNA, 19 nt, Homo sapiens
gcagaagacuagauuagau

SEQ ID NO: 495147 - RNA, 19 nt, Homo sapiens
ccaagacuccuccaacuua

SEQ ID NO: 495148 - RNA, 19 nt, Homo sapiens
cagguuaucugcuuucauu

SEQ ID NO: 495149 - RNA, 19 nt, Homo sapiens
gcaccuugaucauaagaaa

SEQ ID NO: 495150 - RNA, 19 nt, Homo sapiens
gcucacagcuuggcaaaug

SEQ ID NO: 495151 - RNA, 19 nt, Homo sapiens
guucaaggcuguuugucua

SEQ ID NO: 495152 - RNA, 19 nt, Homo sapiens
gcucuagucuuagcauuaa

SEQ ID NO: 495153 - RNA, 19 nt, Homo sapiens
gcuauggccuggcuaagaa

SEQ ID NO: 495154 - RNA, 19 nt, Homo sapiens
ggucauagccagcaacauu

SEQ ID NO: 495155 - RNA, 19 nt, Homo sapiens
gcacuggaauccuaucugu

SEQ ID NO: 495156 - RNA, 19 nt, Homo sapiens
agacugagguuaaacauca

SEQ ID NO: 495157 - RNA, 19 nt, Homo sapiens
caaccuggcugcugaagau

SEQ ID NO: 495158 - RNA, 19 nt, Homo sapiens
gaacacccguggacuugug

SEQ ID NO: 495159 - RNA, 19 nt, Homo sapiens
uggguuaucuccucucaua

SEQ ID NO: 495160 - RNA, 19 nt, Homo sapiens
uagagugacuuguacauga

SEQ ID NO: 495161 - RNA, 19 nt, Homo sapiens
ggcaguaacuuccaugaug

SEQ ID NO: 495162 - RNA, 19 nt, Homo sapiens
ggacacagaggcugacauu

SEQ ID NO: 495163 - RNA, 19 nt, Homo sapiens
gagaugagacucuuagaau

SEQ ID NO: 495164 - RNA, 19 nt, Homo sapiens
gaagacaggacguaaagga

SEQ ID NO: 495165 - RNA, 19 nt, Homo sapiens
ggcaggagauggccaauca

SEQ ID NO: 495166 - RNA, 19 nt, Homo sapiens
caacaaaugauacaaaugg

SEQ ID NO: 495167 - RNA, 19 nt, Homo sapiens
gcaacagccuccugcuaga

SEQ ID NO: 495168 - RNA, 19 nt, Homo sapiens
gagaguggcugguuuuaaa

SEQ ID NO: 495169 - RNA, 19 nt, Homo sapiens
gcuauaagaugcuguacca

SEQ ID NO: 495170 - RNA, 19 nt, Homo sapiens
gcagcucucuccagacaga

SEQ ID NO: 495171 - RNA, 19 nt, Homo sapiens
gaaaggggaugcugaacaa

SEQ ID NO: 495172 - RNA, 19 nt, Homo sapiens
ccucagaccugggcaacua

SEQ ID NO: 495173 - RNA, 19 nt, Homo sapiens
ggcaacaaaugauacaaau

SEQ ID NO: 495174 - RNA, 19 nt, Homo sapiens
gaacaaaaccuccuuccaa

SEQ ID NO: 495175 - RNA, 19 nt, Homo sapiens
gcagguuuauguugauguu

SEQ ID NO: 495176 - RNA, 19 nt, Homo sapiens
cuaaagggcuugucuuggu

SEQ ID NO: 495177 - RNA, 19 nt, Homo sapiens
ggagggcacuaccggagaa

SEQ ID NO: 495178 - RNA, 19 nt, Homo sapiens
gacagggaguccaaacuug

SEQ ID NO: 495179 - RNA, 19 nt, Homo sapiens
uuuaaguccugcucuauuu

SEQ ID NO: 495180 - RNA, 19 nt, Homo sapiens
ucaccauccuucagucuaa

SEQ ID NO: 495181 - RNA, 19 nt, Homo sapiens
gaugagacucuuagaauca

SEQ ID NO: 495182 - RNA, 19 nt, Homo sapiens
ggacaugcaagcuuguaaa

SEQ ID NO: 495183 - RNA, 19 nt, Homo sapiens
gcaggcagaauuuguuuga

SEQ ID NO: 495184 - RNA, 19 nt, Homo sapiens
caccagacaugaacagguu

SEQ ID NO: 495185 - RNA, 19 nt, Homo sapiens
ggaagcagguucggaccaa

SEQ ID NO: 495186 - RNA, 19 nt, Homo sapiens
ggagcgagacccagugaaa

SEQ ID NO: 495187 - RNA, 19 nt, Homo sapiens
cuaaugagguccacuaaaa

SEQ ID NO: 495188 - RNA, 19 nt, Homo sapiens
ccuuagagcucaacuucuu

SEQ ID NO: 495189 - RNA, 19 nt, Homo sapiens
guagaguacugacuaaggu

SEQ ID NO: 495190 - RNA, 19 nt, Homo sapiens
caacgauaguuacucacaa

SEQ ID NO: 495191 - RNA, 19 nt, Homo sapiens
gaaggugauuagucaguag

SEQ ID NO: 495192 - RNA, 19 nt, Homo sapiens
ggcaacaucuccuggacuu

SEQ ID NO: 495193 - RNA, 19 nt, Homo sapiens
ggaccaauccugcaaacau

SEQ ID NO: 495194 - RNA, 19 nt, Homo sapiens
gagacacaguauccucaaa

SEQ ID NO: 495195 - RNA, 19 nt, Homo sapiens
caucuaggaauucugguua

SEQ ID NO: 495196 - RNA, 19 nt, Homo sapiens
agaccacaguucuggguua

SEQ ID NO: 495197 - RNA, 19 nt, Homo sapiens
agaauuuguuugagggaua

SEQ ID NO: 495198 - RNA, 19 nt, Homo sapiens
uguaggagguaggauauuu

SEQ ID NO: 495199 - RNA, 19 nt, Homo sapiens
gcagucaccggcuauaaga

SEQ ID NO: 495200 - RNA, 19 nt, Homo sapiens
gaccaauccugcaaacauc

SEQ ID NO: 495201 - RNA, 19 nt, Homo sapiens
gagggagcuuugaggaauu

SEQ ID NO: 495202 - RNA, 19 nt, Homo sapiens
guugagagugugcuuauuu

SEQ ID NO: 495203 - RNA, 19 nt, Homo sapiens
gagcugguuuggcauagga

SEQ ID NO: 495204 - RNA, 19 nt, Homo sapiens
gaacaggcccaugggaaga

SEQ ID NO: 495205 - RNA, 19 nt, Homo sapiens
ugacuugacucaguguuug

SEQ ID NO: 495206 - RNA, 19 nt, Homo sapiens
agacgagacugagguuaaa

SEQ ID NO: 495207 - RNA, 19 nt, Homo sapiens
ggccaacgauaguuacuca

SEQ ID NO: 495208 - RNA, 19 nt, Homo sapiens
ggaaggaggcacugcugaa

SEQ ID NO: 495209 - RNA, 19 nt, Homo sapiens
gaacgucagagcuggaaga

SEQ ID NO: 495210 - RNA, 19 nt, Homo sapiens
gaagggcagaggauaaaug

SEQ ID NO: 495211 - RNA, 19 nt, Homo sapiens
ggagguaggauauuuuaua

SEQ ID NO: 495212 - RNA, 19 nt, Homo sapiens
cgaaaugagucugcaguca

SEQ ID NO: 495213 - RNA, 19 nt, Homo sapiens
ccggagagcucaucgucaa

SEQ ID NO: 495214 - RNA, 19 nt, Homo sapiens
uaacaacagacgagacuga

SEQ ID NO: 495215 - RNA, 19 nt, Homo sapiens
ccacugggcaggcagaauu

SEQ ID NO: 495216 - RNA, 19 nt, Homo sapiens
gacaugaacagguugaaga

SEQ ID NO: 495217 - RNA, 19 nt, Homo sapiens
caagguggccugacacugu

SEQ ID NO: 495218 - RNA, 19 nt, Homo sapiens
gaugaaugguaccgagaug

SEQ ID NO: 495219 - RNA, 19 nt, Homo sapiens
gagauccgcuacuggaaag

SEQ ID NO: 495220 - RNA, 19 nt, Homo sapiens
gguaugagauccgcuacug

SEQ ID NO: 495221 - RNA, 19 nt, Homo sapiens
cagcaggacaugaauggua

SEQ ID NO: 495222 - RNA, 19 nt, Homo sapiens
gagcaaaggcacggagauu

SEQ ID NO: 495223 - RNA, 19 nt, Homo sapiens
ugagggagcuuugaggaau

SEQ ID NO: 495224 - RNA, 19 nt, Homo sapiens
gccaugcccugguacaaau

SEQ ID NO: 495225 - RNA, 19 nt, Homo sapiens
gcaagaacuggauagaaau

SEQ ID NO: 495226 - RNA, 19 nt, Homo sapiens
auaagaugcuguaccagaa

SEQ ID NO: 495227 - RNA, 19 nt, Homo sapiens
ggagaacuaaugugaagga

SEQ ID NO: 495228 - RNA, 19 nt, Homo sapiens
gcacggagauuuuggucaa

SEQ ID NO: 495229 - RNA, 19 nt, Homo sapiens
ggcaggagaugguccaagu

SEQ ID NO: 495230 - RNA, 19 nt, Homo sapiens
gggcaacaaaugauacaaa

SEQ ID NO: 495231 - RNA, 19 nt, Homo sapiens
uaucuccucucauacauca

SEQ ID NO: 495232 - RNA, 19 nt, Homo sapiens
cagguagaguacugacuaa

SEQ ID NO: 495233 - RNA, 19 nt, Homo sapiens
ucagguggcugggugacua

SEQ ID NO: 495234 - RNA, 19 nt, Homo sapiens
ggucugagauagucacaac

SEQ ID NO: 495235 - RNA, 19 nt, Homo sapiens
gcaggaacaccagacauga

SEQ ID NO: 495236 - RNA, 19 nt, Homo sapiens
ggucagaugaaggcaaaua

SEQ ID NO: 495237 - RNA, 19 nt, Homo sapiens
agcaggcaguucuuaaaua

SEQ ID NO: 495238 - RNA, 19 nt, Homo sapiens
gggauagaacgacaacaaa

SEQ ID NO: 495239 - RNA, 19 nt, Homo sapiens
caacaucacuugaauccua

SEQ ID NO: 495240 - RNA, 19 nt, Homo sapiens
gaaaggagauggcgucuac

SEQ ID NO: 495241 - RNA, 19 nt, Homo sapiens
ggaaagcccugacggacuu

SEQ ID NO: 495242 - RNA, 19 nt, Homo sapiens
ugaaugacguccuuccuaa

SEQ ID NO: 495243 - RNA, 19 nt, Homo sapiens
ggacuucauucaagaggaa

SEQ ID NO: 495244 - RNA, 19 nt, Homo sapiens
gaagggaaagugaacauga

SEQ ID NO: 495245 - RNA, 19 nt, Homo sapiens
caaaggaccucagcugcuu

SEQ ID NO: 495246 - RNA, 19 nt, Homo sapiens
agacagauuuguucauaga

SEQ ID NO: 495247 - RNA, 19 nt, Homo sapiens
gcagggaggaagaagcuua

SEQ ID NO: 495248 - RNA, 19 nt, Homo sapiens
gagauggcgucuaccagaa

SEQ ID NO: 495249 - RNA, 19 nt, Homo sapiens
gcugagggauggacugaug

SEQ ID NO: 495250 - RNA, 19 nt, Homo sapiens
ugacggacuucauucaaga

SEQ ID NO: 495251 - RNA, 19 nt, Homo sapiens
uguacgagcucaucgagaa

SEQ ID NO: 495252 - RNA, 19 nt, Homo sapiens
gagcuacacucccacuucu

SEQ ID NO: 495253 - RNA, 19 nt, Homo sapiens
gcauauguguuggcuuguu

SEQ ID NO: 495254 - RNA, 19 nt, Homo sapiens
gaaacagaaccauaaagca

SEQ ID NO: 495255 - RNA, 19 nt, Homo sapiens
caagucggcuguggagaug

SEQ ID NO: 495256 - RNA, 19 nt, Homo sapiens
acagaaccauaaagcauau

SEQ ID NO: 495257 - RNA, 19 nt, Homo sapiens
gaaggcaggugagcaacca

SEQ ID NO: 495258 - RNA, 19 nt, Homo sapiens
aaacagaaccauaaagcau

SEQ ID NO: 495259 - RNA, 19 nt, Homo sapiens
ggaugccucugcacgugaa

SEQ ID NO: 495260 - RNA, 19 nt, Homo sapiens
ucauagacccucucaagug

SEQ ID NO: 495261 - RNA, 19 nt, Homo sapiens
ggacugggugcauaucuuc

SEQ ID NO: 495262 - RNA, 19 nt, Homo sapiens
gggacugggugcauaucuu

SEQ ID NO: 495263 - RNA, 19 nt, Homo sapiens
caacaacuucuccauccuu

SEQ ID NO: 495264 - RNA, 19 nt, Homo sapiens
cuucuugccuucagauguu

SEQ ID NO: 495265 - RNA, 19 nt, Homo sapiens
guucauagacccucucaag

SEQ ID NO: 495266 - RNA, 19 nt, Homo sapiens
gggauggacugaugcuuuu

SEQ ID NO: 495267 - RNA, 19 nt, Homo sapiens
guuccgaauuccugcguuu

SEQ ID NO: 495268 - RNA, 19 nt, Homo sapiens
gaggaauuccagcaucuga

SEQ ID NO: 495269 - RNA, 19 nt, Homo sapiens
cggaaugaaugacguccuu

SEQ ID NO: 495270 - RNA, 19 nt, Homo sapiens
gugccgaggagcagaauuu

SEQ ID NO: 495271 - RNA, 19 nt, Homo sapiens
gcucaaacguggcuuuuag

SEQ ID NO: 495272 - RNA, 19 nt, Homo sapiens
aacagaaccauaaagcaua

SEQ ID NO: 495273 - RNA, 19 nt, Homo sapiens
ucuggaaccugaaguugau

SEQ ID NO: 495274 - RNA, 19 nt, Homo sapiens
ggaauuccagcaucugaag

SEQ ID NO: 495275 - RNA, 19 nt, Homo sapiens
uaacaguccgcccuacuuc

SEQ ID NO: 495276 - RNA, 19 nt, Homo sapiens
aacaacuucuccauccuuu

SEQ ID NO: 495277 - RNA, 19 nt, Homo sapiens
aagcagcccuuggccagaa

SEQ ID NO: 495278 - RNA, 19 nt, Homo sapiens
gcuacacucccacuucuuc

SEQ ID NO: 495279 - RNA, 19 nt, Homo sapiens
uccagcaucugaagacuca

SEQ ID NO: 495280 - RNA, 19 nt, Homo sapiens
ccuccgugcuuccucaguu

SEQ ID NO: 495281 - RNA, 19 nt, Homo sapiens
ugacguccuuccuaacagu

SEQ ID NO: 495282 - RNA, 19 nt, Homo sapiens
cuccgugcuuccucaguua

SEQ ID NO: 495283 - RNA, 19 nt, Homo sapiens
gcugccuucuggauucuug

SEQ ID NO: 495284 - RNA, 19 nt, Homo sapiens
ggaccaaguacaugaacca

SEQ ID NO: 495285 - RNA, 19 nt, Homo sapiens
ugaaacagaaccauaaagc

SEQ ID NO: 495286 - RNA, 19 nt, Homo sapiens
ggccuggguuuucauguuu

SEQ ID NO: 495287 - RNA, 19 nt, Homo sapiens
gggcucucuuuccuucuug

SEQ ID NO: 495288 - RNA, 19 nt, Homo sapiens
uagacagauuuguucauag

SEQ ID NO: 495289 - RNA, 19 nt, Homo sapiens
gaauuccagcaucugaaga

SEQ ID NO: 495290 - RNA, 19 nt, Homo sapiens
ucaucaccguguccaauca

SEQ ID NO: 495291 - RNA, 19 nt, Homo sapiens
gggaaagugaacaugaguu

SEQ ID NO: 495292 - RNA, 19 nt, Homo sapiens
gggaaagguguucuagaca

SEQ ID NO: 495293 - RNA, 19 nt, Homo sapiens
aagaggaauuccagcaucu

SEQ ID NO: 495294 - RNA, 19 nt, Homo sapiens
gcgccugauugcugagugu

SEQ ID NO: 495295 - RNA, 19 nt, Homo sapiens
gaauuccugcguuucaagu

SEQ ID NO: 495296 - RNA, 19 nt, Homo sapiens
ccuguggcaugucggaaug

SEQ ID NO: 495297 - RNA, 19 nt, Homo sapiens
ccgaauuccugcguuucaa

SEQ ID NO: 495298 - RNA, 19 nt, Homo sapiens
gggauggacuucauuuugg

SEQ ID NO: 495299 - RNA, 19 nt, Homo sapiens
cuaacaguccgcccuacuu

SEQ ID NO: 495300 - RNA, 19 nt, Homo sapiens
uggcaugucggaaugaaug

SEQ ID NO: 495301 - RNA, 19 nt, Homo sapiens
agggauggacugaugcuuu

SEQ ID NO: 495302 - RNA, 19 nt, Homo sapiens
ggggaaagguguucuagac

SEQ ID NO: 495303 - RNA, 19 nt, Homo sapiens
aagggaaagugaacaugag

SEQ ID NO: 495304 - RNA, 19 nt, Homo sapiens
ggauggacuucauuuugga

SEQ ID NO: 495305 - RNA, 19 nt, Homo sapiens
gggcugagggauggacuga

SEQ ID NO: 495306 - RNA, 19 nt, Homo sapiens
acaagucggcuguggagau

SEQ ID NO: 495307 - RNA, 19 nt, Homo sapiens
ucagugcccugccuguacu

SEQ ID NO: 495308 - RNA, 19 nt, Homo sapiens
caucuggaaccugaaguug

SEQ ID NO: 495309 - RNA, 19 nt, Homo sapiens
ggaagaagcugaggaauau

SEQ ID NO: 495310 - RNA, 19 nt, Homo sapiens
guuagaagccugaaacuuu

SEQ ID NO: 495311 - RNA, 19 nt, Homo sapiens
gcagagauccuacaagaau

SEQ ID NO: 495312 - RNA, 19 nt, Homo sapiens
gcuauguguucaaguagua

SEQ ID NO: 495313 - RNA, 19 nt, Homo sapiens
aggcagagauccuacaaga

SEQ ID NO: 495314 - RNA, 19 nt, Homo sapiens
uggaagaagcugaggaaua

SEQ ID NO: 495315 - RNA, 19 nt, Homo sapiens
gaaguuagaagccugaaac

SEQ ID NO: 495316 - RNA, 19 nt, Homo sapiens
ugaagcgguuggucaaaga

SEQ ID NO: 495317 - RNA, 19 nt, Homo sapiens
ucaaguaguaugagaaugu

SEQ ID NO: 495318 - RNA, 19 nt, Homo sapiens
ugaggaauauaaagaagca

SEQ ID NO: 495319 - RNA, 19 nt, Homo sapiens
aagaagcugaggaauauaa

SEQ ID NO: 495320 - RNA, 19 nt, Homo sapiens
gaucuucaacggauacuag

SEQ ID NO: 495321 - RNA, 19 nt, Homo sapiens
ccgcauauuuggaucuuca

SEQ ID NO: 495322 - RNA, 19 nt, Homo sapiens
caaguaguaugagaaugug

SEQ ID NO: 495323 - RNA, 19 nt, Homo sapiens
gaagaagcugaggaauaua

SEQ ID NO: 495324 - RNA, 19 nt, Homo sapiens
acugcuauguguucaagua

SEQ ID NO: 495325 - RNA, 19 nt, Homo sapiens
agaagcacguuuaguacug

SEQ ID NO: 495326 - RNA, 19 nt, Homo sapiens
gcugaggaauauaaagaag

SEQ ID NO: 495327 - RNA, 19 nt, Homo sapiens
gauccucgcgugagacaga

SEQ ID NO: 495328 - RNA, 19 nt, Homo sapiens
gaauauaaagaagcacguu

SEQ ID NO: 495329 - RNA, 19 nt, Homo sapiens
guaugagaaugugauuguu

SEQ ID NO: 495330 - RNA, 19 nt, Homo sapiens
gcacguuuaguacuggauu

SEQ ID NO: 495331 - RNA, 19 nt, Homo sapiens
uuagaagccugaaacuuuu

SEQ ID NO: 495332 - RNA, 19 nt, Homo sapiens
gugaagcgguuggucaaag

SEQ ID NO: 495333 - RNA, 19 nt, Homo sapiens
ccacugcuauguguucaag

SEQ ID NO: 495334 - RNA, 19 nt, Homo sapiens
gaagcgguuggucaaagaa

SEQ ID NO: 495335 - RNA, 19 nt, Homo sapiens
gcaggcagagauccuacaa

SEQ ID NO: 495336 - RNA, 19 nt, Homo sapiens
cagagauccuacaagaauc

SEQ ID NO: 495337 - RNA, 19 nt, Homo sapiens
aagcugaggaauauaaaga

SEQ ID NO: 495338 - RNA, 19 nt, Homo sapiens
cuucaacggauacuagaaa

SEQ ID NO: 495339 - RNA, 19 nt, Homo sapiens
guucaaguaguaugagaau

SEQ ID NO: 495340 - RNA, 19 nt, Homo sapiens
aaagaagcacguuuaguac

SEQ ID NO: 495341 - RNA, 19 nt, Homo sapiens
guaguaugagaaugugauu

SEQ ID NO: 495342 - RNA, 19 nt, Homo sapiens
gaagcugaggaauauaaag

SEQ ID NO: 495343 - RNA, 19 nt, Homo sapiens
gaccacugcuauguguuca

SEQ ID NO: 495344 - RNA, 19 nt, Homo sapiens
caacggauacuagaaaaug

SEQ ID NO: 495345 - RNA, 19 nt, Homo sapiens
gcaaaacaacaagaagaaa

SEQ ID NO: 495346 - RNA, 19 nt, Homo sapiens
ggcagagauccuacaagaa

SEQ ID NO: 495347 - RNA, 19 nt, Homo sapiens
aguaugagaaugugauugu

SEQ ID NO: 495348 - RNA, 19 nt, Homo sapiens
guguucaaguaguaugaga

SEQ ID NO: 495349 - RNA, 19 nt, Homo sapiens
uuugaccacugcuaugugu

SEQ ID NO: 495350 - RNA, 19 nt, Homo sapiens
caacaagaagaaaagauug

SEQ ID NO: 495351 - RNA, 19 nt, Homo sapiens
ugaccacugcuauguguuc

SEQ ID NO: 495352 - RNA, 19 nt, Homo sapiens
gaaggagggugauuauauu

SEQ ID NO: 495353 - RNA, 19 nt, Homo sapiens
ggaacgauguugacgauuu

SEQ ID NO: 495354 - RNA, 19 nt, Homo sapiens
ggaaggagggugauuauau

SEQ ID NO: 495355 - RNA, 19 nt, Homo sapiens
guaaugggcuccuacuugu

SEQ ID NO: 495356 - RNA, 19 nt, Homo sapiens
cgccagggcuuuauuuauu

SEQ ID NO: 495357 - RNA, 19 nt, Homo sapiens
ccaaagugcuggcauuaca

SEQ ID NO: 495358 - RNA, 19 nt, Homo sapiens
cgagagcucugguuuagau

SEQ ID NO: 495359 - RNA, 19 nt, Homo sapiens
ccagggcuuuauuuauuua

SEQ ID NO: 495360 - RNA, 19 nt, Homo sapiens
gccagggcuuuauuuauuu

SEQ ID NO: 495361 - RNA, 19 nt, Homo sapiens
guucuucacuccuaccaaa

SEQ ID NO: 495362 - RNA, 19 nt, Homo sapiens
cguaacagguauaacacua

SEQ ID NO: 495363 - RNA, 19 nt, Homo sapiens
uauugggucucgaaguuua

SEQ ID NO: 495364 - RNA, 19 nt, Homo sapiens
gaacgauguugacgauuuu

SEQ ID NO: 495365 - RNA, 19 nt, Homo sapiens
gaaggagaacagccacuuu

SEQ ID NO: 495366 - RNA, 19 nt, Homo sapiens
acaauaguuugaagcagua

SEQ ID NO: 495367 - RNA, 19 nt, Homo sapiens
ggacuaagcaguugucacu

SEQ ID NO: 495368 - RNA, 19 nt, Homo sapiens
gguauaacacuaaagcauu

SEQ ID NO: 495369 - RNA, 19 nt, Homo sapiens
caacagcuccgcauacaca

SEQ ID NO: 495370 - RNA, 19 nt, Homo sapiens
guugaaaggcggaaacaaa

SEQ ID NO: 495371 - RNA, 19 nt, Homo sapiens
gaacggcagcuggaaguug

SEQ ID NO: 495372 - RNA, 19 nt, Homo sapiens
ucagagacgcgaacaagaa

SEQ ID NO: 495373 - RNA, 19 nt, Homo sapiens
gaaacuaaucaacgacuca

SEQ ID NO: 495374 - RNA, 19 nt, Homo sapiens
guaaugguuugugauacuu

SEQ ID NO: 495375 - RNA, 19 nt, Homo sapiens
guaacagguauaacacuaa

SEQ ID NO: 495376 - RNA, 19 nt, Homo sapiens
cuuauugggucucgaaguu

SEQ ID NO: 495377 - RNA, 19 nt, Homo sapiens
gcauacacaguacgaaaga

SEQ ID NO: 495378 - RNA, 19 nt, Homo sapiens
gaaauauccagugggacua

SEQ ID NO: 495379 - RNA, 19 nt, Homo sapiens
gccaacagcuccgcauaca

SEQ ID NO: 495380 - RNA, 19 nt, Homo sapiens
gaagaggagcgaaauaucc

SEQ ID NO: 495381 - RNA, 19 nt, Homo sapiens
cuaaucaacgacucaguuu

SEQ ID NO: 495382 - RNA, 19 nt, Homo sapiens
gaaccaggagguagagaag

SEQ ID NO: 495383 - RNA, 19 nt, Homo sapiens
gcuuuguaaugguuuguga

SEQ ID NO: 495384 - RNA, 19 nt, Homo sapiens
ggagggugauuauauugcu

SEQ ID NO: 495385 - RNA, 19 nt, Homo sapiens
gggaaggagggugauuaua

SEQ ID NO: 495386 - RNA, 19 nt, Homo sapiens
uguaaugggcuccuacuug

SEQ ID NO: 495387 - RNA, 19 nt, Homo sapiens
cagcuccgcauacacagua

SEQ ID NO: 495388 - RNA, 19 nt, Homo sapiens
ugaccgaacugagcaacug

SEQ ID NO: 495389 - RNA, 19 nt, Homo sapiens
ccacgccagggcuuuauuu

SEQ ID NO: 495390 - RNA, 19 nt, Homo sapiens
ccagugggacuaagcaguu

SEQ ID NO: 495391 - RNA, 19 nt, Homo sapiens
aaugggcuccuacuuguaa

SEQ ID NO: 495392 - RNA, 19 nt, Homo sapiens
ggagaucgacaaggacuuc

SEQ ID NO: 495393 - RNA, 19 nt, Homo sapiens
ggucagacuguauggaaau

SEQ ID NO: 495394 - RNA, 19 nt, Homo sapiens
gagggugauuauauugcuu

SEQ ID NO: 495395 - RNA, 19 nt, Homo sapiens
uguccgggcugcucucgaa

SEQ ID NO: 495396 - RNA, 19 nt, Homo sapiens
aacggcagcuggaaguuga

SEQ ID NO: 495397 - RNA, 19 nt, Homo sapiens
ggagcuacccggagaucga

SEQ ID NO: 495398 - RNA, 19 nt, Homo sapiens
gggcuccuacuuguaauuu

SEQ ID NO: 495399 - RNA, 19 nt, Homo sapiens
ugcagaaacuaaucaacga

SEQ ID NO: 495400 - RNA, 19 nt, Homo sapiens
ccaccacgccagggcuuua

SEQ ID NO: 495401 - RNA, 19 nt, Homo sapiens
gucaugccuuugagacuga

SEQ ID NO: 495402 - RNA, 19 nt, Homo sapiens
acucuguucuucacuccua

SEQ ID NO: 495403 - RNA, 19 nt, Homo sapiens
gagcucugguuuagauagg

SEQ ID NO: 495404 - RNA, 19 nt, Homo sapiens
ccagcugggucugcgguuu

SEQ ID NO: 495405 - RNA, 19 nt, Homo sapiens
acccggagaucgacaagga

SEQ ID NO: 495406 - RNA, 19 nt, Homo sapiens
uguaaugguuugugauacu

SEQ ID NO: 495407 - RNA, 19 nt, Homo sapiens
accaaauacuuuccacguu

SEQ ID NO: 495408 - RNA, 19 nt, Homo sapiens
ccgcauacacaguacgaaa

SEQ ID NO: 495409 - RNA, 19 nt, Homo sapiens
cccggcaguugaaagcaua

SEQ ID NO: 495410 - RNA, 19 nt, Homo sapiens
gcaguugucacucuguucu

SEQ ID NO: 495411 - RNA, 19 nt, Homo sapiens
cccaacacccugcggcuaa

SEQ ID NO: 495412 - RNA, 19 nt, Homo sapiens
caauauggaguccgucagu

SEQ ID NO: 495413 - RNA, 19 nt, Homo sapiens
gaaguugaaaggcggaaac

SEQ ID NO: 495414 - RNA, 19 nt, Homo sapiens
ugaagaggagcgaaauauc

SEQ ID NO: 495415 - RNA, 19 nt, Homo sapiens
ccaaacuggaguauucuuc

SEQ ID NO: 495416 - RNA, 19 nt, Homo sapiens
gauauggccuccccaaacu

SEQ ID NO: 495417 - RNA, 19 nt, Homo sapiens
cuggaacgauguugacgau

SEQ ID NO: 495418 - RNA, 19 nt, Homo sapiens
ucacuccuaccaaauacuu

SEQ ID NO: 495419 - RNA, 19 nt, Homo sapiens
aagcaguugucacucuguu

SEQ ID NO: 495420 - RNA, 19 nt, Homo sapiens
cuucgagagcucugguuua

SEQ ID NO: 495421 - RNA, 19 nt, Homo sapiens
ggauccaguucgccccuua

SEQ ID NO: 495422 - RNA, 19 nt, Homo sapiens
gcaccagcgcgacguucuu

SEQ ID NO: 495423 - RNA, 19 nt, Homo sapiens
ggcagaaccaggagguaga

SEQ ID NO: 495424 - RNA, 19 nt, Homo sapiens
uaaugggcuccuacuugua

SEQ ID NO: 495425 - RNA, 19 nt, Homo sapiens
uuaaggcuagagauuguaa

SEQ ID NO: 495426 - RNA, 19 nt, Homo sapiens
ucuucacuccuaccaaaua

SEQ ID NO: 495427 - RNA, 19 nt, Homo sapiens
acuaagcaguugucacucu

SEQ ID NO: 495428 - RNA, 19 nt, Homo sapiens
cugaagaggagcgaaauau

SEQ ID NO: 495429 - RNA, 19 nt, Homo sapiens
ccugaagaggagcgaaaua

SEQ ID NO: 495430 - RNA, 19 nt, Homo sapiens
aaugguuugugauacuuga

SEQ ID NO: 495431 - RNA, 19 nt, Homo sapiens
cacgccagggcuuuauuua

SEQ ID NO: 495432 - RNA, 19 nt, Homo sapiens
cgcuucagcuucccaaagu

SEQ ID NO: 495433 - RNA, 19 nt, Homo sapiens
gagagcucugguuuagaua

SEQ ID NO: 495434 - RNA, 19 nt, Homo sapiens
caaccuggagucccaaguc

SEQ ID NO: 495435 - RNA, 19 nt, Homo sapiens
accaggagguagagaagga

SEQ ID NO: 495436 - RNA, 19 nt, Homo sapiens
ucccaaagugcuggcauua

SEQ ID NO: 495437 - RNA, 19 nt, Homo sapiens
gauccacccgcuucagcuu

SEQ ID NO: 495438 - RNA, 19 nt, Homo sapiens
aauauggaguccgucaguu

SEQ ID NO: 495439 - RNA, 19 nt, Homo sapiens
uucgagagcucugguuuag

SEQ ID NO: 495440 - RNA, 19 nt, Homo sapiens
cggucagacuguauggaaa

SEQ ID NO: 495441 - RNA, 19 nt, Homo sapiens
gcagcuggaaguugaaagg

SEQ ID NO: 495442 - RNA, 19 nt, Homo sapiens
gcuccuacuuguaauuucc

SEQ ID NO: 495443 - RNA, 19 nt, Homo sapiens
gagcaacugcacggucaga

SEQ ID NO: 495444 - RNA, 19 nt, Homo sapiens
gggcugcagaaacuaauca

SEQ ID NO: 495445 - RNA, 19 nt, Homo sapiens
acuaaucaacgacucaguu

SEQ ID NO: 495446 - RNA, 19 nt, Homo sapiens
ccaccacgcgaacucguau

SEQ ID NO: 495447 - RNA, 19 nt, Homo sapiens
caccagcgcgacguucuuu

SEQ ID NO: 495448 - RNA, 19 nt, Homo sapiens
aaauauccagugggacuaa

SEQ ID NO: 495449 - RNA, 19 nt, Homo sapiens
ggcaauggcugauaaauga

SEQ ID NO: 495450 - RNA, 19 nt, Homo sapiens
caaaugugcuuccuauaaa

SEQ ID NO: 495451 - RNA, 19 nt, Homo sapiens
gagaauguuucccagauuu

SEQ ID NO: 495452 - RNA, 19 nt, Homo sapiens
gcucuaugaucgucaguua

SEQ ID NO: 495453 - RNA, 19 nt, Homo sapiens
gaaacccgcuacaugcuuu

SEQ ID NO: 495454 - RNA, 19 nt, Homo sapiens
ggaggcagaucccgcaauu

SEQ ID NO: 495455 - RNA, 19 nt, Homo sapiens
gaucagacaucuccagcuu

SEQ ID NO: 495456 - RNA, 19 nt, Homo sapiens
gugagaagauugaccguuu

SEQ ID NO: 495457 - RNA, 19 nt, Homo sapiens
gaggacagcucaugagaca

SEQ ID NO: 495458 - RNA, 19 nt, Homo sapiens
gcugauaaaugacacuuug

SEQ ID NO: 495459 - RNA, 19 nt, Homo sapiens
gaccgaagaugacgacgaa

SEQ ID NO: 495460 - RNA, 19 nt, Homo sapiens
gcagaguccuacuugauug

SEQ ID NO: 495461 - RNA, 19 nt, Homo sapiens
gacauaaacugcagaagag

SEQ ID NO: 495462 - RNA, 19 nt, Homo sapiens
ggagcagccucaucuguug

SEQ ID NO: 495463 - RNA, 19 nt, Homo sapiens
gagagaauguuucccagau

SEQ ID NO: 495464 - RNA, 19 nt, Homo sapiens
gaccacagcugacuauuuu

SEQ ID NO: 495465 - RNA, 19 nt, Homo sapiens
gcguaauaauggacaaaua

SEQ ID NO: 495466 - RNA, 19 nt, Homo sapiens
acaaaugugcuuccuauaa

SEQ ID NO: 495467 - RNA, 19 nt, Homo sapiens
guccuuguguccagauuua

SEQ ID NO: 495468 - RNA, 19 nt, Homo sapiens
ggugauugcugcgguguuu

SEQ ID NO: 495469 - RNA, 19 nt, Homo sapiens
gagcugaagcccuuuguga

SEQ ID NO: 495470 - RNA, 19 nt, Homo sapiens
ugaaggcgcugaccuacga

SEQ ID NO: 495471 - RNA, 19 nt, Homo sapiens
aaagcaagauggcugaguu

SEQ ID NO: 495472 - RNA, 19 nt, Homo sapiens
ugaccugccugaucccuuu

SEQ ID NO: 495473 - RNA, 19 nt, Homo sapiens
ucaugaaguugccgaugua

SEQ ID NO: 495474 - RNA, 19 nt, Homo sapiens
aggacaaccuucugaauga

SEQ ID NO: 495475 - RNA, 19 nt, Homo sapiens
gaggacaaccuucugaaug

SEQ ID NO: 495476 - RNA, 19 nt, Homo sapiens
gaacuuguuguuggacaua

SEQ ID NO: 495477 - RNA, 19 nt, Homo sapiens
ucuaugaucgucaguuaua

SEQ ID NO: 495478 - RNA, 19 nt, Homo sapiens
gaagacuguuugcccuaug

SEQ ID NO: 495479 - RNA, 19 nt, Homo sapiens
uaaaugacacuuugagaca

SEQ ID NO: 495480 - RNA, 19 nt, Homo sapiens
gguuggcaauggcugauaa

SEQ ID NO: 495481 - RNA, 19 nt, Homo sapiens
ggacagcucaugagacaag

SEQ ID NO: 495482 - RNA, 19 nt, Homo sapiens
agacauaaacugcagaaga

SEQ ID NO: 495483 - RNA, 19 nt, Homo sapiens
guacacgcagccaaugaua

SEQ ID NO: 495484 - RNA, 19 nt, Homo sapiens
gcacuuucccucaugguau

SEQ ID NO: 495485 - RNA, 19 nt, Homo sapiens
ggucugugcuggacugcuu

SEQ ID NO: 495486 - RNA, 19 nt, Homo sapiens
gauaaaugacacuuugaga

SEQ ID NO: 495487 - RNA, 19 nt, Homo sapiens
caccuugaauggaugauga

SEQ ID NO: 495488 - RNA, 19 nt, Homo sapiens
gcagugaauauuacaugaa

SEQ ID NO: 495489 - RNA, 19 nt, Homo sapiens
cagcuucccuuguacaucu

SEQ ID NO: 495490 - RNA, 19 nt, Homo sapiens
uugaauggaugaugaacuu

SEQ ID NO: 495491 - RNA, 19 nt, Homo sapiens
ggacgccucugccuucacu

SEQ ID NO: 495492 - RNA, 19 nt, Homo sapiens
ggagugggaucugcgaaca

SEQ ID NO: 495493 - RNA, 19 nt, Homo sapiens
guccagaucuucacaugag

SEQ ID NO: 495494 - RNA, 19 nt, Homo sapiens
ggcccuggcacaaauauuu

SEQ ID NO: 495495 - RNA, 19 nt, Homo sapiens
caagcacgaauguccauaa

SEQ ID NO: 495496 - RNA, 19 nt, Homo sapiens
agagaauguuucccagauu

SEQ ID NO: 495497 - RNA, 19 nt, Homo sapiens
uagauuuggucacaauuca

SEQ ID NO: 495498 - RNA, 19 nt, Homo sapiens
agacauugcucaccuacag

SEQ ID NO: 495499 - RNA, 19 nt, Homo sapiens
gaaguugcuugcgcucugu

SEQ ID NO: 495500 - RNA, 19 nt, Homo sapiens
ugacgcuccugcacuuuga

SEQ ID NO: 495501 - RNA, 19 nt, Homo sapiens
gcaggccagugagaagauu

SEQ ID NO: 495502 - RNA, 19 nt, Homo sapiens
gaagcugugugcggagaga

SEQ ID NO: 495503 - RNA, 19 nt, Homo sapiens
cuuccaggcuuccuucuga

SEQ ID NO: 495504 - RNA, 19 nt, Homo sapiens
gaguccagaucuucacaug

SEQ ID NO: 495505 - RNA, 19 nt, Homo sapiens
ugaccacagcugacuauuu

SEQ ID NO: 495506 - RNA, 19 nt, Homo sapiens
ccagacuguuggugugaaa

SEQ ID NO: 495507 - RNA, 19 nt, Homo sapiens
caucucaucucaagucacu

SEQ ID NO: 495508 - RNA, 19 nt, Homo sapiens
ggacgagacacuggccuuu

SEQ ID NO: 495509 - RNA, 19 nt, Homo sapiens
gaugaugaacuuguuguug

SEQ ID NO: 495510 - RNA, 19 nt, Homo sapiens
agacaagcaguguguguuu

SEQ ID NO: 495511 - RNA, 19 nt, Homo sapiens
gguguuugaccgagacaua

SEQ ID NO: 495512 - RNA, 19 nt, Homo sapiens
gcccuggcacaaauauuua

SEQ ID NO: 495513 - RNA, 19 nt, Homo sapiens
ggaaacccgcuacaugcuu

SEQ ID NO: 495514 - RNA, 19 nt, Homo sapiens
gagcagcgcaaccgucugu

SEQ ID NO: 495515 - RNA, 19 nt, Homo sapiens
caaaagauauccagaagcu

SEQ ID NO: 495516 - RNA, 19 nt, Homo sapiens
ggacaaccuucugaaugag

SEQ ID NO: 495517 - RNA, 19 nt, Homo sapiens
ggacccuucugcagaucuu

SEQ ID NO: 495518 - RNA, 19 nt, Homo sapiens
gaauggaugaugaacuugu

SEQ ID NO: 495519 - RNA, 19 nt, Homo sapiens
gaagaugacgacgaagaug

SEQ ID NO: 495520 - RNA, 19 nt, Homo sapiens
ugaccagucugauggaucu

SEQ ID NO: 495521 - RNA, 19 nt, Homo sapiens
ggacauagugcaagaucag

SEQ ID NO: 495522 - RNA, 19 nt, Homo sapiens
caccaagguucgaggcuau

SEQ ID NO: 495523 - RNA, 19 nt, Homo sapiens
gcgggacccuucugcagau

SEQ ID NO: 495524 - RNA, 19 nt, Homo sapiens
cagugaauauuacaugaag

SEQ ID NO: 495525 - RNA, 19 nt, Homo sapiens
ugacaaggcccgagaugca

SEQ ID NO: 495526 - RNA, 19 nt, Homo sapiens
ccugaucccuuuugauuuu

SEQ ID NO: 495527 - RNA, 19 nt, Homo sapiens
ugagaagauugaccguuuc

SEQ ID NO: 495528 - RNA, 19 nt, Homo sapiens
gagcugaucgaggcccaua

SEQ ID NO: 495529 - RNA, 19 nt, Homo sapiens
ugauggaucugacacuucu

SEQ ID NO: 495530 - RNA, 19 nt, Homo sapiens
ugaaggccauugcgaggau

SEQ ID NO: 495531 - RNA, 19 nt, Homo sapiens
ccaacuguuuccugguuau

SEQ ID NO: 495532 - RNA, 19 nt, Homo sapiens
cgagugcacuggugauugc

SEQ ID NO: 495533 - RNA, 19 nt, Homo sapiens
ccuacuugauugucaguga

SEQ ID NO: 495534 - RNA, 19 nt, Homo sapiens
agaauguuucccagauuua

SEQ ID NO: 495535 - RNA, 19 nt, Homo sapiens
gaaggccauugcgaggauu

SEQ ID NO: 495536 - RNA, 19 nt, Homo sapiens
gagcaguuacccacacuuc

SEQ ID NO: 495537 - RNA, 19 nt, Homo sapiens
ugaagacuguuugcccuau

SEQ ID NO: 495538 - RNA, 19 nt, Homo sapiens
acacgcagccaaugauaga

SEQ ID NO: 495539 - RNA, 19 nt, Homo sapiens
uuucaucccucauccuuca

SEQ ID NO: 495540 - RNA, 19 nt, Homo sapiens
gaggagaacuggaaaagcu

SEQ ID NO: 495541 - RNA, 19 nt, Homo sapiens
gugaauauuacaugaagga

SEQ ID NO: 495542 - RNA, 19 nt, Homo sapiens
gacacugaguccagaucuu

SEQ ID NO: 495543 - RNA, 19 nt, Homo sapiens
gaguacacgcagccaauga

SEQ ID NO: 495544 - RNA, 19 nt, Homo sapiens
gaccaugaagcuugggaaa

SEQ ID NO: 495545 - RNA, 19 nt, Homo sapiens
gauuuggucacaauucaga

SEQ ID NO: 495546 - RNA, 19 nt, Homo sapiens
ccaccgaggagaacuggaa

SEQ ID NO: 495547 - RNA, 19 nt, Homo sapiens
gagacaagcaguguguguu

SEQ ID NO: 495548 - RNA, 19 nt, Homo sapiens
caacuguuuccugguuaua

SEQ ID NO: 495549 - RNA, 19 nt, Homo sapiens
gaacaauucuacugucaaa

SEQ ID NO: 495550 - RNA, 19 nt, Homo sapiens
ucaaugagcuagagaaguu

SEQ ID NO: 495551 - RNA, 19 nt, Homo sapiens
gcugaagcauguccuaaua

SEQ ID NO: 495552 - RNA, 19 nt, Homo sapiens
ugaagacgcugaacaaaug

SEQ ID NO: 495553 - RNA, 19 nt, Homo sapiens
gaaauauggugcaccugaa

SEQ ID NO: 495554 - RNA, 19 nt, Homo sapiens
gcgggcagaucucauauuu

SEQ ID NO: 495555 - RNA, 19 nt, Homo sapiens
gaaacaggcugguggacau

SEQ ID NO: 495556 - RNA, 19 nt, Homo sapiens
uaagaaccgcuauguguua

SEQ ID NO: 495557 - RNA, 19 nt, Homo sapiens
ggaacagacuuucuuacug

SEQ ID NO: 495558 - RNA, 19 nt, Homo sapiens
ggaauuucuucucuacauu

SEQ ID NO: 495559 - RNA, 19 nt, Homo sapiens
gaucuuuccucuaaucaau

SEQ ID NO: 495560 - RNA, 19 nt, Homo sapiens
gaaccgcuauguguuagaa

SEQ ID NO: 495561 - RNA, 19 nt, Homo sapiens
uuaaagaccacacugcuua

SEQ ID NO: 495562 - RNA, 19 nt, Homo sapiens
ggugacaaccaacuaauaa

SEQ ID NO: 495563 - RNA, 19 nt, Homo sapiens
gggcagaucucauauuuug

SEQ ID NO: 495564 - RNA, 19 nt, Homo sapiens
gaccaaagaggacaaagaa

SEQ ID NO: 495565 - RNA, 19 nt, Homo sapiens
cuacuaacacugaagauaa

SEQ ID NO: 495566 - RNA, 19 nt, Homo sapiens
aaagucagcugagcaaguu

SEQ ID NO: 495567 - RNA, 19 nt, Homo sapiens
ggucgaagaguugaaguua

SEQ ID NO: 495568 - RNA, 19 nt, Homo sapiens
gaccuaaagucauuacagu

SEQ ID NO: 495569 - RNA, 19 nt, Homo sapiens
gaccauuucuaggcuuaua

SEQ ID NO: 495570 - RNA, 19 nt, Homo sapiens
uggagaacaugcaacagua

SEQ ID NO: 495571 - RNA, 19 nt, Homo sapiens
ucacagcccaucccagaua

SEQ ID NO: 495572 - RNA, 19 nt, Homo sapiens
ggacauaaggauccggaaa

SEQ ID NO: 495573 - RNA, 19 nt, Homo sapiens
uggaggaacucuaccuuga

SEQ ID NO: 495574 - RNA, 19 nt, Homo sapiens
ucgaagaguugaaguuaau

SEQ ID NO: 495575 - RNA, 19 nt, Homo sapiens
gcugucacgucuucucaaa

SEQ ID NO: 495576 - RNA, 19 nt, Homo sapiens
ccuaaagucauuacaguuu

SEQ ID NO: 495577 - RNA, 19 nt, Homo sapiens
ucucaaaguuccuguguca

SEQ ID NO: 495578 - RNA, 19 nt, Homo sapiens
agaaaguccuggagaaaca

SEQ ID NO: 495579 - RNA, 19 nt, Homo sapiens
cuagagaaguuaccaaguc

SEQ ID NO: 495580 - RNA, 19 nt, Homo sapiens
acaaucagauaucacaaug

SEQ ID NO: 495581 - RNA, 19 nt, Homo sapiens
aaacgacaaucagauauca

SEQ ID NO: 495582 - RNA, 19 nt, Homo sapiens
ggauugcugucacgucuuc

SEQ ID NO: 495583 - RNA, 19 nt, Homo sapiens
ucccuccgguucaguauua

SEQ ID NO: 495584 - RNA, 19 nt, Homo sapiens
ucagaaagguagauuuguc

SEQ ID NO: 495585 - RNA, 19 nt, Homo sapiens
gaccagaggaagauagaaa

SEQ ID NO: 495586 - RNA, 19 nt, Homo sapiens
ccagacagucaaguuauua

SEQ ID NO: 495587 - RNA, 19 nt, Homo sapiens
gggaugaagugauacacau

SEQ ID NO: 495588 - RNA, 19 nt, Homo sapiens
gaacaugcaacaguacguu

SEQ ID NO: 495589 - RNA, 19 nt, Homo sapiens
gcccagguuagaacaauua

SEQ ID NO: 495590 - RNA, 19 nt, Homo sapiens
ugaagcauguccuaauauc

SEQ ID NO: 495591 - RNA, 19 nt, Homo sapiens
caauuaauccucucugaca

SEQ ID NO: 495592 - RNA, 19 nt, Homo sapiens
ggaacgcuuucuguacuga

SEQ ID NO: 495593 - RNA, 19 nt, Homo sapiens
gaugaagugauacacauug

SEQ ID NO: 495594 - RNA, 19 nt, Homo sapiens
ggaugucauuggucgaaga

SEQ ID NO: 495595 - RNA, 19 nt, Homo sapiens
gcuacuaacacugaagaua

SEQ ID NO: 495596 - RNA, 19 nt, Homo sapiens
gucgaagaguugaaguuaa

SEQ ID NO: 495597 - RNA, 19 nt, Homo sapiens
ggaaguccuuaaugucagu

SEQ ID NO: 495598 - RNA, 19 nt, Homo sapiens
uaucagaaagguagauuug

SEQ ID NO: 495599 - RNA, 19 nt, Homo sapiens
acgaagggacuguguauuu

SEQ ID NO: 495600 - RNA, 19 nt, Homo sapiens
gugaccauuucuaggcuua

SEQ ID NO: 495601 - RNA, 19 nt, Homo sapiens
gaccuucuguuguccuaug

SEQ ID NO: 495602 - RNA, 19 nt, Homo sapiens
gaagggacuguguauuuua

SEQ ID NO: 495603 - RNA, 19 nt, Homo sapiens
guugggaagugaccauuuc

SEQ ID NO: 495604 - RNA, 19 nt, Homo sapiens
aaaucgagcuggaaaauga

SEQ ID NO: 495605 - RNA, 19 nt, Homo sapiens
aaacacagcaaccacuuau

SEQ ID NO: 495606 - RNA, 19 nt, Homo sapiens
aaucagauaucacaauggu

SEQ ID NO: 495607 - RNA, 19 nt, Homo sapiens
guaaacgacaaucagauau

SEQ ID NO: 495608 - RNA, 19 nt, Homo sapiens
guaguaaacgacaaucaga

SEQ ID NO: 495609 - RNA, 19 nt, Homo sapiens
caccggaaauaaaugauuc

SEQ ID NO: 495610 - RNA, 19 nt, Homo sapiens
ggaguagaaugggacaauc

SEQ ID NO: 495611 - RNA, 19 nt, Homo sapiens
gaaaauggagauugucuau

SEQ ID NO: 495612 - RNA, 19 nt, Homo sapiens
ucaaaguuccugugucaga

SEQ ID NO: 495613 - RNA, 19 nt, Homo sapiens
aaacagacucagcgaagaa

SEQ ID NO: 495614 - RNA, 19 nt, Homo sapiens
gcuuuguccugccuaagaa

SEQ ID NO: 495615 - RNA, 19 nt, Homo sapiens
gaagcauguccuaauauca

SEQ ID NO: 495616 - RNA, 19 nt, Homo sapiens
gaaaagagcaaauuguuac

SEQ ID NO: 495617 - RNA, 19 nt, Homo sapiens
augauucacuggaacaauu

SEQ ID NO: 495618 - RNA, 19 nt, Homo sapiens
aaaauacccucaucaacuu

SEQ ID NO: 495619 - RNA, 19 nt, Homo sapiens
gaucucauauuuuggauuc

SEQ ID NO: 495620 - RNA, 19 nt, Homo sapiens
ugucacgucuucucaaagu

SEQ ID NO: 495621 - RNA, 19 nt, Homo sapiens
caaagaggacaaagaagca

SEQ ID NO: 495622 - RNA, 19 nt, Homo sapiens
ugucauuggucgaagaguu

SEQ ID NO: 495623 - RNA, 19 nt, Homo sapiens
aguaaacgacaaucagaua

SEQ ID NO: 495624 - RNA, 19 nt, Homo sapiens
gguuuugacucuauuauga

SEQ ID NO: 495625 - RNA, 19 nt, Homo sapiens
auaaaccuguggagacuau

SEQ ID NO: 495626 - RNA, 19 nt, Homo sapiens
gcaauuaagaaccgcuaug

SEQ ID NO: 495627 - RNA, 19 nt, Homo sapiens
guccgaacaagguaaauuu

SEQ ID NO: 495628 - RNA, 19 nt, Homo sapiens
gcaaccacuuaugcugaaa

SEQ ID NO: 495629 - RNA, 19 nt, Homo sapiens
ccacgaagggacuguguau

SEQ ID NO: 495630 - RNA, 19 nt, Homo sapiens
uaacuggaacgcuuucugu

SEQ ID NO: 495631 - RNA, 19 nt, Homo sapiens
ggaugaagugauacacauu

SEQ ID NO: 495632 - RNA, 19 nt, Homo sapiens
cgaagggacuguguauuuu

SEQ ID NO: 495633 - RNA, 19 nt, Homo sapiens
gcugaacaaaugugagauu

SEQ ID NO: 495634 - RNA, 19 nt, Homo sapiens
gaaguuaauggagaacaug

SEQ ID NO: 495635 - RNA, 19 nt, Homo sapiens
acacuggaauuucuucucu

SEQ ID NO: 495636 - RNA, 19 nt, Homo sapiens
cagguuagaacaauuaauc

SEQ ID NO: 495637 - RNA, 19 nt, Homo sapiens
acagucaaguuauuagauc

SEQ ID NO: 495638 - RNA, 19 nt, Homo sapiens
caagguaaauuuuggaaca

SEQ ID NO: 495639 - RNA, 19 nt, Homo sapiens
gggaagugaccauuucuag

SEQ ID NO: 495640 - RNA, 19 nt, Homo sapiens
ggaacaauucuacugucaa

SEQ ID NO: 495641 - RNA, 19 nt, Homo sapiens
ucagaaaguccuggagaaa

SEQ ID NO: 495642 - RNA, 19 nt, Homo sapiens
gacaaucagauaucacaau

SEQ ID NO: 495643 - RNA, 19 nt, Homo sapiens
uggaauuucuucucuacau

SEQ ID NO: 495644 - RNA, 19 nt, Homo sapiens
aacaauuaauccucucuga

SEQ ID NO: 495645 - RNA, 19 nt, Homo sapiens
uggaacaauucuacuguca

SEQ ID NO: 495646 - RNA, 19 nt, Homo sapiens
ugaaguuaauggagaacau

SEQ ID NO: 495647 - RNA, 19 nt, Homo sapiens
cagauguucuccagacagu

SEQ ID NO: 495648 - RNA, 19 nt, Homo sapiens
caaagucagcugagcaagu

SEQ ID NO: 495649 - RNA, 19 nt, Homo sapiens
caacucauuugcucuaaua

SEQ ID NO: 495650 - RNA, 19 nt, Homo sapiens
gcaaaguucuugaaugaug

SEQ ID NO: 495651 - RNA, 19 nt, Homo sapiens
gaacuggaauugcagauag

SEQ ID NO: 495652 - RNA, 19 nt, Homo sapiens
caucugaucuguucacuga

SEQ ID NO: 495653 - RNA, 19 nt, Homo sapiens
ugauagaucuuucauguug

SEQ ID NO: 495654 - RNA, 19 nt, Homo sapiens
gagagaagcacaaggagua

SEQ ID NO: 495655 - RNA, 19 nt, Homo sapiens
gcacaguucugcaaaugga

SEQ ID NO: 495656 - RNA, 19 nt, Homo sapiens
ggaaggcucuauguuugua

SEQ ID NO: 495657 - RNA, 19 nt, Homo sapiens
gauaggaaaugcccucuuc

SEQ ID NO: 495658 - RNA, 19 nt, Homo sapiens
ggacuugcauucccuuaug

SEQ ID NO: 495659 - RNA, 19 nt, Homo sapiens
caaauggacuacagcaaga

SEQ ID NO: 495660 - RNA, 19 nt, Homo sapiens
uggcaaaguucuugaauga

SEQ ID NO: 495661 - RNA, 19 nt, Homo sapiens
gagcauuucugcagcuuug

SEQ ID NO: 495662 - RNA, 19 nt, Homo sapiens
ugaaaccacuggcaaaguu

SEQ ID NO: 495663 - RNA, 19 nt, Homo sapiens
gggauggguugacuuguuu

SEQ ID NO: 495664 - RNA, 19 nt, Homo sapiens
gagcacaucaucaaauauu

SEQ ID NO: 495665 - RNA, 19 nt, Homo sapiens
cagcaugccuauucugaaa

SEQ ID NO: 495666 - RNA, 19 nt, Homo sapiens
ggacaauggucugaaacuu

SEQ ID NO: 495667 - RNA, 19 nt, Homo sapiens
uagauuaacuuccuuccaa

SEQ ID NO: 495668 - RNA, 19 nt, Homo sapiens
caaugugggugguuauuau

SEQ ID NO: 495669 - RNA, 19 nt, Homo sapiens
uaggaaggcucuauguuug

SEQ ID NO: 495670 - RNA, 19 nt, Homo sapiens
gaaguggaaccgcuuacua

SEQ ID NO: 495671 - RNA, 19 nt, Homo sapiens
ggaacaauacuaucaccua

SEQ ID NO: 495672 - RNA, 19 nt, Homo sapiens
gcacguguguauugcaaug

SEQ ID NO: 495673 - RNA, 19 nt, Homo sapiens
gaagaaguggaaccgcuua

SEQ ID NO: 495674 - RNA, 19 nt, Homo sapiens
gacaauggucugaaacuuu

SEQ ID NO: 495675 - RNA, 19 nt, Homo sapiens
gaagggauggguugacuug

SEQ ID NO: 495676 - RNA, 19 nt, Homo sapiens
gaaaguugugggucuaauu

SEQ ID NO: 495677 - RNA, 19 nt, Homo sapiens
cacagacacuccaauggua

SEQ ID NO: 495678 - RNA, 19 nt, Homo sapiens
gacaguccauggcauauuc

SEQ ID NO: 495679 - RNA, 19 nt, Homo sapiens
caaagaaggaacuggaauu

SEQ ID NO: 495680 - RNA, 19 nt, Homo sapiens
aauauagccuggugugauu

SEQ ID NO: 495681 - RNA, 19 nt, Homo sapiens
guacuugggcuucaugcua

SEQ ID NO: 495682 - RNA, 19 nt, Homo sapiens
cacaaggaguauucucuuu

SEQ ID NO: 495683 - RNA, 19 nt, Homo sapiens
ccaaauugauagaucuuuc

SEQ ID NO: 495684 - RNA, 19 nt, Homo sapiens
ggaagaggccaauccuaug

SEQ ID NO: 495685 - RNA, 19 nt, Homo sapiens
agaaggaacuggaauugca

SEQ ID NO: 495686 - RNA, 19 nt, Homo sapiens
ugucucacuucaucucuua

SEQ ID NO: 495687 - RNA, 19 nt, Homo sapiens
cagccaagcaggagauuaa

SEQ ID NO: 495688 - RNA, 19 nt, Homo sapiens
gcacaaggaguauucucuu

SEQ ID NO: 495689 - RNA, 19 nt, Homo sapiens
uggaaccgcuuacuacaga

SEQ ID NO: 495690 - RNA, 19 nt, Homo sapiens
aagcugccaugucaucuaa

SEQ ID NO: 495691 - RNA, 19 nt, Homo sapiens
gaauaccccucaacucauu

SEQ ID NO: 495692 - RNA, 19 nt, Homo sapiens
caaggaguauucucuuucu

SEQ ID NO: 495693 - RNA, 19 nt, Homo sapiens
gacaagaccaccacuguuc

SEQ ID NO: 495694 - RNA, 19 nt, Homo sapiens
caaaguucuugaaugaugu

SEQ ID NO: 495695 - RNA, 19 nt, Homo sapiens
uaaucaaugugggugguua

SEQ ID NO: 495696 - RNA, 19 nt, Homo sapiens
agacaguuccagcuucuua

SEQ ID NO: 495697 - RNA, 19 nt, Homo sapiens
ggaacuggaauugcagaua

SEQ ID NO: 495698 - RNA, 19 nt, Homo sapiens
caaaugccacucucuacaa

SEQ ID NO: 495699 - RNA, 19 nt, Homo sapiens
gcuaauugcacguguguau

SEQ ID NO: 495700 - RNA, 19 nt, Homo sapiens
gaucuuucauguuguugau

SEQ ID NO: 495701 - RNA, 19 nt, Homo sapiens
gaagcugccaugucaucua

SEQ ID NO: 495702 - RNA, 19 nt, Homo sapiens
gaagaggccaauccuaugg

SEQ ID NO: 495703 - RNA, 19 nt, Homo sapiens
ccagauggaacaauacuau

SEQ ID NO: 495704 - RNA, 19 nt, Homo sapiens
agaggacaauggucugaaa

SEQ ID NO: 495705 - RNA, 19 nt, Homo sapiens
ggaaaguugugggucuaau

SEQ ID NO: 495706 - RNA, 19 nt, Homo sapiens
ccuacucccuguccauauu

SEQ ID NO: 495707 - RNA, 19 nt, Homo sapiens
gaccuuggagccacacuuu

SEQ ID NO: 495708 - RNA, 19 nt, Homo sapiens
aguggaagcugccauguca

SEQ ID NO: 495709 - RNA, 19 nt, Homo sapiens
gucaagacccucuaugaga

SEQ ID NO: 495710 - RNA, 19 nt, Homo sapiens
guaacagccugccauucau

SEQ ID NO: 495711 - RNA, 19 nt, Homo sapiens
uaauugcacguguguauug

SEQ ID NO: 495712 - RNA, 19 nt, Homo sapiens
gaagaugggcauucagcau

SEQ ID NO: 495713 - RNA, 19 nt, Homo sapiens
uaacagucauguggagaug

SEQ ID NO: 495714 - RNA, 19 nt, Homo sapiens
gacuugcauucccuuauga

SEQ ID NO: 495715 - RNA, 19 nt, Homo sapiens
ucaaugugggugguuauua

SEQ ID NO: 495716 - RNA, 19 nt, Homo sapiens
uucagaaugucaaugagua

SEQ ID NO: 495717 - RNA, 19 nt, Homo sapiens
agaaugcucuggcacucuu

SEQ ID NO: 495718 - RNA, 19 nt, Homo sapiens
uaguggauauggaauugaa

SEQ ID NO: 495719 - RNA, 19 nt, Homo sapiens
ugcaccagauggaacaaua

SEQ ID NO: 495720 - RNA, 19 nt, Homo sapiens
gauagaucuuucauguugu

SEQ ID NO: 495721 - RNA, 19 nt, Homo sapiens
ccuaguggauauggaauug

SEQ ID NO: 495722 - RNA, 19 nt, Homo sapiens
gaugcaaaccaaagggaaa

SEQ ID NO: 495723 - RNA, 19 nt, Homo sapiens
ucacagcguuuucauaaug

SEQ ID NO: 495724 - RNA, 19 nt, Homo sapiens
cagcuuugguuaugcuuuc

SEQ ID NO: 495725 - RNA, 19 nt, Homo sapiens
gcacccaaacugagauugu

SEQ ID NO: 495726 - RNA, 19 nt, Homo sapiens
gugguugucucacuucauc

SEQ ID NO: 495727 - RNA, 19 nt, Homo sapiens
uggguugacuuguuuguuc

SEQ ID NO: 495728 - RNA, 19 nt, Homo sapiens
caaaccaaagggaaaguug

SEQ ID NO: 495729 - RNA, 19 nt, Homo sapiens
aaagaaggaacuggaauug

SEQ ID NO: 495730 - RNA, 19 nt, Homo sapiens
uggaagaggccaauccuau

SEQ ID NO: 495731 - RNA, 19 nt, Homo sapiens
augaugggaugaagauuga

SEQ ID NO: 495732 - RNA, 19 nt, Homo sapiens
ccauuucugccacauauga

SEQ ID NO: 495733 - RNA, 19 nt, Homo sapiens
gcaaaccaaagggaaaguu

SEQ ID NO: 495734 - RNA, 19 nt, Homo sapiens
agcaggagauuaacaguca

SEQ ID NO: 495735 - RNA, 19 nt, Homo sapiens
ggaauugcagauaggaaau

SEQ ID NO: 495736 - RNA, 19 nt, Homo sapiens
ucacugaauuuuccaaaga

SEQ ID NO: 495737 - RNA, 19 nt, Homo sapiens
gacuuugcauucaaucugu

SEQ ID NO: 495738 - RNA, 19 nt, Homo sapiens
agauuaacuuccuuccaaa

SEQ ID NO: 495739 - RNA, 19 nt, Homo sapiens
cauuaaugcugacuuugca

SEQ ID NO: 495740 - RNA, 19 nt, Homo sapiens
aaggcucuauguuuguaua

SEQ ID NO: 495741 - RNA, 19 nt, Homo sapiens
gaacccuggcugaacuuug

SEQ ID NO: 495742 - RNA, 19 nt, Homo sapiens
guuccaaaguuuuccauuu

SEQ ID NO: 495743 - RNA, 19 nt, Homo sapiens
gaguguuucauccaacuaa

SEQ ID NO: 495744 - RNA, 19 nt, Homo sapiens
uaugaugggaugaagauug

SEQ ID NO: 495745 - RNA, 19 nt, Homo sapiens
uaauauagccuggugugau

SEQ ID NO: 495746 - RNA, 19 nt, Homo sapiens
agggauggguugacuuguu

SEQ ID NO: 495747 - RNA, 19 nt, Homo sapiens
ggaaccgcuuacuacagaa

SEQ ID NO: 495748 - RNA, 19 nt, Homo sapiens
gcucagggaguguuucauc

SEQ ID NO: 495749 - RNA, 19 nt, Homo sapiens
gaaagagccuggaguauuu

SEQ ID NO: 495750 - RNA, 19 nt, Homo sapiens
ggaaauagauggagagguu

SEQ ID NO: 495751 - RNA, 19 nt, Homo sapiens
gaacgucgcuaauaauuuc

SEQ ID NO: 495752 - RNA, 19 nt, Homo sapiens
gaacuugacuugcguuaga

SEQ ID NO: 495753 - RNA, 19 nt, Homo sapiens
gguagaacgucgcuaauaa

SEQ ID NO: 495754 - RNA, 19 nt, Homo sapiens
gaaauggccuguggaaugu

SEQ ID NO: 495755 - RNA, 19 nt, Homo sapiens
ggucagggcuucuguggaa

SEQ ID NO: 495756 - RNA, 19 nt, Homo sapiens
ccagacauguucucuauug

SEQ ID NO: 495757 - RNA, 19 nt, Homo sapiens
gcaauucacuagacaaucu

SEQ ID NO: 495758 - RNA, 19 nt, Homo sapiens
guaagggucugcuuuguuc

SEQ ID NO: 495759 - RNA, 19 nt, Homo sapiens
uagaacaucugcugucaaa

SEQ ID NO: 495760 - RNA, 19 nt, Homo sapiens
gcaagugcuucguuugauu

SEQ ID NO: 495761 - RNA, 19 nt, Homo sapiens
ggaagaaaaucauaccaua

SEQ ID NO: 495762 - RNA, 19 nt, Homo sapiens
gaaagcagacauagcauga

SEQ ID NO: 495763 - RNA, 19 nt, Homo sapiens
ccacucggcuuucacguuu

SEQ ID NO: 495764 - RNA, 19 nt, Homo sapiens
gaccaaacgugaccuugaa

SEQ ID NO: 495765 - RNA, 19 nt, Homo sapiens
gcagcuagcacccuucaua

SEQ ID NO: 495766 - RNA, 19 nt, Homo sapiens
caaggacucugugaaguuu

SEQ ID NO: 495767 - RNA, 19 nt, Homo sapiens
ugacagaccuuccuagagu

SEQ ID NO: 495768 - RNA, 19 nt, Homo sapiens
gcagugagacgguguuauu

SEQ ID NO: 495769 - RNA, 19 nt, Homo sapiens
gaaacgcgcaacuuuguaa

SEQ ID NO: 495770 - RNA, 19 nt, Homo sapiens
agacucaacugcaaggaua

SEQ ID NO: 495771 - RNA, 19 nt, Homo sapiens
guaagugcuuuauguaaga

SEQ ID NO: 495772 - RNA, 19 nt, Homo sapiens
aaagagaucuacaccauca

SEQ ID NO: 495773 - RNA, 19 nt, Homo sapiens
gaagagaacagagcacauu

SEQ ID NO: 495774 - RNA, 19 nt, Homo sapiens
uguuguagcucauuuguuu

SEQ ID NO: 495775 - RNA, 19 nt, Homo sapiens
gaaaucuuguccacagcua

SEQ ID NO: 495776 - RNA, 19 nt, Homo sapiens
caggaaagguggucaggaa

SEQ ID NO: 495777 - RNA, 19 nt, Homo sapiens
gaaugcagaaggaagauuu

SEQ ID NO: 495778 - RNA, 19 nt, Homo sapiens
caauugcucucacaaagga

SEQ ID NO: 495779 - RNA, 19 nt, Homo sapiens
gccaugacgucccgaguaa

SEQ ID NO: 495780 - RNA, 19 nt, Homo sapiens
gcagacggcuucccauuuu

SEQ ID NO: 495781 - RNA, 19 nt, Homo sapiens
gaccagccgugaaugugua

SEQ ID NO: 495782 - RNA, 19 nt, Homo sapiens
uugaagaucuggagcauga

SEQ ID NO: 495783 - RNA, 19 nt, Homo sapiens
ucacuggcgugcucucuuu

SEQ ID NO: 495784 - RNA, 19 nt, Homo sapiens
uauggaaccugaaugagaa

SEQ ID NO: 495785 - RNA, 19 nt, Homo sapiens
ggauauggaaccugaauga

SEQ ID NO: 495786 - RNA, 19 nt, Homo sapiens
gaacaucugcugucaaagg

SEQ ID NO: 495787 - RNA, 19 nt, Homo sapiens
cgaaacacuuagcaaagaa

SEQ ID NO: 495788 - RNA, 19 nt, Homo sapiens
agaaaugaaugcagaagga

SEQ ID NO: 495789 - RNA, 19 nt, Homo sapiens
cgacugcucggcuggauua

SEQ ID NO: 495790 - RNA, 19 nt, Homo sapiens
gcaagcaauucacuagaca

SEQ ID NO: 495791 - RNA, 19 nt, Homo sapiens
cguaguaagugcuuuaugu

SEQ ID NO: 495792 - RNA, 19 nt, Homo sapiens
gagcacauucagucaauaa

SEQ ID NO: 495793 - RNA, 19 nt, Homo sapiens
gcucauuuguuucaagaga

SEQ ID NO: 495794 - RNA, 19 nt, Homo sapiens
gcagaagggcugaggaaga

SEQ ID NO: 495795 - RNA, 19 nt, Homo sapiens
ugugauggcugaauggaaa

SEQ ID NO: 495796 - RNA, 19 nt, Homo sapiens
gacaugacauugaagaucu

SEQ ID NO: 495797 - RNA, 19 nt, Homo sapiens
ggacuggaauaccaaugga

SEQ ID NO: 495798 - RNA, 19 nt, Homo sapiens
gaagcucgcucagcagcaa

SEQ ID NO: 495799 - RNA, 19 nt, Homo sapiens
gaucauauucagugucuug

SEQ ID NO: 495800 - RNA, 19 nt, Homo sapiens
ggacuugacuuuuguuuag

SEQ ID NO: 495801 - RNA, 19 nt, Homo sapiens
guaguaagugcuuuaugua

SEQ ID NO: 495802 - RNA, 19 nt, Homo sapiens
ucagucggcuggaauucua

SEQ ID NO: 495803 - RNA, 19 nt, Homo sapiens
gaucuucaggcucacaaua

SEQ ID NO: 495804 - RNA, 19 nt, Homo sapiens
agaagggccugcaguaugu

SEQ ID NO: 495805 - RNA, 19 nt, Homo sapiens
gaaguuuagaguacaguuu

SEQ ID NO: 495806 - RNA, 19 nt, Homo sapiens
ccgaaacacuuagcaaaga

SEQ ID NO: 495807 - RNA, 19 nt, Homo sapiens
cagaagggcugaggaagau

SEQ ID NO: 495808 - RNA, 19 nt, Homo sapiens
gauguggacuggcagaaca

SEQ ID NO: 495809 - RNA, 19 nt, Homo sapiens
uaaccuggccagcaccuua

SEQ ID NO: 495810 - RNA, 19 nt, Homo sapiens
agucugagguguucauuug

SEQ ID NO: 495811 - RNA, 19 nt, Homo sapiens
gagaaucaacagaucauau

SEQ ID NO: 495812 - RNA, 19 nt, Homo sapiens
agaaauggccuguggaaug

SEQ ID NO: 495813 - RNA, 19 nt, Homo sapiens
gcuuuagucuugaugaaug

SEQ ID NO: 495814 - RNA, 19 nt, Homo sapiens
agggauggcuuuagucuug

SEQ ID NO: 495815 - RNA, 19 nt, Homo sapiens
uggaugaggugaugauuuc

SEQ ID NO: 495816 - RNA, 19 nt, Homo sapiens
ucugccaucuucauaauuu

SEQ ID NO: 495817 - RNA, 19 nt, Homo sapiens
cauaguugcuucagaucuu

SEQ ID NO: 495818 - RNA, 19 nt, Homo sapiens
gcaccacuuucaacguuug

SEQ ID NO: 495819 - RNA, 19 nt, Homo sapiens
gaugaaacgcgcaacuuug

SEQ ID NO: 495820 - RNA, 19 nt, Homo sapiens
gaagaucuggagcaugaaa

SEQ ID NO: 495821 - RNA, 19 nt, Homo sapiens
caagagagaaucaacagau

SEQ ID NO: 495822 - RNA, 19 nt, Homo sapiens
aagcuuauguuucuuguca

SEQ ID NO: 495823 - RNA, 19 nt, Homo sapiens
gcacucaucucuguagaac

SEQ ID NO: 495824 - RNA, 19 nt, Homo sapiens
ggaaguaaccacaaaauau

SEQ ID NO: 495825 - RNA, 19 nt, Homo sapiens
auaaagagaucuacaccau

SEQ ID NO: 495826 - RNA, 19 nt, Homo sapiens
cggaugacaugacauugaa

SEQ ID NO: 495827 - RNA, 19 nt, Homo sapiens
gaaaggggaauuacauuuu

SEQ ID NO: 495828 - RNA, 19 nt, Homo sapiens
gagauuccauccagcaaag

SEQ ID NO: 495829 - RNA, 19 nt, Homo sapiens
gcuuauguuucuugucaaa

SEQ ID NO: 495830 - RNA, 19 nt, Homo sapiens
gguagagucaucccuguaa

SEQ ID NO: 495831 - RNA, 19 nt, Homo sapiens
ccacuuggguaugugaauu

SEQ ID NO: 495832 - RNA, 19 nt, Homo sapiens
ggugcaaucuggugugugu

SEQ ID NO: 495833 - RNA, 19 nt, Homo sapiens
caucagacauagagagcuu

SEQ ID NO: 495834 - RNA, 19 nt, Homo sapiens
agaaagagccuggaguauu

SEQ ID NO: 495835 - RNA, 19 nt, Homo sapiens
cacauucagucaauaauca

SEQ ID NO: 495836 - RNA, 19 nt, Homo sapiens
aauaauuucugccaucuuc

SEQ ID NO: 495837 - RNA, 19 nt, Homo sapiens
cgaagccaauggaaauaga

SEQ ID NO: 495838 - RNA, 19 nt, Homo sapiens
cagcaggcauuccgagaga

SEQ ID NO: 495839 - RNA, 19 nt, Homo sapiens
caagaaauggccuguggaa

SEQ ID NO: 495840 - RNA, 19 nt, Homo sapiens
gagacgguguuauugugaa

SEQ ID NO: 495841 - RNA, 19 nt, Homo sapiens
guccugaacgugaauuaua

SEQ ID NO: 495842 - RNA, 19 nt, Homo sapiens
uugcagagcugacauagag

SEQ ID NO: 495843 - RNA, 19 nt, Homo sapiens
gauggucauuucuccaaga

SEQ ID NO: 495844 - RNA, 19 nt, Homo sapiens
gagcauuggcagaaccaua

SEQ ID NO: 495845 - RNA, 19 nt, Homo sapiens
gaagaagaaccucgcaucu

SEQ ID NO: 495846 - RNA, 19 nt, Homo sapiens
ggauccgucuggaauguug

SEQ ID NO: 495847 - RNA, 19 nt, Homo sapiens
ucaccucacuggacuggaa

SEQ ID NO: 495848 - RNA, 19 nt, Homo sapiens
gcuuuguucuuguugcuuu

SEQ ID NO: 495849 - RNA, 19 nt, Homo sapiens
gaagauggauguugaguug

SEQ ID NO: 495850 - RNA, 19 nt, Homo sapiens
gaagauaacccaaggaauu

SEQ ID NO: 495851 - RNA, 19 nt, Homo sapiens
gaugugaaguuuccuauaa

SEQ ID NO: 495852 - RNA, 19 nt, Homo sapiens
gaaguuuccuauaagguua

SEQ ID NO: 495853 - RNA, 19 nt, Homo sapiens
ggacagaauauauguguua

SEQ ID NO: 495854 - RNA, 19 nt, Homo sapiens
gcgcaaggguuucugguuu

SEQ ID NO: 495855 - RNA, 19 nt, Homo sapiens
gaaaacaucuacccuauuc

SEQ ID NO: 495856 - RNA, 19 nt, Homo sapiens
gguuuaaucuacagaauga

SEQ ID NO: 495857 - RNA, 19 nt, Homo sapiens
cuaaagggauucaggaaga

SEQ ID NO: 495858 - RNA, 19 nt, Homo sapiens
gaucaaacccagaauuguu

SEQ ID NO: 495859 - RNA, 19 nt, Homo sapiens
ggagaguucugggauugua

SEQ ID NO: 495860 - RNA, 19 nt, Homo sapiens
gugagaagauggauguuga

SEQ ID NO: 495861 - RNA, 19 nt, Homo sapiens
guuguaaacuugaccuaaa

SEQ ID NO: 495862 - RNA, 19 nt, Homo sapiens
aaagccaccucuauaauug

SEQ ID NO: 495863 - RNA, 19 nt, Homo sapiens
agaguuauuuccugguuua

SEQ ID NO: 495864 - RNA, 19 nt, Homo sapiens
gcacaggagccaagaguga

SEQ ID NO: 495865 - RNA, 19 nt, Homo sapiens
uaaagccaccucuauaauu

SEQ ID NO: 495866 - RNA, 19 nt, Homo sapiens
gagcugugaugugaaguuu

SEQ ID NO: 495867 - RNA, 19 nt, Homo sapiens
guuaaagccaccucuauaa

SEQ ID NO: 495868 - RNA, 19 nt, Homo sapiens
caccaacaauuuaguaguu

SEQ ID NO: 495869 - RNA, 19 nt, Homo sapiens
gggcaccacuccacuguau

SEQ ID NO: 495870 - RNA, 19 nt, Homo sapiens
acaacagccugccaccuua

SEQ ID NO: 495871 - RNA, 19 nt, Homo sapiens
gaacaccaauagucugucu

SEQ ID NO: 495872 - RNA, 19 nt, Homo sapiens
gaagaaagugaacaucaug

SEQ ID NO: 495873 - RNA, 19 nt, Homo sapiens
augaauggcuguacauauu

SEQ ID NO: 495874 - RNA, 19 nt, Homo sapiens
cguaauggcucucauguac

SEQ ID NO: 495875 - RNA, 19 nt, Homo sapiens
gaaucuugguuguaaacuu

SEQ ID NO: 495876 - RNA, 19 nt, Homo sapiens
gcgguaaucaugaggauaa

SEQ ID NO: 495877 - RNA, 19 nt, Homo sapiens
cagugaaucuugguuguaa

SEQ ID NO: 495878 - RNA, 19 nt, Homo sapiens
ggaaguugcugagaagagu

SEQ ID NO: 495879 - RNA, 19 nt, Homo sapiens
guuaugagccagaguuauu

SEQ ID NO: 495880 - RNA, 19 nt, Homo sapiens
acacugcuguugacaaguu

SEQ ID NO: 495881 - RNA, 19 nt, Homo sapiens
aaacaucuacccuauucua

SEQ ID NO: 495882 - RNA, 19 nt, Homo sapiens
ccaaggaauugaggaaguu

SEQ ID NO: 495883 - RNA, 19 nt, Homo sapiens
gcucacccaccaacaauuu

SEQ ID NO: 495884 - RNA, 19 nt, Homo sapiens
uaaagucagagcagaaauu

SEQ ID NO: 495885 - RNA, 19 nt, Homo sapiens
aauauuguauccacaguga

SEQ ID NO: 495886 - RNA, 19 nt, Homo sapiens
ccaccucuauaauugauug

SEQ ID NO: 495887 - RNA, 19 nt, Homo sapiens
gcucauaccgugcugcuau

SEQ ID NO: 495888 - RNA, 19 nt, Homo sapiens
gugaugcccuucuguaagu

SEQ ID NO: 495889 - RNA, 19 nt, Homo sapiens
caucuacccuauucuaaag

SEQ ID NO: 495890 - RNA, 19 nt, Homo sapiens
guuauuuccugguuuaauc

SEQ ID NO: 495891 - RNA, 19 nt, Homo sapiens
aaucuugguuguaaacuug

SEQ ID NO: 495892 - RNA, 19 nt, Homo sapiens
gaaaaugaauggcuguaca

SEQ ID NO: 495893 - RNA, 19 nt, Homo sapiens
ucaggaagacgacguaaug

SEQ ID NO: 495894 - RNA, 19 nt, Homo sapiens
agucagagcagaaauuuau

SEQ ID NO: 495895 - RNA, 19 nt, Homo sapiens
gaaagugaacaucauggau

SEQ ID NO: 495896 - RNA, 19 nt, Homo sapiens
ccgaaacgccgaauauaau

SEQ ID NO: 495897 - RNA, 19 nt, Homo sapiens
auagugaucuuugcaguga

SEQ ID NO: 495898 - RNA, 19 nt, Homo sapiens
cagcgcugcccauuuauuu

SEQ ID NO: 495899 - RNA, 19 nt, Homo sapiens
uuaguccaaugaugccuua

SEQ ID NO: 495900 - RNA, 19 nt, Homo sapiens
agaagaaagugaacaucau

SEQ ID NO: 495901 - RNA, 19 nt, Homo sapiens
gaauggcuguacauauuuu

SEQ ID NO: 495902 - RNA, 19 nt, Homo sapiens
ugaauggcuguacauauuu

SEQ ID NO: 495903 - RNA, 19 nt, Homo sapiens
gcgcugcccauuuauuuau

SEQ ID NO: 495904 - RNA, 19 nt, Homo sapiens
ggcauuauuugugcacuga

SEQ ID NO: 495905 - RNA, 19 nt, Homo sapiens
ugaggaaguugcugagaag

SEQ ID NO: 495906 - RNA, 19 nt, Homo sapiens
gcagaaauuuaugaagcau

SEQ ID NO: 495907 - RNA, 19 nt, Homo sapiens
gcuaaagucagagcagaaa

SEQ ID NO: 495908 - RNA, 19 nt, Homo sapiens
aaagucagagcagaaauuu

SEQ ID NO: 495909 - RNA, 19 nt, Homo sapiens
cccgaaacgccgaauauaa

SEQ ID NO: 495910 - RNA, 19 nt, Homo sapiens
cggaaucccuaucuuuagu

SEQ ID NO: 495911 - RNA, 19 nt, Homo sapiens
cccggaaucccuaucuuua

SEQ ID NO: 495912 - RNA, 19 nt, Homo sapiens
uguuaaagccaccucuaua

SEQ ID NO: 495913 - RNA, 19 nt, Homo sapiens
cagaguuauuuccugguuu

SEQ ID NO: 495914 - RNA, 19 nt, Homo sapiens
ugaaguuuccuauaagguu

SEQ ID NO: 495915 - RNA, 19 nt, Homo sapiens
guaguuaugagccagaguu

SEQ ID NO: 495916 - RNA, 19 nt, Homo sapiens
gaacaucauggaucagaac

SEQ ID NO: 495917 - RNA, 19 nt, Homo sapiens
guacagaaguuggguuuuc

SEQ ID NO: 495918 - RNA, 19 nt, Homo sapiens
gcccgaaacgccgaauaua

SEQ ID NO: 495919 - RNA, 19 nt, Homo sapiens
gugaagauaacccaaggaa

SEQ ID NO: 495920 - RNA, 19 nt, Homo sapiens
uaucuuuaguccaaugaug

SEQ ID NO: 495921 - RNA, 19 nt, Homo sapiens
cuagaguuguacagaaguu

SEQ ID NO: 495922 - RNA, 19 nt, Homo sapiens
gagccaagagugaagaaca

SEQ ID NO: 495923 - RNA, 19 nt, Homo sapiens
cuaaagaccauugcacuuc

SEQ ID NO: 495924 - RNA, 19 nt, Homo sapiens
caucauggaucagaacaac

SEQ ID NO: 495925 - RNA, 19 nt, Homo sapiens
gcugcccauuuauuuauau

SEQ ID NO: 495926 - RNA, 19 nt, Homo sapiens
aaauggugguguugugaga

SEQ ID NO: 495927 - RNA, 19 nt, Homo sapiens
uugaggaaguugcugagaa

SEQ ID NO: 495928 - RNA, 19 nt, Homo sapiens
ucagagcagaaauuuauga

SEQ ID NO: 495929 - RNA, 19 nt, Homo sapiens
ccacgaaccacggcacuga

SEQ ID NO: 495930 - RNA, 19 nt, Homo sapiens
guccaaugaugccuuaugg

SEQ ID NO: 495931 - RNA, 19 nt, Homo sapiens
ugaacaucauggaucagaa

SEQ ID NO: 495932 - RNA, 19 nt, Homo sapiens
uguauuaacaggugcuaaa

SEQ ID NO: 495933 - RNA, 19 nt, Homo sapiens
agaaugaucaaacccagaa

SEQ ID NO: 495934 - RNA, 19 nt, Homo sapiens
cgcaaggguuucugguuug

SEQ ID NO: 495935 - RNA, 19 nt, Homo sapiens
gaaaauaugcuagaguugu

SEQ ID NO: 495936 - RNA, 19 nt, Homo sapiens
agaagagugugcuggagau

SEQ ID NO: 495937 - RNA, 19 nt, Homo sapiens
uuccaccucuccaguauug

SEQ ID NO: 495938 - RNA, 19 nt, Homo sapiens
cauuccaccucuccaguau

SEQ ID NO: 495939 - RNA, 19 nt, Homo sapiens
ccaagaagaaagugaacau

SEQ ID NO: 495940 - RNA, 19 nt, Homo sapiens
gcagcgugacugugaguug

SEQ ID NO: 495941 - RNA, 19 nt, Homo sapiens
aagaagaaagugaacauca

SEQ ID NO: 495942 - RNA, 19 nt, Homo sapiens
gcgguuugcugcgguaauc

SEQ ID NO: 495943 - RNA, 19 nt, Homo sapiens
ucacagacucucacaacug

SEQ ID NO: 495944 - RNA, 19 nt, Homo sapiens
uuaaagccaccucuauaau

SEQ ID NO: 495945 - RNA, 19 nt, Homo sapiens
cauuauuugugcacugaga

SEQ ID NO: 495946 - RNA, 19 nt, Homo sapiens
ggagcugugaugugaaguu

SEQ ID NO: 495947 - RNA, 19 nt, Homo sapiens
gaaccacggcacugauuuu

SEQ ID NO: 495948 - RNA, 19 nt, Homo sapiens
uaccgcagcugcaaaauau

SEQ ID NO: 495949 - RNA, 19 nt, Homo sapiens
uaaacuccaugcacaagua

SEQ ID NO: 495950 - RNA, 19 nt, Homo sapiens
gaauuccaaugcccacuuu

SEQ ID NO: 495951 - RNA, 19 nt, Homo sapiens
guacagcacagaaugagua

SEQ ID NO: 495952 - RNA, 19 nt, Homo sapiens
ucacacagcugaagaucga

SEQ ID NO: 495953 - RNA, 19 nt, Homo sapiens
caucugcgcucccucaaga

SEQ ID NO: 495954 - RNA, 19 nt, Homo sapiens
cagcacagaaugaguauuu

SEQ ID NO: 495955 - RNA, 19 nt, Homo sapiens
acaagaaggccaaguauau

SEQ ID NO: 495956 - RNA, 19 nt, Homo sapiens
gacaagaaggccaaguaua

SEQ ID NO: 495957 - RNA, 19 nt, Homo sapiens
ggacaagaaggccaaguau

SEQ ID NO: 495958 - RNA, 19 nt, Homo sapiens
gcacagaaugaguauuuau

SEQ ID NO: 495959 - RNA, 19 nt, Homo sapiens
gggcaugggucaccuacug

SEQ ID NO: 495960 - RNA, 19 nt, Homo sapiens
ccaacaacaucucugacaa

SEQ ID NO: 495961 - RNA, 19 nt, Homo sapiens
ccaaguauauccugcugau

SEQ ID NO: 495962 - RNA, 19 nt, Homo sapiens
gggccuagaccgcgugaua

SEQ ID NO: 495963 - RNA, 19 nt, Homo sapiens
ggagggaaccuguuagucu

SEQ ID NO: 495964 - RNA, 19 nt, Homo sapiens
ugaggagccuggagaagga

SEQ ID NO: 495965 - RNA, 19 nt, Homo sapiens
gcugggagggaaccuguua

SEQ ID NO: 495966 - RNA, 19 nt, Homo sapiens
gcuggcaucucagggaauu

SEQ ID NO: 495967 - RNA, 19 nt, Homo sapiens
ucagcggccuggacaagaa

SEQ ID NO: 495968 - RNA, 19 nt, Homo sapiens
gcugacgauugccgcuaua

SEQ ID NO: 495969 - RNA, 19 nt, Homo sapiens
ggaucaggcugcuggaaac

SEQ ID NO: 495970 - RNA, 19 nt, Homo sapiens
ggacguguacagcacagaa

SEQ ID NO: 495971 - RNA, 19 nt, Homo sapiens
caaggccgcugguggaaac

SEQ ID NO: 495972 - RNA, 19 nt, Homo sapiens
guacgaggagcacugcaaa

SEQ ID NO: 495973 - RNA, 19 nt, Homo sapiens
gaucgacaacaacccguuu

SEQ ID NO: 495974 - RNA, 19 nt, Homo sapiens
gcacgggcagcaguucuuu

SEQ ID NO: 495975 - RNA, 19 nt, Homo sapiens
caacaacaucucugacaag

SEQ ID NO: 495976 - RNA, 19 nt, Homo sapiens
ggaauuccaaugcccacuu

SEQ ID NO: 495977 - RNA, 19 nt, Homo sapiens
gaagcugaccaacaacauc

SEQ ID NO: 495978 - RNA, 19 nt, Homo sapiens
gacgauugccgcuauaagu

SEQ ID NO: 495979 - RNA, 19 nt, Homo sapiens
caagaaggccaaguauauc

SEQ ID NO: 495980 - RNA, 19 nt, Homo sapiens
ggaccaguuccacaagcua

SEQ ID NO: 495981 - RNA, 19 nt, Homo sapiens
ccaacgacauccugaagcu

SEQ ID NO: 495982 - RNA, 19 nt, Homo sapiens
caagguggcauccgaaggu

SEQ ID NO: 495983 - RNA, 19 nt, Homo sapiens
ugaccaacaacaucucuga

SEQ ID NO: 495984 - RNA, 19 nt, Homo sapiens
ccaaacgcauguacaucca

SEQ ID NO: 495985 - RNA, 19 nt, Homo sapiens
cuaccagaaugacaagauc

SEQ ID NO: 495986 - RNA, 19 nt, Homo sapiens
gcacggcuucaccauccua

SEQ ID NO: 495987 - RNA, 19 nt, Homo sapiens
gccuagaccgcgugauaaa

SEQ ID NO: 495988 - RNA, 19 nt, Homo sapiens
ggccuagaccgcgugauaa

SEQ ID NO: 495989 - RNA, 19 nt, Homo sapiens
uggacaagaaggccaagua

SEQ ID NO: 495990 - RNA, 19 nt, Homo sapiens
ucaggcugcuggaaacaca

SEQ ID NO: 495991 - RNA, 19 nt, Homo sapiens
gggagcaguggauggcuaa

SEQ ID NO: 495992 - RNA, 19 nt, Homo sapiens
caaggccgacccugagaug

SEQ ID NO: 495993 - RNA, 19 nt, Homo sapiens
ucacugccuaccagaauga

SEQ ID NO: 495994 - RNA, 19 nt, Homo sapiens
cauuguagccgcugacgau

SEQ ID NO: 495995 - RNA, 19 nt, Homo sapiens
gagccaacgacauccugaa

SEQ ID NO: 495996 - RNA, 19 nt, Homo sapiens
gcaaggccgacccugagau

SEQ ID NO: 495997 - RNA, 19 nt, Homo sapiens
agcacagaaugaguauuua

SEQ ID NO: 495998 - RNA, 19 nt, Homo sapiens
caagaucacacagcugaag

SEQ ID NO: 495999 - RNA, 19 nt, Homo sapiens
agaaugacaagaucacaca

SEQ ID NO: 496000 - RNA, 19 nt, Homo sapiens
ccugcacccuggacaguuc

SEQ ID NO: 496001 - RNA, 19 nt, Homo sapiens
acacuucccugggccucaa

SEQ ID NO: 496002 - RNA, 19 nt, Homo sapiens
aguauauccugcugaugga

SEQ ID NO: 496003 - RNA, 19 nt, Homo sapiens
gucacugccuaccagaaug

SEQ ID NO: 496004 - RNA, 19 nt, Homo sapiens
gauaauaaauggucuguga

SEQ ID NO: 496005 - RNA, 19 nt, Homo sapiens
ccacagaccaucccuauaa

SEQ ID NO: 496006 - RNA, 19 nt, Homo sapiens
gaucuuggcucuauuugug

SEQ ID NO: 496007 - RNA, 19 nt, Homo sapiens
caacagacauuuccuagag

SEQ ID NO: 496008 - RNA, 19 nt, Homo sapiens
gauacaaauucgcagauaa

SEQ ID NO: 496009 - RNA, 19 nt, Homo sapiens
gaaagagaacuguggcuaa

SEQ ID NO: 496010 - RNA, 19 nt, Homo sapiens
gaagacggagagaaauuua

SEQ ID NO: 496011 - RNA, 19 nt, Homo sapiens
caaauaccagccuagauua

SEQ ID NO: 496012 - RNA, 19 nt, Homo sapiens
guucugcacucacgucuuu

SEQ ID NO: 496013 - RNA, 19 nt, Homo sapiens
gcacggaaaugaucauaac

SEQ ID NO: 496014 - RNA, 19 nt, Homo sapiens
aaagagaacuguggcuaaa

SEQ ID NO: 496015 - RNA, 19 nt, Homo sapiens
ggaaagaggaagaauguuc

SEQ ID NO: 496016 - RNA, 19 nt, Homo sapiens
ggguaugccugguaauaaa

SEQ ID NO: 496017 - RNA, 19 nt, Homo sapiens
ugucaagaaugcaaaguaa

SEQ ID NO: 496018 - RNA, 19 nt, Homo sapiens
ggaagaagaccuggccuaa

SEQ ID NO: 496019 - RNA, 19 nt, Homo sapiens
ggagguacgugcucuucuu

SEQ ID NO: 496020 - RNA, 19 nt, Homo sapiens
ggagaaagccggguugguu

SEQ ID NO: 496021 - RNA, 19 nt, Homo sapiens
gaucuaaucaguagcuuga

SEQ ID NO: 496022 - RNA, 19 nt, Homo sapiens
caaaguguuucuccaugaa

SEQ ID NO: 496023 - RNA, 19 nt, Homo sapiens
gaagugggcacggaaauga

SEQ ID NO: 496024 - RNA, 19 nt, Homo sapiens
gaggaaagaggaagaaugu

SEQ ID NO: 496025 - RNA, 19 nt, Homo sapiens
ucaaaguguuucuccauga

SEQ ID NO: 496026 - RNA, 19 nt, Homo sapiens
aagaagaccuggccuaaag

SEQ ID NO: 496027 - RNA, 19 nt, Homo sapiens
gcacuucuccgcucacuuc

SEQ ID NO: 496028 - RNA, 19 nt, Homo sapiens
ccaaagaagaggugggaua

SEQ ID NO: 496029 - RNA, 19 nt, Homo sapiens
gaagaagaccuggccuaaa

SEQ ID NO: 496030 - RNA, 19 nt, Homo sapiens
gagaaagccggguugguuu

SEQ ID NO: 496031 - RNA, 19 nt, Homo sapiens
gcacagaaugucaagaaug

SEQ ID NO: 496032 - RNA, 19 nt, Homo sapiens
cacaagaucacgcaauuaa

SEQ ID NO: 496033 - RNA, 19 nt, Homo sapiens
acaaauaccagccuagauu

SEQ ID NO: 496034 - RNA, 19 nt, Homo sapiens
gaucacagauacaaauucg

SEQ ID NO: 496035 - RNA, 19 nt, Homo sapiens
aagaagaggugggauaguu

SEQ ID NO: 496036 - RNA, 19 nt, Homo sapiens
ggagaaagagagagaagga

SEQ ID NO: 496037 - RNA, 19 nt, Homo sapiens
gcuggaugcugaucuaauc

SEQ ID NO: 496038 - RNA, 19 nt, Homo sapiens
gaaagcggaugaaaauaau

SEQ ID NO: 496039 - RNA, 19 nt, Homo sapiens
gaggcgcacuccuggcuuu

SEQ ID NO: 496040 - RNA, 19 nt, Homo sapiens
gacagacguuggaagaaga

SEQ ID NO: 496041 - RNA, 19 nt, Homo sapiens
guucacaucugcacucaag

SEQ ID NO: 496042 - RNA, 19 nt, Homo sapiens
acauggagcugcacagaau

SEQ ID NO: 496043 - RNA, 19 nt, Homo sapiens
ggagggaaucaaaguguuu

SEQ ID NO: 496044 - RNA, 19 nt, Homo sapiens
gagcgacaauagcuaaagu

SEQ ID NO: 496045 - RNA, 19 nt, Homo sapiens
ccaggagcauagccaaauu

SEQ ID NO: 496046 - RNA, 19 nt, Homo sapiens
caagaucacgcaauuaaag

SEQ ID NO: 496047 - RNA, 19 nt, Homo sapiens
gcacaaauaccagccuaga

SEQ ID NO: 496048 - RNA, 19 nt, Homo sapiens
ggccaagcaugccuuccua

SEQ ID NO: 496049 - RNA, 19 nt, Homo sapiens
gcucgucuccuuccagaaa

SEQ ID NO: 496050 - RNA, 19 nt, Homo sapiens
ugaggcagcucgucuccuu

SEQ ID NO: 496051 - RNA, 19 nt, Homo sapiens
gggcauggagggaaucaaa

SEQ ID NO: 496052 - RNA, 19 nt, Homo sapiens
gaucacgcaauuaaagauu

SEQ ID NO: 496053 - RNA, 19 nt, Homo sapiens
gcgaagacggagagaaauu

SEQ ID NO: 496054 - RNA, 19 nt, Homo sapiens
cggguugguuuaugucuuu

SEQ ID NO: 496055 - RNA, 19 nt, Homo sapiens
ucuaaucaguagcuugaaa

SEQ ID NO: 496056 - RNA, 19 nt, Homo sapiens
ccacaagaucacgcaauua

SEQ ID NO: 496057 - RNA, 19 nt, Homo sapiens
agauacaaauucgcagaua

SEQ ID NO: 496058 - RNA, 19 nt, Homo sapiens
cgaagacggagagaaauuu

SEQ ID NO: 496059 - RNA, 19 nt, Homo sapiens
ggcggauguuucccaguua

SEQ ID NO: 496060 - RNA, 19 nt, Homo sapiens
gagaggagaaagagagaga

SEQ ID NO: 496061 - RNA, 19 nt, Homo sapiens
cggaaaugaucauaaccaa

SEQ ID NO: 496062 - RNA, 19 nt, Homo sapiens
ugacagacguuggaagaag

SEQ ID NO: 496063 - RNA, 19 nt, Homo sapiens
caacucgauuuccuuccaa

SEQ ID NO: 496064 - RNA, 19 nt, Homo sapiens
acagacauuuccuagagaa

SEQ ID NO: 496065 - RNA, 19 nt, Homo sapiens
acaaccaccuggacccauu

SEQ ID NO: 496066 - RNA, 19 nt, Homo sapiens
agaaagccggguugguuua

SEQ ID NO: 496067 - RNA, 19 nt, Homo sapiens
gaccacaaaccaaccuuga

SEQ ID NO: 496068 - RNA, 19 nt, Homo sapiens
ccugguugccucuuuauuu

SEQ ID NO: 496069 - RNA, 19 nt, Homo sapiens
gagagagagaggagaaaga

SEQ ID NO: 496070 - RNA, 19 nt, Homo sapiens
auaagaagcccuacaugga

SEQ ID NO: 496071 - RNA, 19 nt, Homo sapiens
gagcauagccaaauuuacc

SEQ ID NO: 496072 - RNA, 19 nt, Homo sapiens
uagcuugaaaccacaauuu

SEQ ID NO: 496073 - RNA, 19 nt, Homo sapiens
ucacaacagacauuuccua

SEQ ID NO: 496074 - RNA, 19 nt, Homo sapiens
cacagaaugucaagaaugc

SEQ ID NO: 496075 - RNA, 19 nt, Homo sapiens
gaaagccggguugguuuau

SEQ ID NO: 496076 - RNA, 19 nt, Homo sapiens
caaagaagaggugggauag

SEQ ID NO: 496077 - RNA, 19 nt, Homo sapiens
gagagacaguagccaagag

SEQ ID NO: 496078 - RNA, 19 nt, Homo sapiens
gagaaggagagagacagua

SEQ ID NO: 496079 - RNA, 19 nt, Homo sapiens
cagaccaucccuauaagaa

SEQ ID NO: 496080 - RNA, 19 nt, Homo sapiens
uuauagcagugacuuccua

SEQ ID NO: 496081 - RNA, 19 nt, Homo sapiens
gcgacaauagcuaaaguga

SEQ ID NO: 496082 - RNA, 19 nt, Homo sapiens
ugaaagcggaugaaaauaa

SEQ ID NO: 496083 - RNA, 19 nt, Homo sapiens
gauuacacaucgugaaagc

SEQ ID NO: 496084 - RNA, 19 nt, Homo sapiens
caagaaugcaaaguaaaga

SEQ ID NO: 496085 - RNA, 19 nt, Homo sapiens
ucgauuuccuuccaauaga

SEQ ID NO: 496086 - RNA, 19 nt, Homo sapiens
uagauuacacaucgugaaa

SEQ ID NO: 496087 - RNA, 19 nt, Homo sapiens
cuauuugugucuuauguuc

SEQ ID NO: 496088 - RNA, 19 nt, Homo sapiens
gacgaucacagauacaaau

SEQ ID NO: 496089 - RNA, 19 nt, Homo sapiens
cauuguaccugccgacgau

SEQ ID NO: 496090 - RNA, 19 nt, Homo sapiens
gauguuucccaguuacaaa

SEQ ID NO: 496091 - RNA, 19 nt, Homo sapiens
agagagagaaggagagaga

SEQ ID NO: 496092 - RNA, 19 nt, Homo sapiens
uagccaaauuuaccauugu

SEQ ID NO: 496093 - RNA, 19 nt, Homo sapiens
ucaagaaugcaaaguaaag

SEQ ID NO: 496094 - RNA, 19 nt, Homo sapiens
ucgccugguugccucuuua

SEQ ID NO: 496095 - RNA, 19 nt, Homo sapiens
ccucauuccuccggagaaa

SEQ ID NO: 496096 - RNA, 19 nt, Homo sapiens
gagagaggagaaagagaga

SEQ ID NO: 496097 - RNA, 19 nt, Homo sapiens
gaggacaucagcugcaaca

SEQ ID NO: 496098 - RNA, 19 nt, Homo sapiens
agccaaauuuaccauugua

SEQ ID NO: 496099 - RNA, 19 nt, Homo sapiens
caauaccagugugagaaug

SEQ ID NO: 496100 - RNA, 19 nt, Homo sapiens
accacaagaucacgcaauu

SEQ ID NO: 496101 - RNA, 19 nt, Homo sapiens
caagaggaaagaggaagaa

SEQ ID NO: 496102 - RNA, 19 nt, Homo sapiens
aauaauggauuuggcucaa

SEQ ID NO: 496103 - RNA, 19 nt, Homo sapiens
aggcggauguuucccaguu

SEQ ID NO: 496104 - RNA, 19 nt, Homo sapiens
gauaauaaauggucuguga

SEQ ID NO: 496105 - RNA, 19 nt, Homo sapiens
ccacagaccaucccuauaa

SEQ ID NO: 496106 - RNA, 19 nt, Homo sapiens
gaucuuggcucuauuugug

SEQ ID NO: 496107 - RNA, 19 nt, Homo sapiens
caacagacauuuccuagag

SEQ ID NO: 496108 - RNA, 19 nt, Homo sapiens
gauacaaauucgcagauaa

SEQ ID NO: 496109 - RNA, 19 nt, Homo sapiens
gaaagagaacuguggcuaa

SEQ ID NO: 496110 - RNA, 19 nt, Homo sapiens
gaagacggagagaaauuua

SEQ ID NO: 496111 - RNA, 19 nt, Homo sapiens
caaauaccagccuagauua

SEQ ID NO: 496112 - RNA, 19 nt, Homo sapiens
guucugcacucacgucuuu

SEQ ID NO: 496113 - RNA, 19 nt, Homo sapiens
gcacggaaaugaucauaac

SEQ ID NO: 496114 - RNA, 19 nt, Homo sapiens
aaagagaacuguggcuaaa

SEQ ID NO: 496115 - RNA, 19 nt, Homo sapiens
ggaaagaggaagaauguuc

SEQ ID NO: 496116 - RNA, 19 nt, Homo sapiens
ggguaugccugguaauaaa

SEQ ID NO: 496117 - RNA, 19 nt, Homo sapiens
ugucaagaaugcaaaguaa

SEQ ID NO: 496118 - RNA, 19 nt, Homo sapiens
ggaagaagaccuggccuaa

SEQ ID NO: 496119 - RNA, 19 nt, Homo sapiens
ggagguacgugcucuucuu

SEQ ID NO: 496120 - RNA, 19 nt, Homo sapiens
ggagaaagccggguugguu

SEQ ID NO: 496121 - RNA, 19 nt, Homo sapiens
gaucuaaucaguagcuuga

SEQ ID NO: 496122 - RNA, 19 nt, Homo sapiens
caaaguguuucuccaugaa

SEQ ID NO: 496123 - RNA, 19 nt, Homo sapiens
gaagugggcacggaaauga

SEQ ID NO: 496124 - RNA, 19 nt, Homo sapiens
gaggaaagaggaagaaugu

SEQ ID NO: 496125 - RNA, 19 nt, Homo sapiens
ucaaaguguuucuccauga

SEQ ID NO: 496126 - RNA, 19 nt, Homo sapiens
aagaagaccuggccuaaag

SEQ ID NO: 496127 - RNA, 19 nt, Homo sapiens
gcacuucuccgcucacuuc

SEQ ID NO: 496128 - RNA, 19 nt, Homo sapiens
ccaaagaagaggugggaua

SEQ ID NO: 496129 - RNA, 19 nt, Homo sapiens
gaagaagaccuggccuaaa

SEQ ID NO: 496130 - RNA, 19 nt, Homo sapiens
gagaaagccggguugguuu

SEQ ID NO: 496131 - RNA, 19 nt, Homo sapiens
gcacagaaugucaagaaug

SEQ ID NO: 496132 - RNA, 19 nt, Homo sapiens
cacaagaucacgcaauuaa

SEQ ID NO: 496133 - RNA, 19 nt, Homo sapiens
acaaauaccagccuagauu

SEQ ID NO: 496134 - RNA, 19 nt, Homo sapiens
gaucacagauacaaauucg

SEQ ID NO: 496135 - RNA, 19 nt, Homo sapiens
aagaagaggugggauaguu

SEQ ID NO: 496136 - RNA, 19 nt, Homo sapiens
ggagaaagagagagaagga

SEQ ID NO: 496137 - RNA, 19 nt, Homo sapiens
gcuggaugcugaucuaauc

SEQ ID NO: 496138 - RNA, 19 nt, Homo sapiens
gaaagcggaugaaaauaau

SEQ ID NO: 496139 - RNA, 19 nt, Homo sapiens
gaggcgcacuccuggcuuu

SEQ ID NO: 496140 - RNA, 19 nt, Homo sapiens
gacagacguuggaagaaga

SEQ ID NO: 496141 - RNA, 19 nt, Homo sapiens
guucacaucugcacucaag

SEQ ID NO: 496142 - RNA, 19 nt, Homo sapiens
acauggagcugcacagaau

SEQ ID NO: 496143 - RNA, 19 nt, Homo sapiens
ggagggaaucaaaguguuu

SEQ ID NO: 496144 - RNA, 19 nt, Homo sapiens
gagcgacaauagcuaaagu

SEQ ID NO: 496145 - RNA, 19 nt, Homo sapiens
ccaggagcauagccaaauu

SEQ ID NO: 496146 - RNA, 19 nt, Homo sapiens
caagaucacgcaauuaaag

SEQ ID NO: 496147 - RNA, 19 nt, Homo sapiens
gcacaaauaccagccuaga

SEQ ID NO: 496148 - RNA, 19 nt, Homo sapiens
ggccaagcaugccuuccua

SEQ ID NO: 496149 - RNA, 19 nt, Homo sapiens
gcucgucuccuuccagaaa

SEQ ID NO: 496150 - RNA, 19 nt, Homo sapiens
ugaggcagcucgucuccuu

SEQ ID NO: 496151 - RNA, 19 nt, Homo sapiens
gggcauggagggaaucaaa

SEQ ID NO: 496152 - RNA, 19 nt, Homo sapiens
gaucacgcaauuaaagauu

SEQ ID NO: 496153 - RNA, 19 nt, Homo sapiens
gcgaagacggagagaaauu

SEQ ID NO: 496154 - RNA, 19 nt, Homo sapiens
cggguugguuuaugucuuu

SEQ ID NO: 496155 - RNA, 19 nt, Homo sapiens
ucuaaucaguagcuugaaa

SEQ ID NO: 496156 - RNA, 19 nt, Homo sapiens
ccacaagaucacgcaauua

SEQ ID NO: 496157 - RNA, 19 nt, Homo sapiens
agauacaaauucgcagaua

SEQ ID NO: 496158 - RNA, 19 nt, Homo sapiens
cgaagacggagagaaauuu

SEQ ID NO: 496159 - RNA, 19 nt, Homo sapiens
ggcggauguuucccaguua

SEQ ID NO: 496160 - RNA, 19 nt, Homo sapiens
gagaggagaaagagagaga

SEQ ID NO: 496161 - RNA, 19 nt, Homo sapiens
cggaaaugaucauaaccaa

SEQ ID NO: 496162 - RNA, 19 nt, Homo sapiens
ugacagacguuggaagaag

SEQ ID NO: 496163 - RNA, 19 nt, Homo sapiens
caacucgauuuccuuccaa

SEQ ID NO: 496164 - RNA, 19 nt, Homo sapiens
acagacauuuccuagagaa

SEQ ID NO: 496165 - RNA, 19 nt, Homo sapiens
acaaccaccuggacccauu

SEQ ID NO: 496166 - RNA, 19 nt, Homo sapiens
agaaagccggguugguuua

SEQ ID NO: 496167 - RNA, 19 nt, Homo sapiens
gaccacaaaccaaccuuga

SEQ ID NO: 496168 - RNA, 19 nt, Homo sapiens
ccugguugccucuuuauuu

SEQ ID NO: 496169 - RNA, 19 nt, Homo sapiens
gagagagagaggagaaaga

SEQ ID NO: 496170 - RNA, 19 nt, Homo sapiens
auaagaagcccuacaugga

SEQ ID NO: 496171 - RNA, 19 nt, Homo sapiens
gagcauagccaaauuuacc

SEQ ID NO: 496172 - RNA, 19 nt, Homo sapiens
uagcuugaaaccacaauuu

SEQ ID NO: 496173 - RNA, 19 nt, Homo sapiens
ucacaacagacauuuccua

SEQ ID NO: 496174 - RNA, 19 nt, Homo sapiens
cacagaaugucaagaaugc

SEQ ID NO: 496175 - RNA, 19 nt, Homo sapiens
gaaagccggguugguuuau

SEQ ID NO: 496176 - RNA, 19 nt, Homo sapiens
caaagaagaggugggauag

SEQ ID NO: 496177 - RNA, 19 nt, Homo sapiens
gagagacaguagccaagag

SEQ ID NO: 496178 - RNA, 19 nt, Homo sapiens
gagaaggagagagacagua

SEQ ID NO: 496179 - RNA, 19 nt, Homo sapiens
cagaccaucccuauaagaa

SEQ ID NO: 496180 - RNA, 19 nt, Homo sapiens
uuauagcagugacuuccua

SEQ ID NO: 496181 - RNA, 19 nt, Homo sapiens
gcgacaauagcuaaaguga

SEQ ID NO: 496182 - RNA, 19 nt, Homo sapiens
ugaaagcggaugaaaauaa

SEQ ID NO: 496183 - RNA, 19 nt, Homo sapiens
gauuacacaucgugaaagc

SEQ ID NO: 496184 - RNA, 19 nt, Homo sapiens
caagaaugcaaaguaaaga

SEQ ID NO: 496185 - RNA, 19 nt, Homo sapiens
ucgauuuccuuccaauaga

SEQ ID NO: 496186 - RNA, 19 nt, Homo sapiens
uagauuacacaucgugaaa

SEQ ID NO: 496187 - RNA, 19 nt, Homo sapiens
cuauuugugucuuauguuc

SEQ ID NO: 496188 - RNA, 19 nt, Homo sapiens
gacgaucacagauacaaau

SEQ ID NO: 496189 - RNA, 19 nt, Homo sapiens
cauuguaccugccgacgau

SEQ ID NO: 496190 - RNA, 19 nt, Homo sapiens
gauguuucccaguuacaaa

SEQ ID NO: 496191 - RNA, 19 nt, Homo sapiens
agagagagaaggagagaga

SEQ ID NO: 496192 - RNA, 19 nt, Homo sapiens
uagccaaauuuaccauugu

SEQ ID NO: 496193 - RNA, 19 nt, Homo sapiens
ucaagaaugcaaaguaaag

SEQ ID NO: 496194 - RNA, 19 nt, Homo sapiens
ucgccugguugccucuuua

SEQ ID NO: 496195 - RNA, 19 nt, Homo sapiens
ccucauuccuccggagaaa

SEQ ID NO: 496196 - RNA, 19 nt, Homo sapiens
gagagaggagaaagagaga

SEQ ID NO: 496197 - RNA, 19 nt, Homo sapiens
gaggacaucagcugcaaca

SEQ ID NO: 496198 - RNA, 19 nt, Homo sapiens
agccaaauuuaccauugua

SEQ ID NO: 496199 - RNA, 19 nt, Homo sapiens
caauaccagugugagaaug

SEQ ID NO: 496200 - RNA, 19 nt, Homo sapiens
accacaagaucacgcaauu

SEQ ID NO: 496201 - RNA, 19 nt, Homo sapiens
caagaggaaagaggaagaa

SEQ ID NO: 496202 - RNA, 19 nt, Homo sapiens
aauaauggauuuggcucaa

SEQ ID NO: 496203 - RNA, 19 nt, Homo sapiens
aggcggauguuucccaguu

SEQ ID NO: 496204 - RNA, 19 nt, Homo sapiens
gauaauaaauggucuguga

SEQ ID NO: 496205 - RNA, 19 nt, Homo sapiens
gauacaaauucgcagauaa

SEQ ID NO: 496206 - RNA, 19 nt, Homo sapiens
gaaagagaacuguggcuaa

SEQ ID NO: 496207 - RNA, 19 nt, Homo sapiens
caaauaccagccuagauua

SEQ ID NO: 496208 - RNA, 19 nt, Homo sapiens
guucugcacucacgucuuu

SEQ ID NO: 496209 - RNA, 19 nt, Homo sapiens
gcacggaaaugaucauaac

SEQ ID NO: 496210 - RNA, 19 nt, Homo sapiens
aaagagaacuguggcuaaa

SEQ ID NO: 496211 - RNA, 19 nt, Homo sapiens
ugucaagaaugcaaaguaa

SEQ ID NO: 496212 - RNA, 19 nt, Homo sapiens
caaaguguuucuccaugaa

SEQ ID NO: 496213 - RNA, 19 nt, Homo sapiens
gaagugggcacggaaauga

SEQ ID NO: 496214 - RNA, 19 nt, Homo sapiens
gaucaccccuggucaauuu

SEQ ID NO: 496215 - RNA, 19 nt, Homo sapiens
ucaaaguguuucuccauga

SEQ ID NO: 496216 - RNA, 19 nt, Homo sapiens
gcacagaaugucaagaaug

SEQ ID NO: 496217 - RNA, 19 nt, Homo sapiens
cacaagaucacgcaauuaa

SEQ ID NO: 496218 - RNA, 19 nt, Homo sapiens
acaaauaccagccuagauu

SEQ ID NO: 496219 - RNA, 19 nt, Homo sapiens
gaucacagauacaaauucg

SEQ ID NO: 496220 - RNA, 19 nt, Homo sapiens
gaaagcggaugaaaauaau

SEQ ID NO: 496221 - RNA, 19 nt, Homo sapiens
acauggagcugcacagaau

SEQ ID NO: 496222 - RNA, 19 nt, Homo sapiens
ggagggaaucaaaguguuu

SEQ ID NO: 496223 - RNA, 19 nt, Homo sapiens
ccaggagcauagccaaauu

SEQ ID NO: 496224 - RNA, 19 nt, Homo sapiens
caagaucacgcaauuaaag

SEQ ID NO: 496225 - RNA, 19 nt, Homo sapiens
gcacaaauaccagccuaga

SEQ ID NO: 496226 - RNA, 19 nt, Homo sapiens
gaggaaaggugagugugau

SEQ ID NO: 496227 - RNA, 19 nt, Homo sapiens
gcucgucuccuuccagaaa

SEQ ID NO: 496228 - RNA, 19 nt, Homo sapiens
ugaggcagcucgucuccuu

SEQ ID NO: 496229 - RNA, 19 nt, Homo sapiens
gggcauggagggaaucaaa

SEQ ID NO: 496230 - RNA, 19 nt, Homo sapiens
gaucacgcaauuaaagauu

SEQ ID NO: 496231 - RNA, 19 nt, Homo sapiens
ccacaagaucacgcaauua

SEQ ID NO: 496232 - RNA, 19 nt, Homo sapiens
agauacaaauucgcagaua

SEQ ID NO: 496233 - RNA, 19 nt, Homo sapiens
ggcggauguuucccaguua

SEQ ID NO: 496234 - RNA, 19 nt, Homo sapiens
cggaaaugaucauaaccaa

SEQ ID NO: 496235 - RNA, 19 nt, Homo sapiens
acaaccaccuggacccauu

SEQ ID NO: 496236 - RNA, 19 nt, Homo sapiens
gagcauagccaaauuuacc

SEQ ID NO: 496237 - RNA, 19 nt, Homo sapiens
cacagaaugucaagaaugc

SEQ ID NO: 496238 - RNA, 19 nt, Homo sapiens
uuauagcagugacuuccua

SEQ ID NO: 496239 - RNA, 19 nt, Homo sapiens
ugaaagcggaugaaaauaa

SEQ ID NO: 496240 - RNA, 19 nt, Homo sapiens
gauuacacaucgugaaagc

SEQ ID NO: 496241 - RNA, 19 nt, Homo sapiens
ggaaaggugagugugauca

SEQ ID NO: 496242 - RNA, 19 nt, Homo sapiens
caagaaugcaaaguaaaga

SEQ ID NO: 496243 - RNA, 19 nt, Homo sapiens
uagauuacacaucgugaaa

SEQ ID NO: 496244 - RNA, 19 nt, Homo sapiens
gacgaucacagauacaaau

SEQ ID NO: 496245 - RNA, 19 nt, Homo sapiens
cauuguaccugccgacgau

SEQ ID NO: 496246 - RNA, 19 nt, Homo sapiens
gauguuucccaguuacaaa

SEQ ID NO: 496247 - RNA, 19 nt, Homo sapiens
uagccaaauuuaccauugu

SEQ ID NO: 496248 - RNA, 19 nt, Homo sapiens
ucaagaaugcaaaguaaag

SEQ ID NO: 496249 - RNA, 19 nt, Homo sapiens
caagaggaaaggugagugu

SEQ ID NO: 496250 - RNA, 19 nt, Homo sapiens
agccaaauuuaccauugua

SEQ ID NO: 496251 - RNA, 19 nt, Homo sapiens
caauaccagugugagaaug

SEQ ID NO: 496252 - RNA, 19 nt, Homo sapiens
accacaagaucacgcaauu

SEQ ID NO: 496253 - RNA, 19 nt, Homo sapiens
aauaauggauuuggcucaa

SEQ ID NO: 496254 - RNA, 19 nt, Homo sapiens
aggcggauguuucccaguu

SEQ ID NO: 496255 - RNA, 19 nt, Homo sapiens
gcuggaaggcggauguuuc

SEQ ID NO: 496256 - RNA, 19 nt, Homo sapiens
caggagcauagccaaauuu

SEQ ID NO: 496257 - RNA, 19 nt, Homo sapiens
gagcugcacagaaugucaa

SEQ ID NO: 496258 - RNA, 19 nt, Homo sapiens
uaccagaaccacaagauca

SEQ ID NO: 496259 - RNA, 19 nt, Homo sapiens
gcauggagggaaucaaagu

SEQ ID NO: 496260 - RNA, 19 nt, Homo sapiens
auagccaaauuuaccauug

SEQ ID NO: 496261 - RNA, 19 nt, Homo sapiens
gacauggagcugcacagaa

SEQ ID NO: 496262 - RNA, 19 nt, Homo sapiens
ccauuugggcauauuauuc

SEQ ID NO: 496263 - RNA, 19 nt, Homo sapiens
cgacgcagacgagggcuuu

SEQ ID NO: 496264 - RNA, 19 nt, Homo sapiens
cuaaauuccaugcacaaau

SEQ ID NO: 496265 - RNA, 19 nt, Homo sapiens
caaauuuaccauuguacca

SEQ ID NO: 496266 - RNA, 19 nt, Homo sapiens
ccaauaccagugugagaau

SEQ ID NO: 496267 - RNA, 19 nt, Homo sapiens
caaccaccuggacccauuu

SEQ ID NO: 496268 - RNA, 19 nt, Homo sapiens
aacucaagcucaccaacaa

SEQ ID NO: 496269 - RNA, 19 nt, Homo sapiens
aggagcauagccaaauuua

SEQ ID NO: 496270 - RNA, 19 nt, Homo sapiens
cagaaugucaagaaugcaa

SEQ ID NO: 496271 - RNA, 19 nt, Homo sapiens
uggagggaaucaaaguguu

SEQ ID NO: 496272 - RNA, 19 nt, Homo sapiens
acaagaucacgcaauuaaa

SEQ ID NO: 496273 - RNA, 19 nt, Homo sapiens
aaacucaagcucaccaaca

SEQ ID NO: 496274 - RNA, 19 nt, Homo sapiens
uggucaauuugcuuucuuu

SEQ ID NO: 496275 - RNA, 19 nt, Homo sapiens
agaggaaaggugaguguga

SEQ ID NO: 496276 - RNA, 19 nt, Homo sapiens
gaccugcccugcgauucga

SEQ ID NO: 496277 - RNA, 19 nt, Homo sapiens
cugcacagaaugucaagaa

SEQ ID NO: 496278 - RNA, 19 nt, Homo sapiens
gggcacggaaaugaucaua

SEQ ID NO: 496279 - RNA, 19 nt, Homo sapiens
auacagcguucugcacuca

SEQ ID NO: 496280 - RNA, 19 nt, Homo sapiens
cgacgaucacagauacaaa

SEQ ID NO: 496281 - RNA, 19 nt, Homo sapiens
gcggauguuucccaguuac

SEQ ID NO: 496282 - RNA, 19 nt, Homo sapiens
gucaagaaugcaaaguaaa

SEQ ID NO: 496283 - RNA, 19 nt, Homo sapiens
ugacauggagcugcacaga

SEQ ID NO: 496284 - RNA, 19 nt, Homo sapiens
cgaagugggcacggaaaug

SEQ ID NO: 496285 - RNA, 19 nt, Homo sapiens
gacgggccuuaaucccaaa

SEQ ID NO: 496286 - RNA, 19 nt, Homo sapiens
ggauguuucccaguuacaa

SEQ ID NO: 496287 - RNA, 19 nt, Homo sapiens
ggcacggaaaugaucauaa

SEQ ID NO: 496288 - RNA, 19 nt, Homo sapiens
agagaacuguggcuaaaau

SEQ ID NO: 496289 - RNA, 19 nt, Homo sapiens
gaaugucaagaaugcaaag

SEQ ID NO: 496290 - RNA, 19 nt, Homo sapiens
ggagcugcacagaauguca

SEQ ID NO: 496291 - RNA, 19 nt, Homo sapiens
aagaucacgcaauuaaaga

SEQ ID NO: 496292 - RNA, 19 nt, Homo sapiens
caacuucacaccuugauuu

SEQ ID NO: 496293 - RNA, 19 nt, Homo sapiens
ccacagaucacacaacuga

SEQ ID NO: 496294 - RNA, 19 nt, Homo sapiens
ggaaggaguucagcucugu

SEQ ID NO: 496295 - RNA, 19 nt, Homo sapiens
acauugggcuccuguguuu

SEQ ID NO: 496296 - RNA, 19 nt, Homo sapiens
gagaacggcagaaacugua

SEQ ID NO: 496297 - RNA, 19 nt, Homo sapiens
ucacacaacugaagauugc

SEQ ID NO: 496298 - RNA, 19 nt, Homo sapiens
agacggaacuacaacaugu

SEQ ID NO: 496299 - RNA, 19 nt, Homo sapiens
ccgaggaguuaauuaugua

SEQ ID NO: 496300 - RNA, 19 nt, Homo sapiens
gccgaggaguuaauuaugu

SEQ ID NO: 496301 - RNA, 19 nt, Homo sapiens
gggcucugcuggccaaaug

SEQ ID NO: 496302 - RNA, 19 nt, Homo sapiens
cgagugcccugugaaauca

SEQ ID NO: 496303 - RNA, 19 nt, Homo sapiens
ggaaggggcugagcuguga

SEQ ID NO: 496304 - RNA, 19 nt, Homo sapiens
ggagaacggcagaaacugu

SEQ ID NO: 496305 - RNA, 19 nt, Homo sapiens
ugaaucagauccagaacag

SEQ ID NO: 496306 - RNA, 19 nt, Homo sapiens
gugagcgccuucgaacuuu

SEQ ID NO: 496307 - RNA, 19 nt, Homo sapiens
gaucacacaacugaagauu

SEQ ID NO: 496308 - RNA, 19 nt, Homo sapiens
cauguaccauccacgagaa

SEQ ID NO: 496309 - RNA, 19 nt, Homo sapiens
cuacucggcugcauuucug

SEQ ID NO: 496310 - RNA, 19 nt, Homo sapiens
uaccagaacccacagauca

SEQ ID NO: 496311 - RNA, 19 nt, Homo sapiens
ccacaccagucuguuguuc

SEQ ID NO: 496312 - RNA, 19 nt, Homo sapiens
ccaaacccauguacugaac

SEQ ID NO: 496313 - RNA, 19 nt, Homo sapiens
ccaaaggcuuccgggagaa

SEQ ID NO: 496314 - RNA, 19 nt, Homo sapiens
cagucaagccgaggaguua

SEQ ID NO: 496315 - RNA, 19 nt, Homo sapiens
gcuccaaacccauguacug

SEQ ID NO: 496316 - RNA, 19 nt, Homo sapiens
guaccauccacgagaauug

SEQ ID NO: 496317 - RNA, 19 nt, Homo sapiens
aggcuuggcucgugaugga

SEQ ID NO: 496318 - RNA, 19 nt, Homo sapiens
cuacuuguuucuucuggau

SEQ ID NO: 496319 - RNA, 19 nt, Homo sapiens
caagccgaggaguuaauua

SEQ ID NO: 496320 - RNA, 19 nt, Homo sapiens
acaccagucuguuguucug

SEQ ID NO: 496321 - RNA, 19 nt, Homo sapiens
gcccgcuacuuguuucuuc

SEQ ID NO: 496322 - RNA, 19 nt, Homo sapiens
ugugagcgccuucgaacuu

SEQ ID NO: 496323 - RNA, 19 nt, Homo sapiens
cauccaugcucaggaaaca

SEQ ID NO: 496324 - RNA, 19 nt, Homo sapiens
gccugaccgugucuacauu

SEQ ID NO: 496325 - RNA, 19 nt, Homo sapiens
ggacaccccuaaacuggau

SEQ ID NO: 496326 - RNA, 19 nt, Homo sapiens
aaacauugggcuccugugu

SEQ ID NO: 496327 - RNA, 19 nt, Homo sapiens
gaacccacagaucacacaa

SEQ ID NO: 496328 - RNA, 19 nt, Homo sapiens
gcaggccacaccagucugu

SEQ ID NO: 496329 - RNA, 19 nt, Homo sapiens
agaccagcauccccacuua

SEQ ID NO: 496330 - RNA, 19 nt, Homo sapiens
gaacggcagaaacuguaag

SEQ ID NO: 496331 - RNA, 19 nt, Homo sapiens
gugucaagcucaccaacag

SEQ ID NO: 496332 - RNA, 19 nt, Homo sapiens
cgaggaguuaauuauguaa

SEQ ID NO: 496333 - RNA, 19 nt, Homo sapiens
ccgagugcccugugaaauc

SEQ ID NO: 496334 - RNA, 19 nt, Homo sapiens
aagccgaggaguuaauuau

SEQ ID NO: 496335 - RNA, 19 nt, Homo sapiens
ucaagccgaggaguuaauu

SEQ ID NO: 496336 - RNA, 19 nt, Homo sapiens
agccauccaugcucaggaa

SEQ ID NO: 496337 - RNA, 19 nt, Homo sapiens
cagaucacacaacugaaga

SEQ ID NO: 496338 - RNA, 19 nt, Homo sapiens
ugcggcagccugugucuuu

SEQ ID NO: 496339 - RNA, 19 nt, Homo sapiens
gaaaugcagugguaaguga

SEQ ID NO: 496340 - RNA, 19 nt, Homo sapiens
caucagaaaugcaguggua

SEQ ID NO: 496341 - RNA, 19 nt, Homo sapiens
gaaacccugucucugcuaa

SEQ ID NO: 496342 - RNA, 19 nt, Homo sapiens
ccacagaucacacaacuga

SEQ ID NO: 496343 - RNA, 19 nt, Homo sapiens
ggaaggaguucagcucugu

SEQ ID NO: 496344 - RNA, 19 nt, Homo sapiens
gggaguuguucauucauuu

SEQ ID NO: 496345 - RNA, 19 nt, Homo sapiens
ggaagccauucuaaagaga

SEQ ID NO: 496346 - RNA, 19 nt, Homo sapiens
guucaugcauucaacaaau

SEQ ID NO: 496347 - RNA, 19 nt, Homo sapiens
gagaacggcagaaacugua

SEQ ID NO: 496348 - RNA, 19 nt, Homo sapiens
gcagacaagagaaauaaau

SEQ ID NO: 496349 - RNA, 19 nt, Homo sapiens
ucacacaacugaagauugc

SEQ ID NO: 496350 - RNA, 19 nt, Homo sapiens
agacggaacuacaacaugu

SEQ ID NO: 496351 - RNA, 19 nt, Homo sapiens
ccgaggaguuaauuaugua

SEQ ID NO: 496352 - RNA, 19 nt, Homo sapiens
ggugggaguuguucauuca

SEQ ID NO: 496353 - RNA, 19 nt, Homo sapiens
gagucgagaucaugccauu

SEQ ID NO: 496354 - RNA, 19 nt, Homo sapiens
ucaugcagcugauuucuag

SEQ ID NO: 496355 - RNA, 19 nt, Homo sapiens
gagcaaaacuuccucucaa

SEQ ID NO: 496356 - RNA, 19 nt, Homo sapiens
gccgaggaguuaauuaugu

SEQ ID NO: 496357 - RNA, 19 nt, Homo sapiens
caagcagacaagagaaaua

SEQ ID NO: 496358 - RNA, 19 nt, Homo sapiens
cgagugcccugugaaauca

SEQ ID NO: 496359 - RNA, 19 nt, Homo sapiens
ggaaggggcugagcuguga

SEQ ID NO: 496360 - RNA, 19 nt, Homo sapiens
ggagaacggcagaaacugu

SEQ ID NO: 496361 - RNA, 19 nt, Homo sapiens
gacaagcagacaagagaaa

SEQ ID NO: 496362 - RNA, 19 nt, Homo sapiens
aaacaaagcaaaccaaagc

SEQ ID NO: 496363 - RNA, 19 nt, Homo sapiens
gaucacacaacugaagauu

SEQ ID NO: 496364 - RNA, 19 nt, Homo sapiens
gugagcgccuucgaacuuu

SEQ ID NO: 496365 - RNA, 19 nt, Homo sapiens
cauguaccauccacgagaa

SEQ ID NO: 496366 - RNA, 19 nt, Homo sapiens
agaccagccugccaacaug

SEQ ID NO: 496367 - RNA, 19 nt, Homo sapiens
aagcagacaagagaaauaa

SEQ ID NO: 496368 - RNA, 19 nt, Homo sapiens
uaccagaacccacagauca

SEQ ID NO: 496369 - RNA, 19 nt, Homo sapiens
gcagugagucgagaucaug

SEQ ID NO: 496370 - RNA, 19 nt, Homo sapiens
aaacauucauucacugacu

SEQ ID NO: 496371 - RNA, 19 nt, Homo sapiens
ggaguuguucauucauuug

SEQ ID NO: 496372 - RNA, 19 nt, Homo sapiens
ugacucagcaaauacuuau

SEQ ID NO: 496373 - RNA, 19 nt, Homo sapiens
gaaaacauucauucacuga

SEQ ID NO: 496374 - RNA, 19 nt, Homo sapiens
ccaaaggcuuccgggagaa

SEQ ID NO: 496375 - RNA, 19 nt, Homo sapiens
cagucaagccgaggaguua

SEQ ID NO: 496376 - RNA, 19 nt, Homo sapiens
gagaccagccugccaacau

SEQ ID NO: 496377 - RNA, 19 nt, Homo sapiens
uaggaagccauucuaaaga

SEQ ID NO: 496378 - RNA, 19 nt, Homo sapiens
uagacaagcagacaagaga

SEQ ID NO: 496379 - RNA, 19 nt, Homo sapiens
gcaaaacuuccucucaaaa

SEQ ID NO: 496380 - RNA, 19 nt, Homo sapiens
ccuguaaucccaacuacuu

SEQ ID NO: 496381 - RNA, 19 nt, Homo sapiens
ugugguggcucacgcaugu

SEQ ID NO: 496382 - RNA, 19 nt, Homo sapiens
acaaacaaagcaaaccaaa

SEQ ID NO: 496383 - RNA, 19 nt, Homo sapiens
guuguucauucauuuguuc

SEQ ID NO: 496384 - RNA, 19 nt, Homo sapiens
uguaagaggugggaguugu

SEQ ID NO: 496385 - RNA, 19 nt, Homo sapiens
guaccauccacgagaauug

SEQ ID NO: 496386 - RNA, 19 nt, Homo sapiens
guucauucauuuguucaug

SEQ ID NO: 496387 - RNA, 19 nt, Homo sapiens
aggcuuggcucgugaugga

SEQ ID NO: 496388 - RNA, 19 nt, Homo sapiens
caagccgaggaguuaauua

SEQ ID NO: 496389 - RNA, 19 nt, Homo sapiens
guaagaggugggaguuguu

SEQ ID NO: 496390 - RNA, 19 nt, Homo sapiens
cuacuuguuucuucuggau

SEQ ID NO: 496391 - RNA, 19 nt, Homo sapiens
caaacaaagcaaaccaaag

SEQ ID NO: 496392 - RNA, 19 nt, Homo sapiens
gugcuggacaucagaaaug

SEQ ID NO: 496393 - RNA, 19 nt, Homo sapiens
ugggaguuguucauucauu

SEQ ID NO: 496394 - RNA, 19 nt, Homo sapiens
gguggagguugcagugagu

SEQ ID NO: 496395 - RNA, 19 nt, Homo sapiens
gagaguagacaagcagaca

SEQ ID NO: 496396 - RNA, 19 nt, Homo sapiens
gcccgcuacuuguuucuuc

SEQ ID NO: 496397 - RNA, 19 nt, Homo sapiens
ugugagcgccuucgaacuu

SEQ ID NO: 496398 - RNA, 19 nt, Homo sapiens
gccugaccgugucuacauu

SEQ ID NO: 496399 - RNA, 19 nt, Homo sapiens
gaggugggaguuguucauu

SEQ ID NO: 496400 - RNA, 19 nt, Homo sapiens
ggacaccccuaaacuggau

SEQ ID NO: 496401 - RNA, 19 nt, Homo sapiens
aggaagccauucuaaagag

SEQ ID NO: 496402 - RNA, 19 nt, Homo sapiens
gcacuggagauaaaacaaa

SEQ ID NO: 496403 - RNA, 19 nt, Homo sapiens
gaacccacagaucacacaa

SEQ ID NO: 496404 - RNA, 19 nt, Homo sapiens
aaacaaacaaagcaaacca

SEQ ID NO: 496405 - RNA, 19 nt, Homo sapiens
gcccucaugcagcugauuu

SEQ ID NO: 496406 - RNA, 19 nt, Homo sapiens
cgaggaguuaauuauguaa

SEQ ID NO: 496407 - RNA, 19 nt, Homo sapiens
gaacggcagaaacuguaag

SEQ ID NO: 496408 - RNA, 19 nt, Homo sapiens
gugucaagcucaccaacag

SEQ ID NO: 496409 - RNA, 19 nt, Homo sapiens
gaguagacaagcagacaag

SEQ ID NO: 496410 - RNA, 19 nt, Homo sapiens
ccgagugcccugugaaauc

SEQ ID NO: 496411 - RNA, 19 nt, Homo sapiens
aagccgaggaguuaauuau

SEQ ID NO: 496412 - RNA, 19 nt, Homo sapiens
ucaagccgaggaguuaauu

SEQ ID NO: 496413 - RNA, 19 nt, Homo sapiens
ggagauaaaacaaacaaag

SEQ ID NO: 496414 - RNA, 19 nt, Homo sapiens
guagacaagcagacaagag

SEQ ID NO: 496415 - RNA, 19 nt, Homo sapiens
cagaucacacaacugaaga

SEQ ID NO: 496416 - RNA, 19 nt, Homo sapiens
ugcggcagccugugucuuu

SEQ ID NO: 496417 - RNA, 19 nt, Homo sapiens
aaacagaacuggacuugaa

SEQ ID NO: 496418 - RNA, 19 nt, Homo sapiens
gaagacauauacccaagaa

SEQ ID NO: 496419 - RNA, 19 nt, Homo sapiens
gcuaaaggauucagagauu

SEQ ID NO: 496420 - RNA, 19 nt, Homo sapiens
gagcaagacugacagagaa

SEQ ID NO: 496421 - RNA, 19 nt, Homo sapiens
gaacaagagauaccuuuaa

SEQ ID NO: 496422 - RNA, 19 nt, Homo sapiens
cagcagagcuccuacaaug

SEQ ID NO: 496423 - RNA, 19 nt, Homo sapiens
acagaaagccgcuaaauaa

SEQ ID NO: 496424 - RNA, 19 nt, Homo sapiens
gaagagaggugcacuacgu

SEQ ID NO: 496425 - RNA, 19 nt, Homo sapiens
gcagaugggucuucuauac

SEQ ID NO: 496426 - RNA, 19 nt, Homo sapiens
gaacuggacuugaaaccau

SEQ ID NO: 496427 - RNA, 19 nt, Homo sapiens
ggagaaagacaaacagaaa

SEQ ID NO: 496428 - RNA, 19 nt, Homo sapiens
ugaagagacugaauaauca

SEQ ID NO: 496429 - RNA, 19 nt, Homo sapiens
gcaaagacuucagcaguga

SEQ ID NO: 496430 - RNA, 19 nt, Homo sapiens
gaaggauacuugcgauaga

SEQ ID NO: 496431 - RNA, 19 nt, Homo sapiens
gagaaagugugagcaauga

SEQ ID NO: 496432 - RNA, 19 nt, Homo sapiens
ccagacaccugaccuagaa

SEQ ID NO: 496433 - RNA, 19 nt, Homo sapiens
ggaacgagguggagagcaa

SEQ ID NO: 496434 - RNA, 19 nt, Homo sapiens
ggaaagaaucauggcauua

SEQ ID NO: 496435 - RNA, 19 nt, Homo sapiens
ccaagaauuugucugugua

SEQ ID NO: 496436 - RNA, 19 nt, Homo sapiens
gagaaagccagcuguguaa

SEQ ID NO: 496437 - RNA, 19 nt, Homo sapiens
ggacuuggcuuccggaaaa

SEQ ID NO: 496438 - RNA, 19 nt, Homo sapiens
aaucauacaugcacacuga

SEQ ID NO: 496439 - RNA, 19 nt, Homo sapiens
ucauacacaugcaaucaua

SEQ ID NO: 496440 - RNA, 19 nt, Homo sapiens
gaaagagggagaaagagaa

SEQ ID NO: 496441 - RNA, 19 nt, Homo sapiens
ucacuuguaugcuaucauu

SEQ ID NO: 496442 - RNA, 19 nt, Homo sapiens
gaauaaucacuucgucaua

SEQ ID NO: 496443 - RNA, 19 nt, Homo sapiens
gagcagaggcaacaaauag

SEQ ID NO: 496444 - RNA, 19 nt, Homo sapiens
ggaaagagggagaaagaga

SEQ ID NO: 496445 - RNA, 19 nt, Homo sapiens
ggaaagacaucaguacaac

SEQ ID NO: 496446 - RNA, 19 nt, Homo sapiens
gcacacacacauacauauu

SEQ ID NO: 496447 - RNA, 19 nt, Homo sapiens
gaaagccgcuaaauaaaau

SEQ ID NO: 496448 - RNA, 19 nt, Homo sapiens
ggucagauccuccucuuug

SEQ ID NO: 496449 - RNA, 19 nt, Homo sapiens
gcacuuuacucuguucuuc

SEQ ID NO: 496450 - RNA, 19 nt, Homo sapiens
cgagaaagccagcugugua

SEQ ID NO: 496451 - RNA, 19 nt, Homo sapiens
agacagaccuaccuauaca

SEQ ID NO: 496452 - RNA, 19 nt, Homo sapiens
uauaaagcauugucuguuc

SEQ ID NO: 496453 - RNA, 19 nt, Homo sapiens
gaaagugugagcaaugaug

SEQ ID NO: 496454 - RNA, 19 nt, Homo sapiens
cacagaaagccgcuaaaua

SEQ ID NO: 496455 - RNA, 19 nt, Homo sapiens
gaaagaaucauggcauuac

SEQ ID NO: 496456 - RNA, 19 nt, Homo sapiens
gaaagacaaacagaaagaa

SEQ ID NO: 496457 - RNA, 19 nt, Homo sapiens
ucacuucgucauaauguua

SEQ ID NO: 496458 - RNA, 19 nt, Homo sapiens
ggaguccagugucuuugaa

SEQ ID NO: 496459 - RNA, 19 nt, Homo sapiens
uagaaugccugcccgcuau

SEQ ID NO: 496460 - RNA, 19 nt, Homo sapiens
ucucuucacuuguaugcua

SEQ ID NO: 496461 - RNA, 19 nt, Homo sapiens
acacauacacacccacaua

SEQ ID NO: 496462 - RNA, 19 nt, Homo sapiens
gauuagcccuucacccaau

SEQ ID NO: 496463 - RNA, 19 nt, Homo sapiens
gcacaugauuagcccuuca

SEQ ID NO: 496464 - RNA, 19 nt, Homo sapiens
cagaaagccgcuaaauaaa

SEQ ID NO: 496465 - RNA, 19 nt, Homo sapiens
gcacagaaagccgcuaaau

SEQ ID NO: 496466 - RNA, 19 nt, Homo sapiens
ccacuucccaguuucagua

SEQ ID NO: 496467 - RNA, 19 nt, Homo sapiens
ggucuucuauacccuucua

SEQ ID NO: 496468 - RNA, 19 nt, Homo sapiens
gaaagccagcuguguaauc

SEQ ID NO: 496469 - RNA, 19 nt, Homo sapiens
aaugugggcugccgagaaa

SEQ ID NO: 496470 - RNA, 19 nt, Homo sapiens
gaagaaaagguguacaaaa

SEQ ID NO: 496471 - RNA, 19 nt, Homo sapiens
uaaaugguguggaaaugca

SEQ ID NO: 496472 - RNA, 19 nt, Homo sapiens
acacacacauacauauuca

SEQ ID NO: 496473 - RNA, 19 nt, Homo sapiens
caaacaccacggagcauuu

SEQ ID NO: 496474 - RNA, 19 nt, Homo sapiens
aucuaaaccucucugauua

SEQ ID NO: 496475 - RNA, 19 nt, Homo sapiens
gcaauaaaaggguauguaa

SEQ ID NO: 496476 - RNA, 19 nt, Homo sapiens
gcccuuagaucuccauuuu

SEQ ID NO: 496477 - RNA, 19 nt, Homo sapiens
gagacugaauaaucacuuc

SEQ ID NO: 496478 - RNA, 19 nt, Homo sapiens
acagacagaccuaccuaua

SEQ ID NO: 496479 - RNA, 19 nt, Homo sapiens
cagcagauuaccagauuaa

SEQ ID NO: 496480 - RNA, 19 nt, Homo sapiens
uggaaagaaucauggcauu

SEQ ID NO: 496481 - RNA, 19 nt, Homo sapiens
ggaugagaguggaaagaca

SEQ ID NO: 496482 - RNA, 19 nt, Homo sapiens
ugaacugggugaacucugu

SEQ ID NO: 496483 - RNA, 19 nt, Homo sapiens
auacauacgugcacacaca

SEQ ID NO: 496484 - RNA, 19 nt, Homo sapiens
gcaacucaguggccauucu

SEQ ID NO: 496485 - RNA, 19 nt, Homo sapiens
ccacggagcauuuggcaau

SEQ ID NO: 496486 - RNA, 19 nt, Homo sapiens
gcaaccaacacuugugaug

SEQ ID NO: 496487 - RNA, 19 nt, Homo sapiens
gagguguuguagauaaaug

SEQ ID NO: 496488 - RNA, 19 nt, Homo sapiens
uuugagguguuguagauaa

SEQ ID NO: 496489 - RNA, 19 nt, Homo sapiens
gguguggaaaugcaaauaa

SEQ ID NO: 496490 - RNA, 19 nt, Homo sapiens
caagagcagaggcaacaaa

SEQ ID NO: 496491 - RNA, 19 nt, Homo sapiens
ucaccaaggagacguguuu

SEQ ID NO: 496492 - RNA, 19 nt, Homo sapiens
gagcaaugaugagaauuuu

SEQ ID NO: 496493 - RNA, 19 nt, Homo sapiens
gaauagagaacaggaacga

SEQ ID NO: 496494 - RNA, 19 nt, Homo sapiens
gggaauccaauauuaugaa

SEQ ID NO: 496495 - RNA, 19 nt, Homo sapiens
ucagcagauuaccagauua

SEQ ID NO: 496496 - RNA, 19 nt, Homo sapiens
ugagcaaugaugagaauuu

SEQ ID NO: 496497 - RNA, 19 nt, Homo sapiens
guggaaagagggagaaaga

SEQ ID NO: 496498 - RNA, 19 nt, Homo sapiens
gugcacacacacauacaua

SEQ ID NO: 496499 - RNA, 19 nt, Homo sapiens
ccacauacagacagaccua

SEQ ID NO: 496500 - RNA, 19 nt, Homo sapiens
agaacaagagauaccuuua

SEQ ID NO: 496501 - RNA, 19 nt, Homo sapiens
ccacugugauccagaagag

SEQ ID NO: 496502 - RNA, 19 nt, Homo sapiens
ugaccacugugauccagaa

SEQ ID NO: 496503 - RNA, 19 nt, Homo sapiens
gaaacagaacuggacuuga

SEQ ID NO: 496504 - RNA, 19 nt, Homo sapiens
guguacaacucuagaugga

SEQ ID NO: 496505 - RNA, 19 nt, Homo sapiens
agacauauacccaagaaca

SEQ ID NO: 496506 - RNA, 19 nt, Homo sapiens
agccagcuguguaaucuaa

SEQ ID NO: 496507 - RNA, 19 nt, Homo sapiens
ggacagagcaaggaaugca

SEQ ID NO: 496508 - RNA, 19 nt, Homo sapiens
agaaagacaaacagaaaga

SEQ ID NO: 496509 - RNA, 19 nt, Homo sapiens
guguggaaaugcaaauaau

SEQ ID NO: 496510 - RNA, 19 nt, Homo sapiens
gagaaagacaaacagaaag

SEQ ID NO: 496511 - RNA, 19 nt, Homo sapiens
gauagaaucauccgcaacu

SEQ ID NO: 496512 - RNA, 19 nt, Homo sapiens
aacaagagauaccuuuaag

SEQ ID NO: 496513 - RNA, 19 nt, Homo sapiens
cuaaaccucucugauuauc

SEQ ID NO: 496514 - RNA, 19 nt, Homo sapiens
gguaagaaagcaagugaag

SEQ ID NO: 496515 - RNA, 19 nt, Homo sapiens
ggaaauauccccucauguc

SEQ ID NO: 496516 - RNA, 19 nt, Homo sapiens
gcacacugacucugaacug

SEQ ID NO: 496517 - RNA, 19 nt, Homo sapiens
ggcaucagcagcaggguuu

SEQ ID NO: 496518 - RNA, 19 nt, Homo sapiens
gaaacccgccugccaugag

SEQ ID NO: 496519 - RNA, 19 nt, Homo sapiens
gugccaaccugcccugucu

SEQ ID NO: 496520 - RNA, 19 nt, Homo sapiens
gcaguaggaaguggacaga

SEQ ID NO: 496521 - RNA, 19 nt, Homo sapiens
cccagacagugcugcgaaa

SEQ ID NO: 496522 - RNA, 19 nt, Homo sapiens
cagcccaucugccuguucu

SEQ ID NO: 496523 - RNA, 19 nt, Homo sapiens
gcuccuccuuccucaccuu

SEQ ID NO: 496524 - RNA, 19 nt, Homo sapiens
gcccaucugccuguucuga

SEQ ID NO: 496525 - RNA, 19 nt, Homo sapiens
cgaaacccgccugccauga

SEQ ID NO: 496526 - RNA, 19 nt, Homo sapiens
cgucggauguuuauuguua

SEQ ID NO: 496527 - RNA, 19 nt, Homo sapiens
uaaaguugcugauucauuc

SEQ ID NO: 496528 - RNA, 19 nt, Homo sapiens
gaaccgagacgaacugaau

SEQ ID NO: 496529 - RNA, 19 nt, Homo sapiens
gcaauuacaccacagaugu

SEQ ID NO: 496530 - RNA, 19 nt, Homo sapiens
gaaaugguacuccacauca

SEQ ID NO: 496531 - RNA, 19 nt, Homo sapiens
gcaagcguuucuucgaauu

SEQ ID NO: 496532 - RNA, 19 nt, Homo sapiens
gcagagcacgguucccaua

SEQ ID NO: 496533 - RNA, 19 nt, Homo sapiens
guguggauguucagaauuu

SEQ ID NO: 496534 - RNA, 19 nt, Homo sapiens
cagagacgcugaggaugua

SEQ ID NO: 496535 - RNA, 19 nt, Homo sapiens
ggauguacccgccagcuuu

SEQ ID NO: 496536 - RNA, 19 nt, Homo sapiens
gagaacuucaguaacuuua

SEQ ID NO: 496537 - RNA, 19 nt, Homo sapiens
guugagaacuucaguaacu

SEQ ID NO: 496538 - RNA, 19 nt, Homo sapiens
gaagagaggcggagagacu

SEQ ID NO: 496539 - RNA, 19 nt, Homo sapiens
gaaguuaggccucagacau

SEQ ID NO: 496540 - RNA, 19 nt, Homo sapiens
gcagagacgcugaggaugu

SEQ ID NO: 496541 - RNA, 19 nt, Homo sapiens
cagaggugcuacugcaauu

SEQ ID NO: 496542 - RNA, 19 nt, Homo sapiens
ggagacacucugagaaaga

SEQ ID NO: 496543 - RNA, 19 nt, Homo sapiens
ggucgucggauguuuauug

SEQ ID NO: 496544 - RNA, 19 nt, Homo sapiens
caagccuucuccuuucauu

SEQ ID NO: 496545 - RNA, 19 nt, Homo sapiens
acacugaaacccuuuguug

SEQ ID NO: 496546 - RNA, 19 nt, Homo sapiens
gagcacgguucccauaagg

SEQ ID NO: 496547 - RNA, 19 nt, Homo sapiens
gcagcuagaauccaaaucu

SEQ ID NO: 496548 - RNA, 19 nt, Homo sapiens
gaggaucccuuugugaaac

SEQ ID NO: 496549 - RNA, 19 nt, Homo sapiens
guaucccgcugacacagaa

SEQ ID NO: 496550 - RNA, 19 nt, Homo sapiens
ucaccaacacacuuucuuu

SEQ ID NO: 496551 - RNA, 19 nt, Homo sapiens
gagagacuuccuccaaaug

SEQ ID NO: 496552 - RNA, 19 nt, Homo sapiens
caauaagaaccgagacgaa

SEQ ID NO: 496553 - RNA, 19 nt, Homo sapiens
gcugauucauuccuuuaca

SEQ ID NO: 496554 - RNA, 19 nt, Homo sapiens
cuuaucauuuccauccaua

SEQ ID NO: 496555 - RNA, 19 nt, Homo sapiens
auucauuccuuuacacuga

SEQ ID NO: 496556 - RNA, 19 nt, Homo sapiens
ugagagagguagacguuuu

SEQ ID NO: 496557 - RNA, 19 nt, Homo sapiens
ccuccugucucaucuggaa

SEQ ID NO: 496558 - RNA, 19 nt, Homo sapiens
gggagacacucugagaaag

SEQ ID NO: 496559 - RNA, 19 nt, Homo sapiens
aauggugucuauaucaaga

SEQ ID NO: 496560 - RNA, 19 nt, Homo sapiens
cugcaagcguuucuucgaa

SEQ ID NO: 496561 - RNA, 19 nt, Homo sapiens
uaacuuuaccaacagaaug

SEQ ID NO: 496562 - RNA, 19 nt, Homo sapiens
ccaaauggagcucagaaag

SEQ ID NO: 496563 - RNA, 19 nt, Homo sapiens
ucucuuggcccuccugaaa

SEQ ID NO: 496564 - RNA, 19 nt, Homo sapiens
cagcuagaauccaaaucug

SEQ ID NO: 496565 - RNA, 19 nt, Homo sapiens
gcccugaugucugcuuuca

SEQ ID NO: 496566 - RNA, 19 nt, Homo sapiens
ccucuuccuuccucuuuau

SEQ ID NO: 496567 - RNA, 19 nt, Homo sapiens
gagacuuccuccaaauggu

SEQ ID NO: 496568 - RNA, 19 nt, Homo sapiens
ugagaacuucaguaacuuu

SEQ ID NO: 496569 - RNA, 19 nt, Homo sapiens
guacuccacaucagcauuc

SEQ ID NO: 496570 - RNA, 19 nt, Homo sapiens
uauccugguuuuacucuua

SEQ ID NO: 496571 - RNA, 19 nt, Homo sapiens
gaccuucuccuggcucauu

SEQ ID NO: 496572 - RNA, 19 nt, Homo sapiens
ggagaaguuaggccucaga

SEQ ID NO: 496573 - RNA, 19 nt, Homo sapiens
cacaucagcauucucaaga

SEQ ID NO: 496574 - RNA, 19 nt, Homo sapiens
ugaggaucccuuugugaaa

SEQ ID NO: 496575 - RNA, 19 nt, Homo sapiens
cagccaagccugcgaccuu

SEQ ID NO: 496576 - RNA, 19 nt, Homo sapiens
gguguugguugagaacuuc

SEQ ID NO: 496577 - RNA, 19 nt, Homo sapiens
ucuccuggcucauuuaaaa

SEQ ID NO: 496578 - RNA, 19 nt, Homo sapiens
ucccaagccuucuccuuuc

SEQ ID NO: 496579 - RNA, 19 nt, Homo sapiens
cagagcacgguucccauaa

SEQ ID NO: 496580 - RNA, 19 nt, Homo sapiens
uugguugccuguucccuuu

SEQ ID NO: 496581 - RNA, 19 nt, Homo sapiens
caucagcauucucaagacu

SEQ ID NO: 496582 - RNA, 19 nt, Homo sapiens
caaagaaaacccuaagugu

SEQ ID NO: 496583 - RNA, 19 nt, Homo sapiens
gcacaaguuccgguuccaa

SEQ ID NO: 496584 - RNA, 19 nt, Homo sapiens
gcccggauuuugcccaaua

SEQ ID NO: 496585 - RNA, 19 nt, Homo sapiens
cugaaaagcugaacgagau

SEQ ID NO: 496586 - RNA, 19 nt, Homo sapiens
aagcagguguugguugaga

SEQ ID NO: 496587 - RNA, 19 nt, Homo sapiens
gaucaagcagguguugguu

SEQ ID NO: 496588 - RNA, 19 nt, Homo sapiens
caaauggagcucagaaagc

SEQ ID NO: 496589 - RNA, 19 nt, Homo sapiens
guugcugauucauuccuuu

SEQ ID NO: 496590 - RNA, 19 nt, Homo sapiens
cagaauggcgucggguuug

SEQ ID NO: 496591 - RNA, 19 nt, Homo sapiens
gccaaauggagcucagaaa

SEQ ID NO: 496592 - RNA, 19 nt, Homo sapiens
cauuggaaacuugacauuu

SEQ ID NO: 496593 - RNA, 19 nt, Homo sapiens
ucuuggcccuccugaaaug

SEQ ID NO: 496594 - RNA, 19 nt, Homo sapiens
aaguguggauguucagaau

SEQ ID NO: 496595 - RNA, 19 nt, Homo sapiens
ggccuuugacuguggauga

SEQ ID NO: 496596 - RNA, 19 nt, Homo sapiens
gguccuggaugcccgacau

SEQ ID NO: 496597 - RNA, 19 nt, Homo sapiens
uaaguguggauguucagaa

SEQ ID NO: 496598 - RNA, 19 nt, Homo sapiens
ccaugggcgugcaagacuu

SEQ ID NO: 496599 - RNA, 19 nt, Homo sapiens
ggauuuugcccaauaagaa

SEQ ID NO: 496600 - RNA, 19 nt, Homo sapiens
acagaauggcgucggguuu

SEQ ID NO: 496601 - RNA, 19 nt, Homo sapiens
agccagacaugaucaagca

SEQ ID NO: 496602 - RNA, 19 nt, Homo sapiens
ccacaucagcauucucaag

SEQ ID NO: 496603 - RNA, 19 nt, Homo sapiens
ugaaaugguacuccacauc

SEQ ID NO: 496604 - RNA, 19 nt, Homo sapiens
uuccaagccugcccugaga

SEQ ID NO: 496605 - RNA, 19 nt, Homo sapiens
cccgccagcuuucagauuc

SEQ ID NO: 496606 - RNA, 19 nt, Homo sapiens
gauguacccgccagcuuuc

SEQ ID NO: 496607 - RNA, 19 nt, Homo sapiens
ccagaggugcuacugcaau

SEQ ID NO: 496608 - RNA, 19 nt, Homo sapiens
ugguugagaacuucaguaa

SEQ ID NO: 496609 - RNA, 19 nt, Homo sapiens
gcucagaaagcuguaugga

SEQ ID NO: 496610 - RNA, 19 nt, Homo sapiens
gauggaagccuugggguuu

SEQ ID NO: 496611 - RNA, 19 nt, Homo sapiens
auccaaaucugcccuaggu

SEQ ID NO: 496612 - RNA, 19 nt, Homo sapiens
ccagguaccgcugcagcua

SEQ ID NO: 496613 - RNA, 19 nt, Homo sapiens
ucugagagagguagacguu

SEQ ID NO: 496614 - RNA, 19 nt, Homo sapiens
cugaggaucccuuugugaa

SEQ ID NO: 496615 - RNA, 19 nt, Homo sapiens
gaggugcuacugcaauuac

SEQ ID NO: 496616 - RNA, 19 nt, Homo sapiens
agggagacacucugagaaa

SEQ ID NO: 496617 - RNA, 19 nt, Homo sapiens
gugcccugaugucugcuuu

SEQ ID NO: 496618 - RNA, 19 nt, Homo sapiens
acugaaacccuuuguugug

SEQ ID NO: 496619 - RNA, 19 nt, Homo sapiens
agaucagccuccugucuca

SEQ ID NO: 496620 - RNA, 19 nt, Homo sapiens
aacccugacugccaagaga

SEQ ID NO: 496621 - RNA, 19 nt, Homo sapiens
aaucaucaccaacacacuu

SEQ ID NO: 496622 - RNA, 19 nt, Homo sapiens
uaagaaccgagacgaacug

SEQ ID NO: 496623 - RNA, 19 nt, Homo sapiens
ugcaagcguuucuucgaau

SEQ ID NO: 496624 - RNA, 19 nt, Homo sapiens
gucgucggauguuuauugu

SEQ ID NO: 496625 - RNA, 19 nt, Homo sapiens
cccaagccuucuccuuuca

SEQ ID NO: 496626 - RNA, 19 nt, Homo sapiens
cgucggauguuuauuguua

SEQ ID NO: 496627 - RNA, 19 nt, Homo sapiens
uaaaguugcugauucauuc

SEQ ID NO: 496628 - RNA, 19 nt, Homo sapiens
gaaccgagacgaacugaau

SEQ ID NO: 496629 - RNA, 19 nt, Homo sapiens
gcaauuacaccacagaugu

SEQ ID NO: 496630 - RNA, 19 nt, Homo sapiens
gaaaugguacuccacauca

SEQ ID NO: 496631 - RNA, 19 nt, Homo sapiens
gcaagcguuucuucgaauu

SEQ ID NO: 496632 - RNA, 19 nt, Homo sapiens
gcagagcacgguucccaua

SEQ ID NO: 496633 - RNA, 19 nt, Homo sapiens
guguggauguucagaauuu

SEQ ID NO: 496634 - RNA, 19 nt, Homo sapiens
cagagacgcugaggaugua

SEQ ID NO: 496635 - RNA, 19 nt, Homo sapiens
ggauguacccgccagcuuu

SEQ ID NO: 496636 - RNA, 19 nt, Homo sapiens
gagaacuucaguaacuuua

SEQ ID NO: 496637 - RNA, 19 nt, Homo sapiens
guugagaacuucaguaacu

SEQ ID NO: 496638 - RNA, 19 nt, Homo sapiens
gaagagaggcggagagacu

SEQ ID NO: 496639 - RNA, 19 nt, Homo sapiens
gaaguuaggccucagacau

SEQ ID NO: 496640 - RNA, 19 nt, Homo sapiens
gcagagacgcugaggaugu

SEQ ID NO: 496641 - RNA, 19 nt, Homo sapiens
cagaggugcuacugcaauu

SEQ ID NO: 496642 - RNA, 19 nt, Homo sapiens
ggagacacucugagaaaga

SEQ ID NO: 496643 - RNA, 19 nt, Homo sapiens
ggucgucggauguuuauug

SEQ ID NO: 496644 - RNA, 19 nt, Homo sapiens
caagccuucuccuuucauu

SEQ ID NO: 496645 - RNA, 19 nt, Homo sapiens
acacugaaacccuuuguug

SEQ ID NO: 496646 - RNA, 19 nt, Homo sapiens
gagcacgguucccauaagg

SEQ ID NO: 496647 - RNA, 19 nt, Homo sapiens
gcagcuagaauccaaaucu

SEQ ID NO: 496648 - RNA, 19 nt, Homo sapiens
gaggaucccuuugugaaac

SEQ ID NO: 496649 - RNA, 19 nt, Homo sapiens
guaucccgcugacacagaa

SEQ ID NO: 496650 - RNA, 19 nt, Homo sapiens
ucaccaacacacuuucuuu

SEQ ID NO: 496651 - RNA, 19 nt, Homo sapiens
gagagacuuccuccaaaug

SEQ ID NO: 496652 - RNA, 19 nt, Homo sapiens
caauaagaaccgagacgaa

SEQ ID NO: 496653 - RNA, 19 nt, Homo sapiens
gcugauucauuccuuuaca

SEQ ID NO: 496654 - RNA, 19 nt, Homo sapiens
cuuaucauuuccauccaua

SEQ ID NO: 496655 - RNA, 19 nt, Homo sapiens
auucauuccuuuacacuga

SEQ ID NO: 496656 - RNA, 19 nt, Homo sapiens
ugagagagguagacguuuu

SEQ ID NO: 496657 - RNA, 19 nt, Homo sapiens
ccuccugucucaucuggaa

SEQ ID NO: 496658 - RNA, 19 nt, Homo sapiens
gggagacacucugagaaag

SEQ ID NO: 496659 - RNA, 19 nt, Homo sapiens
aauggugucuauaucaaga

SEQ ID NO: 496660 - RNA, 19 nt, Homo sapiens
cugcaagcguuucuucgaa

SEQ ID NO: 496661 - RNA, 19 nt, Homo sapiens
uaacuuuaccaacagaaug

SEQ ID NO: 496662 - RNA, 19 nt, Homo sapiens
ccaaauggagcucagaaag

SEQ ID NO: 496663 - RNA, 19 nt, Homo sapiens
ucucuuggcccuccugaaa

SEQ ID NO: 496664 - RNA, 19 nt, Homo sapiens
cagcuagaauccaaaucug

SEQ ID NO: 496665 - RNA, 19 nt, Homo sapiens
gcccugaugucugcuuuca

SEQ ID NO: 496666 - RNA, 19 nt, Homo sapiens
ccucuuccuuccucuuuau

SEQ ID NO: 496667 - RNA, 19 nt, Homo sapiens
gagacuuccuccaaauggu

SEQ ID NO: 496668 - RNA, 19 nt, Homo sapiens
ugagaacuucaguaacuuu

SEQ ID NO: 496669 - RNA, 19 nt, Homo sapiens
guacuccacaucagcauuc

SEQ ID NO: 496670 - RNA, 19 nt, Homo sapiens
uauccugguuuuacucuua

SEQ ID NO: 496671 - RNA, 19 nt, Homo sapiens
gaccuucuccuggcucauu

SEQ ID NO: 496672 - RNA, 19 nt, Homo sapiens
ggagaaguuaggccucaga

SEQ ID NO: 496673 - RNA, 19 nt, Homo sapiens
cacaucagcauucucaaga

SEQ ID NO: 496674 - RNA, 19 nt, Homo sapiens
ugaggaucccuuugugaaa

SEQ ID NO: 496675 - RNA, 19 nt, Homo sapiens
cagccaagccugcgaccuu

SEQ ID NO: 496676 - RNA, 19 nt, Homo sapiens
gguguugguugagaacuuc

SEQ ID NO: 496677 - RNA, 19 nt, Homo sapiens
ucuccuggcucauuuaaaa

SEQ ID NO: 496678 - RNA, 19 nt, Homo sapiens
ucccaagccuucuccuuuc

SEQ ID NO: 496679 - RNA, 19 nt, Homo sapiens
cagagcacgguucccauaa

SEQ ID NO: 496680 - RNA, 19 nt, Homo sapiens
uugguugccuguucccuuu

SEQ ID NO: 496681 - RNA, 19 nt, Homo sapiens
caucagcauucucaagacu

SEQ ID NO: 496682 - RNA, 19 nt, Homo sapiens
caaagaaaacccuaagugu

SEQ ID NO: 496683 - RNA, 19 nt, Homo sapiens
gcccggauuuugcccaaua

SEQ ID NO: 496684 - RNA, 19 nt, Homo sapiens
cugaaaagcugaacgagau

SEQ ID NO: 496685 - RNA, 19 nt, Homo sapiens
aagcagguguugguugaga

SEQ ID NO: 496686 - RNA, 19 nt, Homo sapiens
gaucaagcagguguugguu

SEQ ID NO: 496687 - RNA, 19 nt, Homo sapiens
caaauggagcucagaaagc

SEQ ID NO: 496688 - RNA, 19 nt, Homo sapiens
guugcugauucauuccuuu

SEQ ID NO: 496689 - RNA, 19 nt, Homo sapiens
cagaauggcgucggguuug

SEQ ID NO: 496690 - RNA, 19 nt, Homo sapiens
gccaaauggagcucagaaa

SEQ ID NO: 496691 - RNA, 19 nt, Homo sapiens
cauuggaaacuugacauuu

SEQ ID NO: 496692 - RNA, 19 nt, Homo sapiens
ucuuggcccuccugaaaug

SEQ ID NO: 496693 - RNA, 19 nt, Homo sapiens
aaguguggauguucagaau

SEQ ID NO: 496694 - RNA, 19 nt, Homo sapiens
ggccuuugacuguggauga

SEQ ID NO: 496695 - RNA, 19 nt, Homo sapiens
gguccuggaugcccgacau

SEQ ID NO: 496696 - RNA, 19 nt, Homo sapiens
uaaguguggauguucagaa

SEQ ID NO: 496697 - RNA, 19 nt, Homo sapiens
ccaugggcgugcaagacuu

SEQ ID NO: 496698 - RNA, 19 nt, Homo sapiens
ggauuuugcccaauaagaa

SEQ ID NO: 496699 - RNA, 19 nt, Homo sapiens
acagaauggcgucggguuu

SEQ ID NO: 496700 - RNA, 19 nt, Homo sapiens
agccagacaugaucaagca

SEQ ID NO: 496701 - RNA, 19 nt, Homo sapiens
ccacaucagcauucucaag

SEQ ID NO: 496702 - RNA, 19 nt, Homo sapiens
ugaaaugguacuccacauc

SEQ ID NO: 496703 - RNA, 19 nt, Homo sapiens
aaagguaccgcugcagcua

SEQ ID NO: 496704 - RNA, 19 nt, Homo sapiens
cccgccagcuuucagauuc

SEQ ID NO: 496705 - RNA, 19 nt, Homo sapiens
gauguacccgccagcuuuc

SEQ ID NO: 496706 - RNA, 19 nt, Homo sapiens
ccagaggugcuacugcaau

SEQ ID NO: 496707 - RNA, 19 nt, Homo sapiens
ugguugagaacuucaguaa

SEQ ID NO: 496708 - RNA, 19 nt, Homo sapiens
gcucagaaagcuguaugga

SEQ ID NO: 496709 - RNA, 19 nt, Homo sapiens
gauggaagccuugggguuu

SEQ ID NO: 496710 - RNA, 19 nt, Homo sapiens
auccaaaucugcccuaggu

SEQ ID NO: 496711 - RNA, 19 nt, Homo sapiens
ucugagagagguagacguu

SEQ ID NO: 496712 - RNA, 19 nt, Homo sapiens
cugaggaucccuuugugaa

SEQ ID NO: 496713 - RNA, 19 nt, Homo sapiens
gaggugcuacugcaauuac

SEQ ID NO: 496714 - RNA, 19 nt, Homo sapiens
agggagacacucugagaaa

SEQ ID NO: 496715 - RNA, 19 nt, Homo sapiens
gugcccugaugucugcuuu

SEQ ID NO: 496716 - RNA, 19 nt, Homo sapiens
acugaaacccuuuguugug

SEQ ID NO: 496717 - RNA, 19 nt, Homo sapiens
aacccugacugccaagaga

SEQ ID NO: 496718 - RNA, 19 nt, Homo sapiens
aaucaucaccaacacacuu

SEQ ID NO: 496719 - RNA, 19 nt, Homo sapiens
agaucagccuccugucuca

SEQ ID NO: 496720 - RNA, 19 nt, Homo sapiens
uaagaaccgagacgaacug

SEQ ID NO: 496721 - RNA, 19 nt, Homo sapiens
ugcaagcguuucuucgaau

SEQ ID NO: 496722 - RNA, 19 nt, Homo sapiens
gucgucggauguuuauugu

SEQ ID NO: 496723 - RNA, 19 nt, Homo sapiens
cccaagccuucuccuuuca

SEQ ID NO: 496724 - RNA, 19 nt, Homo sapiens
aaucugcccuagguccaaa

SEQ ID NO: 496725 - RNA, 19 nt, Homo sapiens
caugggcgugcaagacuuu

SEQ ID NO: 496726 - RNA, 19 nt, Homo sapiens
ugagguagcuuaugaauuu

SEQ ID NO: 496727 - RNA, 19 nt, Homo sapiens
gaauauuccuccugacuua

SEQ ID NO: 496728 - RNA, 19 nt, Homo sapiens
gaaagaaccugcaauuaca

SEQ ID NO: 496729 - RNA, 19 nt, Homo sapiens
caaaauaucuggaccauua

SEQ ID NO: 496730 - RNA, 19 nt, Homo sapiens
gcaaguagcuuuacaguac

SEQ ID NO: 496731 - RNA, 19 nt, Homo sapiens
ucacaagcuuggaauauua

SEQ ID NO: 496732 - RNA, 19 nt, Homo sapiens
uaacaucccuuccuuaaau

SEQ ID NO: 496733 - RNA, 19 nt, Homo sapiens
gaacgcggcuggagcauug

SEQ ID NO: 496734 - RNA, 19 nt, Homo sapiens
gaagaaagaaccugcaauu

SEQ ID NO: 496735 - RNA, 19 nt, Homo sapiens
guagggagaccauauaaua

SEQ ID NO: 496736 - RNA, 19 nt, Homo sapiens
caaagucucucaucaaauc

SEQ ID NO: 496737 - RNA, 19 nt, Homo sapiens
gaacagcccugaggcaaga

SEQ ID NO: 496738 - RNA, 19 nt, Homo sapiens
gcaauuacaucgcagaaca

SEQ ID NO: 496739 - RNA, 19 nt, Homo sapiens
ggaauacagacaugaaaua

SEQ ID NO: 496740 - RNA, 19 nt, Homo sapiens
ccaagaagauggacaagau

SEQ ID NO: 496741 - RNA, 19 nt, Homo sapiens
gaaguaggauaucaaaucu

SEQ ID NO: 496742 - RNA, 19 nt, Homo sapiens
guuaaaguguguaccauuu

SEQ ID NO: 496743 - RNA, 19 nt, Homo sapiens
uuaaaugccuucuguaguu

SEQ ID NO: 496744 - RNA, 19 nt, Homo sapiens
ggaaaucgauggaaguucu

SEQ ID NO: 496745 - RNA, 19 nt, Homo sapiens
ggaaauggcuagugaugag

SEQ ID NO: 496746 - RNA, 19 nt, Homo sapiens
guaaacaguucaugacuag

SEQ ID NO: 496747 - RNA, 19 nt, Homo sapiens
ggaaaucuauacugaccaa

SEQ ID NO: 496748 - RNA, 19 nt, Homo sapiens
gcaccaagcacuucugauu

SEQ ID NO: 496749 - RNA, 19 nt, Homo sapiens
gaaguucuguugaguugga

SEQ ID NO: 496750 - RNA, 19 nt, Homo sapiens
caaaugcucgagauacuua

SEQ ID NO: 496751 - RNA, 19 nt, Homo sapiens
ggaaacaagacuuuauuga

SEQ ID NO: 496752 - RNA, 19 nt, Homo sapiens
gaaugucaguuaaugcuau

SEQ ID NO: 496753 - RNA, 19 nt, Homo sapiens
gugaugagcugaaagagau

SEQ ID NO: 496754 - RNA, 19 nt, Homo sapiens
gggagaccauauaauaauu

SEQ ID NO: 496755 - RNA, 19 nt, Homo sapiens
cagaggaaauggcuaguga

SEQ ID NO: 496756 - RNA, 19 nt, Homo sapiens
gaaucggaaugucaguuaa

SEQ ID NO: 496757 - RNA, 19 nt, Homo sapiens
ugaccaaggauuaaucuua

SEQ ID NO: 496758 - RNA, 19 nt, Homo sapiens
agaaagaccucaguacaug

SEQ ID NO: 496759 - RNA, 19 nt, Homo sapiens
gaugaaaacuucccacuau

SEQ ID NO: 496760 - RNA, 19 nt, Homo sapiens
gaaacaagacuuuauugag

SEQ ID NO: 496761 - RNA, 19 nt, Homo sapiens
gaaauaaggaauacagaca

SEQ ID NO: 496762 - RNA, 19 nt, Homo sapiens
gcaagcagaguacagauga

SEQ ID NO: 496763 - RNA, 19 nt, Homo sapiens
caguacagaucuuacaauu

SEQ ID NO: 496764 - RNA, 19 nt, Homo sapiens
cuaaaggagcuuaagaaua

SEQ ID NO: 496765 - RNA, 19 nt, Homo sapiens
gaagacauacuggaaagaa

SEQ ID NO: 496766 - RNA, 19 nt, Homo sapiens
ugacuuauuugcuagaaug

SEQ ID NO: 496767 - RNA, 19 nt, Homo sapiens
gaacaaacugaauauaugg

SEQ ID NO: 496768 - RNA, 19 nt, Homo sapiens
uaaaugccuucuguaguuu

SEQ ID NO: 496769 - RNA, 19 nt, Homo sapiens
ccaaagaagccaucagaga

SEQ ID NO: 496770 - RNA, 19 nt, Homo sapiens
gaagaauuaggaucucaaa

SEQ ID NO: 496771 - RNA, 19 nt, Homo sapiens
agaaagaccuugacgaaaa

SEQ ID NO: 496772 - RNA, 19 nt, Homo sapiens
gaguacagaugaggaaguu

SEQ ID NO: 496773 - RNA, 19 nt, Homo sapiens
gaccuaacaucccuuccuu

SEQ ID NO: 496774 - RNA, 19 nt, Homo sapiens
gaaaggaugagacaaaugc

SEQ ID NO: 496775 - RNA, 19 nt, Homo sapiens
ccuguuaauuuaccuguuu

SEQ ID NO: 496776 - RNA, 19 nt, Homo sapiens
ugagaaagaccuugacgaa

SEQ ID NO: 496777 - RNA, 19 nt, Homo sapiens
uguaaacaguucaugacua

SEQ ID NO: 496778 - RNA, 19 nt, Homo sapiens
cgaaguaggauaucaaauc

SEQ ID NO: 496779 - RNA, 19 nt, Homo sapiens
gagcugaugaggaagaauu

SEQ ID NO: 496780 - RNA, 19 nt, Homo sapiens
gaccaaagaagccaucaga

SEQ ID NO: 496781 - RNA, 19 nt, Homo sapiens
cagaaaggaugagacaaau

SEQ ID NO: 496782 - RNA, 19 nt, Homo sapiens
gagaaagaccuugacgaaa

SEQ ID NO: 496783 - RNA, 19 nt, Homo sapiens
acaagauggugcagaagaa

SEQ ID NO: 496784 - RNA, 19 nt, Homo sapiens
gacaaaugcucgagauacu

SEQ ID NO: 496785 - RNA, 19 nt, Homo sapiens
gacccagacugacuuguuc

SEQ ID NO: 496786 - RNA, 19 nt, Homo sapiens
aauuggagcugaugaggaa

SEQ ID NO: 496787 - RNA, 19 nt, Homo sapiens
caacugagaaagaccuuga

SEQ ID NO: 496788 - RNA, 19 nt, Homo sapiens
ggcaauauuucuucuuucu

SEQ ID NO: 496789 - RNA, 19 nt, Homo sapiens
ccuaacaucccuuccuuaa

SEQ ID NO: 496790 - RNA, 19 nt, Homo sapiens
uggaaguucuguugaguug

SEQ ID NO: 496791 - RNA, 19 nt, Homo sapiens
uuacugcaguccacaagaa

SEQ ID NO: 496792 - RNA, 19 nt, Homo sapiens
agaaagaaccugcaauuac

SEQ ID NO: 496793 - RNA, 19 nt, Homo sapiens
ggagacugauagaaaauaa

SEQ ID NO: 496794 - RNA, 19 nt, Homo sapiens
agacugacuuguucacaug

SEQ ID NO: 496795 - RNA, 19 nt, Homo sapiens
ggacccagacugacuuguu

SEQ ID NO: 496796 - RNA, 19 nt, Homo sapiens
acagaaaggaugagacaaa

SEQ ID NO: 496797 - RNA, 19 nt, Homo sapiens
aagaaagaaccugcaauua

SEQ ID NO: 496798 - RNA, 19 nt, Homo sapiens
ugaggaaguuacaucuuug

SEQ ID NO: 496799 - RNA, 19 nt, Homo sapiens
ccuccugacuuauuugcua

SEQ ID NO: 496800 - RNA, 19 nt, Homo sapiens
gagcuuaagaauauuccua

SEQ ID NO: 496801 - RNA, 19 nt, Homo sapiens
augaggaaguuacaucuuu

SEQ ID NO: 496802 - RNA, 19 nt, Homo sapiens
gcuauucgcaagcagagua

SEQ ID NO: 496803 - RNA, 19 nt, Homo sapiens
gcucuagcauacuuuaaag

SEQ ID NO: 496804 - RNA, 19 nt, Homo sapiens
cuguuacucucuguuauua

SEQ ID NO: 496805 - RNA, 19 nt, Homo sapiens
uaaugaauguggaaaucga

SEQ ID NO: 496806 - RNA, 19 nt, Homo sapiens
gagacaaaugcucgagaua

SEQ ID NO: 496807 - RNA, 19 nt, Homo sapiens
gcuaaaggagcuuaagaau

SEQ ID NO: 496808 - RNA, 19 nt, Homo sapiens
aauaauacuugaccagcuu

SEQ ID NO: 496809 - RNA, 19 nt, Homo sapiens
ugaaacauacacaguagaa

SEQ ID NO: 496810 - RNA, 19 nt, Homo sapiens
gaggaaauggcuagugaug

SEQ ID NO: 496811 - RNA, 19 nt, Homo sapiens
agaaucggaaugucaguua

SEQ ID NO: 496812 - RNA, 19 nt, Homo sapiens
gacaagauggugcagaaga

SEQ ID NO: 496813 - RNA, 19 nt, Homo sapiens
aaagaagaauugcacuuac

SEQ ID NO: 496814 - RNA, 19 nt, Homo sapiens
gcagaguacagaugaggaa

SEQ ID NO: 496815 - RNA, 19 nt, Homo sapiens
uaaaggccacuguugcaaa

SEQ ID NO: 496816 - RNA, 19 nt, Homo sapiens
guauagcuauuguaaacag

SEQ ID NO: 496817 - RNA, 19 nt, Homo sapiens
gaaacauacacaguagaaa

SEQ ID NO: 496818 - RNA, 19 nt, Homo sapiens
uagggagaccauauaauaa

SEQ ID NO: 496819 - RNA, 19 nt, Homo sapiens
uggaagaauuggcaaaaua

SEQ ID NO: 496820 - RNA, 19 nt, Homo sapiens
gauggaaguucuguugagu

SEQ ID NO: 496821 - RNA, 19 nt, Homo sapiens
aagaagaauugcacuuaca

SEQ ID NO: 496822 - RNA, 19 nt, Homo sapiens
ugagacaaaugcucgagau

SEQ ID NO: 496823 - RNA, 19 nt, Homo sapiens
ggaaugucaguuaaugcua

SEQ ID NO: 496824 - RNA, 19 nt, Homo sapiens
auucggaaaucuauacuga

SEQ ID NO: 496825 - RNA, 19 nt, Homo sapiens
ucaguagggagaccauaua

SEQ ID NO: 496826 - RNA, 19 nt, Homo sapiens
acacagacaugaaguauaa

SEQ ID NO: 496827 - RNA, 19 nt, Homo sapiens
ggaaaccgcuggaaguucu

SEQ ID NO: 496828 - RNA, 19 nt, Homo sapiens
cagaggagauggccaguga

SEQ ID NO: 496829 - RNA, 19 nt, Homo sapiens
gaaacacagacaugaagua

SEQ ID NO: 496830 - RNA, 19 nt, Homo sapiens
gugaugagcugaaggagau

SEQ ID NO: 496831 - RNA, 19 nt, Homo sapiens
ccaagucucucaucaaguc

SEQ ID NO: 496832 - RNA, 19 nt, Homo sapiens
caaccugccugccuggauu

SEQ ID NO: 496833 - RNA, 19 nt, Homo sapiens
guaaggccaugaccaagga

SEQ ID NO: 496834 - RNA, 19 nt, Homo sapiens
ggaagcagagcucggauga

SEQ ID NO: 496835 - RNA, 19 nt, Homo sapiens
ggagggagccauggauuug

SEQ ID NO: 496836 - RNA, 19 nt, Homo sapiens
ggccaagucucucaucaag

SEQ ID NO: 496837 - RNA, 19 nt, Homo sapiens
caacaagugccgcgagaug

SEQ ID NO: 496838 - RNA, 19 nt, Homo sapiens
gaucgaggaaugcaucuuc

SEQ ID NO: 496839 - RNA, 19 nt, Homo sapiens
cggcucagaucgaggaaug

SEQ ID NO: 496840 - RNA, 19 nt, Homo sapiens
ggagauggccagugaugag

SEQ ID NO: 496841 - RNA, 19 nt, Homo sapiens
gaggagauggccagugaug

SEQ ID NO: 496842 - RNA, 19 nt, Homo sapiens
aaacacagacaugaaguau

SEQ ID NO: 496843 - RNA, 19 nt, Homo sapiens
gcacuggccaagucucuca

SEQ ID NO: 496844 - RNA, 19 nt, Homo sapiens
ggaaacacagacaugaagu

SEQ ID NO: 496845 - RNA, 19 nt, Homo sapiens
gaaguauaagaaccgugua

SEQ ID NO: 496846 - RNA, 19 nt, Homo sapiens
ucauugcacuggccaaguc

SEQ ID NO: 496847 - RNA, 19 nt, Homo sapiens
gggcaaggaagaggagauu

SEQ ID NO: 496848 - RNA, 19 nt, Homo sapiens
cugccuggauugcaccuuu

SEQ ID NO: 496849 - RNA, 19 nt, Homo sapiens
gcccaugaccaccuuuguu

SEQ ID NO: 496850 - RNA, 19 nt, Homo sapiens
cuccgaggaucaccacauu

SEQ ID NO: 496851 - RNA, 19 nt, Homo sapiens
gcaccuuucugcccuuucc

SEQ ID NO: 496852 - RNA, 19 nt, Homo sapiens
ccaccuuuguugucugcaa

SEQ ID NO: 496853 - RNA, 19 nt, Homo sapiens
ccagugaugagcugaagga

SEQ ID NO: 496854 - RNA, 19 nt, Homo sapiens
ccugaaggaugccaagaac

SEQ ID NO: 496855 - RNA, 19 nt, Homo sapiens
ccgaggaucaccacauuuc

SEQ ID NO: 496856 - RNA, 19 nt, Homo sapiens
cccggaggcuggacaagau

SEQ ID NO: 496857 - RNA, 19 nt, Homo sapiens
gagucgggaugucugucaa

SEQ ID NO: 496858 - RNA, 19 nt, Homo sapiens
cggagggagccauggauuu

SEQ ID NO: 496859 - RNA, 19 nt, Homo sapiens
ucgcugugaugaccucaga

SEQ ID NO: 496860 - RNA, 19 nt, Homo sapiens
gcggagggagccauggauu

SEQ ID NO: 496861 - RNA, 19 nt, Homo sapiens
guggaaaccgcuggaaguu

SEQ ID NO: 496862 - RNA, 19 nt, Homo sapiens
cccaugaccaccuuuguug

SEQ ID NO: 496863 - RNA, 19 nt, Homo sapiens
guuggaaacacagacauga

SEQ ID NO: 496864 - RNA, 19 nt, Homo sapiens
gugaugccgugcgcaacaa

SEQ ID NO: 496865 - RNA, 19 nt, Homo sapiens
caucaaguccuggaagaag

SEQ ID NO: 496866 - RNA, 19 nt, Homo sapiens
cagacaugaaguauaagaa

SEQ ID NO: 496867 - RNA, 19 nt, Homo sapiens
acagacaugaaguauaaga

SEQ ID NO: 496868 - RNA, 19 nt, Homo sapiens
ggaugcuuccgaugccaaa

SEQ ID NO: 496869 - RNA, 19 nt, Homo sapiens
ggccaugaauuuauuguaa

SEQ ID NO: 496870 - RNA, 19 nt, Homo sapiens
gaaauuuguuugcuacauc

SEQ ID NO: 496871 - RNA, 19 nt, Homo sapiens
gaacaugcauuaacaucag

SEQ ID NO: 496872 - RNA, 19 nt, Homo sapiens
gaagcaaaguagaauuuca

SEQ ID NO: 496873 - RNA, 19 nt, Homo sapiens
gcugcgaacuucuuagauu

SEQ ID NO: 496874 - RNA, 19 nt, Homo sapiens
agagauaccuucacaugug

SEQ ID NO: 496875 - RNA, 19 nt, Homo sapiens
gggaagcaaaguagaauuu

SEQ ID NO: 496876 - RNA, 19 nt, Homo sapiens
gcugauggcugcgaacuuc

SEQ ID NO: 496877 - RNA, 19 nt, Homo sapiens
uaacagcuccaccgagauu

SEQ ID NO: 496878 - RNA, 19 nt, Homo sapiens
aaaccaaugaggucaauuu

SEQ ID NO: 496879 - RNA, 19 nt, Homo sapiens
uaacaucaggcacgauaaa

SEQ ID NO: 496880 - RNA, 19 nt, Homo sapiens
aagagaacaugcauuaaca

SEQ ID NO: 496881 - RNA, 19 nt, Homo sapiens
guacaagguucgcuacacu

SEQ ID NO: 496882 - RNA, 19 nt, Homo sapiens
uauagcauguugccuguau

SEQ ID NO: 496883 - RNA, 19 nt, Homo sapiens
cgaacuucuuagauuguua

SEQ ID NO: 496884 - RNA, 19 nt, Homo sapiens
ugccauguaugucaaauug

SEQ ID NO: 496885 - RNA, 19 nt, Homo sapiens
ucgaaaguaugcauguauu

SEQ ID NO: 496886 - RNA, 19 nt, Homo sapiens
caugugcuaucgaaaguau

SEQ ID NO: 496887 - RNA, 19 nt, Homo sapiens
ccaaugaggucaauuuuag

SEQ ID NO: 496888 - RNA, 19 nt, Homo sapiens
uaaaguucauugcaaagca

SEQ ID NO: 496889 - RNA, 19 nt, Homo sapiens
uuagagagauaccuucaca

SEQ ID NO: 496890 - RNA, 19 nt, Homo sapiens
ugauggccaugaauuuauu

SEQ ID NO: 496891 - RNA, 19 nt, Homo sapiens
gaccugaugccauguaugu

SEQ ID NO: 496892 - RNA, 19 nt, Homo sapiens
cgaaaguaugcauguauuu

SEQ ID NO: 496893 - RNA, 19 nt, Homo sapiens
uaucgaaaguaugcaugua

SEQ ID NO: 496894 - RNA, 19 nt, Homo sapiens
gacgagaaacuacuaaagu

SEQ ID NO: 496895 - RNA, 19 nt, Homo sapiens
gcgaacuucuuagauuguu

SEQ ID NO: 496896 - RNA, 19 nt, Homo sapiens
gagagauaccuucacaugu

SEQ ID NO: 496897 - RNA, 19 nt, Homo sapiens
cugcgggacugacgagaaa

SEQ ID NO: 496898 - RNA, 19 nt, Homo sapiens
cuucacaugugcuaucgaa

SEQ ID NO: 496899 - RNA, 19 nt, Homo sapiens
cgaaaccaaugaggucaau

SEQ ID NO: 496900 - RNA, 19 nt, Homo sapiens
gagaacaugcauuaacauc

SEQ ID NO: 496901 - RNA, 19 nt, Homo sapiens
cugcgaacuucuuagauug

SEQ ID NO: 496902 - RNA, 19 nt, Homo sapiens
gauggcugcgaacuucuua

SEQ ID NO: 496903 - RNA, 19 nt, Homo sapiens
agagagauaccuucacaug

SEQ ID NO: 496904 - RNA, 19 nt, Homo sapiens
gcugagaacgaaaccaaug

SEQ ID NO: 496905 - RNA, 19 nt, Homo sapiens
ucugauggccaugaauuua

SEQ ID NO: 496906 - RNA, 19 nt, Homo sapiens
uaauaccuguaguucaguu

SEQ ID NO: 496907 - RNA, 19 nt, Homo sapiens
aagguucgcuacacuaaca

SEQ ID NO: 496908 - RNA, 19 nt, Homo sapiens
ggaagcaaaguagaauuuc

SEQ ID NO: 496909 - RNA, 19 nt, Homo sapiens
aaagagaacaugcauuaac

SEQ ID NO: 496910 - RNA, 19 nt, Homo sapiens
uuuaauaccuguaguucag

SEQ ID NO: 496911 - RNA, 19 nt, Homo sapiens
cacaugugcuaucgaaagu

SEQ ID NO: 496912 - RNA, 19 nt, Homo sapiens
gaguggcccaggucaguuu

SEQ ID NO: 496913 - RNA, 19 nt, Homo sapiens
acaagguucgcuacacuaa

SEQ ID NO: 496914 - RNA, 19 nt, Homo sapiens
ucacaugugcuaucgaaag

SEQ ID NO: 496915 - RNA, 19 nt, Homo sapiens
ggacugacgagaaacuacu

SEQ ID NO: 496916 - RNA, 19 nt, Homo sapiens
ggucaauuuuagagagaua

SEQ ID NO: 496917 - RNA, 19 nt, Homo sapiens
cuacaucaacaaauuaagg

SEQ ID NO: 496918 - RNA, 19 nt, Homo sapiens
ugacgagaaacuacuaaag

SEQ ID NO: 496919 - RNA, 19 nt, Homo sapiens
gauaaaagccauguugagu

SEQ ID NO: 496920 - RNA, 19 nt, Homo sapiens
auuaacaucaggcacgaua

SEQ ID NO: 496921 - RNA, 19 nt, Homo sapiens
gaugccauguaugucaaau

SEQ ID NO: 496922 - RNA, 19 nt, Homo sapiens
gaggucaauuuuagagaga

SEQ ID NO: 496923 - RNA, 19 nt, Homo sapiens
gaaaccaaugaggucaauu

SEQ ID NO: 496924 - RNA, 19 nt, Homo sapiens
agaacaugcauuaacauca

SEQ ID NO: 496925 - RNA, 19 nt, Homo sapiens
ccugaugccauguauguca

SEQ ID NO: 496926 - RNA, 19 nt, Homo sapiens
guacaaggaugaccaacuc

SEQ ID NO: 496927 - RNA, 19 nt, Homo sapiens
gggaagcagugccaaugaa

SEQ ID NO: 496928 - RNA, 19 nt, Homo sapiens
gcacgguguucgaacugaa

SEQ ID NO: 496929 - RNA, 19 nt, Homo sapiens
gggcagaugacaccuuuga

SEQ ID NO: 496930 - RNA, 19 nt, Homo sapiens
ugaacaagccgugcaguga

SEQ ID NO: 496931 - RNA, 19 nt, Homo sapiens
ccgggcagaugacaccuuu

SEQ ID NO: 496932 - RNA, 19 nt, Homo sapiens
gaagcagugccaaugaaca

SEQ ID NO: 496933 - RNA, 19 nt, Homo sapiens
ggacguguuccucaugauc

SEQ ID NO: 496934 - RNA, 19 nt, Homo sapiens
ggaagcagugccaaugaac

SEQ ID NO: 496935 - RNA, 19 nt, Homo sapiens
aagcagugccaaugaacaa

SEQ ID NO: 496936 - RNA, 19 nt, Homo sapiens
gagcugcccgaugugauga

SEQ ID NO: 496937 - RNA, 19 nt, Homo sapiens
ccagcacgguguucgaacu

SEQ ID NO: 496938 - RNA, 19 nt, Homo sapiens
ccagagcugcccgauguga

SEQ ID NO: 496939 - RNA, 19 nt, Homo sapiens
ggacucaguucagaaauua

SEQ ID NO: 496940 - RNA, 19 nt, Homo sapiens
gcacaaaucuucccacaag

SEQ ID NO: 496941 - RNA, 19 nt, Homo sapiens
gaacaggacuuugagaaga

SEQ ID NO: 496942 - RNA, 19 nt, Homo sapiens
gcacagagacccagagaaa

SEQ ID NO: 496943 - RNA, 19 nt, Homo sapiens
agaaagaggugucacagaa

SEQ ID NO: 496944 - RNA, 19 nt, Homo sapiens
cgagagaccucacaaagug

SEQ ID NO: 496945 - RNA, 19 nt, Homo sapiens
ggagcacacuuuagaauuc

SEQ ID NO: 496946 - RNA, 19 nt, Homo sapiens
ccaagacaauuaaagcuuu

SEQ ID NO: 496947 - RNA, 19 nt, Homo sapiens
agacagauauggaggauga

SEQ ID NO: 496948 - RNA, 19 nt, Homo sapiens
gaagagcaauucccgaaag

SEQ ID NO: 496949 - RNA, 19 nt, Homo sapiens
gcagcagccugaagaagaa

SEQ ID NO: 496950 - RNA, 19 nt, Homo sapiens
gcagcacuguuuccuauga

SEQ ID NO: 496951 - RNA, 19 nt, Homo sapiens
gaagaagaagcuggauuua

SEQ ID NO: 496952 - RNA, 19 nt, Homo sapiens
gaaacccacugugaagaaa

SEQ ID NO: 496953 - RNA, 19 nt, Homo sapiens
gaucaauuauggaaaguuc

SEQ ID NO: 496954 - RNA, 19 nt, Homo sapiens
agaaacagaucaauuaugg

SEQ ID NO: 496955 - RNA, 19 nt, Homo sapiens
ugagaaaggugccugaugu

SEQ ID NO: 496956 - RNA, 19 nt, Homo sapiens
gagcagcugucccugagaa

SEQ ID NO: 496957 - RNA, 19 nt, Homo sapiens
ccacggcacuuggagauaa

SEQ ID NO: 496958 - RNA, 19 nt, Homo sapiens
guaaauagcuugcgaaaac

SEQ ID NO: 496959 - RNA, 19 nt, Homo sapiens
ggacuugccuuggaaaugg

SEQ ID NO: 496960 - RNA, 19 nt, Homo sapiens
cagcagcacuguuuccuau

SEQ ID NO: 496961 - RNA, 19 nt, Homo sapiens
aaaggugccugauguguug

SEQ ID NO: 496962 - RNA, 19 nt, Homo sapiens
gaaaggugccugauguguu

SEQ ID NO: 496963 - RNA, 19 nt, Homo sapiens
agaaagacccgaagaguau

SEQ ID NO: 496964 - RNA, 19 nt, Homo sapiens
agaagaagcuggauuuacu

SEQ ID NO: 496965 - RNA, 19 nt, Homo sapiens
gaaaugcugagccugauga

SEQ ID NO: 496966 - RNA, 19 nt, Homo sapiens
acaaggcccucuccaaaga

SEQ ID NO: 496967 - RNA, 19 nt, Homo sapiens
ggaaacccacugugaagaa

SEQ ID NO: 496968 - RNA, 19 nt, Homo sapiens
gaagaaacauaggaaacuc

SEQ ID NO: 496969 - RNA, 19 nt, Homo sapiens
gaucagcuguaucgcauag

SEQ ID NO: 496970 - RNA, 19 nt, Homo sapiens
gaggagagaugagagaaag

SEQ ID NO: 496971 - RNA, 19 nt, Homo sapiens
gggaugcccugcagaagga

SEQ ID NO: 496972 - RNA, 19 nt, Homo sapiens
gaagaaagacccgaagagu

SEQ ID NO: 496973 - RNA, 19 nt, Homo sapiens
ggaaagggguugugaguca

SEQ ID NO: 496974 - RNA, 19 nt, Homo sapiens
aaagaggugucacagaaug

SEQ ID NO: 496975 - RNA, 19 nt, Homo sapiens
gcauagaggaauacaauca

SEQ ID NO: 496976 - RNA, 19 nt, Homo sapiens
agaagaagaagcuggauuu

SEQ ID NO: 496977 - RNA, 19 nt, Homo sapiens
cagauucucccgacgauaa

SEQ ID NO: 496978 - RNA, 19 nt, Homo sapiens
caaugcauccgaguacuua

SEQ ID NO: 496979 - RNA, 19 nt, Homo sapiens
gaaagaggugucacagaau

SEQ ID NO: 496980 - RNA, 19 nt, Homo sapiens
caaagugucucacggucau

SEQ ID NO: 496981 - RNA, 19 nt, Homo sapiens
acacaaggcccucuccaaa

SEQ ID NO: 496982 - RNA, 19 nt, Homo sapiens
gaccaggagcccauuguuu

SEQ ID NO: 496983 - RNA, 19 nt, Homo sapiens
gcagaagaaacauaggaaa

SEQ ID NO: 496984 - RNA, 19 nt, Homo sapiens
uauggaaaguucauuguca

SEQ ID NO: 496985 - RNA, 19 nt, Homo sapiens
gcagagagaaaucacacaa

SEQ ID NO: 496986 - RNA, 19 nt, Homo sapiens
acaaggagcacaaaucuuc

SEQ ID NO: 496987 - RNA, 19 nt, Homo sapiens
guacgucgaccacuacaga

SEQ ID NO: 496988 - RNA, 19 nt, Homo sapiens
cacagaaugucaccaacuu

SEQ ID NO: 496989 - RNA, 19 nt, Homo sapiens
caagacaauuaaagcuuuc

SEQ ID NO: 496990 - RNA, 19 nt, Homo sapiens
aagaaagacccgaagagua

SEQ ID NO: 496991 - RNA, 19 nt, Homo sapiens
aauccuaccucagcuauga

SEQ ID NO: 496992 - RNA, 19 nt, Homo sapiens
gacccugagucuucugauu

SEQ ID NO: 496993 - RNA, 19 nt, Homo sapiens
cgaguacuaacaaagaaua

SEQ ID NO: 496994 - RNA, 19 nt, Homo sapiens
ggagauaaaggacuuaaaa

SEQ ID NO: 496995 - RNA, 19 nt, Homo sapiens
ggagacagauauggaggau

SEQ ID NO: 496996 - RNA, 19 nt, Homo sapiens
agaaagagaaggacagaga

SEQ ID NO: 496997 - RNA, 19 nt, Homo sapiens
gggaaaggccacagcaaug

SEQ ID NO: 496998 - RNA, 19 nt, Homo sapiens
gaagccggcuggagcugau

SEQ ID NO: 496999 - RNA, 19 nt, Homo sapiens
gagaaaccgcccucuagug

SEQ ID NO: 497000 - RNA, 19 nt, Homo sapiens
ucaccgagacuuuaaggaa

SEQ ID NO: 497001 - RNA, 19 nt, Homo sapiens
gaaauuacccaaggugaac

SEQ ID NO: 497002 - RNA, 19 nt, Homo sapiens
gggagaaaccgcccucuag

SEQ ID NO: 497003 - RNA, 19 nt, Homo sapiens
gagaaagaggugucacaga

SEQ ID NO: 497004 - RNA, 19 nt, Homo sapiens
acgauaaacugaggacuug

SEQ ID NO: 497005 - RNA, 19 nt, Homo sapiens
ccuaagaagcuauugaaau

SEQ ID NO: 497006 - RNA, 19 nt, Homo sapiens
acagaucaauuauggaaag

SEQ ID NO: 497007 - RNA, 19 nt, Homo sapiens
cccauacucuguucuugaa

SEQ ID NO: 497008 - RNA, 19 nt, Homo sapiens
gcaaugcauccgaguacuu

SEQ ID NO: 497009 - RNA, 19 nt, Homo sapiens
ccaagaugcagguguauuc

SEQ ID NO: 497010 - RNA, 19 nt, Homo sapiens
ggagaaaccgcccucuagu

SEQ ID NO: 497011 - RNA, 19 nt, Homo sapiens
ggacaaugcaagggagaaa

SEQ ID NO: 497012 - RNA, 19 nt, Homo sapiens
ggaaaacaguaaauagcuu

SEQ ID NO: 497013 - RNA, 19 nt, Homo sapiens
aaacaaggagcacaaaucu

SEQ ID NO: 497014 - RNA, 19 nt, Homo sapiens
gagcagcggcuacgaguac

SEQ ID NO: 497015 - RNA, 19 nt, Homo sapiens
ggaagaaagacccgaagag

SEQ ID NO: 497016 - RNA, 19 nt, Homo sapiens
gaagggaaagucaaaacua

SEQ ID NO: 497017 - RNA, 19 nt, Homo sapiens
uuagaauucugaagaugug

SEQ ID NO: 497018 - RNA, 19 nt, Homo sapiens
gagcacacuuuagaauucu

SEQ ID NO: 497019 - RNA, 19 nt, Homo sapiens
cuacgaguacuaacaaaga

SEQ ID NO: 497020 - RNA, 19 nt, Homo sapiens
gaagaagcuggauuuacug

SEQ ID NO: 497021 - RNA, 19 nt, Homo sapiens
uggacucaguucagaaauu

SEQ ID NO: 497022 - RNA, 19 nt, Homo sapiens
ggcagcagccugaagaaga

SEQ ID NO: 497023 - RNA, 19 nt, Homo sapiens
agauguacgucgaccacua

SEQ ID NO: 497024 - RNA, 19 nt, Homo sapiens
gaagaugugaagccucugu

SEQ ID NO: 497025 - RNA, 19 nt, Homo sapiens
gacgauaaacugaggacuu

SEQ ID NO: 497026 - RNA, 19 nt, Homo sapiens
cacccugccuauuacagua

SEQ ID NO: 497027 - RNA, 19 nt, Homo sapiens
guuguucauuagcaucuuu

SEQ ID NO: 497028 - RNA, 19 nt, Homo sapiens
gagggcagcagccugaaga

SEQ ID NO: 497029 - RNA, 19 nt, Homo sapiens
ccacagcaaugccuuucag

SEQ ID NO: 497030 - RNA, 19 nt, Homo sapiens
guggucagcagcacuguuu

SEQ ID NO: 497031 - RNA, 19 nt, Homo sapiens
ccaaaggccgacaagcaaa

SEQ ID NO: 497032 - RNA, 19 nt, Homo sapiens
ccgcgauacaggccaauua

SEQ ID NO: 497033 - RNA, 19 nt, Homo sapiens
ggaccaggagcccauuguu

SEQ ID NO: 497034 - RNA, 19 nt, Homo sapiens
uagccaagcugagaaaggu

SEQ ID NO: 497035 - RNA, 19 nt, Homo sapiens
gagagaaagaggugucaca

SEQ ID NO: 497036 - RNA, 19 nt, Homo sapiens
gcacacuuuagaauucuga

SEQ ID NO: 497037 - RNA, 19 nt, Homo sapiens
ccuaggaaacccacuguga

SEQ ID NO: 497038 - RNA, 19 nt, Homo sapiens
gcccaaaggccgacaagca

SEQ ID NO: 497039 - RNA, 19 nt, Homo sapiens
gaaauuagaugacgacaag

SEQ ID NO: 497040 - RNA, 19 nt, Homo sapiens
ggacaugcauggaaucauu

SEQ ID NO: 497041 - RNA, 19 nt, Homo sapiens
acaaagagcugagugauuu

SEQ ID NO: 497042 - RNA, 19 nt, Homo sapiens
caacagacauucacucaug

SEQ ID NO: 497043 - RNA, 19 nt, Homo sapiens
cauaaacacuucuccuuaa

SEQ ID NO: 497044 - RNA, 19 nt, Homo sapiens
gggcaacucuucucauauu

SEQ ID NO: 497045 - RNA, 19 nt, Homo sapiens
caagaaggauaucaaauca

SEQ ID NO: 497046 - RNA, 19 nt, Homo sapiens
gcaagagguuucagcauuc

SEQ ID NO: 497047 - RNA, 19 nt, Homo sapiens
caagagaccacuuccuuaa

SEQ ID NO: 497048 - RNA, 19 nt, Homo sapiens
ccacauugcuucauuaaaa

SEQ ID NO: 497049 - RNA, 19 nt, Homo sapiens
gcacuugcuucgaucuauu

SEQ ID NO: 497050 - RNA, 19 nt, Homo sapiens
gacaaucucucuccaccuu

SEQ ID NO: 497051 - RNA, 19 nt, Homo sapiens
ccucaucgucuccuaauua

SEQ ID NO: 497052 - RNA, 19 nt, Homo sapiens
gagggacgacuuucuuuaa

SEQ ID NO: 497053 - RNA, 19 nt, Homo sapiens
gcacagcuguuuggucuag

SEQ ID NO: 497054 - RNA, 19 nt, Homo sapiens
cuuaacagcuguauuaucu

SEQ ID NO: 497055 - RNA, 19 nt, Homo sapiens
caucgucuccuaauuauga

SEQ ID NO: 497056 - RNA, 19 nt, Homo sapiens
ggacgacuuucuuuaacau

SEQ ID NO: 497057 - RNA, 19 nt, Homo sapiens
gguccaaguugccacauug

SEQ ID NO: 497058 - RNA, 19 nt, Homo sapiens
gaaagcugcgugucugaaa

SEQ ID NO: 497059 - RNA, 19 nt, Homo sapiens
caacgggacagacaguaua

SEQ ID NO: 497060 - RNA, 19 nt, Homo sapiens
cgcaagagguuucagcauu

SEQ ID NO: 497061 - RNA, 19 nt, Homo sapiens
gaugagaaccugcaagaca

SEQ ID NO: 497062 - RNA, 19 nt, Homo sapiens
gccauucucuucugccaaa

SEQ ID NO: 497063 - RNA, 19 nt, Homo sapiens
ggaggccucuucacaguag

SEQ ID NO: 497064 - RNA, 19 nt, Homo sapiens
ggauuucagugcgauguuu

SEQ ID NO: 497065 - RNA, 19 nt, Homo sapiens
gaagaucguuuagaaagac

SEQ ID NO: 497066 - RNA, 19 nt, Homo sapiens
ccauggagguacagacaaa

SEQ ID NO: 497067 - RNA, 19 nt, Homo sapiens
ugagugauuuacuggauuu

SEQ ID NO: 497068 - RNA, 19 nt, Homo sapiens
ugaagaucguuuagaaaga

SEQ ID NO: 497069 - RNA, 19 nt, Homo sapiens
ugggagagaaucaaacuua

SEQ ID NO: 497070 - RNA, 19 nt, Homo sapiens
acauaaacacuucuccuua

SEQ ID NO: 497071 - RNA, 19 nt, Homo sapiens
gcuguuuggucuagaaaug

SEQ ID NO: 497072 - RNA, 19 nt, Homo sapiens
gacaguauaauggcaaaua

SEQ ID NO: 497073 - RNA, 19 nt, Homo sapiens
caacuugagggacgacuuu

SEQ ID NO: 497074 - RNA, 19 nt, Homo sapiens
guuucagcauucccaauua

SEQ ID NO: 497075 - RNA, 19 nt, Homo sapiens
ggagacgcaucgaaucaca

SEQ ID NO: 497076 - RNA, 19 nt, Homo sapiens
cgacaagaaggauaucaaa

SEQ ID NO: 497077 - RNA, 19 nt, Homo sapiens
cauuggaccuucucauaau

SEQ ID NO: 497078 - RNA, 19 nt, Homo sapiens
gacaaagagcugagugauu

SEQ ID NO: 497079 - RNA, 19 nt, Homo sapiens
caaagagcugagugauuua

SEQ ID NO: 497080 - RNA, 19 nt, Homo sapiens
gaaaaguuccuccagguuu

SEQ ID NO: 497081 - RNA, 19 nt, Homo sapiens
acaagagaccacuuccuua

SEQ ID NO: 497082 - RNA, 19 nt, Homo sapiens
gagcagcaaguccgagaaa

SEQ ID NO: 497083 - RNA, 19 nt, Homo sapiens
caucaacgaggcuuucaaa

SEQ ID NO: 497084 - RNA, 19 nt, Homo sapiens
guacagacaaagaaaguuc

SEQ ID NO: 497085 - RNA, 19 nt, Homo sapiens
ggagguacagacaaagaaa

SEQ ID NO: 497086 - RNA, 19 nt, Homo sapiens
gggacgacuuucuuuaaca

SEQ ID NO: 497087 - RNA, 19 nt, Homo sapiens
agagaccacuuccuuaaca

SEQ ID NO: 497088 - RNA, 19 nt, Homo sapiens
gacaucaauuccagucuuc

SEQ ID NO: 497089 - RNA, 19 nt, Homo sapiens
gaaaggggcucauacucau

SEQ ID NO: 497090 - RNA, 19 nt, Homo sapiens
ugagggacgacuuucuuua

SEQ ID NO: 497091 - RNA, 19 nt, Homo sapiens
gcugagugauuuacuggau

SEQ ID NO: 497092 - RNA, 19 nt, Homo sapiens
uggcagcucugagaucaaa

SEQ ID NO: 497093 - RNA, 19 nt, Homo sapiens
ggucugggcucaggguaug

SEQ ID NO: 497094 - RNA, 19 nt, Homo sapiens
ucauuggaccuucucauaa

SEQ ID NO: 497095 - RNA, 19 nt, Homo sapiens
gcauccacaugaacguuug

SEQ ID NO: 497096 - RNA, 19 nt, Homo sapiens
uugggcaacucuucucaua

SEQ ID NO: 497097 - RNA, 19 nt, Homo sapiens
gcacugccgacuacaauag

SEQ ID NO: 497098 - RNA, 19 nt, Homo sapiens
uuccuuaacagcuguauua

SEQ ID NO: 497099 - RNA, 19 nt, Homo sapiens
acaagaaggauaucaaauc

SEQ ID NO: 497100 - RNA, 19 nt, Homo sapiens
gaaccugcaagacacgaaa

SEQ ID NO: 497101 - RNA, 19 nt, Homo sapiens
agacaaagaaaguucgaaa

SEQ ID NO: 497102 - RNA, 19 nt, Homo sapiens
gugcaaagcaguauguaca

SEQ ID NO: 497103 - RNA, 19 nt, Homo sapiens
gcaaagccgaauugaagau

SEQ ID NO: 497104 - RNA, 19 nt, Homo sapiens
ggagagaaucaaacuuaca

SEQ ID NO: 497105 - RNA, 19 nt, Homo sapiens
ggacaaagagcugagugau

SEQ ID NO: 497106 - RNA, 19 nt, Homo sapiens
cagaaugugcaaagcagua

SEQ ID NO: 497107 - RNA, 19 nt, Homo sapiens
gaagggaggaagagaaggu

SEQ ID NO: 497108 - RNA, 19 nt, Homo sapiens
gggagagaaucaaacuuac

SEQ ID NO: 497109 - RNA, 19 nt, Homo sapiens
gaugacgacaagaaggaua

SEQ ID NO: 497110 - RNA, 19 nt, Homo sapiens
ugacgagggugaugagaac

SEQ ID NO: 497111 - RNA, 19 nt, Homo sapiens
uauggaaccggccuucuuu

SEQ ID NO: 497112 - RNA, 19 nt, Homo sapiens
gaauugaagaucguuuaga

SEQ ID NO: 497113 - RNA, 19 nt, Homo sapiens
ccgaauugaagaucguuua

SEQ ID NO: 497114 - RNA, 19 nt, Homo sapiens
aaacccacauaaacacuuc

SEQ ID NO: 497115 - RNA, 19 nt, Homo sapiens
gaaggcagagcgugagaag

SEQ ID NO: 497116 - RNA, 19 nt, Homo sapiens
gacaagaaggauaucaaau

SEQ ID NO: 497117 - RNA, 19 nt, Homo sapiens
aagacuggaugaugcuauu

SEQ ID NO: 497118 - RNA, 19 nt, Homo sapiens
cacaugaacguuugagcua

SEQ ID NO: 497119 - RNA, 19 nt, Homo sapiens
caacucuucucauauucca

SEQ ID NO: 497120 - RNA, 19 nt, Homo sapiens
cgacuuucuuuaacauauc

SEQ ID NO: 497121 - RNA, 19 nt, Homo sapiens
gguuucagcauucccaauu

SEQ ID NO: 497122 - RNA, 19 nt, Homo sapiens
aaagaagggaggaagagaa

SEQ ID NO: 497123 - RNA, 19 nt, Homo sapiens
gaaagacuggaugaugcua

SEQ ID NO: 497124 - RNA, 19 nt, Homo sapiens
acaguauaauggcaaauag

SEQ ID NO: 497125 - RNA, 19 nt, Homo sapiens
caugaacguuugagcuauc

SEQ ID NO: 497126 - RNA, 19 nt, Homo sapiens
caaagaaaguucgaaaagu

SEQ ID NO: 497127 - RNA, 19 nt, Homo sapiens
gagaaaggaaucugaaucc

SEQ ID NO: 497128 - RNA, 19 nt, Homo sapiens
gugaugagaaccugcaaga

SEQ ID NO: 497129 - RNA, 19 nt, Homo sapiens
ccagaucacacuaacaaca

SEQ ID NO: 497130 - RNA, 19 nt, Homo sapiens
guagugccauggagguaca

SEQ ID NO: 497131 - RNA, 19 nt, Homo sapiens
guugccacauugcuucauu

SEQ ID NO: 497132 - RNA, 19 nt, Homo sapiens
cgagaaaggaaucugaauc

SEQ ID NO: 497133 - RNA, 19 nt, Homo sapiens
gcaaguccgagaaaggaau

SEQ ID NO: 497134 - RNA, 19 nt, Homo sapiens
ggacaagaaauuagaugac

SEQ ID NO: 497135 - RNA, 19 nt, Homo sapiens
cuucggaggacaagaaauu

SEQ ID NO: 497136 - RNA, 19 nt, Homo sapiens
guauggaaccggccuucuu

SEQ ID NO: 497137 - RNA, 19 nt, Homo sapiens
cagacaguauaauggcaaa

SEQ ID NO: 497138 - RNA, 19 nt, Homo sapiens
cagcaagcacugccgacua

SEQ ID NO: 497139 - RNA, 19 nt, Homo sapiens
ggaaauggccgaagagaaa

SEQ ID NO: 497140 - RNA, 19 nt, Homo sapiens
caucgaaccucaaagauuu

SEQ ID NO: 497141 - RNA, 19 nt, Homo sapiens
gcugaugacugucguuaua

SEQ ID NO: 497142 - RNA, 19 nt, Homo sapiens
caacaacauuucagacaaa

SEQ ID NO: 497143 - RNA, 19 nt, Homo sapiens
caaagaggauguacauuca

SEQ ID NO: 497144 - RNA, 19 nt, Homo sapiens
gaaacucccuuauaguaca

SEQ ID NO: 497145 - RNA, 19 nt, Homo sapiens
ugaacuccaugcacaaaua

SEQ ID NO: 497146 - RNA, 19 nt, Homo sapiens
ggacaucgaaccucaaaga

SEQ ID NO: 497147 - RNA, 19 nt, Homo sapiens
gcaccgagauggucauuac

SEQ ID NO: 497148 - RNA, 19 nt, Homo sapiens
gaaacucaccaacaacauu

SEQ ID NO: 497149 - RNA, 19 nt, Homo sapiens
cgacuauguuugcugauuu

SEQ ID NO: 497150 - RNA, 19 nt, Homo sapiens
ccaaugacaucuugaaacu

SEQ ID NO: 497151 - RNA, 19 nt, Homo sapiens
ccaaagaggauguacauuc

SEQ ID NO: 497152 - RNA, 19 nt, Homo sapiens
ggacaagcauggccuacca

SEQ ID NO: 497153 - RNA, 19 nt, Homo sapiens
ugaauuaugugcugcuguu

SEQ ID NO: 497154 - RNA, 19 nt, Homo sapiens
ccaacaacauuucagacaa

SEQ ID NO: 497155 - RNA, 19 nt, Homo sapiens
ccaugaggguguuugauga

SEQ ID NO: 497156 - RNA, 19 nt, Homo sapiens
gaggguguuugaugaaaga

SEQ ID NO: 497157 - RNA, 19 nt, Homo sapiens
gaaccucaaagauuuaugu

SEQ ID NO: 497158 - RNA, 19 nt, Homo sapiens
agacaaacauggauuuacu

SEQ ID NO: 497159 - RNA, 19 nt, Homo sapiens
ugaagugcauuaguuguga

SEQ ID NO: 497160 - RNA, 19 nt, Homo sapiens
gcgacuauguuugcugauu

SEQ ID NO: 497161 - RNA, 19 nt, Homo sapiens
cugcauaccagaaugauaa

SEQ ID NO: 497162 - RNA, 19 nt, Homo sapiens
gagaaugggaccucugaug

SEQ ID NO: 497163 - RNA, 19 nt, Homo sapiens
gcaccuggaggcuaaagaa

SEQ ID NO: 497164 - RNA, 19 nt, Homo sapiens
caucugaggccuuugaaga

SEQ ID NO: 497165 - RNA, 19 nt, Homo sapiens
uugaaacucccuuauagua

SEQ ID NO: 497166 - RNA, 19 nt, Homo sapiens
aaacucaccaacaacauuu

SEQ ID NO: 497167 - RNA, 19 nt, Homo sapiens
agucgucacuuuccacaaa

SEQ ID NO: 497168 - RNA, 19 nt, Homo sapiens
ugaugacugucguuauaaa

SEQ ID NO: 497169 - RNA, 19 nt, Homo sapiens
guacauuucggacauacuu

SEQ ID NO: 497170 - RNA, 19 nt, Homo sapiens
cauuauagcugcugaugac

SEQ ID NO: 497171 - RNA, 19 nt, Homo sapiens
gguggaugguggcugguaa

SEQ ID NO: 497172 - RNA, 19 nt, Homo sapiens
ccauggagcccgaagaaga

SEQ ID NO: 497173 - RNA, 19 nt, Homo sapiens
ucuugaaacucccuuauag

SEQ ID NO: 497174 - RNA, 19 nt, Homo sapiens
gugcauuaguugugauuuc

SEQ ID NO: 497175 - RNA, 19 nt, Homo sapiens
gacaaacauggauuuacua

SEQ ID NO: 497176 - RNA, 19 nt, Homo sapiens
gaccauggagcccgaagaa

SEQ ID NO: 497177 - RNA, 19 nt, Homo sapiens
ccuuugaagugcauuaguu

SEQ ID NO: 497178 - RNA, 19 nt, Homo sapiens
agaaugggaccucugauga

SEQ ID NO: 497179 - RNA, 19 nt, Homo sapiens
uauaguacauuucggacau

SEQ ID NO: 497180 - RNA, 19 nt, Homo sapiens
gaagugcauuaguugugau

SEQ ID NO: 497181 - RNA, 19 nt, Homo sapiens
caacauuucagacaaacau

SEQ ID NO: 497182 - RNA, 19 nt, Homo sapiens
gaaaugccaaagaggaugu

SEQ ID NO: 497183 - RNA, 19 nt, Homo sapiens
ggaugagccucuccaugag

SEQ ID NO: 497184 - RNA, 19 nt, Homo sapiens
gaugaguccuccagugaac

SEQ ID NO: 497185 - RNA, 19 nt, Homo sapiens
aaacugaaacucaccaaca

SEQ ID NO: 497186 - RNA, 19 nt, Homo sapiens
gauguucugggcuggauaa

SEQ ID NO: 497187 - RNA, 19 nt, Homo sapiens
ugugauuucugccuccuuu

SEQ ID NO: 497188 - RNA, 19 nt, Homo sapiens
aaauagacaacaacccuuu

SEQ ID NO: 497189 - RNA, 19 nt, Homo sapiens
ccuggaggcuaaagaacuu

SEQ ID NO: 497190 - RNA, 19 nt, Homo sapiens
ucagacaaacauggauuua

SEQ ID NO: 497191 - RNA, 19 nt, Homo sapiens
gaauuaugugcugcuguua

SEQ ID NO: 497192 - RNA, 19 nt, Homo sapiens
uauagcugcugaugacugu

SEQ ID NO: 497193 - RNA, 19 nt, Homo sapiens
auuaugugcugcuguuaaa

SEQ ID NO: 497194 - RNA, 19 nt, Homo sapiens
ccagcgaacugcagagcau

SEQ ID NO: 497195 - RNA, 19 nt, Homo sapiens
gagccaaugacaucuugaa

SEQ ID NO: 497196 - RNA, 19 nt, Homo sapiens
uguaagagccaaugacauc

SEQ ID NO: 497197 - RNA, 19 nt, Homo sapiens
gcgcaucugaggccuuuga

SEQ ID NO: 497198 - RNA, 19 nt, Homo sapiens
gaaugggaccucugaugag

SEQ ID NO: 497199 - RNA, 19 nt, Homo sapiens
gagauguucugggcuggau

SEQ ID NO: 497200 - RNA, 19 nt, Homo sapiens
cauuuaaagugagauguuc

SEQ ID NO: 497201 - RNA, 19 nt, Homo sapiens
augauaagauaacccaguu

SEQ ID NO: 497202 - RNA, 19 nt, Homo sapiens
ucaucgcugugacugcaua

SEQ ID NO: 497203 - RNA, 19 nt, Homo sapiens
gaacuccaugcacaaauac

SEQ ID NO: 497204 - RNA, 19 nt, Homo sapiens
aacugaaacucaccaacaa

SEQ ID NO: 497205 - RNA, 19 nt, Homo sapiens
gacugucguuauaaauuuc

SEQ ID NO: 497206 - RNA, 19 nt, Homo sapiens
gaugacugucguuauaaau

SEQ ID NO: 497207 - RNA, 19 nt, Homo sapiens
acaucgaaccucaaagauu

SEQ ID NO: 497208 - RNA, 19 nt, Homo sapiens
ugacugcauaccagaauga

SEQ ID NO: 497209 - RNA, 19 nt, Homo sapiens
ccauuuaaagugagauguu

SEQ ID NO: 497210 - RNA, 19 nt, Homo sapiens
ggacucgggcucugaacuc

SEQ ID NO: 497211 - RNA, 19 nt, Homo sapiens
ucaccaacaacauuucaga

SEQ ID NO: 497212 - RNA, 19 nt, Homo sapiens
ggccuaccauccguuccua

SEQ ID NO: 497213 - RNA, 19 nt, Homo sapiens
auaguacauuucggacaua

SEQ ID NO: 497214 - RNA, 19 nt, Homo sapiens
uuuccuccauuuaaaguga

SEQ ID NO: 497215 - RNA, 19 nt, Homo sapiens
cacuggaaauggccgaaga

SEQ ID NO: 497216 - RNA, 19 nt, Homo sapiens
caaacucugcgcggagaaa

SEQ ID NO: 497217 - RNA, 19 nt, Homo sapiens
ucgcccgacucacgccaua

SEQ ID NO: 497218 - RNA, 19 nt, Homo sapiens
cugaugaguccuccaguga

SEQ ID NO: 497219 - RNA, 19 nt, Homo sapiens
ugaaacucccuuauaguac

SEQ ID NO: 497220 - RNA, 19 nt, Homo sapiens
gacuauguuugcugauuuu

SEQ ID NO: 497221 - RNA, 19 nt, Homo sapiens
gacauuauagcugcugaug

SEQ ID NO: 497222 - RNA, 19 nt, Homo sapiens
gagcauccagcgguugguu

SEQ ID NO: 497223 - RNA, 19 nt, Homo sapiens
gacucgggcucugaacuca

SEQ ID NO: 497224 - RNA, 19 nt, Homo sapiens
aaugggaccucugaugagu

SEQ ID NO: 497225 - RNA, 19 nt, Homo sapiens
ugaggguguuugaugaaag

SEQ ID NO: 497226 - RNA, 19 nt, Homo sapiens
caugaggguguuugaugaa

SEQ ID NO: 497227 - RNA, 19 nt, Homo sapiens
cauaccagaaugauaagau

SEQ ID NO: 497228 - RNA, 19 nt, Homo sapiens
gugacugcauaccagaaug

SEQ ID NO: 497229 - RNA, 19 nt, Homo sapiens
uaaaagcggccucccauuc

SEQ ID NO: 497230 - RNA, 19 nt, Homo sapiens
ugagagauccggucauucc

SEQ ID NO: 497231 - RNA, 19 nt, Homo sapiens
gacaucgaaccucaaagau

SEQ ID NO: 497232 - RNA, 19 nt, Homo sapiens
gcauccagcgguugguuag

SEQ ID NO: 497233 - RNA, 19 nt, Homo sapiens
aaacucccuuauaguacau

SEQ ID NO: 497234 - RNA, 19 nt, Homo sapiens
caucuugaaacucccuuau

SEQ ID NO: 497235 - RNA, 19 nt, Homo sapiens
gccaaugacaucuugaaac

SEQ ID NO: 497236 - RNA, 19 nt, Homo sapiens
aauuaugugcugcuguuaa

SEQ ID NO: 497237 - RNA, 19 nt, Homo sapiens
uggccaagccgaucaugga

SEQ ID NO: 497238 - RNA, 19 nt, Homo sapiens
ucacuuuccacaaacugaa

SEQ ID NO: 497239 - RNA, 19 nt, Homo sapiens
guaaauagguggaauauga

SEQ ID NO: 497240 - RNA, 19 nt, Homo sapiens
ggaaauggccgaagagaaa

SEQ ID NO: 497241 - RNA, 19 nt, Homo sapiens
caucgaaccucaaagauuu

SEQ ID NO: 497242 - RNA, 19 nt, Homo sapiens
gcugaugacugucguuaua

SEQ ID NO: 497243 - RNA, 19 nt, Homo sapiens
gaauaugaaugcuuggaaa

SEQ ID NO: 497244 - RNA, 19 nt, Homo sapiens
gguaggaguuccaacauuu

SEQ ID NO: 497245 - RNA, 19 nt, Homo sapiens
caacaacauuucagacaaa

SEQ ID NO: 497246 - RNA, 19 nt, Homo sapiens
caaagaggauguacauuca

SEQ ID NO: 497247 - RNA, 19 nt, Homo sapiens
gaaacucccuuauaguaca

SEQ ID NO: 497248 - RNA, 19 nt, Homo sapiens
gaagugagacuauuagaca

SEQ ID NO: 497249 - RNA, 19 nt, Homo sapiens
ugaacuccaugcacaaaua

SEQ ID NO: 497250 - RNA, 19 nt, Homo sapiens
ggacaucgaaccucaaaga

SEQ ID NO: 497251 - RNA, 19 nt, Homo sapiens
aaacauggauuuacuuugg

SEQ ID NO: 497252 - RNA, 19 nt, Homo sapiens
gcaccgagauggucauuac

SEQ ID NO: 497253 - RNA, 19 nt, Homo sapiens
gaauugcuguuaacacuag

SEQ ID NO: 497254 - RNA, 19 nt, Homo sapiens
cgacuauguuugcugauuu

SEQ ID NO: 497255 - RNA, 19 nt, Homo sapiens
gaaacucaccaacaacauu

SEQ ID NO: 497256 - RNA, 19 nt, Homo sapiens
acauagcucuguguaaaua

SEQ ID NO: 497257 - RNA, 19 nt, Homo sapiens
ggaagucccuaccauccuu

SEQ ID NO: 497258 - RNA, 19 nt, Homo sapiens
ggacaagugaacacauuaa

SEQ ID NO: 497259 - RNA, 19 nt, Homo sapiens
uuacugagcagcuuuguuu

SEQ ID NO: 497260 - RNA, 19 nt, Homo sapiens
ccaaugacaucuugaaacu

SEQ ID NO: 497261 - RNA, 19 nt, Homo sapiens
guacucagacuauauugaa

SEQ ID NO: 497262 - RNA, 19 nt, Homo sapiens
ccaaagaggauguacauuc

SEQ ID NO: 497263 - RNA, 19 nt, Homo sapiens
ggacaagcauggccuacca

SEQ ID NO: 497264 - RNA, 19 nt, Homo sapiens
ugaauuaugugcugcuguu

SEQ ID NO: 497265 - RNA, 19 nt, Homo sapiens
ggauucaugucguucuuug

SEQ ID NO: 497266 - RNA, 19 nt, Homo sapiens
ccaacaacauuucagacaa

SEQ ID NO: 497267 - RNA, 19 nt, Homo sapiens
ugacaguucuuucucuuuc

SEQ ID NO: 497268 - RNA, 19 nt, Homo sapiens
ccaugaggguguuugauga

SEQ ID NO: 497269 - RNA, 19 nt, Homo sapiens
gaggguguuugaugaaaga

SEQ ID NO: 497270 - RNA, 19 nt, Homo sapiens
caacaccaauacccuuuca

SEQ ID NO: 497271 - RNA, 19 nt, Homo sapiens
guaggaguuccaacauuua

SEQ ID NO: 497272 - RNA, 19 nt, Homo sapiens
gaaccucaaagauuuaugu

SEQ ID NO: 497273 - RNA, 19 nt, Homo sapiens
cagugcggauuuauauaua

SEQ ID NO: 497274 - RNA, 19 nt, Homo sapiens
gcacuuugucggauauaaa

SEQ ID NO: 497275 - RNA, 19 nt, Homo sapiens
gagacuauuagacaaagua

SEQ ID NO: 497276 - RNA, 19 nt, Homo sapiens
agacaaacauggauuuacu

SEQ ID NO: 497277 - RNA, 19 nt, Homo sapiens
cagaauugcuguuaacacu

SEQ ID NO: 497278 - RNA, 19 nt, Homo sapiens
gaacacauuaacaugauuc

SEQ ID NO: 497279 - RNA, 19 nt, Homo sapiens
ugaagugcauuaguuguga

SEQ ID NO: 497280 - RNA, 19 nt, Homo sapiens
ggguaggaguuccaacauu

SEQ ID NO: 497281 - RNA, 19 nt, Homo sapiens
uauagggacuugcauuauc

SEQ ID NO: 497282 - RNA, 19 nt, Homo sapiens
gugaacacauuaacaugau

SEQ ID NO: 497283 - RNA, 19 nt, Homo sapiens
gcgacuauguuugcugauu

SEQ ID NO: 497284 - RNA, 19 nt, Homo sapiens
cugcauaccagaaugauaa

SEQ ID NO: 497285 - RNA, 19 nt, Homo sapiens
guaaauagaauugcaacug

SEQ ID NO: 497286 - RNA, 19 nt, Homo sapiens
ggaauaugaaugcuuggaa

SEQ ID NO: 497287 - RNA, 19 nt, Homo sapiens
caagugaacacauuaacau

SEQ ID NO: 497288 - RNA, 19 nt, Homo sapiens
gagaaugggaccucugaug

SEQ ID NO: 497289 - RNA, 19 nt, Homo sapiens
gcaccuggaggcuaaagaa

SEQ ID NO: 497290 - RNA, 19 nt, Homo sapiens
caucugaggccuuugaaga

SEQ ID NO: 497291 - RNA, 19 nt, Homo sapiens
uugaaacucccuuauagua

SEQ ID NO: 497292 - RNA, 19 nt, Homo sapiens
aaacucaccaacaacauuu

SEQ ID NO: 497293 - RNA, 19 nt, Homo sapiens
agucgucacuuuccacaaa

SEQ ID NO: 497294 - RNA, 19 nt, Homo sapiens
ugaugacugucguuauaaa

SEQ ID NO: 497295 - RNA, 19 nt, Homo sapiens
gaauugcaacugucagguu

SEQ ID NO: 497296 - RNA, 19 nt, Homo sapiens
guacauuucggacauacuu

SEQ ID NO: 497297 - RNA, 19 nt, Homo sapiens
gcaggggaauuauaguuuu

SEQ ID NO: 497298 - RNA, 19 nt, Homo sapiens
cauuauagcugcugaugac

SEQ ID NO: 497299 - RNA, 19 nt, Homo sapiens
ccggacaagugaacacauu

SEQ ID NO: 497300 - RNA, 19 nt, Homo sapiens
gguggaugguggcugguaa

SEQ ID NO: 497301 - RNA, 19 nt, Homo sapiens
ccauggagcccgaagaaga

SEQ ID NO: 497302 - RNA, 19 nt, Homo sapiens
ccacuucaaauuccuuaaa

SEQ ID NO: 497303 - RNA, 19 nt, Homo sapiens
gugcauuaguugugauuuc

SEQ ID NO: 497304 - RNA, 19 nt, Homo sapiens
aaacgucgguugcauugag

SEQ ID NO: 497305 - RNA, 19 nt, Homo sapiens
ucuugaaacucccuuauag

SEQ ID NO: 497306 - RNA, 19 nt, Homo sapiens
ccuuugaagugcauuaguu

SEQ ID NO: 497307 - RNA, 19 nt, Homo sapiens
gaccauggagcccgaagaa

SEQ ID NO: 497308 - RNA, 19 nt, Homo sapiens
uagcaggauucaugucguu

SEQ ID NO: 497309 - RNA, 19 nt, Homo sapiens
ucccuaccauccuuguuua

SEQ ID NO: 497310 - RNA, 19 nt, Homo sapiens
gaagugcauuaguugugau

SEQ ID NO: 497311 - RNA, 19 nt, Homo sapiens
agaaugggaccucugauga

SEQ ID NO: 497312 - RNA, 19 nt, Homo sapiens
uauaguacauuucggacau

SEQ ID NO: 497313 - RNA, 19 nt, Homo sapiens
caacauuucagacaaacau

SEQ ID NO: 497314 - RNA, 19 nt, Homo sapiens
gaaaugccaaagaggaugu

SEQ ID NO: 497315 - RNA, 19 nt, Homo sapiens
ggaugagccucuccaugag

SEQ ID NO: 497316 - RNA, 19 nt, Homo sapiens
ugugauuucugccuccuuu

SEQ ID NO: 497317 - RNA, 19 nt, Homo sapiens
ucagugcggauuuauauau

SEQ ID NO: 497318 - RNA, 19 nt, Homo sapiens
gaugaguccuccagugaac

SEQ ID NO: 497319 - RNA, 19 nt, Homo sapiens
aaacugaaacucaccaaca

SEQ ID NO: 497320 - RNA, 19 nt, Homo sapiens
gauguucugggcuggauaa

SEQ ID NO: 497321 - RNA, 19 nt, Homo sapiens
aauugcaacugucagguuu

SEQ ID NO: 497322 - RNA, 19 nt, Homo sapiens
uguccacaguaauguauuu

SEQ ID NO: 497323 - RNA, 19 nt, Homo sapiens
ccucagugcggauuuauau

SEQ ID NO: 497324 - RNA, 19 nt, Homo sapiens
aaauagacaacaacccuuu

SEQ ID NO: 497325 - RNA, 19 nt, Homo sapiens
ccuggaggcuaaagaacuu

SEQ ID NO: 497326 - RNA, 19 nt, Homo sapiens
ucagacaaacauggauuua

SEQ ID NO: 497327 - RNA, 19 nt, Homo sapiens
gaauuaugugcugcuguua

SEQ ID NO: 497328 - RNA, 19 nt, Homo sapiens
acaccaauacccuuucaaa

SEQ ID NO: 497329 - RNA, 19 nt, Homo sapiens
gcauguccacaguaaugua

SEQ ID NO: 497330 - RNA, 19 nt, Homo sapiens
uaaauuacugagcagcuuu

SEQ ID NO: 497331 - RNA, 19 nt, Homo sapiens
gcauuaucgguucucaaua

SEQ ID NO: 497332 - RNA, 19 nt, Homo sapiens
gugucaaaguggaaacaaa

SEQ ID NO: 497333 - RNA, 19 nt, Homo sapiens
auuaugugcugcuguuaaa

SEQ ID NO: 497334 - RNA, 19 nt, Homo sapiens
uauagcugcugaugacugu

SEQ ID NO: 497335 - RNA, 19 nt, Homo sapiens
gggcaaaacacauaaaaug

SEQ ID NO: 497336 - RNA, 19 nt, Homo sapiens
ccagcgaacugcagagcau

SEQ ID NO: 497337 - RNA, 19 nt, Homo sapiens
gagccaaugacaucuugaa

SEQ ID NO: 497338 - RNA, 19 nt, Homo sapiens
uguaagagccaaugacauc

SEQ ID NO: 497339 - RNA, 19 nt, Homo sapiens
gauacagucuucuuacuug

SEQ ID NO: 497340 - RNA, 19 nt, Homo sapiens
gaaccuggccuucagugua

SEQ ID NO: 497341 - RNA, 19 nt, Homo sapiens
gcgaguggcacguuuauuu

SEQ ID NO: 497342 - RNA, 19 nt, Homo sapiens
ggacaaaggagccugugaa

SEQ ID NO: 497343 - RNA, 19 nt, Homo sapiens
ucaaagagcuggagaaccu

SEQ ID NO: 497344 - RNA, 19 nt, Homo sapiens
ugacagcacugcacagcuu

SEQ ID NO: 497345 - RNA, 19 nt, Homo sapiens
gcccacaggugaugagcua

SEQ ID NO: 497346 - RNA, 19 nt, Homo sapiens
cgaagauggucaaguccua

SEQ ID NO: 497347 - RNA, 19 nt, Homo sapiens
gugaugagcuaccaaccaa

SEQ ID NO: 497348 - RNA, 19 nt, Homo sapiens
cgaguggcacguuuauuua

SEQ ID NO: 497349 - RNA, 19 nt, Homo sapiens
ggaggaaccguuucaagug

SEQ ID NO: 497350 - RNA, 19 nt, Homo sapiens
gccgagccaugguuucuaa

SEQ ID NO: 497351 - RNA, 19 nt, Homo sapiens
gagcaaagaggcacugauc

SEQ ID NO: 497352 - RNA, 19 nt, Homo sapiens
caagggcacucccaugaag

SEQ ID NO: 497353 - RNA, 19 nt, Homo sapiens
uuaguaaagucaaggagaa

SEQ ID NO: 497354 - RNA, 19 nt, Homo sapiens
uggcugagcugcccaaugg

SEQ ID NO: 497355 - RNA, 19 nt, Homo sapiens
ggcacaagcuggccaugga

SEQ ID NO: 497356 - RNA, 19 nt, Homo sapiens
ccagggaggccgaagcuaa

SEQ ID NO: 497357 - RNA, 19 nt, Homo sapiens
ggauacagucuucuuacuu

SEQ ID NO: 497358 - RNA, 19 nt, Homo sapiens
gaguggcacguuuauuuaa

SEQ ID NO: 497359 - RNA, 19 nt, Homo sapiens
guggagagcuaggagcaaa

SEQ ID NO: 497360 - RNA, 19 nt, Homo sapiens
ccacccagauggccucuuc

SEQ ID NO: 497361 - RNA, 19 nt, Homo sapiens
gcaaagaggcacugaucca

SEQ ID NO: 497362 - RNA, 19 nt, Homo sapiens
cagcuuuccuguauuucuu

SEQ ID NO: 497363 - RNA, 19 nt, Homo sapiens
guucauggcagauguagga

SEQ ID NO: 497364 - RNA, 19 nt, Homo sapiens
gaugagcuaccaaccaaga

SEQ ID NO: 497365 - RNA, 19 nt, Homo sapiens
agggagggcugauugaaga

SEQ ID NO: 497366 - RNA, 19 nt, Homo sapiens
gguccuacguucaccaaca

SEQ ID NO: 497367 - RNA, 19 nt, Homo sapiens
gaagagcccacaggugaug

SEQ ID NO: 497368 - RNA, 19 nt, Homo sapiens
gcagaaguacccucaagca

SEQ ID NO: 497369 - RNA, 19 nt, Homo sapiens
gcaauagggcggaaugcau

SEQ ID NO: 497370 - RNA, 19 nt, Homo sapiens
guaaagucaaggagaaaug

SEQ ID NO: 497371 - RNA, 19 nt, Homo sapiens
ccacaugccauuuguacug

SEQ ID NO: 497372 - RNA, 19 nt, Homo sapiens
ggaggugcgugucuacaac

SEQ ID NO: 497373 - RNA, 19 nt, Homo sapiens
uggcgaagauggucaaguc

SEQ ID NO: 497374 - RNA, 19 nt, Homo sapiens
cuccagcuuuccuguauuu

SEQ ID NO: 497375 - RNA, 19 nt, Homo sapiens
gagcucagacuccagcaau

SEQ ID NO: 497376 - RNA, 19 nt, Homo sapiens
gaggugcccaggagaagaa

SEQ ID NO: 497377 - RNA, 19 nt, Homo sapiens
ccuaugagaggcagaagaa

SEQ ID NO: 497378 - RNA, 19 nt, Homo sapiens
cccaugaccuccagcuuuc

SEQ ID NO: 497379 - RNA, 19 nt, Homo sapiens
gaucagcguggccuuguuc

SEQ ID NO: 497380 - RNA, 19 nt, Homo sapiens
gggauacagucuucuuacu

SEQ ID NO: 497381 - RNA, 19 nt, Homo sapiens
ggacgagacggacgacgau

SEQ ID NO: 497382 - RNA, 19 nt, Homo sapiens
ugacccacaugccauuugu

SEQ ID NO: 497383 - RNA, 19 nt, Homo sapiens
gcagggagggcugauugaa

SEQ ID NO: 497384 - RNA, 19 nt, Homo sapiens
guacugaccccaucaccua

SEQ ID NO: 497385 - RNA, 19 nt, Homo sapiens
cacaugccauuuguacuga

SEQ ID NO: 497386 - RNA, 19 nt, Homo sapiens
gcugggaagucguccuuac

SEQ ID NO: 497387 - RNA, 19 nt, Homo sapiens
gugggauacagucuucuua

SEQ ID NO: 497388 - RNA, 19 nt, Homo sapiens
agaagaacccuagcaagga

SEQ ID NO: 497389 - RNA, 19 nt, Homo sapiens
acagucuucuuacuuggaa

SEQ ID NO: 497390 - RNA, 19 nt, Homo sapiens
gagagguggcgcagcaguu

SEQ ID NO: 497391 - RNA, 19 nt, Homo sapiens
ccacacuucucaggacaca

SEQ ID NO: 497392 - RNA, 19 nt, Homo sapiens
cuucuuacuuggaacugaa

SEQ ID NO: 497393 - RNA, 19 nt, Homo sapiens
aacaagggcacucccauga

SEQ ID NO: 497394 - RNA, 19 nt, Homo sapiens
cgccacccauccucaaaga

SEQ ID NO: 497395 - RNA, 19 nt, Homo sapiens
gcugagaaccuggccuuca

SEQ ID NO: 497396 - RNA, 19 nt, Homo sapiens
ggagcaaagccuguucaug

SEQ ID NO: 497397 - RNA, 19 nt, Homo sapiens
cggaggaaccguuucaagu

SEQ ID NO: 497398 - RNA, 19 nt, Homo sapiens
gcugaggugcccaggagaa

SEQ ID NO: 497399 - RNA, 19 nt, Homo sapiens
cuuguucugucaccaaugu

SEQ ID NO: 497400 - RNA, 19 nt, Homo sapiens
ggcagaagaacccuagcaa

SEQ ID NO: 497401 - RNA, 19 nt, Homo sapiens
cagcguggccuuguucugu

SEQ ID NO: 497402 - RNA, 19 nt, Homo sapiens
cgauaccacuggccucaac

SEQ ID NO: 497403 - RNA, 19 nt, Homo sapiens
ccacgcaggcacagagugu

SEQ ID NO: 497404 - RNA, 19 nt, Homo sapiens
gaccuccagcuuuccugua

SEQ ID NO: 497405 - RNA, 19 nt, Homo sapiens
gggcggaggaaccguuuca

SEQ ID NO: 497406 - RNA, 19 nt, Homo sapiens
gggcgaguggcacguuuau

SEQ ID NO: 497407 - RNA, 19 nt, Homo sapiens
cugcagaaguacccucaag

SEQ ID NO: 497408 - RNA, 19 nt, Homo sapiens
aaccuggccuucaguguac

SEQ ID NO: 497409 - RNA, 19 nt, Homo sapiens
gacaaaggagccugugaac

SEQ ID NO: 497410 - RNA, 19 nt, Homo sapiens
acaagggcacucccaugaa

SEQ ID NO: 497411 - RNA, 19 nt, Homo sapiens
gcuaggagcaaagccuguu

SEQ ID NO: 497412 - RNA, 19 nt, Homo sapiens
ggccucuuccucccaguaa

SEQ ID NO: 497413 - RNA, 19 nt, Homo sapiens
gacagccugcgaccaguga

SEQ ID NO: 497414 - RNA, 19 nt, Homo sapiens
ccacucugcucugaugcau

SEQ ID NO: 497415 - RNA, 19 nt, Homo sapiens
gcucagacuccagcaaugg

SEQ ID NO: 497416 - RNA, 19 nt, Homo sapiens
caacaugucuucaaguaaa

SEQ ID NO: 497417 - RNA, 19 nt, Homo sapiens
gaaguaaauuuguccaaug

SEQ ID NO: 497418 - RNA, 19 nt, Homo sapiens
ucagaaagccuuccauuaa

SEQ ID NO: 497419 - RNA, 19 nt, Homo sapiens
cagaaagccuuccauuaaa

SEQ ID NO: 497420 - RNA, 19 nt, Homo sapiens
cgaacaaacugaugcgaaa

SEQ ID NO: 497421 - RNA, 19 nt, Homo sapiens
caaacacacuguaaauauc

SEQ ID NO: 497422 - RNA, 19 nt, Homo sapiens
caauggcuguaaacuauaa

SEQ ID NO: 497423 - RNA, 19 nt, Homo sapiens
ucacgucgcuccagcaaga

SEQ ID NO: 497424 - RNA, 19 nt, Homo sapiens
ccaaacacacuguaaauau

SEQ ID NO: 497425 - RNA, 19 nt, Homo sapiens
caagaaagccguacugucu

SEQ ID NO: 497426 - RNA, 19 nt, Homo sapiens
gaacugagccaaacacacu

SEQ ID NO: 497427 - RNA, 19 nt, Homo sapiens
gcaaugguggucacagaua

SEQ ID NO: 497428 - RNA, 19 nt, Homo sapiens
ccaaggaggugcugguuca

SEQ ID NO: 497429 - RNA, 19 nt, Homo sapiens
uccaauggcuguaaacuau

SEQ ID NO: 497430 - RNA, 19 nt, Homo sapiens
gaaacaaugagaucacuuc

SEQ ID NO: 497431 - RNA, 19 nt, Homo sapiens
gaggaggcauuccggcaaa

SEQ ID NO: 497432 - RNA, 19 nt, Homo sapiens
gcuguaaacuauaaacuac

SEQ ID NO: 497433 - RNA, 19 nt, Homo sapiens
cgcgaggccuggacacuua

SEQ ID NO: 497434 - RNA, 19 nt, Homo sapiens
gauaccagcagcaucagua

SEQ ID NO: 497435 - RNA, 19 nt, Homo sapiens
gaaguuuucugacuccuuu

SEQ ID NO: 497436 - RNA, 19 nt, Homo sapiens
uaaacaguguccucuacaa

SEQ ID NO: 497437 - RNA, 19 nt, Homo sapiens
cugcagaacucacacaugu

SEQ ID NO: 497438 - RNA, 19 nt, Homo sapiens
ugcgagaggucccugcuua

SEQ ID NO: 497439 - RNA, 19 nt, Homo sapiens
ugacucagcugcagaacuc

SEQ ID NO: 497440 - RNA, 19 nt, Homo sapiens
gagagauccuccgacaauu

SEQ ID NO: 497441 - RNA, 19 nt, Homo sapiens
gccaaacacacuguaaaua

SEQ ID NO: 497442 - RNA, 19 nt, Homo sapiens
ccucucaccugaugguaaa

SEQ ID NO: 497443 - RNA, 19 nt, Homo sapiens
gcaggaaggaggaggcauu

SEQ ID NO: 497444 - RNA, 19 nt, Homo sapiens
ucacugagguccgugucua

SEQ ID NO: 497445 - RNA, 19 nt, Homo sapiens
gccgugcacucccuaagaa

SEQ ID NO: 497446 - RNA, 19 nt, Homo sapiens
ccucugcccuguauauaau

SEQ ID NO: 497447 - RNA, 19 nt, Homo sapiens
gagccaaacacacuguaaa

SEQ ID NO: 497448 - RNA, 19 nt, Homo sapiens
agaaagccguacugucuau

SEQ ID NO: 497449 - RNA, 19 nt, Homo sapiens
cuaaaaugaucaaggguua

SEQ ID NO: 497450 - RNA, 19 nt, Homo sapiens
accaacaugucuucaagua

SEQ ID NO: 497451 - RNA, 19 nt, Homo sapiens
agagggagguggucgaugu

SEQ ID NO: 497452 - RNA, 19 nt, Homo sapiens
gaucauggcaaguuagaag

SEQ ID NO: 497453 - RNA, 19 nt, Homo sapiens
ucaguacacucaccaacau

SEQ ID NO: 497454 - RNA, 19 nt, Homo sapiens
gcagaacucacacauguac

SEQ ID NO: 497455 - RNA, 19 nt, Homo sapiens
ggaagagagagaggccuua

SEQ ID NO: 497456 - RNA, 19 nt, Homo sapiens
cauggcaaguuagaaguuu

SEQ ID NO: 497457 - RNA, 19 nt, Homo sapiens
aauguagugugucagagua

SEQ ID NO: 497458 - RNA, 19 nt, Homo sapiens
gaggagagaaggacaugug

SEQ ID NO: 497459 - RNA, 19 nt, Homo sapiens
ucaccaacaugucuucaag

SEQ ID NO: 497460 - RNA, 19 nt, Homo sapiens
cacagccucucccaccaua

SEQ ID NO: 497461 - RNA, 19 nt, Homo sapiens
uuacugaaaugaggagaga

SEQ ID NO: 497462 - RNA, 19 nt, Homo sapiens
gagauccuccgacaauuca

SEQ ID NO: 497463 - RNA, 19 nt, Homo sapiens
cauccuaagugggaaguga

SEQ ID NO: 497464 - RNA, 19 nt, Homo sapiens
guugugauccuucaucgaa

SEQ ID NO: 497465 - RNA, 19 nt, Homo sapiens
uaacuccagucuccugaca

SEQ ID NO: 497466 - RNA, 19 nt, Homo sapiens
aaacuugaaucuguuacug

SEQ ID NO: 497467 - RNA, 19 nt, Homo sapiens
ggaggugggagacaaggaa

SEQ ID NO: 497468 - RNA, 19 nt, Homo sapiens
gagaucacuuccuccucaa

SEQ ID NO: 497469 - RNA, 19 nt, Homo sapiens
ggcaaaagcuggccaugga

SEQ ID NO: 497470 - RNA, 19 nt, Homo sapiens
ccaagccggucuuccauac

SEQ ID NO: 497471 - RNA, 19 nt, Homo sapiens
gaauguagugugucagagu

SEQ ID NO: 497472 - RNA, 19 nt, Homo sapiens
ucccuucuaugcaguauug

SEQ ID NO: 497473 - RNA, 19 nt, Homo sapiens
gaugcccacacaccacuua

SEQ ID NO: 497474 - RNA, 19 nt, Homo sapiens
gcagggaaacaaugagauc

SEQ ID NO: 497475 - RNA, 19 nt, Homo sapiens
cuggaaauaugacagacaa

SEQ ID NO: 497476 - RNA, 19 nt, Homo sapiens
gcuguuugauagcagaaga

SEQ ID NO: 497477 - RNA, 19 nt, Homo sapiens
cuacuguaauuaagugcaa

SEQ ID NO: 497478 - RNA, 19 nt, Homo sapiens
ccaauggcuguaaacuaua

SEQ ID NO: 497479 - RNA, 19 nt, Homo sapiens
cucagaaagccuuccauua

SEQ ID NO: 497480 - RNA, 19 nt, Homo sapiens
ggcuguaaacuauaaacua

SEQ ID NO: 497481 - RNA, 19 nt, Homo sapiens
gaagaggaagcaagaaagc

SEQ ID NO: 497482 - RNA, 19 nt, Homo sapiens
gggcagcugucauggaaaa

SEQ ID NO: 497483 - RNA, 19 nt, Homo sapiens
ccaacaugucuucaaguaa

SEQ ID NO: 497484 - RNA, 19 nt, Homo sapiens
acagauaccagcagcauca

SEQ ID NO: 497485 - RNA, 19 nt, Homo sapiens
agaaagccuuccauuaaaa

SEQ ID NO: 497486 - RNA, 19 nt, Homo sapiens
ccgaagaggaagcaagaaa

SEQ ID NO: 497487 - RNA, 19 nt, Homo sapiens
cugggcagcugucauggaa

SEQ ID NO: 497488 - RNA, 19 nt, Homo sapiens
gagugucccugucaucaac

SEQ ID NO: 497489 - RNA, 19 nt, Homo sapiens
ucagcaccuugacgaauau

SEQ ID NO: 497490 - RNA, 19 nt, Homo sapiens
aaucuccucucaccugaug

SEQ ID NO: 497491 - RNA, 19 nt, Homo sapiens
gaagagagagaggccuuag

SEQ ID NO: 497492 - RNA, 19 nt, Homo sapiens
caaugguggucacagauac

SEQ ID NO: 497493 - RNA, 19 nt, Homo sapiens
ggaaauaugacagacaaaa

SEQ ID NO: 497494 - RNA, 19 nt, Homo sapiens
cagaguaacaugccagcuu

SEQ ID NO: 497495 - RNA, 19 nt, Homo sapiens
acuccagucuccugacauu

SEQ ID NO: 497496 - RNA, 19 nt, Homo sapiens
cgaggacggcgacgacuau

SEQ ID NO: 497497 - RNA, 19 nt, Homo sapiens
ugaaucuguuacugaaaug

SEQ ID NO: 497498 - RNA, 19 nt, Homo sapiens
ggaaacaaugagaucacuu

SEQ ID NO: 497499 - RNA, 19 nt, Homo sapiens
gcuccucuccuccaaacaa

SEQ ID NO: 497500 - RNA, 19 nt, Homo sapiens
agagagagaggccuuagug

SEQ ID NO: 497501 - RNA, 19 nt, Homo sapiens
guccaauggcuguaaacua

SEQ ID NO: 497502 - RNA, 19 nt, Homo sapiens
acuugaaucuguuacugaa

SEQ ID NO: 497503 - RNA, 19 nt, Homo sapiens
gcgaaaacuugaaucuguu

SEQ ID NO: 497504 - RNA, 19 nt, Homo sapiens
gaucacuuccuccucaaca

SEQ ID NO: 497505 - RNA, 19 nt, Homo sapiens
gggaaacaaugagaucacu

SEQ ID NO: 497506 - RNA, 19 nt, Homo sapiens
uggacugacuaccagcuaa

SEQ ID NO: 497507 - RNA, 19 nt, Homo sapiens
aaguaaauuuguccaaugg

SEQ ID NO: 497508 - RNA, 19 nt, Homo sapiens
cugcaaugguggucacaga

SEQ ID NO: 497509 - RNA, 19 nt, Homo sapiens
gucuacaacugguuugcaa

SEQ ID NO: 497510 - RNA, 19 nt, Homo sapiens
aaaguugcagucucagaaa

SEQ ID NO: 497511 - RNA, 19 nt, Homo sapiens
uccagucuccugacauuaa

SEQ ID NO: 497512 - RNA, 19 nt, Homo sapiens
gcuggcaccucagacaauc

SEQ ID NO: 497513 - RNA, 19 nt, Homo sapiens
guaaacaguguccucuaca

SEQ ID NO: 497514 - RNA, 19 nt, Homo sapiens
ggacggcgacgacuaugac

SEQ ID NO: 497515 - RNA, 19 nt, Homo sapiens
gcagcccgaagcccaguuu

SEQ ID NO: 497516 - RNA, 19 nt, Homo sapiens
caaacaagcugucagguaa

SEQ ID NO: 497517 - RNA, 19 nt, Homo sapiens
gaacugaggcccagaaaga

SEQ ID NO: 497518 - RNA, 19 nt, Homo sapiens
gaaaggagugaauguauaa

SEQ ID NO: 497519 - RNA, 19 nt, Homo sapiens
guaauaagauccuauacug

SEQ ID NO: 497520 - RNA, 19 nt, Homo sapiens
ccacggaucuuaucugguu

SEQ ID NO: 497521 - RNA, 19 nt, Homo sapiens
ugaaaggagugaauguaua

SEQ ID NO: 497522 - RNA, 19 nt, Homo sapiens
ucacauaacuucucugagu

SEQ ID NO: 497523 - RNA, 19 nt, Homo sapiens
ggaggaauuugaagaagga

SEQ ID NO: 497524 - RNA, 19 nt, Homo sapiens
gaaaagggcuugugaaagg

SEQ ID NO: 497525 - RNA, 19 nt, Homo sapiens
ggauuacaguugugagauu

SEQ ID NO: 497526 - RNA, 19 nt, Homo sapiens
gcacuacgauguguugaau

SEQ ID NO: 497527 - RNA, 19 nt, Homo sapiens
ggcaaagacuggccugauu

SEQ ID NO: 497528 - RNA, 19 nt, Homo sapiens
gggauaugcuagugaugua

SEQ ID NO: 497529 - RNA, 19 nt, Homo sapiens
ucacgucgcuccagcaaga

SEQ ID NO: 497530 - RNA, 19 nt, Homo sapiens
uaaccaagccagaaacgua

SEQ ID NO: 497531 - RNA, 19 nt, Homo sapiens
gcucaagucugaucuuucu

SEQ ID NO: 497532 - RNA, 19 nt, Homo sapiens
gcaggcagcagaaaucauu

SEQ ID NO: 497533 - RNA, 19 nt, Homo sapiens
ugaauuuccugccuacaaa

SEQ ID NO: 497534 - RNA, 19 nt, Homo sapiens
ccaaggaggugcugguuca

SEQ ID NO: 497535 - RNA, 19 nt, Homo sapiens
gagaagcccuaggcaaaga

SEQ ID NO: 497536 - RNA, 19 nt, Homo sapiens
gagaagcucaguagccuuu

SEQ ID NO: 497537 - RNA, 19 nt, Homo sapiens
gcaaagacuggccugauug

SEQ ID NO: 497538 - RNA, 19 nt, Homo sapiens
ccaaacaagcugucaggua

SEQ ID NO: 497539 - RNA, 19 nt, Homo sapiens
gaggaggcauuccggcaaa

SEQ ID NO: 497540 - RNA, 19 nt, Homo sapiens
cagagaagcccuaggcaaa

SEQ ID NO: 497541 - RNA, 19 nt, Homo sapiens
gcccuggccuggauuagaa

SEQ ID NO: 497542 - RNA, 19 nt, Homo sapiens
gaugaaaggagugaaugua

SEQ ID NO: 497543 - RNA, 19 nt, Homo sapiens
uaacuucucugagucugaa

SEQ ID NO: 497544 - RNA, 19 nt, Homo sapiens
ccagaaagaggcagugauu

SEQ ID NO: 497545 - RNA, 19 nt, Homo sapiens
ucagucacuugaaaucuuu

SEQ ID NO: 497546 - RNA, 19 nt, Homo sapiens
gaaguuuucugacuccuuu

SEQ ID NO: 497547 - RNA, 19 nt, Homo sapiens
caagucugaucuuucuaaa

SEQ ID NO: 497548 - RNA, 19 nt, Homo sapiens
ccgaguaccugcuccauca

SEQ ID NO: 497549 - RNA, 19 nt, Homo sapiens
gagagauccuccgacaauu

SEQ ID NO: 497550 - RNA, 19 nt, Homo sapiens
uuauguaucuggguucuaa

SEQ ID NO: 497551 - RNA, 19 nt, Homo sapiens
gauuacaguugugagauug

SEQ ID NO: 497552 - RNA, 19 nt, Homo sapiens
agaaagaggcagugauuug

SEQ ID NO: 497553 - RNA, 19 nt, Homo sapiens
guaacugugugcagaauac

SEQ ID NO: 497554 - RNA, 19 nt, Homo sapiens
gaccaaagccaccaagaca

SEQ ID NO: 497555 - RNA, 19 nt, Homo sapiens
guguggcucugaucaguuu

SEQ ID NO: 497556 - RNA, 19 nt, Homo sapiens
gcaggaaggaggaggcauu

SEQ ID NO: 497557 - RNA, 19 nt, Homo sapiens
ucacugagguccgugucua

SEQ ID NO: 497558 - RNA, 19 nt, Homo sapiens
gggacuggcuucucuuucu

SEQ ID NO: 497559 - RNA, 19 nt, Homo sapiens
acagagcaaugguacgaaa

SEQ ID NO: 497560 - RNA, 19 nt, Homo sapiens
ccauagcacugccucuuuc

SEQ ID NO: 497561 - RNA, 19 nt, Homo sapiens
cuaaaaugaucaaggguua

SEQ ID NO: 497562 - RNA, 19 nt, Homo sapiens
gguguaauaagauccuaua

SEQ ID NO: 497563 - RNA, 19 nt, Homo sapiens
guugaaugcuuaccaaguc

SEQ ID NO: 497564 - RNA, 19 nt, Homo sapiens
gaaaggaaagccaaacacu

SEQ ID NO: 497565 - RNA, 19 nt, Homo sapiens
gguuauaacuguggcuaau

SEQ ID NO: 497566 - RNA, 19 nt, Homo sapiens
ggaaggauaucgggucacu

SEQ ID NO: 497567 - RNA, 19 nt, Homo sapiens
gcugugggcuuuggguuug

SEQ ID NO: 497568 - RNA, 19 nt, Homo sapiens
agagggagguggucgaugu

SEQ ID NO: 497569 - RNA, 19 nt, Homo sapiens
gagugaauguauaaagaca

SEQ ID NO: 497570 - RNA, 19 nt, Homo sapiens
gaucauggcaaguuagaag

SEQ ID NO: 497571 - RNA, 19 nt, Homo sapiens
agaaccagcugcagaugga

SEQ ID NO: 497572 - RNA, 19 nt, Homo sapiens
ucaagucugaucuuucuaa

SEQ ID NO: 497573 - RNA, 19 nt, Homo sapiens
gugcucaagucugaucuuu

SEQ ID NO: 497574 - RNA, 19 nt, Homo sapiens
ggaagagagagaggccuua

SEQ ID NO: 497575 - RNA, 19 nt, Homo sapiens
uaagaggcagugagaugua

SEQ ID NO: 497576 - RNA, 19 nt, Homo sapiens
cauggcaaguuagaaguuu

SEQ ID NO: 497577 - RNA, 19 nt, Homo sapiens
uuauaacuguggcuaauuc

SEQ ID NO: 497578 - RNA, 19 nt, Homo sapiens
ggagcccuuuacccuauuu

SEQ ID NO: 497579 - RNA, 19 nt, Homo sapiens
ucacuaaccaagccagaaa

SEQ ID NO: 497580 - RNA, 19 nt, Homo sapiens
uuucugcgguguaauaaga

SEQ ID NO: 497581 - RNA, 19 nt, Homo sapiens
ggaucuuucugcgguguaa

SEQ ID NO: 497582 - RNA, 19 nt, Homo sapiens
aggagugaauguauaaaga

SEQ ID NO: 497583 - RNA, 19 nt, Homo sapiens
gcaggguucugaggcaaau

SEQ ID NO: 497584 - RNA, 19 nt, Homo sapiens
gucagucacuugaaaucuu

SEQ ID NO: 497585 - RNA, 19 nt, Homo sapiens
gagauccuccgacaauuca

SEQ ID NO: 497586 - RNA, 19 nt, Homo sapiens
ccuacaaaauggagaaaua

SEQ ID NO: 497587 - RNA, 19 nt, Homo sapiens
uugcgguccuccugucuua

SEQ ID NO: 497588 - RNA, 19 nt, Homo sapiens
gaaagaggcagugauuugc

SEQ ID NO: 497589 - RNA, 19 nt, Homo sapiens
uggcaacccucacuguguu

SEQ ID NO: 497590 - RNA, 19 nt, Homo sapiens
gcugugcugugccuagaug

SEQ ID NO: 497591 - RNA, 19 nt, Homo sapiens
gcagauggagguuuuguuu

SEQ ID NO: 497592 - RNA, 19 nt, Homo sapiens
ccaagccggucuuccauac

SEQ ID NO: 497593 - RNA, 19 nt, Homo sapiens
gguucccacuccauacuuu

SEQ ID NO: 497594 - RNA, 19 nt, Homo sapiens
gcugugcccucccauagca

SEQ ID NO: 497595 - RNA, 19 nt, Homo sapiens
ggcaaaagcuggccaugga

SEQ ID NO: 497596 - RNA, 19 nt, Homo sapiens
ggacuggcuucucuuucuc

SEQ ID NO: 497597 - RNA, 19 nt, Homo sapiens
ugucuuagccucccuuugu

SEQ ID NO: 497598 - RNA, 19 nt, Homo sapiens
ggauggagcacuucuucug

SEQ ID NO: 497599 - RNA, 19 nt, Homo sapiens
gaagcucaguagccuuugg

SEQ ID NO: 497600 - RNA, 19 nt, Homo sapiens
acgauguguugaaugcuua

SEQ ID NO: 497601 - RNA, 19 nt, Homo sapiens
ucagcugggugguguacaa

SEQ ID NO: 497602 - RNA, 19 nt, Homo sapiens
cuggaaauaugacagacaa

SEQ ID NO: 497603 - RNA, 19 nt, Homo sapiens
gcacgaugcuggggucaaa

SEQ ID NO: 497604 - RNA, 19 nt, Homo sapiens
caggagacccagagagcua

SEQ ID NO: 497605 - RNA, 19 nt, Homo sapiens
gcagcaaugaguugggaaa

SEQ ID NO: 497606 - RNA, 19 nt, Homo sapiens
gccaagguagggucacuaa

SEQ ID NO: 497607 - RNA, 19 nt, Homo sapiens
gaauguauaaagacaccuu

SEQ ID NO: 497608 - RNA, 19 nt, Homo sapiens
gggcauuacugggaagaca

SEQ ID NO: 497609 - RNA, 19 nt, Homo sapiens
guucuugccacggaucuua

SEQ ID NO: 497610 - RNA, 19 nt, Homo sapiens
gccagaaacguaacugugu

SEQ ID NO: 497611 - RNA, 19 nt, Homo sapiens
aaggaaagccaaacacugu

SEQ ID NO: 497612 - RNA, 19 nt, Homo sapiens
gaagagagagaggccuuag

SEQ ID NO: 497613 - RNA, 19 nt, Homo sapiens
uaugggacacugauauuau

SEQ ID NO: 497614 - RNA, 19 nt, Homo sapiens
guuaugggacacugauauu

SEQ ID NO: 497615 - RNA, 19 nt, Homo sapiens
gcagccuucugacaagcaa

SEQ ID NO: 497616 - RNA, 19 nt, Homo sapiens
gcaaagcacuggccucgau

SEQ ID NO: 497617 - RNA, 19 nt, Homo sapiens
ucagagaccuguccuguau

SEQ ID NO: 497618 - RNA, 19 nt, Homo sapiens
gaacuugccucucccucuu

SEQ ID NO: 497619 - RNA, 19 nt, Homo sapiens
gcacagcucucugaaaugg

SEQ ID NO: 497620 - RNA, 19 nt, Homo sapiens
guggaaaccuggcuuauuc

SEQ ID NO: 497621 - RNA, 19 nt, Homo sapiens
ggaagccacugcacacaga

SEQ ID NO: 497622 - RNA, 19 nt, Homo sapiens
ccggaucacucaagcaaua

SEQ ID NO: 497623 - RNA, 19 nt, Homo sapiens
gaaccugaaucccaaagca

SEQ ID NO: 497624 - RNA, 19 nt, Homo sapiens
aaacauacacuuugucaga

SEQ ID NO: 497625 - RNA, 19 nt, Homo sapiens
gcaccagccucaugcacaa

SEQ ID NO: 497626 - RNA, 19 nt, Homo sapiens
gggcacaugugaaagguau

SEQ ID NO: 497627 - RNA, 19 nt, Homo sapiens
ggaagcagcagcacguuug

SEQ ID NO: 497628 - RNA, 19 nt, Homo sapiens
gcaauaaacgugacauuuu

SEQ ID NO: 497629 - RNA, 19 nt, Homo sapiens
ggaguuugaucucuuaagg

SEQ ID NO: 497630 - RNA, 19 nt, Homo sapiens
gggacugucuuggguuuaa

SEQ ID NO: 497631 - RNA, 19 nt, Homo sapiens
ucagugaccuccuggacuu

SEQ ID NO: 497632 - RNA, 19 nt, Homo sapiens
agaccuguccuguauauaa

SEQ ID NO: 497633 - RNA, 19 nt, Homo sapiens
cugcacagcucucugaaau

SEQ ID NO: 497634 - RNA, 19 nt, Homo sapiens
gaagggacgucagcaaggu

SEQ ID NO: 497635 - RNA, 19 nt, Homo sapiens
gcacuggccucgaucuacu

SEQ ID NO: 497636 - RNA, 19 nt, Homo sapiens
gcauugcauuucuugauca

SEQ ID NO: 497637 - RNA, 19 nt, Homo sapiens
gugccuaagcgaaauauuu

SEQ ID NO: 497638 - RNA, 19 nt, Homo sapiens
aaaccuggcuuauucuucu

SEQ ID NO: 497639 - RNA, 19 nt, Homo sapiens
gcacagcagccucucuuca

SEQ ID NO: 497640 - RNA, 19 nt, Homo sapiens
agagaccuguccuguauau

SEQ ID NO: 497641 - RNA, 19 nt, Homo sapiens
ggacugucuuggguuuaaa

SEQ ID NO: 497642 - RNA, 19 nt, Homo sapiens
uaaagccaccagcaaauug

SEQ ID NO: 497643 - RNA, 19 nt, Homo sapiens
ccaagaagguccggaaggu

SEQ ID NO: 497644 - RNA, 19 nt, Homo sapiens
ggaggaagaaacagcaguu

SEQ ID NO: 497645 - RNA, 19 nt, Homo sapiens
guucggagguucaggucuu

SEQ ID NO: 497646 - RNA, 19 nt, Homo sapiens
gagcauugcauuucuugau

SEQ ID NO: 497647 - RNA, 19 nt, Homo sapiens
gcccaucugugucccaugu

SEQ ID NO: 497648 - RNA, 19 nt, Homo sapiens
aagcugcucucccuuggaa

SEQ ID NO: 497649 - RNA, 19 nt, Homo sapiens
gcuggaugauugggacuuu

SEQ ID NO: 497650 - RNA, 19 nt, Homo sapiens
agagggccaucgugacgua

SEQ ID NO: 497651 - RNA, 19 nt, Homo sapiens
gaaaccuggcuuauucuuc

SEQ ID NO: 497652 - RNA, 19 nt, Homo sapiens
ccugaaagcaagcaacaaa

SEQ ID NO: 497653 - RNA, 19 nt, Homo sapiens
guuccuagacugagcauug

SEQ ID NO: 497654 - RNA, 19 nt, Homo sapiens
gaaacggcgagaagaggaa

SEQ ID NO: 497655 - RNA, 19 nt, Homo sapiens
gcgcuggccucagguuuca

SEQ ID NO: 497656 - RNA, 19 nt, Homo sapiens
cugggaguuugaucucuua

SEQ ID NO: 497657 - RNA, 19 nt, Homo sapiens
ggaaaccuggcuuauucuu

SEQ ID NO: 497658 - RNA, 19 nt, Homo sapiens
gcagacggcagccuagaca

SEQ ID NO: 497659 - RNA, 19 nt, Homo sapiens
gaccuguccuguauauaac

SEQ ID NO: 497660 - RNA, 19 nt, Homo sapiens
ucaaccagaugauuaaacg

SEQ ID NO: 497661 - RNA, 19 nt, Homo sapiens
cuaaagccaccagcaaauu

SEQ ID NO: 497662 - RNA, 19 nt, Homo sapiens
cauacacuuugucagagaa

SEQ ID NO: 497663 - RNA, 19 nt, Homo sapiens
gcaacaaaacauacacuuu

SEQ ID NO: 497664 - RNA, 19 nt, Homo sapiens
aaacaaaaccugaaagcaa

SEQ ID NO: 497665 - RNA, 19 nt, Homo sapiens
ccagaugauuaaacguugu

SEQ ID NO: 497666 - RNA, 19 nt, Homo sapiens
agacugagcauugcauuuc

SEQ ID NO: 497667 - RNA, 19 nt, Homo sapiens
cuccuggacuucagcauga

SEQ ID NO: 497668 - RNA, 19 nt, Homo sapiens
cagacaaggagcucaguga

SEQ ID NO: 497669 - RNA, 19 nt, Homo sapiens
gcuguggaaaccuggcuua

SEQ ID NO: 497670 - RNA, 19 nt, Homo sapiens
agaaggaggacgaggagaa

SEQ ID NO: 497671 - RNA, 19 nt, Homo sapiens
ccucaaggccagcucaaug

SEQ ID NO: 497672 - RNA, 19 nt, Homo sapiens
acauacacuuugucagaga

SEQ ID NO: 497673 - RNA, 19 nt, Homo sapiens
ggacgaggacgaccuucuc

SEQ ID NO: 497674 - RNA, 19 nt, Homo sapiens
uccacggccugcagaguaa

SEQ ID NO: 497675 - RNA, 19 nt, Homo sapiens
uccugagacuccaccguua

SEQ ID NO: 497676 - RNA, 19 nt, Homo sapiens
cgugggcguucccugauga

SEQ ID NO: 497677 - RNA, 19 nt, Homo sapiens
aaauugugccuaagcgaaa

SEQ ID NO: 497678 - RNA, 19 nt, Homo sapiens
ggacuucagcaugauguuc

SEQ ID NO: 497679 - RNA, 19 nt, Homo sapiens
cagaugauuaaacguugua

SEQ ID NO: 497680 - RNA, 19 nt, Homo sapiens
acacgcagcccaagaaggu

SEQ ID NO: 497681 - RNA, 19 nt, Homo sapiens
ucccgugucucucgcuauu

SEQ ID NO: 497682 - RNA, 19 nt, Homo sapiens
gacaagguucggagugaug

SEQ ID NO: 497683 - RNA, 19 nt, Homo sapiens
ggugucaggugugguugga

SEQ ID NO: 497684 - RNA, 19 nt, Homo sapiens
gcgcgaggaggaagaaaca

SEQ ID NO: 497685 - RNA, 19 nt, Homo sapiens
ccgugucucucgcuauuuc

SEQ ID NO: 497686 - RNA, 19 nt, Homo sapiens
cugacaagguucggaguga

SEQ ID NO: 497687 - RNA, 19 nt, Homo sapiens
ucuuucagguggauucaga

SEQ ID NO: 497688 - RNA, 19 nt, Homo sapiens
ggaugauugggacuuuaaa

SEQ ID NO: 497689 - RNA, 19 nt, Homo sapiens
cugcauagaauucaaacga

SEQ ID NO: 497690 - RNA, 19 nt, Homo sapiens
ccugggaguuugaucucuu

SEQ ID NO: 497691 - RNA, 19 nt, Homo sapiens
ccauccaguuccacacgaa

SEQ ID NO: 497692 - RNA, 19 nt, Homo sapiens
uuugucauguggaaaguga

SEQ ID NO: 497693 - RNA, 19 nt, Homo sapiens
accagcaaauugugccuaa

SEQ ID NO: 497694 - RNA, 19 nt, Homo sapiens
acagcagccucucuucauc

SEQ ID NO: 497695 - RNA, 19 nt, Homo sapiens
ugacaagguucggagugau

SEQ ID NO: 497696 - RNA, 19 nt, Homo sapiens
aaaggugucaggugugguu

SEQ ID NO: 497697 - RNA, 19 nt, Homo sapiens
ucacucaagcaauaacuuc

SEQ ID NO: 497698 - RNA, 19 nt, Homo sapiens
gcauauguuuuguaagcaa

SEQ ID NO: 497699 - RNA, 19 nt, Homo sapiens
ugccuuuggucucugguuu

SEQ ID NO: 497700 - RNA, 19 nt, Homo sapiens
gaugcugccuuuggucucu

SEQ ID NO: 497701 - RNA, 19 nt, Homo sapiens
uagacacgcagcccaagaa

SEQ ID NO: 497702 - RNA, 19 nt, Homo sapiens
ucccauggauccugaaacu

SEQ ID NO: 497703 - RNA, 19 nt, Homo sapiens
gauugggacuuuaaaacga

SEQ ID NO: 497704 - RNA, 19 nt, Homo sapiens
uggaugauugggacuuuaa

SEQ ID NO: 497705 - RNA, 19 nt, Homo sapiens
cuggaugauugggacuuua

SEQ ID NO: 497706 - RNA, 19 nt, Homo sapiens
ugaaccagccgcagaggau

SEQ ID NO: 497707 - RNA, 19 nt, Homo sapiens
gaaagcaagcaacaaaaca

SEQ ID NO: 497708 - RNA, 19 nt, Homo sapiens
acacaccuguugucagcau

SEQ ID NO: 497709 - RNA, 19 nt, Homo sapiens
cggaggaggagaagaagga

SEQ ID NO: 497710 - RNA, 19 nt, Homo sapiens
gaaggaggacgaggagaac

SEQ ID NO: 497711 - RNA, 19 nt, Homo sapiens
cugggacugucuuggguuu

SEQ ID NO: 497712 - RNA, 19 nt, Homo sapiens
gacugagcauugcauuucu

SEQ ID NO: 497713 - RNA, 19 nt, Homo sapiens
agcaauaaacgugacauuu

SEQ ID NO: 497714 - RNA, 19 nt, Homo sapiens
uagcaauaaacgugacauu

SEQ ID NO: 497715 - RNA, 19 nt, Homo sapiens
aaccagaugauuaaacguu

SEQ ID NO: 497716 - RNA, 19 nt, Homo sapiens
gagaagcucuguuuauaaa

SEQ ID NO: 497717 - RNA, 19 nt, Homo sapiens
gaaaugcauucgguacuua

SEQ ID NO: 497718 - RNA, 19 nt, Homo sapiens
gcacaaagcucaagaugac

SEQ ID NO: 497719 - RNA, 19 nt, Homo sapiens
gagaagagcaggccaagua

SEQ ID NO: 497720 - RNA, 19 nt, Homo sapiens
gaaaugccgugcucgcuuu

SEQ ID NO: 497721 - RNA, 19 nt, Homo sapiens
gaucacauauucuagugua

SEQ ID NO: 497722 - RNA, 19 nt, Homo sapiens
ccacagaacugcuuacuag

SEQ ID NO: 497723 - RNA, 19 nt, Homo sapiens
ucaaucugcucaugcauua

SEQ ID NO: 497724 - RNA, 19 nt, Homo sapiens
gcagauaacucucuucacu

SEQ ID NO: 497725 - RNA, 19 nt, Homo sapiens
agaaugagcugguuuguca

SEQ ID NO: 497726 - RNA, 19 nt, Homo sapiens
ugacagcucuucuaaggaa

SEQ ID NO: 497727 - RNA, 19 nt, Homo sapiens
gaugacagcucuucuaagg

SEQ ID NO: 497728 - RNA, 19 nt, Homo sapiens
ggacagaggaccauuacaa

SEQ ID NO: 497729 - RNA, 19 nt, Homo sapiens
ggaaucagaucugucuuga

SEQ ID NO: 497730 - RNA, 19 nt, Homo sapiens
ccaaagaucacauauucua

SEQ ID NO: 497731 - RNA, 19 nt, Homo sapiens
gaaacccuguaucuacuaa

SEQ ID NO: 497732 - RNA, 19 nt, Homo sapiens
ggagaagcucuguuuauaa

SEQ ID NO: 497733 - RNA, 19 nt, Homo sapiens
uggagaagcucuguuuaua

SEQ ID NO: 497734 - RNA, 19 nt, Homo sapiens
gcacacagguacagcaaca

SEQ ID NO: 497735 - RNA, 19 nt, Homo sapiens
gaugcuagguucuggugua

SEQ ID NO: 497736 - RNA, 19 nt, Homo sapiens
ggagagcgcugccaucaac

SEQ ID NO: 497737 - RNA, 19 nt, Homo sapiens
gagccgagauggcgcuauu

SEQ ID NO: 497738 - RNA, 19 nt, Homo sapiens
uggaauagguuaaguuuag

SEQ ID NO: 497739 - RNA, 19 nt, Homo sapiens
gagccugucuuucagcauu

SEQ ID NO: 497740 - RNA, 19 nt, Homo sapiens
guuaaugcaucaucauaga

SEQ ID NO: 497741 - RNA, 19 nt, Homo sapiens
gacccuggcucgccuaaga

SEQ ID NO: 497742 - RNA, 19 nt, Homo sapiens
gccuuuaguuccuacuuua

SEQ ID NO: 497743 - RNA, 19 nt, Homo sapiens
ccaacucucucucuacgaa

SEQ ID NO: 497744 - RNA, 19 nt, Homo sapiens
gagaaacccaccagccuaa

SEQ ID NO: 497745 - RNA, 19 nt, Homo sapiens
gcagucaacaguucaaaga

SEQ ID NO: 497746 - RNA, 19 nt, Homo sapiens
gagccuagcuaccuucucu

SEQ ID NO: 497747 - RNA, 19 nt, Homo sapiens
agauaacucucuucacuau

SEQ ID NO: 497748 - RNA, 19 nt, Homo sapiens
guccagacccugaagauuu

SEQ ID NO: 497749 - RNA, 19 nt, Homo sapiens
cagaggaccauuacaacua

SEQ ID NO: 497750 - RNA, 19 nt, Homo sapiens
gaggguguaucuagcucua

SEQ ID NO: 497751 - RNA, 19 nt, Homo sapiens
ccaagaagccaaccaucaa

SEQ ID NO: 497752 - RNA, 19 nt, Homo sapiens
acaauuccauuuccaguuc

SEQ ID NO: 497753 - RNA, 19 nt, Homo sapiens
gaauggaauagguuaaguu

SEQ ID NO: 497754 - RNA, 19 nt, Homo sapiens
ggaauggaauagguuaagu

SEQ ID NO: 497755 - RNA, 19 nt, Homo sapiens
auaacucucuucacuauuc

SEQ ID NO: 497756 - RNA, 19 nt, Homo sapiens
aaccuaagcaacagaaaua

SEQ ID NO: 497757 - RNA, 19 nt, Homo sapiens
gaacugagccuagcuaccu

SEQ ID NO: 497758 - RNA, 19 nt, Homo sapiens
gauucaaacugcuccaagu

SEQ ID NO: 497759 - RNA, 19 nt, Homo sapiens
ucaaugccuucaugcugua

SEQ ID NO: 497760 - RNA, 19 nt, Homo sapiens
auccaaagaucacauauuc

SEQ ID NO: 497761 - RNA, 19 nt, Homo sapiens
aaagggcuguccauguauu

SEQ ID NO: 497762 - RNA, 19 nt, Homo sapiens
ggugaaacccuguaucuac

SEQ ID NO: 497763 - RNA, 19 nt, Homo sapiens
cagaaaaccuccaguagug

SEQ ID NO: 497764 - RNA, 19 nt, Homo sapiens
gaaacccaccagccuaaga

SEQ ID NO: 497765 - RNA, 19 nt, Homo sapiens
ggaaucccuuguaccuaug

SEQ ID NO: 497766 - RNA, 19 nt, Homo sapiens
ucagaucugucuugaugug

SEQ ID NO: 497767 - RNA, 19 nt, Homo sapiens
ugacgucaguaguuugaga

SEQ ID NO: 497768 - RNA, 19 nt, Homo sapiens
cagcugcagucaacaguuc

SEQ ID NO: 497769 - RNA, 19 nt, Homo sapiens
aaauggagaagcucuguuu

SEQ ID NO: 497770 - RNA, 19 nt, Homo sapiens
agacccagaucucauggaa

SEQ ID NO: 497771 - RNA, 19 nt, Homo sapiens
ggacucacccucauaccau

SEQ ID NO: 497772 - RNA, 19 nt, Homo sapiens
ccagcggcauguacaaaga

SEQ ID NO: 497773 - RNA, 19 nt, Homo sapiens
uagccuacguuaacccauu

SEQ ID NO: 497774 - RNA, 19 nt, Homo sapiens
cuccgucgaucuauucuuu

SEQ ID NO: 497775 - RNA, 19 nt, Homo sapiens
gaucugucuugauguguca

SEQ ID NO: 497776 - RNA, 19 nt, Homo sapiens
agaaaugcauucgguacuu

SEQ ID NO: 497777 - RNA, 19 nt, Homo sapiens
uaccuuaucaggcaaauug

SEQ ID NO: 497778 - RNA, 19 nt, Homo sapiens
cagagaaggaggccaagaa

SEQ ID NO: 497779 - RNA, 19 nt, Homo sapiens
gggaaucagaucugucuug

SEQ ID NO: 497780 - RNA, 19 nt, Homo sapiens
cuaaggaaauggagaagcu

SEQ ID NO: 497781 - RNA, 19 nt, Homo sapiens
gugaaacccuguaucuacu

SEQ ID NO: 497782 - RNA, 19 nt, Homo sapiens
ccaagaaugagcugguuug

SEQ ID NO: 497783 - RNA, 19 nt, Homo sapiens
gaucuauucuuuguaccau

SEQ ID NO: 497784 - RNA, 19 nt, Homo sapiens
agagacagguggccuagca

SEQ ID NO: 497785 - RNA, 19 nt, Homo sapiens
cagauaacucucuucacua

SEQ ID NO: 497786 - RNA, 19 nt, Homo sapiens
gccaagaagccaaccauca

SEQ ID NO: 497787 - RNA, 19 nt, Homo sapiens
caccauagccuacguuaac

SEQ ID NO: 497788 - RNA, 19 nt, Homo sapiens
caaccuaagcaacagaaau

SEQ ID NO: 497789 - RNA, 19 nt, Homo sapiens
ccaggugacugacuaaucc

SEQ ID NO: 497790 - RNA, 19 nt, Homo sapiens
gaaauggagaagcucuguu

SEQ ID NO: 497791 - RNA, 19 nt, Homo sapiens
ugaccucucuggcuucuac

SEQ ID NO: 497792 - RNA, 19 nt, Homo sapiens
ggacaucagccagaagcaa

SEQ ID NO: 497793 - RNA, 19 nt, Homo sapiens
aagaggcggucgagggaaa

SEQ ID NO: 497794 - RNA, 19 nt, Homo sapiens
gcgcugccaucaaccagau

SEQ ID NO: 497795 - RNA, 19 nt, Homo sapiens
gcggaagaaucacuugaac

SEQ ID NO: 497796 - RNA, 19 nt, Homo sapiens
uugccuaaauccaaagaaa

SEQ ID NO: 497797 - RNA, 19 nt, Homo sapiens
gucaacaguucaaagaagu

SEQ ID NO: 497798 - RNA, 19 nt, Homo sapiens
cuaagcaacagaaauaauc

SEQ ID NO: 497799 - RNA, 19 nt, Homo sapiens
ggaauagguuaaguuuagg

SEQ ID NO: 497800 - RNA, 19 nt, Homo sapiens
cagcugcuacucauaaguu

SEQ ID NO: 497801 - RNA, 19 nt, Homo sapiens
agaggaccauuacaacuag

SEQ ID NO: 497802 - RNA, 19 nt, Homo sapiens
gcgggacagaggaccauua

SEQ ID NO: 497803 - RNA, 19 nt, Homo sapiens
ucaaccagcagacggauug

SEQ ID NO: 497804 - RNA, 19 nt, Homo sapiens
gcgcauguaaucccagcua

SEQ ID NO: 497805 - RNA, 19 nt, Homo sapiens
cucaggagcuugcaagaag

SEQ ID NO: 497806 - RNA, 19 nt, Homo sapiens
ggaaauggagaagcucugu

SEQ ID NO: 497807 - RNA, 19 nt, Homo sapiens
ggugugguccgugcagaua

SEQ ID NO: 497808 - RNA, 19 nt, Homo sapiens
caacagguuuucaccauag

SEQ ID NO: 497809 - RNA, 19 nt, Homo sapiens
gagcacacagguacagcaa

SEQ ID NO: 497810 - RNA, 19 nt, Homo sapiens
ggacaacuacgggaagaag

SEQ ID NO: 497811 - RNA, 19 nt, Homo sapiens
aagagcaggccaaguacua

SEQ ID NO: 497812 - RNA, 19 nt, Homo sapiens
gaagccaaccaucaagaag

SEQ ID NO: 497813 - RNA, 19 nt, Homo sapiens
cacauauucuaguguaaca

SEQ ID NO: 497814 - RNA, 19 nt, Homo sapiens
aagaucacauauucuagug

SEQ ID NO: 497815 - RNA, 19 nt, Homo sapiens
agaaauaaucugacacuac

SEQ ID NO: 497816 - RNA, 19 nt, Homo sapiens
ggauuuagcugaugucaaa

SEQ ID NO: 497817 - RNA, 19 nt, Homo sapiens
gauggaagcuuacuagauu

SEQ ID NO: 497818 - RNA, 19 nt, Homo sapiens
gagaagagcaagcgaaaua

SEQ ID NO: 497819 - RNA, 19 nt, Homo sapiens
gagaagaaccucaugauug

SEQ ID NO: 497820 - RNA, 19 nt, Homo sapiens
gaaagaagaagaagaggaa

SEQ ID NO: 497821 - RNA, 19 nt, Homo sapiens
aaacccaccuccacacuua

SEQ ID NO: 497822 - RNA, 19 nt, Homo sapiens
gaacugauuuccuucaaag

SEQ ID NO: 497823 - RNA, 19 nt, Homo sapiens
gaugucggcucacuccaua

SEQ ID NO: 497824 - RNA, 19 nt, Homo sapiens
guacagcaaugaacacuuc

SEQ ID NO: 497825 - RNA, 19 nt, Homo sapiens
ccucagcgcuccuaagaaa

SEQ ID NO: 497826 - RNA, 19 nt, Homo sapiens
caaaucgucucuagucaau

SEQ ID NO: 497827 - RNA, 19 nt, Homo sapiens
gcacagccgucgacuucuu

SEQ ID NO: 497828 - RNA, 19 nt, Homo sapiens
caccaagucuuuagaauag

SEQ ID NO: 497829 - RNA, 19 nt, Homo sapiens
cagcgaauguuuccuaaau

SEQ ID NO: 497830 - RNA, 19 nt, Homo sapiens
aaagugcguucgcuacaua

SEQ ID NO: 497831 - RNA, 19 nt, Homo sapiens
caaaacagcuccuccgauu

SEQ ID NO: 497832 - RNA, 19 nt, Homo sapiens
agaaaccucuuaaugcauu

SEQ ID NO: 497833 - RNA, 19 nt, Homo sapiens
cggcacacauugucucuaa

SEQ ID NO: 497834 - RNA, 19 nt, Homo sapiens
agaagaaccucaugauugg

SEQ ID NO: 497835 - RNA, 19 nt, Homo sapiens
ggauaacuauggaaagaag

SEQ ID NO: 497836 - RNA, 19 nt, Homo sapiens
ucaccaagucuuuagaaua

SEQ ID NO: 497837 - RNA, 19 nt, Homo sapiens
cgagacaaaucccgggaaa

SEQ ID NO: 497838 - RNA, 19 nt, Homo sapiens
aaucgucucuagucaauga

SEQ ID NO: 497839 - RNA, 19 nt, Homo sapiens
gagugcacguugaaagaaa

SEQ ID NO: 497840 - RNA, 19 nt, Homo sapiens
gaugucaaaucgucucuag

SEQ ID NO: 497841 - RNA, 19 nt, Homo sapiens
ugaaggaaaugagagcaaa

SEQ ID NO: 497842 - RNA, 19 nt, Homo sapiens
gccgucgacuucuugguua

SEQ ID NO: 497843 - RNA, 19 nt, Homo sapiens
acaaaucccgggaaaguuu

SEQ ID NO: 497844 - RNA, 19 nt, Homo sapiens
cgaacugauuuccuucaaa

SEQ ID NO: 497845 - RNA, 19 nt, Homo sapiens
ggcaugcacuguccagaga

SEQ ID NO: 497846 - RNA, 19 nt, Homo sapiens
caaccaguguacccaauca

SEQ ID NO: 497847 - RNA, 19 nt, Homo sapiens
ugaaauggccacugcuuga

SEQ ID NO: 497848 - RNA, 19 nt, Homo sapiens
ccuaaauccuugccuuuca

SEQ ID NO: 497849 - RNA, 19 nt, Homo sapiens
gacccauucuuauuucaau

SEQ ID NO: 497850 - RNA, 19 nt, Homo sapiens
gaccucagcgcuccuaaga

SEQ ID NO: 497851 - RNA, 19 nt, Homo sapiens
cgggauaacuauggaaaga

SEQ ID NO: 497852 - RNA, 19 nt, Homo sapiens
gagagaagaaccucaugau

SEQ ID NO: 497853 - RNA, 19 nt, Homo sapiens
acacuuaccagccgacgua

SEQ ID NO: 497854 - RNA, 19 nt, Homo sapiens
gcacacauugucucuaaca

SEQ ID NO: 497855 - RNA, 19 nt, Homo sapiens
gaauguuuccuaaauccuu

SEQ ID NO: 497856 - RNA, 19 nt, Homo sapiens
gagaagagcuccgaaaacu

SEQ ID NO: 497857 - RNA, 19 nt, Homo sapiens
caaagcaucaggacuccaa

SEQ ID NO: 497858 - RNA, 19 nt, Homo sapiens
gaaacccaccuccacacuu

SEQ ID NO: 497859 - RNA, 19 nt, Homo sapiens
gcagcacccucaccauguc

SEQ ID NO: 497860 - RNA, 19 nt, Homo sapiens
ucuagucaaugaaucagaa

SEQ ID NO: 497861 - RNA, 19 nt, Homo sapiens
guagcugagugcacguuga

SEQ ID NO: 497862 - RNA, 19 nt, Homo sapiens
ucggauagcuuaguuuuaa

SEQ ID NO: 497863 - RNA, 19 nt, Homo sapiens
acacagcgaauguuuccua

SEQ ID NO: 497864 - RNA, 19 nt, Homo sapiens
cagagaagagcaagcgaaa

SEQ ID NO: 497865 - RNA, 19 nt, Homo sapiens
guagacaagcccucaagga

SEQ ID NO: 497866 - RNA, 19 nt, Homo sapiens
gaaucagaaacgaaucaaa

SEQ ID NO: 497867 - RNA, 19 nt, Homo sapiens
gcucgucaccaagucuuua

SEQ ID NO: 497868 - RNA, 19 nt, Homo sapiens
gcuuuggccuugaucaaca

SEQ ID NO: 497869 - RNA, 19 nt, Homo sapiens
gaaaugccgagcgcgcuuu

SEQ ID NO: 497870 - RNA, 19 nt, Homo sapiens
ccagauauauccccguauu

SEQ ID NO: 497871 - RNA, 19 nt, Homo sapiens
caaugaaucagaaacgaau

SEQ ID NO: 497872 - RNA, 19 nt, Homo sapiens
gagagggauuuagcugaug

SEQ ID NO: 497873 - RNA, 19 nt, Homo sapiens
agagagggauuuagcugau

SEQ ID NO: 497874 - RNA, 19 nt, Homo sapiens
cacagcgaauguuuccuaa

SEQ ID NO: 497875 - RNA, 19 nt, Homo sapiens
gaagaagccccacauaaag

SEQ ID NO: 497876 - RNA, 19 nt, Homo sapiens
gaaauggccacugcuugau

SEQ ID NO: 497877 - RNA, 19 nt, Homo sapiens
gaugaaauggccacugcuu

SEQ ID NO: 497878 - RNA, 19 nt, Homo sapiens
agagaagaaccucaugauu

SEQ ID NO: 497879 - RNA, 19 nt, Homo sapiens
gcgaauguuuccuaaaucc

SEQ ID NO: 497880 - RNA, 19 nt, Homo sapiens
gcaaaggucguagcugagu

SEQ ID NO: 497881 - RNA, 19 nt, Homo sapiens
caaacucacgcgugcagaa

SEQ ID NO: 497882 - RNA, 19 nt, Homo sapiens
ccaaugaacacagcgaaug

SEQ ID NO: 497883 - RNA, 19 nt, Homo sapiens
gaagagcaagcgaaauacu

SEQ ID NO: 497884 - RNA, 19 nt, Homo sapiens
agacaaaucccgggaaagu

SEQ ID NO: 497885 - RNA, 19 nt, Homo sapiens
gccuugaucaacagaauaa

SEQ ID NO: 497886 - RNA, 19 nt, Homo sapiens
cuuaaugcauucauguugu

SEQ ID NO: 497887 - RNA, 19 nt, Homo sapiens
gaaaccucuuaaugcauuc

SEQ ID NO: 497888 - RNA, 19 nt, Homo sapiens
ccgcuaggaugguuaguac

SEQ ID NO: 497889 - RNA, 19 nt, Homo sapiens
caaugaacacagcgaaugu

SEQ ID NO: 497890 - RNA, 19 nt, Homo sapiens
guauaugaaggaaaugaga

SEQ ID NO: 497891 - RNA, 19 nt, Homo sapiens
agaagaagccccacauaaa

SEQ ID NO: 497892 - RNA, 19 nt, Homo sapiens
ccgggaaaguuuggaagaa

SEQ ID NO: 497893 - RNA, 19 nt, Homo sapiens
ggagagaccaaugaacaca

SEQ ID NO: 497894 - RNA, 19 nt, Homo sapiens
ggagcgacagcuucauaug

SEQ ID NO: 497895 - RNA, 19 nt, Homo sapiens
acgacgaacugauuuccuu

SEQ ID NO: 497896 - RNA, 19 nt, Homo sapiens
aagaaccucaugauuggua

SEQ ID NO: 497897 - RNA, 19 nt, Homo sapiens
cuugaaagguuuuguuuug

SEQ ID NO: 497898 - RNA, 19 nt, Homo sapiens
ucaaaucgucucuagucaa

SEQ ID NO: 497899 - RNA, 19 nt, Homo sapiens
gacaaaucccgggaaaguu

SEQ ID NO: 497900 - RNA, 19 nt, Homo sapiens
ccgccucgcuccgaaaguu

SEQ ID NO: 497901 - RNA, 19 nt, Homo sapiens
ucaaugaaucagaaacgaa

SEQ ID NO: 497902 - RNA, 19 nt, Homo sapiens
gaaaacuccucggcagaga

SEQ ID NO: 497903 - RNA, 19 nt, Homo sapiens
ucagauggaagcuuacuag

SEQ ID NO: 497904 - RNA, 19 nt, Homo sapiens
aaggagcgacagcuucaua

SEQ ID NO: 497905 - RNA, 19 nt, Homo sapiens
aagagcaagcgaaauacua

SEQ ID NO: 497906 - RNA, 19 nt, Homo sapiens
uagacaagcccucaaggau

SEQ ID NO: 497907 - RNA, 19 nt, Homo sapiens
gauggagggcucuuuaagg

SEQ ID NO: 497908 - RNA, 19 nt, Homo sapiens
gucaaaucgucucuaguca

SEQ ID NO: 497909 - RNA, 19 nt, Homo sapiens
auauguagaugagagaaga

SEQ ID NO: 497910 - RNA, 19 nt, Homo sapiens
guugauguuuaucgaguuc

SEQ ID NO: 497911 - RNA, 19 nt, Homo sapiens
ucagcgcuccuaagaaaug

SEQ ID NO: 497912 - RNA, 19 nt, Homo sapiens
gagcgacagcuucauaugc

SEQ ID NO: 497913 - RNA, 19 nt, Homo sapiens
ugucaaaucgucucuaguc

SEQ ID NO: 497914 - RNA, 19 nt, Homo sapiens
cgccaacgacgaacugauu

SEQ ID NO: 497915 - RNA, 19 nt, Homo sapiens
gcgacagcuucauaugcaa

SEQ ID NO: 497916 - RNA, 19 nt, Homo sapiens
cagaagaucuuacuguuaa

SEQ ID NO: 497917 - RNA, 19 nt, Homo sapiens
gaacaggacucaagacauc

SEQ ID NO: 497918 - RNA, 19 nt, Homo sapiens
gcacuugucuucuguguga

SEQ ID NO: 497919 - RNA, 19 nt, Homo sapiens
gaaccacccuugaaaguga

SEQ ID NO: 497920 - RNA, 19 nt, Homo sapiens
gaagcaggauguacaguaa

SEQ ID NO: 497921 - RNA, 19 nt, Homo sapiens
gaagaacccuugaacuugu

SEQ ID NO: 497922 - RNA, 19 nt, Homo sapiens
aaacugaaccuguggauua

SEQ ID NO: 497923 - RNA, 19 nt, Homo sapiens
gaacacaugcgauuacauu

SEQ ID NO: 497924 - RNA, 19 nt, Homo sapiens
gaugcaagcuggacagauu

SEQ ID NO: 497925 - RNA, 19 nt, Homo sapiens
gaagacaaacugcauauug

SEQ ID NO: 497926 - RNA, 19 nt, Homo sapiens
gcaacagggagaauuauua

SEQ ID NO: 497927 - RNA, 19 nt, Homo sapiens
ggaaagcgcuucucacacu

SEQ ID NO: 497928 - RNA, 19 nt, Homo sapiens
aaagagcacuuaagaauuc

SEQ ID NO: 497929 - RNA, 19 nt, Homo sapiens
gcauacaccuacucaacua

SEQ ID NO: 497930 - RNA, 19 nt, Homo sapiens
ggcgauagaugguaaugua

SEQ ID NO: 497931 - RNA, 19 nt, Homo sapiens
gaaggaguaucaaauguag

SEQ ID NO: 497932 - RNA, 19 nt, Homo sapiens
uuagaaaggucaacuauca

SEQ ID NO: 497933 - RNA, 19 nt, Homo sapiens
caagguggccauucuguua

SEQ ID NO: 497934 - RNA, 19 nt, Homo sapiens
ggaagaggaugaagacagu

SEQ ID NO: 497935 - RNA, 19 nt, Homo sapiens
gaacuugucuugcgcaaaa

SEQ ID NO: 497936 - RNA, 19 nt, Homo sapiens
aaagacaaaugaagccuaa

SEQ ID NO: 497937 - RNA, 19 nt, Homo sapiens
ggacagcacaguaaaucua

SEQ ID NO: 497938 - RNA, 19 nt, Homo sapiens
gaacaagaaacaaucaaug

SEQ ID NO: 497939 - RNA, 19 nt, Homo sapiens
gcaguuacaccuuugcaua

SEQ ID NO: 497940 - RNA, 19 nt, Homo sapiens
gaagaaaguguuacagaug

SEQ ID NO: 497941 - RNA, 19 nt, Homo sapiens
ggaagaacccuugaacuug

SEQ ID NO: 497942 - RNA, 19 nt, Homo sapiens
gaaccaggcaaaguaaaua

SEQ ID NO: 497943 - RNA, 19 nt, Homo sapiens
aaucaaugcuucacccaua

SEQ ID NO: 497944 - RNA, 19 nt, Homo sapiens
gagcaagugucugaagaaa

SEQ ID NO: 497945 - RNA, 19 nt, Homo sapiens
gagagaagccauaugaaug

SEQ ID NO: 497946 - RNA, 19 nt, Homo sapiens
ggaagaaguggaagaagaa

SEQ ID NO: 497947 - RNA, 19 nt, Homo sapiens
uuaaugcacuuccagaauu

SEQ ID NO: 497948 - RNA, 19 nt, Homo sapiens
ggaagcugauuaauuagau

SEQ ID NO: 497949 - RNA, 19 nt, Homo sapiens
ggaggaggauaaagagaug

SEQ ID NO: 497950 - RNA, 19 nt, Homo sapiens
ggcaaguguuggagaauaa

SEQ ID NO: 497951 - RNA, 19 nt, Homo sapiens
gaggagcagugaaagagaa

SEQ ID NO: 497952 - RNA, 19 nt, Homo sapiens
caaaugaagccuaaucguu

SEQ ID NO: 497953 - RNA, 19 nt, Homo sapiens
uccuauagcucacacauaa

SEQ ID NO: 497954 - RNA, 19 nt, Homo sapiens
ggagagaagccauaugaau

SEQ ID NO: 497955 - RNA, 19 nt, Homo sapiens
gaaaggaagggcaagaaau

SEQ ID NO: 497956 - RNA, 19 nt, Homo sapiens
ucacagagaaguauaaugu

SEQ ID NO: 497957 - RNA, 19 nt, Homo sapiens
aaaugaagccuaaucguuu

SEQ ID NO: 497958 - RNA, 19 nt, Homo sapiens
gaauguaugcuugugauuu

SEQ ID NO: 497959 - RNA, 19 nt, Homo sapiens
gaacaaugaucagccucaa

SEQ ID NO: 497960 - RNA, 19 nt, Homo sapiens
uuacucaccuguccauauu

SEQ ID NO: 497961 - RNA, 19 nt, Homo sapiens
gagaagggaaugcuaagaa

SEQ ID NO: 497962 - RNA, 19 nt, Homo sapiens
uaaccuguaugcugugauu

SEQ ID NO: 497963 - RNA, 19 nt, Homo sapiens
uaaaagaccucaugagugu

SEQ ID NO: 497964 - RNA, 19 nt, Homo sapiens
ggcaaaagauagagaauaa

SEQ ID NO: 497965 - RNA, 19 nt, Homo sapiens
gaaagagaagggaaugcua

SEQ ID NO: 497966 - RNA, 19 nt, Homo sapiens
guaaacauaugcuaaaucc

SEQ ID NO: 497967 - RNA, 19 nt, Homo sapiens
ggaagaagaagagguagaa

SEQ ID NO: 497968 - RNA, 19 nt, Homo sapiens
gaaaucaggaugaaagaca

SEQ ID NO: 497969 - RNA, 19 nt, Homo sapiens
ugaaagugauccagccaaa

SEQ ID NO: 497970 - RNA, 19 nt, Homo sapiens
ccagaaauacacaggguua

SEQ ID NO: 497971 - RNA, 19 nt, Homo sapiens
ccagaagaucuuacuguua

SEQ ID NO: 497972 - RNA, 19 nt, Homo sapiens
ccaaaagaguaguucauua

SEQ ID NO: 497973 - RNA, 19 nt, Homo sapiens
ggucagcccugcaguccaa

SEQ ID NO: 497974 - RNA, 19 nt, Homo sapiens
cacaugacaucacauaaau

SEQ ID NO: 497975 - RNA, 19 nt, Homo sapiens
gaugaaagacaagauacua

SEQ ID NO: 497976 - RNA, 19 nt, Homo sapiens
gaaccaguuguaaauguaa

SEQ ID NO: 497977 - RNA, 19 nt, Homo sapiens
ucacuaguguuuaccagaa

SEQ ID NO: 497978 - RNA, 19 nt, Homo sapiens
caacuugaacgucacauga

SEQ ID NO: 497979 - RNA, 19 nt, Homo sapiens
gacaagauauuccaaaaga

SEQ ID NO: 497980 - RNA, 19 nt, Homo sapiens
uaucaaauguagaggauca

SEQ ID NO: 497981 - RNA, 19 nt, Homo sapiens
caaaaggacaguuguguua

SEQ ID NO: 497982 - RNA, 19 nt, Homo sapiens
acaagaagagccacaagua

SEQ ID NO: 497983 - RNA, 19 nt, Homo sapiens
ggagaauaaucaagccaau

SEQ ID NO: 497984 - RNA, 19 nt, Homo sapiens
ucacaugacaucacauaaa

SEQ ID NO: 497985 - RNA, 19 nt, Homo sapiens
gguuaaaggaagcugauua

SEQ ID NO: 497986 - RNA, 19 nt, Homo sapiens
uagaagaggcagagaauga

SEQ ID NO: 497987 - RNA, 19 nt, Homo sapiens
gaaaagcccuaucaaugug

SEQ ID NO: 497988 - RNA, 19 nt, Homo sapiens
cagggagaauuauuagaaa

SEQ ID NO: 497989 - RNA, 19 nt, Homo sapiens
gaauaaaccccuucaagaa

SEQ ID NO: 497990 - RNA, 19 nt, Homo sapiens
gcucacacauaagcaguaa

SEQ ID NO: 497991 - RNA, 19 nt, Homo sapiens
ucacucuuauguugguuua

SEQ ID NO: 497992 - RNA, 19 nt, Homo sapiens
gagaaaagcccuaucaaug

SEQ ID NO: 497993 - RNA, 19 nt, Homo sapiens
cagaaggaguaucaaaugu

SEQ ID NO: 497994 - RNA, 19 nt, Homo sapiens
cagaaccaguuguaaaugu

SEQ ID NO: 497995 - RNA, 19 nt, Homo sapiens
gaaauacacaggguuacuu

SEQ ID NO: 497996 - RNA, 19 nt, Homo sapiens
uaaggcaaguguuggagaa

SEQ ID NO: 497997 - RNA, 19 nt, Homo sapiens
caaauucagauucagauga

SEQ ID NO: 497998 - RNA, 19 nt, Homo sapiens
gcaacaauacaagagguua

SEQ ID NO: 497999 - RNA, 19 nt, Homo sapiens
guagugagcaagugucuga

SEQ ID NO: 498000 - RNA, 19 nt, Homo sapiens
agaagaaaguguuacagau

SEQ ID NO: 498001 - RNA, 19 nt, Homo sapiens
agaaccaguuguaaaugua

SEQ ID NO: 498002 - RNA, 19 nt, Homo sapiens
aaagcaacagggagaauua

SEQ ID NO: 498003 - RNA, 19 nt, Homo sapiens
gauagcacuugucuucugu

SEQ ID NO: 498004 - RNA, 19 nt, Homo sapiens
ccaaagaacaagaaacaau

SEQ ID NO: 498005 - RNA, 19 nt, Homo sapiens
caaacugcauauuguggaa

SEQ ID NO: 498006 - RNA, 19 nt, Homo sapiens
gaugaagacaaacugcaua

SEQ ID NO: 498007 - RNA, 19 nt, Homo sapiens
gcaagugucugaagaaaag

SEQ ID NO: 498008 - RNA, 19 nt, Homo sapiens
cugaaauccucucgaauga

SEQ ID NO: 498009 - RNA, 19 nt, Homo sapiens
ggccugaaauccucucgaa

SEQ ID NO: 498010 - RNA, 19 nt, Homo sapiens
cgcaauaacguuacaaauu

SEQ ID NO: 498011 - RNA, 19 nt, Homo sapiens
cacaguaaaucuacaaagu

SEQ ID NO: 498012 - RNA, 19 nt, Homo sapiens
gauggcaauuugucuccua

SEQ ID NO: 498013 - RNA, 19 nt, Homo sapiens
gaagagaucaaagacaugu

SEQ ID NO: 498014 - RNA, 19 nt, Homo sapiens
caaauggaaaucaggauga

SEQ ID NO: 498015 - RNA, 19 nt, Homo sapiens
uuaaagcacuaugaccuaa

SEQ ID NO: 498016 - RNA, 19 nt, Homo sapiens
guucaaaucuguagaagaa

SEQ ID NO: 498017 - RNA, 19 nt, Homo sapiens
cuaaagcucuuccgcaaua

SEQ ID NO: 498018 - RNA, 19 nt, Homo sapiens
ggaauggacuccuuacaga

SEQ ID NO: 498019 - RNA, 19 nt, Homo sapiens
ggaaaguaguucagauaaa

SEQ ID NO: 498020 - RNA, 19 nt, Homo sapiens
caacauaccuccuccaucu

SEQ ID NO: 498021 - RNA, 19 nt, Homo sapiens
ggaagcugcuaaaucguua

SEQ ID NO: 498022 - RNA, 19 nt, Homo sapiens
gcaauauucuucuuuggaa

SEQ ID NO: 498023 - RNA, 19 nt, Homo sapiens
ggaugaagucgaagaaaua

SEQ ID NO: 498024 - RNA, 19 nt, Homo sapiens
gaacauuccacuugugaaa

SEQ ID NO: 498025 - RNA, 19 nt, Homo sapiens
gaagugaauucagggauga

SEQ ID NO: 498026 - RNA, 19 nt, Homo sapiens
ggaauccucuuaaguugga

SEQ ID NO: 498027 - RNA, 19 nt, Homo sapiens
cagcagagaugauugacuu

SEQ ID NO: 498028 - RNA, 19 nt, Homo sapiens
gaaaugaagaaacaaguga

SEQ ID NO: 498029 - RNA, 19 nt, Homo sapiens
gagaauaccauuuacucua

SEQ ID NO: 498030 - RNA, 19 nt, Homo sapiens
aaacaucaccucauucaaa

SEQ ID NO: 498031 - RNA, 19 nt, Homo sapiens
gaaggaaaguaguucagau

SEQ ID NO: 498032 - RNA, 19 nt, Homo sapiens
caaaucaagcucuaaauug

SEQ ID NO: 498033 - RNA, 19 nt, Homo sapiens
gaagaacauuccacuugug

SEQ ID NO: 498034 - RNA, 19 nt, Homo sapiens
gcagacaggauuuacuuaa

SEQ ID NO: 498035 - RNA, 19 nt, Homo sapiens
caacguauuuacaacaguu

SEQ ID NO: 498036 - RNA, 19 nt, Homo sapiens
auacaucacuccucagaaa

SEQ ID NO: 498037 - RNA, 19 nt, Homo sapiens
gcuaaaucguuaccuuauu

SEQ ID NO: 498038 - RNA, 19 nt, Homo sapiens
gcuaugaccuuuaugaaac

SEQ ID NO: 498039 - RNA, 19 nt, Homo sapiens
gaagaaacaagugaagaaa

SEQ ID NO: 498040 - RNA, 19 nt, Homo sapiens
acacucaguuccuuuguuu

SEQ ID NO: 498041 - RNA, 19 nt, Homo sapiens
gggaugaagucgaagaaau

SEQ ID NO: 498042 - RNA, 19 nt, Homo sapiens
ucacagacaacaaguuuaa

SEQ ID NO: 498043 - RNA, 19 nt, Homo sapiens
caaaugaggaaagcaguua

SEQ ID NO: 498044 - RNA, 19 nt, Homo sapiens
gagaugccaugguucaaau

SEQ ID NO: 498045 - RNA, 19 nt, Homo sapiens
uaaaagagaugccaugguu

SEQ ID NO: 498046 - RNA, 19 nt, Homo sapiens
cgaguucaguugauugauu

SEQ ID NO: 498047 - RNA, 19 nt, Homo sapiens
caacauccaagaaauagaa

SEQ ID NO: 498048 - RNA, 19 nt, Homo sapiens
cuagagaguucaucaaauc

SEQ ID NO: 498049 - RNA, 19 nt, Homo sapiens
ggcccaagaugacuauauu

SEQ ID NO: 498050 - RNA, 19 nt, Homo sapiens
ucuaagaccucaaacacuu

SEQ ID NO: 498051 - RNA, 19 nt, Homo sapiens
aagcagaaaugaagaaaca

SEQ ID NO: 498052 - RNA, 19 nt, Homo sapiens
uuuaagagcucaacguguu

SEQ ID NO: 498053 - RNA, 19 nt, Homo sapiens
ggaaacuucucaguagaug

SEQ ID NO: 498054 - RNA, 19 nt, Homo sapiens
gucaaaagcucaaagagua

SEQ ID NO: 498055 - RNA, 19 nt, Homo sapiens
gaagagagagagcgaagau

SEQ ID NO: 498056 - RNA, 19 nt, Homo sapiens
ggacuccaccucuguauuc

SEQ ID NO: 498057 - RNA, 19 nt, Homo sapiens
gaguucaguugauugauug

SEQ ID NO: 498058 - RNA, 19 nt, Homo sapiens
agaaacaagugaagaaagu

SEQ ID NO: 498059 - RNA, 19 nt, Homo sapiens
guaauagaagguaggauuu

SEQ ID NO: 498060 - RNA, 19 nt, Homo sapiens
gaugacaccuugcaagaac

SEQ ID NO: 498061 - RNA, 19 nt, Homo sapiens
ugaagaacauuccacuugu

SEQ ID NO: 498062 - RNA, 19 nt, Homo sapiens
gaucaggguuugucuucug

SEQ ID NO: 498063 - RNA, 19 nt, Homo sapiens
ucaagcagaauccuucaua

SEQ ID NO: 498064 - RNA, 19 nt, Homo sapiens
caacaguuaucacgcaaag

SEQ ID NO: 498065 - RNA, 19 nt, Homo sapiens
ccacagaugaagaggauaa

SEQ ID NO: 498066 - RNA, 19 nt, Homo sapiens
uugaagaagugcaagauga

SEQ ID NO: 498067 - RNA, 19 nt, Homo sapiens
guaaggaugaucaggguuu

SEQ ID NO: 498068 - RNA, 19 nt, Homo sapiens
ucaccuagaccaucuuaaa

SEQ ID NO: 498069 - RNA, 19 nt, Homo sapiens
gaugaagucgaagaaauaa

SEQ ID NO: 498070 - RNA, 19 nt, Homo sapiens
ggaaggaacaucuagugau

SEQ ID NO: 498071 - RNA, 19 nt, Homo sapiens
ucaauaagcagaaaugaag

SEQ ID NO: 498072 - RNA, 19 nt, Homo sapiens
ccucaaacacuuagacaaa

SEQ ID NO: 498073 - RNA, 19 nt, Homo sapiens
caucacuccucagaaagua

SEQ ID NO: 498074 - RNA, 19 nt, Homo sapiens
ccuagaccaucuuaaauca

SEQ ID NO: 498075 - RNA, 19 nt, Homo sapiens
uagggaagcugcuaaaucg

SEQ ID NO: 498076 - RNA, 19 nt, Homo sapiens
caaagaguaccauccagaa

SEQ ID NO: 498077 - RNA, 19 nt, Homo sapiens
gaagaaagucaggaagaug

SEQ ID NO: 498078 - RNA, 19 nt, Homo sapiens
gugccucucucuucuuuau

SEQ ID NO: 498079 - RNA, 19 nt, Homo sapiens
gaagaagugcaagaugauu

SEQ ID NO: 498080 - RNA, 19 nt, Homo sapiens
caagcuaugaccuuuauga

SEQ ID NO: 498081 - RNA, 19 nt, Homo sapiens
aaacaagcuaugaccuuua

SEQ ID NO: 498082 - RNA, 19 nt, Homo sapiens
ugaagaaacaagugaagaa

SEQ ID NO: 498083 - RNA, 19 nt, Homo sapiens
gaaucaauaagcagaaaug

SEQ ID NO: 498084 - RNA, 19 nt, Homo sapiens
gcugaggaaucaauaagca

SEQ ID NO: 498085 - RNA, 19 nt, Homo sapiens
ggacuagggaagcugcuaa

SEQ ID NO: 498086 - RNA, 19 nt, Homo sapiens
gcuuuuaaauccccuaaua

SEQ ID NO: 498087 - RNA, 19 nt, Homo sapiens
gcaggcaagaugaauuaaa

SEQ ID NO: 498088 - RNA, 19 nt, Homo sapiens
ugaagaaagucaggaagau

SEQ ID NO: 498089 - RNA, 19 nt, Homo sapiens
caagcagaauccuucauag

SEQ ID NO: 498090 - RNA, 19 nt, Homo sapiens
ggacgaaggcucagaaucc

SEQ ID NO: 498091 - RNA, 19 nt, Homo sapiens
caucaaaucaagcucuaaa

SEQ ID NO: 498092 - RNA, 19 nt, Homo sapiens
uaacauuacuacaggaaac

SEQ ID NO: 498093 - RNA, 19 nt, Homo sapiens
gugguguucuaaggaauua

SEQ ID NO: 498094 - RNA, 19 nt, Homo sapiens
ggucaggccuaaagcucuu

SEQ ID NO: 498095 - RNA, 19 nt, Homo sapiens
ucaaagaaggaaaguaguu

SEQ ID NO: 498096 - RNA, 19 nt, Homo sapiens
aaaguuuccugacuccuau

SEQ ID NO: 498097 - RNA, 19 nt, Homo sapiens
gagaguucaucaaaucaag

SEQ ID NO: 498098 - RNA, 19 nt, Homo sapiens
gcaaaugaggaaagcaguu

SEQ ID NO: 498099 - RNA, 19 nt, Homo sapiens
aauagaagguaggauuuga

SEQ ID NO: 498100 - RNA, 19 nt, Homo sapiens
ccagguagcagcaugucua

SEQ ID NO: 498101 - RNA, 19 nt, Homo sapiens
cauucaaaguuccaagaaa

SEQ ID NO: 498102 - RNA, 19 nt, Homo sapiens
aaggauggcugaggaauca

SEQ ID NO: 498103 - RNA, 19 nt, Homo sapiens
gcaggacuccaccucugua

SEQ ID NO: 498104 - RNA, 19 nt, Homo sapiens
ccaaagagugcuguagaaa

SEQ ID NO: 498105 - RNA, 19 nt, Homo sapiens
aaacuucucaguagaugaa

SEQ ID NO: 498106 - RNA, 19 nt, Homo sapiens
gaaucaacguauuuacaac

SEQ ID NO: 498107 - RNA, 19 nt, Homo sapiens
aagaugacccugagaguga

SEQ ID NO: 498108 - RNA, 19 nt, Homo sapiens
agagagagagcgaagauga

SEQ ID NO: 498109 - RNA, 19 nt, Homo sapiens
gggaagcugcuaaaucguu

SEQ ID NO: 498110 - RNA, 19 nt, Homo sapiens
ccucacagacaacaaguuu

SEQ ID NO: 498111 - RNA, 19 nt, Homo sapiens
gaaacgcaggcaagaugaa

SEQ ID NO: 498112 - RNA, 19 nt, Homo sapiens
aacaagcuaugaccuuuau

SEQ ID NO: 498113 - RNA, 19 nt, Homo sapiens
gaauaccauuuacucuaag

SEQ ID NO: 498114 - RNA, 19 nt, Homo sapiens
gcucaacguguuucccuuu

SEQ ID NO: 498115 - RNA, 19 nt, Homo sapiens
gcugcuaaaucguuaccuu

SEQ ID NO: 498116 - RNA, 19 nt, Homo sapiens
gcacagaccugaaccauaa

SEQ ID NO: 498117 - RNA, 19 nt, Homo sapiens
ccaagaaacucaaauguaa

SEQ ID NO: 498118 - RNA, 19 nt, Homo sapiens
caacagaaaucaagacuga

SEQ ID NO: 498119 - RNA, 19 nt, Homo sapiens
gaaguugccuugugccuaa

SEQ ID NO: 498120 - RNA, 19 nt, Homo sapiens
cagcagagauacuggauua

SEQ ID NO: 498121 - RNA, 19 nt, Homo sapiens
gaacaagcaguacuaauga

SEQ ID NO: 498122 - RNA, 19 nt, Homo sapiens
gaaaggacccaaaucacua

SEQ ID NO: 498123 - RNA, 19 nt, Homo sapiens
auaggaagcucaucagaua

SEQ ID NO: 498124 - RNA, 19 nt, Homo sapiens
ggacccaaaucacuaugua

SEQ ID NO: 498125 - RNA, 19 nt, Homo sapiens
gaauugagugggugauuua

SEQ ID NO: 498126 - RNA, 19 nt, Homo sapiens
gcaauggucacccguauuu

SEQ ID NO: 498127 - RNA, 19 nt, Homo sapiens
ggucaacacuuccaucaga

SEQ ID NO: 498128 - RNA, 19 nt, Homo sapiens
caaggcagguagugugaua

SEQ ID NO: 498129 - RNA, 19 nt, Homo sapiens
gaaaggugccuccugguuu

SEQ ID NO: 498130 - RNA, 19 nt, Homo sapiens
ggacuucagugcgauguuu

SEQ ID NO: 498131 - RNA, 19 nt, Homo sapiens
ggagguaucuuggcuuaau

SEQ ID NO: 498132 - RNA, 19 nt, Homo sapiens
gaaagcugaucuacacuca

SEQ ID NO: 498133 - RNA, 19 nt, Homo sapiens
caacaacccugggagagaa

SEQ ID NO: 498134 - RNA, 19 nt, Homo sapiens
guucuucauuucaguguua

SEQ ID NO: 498135 - RNA, 19 nt, Homo sapiens
gaugaugaauccucccaaa

SEQ ID NO: 498136 - RNA, 19 nt, Homo sapiens
gaaugacagucgauuagga

SEQ ID NO: 498137 - RNA, 19 nt, Homo sapiens
gaagucagaugaugaaucc

SEQ ID NO: 498138 - RNA, 19 nt, Homo sapiens
cagcacagcuaucuucuuc

SEQ ID NO: 498139 - RNA, 19 nt, Homo sapiens
ucaaagagcuuggccgaau

SEQ ID NO: 498140 - RNA, 19 nt, Homo sapiens
cagaaguuguugcuuauga

SEQ ID NO: 498141 - RNA, 19 nt, Homo sapiens
gaagauaggaagcucauca

SEQ ID NO: 498142 - RNA, 19 nt, Homo sapiens
gaaccaagaaacucaaaug

SEQ ID NO: 498143 - RNA, 19 nt, Homo sapiens
gagguaucuuggcuuaaua

SEQ ID NO: 498144 - RNA, 19 nt, Homo sapiens
cauaggaaagcuuguaaua

SEQ ID NO: 498145 - RNA, 19 nt, Homo sapiens
ugacaaccauuggcccuua

SEQ ID NO: 498146 - RNA, 19 nt, Homo sapiens
gaacagcaagucagagaga

SEQ ID NO: 498147 - RNA, 19 nt, Homo sapiens
acucaaaucugaugggaaa

SEQ ID NO: 498148 - RNA, 19 nt, Homo sapiens
cauaaucacuuugaacuuc

SEQ ID NO: 498149 - RNA, 19 nt, Homo sapiens
gagcaauggucacccguau

SEQ ID NO: 498150 - RNA, 19 nt, Homo sapiens
ggucacccguauuuccuua

SEQ ID NO: 498151 - RNA, 19 nt, Homo sapiens
gagaccaucugugaccaua

SEQ ID NO: 498152 - RNA, 19 nt, Homo sapiens
uaaugaagaugaggauuug

SEQ ID NO: 498153 - RNA, 19 nt, Homo sapiens
ccacaauucuucugaccuu

SEQ ID NO: 498154 - RNA, 19 nt, Homo sapiens
cagguagugugauaaauga

SEQ ID NO: 498155 - RNA, 19 nt, Homo sapiens
gaucuacacucagcugaug

SEQ ID NO: 498156 - RNA, 19 nt, Homo sapiens
gaacaucagcccaugagau

SEQ ID NO: 498157 - RNA, 19 nt, Homo sapiens
gaccauaccagcaguaguu

SEQ ID NO: 498158 - RNA, 19 nt, Homo sapiens
gaggaaaggacccaaauca

SEQ ID NO: 498159 - RNA, 19 nt, Homo sapiens
gaaagcuuguaauagcaaa

SEQ ID NO: 498160 - RNA, 19 nt, Homo sapiens
uuacagacagcccucauua

SEQ ID NO: 498161 - RNA, 19 nt, Homo sapiens
ccaaguccuuccuaugauu

SEQ ID NO: 498162 - RNA, 19 nt, Homo sapiens
gaugauuccuaacaaguca

SEQ ID NO: 498163 - RNA, 19 nt, Homo sapiens
gcagguagugugauaaaug

SEQ ID NO: 498164 - RNA, 19 nt, Homo sapiens
ucagccaguuccagaguua

SEQ ID NO: 498165 - RNA, 19 nt, Homo sapiens
gcacagcuaucuucuucag

SEQ ID NO: 498166 - RNA, 19 nt, Homo sapiens
cuucagagcuuguugucuu

SEQ ID NO: 498167 - RNA, 19 nt, Homo sapiens
caaaucacuauguagcuua

SEQ ID NO: 498168 - RNA, 19 nt, Homo sapiens
aaggagguaucuuggcuua

SEQ ID NO: 498169 - RNA, 19 nt, Homo sapiens
ucgaucagcuucaaugguu

SEQ ID NO: 498170 - RNA, 19 nt, Homo sapiens
cacaugaccgcuugaguua

SEQ ID NO: 498171 - RNA, 19 nt, Homo sapiens
ggacagcauacuauucauu

SEQ ID NO: 498172 - RNA, 19 nt, Homo sapiens
uuaccaggcugucaaucua

SEQ ID NO: 498173 - RNA, 19 nt, Homo sapiens
uaagagaagggaagaagaa

SEQ ID NO: 498174 - RNA, 19 nt, Homo sapiens
gaaagaggagguacaacau

SEQ ID NO: 498175 - RNA, 19 nt, Homo sapiens
ggaaaggacccaaaucacu

SEQ ID NO: 498176 - RNA, 19 nt, Homo sapiens
gauuagcauuaaaccagua

SEQ ID NO: 498177 - RNA, 19 nt, Homo sapiens
gcagucauccuuagucuag

SEQ ID NO: 498178 - RNA, 19 nt, Homo sapiens
caaagagcuuggccgaaug

SEQ ID NO: 498179 - RNA, 19 nt, Homo sapiens
ggaggaucguuuagacaga

SEQ ID NO: 498180 - RNA, 19 nt, Homo sapiens
agacagcccucauuacagu

SEQ ID NO: 498181 - RNA, 19 nt, Homo sapiens
ucagucauuugugaacuua

SEQ ID NO: 498182 - RNA, 19 nt, Homo sapiens
ccuaacaagucagucauuu

SEQ ID NO: 498183 - RNA, 19 nt, Homo sapiens
gggaagcagucaauucagu

SEQ ID NO: 498184 - RNA, 19 nt, Homo sapiens
uaggaaagcuuguaauagc

SEQ ID NO: 498185 - RNA, 19 nt, Homo sapiens
aaacugaauugacaaaugc

SEQ ID NO: 498186 - RNA, 19 nt, Homo sapiens
caaagcaacuggucaacac

SEQ ID NO: 498187 - RNA, 19 nt, Homo sapiens
gaucaaagcaacuggucaa

SEQ ID NO: 498188 - RNA, 19 nt, Homo sapiens
ucagagagaggaaccuuaa

SEQ ID NO: 498189 - RNA, 19 nt, Homo sapiens
aaaggugccuccugguuug

SEQ ID NO: 498190 - RNA, 19 nt, Homo sapiens
ccaaaucacuauguagcuu

SEQ ID NO: 498191 - RNA, 19 nt, Homo sapiens
cucuaaaucugaacaguuu

SEQ ID NO: 498192 - RNA, 19 nt, Homo sapiens
caucagaagugaagauagg

SEQ ID NO: 498193 - RNA, 19 nt, Homo sapiens
uaucaagguuucaucuaga

SEQ ID NO: 498194 - RNA, 19 nt, Homo sapiens
gacaugaagucagaugaug

SEQ ID NO: 498195 - RNA, 19 nt, Homo sapiens
gaaacuaccaacccuaugg

SEQ ID NO: 498196 - RNA, 19 nt, Homo sapiens
cuaaugaagaugaggauuu

SEQ ID NO: 498197 - RNA, 19 nt, Homo sapiens
gcaguacuaaugaagauga

SEQ ID NO: 498198 - RNA, 19 nt, Homo sapiens
gcuuuggcaucuauuuauu

SEQ ID NO: 498199 - RNA, 19 nt, Homo sapiens
ucacaugaccgcuugaguu

SEQ ID NO: 498200 - RNA, 19 nt, Homo sapiens
agaauugagugggugauuu

SEQ ID NO: 498201 - RNA, 19 nt, Homo sapiens
uguaaaguguuagcuguaa

SEQ ID NO: 498202 - RNA, 19 nt, Homo sapiens
gcuucuagaucucauagga

SEQ ID NO: 498203 - RNA, 19 nt, Homo sapiens
gugcagcccugugugcuuu

SEQ ID NO: 498204 - RNA, 19 nt, Homo sapiens
gcagagaacaaagcaguga

SEQ ID NO: 498205 - RNA, 19 nt, Homo sapiens
guggaaagcugaucuacac

SEQ ID NO: 498206 - RNA, 19 nt, Homo sapiens
caugaccgcuugaguuauc

SEQ ID NO: 498207 - RNA, 19 nt, Homo sapiens
uucaugaacucaaaucuga

SEQ ID NO: 498208 - RNA, 19 nt, Homo sapiens
uuaaucagcuaaacagaag

SEQ ID NO: 498209 - RNA, 19 nt, Homo sapiens
uugcauauauucuccaguu

SEQ ID NO: 498210 - RNA, 19 nt, Homo sapiens
gaacuucugguacucuaau

SEQ ID NO: 498211 - RNA, 19 nt, Homo sapiens
caagggaagaaucuacuuu

SEQ ID NO: 498212 - RNA, 19 nt, Homo sapiens
agaacaagcaguacuaaug

SEQ ID NO: 498213 - RNA, 19 nt, Homo sapiens
gcagaacaagcaguacuaa

SEQ ID NO: 498214 - RNA, 19 nt, Homo sapiens
gacauaaacacgagucuuc

SEQ ID NO: 498215 - RNA, 19 nt, Homo sapiens
cuuuguggguguuauauuu

SEQ ID NO: 498216 - RNA, 19 nt, Homo sapiens
agagagaauuggugaguuu

SEQ ID NO: 498217 - RNA, 19 nt, Homo sapiens
gagagagaauuggugaguu

SEQ ID NO: 498218 - RNA, 19 nt, Homo sapiens
gagaauuggugaguuuuaa

SEQ ID NO: 498219 - RNA, 19 nt, Homo sapiens
ggucagagacaaggcagaa

SEQ ID NO: 498220 - RNA, 19 nt, Homo sapiens
ugacaggguguguguguau

SEQ ID NO: 498221 - RNA, 19 nt, Homo sapiens
ccuggacccuggagaagga

SEQ ID NO: 498222 - RNA, 19 nt, Homo sapiens
gagccuggacccuggagaa

SEQ ID NO: 498223 - RNA, 19 nt, Homo sapiens
gagugugugugagagagaa

SEQ ID NO: 498224 - RNA, 19 nt, Homo sapiens
ggagagcugugaggaucca

SEQ ID NO: 498225 - RNA, 19 nt, Homo sapiens
uaucugugcgugaguguga

SEQ ID NO: 498226 - RNA, 19 nt, Homo sapiens
gugacagggugugugugua

SEQ ID NO: 498227 - RNA, 19 nt, Homo sapiens
gagcugugaggauccauuc

SEQ ID NO: 498228 - RNA, 19 nt, Homo sapiens
gaccgcaagcuguccaaga

SEQ ID NO: 498229 - RNA, 19 nt, Homo sapiens
ggugacagggugugugugu

SEQ ID NO: 498230 - RNA, 19 nt, Homo sapiens
gcacucagagcgugaacac

SEQ ID NO: 498231 - RNA, 19 nt, Homo sapiens
agacaaggcagaacuuuug

SEQ ID NO: 498232 - RNA, 19 nt, Homo sapiens
gacaggguguguguguauc

SEQ ID NO: 498233 - RNA, 19 nt, Homo sapiens
gagacaaggcagaacuuuu

SEQ ID NO: 498234 - RNA, 19 nt, Homo sapiens
accgcaagcuguccaagau

SEQ ID NO: 498235 - RNA, 19 nt, Homo sapiens
gaaagacccuauaaaugua

SEQ ID NO: 498236 - RNA, 19 nt, Homo sapiens
agacaaagcucaucacgua

SEQ ID NO: 498237 - RNA, 19 nt, Homo sapiens
gaaaguagauuuguaugug

SEQ ID NO: 498238 - RNA, 19 nt, Homo sapiens
guacaucccuuuauaaaca

SEQ ID NO: 498239 - RNA, 19 nt, Homo sapiens
gaaacagccucaaacagaa

SEQ ID NO: 498240 - RNA, 19 nt, Homo sapiens
ggauaaaccucagcuauau

SEQ ID NO: 498241 - RNA, 19 nt, Homo sapiens
gagagaaacuauuuaagug

SEQ ID NO: 498242 - RNA, 19 nt, Homo sapiens
ggaaacagccucaaacaga

SEQ ID NO: 498243 - RNA, 19 nt, Homo sapiens
ggucaucccuuacuaauca

SEQ ID NO: 498244 - RNA, 19 nt, Homo sapiens
ggagaaagacccuauaaau

SEQ ID NO: 498245 - RNA, 19 nt, Homo sapiens
gaauguaccuugggauuug

SEQ ID NO: 498246 - RNA, 19 nt, Homo sapiens
gcacaucagagaauucaua

SEQ ID NO: 498247 - RNA, 19 nt, Homo sapiens
gagaaagacccuauaaaug

SEQ ID NO: 498248 - RNA, 19 nt, Homo sapiens
ggagaaauccuacagaugu

SEQ ID NO: 498249 - RNA, 19 nt, Homo sapiens
gcagauaaacgcuauaaau

SEQ ID NO: 498250 - RNA, 19 nt, Homo sapiens
gagaaacccuaugaaugua

SEQ ID NO: 498251 - RNA, 19 nt, Homo sapiens
aaccauaggucaucccuua

SEQ ID NO: 498252 - RNA, 19 nt, Homo sapiens
ggccaaaguucagcucuua

SEQ ID NO: 498253 - RNA, 19 nt, Homo sapiens
aaccugagaugaagaauuu

SEQ ID NO: 498254 - RNA, 19 nt, Homo sapiens
gacauugacuuuagccauu

SEQ ID NO: 498255 - RNA, 19 nt, Homo sapiens
gugaaagccuuaaaccaaa

SEQ ID NO: 498256 - RNA, 19 nt, Homo sapiens
ggagagaaacccuacauau

SEQ ID NO: 498257 - RNA, 19 nt, Homo sapiens
ggagagaaacuauuuaagu

SEQ ID NO: 498258 - RNA, 19 nt, Homo sapiens
gagagaaacccuaugaaug

SEQ ID NO: 498259 - RNA, 19 nt, Homo sapiens
caaagucagugcuuauuag

SEQ ID NO: 498260 - RNA, 19 nt, Homo sapiens
caaagcucaucgaagaaua

SEQ ID NO: 498261 - RNA, 19 nt, Homo sapiens
aaccaaagcucaucgaaga

SEQ ID NO: 498262 - RNA, 19 nt, Homo sapiens
agaaagacccuauaaaugu

SEQ ID NO: 498263 - RNA, 19 nt, Homo sapiens
gagagaaacccuacauaug

SEQ ID NO: 498264 - RNA, 19 nt, Homo sapiens
gaggugugcuuuagauuuc

SEQ ID NO: 498265 - RNA, 19 nt, Homo sapiens
gagaaugcauacuggagaa

SEQ ID NO: 498266 - RNA, 19 nt, Homo sapiens
gcucaucccuucguuauca

SEQ ID NO: 498267 - RNA, 19 nt, Homo sapiens
gaauguggcaacaccuuua

SEQ ID NO: 498268 - RNA, 19 nt, Homo sapiens
ggcaacaccuuuaagucua

SEQ ID NO: 498269 - RNA, 19 nt, Homo sapiens
ggagagaaacccuaugaau

SEQ ID NO: 498270 - RNA, 19 nt, Homo sapiens
caacaucagagaaugcaua

SEQ ID NO: 498271 - RNA, 19 nt, Homo sapiens
ggaaaagccuucagacaga

SEQ ID NO: 498272 - RNA, 19 nt, Homo sapiens
ccaaagucagugcuuauua

SEQ ID NO: 498273 - RNA, 19 nt, Homo sapiens
ggaggugugcuuuagauuu

SEQ ID NO: 498274 - RNA, 19 nt, Homo sapiens
ugaaugugguaaagccuua

SEQ ID NO: 498275 - RNA, 19 nt, Homo sapiens
gagaaaaggaccaaaauaa

SEQ ID NO: 498276 - RNA, 19 nt, Homo sapiens
guucagcucuuauucaaca

SEQ ID NO: 498277 - RNA, 19 nt, Homo sapiens
caaagcucaucacguauug

SEQ ID NO: 498278 - RNA, 19 nt, Homo sapiens
agguguaacucaucacuua

SEQ ID NO: 498279 - RNA, 19 nt, Homo sapiens
gaagaauacauccuugaga

SEQ ID NO: 498280 - RNA, 19 nt, Homo sapiens
ccuagaaaguagauuugua

SEQ ID NO: 498281 - RNA, 19 nt, Homo sapiens
gaaacccuaugaauguaau

SEQ ID NO: 498282 - RNA, 19 nt, Homo sapiens
gaaaacccuuguaaguaua

SEQ ID NO: 498283 - RNA, 19 nt, Homo sapiens
uaaagaaugugguaaaucc

SEQ ID NO: 498284 - RNA, 19 nt, Homo sapiens
agacguauaugcuagaugu

SEQ ID NO: 498285 - RNA, 19 nt, Homo sapiens
gauaaaccucagcuauaua

SEQ ID NO: 498286 - RNA, 19 nt, Homo sapiens
cagcaucgaaggauucaua

SEQ ID NO: 498287 - RNA, 19 nt, Homo sapiens
gagaaaccauaucgaugug

SEQ ID NO: 498288 - RNA, 19 nt, Homo sapiens
ggagagaaaccauaucgau

SEQ ID NO: 498289 - RNA, 19 nt, Homo sapiens
cagauaaacgcuauaaaug

SEQ ID NO: 498290 - RNA, 19 nt, Homo sapiens
agagaaacccuaugaaugu

SEQ ID NO: 498291 - RNA, 19 nt, Homo sapiens
gagagaagccuuuuaaaug

SEQ ID NO: 498292 - RNA, 19 nt, Homo sapiens
agagaaacccuacauaugu

SEQ ID NO: 498293 - RNA, 19 nt, Homo sapiens
ccacucaacacuuauuauu

SEQ ID NO: 498294 - RNA, 19 nt, Homo sapiens
uaauagacaccgaaucauu

SEQ ID NO: 498295 - RNA, 19 nt, Homo sapiens
gagaaaagcccuauagaug

SEQ ID NO: 498296 - RNA, 19 nt, Homo sapiens
gaagaaaacccuuguaagu

SEQ ID NO: 498297 - RNA, 19 nt, Homo sapiens
ggaauguaccuugggauuu

SEQ ID NO: 498298 - RNA, 19 nt, Homo sapiens
gcaacaccuuuaagucuag

SEQ ID NO: 498299 - RNA, 19 nt, Homo sapiens
gaacccauacuguggagaa

SEQ ID NO: 498300 - RNA, 19 nt, Homo sapiens
aaacaucuaagaacccaua

SEQ ID NO: 498301 - RNA, 19 nt, Homo sapiens
ccugggagguggagaaaga

SEQ ID NO: 498302 - RNA, 19 nt, Homo sapiens
uggauaaaccucagcuaua

SEQ ID NO: 498303 - RNA, 19 nt, Homo sapiens
gagaagccuuuuaaaugua

SEQ ID NO: 498304 - RNA, 19 nt, Homo sapiens
guaggaaggcaucuaguug

SEQ ID NO: 498305 - RNA, 19 nt, Homo sapiens
cucaguacaucccuuuaua

SEQ ID NO: 498306 - RNA, 19 nt, Homo sapiens
aaagggaaguuuucagaua

SEQ ID NO: 498307 - RNA, 19 nt, Homo sapiens
gaaggcagauuagagaaaa

SEQ ID NO: 498308 - RNA, 19 nt, Homo sapiens
gggaugugaugcuggagaa

SEQ ID NO: 498309 - RNA, 19 nt, Homo sapiens
gggaaaacauucaggugua

SEQ ID NO: 498310 - RNA, 19 nt, Homo sapiens
acagauacuucccagagaa

SEQ ID NO: 498311 - RNA, 19 nt, Homo sapiens
cauauaugaaggcagauua

SEQ ID NO: 498312 - RNA, 19 nt, Homo sapiens
cauaggucaucccuuacua

SEQ ID NO: 498313 - RNA, 19 nt, Homo sapiens
caucacguauugcacauca

SEQ ID NO: 498314 - RNA, 19 nt, Homo sapiens
gaaaagccuuacauauaug

SEQ ID NO: 498315 - RNA, 19 nt, Homo sapiens
ccaaaguucagcucuuauu

SEQ ID NO: 498316 - RNA, 19 nt, Homo sapiens
ggaaaacauucagguguaa

SEQ ID NO: 498317 - RNA, 19 nt, Homo sapiens
gaaaagcccuauagaugca

SEQ ID NO: 498318 - RNA, 19 nt, Homo sapiens
ccaaaguucagcucuuauu

SEQ ID NO: 498319 - RNA, 19 nt, Homo sapiens
agccaaaguucagcucuua

SEQ ID NO: 498320 - RNA, 19 nt, Homo sapiens
guggagaaauccuacagau

SEQ ID NO: 498321 - RNA, 19 nt, Homo sapiens
gaaaagauccaacaggaau

SEQ ID NO: 498322 - RNA, 19 nt, Homo sapiens
guggagagaaacuauuuaa

SEQ ID NO: 498323 - RNA, 19 nt, Homo sapiens
caucagagaauucauacug

SEQ ID NO: 498324 - RNA, 19 nt, Homo sapiens
acucaucacuuaguaauca

SEQ ID NO: 498325 - RNA, 19 nt, Homo sapiens
agaaaacccuuguaaguau

SEQ ID NO: 498326 - RNA, 19 nt, Homo sapiens
gaucaucagaaacagauau

SEQ ID NO: 498327 - RNA, 19 nt, Homo sapiens
uugaagacauugacuuuag

SEQ ID NO: 498328 - RNA, 19 nt, Homo sapiens
uguaacucaucacuuagua

SEQ ID NO: 498329 - RNA, 19 nt, Homo sapiens
gcgaauucauacuggagaa

SEQ ID NO: 498330 - RNA, 19 nt, Homo sapiens
caguacaucccuuuauaaa

SEQ ID NO: 498331 - RNA, 19 nt, Homo sapiens
ugugaaagccuuaaaccaa

SEQ ID NO: 498332 - RNA, 19 nt, Homo sapiens
gguaggaaggcaucuaguu

SEQ ID NO: 498333 - RNA, 19 nt, Homo sapiens
ucaguacaucccuuuauaa

SEQ ID NO: 498334 - RNA, 19 nt, Homo sapiens
aaaccauaguggagagaaa

SEQ ID NO: 498335 - RNA, 19 nt, Homo sapiens
gaaacuccguguagacaaa

SEQ ID NO: 498336 - RNA, 19 nt, Homo sapiens
ggaagaaacuccguguaga

SEQ ID NO: 498337 - RNA, 19 nt, Homo sapiens
ccaaagagccugccuguuc

SEQ ID NO: 498338 - RNA, 19 nt, Homo sapiens
guacuuuggucaauaaugu

SEQ ID NO: 498339 - RNA, 19 nt, Homo sapiens
caagguacuuuggucaaua

SEQ ID NO: 498340 - RNA, 19 nt, Homo sapiens
ggacacaccugcccaugag

SEQ ID NO: 498341 - RNA, 19 nt, Homo sapiens
ggaacuggaugaugagagu

SEQ ID NO: 498342 - RNA, 19 nt, Homo sapiens
uggcggaacuggaugauga

SEQ ID NO: 498343 - RNA, 19 nt, Homo sapiens
gaccacagcagccaaggua

SEQ ID NO: 498344 - RNA, 19 nt, Homo sapiens
ggaguucuacuucauguuc

SEQ ID NO: 498345 - RNA, 19 nt, Homo sapiens
aagguacuuuggucaauaa

SEQ ID NO: 498346 - RNA, 19 nt, Homo sapiens
gaagaaacuccguguagac

SEQ ID NO: 498347 - RNA, 19 nt, Homo sapiens
ggacuuugcugccauuacc

SEQ ID NO: 498348 - RNA, 19 nt, Homo sapiens
ggucacaggcuggaauuga

SEQ ID NO: 498349 - RNA, 19 nt, Homo sapiens
ccucggaaguacccaguga

SEQ ID NO: 498350 - RNA, 19 nt, Homo sapiens
gcaaucggaggaaaucugu

SEQ ID NO: 498351 - RNA, 19 nt, Homo sapiens
gggccgaccugugugaugu

SEQ ID NO: 498352 - RNA, 19 nt, Homo sapiens
ccacacugauccuaaacuc

SEQ ID NO: 498353 - RNA, 19 nt, Homo sapiens
ccacugacucccacuggaa

SEQ ID NO: 498354 - RNA, 19 nt, Homo sapiens
uggccuggguucaguguga

SEQ ID NO: 498355 - RNA, 19 nt, Homo sapiens
caacgcaaucggaggaaau

SEQ ID NO: 498356 - RNA, 19 nt, Homo sapiens
ucaggacuuugcugccauu

SEQ ID NO: 498357 - RNA, 19 nt, Homo sapiens
acacaccugcccaugagua

SEQ ID NO: 498358 - RNA, 19 nt, Homo sapiens
ccucggaguucuacuucau

SEQ ID NO: 498359 - RNA, 19 nt, Homo sapiens
gauccacgccgaacugcau

SEQ ID NO: 498360 - RNA, 19 nt, Homo sapiens
gaggucacaggcuggaauu

SEQ ID NO: 498361 - RNA, 19 nt, Homo sapiens
aggccacacugauccuaaa

SEQ ID NO: 498362 - RNA, 19 nt, Homo sapiens
aggcuggaauugagugaug

SEQ ID NO: 498363 - RNA, 19 nt, Homo sapiens
uuauggagcccaggaagaa

SEQ ID NO: 498364 - RNA, 19 nt, Homo sapiens
gagaccuccugaccuuugg

SEQ ID NO: 498365 - RNA, 19 nt, Homo sapiens
cagcagccaagguacuuug

SEQ ID NO: 498366 - RNA, 19 nt, Homo sapiens
caggaagaaacuccgugua

SEQ ID NO: 498367 - RNA, 19 nt, Homo sapiens
gaaccagccccucggaguu

SEQ ID NO: 498368 - RNA, 19 nt, Homo sapiens
gucacaggcuggaauugag

SEQ ID NO: 498369 - RNA, 19 nt, Homo sapiens
aggaagaaacuccguguag

SEQ ID NO: 498370 - RNA, 19 nt, Homo sapiens
cgccaccgguccuuaugga

SEQ ID NO: 498371 - RNA, 19 nt, Homo sapiens
ucggaguucuacuucaugu

SEQ ID NO: 498372 - RNA, 19 nt, Homo sapiens
gauccuggcuaacgacaaa

SEQ ID NO: 498373 - RNA, 19 nt, Homo sapiens
cgagaacacuuuacaacga

SEQ ID NO: 498374 - RNA, 19 nt, Homo sapiens
ggagaucaauuguacuuac

SEQ ID NO: 498375 - RNA, 19 nt, Homo sapiens
uaacuucuaccgugaauga

SEQ ID NO: 498376 - RNA, 19 nt, Homo sapiens
cagaggagaucaauuguac

SEQ ID NO: 498377 - RNA, 19 nt, Homo sapiens
gcgagccgcuuauguggaa

SEQ ID NO: 498378 - RNA, 19 nt, Homo sapiens
gcaaugcuccucucucugu

SEQ ID NO: 498379 - RNA, 19 nt, Homo sapiens
ugaggcagauccuggcuaa

SEQ ID NO: 498380 - RNA, 19 nt, Homo sapiens
auaagagccuaucaaugua

SEQ ID NO: 498381 - RNA, 19 nt, Homo sapiens
ccaagugcaauauguaauu

SEQ ID NO: 498382 - RNA, 19 nt, Homo sapiens
gaggagaucaauuguacuu

SEQ ID NO: 498383 - RNA, 19 nt, Homo sapiens
agagugaccugaaagaagu

SEQ ID NO: 498384 - RNA, 19 nt, Homo sapiens
uaggauagcugacuuugac

SEQ ID NO: 498385 - RNA, 19 nt, Homo sapiens
gaaaauggauucgaacaag

SEQ ID NO: 498386 - RNA, 19 nt, Homo sapiens
gaggagauucguuuccaaa

SEQ ID NO: 498387 - RNA, 19 nt, Homo sapiens
aaccugacguggcccuuua

SEQ ID NO: 498388 - RNA, 19 nt, Homo sapiens
gagagugaccugaaagaag

SEQ ID NO: 498389 - RNA, 19 nt, Homo sapiens
ggaaugugacggguugaaa

SEQ ID NO: 498390 - RNA, 19 nt, Homo sapiens
ccagaggagaucaauugua

SEQ ID NO: 498391 - RNA, 19 nt, Homo sapiens
gacagucacauuuauaaag

SEQ ID NO: 498392 - RNA, 19 nt, Homo sapiens
gguccaagugcaauaugua

SEQ ID NO: 498393 - RNA, 19 nt, Homo sapiens
uucaagagguggagauguu

SEQ ID NO: 498394 - RNA, 19 nt, Homo sapiens
aaccagaggagaucaauug

SEQ ID NO: 498395 - RNA, 19 nt, Homo sapiens
gcaaggccuucuccagacu

SEQ ID NO: 498396 - RNA, 19 nt, Homo sapiens
ccagcuacaucgcccacuu

SEQ ID NO: 498397 - RNA, 19 nt, Homo sapiens
cgaggagauucguuuccaa

SEQ ID NO: 498398 - RNA, 19 nt, Homo sapiens
cgggaggccucuugguuuc

SEQ ID NO: 498399 - RNA, 19 nt, Homo sapiens
uaagagccuaucaauguau

SEQ ID NO: 498400 - RNA, 19 nt, Homo sapiens
ucgcaaugcuccucucucu

SEQ ID NO: 498401 - RNA, 19 nt, Homo sapiens
guccaagugcaauauguaa

SEQ ID NO: 498402 - RNA, 19 nt, Homo sapiens
uuacaacgacgaggagauu

SEQ ID NO: 498403 - RNA, 19 nt, Homo sapiens
guggagauguuggaaugug

SEQ ID NO: 498404 - RNA, 19 nt, Homo sapiens
gaucauaggauagcugacu

SEQ ID NO: 498405 - RNA, 19 nt, Homo sapiens
gaggugcgagucugggaaa

SEQ ID NO: 498406 - RNA, 19 nt, Homo sapiens
ugacguggcccuuuauggu

SEQ ID NO: 498407 - RNA, 19 nt, Homo sapiens
ggcagauccuggcuaacga

SEQ ID NO: 498408 - RNA, 19 nt, Homo sapiens
uggagauguuggaauguga

SEQ ID NO: 498409 - RNA, 19 nt, Homo sapiens
cgagagugaccugaaagaa

SEQ ID NO: 498410 - RNA, 19 nt, Homo sapiens
agguggagauguuggaaug

SEQ ID NO: 498411 - RNA, 19 nt, Homo sapiens
ucgggaggccucuugguuu

SEQ ID NO: 498412 - RNA, 19 nt, Homo sapiens
caaccugacguggcccuuu

SEQ ID NO: 498413 - RNA, 19 nt, Homo sapiens
gagcuccaacugcgagaau

SEQ ID NO: 498414 - RNA, 19 nt, Homo sapiens
gaaugugacggguugaaaa

SEQ ID NO: 498415 - RNA, 19 nt, Homo sapiens
uacgagaacggguacauuc

SEQ ID NO: 498416 - RNA, 19 nt, Homo sapiens
gauagcugacuuugacagu

SEQ ID NO: 498417 - RNA, 19 nt, Homo sapiens
aaauggauucgaacaagga

SEQ ID NO: 498418 - RNA, 19 nt, Homo sapiens
gguugaaaauggauucgaa

SEQ ID NO: 498419 - RNA, 19 nt, Homo sapiens
ucauaggauagcugacuuu

SEQ ID NO: 498420 - RNA, 19 nt, Homo sapiens
caaaccagaggagaucaau

SEQ ID NO: 498421 - RNA, 19 nt, Homo sapiens
ggaggccucuugguuucag

SEQ ID NO: 498422 - RNA, 19 nt, Homo sapiens
ggaagagaacguugacaua

SEQ ID NO: 498423 - RNA, 19 nt, Homo sapiens
ucacagaagagcuuaauuu

SEQ ID NO: 498424 - RNA, 19 nt, Homo sapiens
ucacguaccuucaucacuu

SEQ ID NO: 498425 - RNA, 19 nt, Homo sapiens
agaagcagguucauaagaa

SEQ ID NO: 498426 - RNA, 19 nt, Homo sapiens
cagaagagcuuaauuuacg

SEQ ID NO: 498427 - RNA, 19 nt, Homo sapiens
cauuagaacuacaagauga

SEQ ID NO: 498428 - RNA, 19 nt, Homo sapiens
guacauuacugcccaugga

SEQ ID NO: 498429 - RNA, 19 nt, Homo sapiens
gcucgagccuucaagauca

SEQ ID NO: 498430 - RNA, 19 nt, Homo sapiens
cacagaagagcuuaauuua

SEQ ID NO: 498431 - RNA, 19 nt, Homo sapiens
gaagagaacguugacauag

SEQ ID NO: 498432 - RNA, 19 nt, Homo sapiens
ggaggaagaugaguucuac

SEQ ID NO: 498433 - RNA, 19 nt, Homo sapiens
agagaacguugacauagaa

SEQ ID NO: 498434 - RNA, 19 nt, Homo sapiens
gaagcagguucauaagaag

SEQ ID NO: 498435 - RNA, 19 nt, Homo sapiens
cauaaucaccuaucauuca

SEQ ID NO: 498436 - RNA, 19 nt, Homo sapiens
cgugaggucuguccaguga

SEQ ID NO: 498437 - RNA, 19 nt, Homo sapiens
gaacguugacauagaagga

SEQ ID NO: 498438 - RNA, 19 nt, Homo sapiens
gcagaagagccaagaagga

SEQ ID NO: 498439 - RNA, 19 nt, Homo sapiens
gaucuuugccuaaucuguu

SEQ ID NO: 498440 - RNA, 19 nt, Homo sapiens
aagagaacguugacauaga

SEQ ID NO: 498441 - RNA, 19 nt, Homo sapiens
uacggucacuggagacaua

SEQ ID NO: 498442 - RNA, 19 nt, Homo sapiens
ggacucugacuuugacauu

SEQ ID NO: 498443 - RNA, 19 nt, Homo sapiens
ugaugcaacuuucgaggaa

SEQ ID NO: 498444 - RNA, 19 nt, Homo sapiens
aaaagaagcagguucauaa

SEQ ID NO: 498445 - RNA, 19 nt, Homo sapiens
caccaaggccuauaaggaa

SEQ ID NO: 498446 - RNA, 19 nt, Homo sapiens
uaaaugaagagaugucuag

SEQ ID NO: 498447 - RNA, 19 nt, Homo sapiens
gccagaaaauugucauuaa

SEQ ID NO: 498448 - RNA, 19 nt, Homo sapiens
ugacauagaaggacuugau

SEQ ID NO: 498449 - RNA, 19 nt, Homo sapiens
caagaucacagaagagcuu

SEQ ID NO: 498450 - RNA, 19 nt, Homo sapiens
gagcauacacgacaaacgu

SEQ ID NO: 498451 - RNA, 19 nt, Homo sapiens
ccugcucgcugcucacgua

SEQ ID NO: 498452 - RNA, 19 nt, Homo sapiens
cagaagagccaagaaggaa

SEQ ID NO: 498453 - RNA, 19 nt, Homo sapiens
gaugucuaguccucagaaa

SEQ ID NO: 498454 - RNA, 19 nt, Homo sapiens
ucaccaaggccuauaagga

SEQ ID NO: 498455 - RNA, 19 nt, Homo sapiens
ccaaggaagagaacguuga

SEQ ID NO: 498456 - RNA, 19 nt, Homo sapiens
acucugacuuugacauuga

SEQ ID NO: 498457 - RNA, 19 nt, Homo sapiens
gcuuacaagaaguacauua

SEQ ID NO: 498458 - RNA, 19 nt, Homo sapiens
gaucacagaagagcuuaau

SEQ ID NO: 498459 - RNA, 19 nt, Homo sapiens
caagaugacggcucugaca

SEQ ID NO: 498460 - RNA, 19 nt, Homo sapiens
gaaggaagcgccgaguagu

SEQ ID NO: 498461 - RNA, 19 nt, Homo sapiens
uuacagguuucguuguguu

SEQ ID NO: 498462 - RNA, 19 nt, Homo sapiens
ugucaucucugaucuuugc

SEQ ID NO: 498463 - RNA, 19 nt, Homo sapiens
gccauuagaacuacaagau

SEQ ID NO: 498464 - RNA, 19 nt, Homo sapiens
gguaggcgguaugaguuug

SEQ ID NO: 498465 - RNA, 19 nt, Homo sapiens
cacguaccuucaucacuuu

SEQ ID NO: 498466 - RNA, 19 nt, Homo sapiens
aggccaagaucacagaaga

SEQ ID NO: 498467 - RNA, 19 nt, Homo sapiens
gcacuacugccauuagaac

SEQ ID NO: 498468 - RNA, 19 nt, Homo sapiens
uauaaggaaccucucaaga

SEQ ID NO: 498469 - RNA, 19 nt, Homo sapiens
uuagugaugaugcaacuuu

SEQ ID NO: 498470 - RNA, 19 nt, Homo sapiens
ggucacuggagacauauga

SEQ ID NO: 498471 - RNA, 19 nt, Homo sapiens
gagaagagaaggcacuacu

SEQ ID NO: 498472 - RNA, 19 nt, Homo sapiens
ucucugaucuuugccuaau

SEQ ID NO: 498473 - RNA, 19 nt, Homo sapiens
cccauaaucaccuaucauu

SEQ ID NO: 498474 - RNA, 19 nt, Homo sapiens
cuucuuuccugcccugauu

SEQ ID NO: 498475 - RNA, 19 nt, Homo sapiens
uuugucaucucugaucuuu

SEQ ID NO: 498476 - RNA, 19 nt, Homo sapiens
gagcuuaaggccucgaaag

SEQ ID NO: 498477 - RNA, 19 nt, Homo sapiens
gaagcagaagagccaagaa

SEQ ID NO: 498478 - RNA, 19 nt, Homo sapiens
agacacagaggacgaagug

SEQ ID NO: 498479 - RNA, 19 nt, Homo sapiens
aggacgaaguggacucuga

SEQ ID NO: 498480 - RNA, 19 nt, Homo sapiens
gacucugacuuugacauug

SEQ ID NO: 498481 - RNA, 19 nt, Homo sapiens
aggcagaggaggaagauga

SEQ ID NO: 498482 - RNA, 19 nt, Homo sapiens
auccggagaugaugaguau

SEQ ID NO: 498483 - RNA, 19 nt, Homo sapiens
cccuaguucuuacagguuu

SEQ ID NO: 498484 - RNA, 19 nt, Homo sapiens
ugccuaaucuguuucuuuu

SEQ ID NO: 498485 - RNA, 19 nt, Homo sapiens
ggcucuugcuguuccguuu

SEQ ID NO: 498486 - RNA, 19 nt, Homo sapiens
cagaggaggaagaugaguu

SEQ ID NO: 498487 - RNA, 19 nt, Homo sapiens
caacuuucgaggaaugguu

SEQ ID NO: 498488 - RNA, 19 nt, Homo sapiens
aagaagcagguucauaaga

SEQ ID NO: 498489 - RNA, 19 nt, Homo sapiens
ucuuacagguuucguugug

SEQ ID NO: 498490 - RNA, 19 nt, Homo sapiens
ugacuuugacauugaugaa

SEQ ID NO: 498491 - RNA, 19 nt, Homo sapiens
agaggaauccggagaugau

SEQ ID NO: 498492 - RNA, 19 nt, Homo sapiens
gaucauucgugaggcuuac

SEQ ID NO: 498493 - RNA, 19 nt, Homo sapiens
ggcccauaaucaccuauca

SEQ ID NO: 498494 - RNA, 19 nt, Homo sapiens
ucagaaggcgcgagaagag

SEQ ID NO: 498495 - RNA, 19 nt, Homo sapiens
acagaggaauccggagaug

SEQ ID NO: 498496 - RNA, 19 nt, Homo sapiens
gugaggcuuacaagaagua

SEQ ID NO: 498497 - RNA, 19 nt, Homo sapiens
ccauuagaacuacaagaug

SEQ ID NO: 498498 - RNA, 19 nt, Homo sapiens
agaaggaagcgccgaguag

SEQ ID NO: 498499 - RNA, 19 nt, Homo sapiens
gcugggaaccggcuuucug

SEQ ID NO: 498500 - RNA, 19 nt, Homo sapiens
cuacugccauuagaacuac

SEQ ID NO: 498501 - RNA, 19 nt, Homo sapiens
agaaggcgcgagaagagaa

SEQ ID NO: 498502 - RNA, 19 nt, Homo sapiens
gauuggggcucuugcuguu

SEQ ID NO: 498503 - RNA, 19 nt, Homo sapiens
ucgugaggcuuacaagaag

SEQ ID NO: 498504 - RNA, 19 nt, Homo sapiens
gaugcaacuuucgaggaau

SEQ ID NO: 498505 - RNA, 19 nt, Homo sapiens
gcugagcauacacgacaaa

SEQ ID NO: 498506 - RNA, 19 nt, Homo sapiens
ucugaucuuugccuaaucu

SEQ ID NO: 498507 - RNA, 19 nt, Homo sapiens
ggaauccggagaugaugag

SEQ ID NO: 498508 - RNA, 19 nt, Homo sapiens
acagaagagcuuaauuuac

SEQ ID NO: 498509 - RNA, 19 nt, Homo sapiens
aagaaggaagcgccgagua

SEQ ID NO: 498510 - RNA, 19 nt, Homo sapiens
gcgagaagagaaggcacua

SEQ ID NO: 498511 - RNA, 19 nt, Homo sapiens
ccauaaucaccuaucauuc

SEQ ID NO: 498512 - RNA, 19 nt, Homo sapiens
ggaggcagaggaggaagau

SEQ ID NO: 498513 - RNA, 19 nt, Homo sapiens
guagucaccaaggccuaua

SEQ ID NO: 498514 - RNA, 19 nt, Homo sapiens
aaacguuccuucggguaca

SEQ ID NO: 498515 - RNA, 19 nt, Homo sapiens
gacauagaaggacuugauc

SEQ ID NO: 498516 - RNA, 19 nt, Homo sapiens
gggaggccaagaucacaga

SEQ ID NO: 498517 - RNA, 19 nt, Homo sapiens
gaagagagcuccacuuaca

SEQ ID NO: 498518 - RNA, 19 nt, Homo sapiens
ugugaaagcuucugauuaa

SEQ ID NO: 498519 - RNA, 19 nt, Homo sapiens
gaaaguagcaggaacaaca

SEQ ID NO: 498520 - RNA, 19 nt, Homo sapiens
gagcuccacuuacaaagaa

SEQ ID NO: 498521 - RNA, 19 nt, Homo sapiens
cagcaggacuucuccauug

SEQ ID NO: 498522 - RNA, 19 nt, Homo sapiens
ggagacaagugaaugagau

SEQ ID NO: 498523 - RNA, 19 nt, Homo sapiens
gcaaagccaucguucuaca

SEQ ID NO: 498524 - RNA, 19 nt, Homo sapiens
caucauggauucccuguuc

SEQ ID NO: 498525 - RNA, 19 nt, Homo sapiens
cuaaagaucaugaaaguga

SEQ ID NO: 498526 - RNA, 19 nt, Homo sapiens
ccaaaugcuuuccuuuaga

SEQ ID NO: 498527 - RNA, 19 nt, Homo sapiens
caaaugcuuuccuuuagau

SEQ ID NO: 498528 - RNA, 19 nt, Homo sapiens
gccaaaugcuuuccuuuag

SEQ ID NO: 498529 - RNA, 19 nt, Homo sapiens
gcagagggcagguauaaca

SEQ ID NO: 498530 - RNA, 19 nt, Homo sapiens
cagcaaagccaucguucua

SEQ ID NO: 498531 - RNA, 19 nt, Homo sapiens
guuccaagucuaaauguua

SEQ ID NO: 498532 - RNA, 19 nt, Homo sapiens
caagguagccagugcaaga

SEQ ID NO: 498533 - RNA, 19 nt, Homo sapiens
gaaaagcguacaaaagaua

SEQ ID NO: 498534 - RNA, 19 nt, Homo sapiens
uuugauaucuggcagguuu

SEQ ID NO: 498535 - RNA, 19 nt, Homo sapiens
cuacauagauuuggaaacu

SEQ ID NO: 498536 - RNA, 19 nt, Homo sapiens
gagaggcuaugaugaccuu

SEQ ID NO: 498537 - RNA, 19 nt, Homo sapiens
ggguauccuucaaguauug

SEQ ID NO: 498538 - RNA, 19 nt, Homo sapiens
ugacugcucugcuuaaagg

SEQ ID NO: 498539 - RNA, 19 nt, Homo sapiens
cuacugcaauuuagacaau

SEQ ID NO: 498540 - RNA, 19 nt, Homo sapiens
gauuucugcucaugaucua

SEQ ID NO: 498541 - RNA, 19 nt, Homo sapiens
aggaagagagcuccacuua

SEQ ID NO: 498542 - RNA, 19 nt, Homo sapiens
ugagaugucaccaggauaa

SEQ ID NO: 498543 - RNA, 19 nt, Homo sapiens
ggaggagguguccacguua

SEQ ID NO: 498544 - RNA, 19 nt, Homo sapiens
uacccuaguucuccaaauu

SEQ ID NO: 498545 - RNA, 19 nt, Homo sapiens
aaagaccauugacuacauu

SEQ ID NO: 498546 - RNA, 19 nt, Homo sapiens
caacaaaagccaaccaaaa

SEQ ID NO: 498547 - RNA, 19 nt, Homo sapiens
agacaucucacucuucuga

SEQ ID NO: 498548 - RNA, 19 nt, Homo sapiens
ggaucgaggagcacuguaa

SEQ ID NO: 498549 - RNA, 19 nt, Homo sapiens
ccugucaguuuaugauauu

SEQ ID NO: 498550 - RNA, 19 nt, Homo sapiens
ucuguagccugacaagaaa

SEQ ID NO: 498551 - RNA, 19 nt, Homo sapiens
gaacugcuucuugcucuug

SEQ ID NO: 498552 - RNA, 19 nt, Homo sapiens
cuaaauaccaaugcaguuu

SEQ ID NO: 498553 - RNA, 19 nt, Homo sapiens
ccaacuuccuccugugaga

SEQ ID NO: 498554 - RNA, 19 nt, Homo sapiens
ugccaaaugcuuuccuuua

SEQ ID NO: 498555 - RNA, 19 nt, Homo sapiens
ucucagcccuuuauucaag

SEQ ID NO: 498556 - RNA, 19 nt, Homo sapiens
cuucaaguauugcaucaga

SEQ ID NO: 498557 - RNA, 19 nt, Homo sapiens
agaguaagaggaaauauuc

SEQ ID NO: 498558 - RNA, 19 nt, Homo sapiens
gaugucaccgcccuaaaga

SEQ ID NO: 498559 - RNA, 19 nt, Homo sapiens
ggagugugacguuguaauc

SEQ ID NO: 498560 - RNA, 19 nt, Homo sapiens
ucaagcuacugcaauuuag

SEQ ID NO: 498561 - RNA, 19 nt, Homo sapiens
gcagcaggacuucuccauu

SEQ ID NO: 498562 - RNA, 19 nt, Homo sapiens
caagagaggcuaugaugac

SEQ ID NO: 498563 - RNA, 19 nt, Homo sapiens
caggugaggccaaggcuuu

SEQ ID NO: 498564 - RNA, 19 nt, Homo sapiens
ggagaacagccaacaagag

SEQ ID NO: 498565 - RNA, 19 nt, Homo sapiens
ggucaaguucaacguguuu

SEQ ID NO: 498566 - RNA, 19 nt, Homo sapiens
gaucaugaaagugaacuau

SEQ ID NO: 498567 - RNA, 19 nt, Homo sapiens
cccuaaagaucaugaaagu

SEQ ID NO: 498568 - RNA, 19 nt, Homo sapiens
gagggacgccaucaagaga

SEQ ID NO: 498569 - RNA, 19 nt, Homo sapiens
gaggagguguccacguuac

SEQ ID NO: 498570 - RNA, 19 nt, Homo sapiens
aggaggagguguccacguu

SEQ ID NO: 498571 - RNA, 19 nt, Homo sapiens
gagacagggagacaaguga

SEQ ID NO: 498572 - RNA, 19 nt, Homo sapiens
ccucugcucugggugguaa

SEQ ID NO: 498573 - RNA, 19 nt, Homo sapiens
ccucucagcccuuuauuca

SEQ ID NO: 498574 - RNA, 19 nt, Homo sapiens
aaugagaugucaccaggau

SEQ ID NO: 498575 - RNA, 19 nt, Homo sapiens
cagaugaugaggacaguga

SEQ ID NO: 498576 - RNA, 19 nt, Homo sapiens
gugaaaagcguacaaaaga

SEQ ID NO: 498577 - RNA, 19 nt, Homo sapiens
agagagcuccacuuacaaa

SEQ ID NO: 498578 - RNA, 19 nt, Homo sapiens
guaguguccagagcuaaua

SEQ ID NO: 498579 - RNA, 19 nt, Homo sapiens
cucaagcuacugcaauuua

SEQ ID NO: 498580 - RNA, 19 nt, Homo sapiens
gcauuucucccaggacuug

SEQ ID NO: 498581 - RNA, 19 nt, Homo sapiens
caaguuugggcaacauuug

SEQ ID NO: 498582 - RNA, 19 nt, Homo sapiens
ccgggagacuggacuacaa

SEQ ID NO: 498583 - RNA, 19 nt, Homo sapiens
ggaugucaccgcccuaaag

SEQ ID NO: 498584 - RNA, 19 nt, Homo sapiens
ggagggacgccaucaagag

SEQ ID NO: 498585 - RNA, 19 nt, Homo sapiens
gccugucaguuuaugauau

SEQ ID NO: 498586 - RNA, 19 nt, Homo sapiens
gggaagcaaagaaggaaga

SEQ ID NO: 498587 - RNA, 19 nt, Homo sapiens
acaagugaaugagauguca

SEQ ID NO: 498588 - RNA, 19 nt, Homo sapiens
uggcagagggcagguauaa

SEQ ID NO: 498589 - RNA, 19 nt, Homo sapiens
gaugaugaggacagugauu

SEQ ID NO: 498590 - RNA, 19 nt, Homo sapiens
ucaagagaggcuaugauga

SEQ ID NO: 498591 - RNA, 19 nt, Homo sapiens
ggaagagagcuccacuuac

SEQ ID NO: 498592 - RNA, 19 nt, Homo sapiens
ccacagggaagcaaagaag

SEQ ID NO: 498593 - RNA, 19 nt, Homo sapiens
uccaaaugcucguuuuaua

SEQ ID NO: 498594 - RNA, 19 nt, Homo sapiens
gaggagggacgccaucaag

SEQ ID NO: 498595 - RNA, 19 nt, Homo sapiens
uagcaggaacaacaacaaa

SEQ ID NO: 498596 - RNA, 19 nt, Homo sapiens
gugaaagcuucugauuaau

SEQ ID NO: 498597 - RNA, 19 nt, Homo sapiens
gaacuaugagcagauugug

SEQ ID NO: 498598 - RNA, 19 nt, Homo sapiens
gcucagcaaagccaucguu

SEQ ID NO: 498599 - RNA, 19 nt, Homo sapiens
aaagccaucguucuacaaa

SEQ ID NO: 498600 - RNA, 19 nt, Homo sapiens
ggucugggagugugacguu

SEQ ID NO: 498601 - RNA, 19 nt, Homo sapiens
caaagccaucguucuacaa

SEQ ID NO: 498602 - RNA, 19 nt, Homo sapiens
ccugacugcucugcuuaaa

SEQ ID NO: 498603 - RNA, 19 nt, Homo sapiens
gucuaaauguuaaccucaa

SEQ ID NO: 498604 - RNA, 19 nt, Homo sapiens
guuugacuauccagaggaa

SEQ ID NO: 498605 - RNA, 19 nt, Homo sapiens
gggucaagguggaguaugc

SEQ ID NO: 498606 - RNA, 19 nt, Homo sapiens
gagacaagugaaugagaug

SEQ ID NO: 498607 - RNA, 19 nt, Homo sapiens
gggagacaagugaaugaga

SEQ ID NO: 498608 - RNA, 19 nt, Homo sapiens
gugugacguuguaaucuuc

SEQ ID NO: 498609 - RNA, 19 nt, Homo sapiens
ggugaaaguagcaggaaca

SEQ ID NO: 498610 - RNA, 19 nt, Homo sapiens
ucucaguguugccugcauu

SEQ ID NO: 498611 - RNA, 19 nt, Homo sapiens
aaaucacccuuucugucaa

SEQ ID NO: 498612 - RNA, 19 nt, Homo sapiens
uauucaagccucagauuuc

SEQ ID NO: 498613 - RNA, 19 nt, Homo sapiens
ucacacuggucagcugguu

SEQ ID NO: 498614 - RNA, 19 nt, Homo sapiens
acuaugagcagauugugaa

SEQ ID NO: 498615 - RNA, 19 nt, Homo sapiens
cugggagugugacguugua

SEQ ID NO: 498616 - RNA, 19 nt, Homo sapiens
guagcaggaacaacaacaa

SEQ ID NO: 498617 - RNA, 19 nt, Homo sapiens
gaagagagcuccacuuaca

SEQ ID NO: 498618 - RNA, 19 nt, Homo sapiens
ugugaaagcuucugauuaa

SEQ ID NO: 498619 - RNA, 19 nt, Homo sapiens
gaaaguagcaggaacaaca

SEQ ID NO: 498620 - RNA, 19 nt, Homo sapiens
gagcuccacuuacaaagaa

SEQ ID NO: 498621 - RNA, 19 nt, Homo sapiens
cagcaggacuucuccauug

SEQ ID NO: 498622 - RNA, 19 nt, Homo sapiens
ggagacaagugaaugagau

SEQ ID NO: 498623 - RNA, 19 nt, Homo sapiens
gcaaagccaucguucuaca

SEQ ID NO: 498624 - RNA, 19 nt, Homo sapiens
caucauggauucccuguuc

SEQ ID NO: 498625 - RNA, 19 nt, Homo sapiens
cuaaagaucaugaaaguga

SEQ ID NO: 498626 - RNA, 19 nt, Homo sapiens
ccaaaugcuuuccuuuaga

SEQ ID NO: 498627 - RNA, 19 nt, Homo sapiens
caaaugcuuuccuuuagau

SEQ ID NO: 498628 - RNA, 19 nt, Homo sapiens
gccaaaugcuuuccuuuag

SEQ ID NO: 498629 - RNA, 19 nt, Homo sapiens
gcagagggcagguauaaca

SEQ ID NO: 498630 - RNA, 19 nt, Homo sapiens
cagcaaagccaucguucua

SEQ ID NO: 498631 - RNA, 19 nt, Homo sapiens
guuccaagucuaaauguua

SEQ ID NO: 498632 - RNA, 19 nt, Homo sapiens
caagguagccagugcaaga

SEQ ID NO: 498633 - RNA, 19 nt, Homo sapiens
gaaaagcguacaaaagaua

SEQ ID NO: 498634 - RNA, 19 nt, Homo sapiens
uuugauaucuggcagguuu

SEQ ID NO: 498635 - RNA, 19 nt, Homo sapiens
cuacauagauuuggaaacu

SEQ ID NO: 498636 - RNA, 19 nt, Homo sapiens
gagaggcuaugaugaccuu

SEQ ID NO: 498637 - RNA, 19 nt, Homo sapiens
ggguauccuucaaguauug

SEQ ID NO: 498638 - RNA, 19 nt, Homo sapiens
ugacugcucugcuuaaagg

SEQ ID NO: 498639 - RNA, 19 nt, Homo sapiens
cuacugcaauuuagacaau

SEQ ID NO: 498640 - RNA, 19 nt, Homo sapiens
gauuucugcucaugaucua

SEQ ID NO: 498641 - RNA, 19 nt, Homo sapiens
aggaagagagcuccacuua

SEQ ID NO: 498642 - RNA, 19 nt, Homo sapiens
ugagaugucaccaggauaa

SEQ ID NO: 498643 - RNA, 19 nt, Homo sapiens
ggaggagguguccacguua

SEQ ID NO: 498644 - RNA, 19 nt, Homo sapiens
uacccuaguucuccaaauu

SEQ ID NO: 498645 - RNA, 19 nt, Homo sapiens
aaagaccauugacuacauu

SEQ ID NO: 498646 - RNA, 19 nt, Homo sapiens
caacaaaagccaaccaaaa

SEQ ID NO: 498647 - RNA, 19 nt, Homo sapiens
agacaucucacucuucuga

SEQ ID NO: 498648 - RNA, 19 nt, Homo sapiens
ggaucgaggagcacuguaa

SEQ ID NO: 498649 - RNA, 19 nt, Homo sapiens
ccugucaguuuaugauauu

SEQ ID NO: 498650 - RNA, 19 nt, Homo sapiens
ucuguagccugacaagaaa

SEQ ID NO: 498651 - RNA, 19 nt, Homo sapiens
gaacugcuucuugcucuug

SEQ ID NO: 498652 - RNA, 19 nt, Homo sapiens
cuaaauaccaaugcaguuu

SEQ ID NO: 498653 - RNA, 19 nt, Homo sapiens
ccaacuuccuccugugaga

SEQ ID NO: 498654 - RNA, 19 nt, Homo sapiens
ugccaaaugcuuuccuuua

SEQ ID NO: 498655 - RNA, 19 nt, Homo sapiens
ucucagcccuuuauucaag

SEQ ID NO: 498656 - RNA, 19 nt, Homo sapiens
cuucaaguauugcaucaga

SEQ ID NO: 498657 - RNA, 19 nt, Homo sapiens
agaguaagaggaaauauuc

SEQ ID NO: 498658 - RNA, 19 nt, Homo sapiens
gaugucaccgcccuaaaga

SEQ ID NO: 498659 - RNA, 19 nt, Homo sapiens
ggagugugacguuguaauc

SEQ ID NO: 498660 - RNA, 19 nt, Homo sapiens
ucaagcuacugcaauuuag

SEQ ID NO: 498661 - RNA, 19 nt, Homo sapiens
gcagcaggacuucuccauu

SEQ ID NO: 498662 - RNA, 19 nt, Homo sapiens
caagagaggcuaugaugac

SEQ ID NO: 498663 - RNA, 19 nt, Homo sapiens
caggugaggccaaggcuuu

SEQ ID NO: 498664 - RNA, 19 nt, Homo sapiens
ggagaacagccaacaagag

SEQ ID NO: 498665 - RNA, 19 nt, Homo sapiens
ggucaaguucaacguguuu

SEQ ID NO: 498666 - RNA, 19 nt, Homo sapiens
gaucaugaaagugaacuau

SEQ ID NO: 498667 - RNA, 19 nt, Homo sapiens
cccuaaagaucaugaaagu

SEQ ID NO: 498668 - RNA, 19 nt, Homo sapiens
gagggacgccaucaagaga

SEQ ID NO: 498669 - RNA, 19 nt, Homo sapiens
gaggagguguccacguuac

SEQ ID NO: 498670 - RNA, 19 nt, Homo sapiens
aggaggagguguccacguu

SEQ ID NO: 498671 - RNA, 19 nt, Homo sapiens
gagacagggagacaaguga

SEQ ID NO: 498672 - RNA, 19 nt, Homo sapiens
ccucugcucugggugguaa

SEQ ID NO: 498673 - RNA, 19 nt, Homo sapiens
ccucucagcccuuuauuca

SEQ ID NO: 498674 - RNA, 19 nt, Homo sapiens
aaugagaugucaccaggau

SEQ ID NO: 498675 - RNA, 19 nt, Homo sapiens
cagaugaugaggacaguga

SEQ ID NO: 498676 - RNA, 19 nt, Homo sapiens
gugaaaagcguacaaaaga

SEQ ID NO: 498677 - RNA, 19 nt, Homo sapiens
agagagcuccacuuacaaa

SEQ ID NO: 498678 - RNA, 19 nt, Homo sapiens
ggagggacgccaucaagag

SEQ ID NO: 498679 - RNA, 19 nt, Homo sapiens
cucaagcuacugcaauuua

SEQ ID NO: 498680 - RNA, 19 nt, Homo sapiens
gcauuucucccaggacuug

SEQ ID NO: 498681 - RNA, 19 nt, Homo sapiens
caaguuugggcaacauuug

SEQ ID NO: 498682 - RNA, 19 nt, Homo sapiens
ccgggagacuggacuacaa

SEQ ID NO: 498683 - RNA, 19 nt, Homo sapiens
ggaugucaccgcccuaaag

SEQ ID NO: 498684 - RNA, 19 nt, Homo sapiens
guaguguccagagcuaaua

SEQ ID NO: 498685 - RNA, 19 nt, Homo sapiens
gugccaagguggaguaugc

SEQ ID NO: 498686 - RNA, 19 nt, Homo sapiens
gccugucaguuuaugauau

SEQ ID NO: 498687 - RNA, 19 nt, Homo sapiens
gggaagcaaagaaggaaga

SEQ ID NO: 498688 - RNA, 19 nt, Homo sapiens
acaagugaaugagauguca

SEQ ID NO: 498689 - RNA, 19 nt, Homo sapiens
uggcagagggcagguauaa

SEQ ID NO: 498690 - RNA, 19 nt, Homo sapiens
ucaagagaggcuaugauga

SEQ ID NO: 498691 - RNA, 19 nt, Homo sapiens
gaugaugaggacagugauu

SEQ ID NO: 498692 - RNA, 19 nt, Homo sapiens
ggaagagagcuccacuuac

SEQ ID NO: 498693 - RNA, 19 nt, Homo sapiens
ccacagggaagcaaagaag

SEQ ID NO: 498694 - RNA, 19 nt, Homo sapiens
uccaaaugcucguuuuaua

SEQ ID NO: 498695 - RNA, 19 nt, Homo sapiens
gaggagggacgccaucaag

SEQ ID NO: 498696 - RNA, 19 nt, Homo sapiens
uagcaggaacaacaacaaa

SEQ ID NO: 498697 - RNA, 19 nt, Homo sapiens
gugaaagcuucugauuaau

SEQ ID NO: 498698 - RNA, 19 nt, Homo sapiens
gaacuaugagcagauugug

SEQ ID NO: 498699 - RNA, 19 nt, Homo sapiens
aaagccaucguucuacaaa

SEQ ID NO: 498700 - RNA, 19 nt, Homo sapiens
gcucagcaaagccaucguu

SEQ ID NO: 498701 - RNA, 19 nt, Homo sapiens
ggucugggagugugacguu

SEQ ID NO: 498702 - RNA, 19 nt, Homo sapiens
caaagccaucguucuacaa

SEQ ID NO: 498703 - RNA, 19 nt, Homo sapiens
ccugacugcucugcuuaaa

SEQ ID NO: 498704 - RNA, 19 nt, Homo sapiens
gucuaaauguuaaccucaa

SEQ ID NO: 498705 - RNA, 19 nt, Homo sapiens
guuugacuauccagaggaa

SEQ ID NO: 498706 - RNA, 19 nt, Homo sapiens
gagacaagugaaugagaug

SEQ ID NO: 498707 - RNA, 19 nt, Homo sapiens
gggagacaagugaaugaga

SEQ ID NO: 498708 - RNA, 19 nt, Homo sapiens
gugugacguuguaaucuuc

SEQ ID NO: 498709 - RNA, 19 nt, Homo sapiens
ggugaaaguagcaggaaca

SEQ ID NO: 498710 - RNA, 19 nt, Homo sapiens
ucucaguguugccugcauu

SEQ ID NO: 498711 - RNA, 19 nt, Homo sapiens
aaaucacccuuucugucaa

SEQ ID NO: 498712 - RNA, 19 nt, Homo sapiens
uauucaagccucagauuuc

SEQ ID NO: 498713 - RNA, 19 nt, Homo sapiens
ucacacuggucagcugguu

SEQ ID NO: 498714 - RNA, 19 nt, Homo sapiens
acuaugagcagauugugaa

SEQ ID NO: 498715 - RNA, 19 nt, Homo sapiens
cugggagugugacguugua

SEQ ID NO: 498716 - RNA, 19 nt, Homo sapiens
guagcaggaacaacaacaa

SEQ ID NO: 498717 - RNA, 19 nt, Homo sapiens
gaagagagcuccacuuaca

SEQ ID NO: 498718 - RNA, 19 nt, Homo sapiens
ugugaaagcuucugauuaa

SEQ ID NO: 498719 - RNA, 19 nt, Homo sapiens
gaaaguagcaggaacaaca

SEQ ID NO: 498720 - RNA, 19 nt, Homo sapiens
gagcuccacuuacaaagaa

SEQ ID NO: 498721 - RNA, 19 nt, Homo sapiens
cagcaggacuucuccauug

SEQ ID NO: 498722 - RNA, 19 nt, Homo sapiens
ggagacaagugaaugagau

SEQ ID NO: 498723 - RNA, 19 nt, Homo sapiens
gcaaagccaucguucuaca

SEQ ID NO: 498724 - RNA, 19 nt, Homo sapiens
caucauggauucccuguuc

SEQ ID NO: 498725 - RNA, 19 nt, Homo sapiens
cuaaagaucaugaaaguga

SEQ ID NO: 498726 - RNA, 19 nt, Homo sapiens
ccaaaugcuuuccuuuaga

SEQ ID NO: 498727 - RNA, 19 nt, Homo sapiens
caaaugcuuuccuuuagau

SEQ ID NO: 498728 - RNA, 19 nt, Homo sapiens
gccaaaugcuuuccuuuag

SEQ ID NO: 498729 - RNA, 19 nt, Homo sapiens
gcagagggcagguauaaca

SEQ ID NO: 498730 - RNA, 19 nt, Homo sapiens
cagcaaagccaucguucua

SEQ ID NO: 498731 - RNA, 19 nt, Homo sapiens
guuccaagucuaaauguua

SEQ ID NO: 498732 - RNA, 19 nt, Homo sapiens
caagguagccagugcaaga

SEQ ID NO: 498733 - RNA, 19 nt, Homo sapiens
gaaaagcguacaaaagaua

SEQ ID NO: 498734 - RNA, 19 nt, Homo sapiens
uuugauaucuggcagguuu

SEQ ID NO: 498735 - RNA, 19 nt, Homo sapiens
cuacauagauuuggaaacu

SEQ ID NO: 498736 - RNA, 19 nt, Homo sapiens
gagaggcuaugaugaccuu

SEQ ID NO: 498737 - RNA, 19 nt, Homo sapiens
ggguauccuucaaguauug

SEQ ID NO: 498738 - RNA, 19 nt, Homo sapiens
ugacugcucugcuuaaagg

SEQ ID NO: 498739 - RNA, 19 nt, Homo sapiens
cuacugcaauuuagacaau

SEQ ID NO: 498740 - RNA, 19 nt, Homo sapiens
gauuucugcucaugaucua

SEQ ID NO: 498741 - RNA, 19 nt, Homo sapiens
aggaagagagcuccacuua

SEQ ID NO: 498742 - RNA, 19 nt, Homo sapiens
ugagaugucaccaggauaa

SEQ ID NO: 498743 - RNA, 19 nt, Homo sapiens
ggaggagguguccacguua

SEQ ID NO: 498744 - RNA, 19 nt, Homo sapiens
uacccuaguucuccaaauu

SEQ ID NO: 498745 - RNA, 19 nt, Homo sapiens
aaagaccauugacuacauu

SEQ ID NO: 498746 - RNA, 19 nt, Homo sapiens
caacaaaagccaaccaaaa

SEQ ID NO: 498747 - RNA, 19 nt, Homo sapiens
agacaucucacucuucuga

SEQ ID NO: 498748 - RNA, 19 nt, Homo sapiens
ggaucgaggagcacuguaa

SEQ ID NO: 498749 - RNA, 19 nt, Homo sapiens
ccugucaguuuaugauauu

SEQ ID NO: 498750 - RNA, 19 nt, Homo sapiens
ucuguagccugacaagaaa

SEQ ID NO: 498751 - RNA, 19 nt, Homo sapiens
gaacugcuucuugcucuug

SEQ ID NO: 498752 - RNA, 19 nt, Homo sapiens
cuaaauaccaaugcaguuu

SEQ ID NO: 498753 - RNA, 19 nt, Homo sapiens
ccaacuuccuccugugaga

SEQ ID NO: 498754 - RNA, 19 nt, Homo sapiens
ugccaaaugcuuuccuuua

SEQ ID NO: 498755 - RNA, 19 nt, Homo sapiens
ucucagcccuuuauucaag

SEQ ID NO: 498756 - RNA, 19 nt, Homo sapiens
cuucaaguauugcaucaga

SEQ ID NO: 498757 - RNA, 19 nt, Homo sapiens
agaguaagaggaaauauuc

SEQ ID NO: 498758 - RNA, 19 nt, Homo sapiens
gaugucaccgcccuaaaga

SEQ ID NO: 498759 - RNA, 19 nt, Homo sapiens
ggagugugacguuguaauc

SEQ ID NO: 498760 - RNA, 19 nt, Homo sapiens
ucaagcuacugcaauuuag

SEQ ID NO: 498761 - RNA, 19 nt, Homo sapiens
caagagaggcuaugaugac

SEQ ID NO: 498762 - RNA, 19 nt, Homo sapiens
gcagcaggacuucuccauu

SEQ ID NO: 498763 - RNA, 19 nt, Homo sapiens
gagggacgccaucaagaga

SEQ ID NO: 498764 - RNA, 19 nt, Homo sapiens
caggugaggccaaggcuuu

SEQ ID NO: 498765 - RNA, 19 nt, Homo sapiens
ggagaacagccaacaagag

SEQ ID NO: 498766 - RNA, 19 nt, Homo sapiens
ggucaaguucaacguguuu

SEQ ID NO: 498767 - RNA, 19 nt, Homo sapiens
gaucaugaaagugaacuau

SEQ ID NO: 498768 - RNA, 19 nt, Homo sapiens
cccuaaagaucaugaaagu

SEQ ID NO: 498769 - RNA, 19 nt, Homo sapiens
gaggagguguccacguuac

SEQ ID NO: 498770 - RNA, 19 nt, Homo sapiens
aggaggagguguccacguu

SEQ ID NO: 498771 - RNA, 19 nt, Homo sapiens
gagacagggagacaaguga

SEQ ID NO: 498772 - RNA, 19 nt, Homo sapiens
ccucugcucugggugguaa

SEQ ID NO: 498773 - RNA, 19 nt, Homo sapiens
ccucucagcccuuuauuca

SEQ ID NO: 498774 - RNA, 19 nt, Homo sapiens
aaugagaugucaccaggau

SEQ ID NO: 498775 - RNA, 19 nt, Homo sapiens
gugaaaagcguacaaaaga

SEQ ID NO: 498776 - RNA, 19 nt, Homo sapiens
agagagcuccacuuacaaa

SEQ ID NO: 498777 - RNA, 19 nt, Homo sapiens
cucaagcuacugcaauuua

SEQ ID NO: 498778 - RNA, 19 nt, Homo sapiens
gcauuucucccaggacuug

SEQ ID NO: 498779 - RNA, 19 nt, Homo sapiens
ggagggacgccaucaagag

SEQ ID NO: 498780 - RNA, 19 nt, Homo sapiens
caaguuugggcaacauuug

SEQ ID NO: 498781 - RNA, 19 nt, Homo sapiens
ccgggagacuggacuacaa

SEQ ID NO: 498782 - RNA, 19 nt, Homo sapiens
ggaugucaccgcccuaaag

SEQ ID NO: 498783 - RNA, 19 nt, Homo sapiens
gccugucaguuuaugauau

SEQ ID NO: 498784 - RNA, 19 nt, Homo sapiens
gggaagcaaagaaggaaga

SEQ ID NO: 498785 - RNA, 19 nt, Homo sapiens
acaagugaaugagauguca

SEQ ID NO: 498786 - RNA, 19 nt, Homo sapiens
uggcagagggcagguauaa

SEQ ID NO: 498787 - RNA, 19 nt, Homo sapiens
gaugaugaggacagugauu

SEQ ID NO: 498788 - RNA, 19 nt, Homo sapiens
ucaagagaggcuaugauga

SEQ ID NO: 498789 - RNA, 19 nt, Homo sapiens
gaggagggacgccaucaag

SEQ ID NO: 498790 - RNA, 19 nt, Homo sapiens
ggaagagagcuccacuuac

SEQ ID NO: 498791 - RNA, 19 nt, Homo sapiens
ccacagggaagcaaagaag

SEQ ID NO: 498792 - RNA, 19 nt, Homo sapiens
uccaaaugcucguuuuaua

SEQ ID NO: 498793 - RNA, 19 nt, Homo sapiens
uagcaggaacaacaacaaa

SEQ ID NO: 498794 - RNA, 19 nt, Homo sapiens
gugaaagcuucugauuaau

SEQ ID NO: 498795 - RNA, 19 nt, Homo sapiens
gaacuaugagcagauugug

SEQ ID NO: 498796 - RNA, 19 nt, Homo sapiens
aaagccaucguucuacaaa

SEQ ID NO: 498797 - RNA, 19 nt, Homo sapiens
gcucagcaaagccaucguu

SEQ ID NO: 498798 - RNA, 19 nt, Homo sapiens
caaagccaucguucuacaa

SEQ ID NO: 498799 - RNA, 19 nt, Homo sapiens
ggucugggagugugacguu

SEQ ID NO: 498800 - RNA, 19 nt, Homo sapiens
ccugacugcucugcuuaaa

SEQ ID NO: 498801 - RNA, 19 nt, Homo sapiens
gucuaaauguuaaccucaa

SEQ ID NO: 498802 - RNA, 19 nt, Homo sapiens
guuugacuauccagaggaa

SEQ ID NO: 498803 - RNA, 19 nt, Homo sapiens
gggucaagguggaguaugc

SEQ ID NO: 498804 - RNA, 19 nt, Homo sapiens
gagacaagugaaugagaug

SEQ ID NO: 498805 - RNA, 19 nt, Homo sapiens
gggagacaagugaaugaga

SEQ ID NO: 498806 - RNA, 19 nt, Homo sapiens
gugugacguuguaaucuuc

SEQ ID NO: 498807 - RNA, 19 nt, Homo sapiens
ggugaaaguagcaggaaca

SEQ ID NO: 498808 - RNA, 19 nt, Homo sapiens
ucucaguguugccugcauu

SEQ ID NO: 498809 - RNA, 19 nt, Homo sapiens
aaaucacccuuucugucaa

SEQ ID NO: 498810 - RNA, 19 nt, Homo sapiens
uauucaagccucagauuuc

SEQ ID NO: 498811 - RNA, 19 nt, Homo sapiens
ucacacuggucagcugguu

SEQ ID NO: 498812 - RNA, 19 nt, Homo sapiens
acuaugagcagauugugaa

SEQ ID NO: 498813 - RNA, 19 nt, Homo sapiens
cugggagugugacguugua

SEQ ID NO: 498814 - RNA, 19 nt, Homo sapiens
guagcaggaacaacaacaa

SEQ ID NO: 498815 - RNA, 19 nt, Homo sapiens
caagcuacugcaauuuaga

SEQ ID NO: 498816 - RNA, 19 nt, Homo sapiens
gacuauccagaggaaauua

SEQ ID NO: 498817 - RNA, 19 nt, Homo sapiens
gcccaucacuuaauaaaua

SEQ ID NO: 498818 - RNA, 19 nt, Homo sapiens
gagcuugccuugauuauac

SEQ ID NO: 498819 - RNA, 19 nt, Homo sapiens
gaaggcaguuuaaagaaca

SEQ ID NO: 498820 - RNA, 19 nt, Homo sapiens
ggucuuaccugcccugaug

SEQ ID NO: 498821 - RNA, 19 nt, Homo sapiens
gagguucgcuggagcaaau

SEQ ID NO: 498822 - RNA, 19 nt, Homo sapiens
ccaaggagcugguaguuac

SEQ ID NO: 498823 - RNA, 19 nt, Homo sapiens
gaugaaggcaguuuaaaga

SEQ ID NO: 498824 - RNA, 19 nt, Homo sapiens
ggaguuccauguuuauugu

SEQ ID NO: 498825 - RNA, 19 nt, Homo sapiens
gcuaaaugguucugucuuc

SEQ ID NO: 498826 - RNA, 19 nt, Homo sapiens
ucauauaucuccgucaauu

SEQ ID NO: 498827 - RNA, 19 nt, Homo sapiens
gugaagaagagucuaauaa

SEQ ID NO: 498828 - RNA, 19 nt, Homo sapiens
gcagaugaaggcaguuuaa

SEQ ID NO: 498829 - RNA, 19 nt, Homo sapiens
ggagagcuugccuugauua

SEQ ID NO: 498830 - RNA, 19 nt, Homo sapiens
gcucugaccugugugaaga

SEQ ID NO: 498831 - RNA, 19 nt, Homo sapiens
ucagguaacuucaacaucu

SEQ ID NO: 498832 - RNA, 19 nt, Homo sapiens
cuaauaagcccaaacuuuc

SEQ ID NO: 498833 - RNA, 19 nt, Homo sapiens
auacaaugauccagucaaa

SEQ ID NO: 498834 - RNA, 19 nt, Homo sapiens
auaaauagccagccaauuc

SEQ ID NO: 498835 - RNA, 19 nt, Homo sapiens
ugacuggaauugccaacaa

SEQ ID NO: 498836 - RNA, 19 nt, Homo sapiens
caaugucacugugcuaaau

SEQ ID NO: 498837 - RNA, 19 nt, Homo sapiens
cgggagagcuugccuugau

SEQ ID NO: 498838 - RNA, 19 nt, Homo sapiens
ccaacaaacucugaauaca

SEQ ID NO: 498839 - RNA, 19 nt, Homo sapiens
agaagagucuaauaaaugg

SEQ ID NO: 498840 - RNA, 19 nt, Homo sapiens
aaccagcgcugucaauguu

SEQ ID NO: 498841 - RNA, 19 nt, Homo sapiens
gaaccagcgcugucaaugu

SEQ ID NO: 498842 - RNA, 19 nt, Homo sapiens
aaaccucuguugaauacaa

SEQ ID NO: 498843 - RNA, 19 nt, Homo sapiens
caaggagcauucagcaauc

SEQ ID NO: 498844 - RNA, 19 nt, Homo sapiens
gcacuccccugacuaacua

SEQ ID NO: 498845 - RNA, 19 nt, Homo sapiens
aaucauauaucuccgucaa

SEQ ID NO: 498846 - RNA, 19 nt, Homo sapiens
auacagugcucacggaaau

SEQ ID NO: 498847 - RNA, 19 nt, Homo sapiens
gggagagcuugccuugauu

SEQ ID NO: 498848 - RNA, 19 nt, Homo sapiens
acuaauaagcccaaacuuu

SEQ ID NO: 498849 - RNA, 19 nt, Homo sapiens
gggccuaugugccaacaau

SEQ ID NO: 498850 - RNA, 19 nt, Homo sapiens
ggcccuauaucaccuguau

SEQ ID NO: 498851 - RNA, 19 nt, Homo sapiens
gaaaagauucugucugaga

SEQ ID NO: 498852 - RNA, 19 nt, Homo sapiens
gcagaucaaagcagaugaa

SEQ ID NO: 498853 - RNA, 19 nt, Homo sapiens
guacacuguuggagagaug

SEQ ID NO: 498854 - RNA, 19 nt, Homo sapiens
cauauaucuccgucaauua

SEQ ID NO: 498855 - RNA, 19 nt, Homo sapiens
ggagaaagcccagaaaaug

SEQ ID NO: 498856 - RNA, 19 nt, Homo sapiens
ucaaggagcauucagcaau

SEQ ID NO: 498857 - RNA, 19 nt, Homo sapiens
gacuggaauugccaacaaa

SEQ ID NO: 498858 - RNA, 19 nt, Homo sapiens
uaaauagccagccaauuca

SEQ ID NO: 498859 - RNA, 19 nt, Homo sapiens
caacaaacucugaauacag

SEQ ID NO: 498860 - RNA, 19 nt, Homo sapiens
ccucaaacuuguuggaauc

SEQ ID NO: 498861 - RNA, 19 nt, Homo sapiens
caauuacucugugagaauc

SEQ ID NO: 498862 - RNA, 19 nt, Homo sapiens
aguacgagcaggagaguua

SEQ ID NO: 498863 - RNA, 19 nt, Homo sapiens
aacaaacucugaauacagu

SEQ ID NO: 498864 - RNA, 19 nt, Homo sapiens
uaaaaccucuguugaauac

SEQ ID NO: 498865 - RNA, 19 nt, Homo sapiens
cuacucaaccgccgaaguu

SEQ ID NO: 498866 - RNA, 19 nt, Homo sapiens
ucgacaagcuagaaaauaa

SEQ ID NO: 498867 - RNA, 19 nt, Homo sapiens
caaaagaugauccaacaaa

SEQ ID NO: 498868 - RNA, 19 nt, Homo sapiens
gccaaggagcugguaguua

SEQ ID NO: 498869 - RNA, 19 nt, Homo sapiens
gagaaagcccagaaaauga

SEQ ID NO: 498870 - RNA, 19 nt, Homo sapiens
ugugacaccuccugacuca

SEQ ID NO: 498871 - RNA, 19 nt, Homo sapiens
cugaugagccuauaacugu

SEQ ID NO: 498872 - RNA, 19 nt, Homo sapiens
uaccugcccugaugggaaa

SEQ ID NO: 498873 - RNA, 19 nt, Homo sapiens
ugaaggcaguuuaaagaac

SEQ ID NO: 498874 - RNA, 19 nt, Homo sapiens
gccuaugugccaacaauaa

SEQ ID NO: 498875 - RNA, 19 nt, Homo sapiens
gguagccaguucucaguag

SEQ ID NO: 498876 - RNA, 19 nt, Homo sapiens
gcuggagcaaauacuaaua

SEQ ID NO: 498877 - RNA, 19 nt, Homo sapiens
ucaauuacucugugagaau

SEQ ID NO: 498878 - RNA, 19 nt, Homo sapiens
caugcaggcccucuuugua

SEQ ID NO: 498879 - RNA, 19 nt, Homo sapiens
guagccaguucucaguaga

SEQ ID NO: 498880 - RNA, 19 nt, Homo sapiens
aaaagcagauugucagaug

SEQ ID NO: 498881 - RNA, 19 nt, Homo sapiens
gaugagccuauaacuguga

SEQ ID NO: 498882 - RNA, 19 nt, Homo sapiens
ggaauugccaacaaacucu

SEQ ID NO: 498883 - RNA, 19 nt, Homo sapiens
uaaaugggcagaucaaagc

SEQ ID NO: 498884 - RNA, 19 nt, Homo sapiens
ccuuaugccuucuucuuca

SEQ ID NO: 498885 - RNA, 19 nt, Homo sapiens
agaccuucuuggauauuaa

SEQ ID NO: 498886 - RNA, 19 nt, Homo sapiens
gagcauucagcaauccaaa

SEQ ID NO: 498887 - RNA, 19 nt, Homo sapiens
ucuaauaaaugggcagauc

SEQ ID NO: 498888 - RNA, 19 nt, Homo sapiens
cagcucagccuggacguuu

SEQ ID NO: 498889 - RNA, 19 nt, Homo sapiens
ggaaccagcgcugucaaug

SEQ ID NO: 498890 - RNA, 19 nt, Homo sapiens
cgagcaggagaguuaauaa

SEQ ID NO: 498891 - RNA, 19 nt, Homo sapiens
cacggaaauuucucaagga

SEQ ID NO: 498892 - RNA, 19 nt, Homo sapiens
gauccaaacccugaugcaa

SEQ ID NO: 498893 - RNA, 19 nt, Homo sapiens
caaugauccagucaaacua

SEQ ID NO: 498894 - RNA, 19 nt, Homo sapiens
uaugccuucuucuucauuu

SEQ ID NO: 498895 - RNA, 19 nt, Homo sapiens
gauggagaaagcccagaaa

SEQ ID NO: 498896 - RNA, 19 nt, Homo sapiens
gucaauuacucugugagaa

SEQ ID NO: 498897 - RNA, 19 nt, Homo sapiens
uaauaaaugggcagaucaa

SEQ ID NO: 498898 - RNA, 19 nt, Homo sapiens
gccaauucaucaacauucu

SEQ ID NO: 498899 - RNA, 19 nt, Homo sapiens
ccauguuuauuguccuuau

SEQ ID NO: 498900 - RNA, 19 nt, Homo sapiens
caacuaugcgagauuugug

SEQ ID NO: 498901 - RNA, 19 nt, Homo sapiens
gccaacaaacucugaauac

SEQ ID NO: 498902 - RNA, 19 nt, Homo sapiens
aagcagauugucagaugua

SEQ ID NO: 498903 - RNA, 19 nt, Homo sapiens
aaagaugauccaacaaauc

SEQ ID NO: 498904 - RNA, 19 nt, Homo sapiens
ucugugagaaucaaugaaa

SEQ ID NO: 498905 - RNA, 19 nt, Homo sapiens
uaauaaauagccagccaau

SEQ ID NO: 498906 - RNA, 19 nt, Homo sapiens
cgagauuugugagguaagu

SEQ ID NO: 498907 - RNA, 19 nt, Homo sapiens
gaaaacuacauccgccuaa

SEQ ID NO: 498908 - RNA, 19 nt, Homo sapiens
ugaccugugugaagaagag

SEQ ID NO: 498909 - RNA, 19 nt, Homo sapiens
cucucuacauguucaauaa

SEQ ID NO: 498910 - RNA, 19 nt, Homo sapiens
cuggagcaaauacuaauaa

SEQ ID NO: 498911 - RNA, 19 nt, Homo sapiens
ccaaugucacugugcuaaa

SEQ ID NO: 498912 - RNA, 19 nt, Homo sapiens
ugacaccuccugacucaca

SEQ ID NO: 498913 - RNA, 19 nt, Homo sapiens
agccaguucucaguagaua

SEQ ID NO: 498914 - RNA, 19 nt, Homo sapiens
ccuugugucuguucaaugg

SEQ ID NO: 498915 - RNA, 19 nt, Homo sapiens
gcuuugggaguaugucgua

SEQ ID NO: 498916 - RNA, 19 nt, Homo sapiens
gauccaacaaaucaaauac

SEQ ID NO: 498917 - RNA, 19 nt, Homo sapiens
gaagaaggcccaugaguua

SEQ ID NO: 498918 - RNA, 19 nt, Homo sapiens
ccagaaugcucucaugauu

SEQ ID NO: 498919 - RNA, 19 nt, Homo sapiens
gcauuacaguuccucauga

SEQ ID NO: 498920 - RNA, 19 nt, Homo sapiens
ucucacagcucaaaugguu

SEQ ID NO: 498921 - RNA, 19 nt, Homo sapiens
gcucuccacucugcuguua

SEQ ID NO: 498922 - RNA, 19 nt, Homo sapiens
uggaagauguccugaagaa

SEQ ID NO: 498923 - RNA, 19 nt, Homo sapiens
caagagaucaucaguguca

SEQ ID NO: 498924 - RNA, 19 nt, Homo sapiens
agaaugcucucaugauuuc

SEQ ID NO: 498925 - RNA, 19 nt, Homo sapiens
ccaggagucuuucccgauu

SEQ ID NO: 498926 - RNA, 19 nt, Homo sapiens
cccaagagaucaucagugu

SEQ ID NO: 498927 - RNA, 19 nt, Homo sapiens
uugcaggcauggaggauua

SEQ ID NO: 498928 - RNA, 19 nt, Homo sapiens
cacaagaccuacauugauc

SEQ ID NO: 498929 - RNA, 19 nt, Homo sapiens
uaggaggauucacauauga

SEQ ID NO: 498930 - RNA, 19 nt, Homo sapiens
ugaagaaggcccaugaguu

SEQ ID NO: 498931 - RNA, 19 nt, Homo sapiens
ggacagccaucugguagag

SEQ ID NO: 498932 - RNA, 19 nt, Homo sapiens
gcaggugcuuagucucuug

SEQ ID NO: 498933 - RNA, 19 nt, Homo sapiens
ccacaagaccuacauugau

SEQ ID NO: 498934 - RNA, 19 nt, Homo sapiens
gcagagagccaagcaucuu

SEQ ID NO: 498935 - RNA, 19 nt, Homo sapiens
cuacuuaaccuccgugaug

SEQ ID NO: 498936 - RNA, 19 nt, Homo sapiens
gggacaggcuggucucaca

SEQ ID NO: 498937 - RNA, 19 nt, Homo sapiens
cagcaccucuuaccuugga

SEQ ID NO: 498938 - RNA, 19 nt, Homo sapiens
gaaggcccaugaguuagga

SEQ ID NO: 498939 - RNA, 19 nt, Homo sapiens
cagaaugcucucaugauuu

SEQ ID NO: 498940 - RNA, 19 nt, Homo sapiens
gaacagugcgagaggagau

SEQ ID NO: 498941 - RNA, 19 nt, Homo sapiens
uuaggaggauucacauaug

SEQ ID NO: 498942 - RNA, 19 nt, Homo sapiens
ggacaaacuucuguaugcu

SEQ ID NO: 498943 - RNA, 19 nt, Homo sapiens
guuaggaggauucacauau

SEQ ID NO: 498944 - RNA, 19 nt, Homo sapiens
gaaccacaagaccuacauu

SEQ ID NO: 498945 - RNA, 19 nt, Homo sapiens
uguaugcuguggaaccuuu

SEQ ID NO: 498946 - RNA, 19 nt, Homo sapiens
gggaacagcaugucucaag

SEQ ID NO: 498947 - RNA, 19 nt, Homo sapiens
ugagaugugugaaauacca

SEQ ID NO: 498948 - RNA, 19 nt, Homo sapiens
guacagacaguccaucucu

SEQ ID NO: 498949 - RNA, 19 nt, Homo sapiens
gcauggaggauuaaucagu

SEQ ID NO: 498950 - RNA, 19 nt, Homo sapiens
acagccaucugguagagaa

SEQ ID NO: 498951 - RNA, 19 nt, Homo sapiens
gcaugaagcaucucagacu

SEQ ID NO: 498952 - RNA, 19 nt, Homo sapiens
cguggaagauguccugaag

SEQ ID NO: 498953 - RNA, 19 nt, Homo sapiens
ggucggagacaacggauca

SEQ ID NO: 498954 - RNA, 19 nt, Homo sapiens
gaugagaagagagccauug

SEQ ID NO: 498955 - RNA, 19 nt, Homo sapiens
ggaccaaggaagaccucua

SEQ ID NO: 498956 - RNA, 19 nt, Homo sapiens
ucaaggcgaggguugcuuu

SEQ ID NO: 498957 - RNA, 19 nt, Homo sapiens
ggagacaacggaucaccau

SEQ ID NO: 498958 - RNA, 19 nt, Homo sapiens
uggacaaacuucuguaugc

SEQ ID NO: 498959 - RNA, 19 nt, Homo sapiens
gagggccacuuugggaaug

SEQ ID NO: 498960 - RNA, 19 nt, Homo sapiens
agagagccauugggcauga

SEQ ID NO: 498961 - RNA, 19 nt, Homo sapiens
ggccgcagguguugugaag

SEQ ID NO: 498962 - RNA, 19 nt, Homo sapiens
ucuccacucugcuguuaga

SEQ ID NO: 498963 - RNA, 19 nt, Homo sapiens
gggcaugaagcaucucaga

SEQ ID NO: 498964 - RNA, 19 nt, Homo sapiens
agaccuacauugaucugau

SEQ ID NO: 498965 - RNA, 19 nt, Homo sapiens
uacaguuccucaugacuuc

SEQ ID NO: 498966 - RNA, 19 nt, Homo sapiens
cugcaggucucccaugaag

SEQ ID NO: 498967 - RNA, 19 nt, Homo sapiens
caccuccugugcacuuuga

SEQ ID NO: 498968 - RNA, 19 nt, Homo sapiens
ggccagcaccucuuaccuu

SEQ ID NO: 498969 - RNA, 19 nt, Homo sapiens
gaacugggaacagcauguc

SEQ ID NO: 498970 - RNA, 19 nt, Homo sapiens
agguauugcugacuacaga

SEQ ID NO: 498971 - RNA, 19 nt, Homo sapiens
ugaguuaggaggauucaca

SEQ ID NO: 498972 - RNA, 19 nt, Homo sapiens
gaccaaggaagaccucuac

SEQ ID NO: 498973 - RNA, 19 nt, Homo sapiens
gugaagaccacucguucug

SEQ ID NO: 498974 - RNA, 19 nt, Homo sapiens
uaccauggcccaccuugga

SEQ ID NO: 498975 - RNA, 19 nt, Homo sapiens
gccaucugguagagaaguu

SEQ ID NO: 498976 - RNA, 19 nt, Homo sapiens
ggcauuacaguuccucaug

SEQ ID NO: 498977 - RNA, 19 nt, Homo sapiens
guugggccagcaccucuua

SEQ ID NO: 498978 - RNA, 19 nt, Homo sapiens
caccacgagucauguugga

SEQ ID NO: 498979 - RNA, 19 nt, Homo sapiens
uuacaguuccucaugacuu

SEQ ID NO: 498980 - RNA, 19 nt, Homo sapiens
gcccaugaguuaggaggau

SEQ ID NO: 498981 - RNA, 19 nt, Homo sapiens
gcagaacugggaacagcau

SEQ ID NO: 498982 - RNA, 19 nt, Homo sapiens
gacaggaagcugcgucucu

SEQ ID NO: 498983 - RNA, 19 nt, Homo sapiens
caccauggccaucagaaca

SEQ ID NO: 498984 - RNA, 19 nt, Homo sapiens
ccauugggcaugaucacaa

SEQ ID NO: 498985 - RNA, 19 nt, Homo sapiens
ccgcagguguugugaagac

SEQ ID NO: 498986 - RNA, 19 nt, Homo sapiens
acugagaugugugaaauac

SEQ ID NO: 498987 - RNA, 19 nt, Homo sapiens
ggcuuucccuggagcacuu

SEQ ID NO: 498988 - RNA, 19 nt, Homo sapiens
aggcauggaggauuaauca

SEQ ID NO: 498989 - RNA, 19 nt, Homo sapiens
gguggacaaacuucuguau

SEQ ID NO: 498990 - RNA, 19 nt, Homo sapiens
ccuggaggaugagaagaga

SEQ ID NO: 498991 - RNA, 19 nt, Homo sapiens
ugaggcugguuagcuggua

SEQ ID NO: 498992 - RNA, 19 nt, Homo sapiens
cuacagacccaaggaugga

SEQ ID NO: 498993 - RNA, 19 nt, Homo sapiens
cagaagcggguccaugaca

SEQ ID NO: 498994 - RNA, 19 nt, Homo sapiens
caggagucuuucccgauuc

SEQ ID NO: 498995 - RNA, 19 nt, Homo sapiens
gaucaccauggccaucaga

SEQ ID NO: 498996 - RNA, 19 nt, Homo sapiens
agacuuagccgugcauugc

SEQ ID NO: 498997 - RNA, 19 nt, Homo sapiens
ccucagacccaagagauca

SEQ ID NO: 498998 - RNA, 19 nt, Homo sapiens
gagucuuucccgauucuug

SEQ ID NO: 498999 - RNA, 19 nt, Homo sapiens
cccauuggcauuacaguuc

SEQ ID NO: 499000 - RNA, 19 nt, Homo sapiens
ugacagcgugguggacaaa

SEQ ID NO: 499001 - RNA, 19 nt, Homo sapiens
accagaagcggguccauga

SEQ ID NO: 499002 - RNA, 19 nt, Homo sapiens
ggucucacagcucaaaugg

SEQ ID NO: 499003 - RNA, 19 nt, Homo sapiens
gcagagcccucagcaaaua

SEQ ID NO: 499004 - RNA, 19 nt, Homo sapiens
gaagaaauccgacaagaga

SEQ ID NO: 499005 - RNA, 19 nt, Homo sapiens
gauaucagauggcaagaaa

SEQ ID NO: 499006 - RNA, 19 nt, Homo sapiens
ggaaaggccuccaggugaa

SEQ ID NO: 499007 - RNA, 19 nt, Homo sapiens
gguuggaacuaaacuguua

SEQ ID NO: 499008 - RNA, 19 nt, Homo sapiens
ggaaucagauagugaggaa

SEQ ID NO: 499009 - RNA, 19 nt, Homo sapiens
gcaagaaggagaagaagaa

SEQ ID NO: 499010 - RNA, 19 nt, Homo sapiens
ccacucaggugucaaagaa

SEQ ID NO: 499011 - RNA, 19 nt, Homo sapiens
gaucaaagcaacccaaaga

SEQ ID NO: 499012 - RNA, 19 nt, Homo sapiens
gaaaagaccuccacgacuu

SEQ ID NO: 499013 - RNA, 19 nt, Homo sapiens
caacacaggacgcuucaua

SEQ ID NO: 499014 - RNA, 19 nt, Homo sapiens
ugacugagcugcuggaaca

SEQ ID NO: 499015 - RNA, 19 nt, Homo sapiens
uaagugaccuccucuccuu

SEQ ID NO: 499016 - RNA, 19 nt, Homo sapiens
gaggaggacucaagaagca

SEQ ID NO: 499017 - RNA, 19 nt, Homo sapiens
agacagacguggagguaaa

SEQ ID NO: 499018 - RNA, 19 nt, Homo sapiens
cagcagagcccucagcaaa

SEQ ID NO: 499019 - RNA, 19 nt, Homo sapiens
acaggacgcuucauauaga

SEQ ID NO: 499020 - RNA, 19 nt, Homo sapiens
gcaaagagagacaaagcaa

SEQ ID NO: 499021 - RNA, 19 nt, Homo sapiens
gcaacaaaccucagagcuu

SEQ ID NO: 499022 - RNA, 19 nt, Homo sapiens
aaccaaagauucugaguca

SEQ ID NO: 499023 - RNA, 19 nt, Homo sapiens
gaaagcaaagagagacaaa

SEQ ID NO: 499024 - RNA, 19 nt, Homo sapiens
acacaggacgcuucauaua

SEQ ID NO: 499025 - RNA, 19 nt, Homo sapiens
ggagcaagaagaagaagaa

SEQ ID NO: 499026 - RNA, 19 nt, Homo sapiens
gcagaggauucuucaagca

SEQ ID NO: 499027 - RNA, 19 nt, Homo sapiens
gaaugcagcucaggugaag

SEQ ID NO: 499028 - RNA, 19 nt, Homo sapiens
agagaaagcuggcaagacu

SEQ ID NO: 499029 - RNA, 19 nt, Homo sapiens
caccauggguuggaacuaa

SEQ ID NO: 499030 - RNA, 19 nt, Homo sapiens
gagcagagcggccagaagu

SEQ ID NO: 499031 - RNA, 19 nt, Homo sapiens
uauacacacuggcaacaaa

SEQ ID NO: 499032 - RNA, 19 nt, Homo sapiens
ccaaaggccucgggacuuc

SEQ ID NO: 499033 - RNA, 19 nt, Homo sapiens
ggaaucagacagugaggaa

SEQ ID NO: 499034 - RNA, 19 nt, Homo sapiens
gcagugaggaggaaucaga

SEQ ID NO: 499035 - RNA, 19 nt, Homo sapiens
ggaacuaaacuguuaccuu

SEQ ID NO: 499036 - RNA, 19 nt, Homo sapiens
caaagcaaguggugauguc

SEQ ID NO: 499037 - RNA, 19 nt, Homo sapiens
ggaccaacaagcucagaaa

SEQ ID NO: 499038 - RNA, 19 nt, Homo sapiens
ccagaacaguaccgucuug

SEQ ID NO: 499039 - RNA, 19 nt, Homo sapiens
gcagugaggaggagucaga

SEQ ID NO: 499040 - RNA, 19 nt, Homo sapiens
cagcaucugugccaucugu

SEQ ID NO: 499041 - RNA, 19 nt, Homo sapiens
gcaccaggcacagggauuu

SEQ ID NO: 499042 - RNA, 19 nt, Homo sapiens
cagcagagcagacuguaug

SEQ ID NO: 499043 - RNA, 19 nt, Homo sapiens
gcaagaagaagaagaagcu

SEQ ID NO: 499044 - RNA, 19 nt, Homo sapiens
caaggaguccagucggaua

SEQ ID NO: 499045 - RNA, 19 nt, Homo sapiens
gggaagacccaccagauca

SEQ ID NO: 499046 - RNA, 19 nt, Homo sapiens
ccagagcaccuucagcaaa

SEQ ID NO: 499047 - RNA, 19 nt, Homo sapiens
gaaaaccucaguaaagaaa

SEQ ID NO: 499048 - RNA, 19 nt, Homo sapiens
gcagcgaggagucaucuga

SEQ ID NO: 499049 - RNA, 19 nt, Homo sapiens
guggugaugucaaggagaa

SEQ ID NO: 499050 - RNA, 19 nt, Homo sapiens
ggaagacgguggccaaccu

SEQ ID NO: 499051 - RNA, 19 nt, Homo sapiens
aagaagaaauccgacaaga

SEQ ID NO: 499052 - RNA, 19 nt, Homo sapiens
gaagaagaaauccgacaag

SEQ ID NO: 499053 - RNA, 19 nt, Homo sapiens
gaacacucccugcaacaag

SEQ ID NO: 499054 - RNA, 19 nt, Homo sapiens
gaagguccucgcccagaaa

SEQ ID NO: 499055 - RNA, 19 nt, Homo sapiens
guagugaggagucaucaga

SEQ ID NO: 499056 - RNA, 19 nt, Homo sapiens
ucauauagauguguacagu

SEQ ID NO: 499057 - RNA, 19 nt, Homo sapiens
ccaauucccaggccucaaa

SEQ ID NO: 499058 - RNA, 19 nt, Homo sapiens
ugaagguccucgcccagaa

SEQ ID NO: 499059 - RNA, 19 nt, Homo sapiens
gaacauccuccaggccaaa

SEQ ID NO: 499060 - RNA, 19 nt, Homo sapiens
ccaucaagcaugaaagaaa

SEQ ID NO: 499061 - RNA, 19 nt, Homo sapiens
cgccaaagaugacccagau

SEQ ID NO: 499062 - RNA, 19 nt, Homo sapiens
uaacccuucuggacaucua

SEQ ID NO: 499063 - RNA, 19 nt, Homo sapiens
ggaagaggaggaagaagca

SEQ ID NO: 499064 - RNA, 19 nt, Homo sapiens
ccaccuugcuccacagauc

SEQ ID NO: 499065 - RNA, 19 nt, Homo sapiens
ggaguccagucggauauca

SEQ ID NO: 499066 - RNA, 19 nt, Homo sapiens
gaaaggccuccaggugaaa

SEQ ID NO: 499067 - RNA, 19 nt, Homo sapiens
gcagugaggaaucagauag

SEQ ID NO: 499068 - RNA, 19 nt, Homo sapiens
gaccaaggccugcccaaag

SEQ ID NO: 499069 - RNA, 19 nt, Homo sapiens
caaagagcaagaaggagaa

SEQ ID NO: 499070 - RNA, 19 nt, Homo sapiens
gcaccacaccucagaaguc

SEQ ID NO: 499071 - RNA, 19 nt, Homo sapiens
uaaaacagguggaaaagag

SEQ ID NO: 499072 - RNA, 19 nt, Homo sapiens
gugaaaaccucaguaaaga

SEQ ID NO: 499073 - RNA, 19 nt, Homo sapiens
gcaggaggaggacucaaga

SEQ ID NO: 499074 - RNA, 19 nt, Homo sapiens
ggaagaugcggcacugcaa

SEQ ID NO: 499075 - RNA, 19 nt, Homo sapiens
caucaagcaugaaagaaaa

SEQ ID NO: 499076 - RNA, 19 nt, Homo sapiens
agaaggagaagaagaaauc

SEQ ID NO: 499077 - RNA, 19 nt, Homo sapiens
gagcaguagugaggaguca

SEQ ID NO: 499078 - RNA, 19 nt, Homo sapiens
gagaucaaagcaacccaaa

SEQ ID NO: 499079 - RNA, 19 nt, Homo sapiens
aaaaccagcucugaaaauu

SEQ ID NO: 499080 - RNA, 19 nt, Homo sapiens
aaagagagacaaagcaagu

SEQ ID NO: 499081 - RNA, 19 nt, Homo sapiens
uggugaagguccugacuga

SEQ ID NO: 499082 - RNA, 19 nt, Homo sapiens
ucucuccucucagguuaua

SEQ ID NO: 499083 - RNA, 19 nt, Homo sapiens
acucaggugucaaagaaga

SEQ ID NO: 499084 - RNA, 19 nt, Homo sapiens
gcgaggaaucggacaguga

SEQ ID NO: 499085 - RNA, 19 nt, Homo sapiens
agaaauccgacaagagaaa

SEQ ID NO: 499086 - RNA, 19 nt, Homo sapiens
ggaacacucccugcaacaa

SEQ ID NO: 499087 - RNA, 19 nt, Homo sapiens
gcgaggagucagacaguga

SEQ ID NO: 499088 - RNA, 19 nt, Homo sapiens
auacuacguuggucucaga

SEQ ID NO: 499089 - RNA, 19 nt, Homo sapiens
ggaagucucccaggaaguc

SEQ ID NO: 499090 - RNA, 19 nt, Homo sapiens
gaagacagcagagcagacu

SEQ ID NO: 499091 - RNA, 19 nt, Homo sapiens
caagaaggagaagaagaaa

SEQ ID NO: 499092 - RNA, 19 nt, Homo sapiens
gaagguggagaucaaagca

SEQ ID NO: 499093 - RNA, 19 nt, Homo sapiens
ggacagcagcgacaguucu

SEQ ID NO: 499094 - RNA, 19 nt, Homo sapiens
gagcagcagcgaggaauca

SEQ ID NO: 499095 - RNA, 19 nt, Homo sapiens
aagcagaggucuccaucca

SEQ ID NO: 499096 - RNA, 19 nt, Homo sapiens
cagcagaggauucuucaag

SEQ ID NO: 499097 - RNA, 19 nt, Homo sapiens
accaaggccugcccaaaga

SEQ ID NO: 499098 - RNA, 19 nt, Homo sapiens
gcagagcggccagaagugu

SEQ ID NO: 499099 - RNA, 19 nt, Homo sapiens
caaggcagagacagagaaa

SEQ ID NO: 499100 - RNA, 19 nt, Homo sapiens
uggcugaucccgaggcuuu

SEQ ID NO: 499101 - RNA, 19 nt, Homo sapiens
ggaaagcaaagagagacaa

SEQ ID NO: 499102 - RNA, 19 nt, Homo sapiens
uaucagauggcaagaaaca

SEQ ID NO: 499103 - RNA, 19 nt, Homo sapiens
ggaagagauugccugauua

SEQ ID NO: 499104 - RNA, 19 nt, Homo sapiens
ccacagaucugguugcaaa

SEQ ID NO: 499105 - RNA, 19 nt, Homo sapiens
gggaagagauugccugauu

SEQ ID NO: 499106 - RNA, 19 nt, Homo sapiens
gaagucaaauggagaguau

SEQ ID NO: 499107 - RNA, 19 nt, Homo sapiens
ccagucaacucuguuaaua

SEQ ID NO: 499108 - RNA, 19 nt, Homo sapiens
gaagagauugccugauuaa

SEQ ID NO: 499109 - RNA, 19 nt, Homo sapiens
aagcagcccuuuccauaua

SEQ ID NO: 499110 - RNA, 19 nt, Homo sapiens
caaagaaguuggagaugga

SEQ ID NO: 499111 - RNA, 19 nt, Homo sapiens
ccaauacacuagcaguuaa

SEQ ID NO: 499112 - RNA, 19 nt, Homo sapiens
ugucaacccuggccaauuu

SEQ ID NO: 499113 - RNA, 19 nt, Homo sapiens
ggaacuacuucagugguua

SEQ ID NO: 499114 - RNA, 19 nt, Homo sapiens
gaaacgauccgcucccaaa

SEQ ID NO: 499115 - RNA, 19 nt, Homo sapiens
gcaaccuaguacuuuauua

SEQ ID NO: 499116 - RNA, 19 nt, Homo sapiens
uaccuugaguugaguauua

SEQ ID NO: 499117 - RNA, 19 nt, Homo sapiens
ggagagaauuugugaugau

SEQ ID NO: 499118 - RNA, 19 nt, Homo sapiens
gaugauaugugucugaagu

SEQ ID NO: 499119 - RNA, 19 nt, Homo sapiens
gcaaggaagcagugcguua

SEQ ID NO: 499120 - RNA, 19 nt, Homo sapiens
guacuuugguccucugauu

SEQ ID NO: 499121 - RNA, 19 nt, Homo sapiens
ggauuaaacauggaaguua

SEQ ID NO: 499122 - RNA, 19 nt, Homo sapiens
gagauugccugauuaaugc

SEQ ID NO: 499123 - RNA, 19 nt, Homo sapiens
gaacacacauugcuauucc

SEQ ID NO: 499124 - RNA, 19 nt, Homo sapiens
gcuaugcacucaacugugu

SEQ ID NO: 499125 - RNA, 19 nt, Homo sapiens
caaauuagacagagagaau

SEQ ID NO: 499126 - RNA, 19 nt, Homo sapiens
guaacagggucacaagaau

SEQ ID NO: 499127 - RNA, 19 nt, Homo sapiens
gggaacagcuugcgauugc

SEQ ID NO: 499128 - RNA, 19 nt, Homo sapiens
gcaacuggugccaauguua

SEQ ID NO: 499129 - RNA, 19 nt, Homo sapiens
aaucagauaucaccaagga

SEQ ID NO: 499130 - RNA, 19 nt, Homo sapiens
caucccacaucaguuauua

SEQ ID NO: 499131 - RNA, 19 nt, Homo sapiens
gauuaaugcugcuaagaca

SEQ ID NO: 499132 - RNA, 19 nt, Homo sapiens
uaaaugcaaugucuuguac

SEQ ID NO: 499133 - RNA, 19 nt, Homo sapiens
ccauauaccuugaaaacua

SEQ ID NO: 499134 - RNA, 19 nt, Homo sapiens
gaagcagcccuuuccauau

SEQ ID NO: 499135 - RNA, 19 nt, Homo sapiens
agacagagagaaucagaua

SEQ ID NO: 499136 - RNA, 19 nt, Homo sapiens
ggaccaaauuagacagaga

SEQ ID NO: 499137 - RNA, 19 nt, Homo sapiens
gcagugcguuauaucaaug

SEQ ID NO: 499138 - RNA, 19 nt, Homo sapiens
cuacuucagugguuauuau

SEQ ID NO: 499139 - RNA, 19 nt, Homo sapiens
gugcaaccauccugaaguu

SEQ ID NO: 499140 - RNA, 19 nt, Homo sapiens
ugagguuguucaaaguuua

SEQ ID NO: 499141 - RNA, 19 nt, Homo sapiens
agaagcagcccuuuccaua

SEQ ID NO: 499142 - RNA, 19 nt, Homo sapiens
gaugaugagcugaucuuaa

SEQ ID NO: 499143 - RNA, 19 nt, Homo sapiens
gagcaacuauucugucaac

SEQ ID NO: 499144 - RNA, 19 nt, Homo sapiens
gcaaugucuuguaccuuga

SEQ ID NO: 499145 - RNA, 19 nt, Homo sapiens
gagagaauuugugaugaug

SEQ ID NO: 499146 - RNA, 19 nt, Homo sapiens
ggagagaauucagaagauc

SEQ ID NO: 499147 - RNA, 19 nt, Homo sapiens
cagaugaacugggaagaga

SEQ ID NO: 499148 - RNA, 19 nt, Homo sapiens
ggagcgcucuuuacaugau

SEQ ID NO: 499149 - RNA, 19 nt, Homo sapiens
gaucugauguuccuuuuau

SEQ ID NO: 499150 - RNA, 19 nt, Homo sapiens
ccaaccauaguuaaaguua

SEQ ID NO: 499151 - RNA, 19 nt, Homo sapiens
uuucagauauugcaaccua

SEQ ID NO: 499152 - RNA, 19 nt, Homo sapiens
gaaccaaccauaguuaaag

SEQ ID NO: 499153 - RNA, 19 nt, Homo sapiens
ggauuggucuugauuugag

SEQ ID NO: 499154 - RNA, 19 nt, Homo sapiens
gaagcagugcguuauauca

SEQ ID NO: 499155 - RNA, 19 nt, Homo sapiens
gaaaauucaucccacauca

SEQ ID NO: 499156 - RNA, 19 nt, Homo sapiens
uagaacauccugcagcuaa

SEQ ID NO: 499157 - RNA, 19 nt, Homo sapiens
ccaagagaaucguaaaugc

SEQ ID NO: 499158 - RNA, 19 nt, Homo sapiens
uaacagggucacaagaauu

SEQ ID NO: 499159 - RNA, 19 nt, Homo sapiens
ugagauggagcgcucuuua

SEQ ID NO: 499160 - RNA, 19 nt, Homo sapiens
augaugagcugaucuuaau

SEQ ID NO: 499161 - RNA, 19 nt, Homo sapiens
ggaugauauuggugaugua

SEQ ID NO: 499162 - RNA, 19 nt, Homo sapiens
ggucuugauuugagcaaug

SEQ ID NO: 499163 - RNA, 19 nt, Homo sapiens
gaagagaguuuuggaguca

SEQ ID NO: 499164 - RNA, 19 nt, Homo sapiens
gcccaggacuccacagauc

SEQ ID NO: 499165 - RNA, 19 nt, Homo sapiens
gagaauuugugaugaugag

SEQ ID NO: 499166 - RNA, 19 nt, Homo sapiens
gaugcuguacuugcuauua

SEQ ID NO: 499167 - RNA, 19 nt, Homo sapiens
gcagaugaauuagucaaac

SEQ ID NO: 499168 - RNA, 19 nt, Homo sapiens
uggcugaucugcaagacaa

SEQ ID NO: 499169 - RNA, 19 nt, Homo sapiens
cauaaugaggcccagguua

SEQ ID NO: 499170 - RNA, 19 nt, Homo sapiens
ugaaguuacuggagguaga

SEQ ID NO: 499171 - RNA, 19 nt, Homo sapiens
caacuggugccaauguuau

SEQ ID NO: 499172 - RNA, 19 nt, Homo sapiens
agagauugccugauuaaug

SEQ ID NO: 499173 - RNA, 19 nt, Homo sapiens
cagaugaauuagucaaaca

SEQ ID NO: 499174 - RNA, 19 nt, Homo sapiens
aaaugcagaugaauuaguc

SEQ ID NO: 499175 - RNA, 19 nt, Homo sapiens
gaugauauuggugauguaa

SEQ ID NO: 499176 - RNA, 19 nt, Homo sapiens
cagagagaaucagauauca

SEQ ID NO: 499177 - RNA, 19 nt, Homo sapiens
gcucaucaguggcuaugca

SEQ ID NO: 499178 - RNA, 19 nt, Homo sapiens
gaugaacugggaagagauu

SEQ ID NO: 499179 - RNA, 19 nt, Homo sapiens
gaacuacuucagugguuau

SEQ ID NO: 499180 - RNA, 19 nt, Homo sapiens
auaaugaggcccagguuaa

SEQ ID NO: 499181 - RNA, 19 nt, Homo sapiens
uggaauugaugauaugugu

SEQ ID NO: 499182 - RNA, 19 nt, Homo sapiens
ccaaggagagaauucagaa

SEQ ID NO: 499183 - RNA, 19 nt, Homo sapiens
gaaagcccaugggagaagu

SEQ ID NO: 499184 - RNA, 19 nt, Homo sapiens
ggugauuucuuugcuaaca

SEQ ID NO: 499185 - RNA, 19 nt, Homo sapiens
aaauguugguggaugauau

SEQ ID NO: 499186 - RNA, 19 nt, Homo sapiens
ugagcuggcugaucugcaa

SEQ ID NO: 499187 - RNA, 19 nt, Homo sapiens
caaccuaguacuuuauuag

SEQ ID NO: 499188 - RNA, 19 nt, Homo sapiens
ggacuccacagaucugguu

SEQ ID NO: 499189 - RNA, 19 nt, Homo sapiens
gagaaucagauaucaccaa

SEQ ID NO: 499190 - RNA, 19 nt, Homo sapiens
gaaguuacuggagguagaa

SEQ ID NO: 499191 - RNA, 19 nt, Homo sapiens
gaguugaguauuacacauu

SEQ ID NO: 499192 - RNA, 19 nt, Homo sapiens
acauggaaguuaugaagau

SEQ ID NO: 499193 - RNA, 19 nt, Homo sapiens
uaaaauggauuggucuuga

SEQ ID NO: 499194 - RNA, 19 nt, Homo sapiens
cccaauacacuagcaguua

SEQ ID NO: 499195 - RNA, 19 nt, Homo sapiens
caggagagaauuugugaug

SEQ ID NO: 499196 - RNA, 19 nt, Homo sapiens
caauuuggaaggugaagaa

SEQ ID NO: 499197 - RNA, 19 nt, Homo sapiens
gaauugaugauaugugucu

SEQ ID NO: 499198 - RNA, 19 nt, Homo sapiens
ccaguuggcuuggauaaaa

SEQ ID NO: 499199 - RNA, 19 nt, Homo sapiens
aaaugaagcuugguguaca

SEQ ID NO: 499200 - RNA, 19 nt, Homo sapiens
gcuauccagucaacucugu

SEQ ID NO: 499201 - RNA, 19 nt, Homo sapiens
gcaagacaaagaaguugga

SEQ ID NO: 499202 - RNA, 19 nt, Homo sapiens
caaggaagcagugcguuau

SEQ ID NO: 499203 - RNA, 19 nt, Homo sapiens
ccacuuagcuccuccaaag

SEQ ID NO: 499204 - RNA, 19 nt, Homo sapiens
gggcugauauucacagaaa

SEQ ID NO: 499205 - RNA, 19 nt, Homo sapiens
gacagaagcucaucagucu

SEQ ID NO: 499206 - RNA, 19 nt, Homo sapiens
ggguuaagaucaaagauga

SEQ ID NO: 499207 - RNA, 19 nt, Homo sapiens
uaaagugacucaagaagca

SEQ ID NO: 499208 - RNA, 19 nt, Homo sapiens
gaaauacaaaugccaauuc

SEQ ID NO: 499209 - RNA, 19 nt, Homo sapiens
ggaaaggaacggcgacaaa

SEQ ID NO: 499210 - RNA, 19 nt, Homo sapiens
cagaagcucaucagucuua

SEQ ID NO: 499211 - RNA, 19 nt, Homo sapiens
cccaauggcuccaaagaaa

SEQ ID NO: 499212 - RNA, 19 nt, Homo sapiens
gaagagacaacacccaaau

SEQ ID NO: 499213 - RNA, 19 nt, Homo sapiens
gacgggaggugucugaaga

SEQ ID NO: 499214 - RNA, 19 nt, Homo sapiens
acaggaagauagagagaaa

SEQ ID NO: 499215 - RNA, 19 nt, Homo sapiens
aucagaagaugcauaguua

SEQ ID NO: 499216 - RNA, 19 nt, Homo sapiens
ggccauuucugccuuguga

SEQ ID NO: 499217 - RNA, 19 nt, Homo sapiens
caaagccaaugaguuuaaa

SEQ ID NO: 499218 - RNA, 19 nt, Homo sapiens
ccaaagccaaugaguuuaa

SEQ ID NO: 499219 - RNA, 19 nt, Homo sapiens
gacauucucuccccuauuu

SEQ ID NO: 499220 - RNA, 19 nt, Homo sapiens
caaaugccaauucaccuaa

SEQ ID NO: 499221 - RNA, 19 nt, Homo sapiens
agucagggcuccaauagug

SEQ ID NO: 499222 - RNA, 19 nt, Homo sapiens
gcacgucgccucuugaaac

SEQ ID NO: 499223 - RNA, 19 nt, Homo sapiens
gaaaugccaauugcagauu

SEQ ID NO: 499224 - RNA, 19 nt, Homo sapiens
gcaacgggcagaaagaaau

SEQ ID NO: 499225 - RNA, 19 nt, Homo sapiens
ucucaaggauggacaggaa

SEQ ID NO: 499226 - RNA, 19 nt, Homo sapiens
gccaaugaguuuaaagaca

SEQ ID NO: 499227 - RNA, 19 nt, Homo sapiens
guuacuuacuucuuuguug

SEQ ID NO: 499228 - RNA, 19 nt, Homo sapiens
gacaagagggagacaauuc

SEQ ID NO: 499229 - RNA, 19 nt, Homo sapiens
gcagaaagaaauccacaca

SEQ ID NO: 499230 - RNA, 19 nt, Homo sapiens
ggagacaauucuagucacu

SEQ ID NO: 499231 - RNA, 19 nt, Homo sapiens
caagucaucuagaaauugc

SEQ ID NO: 499232 - RNA, 19 nt, Homo sapiens
ccaguuacuuacuucuuug

SEQ ID NO: 499233 - RNA, 19 nt, Homo sapiens
cuacccaagucaucuagaa

SEQ ID NO: 499234 - RNA, 19 nt, Homo sapiens
caccaaaacuuuaggacua

SEQ ID NO: 499235 - RNA, 19 nt, Homo sapiens
ucaccagccuccaccaaga

SEQ ID NO: 499236 - RNA, 19 nt, Homo sapiens
ggaaaugccaauugcagau

SEQ ID NO: 499237 - RNA, 19 nt, Homo sapiens
gguggaacaucucaaggau

SEQ ID NO: 499238 - RNA, 19 nt, Homo sapiens
ucugaagacggaaagauua

SEQ ID NO: 499239 - RNA, 19 nt, Homo sapiens
uaucagaagaugcauaguu

SEQ ID NO: 499240 - RNA, 19 nt, Homo sapiens
ggacaagagggagacaauu

SEQ ID NO: 499241 - RNA, 19 nt, Homo sapiens
agaugaagcuggaaauguc

SEQ ID NO: 499242 - RNA, 19 nt, Homo sapiens
cgggagacgucaagacaga

SEQ ID NO: 499243 - RNA, 19 nt, Homo sapiens
gaaccgggagcuccgagaa

SEQ ID NO: 499244 - RNA, 19 nt, Homo sapiens
caagagggagacaauucua

SEQ ID NO: 499245 - RNA, 19 nt, Homo sapiens
ucuagaaauugcaaaggaa

SEQ ID NO: 499246 - RNA, 19 nt, Homo sapiens
cccaagucaucuagaaauu

SEQ ID NO: 499247 - RNA, 19 nt, Homo sapiens
acaggaagagaccuuauuu

SEQ ID NO: 499248 - RNA, 19 nt, Homo sapiens
cuccaaagccaaugaguuu

SEQ ID NO: 499249 - RNA, 19 nt, Homo sapiens
gagaacaggaggcucacaa

SEQ ID NO: 499250 - RNA, 19 nt, Homo sapiens
gacaggaagagaccuuauu

SEQ ID NO: 499251 - RNA, 19 nt, Homo sapiens
ggaaagauuaugcauccau

SEQ ID NO: 499252 - RNA, 19 nt, Homo sapiens
gaaaacaccaccacaggaa

SEQ ID NO: 499253 - RNA, 19 nt, Homo sapiens
cagaagaugcauaguuaau

SEQ ID NO: 499254 - RNA, 19 nt, Homo sapiens
ccaccuagaaauacaaaug

SEQ ID NO: 499255 - RNA, 19 nt, Homo sapiens
gcugcacccuccuugauca

SEQ ID NO: 499256 - RNA, 19 nt, Homo sapiens
ggacaggaagagaccuuau

SEQ ID NO: 499257 - RNA, 19 nt, Homo sapiens
uaucuggcuuugaaggaaa

SEQ ID NO: 499258 - RNA, 19 nt, Homo sapiens
ugugcuaucuggcuuugaa

SEQ ID NO: 499259 - RNA, 19 nt, Homo sapiens
gagcacgucgccucuugaa

SEQ ID NO: 499260 - RNA, 19 nt, Homo sapiens
gaacaggaggcucacaaaa

SEQ ID NO: 499261 - RNA, 19 nt, Homo sapiens
cguucaagcugacgaguuc

SEQ ID NO: 499262 - RNA, 19 nt, Homo sapiens
caaugaguuuaaagacaga

SEQ ID NO: 499263 - RNA, 19 nt, Homo sapiens
accaguuacuuacuucuuu

SEQ ID NO: 499264 - RNA, 19 nt, Homo sapiens
ucaaagaugaagcuggaaa

SEQ ID NO: 499265 - RNA, 19 nt, Homo sapiens
gaaaggaacggcgacaaaa

SEQ ID NO: 499266 - RNA, 19 nt, Homo sapiens
caacaugauuuuggaaaga

SEQ ID NO: 499267 - RNA, 19 nt, Homo sapiens
uggaccagcugauucacaa

SEQ ID NO: 499268 - RNA, 19 nt, Homo sapiens
ggagagccaccaaaacuuu

SEQ ID NO: 499269 - RNA, 19 nt, Homo sapiens
caaagaugaagcuggaaau

SEQ ID NO: 499270 - RNA, 19 nt, Homo sapiens
ggagaugccgucauuacag

SEQ ID NO: 499271 - RNA, 19 nt, Homo sapiens
acaaaugccaauucaccua

SEQ ID NO: 499272 - RNA, 19 nt, Homo sapiens
cagagcaagugccguugga

SEQ ID NO: 499273 - RNA, 19 nt, Homo sapiens
gguaaugcuauuuaaagug

SEQ ID NO: 499274 - RNA, 19 nt, Homo sapiens
uuguagcccucaauauuug

SEQ ID NO: 499275 - RNA, 19 nt, Homo sapiens
uuaggaaacuugguuagag

SEQ ID NO: 499276 - RNA, 19 nt, Homo sapiens
ccaagucaucuagaaauug

SEQ ID NO: 499277 - RNA, 19 nt, Homo sapiens
ucugucagcugaugaagag

SEQ ID NO: 499278 - RNA, 19 nt, Homo sapiens
ggaggguuaagaucaaaga

SEQ ID NO: 499279 - RNA, 19 nt, Homo sapiens
gcugucaggaaaccaagua

SEQ ID NO: 499280 - RNA, 19 nt, Homo sapiens
gaagacggaaagauuaugc

SEQ ID NO: 499281 - RNA, 19 nt, Homo sapiens
agaauuaacucggggaaaa

SEQ ID NO: 499282 - RNA, 19 nt, Homo sapiens
aagagacaacacccaaaua

SEQ ID NO: 499283 - RNA, 19 nt, Homo sapiens
acaggaggcucacaaaaga

SEQ ID NO: 499284 - RNA, 19 nt, Homo sapiens
caacacgcagcaucacaug

SEQ ID NO: 499285 - RNA, 19 nt, Homo sapiens
ccacacagcccgguucaag

SEQ ID NO: 499286 - RNA, 19 nt, Homo sapiens
gagaccuuauuuccugaug

SEQ ID NO: 499287 - RNA, 19 nt, Homo sapiens
gugggaagccgggaagaaa

SEQ ID NO: 499288 - RNA, 19 nt, Homo sapiens
aaacaccaccacaggaaga

SEQ ID NO: 499289 - RNA, 19 nt, Homo sapiens
gaguuuaaagacagaaaga

SEQ ID NO: 499290 - RNA, 19 nt, Homo sapiens
gcugugggcugauauucac

SEQ ID NO: 499291 - RNA, 19 nt, Homo sapiens
uagcugcccuaaaugaucu

SEQ ID NO: 499292 - RNA, 19 nt, Homo sapiens
caugggaaaugccaauugc

SEQ ID NO: 499293 - RNA, 19 nt, Homo sapiens
ucguaaggguggaaaggaa

SEQ ID NO: 499294 - RNA, 19 nt, Homo sapiens
gggcuccaauagugcaguu

SEQ ID NO: 499295 - RNA, 19 nt, Homo sapiens
gggagaugccgucauuaca

SEQ ID NO: 499296 - RNA, 19 nt, Homo sapiens
caauggcuccaaagaaauc

SEQ ID NO: 499297 - RNA, 19 nt, Homo sapiens
gaagauagagagaaaaguc

SEQ ID NO: 499298 - RNA, 19 nt, Homo sapiens
uccauuauguacucauguu

SEQ ID NO: 499299 - RNA, 19 nt, Homo sapiens
ucagaagaugcauaguuaa

SEQ ID NO: 499300 - RNA, 19 nt, Homo sapiens
ccagcugauucacaaagug

SEQ ID NO: 499301 - RNA, 19 nt, Homo sapiens
cuagaaauugcaaaggaaa

SEQ ID NO: 499302 - RNA, 19 nt, Homo sapiens
cagcaucacaugggaaaug

SEQ ID NO: 499303 - RNA, 19 nt, Homo sapiens
gaacagguaucucaggaaa

SEQ ID NO: 499304 - RNA, 19 nt, Homo sapiens
gaacguaacuagucaucaa

SEQ ID NO: 499305 - RNA, 19 nt, Homo sapiens
caucaaagccucaagaaua

SEQ ID NO: 499306 - RNA, 19 nt, Homo sapiens
gcucuaagcagugauaaua

SEQ ID NO: 499307 - RNA, 19 nt, Homo sapiens
ccauacccauucauuaaua

SEQ ID NO: 499308 - RNA, 19 nt, Homo sapiens
ggacagcuccagaacauug

SEQ ID NO: 499309 - RNA, 19 nt, Homo sapiens
ugaagaagcucuggacaug

SEQ ID NO: 499310 - RNA, 19 nt, Homo sapiens
ugaggucgcugcugguuaa

SEQ ID NO: 499311 - RNA, 19 nt, Homo sapiens
gaagcuauacugacuguga

SEQ ID NO: 499312 - RNA, 19 nt, Homo sapiens
aaauggacauggugaacua

SEQ ID NO: 499313 - RNA, 19 nt, Homo sapiens
gcagagaacguaacuaguc

SEQ ID NO: 499314 - RNA, 19 nt, Homo sapiens
gaacauuccauucaguaug

SEQ ID NO: 499315 - RNA, 19 nt, Homo sapiens
uaacuagucaucaaacuga

SEQ ID NO: 499316 - RNA, 19 nt, Homo sapiens
uaaguacguucucaacaug

SEQ ID NO: 499317 - RNA, 19 nt, Homo sapiens
cagaaccgccugagaauug

SEQ ID NO: 499318 - RNA, 19 nt, Homo sapiens
ugcaacaacucaagauaaa

SEQ ID NO: 499319 - RNA, 19 nt, Homo sapiens
gauaaacugaaacgcauaa

SEQ ID NO: 499320 - RNA, 19 nt, Homo sapiens
cagcugugcucuugaacuu

SEQ ID NO: 499321 - RNA, 19 nt, Homo sapiens
guagggaucaagcauguaa

SEQ ID NO: 499322 - RNA, 19 nt, Homo sapiens
gugcagcggucucuauuag

SEQ ID NO: 499323 - RNA, 19 nt, Homo sapiens
guccauacccauucauuaa

SEQ ID NO: 499324 - RNA, 19 nt, Homo sapiens
gugcaacaacucaagauaa

SEQ ID NO: 499325 - RNA, 19 nt, Homo sapiens
gguccauacccauucauua

SEQ ID NO: 499326 - RNA, 19 nt, Homo sapiens
gauccuguuuggcuacuga

SEQ ID NO: 499327 - RNA, 19 nt, Homo sapiens
cuaaguacguucucaacau

SEQ ID NO: 499328 - RNA, 19 nt, Homo sapiens
cuacuacacugagauccua

SEQ ID NO: 499329 - RNA, 19 nt, Homo sapiens
caacuugacacaucacaau

SEQ ID NO: 499330 - RNA, 19 nt, Homo sapiens
caugauggcuuugcugugu

SEQ ID NO: 499331 - RNA, 19 nt, Homo sapiens
cgucauggccucagucuug

SEQ ID NO: 499332 - RNA, 19 nt, Homo sapiens
cagagaacguaacuaguca

SEQ ID NO: 499333 - RNA, 19 nt, Homo sapiens
caggagaccucaccauguc

SEQ ID NO: 499334 - RNA, 19 nt, Homo sapiens
gggcagagaacguaacuag

SEQ ID NO: 499335 - RNA, 19 nt, Homo sapiens
caacugguccauacccauu

SEQ ID NO: 499336 - RNA, 19 nt, Homo sapiens
gcaggagaccucaccaugu

SEQ ID NO: 499337 - RNA, 19 nt, Homo sapiens
aacauuccauucaguauga

SEQ ID NO: 499338 - RNA, 19 nt, Homo sapiens
aagaagcucuggacaugga

SEQ ID NO: 499339 - RNA, 19 nt, Homo sapiens
ugaggaagcuauacugacu

SEQ ID NO: 499340 - RNA, 19 nt, Homo sapiens
gagaauugagauugaagaa

SEQ ID NO: 499341 - RNA, 19 nt, Homo sapiens
ccaagaaggagaacugugu

SEQ ID NO: 499342 - RNA, 19 nt, Homo sapiens
acagguaucucaggaaauc

SEQ ID NO: 499343 - RNA, 19 nt, Homo sapiens
aagcagaacuggcagaacu

SEQ ID NO: 499344 - RNA, 19 nt, Homo sapiens
ccaaugaggcagccaacaa

SEQ ID NO: 499345 - RNA, 19 nt, Homo sapiens
gagaugaagcagugcagaa

SEQ ID NO: 499346 - RNA, 19 nt, Homo sapiens
gacuucagcugugcucuug

SEQ ID NO: 499347 - RNA, 19 nt, Homo sapiens
aaacaaaaguggagucugu

SEQ ID NO: 499348 - RNA, 19 nt, Homo sapiens
ugaaacgcauaaccaaauc

SEQ ID NO: 499349 - RNA, 19 nt, Homo sapiens
ucaauaagcagccuagucu

SEQ ID NO: 499350 - RNA, 19 nt, Homo sapiens
gaaaguccucuaucucucu

SEQ ID NO: 499351 - RNA, 19 nt, Homo sapiens
uccagaacauugccaagaa

SEQ ID NO: 499352 - RNA, 19 nt, Homo sapiens
aucaaagccucaagaauau

SEQ ID NO: 499353 - RNA, 19 nt, Homo sapiens
gagcaacuaucagcaacuc

SEQ ID NO: 499354 - RNA, 19 nt, Homo sapiens
ucaagcauguaaacaccaa

SEQ ID NO: 499355 - RNA, 19 nt, Homo sapiens
ucuaagcagugauaauaca

SEQ ID NO: 499356 - RNA, 19 nt, Homo sapiens
ggucgcugcugguuaacug

SEQ ID NO: 499357 - RNA, 19 nt, Homo sapiens
gcagacagugagcuucuau

SEQ ID NO: 499358 - RNA, 19 nt, Homo sapiens
gaggaggcccaucaucuuc

SEQ ID NO: 499359 - RNA, 19 nt, Homo sapiens
ccagaacauugccaagaag

SEQ ID NO: 499360 - RNA, 19 nt, Homo sapiens
ugggacagcuccagaacau

SEQ ID NO: 499361 - RNA, 19 nt, Homo sapiens
aaugaagaguucccugaga

SEQ ID NO: 499362 - RNA, 19 nt, Homo sapiens
aguaugaacgggcuaaauu

SEQ ID NO: 499363 - RNA, 19 nt, Homo sapiens
uccucuaucucucuaagua

SEQ ID NO: 499364 - RNA, 19 nt, Homo sapiens
aaaguccucuaucucucua

SEQ ID NO: 499365 - RNA, 19 nt, Homo sapiens
gcugugcucuugaacuucu

SEQ ID NO: 499366 - RNA, 19 nt, Homo sapiens
aggcuuugcggcugaauua

SEQ ID NO: 499367 - RNA, 19 nt, Homo sapiens
ucagagggcagagaacgua

SEQ ID NO: 499368 - RNA, 19 nt, Homo sapiens
gcagugcagaaacuagaaa

SEQ ID NO: 499369 - RNA, 19 nt, Homo sapiens
gccugagaauugagauuga

SEQ ID NO: 499370 - RNA, 19 nt, Homo sapiens
uuaacugaauggcaccaaa

SEQ ID NO: 499371 - RNA, 19 nt, Homo sapiens
aagaauaugggccuuguug

SEQ ID NO: 499372 - RNA, 19 nt, Homo sapiens
agccuagucuccuuaauca

SEQ ID NO: 499373 - RNA, 19 nt, Homo sapiens
guaugaacgggcuaaauuc

SEQ ID NO: 499374 - RNA, 19 nt, Homo sapiens
gaauaugggccuuguugcu

SEQ ID NO: 499375 - RNA, 19 nt, Homo sapiens
cgacucagagggcagagaa

SEQ ID NO: 499376 - RNA, 19 nt, Homo sapiens
aaacugaaacgcauaacca

SEQ ID NO: 499377 - RNA, 19 nt, Homo sapiens
uaagcagccuagucuccuu

SEQ ID NO: 499378 - RNA, 19 nt, Homo sapiens
ucaaggagacagugcacaa

SEQ ID NO: 499379 - RNA, 19 nt, Homo sapiens
cggcugaauuagauugguu

SEQ ID NO: 499380 - RNA, 19 nt, Homo sapiens
cgacuugcccagacacuuc

SEQ ID NO: 499381 - RNA, 19 nt, Homo sapiens
aaagagcaacuaucagcaa

SEQ ID NO: 499382 - RNA, 19 nt, Homo sapiens
cagcggauccauuuguuuc

SEQ ID NO: 499383 - RNA, 19 nt, Homo sapiens
ucugggaccuugaaaauga

SEQ ID NO: 499384 - RNA, 19 nt, Homo sapiens
ccaugucaccuccgacuug

SEQ ID NO: 499385 - RNA, 19 nt, Homo sapiens
uuaaucacaccaccaaaug

SEQ ID NO: 499386 - RNA, 19 nt, Homo sapiens
gugcaccaguucgagauga

SEQ ID NO: 499387 - RNA, 19 nt, Homo sapiens
ccugagaauugagauugaa

SEQ ID NO: 499388 - RNA, 19 nt, Homo sapiens
ggucauuuccaacagcuau

SEQ ID NO: 499389 - RNA, 19 nt, Homo sapiens
gaucuugcuaucacugcua

SEQ ID NO: 499390 - RNA, 19 nt, Homo sapiens
gagagggaucuuccagguu

SEQ ID NO: 499391 - RNA, 19 nt, Homo sapiens
guaacuagucaucaaacug

SEQ ID NO: 499392 - RNA, 19 nt, Homo sapiens
cgccagaaccgccugagaa

SEQ ID NO: 499393 - RNA, 19 nt, Homo sapiens
caucaucuuccuggaguaa

SEQ ID NO: 499394 - RNA, 19 nt, Homo sapiens
aaguggagucuguuugaua

SEQ ID NO: 499395 - RNA, 19 nt, Homo sapiens
gguguuuggucccuacuac

SEQ ID NO: 499396 - RNA, 19 nt, Homo sapiens
cauaaccaaauccuuguug

SEQ ID NO: 499397 - RNA, 19 nt, Homo sapiens
cugaaacgcauaaccaaau

SEQ ID NO: 499398 - RNA, 19 nt, Homo sapiens
gcagaaacuagaaaacauu

SEQ ID NO: 499399 - RNA, 19 nt, Homo sapiens
gaagcagugcagaaacuag

SEQ ID NO: 499400 - RNA, 19 nt, Homo sapiens
gacagugcacaaugccuuu

SEQ ID NO: 499401 - RNA, 19 nt, Homo sapiens
aguggagucuguuugauag

SEQ ID NO: 499402 - RNA, 19 nt, Homo sapiens
gcauaaccaaauccuuguu

SEQ ID NO: 499403 - RNA, 19 nt, Homo sapiens
gccaaaggguuaagcauua

SEQ ID NO: 499404 - RNA, 19 nt, Homo sapiens
cgaaggagguuacuaccaa

SEQ ID NO: 499405 - RNA, 19 nt, Homo sapiens
uaaagcagaugucauucuu

SEQ ID NO: 499406 - RNA, 19 nt, Homo sapiens
ggagguuacuaccaauuug

SEQ ID NO: 499407 - RNA, 19 nt, Homo sapiens
ggguuaagcauuagguuua

SEQ ID NO: 499408 - RNA, 19 nt, Homo sapiens
ggagggcuguguuacaaug

SEQ ID NO: 499409 - RNA, 19 nt, Homo sapiens
cgaaaucgguucagaucug

SEQ ID NO: 499410 - RNA, 19 nt, Homo sapiens
gaaggccuuugucuuguug

SEQ ID NO: 499411 - RNA, 19 nt, Homo sapiens
ccaacugucucucaacuuc

SEQ ID NO: 499412 - RNA, 19 nt, Homo sapiens
guacaagccaccuaucuau

SEQ ID NO: 499413 - RNA, 19 nt, Homo sapiens
gacgaaggccuuugucuug

SEQ ID NO: 499414 - RNA, 19 nt, Homo sapiens
gaaaucgguucagaucugu

SEQ ID NO: 499415 - RNA, 19 nt, Homo sapiens
gaaggagguuacuaccaau

SEQ ID NO: 499416 - RNA, 19 nt, Homo sapiens
gcagaugucauucuugugu

SEQ ID NO: 499417 - RNA, 19 nt, Homo sapiens
ggauuugugccguguuaua

SEQ ID NO: 499418 - RNA, 19 nt, Homo sapiens
ucucucaacuucuacacua

SEQ ID NO: 499419 - RNA, 19 nt, Homo sapiens
gcaccuaccacuccaccua

SEQ ID NO: 499420 - RNA, 19 nt, Homo sapiens
gguuuaaaguggucuugaa

SEQ ID NO: 499421 - RNA, 19 nt, Homo sapiens
gccaaguucuccaucaaga

SEQ ID NO: 499422 - RNA, 19 nt, Homo sapiens
gaacccagucugaguacaa

SEQ ID NO: 499423 - RNA, 19 nt, Homo sapiens
aagcagaugucauucuugu

SEQ ID NO: 499424 - RNA, 19 nt, Homo sapiens
cgaaggccuuugucuuguu

SEQ ID NO: 499425 - RNA, 19 nt, Homo sapiens
aaacucuccugcccaguga

SEQ ID NO: 499426 - RNA, 19 nt, Homo sapiens
gggcaaccuuccaauucaa

SEQ ID NO: 499427 - RNA, 19 nt, Homo sapiens
aaaccguccucgugcauga

SEQ ID NO: 499428 - RNA, 19 nt, Homo sapiens
aaaccagccugucaacuac

SEQ ID NO: 499429 - RNA, 19 nt, Homo sapiens
ccagugaccugcgauaaac

SEQ ID NO: 499430 - RNA, 19 nt, Homo sapiens
ccaccuaucuaucacuucu

SEQ ID NO: 499431 - RNA, 19 nt, Homo sapiens
cucuauagcuucucagaug

SEQ ID NO: 499432 - RNA, 19 nt, Homo sapiens
aaucgugugcuccaaauaa

SEQ ID NO: 499433 - RNA, 19 nt, Homo sapiens
ccaaaggguuaagcauuag

SEQ ID NO: 499434 - RNA, 19 nt, Homo sapiens
acaccacagugauuguaaa

SEQ ID NO: 499435 - RNA, 19 nt, Homo sapiens
ccaaauaaagcagauguca

SEQ ID NO: 499436 - RNA, 19 nt, Homo sapiens
agaugucauucuuguguuu

SEQ ID NO: 499437 - RNA, 19 nt, Homo sapiens
aguggcagcugaucaacaa

SEQ ID NO: 499438 - RNA, 19 nt, Homo sapiens
caaugacaccacagugauu

SEQ ID NO: 499439 - RNA, 19 nt, Homo sapiens
aguggaagccaaaggguua

SEQ ID NO: 499440 - RNA, 19 nt, Homo sapiens
ucacaucguuuccaaugac

SEQ ID NO: 499441 - RNA, 19 nt, Homo sapiens
ugacgaaggccuuugucuu

SEQ ID NO: 499442 - RNA, 19 nt, Homo sapiens
cuacacuaaugccaaguuc

SEQ ID NO: 499443 - RNA, 19 nt, Homo sapiens
ucccagauuuaucaccuaa

SEQ ID NO: 499444 - RNA, 19 nt, Homo sapiens
aauuugugaucccagauuu

SEQ ID NO: 499445 - RNA, 19 nt, Homo sapiens
ccacgaaggagguuacuac

SEQ ID NO: 499446 - RNA, 19 nt, Homo sapiens
ucggagggcuguguuacaa

SEQ ID NO: 499447 - RNA, 19 nt, Homo sapiens
caucugcgacagugagaaa

SEQ ID NO: 499448 - RNA, 19 nt, Homo sapiens
cagggcaaccuuccaauuc

SEQ ID NO: 499449 - RNA, 19 nt, Homo sapiens
cagaugucauucuuguguu

SEQ ID NO: 499450 - RNA, 19 nt, Homo sapiens
acaagccaccuaucuauca

SEQ ID NO: 499451 - RNA, 19 nt, Homo sapiens
guggaacccagucugagua

SEQ ID NO: 499452 - RNA, 19 nt, Homo sapiens
ggggauuugugccguguua

SEQ ID NO: 499453 - RNA, 19 nt, Homo sapiens
uuaaaguggucuugaacag

SEQ ID NO: 499454 - RNA, 19 nt, Homo sapiens
acagucacaucguuuccaa

SEQ ID NO: 499455 - RNA, 19 nt, Homo sapiens
gacaccacagugauuguaa

SEQ ID NO: 499456 - RNA, 19 nt, Homo sapiens
ccaaaaccaucaucaccaa

SEQ ID NO: 499457 - RNA, 19 nt, Homo sapiens
ucacagggcaaccuuccaa

SEQ ID NO: 499458 - RNA, 19 nt, Homo sapiens
ccaaugacaccacagugau

SEQ ID NO: 499459 - RNA, 19 nt, Homo sapiens
cuucuacagucacaucguu

SEQ ID NO: 499460 - RNA, 19 nt, Homo sapiens
caauuugugaucccagauu

SEQ ID NO: 499461 - RNA, 19 nt, Homo sapiens
caaauaaagcagaugucau

SEQ ID NO: 499462 - RNA, 19 nt, Homo sapiens
gcaugagaaugggagagau

SEQ ID NO: 499463 - RNA, 19 nt, Homo sapiens
gagcaugggcacauuugag

SEQ ID NO: 499464 - RNA, 19 nt, Homo sapiens
ugacaccacagugauugua

SEQ ID NO: 499465 - RNA, 19 nt, Homo sapiens
gagaaugggagagaucaca

SEQ ID NO: 499466 - RNA, 19 nt, Homo sapiens
gagguuacuaccaauuugu

SEQ ID NO: 499467 - RNA, 19 nt, Homo sapiens
ggagcaugggcacauuuga

SEQ ID NO: 499468 - RNA, 19 nt, Homo sapiens
gucacaucguuuccaauga

SEQ ID NO: 499469 - RNA, 19 nt, Homo sapiens
ucuaucacuucuacaguca

SEQ ID NO: 499470 - RNA, 19 nt, Homo sapiens
agggcaaccuuccaauuca

SEQ ID NO: 499471 - RNA, 19 nt, Homo sapiens
gaagccaaaggguuaagca

SEQ ID NO: 499472 - RNA, 19 nt, Homo sapiens
gggagcaugggcacauuug

SEQ ID NO: 499473 - RNA, 19 nt, Homo sapiens
gaguacaagccaccuaucu

SEQ ID NO: 499474 - RNA, 19 nt, Homo sapiens
ucuauagcuucucagaugu

SEQ ID NO: 499475 - RNA, 19 nt, Homo sapiens
aacugucucucaacuucua

SEQ ID NO: 499476 - RNA, 19 nt, Homo sapiens
aaaaccagccugucaacua

SEQ ID NO: 499477 - RNA, 19 nt, Homo sapiens
gauuugugccguguuauag

SEQ ID NO: 499478 - RNA, 19 nt, Homo sapiens
gcaaccuuccaauucaaug

SEQ ID NO: 499479 - RNA, 19 nt, Homo sapiens
gagaucacagggcaaccuu

SEQ ID NO: 499480 - RNA, 19 nt, Homo sapiens
uaucacuucuacagucaca

SEQ ID NO: 499481 - RNA, 19 nt, Homo sapiens
cccagugaccugcgauaaa

SEQ ID NO: 499482 - RNA, 19 nt, Homo sapiens
gcccagugaccugcgauaa

SEQ ID NO: 499483 - RNA, 19 nt, Homo sapiens
aaucgguucagaucuguuu

SEQ ID NO: 499484 - RNA, 19 nt, Homo sapiens
acagggcaaccuuccaauu

SEQ ID NO: 499485 - RNA, 19 nt, Homo sapiens
aguacaagccaccuaucua

SEQ ID NO: 499486 - RNA, 19 nt, Homo sapiens
cuaccacuccaccuacuug

SEQ ID NO: 499487 - RNA, 19 nt, Homo sapiens
uauagcuucucagauguuc

SEQ ID NO: 499488 - RNA, 19 nt, Homo sapiens
uuuccagucucuauagcuu

SEQ ID NO: 499489 - RNA, 19 nt, Homo sapiens
acgaaggccuuugucuugu

SEQ ID NO: 499490 - RNA, 19 nt, Homo sapiens
uccaaugacaccacaguga

SEQ ID NO: 499491 - RNA, 19 nt, Homo sapiens
agucacaucguuuccaaug

SEQ ID NO: 499492 - RNA, 19 nt, Homo sapiens
ggagagagauuguguucuu

SEQ ID NO: 499493 - RNA, 19 nt, Homo sapiens
ggauguggcuuauuaaaca

SEQ ID NO: 499494 - RNA, 19 nt, Homo sapiens
caacugaggauguggcuua

SEQ ID NO: 499495 - RNA, 19 nt, Homo sapiens
ggaaauggcagcaaacgaa

SEQ ID NO: 499496 - RNA, 19 nt, Homo sapiens
cugaggauguggcuuauua

SEQ ID NO: 499497 - RNA, 19 nt, Homo sapiens
gagcaagacccaucucaaa

SEQ ID NO: 499498 - RNA, 19 nt, Homo sapiens
caaaggaaauugucaucug

SEQ ID NO: 499499 - RNA, 19 nt, Homo sapiens
caacuguccuacucauauu

SEQ ID NO: 499500 - RNA, 19 nt, Homo sapiens
gagucaggaucucacauuu

SEQ ID NO: 499501 - RNA, 19 nt, Homo sapiens
gcccugccaugucacaaua

SEQ ID NO: 499502 - RNA, 19 nt, Homo sapiens
gaccugagccagaccuuaa

SEQ ID NO: 499503 - RNA, 19 nt, Homo sapiens
caucaguucuuuugucuua

SEQ ID NO: 499504 - RNA, 19 nt, Homo sapiens
gucaggaucucacauuuca

SEQ ID NO: 499505 - RNA, 19 nt, Homo sapiens
uuauuuagcuggccauuca

SEQ ID NO: 499506 - RNA, 19 nt, Homo sapiens
guacugaggaugauguuau

SEQ ID NO: 499507 - RNA, 19 nt, Homo sapiens
gaaacaccaguaccugaaa

SEQ ID NO: 499508 - RNA, 19 nt, Homo sapiens
ccugauggcuccacgcauu

SEQ ID NO: 499509 - RNA, 19 nt, Homo sapiens
gcaaaugccccuauagaaa

SEQ ID NO: 499510 - RNA, 19 nt, Homo sapiens
accuuaagcucuaugguua

SEQ ID NO: 499511 - RNA, 19 nt, Homo sapiens
gugaagaguuugccuguac

SEQ ID NO: 499512 - RNA, 19 nt, Homo sapiens
ccuguaaucccaacacuuu

SEQ ID NO: 499513 - RNA, 19 nt, Homo sapiens
gaggauguggcuuauuaaa

SEQ ID NO: 499514 - RNA, 19 nt, Homo sapiens
ccacuagcaucuucucuac

SEQ ID NO: 499515 - RNA, 19 nt, Homo sapiens
gaaugugggucugcaccuu

SEQ ID NO: 499516 - RNA, 19 nt, Homo sapiens
gaccuuaagcucuaugguu

SEQ ID NO: 499517 - RNA, 19 nt, Homo sapiens
ccaacuguccuacucauau

SEQ ID NO: 499518 - RNA, 19 nt, Homo sapiens
agaggaagccugagguuga

SEQ ID NO: 499519 - RNA, 19 nt, Homo sapiens
gaaaaccccaucucuacua

SEQ ID NO: 499520 - RNA, 19 nt, Homo sapiens
gcacagagucaggaucuca

SEQ ID NO: 499521 - RNA, 19 nt, Homo sapiens
gcaccaaacacccacauac

SEQ ID NO: 499522 - RNA, 19 nt, Homo sapiens
agccagaccuuaagcucua

SEQ ID NO: 499523 - RNA, 19 nt, Homo sapiens
gagagagauuguguucuuc

SEQ ID NO: 499524 - RNA, 19 nt, Homo sapiens
caucuucucuaccuucaag

SEQ ID NO: 499525 - RNA, 19 nt, Homo sapiens
gcagcuguacugaggauga

SEQ ID NO: 499526 - RNA, 19 nt, Homo sapiens
ucacucaucccuuaagcaa

SEQ ID NO: 499527 - RNA, 19 nt, Homo sapiens
ggaauugcagcuguacuga

SEQ ID NO: 499528 - RNA, 19 nt, Homo sapiens
gcacaguggccccaucaua

SEQ ID NO: 499529 - RNA, 19 nt, Homo sapiens
gagaccagccugaccaaca

SEQ ID NO: 499530 - RNA, 19 nt, Homo sapiens
cgugggaaauggcagcaaa

SEQ ID NO: 499531 - RNA, 19 nt, Homo sapiens
gcucuaugguuauuuagcu

SEQ ID NO: 499532 - RNA, 19 nt, Homo sapiens
gcaggucuguuuucuccua

SEQ ID NO: 499533 - RNA, 19 nt, Homo sapiens
gcaggagauuugcuugaac

SEQ ID NO: 499534 - RNA, 19 nt, Homo sapiens
gccugcagccucaucauuu

SEQ ID NO: 499535 - RNA, 19 nt, Homo sapiens
cuuaagcucuaugguuauu

SEQ ID NO: 499536 - RNA, 19 nt, Homo sapiens
ggccucuucugccucuuaa

SEQ ID NO: 499537 - RNA, 19 nt, Homo sapiens
cuacagggcugggccucuu

SEQ ID NO: 499538 - RNA, 19 nt, Homo sapiens
gaugguaccaagcauuuag

SEQ ID NO: 499539 - RNA, 19 nt, Homo sapiens
ggaugguaccaagcauuua

SEQ ID NO: 499540 - RNA, 19 nt, Homo sapiens
uacugaggaugauguuauu

SEQ ID NO: 499541 - RNA, 19 nt, Homo sapiens
gauaucauacuuccaucug

SEQ ID NO: 499542 - RNA, 19 nt, Homo sapiens
ccuguuggauaucauacuu

SEQ ID NO: 499543 - RNA, 19 nt, Homo sapiens
gggccucuucugccucuua

SEQ ID NO: 499544 - RNA, 19 nt, Homo sapiens
gcagcaaacgaaccucuca

SEQ ID NO: 499545 - RNA, 19 nt, Homo sapiens
uaauacuacugcacagagu

SEQ ID NO: 499546 - RNA, 19 nt, Homo sapiens
aaacaccaguaccugaaag

SEQ ID NO: 499547 - RNA, 19 nt, Homo sapiens
gcuggccauucagguauaa

SEQ ID NO: 499548 - RNA, 19 nt, Homo sapiens
ccaagauugcgccguugua

SEQ ID NO: 499549 - RNA, 19 nt, Homo sapiens
cugggcaagugaagaguuu

SEQ ID NO: 499550 - RNA, 19 nt, Homo sapiens
agaaacaccaguaccugaa

SEQ ID NO: 499551 - RNA, 19 nt, Homo sapiens
gcaaaggaaauugucaucu

SEQ ID NO: 499552 - RNA, 19 nt, Homo sapiens
gagccaggcaaaggaaauu

SEQ ID NO: 499553 - RNA, 19 nt, Homo sapiens
ucuccuaggcccugaguuu

SEQ ID NO: 499554 - RNA, 19 nt, Homo sapiens
cuacuuccuuccuguugga

SEQ ID NO: 499555 - RNA, 19 nt, Homo sapiens
gcaaggagccagggaaucc

SEQ ID NO: 499556 - RNA, 19 nt, Homo sapiens
ggcugaagcaggagauuug

SEQ ID NO: 499557 - RNA, 19 nt, Homo sapiens
agaccagccugaccaacau

SEQ ID NO: 499558 - RNA, 19 nt, Homo sapiens
gcaaacgaaccucucaaaa

SEQ ID NO: 499559 - RNA, 19 nt, Homo sapiens
gaucacgaggucaggaguu

SEQ ID NO: 499560 - RNA, 19 nt, Homo sapiens
caaaacccacagagaauaa

SEQ ID NO: 499561 - RNA, 19 nt, Homo sapiens
uuaagugccuaugggaaug

SEQ ID NO: 499562 - RNA, 19 nt, Homo sapiens
gaggaagccugagguugac

SEQ ID NO: 499563 - RNA, 19 nt, Homo sapiens
ccugcagccucaucauuuc

SEQ ID NO: 499564 - RNA, 19 nt, Homo sapiens
gccaacuguccuacucaua

SEQ ID NO: 499565 - RNA, 19 nt, Homo sapiens
gcgcgugacccucuucaag

SEQ ID NO: 499566 - RNA, 19 nt, Homo sapiens
caaagauguggguggcaaa

SEQ ID NO: 499567 - RNA, 19 nt, Homo sapiens
gguuuacgcgugcgcacua

SEQ ID NO: 499568 - RNA, 19 nt, Homo sapiens
agagucaggaucucacauu

SEQ ID NO: 499569 - RNA, 19 nt, Homo sapiens
auacuucuguuuccaucug

SEQ ID NO: 499570 - RNA, 19 nt, Homo sapiens
uauaaggcaggguggugua

SEQ ID NO: 499571 - RNA, 19 nt, Homo sapiens
cccaagaugugaccccaua

SEQ ID NO: 499572 - RNA, 19 nt, Homo sapiens
ggcccacccacuaauacua

SEQ ID NO: 499573 - RNA, 19 nt, Homo sapiens
gaggaugauguuauucaca

SEQ ID NO: 499574 - RNA, 19 nt, Homo sapiens
ccucaucauuucccaucug

SEQ ID NO: 499575 - RNA, 19 nt, Homo sapiens
uuaaggagagagauugugu

SEQ ID NO: 499576 - RNA, 19 nt, Homo sapiens
cuuccuuccuguuggauau

SEQ ID NO: 499577 - RNA, 19 nt, Homo sapiens
ccaggggaguuuccaaaga

SEQ ID NO: 499578 - RNA, 19 nt, Homo sapiens
aggaugguaccaagcauuu

SEQ ID NO: 499579 - RNA, 19 nt, Homo sapiens
uuagcuggccauucaggua

SEQ ID NO: 499580 - RNA, 19 nt, Homo sapiens
ggugaaaaccccaucucua

SEQ ID NO: 499581 - RNA, 19 nt, Homo sapiens
ugaggauguggcuuauuaa

SEQ ID NO: 499582 - RNA, 19 nt, Homo sapiens
gcgugacccucuucaagcu

SEQ ID NO: 499583 - RNA, 19 nt, Homo sapiens
agauguggguggcaaaugc

SEQ ID NO: 499584 - RNA, 19 nt, Homo sapiens
cauaggaugguaccaagca

SEQ ID NO: 499585 - RNA, 19 nt, Homo sapiens
ugaccugagccagaccuua

SEQ ID NO: 499586 - RNA, 19 nt, Homo sapiens
aaaaccccaucucuacuaa

SEQ ID NO: 499587 - RNA, 19 nt, Homo sapiens
cagcuguacugaggaugau

SEQ ID NO: 499588 - RNA, 19 nt, Homo sapiens
gggaaauggcagcaaacga

SEQ ID NO: 499589 - RNA, 19 nt, Homo sapiens
uaaggagagagauuguguu

SEQ ID NO: 499590 - RNA, 19 nt, Homo sapiens
ggaauaagcuuagcguuaa

SEQ ID NO: 499591 - RNA, 19 nt, Homo sapiens
cagauuagcucauauucua

SEQ ID NO: 499592 - RNA, 19 nt, Homo sapiens
gauggaaccuguaccguaa

SEQ ID NO: 499593 - RNA, 19 nt, Homo sapiens
ucaaacagcugccuuacaa

SEQ ID NO: 499594 - RNA, 19 nt, Homo sapiens
gggcauaugucucugcuaa

SEQ ID NO: 499595 - RNA, 19 nt, Homo sapiens
gaacuccauucagauaaua

SEQ ID NO: 499596 - RNA, 19 nt, Homo sapiens
gaagagcgcauauggcuuu

SEQ ID NO: 499597 - RNA, 19 nt, Homo sapiens
guacacagcuggccaccaa

SEQ ID NO: 499598 - RNA, 19 nt, Homo sapiens
ccacuaacacuaauacaua

SEQ ID NO: 499599 - RNA, 19 nt, Homo sapiens
caaauugaguggaauaaag

SEQ ID NO: 499600 - RNA, 19 nt, Homo sapiens
ucucagggcuuaugaaaug

SEQ ID NO: 499601 - RNA, 19 nt, Homo sapiens
aaauauacaugcagacuug

SEQ ID NO: 499602 - RNA, 19 nt, Homo sapiens
guuggaagacguauuaaua

SEQ ID NO: 499603 - RNA, 19 nt, Homo sapiens
guuaaaggccuuauuauca

SEQ ID NO: 499604 - RNA, 19 nt, Homo sapiens
ggaacaaacauuuaucaga

SEQ ID NO: 499605 - RNA, 19 nt, Homo sapiens
ccauugcuauuguucuuua

SEQ ID NO: 499606 - RNA, 19 nt, Homo sapiens
gaacuguauugucaacguu

SEQ ID NO: 499607 - RNA, 19 nt, Homo sapiens
ggaauacuaugugcauguu

SEQ ID NO: 499608 - RNA, 19 nt, Homo sapiens
agucuuaccuauacaagua

SEQ ID NO: 499609 - RNA, 19 nt, Homo sapiens
cuagagaaguuaacaggaa

SEQ ID NO: 499610 - RNA, 19 nt, Homo sapiens
ggaacuccauucagauaau

SEQ ID NO: 499611 - RNA, 19 nt, Homo sapiens
cagcaucguuuaaauagga

SEQ ID NO: 499612 - RNA, 19 nt, Homo sapiens
ugaggaagcccacaauauu

SEQ ID NO: 499613 - RNA, 19 nt, Homo sapiens
gaacaguguaugacucaaa

SEQ ID NO: 499614 - RNA, 19 nt, Homo sapiens
aagcuuagcguuaauauug

SEQ ID NO: 499615 - RNA, 19 nt, Homo sapiens
gcgcuaccauggaggagua

SEQ ID NO: 499616 - RNA, 19 nt, Homo sapiens
ucaguuggaagacguauua

SEQ ID NO: 499617 - RNA, 19 nt, Homo sapiens
gcaagcaauaucauaguaa

SEQ ID NO: 499618 - RNA, 19 nt, Homo sapiens
gaggaagcccacaauauug

SEQ ID NO: 499619 - RNA, 19 nt, Homo sapiens
gcaccauaguugucaaugu

SEQ ID NO: 499620 - RNA, 19 nt, Homo sapiens
gaauaagcuuagcguuaau

SEQ ID NO: 499621 - RNA, 19 nt, Homo sapiens
cacguuaucucagggcuua

SEQ ID NO: 499622 - RNA, 19 nt, Homo sapiens
auagagagcggaaccauaa

SEQ ID NO: 499623 - RNA, 19 nt, Homo sapiens
cauauuaccacuaacacua

SEQ ID NO: 499624 - RNA, 19 nt, Homo sapiens
ucaaugugcugugcaaaug

SEQ ID NO: 499625 - RNA, 19 nt, Homo sapiens
aaacagcugccuuacaauu

SEQ ID NO: 499626 - RNA, 19 nt, Homo sapiens
ggauaaauguggagaaaau

SEQ ID NO: 499627 - RNA, 19 nt, Homo sapiens
cauaguggaacaauccuua

SEQ ID NO: 499628 - RNA, 19 nt, Homo sapiens
gcggaaccauaacucauug

SEQ ID NO: 499629 - RNA, 19 nt, Homo sapiens
caccauaguugucaaugug

SEQ ID NO: 499630 - RNA, 19 nt, Homo sapiens
gaugagaauuagcuaacau

SEQ ID NO: 499631 - RNA, 19 nt, Homo sapiens
gaaccuguaccguaagaug

SEQ ID NO: 499632 - RNA, 19 nt, Homo sapiens
uggaagaucauaauaguga

SEQ ID NO: 499633 - RNA, 19 nt, Homo sapiens
cgacgagguuggcuucaau

SEQ ID NO: 499634 - RNA, 19 nt, Homo sapiens
aggaauaagcuuagcguua

SEQ ID NO: 499635 - RNA, 19 nt, Homo sapiens
ugaaucugguuacacauau

SEQ ID NO: 499636 - RNA, 19 nt, Homo sapiens
ggaguuuaaugcagugauc

SEQ ID NO: 499637 - RNA, 19 nt, Homo sapiens
ugucauugcuuuaguuaca

SEQ ID NO: 499638 - RNA, 19 nt, Homo sapiens
cuugcuaucugcucuguuu

SEQ ID NO: 499639 - RNA, 19 nt, Homo sapiens
gggcuuaugaaauguaauu

SEQ ID NO: 499640 - RNA, 19 nt, Homo sapiens
ggccuuauuaucagucuua

SEQ ID NO: 499641 - RNA, 19 nt, Homo sapiens
gaaucugguuacacauaug

SEQ ID NO: 499642 - RNA, 19 nt, Homo sapiens
gugaaucugguuacacaua

SEQ ID NO: 499643 - RNA, 19 nt, Homo sapiens
gcaaaugcuaaguuccuuu

SEQ ID NO: 499644 - RNA, 19 nt, Homo sapiens
aaggauaaauguggagaaa

SEQ ID NO: 499645 - RNA, 19 nt, Homo sapiens
ccuggaagaucauaauagu

SEQ ID NO: 499646 - RNA, 19 nt, Homo sapiens
gagaaguuaacaggaauaa

SEQ ID NO: 499647 - RNA, 19 nt, Homo sapiens
ucugcucuguuucuaguua

SEQ ID NO: 499648 - RNA, 19 nt, Homo sapiens
gcuaucugcucuguuucua

SEQ ID NO: 499649 - RNA, 19 nt, Homo sapiens
uuaaugcagugaucuuugu

SEQ ID NO: 499650 - RNA, 19 nt, Homo sapiens
gaaccauaacucauugaau

SEQ ID NO: 499651 - RNA, 19 nt, Homo sapiens
ugaguggaauaaaguauag

SEQ ID NO: 499652 - RNA, 19 nt, Homo sapiens
aauacuaugugcauguuug

SEQ ID NO: 499653 - RNA, 19 nt, Homo sapiens
uacaauccuuagcacguua

SEQ ID NO: 499654 - RNA, 19 nt, Homo sapiens
uuaaaggccuuauuaucag

SEQ ID NO: 499655 - RNA, 19 nt, Homo sapiens
gguuacacauauggaagua

SEQ ID NO: 499656 - RNA, 19 nt, Homo sapiens
ccucaguuguacuuaauau

SEQ ID NO: 499657 - RNA, 19 nt, Homo sapiens
cuuaagaauuugucagugu

SEQ ID NO: 499658 - RNA, 19 nt, Homo sapiens
gcuauuguucuuuaacuga

SEQ ID NO: 499659 - RNA, 19 nt, Homo sapiens
gcauaugucucugcuaagc

SEQ ID NO: 499660 - RNA, 19 nt, Homo sapiens
uaucagaugccuauuaugg

SEQ ID NO: 499661 - RNA, 19 nt, Homo sapiens
accaugaacuguauuguca

SEQ ID NO: 499662 - RNA, 19 nt, Homo sapiens
gggagaaccggaccaugaa

SEQ ID NO: 499663 - RNA, 19 nt, Homo sapiens
gcugaggaagcccacaaua

SEQ ID NO: 499664 - RNA, 19 nt, Homo sapiens
uaucugcucuguuucuagu

SEQ ID NO: 499665 - RNA, 19 nt, Homo sapiens
cuaugugcauguuugauau

SEQ ID NO: 499666 - RNA, 19 nt, Homo sapiens
ggaaccauaacucauugaa

SEQ ID NO: 499667 - RNA, 19 nt, Homo sapiens
gggaacuccauucagauaa

SEQ ID NO: 499668 - RNA, 19 nt, Homo sapiens
agcaagcaauaucauagua

SEQ ID NO: 499669 - RNA, 19 nt, Homo sapiens
gaucauaauagugaccaaa

SEQ ID NO: 499670 - RNA, 19 nt, Homo sapiens
ggaaguaagcaaaaugaaa

SEQ ID NO: 499671 - RNA, 19 nt, Homo sapiens
acacuugaggguaaauuaa

SEQ ID NO: 499672 - RNA, 19 nt, Homo sapiens
uagagaaguuaacaggaau

SEQ ID NO: 499673 - RNA, 19 nt, Homo sapiens
uaaaggccuuauuaucagu

SEQ ID NO: 499674 - RNA, 19 nt, Homo sapiens
gccuuacaauucacucauu

SEQ ID NO: 499675 - RNA, 19 nt, Homo sapiens
acagcugccuuacaauuca

SEQ ID NO: 499676 - RNA, 19 nt, Homo sapiens
uaagcaagcaauaucauag

SEQ ID NO: 499677 - RNA, 19 nt, Homo sapiens
cagggcuuaugaaauguaa

SEQ ID NO: 499678 - RNA, 19 nt, Homo sapiens
ugggagaaccggaccauga

SEQ ID NO: 499679 - RNA, 19 nt, Homo sapiens
acaaccaucuguaaauaac

SEQ ID NO: 499680 - RNA, 19 nt, Homo sapiens
uagcaauuguucaguugga

SEQ ID NO: 499681 - RNA, 19 nt, Homo sapiens
gcgacgagguuggcuucaa

SEQ ID NO: 499682 - RNA, 19 nt, Homo sapiens
ucuuucagcuagagaaguu

SEQ ID NO: 499683 - RNA, 19 nt, Homo sapiens
uauagagagcggaaccaua

SEQ ID NO: 499684 - RNA, 19 nt, Homo sapiens
caaaugcgaagucaaucug

SEQ ID NO: 499685 - RNA, 19 nt, Homo sapiens
caccaaaugcgaagucaau

SEQ ID NO: 499686 - RNA, 19 nt, Homo sapiens
uaucucagggcuuaugaaa

SEQ ID NO: 499687 - RNA, 19 nt, Homo sapiens
aagugaaucugguuacaca

SEQ ID NO: 499688 - RNA, 19 nt, Homo sapiens
gacucaaacagcugccuua

SEQ ID NO: 499689 - RNA, 19 nt, Homo sapiens
caccagcuuuucacuaaua

SEQ ID NO: 499690 - RNA, 19 nt, Homo sapiens
gaacagagauccugaaauu

SEQ ID NO: 499691 - RNA, 19 nt, Homo sapiens
gaagagggcuguggucaua

SEQ ID NO: 499692 - RNA, 19 nt, Homo sapiens
ggcgagagcuccacggaaa

SEQ ID NO: 499693 - RNA, 19 nt, Homo sapiens
ggaaagugaugaggaggaa

SEQ ID NO: 499694 - RNA, 19 nt, Homo sapiens
agagacagauccaauauag

SEQ ID NO: 499695 - RNA, 19 nt, Homo sapiens
ugagaaaccucgggccuuu

SEQ ID NO: 499696 - RNA, 19 nt, Homo sapiens
guuuagagcuaucccacua

SEQ ID NO: 499697 - RNA, 19 nt, Homo sapiens
gaauuugcgcccuaacuuu

SEQ ID NO: 499698 - RNA, 19 nt, Homo sapiens
ugugagauaugaggucuua

SEQ ID NO: 499699 - RNA, 19 nt, Homo sapiens
uuacagagaucagucaaau

SEQ ID NO: 499700 - RNA, 19 nt, Homo sapiens
cgauaccgcuucucuuaga

SEQ ID NO: 499701 - RNA, 19 nt, Homo sapiens
gaaaagagguccuugucau

SEQ ID NO: 499702 - RNA, 19 nt, Homo sapiens
guagcgaacacuuaaauug

SEQ ID NO: 499703 - RNA, 19 nt, Homo sapiens
gcuugagauuggucacuua

SEQ ID NO: 499704 - RNA, 19 nt, Homo sapiens
uaacuuugcuugcuaaucc

SEQ ID NO: 499705 - RNA, 19 nt, Homo sapiens
ggaauuugcgcccuaacuu

SEQ ID NO: 499706 - RNA, 19 nt, Homo sapiens
gagaucagucaaauccaua

SEQ ID NO: 499707 - RNA, 19 nt, Homo sapiens
gaaacggaagccagagaaa

SEQ ID NO: 499708 - RNA, 19 nt, Homo sapiens
gcccuaacuuugcuugcua

SEQ ID NO: 499709 - RNA, 19 nt, Homo sapiens
gcccugcacucucaacaug

SEQ ID NO: 499710 - RNA, 19 nt, Homo sapiens
ggaaacggaagccagagaa

SEQ ID NO: 499711 - RNA, 19 nt, Homo sapiens
gcaaagagauugggguaug

SEQ ID NO: 499712 - RNA, 19 nt, Homo sapiens
gugacacuguggacaauga

SEQ ID NO: 499713 - RNA, 19 nt, Homo sapiens
ggagggagcaaagagauug

SEQ ID NO: 499714 - RNA, 19 nt, Homo sapiens
gaagagggagggagcaaag

SEQ ID NO: 499715 - RNA, 19 nt, Homo sapiens
gaacacuuaaauuggguuu

SEQ ID NO: 499716 - RNA, 19 nt, Homo sapiens
cagcccagauguucaguuc

SEQ ID NO: 499717 - RNA, 19 nt, Homo sapiens
agacagauccaauauaguc

SEQ ID NO: 499718 - RNA, 19 nt, Homo sapiens
caugaguagcgaacacuua

SEQ ID NO: 499719 - RNA, 19 nt, Homo sapiens
gcugcuguauuuaugagaa

SEQ ID NO: 499720 - RNA, 19 nt, Homo sapiens
ccacagaugcacaaaauaa

SEQ ID NO: 499721 - RNA, 19 nt, Homo sapiens
cagagacagauccaauaua

SEQ ID NO: 499722 - RNA, 19 nt, Homo sapiens
ccacccuucuccuguuauu

SEQ ID NO: 499723 - RNA, 19 nt, Homo sapiens
ccaggaauuugcgcccuaa

SEQ ID NO: 499724 - RNA, 19 nt, Homo sapiens
gaguagcgaacacuuaaau

SEQ ID NO: 499725 - RNA, 19 nt, Homo sapiens
uccgauaccgcuucucuua

SEQ ID NO: 499726 - RNA, 19 nt, Homo sapiens
ugagauuggucacuuagag

SEQ ID NO: 499727 - RNA, 19 nt, Homo sapiens
cccgagaaccggagccuua

SEQ ID NO: 499728 - RNA, 19 nt, Homo sapiens
uuucaacagucccagcuuu

SEQ ID NO: 499729 - RNA, 19 nt, Homo sapiens
caacaugaguagcgaacac

SEQ ID NO: 499730 - RNA, 19 nt, Homo sapiens
acagagauccugaaauucu

SEQ ID NO: 499731 - RNA, 19 nt, Homo sapiens
gcccagauguucaguucuc

SEQ ID NO: 499732 - RNA, 19 nt, Homo sapiens
ucagagacagauccaauau

SEQ ID NO: 499733 - RNA, 19 nt, Homo sapiens
gcccuucuccuccugcuaa

SEQ ID NO: 499734 - RNA, 19 nt, Homo sapiens
acccuucuccuguuauuua

SEQ ID NO: 499735 - RNA, 19 nt, Homo sapiens
ccugggaucuaguuaucuu

SEQ ID NO: 499736 - RNA, 19 nt, Homo sapiens
ccucuuacuuccuagacuu

SEQ ID NO: 499737 - RNA, 19 nt, Homo sapiens
ucucauuuauugccacaga

SEQ ID NO: 499738 - RNA, 19 nt, Homo sapiens
gugaugaggaggaagaaga

SEQ ID NO: 499739 - RNA, 19 nt, Homo sapiens
ggaagagggagggagcaaa

SEQ ID NO: 499740 - RNA, 19 nt, Homo sapiens
caagaggaguuagaaaaga

SEQ ID NO: 499741 - RNA, 19 nt, Homo sapiens
gcuugcuaauccugguuua

SEQ ID NO: 499742 - RNA, 19 nt, Homo sapiens
ugagcgagaccgucacuga

SEQ ID NO: 499743 - RNA, 19 nt, Homo sapiens
guccugggaucuaguuauc

SEQ ID NO: 499744 - RNA, 19 nt, Homo sapiens
gauagagggaagaggaaga

SEQ ID NO: 499745 - RNA, 19 nt, Homo sapiens
ggccaaugcagcacuaaau

SEQ ID NO: 499746 - RNA, 19 nt, Homo sapiens
agagaucagucaaauccau

SEQ ID NO: 499747 - RNA, 19 nt, Homo sapiens
cauacacaguuacagagau

SEQ ID NO: 499748 - RNA, 19 nt, Homo sapiens
auucucaccucuuauggaa

SEQ ID NO: 499749 - RNA, 19 nt, Homo sapiens
aaagagguccuugucauuc

SEQ ID NO: 499750 - RNA, 19 nt, Homo sapiens
guccuugccugugagauau

SEQ ID NO: 499751 - RNA, 19 nt, Homo sapiens
cgagggaucuaggcaccuu

SEQ ID NO: 499752 - RNA, 19 nt, Homo sapiens
guauccauguggcuacuuc

SEQ ID NO: 499753 - RNA, 19 nt, Homo sapiens
guacguggccaccgcaaag

SEQ ID NO: 499754 - RNA, 19 nt, Homo sapiens
ucccacccuucuccuguua

SEQ ID NO: 499755 - RNA, 19 nt, Homo sapiens
gagcuaucccacuaaaaua

SEQ ID NO: 499756 - RNA, 19 nt, Homo sapiens
ggaagaggaggacgaacag

SEQ ID NO: 499757 - RNA, 19 nt, Homo sapiens
aaccggagccuuaccauca

SEQ ID NO: 499758 - RNA, 19 nt, Homo sapiens
auacacaguuacagagauc

SEQ ID NO: 499759 - RNA, 19 nt, Homo sapiens
gagggagggagcaaagaga

SEQ ID NO: 499760 - RNA, 19 nt, Homo sapiens
gacugucuccucugccuuu

SEQ ID NO: 499761 - RNA, 19 nt, Homo sapiens
ugucuggcccuaaauguau

SEQ ID NO: 499762 - RNA, 19 nt, Homo sapiens
aaagugaugaggaggaaga

SEQ ID NO: 499763 - RNA, 19 nt, Homo sapiens
aagguagaauggacaagug

SEQ ID NO: 499764 - RNA, 19 nt, Homo sapiens
ugagauaugaggucuuaca

SEQ ID NO: 499765 - RNA, 19 nt, Homo sapiens
ucuuaguccuugccuguga

SEQ ID NO: 499766 - RNA, 19 nt, Homo sapiens
uaaauuggguuuucaacag

SEQ ID NO: 499767 - RNA, 19 nt, Homo sapiens
ucauccaaaugcugcugua

SEQ ID NO: 499768 - RNA, 19 nt, Homo sapiens
cagauguucaguucucuug

SEQ ID NO: 499769 - RNA, 19 nt, Homo sapiens
gggagggagcaaagagauu

SEQ ID NO: 499770 - RNA, 19 nt, Homo sapiens
auccugaaauucugacuug

SEQ ID NO: 499771 - RNA, 19 nt, Homo sapiens
uaauccugguuuagagcua

SEQ ID NO: 499772 - RNA, 19 nt, Homo sapiens
uagcgaacacuuaaauugg

SEQ ID NO: 499773 - RNA, 19 nt, Homo sapiens
gaagaggaggacgaacaga

SEQ ID NO: 499774 - RNA, 19 nt, Homo sapiens
cagggccaaugcagcacua

SEQ ID NO: 499775 - RNA, 19 nt, Homo sapiens
uaggauuucugacaaagcu

SEQ ID NO: 499776 - RNA, 19 nt, Homo sapiens
ugacaaccgagcccgagaa

SEQ ID NO: 499777 - RNA, 19 nt, Homo sapiens
ccaauacccacccuucucu

SEQ ID NO: 499778 - RNA, 19 nt, Homo sapiens
guagaauggacaagugaca

SEQ ID NO: 499779 - RNA, 19 nt, Homo sapiens
ccggagccuuaccaucaaa

SEQ ID NO: 499780 - RNA, 19 nt, Homo sapiens
ccauacacaguuacagaga

SEQ ID NO: 499781 - RNA, 19 nt, Homo sapiens
ggcuugagauuggucacuu

SEQ ID NO: 499782 - RNA, 19 nt, Homo sapiens
ucucaccucuuauggaaaa

SEQ ID NO: 499783 - RNA, 19 nt, Homo sapiens
gagccuuaccaucaaacuu

SEQ ID NO: 499784 - RNA, 19 nt, Homo sapiens
agaggaggacgaacagaga

SEQ ID NO: 499785 - RNA, 19 nt, Homo sapiens
gccaaugcagcacuaaauc

SEQ ID NO: 499786 - RNA, 19 nt, Homo sapiens
agagggcuguggucauaca

SEQ ID NO: 499787 - RNA, 19 nt, Homo sapiens
cugcuguauuuaugagaaa

SEQ ID NO: 499788 - RNA, 19 nt, Homo sapiens
cuuccuagacuuugauuuc

SEQ ID NO: 499789 - RNA, 19 nt, Homo sapiens
aagagguccuugucauucu

SEQ ID NO: 499790 - RNA, 19 nt, Homo sapiens
gaacagagauccugaaauu

SEQ ID NO: 499791 - RNA, 19 nt, Homo sapiens
gaagagggcuguggucaua

SEQ ID NO: 499792 - RNA, 19 nt, Homo sapiens
ggagaaacagcaaggauua

SEQ ID NO: 499793 - RNA, 19 nt, Homo sapiens
caaccgagcccgaugauuu

SEQ ID NO: 499794 - RNA, 19 nt, Homo sapiens
ggcgagagcuccacggaaa

SEQ ID NO: 499795 - RNA, 19 nt, Homo sapiens
ggaaagugaugaggaggaa

SEQ ID NO: 499796 - RNA, 19 nt, Homo sapiens
agagacagauccaauauag

SEQ ID NO: 499797 - RNA, 19 nt, Homo sapiens
gcugggaccuuuccuagga

SEQ ID NO: 499798 - RNA, 19 nt, Homo sapiens
ugagaaaccucgggccuuu

SEQ ID NO: 499799 - RNA, 19 nt, Homo sapiens
guuuagagcuaucccacua

SEQ ID NO: 499800 - RNA, 19 nt, Homo sapiens
gaaacagcaaggauuauau

SEQ ID NO: 499801 - RNA, 19 nt, Homo sapiens
gaauuugcgcccuaacuuu

SEQ ID NO: 499802 - RNA, 19 nt, Homo sapiens
ggaggaagacggagaaaca

SEQ ID NO: 499803 - RNA, 19 nt, Homo sapiens
ugugagauaugaggucuua

SEQ ID NO: 499804 - RNA, 19 nt, Homo sapiens
uuacagagaucagucaaau

SEQ ID NO: 499805 - RNA, 19 nt, Homo sapiens
uaggagaaccggagccuua

SEQ ID NO: 499806 - RNA, 19 nt, Homo sapiens
cgauaccgcuucucuuaga

SEQ ID NO: 499807 - RNA, 19 nt, Homo sapiens
gaaaagagguccuugucau

SEQ ID NO: 499808 - RNA, 19 nt, Homo sapiens
guagcgaacacuuaaauug

SEQ ID NO: 499809 - RNA, 19 nt, Homo sapiens
gcuugagauuggucacuua

SEQ ID NO: 499810 - RNA, 19 nt, Homo sapiens
uaacuuugcuugcuaaucc

SEQ ID NO: 499811 - RNA, 19 nt, Homo sapiens
ggaauuugcgcccuaacuu

SEQ ID NO: 499812 - RNA, 19 nt, Homo sapiens
gagaucagucaaauccaua

SEQ ID NO: 499813 - RNA, 19 nt, Homo sapiens
gaaacggaagccagagaaa

SEQ ID NO: 499814 - RNA, 19 nt, Homo sapiens
gcccuaacuuugcuugcua

SEQ ID NO: 499815 - RNA, 19 nt, Homo sapiens
gcccugcacucucaacaug

SEQ ID NO: 499816 - RNA, 19 nt, Homo sapiens
ggaaacggaagccagagaa

SEQ ID NO: 499817 - RNA, 19 nt, Homo sapiens
gcaaagagauugggguaug

SEQ ID NO: 499818 - RNA, 19 nt, Homo sapiens
gugacacuguggacaauga

SEQ ID NO: 499819 - RNA, 19 nt, Homo sapiens
ggagggagcaaagagauug

SEQ ID NO: 499820 - RNA, 19 nt, Homo sapiens
gaagagggagggagcaaag

SEQ ID NO: 499821 - RNA, 19 nt, Homo sapiens
agaaacagcaaggauuaua

SEQ ID NO: 499822 - RNA, 19 nt, Homo sapiens
gaacacuuaaauuggguuu

SEQ ID NO: 499823 - RNA, 19 nt, Homo sapiens
cagcccagauguucaguuc

SEQ ID NO: 499824 - RNA, 19 nt, Homo sapiens
agacagauccaauauaguc

SEQ ID NO: 499825 - RNA, 19 nt, Homo sapiens
caugaguagcgaacacuua

SEQ ID NO: 499826 - RNA, 19 nt, Homo sapiens
gcugcuguauuuaugagaa

SEQ ID NO: 499827 - RNA, 19 nt, Homo sapiens
ccacagaugcacaaaauaa

SEQ ID NO: 499828 - RNA, 19 nt, Homo sapiens
cagcaaggauuauauuuuc

SEQ ID NO: 499829 - RNA, 19 nt, Homo sapiens
cagagacagauccaauaua

SEQ ID NO: 499830 - RNA, 19 nt, Homo sapiens
ccacccuucuccuguuauu

SEQ ID NO: 499831 - RNA, 19 nt, Homo sapiens
ccaggaauuugcgcccuaa

SEQ ID NO: 499832 - RNA, 19 nt, Homo sapiens
gaguagcgaacacuuaaau

SEQ ID NO: 499833 - RNA, 19 nt, Homo sapiens
ugagauuggucacuuagag

SEQ ID NO: 499834 - RNA, 19 nt, Homo sapiens
uccgauaccgcuucucuua

SEQ ID NO: 499835 - RNA, 19 nt, Homo sapiens
uuucaacagucccagcuuu

SEQ ID NO: 499836 - RNA, 19 nt, Homo sapiens
caacaugaguagcgaacac

SEQ ID NO: 499837 - RNA, 19 nt, Homo sapiens
acagagauccugaaauucu

SEQ ID NO: 499838 - RNA, 19 nt, Homo sapiens
gcccagauguucaguucuc

SEQ ID NO: 499839 - RNA, 19 nt, Homo sapiens
ucagagacagauccaauau

SEQ ID NO: 499840 - RNA, 19 nt, Homo sapiens
gcccuucuccuccugcuaa

SEQ ID NO: 499841 - RNA, 19 nt, Homo sapiens
acccuucuccuguuauuua

SEQ ID NO: 499842 - RNA, 19 nt, Homo sapiens
ccugggaucuaguuaucuu

SEQ ID NO: 499843 - RNA, 19 nt, Homo sapiens
ccucuuacuuccuagacuu

SEQ ID NO: 499844 - RNA, 19 nt, Homo sapiens
gaagacggagaaacagcaa

SEQ ID NO: 499845 - RNA, 19 nt, Homo sapiens
ucucauuuauugccacaga

SEQ ID NO: 499846 - RNA, 19 nt, Homo sapiens
gugaugaggaggaagaaga

SEQ ID NO: 499847 - RNA, 19 nt, Homo sapiens
aagaguugcugggaccuuu

SEQ ID NO: 499848 - RNA, 19 nt, Homo sapiens
gagaaacagcaaggauuau

SEQ ID NO: 499849 - RNA, 19 nt, Homo sapiens
ggaagagggagggagcaaa

SEQ ID NO: 499850 - RNA, 19 nt, Homo sapiens
ugagcgagaccgucacuga

SEQ ID NO: 499851 - RNA, 19 nt, Homo sapiens
caagaggaguuagaaaaga

SEQ ID NO: 499852 - RNA, 19 nt, Homo sapiens
gcuugcuaauccugguuua

SEQ ID NO: 499853 - RNA, 19 nt, Homo sapiens
guccugggaucuaguuauc

SEQ ID NO: 499854 - RNA, 19 nt, Homo sapiens
gauagagggaagaggaaga

SEQ ID NO: 499855 - RNA, 19 nt, Homo sapiens
ggccaaugcagcacuaaau

SEQ ID NO: 499856 - RNA, 19 nt, Homo sapiens
agagaucagucaaauccau

SEQ ID NO: 499857 - RNA, 19 nt, Homo sapiens
cauacacaguuacagagau

SEQ ID NO: 499858 - RNA, 19 nt, Homo sapiens
auucucaccucuuauggaa

SEQ ID NO: 499859 - RNA, 19 nt, Homo sapiens
aaagagguccuugucauuc

SEQ ID NO: 499860 - RNA, 19 nt, Homo sapiens
guccuugccugugagauau

SEQ ID NO: 499861 - RNA, 19 nt, Homo sapiens
cgagggaucuaggcaccuu

SEQ ID NO: 499862 - RNA, 19 nt, Homo sapiens
guauccauguggcuacuuc

SEQ ID NO: 499863 - RNA, 19 nt, Homo sapiens
guacguggccaccgcaaag

SEQ ID NO: 499864 - RNA, 19 nt, Homo sapiens
ucccacccuucuccuguua

SEQ ID NO: 499865 - RNA, 19 nt, Homo sapiens
ugacaaccgagcccgauga

SEQ ID NO: 499866 - RNA, 19 nt, Homo sapiens
cggagaaacagcaaggauu

SEQ ID NO: 499867 - RNA, 19 nt, Homo sapiens
gagcuaucccacuaaaaua

SEQ ID NO: 499868 - RNA, 19 nt, Homo sapiens
ggaagaggaggacgaacag

SEQ ID NO: 499869 - RNA, 19 nt, Homo sapiens
aaccggagccuuaccauca

SEQ ID NO: 499870 - RNA, 19 nt, Homo sapiens
auacacaguuacagagauc

SEQ ID NO: 499871 - RNA, 19 nt, Homo sapiens
gagggagggagcaaagaga

SEQ ID NO: 499872 - RNA, 19 nt, Homo sapiens
gacugucuccucugccuuu

SEQ ID NO: 499873 - RNA, 19 nt, Homo sapiens
ugucuggcccuaaauguau

SEQ ID NO: 499874 - RNA, 19 nt, Homo sapiens
aaagugaugaggaggaaga

SEQ ID NO: 499875 - RNA, 19 nt, Homo sapiens
ugagauaugaggucuuaca

SEQ ID NO: 499876 - RNA, 19 nt, Homo sapiens
ucuuaguccuugccuguga

SEQ ID NO: 499877 - RNA, 19 nt, Homo sapiens
uaaauuggguuuucaacag

SEQ ID NO: 499878 - RNA, 19 nt, Homo sapiens
ucauccaaaugcugcugua

SEQ ID NO: 499879 - RNA, 19 nt, Homo sapiens
aagguagaauggacaagug

SEQ ID NO: 499880 - RNA, 19 nt, Homo sapiens
cagauguucaguucucuug

SEQ ID NO: 499881 - RNA, 19 nt, Homo sapiens
gggagggagcaaagagauu

SEQ ID NO: 499882 - RNA, 19 nt, Homo sapiens
auccugaaauucugacuug

SEQ ID NO: 499883 - RNA, 19 nt, Homo sapiens
uaauccugguuuagagcua

SEQ ID NO: 499884 - RNA, 19 nt, Homo sapiens
uagcgaacacuuaaauugg

SEQ ID NO: 499885 - RNA, 19 nt, Homo sapiens
gaagaggaggacgaacaga

SEQ ID NO: 499886 - RNA, 19 nt, Homo sapiens
cagggccaaugcagcacua

SEQ ID NO: 499887 - RNA, 19 nt, Homo sapiens
uaggauuucugacaaagcu

SEQ ID NO: 499888 - RNA, 19 nt, Homo sapiens
ccaauacccacccuucucu

SEQ ID NO: 499889 - RNA, 19 nt, Homo sapiens
gaagaguugcugggaccuu

SEQ ID NO: 499890 - RNA, 19 nt, Homo sapiens
gaagugagcaacauuguaa

SEQ ID NO: 499891 - RNA, 19 nt, Homo sapiens
gaaaucugcuagugugaaa

SEQ ID NO: 499892 - RNA, 19 nt, Homo sapiens
ccacuugucuuaacucuga

SEQ ID NO: 499893 - RNA, 19 nt, Homo sapiens
gaagaauggagcuggauua

SEQ ID NO: 499894 - RNA, 19 nt, Homo sapiens
gaccacaaauguaguagaa

SEQ ID NO: 499895 - RNA, 19 nt, Homo sapiens
gaaacuugcucuacucucu

SEQ ID NO: 499896 - RNA, 19 nt, Homo sapiens
gcucuacucucugaaauga

SEQ ID NO: 499897 - RNA, 19 nt, Homo sapiens
gaauggagcuggauuacac

SEQ ID NO: 499898 - RNA, 19 nt, Homo sapiens
ccacaaauguaguagaaca

SEQ ID NO: 499899 - RNA, 19 nt, Homo sapiens
ccaaaugaccgcacuguga

SEQ ID NO: 499900 - RNA, 19 nt, Homo sapiens
ccuauggccuuucuccuuu

SEQ ID NO: 499901 - RNA, 19 nt, Homo sapiens
gaauggcaccgaagucaga

SEQ ID NO: 499902 - RNA, 19 nt, Homo sapiens
guaauuaugcagaagaaug

SEQ ID NO: 499903 - RNA, 19 nt, Homo sapiens
gggagaauaagaccaugua

SEQ ID NO: 499904 - RNA, 19 nt, Homo sapiens
ucuacucucugaaaugauu

SEQ ID NO: 499905 - RNA, 19 nt, Homo sapiens
ucagaugaguaucccugua

SEQ ID NO: 499906 - RNA, 19 nt, Homo sapiens
gcaccgaagucagaugagu

SEQ ID NO: 499907 - RNA, 19 nt, Homo sapiens
uaucaacacagcaaaguga

SEQ ID NO: 499908 - RNA, 19 nt, Homo sapiens
ggaggagacugcuuuuguu

SEQ ID NO: 499909 - RNA, 19 nt, Homo sapiens
gaugaagugagcaacauug

SEQ ID NO: 499910 - RNA, 19 nt, Homo sapiens
gaccugcaguccagccuau

SEQ ID NO: 499911 - RNA, 19 nt, Homo sapiens
agaauaagaccauguacug

SEQ ID NO: 499912 - RNA, 19 nt, Homo sapiens
ugaccgcacugugauguga

SEQ ID NO: 499913 - RNA, 19 nt, Homo sapiens
caaaugaccgcacugugau

SEQ ID NO: 499914 - RNA, 19 nt, Homo sapiens
ggagacugcuuuuguuguu

SEQ ID NO: 499915 - RNA, 19 nt, Homo sapiens
caauuggugguaacgcuua

SEQ ID NO: 499916 - RNA, 19 nt, Homo sapiens
gaaagcgcaauugguggua

SEQ ID NO: 499917 - RNA, 19 nt, Homo sapiens
ucagugaacucuuuucuca

SEQ ID NO: 499918 - RNA, 19 nt, Homo sapiens
guguaauuaugcagaagaa

SEQ ID NO: 499919 - RNA, 19 nt, Homo sapiens
ugaagugagcaacauugua

SEQ ID NO: 499920 - RNA, 19 nt, Homo sapiens
aaucugaaaucugcuagug

SEQ ID NO: 499921 - RNA, 19 nt, Homo sapiens
cagccugcguugccacuug

SEQ ID NO: 499922 - RNA, 19 nt, Homo sapiens
caccagccaugaauucagu

SEQ ID NO: 499923 - RNA, 19 nt, Homo sapiens
caaauguaguagaacaaac

SEQ ID NO: 499924 - RNA, 19 nt, Homo sapiens
uaaaagaggcuauagaaag

SEQ ID NO: 499925 - RNA, 19 nt, Homo sapiens
gagaauaagaccauguacu

SEQ ID NO: 499926 - RNA, 19 nt, Homo sapiens
ggauuacacacagcaaguu

SEQ ID NO: 499927 - RNA, 19 nt, Homo sapiens
uaagccaacucaccaagcu

SEQ ID NO: 499928 - RNA, 19 nt, Homo sapiens
ggaccacaaauguaguaga

SEQ ID NO: 499929 - RNA, 19 nt, Homo sapiens
aaagcgcaauuggugguaa

SEQ ID NO: 499930 - RNA, 19 nt, Homo sapiens
uaaccaccagccaugaauu

SEQ ID NO: 499931 - RNA, 19 nt, Homo sapiens
acugugcgaugggagaaua

SEQ ID NO: 499932 - RNA, 19 nt, Homo sapiens
gggaaaaccauuuaaauac

SEQ ID NO: 499933 - RNA, 19 nt, Homo sapiens
caccgaagucagaugagua

SEQ ID NO: 499934 - RNA, 19 nt, Homo sapiens
guggcacuuucacaaugua

SEQ ID NO: 499935 - RNA, 19 nt, Homo sapiens
ccuucggacugucuauuug

SEQ ID NO: 499936 - RNA, 19 nt, Homo sapiens
gcuauagaaagcgcaauug

SEQ ID NO: 499937 - RNA, 19 nt, Homo sapiens
guaaaagaggcuauagaaa

SEQ ID NO: 499938 - RNA, 19 nt, Homo sapiens
ugagcaacauuguaaaaga

SEQ ID NO: 499939 - RNA, 19 nt, Homo sapiens
gguaacgcuuaucaacaca

SEQ ID NO: 499940 - RNA, 19 nt, Homo sapiens
gagcaacauuguaaaagag

SEQ ID NO: 499941 - RNA, 19 nt, Homo sapiens
cagaugaguaucccuguag

SEQ ID NO: 499942 - RNA, 19 nt, Homo sapiens
gauuacacacagcaaguuc

SEQ ID NO: 499943 - RNA, 19 nt, Homo sapiens
uaauuaugcagaagaaugg

SEQ ID NO: 499944 - RNA, 19 nt, Homo sapiens
ccuguguaauuaugcagaa

SEQ ID NO: 499945 - RNA, 19 nt, Homo sapiens
ugaaaucugcuagugugaa

SEQ ID NO: 499946 - RNA, 19 nt, Homo sapiens
gugaauggcaccgaaguca

SEQ ID NO: 499947 - RNA, 19 nt, Homo sapiens
gccuauggccuuucuccuu

SEQ ID NO: 499948 - RNA, 19 nt, Homo sapiens
gccuucggacugucuauuu

SEQ ID NO: 499949 - RNA, 19 nt, Homo sapiens
gcacuuucacaauguagag

SEQ ID NO: 499950 - RNA, 19 nt, Homo sapiens
ggcuauagaaagcgcaauu

SEQ ID NO: 499951 - RNA, 19 nt, Homo sapiens
gugugaaacuugcucuacu

SEQ ID NO: 499952 - RNA, 19 nt, Homo sapiens
ggugguaacgcuuaucaac

SEQ ID NO: 499953 - RNA, 19 nt, Homo sapiens
ugugaaacuugcucuacuc

SEQ ID NO: 499954 - RNA, 19 nt, Homo sapiens
agugaacucuuuucucauu

SEQ ID NO: 499955 - RNA, 19 nt, Homo sapiens
auaagaccauguacugcau

SEQ ID NO: 499956 - RNA, 19 nt, Homo sapiens
ugguaacgcuuaucaacac

SEQ ID NO: 499957 - RNA, 19 nt, Homo sapiens
ugcguugccacuugucuua

SEQ ID NO: 499958 - RNA, 19 nt, Homo sapiens
aaaagaggcuauagaaagc

SEQ ID NO: 499959 - RNA, 19 nt, Homo sapiens
gugguaacgcuuaucaaca

SEQ ID NO: 499960 - RNA, 19 nt, Homo sapiens
ugaccuguguaauuaugca

SEQ ID NO: 499961 - RNA, 19 nt, Homo sapiens
gaaacucucugcuauguua

SEQ ID NO: 499962 - RNA, 19 nt, Homo sapiens
gaagauggcuguuaaggaa

SEQ ID NO: 499963 - RNA, 19 nt, Homo sapiens
caaagaagauggcuguuaa

SEQ ID NO: 499964 - RNA, 19 nt, Homo sapiens
caaauuccuuccuuuagua

SEQ ID NO: 499965 - RNA, 19 nt, Homo sapiens
gaaguaugguauuggauuu

SEQ ID NO: 499966 - RNA, 19 nt, Homo sapiens
gagauggguuugaggauuu

SEQ ID NO: 499967 - RNA, 19 nt, Homo sapiens
gaaccuaaguaguuuggaa

SEQ ID NO: 499968 - RNA, 19 nt, Homo sapiens
ggaaagugauaagaaauga

SEQ ID NO: 499969 - RNA, 19 nt, Homo sapiens
ggaaggaacugaauuucuc

SEQ ID NO: 499970 - RNA, 19 nt, Homo sapiens
gcaaagaagauggcuguua

SEQ ID NO: 499971 - RNA, 19 nt, Homo sapiens
gaaaggcauugaacgaaau

SEQ ID NO: 499972 - RNA, 19 nt, Homo sapiens
guuaagaacuuggaauuug

SEQ ID NO: 499973 - RNA, 19 nt, Homo sapiens
gaauagcaguguuuaaugg

SEQ ID NO: 499974 - RNA, 19 nt, Homo sapiens
gcaaaugccagaagaaguu

SEQ ID NO: 499975 - RNA, 19 nt, Homo sapiens
uaugauugcucuucucuuu

SEQ ID NO: 499976 - RNA, 19 nt, Homo sapiens
uauuaaagcuggguacuaa

SEQ ID NO: 499977 - RNA, 19 nt, Homo sapiens
uaaagaauuucgugaagga

SEQ ID NO: 499978 - RNA, 19 nt, Homo sapiens
uaaagcauguaacuaggua

SEQ ID NO: 499979 - RNA, 19 nt, Homo sapiens
ggaacugaauuucuccauu

SEQ ID NO: 499980 - RNA, 19 nt, Homo sapiens
acuaauggcugcuuacaaa

SEQ ID NO: 499981 - RNA, 19 nt, Homo sapiens
gcucaugccuguaauccaa

SEQ ID NO: 499982 - RNA, 19 nt, Homo sapiens
guaacuagguauugcuuug

SEQ ID NO: 499983 - RNA, 19 nt, Homo sapiens
cauggaaagugauaagaaa

SEQ ID NO: 499984 - RNA, 19 nt, Homo sapiens
gaccaaauuccuuccuuua

SEQ ID NO: 499985 - RNA, 19 nt, Homo sapiens
ugaaaggcauugaacgaaa

SEQ ID NO: 499986 - RNA, 19 nt, Homo sapiens
ggacuuaagagaucaguug

SEQ ID NO: 499987 - RNA, 19 nt, Homo sapiens
gaaauaucagccacgaaua

SEQ ID NO: 499988 - RNA, 19 nt, Homo sapiens
gcucagcccuguguguuaa

SEQ ID NO: 499989 - RNA, 19 nt, Homo sapiens
caugacagaugaguaguaa

SEQ ID NO: 499990 - RNA, 19 nt, Homo sapiens
guaugaaccuaaguaguuu

SEQ ID NO: 499991 - RNA, 19 nt, Homo sapiens
agacaaaguucauuacuac

SEQ ID NO: 499992 - RNA, 19 nt, Homo sapiens
ggaaguaugguauuggauu

SEQ ID NO: 499993 - RNA, 19 nt, Homo sapiens
aagaagggcaugcuaauaa

SEQ ID NO: 499994 - RNA, 19 nt, Homo sapiens
gcaagaggcuccaaaagga

SEQ ID NO: 499995 - RNA, 19 nt, Homo sapiens
ugacugaugucuucugugu

SEQ ID NO: 499996 - RNA, 19 nt, Homo sapiens
aguggagucucauuuguua

SEQ ID NO: 499997 - RNA, 19 nt, Homo sapiens
ccaaauuccuuccuuuagu

SEQ ID NO: 499998 - RNA, 19 nt, Homo sapiens
gaaggaggacguauucuag

SEQ ID NO: 499999 - RNA, 19 nt, Homo sapiens
cuaaguaguuuggaagaaa

SEQ ID NO: 500000 - RNA, 19 nt, Homo sapiens
gaguuugacugaugucuuc

SEQ ID NO: 500001 - RNA, 19 nt, Homo sapiens
gggauuaggagcaauuaaa

SEQ ID NO: 500002 - RNA, 19 nt, Homo sapiens
cccaggagguuauaugauu

SEQ ID NO: 500003 - RNA, 19 nt, Homo sapiens
cuuaagagaucaguugaaa

SEQ ID NO: 500004 - RNA, 19 nt, Homo sapiens
ugauuaggcuuucgaacuu

SEQ ID NO: 500005 - RNA, 19 nt, Homo sapiens
gguauugcuuugguauaua

SEQ ID NO: 500006 - RNA, 19 nt, Homo sapiens
ccaagaggaugcaaagaag

SEQ ID NO: 500007 - RNA, 19 nt, Homo sapiens
gcaauauacauuugaccua

SEQ ID NO: 500008 - RNA, 19 nt, Homo sapiens
gaggugcaauauacauuug

SEQ ID NO: 500009 - RNA, 19 nt, Homo sapiens
gaaauauggacguucaaga

SEQ ID NO: 500010 - RNA, 19 nt, Homo sapiens
ugcaagaugugcucaguuu

SEQ ID NO: 500011 - RNA, 19 nt, Homo sapiens
ggaaguguuuguuuauguc

SEQ ID NO: 500012 - RNA, 19 nt, Homo sapiens
ggcugaagcuccuaauaug

SEQ ID NO: 500013 - RNA, 19 nt, Homo sapiens
ugauugcucuucucuuuau

SEQ ID NO: 500014 - RNA, 19 nt, Homo sapiens
gaagggcaugcuaauaauu

SEQ ID NO: 500015 - RNA, 19 nt, Homo sapiens
acaaguagaaccucaguuu

SEQ ID NO: 500016 - RNA, 19 nt, Homo sapiens
gaacacaagaacaggaaga

SEQ ID NO: 500017 - RNA, 19 nt, Homo sapiens
ggaguuaagaggagaauca

SEQ ID NO: 500018 - RNA, 19 nt, Homo sapiens
uaagaagggcaugcuaaua

SEQ ID NO: 500019 - RNA, 19 nt, Homo sapiens
cguaugaaccuaaguaguu

SEQ ID NO: 500020 - RNA, 19 nt, Homo sapiens
uaacaugacagaugaguag

SEQ ID NO: 500021 - RNA, 19 nt, Homo sapiens
caucauugcuguuuguuac

SEQ ID NO: 500022 - RNA, 19 nt, Homo sapiens
aaaugaacuucuaggcuaa

SEQ ID NO: 500023 - RNA, 19 nt, Homo sapiens
aagcugaacuucugaccaa

SEQ ID NO: 500024 - RNA, 19 nt, Homo sapiens
ugacagaugaguaguaaau

SEQ ID NO: 500025 - RNA, 19 nt, Homo sapiens
gaugaguaguaaauguuga

SEQ ID NO: 500026 - RNA, 19 nt, Homo sapiens
uaaauccaguaagccaaua

SEQ ID NO: 500027 - RNA, 19 nt, Homo sapiens
gaacuucuaggcuaagcaa

SEQ ID NO: 500028 - RNA, 19 nt, Homo sapiens
gguggcagguuccagagaa

SEQ ID NO: 500029 - RNA, 19 nt, Homo sapiens
gaacagcaaaugccagaag

SEQ ID NO: 500030 - RNA, 19 nt, Homo sapiens
ccaggagguuauaugauug

SEQ ID NO: 500031 - RNA, 19 nt, Homo sapiens
cuacaaauaauccagacua

SEQ ID NO: 500032 - RNA, 19 nt, Homo sapiens
ucugauggcuuuuacaaua

SEQ ID NO: 500033 - RNA, 19 nt, Homo sapiens
caaauaauccagacuacca

SEQ ID NO: 500034 - RNA, 19 nt, Homo sapiens
gagaaucgaguagaccuuu

SEQ ID NO: 500035 - RNA, 19 nt, Homo sapiens
agaccaaauuccuuccuuu

SEQ ID NO: 500036 - RNA, 19 nt, Homo sapiens
ccagggaaguaugguauug

SEQ ID NO: 500037 - RNA, 19 nt, Homo sapiens
ugacggacauccacuagag

SEQ ID NO: 500038 - RNA, 19 nt, Homo sapiens
ggauuaggagcaauuaaau

SEQ ID NO: 500039 - RNA, 19 nt, Homo sapiens
gagucucauuuguuaguuu

SEQ ID NO: 500040 - RNA, 19 nt, Homo sapiens
uaagagaucaguugaaagg

SEQ ID NO: 500041 - RNA, 19 nt, Homo sapiens
ugaaggaggacguauucua

SEQ ID NO: 500042 - RNA, 19 nt, Homo sapiens
acagaugaguaguaaaugu

SEQ ID NO: 500043 - RNA, 19 nt, Homo sapiens
aaagcuggguacuaagaaa

SEQ ID NO: 500044 - RNA, 19 nt, Homo sapiens
cuugagacauguaaauaug

SEQ ID NO: 500045 - RNA, 19 nt, Homo sapiens
uuugcuaacugaaguguuu

SEQ ID NO: 500046 - RNA, 19 nt, Homo sapiens
ggaucagucgcauugguua

SEQ ID NO: 500047 - RNA, 19 nt, Homo sapiens
guucaagaggugcaauaua

SEQ ID NO: 500048 - RNA, 19 nt, Homo sapiens
uagcaguguuuaauggaaa

SEQ ID NO: 500049 - RNA, 19 nt, Homo sapiens
ccacgaauagcaguguuua

SEQ ID NO: 500050 - RNA, 19 nt, Homo sapiens
aggaggacguauucuagua

SEQ ID NO: 500051 - RNA, 19 nt, Homo sapiens
agaagggcaugcuaauaau

SEQ ID NO: 500052 - RNA, 19 nt, Homo sapiens
cuaaaucccacagcauaua

SEQ ID NO: 500053 - RNA, 19 nt, Homo sapiens
ugaaccauauggaugauca

SEQ ID NO: 500054 - RNA, 19 nt, Homo sapiens
cauaaacccgggacuaaug

SEQ ID NO: 500055 - RNA, 19 nt, Homo sapiens
uaauauggcaguugugaau

SEQ ID NO: 500056 - RNA, 19 nt, Homo sapiens
caucagggauuaggagcaa

SEQ ID NO: 500057 - RNA, 19 nt, Homo sapiens
aaaagaugcuggagauauu

SEQ ID NO: 500058 - RNA, 19 nt, Homo sapiens
ucaaagaggcaaagguguu

SEQ ID NO: 500059 - RNA, 19 nt, Homo sapiens
ucagucgcauugguuauaa

SEQ ID NO: 500060 - RNA, 19 nt, Homo sapiens
ggacguauucuaguacaga

SEQ ID NO: 500061 - RNA, 19 nt, Homo sapiens
ccaacaagauugcuuaaua

SEQ ID NO: 500062 - RNA, 19 nt, Homo sapiens
gaaugaagccuccuuagaa

SEQ ID NO: 500063 - RNA, 19 nt, Homo sapiens
gaaagaugaucauuuguag

SEQ ID NO: 500064 - RNA, 19 nt, Homo sapiens
caaauuucaugaccaguaa

SEQ ID NO: 500065 - RNA, 19 nt, Homo sapiens
gcaaugacucugaauuaaa

SEQ ID NO: 500066 - RNA, 19 nt, Homo sapiens
gaaccagagugcugaagga

SEQ ID NO: 500067 - RNA, 19 nt, Homo sapiens
gcaaauuucaugaccagua

SEQ ID NO: 500068 - RNA, 19 nt, Homo sapiens
ggaauuugcucguccaucu

SEQ ID NO: 500069 - RNA, 19 nt, Homo sapiens
ggcaaugacucugaauuaa

SEQ ID NO: 500070 - RNA, 19 nt, Homo sapiens
caaaauggguuacuugauu

SEQ ID NO: 500071 - RNA, 19 nt, Homo sapiens
gaaagaggaagcaaauaga

SEQ ID NO: 500072 - RNA, 19 nt, Homo sapiens
ggaaagaggaagcaaauag

SEQ ID NO: 500073 - RNA, 19 nt, Homo sapiens
guaaggagcuaaacagaac

SEQ ID NO: 500074 - RNA, 19 nt, Homo sapiens
gaucauggccauuucuaaa

SEQ ID NO: 500075 - RNA, 19 nt, Homo sapiens
caagugaucaaacuacaua

SEQ ID NO: 500076 - RNA, 19 nt, Homo sapiens
gcuacaauguccuaacuga

SEQ ID NO: 500077 - RNA, 19 nt, Homo sapiens
gcuauggacugcaggaaga

SEQ ID NO: 500078 - RNA, 19 nt, Homo sapiens
caaugacucugaauuaaag

SEQ ID NO: 500079 - RNA, 19 nt, Homo sapiens
ccagagugcugaaggaaug

SEQ ID NO: 500080 - RNA, 19 nt, Homo sapiens
caagaaguguucccugugu

SEQ ID NO: 500081 - RNA, 19 nt, Homo sapiens
gccgaaagcccuccaguuu

SEQ ID NO: 500082 - RNA, 19 nt, Homo sapiens
uaaauuguguuuccuccaa

SEQ ID NO: 500083 - RNA, 19 nt, Homo sapiens
ggccugguguuucuugaua

SEQ ID NO: 500084 - RNA, 19 nt, Homo sapiens
acugaaagaugaucauuug

SEQ ID NO: 500085 - RNA, 19 nt, Homo sapiens
ccuccaagcuauucaauuc

SEQ ID NO: 500086 - RNA, 19 nt, Homo sapiens
aaugaagccuccuuagaaa

SEQ ID NO: 500087 - RNA, 19 nt, Homo sapiens
caucaucuauagaaagcua

SEQ ID NO: 500088 - RNA, 19 nt, Homo sapiens
cuucagagaugacagcauu

SEQ ID NO: 500089 - RNA, 19 nt, Homo sapiens
uguccuaacugaaagauga

SEQ ID NO: 500090 - RNA, 19 nt, Homo sapiens
gugauuagguggugguaga

SEQ ID NO: 500091 - RNA, 19 nt, Homo sapiens
uaauguggaccuuagaaua

SEQ ID NO: 500092 - RNA, 19 nt, Homo sapiens
cuaccaaggucuucuuaau

SEQ ID NO: 500093 - RNA, 19 nt, Homo sapiens
gccuaagccucccaaguaa

SEQ ID NO: 500094 - RNA, 19 nt, Homo sapiens
gugccuaaguccaguguuu

SEQ ID NO: 500095 - RNA, 19 nt, Homo sapiens
acaccuggcugcccaagaa

SEQ ID NO: 500096 - RNA, 19 nt, Homo sapiens
uggcaaugacucugaauua

SEQ ID NO: 500097 - RNA, 19 nt, Homo sapiens
accaaggucuucuuaauau

SEQ ID NO: 500098 - RNA, 19 nt, Homo sapiens
gaacuacuucuuacuucuu

SEQ ID NO: 500099 - RNA, 19 nt, Homo sapiens
aaucgacauugaccuauuu

SEQ ID NO: 500100 - RNA, 19 nt, Homo sapiens
ucagauuauuggagacuaa

SEQ ID NO: 500101 - RNA, 19 nt, Homo sapiens
uaccaaggucuucuuaaua

SEQ ID NO: 500102 - RNA, 19 nt, Homo sapiens
ugaauuaaagcgaugcuaa

SEQ ID NO: 500103 - RNA, 19 nt, Homo sapiens
guuacuugauuggugauua

SEQ ID NO: 500104 - RNA, 19 nt, Homo sapiens
ggagacuaauucuaaugug

SEQ ID NO: 500105 - RNA, 19 nt, Homo sapiens
gcaucugccuuucuauaca

SEQ ID NO: 500106 - RNA, 19 nt, Homo sapiens
ccaagcuauucaauucuuu

SEQ ID NO: 500107 - RNA, 19 nt, Homo sapiens
uaaucgacauugaccuauu

SEQ ID NO: 500108 - RNA, 19 nt, Homo sapiens
gcugggccaucaggaauuu

SEQ ID NO: 500109 - RNA, 19 nt, Homo sapiens
ugccuaagccucccaagua

SEQ ID NO: 500110 - RNA, 19 nt, Homo sapiens
gugaucaaacuacauauug

SEQ ID NO: 500111 - RNA, 19 nt, Homo sapiens
caccaugcccagcuaauuu

SEQ ID NO: 500112 - RNA, 19 nt, Homo sapiens
uacaauguccuaacugaaa

SEQ ID NO: 500113 - RNA, 19 nt, Homo sapiens
aaagaaugaagccuccuua

SEQ ID NO: 500114 - RNA, 19 nt, Homo sapiens
gugauggccuugugaugga

SEQ ID NO: 500115 - RNA, 19 nt, Homo sapiens
uaaaccaagugaucaaacu

SEQ ID NO: 500116 - RNA, 19 nt, Homo sapiens
caucugccuuucuauacaa

SEQ ID NO: 500117 - RNA, 19 nt, Homo sapiens
uggaaacuauauugaccua

SEQ ID NO: 500118 - RNA, 19 nt, Homo sapiens
gaguagaguugaucaaaau

SEQ ID NO: 500119 - RNA, 19 nt, Homo sapiens
gcaaugacgcgaucuuggu

SEQ ID NO: 500120 - RNA, 19 nt, Homo sapiens
caaaagaaagucagccaua

SEQ ID NO: 500121 - RNA, 19 nt, Homo sapiens
gaagcaaauagaagagaga

SEQ ID NO: 500122 - RNA, 19 nt, Homo sapiens
gcagggagacuggguagga

SEQ ID NO: 500123 - RNA, 19 nt, Homo sapiens
ucucuaacauuuccuuaca

SEQ ID NO: 500124 - RNA, 19 nt, Homo sapiens
aaaggcugcugcuacaaug

SEQ ID NO: 500125 - RNA, 19 nt, Homo sapiens
gcaauucggccucggucuu

SEQ ID NO: 500126 - RNA, 19 nt, Homo sapiens
aaagaggaagcaaauagaa

SEQ ID NO: 500127 - RNA, 19 nt, Homo sapiens
caaggucuucuuaauaugu

SEQ ID NO: 500128 - RNA, 19 nt, Homo sapiens
ccaaggucuucuuaauaug

SEQ ID NO: 500129 - RNA, 19 nt, Homo sapiens
gaacucugaccuugugauc

SEQ ID NO: 500130 - RNA, 19 nt, Homo sapiens
ggagaugaauguuuuccuu

SEQ ID NO: 500131 - RNA, 19 nt, Homo sapiens
ucuaacauuuccuuacaga

SEQ ID NO: 500132 - RNA, 19 nt, Homo sapiens
gcacguacuaccacuuuua

SEQ ID NO: 500133 - RNA, 19 nt, Homo sapiens
gaaguguucccuguguaaa

SEQ ID NO: 500134 - RNA, 19 nt, Homo sapiens
ggauacagcacaguaagga

SEQ ID NO: 500135 - RNA, 19 nt, Homo sapiens
caaagcuacuauuaaucga

SEQ ID NO: 500136 - RNA, 19 nt, Homo sapiens
uuccaggacuccagaacua

SEQ ID NO: 500137 - RNA, 19 nt, Homo sapiens
gaacugugagcacgaugug

SEQ ID NO: 500138 - RNA, 19 nt, Homo sapiens
guaggaaagaggaagcaaa

SEQ ID NO: 500139 - RNA, 19 nt, Homo sapiens
aguaaaggcugcugcuaca

SEQ ID NO: 500140 - RNA, 19 nt, Homo sapiens
ggaucauggccauuucuaa

SEQ ID NO: 500141 - RNA, 19 nt, Homo sapiens
agaaugaagccuccuuaga

SEQ ID NO: 500142 - RNA, 19 nt, Homo sapiens
cuaaguccaguguuucuuu

SEQ ID NO: 500143 - RNA, 19 nt, Homo sapiens
uaacauuuccuuacagaac

SEQ ID NO: 500144 - RNA, 19 nt, Homo sapiens
uaaaggcugcugcuacaau

SEQ ID NO: 500145 - RNA, 19 nt, Homo sapiens
uaccuggccuucagagaug

SEQ ID NO: 500146 - RNA, 19 nt, Homo sapiens
aagaaguguucccugugua

SEQ ID NO: 500147 - RNA, 19 nt, Homo sapiens
gcgaugcuaacgccucuuu

SEQ ID NO: 500148 - RNA, 19 nt, Homo sapiens
uuacuugauuggugauuag

SEQ ID NO: 500149 - RNA, 19 nt, Homo sapiens
agaggaagcaaauagaaga

SEQ ID NO: 500150 - RNA, 19 nt, Homo sapiens
gaauuaaagcgaugcuaac

SEQ ID NO: 500151 - RNA, 19 nt, Homo sapiens
aaaccaagugaucaaacua

SEQ ID NO: 500152 - RNA, 19 nt, Homo sapiens
caaauagaagagagagguu

SEQ ID NO: 500153 - RNA, 19 nt, Homo sapiens
uaggaaagaggaagcaaau

SEQ ID NO: 500154 - RNA, 19 nt, Homo sapiens
guaauucuaccaaggucuu

SEQ ID NO: 500155 - RNA, 19 nt, Homo sapiens
ucauggccauuucuaaagu

SEQ ID NO: 500156 - RNA, 19 nt, Homo sapiens
agaaguguucccuguguaa

SEQ ID NO: 500157 - RNA, 19 nt, Homo sapiens
cauuuguaguugccuuaaa

SEQ ID NO: 500158 - RNA, 19 nt, Homo sapiens
cauauuguaaagcccauuu

SEQ ID NO: 500159 - RNA, 19 nt, Homo sapiens
uccaagcuauucaauucuu

SEQ ID NO: 500160 - RNA, 19 nt, Homo sapiens
ggugguagagaagcaagua

SEQ ID NO: 500161 - RNA, 19 nt, Homo sapiens
ggaaagaacuccagguuua

SEQ ID NO: 500162 - RNA, 19 nt, Homo sapiens
ggacauagauucacugaug

SEQ ID NO: 500163 - RNA, 19 nt, Homo sapiens
ggaaacaacuuuggauaua

SEQ ID NO: 500164 - RNA, 19 nt, Homo sapiens
caaaggaggucuuaucuau

SEQ ID NO: 500165 - RNA, 19 nt, Homo sapiens
gaagaggaauucauaagga

SEQ ID NO: 500166 - RNA, 19 nt, Homo sapiens
guacuuaucuccagcauca

SEQ ID NO: 500167 - RNA, 19 nt, Homo sapiens
gaacaucuccuuaguaaag

SEQ ID NO: 500168 - RNA, 19 nt, Homo sapiens
cgagagaucuuucagaaug

SEQ ID NO: 500169 - RNA, 19 nt, Homo sapiens
gaagacaaaucacaaacug

SEQ ID NO: 500170 - RNA, 19 nt, Homo sapiens
gaagaauacugguuucaca

SEQ ID NO: 500171 - RNA, 19 nt, Homo sapiens
gagagucccuuauaacaga

SEQ ID NO: 500172 - RNA, 19 nt, Homo sapiens
cacaagaacugcaaaguga

SEQ ID NO: 500173 - RNA, 19 nt, Homo sapiens
ggaacuaccugcauuugga

SEQ ID NO: 500174 - RNA, 19 nt, Homo sapiens
ggacuucaaugacuucaga

SEQ ID NO: 500175 - RNA, 19 nt, Homo sapiens
gcauuaagaugagaaagaa

SEQ ID NO: 500176 - RNA, 19 nt, Homo sapiens
gcaccacgaugcucugauu

SEQ ID NO: 500177 - RNA, 19 nt, Homo sapiens
gaacucugguuuaagcaaa

SEQ ID NO: 500178 - RNA, 19 nt, Homo sapiens
gaaaaugaacugcuacuua

SEQ ID NO: 500179 - RNA, 19 nt, Homo sapiens
gaauagagccagcaaagga

SEQ ID NO: 500180 - RNA, 19 nt, Homo sapiens
gaagaagacaaaucacaaa

SEQ ID NO: 500181 - RNA, 19 nt, Homo sapiens
aaagacacuucuggaauua

SEQ ID NO: 500182 - RNA, 19 nt, Homo sapiens
gacuuaauguaaccacuua

SEQ ID NO: 500183 - RNA, 19 nt, Homo sapiens
ugacaagacuaagcauuaa

SEQ ID NO: 500184 - RNA, 19 nt, Homo sapiens
gauuaccucuuguuuguga

SEQ ID NO: 500185 - RNA, 19 nt, Homo sapiens
ccacgaugcucugauuuaa

SEQ ID NO: 500186 - RNA, 19 nt, Homo sapiens
gaugaaaggaacaugcuua

SEQ ID NO: 500187 - RNA, 19 nt, Homo sapiens
uaaagaagagucugaagaa

SEQ ID NO: 500188 - RNA, 19 nt, Homo sapiens
gaaaggaacaugcuuaagg

SEQ ID NO: 500189 - RNA, 19 nt, Homo sapiens
gaagaugaacccaaccauu

SEQ ID NO: 500190 - RNA, 19 nt, Homo sapiens
agacuaagcauuaagauga

SEQ ID NO: 500191 - RNA, 19 nt, Homo sapiens
gugacaagacuaagcauua

SEQ ID NO: 500192 - RNA, 19 nt, Homo sapiens
gauagcaucugccuagagu

SEQ ID NO: 500193 - RNA, 19 nt, Homo sapiens
ucauaaggauucaggcuaa

SEQ ID NO: 500194 - RNA, 19 nt, Homo sapiens
ggaacaugcuuaagguugu

SEQ ID NO: 500195 - RNA, 19 nt, Homo sapiens
gaaacaacuuuggauauac

SEQ ID NO: 500196 - RNA, 19 nt, Homo sapiens
gaacccaaccauucacaaa

SEQ ID NO: 500197 - RNA, 19 nt, Homo sapiens
gaaagacggcugucauaca

SEQ ID NO: 500198 - RNA, 19 nt, Homo sapiens
ccacauggauuuaacuucu

SEQ ID NO: 500199 - RNA, 19 nt, Homo sapiens
gcaucaggcuuccagaguu

SEQ ID NO: 500200 - RNA, 19 nt, Homo sapiens
gcacaagaacugcaaagug

SEQ ID NO: 500201 - RNA, 19 nt, Homo sapiens
ggaguuggauucuguucga

SEQ ID NO: 500202 - RNA, 19 nt, Homo sapiens
gaacaugagagucccuuau

SEQ ID NO: 500203 - RNA, 19 nt, Homo sapiens
caucaggcuuccagaguuu

SEQ ID NO: 500204 - RNA, 19 nt, Homo sapiens
uaucauaacucaucaagcu

SEQ ID NO: 500205 - RNA, 19 nt, Homo sapiens
gcaaaggaggucuuaucua

SEQ ID NO: 500206 - RNA, 19 nt, Homo sapiens
acgaugcucugauuuaauu

SEQ ID NO: 500207 - RNA, 19 nt, Homo sapiens
uguaaucacuaucucauug

SEQ ID NO: 500208 - RNA, 19 nt, Homo sapiens
acaauuugauuaccucuug

SEQ ID NO: 500209 - RNA, 19 nt, Homo sapiens
ugugauagcuccuacuuca

SEQ ID NO: 500210 - RNA, 19 nt, Homo sapiens
gacauagauucacugauga

SEQ ID NO: 500211 - RNA, 19 nt, Homo sapiens
augaacaucuccuuaguaa

SEQ ID NO: 500212 - RNA, 19 nt, Homo sapiens
gcaauuccgacuauuagaa

SEQ ID NO: 500213 - RNA, 19 nt, Homo sapiens
cuuaugaacucugguuuaa

SEQ ID NO: 500214 - RNA, 19 nt, Homo sapiens
ugagaaacgucaugaacau

SEQ ID NO: 500215 - RNA, 19 nt, Homo sapiens
ggaacagguggcugaauuu

SEQ ID NO: 500216 - RNA, 19 nt, Homo sapiens
aaagaagagucugaagaaa

SEQ ID NO: 500217 - RNA, 19 nt, Homo sapiens
cagaagacauuaucgugau

SEQ ID NO: 500218 - RNA, 19 nt, Homo sapiens
ucaaugacuucagagagua

SEQ ID NO: 500219 - RNA, 19 nt, Homo sapiens
gaacugcuacuuaaaucug

SEQ ID NO: 500220 - RNA, 19 nt, Homo sapiens
gugaaagacggcugucaua

SEQ ID NO: 500221 - RNA, 19 nt, Homo sapiens
gugcuacuguccuuauuug

SEQ ID NO: 500222 - RNA, 19 nt, Homo sapiens
acaugagagucccuuauaa

SEQ ID NO: 500223 - RNA, 19 nt, Homo sapiens
gcaucugccuagagucaaa

SEQ ID NO: 500224 - RNA, 19 nt, Homo sapiens
gaauggccaugucagagau

SEQ ID NO: 500225 - RNA, 19 nt, Homo sapiens
uagauucacugaugaccaa

SEQ ID NO: 500226 - RNA, 19 nt, Homo sapiens
cuacuguccuuauuugaug

SEQ ID NO: 500227 - RNA, 19 nt, Homo sapiens
ugacuucucuuauggacau

SEQ ID NO: 500228 - RNA, 19 nt, Homo sapiens
ucagggagcauugaugaua

SEQ ID NO: 500229 - RNA, 19 nt, Homo sapiens
guccuuauuugaugagaaa

SEQ ID NO: 500230 - RNA, 19 nt, Homo sapiens
aaaggaacaugcuuaaggu

SEQ ID NO: 500231 - RNA, 19 nt, Homo sapiens
ucauaacucaucaagcuua

SEQ ID NO: 500232 - RNA, 19 nt, Homo sapiens
caacugugagugauaggua

SEQ ID NO: 500233 - RNA, 19 nt, Homo sapiens
aggaacagguggcugaauu

SEQ ID NO: 500234 - RNA, 19 nt, Homo sapiens
caagaacugcaaagugaaa

SEQ ID NO: 500235 - RNA, 19 nt, Homo sapiens
gcucugauuuaauucuaga

SEQ ID NO: 500236 - RNA, 19 nt, Homo sapiens
ggauucaggcuaaagaaga

SEQ ID NO: 500237 - RNA, 19 nt, Homo sapiens
aaaagacacuucuggaauu

SEQ ID NO: 500238 - RNA, 19 nt, Homo sapiens
gaacuaccugcauuuggaa

SEQ ID NO: 500239 - RNA, 19 nt, Homo sapiens
gcuuaugaacucugguuua

SEQ ID NO: 500240 - RNA, 19 nt, Homo sapiens
uugauuaccucuuguuugu

SEQ ID NO: 500241 - RNA, 19 nt, Homo sapiens
cgaagaagacaaaucacaa

SEQ ID NO: 500242 - RNA, 19 nt, Homo sapiens
uaccugcgaucaacuguga

SEQ ID NO: 500243 - RNA, 19 nt, Homo sapiens
gaaagaacuccagguuuag

SEQ ID NO: 500244 - RNA, 19 nt, Homo sapiens
uaugggaacuaccugcauu

SEQ ID NO: 500245 - RNA, 19 nt, Homo sapiens
gaacagguggcugaauuuc

SEQ ID NO: 500246 - RNA, 19 nt, Homo sapiens
ggaagaggaauucauaagg

SEQ ID NO: 500247 - RNA, 19 nt, Homo sapiens
cagcgaagaagacaaauca

SEQ ID NO: 500248 - RNA, 19 nt, Homo sapiens
gaugacagccuuggacuuc

SEQ ID NO: 500249 - RNA, 19 nt, Homo sapiens
cagggagcauugaugauau

SEQ ID NO: 500250 - RNA, 19 nt, Homo sapiens
aaggaggucuuaucuaugg

SEQ ID NO: 500251 - RNA, 19 nt, Homo sapiens
gaaaagacacuucuggaau

SEQ ID NO: 500252 - RNA, 19 nt, Homo sapiens
ccacuuaauguaaucacua

SEQ ID NO: 500253 - RNA, 19 nt, Homo sapiens
gaacugcaaagugaaacaa

SEQ ID NO: 500254 - RNA, 19 nt, Homo sapiens
gauauaaccaugugugcau

SEQ ID NO: 500255 - RNA, 19 nt, Homo sapiens
cccaaccauucacaaauuu

SEQ ID NO: 500256 - RNA, 19 nt, Homo sapiens
cuaaagaagagucugaaga

SEQ ID NO: 500257 - RNA, 19 nt, Homo sapiens
ccuggaagaggaauucaua

SEQ ID NO: 500258 - RNA, 19 nt, Homo sapiens
caauuccgacuauuagaaa

SEQ ID NO: 500259 - RNA, 19 nt, Homo sapiens
acccaaccauucacaaauu

SEQ ID NO: 500260 - RNA, 19 nt, Homo sapiens
uaggaaacaacuuuggaua

SEQ ID NO: 500261 - RNA, 19 nt, Homo sapiens
ccuagaagcugaauaguga

SEQ ID NO: 500262 - RNA, 19 nt, Homo sapiens
caaggaauauuucuccaaa

SEQ ID NO: 500263 - RNA, 19 nt, Homo sapiens
gcacacaggccuagaggua

SEQ ID NO: 500264 - RNA, 19 nt, Homo sapiens
gaauauuucuccaaacaca

SEQ ID NO: 500265 - RNA, 19 nt, Homo sapiens
gccuagagguaaccaauaa

SEQ ID NO: 500266 - RNA, 19 nt, Homo sapiens
ggaaguacgugguccucuu

SEQ ID NO: 500267 - RNA, 19 nt, Homo sapiens
ccgcaaagcugggcuguga

SEQ ID NO: 500268 - RNA, 19 nt, Homo sapiens
gaaguacgugguccucuuu

SEQ ID NO: 500269 - RNA, 19 nt, Homo sapiens
agagguaaccaauaaagua

SEQ ID NO: 500270 - RNA, 19 nt, Homo sapiens
gaagcugucggacuacaaa

SEQ ID NO: 500271 - RNA, 19 nt, Homo sapiens
ccacgcagcuuucagucau

SEQ ID NO: 500272 - RNA, 19 nt, Homo sapiens
gagguaaccaauaaaguau

SEQ ID NO: 500273 - RNA, 19 nt, Homo sapiens
gcaaggaauauuucuccaa

SEQ ID NO: 500274 - RNA, 19 nt, Homo sapiens
gcuaacggauagugagcuu

SEQ ID NO: 500275 - RNA, 19 nt, Homo sapiens
aggaauauuucuccaaaca

SEQ ID NO: 500276 - RNA, 19 nt, Homo sapiens
gaugacagcaaggaauauu

SEQ ID NO: 500277 - RNA, 19 nt, Homo sapiens
gagaucaucgcguucacaa

SEQ ID NO: 500278 - RNA, 19 nt, Homo sapiens
aggugaagcugucggacua

SEQ ID NO: 500279 - RNA, 19 nt, Homo sapiens
gcaaagcugggcugugaag

SEQ ID NO: 500280 - RNA, 19 nt, Homo sapiens
ugacagcaaggaauauuuc

SEQ ID NO: 500281 - RNA, 19 nt, Homo sapiens
uggaugacagcaaggaaua

SEQ ID NO: 500282 - RNA, 19 nt, Homo sapiens
ucacccaccuggcuuggau

SEQ ID NO: 500283 - RNA, 19 nt, Homo sapiens
ggccuagagguaaccaaua

SEQ ID NO: 500284 - RNA, 19 nt, Homo sapiens
uaacggauagugagcuugu

SEQ ID NO: 500285 - RNA, 19 nt, Homo sapiens
guccgugcgucuagccuuu

SEQ ID NO: 500286 - RNA, 19 nt, Homo sapiens
ggauuacggcgugcugaaa

SEQ ID NO: 500287 - RNA, 19 nt, Homo sapiens
guccaggccuuccaguaca

SEQ ID NO: 500288 - RNA, 19 nt, Homo sapiens
gccagaucacuguuaauga

SEQ ID NO: 500289 - RNA, 19 nt, Homo sapiens
ccaccuggcuuggaucaac

SEQ ID NO: 500290 - RNA, 19 nt, Homo sapiens
gacgcuugucugaggauua

SEQ ID NO: 500291 - RNA, 19 nt, Homo sapiens
acacaggccuagagguaac

SEQ ID NO: 500292 - RNA, 19 nt, Homo sapiens
uaggcuggcuaacggauag

SEQ ID NO: 500293 - RNA, 19 nt, Homo sapiens
gguccaggccuuccaguac

SEQ ID NO: 500294 - RNA, 19 nt, Homo sapiens
ccucuggacuucacuuuug

SEQ ID NO: 500295 - RNA, 19 nt, Homo sapiens
gcgucucgguggacucuca

SEQ ID NO: 500296 - RNA, 19 nt, Homo sapiens
ucgguggacucucaguuca

SEQ ID NO: 500297 - RNA, 19 nt, Homo sapiens
ggaugacagcaaggaauau

SEQ ID NO: 500298 - RNA, 19 nt, Homo sapiens
cgccagaucacuguuaaug

SEQ ID NO: 500299 - RNA, 19 nt, Homo sapiens
gacgugaccagacgcuugu

SEQ ID NO: 500300 - RNA, 19 nt, Homo sapiens
aaagcugggcugugaagug

SEQ ID NO: 500301 - RNA, 19 nt, Homo sapiens
uaaaggaacuguuuggaaa

SEQ ID NO: 500302 - RNA, 19 nt, Homo sapiens
gagcacaacaucauauuua

SEQ ID NO: 500303 - RNA, 19 nt, Homo sapiens
gagaauggccgauuuguau

SEQ ID NO: 500304 - RNA, 19 nt, Homo sapiens
ccagagaaauauaugauga

SEQ ID NO: 500305 - RNA, 19 nt, Homo sapiens
aaagaaagguggcuuaaag

SEQ ID NO: 500306 - RNA, 19 nt, Homo sapiens
aaacagggauacacaagaa

SEQ ID NO: 500307 - RNA, 19 nt, Homo sapiens
gaaaacaggugucuaguca

SEQ ID NO: 500308 - RNA, 19 nt, Homo sapiens
gaaagguggcuuaaaggaa

SEQ ID NO: 500309 - RNA, 19 nt, Homo sapiens
ggacauucgucagauuuau

SEQ ID NO: 500310 - RNA, 19 nt, Homo sapiens
cacaagacgucaagccuuu

SEQ ID NO: 500311 - RNA, 19 nt, Homo sapiens
ccacugccauucauaacaa

SEQ ID NO: 500312 - RNA, 19 nt, Homo sapiens
cgauuuguauaccgaauaa

SEQ ID NO: 500313 - RNA, 19 nt, Homo sapiens
gaucagacugcaaaggaua

SEQ ID NO: 500314 - RNA, 19 nt, Homo sapiens
uaaaggaucagacugcaaa

SEQ ID NO: 500315 - RNA, 19 nt, Homo sapiens
gcagauaagccaauugaca

SEQ ID NO: 500316 - RNA, 19 nt, Homo sapiens
gcaagacgaggaccagaaa

SEQ ID NO: 500317 - RNA, 19 nt, Homo sapiens
aaacaggugucuagucaca

SEQ ID NO: 500318 - RNA, 19 nt, Homo sapiens
ccacaagcucaaacacuua

SEQ ID NO: 500319 - RNA, 19 nt, Homo sapiens
ggaaagggcccucaaaaug

SEQ ID NO: 500320 - RNA, 19 nt, Homo sapiens
cgacaucgagcaaagcuuu

SEQ ID NO: 500321 - RNA, 19 nt, Homo sapiens
gacggaguaugcaagguuu

SEQ ID NO: 500322 - RNA, 19 nt, Homo sapiens
ggagcacaacaucauauuu

SEQ ID NO: 500323 - RNA, 19 nt, Homo sapiens
gaacacggagcacaacauc

SEQ ID NO: 500324 - RNA, 19 nt, Homo sapiens
cagauaagccaauugacaa

SEQ ID NO: 500325 - RNA, 19 nt, Homo sapiens
ugguaggaaugaauugaua

SEQ ID NO: 500326 - RNA, 19 nt, Homo sapiens
ggaaaaucaucuuaucaga

SEQ ID NO: 500327 - RNA, 19 nt, Homo sapiens
cugcauggccuguguguuu

SEQ ID NO: 500328 - RNA, 19 nt, Homo sapiens
uaacaaacagggauacaca

SEQ ID NO: 500329 - RNA, 19 nt, Homo sapiens
ucaaacacuuaccagagaa

SEQ ID NO: 500330 - RNA, 19 nt, Homo sapiens
acaggugucuagucacauu

SEQ ID NO: 500331 - RNA, 19 nt, Homo sapiens
ggaagcaaguaguagaaaa

SEQ ID NO: 500332 - RNA, 19 nt, Homo sapiens
ggaucagacugcaaaggau

SEQ ID NO: 500333 - RNA, 19 nt, Homo sapiens
guacaacaaacaccucuuc

SEQ ID NO: 500334 - RNA, 19 nt, Homo sapiens
gcacaacaucauauuuaca

SEQ ID NO: 500335 - RNA, 19 nt, Homo sapiens
cccaaugugugaauauaug

SEQ ID NO: 500336 - RNA, 19 nt, Homo sapiens
gggcugauuuaaacugcaa

SEQ ID NO: 500337 - RNA, 19 nt, Homo sapiens
gacccagacucguacaaca

SEQ ID NO: 500338 - RNA, 19 nt, Homo sapiens
gaauugauagccagauaca

SEQ ID NO: 500339 - RNA, 19 nt, Homo sapiens
caaaauguaugguaggaau

SEQ ID NO: 500340 - RNA, 19 nt, Homo sapiens
ggaggaaaaucaucuuauc

SEQ ID NO: 500341 - RNA, 19 nt, Homo sapiens
acacuuaccagagaaauau

SEQ ID NO: 500342 - RNA, 19 nt, Homo sapiens
cucaaacacuuaccagaga

SEQ ID NO: 500343 - RNA, 19 nt, Homo sapiens
ugagaauggccgauuugua

SEQ ID NO: 500344 - RNA, 19 nt, Homo sapiens
guuugagaauggccgauuu

SEQ ID NO: 500345 - RNA, 19 nt, Homo sapiens
caaacagggauacacaaga

SEQ ID NO: 500346 - RNA, 19 nt, Homo sapiens
gaaaagaaagguggcuuaa

SEQ ID NO: 500347 - RNA, 19 nt, Homo sapiens
ggcaugccaaccauucuua

SEQ ID NO: 500348 - RNA, 19 nt, Homo sapiens
guacgagaguucugaaaau

SEQ ID NO: 500349 - RNA, 19 nt, Homo sapiens
uccacaagcucaaacacuu

SEQ ID NO: 500350 - RNA, 19 nt, Homo sapiens
uuaaaggaacuguuuggaa

SEQ ID NO: 500351 - RNA, 19 nt, Homo sapiens
ggauacacaagaaacucua

SEQ ID NO: 500352 - RNA, 19 nt, Homo sapiens
gauagccagauacaucaaa

SEQ ID NO: 500353 - RNA, 19 nt, Homo sapiens
guaaaauucugggcugauu

SEQ ID NO: 500354 - RNA, 19 nt, Homo sapiens
augaauugauagccagaua

SEQ ID NO: 500355 - RNA, 19 nt, Homo sapiens
acugcaauauucaagauga

SEQ ID NO: 500356 - RNA, 19 nt, Homo sapiens
agaauggccgauuuguaua

SEQ ID NO: 500357 - RNA, 19 nt, Homo sapiens
uggcuuaaaggaacuguuu

SEQ ID NO: 500358 - RNA, 19 nt, Homo sapiens
aggaggcccuggcuaucua

SEQ ID NO: 500359 - RNA, 19 nt, Homo sapiens
gaauggccgauuuguauac

SEQ ID NO: 500360 - RNA, 19 nt, Homo sapiens
uaugcaagguuugagaaug

SEQ ID NO: 500361 - RNA, 19 nt, Homo sapiens
aagaaacucuacucugcau

SEQ ID NO: 500362 - RNA, 19 nt, Homo sapiens
caaacacuuaccagagaaa

SEQ ID NO: 500363 - RNA, 19 nt, Homo sapiens
ccaaugugugaauauauga

SEQ ID NO: 500364 - RNA, 19 nt, Homo sapiens
ggcuaucuauccaccaugu

SEQ ID NO: 500365 - RNA, 19 nt, Homo sapiens
gggaagcaaguaguagaaa

SEQ ID NO: 500366 - RNA, 19 nt, Homo sapiens
cgagaguucugaaaauaug

SEQ ID NO: 500367 - RNA, 19 nt, Homo sapiens
gaaggcaaaauguauggua

SEQ ID NO: 500368 - RNA, 19 nt, Homo sapiens
guggacauucgucagauuu

SEQ ID NO: 500369 - RNA, 19 nt, Homo sapiens
gcugauuuaaacugcaaua

SEQ ID NO: 500370 - RNA, 19 nt, Homo sapiens
auucugggcugauuuaaac

SEQ ID NO: 500371 - RNA, 19 nt, Homo sapiens
ccaaccauucuuacaguga

SEQ ID NO: 500372 - RNA, 19 nt, Homo sapiens
cagccaggauccucacaag

SEQ ID NO: 500373 - RNA, 19 nt, Homo sapiens
auuccaagcuaaaggauca

SEQ ID NO: 500374 - RNA, 19 nt, Homo sapiens
gaaagggcccucaaaaugc

SEQ ID NO: 500375 - RNA, 19 nt, Homo sapiens
agaaagguggcuuaaagga

SEQ ID NO: 500376 - RNA, 19 nt, Homo sapiens
acagugacccauugcuuga

SEQ ID NO: 500377 - RNA, 19 nt, Homo sapiens
gguggaauuuucagcuuuu

SEQ ID NO: 500378 - RNA, 19 nt, Homo sapiens
ggcaagacgaggaccagaa

SEQ ID NO: 500379 - RNA, 19 nt, Homo sapiens
acacggagcacaacaucau

SEQ ID NO: 500380 - RNA, 19 nt, Homo sapiens
gccuguguguuugaaguuu

SEQ ID NO: 500381 - RNA, 19 nt, Homo sapiens
gaguaugcaagguuugaga

SEQ ID NO: 500382 - RNA, 19 nt, Homo sapiens
guagagacggaguaugcaa

SEQ ID NO: 500383 - RNA, 19 nt, Homo sapiens
uacgagaguucugaaaaua

SEQ ID NO: 500384 - RNA, 19 nt, Homo sapiens
cugcagauaagccaauuga

SEQ ID NO: 500385 - RNA, 19 nt, Homo sapiens
gacauucgucagauuuaug

SEQ ID NO: 500386 - RNA, 19 nt, Homo sapiens
aaauguaugguaggaauga

SEQ ID NO: 500387 - RNA, 19 nt, Homo sapiens
agacggaguaugcaagguu

SEQ ID NO: 500388 - RNA, 19 nt, Homo sapiens
ucaguggacauucgucaga

SEQ ID NO: 500389 - RNA, 19 nt, Homo sapiens
gaucaacuucauccacaag

SEQ ID NO: 500390 - RNA, 19 nt, Homo sapiens
agucaccuguuccaccaaa

SEQ ID NO: 500391 - RNA, 19 nt, Homo sapiens
acccauugcuugaaucagu

SEQ ID NO: 500392 - RNA, 19 nt, Homo sapiens
auaaaccgcuccccaaugu

SEQ ID NO: 500393 - RNA, 19 nt, Homo sapiens
gaauaaaccgcuccccaau

SEQ ID NO: 500394 - RNA, 19 nt, Homo sapiens
ugaaaagaaagguggcuua

SEQ ID NO: 500395 - RNA, 19 nt, Homo sapiens
gcuugaaucaguggacauu

SEQ ID NO: 500396 - RNA, 19 nt, Homo sapiens
gggcaugccaaccauucuu

SEQ ID NO: 500397 - RNA, 19 nt, Homo sapiens
auaaggcccugcagcacau

SEQ ID NO: 500398 - RNA, 19 nt, Homo sapiens
gaggaggaaaaucaucuua

SEQ ID NO: 500399 - RNA, 19 nt, Homo sapiens
ugaucaacuucauccacaa

SEQ ID NO: 500400 - RNA, 19 nt, Homo sapiens
augcaagguuugagaaugg

SEQ ID NO: 500401 - RNA, 19 nt, Homo sapiens
ccaaaucuaugacaaauuc

SEQ ID NO: 500402 - RNA, 19 nt, Homo sapiens
gcaagcaggugguggagaa

SEQ ID NO: 500403 - RNA, 19 nt, Homo sapiens
ccacgaaggucugcucuuu

SEQ ID NO: 500404 - RNA, 19 nt, Homo sapiens
gggcagaccucaacaccaa

SEQ ID NO: 500405 - RNA, 19 nt, Homo sapiens
ggacauccgccaaaucuau

SEQ ID NO: 500406 - RNA, 19 nt, Homo sapiens
ggaacaaacugugccugaa

SEQ ID NO: 500407 - RNA, 19 nt, Homo sapiens
ucaagcaccucccugagaa

SEQ ID NO: 500408 - RNA, 19 nt, Homo sapiens
uaaaggaccaggcagcuaa

SEQ ID NO: 500409 - RNA, 19 nt, Homo sapiens
gugaguacaugaucaacuu

SEQ ID NO: 500410 - RNA, 19 nt, Homo sapiens
agaauggacacuacucuua

SEQ ID NO: 500411 - RNA, 19 nt, Homo sapiens
gugcauugccuaugucuuu

SEQ ID NO: 500412 - RNA, 19 nt, Homo sapiens
ggacaagcccaucgacaau

SEQ ID NO: 500413 - RNA, 19 nt, Homo sapiens
cccaagaugcuguguauuu

SEQ ID NO: 500414 - RNA, 19 nt, Homo sapiens
ccugagaaguacaugauga

SEQ ID NO: 500415 - RNA, 19 nt, Homo sapiens
ucuacaggcuggugaaaga

SEQ ID NO: 500416 - RNA, 19 nt, Homo sapiens
gacagaguaugcucgcuau

SEQ ID NO: 500417 - RNA, 19 nt, Homo sapiens
gaaaguugagacagaguau

SEQ ID NO: 500418 - RNA, 19 nt, Homo sapiens
acaagcccaucgacaauga

SEQ ID NO: 500419 - RNA, 19 nt, Homo sapiens
gccgaaacgucccaugaug

SEQ ID NO: 500420 - RNA, 19 nt, Homo sapiens
ggugcuggcucgucgcaaa

SEQ ID NO: 500421 - RNA, 19 nt, Homo sapiens
ggaagacccgcaccaggaa

SEQ ID NO: 500422 - RNA, 19 nt, Homo sapiens
caaauaaacccaagaugcu

SEQ ID NO: 500423 - RNA, 19 nt, Homo sapiens
gaggagcaguugugacucu

SEQ ID NO: 500424 - RNA, 19 nt, Homo sapiens
acucaaggaucucuucgaa

SEQ ID NO: 500425 - RNA, 19 nt, Homo sapiens
gccacggccuuccacagua

SEQ ID NO: 500426 - RNA, 19 nt, Homo sapiens
uggagaaaguugagacaga

SEQ ID NO: 500427 - RNA, 19 nt, Homo sapiens
cccaugaugugaagccuuu

SEQ ID NO: 500428 - RNA, 19 nt, Homo sapiens
gaacaaacugugccugaac

SEQ ID NO: 500429 - RNA, 19 nt, Homo sapiens
gggcucagcaccacaucua

SEQ ID NO: 500430 - RNA, 19 nt, Homo sapiens
agaaguacaugaugaacag

SEQ ID NO: 500431 - RNA, 19 nt, Homo sapiens
gcaccucccugagaaguac

SEQ ID NO: 500432 - RNA, 19 nt, Homo sapiens
gagaggagcaguugugacu

SEQ ID NO: 500433 - RNA, 19 nt, Homo sapiens
gagcugagaggagcaguug

SEQ ID NO: 500434 - RNA, 19 nt, Homo sapiens
ccaagaugcuguguauuuu

SEQ ID NO: 500435 - RNA, 19 nt, Homo sapiens
aacccaagaugcuguguau

SEQ ID NO: 500436 - RNA, 19 nt, Homo sapiens
gagaaguacaugaugaaca

SEQ ID NO: 500437 - RNA, 19 nt, Homo sapiens
gaauggacacuacucuuac

SEQ ID NO: 500438 - RNA, 19 nt, Homo sapiens
gagaauggacacuacucuu

SEQ ID NO: 500439 - RNA, 19 nt, Homo sapiens
ggacgagggcaagauguau

SEQ ID NO: 500440 - RNA, 19 nt, Homo sapiens
gcuaugagaauggacacua

SEQ ID NO: 500441 - RNA, 19 nt, Homo sapiens
cagaguaugcucgcuauga

SEQ ID NO: 500442 - RNA, 19 nt, Homo sapiens
cgaaacgucccaugaugug

SEQ ID NO: 500443 - RNA, 19 nt, Homo sapiens
ugacaaauucccggagaaa

SEQ ID NO: 500444 - RNA, 19 nt, Homo sapiens
cgccaaaucuaugacaaau

SEQ ID NO: 500445 - RNA, 19 nt, Homo sapiens
ccacggccuuccacaguag

SEQ ID NO: 500446 - RNA, 19 nt, Homo sapiens
gcaaagcucgcgagaucca

SEQ ID NO: 500447 - RNA, 19 nt, Homo sapiens
ccaacgagcgcuccuccaa

SEQ ID NO: 500448 - RNA, 19 nt, Homo sapiens
gaaacgucccaugauguga

SEQ ID NO: 500449 - RNA, 19 nt, Homo sapiens
gcugagaggagcaguugug

SEQ ID NO: 500450 - RNA, 19 nt, Homo sapiens
aaacgucccaugaugugaa

SEQ ID NO: 500451 - RNA, 19 nt, Homo sapiens
acaaggcccugcagagcau

SEQ ID NO: 500452 - RNA, 19 nt, Homo sapiens
gaacggggacccuccaaug

SEQ ID NO: 500453 - RNA, 19 nt, Homo sapiens
gcugauugcccgcuacauc

SEQ ID NO: 500454 - RNA, 19 nt, Homo sapiens
gcaggucuccagccacauc

SEQ ID NO: 500455 - RNA, 19 nt, Homo sapiens
gagauccaggccaagcuaa

SEQ ID NO: 500456 - RNA, 19 nt, Homo sapiens
ggugaaagaaugagagacu

SEQ ID NO: 500457 - RNA, 19 nt, Homo sapiens
guguggagcccggauauug

SEQ ID NO: 500458 - RNA, 19 nt, Homo sapiens
agaaaguugagacagagua

SEQ ID NO: 500459 - RNA, 19 nt, Homo sapiens
ccaggcagcuaaggacaag

SEQ ID NO: 500460 - RNA, 19 nt, Homo sapiens
cgagauccaggccaagcua

SEQ ID NO: 500461 - RNA, 19 nt, Homo sapiens
gcauugccuaugucuuuga

SEQ ID NO: 500462 - RNA, 19 nt, Homo sapiens
agaguaugcucgcuaugag

SEQ ID NO: 500463 - RNA, 19 nt, Homo sapiens
aagccuuucucucagcaaa

SEQ ID NO: 500464 - RNA, 19 nt, Homo sapiens
gacaagcccaucgacaaug

SEQ ID NO: 500465 - RNA, 19 nt, Homo sapiens
gcucagcaccacaucuaca

SEQ ID NO: 500466 - RNA, 19 nt, Homo sapiens
gcaggugguggagaaaguu

SEQ ID NO: 500467 - RNA, 19 nt, Homo sapiens
gacauccgccaaaucuaug

SEQ ID NO: 500468 - RNA, 19 nt, Homo sapiens
guggacauccgccaaaucu

SEQ ID NO: 500469 - RNA, 19 nt, Homo sapiens
gagacacacaggagaccuu

SEQ ID NO: 500470 - RNA, 19 nt, Homo sapiens
cggacgagggcaagaugua

SEQ ID NO: 500471 - RNA, 19 nt, Homo sapiens
gaucaacuucauccacaag

SEQ ID NO: 500472 - RNA, 19 nt, Homo sapiens
gaguaugcucgcuaugaga

SEQ ID NO: 500473 - RNA, 19 nt, Homo sapiens
agacgugugugcaggaaac

SEQ ID NO: 500474 - RNA, 19 nt, Homo sapiens
uggacaagcccaucgacaa

SEQ ID NO: 500475 - RNA, 19 nt, Homo sapiens
gacgagggcaagauguaug

SEQ ID NO: 500476 - RNA, 19 nt, Homo sapiens
caacaccaacaucgaggau

SEQ ID NO: 500477 - RNA, 19 nt, Homo sapiens
gcagaccucaacaccaaca

SEQ ID NO: 500478 - RNA, 19 nt, Homo sapiens
gccaaaucuaugacaaauu

SEQ ID NO: 500479 - RNA, 19 nt, Homo sapiens
acaggcuggugaaagaaug

SEQ ID NO: 500480 - RNA, 19 nt, Homo sapiens
cuaaaggaccaggcagcua

SEQ ID NO: 500481 - RNA, 19 nt, Homo sapiens
ugaucaacuucauccacaa

SEQ ID NO: 500482 - RNA, 19 nt, Homo sapiens
gaguacaugaucaacuuca

SEQ ID NO: 500483 - RNA, 19 nt, Homo sapiens
gcaccauuaccuccaacga

SEQ ID NO: 500484 - RNA, 19 nt, Homo sapiens
gauccaggccaagcuaaag

SEQ ID NO: 500485 - RNA, 19 nt, Homo sapiens
ccgaaacgucccaugaugu

SEQ ID NO: 500486 - RNA, 19 nt, Homo sapiens
aaacccaagaugcugugua

SEQ ID NO: 500487 - RNA, 19 nt, Homo sapiens
cuaugagaauggacacuac

SEQ ID NO: 500488 - RNA, 19 nt, Homo sapiens
uaugcucgcuaugagaaug

SEQ ID NO: 500489 - RNA, 19 nt, Homo sapiens
ccgccaaaucuaugacaaa

SEQ ID NO: 500490 - RNA, 19 nt, Homo sapiens
gcaaacaggugguagagaa

SEQ ID NO: 500491 - RNA, 19 nt, Homo sapiens
ugaaggagcucuaugagaa

SEQ ID NO: 500492 - RNA, 19 nt, Homo sapiens
ggaagaaggugcgggagua

SEQ ID NO: 500493 - RNA, 19 nt, Homo sapiens
gcagaaggcuuuugauuuu

SEQ ID NO: 500494 - RNA, 19 nt, Homo sapiens
gagaguagcagaaggcuuu

SEQ ID NO: 500495 - RNA, 19 nt, Homo sapiens
ggugggcacuguucccuua

SEQ ID NO: 500496 - RNA, 19 nt, Homo sapiens
ccagaucuaugacaaauuc

SEQ ID NO: 500497 - RNA, 19 nt, Homo sapiens
uagagaagguggagacuga

SEQ ID NO: 500498 - RNA, 19 nt, Homo sapiens
gguccucacuguuugcaua

SEQ ID NO: 500499 - RNA, 19 nt, Homo sapiens
gcgaguacaugaucaacuu

SEQ ID NO: 500500 - RNA, 19 nt, Homo sapiens
gaagggagcacagcaggua

SEQ ID NO: 500501 - RNA, 19 nt, Homo sapiens
ggaagacucggacaagaaa

SEQ ID NO: 500502 - RNA, 19 nt, Homo sapiens
gggcagagcuggaguucuc

SEQ ID NO: 500503 - RNA, 19 nt, Homo sapiens
ucuacaagcucgucaaaga

SEQ ID NO: 500504 - RNA, 19 nt, Homo sapiens
caauuuaccugccuagagu

SEQ ID NO: 500505 - RNA, 19 nt, Homo sapiens
ggaagaucauccugucaga

SEQ ID NO: 500506 - RNA, 19 nt, Homo sapiens
gcacuguucccuuagguuu

SEQ ID NO: 500507 - RNA, 19 nt, Homo sapiens
guucugcgcuuuaauugug

SEQ ID NO: 500508 - RNA, 19 nt, Homo sapiens
ggacagagggcccacacuu

SEQ ID NO: 500509 - RNA, 19 nt, Homo sapiens
ugaagcaccugcccgagaa

SEQ ID NO: 500510 - RNA, 19 nt, Homo sapiens
ccacuguucugcgcuuuaa

SEQ ID NO: 500511 - RNA, 19 nt, Homo sapiens
gagcacagcagguacuaga

SEQ ID NO: 500512 - RNA, 19 nt, Homo sapiens
gauugaaggagcucuauga

SEQ ID NO: 500513 - RNA, 19 nt, Homo sapiens
gagcccagguuuauacuac

SEQ ID NO: 500514 - RNA, 19 nt, Homo sapiens
gguccaggauugaggauuc

SEQ ID NO: 500515 - RNA, 19 nt, Homo sapiens
cgccgacgcucagcaguua

SEQ ID NO: 500516 - RNA, 19 nt, Homo sapiens
ugaagguccucacuguuug

SEQ ID NO: 500517 - RNA, 19 nt, Homo sapiens
ccaccuagguuuuauaaug

SEQ ID NO: 500518 - RNA, 19 nt, Homo sapiens
gaacccugcuugucauugc

SEQ ID NO: 500519 - RNA, 19 nt, Homo sapiens
gggaagacucggacaagaa

SEQ ID NO: 500520 - RNA, 19 nt, Homo sapiens
gaagguggagacugaguau

SEQ ID NO: 500521 - RNA, 19 nt, Homo sapiens
cagcauguguggccacugu

SEQ ID NO: 500522 - RNA, 19 nt, Homo sapiens
cagagcaaccagcacaaua

SEQ ID NO: 500523 - RNA, 19 nt, Homo sapiens
acaaagcccuucagagcau

SEQ ID NO: 500524 - RNA, 19 nt, Homo sapiens
ccaguguccugcagaacaa

SEQ ID NO: 500525 - RNA, 19 nt, Homo sapiens
agaaguacaugaugaacag

SEQ ID NO: 500526 - RNA, 19 nt, Homo sapiens
cagcugugauggguuauau

SEQ ID NO: 500527 - RNA, 19 nt, Homo sapiens
caagauguacggccgaaau

SEQ ID NO: 500528 - RNA, 19 nt, Homo sapiens
cugaagguccucacuguuu

SEQ ID NO: 500529 - RNA, 19 nt, Homo sapiens
cccagcaccuuccagauug

SEQ ID NO: 500530 - RNA, 19 nt, Homo sapiens
uugauugcacgcuauauua

SEQ ID NO: 500531 - RNA, 19 nt, Homo sapiens
gauugcacgcuauauuaaa

SEQ ID NO: 500532 - RNA, 19 nt, Homo sapiens
gagaaguacaugaugaaca

SEQ ID NO: 500533 - RNA, 19 nt, Homo sapiens
caaaggcccaguuccuguu

SEQ ID NO: 500534 - RNA, 19 nt, Homo sapiens
aggaaggagucccagcuuu

SEQ ID NO: 500535 - RNA, 19 nt, Homo sapiens
ggauugaggauucaucuac

SEQ ID NO: 500536 - RNA, 19 nt, Homo sapiens
guaccagguuggcaucaag

SEQ ID NO: 500537 - RNA, 19 nt, Homo sapiens
ugauugcacgcuauauuaa

SEQ ID NO: 500538 - RNA, 19 nt, Homo sapiens
cccgagaaguacaugauga

SEQ ID NO: 500539 - RNA, 19 nt, Homo sapiens
cagacgagggcaagaugua

SEQ ID NO: 500540 - RNA, 19 nt, Homo sapiens
ggaaggagucccagcuuuu

SEQ ID NO: 500541 - RNA, 19 nt, Homo sapiens
gaugugcgccagaucuaug

SEQ ID NO: 500542 - RNA, 19 nt, Homo sapiens
ggaguauucagccuucaug

SEQ ID NO: 500543 - RNA, 19 nt, Homo sapiens
ggacaucaagcccuuugca

SEQ ID NO: 500544 - RNA, 19 nt, Homo sapiens
ccagcaccuuccagauuga

SEQ ID NO: 500545 - RNA, 19 nt, Homo sapiens
guugauugcacgcuauauu

SEQ ID NO: 500546 - RNA, 19 nt, Homo sapiens
gaaggagcucuaugagaag

SEQ ID NO: 500547 - RNA, 19 nt, Homo sapiens
ccagagcccagguuuauac

SEQ ID NO: 500548 - RNA, 19 nt, Homo sapiens
gacagagggcccacacuuc

SEQ ID NO: 500549 - RNA, 19 nt, Homo sapiens
ugaguugauugcacgcuau

SEQ ID NO: 500550 - RNA, 19 nt, Homo sapiens
cgccagaucuaugacaaau

SEQ ID NO: 500551 - RNA, 19 nt, Homo sapiens
uggcaggaccguaccauug

SEQ ID NO: 500552 - RNA, 19 nt, Homo sapiens
acagguguccagccacaua

SEQ ID NO: 500553 - RNA, 19 nt, Homo sapiens
gaguugauugcacgcuaua

SEQ ID NO: 500554 - RNA, 19 nt, Homo sapiens
auccagcugugauggguua

SEQ ID NO: 500555 - RNA, 19 nt, Homo sapiens
cggccgaaaugaguugauu

SEQ ID NO: 500556 - RNA, 19 nt, Homo sapiens
gaggaaggagucccagcuu

SEQ ID NO: 500557 - RNA, 19 nt, Homo sapiens
cuaaugccuucuuccuugu

SEQ ID NO: 500558 - RNA, 19 nt, Homo sapiens
gcacaauagcguccaacag

SEQ ID NO: 500559 - RNA, 19 nt, Homo sapiens
acaagcucgucaaagacua

SEQ ID NO: 500560 - RNA, 19 nt, Homo sapiens
ccacauacagguucuagcu

SEQ ID NO: 500561 - RNA, 19 nt, Homo sapiens
ccagauugagagcaaggua

SEQ ID NO: 500562 - RNA, 19 nt, Homo sapiens
gcguaggucucuggguuuc

SEQ ID NO: 500563 - RNA, 19 nt, Homo sapiens
ggguuggacugaggacaga

SEQ ID NO: 500564 - RNA, 19 nt, Homo sapiens
gaggauugaaggagcucua

SEQ ID NO: 500565 - RNA, 19 nt, Homo sapiens
guacggccgaaaugaguug

SEQ ID NO: 500566 - RNA, 19 nt, Homo sapiens
gcacgcuauauuaaacuga

SEQ ID NO: 500567 - RNA, 19 nt, Homo sapiens
gagcaagguagaggaagga

SEQ ID NO: 500568 - RNA, 19 nt, Homo sapiens
ccagcaccaugucuacaag

SEQ ID NO: 500569 - RNA, 19 nt, Homo sapiens
uguggguauuuaugaguuu

SEQ ID NO: 500570 - RNA, 19 nt, Homo sapiens
cacacucccugccacuguu

SEQ ID NO: 500571 - RNA, 19 nt, Homo sapiens
gaucaacuucauccacaag

SEQ ID NO: 500572 - RNA, 19 nt, Homo sapiens
caccuguggguauuuauga

SEQ ID NO: 500573 - RNA, 19 nt, Homo sapiens
gcagucccagacccaguuu

SEQ ID NO: 500574 - RNA, 19 nt, Homo sapiens
gggcacuguucccuuaggu

SEQ ID NO: 500575 - RNA, 19 nt, Homo sapiens
gagggagagaguagcagaa

SEQ ID NO: 500576 - RNA, 19 nt, Homo sapiens
ugagagcaagguagaggaa

SEQ ID NO: 500577 - RNA, 19 nt, Homo sapiens
gggcccagcaccaugucua

SEQ ID NO: 500578 - RNA, 19 nt, Homo sapiens
ugucauugcuuuugucuuc

SEQ ID NO: 500579 - RNA, 19 nt, Homo sapiens
ccgagaaguacaugaugaa

SEQ ID NO: 500580 - RNA, 19 nt, Homo sapiens
agaagguggagacugagua

SEQ ID NO: 500581 - RNA, 19 nt, Homo sapiens
gauguacggccgaaaugag

SEQ ID NO: 500582 - RNA, 19 nt, Homo sapiens
ucaauuuaccugccuagag

SEQ ID NO: 500583 - RNA, 19 nt, Homo sapiens
gaggcuugaaucugacaaa

SEQ ID NO: 500584 - RNA, 19 nt, Homo sapiens
gaaggagucccagcuuuug

SEQ ID NO: 500585 - RNA, 19 nt, Homo sapiens
gaagaaggugcgggaguac

SEQ ID NO: 500586 - RNA, 19 nt, Homo sapiens
guaggucucuggguuucag

SEQ ID NO: 500587 - RNA, 19 nt, Homo sapiens
ggaacccugcuugucauug

SEQ ID NO: 500588 - RNA, 19 nt, Homo sapiens
ugaucaacuucauccacaa

SEQ ID NO: 500589 - RNA, 19 nt, Homo sapiens
gcgccagaucuaugacaaa

SEQ ID NO: 500590 - RNA, 19 nt, Homo sapiens
gaagauaagugauguguga

SEQ ID NO: 500591 - RNA, 19 nt, Homo sapiens
gaaauugucuaguaaguga

SEQ ID NO: 500592 - RNA, 19 nt, Homo sapiens
caccugaaguguuuaauua

SEQ ID NO: 500593 - RNA, 19 nt, Homo sapiens
gcagaaauaugaauagaag

SEQ ID NO: 500594 - RNA, 19 nt, Homo sapiens
ggaaagaaaucaaacaacu

SEQ ID NO: 500595 - RNA, 19 nt, Homo sapiens
gaagaaaguaaacugcuua

SEQ ID NO: 500596 - RNA, 19 nt, Homo sapiens
cacaauagaugaacuaguu

SEQ ID NO: 500597 - RNA, 19 nt, Homo sapiens
ggacacagacacuauaauu

SEQ ID NO: 500598 - RNA, 19 nt, Homo sapiens
caacaucuccaaagaagua

SEQ ID NO: 500599 - RNA, 19 nt, Homo sapiens
ggagaaccauuucauuuca

SEQ ID NO: 500600 - RNA, 19 nt, Homo sapiens
gaacccaucuuggauaaau

SEQ ID NO: 500601 - RNA, 19 nt, Homo sapiens
guacaaagucgcaaucaaa

SEQ ID NO: 500602 - RNA, 19 nt, Homo sapiens
uggaggagauucuuauuaa

SEQ ID NO: 500603 - RNA, 19 nt, Homo sapiens
caucaaauaugccugaaga

SEQ ID NO: 500604 - RNA, 19 nt, Homo sapiens
caaaguccaugcuaaccua

SEQ ID NO: 500605 - RNA, 19 nt, Homo sapiens
ggaagaaaguaaacugcuu

SEQ ID NO: 500606 - RNA, 19 nt, Homo sapiens
gcagaaaccaauauacauu

SEQ ID NO: 500607 - RNA, 19 nt, Homo sapiens
agaagaagcuaaagugaug

SEQ ID NO: 500608 - RNA, 19 nt, Homo sapiens
uaugagaaaugggagauua

SEQ ID NO: 500609 - RNA, 19 nt, Homo sapiens
gcaaauggcgagcccagua

SEQ ID NO: 500610 - RNA, 19 nt, Homo sapiens
guaauuacguaacgggaaa

SEQ ID NO: 500611 - RNA, 19 nt, Homo sapiens
ccuuauagcuguuaauuca

SEQ ID NO: 500612 - RNA, 19 nt, Homo sapiens
gaggaggacuuuauagaag

SEQ ID NO: 500613 - RNA, 19 nt, Homo sapiens
gagaagaaauacagaaagg

SEQ ID NO: 500614 - RNA, 19 nt, Homo sapiens
agacaucgcccuuaaacua

SEQ ID NO: 500615 - RNA, 19 nt, Homo sapiens
gccagaaauugucuaguaa

SEQ ID NO: 500616 - RNA, 19 nt, Homo sapiens
cgaaguuagugcagcuuua

SEQ ID NO: 500617 - RNA, 19 nt, Homo sapiens
gcuaacacacuuuacauuu

SEQ ID NO: 500618 - RNA, 19 nt, Homo sapiens
gaugaucaguacacaaguu

SEQ ID NO: 500619 - RNA, 19 nt, Homo sapiens
gagacaaggucauuucagu

SEQ ID NO: 500620 - RNA, 19 nt, Homo sapiens
ggagagcaagagauaaaua

SEQ ID NO: 500621 - RNA, 19 nt, Homo sapiens
ugccagaaauugucuagua

SEQ ID NO: 500622 - RNA, 19 nt, Homo sapiens
uggaguaucuggagagaaa

SEQ ID NO: 500623 - RNA, 19 nt, Homo sapiens
aagaagacaucgcccuuaa

SEQ ID NO: 500624 - RNA, 19 nt, Homo sapiens
caaauaugccugaagagaa

SEQ ID NO: 500625 - RNA, 19 nt, Homo sapiens
ccuuagaaauggugauuaa

SEQ ID NO: 500626 - RNA, 19 nt, Homo sapiens
gacuagagacugugccuua

SEQ ID NO: 500627 - RNA, 19 nt, Homo sapiens
uagaugaacuaguugaaug

SEQ ID NO: 500628 - RNA, 19 nt, Homo sapiens
aaucaaguguguggaaaua

SEQ ID NO: 500629 - RNA, 19 nt, Homo sapiens
gagaagaaagucuagauuc

SEQ ID NO: 500630 - RNA, 19 nt, Homo sapiens
gaagcuaaagugaugauga

SEQ ID NO: 500631 - RNA, 19 nt, Homo sapiens
gauuaacccuucagaacug

SEQ ID NO: 500632 - RNA, 19 nt, Homo sapiens
ccaagaguaucucauuuua

SEQ ID NO: 500633 - RNA, 19 nt, Homo sapiens
gaaaguaaacugcuuaucc

SEQ ID NO: 500634 - RNA, 19 nt, Homo sapiens
ggaggacuuuauagaagaa

SEQ ID NO: 500635 - RNA, 19 nt, Homo sapiens
caacaacaucuccaaagaa

SEQ ID NO: 500636 - RNA, 19 nt, Homo sapiens
gguaagggauuccagucaa

SEQ ID NO: 500637 - RNA, 19 nt, Homo sapiens
ggccaagaguaucucauuu

SEQ ID NO: 500638 - RNA, 19 nt, Homo sapiens
agaaggacaugaucucaga

SEQ ID NO: 500639 - RNA, 19 nt, Homo sapiens
gcauuuggccuauguaauc

SEQ ID NO: 500640 - RNA, 19 nt, Homo sapiens
ggaguucaccuucuuagga

SEQ ID NO: 500641 - RNA, 19 nt, Homo sapiens
ggaaauguugccuuagaaa

SEQ ID NO: 500642 - RNA, 19 nt, Homo sapiens
acaacaacaucuccaaaga

SEQ ID NO: 500643 - RNA, 19 nt, Homo sapiens
uaagacaucaacggaauua

SEQ ID NO: 500644 - RNA, 19 nt, Homo sapiens
guggaaauguugccuuaga

SEQ ID NO: 500645 - RNA, 19 nt, Homo sapiens
guguggaaauguugccuua

SEQ ID NO: 500646 - RNA, 19 nt, Homo sapiens
gaaggugguuuuaugguaa

SEQ ID NO: 500647 - RNA, 19 nt, Homo sapiens
agacggagaugaauuuuaa

SEQ ID NO: 500648 - RNA, 19 nt, Homo sapiens
guacacagucucccuuuau

SEQ ID NO: 500649 - RNA, 19 nt, Homo sapiens
ugaaugguauugcagaaau

SEQ ID NO: 500650 - RNA, 19 nt, Homo sapiens
gaaauguugccuuagaaau

SEQ ID NO: 500651 - RNA, 19 nt, Homo sapiens
ggugcuaaguuuccuguga

SEQ ID NO: 500652 - RNA, 19 nt, Homo sapiens
gugaagggauggaguaucu

SEQ ID NO: 500653 - RNA, 19 nt, Homo sapiens
gaaguuaucaguguuguag

SEQ ID NO: 500654 - RNA, 19 nt, Homo sapiens
gaagacaucgcccuuaaac

SEQ ID NO: 500655 - RNA, 19 nt, Homo sapiens
ugaacuaguugaaugugaa

SEQ ID NO: 500656 - RNA, 19 nt, Homo sapiens
aagcuaaagugaugaugaa

SEQ ID NO: 500657 - RNA, 19 nt, Homo sapiens
uacacagucucccuuuaua

SEQ ID NO: 500658 - RNA, 19 nt, Homo sapiens
gauggaaguuaucaguguu

SEQ ID NO: 500659 - RNA, 19 nt, Homo sapiens
gaaagggguuuauugaugu

SEQ ID NO: 500660 - RNA, 19 nt, Homo sapiens
gaagaucugcugcgcacaa

SEQ ID NO: 500661 - RNA, 19 nt, Homo sapiens
ggauucagcuaugagaaau

SEQ ID NO: 500662 - RNA, 19 nt, Homo sapiens
gaaacaacaacaucuccaa

SEQ ID NO: 500663 - RNA, 19 nt, Homo sapiens
gagagcaagagauaaauau

SEQ ID NO: 500664 - RNA, 19 nt, Homo sapiens
gaagaagaagauaauagug

SEQ ID NO: 500665 - RNA, 19 nt, Homo sapiens
cauuucagguuguucauga

SEQ ID NO: 500666 - RNA, 19 nt, Homo sapiens
ugaagaaacuuuuggaaga

SEQ ID NO: 500667 - RNA, 19 nt, Homo sapiens
guacccaguuagugugaaa

SEQ ID NO: 500668 - RNA, 19 nt, Homo sapiens
gaaauagugaagaaugaug

SEQ ID NO: 500669 - RNA, 19 nt, Homo sapiens
uggaaauagugaagaauga

SEQ ID NO: 500670 - RNA, 19 nt, Homo sapiens
gcagagaagaaauacagaa

SEQ ID NO: 500671 - RNA, 19 nt, Homo sapiens
ccaggaagcuacggagaga

SEQ ID NO: 500672 - RNA, 19 nt, Homo sapiens
gaccuucgcaacaaaguuu

SEQ ID NO: 500673 - RNA, 19 nt, Homo sapiens
gugcuaaguuuccugugaa

SEQ ID NO: 500674 - RNA, 19 nt, Homo sapiens
agaagacggagaugaauuu

SEQ ID NO: 500675 - RNA, 19 nt, Homo sapiens
gagauuaacccuucagaac

SEQ ID NO: 500676 - RNA, 19 nt, Homo sapiens
gcacaaugcagcaggacuu

SEQ ID NO: 500677 - RNA, 19 nt, Homo sapiens
aaauaugccugaagagaag

SEQ ID NO: 500678 - RNA, 19 nt, Homo sapiens
acaauuggguucuagauac

SEQ ID NO: 500679 - RNA, 19 nt, Homo sapiens
gaaguuagugcagcuuuau

SEQ ID NO: 500680 - RNA, 19 nt, Homo sapiens
cgaggaggacuuuauagaa

SEQ ID NO: 500681 - RNA, 19 nt, Homo sapiens
ggaugccuguccagcuuaa

SEQ ID NO: 500682 - RNA, 19 nt, Homo sapiens
uauaggaguucaccuucuu

SEQ ID NO: 500683 - RNA, 19 nt, Homo sapiens
cagaaauugucuaguaagu

SEQ ID NO: 500684 - RNA, 19 nt, Homo sapiens
caucuccaaagaaguauua

SEQ ID NO: 500685 - RNA, 19 nt, Homo sapiens
ggccgcagcuaaucagaau

SEQ ID NO: 500686 - RNA, 19 nt, Homo sapiens
caaggaaggaugggcauuu

SEQ ID NO: 500687 - RNA, 19 nt, Homo sapiens
cgacagagacaaggucauu

SEQ ID NO: 500688 - RNA, 19 nt, Homo sapiens
gcaggaggaguaaucagaa

SEQ ID NO: 500689 - RNA, 19 nt, Homo sapiens
gagcagagaagaaauacag

SEQ ID NO: 500690 - RNA, 19 nt, Homo sapiens
ggaaauaacucacaugaca

SEQ ID NO: 500691 - RNA, 19 nt, Homo sapiens
gcacgcauaucauguauaa

SEQ ID NO: 500692 - RNA, 19 nt, Homo sapiens
caagauggcucucuacaaa

SEQ ID NO: 500693 - RNA, 19 nt, Homo sapiens
ggagagagcuggcgugugu

SEQ ID NO: 500694 - RNA, 19 nt, Homo sapiens
guggaaaccucaccaauuu

SEQ ID NO: 500695 - RNA, 19 nt, Homo sapiens
gaaaaguacuccuguaaaa

SEQ ID NO: 500696 - RNA, 19 nt, Homo sapiens
gcccagacauccagauaua

SEQ ID NO: 500697 - RNA, 19 nt, Homo sapiens
caacaacacuggcaacauc

SEQ ID NO: 500698 - RNA, 19 nt, Homo sapiens
ucacuggccuuguggguua

SEQ ID NO: 500699 - RNA, 19 nt, Homo sapiens
uauaagaacugccuguuug

SEQ ID NO: 500700 - RNA, 19 nt, Homo sapiens
gucagaaccucaaagauaa

SEQ ID NO: 500701 - RNA, 19 nt, Homo sapiens
gggcagagcugggugaaga

SEQ ID NO: 500702 - RNA, 19 nt, Homo sapiens
ccaaggacaucaggaagua

SEQ ID NO: 500703 - RNA, 19 nt, Homo sapiens
guaauuaaccugacaguuc

SEQ ID NO: 500704 - RNA, 19 nt, Homo sapiens
gcaaugauaagcuccgaua

SEQ ID NO: 500705 - RNA, 19 nt, Homo sapiens
gcgagaggcugcagaacaa

SEQ ID NO: 500706 - RNA, 19 nt, Homo sapiens
caaagcagcccaaauggaa

SEQ ID NO: 500707 - RNA, 19 nt, Homo sapiens
gcaagcgccugcaagaaug

SEQ ID NO: 500708 - RNA, 19 nt, Homo sapiens
gcuccgauauuucaucauu

SEQ ID NO: 500709 - RNA, 19 nt, Homo sapiens
gauaagcuccgauauuuca

SEQ ID NO: 500710 - RNA, 19 nt, Homo sapiens
cauucacccucuucaauua

SEQ ID NO: 500711 - RNA, 19 nt, Homo sapiens
ugucagaaccucaaagaua

SEQ ID NO: 500712 - RNA, 19 nt, Homo sapiens
gcaacgagcugcaguucuc

SEQ ID NO: 500713 - RNA, 19 nt, Homo sapiens
gaacgccacugccuacuac

SEQ ID NO: 500714 - RNA, 19 nt, Homo sapiens
uaaaguugauggaaaggaa

SEQ ID NO: 500715 - RNA, 19 nt, Homo sapiens
ggaggaagguggccuguac

SEQ ID NO: 500716 - RNA, 19 nt, Homo sapiens
gcacaugcgugguguuugg

SEQ ID NO: 500717 - RNA, 19 nt, Homo sapiens
ucaaagacauggcaaccuu

SEQ ID NO: 500718 - RNA, 19 nt, Homo sapiens
ccaaagaacagaucauuuc

SEQ ID NO: 500719 - RNA, 19 nt, Homo sapiens
gagcugacgccacacauuu

SEQ ID NO: 500720 - RNA, 19 nt, Homo sapiens
ggaccuaacagaugauuau

SEQ ID NO: 500721 - RNA, 19 nt, Homo sapiens
gucccaggcuccuauauaa

SEQ ID NO: 500722 - RNA, 19 nt, Homo sapiens
gggcagaugugcacaaugg

SEQ ID NO: 500723 - RNA, 19 nt, Homo sapiens
ccucaaagauaacaccauu

SEQ ID NO: 500724 - RNA, 19 nt, Homo sapiens
ggaacacggucaaggugaa

SEQ ID NO: 500725 - RNA, 19 nt, Homo sapiens
gccugaagguuguauauga

SEQ ID NO: 500726 - RNA, 19 nt, Homo sapiens
ggauugagaaggagaauug

SEQ ID NO: 500727 - RNA, 19 nt, Homo sapiens
gaguguggcugcaacuuug

SEQ ID NO: 500728 - RNA, 19 nt, Homo sapiens
ggacaacuuucgaggagau

SEQ ID NO: 500729 - RNA, 19 nt, Homo sapiens
caaguugaauggucaggaa

SEQ ID NO: 500730 - RNA, 19 nt, Homo sapiens
gcucaggagugguugaaga

SEQ ID NO: 500731 - RNA, 19 nt, Homo sapiens
gaaaucgacaucaacaaga

SEQ ID NO: 500732 - RNA, 19 nt, Homo sapiens
gaagagucaagguuaauga

SEQ ID NO: 500733 - RNA, 19 nt, Homo sapiens
caaaggaagcuauggaaga

SEQ ID NO: 500734 - RNA, 19 nt, Homo sapiens
gaauuugggucucuuucau

SEQ ID NO: 500735 - RNA, 19 nt, Homo sapiens
augauaagcuccgauauuu

SEQ ID NO: 500736 - RNA, 19 nt, Homo sapiens
uaacucacaugacauuauc

SEQ ID NO: 500737 - RNA, 19 nt, Homo sapiens
gacaucuccuuccagcuua

SEQ ID NO: 500738 - RNA, 19 nt, Homo sapiens
gggcaagggaagauaaaua

SEQ ID NO: 500739 - RNA, 19 nt, Homo sapiens
gccacuaccucaccuuuga

SEQ ID NO: 500740 - RNA, 19 nt, Homo sapiens
gaucugcaauggagagugu

SEQ ID NO: 500741 - RNA, 19 nt, Homo sapiens
gcacaggcaggauuuaaug

SEQ ID NO: 500742 - RNA, 19 nt, Homo sapiens
ggaguuguuuccuucaaug

SEQ ID NO: 500743 - RNA, 19 nt, Homo sapiens
cuuaugagcuggauaucaa

SEQ ID NO: 500744 - RNA, 19 nt, Homo sapiens
cuacuccgauggcaaauau

SEQ ID NO: 500745 - RNA, 19 nt, Homo sapiens
cuggaaagcuggacaacuu

SEQ ID NO: 500746 - RNA, 19 nt, Homo sapiens
gggaggaagucacguuuua

SEQ ID NO: 500747 - RNA, 19 nt, Homo sapiens
ucaccaagauggcucucua

SEQ ID NO: 500748 - RNA, 19 nt, Homo sapiens
gugacuggcuggaggaauu

SEQ ID NO: 500749 - RNA, 19 nt, Homo sapiens
gugccaagguggaagguuu

SEQ ID NO: 500750 - RNA, 19 nt, Homo sapiens
uuaaugaccuagugacuuc

SEQ ID NO: 500751 - RNA, 19 nt, Homo sapiens
gaaacauugugcaguccaa

SEQ ID NO: 500752 - RNA, 19 nt, Homo sapiens
ccuaacagaugauuaugug

SEQ ID NO: 500753 - RNA, 19 nt, Homo sapiens
gaagagcagauucucauca

SEQ ID NO: 500754 - RNA, 19 nt, Homo sapiens
cggggaagcuggaaauuua

SEQ ID NO: 500755 - RNA, 19 nt, Homo sapiens
ccagggagcucauguaucc

SEQ ID NO: 500756 - RNA, 19 nt, Homo sapiens
ggaaaucgacaucaacaag

SEQ ID NO: 500757 - RNA, 19 nt, Homo sapiens
gcaaagcagcccaaaugga

SEQ ID NO: 500758 - RNA, 19 nt, Homo sapiens
gaggagugcaucacaugua

SEQ ID NO: 500759 - RNA, 19 nt, Homo sapiens
ggacuggugugaggacaau

SEQ ID NO: 500760 - RNA, 19 nt, Homo sapiens
ucacgucaccgucuuuaaa

SEQ ID NO: 500761 - RNA, 19 nt, Homo sapiens
caaagggaauuguggaaac

SEQ ID NO: 500762 - RNA, 19 nt, Homo sapiens
gugaauggcacacaaguga

SEQ ID NO: 500763 - RNA, 19 nt, Homo sapiens
caaggugaauggcacacaa

SEQ ID NO: 500764 - RNA, 19 nt, Homo sapiens
ggaggugaauggcuacaag

SEQ ID NO: 500765 - RNA, 19 nt, Homo sapiens
aagaacagaucauuucagu

SEQ ID NO: 500766 - RNA, 19 nt, Homo sapiens
caucgagugucaaugaguu

SEQ ID NO: 500767 - RNA, 19 nt, Homo sapiens
gcaccaacuugccaccaau

SEQ ID NO: 500768 - RNA, 19 nt, Homo sapiens
aaaucgacaucaacaagaa

SEQ ID NO: 500769 - RNA, 19 nt, Homo sapiens
caaaagagcccaaagaaca

SEQ ID NO: 500770 - RNA, 19 nt, Homo sapiens
gagcugcaguucucacagu

SEQ ID NO: 500771 - RNA, 19 nt, Homo sapiens
gcacugucuaugucaauaa

SEQ ID NO: 500772 - RNA, 19 nt, Homo sapiens
gcaccaagaccuccuacug

SEQ ID NO: 500773 - RNA, 19 nt, Homo sapiens
caacuugccaccaaugaga

SEQ ID NO: 500774 - RNA, 19 nt, Homo sapiens
caacgccagugacgaguuc

SEQ ID NO: 500775 - RNA, 19 nt, Homo sapiens
ccucuucaauuauuacgaa

SEQ ID NO: 500776 - RNA, 19 nt, Homo sapiens
cacgaucaauguggaauuu

SEQ ID NO: 500777 - RNA, 19 nt, Homo sapiens
caacaacaccaaagggaau

SEQ ID NO: 500778 - RNA, 19 nt, Homo sapiens
ggcaagggaagauaaauau

SEQ ID NO: 500779 - RNA, 19 nt, Homo sapiens
gcugaaggccugcaacaau

SEQ ID NO: 500780 - RNA, 19 nt, Homo sapiens
gugcgacgcugccacugaa

SEQ ID NO: 500781 - RNA, 19 nt, Homo sapiens
uauggaagagucaagguua

SEQ ID NO: 500782 - RNA, 19 nt, Homo sapiens
ucacccucuucaauuauua

SEQ ID NO: 500783 - RNA, 19 nt, Homo sapiens
cgacaucuccuuccagcuu

SEQ ID NO: 500784 - RNA, 19 nt, Homo sapiens
cagaccagcugcccacuca

SEQ ID NO: 500785 - RNA, 19 nt, Homo sapiens
gcaaggaugaugaguacug

SEQ ID NO: 500786 - RNA, 19 nt, Homo sapiens
ccagagaacagccacuuug

SEQ ID NO: 500787 - RNA, 19 nt, Homo sapiens
ggccaugucuguccuggau

SEQ ID NO: 500788 - RNA, 19 nt, Homo sapiens
gauccagauuucauuaugg

SEQ ID NO: 500789 - RNA, 19 nt, Homo sapiens
ccgaguggauugagaagga

SEQ ID NO: 500790 - RNA, 19 nt, Homo sapiens
ugaagaagcugauggagaa

SEQ ID NO: 500791 - RNA, 19 nt, Homo sapiens
ggacaagacgcaagaagaa

SEQ ID NO: 500792 - RNA, 19 nt, Homo sapiens
ccaaguaugagaccaaaua

SEQ ID NO: 500793 - RNA, 19 nt, Homo sapiens
gcaaggaggugggcaagug

SEQ ID NO: 500794 - RNA, 19 nt, Homo sapiens
ggacaagaccaucccauau

SEQ ID NO: 500795 - RNA, 19 nt, Homo sapiens
gcaagaccaucguguccaa

SEQ ID NO: 500796 - RNA, 19 nt, Homo sapiens
gaacaacguggcagcuaaa

SEQ ID NO: 500797 - RNA, 19 nt, Homo sapiens
acaagaccaucccauauga

SEQ ID NO: 500798 - RNA, 19 nt, Homo sapiens
agaacaacguggcagcuaa

SEQ ID NO: 500799 - RNA, 19 nt, Homo sapiens
gacaagaccaucccauaug

SEQ ID NO: 500800 - RNA, 19 nt, Homo sapiens
cauaugauggcgaaucuuu

SEQ ID NO: 500801 - RNA, 19 nt, Homo sapiens
acauggaccuggaugaguu

SEQ ID NO: 500802 - RNA, 19 nt, Homo sapiens
gggcagccuuccuggagaa

SEQ ID NO: 500803 - RNA, 19 nt, Homo sapiens
gcagaaggaugaaaaguac

SEQ ID NO: 500804 - RNA, 19 nt, Homo sapiens
gaaaaguacuggacaagac

SEQ ID NO: 500805 - RNA, 19 nt, Homo sapiens
agaccaucguguccaagua

SEQ ID NO: 500806 - RNA, 19 nt, Homo sapiens
gaccaucguguccaaguau

SEQ ID NO: 500807 - RNA, 19 nt, Homo sapiens
ccgacgagcagaaggauga

SEQ ID NO: 500808 - RNA, 19 nt, Homo sapiens
gaugaaaaguacuggacaa

SEQ ID NO: 500809 - RNA, 19 nt, Homo sapiens
guccaaguaugagaccaaa

SEQ ID NO: 500810 - RNA, 19 nt, Homo sapiens
gaggugggcaagugcaaga

SEQ ID NO: 500811 - RNA, 19 nt, Homo sapiens
caagacgcaagaagaacaa

SEQ ID NO: 500812 - RNA, 19 nt, Homo sapiens
guguggaaguggaugugaa

SEQ ID NO: 500813 - RNA, 19 nt, Homo sapiens
cuccuccacugccaucuuu

SEQ ID NO: 500814 - RNA, 19 nt, Homo sapiens
cagaaucuucccuggagaa

SEQ ID NO: 500815 - RNA, 19 nt, Homo sapiens
ugucucagccucccucaug

SEQ ID NO: 500816 - RNA, 19 nt, Homo sapiens
guacauggaccuggaugag

SEQ ID NO: 500817 - RNA, 19 nt, Homo sapiens
ugaaagagaaucagaucac

SEQ ID NO: 500818 - RNA, 19 nt, Homo sapiens
uggacaagacgcaagaaga

SEQ ID NO: 500819 - RNA, 19 nt, Homo sapiens
acaagacgcaagaagaaca

SEQ ID NO: 500820 - RNA, 19 nt, Homo sapiens
cuacagagcuucaguguga

SEQ ID NO: 500821 - RNA, 19 nt, Homo sapiens
gaacauauuugaucgaaag

SEQ ID NO: 500822 - RNA, 19 nt, Homo sapiens
gagcaaaccuagauaagga

SEQ ID NO: 500823 - RNA, 19 nt, Homo sapiens
aaacacaccuuucugcuuu

SEQ ID NO: 500824 - RNA, 19 nt, Homo sapiens
gcauugaucucuucuuaga

SEQ ID NO: 500825 - RNA, 19 nt, Homo sapiens
gcgaggcugugauaacuua

SEQ ID NO: 500826 - RNA, 19 nt, Homo sapiens
gcccugagcuuguugcuuu

SEQ ID NO: 500827 - RNA, 19 nt, Homo sapiens
gaauauaguuuggaguuug

SEQ ID NO: 500828 - RNA, 19 nt, Homo sapiens
ccaugaaacugaacagaaa

SEQ ID NO: 500829 - RNA, 19 nt, Homo sapiens
gcacuuccuuccuguuaaa

SEQ ID NO: 500830 - RNA, 19 nt, Homo sapiens
gaaguucaguggucccauu

SEQ ID NO: 500831 - RNA, 19 nt, Homo sapiens
gaacauggagaucaagauu

SEQ ID NO: 500832 - RNA, 19 nt, Homo sapiens
gaaaugaagugaccaucca

SEQ ID NO: 500833 - RNA, 19 nt, Homo sapiens
gaagaaagagaagaaauga

SEQ ID NO: 500834 - RNA, 19 nt, Homo sapiens
ccucaaaucucaacuguca

SEQ ID NO: 500835 - RNA, 19 nt, Homo sapiens
ggaggcagcaauccuaaua

SEQ ID NO: 500836 - RNA, 19 nt, Homo sapiens
gaaacagugccaagaauga

SEQ ID NO: 500837 - RNA, 19 nt, Homo sapiens
ccuguuaacucuccauaaa

SEQ ID NO: 500838 - RNA, 19 nt, Homo sapiens
ggccuaagauuuugaguua

SEQ ID NO: 500839 - RNA, 19 nt, Homo sapiens
ggugguguguucugugaua

SEQ ID NO: 500840 - RNA, 19 nt, Homo sapiens
cugcauugaucucuucuua

SEQ ID NO: 500841 - RNA, 19 nt, Homo sapiens
gcacugcauugaucucuuc

SEQ ID NO: 500842 - RNA, 19 nt, Homo sapiens
gaugcuguccucugauuua

SEQ ID NO: 500843 - RNA, 19 nt, Homo sapiens
gauuaaaugucccaagcaa

SEQ ID NO: 500844 - RNA, 19 nt, Homo sapiens
gauuauguguaucaaggua

SEQ ID NO: 500845 - RNA, 19 nt, Homo sapiens
gaaagcucauuaccaguag

SEQ ID NO: 500846 - RNA, 19 nt, Homo sapiens
ugaaagcucauuaccagua

SEQ ID NO: 500847 - RNA, 19 nt, Homo sapiens
uauggucacucauuucauu

SEQ ID NO: 500848 - RNA, 19 nt, Homo sapiens
acauggagaucaagauuau

SEQ ID NO: 500849 - RNA, 19 nt, Homo sapiens
ccaagcaguuccucauuca

SEQ ID NO: 500850 - RNA, 19 nt, Homo sapiens
gaaccaugaacauauuuga

SEQ ID NO: 500851 - RNA, 19 nt, Homo sapiens
gauacucaacucauuauug

SEQ ID NO: 500852 - RNA, 19 nt, Homo sapiens
ccagaaauuuguggccuuu

SEQ ID NO: 500853 - RNA, 19 nt, Homo sapiens
gaagaaggucuaugcaagu

SEQ ID NO: 500854 - RNA, 19 nt, Homo sapiens
ggaccugaacuguuuggua

SEQ ID NO: 500855 - RNA, 19 nt, Homo sapiens
cauccagccuuucccaauu

SEQ ID NO: 500856 - RNA, 19 nt, Homo sapiens
gaaggucuaugcaaguuuu

SEQ ID NO: 500857 - RNA, 19 nt, Homo sapiens
ucccugauauugaugauuu

SEQ ID NO: 500858 - RNA, 19 nt, Homo sapiens
ugccaagaaugacaagaua

SEQ ID NO: 500859 - RNA, 19 nt, Homo sapiens
cuagguggcugugauuaaa

SEQ ID NO: 500860 - RNA, 19 nt, Homo sapiens
gagcgaggcugugauaacu

SEQ ID NO: 500861 - RNA, 19 nt, Homo sapiens
gaggaucgagccauugaaa

SEQ ID NO: 500862 - RNA, 19 nt, Homo sapiens
ggcaguagauaaauguuca

SEQ ID NO: 500863 - RNA, 19 nt, Homo sapiens
uagaaacagugccaagaau

SEQ ID NO: 500864 - RNA, 19 nt, Homo sapiens
gaguuaacaucucuugaag

SEQ ID NO: 500865 - RNA, 19 nt, Homo sapiens
gagaggaucgagccauuga

SEQ ID NO: 500866 - RNA, 19 nt, Homo sapiens
gugagaggaucgagccauu

SEQ ID NO: 500867 - RNA, 19 nt, Homo sapiens
cacaaccagugcacaguuu

SEQ ID NO: 500868 - RNA, 19 nt, Homo sapiens
ucauuacugucuucagaaa

SEQ ID NO: 500869 - RNA, 19 nt, Homo sapiens
caacuuugaugcgcuuuua

SEQ ID NO: 500870 - RNA, 19 nt, Homo sapiens
ugaaaaggcugauuaugug

SEQ ID NO: 500871 - RNA, 19 nt, Homo sapiens
guucaguggucccauuguu

SEQ ID NO: 500872 - RNA, 19 nt, Homo sapiens
cagaauauaguuuggaguu

SEQ ID NO: 500873 - RNA, 19 nt, Homo sapiens
cauuacaggugguguguuc

SEQ ID NO: 500874 - RNA, 19 nt, Homo sapiens
cuugagaacuuacuaaagg

SEQ ID NO: 500875 - RNA, 19 nt, Homo sapiens
caacgcagcagcaccugaa

SEQ ID NO: 500876 - RNA, 19 nt, Homo sapiens
ugaguuaacaucucuugaa

SEQ ID NO: 500877 - RNA, 19 nt, Homo sapiens
ccauaaauuuggugauucu

SEQ ID NO: 500878 - RNA, 19 nt, Homo sapiens
ucaguggucccauuguuaa

SEQ ID NO: 500879 - RNA, 19 nt, Homo sapiens
caggugguguguucuguga

SEQ ID NO: 500880 - RNA, 19 nt, Homo sapiens
ggccgaacauggagaucaa

SEQ ID NO: 500881 - RNA, 19 nt, Homo sapiens
aaaggcugauuauguguau

SEQ ID NO: 500882 - RNA, 19 nt, Homo sapiens
caaacacaccuuucugcuu

SEQ ID NO: 500883 - RNA, 19 nt, Homo sapiens
gccuugggcucccugauau

SEQ ID NO: 500884 - RNA, 19 nt, Homo sapiens
ucacugugcuauccuacga

SEQ ID NO: 500885 - RNA, 19 nt, Homo sapiens
agaaauuuguggccuuuua

SEQ ID NO: 500886 - RNA, 19 nt, Homo sapiens
uaacuuaggaggcagcaau

SEQ ID NO: 500887 - RNA, 19 nt, Homo sapiens
gcacaaaggaaagacuaau

SEQ ID NO: 500888 - RNA, 19 nt, Homo sapiens
ggagucagccugcuuccau

SEQ ID NO: 500889 - RNA, 19 nt, Homo sapiens
ggaguuuggcuucaucuuc

SEQ ID NO: 500890 - RNA, 19 nt, Homo sapiens
gaaagagaagaaaugaagu

SEQ ID NO: 500891 - RNA, 19 nt, Homo sapiens
agaaagagaagaaaugaag

SEQ ID NO: 500892 - RNA, 19 nt, Homo sapiens
aagaaggucuaugcaaguu

SEQ ID NO: 500893 - RNA, 19 nt, Homo sapiens
gucaggcccuacaaagaaa

SEQ ID NO: 500894 - RNA, 19 nt, Homo sapiens
uaacucagccucaaaucuc

SEQ ID NO: 500895 - RNA, 19 nt, Homo sapiens
gaagaaaugaagugaccau

SEQ ID NO: 500896 - RNA, 19 nt, Homo sapiens
agaagaaagagaagaaaug

SEQ ID NO: 500897 - RNA, 19 nt, Homo sapiens
ggcacuuccuuccuguuaa

SEQ ID NO: 500898 - RNA, 19 nt, Homo sapiens
ccucuggcuugagaacuua

SEQ ID NO: 500899 - RNA, 19 nt, Homo sapiens
gguguguucugugauaaug

SEQ ID NO: 500900 - RNA, 19 nt, Homo sapiens
ggauuugcauuccuuacag

SEQ ID NO: 500901 - RNA, 19 nt, Homo sapiens
gacaguggccucagguuca

SEQ ID NO: 500902 - RNA, 19 nt, Homo sapiens
acaaaggaaagacuaauuc

SEQ ID NO: 500903 - RNA, 19 nt, Homo sapiens
ugucaggcccuacaaagaa

SEQ ID NO: 500904 - RNA, 19 nt, Homo sapiens
gccaugaaacugaacagaa

SEQ ID NO: 500905 - RNA, 19 nt, Homo sapiens
cuggaaccaugaacauauu

SEQ ID NO: 500906 - RNA, 19 nt, Homo sapiens
uccauauggucacucauuu

SEQ ID NO: 500907 - RNA, 19 nt, Homo sapiens
gggacugggccgugaguuu

SEQ ID NO: 500908 - RNA, 19 nt, Homo sapiens
gauaagaagaaagagaaga

SEQ ID NO: 500909 - RNA, 19 nt, Homo sapiens
uuucauuacugucuucaga

SEQ ID NO: 500910 - RNA, 19 nt, Homo sapiens
cuccauaaauuuggugauu

SEQ ID NO: 500911 - RNA, 19 nt, Homo sapiens
gcuauccuacgaaaucauu

SEQ ID NO: 500912 - RNA, 19 nt, Homo sapiens
cacaaaggaaagacuaauu

SEQ ID NO: 500913 - RNA, 19 nt, Homo sapiens
auccagccuuucccaauua

SEQ ID NO: 500914 - RNA, 19 nt, Homo sapiens
uaauaguccuucagugcau

SEQ ID NO: 500915 - RNA, 19 nt, Homo sapiens
gggacuucuugcuggauuu

SEQ ID NO: 500916 - RNA, 19 nt, Homo sapiens
ggaaccaugaacauauuug

SEQ ID NO: 500917 - RNA, 19 nt, Homo sapiens
cgccguagcuaccucuuuc

SEQ ID NO: 500918 - RNA, 19 nt, Homo sapiens
uuagaaacagugccaagaa

SEQ ID NO: 500919 - RNA, 19 nt, Homo sapiens
uuacugaugcacuuuaguu

SEQ ID NO: 500920 - RNA, 19 nt, Homo sapiens
gaaagaauaugccuccaaa

SEQ ID NO: 500921 - RNA, 19 nt, Homo sapiens
guacauaugugcuggaauu

SEQ ID NO: 500922 - RNA, 19 nt, Homo sapiens
ggaaugacaucaaauuuca

SEQ ID NO: 500923 - RNA, 19 nt, Homo sapiens
gaaaagcccuucaacauuu

SEQ ID NO: 500924 - RNA, 19 nt, Homo sapiens
gaaacuggauggagagauu

SEQ ID NO: 500925 - RNA, 19 nt, Homo sapiens
ggacagugcuccauccaaa

SEQ ID NO: 500926 - RNA, 19 nt, Homo sapiens
gaauaugccuccaaagaug

SEQ ID NO: 500927 - RNA, 19 nt, Homo sapiens
ugaaguaccugauauucua

SEQ ID NO: 500928 - RNA, 19 nt, Homo sapiens
cgaaagaccuacgugaaua

SEQ ID NO: 500929 - RNA, 19 nt, Homo sapiens
gaauuaauaucccuacaug

SEQ ID NO: 500930 - RNA, 19 nt, Homo sapiens
gaagaugacuuuuauguug

SEQ ID NO: 500931 - RNA, 19 nt, Homo sapiens
ucaacaagcuuccuuccua

SEQ ID NO: 500932 - RNA, 19 nt, Homo sapiens
gcacguugaugugaagaua

SEQ ID NO: 500933 - RNA, 19 nt, Homo sapiens
agaagaagaugcagugauu

SEQ ID NO: 500934 - RNA, 19 nt, Homo sapiens
ggagauaacgugaacauau

SEQ ID NO: 500935 - RNA, 19 nt, Homo sapiens
caaaugagauuguuacacu

SEQ ID NO: 500936 - RNA, 19 nt, Homo sapiens
uggcagaacuuguaaagaa

SEQ ID NO: 500937 - RNA, 19 nt, Homo sapiens
gugcagaacucuacgagaa

SEQ ID NO: 500938 - RNA, 19 nt, Homo sapiens
caacccagauccuacaauu

SEQ ID NO: 500939 - RNA, 19 nt, Homo sapiens
gaucaauggugcuuauuuc

SEQ ID NO: 500940 - RNA, 19 nt, Homo sapiens
ggaauucuaacaagucaua

SEQ ID NO: 500941 - RNA, 19 nt, Homo sapiens
ugacuucggugcuacuuaa

SEQ ID NO: 500942 - RNA, 19 nt, Homo sapiens
gagagaaggucugugcaaa

SEQ ID NO: 500943 - RNA, 19 nt, Homo sapiens
ggaaguuacucaagaugug

SEQ ID NO: 500944 - RNA, 19 nt, Homo sapiens
caacuugacuucggugcua

SEQ ID NO: 500945 - RNA, 19 nt, Homo sapiens
gaguuuaccuuguauacug

SEQ ID NO: 500946 - RNA, 19 nt, Homo sapiens
cauaugugcuggaauucua

SEQ ID NO: 500947 - RNA, 19 nt, Homo sapiens
ugacuggaaugacaucaaa

SEQ ID NO: 500948 - RNA, 19 nt, Homo sapiens
ucagaccacucuaaauuug

SEQ ID NO: 500949 - RNA, 19 nt, Homo sapiens
ugagaaggcuugugaacug

SEQ ID NO: 500950 - RNA, 19 nt, Homo sapiens
gccaaaggaugugauauau

SEQ ID NO: 500951 - RNA, 19 nt, Homo sapiens
caucaucaaucucuuagga

SEQ ID NO: 500952 - RNA, 19 nt, Homo sapiens
gaaguaaacagugguaaau

SEQ ID NO: 500953 - RNA, 19 nt, Homo sapiens
guugugaguuuaccuugua
